United States Patent 7,777,022 (BIOINFORMATICALLY DETECTABLE GROUP OF NOVEL REGULATORY VIRAL AND VIRAL ASSOCIATED OLIGONUCLEOTIDES AND USES THEREOF) - sequence listing, part 88

SEQ ID NO: 4008555 - RNA, 15 nt, Human metapneumovirus
cuuuggacuuaauga

SEQ ID NO: 4008556 - RNA, 21 nt, Human metapneumovirus
gaaagugaaguaacagcaauu

SEQ ID NO: 4008557 - RNA, 16 nt, Human metapneumovirus
gaaaucauuaagaaaa

SEQ ID NO: 4008558 - RNA, 17 nt, Human metapneumovirus
gaacuagccagagcugu

SEQ ID NO: 4008559 - RNA, 16 nt, Human metapneumovirus
gaagaugaaagcacaa

SEQ ID NO: 4008560 - RNA, 21 nt, Human metapneumovirus
gaagcugcuauaagcagugaa

SEQ ID NO: 4008561 - RNA, 16 nt, Human metapneumovirus
gacaaauaaaacugau

SEQ ID NO: 4008562 - RNA, 16 nt, Human metapneumovirus
gacacagcagcaggaa

SEQ ID NO: 4008563 - RNA, 20 nt, Human metapneumovirus
gaccaagcucuaacacaggc

SEQ ID NO: 4008564 - RNA, 19 nt, Human metapneumovirus
gagaaaggaaacacuggcu

SEQ ID NO: 4008565 - RNA, 20 nt, Human metapneumovirus
gagagcuugacagaacuaag

SEQ ID NO: 4008566 - RNA, 19 nt, Human metapneumovirus
gaggaaaugagucaacgau

SEQ ID NO: 4008567 - RNA, 15 nt, Human metapneumovirus
gaucaaucaaacaga

SEQ ID NO: 4008568 - RNA, 15 nt, Human metapneumovirus
gaucuaauagaaaag

SEQ ID NO: 4008569 - RNA, 22 nt, Human metapneumovirus
gauuuuauggaucuagaaaaga

SEQ ID NO: 4008570 - RNA, 17 nt, Human metapneumovirus
gcaacauaaacauaucu

SEQ ID NO: 4008571 - RNA, 13 nt, Human metapneumovirus
gcaagcaaucaaa

SEQ ID NO: 4008572 - RNA, 20 nt, Human metapneumovirus
gcaaugguaagaagaaaagg

SEQ ID NO: 4008573 - RNA, 13 nt, Human metapneumovirus
gcacuaagagagc

SEQ ID NO: 4008574 - RNA, 21 nt, Human metapneumovirus
gcacuaaucaagugcagugag

SEQ ID NO: 4008575 - RNA, 18 nt, Human metapneumovirus
gcagacauaauaaaggaa

SEQ ID NO: 4008576 - RNA, 19 nt, Human metapneumovirus
gccaacacaucaacaacau

SEQ ID NO: 4008577 - RNA, 14 nt, Human metapneumovirus
gcgcaagcagaaca

SEQ ID NO: 4008578 - RNA, 16 nt, Human metapneumovirus
gcucagccaaaucagu

SEQ ID NO: 4008579 - RNA, 17 nt, Human metapneumovirus
gcucagccaaaucaguu

SEQ ID NO: 4008580 - RNA, 19 nt, Human metapneumovirus
gcugaaagcauaagcaaaa

SEQ ID NO: 4008581 - RNA, 17 nt, Human metapneumovirus
gcugaguggugucacaa

SEQ ID NO: 4008582 - RNA, 23 nt, Human metapneumovirus
gcugcuauaagcagugaagcaga

SEQ ID NO: 4008583 - RNA, 17 nt, Human metapneumovirus
gcuugaaagugaaguaa

SEQ ID NO: 4008584 - RNA, 23 nt, Human metapneumovirus
ggagaugagcaaaacuccugcau

SEQ ID NO: 4008585 - RNA, 14 nt, Human metapneumovirus
ggagugagcuguuc

SEQ ID NO: 4008586 - RNA, 14 nt, Human metapneumovirus
ggcaacugcaguga

SEQ ID NO: 4008587 - RNA, 15 nt, Human metapneumovirus
ggcaacugcagugag

SEQ ID NO: 4008588 - RNA, 15 nt, Human metapneumovirus
ggucuuaaagagagc

SEQ ID NO: 4008589 - RNA, 12 nt, Human metapneumovirus
guaacagcaauu

SEQ ID NO: 4008590 - RNA, 20 nt, Human metapneumovirus
guagggaucaucaagcaacu

SEQ ID NO: 4008591 - RNA, 21 nt, Human metapneumovirus
gucaagcagcuuugacccagu

SEQ ID NO: 4008592 - RNA, 21 nt, Human metapneumovirus
gucagcuacuguugaagcugc

SEQ ID NO: 4008593 - RNA, 18 nt, Human metapneumovirus
gugccgauggacccagcu

SEQ ID NO: 4008594 - RNA, 21 nt, Human metapneumovirus
gugucacaaacaauggcuuca

SEQ ID NO: 4008595 - RNA, 16 nt, Human metapneumovirus
guuauauaaaaaucaa

SEQ ID NO: 4008596 - RNA, 17 nt, Human metapneumovirus
guuggcaacugcaguga

SEQ ID NO: 4008597 - RNA, 20 nt, Human metapneumovirus
uaaccacucuguaugcugca

SEQ ID NO: 4008598 - RNA, 18 nt, Human metapneumovirus
uaagagaggaauuaauag

SEQ ID NO: 4008599 - RNA, 19 nt, Human metapneumovirus
uaaucaagugcagugagca

SEQ ID NO: 4008600 - RNA, 18 nt, Human papillomavirus type 11
aaaaacucaguauggugu

SEQ ID NO: 4008601 - RNA, 19 nt, Human papillomavirus type 11
aaaacaaaugggccugagc

SEQ ID NO: 4008602 - RNA, 22 nt, Human papillomavirus type 11
aaaacgaaaguauuuaggcagu

SEQ ID NO: 4008603 - RNA, 21 nt, Human papillomavirus type 11
aagacagcucagaagaugagg

SEQ ID NO: 4008604 - RNA, 14 nt, Human papillomavirus type 11
aagcacaggcauug

SEQ ID NO: 4008605 - RNA, 22 nt, Human papillomavirus type 11
aaguaguaccaccauuaacugu

SEQ ID NO: 4008606 - RNA, 12 nt, Human papillomavirus type 11
aauaucagaaga

SEQ ID NO: 4008607 - RNA, 13 nt, Human papillomavirus type 11
aaugcaaaugcau

SEQ ID NO: 4008608 - RNA, 14 nt, Human papillomavirus type 11
aaugcaauuguaac

SEQ ID NO: 4008609 - RNA, 17 nt, Human papillomavirus type 11
aauggaguaugugguau

SEQ ID NO: 4008610 - RNA, 22 nt, Human papillomavirus type 11
aauuugauggcugugaagacaa

SEQ ID NO: 4008611 - RNA, 18 nt, Human papillomavirus type 11
acaaaugggccugagcca

SEQ ID NO: 4008612 - RNA, 18 nt, Human papillomavirus type 11
acaccaguuaugaaaugu

SEQ ID NO: 4008613 - RNA, 22 nt, Human papillomavirus type 11
acagcaacguccgacugguugu

SEQ ID NO: 4008614 - RNA, 12 nt, Human papillomavirus type 11
acagccaaaaaa

SEQ ID NO: 4008615 - RNA, 10 nt, Human papillomavirus type 11
acaggauggu

SEQ ID NO: 4008616 - RNA, 20 nt, Human papillomavirus type 11
acaugguuguuucugugguu

SEQ ID NO: 4008617 - RNA, 15 nt, Human papillomavirus type 11
accuguauauaugua

SEQ ID NO: 4008618 - RNA, 11 nt, Human papillomavirus type 11
acuaacacugu

SEQ ID NO: 4008619 - RNA, 22 nt, Human papillomavirus type 11
acuaaucccauauguugugugc

SEQ ID NO: 4008620 - RNA, 22 nt, Human papillomavirus type 11
acuacauuacagggcuguacau

SEQ ID NO: 4008621 - RNA, 10 nt, Human papillomavirus type 11
acugcauuug

SEQ ID NO: 4008622 - RNA, 13 nt, Human papillomavirus type 11
acugguacauguc

SEQ ID NO: 4008623 - RNA, 21 nt, Human papillomavirus type 11
agaugaggaagaggaggugga

SEQ ID NO: 4008624 - RNA, 16 nt, Human papillomavirus type 11
aggagguggaggacag

SEQ ID NO: 4008625 - RNA, 19 nt, Human papillomavirus type 11
agggguuuuuuuugguggg

SEQ ID NO: 4008626 - RNA, 14 nt, Human papillomavirus type 11
agugccuguacaaa

SEQ ID NO: 4008627 - RNA, 14 nt, Human papillomavirus type 11
auacacauauacau

SEQ ID NO: 4008628 - RNA, 19 nt, Human papillomavirus type 11
auaucugauuuuguaguau

SEQ ID NO: 4008629 - RNA, 12 nt, Human papillomavirus type 11
augacaggcaua

SEQ ID NO: 4008630 - RNA, 21 nt, Human papillomavirus type 11
auggugauguuaaccugucac

SEQ ID NO: 4008631 - RNA, 18 nt, Human papillomavirus type 11
auuagaagacagcucaga

SEQ ID NO: 4008632 - RNA, 21 nt, Human papillomavirus type 11
auucuguggaagcacaggcau

SEQ ID NO: 4008633 - RNA, 15 nt, Human papillomavirus type 11
auugaugacaggcau

SEQ ID NO: 4008634 - RNA, 21 nt, Human papillomavirus type 11
auugccuguuguuauugcauu

SEQ ID NO: 4008635 - RNA, 18 nt, Human papillomavirus type 11
auuuuccugccuuuuaua

SEQ ID NO: 4008636 - RNA, 23 nt, Human papillomavirus type 11
caaaacaguuguaccaaaggugu

SEQ ID NO: 4008637 - RNA, 17 nt, Human papillomavirus type 11
caaagcaaaacaaaugg

SEQ ID NO: 4008638 - RNA, 15 nt, Human papillomavirus type 11
caauuguaacauuaa

SEQ ID NO: 4008639 - RNA, 23 nt, Human papillomavirus type 11
caauuuuuaaacaguguaaaaau

SEQ ID NO: 4008640 - RNA, 19 nt, Human papillomavirus type 11
cacacuaaauauugugugu

SEQ ID NO: 4008641 - RNA, 14 nt, Human papillomavirus type 11
cacauuaugcauug

SEQ ID NO: 4008642 - RNA, 21 nt, Human papillomavirus type 11
cacugugugugugcuauuuuc

SEQ ID NO: 4008643 - RNA, 15 nt, Human papillomavirus type 11
cacuuaaaugauggu

SEQ ID NO: 4008644 - RNA, 19 nt, Human papillomavirus type 11
cagaagaugaggaagagga

SEQ ID NO: 4008645 - RNA, 14 nt, Human papillomavirus type 11
cagccuccugaccc

SEQ ID NO: 4008646 - RNA, 18 nt, Human papillomavirus type 11
cauaacaaggauggcgga

SEQ ID NO: 4008647 - RNA, 18 nt, Human papillomavirus type 11
cauaguagagcacacuac

SEQ ID NO: 4008648 - RNA, 17 nt, Human papillomavirus type 11
cauauacauugugcaaa

SEQ ID NO: 4008649 - RNA, 16 nt, Human papillomavirus type 11
caugcaaggccacugg

SEQ ID NO: 4008650 - RNA, 21 nt, Human papillomavirus type 11
caugguacugaaaaaacuaaa

SEQ ID NO: 4008651 - RNA, 17 nt, Human papillomavirus type 11
cauuaacauauagcagu

SEQ ID NO: 4008652 - RNA, 13 nt, Human papillomavirus type 11
cauugcuaaacaa

SEQ ID NO: 4008653 - RNA, 23 nt, Human papillomavirus type 11
ccugucacuuaaaugauggugau

SEQ ID NO: 4008654 - RNA, 15 nt, Human papillomavirus type 11
cgacugguuguggag

SEQ ID NO: 4008655 - RNA, 13 nt, Human papillomavirus type 11
cggagacaucaga

SEQ ID NO: 4008656 - RNA, 16 nt, Human papillomavirus type 11
cguuuguguugccuuc

SEQ ID NO: 4008657 - RNA, 23 nt, Human papillomavirus type 11
cuacaagaccuuuugcugggcac

SEQ ID NO: 4008658 - RNA, 17 nt, Human papillomavirus type 11
cuauaucaaacaugcaa

SEQ ID NO: 4008659 - RNA, 22 nt, Human papillomavirus type 11
cuauugaaaugcaaaugcauuu

SEQ ID NO: 4008660 - RNA, 18 nt, Human papillomavirus type 11
cucaccugaggcaccaca

SEQ ID NO: 4008661 - RNA, 11 nt, Human papillomavirus type 11
cugcaggacaa

SEQ ID NO: 4008662 - RNA, 15 nt, Human papillomavirus type 11
cugugugugugcuau

SEQ ID NO: 4008663 - RNA, 14 nt, Human papillomavirus type 11
cuuagcaaaaacuc

SEQ ID NO: 4008664 - RNA, 18 nt, Human papillomavirus type 11
cuuuaacacaacauuacc

SEQ ID NO: 4008665 - RNA, 18 nt, Human papillomavirus type 11
gaaaaaacuaaaugugcu

SEQ ID NO: 4008666 - RNA, 16 nt, Human papillomavirus type 11
gaagaugagguggaca

SEQ ID NO: 4008667 - RNA, 14 nt, Human papillomavirus type 11
gaauguguauguau

SEQ ID NO: 4008668 - RNA, 15 nt, Human papillomavirus type 11
gacaggcauauuaca

SEQ ID NO: 4008669 - RNA, 16 nt, Human papillomavirus type 11
gacaguggguaugaca

SEQ ID NO: 4008670 - RNA, 11 nt, Human papillomavirus type 11
gacccuguagg

SEQ ID NO: 4008671 - RNA, 15 nt, Human papillomavirus type 11
gaccuuuugcugggc

SEQ ID NO: 4008672 - RNA, 17 nt, Human papillomavirus type 11
gacggcuguuugaaaca

SEQ ID NO: 4008673 - RNA, 13 nt, Human papillomavirus type 11
gaggagucugcua

SEQ ID NO: 4008674 - RNA, 21 nt, Human papillomavirus type 11
gcaguauguauucuuaguauu

SEQ ID NO: 4008675 - RNA, 20 nt, Human papillomavirus type 11
gcuaaugcaguagaaaguga

SEQ ID NO: 4008676 - RNA, 15 nt, Human papillomavirus type 11
gcucagaagaugagg

SEQ ID NO: 4008677 - RNA, 14 nt, Human papillomavirus type 11
gcuguggaugugac

SEQ ID NO: 4008678 - RNA, 14 nt, Human papillomavirus type 11
ggaauguguaugua

SEQ ID NO: 4008679 - RNA, 21 nt, Human papillomavirus type 11
ggacgauucagguacagaaaa

SEQ ID NO: 4008680 - RNA, 17 nt, Human papillomavirus type 11
gggaaauacuguggagg

SEQ ID NO: 4008681 - RNA, 20 nt, Human papillomavirus type 11
gggguuuaugucauuacauu

SEQ ID NO: 4008682 - RNA, 13 nt, Human papillomavirus type 11
ggguguacaggau

SEQ ID NO: 4008683 - RNA, 23 nt, Human papillomavirus type 11
gguacacaaauaucagaagauga

SEQ ID NO: 4008684 - RNA, 16 nt, Human papillomavirus type 11
gguuguuucugugguu

SEQ ID NO: 4008685 - RNA, 16 nt, Human papillomavirus type 11
guaacauuaacauaua

SEQ ID NO: 4008686 - RNA, 18 nt, Human papillomavirus type 11
guaccaccauuaacugug

SEQ ID NO: 4008687 - RNA, 14 nt, Human papillomavirus type 11
guaguauauacauc

SEQ ID NO: 4008688 - RNA, 14 nt, Human papillomavirus type 11
guauaugucacaug

SEQ ID NO: 4008689 - RNA, 14 nt, Human papillomavirus type 11
guauugauauacac

SEQ ID NO: 4008690 - RNA, 18 nt, Human papillomavirus type 11
gucgggguguacaggaug

SEQ ID NO: 4008691 - RNA, 21 nt, Human papillomavirus type 11
guggaaccuuggacauuacag

SEQ ID NO: 4008692 - RNA, 22 nt, Human papillomavirus type 11
guggaauguguauguauguuuu

SEQ ID NO: 4008693 - RNA, 16 nt, Human papillomavirus type 11
guuacacccagugacu

SEQ ID NO: 4008694 - RNA, 23 nt, Human papillomavirus type 11
guuacacccagugacuaaguugu

SEQ ID NO: 4008695 - RNA, 20 nt, Human papillomavirus type 11
uaaaugugcuaaguguaaau

SEQ ID NO: 4008696 - RNA, 22 nt, Human papillomavirus type 11
uaacaaaacaguuguaccaaag

SEQ ID NO: 4008697 - RNA, 22 nt, Human papillomavirus type 11
uaacacugugugugugcuauuu

SEQ ID NO: 4008698 - RNA, 17 nt, Human papillomavirus type 11
uaaccugucacuuaaau

SEQ ID NO: 4008699 - RNA, 22 nt, Human papillomavirus type 11
uacaaauugcugcagcaacaac

SEQ ID NO: 4008700 - RNA, 16 nt, Human papillomavirus type 11
uacaucugugcuggua

SEQ ID NO: 4008701 - RNA, 17 nt, Human papillomavirus type 11
uacauuacagggcugua

SEQ ID NO: 4008702 - RNA, 14 nt, Human papillomavirus type 11
uaguguguguauau

SEQ ID NO: 4008703 - RNA, 17 nt, Human papillomavirus type 11
uauaaacauuuguuuga

SEQ ID NO: 4008704 - RNA, 14 nt, Human papillomavirus type 11
uauugauauacaca

SEQ ID NO: 4008705 - RNA, 17 nt, Human papillomavirus type 11
uauugaugacaggcaua

SEQ ID NO: 4008706 - RNA, 16 nt, Human papillomavirus type 11
uauuguacuuauaaua

SEQ ID NO: 4008707 - RNA, 17 nt, Human papillomavirus type 11
ucuuguauuguguauau

SEQ ID NO: 4008708 - RNA, 15 nt, Human papillomavirus type 11
ugaaaugcaaaugca

SEQ ID NO: 4008709 - RNA, 15 nt, Human papillomavirus type 11
ugauauacacaaaca

SEQ ID NO: 4008710 - RNA, 15 nt, Human papillomavirus type 11
ugcaaacgcaacaau

SEQ ID NO: 4008711 - RNA, 16 nt, Human papillomavirus type 11
ugcuaaguguaaauca

SEQ ID NO: 4008712 - RNA, 22 nt, Human papillomavirus type 11
uggacuuuauugaugacaggca

SEQ ID NO: 4008713 - RNA, 15 nt, Human papillomavirus type 11
uggagauuaugugua

SEQ ID NO: 4008714 - RNA, 16 nt, Human papillomavirus type 11
uggagauuauguguac

SEQ ID NO: 4008715 - RNA, 19 nt, Human papillomavirus type 11
uggagauuauguguacaug

SEQ ID NO: 4008716 - RNA, 23 nt, Human papillomavirus type 11
uggagauuauguguacaugaacu

SEQ ID NO: 4008717 - RNA, 16 nt, Human papillomavirus type 11
ugucccaucugcgcac

SEQ ID NO: 4008718 - RNA, 22 nt, Human papillomavirus type 11
ugugaagacaauguaauggagu

SEQ ID NO: 4008719 - RNA, 18 nt, Human papillomavirus type 11
uguggaagcacaggcauu

SEQ ID NO: 4008720 - RNA, 18 nt, Human papillomavirus type 11
uguguauguuauguaugu

SEQ ID NO: 4008721 - RNA, 15 nt, Human papillomavirus type 11
uguuauuuauauguu

SEQ ID NO: 4008722 - RNA, 19 nt, Human papillomavirus type 11
uuaaccugucacuuaaaug

SEQ ID NO: 4008723 - RNA, 17 nt, Human papillomavirus type 11
uuaccaaauacugaccu

SEQ ID NO: 4008724 - RNA, 17 nt, Human papillomavirus type 11
uuguuuacugcauuugu

SEQ ID NO: 4008725 - RNA, 21 nt, Human papillomavirus type 11
uuguuucugugguuguuuacu

SEQ ID NO: 4008726 - RNA, 20 nt, Human papillomavirus type 11
aaacuaaaugugcuaagugu

SEQ ID NO: 4008727 - RNA, 17 nt, Human papillomavirus type 11
aaauacugaccuguugc

SEQ ID NO: 4008728 - RNA, 18 nt, Human papillomavirus type 11
aaauaucagaagaugagg

SEQ ID NO: 4008729 - RNA, 14 nt, Human papillomavirus type 11
aauguguauguaug

SEQ ID NO: 4008730 - RNA, 22 nt, Human papillomavirus type 11
aauuagaagacagcucagaaga

SEQ ID NO: 4008731 - RNA, 14 nt, Human papillomavirus type 11
aauuguuuaaaaug

SEQ ID NO: 4008732 - RNA, 15 nt, Human papillomavirus type 11
aauuuuuaaacagug

SEQ ID NO: 4008733 - RNA, 22 nt, Human papillomavirus type 11
acaaauaucagaagaugaggaa

SEQ ID NO: 4008734 - RNA, 16 nt, Human papillomavirus type 11
acagcucagaagauga

SEQ ID NO: 4008735 - RNA, 17 nt, Human papillomavirus type 11
acagcucagaagaugag

SEQ ID NO: 4008736 - RNA, 19 nt, Human papillomavirus type 11
accugucacuuaaaugaug

SEQ ID NO: 4008737 - RNA, 13 nt, Human papillomavirus type 11
accuguugcugug

SEQ ID NO: 4008738 - RNA, 12 nt, Human papillomavirus type 11
accuuuugcugg

SEQ ID NO: 4008739 - RNA, 16 nt, Human papillomavirus type 11
agaugaggaagaggag

SEQ ID NO: 4008740 - RNA, 14 nt, Human papillomavirus type 11
agcucagaagauga

SEQ ID NO: 4008741 - RNA, 20 nt, Human papillomavirus type 11
agcucagaagaugaggugga

SEQ ID NO: 4008742 - RNA, 16 nt, Human papillomavirus type 11
aggagucugcuauuau

SEQ ID NO: 4008743 - RNA, 19 nt, Human papillomavirus type 11
aggaugguuuaugguagaa

SEQ ID NO: 4008744 - RNA, 15 nt, Human papillomavirus type 11
agggaaauacugugg

SEQ ID NO: 4008745 - RNA, 17 nt, Human papillomavirus type 11
aggugauuccaauuguu

SEQ ID NO: 4008746 - RNA, 22 nt, Human papillomavirus type 11
aguaguaccaccauuaacugug

SEQ ID NO: 4008747 - RNA, 22 nt, Human papillomavirus type 11
aguaugguguggaaccuuggac

SEQ ID NO: 4008748 - RNA, 12 nt, Human papillomavirus type 11
aguaugugguau

SEQ ID NO: 4008749 - RNA, 20 nt, Human papillomavirus type 11
agugccuguacaaauugcug

SEQ ID NO: 4008750 - RNA, 20 nt, Human papillomavirus type 11
aguggguaugacauggugga

SEQ ID NO: 4008751 - RNA, 19 nt, Human papillomavirus type 11
auaguacuagaccugcagc

SEQ ID NO: 4008752 - RNA, 19 nt, Human papillomavirus type 11
auauaaacauuuguuugaa

SEQ ID NO: 4008753 - RNA, 19 nt, Human papillomavirus type 11
auauauuuguaauauaccu

SEQ ID NO: 4008754 - RNA, 21 nt, Human papillomavirus type 11
auauauuuguggaauguguau

SEQ ID NO: 4008755 - RNA, 14 nt, Human papillomavirus type 11
auauguuguuguag

SEQ ID NO: 4008756 - RNA, 15 nt, Human papillomavirus type 11
auauguuucuuguau

SEQ ID NO: 4008757 - RNA, 20 nt, Human papillomavirus type 11
auauuaaaauggggaagcuu

SEQ ID NO: 4008758 - RNA, 16 nt, Human papillomavirus type 11
augcgacugugcagga

SEQ ID NO: 4008759 - RNA, 23 nt, Human papillomavirus type 11
augcuauugaaaugcaaaugcau

SEQ ID NO: 4008760 - RNA, 20 nt, Human papillomavirus type 11
auggagguagugccuguaca

SEQ ID NO: 4008761 - RNA, 18 nt, Human papillomavirus type 11
auggugauguuaaccugu

SEQ ID NO: 4008762 - RNA, 11 nt, Human papillomavirus type 11
auguauguuug

SEQ ID NO: 4008763 - RNA, 11 nt, Human papillomavirus type 11
auguauguuuu

SEQ ID NO: 4008764 - RNA, 16 nt, Human papillomavirus type 11
augucauuacauuuau

SEQ ID NO: 4008765 - RNA, 17 nt, Human papillomavirus type 11
auguuguuauguauguu

SEQ ID NO: 4008766 - RNA, 16 nt, Human papillomavirus type 11
auguuguuguagugug

SEQ ID NO: 4008767 - RNA, 17 nt, Human papillomavirus type 11
auguuuuugugcaauaa

SEQ ID NO: 4008768 - RNA, 22 nt, Human papillomavirus type 11
auuaauaucugauuuuguagua

SEQ ID NO: 4008769 - RNA, 18 nt, Human papillomavirus type 11
auuauauauauuuguaau

SEQ ID NO: 4008770 - RNA, 15 nt, Human papillomavirus type 11
auugcauuugcagua

SEQ ID NO: 4008771 - RNA, 23 nt, Human papillomavirus type 11
auuugcaguauguauucuuagua

SEQ ID NO: 4008772 - RNA, 18 nt, Human papillomavirus type 11
caauucuuuuuacuaaca

SEQ ID NO: 4008773 - RNA, 23 nt, Human papillomavirus type 11
cagaucaaauauuaaaaugggga

SEQ ID NO: 4008774 - RNA, 22 nt, Human papillomavirus type 11
caggaccuaaaacgaaaguauu

SEQ ID NO: 4008775 - RNA, 15 nt, Human papillomavirus type 11
cagggaaauacugug

SEQ ID NO: 4008776 - RNA, 14 nt, Human papillomavirus type 11
caucuucaacgugg

SEQ ID NO: 4008777 - RNA, 12 nt, Human papillomavirus type 11
caugaacuagag

SEQ ID NO: 4008778 - RNA, 14 nt, Human papillomavirus type 11
cauuggaaaugcau

SEQ ID NO: 4008779 - RNA, 21 nt, Human papillomavirus type 11
ccaacauauuuuaucaugcca

SEQ ID NO: 4008780 - RNA, 14 nt, Human papillomavirus type 11
ccugauucaucccu

SEQ ID NO: 4008781 - RNA, 17 nt, Human papillomavirus type 11
ccugcagccuccugacc

SEQ ID NO: 4008782 - RNA, 18 nt, Human papillomavirus type 11
ccugucacuuaaaugaug

SEQ ID NO: 4008783 - RNA, 15 nt, Human papillomavirus type 11
ccuguugcuguggau

SEQ ID NO: 4008784 - RNA, 20 nt, Human papillomavirus type 11
cuauugaaaugcaaaugcau

SEQ ID NO: 4008785 - RNA, 14 nt, Human papillomavirus type 11
cucagaagaugagg

SEQ ID NO: 4008786 - RNA, 17 nt, Human papillomavirus type 11
cugaccuguugcugugg

SEQ ID NO: 4008787 - RNA, 14 nt, Human papillomavirus type 11
cugauucaucccug

SEQ ID NO: 4008788 - RNA, 13 nt, Human papillomavirus type 11
cugggcacacuaa

SEQ ID NO: 4008789 - RNA, 14 nt, Human papillomavirus type 11
cugguuguggagug

SEQ ID NO: 4008790 - RNA, 20 nt, Human papillomavirus type 11
cuguggaagcacaggcauug

SEQ ID NO: 4008791 - RNA, 22 nt, Human papillomavirus type 11
cuuaauugaggagucugcuauu

SEQ ID NO: 4008792 - RNA, 19 nt, Human papillomavirus type 11
gaaaaaacuaaaugugcua

SEQ ID NO: 4008793 - RNA, 14 nt, Human papillomavirus type 11
gaagaggaggugga

SEQ ID NO: 4008794 - RNA, 23 nt, Human papillomavirus type 11
gaagaggagguggaggacagugg

SEQ ID NO: 4008795 - RNA, 16 nt, Human papillomavirus type 11
gacugguuguggagug

SEQ ID NO: 4008796 - RNA, 22 nt, Human papillomavirus type 11
gacugguuguggagugcacaga

SEQ ID NO: 4008797 - RNA, 18 nt, Human papillomavirus type 11
gaugagguggacaaggug

SEQ ID NO: 4008798 - RNA, 21 nt, Human papillomavirus type 11
gcaacaauaauggugauguua

SEQ ID NO: 4008799 - RNA, 19 nt, Human papillomavirus type 11
gccaaaaaagguaaagcga

SEQ ID NO: 4008800 - RNA, 19 nt, Human papillomavirus type 11
gcuauuacuggggggccag

SEQ ID NO: 4008801 - RNA, 14 nt, Human papillomavirus type 11
gcuauugaaaugca

SEQ ID NO: 4008802 - RNA, 19 nt, Human papillomavirus type 11
gcucagaagaugaggugga

SEQ ID NO: 4008803 - RNA, 14 nt, Human papillomavirus type 11
gcuuguggagccug

SEQ ID NO: 4008804 - RNA, 16 nt, Human papillomavirus type 11
ggacauuacaggacac

SEQ ID NO: 4008805 - RNA, 21 nt, Human papillomavirus type 11
ggcggacgauucagguacaga

SEQ ID NO: 4008806 - RNA, 16 nt, Human papillomavirus type 11
ggcgugcacaggguug

SEQ ID NO: 4008807 - RNA, 23 nt, Human papillomavirus type 11
gggaagcucucccaagccugcua

SEQ ID NO: 4008808 - RNA, 16 nt, Human papillomavirus type 11
gggucgggguguacag

SEQ ID NO: 4008809 - RNA, 14 nt, Human papillomavirus type 11
gguauugguacagg

SEQ ID NO: 4008810 - RNA, 22 nt, Human papillomavirus type 11
guacaugucccccagauguaau

SEQ ID NO: 4008811 - RNA, 12 nt, Human papillomavirus type 11
guagcuaaugca

SEQ ID NO: 4008812 - RNA, 18 nt, Human papillomavirus type 11
guauauacaucugugcug

SEQ ID NO: 4008813 - RNA, 18 nt, Human papillomavirus type 11
gugguuguuuacugcauu

SEQ ID NO: 4008814 - RNA, 14 nt, Human papillomavirus type 11
guuguuauugcauu

SEQ ID NO: 4008815 - RNA, 20 nt, Human papillomavirus type 11
uaaaaaugcaauuguaacau

SEQ ID NO: 4008816 - RNA, 17 nt, Human papillomavirus type 11
uaaacaauuauuaugug

SEQ ID NO: 4008817 - RNA, 20 nt, Human papillomavirus type 11
uaaacaauuauuaugugugu

SEQ ID NO: 4008818 - RNA, 16 nt, Human papillomavirus type 11
uaaaguugaacauacu

SEQ ID NO: 4008819 - RNA, 15 nt, Human papillomavirus type 11
uaaaucaaaccgcaa

SEQ ID NO: 4008820 - RNA, 17 nt, Human papillomavirus type 11
uaaaugugcuaagugua

SEQ ID NO: 4008821 - RNA, 18 nt, Human papillomavirus type 11
uaaucccauauguugugu

SEQ ID NO: 4008822 - RNA, 21 nt, Human papillomavirus type 11
uacaaauugcugcagcaacaa

SEQ ID NO: 4008823 - RNA, 17 nt, Human papillomavirus type 11
uacauaacauacgugua

SEQ ID NO: 4008824 - RNA, 24 nt, Human papillomavirus type 11
uacauuacagggcuguacauggua

SEQ ID NO: 4008825 - RNA, 17 nt, Human papillomavirus type 11
uaccaaauacugaccug

SEQ ID NO: 4008826 - RNA, 22 nt, Human papillomavirus type 11
uacuacuguggauuauguguau

SEQ ID NO: 4008827 - RNA, 18 nt, Human papillomavirus type 11
uacuauugcagaucaaau

SEQ ID NO: 4008828 - RNA, 21 nt, Human papillomavirus type 11
uacuguggauuauguguauau

SEQ ID NO: 4008829 - RNA, 12 nt, Human papillomavirus type 11
uagaagccauag

SEQ ID NO: 4008830 - RNA, 16 nt, Human papillomavirus type 11
uagcagugaggaacaa

SEQ ID NO: 4008831 - RNA, 14 nt, Human papillomavirus type 11
uagugccuguacaa

SEQ ID NO: 4008832 - RNA, 23 nt, Human papillomavirus type 11
aaaauucuguggaagcacaggca

SEQ ID NO: 4008833 - RNA, 22 nt, Human papillomavirus type 11
aaaugcauuuagaauccuuagc

SEQ ID NO: 4008834 - RNA, 18 nt, Human papillomavirus type 11
aaccauaacaaggauggc

SEQ ID NO: 4008835 - RNA, 17 nt, Human papillomavirus type 11
aaccgcaauacuacugu

SEQ ID NO: 4008836 - RNA, 12 nt, Human papillomavirus type 11
aagguaaagcga

SEQ ID NO: 4008837 - RNA, 16 nt, Human papillomavirus type 11
aauuauuauguguguc

SEQ ID NO: 4008838 - RNA, 14 nt, Human papillomavirus type 11
aauucuuuuuacua

SEQ ID NO: 4008839 - RNA, 13 nt, Human papillomavirus type 11
acacaaagcaaaa

SEQ ID NO: 4008840 - RNA, 17 nt, Human papillomavirus type 11
acaccacccaaacggug

SEQ ID NO: 4008841 - RNA, 22 nt, Human papillomavirus type 11
acauuaugcauuggaaaugcau

SEQ ID NO: 4008842 - RNA, 15 nt, Human papillomavirus type 11
accuagggcacgcag

SEQ ID NO: 4008843 - RNA, 22 nt, Human papillomavirus type 11
acuaaaugugcuaaguguaaau

SEQ ID NO: 4008844 - RNA, 16 nt, Human papillomavirus type 11
acuggggggccagcag

SEQ ID NO: 4008845 - RNA, 13 nt, Human papillomavirus type 11
aguauuuaggcag

SEQ ID NO: 4008846 - RNA, 16 nt, Human papillomavirus type 11
auauaccugcaggaca

SEQ ID NO: 4008847 - RNA, 17 nt, Human papillomavirus type 11
auauguguauauguuug

SEQ ID NO: 4008848 - RNA, 15 nt, Human papillomavirus type 11
aucugcgcaccaaaa

SEQ ID NO: 4008849 - RNA, 12 nt, Human papillomavirus type 11
augcauuggaaa

SEQ ID NO: 4008850 - RNA, 17 nt, Human papillomavirus type 11
augcauuggaaaugcau

SEQ ID NO: 4008851 - RNA, 19 nt, Human papillomavirus type 11
auguagaaaauaguggugg

SEQ ID NO: 4008852 - RNA, 15 nt, Human papillomavirus type 11
augucacauggugau

SEQ ID NO: 4008853 - RNA, 16 nt, Human papillomavirus type 11
augugguauggacaca

SEQ ID NO: 4008854 - RNA, 11 nt, Human papillomavirus type 11
auguguauguu

SEQ ID NO: 4008855 - RNA, 14 nt, Human papillomavirus type 11
auguguauguuaug

SEQ ID NO: 4008856 - RNA, 21 nt, Human papillomavirus type 11
auguuuuagauauagacugaa

SEQ ID NO: 4008857 - RNA, 17 nt, Human papillomavirus type 11
auuacaccuguauauau

SEQ ID NO: 4008858 - RNA, 17 nt, Human papillomavirus type 11
auuacauuuauuguaac

SEQ ID NO: 4008859 - RNA, 18 nt, Human papillomavirus type 11
auuacuacacaaagcaaa

SEQ ID NO: 4008860 - RNA, 16 nt, Human papillomavirus type 11
auucuuaguauuguac

SEQ ID NO: 4008861 - RNA, 23 nt, Human papillomavirus type 11
auugugcaaacgcaacaauaaug

SEQ ID NO: 4008862 - RNA, 22 nt, Human papillomavirus type 11
caaaacaaaugggccugagcca

SEQ ID NO: 4008863 - RNA, 15 nt, Human papillomavirus type 11
caaaauucuguggaa

SEQ ID NO: 4008864 - RNA, 19 nt, Human papillomavirus type 11
caaauaucagaagaugagg

SEQ ID NO: 4008865 - RNA, 12 nt, Human papillomavirus type 11
caacacagccaa

SEQ ID NO: 4008866 - RNA, 14 nt, Human papillomavirus type 11
caauuguaacauua

SEQ ID NO: 4008867 - RNA, 17 nt, Human papillomavirus type 11
caauuuuuaaacagugu

SEQ ID NO: 4008868 - RNA, 18 nt, Human papillomavirus type 11
caauuuuuaaacagugua

SEQ ID NO: 4008869 - RNA, 22 nt, Human papillomavirus type 11
cacauuaugcauuggaaaugca

SEQ ID NO: 4008870 - RNA, 19 nt, Human papillomavirus type 11
caccuguauauauguauau

SEQ ID NO: 4008871 - RNA, 20 nt, Human papillomavirus type 11
cagaagaugagguggacaag

SEQ ID NO: 4008872 - RNA, 18 nt, Human papillomavirus type 11
cagagacuaaaggacaua

SEQ ID NO: 4008873 - RNA, 15 nt, Human papillomavirus type 11
cagcaacguccgacu

SEQ ID NO: 4008874 - RNA, 19 nt, Human papillomavirus type 11
caggaugguuuaugguaga

SEQ ID NO: 4008875 - RNA, 15 nt, Human papillomavirus type 11
caguuaugaaaugug

SEQ ID NO: 4008876 - RNA, 13 nt, Human papillomavirus type 11
caucugugcuggu

SEQ ID NO: 4008877 - RNA, 20 nt, Human papillomavirus type 11
caucugugcugguacuaaca

SEQ ID NO: 4008878 - RNA, 16 nt, Human papillomavirus type 11
cauuaugcgacugugc

SEQ ID NO: 4008879 - RNA, 18 nt, Human papillomavirus type 11
cauuguuuaauaggcagg

SEQ ID NO: 4008880 - RNA, 23 nt, Human papillomavirus type 11
ccauuaaacuuacaacacagcca

SEQ ID NO: 4008881 - RNA, 13 nt, Human papillomavirus type 11
ccgcaauacuacu

SEQ ID NO: 4008882 - RNA, 14 nt, Human papillomavirus type 11
ccuccugacccugu

SEQ ID NO: 4008883 - RNA, 21 nt, Human papillomavirus type 11
ccuuggacauuacaggacacc

SEQ ID NO: 4008884 - RNA, 22 nt, Human papillomavirus type 11
cgucagcaauuuuuaaacagug

SEQ ID NO: 4008885 - RNA, 13 nt, Human papillomavirus type 11
cuauacuauguua

SEQ ID NO: 4008886 - RNA, 15 nt, Human papillomavirus type 11
cuccucccaacccug

SEQ ID NO: 4008887 - RNA, 18 nt, Human papillomavirus type 11
cugaaaaaacuaaaugug

SEQ ID NO: 4008888 - RNA, 20 nt, Human papillomavirus type 11
cugauuuuguaguauauaca

SEQ ID NO: 4008889 - RNA, 23 nt, Human papillomavirus type 11
cugcagcaacaacuacaacauug

SEQ ID NO: 4008890 - RNA, 16 nt, Human papillomavirus type 11
cugccuuuuauauaca

SEQ ID NO: 4008891 - RNA, 16 nt, Human papillomavirus type 11
cugcuauuacuggggg

SEQ ID NO: 4008892 - RNA, 21 nt, Human papillomavirus type 11
cugcuauuauuaaugcuggug

SEQ ID NO: 4008893 - RNA, 21 nt, Human papillomavirus type 11
cuguacaaauugcugcagcaa

SEQ ID NO: 4008894 - RNA, 16 nt, Human papillomavirus type 11
cuguauccaagguugu

SEQ ID NO: 4008895 - RNA, 18 nt, Human papillomavirus type 11
cuguggaagcacaggcau

SEQ ID NO: 4008896 - RNA, 20 nt, Human papillomavirus type 11
cuguugcuguggaugugaca

SEQ ID NO: 4008897 - RNA, 23 nt, Human papillomavirus type 11
cuuuaaaaaacagggaaauacug

SEQ ID NO: 4008898 - RNA, 11 nt, Human papillomavirus type 11
gaagcacaggc

SEQ ID NO: 4008899 - RNA, 22 nt, Human papillomavirus type 11
gacauaaugcuauugaaaugca

SEQ ID NO: 4008900 - RNA, 20 nt, Human papillomavirus type 11
gaccccacuacacagcguuu

SEQ ID NO: 4008901 - RNA, 16 nt, Human papillomavirus type 11
gagacuaaaggacaua

SEQ ID NO: 4008902 - RNA, 23 nt, Human papillomavirus type 11
gcacguccgccagugcuugugga

SEQ ID NO: 4008903 - RNA, 16 nt, Human papillomavirus type 11
gcagcacguccgccag

SEQ ID NO: 4008904 - RNA, 15 nt, Human papillomavirus type 11
gcaguccauauguaa

SEQ ID NO: 4008905 - RNA, 18 nt, Human papillomavirus type 11
gccauuaaacuuacaaca

SEQ ID NO: 4008906 - RNA, 22 nt, Human papillomavirus type 11
ggaggacaguggguaugacaug

SEQ ID NO: 4008907 - RNA, 11 nt, Human papillomavirus type 11
ggaugugacag

SEQ ID NO: 4008908 - RNA, 23 nt, Human papillomavirus type 11
ggccacugguacaugucccccag

SEQ ID NO: 4008909 - RNA, 15 nt, Human papillomavirus type 11
gggaagcucucccaa

SEQ ID NO: 4008910 - RNA, 22 nt, Human papillomavirus type 11
gguggacuuuauugaugacagg

SEQ ID NO: 4008911 - RNA, 15 nt, Human papillomavirus type 11
gguguacaggauggu

SEQ ID NO: 4008912 - RNA, 18 nt, Human papillomavirus type 11
guacacaaauaucagaag

SEQ ID NO: 4008913 - RNA, 19 nt, Human papillomavirus type 11
guagagcacacuacaggua

SEQ ID NO: 4008914 - RNA, 14 nt, Human papillomavirus type 11
guguauauguuucu

SEQ ID NO: 4008915 - RNA, 20 nt, Human papillomavirus type 11
guguauuacuacacaaagca

SEQ ID NO: 4008916 - RNA, 21 nt, Human papillomavirus type 11
guuuaaaauguuuuagauaua

SEQ ID NO: 4008917 - RNA, 19 nt, Human papillomavirus type 11
uaaaguugaacauacuacu

SEQ ID NO: 4008918 - RNA, 20 nt, Human papillomavirus type 11
uaacaaccccuuugcaauuc

SEQ ID NO: 4008919 - RNA, 13 nt, Human papillomavirus type 11
uaacaaggauggc

SEQ ID NO: 4008920 - RNA, 18 nt, Human papillomavirus type 11
uaacacaacauuaccaaa

SEQ ID NO: 4008921 - RNA, 16 nt, Human papillomavirus type 11
uaacauuaacauauag

SEQ ID NO: 4008922 - RNA, 12 nt, Human papillomavirus type 11
uaaccugucacu

SEQ ID NO: 4008923 - RNA, 22 nt, Human papillomavirus type 11
uacacaaauaucagaagaugag

SEQ ID NO: 4008924 - RNA, 20 nt, Human papillomavirus type 11
uacuaaucccauauguugug

SEQ ID NO: 4008925 - RNA, 20 nt, Human papillomavirus type 11
uacuauugcagaucaaauau

SEQ ID NO: 4008926 - RNA, 17 nt, Human papillomavirus type 11
uacugcauuuguuguag

SEQ ID NO: 4008927 - RNA, 23 nt, Human papillomavirus type 11
uacuuggauuguuguuacuacau

SEQ ID NO: 4008928 - RNA, 18 nt, Human papillomavirus type 11
uauaaacauuuguuugaa

SEQ ID NO: 4008929 - RNA, 12 nt, Human papillomavirus type 11
uauacacauaua

SEQ ID NO: 4008930 - RNA, 18 nt, Human papillomavirus type 11
uauacaguguguggugua

SEQ ID NO: 4008931 - RNA, 15 nt, Human papillomavirus type 11
uauguguacaugaac

SEQ ID NO: 4008932 - RNA, 17 nt, Human papillomavirus type 11
uauguguauguuaugua

SEQ ID NO: 4008933 - RNA, 13 nt, Human papillomavirus type 11
uauguugugugcc

SEQ ID NO: 4008934 - RNA, 14 nt, Human papillomavirus type 11
uauguuuguguaua

SEQ ID NO: 4008935 - RNA, 15 nt, Human papillomavirus type 11
uauguuuguguauau

SEQ ID NO: 4008936 - RNA, 17 nt, Human papillomavirus type 11
uauuauguguguccugu

SEQ ID NO: 4008937 - RNA, 20 nt, Human papillomavirus type 11
uauugaaaugcaaaugcauu

SEQ ID NO: 4008938 - RNA, 14 nt, Human papillomavirus type 11
uauuguacuuauaa

SEQ ID NO: 4008939 - RNA, 21 nt, Human papillomavirus type 11
uauuuuccugccuuuuauaua

SEQ ID NO: 4008940 - RNA, 19 nt, Human papillomavirus type 11
ucauuaugcgacugugcag

SEQ ID NO: 4008941 - RNA, 20 nt, Human papillomavirus type 11
ugagcaauuagaagacagcu

SEQ ID NO: 4008942 - RNA, 14 nt, Human papillomavirus type 11
ugaugacaggcaua

SEQ ID NO: 4008943 - RNA, 15 nt, Human papillomavirus type 11
ugaugacaggcauau

SEQ ID NO: 4008944 - RNA, 17 nt, Human papillomavirus type 11
ugauuccaauuguuuaa

SEQ ID NO: 4008945 - RNA, 16 nt, Human papillomavirus type 11
ugcaauucuuuuuacu

SEQ ID NO: 4008946 - RNA, 14 nt, Human papillomavirus type 11
uggaagcacaggca

SEQ ID NO: 4008947 - RNA, 15 nt, Human papillomavirus type 11
uggaagcacaggcau

SEQ ID NO: 4008948 - RNA, 23 nt, Human papillomavirus type 11
uggauuauguguauaugucacau

SEQ ID NO: 4008949 - RNA, 23 nt, Human papillomavirus type 11
ugguacaggggcugguaguggcg

SEQ ID NO: 4008950 - RNA, 17 nt, Human papillomavirus type 11
ugguacaugucccccag

SEQ ID NO: 4008951 - RNA, 14 nt, Human papillomavirus type 11
uguagcuguacuug

SEQ ID NO: 4008952 - RNA, 18 nt, Human papillomavirus type 11
uguauauauuuguggaau

SEQ ID NO: 4008953 - RNA, 21 nt, Human papillomavirus type 11
uguauauguguauauguuugu

SEQ ID NO: 4008954 - RNA, 15 nt, Human papillomavirus type 11
uguguauauguguau

SEQ ID NO: 4008955 - RNA, 13 nt, Human papillomavirus type 11
uuagauauagacu

SEQ ID NO: 4008956 - RNA, 14 nt, Human papillomavirus type 11
uugaugacaggcau

SEQ ID NO: 4008957 - RNA, 16 nt, Human papillomavirus type 11
uuggauuguuguuacu

SEQ ID NO: 4008958 - RNA, 13 nt, Human papillomavirus type 11
uuguaguguguau

SEQ ID NO: 4008959 - RNA, 15 nt, Human papillomavirus type 11
uuguggaauguguau

SEQ ID NO: 4008960 - RNA, 16 nt, Human papillomavirus type 11
uuguuauugcauuugc

SEQ ID NO: 4008961 - RNA, 14 nt, Human papillomavirus type 11
uuuguguugccuuc

SEQ ID NO: 4008962 - RNA, 18 nt, Human papillomavirus type 11
aaacagggaaauacugug

SEQ ID NO: 4008963 - RNA, 16 nt, Human papillomavirus type 11
aacaacgucagcaauu

SEQ ID NO: 4008964 - RNA, 19 nt, Human papillomavirus type 11
aacacauuaugcauuggaa

SEQ ID NO: 4008965 - RNA, 20 nt, Human papillomavirus type 11
aacgucagcaauuuuuaaac

SEQ ID NO: 4008966 - RNA, 15 nt, Human papillomavirus type 11
aacuauaucaaacau

SEQ ID NO: 4008967 - RNA, 16 nt, Human papillomavirus type 11
aauaccacccaccauu

SEQ ID NO: 4008968 - RNA, 17 nt, Human papillomavirus type 11
aauacugaccuguugcu

SEQ ID NO: 4008969 - RNA, 15 nt, Human papillomavirus type 11
aauaucagaagauga

SEQ ID NO: 4008970 - RNA, 20 nt, Human papillomavirus type 11
acaccuguauauauguauau

SEQ ID NO: 4008971 - RNA, 16 nt, Human papillomavirus type 11
accauuaacuguguca

SEQ ID NO: 4008972 - RNA, 21 nt, Human papillomavirus type 11
acgacucauggguaaaaguaa

SEQ ID NO: 4008973 - RNA, 19 nt, Human papillomavirus type 11
acgcaacaauaauggugau

SEQ ID NO: 4008974 - RNA, 23 nt, Human papillomavirus type 11
acuaaaugugcuaaguguaaauc

SEQ ID NO: 4008975 - RNA, 22 nt, Human papillomavirus type 11
acuaacacuucuuuuauauuug

SEQ ID NO: 4008976 - RNA, 19 nt, Human papillomavirus type 11
acugaaaaaacuaaaugug

SEQ ID NO: 4008977 - RNA, 21 nt, Human papillomavirus type 11
acuuuauugaugacaggcaua

SEQ ID NO: 4008978 - RNA, 14 nt, Human papillomavirus type 11
agaaagugagauaa

SEQ ID NO: 4008979 - RNA, 16 nt, Human papillomavirus type 11
agaauccuuagcaaaa

SEQ ID NO: 4008980 - RNA, 12 nt, Human papillomavirus type 11
agcacaggcauu

SEQ ID NO: 4008981 - RNA, 21 nt, Human papillomavirus type 11
agcucagaagaugagguggac

SEQ ID NO: 4008982 - RNA, 20 nt, Human papillomavirus type 11
aggcguugguguuagugggc

SEQ ID NO: 4008983 - RNA, 18 nt, Human papillomavirus type 11
agguggaggacagugggu

SEQ ID NO: 4008984 - RNA, 15 nt, Human papillomavirus type 11
aguaugguguggaac

SEQ ID NO: 4008985 - RNA, 20 nt, Human papillomavirus type 11
aguccacgguuagacgccau

SEQ ID NO: 4008986 - RNA, 12 nt, Human papillomavirus type 11
agugcuugugga

SEQ ID NO: 4008987 - RNA, 18 nt, Human papillomavirus type 11
aguugaacauacuacuau

SEQ ID NO: 4008988 - RNA, 17 nt, Human papillomavirus type 11
auacccuugggaagcuc

SEQ ID NO: 4008989 - RNA, 21 nt, Human papillomavirus type 11
auaucaauauagaguguuuaa

SEQ ID NO: 4008990 - RNA, 13 nt, Human papillomavirus type 11
auauguguacaua

SEQ ID NO: 4008991 - RNA, 14 nt, Human papillomavirus type 11
auauguguacauaa

SEQ ID NO: 4008992 - RNA, 19 nt, Human papillomavirus type 11
auauguguauguuauguau

SEQ ID NO: 4008993 - RNA, 13 nt, Human papillomavirus type 11
auauuuguggaau

SEQ ID NO: 4008994 - RNA, 17 nt, Human papillomavirus type 11
augcuauugaaaugcaa

SEQ ID NO: 4008995 - RNA, 19 nt, Human papillomavirus type 11
auguaauuccuaaaguuga

SEQ ID NO: 4008996 - RNA, 16 nt, Human papillomavirus type 11
auguauguuuuugugc

SEQ ID NO: 4008997 - RNA, 13 nt, Human papillomavirus type 11
auguuucuuguau

SEQ ID NO: 4008998 - RNA, 18 nt, Human papillomavirus type 11
auuacagggcuguacaug

SEQ ID NO: 4008999 - RNA, 15 nt, Human papillomavirus type 11
auuccaauuguuuaa

SEQ ID NO: 4009000 - RNA, 13 nt, Human papillomavirus type 11
auuuguuugaauu

SEQ ID NO: 4009001 - RNA, 14 nt, Human papillomavirus type 11
caagaccuuuugcu

SEQ ID NO: 4009002 - RNA, 12 nt, Human papillomavirus type 11
caauuguaacau

SEQ ID NO: 4009003 - RNA, 17 nt, Human papillomavirus type 11
cacauuaugcauuggaa

SEQ ID NO: 4009004 - RNA, 14 nt, Human papillomavirus type 11
caccauuaacugug

SEQ ID NO: 4009005 - RNA, 15 nt, Human papillomavirus type 11
cacguccgccagugc

SEQ ID NO: 4009006 - RNA, 17 nt, Human papillomavirus type 11
cagaagaugaggaagag

SEQ ID NO: 4009007 - RNA, 15 nt, Human papillomavirus type 11
cagcucagaagauga

SEQ ID NO: 4009008 - RNA, 16 nt, Human papillomavirus type 11
cagcucagaagaugag

SEQ ID NO: 4009009 - RNA, 16 nt, Human papillomavirus type 11
cagguacacaaauauc

SEQ ID NO: 4009010 - RNA, 15 nt, Human papillomavirus type 11
cauaaugcuauugaa

SEQ ID NO: 4009011 - RNA, 19 nt, Human papillomavirus type 11
cauaguagagcacacuaca

SEQ ID NO: 4009012 - RNA, 20 nt, Human papillomavirus type 11
cauauauaccugcaggacaa

SEQ ID NO: 4009013 - RNA, 17 nt, Human papillomavirus type 11
caugaacuagaguaaac

SEQ ID NO: 4009014 - RNA, 13 nt, Human papillomavirus type 11
cauuacaggacac

SEQ ID NO: 4009015 - RNA, 16 nt, Human papillomavirus type 11
cauuuauuguaaccau

SEQ ID NO: 4009016 - RNA, 16 nt, Human papillomavirus type 11
ccuguugcuguggaug

SEQ ID NO: 4009017 - RNA, 17 nt, Human papillomavirus type 11
cucccaagccugcuauu

SEQ ID NO: 4009018 - RNA, 15 nt, Human papillomavirus type 11
cugcuauuacugggg

SEQ ID NO: 4009019 - RNA, 18 nt, Human papillomavirus type 11
cuguuguuauugcauuug

SEQ ID NO: 4009020 - RNA, 20 nt, Human papillomavirus type 11
cuguuguuauugcauuugca

SEQ ID NO: 4009021 - RNA, 20 nt, Human papillomavirus type 11
gacaccaguuaugaaaugug

SEQ ID NO: 4009022 - RNA, 21 nt, Human papillomavirus type 11
gacagcucagaagaugaggug

SEQ ID NO: 4009023 - RNA, 15 nt, Human papillomavirus type 11
gacgauucagguaca

SEQ ID NO: 4009024 - RNA, 14 nt, Human papillomavirus type 11
gacguaaacgugcg

SEQ ID NO: 4009025 - RNA, 21 nt, Human papillomavirus type 11
gaggggucgggguguacagga

SEQ ID NO: 4009026 - RNA, 19 nt, Human papillomavirus type 11
gauacaugguuguuucugu

SEQ ID NO: 4009027 - RNA, 16 nt, Human papillomavirus type 11
gauauugccuguuguu

SEQ ID NO: 4009028 - RNA, 23 nt, Human papillomavirus type 11
gaugaggaagaggagguggagga

SEQ ID NO: 4009029 - RNA, 19 nt, Human papillomavirus type 11
gcaacaacuacaacauuga

SEQ ID NO: 4009030 - RNA, 19 nt, Human papillomavirus type 11
gcaaggccacugguacaug

SEQ ID NO: 4009031 - RNA, 14 nt, Human papillomavirus type 11
gcauuggaaaugca

SEQ ID NO: 4009032 - RNA, 17 nt, Human papillomavirus type 11
gcauuugcaguauguau

SEQ ID NO: 4009033 - RNA, 14 nt, Human papillomavirus type 11
gccacugguacaug

SEQ ID NO: 4009034 - RNA, 16 nt, Human papillomavirus type 11
gccauaguagagcaca

SEQ ID NO: 4009035 - RNA, 16 nt, Human papillomavirus type 11
gcguauguuaaacgca

SEQ ID NO: 4009036 - RNA, 18 nt, Human papillomavirus type 11
gcuaugagcaauuagaag

SEQ ID NO: 4009037 - RNA, 21 nt, Human papillomavirus type 11
gcuauugaaaugcaaaugcau

SEQ ID NO: 4009038 - RNA, 14 nt, Human papillomavirus type 11
ggaagcacaggcau

SEQ ID NO: 4009039 - RNA, 17 nt, Human papillomavirus type 11
ggacauuacaggacacc

SEQ ID NO: 4009040 - RNA, 13 nt, Human papillomavirus type 11
ggaugugacagca

SEQ ID NO: 4009041 - RNA, 14 nt, Human papillomavirus type 11
guauauguguacau

SEQ ID NO: 4009042 - RNA, 22 nt, Human papillomavirus type 11
gugauaauggagauuaugugua

SEQ ID NO: 4009043 - RNA, 19 nt, Human papillomavirus type 11
gugauguuaaccugucacu

SEQ ID NO: 4009044 - RNA, 15 nt, Human papillomavirus type 11
gugcuauuuuccugc

SEQ ID NO: 4009045 - RNA, 19 nt, Human papillomavirus type 11
guuacauugcuaugagcaa

SEQ ID NO: 4009046 - RNA, 21 nt, Human papillomavirus type 11
uaauggagauuauguguacau

SEQ ID NO: 4009047 - RNA, 14 nt, Human papillomavirus type 11
uacaaauugcugca

SEQ ID NO: 4009048 - RNA, 20 nt, Human papillomavirus type 11
uaccaccauuaacuguguca

SEQ ID NO: 4009049 - RNA, 22 nt, Human papillomavirus type 11
uacuaacacugugugugugcua

SEQ ID NO: 4009050 - RNA, 18 nt, Human papillomavirus type 11
uagugccuguacaaauug

SEQ ID NO: 4009051 - RNA, 21 nt, Human papillomavirus type 11
uauauauguauauguguacau

SEQ ID NO: 4009052 - RNA, 22 nt, Human papillomavirus type 11
uauauauuuguggaauguguau

SEQ ID NO: 4009053 - RNA, 10 nt, Human papillomavirus type 11
uauauguuuc

SEQ ID NO: 4009054 - RNA, 23 nt, Human papillomavirus type 11
uauauguuucuuguauuguguau

SEQ ID NO: 4009055 - RNA, 15 nt, Human papillomavirus type 11
uaucagaagaugagg

SEQ ID NO: 4009056 - RNA, 20 nt, Human papillomavirus type 11
uaucugauuuuguaguauau

SEQ ID NO: 4009057 - RNA, 19 nt, Human papillomavirus type 11
uauguaaguccuauaagca

SEQ ID NO: 4009058 - RNA, 14 nt, Human papillomavirus type 11
uaugucauuacauu

SEQ ID NO: 4009059 - RNA, 14 nt, Human papillomavirus type 11
uauguuguuaugua

SEQ ID NO: 4009060 - RNA, 22 nt, Human papillomavirus type 11
uauguuguuguaguguguauau

SEQ ID NO: 4009061 - RNA, 22 nt, Human papillomavirus type 11
uauguuucuuguauuguguaua

SEQ ID NO: 4009062 - RNA, 14 nt, Human papillomavirus type 11
uauuauauuauaua

SEQ ID NO: 4009063 - RNA, 12 nt, Human papillomavirus type 11
uauuuuccugcc

SEQ ID NO: 4009064 - RNA, 18 nt, Human papillomavirus type 11
ucagccacacaacuauau

SEQ ID NO: 4009065 - RNA, 15 nt, Human papillomavirus type 11
ucugauuuuguagua

SEQ ID NO: 4009066 - RNA, 16 nt, Human papillomavirus type 11
ugaauuagcaucuuca

SEQ ID NO: 4009067 - RNA, 18 nt, Human papillomavirus type 11
ugauucaucccuguuuga

SEQ ID NO: 4009068 - RNA, 17 nt, Human papillomavirus type 11
ugcagccuccugacccu

SEQ ID NO: 4009069 - RNA, 13 nt, Human papillomavirus type 11
uggauuaugugua

SEQ ID NO: 4009070 - RNA, 14 nt, Human papillomavirus type 11
uguaacauuaacau

SEQ ID NO: 4009071 - RNA, 18 nt, Human papillomavirus type 11
uguauauguguauauguu

SEQ ID NO: 4009072 - RNA, 15 nt, Human papillomavirus type 11
uguauauguuucuug

SEQ ID NO: 4009073 - RNA, 18 nt, Human papillomavirus type 11
uguauguuuuugugcaau

SEQ ID NO: 4009074 - RNA, 13 nt, Human papillomavirus type 11
ugugguauggaca

SEQ ID NO: 4009075 - RNA, 17 nt, Human papillomavirus type 11
uguuguuacuacauuac

SEQ ID NO: 4009076 - RNA, 23 nt, Human papillomavirus type 11
uguuucugugguuguuuacugca

SEQ ID NO: 4009077 - RNA, 23 nt, Human papillomavirus type 11
uuacaccuguauauauguauaug

SEQ ID NO: 4009078 - RNA, 19 nt, Human papillomavirus type 11
uuaccaaauacugaccugu

SEQ ID NO: 4009079 - RNA, 19 nt, Human papillomavirus type 11
uuauacaguguguggugua

SEQ ID NO: 4009080 - RNA, 18 nt, Human papillomavirus type 11
uuaugcauuggaaaugca

SEQ ID NO: 4009081 - RNA, 17 nt, Human papillomavirus type 11
uuauuaaugcuggugca

SEQ ID NO: 4009082 - RNA, 16 nt, Human papillomavirus type 11
uucaucccuguuugac

SEQ ID NO: 4009083 - RNA, 14 nt, Human papillomavirus type 11
uugcagaucaaaua

SEQ ID NO: 4009084 - RNA, 22 nt, Human papillomavirus type 11
uugcauuaccugauucaucccu

SEQ ID NO: 4009085 - RNA, 21 nt, Human papillomavirus type 11
uuguaaccauuacaccuguau

SEQ ID NO: 4009086 - RNA, 15 nt, Human papillomavirus type 11
uuguguauaugugua

SEQ ID NO: 4009087 - RNA, 16 nt, Human papillomavirus type 11
uuguguauauguguau

SEQ ID NO: 4009088 - RNA, 13 nt, Human papillomavirus type 11
uuguuauguaugu

SEQ ID NO: 4009089 - RNA, 17 nt, Human papillomavirus type 11
uuuaugguagaagccau

SEQ ID NO: 4009090 - RNA, 20 nt, Human papillomavirus type 11
uuuucgguugcccuuacaua

SEQ ID NO: 4009091 - RNA, 17 nt, Human papillomavirus type 11
uauaauauuaauaucug

SEQ ID NO: 4009092 - RNA, 16 nt, Human papillomavirus type 11
uauacacauauacauu

SEQ ID NO: 4009093 - RNA, 15 nt, Human papillomavirus type 11
uauauguuuguguau

SEQ ID NO: 4009094 - RNA, 20 nt, Human papillomavirus type 11
uaucaauauagaguguuuaa

SEQ ID NO: 4009095 - RNA, 12 nt, Human papillomavirus type 11
uaucugauuuug

SEQ ID NO: 4009096 - RNA, 15 nt, Human papillomavirus type 11
uauguuuuugugcaa

SEQ ID NO: 4009097 - RNA, 20 nt, Human papillomavirus type 11
uauguuuuugugcaauaaac

SEQ ID NO: 4009098 - RNA, 18 nt, Human papillomavirus type 11
uauuacuacacaaagcaa

SEQ ID NO: 4009099 - RNA, 16 nt, Human papillomavirus type 11
uauuacucuaucaaaa

SEQ ID NO: 4009100 - RNA, 13 nt, Human papillomavirus type 11
uccaauuguuuaa

SEQ ID NO: 4009101 - RNA, 23 nt, Human papillomavirus type 11
ucccaagccugcuauuacugggg

SEQ ID NO: 4009102 - RNA, 22 nt, Human papillomavirus type 11
uccuaaaguugaacauacuacu

SEQ ID NO: 4009103 - RNA, 17 nt, Human papillomavirus type 11
ugaggcaccacauaaaa

SEQ ID NO: 4009104 - RNA, 19 nt, Human papillomavirus type 11
ugauacaugguuguuucug

SEQ ID NO: 4009105 - RNA, 20 nt, Human papillomavirus type 11
ugauuuuguaguauauacau

SEQ ID NO: 4009106 - RNA, 22 nt, Human papillomavirus type 11
ugcaggguauauacccuuggga

SEQ ID NO: 4009107 - RNA, 17 nt, Human papillomavirus type 11
ugcauuggaaaugcaua

SEQ ID NO: 4009108 - RNA, 18 nt, Human papillomavirus type 11
ugccuuuuauauacacau

SEQ ID NO: 4009109 - RNA, 12 nt, Human papillomavirus type 11
ugcuauuuuccu

SEQ ID NO: 4009110 - RNA, 16 nt, Human papillomavirus type 11
uggaagcacaggcauu

SEQ ID NO: 4009111 - RNA, 18 nt, Human papillomavirus type 11
uggaauguguauguaugu

SEQ ID NO: 4009112 - RNA, 16 nt, Human papillomavirus type 11
uggacauuacaggaca

SEQ ID NO: 4009113 - RNA, 15 nt, Human papillomavirus type 11
uggauuguuguuacu

SEQ ID NO: 4009114 - RNA, 23 nt, Human papillomavirus type 11
ugguagaagccauaguagagcac

SEQ ID NO: 4009115 - RNA, 19 nt, Human papillomavirus type 11
uguacuaaucccauauguu

SEQ ID NO: 4009116 - RNA, 13 nt, Human papillomavirus type 11
uguauauauguau

SEQ ID NO: 4009117 - RNA, 14 nt, Human papillomavirus type 11
uguauauauguaua

SEQ ID NO: 4009118 - RNA, 22 nt, Human papillomavirus type 11
uguauauauguauauguguaca

SEQ ID NO: 4009119 - RNA, 18 nt, Human papillomavirus type 11
uguauuacuacacaaagc

SEQ ID NO: 4009120 - RNA, 19 nt, Human papillomavirus type 11
ugugcaggaccuaaaacga

SEQ ID NO: 4009121 - RNA, 15 nt, Human papillomavirus type 11
ugugcuauuuuccug

SEQ ID NO: 4009122 - RNA, 16 nt, Human papillomavirus type 11
uguggaaccuuggaca

SEQ ID NO: 4009123 - RNA, 22 nt, Human papillomavirus type 11
uguguacauaacauacguguau

SEQ ID NO: 4009124 - RNA, 21 nt, Human papillomavirus type 11
ugugucagagacuaaaggaca

SEQ ID NO: 4009125 - RNA, 19 nt, Human papillomavirus type 11
uguguuuaguguguguaua

SEQ ID NO: 4009126 - RNA, 13 nt, Human papillomavirus type 11
uguugccuucaua

SEQ ID NO: 4009127 - RNA, 23 nt, Human papillomavirus type 11
uuacaacacagccaaaaaaggua

SEQ ID NO: 4009128 - RNA, 17 nt, Human papillomavirus type 11
uuaugaaauguggcuaa

SEQ ID NO: 4009129 - RNA, 15 nt, Human papillomavirus type 11
uuauguauguuaugu

SEQ ID NO: 4009130 - RNA, 14 nt, Human papillomavirus type 11
uuauguauguuugu

SEQ ID NO: 4009131 - RNA, 18 nt, Human papillomavirus type 11
uuauuauguguguccugu

SEQ ID NO: 4009132 - RNA, 16 nt, Human papillomavirus type 11
uugauggcugugaaga

SEQ ID NO: 4009133 - RNA, 12 nt, Human papillomavirus type 11
uuggaaaugcau

SEQ ID NO: 4009134 - RNA, 15 nt, Human papillomavirus type 11
uuguaguauauacau

SEQ ID NO: 4009135 - RNA, 14 nt, Human papillomavirus type 11
uuuaguguguguau

SEQ ID NO: 4009136 - RNA, 11 nt, Human papillomavirus type 11
uuuauauacac

SEQ ID NO: 4009137 - RNA, 20 nt, Human papillomavirus type 11
uuucugugguuguuuacugc

SEQ ID NO: 4009138 - RNA, 21 nt, Human papillomavirus type 11
uuuguguguuuagugugugua

SEQ ID NO: 4009139 - RNA, 13 nt, Human papillomavirus type 11
uuuuaucaugcca

SEQ ID NO: 4009140 - RNA, 17 nt, Human papillomavirus type 11
uuuuuaaacaguguaaa

SEQ ID NO: 4009141 - RNA, 16 nt, Human papillomavirus type 16
aaaacaugcaaacagg

SEQ ID NO: 4009142 - RNA, 23 nt, Human papillomavirus type 16
aaaauguuuaagauauagauuua

SEQ ID NO: 4009143 - RNA, 15 nt, Human papillomavirus type 16
aaacguucugcaaaa

SEQ ID NO: 4009144 - RNA, 14 nt, Human papillomavirus type 16
aaagcauuacaagc

SEQ ID NO: 4009145 - RNA, 19 nt, Human papillomavirus type 16
aaaugcuuguguaacuauu

SEQ ID NO: 4009146 - RNA, 15 nt, Human papillomavirus type 16
aacaggauguauaaa

SEQ ID NO: 4009147 - RNA, 22 nt, Human papillomavirus type 16
aagcacggaugaauauguugca

SEQ ID NO: 4009148 - RNA, 11 nt, Human papillomavirus type 16
aauaaagcauu

SEQ ID NO: 4009149 - RNA, 20 nt, Human papillomavirus type 16
aaugcauuauacaaacugga

SEQ ID NO: 4009150 - RNA, 22 nt, Human papillomavirus type 16
aauggcaacgugaccaauuuuu

SEQ ID NO: 4009151 - RNA, 22 nt, Human papillomavirus type 16
aaugugcuauuuauuacaaggc

SEQ ID NO: 4009152 - RNA, 21 nt, Human papillomavirus type 16
acauaugcaauacaaugcauu

SEQ ID NO: 4009153 - RNA, 11 nt, Human papillomavirus type 16
acauccagacu

SEQ ID NO: 4009154 - RNA, 20 nt, Human papillomavirus type 16
acgcuuuuuaauuacauaau

SEQ ID NO: 4009155 - RNA, 14 nt, Human papillomavirus type 16
acuauauuugcuac

SEQ ID NO: 4009156 - RNA, 13 nt, Human papillomavirus type 16
acugcagugucgu

SEQ ID NO: 4009157 - RNA, 17 nt, Human papillomavirus type 16
acugcauccacaacauu

SEQ ID NO: 4009158 - RNA, 18 nt, Human papillomavirus type 16
agaaaccauaaucuacca

SEQ ID NO: 4009159 - RNA, 18 nt, Human papillomavirus type 16
agacauaugcaauacaau

SEQ ID NO: 4009160 - RNA, 22 nt, Human papillomavirus type 16
agacauaugcaauacaaugcau

SEQ ID NO: 4009161 - RNA, 21 nt, Human papillomavirus type 16
aggugaugcuaauacuuuaaa

SEQ ID NO: 4009162 - RNA, 19 nt, Human papillomavirus type 16
agguucuaaaacgaaagua

SEQ ID NO: 4009163 - RNA, 13 nt, Human papillomavirus type 16
agugauacaggug

SEQ ID NO: 4009164 - RNA, 14 nt, Human papillomavirus type 16
aguguauuuaacug

SEQ ID NO: 4009165 - RNA, 17 nt, Human papillomavirus type 16
auaaauaaacuuauugu

SEQ ID NO: 4009166 - RNA, 20 nt, Human papillomavirus type 16
auaauguaauuguuacauau

SEQ ID NO: 4009167 - RNA, 16 nt, Human papillomavirus type 16
aucuugauacugcauc

SEQ ID NO: 4009168 - RNA, 20 nt, Human papillomavirus type 16
augacgagaacgaaaaugac

SEQ ID NO: 4009169 - RNA, 15 nt, Human papillomavirus type 16
auggagacauaugca

SEQ ID NO: 4009170 - RNA, 20 nt, Human papillomavirus type 16
auguauagaaaaacaaagua

SEQ ID NO: 4009171 - RNA, 22 nt, Human papillomavirus type 16
auguuuaagauauagauuuaaa

SEQ ID NO: 4009172 - RNA, 13 nt, Human papillomavirus type 16
auguuuguaugug

SEQ ID NO: 4009173 - RNA, 18 nt, Human papillomavirus type 16
auuauacaaacuggacac

SEQ ID NO: 4009174 - RNA, 23 nt, Human papillomavirus type 16
auuuaacacaggcagaaacagag

SEQ ID NO: 4009175 - RNA, 20 nt, Human papillomavirus type 16
auuugcaaccagagacaacu

SEQ ID NO: 4009176 - RNA, 22 nt, Human papillomavirus type 16
auuugugaagaagcaucaguaa

SEQ ID NO: 4009177 - RNA, 14 nt, Human papillomavirus type 16
auuuuugucucaag

SEQ ID NO: 4009178 - RNA, 23 nt, Human papillomavirus type 16
caauaaguuugguuuuccugaca

SEQ ID NO: 4009179 - RNA, 15 nt, Human papillomavirus type 16
caauggggaagaggg

SEQ ID NO: 4009180 - RNA, 17 nt, Human papillomavirus type 16
caauuguuacacuuaca

SEQ ID NO: 4009181 - RNA, 23 nt, Human papillomavirus type 16
cacaauauaguaaugaaaagugg

SEQ ID NO: 4009182 - RNA, 13 nt, Human papillomavirus type 16
cagaaacagagac

SEQ ID NO: 4009183 - RNA, 15 nt, Human papillomavirus type 16
cagaaacagagacag

SEQ ID NO: 4009184 - RNA, 13 nt, Human papillomavirus type 16
cagcucagaggag

SEQ ID NO: 4009185 - RNA, 15 nt, Human papillomavirus type 16
cagcucagaggagga

SEQ ID NO: 4009186 - RNA, 15 nt, Human papillomavirus type 16
caucaguaacugugg

SEQ ID NO: 4009187 - RNA, 17 nt, Human papillomavirus type 16
cauuacuggcgugcuuu

SEQ ID NO: 4009188 - RNA, 16 nt, Human papillomavirus type 16
cccaucuguucucaga

SEQ ID NO: 4009189 - RNA, 23 nt, Human papillomavirus type 16
ccuaagguugaaggcaaaacuau

SEQ ID NO: 4009190 - RNA, 23 nt, Human papillomavirus type 16
ccuugaaguguauuuaacugcac

SEQ ID NO: 4009191 - RNA, 13 nt, Human papillomavirus type 16
cuacauacacauc

SEQ ID NO: 4009192 - RNA, 16 nt, Human papillomavirus type 16
aaaacauggauauaca

SEQ ID NO: 4009193 - RNA, 14 nt, Human papillomavirus type 16
aaacacguguguau

SEQ ID NO: 4009194 - RNA, 20 nt, Human papillomavirus type 16
aaacuauugcugaacaaaua

SEQ ID NO: 4009195 - RNA, 12 nt, Human papillomavirus type 16
aaauaaacuuau

SEQ ID NO: 4009196 - RNA, 16 nt, Human papillomavirus type 16
aaaucuugauacugca

SEQ ID NO: 4009197 - RNA, 19 nt, Human papillomavirus type 16
aaaugggauuuaaacauau

SEQ ID NO: 4009198 - RNA, 19 nt, Human papillomavirus type 16
aacauccagacuacuugca

SEQ ID NO: 4009199 - RNA, 17 nt, Human papillomavirus type 16
aacuauugcugaacaaa

SEQ ID NO: 4009200 - RNA, 11 nt, Human papillomavirus type 16
aauaaacuguu

SEQ ID NO: 4009201 - RNA, 18 nt, Human papillomavirus type 16
aauacuuuaaaauguuua

SEQ ID NO: 4009202 - RNA, 19 nt, Human papillomavirus type 16
aauguaaaacauaaaagug

SEQ ID NO: 4009203 - RNA, 16 nt, Human papillomavirus type 16
acaagcaauugaacug

SEQ ID NO: 4009204 - RNA, 11 nt, Human papillomavirus type 16
acauacacaug

SEQ ID NO: 4009205 - RNA, 19 nt, Human papillomavirus type 16
acccaacuuuauaaaacau

SEQ ID NO: 4009206 - RNA, 22 nt, Human papillomavirus type 16
accucauuuuauaauccagaua

SEQ ID NO: 4009207 - RNA, 17 nt, Human papillomavirus type 16
acuuuaaaauguuuaag

SEQ ID NO: 4009208 - RNA, 23 nt, Human papillomavirus type 16
agcagaaccggacagagcccauu

SEQ ID NO: 4009209 - RNA, 22 nt, Human papillomavirus type 16
aggccucccacagcuacagaua

SEQ ID NO: 4009210 - RNA, 17 nt, Human papillomavirus type 16
agugcuuaugcagcaaa

SEQ ID NO: 4009211 - RNA, 17 nt, Human papillomavirus type 16
aguguauuuaacugcac

SEQ ID NO: 4009212 - RNA, 17 nt, Human papillomavirus type 16
auaaacacguguguaug

SEQ ID NO: 4009213 - RNA, 15 nt, Human papillomavirus type 16
auacuuuaaaauguu

SEQ ID NO: 4009214 - RNA, 14 nt, Human papillomavirus type 16
augcaguacagguu

SEQ ID NO: 4009215 - RNA, 18 nt, Human papillomavirus type 16
auggagacauaugcaaua

SEQ ID NO: 4009216 - RNA, 21 nt, Human papillomavirus type 16
auguaauuguuacauauaauu

SEQ ID NO: 4009217 - RNA, 22 nt, Human papillomavirus type 16
auguuagauuugcaaccagaga

SEQ ID NO: 4009218 - RNA, 17 nt, Human papillomavirus type 16
auuacaagcaauugaac

SEQ ID NO: 4009219 - RNA, 15 nt, Human papillomavirus type 16
auuauauuuguuuau

SEQ ID NO: 4009220 - RNA, 21 nt, Human papillomavirus type 16
auuguuacacuuacauaugau

SEQ ID NO: 4009221 - RNA, 16 nt, Human papillomavirus type 16
auuuaaacauauuaac

SEQ ID NO: 4009222 - RNA, 18 nt, Human papillomavirus type 16
auuugaaagcgaagacag

SEQ ID NO: 4009223 - RNA, 15 nt, Human papillomavirus type 16
caaguggugccaaca

SEQ ID NO: 4009224 - RNA, 22 nt, Human papillomavirus type 16
caaugcauuauacaaacuggac

SEQ ID NO: 4009225 - RNA, 13 nt, Human papillomavirus type 16
caccuacauugca

SEQ ID NO: 4009226 - RNA, 15 nt, Human papillomavirus type 16
cagaaccggacagag

SEQ ID NO: 4009227 - RNA, 16 nt, Human papillomavirus type 16
caggcagaaacagaga

SEQ ID NO: 4009228 - RNA, 20 nt, Human papillomavirus type 16
cagguaccaauggggaagag

SEQ ID NO: 4009229 - RNA, 14 nt, Human papillomavirus type 16
caugaauauauguu

SEQ ID NO: 4009230 - RNA, 17 nt, Human papillomavirus type 16
caugcaaacaggcaggu

SEQ ID NO: 4009231 - RNA, 15 nt, Human papillomavirus type 16
ccagcuggacaagca

SEQ ID NO: 4009232 - RNA, 18 nt, Human papillomavirus type 16
ccauccuuuauuaaauaa

SEQ ID NO: 4009233 - RNA, 13 nt, Human papillomavirus type 16
cucagaggaggag

SEQ ID NO: 4009234 - RNA, 19 nt, Human papillomavirus type 16
cucauuuuauaauccagau

SEQ ID NO: 4009235 - RNA, 22 nt, Human papillomavirus type 16
cugcaccaacaggauguauaaa

SEQ ID NO: 4009236 - RNA, 22 nt, Human papillomavirus type 16
cuugaaguguauuuaacugcac

SEQ ID NO: 4009237 - RNA, 18 nt, Human papillomavirus type 16
cuuugcuuugugugcuuu

SEQ ID NO: 4009238 - RNA, 15 nt, Human papillomavirus type 16
gaaacagagacagca

SEQ ID NO: 4009239 - RNA, 20 nt, Human papillomavirus type 16
auguauaaaaaaacauggau

SEQ ID NO: 4009240 - RNA, 17 nt, Human papillomavirus type 16
augucuauaugacaaau

SEQ ID NO: 4009241 - RNA, 16 nt, Human papillomavirus type 16
auguugcacgcacaaa

SEQ ID NO: 4009242 - RNA, 20 nt, Human papillomavirus type 16
auuacuuaacaaugcgacac

SEQ ID NO: 4009243 - RNA, 14 nt, Human papillomavirus type 16
auugaacugcaacu

SEQ ID NO: 4009244 - RNA, 14 nt, Human papillomavirus type 16
auuuaaaaagcauu

SEQ ID NO: 4009245 - RNA, 13 nt, Human papillomavirus type 16
auuuaccugaccc

SEQ ID NO: 4009246 - RNA, 17 nt, Human papillomavirus type 16
auuuuuaauacauacac

SEQ ID NO: 4009247 - RNA, 22 nt, Human papillomavirus type 16
caaaaacuauuacagugucuac

SEQ ID NO: 4009248 - RNA, 15 nt, Human papillomavirus type 16
caaaacaacauagag

SEQ ID NO: 4009249 - RNA, 20 nt, Human papillomavirus type 16
caagcaauugaacugcaacu

SEQ ID NO: 4009250 - RNA, 22 nt, Human papillomavirus type 16
caccaaguggugccaacacugg

SEQ ID NO: 4009251 - RNA, 22 nt, Human papillomavirus type 16
caggauguauaaaaaaacaugg

SEQ ID NO: 4009252 - RNA, 22 nt, Human papillomavirus type 16
cagguaccaauggggaagaggg

SEQ ID NO: 4009253 - RNA, 20 nt, Human papillomavirus type 16
caguuugauggagacauaug

SEQ ID NO: 4009254 - RNA, 17 nt, Human papillomavirus type 16
cauauauauauuuguga

SEQ ID NO: 4009255 - RNA, 20 nt, Human papillomavirus type 16
cauguccaccugacauuaua

SEQ ID NO: 4009256 - RNA, 14 nt, Human papillomavirus type 16
cauuauacaaacug

SEQ ID NO: 4009257 - RNA, 20 nt, Human papillomavirus type 16
cauuauuuuuaauacauaca

SEQ ID NO: 4009258 - RNA, 21 nt, Human papillomavirus type 16
ccaaguggugccaacacuggc

SEQ ID NO: 4009259 - RNA, 21 nt, Human papillomavirus type 16
ccauauagacuauuggaaaca

SEQ ID NO: 4009260 - RNA, 15 nt, Human papillomavirus type 16
ccuguuuuuguuuua

SEQ ID NO: 4009261 - RNA, 19 nt, Human papillomavirus type 16
cuaauacuuuaaaauguuu

SEQ ID NO: 4009262 - RNA, 17 nt, Human papillomavirus type 16
cuauaugacaaaucuug

SEQ ID NO: 4009263 - RNA, 16 nt, Human papillomavirus type 16
cuaugguuuaaacuug

SEQ ID NO: 4009264 - RNA, 17 nt, Human papillomavirus type 16
cugaucucuacuguuau

SEQ ID NO: 4009265 - RNA, 21 nt, Human papillomavirus type 16
cuggcuguaucaaagaauaaa

SEQ ID NO: 4009266 - RNA, 23 nt, Human papillomavirus type 16
gaauauguugcacgcacaaacau

SEQ ID NO: 4009267 - RNA, 16 nt, Human papillomavirus type 16
gagaugcaguacaggu

SEQ ID NO: 4009268 - RNA, 20 nt, Human papillomavirus type 16
gagcugcaaaaaggagauua

SEQ ID NO: 4009269 - RNA, 16 nt, Human papillomavirus type 16
gaggguacgggaugua

SEQ ID NO: 4009270 - RNA, 16 nt, Human papillomavirus type 16
gauccugcagguacca

SEQ ID NO: 4009271 - RNA, 20 nt, Human papillomavirus type 16
gccucccacagcuacagaua

SEQ ID NO: 4009272 - RNA, 14 nt, Human papillomavirus type 16
gcuggacaagcaga

SEQ ID NO: 4009273 - RNA, 13 nt, Human papillomavirus type 16
gcuuaugcagcaa

SEQ ID NO: 4009274 - RNA, 16 nt, Human papillomavirus type 16
gcuuuugugugucugc

SEQ ID NO: 4009275 - RNA, 15 nt, Human papillomavirus type 16
ggcagaaacagagac

SEQ ID NO: 4009276 - RNA, 21 nt, Human papillomavirus type 16
guuucaacaccuacuaauugu

SEQ ID NO: 4009277 - RNA, 16 nt, Human papillomavirus type 16
uaacuauugugucaug

SEQ ID NO: 4009278 - RNA, 21 nt, Human papillomavirus type 16
uaaguuguauguguguuugua

SEQ ID NO: 4009279 - RNA, 20 nt, Human papillomavirus type 16
uaauaaacuguuauuacuua

SEQ ID NO: 4009280 - RNA, 12 nt, Human papillomavirus type 16
uaauuacauaau

SEQ ID NO: 4009281 - RNA, 13 nt, Human papillomavirus type 16
uacauacacauca

SEQ ID NO: 4009282 - RNA, 14 nt, Human papillomavirus type 16
uacuuuaaaauguu

SEQ ID NO: 4009283 - RNA, 22 nt, Human papillomavirus type 16
uagauuaaaagcuauauguaua

SEQ ID NO: 4009284 - RNA, 21 nt, Human papillomavirus type 16
uagauuuuauaguaaaugaua

SEQ ID NO: 4009285 - RNA, 16 nt, Human papillomavirus type 16
uagguguuuuauugua

SEQ ID NO: 4009286 - RNA, 20 nt, Human papillomavirus type 16
uauagacuauuggaaacaca

SEQ ID NO: 4009287 - RNA, 13 nt, Human papillomavirus type 16
uauauguuuguau

SEQ ID NO: 4009288 - RNA, 21 nt, Human papillomavirus type 16
uauauguuuguaugugcuugu

SEQ ID NO: 4009289 - RNA, 15 nt, Human papillomavirus type 16
uaugcagcaaaugca

SEQ ID NO: 4009290 - RNA, 20 nt, Human papillomavirus type 16
uaugucuauaugacaaaucu

SEQ ID NO: 4009291 - RNA, 16 nt, Human papillomavirus type 16
uauuacuauuguggau

SEQ ID NO: 4009292 - RNA, 18 nt, Human papillomavirus type 16
uccacaacauuacuggcg

SEQ ID NO: 4009293 - RNA, 19 nt, Human papillomavirus type 16
uccacaacauuacuggcgu

SEQ ID NO: 4009294 - RNA, 18 nt, Human papillomavirus type 16
ugacacagaaaaugcuag

SEQ ID NO: 4009295 - RNA, 21 nt, Human papillomavirus type 16
ugcugaacaaauauuacaaua

SEQ ID NO: 4009296 - RNA, 11 nt, Human papillomavirus type 16
ugcuuuugugu

SEQ ID NO: 4009297 - RNA, 15 nt, Human papillomavirus type 16
uguauuuaacugcac

SEQ ID NO: 4009298 - RNA, 18 nt, Human papillomavirus type 16
ugucuacauacacaucau

SEQ ID NO: 4009299 - RNA, 17 nt, Human papillomavirus type 16
ugugccccaucuguucu

SEQ ID NO: 4009300 - RNA, 13 nt, Human papillomavirus type 16
ugugucuacauac

SEQ ID NO: 4009301 - RNA, 14 nt, Human papillomavirus type 16
ugugucuacauaca

SEQ ID NO: 4009302 - RNA, 22 nt, Human papillomavirus type 16
cuauaugacaaaucuugauacu

SEQ ID NO: 4009303 - RNA, 16 nt, Human papillomavirus type 16
cuauuacagugucuac

SEQ ID NO: 4009304 - RNA, 18 nt, Human papillomavirus type 16
cugaucucuacuguuaug

SEQ ID NO: 4009305 - RNA, 21 nt, Human papillomavirus type 16
cugcagguaccaauggggaag

SEQ ID NO: 4009306 - RNA, 22 nt, Human papillomavirus type 16
cuuuugucugugucuacauaca

SEQ ID NO: 4009307 - RNA, 22 nt, Human papillomavirus type 16
cuuuuguugcaagugugacucu

SEQ ID NO: 4009308 - RNA, 18 nt, Human papillomavirus type 16
gaaaaacaaaguagagcu

SEQ ID NO: 4009309 - RNA, 13 nt, Human papillomavirus type 16
gaaccggacagag

SEQ ID NO: 4009310 - RNA, 21 nt, Human papillomavirus type 16
gaccauauagacuauuggaaa

SEQ ID NO: 4009311 - RNA, 23 nt, Human papillomavirus type 16
gaugacgagaacgaaaaugacag

SEQ ID NO: 4009312 - RNA, 18 nt, Human papillomavirus type 16
gcaaaacaacauagagau

SEQ ID NO: 4009313 - RNA, 15 nt, Human papillomavirus type 16
gcacaaaauguguuu

SEQ ID NO: 4009314 - RNA, 22 nt, Human papillomavirus type 16
gcacaugcguuguuuacugcac

SEQ ID NO: 4009315 - RNA, 16 nt, Human papillomavirus type 16
gcaggaacauccagac

SEQ ID NO: 4009316 - RNA, 22 nt, Human papillomavirus type 16
guacauaauguaauuguuacau

SEQ ID NO: 4009317 - RNA, 18 nt, Human papillomavirus type 16
gugggcauuaguggccau

SEQ ID NO: 4009318 - RNA, 17 nt, Human papillomavirus type 16
guuacacuuacauauga

SEQ ID NO: 4009319 - RNA, 19 nt, Human papillomavirus type 16
guugugcguacaaagcaca

SEQ ID NO: 4009320 - RNA, 17 nt, Human papillomavirus type 16
uaaaagugcaauuguua

SEQ ID NO: 4009321 - RNA, 22 nt, Human papillomavirus type 16
uaaaugcuuguguaacuauugu

SEQ ID NO: 4009322 - RNA, 20 nt, Human papillomavirus type 16
uaauaaacacguguguaugu

SEQ ID NO: 4009323 - RNA, 14 nt, Human papillomavirus type 16
uagauuaaaagcua

SEQ ID NO: 4009324 - RNA, 21 nt, Human papillomavirus type 16
uauacaaacuggacacauaua

SEQ ID NO: 4009325 - RNA, 14 nt, Human papillomavirus type 16
uauacuauauuuug

SEQ ID NO: 4009326 - RNA, 15 nt, Human papillomavirus type 16
uaugugcuuguaaau

SEQ ID NO: 4009327 - RNA, 14 nt, Human papillomavirus type 16
ucagaugacgagaa

SEQ ID NO: 4009328 - RNA, 18 nt, Human papillomavirus type 16
ucaggauuacaauacagg

SEQ ID NO: 4009329 - RNA, 17 nt, Human papillomavirus type 16
ucugugucuacauacac

SEQ ID NO: 4009330 - RNA, 20 nt, Human papillomavirus type 16
ugacaaaucuugauacugca

SEQ ID NO: 4009331 - RNA, 18 nt, Human papillomavirus type 16
ugaccaauuuuugucuca

SEQ ID NO: 4009332 - RNA, 23 nt, Human papillomavirus type 16
ugaccauauagacuauuggaaac

SEQ ID NO: 4009333 - RNA, 13 nt, Human papillomavirus type 16
ugcuuuugucugu

SEQ ID NO: 4009334 - RNA, 20 nt, Human papillomavirus type 16
ugguaguccacuuagugaua

SEQ ID NO: 4009335 - RNA, 20 nt, Human papillomavirus type 16
uguacauuguauacugcagu

SEQ ID NO: 4009336 - RNA, 16 nt, Human papillomavirus type 16
ugugugccccaucugu

SEQ ID NO: 4009337 - RNA, 19 nt, Human papillomavirus type 16
ugugugccccaucuguucu

SEQ ID NO: 4009338 - RNA, 23 nt, Human papillomavirus type 16
uguugugguuauucauuguauau

SEQ ID NO: 4009339 - RNA, 19 nt, Human papillomavirus type 16
uuaauacauacacaugcac

SEQ ID NO: 4009340 - RNA, 14 nt, Human papillomavirus type 16
uuaauuacauaaug

SEQ ID NO: 4009341 - RNA, 17 nt, Human papillomavirus type 16
uuauacaaacuggacac

SEQ ID NO: 4009342 - RNA, 13 nt, Human papillomavirus type 16
uugaaguguauuu

SEQ ID NO: 4009343 - RNA, 22 nt, Human papillomavirus type 16
uuguaaauauuaaguuguaugu

SEQ ID NO: 4009344 - RNA, 22 nt, Human papillomavirus type 16
uuuaaaaggugaugcuaauacu

SEQ ID NO: 4009345 - RNA, 12 nt, Human papillomavirus type 16
uuuauuaaauaa

SEQ ID NO: 4009346 - RNA, 13 nt, Human papillomavirus type 16
uuuguuguguaua

SEQ ID NO: 4009347 - RNA, 17 nt, Human papillomavirus type 16
aaacauggauauacagu

SEQ ID NO: 4009348 - RNA, 20 nt, Human papillomavirus type 16
aaagcacacacguagacauu

SEQ ID NO: 4009349 - RNA, 12 nt, Human papillomavirus type 16
aacauccagacu

SEQ ID NO: 4009350 - RNA, 17 nt, Human papillomavirus type 16
aacauggauauacagug

SEQ ID NO: 4009351 - RNA, 18 nt, Human papillomavirus type 16
aacucacaauauaguaau

SEQ ID NO: 4009352 - RNA, 12 nt, Human papillomavirus type 16
aaguuguaugug

SEQ ID NO: 4009353 - RNA, 21 nt, Human papillomavirus type 16
aauaaacuguuauuacuuaac

SEQ ID NO: 4009354 - RNA, 14 nt, Human papillomavirus type 16
aauacauacacaug

SEQ ID NO: 4009355 - RNA, 19 nt, Human papillomavirus type 16
aaugacagcucagaggagg

SEQ ID NO: 4009356 - RNA, 18 nt, Human papillomavirus type 16
acacguguguauguguuu

SEQ ID NO: 4009357 - RNA, 13 nt, Human papillomavirus type 16
acagcuacagaua

SEQ ID NO: 4009358 - RNA, 17 nt, Human papillomavirus type 16
acaggugaagauuuggu

SEQ ID NO: 4009359 - RNA, 19 nt, Human papillomavirus type 16
acauauauauauuugugaa

SEQ ID NO: 4009360 - RNA, 22 nt, Human papillomavirus type 16
acauuacuggcgugcuuuuugc

SEQ ID NO: 4009361 - RNA, 14 nt, Human papillomavirus type 16
acauuauaccuaag

SEQ ID NO: 4009362 - RNA, 17 nt, Human papillomavirus type 16
accaaguggugccaaca

SEQ ID NO: 4009363 - RNA, 20 nt, Human papillomavirus type 16
accauggcugauccugcagg

SEQ ID NO: 4009364 - RNA, 19 nt, Human papillomavirus type 16
accuguuaaugggcacacu

SEQ ID NO: 4009365 - RNA, 15 nt, Human papillomavirus type 16
acgaaaguauuuggu

SEQ ID NO: 4009366 - RNA, 16 nt, Human papillomavirus type 16
acuaugguuuaaacuu

SEQ ID NO: 4009367 - RNA, 13 nt, Human papillomavirus type 16
acuguuauuacuu

SEQ ID NO: 4009368 - RNA, 13 nt, Human papillomavirus type 16
agaaacaauauau

SEQ ID NO: 4009369 - RNA, 13 nt, Human papillomavirus type 16
agaccuguuaaug

SEQ ID NO: 4009370 - RNA, 16 nt, Human papillomavirus type 16
agcaauugaacugcaa

SEQ ID NO: 4009371 - RNA, 12 nt, Human papillomavirus type 16
agcaucaguaac

SEQ ID NO: 4009372 - RNA, 19 nt, Human papillomavirus type 16
aguaaugaaaaguggacau

SEQ ID NO: 4009373 - RNA, 20 nt, Human papillomavirus type 16
aguggccauccuuuauuaaa

SEQ ID NO: 4009374 - RNA, 13 nt, Human papillomavirus type 16
auaauuguuguau

SEQ ID NO: 4009375 - RNA, 13 nt, Human papillomavirus type 16
auauaaacuauau

SEQ ID NO: 4009376 - RNA, 14 nt, Human papillomavirus type 16
auauaauuguugua

SEQ ID NO: 4009377 - RNA, 23 nt, Human papillomavirus type 16
auauaauuguuguauaccauaac

SEQ ID NO: 4009378 - RNA, 23 nt, Human papillomavirus type 16
auauauaacucacaauauaguaa

SEQ ID NO: 4009379 - RNA, 14 nt, Human papillomavirus type 16
auauuaaguuguau

SEQ ID NO: 4009380 - RNA, 20 nt, Human papillomavirus type 16
aucccuauuuuccuauuaaa

SEQ ID NO: 4009381 - RNA, 23 nt, Human papillomavirus type 16
auguauaaaaaaacauggauaua

SEQ ID NO: 4009382 - RNA, 20 nt, Human papillomavirus type 16
augucuauaugacaaaucuu

SEQ ID NO: 4009383 - RNA, 14 nt, Human papillomavirus type 16
auuccauugggaac

SEQ ID NO: 4009384 - RNA, 17 nt, Human papillomavirus type 16
auuggacaggacauaau

SEQ ID NO: 4009385 - RNA, 16 nt, Human papillomavirus type 16
auuuuccuauuaaaaa

SEQ ID NO: 4009386 - RNA, 19 nt, Human papillomavirus type 16
caaaaacuauuacaguguc

SEQ ID NO: 4009387 - RNA, 21 nt, Human papillomavirus type 16
caaaaacuauuacagugucua

SEQ ID NO: 4009388 - RNA, 14 nt, Human papillomavirus type 16
caauugaacugcaa

SEQ ID NO: 4009389 - RNA, 23 nt, Human papillomavirus type 16
cacaugcguuguuuacugcacag

SEQ ID NO: 4009390 - RNA, 14 nt, Human papillomavirus type 16
cacguguguaugug

SEQ ID NO: 4009391 - RNA, 16 nt, Human papillomavirus type 16
caggaacauccagacu

SEQ ID NO: 4009392 - RNA, 23 nt, Human papillomavirus type 16
caggauguauaaaaaaacaugga

SEQ ID NO: 4009393 - RNA, 16 nt, Human papillomavirus type 16
cagguaccaaugggga

SEQ ID NO: 4009394 - RNA, 21 nt, Human papillomavirus type 16
cagguaccaauggggaagagg

SEQ ID NO: 4009395 - RNA, 16 nt, Human papillomavirus type 16
caguuugauggagaca

SEQ ID NO: 4009396 - RNA, 18 nt, Human papillomavirus type 16
cauagagaugcaguacag

SEQ ID NO: 4009397 - RNA, 16 nt, Human papillomavirus type 16
cauccacaacauuacu

SEQ ID NO: 4009398 - RNA, 16 nt, Human papillomavirus type 16
cauuguauacugcagu

SEQ ID NO: 4009399 - RNA, 17 nt, Human papillomavirus type 16
ccauauagacuauugga

SEQ ID NO: 4009400 - RNA, 20 nt, Human papillomavirus type 16
ccucauuuuauaauccagau

SEQ ID NO: 4009401 - RNA, 16 nt, Human papillomavirus type 16
ccugaccccaauaagu

SEQ ID NO: 4009402 - RNA, 18 nt, Human papillomavirus type 16
cgggauguaauggauggu

SEQ ID NO: 4009403 - RNA, 23 nt, Human papillomavirus type 16
cguacuuuggaagaccuguuaau

SEQ ID NO: 4009404 - RNA, 14 nt, Human papillomavirus type 16
cuacuaauuguguu

SEQ ID NO: 4009405 - RNA, 14 nt, Human papillomavirus type 16
cuauuacagugucu

SEQ ID NO: 4009406 - RNA, 22 nt, Human papillomavirus type 16
cuauugcugaacaaauauuaca

SEQ ID NO: 4009407 - RNA, 10 nt, Human papillomavirus type 16
cugugucuac

SEQ ID NO: 4009408 - RNA, 18 nt, Human papillomavirus type 16
gaacagggucggguacag

SEQ ID NO: 4009409 - RNA, 13 nt, Human papillomavirus type 16
gaagaggguacgg

SEQ ID NO: 4009410 - RNA, 24 nt, Human papillomavirus type 16
gaagcaaaacaacauagagaugca

SEQ ID NO: 4009411 - RNA, 15 nt, Human papillomavirus type 16
gacagugauacaggu

SEQ ID NO: 4009412 - RNA, 18 nt, Human papillomavirus type 16
gagguaggucguggucag

SEQ ID NO: 4009413 - RNA, 15 nt, Human papillomavirus type 16
gauggagacauaugc

SEQ ID NO: 4009414 - RNA, 16 nt, Human papillomavirus type 16
gaugguccagcuggac

SEQ ID NO: 4009415 - RNA, 19 nt, Human papillomavirus type 16
gcaaacaggcagguacaug

SEQ ID NO: 4009416 - RNA, 22 nt, Human papillomavirus type 16
gcuuaugcagcaaaugcaggug

SEQ ID NO: 4009417 - RNA, 22 nt, Human papillomavirus type 16
ggaagcaaaacaacauagagau

SEQ ID NO: 4009418 - RNA, 22 nt, Human papillomavirus type 16
ggccagagaaaugggauuuaaa

SEQ ID NO: 4009419 - RNA, 14 nt, Human papillomavirus type 16
ggcugauccugcag

SEQ ID NO: 4009420 - RNA, 13 nt, Human papillomavirus type 16
ggcuguaguggaa

SEQ ID NO: 4009421 - RNA, 16 nt, Human papillomavirus type 16
guaauggaugguuuua

SEQ ID NO: 4009422 - RNA, 16 nt, Human papillomavirus type 16
gucggguacaggcgga

SEQ ID NO: 4009423 - RNA, 17 nt, Human papillomavirus type 16
gugucgucuacauggca

SEQ ID NO: 4009424 - RNA, 19 nt, Human papillomavirus type 16
guuaaugggcacacuagga

SEQ ID NO: 4009425 - RNA, 12 nt, Human papillomavirus type 16
guugaaggcaaa

SEQ ID NO: 4009426 - RNA, 17 nt, Human papillomavirus type 16
uaaaaagcauuguacau

SEQ ID NO: 4009427 - RNA, 21 nt, Human papillomavirus type 16
uaaacacguguguauguguuu

SEQ ID NO: 4009428 - RNA, 13 nt, Human papillomavirus type 16
uaaacuauauuug

SEQ ID NO: 4009429 - RNA, 13 nt, Human papillomavirus type 16
uaauuguuacaua

SEQ ID NO: 4009430 - RNA, 15 nt, Human papillomavirus type 16
uaauuguuacauaua

SEQ ID NO: 4009431 - RNA, 14 nt, Human papillomavirus type 16
uacauacacaugca

SEQ ID NO: 4009432 - RNA, 14 nt, Human papillomavirus type 16
uacauccuguuuuu

SEQ ID NO: 4009433 - RNA, 15 nt, Human papillomavirus type 16
uagaaugugcuauuu

SEQ ID NO: 4009434 - RNA, 19 nt, Human papillomavirus type 16
uaucaggauuacaauacag

SEQ ID NO: 4009435 - RNA, 18 nt, Human papillomavirus type 16
uaugauagugaauggcaa

SEQ ID NO: 4009436 - RNA, 13 nt, Human papillomavirus type 16
uauuacagugucu

SEQ ID NO: 4009437 - RNA, 14 nt, Human papillomavirus type 16
uauuuuuaauacau

SEQ ID NO: 4009438 - RNA, 11 nt, Human papillomavirus type 16
ucaugcaggaa

SEQ ID NO: 4009439 - RNA, 13 nt, Human papillomavirus type 16
uggaagugcaguu

SEQ ID NO: 4009440 - RNA, 19 nt, Human papillomavirus type 16
uguaacuauugugucaugc

SEQ ID NO: 4009441 - RNA, 18 nt, Human papillomavirus type 16
uguacauuguauacugca

SEQ ID NO: 4009442 - RNA, 17 nt, Human papillomavirus type 16
uguauguguguuuguau

SEQ ID NO: 4009443 - RNA, 19 nt, Human papillomavirus type 16
uuaguggauguguagacaa

SEQ ID NO: 4009444 - RNA, 16 nt, Human papillomavirus type 16
uuauaaaacaugcaaa

SEQ ID NO: 4009445 - RNA, 20 nt, Human papillomavirus type 16
uuauuugaaagcgaagacag

SEQ ID NO: 4009446 - RNA, 20 nt, Human papillomavirus type 16
uuggcacaaaauguguuuuu

SEQ ID NO: 4009447 - RNA, 19 nt, Human papillomavirus type 16
uuguauacugcagugucgu

SEQ ID NO: 4009448 - RNA, 22 nt, Human papillomavirus type 16
uugucucaaguuaaaauaccaa

SEQ ID NO: 4009449 - RNA, 19 nt, Human papillomavirus type 16
uuguuacauauaauuguug

SEQ ID NO: 4009450 - RNA, 13 nt, Human papillomavirus type 16
uuuauuguauaua

SEQ ID NO: 4009451 - RNA, 14 nt, Human papillomavirus type 16
uuuuuaauuacaua

SEQ ID NO: 4009452 - RNA, 16 nt, Human papillomavirus type 16
uguuguauaccauaac

SEQ ID NO: 4009453 - RNA, 23 nt, Human papillomavirus type 16
uugaaggcaaaacuauugcugaa

SEQ ID NO: 4009454 - RNA, 18 nt, Human papillomavirus type 16
uuguacguuuccugcuug

SEQ ID NO: 4009455 - RNA, 13 nt, Human papillomavirus type 16
uuguaugugcuug

SEQ ID NO: 4009456 - RNA, 23 nt, Human papillomavirus type 16
uuguuacauauaauuguuguaua

SEQ ID NO: 4009457 - RNA, 13 nt, Human papillomavirus type 16
uuuaaaugcuugu

SEQ ID NO: 4009458 - RNA, 14 nt, Human papillomavirus type 16
uuuuuauuuucaua

SEQ ID NO: 4009459 - RNA, 12 nt, Human papillomavirus type 16
aaaaaaaacagg

SEQ ID NO: 4009460 - RNA, 17 nt, Human papillomavirus type 16
aaaacgcacaaaacgug

SEQ ID NO: 4009461 - RNA, 13 nt, Human papillomavirus type 16
aaacaugcaaaca

SEQ ID NO: 4009462 - RNA, 16 nt, Human papillomavirus type 16
aaacgcacaaaacgug

SEQ ID NO: 4009463 - RNA, 12 nt, Human papillomavirus type 16
aaauaguucuau

SEQ ID NO: 4009464 - RNA, 19 nt, Human papillomavirus type 16
aacauggauauacagugga

SEQ ID NO: 4009465 - RNA, 19 nt, Human papillomavirus type 16
aaccuaacaauaacaaaau

SEQ ID NO: 4009466 - RNA, 16 nt, Human papillomavirus type 16
aacucacaauauagua

SEQ ID NO: 4009467 - RNA, 21 nt, Human papillomavirus type 16
aacugcaacuaacguuagaaa

SEQ ID NO: 4009468 - RNA, 23 nt, Human papillomavirus type 16
aagcaaaacaacauagagaugca

SEQ ID NO: 4009469 - RNA, 14 nt, Human papillomavirus type 16
aauacuuuaaaaug

SEQ ID NO: 4009470 - RNA, 17 nt, Human papillomavirus type 16
aaugacagugauacagg

SEQ ID NO: 4009471 - RNA, 19 nt, Human papillomavirus type 16
aauuguuacacuuacauau

SEQ ID NO: 4009472 - RNA, 13 nt, Human papillomavirus type 16
acaaaauguguuu

SEQ ID NO: 4009473 - RNA, 13 nt, Human papillomavirus type 16
acaacauuacugg

SEQ ID NO: 4009474 - RNA, 15 nt, Human papillomavirus type 16
acacagaaaaugcua

SEQ ID NO: 4009475 - RNA, 18 nt, Human papillomavirus type 16
acaccuacuaauuguguu

SEQ ID NO: 4009476 - RNA, 15 nt, Human papillomavirus type 16
acauaugauagugaa

SEQ ID NO: 4009477 - RNA, 15 nt, Human papillomavirus type 16
accauggcugauccu

SEQ ID NO: 4009478 - RNA, 18 nt, Human papillomavirus type 16
acgugaccaauuuuuguc

SEQ ID NO: 4009479 - RNA, 15 nt, Human papillomavirus type 16
agcugcaaaaaggag

SEQ ID NO: 4009480 - RNA, 20 nt, Human papillomavirus type 16
agcuucaaccgaauucgguu

SEQ ID NO: 4009481 - RNA, 21 nt, Human papillomavirus type 16
aguggaaaaaaaaacagggga

SEQ ID NO: 4009482 - RNA, 16 nt, Human papillomavirus type 16
auaaacacguguguau

SEQ ID NO: 4009483 - RNA, 21 nt, Human papillomavirus type 16
auaaugauuauuuaacacagg

SEQ ID NO: 4009484 - RNA, 15 nt, Human papillomavirus type 16
aucaguaacuguggu

SEQ ID NO: 4009485 - RNA, 17 nt, Human papillomavirus type 16
auguauaaaaaaacaug

SEQ ID NO: 4009486 - RNA, 19 nt, Human papillomavirus type 16
auguauaaaaaaacaugga

SEQ ID NO: 4009487 - RNA, 17 nt, Human papillomavirus type 16
gaacaaauauuacaaua

SEQ ID NO: 4009488 - RNA, 14 nt, Human papillomavirus type 16
gacagugauacagg

SEQ ID NO: 4009489 - RNA, 21 nt, Human papillomavirus type 16
gacauucguacuuuggaagac

SEQ ID NO: 4009490 - RNA, 15 nt, Human papillomavirus type 16
gaugaaauagauggu

SEQ ID NO: 4009491 - RNA, 18 nt, Human papillomavirus type 16
gcugaacaaauauuacaa

SEQ ID NO: 4009492 - RNA, 20 nt, Human papillomavirus type 16
gcuuguaaauauuaaguugu

SEQ ID NO: 4009493 - RNA, 19 nt, Human papillomavirus type 16
ggaggaugaaauagauggu

SEQ ID NO: 4009494 - RNA, 18 nt, Human papillomavirus type 16
guccacuuagugauauua

SEQ ID NO: 4009495 - RNA, 23 nt, Human papillomavirus type 16
guuauucauuguauauaaacuau

SEQ ID NO: 4009496 - RNA, 16 nt, Human papillomavirus type 16
guucucagaaaccaua

SEQ ID NO: 4009497 - RNA, 16 nt, Human papillomavirus type 16
uaaaaagcauuguaca

SEQ ID NO: 4009498 - RNA, 19 nt, Human papillomavirus type 16
uaaaagugcaauuguuaca

SEQ ID NO: 4009499 - RNA, 20 nt, Human papillomavirus type 16
uaauguaauuguuacauaua

SEQ ID NO: 4009500 - RNA, 19 nt, Human papillomavirus type 16
uacaguggaagugcaguuu

SEQ ID NO: 4009501 - RNA, 18 nt, Human papillomavirus type 16
uaccauaacuuacuauuu

SEQ ID NO: 4009502 - RNA, 21 nt, Human papillomavirus type 16
uacuuuggaagaccuguuaau

SEQ ID NO: 4009503 - RNA, 15 nt, Human papillomavirus type 16
uauacugcagugucg

SEQ ID NO: 4009504 - RNA, 14 nt, Human papillomavirus type 16
uauguagaggcugu

SEQ ID NO: 4009505 - RNA, 21 nt, Human papillomavirus type 16
uaugucuauaugacaaaucuu

SEQ ID NO: 4009506 - RNA, 14 nt, Human papillomavirus type 16
uauuacuauugugg

SEQ ID NO: 4009507 - RNA, 14 nt, Human papillomavirus type 16
uauuuguuuauaua

SEQ ID NO: 4009508 - RNA, 17 nt, Human papillomavirus type 16
ucagaggaggaggauga

SEQ ID NO: 4009509 - RNA, 21 nt, Human papillomavirus type 16
ugaagaagcaucaguaacugu

SEQ ID NO: 4009510 - RNA, 20 nt, Human papillomavirus type 16
ugagcaauuaaaugacagcu

SEQ ID NO: 4009511 - RNA, 15 nt, Human papillomavirus type 16
ugcagcaaaugcagg

SEQ ID NO: 4009512 - RNA, 20 nt, Human papillomavirus type 16
ugcuuguaaauauuaaguug

SEQ ID NO: 4009513 - RNA, 21 nt, Human papillomavirus type 16
ugcuuuugucugugucuacau

SEQ ID NO: 4009514 - RNA, 19 nt, Human papillomavirus type 16
uggagacauaugcaauaca

SEQ ID NO: 4009515 - RNA, 12 nt, Human papillomavirus type 16
ugguccagcugg

SEQ ID NO: 4009516 - RNA, 18 nt, Human papillomavirus type 16
uguaguggaaaaaaaaac

SEQ ID NO: 4009517 - RNA, 19 nt, Human papillomavirus type 16
uguauguugaauuaguguu

SEQ ID NO: 4009518 - RNA, 21 nt, Human papillomavirus type 16
ugugguuauucauuguauaua

SEQ ID NO: 4009519 - RNA, 12 nt, Human papillomavirus type 16
uuaaaauguuua

SEQ ID NO: 4009520 - RNA, 19 nt, Human papillomavirus type 16
uuacaagcaauugaacugc

SEQ ID NO: 4009521 - RNA, 19 nt, Human papillomavirus type 16
uuacauaauguauauguac

SEQ ID NO: 4009522 - RNA, 21 nt, Human papillomavirus type 16
uuacuauuguggauaacagca

SEQ ID NO: 4009523 - RNA, 23 nt, Human papillomavirus type 16
uuauacaaacuggacacauauau

SEQ ID NO: 4009524 - RNA, 11 nt, Human papillomavirus type 16
uuccugacacc

SEQ ID NO: 4009525 - RNA, 11 nt, Human papillomavirus type 16
uugaacugcaa

SEQ ID NO: 4009526 - RNA, 24 nt, Human papillomavirus type 16
uuggaugacacagaaaaugcuagu

SEQ ID NO: 4009527 - RNA, 15 nt, Human papillomavirus type 16
uugguauuacuauug

SEQ ID NO: 4009528 - RNA, 14 nt, Human papillomavirus type 16
uuuugucugugucu

SEQ ID NO: 4009529 - RNA, 13 nt, Human papillomavirus type 18
aaacaguacaagu

SEQ ID NO: 4009530 - RNA, 21 nt, Human papillomavirus type 18
aaaccgaggauuggacacugc

SEQ ID NO: 4009531 - RNA, 18 nt, Human papillomavirus type 18
aaauaucuuuaaauagug

SEQ ID NO: 4009532 - RNA, 14 nt, Human papillomavirus type 18
aaaugcaacagaca

SEQ ID NO: 4009533 - RNA, 12 nt, Human papillomavirus type 18
aagacauagaca

SEQ ID NO: 4009534 - RNA, 18 nt, Human papillomavirus type 18
aaggaacauuuugugaac

SEQ ID NO: 4009535 - RNA, 17 nt, Human papillomavirus type 18
aaugcaacagacacagg

SEQ ID NO: 4009536 - RNA, 16 nt, Human papillomavirus type 18
acaauguaauacauau

SEQ ID NO: 4009537 - RNA, 18 nt, Human papillomavirus type 18
acaccuuacagcauccau

SEQ ID NO: 4009538 - RNA, 19 nt, Human papillomavirus type 18
acagaaccuacucacugcu

SEQ ID NO: 4009539 - RNA, 14 nt, Human papillomavirus type 18
acaguaauuguaua

SEQ ID NO: 4009540 - RNA, 20 nt, Human papillomavirus type 18
acucccacaagcauauuuua

SEQ ID NO: 4009541 - RNA, 23 nt, Human papillomavirus type 18
agaacaaaauuuuuaaauacugu

SEQ ID NO: 4009542 - RNA, 15 nt, Human papillomavirus type 18
agacggggagggcac

SEQ ID NO: 4009543 - RNA, 17 nt, Human papillomavirus type 18
agagacagcacaggcau

SEQ ID NO: 4009544 - RNA, 20 nt, Human papillomavirus type 18
agcagauaaaauauugcaau

SEQ ID NO: 4009545 - RNA, 16 nt, Human papillomavirus type 18
agcuagagacagcaca

SEQ ID NO: 4009546 - RNA, 19 nt, Human papillomavirus type 18
agcuagagacagcacaggc

SEQ ID NO: 4009547 - RNA, 16 nt, Human papillomavirus type 18
aggaagaaaacgauga

SEQ ID NO: 4009548 - RNA, 20 nt, Human papillomavirus type 18
aggauauuccuaagguuucu

SEQ ID NO: 4009549 - RNA, 22 nt, Human papillomavirus type 18
agggaacauggcauacagacau

SEQ ID NO: 4009550 - RNA, 15 nt, Human papillomavirus type 18
aguaagcaacaaugg

SEQ ID NO: 4009551 - RNA, 18 nt, Human papillomavirus type 18
agugggcagaaaaaggca

SEQ ID NO: 4009552 - RNA, 20 nt, Human papillomavirus type 18
auacagaaccuacucacugc

SEQ ID NO: 4009553 - RNA, 20 nt, Human papillomavirus type 18
auagguuguuuuauacagug

SEQ ID NO: 4009554 - RNA, 21 nt, Human papillomavirus type 18
auagguuguuuuauacagugu

SEQ ID NO: 4009555 - RNA, 22 nt, Human papillomavirus type 18
auagugggcagaaaaaggcaaa

SEQ ID NO: 4009556 - RNA, 15 nt, Human papillomavirus type 18
auauaaaacauguaa

SEQ ID NO: 4009557 - RNA, 12 nt, Human papillomavirus type 18
auccauauuuua

SEQ ID NO: 4009558 - RNA, 17 nt, Human papillomavirus type 18
augcgcaggagguccac

SEQ ID NO: 4009559 - RNA, 16 nt, Human papillomavirus type 18
auggcaacaaagacaa

SEQ ID NO: 4009560 - RNA, 20 nt, Human papillomavirus type 18
auguacaagcuauuguagac

SEQ ID NO: 4009561 - RNA, 20 nt, Human papillomavirus type 18
auguaugguuguuguuguau

SEQ ID NO: 4009562 - RNA, 18 nt, Human papillomavirus type 18
auugauacacaaggaaca

SEQ ID NO: 4009563 - RNA, 15 nt, Human papillomavirus type 18
auuucaaaaaguaaa

SEQ ID NO: 4009564 - RNA, 23 nt, Human papillomavirus type 18
caaauaaauuugguuuaccugau

SEQ ID NO: 4009565 - RNA, 15 nt, Human papillomavirus type 18
caacauuuaccagcc

SEQ ID NO: 4009566 - RNA, 20 nt, Human papillomavirus type 18
caagccuugguauauuuuug

SEQ ID NO: 4009567 - RNA, 20 nt, Human papillomavirus type 18
caaguauauuuugauggcaa

SEQ ID NO: 4009568 - RNA, 16 nt, Human papillomavirus type 18
caauauagaguauuua

SEQ ID NO: 4009569 - RNA, 13 nt, Human papillomavirus type 18
cacaguauaugua

SEQ ID NO: 4009570 - RNA, 17 nt, Human papillomavirus type 18
cacauaaagcuauugaa

SEQ ID NO: 4009571 - RNA, 17 nt, Human papillomavirus type 18
cacugcuuuaaaaaagg

SEQ ID NO: 4009572 - RNA, 16 nt, Human papillomavirus type 18
cagacggggagggcac

SEQ ID NO: 4009573 - RNA, 20 nt, Human papillomavirus type 18
cagagcuagagacagcacag

SEQ ID NO: 4009574 - RNA, 21 nt, Human papillomavirus type 18
cauagacagccaaauacagua

SEQ ID NO: 4009575 - RNA, 16 nt, Human papillomavirus type 18
caucugucuguaugug

SEQ ID NO: 4009576 - RNA, 13 nt, Human papillomavirus type 18
caugggacaaaac

SEQ ID NO: 4009577 - RNA, 12 nt, Human papillomavirus type 18
cauguccaccug

SEQ ID NO: 4009578 - RNA, 21 nt, Human papillomavirus type 18
ccaugucccgcuuuugccauc

SEQ ID NO: 4009579 - RNA, 17 nt, Human papillomavirus type 18
ccauuuugcugugcaac

SEQ ID NO: 4009580 - RNA, 14 nt, Human papillomavirus type 18
ccugcagguggugg

SEQ ID NO: 4009581 - RNA, 18 nt, Human papillomavirus type 18
ccuuacagcauccauuuu

SEQ ID NO: 4009582 - RNA, 19 nt, Human papillomavirus type 18
ccuucgagcauuccagcag

SEQ ID NO: 4009583 - RNA, 15 nt, Human papillomavirus type 18
cuaagguuucugcau

SEQ ID NO: 4009584 - RNA, 12 nt, Human papillomavirus type 18
cuaauguuucug

SEQ ID NO: 4009585 - RNA, 16 nt, Human papillomavirus type 18
cuagagacagcacagg

SEQ ID NO: 4009586 - RNA, 17 nt, Human papillomavirus type 18
cuagauuauuaacuguu

SEQ ID NO: 4009587 - RNA, 16 nt, Human papillomavirus type 18
cuauauauuguccugu

SEQ ID NO: 4009588 - RNA, 16 nt, Human papillomavirus type 18
cugauacuaguauuua

SEQ ID NO: 4009589 - RNA, 19 nt, Human papillomavirus type 18
gagcuagagacagcacagg

SEQ ID NO: 4009590 - RNA, 20 nt, Human papillomavirus type 18
gagcuagagacagcacaggc

SEQ ID NO: 4009591 - RNA, 13 nt, Human papillomavirus type 18
gaggcagcacaga

SEQ ID NO: 4009592 - RNA, 14 nt, Human papillomavirus type 18
gagguggauacaga

SEQ ID NO: 4009593 - RNA, 17 nt, Human papillomavirus type 18
gaguuaaucaucaacau

SEQ ID NO: 4009594 - RNA, 16 nt, Human papillomavirus type 18
gauggcaacaaagaca

SEQ ID NO: 4009595 - RNA, 22 nt, Human papillomavirus type 18
gcagagcuagagacagcacagg

SEQ ID NO: 4009596 - RNA, 16 nt, Human papillomavirus type 18
gcaggaggcagcacag

SEQ ID NO: 4009597 - RNA, 20 nt, Human papillomavirus type 18
gcccauguuacuauugcaua

SEQ ID NO: 4009598 - RNA, 12 nt, Human papillomavirus type 18
gcgacucagagg

SEQ ID NO: 4009599 - RNA, 17 nt, Human papillomavirus type 18
gcuagagacagcacagg

SEQ ID NO: 4009600 - RNA, 12 nt, Human papillomavirus type 18
gcugauccagaa

SEQ ID NO: 4009601 - RNA, 17 nt, Human papillomavirus type 18
gcuuuuguguaugcaug

SEQ ID NO: 4009602 - RNA, 13 nt, Human papillomavirus type 18
ggagcggcuggag

SEQ ID NO: 4009603 - RNA, 21 nt, Human papillomavirus type 18
ggcugauccagaagguacaga

SEQ ID NO: 4009604 - RNA, 19 nt, Human papillomavirus type 18
ggcuggagguggauacaga

SEQ ID NO: 4009605 - RNA, 21 nt, Human papillomavirus type 18
gggacaaaaccgcuaccugug

SEQ ID NO: 4009606 - RNA, 17 nt, Human papillomavirus type 18
gguuguuguuguauguu

SEQ ID NO: 4009607 - RNA, 21 nt, Human papillomavirus type 18
guaacugacuuauauaaaaca

SEQ ID NO: 4009608 - RNA, 15 nt, Human papillomavirus type 18
guacaggguacauuc

SEQ ID NO: 4009609 - RNA, 16 nt, Human papillomavirus type 18
guagcaugggacagug

SEQ ID NO: 4009610 - RNA, 13 nt, Human papillomavirus type 18
guauguccugugu

SEQ ID NO: 4009611 - RNA, 12 nt, Human papillomavirus type 18
guguaugcaugu

SEQ ID NO: 4009612 - RNA, 19 nt, Human papillomavirus type 18
guguuuguauguccugugu

SEQ ID NO: 4009613 - RNA, 13 nt, Human papillomavirus type 18
guuugcaggaggc

SEQ ID NO: 4009614 - RNA, 15 nt, Human papillomavirus type 18
guuuguauguccugu

SEQ ID NO: 4009615 - RNA, 20 nt, Human papillomavirus type 18
uaaaacgaaaguuugcagga

SEQ ID NO: 4009616 - RNA, 15 nt, Human papillomavirus type 18
uaagcgacucagagg

SEQ ID NO: 4009617 - RNA, 20 nt, Human papillomavirus type 18
uaauaacguccccugccaca

SEQ ID NO: 4009618 - RNA, 16 nt, Human papillomavirus type 18
uacaguguauuguaca

SEQ ID NO: 4009619 - RNA, 13 nt, Human papillomavirus type 18
uacgguacagauu

SEQ ID NO: 4009620 - RNA, 16 nt, Human papillomavirus type 18
uagacagccaaauaca

SEQ ID NO: 4009621 - RNA, 21 nt, Human papillomavirus type 18
uagugaguaacaacuguauuu

SEQ ID NO: 4009622 - RNA, 16 nt, Human papillomavirus type 18
uauauaaaacauguaa

SEQ ID NO: 4009623 - RNA, 18 nt, Human papillomavirus type 18
uaucauccaccuggcauu

SEQ ID NO: 4009624 - RNA, 17 nt, Human papillomavirus type 18
uaugcauguaugugugc

SEQ ID NO: 4009625 - RNA, 22 nt, Human papillomavirus type 18
uaugugacucccacaagcauau

SEQ ID NO: 4009626 - RNA, 11 nt, Human papillomavirus type 18
uauugcccaug

SEQ ID NO: 4009627 - RNA, 18 nt, Human papillomavirus type 18
ucacacaauguuguguau

SEQ ID NO: 4009628 - RNA, 15 nt, Human papillomavirus type 18
ucugguacaugucca

SEQ ID NO: 4009629 - RNA, 21 nt, Human papillomavirus type 18
ugaugcacaaguguugcaugu

SEQ ID NO: 4009630 - RNA, 16 nt, Human papillomavirus type 18
ugcauaccaauauaga

SEQ ID NO: 4009631 - RNA, 16 nt, Human papillomavirus type 18
ugcauguaugugugcu

SEQ ID NO: 4009632 - RNA, 23 nt, Human papillomavirus type 18
uggcauagguacuggcaguggua

SEQ ID NO: 4009633 - RNA, 14 nt, Human papillomavirus type 18
ugggauacaugaca

SEQ ID NO: 4009634 - RNA, 20 nt, Human papillomavirus type 18
uguaaacaaucugguacaug

SEQ ID NO: 4009635 - RNA, 17 nt, Human papillomavirus type 18
uguaguaccaauauguu

SEQ ID NO: 4009636 - RNA, 13 nt, Human papillomavirus type 18
uguaugcauguau

SEQ ID NO: 4009637 - RNA, 14 nt, Human papillomavirus type 18
uguauuguacauug

SEQ ID NO: 4009638 - RNA, 16 nt, Human papillomavirus type 18
ugucuguaugugugcg

SEQ ID NO: 4009639 - RNA, 22 nt, Human papillomavirus type 18
ugugguaauaacguccccugcc

SEQ ID NO: 4009640 - RNA, 15 nt, Human papillomavirus type 18
ugugguucugugugu

SEQ ID NO: 4009641 - RNA, 20 nt, Human papillomavirus type 18
uguuacuauugcauauacau

SEQ ID NO: 4009642 - RNA, 12 nt, Human papillomavirus type 18
uuaaauacuguu

SEQ ID NO: 4009643 - RNA, 21 nt, Human papillomavirus type 18
uuauugauacacaaggaacau

SEQ ID NO: 4009644 - RNA, 16 nt, Human papillomavirus type 18
uugcaagacauuguau

SEQ ID NO: 4009645 - RNA, 19 nt, Human papillomavirus type 18
uugcaggaggcagcacaga

SEQ ID NO: 4009646 - RNA, 18 nt, Human papillomavirus type 18
uugcauguuuuaaaacga

SEQ ID NO: 4009647 - RNA, 20 nt, Human papillomavirus type 18
uuugcaggaggcagcacaga

SEQ ID NO: 4009648 - RNA, 15 nt, Human papillomavirus type 18
aaaaguaaagcacau

SEQ ID NO: 4009649 - RNA, 15 nt, Human papillomavirus type 18
acaaaaaaacaggag

SEQ ID NO: 4009650 - RNA, 13 nt, Human papillomavirus type 18
acaaguguugcau

SEQ ID NO: 4009651 - RNA, 13 nt, Human papillomavirus type 18
acagaaaacaguc

SEQ ID NO: 4009652 - RNA, 21 nt, Human papillomavirus type 18
acagaaaacaguccauuaggg

SEQ ID NO: 4009653 - RNA, 15 nt, Human papillomavirus type 18
acgucuaauguuucu

SEQ ID NO: 4009654 - RNA, 12 nt, Human papillomavirus type 18
acuggcaguggu

SEQ ID NO: 4009655 - RNA, 18 nt, Human papillomavirus type 18
agauaguguacaaauauu

SEQ ID NO: 4009656 - RNA, 13 nt, Human papillomavirus type 18
agccaaauacagu

SEQ ID NO: 4009657 - RNA, 22 nt, Human papillomavirus type 18
aggaacauuuugugaacaggca

SEQ ID NO: 4009658 - RNA, 18 nt, Human papillomavirus type 18
aggaggcagcacagaaaa

SEQ ID NO: 4009659 - RNA, 14 nt, Human papillomavirus type 18
aggcagagcuagag

SEQ ID NO: 4009660 - RNA, 17 nt, Human papillomavirus type 18
agggcacggguuguaac

SEQ ID NO: 4009661 - RNA, 21 nt, Human papillomavirus type 18
agguuguuuuauacaguguau

SEQ ID NO: 4009662 - RNA, 22 nt, Human papillomavirus type 18
aguuugcaggaggcagcacaga

SEQ ID NO: 4009663 - RNA, 18 nt, Human papillomavirus type 18
auacaucuauuguugugu

SEQ ID NO: 4009664 - RNA, 16 nt, Human papillomavirus type 18
auauauuguccuguau

SEQ ID NO: 4009665 - RNA, 21 nt, Human papillomavirus type 18
auauguuuugugguucugugu

SEQ ID NO: 4009666 - RNA, 16 nt, Human papillomavirus type 18
auauucuuugcagcaa

SEQ ID NO: 4009667 - RNA, 19 nt, Human papillomavirus type 18
auauuuuaggguuccugca

SEQ ID NO: 4009668 - RNA, 12 nt, Human papillomavirus type 18
augcaacagaca

SEQ ID NO: 4009669 - RNA, 19 nt, Human papillomavirus type 18
augcaggaacaugggacaa

SEQ ID NO: 4009670 - RNA, 13 nt, Human papillomavirus type 18
augcauguaugug

SEQ ID NO: 4009671 - RNA, 13 nt, Human papillomavirus type 18
auggcaacaaaga

SEQ ID NO: 4009672 - RNA, 18 nt, Human papillomavirus type 18
augugugcguaugcaugg

SEQ ID NO: 4009673 - RNA, 16 nt, Human papillomavirus type 18
auugcauuuagagccc

SEQ ID NO: 4009674 - RNA, 15 nt, Human papillomavirus type 18
auuggcaacuaauac

SEQ ID NO: 4009675 - RNA, 21 nt, Human papillomavirus type 18
auuuugugaacaggcagagcu

SEQ ID NO: 4009676 - RNA, 13 nt, Human papillomavirus type 18
auuuuguuuuaua

SEQ ID NO: 4009677 - RNA, 17 nt, Human papillomavirus type 18
caaauacaguauuggca

SEQ ID NO: 4009678 - RNA, 22 nt, Human papillomavirus type 18
caauuccagauaguguacaaau

SEQ ID NO: 4009679 - RNA, 18 nt, Human papillomavirus type 18
cacaacguuuaguguggg

SEQ ID NO: 4009680 - RNA, 15 nt, Human papillomavirus type 18
uaugugugcugccau

SEQ ID NO: 4009681 - RNA, 21 nt, Human papillomavirus type 18
uccccugccacagcauucaca

SEQ ID NO: 4009682 - RNA, 16 nt, Human papillomavirus type 18
uccuaagguuucugca

SEQ ID NO: 4009683 - RNA, 14 nt, Human papillomavirus type 18
ucuauuguuguguu

SEQ ID NO: 4009684 - RNA, 18 nt, Human papillomavirus type 18
ucugcauaccaauauaga

SEQ ID NO: 4009685 - RNA, 22 nt, Human papillomavirus type 18
ugaaaaaacaggaauacugacu

SEQ ID NO: 4009686 - RNA, 13 nt, Human papillomavirus type 18
ugcaucccagcag

SEQ ID NO: 4009687 - RNA, 14 nt, Human papillomavirus type 18
ugcuauauugucuu

SEQ ID NO: 4009688 - RNA, 15 nt, Human papillomavirus type 18
uggaccuaaggcaac

SEQ ID NO: 4009689 - RNA, 21 nt, Human papillomavirus type 18
uggcugauccagaagguacag

SEQ ID NO: 4009690 - RNA, 12 nt, Human papillomavirus type 18
uguauguccugu

SEQ ID NO: 4009691 - RNA, 18 nt, Human papillomavirus type 18
uguaugugugcugccaug

SEQ ID NO: 4009692 - RNA, 20 nt, Human papillomavirus type 18
uuaugcuuuuuguauuuuug

SEQ ID NO: 4009693 - RNA, 18 nt, Human papillomavirus type 18
uucgagcauuccagcagc

SEQ ID NO: 4009694 - RNA, 18 nt, Human papillomavirus type 18
uucugcauaccaauauag

SEQ ID NO: 4009695 - RNA, 21 nt, Human papillomavirus type 18
uugggcuauauauuguccugu

SEQ ID NO: 4009696 - RNA, 13 nt, Human papillomavirus type 18
uuguauauuuugu

SEQ ID NO: 4009697 - RNA, 15 nt, Human papillomavirus type 18
uuuauacaguguauu

SEQ ID NO: 4009698 - RNA, 13 nt, Human papillomavirus type 18
uuugugguucugu

SEQ ID NO: 4009699 - RNA, 23 nt, Human papillomavirus type 18
aaaguuugcaggaggcagcacag

SEQ ID NO: 4009700 - RNA, 18 nt, Human papillomavirus type 18
aagguggagggcaccacg

SEQ ID NO: 4009701 - RNA, 15 nt, Human papillomavirus type 18
aauacaguauuggca

SEQ ID NO: 4009702 - RNA, 18 nt, Human papillomavirus type 18
aaugcaauauucuuugca

SEQ ID NO: 4009703 - RNA, 23 nt, Human papillomavirus type 18
accauagugaaacacaaagaaca

SEQ ID NO: 4009704 - RNA, 16 nt, Human papillomavirus type 18
accugugggccccaca

SEQ ID NO: 4009705 - RNA, 13 nt, Human papillomavirus type 18
accuucgagcauu

SEQ ID NO: 4009706 - RNA, 14 nt, Human papillomavirus type 18
acguccccugccac

SEQ ID NO: 4009707 - RNA, 22 nt, Human papillomavirus type 18
acugaugcaggaacaugggaca

SEQ ID NO: 4009708 - RNA, 22 nt, Human papillomavirus type 18
agacgaccuucgagcauuccag

SEQ ID NO: 4009709 - RNA, 13 nt, Human papillomavirus type 18
agagacagcacag

SEQ ID NO: 4009710 - RNA, 12 nt, Human papillomavirus type 18
agcauuccagca

SEQ ID NO: 4009711 - RNA, 14 nt, Human papillomavirus type 18
aggcaacauugcaa

SEQ ID NO: 4009712 - RNA, 13 nt, Human papillomavirus type 18
aguaagcaacaau

SEQ ID NO: 4009713 - RNA, 14 nt, Human papillomavirus type 18
auaugacugaugca

SEQ ID NO: 4009714 - RNA, 20 nt, Human papillomavirus type 18
auauuccuaagguuucugca

SEQ ID NO: 4009715 - RNA, 21 nt, Human papillomavirus type 18
auauugcaauggucaagccuu

SEQ ID NO: 4009716 - RNA, 17 nt, Human papillomavirus type 18
auccuacaauccuccau

SEQ ID NO: 4009717 - RNA, 14 nt, Human papillomavirus type 18
aucugucuguaugu

SEQ ID NO: 4009718 - RNA, 18 nt, Human papillomavirus type 18
augcaacagacacagggu

SEQ ID NO: 4009719 - RNA, 22 nt, Human papillomavirus type 18
augcauguaugugugcugccau

SEQ ID NO: 4009720 - RNA, 14 nt, Human papillomavirus type 18
gcuauugaacugca

SEQ ID NO: 4009721 - RNA, 22 nt, Human papillomavirus type 18
ggcagcacagaaaacaguccau

SEQ ID NO: 4009722 - RNA, 14 nt, Human papillomavirus type 18
ggccuuagugggca

SEQ ID NO: 4009723 - RNA, 15 nt, Human papillomavirus type 18
gguuauugaaccugu

SEQ ID NO: 4009724 - RNA, 11 nt, Human papillomavirus type 18
guaauaaaagu

SEQ ID NO: 4009725 - RNA, 19 nt, Human papillomavirus type 18
guacagacggggagggcac

SEQ ID NO: 4009726 - RNA, 19 nt, Human papillomavirus type 18
guacgcuggcacuauugca

SEQ ID NO: 4009727 - RNA, 15 nt, Human papillomavirus type 18
guauauauauauaca

SEQ ID NO: 4009728 - RNA, 14 nt, Human papillomavirus type 18
guauuguacauugu

SEQ ID NO: 4009729 - RNA, 17 nt, Human papillomavirus type 18
guccacaaugaugcaca

SEQ ID NO: 4009730 - RNA, 14 nt, Human papillomavirus type 18
gucuguaugugugc

SEQ ID NO: 4009731 - RNA, 23 nt, Human papillomavirus type 18
gugguggauguugguccuacacg

SEQ ID NO: 4009732 - RNA, 12 nt, Human papillomavirus type 18
guguauauugug

SEQ ID NO: 4009733 - RNA, 17 nt, Human papillomavirus type 18
guuugcaggaggcagca

SEQ ID NO: 4009734 - RNA, 16 nt, Human papillomavirus type 18
uaaacaaucugguaca

SEQ ID NO: 4009735 - RNA, 20 nt, Human papillomavirus type 18
uaauccauauuuuaggguuc

SEQ ID NO: 4009736 - RNA, 13 nt, Human papillomavirus type 18
uacauaugcugua

SEQ ID NO: 4009737 - RNA, 21 nt, Human papillomavirus type 18
uacuauugcauauacaugcua

SEQ ID NO: 4009738 - RNA, 14 nt, Human papillomavirus type 18
uaggguuccugcag

SEQ ID NO: 4009739 - RNA, 19 nt, Human papillomavirus type 18
uaguagaaagcucagcaga

SEQ ID NO: 4009740 - RNA, 17 nt, Human papillomavirus type 18
uagugaaacacaaagaa

SEQ ID NO: 4009741 - RNA, 20 nt, Human papillomavirus type 18
uagugaguaacaacuguauu

SEQ ID NO: 4009742 - RNA, 15 nt, Human papillomavirus type 18
uauugugguaauaac

SEQ ID NO: 4009743 - RNA, 15 nt, Human papillomavirus type 18
uccaauacaguggug

SEQ ID NO: 4009744 - RNA, 23 nt, Human papillomavirus type 18
uccguggugugcaucccagcagu

SEQ ID NO: 4009745 - RNA, 19 nt, Human papillomavirus type 18
ugaaauuccgguugaccuu

SEQ ID NO: 4009746 - RNA, 16 nt, Human papillomavirus type 18
ugaacacccuguccuu

SEQ ID NO: 4009747 - RNA, 12 nt, Human papillomavirus type 18
ugcaggaggcag

SEQ ID NO: 4009748 - RNA, 21 nt, Human papillomavirus type 18
ugcaucccagcaguaagcaac

SEQ ID NO: 4009749 - RNA, 22 nt, Human papillomavirus type 18
ugccaugucccgcuuuugccau

SEQ ID NO: 4009750 - RNA, 23 nt, Human papillomavirus type 18
ugcgaggaacuauggaauacaga

SEQ ID NO: 4009751 - RNA, 12 nt, Human papillomavirus type 18
ugcuuuuuguau

SEQ ID NO: 4009752 - RNA, 13 nt, Human papillomavirus type 18
uggaaauuggccg

SEQ ID NO: 4009753 - RNA, 20 nt, Human papillomavirus type 18
uggcauuggacaggugcagg

SEQ ID NO: 4009754 - RNA, 20 nt, Human papillomavirus type 18
ugggcguuccaauacagugg

SEQ ID NO: 4009755 - RNA, 14 nt, Human papillomavirus type 18
uguauuauaugacu

SEQ ID NO: 4009756 - RNA, 13 nt, Human papillomavirus type 18
ugugaacaggcag

SEQ ID NO: 4009757 - RNA, 22 nt, Human papillomavirus type 18
ugugcaucccagcaguaagcaa

SEQ ID NO: 4009758 - RNA, 13 nt, Human papillomavirus type 18
ugugcguaugcau

SEQ ID NO: 4009759 - RNA, 18 nt, Human papillomavirus type 18
uuaaauacuguugcaauu

SEQ ID NO: 4009760 - RNA, 16 nt, Human papillomavirus type 18
uucacaguauauguau

SEQ ID NO: 4009761 - RNA, 17 nt, Human papillomavirus type 18
uucacaguauauguauu

SEQ ID NO: 4009762 - RNA, 21 nt, Human papillomavirus type 18
uucacaguauauguauuuugu

SEQ ID NO: 4009763 - RNA, 20 nt, Human papillomavirus type 18
uugcuuuuguguaugcaugu

SEQ ID NO: 4009764 - RNA, 16 nt, Human papillomavirus type 18
uuuagguguuggccuu

SEQ ID NO: 4009765 - RNA, 10 nt, Human papillomavirus type 18
uuuguuguau

SEQ ID NO: 4009766 - RNA, 20 nt, Human papillomavirus type 18
aaacaggaauacugacugua

SEQ ID NO: 4009767 - RNA, 17 nt, Human papillomavirus type 18
aaaggcggcuguuuaca

SEQ ID NO: 4009768 - RNA, 22 nt, Human papillomavirus type 18
aaaguuugcaggaggcagcaca

SEQ ID NO: 4009769 - RNA, 20 nt, Human papillomavirus type 18
aaauguuuacgguacagauu

SEQ ID NO: 4009770 - RNA, 19 nt, Human papillomavirus type 18
aaguauauuuugauggcaa

SEQ ID NO: 4009771 - RNA, 21 nt, Human papillomavirus type 18
aauuguauagguuguuuuaua

SEQ ID NO: 4009772 - RNA, 18 nt, Human papillomavirus type 18
acaacuguauuuguguuu

SEQ ID NO: 4009773 - RNA, 12 nt, Human papillomavirus type 18
acagacacaggg

SEQ ID NO: 4009774 - RNA, 19 nt, Human papillomavirus type 18
acaggugcaggcaaugaaa

SEQ ID NO: 4009775 - RNA, 22 nt, Human papillomavirus type 18
acaguguauuguacauuguaua

SEQ ID NO: 4009776 - RNA, 18 nt, Human papillomavirus type 18
acauuuugugaacaggca

SEQ ID NO: 4009777 - RNA, 21 nt, Human papillomavirus type 18
accgaggauuggacacugcaa

SEQ ID NO: 4009778 - RNA, 19 nt, Human papillomavirus type 18
accuauguagcaugggaca

SEQ ID NO: 4009779 - RNA, 22 nt, Human papillomavirus type 18
accuucuaugucacgagcaauu

SEQ ID NO: 4009780 - RNA, 13 nt, Human papillomavirus type 18
acgaggacgaaaa

SEQ ID NO: 4009781 - RNA, 14 nt, Human papillomavirus type 18
acuggcagugguac

SEQ ID NO: 4009782 - RNA, 17 nt, Human papillomavirus type 18
acuuauauaaaacaugu

SEQ ID NO: 4009783 - RNA, 18 nt, Human papillomavirus type 18
agaaacaguuuaaaaugu

SEQ ID NO: 4009784 - RNA, 16 nt, Human papillomavirus type 18
agagacagcacaggca

SEQ ID NO: 4009785 - RNA, 15 nt, Human papillomavirus type 18
aggguacauuccauu

SEQ ID NO: 4009786 - RNA, 20 nt, Human papillomavirus type 18
agguccacaaugaugcacaa

SEQ ID NO: 4009787 - RNA, 14 nt, Human papillomavirus type 18
aguuugcaggaggc

SEQ ID NO: 4009788 - RNA, 20 nt, Human papillomavirus type 18
auacaucuauuguuguguuu

SEQ ID NO: 4009789 - RNA, 13 nt, Human papillomavirus type 18
augcgcaggaggu

SEQ ID NO: 4009790 - RNA, 18 nt, Human papillomavirus type 18
auggcugauccagaaggu

SEQ ID NO: 4009791 - RNA, 16 nt, Human papillomavirus type 18
augguaucccaccgug

SEQ ID NO: 4009792 - RNA, 16 nt, Human papillomavirus type 18
auguagcaugggacag

SEQ ID NO: 4009793 - RNA, 19 nt, Human papillomavirus type 18
augucccgcuuuugccauc

SEQ ID NO: 4009794 - RNA, 16 nt, Human papillomavirus type 18
auugauacacaaggaa

SEQ ID NO: 4009795 - RNA, 21 nt, Human papillomavirus type 18
auuguuccaugcgcaggaggu

SEQ ID NO: 4009796 - RNA, 23 nt, Human papillomavirus type 18
caaggaacauuuugugaacaggc

SEQ ID NO: 4009797 - RNA, 18 nt, Human papillomavirus type 18
caauggcugauccagaag

SEQ ID NO: 4009798 - RNA, 15 nt, Human papillomavirus type 18
cacacaauguugugu

SEQ ID NO: 4009799 - RNA, 19 nt, Human papillomavirus type 18
caggaggcagcacagaaaa

SEQ ID NO: 4009800 - RNA, 20 nt, Human papillomavirus type 18
cauagacagccaaauacagu

SEQ ID NO: 4009801 - RNA, 16 nt, Human papillomavirus type 18
ccaugucccgcuuuug

SEQ ID NO: 4009802 - RNA, 11 nt, Human papillomavirus type 18
ccguggugugc

SEQ ID NO: 4009803 - RNA, 16 nt, Human papillomavirus type 18
ccuuuuaugcuuuuug

SEQ ID NO: 4009804 - RNA, 16 nt, Human papillomavirus type 18
cggguuguaacggcug

SEQ ID NO: 4009805 - RNA, 21 nt, Human papillomavirus type 18
cugcaggugguggcaauaagc

SEQ ID NO: 4009806 - RNA, 18 nt, Human papillomavirus type 18
cuuauuuuuuuauuuugc

SEQ ID NO: 4009807 - RNA, 13 nt, Human papillomavirus type 18
gaaagcucagcag

SEQ ID NO: 4009808 - RNA, 16 nt, Human papillomavirus type 18
gaaccacaacgucaca

SEQ ID NO: 4009809 - RNA, 18 nt, Human papillomavirus type 18
gaacuauggaauacagaa

SEQ ID NO: 4009810 - RNA, 16 nt, Human papillomavirus type 18
gaccacuauagagaua

SEQ ID NO: 4009811 - RNA, 15 nt, Human papillomavirus type 18
gagacagcacaggca

SEQ ID NO: 4009812 - RNA, 19 nt, Human papillomavirus type 18
gagcauuccagcagcuguu

SEQ ID NO: 4009813 - RNA, 15 nt, Human papillomavirus type 18
gaggauuggacacug

SEQ ID NO: 4009814 - RNA, 14 nt, Human papillomavirus type 18
gcaacagacacagg

SEQ ID NO: 4009815 - RNA, 20 nt, Human papillomavirus type 18
gcagagcuagagacagcaca

SEQ ID NO: 4009816 - RNA, 21 nt, Human papillomavirus type 18
gcagagcuagagacagcacag

SEQ ID NO: 4009817 - RNA, 13 nt, Human papillomavirus type 18
gcauauacaugcu

SEQ ID NO: 4009818 - RNA, 21 nt, Human papillomavirus type 18
gcauauuuuaucaugcuggca

SEQ ID NO: 4009819 - RNA, 14 nt, Human papillomavirus type 18
gcauguaugugugc

SEQ ID NO: 4009820 - RNA, 12 nt, Human papillomavirus type 18
gccaaauacagu

SEQ ID NO: 4009821 - RNA, 17 nt, Human papillomavirus type 18
gcuauauauuguccugu

SEQ ID NO: 4009822 - RNA, 15 nt, Human papillomavirus type 18
cagaaaacaguccau

SEQ ID NO: 4009823 - RNA, 22 nt, Human papillomavirus type 18
cagagcuagagacagcacaggc

SEQ ID NO: 4009824 - RNA, 19 nt, Human papillomavirus type 18
cagaugacgaggacgaaaa

SEQ ID NO: 4009825 - RNA, 18 nt, Human papillomavirus type 18
cagcaagggaacauggca

SEQ ID NO: 4009826 - RNA, 12 nt, Human papillomavirus type 18
cagcacaggcau

SEQ ID NO: 4009827 - RNA, 20 nt, Human papillomavirus type 18
cagcagacgaccuucgagca

SEQ ID NO: 4009828 - RNA, 19 nt, Human papillomavirus type 18
cagcagcuguuucugaaca

SEQ ID NO: 4009829 - RNA, 13 nt, Human papillomavirus type 18
caggaacauggga

SEQ ID NO: 4009830 - RNA, 14 nt, Human papillomavirus type 18
caguacgcuggcac

SEQ ID NO: 4009831 - RNA, 16 nt, Human papillomavirus type 18
caguauuggcaacuaa

SEQ ID NO: 4009832 - RNA, 19 nt, Human papillomavirus type 18
caguguauuguacauugua

SEQ ID NO: 4009833 - RNA, 20 nt, Human papillomavirus type 18
cauaaagcuauugaacugca

SEQ ID NO: 4009834 - RNA, 19 nt, Human papillomavirus type 18
caucaacauuuaccagccc

SEQ ID NO: 4009835 - RNA, 18 nt, Human papillomavirus type 18
cauguuacuauugcauau

SEQ ID NO: 4009836 - RNA, 15 nt, Human papillomavirus type 18
cauuuugcugugcaa

SEQ ID NO: 4009837 - RNA, 11 nt, Human papillomavirus type 18
ccaauacagug

SEQ ID NO: 4009838 - RNA, 12 nt, Human papillomavirus type 18
ccaauacagugg

SEQ ID NO: 4009839 - RNA, 13 nt, Human papillomavirus type 18
ccaauacaguggu

SEQ ID NO: 4009840 - RNA, 23 nt, Human papillomavirus type 18
ccagcaguaagcaacaauggcug

SEQ ID NO: 4009841 - RNA, 13 nt, Human papillomavirus type 18
ccgacgagccgaa

SEQ ID NO: 4009842 - RNA, 17 nt, Human papillomavirus type 18
ccgccacgucuaauguu

SEQ ID NO: 4009843 - RNA, 13 nt, Human papillomavirus type 18
ccuaagguuucug

SEQ ID NO: 4009844 - RNA, 18 nt, Human papillomavirus type 18
ccuacaauccuccauuuu

SEQ ID NO: 4009845 - RNA, 19 nt, Human papillomavirus type 18
ccugcaggugguggcaaua

SEQ ID NO: 4009846 - RNA, 15 nt, Human papillomavirus type 18
cguuuagugugggcc

SEQ ID NO: 4009847 - RNA, 22 nt, Human papillomavirus type 18
cuaauacguugggaaaaugcaa

SEQ ID NO: 4009848 - RNA, 15 nt, Human papillomavirus type 18
cuauggaauacagaa

SEQ ID NO: 4009849 - RNA, 22 nt, Human papillomavirus type 18
cucccacaagcauauuuuauca

SEQ ID NO: 4009850 - RNA, 18 nt, Human papillomavirus type 18
cugaugcaggaacauggg

SEQ ID NO: 4009851 - RNA, 22 nt, Human papillomavirus type 18
cuuagugggcauccauuuuaua

SEQ ID NO: 4009852 - RNA, 15 nt, Human papillomavirus type 18
cuuuuguguaugcau

SEQ ID NO: 4009853 - RNA, 18 nt, Human papillomavirus type 18
gaaaaugcaacagacaca

SEQ ID NO: 4009854 - RNA, 18 nt, Human papillomavirus type 18
gaacauggcauacagaca

SEQ ID NO: 4009855 - RNA, 21 nt, Human papillomavirus type 18
gacugaugcaggaacauggga

SEQ ID NO: 4009856 - RNA, 16 nt, Human papillomavirus type 18
gagacagcacaggcau

SEQ ID NO: 4009857 - RNA, 14 nt, Human papillomavirus type 18
gauguaauaucaga

SEQ ID NO: 4009858 - RNA, 13 nt, Human papillomavirus type 18
gcaacagacacag

SEQ ID NO: 4009859 - RNA, 16 nt, Human papillomavirus type 18
gcagcucuagauuauu

SEQ ID NO: 4009860 - RNA, 14 nt, Human papillomavirus type 18
gcugauccagaagg

SEQ ID NO: 4009861 - RNA, 15 nt, Human papillomavirus type 18
ggagcggcuggaggu

SEQ ID NO: 4009862 - RNA, 14 nt, Human papillomavirus type 18
ggaggcagcacaga

SEQ ID NO: 4009863 - RNA, 18 nt, Human papillomavirus type 18
ggcagagcuagagacagc

SEQ ID NO: 4009864 - RNA, 19 nt, Human papillomavirus type 18
ggccugugcuggaguggaa

SEQ ID NO: 4009865 - RNA, 20 nt, Human papillomavirus type 18
gggaacauggcauacagaca

SEQ ID NO: 4009866 - RNA, 20 nt, Human papillomavirus type 18
gguguuggccuuagugggca

SEQ ID NO: 4009867 - RNA, 17 nt, Human papillomavirus type 18
guagaaagcucagcaga

SEQ ID NO: 4009868 - RNA, 19 nt, Human papillomavirus type 18
guccacgguuacaagaaau

SEQ ID NO: 4009869 - RNA, 13 nt, Human papillomavirus type 18
guguuuguauguc

SEQ ID NO: 4009870 - RNA, 16 nt, Human papillomavirus type 18
guuagcagauaaaaua

SEQ ID NO: 4009871 - RNA, 14 nt, Human papillomavirus type 18
guuguuuuauacag

SEQ ID NO: 4009872 - RNA, 19 nt, Human papillomavirus type 18
guuuuauguacaagcuauu

SEQ ID NO: 4009873 - RNA, 18 nt, Human papillomavirus type 18
uaaaauauugcaaugguc

SEQ ID NO: 4009874 - RNA, 21 nt, Human papillomavirus type 18
uacaauccuccauuuugcugu

SEQ ID NO: 4009875 - RNA, 14 nt, Human papillomavirus type 18
uaccaauauguuau

SEQ ID NO: 4009876 - RNA, 20 nt, Human papillomavirus type 18
uacuguugcaauuccagaua

SEQ ID NO: 4009877 - RNA, 17 nt, Human papillomavirus type 18
uagaguauuuagggugc

SEQ ID NO: 4009878 - RNA, 18 nt, Human papillomavirus type 18
uagguacuggcaguggua

SEQ ID NO: 4009879 - RNA, 22 nt, Human papillomavirus type 18
uauagguuguuuuauacagugu

SEQ ID NO: 4009880 - RNA, 15 nt, Human papillomavirus type 18
uauauaaaacaugua

SEQ ID NO: 4009881 - RNA, 16 nt, Human papillomavirus type 18
uaugcuuuuuguauuu

SEQ ID NO: 4009882 - RNA, 19 nt, Human papillomavirus type 18
uaugguaucccaccgugcc

SEQ ID NO: 4009883 - RNA, 15 nt, Human papillomavirus type 18
auguuuuaaaacgaa

SEQ ID NO: 4009884 - RNA, 21 nt, Human papillomavirus type 18
caaauauuggugggauacaug

SEQ ID NO: 4009885 - RNA, 16 nt, Human papillomavirus type 18
caacuguauuuguguu

SEQ ID NO: 4009886 - RNA, 14 nt, Human papillomavirus type 18
caagggaacauggc

SEQ ID NO: 4009887 - RNA, 21 nt, Human papillomavirus type 18
cagagcuagagacagcacagg

SEQ ID NO: 4009888 - RNA, 21 nt, Human papillomavirus type 18
cagauaaaauauugcaauggu

SEQ ID NO: 4009889 - RNA, 21 nt, Human papillomavirus type 18
cagauugcgaaaacauagcga

SEQ ID NO: 4009890 - RNA, 20 nt, Human papillomavirus type 18
cagcaagggaacauggcaua

SEQ ID NO: 4009891 - RNA, 17 nt, Human papillomavirus type 18
caggaggcagcacagaa

SEQ ID NO: 4009892 - RNA, 15 nt, Human papillomavirus type 18
caggcagagcuagag

SEQ ID NO: 4009893 - RNA, 15 nt, Human papillomavirus type 18
caguguauuguacau

SEQ ID NO: 4009894 - RNA, 13 nt, Human papillomavirus type 18
cauagacagccaa

SEQ ID NO: 4009895 - RNA, 14 nt, Human papillomavirus type 18
caugcuauauuguc

SEQ ID NO: 4009896 - RNA, 16 nt, Human papillomavirus type 18
ccuauguagcauggga

SEQ ID NO: 4009897 - RNA, 15 nt, Human papillomavirus type 18
ccuccuucuguggca

SEQ ID NO: 4009898 - RNA, 19 nt, Human papillomavirus type 18
ccugauacuaguauuuaua

SEQ ID NO: 4009899 - RNA, 19 nt, Human papillomavirus type 18
cgaggaacuauggaauaca

SEQ ID NO: 4009900 - RNA, 21 nt, Human papillomavirus type 18
cuaagguuucugcauaccaau

SEQ ID NO: 4009901 - RNA, 15 nt, Human papillomavirus type 18
cuagagacagcacag

SEQ ID NO: 4009902 - RNA, 15 nt, Human papillomavirus type 18
cuauagagauauauc

SEQ ID NO: 4009903 - RNA, 17 nt, Human papillomavirus type 18
cuauauauuguccugua

SEQ ID NO: 4009904 - RNA, 14 nt, Human papillomavirus type 18
cugauacuaguauu

SEQ ID NO: 4009905 - RNA, 22 nt, Human papillomavirus type 18
gaaaaugcaacagacacagggu

SEQ ID NO: 4009906 - RNA, 15 nt, Human papillomavirus type 18
gacaaaaaaacagga

SEQ ID NO: 4009907 - RNA, 23 nt, Human papillomavirus type 18
gacacagggucggauaugguaga

SEQ ID NO: 4009908 - RNA, 22 nt, Human papillomavirus type 18
gacagcacaggcauuguuccau

SEQ ID NO: 4009909 - RNA, 16 nt, Human papillomavirus type 18
gacgaaaaugcaacag

SEQ ID NO: 4009910 - RNA, 19 nt, Human papillomavirus type 18
gcaauuaagcgacucagag

SEQ ID NO: 4009911 - RNA, 19 nt, Human papillomavirus type 18
gcagaaaaaggcaaaaagg

SEQ ID NO: 4009912 - RNA, 20 nt, Human papillomavirus type 18
gcauuuagagccccaaaaug

SEQ ID NO: 4009913 - RNA, 22 nt, Human papillomavirus type 18
gccaugucccgcuuuugccauc

SEQ ID NO: 4009914 - RNA, 22 nt, Human papillomavirus type 18
gcggcuggagguggauacagag

SEQ ID NO: 4009915 - RNA, 18 nt, Human papillomavirus type 18
ggcaaaaaggcggcuguu

SEQ ID NO: 4009916 - RNA, 23 nt, Human papillomavirus type 18
ggcacggguuguaacggcugguu

SEQ ID NO: 4009917 - RNA, 14 nt, Human papillomavirus type 18
ggcagcacagaaaa

SEQ ID NO: 4009918 - RNA, 21 nt, Human papillomavirus type 18
ggcguuccaauacaguggugg

SEQ ID NO: 4009919 - RNA, 22 nt, Human papillomavirus type 18
guaaagacauagacagccaaau

SEQ ID NO: 4009920 - RNA, 11 nt, Human papillomavirus type 18
guauguccugu

SEQ ID NO: 4009921 - RNA, 23 nt, Human papillomavirus type 18
gucuguaugugugcguaugcaug

SEQ ID NO: 4009922 - RNA, 12 nt, Human papillomavirus type 18
gugaagccagaa

SEQ ID NO: 4009923 - RNA, 20 nt, Human papillomavirus type 18
guguguauauauauauacau

SEQ ID NO: 4009924 - RNA, 14 nt, Human papillomavirus type 18
guugggaaaaugca

SEQ ID NO: 4009925 - RNA, 20 nt, Human papillomavirus type 18
uaaaauguuuacgguacaga

SEQ ID NO: 4009926 - RNA, 21 nt, Human papillomavirus type 18
uaacggcugguuuuauguaca

SEQ ID NO: 4009927 - RNA, 20 nt, Human papillomavirus type 18
uaacuguugguaauccauau

SEQ ID NO: 4009928 - RNA, 17 nt, Human papillomavirus type 18
uaauaacguccccugcc

SEQ ID NO: 4009929 - RNA, 19 nt, Human papillomavirus type 18
uacacgucccccagugguu

SEQ ID NO: 4009930 - RNA, 17 nt, Human papillomavirus type 18
uagacaaaaaaacagga

SEQ ID NO: 4009931 - RNA, 23 nt, Human papillomavirus type 18
uagugaguaacaacuguauuugu

SEQ ID NO: 4009932 - RNA, 17 nt, Human papillomavirus type 18
uauaucauccaccuggc

SEQ ID NO: 4009933 - RNA, 20 nt, Human papillomavirus type 18
uauauuuuguuuuauaccuu

SEQ ID NO: 4009934 - RNA, 20 nt, Human papillomavirus type 18
uaugcauggaccuaaggcaa

SEQ ID NO: 4009935 - RNA, 14 nt, Human papillomavirus type 18
uauguccuguguuu

SEQ ID NO: 4009936 - RNA, 14 nt, Human papillomavirus type 18
uauuguccuguauu

SEQ ID NO: 4009937 - RNA, 13 nt, Human papillomavirus type 18
ucccccagugguu

SEQ ID NO: 4009938 - RNA, 17 nt, Human papillomavirus type 18
ucccgcuuuugccaucu

SEQ ID NO: 4009939 - RNA, 19 nt, Human papillomavirus type 18
ucuauuguuguguuuguau

SEQ ID NO: 4009940 - RNA, 13 nt, Human papillomavirus type 18
ugcaggaggcagc

SEQ ID NO: 4009941 - RNA, 17 nt, Human papillomavirus type 18
ugcaggaggcagcacag

SEQ ID NO: 4009942 - RNA, 20 nt, Human papillomavirus type 18
ugcaggugguggcaauaagc

SEQ ID NO: 4009943 - RNA, 23 nt, Human papillomavirus type 18
ugcauguaugugugcugccaugu

SEQ ID NO: 4009944 - RNA, 17 nt, Human papillomavirus type 18
ugccaucugucuguaug

SEQ ID NO: 4009945 - RNA, 22 nt, Human papillomavirus type 18
ugccaucugucuguaugugugc

SEQ ID NO: 4009946 - RNA, 21 nt, Human papillomavirus type 18
uggacaggugcaggcaaugaa

SEQ ID NO: 4009947 - RNA, 17 nt, Human papillomavirus type 18
uggcuuaugucuguggu

SEQ ID NO: 4009948 - RNA, 19 nt, Human papillomavirus type 18
uggcuuaugucugugguuu

SEQ ID NO: 4009949 - RNA, 22 nt, Human papillomavirus type 18
ugggcguuccaauacaguggug

SEQ ID NO: 4009950 - RNA, 16 nt, Human papillomavirus type 18
uggugggauacaugac

SEQ ID NO: 4009951 - RNA, 22 nt, Human papillomavirus type 18
ugugacucccacaagcauauuu

SEQ ID NO: 4009952 - RNA, 18 nt, Human papillomavirus type 18
uguugguaauccauauuu

SEQ ID NO: 4009953 - RNA, 15 nt, Human papillomavirus type 18
uuacaguaauuguau

SEQ ID NO: 4009954 - RNA, 14 nt, Human papillomavirus type 18
uuaccugauacuag

SEQ ID NO: 4009955 - RNA, 17 nt, Human papillomavirus type 18
uuguaugauugcauugu

SEQ ID NO: 4009956 - RNA, 17 nt, Human papillomavirus type 18
uuguauguuacuauauu

SEQ ID NO: 4009957 - RNA, 14 nt, Human papillomavirus type 18
uuuguauguccugu

SEQ ID NO: 4009958 - RNA, 16 nt, Human papillomavirus type 18
uuuguauuuuuguaau

SEQ ID NO: 4009959 - RNA, 22 nt, Human papillomavirus type 18
cugcauaccaauauagaguauu

SEQ ID NO: 4009960 - RNA, 19 nt, Human papillomavirus type 18
cuguaacauaccauaguga

SEQ ID NO: 4009961 - RNA, 14 nt, Human papillomavirus type 18
cuguaugugugcgu

SEQ ID NO: 4009962 - RNA, 14 nt, Human papillomavirus type 18
cuguguuuguguuu

SEQ ID NO: 4009963 - RNA, 22 nt, Human papillomavirus type 18
gaaaacaguccauuaggggagc

SEQ ID NO: 4009964 - RNA, 20 nt, Human papillomavirus type 18
gacgaaaaugcaacagacac

SEQ ID NO: 4009965 - RNA, 14 nt, Human papillomavirus type 18
gagcuagagacagc

SEQ ID NO: 4009966 - RNA, 17 nt, Human papillomavirus type 31
auguacuguuguggaag

SEQ ID NO: 4009967 - RNA, 17 nt, Human papillomavirus type 31
auguguuagauuugcaa

SEQ ID NO: 4009968 - RNA, 20 nt, Human papillomavirus type 31
auguuggaaacauuaaauaa

SEQ ID NO: 4009969 - RNA, 21 nt, Human papillomavirus type 31
auucauacacaugcaucuuuu

SEQ ID NO: 4009970 - RNA, 13 nt, Human papillomavirus type 31
auugacagacaga

SEQ ID NO: 4009971 - RNA, 15 nt, Human papillomavirus type 31
auuuuuuaaauacug

SEQ ID NO: 4009972 - RNA, 14 nt, Human papillomavirus type 31
caaaaaugaggacu

SEQ ID NO: 4009973 - RNA, 21 nt, Human papillomavirus type 31
caaaugauguuggaaacauua

SEQ ID NO: 4009974 - RNA, 15 nt, Human papillomavirus type 31
cagaagcagagacag

SEQ ID NO: 4009975 - RNA, 17 nt, Human papillomavirus type 31
caggcagaagcagagac

SEQ ID NO: 4009976 - RNA, 16 nt, Human papillomavirus type 31
cagguacagaugggga

SEQ ID NO: 4009977 - RNA, 15 nt, Human papillomavirus type 31
caguaaaacagcaaa

SEQ ID NO: 4009978 - RNA, 17 nt, Human papillomavirus type 31
caguaauugacagacag

SEQ ID NO: 4009979 - RNA, 22 nt, Human papillomavirus type 31
caguaauugacagacagacagg

SEQ ID NO: 4009980 - RNA, 12 nt, Human papillomavirus type 31
caguccagcugg

SEQ ID NO: 4009981 - RNA, 18 nt, Human papillomavirus type 31
cauagacaguccagcugg

SEQ ID NO: 4009982 - RNA, 20 nt, Human papillomavirus type 31
cauauagacuauuggaaaca

SEQ ID NO: 4009983 - RNA, 17 nt, Human papillomavirus type 31
cauguacuuauuucugc

SEQ ID NO: 4009984 - RNA, 19 nt, Human papillomavirus type 31
cauugugcuaugcuuuuug

SEQ ID NO: 4009985 - RNA, 11 nt, Human papillomavirus type 31
ccagacagcgg

SEQ ID NO: 4009986 - RNA, 16 nt, Human papillomavirus type 31
ccagcagguacagaug

SEQ ID NO: 4009987 - RNA, 13 nt, Human papillomavirus type 31
cgcaggcagugcu

SEQ ID NO: 4009988 - RNA, 17 nt, Human papillomavirus type 31
cggaggaacaugcagag

SEQ ID NO: 4009989 - RNA, 22 nt, Human papillomavirus type 31
cuacuauuauuaauugugauuu

SEQ ID NO: 4009990 - RNA, 20 nt, Human papillomavirus type 31
cuacugucuacuuaccaccu

SEQ ID NO: 4009991 - RNA, 22 nt, Human papillomavirus type 31
cuagacuguaacuacaauggcu

SEQ ID NO: 4009992 - RNA, 13 nt, Human papillomavirus type 31
cucuaauagauau

SEQ ID NO: 4009993 - RNA, 22 nt, Human papillomavirus type 31
cuugaacuguauuuaacugcac

SEQ ID NO: 4009994 - RNA, 13 nt, Human papillomavirus type 31
gaaaaugaagaca

SEQ ID NO: 4009995 - RNA, 15 nt, Human papillomavirus type 31
gaagcagagacagca

SEQ ID NO: 4009996 - RNA, 18 nt, Human papillomavirus type 31
gaauguguauuaauguau

SEQ ID NO: 4009997 - RNA, 15 nt, Human papillomavirus type 31
gauauaggcugucaa

SEQ ID NO: 4009998 - RNA, 21 nt, Human papillomavirus type 31
gaucauauagacuauuggaaa

SEQ ID NO: 4009999 - RNA, 15 nt, Human papillomavirus type 31
gcagaggcugugcag

SEQ ID NO: 4010000 - RNA, 14 nt, Human papillomavirus type 31
gcuggacaagcaga

SEQ ID NO: 4010001 - RNA, 14 nt, Human papillomavirus type 31
ggaggaacaugcag

SEQ ID NO: 4010002 - RNA, 21 nt, Human papillomavirus type 31
ggaggggacgggaugcaaugg

SEQ ID NO: 4010003 - RNA, 23 nt, Human papillomavirus type 31
ggaugucauagacaguccagcug

SEQ ID NO: 4010004 - RNA, 23 nt, Human papillomavirus type 31
ggccaaagccuuacaagcuauug

SEQ ID NO: 4010005 - RNA, 17 nt, Human papillomavirus type 31
guaagcauugugcuaug

SEQ ID NO: 4010006 - RNA, 22 nt, Human papillomavirus type 31
guaauugacagacagacagggg

SEQ ID NO: 4010007 - RNA, 13 nt, Human papillomavirus type 31
guaccaaaggugu

SEQ ID NO: 4010008 - RNA, 17 nt, Human papillomavirus type 31
guauaccuauuagacca

SEQ ID NO: 4010009 - RNA, 20 nt, Human papillomavirus type 31
guauguuguccuuauauaca

SEQ ID NO: 4010010 - RNA, 14 nt, Human papillomavirus type 31
guauguuuauguau

SEQ ID NO: 4010011 - RNA, 17 nt, Human papillomavirus type 31
gucaacaggauauauga

SEQ ID NO: 4010012 - RNA, 21 nt, Human papillomavirus type 31
gucaacaggauauaugacuau

SEQ ID NO: 4010013 - RNA, 14 nt, Human papillomavirus type 31
gucauguacuuauu

SEQ ID NO: 4010014 - RNA, 19 nt, Human papillomavirus type 31
gugucaacaggauauauga

SEQ ID NO: 4010015 - RNA, 13 nt, Human papillomavirus type 31
guuccuacuuguu

SEQ ID NO: 4010016 - RNA, 13 nt, Human papillomavirus type 31
uaaaaguuguaca

SEQ ID NO: 4010017 - RNA, 16 nt, Human papillomavirus type 31
uaaacuauuguuccua

SEQ ID NO: 4010018 - RNA, 22 nt, Human papillomavirus type 31
uacuauuugugugucuugucau

SEQ ID NO: 4010019 - RNA, 17 nt, Human papillomavirus type 31
uagauaugccggugguc

SEQ ID NO: 4010020 - RNA, 19 nt, Human papillomavirus type 31
uaggucgcgggcagccauu

SEQ ID NO: 4010021 - RNA, 17 nt, Human papillomavirus type 31
uagugauacuggggagg

SEQ ID NO: 4010022 - RNA, 14 nt, Human papillomavirus type 31
uaguuguaccaaag

SEQ ID NO: 4010023 - RNA, 17 nt, Human papillomavirus type 31
uauaaacaauuguauga

SEQ ID NO: 4010024 - RNA, 15 nt, Human papillomavirus type 31
uauaucaaacaugua

SEQ ID NO: 4010025 - RNA, 17 nt, Human papillomavirus type 31
uauauuaaaauguuuaa

SEQ ID NO: 4010026 - RNA, 19 nt, Human papillomavirus type 31
uaucacgcaggcagugcua

SEQ ID NO: 4010027 - RNA, 15 nt, Human papillomavirus type 31
uauguaauacaugug

SEQ ID NO: 4010028 - RNA, 14 nt, Human papillomavirus type 31
uauguauguuuaug

SEQ ID NO: 4010029 - RNA, 18 nt, Human papillomavirus type 31
uauuaauguauaaagcaa

SEQ ID NO: 4010030 - RNA, 13 nt, Human papillomavirus type 31
uauuaauugugau

SEQ ID NO: 4010031 - RNA, 15 nt, Human papillomavirus type 31
uauuauuaccaugcg

SEQ ID NO: 4010032 - RNA, 15 nt, Human papillomavirus type 31
uauuguauaugugug

SEQ ID NO: 4010033 - RNA, 16 nt, Human papillomavirus type 31
uauuguuccuacuugu

SEQ ID NO: 4010034 - RNA, 20 nt, Human papillomavirus type 31
uauuuaggguucguuuacca

SEQ ID NO: 4010035 - RNA, 12 nt, Human papillomavirus type 31
uccugaaacuca

SEQ ID NO: 4010036 - RNA, 12 nt, Human papillomavirus type 31
ucugacaauccu

SEQ ID NO: 4010037 - RNA, 19 nt, Human papillomavirus type 31
ugagcaauuacccgacagc

SEQ ID NO: 4010038 - RNA, 22 nt, Human papillomavirus type 31
ugauguacacaacaccaugcau

SEQ ID NO: 4010039 - RNA, 17 nt, Human papillomavirus type 31
ugauugaacuaaauauu

SEQ ID NO: 4010040 - RNA, 16 nt, Human papillomavirus type 31
ugcaacacuacuauua

SEQ ID NO: 4010041 - RNA, 19 nt, Human papillomavirus type 31
uggacaaugcagcaaacaa

SEQ ID NO: 4010042 - RNA, 16 nt, Human papillomavirus type 31
uggcugauccagcagg

SEQ ID NO: 4010043 - RNA, 19 nt, Human papillomavirus type 31
uguaauucauacacaugca

SEQ ID NO: 4010044 - RNA, 15 nt, Human papillomavirus type 31
uguauagauggccaa

SEQ ID NO: 4010045 - RNA, 12 nt, Human papillomavirus type 31
uguauauauguu

SEQ ID NO: 4010046 - RNA, 18 nt, Human papillomavirus type 31
uguauguaauacaugugu

SEQ ID NO: 4010047 - RNA, 19 nt, Human papillomavirus type 31
uguauuaauguauaaagca

SEQ ID NO: 4010048 - RNA, 18 nt, Human papillomavirus type 31
ugucaacaggauauauga

SEQ ID NO: 4010049 - RNA, 19 nt, Human papillomavirus type 31
ugucaguaucaaaggccaa

SEQ ID NO: 4010050 - RNA, 23 nt, Human papillomavirus type 31
ugucauacguccacuugugcugu

SEQ ID NO: 4010051 - RNA, 13 nt, Human papillomavirus type 31
uuaaauaaauuug

SEQ ID NO: 4010052 - RNA, 13 nt, Human papillomavirus type 31
uuauaauccugaa

SEQ ID NO: 4010053 - RNA, 17 nt, Human papillomavirus type 31
uuauauaccuauguaua

SEQ ID NO: 4010054 - RNA, 17 nt, Human papillomavirus type 31
uucgcauauugcaagag

SEQ ID NO: 4010055 - RNA, 21 nt, Human papillomavirus type 31
uugaugacacugaaaacucua

SEQ ID NO: 4010056 - RNA, 12 nt, Human papillomavirus type 31
uuggaaacauua

SEQ ID NO: 4010057 - RNA, 14 nt, Human papillomavirus type 31
uuguaaccuuaaca

SEQ ID NO: 4010058 - RNA, 17 nt, Human papillomavirus type 31
uuuauaauccugaaacu

SEQ ID NO: 4010059 - RNA, 19 nt, Human papillomavirus type 31
uuuauguagaagcaguaau

SEQ ID NO: 4010060 - RNA, 15 nt, Human papillomavirus type 31
uuuguguguuauaua

SEQ ID NO: 4010061 - RNA, 17 nt, Human papillomavirus type 31
uuuuuuacuuguguaua

SEQ ID NO: 4010062 - RNA, 16 nt, Human papillomavirus type 31
auugaacuacaaauga

SEQ ID NO: 4010063 - RNA, 16 nt, Human papillomavirus type 31
caaaugauguuggaaa

SEQ ID NO: 4010064 - RNA, 23 nt, Human papillomavirus type 31
caaauuuggauuuccugauacau

SEQ ID NO: 4010065 - RNA, 18 nt, Human papillomavirus type 31
caacaaucaggcagaagc

SEQ ID NO: 4010066 - RNA, 16 nt, Human papillomavirus type 31
caaccucuccauuacg

SEQ ID NO: 4010067 - RNA, 16 nt, Human papillomavirus type 31
caagagaaaugggaau

SEQ ID NO: 4010068 - RNA, 19 nt, Human papillomavirus type 31
caagagcuguuaaugggcu

SEQ ID NO: 4010069 - RNA, 18 nt, Human papillomavirus type 31
cacaguauuaaccaccag

SEQ ID NO: 4010070 - RNA, 17 nt, Human papillomavirus type 31
caccuacguugcaagac

SEQ ID NO: 4010071 - RNA, 23 nt, Human papillomavirus type 31
caucuuuuuuaagucaacaguaa

SEQ ID NO: 4010072 - RNA, 23 nt, Human papillomavirus type 31
ccugucccagugucuaaaguugu

SEQ ID NO: 4010073 - RNA, 16 nt, Human papillomavirus type 31
cuaaaaaaauaguugu

SEQ ID NO: 4010074 - RNA, 22 nt, Human papillomavirus type 31
cuacuccauuuugauuuuaugc

SEQ ID NO: 4010075 - RNA, 15 nt, Human papillomavirus type 31
cuauuagaccaccag

SEQ ID NO: 4010076 - RNA, 17 nt, Human papillomavirus type 31
cugaccuccacuguuau

SEQ ID NO: 4010077 - RNA, 10 nt, Human papillomavirus type 31
cuuacaagcu

SEQ ID NO: 4010078 - RNA, 12 nt, Human papillomavirus type 31
cuugugcugucu

SEQ ID NO: 4010079 - RNA, 18 nt, Human papillomavirus type 31
gaaaauaacaguaaaaca

SEQ ID NO: 4010080 - RNA, 19 nt, Human papillomavirus type 31
gaaacauauucgacuugaa

SEQ ID NO: 4010081 - RNA, 21 nt, Human papillomavirus type 31
gaaacauuaaauaacacugaa

SEQ ID NO: 4010082 - RNA, 21 nt, Human papillomavirus type 31
gaacuaaauauuucuacagua

SEQ ID NO: 4010083 - RNA, 14 nt, Human papillomavirus type 31
gaacuuccagacag

SEQ ID NO: 4010084 - RNA, 22 nt, Human papillomavirus type 31
gaagacucuuugaacuuccaga

SEQ ID NO: 4010085 - RNA, 22 nt, Human papillomavirus type 31
gaagcaguaauugacagacaga

SEQ ID NO: 4010086 - RNA, 22 nt, Human papillomavirus type 31
gacaguccagcuggacaagcag

SEQ ID NO: 4010087 - RNA, 14 nt, Human papillomavirus type 31
gacauguacagaug

SEQ ID NO: 4010088 - RNA, 21 nt, Human papillomavirus type 31
gacuauuuagccuaaugauug

SEQ ID NO: 4010089 - RNA, 19 nt, Human papillomavirus type 31
gacuggacaaugcagcaaa

SEQ ID NO: 4010090 - RNA, 14 nt, Human papillomavirus type 31
gaggacuggacaau

SEQ ID NO: 4010091 - RNA, 19 nt, Human papillomavirus type 31
gauccagcagguacagaug

SEQ ID NO: 4010092 - RNA, 13 nt, Human papillomavirus type 31
gaugcaaugguug

SEQ ID NO: 4010093 - RNA, 15 nt, Human papillomavirus type 31
gaugucauagacagu

SEQ ID NO: 4010094 - RNA, 18 nt, Human papillomavirus type 31
gcagaagcagagacagca

SEQ ID NO: 4010095 - RNA, 19 nt, Human papillomavirus type 31
gcaguaauugacagacaga

SEQ ID NO: 4010096 - RNA, 17 nt, Human papillomavirus type 31
ggaggaacaugcagagg

SEQ ID NO: 4010097 - RNA, 15 nt, Human papillomavirus type 31
gggacaacauuucag

SEQ ID NO: 4010098 - RNA, 14 nt, Human papillomavirus type 31
gggaggggacggga

SEQ ID NO: 4010099 - RNA, 16 nt, Human papillomavirus type 31
gguacagauggggagg

SEQ ID NO: 4010100 - RNA, 14 nt, Human papillomavirus type 31
gguauauguauguu

SEQ ID NO: 4010101 - RNA, 18 nt, Human papillomavirus type 31
guaggccauccauauuau

SEQ ID NO: 4010102 - RNA, 18 nt, Human papillomavirus type 31
guccacuugugcugucug

SEQ ID NO: 4010103 - RNA, 20 nt, Human papillomavirus type 31
uaaagcaagagaaaugggaa

SEQ ID NO: 4010104 - RNA, 14 nt, Human papillomavirus type 31
uaaauauguguaua

SEQ ID NO: 4010105 - RNA, 22 nt, Human papillomavirus type 31
uaagauauaggcugucaaaaua

SEQ ID NO: 4010106 - RNA, 13 nt, Human papillomavirus type 31
uaauaaauaugug

SEQ ID NO: 4010107 - RNA, 18 nt, Human papillomavirus type 31
uacacaugcaucuuuuuu

SEQ ID NO: 4010108 - RNA, 19 nt, Human papillomavirus type 31
uacaguaggccauccauau

SEQ ID NO: 4010109 - RNA, 20 nt, Human papillomavirus type 31
uacauggcauuggacaugua

SEQ ID NO: 4010110 - RNA, 13 nt, Human papillomavirus type 31
uacguugcaagac

SEQ ID NO: 4010111 - RNA, 16 nt, Human papillomavirus type 31
uacugucuacuuacca

SEQ ID NO: 4010112 - RNA, 15 nt, Human papillomavirus type 31
uacuguuguuuguau

SEQ ID NO: 4010113 - RNA, 18 nt, Human papillomavirus type 31
uauaaacaauuguaugaa

SEQ ID NO: 4010114 - RNA, 15 nt, Human papillomavirus type 31
uauaaagcaagagaa

SEQ ID NO: 4010115 - RNA, 18 nt, Human papillomavirus type 31
uauaauccugaaacucaa

SEQ ID NO: 4010116 - RNA, 17 nt, Human papillomavirus type 31
uauagacuauuggaaac

SEQ ID NO: 4010117 - RNA, 15 nt, Human papillomavirus type 31
uauagauggccaaug

SEQ ID NO: 4010118 - RNA, 13 nt, Human papillomavirus type 31
uauauuccauuau

SEQ ID NO: 4010119 - RNA, 20 nt, Human papillomavirus type 31
uauggguguuuuuuuuggug

SEQ ID NO: 4010120 - RNA, 21 nt, Human papillomavirus type 31
uauguaugcguguguacuugu

SEQ ID NO: 4010121 - RNA, 17 nt, Human papillomavirus type 31
uauguuguccuuauaua

SEQ ID NO: 4010122 - RNA, 14 nt, Human papillomavirus type 31
uauuaaauaaauuu

SEQ ID NO: 4010123 - RNA, 23 nt, Human papillomavirus type 31
ucagaggacgaaaaugaagacag

SEQ ID NO: 4010124 - RNA, 16 nt, Human papillomavirus type 31
uccauaccuaaaucug

SEQ ID NO: 4010125 - RNA, 15 nt, Human papillomavirus type 31
uccauuuugauuuua

SEQ ID NO: 4010126 - RNA, 16 nt, Human papillomavirus type 31
ucccaauagucaugua

SEQ ID NO: 4010127 - RNA, 13 nt, Human papillomavirus type 31
uccuucuacagua

SEQ ID NO: 4010128 - RNA, 16 nt, Human papillomavirus type 31
ugaacuuccagacagc

SEQ ID NO: 4010129 - RNA, 15 nt, Human papillomavirus type 31
ugacagacagacagg

SEQ ID NO: 4010130 - RNA, 21 nt, Human papillomavirus type 31
ugagcaauuacccgacagcuc

SEQ ID NO: 4010131 - RNA, 13 nt, Human papillomavirus type 31
ugaggacuggaca

SEQ ID NO: 4010132 - RNA, 16 nt, Human papillomavirus type 31
ugaggacuggacaaug

SEQ ID NO: 4010133 - RNA, 16 nt, Human papillomavirus type 31
ugcaaccucuccauua

SEQ ID NO: 4010134 - RNA, 22 nt, Human papillomavirus type 31
ugcaaugguugguuuuauguag

SEQ ID NO: 4010135 - RNA, 15 nt, Human papillomavirus type 31
uguagaggugcaauu

SEQ ID NO: 4010136 - RNA, 14 nt, Human papillomavirus type 31
uguauauauguaua

SEQ ID NO: 4010137 - RNA, 22 nt, Human papillomavirus type 31
uguauguuaauaaauaugugua

SEQ ID NO: 4010138 - RNA, 15 nt, Human papillomavirus type 31
ugucgguauaugcaa

SEQ ID NO: 4010139 - RNA, 19 nt, Human papillomavirus type 31
ugugcagguucuaaaacga

SEQ ID NO: 4010140 - RNA, 13 nt, Human papillomavirus type 31
uguguauacuguu

SEQ ID NO: 4010141 - RNA, 17 nt, Human papillomavirus type 31
ugugucgguauaugcaa

SEQ ID NO: 4010142 - RNA, 15 nt, Human papillomavirus type 31
uuaaaaaaacaugga

SEQ ID NO: 4010143 - RNA, 16 nt, Human papillomavirus type 31
uuaagugauauuagua

SEQ ID NO: 4010144 - RNA, 21 nt, Human papillomavirus type 31
uugaauguguauuaauguaua

SEQ ID NO: 4010145 - RNA, 17 nt, Human papillomavirus type 31
uuggauuuccugauaca

SEQ ID NO: 4010146 - RNA, 19 nt, Human papillomavirus type 31
uuguaugaacaagugucau

SEQ ID NO: 4010147 - RNA, 17 nt, Human papillomavirus type 31
uuuauggguuauugcaa

SEQ ID NO: 4010148 - RNA, 14 nt, Human papillomavirus type 31
uuugugugucuugu

SEQ ID NO: 4010149 - RNA, 15 nt, Human papillomavirus type 31
gagacagcacaggca

SEQ ID NO: 4010150 - RNA, 13 nt, Human papillomavirus type 31
gaggauaugguug

SEQ ID NO: 4010151 - RNA, 13 nt, Human papillomavirus type 31
gcaaauauauuaa

SEQ ID NO: 4010152 - RNA, 22 nt, Human papillomavirus type 31
gcaacacuacuauuauuaauug

SEQ ID NO: 4010153 - RNA, 17 nt, Human papillomavirus type 31
gcaacugaccuccacug

SEQ ID NO: 4010154 - RNA, 16 nt, Human papillomavirus type 31
gcaaugguugguuuua

SEQ ID NO: 4010155 - RNA, 21 nt, Human papillomavirus type 31
ggaagcggaggaacaugcaga

SEQ ID NO: 4010156 - RNA, 22 nt, Human papillomavirus type 31
guaacauacuauuacuauuuua

SEQ ID NO: 4010157 - RNA, 16 nt, Human papillomavirus type 31
guaaccuuaacauaua

SEQ ID NO: 4010158 - RNA, 18 nt, Human papillomavirus type 31
gucaguguaagucuacac

SEQ ID NO: 4010159 - RNA, 20 nt, Human papillomavirus type 31
guccaucagacguuauaccu

SEQ ID NO: 4010160 - RNA, 16 nt, Human papillomavirus type 31
gucuguauguguaugu

SEQ ID NO: 4010161 - RNA, 13 nt, Human papillomavirus type 31
guguacagagcac

SEQ ID NO: 4010162 - RNA, 21 nt, Human papillomavirus type 31
guguguacuuguauauaugua

SEQ ID NO: 4010163 - RNA, 17 nt, Human papillomavirus type 31
uaaacgugcgucugcua

SEQ ID NO: 4010164 - RNA, 23 nt, Human papillomavirus type 31
uaaauaaauuugaugacacugaa

SEQ ID NO: 4010165 - RNA, 16 nt, Human papillomavirus type 31
uaacaguaaaacagca

SEQ ID NO: 4010166 - RNA, 20 nt, Human papillomavirus type 31
uaagucaacaguaacuuuuu

SEQ ID NO: 4010167 - RNA, 16 nt, Human papillomavirus type 31
uaauacaugugucugu

SEQ ID NO: 4010168 - RNA, 21 nt, Human papillomavirus type 31
uacaugugucuguauguguau

SEQ ID NO: 4010169 - RNA, 12 nt, Human papillomavirus type 31
uacuuguuccug

SEQ ID NO: 4010170 - RNA, 23 nt, Human papillomavirus type 31
uauauauguauaguauguuaugu

SEQ ID NO: 4010171 - RNA, 15 nt, Human papillomavirus type 31
uauaugguauaugua

SEQ ID NO: 4010172 - RNA, 23 nt, Human papillomavirus type 31
uauguaugcguguguacuuguau

SEQ ID NO: 4010173 - RNA, 21 nt, Human papillomavirus type 31
uauucgacuugaauguguauu

SEQ ID NO: 4010174 - RNA, 14 nt, Human papillomavirus type 31
uauuguaaccuuaa

SEQ ID NO: 4010175 - RNA, 18 nt, Human papillomavirus type 31
uauuguaaccuuaacaua

SEQ ID NO: 4010176 - RNA, 20 nt, Human papillomavirus type 31
uauuugugugucuugucaua

SEQ ID NO: 4010177 - RNA, 17 nt, Human papillomavirus type 31
ucaacaguaacuuuuuu

SEQ ID NO: 4010178 - RNA, 14 nt, Human papillomavirus type 31
ucacgccauaguaa

SEQ ID NO: 4010179 - RNA, 16 nt, Human papillomavirus type 31
ucaggcagaagcagag

SEQ ID NO: 4010180 - RNA, 19 nt, Human papillomavirus type 31
ucaguaucaaaggccaaag

SEQ ID NO: 4010181 - RNA, 22 nt, Human papillomavirus type 31
ucauauagacuauuggaaacau

SEQ ID NO: 4010182 - RNA, 20 nt, Human papillomavirus type 31
ucgugugccccaacuguucu

SEQ ID NO: 4010183 - RNA, 23 nt, Human papillomavirus type 31
ucuaaaacgaaaguauguaggua

SEQ ID NO: 4010184 - RNA, 15 nt, Human papillomavirus type 31
ucuacaguaagcauu

SEQ ID NO: 4010185 - RNA, 13 nt, Human papillomavirus type 31
ucuacauggcauu

SEQ ID NO: 4010186 - RNA, 19 nt, Human papillomavirus type 31
ugaacuguauuuaacugca

SEQ ID NO: 4010187 - RNA, 20 nt, Human papillomavirus type 31
ugagcaauuacccgacagcu

SEQ ID NO: 4010188 - RNA, 16 nt, Human papillomavirus type 31
ugaggaggaugucaua

SEQ ID NO: 4010189 - RNA, 13 nt, Human papillomavirus type 31
ugauguuggaaac

SEQ ID NO: 4010190 - RNA, 15 nt, Human papillomavirus type 31
ugauguuggaaacau

SEQ ID NO: 4010191 - RNA, 23 nt, Human papillomavirus type 31
ugauguuggaaacauuaaauaac

SEQ ID NO: 4010192 - RNA, 17 nt, Human papillomavirus type 31
ugcaagacuauguguua

SEQ ID NO: 4010193 - RNA, 14 nt, Human papillomavirus type 31
ugcaagagcuguua

SEQ ID NO: 4010194 - RNA, 17 nt, Human papillomavirus type 31
ugcuaugcuuuuugcuu

SEQ ID NO: 4010195 - RNA, 13 nt, Human papillomavirus type 31
uggauauacugua

SEQ ID NO: 4010196 - RNA, 12 nt, Human papillomavirus type 31
ugugaucauaua

SEQ ID NO: 4010197 - RNA, 23 nt, Human papillomavirus type 31
ugugauuuuauggguuauugcaa

SEQ ID NO: 4010198 - RNA, 17 nt, Human papillomavirus type 31
ugugccccaacuguucu

SEQ ID NO: 4010199 - RNA, 13 nt, Human papillomavirus type 31
uguguauguaugc

SEQ ID NO: 4010200 - RNA, 22 nt, Human papillomavirus type 31
uguuuaagauauaggcugucaa

SEQ ID NO: 4010201 - RNA, 22 nt, Human papillomavirus type 31
uucuacaguaagcauugugcua

SEQ ID NO: 4010202 - RNA, 15 nt, Human papillomavirus type 31
uuguuuuuguauaua

SEQ ID NO: 4010203 - RNA, 15 nt, Human papillomavirus type 31
gugucgguauaugca

SEQ ID NO: 4010204 - RNA, 15 nt, Human papillomavirus type 31
guguguuguguaugu

SEQ ID NO: 4010205 - RNA, 16 nt, Human papillomavirus type 31
uaaaacagcaaaacga

SEQ ID NO: 4010206 - RNA, 20 nt, Human papillomavirus type 31
uaaaaggugaugcaaauaua

SEQ ID NO: 4010207 - RNA, 12 nt, Human papillomavirus type 31
uaaauaugugua

SEQ ID NO: 4010208 - RNA, 17 nt, Human papillomavirus type 31
uaaauauuucuacagua

SEQ ID NO: 4010209 - RNA, 15 nt, Human papillomavirus type 31
uaacacugaauacaa

SEQ ID NO: 4010210 - RNA, 17 nt, Human papillomavirus type 31
uaauguauaaagcaaga

SEQ ID NO: 4010211 - RNA, 17 nt, Human papillomavirus type 31
uacuauuugugugucuu

SEQ ID NO: 4010212 - RNA, 22 nt, Human papillomavirus type 31
uacuguaaaaauaccuaacaca

SEQ ID NO: 4010213 - RNA, 19 nt, Human papillomavirus type 31
uacuguuguggaagggcaa

SEQ ID NO: 4010214 - RNA, 16 nt, Human papillomavirus type 31
uacuuguauauaugua

SEQ ID NO: 4010215 - RNA, 16 nt, Human papillomavirus type 31
uagacaguccagcugg

SEQ ID NO: 4010216 - RNA, 15 nt, Human papillomavirus type 31
uagguauuagugguc

SEQ ID NO: 4010217 - RNA, 17 nt, Human papillomavirus type 31
uaguaaaaguuguacac

SEQ ID NO: 4010218 - RNA, 17 nt, Human papillomavirus type 31
uaguauguuaugugugu

SEQ ID NO: 4010219 - RNA, 12 nt, Human papillomavirus type 31
uauaauaaacuu

SEQ ID NO: 4010220 - RNA, 15 nt, Human papillomavirus type 31
uauaauccugaaacu

SEQ ID NO: 4010221 - RNA, 22 nt, Human papillomavirus type 31
uauagauggccaauguacuguu

SEQ ID NO: 4010222 - RNA, 11 nt, Human papillomavirus type 31
uauaugugugu

SEQ ID NO: 4010223 - RNA, 14 nt, Human papillomavirus type 31
uauauuaaaauguu

SEQ ID NO: 4010224 - RNA, 14 nt, Human papillomavirus type 31
uaugcguguguacu

SEQ ID NO: 4010225 - RNA, 22 nt, Human papillomavirus type 31
uauguauaguauguuaugugug

SEQ ID NO: 4010226 - RNA, 17 nt, Human papillomavirus type 31
uauguuguguuuauaua

SEQ ID NO: 4010227 - RNA, 15 nt, Human papillomavirus type 31
uauuccauaccuaaa

SEQ ID NO: 4010228 - RNA, 19 nt, Human papillomavirus type 31
uauugcaagagcuguuaau

SEQ ID NO: 4010229 - RNA, 20 nt, Human papillomavirus type 31
uauuuagccuaaugauugaa

SEQ ID NO: 4010230 - RNA, 14 nt, Human papillomavirus type 31
ucaggcagaagcag

SEQ ID NO: 4010231 - RNA, 23 nt, Human papillomavirus type 31
uccagcagguacagauggggagg

SEQ ID NO: 4010232 - RNA, 18 nt, Human papillomavirus type 31
uccauaccuaaaucugac

SEQ ID NO: 4010233 - RNA, 15 nt, Human papillomavirus type 31
uccucccaauaguca

SEQ ID NO: 4010234 - RNA, 17 nt, Human papillomavirus type 31
ugacaauuguaauguau

SEQ ID NO: 4010235 - RNA, 19 nt, Human papillomavirus type 31
ugaggacuggacaaugcag

SEQ ID NO: 4010236 - RNA, 13 nt, Human papillomavirus type 31
ugauguacacaac

SEQ ID NO: 4010237 - RNA, 21 nt, Human papillomavirus type 31
uggcugauccagcagguacag

SEQ ID NO: 4010238 - RNA, 14 nt, Human papillomavirus type 31
ugguauauguaugu

SEQ ID NO: 4010239 - RNA, 18 nt, Human papillomavirus type 31
uguaugaacaagugucau

SEQ ID NO: 4010240 - RNA, 15 nt, Human papillomavirus type 31
ugucauagacagucc

SEQ ID NO: 4010241 - RNA, 22 nt, Human papillomavirus type 31
ugucauagacaguccagcugga

SEQ ID NO: 4010242 - RNA, 13 nt, Human papillomavirus type 31
ugugcuacuauuu

SEQ ID NO: 4010243 - RNA, 23 nt, Human papillomavirus type 31
ugugcuguauuguauaugugugu

SEQ ID NO: 4010244 - RNA, 14 nt, Human papillomavirus type 31
ugugcugucugugu

SEQ ID NO: 4010245 - RNA, 22 nt, Human papillomavirus type 31
uguguacuuguauauauguaua

SEQ ID NO: 4010246 - RNA, 17 nt, Human papillomavirus type 31
uguguauaccugugugu

SEQ ID NO: 4010247 - RNA, 13 nt, Human papillomavirus type 31
uuaaaaaaacaug

SEQ ID NO: 4010248 - RNA, 17 nt, Human papillomavirus type 31
uuaauaaauauguguau

SEQ ID NO: 4010249 - RNA, 18 nt, Human papillomavirus type 31
uuaguacacguccuucua

SEQ ID NO: 4010250 - RNA, 16 nt, Human papillomavirus type 31
uuauacuaacuggaaa

SEQ ID NO: 4010251 - RNA, 20 nt, Human papillomavirus type 31
uuauauacacccuauuagua

SEQ ID NO: 4010252 - RNA, 21 nt, Human papillomavirus type 31
uuauauaugguauauguaugu

SEQ ID NO: 4010253 - RNA, 12 nt, Human papillomavirus type 31
uugacagacaga

SEQ ID NO: 4010254 - RNA, 19 nt, Human papillomavirus type 31
uugguauaauaaacuuuuu

SEQ ID NO: 4010255 - RNA, 12 nt, Human papillomavirus type 31
uuuugugugcua

SEQ ID NO: 4010256 - RNA, 14 nt, Human papillomavirus type 31
uuuugugugcuacu

SEQ ID NO: 4010257 - RNA, 17 nt, Human papillomavirus type 31
aauguacuguuguggaa

SEQ ID NO: 4010258 - RNA, 22 nt, Human papillomavirus type 31
aauugacagacagacaggggac

SEQ ID NO: 4010259 - RNA, 23 nt, Human papillomavirus type 31
aauugacagacagacaggggaca

SEQ ID NO: 4010260 - RNA, 23 nt, Human papillomavirus type 31
acaauuauaucaaacauguaaag

SEQ ID NO: 4010261 - RNA, 18 nt, Human papillomavirus type 31
acacaugcaucuuuuuua

SEQ ID NO: 4010262 - RNA, 19 nt, Human papillomavirus type 31
acaccaugcauuauacuaa

SEQ ID NO: 4010263 - RNA, 15 nt, Human papillomavirus type 31
acaguaacuuuuuua

SEQ ID NO: 4010264 - RNA, 20 nt, Human papillomavirus type 31
accuacaggguguuuaaaaa

SEQ ID NO: 4010265 - RNA, 21 nt, Human papillomavirus type 31
acuccauuuugauuuuaugca

SEQ ID NO: 4010266 - RNA, 18 nt, Human papillomavirus type 31
agcaaacaagucuugaac

SEQ ID NO: 4010267 - RNA, 15 nt, Human papillomavirus type 31
aggcugugcagguuc

SEQ ID NO: 4010268 - RNA, 19 nt, Human papillomavirus type 31
aguagugauacuggggagg

SEQ ID NO: 4010269 - RNA, 15 nt, Human papillomavirus type 31
agugauacuggggag

SEQ ID NO: 4010270 - RNA, 14 nt, Human papillomavirus type 31
agugucaacaggau

SEQ ID NO: 4010271 - RNA, 19 nt, Human papillomavirus type 31
auaaaaaugcuauuguaac

SEQ ID NO: 4010272 - RNA, 15 nt, Human papillomavirus type 31
auacacaguauuaac

SEQ ID NO: 4010273 - RNA, 22 nt, Human papillomavirus type 31
auaccuguguguguuguguaug

SEQ ID NO: 4010274 - RNA, 18 nt, Human papillomavirus type 31
auaggcugucaaaauaua

SEQ ID NO: 4010275 - RNA, 13 nt, Human papillomavirus type 31
auauacuguagag

SEQ ID NO: 4010276 - RNA, 16 nt, Human papillomavirus type 31
auauuccauuauuugu

SEQ ID NO: 4010277 - RNA, 22 nt, Human papillomavirus type 31
auggugauguacacaacaccau

SEQ ID NO: 4010278 - RNA, 17 nt, Human papillomavirus type 31
auguauagauggccaau

SEQ ID NO: 4010279 - RNA, 22 nt, Human papillomavirus type 31
auguaugcguguguacuuguau

SEQ ID NO: 4010280 - RNA, 12 nt, Human papillomavirus type 31
auguuguccuua

SEQ ID NO: 4010281 - RNA, 18 nt, Human papillomavirus type 31
aaauaacacugaauacaa

SEQ ID NO: 4010282 - RNA, 18 nt, Human papillomavirus type 31
aacacgaaccaacauaua

SEQ ID NO: 4010283 - RNA, 14 nt, Human papillomavirus type 31
aacauacuaccauu

SEQ ID NO: 4010284 - RNA, 15 nt, Human papillomavirus type 31
aacuuuuuuacuugu

SEQ ID NO: 4010285 - RNA, 16 nt, Human papillomavirus type 31
aauagucauguacuua

SEQ ID NO: 4010286 - RNA, 16 nt, Human papillomavirus type 31
aaugauugaacuaaau

SEQ ID NO: 4010287 - RNA, 22 nt, Human papillomavirus type 31
acaaaaaugaggacuggacaau

SEQ ID NO: 4010288 - RNA, 14 nt, Human papillomavirus type 31
acaagcuauugaac

SEQ ID NO: 4010289 - RNA, 21 nt, Human papillomavirus type 31
acacccgguccguuuuuugca

SEQ ID NO: 4010290 - RNA, 21 nt, Human papillomavirus type 31
acaucuuuuuauaauccugaa

SEQ ID NO: 4010291 - RNA, 18 nt, Human papillomavirus type 31
acuuguauauauguauag

SEQ ID NO: 4010292 - RNA, 18 nt, Human papillomavirus type 31
agcaagagaaaugggaau

SEQ ID NO: 4010293 - RNA, 17 nt, Human papillomavirus type 31
aggugaugcaaauauau

SEQ ID NO: 4010294 - RNA, 16 nt, Human papillomavirus type 31
agucaacaguaacuuu

SEQ ID NO: 4010295 - RNA, 14 nt, Human papillomavirus type 31
agugauacugggga

SEQ ID NO: 4010296 - RNA, 18 nt, Human papillomavirus type 31
auaaacaauuguaugaac

SEQ ID NO: 4010297 - RNA, 21 nt, Human papillomavirus type 31
auagaacauacuaccauugca

SEQ ID NO: 4010298 - RNA, 12 nt, Human papillomavirus type 31
auagucauguac

SEQ ID NO: 4010299 - RNA, 16 nt, Human papillomavirus type 31
auauaccuauguauag

SEQ ID NO: 4010300 - RNA, 14 nt, Human papillomavirus type 31
auauuucuacagua

SEQ ID NO: 4010301 - RNA, 17 nt, Human papillomavirus type 31
aucagacguuauaccua

SEQ ID NO: 4010302 - RNA, 18 nt, Human papillomavirus type 31
aucagacguuauaccuaa

SEQ ID NO: 4010303 - RNA, 13 nt, Human papillomavirus type 31
auccaaacaaauu

SEQ ID NO: 4010304 - RNA, 14 nt, Human papillomavirus type 31
aucugacaauccua

SEQ ID NO: 4010305 - RNA, 14 nt, Human papillomavirus type 31
auguauacaacaau

SEQ ID NO: 4010306 - RNA, 13 nt, Human papillomavirus type 31
auguguguaugua

SEQ ID NO: 4010307 - RNA, 14 nt, Human papillomavirus type 31
auuauuaccaugcg

SEQ ID NO: 4010308 - RNA, 13 nt, Human papillomavirus type 31
auugguauuggua

SEQ ID NO: 4010309 - RNA, 19 nt, Human papillomavirus type 31
caaacauguaaagcagcag

SEQ ID NO: 4010310 - RNA, 16 nt, Human papillomavirus type 31
caagucuugaacugua

SEQ ID NO: 4010311 - RNA, 21 nt, Human papillomavirus type 31
caaucaggcagaagcagagac

SEQ ID NO: 4010312 - RNA, 14 nt, Human papillomavirus type 31
cacaggaagcggag

SEQ ID NO: 4010313 - RNA, 21 nt, Human papillomavirus type 31
caccuacaggguguuuaaaaa

SEQ ID NO: 4010314 - RNA, 18 nt, Human papillomavirus type 31
cauacuauuacuauuuua

SEQ ID NO: 4010315 - RNA, 21 nt, Human papillomavirus type 31
caugcauuauacuaacuggaa

SEQ ID NO: 4010316 - RNA, 16 nt, Human papillomavirus type 31
caugugucuguaugug

SEQ ID NO: 4010317 - RNA, 18 nt, Human papillomavirus type 31
ccaaacaaauuuggauuu

SEQ ID NO: 4010318 - RNA, 16 nt, Human papillomavirus type 31
ccacuugugcugucug

SEQ ID NO: 4010319 - RNA, 22 nt, Human papillomavirus type 31
ccagcuggacaagcagaaccgg

SEQ ID NO: 4010320 - RNA, 23 nt, Human papillomavirus type 31
ccaugcauuauacuaacuggaaa

SEQ ID NO: 4010321 - RNA, 15 nt, Human papillomavirus type 31
ccugaggcaacugac

SEQ ID NO: 4010322 - RNA, 16 nt, Human papillomavirus type 31
cggaggaacaugcaga

SEQ ID NO: 4010323 - RNA, 19 nt, Human papillomavirus type 31
cggaggaacaugcagaggc

SEQ ID NO: 4010324 - RNA, 14 nt, Human papillomavirus type 31
cgggaugcaauggu

SEQ ID NO: 4010325 - RNA, 15 nt, Human papillomavirus type 31
cguuuguguguacag

SEQ ID NO: 4010326 - RNA, 16 nt, Human papillomavirus type 31
cuaugcuuuuugcuuu

SEQ ID NO: 4010327 - RNA, 15 nt, Human papillomavirus type 31
cuauguauguuaaua

SEQ ID NO: 4010328 - RNA, 23 nt, Human papillomavirus type 31
cugauacaucuuuuuauaauccu

SEQ ID NO: 4010329 - RNA, 20 nt, Human papillomavirus type 31
cuguguguguuguguauguu

SEQ ID NO: 4010330 - RNA, 22 nt, Human papillomavirus type 31
cuuacaagcuauugaacuacaa

SEQ ID NO: 4010331 - RNA, 21 nt, Human papillomavirus type 31
cuugaacuguauuuaacugca

SEQ ID NO: 4010332 - RNA, 16 nt, Human papillomavirus type 31
gaaaauaacaguaaaa

SEQ ID NO: 4010333 - RNA, 17 nt, Human papillomavirus type 31
gaaccaacauauauuau

SEQ ID NO: 4010334 - RNA, 14 nt, Human papillomavirus type 31
gaacuacaaaugau

SEQ ID NO: 4010335 - RNA, 19 nt, Human papillomavirus type 31
gacacauccaauuacaaua

SEQ ID NO: 4010336 - RNA, 13 nt, Human papillomavirus type 31
gacagacagacag

SEQ ID NO: 4010337 - RNA, 18 nt, Human papillomavirus type 31
aaaacauggauauacugu

SEQ ID NO: 4010338 - RNA, 18 nt, Human papillomavirus type 31
aaacauggauauacugua

SEQ ID NO: 4010339 - RNA, 13 nt, Human papillomavirus type 31
aaaugcuauugua

SEQ ID NO: 4010340 - RNA, 18 nt, Human papillomavirus type 31
aaauuugaugacacugaa

SEQ ID NO: 4010341 - RNA, 12 nt, Human papillomavirus type 31
aacauuaaauaa

SEQ ID NO: 4010342 - RNA, 23 nt, Human papillomavirus type 31
aagagaaaugggaauacacagua

SEQ ID NO: 4010343 - RNA, 17 nt, Human papillomavirus type 31
aagcuauugaacuacaa

SEQ ID NO: 4010344 - RNA, 17 nt, Human papillomavirus type 31
aauaaauuugaugacac

SEQ ID NO: 4010345 - RNA, 13 nt, Human papillomavirus type 31
aaugcagcaaaca

SEQ ID NO: 4010346 - RNA, 22 nt, Human papillomavirus type 31
acaggaagcggaggaacaugca

SEQ ID NO: 4010347 - RNA, 21 nt, Human papillomavirus type 31
acaggggacaacauuucagag

SEQ ID NO: 4010348 - RNA, 14 nt, Human papillomavirus type 31
acauaaaaaugcua

SEQ ID NO: 4010349 - RNA, 15 nt, Human papillomavirus type 31
acauaaaaaugcuau

SEQ ID NO: 4010350 - RNA, 14 nt, Human papillomavirus type 31
acaugugucuguau

SEQ ID NO: 4010351 - RNA, 13 nt, Human papillomavirus type 31
acuaacuggaaau

SEQ ID NO: 4010352 - RNA, 23 nt, Human papillomavirus type 31
acucuuugaacuuccagacagcg

SEQ ID NO: 4010353 - RNA, 17 nt, Human papillomavirus type 31
acuguauuuaacugcac

SEQ ID NO: 4010354 - RNA, 23 nt, Human papillomavirus type 31
acuuuuuuuuuauuauuaccaug

SEQ ID NO: 4010355 - RNA, 23 nt, Human papillomavirus type 31
agagacgauuuuuuaaauacugu

SEQ ID NO: 4010356 - RNA, 17 nt, Human papillomavirus type 31
agauauaggcugucaaa

SEQ ID NO: 4010357 - RNA, 16 nt, Human papillomavirus type 31
agauggggaggggacg

SEQ ID NO: 4010358 - RNA, 15 nt, Human papillomavirus type 31
aggcauuguuucaug

SEQ ID NO: 4010359 - RNA, 17 nt, Human papillomavirus type 31
agguacagauggggagg

SEQ ID NO: 4010360 - RNA, 18 nt, Human papillomavirus type 31
auaacaguaaaacagcaa

SEQ ID NO: 4010361 - RNA, 16 nt, Human papillomavirus type 31
auacaugugucuguau

SEQ ID NO: 4010362 - RNA, 20 nt, Human papillomavirus type 31
auagauggccaauguacugu

SEQ ID NO: 4010363 - RNA, 17 nt, Human papillomavirus type 31
auauaugguauauguau

SEQ ID NO: 4010364 - RNA, 22 nt, Human papillomavirus type 31
auauaugguauauguauguuua

SEQ ID NO: 4010365 - RNA, 21 nt, Human papillomavirus type 31
auauguaacacgaaccaacau

SEQ ID NO: 4010366 - RNA, 16 nt, Human papillomavirus type 31
aucaggcagaagcaga

SEQ ID NO: 4010367 - RNA, 17 nt, Human papillomavirus type 31
aucuuuuuauaauccug

SEQ ID NO: 4010368 - RNA, 22 nt, Human papillomavirus type 31
auguacacaacaccaugcauua

SEQ ID NO: 4010369 - RNA, 12 nt, Human papillomavirus type 31
auguuggaaaca

SEQ ID NO: 4010370 - RNA, 13 nt, Human papillomavirus type 31
auguuguccuuau

SEQ ID NO: 4010371 - RNA, 22 nt, Human papillomavirus type 31
auuaaauaaauuugaugacacu

SEQ ID NO: 4010372 - RNA, 18 nt, Human papillomavirus type 31
auugacagacagacaggg

SEQ ID NO: 4010373 - RNA, 18 nt, Human papillomavirus type 31
auuucagaggacgaaaau

SEQ ID NO: 4010374 - RNA, 19 nt, Human papillomavirus type 31
caaaauauaaacaauugua

SEQ ID NO: 4010375 - RNA, 15 nt, Human papillomavirus type 31
caaaugauguuggaa

SEQ ID NO: 4010376 - RNA, 15 nt, Human papillomavirus type 31
caacaaucaggcaga

SEQ ID NO: 4010377 - RNA, 13 nt, Human papillomavirus type 31
caaguauaccuau

SEQ ID NO: 4010378 - RNA, 12 nt, Human papillomavirus type 31
cacaggaagcgg

SEQ ID NO: 4010379 - RNA, 17 nt, Human papillomavirus type 31
caccugucccagugucu

SEQ ID NO: 4010380 - RNA, 18 nt, Human papillomavirus type 31
cacgaaccaacauauauu

SEQ ID NO: 4010381 - RNA, 13 nt, Human papillomavirus type 31
cagacagacaggg

SEQ ID NO: 4010382 - RNA, 15 nt, Human papillomavirus type 31
cagacagacagggga

SEQ ID NO: 4010383 - RNA, 17 nt, Human papillomavirus type 31
cagacguuauaccuaaa

SEQ ID NO: 4010384 - RNA, 16 nt, Human papillomavirus type 31
cagagacagcacaggc

SEQ ID NO: 4010385 - RNA, 15 nt, Human papillomavirus type 31
cagcuggacaagcag

SEQ ID NO: 4010386 - RNA, 15 nt, Human papillomavirus type 31
caguaauugacagac

SEQ ID NO: 4010387 - RNA, 20 nt, Human papillomavirus type 31
cauagacaguccagcuggac

SEQ ID NO: 4010388 - RNA, 17 nt, Human papillomavirus type 31
cauauagacuauuggaa

SEQ ID NO: 4010389 - RNA, 13 nt, Human papillomavirus type 31
caugcacaggaag

SEQ ID NO: 4010390 - RNA, 16 nt, Human papillomavirus type 31
cgugugccccaacugu

SEQ ID NO: 4010391 - RNA, 17 nt, Human papillomavirus type 31
cguguguacuuguauau

SEQ ID NO: 4010392 - RNA, 22 nt, Human papillomavirus type 31
cuacuagacuguaacuacaaug

SEQ ID NO: 4010393 - RNA, 21 nt, Human papillomavirus type 31
cuagacuguaacuacaauggc

SEQ ID NO: 4010394 - RNA, 22 nt, Human papillomavirus type 31
cugaaacucaacgcuuaguuug

SEQ ID NO: 4010395 - RNA, 14 nt, Human papillomavirus type 31
cugaccuccacugu

SEQ ID NO: 4010396 - RNA, 15 nt, Human papillomavirus type 31
cugucccagugucua

SEQ ID NO: 4010397 - RNA, 22 nt, Human papillomavirus type 31
cugucccagugucuaaaguugu

SEQ ID NO: 4010398 - RNA, 19 nt, Human papillomavirus type 31
cuugugcuguauuguauau

SEQ ID NO: 4010399 - RNA, 17 nt, Human papillomavirus type 31
cuuugcuuuugugugcu

SEQ ID NO: 4010400 - RNA, 16 nt, Human papillomavirus type 31
gaaaaugaagacagua

SEQ ID NO: 4010401 - RNA, 19 nt, Human papillomavirus type 31
gaagcagagacagcacagg

SEQ ID NO: 4010402 - RNA, 23 nt, Human papillomavirus type 31
gacacugaaaacucuaauagaua

SEQ ID NO: 4010403 - RNA, 23 nt, Human papillomavirus type 31
gagcaauuacccgacagcucaga

SEQ ID NO: 4010404 - RNA, 18 nt, Human papillomavirus type 31
gaggaacaugcagaggcu

SEQ ID NO: 4010405 - RNA, 12 nt, Human papillomavirus type 31
gauacuggggag

SEQ ID NO: 4010406 - RNA, 13 nt, Human papillomavirus type 31
gauacuggggagg

SEQ ID NO: 4010407 - RNA, 21 nt, Human papillomavirus type 31
gcaauuacccgacagcucaga

SEQ ID NO: 4010408 - RNA, 22 nt, Human papillomavirus type 31
gcagccauuagguguagguauu

SEQ ID NO: 4010409 - RNA, 16 nt, Human papillomavirus type 31
ggaagcggaggaacau

SEQ ID NO: 4010410 - RNA, 16 nt, Human papillomavirus type 31
ggccaauguacuguug

SEQ ID NO: 4010411 - RNA, 15 nt, Human papillomavirus type 31
ggccuguguugguuu

SEQ ID NO: 4010412 - RNA, 19 nt, Human papillomavirus type 31
gguuaaaagcuauaugcau

SEQ ID NO: 4010413 - RNA, 14 nt, Human papillomavirus type 31
guaaaaauaccuaa

SEQ ID NO: 4010414 - RNA, 20 nt, Human papillomavirus type 31
guagaagcaguaauugacag

SEQ ID NO: 4010415 - RNA, 21 nt, Human papillomavirus type 31
guaguccuuuaagugauauua

SEQ ID NO: 4010416 - RNA, 20 nt, Human papillomavirus type 31
aaaaggugaugcaaauauau

SEQ ID NO: 4010417 - RNA, 22 nt, Human papillomavirus type 31
aaacauguaaagcagcagguac

SEQ ID NO: 4010418 - RNA, 20 nt, Human papillomavirus type 31
aaacauuaaauaacacugaa

SEQ ID NO: 4010419 - RNA, 16 nt, Human papillomavirus type 31
aaagcaagagaaaugg

SEQ ID NO: 4010420 - RNA, 12 nt, Human papillomavirus type 31
aaauauguguau

SEQ ID NO: 4010421 - RNA, 20 nt, Human papillomavirus type 31
aaauuuauauaccuauguau

SEQ ID NO: 4010422 - RNA, 18 nt, Human papillomavirus type 31
aacacugaauacaaaaau

SEQ ID NO: 4010423 - RNA, 17 nt, Human papillomavirus type 31
aacauggauauacugua

SEQ ID NO: 4010424 - RNA, 22 nt, Human papillomavirus type 31
aaccuuaacauauauaaguaca

SEQ ID NO: 4010425 - RNA, 14 nt, Human papillomavirus type 31
aauaaacuuuuuua

SEQ ID NO: 4010426 - RNA, 23 nt, Human papillomavirus type 31
acaauggcugauccagcagguac

SEQ ID NO: 4010427 - RNA, 21 nt, Human papillomavirus type 31
acacugaauacaaaaaugagg

SEQ ID NO: 4010428 - RNA, 12 nt, Human papillomavirus type 31
acaugcagaggc

SEQ ID NO: 4010429 - RNA, 17 nt, Human papillomavirus type 31
acgauuuuuuaaauacu

SEQ ID NO: 4010430 - RNA, 19 nt, Human papillomavirus type 31
acuuaaaaggugaugcaaa

SEQ ID NO: 4010431 - RNA, 16 nt, Human papillomavirus type 31
acuuguauauauguau

SEQ ID NO: 4010432 - RNA, 19 nt, Human papillomavirus type 31
agaagcagagacagcacag

SEQ ID NO: 4010433 - RNA, 22 nt, Human papillomavirus type 31
agaagcaguaauugacagacag

SEQ ID NO: 4010434 - RNA, 14 nt, Human papillomavirus type 31
agaccaaauauuaa

SEQ ID NO: 4010435 - RNA, 20 nt, Human papillomavirus type 31
agcauugacccuguaggucc

SEQ ID NO: 4010436 - RNA, 20 nt, Human papillomavirus type 31
agcauugugcuaugcuuuuu

SEQ ID NO: 4010437 - RNA, 21 nt, Human papillomavirus type 31
agcuauugaacuacaaaugau

SEQ ID NO: 4010438 - RNA, 16 nt, Human papillomavirus type 31
agguacagauggggag

SEQ ID NO: 4010439 - RNA, 22 nt, Human papillomavirus type 31
aguauguuauguguguauguau

SEQ ID NO: 4010440 - RNA, 19 nt, Human papillomavirus type 31
agugucaucuacauggcau

SEQ ID NO: 4010441 - RNA, 16 nt, Human papillomavirus type 31
auacacaugcaucuuu

SEQ ID NO: 4010442 - RNA, 21 nt, Human papillomavirus type 31
auacaugugucuguaugugua

SEQ ID NO: 4010443 - RNA, 23 nt, Human papillomavirus type 31
auacaugugucuguauguguaug

SEQ ID NO: 4010444 - RNA, 15 nt, Human papillomavirus type 31
auacuaacuggaaau

SEQ ID NO: 4010445 - RNA, 21 nt, Human papillomavirus type 31
auacuguuguuuguauuggua

SEQ ID NO: 4010446 - RNA, 20 nt, Human papillomavirus type 31
auaguauguuauguguguau

SEQ ID NO: 4010447 - RNA, 15 nt, Human papillomavirus type 31
auaugguauauguau

SEQ ID NO: 4010448 - RNA, 20 nt, Human papillomavirus type 31
aucugaggcaaguauaccua

SEQ ID NO: 4010449 - RNA, 18 nt, Human papillomavirus type 31
auggcugauccagcaggu

SEQ ID NO: 4010450 - RNA, 14 nt, Human papillomavirus type 31
auggguuauugcaa

SEQ ID NO: 4010451 - RNA, 22 nt, Human papillomavirus type 31
auguaauacaugugucuguaug

SEQ ID NO: 4010452 - RNA, 24 nt, Human papillomavirus type 45
auacuacacagcauccauuuuacu

SEQ ID NO: 4010453 - RNA, 18 nt, Human papillomavirus type 45
auauauguauguuuguau

SEQ ID NO: 4010454 - RNA, 21 nt, Human papillomavirus type 45
aucuguauauuguauacagua

SEQ ID NO: 4010455 - RNA, 23 nt, Human papillomavirus type 45
augcaauacuauuuacagcaagg

SEQ ID NO: 4010456 - RNA, 17 nt, Human papillomavirus type 45
auguaugaaugugccuu

SEQ ID NO: 4010457 - RNA, 19 nt, Human papillomavirus type 45
augugucucgcacaagcau

SEQ ID NO: 4010458 - RNA, 20 nt, Human papillomavirus type 45
auguuagcacauauauguau

SEQ ID NO: 4010459 - RNA, 14 nt, Human papillomavirus type 45
auuaacauuucaaa

SEQ ID NO: 4010460 - RNA, 21 nt, Human papillomavirus type 45
auuaacauuucaaaaagcaaa

SEQ ID NO: 4010461 - RNA, 17 nt, Human papillomavirus type 45
auuacuauaauguacag

SEQ ID NO: 4010462 - RNA, 22 nt, Human papillomavirus type 45
auuggccuaaguggccauccau

SEQ ID NO: 4010463 - RNA, 20 nt, Human papillomavirus type 45
auuggucgugggcagccuuu

SEQ ID NO: 4010464 - RNA, 15 nt, Human papillomavirus type 45
caagagacagcacag

SEQ ID NO: 4010465 - RNA, 17 nt, Human papillomavirus type 45
caaggaaaacaguccau

SEQ ID NO: 4010466 - RNA, 15 nt, Human papillomavirus type 45
cagguguugcaucuu

SEQ ID NO: 4010467 - RNA, 21 nt, Human papillomavirus type 45
caguauauauuauauaacuga

SEQ ID NO: 4010468 - RNA, 20 nt, Human papillomavirus type 45
cauaaagcuauugaacugca

SEQ ID NO: 4010469 - RNA, 17 nt, Human papillomavirus type 45
cauaauaccuaaacugg

SEQ ID NO: 4010470 - RNA, 15 nt, Human papillomavirus type 45
cauaugcaugcuuua

SEQ ID NO: 4010471 - RNA, 16 nt, Human papillomavirus type 45
cauuugcuguauacau

SEQ ID NO: 4010472 - RNA, 18 nt, Human papillomavirus type 45
ccuaauaaauuuggauua

SEQ ID NO: 4010473 - RNA, 20 nt, Human papillomavirus type 45
ccugugaugugcauguuguu

SEQ ID NO: 4010474 - RNA, 15 nt, Human papillomavirus type 45
cgagucagaggagga

SEQ ID NO: 4010475 - RNA, 13 nt, Human papillomavirus type 45
cuacaauggcgga

SEQ ID NO: 4010476 - RNA, 15 nt, Human papillomavirus type 45
cuauggaauacagaa

SEQ ID NO: 4010477 - RNA, 19 nt, Human papillomavirus type 45
cugucuaugugugugcuuu

SEQ ID NO: 4010478 - RNA, 13 nt, Human papillomavirus type 45
cugugaugugcau

SEQ ID NO: 4010479 - RNA, 18 nt, Human papillomavirus type 45
cuuuaugugugcugcaau

SEQ ID NO: 4010480 - RNA, 13 nt, Human papillomavirus type 45
gaaaaaaacaggg

SEQ ID NO: 4010481 - RNA, 17 nt, Human papillomavirus type 45
gaaacacugcaagaaau

SEQ ID NO: 4010482 - RNA, 18 nt, Human papillomavirus type 45
gacaaaacagcagcaugu

SEQ ID NO: 4010483 - RNA, 20 nt, Human papillomavirus type 45
gagcaagagacagcacaggc

SEQ ID NO: 4010484 - RNA, 15 nt, Human papillomavirus type 45
gaggaauggacacug

SEQ ID NO: 4010485 - RNA, 19 nt, Human papillomavirus type 45
gcaaaacgacgguuguuua

SEQ ID NO: 4010486 - RNA, 13 nt, Human papillomavirus type 45
gcaaagcacauaa

SEQ ID NO: 4010487 - RNA, 23 nt, Human papillomavirus type 45
gccuuaaagggccuugcacaaag

SEQ ID NO: 4010488 - RNA, 16 nt, Human papillomavirus type 45
gccuugcacaaagcaa

SEQ ID NO: 4010489 - RNA, 14 nt, Human papillomavirus type 45
ggaaaaugcaauac

SEQ ID NO: 4010490 - RNA, 13 nt, Human papillomavirus type 45
ggauccagaaggu

SEQ ID NO: 4010491 - RNA, 18 nt, Human papillomavirus type 45
guaccuaauggugcaggu

SEQ ID NO: 4010492 - RNA, 19 nt, Human papillomavirus type 45
guaucccaccgugcagcac

SEQ ID NO: 4010493 - RNA, 22 nt, Human papillomavirus type 45
guauggaaauuggucgugggca

SEQ ID NO: 4010494 - RNA, 15 nt, Human papillomavirus type 45
guauguuguauguau

SEQ ID NO: 4010495 - RNA, 16 nt, Human papillomavirus type 45
guauguuuguauguau

SEQ ID NO: 4010496 - RNA, 19 nt, Human papillomavirus type 45
guccacgguuacaagaaau

SEQ ID NO: 4010497 - RNA, 19 nt, Human papillomavirus type 45
guccauuaggggagcagcu

SEQ ID NO: 4010498 - RNA, 17 nt, Human papillomavirus type 45
gucccgcuugugcaguc

SEQ ID NO: 4010499 - RNA, 21 nt, Human papillomavirus type 45
gucucgcacaagcauauuuua

SEQ ID NO: 4010500 - RNA, 18 nt, Human papillomavirus type 45
uaacagcauuugcuguau

SEQ ID NO: 4010501 - RNA, 20 nt, Human papillomavirus type 45
uaacuguaggcaauccauau

SEQ ID NO: 4010502 - RNA, 16 nt, Human papillomavirus type 45
uacauaauugugguau

SEQ ID NO: 4010503 - RNA, 15 nt, Human papillomavirus type 45
uacauuuguugcuau

SEQ ID NO: 4010504 - RNA, 15 nt, Human papillomavirus type 45
uaccugugaugugca

SEQ ID NO: 4010505 - RNA, 12 nt, Human papillomavirus type 45
uacuauaaugua

SEQ ID NO: 4010506 - RNA, 16 nt, Human papillomavirus type 45
uagcacauauauguau

SEQ ID NO: 4010507 - RNA, 20 nt, Human papillomavirus type 45
uaguguuuuuauugugcuuu

SEQ ID NO: 4010508 - RNA, 17 nt, Human papillomavirus type 45
uauaguuguuauuacau

SEQ ID NO: 4010509 - RNA, 10 nt, Human papillomavirus type 45
uauauguuua

SEQ ID NO: 4010510 - RNA, 13 nt, Human papillomavirus type 45
uaucaugcaggca

SEQ ID NO: 4010511 - RNA, 12 nt, Human papillomavirus type 45
uauguaugaaug

SEQ ID NO: 4010512 - RNA, 18 nt, Human papillomavirus type 45
uauuaacauuucaaaaag

SEQ ID NO: 4010513 - RNA, 14 nt, Human papillomavirus type 45
uauuguauacagua

SEQ ID NO: 4010514 - RNA, 15 nt, Human papillomavirus type 45
ugccuuuaugugugc

SEQ ID NO: 4010515 - RNA, 23 nt, Human papillomavirus type 45
ugccuuuaugugugcugcaaugu

SEQ ID NO: 4010516 - RNA, 15 nt, Human papillomavirus type 45
ugggacaguauauau

SEQ ID NO: 4010517 - RNA, 20 nt, Human papillomavirus type 45
uguacaguacaguguaacau

SEQ ID NO: 4010518 - RNA, 17 nt, Human papillomavirus type 45
uguaugguguuacugua

SEQ ID NO: 4010519 - RNA, 17 nt, Human papillomavirus type 45
ugugauauauuacugua

SEQ ID NO: 4010520 - RNA, 14 nt, Human papillomavirus type 45
uguggcauguaugg

SEQ ID NO: 4010521 - RNA, 15 nt, Human papillomavirus type 45
uugcaggaggcagca

SEQ ID NO: 4010522 - RNA, 13 nt, Human papillomavirus type 45
uugcuguauacau

SEQ ID NO: 4010523 - RNA, 17 nt, Human papillomavirus type 45
ugugaugugcauguugu

SEQ ID NO: 4010524 - RNA, 19 nt, Human papillomavirus type 45
uuagcacauauauguaugu

SEQ ID NO: 4010525 - RNA, 19 nt, Human papillomavirus type 45
uuguauguauguauguauu

SEQ ID NO: 4010526 - RNA, 16 nt, Human papillomavirus type 45
uuguauuuuuguauuu

SEQ ID NO: 4010527 - RNA, 15 nt, Human papillomavirus type 45
uuuaugugugcugca

SEQ ID NO: 4010528 - RNA, 13 nt, Human papillomavirus type 45
uuuauugugcuuu

SEQ ID NO: 4010529 - RNA, 23 nt, Human papillomavirus type 45
uuuauugugcuuuucugugugcc

SEQ ID NO: 4010530 - RNA, 17 nt, Human papillomavirus type 45
uuugauggcaacaagga

SEQ ID NO: 4010531 - RNA, 21 nt, Human papillomavirus type 45
uuugcgugcguguauguauga

SEQ ID NO: 4010532 - RNA, 16 nt, Human papillomavirus type 45
gcuuauaugugaccuu

SEQ ID NO: 4010533 - RNA, 17 nt, Human papillomavirus type 45
gcuuauaugugaccuuu

SEQ ID NO: 4010534 - RNA, 19 nt, Human papillomavirus type 45
ggcagagcaagagacagca

SEQ ID NO: 4010535 - RNA, 13 nt, Human papillomavirus type 45
ggcagcaaggaaa

SEQ ID NO: 4010536 - RNA, 22 nt, Human papillomavirus type 45
ggcagcaaggaaaacaguccau

SEQ ID NO: 4010537 - RNA, 22 nt, Human papillomavirus type 45
guaaagacauaaacagccaaau

SEQ ID NO: 4010538 - RNA, 20 nt, Human papillomavirus type 45
guauuggccuaaguggccau

SEQ ID NO: 4010539 - RNA, 18 nt, Human papillomavirus type 45
gugaacaggcagagcaag

SEQ ID NO: 4010540 - RNA, 20 nt, Human papillomavirus type 45
gugcagguaauaaacaggcu

SEQ ID NO: 4010541 - RNA, 19 nt, Human papillomavirus type 45
guuguaccuaauggugcag

SEQ ID NO: 4010542 - RNA, 21 nt, Human papillomavirus type 45
guuguaccuaauggugcaggu

SEQ ID NO: 4010543 - RNA, 14 nt, Human papillomavirus type 45
guuuggaaaaugca

SEQ ID NO: 4010544 - RNA, 22 nt, Human papillomavirus type 45
uaaagggccuugcacaaagcaa

SEQ ID NO: 4010545 - RNA, 17 nt, Human papillomavirus type 45
uaacauuacuaugcuau

SEQ ID NO: 4010546 - RNA, 20 nt, Human papillomavirus type 45
uaacauuucaaaaagcaaag

SEQ ID NO: 4010547 - RNA, 15 nt, Human papillomavirus type 45
uaagugugacggcag

SEQ ID NO: 4010548 - RNA, 22 nt, Human papillomavirus type 45
uacuauuuguguguauguguau

SEQ ID NO: 4010549 - RNA, 16 nt, Human papillomavirus type 45
uaguuguuauuacauc

SEQ ID NO: 4010550 - RNA, 15 nt, Human papillomavirus type 45
uauaacugagacagg

SEQ ID NO: 4010551 - RNA, 12 nt, Human papillomavirus type 45
uauauuacugua

SEQ ID NO: 4010552 - RNA, 16 nt, Human papillomavirus type 45
uauauuguauacagua

SEQ ID NO: 4010553 - RNA, 17 nt, Human papillomavirus type 45
uauucuuuccuguauuu

SEQ ID NO: 4010554 - RNA, 23 nt, Human papillomavirus type 45
uauuuacagcaagggaacauggu

SEQ ID NO: 4010555 - RNA, 21 nt, Human papillomavirus type 45
uauuuacuaccuauguuugua

SEQ ID NO: 4010556 - RNA, 16 nt, Human papillomavirus type 45
ucaaaaagcaaagcac

SEQ ID NO: 4010557 - RNA, 19 nt, Human papillomavirus type 45
uccauuugugaacaggcag

SEQ ID NO: 4010558 - RNA, 14 nt, Human papillomavirus type 45
ucuaugugugugcu

SEQ ID NO: 4010559 - RNA, 17 nt, Human papillomavirus type 45
ugaaacugcaacagaua

SEQ ID NO: 4010560 - RNA, 17 nt, Human papillomavirus type 45
ugaggaauggacacugc

SEQ ID NO: 4010561 - RNA, 20 nt, Human papillomavirus type 45
ugcagucugucuaugugugu

SEQ ID NO: 4010562 - RNA, 21 nt, Human papillomavirus type 45
ugcgcaggaaguucagaauga

SEQ ID NO: 4010563 - RNA, 21 nt, Human papillomavirus type 45
uguaugaaugugccuuguggc

SEQ ID NO: 4010564 - RNA, 17 nt, Human papillomavirus type 45
ugucccgcuugugcagu

SEQ ID NO: 4010565 - RNA, 20 nt, Human papillomavirus type 45
ugugucucgcacaagcauau

SEQ ID NO: 4010566 - RNA, 15 nt, Human papillomavirus type 45
uguguguauguguau

SEQ ID NO: 4010567 - RNA, 15 nt, Human papillomavirus type 45
uguugguguuucuuu

SEQ ID NO: 4010568 - RNA, 19 nt, Human papillomavirus type 45
uugcacaaagcaaguauaa

SEQ ID NO: 4010569 - RNA, 17 nt, Human papillomavirus type 45
uugucagcacugaugau

SEQ ID NO: 4010570 - RNA, 20 nt, Human papillomavirus type 45
uugugcuuuucugugugccu

SEQ ID NO: 4010571 - RNA, 20 nt, Human papillomavirus type 45
uuuguauguuguauguaugu

SEQ ID NO: 4010572 - RNA, 14 nt, Human papillomavirus type 45
uuuuauugugcuuu

SEQ ID NO: 4010573 - RNA, 18 nt, Human papillomavirus type 45
aaaacgaugaagcagaug

SEQ ID NO: 4010574 - RNA, 15 nt, Human papillomavirus type 45
aaaagcaaagcacau

SEQ ID NO: 4010575 - RNA, 23 nt, Human papillomavirus type 45
aacagccaaauaaguuauuggca

SEQ ID NO: 4010576 - RNA, 19 nt, Human papillomavirus type 45
aacugcaacagauacaggg

SEQ ID NO: 4010577 - RNA, 23 nt, Human papillomavirus type 45
aagugcucaugcagcuacagcug

SEQ ID NO: 4010578 - RNA, 15 nt, Human papillomavirus type 45
aaugaugcacaggug

SEQ ID NO: 4010579 - RNA, 18 nt, Human papillomavirus type 45
aaugcaauacuauuuaca

SEQ ID NO: 4010580 - RNA, 22 nt, Human papillomavirus type 45
aauggcugguucuuuguagaaa

SEQ ID NO: 4010581 - RNA, 18 nt, Human papillomavirus type 45
aaugucccgcuugugcag

SEQ ID NO: 4010582 - RNA, 14 nt, Human papillomavirus type 45
acaaaauuuugugu

SEQ ID NO: 4010583 - RNA, 15 nt, Human papillomavirus type 45
acacaccauacaaua

SEQ ID NO: 4010584 - RNA, 15 nt, Human papillomavirus type 45
acacuacagcagcug

SEQ ID NO: 4010585 - RNA, 16 nt, Human papillomavirus type 45
acagcgucacaaaauu

SEQ ID NO: 4010586 - RNA, 21 nt, Human papillomavirus type 45
acaguauauauuauauaacug

SEQ ID NO: 4010587 - RNA, 20 nt, Human papillomavirus type 45
acaguauguaacauuacuau

SEQ ID NO: 4010588 - RNA, 19 nt, Human papillomavirus type 45
acauuucaaaaagcaaagc

SEQ ID NO: 4010589 - RNA, 19 nt, Human papillomavirus type 45
agcauauuuuaucaugcag

SEQ ID NO: 4010590 - RNA, 21 nt, Human papillomavirus type 45
aggaccuuagaacacuacagc

SEQ ID NO: 4010591 - RNA, 17 nt, Human papillomavirus type 45
aggaggcagcaaggaaa

SEQ ID NO: 4010592 - RNA, 12 nt, Human papillomavirus type 45
agugggcacaaa

SEQ ID NO: 4010593 - RNA, 14 nt, Human papillomavirus type 45
auaauguacaguac

SEQ ID NO: 4010594 - RNA, 17 nt, Human papillomavirus type 45
auacuauuuguguguau

SEQ ID NO: 4010595 - RNA, 23 nt, Human papillomavirus type 45
auagugggcacaaaaaagcaaaa

SEQ ID NO: 4010596 - RNA, 22 nt, Human papillomavirus type 45
auauuguauacaguauguaaca

SEQ ID NO: 4010597 - RNA, 22 nt, Human papillomavirus type 45
aucaguauaggguguuuagagu

SEQ ID NO: 4010598 - RNA, 13 nt, Human papillomavirus type 45
augaaugugccuu

SEQ ID NO: 4010599 - RNA, 12 nt, Human papillomavirus type 45
augcacaggugu

SEQ ID NO: 4010600 - RNA, 15 nt, Human papillomavirus type 45
augguuuuguauguu

SEQ ID NO: 4010601 - RNA, 16 nt, Human papillomavirus type 45
auguaguaugggacag

SEQ ID NO: 4010602 - RNA, 16 nt, Human papillomavirus type 45
auguauguauguauuu

SEQ ID NO: 4010603 - RNA, 14 nt, Human papillomavirus type 45
auuuacagcaaggg

SEQ ID NO: 4010604 - RNA, 14 nt, Human papillomavirus type 45
auuugcuguauaca

SEQ ID NO: 4010605 - RNA, 15 nt, Human papillomavirus type 45
caaaaagcaaagcac

SEQ ID NO: 4010606 - RNA, 17 nt, Human papillomavirus type 45
caaauaaguuauuggca

SEQ ID NO: 4010607 - RNA, 23 nt, Human papillomavirus type 45
caacaaggacaacuguaugaacu

SEQ ID NO: 4010608 - RNA, 23 nt, Human papillomavirus type 45
caagaaauuucauuaaauagugg

SEQ ID NO: 4010609 - RNA, 16 nt, Human papillomavirus type 45
caauuaagcgagucag

SEQ ID NO: 4010610 - RNA, 14 nt, Human papillomavirus type 45
cacaaagcaaguau

SEQ ID NO: 4010611 - RNA, 21 nt, Human papillomavirus type 45
cagccaaauaaguuauuggca

SEQ ID NO: 4010612 - RNA, 19 nt, Human papillomavirus type 45
cagggauaugggacaaaac

SEQ ID NO: 4010613 - RNA, 17 nt, Human papillomavirus type 45
caguauguaacauuacu

SEQ ID NO: 4010614 - RNA, 20 nt, Human papillomavirus type 45
cauaauaccuaaacuggcac

SEQ ID NO: 4010615 - RNA, 17 nt, Human papillomavirus type 45
cauauuuuaucaugcag

SEQ ID NO: 4010616 - RNA, 13 nt, Human papillomavirus type 45
caugcgcaggaag

SEQ ID NO: 4010617 - RNA, 21 nt, Human papillomavirus type 45
caugguauuaccaaacuaaac

SEQ ID NO: 4010618 - RNA, 14 nt, Human papillomavirus type 45
cauuaacagcauuu

SEQ ID NO: 4010619 - RNA, 17 nt, Human papillomavirus type 45
ccauuuugcugugcaac

SEQ ID NO: 4010620 - RNA, 14 nt, Human papillomavirus type 45
cccauuaacagcau

SEQ ID NO: 4010621 - RNA, 15 nt, Human papillomavirus type 45
ccuauguuuguauua

SEQ ID NO: 4010622 - RNA, 17 nt, Human papillomavirus type 45
cuguggcuuauauguga

SEQ ID NO: 4010623 - RNA, 22 nt, Human papillomavirus type 45
cuugcacaaagcaaguauaaca

SEQ ID NO: 4010624 - RNA, 23 nt, Human papillomavirus type 45
gaaaacaguccauuaggggagca

SEQ ID NO: 4010625 - RNA, 15 nt, Human papillomavirus type 45
gaaugaugcacaggu

SEQ ID NO: 4010626 - RNA, 22 nt, Human papillomavirus type 45
gaaugugccuuguggcauguau

SEQ ID NO: 4010627 - RNA, 14 nt, Human papillomavirus type 45
gacaacuguaugaa

SEQ ID NO: 4010628 - RNA, 23 nt, Human papillomavirus type 45
gauacaugcgaggaacuauggaa

SEQ ID NO: 4010629 - RNA, 19 nt, Human papillomavirus type 45
gauaugggacaaaacagca

SEQ ID NO: 4010630 - RNA, 15 nt, Human papillomavirus type 45
gauuucgguugccug

SEQ ID NO: 4010631 - RNA, 11 nt, Human papillomavirus type 45
ggaaaaugcaa

SEQ ID NO: 4010632 - RNA, 18 nt, Human papillomavirus type 45
ggcagagcaagagacagc

SEQ ID NO: 4010633 - RNA, 20 nt, Human papillomavirus type 45
gggacaaaacagcagcaugu

SEQ ID NO: 4010634 - RNA, 19 nt, Human papillomavirus type 45
gguuguaccuaauggugca

SEQ ID NO: 4010635 - RNA, 12 nt, Human papillomavirus type 45
guaauggcuggu

SEQ ID NO: 4010636 - RNA, 18 nt, Human papillomavirus type 45
guaucccaccgugcagca

SEQ ID NO: 4010637 - RNA, 23 nt, Human papillomavirus type 45
guauggaaauuggucgugggcag

SEQ ID NO: 4010638 - RNA, 16 nt, Human papillomavirus type 45
gucuaugugugugcuu

SEQ ID NO: 4010639 - RNA, 14 nt, Human papillomavirus type 45
gugcucaugcagcu

SEQ ID NO: 4010640 - RNA, 23 nt, Human papillomavirus type 45
guucccgauuauuaacuguaggc

SEQ ID NO: 4010641 - RNA, 21 nt, Human papillomavirus type 45
guuguguaggguugcacccuu

SEQ ID NO: 4010642 - RNA, 13 nt, Human papillomavirus type 45
guuugcaggaggc

SEQ ID NO: 4010643 - RNA, 14 nt, Human papillomavirus type 45
uaauaguguugugu

SEQ ID NO: 4010644 - RNA, 17 nt, Human papillomavirus type 45
uacauuuguugcuauuu

SEQ ID NO: 4010645 - RNA, 17 nt, Human papillomavirus type 45
uacuauaauguacagua

SEQ ID NO: 4010646 - RNA, 13 nt, Human papillomavirus type 45
uaggggagcagcu

SEQ ID NO: 4010647 - RNA, 18 nt, Human papillomavirus type 45
uauaauaaauuggaugau

SEQ ID NO: 4010648 - RNA, 13 nt, Human papillomavirus type 45
uauauuacuguau

SEQ ID NO: 4010649 - RNA, 20 nt, Human papillomavirus type 45
uaucagaugaugaggaugaa

SEQ ID NO: 4010650 - RNA, 14 nt, Human papillomavirus type 45
uauguaacauuacu

SEQ ID NO: 4010651 - RNA, 16 nt, Human papillomavirus type 45
uauguuuguauuacau

SEQ ID NO: 4010652 - RNA, 13 nt, Human papillomavirus type 45
uauugaacugcaa

SEQ ID NO: 4010653 - RNA, 13 nt, Human papillomavirus type 45
ucaugcaggcagu

SEQ ID NO: 4010654 - RNA, 15 nt, Human papillomavirus type 45
uccauuuuacuuaua

SEQ ID NO: 4010655 - RNA, 17 nt, Human papillomavirus type 45
uccccauuaacagcauu

SEQ ID NO: 4010656 - RNA, 17 nt, Human papillomavirus type 45
ugauauauuacuguauu

SEQ ID NO: 4010657 - RNA, 11 nt, Human papillomavirus type 45
ugaugcacagg

SEQ ID NO: 4010658 - RNA, 20 nt, Human papillomavirus type 45
ugcaauacuauuuacagcaa

SEQ ID NO: 4010659 - RNA, 13 nt, Human papillomavirus type 45
ugcaggaggcagc

SEQ ID NO: 4010660 - RNA, 16 nt, Human papillomavirus type 45
ugcaggaggcagcaag

SEQ ID NO: 4010661 - RNA, 20 nt, Human papillomavirus type 45
ugcuaucuuuaguguuuuua

SEQ ID NO: 4010662 - RNA, 16 nt, Human papillomavirus type 45
uggaaccucagaauga

SEQ ID NO: 4010663 - RNA, 19 nt, Human papillomavirus type 45
uggacacugcaagauacau

SEQ ID NO: 4010664 - RNA, 19 nt, Human papillomavirus type 45
uggcaacaaggacaacugu

SEQ ID NO: 4010665 - RNA, 23 nt, Human papillomavirus type 45
ugguaucccaccgugcagcacgu

SEQ ID NO: 4010666 - RNA, 13 nt, Human papillomavirus type 45
ugguguuacugua

SEQ ID NO: 4010667 - RNA, 21 nt, Human papillomavirus type 45
ugguucuuuguagaaacaauu

SEQ ID NO: 4010668 - RNA, 21 nt, Human papillomavirus type 45
uguaggguugcacccuuguga

SEQ ID NO: 4010669 - RNA, 21 nt, Human papillomavirus type 45
aaaccaccagguggugccucc

SEQ ID NO: 4010670 - RNA, 14 nt, Human papillomavirus type 45
aaaccgugcacgua

SEQ ID NO: 4010671 - RNA, 18 nt, Human papillomavirus type 45
aaagcacauaaagcuauu

SEQ ID NO: 4010672 - RNA, 14 nt, Human papillomavirus type 45
aacaauuguagaga

SEQ ID NO: 4010673 - RNA, 18 nt, Human papillomavirus type 45
aacgaaaguuugcaggag

SEQ ID NO: 4010674 - RNA, 21 nt, Human papillomavirus type 45
aacuuauacguuuggaaaaug

SEQ ID NO: 4010675 - RNA, 16 nt, Human papillomavirus type 45
aauccauauuuuaggg

SEQ ID NO: 4010676 - RNA, 13 nt, Human papillomavirus type 45
aauguacaguaca

SEQ ID NO: 4010677 - RNA, 16 nt, Human papillomavirus type 45
acagcaagggaacaug

SEQ ID NO: 4010678 - RNA, 18 nt, Human papillomavirus type 45
acaguaaagacauaaaca

SEQ ID NO: 4010679 - RNA, 19 nt, Human papillomavirus type 45
acauaaagcuauugaacug

SEQ ID NO: 4010680 - RNA, 17 nt, Human papillomavirus type 45
acgagccgaaccacagc

SEQ ID NO: 4010681 - RNA, 20 nt, Human papillomavirus type 45
acuauaauguacaguacagu

SEQ ID NO: 4010682 - RNA, 16 nt, Human papillomavirus type 45
agagaaaaaaacaggg

SEQ ID NO: 4010683 - RNA, 13 nt, Human papillomavirus type 45
aguucagaaugau

SEQ ID NO: 4010684 - RNA, 23 nt, Human papillomavirus type 45
auaccuaaacuggcacauuuaca

SEQ ID NO: 4010685 - RNA, 15 nt, Human papillomavirus type 45
auauauaauccugaa

SEQ ID NO: 4010686 - RNA, 18 nt, Human papillomavirus type 45
auaugcaugcuuuacaca

SEQ ID NO: 4010687 - RNA, 21 nt, Human papillomavirus type 45
auauguauguuuguauguaug

SEQ ID NO: 4010688 - RNA, 16 nt, Human papillomavirus type 45
auauuguauacaguau

SEQ ID NO: 4010689 - RNA, 13 nt, Human papillomavirus type 45
aucagaugaugag

SEQ ID NO: 4010690 - RNA, 23 nt, Human papillomavirus type 45
auuguagagaaaaaaacagggga

SEQ ID NO: 4010691 - RNA, 14 nt, Human papillomavirus type 45
auuguauacaguau

SEQ ID NO: 4010692 - RNA, 21 nt, Human papillomavirus type 45
auuguuccaugcgcaggaagu

SEQ ID NO: 4010693 - RNA, 22 nt, Human papillomavirus type 45
caauacuauuuguguguaugug

SEQ ID NO: 4010694 - RNA, 13 nt, Human papillomavirus type 45
cagaaugaugcac

SEQ ID NO: 4010695 - RNA, 12 nt, Human papillomavirus type 45
cagcacaggcau

SEQ ID NO: 4010696 - RNA, 16 nt, Human papillomavirus type 45
cagcacaggcauuguu

SEQ ID NO: 4010697 - RNA, 12 nt, Human papillomavirus type 45
caggcuguuccu

SEQ ID NO: 4010698 - RNA, 22 nt, Human papillomavirus type 45
cagguggugccuccuauuaaca

SEQ ID NO: 4010699 - RNA, 19 nt, Human papillomavirus type 45
caguccauuaggggagcag

SEQ ID NO: 4010700 - RNA, 21 nt, Human papillomavirus type 45
cauacuacacagcauccauuu

SEQ ID NO: 4010701 - RNA, 14 nt, Human papillomavirus type 45
cauaugcaugcuuu

SEQ ID NO: 4010702 - RNA, 15 nt, Human papillomavirus type 45
cauguuguuguauuu

SEQ ID NO: 4010703 - RNA, 19 nt, Human papillomavirus type 45
cauuacuaugcuaucuuua

SEQ ID NO: 4010704 - RNA, 13 nt, Human papillomavirus type 45
cauuuugcugugc

SEQ ID NO: 4010705 - RNA, 15 nt, Human papillomavirus type 45
ccuugcacaaagcaa

SEQ ID NO: 4010706 - RNA, 13 nt, Human papillomavirus type 45
cuaccuauguuug

SEQ ID NO: 4010707 - RNA, 13 nt, Human papillomavirus type 45
cuauuuacagcaa

SEQ ID NO: 4010708 - RNA, 15 nt, Human papillomavirus type 45
cugcaagaaauugua

SEQ ID NO: 4010709 - RNA, 12 nt, Human papillomavirus type 45
cuguacauaauu

SEQ ID NO: 4010710 - RNA, 22 nt, Human papillomavirus type 45
cuuauacguuuggaaaaugcaa

SEQ ID NO: 4010711 - RNA, 14 nt, Human papillomavirus type 45
gaguuagucaugca

SEQ ID NO: 4010712 - RNA, 14 nt, Human papillomavirus type 45
gcaacagauacagg

SEQ ID NO: 4010713 - RNA, 15 nt, Human papillomavirus type 45
gcaaggaaaacaguc

SEQ ID NO: 4010714 - RNA, 15 nt, Human papillomavirus type 45
gcaauccauauuuua

SEQ ID NO: 4010715 - RNA, 12 nt, Human papillomavirus type 45
gcacaaagcaag

SEQ ID NO: 4010716 - RNA, 14 nt, Human papillomavirus type 45
gcuauugaacugca

SEQ ID NO: 4010717 - RNA, 16 nt, Human papillomavirus type 45
aaacgaugaagcagau

SEQ ID NO: 4010718 - RNA, 22 nt, Human papillomavirus type 45
aaauaaguuauuggcaacuuau

SEQ ID NO: 4010719 - RNA, 18 nt, Human papillomavirus type 45
aaauuggaugauacagaa

SEQ ID NO: 4010720 - RNA, 18 nt, Human papillomavirus type 45
aaauuucauuaaauagug

SEQ ID NO: 4010721 - RNA, 17 nt, Human papillomavirus type 45
aacuauggaauacagaa

SEQ ID NO: 4010722 - RNA, 19 nt, Human papillomavirus type 45
aagaaauuguauugcauuu

SEQ ID NO: 4010723 - RNA, 13 nt, Human papillomavirus type 45
aaggaaaacaguc

SEQ ID NO: 4010724 - RNA, 22 nt, Human papillomavirus type 45
aagggccuugcacaaagcaagu

SEQ ID NO: 4010725 - RNA, 13 nt, Human papillomavirus type 45
aaguauaacaaug

SEQ ID NO: 4010726 - RNA, 17 nt, Human papillomavirus type 45
aaguucagaaugaugca

SEQ ID NO: 4010727 - RNA, 15 nt, Human papillomavirus type 45
aauaaacaggcuguu

SEQ ID NO: 4010728 - RNA, 12 nt, Human papillomavirus type 45
aauguacaguac

SEQ ID NO: 4010729 - RNA, 13 nt, Human papillomavirus type 45
acaaaaaagcaaa

SEQ ID NO: 4010730 - RNA, 16 nt, Human papillomavirus type 45
acaaaacagcagcaug

SEQ ID NO: 4010731 - RNA, 16 nt, Human papillomavirus type 45
acaaggacaacuguau

SEQ ID NO: 4010732 - RNA, 17 nt, Human papillomavirus type 45
acaguacaguguaacau

SEQ ID NO: 4010733 - RNA, 19 nt, Human papillomavirus type 45
acauuuguugcuauuuacu

SEQ ID NO: 4010734 - RNA, 18 nt, Human papillomavirus type 45
accaccuucuguggccag

SEQ ID NO: 4010735 - RNA, 16 nt, Human papillomavirus type 45
accuuuuaaacauaau

SEQ ID NO: 4010736 - RNA, 14 nt, Human papillomavirus type 45
acuaaccaauaauc

SEQ ID NO: 4010737 - RNA, 12 nt, Human papillomavirus type 45
acuguacauaau

SEQ ID NO: 4010738 - RNA, 16 nt, Human papillomavirus type 45
acuguaggcaauccau

SEQ ID NO: 4010739 - RNA, 17 nt, Human papillomavirus type 45
acuuauacguuuggaaa

SEQ ID NO: 4010740 - RNA, 18 nt, Human papillomavirus type 45
agcaaagcacauaaagcu

SEQ ID NO: 4010741 - RNA, 18 nt, Human papillomavirus type 45
aggaggcagcaaggaaaa

SEQ ID NO: 4010742 - RNA, 17 nt, Human papillomavirus type 45
agguauccgcauaucag

SEQ ID NO: 4010743 - RNA, 13 nt, Human papillomavirus type 45
aguuauaaacuug

SEQ ID NO: 4010744 - RNA, 14 nt, Human papillomavirus type 45
aguuugcaggaggc

SEQ ID NO: 4010745 - RNA, 14 nt, Human papillomavirus type 45
auaaagcuauugaa

SEQ ID NO: 4010746 - RNA, 21 nt, Human papillomavirus type 45
auaauaaauuggaugauacag

SEQ ID NO: 4010747 - RNA, 13 nt, Human papillomavirus type 45
auaauugugguau

SEQ ID NO: 4010748 - RNA, 17 nt, Human papillomavirus type 45
auaccugugaugugcau

SEQ ID NO: 4010749 - RNA, 15 nt, Human papillomavirus type 45
auacuauuuacagca

SEQ ID NO: 4010750 - RNA, 14 nt, Human papillomavirus type 45
auauauuacuguau

SEQ ID NO: 4010751 - RNA, 11 nt, Human papillomavirus type 45
auaugggacaa

SEQ ID NO: 4010752 - RNA, 22 nt, Human papillomavirus type 45
aucuuccaccaccuucuguggc

SEQ ID NO: 4010753 - RNA, 13 nt, Human papillomavirus type 45
auggcaacaagga

SEQ ID NO: 4010754 - RNA, 16 nt, Human papillomavirus type 45
auggcaacaaggacaa

SEQ ID NO: 4010755 - RNA, 19 nt, Human papillomavirus type 45
auguaauaucagaugauga

SEQ ID NO: 4010756 - RNA, 18 nt, Human papillomavirus type 45
augugcauguuguuguau

SEQ ID NO: 4010757 - RNA, 20 nt, Human papillomavirus type 45
augugccuuguggcauguau

SEQ ID NO: 4010758 - RNA, 15 nt, Human papillomavirus type 45
auuucaaaaagcaaa

SEQ ID NO: 4010759 - RNA, 14 nt, Human papillomavirus type 45
caaaacagcagcau

SEQ ID NO: 4010760 - RNA, 22 nt, Human papillomavirus type 45
caacuaccagcccgacgagccg

SEQ ID NO: 4010761 - RNA, 23 nt, Human papillomavirus type 45
cacaagcauauuuuaucaugcag

SEQ ID NO: 4010762 - RNA, 17 nt, Human papillomavirus type 45
cacauaaagcuauugaa

SEQ ID NO: 4010763 - RNA, 18 nt, Human papillomavirus type 45
cagaaagugcucaugcag

SEQ ID NO: 4010764 - RNA, 14 nt, Human papillomavirus type 45
cauauauguauguu

SEQ ID NO: 4010765 - RNA, 20 nt, Human papillomavirus type 45
cauguaugguguuacuguac

SEQ ID NO: 4010766 - RNA, 15 nt, Human papillomavirus type 45
cauuuugcugugcaa

SEQ ID NO: 4010767 - RNA, 18 nt, Human papillomavirus type 45
ccaugguaucccaccgug

SEQ ID NO: 4010768 - RNA, 22 nt, Human papillomavirus type 45
ccugaaacacaacguuugguuu

SEQ ID NO: 4010769 - RNA, 14 nt, Human papillomavirus type 45
cgugcguguaugua

SEQ ID NO: 4010770 - RNA, 17 nt, Human papillomavirus type 45
cugguucuuuguagaaa

SEQ ID NO: 4010771 - RNA, 15 nt, Human papillomavirus type 45
cuuuuaaacauaaua

SEQ ID NO: 4010772 - RNA, 23 nt, Human papillomavirus type 45
gaaaaugcaauacuauuuacagc

SEQ ID NO: 4010773 - RNA, 21 nt, Human papillomavirus type 45
gaaaguuugcaggaggcagca

SEQ ID NO: 4010774 - RNA, 14 nt, Human papillomavirus type 45
gacagcacaggcau

SEQ ID NO: 4010775 - RNA, 19 nt, Human papillomavirus type 45
gaccccgggaaacacugca

SEQ ID NO: 4010776 - RNA, 16 nt, Human papillomavirus type 45
gagacagcacaggcau

SEQ ID NO: 4010777 - RNA, 20 nt, Human papillomavirus type 45
gauggcaacaaggacaacug

SEQ ID NO: 4010778 - RNA, 17 nt, Human papillomavirus type 45
gcaagagacagcacagg

SEQ ID NO: 4010779 - RNA, 13 nt, Human papillomavirus type 45
gcaaguauaacaa

SEQ ID NO: 4010780 - RNA, 20 nt, Human papillomavirus type 45
gcaauacuauuuacagcaag

SEQ ID NO: 4010781 - RNA, 15 nt, Human papillomavirus type 45
gcaggaggcagcaag

SEQ ID NO: 4010782 - RNA, 13 nt, Human papillomavirus type 45
gcaggcaguuccc

SEQ ID NO: 4010783 - RNA, 18 nt, Human papillomavirus type 45
gcauuugcuguauacauu

SEQ ID NO: 4010784 - RNA, 16 nt, Human papillomavirus type 45
gcgucacaaaauuuug

SEQ ID NO: 4010785 - RNA, 14 nt, Human papillomavirus type 45
gcuuuacacaccau

SEQ ID NO: 4010786 - RNA, 17 nt, Human papillomavirus type 45
gcuuuucugugugccuu

SEQ ID NO: 4010787 - RNA, 14 nt, Human papillomavirus type 45
ggaggcagcaagga

SEQ ID NO: 4010788 - RNA, 18 nt, Human papillomavirus type 45
ggccuugcacaaagcaag

SEQ ID NO: 4010789 - RNA, 21 nt, Human papillomavirus type 45
guagagaaaaaaacaggggau

SEQ ID NO: 4010790 - RNA, 16 nt, Human papillomavirus type 45
guauauuguauacagu

SEQ ID NO: 4010791 - RNA, 21 nt, Human papillomavirus type 45
uaacauaccugugaugugcau

SEQ ID NO: 4010792 - RNA, 14 nt, Human papillomavirus type 45
uaacuguaggcaau

SEQ ID NO: 4010793 - RNA, 16 nt, Human papillomavirus type 45
uacagcagcuguuuuu

SEQ ID NO: 4010794 - RNA, 20 nt, Human papillomavirus type 45
uacaguagagagcucggcag

SEQ ID NO: 4010795 - RNA, 18 nt, Human papillomavirus type 45
uaugggacaaaacagcag

SEQ ID NO: 4010796 - RNA, 13 nt, Human papillomavirus type 45
uauuacuguauuu

SEQ ID NO: 4010797 - RNA, 16 nt, Human papillomavirus type 45
uauuuuauauguuuaa

SEQ ID NO: 4010798 - RNA, 21 nt, Human papillomavirus type 45
ucuaugugugugcuuuugcuu

SEQ ID NO: 4010799 - RNA, 15 nt, Human papillomavirus type 45
ugcaggaggcagcaa

SEQ ID NO: 4010800 - RNA, 17 nt, Human papillomavirus type 45
ugcuguauacauuuguu

SEQ ID NO: 4010801 - RNA, 21 nt, Human papillomavirus type 45
ugcuuuacacaccauacaaua

SEQ ID NO: 4010802 - RNA, 16 nt, Human papillomavirus type 45
uggcggauccagaagg

SEQ ID NO: 4010803 - RNA, 20 nt, Human papillomavirus type 45
uguauacauuuguugcuauu

SEQ ID NO: 4010804 - RNA, 13 nt, Human papillomavirus type 45
uguauuuuuguau

SEQ ID NO: 4010805 - RNA, 18 nt, Human papillomavirus type 45
ugucuaugugugugcuuu

SEQ ID NO: 4010806 - RNA, 15 nt, Human papillomavirus type 45
uguuccaugcgcagg

SEQ ID NO: 4010807 - RNA, 14 nt, Human papillomavirus type 45
uuaacagcauuugc

SEQ ID NO: 4010808 - RNA, 19 nt, Human papillomavirus type 45
uuauccauuugugaacagg

SEQ ID NO: 4010809 - RNA, 18 nt, Human papillomavirus type 45
uugcacccuugugaguaa

SEQ ID NO: 4010810 - RNA, 15 nt, Human papillomavirus type 45
uuguguguaugugua

SEQ ID NO: 4010811 - RNA, 15 nt, Human papillomavirus type 45
aaagcaaagcacaua

SEQ ID NO: 4010812 - RNA, 23 nt, Human papillomavirus type 45
aaagggccuugcacaaagcaagu

SEQ ID NO: 4010813 - RNA, 16 nt, Human papillomavirus type 45
aacugcaacagauaca

SEQ ID NO: 4010814 - RNA, 14 nt, Human papillomavirus type 45
acaauaauuacuau

SEQ ID NO: 4010815 - RNA, 19 nt, Human papillomavirus type 45
acagcagcuguuuuugagc

SEQ ID NO: 4010816 - RNA, 14 nt, Human papillomavirus type 45
acaguauguaacau

SEQ ID NO: 4010817 - RNA, 22 nt, Human papillomavirus type 45
accagguggugccuccuauuaa

SEQ ID NO: 4010818 - RNA, 17 nt, Human papillomavirus type 45
agagacagcacaggcau

SEQ ID NO: 4010819 - RNA, 16 nt, Human papillomavirus type 45
agagcucggcagagga

SEQ ID NO: 4010820 - RNA, 21 nt, Human papillomavirus type 45
agcuauugaacugcaaauggc

SEQ ID NO: 4010821 - RNA, 19 nt, Human papillomavirus type 45
aguuugcaggaggcagcaa

SEQ ID NO: 4010822 - RNA, 13 nt, Human papillomavirus type 5
aaagcauacagga

SEQ ID NO: 4010823 - RNA, 22 nt, Human papillomavirus type 5
aaauuaccagauccuaacagau

SEQ ID NO: 4010824 - RNA, 21 nt, Human papillomavirus type 5
aacaaaggcuaaagaagccau

SEQ ID NO: 4010825 - RNA, 12 nt, Human papillomavirus type 5
aacaggcaggca

SEQ ID NO: 4010826 - RNA, 10 nt, Human papillomavirus type 5
aacugugagg

SEQ ID NO: 4010827 - RNA, 14 nt, Human papillomavirus type 5
aagcugacuguagu

SEQ ID NO: 4010828 - RNA, 19 nt, Human papillomavirus type 5
aaggcucuuugcagagcag

SEQ ID NO: 4010829 - RNA, 16 nt, Human papillomavirus type 5
aauagguaggggccag

SEQ ID NO: 4010830 - RNA, 15 nt, Human papillomavirus type 5
acaggagugugagca

SEQ ID NO: 4010831 - RNA, 15 nt, Human papillomavirus type 5
acagucuuuaacauu

SEQ ID NO: 4010832 - RNA, 12 nt, Human papillomavirus type 5
acauuuacuaau

SEQ ID NO: 4010833 - RNA, 13 nt, Human papillomavirus type 5
acucgagcugacu

SEQ ID NO: 4010834 - RNA, 14 nt, Human papillomavirus type 5
acugcaaacaugac

SEQ ID NO: 4010835 - RNA, 17 nt, Human papillomavirus type 5
acuugagucaauuucau

SEQ ID NO: 4010836 - RNA, 18 nt, Human papillomavirus type 5
agaggcuuagaaauaggu

SEQ ID NO: 4010837 - RNA, 17 nt, Human papillomavirus type 5
agcagaagucuaagcga

SEQ ID NO: 4010838 - RNA, 16 nt, Human papillomavirus type 5
agcgcuccagaagguc

SEQ ID NO: 4010839 - RNA, 23 nt, Human papillomavirus type 5
aggagccugacaacgaaaggauc

SEQ ID NO: 4010840 - RNA, 22 nt, Human papillomavirus type 5
aggggcggcuaacacacugaaa

SEQ ID NO: 4010841 - RNA, 16 nt, Human papillomavirus type 5
aucagaucagugccaa

SEQ ID NO: 4010842 - RNA, 12 nt, Human papillomavirus type 5
auggacucuagu

SEQ ID NO: 4010843 - RNA, 16 nt, Human papillomavirus type 5
auggcaaccuggacag

SEQ ID NO: 4010844 - RNA, 19 nt, Human papillomavirus type 5
auggugcugcagcuugagu

SEQ ID NO: 4010845 - RNA, 18 nt, Human papillomavirus type 5
caguaucagaaacaaagg

SEQ ID NO: 4010846 - RNA, 23 nt, Human papillomavirus type 5
cauuuagaagcgcuccagaaggu

SEQ ID NO: 4010847 - RNA, 17 nt, Human papillomavirus type 5
ccugcaaacaggcaggc

SEQ ID NO: 4010848 - RNA, 20 nt, Human papillomavirus type 5
ccuggucauggguggcagga

SEQ ID NO: 4010849 - RNA, 11 nt, Human papillomavirus type 5
cgagcaggaaa

SEQ ID NO: 4010850 - RNA, 14 nt, Human papillomavirus type 5
cgagcugacuuuaa

SEQ ID NO: 4010851 - RNA, 15 nt, Human papillomavirus type 5
cgugccacuugggga

SEQ ID NO: 4010852 - RNA, 17 nt, Human papillomavirus type 5
cuacugaccggagaucu

SEQ ID NO: 4010853 - RNA, 16 nt, Human papillomavirus type 5
cuauacucaaaggaga

SEQ ID NO: 4010854 - RNA, 21 nt, Human papillomavirus type 5
cuccgugcgguugcaggaacu

SEQ ID NO: 4010855 - RNA, 21 nt, Human papillomavirus type 5
cuuacgaaaagaaccuguauu

SEQ ID NO: 4010856 - RNA, 15 nt, Human papillomavirus type 5
cuuauuucaauguau

SEQ ID NO: 4010857 - RNA, 16 nt, Human papillomavirus type 5
cuuuaacauuuacuaa

SEQ ID NO: 4010858 - RNA, 15 nt, Human papillomavirus type 5
gaccuccccaaagaa

SEQ ID NO: 4010859 - RNA, 15 nt, Human papillomavirus type 5
gagucacuacagaca

SEQ ID NO: 4010860 - RNA, 22 nt, Human papillomavirus type 5
gauacugaacuggagcagggca

SEQ ID NO: 4010861 - RNA, 12 nt, Human papillomavirus type 5
gcgguugcagga

SEQ ID NO: 4010862 - RNA, 14 nt, Human papillomavirus type 5
gcgucuaggcaggc

SEQ ID NO: 4010863 - RNA, 13 nt, Human papillomavirus type 5
gcugacuguagug

SEQ ID NO: 4010864 - RNA, 18 nt, Human papillomavirus type 5
ggacucgagcugacuuua

SEQ ID NO: 4010865 - RNA, 18 nt, Human papillomavirus type 5
ggagcucagugaggugca

SEQ ID NO: 4010866 - RNA, 21 nt, Human papillomavirus type 5
ggagcucagugaggugcagcc

SEQ ID NO: 4010867 - RNA, 17 nt, Human papillomavirus type 5
ggagugugagcagagcg

SEQ ID NO: 4010868 - RNA, 17 nt, Human papillomavirus type 5
ggaugauaaguggcaua

SEQ ID NO: 4010869 - RNA, 19 nt, Human papillomavirus type 5
ggauuagggaccuccccaa

SEQ ID NO: 4010870 - RNA, 13 nt, Human papillomavirus type 5
gguggccuuggua

SEQ ID NO: 4010871 - RNA, 21 nt, Human papillomavirus type 5
gguguccgugucggaggaacc

SEQ ID NO: 4010872 - RNA, 22 nt, Human papillomavirus type 5
gugauugguguuuauuggaagc

SEQ ID NO: 4010873 - RNA, 17 nt, Human papillomavirus type 5
uaaacaaugaagcugaa

SEQ ID NO: 4010874 - RNA, 19 nt, Human papillomavirus type 5
uaaugcugcuuuugcuacu

SEQ ID NO: 4010875 - RNA, 20 nt, Human papillomavirus type 5
uacauuuuguauuugcuaug

SEQ ID NO: 4010876 - RNA, 16 nt, Human papillomavirus type 5
uacuggaagaagcucg

SEQ ID NO: 4010877 - RNA, 20 nt, Human papillomavirus type 5
uaggucauccuuauuucaau

SEQ ID NO: 4010878 - RNA, 18 nt, Human papillomavirus type 5
uauauuuuuuuuuacauu

SEQ ID NO: 4010879 - RNA, 23 nt, Human papillomavirus type 5
ucaacaggagugugagcagagcg

SEQ ID NO: 4010880 - RNA, 16 nt, Human papillomavirus type 5
ucauuuaguacuaccu

SEQ ID NO: 4010881 - RNA, 13 nt, Human papillomavirus type 5
uccugugcccuga

SEQ ID NO: 4010882 - RNA, 18 nt, Human papillomavirus type 5
ucggauuuguuagaugau

SEQ ID NO: 4010883 - RNA, 15 nt, Human papillomavirus type 5
ucuuuaacauuuacu

SEQ ID NO: 4010884 - RNA, 23 nt, Human papillomavirus type 5
ugaugaagcggugcgauacccca

SEQ ID NO: 4010885 - RNA, 23 nt, Human papillomavirus type 5
ugauugguguuuauuggaagcug

SEQ ID NO: 4010886 - RNA, 16 nt, Human papillomavirus type 5
ugcccauugauacagu

SEQ ID NO: 4010887 - RNA, 22 nt, Human papillomavirus type 5
ugcuuuugcuacuaacauacua

SEQ ID NO: 4010888 - RNA, 14 nt, Human papillomavirus type 5
ugggacaauuauuu

SEQ ID NO: 4010889 - RNA, 19 nt, Human papillomavirus type 5
uguauacaauguggaccua

SEQ ID NO: 4010890 - RNA, 18 nt, Human papillomavirus type 5
uuaguccgcgacuugagu

SEQ ID NO: 4010891 - RNA, 15 nt, Human papillomavirus type 5
uucaucaacaggagu

SEQ ID NO: 4010892 - RNA, 22 nt, Human papillomavirus type 5
uugccaauauagaaucagauca

SEQ ID NO: 4010893 - RNA, 15 nt, Human papillomavirus type 5
aaccugcaaacaggc

SEQ ID NO: 4010894 - RNA, 13 nt, Human papillomavirus type 5
aaugaagcugaag

SEQ ID NO: 4010895 - RNA, 18 nt, Human papillomavirus type 5
acauuuuguauuugcuau

SEQ ID NO: 4010896 - RNA, 21 nt, Human papillomavirus type 5
acucagucaaguuguugccaa

SEQ ID NO: 4010897 - RNA, 14 nt, Human papillomavirus type 5
acucgagcugacuu

SEQ ID NO: 4010898 - RNA, 22 nt, Human papillomavirus type 5
acuggucacccuuauuucaaua

SEQ ID NO: 4010899 - RNA, 13 nt, Human papillomavirus type 5
agaaccuguauua

SEQ ID NO: 4010900 - RNA, 19 nt, Human papillomavirus type 5
agcuuuccaacagcuacug

SEQ ID NO: 4010901 - RNA, 13 nt, Human papillomavirus type 5
aggacgacuugga

SEQ ID NO: 4010902 - RNA, 22 nt, Human papillomavirus type 5
aggccuauggcaaccuggacag

SEQ ID NO: 4010903 - RNA, 21 nt, Human papillomavirus type 5
aggucauccuuauuucaaugu

SEQ ID NO: 4010904 - RNA, 16 nt, Human papillomavirus type 5
aguacuaccuggucau

SEQ ID NO: 4010905 - RNA, 14 nt, Human papillomavirus type 5
agucuuccaaggau

SEQ ID NO: 4010906 - RNA, 18 nt, Human papillomavirus type 5
auauuauucuggagcuca

SEQ ID NO: 4010907 - RNA, 19 nt, Human papillomavirus type 5
auauuuaccaaaccugcaa

SEQ ID NO: 4010908 - RNA, 22 nt, Human papillomavirus type 5
aucugauuuugcucaugagcca

SEQ ID NO: 4010909 - RNA, 13 nt, Human papillomavirus type 5
augaagcugaaga

SEQ ID NO: 4010910 - RNA, 14 nt, Human papillomavirus type 5
auucccuggaacua

SEQ ID NO: 4010911 - RNA, 22 nt, Human papillomavirus type 5
auuuuaaaauauggcagugcug

SEQ ID NO: 4010912 - RNA, 16 nt, Human papillomavirus type 5
cagagcaggacagcgg

SEQ ID NO: 4010913 - RNA, 19 nt, Human papillomavirus type 5
caggagugugagcagagcg

SEQ ID NO: 4010914 - RNA, 22 nt, Human papillomavirus type 5
caggagugugagcagagcgagg

SEQ ID NO: 4010915 - RNA, 19 nt, Human papillomavirus type 5
caggccgaggaacuggggg

SEQ ID NO: 4010916 - RNA, 19 nt, Human papillomavirus type 5
caguaucagaaacaaaggc

SEQ ID NO: 4010917 - RNA, 13 nt, Human papillomavirus type 5
cauccuuauuuca

SEQ ID NO: 4010918 - RNA, 16 nt, Human papillomavirus type 5
ccagaguccaaagcac

SEQ ID NO: 4010919 - RNA, 20 nt, Human papillomavirus type 5
ccuuccuugguuccugaaac

SEQ ID NO: 4010920 - RNA, 17 nt, Human papillomavirus type 5
cgauaccccaaaggagu

SEQ ID NO: 4010921 - RNA, 16 nt, Human papillomavirus type 5
cuggaacuauuucauc

SEQ ID NO: 4010922 - RNA, 14 nt, Human papillomavirus type 5
cuguagugauguag

SEQ ID NO: 4010923 - RNA, 18 nt, Human papillomavirus type 5
gaaacaaaggcuaaagaa

SEQ ID NO: 4010924 - RNA, 12 nt, Human papillomavirus type 5
gaagcugaagau

SEQ ID NO: 4010925 - RNA, 15 nt, Human papillomavirus type 5
gaagguccugguguc

SEQ ID NO: 4010926 - RNA, 19 nt, Human papillomavirus type 5
gacagucuuuaacauuuac

SEQ ID NO: 4010927 - RNA, 20 nt, Human papillomavirus type 5
gagaaagguguuacaaggcu

SEQ ID NO: 4010928 - RNA, 13 nt, Human papillomavirus type 5
gagugugagcaga

SEQ ID NO: 4010929 - RNA, 12 nt, Human papillomavirus type 5
gaucugcagcuc

SEQ ID NO: 4010930 - RNA, 15 nt, Human papillomavirus type 5
gcaagaaguggggug

SEQ ID NO: 4010931 - RNA, 23 nt, Human papillomavirus type 5
gcagcuccugugcccugacuguc

SEQ ID NO: 4010932 - RNA, 21 nt, Human papillomavirus type 5
gcgauaccccaaaggaguuga

SEQ ID NO: 4010933 - RNA, 22 nt, Human papillomavirus type 5
gcuacaggguacgugccacuug

SEQ ID NO: 4010934 - RNA, 18 nt, Human papillomavirus type 5
gcucagugaggugcagcc

SEQ ID NO: 4010935 - RNA, 19 nt, Human papillomavirus type 5
gcuccugugcccugacugu

SEQ ID NO: 4010936 - RNA, 20 nt, Human papillomavirus type 5
gcucuuugcagagcaggaca

SEQ ID NO: 4010937 - RNA, 15 nt, Human papillomavirus type 5
gcuuuugcuacuaac

SEQ ID NO: 4010938 - RNA, 13 nt, Human papillomavirus type 5
ggaagcugacugu

SEQ ID NO: 4010939 - RNA, 19 nt, Human papillomavirus type 5
ggcaggcccagaaugcuca

SEQ ID NO: 4010940 - RNA, 14 nt, Human papillomavirus type 5
ggccuuccuugguu

SEQ ID NO: 4010941 - RNA, 17 nt, Human papillomavirus type 5
guacaggccgaggaacu

SEQ ID NO: 4010942 - RNA, 16 nt, Human papillomavirus type 5
gucauggguggcagga

SEQ ID NO: 4010943 - RNA, 13 nt, Human papillomavirus type 5
gucuaggcaggcc

SEQ ID NO: 4010944 - RNA, 16 nt, Human papillomavirus type 5
gugagcagagcgagga

SEQ ID NO: 4010945 - RNA, 15 nt, Human papillomavirus type 5
gugccacuuggggaa

SEQ ID NO: 4010946 - RNA, 16 nt, Human papillomavirus type 5
gugcgguugcaggaac

SEQ ID NO: 4010947 - RNA, 23 nt, Human papillomavirus type 5
gugcugguguauuuuuugguggc

SEQ ID NO: 4010948 - RNA, 18 nt, Human papillomavirus type 5
guuagaugauacugaacu

SEQ ID NO: 4010949 - RNA, 23 nt, Human papillomavirus type 5
uaaaauauggcagugcuggugua

SEQ ID NO: 4010950 - RNA, 14 nt, Human papillomavirus type 5
uaacagauuugcau

SEQ ID NO: 4010951 - RNA, 19 nt, Human papillomavirus type 5
uaccaaacgagcaggaaac

SEQ ID NO: 4010952 - RNA, 21 nt, Human papillomavirus type 5
uaccagauccuaacagauuug

SEQ ID NO: 4010953 - RNA, 21 nt, Human papillomavirus type 5
uacuaaugcugcuuuugcuac

SEQ ID NO: 4010954 - RNA, 14 nt, Human papillomavirus type 5
auuggaagcugacu

SEQ ID NO: 4010955 - RNA, 20 nt, Human papillomavirus type 5
auuuaguacuaccuggucau

SEQ ID NO: 4010956 - RNA, 16 nt, Human papillomavirus type 5
auuucgccuaaaauua

SEQ ID NO: 4010957 - RNA, 22 nt, Human papillomavirus type 5
caaaagcugucgcacagcuuag

SEQ ID NO: 4010958 - RNA, 20 nt, Human papillomavirus type 5
caaaccugcaaacaggcagg

SEQ ID NO: 4010959 - RNA, 22 nt, Human papillomavirus type 5
caaaggagagauuuugaugaag

SEQ ID NO: 4010960 - RNA, 16 nt, Human papillomavirus type 5
caacgaaaggaucucu

SEQ ID NO: 4010961 - RNA, 19 nt, Human papillomavirus type 5
caaugaagcugaagauguu

SEQ ID NO: 4010962 - RNA, 23 nt, Human papillomavirus type 5
cacagcuuaguccgcgacuugag

SEQ ID NO: 4010963 - RNA, 15 nt, Human papillomavirus type 5
caccccagcagaagu

SEQ ID NO: 4010964 - RNA, 14 nt, Human papillomavirus type 5
cacuucaaaaaagg

SEQ ID NO: 4010965 - RNA, 14 nt, Human papillomavirus type 5
cagcuccugugccc

SEQ ID NO: 4010966 - RNA, 18 nt, Human papillomavirus type 5
caggagugugagcagagc

SEQ ID NO: 4010967 - RNA, 19 nt, Human papillomavirus type 5
ccuguuuugugaagaggaa

SEQ ID NO: 4010968 - RNA, 22 nt, Human papillomavirus type 5
cgaaggcucuuugcagagcagg

SEQ ID NO: 4010969 - RNA, 17 nt, Human papillomavirus type 5
cuaaugcugcuuuugcu

SEQ ID NO: 4010970 - RNA, 16 nt, Human papillomavirus type 5
cuacagacaucugauu

SEQ ID NO: 4010971 - RNA, 19 nt, Human papillomavirus type 5
cucuuugcagagcaggaca

SEQ ID NO: 4010972 - RNA, 18 nt, Human papillomavirus type 5
cugagcgucuaggcaggc

SEQ ID NO: 4010973 - RNA, 23 nt, Human papillomavirus type 5
cugcagcuugagucacuacagac

SEQ ID NO: 4010974 - RNA, 14 nt, Human papillomavirus type 5
cuggagcucaguga

SEQ ID NO: 4010975 - RNA, 15 nt, Human papillomavirus type 5
gacaccgguggccag

SEQ ID NO: 4010976 - RNA, 14 nt, Human papillomavirus type 5
gauccuaacagauu

SEQ ID NO: 4010977 - RNA, 23 nt, Human papillomavirus type 5
gauugguguuuauuggaagcuga

SEQ ID NO: 4010978 - RNA, 14 nt, Human papillomavirus type 5
gcaaacaggcaggc

SEQ ID NO: 4010979 - RNA, 21 nt, Human papillomavirus type 5
gcacugagcgucuaggcaggc

SEQ ID NO: 4010980 - RNA, 22 nt, Human papillomavirus type 5
gcagcuccugugcccugacugu

SEQ ID NO: 4010981 - RNA, 14 nt, Human papillomavirus type 5
gccagaguccaaag

SEQ ID NO: 4010982 - RNA, 17 nt, Human papillomavirus type 5
gccauagcaauggugcu

SEQ ID NO: 4010983 - RNA, 15 nt, Human papillomavirus type 5
ggagauggcacugag

SEQ ID NO: 4010984 - RNA, 15 nt, Human papillomavirus type 5
ggcucuuugcagagc

SEQ ID NO: 4010985 - RNA, 18 nt, Human papillomavirus type 5
gguaguacaucuaaagaa

SEQ ID NO: 4010986 - RNA, 15 nt, Human papillomavirus type 5
guauaagucuuccaa

SEQ ID NO: 4010987 - RNA, 16 nt, Human papillomavirus type 5
gucgcacagcuuaguc

SEQ ID NO: 4010988 - RNA, 19 nt, Human papillomavirus type 5
gucuuuaacauuuacuaau

SEQ ID NO: 4010989 - RNA, 14 nt, Human papillomavirus type 5
guggcaggagaugg

SEQ ID NO: 4010990 - RNA, 23 nt, Human papillomavirus type 5
guuuauuggaagcugacuguagu

SEQ ID NO: 4010991 - RNA, 22 nt, Human papillomavirus type 5
uaacuguaggucauccuuauuu

SEQ ID NO: 4010992 - RNA, 17 nt, Human papillomavirus type 5
uaaugcugcuuuugcua

SEQ ID NO: 4010993 - RNA, 22 nt, Human papillomavirus type 5
uacaauguggaccuauguguau

SEQ ID NO: 4010994 - RNA, 18 nt, Human papillomavirus type 5
uacauucaaagaacaaau

SEQ ID NO: 4010995 - RNA, 19 nt, Human papillomavirus type 5
uacauuuuguauuugcuau

SEQ ID NO: 4010996 - RNA, 15 nt, Human papillomavirus type 5
uaguacaucuaaaga

SEQ ID NO: 4010997 - RNA, 22 nt, Human papillomavirus type 5
uccagauaaugccaauuuguau

SEQ ID NO: 4010998 - RNA, 13 nt, Human papillomavirus type 5
ucuuugcagagca

SEQ ID NO: 4010999 - RNA, 17 nt, Human papillomavirus type 5
ugacaaugauccagaua

SEQ ID NO: 4011000 - RNA, 13 nt, Human papillomavirus type 5
ugagguuccuaag

SEQ ID NO: 4011001 - RNA, 15 nt, Human papillomavirus type 5
ugcaagauauuauuc

SEQ ID NO: 4011002 - RNA, 14 nt, Human papillomavirus type 5
ugcagagcaggaca

SEQ ID NO: 4011003 - RNA, 23 nt, Human papillomavirus type 5
ugcagcccgaagugcuaccaguu

SEQ ID NO: 4011004 - RNA, 21 nt, Human papillomavirus type 5
uguaggucauccuuauuucaa

SEQ ID NO: 4011005 - RNA, 23 nt, Human papillomavirus type 5
uugauaccagcauagaaacauuu

SEQ ID NO: 4011006 - RNA, 17 nt, Human papillomavirus type 5
aaaggaguugauaaggc

SEQ ID NO: 4011007 - RNA, 23 nt, Human papillomavirus type 5
aaaggggcggcuaacacacugaa

SEQ ID NO: 4011008 - RNA, 19 nt, Human papillomavirus type 5
aaauuaccagauccuaaca

SEQ ID NO: 4011009 - RNA, 15 nt, Human papillomavirus type 5
aacagauuugcauua

SEQ ID NO: 4011010 - RNA, 22 nt, Human papillomavirus type 5
aacuggagcagggcaauucccu

SEQ ID NO: 4011011 - RNA, 18 nt, Human papillomavirus type 5
aagguaguacaucuaaag

SEQ ID NO: 4011012 - RNA, 23 nt, Human papillomavirus type 5
aaguuauuuaugacaaugaucca

SEQ ID NO: 4011013 - RNA, 15 nt, Human papillomavirus type 5
aauauagaaucagau

SEQ ID NO: 4011014 - RNA, 13 nt, Human papillomavirus type 5
acaaugaagcuga

SEQ ID NO: 4011015 - RNA, 16 nt, Human papillomavirus type 5
acccgguacacucagu

SEQ ID NO: 4011016 - RNA, 14 nt, Human papillomavirus type 5
acugaacuggagca

SEQ ID NO: 4011017 - RNA, 16 nt, Human papillomavirus type 5
acugagcgucuaggca

SEQ ID NO: 4011018 - RNA, 14 nt, Human papillomavirus type 5
acuggagcagggca

SEQ ID NO: 4011019 - RNA, 23 nt, Human papillomavirus type 5
acuguagugauguagaaaaugau

SEQ ID NO: 4011020 - RNA, 22 nt, Human papillomavirus type 5
acuuuaaacaaugaagcugaag

SEQ ID NO: 4011021 - RNA, 13 nt, Human papillomavirus type 5
agaacaaauaucu

SEQ ID NO: 4011022 - RNA, 15 nt, Human papillomavirus type 5
agaagcgcuccagaa

SEQ ID NO: 4011023 - RNA, 22 nt, Human papillomavirus type 5
agaaugcucauuagcuuuucuu

SEQ ID NO: 4011024 - RNA, 19 nt, Human papillomavirus type 5
agagcuaaaauuaaauaca

SEQ ID NO: 4011025 - RNA, 23 nt, Human papillomavirus type 5
agagcuaaaauuaaauacauggg

SEQ ID NO: 4011026 - RNA, 20 nt, Human papillomavirus type 5
agaggaauuaccaaacgagc

SEQ ID NO: 4011027 - RNA, 20 nt, Human papillomavirus type 5
agcaggaaacggaggaggag

SEQ ID NO: 4011028 - RNA, 15 nt, Human papillomavirus type 5
agcgucuaggcaggc

SEQ ID NO: 4011029 - RNA, 22 nt, Human papillomavirus type 5
agcuccgugcgguugcaggaac

SEQ ID NO: 4011030 - RNA, 14 nt, Human papillomavirus type 5
agguguuacaaggc

SEQ ID NO: 4011031 - RNA, 20 nt, Human papillomavirus type 5
aguugauaaggccuauggca

SEQ ID NO: 4011032 - RNA, 20 nt, Human papillomavirus type 5
auacauucaaagaacaaaua

SEQ ID NO: 4011033 - RNA, 22 nt, Human papillomavirus type 5
auacucaaaggagagauuuuga

SEQ ID NO: 4011034 - RNA, 16 nt, Human papillomavirus type 5
auccagauaaugccaa

SEQ ID NO: 4011035 - RNA, 16 nt, Human papillomavirus type 5
auuucaauaaaguaaa

SEQ ID NO: 4011036 - RNA, 22 nt, Human papillomavirus type 5
auuugagagagauacagacucu

SEQ ID NO: 4011037 - RNA, 13 nt, Human papillomavirus type 5
auuugcuauggcg

SEQ ID NO: 4011038 - RNA, 16 nt, Human papillomavirus type 5
caaauaucuacuauca

SEQ ID NO: 4011039 - RNA, 22 nt, Human papillomavirus type 5
caagauauuauucuggagcuca

SEQ ID NO: 4011040 - RNA, 15 nt, Human papillomavirus type 5
cacccuuauuucaau

SEQ ID NO: 4011041 - RNA, 17 nt, Human papillomavirus type 5
cagaacaaacauugcag

SEQ ID NO: 4011042 - RNA, 21 nt, Human papillomavirus type 5
caguugaccuguuuugugaag

SEQ ID NO: 4011043 - RNA, 17 nt, Human papillomavirus type 5
cauacuaacauacccua

SEQ ID NO: 4011044 - RNA, 15 nt, Human papillomavirus type 5
cauccuuauuucaau

SEQ ID NO: 4011045 - RNA, 17 nt, Human papillomavirus type 5
cauggguggcaggagau

SEQ ID NO: 4011046 - RNA, 14 nt, Human papillomavirus type 5
ccaaaccugcaaac

SEQ ID NO: 4011047 - RNA, 15 nt, Human papillomavirus type 5
ccaacagcuacugac

SEQ ID NO: 4011048 - RNA, 23 nt, Human papillomavirus type 5
ccgcgacuugagucaauuucauu

SEQ ID NO: 4011049 - RNA, 13 nt, Human papillomavirus type 5
ccugacaaagaac

SEQ ID NO: 4011050 - RNA, 21 nt, Human papillomavirus type 5
cgagcaggaaacggaggagga

SEQ ID NO: 4011051 - RNA, 11 nt, Human papillomavirus type 5
cggaggaggag

SEQ ID NO: 4011052 - RNA, 11 nt, Human papillomavirus type 5
cuaaugcugcu

SEQ ID NO: 4011053 - RNA, 17 nt, Human papillomavirus type 5
cugagcgucuaggcagg

SEQ ID NO: 4011054 - RNA, 16 nt, Human papillomavirus type 5
cugcaaacaggcaggc

SEQ ID NO: 4011055 - RNA, 17 nt, Human papillomavirus type 5
cuuggaagauuacugga

SEQ ID NO: 4011056 - RNA, 23 nt, Human papillomavirus type 5
gaaacggaggaggagccugacaa

SEQ ID NO: 4011057 - RNA, 13 nt, Human papillomavirus type 5
gaacuauuucauc

SEQ ID NO: 4011058 - RNA, 12 nt, Human papillomavirus type 5
gaagcugacugu

SEQ ID NO: 4011059 - RNA, 17 nt, Human papillomavirus type 5
gacaauuauuugagaga

SEQ ID NO: 4011060 - RNA, 20 nt, Human papillomavirus type 5
gaccuguuuugugaagagga

SEQ ID NO: 4011061 - RNA, 21 nt, Human papillomavirus type 5
gacucuguaacucauauuuac

SEQ ID NO: 4011062 - RNA, 14 nt, Human papillomavirus type 5
gagucaauuucauu

SEQ ID NO: 4011063 - RNA, 13 nt, Human papillomavirus type 5
gcaaccuggacag

SEQ ID NO: 4011064 - RNA, 15 nt, Human papillomavirus type 5
gcagagcgaggagca

SEQ ID NO: 4011065 - RNA, 22 nt, Human papillomavirus type 5
gcccugacugucgcggaaacug

SEQ ID NO: 4011066 - RNA, 17 nt, Human papillomavirus type 5
gcuccugugcccugacu

SEQ ID NO: 4011067 - RNA, 18 nt, Human papillomavirus type 5
ggaagcugacuguaguga

SEQ ID NO: 4011068 - RNA, 12 nt, Human papillomavirus type 5
ggagcucaguga

SEQ ID NO: 4011069 - RNA, 15 nt, Human papillomavirus type 5
ggcccagaaugcuca

SEQ ID NO: 4011070 - RNA, 14 nt, Human papillomavirus type 5
gugccacuugggga

SEQ ID NO: 4011071 - RNA, 18 nt, Human papillomavirus type 5
guguccgugucggaggaa

SEQ ID NO: 4011072 - RNA, 19 nt, Human papillomavirus type 5
guugauauuuugcccauug

SEQ ID NO: 4011073 - RNA, 20 nt, Human papillomavirus type 5
uaacauuuacuaaugcugcu

SEQ ID NO: 4011074 - RNA, 17 nt, Human papillomavirus type 5
uacauuuuguauuugcu

SEQ ID NO: 4011075 - RNA, 21 nt, Human papillomavirus type 5
uaggcaggcccagaaugcuca

SEQ ID NO: 4011076 - RNA, 16 nt, Human papillomavirus type 5
uagggaccuccccaaa

SEQ ID NO: 4011077 - RNA, 20 nt, Human papillomavirus type 5
uaucaaccugugccuguaaa

SEQ ID NO: 4011078 - RNA, 14 nt, Human papillomavirus type 5
uauuggaagcugac

SEQ ID NO: 4011079 - RNA, 22 nt, Human papillomavirus type 5
ucaugcauuuagugacagauug

SEQ ID NO: 4011080 - RNA, 16 nt, Human papillomavirus type 5
ugagucacuacagaca

SEQ ID NO: 4011081 - RNA, 18 nt, Human papillomavirus type 5
ugcauuuagugacagauu

SEQ ID NO: 4011082 - RNA, 16 nt, Human papillomavirus type 5
uggacucagaacagac

SEQ ID NO: 4011083 - RNA, 17 nt, Human papillomavirus type 5
uguuagaugauacugaa

SEQ ID NO: 4011084 - RNA, 17 nt, Human papillomavirus type 5
uguuuaggucauuuagu

SEQ ID NO: 4011085 - RNA, 16 nt, Human papillomavirus type 5
uugguauuaguacagg

SEQ ID NO: 4011086 - RNA, 22 nt, Human papillomavirus type 5
uuugcucaugagccauggacuc

SEQ ID NO: 4011087 - RNA, 14 nt, Human papillomavirus type 5
aaacgagcaggaaa

SEQ ID NO: 4011088 - RNA, 12 nt, Human papillomavirus type 5
aaggcuaaagaa

SEQ ID NO: 4011089 - RNA, 16 nt, Human papillomavirus type 5
aaguggcauaaggcaa

SEQ ID NO: 4011090 - RNA, 16 nt, Human papillomavirus type 5
aaugcugcuuuugcua

SEQ ID NO: 4011091 - RNA, 17 nt, Human papillomavirus type 5
aaugcugcuuuugcuac

SEQ ID NO: 4011092 - RNA, 17 nt, Human papillomavirus type 5
acaacaguugcugacaa

SEQ ID NO: 4011093 - RNA, 17 nt, Human papillomavirus type 5
acuaacauacccuagca

SEQ ID NO: 4011094 - RNA, 15 nt, Human papillomavirus type 5
acuaucaugcauuua

SEQ ID NO: 4011095 - RNA, 13 nt, Human papillomavirus type 5
agaaacaaaggcu

SEQ ID NO: 4011096 - RNA, 19 nt, Human papillomavirus type 5
agaaacaaaggcuaaagaa

SEQ ID NO: 4011097 - RNA, 17 nt, Human papillomavirus type 5
agagauacagacucuga

SEQ ID NO: 4011098 - RNA, 15 nt, Human papillomavirus type 5
agauccuaacagauu

SEQ ID NO: 4011099 - RNA, 14 nt, Human papillomavirus type 5
agaucugcagcucc

SEQ ID NO: 4011100 - RNA, 16 nt, Human papillomavirus type 5
agaucugcagcuccug

SEQ ID NO: 4011101 - RNA, 13 nt, Human papillomavirus type 5
agcaauggugcug

SEQ ID NO: 4011102 - RNA, 20 nt, Human papillomavirus type 5
agcucagugaggugcagccc

SEQ ID NO: 4011103 - RNA, 16 nt, Human papillomavirus type 5
aggaacugugagguca

SEQ ID NO: 4011104 - RNA, 13 nt, Human papillomavirus type 5
aguacuaccuggu

SEQ ID NO: 4011105 - RNA, 22 nt, Human papillomavirus type 5
aguacuggucacccuuauuuca

SEQ ID NO: 4011106 - RNA, 22 nt, Human papillomavirus type 5
aucaacaggagugugagcagag

SEQ ID NO: 4011107 - RNA, 20 nt, Human papillomavirus type 5
aucagugccaaacacaccgu

SEQ ID NO: 4011108 - RNA, 21 nt, Human papillomavirus type 5
augauacugaacuggagcagg

SEQ ID NO: 4011109 - RNA, 15 nt, Human papillomavirus type 5
auguauacaauauua

SEQ ID NO: 4011110 - RNA, 13 nt, Human papillomavirus type 5
auucaaagaacaa

SEQ ID NO: 4011111 - RNA, 18 nt, Human papillomavirus type 5
caaagcauacaggacgac

SEQ ID NO: 4011112 - RNA, 16 nt, Human papillomavirus type 5
caaaggaguugauaag

SEQ ID NO: 4011113 - RNA, 13 nt, Human papillomavirus type 5
caaugaagcugaa

SEQ ID NO: 4011114 - RNA, 17 nt, Human papillomavirus type 5
caggagauggcacugag

SEQ ID NO: 4011115 - RNA, 23 nt, Human papillomavirus type 5
uacugaccggagaucugcagcuc

SEQ ID NO: 4011116 - RNA, 18 nt, Human papillomavirus type 5
uacuggucacccuuauuu

SEQ ID NO: 4011117 - RNA, 22 nt, Human papillomavirus type 5
uacuggucacccuuauuucaau

SEQ ID NO: 4011118 - RNA, 21 nt, Human papillomavirus type 5
uagaaucagaucagugccaaa

SEQ ID NO: 4011119 - RNA, 21 nt, Human papillomavirus type 5
uccgugcgguugcaggaacug

SEQ ID NO: 4011120 - RNA, 20 nt, Human papillomavirus type 5
ucuccuggugaagugggagg

SEQ ID NO: 4011121 - RNA, 22 nt, Human papillomavirus type 5
ugcaggcacaaauuaaacauug

SEQ ID NO: 4011122 - RNA, 18 nt, Human papillomavirus type 5
ugcuaccaguugaccugu

SEQ ID NO: 4011123 - RNA, 20 nt, Human papillomavirus type 5
ugcugguguauuuuuuggug

SEQ ID NO: 4011124 - RNA, 13 nt, Human papillomavirus type 5
uggaagaagcucg

SEQ ID NO: 4011125 - RNA, 11 nt, Human papillomavirus type 5
uggaagcugac

SEQ ID NO: 4011126 - RNA, 21 nt, Human papillomavirus type 5
uggcaaaccuuacgaaaagaa

SEQ ID NO: 4011127 - RNA, 19 nt, Human papillomavirus type 5
uuuaaacaaugaagcugaa

SEQ ID NO: 4011128 - RNA, 15 nt, Human papillomavirus type 5
uuuugugaagaggaa

SEQ ID NO: 4011129 - RNA, 18 nt, Human papillomavirus type 6
aaaacaguacugaccuaa

SEQ ID NO: 4011130 - RNA, 16 nt, Human papillomavirus type 6
aaacaaguuaugaaau

SEQ ID NO: 4011131 - RNA, 15 nt, Human papillomavirus type 6
aaacuuacaagacag

SEQ ID NO: 4011132 - RNA, 13 nt, Human papillomavirus type 6
aaagacugaguau

SEQ ID NO: 4011133 - RNA, 23 nt, Human papillomavirus type 6
aacaguuuuuaaauguuguaaaa

SEQ ID NO: 4011134 - RNA, 16 nt, Human papillomavirus type 6
aacauuaccaaauagu

SEQ ID NO: 4011135 - RNA, 12 nt, Human papillomavirus type 6
aagguaaagcga

SEQ ID NO: 4011136 - RNA, 22 nt, Human papillomavirus type 6
aaguagugccaccauuaaaggu

SEQ ID NO: 4011137 - RNA, 23 nt, Human papillomavirus type 6
aauauauauauuuuuguuuccaa

SEQ ID NO: 4011138 - RNA, 15 nt, Human papillomavirus type 6
aauaucagacgauga

SEQ ID NO: 4011139 - RNA, 22 nt, Human papillomavirus type 6
aauuugauggcugugcaaacaa

SEQ ID NO: 4011140 - RNA, 17 nt, Human papillomavirus type 6
acaacuguaaugaugau

SEQ ID NO: 4011141 - RNA, 22 nt, Human papillomavirus type 6
acaauuaacuacauuauuguau

SEQ ID NO: 4011142 - RNA, 19 nt, Human papillomavirus type 6
acacaacuguaaugaugau

SEQ ID NO: 4011143 - RNA, 17 nt, Human papillomavirus type 6
acauuacaagaaacaag

SEQ ID NO: 4011144 - RNA, 14 nt, Human papillomavirus type 6
acauugugaacaca

SEQ ID NO: 4011145 - RNA, 16 nt, Human papillomavirus type 6
acauuuauuugauuua

SEQ ID NO: 4011146 - RNA, 18 nt, Human papillomavirus type 6
acuauagagcuguacaag

SEQ ID NO: 4011147 - RNA, 17 nt, Human papillomavirus type 6
acuguagaaguuaaauu

SEQ ID NO: 4011148 - RNA, 16 nt, Human papillomavirus type 6
acuuacaagacagcca

SEQ ID NO: 4011149 - RNA, 19 nt, Human papillomavirus type 6
agaaacagacaucagagaa

SEQ ID NO: 4011150 - RNA, 19 nt, Human papillomavirus type 6
agacaucagagaagugcaa

SEQ ID NO: 4011151 - RNA, 14 nt, Human papillomavirus type 6
agacaugaaagugu

SEQ ID NO: 4011152 - RNA, 20 nt, Human papillomavirus type 6
agacaugaaaguguauuauu

SEQ ID NO: 4011153 - RNA, 20 nt, Human papillomavirus type 6
agacugaguauaguauggaa

SEQ ID NO: 4011154 - RNA, 20 nt, Human papillomavirus type 6
agcucagaagaugaggugga

SEQ ID NO: 4011155 - RNA, 17 nt, Human papillomavirus type 6
aggaggcggacacccau

SEQ ID NO: 4011156 - RNA, 18 nt, Human papillomavirus type 6
agguggaggacagugggu

SEQ ID NO: 4011157 - RNA, 22 nt, Human papillomavirus type 6
agguguggguguaaguggacau

SEQ ID NO: 4011158 - RNA, 20 nt, Human papillomavirus type 6
aguggguaugacauggugga

SEQ ID NO: 4011159 - RNA, 17 nt, Human papillomavirus type 6
aguguaacaaacacaac

SEQ ID NO: 4011160 - RNA, 19 nt, Human papillomavirus type 6
aguguacagaaacagacau

SEQ ID NO: 4011161 - RNA, 21 nt, Human papillomavirus type 6
auacuuacuauuguggcugcu

SEQ ID NO: 4011162 - RNA, 13 nt, Human papillomavirus type 6
auauaaagcaaaa

SEQ ID NO: 4011163 - RNA, 12 nt, Human papillomavirus type 6
auauauguguau

SEQ ID NO: 4011164 - RNA, 14 nt, Human papillomavirus type 6
auauauguguguau

SEQ ID NO: 4011165 - RNA, 13 nt, Human papillomavirus type 6
auauguaaaugug

SEQ ID NO: 4011166 - RNA, 15 nt, Human papillomavirus type 6
auauuacacacaauu

SEQ ID NO: 4011167 - RNA, 13 nt, Human papillomavirus type 6
augaggaugagga

SEQ ID NO: 4011168 - RNA, 23 nt, Human papillomavirus type 6
augaugauuauguaacuaugcau

SEQ ID NO: 4011169 - RNA, 22 nt, Human papillomavirus type 6
augauuauguaacuaugcauua

SEQ ID NO: 4011170 - RNA, 14 nt, Human papillomavirus type 6
auguauauguguuu

SEQ ID NO: 4011171 - RNA, 22 nt, Human papillomavirus type 6
augugccuccuccuaacccugu

SEQ ID NO: 4011172 - RNA, 11 nt, Human papillomavirus type 6
auguguaugug

SEQ ID NO: 4011173 - RNA, 20 nt, Human papillomavirus type 6
auguguguuuaugugcaaua

SEQ ID NO: 4011174 - RNA, 21 nt, Human papillomavirus type 6
auuccuuggaagcacaggcau

SEQ ID NO: 4011175 - RNA, 13 nt, Human papillomavirus type 6
auugaugacagca

SEQ ID NO: 4011176 - RNA, 13 nt, Human papillomavirus type 6
auuguaacuguaa

SEQ ID NO: 4011177 - RNA, 14 nt, Human papillomavirus type 6
auuguguacacauc

SEQ ID NO: 4011178 - RNA, 15 nt, Human papillomavirus type 6
caaacaauacaaugg

SEQ ID NO: 4011179 - RNA, 12 nt, Human papillomavirus type 6
caagacagccaa

SEQ ID NO: 4011180 - RNA, 19 nt, Human papillomavirus type 6
caaugcaccuauuguaauu

SEQ ID NO: 4011181 - RNA, 19 nt, Human papillomavirus type 6
caccgguuccggcacuggg

SEQ ID NO: 4011182 - RNA, 15 nt, Human papillomavirus type 6
cacuauagccgaggc

SEQ ID NO: 4011183 - RNA, 14 nt, Human papillomavirus type 6
cagacaucagagaa

SEQ ID NO: 4011184 - RNA, 19 nt, Human papillomavirus type 6
cagcacauuaauacugccu

SEQ ID NO: 4011185 - RNA, 14 nt, Human papillomavirus type 6
cauaagacaugaaa

SEQ ID NO: 4011186 - RNA, 17 nt, Human papillomavirus type 6
caucagagaagugcaac

SEQ ID NO: 4011187 - RNA, 20 nt, Human papillomavirus type 6
cauuaauacugccuguuaua

SEQ ID NO: 4011188 - RNA, 15 nt, Human papillomavirus type 6
cauuaugauacugcu

SEQ ID NO: 4011189 - RNA, 14 nt, Human papillomavirus type 6
cauuggaaaugcau

SEQ ID NO: 4011190 - RNA, 14 nt, Human papillomavirus type 6
ccacuacauuguga

SEQ ID NO: 4011191 - RNA, 15 nt, Human papillomavirus type 6
ccuauuguaauuugu

SEQ ID NO: 4011192 - RNA, 22 nt, Human papillomavirus type 6
cgauggcggacgauucagguac

SEQ ID NO: 4011193 - RNA, 12 nt, Human papillomavirus type 6
cuaauuguuuaa

SEQ ID NO: 4011194 - RNA, 20 nt, Human papillomavirus type 6
cuacauugugaacacacagc

SEQ ID NO: 4011195 - RNA, 19 nt, Human papillomavirus type 6
cuagacuucuugcaguggg

SEQ ID NO: 4011196 - RNA, 16 nt, Human papillomavirus type 6
cuaguacuaacacugc

SEQ ID NO: 4011197 - RNA, 17 nt, Human papillomavirus type 6
cuauuguggcugcuauu

SEQ ID NO: 4011198 - RNA, 14 nt, Human papillomavirus type 6
cugggguuuauguc

SEQ ID NO: 4011199 - RNA, 20 nt, Human papillomavirus type 6
gaaacaaguuaugaaaugug

SEQ ID NO: 4011200 - RNA, 11 nt, Human papillomavirus type 6
gaagcacaggc

SEQ ID NO: 4011201 - RNA, 20 nt, Human papillomavirus type 6
gaaucuaauuguuuaaagug

SEQ ID NO: 4011202 - RNA, 13 nt, Human papillomavirus type 6
gacaucagagaag

SEQ ID NO: 4011203 - RNA, 13 nt, Human papillomavirus type 6
gauggcugugcaa

SEQ ID NO: 4011204 - RNA, 19 nt, Human papillomavirus type 6
gauuaugugguauggacag

SEQ ID NO: 4011205 - RNA, 14 nt, Human papillomavirus type 6
gcaaacaauacaau

SEQ ID NO: 4011206 - RNA, 12 nt, Human papillomavirus type 6
gcauuaugauac

SEQ ID NO: 4011207 - RNA, 16 nt, Human papillomavirus type 6
gccacauaggaaugca

SEQ ID NO: 4011208 - RNA, 14 nt, Human papillomavirus type 6
gccauugaaaugca

SEQ ID NO: 4011209 - RNA, 17 nt, Human papillomavirus type 6
gcucguccuccuguggu

SEQ ID NO: 4011210 - RNA, 21 nt, Human papillomavirus type 6
ggcggacgauucagguacaga

SEQ ID NO: 4011211 - RNA, 23 nt, Human papillomavirus type 6
gggaguggugguaacccuggaca

SEQ ID NO: 4011212 - RNA, 15 nt, Human papillomavirus type 6
ggguguaaguggaca

SEQ ID NO: 4011213 - RNA, 13 nt, Human papillomavirus type 6
ggguguacaggau

SEQ ID NO: 4011214 - RNA, 19 nt, Human papillomavirus type 6
gguaacccuggacaggaua

SEQ ID NO: 4011215 - RNA, 14 nt, Human papillomavirus type 6
guacauguauggaa

SEQ ID NO: 4011216 - RNA, 14 nt, Human papillomavirus type 6
guacuaacacugcu

SEQ ID NO: 4011217 - RNA, 16 nt, Human papillomavirus type 6
guauaucuuguuacac

SEQ ID NO: 4011218 - RNA, 17 nt, Human papillomavirus type 6
guauguguguauaugua

SEQ ID NO: 4011219 - RNA, 18 nt, Human papillomavirus type 6
guauguguguauauguau

SEQ ID NO: 4011220 - RNA, 19 nt, Human papillomavirus type 6
guccgaagcaaaaggacau

SEQ ID NO: 4011221 - RNA, 12 nt, Human papillomavirus type 6
gugccuuuauug

SEQ ID NO: 4011222 - RNA, 23 nt, Human papillomavirus type 6
gugguauggacagauguguaugu

SEQ ID NO: 4011223 - RNA, 15 nt, Human papillomavirus type 6
guguaaguggacauc

SEQ ID NO: 4011224 - RNA, 20 nt, Human papillomavirus type 6
guguguauauauguguaugu

SEQ ID NO: 4011225 - RNA, 17 nt, Human papillomavirus type 6
guuauguauauguguuu

SEQ ID NO: 4011226 - RNA, 20 nt, Human papillomavirus type 6
uaacaacccccuugcaauuu

SEQ ID NO: 4011227 - RNA, 16 nt, Human papillomavirus type 6
uaauguguaugugugu

SEQ ID NO: 4011228 - RNA, 20 nt, Human papillomavirus type 6
uacaauggauuaugugguau

SEQ ID NO: 4011229 - RNA, 15 nt, Human papillomavirus type 6
uacacaucugugcua

SEQ ID NO: 4011230 - RNA, 13 nt, Human papillomavirus type 6
uacugccuguuau

SEQ ID NO: 4011231 - RNA, 19 nt, Human papillomavirus type 6
uagaagcuauagugcaaca

SEQ ID NO: 4011232 - RNA, 14 nt, Human papillomavirus type 6
uagaggugggcagg

SEQ ID NO: 4011233 - RNA, 13 nt, Human papillomavirus type 6
uagugaggaacaa

SEQ ID NO: 4011234 - RNA, 13 nt, Human papillomavirus type 6
uauaauugcauuu

SEQ ID NO: 4011235 - RNA, 24 nt, Human papillomavirus type 6
uauaccauggcacauaguagggcc

SEQ ID NO: 4011236 - RNA, 17 nt, Human papillomavirus type 6
uauagugcaacacccaa

SEQ ID NO: 4011237 - RNA, 13 nt, Human papillomavirus type 6
uauauauguguau

SEQ ID NO: 4011238 - RNA, 18 nt, Human papillomavirus type 6
uaucaugccagcaguucu

SEQ ID NO: 4011239 - RNA, 22 nt, Human papillomavirus type 6
uaucuuguuacacccugugacu

SEQ ID NO: 4011240 - RNA, 18 nt, Human papillomavirus type 6
uaugauacugcuggugau

SEQ ID NO: 4011241 - RNA, 17 nt, Human papillomavirus type 6
uauggacagauguguau

SEQ ID NO: 4011242 - RNA, 18 nt, Human papillomavirus type 6
uauguauauguguuuaug

SEQ ID NO: 4011243 - RNA, 17 nt, Human papillomavirus type 6
uaugugccuuuauugua

SEQ ID NO: 4011244 - RNA, 14 nt, Human papillomavirus type 6
uauguguguauaua

SEQ ID NO: 4011245 - RNA, 22 nt, Human papillomavirus type 6
uauuaacaacccccuugcaauu

SEQ ID NO: 4011246 - RNA, 16 nt, Human papillomavirus type 6
ucagagaagugcaaca

SEQ ID NO: 4011247 - RNA, 21 nt, Human papillomavirus type 6
ucagcuacacagcuauaucaa

SEQ ID NO: 4011248 - RNA, 17 nt, Human papillomavirus type 6
ucauccuuauuuuucca

SEQ ID NO: 4011249 - RNA, 22 nt, Human papillomavirus type 6
uccauauguuaguccuauaaac

SEQ ID NO: 4011250 - RNA, 14 nt, Human papillomavirus type 6
uccuccuguggugg

SEQ ID NO: 4011251 - RNA, 16 nt, Human papillomavirus type 6
ugaaaauucagggagu

SEQ ID NO: 4011252 - RNA, 15 nt, Human papillomavirus type 6
ugaaaugcaaaugca

SEQ ID NO: 4011253 - RNA, 19 nt, Human papillomavirus type 6
ugagcaauuaguagacagc

SEQ ID NO: 4011254 - RNA, 20 nt, Human papillomavirus type 6
ugcaacacccaacagguaca

SEQ ID NO: 4011255 - RNA, 13 nt, Human papillomavirus type 6
uggagccuguggc

SEQ ID NO: 4011256 - RNA, 14 nt, Human papillomavirus type 6
ugggcaugcacagg

SEQ ID NO: 4011257 - RNA, 14 nt, Human papillomavirus type 6
uguaacuguaacau

SEQ ID NO: 4011258 - RNA, 19 nt, Human papillomavirus type 6
uguaauacaacuguacaug

SEQ ID NO: 4011259 - RNA, 14 nt, Human papillomavirus type 6
uguauaccauggca

SEQ ID NO: 4011260 - RNA, 19 nt, Human papillomavirus type 6
ugugcaggaccuaaaacga

SEQ ID NO: 4011261 - RNA, 17 nt, Human papillomavirus type 6
uguguauauauguguau

SEQ ID NO: 4011262 - RNA, 17 nt, Human papillomavirus type 6
uguguauguacuguuau

SEQ ID NO: 4011263 - RNA, 17 nt, Human papillomavirus type 6
uguguuauguguguaau

SEQ ID NO: 4011264 - RNA, 19 nt, Human papillomavirus type 6
uguguuuauguacuguuau

SEQ ID NO: 4011265 - RNA, 14 nt, Human papillomavirus type 6
uguuaccagauccu

SEQ ID NO: 4011266 - RNA, 22 nt, Human papillomavirus type 6
uuaaaaaacggggcaaaacugu

SEQ ID NO: 4011267 - RNA, 20 nt, Human papillomavirus type 6
uuauauauauguguguaugu

SEQ ID NO: 4011268 - RNA, 23 nt, Human papillomavirus type 6
uuauauauauguguguauguacu

SEQ ID NO: 4011269 - RNA, 23 nt, Human papillomavirus type 6
uuauguauauguguuuauguacu

SEQ ID NO: 4011270 - RNA, 12 nt, Human papillomavirus type 6
uuguaacuguaa

SEQ ID NO: 4011271 - RNA, 15 nt, Human papillomavirus type 6
uuguuacaacguguu

SEQ ID NO: 4011272 - RNA, 14 nt, Human papillomavirus type 6
uuuguuagcaucau

SEQ ID NO: 4011273 - RNA, 16 nt, Human papillomavirus type 6
uuuuaaauguuguaaa

SEQ ID NO: 4011274 - RNA, 11 nt, Human papillomavirus type 6
aaacaaacaug

SEQ ID NO: 4011275 - RNA, 12 nt, Human papillomavirus type 6
aaacaauacaau

SEQ ID NO: 4011276 - RNA, 13 nt, Human papillomavirus type 6
aaacacagacauu

SEQ ID NO: 4011277 - RNA, 15 nt, Human papillomavirus type 6
aaacuguagaaguua

SEQ ID NO: 4011278 - RNA, 16 nt, Human papillomavirus type 6
aaagcaaaacaaaugg

SEQ ID NO: 4011279 - RNA, 15 nt, Human papillomavirus type 6
aaaggugcauaguau

SEQ ID NO: 4011280 - RNA, 19 nt, Human papillomavirus type 6
aaagguguccgaagcaaaa

SEQ ID NO: 4011281 - RNA, 18 nt, Human papillomavirus type 6
aacaccaccuaaacgcug

SEQ ID NO: 4011282 - RNA, 11 nt, Human papillomavirus type 6
aacaggcagga

SEQ ID NO: 4011283 - RNA, 21 nt, Human papillomavirus type 6
aagccacauaggaaugcaagu

SEQ ID NO: 4011284 - RNA, 21 nt, Human papillomavirus type 6
aauauauuuuuauauuugcaa

SEQ ID NO: 4011285 - RNA, 22 nt, Human papillomavirus type 6
aauuccuaagguggaacacaac

SEQ ID NO: 4011286 - RNA, 14 nt, Human papillomavirus type 6
aauuuaaugaugga

SEQ ID NO: 4011287 - RNA, 22 nt, Human papillomavirus type 6
aauuuguauauauguaaaugug

SEQ ID NO: 4011288 - RNA, 17 nt, Human papillomavirus type 6
uauuguaauuuguauau

SEQ ID NO: 4011289 - RNA, 13 nt, Human papillomavirus type 6
uauuguguacaca

SEQ ID NO: 4011290 - RNA, 23 nt, Human papillomavirus type 6
ucagggaguggugguaacccugg

SEQ ID NO: 4011291 - RNA, 13 nt, Human papillomavirus type 6
ucagguacagaaa

SEQ ID NO: 4011292 - RNA, 18 nt, Human papillomavirus type 6
uccaccaauuuguuacaa

SEQ ID NO: 4011293 - RNA, 17 nt, Human papillomavirus type 6
ucuauuacuagugggcc

SEQ ID NO: 4011294 - RNA, 21 nt, Human papillomavirus type 6
ucugacuuuauuguguacaca

SEQ ID NO: 4011295 - RNA, 13 nt, Human papillomavirus type 6
ugauuuaauauca

SEQ ID NO: 4011296 - RNA, 20 nt, Human papillomavirus type 6
ugcaguguacagaaacagac

SEQ ID NO: 4011297 - RNA, 16 nt, Human papillomavirus type 6
ugcauuggaaaugcau

SEQ ID NO: 4011298 - RNA, 22 nt, Human papillomavirus type 6
uggagccuguggccccuucgga

SEQ ID NO: 4011299 - RNA, 13 nt, Human papillomavirus type 6
ugguaugggcaug

SEQ ID NO: 4011300 - RNA, 15 nt, Human papillomavirus type 6
uguauauguacuguu

SEQ ID NO: 4011301 - RNA, 19 nt, Human papillomavirus type 6
uguguauauguacuguuau

SEQ ID NO: 4011302 - RNA, 18 nt, Human papillomavirus type 6
uguuacacccugugacuc

SEQ ID NO: 4011303 - RNA, 16 nt, Human papillomavirus type 6
uuauaauugcauuugu

SEQ ID NO: 4011304 - RNA, 18 nt, Human papillomavirus type 6
uuccauaaaacgggcuaa

SEQ ID NO: 4011305 - RNA, 22 nt, Human papillomavirus type 6
uugcauugccugacucgucucu

SEQ ID NO: 4011306 - RNA, 22 nt, Human papillomavirus type 6
uugguguaauacaacuguacau

SEQ ID NO: 4011307 - RNA, 18 nt, Human papillomavirus type 6
uuguuagcaucauacuua

SEQ ID NO: 4011308 - RNA, 16 nt, Human papillomavirus type 6
uuuguauauauguaaa

SEQ ID NO: 4011309 - RNA, 18 nt, Human papillomavirus type 6
acaaacacaacuguaaug

SEQ ID NO: 4011310 - RNA, 22 nt, Human papillomavirus type 6
acaauggauuaugugguaugga

SEQ ID NO: 4011311 - RNA, 14 nt, Human papillomavirus type 6
acacaucugugcua

SEQ ID NO: 4011312 - RNA, 21 nt, Human papillomavirus type 6
acagaaacagacaucagagaa

SEQ ID NO: 4011313 - RNA, 14 nt, Human papillomavirus type 6
acagcaaugaugcu

SEQ ID NO: 4011314 - RNA, 16 nt, Human papillomavirus type 6
acagcucagaagauga

SEQ ID NO: 4011315 - RNA, 19 nt, Human papillomavirus type 6
acauauuuuaucaugccag

SEQ ID NO: 4011316 - RNA, 13 nt, Human papillomavirus type 6
accuaaacgcugu

SEQ ID NO: 4011317 - RNA, 16 nt, Human papillomavirus type 6
acuauagccgaggcag

SEQ ID NO: 4011318 - RNA, 15 nt, Human papillomavirus type 6
acuuuauuguguaca

SEQ ID NO: 4011319 - RNA, 18 nt, Human papillomavirus type 6
agaagcuauagugcaaca

SEQ ID NO: 4011320 - RNA, 19 nt, Human papillomavirus type 6
agaagcuauagugcaacac

SEQ ID NO: 4011321 - RNA, 15 nt, Human papillomavirus type 6
agccgaggcagugga

SEQ ID NO: 4011322 - RNA, 19 nt, Human papillomavirus type 6
aggaugguuuaugguagaa

SEQ ID NO: 4011323 - RNA, 20 nt, Human papillomavirus type 6
aggcaggaggcggacaccca

SEQ ID NO: 4011324 - RNA, 23 nt, Human papillomavirus type 6
aguguauuauuauauaaagcaaa

SEQ ID NO: 4011325 - RNA, 14 nt, Human papillomavirus type 6
aguuuuuaaauguu

SEQ ID NO: 4011326 - RNA, 22 nt, Human papillomavirus type 6
auaaacacuauagccgaggcag

SEQ ID NO: 4011327 - RNA, 16 nt, Human papillomavirus type 6
auaaugccauugaaau

SEQ ID NO: 4011328 - RNA, 17 nt, Human papillomavirus type 6
auacuuauuguauggau

SEQ ID NO: 4011329 - RNA, 14 nt, Human papillomavirus type 6
auagagcuguacaa

SEQ ID NO: 4011330 - RNA, 11 nt, Human papillomavirus type 6
auauguaaaug

SEQ ID NO: 4011331 - RNA, 15 nt, Human papillomavirus type 6
auguauauguaugug

SEQ ID NO: 4011332 - RNA, 13 nt, Human papillomavirus type 6
auguguguauaua

SEQ ID NO: 4011333 - RNA, 16 nt, Human papillomavirus type 6
auuaggugugggugua

SEQ ID NO: 4011334 - RNA, 16 nt, Human papillomavirus type 6
auuuuuauauuugcaa

SEQ ID NO: 4011335 - RNA, 23 nt, Human papillomavirus type 6
caaaacuguugugccaaaggugu

SEQ ID NO: 4011336 - RNA, 17 nt, Human papillomavirus type 6
caaacacaacuguaaug

SEQ ID NO: 4011337 - RNA, 19 nt, Human papillomavirus type 6
caaacacaacuguaaugau

SEQ ID NO: 4011338 - RNA, 16 nt, Human papillomavirus type 6
caaauaucagacgaug

SEQ ID NO: 4011339 - RNA, 18 nt, Human papillomavirus type 6
caacaguuuuuaaauguu

SEQ ID NO: 4011340 - RNA, 21 nt, Human papillomavirus type 6
caacaguuuuuaaauguugua

SEQ ID NO: 4011341 - RNA, 12 nt, Human papillomavirus type 6
caauuuaaugau

SEQ ID NO: 4011342 - RNA, 15 nt, Human papillomavirus type 6
cagaagaugaggugg

SEQ ID NO: 4011343 - RNA, 17 nt, Human papillomavirus type 6
cagacgaugaggaugag

SEQ ID NO: 4011344 - RNA, 23 nt, Human papillomavirus type 6
cagauccuaacaaauuugcauug

SEQ ID NO: 4011345 - RNA, 23 nt, Human papillomavirus type 6
cagauguguaugugcaggacacu

SEQ ID NO: 4011346 - RNA, 19 nt, Human papillomavirus type 6
caggaugguuuaugguaga

SEQ ID NO: 4011347 - RNA, 23 nt, Human papillomavirus type 6
caggcauuguuuaacaggcagga

SEQ ID NO: 4011348 - RNA, 22 nt, Human papillomavirus type 6
cauaaugccauugaaaugcaaa

SEQ ID NO: 4011349 - RNA, 19 nt, Human papillomavirus type 6
cauugaaaugcaaaugcau

SEQ ID NO: 4011350 - RNA, 15 nt, Human papillomavirus type 6
cauuuguuguauguu

SEQ ID NO: 4011351 - RNA, 12 nt, Human papillomavirus type 6
cccuugcaauuu

SEQ ID NO: 4011352 - RNA, 18 nt, Human papillomavirus type 6
ccgaagcaaaaggacaua

SEQ ID NO: 4011353 - RNA, 15 nt, Human papillomavirus type 6
ccuggguaaaggugc

SEQ ID NO: 4011354 - RNA, 15 nt, Human papillomavirus type 6
cggggcaaaacugua

SEQ ID NO: 4011355 - RNA, 17 nt, Human papillomavirus type 6
cuaagguggaacacaac

SEQ ID NO: 4011356 - RNA, 13 nt, Human papillomavirus type 6
cuccuaacccugu

SEQ ID NO: 4011357 - RNA, 15 nt, Human papillomavirus type 6
cucguccuccugugg

SEQ ID NO: 4011358 - RNA, 15 nt, Human papillomavirus type 6
cugacuuuauugugu

SEQ ID NO: 4011359 - RNA, 21 nt, Human papillomavirus type 6
cugccuguuauaauugcauuu

SEQ ID NO: 4011360 - RNA, 16 nt, Human papillomavirus type 6
cuguauccaaaguugu

SEQ ID NO: 4011361 - RNA, 20 nt, Human papillomavirus type 6
cuguugcuguggaugugaca

SEQ ID NO: 4011362 - RNA, 13 nt, Human papillomavirus type 6
cuuguuauauaca

SEQ ID NO: 4011363 - RNA, 16 nt, Human papillomavirus type 6
gaacacuaaacauagu

SEQ ID NO: 4011364 - RNA, 15 nt, Human papillomavirus type 6
gaagugcaacagcuu

SEQ ID NO: 4011365 - RNA, 17 nt, Human papillomavirus type 6
gacuucuugcagugggu

SEQ ID NO: 4011366 - RNA, 18 nt, Human papillomavirus type 6
gcaguguacagaaacaga

SEQ ID NO: 4011367 - RNA, 15 nt, Human papillomavirus type 6
gcauuuguuguaugu

SEQ ID NO: 4011368 - RNA, 19 nt, Human papillomavirus type 6
gccaaaaaagguaaagcga

SEQ ID NO: 4011369 - RNA, 17 nt, Human papillomavirus type 6
gccaccauuaaaggugu

SEQ ID NO: 4011370 - RNA, 20 nt, Human papillomavirus type 6
gccgaggcaguggaaaguga

SEQ ID NO: 4011371 - RNA, 13 nt, Human papillomavirus type 6
gcuauagugcaac

SEQ ID NO: 4011372 - RNA, 19 nt, Human papillomavirus type 6
gcucagaagaugaggugga

SEQ ID NO: 4011373 - RNA, 13 nt, Human papillomavirus type 6
gcugugcaaacaa

SEQ ID NO: 4011374 - RNA, 14 nt, Human papillomavirus type 6
gcuguggaugugac

SEQ ID NO: 4011375 - RNA, 17 nt, Human papillomavirus type 6
ggaacuucugcaaaacc

SEQ ID NO: 4011376 - RNA, 12 nt, Human papillomavirus type 6
ggagccuguggc

SEQ ID NO: 4011377 - RNA, 21 nt, Human papillomavirus type 6
ggccuagaggugggcagggga

SEQ ID NO: 4011378 - RNA, 16 nt, Human papillomavirus type 6
gggcaugcacaggccu

SEQ ID NO: 4011379 - RNA, 18 nt, Human papillomavirus type 6
guaacuaugcauuaugau

SEQ ID NO: 4011380 - RNA, 17 nt, Human papillomavirus type 6
guauauauguaaaugug

SEQ ID NO: 4011381 - RNA, 18 nt, Human papillomavirus type 6
guauguacuguuauguau

SEQ ID NO: 4011382 - RNA, 14 nt, Human papillomavirus type 6
gucuggguguacag

SEQ ID NO: 4011383 - RNA, 17 nt, Human papillomavirus type 6
gucuggguguacaggau

SEQ ID NO: 4011384 - RNA, 18 nt, Human papillomavirus type 6
gugcaacacccaacaggu

SEQ ID NO: 4011385 - RNA, 13 nt, Human papillomavirus type 6
gugccuccuccua

SEQ ID NO: 4011386 - RNA, 18 nt, Human papillomavirus type 6
gugcuaguacuaacacug

SEQ ID NO: 4011387 - RNA, 16 nt, Human papillomavirus type 6
gugggcaggggacagc

SEQ ID NO: 4011388 - RNA, 22 nt, Human papillomavirus type 6
gugguaccuguacaaauagcug

SEQ ID NO: 4011389 - RNA, 23 nt, Human papillomavirus type 6
guguaugcuuuguauaccauggc

SEQ ID NO: 4011390 - RNA, 13 nt, Human papillomavirus type 6
guguguauguacu

SEQ ID NO: 4011391 - RNA, 17 nt, Human papillomavirus type 6
guuagcaucauacuuau

SEQ ID NO: 4011392 - RNA, 12 nt, Human papillomavirus type 6
guuuaugucaau

SEQ ID NO: 4011393 - RNA, 20 nt, Human papillomavirus type 6
uaaacuuacaagacagccaa

SEQ ID NO: 4011394 - RNA, 12 nt, Human papillomavirus type 6
uaaauguuguaa

SEQ ID NO: 4011395 - RNA, 16 nt, Human papillomavirus type 6
uaacuacauuauugua

SEQ ID NO: 4011396 - RNA, 18 nt, Human papillomavirus type 6
uaauacaacuguacaugu

SEQ ID NO: 4011397 - RNA, 13 nt, Human papillomavirus type 6
uacaacuguacau

SEQ ID NO: 4011398 - RNA, 21 nt, Human papillomavirus type 6
uacaagaaacaaguuaugaaa

SEQ ID NO: 4011399 - RNA, 11 nt, Human papillomavirus type 6
uacuagugggc

SEQ ID NO: 4011400 - RNA, 15 nt, Human papillomavirus type 6
uacuguuauguauau

SEQ ID NO: 4011401 - RNA, 17 nt, Human papillomavirus type 6
uagaccugcaaccucca

SEQ ID NO: 4011402 - RNA, 14 nt, Human papillomavirus type 6
uagguaguccauau

SEQ ID NO: 4011403 - RNA, 19 nt, Human papillomavirus type 6
uagguguggguguaagugg

SEQ ID NO: 4011404 - RNA, 16 nt, Human papillomavirus type 6
uauagugcaacaccca

SEQ ID NO: 4011405 - RNA, 19 nt, Human papillomavirus type 6
uauauauguguaugugugu

SEQ ID NO: 4011406 - RNA, 15 nt, Human papillomavirus type 6
uauauguacuguuau

SEQ ID NO: 4011407 - RNA, 13 nt, Human papillomavirus type 6
uaucuuguuacac

SEQ ID NO: 4011408 - RNA, 16 nt, Human papillomavirus type 6
uauguacuguuaugua

SEQ ID NO: 4011409 - RNA, 18 nt, Human papillomavirus type 6
uauguacuguuauguaua

SEQ ID NO: 4011410 - RNA, 22 nt, Human papillomavirus type 6
uauguacuguuauguauaugug

SEQ ID NO: 4011411 - RNA, 16 nt, Human papillomavirus type 6
uauguauauguaugug

SEQ ID NO: 4011412 - RNA, 9 nt, Human papillomavirus type 6
uaugugugu

SEQ ID NO: 4011413 - RNA, 14 nt, Human papillomavirus type 6
uauguguguuuaug

SEQ ID NO: 4011414 - RNA, 22 nt, Human papillomavirus type 6
aaacacuauagccgaggcagug

SEQ ID NO: 4011415 - RNA, 13 nt, Human papillomavirus type 6
aaacucacuggaa

SEQ ID NO: 4011416 - RNA, 15 nt, Human papillomavirus type 6
aacaaccagcacauu

SEQ ID NO: 4011417 - RNA, 14 nt, Human papillomavirus type 6
aacuguaaugauga

SEQ ID NO: 4011418 - RNA, 18 nt, Human papillomavirus type 6
aaucauuauuaaagacug

SEQ ID NO: 4011419 - RNA, 13 nt, Human papillomavirus type 6
acagaaaaugagg

SEQ ID NO: 4011420 - RNA, 21 nt, Human papillomavirus type 6
acaggcauuguuuaacaggca

SEQ ID NO: 4011421 - RNA, 21 nt, Human papillomavirus type 6
acaugccccccagauguaauu

SEQ ID NO: 4011422 - RNA, 13 nt, Human papillomavirus type 6
accgaagacauaa

SEQ ID NO: 4011423 - RNA, 16 nt, Human papillomavirus type 6
accuaaacaaacaugu

SEQ ID NO: 4011424 - RNA, 17 nt, Human papillomavirus type 6
acuccuggguaaaggug

SEQ ID NO: 4011425 - RNA, 16 nt, Human papillomavirus type 6
agaagcuauagugcaa

SEQ ID NO: 4011426 - RNA, 19 nt, Human papillomavirus type 6
agacugaguauaguaugga

SEQ ID NO: 4011427 - RNA, 15 nt, Human papillomavirus type 6
agacuucuugcagug

SEQ ID NO: 4011428 - RNA, 18 nt, Human papillomavirus type 6
agacuucuugcagugggu

SEQ ID NO: 4011429 - RNA, 14 nt, Human papillomavirus type 6
agagaagugcaaca

SEQ ID NO: 4011430 - RNA, 16 nt, Human papillomavirus type 6
agaggugggcagggga

SEQ ID NO: 4011431 - RNA, 14 nt, Human papillomavirus type 6
agcaucauacuuau

SEQ ID NO: 4011432 - RNA, 19 nt, Human papillomavirus type 6
agccacauaggaaugcaag

SEQ ID NO: 4011433 - RNA, 14 nt, Human papillomavirus type 6
agcuauagugcaac

SEQ ID NO: 4011434 - RNA, 21 nt, Human papillomavirus type 6
agcucagaagaugagguggac

SEQ ID NO: 4011435 - RNA, 21 nt, Human papillomavirus type 6
aggagguggaggacagugggu

SEQ ID NO: 4011436 - RNA, 19 nt, Human papillomavirus type 6
agugaccuguugcugugga

SEQ ID NO: 4011437 - RNA, 14 nt, Human papillomavirus type 6
agugggucauccuu

SEQ ID NO: 4011438 - RNA, 13 nt, Human papillomavirus type 6
agugguaccugua

SEQ ID NO: 4011439 - RNA, 13 nt, Human papillomavirus type 6
aguuaugaaaugu

SEQ ID NO: 4011440 - RNA, 14 nt, Human papillomavirus type 6
aguuaugaaaugug

SEQ ID NO: 4011441 - RNA, 19 nt, Human papillomavirus type 6
aguucuagacuucuugcag

SEQ ID NO: 4011442 - RNA, 13 nt, Human papillomavirus type 6
auaauugcauuug

SEQ ID NO: 4011443 - RNA, 12 nt, Human papillomavirus type 6
auaccauggcac

SEQ ID NO: 4011444 - RNA, 19 nt, Human papillomavirus type 6
auauauuuuuauauuugca

SEQ ID NO: 4011445 - RNA, 15 nt, Human papillomavirus type 6
auaucaaacauguaa

SEQ ID NO: 4011446 - RNA, 17 nt, Human papillomavirus type 6
aucauuauuaaagacug

SEQ ID NO: 4011447 - RNA, 14 nt, Human papillomavirus type 6
aucuaauuguuuaa

SEQ ID NO: 4011448 - RNA, 23 nt, Human papillomavirus type 6
aucugugcuaguacuaacacugc

SEQ ID NO: 4011449 - RNA, 17 nt, Human papillomavirus type 6
augaugauuauguaacu

SEQ ID NO: 4011450 - RNA, 23 nt, Human papillomavirus type 6
augcauaagacaugaaaguguau

SEQ ID NO: 4011451 - RNA, 23 nt, Human papillomavirus type 6
augccauugaaaugcaaaugcau

SEQ ID NO: 4011452 - RNA, 21 nt, Human papillomavirus type 6
auggcugugcaaacaauacaa

SEQ ID NO: 4011453 - RNA, 19 nt, Human papillomavirus type 6
augguauugguguaauaca

SEQ ID NO: 4011454 - RNA, 22 nt, Human papillomavirus type 6
augucaauuuaaugauggagau

SEQ ID NO: 4011455 - RNA, 18 nt, Human papillomavirus type 6
auguggcaaacaccaccu

SEQ ID NO: 4011456 - RNA, 15 nt, Human papillomavirus type 6
auguguuuauguacu

SEQ ID NO: 4011457 - RNA, 22 nt, Human papillomavirus type 6
auguuaguccuauaaacacuau

SEQ ID NO: 4011458 - RNA, 16 nt, Human papillomavirus type 6
auuaauacugccuguu

SEQ ID NO: 4011459 - RNA, 20 nt, Human papillomavirus type 6
auuugauuuaauaucaucaa

SEQ ID NO: 4011460 - RNA, 16 nt, Human papillomavirus type 6
auuuguaacaguguau

SEQ ID NO: 4011461 - RNA, 22 nt, Human papillomavirus type 6
caacagguacacaaauaucaga

SEQ ID NO: 4011462 - RNA, 20 nt, Human papillomavirus type 6
caacuguacauguauggaag

SEQ ID NO: 4011463 - RNA, 16 nt, Human papillomavirus type 6
caaguagugccaccau

SEQ ID NO: 4011464 - RNA, 14 nt, Human papillomavirus type 6
aaacacaacuguaa

SEQ ID NO: 4011465 - RNA, 17 nt, Human papillomavirus type 6
aaacaugccauuguaac

SEQ ID NO: 4011466 - RNA, 18 nt, Human papillomavirus type 6
aaacggggcaaaacugua

SEQ ID NO: 4011467 - RNA, 17 nt, Human papillomavirus type 6
aaaugcauuuagaauca

SEQ ID NO: 4011468 - RNA, 21 nt, Human papillomavirus type 6
aagaaacaaguuaugaaaugu

SEQ ID NO: 4011469 - RNA, 24 nt, Human papillomavirus type 6
aagcgugcgucagcuacacagcua

SEQ ID NO: 4011470 - RNA, 18 nt, Human papillomavirus type 6
aaggcgauaaacacacca

SEQ ID NO: 4011471 - RNA, 17 nt, Human papillomavirus type 6
aagugguaccuguacaa

SEQ ID NO: 4011472 - RNA, 13 nt, Human papillomavirus type 6
aauacaacuguac

SEQ ID NO: 4011473 - RNA, 16 nt, Human papillomavirus type 6
aauacaauggauuaug

SEQ ID NO: 4011474 - RNA, 19 nt, Human papillomavirus type 6
aaugacaaacacagacauu

SEQ ID NO: 4011475 - RNA, 13 nt, Human papillomavirus type 6
aaugcaaaugcau

SEQ ID NO: 4011476 - RNA, 19 nt, Human papillomavirus type 6
aauguguaaauauauggua

SEQ ID NO: 4011477 - RNA, 16 nt, Human papillomavirus type 6
acaaguuaugaaaugu

SEQ ID NO: 4011478 - RNA, 15 nt, Human papillomavirus type 6
acagcaaugaugcua

SEQ ID NO: 4011479 - RNA, 21 nt, Human papillomavirus type 6
acagcaaugaugcuaacaugu

SEQ ID NO: 4011480 - RNA, 21 nt, Human papillomavirus type 6
acagccauuaggugugggugu

SEQ ID NO: 4011481 - RNA, 22 nt, Human papillomavirus type 6
acaggguauuuaaggugguguu

SEQ ID NO: 4011482 - RNA, 19 nt, Human papillomavirus type 6
acauaaugccauugaaaug

SEQ ID NO: 4011483 - RNA, 20 nt, Human papillomavirus type 6
acaucagagaagugcaacag

SEQ ID NO: 4011484 - RNA, 16 nt, Human papillomavirus type 6
acaugccauuguaacu

SEQ ID NO: 4011485 - RNA, 20 nt, Human papillomavirus type 6
acauguauggaagugguacc

SEQ ID NO: 4011486 - RNA, 19 nt, Human papillomavirus type 6
accacauaaacaugccauu

SEQ ID NO: 4011487 - RNA, 23 nt, Human papillomavirus type 6
acuaacacugcuuuuauacuuac

SEQ ID NO: 4011488 - RNA, 15 nt, Human papillomavirus type 6
acugcauuggaaaug

SEQ ID NO: 4011489 - RNA, 18 nt, Human papillomavirus type 6
acugcauuggaaaugcau

SEQ ID NO: 4011490 - RNA, 16 nt, Human papillomavirus type 6
acuuuauugaugacag

SEQ ID NO: 4011491 - RNA, 21 nt, Human papillomavirus type 6
agauauaggcuaaaugacaaa

SEQ ID NO: 4011492 - RNA, 15 nt, Human papillomavirus type 6
agcaaaaggacauaa

SEQ ID NO: 4011493 - RNA, 22 nt, Human papillomavirus type 6
agcgugcgucagcuacacagcu

SEQ ID NO: 4011494 - RNA, 12 nt, Human papillomavirus type 6
aggacagugggu

SEQ ID NO: 4011495 - RNA, 16 nt, Human papillomavirus type 6
aggaugaggaggugga

SEQ ID NO: 4011496 - RNA, 22 nt, Human papillomavirus type 6
aguacugaccuaaacaaacaug

SEQ ID NO: 4011497 - RNA, 13 nt, Human papillomavirus type 6
agugcaacaccca

SEQ ID NO: 4011498 - RNA, 17 nt, Human papillomavirus type 6
aguggugguaacccugg

SEQ ID NO: 4011499 - RNA, 21 nt, Human papillomavirus type 6
aguggugguaacccuggacag

SEQ ID NO: 4011500 - RNA, 14 nt, Human papillomavirus type 6
auaaacaugccauu

SEQ ID NO: 4011501 - RNA, 21 nt, Human papillomavirus type 6
auaaacaugccauuguaacug

SEQ ID NO: 4011502 - RNA, 15 nt, Human papillomavirus type 6
auaagacaugaaagu

SEQ ID NO: 4011503 - RNA, 19 nt, Human papillomavirus type 6
auaauugcauuuguuguau

SEQ ID NO: 4011504 - RNA, 20 nt, Human papillomavirus type 6
auacaggguauuuaaggugg

SEQ ID NO: 4011505 - RNA, 17 nt, Human papillomavirus type 6
auauauuuuuguuucca

SEQ ID NO: 4011506 - RNA, 12 nt, Human papillomavirus type 6
auauuuguaaca

SEQ ID NO: 4011507 - RNA, 16 nt, Human papillomavirus type 6
aucauacuuauuguau

SEQ ID NO: 4011508 - RNA, 21 nt, Human papillomavirus type 6
aucauagugaggaacaaaggc

SEQ ID NO: 4011509 - RNA, 16 nt, Human papillomavirus type 6
augcgacugugcagga

SEQ ID NO: 4011510 - RNA, 18 nt, Human papillomavirus type 6
auguauauguauguguug

SEQ ID NO: 4011511 - RNA, 13 nt, Human papillomavirus type 6
auguguguaugua

SEQ ID NO: 4011512 - RNA, 16 nt, Human papillomavirus type 6
auguguuguguauaua

SEQ ID NO: 4011513 - RNA, 17 nt, Human papillomavirus type 6
auuauuaaugcacuaua

SEQ ID NO: 4011514 - RNA, 15 nt, Human papillomavirus type 6
auugcauuuguugua

SEQ ID NO: 4011515 - RNA, 14 nt, Human papillomavirus type 6
caacaccauugcag

SEQ ID NO: 4011516 - RNA, 19 nt, Human papillomavirus type 6
caaguguaacaaacacaac

SEQ ID NO: 4011517 - RNA, 13 nt, Human papillomavirus type 6
caauuuguuacaa

SEQ ID NO: 4011518 - RNA, 18 nt, Human papillomavirus type 6
caauuuuuccuacuaacu

SEQ ID NO: 4011519 - RNA, 23 nt, Human papillomavirus type 6
cacaauuccuuggaagcacaggc

SEQ ID NO: 4011520 - RNA, 14 nt, Human papillomavirus type 6
cacagcaaugaugc

SEQ ID NO: 4011521 - RNA, 21 nt, Human papillomavirus type 6
cacagcaaugaugcuaacaug

SEQ ID NO: 4011522 - RNA, 22 nt, Human papillomavirus type 6
cacaucugugcuaguacuaaca

SEQ ID NO: 4011523 - RNA, 15 nt, Human papillomavirus type 6
caccuauuguaauuu

SEQ ID NO: 4011524 - RNA, 13 nt, Human papillomavirus type 6
cagacgaugagga

SEQ ID NO: 4011525 - RNA, 15 nt, Human papillomavirus type 6
cagcucagaagauga

SEQ ID NO: 4011526 - RNA, 22 nt, Human papillomavirus type 6
caggaccuaaaacgaaaguauu

SEQ ID NO: 4011527 - RNA, 18 nt, Human papillomavirus type 6
cauaacaacgauggcgga

SEQ ID NO: 4011528 - RNA, 19 nt, Human papillomavirus type 6
cauacuuauuguauggaua

SEQ ID NO: 4011529 - RNA, 19 nt, Human papillomavirus type 6
ccaauaauauauuuuuaua

SEQ ID NO: 4011530 - RNA, 14 nt, Human papillomavirus type 6
ccauugaaaugcaa

SEQ ID NO: 4011531 - RNA, 12 nt, Human papillomavirus type 6
cccuggacagga

SEQ ID NO: 4011532 - RNA, 16 nt, Human papillomavirus type 6
ccuaaacgcuguuuua

SEQ ID NO: 4011533 - RNA, 23 nt, Human papillomavirus type 6
ccuaagccacauaggaaugcaag

SEQ ID NO: 4011534 - RNA, 20 nt, Human papillomavirus type 6
ccuauuguaauuuguauaua

SEQ ID NO: 4011535 - RNA, 22 nt, Human papillomavirus type 6
cgacugguugugcaguguacag

SEQ ID NO: 4011536 - RNA, 14 nt, Human papillomavirus type 6
cuaaacaaacaugu

SEQ ID NO: 4011537 - RNA, 19 nt, Human papillomavirus type 6
cuaacaugucaauuuaaug

SEQ ID NO: 4011538 - RNA, 23 nt, Human papillomavirus type 6
cuaacuuuacuuguguguuacug

SEQ ID NO: 4011539 - RNA, 16 nt, Human papillomavirus type 6
cuacauugugaacaca

SEQ ID NO: 4011540 - RNA, 16 nt, Human papillomavirus type 6
cuagaggugggcaggg

SEQ ID NO: 4011541 - RNA, 18 nt, Human papillomavirus type 6
cuagaggugggcagggga

SEQ ID NO: 4011542 - RNA, 18 nt, Human papillomavirus type 6
cuaguacuaacacugcuu

SEQ ID NO: 4011543 - RNA, 18 nt, Human papillomavirus type 6
gaaaauucagggaguggu

SEQ ID NO: 4011544 - RNA, 19 nt, Human papillomavirus type 6
gacagauguguaugugcag

SEQ ID NO: 4011545 - RNA, 13 nt, Human papillomavirus type 6
gacagccaaaaaa

SEQ ID NO: 4011546 - RNA, 16 nt, Human papillomavirus type 6
gacuucuugcaguggg

SEQ ID NO: 4011547 - RNA, 12 nt, Human papillomavirus type 6
gagaagugcaac

SEQ ID NO: 4011548 - RNA, 17 nt, Human papillomavirus type 6
gaugaggagguggagga

SEQ ID NO: 4011549 - RNA, 14 nt, Human papillomavirus type 6
gcauuggaaaugca

SEQ ID NO: 4011550 - RNA, 21 nt, Human papillomavirus type 6
gccauuagguguggguguaag

SEQ ID NO: 4011551 - RNA, 23 nt, Human papillomavirus type 6
gccgaggcaguggaaagugaaau

SEQ ID NO: 4011552 - RNA, 13 nt, Human papillomavirus type 6
ggagauaccuggc

SEQ ID NO: 4011553 - RNA, 15 nt, Human papillomavirus type 6
ggaggcggacaccca

SEQ ID NO: 4011554 - RNA, 18 nt, Human papillomavirus type 6
ggauuaugugguauggac

SEQ ID NO: 4011555 - RNA, 21 nt, Human papillomavirus type 6
gguugugcaguguacagaaac

SEQ ID NO: 4011556 - RNA, 12 nt, Human papillomavirus type 6
guaacaagugua

SEQ ID NO: 4011557 - RNA, 15 nt, Human papillomavirus type 6
guaauacaacuguac

SEQ ID NO: 4011558 - RNA, 19 nt, Human papillomavirus type 6
guagaagcuauagugcaac

SEQ ID NO: 4011559 - RNA, 19 nt, Human papillomavirus type 6
guauguguguuuaugugca

SEQ ID NO: 4011560 - RNA, 21 nt, Human papillomavirus type 6
guauuauuauauaaagcaaaa

SEQ ID NO: 4011561 - RNA, 18 nt, Human papillomavirus type 6
gucuggguguacaggaug

SEQ ID NO: 4011562 - RNA, 13 nt, Human papillomavirus type 6
guggaaagugaaa

SEQ ID NO: 4011563 - RNA, 15 nt, Human papillomavirus type 6
guguaauguguaugu

SEQ ID NO: 4011564 - RNA, 21 nt, Human papillomavirus type 6
guguguauauauguguaugug

SEQ ID NO: 4011565 - RNA, 18 nt, Human papillomavirus type 6
guuauauauaugugugua

SEQ ID NO: 4011566 - RNA, 21 nt, Human papillomavirus type 6
guuaugaaauguggcaaacac

SEQ ID NO: 4011567 - RNA, 18 nt, Human papillomavirus type 6
uaaauguguaaauauaug

SEQ ID NO: 4011568 - RNA, 19 nt, Human papillomavirus type 6
uaacuacauuauuguauau

SEQ ID NO: 4011569 - RNA, 16 nt, Human papillomavirus type 6
uaacuguaacauauca

SEQ ID NO: 4011570 - RNA, 16 nt, Human papillomavirus type 6
uaaugaugauuaugua

SEQ ID NO: 4011571 - RNA, 22 nt, Human papillomavirus type 6
uaauguaauuuauuuguguaau

SEQ ID NO: 4011572 - RNA, 15 nt, Human papillomavirus type 6
uaauguguaugugug

SEQ ID NO: 4011573 - RNA, 16 nt, Human papillomavirus type 6
uacagaaacagacauc

SEQ ID NO: 4011574 - RNA, 22 nt, Human papillomavirus type 6
uacuauuagacacaaacugggg

SEQ ID NO: 4011575 - RNA, 23 nt, Human papillomavirus type 6
uacuguuauauauauguguguau

SEQ ID NO: 4011576 - RNA, 19 nt, Human papillomavirus type 6
uacuguuauauguguguau

SEQ ID NO: 4011577 - RNA, 15 nt, Human papillomavirus type 6
uacuuguguguuacu

SEQ ID NO: 4011578 - RNA, 14 nt, Human papillomavirus type 6
uagcaucauacuua

SEQ ID NO: 4011579 - RNA, 15 nt, Human papillomavirus type 6
uagcugcaggaacaa

SEQ ID NO: 4011580 - RNA, 22 nt, Human papillomavirus type 6
uagugccaccauuaaagguguc

SEQ ID NO: 4011581 - RNA, 12 nt, Human papillomavirus type 6
uauaauugcauu

SEQ ID NO: 4011582 - RNA, 23 nt, Human papillomavirus type 6
uauagugcaacacccaacaggua

SEQ ID NO: 4011583 - RNA, 15 nt, Human papillomavirus type 6
uauauauguguaugu

SEQ ID NO: 4011584 - RNA, 17 nt, Human papillomavirus type 6
uauggauaucugacuuu

SEQ ID NO: 4011585 - RNA, 12 nt, Human papillomavirus type 6
uauguaaaugug

SEQ ID NO: 4011586 - RNA, 14 nt, Human papillomavirus type 6
uauguaacuaugca

SEQ ID NO: 4011587 - RNA, 23 nt, Human papillomavirus type 6
ucaaacauguaaacucacuggaa

SEQ ID NO: 4011588 - RNA, 15 nt, Human papillomavirus type 6
ucagagaagugcaac

SEQ ID NO: 4011589 - RNA, 18 nt, Human papillomavirus type 6
ucagagaagugcaacagc

SEQ ID NO: 4011590 - RNA, 14 nt, Human papillomavirus type 6
uccggcacuggggg

SEQ ID NO: 4011591 - RNA, 20 nt, Human papillomavirus type 6
ugagcaauuaguagacagcu

SEQ ID NO: 4011592 - RNA, 24 nt, Human papillomavirus type 6
ugaugcuaacaugucaauuuaaug

SEQ ID NO: 4011593 - RNA, 21 nt, Human papillomavirus type 6
ugccauugaaaugcaaaugca

SEQ ID NO: 4011594 - RNA, 15 nt, Human papillomavirus type 6
ugcgcaccgaagaca

SEQ ID NO: 4011595 - RNA, 22 nt, Human papillomavirus type 6
ugcuaugagcaauuaguagaca

SEQ ID NO: 4011596 - RNA, 14 nt, Human papillomavirus type 6
ugcuuuuauacuua

SEQ ID NO: 4011597 - RNA, 11 nt, Human papillomavirus type 6
uggcacugggc

SEQ ID NO: 4011598 - RNA, 19 nt, Human papillomavirus type 6
uggcuauguucccuuagga

SEQ ID NO: 4011599 - RNA, 19 nt, Human papillomavirus type 6
uggcucguccuccuguggu

SEQ ID NO: 4011600 - RNA, 14 nt, Human papillomavirus type 6
uggguaaaggugca

SEQ ID NO: 4011601 - RNA, 14 nt, Human papillomavirus type 6
uguauauaugugua

SEQ ID NO: 4011602 - RNA, 16 nt, Human papillomavirus type 6
uguauauguacuguua

SEQ ID NO: 4011603 - RNA, 23 nt, Human papillomavirus type 6
uguauauguguuuauguacuguu

SEQ ID NO: 4011604 - RNA, 15 nt, Human papillomavirus type 6
uguauguacuguuau

SEQ ID NO: 4011605 - RNA, 20 nt, Human papillomavirus type 6
uguauguacuguuauguaua

SEQ ID NO: 4011606 - RNA, 14 nt, Human papillomavirus type 6
uguguaauguguau

SEQ ID NO: 4011607 - RNA, 15 nt, Human papillomavirus type 6
uguguuuaugugcaa

SEQ ID NO: 4011608 - RNA, 16 nt, Human papillomavirus type 6
uguguuuaugugcaau

SEQ ID NO: 4011609 - RNA, 22 nt, Human papillomavirus type 6
uguuauauacaccacuacauug

SEQ ID NO: 4011610 - RNA, 16 nt, Human papillomavirus type 6
uguuuauguacuguua

SEQ ID NO: 4011611 - RNA, 18 nt, Human papillomavirus type 6
uuaacaggcaggaggcgg

SEQ ID NO: 4011612 - RNA, 18 nt, Human papillomavirus type 6
uucagggaguggugguaa

SEQ ID NO: 4011613 - RNA, 18 nt, Human papillomavirus type 6
uuuccuacuaacuuuacu

SEQ ID NO: 4011614 - RNA, 13 nt, Human papillomavirus type 6
uuuuaucaugcca

SEQ ID NO: 4011615 - RNA, 16 nt, Human papillomavirus type 6
caaugcaccuauugua

SEQ ID NO: 4011616 - RNA, 15 nt, Human papillomavirus type 6
cacaacuguaaugau

SEQ ID NO: 4011617 - RNA, 18 nt, Human papillomavirus type 6
cacuauagagcuguacaa

SEQ ID NO: 4011618 - RNA, 21 nt, Human papillomavirus type 6
cagaaacagacaucagagaag

SEQ ID NO: 4011619 - RNA, 17 nt, Human papillomavirus type 6
cagccauuagguguggg

SEQ ID NO: 4011620 - RNA, 18 nt, Human papillomavirus type 6
caggaggcggacacccau

SEQ ID NO: 4011621 - RNA, 21 nt, Human papillomavirus type 6
caggccuagaggugggcaggg

SEQ ID NO: 4011622 - RNA, 14 nt, Human papillomavirus type 6
cagggagugguggu

SEQ ID NO: 4011623 - RNA, 16 nt, Human papillomavirus type 6
cagguacacaaauauc

SEQ ID NO: 4011624 - RNA, 21 nt, Human papillomavirus type 6
ccaacauauuuuaucaugcca

SEQ ID NO: 4011625 - RNA, 16 nt, Human papillomavirus type 6
ccacauaggaaugcaa

SEQ ID NO: 4011626 - RNA, 23 nt, Human papillomavirus type 6
ccccuacuauuagacacaaacug

SEQ ID NO: 4011627 - RNA, 18 nt, Human papillomavirus type 6
ccuagaggugggcagggg

SEQ ID NO: 4011628 - RNA, 23 nt, Human papillomavirus type 6
cgacugguugugcaguguacaga

SEQ ID NO: 4011629 - RNA, 17 nt, Human papillomavirus type 6
cuauagagcuguacaag

SEQ ID NO: 4011630 - RNA, 12 nt, Human papillomavirus type 6
cuauagugcaac

SEQ ID NO: 4011631 - RNA, 19 nt, Human papillomavirus type 6
cuauaucaaacauguaaac

SEQ ID NO: 4011632 - RNA, 12 nt, Human papillomavirus type 6
cugacuuuauug

SEQ ID NO: 4011633 - RNA, 17 nt, Human papillomavirus type 6
cugcauuggaaaugcau

SEQ ID NO: 4011634 - RNA, 13 nt, Human papillomavirus type 6
cuuacuauugugg

SEQ ID NO: 4011635 - RNA, 14 nt, Human papillomavirus type 6
cuugcaguggguca

SEQ ID NO: 4011636 - RNA, 18 nt, Human papillomavirus type 6
cuugcagugggucauccu

SEQ ID NO: 4011637 - RNA, 21 nt, Human papillomavirus type 6
gaagcuauagugcaacaccca

SEQ ID NO: 4011638 - RNA, 22 nt, Human papillomavirus type 6
gacugguugugcaguguacaga

SEQ ID NO: 4011639 - RNA, 20 nt, Human papillomavirus type 6
gagcaauuaguagacagcuc

SEQ ID NO: 4011640 - RNA, 21 nt, Human papillomavirus type 6
gaggggucuggguguacagga

SEQ ID NO: 4011641 - RNA, 14 nt, Human papillomavirus type 6
gaugaggaggugga

SEQ ID NO: 4011642 - RNA, 18 nt, Human papillomavirus type 6
gauggagauaccuggcug

SEQ ID NO: 4011643 - RNA, 16 nt, Human papillomavirus type 6
gcacuauagagcugua

SEQ ID NO: 4011644 - RNA, 21 nt, Human papillomavirus type 6
gcacugggccuccucaaaggc

SEQ ID NO: 4011645 - RNA, 22 nt, Human papillomavirus type 6
gcaguguacagaaacagacauc

SEQ ID NO: 4011646 - RNA, 14 nt, Human papillomavirus type 6
gccaaaggugucag

SEQ ID NO: 4011647 - RNA, 17 nt, Human papillomavirus type 6
gcgacugugcaggaccu

SEQ ID NO: 4011648 - RNA, 22 nt, Human papillomavirus type 6
gcuaacaugucaauuuaaugau

SEQ ID NO: 4011649 - RNA, 21 nt, Human papillomavirus type 6
gcuguuucaaaccagggaacu

SEQ ID NO: 4011650 - RNA, 14 nt, Human papillomavirus type 6
ggaagcacaggcau

SEQ ID NO: 4011651 - RNA, 21 nt, Human papillomavirus type 6
ggacgauucagguacagaaaa

SEQ ID NO: 4011652 - RNA, 22 nt, Human papillomavirus type 6
ggaggacaguggguaugacaug

SEQ ID NO: 4011653 - RNA, 17 nt, Human papillomavirus type 6
gggcaggggacagccau

SEQ ID NO: 4011654 - RNA, 17 nt, Human papillomavirus type 6
ggguaaaggugcauagu

SEQ ID NO: 4011655 - RNA, 21 nt, Human papillomavirus type 6
ggugauuauauauauaugaau

SEQ ID NO: 4011656 - RNA, 22 nt, Human papillomavirus type 6
gguggacuuuauugaugacagc

SEQ ID NO: 4011657 - RNA, 15 nt, Human papillomavirus type 6
guaacccuggacagg

SEQ ID NO: 4011658 - RNA, 18 nt, Human papillomavirus type 6
guagaagcuauagugcaa

SEQ ID NO: 4011659 - RNA, 13 nt, Human papillomavirus type 6
guauauauguaaa

SEQ ID NO: 4011660 - RNA, 16 nt, Human papillomavirus type 6
guauauguauguguug

SEQ ID NO: 4011661 - RNA, 21 nt, Human papillomavirus type 6
guaugggcaugcacaggccua

SEQ ID NO: 4011662 - RNA, 21 nt, Human papillomavirus type 6
gucaaugcaccuauuguaauu

SEQ ID NO: 4011663 - RNA, 17 nt, Human papillomavirus type 6
gucaauuuaaugaugga

SEQ ID NO: 4011664 - RNA, 22 nt, Human papillomavirus type 6
gucaggauaucaauacagggua

SEQ ID NO: 4011665 - RNA, 13 nt, Human papillomavirus type 6
guccgaagcaaaa

SEQ ID NO: 4011666 - RNA, 16 nt, Human papillomavirus type 6
guugugcaguguacag

SEQ ID NO: 4011667 - RNA, 14 nt, Human papillomavirus type 6
uaaacaaacaugua

SEQ ID NO: 4011668 - RNA, 24 nt, Human papillomavirus type 6
uaacacugcuuuuauacuuacuau

SEQ ID NO: 4011669 - RNA, 14 nt, Human papillomavirus type 6
uaacccuggacagg

SEQ ID NO: 4011670 - RNA, 13 nt, Human papillomavirus type 6
uaauacugccugu

SEQ ID NO: 4011671 - RNA, 14 nt, Human papillomavirus type 6
uacagaaacagaca

SEQ ID NO: 4011672 - RNA, 16 nt, Human papillomavirus type 6
uacuaacuuuacuugu

SEQ ID NO: 4011673 - RNA, 16 nt, Human papillomavirus type 6
uagcaucauacuuauu

SEQ ID NO: 4011674 - RNA, 14 nt, Human papillomavirus type 6
uagccgaggcagug

SEQ ID NO: 4011675 - RNA, 22 nt, Human papillomavirus type 6
uauaauugcauuuguuguaugu

SEQ ID NO: 4011676 - RNA, 14 nt, Human papillomavirus type 6
uauagccgaggcag

SEQ ID NO: 4011677 - RNA, 12 nt, Human papillomavirus type 6
uauauaaagcaa

SEQ ID NO: 4011678 - RNA, 20 nt, Human papillomavirus type 6
uauauacaccacuacauugu

SEQ ID NO: 4011679 - RNA, 15 nt, Human papillomavirus type 6
uauauauaugugugu

SEQ ID NO: 4011680 - RNA, 22 nt, Human papillomavirus type 6
uauguacuguuauauauaugug

SEQ ID NO: 4011681 - RNA, 18 nt, Human papillomavirus type 6
uauguacuguuauaugug

SEQ ID NO: 4011682 - RNA, 21 nt, Human papillomavirus type 6
uauguacuguuauaugugugu

SEQ ID NO: 4011683 - RNA, 15 nt, Human papillomavirus type 6
uauguauauguaugu

SEQ ID NO: 4011684 - RNA, 13 nt, Human papillomavirus type 6
uauguguguauau

SEQ ID NO: 4011685 - RNA, 16 nt, Human papillomavirus type 6
uauguguuguguauau

SEQ ID NO: 4011686 - RNA, 23 nt, Human papillomavirus type 6
uccacgauuggacgccauuaaac

SEQ ID NO: 4011687 - RNA, 14 nt, Human papillomavirus type 6
uccuauaaacacua

SEQ ID NO: 4011688 - RNA, 16 nt, Human papillomavirus type 6
ucucuuuuugauccca

SEQ ID NO: 4011689 - RNA, 15 nt, Human papillomavirus type 6
ugauacugcugguga

SEQ ID NO: 4011690 - RNA, 15 nt, Human papillomavirus type 6
ugaugacagcaauau

SEQ ID NO: 4011691 - RNA, 20 nt, Human papillomavirus type 6
ugauggagauaccuggcugg

SEQ ID NO: 4011692 - RNA, 17 nt, Human papillomavirus type 6
ugcaguguacagaaaca

SEQ ID NO: 4011693 - RNA, 17 nt, Human papillomavirus type 6
ugcauuggaaaugcaua

SEQ ID NO: 4011694 - RNA, 23 nt, Human papillomavirus type 6
ugccauugaaaugcaaaugcauu

SEQ ID NO: 4011695 - RNA, 15 nt, Human papillomavirus type 6
uggcacauaguaggg

SEQ ID NO: 4011696 - RNA, 18 nt, Human papillomavirus type 6
ugggaacacuaaacauag

SEQ ID NO: 4011697 - RNA, 21 nt, Human papillomavirus type 6
ugguagaagcuauagugcaac

SEQ ID NO: 4011698 - RNA, 21 nt, Human papillomavirus type 6
uggugguaacccuggacagga

SEQ ID NO: 4011699 - RNA, 22 nt, Human papillomavirus type 6
uguacacaucugugcuaguacu

SEQ ID NO: 4011700 - RNA, 16 nt, Human papillomavirus type 6
uguacagaaacagaca

SEQ ID NO: 4011701 - RNA, 20 nt, Human papillomavirus type 6
uguacugcauuggaaaugca

SEQ ID NO: 4011702 - RNA, 20 nt, Human papillomavirus type 6
uguauccaaaguuguugcca

SEQ ID NO: 4011703 - RNA, 14 nt, Human papillomavirus type 6
uguauguacuguua

SEQ ID NO: 4011704 - RNA, 12 nt, Human papillomavirus type 6
uguguuacuguc

SEQ ID NO: 4011705 - RNA, 13 nt, Human papillomavirus type 6
uguguuguguaua

SEQ ID NO: 4011706 - RNA, 14 nt, Human papillomavirus type 6
uuauacuuacuauu

SEQ ID NO: 4011707 - RNA, 16 nt, Human papillomavirus type 6
uuaugaaauguggcaa

SEQ ID NO: 4011708 - RNA, 18 nt, Human papillomavirus type 6
uuauguguguaauguaau

SEQ ID NO: 4011709 - RNA, 17 nt, Human papillomavirus type 6
uuggaagcacaggcauu

SEQ ID NO: 4011710 - RNA, 15 nt, Human papillomavirus type 6
uuguguaauguguau

SEQ ID NO: 4011711 - RNA, 21 nt, Human papillomavirus type 6
uuuuaucaugccagcaguucu

SEQ ID NO: 4011712 - RNA, 14 nt, Human papillomavirus type 8
aaacaggcagguac

SEQ ID NO: 4011713 - RNA, 20 nt, Human papillomavirus type 8
aacagccugacaaugccaau

SEQ ID NO: 4011714 - RNA, 22 nt, Human papillomavirus type 8
aauguuuguuuauucugacuca

SEQ ID NO: 4011715 - RNA, 16 nt, Human papillomavirus type 8
acacuugaggcacaga

SEQ ID NO: 4011716 - RNA, 13 nt, Human papillomavirus type 8
acagacucaguuu

SEQ ID NO: 4011717 - RNA, 21 nt, Human papillomavirus type 8
aaacacuugaggcacagauug

SEQ ID NO: 4011718 - RNA, 16 nt, Human papillomavirus type 8
aacaggagugugagca

SEQ ID NO: 4011719 - RNA, 19 nt, Human papillomavirus type 8
aacuguauucaaaauuguu

SEQ ID NO: 4011720 - RNA, 16 nt, Human papillomavirus type 8
aagaauugcuguucag

SEQ ID NO: 4011721 - RNA, 22 nt, Human papillomavirus type 8
aagaauugcuguucagagaccu

SEQ ID NO: 4011722 - RNA, 14 nt, Human papillomavirus type 8
aagcaaaagccaag

SEQ ID NO: 4011723 - RNA, 17 nt, Human papillomavirus type 8
acaacaguugcugacaa

SEQ ID NO: 4011724 - RNA, 13 nt, Human papillomavirus type 8
acaaugaagcuga

SEQ ID NO: 4011725 - RNA, 22 nt, Human papillomavirus type 8
acagauggcaguguggcaaucg

SEQ ID NO: 4011726 - RNA, 16 nt, Human papillomavirus type 8
acauuaguggacacaa

SEQ ID NO: 4011727 - RNA, 15 nt, Human papillomavirus type 8
accggccgugguaca

SEQ ID NO: 4011728 - RNA, 21 nt, Human papillomavirus type 8
accguguggcugcagcugcug

SEQ ID NO: 4011729 - RNA, 22 nt, Human papillomavirus type 8
acuauguggaagcacauuuacu

SEQ ID NO: 4011730 - RNA, 21 nt, Human papillomavirus type 8
acucuuaacaaugaagcugaa

SEQ ID NO: 4011731 - RNA, 15 nt, Human papillomavirus type 8
agaaaccgaccgcac

SEQ ID NO: 4011732 - RNA, 21 nt, Human papillomavirus type 8
agaaaucugaguuugcagaug

SEQ ID NO: 4011733 - RNA, 15 nt, Human papillomavirus type 8
agaagcgguaggucc

SEQ ID NO: 4011734 - RNA, 20 nt, Human papillomavirus type 8
agacaucgaaagaacuguau

SEQ ID NO: 4011735 - RNA, 17 nt, Human papillomavirus type 8
agccaagcaggcuauag

SEQ ID NO: 4011736 - RNA, 17 nt, Human papillomavirus type 8
aggaauguuuguuuauu

SEQ ID NO: 4011737 - RNA, 17 nt, Human papillomavirus type 8
aggucgccugccaagga

SEQ ID NO: 4011738 - RNA, 22 nt, Human papillomavirus type 8
aguugccaaaacagacucaguu

SEQ ID NO: 4011739 - RNA, 20 nt, Human papillomavirus type 8
aucggcuaccgguaagguuu

SEQ ID NO: 4011740 - RNA, 15 nt, Human papillomavirus type 8
auguagacaaugauu

SEQ ID NO: 4011741 - RNA, 15 nt, Human papillomavirus type 8
auguugcagcugcag

SEQ ID NO: 4011742 - RNA, 16 nt, Human papillomavirus type 8
auguuucucaugaggu

SEQ ID NO: 4011743 - RNA, 16 nt, Human papillomavirus type 8
auucaaaauuguugca

SEQ ID NO: 4011744 - RNA, 16 nt, Human papillomavirus type 8
auucugacucagcauc

SEQ ID NO: 4011745 - RNA, 17 nt, Human papillomavirus type 8
auucugacucagcauca

SEQ ID NO: 4011746 - RNA, 12 nt, Human papillomavirus type 8
caaacaacaguu

SEQ ID NO: 4011747 - RNA, 15 nt, Human papillomavirus type 8
caaagaacuaacauc

SEQ ID NO: 4011748 - RNA, 22 nt, Human papillomavirus type 8
caaagcacggaugaauacauuc

SEQ ID NO: 4011749 - RNA, 21 nt, Human papillomavirus type 8
caagaauugcuguucagagac

SEQ ID NO: 4011750 - RNA, 17 nt, Human papillomavirus type 8
caauuauuugagcgaga

SEQ ID NO: 4011751 - RNA, 12 nt, Human papillomavirus type 8
cacaccugugga

SEQ ID NO: 4011752 - RNA, 17 nt, Human papillomavirus type 8
cagauugcgcauuggcu

SEQ ID NO: 4011753 - RNA, 20 nt, Human papillomavirus type 8
cagcugcagucacuacagaa

SEQ ID NO: 4011754 - RNA, 23 nt, Human papillomavirus type 8
caggaaacggaggaggagcuaga

SEQ ID NO: 4011755 - RNA, 20 nt, Human papillomavirus type 8
cauuuacuacacugaugcag

SEQ ID NO: 4011756 - RNA, 12 nt, Human papillomavirus type 8
ccugccaaggaa

SEQ ID NO: 4011757 - RNA, 20 nt, Human papillomavirus type 8
cuaaagaaggguuaagugag

SEQ ID NO: 4011758 - RNA, 18 nt, Human papillomavirus type 8
cugcagucacuacagaaa

SEQ ID NO: 4011759 - RNA, 21 nt, Human papillomavirus type 8
cuuauaagaaugcuccagaaa

SEQ ID NO: 4011760 - RNA, 17 nt, Human papillomavirus type 8
gaaaagaagcuguguug

SEQ ID NO: 4011761 - RNA, 18 nt, Human papillomavirus type 8
gagcuagacaucgaaaga

SEQ ID NO: 4011762 - RNA, 22 nt, Human papillomavirus type 8
gauccaaauagguuugcacugg

SEQ ID NO: 4011763 - RNA, 17 nt, Human papillomavirus type 8
gcaaaagccaagcaggc

SEQ ID NO: 4011764 - RNA, 16 nt, Human papillomavirus type 8
gccaauacugacagac

SEQ ID NO: 4011765 - RNA, 19 nt, Human papillomavirus type 8
gcuacuaacacacuaacau

SEQ ID NO: 4011766 - RNA, 13 nt, Human papillomavirus type 8
gcuaggcaaaaag

SEQ ID NO: 4011767 - RNA, 17 nt, Human papillomavirus type 8
gcuccagaaaaucauuu

SEQ ID NO: 4011768 - RNA, 21 nt, Human papillomavirus type 8
gcuguucagagaccuacagcu

SEQ ID NO: 4011769 - RNA, 18 nt, Human papillomavirus type 8
ggaaauacucccacagug

SEQ ID NO: 4011770 - RNA, 21 nt, Human papillomavirus type 8
ggaauaauguugcagcugcag

SEQ ID NO: 4011771 - RNA, 23 nt, Human papillomavirus type 8
gggacaaccauuagguguuggga

SEQ ID NO: 4011772 - RNA, 21 nt, Human papillomavirus type 8
gucugaagcaaaagccaagca

SEQ ID NO: 4011773 - RNA, 15 nt, Human papillomavirus type 8
gugagcagagcgagg

SEQ ID NO: 4011774 - RNA, 19 nt, Human papillomavirus type 8
guucaaacaugcucggauu

SEQ ID NO: 4011775 - RNA, 19 nt, Human papillomavirus type 8
guuuguuuauucugacuca

SEQ ID NO: 4011776 - RNA, 22 nt, Human papillomavirus type 8
uaacucuuaacaaugaagcuga

SEQ ID NO: 4011777 - RNA, 16 nt, Human papillomavirus type 8
uauuuuggaagcugaa

SEQ ID NO: 4011778 - RNA, 20 nt, Human papillomavirus type 8
ugaacaauuauuugagcgag

SEQ ID NO: 4011779 - RNA, 15 nt, Human papillomavirus type 8
ugacagacugcucac

SEQ ID NO: 4011780 - RNA, 12 nt, Human papillomavirus type 8
uugucaacgcaa

SEQ ID NO: 4011781 - RNA, 14 nt, Human papillomavirus type 8
acauucaaagaacu

SEQ ID NO: 4011782 - RNA, 22 nt, Human papillomavirus type 8
accaguggccagggugcaaagc

SEQ ID NO: 4011783 - RNA, 12 nt, Human papillomavirus type 8
acuaacacacua

SEQ ID NO: 4011784 - RNA, 13 nt, Human papillomavirus type 8
acuaacacacuaa

SEQ ID NO: 4011785 - RNA, 19 nt, Human papillomavirus type 8
agaauagaccauguucguu

SEQ ID NO: 4011786 - RNA, 18 nt, Human papillomavirus type 8
agaauugcuguucagaga

SEQ ID NO: 4011787 - RNA, 13 nt, Human papillomavirus type 8
agacuuauaagaa

SEQ ID NO: 4011788 - RNA, 17 nt, Human papillomavirus type 8
agauacagacucagaua

SEQ ID NO: 4011789 - RNA, 19 nt, Human papillomavirus type 8
aggaauaauguugcagcug

SEQ ID NO: 4011790 - RNA, 21 nt, Human papillomavirus type 8
aggaccuuucaagaauugcug

SEQ ID NO: 4011791 - RNA, 19 nt, Human papillomavirus type 8
aguugaccugcuuugugaa

SEQ ID NO: 4011792 - RNA, 15 nt, Human papillomavirus type 8
auaugucuguauaca

SEQ ID NO: 4011793 - RNA, 14 nt, Human papillomavirus type 8
aucugaguuugcag

SEQ ID NO: 4011794 - RNA, 17 nt, Human papillomavirus type 8
auuagguguugggagca

SEQ ID NO: 4011795 - RNA, 17 nt, Human papillomavirus type 8
caaucuauuuuggcagc

SEQ ID NO: 4011796 - RNA, 22 nt, Human papillomavirus type 8
cacauuuaucaaaccugcaaac

SEQ ID NO: 4011797 - RNA, 18 nt, Human papillomavirus type 8
caccaguggccagggugc

SEQ ID NO: 4011798 - RNA, 20 nt, Human papillomavirus type 8
cagagaccuacagcuucugu

SEQ ID NO: 4011799 - RNA, 21 nt, Human papillomavirus type 8
cagaugagccuuggacauuag

SEQ ID NO: 4011800 - RNA, 19 nt, Human papillomavirus type 8
caggagugugagcagagcg

SEQ ID NO: 4011801 - RNA, 23 nt, Human papillomavirus type 8
ccaggauuggauaucaaccugug

SEQ ID NO: 4011802 - RNA, 18 nt, Human papillomavirus type 8
ccaguugaccugcuuugu

SEQ ID NO: 4011803 - RNA, 14 nt, Human papillomavirus type 8
ccaucccuauuuua

SEQ ID NO: 4011804 - RNA, 21 nt, Human papillomavirus type 8
ccuggaucagggaaauucucu

SEQ ID NO: 4011805 - RNA, 15 nt, Human papillomavirus type 8
cgaaaagaagcugug

SEQ ID NO: 4011806 - RNA, 16 nt, Human papillomavirus type 8
cguguuggaaauacuc

SEQ ID NO: 4011807 - RNA, 19 nt, Human papillomavirus type 8
cuauggacauacugccaau

SEQ ID NO: 4011808 - RNA, 16 nt, Human papillomavirus type 8
cuauuuuaauaaagug

SEQ ID NO: 4011809 - RNA, 20 nt, Human papillomavirus type 8
cugauucggguaucaggacc

SEQ ID NO: 4011810 - RNA, 16 nt, Human papillomavirus type 8
cugucgcgcagcucag

SEQ ID NO: 4011811 - RNA, 20 nt, Human papillomavirus type 8
cuuauaagaaugcuccagaa

SEQ ID NO: 4011812 - RNA, 18 nt, Human papillomavirus type 8
gaacaauuauuugagcga

SEQ ID NO: 4011813 - RNA, 17 nt, Human papillomavirus type 8
gacaaccauuagguguu

SEQ ID NO: 4011814 - RNA, 14 nt, Human papillomavirus type 8
gacauacugccaau

SEQ ID NO: 4011815 - RNA, 23 nt, Human papillomavirus type 8
gaccgcacccgguacauaaaggu

SEQ ID NO: 4011816 - RNA, 20 nt, Human papillomavirus type 8
gaccuuucaagaauugcugu

SEQ ID NO: 4011817 - RNA, 15 nt, Human papillomavirus type 8
gauggcaguguggca

SEQ ID NO: 4011818 - RNA, 22 nt, Human papillomavirus type 8
gauuggauaucaaccugugccg

SEQ ID NO: 4011819 - RNA, 19 nt, Human papillomavirus type 8
gcagagcaggacagcggag

SEQ ID NO: 4011820 - RNA, 21 nt, Human papillomavirus type 8
gcuagacaucgaaagaacugu

SEQ ID NO: 4011821 - RNA, 17 nt, Human papillomavirus type 8
gcuauaggaauaauguu

SEQ ID NO: 4011822 - RNA, 12 nt, Human papillomavirus type 8
ggcagugcuggu

SEQ ID NO: 4011823 - RNA, 22 nt, Human papillomavirus type 8
ggggccugguauccguguugga

SEQ ID NO: 4011824 - RNA, 19 nt, Human papillomavirus type 8
guauacacuauguggaagc

SEQ ID NO: 4011825 - RNA, 21 nt, Human papillomavirus type 8
gugagauacaaccugaagugu

SEQ ID NO: 4011826 - RNA, 16 nt, Human papillomavirus type 8
gugagcagagcgagga

SEQ ID NO: 4011827 - RNA, 18 nt, Human papillomavirus type 8
guguauuuuggaagcuga

SEQ ID NO: 4011828 - RNA, 12 nt, Human papillomavirus type 8
guucguucaaac

SEQ ID NO: 4011829 - RNA, 16 nt, Human papillomavirus type 8
guuuucgguacaaaac

SEQ ID NO: 4011830 - RNA, 16 nt, Human papillomavirus type 8
uaacaucuacuaucac

SEQ ID NO: 4011831 - RNA, 22 nt, Human papillomavirus type 8
uaucaaccugugccgccacuag

SEQ ID NO: 4011832 - RNA, 22 nt, Human papillomavirus type 8
ucccaaaguaucgggaaaucaa

SEQ ID NO: 4011833 - RNA, 14 nt, Human papillomavirus type 8
ugaaguuaagugag

SEQ ID NO: 4011834 - RNA, 11 nt, Human papillomavirus type 8
uuggcaucucc

SEQ ID NO: 4011835 - RNA, 13 nt, Human papillomavirus type 8
gcgguaacugcaa

SEQ ID NO: 4011836 - RNA, 15 nt, Human papillomavirus type 8
gcuaggcaaaaaggc

SEQ ID NO: 4011837 - RNA, 20 nt, Human papillomavirus type 8
gcucuuugcagagcaggaca

SEQ ID NO: 4011838 - RNA, 15 nt, Human papillomavirus type 8
ggcucuuugcagagc

SEQ ID NO: 4011839 - RNA, 11 nt, Human papillomavirus type 8
gguaacugcaa

SEQ ID NO: 4011840 - RNA, 21 nt, Human papillomavirus type 8
guacaaaaccauaaacuuuua

SEQ ID NO: 4011841 - RNA, 18 nt, Human papillomavirus type 8
guauucaaggaauguuug

SEQ ID NO: 4011842 - RNA, 14 nt, Human papillomavirus type 8
guccuaaagcuguc

SEQ ID NO: 4011843 - RNA, 13 nt, Human papillomavirus type 8
gucgccugccaag

SEQ ID NO: 4011844 - RNA, 13 nt, Human papillomavirus type 8
guugagcaaacaa

SEQ ID NO: 4011845 - RNA, 19 nt, Human papillomavirus type 8
guuuauucugacucagcau

SEQ ID NO: 4011846 - RNA, 22 nt, Human papillomavirus type 8
uagacaucgaaagaacuguauu

SEQ ID NO: 4011847 - RNA, 21 nt, Human papillomavirus type 8
uauggcagugcugguguauuu

SEQ ID NO: 4011848 - RNA, 18 nt, Human papillomavirus type 8
ucacucuaccuaagaaac

SEQ ID NO: 4011849 - RNA, 15 nt, Human papillomavirus type 8
ucacugucaccucag

SEQ ID NO: 4011850 - RNA, 17 nt, Human papillomavirus type 8
ucaguuuagugccagaa

SEQ ID NO: 4011851 - RNA, 18 nt, Human papillomavirus type 8
uccguguuggaaauacuc

SEQ ID NO: 4011852 - RNA, 14 nt, Human papillomavirus type 8
ucugucacacacau

SEQ ID NO: 4011853 - RNA, 13 nt, Human papillomavirus type 8
ucuuugcagagca

SEQ ID NO: 4011854 - RNA, 13 nt, Human papillomavirus type 8
ugaguaguugcca

SEQ ID NO: 4011855 - RNA, 20 nt, Human papillomavirus type 8
ugcucggauuaggucgccug

SEQ ID NO: 4011856 - RNA, 17 nt, Human papillomavirus type 8
ugcuuugugaagaggaa

SEQ ID NO: 4011857 - RNA, 19 nt, Human papillomavirus type 8
uuugcuuuuuacuauauuu

SEQ ID NO: 4011858 - RNA, 22 nt, Human papillomavirus type 8
aacucuuaacaaugaagcugaa

SEQ ID NO: 4011859 - RNA, 14 nt, Human papillomavirus type 8
aauacauucaaaga

SEQ ID NO: 4011860 - RNA, 17 nt, Human papillomavirus type 8
acagauggcaguguggc

SEQ ID NO: 4011861 - RNA, 22 nt, Human papillomavirus type 8
acauuacagguucccaaaguau

SEQ ID NO: 4011862 - RNA, 22 nt, Human papillomavirus type 8
accguuuucgguacaaaaccau

SEQ ID NO: 4011863 - RNA, 13 nt, Human papillomavirus type 8
accuuucaagaau

SEQ ID NO: 4011864 - RNA, 13 nt, Human papillomavirus type 8
acuagcagugucu

SEQ ID NO: 4011865 - RNA, 11 nt, Human papillomavirus type 8
acuauguggaa

SEQ ID NO: 4011866 - RNA, 18 nt, Human papillomavirus type 8
acugccaaucgacacuau

SEQ ID NO: 4011867 - RNA, 15 nt, Human papillomavirus type 8
acuguauucaaaauu

SEQ ID NO: 4011868 - RNA, 15 nt, Human papillomavirus type 8
agaaauccaagcgaa

SEQ ID NO: 4011869 - RNA, 13 nt, Human papillomavirus type 8
agcugcagucacu

SEQ ID NO: 4011870 - RNA, 20 nt, Human papillomavirus type 8
agcugcugucaggucaagcu

SEQ ID NO: 4011871 - RNA, 22 nt, Human papillomavirus type 8
agcuguguugcuauauuucgcu

SEQ ID NO: 4011872 - RNA, 18 nt, Human papillomavirus type 8
agguugguaugggcuugc

SEQ ID NO: 4011873 - RNA, 12 nt, Human papillomavirus type 8
aucgggaaauca

SEQ ID NO: 4011874 - RNA, 16 nt, Human papillomavirus type 8
auguucguucaaacau

SEQ ID NO: 4011875 - RNA, 20 nt, Human papillomavirus type 8
auuacaaaaacuaaaacgaa

SEQ ID NO: 4011876 - RNA, 22 nt, Human papillomavirus type 8
auuuuaaaauauggcagugcug

SEQ ID NO: 4011877 - RNA, 15 nt, Human papillomavirus type 8
auuuuggaagcugaa

SEQ ID NO: 4011878 - RNA, 16 nt, Human papillomavirus type 8
caaacgaacaggaaac

SEQ ID NO: 4011879 - RNA, 17 nt, Human papillomavirus type 8
caauauuuuaaaauaug

SEQ ID NO: 4011880 - RNA, 14 nt, Human papillomavirus type 8
cacuagcagugucu

SEQ ID NO: 4011881 - RNA, 23 nt, Human papillomavirus type 8
cagacucaguuuagugccagaau

SEQ ID NO: 4011882 - RNA, 16 nt, Human papillomavirus type 8
cagagcaggacagcgg

SEQ ID NO: 4011883 - RNA, 22 nt, Human papillomavirus type 8
caggagugugagcagagcgagg

SEQ ID NO: 4011884 - RNA, 23 nt, Human papillomavirus type 8
ccaaucuauuuuggcagcgcuuu

SEQ ID NO: 4011885 - RNA, 22 nt, Human papillomavirus type 8
cgaaggcucuuugcagagcagg

SEQ ID NO: 4011886 - RNA, 14 nt, Human papillomavirus type 8
cgccugccaaggaa

SEQ ID NO: 4011887 - RNA, 11 nt, Human papillomavirus type 8
cggaggaggag

SEQ ID NO: 4011888 - RNA, 20 nt, Human papillomavirus type 8
cuauaggaauaauguugcag

SEQ ID NO: 4011889 - RNA, 15 nt, Human papillomavirus type 8
cucugucacacacau

SEQ ID NO: 4011890 - RNA, 18 nt, Human papillomavirus type 8
cuuaacaaugaagcugaa

SEQ ID NO: 4011891 - RNA, 18 nt, Human papillomavirus type 8
cuugccaaucuauuuugg

SEQ ID NO: 4011892 - RNA, 14 nt, Human papillomavirus type 8
gaaaagaagcugug

SEQ ID NO: 4011893 - RNA, 19 nt, Human papillomavirus type 8
gaacuaacaucuacuauca

SEQ ID NO: 4011894 - RNA, 17 nt, Human papillomavirus type 8
gacagacugcucacugu

SEQ ID NO: 4011895 - RNA, 13 nt, Human papillomavirus type 8
gacuuauuagaua

SEQ ID NO: 4011896 - RNA, 14 nt, Human papillomavirus type 8
gaguaguugccaaa

SEQ ID NO: 4011897 - RNA, 13 nt, Human papillomavirus type 8
gagugugagcaga

SEQ ID NO: 4011898 - RNA, 15 nt, Human papillomavirus type 8
gauaaguggcacaaa

SEQ ID NO: 4011899 - RNA, 16 nt, Human papillomavirus type 8
gauccaaauagguuug

SEQ ID NO: 4011900 - RNA, 15 nt, Human papillomavirus type 8
gaugaauacauucaa

SEQ ID NO: 4011901 - RNA, 15 nt, Human papillomavirus type 8
gauguagacaaugau

SEQ ID NO: 4011902 - RNA, 19 nt, Human papillomavirus type 8
gcaaacaggcagguacaug

SEQ ID NO: 4011903 - RNA, 19 nt, Human papillomavirus type 8
gcaaagcacggaugaauac

SEQ ID NO: 4011904 - RNA, 21 nt, Human papillomavirus type 8
gccaaucuauuuuggcagcgc

SEQ ID NO: 4011905 - RNA, 14 nt, Human papillomavirus type 8
ggaagcacauuuac

SEQ ID NO: 4011906 - RNA, 16 nt, Human papillomavirus type 8
ggacauuaguggacac

SEQ ID NO: 4011907 - RNA, 17 nt, Human papillomavirus type 8
ggagugugagcagagcg

SEQ ID NO: 4011908 - RNA, 14 nt, Human papillomavirus type 8
gucugaagcaaaag

SEQ ID NO: 4011909 - RNA, 23 nt, Human papillomavirus type 8
guguugcuauauuucgcuaggca

SEQ ID NO: 4011910 - RNA, 21 nt, Human papillomavirus type 8
uaaagcugucgcgcagcucag

SEQ ID NO: 4011911 - RNA, 14 nt, Human papillomavirus type 8
uaucaaaccugcaa

SEQ ID NO: 4011912 - RNA, 23 nt, Human papillomavirus type 8
ucaacaggagugugagcagagcg

SEQ ID NO: 4011913 - RNA, 16 nt, Human papillomavirus type 8
uccuauggacauacug

SEQ ID NO: 4011914 - RNA, 21 nt, Human papillomavirus type 8
ugaacaauuauuugagcgaga

SEQ ID NO: 4011915 - RNA, 20 nt, Human papillomavirus type 8
ugagcgagauacagacucag

SEQ ID NO: 4011916 - RNA, 11 nt, Human papillomavirus type 8
uggaagcugaa

SEQ ID NO: 4011917 - RNA, 16 nt, Human papillomavirus type 8
uguugaaguuaaguga

SEQ ID NO: 4011918 - RNA, 17 nt, Human papillomavirus type 8
uucaauguuuacaacaa

SEQ ID NO: 4011919 - RNA, 21 nt, Human papillomavirus type 8
uugcagaggcuuagaaaucag

SEQ ID NO: 4011920 - RNA, 18 nt, Human papillomavirus type 8
uugcagaugagccuugga

SEQ ID NO: 4011921 - RNA, 18 nt, Human papillomavirus type 8
uugucaacgcaacugauu

SEQ ID NO: 4011922 - RNA, 21 nt, Human papillomavirus type 8
aaaguugagcaaacaacaguu

SEQ ID NO: 4011923 - RNA, 16 nt, Human papillomavirus type 8
aacucuuaacaaugaa

SEQ ID NO: 4011924 - RNA, 15 nt, Human papillomavirus type 8
aacuguauucaaaau

SEQ ID NO: 4011925 - RNA, 22 nt, Human papillomavirus type 8
aagagagacucugucacacaca

SEQ ID NO: 4011926 - RNA, 19 nt, Human papillomavirus type 8
aaggcucuuugcagagcag

SEQ ID NO: 4011927 - RNA, 13 nt, Human papillomavirus type 8
aaggguuaaguga

SEQ ID NO: 4011928 - RNA, 20 nt, Human papillomavirus type 8
acaaugaagcugaagauguu

SEQ ID NO: 4011929 - RNA, 17 nt, Human papillomavirus type 8
accaguggccagggugc

SEQ ID NO: 4011930 - RNA, 18 nt, Human papillomavirus type 8
accaguggccagggugca

SEQ ID NO: 4011931 - RNA, 14 nt, Human papillomavirus type 8
accuacagcuucug

SEQ ID NO: 4011932 - RNA, 22 nt, Human papillomavirus type 8
acugauucggguaucaggaccu

SEQ ID NO: 4011933 - RNA, 22 nt, Human papillomavirus type 8
agacaaugauuuugaacaauua

SEQ ID NO: 4011934 - RNA, 13 nt, Human papillomavirus type 8
agacgauaagugg

SEQ ID NO: 4011935 - RNA, 14 nt, Human papillomavirus type 8
agacucagauauuu

SEQ ID NO: 4011936 - RNA, 17 nt, Human papillomavirus type 8
agagacuuauaagaaug

SEQ ID NO: 4011937 - RNA, 18 nt, Human papillomavirus type 8
agccuuggacauuagugg

SEQ ID NO: 4011938 - RNA, 20 nt, Human papillomavirus type 8
agccuuggacauuaguggac

SEQ ID NO: 4011939 - RNA, 19 nt, Human papillomavirus type 8
agcuaacucuuaacaauga

SEQ ID NO: 4011940 - RNA, 17 nt, Human papillomavirus type 8
agggaaauucucuggaa

SEQ ID NO: 4011941 - RNA, 13 nt, Human papillomavirus type 8
aggucgccugcca

SEQ ID NO: 4011942 - RNA, 16 nt, Human papillomavirus type 8
auaaacagccugacaa

SEQ ID NO: 4011943 - RNA, 14 nt, Human papillomavirus type 8
auaauggugacaca

SEQ ID NO: 4011944 - RNA, 13 nt, Human papillomavirus type 8
auacauucaaaga

SEQ ID NO: 4011945 - RNA, 14 nt, Human papillomavirus type 8
auauaugauaaaca

SEQ ID NO: 4011946 - RNA, 13 nt, Human papillomavirus type 8
augaagcugaaga

SEQ ID NO: 4011947 - RNA, 21 nt, Human papillomavirus type 8
auggugacacauuacagguuc

SEQ ID NO: 4011948 - RNA, 19 nt, Human papillomavirus type 8
auuacagguucccaaagua

SEQ ID NO: 4011949 - RNA, 18 nt, Human papillomavirus type 8
auuagauaauugugaccu

SEQ ID NO: 4011950 - RNA, 17 nt, Human papillomavirus type 8
auuucaucaacaggagu

SEQ ID NO: 4011951 - RNA, 17 nt, Human papillomavirus type 8
caauacugacagacugc

SEQ ID NO: 4011952 - RNA, 14 nt, Human papillomavirus type 8
cacacuaacauauu

SEQ ID NO: 4011953 - RNA, 13 nt, Human papillomavirus type 8
cacagugguacgg

SEQ ID NO: 4011954 - RNA, 18 nt, Human papillomavirus type 8
ccaaucuauuuuggcagc

SEQ ID NO: 4011955 - RNA, 17 nt, Human papillomavirus type 8
ccauauuucaauguuua

SEQ ID NO: 4011956 - RNA, 14 nt, Human papillomavirus type 8
cccacagugguacg

SEQ ID NO: 4011957 - RNA, 11 nt, Human papillomavirus type 8
ccugcaaacag

SEQ ID NO: 4011958 - RNA, 19 nt, Human papillomavirus type 8
cucuuugcagagcaggaca

SEQ ID NO: 4011959 - RNA, 14 nt, Human papillomavirus type 8
cugcugucagguca

SEQ ID NO: 4011960 - RNA, 16 nt, Human papillomavirus type 8
cuuucgcuuaaaguua

SEQ ID NO: 4011961 - RNA, 22 nt, Human papillomavirus type 8
gaacuguauucaaaauuguugc

SEQ ID NO: 4011962 - RNA, 19 nt, Human papillomavirus type 8
gaaguauugaucuugccaa

SEQ ID NO: 4011963 - RNA, 16 nt, Human papillomavirus type 8
gaccuggaucagggaa

SEQ ID NO: 4011964 - RNA, 11 nt, Human papillomavirus type 8
gaggcacagau

SEQ ID NO: 4011965 - RNA, 22 nt, Human papillomavirus type 8
gcaaacaacaguugcugacaau

SEQ ID NO: 4011966 - RNA, 17 nt, Human papillomavirus type 8
gcagaacaaacacuuga

SEQ ID NO: 4011967 - RNA, 15 nt, Human papillomavirus type 8
gcagagcgaggagca

SEQ ID NO: 4011968 - RNA, 13 nt, Human papillomavirus type 8
gccgugguacagg

SEQ ID NO: 4011969 - RNA, 21 nt, Human parainfluenza virus 1 strain Washington/1964
aaaaccagauaugauguauaa

SEQ ID NO: 4011970 - RNA, 20 nt, Human parainfluenza virus 1 strain Washington/1964
aaagcucccucaaaacaauu

SEQ ID NO: 4011971 - RNA, 18 nt, Human parainfluenza virus 1 strain Washington/1964
aaaucaauauccagagcc

SEQ ID NO: 4011972 - RNA, 13 nt, Human parainfluenza virus 1 strain Washington/1964
aaaucuauccaca

SEQ ID NO: 4011973 - RNA, 14 nt, Human parainfluenza virus 1 strain Washington/1964
aacaagugaaaaua

SEQ ID NO: 4011974 - RNA, 20 nt, Human parainfluenza virus 1 strain Washington/1964
aaccacaaccacagaaaaac

SEQ ID NO: 4011975 - RNA, 15 nt, Human parainfluenza virus 1 strain Washington/1964
aagccagaucaaaag

SEQ ID NO: 4011976 - RNA, 16 nt, Human parainfluenza virus 1 strain Washington/1964
aaggucaaaaagacaa

SEQ ID NO: 4011977 - RNA, 17 nt, Human parainfluenza virus 1 strain Washington/1964
aauauccagagccaacu

SEQ ID NO: 4011978 - RNA, 20 nt, Human parainfluenza virus 1 strain Washington/1964
aauauccagagccaacucaa

SEQ ID NO: 4011979 - RNA, 22 nt, Human parainfluenza virus 1 strain Washington/1964
aauauccagagccaacucaaaa

SEQ ID NO: 4011980 - RNA, 21 nt, Human parainfluenza virus 1 strain Washington/1964
aaucaaaucuauccacaacuu

SEQ ID NO: 4011981 - RNA, 18 nt, Human parainfluenza virus 1 strain Washington/1964
aaucaauauccagagcca

SEQ ID NO: 4011982 - RNA, 14 nt, Human parainfluenza virus 1 strain Washington/1964
aaucccuuuaacug

SEQ ID NO: 4011983 - RNA, 16 nt, Human parainfluenza virus 1 strain Washington/1964
aaucuacaauuucaac

SEQ ID NO: 4011984 - RNA, 20 nt, Human parainfluenza virus 1 strain Washington/1964
acaauuucaaccagcaauca

SEQ ID NO: 4011985 - RNA, 14 nt, Human parainfluenza virus 1 strain Washington/1964
acacagaguucaga

SEQ ID NO: 4011986 - RNA, 18 nt, Human parainfluenza virus 1 strain Washington/1964
acuucaccaaucaggugu

SEQ ID NO: 4011987 - RNA, 19 nt, Human parainfluenza virus 1 strain Washington/1964
acuuggacaauagaagcca

SEQ ID NO: 4011988 - RNA, 20 nt, Human parainfluenza virus 1 strain Washington/1964
acuuggacaauagaagccag

SEQ ID NO: 4011989 - RNA, 21 nt, Human parainfluenza virus 1 strain Washington/1964
acuuggacaauagaagccaga

SEQ ID NO: 4011990 - RNA, 15 nt, Human parainfluenza virus 1 strain Washington/1964
agaaaacaacaauga

SEQ ID NO: 4011991 - RNA, 21 nt, Human parainfluenza virus 1 strain Washington/1964
agaagccagaucaaaaguaag

SEQ ID NO: 4011992 - RNA, 22 nt, Human parainfluenza virus 1 strain Washington/1964
agagccaacucaaaaagcuccc

SEQ ID NO: 4011993 - RNA, 18 nt, Human parainfluenza virus 1 strain Washington/1964
agccaacucaaaaagcuc

SEQ ID NO: 4011994 - RNA, 21 nt, Human parainfluenza virus 1 strain Washington/1964
aggauacuuggacaauagaag

SEQ ID NO: 4011995 - RNA, 19 nt, Human parainfluenza virus 1 strain Washington/1964
aggucaaaaagacaagguu

SEQ ID NO: 4011996 - RNA, 16 nt, Human parainfluenza virus 1 strain Washington/1964
auacaaucaguucaaa

SEQ ID NO: 4011997 - RNA, 18 nt, Human parainfluenza virus 1 strain Washington/1964
auagacauuuauaugaca

SEQ ID NO: 4011998 - RNA, 18 nt, Human parainfluenza virus 1 strain Washington/1964
aucaagacccaacacuau

SEQ ID NO: 4011999 - RNA, 13 nt, Human parainfluenza virus 1 strain Washington/1964
aucaguucaaaua

SEQ ID NO: 4012000 - RNA, 17 nt, Human parainfluenza virus 1 strain Washington/1964
auccagggaucuucaca

SEQ ID NO: 4012001 - RNA, 17 nt, Human parainfluenza virus 1 strain Washington/1964
augaaaucacaacauga

SEQ ID NO: 4012002 - RNA, 23 nt, Human parainfluenza virus 1 strain Washington/1964
augaaucuacaauuucaaccagc

SEQ ID NO: 4012003 - RNA, 13 nt, Human parainfluenza virus 1 strain Washington/1964
augaguuaacaag

SEQ ID NO: 4012004 - RNA, 16 nt, Human parainfluenza virus 1 strain Washington/1964
auuucaaccagcaauc

SEQ ID NO: 4012005 - RNA, 18 nt, Human parainfluenza virus 1 strain Washington/1964
auuucaaccagcaaucaa

SEQ ID NO: 4012006 - RNA, 23 nt, Human parainfluenza virus 1 strain Washington/1964
auuucaaccagcaaucaaaauca

SEQ ID NO: 4012007 - RNA, 13 nt, Human parainfluenza virus 1 strain Washington/1964
caaaaagcucccu

SEQ ID NO: 4012008 - RNA, 23 nt, Human parainfluenza virus 1 strain Washington/1964
caaaaucaauauccagagccaac

SEQ ID NO: 4012009 - RNA, 23 nt, Human parainfluenza virus 1 strain Washington/1964
caaggucaccaucagucuucaca

SEQ ID NO: 4012010 - RNA, 15 nt, Human parainfluenza virus 1 strain Washington/1964
caauauccagagcca

SEQ ID NO: 4012011 - RNA, 16 nt, Human parainfluenza virus 1 strain Washington/1964
cagagccaacucaaaa

SEQ ID NO: 4012012 - RNA, 21 nt, Human parainfluenza virus 1 strain Washington/1964
caggauacuuggacaauagaa

SEQ ID NO: 4012013 - RNA, 18 nt, Human parainfluenza virus 1 strain Washington/1964
cagugauacuacaagguc

SEQ ID NO: 4012014 - RNA, 12 nt, Human parainfluenza virus 1 strain Washington/1964
cauuagcucuaa

SEQ ID NO: 4012015 - RNA, 15 nt, Human parainfluenza virus 1 strain Washington/1964
ccagagccaacucaa

SEQ ID NO: 4012016 - RNA, 21 nt, Human parainfluenza virus 1 strain Washington/1964
cgcauguuaaaaucugcaaau

SEQ ID NO: 4012017 - RNA, 18 nt, Human parainfluenza virus 1 strain Washington/1964
cuaaaucguaccauuaau

SEQ ID NO: 4012018 - RNA, 16 nt, Human parainfluenza virus 1 strain Washington/1964
cuaguuaucgaaaaca

SEQ ID NO: 4012019 - RNA, 16 nt, Human parainfluenza virus 1 strain Washington/1964
cucaaaacaauuaaga

SEQ ID NO: 4012020 - RNA, 20 nt, Human parainfluenza virus 1 strain Washington/1964
cucaauaaugacacccauua

SEQ ID NO: 4012021 - RNA, 14 nt, Human parainfluenza virus 1 strain Washington/1964
cugcaaauuacaaa

SEQ ID NO: 4012022 - RNA, 15 nt, Human parainfluenza virus 1 strain Washington/1964
cuucaccaaucaggu

SEQ ID NO: 4012023 - RNA, 15 nt, Human parainfluenza virus 1 strain Washington/1964
cuucucaucuuuauu

SEQ ID NO: 4012024 - RNA, 16 nt, Human parainfluenza virus 1 strain Washington/1964
cuuggacaauagaagc

SEQ ID NO: 4012025 - RNA, 21 nt, Human parainfluenza virus 1 strain Washington/1964
cuuggacaauagaagccagau

SEQ ID NO: 4012026 - RNA, 13 nt, Human parainfluenza virus 1 strain Washington/1964
cuuuauuaucuaa

SEQ ID NO: 4012027 - RNA, 20 nt, Human parainfluenza virus 1 strain Washington/1964
gagccaacucaaaaagcucc

SEQ ID NO: 4012028 - RNA, 16 nt, Human parainfluenza virus 1 strain Washington/1964
gagccucaagcaucca

SEQ ID NO: 4012029 - RNA, 18 nt, Human parainfluenza virus 1 strain Washington/1964
gauacuuggacaauagaa

SEQ ID NO: 4012030 - RNA, 15 nt, Human parainfluenza virus 1 strain Washington/1964
gaucaaaaguaagaa

SEQ ID NO: 4012031 - RNA, 14 nt, Human parainfluenza virus 1 strain Washington/1964
gaugagauggccaa

SEQ ID NO: 4012032 - RNA, 17 nt, Human parainfluenza virus 1 strain Washington/1964
gcaaucaaaaucaauau

SEQ ID NO: 4012033 - RNA, 23 nt, Human parainfluenza virus 1 strain Washington/1964
gcaaucaaaaucaauauccagag

SEQ ID NO: 4012034 - RNA, 19 nt, Human parainfluenza virus 1 strain Washington/1964
gcucuaggaggucaagagu

SEQ ID NO: 4012035 - RNA, 24 nt, Human parainfluenza virus 1 strain Washington/1964
gcuugaagaugccguucuacaaag

SEQ ID NO: 4012036 - RNA, 16 nt, Human parainfluenza virus 1 strain Washington/1964
ggacaauagaagccag

SEQ ID NO: 4012037 - RNA, 23 nt, Human parainfluenza virus 1 strain Washington/1964
guaccauuaaucaaauacagauc

SEQ ID NO: 4012038 - RNA, 12 nt, Human parainfluenza virus 1 strain Washington/1964
gucuucacaaaa

SEQ ID NO: 4012039 - RNA, 20 nt, Human parainfluenza virus 1 strain Washington/1964
guuaaaaucugcaaauuaca

SEQ ID NO: 4012040 - RNA, 18 nt, Human parainfluenza virus 1 strain Washington/1964
guuuaaagagaugaguua

SEQ ID NO: 4012041 - RNA, 20 nt, Human parainfluenza virus 1 strain Washington/1964
uaaacaugaaucuacaauuu

SEQ ID NO: 4012042 - RNA, 13 nt, Human parainfluenza virus 1 strain Washington/1964
uaaugacacccau

SEQ ID NO: 4012043 - RNA, 20 nt, Human parainfluenza virus 1 strain Washington/1964
uacauacaacaaucaaaucu

SEQ ID NO: 4012044 - RNA, 22 nt, Human parainfluenza virus 1 strain Washington/1964
uaccauuaaucaaauacagauc

SEQ ID NO: 4012045 - RNA, 15 nt, Human parainfluenza virus 1 strain Washington/1964
uacuuaaacaaauuc

SEQ ID NO: 4012046 - RNA, 23 nt, Human parainfluenza virus 1 strain Washington/1964
uacuuggacaauagaagccagau

SEQ ID NO: 4012047 - RNA, 12 nt, Human parainfluenza virus 1 strain Washington/1964
uauccagagcca

SEQ ID NO: 4012048 - RNA, 14 nt, Human parainfluenza virus 1 strain Washington/1964
uaugacaaauagaa

SEQ ID NO: 4012049 - RNA, 18 nt, Human parainfluenza virus 1 strain Washington/1964
ucaguucaaauaagaaaa

SEQ ID NO: 4012050 - RNA, 18 nt, Human parainfluenza virus 1 strain Washington/1964
ucauccagggaucuucac

SEQ ID NO: 4012051 - RNA, 23 nt, Human parainfluenza virus 1 strain Washington/1964
uccguccacugaaaaacacacuc

SEQ ID NO: 4012052 - RNA, 22 nt, Human parainfluenza virus 1 strain Washington/1964
ucuucacaaaagggaaagacaa

SEQ ID NO: 4012053 - RNA, 11 nt, Human parainfluenza virus 1 strain Washington/1964
ucuucacaaac

SEQ ID NO: 4012054 - RNA, 20 nt, Human parainfluenza virus 1 strain Washington/1964
ugaaaucacaacaugaauuu

SEQ ID NO: 4012055 - RNA, 19 nt, Human parainfluenza virus 1 strain Washington/1964
ugaagaugccguucuacaa

SEQ ID NO: 4012056 - RNA, 16 nt, Human parainfluenza virus 1 strain Washington/1964
ugacaaauagaauaag

SEQ ID NO: 4012057 - RNA, 21 nt, Human parainfluenza virus 1 strain Washington/1964
ugagccucaagcauccaaugc

SEQ ID NO: 4012058 - RNA, 22 nt, Human parainfluenza virus 1 strain Washington/1964
uggaagcucuaggaggucaaga

SEQ ID NO: 4012059 - RNA, 22 nt, Human parainfluenza virus 1 strain Washington/1964
ugugaaaaccagauaugaugua

SEQ ID NO: 4012060 - RNA, 20 nt, Human parainfluenza virus 1 strain Washington/1964
uucacaaaagggaaagacaa

SEQ ID NO: 4012061 - RNA, 15 nt, Human parainfluenza virus 1 strain Washington/1964
cagagccaacucaaa

SEQ ID NO: 4012062 - RNA, 18 nt, Human parainfluenza virus 1 strain Washington/1964
cagaucaaaaguaagaaa

SEQ ID NO: 4012063 - RNA, 14 nt, Human parainfluenza virus 1 strain Washington/1964
cagggaucuucaca

SEQ ID NO: 4012064 - RNA, 17 nt, Human parainfluenza virus 1 strain Washington/1964
cauuaaucaaauacaga

SEQ ID NO: 4012065 - RNA, 19 nt, Human parainfluenza virus 1 strain Washington/1964
ccaacacuauaucaauuau

SEQ ID NO: 4012066 - RNA, 19 nt, Human parainfluenza virus 1 strain Washington/1964
ccaacucaaaaagcucccu

SEQ ID NO: 4012067 - RNA, 13 nt, Human parainfluenza virus 1 strain Washington/1964
ccagaucaaaagu

SEQ ID NO: 4012068 - RNA, 20 nt, Human parainfluenza virus 1 strain Washington/1964
ccagaucaaaaguaagaaaa

SEQ ID NO: 4012069 - RNA, 22 nt, Human parainfluenza virus 1 strain Washington/1964
cccaacacuauaucaauuaugu

SEQ ID NO: 4012070 - RNA, 21 nt, Human parainfluenza virus 1 strain Washington/1964
ccucuaagcagaguagagaag

SEQ ID NO: 4012071 - RNA, 13 nt, Human parainfluenza virus 1 strain Washington/1964
cuacaauuucaac

SEQ ID NO: 4012072 - RNA, 13 nt, Human parainfluenza virus 1 strain Washington/1964
cuagaagaaaaca

SEQ ID NO: 4012073 - RNA, 16 nt, Human parainfluenza virus 1 strain Washington/1964
cugaaaaacacacucu

SEQ ID NO: 4012074 - RNA, 21 nt, Human parainfluenza virus 1 strain Washington/1964
gaaaucccuuuaacugacuca

SEQ ID NO: 4012075 - RNA, 17 nt, Human parainfluenza virus 1 strain Washington/1964
gaaucuacaauuucaac

SEQ ID NO: 4012076 - RNA, 21 nt, Human parainfluenza virus 1 strain Washington/1964
gaaucuacaauuucaaccagc

SEQ ID NO: 4012077 - RNA, 23 nt, Human parainfluenza virus 1 strain Washington/1964
gagccaacucaaaaagcucccuc

SEQ ID NO: 4012078 - RNA, 20 nt, Human parainfluenza virus 1 strain Washington/1964
gcauacauacaacaaucaaa

SEQ ID NO: 4012079 - RNA, 18 nt, Human parainfluenza virus 1 strain Washington/1964
ggacaauagaagccagau

SEQ ID NO: 4012080 - RNA, 17 nt, Human parainfluenza virus 1 strain Washington/1964
gucaaaaagacaagguu

SEQ ID NO: 4012081 - RNA, 16 nt, Human parainfluenza virus 1 strain Washington/1964
gugauacuacaagguc

SEQ ID NO: 4012082 - RNA, 19 nt, Human parainfluenza virus 1 strain Washington/1964
guguacaacaaguaagaaa

SEQ ID NO: 4012083 - RNA, 16 nt, Human parainfluenza virus 1 strain Washington/1964
uacaacaaucaaaucu

SEQ ID NO: 4012084 - RNA, 12 nt, Human parainfluenza virus 1 strain Washington/1964
uacaauuucaac

SEQ ID NO: 4012085 - RNA, 14 nt, Human parainfluenza virus 1 strain Washington/1964
uacaauuucaacca

SEQ ID NO: 4012086 - RNA, 22 nt, Human parainfluenza virus 1 strain Washington/1964
uaccaaaaagaacagaacucac

SEQ ID NO: 4012087 - RNA, 19 nt, Human parainfluenza virus 1 strain Washington/1964
uagaagccagaucaaaagu

SEQ ID NO: 4012088 - RNA, 13 nt, Human parainfluenza virus 1 strain Washington/1964
uauccagagccaa

SEQ ID NO: 4012089 - RNA, 21 nt, Human parainfluenza virus 1 strain Washington/1964
uauccagagccaacucaaaaa

SEQ ID NO: 4012090 - RNA, 21 nt, Human parainfluenza virus 1 strain Washington/1964
ucaaaucuauccacaacuuca

SEQ ID NO: 4012091 - RNA, 23 nt, Human parainfluenza virus 1 strain Washington/1964
ucagaacuccacaaaucaacaag

SEQ ID NO: 4012092 - RNA, 12 nt, Human parainfluenza virus 1 strain Washington/1964
ucagguguacaa

SEQ ID NO: 4012093 - RNA, 22 nt, Human parainfluenza virus 1 strain Washington/1964
ucauaaaaacauaguaagaaaa

SEQ ID NO: 4012094 - RNA, 19 nt, Human parainfluenza virus 1 strain Washington/1964
ucccucaaaacaauuaaga

SEQ ID NO: 4012095 - RNA, 20 nt, Human parainfluenza virus 1 strain Washington/1964
ucuaauuuguuuaaagagau

SEQ ID NO: 4012096 - RNA, 16 nt, Human parainfluenza virus 1 strain Washington/1964
ucugcacucacucaaa

SEQ ID NO: 4012097 - RNA, 14 nt, Human parainfluenza virus 1 strain Washington/1964
ucuucucaucuuua

SEQ ID NO: 4012098 - RNA, 18 nt, Human parainfluenza virus 1 strain Washington/1964
uggacaauagaagccaga

SEQ ID NO: 4012099 - RNA, 14 nt, Human parainfluenza virus 1 strain Washington/1964
uguagcauacauac

SEQ ID NO: 4012100 - RNA, 21 nt, Human parainfluenza virus 1 strain Washington/1964
uguagcauacauacaacaauc

SEQ ID NO: 4012101 - RNA, 15 nt, Human parainfluenza virus 1 strain Washington/1964
uuaugugaaaaccag

SEQ ID NO: 4012102 - RNA, 18 nt, Human parainfluenza virus 1 strain Washington/1964
uucacuaacuaacuaaac

SEQ ID NO: 4012103 - RNA, 17 nt, Human parainfluenza virus 1 strain Washington/1964
uuggacaauagaagcca

SEQ ID NO: 4012104 - RNA, 15 nt, Human parainfluenza virus 1 strain Washington/1964
uuuauaugacaaaua

SEQ ID NO: 4012105 - RNA, 12 nt, Human parainfluenza virus 1 strain Washington/1964
caaguaagaaaa

SEQ ID NO: 4012106 - RNA, 15 nt, Human parainfluenza virus 1 strain Washington/1964
caaucagguguacaa

SEQ ID NO: 4012107 - RNA, 20 nt, Human parainfluenza virus 1 strain Washington/1964
caauuaugugaaaaccagau

SEQ ID NO: 4012108 - RNA, 21 nt, Human parainfluenza virus 1 strain Washington/1964
caauuucaaccagcaaucaaa

SEQ ID NO: 4012109 - RNA, 13 nt, Human parainfluenza virus 1 strain Washington/1964
cagagccaacuca

SEQ ID NO: 4012110 - RNA, 23 nt, Human parainfluenza virus 1 strain Washington/1964
aaaaagcucccucaaaacaauua

SEQ ID NO: 4012111 - RNA, 18 nt, Human parainfluenza virus 1 strain Washington/1964
aaagcaugaauagacauu

SEQ ID NO: 4012112 - RNA, 17 nt, Human parainfluenza virus 1 strain Washington/1964
aaaguccaccaacuccc

SEQ ID NO: 4012113 - RNA, 14 nt, Human parainfluenza virus 1 strain Washington/1964
aacaaagcaugaau

SEQ ID NO: 4012114 - RNA, 22 nt, Human parainfluenza virus 1 strain Washington/1964
aacacuauaucaauuaugugaa

SEQ ID NO: 4012115 - RNA, 18 nt, Human parainfluenza virus 1 strain Washington/1964
aagaacgaagagucagca

SEQ ID NO: 4012116 - RNA, 15 nt, Human parainfluenza virus 1 strain Washington/1964
aauuaugugaaaacc

SEQ ID NO: 4012117 - RNA, 19 nt, Human parainfluenza virus 1 strain Washington/1964
aauuuaaaaacaaagcaug

SEQ ID NO: 4012118 - RNA, 17 nt, Human parainfluenza virus 1 strain Washington/1964
acaauuucaaccagcaa

SEQ ID NO: 4012119 - RNA, 22 nt, Human parainfluenza virus 1 strain Washington/1964
acuccucaauaaugacacccau

SEQ ID NO: 4012120 - RNA, 20 nt, Human parainfluenza virus 1 strain Washington/1964
acuucaccaaucagguguac

SEQ ID NO: 4012121 - RNA, 19 nt, Human parainfluenza virus 1 strain Washington/1964
agagccaacucaaaaagcu

SEQ ID NO: 4012122 - RNA, 20 nt, Human parainfluenza virus 1 strain Washington/1964
auacauacaacaaucaaauc

SEQ ID NO: 4012123 - RNA, 17 nt, Human parainfluenza virus 1 strain Washington/1964
auacuuggacaauagaa

SEQ ID NO: 4012124 - RNA, 21 nt, Human parainfluenza virus 1 strain Washington/1964
auagaagccagaucaaaagua

SEQ ID NO: 4012125 - RNA, 14 nt, Human parainfluenza virus 1 strain Washington/1964
auauaauuacagau

SEQ ID NO: 4012126 - RNA, 17 nt, Human parainfluenza virus 1 strain Washington/1964
auaucaauuaugugaaa

SEQ ID NO: 4012127 - RNA, 13 nt, Human parainfluenza virus 1 strain Washington/1964
auauccagagcca

SEQ ID NO: 4012128 - RNA, 15 nt, Human parainfluenza virus 1 strain Washington/1964
aucaauauccagagc

SEQ ID NO: 4012129 - RNA, 13 nt, Human parainfluenza virus 1 strain Washington/1964
aucagucuucaca

SEQ ID NO: 4012130 - RNA, 12 nt, Human parainfluenza virus 1 strain Washington/1964
auuaaucaaaua

SEQ ID NO: 4012131 - RNA, 14 nt, Human parainfluenza virus 1 strain Washington/1964
auuuauaugacaaa

SEQ ID NO: 4012132 - RNA, 16 nt, Human parainfluenza virus 1 strain Washington/1964
auuuauaugacaaaua

SEQ ID NO: 4012133 - RNA, 14 nt, Human parainfluenza virus 1 strain Washington/1964
caaaaagcucccuc

SEQ ID NO: 4012134 - RNA, 19 nt, Human parainfluenza virus 1 strain Washington/1964
caaaaucaauauccagagc

SEQ ID NO: 4012135 - RNA, 16 nt, Human parainfluenza virus 1 strain Washington/1964
caaagcaugaauagac

SEQ ID NO: 4012136 - RNA, 15 nt, Human parainfluenza virus 1 strain Washington/1964
caaaugaagaggaaa

SEQ ID NO: 4012137 - RNA, 13 nt, Human parainfluenza virus 1 strain Washington/1964
caagaggaaauaa

SEQ ID NO: 4012138 - RNA, 14 nt, Human parainfluenza virus 1 strain Washington/1964
caauagaagccaga

SEQ ID NO: 4012139 - RNA, 14 nt, Human parainfluenza virus 1 strain Washington/1964
caauauccagagcc

SEQ ID NO: 4012140 - RNA, 17 nt, Human parainfluenza virus 1 strain Washington/1964
cacuccucaauaaugac

SEQ ID NO: 4012141 - RNA, 20 nt, Human parainfluenza virus 1 strain Washington/1964
cagaucaaaaguaagaaaaa

SEQ ID NO: 4012142 - RNA, 16 nt, Human parainfluenza virus 1 strain Washington/1964
cagggaucuucacaaa

SEQ ID NO: 4012143 - RNA, 17 nt, Human parainfluenza virus 1 strain Washington/1964
caugaauagacauuuau

SEQ ID NO: 4012144 - RNA, 14 nt, Human parainfluenza virus 1 strain Washington/1964
cauuguagcauaca

SEQ ID NO: 4012145 - RNA, 18 nt, Human parainfluenza virus 1 strain Washington/1964
cauuguagcauacauaca

SEQ ID NO: 4012146 - RNA, 21 nt, Human parainfluenza virus 1 strain Washington/1964
ccaacucaaaaagcucccuca

SEQ ID NO: 4012147 - RNA, 16 nt, Human parainfluenza virus 1 strain Washington/1964
cccuuuaacugacuca

SEQ ID NO: 4012148 - RNA, 21 nt, Human parainfluenza virus 1 strain Washington/1964
ccucaauaaugacacccauua

SEQ ID NO: 4012149 - RNA, 15 nt, Human parainfluenza virus 1 strain Washington/1964
ccuuuaacugacuca

SEQ ID NO: 4012150 - RNA, 15 nt, Human parainfluenza virus 1 strain Washington/1964
cgguacuagaagaaa

SEQ ID NO: 4012151 - RNA, 18 nt, Human parainfluenza virus 1 strain Washington/1964
cuauaucaauuaugugaa

SEQ ID NO: 4012152 - RNA, 23 nt, Human parainfluenza virus 1 strain Washington/1964
cucaauaaugacacccauuagcu

SEQ ID NO: 4012153 - RNA, 21 nt, Human parainfluenza virus 1 strain Washington/1964
cucccucaaaacaauuaagaa

SEQ ID NO: 4012154 - RNA, 22 nt, Human parainfluenza virus 1 strain Washington/1964
cuccucaauaaugacacccauu

SEQ ID NO: 4012155 - RNA, 22 nt, Human parainfluenza virus 1 strain Washington/1964
cuucaccaaucagguguacaac

SEQ ID NO: 4012156 - RNA, 20 nt, Human parainfluenza virus 1 strain Washington/1964
gaagccagaucaaaaguaag

SEQ ID NO: 4012157 - RNA, 17 nt, Human parainfluenza virus 1 strain Washington/1964
gacaauagaagccagau

SEQ ID NO: 4012158 - RNA, 16 nt, Human parainfluenza virus 1 strain Washington/1964
gagagaugacaucaaa

SEQ ID NO: 4012159 - RNA, 19 nt, Human parainfluenza virus 1 strain Washington/1964
gagccaacucaaaaagcuc

SEQ ID NO: 4012160 - RNA, 22 nt, Human parainfluenza virus 1 strain Washington/1964
gagucagcagccacuccaaaga

SEQ ID NO: 4012161 - RNA, 17 nt, Human parainfluenza virus 1 strain Washington/1964
gauaagaaaucccuuua

SEQ ID NO: 4012162 - RNA, 14 nt, Human parainfluenza virus 1 strain Washington/1964
gauacuacaagguc

SEQ ID NO: 4012163 - RNA, 14 nt, Human parainfluenza virus 1 strain Washington/1964
gcaaucaaaaucaa

SEQ ID NO: 4012164 - RNA, 18 nt, Human parainfluenza virus 1 strain Washington/1964
ggucaaaaagacaagguu

SEQ ID NO: 4012165 - RNA, 15 nt, Human parainfluenza virus 1 strain Washington/1964
uaaaaucugcaaauu

SEQ ID NO: 4012166 - RNA, 13 nt, Human parainfluenza virus 1 strain Washington/1964
uaaagagaugagu

SEQ ID NO: 4012167 - RNA, 22 nt, Human parainfluenza virus 1 strain Washington/1964
uaacuaaacaugaaucuacaau

SEQ ID NO: 4012168 - RNA, 20 nt, Human parainfluenza virus 1 strain Washington/1964
uaccaaaaagaacagaacuc

SEQ ID NO: 4012169 - RNA, 17 nt, Human parainfluenza virus 1 strain Washington/1964
uagaagaaaacaacaau

SEQ ID NO: 4012170 - RNA, 16 nt, Human parainfluenza virus 1 strain Washington/1964
ucaaccagcaaucaaa

SEQ ID NO: 4012171 - RNA, 20 nt, Human parainfluenza virus 1 strain Washington/1964
aaaagcucccucaaaacaau

SEQ ID NO: 4012172 - RNA, 20 nt, Human parainfluenza virus 1 strain Washington/1964
aaaaucugcaaauuacaaag

SEQ ID NO: 4012173 - RNA, 12 nt, Human parainfluenza virus 1 strain Washington/1964
aagcucccucaa

SEQ ID NO: 4012174 - RNA, 17 nt, Human parainfluenza virus 1 strain Washington/1964
aaucaaaucuauccaca

SEQ ID NO: 4012175 - RNA, 14 nt, Human parainfluenza virus 1 strain Washington/1964
aaucaauauccaga

SEQ ID NO: 4012176 - RNA, 15 nt, Human parainfluenza virus 1 strain Washington/1964
aaucuacaauuucaa

SEQ ID NO: 4012177 - RNA, 22 nt, Human parainfluenza virus 1 strain Washington/1964
aaucuacaauuucaaccagcaa

SEQ ID NO: 4012178 - RNA, 15 nt, Human parainfluenza virus 1 strain Washington/1964
aauuucaaccagcaa

SEQ ID NO: 4012179 - RNA, 14 nt, Human parainfluenza virus 1 strain Washington/1964
acaacaaacaaugc

SEQ ID NO: 4012180 - RNA, 19 nt, Human parainfluenza virus 1 strain Washington/1964
acaacaaucaaaucuaucc

SEQ ID NO: 4012181 - RNA, 22 nt, Human parainfluenza virus 1 strain Washington/1964
acacuauaucaauuaugugaaa

SEQ ID NO: 4012182 - RNA, 20 nt, Human parainfluenza virus 1 strain Washington/1964
acaguccucuaagcagagua

SEQ ID NO: 4012183 - RNA, 19 nt, Human parainfluenza virus 1 strain Washington/1964
acucaaaaagcucccucaa

SEQ ID NO: 4012184 - RNA, 12 nt, Human parainfluenza virus 1 strain Washington/1964
acuccacaaauc

SEQ ID NO: 4012185 - RNA, 20 nt, Human parainfluenza virus 1 strain Washington/1964
agaacgaagagucagcagcc

SEQ ID NO: 4012186 - RNA, 16 nt, Human parainfluenza virus 1 strain Washington/1964
agacaauaaggucaaa

SEQ ID NO: 4012187 - RNA, 14 nt, Human parainfluenza virus 1 strain Washington/1964
agaucaaaaguaag

SEQ ID NO: 4012188 - RNA, 18 nt, Human parainfluenza virus 1 strain Washington/1964
agccagaucaaaaguaag

SEQ ID NO: 4012189 - RNA, 15 nt, Human parainfluenza virus 1 strain Washington/1964
aguugaaaaaucacu

SEQ ID NO: 4012190 - RNA, 21 nt, Human parainfluenza virus 1 strain Washington/1964
aucaaaucuauccacaacuuc

SEQ ID NO: 4012191 - RNA, 14 nt, Human parainfluenza virus 1 strain Washington/1964
auccagagccaacu

SEQ ID NO: 4012192 - RNA, 20 nt, Human parainfluenza virus 1 strain Washington/1964
aucguaccauuaaucaaaua

SEQ ID NO: 4012193 - RNA, 14 nt, Human parainfluenza virus 1 strain Washington/1964
augagccucaagca

SEQ ID NO: 4012194 - RNA, 13 nt, Human parainfluenza virus 1 strain Washington/1964
auuucaaccagca

SEQ ID NO: 4012195 - RNA, 16 nt, Human parainfluenza virus 1 strain Washington/1964
caaaaagcucccucaa

SEQ ID NO: 4012196 - RNA, 21 nt, Human parainfluenza virus 1 strain Washington/1964
caaagcaugaauagacauuua

SEQ ID NO: 4012197 - RNA, 17 nt, Human parainfluenza virus 1 strain Washington/1964
caaccagcaaucaaaau

SEQ ID NO: 4012198 - RNA, 17 nt, Human parainfluenza virus 1 strain Washington/1964
caauauccagagccaac

SEQ ID NO: 4012199 - RNA, 15 nt, Human parainfluenza virus 1 strain Washington/1964
caaucaaaaucaaua

SEQ ID NO: 4012200 - RNA, 18 nt, Human parainfluenza virus 1 strain Washington/1964
caauuucaaccagcaauc

SEQ ID NO: 4012201 - RNA, 21 nt, Human parainfluenza virus 1 strain Washington/1964
cagagccaacucaaaaagcuc

SEQ ID NO: 4012202 - RNA, 12 nt, Human parainfluenza virus 1 strain Washington/1964
caugaauagaca

SEQ ID NO: 4012203 - RNA, 20 nt, Human parainfluenza virus 1 strain Washington/1964
ccaagagguuaaaaauguaa

SEQ ID NO: 4012204 - RNA, 17 nt, Human parainfluenza virus 1 strain Washington/1964
ccagcaaucaaaaucaa

SEQ ID NO: 4012205 - RNA, 19 nt, Human parainfluenza virus 1 strain Washington/1964
cgacgcaaccgcaaaugaa

SEQ ID NO: 4012206 - RNA, 16 nt, Human parainfluenza virus 1 strain Washington/1964
cuaaaucguaccauua

SEQ ID NO: 4012207 - RNA, 18 nt, Human parainfluenza virus 1 strain Washington/1964
cucaaaacaauuaagaaa

SEQ ID NO: 4012208 - RNA, 17 nt, Human parainfluenza virus 1 strain Washington/1964
aaaacaaagcaugaaua

SEQ ID NO: 4012209 - RNA, 13 nt, Human parainfluenza virus 1 strain Washington/1964
aaacaauuaagaa

SEQ ID NO: 4012210 - RNA, 21 nt, Human parainfluenza virus 1 strain Washington/1964
aaaccagauaugauguauaaa

SEQ ID NO: 4012211 - RNA, 17 nt, Human parainfluenza virus 1 strain Washington/1964
aaccagcaaucaaaauc

SEQ ID NO: 4012212 - RNA, 18 nt, Human parainfluenza virus 1 strain Washington/1964
aaccagcaaucaaaauca

SEQ ID NO: 4012213 - RNA, 19 nt, Human parainfluenza virus 1 strain Washington/1964
aagaugccguucuacaaag

SEQ ID NO: 4012214 - RNA, 17 nt, Human parainfluenza virus 1 strain Washington/1964
aaucacuugagaauaaa

SEQ ID NO: 4012215 - RNA, 15 nt, Human parainfluenza virus 1 strain Washington/1964
aaucaguucaaauaa

SEQ ID NO: 4012216 - RNA, 21 nt, Human parainfluenza virus 1 strain Washington/1964
aauucgauacaaucaguucaa

SEQ ID NO: 4012217 - RNA, 16 nt, Human parainfluenza virus 1 strain Washington/1964
acaauagaagccagau

SEQ ID NO: 4012218 - RNA, 19 nt, Human parainfluenza virus 1 strain Washington/1964
acaauuucaaccagcaauc

SEQ ID NO: 4012219 - RNA, 20 nt, Human parainfluenza virus 1 strain Washington/1964
acuauaucaauuaugugaaa

SEQ ID NO: 4012220 - RNA, 21 nt, Human parainfluenza virus 1 strain Washington/1964
acuccucaauaaugacaccca

SEQ ID NO: 4012221 - RNA, 23 nt, Human parainfluenza virus 1 strain Washington/1964
acuuaaacaaauucaagaggaaa

SEQ ID NO: 4012222 - RNA, 18 nt, Human parainfluenza virus 1 strain Washington/1964
acuugauaagagaggaug

SEQ ID NO: 4012223 - RNA, 15 nt, Human parainfluenza virus 1 strain Washington/1964
agaagccagaucaaa

SEQ ID NO: 4012224 - RNA, 21 nt, Human parainfluenza virus 1 strain Washington/1964
agaaggcuuacaucaaauccc

SEQ ID NO: 4012225 - RNA, 19 nt, Human parainfluenza virus 1 strain Washington/1964
agaugaguuaacaagauaa

SEQ ID NO: 4012226 - RNA, 17 nt, Human parainfluenza virus 1 strain Washington/1964
agccagaucaaaaguaa

SEQ ID NO: 4012227 - RNA, 17 nt, Human parainfluenza virus 1 strain Washington/1964
agugauacuacaagguc

SEQ ID NO: 4012228 - RNA, 23 nt, Human parainfluenza virus 1 strain Washington/1964
auacuuggacaauagaagccaga

SEQ ID NO: 4012229 - RNA, 14 nt, Human parainfluenza virus 1 strain Washington/1964
aucaaaaucaauau

SEQ ID NO: 4012230 - RNA, 19 nt, Human parainfluenza virus 1 strain Washington/1964
aucaaguacauuguagcau

SEQ ID NO: 4012231 - RNA, 23 nt, Human parainfluenza virus 1 strain Washington/1964
aucuacaauuucaaccagcaauc

SEQ ID NO: 4012232 - RNA, 17 nt, Human parainfluenza virus 1 strain Washington/1964
augacaaauagaauaag

SEQ ID NO: 4012233 - RNA, 22 nt, Human parainfluenza virus 1 strain Washington/1964
auuaucuaauuuguuuaaagag

SEQ ID NO: 4012234 - RNA, 13 nt, Human parainfluenza virus 1 strain Washington/1964
caaauagaauaag

SEQ ID NO: 4012235 - RNA, 22 nt, Human parainfluenza virus 1 strain Washington/1964
caacaaucaaaucuauccacaa

SEQ ID NO: 4012236 - RNA, 14 nt, Human parainfluenza virus 1 strain Washington/1964
caacucaaaaagcu

SEQ ID NO: 4012237 - RNA, 18 nt, Human parainfluenza virus 1 strain Washington/1964
caacucaaaaagcucccu

SEQ ID NO: 4012238 - RNA, 19 nt, Human parainfluenza virus 1 strain Washington/1964
caacucaaaaagcucccuc

SEQ ID NO: 4012239 - RNA, 22 nt, Human parainfluenza virus 1 strain Washington/1964
uugagaauaaaguagaagaaaa

SEQ ID NO: 4012240 - RNA, 13 nt, Human parainfluenza virus 1 strain Washington/1964
cucaucuuuauua

SEQ ID NO: 4012241 - RNA, 19 nt, Human parainfluenza virus 1 strain Washington/1964
cuuaaacaaauucaagagg

SEQ ID NO: 4012242 - RNA, 22 nt, Human parainfluenza virus 1 strain Washington/1964
cuugagaauaaaguagaagaaa

SEQ ID NO: 4012243 - RNA, 19 nt, Human parainfluenza virus 1 strain Washington/1964
cuuggacaauagaagccag

SEQ ID NO: 4012244 - RNA, 13 nt, Human parainfluenza virus 1 strain Washington/1964
gagccaacucaaa

SEQ ID NO: 4012245 - RNA, 22 nt, Human parainfluenza virus 1 strain Washington/1964
gagccaacucaaaaagcucccu

SEQ ID NO: 4012246 - RNA, 24 nt, Human parainfluenza virus 1 strain Washington/1964
gagccaacucaaaaagcucccuca

SEQ ID NO: 4012247 - RNA, 22 nt, Human parainfluenza virus 1 strain Washington/1964
gauacuuggacaauagaagcca

SEQ ID NO: 4012248 - RNA, 20 nt, Human parainfluenza virus 1 strain Washington/1964
gaucaagacccaacacuaua

SEQ ID NO: 4012249 - RNA, 20 nt, Human parainfluenza virus 1 strain Washington/1964
gccagaucaaaaguaagaaa

SEQ ID NO: 4012250 - RNA, 17 nt, Human parainfluenza virus 1 strain Washington/1964
ggacaauagaagccaga

SEQ ID NO: 4012251 - RNA, 21 nt, Human parainfluenza virus 1 strain Washington/1964
ggacaauagaagccagaucaa

SEQ ID NO: 4012252 - RNA, 18 nt, Human parainfluenza virus 1 strain Washington/1964
gucaccaucagucuucac

SEQ ID NO: 4012253 - RNA, 23 nt, Human parainfluenza virus 1 strain Washington/1964
guuaaaaucugcaaauuacaaag

SEQ ID NO: 4012254 - RNA, 16 nt, Human parainfluenza virus 1 strain Washington/1964
guuuaaagagaugagu

SEQ ID NO: 4012255 - RNA, 21 nt, Human parainfluenza virus 1 strain Washington/1964
uaaugacacccauuagcucua

SEQ ID NO: 4012256 - RNA, 14 nt, Human parainfluenza virus 1 strain Washington/1964
uacaaagaaaugac

SEQ ID NO: 4012257 - RNA, 21 nt, Human parainfluenza virus 1 strain Washington/1964
uaccaacccaaguccagagcu

SEQ ID NO: 4012258 - RNA, 20 nt, Human parainfluenza virus 1 strain Washington/1964
uaccauuaaucaaauacaga

SEQ ID NO: 4012259 - RNA, 21 nt, Human parainfluenza virus 1 strain Washington/1964
ucaaaaucaauauccagagcc

SEQ ID NO: 4012260 - RNA, 13 nt, Human parainfluenza virus 1 strain Washington/1964
ucaagaguucaag

SEQ ID NO: 4012261 - RNA, 16 nt, Human parainfluenza virus 1 strain Washington/1964
ucaauaaugacaccca

SEQ ID NO: 4012262 - RNA, 16 nt, Human parainfluenza virus 1 strain Washington/1964
ucaauauccagagcca

SEQ ID NO: 4012263 - RNA, 22 nt, Human parainfluenza virus 1 strain Washington/1964
ucagcagccacuccaaagaaca

SEQ ID NO: 4012264 - RNA, 15 nt, Human parainfluenza virus 1 strain Washington/1964
uccacaacuucacca

SEQ ID NO: 4012265 - RNA, 14 nt, Human parainfluenza virus 1 strain Washington/1964
uccagagccaacuc

SEQ ID NO: 4012266 - RNA, 22 nt, Human parainfluenza virus 1 strain Washington/1964
ucccucaaaacaauuaagaaaa

SEQ ID NO: 4012267 - RNA, 14 nt, Human parainfluenza virus 1 strain Washington/1964
ucuauccacacucc

SEQ ID NO: 4012268 - RNA, 12 nt, Human parainfluenza virus 1 strain Washington/1964
ugaaucuacaau

SEQ ID NO: 4012269 - RNA, 10 nt, Human parainfluenza virus 1 strain Washington/1964
ugauggccaa

SEQ ID NO: 4012270 - RNA, 14 nt, Human parainfluenza virus 1 strain Washington/1964
uuaaucaaauacag

SEQ ID NO: 4012271 - RNA, 21 nt, Human parainfluenza virus 1 strain Washington/1964
uucaaccagcaaucaaaauca

SEQ ID NO: 4012272 - RNA, 21 nt, Human parainfluenza virus 1 strain Washington/1964
uuuaaaaacaaagcaugaaua

SEQ ID NO: 4012273 - RNA, 12 nt, Human parainfluenza virus 1 strain Washington/1964
ucaaguacauug

SEQ ID NO: 4012274 - RNA, 17 nt, Human parainfluenza virus 1 strain Washington/1964
ucaauauccagagccaa

SEQ ID NO: 4012275 - RNA, 16 nt, Human parainfluenza virus 1 strain Washington/1964
ucacuugagaauaaag

SEQ ID NO: 4012276 - RNA, 17 nt, Human parainfluenza virus 1 strain Washington/1964
ucagcagccacuccaaa

SEQ ID NO: 4012277 - RNA, 12 nt, Human parainfluenza virus 1 strain Washington/1964
ucgauacaauca

SEQ ID NO: 4012278 - RNA, 20 nt, Human parainfluenza virus 1 strain Washington/1964
ucggaauaccaaaaagaaca

SEQ ID NO: 4012279 - RNA, 13 nt, Human parainfluenza virus 1 strain Washington/1964
ucuacaauuucaa

SEQ ID NO: 4012280 - RNA, 15 nt, Human parainfluenza virus 1 strain Washington/1964
ucugcaaauuacaaa

SEQ ID NO: 4012281 - RNA, 20 nt, Human parainfluenza virus 1 strain Washington/1964
ugagagaugacaucaaaaau

SEQ ID NO: 4012282 - RNA, 18 nt, Human parainfluenza virus 1 strain Washington/1964
ugaguuaacaagauaaga

SEQ ID NO: 4012283 - RNA, 21 nt, Human parainfluenza virus 1 strain Washington/1964
ugaguuaacaagauaagaaau

SEQ ID NO: 4012284 - RNA, 12 nt, Human parainfluenza virus 1 strain Washington/1964
ugauacuacaag

SEQ ID NO: 4012285 - RNA, 16 nt, Human parainfluenza virus 1 strain Washington/1964
uggacaauagaagcca

SEQ ID NO: 4012286 - RNA, 14 nt, Human parainfluenza virus 1 strain Washington/1964
uguaaugaaaucac

SEQ ID NO: 4012287 - RNA, 15 nt, Human parainfluenza virus 1 strain Washington/1964
uguaaugaaaucaca

SEQ ID NO: 4012288 - RNA, 19 nt, Human parainfluenza virus 2
aaaaauuaacauuaagccu

SEQ ID NO: 4012289 - RNA, 19 nt, Human parainfluenza virus 2
aaaggcucucuaucuuaug

SEQ ID NO: 4012290 - RNA, 14 nt, Human parainfluenza virus 2
aaaugaaaugacua

SEQ ID NO: 4012291 - RNA, 14 nt, Human parainfluenza virus 2
acaagagacacuca

SEQ ID NO: 4012292 - RNA, 19 nt, Human parainfluenza virus 2
acaaugauuauaagaacuc

SEQ ID NO: 4012293 - RNA, 17 nt, Human parainfluenza virus 2
acacacucauccagaca

SEQ ID NO: 4012294 - RNA, 22 nt, Human parainfluenza virus 2
acaccaagaaacaaccacagcc

SEQ ID NO: 4012295 - RNA, 13 nt, Human parainfluenza virus 2
acacucauccaga

SEQ ID NO: 4012296 - RNA, 10 nt, Human parainfluenza virus 2
agaacucaug

SEQ ID NO: 4012297 - RNA, 17 nt, Human parainfluenza virus 2
agacuccauccauccaa

SEQ ID NO: 4012298 - RNA, 13 nt, Human parainfluenza virus 2
agcguaguacaau

SEQ ID NO: 4012299 - RNA, 17 nt, Human parainfluenza virus 2
aggcgaguguugcaacu

SEQ ID NO: 4012300 - RNA, 11 nt, Human parainfluenza virus 2
aggcuggacau

SEQ ID NO: 4012301 - RNA, 15 nt, Human parainfluenza virus 2
aguacaauuuaagaa

SEQ ID NO: 4012302 - RNA, 15 nt, Human parainfluenza virus 2
aguuuuauuuaagaa

SEQ ID NO: 4012303 - RNA, 19 nt, Human parainfluenza virus 2
auaguuuuauuuaagaaaa

SEQ ID NO: 4012304 - RNA, 20 nt, Human parainfluenza virus 2
auauaaaaugaggugcaguc

SEQ ID NO: 4012305 - RNA, 18 nt, Human parainfluenza virus 2
aucaaucuuaaaaaugaa

SEQ ID NO: 4012306 - RNA, 14 nt, Human parainfluenza virus 2
augcagcuugcaaa

SEQ ID NO: 4012307 - RNA, 20 nt, Human parainfluenza virus 2
augcagcuugcaaaugacug

SEQ ID NO: 4012308 - RNA, 11 nt, Human parainfluenza virus 2
auguuaucaua

SEQ ID NO: 4012309 - RNA, 18 nt, Human parainfluenza virus 2
auuuucucaucauuuacu

SEQ ID NO: 4012310 - RNA, 15 nt, Human parainfluenza virus 2
caacaccaagaaaca

SEQ ID NO: 4012311 - RNA, 15 nt, Human parainfluenza virus 2
caacaccucacauca

SEQ ID NO: 4012312 - RNA, 21 nt, Human parainfluenza virus 2
caaccaaaagacccaaacaac

SEQ ID NO: 4012313 - RNA, 23 nt, Human parainfluenza virus 2
caacuaguggaggcuucacagcc

SEQ ID NO: 4012314 - RNA, 14 nt, Human parainfluenza virus 2
caacuucugcaacu

SEQ ID NO: 4012315 - RNA, 17 nt, Human parainfluenza virus 2
caagaaacaaccacagc

SEQ ID NO: 4012316 - RNA, 10 nt, Human parainfluenza virus 2
cacucagaga

SEQ ID NO: 4012317 - RNA, 20 nt, Human parainfluenza virus 2
cagauaccaagacugaguuc

SEQ ID NO: 4012318 - RNA, 15 nt, Human parainfluenza virus 2
cagccgaaccaugcu

SEQ ID NO: 4012319 - RNA, 13 nt, Human parainfluenza virus 2
caugauaguuuua

SEQ ID NO: 4012320 - RNA, 12 nt, Human parainfluenza virus 2
ccaaacaacacc

SEQ ID NO: 4012321 - RNA, 21 nt, Human parainfluenza virus 2
ccacagccgaaccaugcucaa

SEQ ID NO: 4012322 - RNA, 15 nt, Human parainfluenza virus 2
ccagauauacacauc

SEQ ID NO: 4012323 - RNA, 15 nt, Human parainfluenza virus 2
cggaaacaauucucu

SEQ ID NO: 4012324 - RNA, 19 nt, Human parainfluenza virus 2
cguaguacaauuuaagaaa

SEQ ID NO: 4012325 - RNA, 14 nt, Human parainfluenza virus 2
gcugccacucacac

SEQ ID NO: 4012326 - RNA, 13 nt, Human parainfluenza virus 2
guccgaacugauc

SEQ ID NO: 4012327 - RNA, 14 nt, Human parainfluenza virus 2
uaacgaaauuaaac

SEQ ID NO: 4012328 - RNA, 20 nt, Human parainfluenza virus 2
uaagauucaggcagcaacca

SEQ ID NO: 4012329 - RNA, 20 nt, Human parainfluenza virus 2
uacuacuagucacuauacaa

SEQ ID NO: 4012330 - RNA, 18 nt, Human parainfluenza virus 2
uaucuuaugcaauaguua

SEQ ID NO: 4012331 - RNA, 19 nt, Human parainfluenza virus 2
uauugaaugaagacuccag

SEQ ID NO: 4012332 - RNA, 21 nt, Human parainfluenza virus 2
uccaaucaagauccagacucc

SEQ ID NO: 4012333 - RNA, 13 nt, Human parainfluenza virus 2
uccauccauccaa

SEQ ID NO: 4012334 - RNA, 18 nt, Human parainfluenza virus 2
ugauuauaagaacucaug

SEQ ID NO: 4012335 - RNA, 15 nt, Human parainfluenza virus 2
ugcauccaaucaaga

SEQ ID NO: 4012336 - RNA, 19 nt, Human parainfluenza virus 2
uugucaacaccaagaaaca

SEQ ID NO: 4012337 - RNA, 17 nt, Human parainfluenza virus 2
aaagaguuuacacaaug

SEQ ID NO: 4012338 - RNA, 23 nt, Human parainfluenza virus 2
aacaccaagaaacaaccacagcc

SEQ ID NO: 4012339 - RNA, 22 nt, Human parainfluenza virus 2
aagaacucaugauaguuuuauu

SEQ ID NO: 4012340 - RNA, 13 nt, Human parainfluenza virus 2
acaucaauagaag

SEQ ID NO: 4012341 - RNA, 17 nt, Human parainfluenza virus 2
accacagaaucacagcu

SEQ ID NO: 4012342 - RNA, 21 nt, Human parainfluenza virus 2
acuaagauucaggcagcaacc

SEQ ID NO: 4012343 - RNA, 21 nt, Human parainfluenza virus 2
acuaguggaggcuucacagcc

SEQ ID NO: 4012344 - RNA, 14 nt, Human parainfluenza virus 2
acucaugauaguuu

SEQ ID NO: 4012345 - RNA, 16 nt, Human parainfluenza virus 2
acucaugauaguuuua

SEQ ID NO: 4012346 - RNA, 15 nt, Human parainfluenza virus 2
acuuagguucaauuu

SEQ ID NO: 4012347 - RNA, 13 nt, Human parainfluenza virus 2
agaaggcuggaca

SEQ ID NO: 4012348 - RNA, 14 nt, Human parainfluenza virus 2
agaaggcuggacau

SEQ ID NO: 4012349 - RNA, 17 nt, Human parainfluenza virus 2
agccugaauccaagaaa

SEQ ID NO: 4012350 - RNA, 16 nt, Human parainfluenza virus 2
aguauaauaguuuaaa

SEQ ID NO: 4012351 - RNA, 12 nt, Human parainfluenza virus 2
auaaucaacaau

SEQ ID NO: 4012352 - RNA, 11 nt, Human parainfluenza virus 2
aucacucagag

SEQ ID NO: 4012353 - RNA, 14 nt, Human parainfluenza virus 2
auuagaauguuaua

SEQ ID NO: 4012354 - RNA, 22 nt, Human parainfluenza virus 2
auuuacuguuguaauucaaucu

SEQ ID NO: 4012355 - RNA, 20 nt, Human parainfluenza virus 2
caagagacacucaacaugca

SEQ ID NO: 4012356 - RNA, 15 nt, Human parainfluenza virus 2
caaucaagucauacu

SEQ ID NO: 4012357 - RNA, 19 nt, Human parainfluenza virus 2
caaugauuauaagaacuca

SEQ ID NO: 4012358 - RNA, 15 nt, Human parainfluenza virus 2
cacagaaucacagcu

SEQ ID NO: 4012359 - RNA, 18 nt, Human parainfluenza virus 2
cagcaucugagaauagaa

SEQ ID NO: 4012360 - RNA, 17 nt, Human parainfluenza virus 2
cagccgaaccaugcuca

SEQ ID NO: 4012361 - RNA, 12 nt, Human parainfluenza virus 2
cauaugaagcaa

SEQ ID NO: 4012362 - RNA, 17 nt, Human parainfluenza virus 2
cauccacaucacucaga

SEQ ID NO: 4012363 - RNA, 20 nt, Human parainfluenza virus 2
ccaaaagacccaaacaacac

SEQ ID NO: 4012364 - RNA, 21 nt, Human parainfluenza virus 2
ccaagaaagauuuaacaggca

SEQ ID NO: 4012365 - RNA, 18 nt, Human parainfluenza virus 2
ccaaucaagauccagacu

SEQ ID NO: 4012366 - RNA, 16 nt, Human parainfluenza virus 2
ccacaauugucaacac

SEQ ID NO: 4012367 - RNA, 19 nt, Human parainfluenza virus 2
ccacagaaucacagcuuaa

SEQ ID NO: 4012368 - RNA, 23 nt, Human parainfluenza virus 2
ccacucacacacucauccagaca

SEQ ID NO: 4012369 - RNA, 23 nt, Human parainfluenza virus 2
ccagacuccauccauccaaaaac

SEQ ID NO: 4012370 - RNA, 13 nt, Human parainfluenza virus 2
ccauaugaagcaa

SEQ ID NO: 4012371 - RNA, 16 nt, Human parainfluenza virus 2
cuagucacuauacaau

SEQ ID NO: 4012372 - RNA, 18 nt, Human parainfluenza virus 2
cuccauccauccaaaaac

SEQ ID NO: 4012373 - RNA, 17 nt, Human parainfluenza virus 2
cugcaauauaaaaugag

SEQ ID NO: 4012374 - RNA, 21 nt, Human parainfluenza virus 2
gaaagccugaauccaagaaag

SEQ ID NO: 4012375 - RNA, 13 nt, Human parainfluenza virus 2
gacucacaucauu

SEQ ID NO: 4012376 - RNA, 16 nt, Human parainfluenza virus 2
gauuauaagaacucau

SEQ ID NO: 4012377 - RNA, 20 nt, Human parainfluenza virus 2
gcuggacaugauaaauuuaa

SEQ ID NO: 4012378 - RNA, 15 nt, Human parainfluenza virus 2
ggcagcaaccacaga

SEQ ID NO: 4012379 - RNA, 15 nt, Human parainfluenza virus 2
gucaacaccaagaaa

SEQ ID NO: 4012380 - RNA, 20 nt, Human parainfluenza virus 2
gucacacaagagacacucaa

SEQ ID NO: 4012381 - RNA, 20 nt, Human parainfluenza virus 2
guccgaacugaucaaucuaa

SEQ ID NO: 4012382 - RNA, 15 nt, Human parainfluenza virus 2
uacacaauguuccag

SEQ ID NO: 4012383 - RNA, 20 nt, Human parainfluenza virus 2
uacaccaacuaaugucccug

SEQ ID NO: 4012384 - RNA, 14 nt, Human parainfluenza virus 2
uauaucucuuagaa

SEQ ID NO: 4012385 - RNA, 20 nt, Human parainfluenza virus 2
uaugauaacaacaauuaaaa

SEQ ID NO: 4012386 - RNA, 17 nt, Human parainfluenza virus 2
ucaaacuagacucacau

SEQ ID NO: 4012387 - RNA, 21 nt, Human parainfluenza virus 2
ucaacaugcauccaaucaaga

SEQ ID NO: 4012388 - RNA, 13 nt, Human parainfluenza virus 2
ucauacaaccaga

SEQ ID NO: 4012389 - RNA, 17 nt, Human parainfluenza virus 2
ucucaucauuuacuguu

SEQ ID NO: 4012390 - RNA, 16 nt, Human parainfluenza virus 2
ugauuauuaugugaua

SEQ ID NO: 4012391 - RNA, 19 nt, Human parainfluenza virus 2
ugcagucacacaagagaca

SEQ ID NO: 4012392 - RNA, 14 nt, Human parainfluenza virus 2
uguuguaauucaau

SEQ ID NO: 4012393 - RNA, 19 nt, Human parainfluenza virus 2
uuaacaggcauaaaacuaa

SEQ ID NO: 4012394 - RNA, 13 nt, Human parainfluenza virus 2
uuaacgaaauuaa

SEQ ID NO: 4012395 - RNA, 13 nt, Human parainfluenza virus 2
uuauuuaagaaaa

SEQ ID NO: 4012396 - RNA, 20 nt, Human parainfluenza virus 2
aacaaugauuauaagaacuc

SEQ ID NO: 4012397 - RNA, 18 nt, Human parainfluenza virus 2
aagguaugauaacaacaa

SEQ ID NO: 4012398 - RNA, 18 nt, Human parainfluenza virus 2
aaucaaacuagacucaca

SEQ ID NO: 4012399 - RNA, 21 nt, Human parainfluenza virus 2
aauuuucucaucauuuacugu

SEQ ID NO: 4012400 - RNA, 13 nt, Human parainfluenza virus 2
acauuaagccucc

SEQ ID NO: 4012401 - RNA, 17 nt, Human parainfluenza virus 2
acucaacaugcauccaa

SEQ ID NO: 4012402 - RNA, 15 nt, Human parainfluenza virus 2
agagauacagcugcc

SEQ ID NO: 4012403 - RNA, 19 nt, Human parainfluenza virus 2
agauaaaauucuugcaacu

SEQ ID NO: 4012404 - RNA, 15 nt, Human parainfluenza virus 2
agauacagcugccac

SEQ ID NO: 4012405 - RNA, 15 nt, Human parainfluenza virus 2
agauaccaaugaaua

SEQ ID NO: 4012406 - RNA, 13 nt, Human parainfluenza virus 2
aggcuucacagcc

SEQ ID NO: 4012407 - RNA, 23 nt, Human parainfluenza virus 2
auaauaguuuaaaaauuaacauu

SEQ ID NO: 4012408 - RNA, 13 nt, Human parainfluenza virus 2
auacacauccaca

SEQ ID NO: 4012409 - RNA, 13 nt, Human parainfluenza virus 2
auccagacaaauc

SEQ ID NO: 4012410 - RNA, 19 nt, Human parainfluenza virus 2
augauaguuuuauuuaaga

SEQ ID NO: 4012411 - RNA, 15 nt, Human parainfluenza virus 2
auuauaagaacucau

SEQ ID NO: 4012412 - RNA, 18 nt, Human parainfluenza virus 2
auuauaagaacucaugau

SEQ ID NO: 4012413 - RNA, 23 nt, Human parainfluenza virus 2
auucaggcagcaaccacagaauc

SEQ ID NO: 4012414 - RNA, 19 nt, Human parainfluenza virus 2
auucuugcaacuucugcaa

SEQ ID NO: 4012415 - RNA, 13 nt, Human parainfluenza virus 2
caacaccaagaaa

SEQ ID NO: 4012416 - RNA, 15 nt, Human parainfluenza virus 2
caauuuuagucaacu

SEQ ID NO: 4012417 - RNA, 18 nt, Human parainfluenza virus 2
cacaauugucaacaccaa

SEQ ID NO: 4012418 - RNA, 21 nt, Human parainfluenza virus 2
cacagccgaaccaugcucaac

SEQ ID NO: 4012419 - RNA, 15 nt, Human parainfluenza virus 2
cacauccacaucacu

SEQ ID NO: 4012420 - RNA, 21 nt, Human parainfluenza virus 2
caccaagaaacaaccacagcc

SEQ ID NO: 4012421 - RNA, 19 nt, Human parainfluenza virus 2
cacucagagauacagcugc

SEQ ID NO: 4012422 - RNA, 23 nt, Human parainfluenza virus 2
cacucagagauacagcugccacu

SEQ ID NO: 4012423 - RNA, 13 nt, Human parainfluenza virus 2
cagacuccaucca

SEQ ID NO: 4012424 - RNA, 17 nt, Human parainfluenza virus 2
cagcugccacucacaca

SEQ ID NO: 4012425 - RNA, 17 nt, Human parainfluenza virus 2
cauccauccaaaaacac

SEQ ID NO: 4012426 - RNA, 15 nt, Human parainfluenza virus 2
caugauaaauuuaau

SEQ ID NO: 4012427 - RNA, 22 nt, Human parainfluenza virus 2
caugauaguuuuauuuaagaaa

SEQ ID NO: 4012428 - RNA, 18 nt, Human parainfluenza virus 2
aagaacucaugauaguuu

SEQ ID NO: 4012429 - RNA, 21 nt, Human parainfluenza virus 2
acaaugauuauaagaacucau

SEQ ID NO: 4012430 - RNA, 12 nt, Human parainfluenza virus 2
acaccaagaaac

SEQ ID NO: 4012431 - RNA, 12 nt, Human parainfluenza virus 2
acucaacaugca

SEQ ID NO: 4012432 - RNA, 15 nt, Human parainfluenza virus 2
agaaccaacuuccaa

SEQ ID NO: 4012433 - RNA, 16 nt, Human parainfluenza virus 2
agaaggcuggacauga

SEQ ID NO: 4012434 - RNA, 13 nt, Human parainfluenza virus 2
agacucacaucau

SEQ ID NO: 4012435 - RNA, 18 nt, Human parainfluenza virus 2
auacagcugccacucaca

SEQ ID NO: 4012436 - RNA, 14 nt, Human parainfluenza virus 2
auacgcucugcaau

SEQ ID NO: 4012437 - RNA, 18 nt, Human parainfluenza virus 2
auagaaggcuggacauga

SEQ ID NO: 4012438 - RNA, 15 nt, Human parainfluenza virus 2
aucaagauccagacu

SEQ ID NO: 4012439 - RNA, 16 nt, Human parainfluenza virus 2
auuauaagaacucaug

SEQ ID NO: 4012440 - RNA, 17 nt, Human parainfluenza virus 2
auuauaagaacucauga

SEQ ID NO: 4012441 - RNA, 17 nt, Human parainfluenza virus 2
caaaagacccaaacaac

SEQ ID NO: 4012442 - RNA, 16 nt, Human parainfluenza virus 2
caaacuagacucacau

SEQ ID NO: 4012443 - RNA, 17 nt, Human parainfluenza virus 2
caacaccaagaaacaac

SEQ ID NO: 4012444 - RNA, 19 nt, Human parainfluenza virus 2
caaggcgaguguugcaacu

SEQ ID NO: 4012445 - RNA, 19 nt, Human parainfluenza virus 2
caaugucauacaaccagau

SEQ ID NO: 4012446 - RNA, 21 nt, Human parainfluenza virus 2
cacucacacacucauccagac

SEQ ID NO: 4012447 - RNA, 20 nt, Human parainfluenza virus 2
cacucucaucaacaaaaagg

SEQ ID NO: 4012448 - RNA, 19 nt, Human parainfluenza virus 2
caggcagcaaccacagaau

SEQ ID NO: 4012449 - RNA, 17 nt, Human parainfluenza virus 2
cagucacacaagagaca

SEQ ID NO: 4012450 - RNA, 12 nt, Human parainfluenza virus 2
caucauuuacug

SEQ ID NO: 4012451 - RNA, 21 nt, Human parainfluenza virus 2
caugcauccaaucaagaucca

SEQ ID NO: 4012452 - RNA, 17 nt, Human parainfluenza virus 2
ccaaaagacccaaacaa

SEQ ID NO: 4012453 - RNA, 14 nt, Human parainfluenza virus 2
ccacucacacacuc

SEQ ID NO: 4012454 - RNA, 14 nt, Human parainfluenza virus 2
ccguuaaauuuaag

SEQ ID NO: 4012455 - RNA, 21 nt, Human parainfluenza virus 2
cgaaagccugaauccaagaaa

SEQ ID NO: 4012456 - RNA, 20 nt, Human parainfluenza virus 2
cucaaggcgaguguugcaac

SEQ ID NO: 4012457 - RNA, 18 nt, Human parainfluenza virus 2
gaacucaugauaguuuua

SEQ ID NO: 4012458 - RNA, 15 nt, Human parainfluenza virus 2
gagaucagaaagagu

SEQ ID NO: 4012459 - RNA, 17 nt, Human parainfluenza virus 2
gaggagaucagaaagag

SEQ ID NO: 4012460 - RNA, 13 nt, Human parainfluenza virus 2
gcauccaaucaag

SEQ ID NO: 4012461 - RNA, 21 nt, Human parainfluenza virus 2
gccgaaccaugcucaaccaaa

SEQ ID NO: 4012462 - RNA, 12 nt, Human parainfluenza virus 2
ccaagaaacaac

SEQ ID NO: 4012463 - RNA, 18 nt, Human parainfluenza virus 2
ccaagaaacaaccacagc

SEQ ID NO: 4012464 - RNA, 17 nt, Human parainfluenza virus 2
ccacaauugucaacacc

SEQ ID NO: 4012465 - RNA, 21 nt, Human parainfluenza virus 2
ccuucagacuguagaagggaa

SEQ ID NO: 4012466 - RNA, 16 nt, Human parainfluenza virus 2
cguaguacaauuuaag

SEQ ID NO: 4012467 - RNA, 19 nt, Human parainfluenza virus 2
cuaagauucaggcagcaac

SEQ ID NO: 4012468 - RNA, 11 nt, Human parainfluenza virus 2
cucaacaugca

SEQ ID NO: 4012469 - RNA, 14 nt, Human parainfluenza virus 2
cucaaccaaaagac

SEQ ID NO: 4012470 - RNA, 17 nt, Human parainfluenza virus 2
cugaauccaagaaagau

SEQ ID NO: 4012471 - RNA, 17 nt, Human parainfluenza virus 2
cuugcaacuucugcaac

SEQ ID NO: 4012472 - RNA, 14 nt, Human parainfluenza virus 2
gaaacaaccacagc

SEQ ID NO: 4012473 - RNA, 17 nt, Human parainfluenza virus 2
gaacucaugauaguuuu

SEQ ID NO: 4012474 - RNA, 12 nt, Human parainfluenza virus 2
gaaggcuggaca

SEQ ID NO: 4012475 - RNA, 19 nt, Human parainfluenza virus 2
gauacagcugccacucaca

SEQ ID NO: 4012476 - RNA, 14 nt, Human parainfluenza virus 2
gcagcaaccacaga

SEQ ID NO: 4012477 - RNA, 21 nt, Human parainfluenza virus 2
gcuguuuuucccauaugaagc

SEQ ID NO: 4012478 - RNA, 16 nt, Human parainfluenza virus 2
gcuuaacgaaauuaaa

SEQ ID NO: 4012479 - RNA, 13 nt, Human parainfluenza virus 2
guuaaauuuaagu

SEQ ID NO: 4012480 - RNA, 17 nt, Human parainfluenza virus 2
uaaaaaugaaaugacua

SEQ ID NO: 4012481 - RNA, 21 nt, Human parainfluenza virus 2
uacuguuguaauucaaucuua

SEQ ID NO: 4012482 - RNA, 16 nt, Human parainfluenza virus 2
uagaaccacaaucaag

SEQ ID NO: 4012483 - RNA, 17 nt, Human parainfluenza virus 2
uauaagaacucaugaua

SEQ ID NO: 4012484 - RNA, 17 nt, Human parainfluenza virus 2
uauacguuuuggcugua

SEQ ID NO: 4012485 - RNA, 15 nt, Human parainfluenza virus 2
ucaacaccaagaaac

SEQ ID NO: 4012486 - RNA, 17 nt, Human parainfluenza virus 2
ucaacaccaagaaacaa

SEQ ID NO: 4012487 - RNA, 17 nt, Human parainfluenza virus 2
ucacacacucauccaga

SEQ ID NO: 4012488 - RNA, 21 nt, Human parainfluenza virus 2
ucaugauaguuuuauuuaaga

SEQ ID NO: 4012489 - RNA, 16 nt, Human parainfluenza virus 2
uccacaucacucagag

SEQ ID NO: 4012490 - RNA, 19 nt, Human parainfluenza virus 2
ugcagcuugcaaaugacug

SEQ ID NO: 4012491 - RNA, 15 nt, Human parainfluenza virus 2
ugcucaaccaaaaga

SEQ ID NO: 4012492 - RNA, 13 nt, Human parainfluenza virus 2
uucugcuguuuuu

SEQ ID NO: 4012493 - RNA, 15 nt, Human parainfluenza virus 2
uugacccuuaagaac

SEQ ID NO: 4012494 - RNA, 22 nt, Human parainfluenza virus 2
uugaugcagcuugcaaaugacu

SEQ ID NO: 4012495 - RNA, 20 nt, Human parainfluenza virus 2
ggcuucacagccgaacaggu

SEQ ID NO: 4012496 - RNA, 11 nt, Human parainfluenza virus 2
gucaacugauu

SEQ ID NO: 4012497 - RNA, 18 nt, Human parainfluenza virus 2
guuauacguuuuggcugu

SEQ ID NO: 4012498 - RNA, 13 nt, Human parainfluenza virus 2
uacagcugccacu

SEQ ID NO: 4012499 - RNA, 23 nt, Human parainfluenza virus 2
uagaccuacacucucaucaacaa

SEQ ID NO: 4012500 - RNA, 18 nt, Human parainfluenza virus 2
ucaacaccgacuuagguu

SEQ ID NO: 4012501 - RNA, 14 nt, Human parainfluenza virus 2
ucaauaauaauuga

SEQ ID NO: 4012502 - RNA, 17 nt, Human parainfluenza virus 2
ucacacaagagacacuc

SEQ ID NO: 4012503 - RNA, 13 nt, Human parainfluenza virus 2
ucacaucaauaga

SEQ ID NO: 4012504 - RNA, 11 nt, Human parainfluenza virus 2
ucacucagaga

SEQ ID NO: 4012505 - RNA, 11 nt, Human parainfluenza virus 2
uccacaucacu

SEQ ID NO: 4012506 - RNA, 17 nt, Human parainfluenza virus 2
uggcuguauuagaaugu

SEQ ID NO: 4012507 - RNA, 13 nt, Human parainfluenza virus 2
uguuauagauucu

SEQ ID NO: 4012508 - RNA, 17 nt, Human parainfluenza virus 2
uuaaaaaugaaaugacu

SEQ ID NO: 4012509 - RNA, 12 nt, Human parainfluenza virus 2
uucugcuguuuu

SEQ ID NO: 4012510 - RNA, 22 nt, Human parainfluenza virus 2
uugaaugaagacuccagauuca

SEQ ID NO: 4012511 - RNA, 13 nt, Human parainfluenza virus 2
uuuggcuguauua

SEQ ID NO: 4012512 - RNA, 15 nt, Human parainfluenza virus 3
aaaaauggaacccag

SEQ ID NO: 4012513 - RNA, 20 nt, Human parainfluenza virus 3
aaaacaaaaaguacagaaca

SEQ ID NO: 4012514 - RNA, 17 nt, Human parainfluenza virus 3
aaaacacuaaucccaga

SEQ ID NO: 4012515 - RNA, 14 nt, Human parainfluenza virus 3
aaaacuacagcaug

SEQ ID NO: 4012516 - RNA, 14 nt, Human parainfluenza virus 3
aaaagauagaacua

SEQ ID NO: 4012517 - RNA, 19 nt, Human parainfluenza virus 3
aaaaucaaaccaacagaaa

SEQ ID NO: 4012518 - RNA, 13 nt, Human parainfluenza virus 3
aaaauuauaacac

SEQ ID NO: 4012519 - RNA, 16 nt, Human parainfluenza virus 3
aaacacuagcaaguca

SEQ ID NO: 4012520 - RNA, 22 nt, Human parainfluenza virus 3
aaacagagauuccaaaaagcug

SEQ ID NO: 4012521 - RNA, 18 nt, Human parainfluenza virus 3
aaacaugguuuacuauca

SEQ ID NO: 4012522 - RNA, 22 nt, Human parainfluenza virus 3
aaacgaguuguauguguagcaa

SEQ ID NO: 4012523 - RNA, 18 nt, Human parainfluenza virus 3
aaacuuaggauuaaagaa

SEQ ID NO: 4012524 - RNA, 16 nt, Human parainfluenza virus 3
aaagccauacagauga

SEQ ID NO: 4012525 - RNA, 22 nt, Human parainfluenza virus 3
aaagggaugaagauaucacaaa

SEQ ID NO: 4012526 - RNA, 14 nt, Human parainfluenza virus 3
aaauacuaaugaaa

SEQ ID NO: 4012527 - RNA, 14 nt, Human parainfluenza virus 3
aaauaucacagaaa

SEQ ID NO: 4012528 - RNA, 16 nt, Human parainfluenza virus 3
aaaucaaaacaaaaag

SEQ ID NO: 4012529 - RNA, 17 nt, Human parainfluenza virus 3
aaauccaccaaaacaug

SEQ ID NO: 4012530 - RNA, 15 nt, Human parainfluenza virus 3
aaauuaauaauauau

SEQ ID NO: 4012531 - RNA, 14 nt, Human parainfluenza virus 3
aaauuccuaaguca

SEQ ID NO: 4012532 - RNA, 16 nt, Human parainfluenza virus 3
aaauuccuaagucaau

SEQ ID NO: 4012533 - RNA, 14 nt, Human parainfluenza virus 3
aacaaacaaauaac

SEQ ID NO: 4012534 - RNA, 15 nt, Human parainfluenza virus 3
aacaacaaaaccaaa

SEQ ID NO: 4012535 - RNA, 13 nt, Human parainfluenza virus 3
aacaagugagaaa

SEQ ID NO: 4012536 - RNA, 21 nt, Human parainfluenza virus 3
aacacaagaacccagcaacuc

SEQ ID NO: 4012537 - RNA, 17 nt, Human parainfluenza virus 3
aacccaagacacaaaag

SEQ ID NO: 4012538 - RNA, 18 nt, Human parainfluenza virus 3
aacccaagacacaaaaga

SEQ ID NO: 4012539 - RNA, 24 nt, Human parainfluenza virus 3
aacgcagcauuacucagaauuaac

SEQ ID NO: 4012540 - RNA, 20 nt, Human parainfluenza virus 3
aagaagcuuggaaucuauca

SEQ ID NO: 4012541 - RNA, 19 nt, Human parainfluenza virus 3
aagaccaaaaugaauccaa

SEQ ID NO: 4012542 - RNA, 16 nt, Human parainfluenza virus 3
aaguaagaaaaacaug

SEQ ID NO: 4012543 - RNA, 14 nt, Human parainfluenza virus 3
aaguguacaauaau

SEQ ID NO: 4012544 - RNA, 17 nt, Human parainfluenza virus 3
aaguuggcauagcaaau

SEQ ID NO: 4012545 - RNA, 15 nt, Human parainfluenza virus 3
aauaauauaggaaaa

SEQ ID NO: 4012546 - RNA, 15 nt, Human parainfluenza virus 3
aauacaauaaagaua

SEQ ID NO: 4012547 - RNA, 16 nt, Human parainfluenza virus 3
aauacuguaaacagaa

SEQ ID NO: 4012548 - RNA, 20 nt, Human parainfluenza virus 3
aauaggagaaaucaaaacaa

SEQ ID NO: 4012549 - RNA, 14 nt, Human parainfluenza virus 3
aauauacaaauaag

SEQ ID NO: 4012550 - RNA, 13 nt, Human parainfluenza virus 3
aaucaaagagaac

SEQ ID NO: 4012551 - RNA, 22 nt, Human parainfluenza virus 3
aaucagggacacaaacaaagca

SEQ ID NO: 4012552 - RNA, 12 nt, Human parainfluenza virus 3
aaucccaaaaga

SEQ ID NO: 4012553 - RNA, 23 nt, Human parainfluenza virus 3
aaucccagguucucucauacuuu

SEQ ID NO: 4012554 - RNA, 22 nt, Human parainfluenza virus 3
aaucggaaauccaccaaaacau

SEQ ID NO: 4012555 - RNA, 18 nt, Human parainfluenza virus 3
aaucugcagauguuccaa

SEQ ID NO: 4012556 - RNA, 14 nt, Human parainfluenza virus 3
aaugaaucuacaau

SEQ ID NO: 4012557 - RNA, 15 nt, Human parainfluenza virus 3
aaugacuuaggaaaa

SEQ ID NO: 4012558 - RNA, 19 nt, Human parainfluenza virus 3
aaugagagaguauccauga

SEQ ID NO: 4012559 - RNA, 22 nt, Human parainfluenza virus 3
aaugagagcuacacaaguuuua

SEQ ID NO: 4012560 - RNA, 14 nt, Human parainfluenza virus 3
aauuaggaauaauu

SEQ ID NO: 4012561 - RNA, 16 nt, Human parainfluenza virus 3
aauucuaaaaauggaa

SEQ ID NO: 4012562 - RNA, 15 nt, Human parainfluenza virus 3
acaaaauugaaagaa

SEQ ID NO: 4012563 - RNA, 19 nt, Human parainfluenza virus 3
acaaaauugaaagaagaaa

SEQ ID NO: 4012564 - RNA, 19 nt, Human parainfluenza virus 3
acaacuuauaaaucagaua

SEQ ID NO: 4012565 - RNA, 11 nt, Human parainfluenza virus 3
acaagcugcau

SEQ ID NO: 4012566 - RNA, 20 nt, Human parainfluenza virus 3
acaauaaagauauaucuuaa

SEQ ID NO: 4012567 - RNA, 20 nt, Human parainfluenza virus 3
acaauagauaucaaucaaua

SEQ ID NO: 4012568 - RNA, 16 nt, Human parainfluenza virus 3
acaauuagaaaugaua

SEQ ID NO: 4012569 - RNA, 18 nt, Human parainfluenza virus 3
acacaaaauuaacacaga

SEQ ID NO: 4012570 - RNA, 15 nt, Human parainfluenza virus 3
acacacacaaaauca

SEQ ID NO: 4012571 - RNA, 18 nt, Human parainfluenza virus 3
acaccaagaagaugacaa

SEQ ID NO: 4012572 - RNA, 23 nt, Human parainfluenza virus 3
acagaaaauaaaacucaauaaau

SEQ ID NO: 4012573 - RNA, 22 nt, Human parainfluenza virus 3
acagaaacaagugagaaagaua

SEQ ID NO: 4012574 - RNA, 14 nt, Human parainfluenza virus 3
accacucaaaguca

SEQ ID NO: 4012575 - RNA, 21 nt, Human parainfluenza virus 3
accauuaccacucaaagucaa

SEQ ID NO: 4012576 - RNA, 15 nt, Human parainfluenza virus 3
acgaaucaaagacaa

SEQ ID NO: 4012577 - RNA, 21 nt, Human parainfluenza virus 3
acgaugugcaaguuaaaucag

SEQ ID NO: 4012578 - RNA, 16 nt, Human parainfluenza virus 3
acgugcuaucaaaauu

SEQ ID NO: 4012579 - RNA, 22 nt, Human parainfluenza virus 3
acuaacucugcaauauacacau

SEQ ID NO: 4012580 - RNA, 19 nt, Human parainfluenza virus 3
acuaauacccaaaaaagug

SEQ ID NO: 4012581 - RNA, 15 nt, Human parainfluenza virus 3
acuagacucacagaa

SEQ ID NO: 4012582 - RNA, 22 nt, Human parainfluenza virus 3
acuagauuuauaucaagacaaa

SEQ ID NO: 4012583 - RNA, 18 nt, Human parainfluenza virus 3
acucuuugcaaaaaugac

SEQ ID NO: 4012584 - RNA, 14 nt, Human parainfluenza virus 3
acugagaaagugaa

SEQ ID NO: 4012585 - RNA, 21 nt, Human parainfluenza virus 3
acugagagaggaggaaagaaa

SEQ ID NO: 4012586 - RNA, 16 nt, Human parainfluenza virus 3
acugcugcaacaccag

SEQ ID NO: 4012587 - RNA, 14 nt, Human parainfluenza virus 3
acuguaaacagaaa

SEQ ID NO: 4012588 - RNA, 22 nt, Human parainfluenza virus 3
acuguacagagaggaccuggga

SEQ ID NO: 4012589 - RNA, 14 nt, Human parainfluenza virus 3
acuuaggaaaauac

SEQ ID NO: 4012590 - RNA, 17 nt, Human parainfluenza virus 3
agaaaaugagauugaua

SEQ ID NO: 4012591 - RNA, 18 nt, Human parainfluenza virus 3
agaaaauggaugaaucac

SEQ ID NO: 4012592 - RNA, 20 nt, Human parainfluenza virus 3
agaaacaagugagaaagaua

SEQ ID NO: 4012593 - RNA, 21 nt, Human parainfluenza virus 3
agaaacagugaucauggaaga

SEQ ID NO: 4012594 - RNA, 17 nt, Human parainfluenza virus 3
agaaacccaaaaauaag

SEQ ID NO: 4012595 - RNA, 17 nt, Human parainfluenza virus 3
agaaauaaauaaugagu

SEQ ID NO: 4012596 - RNA, 22 nt, Human parainfluenza virus 3
agaagauauuguacuugauauu

SEQ ID NO: 4012597 - RNA, 18 nt, Human parainfluenza virus 3
agaagauugauagaaaau

SEQ ID NO: 4012598 - RNA, 14 nt, Human parainfluenza virus 3
agaaugaaacaaua

SEQ ID NO: 4012599 - RNA, 14 nt, Human parainfluenza virus 3
agacaaaaaguaag

SEQ ID NO: 4012600 - RNA, 16 nt, Human parainfluenza virus 3
agacaagaaacaacag

SEQ ID NO: 4012601 - RNA, 22 nt, Human parainfluenza virus 3
agaccuaucggaaaacgacaca

SEQ ID NO: 4012602 - RNA, 20 nt, Human parainfluenza virus 3
agaggaccugggagaagaag

SEQ ID NO: 4012603 - RNA, 22 nt, Human parainfluenza virus 3
agagucauguccagaauuauau

SEQ ID NO: 4012604 - RNA, 15 nt, Human parainfluenza virus 3
agauacaaaaugaaa

SEQ ID NO: 4012605 - RNA, 20 nt, Human parainfluenza virus 3
agauagaacauauagucaaa

SEQ ID NO: 4012606 - RNA, 20 nt, Human parainfluenza virus 3
agauaucaaucaauauacaa

SEQ ID NO: 4012607 - RNA, 19 nt, Human parainfluenza virus 3
agauauugagaaacucaaa

SEQ ID NO: 4012608 - RNA, 16 nt, Human parainfluenza virus 3
agauauuuuuaaugaa

SEQ ID NO: 4012609 - RNA, 16 nt, Human parainfluenza virus 3
agaucaagaaaacuag

SEQ ID NO: 4012610 - RNA, 17 nt, Human parainfluenza virus 3
agaucaagcaauacaag

SEQ ID NO: 4012611 - RNA, 23 nt, Human parainfluenza virus 3
agauuuguuauccuuuaauggau

SEQ ID NO: 4012612 - RNA, 18 nt, Human parainfluenza virus 3
agcaaauguacuaaacaa

SEQ ID NO: 4012613 - RNA, 12 nt, Human parainfluenza virus 3
agcacaaaucac

SEQ ID NO: 4012614 - RNA, 20 nt, Human parainfluenza virus 3
agcaccgacccccaagaaga

SEQ ID NO: 4012615 - RNA, 21 nt, Human parainfluenza virus 3
agcacuccuaaauacagaugu

SEQ ID NO: 4012616 - RNA, 18 nt, Human parainfluenza virus 3
agcccaaggauagacaaa

SEQ ID NO: 4012617 - RNA, 20 nt, Human parainfluenza virus 3
agcgugcucggaaaauggac

SEQ ID NO: 4012618 - RNA, 19 nt, Human parainfluenza virus 3
aggauauaggaaaaucaua

SEQ ID NO: 4012619 - RNA, 17 nt, Human parainfluenza virus 3
agggcaauuacucuauu

SEQ ID NO: 4012620 - RNA, 19 nt, Human parainfluenza virus 3
agguaauaaccuaugggaa

SEQ ID NO: 4012621 - RNA, 16 nt, Human parainfluenza virus 3
aguacaccugauacaa

SEQ ID NO: 4012622 - RNA, 12 nt, Human parainfluenza virus 3
aguuacaaaguu

SEQ ID NO: 4012623 - RNA, 20 nt, Human parainfluenza virus 3
aguucuucaauacaccaaga

SEQ ID NO: 4012624 - RNA, 16 nt, Human parainfluenza virus 3
auaaagauauaucuua

SEQ ID NO: 4012625 - RNA, 21 nt, Human parainfluenza virus 3
auaaauacaauaaagauauau

SEQ ID NO: 4012626 - RNA, 13 nt, Human parainfluenza virus 3
auaagaaaaacuu

SEQ ID NO: 4012627 - RNA, 14 nt, Human parainfluenza virus 3
auacaauaaagaua

SEQ ID NO: 4012628 - RNA, 15 nt, Human parainfluenza virus 3
auaccaagcagaguu

SEQ ID NO: 4012629 - RNA, 21 nt, Human parainfluenza virus 3
auacucgcaggaacaagaaag

SEQ ID NO: 4012630 - RNA, 18 nt, Human parainfluenza virus 3
auacugcaucaaagauag

SEQ ID NO: 4012631 - RNA, 16 nt, Human parainfluenza virus 3
auacuguaaacagaaa

SEQ ID NO: 4012632 - RNA, 22 nt, Human parainfluenza virus 3
auacuuucaacauaaaugacaa

SEQ ID NO: 4012633 - RNA, 21 nt, Human parainfluenza virus 3
auagauaucaaucaauauaca

SEQ ID NO: 4012634 - RNA, 15 nt, Human parainfluenza virus 3
auagcagauaguaaa

SEQ ID NO: 4012635 - RNA, 15 nt, Human parainfluenza virus 3
auagucaaaugacug

SEQ ID NO: 4012636 - RNA, 21 nt, Human parainfluenza virus 3
auagugaaaagguccauaauu

SEQ ID NO: 4012637 - RNA, 22 nt, Human parainfluenza virus 3
auauaccugaucuauaucgaca

SEQ ID NO: 4012638 - RNA, 14 nt, Human parainfluenza virus 3
auauauauauacca

SEQ ID NO: 4012639 - RNA, 12 nt, Human parainfluenza virus 3
auaucaagacaa

SEQ ID NO: 4012640 - RNA, 21 nt, Human parainfluenza virus 3
auauggaugacgacucaauac

SEQ ID NO: 4012641 - RNA, 15 nt, Human parainfluenza virus 3
auauuacaaaggcaa

SEQ ID NO: 4012642 - RNA, 14 nt, Human parainfluenza virus 3
aucaaaaucuauca

SEQ ID NO: 4012643 - RNA, 12 nt, Human parainfluenza virus 3
aucaaagagaac

SEQ ID NO: 4012644 - RNA, 16 nt, Human parainfluenza virus 3
aucaaaugcaacaaga

SEQ ID NO: 4012645 - RNA, 23 nt, Human parainfluenza virus 3
aucaagaagugccgcaacaaaga

SEQ ID NO: 4012646 - RNA, 21 nt, Human parainfluenza virus 3
aucagagauauuaaguucaua

SEQ ID NO: 4012647 - RNA, 15 nt, Human parainfluenza virus 3
aucaggaacacaauc

SEQ ID NO: 4012648 - RNA, 12 nt, Human parainfluenza virus 3
auccaacaaaga

SEQ ID NO: 4012649 - RNA, 15 nt, Human parainfluenza virus 3
auccaacaaagaaac

SEQ ID NO: 4012650 - RNA, 16 nt, Human parainfluenza virus 3
auccacaucaaaacua

SEQ ID NO: 4012651 - RNA, 22 nt, Human parainfluenza virus 3
auccaugaucaaaacaaaauug

SEQ ID NO: 4012652 - RNA, 19 nt, Human parainfluenza virus 3
aucuaauaguagcaaucaa

SEQ ID NO: 4012653 - RNA, 17 nt, Human parainfluenza virus 3
aucuauuauuuacagaa

SEQ ID NO: 4012654 - RNA, 18 nt, Human parainfluenza virus 3
aucucucacaaagcacaa

SEQ ID NO: 4012655 - RNA, 15 nt, Human parainfluenza virus 3
augaagaagaaauac

SEQ ID NO: 4012656 - RNA, 14 nt, Human parainfluenza virus 3
augaagauaucaca

SEQ ID NO: 4012657 - RNA, 16 nt, Human parainfluenza virus 3
augacauacaaaauga

SEQ ID NO: 4012658 - RNA, 14 nt, Human parainfluenza virus 3
augagacaaaauua

SEQ ID NO: 4012659 - RNA, 17 nt, Human parainfluenza virus 3
augaucaaaacaaaauu

SEQ ID NO: 4012660 - RNA, 16 nt, Human parainfluenza virus 3
auguacaacagaagca

SEQ ID NO: 4012661 - RNA, 21 nt, Human parainfluenza virus 3
auuaacgugcuaucaaaauua

SEQ ID NO: 4012662 - RNA, 22 nt, Human parainfluenza virus 3
auuaacuaggcugcugaacacu

SEQ ID NO: 4012663 - RNA, 22 nt, Human parainfluenza virus 3
auuaauccuuauccaaaaugag

SEQ ID NO: 4012664 - RNA, 17 nt, Human parainfluenza virus 3
auuacaagaaaaaggaa

SEQ ID NO: 4012665 - RNA, 12 nt, Human parainfluenza virus 3
auuccaaaauua

SEQ ID NO: 4012666 - RNA, 12 nt, Human parainfluenza virus 3
auucuaaaaaug

SEQ ID NO: 4012667 - RNA, 14 nt, Human parainfluenza virus 3
caaaaaaagcaaaa

SEQ ID NO: 4012668 - RNA, 16 nt, Human parainfluenza virus 3
caaaauauaaaaccag

SEQ ID NO: 4012669 - RNA, 19 nt, Human parainfluenza virus 3
caaaaucuaucaacacaca

SEQ ID NO: 4012670 - RNA, 15 nt, Human parainfluenza virus 3
caaacacuaaacaca

SEQ ID NO: 4012671 - RNA, 15 nt, Human parainfluenza virus 3
caaacccaagacaca

SEQ ID NO: 4012672 - RNA, 15 nt, Human parainfluenza virus 3
caaacuguauaacaa

SEQ ID NO: 4012673 - RNA, 18 nt, Human parainfluenza virus 3
caaagaaacgacaccgaa

SEQ ID NO: 4012674 - RNA, 19 nt, Human parainfluenza virus 3
caaaguuuguggcucugga

SEQ ID NO: 4012675 - RNA, 13 nt, Human parainfluenza virus 3
caaauuacaauua

SEQ ID NO: 4012676 - RNA, 19 nt, Human parainfluenza virus 3
caacacagcaaacacuaaa

SEQ ID NO: 4012677 - RNA, 17 nt, Human parainfluenza virus 3
caacuggauccauauca

SEQ ID NO: 4012678 - RNA, 19 nt, Human parainfluenza virus 3
caagaucuauauauauaca

SEQ ID NO: 4012679 - RNA, 17 nt, Human parainfluenza virus 3
caaggauagacaaaaag

SEQ ID NO: 4012680 - RNA, 13 nt, Human parainfluenza virus 3
caaguaugauaug

SEQ ID NO: 4012681 - RNA, 22 nt, Human parainfluenza virus 3
caagucaacggauaucuacaau

SEQ ID NO: 4012682 - RNA, 16 nt, Human parainfluenza virus 3
caaucacggaaaggau

SEQ ID NO: 4012683 - RNA, 17 nt, Human parainfluenza virus 3
caaucagggacacaaac

SEQ ID NO: 4012684 - RNA, 20 nt, Human parainfluenza virus 3
caaucagggacacaaacaaa

SEQ ID NO: 4012685 - RNA, 18 nt, Human parainfluenza virus 3
caaugaaauuagaaagau

SEQ ID NO: 4012686 - RNA, 15 nt, Human parainfluenza virus 3
cacaaaacuacagca

SEQ ID NO: 4012687 - RNA, 15 nt, Human parainfluenza virus 3
cacaaauaucacaga

SEQ ID NO: 4012688 - RNA, 11 nt, Human parainfluenza virus 3
cacauagaaga

SEQ ID NO: 4012689 - RNA, 18 nt, Human parainfluenza virus 3
caccagaugauauaacau

SEQ ID NO: 4012690 - RNA, 22 nt, Human parainfluenza virus 3
cacucucagcuggauauacaac

SEQ ID NO: 4012691 - RNA, 21 nt, Human parainfluenza virus 3
cagaacuccguccuuaauuau

SEQ ID NO: 4012692 - RNA, 13 nt, Human parainfluenza virus 3
cagacaagaaaca

SEQ ID NO: 4012693 - RNA, 13 nt, Human parainfluenza virus 3
cucaaaaaaugau

SEQ ID NO: 4012694 - RNA, 22 nt, Human parainfluenza virus 3
cucaauaaauuagauaaaagac

SEQ ID NO: 4012695 - RNA, 17 nt, Human parainfluenza virus 3
cucuacucauacaauug

SEQ ID NO: 4012696 - RNA, 15 nt, Human parainfluenza virus 3
cugccaaauagauau

SEQ ID NO: 4012697 - RNA, 14 nt, Human parainfluenza virus 3
cuggacauagaagu

SEQ ID NO: 4012698 - RNA, 19 nt, Human parainfluenza virus 3
cuggauccauaucaaaaac

SEQ ID NO: 4012699 - RNA, 15 nt, Human parainfluenza virus 3
cugguauucaaaagg

SEQ ID NO: 4012700 - RNA, 19 nt, Human parainfluenza virus 3
cuuaaaauuaugacugaga

SEQ ID NO: 4012701 - RNA, 20 nt, Human parainfluenza virus 3
cuuaaaauuaugacugagag

SEQ ID NO: 4012702 - RNA, 23 nt, Human parainfluenza virus 3
cuuccacuagauaggagcauaaa

SEQ ID NO: 4012703 - RNA, 14 nt, Human parainfluenza virus 3
cuuuaucuuugagc

SEQ ID NO: 4012704 - RNA, 18 nt, Human parainfluenza virus 3
cuuuaucuuugagcccaa

SEQ ID NO: 4012705 - RNA, 19 nt, Human parainfluenza virus 3
cuuuaucuuugagcccaag

SEQ ID NO: 4012706 - RNA, 21 nt, Human parainfluenza virus 3
gaaaacacagagagacugcaa

SEQ ID NO: 4012707 - RNA, 23 nt, Human parainfluenza virus 3
gaaaagcaguaccccacauuaga

SEQ ID NO: 4012708 - RNA, 22 nt, Human parainfluenza virus 3
gaaaauacacauuuaucagaua

SEQ ID NO: 4012709 - RNA, 14 nt, Human parainfluenza virus 3
gaaaaucaaagaga

SEQ ID NO: 4012710 - RNA, 14 nt, Human parainfluenza virus 3
gaaagaaagaccaa

SEQ ID NO: 4012711 - RNA, 14 nt, Human parainfluenza virus 3
gaaauaaaucagaa

SEQ ID NO: 4012712 - RNA, 15 nt, Human parainfluenza virus 3
gaaauuaauaauaua

SEQ ID NO: 4012713 - RNA, 18 nt, Human parainfluenza virus 3
gaaauuaauaauauauca

SEQ ID NO: 4012714 - RNA, 21 nt, Human parainfluenza virus 3
gaacaaacagacaagaaacaa

SEQ ID NO: 4012715 - RNA, 16 nt, Human parainfluenza virus 3
gaacagacaaacacaa

SEQ ID NO: 4012716 - RNA, 16 nt, Human parainfluenza virus 3
gaaccauugcucuggg

SEQ ID NO: 4012717 - RNA, 16 nt, Human parainfluenza virus 3
gaacgaaucaaagaca

SEQ ID NO: 4012718 - RNA, 21 nt, Human parainfluenza virus 3
gaacuaauaaucucuacuuca

SEQ ID NO: 4012719 - RNA, 17 nt, Human parainfluenza virus 3
gaagaaaagaucaagaa

SEQ ID NO: 4012720 - RNA, 16 nt, Human parainfluenza virus 3
gaagaggaaucaagag

SEQ ID NO: 4012721 - RNA, 17 nt, Human parainfluenza virus 3
gaaggauacagaagaga

SEQ ID NO: 4012722 - RNA, 23 nt, Human parainfluenza virus 3
gaaucuaauaguagcaaucaaau

SEQ ID NO: 4012723 - RNA, 22 nt, Human parainfluenza virus 3
gaaugcuguucaauacaaacaa

SEQ ID NO: 4012724 - RNA, 14 nt, Human parainfluenza virus 3
gaauuaacaaacau

SEQ ID NO: 4012725 - RNA, 14 nt, Human parainfluenza virus 3
gacaaaaaaagcaa

SEQ ID NO: 4012726 - RNA, 13 nt, Human parainfluenza virus 3
gacacaacagaug

SEQ ID NO: 4012727 - RNA, 13 nt, Human parainfluenza virus 3
gacacaguuuauc

SEQ ID NO: 4012728 - RNA, 19 nt, Human parainfluenza virus 3
gacaccgaacaaacagaca

SEQ ID NO: 4012729 - RNA, 21 nt, Human parainfluenza virus 3
gacagugacccgaguuacaaa

SEQ ID NO: 4012730 - RNA, 12 nt, Human parainfluenza virus 3
gaccaacagauc

SEQ ID NO: 4012731 - RNA, 15 nt, Human parainfluenza virus 3
gagaaacucaaagaa

SEQ ID NO: 4012732 - RNA, 23 nt, Human parainfluenza virus 3
gagaauguaaucugcaacacaac

SEQ ID NO: 4012733 - RNA, 16 nt, Human parainfluenza virus 3
gagcaguacaaugaga

SEQ ID NO: 4012734 - RNA, 12 nt, Human parainfluenza virus 3
gagcccaaggau

SEQ ID NO: 4012735 - RNA, 14 nt, Human parainfluenza virus 3
gaggaaucaagaga

SEQ ID NO: 4012736 - RNA, 20 nt, Human parainfluenza virus 3
gaguuccacgguauaaugaa

SEQ ID NO: 4012737 - RNA, 13 nt, Human parainfluenza virus 3
gaguucuucucuu

SEQ ID NO: 4012738 - RNA, 18 nt, Human parainfluenza virus 3
gauaaaugguauaaucca

SEQ ID NO: 4012739 - RNA, 14 nt, Human parainfluenza virus 3
gauacagaagagag

SEQ ID NO: 4012740 - RNA, 21 nt, Human parainfluenza virus 3
gauagacaaaaaguaagaaaa

SEQ ID NO: 4012741 - RNA, 20 nt, Human parainfluenza virus 3
gaucaacuuauacaaaagaa

SEQ ID NO: 4012742 - RNA, 20 nt, Human parainfluenza virus 3
gaucaggaaacuguacagag

SEQ ID NO: 4012743 - RNA, 15 nt, Human parainfluenza virus 3
gauccucaucagaua

SEQ ID NO: 4012744 - RNA, 12 nt, Human parainfluenza virus 3
gcaaaauaauau

SEQ ID NO: 4012745 - RNA, 19 nt, Human parainfluenza virus 3
gcaaauaagggauaaucaa

SEQ ID NO: 4012746 - RNA, 17 nt, Human parainfluenza virus 3
gcaaauguacuaaacaa

SEQ ID NO: 4012747 - RNA, 21 nt, Human parainfluenza virus 3
gcaacaccagaugaugaagaa

SEQ ID NO: 4012748 - RNA, 20 nt, Human parainfluenza virus 3
gcaauuaugaucuuaaugaa

SEQ ID NO: 4012749 - RNA, 22 nt, Human parainfluenza virus 3
gcagaaugaaacaauagauauc

SEQ ID NO: 4012750 - RNA, 15 nt, Human parainfluenza virus 3
gcagaguucuucucu

SEQ ID NO: 4012751 - RNA, 23 nt, Human parainfluenza virus 3
gcaucauuauaccgcacaaauau

SEQ ID NO: 4012752 - RNA, 12 nt, Human parainfluenza virus 3
gccgaagcaaau

SEQ ID NO: 4012753 - RNA, 17 nt, Human parainfluenza virus 3
gcuaucaagaccaggaa

SEQ ID NO: 4012754 - RNA, 13 nt, Human parainfluenza virus 3
gcucgaaaugaga

SEQ ID NO: 4012755 - RNA, 23 nt, Human parainfluenza virus 3
gcuuaucaggaaacauaucccaa

SEQ ID NO: 4012756 - RNA, 15 nt, Human parainfluenza virus 3
ggaauccaaugaaaa

SEQ ID NO: 4012757 - RNA, 17 nt, Human parainfluenza virus 3
ggaucauuacaagaaaa

SEQ ID NO: 4012758 - RNA, 14 nt, Human parainfluenza virus 3
ggaucuuaggaaau

SEQ ID NO: 4012759 - RNA, 19 nt, Human parainfluenza virus 3
ggaugaaucacauagaaga

SEQ ID NO: 4012760 - RNA, 19 nt, Human parainfluenza virus 3
ggauuaguuggaggaauca

SEQ ID NO: 4012761 - RNA, 15 nt, Human parainfluenza virus 3
ggcaaacagaaauac

SEQ ID NO: 4012762 - RNA, 15 nt, Human parainfluenza virus 3
ggcgguugcucuggu

SEQ ID NO: 4012763 - RNA, 13 nt, Human parainfluenza virus 3
gggcagaagaaaa

SEQ ID NO: 4012764 - RNA, 23 nt, Human parainfluenza virus 3
guaauuggaaccauugcucuggg

SEQ ID NO: 4012765 - RNA, 16 nt, Human parainfluenza virus 3
guauaauccauucaaa

SEQ ID NO: 4012766 - RNA, 18 nt, Human parainfluenza virus 3
guauccacuaaaucccac

SEQ ID NO: 4012767 - RNA, 14 nt, Human parainfluenza virus 3
gucaaaugacugau

SEQ ID NO: 4012768 - RNA, 18 nt, Human parainfluenza virus 3
gugaaaagguccauaauu

SEQ ID NO: 4012769 - RNA, 23 nt, Human parainfluenza virus 3
gugcaaguuaaaucagagauauu

SEQ ID NO: 4012770 - RNA, 19 nt, Human parainfluenza virus 3
uaaaacucaauaaauuaga

SEQ ID NO: 4012771 - RNA, 20 nt, Human parainfluenza virus 3
uaaagaaaauggaugaauca

SEQ ID NO: 4012772 - RNA, 16 nt, Human parainfluenza virus 3
uaaagauauaucuuaa

SEQ ID NO: 4012773 - RNA, 21 nt, Human parainfluenza virus 3
uaagaaaaacauguaauauau

SEQ ID NO: 4012774 - RNA, 22 nt, Human parainfluenza virus 3
uaagggauaaucaaaaacuuag

SEQ ID NO: 4012775 - RNA, 22 nt, Human parainfluenza virus 3
uaauauauauauaccaagcaga

SEQ ID NO: 4012776 - RNA, 19 nt, Human parainfluenza virus 3
uaauccuuauccaaaauga

SEQ ID NO: 4012777 - RNA, 11 nt, Human parainfluenza virus 3
uaccaagcaga

SEQ ID NO: 4012778 - RNA, 21 nt, Human parainfluenza virus 3
uacccaacacaauaucaauca

SEQ ID NO: 4012779 - RNA, 23 nt, Human parainfluenza virus 3
uacucauacaauugagaaagaac

SEQ ID NO: 4012780 - RNA, 22 nt, Human parainfluenza virus 3
uagaacauauagucaaaugacu

SEQ ID NO: 4012781 - RNA, 18 nt, Human parainfluenza virus 3
uagacaaaaaguaagaaa

SEQ ID NO: 4012782 - RNA, 19 nt, Human parainfluenza virus 3
uagacaaaaaguaagaaaa

SEQ ID NO: 4012783 - RNA, 15 nt, Human parainfluenza virus 3
uagauaucaaucaau

SEQ ID NO: 4012784 - RNA, 15 nt, Human parainfluenza virus 3
uagauuacauugaua

SEQ ID NO: 4012785 - RNA, 15 nt, Human parainfluenza virus 3
uagcacaauuacaca

SEQ ID NO: 4012786 - RNA, 13 nt, Human parainfluenza virus 3
uaggacaaaagag

SEQ ID NO: 4012787 - RNA, 13 nt, Human parainfluenza virus 3
uauauaccaagca

SEQ ID NO: 4012788 - RNA, 15 nt, Human parainfluenza virus 3
uauauaccaagcaga

SEQ ID NO: 4012789 - RNA, 14 nt, Human parainfluenza virus 3
uauauuauggacaa

SEQ ID NO: 4012790 - RNA, 15 nt, Human parainfluenza virus 3
uaucuuaaccuuuau

SEQ ID NO: 4012791 - RNA, 18 nt, Human parainfluenza virus 3
uauuagcagucauacucg

SEQ ID NO: 4012792 - RNA, 16 nt, Human parainfluenza virus 3
ucaaaaacaacaacca

SEQ ID NO: 4012793 - RNA, 12 nt, Human parainfluenza virus 3
ucaaaacaaaaa

SEQ ID NO: 4012794 - RNA, 15 nt, Human parainfluenza virus 3
ucaaaacaaaauuga

SEQ ID NO: 4012795 - RNA, 12 nt, Human parainfluenza virus 3
ucaacacaagaa

SEQ ID NO: 4012796 - RNA, 17 nt, Human parainfluenza virus 3
ucaacaccgacacaaag

SEQ ID NO: 4012797 - RNA, 16 nt, Human parainfluenza virus 3
ucaaucucaacaacaa

SEQ ID NO: 4012798 - RNA, 23 nt, Human parainfluenza virus 3
uccaagauuaugucaacaaagaa

SEQ ID NO: 4012799 - RNA, 13 nt, Human parainfluenza virus 3
ucccaaaagagac

SEQ ID NO: 4012800 - RNA, 12 nt, Human parainfluenza virus 3
ucgcaaaaggag

SEQ ID NO: 4012801 - RNA, 20 nt, Human parainfluenza virus 3
ucuauuauuuacagaaucaa

SEQ ID NO: 4012802 - RNA, 14 nt, Human parainfluenza virus 3
ugaaacaauagaua

SEQ ID NO: 4012803 - RNA, 12 nt, Human parainfluenza virus 3
ugaaagaagaaa

SEQ ID NO: 4012804 - RNA, 14 nt, Human parainfluenza virus 3
ugaaguguacaaua

SEQ ID NO: 4012805 - RNA, 19 nt, Human parainfluenza virus 3
ugaauccaaugagagagua

SEQ ID NO: 4012806 - RNA, 20 nt, Human parainfluenza virus 3
ugaaugacuuaggaaaauac

SEQ ID NO: 4012807 - RNA, 14 nt, Human parainfluenza virus 3
ugacaauaggaagu

SEQ ID NO: 4012808 - RNA, 20 nt, Human parainfluenza virus 3
ugaccuuaaaaccuacaaua

SEQ ID NO: 4012809 - RNA, 13 nt, Human parainfluenza virus 3
ugacuuaggaaaa

SEQ ID NO: 4012810 - RNA, 23 nt, Human parainfluenza virus 3
ugagaaacucaaagaagcaauca

SEQ ID NO: 4012811 - RNA, 19 nt, Human parainfluenza virus 3
ugagaagaacagucaaagc

SEQ ID NO: 4012812 - RNA, 22 nt, Human parainfluenza virus 3
ugauagaaaaucaaagagaaca

SEQ ID NO: 4012813 - RNA, 22 nt, Human parainfluenza virus 3
uggaauauaagugcaugugcua

SEQ ID NO: 4012814 - RNA, 20 nt, Human parainfluenza virus 3
uggaggaaucuccagaagca

SEQ ID NO: 4012815 - RNA, 17 nt, Human parainfluenza virus 3
uggaucaacugacaaaa

SEQ ID NO: 4012816 - RNA, 13 nt, Human parainfluenza virus 3
ugguuuaagaaau

SEQ ID NO: 4012817 - RNA, 17 nt, Human parainfluenza virus 3
uuaaccuaucuauaaua

SEQ ID NO: 4012818 - RNA, 16 nt, Human parainfluenza virus 3
uuaauaauaaauaaga

SEQ ID NO: 4012819 - RNA, 22 nt, Human parainfluenza virus 3
uuacaaaaagcucgaaaugaga

SEQ ID NO: 4012820 - RNA, 15 nt, Human parainfluenza virus 3
uuccaucaauaguga

SEQ ID NO: 4012821 - RNA, 19 nt, Human parainfluenza virus 3
uugaaugauuacucaauca

SEQ ID NO: 4012822 - RNA, 14 nt, Human parainfluenza virus 3
uugcaacucaauca

SEQ ID NO: 4012823 - RNA, 13 nt, Human parainfluenza virus 3
aaaaaaagcaaaa

SEQ ID NO: 4012824 - RNA, 22 nt, Human parainfluenza virus 3
aaaacauguaauauauauauac

SEQ ID NO: 4012825 - RNA, 23 nt, Human parainfluenza virus 3
aaacaaaaaguacagaacaccaa

SEQ ID NO: 4012826 - RNA, 21 nt, Human parainfluenza virus 3
aaacaacaaccaucaacaccg

SEQ ID NO: 4012827 - RNA, 17 nt, Human parainfluenza virus 3
aaacacuaaacacaaug

SEQ ID NO: 4012828 - RNA, 17 nt, Human parainfluenza virus 3
aaacuuaggacaaaaga

SEQ ID NO: 4012829 - RNA, 13 nt, Human parainfluenza virus 3
aaagaaaauggau

SEQ ID NO: 4012830 - RNA, 16 nt, Human parainfluenza virus 3
aaagggauaguucaaa

SEQ ID NO: 4012831 - RNA, 19 nt, Human parainfluenza virus 3
aaaguaagaaaaacaugua

SEQ ID NO: 4012832 - RNA, 20 nt, Human parainfluenza virus 3
aaagugagcaguacaaugag

SEQ ID NO: 4012833 - RNA, 17 nt, Human parainfluenza virus 3
aaauguucaaauuauau

SEQ ID NO: 4012834 - RNA, 17 nt, Human parainfluenza virus 3
aaauuacaauuagaaau

SEQ ID NO: 4012835 - RNA, 13 nt, Human parainfluenza virus 3
aacaaaguagaaa

SEQ ID NO: 4012836 - RNA, 22 nt, Human parainfluenza virus 3
aacaacaguagaucaaaaucua

SEQ ID NO: 4012837 - RNA, 22 nt, Human parainfluenza virus 3
aacaauggcacuguaucugaca

SEQ ID NO: 4012838 - RNA, 13 nt, Human parainfluenza virus 3
aacaauguagaua

SEQ ID NO: 4012839 - RNA, 21 nt, Human parainfluenza virus 3
aacacucagaucuacaaagua

SEQ ID NO: 4012840 - RNA, 16 nt, Human parainfluenza virus 3
aacaucaacaguugau

SEQ ID NO: 4012841 - RNA, 16 nt, Human parainfluenza virus 3
aacauuuugauccaaa

SEQ ID NO: 4012842 - RNA, 18 nt, Human parainfluenza virus 3
aaccaacagaaacaagug

SEQ ID NO: 4012843 - RNA, 18 nt, Human parainfluenza virus 3
aaccaaucaggaauccaa

SEQ ID NO: 4012844 - RNA, 19 nt, Human parainfluenza virus 3
aaccaaucaggaauccaau

SEQ ID NO: 4012845 - RNA, 20 nt, Human parainfluenza virus 3
aaccuuuaucuuugagccca

SEQ ID NO: 4012846 - RNA, 22 nt, Human parainfluenza virus 3
aaccuuuaucuuugagcccaag

SEQ ID NO: 4012847 - RNA, 18 nt, Human parainfluenza virus 3
aacuucgaaacaagauau

SEQ ID NO: 4012848 - RNA, 23 nt, Human parainfluenza virus 3
aagaaacgacaccgaacaaacag

SEQ ID NO: 4012849 - RNA, 22 nt, Human parainfluenza virus 3
aagaaaucaaaagauacugaca

SEQ ID NO: 4012850 - RNA, 21 nt, Human parainfluenza virus 3
aagaagaugacaaaagaauua

SEQ ID NO: 4012851 - RNA, 20 nt, Human parainfluenza virus 3
aagagacuggcaacacagca

SEQ ID NO: 4012852 - RNA, 14 nt, Human parainfluenza virus 3
aagauauaucuuaa

SEQ ID NO: 4012853 - RNA, 18 nt, Human parainfluenza virus 3
aagaucuauauauauaca

SEQ ID NO: 4012854 - RNA, 12 nt, Human parainfluenza virus 3
aagauuacagaa

SEQ ID NO: 4012855 - RNA, 14 nt, Human parainfluenza virus 3
aagauuacagaaag

SEQ ID NO: 4012856 - RNA, 19 nt, Human parainfluenza virus 3
aagauuaugucaacaaaga

SEQ ID NO: 4012857 - RNA, 20 nt, Human parainfluenza virus 3
aagauugauagaaaaucaaa

SEQ ID NO: 4012858 - RNA, 22 nt, Human parainfluenza virus 3
aagcaaauaagggauaaucaaa

SEQ ID NO: 4012859 - RNA, 13 nt, Human parainfluenza virus 3
aagcagaaugaaa

SEQ ID NO: 4012860 - RNA, 14 nt, Human parainfluenza virus 3
aagcagaguucuuc

SEQ ID NO: 4012861 - RNA, 13 nt, Human parainfluenza virus 3
aaggauacagaag

SEQ ID NO: 4012862 - RNA, 18 nt, Human parainfluenza virus 3
aaggauagacaaaaagua

SEQ ID NO: 4012863 - RNA, 13 nt, Human parainfluenza virus 3
aaggccaaaucag

SEQ ID NO: 4012864 - RNA, 18 nt, Human parainfluenza virus 3
aagggauaaucaaaaacu

SEQ ID NO: 4012865 - RNA, 14 nt, Human parainfluenza virus 3
aaguacagaacacc

SEQ ID NO: 4012866 - RNA, 17 nt, Human parainfluenza virus 3
aagucaaugaacagaga

SEQ ID NO: 4012867 - RNA, 20 nt, Human parainfluenza virus 3
aaguuggcauagcaaauuac

SEQ ID NO: 4012868 - RNA, 15 nt, Human parainfluenza virus 3
aauaaaacucaauaa

SEQ ID NO: 4012869 - RNA, 23 nt, Human parainfluenza virus 3
aauaucauugacacaacagaugu

SEQ ID NO: 4012870 - RNA, 17 nt, Human parainfluenza virus 3
aaucacccuccaaguca

SEQ ID NO: 4012871 - RNA, 19 nt, Human parainfluenza virus 3
aaucaggaauccaaugaaa

SEQ ID NO: 4012872 - RNA, 23 nt, Human parainfluenza virus 3
aaucauaccaagucuuacaggua

SEQ ID NO: 4012873 - RNA, 15 nt, Human parainfluenza virus 3
aaugaaguguacaau

SEQ ID NO: 4012874 - RNA, 19 nt, Human parainfluenza virus 3
aaugacauacaaaaugaga

SEQ ID NO: 4012875 - RNA, 14 nt, Human parainfluenza virus 3
aauuauaaaugauc

SEQ ID NO: 4012876 - RNA, 19 nt, Human parainfluenza virus 3
acaaaacuucgaaacaaga

SEQ ID NO: 4012877 - RNA, 16 nt, Human parainfluenza virus 3
acaaauaacauaucua

SEQ ID NO: 4012878 - RNA, 14 nt, Human parainfluenza virus 3
acaacaacaagcug

SEQ ID NO: 4012879 - RNA, 18 nt, Human parainfluenza virus 3
acaagacuaauacccaaa

SEQ ID NO: 4012880 - RNA, 17 nt, Human parainfluenza virus 3
acaagaucuacaaguug

SEQ ID NO: 4012881 - RNA, 13 nt, Human parainfluenza virus 3
acaauaauaauua

SEQ ID NO: 4012882 - RNA, 14 nt, Human parainfluenza virus 3
acaaucaacacaag

SEQ ID NO: 4012883 - RNA, 17 nt, Human parainfluenza virus 3
acacaaaauuaacacag

SEQ ID NO: 4012884 - RNA, 20 nt, Human parainfluenza virus 3
acacaaaggggcaaacagaa

SEQ ID NO: 4012885 - RNA, 13 nt, Human parainfluenza virus 3
acaccaaaacaac

SEQ ID NO: 4012886 - RNA, 16 nt, Human parainfluenza virus 3
acagaaucaucaggaa

SEQ ID NO: 4012887 - RNA, 16 nt, Human parainfluenza virus 3
acagucccaaagggau

SEQ ID NO: 4012888 - RNA, 15 nt, Human parainfluenza virus 3
acauaucaaaacagg

SEQ ID NO: 4012889 - RNA, 16 nt, Human parainfluenza virus 3
acauugcaaaaaugau

SEQ ID NO: 4012890 - RNA, 13 nt, Human parainfluenza virus 3
accaaaaauagaa

SEQ ID NO: 4012891 - RNA, 20 nt, Human parainfluenza virus 3
accagaugaugaagaagaaa

SEQ ID NO: 4012892 - RNA, 14 nt, Human parainfluenza virus 3
accaugaaauggag

SEQ ID NO: 4012893 - RNA, 13 nt, Human parainfluenza virus 3
accauugcucugg

SEQ ID NO: 4012894 - RNA, 17 nt, Human parainfluenza virus 3
acgaauguacaacagaa

SEQ ID NO: 4012895 - RNA, 20 nt, Human parainfluenza virus 3
acucaaacauugcaaaaaug

SEQ ID NO: 4012896 - RNA, 22 nt, Human parainfluenza virus 3
acucaaacauugcaaaaaugau

SEQ ID NO: 4012897 - RNA, 23 nt, Human parainfluenza virus 3
acucaaagucaaugaacagagaa

SEQ ID NO: 4012898 - RNA, 21 nt, Human parainfluenza virus 3
acuggauccauaucaaaaaca

SEQ ID NO: 4012899 - RNA, 13 nt, Human parainfluenza virus 3
acuguaaacagaa

SEQ ID NO: 4012900 - RNA, 13 nt, Human parainfluenza virus 3
acuuaggaaaaua

SEQ ID NO: 4012901 - RNA, 13 nt, Human parainfluenza virus 3
acuucgaaacaag

SEQ ID NO: 4012902 - RNA, 21 nt, Human parainfluenza virus 3
agaaaagguuagaaaauauau

SEQ ID NO: 4012903 - RNA, 16 nt, Human parainfluenza virus 3
agaaaaucaaagagaa

SEQ ID NO: 4012904 - RNA, 14 nt, Human parainfluenza virus 3
agaaacucaaagaa

SEQ ID NO: 4012905 - RNA, 15 nt, Human parainfluenza virus 3
agaaacucaaagaag

SEQ ID NO: 4012906 - RNA, 16 nt, Human parainfluenza virus 3
agaaagaccaaaauga

SEQ ID NO: 4012907 - RNA, 15 nt, Human parainfluenza virus 3
agaaagucaaaucaa

SEQ ID NO: 4012908 - RNA, 16 nt, Human parainfluenza virus 3
agaaauacuaaugaaa

SEQ ID NO: 4012909 - RNA, 15 nt, Human parainfluenza virus 3
agaagaacagucaaa

SEQ ID NO: 4012910 - RNA, 15 nt, Human parainfluenza virus 3
agaagggacaaaaaa

SEQ ID NO: 4012911 - RNA, 22 nt, Human parainfluenza virus 3
agaagggacaaaaaaagcaaaa

SEQ ID NO: 4012912 - RNA, 15 nt, Human parainfluenza virus 3
agaagugagaagaac

SEQ ID NO: 4012913 - RNA, 15 nt, Human parainfluenza virus 3
agaaugaaacaauag

SEQ ID NO: 4012914 - RNA, 13 nt, Human parainfluenza virus 3
agacaaauccaaa

SEQ ID NO: 4012915 - RNA, 16 nt, Human parainfluenza virus 3
agacuaagaaaaggaa

SEQ ID NO: 4012916 - RNA, 23 nt, Human parainfluenza virus 3
agagacacuacuugcaaauaaua

SEQ ID NO: 4012917 - RNA, 21 nt, Human parainfluenza virus 3
agagauauuaaguucauacaa

SEQ ID NO: 4012918 - RNA, 20 nt, Human parainfluenza virus 3
agaggucaacaccaacaacu

SEQ ID NO: 4012919 - RNA, 12 nt, Human parainfluenza virus 3
agaguucuucuc

SEQ ID NO: 4012920 - RNA, 16 nt, Human parainfluenza virus 3
agauaauauauauauu

SEQ ID NO: 4012921 - RNA, 13 nt, Human parainfluenza virus 3
agauacaaaauga

SEQ ID NO: 4012922 - RNA, 19 nt, Human parainfluenza virus 3
agauauccagaaaugucaa

SEQ ID NO: 4012923 - RNA, 23 nt, Human parainfluenza virus 3
agauauuaaguucauacaaugaa

SEQ ID NO: 4012924 - RNA, 19 nt, Human parainfluenza virus 3
agaucgaaccgaacagaca

SEQ ID NO: 4012925 - RNA, 19 nt, Human parainfluenza virus 3
agaucuaaagaaaauggau

SEQ ID NO: 4012926 - RNA, 14 nt, Human parainfluenza virus 3
agaugacaaaagaa

SEQ ID NO: 4012927 - RNA, 13 nt, Human parainfluenza virus 3
agauuaugucaac

SEQ ID NO: 4012928 - RNA, 21 nt, Human parainfluenza virus 3
agcaaauguacuaaacaaugu

SEQ ID NO: 4012929 - RNA, 13 nt, Human parainfluenza virus 3
agcacaaaacaau

SEQ ID NO: 4012930 - RNA, 15 nt, Human parainfluenza virus 3
agcagaguucuucuc

SEQ ID NO: 4012931 - RNA, 18 nt, Human parainfluenza virus 3
agcagaucuaaagaaaau

SEQ ID NO: 4012932 - RNA, 21 nt, Human parainfluenza virus 3
agcucaacaaggccaaaucag

SEQ ID NO: 4012933 - RNA, 14 nt, Human parainfluenza virus 3
agcucgaaaugaga

SEQ ID NO: 4012934 - RNA, 21 nt, Human parainfluenza virus 3
aggaaaggaaggauacagaag

SEQ ID NO: 4012935 - RNA, 14 nt, Human parainfluenza virus 3
aggaggaaagaaag

SEQ ID NO: 4012936 - RNA, 14 nt, Human parainfluenza virus 3
aggauaaaauggac

SEQ ID NO: 4012937 - RNA, 13 nt, Human parainfluenza virus 3
aggcaaaauaaua

SEQ ID NO: 4012938 - RNA, 14 nt, Human parainfluenza virus 3
agggcagaagaaaa

SEQ ID NO: 4012939 - RNA, 19 nt, Human parainfluenza virus 3
agguggagcagaugucaaa

SEQ ID NO: 4012940 - RNA, 15 nt, Human parainfluenza virus 3
aguaagaaaaacaug

SEQ ID NO: 4012941 - RNA, 16 nt, Human parainfluenza virus 3
aguaagaaaaacaugu

SEQ ID NO: 4012942 - RNA, 18 nt, Human parainfluenza virus 3
aguaagaaaaacauguaa

SEQ ID NO: 4012943 - RNA, 22 nt, Human parainfluenza virus 3
aguacaaaauauaaaaccagaa

SEQ ID NO: 4012944 - RNA, 20 nt, Human parainfluenza virus 3
aguagaaauaaaucagaaaa

SEQ ID NO: 4012945 - RNA, 18 nt, Human parainfluenza virus 3
agucaacggauaucuaca

SEQ ID NO: 4012946 - RNA, 15 nt, Human parainfluenza virus 3
auaaaaccagaacua

SEQ ID NO: 4012947 - RNA, 14 nt, Human parainfluenza virus 3
auaaaugagaaugu

SEQ ID NO: 4012948 - RNA, 13 nt, Human parainfluenza virus 3
auaacaacacaga

SEQ ID NO: 4012949 - RNA, 14 nt, Human parainfluenza virus 3
auacaagaucuaca

SEQ ID NO: 4012950 - RNA, 19 nt, Human parainfluenza virus 3
auacaccaagaagaugaca

SEQ ID NO: 4012951 - RNA, 15 nt, Human parainfluenza virus 3
auacagacagaauca

SEQ ID NO: 4012952 - RNA, 12 nt, Human parainfluenza virus 3
auaccaagcaga

SEQ ID NO: 4012953 - RNA, 19 nt, Human parainfluenza virus 3
auaccugguauuaacagua

SEQ ID NO: 4012954 - RNA, 13 nt, Human parainfluenza virus 3
auagauaucacaa

SEQ ID NO: 4012955 - RNA, 22 nt, Human parainfluenza virus 3
auaggaggauggucaacuccau

SEQ ID NO: 4012956 - RNA, 18 nt, Human parainfluenza virus 3
auaguaggacaaagaaaa

SEQ ID NO: 4012957 - RNA, 20 nt, Human parainfluenza virus 3
auauaccaauaucauugaca

SEQ ID NO: 4012958 - RNA, 13 nt, Human parainfluenza virus 3
auauaggaaaauc

SEQ ID NO: 4012959 - RNA, 18 nt, Human parainfluenza virus 3
auauuauggacaauaauc

SEQ ID NO: 4012960 - RNA, 23 nt, Human parainfluenza virus 3
aucaacaguugauaaauaugaua

SEQ ID NO: 4012961 - RNA, 16 nt, Human parainfluenza virus 3
aucaacuuauacaaaa

SEQ ID NO: 4012962 - RNA, 21 nt, Human parainfluenza virus 3
aucacacgaauguacaacaga

SEQ ID NO: 4012963 - RNA, 19 nt, Human parainfluenza virus 3
aucagggacacaaacaaag

SEQ ID NO: 4012964 - RNA, 19 nt, Human parainfluenza virus 3
aucauucuuugaaaauggu

SEQ ID NO: 4012965 - RNA, 11 nt, Human parainfluenza virus 3
auccaaaauua

SEQ ID NO: 4012966 - RNA, 12 nt, Human parainfluenza virus 3
aucuaaagaaaa

SEQ ID NO: 4012967 - RNA, 18 nt, Human parainfluenza virus 3
aucucuacccaacacaau

SEQ ID NO: 4012968 - RNA, 15 nt, Human parainfluenza virus 3
aucuuugagcccaag

SEQ ID NO: 4012969 - RNA, 14 nt, Human parainfluenza virus 3
augaagaugucaau

SEQ ID NO: 4012970 - RNA, 12 nt, Human parainfluenza virus 3
augaugaagaag

SEQ ID NO: 4012971 - RNA, 23 nt, Human parainfluenza virus 3
auggacacugaaucuaacaaugg

SEQ ID NO: 4012972 - RNA, 22 nt, Human parainfluenza virus 3
auggagacacaagggauugaca

SEQ ID NO: 4012973 - RNA, 14 nt, Human parainfluenza virus 3
auguccagaauuau

SEQ ID NO: 4012974 - RNA, 23 nt, Human parainfluenza virus 3
auuaaaaaagggggaaaagggaa

SEQ ID NO: 4012975 - RNA, 17 nt, Human parainfluenza virus 3
auuaaccauaauaugca

SEQ ID NO: 4012976 - RNA, 19 nt, Human parainfluenza virus 3
auuaauaauauaucaaaag

SEQ ID NO: 4012977 - RNA, 19 nt, Human parainfluenza virus 3
auuaccagagcuucauagg

SEQ ID NO: 4012978 - RNA, 14 nt, Human parainfluenza virus 3
auuacucagaauua

SEQ ID NO: 4012979 - RNA, 17 nt, Human parainfluenza virus 3
auuauccuuaauucaaa

SEQ ID NO: 4012980 - RNA, 15 nt, Human parainfluenza virus 3
auuauuuacagaauc

SEQ ID NO: 4012981 - RNA, 14 nt, Human parainfluenza virus 3
auucaucauaaaug

SEQ ID NO: 4012982 - RNA, 15 nt, Human parainfluenza virus 3
auuccaaaaagcugc

SEQ ID NO: 4012983 - RNA, 15 nt, Human parainfluenza virus 3
auugaucaagagaaa

SEQ ID NO: 4012984 - RNA, 14 nt, Human parainfluenza virus 3
caaaaaugaugaag

SEQ ID NO: 4012985 - RNA, 16 nt, Human parainfluenza virus 3
caaaaaugaugaagaa

SEQ ID NO: 4012986 - RNA, 11 nt, Human parainfluenza virus 3
caaaacaaaaa

SEQ ID NO: 4012987 - RNA, 12 nt, Human parainfluenza virus 3
caaaauuacaau

SEQ ID NO: 4012988 - RNA, 23 nt, Human parainfluenza virus 3
caaaauuagccucaaaaaaugau

SEQ ID NO: 4012989 - RNA, 21 nt, Human parainfluenza virus 3
caaacacuaaacacaaugcca

SEQ ID NO: 4012990 - RNA, 14 nt, Human parainfluenza virus 3
caaacagaaauaca

SEQ ID NO: 4012991 - RNA, 18 nt, Human parainfluenza virus 3
caaacccaagacacaaaa

SEQ ID NO: 4012992 - RNA, 23 nt, Human parainfluenza virus 3
caaacgaguuguauguguagcaa

SEQ ID NO: 4012993 - RNA, 15 nt, Human parainfluenza virus 3
caaaugcaacaagac

SEQ ID NO: 4012994 - RNA, 14 nt, Human parainfluenza virus 3
caacacacacaaaa

SEQ ID NO: 4012995 - RNA, 14 nt, Human parainfluenza virus 3
caacacagcaaaca

SEQ ID NO: 4012996 - RNA, 13 nt, Human parainfluenza virus 3
caacaccaacaac

SEQ ID NO: 4012997 - RNA, 19 nt, Human parainfluenza virus 3
caacagaacaaaguagaaa

SEQ ID NO: 4012998 - RNA, 15 nt, Human parainfluenza virus 3
caacagaucaagcaa

SEQ ID NO: 4012999 - RNA, 23 nt, Human parainfluenza virus 3
caacauuuugauccaaauuaaua

SEQ ID NO: 4013000 - RNA, 13 nt, Human parainfluenza virus 3
caagaaacaacag

SEQ ID NO: 4013001 - RNA, 20 nt, Human parainfluenza virus 3
caagaaagaagggacaaaaa

SEQ ID NO: 4013002 - RNA, 17 nt, Human parainfluenza virus 3
caagacuaauacccaaa

SEQ ID NO: 4013003 - RNA, 23 nt, Human parainfluenza virus 3
caaggauagacaaaaaguaagaa

SEQ ID NO: 4013004 - RNA, 14 nt, Human parainfluenza virus 3
caauagauaucaau

SEQ ID NO: 4013005 - RNA, 14 nt, Human parainfluenza virus 3
caauaucaaucaau

SEQ ID NO: 4013006 - RNA, 14 nt, Human parainfluenza virus 3
cacaaaucacagcg

SEQ ID NO: 4013007 - RNA, 18 nt, Human parainfluenza virus 3
cacaacucccccaacaac

SEQ ID NO: 4013008 - RNA, 16 nt, Human parainfluenza virus 3
caccauugauaacaac

SEQ ID NO: 4013009 - RNA, 16 nt, Human parainfluenza virus 3
caccgaacaaacagac

SEQ ID NO: 4013010 - RNA, 16 nt, Human parainfluenza virus 3
cacugaaucuaacaau

SEQ ID NO: 4013011 - RNA, 15 nt, Human parainfluenza virus 3
cagaaauacagacag

SEQ ID NO: 4013012 - RNA, 12 nt, Human parainfluenza virus 3
cagaacaccaaa

SEQ ID NO: 4013013 - RNA, 19 nt, Human parainfluenza virus 3
cagaauugguuuugauauu

SEQ ID NO: 4013014 - RNA, 12 nt, Human parainfluenza virus 3
cagacaaacaca

SEQ ID NO: 4013015 - RNA, 16 nt, Human parainfluenza virus 3
cagacugauuccaaag

SEQ ID NO: 4013016 - RNA, 24 nt, Human parainfluenza virus 3
cagaucgaaccgaacagacaaaca

SEQ ID NO: 4013017 - RNA, 12 nt, Human parainfluenza virus 3
cagaugaugaag

SEQ ID NO: 4013018 - RNA, 12 nt, Human parainfluenza virus 3
cagccuuaugau

SEQ ID NO: 4013019 - RNA, 21 nt, Human parainfluenza virus 3
cagcugguauucaaaagggag

SEQ ID NO: 4013020 - RNA, 15 nt, Human parainfluenza virus 3
cagggauauauuaca

SEQ ID NO: 4013021 - RNA, 16 nt, Human parainfluenza virus 3
caguaaagugacugaa

SEQ ID NO: 4013022 - RNA, 15 nt, Human parainfluenza virus 3
caguuauaagcaaca

SEQ ID NO: 4013023 - RNA, 22 nt, Human parainfluenza virus 3
cauaaauacaauaaagauauau

SEQ ID NO: 4013024 - RNA, 13 nt, Human parainfluenza virus 3
cauacaaugaauc

SEQ ID NO: 4013025 - RNA, 18 nt, Human parainfluenza virus 3
cauaccaaaaauagaaga

SEQ ID NO: 4013026 - RNA, 19 nt, Human parainfluenza virus 3
cauacuagacucacagaaa

SEQ ID NO: 4013027 - RNA, 20 nt, Human parainfluenza virus 3
caucaaaagggcagaagaaa

SEQ ID NO: 4013028 - RNA, 19 nt, Human parainfluenza virus 3
ccaagauuaugucaacaaa

SEQ ID NO: 4013029 - RNA, 16 nt, Human parainfluenza virus 3
ccacgguauaaugaag

SEQ ID NO: 4013030 - RNA, 18 nt, Human parainfluenza virus 3
ccaugaucaaaacaaaau

SEQ ID NO: 4013031 - RNA, 16 nt, Human parainfluenza virus 3
ccauugauaacaacac

SEQ ID NO: 4013032 - RNA, 14 nt, Human parainfluenza virus 3
cccaaggauagaca

SEQ ID NO: 4013033 - RNA, 14 nt, Human parainfluenza virus 3
cccccaacaacaac

SEQ ID NO: 4013034 - RNA, 23 nt, Human parainfluenza virus 3
ccgaacaaacagacaagaaacaa

SEQ ID NO: 4013035 - RNA, 19 nt, Human parainfluenza virus 3
ccgggaaaacacagagaga

SEQ ID NO: 4013036 - RNA, 18 nt, Human parainfluenza virus 3
ccugaucuauaucgacau

SEQ ID NO: 4013037 - RNA, 18 nt, Human parainfluenza virus 3
cgaaauggaauugauauu

SEQ ID NO: 4013038 - RNA, 15 nt, Human parainfluenza virus 3
cgaacagacaaacac

SEQ ID NO: 4013039 - RNA, 21 nt, Human parainfluenza virus 3
cuacagauccacaucaaaagg

SEQ ID NO: 4013040 - RNA, 12 nt, Human parainfluenza virus 3
cuacuugcaaau

SEQ ID NO: 4013041 - RNA, 19 nt, Human parainfluenza virus 3
cugaucuauuaaaaauaaa

SEQ ID NO: 4013042 - RNA, 12 nt, Human parainfluenza virus 3
cugcaacaccag

SEQ ID NO: 4013043 - RNA, 20 nt, Human parainfluenza virus 3
cugcagguacauaucaaaac

SEQ ID NO: 4013044 - RNA, 22 nt, Human parainfluenza virus 3
cugcagguacauaucaaaacag

SEQ ID NO: 4013045 - RNA, 13 nt, Human parainfluenza virus 3
cuguacaauaaua

SEQ ID NO: 4013046 - RNA, 13 nt, Human parainfluenza virus 3
cuuaauuauaaau

SEQ ID NO: 4013047 - RNA, 14 nt, Human parainfluenza virus 3
cuuauaaaucagau

SEQ ID NO: 4013048 - RNA, 23 nt, Human parainfluenza virus 3
cuucaauacaccaagaagaugac

SEQ ID NO: 4013049 - RNA, 17 nt, Human parainfluenza virus 3
cuucgaaacaagauauu

SEQ ID NO: 4013050 - RNA, 13 nt, Human parainfluenza virus 3
cuucuuacaauuc

SEQ ID NO: 4013051 - RNA, 22 nt, Human parainfluenza virus 3
cuugaacauccaauaaaugaga

SEQ ID NO: 4013052 - RNA, 21 nt, Human parainfluenza virus 3
gaaacgacaccgaacaaacag

SEQ ID NO: 4013053 - RNA, 15 nt, Human parainfluenza virus 3
gaaagaaagaccaaa

SEQ ID NO: 4013054 - RNA, 14 nt, Human parainfluenza virus 3
gaaauuaauaauau

SEQ ID NO: 4013055 - RNA, 19 nt, Human parainfluenza virus 3
gaaguauuuauagcagaua

SEQ ID NO: 4013056 - RNA, 15 nt, Human parainfluenza virus 3
gaagugagaagaaca

SEQ ID NO: 4013057 - RNA, 15 nt, Human parainfluenza virus 3
gaaucaaagacaaau

SEQ ID NO: 4013058 - RNA, 15 nt, Human parainfluenza virus 3
gaaucacauagaaga

SEQ ID NO: 4013059 - RNA, 17 nt, Human parainfluenza virus 3
gaauucagauacuaucc

SEQ ID NO: 4013060 - RNA, 15 nt, Human parainfluenza virus 3
gacaaaaaguaagaa

SEQ ID NO: 4013061 - RNA, 22 nt, Human parainfluenza virus 3
gacaaauggaaaggaaaggaag

SEQ ID NO: 4013062 - RNA, 16 nt, Human parainfluenza virus 3
gacaauuuauaugaaa

SEQ ID NO: 4013063 - RNA, 20 nt, Human parainfluenza virus 3
gacaauuuauaugaaagaua

SEQ ID NO: 4013064 - RNA, 23 nt, Human parainfluenza virus 3
gacagaaucaucaggaacacaau

SEQ ID NO: 4013065 - RNA, 21 nt, Human parainfluenza virus 3
gacauaaauacaauaaagaua

SEQ ID NO: 4013066 - RNA, 16 nt, Human parainfluenza virus 3
gacauacaaaaugaga

SEQ ID NO: 4013067 - RNA, 21 nt, Human parainfluenza virus 3
gacauagaagugagaagaaca

SEQ ID NO: 4013068 - RNA, 22 nt, Human parainfluenza virus 3
gaccaaaaugaauccaaugaga

SEQ ID NO: 4013069 - RNA, 23 nt, Human parainfluenza virus 3
gagaaaagacauuugaugugaua

SEQ ID NO: 4013070 - RNA, 21 nt, Human parainfluenza virus 3
gagagcaaucgauuuacagag

SEQ ID NO: 4013071 - RNA, 22 nt, Human parainfluenza virus 3
gagagcaaucgauuuacagaga

SEQ ID NO: 4013072 - RNA, 11 nt, Human parainfluenza virus 3
gagcccaagga

SEQ ID NO: 4013073 - RNA, 19 nt, Human parainfluenza virus 3
gaguuuauggagauuacag

SEQ ID NO: 4013074 - RNA, 17 nt, Human parainfluenza virus 3
gauaaauaugauaucua

SEQ ID NO: 4013075 - RNA, 12 nt, Human parainfluenza virus 3
gaucaaaacaaa

SEQ ID NO: 4013076 - RNA, 12 nt, Human parainfluenza virus 3
gaucaagagaaa

SEQ ID NO: 4013077 - RNA, 21 nt, Human parainfluenza virus 3
gaucaggaaacuguacagaga

SEQ ID NO: 4013078 - RNA, 14 nt, Human parainfluenza virus 3
gauccagaguuuaa

SEQ ID NO: 4013079 - RNA, 12 nt, Human parainfluenza virus 3
gaugacaaaaga

SEQ ID NO: 4013080 - RNA, 20 nt, Human parainfluenza virus 3
gcaacacagcaaacacuaaa

SEQ ID NO: 4013081 - RNA, 20 nt, Human parainfluenza virus 3
gcaacaccagaugaugaaga

SEQ ID NO: 4013082 - RNA, 13 nt, Human parainfluenza virus 3
gcaaguuaaauca

SEQ ID NO: 4013083 - RNA, 17 nt, Human parainfluenza virus 3
gcaaucagggacacaaa

SEQ ID NO: 4013084 - RNA, 16 nt, Human parainfluenza virus 3
gcaaucucucacaaag

SEQ ID NO: 4013085 - RNA, 22 nt, Human parainfluenza virus 3
gcagaaucuugguguaauucaa

SEQ ID NO: 4013086 - RNA, 19 nt, Human parainfluenza virus 3
gcauccaacgaaucacgaa

SEQ ID NO: 4013087 - RNA, 23 nt, Human parainfluenza virus 3
gcauccauuaagccgaagcaaau

SEQ ID NO: 4013088 - RNA, 20 nt, Human parainfluenza virus 3
gccucauaccaaaaauagaa

SEQ ID NO: 4013089 - RNA, 15 nt, Human parainfluenza virus 3
gcuaucaaaauuagc

SEQ ID NO: 4013090 - RNA, 18 nt, Human parainfluenza virus 3
gcuuaaacucaauuccaa

SEQ ID NO: 4013091 - RNA, 18 nt, Human parainfluenza virus 3
gcuucaucaguagagauu

SEQ ID NO: 4013092 - RNA, 23 nt, Human parainfluenza virus 3
gcuucaucaguagagauuacaag

SEQ ID NO: 4013093 - RNA, 23 nt, Human parainfluenza virus 3
gcuugcaacucaaucaauagaga

SEQ ID NO: 4013094 - RNA, 12 nt, Human parainfluenza virus 3
ggaacaagaaag

SEQ ID NO: 4013095 - RNA, 15 nt, Human parainfluenza virus 3
ggacaacgacacaaa

SEQ ID NO: 4013096 - RNA, 19 nt, Human parainfluenza virus 3
ggacauguucaaugaagau

SEQ ID NO: 4013097 - RNA, 20 nt, Human parainfluenza virus 3
ggaucaacuuauacaaaaga

SEQ ID NO: 4013098 - RNA, 18 nt, Human parainfluenza virus 3
ggcaucuuucugccaaau

SEQ ID NO: 4013099 - RNA, 17 nt, Human parainfluenza virus 3
ggccaucagaaacagaa

SEQ ID NO: 4013100 - RNA, 22 nt, Human parainfluenza virus 3
ggccaucagaaacagaacacuc

SEQ ID NO: 4013101 - RNA, 11 nt, Human parainfluenza virus 3
gggaugaagau

SEQ ID NO: 4013102 - RNA, 21 nt, Human parainfluenza virus 3
guacaccugauacaagaucaa

SEQ ID NO: 4013103 - RNA, 21 nt, Human parainfluenza virus 3
guacuaaacaauguagauacu

SEQ ID NO: 4013104 - RNA, 15 nt, Human parainfluenza virus 3
guaggacaaagaaaa

SEQ ID NO: 4013105 - RNA, 23 nt, Human parainfluenza virus 3
gucucuggaggaaucuccagaag

SEQ ID NO: 4013106 - RNA, 18 nt, Human parainfluenza virus 3
gugagaagaacagucaaa

SEQ ID NO: 4013107 - RNA, 18 nt, Human parainfluenza virus 3
uaaaaccuuuaaauccag

SEQ ID NO: 4013108 - RNA, 21 nt, Human parainfluenza virus 3
uaaaucagaaaaguucaaaca

SEQ ID NO: 4013109 - RNA, 16 nt, Human parainfluenza virus 3
uaacacagauacaaaa

SEQ ID NO: 4013110 - RNA, 13 nt, Human parainfluenza virus 3
uaagaaaaacaug

SEQ ID NO: 4013111 - RNA, 15 nt, Human parainfluenza virus 3
uaauaaauucauaga

SEQ ID NO: 4013112 - RNA, 23 nt, Human parainfluenza virus 3
uaauaacuguaaacucagacuug

SEQ ID NO: 4013113 - RNA, 15 nt, Human parainfluenza virus 3
uaauaguagcaauca

SEQ ID NO: 4013114 - RNA, 19 nt, Human parainfluenza virus 3
uaaucccagaacaaaacga

SEQ ID NO: 4013115 - RNA, 14 nt, Human parainfluenza virus 3
uacaaaagaaucaa

SEQ ID NO: 4013116 - RNA, 18 nt, Human parainfluenza virus 3
uacagaacaccaaaacaa

SEQ ID NO: 4013117 - RNA, 14 nt, Human parainfluenza virus 3
uacccaacacaaua

SEQ ID NO: 4013118 - RNA, 22 nt, Human parainfluenza virus 3
uacugacaaccagauaccaaca

SEQ ID NO: 4013119 - RNA, 22 nt, Human parainfluenza virus 3
uagacucuuugcaaaaaugaca

SEQ ID NO: 4013120 - RNA, 20 nt, Human parainfluenza virus 3
uagauacugcaucaaagaua

SEQ ID NO: 4013121 - RNA, 15 nt, Human parainfluenza virus 3
uagcaaucaaaucag

SEQ ID NO: 4013122 - RNA, 12 nt, Human parainfluenza virus 3
uaggacaaagaa

SEQ ID NO: 4013123 - RNA, 19 nt, Human parainfluenza virus 3
uaggaucauuacaagaaaa

SEQ ID NO: 4013124 - RNA, 15 nt, Human parainfluenza virus 3
uauaccaagcagagu

SEQ ID NO: 4013125 - RNA, 16 nt, Human parainfluenza virus 3
uauaucuuaaccuuua

SEQ ID NO: 4013126 - RNA, 13 nt, Human parainfluenza virus 3
uaucauugacaca

SEQ ID NO: 4013127 - RNA, 18 nt, Human parainfluenza virus 3
uauccacuaaaucccaca

SEQ ID NO: 4013128 - RNA, 20 nt, Human parainfluenza virus 3
uaucggaaaacgacacaauc

SEQ ID NO: 4013129 - RNA, 15 nt, Human parainfluenza virus 3
uaucuuugagcccaa

SEQ ID NO: 4013130 - RNA, 17 nt, Human parainfluenza virus 3
uauguacuaacaaacaa

SEQ ID NO: 4013131 - RNA, 18 nt, Human parainfluenza virus 3
uauuaaguucauacaaug

SEQ ID NO: 4013132 - RNA, 13 nt, Human parainfluenza virus 3
ucaaaaacaacaa

SEQ ID NO: 4013133 - RNA, 23 nt, Human parainfluenza virus 3
ucaaaagaaauguucaaauuaua

SEQ ID NO: 4013134 - RNA, 15 nt, Human parainfluenza virus 3
ucaaaccaacagaaa

SEQ ID NO: 4013135 - RNA, 14 nt, Human parainfluenza virus 3
ucaacuuauacaaa

SEQ ID NO: 4013136 - RNA, 13 nt, Human parainfluenza virus 3
ucaagaaaacuag

SEQ ID NO: 4013137 - RNA, 15 nt, Human parainfluenza virus 3
ucaagagaaaaauag

SEQ ID NO: 4013138 - RNA, 16 nt, Human parainfluenza virus 3
ucaagagauaaaucaa

SEQ ID NO: 4013139 - RNA, 13 nt, Human parainfluenza virus 3
ucaauacaaacaa

SEQ ID NO: 4013140 - RNA, 15 nt, Human parainfluenza virus 3
ucaauauacaaauaa

SEQ ID NO: 4013141 - RNA, 20 nt, Human parainfluenza virus 3
ucaauccacaucaaaacuag

SEQ ID NO: 4013142 - RNA, 14 nt, Human parainfluenza virus 3
ucaaugaaauuaga

SEQ ID NO: 4013143 - RNA, 20 nt, Human parainfluenza virus 3
ucaauggacaacgacacaaa

SEQ ID NO: 4013144 - RNA, 21 nt, Human parainfluenza virus 3
ucagauauugagaaacucaaa

SEQ ID NO: 4013145 - RNA, 17 nt, Human parainfluenza virus 3
ucagggacacaaacaaa

SEQ ID NO: 4013146 - RNA, 14 nt, Human parainfluenza virus 3
ucauacuuucaaca

SEQ ID NO: 4013147 - RNA, 15 nt, Human parainfluenza virus 3
ucgauuuacagagag

SEQ ID NO: 4013148 - RNA, 20 nt, Human parainfluenza virus 3
ucgcaggaacaagaaagaag

SEQ ID NO: 4013149 - RNA, 20 nt, Human parainfluenza virus 3
ucggaaaacgacacaaucaa

SEQ ID NO: 4013150 - RNA, 18 nt, Human parainfluenza virus 3
ucggauugaucaagagaa

SEQ ID NO: 4013151 - RNA, 16 nt, Human parainfluenza virus 3
ucggcaauagaaucaa

SEQ ID NO: 4013152 - RNA, 12 nt, Human parainfluenza virus 3
ucuaacaauggc

SEQ ID NO: 4013153 - RNA, 14 nt, Human parainfluenza virus 3
ucuagaagaaucaa

SEQ ID NO: 4013154 - RNA, 17 nt, Human parainfluenza virus 3
ucuaucaacacacacaa

SEQ ID NO: 4013155 - RNA, 16 nt, Human parainfluenza virus 3
ucuuaaccuuuaucuu

SEQ ID NO: 4013156 - RNA, 21 nt, Human parainfluenza virus 3
ugagaagaacagucaaagcga

SEQ ID NO: 4013157 - RNA, 12 nt, Human parainfluenza virus 3
ugauaacaacac

SEQ ID NO: 4013158 - RNA, 16 nt, Human parainfluenza virus 3
ugauaacauaggauca

SEQ ID NO: 4013159 - RNA, 14 nt, Human parainfluenza virus 3
ugauagaaaaucaa

SEQ ID NO: 4013160 - RNA, 23 nt, Human parainfluenza virus 3
ugauaguaaccaaucaggaaucc

SEQ ID NO: 4013161 - RNA, 23 nt, Human parainfluenza virus 3
ugauauaaggauaaaauggacau

SEQ ID NO: 4013162 - RNA, 15 nt, Human parainfluenza virus 3
ugaucaagagaaaaa

SEQ ID NO: 4013163 - RNA, 14 nt, Human parainfluenza virus 3
ugaugaagaagaaa

SEQ ID NO: 4013164 - RNA, 19 nt, Human parainfluenza virus 3
ugcaaauaauauaggaaaa

SEQ ID NO: 4013165 - RNA, 19 nt, Human parainfluenza virus 3
ugcuaucuucuguacaaua

SEQ ID NO: 4013166 - RNA, 18 nt, Human parainfluenza virus 3
ugcucggaaaauggacac

SEQ ID NO: 4013167 - RNA, 17 nt, Human parainfluenza virus 3
uggauauacaacaacaa

SEQ ID NO: 4013168 - RNA, 15 nt, Human parainfluenza virus 3
uggcauaaugugcua

SEQ ID NO: 4013169 - RNA, 22 nt, Human parainfluenza virus 3
uguaauauauauauaccaagca

SEQ ID NO: 4013170 - RNA, 15 nt, Human parainfluenza virus 3
uguacuaacaaacaa

SEQ ID NO: 4013171 - RNA, 19 nt, Human parainfluenza virus 3
uuaauaauaaauaagaaaa

SEQ ID NO: 4013172 - RNA, 22 nt, Human parainfluenza virus 3
uuaauauuaacugagaaaguga

SEQ ID NO: 4013173 - RNA, 14 nt, Human parainfluenza virus 3
uuaauuucaaaucu

SEQ ID NO: 4013174 - RNA, 20 nt, Human parainfluenza virus 3
uuacaacagaacaaaguaga

SEQ ID NO: 4013175 - RNA, 16 nt, Human parainfluenza virus 3
uuaccacucaaaguca

SEQ ID NO: 4013176 - RNA, 18 nt, Human parainfluenza virus 3
uuagaagauuaaaauuaa

SEQ ID NO: 4013177 - RNA, 17 nt, Human parainfluenza virus 3
uuaggauuaaagaauaa

SEQ ID NO: 4013178 - RNA, 17 nt, Human parainfluenza virus 3
uuaucuuugagcccaag

SEQ ID NO: 4013179 - RNA, 19 nt, Human parainfluenza virus 3
uucgaaauggaacgaauca

SEQ ID NO: 4013180 - RNA, 22 nt, Human parainfluenza virus 3
uucuaaaaauggaacccagaac

SEQ ID NO: 4013181 - RNA, 20 nt, Human parainfluenza virus 3
uugaacauccaauaaaugag

SEQ ID NO: 4013182 - RNA, 14 nt, Human parainfluenza virus 3
uugcaaaaaugaca

SEQ ID NO: 4013183 - RNA, 17 nt, Human parainfluenza virus 3
uugcaguuauaagcaac

SEQ ID NO: 4013184 - RNA, 13 nt, Human parainfluenza virus 3
uugggaaaaucaa

SEQ ID NO: 4013185 - RNA, 17 nt, Human parainfluenza virus 3
uuuaagaaaucaaaaga

SEQ ID NO: 4013186 - RNA, 15 nt, Human parainfluenza virus 3
agcaggcaagaucag

SEQ ID NO: 4013187 - RNA, 22 nt, Human parainfluenza virus 3
agccauauguacuaacaaacaa

SEQ ID NO: 4013188 - RNA, 22 nt, Human parainfluenza virus 3
agcuguuuccuaacaacagauc

SEQ ID NO: 4013189 - RNA, 21 nt, Human parainfluenza virus 3
aggaaaauucuuucaagagaa

SEQ ID NO: 4013190 - RNA, 17 nt, Human parainfluenza virus 3
aggaaacuguacagaga

SEQ ID NO: 4013191 - RNA, 18 nt, Human parainfluenza virus 3
aggauacagaagagagca

SEQ ID NO: 4013192 - RNA, 14 nt, Human parainfluenza virus 3
aggaucauuacaag

SEQ ID NO: 4013193 - RNA, 16 nt, Human parainfluenza virus 3
agggauugacaagaau

SEQ ID NO: 4013194 - RNA, 15 nt, Human parainfluenza virus 3
agggcgaaaaaucac

SEQ ID NO: 4013195 - RNA, 15 nt, Human parainfluenza virus 3
agguuagaaaauaua

SEQ ID NO: 4013196 - RNA, 18 nt, Human parainfluenza virus 3
agucagcugguauucaaa

SEQ ID NO: 4013197 - RNA, 15 nt, Human parainfluenza virus 3
agucuucaugucaau

SEQ ID NO: 4013198 - RNA, 14 nt, Human parainfluenza virus 3
aguuaaaucagaga

SEQ ID NO: 4013199 - RNA, 20 nt, Human parainfluenza virus 3
aguuuauggagauuacagaa

SEQ ID NO: 4013200 - RNA, 17 nt, Human parainfluenza virus 3
auaaagauauaucuuaa

SEQ ID NO: 4013201 - RNA, 17 nt, Human parainfluenza virus 3
auaaagcauuaucucca

SEQ ID NO: 4013202 - RNA, 15 nt, Human parainfluenza virus 3
auaaaucagaaaagu

SEQ ID NO: 4013203 - RNA, 13 nt, Human parainfluenza virus 3
auaaaucagauaa

SEQ ID NO: 4013204 - RNA, 14 nt, Human parainfluenza virus 3
auaacaacaagcuc

SEQ ID NO: 4013205 - RNA, 19 nt, Human parainfluenza virus 3
auaaccuuguucaaaauuc

SEQ ID NO: 4013206 - RNA, 16 nt, Human parainfluenza virus 3
auaacuuguuagaaga

SEQ ID NO: 4013207 - RNA, 14 nt, Human parainfluenza virus 3
auaagauaauauau

SEQ ID NO: 4013208 - RNA, 15 nt, Human parainfluenza virus 3
auaauacaaguauau

SEQ ID NO: 4013209 - RNA, 21 nt, Human parainfluenza virus 3
auaaucaaaaacuuaggacaa

SEQ ID NO: 4013210 - RNA, 17 nt, Human parainfluenza virus 3
auacaaauaagaaaaac

SEQ ID NO: 4013211 - RNA, 16 nt, Human parainfluenza virus 3
auacaaguauaugaua

SEQ ID NO: 4013212 - RNA, 11 nt, Human parainfluenza virus 3
auagacugauc

SEQ ID NO: 4013213 - RNA, 19 nt, Human parainfluenza virus 3
auaguagcaaucaaaucag

SEQ ID NO: 4013214 - RNA, 16 nt, Human parainfluenza virus 3
auauaccaagcagagu

SEQ ID NO: 4013215 - RNA, 14 nt, Human parainfluenza virus 3
auaucacaaaacua

SEQ ID NO: 4013216 - RNA, 14 nt, Human parainfluenza virus 3
auauccagaaaugu

SEQ ID NO: 4013217 - RNA, 17 nt, Human parainfluenza virus 3
auauuaacugagaaagu

SEQ ID NO: 4013218 - RNA, 15 nt, Human parainfluenza virus 3
aucaaaccaacagaa

SEQ ID NO: 4013219 - RNA, 23 nt, Human parainfluenza virus 3
aucaaaccaacagaaacaaguga

SEQ ID NO: 4013220 - RNA, 21 nt, Human parainfluenza virus 3
aucaacugacaaaaauagaca

SEQ ID NO: 4013221 - RNA, 19 nt, Human parainfluenza virus 3
aucaacuuauacaaaagaa

SEQ ID NO: 4013222 - RNA, 22 nt, Human parainfluenza virus 3
aucacagcggcgguugcucugg

SEQ ID NO: 4013223 - RNA, 19 nt, Human parainfluenza virus 3
aucagaaaucuaagaaauu

SEQ ID NO: 4013224 - RNA, 14 nt, Human parainfluenza virus 3
aucagauaaauggu

SEQ ID NO: 4013225 - RNA, 15 nt, Human parainfluenza virus 3
aucagauaaauggua

SEQ ID NO: 4013226 - RNA, 23 nt, Human parainfluenza virus 3
aucauguguuauccgaaauggaa

SEQ ID NO: 4013227 - RNA, 18 nt, Human parainfluenza virus 3
auccaaaaugaguauaac

SEQ ID NO: 4013228 - RNA, 17 nt, Human parainfluenza virus 3
auccaugaucaaaacaa

SEQ ID NO: 4013229 - RNA, 14 nt, Human parainfluenza virus 3
aucgagaaaaugag

SEQ ID NO: 4013230 - RNA, 22 nt, Human parainfluenza virus 3
aucuaucaacacacacaaaauc

SEQ ID NO: 4013231 - RNA, 21 nt, Human parainfluenza virus 3
aucuauuauuuacagaaucaa

SEQ ID NO: 4013232 - RNA, 23 nt, Human parainfluenza virus 3
aucucaaaaacaacaaccaucaa

SEQ ID NO: 4013233 - RNA, 20 nt, Human parainfluenza virus 3
aucucuacccaacacaauau

SEQ ID NO: 4013234 - RNA, 22 nt, Human parainfluenza virus 3
aucugauuuaugcuuauaccuc

SEQ ID NO: 4013235 - RNA, 21 nt, Human parainfluenza virus 3
augagaagggcgaaaaaucac

SEQ ID NO: 4013236 - RNA, 14 nt, Human parainfluenza virus 3
augauaaucaagaa

SEQ ID NO: 4013237 - RNA, 18 nt, Human parainfluenza virus 3
augauaugagaagauuac

SEQ ID NO: 4013238 - RNA, 23 nt, Human parainfluenza virus 3
auggaaagcgaugcuaaaaacua

SEQ ID NO: 4013239 - RNA, 19 nt, Human parainfluenza virus 3
auggaacgaaucaaagaca

SEQ ID NO: 4013240 - RNA, 20 nt, Human parainfluenza virus 3
auggacaacgacacaaaauu

SEQ ID NO: 4013241 - RNA, 21 nt, Human parainfluenza virus 3
auggacaacgacacaaaauua

SEQ ID NO: 4013242 - RNA, 18 nt, Human parainfluenza virus 3
auggcacuguaucugaca

SEQ ID NO: 4013243 - RNA, 23 nt, Human parainfluenza virus 3
auggcaucuuucugccaaauaga

SEQ ID NO: 4013244 - RNA, 14 nt, Human parainfluenza virus 3
auguauaucaacug

SEQ ID NO: 4013245 - RNA, 13 nt, Human parainfluenza virus 3
augucaacaaaga

SEQ ID NO: 4013246 - RNA, 21 nt, Human parainfluenza virus 3
auuaacacagauacaaaauga

SEQ ID NO: 4013247 - RNA, 22 nt, Human parainfluenza virus 3
auuaacacagauacaaaaugaa

SEQ ID NO: 4013248 - RNA, 19 nt, Human parainfluenza virus 3
auuaacaguaaagugacug

SEQ ID NO: 4013249 - RNA, 22 nt, Human parainfluenza virus 3
auuaauggacauguucaaugaa

SEQ ID NO: 4013250 - RNA, 20 nt, Human parainfluenza virus 3
auuacaagguauagcaucau

SEQ ID NO: 4013251 - RNA, 18 nt, Human parainfluenza virus 3
auuacacacuaugacaaa

SEQ ID NO: 4013252 - RNA, 12 nt, Human parainfluenza virus 3
auuauauauacc

SEQ ID NO: 4013253 - RNA, 23 nt, Human parainfluenza virus 3
auuaucuccaaaaaaaucaaauu

SEQ ID NO: 4013254 - RNA, 19 nt, Human parainfluenza virus 3
auuaugggagaaaagacau

SEQ ID NO: 4013255 - RNA, 19 nt, Human parainfluenza virus 3
auuaugucaacaaagaaau

SEQ ID NO: 4013256 - RNA, 14 nt, Human parainfluenza virus 3
auucacaacaucaa

SEQ ID NO: 4013257 - RNA, 18 nt, Human parainfluenza virus 3
auucauuagugaaauuac

SEQ ID NO: 4013258 - RNA, 16 nt, Human parainfluenza virus 3
auugacaagaauauac

SEQ ID NO: 4013259 - RNA, 15 nt, Human parainfluenza virus 3
auugaucucaaugaa

SEQ ID NO: 4013260 - RNA, 14 nt, Human parainfluenza virus 3
auuuacagaaucaa

SEQ ID NO: 4013261 - RNA, 19 nt, Human parainfluenza virus 3
auuucaaaucuuaaaauua

SEQ ID NO: 4013262 - RNA, 21 nt, Human parainfluenza virus 3
auuuucucuuuuuuuagaaca

SEQ ID NO: 4013263 - RNA, 15 nt, Human parainfluenza virus 3
caaaacuauaauggu

SEQ ID NO: 4013264 - RNA, 14 nt, Human parainfluenza virus 3
caaaaggaaaauau

SEQ ID NO: 4013265 - RNA, 16 nt, Human parainfluenza virus 3
caaaagggcagaagaa

SEQ ID NO: 4013266 - RNA, 21 nt, Human parainfluenza virus 3
caaaaugacaagccauaugua

SEQ ID NO: 4013267 - RNA, 14 nt, Human parainfluenza virus 3
caaagaagcaauca

SEQ ID NO: 4013268 - RNA, 18 nt, Human parainfluenza virus 3
caaagaauguauagaagc

SEQ ID NO: 4013269 - RNA, 19 nt, Human parainfluenza virus 3
caaaguagauuccauauca

SEQ ID NO: 4013270 - RNA, 21 nt, Human parainfluenza virus 3
caacaagacuaauacccaaaa

SEQ ID NO: 4013271 - RNA, 14 nt, Human parainfluenza virus 3
caacagaucaagca

SEQ ID NO: 4013272 - RNA, 22 nt, Human parainfluenza virus 3
caacagcaacugaaagaguaaa

SEQ ID NO: 4013273 - RNA, 13 nt, Human parainfluenza virus 3
caacgacacaaaa

SEQ ID NO: 4013274 - RNA, 16 nt, Human parainfluenza virus 3
caagaagaugacaaaa

SEQ ID NO: 4013275 - RNA, 20 nt, Human parainfluenza virus 3
caaucaggaauccaaugaaa

SEQ ID NO: 4013276 - RNA, 22 nt, Human parainfluenza virus 3
caaucagggacacaaacaaagc

SEQ ID NO: 4013277 - RNA, 23 nt, Human parainfluenza virus 3
caaucucucacaaagcacaaaac

SEQ ID NO: 4013278 - RNA, 14 nt, Human parainfluenza virus 3
caauuagaaaugau

SEQ ID NO: 4013279 - RNA, 19 nt, Human parainfluenza virus 3
cacaaaggggcaaacagaa

SEQ ID NO: 4013280 - RNA, 14 nt, Human parainfluenza virus 3
cacaaauaucacag

SEQ ID NO: 4013281 - RNA, 12 nt, Human parainfluenza virus 3
cacaauaucaau

SEQ ID NO: 4013282 - RNA, 15 nt, Human parainfluenza virus 3
caccaaaacaacaaa

SEQ ID NO: 4013283 - RNA, 21 nt, Human parainfluenza virus 3
caccagaugaugaagaagaaa

SEQ ID NO: 4013284 - RNA, 23 nt, Human parainfluenza virus 3
cagaaaaucgagaaaaugagauu

SEQ ID NO: 4013285 - RNA, 18 nt, Human parainfluenza virus 3
cagaacaaaguagaaaca

SEQ ID NO: 4013286 - RNA, 21 nt, Human parainfluenza virus 3
cagaacaccaaaacaacaaaa

SEQ ID NO: 4013287 - RNA, 18 nt, Human parainfluenza virus 3
cagaagcaaaagauagaa

SEQ ID NO: 4013288 - RNA, 23 nt, Human parainfluenza virus 3
cagauaguagagcugagacugug

SEQ ID NO: 4013289 - RNA, 13 nt, Human parainfluenza virus 3
cagauauuaagau

SEQ ID NO: 4013290 - RNA, 22 nt, Human parainfluenza virus 3
cagaugaugaagaagaaauacu

SEQ ID NO: 4013291 - RNA, 19 nt, Human parainfluenza virus 3
cagcaaucucucacaaagc

SEQ ID NO: 4013292 - RNA, 22 nt, Human parainfluenza virus 3
cagcaaucucucacaaagcaca

SEQ ID NO: 4013293 - RNA, 23 nt, Human parainfluenza virus 3
cagcagaaaagguuagaaaauau

SEQ ID NO: 4013294 - RNA, 16 nt, Human parainfluenza virus 3
caggagugaacacaag

SEQ ID NO: 4013295 - RNA, 17 nt, Human parainfluenza virus 3
cauacuuucaacauaaa

SEQ ID NO: 4013296 - RNA, 15 nt, Human parainfluenza virus 3
cauagaagauugaua

SEQ ID NO: 4013297 - RNA, 23 nt, Human parainfluenza virus 3
cauauaguagaaauaaaucagaa

SEQ ID NO: 4013298 - RNA, 12 nt, Human parainfluenza virus 3
caugaaauggag

SEQ ID NO: 4013299 - RNA, 21 nt, Human parainfluenza virus 3
cauguguuauccgaaauggaa

SEQ ID NO: 4013300 - RNA, 15 nt, Human parainfluenza virus 3
ccaaggauagacaaa

SEQ ID NO: 4013301 - RNA, 19 nt, Human parainfluenza virus 3
ccaaugauccaacaaagaa

SEQ ID NO: 4013302 - RNA, 23 nt, Human parainfluenza virus 3
ccugguauuaacaguaaagugac

SEQ ID NO: 4013303 - RNA, 18 nt, Human parainfluenza virus 3
ccuuuaucuuugagccca

SEQ ID NO: 4013304 - RNA, 14 nt, Human parainfluenza virus 3
cgaaucaaagacaa

SEQ ID NO: 4013305 - RNA, 18 nt, Human parainfluenza virus 3
cgacaugcaggaaauaca

SEQ ID NO: 4013306 - RNA, 15 nt, Human parainfluenza virus 3
cgauaauuacaauug

SEQ ID NO: 4013307 - RNA, 17 nt, Human parainfluenza virus 3
cgcaggaacaagaaaga

SEQ ID NO: 4013308 - RNA, 14 nt, Human parainfluenza virus 3
cuacaauagaugaa

SEQ ID NO: 4013309 - RNA, 20 nt, Human parainfluenza virus 3
cuacaaugauggauaugaga

SEQ ID NO: 4013310 - RNA, 15 nt, Human parainfluenza virus 3
cuagauuuauaucaa

SEQ ID NO: 4013311 - RNA, 16 nt, Human parainfluenza virus 3
cuagguugugaagcag

SEQ ID NO: 4013312 - RNA, 15 nt, Human parainfluenza virus 3
cuauauauauacaag

SEQ ID NO: 4013313 - RNA, 16 nt, Human parainfluenza virus 3
cuaucaacacacacaa

SEQ ID NO: 4013314 - RNA, 12 nt, Human parainfluenza virus 3
cucaaaaaauac

SEQ ID NO: 4013315 - RNA, 20 nt, Human parainfluenza virus 3
cuguucgaugccaacaaagu

SEQ ID NO: 4013316 - RNA, 12 nt, Human parainfluenza virus 3
cuuaaaucccag

SEQ ID NO: 4013317 - RNA, 13 nt, Human parainfluenza virus 3
cuuccaaucagaa

SEQ ID NO: 4013318 - RNA, 17 nt, Human parainfluenza virus 3
gaaaacacuaaucccag

SEQ ID NO: 4013319 - RNA, 22 nt, Human parainfluenza virus 3
gaaaacacuaaucccagaacaa

SEQ ID NO: 4013320 - RNA, 16 nt, Human parainfluenza virus 3
gaaaagaucaagaaaa

SEQ ID NO: 4013321 - RNA, 16 nt, Human parainfluenza virus 3
gaaaaucaaacaaugg

SEQ ID NO: 4013322 - RNA, 13 nt, Human parainfluenza virus 3
gaaaaucaaagag

SEQ ID NO: 4013323 - RNA, 19 nt, Human parainfluenza virus 3
gaaaaucgagaaaaugaga

SEQ ID NO: 4013324 - RNA, 18 nt, Human parainfluenza virus 3
gaaacucaaagaagcaau

SEQ ID NO: 4013325 - RNA, 20 nt, Human parainfluenza virus 3
gaaagacugguuuaagaaau

SEQ ID NO: 4013326 - RNA, 13 nt, Human parainfluenza virus 3
gaaaugauaauca

SEQ ID NO: 4013327 - RNA, 23 nt, Human parainfluenza virus 3
gaacagucaaagcgaaagagaug

SEQ ID NO: 4013328 - RNA, 14 nt, Human parainfluenza virus 3
gaagaaaagaucaa

SEQ ID NO: 4013329 - RNA, 20 nt, Human parainfluenza virus 3
gaaggauacagaagagagca

SEQ ID NO: 4013330 - RNA, 13 nt, Human parainfluenza virus 3
gaagugagaagaa

SEQ ID NO: 4013331 - RNA, 17 nt, Human parainfluenza virus 3
gaaucaaagacaaauac

SEQ ID NO: 4013332 - RNA, 17 nt, Human parainfluenza virus 3
gaaucaauccgaacaaa

SEQ ID NO: 4013333 - RNA, 21 nt, Human parainfluenza virus 3
gacacaaaauuaacacagaua

SEQ ID NO: 4013334 - RNA, 21 nt, Human parainfluenza virus 3
gacacaaaggggcaaacagaa

SEQ ID NO: 4013335 - RNA, 22 nt, Human parainfluenza virus 3
gacacuacuugcaaauaauaua

SEQ ID NO: 4013336 - RNA, 15 nt, Human parainfluenza virus 3
gacacuguuaauaaa

SEQ ID NO: 4013337 - RNA, 16 nt, Human parainfluenza virus 3
gacugguuuaagaaau

SEQ ID NO: 4013338 - RNA, 23 nt, Human parainfluenza virus 3
gacugguuuaagaaaucaaaaga

SEQ ID NO: 4013339 - RNA, 16 nt, Human parainfluenza virus 3
gagaaacucaaagaag

SEQ ID NO: 4013340 - RNA, 10 nt, Human parainfluenza virus 3
gagcccaagg

SEQ ID NO: 4013341 - RNA, 16 nt, Human parainfluenza virus 3
gagcccaaggauagac

SEQ ID NO: 4013342 - RNA, 15 nt, Human parainfluenza virus 3
gauaagaaagucaaa

SEQ ID NO: 4013343 - RNA, 16 nt, Human parainfluenza virus 3
gauacugcaucaaaga

SEQ ID NO: 4013344 - RNA, 17 nt, Human parainfluenza virus 3
gauauuacugauuacag

SEQ ID NO: 4013345 - RNA, 19 nt, Human parainfluenza virus 3
gaucuauuaaaaauaaaaa

SEQ ID NO: 4013346 - RNA, 22 nt, Human parainfluenza virus 3
gaugaggauuugacaauuuaua

SEQ ID NO: 4013347 - RNA, 13 nt, Human parainfluenza virus 3
gaugaugaagaag

SEQ ID NO: 4013348 - RNA, 17 nt, Human parainfluenza virus 3
gauugauagaaaaucaa

SEQ ID NO: 4013349 - RNA, 12 nt, Human parainfluenza virus 3
gcaaaaaugaug

SEQ ID NO: 4013350 - RNA, 17 nt, Human parainfluenza virus 3
gcaaaaaugaugaagaa

SEQ ID NO: 4013351 - RNA, 20 nt, Human parainfluenza virus 3
gcagguacauaucaaaacag

SEQ ID NO: 4013352 - RNA, 22 nt, Human parainfluenza virus 3
gcagucauacucgcaggaacaa

SEQ ID NO: 4013353 - RNA, 20 nt, Human parainfluenza virus 3
gccaaauagauaucacaaaa

SEQ ID NO: 4013354 - RNA, 18 nt, Human parainfluenza virus 3
gcuaaaccucaaagcaga

SEQ ID NO: 4013355 - RNA, 17 nt, Human parainfluenza virus 3
ggaaugaccaggaauua

SEQ ID NO: 4013356 - RNA, 13 nt, Human parainfluenza virus 3
ggauauaggaaaa

SEQ ID NO: 4013357 - RNA, 23 nt, Human parainfluenza virus 3
ggcacuguaucugacauacucua

SEQ ID NO: 4013358 - RNA, 13 nt, Human parainfluenza virus 3
ggccaaaucagau

SEQ ID NO: 4013359 - RNA, 23 nt, Human parainfluenza virus 3
guacagaacaccaaaacaacaaa

SEQ ID NO: 4013360 - RNA, 16 nt, Human parainfluenza virus 3
guagaaauaaaucaga

SEQ ID NO: 4013361 - RNA, 18 nt, Human parainfluenza virus 3
guccaugguuuucagaua

SEQ ID NO: 4013362 - RNA, 15 nt, Human parainfluenza virus 3
gucuuccaaucagaa

SEQ ID NO: 4013363 - RNA, 23 nt, Human parainfluenza virus 3
guuacugcugcaacaccagauga

SEQ ID NO: 4013364 - RNA, 23 nt, Human parainfluenza virus 3
guucacacaacuuauaaaucaga

SEQ ID NO: 4013365 - RNA, 13 nt, Human parainfluenza virus 3
uaaagauauaucu

SEQ ID NO: 4013366 - RNA, 15 nt, Human parainfluenza virus 3
uaagaaaucaaaaga

SEQ ID NO: 4013367 - RNA, 17 nt, Human parainfluenza virus 3
uaagaaaucaaaagaua

SEQ ID NO: 4013368 - RNA, 13 nt, Human parainfluenza virus 3
uacagaacaccaa

SEQ ID NO: 4013369 - RNA, 21 nt, Human parainfluenza virus 3
uacagaacaccaaaacaacaa

SEQ ID NO: 4013370 - RNA, 23 nt, Human parainfluenza virus 3
uaccaagcagaguucuucucuug

SEQ ID NO: 4013371 - RNA, 13 nt, Human parainfluenza virus 3
uaccucagccuua

SEQ ID NO: 4013372 - RNA, 16 nt, Human parainfluenza virus 3
uagaaaaucaaagaga

SEQ ID NO: 4013373 - RNA, 17 nt, Human parainfluenza virus 3
uagaaaaucaaagagaa

SEQ ID NO: 4013374 - RNA, 18 nt, Human parainfluenza virus 3
uagaagugagaagaacag

SEQ ID NO: 4013375 - RNA, 22 nt, Human parainfluenza virus 3
uagacaaaaaguaagaaaaaca

SEQ ID NO: 4013376 - RNA, 14 nt, Human parainfluenza virus 3
uagauaucaaucaa

SEQ ID NO: 4013377 - RNA, 15 nt, Human parainfluenza virus 3
uagauccaaaauuac

SEQ ID NO: 4013378 - RNA, 21 nt, Human parainfluenza virus 3
uagcaaccucagcacaaauca

SEQ ID NO: 4013379 - RNA, 13 nt, Human parainfluenza virus 3
uaggagaaaucaa

SEQ ID NO: 4013380 - RNA, 14 nt, Human parainfluenza virus 3
uauaccaagcagag

SEQ ID NO: 4013381 - RNA, 23 nt, Human parainfluenza virus 3
uauaccaagcagaguucuucucu

SEQ ID NO: 4013382 - RNA, 17 nt, Human parainfluenza virus 3
uauauaccaagcagagu

SEQ ID NO: 4013383 - RNA, 19 nt, Human parainfluenza virus 3
uauaucaaaaguucacaca

SEQ ID NO: 4013384 - RNA, 14 nt, Human parainfluenza virus 3
uauaucuuaaccuu

SEQ ID NO: 4013385 - RNA, 20 nt, Human parainfluenza virus 3
ucaaaagauacugacaacca

SEQ ID NO: 4013386 - RNA, 21 nt, Human parainfluenza virus 3
ucaaaagauacugacaaccag

SEQ ID NO: 4013387 - RNA, 22 nt, Human parainfluenza virus 3
ucaaaaucuaucaacacacaca

SEQ ID NO: 4013388 - RNA, 23 nt, Human parainfluenza virus 3
ucaaaauuagccucaaaaaauga

SEQ ID NO: 4013389 - RNA, 16 nt, Human parainfluenza virus 3
ucaaagcgaaagagau

SEQ ID NO: 4013390 - RNA, 19 nt, Human parainfluenza virus 3
ucaacauaaaugacaauag

SEQ ID NO: 4013391 - RNA, 15 nt, Human parainfluenza virus 3
ucaaugaacagagaa

SEQ ID NO: 4013392 - RNA, 22 nt, Human parainfluenza virus 3
ucaauggacaacgacacaaaau

SEQ ID NO: 4013393 - RNA, 17 nt, Human parainfluenza virus 3
ucagaauuaacaaacau

SEQ ID NO: 4013394 - RNA, 13 nt, Human parainfluenza virus 3
ucagaucuacaaa

SEQ ID NO: 4013395 - RNA, 19 nt, Human parainfluenza virus 3
ucagcaaucagacaaugga

SEQ ID NO: 4013396 - RNA, 14 nt, Human parainfluenza virus 3
ucagcacaaaucac

SEQ ID NO: 4013397 - RNA, 16 nt, Human parainfluenza virus 3
ucagggacacaaacaa

SEQ ID NO: 4013398 - RNA, 14 nt, Human parainfluenza virus 3
uccagaagcaucac

SEQ ID NO: 4013399 - RNA, 16 nt, Human parainfluenza virus 3
uccaugaucaaaacaa

SEQ ID NO: 4013400 - RNA, 23 nt, Human parainfluenza virus 3
uccauggcuacucauaacaacaa

SEQ ID NO: 4013401 - RNA, 15 nt, Human parainfluenza virus 3
uccuaaauacagaug

SEQ ID NO: 4013402 - RNA, 21 nt, Human parainfluenza virus 3
ucgaaccgaacagacaaacac

SEQ ID NO: 4013403 - RNA, 23 nt, Human parainfluenza virus 3
ucuaucaacacacacaaaaucaa

SEQ ID NO: 4013404 - RNA, 20 nt, Human parainfluenza virus 3
ucucacaaagcacaaaacaa

SEQ ID NO: 4013405 - RNA, 18 nt, Human parainfluenza virus 3
ucuuaaccuuuaucuuug

SEQ ID NO: 4013406 - RNA, 20 nt, Human parainfluenza virus 3
ucuucaauacaccaagaaga

SEQ ID NO: 4013407 - RNA, 19 nt, Human parainfluenza virus 3
ugaagaaguaucugaauua

SEQ ID NO: 4013408 - RNA, 21 nt, Human parainfluenza virus 3
ugagcuguuuccuaacaacag

SEQ ID NO: 4013409 - RNA, 17 nt, Human parainfluenza virus 3
ugcuaaaccucaaagca

SEQ ID NO: 4013410 - RNA, 20 nt, Human parainfluenza virus 3
uggagaaucgauuagggaau

SEQ ID NO: 4013411 - RNA, 15 nt, Human parainfluenza virus 3
uguacaacagaagca

SEQ ID NO: 4013412 - RNA, 12 nt, Human parainfluenza virus 3
uguauaacagga

SEQ ID NO: 4013413 - RNA, 21 nt, Human parainfluenza virus 3
ugucccgggaaaacacagaga

SEQ ID NO: 4013414 - RNA, 16 nt, Human parainfluenza virus 3
uuaaagaauaaauuaa

SEQ ID NO: 4013415 - RNA, 21 nt, Human parainfluenza virus 3
uuaaguucauacaaugaauca

SEQ ID NO: 4013416 - RNA, 20 nt, Human parainfluenza virus 3
uucaaaucuuaaaauuauga

SEQ ID NO: 4013417 - RNA, 21 nt, Human parainfluenza virus 3
uugagaaacucaaagaagcaa

SEQ ID NO: 4013418 - RNA, 12 nt, Human parainfluenza virus 3
uugagcccaagg

SEQ ID NO: 4013419 - RNA, 22 nt, Human parainfluenza virus 3
uugauauuacugauuacaguga

SEQ ID NO: 4013420 - RNA, 16 nt, Human parainfluenza virus 3
uuguucaaaacagaga

SEQ ID NO: 4013421 - RNA, 13 nt, Human parainfluenza virus 3
aagacaaauggaa

SEQ ID NO: 4013422 - RNA, 17 nt, Human parainfluenza virus 3
aagaggucaacaccaac

SEQ ID NO: 4013423 - RNA, 13 nt, Human parainfluenza virus 3
aagcacaaaacaa

SEQ ID NO: 4013424 - RNA, 17 nt, Human parainfluenza virus 3
aagcuagauccaaaauu

SEQ ID NO: 4013425 - RNA, 14 nt, Human parainfluenza virus 3
aagcugcaaccaaa

SEQ ID NO: 4013426 - RNA, 12 nt, Human parainfluenza virus 3
aagucaaaucaa

SEQ ID NO: 4013427 - RNA, 17 nt, Human parainfluenza virus 3
aagucaaaucaaaaacu

SEQ ID NO: 4013428 - RNA, 17 nt, Human parainfluenza virus 3
aaguuacgcaauccaac

SEQ ID NO: 4013429 - RNA, 21 nt, Human parainfluenza virus 3
aaguucauacaaugaaucaaa

SEQ ID NO: 4013430 - RNA, 17 nt, Human parainfluenza virus 3
aaguuuguggcucugga

SEQ ID NO: 4013431 - RNA, 16 nt, Human parainfluenza virus 3
aauaaagauauaucuu

SEQ ID NO: 4013432 - RNA, 20 nt, Human parainfluenza virus 3
aauacgggaguguaaaugau

SEQ ID NO: 4013433 - RNA, 12 nt, Human parainfluenza virus 3
aaucaaaacaaa

SEQ ID NO: 4013434 - RNA, 12 nt, Human parainfluenza virus 3
aaucaaauggau

SEQ ID NO: 4013435 - RNA, 17 nt, Human parainfluenza virus 3
aaucaauauacaaauaa

SEQ ID NO: 4013436 - RNA, 17 nt, Human parainfluenza virus 3
aauccacaucaaaacua

SEQ ID NO: 4013437 - RNA, 16 nt, Human parainfluenza virus 3
aaugacaauaggaagu

SEQ ID NO: 4013438 - RNA, 14 nt, Human parainfluenza virus 3
aaugacuuaggaaa

SEQ ID NO: 4013439 - RNA, 12 nt, Human parainfluenza virus 3
aaugaguuuaug

SEQ ID NO: 4013440 - RNA, 13 nt, Human parainfluenza virus 3
aaugcaacuggau

SEQ ID NO: 4013441 - RNA, 14 nt, Human parainfluenza virus 3
aaugucaaaagaaa

SEQ ID NO: 4013442 - RNA, 22 nt, Human parainfluenza virus 3
aauugguuuugauauuagauaa

SEQ ID NO: 4013443 - RNA, 22 nt, Human parainfluenza virus 3
aauuugucuuccaaucagaaau

SEQ ID NO: 4013444 - RNA, 21 nt, Human parainfluenza virus 3
acaaaaucaagcagaaugaaa

SEQ ID NO: 4013445 - RNA, 19 nt, Human parainfluenza virus 3
acaaaggcuuaaacucaau

SEQ ID NO: 4013446 - RNA, 15 nt, Human parainfluenza virus 3
acaaauaucacagaa

SEQ ID NO: 4013447 - RNA, 20 nt, Human parainfluenza virus 3
acaacaagcugcauuacaca

SEQ ID NO: 4013448 - RNA, 16 nt, Human parainfluenza virus 3
acaagaaaaaggaaua

SEQ ID NO: 4013449 - RNA, 14 nt, Human parainfluenza virus 3
acaauaaaauaagu

SEQ ID NO: 4013450 - RNA, 14 nt, Human parainfluenza virus 3
acaauaaagauaua

SEQ ID NO: 4013451 - RNA, 22 nt, Human parainfluenza virus 3
acaauaucuaugagacaaaauu

SEQ ID NO: 4013452 - RNA, 19 nt, Human parainfluenza virus 3
acacaaaaucaagcagaau

SEQ ID NO: 4013453 - RNA, 19 nt, Human parainfluenza virus 3
acacaaaggggcaaacaga

SEQ ID NO: 4013454 - RNA, 16 nt, Human parainfluenza virus 3
acacagauacaaaaug

SEQ ID NO: 4013455 - RNA, 16 nt, Human parainfluenza virus 3
acacauuuaucagaua

SEQ ID NO: 4013456 - RNA, 19 nt, Human parainfluenza virus 3
acaccgaacaaacagacaa

SEQ ID NO: 4013457 - RNA, 14 nt, Human parainfluenza virus 3
acacuaaacacaau

SEQ ID NO: 4013458 - RNA, 13 nt, Human parainfluenza virus 3
acagacaagaaac

SEQ ID NO: 4013459 - RNA, 22 nt, Human parainfluenza virus 3
acagacaagaaacaacaguaga

SEQ ID NO: 4013460 - RNA, 19 nt, Human parainfluenza virus 3
acagagaggaccugggaga

SEQ ID NO: 4013461 - RNA, 16 nt, Human parainfluenza virus 3
acagauacaaaaugaa

SEQ ID NO: 4013462 - RNA, 20 nt, Human parainfluenza virus 3
acagcaaacacuaaacacaa

SEQ ID NO: 4013463 - RNA, 17 nt, Human parainfluenza virus 3
acauauagucaaaugac

SEQ ID NO: 4013464 - RNA, 21 nt, Human parainfluenza virus 3
accaagaagaugacaaaagaa

SEQ ID NO: 4013465 - RNA, 14 nt, Human parainfluenza virus 3
accgaacaaacaga

SEQ ID NO: 4013466 - RNA, 19 nt, Human parainfluenza virus 3
accgaacagacaaacacaa

SEQ ID NO: 4013467 - RNA, 17 nt, Human parainfluenza virus 3
accugauacaagaucaa

SEQ ID NO: 4013468 - RNA, 13 nt, Human parainfluenza virus 3
acuaaacacaaug

SEQ ID NO: 4013469 - RNA, 19 nt, Human parainfluenza virus 3
acuaaacacaaugccaacu

SEQ ID NO: 4013470 - RNA, 17 nt, Human parainfluenza virus 3
acuaauaagauaauaua

SEQ ID NO: 4013471 - RNA, 22 nt, Human parainfluenza virus 3
acuaggcuucuucgaaauggaa

SEQ ID NO: 4013472 - RNA, 19 nt, Human parainfluenza virus 3
agaaaaacauguaauauau

SEQ ID NO: 4013473 - RNA, 15 nt, Human parainfluenza virus 3
agaaaagaucaagaa

SEQ ID NO: 4013474 - RNA, 18 nt, Human parainfluenza virus 3
agaaaauauauguauauu

SEQ ID NO: 4013475 - RNA, 18 nt, Human parainfluenza virus 3
agaaaaucgagaaaauga

SEQ ID NO: 4013476 - RNA, 21 nt, Human parainfluenza virus 3
agaaacaauuaaaauuugaca

SEQ ID NO: 4013477 - RNA, 17 nt, Human parainfluenza virus 3
agaaagaccaaaaugaa

SEQ ID NO: 4013478 - RNA, 15 nt, Human parainfluenza virus 3
agaaaucaaauggau

SEQ ID NO: 4013479 - RNA, 21 nt, Human parainfluenza virus 3
agaacaaaguagaaacaguga

SEQ ID NO: 4013480 - RNA, 13 nt, Human parainfluenza virus 3
agaaucaauaaag

SEQ ID NO: 4013481 - RNA, 20 nt, Human parainfluenza virus 3
agaaucuugguguaauucaa

SEQ ID NO: 4013482 - RNA, 12 nt, Human parainfluenza virus 3
agacaaauggaa

SEQ ID NO: 4013483 - RNA, 19 nt, Human parainfluenza virus 3
agacuaauacccaaaaaag

SEQ ID NO: 4013484 - RNA, 14 nt, Human parainfluenza virus 3
agagauugaauuac

SEQ ID NO: 4013485 - RNA, 18 nt, Human parainfluenza virus 3
agauaaacaaaacuauaa

SEQ ID NO: 4013486 - RNA, 19 nt, Human parainfluenza virus 3
agauacugcaucaaagaua

SEQ ID NO: 4013487 - RNA, 16 nt, Human parainfluenza virus 3
agaucacuuuuaaugu

SEQ ID NO: 4013488 - RNA, 14 nt, Human parainfluenza virus 3
agaucuacaaagua

SEQ ID NO: 4013489 - RNA, 17 nt, Human parainfluenza virus 3
agaugaugaagaagaaa

SEQ ID NO: 4013490 - RNA, 15 nt, Human parainfluenza virus 3
agcaacugaaagagu

SEQ ID NO: 4013491 - RNA, 13 nt, Human parainfluenza virus 3
agcaaucaaauca

SEQ ID NO: 4013492 - RNA, 22 nt, Human parainfluenza virus 3
agcaaucagggacacaaacaaa

SEQ ID NO: 4013493 - RNA, 20 nt, Human parainfluenza virus 3
agcaaucgauuuacagagag

SEQ ID NO: 4013494 - RNA, 23 nt, Human parainfluenza virus 3
agcaaucucucacaaagcacaaa

SEQ ID NO: 4013495 - RNA, 16 nt, Human parainfluenza virus 3
agcagaucuaaagaaa

SEQ ID NO: 4013496 - RNA, 11 nt, Human parainfluenza virus 3
agcccaaggau

SEQ ID NO: 4013497 - RNA, 21 nt, Human parainfluenza virus 3
agcccaaggauagacaaaaag

SEQ ID NO: 4013498 - RNA, 16 nt, Human parainfluenza virus 3
agccucaaaaaaugau

SEQ ID NO: 4013499 - RNA, 17 nt, Human parainfluenza virus 3
agccucaaaaaaugaug

SEQ ID NO: 4013500 - RNA, 22 nt, Human parainfluenza virus 3
agccucauaccaaaaauagaag

SEQ ID NO: 4013501 - RNA, 17 nt, Human parainfluenza virus 3
agcuggccaucagaaac

SEQ ID NO: 4013502 - RNA, 18 nt, Human parainfluenza virus 3
aggaaauacacuagagaa

SEQ ID NO: 4013503 - RNA, 14 nt, Human parainfluenza virus 3
aggaauaauugaua

SEQ ID NO: 4013504 - RNA, 15 nt, Human parainfluenza virus 3
aggaaucaagagaua

SEQ ID NO: 4013505 - RNA, 14 nt, Human parainfluenza virus 3
aggauauaggaaaa

SEQ ID NO: 4013506 - RNA, 22 nt, Human parainfluenza virus 3
agggauugacaagaauauaccu

SEQ ID NO: 4013507 - RNA, 13 nt, Human parainfluenza virus 3
agggcagaagaaa

SEQ ID NO: 4013508 - RNA, 23 nt, Human parainfluenza virus 3
aguauuuauagcagauaguaaau

SEQ ID NO: 4013509 - RNA, 16 nt, Human parainfluenza virus 3
agucaaugaacagaga

SEQ ID NO: 4013510 - RNA, 17 nt, Human parainfluenza virus 3
auaaaaucuuagauauu

SEQ ID NO: 4013511 - RNA, 12 nt, Human parainfluenza virus 3
auaaaucagaaa

SEQ ID NO: 4013512 - RNA, 22 nt, Human parainfluenza virus 3
auaacuaacucugcaauauaca

SEQ ID NO: 4013513 - RNA, 17 nt, Human parainfluenza virus 3
auaaggauaaaauggac

SEQ ID NO: 4013514 - RNA, 21 nt, Human parainfluenza virus 3
auaaugugcuaucaagaccag

SEQ ID NO: 4013515 - RNA, 16 nt, Human parainfluenza virus 3
auacaaugaaucaaau

SEQ ID NO: 4013516 - RNA, 15 nt, Human parainfluenza virus 3
auacaguacaaaaua

SEQ ID NO: 4013517 - RNA, 14 nt, Human parainfluenza virus 3
auaccaacaucaga

SEQ ID NO: 4013518 - RNA, 22 nt, Human parainfluenza virus 3
auaccaagcagaguucuucucu

SEQ ID NO: 4013519 - RNA, 14 nt, Human parainfluenza virus 3
auacuagacucaca

SEQ ID NO: 4013520 - RNA, 15 nt, Human parainfluenza virus 3
auagucucaaagaaa

SEQ ID NO: 4013521 - RNA, 20 nt, Human parainfluenza virus 3
auauaucuuaaccuuuaucu

SEQ ID NO: 4013522 - RNA, 14 nt, Human parainfluenza virus 3
aucaaaacaaaaag

SEQ ID NO: 4013523 - RNA, 21 nt, Human parainfluenza virus 3
aucaagaccaggaaacgauga

SEQ ID NO: 4013524 - RNA, 22 nt, Human parainfluenza virus 3
uuaaacucaauuccaaaauuaa

SEQ ID NO: 4013525 - RNA, 23 nt, Human parainfluenza virus 3
uuaacugagaaagugaaugacuu

SEQ ID NO: 4013526 - RNA, 12 nt, Human parainfluenza virus 3
uuaagaaaucaa

SEQ ID NO: 4013527 - RNA, 13 nt, Human parainfluenza virus 3
uuaauuauaaaug

SEQ ID NO: 4013528 - RNA, 14 nt, Human parainfluenza virus 3
uuacaaccauaauu

SEQ ID NO: 4013529 - RNA, 16 nt, Human parainfluenza virus 3
uucaacauaaaugaca

SEQ ID NO: 4013530 - RNA, 15 nt, Human parainfluenza virus 3
uuccaauuaugggag

SEQ ID NO: 4013531 - RNA, 15 nt, Human parainfluenza virus 3
uugaauucauacuua

SEQ ID NO: 4013532 - RNA, 20 nt, Human parainfluenza virus 3
uugagcccaaggauagacaa

SEQ ID NO: 4013533 - RNA, 16 nt, Human parainfluenza virus 3
uugggaaaaucaaaca

SEQ ID NO: 4013534 - RNA, 19 nt, Human parainfluenza virus 3
caggaaacuguacagagag

SEQ ID NO: 4013535 - RNA, 19 nt, Human parainfluenza virus 3
caggaaauacacuagagaa

SEQ ID NO: 4013536 - RNA, 12 nt, Human parainfluenza virus 3
caggaacaagaa

SEQ ID NO: 4013537 - RNA, 14 nt, Human parainfluenza virus 3
caggaguauauacu

SEQ ID NO: 4013538 - RNA, 16 nt, Human parainfluenza virus 3
cauagaagauauugua

SEQ ID NO: 4013539 - RNA, 15 nt, Human parainfluenza virus 3
caugaucaaaacaaa

SEQ ID NO: 4013540 - RNA, 18 nt, Human parainfluenza virus 3
cauuagugaaauuacaau

SEQ ID NO: 4013541 - RNA, 12 nt, Human parainfluenza virus 3
cauuauauuguu

SEQ ID NO: 4013542 - RNA, 15 nt, Human parainfluenza virus 3
cauugcuacaagaaa

SEQ ID NO: 4013543 - RNA, 15 nt, Human parainfluenza virus 3
ccaaaacaacaaaac

SEQ ID NO: 4013544 - RNA, 20 nt, Human parainfluenza virus 3
ccaaagggaugaagauauca

SEQ ID NO: 4013545 - RNA, 14 nt, Human parainfluenza virus 3
ccaaauagauauca

SEQ ID NO: 4013546 - RNA, 20 nt, Human parainfluenza virus 3
ccaaauagauaucacaaaac

SEQ ID NO: 4013547 - RNA, 23 nt, Human parainfluenza virus 3
ccaaauagauaucacaaaacuac

SEQ ID NO: 4013548 - RNA, 19 nt, Human parainfluenza virus 3
ccaaauggauguauaacag

SEQ ID NO: 4013549 - RNA, 20 nt, Human parainfluenza virus 3
ccaagaagaugacaaaagaa

SEQ ID NO: 4013550 - RNA, 18 nt, Human parainfluenza virus 3
ccauauguacuaacaaac

SEQ ID NO: 4013551 - RNA, 21 nt, Human parainfluenza virus 3
ccauuaagccgaagcaaauaa

SEQ ID NO: 4013552 - RNA, 23 nt, Human parainfluenza virus 3
cccaaaguugaugaaagaucaga

SEQ ID NO: 4013553 - RNA, 19 nt, Human parainfluenza virus 3
ccgaacaaacagacaagaa

SEQ ID NO: 4013554 - RNA, 12 nt, Human parainfluenza virus 3
ccgcaacaaaga

SEQ ID NO: 4013555 - RNA, 15 nt, Human parainfluenza virus 3
cuaauaagauaauau

SEQ ID NO: 4013556 - RNA, 21 nt, Human parainfluenza virus 3
aaaaagugagcaguacaauga

SEQ ID NO: 4013557 - RNA, 18 nt, Human parainfluenza virus 3
aaaaauaggcagaaugua

SEQ ID NO: 4013558 - RNA, 21 nt, Human parainfluenza virus 3
aaaacuuaggauuaaagaaua

SEQ ID NO: 4013559 - RNA, 12 nt, Human parainfluenza virus 3
aaaaggaaaaua

SEQ ID NO: 4013560 - RNA, 17 nt, Human parainfluenza virus 3
aaaaguaagaaaaacau

SEQ ID NO: 4013561 - RNA, 21 nt, Human parainfluenza virus 3
aaaaguaagaaaaacauguaa

SEQ ID NO: 4013562 - RNA, 16 nt, Human parainfluenza virus 3
aaaauaaaaaucccaa

SEQ ID NO: 4013563 - RNA, 16 nt, Human parainfluenza virus 3
aaaaucaagcagaaug

SEQ ID NO: 4013564 - RNA, 21 nt, Human parainfluenza virus 3
aaaaugaauccaaugagagag

SEQ ID NO: 4013565 - RNA, 19 nt, Human parainfluenza virus 3
aaaauuaugacugagagag

SEQ ID NO: 4013566 - RNA, 23 nt, Human parainfluenza virus 3
aaacagaaaaucgagaaaaugag

SEQ ID NO: 4013567 - RNA, 14 nt, Human parainfluenza virus 3
aaacagacaagaaa

SEQ ID NO: 4013568 - RNA, 14 nt, Human parainfluenza virus 3
aaacauaucccaau

SEQ ID NO: 4013569 - RNA, 13 nt, Human parainfluenza virus 3
aaaccucaaagca

SEQ ID NO: 4013570 - RNA, 18 nt, Human parainfluenza virus 3
aaacuucgaaacaagaua

SEQ ID NO: 4013571 - RNA, 17 nt, Human parainfluenza virus 3
aaagaggucaacaccaa

SEQ ID NO: 4013572 - RNA, 17 nt, Human parainfluenza virus 3
aaagaguaaacgagcug

SEQ ID NO: 4013573 - RNA, 18 nt, Human parainfluenza virus 3
aaagauauaucuuaaccu

SEQ ID NO: 4013574 - RNA, 19 nt, Human parainfluenza virus 3
aaagcgugcucggaaaaug

SEQ ID NO: 4013575 - RNA, 22 nt, Human parainfluenza virus 3
aaagcgugcucggaaaauggac

SEQ ID NO: 4013576 - RNA, 13 nt, Human parainfluenza virus 3
aaagguuagaaaa

SEQ ID NO: 4013577 - RNA, 19 nt, Human parainfluenza virus 3
aaaguugaugaaagaucag

SEQ ID NO: 4013578 - RNA, 16 nt, Human parainfluenza virus 3
aaauacagacagaauc

SEQ ID NO: 4013579 - RNA, 16 nt, Human parainfluenza virus 3
aaaugaauccaaugag

SEQ ID NO: 4013580 - RNA, 17 nt, Human parainfluenza virus 3
aaauguacuaaacaaug

SEQ ID NO: 4013581 - RNA, 20 nt, Human parainfluenza virus 3
aaauguacuaaacaauguag

SEQ ID NO: 4013582 - RNA, 23 nt, Human parainfluenza virus 3
aaauugaaagaagaaaagaucaa

SEQ ID NO: 4013583 - RNA, 15 nt, Human parainfluenza virus 3
aacaacagaucucaa

SEQ ID NO: 4013584 - RNA, 20 nt, Human parainfluenza virus 3
aacaaucauauauaaacgaa

SEQ ID NO: 4013585 - RNA, 15 nt, Human parainfluenza virus 3
aacacagcaaacacu

SEQ ID NO: 4013586 - RNA, 14 nt, Human parainfluenza virus 3
aacaguagaucaaa

SEQ ID NO: 4013587 - RNA, 22 nt, Human parainfluenza virus 3
aacauaggaucauuacaagaaa

SEQ ID NO: 4013588 - RNA, 13 nt, Human parainfluenza virus 3
aaccuuuaucuuu

SEQ ID NO: 4013589 - RNA, 22 nt, Human parainfluenza virus 3
aagaaacgacaccgaacaaaca

SEQ ID NO: 4013590 - RNA, 20 nt, Human parainfluenza virus 3
aagaaagucaaaucaaaaac

SEQ ID NO: 4013591 - RNA, 23 nt, Human parainfluenza virus 3
gacacaagggauugacaagaaua

SEQ ID NO: 4013592 - RNA, 13 nt, Human parainfluenza virus 3
gacaccgaacaaa

SEQ ID NO: 4013593 - RNA, 22 nt, Human parainfluenza virus 3
gacagaaucaucaggaacacaa

SEQ ID NO: 4013594 - RNA, 19 nt, Human parainfluenza virus 3
gaccaacagaucaagcaau

SEQ ID NO: 4013595 - RNA, 17 nt, Human parainfluenza virus 3
gacugauuccaaaggga

SEQ ID NO: 4013596 - RNA, 20 nt, Human parainfluenza virus 3
gagaagaacagucaaagcga

SEQ ID NO: 4013597 - RNA, 12 nt, Human parainfluenza virus 3
gagauaaaucaa

SEQ ID NO: 4013598 - RNA, 17 nt, Human parainfluenza virus 3
gagcagaugucaaagaa

SEQ ID NO: 4013599 - RNA, 14 nt, Human parainfluenza virus 3
gaggaaagaaagac

SEQ ID NO: 4013600 - RNA, 23 nt, Human parainfluenza virus 3
gaggaaucagucuucaugucaau

SEQ ID NO: 4013601 - RNA, 18 nt, Human parainfluenza virus 3
gauaauaccaaugaucua

SEQ ID NO: 4013602 - RNA, 17 nt, Human parainfluenza virus 3
gauacuauccuaauauu

SEQ ID NO: 4013603 - RNA, 18 nt, Human parainfluenza virus 3
gauagaaaaucaaagaga

SEQ ID NO: 4013604 - RNA, 17 nt, Human parainfluenza virus 3
gauagacaaaaaguaag

SEQ ID NO: 4013605 - RNA, 16 nt, Human parainfluenza virus 3
gauauuuuuaaugaau

SEQ ID NO: 4013606 - RNA, 19 nt, Human parainfluenza virus 3
gaucaacuuauacaaaaga

SEQ ID NO: 4013607 - RNA, 23 nt, Human parainfluenza virus 3
gaucaucagauauuaagauuaua

SEQ ID NO: 4013608 - RNA, 14 nt, Human parainfluenza virus 3
gauccaacaaagaa

SEQ ID NO: 4013609 - RNA, 15 nt, Human parainfluenza virus 3
gaucuacaaaguaga

SEQ ID NO: 4013610 - RNA, 12 nt, Human parainfluenza virus 3
gaucuuaaugaa

SEQ ID NO: 4013611 - RNA, 18 nt, Human parainfluenza virus 3
gaugaagauaucacaaaa

SEQ ID NO: 4013612 - RNA, 21 nt, Human parainfluenza virus 3
gauguauaacaggaguauaua

SEQ ID NO: 4013613 - RNA, 14 nt, Human parainfluenza virus 3
gauuccaaagggau

SEQ ID NO: 4013614 - RNA, 14 nt, Human parainfluenza virus 3
gauugaucaagaga

SEQ ID NO: 4013615 - RNA, 19 nt, Human parainfluenza virus 3
gcaaaauaggagaaaucaa

SEQ ID NO: 4013616 - RNA, 18 nt, Human parainfluenza virus 3
gcaaacacuaaacacaau

SEQ ID NO: 4013617 - RNA, 18 nt, Human parainfluenza virus 3
gcaaauaagggauaauca

SEQ ID NO: 4013618 - RNA, 19 nt, Human parainfluenza virus 3
gcaaucagacaauggacaa

SEQ ID NO: 4013619 - RNA, 19 nt, Human parainfluenza virus 3
gcacuccuaaauacagaug

SEQ ID NO: 4013620 - RNA, 14 nt, Human parainfluenza virus 3
gcagaguucuucuc

SEQ ID NO: 4013621 - RNA, 16 nt, Human parainfluenza virus 3
gcagaguucuucucuu

SEQ ID NO: 4013622 - RNA, 18 nt, Human parainfluenza virus 3
gcagaguucuucucuugu

SEQ ID NO: 4013623 - RNA, 12 nt, Human parainfluenza virus 3
gccauacagaug

SEQ ID NO: 4013624 - RNA, 14 nt, Human parainfluenza virus 3
gcgguugcucuggu

SEQ ID NO: 4013625 - RNA, 17 nt, Human parainfluenza virus 3
gcuucuucgaaauggaa

SEQ ID NO: 4013626 - RNA, 15 nt, Human parainfluenza virus 3
ggaacgaaucaaaga

SEQ ID NO: 4013627 - RNA, 11 nt, Human parainfluenza virus 3
ggagauuacag

SEQ ID NO: 4013628 - RNA, 21 nt, Human parainfluenza virus 3
ggauagacaaaaaguaagaaa

SEQ ID NO: 4013629 - RNA, 22 nt, Human parainfluenza virus 3
ggauagacaaaaaguaagaaaa

SEQ ID NO: 4013630 - RNA, 21 nt, Human parainfluenza virus 3
ggauaucuacaaugauggaua

SEQ ID NO: 4013631 - RNA, 17 nt, Human parainfluenza virus 3
guaaucagcaaucagac

SEQ ID NO: 4013632 - RNA, 17 nt, Human parainfluenza virus 3
guagauacugcaucaaa

SEQ ID NO: 4013633 - RNA, 12 nt, Human parainfluenza virus 3
guagcaaucaaa

SEQ ID NO: 4013634 - RNA, 14 nt, Human parainfluenza virus 3
gucaaucauaauua

SEQ ID NO: 4013635 - RNA, 23 nt, Human parainfluenza virus 3
gucaaucauaauuaaccauaaua

SEQ ID NO: 4013636 - RNA, 17 nt, Human parainfluenza virus 3
gugaaauuacaauuaga

SEQ ID NO: 4013637 - RNA, 13 nt, Human parainfluenza virus 3
guuaagauuacag

SEQ ID NO: 4013638 - RNA, 23 nt, Human parainfluenza virus 3
guuacaaaguuuguggcucugga

SEQ ID NO: 4013639 - RNA, 15 nt, Human parainfluenza virus 3
uaaagauauaucuua

SEQ ID NO: 4013640 - RNA, 19 nt, Human parainfluenza virus 3
uaacacagauacaaaauga

SEQ ID NO: 4013641 - RNA, 16 nt, Human parainfluenza virus 3
uaaccuuuaucuuuga

SEQ ID NO: 4013642 - RNA, 17 nt, Human parainfluenza virus 3
uacaaaauauaaaacca

SEQ ID NO: 4013643 - RNA, 14 nt, Human parainfluenza virus 3
uacagacagaauca

SEQ ID NO: 4013644 - RNA, 17 nt, Human parainfluenza virus 3
uacuaaacaauguagau

SEQ ID NO: 4013645 - RNA, 14 nt, Human parainfluenza virus 3
uagauacugcauca

SEQ ID NO: 4013646 - RNA, 14 nt, Human parainfluenza virus 3
uagcaaucaaauca

SEQ ID NO: 4013647 - RNA, 14 nt, Human parainfluenza virus 3
uaggacaaagaaaa

SEQ ID NO: 4013648 - RNA, 18 nt, Human parainfluenza virus 3
uaggagaaaucaaaacaa

SEQ ID NO: 4013649 - RNA, 14 nt, Human parainfluenza virus 3
uauacaguacaaaa

SEQ ID NO: 4013650 - RNA, 16 nt, Human parainfluenza virus 3
uauaccaagcagaguu

SEQ ID NO: 4013651 - RNA, 17 nt, Human parainfluenza virus 3
uauccaugaucaaaaca

SEQ ID NO: 4013652 - RNA, 19 nt, Human parainfluenza virus 3
uauccugagugucaccuua

SEQ ID NO: 4013653 - RNA, 20 nt, Human parainfluenza virus 3
uaucgacaugcaggaaauac

SEQ ID NO: 4013654 - RNA, 22 nt, Human parainfluenza virus 3
uaucuuaaccuuuaucuuugag

SEQ ID NO: 4013655 - RNA, 23 nt, Human parainfluenza virus 3
uauuaaaaauaaaaaucccaaaa

SEQ ID NO: 4013656 - RNA, 20 nt, Human parainfluenza virus 3
uauuaccagagcuucauagg

SEQ ID NO: 4013657 - RNA, 20 nt, Human parainfluenza virus 3
uauuccucuucccagccaua

SEQ ID NO: 4013658 - RNA, 17 nt, Human parainfluenza virus 3
ucaaaaacaacaaccau

SEQ ID NO: 4013659 - RNA, 18 nt, Human parainfluenza virus 3
ucaaaccaacagaaacaa

SEQ ID NO: 4013660 - RNA, 15 nt, Human parainfluenza virus 3
ucaaagagaacaacu

SEQ ID NO: 4013661 - RNA, 16 nt, Human parainfluenza virus 3
ucaaaucaaaaacuag

SEQ ID NO: 4013662 - RNA, 14 nt, Human parainfluenza virus 3
ucaacacacacaaa

SEQ ID NO: 4013663 - RNA, 16 nt, Human parainfluenza virus 3
ucaacaccgacacaaa

SEQ ID NO: 4013664 - RNA, 23 nt, Human parainfluenza virus 3
ucaagaagugccgcaacaaagaa

SEQ ID NO: 4013665 - RNA, 13 nt, Human parainfluenza virus 3
ucaagacaaacga

SEQ ID NO: 4013666 - RNA, 12 nt, Human parainfluenza virus 3
ucaauauacaaa

SEQ ID NO: 4013667 - RNA, 20 nt, Human parainfluenza virus 3
ucaauauacaaauaagaaaa

SEQ ID NO: 4013668 - RNA, 17 nt, Human parainfluenza virus 3
ucacaaagcacaaaaca

SEQ ID NO: 4013669 - RNA, 18 nt, Human parainfluenza virus 3
ucacuagacagaaaauaa

SEQ ID NO: 4013670 - RNA, 19 nt, Human parainfluenza virus 3
ucagcugguauucaaaagg

SEQ ID NO: 4013671 - RNA, 19 nt, Human parainfluenza virus 3
ucaggaaacuguacagaga

SEQ ID NO: 4013672 - RNA, 17 nt, Human parainfluenza virus 3
ucaggaauccaaugaaa

SEQ ID NO: 4013673 - RNA, 21 nt, Human parainfluenza virus 3
ucauauauaaacgaacucaaa

SEQ ID NO: 4013674 - RNA, 23 nt, Human parainfluenza virus 3
uccaaaauuaaagguauggacaa

SEQ ID NO: 4013675 - RNA, 22 nt, Human parainfluenza virus 3
uccaagaaccacgaucacauca

SEQ ID NO: 4013676 - RNA, 14 nt, Human parainfluenza virus 3
uccacaucaaaagg

SEQ ID NO: 4013677 - RNA, 18 nt, Human parainfluenza virus 3
ucgaaauggaacgaauca

SEQ ID NO: 4013678 - RNA, 17 nt, Human parainfluenza virus 3
ucgaaccgaacagacaa

SEQ ID NO: 4013679 - RNA, 24 nt, Human parainfluenza virus 3
ucuggauccaaacccaagacacaa

SEQ ID NO: 4013680 - RNA, 14 nt, Human parainfluenza virus 3
ucuuaaccuuuauc

SEQ ID NO: 4013681 - RNA, 14 nt, Human parainfluenza virus 3
ugaaauuacaauua

SEQ ID NO: 4013682 - RNA, 20 nt, Human parainfluenza virus 3
ugaaguauuuauagcagaua

SEQ ID NO: 4013683 - RNA, 15 nt, Human parainfluenza virus 3
ugacaaaagaauuaa

SEQ ID NO: 4013684 - RNA, 13 nt, Human parainfluenza virus 3
ugacaagaauaua

SEQ ID NO: 4013685 - RNA, 13 nt, Human parainfluenza virus 3
ugagcccaaggau

SEQ ID NO: 4013686 - RNA, 22 nt, Human parainfluenza virus 3
ugaguuuauggagauuacagaa

SEQ ID NO: 4013687 - RNA, 14 nt, Human parainfluenza virus 3
ugauuacagugaua

SEQ ID NO: 4013688 - RNA, 14 nt, Human parainfluenza virus 3
ugcaaguuaaauca

SEQ ID NO: 4013689 - RNA, 20 nt, Human parainfluenza virus 3
ugcuaaaaacuaucaaauca

SEQ ID NO: 4013690 - RNA, 18 nt, Human parainfluenza virus 3
ugcuguucgaugccaaca

SEQ ID NO: 4013691 - RNA, 18 nt, Human parainfluenza virus 3
uggaacgaaucaaagaca

SEQ ID NO: 4013692 - RNA, 14 nt, Human parainfluenza virus 3
ugguauuaacagua

SEQ ID NO: 4013693 - RNA, 19 nt, Human parainfluenza virus 3
uuaaaaauaaaaaucccaa

SEQ ID NO: 4013694 - RNA, 13 nt, Human parainfluenza virus 3
aaaacauguaaua

SEQ ID NO: 4013695 - RNA, 21 nt, Human parainfluenza virus 3
aaaaccuuuaaauccagauga

SEQ ID NO: 4013696 - RNA, 15 nt, Human parainfluenza virus 3
aaaauaggcagaaug

SEQ ID NO: 4013697 - RNA, 23 nt, Human parainfluenza virus 3
aaaauuaacacagauacaaaaug

SEQ ID NO: 4013698 - RNA, 14 nt, Human parainfluenza virus 3
aaaauuacaaucua

SEQ ID NO: 4013699 - RNA, 22 nt, Human parainfluenza virus 3
aaaauuagccucaaaaaaugau

SEQ ID NO: 4013700 - RNA, 17 nt, Human parainfluenza virus 3
aaacaaaaaguacagaa

SEQ ID NO: 4013701 - RNA, 12 nt, Human parainfluenza virus 3
aaacagaacacu

SEQ ID NO: 4013702 - RNA, 20 nt, Human parainfluenza virus 3
aaacucaauaaauuagauaa

SEQ ID NO: 4013703 - RNA, 16 nt, Human parainfluenza virus 3
aaagggcagaagaaaa

SEQ ID NO: 4013704 - RNA, 18 nt, Human parainfluenza virus 3
aaagggggaaaagggaaa

SEQ ID NO: 4013705 - RNA, 13 nt, Human parainfluenza virus 3
aaaucaaacaaug

SEQ ID NO: 4013706 - RNA, 15 nt, Human parainfluenza virus 3
aaauggaaaggaaag

SEQ ID NO: 4013707 - RNA, 18 nt, Human parainfluenza virus 3
aacauccaauaaaugaga

SEQ ID NO: 4013708 - RNA, 15 nt, Human parainfluenza virus 3
aaccauugcucuggg

SEQ ID NO: 4013709 - RNA, 17 nt, Human parainfluenza virus 3
aacgaacucaaacauug

SEQ ID NO: 4013710 - RNA, 15 nt, Human parainfluenza virus 3
aacuuauacaaaaga

SEQ ID NO: 4013711 - RNA, 13 nt, Human parainfluenza virus 3
aagaaaaacaugu

SEQ ID NO: 4013712 - RNA, 16 nt, Human parainfluenza virus 3
aagaacccaauagaca

SEQ ID NO: 4013713 - RNA, 17 nt, Human parainfluenza virus 3
aagaagcuuggaaucua

SEQ ID NO: 4013714 - RNA, 15 nt, Human parainfluenza virus 3
aagaaucaauccgaa

SEQ ID NO: 4013715 - RNA, 16 nt, Human parainfluenza virus 3
aagacacaaaagacaa

SEQ ID NO: 4013716 - RNA, 22 nt, Human parainfluenza virus 3
aagacugguuuaagaaaucaaa

SEQ ID NO: 4013717 - RNA, 12 nt, Human parainfluenza virus 3
aagauaucacaa

SEQ ID NO: 4013718 - RNA, 16 nt, Human parainfluenza virus 3
aagauuacagaaagau

SEQ ID NO: 4013719 - RNA, 22 nt, Human parainfluenza virus 3
aagcaaaauaggagaaaucaaa

SEQ ID NO: 4013720 - RNA, 18 nt, Human parainfluenza virus 3
aagcagaucuaaagaaaa

SEQ ID NO: 4013721 - RNA, 17 nt, Human parainfluenza virus 3
aagccgaagcaaauaag

SEQ ID NO: 4013722 - RNA, 20 nt, Human parainfluenza virus 3
aauaagggauaaucaaaaac

SEQ ID NO: 4013723 - RNA, 16 nt, Human parainfluenza virus 3
aauacccaaaaaagug

SEQ ID NO: 4013724 - RNA, 15 nt, Human parainfluenza virus 3
aauagauaucacaaa

SEQ ID NO: 4013725 - RNA, 13 nt, Human parainfluenza virus 3
aauauacaaauaa

SEQ ID NO: 4013726 - RNA, 14 nt, Human parainfluenza virus 3
aauauaggaaaauu

SEQ ID NO: 4013727 - RNA, 17 nt, Human parainfluenza virus 3
aauauauauauaccaag

SEQ ID NO: 4013728 - RNA, 16 nt, Human parainfluenza virus 3
aaucaaagagaacaac

SEQ ID NO: 4013729 - RNA, 14 nt, Human parainfluenza virus 3
aauccaccaaaaca

SEQ ID NO: 4013730 - RNA, 15 nt, Human parainfluenza virus 3
aaucgauuagggaau

SEQ ID NO: 4013731 - RNA, 22 nt, Human parainfluenza virus 3
aaucuaucaacacacacaaaau

SEQ ID NO: 4013732 - RNA, 16 nt, Human parainfluenza virus 3
aaucucucacaaagca

SEQ ID NO: 4013733 - RNA, 21 nt, Human parainfluenza virus 3
aaucugaucuauuaaaaauaa

SEQ ID NO: 4013734 - RNA, 18 nt, Human parainfluenza virus 3
aauggaugaaucacauag

SEQ ID NO: 4013735 - RNA, 17 nt, Human parainfluenza virus 3
aauuaaguauuacagaa

SEQ ID NO: 4013736 - RNA, 15 nt, Human parainfluenza virus 3
aauuacaauuagaaa

SEQ ID NO: 4013737 - RNA, 22 nt, Human parainfluenza virus 3
aauuacucuauugcagaaucuu

SEQ ID NO: 4013738 - RNA, 14 nt, Human parainfluenza virus 3
aauuagaaaugaua

SEQ ID NO: 4013739 - RNA, 17 nt, Human parainfluenza virus 3
aauuagauaaaagacaa

SEQ ID NO: 4013740 - RNA, 21 nt, Human parainfluenza virus 3
aauuagccucaaaaaaugaug

SEQ ID NO: 4013741 - RNA, 14 nt, Human parainfluenza virus 3
aauuauauaccaau

SEQ ID NO: 4013742 - RNA, 18 nt, Human parainfluenza virus 3
aauuuauaugaaagauaa

SEQ ID NO: 4013743 - RNA, 15 nt, Human parainfluenza virus 3
acaaacaaagcagug

SEQ ID NO: 4013744 - RNA, 11 nt, Human parainfluenza virus 3
acaaacacaac

SEQ ID NO: 4013745 - RNA, 20 nt, Human parainfluenza virus 3
acaacagaacaaaguagaaa

SEQ ID NO: 4013746 - RNA, 18 nt, Human parainfluenza virus 3
acaaguuuuaucagagac

SEQ ID NO: 4013747 - RNA, 18 nt, Human parainfluenza virus 3
acaauaaagauauaucuu

SEQ ID NO: 4013748 - RNA, 20 nt, Human parainfluenza virus 3
acaauggaacuaauaaucuc

SEQ ID NO: 4013749 - RNA, 15 nt, Human parainfluenza virus 3
acaauuagaaaugau

SEQ ID NO: 4013750 - RNA, 16 nt, Human parainfluenza virus 3
acacaaaagacaaaug

SEQ ID NO: 4013751 - RNA, 18 nt, Human parainfluenza virus 3
acacaaaaucaagcagaa

SEQ ID NO: 4013752 - RNA, 22 nt, Human parainfluenza virus 3
acacaagggauugacaagaaua

SEQ ID NO: 4013753 - RNA, 16 nt, Human parainfluenza virus 3
acacaaucaacacaag

SEQ ID NO: 4013754 - RNA, 19 nt, Human parainfluenza virus 3
acacacaaaaucaagcaga

SEQ ID NO: 4013755 - RNA, 19 nt, Human parainfluenza virus 3
acacagauacaaaaugaaa

SEQ ID NO: 4013756 - RNA, 21 nt, Human parainfluenza virus 3
acaccaagaagaugacaaaag

SEQ ID NO: 4013757 - RNA, 15 nt, Human parainfluenza virus 3
acagaaaaucgagaa

SEQ ID NO: 4013758 - RNA, 18 nt, Human parainfluenza virus 3
acagaaaaucgagaaaau

SEQ ID NO: 4013759 - RNA, 22 nt, Human parainfluenza virus 3
acagaacaaaguagaaacagug

SEQ ID NO: 4013760 - RNA, 16 nt, Human parainfluenza virus 3
acagaagcaaaagaua

SEQ ID NO: 4013761 - RNA, 14 nt, Human parainfluenza virus 3
acagauacaaaaug

SEQ ID NO: 4013762 - RNA, 19 nt, Human parainfluenza virus 3
acaucaaaagggcagaaga

SEQ ID NO: 4013763 - RNA, 20 nt, Human parainfluenza virus 3
acauucauguccaaauggau

SEQ ID NO: 4013764 - RNA, 21 nt, Human parainfluenza virus 3
accaaaaaaucugaucuauua

SEQ ID NO: 4013765 - RNA, 11 nt, Human parainfluenza virus 3
accaaaaugaa

SEQ ID NO: 4013766 - RNA, 15 nt, Human parainfluenza virus 3
accaagcagaguucu

SEQ ID NO: 4013767 - RNA, 11 nt, Human parainfluenza virus 3
accaucuauca

SEQ ID NO: 4013768 - RNA, 17 nt, Human parainfluenza virus 3
accaucuaucaaccaaa

SEQ ID NO: 4013769 - RNA, 15 nt, Human parainfluenza virus 3
accgaacaaacagac

SEQ ID NO: 4013770 - RNA, 18 nt, Human parainfluenza virus 3
accuuuaucuuugagccc

SEQ ID NO: 4013771 - RNA, 21 nt, Human parainfluenza virus 3
acgacaccgaacaaacagaca

SEQ ID NO: 4013772 - RNA, 15 nt, Human parainfluenza virus 3
acuaaugaaaaauag

SEQ ID NO: 4013773 - RNA, 13 nt, Human parainfluenza virus 3
acucaaagucaau

SEQ ID NO: 4013774 - RNA, 20 nt, Human parainfluenza virus 3
acuuauaaaucagauaaaug

SEQ ID NO: 4013775 - RNA, 18 nt, Human parainfluenza virus 3
acuuucaacauaaaugac

SEQ ID NO: 4013776 - RNA, 21 nt, Human parainfluenza virus 3
agaaaaagagauuaaacaaga

SEQ ID NO: 4013777 - RNA, 19 nt, Human parainfluenza virus 3
agaaagaccaaaaugaauc

SEQ ID NO: 4013778 - RNA, 15 nt, Human parainfluenza virus 3
agaaauaaauaauga

SEQ ID NO: 4013779 - RNA, 15 nt, Human parainfluenza virus 3
agaaaucaaaagaua

SEQ ID NO: 4013780 - RNA, 15 nt, Human parainfluenza virus 3
agaacaccaaaacaa

SEQ ID NO: 4013781 - RNA, 21 nt, Human parainfluenza virus 3
agaacauauagucaaaugacu

SEQ ID NO: 4013782 - RNA, 17 nt, Human parainfluenza virus 3
agaagugagaagaacag

SEQ ID NO: 4013783 - RNA, 16 nt, Human parainfluenza virus 3
agacaaaaaguaagaa

SEQ ID NO: 4013784 - RNA, 17 nt, Human parainfluenza virus 3
agacaaauggaaaggaa

SEQ ID NO: 4013785 - RNA, 17 nt, Human parainfluenza virus 3
agacaauggacaaaagg

SEQ ID NO: 4013786 - RNA, 21 nt, Human parainfluenza virus 3
agagagacugcaaucaggcau

SEQ ID NO: 4013787 - RNA, 21 nt, Human parainfluenza virus 3
agagauuccaaaaagcugcag

SEQ ID NO: 4013788 - RNA, 22 nt, Human parainfluenza virus 3
agaguauccaugaucaaaacaa

SEQ ID NO: 4013789 - RNA, 19 nt, Human parainfluenza virus 3
agauacugacaaccagaua

SEQ ID NO: 4013790 - RNA, 13 nt, Human parainfluenza virus 3
agauagaacauau

SEQ ID NO: 4013791 - RNA, 18 nt, Human parainfluenza virus 3
agauugauagaaaaucaa

SEQ ID NO: 4013792 - RNA, 19 nt, Human parainfluenza virus 3
agauuuauaucaagacaaa

SEQ ID NO: 4013793 - RNA, 14 nt, Human parainfluenza virus 3
agcaaucaaaucag

SEQ ID NO: 4013794 - RNA, 18 nt, Human parainfluenza virus 3
agcaaucagggacacaaa

SEQ ID NO: 4013795 - RNA, 21 nt, Human parainfluenza virus 3
agcaaucagggacacaaacaa

SEQ ID NO: 4013796 - RNA, 17 nt, Human parainfluenza virus 3
agcagaugucaaagaau

SEQ ID NO: 4013797 - RNA, 23 nt, Human parainfluenza virus 3
aucacagcggcgguugcucuggu

SEQ ID NO: 4013798 - RNA, 23 nt, Human parainfluenza virus 3
aucacauagaagauugauagaaa

SEQ ID NO: 4013799 - RNA, 20 nt, Human parainfluenza virus 3
aucacgucauuaauuucaaa

SEQ ID NO: 4013800 - RNA, 22 nt, Human parainfluenza virus 3
aucauauauaaacgaacucaaa

SEQ ID NO: 4013801 - RNA, 17 nt, Human parainfluenza virus 3
aucaucaggaacacaau

SEQ ID NO: 4013802 - RNA, 14 nt, Human parainfluenza virus 3
aucucaaaaacaac

SEQ ID NO: 4013803 - RNA, 22 nt, Human parainfluenza virus 3
aucucggauugaucaagagaaa

SEQ ID NO: 4013804 - RNA, 16 nt, Human parainfluenza virus 3
aucugcaacacaacug

SEQ ID NO: 4013805 - RNA, 21 nt, Human parainfluenza virus 3
aucugcagguacauaucaaaa

SEQ ID NO: 4013806 - RNA, 15 nt, Human parainfluenza virus 3
aucuuaaccuuuauc

SEQ ID NO: 4013807 - RNA, 19 nt, Human parainfluenza virus 3
aucuuucugccaaauagau

SEQ ID NO: 4013808 - RNA, 19 nt, Human parainfluenza virus 3
augaguuuauggagauuac

SEQ ID NO: 4013809 - RNA, 18 nt, Human parainfluenza virus 3
augaucaaaacaaaauug

SEQ ID NO: 4013810 - RNA, 14 nt, Human parainfluenza virus 3
augccaacaaaguu

SEQ ID NO: 4013811 - RNA, 21 nt, Human parainfluenza virus 3
auguauauugagaaacaauua

SEQ ID NO: 4013812 - RNA, 19 nt, Human parainfluenza virus 3
augucggaucuuaggaaau

SEQ ID NO: 4013813 - RNA, 13 nt, Human parainfluenza virus 3
auuaaagaauaaa

SEQ ID NO: 4013814 - RNA, 12 nt, Human parainfluenza virus 3
auuaacacagau

SEQ ID NO: 4013815 - RNA, 12 nt, Human parainfluenza virus 3
auuaacaguaaa

SEQ ID NO: 4013816 - RNA, 17 nt, Human parainfluenza virus 3
auuaacaguaaagugac

SEQ ID NO: 4013817 - RNA, 18 nt, Human parainfluenza virus 3
auuaacgaccauaucaau

SEQ ID NO: 4013818 - RNA, 17 nt, Human parainfluenza virus 3
auuaauaauauaucaaa

SEQ ID NO: 4013819 - RNA, 16 nt, Human parainfluenza virus 3
auuacaaccauaauua

SEQ ID NO: 4013820 - RNA, 17 nt, Human parainfluenza virus 3
auuacaauuagaaauga

SEQ ID NO: 4013821 - RNA, 14 nt, Human parainfluenza virus 3
auuacugauuacag

SEQ ID NO: 4013822 - RNA, 13 nt, Human parainfluenza virus 3
auuauaaaugauc

SEQ ID NO: 4013823 - RNA, 12 nt, Human parainfluenza virus 3
auuauaccagaa

SEQ ID NO: 4013824 - RNA, 16 nt, Human parainfluenza virus 3
auucaauccacaucaa

SEQ ID NO: 4013825 - RNA, 21 nt, Human parainfluenza virus 3
auugaaagaagaaaagaucaa

SEQ ID NO: 4013826 - RNA, 22 nt, Human parainfluenza virus 3
auuguuuucauauaguagaaau

SEQ ID NO: 4013827 - RNA, 18 nt, Human parainfluenza virus 3
auuuaauaaauucauaga

SEQ ID NO: 4013828 - RNA, 17 nt, Human parainfluenza virus 3
caaaacaacaaaaccaa

SEQ ID NO: 4013829 - RNA, 23 nt, Human parainfluenza virus 3
caaaacagggguucagacugauu

SEQ ID NO: 4013830 - RNA, 15 nt, Human parainfluenza virus 3
caaagaauaacacau

SEQ ID NO: 4013831 - RNA, 14 nt, Human parainfluenza virus 3
caaaggauauuguu

SEQ ID NO: 4013832 - RNA, 14 nt, Human parainfluenza virus 3
caacaagacuaaua

SEQ ID NO: 4013833 - RNA, 22 nt, Human parainfluenza virus 3
caacaagacuaauacccaaaaa

SEQ ID NO: 4013834 - RNA, 20 nt, Human parainfluenza virus 3
caacagaaacaagugagaaa

SEQ ID NO: 4013835 - RNA, 14 nt, Human parainfluenza virus 3
caacagaagcaaaa

SEQ ID NO: 4013836 - RNA, 17 nt, Human parainfluenza virus 3
caacaucagacuacaga

SEQ ID NO: 4013837 - RNA, 20 nt, Human parainfluenza virus 3
caaccaaaaaucaaaccaac

SEQ ID NO: 4013838 - RNA, 21 nt, Human parainfluenza virus 3
caacucccaaaguugaugaaa

SEQ ID NO: 4013839 - RNA, 18 nt, Human parainfluenza virus 3
caacucccccaacaacaa

SEQ ID NO: 4013840 - RNA, 17 nt, Human parainfluenza virus 3
caacuuauaaaucagau

SEQ ID NO: 4013841 - RNA, 21 nt, Human parainfluenza virus 3
caagaaagaagggacaaaaaa

SEQ ID NO: 4013842 - RNA, 14 nt, Human parainfluenza virus 3
caagugagaaagau

SEQ ID NO: 4013843 - RNA, 15 nt, Human parainfluenza virus 3
caauacaaacaaaga

SEQ ID NO: 4013844 - RNA, 12 nt, Human parainfluenza virus 3
caauacaccaag

SEQ ID NO: 4013845 - RNA, 23 nt, Human parainfluenza virus 3
caauccaacucuacucauacaau

SEQ ID NO: 4013846 - RNA, 18 nt, Human parainfluenza virus 3
caaugagagaguauccau

SEQ ID NO: 4013847 - RNA, 19 nt, Human parainfluenza virus 3
caauggacaacgacacaaa

SEQ ID NO: 4013848 - RNA, 18 nt, Human parainfluenza virus 3
caauuaggaauaauugau

SEQ ID NO: 4013849 - RNA, 14 nt, Human parainfluenza virus 3
cacaaaaucaagca

SEQ ID NO: 4013850 - RNA, 21 nt, Human parainfluenza virus 3
cacagaucgaaccgaacagac

SEQ ID NO: 4013851 - RNA, 22 nt, Human parainfluenza virus 3
caccauugauaacaacacagau

SEQ ID NO: 4013852 - RNA, 19 nt, Human parainfluenza virus 3
cacgaauguacaacagaag

SEQ ID NO: 4013853 - RNA, 13 nt, Human parainfluenza virus 3
cacuagacagaaa

SEQ ID NO: 4013854 - RNA, 15 nt, Human parainfluenza virus 3
cagaauuaacaaaca

SEQ ID NO: 4013855 - RNA, 14 nt, Human parainfluenza virus 3
cagaauuauauacc

SEQ ID NO: 4013856 - RNA, 22 nt, Human parainfluenza virus 3
cagagaggaccugggagaagaa

SEQ ID NO: 4013857 - RNA, 16 nt, Human parainfluenza virus 3
cagaucaagcaauaca

SEQ ID NO: 4013858 - RNA, 15 nt, Human parainfluenza virus 3
cagaugauauaacau

SEQ ID NO: 4013859 - RNA, 14 nt, Human parainfluenza virus 3
cagcaacugaaaga

SEQ ID NO: 4013860 - RNA, 12 nt, Human parainfluenza virus 3
cagcaaucagac

SEQ ID NO: 4013861 - RNA, 15 nt, Human parainfluenza virus 3
cagccuuaugauaug

SEQ ID NO: 4013862 - RNA, 16 nt, Human parainfluenza virus 3
cauccaauaaaugaga

SEQ ID NO: 4013863 - RNA, 19 nt, Human parainfluenza virus 3
cauguaauauauauauacc

SEQ ID NO: 4013864 - RNA, 16 nt, Human parainfluenza virus 3
ccaagacacaaaagac

SEQ ID NO: 4013865 - RNA, 22 nt, Human parainfluenza virus 3
ccaagauuaugucaacaaagaa

SEQ ID NO: 4013866 - RNA, 18 nt, Human parainfluenza virus 3
ccaagcagaguucuucuc

SEQ ID NO: 4013867 - RNA, 20 nt, Human parainfluenza virus 3
ccaaucagaaaucuaagaaa

SEQ ID NO: 4013868 - RNA, 16 nt, Human parainfluenza virus 3
ccaaugauccaacaaa

SEQ ID NO: 4013869 - RNA, 12 nt, Human parainfluenza virus 3
ccagaacaaaac

SEQ ID NO: 4013870 - RNA, 12 nt, Human parainfluenza virus 3
ccagccauauca

SEQ ID NO: 4013871 - RNA, 13 nt, Human parainfluenza virus 3
ccaugaucaaaac

SEQ ID NO: 4013872 - RNA, 14 nt, Human parainfluenza virus 3
ccauuuuuaaugag

SEQ ID NO: 4013873 - RNA, 16 nt, Human parainfluenza virus 3
ccucaguuagaugagg

SEQ ID NO: 4013874 - RNA, 23 nt, Human parainfluenza virus 3
ccuuuaucuuugagcccaaggau

SEQ ID NO: 4013875 - RNA, 13 nt, Human parainfluenza virus 3
cgaugccaacaaa

SEQ ID NO: 4013876 - RNA, 16 nt, Human parainfluenza virus 3
cuaauaguagcaauca

SEQ ID NO: 4013877 - RNA, 14 nt, Human parainfluenza virus 3
cuaaugaaaaauag

SEQ ID NO: 4013878 - RNA, 20 nt, Human parainfluenza virus 3
cuauugaucaggaaacugua

SEQ ID NO: 4013879 - RNA, 12 nt, Human parainfluenza virus 3
cucaaaaacaac

SEQ ID NO: 4013880 - RNA, 16 nt, Human parainfluenza virus 3
cucacaaagcacaaaa

SEQ ID NO: 4013881 - RNA, 16 nt, Human parainfluenza virus 3
cucuacccaacacaau

SEQ ID NO: 4013882 - RNA, 12 nt, Human parainfluenza virus 3
cucuuugcaaaa

SEQ ID NO: 4013883 - RNA, 20 nt, Human parainfluenza virus 3
cugauacaagaucaauaagu

SEQ ID NO: 4013884 - RNA, 19 nt, Human parainfluenza virus 3
cuuaggauuaaagaauaaa

SEQ ID NO: 4013885 - RNA, 23 nt, Human parainfluenza virus 3
cuugcaacucaaucaauagagag

SEQ ID NO: 4013886 - RNA, 20 nt, Human parainfluenza virus 3
gaaaaaggaauaaaauuaca

SEQ ID NO: 4013887 - RNA, 17 nt, Human parainfluenza virus 3
gaaaaguucaaacacau

SEQ ID NO: 4013888 - RNA, 15 nt, Human parainfluenza virus 3
gaaauaaauaaugag

SEQ ID NO: 4013889 - RNA, 16 nt, Human parainfluenza virus 3
gaaauacuaaugaaaa

SEQ ID NO: 4013890 - RNA, 14 nt, Human parainfluenza virus 3
gaacaagaaagaag

SEQ ID NO: 4013891 - RNA, 14 nt, Human parainfluenza virus 3
gaacaccaaaacaa

SEQ ID NO: 4013892 - RNA, 19 nt, Human parainfluenza virus 3
gaacaccaaaacaacaaaa

SEQ ID NO: 4013893 - RNA, 17 nt, Human parainfluenza virus 3
gaacagacaaacacaac

SEQ ID NO: 4013894 - RNA, 13 nt, Human parainfluenza virus 3
gaagaagaaauac

SEQ ID NO: 4013895 - RNA, 21 nt, Human parainfluenza virus 3
gaagggacaaaaaaagcaaaa

SEQ ID NO: 4013896 - RNA, 13 nt, Human parainfluenza virus 3
gaaucaaagacaa

SEQ ID NO: 4013897 - RNA, 19 nt, Human parainfluenza virus 3
gacaaaaaguaagaaaaac

SEQ ID NO: 4013898 - RNA, 21 nt, Human parainfluenza virus 3
gacaaaagaggucaacaccaa

SEQ ID NO: 4013899 - RNA, 16 nt, Human parainfluenza virus 3
gacacaaaagacaaau

SEQ ID NO: 4013900 - RNA, 19 nt, Human respiratory syncytial virus
agaccgaacaaacaaaugu

SEQ ID NO: 4013901 - RNA, 15 nt, Human respiratory syncytial virus
agagacccaaaaaca

SEQ ID NO: 4013902 - RNA, 19 nt, Human respiratory syncytial virus
agauauagaaguaaccaaa

SEQ ID NO: 4013903 - RNA, 19 nt, Human respiratory syncytial virus
agaucaggucuuacagcag

SEQ ID NO: 4013904 - RNA, 21 nt, Human respiratory syncytial virus
agauggcucuuagcaaaguca

SEQ ID NO: 4013905 - RNA, 16 nt, Human respiratory syncytial virus
agcaauagaaaaaaca

SEQ ID NO: 4013906 - RNA, 13 nt, Human respiratory syncytial virus
agcagaagaacag

SEQ ID NO: 4013907 - RNA, 17 nt, Human respiratory syncytial virus
agcauauauuaugugac

SEQ ID NO: 4013908 - RNA, 22 nt, Human respiratory syncytial virus
agcauaugaaucuuaaaaaacu

SEQ ID NO: 4013909 - RNA, 21 nt, Human respiratory syncytial virus
agcauaugcagagcaacucaa

SEQ ID NO: 4013910 - RNA, 21 nt, Human respiratory syncytial virus
aggaagaaguccuugcauaug

SEQ ID NO: 4013911 - RNA, 16 nt, Human respiratory syncytial virus
aggauauagcuaacag

SEQ ID NO: 4013912 - RNA, 15 nt, Human respiratory syncytial virus
agggcaaguaaugcu

SEQ ID NO: 4013913 - RNA, 16 nt, Human respiratory syncytial virus
agguauguuauaugcu

SEQ ID NO: 4013914 - RNA, 11 nt, Human respiratory syncytial virus
aguaauuacuu

SEQ ID NO: 4013915 - RNA, 14 nt, Human respiratory syncytial virus
agucaacauggaga

SEQ ID NO: 4013916 - RNA, 15 nt, Human respiratory syncytial virus
agucagaaacacacc

SEQ ID NO: 4013917 - RNA, 14 nt, Human respiratory syncytial virus
agucauaauuacuu

SEQ ID NO: 4013918 - RNA, 21 nt, Human respiratory syncytial virus
agugucauaacaauagaauua

SEQ ID NO: 4013919 - RNA, 21 nt, Human respiratory syncytial virus
aguguccaggcagaaauggag

SEQ ID NO: 4013920 - RNA, 16 nt, Human respiratory syncytial virus
aguuauuuaaaaauua

SEQ ID NO: 4013921 - RNA, 13 nt, Human respiratory syncytial virus
auaaguggagcug

SEQ ID NO: 4013922 - RNA, 13 nt, Human respiratory syncytial virus
auaauacaaaaua

SEQ ID NO: 4013923 - RNA, 15 nt, Human respiratory syncytial virus
auacaaaauauggca

SEQ ID NO: 4013924 - RNA, 11 nt, Human respiratory syncytial virus
auacaaagaug

SEQ ID NO: 4013925 - RNA, 13 nt, Human respiratory syncytial virus
auacucucaauca

SEQ ID NO: 4013926 - RNA, 14 nt, Human respiratory syncytial virus
auacucucaaucau

SEQ ID NO: 4013927 - RNA, 20 nt, Human respiratory syncytial virus
auagaaucuagaaaauccua

SEQ ID NO: 4013928 - RNA, 22 nt, Human respiratory syncytial virus
auagcaagugguauagcuguau

SEQ ID NO: 4013929 - RNA, 20 nt, Human respiratory syncytial virus
auauaaaaacucaucaaagg

SEQ ID NO: 4013930 - RNA, 20 nt, Human respiratory syncytial virus
auauaguaacaaaaaaagaa

SEQ ID NO: 4013931 - RNA, 22 nt, Human respiratory syncytial virus
auaugaagagauaaaugaucaa

SEQ ID NO: 4013932 - RNA, 12 nt, Human respiratory syncytial virus
auauugaacaau

SEQ ID NO: 4013933 - RNA, 12 nt, Human respiratory syncytial virus
aucaaaaacaac

SEQ ID NO: 4013934 - RNA, 13 nt, Human respiratory syncytial virus
aucaaacacuaaa

SEQ ID NO: 4013935 - RNA, 19 nt, Human respiratory syncytial virus
aucaaucaaacuaugagca

SEQ ID NO: 4013936 - RNA, 16 nt, Human respiratory syncytial virus
aucauaaauucacagg

SEQ ID NO: 4013937 - RNA, 21 nt, Human respiratory syncytial virus
aucaucucugccaaucacaaa

SEQ ID NO: 4013938 - RNA, 16 nt, Human respiratory syncytial virus
aucaugaacaucuaca

SEQ ID NO: 4013939 - RNA, 22 nt, Human respiratory syncytial virus
aucauggcggguuucuagaaug

SEQ ID NO: 4013940 - RNA, 13 nt, Human respiratory syncytial virus
auccuacaaaaaa

SEQ ID NO: 4013941 - RNA, 19 nt, Human respiratory syncytial virus
aucuaauuguaauauccuc

SEQ ID NO: 4013942 - RNA, 21 nt, Human respiratory syncytial virus
aucucucaccaaagaaaucau

SEQ ID NO: 4013943 - RNA, 15 nt, Human respiratory syncytial virus
aucuguaccagcaga

SEQ ID NO: 4013944 - RNA, 16 nt, Human respiratory syncytial virus
aucuuaaaaaacuaac

SEQ ID NO: 4013945 - RNA, 14 nt, Human respiratory syncytial virus
augaacuauacaau

SEQ ID NO: 4013946 - RNA, 20 nt, Human respiratory syncytial virus
augaaguguuugaaaaacac

SEQ ID NO: 4013947 - RNA, 19 nt, Human respiratory syncytial virus
augagcacuacaaaugaca

SEQ ID NO: 4013948 - RNA, 17 nt, Human respiratory syncytial virus
augauacauuaaauaag

SEQ ID NO: 4013949 - RNA, 15 nt, Human respiratory syncytial virus
augcuauuaaucacu

SEQ ID NO: 4013950 - RNA, 15 nt, Human respiratory syncytial virus
augggaucaaaaaca

SEQ ID NO: 4013951 - RNA, 15 nt, Human respiratory syncytial virus
augugcaaaaacacc

SEQ ID NO: 4013952 - RNA, 18 nt, Human respiratory syncytial virus
auguuugcuuaauuacuu

SEQ ID NO: 4013953 - RNA, 14 nt, Human respiratory syncytial virus
auuaaugaucacgg

SEQ ID NO: 4013954 - RNA, 13 nt, Human respiratory syncytial virus
auuaugacaucaa

SEQ ID NO: 4013955 - RNA, 15 nt, Human respiratory syncytial virus
auuaugauugcaaua

SEQ ID NO: 4013956 - RNA, 13 nt, Human respiratory syncytial virus
auucacaaaauua

SEQ ID NO: 4013957 - RNA, 15 nt, Human respiratory syncytial virus
auucgaaguauuaac

SEQ ID NO: 4013958 - RNA, 20 nt, Human respiratory syncytial virus
auugcaaagccaaaaacaca

SEQ ID NO: 4013959 - RNA, 20 nt, Human respiratory syncytial virus
auuuaaaaauuaacauaaug

SEQ ID NO: 4013960 - RNA, 15 nt, Human respiratory syncytial virus
auuuacaacacaacg

SEQ ID NO: 4013961 - RNA, 12 nt, Human respiratory syncytial virus
auuucauggaga

SEQ ID NO: 4013962 - RNA, 12 nt, Human respiratory syncytial virus
caaaaaaaccaa

SEQ ID NO: 4013963 - RNA, 19 nt, Human respiratory syncytial virus
caaaaaaaugcuaaaagag

SEQ ID NO: 4013964 - RNA, 21 nt, Human respiratory syncytial virus
caaaaaauacggggcaaauaa

SEQ ID NO: 4013965 - RNA, 17 nt, Human respiratory syncytial virus
caaaaaucacucaguaa

SEQ ID NO: 4013966 - RNA, 15 nt, Human respiratory syncytial virus
caaaacacaccagcu

SEQ ID NO: 4013967 - RNA, 13 nt, Human respiratory syncytial virus
caaaauuaaauaa

SEQ ID NO: 4013968 - RNA, 13 nt, Human respiratory syncytial virus
caaacaacaaugc

SEQ ID NO: 4013969 - RNA, 14 nt, Human respiratory syncytial virus
caaacccacaaaca

SEQ ID NO: 4013970 - RNA, 19 nt, Human respiratory syncytial virus
caaacuaugagcacuacaa

SEQ ID NO: 4013971 - RNA, 17 nt, Human respiratory syncytial virus
caaagaaacaauagaaa

SEQ ID NO: 4013972 - RNA, 21 nt, Human respiratory syncytial virus
caaagauccuaagaagaaaga

SEQ ID NO: 4013973 - RNA, 19 nt, Human respiratory syncytial virus
caaagucaaguuaaaugau

SEQ ID NO: 4013974 - RNA, 16 nt, Human respiratory syncytial virus
caaauauaucaagcca

SEQ ID NO: 4013975 - RNA, 17 nt, Human respiratory syncytial virus
caaauauggaaacauac

SEQ ID NO: 4013976 - RNA, 15 nt, Human respiratory syncytial virus
caaaucuguaaaaaa

SEQ ID NO: 4013977 - RNA, 15 nt, Human respiratory syncytial virus
caaaugacaacacua

SEQ ID NO: 4013978 - RNA, 16 nt, Human respiratory syncytial virus
caacacuacuaugcaa

SEQ ID NO: 4013979 - RNA, 14 nt, Human respiratory syncytial virus
caacauaacaaaac

SEQ ID NO: 4013980 - RNA, 16 nt, Human respiratory syncytial virus
caacaucaucaaucca

SEQ ID NO: 4013981 - RNA, 17 nt, Human respiratory syncytial virus
caagaaauacacugaau

SEQ ID NO: 4013982 - RNA, 20 nt, Human respiratory syncytial virus
caagaaucaacgcacugcca

SEQ ID NO: 4013983 - RNA, 16 nt, Human respiratory syncytial virus
caagccgagcacaaaa

SEQ ID NO: 4013984 - RNA, 19 nt, Human respiratory syncytial virus
caagccgagcacaaaacca

SEQ ID NO: 4013985 - RNA, 18 nt, Human respiratory syncytial virus
caagcuauuccucaaaca

SEQ ID NO: 4013986 - RNA, 23 nt, Human respiratory syncytial virus
caauaauaacaucucucaccaaa

SEQ ID NO: 4013987 - RNA, 14 nt, Human respiratory syncytial virus
caauaccaagcaac

SEQ ID NO: 4013988 - RNA, 23 nt, Human respiratory syncytial virus
caauaccaagcaacaaaccaaag

SEQ ID NO: 4013989 - RNA, 13 nt, Human respiratory syncytial virus
caaucaaaccacu

SEQ ID NO: 4013990 - RNA, 23 nt, Human respiratory syncytial virus
caaucaaccaacugauccaucag

SEQ ID NO: 4013991 - RNA, 13 nt, Human respiratory syncytial virus
cacaaacaaacca

SEQ ID NO: 4013992 - RNA, 20 nt, Human respiratory syncytial virus
cacaacagcacaaaccaaag

SEQ ID NO: 4013993 - RNA, 19 nt, Human respiratory syncytial virus
cacagaaguugggaggaga

SEQ ID NO: 4013994 - RNA, 20 nt, Human respiratory syncytial virus
caccaacccaacaaaaaaac

SEQ ID NO: 4013995 - RNA, 16 nt, Human respiratory syncytial virus
caccaauccacacaaa

SEQ ID NO: 4013996 - RNA, 16 nt, Human respiratory syncytial virus
cacccccgaaaacaca

SEQ ID NO: 4013997 - RNA, 17 nt, Human respiratory syncytial virus
cacguuuuucaaucaaa

SEQ ID NO: 4013998 - RNA, 24 nt, Human respiratory syncytial virus
cacuacaaaugacaacacuacuau

SEQ ID NO: 4013999 - RNA, 16 nt, Human respiratory syncytial virus
cacuaccagccacuau

SEQ ID NO: 4014000 - RNA, 17 nt, Human respiratory syncytial virus
cacucccaauuaugaug

SEQ ID NO: 4014001 - RNA, 15 nt, Human respiratory syncytial virus
cagcaaauacacuau

SEQ ID NO: 4014002 - RNA, 20 nt, Human respiratory syncytial virus
cagcaaucaacaacaucaau

SEQ ID NO: 4014003 - RNA, 13 nt, Human respiratory syncytial virus
cagcugcugucau

SEQ ID NO: 4014004 - RNA, 14 nt, Human respiratory syncytial virus
caggacucuagaaa

SEQ ID NO: 4014005 - RNA, 17 nt, Human respiratory syncytial virus
caggacucuagaaaaga

SEQ ID NO: 4014006 - RNA, 15 nt, Human respiratory syncytial virus
caggcagaaauggag

SEQ ID NO: 4014007 - RNA, 15 nt, Human respiratory syncytial virus
cagguuaggaaggga

SEQ ID NO: 4014008 - RNA, 11 nt, Human respiratory syncytial virus
caguaaaucaa

SEQ ID NO: 4014009 - RNA, 21 nt, Human respiratory syncytial virus
caguaauuaggagggcaaaca

SEQ ID NO: 4014010 - RNA, 20 nt, Human respiratory syncytial virus
caguaccccagaaaccaaag

SEQ ID NO: 4014011 - RNA, 19 nt, Human respiratory syncytial virus
cauccagcaaauacacuau

SEQ ID NO: 4014012 - RNA, 16 nt, Human respiratory syncytial virus
caucuguaccagcaga

SEQ ID NO: 4014013 - RNA, 17 nt, Human respiratory syncytial virus
cauuggggcaaaugcaa

SEQ ID NO: 4014014 - RNA, 20 nt, Human respiratory syncytial virus
cauuuggauaaccaccagcg

SEQ ID NO: 4014015 - RNA, 13 nt, Human respiratory syncytial virus
ccaaaaaaaccaa

SEQ ID NO: 4014016 - RNA, 11 nt, Human respiratory syncytial virus
ccaaaccaaaa

SEQ ID NO: 4014017 - RNA, 21 nt, Human respiratory syncytial virus
ccaaaccaagcuauuccucaa

SEQ ID NO: 4014018 - RNA, 15 nt, Human respiratory syncytial virus
ccaacccaacaaaaa

SEQ ID NO: 4014019 - RNA, 15 nt, Human respiratory syncytial virus
ccaacccaaccaaac

SEQ ID NO: 4014020 - RNA, 9 nt, Human respiratory syncytial virus
ccacaaaca

SEQ ID NO: 4014021 - RNA, 18 nt, Human respiratory syncytial virus
ccacaaacaaaccaacca

SEQ ID NO: 4014022 - RNA, 14 nt, Human respiratory syncytial virus
ccacagaaagagac

SEQ ID NO: 4014023 - RNA, 16 nt, Human respiratory syncytial virus
ccgagcacaaaaccac

SEQ ID NO: 4014024 - RNA, 23 nt, Human respiratory syncytial virus
ccgucagcggaaccaccaaccaa

SEQ ID NO: 4014025 - RNA, 13 nt, Human respiratory syncytial virus
ccuaucaagcaag

SEQ ID NO: 4014026 - RNA, 17 nt, Human respiratory syncytial virus
cguaaauuccaacaaaa

SEQ ID NO: 4014027 - RNA, 19 nt, Human respiratory syncytial virus
cuaaacaaacuauguggua

SEQ ID NO: 4014028 - RNA, 16 nt, Human respiratory syncytial virus
cuaggacagaugcauc

SEQ ID NO: 4014029 - RNA, 16 nt, Human respiratory syncytial virus
cuaggcaaugcagcag

SEQ ID NO: 4014030 - RNA, 18 nt, Human respiratory syncytial virus
cuaguaagcuucaaagaa

SEQ ID NO: 4014031 - RNA, 17 nt, Human respiratory syncytial virus
cuaugagcacuacaaau

SEQ ID NO: 4014032 - RNA, 14 nt, Human respiratory syncytial virus
cuaugcaccaccaa

SEQ ID NO: 4014033 - RNA, 16 nt, Human respiratory syncytial virus
cucaaacuacacacua

SEQ ID NO: 4014034 - RNA, 18 nt, Human respiratory syncytial virus
cucaaucaucuaauugua

SEQ ID NO: 4014035 - RNA, 13 nt, Human respiratory syncytial virus
cucuuagcaaagu

SEQ ID NO: 4014036 - RNA, 15 nt, Human respiratory syncytial virus
cugaacucacuagaa

SEQ ID NO: 4014037 - RNA, 19 nt, Human respiratory syncytial virus
cugaagauauauauacaau

SEQ ID NO: 4014038 - RNA, 14 nt, Human respiratory syncytial virus
cugaagaugcaaau

SEQ ID NO: 4014039 - RNA, 22 nt, Human respiratory syncytial virus
cugaaucauuucuucacaucau

SEQ ID NO: 4014040 - RNA, 17 nt, Human respiratory syncytial virus
cugccagaccgaacaaa

SEQ ID NO: 4014041 - RNA, 19 nt, Human respiratory syncytial virus
cugcugucauccagcaaau

SEQ ID NO: 4014042 - RNA, 22 nt, Human respiratory syncytial virus
cuggaaauuacacacaucaccu

SEQ ID NO: 4014043 - RNA, 22 nt, Human respiratory syncytial virus
cuuaacucauaguuacauaaaa

SEQ ID NO: 4014044 - RNA, 13 nt, Human respiratory syncytial virus
cuuacagcaguaa

SEQ ID NO: 4014045 - RNA, 19 nt, Human respiratory syncytial virus
cuuaccaugaagacauuca

SEQ ID NO: 4014046 - RNA, 17 nt, Human respiratory syncytial virus
gaaagauagcauaauau

SEQ ID NO: 4014047 - RNA, 20 nt, Human respiratory syncytial virus
gaaaucaucacacacaaauu

SEQ ID NO: 4014048 - RNA, 15 nt, Human respiratory syncytial virus
gaagaaaugauagaa

SEQ ID NO: 4014049 - RNA, 20 nt, Human respiratory syncytial virus
gaauuucauggagaagaugc

SEQ ID NO: 4014050 - RNA, 21 nt, Human respiratory syncytial virus
gacaagcuacauuuacauucu

SEQ ID NO: 4014051 - RNA, 13 nt, Human respiratory syncytial virus
gacacuauaaaga

SEQ ID NO: 4014052 - RNA, 14 nt, Human respiratory syncytial virus
gaccgaacaaacaa

SEQ ID NO: 4014053 - RNA, 17 nt, Human respiratory syncytial virus
gagaaguggcuccagaa

SEQ ID NO: 4014054 - RNA, 12 nt, Human respiratory syncytial virus
gagacaccagca

SEQ ID NO: 4014055 - RNA, 12 nt, Human respiratory syncytial virus
gagcaacucaaa

SEQ ID NO: 4014056 - RNA, 15 nt, Human respiratory syncytial virus
gauaacaaugaagaa

SEQ ID NO: 4014057 - RNA, 14 nt, Human respiratory syncytial virus
gaugcaaauaacaa

SEQ ID NO: 4014058 - RNA, 22 nt, Human respiratory syncytial virus
gauggcucuuagcaaagucaag

SEQ ID NO: 4014059 - RNA, 18 nt, Human respiratory syncytial virus
gauuaaauuuaaaaucua

SEQ ID NO: 4014060 - RNA, 22 nt, Human respiratory syncytial virus
gcaaauaagucaacauggagaa

SEQ ID NO: 4014061 - RNA, 21 nt, Human respiratory syncytial virus
gcaagacuuaggaaugaggaa

SEQ ID NO: 4014062 - RNA, 20 nt, Human respiratory syncytial virus
gcacugcauccaacaaaaau

SEQ ID NO: 4014063 - RNA, 21 nt, Human respiratory syncytial virus
gcacugccaggacucuagaaa

SEQ ID NO: 4014064 - RNA, 21 nt, Human respiratory syncytial virus
gcauaauaucuguuaacucaa

SEQ ID NO: 4014065 - RNA, 22 nt, Human respiratory syncytial virus
gcggaaccaccaaccaaucaau

SEQ ID NO: 4014066 - RNA, 23 nt, Human respiratory syncytial virus
gcugaucaccaaucccaaaucaa

SEQ ID NO: 4014067 - RNA, 18 nt, Human respiratory syncytial virus
gcugucauccagcaaaua

SEQ ID NO: 4014068 - RNA, 14 nt, Human respiratory syncytial virus
ggacucuagaaaag

SEQ ID NO: 4014069 - RNA, 17 nt, Human respiratory syncytial virus
ggcaugauucuccagac

SEQ ID NO: 4014070 - RNA, 14 nt, Human respiratory syncytial virus
guaacaaaaaaaga

SEQ ID NO: 4014071 - RNA, 19 nt, Human respiratory syncytial virus
guaccaaauacaagaaaua

SEQ ID NO: 4014072 - RNA, 13 nt, Human respiratory syncytial virus
guacgccaagaaa

SEQ ID NO: 4014073 - RNA, 14 nt, Human respiratory syncytial virus
guauaguuggagug

SEQ ID NO: 4014074 - RNA, 22 nt, Human respiratory syncytial virus
gucaaugaaaaaaucaaucaaa

SEQ ID NO: 4014075 - RNA, 18 nt, Human respiratory syncytial virus
gucagcggaaccaccaac

SEQ ID NO: 4014076 - RNA, 14 nt, Human respiratory syncytial virus
gucauuaacucaau

SEQ ID NO: 4014077 - RNA, 22 nt, Human respiratory syncytial virus
gucuaugaguaugcacagaagu

SEQ ID NO: 4014078 - RNA, 16 nt, Human respiratory syncytial virus
guuagaguucaaucaa

SEQ ID NO: 4014079 - RNA, 16 nt, Human respiratory syncytial virus
guucaaacaauaaaaa

SEQ ID NO: 4014080 - RNA, 22 nt, Human respiratory syncytial virus
guucaguacaauguucuagaaa

SEQ ID NO: 4014081 - RNA, 12 nt, Human respiratory syncytial virus
guucuagaaaaa

SEQ ID NO: 4014082 - RNA, 16 nt, Human respiratory syncytial virus
guuuauuuuaaaucaa

SEQ ID NO: 4014083 - RNA, 18 nt, Human respiratory syncytial virus
uaaaacuuauaaaacaag

SEQ ID NO: 4014084 - RNA, 19 nt, Human respiratory syncytial virus
uaaaaugggaaauacaucc

SEQ ID NO: 4014085 - RNA, 17 nt, Human respiratory syncytial virus
uaaauaaccaauuauua

SEQ ID NO: 4014086 - RNA, 20 nt, Human respiratory syncytial virus
uaaauguaucaauaagcaag

SEQ ID NO: 4014087 - RNA, 15 nt, Human respiratory syncytial virus
uaaauuuaaaaucua

SEQ ID NO: 4014088 - RNA, 20 nt, Human respiratory syncytial virus
uaauaaccaaauuagcagca

SEQ ID NO: 4014089 - RNA, 20 nt, Human respiratory syncytial virus
uaauacuguguauagcagca

SEQ ID NO: 4014090 - RNA, 17 nt, Human respiratory syncytial virus
uaauagguauguuauau

SEQ ID NO: 4014091 - RNA, 12 nt, Human respiratory syncytial virus
uaugcaaagauu

SEQ ID NO: 4014092 - RNA, 18 nt, Human respiratory syncytial virus
uaugcaaagauuaaugau

SEQ ID NO: 4014093 - RNA, 22 nt, Human respiratory syncytial virus
uaugcacagaaguugggaggag

SEQ ID NO: 4014094 - RNA, 17 nt, Human respiratory syncytial virus
uauuagacuuaacagca

SEQ ID NO: 4014095 - RNA, 15 nt, Human respiratory syncytial virus
uauuaugacaucaaa

SEQ ID NO: 4014096 - RNA, 21 nt, Human respiratory syncytial virus
uauuccucaaacaacaaugcu

SEQ ID NO: 4014097 - RNA, 13 nt, Human respiratory syncytial virus
ucaaaaacaacau

SEQ ID NO: 4014098 - RNA, 12 nt, Human respiratory syncytial virus
ucaaaacaacac

SEQ ID NO: 4014099 - RNA, 21 nt, Human respiratory syncytial virus
ucaacaacaucaauaaaacag

SEQ ID NO: 4014100 - RNA, 18 nt, Human respiratory syncytial virus
ucaacccauaacaaacac

SEQ ID NO: 4014101 - RNA, 12 nt, Human respiratory syncytial virus
ucacaauuauuu

SEQ ID NO: 4014102 - RNA, 23 nt, Human respiratory syncytial virus
ucagcaaauagacaaaaaaccac

SEQ ID NO: 4014103 - RNA, 12 nt, Human respiratory syncytial virus
ucagcaaucaac

SEQ ID NO: 4014104 - RNA, 18 nt, Human respiratory syncytial virus
ucagggcaaguaaugcua

SEQ ID NO: 4014105 - RNA, 22 nt, Human respiratory syncytial virus
ucauaaaagaacuugcaagcau

SEQ ID NO: 4014106 - RNA, 19 nt, Human respiratory syncytial virus
ucauccaaagauccuaaga

SEQ ID NO: 4014107 - RNA, 18 nt, Human respiratory syncytial virus
ucauccagcaaauacacu

SEQ ID NO: 4014108 - RNA, 14 nt, Human respiratory syncytial virus
ucauguuaaagcua

SEQ ID NO: 4014109 - RNA, 22 nt, Human respiratory syncytial virus
uccaaacaaccuacaaccacau

SEQ ID NO: 4014110 - RNA, 11 nt, Human respiratory syncytial virus
ucccacucaaa

SEQ ID NO: 4014111 - RNA, 12 nt, Human respiratory syncytial virus
ucgcaaaaccac

SEQ ID NO: 4014112 - RNA, 20 nt, Human respiratory syncytial virus
ucuagaaaauccuacaaaaa

SEQ ID NO: 4014113 - RNA, 21 nt, Human respiratory syncytial virus
ucucaagugugguccuaggca

SEQ ID NO: 4014114 - RNA, 18 nt, Human respiratory syncytial virus
ugaauaaaagucuaaaac

SEQ ID NO: 4014115 - RNA, 17 nt, Human respiratory syncytial virus
ugaauauaauacaaaau

SEQ ID NO: 4014116 - RNA, 16 nt, Human respiratory syncytial virus
ugacgaaauuaacaau

SEQ ID NO: 4014117 - RNA, 18 nt, Human respiratory syncytial virus
ugauaacuacaauuauua

SEQ ID NO: 4014118 - RNA, 20 nt, Human respiratory syncytial virus
ugaucaacucacucagcaau

SEQ ID NO: 4014119 - RNA, 17 nt, Human respiratory syncytial virus
ugaugcagccaaagcau

SEQ ID NO: 4014120 - RNA, 13 nt, Human respiratory syncytial virus
ugcaagcaucaac

SEQ ID NO: 4014121 - RNA, 20 nt, Human respiratory syncytial virus
ugccucuuaauccaacuucc

SEQ ID NO: 4014122 - RNA, 16 nt, Human respiratory syncytial virus
ugcuaguguccaggca

SEQ ID NO: 4014123 - RNA, 18 nt, Human respiratory syncytial virus
ugcucaauaguuaagaag

SEQ ID NO: 4014124 - RNA, 19 nt, Human respiratory syncytial virus
uggaagccauaaagaauca

SEQ ID NO: 4014125 - RNA, 18 nt, Human respiratory syncytial virus
uggagaagaugcaaauaa

SEQ ID NO: 4014126 - RNA, 18 nt, Human respiratory syncytial virus
uggggcaaauaaacucac

SEQ ID NO: 4014127 - RNA, 14 nt, Human respiratory syncytial virus
ugguaugcuauuaa

SEQ ID NO: 4014128 - RNA, 14 nt, Human respiratory syncytial virus
uuaaaaauaaaagu

SEQ ID NO: 4014129 - RNA, 12 nt, Human respiratory syncytial virus
uuaaagaugcug

SEQ ID NO: 4014130 - RNA, 19 nt, Human respiratory syncytial virus
uuaagcccaacaauaauuc

SEQ ID NO: 4014131 - RNA, 22 nt, Human respiratory syncytial virus
uuaagcccaacaauaauucagg

SEQ ID NO: 4014132 - RNA, 13 nt, Human respiratory syncytial virus
uuacaacacaacg

SEQ ID NO: 4014133 - RNA, 18 nt, Human respiratory syncytial virus
uuacacuaauacauauga

SEQ ID NO: 4014134 - RNA, 12 nt, Human respiratory syncytial virus
uucaacaucaca

SEQ ID NO: 4014135 - RNA, 18 nt, Human respiratory syncytial virus
uucagccacaacaucacc

SEQ ID NO: 4014136 - RNA, 15 nt, Human respiratory syncytial virus
uucaucacacaaacc

SEQ ID NO: 4014137 - RNA, 23 nt, Human respiratory syncytial virus
uugacacucccaauuaugaugug

SEQ ID NO: 4014138 - RNA, 20 nt, Human respiratory syncytial virus
uuggucaaauuuagaugcua

SEQ ID NO: 4014139 - RNA, 18 nt, Human respiratory syncytial virus
uugugacacuaugaacag

SEQ ID NO: 4014140 - RNA, 20 nt, Human respiratory syncytial virus
uuuaaguuaacaaaaaauac

SEQ ID NO: 4014141 - RNA, 18 nt, Human respiratory syncytial virus
auauacaaaauuaaauaa

SEQ ID NO: 4014142 - RNA, 13 nt, Human respiratory syncytial virus
auaucauguuaaa

SEQ ID NO: 4014143 - RNA, 12 nt, Human respiratory syncytial virus
auaugaagagau

SEQ ID NO: 4014144 - RNA, 22 nt, Human respiratory syncytial virus
auaugcaaacuuuucaauaauu

SEQ ID NO: 4014145 - RNA, 17 nt, Human respiratory syncytial virus
aucaacaacaucaauaa

SEQ ID NO: 4014146 - RNA, 22 nt, Human respiratory syncytial virus
aucaacauacuagugaagcaga

SEQ ID NO: 4014147 - RNA, 21 nt, Human respiratory syncytial virus
aucaacucaacccuaaagaag

SEQ ID NO: 4014148 - RNA, 15 nt, Human respiratory syncytial virus
aucaauaaaacagac

SEQ ID NO: 4014149 - RNA, 23 nt, Human respiratory syncytial virus
aucaaucauggcggguuucuaga

SEQ ID NO: 4014150 - RNA, 18 nt, Human respiratory syncytial virus
aucacaauagaauucaca

SEQ ID NO: 4014151 - RNA, 13 nt, Human respiratory syncytial virus
aucacuaacaaua

SEQ ID NO: 4014152 - RNA, 13 nt, Human respiratory syncytial virus
aucacucaguaaa

SEQ ID NO: 4014153 - RNA, 18 nt, Human respiratory syncytial virus
aucaggucuuacagcagu

SEQ ID NO: 4014154 - RNA, 16 nt, Human respiratory syncytial virus
auccaaucuucucaca

SEQ ID NO: 4014155 - RNA, 14 nt, Human respiratory syncytial virus
aucuuuaugaugca

SEQ ID NO: 4014156 - RNA, 16 nt, Human respiratory syncytial virus
augaagcuacugcaca

SEQ ID NO: 4014157 - RNA, 22 nt, Human respiratory syncytial virus
augauaauacuguguauagcag

SEQ ID NO: 4014158 - RNA, 14 nt, Human respiratory syncytial virus
augauacaugugca

SEQ ID NO: 4014159 - RNA, 12 nt, Human respiratory syncytial virus
augcaaaacaca

SEQ ID NO: 4014160 - RNA, 22 nt, Human respiratory syncytial virus
augcaaccauguccaaacacaa

SEQ ID NO: 4014161 - RNA, 24 nt, Human respiratory syncytial virus
auggcaaaagacaccucagaugaa

SEQ ID NO: 4014162 - RNA, 21 nt, Human respiratory syncytial virus
auguccagguuaggaagggaa

SEQ ID NO: 4014163 - RNA, 22 nt, Human respiratory syncytial virus
augucuuaaaaaaugaaauaaa

SEQ ID NO: 4014164 - RNA, 23 nt, Human respiratory syncytial virus
auguuguguuaucacaauuauuu

SEQ ID NO: 4014165 - RNA, 23 nt, Human respiratory syncytial virus
auuaacaaguuuggucaaauuua

SEQ ID NO: 4014166 - RNA, 20 nt, Human respiratory syncytial virus
auuaggagggcaaacaaugu

SEQ ID NO: 4014167 - RNA, 15 nt, Human respiratory syncytial virus
auuaugaugugcaaa

SEQ ID NO: 4014168 - RNA, 19 nt, Human respiratory syncytial virus
auucuaccauauauugaac

SEQ ID NO: 4014169 - RNA, 16 nt, Human respiratory syncytial virus
auucuuagucaauuau

SEQ ID NO: 4014170 - RNA, 15 nt, Human respiratory syncytial virus
auugaugaaaaauua

SEQ ID NO: 4014171 - RNA, 16 nt, Human respiratory syncytial virus
auugcucuaugugaau

SEQ ID NO: 4014172 - RNA, 19 nt, Human respiratory syncytial virus
auuuuugaucagugaucaa

SEQ ID NO: 4014173 - RNA, 14 nt, Human respiratory syncytial virus
caaaaacaccagcc

SEQ ID NO: 4014174 - RNA, 10 nt, Human respiratory syncytial virus
caaaaccaca

SEQ ID NO: 4014175 - RNA, 20 nt, Human respiratory syncytial virus
caaaaccacgccaacuauca

SEQ ID NO: 4014176 - RNA, 17 nt, Human respiratory syncytial virus
caaaccaaccaccaaaa

SEQ ID NO: 4014177 - RNA, 21 nt, Human respiratory syncytial virus
caaagagagcccgauaacauc

SEQ ID NO: 4014178 - RNA, 18 nt, Human respiratory syncytial virus
caaaggcagaaccaccac

SEQ ID NO: 4014179 - RNA, 13 nt, Human respiratory syncytial virus
caaauacaaagau

SEQ ID NO: 4014180 - RNA, 20 nt, Human respiratory syncytial virus
caaauagacaaaaaaccacc

SEQ ID NO: 4014181 - RNA, 18 nt, Human respiratory syncytial virus
caacaauaauucagguga

SEQ ID NO: 4014182 - RNA, 13 nt, Human respiratory syncytial virus
caaccacaucacc

SEQ ID NO: 4014183 - RNA, 19 nt, Human respiratory syncytial virus
caaccacaucaccaaucca

SEQ ID NO: 4014184 - RNA, 15 nt, Human respiratory syncytial virus
caacccucacgacca

SEQ ID NO: 4014185 - RNA, 14 nt, Human respiratory syncytial virus
caaccuacaaccac

SEQ ID NO: 4014186 - RNA, 19 nt, Human respiratory syncytial virus
caacguaguacaggagaua

SEQ ID NO: 4014187 - RNA, 21 nt, Human respiratory syncytial virus
caacuacuacuuacaaucaau

SEQ ID NO: 4014188 - RNA, 15 nt, Human respiratory syncytial virus
caacuccacacaaac

SEQ ID NO: 4014189 - RNA, 22 nt, Human respiratory syncytial virus
caagcuauuccucaaacaacaa

SEQ ID NO: 4014190 - RNA, 19 nt, Human respiratory syncytial virus
caagucccaccagaaaggg

SEQ ID NO: 4014191 - RNA, 15 nt, Human respiratory syncytial virus
caauaaaaaaccaca

SEQ ID NO: 4014192 - RNA, 16 nt, Human respiratory syncytial virus
caauagaaaaaacaac

SEQ ID NO: 4014193 - RNA, 17 nt, Human respiratory syncytial virus
caauuuauauacaaaau

SEQ ID NO: 4014194 - RNA, 17 nt, Human respiratory syncytial virus
cacaacagcacaaacca

SEQ ID NO: 4014195 - RNA, 21 nt, Human respiratory syncytial virus
cacaauagaauucacaagcaa

SEQ ID NO: 4014196 - RNA, 17 nt, Human respiratory syncytial virus
cacacaaaccaauccca

SEQ ID NO: 4014197 - RNA, 14 nt, Human respiratory syncytial virus
cacagaccaacaag

SEQ ID NO: 4014198 - RNA, 23 nt, Human respiratory syncytial virus
cacauauauccucaaacuacaca

SEQ ID NO: 4014199 - RNA, 16 nt, Human respiratory syncytial virus
caccagccaaaacgac

SEQ ID NO: 4014200 - RNA, 23 nt, Human respiratory syncytial virus
cacucaaccacccccgaaaacac

SEQ ID NO: 4014201 - RNA, 22 nt, Human respiratory syncytial virus
cacuccuauaauauacaaauau

SEQ ID NO: 4014202 - RNA, 18 nt, Human respiratory syncytial virus
cacugaauauaauacaaa

SEQ ID NO: 4014203 - RNA, 20 nt, Human respiratory syncytial virus
cacugaauauaauacaaaau

SEQ ID NO: 4014204 - RNA, 20 nt, Human respiratory syncytial virus
cacuuguaaaguacagucca

SEQ ID NO: 4014205 - RNA, 16 nt, Human respiratory syncytial virus
cagaccgaacaaacaa

SEQ ID NO: 4014206 - RNA, 15 nt, Human respiratory syncytial virus
cagacuugcucauaa

SEQ ID NO: 4014207 - RNA, 17 nt, Human respiratory syncytial virus
cagaugcaucaaaucaa

SEQ ID NO: 4014208 - RNA, 11 nt, Human respiratory syncytial virus
cagcacaaacc

SEQ ID NO: 4014209 - RNA, 21 nt, Human respiratory syncytial virus
cagcagauuguuggaaaucaa

SEQ ID NO: 4014210 - RNA, 21 nt, Human respiratory syncytial virus
cagccaaagcauaugcagagc

SEQ ID NO: 4014211 - RNA, 15 nt, Human respiratory syncytial virus
cagcggaaccaccaa

SEQ ID NO: 4014212 - RNA, 11 nt, Human respiratory syncytial virus
cagggcaagua

SEQ ID NO: 4014213 - RNA, 22 nt, Human respiratory syncytial virus
caguucaaacaauaaaaaacca

SEQ ID NO: 4014214 - RNA, 11 nt, Human respiratory syncytial virus
cauaacaaaca

SEQ ID NO: 4014215 - RNA, 19 nt, Human respiratory syncytial virus
cauagugcucuaccaucau

SEQ ID NO: 4014216 - RNA, 20 nt, Human respiratory syncytial virus
cauggugucgcaaaaccacg

SEQ ID NO: 4014217 - RNA, 14 nt, Human respiratory syncytial virus
cauguuaacaaaca

SEQ ID NO: 4014218 - RNA, 12 nt, Human respiratory syncytial virus
cauugcugucau

SEQ ID NO: 4014219 - RNA, 22 nt, Human respiratory syncytial virus
ccaaacaucaugaacaucuaca

SEQ ID NO: 4014220 - RNA, 22 nt, Human respiratory syncytial virus
ccaaagccaacuacccaagaaa

SEQ ID NO: 4014221 - RNA, 16 nt, Human respiratory syncytial virus
ccaaauuagcagcagg

SEQ ID NO: 4014222 - RNA, 14 nt, Human respiratory syncytial virus
ccaagcaacaaacc

SEQ ID NO: 4014223 - RNA, 13 nt, Human respiratory syncytial virus
ccacaaacaaacc

SEQ ID NO: 4014224 - RNA, 18 nt, Human respiratory syncytial virus
ccaccaaaaaaaccaaaa

SEQ ID NO: 4014225 - RNA, 16 nt, Human respiratory syncytial virus
ccaccaaaaccacaaa

SEQ ID NO: 4014226 - RNA, 20 nt, Human respiratory syncytial virus
ccaggaucuuuaugaugcag

SEQ ID NO: 4014227 - RNA, 18 nt, Human respiratory syncytial virus
ccucaaacuacacacuau

SEQ ID NO: 4014228 - RNA, 15 nt, Human respiratory syncytial virus
cgaacaaacaaaugu

SEQ ID NO: 4014229 - RNA, 22 nt, Human respiratory syncytial virus
cgccaagaaaccaggaucuuua

SEQ ID NO: 4014230 - RNA, 19 nt, Human respiratory syncytial virus
cuaaagaagaugauguaga

SEQ ID NO: 4014231 - RNA, 23 nt, Human respiratory syncytial virus
cuaacaaugauacaugugcauuu

SEQ ID NO: 4014232 - RNA, 21 nt, Human respiratory syncytial virus
cuaagugaacauaaaacauuc

SEQ ID NO: 4014233 - RNA, 15 nt, Human respiratory syncytial virus
cuacacuacacacuu

SEQ ID NO: 4014234 - RNA, 15 nt, Human respiratory syncytial virus
cuaugaguaugcaca

SEQ ID NO: 4014235 - RNA, 20 nt, Human respiratory syncytial virus
cucaagugugguccuaggca

SEQ ID NO: 4014236 - RNA, 23 nt, Human respiratory syncytial virus
cucuaccaucaugcugugucaaa

SEQ ID NO: 4014237 - RNA, 17 nt, Human respiratory syncytial virus
cugaaaaaaacaucacc

SEQ ID NO: 4014238 - RNA, 15 nt, Human respiratory syncytial virus
cuggcaaugauaauc

SEQ ID NO: 4014239 - RNA, 13 nt, Human respiratory syncytial virus
cuuaaaaaaugaa

SEQ ID NO: 4014240 - RNA, 18 nt, Human respiratory syncytial virus
cuugugaaaucaaagcau

SEQ ID NO: 4014241 - RNA, 16 nt, Human respiratory syncytial virus
cuuuaaguuaacaaaa

SEQ ID NO: 4014242 - RNA, 21 nt, Human respiratory syncytial virus
cuuuaugaugcagccaaagca

SEQ ID NO: 4014243 - RNA, 18 nt, Human respiratory syncytial virus
gaaaucaucacacacaaa

SEQ ID NO: 4014244 - RNA, 15 nt, Human respiratory syncytial virus
gaaaugauagaaaaa

SEQ ID NO: 4014245 - RNA, 20 nt, Human respiratory syncytial virus
gaacaauccaaaagcaucau

SEQ ID NO: 4014246 - RNA, 14 nt, Human respiratory syncytial virus
gaagccauaaagaa

SEQ ID NO: 4014247 - RNA, 18 nt, Human respiratory syncytial virus
gaagccauaaagaaucaa

SEQ ID NO: 4014248 - RNA, 15 nt, Human respiratory syncytial virus
gaaguggcuccagaa

SEQ ID NO: 4014249 - RNA, 16 nt, Human respiratory syncytial virus
gaauauaauacaaaau

SEQ ID NO: 4014250 - RNA, 17 nt, Human respiratory syncytial virus
gaauauaauacaaaaua

SEQ ID NO: 4014251 - RNA, 14 nt, Human respiratory syncytial virus
gacaaaaaaccacc

SEQ ID NO: 4014252 - RNA, 22 nt, Human respiratory syncytial virus
gacuagauagaauugaugaaaa

SEQ ID NO: 4014253 - RNA, 20 nt, Human respiratory syncytial virus
gagacccaaaaacaccagcc

SEQ ID NO: 4014254 - RNA, 23 nt, Human respiratory syncytial virus
gagauagaaucuagaaaauccua

SEQ ID NO: 4014255 - RNA, 17 nt, Human respiratory syncytial virus
gagcaacucaaagaaaa

SEQ ID NO: 4014256 - RNA, 12 nt, Human respiratory syncytial virus
gaguucaaucaa

SEQ ID NO: 4014257 - RNA, 15 nt, Human respiratory syncytial virus
gauacucucaaucau

SEQ ID NO: 4014258 - RNA, 17 nt, Human respiratory syncytial virus
gaucagaaaaaauuaau

SEQ ID NO: 4014259 - RNA, 16 nt, Human respiratory syncytial virus
gaugaaagacaagcua

SEQ ID NO: 4014260 - RNA, 21 nt, Human respiratory syncytial virus
gaugcaucaaaucaacacaua

SEQ ID NO: 4014261 - RNA, 23 nt, Human respiratory syncytial virus
gauuaauagguauguuauaugcu

SEQ ID NO: 4014262 - RNA, 19 nt, Human respiratory syncytial virus
gcaaaaacaccuaaacaaa

SEQ ID NO: 4014263 - RNA, 19 nt, Human respiratory syncytial virus
gcaaacaaugucuuaaaaa

SEQ ID NO: 4014264 - RNA, 20 nt, Human respiratory syncytial virus
gcaaacaaugucuuaaaaaa

SEQ ID NO: 4014265 - RNA, 20 nt, Human respiratory syncytial virus
gcaaagucaaguuaaaugau

SEQ ID NO: 4014266 - RNA, 12 nt, Human respiratory syncytial virus
gcaacaaucaac

SEQ ID NO: 4014267 - RNA, 17 nt, Human respiratory syncytial virus
gcaagaacgaaauuaaa

SEQ ID NO: 4014268 - RNA, 18 nt, Human respiratory syncytial virus
gcaauacuaaauaagcua

SEQ ID NO: 4014269 - RNA, 19 nt, Human respiratory syncytial virus
gcaauagaaaaaacaacaa

SEQ ID NO: 4014270 - RNA, 14 nt, Human respiratory syncytial virus
gcaaucaacaacau

SEQ ID NO: 4014271 - RNA, 21 nt, Human respiratory syncytial virus
gcagacuugcucauaaaagaa

SEQ ID NO: 4014272 - RNA, 15 nt, Human respiratory syncytial virus
gcagagcaacucaaa

SEQ ID NO: 4014273 - RNA, 20 nt, Human respiratory syncytial virus
gccauaaagaaucaacucaa

SEQ ID NO: 4014274 - RNA, 11 nt, Human respiratory syncytial virus
gccuacaaaac

SEQ ID NO: 4014275 - RNA, 17 nt, Human respiratory syncytial virus
gcuacucauaugaagag

SEQ ID NO: 4014276 - RNA, 15 nt, Human respiratory syncytial virus
ggaaaggaaaugaaa

SEQ ID NO: 4014277 - RNA, 17 nt, Human respiratory syncytial virus
ggaaauggggcaaauaa

SEQ ID NO: 4014278 - RNA, 15 nt, Human respiratory syncytial virus
ggaagccauaaagaa

SEQ ID NO: 4014279 - RNA, 22 nt, Human respiratory syncytial virus
ggaucugaacucacuagaaaac

SEQ ID NO: 4014280 - RNA, 20 nt, Human respiratory syncytial virus
gucuaggcauaaugggagag

SEQ ID NO: 4014281 - RNA, 16 nt, Human respiratory syncytial virus
gucuuaaaaaaugaaa

SEQ ID NO: 4014282 - RNA, 14 nt, Human respiratory syncytial virus
gugaacauaaaaca

SEQ ID NO: 4014283 - RNA, 17 nt, Human respiratory syncytial virus
gugccuaccuagaaaaa

SEQ ID NO: 4014284 - RNA, 16 nt, Human respiratory syncytial virus
gugucgcaaaaccacg

SEQ ID NO: 4014285 - RNA, 21 nt, Human respiratory syncytial virus
guuaaaugauacauuaaauaa

SEQ ID NO: 4014286 - RNA, 13 nt, Human respiratory syncytial virus
guuaauauaaaaa

SEQ ID NO: 4014287 - RNA, 13 nt, Human respiratory syncytial virus
guuuuuaugaagu

SEQ ID NO: 4014288 - RNA, 16 nt, Human respiratory syncytial virus
uaaaaaauaucaugcu

SEQ ID NO: 4014289 - RNA, 14 nt, Human respiratory syncytial virus
uaaaaaauaugcaa

SEQ ID NO: 4014290 - RNA, 16 nt, Human respiratory syncytial virus
uaaaaguaaagccaau

SEQ ID NO: 4014291 - RNA, 16 nt, Human respiratory syncytial virus
uaaagaagaugaugua

SEQ ID NO: 4014292 - RNA, 13 nt, Human respiratory syncytial virus
uaaauaaaaccaa

SEQ ID NO: 4014293 - RNA, 17 nt, Human respiratory syncytial virus
uaaaugaucaaacaaau

SEQ ID NO: 4014294 - RNA, 17 nt, Human respiratory syncytial virus
uaaauuggggcaaauac

SEQ ID NO: 4014295 - RNA, 23 nt, Human respiratory syncytial virus
uaaauuggggcaaauacaaagau

SEQ ID NO: 4014296 - RNA, 19 nt, Human respiratory syncytial virus
uaacaaugauacaugugca

SEQ ID NO: 4014297 - RNA, 12 nt, Human respiratory syncytial virus
uaaccaccagcg

SEQ ID NO: 4014298 - RNA, 15 nt, Human respiratory syncytial virus
uaacuacaauuauua

SEQ ID NO: 4014299 - RNA, 15 nt, Human respiratory syncytial virus
uacaagaaauacacu

SEQ ID NO: 4014300 - RNA, 15 nt, Human respiratory syncytial virus
uacauauacuauaaa

SEQ ID NO: 4014301 - RNA, 14 nt, Human respiratory syncytial virus
uacugaaauuauuu

SEQ ID NO: 4014302 - RNA, 22 nt, Human respiratory syncytial virus
uacuuaugcaaaacacaccagc

SEQ ID NO: 4014303 - RNA, 18 nt, Human respiratory syncytial virus
uagaaguaaccaaagaga

SEQ ID NO: 4014304 - RNA, 15 nt, Human respiratory syncytial virus
uagaauucacaagca

SEQ ID NO: 4014305 - RNA, 15 nt, Human respiratory syncytial virus
uagacaaaaaaccac

SEQ ID NO: 4014306 - RNA, 17 nt, Human respiratory syncytial virus
uagaguugaaggaaucu

SEQ ID NO: 4014307 - RNA, 18 nt, Human respiratory syncytial virus
uagggaguaccaaauaca

SEQ ID NO: 4014308 - RNA, 21 nt, Human respiratory syncytial virus
uagguaaauaaaaccaaaaua

SEQ ID NO: 4014309 - RNA, 17 nt, Human respiratory syncytial virus
uaguaagcuucaaagaa

SEQ ID NO: 4014310 - RNA, 13 nt, Human respiratory syncytial virus
uauaaacaaacaa

SEQ ID NO: 4014311 - RNA, 14 nt, Human respiratory syncytial virus
uaucacaauuauuu

SEQ ID NO: 4014312 - RNA, 13 nt, Human respiratory syncytial virus
aauucaaaaaugc

SEQ ID NO: 4014313 - RNA, 16 nt, Human respiratory syncytial virus
acaaauaugaccucaa

SEQ ID NO: 4014314 - RNA, 15 nt, Human respiratory syncytial virus
acaauaaaaaaccac

SEQ ID NO: 4014315 - RNA, 12 nt, Human respiratory syncytial virus
acaauagaauuc

SEQ ID NO: 4014316 - RNA, 21 nt, Human respiratory syncytial virus
acaaucagcauguguugcuau

SEQ ID NO: 4014317 - RNA, 20 nt, Human respiratory syncytial virus
acacaaauucauauacuuga

SEQ ID NO: 4014318 - RNA, 19 nt, Human respiratory syncytial virus
acacacaauccaacagcaa

SEQ ID NO: 4014319 - RNA, 17 nt, Human respiratory syncytial virus
acacuacuaugcaaaga

SEQ ID NO: 4014320 - RNA, 13 nt, Human respiratory syncytial virus
acagcagaagaau

SEQ ID NO: 4014321 - RNA, 21 nt, Human respiratory syncytial virus
acagcagaagaauuggaagcc

SEQ ID NO: 4014322 - RNA, 13 nt, Human respiratory syncytial virus
acauaaugaugaa

SEQ ID NO: 4014323 - RNA, 16 nt, Human respiratory syncytial virus
acauuaaaaagcugag

SEQ ID NO: 4014324 - RNA, 18 nt, Human respiratory syncytial virus
accaaccaccaaaaccac

SEQ ID NO: 4014325 - RNA, 11 nt, Human respiratory syncytial virus
accaauuauua

SEQ ID NO: 4014326 - RNA, 22 nt, Human respiratory syncytial virus
accauauauugaacaauccaaa

SEQ ID NO: 4014327 - RNA, 17 nt, Human respiratory syncytial virus
accauguccaaacacaa

SEQ ID NO: 4014328 - RNA, 22 nt, Human respiratory syncytial virus
accauuuauaccgccaauucaa

SEQ ID NO: 4014329 - RNA, 17 nt, Human respiratory syncytial virus
acccaaaaacaccagcc

SEQ ID NO: 4014330 - RNA, 13 nt, Human respiratory syncytial virus
accucucucauaa

SEQ ID NO: 4014331 - RNA, 15 nt, Human respiratory syncytial virus
accuugugaaaucaa

SEQ ID NO: 4014332 - RNA, 18 nt, Human respiratory syncytial virus
acuacagucaaagaucuu

SEQ ID NO: 4014333 - RNA, 15 nt, Human respiratory syncytial virus
acuacuaugcaaaga

SEQ ID NO: 4014334 - RNA, 20 nt, Human respiratory syncytial virus
acuauaaagauacuuaaaga

SEQ ID NO: 4014335 - RNA, 16 nt, Human respiratory syncytial virus
acuuuggcauugcaca

SEQ ID NO: 4014336 - RNA, 21 nt, Human respiratory syncytial virus
agaaacauuugauaacaauga

SEQ ID NO: 4014337 - RNA, 16 nt, Human respiratory syncytial virus
agaagaaccaacuuau

SEQ ID NO: 4014338 - RNA, 13 nt, Human respiratory syncytial virus
agaauuacauaaa

SEQ ID NO: 4014339 - RNA, 16 nt, Human respiratory syncytial virus
agacacuauaaagaua

SEQ ID NO: 4014340 - RNA, 19 nt, Human respiratory syncytial virus
agacuuaggaaugaggaaa

SEQ ID NO: 4014341 - RNA, 20 nt, Human respiratory syncytial virus
agagcaauagaaaaaacaac

SEQ ID NO: 4014342 - RNA, 23 nt, Human respiratory syncytial virus
agaugauguagagcuuuaaguua

SEQ ID NO: 4014343 - RNA, 22 nt, Human respiratory syncytial virus
agauggggaguuuuagccaaau

SEQ ID NO: 4014344 - RNA, 21 nt, Human respiratory syncytial virus
agcaacucaaagaaaauggag

SEQ ID NO: 4014345 - RNA, 18 nt, Human respiratory syncytial virus
agcaagacuagauagaau

SEQ ID NO: 4014346 - RNA, 18 nt, Human respiratory syncytial virus
agcaaucaacaacaucaa

SEQ ID NO: 4014347 - RNA, 17 nt, Human respiratory syncytial virus
agcuauuccucaaacaa

SEQ ID NO: 4014348 - RNA, 15 nt, Human respiratory syncytial virus
agcucauccaaacaa

SEQ ID NO: 4014349 - RNA, 18 nt, Human respiratory syncytial virus
aggaagggaagacacuau

SEQ ID NO: 4014350 - RNA, 15 nt, Human respiratory syncytial virus
aggauauagcuaaca

SEQ ID NO: 4014351 - RNA, 22 nt, Human respiratory syncytial virus
agucaaguuaaaugauacauua

SEQ ID NO: 4014352 - RNA, 18 nt, Human respiratory syncytial virus
aguguccaggcagaaaug

SEQ ID NO: 4014353 - RNA, 20 nt, Human respiratory syncytial virus
aguguccaggcagaaaugga

SEQ ID NO: 4014354 - RNA, 16 nt, Human respiratory syncytial virus
aguuaacaaaaaauac

SEQ ID NO: 4014355 - RNA, 20 nt, Human respiratory syncytial virus
auaaaacauucuguaacaau

SEQ ID NO: 4014356 - RNA, 19 nt, Human respiratory syncytial virus
auaaauuggggcaaauaca

SEQ ID NO: 4014357 - RNA, 15 nt, Human respiratory syncytial virus
auaaccauggagcug

SEQ ID NO: 4014358 - RNA, 14 nt, Human respiratory syncytial virus
auaauacuguguau

SEQ ID NO: 4014359 - RNA, 16 nt, Human respiratory syncytial virus
auagacauguguuuau

SEQ ID NO: 4014360 - RNA, 16 nt, Human respiratory syncytial virus
auaguaaggcaacaaa

SEQ ID NO: 4014361 - RNA, 13 nt, Human respiratory syncytial virus
auaguuacauaaa

SEQ ID NO: 4014362 - RNA, 13 nt, Human respiratory syncytial virus
auauacaaaauua

SEQ ID NO: 4014363 - RNA, 14 nt, Human respiratory syncytial virus
auauacaaauauga

SEQ ID NO: 4014364 - RNA, 15 nt, Human respiratory syncytial virus
auauauccucaaacu

SEQ ID NO: 4014365 - RNA, 13 nt, Human respiratory syncytial virus
auauccaaacauc

SEQ ID NO: 4014366 - RNA, 15 nt, Human respiratory syncytial virus
auauuuaucaaucau

SEQ ID NO: 4014367 - RNA, 17 nt, Human respiratory syncytial virus
aucaacucacucagcaa

SEQ ID NO: 4014368 - RNA, 20 nt, Human respiratory syncytial virus
aucauaaaggugaacugaaa

SEQ ID NO: 4014369 - RNA, 21 nt, Human respiratory syncytial virus
aucauaagcgcaaauguauca

SEQ ID NO: 4014370 - RNA, 12 nt, Human respiratory syncytial virus
aucauuaacaag

SEQ ID NO: 4014371 - RNA, 13 nt, Human respiratory syncytial virus
auccugcaucacu

SEQ ID NO: 4014372 - RNA, 22 nt, Human respiratory syncytial virus
aucgucaagauauaaauggaaa

SEQ ID NO: 4014373 - RNA, 21 nt, Human respiratory syncytial virus
aucuggcaccaacaucaucaa

SEQ ID NO: 4014374 - RNA, 14 nt, Human respiratory syncytial virus
aucuguaaaacaau

SEQ ID NO: 4014375 - RNA, 12 nt, Human respiratory syncytial virus
aucuuuaugaug

SEQ ID NO: 4014376 - RNA, 16 nt, Human respiratory syncytial virus
augaucaaacaaauga

SEQ ID NO: 4014377 - RNA, 15 nt, Human respiratory syncytial virus
augaugcagccaaag

SEQ ID NO: 4014378 - RNA, 17 nt, Human respiratory syncytial virus
augaugcagccaaagca

SEQ ID NO: 4014379 - RNA, 17 nt, Human respiratory syncytial virus
augcacagaaguuggga

SEQ ID NO: 4014380 - RNA, 16 nt, Human respiratory syncytial virus
augcuaguguccaggc

SEQ ID NO: 4014381 - RNA, 15 nt, Human respiratory syncytial virus
augcuauguccaggu

SEQ ID NO: 4014382 - RNA, 20 nt, Human respiratory syncytial virus
auggcucuuagcaaagucaa

SEQ ID NO: 4014383 - RNA, 21 nt, Human respiratory syncytial virus
augucacuacagucauaauua

SEQ ID NO: 4014384 - RNA, 13 nt, Human respiratory syncytial virus
auuaacucaagaa

SEQ ID NO: 4014385 - RNA, 21 nt, Human respiratory syncytial virus
auuaaucacugaagaugcaaa

SEQ ID NO: 4014386 - RNA, 21 nt, Human respiratory syncytial virus
auuagacuuaacagcagaaga

SEQ ID NO: 4014387 - RNA, 13 nt, Human respiratory syncytial virus
auuagaugaaaga

SEQ ID NO: 4014388 - RNA, 18 nt, Human respiratory syncytial virus
auucaauaauaacaucuc

SEQ ID NO: 4014389 - RNA, 12 nt, Human respiratory syncytial virus
auuccaaaauua

SEQ ID NO: 4014390 - RNA, 14 nt, Human respiratory syncytial virus
auuguuuaugaaug

SEQ ID NO: 4014391 - RNA, 24 nt, Human respiratory syncytial virus
auuuauaccgccaauucaauacau

SEQ ID NO: 4014392 - RNA, 13 nt, Human respiratory syncytial virus
caaaaaaaugcua

SEQ ID NO: 4014393 - RNA, 18 nt, Human respiratory syncytial virus
caaacaaauguccgucag

SEQ ID NO: 4014394 - RNA, 19 nt, Human respiratory syncytial virus
caaacacuucaacaucaca

SEQ ID NO: 4014395 - RNA, 20 nt, Human respiratory syncytial virus
caaaccaaaggcagaaccac

SEQ ID NO: 4014396 - RNA, 21 nt, Human respiratory syncytial virus
caaaccaaccaccaaaaccac

SEQ ID NO: 4014397 - RNA, 14 nt, Human respiratory syncytial virus
caaacuacacacua

SEQ ID NO: 4014398 - RNA, 15 nt, Human respiratory syncytial virus
caaaguuacacuaac

SEQ ID NO: 4014399 - RNA, 21 nt, Human respiratory syncytial virus
caaauaagucaacauggagaa

SEQ ID NO: 4014400 - RNA, 23 nt, Human respiratory syncytial virus
caaauacacuauucaacguagua

SEQ ID NO: 4014401 - RNA, 15 nt, Human respiratory syncytial virus
uaauauaaaaacuca

SEQ ID NO: 4014402 - RNA, 15 nt, Human respiratory syncytial virus
uacaaccacaucacc

SEQ ID NO: 4014403 - RNA, 17 nt, Human respiratory syncytial virus
uacaagaaauacacuga

SEQ ID NO: 4014404 - RNA, 23 nt, Human respiratory syncytial virus
uacacacuucaucacacaaacca

SEQ ID NO: 4014405 - RNA, 22 nt, Human respiratory syncytial virus
uaccaaauacaagaaauacacu

SEQ ID NO: 4014406 - RNA, 18 nt, Human respiratory syncytial virus
uaccauuuuaguuaauau

SEQ ID NO: 4014407 - RNA, 15 nt, Human respiratory syncytial virus
uacuaugcaaagauu

SEQ ID NO: 4014408 - RNA, 20 nt, Human respiratory syncytial virus
uagaaacauuugauaacaau

SEQ ID NO: 4014409 - RNA, 23 nt, Human respiratory syncytial virus
uagcaaccaccgaauucaaaaau

SEQ ID NO: 4014410 - RNA, 15 nt, Human respiratory syncytial virus
uagggaguaccaaau

SEQ ID NO: 4014411 - RNA, 17 nt, Human respiratory syncytial virus
uauagaaguaaccaaag

SEQ ID NO: 4014412 - RNA, 20 nt, Human respiratory syncytial virus
uaugcaaagauuaaugauca

SEQ ID NO: 4014413 - RNA, 23 nt, Human respiratory syncytial virus
uauugaacaauccaaaagcauca

SEQ ID NO: 4014414 - RNA, 14 nt, Human respiratory syncytial virus
uauuuaucaaucau

SEQ ID NO: 4014415 - RNA, 17 nt, Human respiratory syncytial virus
ucaaaaugaccaaacca

SEQ ID NO: 4014416 - RNA, 18 nt, Human respiratory syncytial virus
ucaaacaaaugacaacau

SEQ ID NO: 4014417 - RNA, 23 nt, Human respiratory syncytial virus
ucaaagggaaauggggcaaauaa

SEQ ID NO: 4014418 - RNA, 14 nt, Human respiratory syncytial virus
ucaaaucaacacau

SEQ ID NO: 4014419 - RNA, 16 nt, Human respiratory syncytial virus
ucaacauggagaaguu

SEQ ID NO: 4014420 - RNA, 21 nt, Human respiratory syncytial virus
ucaaccaacugauccaucagc

SEQ ID NO: 4014421 - RNA, 19 nt, Human respiratory syncytial virus
ucaacguaguacaggagau

SEQ ID NO: 4014422 - RNA, 17 nt, Human respiratory syncytial virus
ucaccaauccacacaaa

SEQ ID NO: 4014423 - RNA, 15 nt, Human respiratory syncytial virus
ucauccaaagauccu

SEQ ID NO: 4014424 - RNA, 22 nt, Human respiratory syncytial virus
ucaugcuaguguccaggcagaa

SEQ ID NO: 4014425 - RNA, 20 nt, Human respiratory syncytial virus
ucauggugucgcaaaaccac

SEQ ID NO: 4014426 - RNA, 19 nt, Human respiratory syncytial virus
uccaaacaaccuacaacca

SEQ ID NO: 4014427 - RNA, 21 nt, Human respiratory syncytial virus
uccagcaaauacacuauucaa

SEQ ID NO: 4014428 - RNA, 22 nt, Human respiratory syncytial virus
uccaucacaauagaauucacaa

SEQ ID NO: 4014429 - RNA, 11 nt, Human respiratory syncytial virus
ucuacaaacaa

SEQ ID NO: 4014430 - RNA, 13 nt, Human respiratory syncytial virus
ucuagaaaaagau

SEQ ID NO: 4014431 - RNA, 17 nt, Human respiratory syncytial virus
ugaaaucaaagcaugca

SEQ ID NO: 4014432 - RNA, 24 nt, Human respiratory syncytial virus
ugaacaucuacacuacacacuuca

SEQ ID NO: 4014433 - RNA, 19 nt, Human respiratory syncytial virus
ugaacucacuagaaaacau

SEQ ID NO: 4014434 - RNA, 23 nt, Human respiratory syncytial virus
ugaacucacuagaaaacauagca

SEQ ID NO: 4014435 - RNA, 23 nt, Human respiratory syncytial virus
ugacaacacuacuaugcaaagau

SEQ ID NO: 4014436 - RNA, 19 nt, Human respiratory syncytial virus
ugaugcagccaaagcauau

SEQ ID NO: 4014437 - RNA, 17 nt, Human respiratory syncytial virus
ugcaaauaacaaagcua

SEQ ID NO: 4014438 - RNA, 15 nt, Human respiratory syncytial virus
ugcaagcaucaacau

SEQ ID NO: 4014439 - RNA, 21 nt, Human respiratory syncytial virus
ugccaacaaccgggccagaag

SEQ ID NO: 4014440 - RNA, 21 nt, Human respiratory syncytial virus
ugccagaccgaacaaacaaau

SEQ ID NO: 4014441 - RNA, 23 nt, Human respiratory syncytial virus
ugcgaauagguaaauaaaaccaa

SEQ ID NO: 4014442 - RNA, 20 nt, Human respiratory syncytial virus
ugcuauuaaucacugaagau

SEQ ID NO: 4014443 - RNA, 23 nt, Human respiratory syncytial virus
ugcuggaaauuacacacaucacc

SEQ ID NO: 4014444 - RNA, 23 nt, Human respiratory syncytial virus
uggaaaucaacagagaauucagu

SEQ ID NO: 4014445 - RNA, 15 nt, Human respiratory syncytial virus
uggaagacaacgaua

SEQ ID NO: 4014446 - RNA, 17 nt, Human respiratory syncytial virus
uggaauaagagaugcua

SEQ ID NO: 4014447 - RNA, 15 nt, Human respiratory syncytial virus
uggauucuaccauau

SEQ ID NO: 4014448 - RNA, 18 nt, Human respiratory syncytial virus
uggcauuaagccuacaaa

SEQ ID NO: 4014449 - RNA, 22 nt, Human respiratory syncytial virus
ugggaaauacauccaucacaau

SEQ ID NO: 4014450 - RNA, 18 nt, Human respiratory syncytial virus
ugguccuaggcaaugcag

SEQ ID NO: 4014451 - RNA, 13 nt, Human respiratory syncytial virus
uguauagcagcac

SEQ ID NO: 4014452 - RNA, 20 nt, Human respiratory syncytial virus
uguauuagacuuaacagcag

SEQ ID NO: 4014453 - RNA, 12 nt, Human respiratory syncytial virus
ugucauccagca

SEQ ID NO: 4014454 - RNA, 20 nt, Human respiratory syncytial virus
ugucauccagcaaauacacu

SEQ ID NO: 4014455 - RNA, 22 nt, Human respiratory syncytial virus
uuaauccaacuuccaaaaaauu

SEQ ID NO: 4014456 - RNA, 15 nt, Human respiratory syncytial virus
uuagacuuaacagca

SEQ ID NO: 4014457 - RNA, 22 nt, Human respiratory syncytial virus
uuaguuaauauaaaaacucauc

SEQ ID NO: 4014458 - RNA, 21 nt, Human respiratory syncytial virus
uuauguuuagucuaacucaau

SEQ ID NO: 4014459 - RNA, 18 nt, Human respiratory syncytial virus
uucaaagaagaucucacc

SEQ ID NO: 4014460 - RNA, 12 nt, Human respiratory syncytial virus
uucaauacauau

SEQ ID NO: 4014461 - RNA, 18 nt, Human respiratory syncytial virus
uugguauaccagugucau

SEQ ID NO: 4014462 - RNA, 23 nt, Human respiratory syncytial virus
uuuaugaaguguuugaaaaacac

SEQ ID NO: 4014463 - RNA, 19 nt, Human respiratory syncytial virus
uuuauuuuaaaucaauaug

SEQ ID NO: 4014464 - RNA, 15 nt, Human respiratory syncytial virus
uuucuucacaucaug

SEQ ID NO: 4014465 - RNA, 22 nt, Human respiratory syncytial virus
aaaacaccuaaacaaacuaugu

SEQ ID NO: 4014466 - RNA, 16 nt, Human respiratory syncytial virus
aaaaucaaucaaaguu

SEQ ID NO: 4014467 - RNA, 19 nt, Human respiratory syncytial virus
aaaauccaccaaaaaaacc

SEQ ID NO: 4014468 - RNA, 18 nt, Human respiratory syncytial virus
aaacaaacuaugugguau

SEQ ID NO: 4014469 - RNA, 21 nt, Human respiratory syncytial virus
aaacaacauuggggcaaaugc

SEQ ID NO: 4014470 - RNA, 17 nt, Human respiratory syncytial virus
aaacgacgaaaaaagaa

SEQ ID NO: 4014471 - RNA, 12 nt, Human respiratory syncytial virus
aaacuacacacu

SEQ ID NO: 4014472 - RNA, 13 nt, Human respiratory syncytial virus
aaagaaaauggag

SEQ ID NO: 4014473 - RNA, 12 nt, Human respiratory syncytial virus
aaagaagaucuc

SEQ ID NO: 4014474 - RNA, 16 nt, Human respiratory syncytial virus
aaagacuaccagcaga

SEQ ID NO: 4014475 - RNA, 15 nt, Human respiratory syncytial virus
aaagcgaaaaaaugg

SEQ ID NO: 4014476 - RNA, 14 nt, Human respiratory syncytial virus
aaauaaaaguaaag

SEQ ID NO: 4014477 - RNA, 12 nt, Human respiratory syncytial virus
aaauaaggauca

SEQ ID NO: 4014478 - RNA, 17 nt, Human respiratory syncytial virus
aaauccaccaaaaaaac

SEQ ID NO: 4014479 - RNA, 22 nt, Human respiratory syncytial virus
aaaugacaacauuacagcaaga

SEQ ID NO: 4014480 - RNA, 15 nt, Human respiratory syncytial virus
aaauuccuagaauca

SEQ ID NO: 4014481 - RNA, 16 nt, Human respiratory syncytial virus
aacaaaaaaagaacaa

SEQ ID NO: 4014482 - RNA, 19 nt, Human respiratory syncytial virus
aacaacauaacaaaacaau

SEQ ID NO: 4014483 - RNA, 23 nt, Human respiratory syncytial virus
aacaacggucacaguucaaacaa

SEQ ID NO: 4014484 - RNA, 22 nt, Human respiratory syncytial virus
aacacaagaaucaacgcacugc

SEQ ID NO: 4014485 - RNA, 20 nt, Human respiratory syncytial virus
aacacacaauccaacagcaa

SEQ ID NO: 4014486 - RNA, 21 nt, Human respiratory syncytial virus
aacacaccacacaacagcaca

SEQ ID NO: 4014487 - RNA, 12 nt, Human respiratory syncytial virus
aacacaccagcu

SEQ ID NO: 4014488 - RNA, 22 nt, Human respiratory syncytial virus
aacacacuccuauaauauacaa

SEQ ID NO: 4014489 - RNA, 18 nt, Human respiratory syncytial virus
aacacuacuaugcaaaga

SEQ ID NO: 4014490 - RNA, 16 nt, Human respiratory syncytial virus
aacaucaucaauccaa

SEQ ID NO: 4014491 - RNA, 17 nt, Human respiratory syncytial virus
aacauucuguaacaaua

SEQ ID NO: 4014492 - RNA, 23 nt, Human respiratory syncytial virus
aaccaaauuagcagcaggagaca

SEQ ID NO: 4014493 - RNA, 18 nt, Human respiratory syncytial virus
aaccacgccaacuaucau

SEQ ID NO: 4014494 - RNA, 21 nt, Human respiratory syncytial virus
aaccugacgaaauuaacaaua

SEQ ID NO: 4014495 - RNA, 12 nt, Human respiratory syncytial virus
aacuaccaccaa

SEQ ID NO: 4014496 - RNA, 17 nt, Human respiratory syncytial virus
aacuugaugaaagacaa

SEQ ID NO: 4014497 - RNA, 20 nt, Human respiratory syncytial virus
aacuugcaagcaucaacaua

SEQ ID NO: 4014498 - RNA, 18 nt, Human respiratory syncytial virus
aagaaacaauagaaacau

SEQ ID NO: 4014499 - RNA, 16 nt, Human respiratory syncytial virus
aagaaaccaggaucuu

SEQ ID NO: 4014500 - RNA, 22 nt, Human respiratory syncytial virus
aagaaaugauagaaaaaauaag

SEQ ID NO: 4014501 - RNA, 14 nt, Human respiratory syncytial virus
aagagcggaagcau

SEQ ID NO: 4014502 - RNA, 13 nt, Human respiratory syncytial virus
aagaugauguaga

SEQ ID NO: 4014503 - RNA, 18 nt, Human respiratory syncytial virus
aagaugcaaauaacaaag

SEQ ID NO: 4014504 - RNA, 12 nt, Human respiratory syncytial virus
aagcauaugcag

SEQ ID NO: 4014505 - RNA, 17 nt, Human respiratory syncytial virus
aagcuacugcacaaagu

SEQ ID NO: 4014506 - RNA, 15 nt, Human respiratory syncytial virus
aaggcuccacauaca

SEQ ID NO: 4014507 - RNA, 13 nt, Human respiratory syncytial virus
aaguaaccaaaga

SEQ ID NO: 4014508 - RNA, 18 nt, Human respiratory syncytial virus
aagucaaguuaaaugaua

SEQ ID NO: 4014509 - RNA, 17 nt, Human respiratory syncytial virus
aagugugguccuaggca

SEQ ID NO: 4014510 - RNA, 13 nt, Human respiratory syncytial virus
aauaaaagcuuag

SEQ ID NO: 4014511 - RNA, 14 nt, Human respiratory syncytial virus
aauaaccaaauuag

SEQ ID NO: 4014512 - RNA, 18 nt, Human respiratory syncytial virus
aauaagucaacauggaga

SEQ ID NO: 4014513 - RNA, 19 nt, Human respiratory syncytial virus
aauagguaaauaaaaccaa

SEQ ID NO: 4014514 - RNA, 23 nt, Human respiratory syncytial virus
aauagguauguuauaugcuaugu

SEQ ID NO: 4014515 - RNA, 19 nt, Human respiratory syncytial virus
aauaguuaagaaggagcua

SEQ ID NO: 4014516 - RNA, 15 nt, Human respiratory syncytial virus
aaucaaucauauaca

SEQ ID NO: 4014517 - RNA, 17 nt, Human respiratory syncytial virus
aaucacugaagaugcaa

SEQ ID NO: 4014518 - RNA, 18 nt, Human respiratory syncytial virus
aauuaacauaaugaugaa

SEQ ID NO: 4014519 - RNA, 17 nt, Human respiratory syncytial virus
aauuagcagcaggagac

SEQ ID NO: 4014520 - RNA, 15 nt, Human respiratory syncytial virus
aauuaugaugugcaa

SEQ ID NO: 4014521 - RNA, 15 nt, Human respiratory syncytial virus
aauucaaaaaugcua

SEQ ID NO: 4014522 - RNA, 20 nt, Human respiratory syncytial virus
aauucaaaaaugcuaucacc

SEQ ID NO: 4014523 - RNA, 14 nt, Human respiratory syncytial virus
aauuggaagccaua

SEQ ID NO: 4014524 - RNA, 15 nt, Human respiratory syncytial virus
aauuggaagccauaa

SEQ ID NO: 4014525 - RNA, 22 nt, Human respiratory syncytial virus
aauuuaaaaucuauagcacaaa

SEQ ID NO: 4014526 - RNA, 16 nt, Human respiratory syncytial virus
acaaacaaagcuguag

SEQ ID NO: 4014527 - RNA, 16 nt, Human respiratory syncytial virus
acaaauagcacuauca

SEQ ID NO: 4014528 - RNA, 16 nt, Human respiratory syncytial virus
acaagaaauacacuga

SEQ ID NO: 4014529 - RNA, 18 nt, Human respiratory syncytial virus
acaagauggggcaaauau

SEQ ID NO: 4014530 - RNA, 22 nt, Human respiratory syncytial virus
acaagggucucauaccaaagga

SEQ ID NO: 4014531 - RNA, 14 nt, Human respiratory syncytial virus
acaauccaaaagca

SEQ ID NO: 4014532 - RNA, 18 nt, Human respiratory syncytial virus
acacucccaauuaugaug

SEQ ID NO: 4014533 - RNA, 21 nt, Human respiratory syncytial virus
acagauuaaauuuaaaaucua

SEQ ID NO: 4014534 - RNA, 15 nt, Human respiratory syncytial virus
acauaaauuggggca

SEQ ID NO: 4014535 - RNA, 16 nt, Human respiratory syncytial virus
acaucaccaauccaca

SEQ ID NO: 4014536 - RNA, 18 nt, Human respiratory syncytial virus
acaucaccaauccacaca

SEQ ID NO: 4014537 - RNA, 19 nt, Human respiratory syncytial virus
acaucaccaauccacacaa

SEQ ID NO: 4014538 - RNA, 18 nt, Human respiratory syncytial virus
accauuuuaguuaauaua

SEQ ID NO: 4014539 - RNA, 16 nt, Human respiratory syncytial virus
acccuaaagaagauga

SEQ ID NO: 4014540 - RNA, 15 nt, Human respiratory syncytial virus
acuaauacauaugau

SEQ ID NO: 4014541 - RNA, 14 nt, Human respiratory syncytial virus
acuaauuauaauca

SEQ ID NO: 4014542 - RNA, 16 nt, Human respiratory syncytial virus
acuacaccuugugaaa

SEQ ID NO: 4014543 - RNA, 23 nt, Human respiratory syncytial virus
acuauaaaucuuaaaaugggaaa

SEQ ID NO: 4014544 - RNA, 21 nt, Human respiratory syncytial virus
acuaugagcacuacaaaugac

SEQ ID NO: 4014545 - RNA, 23 nt, Human respiratory syncytial virus
acuauucaacguaguacaggaga

SEQ ID NO: 4014546 - RNA, 14 nt, Human respiratory syncytial virus
acucaaaauccaaa

SEQ ID NO: 4014547 - RNA, 22 nt, Human respiratory syncytial virus
acugaaugacagguccacauau

SEQ ID NO: 4014548 - RNA, 15 nt, Human respiratory syncytial virus
acuuccaaaaaauug

SEQ ID NO: 4014549 - RNA, 15 nt, Human respiratory syncytial virus
agaaaccaaagccaa

SEQ ID NO: 4014550 - RNA, 13 nt, Human respiratory syncytial virus
agaaguugggagg

SEQ ID NO: 4014551 - RNA, 10 nt, Human respiratory syncytial virus
aaaacacacc

SEQ ID NO: 4014552 - RNA, 21 nt, Human respiratory syncytial virus
aaaaccccuaguaagcuucaa

SEQ ID NO: 4014553 - RNA, 24 nt, Human respiratory syncytial virus
aaaauaugggguaaauagacauua

SEQ ID NO: 4014554 - RNA, 15 nt, Human respiratory syncytial virus
aaacacaccacacaa

SEQ ID NO: 4014555 - RNA, 22 nt, Human respiratory syncytial virus
aaacacacccaacuccacacaa

SEQ ID NO: 4014556 - RNA, 13 nt, Human respiratory syncytial virus
aaacuacacacua

SEQ ID NO: 4014557 - RNA, 15 nt, Human respiratory syncytial virus
aaacuugaugaaaga

SEQ ID NO: 4014558 - RNA, 20 nt, Human respiratory syncytial virus
aaagaacuugcaagcaucaa

SEQ ID NO: 4014559 - RNA, 14 nt, Human respiratory syncytial virus
aaagaaucaacuca

SEQ ID NO: 4014560 - RNA, 22 nt, Human respiratory syncytial virus
aaagcauaugcagagcaacuca

SEQ ID NO: 4014561 - RNA, 19 nt, Human respiratory syncytial virus
aaauaaaaguaaagccaau

SEQ ID NO: 4014562 - RNA, 13 nt, Human respiratory syncytial virus
aaauacaagucaa

SEQ ID NO: 4014563 - RNA, 15 nt, Human respiratory syncytial virus
aaaucaaagcaugca

SEQ ID NO: 4014564 - RNA, 18 nt, Human respiratory syncytial virus
aaaucaauaugguuguau

SEQ ID NO: 4014565 - RNA, 21 nt, Human respiratory syncytial virus
aaaucaucacacacaaauuca

SEQ ID NO: 4014566 - RNA, 14 nt, Human respiratory syncytial virus
aaaugaucaaacaa

SEQ ID NO: 4014567 - RNA, 23 nt, Human respiratory syncytial virus
aaaugcaaccauguccaaacaca

SEQ ID NO: 4014568 - RNA, 17 nt, Human respiratory syncytial virus
aaauuacacacaucacc

SEQ ID NO: 4014569 - RNA, 22 nt, Human respiratory syncytial virus
aacaaugauacaugugcauuua

SEQ ID NO: 4014570 - RNA, 16 nt, Human respiratory syncytial virus
aacacacaauccaaca

SEQ ID NO: 4014571 - RNA, 18 nt, Human respiratory syncytial virus
aacacacaauccaacagc

SEQ ID NO: 4014572 - RNA, 15 nt, Human respiratory syncytial virus
aacacccacagcauc

SEQ ID NO: 4014573 - RNA, 16 nt, Human respiratory syncytial virus
aacaguuauagaauuc

SEQ ID NO: 4014574 - RNA, 23 nt, Human respiratory syncytial virus
aacaguuauagaauuccagcaga

SEQ ID NO: 4014575 - RNA, 12 nt, Human respiratory syncytial virus
aaccacaaacaa

SEQ ID NO: 4014576 - RNA, 21 nt, Human respiratory syncytial virus
aacccuaaagaagaugaugua

SEQ ID NO: 4014577 - RNA, 22 nt, Human respiratory syncytial virus
aacuacacacuauauccaaaca

SEQ ID NO: 4014578 - RNA, 16 nt, Human respiratory syncytial virus
aacuacagucaaagau

SEQ ID NO: 4014579 - RNA, 13 nt, Human respiratory syncytial virus
aacucaaagaaaa

SEQ ID NO: 4014580 - RNA, 15 nt, Human respiratory syncytial virus
aacuuauaaaacaag

SEQ ID NO: 4014581 - RNA, 15 nt, Human respiratory syncytial virus
aacuuccaaaaaauu

SEQ ID NO: 4014582 - RNA, 16 nt, Human respiratory syncytial virus
aagaacuugcaagcau

SEQ ID NO: 4014583 - RNA, 20 nt, Human respiratory syncytial virus
aagaauuggaagccauaaag

SEQ ID NO: 4014584 - RNA, 17 nt, Human respiratory syncytial virus
aagacacuauaaagaua

SEQ ID NO: 4014585 - RNA, 23 nt, Human respiratory syncytial virus
aagaccaauuagugucaaaaaca

SEQ ID NO: 4014586 - RNA, 14 nt, Human respiratory syncytial virus
aagaugcaaauaac

SEQ ID NO: 4014587 - RNA, 17 nt, Human respiratory syncytial virus
aagaugcuggauaucau

SEQ ID NO: 4014588 - RNA, 19 nt, Human respiratory syncytial virus
aagaugcuggauaucaugu

SEQ ID NO: 4014589 - RNA, 20 nt, Human respiratory syncytial virus
aagauggcucuuagcaaagu

SEQ ID NO: 4014590 - RNA, 12 nt, Human respiratory syncytial virus
aagccaaaaaca

SEQ ID NO: 4014591 - RNA, 14 nt, Human respiratory syncytial virus
aagccuacaaaaca

SEQ ID NO: 4014592 - RNA, 19 nt, Human respiratory syncytial virus
aagcuugacaucagaaaua

SEQ ID NO: 4014593 - RNA, 14 nt, Human respiratory syncytial virus
aaguguuugaaaaa

SEQ ID NO: 4014594 - RNA, 17 nt, Human respiratory syncytial virus
aauaucuguuaacucaa

SEQ ID NO: 4014595 - RNA, 23 nt, Human respiratory syncytial virus
aaucacugaagaugcaaaucaua

SEQ ID NO: 4014596 - RNA, 19 nt, Human respiratory syncytial virus
aaugaucaaacaaaugaca

SEQ ID NO: 4014597 - RNA, 14 nt, Human respiratory syncytial virus
aaugaucugucacu

SEQ ID NO: 4014598 - RNA, 22 nt, Human respiratory syncytial virus
aauggaguagauauaacaacau

SEQ ID NO: 4014599 - RNA, 19 nt, Human respiratory syncytial virus
aauuacuuggauaaguaau

SEQ ID NO: 4014600 - RNA, 18 nt, Human respiratory syncytial virus
aauuagcauaugauguaa

SEQ ID NO: 4014601 - RNA, 14 nt, Human respiratory syncytial virus
aauuaugaugugca

SEQ ID NO: 4014602 - RNA, 12 nt, Human respiratory syncytial virus
acaaacaaaugu

SEQ ID NO: 4014603 - RNA, 21 nt, Human respiratory syncytial virus
acaaaccaaucccacucaaaa

SEQ ID NO: 4014604 - RNA, 13 nt, Human respiratory syncytial virus
acaacaucaauaa

SEQ ID NO: 4014605 - RNA, 15 nt, Human respiratory syncytial virus
acaacauuacagcaa

SEQ ID NO: 4014606 - RNA, 21 nt, Human respiratory syncytial virus
acaagccgagcacaaaaccac

SEQ ID NO: 4014607 - RNA, 17 nt, Human respiratory syncytial virus
acaaugaucugucacuu

SEQ ID NO: 4014608 - RNA, 19 nt, Human respiratory syncytial virus
acauaagcagcucaguaau

SEQ ID NO: 4014609 - RNA, 14 nt, Human respiratory syncytial virus
acauacacagcagc

SEQ ID NO: 4014610 - RNA, 12 nt, Human respiratory syncytial virus
acaucaaaaaca

SEQ ID NO: 4014611 - RNA, 16 nt, Human respiratory syncytial virus
acaucaugaacaucua

SEQ ID NO: 4014612 - RNA, 23 nt, Human respiratory syncytial virus
acaugcuuaguuauucaaaaacu

SEQ ID NO: 4014613 - RNA, 22 nt, Human respiratory syncytial virus
acauuaguuagaguucaaucaa

SEQ ID NO: 4014614 - RNA, 18 nt, Human respiratory syncytial virus
acauuggggcaaaugcaa

SEQ ID NO: 4014615 - RNA, 13 nt, Human respiratory syncytial virus
accaacaucauca

SEQ ID NO: 4014616 - RNA, 16 nt, Human respiratory syncytial virus
accaaccaaucaauca

SEQ ID NO: 4014617 - RNA, 13 nt, Human respiratory syncytial virus
accaaucaaucaa

SEQ ID NO: 4014618 - RNA, 22 nt, Human respiratory syncytial virus
accaaucaaucaaccaacugau

SEQ ID NO: 4014619 - RNA, 16 nt, Human respiratory syncytial virus
accacacaacagcaca

SEQ ID NO: 4014620 - RNA, 14 nt, Human respiratory syncytial virus
accuagaaaaagag

SEQ ID NO: 4014621 - RNA, 16 nt, Human respiratory syncytial virus
acuauaaagauacuua

SEQ ID NO: 4014622 - RNA, 19 nt, Human respiratory syncytial virus
acuaugcaaagauuaauga

SEQ ID NO: 4014623 - RNA, 23 nt, Human respiratory syncytial virus
acucaccuaaucaaucaaacuau

SEQ ID NO: 4014624 - RNA, 13 nt, Human respiratory syncytial virus
acugaaauuauuu

SEQ ID NO: 4014625 - RNA, 22 nt, Human respiratory syncytial virus
acugccagaccgaacaaacaaa

SEQ ID NO: 4014626 - RNA, 20 nt, Human respiratory syncytial virus
acuugaugaaagacaagcua

SEQ ID NO: 4014627 - RNA, 15 nt, Human respiratory syncytial virus
acuugcaagcaucaa

SEQ ID NO: 4014628 - RNA, 18 nt, Human respiratory syncytial virus
agaaaauggaguaauaaa

SEQ ID NO: 4014629 - RNA, 16 nt, Human respiratory syncytial virus
agaaauggagcaaguu

SEQ ID NO: 4014630 - RNA, 17 nt, Human respiratory syncytial virus
agaauugaugaaaaauu

SEQ ID NO: 4014631 - RNA, 15 nt, Human respiratory syncytial virus
agacaauaaaaaaca

SEQ ID NO: 4014632 - RNA, 13 nt, Human respiratory syncytial virus
agagaagaaauga

SEQ ID NO: 4014633 - RNA, 19 nt, Human respiratory syncytial virus
agagaagaaaugauagaaa

SEQ ID NO: 4014634 - RNA, 20 nt, Human respiratory syncytial virus
agauccuaagaagaaagaua

SEQ ID NO: 4014635 - RNA, 20 nt, Human respiratory syncytial virus
agaugcuggauaucauguua

SEQ ID NO: 4014636 - RNA, 14 nt, Human respiratory syncytial virus
agcaaagucaaguu

SEQ ID NO: 4014637 - RNA, 15 nt, Human respiratory syncytial virus
agcaaagucaaguua

SEQ ID NO: 4014638 - RNA, 21 nt, Human respiratory syncytial virus
agcaaauagacaaaaaaccac

SEQ ID NO: 4014639 - RNA, 17 nt, Human respiratory syncytial virus
agcagaagaacagcaga

SEQ ID NO: 4014640 - RNA, 23 nt, Human respiratory syncytial virus
agcauauauuaugugacuacuaa

SEQ ID NO: 4014641 - RNA, 21 nt, Human respiratory syncytial virus
agccauaaagaaucaacucaa

SEQ ID NO: 4014642 - RNA, 21 nt, Human respiratory syncytial virus
agcuacucauaugaagagaua

SEQ ID NO: 4014643 - RNA, 18 nt, Human respiratory syncytial virus
agcuuuaaguuaacaaaa

SEQ ID NO: 4014644 - RNA, 18 nt, Human respiratory syncytial virus
aggaucuuuaugaugcag

SEQ ID NO: 4014645 - RNA, 15 nt, Human respiratory syncytial virus
aggcauaaugggaga

SEQ ID NO: 4014646 - RNA, 21 nt, Human respiratory syncytial virus
agggaagacacuauaaagaua

SEQ ID NO: 4014647 - RNA, 16 nt, Human respiratory syncytial virus
aguauaugaacuauac

SEQ ID NO: 4014648 - RNA, 17 nt, Human respiratory syncytial virus
agucagucuaucaaaug

SEQ ID NO: 4014649 - RNA, 15 nt, Human respiratory syncytial virus
aguggcuccagaaua

SEQ ID NO: 4014650 - RNA, 15 nt, Human respiratory syncytial virus
agugucaaaaacaag

SEQ ID NO: 4014651 - RNA, 18 nt, Human respiratory syncytial virus
aguuaaaugauacauuaa

SEQ ID NO: 4014652 - RNA, 16 nt, Human respiratory syncytial virus
auaaaacaagaauuag

SEQ ID NO: 4014653 - RNA, 18 nt, Human respiratory syncytial virus
auaaacucaccuaaucaa

SEQ ID NO: 4014654 - RNA, 14 nt, Human respiratory syncytial virus
auaaagauacuuaa

SEQ ID NO: 4014655 - RNA, 21 nt, Human respiratory syncytial virus
auaaagauacuuaaagaugcu

SEQ ID NO: 4014656 - RNA, 22 nt, Human respiratory syncytial virus
auaaugaaggcuucuacauaau

SEQ ID NO: 4014657 - RNA, 14 nt, Human respiratory syncytial virus
auaaugaugaauua

SEQ ID NO: 4014658 - RNA, 14 nt, Human respiratory syncytial virus
auacaaauaugacc

SEQ ID NO: 4014659 - RNA, 13 nt, Human respiratory syncytial virus
auacauuaaauaa

SEQ ID NO: 4014660 - RNA, 15 nt, Human respiratory syncytial virus
auaccaagcaacaaa

SEQ ID NO: 4014661 - RNA, 21 nt, Human respiratory syncytial virus
auacuugauaaacaaugaaug

SEQ ID NO: 4014662 - RNA, 18 nt, Human respiratory syncytial virus
auagaaguaaccaaagag

SEQ ID NO: 4014663 - RNA, 22 nt, Human respiratory syncytial virus
auagcuaacaguuuuuaugaag

SEQ ID NO: 4014664 - RNA, 22 nt, Human respiratory syncytial virus
auaguuauuaaaaaauaugcaa

SEQ ID NO: 4014665 - RNA, 14 nt, Human respiratory syncytial virus
auaucgaucaaaug

SEQ ID NO: 4014666 - RNA, 18 nt, Human respiratory syncytial virus
auaucuguuaacucaaua

SEQ ID NO: 4014667 - RNA, 15 nt, Human respiratory syncytial virus
auauguggcaacaau

SEQ ID NO: 4014668 - RNA, 18 nt, Human respiratory syncytial virus
aucaagcuugacaucaga

SEQ ID NO: 4014669 - RNA, 13 nt, Human respiratory syncytial virus
aucauccaaagau

SEQ ID NO: 4014670 - RNA, 16 nt, Human respiratory syncytial virus
auccaaacaucaugaa

SEQ ID NO: 4014671 - RNA, 18 nt, Human respiratory syncytial virus
aucgucaagauauaaaug

SEQ ID NO: 4014672 - RNA, 13 nt, Human respiratory syncytial virus
aucuauagcacaa

SEQ ID NO: 4014673 - RNA, 17 nt, Human respiratory syncytial virus
aucucucaccaaagaaa

SEQ ID NO: 4014674 - RNA, 16 nt, Human respiratory syncytial virus
aucugaugaauuacua

SEQ ID NO: 4014675 - RNA, 23 nt, Human respiratory syncytial virus
aucugaugaauuacuacauaaug

SEQ ID NO: 4014676 - RNA, 15 nt, Human respiratory syncytial virus
augacugcaaaauua

SEQ ID NO: 4014677 - RNA, 20 nt, Human respiratory syncytial virus
augaguaugcacagaaguug

SEQ ID NO: 4014678 - RNA, 14 nt, Human respiratory syncytial virus
augauaugccuaua

SEQ ID NO: 4014679 - RNA, 18 nt, Human respiratory syncytial virus
augcagcaggucuaggca

SEQ ID NO: 4014680 - RNA, 12 nt, Human respiratory syncytial virus
augcuaaaagag

SEQ ID NO: 4014681 - RNA, 17 nt, Human respiratory syncytial virus
auggaacugacacuaaa

SEQ ID NO: 4014682 - RNA, 16 nt, Human respiratory syncytial virus
auggagcaaguugugg

SEQ ID NO: 4014683 - RNA, 12 nt, Human respiratory syncytial virus
augucaagcaau

SEQ ID NO: 4014684 - RNA, 18 nt, Human respiratory syncytial virus
auguccagguuaggaagg

SEQ ID NO: 4014685 - RNA, 22 nt, Human respiratory syncytial virus
auguccagguuaggaagggaag

SEQ ID NO: 4014686 - RNA, 14 nt, Human respiratory syncytial virus
augugcaaaaacac

SEQ ID NO: 4014687 - RNA, 14 nt, Human respiratory syncytial virus
auuaagccuacaaa

SEQ ID NO: 4014688 - RNA, 18 nt, Human respiratory syncytial virus
auuaaucacugaagaugc

SEQ ID NO: 4014689 - RNA, 13 nt, Human respiratory syncytial virus
auuagaacacaca

SEQ ID NO: 4014690 - RNA, 18 nt, Human respiratory syncytial virus
auuagacuuaacagcaga

SEQ ID NO: 4014691 - RNA, 19 nt, Human respiratory syncytial virus
auuaugacaucaaaaagag

SEQ ID NO: 4014692 - RNA, 22 nt, Human respiratory syncytial virus
auuaugauaacuacaauuauua

SEQ ID NO: 4014693 - RNA, 13 nt, Human respiratory syncytial virus
auucacaagcaaa

SEQ ID NO: 4014694 - RNA, 14 nt, Human respiratory syncytial virus
auuccaacaaaaaa

SEQ ID NO: 4014695 - RNA, 17 nt, Human respiratory syncytial virus
auuccuagaaucaauaa

SEQ ID NO: 4014696 - RNA, 22 nt, Human respiratory syncytial virus
auucuuagucaauuaugagaug

SEQ ID NO: 4014697 - RNA, 22 nt, Human respiratory syncytial virus
auugcaaagccaaaaacacacc

SEQ ID NO: 4014698 - RNA, 18 nt, Human respiratory syncytial virus
auugguuugcuguuguau

SEQ ID NO: 4014699 - RNA, 20 nt, Human respiratory syncytial virus
auuuagaugcuaacacauca

SEQ ID NO: 4014700 - RNA, 14 nt, Human respiratory syncytial virus
auuucauggagaag

SEQ ID NO: 4014701 - RNA, 20 nt, Human respiratory syncytial virus
auuucauggagaagaugcaa

SEQ ID NO: 4014702 - RNA, 19 nt, Human respiratory syncytial virus
caaaaaaagaacaagaugg

SEQ ID NO: 4014703 - RNA, 14 nt, Human respiratory syncytial virus
caaaaaugcuauca

SEQ ID NO: 4014704 - RNA, 23 nt, Human respiratory syncytial virus
caaaaaugcuaucaccaaugcga

SEQ ID NO: 4014705 - RNA, 21 nt, Human respiratory syncytial virus
caaaacacacuccuauaauau

SEQ ID NO: 4014706 - RNA, 15 nt, Human respiratory syncytial virus
caaaaccacaaacaa

SEQ ID NO: 4014707 - RNA, 17 nt, Human respiratory syncytial virus
caaaauccaaaaucacu

SEQ ID NO: 4014708 - RNA, 17 nt, Human respiratory syncytial virus
caaacaucaugaacauc

SEQ ID NO: 4014709 - RNA, 15 nt, Human respiratory syncytial virus
caaaccaaccaccaa

SEQ ID NO: 4014710 - RNA, 22 nt, Human respiratory syncytial virus
caaagaaaucaucacacacaaa

SEQ ID NO: 4014711 - RNA, 23 nt, Human respiratory syncytial virus
caaagaaaucaucacacacaaau

SEQ ID NO: 4014712 - RNA, 15 nt, Human respiratory syncytial virus
caaagcauaugcaga

SEQ ID NO: 4014713 - RNA, 19 nt, Human respiratory syncytial virus
caaagcauaugcagagcaa

SEQ ID NO: 4014714 - RNA, 19 nt, Human respiratory syncytial virus
caaaucuacuacaaauauu

SEQ ID NO: 4014715 - RNA, 18 nt, Human respiratory syncytial virus
caaauuagcagcaggaga

SEQ ID NO: 4014716 - RNA, 20 nt, Human respiratory syncytial virus
caaauuagcagcaggagaca

SEQ ID NO: 4014717 - RNA, 16 nt, Human respiratory syncytial virus
caaauuagcauaugau

SEQ ID NO: 4014718 - RNA, 22 nt, Human respiratory syncytial virus
caaauucagccacaacaucacc

SEQ ID NO: 4014719 - RNA, 18 nt, Human respiratory syncytial virus
caaauuuagaugcuaaca

SEQ ID NO: 4014720 - RNA, 14 nt, Human respiratory syncytial virus
caacagcacaaacc

SEQ ID NO: 4014721 - RNA, 17 nt, Human respiratory syncytial virus
caaccaacugauccauc

SEQ ID NO: 4014722 - RNA, 17 nt, Human respiratory syncytial virus
caaccaccaaaaccaca

SEQ ID NO: 4014723 - RNA, 17 nt, Human respiratory syncytial virus
caacguaguacaggaga

SEQ ID NO: 4014724 - RNA, 20 nt, Human respiratory syncytial virus
caagauauaaauggaaagga

SEQ ID NO: 4014725 - RNA, 20 nt, Human respiratory syncytial virus
caagccgagcacaaaaccac

SEQ ID NO: 4014726 - RNA, 14 nt, Human respiratory syncytial virus
caauaaaaaacaca

SEQ ID NO: 4014727 - RNA, 19 nt, Human respiratory syncytial virus
caaucaaacacuaaaucaa

SEQ ID NO: 4014728 - RNA, 11 nt, Human respiratory syncytial virus
caaucaaucaa

SEQ ID NO: 4014729 - RNA, 18 nt, Human respiratory syncytial virus
caaucaaucauauacaaa

SEQ ID NO: 4014730 - RNA, 19 nt, Human respiratory syncytial virus
caauuaugagaugaagcua

SEQ ID NO: 4014731 - RNA, 16 nt, Human respiratory syncytial virus
caccagcugccaacaa

SEQ ID NO: 4014732 - RNA, 15 nt, Human respiratory syncytial virus
cacccccgaaaacac

SEQ ID NO: 4014733 - RNA, 16 nt, Human respiratory syncytial virus
caccuugugaaaucaa

SEQ ID NO: 4014734 - RNA, 16 nt, Human respiratory syncytial virus
cacguuuuucaaucaa

SEQ ID NO: 4014735 - RNA, 20 nt, Human respiratory syncytial virus
cacuaaaucaacacaucauu

SEQ ID NO: 4014736 - RNA, 20 nt, Human respiratory syncytial virus
cacugugcucgacacaacca

SEQ ID NO: 4014737 - RNA, 18 nt, Human respiratory syncytial virus
cagaaagagacaccagca

SEQ ID NO: 4014738 - RNA, 15 nt, Human respiratory syncytial virus
cagaccgaacaaaca

SEQ ID NO: 4014739 - RNA, 17 nt, Human respiratory syncytial virus
cauaaaagaacuugcaa

SEQ ID NO: 4014740 - RNA, 14 nt, Human respiratory syncytial virus
caucaaaaacagac

SEQ ID NO: 4014741 - RNA, 14 nt, Human respiratory syncytial virus
caucacacacaaau

SEQ ID NO: 4014742 - RNA, 19 nt, Human respiratory syncytial virus
cauggugucgcaaaaccac

SEQ ID NO: 4014743 - RNA, 16 nt, Human respiratory syncytial virus
ccaacaaaaaaaccaa

SEQ ID NO: 4014744 - RNA, 21 nt, Human respiratory syncytial virus
ccaacaucaucaauccaacaa

SEQ ID NO: 4014745 - RNA, 19 nt, Human respiratory syncytial virus
ccacacaacagcacaaacc

SEQ ID NO: 4014746 - RNA, 20 nt, Human respiratory syncytial virus
ccuguauauauaaacaaaca

SEQ ID NO: 4014747 - RNA, 23 nt, Human respiratory syncytial virus
cgaauagguaaauaaaaccaaaa

SEQ ID NO: 4014748 - RNA, 16 nt, Human respiratory syncytial virus
cuaacaaugauacaug

SEQ ID NO: 4014749 - RNA, 14 nt, Human respiratory syncytial virus
cuaauacauaugau

SEQ ID NO: 4014750 - RNA, 14 nt, Human respiratory syncytial virus
cuacaaaaaaaugc

SEQ ID NO: 4014751 - RNA, 16 nt, Human respiratory syncytial virus
cuacauuuacauucuu

SEQ ID NO: 4014752 - RNA, 13 nt, Human respiratory syncytial virus
cuaccuagaaaaa

SEQ ID NO: 4014753 - RNA, 15 nt, Human respiratory syncytial virus
cuagaaucaauaaag

SEQ ID NO: 4014754 - RNA, 18 nt, Human respiratory syncytial virus
cuagaggauuaaauuuaa

SEQ ID NO: 4014755 - RNA, 23 nt, Human respiratory syncytial virus
cuaggucaugcuaguguccaggc

SEQ ID NO: 4014756 - RNA, 15 nt, Human respiratory syncytial virus
cuauauccaaacauc

SEQ ID NO: 4014757 - RNA, 12 nt, Human respiratory syncytial virus
cuauguccaggu

SEQ ID NO: 4014758 - RNA, 15 nt, Human respiratory syncytial virus
cugaaaaaaacauca

SEQ ID NO: 4014759 - RNA, 18 nt, Human respiratory syncytial virus
cugaaaaaaacaucacca

SEQ ID NO: 4014760 - RNA, 16 nt, Human respiratory syncytial virus
cugugucaaauuauaa

SEQ ID NO: 4014761 - RNA, 20 nt, Human respiratory syncytial virus
cuugaugauuuuugaucagu

SEQ ID NO: 4014762 - RNA, 15 nt, Human respiratory syncytial virus
gaaaaagaugaugau

SEQ ID NO: 4014763 - RNA, 22 nt, Human respiratory syncytial virus
gaaaauccuacaaaaaaaugcu

SEQ ID NO: 4014764 - RNA, 20 nt, Human respiratory syncytial virus
gaaacaauagaaacauuuga

SEQ ID NO: 4014765 - RNA, 15 nt, Human respiratory syncytial virus
gaaauacaagucaau

SEQ ID NO: 4014766 - RNA, 15 nt, Human respiratory syncytial virus
gaaguaaccaaagag

SEQ ID NO: 4014767 - RNA, 13 nt, Human respiratory syncytial virus
gaaucaacucaac

SEQ ID NO: 4014768 - RNA, 20 nt, Human respiratory syncytial virus
gaaugacagguccacauaua

SEQ ID NO: 4014769 - RNA, 16 nt, Human respiratory syncytial virus
gaauucaaaaaugcua

SEQ ID NO: 4014770 - RNA, 11 nt, Human respiratory syncytial virus
gagagaagaaa

SEQ ID NO: 4014771 - RNA, 18 nt, Human respiratory syncytial virus
gauaacaaugaagaagaa

SEQ ID NO: 4014772 - RNA, 14 nt, Human respiratory syncytial virus
gauaaccaccagcg

SEQ ID NO: 4014773 - RNA, 13 nt, Human respiratory syncytial virus
gaucaaacaaaug

SEQ ID NO: 4014774 - RNA, 19 nt, Human respiratory syncytial virus
gaucugaacucacuagaaa

SEQ ID NO: 4014775 - RNA, 21 nt, Human respiratory syncytial virus
gaucuuggugccuaccuagaa

SEQ ID NO: 4014776 - RNA, 22 nt, Human respiratory syncytial virus
gaugaagcuacugcacaaagua

SEQ ID NO: 4014777 - RNA, 23 nt, Human respiratory syncytial virus
gauuaaauuuaauuaucaacacu

SEQ ID NO: 4014778 - RNA, 14 nt, Human respiratory syncytial virus
gcaaaaacaccuaa

SEQ ID NO: 4014779 - RNA, 18 nt, Human respiratory syncytial virus
gcaaaaacaccuaaacaa

SEQ ID NO: 4014780 - RNA, 15 nt, Human respiratory syncytial virus
gcaaagauuaaugau

SEQ ID NO: 4014781 - RNA, 16 nt, Human respiratory syncytial virus
gcaaauaaacucaccu

SEQ ID NO: 4014782 - RNA, 23 nt, Human respiratory syncytial virus
gcaaguucgcaucauccaaagau

SEQ ID NO: 4014783 - RNA, 14 nt, Human respiratory syncytial virus
gcaauacuaaauaa

SEQ ID NO: 4014784 - RNA, 14 nt, Human respiratory syncytial virus
gcaaugauaaucuc

SEQ ID NO: 4014785 - RNA, 14 nt, Human respiratory syncytial virus
gcagagcaacucaa

SEQ ID NO: 4014786 - RNA, 21 nt, Human respiratory syncytial virus
gcagccaaagcauaugcagag

SEQ ID NO: 4014787 - RNA, 14 nt, Human respiratory syncytial virus
gccaauaacauaaa

SEQ ID NO: 4014788 - RNA, 15 nt, Human respiratory syncytial virus
gccucuuaauccaac

SEQ ID NO: 4014789 - RNA, 20 nt, Human respiratory syncytial virus
gcuaagugaacauaaaacau

SEQ ID NO: 4014790 - RNA, 20 nt, Human respiratory syncytial virus
gcuacacguuuuucaaucaa

SEQ ID NO: 4014791 - RNA, 24 nt, Human respiratory syncytial virus
ggaaacauacgugaacaagcuuca

SEQ ID NO: 4014792 - RNA, 13 nt, Human respiratory syncytial virus
ggagaagaugcaa

SEQ ID NO: 4014793 - RNA, 21 nt, Human respiratory syncytial virus
ggauucaauaauaacaucucu

SEQ ID NO: 4014794 - RNA, 15 nt, Human respiratory syncytial virus
ggcaaauaagucaac

SEQ ID NO: 4014795 - RNA, 15 nt, Human respiratory syncytial virus
ggcauaaugggagag

SEQ ID NO: 4014796 - RNA, 15 nt, Human respiratory syncytial virus
gggcaaauaagucaa

SEQ ID NO: 4014797 - RNA, 15 nt, Human respiratory syncytial virus
guaccaaauacaaga

SEQ ID NO: 4014798 - RNA, 20 nt, Human respiratory syncytial virus
guaguuauuuaaaaauuaac

SEQ ID NO: 4014799 - RNA, 22 nt, Human respiratory syncytial virus
guauaugaacuauacaaucaau

SEQ ID NO: 4014800 - RNA, 19 nt, Human respiratory syncytial virus
guaucauuagaugaaagaa

SEQ ID NO: 4014801 - RNA, 15 nt, Human respiratory syncytial virus
gucaacauggagaag

SEQ ID NO: 4014802 - RNA, 24 nt, Human respiratory syncytial virus
gugcaaaaacaccuaaacaaacua

SEQ ID NO: 4014803 - RNA, 22 nt, Human respiratory syncytial virus
guucaaacaauaaaaaaccaca

SEQ ID NO: 4014804 - RNA, 19 nt, Human respiratory syncytial virus
guuuuucaaucaaaccacu

SEQ ID NO: 4014805 - RNA, 15 nt, Human respiratory syncytial virus
uaaaacuaacaauga

SEQ ID NO: 4014806 - RNA, 15 nt, Human respiratory syncytial virus
uaaagccaauaacau

SEQ ID NO: 4014807 - RNA, 13 nt, Human respiratory syncytial virus
uaaauaaggauca

SEQ ID NO: 4014808 - RNA, 21 nt, Human respiratory syncytial virus
uaacaucuggcaccaacauca

SEQ ID NO: 4014809 - RNA, 13 nt, Human respiratory syncytial virus
uaaccaauuauua

SEQ ID NO: 4014810 - RNA, 18 nt, Human respiratory syncytial virus
uaagucaacauggagaag

SEQ ID NO: 4014811 - RNA, 15 nt, Human respiratory syncytial virus
uaaucauuguaguau

SEQ ID NO: 4014812 - RNA, 15 nt, Human respiratory syncytial virus
uaaugucaagcaaug

SEQ ID NO: 4014813 - RNA, 15 nt, Human respiratory syncytial virus
uacaaagaaacaaua

SEQ ID NO: 4014814 - RNA, 16 nt, Human respiratory syncytial virus
uacacacuucaucaca

SEQ ID NO: 4014815 - RNA, 23 nt, Human respiratory syncytial virus
uacauaggaucuauaaacaacau

SEQ ID NO: 4014816 - RNA, 17 nt, Human respiratory syncytial virus
uacauguuaacaaacag

SEQ ID NO: 4014817 - RNA, 17 nt, Human respiratory syncytial virus
uaccaagcaacaaacca

SEQ ID NO: 4014818 - RNA, 17 nt, Human respiratory syncytial virus
uacuaauuauaaucacu

SEQ ID NO: 4014819 - RNA, 21 nt, Human respiratory syncytial virus
uacuaugcaaagauuaaugau

SEQ ID NO: 4014820 - RNA, 20 nt, Human respiratory syncytial virus
uagcuuacugauuccaaaau

SEQ ID NO: 4014821 - RNA, 20 nt, Human respiratory syncytial virus
uaggaagggaagacacuaua

SEQ ID NO: 4014822 - RNA, 14 nt, Human respiratory syncytial virus
uauaaaaacucauc

SEQ ID NO: 4014823 - RNA, 17 nt, Human respiratory syncytial virus
uauaaaagaaaccaaau

SEQ ID NO: 4014824 - RNA, 15 nt, Human respiratory syncytial virus
uaugagcacuacaaa

SEQ ID NO: 4014825 - RNA, 14 nt, Human respiratory syncytial virus
uauguuauaugcua

SEQ ID NO: 4014826 - RNA, 12 nt, Human respiratory syncytial virus
uauuagugucau

SEQ ID NO: 4014827 - RNA, 19 nt, Human respiratory syncytial virus
ucaaacaauaaaaaaccac

SEQ ID NO: 4014828 - RNA, 16 nt, Human respiratory syncytial virus
ucaaacccacaaacaa

SEQ ID NO: 4014829 - RNA, 17 nt, Human respiratory syncytial virus
ucaaagaaaauggagua

SEQ ID NO: 4014830 - RNA, 18 nt, Human respiratory syncytial virus
ucaacaacaucaauaaaa

SEQ ID NO: 4014831 - RNA, 18 nt, Human respiratory syncytial virus
ucaacguaguacaggaga

SEQ ID NO: 4014832 - RNA, 22 nt, Human respiratory syncytial virus
ucaacucaacccuaaagaagau

SEQ ID NO: 4014833 - RNA, 18 nt, Human respiratory syncytial virus
ucaaguaucacaaucaaa

SEQ ID NO: 4014834 - RNA, 21 nt, Human respiratory syncytial virus
ucaagugugguccuaggcaau

SEQ ID NO: 4014835 - RNA, 15 nt, Human respiratory syncytial virus
ucaaguuaaaugaua

SEQ ID NO: 4014836 - RNA, 19 nt, Human respiratory syncytial virus
ucaauaucucaagucaaug

SEQ ID NO: 4014837 - RNA, 21 nt, Human respiratory syncytial virus
ucaaucauauacaaauucaga

SEQ ID NO: 4014838 - RNA, 17 nt, Human respiratory syncytial virus
ucacaguucaaacaaua

SEQ ID NO: 4014839 - RNA, 20 nt, Human respiratory syncytial virus
ucacaguucaaacaauaaaa

SEQ ID NO: 4014840 - RNA, 22 nt, Human respiratory syncytial virus
ucagcaaauagacaaaaaacca

SEQ ID NO: 4014841 - RNA, 14 nt, Human respiratory syncytial virus
ucaucacacaaacc

SEQ ID NO: 4014842 - RNA, 19 nt, Human respiratory syncytial virus
ucauggagaagaugcaaau

SEQ ID NO: 4014843 - RNA, 17 nt, Human respiratory syncytial virus
ucauguuucaacaacag

SEQ ID NO: 4014844 - RNA, 12 nt, Human respiratory syncytial virus
uccacacaaaca

SEQ ID NO: 4014845 - RNA, 13 nt, Human respiratory syncytial virus
uccacacaaacac

SEQ ID NO: 4014846 - RNA, 13 nt, Human respiratory syncytial virus
uccuaagaagaaa

SEQ ID NO: 4014847 - RNA, 12 nt, Human respiratory syncytial virus
ucuagaaaaucc

SEQ ID NO: 4014848 - RNA, 15 nt, Human respiratory syncytial virus
ugaaauucgaaguau

SEQ ID NO: 4014849 - RNA, 22 nt, Human respiratory syncytial virus
ugaacaucuacacuacacacuu

SEQ ID NO: 4014850 - RNA, 19 nt, Human respiratory syncytial virus
ugaauuucauggagaagau

SEQ ID NO: 4014851 - RNA, 13 nt, Human respiratory syncytial virus
ugagcacuacaaa

SEQ ID NO: 4014852 - RNA, 17 nt, Human respiratory syncytial virus
ugcagcaggucuaggca

SEQ ID NO: 4014853 - RNA, 15 nt, Human respiratory syncytial virus
ugcuaacacaucauu

SEQ ID NO: 4014854 - RNA, 20 nt, Human respiratory syncytial virus
uggaguagauauaacaacau

SEQ ID NO: 4014855 - RNA, 14 nt, Human respiratory syncytial virus
uggcaccaacauca

SEQ ID NO: 4014856 - RNA, 19 nt, Human respiratory syncytial virus
uguauauauaaacaaacaa

SEQ ID NO: 4014857 - RNA, 21 nt, Human respiratory syncytial virus
uguuaacuacagucaaagauc

SEQ ID NO: 4014858 - RNA, 17 nt, Human respiratory syncytial virus
uuaaagcuaauggagua

SEQ ID NO: 4014859 - RNA, 16 nt, Human respiratory syncytial virus
uuaacauuaucaagcu

SEQ ID NO: 4014860 - RNA, 15 nt, Human respiratory syncytial virus
uuaaguuaacaaaaa

SEQ ID NO: 4014861 - RNA, 18 nt, Human respiratory syncytial virus
uuacauguuaacaaacag

SEQ ID NO: 4014862 - RNA, 17 nt, Human respiratory syncytial virus
uuaguuuuugacacuuu

SEQ ID NO: 4014863 - RNA, 19 nt, Human respiratory syncytial virus
uuccuagaaucaauaaagg

SEQ ID NO: 4014864 - RNA, 13 nt, Human respiratory syncytial virus
uugaugaaaaauu

SEQ ID NO: 4014865 - RNA, 14 nt, Human respiratory syncytial virus
uugcucauaaaaga

SEQ ID NO: 4014866 - RNA, 21 nt, Human respiratory syncytial virus
uuggaagccauaaagaaucaa

SEQ ID NO: 4014867 - RNA, 12 nt, Human respiratory syncytial virus
uuuauuaaauaa

SEQ ID NO: 4014868 - RNA, 13 nt, Human respiratory syncytial virus
uuucauggagaag

SEQ ID NO: 4014869 - RNA, 21 nt, Human respiratory syncytial virus
aaaaaacaacaagcaaacaau

SEQ ID NO: 4014870 - RNA, 13 nt, Human respiratory syncytial virus
aaaaagaacaaga

SEQ ID NO: 4014871 - RNA, 16 nt, Human respiratory syncytial virus
aaaaagaacaagaugg

SEQ ID NO: 4014872 - RNA, 14 nt, Human respiratory syncytial virus
aaaacuaacuauaa

SEQ ID NO: 4014873 - RNA, 14 nt, Human respiratory syncytial virus
aaaagagacccaaa

SEQ ID NO: 4014874 - RNA, 22 nt, Human respiratory syncytial virus
aaaagucuaaaacuaacaauga

SEQ ID NO: 4014875 - RNA, 18 nt, Human respiratory syncytial virus
aaaauaucauuaacaagu

SEQ ID NO: 4014876 - RNA, 15 nt, Human respiratory syncytial virus
aaagagaugggagaa

SEQ ID NO: 4014877 - RNA, 23 nt, Human respiratory syncytial virus
aaaguguuagaucucaagaauua

SEQ ID NO: 4014878 - RNA, 23 nt, Human respiratory syncytial virus
caggauuguuuaugaaugccuau

SEQ ID NO: 4014879 - RNA, 20 nt, Human respiratory syncytial virus
caguuacugacaauaaagga

SEQ ID NO: 4014880 - RNA, 13 nt, Human respiratory syncytial virus
caucacacaaacc

SEQ ID NO: 4014881 - RNA, 13 nt, Human respiratory syncytial virus
caucuuauagaug

SEQ ID NO: 4014882 - RNA, 14 nt, Human respiratory syncytial virus
cauguccaaacaca

SEQ ID NO: 4014883 - RNA, 20 nt, Human respiratory syncytial virus
cauuaagccuacaaaacaca

SEQ ID NO: 4014884 - RNA, 18 nt, Human respiratory syncytial virus
cauuuggauaaccaccag

SEQ ID NO: 4014885 - RNA, 15 nt, Human respiratory syncytial virus
ccaaaaccacaaaca

SEQ ID NO: 4014886 - RNA, 19 nt, Human respiratory syncytial virus
ccaaaaccacaaacaaaag

SEQ ID NO: 4014887 - RNA, 19 nt, Human respiratory syncytial virus
ccaaagaagaaaccaacca

SEQ ID NO: 4014888 - RNA, 17 nt, Human respiratory syncytial virus
ccaaccaccaaaaccac

SEQ ID NO: 4014889 - RNA, 17 nt, Human respiratory syncytial virus
ccacaaacaaaagagac

SEQ ID NO: 4014890 - RNA, 15 nt, Human respiratory syncytial virus
ccaccaacccaacaa

SEQ ID NO: 4014891 - RNA, 18 nt, Human respiratory syncytial virus
ccagcguuuauuaaauaa

SEQ ID NO: 4014892 - RNA, 18 nt, Human respiratory syncytial virus
ccaggcagaaauggagca

SEQ ID NO: 4014893 - RNA, 18 nt, Human respiratory syncytial virus
ccuaggcaaugcagcagg

SEQ ID NO: 4014894 - RNA, 17 nt, Human respiratory syncytial virus
cuaaguuguacaaagaa

SEQ ID NO: 4014895 - RNA, 22 nt, Human respiratory syncytial virus
cuaaucucuuuacuaauuauaa

SEQ ID NO: 4014896 - RNA, 17 nt, Human respiratory syncytial virus
cuacaaccacaucacca

SEQ ID NO: 4014897 - RNA, 22 nt, Human respiratory syncytial virus
cuagaaaagaccugggauacuc

SEQ ID NO: 4014898 - RNA, 23 nt, Human respiratory syncytial virus
cuaggacagaugcaucaaaucaa

SEQ ID NO: 4014899 - RNA, 16 nt, Human respiratory syncytial virus
cuauaucauccaacca

SEQ ID NO: 4014900 - RNA, 17 nt, Human respiratory syncytial virus
cuaucaccaaugcgaaa

SEQ ID NO: 4014901 - RNA, 15 nt, Human respiratory syncytial virus
cuauuuuacacuaau

SEQ ID NO: 4014902 - RNA, 20 nt, Human respiratory syncytial virus
cucuaaucucuuuacuaauu

SEQ ID NO: 4014903 - RNA, 13 nt, Human respiratory syncytial virus
cucucaccaaaga

SEQ ID NO: 4014904 - RNA, 17 nt, Human respiratory syncytial virus
cugaauauaauacaaaa

SEQ ID NO: 4014905 - RNA, 14 nt, Human respiratory syncytial virus
cugacgaaauuaac

SEQ ID NO: 4014906 - RNA, 17 nt, Human respiratory syncytial virus
cugcaucacuaacaaua

SEQ ID NO: 4014907 - RNA, 19 nt, Human respiratory syncytial virus
cugccagaccgaacaaaca

SEQ ID NO: 4014908 - RNA, 23 nt, Human respiratory syncytial virus
cuguauauauaaacaaacaaauc

SEQ ID NO: 4014909 - RNA, 13 nt, Human respiratory syncytial virus
cuuaacagcagaa

SEQ ID NO: 4014910 - RNA, 14 nt, Human respiratory syncytial virus
cuuagcaaagucaa

SEQ ID NO: 4014911 - RNA, 15 nt, Human respiratory syncytial virus
cuucaucacacaaac

SEQ ID NO: 4014912 - RNA, 16 nt, Human respiratory syncytial virus
cuuguaauaaccaaau

SEQ ID NO: 4014913 - RNA, 18 nt, Human respiratory syncytial virus
cuuuaaguuaacaaaaaa

SEQ ID NO: 4014914 - RNA, 13 nt, Human respiratory syncytial virus
gaaagcaaucaau

SEQ ID NO: 4014915 - RNA, 22 nt, Human respiratory syncytial virus
gaagaugcaaauaacaaagcua

SEQ ID NO: 4014916 - RNA, 23 nt, Human respiratory syncytial virus
gaaggagaagugaacaagaucaa

SEQ ID NO: 4014917 - RNA, 22 nt, Human respiratory syncytial virus
gaccacagaaagagacaccagc

SEQ ID NO: 4014918 - RNA, 17 nt, Human respiratory syncytial virus
gacccaaaaacaccagc

SEQ ID NO: 4014919 - RNA, 13 nt, Human respiratory syncytial virus
gaccgaacaaaca

SEQ ID NO: 4014920 - RNA, 17 nt, Human respiratory syncytial virus
gacuugcucauaaaaga

SEQ ID NO: 4014921 - RNA, 16 nt, Human respiratory syncytial virus
gagaagaaaugauaga

SEQ ID NO: 4014922 - RNA, 18 nt, Human respiratory syncytial virus
gagcaacucaaagaaaau

SEQ ID NO: 4014923 - RNA, 21 nt, Human respiratory syncytial virus
gauacauuaaauaaggaucag

SEQ ID NO: 4014924 - RNA, 20 nt, Human respiratory syncytial virus
gauauaaauggaaaggaaau

SEQ ID NO: 4014925 - RNA, 13 nt, Human respiratory syncytial virus
gaucaaaaacaac

SEQ ID NO: 4014926 - RNA, 14 nt, Human respiratory syncytial virus
gaucaaacaaauga

SEQ ID NO: 4014927 - RNA, 21 nt, Human respiratory syncytial virus
gaugcagccaaagcauaugca

SEQ ID NO: 4014928 - RNA, 12 nt, Human respiratory syncytial virus
gcaaagccaaaa

SEQ ID NO: 4014929 - RNA, 15 nt, Human respiratory syncytial virus
gcaaauacaaagaug

SEQ ID NO: 4014930 - RNA, 17 nt, Human respiratory syncytial virus
gcaaauuagcauaugau

SEQ ID NO: 4014931 - RNA, 19 nt, Human respiratory syncytial virus
gcaaccaccgaauucaaaa

SEQ ID NO: 4014932 - RNA, 18 nt, Human respiratory syncytial virus
gcagagcaacucaaagaa

SEQ ID NO: 4014933 - RNA, 20 nt, Human respiratory syncytial virus
gcagagcaacucaaagaaaa

SEQ ID NO: 4014934 - RNA, 19 nt, Human respiratory syncytial virus
gcagauuguuggaaaucaa

SEQ ID NO: 4014935 - RNA, 14 nt, Human respiratory syncytial virus
gcagcaggagacag

SEQ ID NO: 4014936 - RNA, 13 nt, Human respiratory syncytial virus
gcauaaugggaga

SEQ ID NO: 4014937 - RNA, 12 nt, Human respiratory syncytial virus
gcaucaaaucaa

SEQ ID NO: 4014938 - RNA, 16 nt, Human respiratory syncytial virus
gcauuuacaacacaac

SEQ ID NO: 4014939 - RNA, 18 nt, Human respiratory syncytial virus
gccgagcacaaaaccacg

SEQ ID NO: 4014940 - RNA, 16 nt, Human respiratory syncytial virus
gcgaauagguaaauaa

SEQ ID NO: 4014941 - RNA, 19 nt, Human respiratory syncytial virus
gcuaccaaauuccuagaau

SEQ ID NO: 4014942 - RNA, 23 nt, Human respiratory syncytial virus
gcuauuaaucacugaagaugcaa

SEQ ID NO: 4014943 - RNA, 19 nt, Human respiratory syncytial virus
ggaagccauaaagaaucaa

SEQ ID NO: 4014944 - RNA, 18 nt, Human respiratory syncytial virus
ggauaucauguuaaagcu

SEQ ID NO: 4014945 - RNA, 13 nt, Human respiratory syncytial virus
ggcagaaauggag

SEQ ID NO: 4014946 - RNA, 21 nt, Human respiratory syncytial virus
guacaauguucuagaaaaaga

SEQ ID NO: 4014947 - RNA, 20 nt, Human respiratory syncytial virus
guagagcuuuaaguuaacaa

SEQ ID NO: 4014948 - RNA, 14 nt, Human respiratory syncytial virus
guauauauaaacaa

SEQ ID NO: 4014949 - RNA, 14 nt, Human respiratory syncytial virus
guauguuauaugcu

SEQ ID NO: 4014950 - RNA, 20 nt, Human respiratory syncytial virus
gucacaguucaaacaauaaa

SEQ ID NO: 4014951 - RNA, 15 nt, Human respiratory syncytial virus
gucugagagaagaaa

SEQ ID NO: 4014952 - RNA, 19 nt, Human respiratory syncytial virus
gugacuuguuggaagacaa

SEQ ID NO: 4014953 - RNA, 18 nt, Human respiratory syncytial virus
gugaucaacucacucagc

SEQ ID NO: 4014954 - RNA, 15 nt, Human respiratory syncytial virus
gugcuuuaagaacag

SEQ ID NO: 4014955 - RNA, 18 nt, Human respiratory syncytial virus
guuacugacaauaaagga

SEQ ID NO: 4014956 - RNA, 21 nt, Human respiratory syncytial virus
guucuagaaaaagaugaugau

SEQ ID NO: 4014957 - RNA, 15 nt, Human respiratory syncytial virus
guuggucugagagaa

SEQ ID NO: 4014958 - RNA, 18 nt, Human respiratory syncytial virus
uaaaagaacuugcaagca

SEQ ID NO: 4014959 - RNA, 22 nt, Human respiratory syncytial virus
uaagaaaacuugaugaaagaca

SEQ ID NO: 4014960 - RNA, 14 nt, Human respiratory syncytial virus
uaaguauaagaaug

SEQ ID NO: 4014961 - RNA, 20 nt, Human respiratory syncytial virus
uaauauaaaaacucaucaaa

SEQ ID NO: 4014962 - RNA, 15 nt, Human respiratory syncytial virus
uaauauacaaauaug

SEQ ID NO: 4014963 - RNA, 14 nt, Human respiratory syncytial virus
uaauccguuuuagu

SEQ ID NO: 4014964 - RNA, 12 nt, Human respiratory syncytial virus
uaauuuagcuua

SEQ ID NO: 4014965 - RNA, 21 nt, Human respiratory syncytial virus
uacacugaauauaauacaaaa

SEQ ID NO: 4014966 - RNA, 17 nt, Human respiratory syncytial virus
uagaucucaagaauuac

SEQ ID NO: 4014967 - RNA, 15 nt, Human respiratory syncytial virus
uagaugaaagaagca

SEQ ID NO: 4014968 - RNA, 18 nt, Human respiratory syncytial virus
uaggaagggaagacacua

SEQ ID NO: 4014969 - RNA, 18 nt, Human respiratory syncytial virus
uagguauguuauaugcua

SEQ ID NO: 4014970 - RNA, 11 nt, Human respiratory syncytial virus
uaguaaaucaa

SEQ ID NO: 4014971 - RNA, 23 nt, Human respiratory syncytial virus
uaguacaggagauaauauugaca

SEQ ID NO: 4014972 - RNA, 19 nt, Human respiratory syncytial virus
uaguuagaguucaaucaau

SEQ ID NO: 4014973 - RNA, 17 nt, Human respiratory syncytial virus
uaucauugaucaaugau

SEQ ID NO: 4014974 - RNA, 16 nt, Human respiratory syncytial virus
uauccaaacaucauga

SEQ ID NO: 4014975 - RNA, 14 nt, Human respiratory syncytial virus
uauuccucaaacaa

SEQ ID NO: 4014976 - RNA, 15 nt, Human respiratory syncytial virus
ucaaacccacaaaca

SEQ ID NO: 4014977 - RNA, 17 nt, Human respiratory syncytial virus
ucaaacuaugagcacua

SEQ ID NO: 4014978 - RNA, 13 nt, Human respiratory syncytial virus
ucaacacaucauu

SEQ ID NO: 4014979 - RNA, 14 nt, Human respiratory syncytial virus
ucaacauggagaag

SEQ ID NO: 4014980 - RNA, 17 nt, Human respiratory syncytial virus
ucaaucucaacaaccau

SEQ ID NO: 4014981 - RNA, 21 nt, Human respiratory syncytial virus
ucacaguuacugacaauaaag

SEQ ID NO: 4014982 - RNA, 19 nt, Human respiratory syncytial virus
ucagggcaaguaaugcuaa

SEQ ID NO: 4014983 - RNA, 14 nt, Human respiratory syncytial virus
ucaucacacacaaa

SEQ ID NO: 4014984 - RNA, 17 nt, Human respiratory syncytial virus
ucaugcuacccacacaa

SEQ ID NO: 4014985 - RNA, 16 nt, Human respiratory syncytial virus
ucauggagaagaugca

SEQ ID NO: 4014986 - RNA, 13 nt, Human respiratory syncytial virus
ucgacacaaccac

SEQ ID NO: 4014987 - RNA, 23 nt, Human respiratory syncytial virus
ucgcaaaaccacgccaacuauca

SEQ ID NO: 4014988 - RNA, 18 nt, Human respiratory syncytial virus
ucgcaucauccaaagauc

SEQ ID NO: 4014989 - RNA, 16 nt, Human respiratory syncytial virus
ucuaaaacuaacaaug

SEQ ID NO: 4014990 - RNA, 18 nt, Human respiratory syncytial virus
ucuaaguuguacaaagaa

SEQ ID NO: 4014991 - RNA, 20 nt, Human respiratory syncytial virus
ucuuggagcuauagugucau

SEQ ID NO: 4014992 - RNA, 15 nt, Human respiratory syncytial virus
ugaaauaaaacgcua

SEQ ID NO: 4014993 - RNA, 19 nt, Human respiratory syncytial virus
ugaacaucuacacuacaca

SEQ ID NO: 4014994 - RNA, 23 nt, Human respiratory syncytial virus
ugacaauaaaggagcauucaaau

SEQ ID NO: 4014995 - RNA, 17 nt, Human respiratory syncytial virus
ugagagaagaaaugaua

SEQ ID NO: 4014996 - RNA, 18 nt, Human respiratory syncytial virus
ugaguaugcacagaaguu

SEQ ID NO: 4014997 - RNA, 20 nt, Human respiratory syncytial virus
ugauaacaaugaagaagaau

SEQ ID NO: 4014998 - RNA, 16 nt, Human respiratory syncytial virus
ugauacaugugcauuu

SEQ ID NO: 4014999 - RNA, 13 nt, Human respiratory syncytial virus
ugauucuccagac

SEQ ID NO: 4015000 - RNA, 19 nt, Human respiratory syncytial virus
ugcaaaucauaaauucaca

SEQ ID NO: 4015001 - RNA, 22 nt, Human respiratory syncytial virus
ugcaagugcaggacccacuuca

SEQ ID NO: 4015002 - RNA, 21 nt, Human respiratory syncytial virus
ugcagagcaacucaaagaaaa

SEQ ID NO: 4015003 - RNA, 17 nt, Human respiratory syncytial virus
ugcagguguaacaacac

SEQ ID NO: 4015004 - RNA, 12 nt, Human respiratory syncytial virus
ugcaucacuaac

SEQ ID NO: 4015005 - RNA, 21 nt, Human respiratory syncytial virus
ugcuuuguuaucuacaaacaa

SEQ ID NO: 4015006 - RNA, 20 nt, Human respiratory syncytial virus
uggauaucauguuaaagcua

SEQ ID NO: 4015007 - RNA, 17 nt, Human respiratory syncytial virus
ugucauccagcaaauac

SEQ ID NO: 4015008 - RNA, 23 nt, Human respiratory syncytial virus
ugucauccagcaaauacacuauu

SEQ ID NO: 4015009 - RNA, 13 nt, Human respiratory syncytial virus
uguucuagaaaaa

SEQ ID NO: 4015010 - RNA, 20 nt, Human respiratory syncytial virus
uuaacaauauaguaacaaaa

SEQ ID NO: 4015011 - RNA, 19 nt, Human respiratory syncytial virus
uuaaguuaacaaaaaauac

SEQ ID NO: 4015012 - RNA, 14 nt, Human respiratory syncytial virus
uuaaucacugaaga

SEQ ID NO: 4015013 - RNA, 18 nt, Human respiratory syncytial virus
uuaaucacugaagaugca

SEQ ID NO: 4015014 - RNA, 16 nt, Human respiratory syncytial virus
uuacacuaauacauau

SEQ ID NO: 4015015 - RNA, 20 nt, Human respiratory syncytial virus
uuagaugcuaacacaucauu

SEQ ID NO: 4015016 - RNA, 16 nt, Human respiratory syncytial virus
uuaggagggcaaacaa

SEQ ID NO: 4015017 - RNA, 21 nt, Human respiratory syncytial virus
uuaguuaauauaaaaacucau

SEQ ID NO: 4015018 - RNA, 17 nt, Human respiratory syncytial virus
uucauggagaagaugca

SEQ ID NO: 4015019 - RNA, 20 nt, Human respiratory syncytial virus
uugugauaaugcaggaucag

SEQ ID NO: 4015020 - RNA, 21 nt, Human respiratory syncytial virus
uuucggcuguggaaagcaauc

SEQ ID NO: 4015021 - RNA, 20 nt, Human respiratory syncytial virus
caaaucauaaauucacagga

SEQ ID NO: 4015022 - RNA, 23 nt, Human respiratory syncytial virus
caaauucagccacaacaucaccc

SEQ ID NO: 4015023 - RNA, 22 nt, Human respiratory syncytial virus
caacaacaucaauaaaacagac

SEQ ID NO: 4015024 - RNA, 21 nt, Human respiratory syncytial virus
caacaaccgggccagaagaga

SEQ ID NO: 4015025 - RNA, 20 nt, Human respiratory syncytial virus
caacaucacccaacacaaag

SEQ ID NO: 4015026 - RNA, 16 nt, Human respiratory syncytial virus
caaccauguccaaaca

SEQ ID NO: 4015027 - RNA, 18 nt, Human respiratory syncytial virus
caacguaguacaggagau

SEQ ID NO: 4015028 - RNA, 23 nt, Human respiratory syncytial virus
caacucaacccuaaagaagauga

SEQ ID NO: 4015029 - RNA, 16 nt, Human respiratory syncytial virus
caacuccacacaaaca

SEQ ID NO: 4015030 - RNA, 21 nt, Human respiratory syncytial virus
caagccgagcacaaaaccacg

SEQ ID NO: 4015031 - RNA, 22 nt, Human respiratory syncytial virus
caaggaucugaacucacuagaa

SEQ ID NO: 4015032 - RNA, 22 nt, Human respiratory syncytial virus
caaguucgcaucauccaaagau

SEQ ID NO: 4015033 - RNA, 19 nt, Human respiratory syncytial virus
caauagaauucacaagcaa

SEQ ID NO: 4015034 - RNA, 15 nt, Human respiratory syncytial virus
caauuuauauacaaa

SEQ ID NO: 4015035 - RNA, 21 nt, Human respiratory syncytial virus
cacaaagucagaaacacacca

SEQ ID NO: 4015036 - RNA, 19 nt, Human respiratory syncytial virus
cacaaaguuacacuaacaa

SEQ ID NO: 4015037 - RNA, 20 nt, Human respiratory syncytial virus
cacagaaguugggaggagaa

SEQ ID NO: 4015038 - RNA, 17 nt, Human respiratory syncytial virus
caccaauccacacaaau

SEQ ID NO: 4015039 - RNA, 12 nt, Human respiratory syncytial virus
caccagccaaaa

SEQ ID NO: 4015040 - RNA, 16 nt, Human respiratory syncytial virus
caccaguuacacuaag

SEQ ID NO: 4015041 - RNA, 12 nt, Human respiratory syncytial virus
cacgccaacuau

SEQ ID NO: 4015042 - RNA, 12 nt, Human respiratory syncytial virus
cacuacacacuu

SEQ ID NO: 4015043 - RNA, 20 nt, Human respiratory syncytial virus
cacucaaaauccaaaaucac

SEQ ID NO: 4015044 - RNA, 16 nt, Human respiratory syncytial virus
cacugcauccaacaaa

SEQ ID NO: 4015045 - RNA, 18 nt, Human respiratory syncytial virus
cacugcauccaacaaaaa

SEQ ID NO: 4015046 - RNA, 13 nt, Human respiratory syncytial virus
cagaaauggagca

SEQ ID NO: 4015047 - RNA, 14 nt, Human respiratory syncytial virus
cagacaucaaucca

SEQ ID NO: 4015048 - RNA, 17 nt, Human respiratory syncytial virus
cagagcaacucaaagaa

SEQ ID NO: 4015049 - RNA, 14 nt, Human respiratory syncytial virus
cagauuaaauuuaa

SEQ ID NO: 4015050 - RNA, 15 nt, Human respiratory syncytial virus
cagcaagacuagaua

SEQ ID NO: 4015051 - RNA, 18 nt, Human respiratory syncytial virus
cagcaggagacagaucag

SEQ ID NO: 4015052 - RNA, 19 nt, Human respiratory syncytial virus
aaaacacacuccuauaaua

SEQ ID NO: 4015053 - RNA, 15 nt, Human respiratory syncytial virus
aaaacaccuaaacaa

SEQ ID NO: 4015054 - RNA, 15 nt, Human respiratory syncytial virus
aaaacucaguacuua

SEQ ID NO: 4015055 - RNA, 15 nt, Human respiratory syncytial virus
aaaagcaucauugcu

SEQ ID NO: 4015056 - RNA, 17 nt, Human respiratory syncytial virus
aaaauuaacauaaugau

SEQ ID NO: 4015057 - RNA, 16 nt, Human respiratory syncytial virus
aaacaacaaugcucaa

SEQ ID NO: 4015058 - RNA, 15 nt, Human respiratory syncytial virus
aaacaaggaucugaa

SEQ ID NO: 4015059 - RNA, 15 nt, Human respiratory syncytial virus
aaacaauaaaaaacc

SEQ ID NO: 4015060 - RNA, 23 nt, Human respiratory syncytial virus
aaacaauaaaaaaccacacugaa

SEQ ID NO: 4015061 - RNA, 15 nt, Human respiratory syncytial virus
aaauacauccaucac

SEQ ID NO: 4015062 - RNA, 15 nt, Human respiratory syncytial virus
aaauauggaaacaua

SEQ ID NO: 4015063 - RNA, 21 nt, Human respiratory syncytial virus
aaauauggaaacauacgugaa

SEQ ID NO: 4015064 - RNA, 18 nt, Human respiratory syncytial virus
aaaucaacacaucauuca

SEQ ID NO: 4015065 - RNA, 19 nt, Human respiratory syncytial virus
aaauccuacaaaaaaaugc

SEQ ID NO: 4015066 - RNA, 21 nt, Human respiratory syncytial virus
aaauuggggcaaauacaaaga

SEQ ID NO: 4015067 - RNA, 12 nt, Human respiratory syncytial virus
aacaaauccaau

SEQ ID NO: 4015068 - RNA, 15 nt, Human respiratory syncytial virus
aacacacaauccaac

SEQ ID NO: 4015069 - RNA, 20 nt, Human respiratory syncytial virus
aacacacccaacuccacaca

SEQ ID NO: 4015070 - RNA, 20 nt, Human respiratory syncytial virus
aacaguuugacauuaccaag

SEQ ID NO: 4015071 - RNA, 12 nt, Human respiratory syncytial virus
aacaucuacacu

SEQ ID NO: 4015072 - RNA, 16 nt, Human respiratory syncytial virus
aaccaacccaaccaaa

SEQ ID NO: 4015073 - RNA, 16 nt, Human respiratory syncytial virus
aacuaacaaugauaca

SEQ ID NO: 4015074 - RNA, 22 nt, Human respiratory syncytial virus
aacucaccuaaucaaucaaacu

SEQ ID NO: 4015075 - RNA, 22 nt, Human respiratory syncytial virus
aacugccagaccgaacaaacaa

SEQ ID NO: 4015076 - RNA, 19 nt, Human respiratory syncytial virus
aacuugcaagcaucaacau

SEQ ID NO: 4015077 - RNA, 12 nt, Human respiratory syncytial virus
aagaagaaagau

SEQ ID NO: 4015078 - RNA, 13 nt, Human respiratory syncytial virus
aagaagaugaugu

SEQ ID NO: 4015079 - RNA, 14 nt, Human respiratory syncytial virus
aagacacuauaaag

SEQ ID NO: 4015080 - RNA, 17 nt, Human respiratory syncytial virus
aagacuagauagaauug

SEQ ID NO: 4015081 - RNA, 13 nt, Human respiratory syncytial virus
aagagaugggaga

SEQ ID NO: 4015082 - RNA, 17 nt, Human respiratory syncytial virus
aagauccuaagaagaaa

SEQ ID NO: 4015083 - RNA, 19 nt, Human respiratory syncytial virus
aagaucuuaccaugaagac

SEQ ID NO: 4015084 - RNA, 19 nt, Human respiratory syncytial virus
aagauggcucuuagcaaag

SEQ ID NO: 4015085 - RNA, 15 nt, Human respiratory syncytial virus
aagcaacaaaccaaa

SEQ ID NO: 4015086 - RNA, 13 nt, Human respiratory syncytial virus
aagcaagaagagg

SEQ ID NO: 4015087 - RNA, 17 nt, Human respiratory syncytial virus
aagccaauaacauaaau

SEQ ID NO: 4015088 - RNA, 21 nt, Human respiratory syncytial virus
aagcuugacaucagaaauaca

SEQ ID NO: 4015089 - RNA, 15 nt, Human respiratory syncytial virus
aaguuaaaugauaca

SEQ ID NO: 4015090 - RNA, 24 nt, Human respiratory syncytial virus
aauaaccaaauuagcagcaggaga

SEQ ID NO: 4015091 - RNA, 14 nt, Human respiratory syncytial virus
aauacaaaauaugg

SEQ ID NO: 4015092 - RNA, 17 nt, Human respiratory syncytial virus
aauacuaaauaagcuaa

SEQ ID NO: 4015093 - RNA, 12 nt, Human respiratory syncytial virus
aaucaaucucaa

SEQ ID NO: 4015094 - RNA, 17 nt, Human respiratory syncytial virus
aaucacuaccagccacu

SEQ ID NO: 4015095 - RNA, 21 nt, Human respiratory syncytial virus
aaucacugaagaugcaaauca

SEQ ID NO: 4015096 - RNA, 20 nt, Human respiratory syncytial virus
aaucuagcuacucauaugaa

SEQ ID NO: 4015097 - RNA, 13 nt, Human respiratory syncytial virus
aaugaagaagaau

SEQ ID NO: 4015098 - RNA, 13 nt, Human respiratory syncytial virus
aaugaucaaacaa

SEQ ID NO: 4015099 - RNA, 17 nt, Human respiratory syncytial virus
aaugucuuaaaaaauga

SEQ ID NO: 4015100 - RNA, 18 nt, Human respiratory syncytial virus
aaauaaaaguaaagccaa

SEQ ID NO: 4015101 - RNA, 12 nt, Human respiratory syncytial virus
aaauaaacucac

SEQ ID NO: 4015102 - RNA, 13 nt, Human respiratory syncytial virus
aaauaacauauua

SEQ ID NO: 4015103 - RNA, 18 nt, Human respiratory syncytial virus
aaauacggggcaaauaag

SEQ ID NO: 4015104 - RNA, 22 nt, Human respiratory syncytial virus
aaauacggggcaaauaagucaa

SEQ ID NO: 4015105 - RNA, 17 nt, Human respiratory syncytial virus
aaaucuguaaaaaauau

SEQ ID NO: 4015106 - RNA, 17 nt, Human respiratory syncytial virus
aaauuccacccaaaaua

SEQ ID NO: 4015107 - RNA, 14 nt, Human respiratory syncytial virus
aacacaccagcugc

SEQ ID NO: 4015108 - RNA, 16 nt, Human respiratory syncytial virus
aacacugacauauuca

SEQ ID NO: 4015109 - RNA, 19 nt, Human respiratory syncytial virus
aacaucaauaaaacagaca

SEQ ID NO: 4015110 - RNA, 20 nt, Human respiratory syncytial virus
aacaucuacacuacacacuu

SEQ ID NO: 4015111 - RNA, 18 nt, Human respiratory syncytial virus
aacauuacagcaagacua

SEQ ID NO: 4015112 - RNA, 18 nt, Human respiratory syncytial virus
aacauuggggcaaaugca

SEQ ID NO: 4015113 - RNA, 22 nt, Human respiratory syncytial virus
aaccacaucaccaauccacaca

SEQ ID NO: 4015114 - RNA, 22 nt, Human respiratory syncytial virus
aaccaggaucuuuaugaugcag

SEQ ID NO: 4015115 - RNA, 21 nt, Human respiratory syncytial virus
aacuacaauuauuauaguaau

SEQ ID NO: 4015116 - RNA, 21 nt, Human respiratory syncytial virus
aacuauaacacagucauuaau

SEQ ID NO: 4015117 - RNA, 11 nt, Human respiratory syncytial virus
aagaaaugaua

SEQ ID NO: 4015118 - RNA, 23 nt, Human respiratory syncytial virus
aagaacaagauggggcaaauaug

SEQ ID NO: 4015119 - RNA, 22 nt, Human respiratory syncytial virus
aagaaugcagugacagaauuac

SEQ ID NO: 4015120 - RNA, 17 nt, Human respiratory syncytial virus
aagaugcaaauaacaaa

SEQ ID NO: 4015121 - RNA, 14 nt, Human respiratory syncytial virus
aaguaaugcuaaga

SEQ ID NO: 4015122 - RNA, 16 nt, Human respiratory syncytial virus
aaguaucacaaucaaa

SEQ ID NO: 4015123 - RNA, 21 nt, Human respiratory syncytial virus
aagucuaugaguaugcacaga

SEQ ID NO: 4015124 - RNA, 21 nt, Human respiratory syncytial virus
aaguugggaggagaagcugga

SEQ ID NO: 4015125 - RNA, 15 nt, Human respiratory syncytial virus
aauaaacuaggacua

SEQ ID NO: 4015126 - RNA, 21 nt, Human respiratory syncytial virus
aauaacaucucucaccaaaga

SEQ ID NO: 4015127 - RNA, 19 nt, Human respiratory syncytial virus
aauaagucaacauggagaa

SEQ ID NO: 4015128 - RNA, 23 nt, Human respiratory syncytial virus
aauaagucaacauggagaaguuu

SEQ ID NO: 4015129 - RNA, 20 nt, Human respiratory syncytial virus
aauacacugaauauaauaca

SEQ ID NO: 4015130 - RNA, 14 nt, Human respiratory syncytial virus
aauacauuaaauaa

SEQ ID NO: 4015131 - RNA, 13 nt, Human respiratory syncytial virus
aauauacaaauau

SEQ ID NO: 4015132 - RNA, 16 nt, Human respiratory syncytial virus
aaucucaacaaccauu

SEQ ID NO: 4015133 - RNA, 17 nt, Human respiratory syncytial virus
aauggaaaggaaaugaa

SEQ ID NO: 4015134 - RNA, 18 nt, Human respiratory syncytial virus
aaugucuuaaaaaaugaa

SEQ ID NO: 4015135 - RNA, 18 nt, Human respiratory syncytial virus
aauguucuagaaaaagau

SEQ ID NO: 4015136 - RNA, 15 nt, Human respiratory syncytial virus
aauuaacauaaugau

SEQ ID NO: 4015137 - RNA, 14 nt, Human respiratory syncytial virus
aauuacuacauaau

SEQ ID NO: 4015138 - RNA, 16 nt, Human respiratory syncytial virus
aauuaucaacacugaa

SEQ ID NO: 4015139 - RNA, 17 nt, Human respiratory syncytial virus
aauuaugaugugcaaaa

SEQ ID NO: 4015140 - RNA, 13 nt, Human respiratory syncytial virus
acaaaaaaaccaa

SEQ ID NO: 4015141 - RNA, 22 nt, Human respiratory syncytial virus
acaaaguagggaguaccaaaua

SEQ ID NO: 4015142 - RNA, 13 nt, Human respiratory syncytial virus
acaauagaauuaa

SEQ ID NO: 4015143 - RNA, 15 nt, Human respiratory syncytial virus
acaauagaauucaca

SEQ ID NO: 4015144 - RNA, 18 nt, Human respiratory syncytial virus
acaaugaagaagaaucua

SEQ ID NO: 4015145 - RNA, 12 nt, Human respiratory syncytial virus
acacuacacacu

SEQ ID NO: 4015146 - RNA, 17 nt, Human respiratory syncytial virus
acacuucaucacacaaa

SEQ ID NO: 4015147 - RNA, 16 nt, Human respiratory syncytial virus
acagaaguugggagga

SEQ ID NO: 4015148 - RNA, 18 nt, Human respiratory syncytial virus
acagaaguugggaggaga

SEQ ID NO: 4015149 - RNA, 19 nt, Human respiratory syncytial virus
acagaaguugggaggagaa

SEQ ID NO: 4015150 - RNA, 22 nt, Human respiratory syncytial virus
acagaaguugggaggagaagcu

SEQ ID NO: 4015151 - RNA, 14 nt, Human respiratory syncytial virus
acaggauuaauagg

SEQ ID NO: 4015152 - RNA, 13 nt, Human respiratory syncytial virus
acaucaaaaagag

SEQ ID NO: 4015153 - RNA, 21 nt, Human respiratory syncytial virus
acaucacccaacacaaaguca

SEQ ID NO: 4015154 - RNA, 13 nt, Human respiratory syncytial virus
acaucauucacaa

SEQ ID NO: 4015155 - RNA, 17 nt, Human respiratory syncytial virus
acaucucucaccaaaga

SEQ ID NO: 4015156 - RNA, 18 nt, Human respiratory syncytial virus
acaugcuuaaaagugaaa

SEQ ID NO: 4015157 - RNA, 14 nt, Human respiratory syncytial virus
accaaaaaaaccaa

SEQ ID NO: 4015158 - RNA, 14 nt, Human respiratory syncytial virus
accaccaaaaccac

SEQ ID NO: 4015159 - RNA, 15 nt, Human respiratory syncytial virus
acgaaauuaacaaua

SEQ ID NO: 4015160 - RNA, 15 nt, Human respiratory syncytial virus
acgacgaaaaaagaa

SEQ ID NO: 4015161 - RNA, 16 nt, Human respiratory syncytial virus
acucaucaaagggaaa

SEQ ID NO: 4015162 - RNA, 23 nt, Human respiratory syncytial virus
acugacaauaaaggagcauucaa

SEQ ID NO: 4015163 - RNA, 16 nt, Human respiratory syncytial virus
acuguguauagcagca

SEQ ID NO: 4015164 - RNA, 18 nt, Human respiratory syncytial virus
acuuaugcaaaacacacc

SEQ ID NO: 4015165 - RNA, 16 nt, Human respiratory syncytial virus
acuugauaaacaauga

SEQ ID NO: 4015166 - RNA, 13 nt, Human respiratory syncytial virus
agaaaaagaugau

SEQ ID NO: 4015167 - RNA, 16 nt, Human respiratory syncytial virus
agaaauacacugaaua

SEQ ID NO: 4015168 - RNA, 13 nt, Human respiratory syncytial virus
agaauauaggcau

SEQ ID NO: 4015169 - RNA, 21 nt, Human respiratory syncytial virus
agacaacgauagugacaauga

SEQ ID NO: 4015170 - RNA, 14 nt, Human respiratory syncytial virus
agauauaaauggaa

SEQ ID NO: 4015171 - RNA, 16 nt, Human respiratory syncytial virus
agauccuaagaagaaa

SEQ ID NO: 4015172 - RNA, 18 nt, Human respiratory syncytial virus
agaucuuaccaugaagac

SEQ ID NO: 4015173 - RNA, 13 nt, Human respiratory syncytial virus
agaugcaaaucau

SEQ ID NO: 4015174 - RNA, 22 nt, Human respiratory syncytial virus
agaugcaucaaaucaacacaua

SEQ ID NO: 4015175 - RNA, 19 nt, Human respiratory syncytial virus
agcaaauagacaaaaaacc

SEQ ID NO: 4015176 - RNA, 17 nt, Human respiratory syncytial virus
agcaacucaaagaaaau

SEQ ID NO: 4015177 - RNA, 19 nt, Human respiratory syncytial virus
agcacuuguaauaaccaaa

SEQ ID NO: 4015178 - RNA, 14 nt, Human respiratory syncytial virus
agcaggucuaggca

SEQ ID NO: 4015179 - RNA, 22 nt, Human respiratory syncytial virus
agcauaugcagagcaacucaaa

SEQ ID NO: 4015180 - RNA, 17 nt, Human respiratory syncytial virus
agcuacucauaugaaga

SEQ ID NO: 4015181 - RNA, 19 nt, Human respiratory syncytial virus
aggauuguuuaugaaugcc

SEQ ID NO: 4015182 - RNA, 16 nt, Human respiratory syncytial virus
aguaacaaaaaaagaa

SEQ ID NO: 4015183 - RNA, 21 nt, Human respiratory syncytial virus
aguaauuaggagggcaaacaa

SEQ ID NO: 4015184 - RNA, 24 nt, Human respiratory syncytial virus
aguaccaaauacaagaaauacacu

SEQ ID NO: 4015185 - RNA, 20 nt, Human respiratory syncytial virus
aguaccccagaaaccaaagc

SEQ ID NO: 4015186 - RNA, 17 nt, Human respiratory syncytial virus
aguacuuacaacuauaa

SEQ ID NO: 4015187 - RNA, 21 nt, Human respiratory syncytial virus
auaaaacauucuguaacaaua

SEQ ID NO: 4015188 - RNA, 11 nt, Human respiratory syncytial virus
auaaaaguaaa

SEQ ID NO: 4015189 - RNA, 21 nt, Human respiratory syncytial virus
auaaaugaucaaacaaaugac

SEQ ID NO: 4015190 - RNA, 22 nt, Human respiratory syncytial virus
auaacaucucucaccaaagaaa

SEQ ID NO: 4015191 - RNA, 14 nt, Human respiratory syncytial virus
auaauaaauuacua

SEQ ID NO: 4015192 - RNA, 16 nt, Human respiratory syncytial virus
auaauauacaaauaug

SEQ ID NO: 4015193 - RNA, 13 nt, Human respiratory syncytial virus
auauaaauggaaa

SEQ ID NO: 4015194 - RNA, 15 nt, Human respiratory syncytial virus
auauaaauggaaagg

SEQ ID NO: 4015195 - RNA, 15 nt, Human T-lymphotropic virus 1
caggcccuacagcca

SEQ ID NO: 4015196 - RNA, 13 nt, Human T-lymphotropic virus 1
caggcccuccugc

SEQ ID NO: 4015197 - RNA, 15 nt, Human T-lymphotropic virus 1
caggcccuccugccc

SEQ ID NO: 4015198 - RNA, 14 nt, Human T-lymphotropic virus 1
caggcuaggcccug

SEQ ID NO: 4015199 - RNA, 12 nt, Human T-lymphotropic virus 1
cagggcccagaa

SEQ ID NO: 4015200 - RNA, 15 nt, Human T-lymphotropic virus 1
cagggggccaaaccc

SEQ ID NO: 4015201 - RNA, 16 nt, Human T-lymphotropic virus 1
caguggccacuugucu

SEQ ID NO: 4015202 - RNA, 19 nt, Human T-lymphotropic virus 1
caguucugcccccucaucc

SEQ ID NO: 4015203 - RNA, 14 nt, Human T-lymphotropic virus 1
caguuuccuccucc

SEQ ID NO: 4015204 - RNA, 19 nt, Human T-lymphotropic virus 1
cauacaguacucuuccuuu

SEQ ID NO: 4015205 - RNA, 22 nt, Human T-lymphotropic virus 1
cauaccacucuaaacccugcaa

SEQ ID NO: 4015206 - RNA, 16 nt, Human T-lymphotropic virus 1
cauauccucgagcccu

SEQ ID NO: 4015207 - RNA, 16 nt, Human T-lymphotropic virus 1
caucaaauccuccuuc

SEQ ID NO: 4015208 - RNA, 13 nt, Human T-lymphotropic virus 1
cauccccuucuuc

SEQ ID NO: 4015209 - RNA, 15 nt, Human T-lymphotropic virus 1
cauccugccccccuu

SEQ ID NO: 4015210 - RNA, 14 nt, Human T-lymphotropic virus 1
caucgaaacagccc

SEQ ID NO: 4015211 - RNA, 13 nt, Human T-lymphotropic virus 1
caugcccaagacc

SEQ ID NO: 4015212 - RNA, 20 nt, Human T-lymphotropic virus 1
caugcgcaaauacucccccu

SEQ ID NO: 4015213 - RNA, 23 nt, Human T-lymphotropic virus 1
caugcuuauuaucagcccacuuc

SEQ ID NO: 4015214 - RNA, 19 nt, Human T-lymphotropic virus 1
caugggagccggaguggcu

SEQ ID NO: 4015215 - RNA, 15 nt, Human T-lymphotropic virus 1
cauguaccucuacca

SEQ ID NO: 4015216 - RNA, 12 nt, Human T-lymphotropic virus 1
cauuccacccuc

SEQ ID NO: 4015217 - RNA, 17 nt, Human T-lymphotropic virus 1
ccaaaucccccuaccua

SEQ ID NO: 4015218 - RNA, 16 nt, Human T-lymphotropic virus 1
ccaacaucuauucugc

SEQ ID NO: 4015219 - RNA, 20 nt, Human T-lymphotropic virus 1
ccaacaucuauucugccagu

SEQ ID NO: 4015220 - RNA, 15 nt, Human T-lymphotropic virus 1
ccaagcagcaguggc

SEQ ID NO: 4015221 - RNA, 20 nt, Human T-lymphotropic virus 1
ccaaucauggaccugccccu

SEQ ID NO: 4015222 - RNA, 14 nt, Human T-lymphotropic virus 1
ccaauggaaccugg

SEQ ID NO: 4015223 - RNA, 16 nt, Human T-lymphotropic virus 1
ccacagucaccgauuc

SEQ ID NO: 4015224 - RNA, 18 nt, Human T-lymphotropic virus 1
ccacaucgccuccagccu

SEQ ID NO: 4015225 - RNA, 12 nt, Human T-lymphotropic virus 1
ccacccaaaccu

SEQ ID NO: 4015226 - RNA, 19 nt, Human T-lymphotropic virus 1
ccacccauuuccuccccau

SEQ ID NO: 4015227 - RNA, 12 nt, Human T-lymphotropic virus 1
ccaccccagugu

SEQ ID NO: 4015228 - RNA, 15 nt, Human T-lymphotropic virus 1
ccaccccggccagcu

SEQ ID NO: 4015229 - RNA, 16 nt, Human T-lymphotropic virus 1
ccacccuccuuccucc

SEQ ID NO: 4015230 - RNA, 12 nt, Human T-lymphotropic virus 1
ccacccugcccu

SEQ ID NO: 4015231 - RNA, 21 nt, Human T-lymphotropic virus 1
ccaccgggaaccacccauuuc

SEQ ID NO: 4015232 - RNA, 12 nt, Human T-lymphotropic virus 1
ccaccucccagg

SEQ ID NO: 4015233 - RNA, 16 nt, Human T-lymphotropic virus 1
ccacguucgcagccau

SEQ ID NO: 4015234 - RNA, 21 nt, Human T-lymphotropic virus 1
ccacugugguguuccagucca

SEQ ID NO: 4015235 - RNA, 21 nt, Human T-lymphotropic virus 1
ccagaacagacgaggccuuga

SEQ ID NO: 4015236 - RNA, 18 nt, Human T-lymphotropic virus 1
ccagcagguccuccgggc

SEQ ID NO: 4015237 - RNA, 16 nt, Human T-lymphotropic virus 1
ccagccaacugccucc

SEQ ID NO: 4015238 - RNA, 13 nt, Human T-lymphotropic virus 1
ccagccgauccca

SEQ ID NO: 4015239 - RNA, 19 nt, Human T-lymphotropic virus 1
ccaggcucaacgcucucac

SEQ ID NO: 4015240 - RNA, 23 nt, Human T-lymphotropic virus 1
ccaucaacccccaacuccugcau

SEQ ID NO: 4015241 - RNA, 14 nt, Human T-lymphotropic virus 1
ccaucaccuggccc

SEQ ID NO: 4015242 - RNA, 15 nt, Human T-lymphotropic virus 1
ccaugcauccuccgu

SEQ ID NO: 4015243 - RNA, 19 nt, Human T-lymphotropic virus 1
cccaacccugucuuuucca

SEQ ID NO: 4015244 - RNA, 23 nt, Human T-lymphotropic virus 1
cccaacccugucuuuuccagacc

SEQ ID NO: 4015245 - RNA, 15 nt, Human T-lymphotropic virus 1
cccaagguaccuaua

SEQ ID NO: 4015246 - RNA, 17 nt, Human T-lymphotropic virus 1
uccaccucgccuuccaa

SEQ ID NO: 4015247 - RNA, 16 nt, Human T-lymphotropic virus 1
uccagccccccaccug

SEQ ID NO: 4015248 - RNA, 12 nt, Human T-lymphotropic virus 1
uccagccccuac

SEQ ID NO: 4015249 - RNA, 19 nt, Human T-lymphotropic virus 1
uccagcuaccaugccaccu

SEQ ID NO: 4015250 - RNA, 20 nt, Human T-lymphotropic virus 1
uccagcuaccaugccaccua

SEQ ID NO: 4015251 - RNA, 17 nt, Human T-lymphotropic virus 1
uccaggauaugacccca

SEQ ID NO: 4015252 - RNA, 19 nt, Human T-lymphotropic virus 1
uccaggccauugccuaucu

SEQ ID NO: 4015253 - RNA, 23 nt, Human T-lymphotropic virus 1
ucccaacccugucuuuuccagac

SEQ ID NO: 4015254 - RNA, 14 nt, Human T-lymphotropic virus 1
ucccacccuguucg

SEQ ID NO: 4015255 - RNA, 14 nt, Human T-lymphotropic virus 1
ucccaccgccccuc

SEQ ID NO: 4015256 - RNA, 15 nt, Human T-lymphotropic virus 1
ucccaucuccaggcu

SEQ ID NO: 4015257 - RNA, 11 nt, Human T-lymphotropic virus 1
ucccccuuccg

SEQ ID NO: 4015258 - RNA, 22 nt, Human T-lymphotropic virus 1
ucccgccuguggugccuccuga

SEQ ID NO: 4015259 - RNA, 15 nt, Human T-lymphotropic virus 1
ucccuaaucucccau

SEQ ID NO: 4015260 - RNA, 21 nt, Human T-lymphotropic virus 1
uccgucagcuacgacaccucc

SEQ ID NO: 4015261 - RNA, 13 nt, Human T-lymphotropic virus 1
uccguucagccuc

SEQ ID NO: 4015262 - RNA, 22 nt, Human T-lymphotropic virus 1
uccuaggggcuauuaugcugac

SEQ ID NO: 4015263 - RNA, 21 nt, Human T-lymphotropic virus 1
uccuccgcccgcuuccugcgc

SEQ ID NO: 4015264 - RNA, 17 nt, Human T-lymphotropic virus 1
uccuccguucagccucc

SEQ ID NO: 4015265 - RNA, 20 nt, Human T-lymphotropic virus 1
uccucggugauuacagcccc

SEQ ID NO: 4015266 - RNA, 16 nt, Human T-lymphotropic virus 1
uccucuacucucccac

SEQ ID NO: 4015267 - RNA, 18 nt, Human T-lymphotropic virus 1
uccucucaggcccccuuu

SEQ ID NO: 4015268 - RNA, 14 nt, Human T-lymphotropic virus 1
uccucuuucucccg

SEQ ID NO: 4015269 - RNA, 18 nt, Human T-lymphotropic virus 1
uccugcagcaaccuccuc

SEQ ID NO: 4015270 - RNA, 19 nt, Human T-lymphotropic virus 1
uccugcagcucucuccugc

SEQ ID NO: 4015271 - RNA, 17 nt, Human T-lymphotropic virus 1
uccuggcaagccccucc

SEQ ID NO: 4015272 - RNA, 16 nt, Human T-lymphotropic virus 1
uccuguaccucccuga

SEQ ID NO: 4015273 - RNA, 23 nt, Human T-lymphotropic virus 1
uccuucacgcgcccgccgccuua

SEQ ID NO: 4015274 - RNA, 16 nt, Human T-lymphotropic virus 1
ucgaccugcuggcccu

SEQ ID NO: 4015275 - RNA, 20 nt, Human T-lymphotropic virus 1
ucgccacuuugauuuuauuc

SEQ ID NO: 4015276 - RNA, 23 nt, Human T-lymphotropic virus 1
ucgcuuccucuucuccucagccc

SEQ ID NO: 4015277 - RNA, 20 nt, Human T-lymphotropic virus 1
ucggacuuuugcauggccuc

SEQ ID NO: 4015278 - RNA, 16 nt, Human T-lymphotropic virus 1
ucguggcgcugucuca

SEQ ID NO: 4015279 - RNA, 21 nt, Human T-lymphotropic virus 1
ucuaguauagccaucaacccc

SEQ ID NO: 4015280 - RNA, 18 nt, Human T-lymphotropic virus 1
ucucagccccuugucucc

SEQ ID NO: 4015281 - RNA, 23 nt, Human T-lymphotropic virus 1
ucuccgggcgaagucagcggccu

SEQ ID NO: 4015282 - RNA, 16 nt, Human T-lymphotropic virus 1
ucuccugcagcaaccu

SEQ ID NO: 4015283 - RNA, 13 nt, Human T-lymphotropic virus 1
ucugcuuuuccuc

SEQ ID NO: 4015284 - RNA, 20 nt, Human T-lymphotropic virus 1
ucuggcuacaugccccccua

SEQ ID NO: 4015285 - RNA, 20 nt, Human T-lymphotropic virus 1
ucuuccaguucugcccccuc

SEQ ID NO: 4015286 - RNA, 15 nt, Human T-lymphotropic virus 1
ucuucuccucagccc

SEQ ID NO: 4015287 - RNA, 23 nt, Human T-lymphotropic virus 1
ugacacccagaccagccacccaa

SEQ ID NO: 4015288 - RNA, 16 nt, Human T-lymphotropic virus 1
ugacuuguccagccug

SEQ ID NO: 4015289 - RNA, 17 nt, Human T-lymphotropic virus 1
ugaucccaucuccaggc

SEQ ID NO: 4015290 - RNA, 17 nt, Human T-lymphotropic virus 1
ugcaauccugcccagcc

SEQ ID NO: 4015291 - RNA, 19 nt, Human T-lymphotropic virus 1
ugcaccacguucgcagcca

SEQ ID NO: 4015292 - RNA, 22 nt, Human T-lymphotropic virus 1
ugcagcucucuccugcagaccu

SEQ ID NO: 4015293 - RNA, 15 nt, Human T-lymphotropic virus 1
ugcaugcccaagacc

SEQ ID NO: 4015294 - RNA, 13 nt, Human T-lymphotropic virus 1
ugcauggccucuc

SEQ ID NO: 4015295 - RNA, 19 nt, Human T-lymphotropic virus 1
ugccaacuacacuagccca

SEQ ID NO: 4015296 - RNA, 12 nt, Human T-lymphotropic virus 1
ugccccccuacc

SEQ ID NO: 4015297 - RNA, 19 nt, Human T-lymphotropic virus 1
ugcccuaggcaccuuccaa

SEQ ID NO: 4015298 - RNA, 22 nt, Human T-lymphotropic virus 1
ugcccuaggcaccuuccaaggc

SEQ ID NO: 4015299 - RNA, 18 nt, Human T-lymphotropic virus 1
ugcgcaaauacucccccu

SEQ ID NO: 4015300 - RNA, 16 nt, Human T-lymphotropic virus 1
ugcucuauccauagcc

SEQ ID NO: 4015301 - RNA, 13 nt, Human T-lymphotropic virus 1
ugcucuuccugcu

SEQ ID NO: 4015302 - RNA, 21 nt, Human T-lymphotropic virus 1
uggaucccguggaggcuccuc

SEQ ID NO: 4015303 - RNA, 13 nt, Human T-lymphotropic virus 1
uggcccuuucagc

SEQ ID NO: 4015304 - RNA, 22 nt, Human T-lymphotropic virus 1
uggcggaggcuauuauucagcc

SEQ ID NO: 4015305 - RNA, 17 nt, Human T-lymphotropic virus 1
ugucaagccguccucag

SEQ ID NO: 4015306 - RNA, 17 nt, Human T-lymphotropic virus 1
ugucgcgcuacuccuuc

SEQ ID NO: 4015307 - RNA, 23 nt, Human T-lymphotropic virus 1
ugugaucauaaacaccgccccuu

SEQ ID NO: 4015308 - RNA, 14 nt, Human T-lymphotropic virus 1
uguggugccuccug

SEQ ID NO: 4015309 - RNA, 22 nt, Human T-lymphotropic virus 1
uguuuucagacggauccaccuc

SEQ ID NO: 4015310 - RNA, 19 nt, Human T-lymphotropic virus 1
uuaauaccgaacccagcca

SEQ ID NO: 4015311 - RNA, 14 nt, Human T-lymphotropic virus 1
uuacgccagccccu

SEQ ID NO: 4015312 - RNA, 13 nt, Human T-lymphotropic virus 1
uuaggugcccaga

SEQ ID NO: 4015313 - RNA, 21 nt, Human T-lymphotropic virus 1
uuaguacuacaguccuccucc

SEQ ID NO: 4015314 - RNA, 15 nt, Human T-lymphotropic virus 1
uucaccuaaucaccu

SEQ ID NO: 4015315 - RNA, 21 nt, Human T-lymphotropic virus 1
gccuucuccuccgcccgcuuc

SEQ ID NO: 4015316 - RNA, 15 nt, Human T-lymphotropic virus 1
gccuugaucuccugu

SEQ ID NO: 4015317 - RNA, 16 nt, Human T-lymphotropic virus 1
gcggcuuuccucuucu

SEQ ID NO: 4015318 - RNA, 17 nt, Human T-lymphotropic virus 1
gcuacgacaccuccccu

SEQ ID NO: 4015319 - RNA, 18 nt, Human T-lymphotropic virus 1
gcuacuugccucagcugu

SEQ ID NO: 4015320 - RNA, 19 nt, Human T-lymphotropic virus 1
gcucaccucccuuccugug

SEQ ID NO: 4015321 - RNA, 23 nt, Human T-lymphotropic virus 1
gcucacggcgcuccugcucuucc

SEQ ID NO: 4015322 - RNA, 24 nt, Human T-lymphotropic virus 1
gcuccucaagcgagcugcaugccc

SEQ ID NO: 4015323 - RNA, 14 nt, Human T-lymphotropic virus 1
gcucugacgucucc

SEQ ID NO: 4015324 - RNA, 14 nt, Human T-lymphotropic virus 1
gcucuuccugcuuu

SEQ ID NO: 4015325 - RNA, 13 nt, Human T-lymphotropic virus 1
gcugacagccugg

SEQ ID NO: 4015326 - RNA, 13 nt, Human T-lymphotropic virus 1
gcugcaugcccaa

SEQ ID NO: 4015327 - RNA, 17 nt, Human T-lymphotropic virus 1
gcuuccagccccccacc

SEQ ID NO: 4015328 - RNA, 19 nt, Human T-lymphotropic virus 1
ggacaaagauauuucccaa

SEQ ID NO: 4015329 - RNA, 21 nt, Human T-lymphotropic virus 1
ggacuguuugcccaccacccu

SEQ ID NO: 4015330 - RNA, 15 nt, Human T-lymphotropic virus 1
ggagccgucuccagc

SEQ ID NO: 4015331 - RNA, 21 nt, Human T-lymphotropic virus 1
ggauacauggaacccacccuu

SEQ ID NO: 4015332 - RNA, 23 nt, Human T-lymphotropic virus 1
ggaugacauucuccuggcaagcc

SEQ ID NO: 4015333 - RNA, 22 nt, Human T-lymphotropic virus 1
ggcacguccuauacucucccaa

SEQ ID NO: 4015334 - RNA, 23 nt, Human T-lymphotropic virus 1
ggcagcaccucccaacccugucu

SEQ ID NO: 4015335 - RNA, 16 nt, Human T-lymphotropic virus 1
ggcagguccucucagg

SEQ ID NO: 4015336 - RNA, 18 nt, Human T-lymphotropic virus 1
ggcccauauccugcagcc

SEQ ID NO: 4015337 - RNA, 14 nt, Human T-lymphotropic virus 1
ggcccuccugcccc

SEQ ID NO: 4015338 - RNA, 13 nt, Human T-lymphotropic virus 1
ggccucuccagcg

SEQ ID NO: 4015339 - RNA, 18 nt, Human T-lymphotropic virus 1
ggcuagaacaccucccaa

SEQ ID NO: 4015340 - RNA, 17 nt, Human T-lymphotropic virus 1
gggagccggaguggcug

SEQ ID NO: 4015341 - RNA, 21 nt, Human T-lymphotropic virus 1
gggccaggaaauaacccagua

SEQ ID NO: 4015342 - RNA, 21 nt, Human T-lymphotropic virus 1
gguaagcgcuaguucugccca

SEQ ID NO: 4015343 - RNA, 15 nt, Human T-lymphotropic virus 1
guaccucccugaggc

SEQ ID NO: 4015344 - RNA, 13 nt, Human T-lymphotropic virus 1
guaugcugcccag

SEQ ID NO: 4015345 - RNA, 14 nt, Human T-lymphotropic virus 1
guccagagcaucag

SEQ ID NO: 4015346 - RNA, 14 nt, Human T-lymphotropic virus 1
guccuuaccccgcc

SEQ ID NO: 4015347 - RNA, 12 nt, Human T-lymphotropic virus 1
gucuccagcccc

SEQ ID NO: 4015348 - RNA, 15 nt, Human T-lymphotropic virus 1
gugauuacagcccca

SEQ ID NO: 4015349 - RNA, 18 nt, Human T-lymphotropic virus 1
gugauuacagccccagcu

SEQ ID NO: 4015350 - RNA, 21 nt, Human T-lymphotropic virus 1
gugcagcugcggcaggcccug

SEQ ID NO: 4015351 - RNA, 13 nt, Human T-lymphotropic virus 1
gugccagccuauc

SEQ ID NO: 4015352 - RNA, 21 nt, Human T-lymphotropic virus 1
gugccccugggggcagcuacu

SEQ ID NO: 4015353 - RNA, 21 nt, Human T-lymphotropic virus 1
guugacgacaaccccucaccu

SEQ ID NO: 4015354 - RNA, 18 nt, Human T-lymphotropic virus 1
uaaacccugcaauccugc

SEQ ID NO: 4015355 - RNA, 21 nt, Human T-lymphotropic virus 1
uaaacccugcaauccugccca

SEQ ID NO: 4015356 - RNA, 16 nt, Human T-lymphotropic virus 1
uaaagauggccagcca

SEQ ID NO: 4015357 - RNA, 14 nt, Human T-lymphotropic virus 1
uaacaucuccaccc

SEQ ID NO: 4015358 - RNA, 19 nt, Human T-lymphotropic virus 1
uaaccaagacccaacaucu

SEQ ID NO: 4015359 - RNA, 14 nt, Human T-lymphotropic virus 1
uaacucuuccucca

SEQ ID NO: 4015360 - RNA, 14 nt, Human T-lymphotropic virus 1
uaagcucagaccuc

SEQ ID NO: 4015361 - RNA, 18 nt, Human T-lymphotropic virus 1
uaaguuacuccagcuacc

SEQ ID NO: 4015362 - RNA, 11 nt, Human T-lymphotropic virus 1
uaaucucccau

SEQ ID NO: 4015363 - RNA, 18 nt, Human T-lymphotropic virus 1
uaauggcauucuuaaaac

SEQ ID NO: 4015364 - RNA, 22 nt, Human T-lymphotropic virus 1
uaauuaaccucucccaucaaau

SEQ ID NO: 4015365 - RNA, 13 nt, Human T-lymphotropic virus 1
uacacccucuggg

SEQ ID NO: 4015366 - RNA, 17 nt, Human T-lymphotropic virus 1
uacagccccagcugcug

SEQ ID NO: 4015367 - RNA, 19 nt, Human T-lymphotropic virus 1
uacaggagccgucuccagc

SEQ ID NO: 4015368 - RNA, 22 nt, Human T-lymphotropic virus 1
uacaggagccgucuccagcccc

SEQ ID NO: 4015369 - RNA, 22 nt, Human T-lymphotropic virus 1
uacauggaugacauucuccugg

SEQ ID NO: 4015370 - RNA, 20 nt, Human T-lymphotropic virus 1
uacccaucguuagcgcuucc

SEQ ID NO: 4015371 - RNA, 14 nt, Human T-lymphotropic virus 1
uaccgaacccagcc

SEQ ID NO: 4015372 - RNA, 16 nt, Human T-lymphotropic virus 1
uacgccagccccuuca

SEQ ID NO: 4015373 - RNA, 19 nt, Human T-lymphotropic virus 1
uacgccagccccuucacag

SEQ ID NO: 4015374 - RNA, 17 nt, Human T-lymphotropic virus 1
uacuacaguccuccucc

SEQ ID NO: 4015375 - RNA, 14 nt, Human T-lymphotropic virus 1
uacucccccuuccg

SEQ ID NO: 4015376 - RNA, 15 nt, Human T-lymphotropic virus 1
uagaacaccucccaa

SEQ ID NO: 4015377 - RNA, 19 nt, Human T-lymphotropic virus 1
uagaacaccucccaaggcc

SEQ ID NO: 4015378 - RNA, 13 nt, Human T-lymphotropic virus 1
uagacaccuuuuc

SEQ ID NO: 4015379 - RNA, 23 nt, Human T-lymphotropic virus 1
uagaccuuaaagacgccuuuuuc

SEQ ID NO: 4015380 - RNA, 12 nt, Human T-lymphotropic virus 1
uagacucagccg

SEQ ID NO: 4015381 - RNA, 16 nt, Human T-lymphotropic virus 1
aaaaauuuaggugccc

SEQ ID NO: 4015382 - RNA, 12 nt, Human T-lymphotropic virus 1
aaaagaggcaga

SEQ ID NO: 4015383 - RNA, 21 nt, Human T-lymphotropic virus 1
aaaagcguggggacaguucag

SEQ ID NO: 4015384 - RNA, 22 nt, Human T-lymphotropic virus 1
aaaaugcgguuuuuccuucucc

SEQ ID NO: 4015385 - RNA, 14 nt, Human T-lymphotropic virus 1
aaacaguuccagcc

SEQ ID NO: 4015386 - RNA, 14 nt, Human T-lymphotropic virus 1
aaacuccucuauaa

SEQ ID NO: 4015387 - RNA, 11 nt, Human T-lymphotropic virus 1
aaagagccucc

SEQ ID NO: 4015388 - RNA, 15 nt, Human T-lymphotropic virus 1
aacaauuaaguuccu

SEQ ID NO: 4015389 - RNA, 16 nt, Human T-lymphotropic virus 1
aacaccucccaaggcc

SEQ ID NO: 4015390 - RNA, 15 nt, Human T-lymphotropic virus 1
aacacuuuucuuaaa

SEQ ID NO: 4015391 - RNA, 23 nt, Human T-lymphotropic virus 1
aacagaagucugagaaggucagg

SEQ ID NO: 4015392 - RNA, 19 nt, Human T-lymphotropic virus 1
aacagugcuguuuucuaaa

SEQ ID NO: 4015393 - RNA, 15 nt, Human T-lymphotropic virus 1
aacccgaccuaccua

SEQ ID NO: 4015394 - RNA, 16 nt, Human T-lymphotropic virus 1
aaccuagaccauaucc

SEQ ID NO: 4015395 - RNA, 21 nt, Human T-lymphotropic virus 1
aaccuccuccguucagccucc

SEQ ID NO: 4015396 - RNA, 14 nt, Human T-lymphotropic virus 1
aacgccuccaggcc

SEQ ID NO: 4015397 - RNA, 13 nt, Human T-lymphotropic virus 1
aacucccucaucc

SEQ ID NO: 4015398 - RNA, 18 nt, Human T-lymphotropic virus 1
aacucccucauccugccc

SEQ ID NO: 4015399 - RNA, 20 nt, Human T-lymphotropic virus 1
aacucccucauccugccccc

SEQ ID NO: 4015400 - RNA, 17 nt, Human T-lymphotropic virus 1
aacucuuccuccaagga

SEQ ID NO: 4015401 - RNA, 21 nt, Human T-lymphotropic virus 1
aagacaaaucauaagcucaga

SEQ ID NO: 4015402 - RNA, 13 nt, Human T-lymphotropic virus 1
aagccccucccau

SEQ ID NO: 4015403 - RNA, 16 nt, Human T-lymphotropic virus 1
aaguacuuuacugaca

SEQ ID NO: 4015404 - RNA, 17 nt, Human T-lymphotropic virus 1
aauccuccuucuccugc

SEQ ID NO: 4015405 - RNA, 20 nt, Human T-lymphotropic virus 1
acaaggcgacuggugcccca

SEQ ID NO: 4015406 - RNA, 15 nt, Human T-lymphotropic virus 1
acacuagcccacuua

SEQ ID NO: 4015407 - RNA, 17 nt, Human T-lymphotropic virus 1
acacuuuucuuaaaaca

SEQ ID NO: 4015408 - RNA, 12 nt, Human T-lymphotropic virus 1
acagaacugccg

SEQ ID NO: 4015409 - RNA, 15 nt, Human T-lymphotropic virus 1
acagacgaggccuug

SEQ ID NO: 4015410 - RNA, 22 nt, Human T-lymphotropic virus 1
acagacgaggccuugaucuccu

SEQ ID NO: 4015411 - RNA, 20 nt, Human T-lymphotropic virus 1
acagcucagcaccagcucag

SEQ ID NO: 4015412 - RNA, 13 nt, Human T-lymphotropic virus 1
acaguccuccucc

SEQ ID NO: 4015413 - RNA, 16 nt, Human T-lymphotropic virus 1
acaguuggagucuccu

SEQ ID NO: 4015414 - RNA, 20 nt, Human T-lymphotropic virus 1
acaucugaccaccccagugu

SEQ ID NO: 4015415 - RNA, 20 nt, Human T-lymphotropic virus 1
acauuacccauuucaaauau

SEQ ID NO: 4015416 - RNA, 22 nt, Human T-lymphotropic virus 1
acauucuccuggcaagccccuc

SEQ ID NO: 4015417 - RNA, 18 nt, Human T-lymphotropic virus 1
accacccuuuuccagccu

SEQ ID NO: 4015418 - RNA, 19 nt, Human T-lymphotropic virus 1
accagaacgccuccaggcc

SEQ ID NO: 4015419 - RNA, 13 nt, Human T-lymphotropic virus 1
accagcuuucccc

SEQ ID NO: 4015420 - RNA, 14 nt, Human T-lymphotropic virus 1
accagcuuuccccc

SEQ ID NO: 4015421 - RNA, 20 nt, Human T-lymphotropic virus 1
accagcuuuccccccccauc

SEQ ID NO: 4015422 - RNA, 12 nt, Human T-lymphotropic virus 1
acccuccuuccu

SEQ ID NO: 4015423 - RNA, 18 nt, Human T-lymphotropic virus 1
acccuccuuccuccaggc

SEQ ID NO: 4015424 - RNA, 20 nt, Human T-lymphotropic virus 1
acccuccuuccuccaggcca

SEQ ID NO: 4015425 - RNA, 23 nt, Human T-lymphotropic virus 1
acccugcaauccugcccagccag

SEQ ID NO: 4015426 - RNA, 19 nt, Human T-lymphotropic virus 1
acccugucuuuuccagacc

SEQ ID NO: 4015427 - RNA, 21 nt, Human T-lymphotropic virus 1
acccuguucgaaaugcagcug

SEQ ID NO: 4015428 - RNA, 13 nt, Human T-lymphotropic virus 1
accgccccuccuc

SEQ ID NO: 4015429 - RNA, 22 nt, Human T-lymphotropic virus 1
accgccccuccucuacucuccc

SEQ ID NO: 4015430 - RNA, 16 nt, Human T-lymphotropic virus 1
accggcuccauguccc

SEQ ID NO: 4015431 - RNA, 17 nt, Human T-lymphotropic virus 1
accggcuccaugucccu

SEQ ID NO: 4015432 - RNA, 15 nt, Human T-lymphotropic virus 1
accuauggauaaugc

SEQ ID NO: 4015433 - RNA, 16 nt, Human T-lymphotropic virus 1
acgcuuugccugaccc

SEQ ID NO: 4015434 - RNA, 17 nt, Human T-lymphotropic virus 1
acggauccaccucccag

SEQ ID NO: 4015435 - RNA, 17 nt, Human T-lymphotropic virus 1
acguccuauacucuccc

SEQ ID NO: 4015436 - RNA, 13 nt, Human T-lymphotropic virus 1
acuacccaugucc

SEQ ID NO: 4015437 - RNA, 14 nt, Human T-lymphotropic virus 1
acuccaccacaguc

SEQ ID NO: 4015438 - RNA, 13 nt, Human T-lymphotropic virus 1
acuccagcuacca

SEQ ID NO: 4015439 - RNA, 22 nt, Human T-lymphotropic virus 1
acuccagcuaccaugccaccua

SEQ ID NO: 4015440 - RNA, 17 nt, Human T-lymphotropic virus 1
acucccucauccugccc

SEQ ID NO: 4015441 - RNA, 16 nt, Human T-lymphotropic virus 1
acuccugacucuuguc

SEQ ID NO: 4015442 - RNA, 13 nt, Human T-lymphotropic virus 1
acucucccacucu

SEQ ID NO: 4015443 - RNA, 21 nt, Human T-lymphotropic virus 1
acugacaaacccgaccuaccu

SEQ ID NO: 4015444 - RNA, 12 nt, Human T-lymphotropic virus 1
acugccucccac

SEQ ID NO: 4015445 - RNA, 13 nt, Human T-lymphotropic virus 1
acuggcaccacca

SEQ ID NO: 4015446 - RNA, 18 nt, Human T-lymphotropic virus 1
agaccgggccuuuguccg

SEQ ID NO: 4015447 - RNA, 21 nt, Human T-lymphotropic virus 1
agaucaggcccuacagccacc

SEQ ID NO: 4015448 - RNA, 22 nt, Human T-lymphotropic virus 1
agcaaccuccuccguucagccu

SEQ ID NO: 4015449 - RNA, 15 nt, Human T-lymphotropic virus 1
agcacaguuuccucc

SEQ ID NO: 4015450 - RNA, 19 nt, Human T-lymphotropic virus 1
agccacccugcccuaaucu

SEQ ID NO: 4015451 - RNA, 20 nt, Human T-lymphotropic virus 1
agccauaccaaucuaccuga

SEQ ID NO: 4015452 - RNA, 17 nt, Human T-lymphotropic virus 1
agcccuacuuugcuuuc

SEQ ID NO: 4015453 - RNA, 14 nt, Human T-lymphotropic virus 1
agccgucuccagcc

SEQ ID NO: 4015454 - RNA, 16 nt, Human T-lymphotropic virus 1
agccgucuccagcccc

SEQ ID NO: 4015455 - RNA, 21 nt, Human T-lymphotropic virus 1
agccgucuccagccccuacug

SEQ ID NO: 4015456 - RNA, 12 nt, Human T-lymphotropic virus 1
agccuccaagga

SEQ ID NO: 4015457 - RNA, 20 nt, Human T-lymphotropic virus 1
agccuccaaggacuccaccu

SEQ ID NO: 4015458 - RNA, 23 nt, Human T-lymphotropic virus 1
agccugccaacuacacuagccca

SEQ ID NO: 4015459 - RNA, 23 nt, Human T-lymphotropic virus 1
agccuggcaaaacggccuccuuc

SEQ ID NO: 4015460 - RNA, 16 nt, Human T-lymphotropic virus 1
agcgcuaguucugccc

SEQ ID NO: 4015461 - RNA, 21 nt, Human T-lymphotropic virus 1
agcgcuaguucugcccagugg

SEQ ID NO: 4015462 - RNA, 22 nt, Human T-lymphotropic virus 1
agcgcuaguucugcccagugga

SEQ ID NO: 4015463 - RNA, 22 nt, Human T-lymphotropic virus 1
agcggccuucuccuccgcccgc

SEQ ID NO: 4015464 - RNA, 13 nt, Human T-lymphotropic virus 1
agcucaccucccu

SEQ ID NO: 4015465 - RNA, 19 nt, Human T-lymphotropic virus 1
agcucagcaccagcucagg

SEQ ID NO: 4015466 - RNA, 21 nt, Human T-lymphotropic virus 1
agcuggcccauauccugcagc

SEQ ID NO: 4015467 - RNA, 15 nt, Human T-lymphotropic virus 1
agcuucaccacuccc

SEQ ID NO: 4015468 - RNA, 21 nt, Human T-lymphotropic virus 1
aggagccaucucagcuaccca

SEQ ID NO: 4015469 - RNA, 20 nt, Human T-lymphotropic virus 1
aggagccgucuccagccccu

SEQ ID NO: 4015470 - RNA, 19 nt, Human T-lymphotropic virus 1
aggcccuacagccacccug

SEQ ID NO: 4015471 - RNA, 14 nt, Human T-lymphotropic virus 1
aggcccuccugccc

SEQ ID NO: 4015472 - RNA, 22 nt, Human T-lymphotropic virus 1
aggggcaaccacaacugaggcc

SEQ ID NO: 4015473 - RNA, 21 nt, Human T-lymphotropic virus 1
agguaaguuuagagcucaggu

SEQ ID NO: 4015474 - RNA, 16 nt, Human T-lymphotropic virus 1
agguggcgcuuucccc

SEQ ID NO: 4015475 - RNA, 18 nt, Human T-lymphotropic virus 1
aguacucuuccuuucaua

SEQ ID NO: 4015476 - RNA, 14 nt, Human T-lymphotropic virus 1
aguucugcccccuc

SEQ ID NO: 4015477 - RNA, 12 nt, Human T-lymphotropic virus 1
aguuuccuccuc

SEQ ID NO: 4015478 - RNA, 16 nt, Human T-lymphotropic virus 1
aguuucucgccacuuu

SEQ ID NO: 4015479 - RNA, 19 nt, Human T-lymphotropic virus 1
auaaguacuuuacugacaa

SEQ ID NO: 4015480 - RNA, 14 nt, Human T-lymphotropic virus 1
auacaucauaacau

SEQ ID NO: 4015481 - RNA, 16 nt, Human T-lymphotropic virus 1
auagccuuguucucaa

SEQ ID NO: 4015482 - RNA, 14 nt, Human T-lymphotropic virus 1
auagucccacccug

SEQ ID NO: 4015483 - RNA, 16 nt, Human T-lymphotropic virus 1
auauccucgagcccuc

SEQ ID NO: 4015484 - RNA, 22 nt, Human T-lymphotropic virus 1
aucaccccuguccugcagcucu

SEQ ID NO: 4015485 - RNA, 13 nt, Human T-lymphotropic virus 1
aucaccuggcccc

SEQ ID NO: 4015486 - RNA, 22 nt, Human T-lymphotropic virus 1
aucauaggucgugaugccuuac

SEQ ID NO: 4015487 - RNA, 20 nt, Human T-lymphotropic virus 1
aucaucuucccccgggcccc

SEQ ID NO: 4015488 - RNA, 20 nt, Human T-lymphotropic virus 1
aucauggaccugccccuaua

SEQ ID NO: 4015489 - RNA, 14 nt, Human T-lymphotropic virus 1
auccaaccagcucc

SEQ ID NO: 4015490 - RNA, 15 nt, Human T-lymphotropic virus 1
aucccaucuccaggc

SEQ ID NO: 4015491 - RNA, 19 nt, Human T-lymphotropic virus 1
aucccucgacuccccuccu

SEQ ID NO: 4015492 - RNA, 22 nt, Human T-lymphotropic virus 1
auccgccguggccuacucccua

SEQ ID NO: 4015493 - RNA, 14 nt, Human T-lymphotropic virus 1
aucuauucccucau

SEQ ID NO: 4015494 - RNA, 22 nt, Human T-lymphotropic virus 1
aucugcuuuuccuccucuuucu

SEQ ID NO: 4015495 - RNA, 15 nt, Human T-lymphotropic virus 1
aucuuuaucauuacc

SEQ ID NO: 4015496 - RNA, 18 nt, Human T-lymphotropic virus 1
augacauucuccuggcaa

SEQ ID NO: 4015497 - RNA, 22 nt, Human T-lymphotropic virus 1
augacauucuccuggcaagccc

SEQ ID NO: 4015498 - RNA, 21 nt, Human T-lymphotropic virus 1
augauuuccgggcccugcccu

SEQ ID NO: 4015499 - RNA, 14 nt, Human T-lymphotropic virus 1
augcagcuggccca

SEQ ID NO: 4015500 - RNA, 13 nt, Human T-lymphotropic virus 1
augcugcccagaa

SEQ ID NO: 4015501 - RNA, 15 nt, Human T-lymphotropic virus 1
auuaaccaacugcca

SEQ ID NO: 4015502 - RNA, 12 nt, Human T-lymphotropic virus 1
auuacagcccca

SEQ ID NO: 4015503 - RNA, 23 nt, Human T-lymphotropic virus 1
auucaaacaucugaccaccccag

SEQ ID NO: 4015504 - RNA, 11 nt, Human T-lymphotropic virus 1
auuccacccuc

SEQ ID NO: 4015505 - RNA, 14 nt, Human T-lymphotropic virus 1
auucuuccaguucu

SEQ ID NO: 4015506 - RNA, 16 nt, Human T-lymphotropic virus 1
auugacacccagacca

SEQ ID NO: 4015507 - RNA, 20 nt, Human T-lymphotropic virus 1
auugcacaguaugcugccca

SEQ ID NO: 4015508 - RNA, 20 nt, Human T-lymphotropic virus 1
auuuaacuggacccacugcu

SEQ ID NO: 4015509 - RNA, 16 nt, Human T-lymphotropic virus 1
auuuccgggcccugcc

SEQ ID NO: 4015510 - RNA, 22 nt, Human T-lymphotropic virus 1
auuugcaccacguucgcagcca

SEQ ID NO: 4015511 - RNA, 15 nt, Human T-lymphotropic virus 1
caaaaagccaaaccg

SEQ ID NO: 4015512 - RNA, 19 nt, Human T-lymphotropic virus 1
caaaaauuuaggugcccag

SEQ ID NO: 4015513 - RNA, 19 nt, Human T-lymphotropic virus 1
caaaacccagcaaaccccu

SEQ ID NO: 4015514 - RNA, 20 nt, Human T-lymphotropic virus 1
caaauccuccuucuccugca

SEQ ID NO: 4015515 - RNA, 23 nt, Human T-lymphotropic virus 1
caacacuugguccggaaggcccu

SEQ ID NO: 4015516 - RNA, 17 nt, Human T-lymphotropic virus 1
caacaucuauucugcca

SEQ ID NO: 4015517 - RNA, 22 nt, Human T-lymphotropic virus 1
caacauuccacccuccuuccuc

SEQ ID NO: 4015518 - RNA, 18 nt, Human T-lymphotropic virus 1
caagaaguuucacaccuc

SEQ ID NO: 4015519 - RNA, 23 nt, Human T-lymphotropic virus 1
caaggacuccaccucgccuucca

SEQ ID NO: 4015520 - RNA, 19 nt, Human T-lymphotropic virus 1
caauaauuaaccucuccca

SEQ ID NO: 4015521 - RNA, 14 nt, Human T-lymphotropic virus 1
caauccugcccagc

SEQ ID NO: 4015522 - RNA, 15 nt, Human T-lymphotropic virus 1
caaucugcuuuuccu

SEQ ID NO: 4015523 - RNA, 14 nt, Human T-lymphotropic virus 1
cacagaugcccuac

SEQ ID NO: 4015524 - RNA, 18 nt, Human T-lymphotropic virus 1
cacagaugcccuacuaau

SEQ ID NO: 4015525 - RNA, 18 nt, Human T-lymphotropic virus 1
cacaguuggagucuccuc

SEQ ID NO: 4015526 - RNA, 18 nt, Human T-lymphotropic virus 1
caccacccuuuuccagcc

SEQ ID NO: 4015527 - RNA, 23 nt, Human T-lymphotropic virus 1
caccacuccccccgacuccagcc

SEQ ID NO: 4015528 - RNA, 16 nt, Human T-lymphotropic virus 1
uagcgcuuccagcccc

SEQ ID NO: 4015529 - RNA, 17 nt, Human T-lymphotropic virus 1
uagcgcuuccagccccc

SEQ ID NO: 4015530 - RNA, 18 nt, Human T-lymphotropic virus 1
uaggcaccuuccaaggca

SEQ ID NO: 4015531 - RNA, 23 nt, Human T-lymphotropic virus 1
uaggggcuauuaugcugacccuc

SEQ ID NO: 4015532 - RNA, 12 nt, Human T-lymphotropic virus 1
uaggugcccaga

SEQ ID NO: 4015533 - RNA, 16 nt, Human T-lymphotropic virus 1
uauucccaguuaaaaa

SEQ ID NO: 4015534 - RNA, 18 nt, Human T-lymphotropic virus 1
uauuuaaauccuucucaa

SEQ ID NO: 4015535 - RNA, 16 nt, Human T-lymphotropic virus 1
ucaaaacuccugacuc

SEQ ID NO: 4015536 - RNA, 20 nt, Human T-lymphotropic virus 1
ucaaacaucugaccacccca

SEQ ID NO: 4015537 - RNA, 21 nt, Human T-lymphotropic virus 1
ucaacccucaccacuccaggc

SEQ ID NO: 4015538 - RNA, 14 nt, Human T-lymphotropic virus 1
ucaacgcucucaca

SEQ ID NO: 4015539 - RNA, 19 nt, Human T-lymphotropic virus 1
ucaagcacaguuuccuccu

SEQ ID NO: 4015540 - RNA, 20 nt, Human T-lymphotropic virus 1
ucaagcacaguuuccuccuc

SEQ ID NO: 4015541 - RNA, 21 nt, Human T-lymphotropic virus 1
ucaaucauuagugcagcugcg

SEQ ID NO: 4015542 - RNA, 20 nt, Human T-lymphotropic virus 1
ucacaguuggagucuccuca

SEQ ID NO: 4015543 - RNA, 15 nt, Human T-lymphotropic virus 1
ucacgcgcccgccgc

SEQ ID NO: 4015544 - RNA, 16 nt, Human T-lymphotropic virus 1
ucacgcgcccgccgcc

SEQ ID NO: 4015545 - RNA, 20 nt, Human T-lymphotropic virus 1
ucacuuuaagcucaccuccc

SEQ ID NO: 4015546 - RNA, 20 nt, Human T-lymphotropic virus 1
ucagcaaucugcuuuuccuc

SEQ ID NO: 4015547 - RNA, 21 nt, Human T-lymphotropic virus 1
ucagcaccagcucaggcuagg

SEQ ID NO: 4015548 - RNA, 21 nt, Human T-lymphotropic virus 1
ucagcagaucaggcccuacag

SEQ ID NO: 4015549 - RNA, 16 nt, Human T-lymphotropic virus 1
ucaggcccuccugccc

SEQ ID NO: 4015550 - RNA, 14 nt, Human T-lymphotropic virus 1
ucaucaucuucccc

SEQ ID NO: 4015551 - RNA, 15 nt, Human T-lymphotropic virus 1
ucauucaaacaucug

SEQ ID NO: 4015552 - RNA, 17 nt, Human T-lymphotropic virus 1
uccaaacccugccccuc

SEQ ID NO: 4015553 - RNA, 14 nt, Human T-lymphotropic virus 1
uccaaccagcuccg

SEQ ID NO: 4015554 - RNA, 18 nt, Human T-lymphotropic virus 1
uccaaggacuccaccucg

SEQ ID NO: 4015555 - RNA, 20 nt, Human T-lymphotropic virus 1
uccaaggacuccaccucgcc

SEQ ID NO: 4015556 - RNA, 13 nt, Human T-lymphotropic virus 1
uccaauauccugc

SEQ ID NO: 4015557 - RNA, 21 nt, Human T-lymphotropic virus 1
uccaccagcagguccuccggg

SEQ ID NO: 4015558 - RNA, 20 nt, Human T-lymphotropic virus 1
uccacccuccuuccuccagg

SEQ ID NO: 4015559 - RNA, 19 nt, Human T-lymphotropic virus 1
uccagccgaucccagagac

SEQ ID NO: 4015560 - RNA, 14 nt, Human T-lymphotropic virus 1
uccagccuccccug

SEQ ID NO: 4015561 - RNA, 17 nt, Human T-lymphotropic virus 1
uccagccuccccugcca

SEQ ID NO: 4015562 - RNA, 13 nt, Human T-lymphotropic virus 1
uccagccugccaa

SEQ ID NO: 4015563 - RNA, 15 nt, Human T-lymphotropic virus 1
uccagccugccaacu

SEQ ID NO: 4015564 - RNA, 13 nt, Human T-lymphotropic virus 1
uccaguccaagca

SEQ ID NO: 4015565 - RNA, 18 nt, Human T-lymphotropic virus 1
uccaguucugcccccuca

SEQ ID NO: 4015566 - RNA, 18 nt, Human T-lymphotropic virus 1
ucccaguuaaaaaagcca

SEQ ID NO: 4015567 - RNA, 16 nt, Human T-lymphotropic virus 1
uccccauuucucuacu

SEQ ID NO: 4015568 - RNA, 14 nt, Human T-lymphotropic virus 1
uccccccccaucac

SEQ ID NO: 4015569 - RNA, 18 nt, Human T-lymphotropic virus 1
uccccccgacuccagccg

SEQ ID NO: 4015570 - RNA, 23 nt, Human T-lymphotropic virus 1
ucccccuaccuaaacaguuccag

SEQ ID NO: 4015571 - RNA, 18 nt, Human T-lymphotropic virus 1
ucccccuuccgccaccgc

SEQ ID NO: 4015572 - RNA, 21 nt, Human T-lymphotropic virus 1
ucccgccuguggugccuccug

SEQ ID NO: 4015573 - RNA, 15 nt, Human T-lymphotropic virus 1
ucccucauccugccc

SEQ ID NO: 4015574 - RNA, 15 nt, Human T-lymphotropic virus 1
ucccucgacuccccu

SEQ ID NO: 4015575 - RNA, 16 nt, Human T-lymphotropic virus 1
uccgcccgcuuccugc

SEQ ID NO: 4015576 - RNA, 21 nt, Human T-lymphotropic virus 1
uccuaccuuacgccagccccu

SEQ ID NO: 4015577 - RNA, 16 nt, Human T-lymphotropic virus 1
uccuccguucagccuc

SEQ ID NO: 4015578 - RNA, 15 nt, Human T-lymphotropic virus 1
uccuccuccuugucc

SEQ ID NO: 4015579 - RNA, 18 nt, Human T-lymphotropic virus 1
uccuccuucuccugcagc

SEQ ID NO: 4015580 - RNA, 15 nt, Human T-lymphotropic virus 1
uccugcagcaaccuc

SEQ ID NO: 4015581 - RNA, 14 nt, Human T-lymphotropic virus 1
uccugccccccuuu

SEQ ID NO: 4015582 - RNA, 18 nt, Human T-lymphotropic virus 1
uccugcgccgugccuucu

SEQ ID NO: 4015583 - RNA, 19 nt, Human T-lymphotropic virus 1
uccuggcaagccccuccca

SEQ ID NO: 4015584 - RNA, 22 nt, Human T-lymphotropic virus 1
uccuggcaagccccucccaugc

SEQ ID NO: 4015585 - RNA, 22 nt, Human T-lymphotropic virus 1
uccuugggcuagaacaccuccc

SEQ ID NO: 4015586 - RNA, 21 nt, Human T-lymphotropic virus 1
ucgaccugcuggcccuuucag

SEQ ID NO: 4015587 - RNA, 14 nt, Human T-lymphotropic virus 1
ucgacgcuccagga

SEQ ID NO: 4015588 - RNA, 13 nt, Human T-lymphotropic virus 1
ucgcaucucuccu

SEQ ID NO: 4015589 - RNA, 17 nt, Human T-lymphotropic virus 1
ucgcaucucuccuucac

SEQ ID NO: 4015590 - RNA, 13 nt, Human T-lymphotropic virus 1
ucgccuccagccu

SEQ ID NO: 4015591 - RNA, 15 nt, Human T-lymphotropic virus 1
ucgccuucucagccc

SEQ ID NO: 4015592 - RNA, 12 nt, Human T-lymphotropic virus 1
ucggcccgccua

SEQ ID NO: 4015593 - RNA, 22 nt, Human T-lymphotropic virus 1
ucggugauuacagccccagcug

SEQ ID NO: 4015594 - RNA, 20 nt, Human T-lymphotropic virus 1
ucuagucgacgcuccaggau

SEQ ID NO: 4015595 - RNA, 16 nt, Human T-lymphotropic virus 1
ucuauaaaauuucccu

SEQ ID NO: 4015596 - RNA, 22 nt, Human T-lymphotropic virus 1
ucucaaguaauacuccccucaa

SEQ ID NO: 4015597 - RNA, 23 nt, Human T-lymphotropic virus 1
ucuccacgcuuugccugacccug

SEQ ID NO: 4015598 - RNA, 13 nt, Human T-lymphotropic virus 1
ucuccagccccua

SEQ ID NO: 4015599 - RNA, 15 nt, Human T-lymphotropic virus 1
ucuccauuuuucaaa

SEQ ID NO: 4015600 - RNA, 14 nt, Human T-lymphotropic virus 1
ucuccgcccuggcc

SEQ ID NO: 4015601 - RNA, 18 nt, Human T-lymphotropic virus 1
ucuccuggcaagccccuc

SEQ ID NO: 4015602 - RNA, 21 nt, Human T-lymphotropic virus 1
ucuccuucacgcgcccgccgc

SEQ ID NO: 4015603 - RNA, 12 nt, Human T-lymphotropic virus 1
ucugcccagugg

SEQ ID NO: 4015604 - RNA, 22 nt, Human T-lymphotropic virus 1
ucuguaucgaucgugccagccu

SEQ ID NO: 4015605 - RNA, 14 nt, Human T-lymphotropic virus 1
ucuuaaaacaacug

SEQ ID NO: 4015606 - RNA, 20 nt, Human T-lymphotropic virus 1
ucuuaaaacaacugccccau

SEQ ID NO: 4015607 - RNA, 14 nt, Human T-lymphotropic virus 1
ucuuauaaacccug

SEQ ID NO: 4015608 - RNA, 15 nt, Human T-lymphotropic virus 1
ugacauucuccuggc

SEQ ID NO: 4015609 - RNA, 18 nt, Human T-lymphotropic virus 1
aaaaagaccaccaacacc

SEQ ID NO: 4015610 - RNA, 12 nt, Human T-lymphotropic virus 1
aaaacggccucc

SEQ ID NO: 4015611 - RNA, 16 nt, Human T-lymphotropic virus 1
aaacaucgaaacagcc

SEQ ID NO: 4015612 - RNA, 18 nt, Human T-lymphotropic virus 1
aaacccugagucaucccu

SEQ ID NO: 4015613 - RNA, 13 nt, Human T-lymphotropic virus 1
aaauauuacuaau

SEQ ID NO: 4015614 - RNA, 15 nt, Human T-lymphotropic virus 1
aaauccuccuucucc

SEQ ID NO: 4015615 - RNA, 23 nt, Human T-lymphotropic virus 1
aacacagacaauggcccugccua

SEQ ID NO: 4015616 - RNA, 20 nt, Human T-lymphotropic virus 1
aaccaacugccacaaaaccc

SEQ ID NO: 4015617 - RNA, 19 nt, Human T-lymphotropic virus 1
aaccacccauuuccucccc

SEQ ID NO: 4015618 - RNA, 12 nt, Human T-lymphotropic virus 1
aaccccucaccu

SEQ ID NO: 4015619 - RNA, 19 nt, Human T-lymphotropic virus 1
aacccugcaauccugccca

SEQ ID NO: 4015620 - RNA, 15 nt, Human T-lymphotropic virus 1
aacccugccccuccu

SEQ ID NO: 4015621 - RNA, 16 nt, Human T-lymphotropic virus 1
aacccugccccuccua

SEQ ID NO: 4015622 - RNA, 19 nt, Human T-lymphotropic virus 1
aacucccucauccugcccc

SEQ ID NO: 4015623 - RNA, 18 nt, Human T-lymphotropic virus 1
aacuccuaccuuacgcca

SEQ ID NO: 4015624 - RNA, 12 nt, Human T-lymphotropic virus 1
aagaagcugccg

SEQ ID NO: 4015625 - RNA, 14 nt, Human T-lymphotropic virus 1
aagcccuuaugcca

SEQ ID NO: 4015626 - RNA, 22 nt, Human T-lymphotropic virus 1
aagccuagcuacauaaacacag

SEQ ID NO: 4015627 - RNA, 12 nt, Human T-lymphotropic virus 1
aagcucaccucc

SEQ ID NO: 4015628 - RNA, 23 nt, Human T-lymphotropic virus 1
aagcucuacuagauacaggagca

SEQ ID NO: 4015629 - RNA, 17 nt, Human T-lymphotropic virus 1
aaggcagguccucucag

SEQ ID NO: 4015630 - RNA, 13 nt, Human T-lymphotropic virus 1
aauaacccacaac

SEQ ID NO: 4015631 - RNA, 21 nt, Human T-lymphotropic virus 1
aauauccugcgcucuugccac

SEQ ID NO: 4015632 - RNA, 15 nt, Human T-lymphotropic virus 1
acaaagauauuuccc

SEQ ID NO: 4015633 - RNA, 14 nt, Human T-lymphotropic virus 1
acacaguuucaccc

SEQ ID NO: 4015634 - RNA, 19 nt, Human T-lymphotropic virus 1
acacuuuucuuaaaacaac

SEQ ID NO: 4015635 - RNA, 13 nt, Human T-lymphotropic virus 1
acagccccagcug

SEQ ID NO: 4015636 - RNA, 15 nt, Human T-lymphotropic virus 1
acagccccagcugcu

SEQ ID NO: 4015637 - RNA, 16 nt, Human T-lymphotropic virus 1
acagccccagcugcug

SEQ ID NO: 4015638 - RNA, 20 nt, Human T-lymphotropic virus 1
acaggagccgucuccagccc

SEQ ID NO: 4015639 - RNA, 18 nt, Human T-lymphotropic virus 1
acaucgccuccagccucc

SEQ ID NO: 4015640 - RNA, 12 nt, Human T-lymphotropic virus 1
accaaaaacaac

SEQ ID NO: 4015641 - RNA, 23 nt, Human T-lymphotropic virus 1
accaaucuaccugaucccaucuc

SEQ ID NO: 4015642 - RNA, 19 nt, Human T-lymphotropic virus 1
accacaucgccuccagccu

SEQ ID NO: 4015643 - RNA, 13 nt, Human T-lymphotropic virus 1
accagcucaggcu

SEQ ID NO: 4015644 - RNA, 21 nt, Human T-lymphotropic virus 1
accagcuuuccccccccauca

SEQ ID NO: 4015645 - RNA, 13 nt, Human T-lymphotropic virus 1
accaugccaccua

SEQ ID NO: 4015646 - RNA, 20 nt, Human T-lymphotropic virus 1
accaugccaccuauucccua

SEQ ID NO: 4015647 - RNA, 21 nt, Human T-lymphotropic virus 1
acccacccuugggcagcaccu

SEQ ID NO: 4015648 - RNA, 16 nt, Human T-lymphotropic virus 1
acccagccaacugccu

SEQ ID NO: 4015649 - RNA, 18 nt, Human T-lymphotropic virus 1
accccaucugguuccuua

SEQ ID NO: 4015650 - RNA, 22 nt, Human T-lymphotropic virus 1
acccccaacauuccacccuccu

SEQ ID NO: 4015651 - RNA, 15 nt, Human T-lymphotropic virus 1
accccggccagcucg

SEQ ID NO: 4015652 - RNA, 23 nt, Human T-lymphotropic virus 1
accccuguccugcagcucucucc

SEQ ID NO: 4015653 - RNA, 18 nt, Human T-lymphotropic virus 1
acccucaccacuccaggc

SEQ ID NO: 4015654 - RNA, 20 nt, Human T-lymphotropic virus 1
acccucaccacuccaggccu

SEQ ID NO: 4015655 - RNA, 14 nt, Human T-lymphotropic virus 1
acccugcccuaauc

SEQ ID NO: 4015656 - RNA, 22 nt, Human T-lymphotropic virus 1
acccuguucgaaaugcagcugg

SEQ ID NO: 4015657 - RNA, 19 nt, Human T-lymphotropic virus 1
acccuuaagguccuuaccc

SEQ ID NO: 4015658 - RNA, 14 nt, Human T-lymphotropic virus 1
acccuuuuccagcc

SEQ ID NO: 4015659 - RNA, 14 nt, Human T-lymphotropic virus 1
accgccccuccucu

SEQ ID NO: 4015660 - RNA, 22 nt, Human T-lymphotropic virus 1
accggcuccaugucccucgccu

SEQ ID NO: 4015661 - RNA, 22 nt, Human T-lymphotropic virus 1
accucuaccagcuuuccccccc

SEQ ID NO: 4015662 - RNA, 16 nt, Human T-lymphotropic virus 1
accugaucccaucucc

SEQ ID NO: 4015663 - RNA, 17 nt, Human T-lymphotropic virus 1
accugaucccaucucca

SEQ ID NO: 4015664 - RNA, 17 nt, Human T-lymphotropic virus 1
accugcaacuacucuca

SEQ ID NO: 4015665 - RNA, 18 nt, Human T-lymphotropic virus 1
accugcaacuacucucag

SEQ ID NO: 4015666 - RNA, 14 nt, Human T-lymphotropic virus 1
accugcgggccacu

SEQ ID NO: 4015667 - RNA, 23 nt, Human T-lymphotropic virus 1
accugcgggccacuaacucucua

SEQ ID NO: 4015668 - RNA, 20 nt, Human T-lymphotropic virus 1
accuggccccuccugcccca

SEQ ID NO: 4015669 - RNA, 15 nt, Human T-lymphotropic virus 1
accugggaccccauc

SEQ ID NO: 4015670 - RNA, 13 nt, Human T-lymphotropic virus 1
accuuggccucuc

SEQ ID NO: 4015671 - RNA, 16 nt, Human T-lymphotropic virus 1
acgaugcguuuccccg

SEQ ID NO: 4015672 - RNA, 19 nt, Human T-lymphotropic virus 1
acgcccuacuggccaccug

SEQ ID NO: 4015673 - RNA, 20 nt, Human T-lymphotropic virus 1
acuacaagagagaccccccc

SEQ ID NO: 4015674 - RNA, 15 nt, Human T-lymphotropic virus 1
acucaacccucacca

SEQ ID NO: 4015675 - RNA, 16 nt, Human T-lymphotropic virus 1
acucagccggcucucc

SEQ ID NO: 4015676 - RNA, 13 nt, Human T-lymphotropic virus 1
acuccaccucgcc

SEQ ID NO: 4015677 - RNA, 17 nt, Human T-lymphotropic virus 1
acuccaccucgccuucc

SEQ ID NO: 4015678 - RNA, 18 nt, Human T-lymphotropic virus 1
acuccaccucgccuucca

SEQ ID NO: 4015679 - RNA, 12 nt, Human T-lymphotropic virus 1
acuccaggccuu

SEQ ID NO: 4015680 - RNA, 18 nt, Human T-lymphotropic virus 1
acuccccccgacuccagc

SEQ ID NO: 4015681 - RNA, 13 nt, Human T-lymphotropic virus 1
acuccccuccuuc

SEQ ID NO: 4015682 - RNA, 15 nt, Human T-lymphotropic virus 1
acucccucauccugc

SEQ ID NO: 4015683 - RNA, 18 nt, Human T-lymphotropic virus 1
acuggcaccaccacugug

SEQ ID NO: 4015684 - RNA, 18 nt, Human T-lymphotropic virus 1
acuuuaagcucaccuccc

SEQ ID NO: 4015685 - RNA, 13 nt, Human T-lymphotropic virus 1
agaacugccgcag

SEQ ID NO: 4015686 - RNA, 19 nt, Human T-lymphotropic virus 1
agacaaaucauaagcucag

SEQ ID NO: 4015687 - RNA, 16 nt, Human T-lymphotropic virus 1
agacacauucccucag

SEQ ID NO: 4015688 - RNA, 17 nt, Human T-lymphotropic virus 1
agaccccggacuccggc

SEQ ID NO: 4015689 - RNA, 17 nt, Human T-lymphotropic virus 1
agacccuuguuccuuaa

SEQ ID NO: 4015690 - RNA, 18 nt, Human T-lymphotropic virus 1
agacuaguccaaacccug

SEQ ID NO: 4015691 - RNA, 16 nt, Human T-lymphotropic virus 1
agagccuccuacauga

SEQ ID NO: 4015692 - RNA, 13 nt, Human T-lymphotropic virus 1
agaguacuacccc

SEQ ID NO: 4015693 - RNA, 23 nt, Human T-lymphotropic virus 1
agaucacuuuaagcucaccuccc

SEQ ID NO: 4015694 - RNA, 13 nt, Human T-lymphotropic virus 1
agaucaggcccua

SEQ ID NO: 4015695 - RNA, 23 nt, Human T-lymphotropic virus 1
agaucauucccccuuccgccacc

SEQ ID NO: 4015696 - RNA, 13 nt, Human T-lymphotropic virus 1
agcaaccuccucc

SEQ ID NO: 4015697 - RNA, 22 nt, Human T-lymphotropic virus 1
agcagaucaggcccuacagcca

SEQ ID NO: 4015698 - RNA, 11 nt, Human T-lymphotropic virus 1
agccccagcug

SEQ ID NO: 4015699 - RNA, 13 nt, Human T-lymphotropic virus 1
agccgccagugga

SEQ ID NO: 4015700 - RNA, 17 nt, Human T-lymphotropic virus 1
agcgcuaguucugccca

SEQ ID NO: 4015701 - RNA, 14 nt, Human T-lymphotropic virus 1
agcgcuuccagccc

SEQ ID NO: 4015702 - RNA, 19 nt, Human T-lymphotropic virus 1
agcgcuuccagccccccac

SEQ ID NO: 4015703 - RNA, 23 nt, Human T-lymphotropic virus 1
agcgcuuccagccccccaccuga

SEQ ID NO: 4015704 - RNA, 22 nt, Human T-lymphotropic virus 1
agcuaccaugccaccuauuccc

SEQ ID NO: 4015705 - RNA, 18 nt, Human T-lymphotropic virus 1
agcucggggccuuccuca

SEQ ID NO: 4015706 - RNA, 17 nt, Human T-lymphotropic virus 1
agcucuacaguuccuua

SEQ ID NO: 4015707 - RNA, 18 nt, Human T-lymphotropic virus 1
agcugcuguacucucaca

SEQ ID NO: 4015708 - RNA, 15 nt, Human T-lymphotropic virus 1
aggcaagccuagcua

SEQ ID NO: 4015709 - RNA, 19 nt, Human T-lymphotropic virus 1
aggcagguccucucaggcc

SEQ ID NO: 4015710 - RNA, 23 nt, Human T-lymphotropic virus 1
aggcagguccucucaggcccccu

SEQ ID NO: 4015711 - RNA, 21 nt, Human T-lymphotropic virus 1
aggccccccgaaaucagccag

SEQ ID NO: 4015712 - RNA, 20 nt, Human T-lymphotropic virus 1
aggcccccuuucaggcccuc

SEQ ID NO: 4015713 - RNA, 18 nt, Human T-lymphotropic virus 1
aggcccuacagccacccu

SEQ ID NO: 4015714 - RNA, 15 nt, Human T-lymphotropic virus 1
aggcgacauuaccca

SEQ ID NO: 4015715 - RNA, 18 nt, Human T-lymphotropic virus 1
aggcucaacgcucucaca

SEQ ID NO: 4015716 - RNA, 21 nt, Human T-lymphotropic virus 1
agggggccaaacccaagauca

SEQ ID NO: 4015717 - RNA, 13 nt, Human T-lymphotropic virus 1
aguacucuuccuu

SEQ ID NO: 4015718 - RNA, 14 nt, Human T-lymphotropic virus 1
aguccaaacccugc

SEQ ID NO: 4015719 - RNA, 20 nt, Human T-lymphotropic virus 1
aguccuuccuaaccaagacc

SEQ ID NO: 4015720 - RNA, 21 nt, Human T-lymphotropic virus 1
agugaaaaacauuuccgugaa

SEQ ID NO: 4015721 - RNA, 21 nt, Human T-lymphotropic virus 1
aguucccuuuaaaccagaacg

SEQ ID NO: 4015722 - RNA, 21 nt, Human T-lymphotropic virus 1
auaccaaaaacaacugggcca

SEQ ID NO: 4015723 - RNA, 14 nt, Human T-lymphotropic virus 1
auaugaccccaucu

SEQ ID NO: 4015724 - RNA, 12 nt, Human T-lymphotropic virus 1
aucaaaaagcca

SEQ ID NO: 4015725 - RNA, 14 nt, Human T-lymphotropic virus 1
aucaaaacuccuga

SEQ ID NO: 4015726 - RNA, 19 nt, Human T-lymphotropic virus 1
aucaacccccaacuccugc

SEQ ID NO: 4015727 - RNA, 14 nt, Human T-lymphotropic virus 1
aucagccaguuccc

SEQ ID NO: 4015728 - RNA, 19 nt, Human T-lymphotropic virus 1
aucaggcccuacagccacc

SEQ ID NO: 4015729 - RNA, 17 nt, Human T-lymphotropic virus 1
aucauggaccugccccu

SEQ ID NO: 4015730 - RNA, 16 nt, Human T-lymphotropic virus 1
aucauuagugcagcug

SEQ ID NO: 4015731 - RNA, 15 nt, Human T-lymphotropic virus 1
aucccucgacucccc

SEQ ID NO: 4015732 - RNA, 21 nt, Human T-lymphotropic virus 1
auccucggugauuacagcccc

SEQ ID NO: 4015733 - RNA, 11 nt, Human T-lymphotropic virus 1
auccugcccag

SEQ ID NO: 4015734 - RNA, 21 nt, Human T-lymphotropic virus 1
auccugcgcucuugccacgcc

SEQ ID NO: 4015735 - RNA, 12 nt, Human T-lymphotropic virus 1
auccuucucaag

SEQ ID NO: 4015736 - RNA, 15 nt, Human T-lymphotropic virus 1
aucgccuccagccuc

SEQ ID NO: 4015737 - RNA, 19 nt, Human T-lymphotropic virus 1
aucgccuccagccuccccu

SEQ ID NO: 4015738 - RNA, 21 nt, Human T-lymphotropic virus 1
aucgucacgcccuacuggcca

SEQ ID NO: 4015739 - RNA, 14 nt, Human T-lymphotropic virus 1
aucgugccagccua

SEQ ID NO: 4015740 - RNA, 14 nt, Human T-lymphotropic virus 1
aucuaggcaagccu

SEQ ID NO: 4015741 - RNA, 13 nt, Human T-lymphotropic virus 1
aucugaccacccc

SEQ ID NO: 4015742 - RNA, 18 nt, Human T-lymphotropic virus 1
gcugggcgcuaccugaac

SEQ ID NO: 4015743 - RNA, 12 nt, Human T-lymphotropic virus 1
gcuucccuaauc

SEQ ID NO: 4015744 - RNA, 17 nt, Human T-lymphotropic virus 1
gcuucccuaaucuccca

SEQ ID NO: 4015745 - RNA, 22 nt, Human T-lymphotropic virus 1
gcuuuccccccuggagggcccc

SEQ ID NO: 4015746 - RNA, 12 nt, Human T-lymphotropic virus 1
ggacccacugcu

SEQ ID NO: 4015747 - RNA, 18 nt, Human T-lymphotropic virus 1
ggaccuuggccucucaca

SEQ ID NO: 4015748 - RNA, 15 nt, Human T-lymphotropic virus 1
ggacuacucugccaa

SEQ ID NO: 4015749 - RNA, 14 nt, Human T-lymphotropic virus 1
ggagccgucuccag

SEQ ID NO: 4015750 - RNA, 19 nt, Human T-lymphotropic virus 1
ggagccuaccuagacucag

SEQ ID NO: 4015751 - RNA, 14 nt, Human T-lymphotropic virus 1
ggaggacagcucag

SEQ ID NO: 4015752 - RNA, 17 nt, Human T-lymphotropic virus 1
ggaggcuauuauucagc

SEQ ID NO: 4015753 - RNA, 17 nt, Human T-lymphotropic virus 1
ggcccauauccugcagc

SEQ ID NO: 4015754 - RNA, 22 nt, Human T-lymphotropic virus 1
ggcccuacagccacccugcccu

SEQ ID NO: 4015755 - RNA, 20 nt, Human T-lymphotropic virus 1
ggcccugacgugucccccua

SEQ ID NO: 4015756 - RNA, 23 nt, Human T-lymphotropic virus 1
ggcccugccuauauuucccaaga

SEQ ID NO: 4015757 - RNA, 17 nt, Human T-lymphotropic virus 1
ggcccuggaggcaggcc

SEQ ID NO: 4015758 - RNA, 20 nt, Human T-lymphotropic virus 1
ggccgcggcuuuccucuucu

SEQ ID NO: 4015759 - RNA, 13 nt, Human T-lymphotropic virus 1
ggccuaccacccc

SEQ ID NO: 4015760 - RNA, 18 nt, Human T-lymphotropic virus 1
ggccuaccaccccucauu

SEQ ID NO: 4015761 - RNA, 19 nt, Human T-lymphotropic virus 1
ggccuccuuccguuccacu

SEQ ID NO: 4015762 - RNA, 12 nt, Human T-lymphotropic virus 1
ggccucuccagc

SEQ ID NO: 4015763 - RNA, 16 nt, Human T-lymphotropic virus 1
ggcgcuuuccccccug

SEQ ID NO: 4015764 - RNA, 23 nt, Human T-lymphotropic virus 1
ggcuucccuaaucucccaugggu

SEQ ID NO: 4015765 - RNA, 15 nt, Human T-lymphotropic virus 1
gggcagcaccuccca

SEQ ID NO: 4015766 - RNA, 12 nt, Human T-lymphotropic virus 1
gggcccugcccu

SEQ ID NO: 4015767 - RNA, 20 nt, Human T-lymphotropic virus 1
gguaaguuuagagcucaggu

SEQ ID NO: 4015768 - RNA, 19 nt, Human T-lymphotropic virus 1
ggucgagaccgggccuuug

SEQ ID NO: 4015769 - RNA, 16 nt, Human T-lymphotropic virus 1
ggugauuacagcccca

SEQ ID NO: 4015770 - RNA, 12 nt, Human T-lymphotropic virus 1
ggugcccagacu

SEQ ID NO: 4015771 - RNA, 10 nt, Human T-lymphotropic virus 1
gguuccuuaa

SEQ ID NO: 4015772 - RNA, 23 nt, Human T-lymphotropic virus 1
gguugagucgcguucugccgccu

SEQ ID NO: 4015773 - RNA, 21 nt, Human T-lymphotropic virus 1
guaagcgcuaguucugcccag

SEQ ID NO: 4015774 - RNA, 17 nt, Human T-lymphotropic virus 1
guaaguuuagagcucag

SEQ ID NO: 4015775 - RNA, 14 nt, Human T-lymphotropic virus 1
guaugcugcccaga

SEQ ID NO: 4015776 - RNA, 18 nt, Human T-lymphotropic virus 1
gucacaaagaucauuccc

SEQ ID NO: 4015777 - RNA, 17 nt, Human T-lymphotropic virus 1
gucacgcugacagccug

SEQ ID NO: 4015778 - RNA, 15 nt, Human T-lymphotropic virus 1
guccccaagguaccu

SEQ ID NO: 4015779 - RNA, 20 nt, Human T-lymphotropic virus 1
guccgaaaacaaaacccagc

SEQ ID NO: 4015780 - RNA, 20 nt, Human T-lymphotropic virus 1
gucuccccccggaggacagc

SEQ ID NO: 4015781 - RNA, 21 nt, Human T-lymphotropic virus 1
gucugagaaggucagggccca

SEQ ID NO: 4015782 - RNA, 16 nt, Human T-lymphotropic virus 1
gucuggcuugucuccg

SEQ ID NO: 4015783 - RNA, 12 nt, Human T-lymphotropic virus 1
gucuuuuccaga

SEQ ID NO: 4015784 - RNA, 17 nt, Human T-lymphotropic virus 1
guuccuaucuuacucca

SEQ ID NO: 4015785 - RNA, 17 nt, Human T-lymphotropic virus 1
guuugcccaccacccuu

SEQ ID NO: 4015786 - RNA, 17 nt, Human T-lymphotropic virus 1
uaaaaauagucccaccc

SEQ ID NO: 4015787 - RNA, 21 nt, Human T-lymphotropic virus 1
uaaaccagaacgccuccaggc

SEQ ID NO: 4015788 - RNA, 22 nt, Human T-lymphotropic virus 1
uaaccaugcuuauuaucagccc

SEQ ID NO: 4015789 - RNA, 15 nt, Human T-lymphotropic virus 1
uaacuggacccacug

SEQ ID NO: 4015790 - RNA, 16 nt, Human T-lymphotropic virus 1
uaagcucaccucccuu

SEQ ID NO: 4015791 - RNA, 17 nt, Human T-lymphotropic virus 1
uaauaccgaacccagcc

SEQ ID NO: 4015792 - RNA, 18 nt, Human T-lymphotropic virus 1
uacaacaaugccaaggcg

SEQ ID NO: 4015793 - RNA, 18 nt, Human T-lymphotropic virus 1
uacaggcgccagcugucc

SEQ ID NO: 4015794 - RNA, 23 nt, Human T-lymphotropic virus 1
uacaugccccccuaccccacacu

SEQ ID NO: 4015795 - RNA, 21 nt, Human T-lymphotropic virus 1
uaccaccccucauuucuacuc

SEQ ID NO: 4015796 - RNA, 19 nt, Human T-lymphotropic virus 1
uaccuaaacaguuccagcc

SEQ ID NO: 4015797 - RNA, 15 nt, Human T-lymphotropic virus 1
uaccucccugaggca

SEQ ID NO: 4015798 - RNA, 16 nt, Human T-lymphotropic virus 1
uagccagugccccugg

SEQ ID NO: 4015799 - RNA, 17 nt, Human T-lymphotropic virus 1
uagccagugccccuggg

SEQ ID NO: 4015800 - RNA, 15 nt, Human T-lymphotropic virus 1
uaguacuacaguccu

SEQ ID NO: 4015801 - RNA, 19 nt, Human T-lymphotropic virus 1
uaguacuacaguccuccuc

SEQ ID NO: 4015802 - RNA, 17 nt, Human T-lymphotropic virus 1
ucaacccccaacuccug

SEQ ID NO: 4015803 - RNA, 22 nt, Human T-lymphotropic virus 1
ucacaaauuucaaaccaaggcc

SEQ ID NO: 4015804 - RNA, 16 nt, Human T-lymphotropic virus 1
ucaccucccuuccugu

SEQ ID NO: 4015805 - RNA, 21 nt, Human T-lymphotropic virus 1
ucacgcccuacuggccaccug

SEQ ID NO: 4015806 - RNA, 12 nt, Human T-lymphotropic virus 1
ucagcaccagcu

SEQ ID NO: 4015807 - RNA, 13 nt, Human T-lymphotropic virus 1
ucagcaccagcuc

SEQ ID NO: 4015808 - RNA, 13 nt, Human T-lymphotropic virus 1
ucagccuccaagg

SEQ ID NO: 4015809 - RNA, 20 nt, Human T-lymphotropic virus 1
ucagccucuuauucagaccc

SEQ ID NO: 4015810 - RNA, 13 nt, Human T-lymphotropic virus 1
ucaggagccaucu

SEQ ID NO: 4015811 - RNA, 22 nt, Human T-lymphotropic virus 1
ucaggcccccuuucaggcccuc

SEQ ID NO: 4015812 - RNA, 22 nt, Human T-lymphotropic virus 1
ucauaacaucuccacccaaacc

SEQ ID NO: 4015813 - RNA, 16 nt, Human T-lymphotropic virus 1
ucauccugccccccuu

SEQ ID NO: 4015814 - RNA, 22 nt, Human T-lymphotropic virus 1
ucaucuucccccgggcccccug

SEQ ID NO: 4015815 - RNA, 15 nt, Human T-lymphotropic virus 1
ucauggacccucgac

SEQ ID NO: 4015816 - RNA, 13 nt, Human T-lymphotropic virus 1
ucauucccccuuc

SEQ ID NO: 4015817 - RNA, 20 nt, Human T-lymphotropic virus 1
ucauucccccuuccgccacc

SEQ ID NO: 4015818 - RNA, 16 nt, Human T-lymphotropic virus 1
ucauuucuacucucac

SEQ ID NO: 4015819 - RNA, 21 nt, Human T-lymphotropic virus 1
uccaaacccugccccuccuag

SEQ ID NO: 4015820 - RNA, 15 nt, Human T-lymphotropic virus 1
uccaaaucccccuac

SEQ ID NO: 4015821 - RNA, 17 nt, Human T-lymphotropic virus 1
uccaccaauuccuccac

SEQ ID NO: 4015822 - RNA, 17 nt, Human T-lymphotropic virus 1
uccacccuccuuccucc

SEQ ID NO: 4015823 - RNA, 19 nt, Human T-lymphotropic virus 1
uccacccuccuuccuccag

SEQ ID NO: 4015824 - RNA, 21 nt, Human T-lymphotropic virus 1
uccacccuccuuccuccaggc

SEQ ID NO: 4015825 - RNA, 16 nt, Human T-lymphotropic virus 1
uccaccucgccuucca

SEQ ID NO: 4015826 - RNA, 21 nt, Human T-lymphotropic virus 1
uccaggauaugaccccaucug

SEQ ID NO: 4015827 - RNA, 17 nt, Human T-lymphotropic virus 1
uccauccccuucuucua

SEQ ID NO: 4015828 - RNA, 19 nt, Human T-lymphotropic virus 1
uccaugucccucgccucag

SEQ ID NO: 4015829 - RNA, 22 nt, Human T-lymphotropic virus 1
ucccaacgucucuguuccaucc

SEQ ID NO: 4015830 - RNA, 15 nt, Human T-lymphotropic virus 1
ucccaaggccccccg

SEQ ID NO: 4015831 - RNA, 20 nt, Human T-lymphotropic virus 1
uccccuccuuccccacccag

SEQ ID NO: 4015832 - RNA, 18 nt, Human T-lymphotropic virus 1
uccgcccuggccauggga

SEQ ID NO: 4015833 - RNA, 20 nt, Human T-lymphotropic virus 1
uccuaccuuacgccagcccc

SEQ ID NO: 4015834 - RNA, 16 nt, Human T-lymphotropic virus 1
uccuauacucucccaa

SEQ ID NO: 4015835 - RNA, 13 nt, Human T-lymphotropic virus 1
uccuccuccuuua

SEQ ID NO: 4015836 - RNA, 20 nt, Human T-lymphotropic virus 1
uccuccuuguccuuuaacuc

SEQ ID NO: 4015837 - RNA, 14 nt, Human T-lymphotropic virus 1
uccucgagcccucu

SEQ ID NO: 4015838 - RNA, 17 nt, Human T-lymphotropic virus 1
uccucucaggcccccuu

SEQ ID NO: 4015839 - RNA, 14 nt, Human T-lymphotropic virus 1
uccucuucuccuca

SEQ ID NO: 4015840 - RNA, 15 nt, Human T-lymphotropic virus 1
uccucuucuccucag

SEQ ID NO: 4015841 - RNA, 19 nt, Human T-lymphotropic virus 1
uccugcagcaaccuccucc

SEQ ID NO: 4015842 - RNA, 17 nt, Human T-lymphotropic virus 1
uccugcagcucucuccu

SEQ ID NO: 4015843 - RNA, 20 nt, Human T-lymphotropic virus 1
uccugugcuaauacgccucc

SEQ ID NO: 4015844 - RNA, 12 nt, Human T-lymphotropic virus 1
uccuuccuccag

SEQ ID NO: 4015845 - RNA, 14 nt, Human T-lymphotropic virus 1
uccuucucccuucu

SEQ ID NO: 4015846 - RNA, 12 nt, Human T-lymphotropic virus 1
uccuucuccugc

SEQ ID NO: 4015847 - RNA, 17 nt, Human T-lymphotropic virus 1
uccuugucaccuguucc

SEQ ID NO: 4015848 - RNA, 15 nt, Human T-lymphotropic virus 1
ucgacaaauacaccu

SEQ ID NO: 4015849 - RNA, 17 nt, Human T-lymphotropic virus 1
ucgaccugcuggcccuu

SEQ ID NO: 4015850 - RNA, 13 nt, Human T-lymphotropic virus 1
ucgagcccucuau

SEQ ID NO: 4015851 - RNA, 21 nt, Human T-lymphotropic virus 1
ucgccucaggaaagagccucc

SEQ ID NO: 4015852 - RNA, 16 nt, Human T-lymphotropic virus 1
ucgccuccagccuccc

SEQ ID NO: 4015853 - RNA, 12 nt, Human T-lymphotropic virus 1
ucgcuuccucuu

SEQ ID NO: 4015854 - RNA, 19 nt, Human T-lymphotropic virus 1
ucguuagcgcuuccagccc

SEQ ID NO: 4015855 - RNA, 21 nt, Human T-lymphotropic virus 1
ucguuagcgcuuccagccccc

SEQ ID NO: 4015856 - RNA, 18 nt, Human T-lymphotropic virus 1
ucuaccugaucccaucuc

SEQ ID NO: 4015857 - RNA, 20 nt, Human T-lymphotropic virus 1
ucuaguaaguuacuccagcu

SEQ ID NO: 4015858 - RNA, 23 nt, Human T-lymphotropic virus 1
ucucacaguuggagucuccucau

SEQ ID NO: 4015859 - RNA, 15 nt, Human T-lymphotropic virus 1
ucugagaaggucagg

SEQ ID NO: 4015860 - RNA, 14 nt, Human T-lymphotropic virus 1
ucugccgccucccg

SEQ ID NO: 4015861 - RNA, 17 nt, Human T-lymphotropic virus 1
ucugcuuuuccuccucu

SEQ ID NO: 4015862 - RNA, 13 nt, Human T-lymphotropic virus 1
ucuguuccauccc

SEQ ID NO: 4015863 - RNA, 20 nt, Human T-lymphotropic virus 1
ucuuccugcuuucuccgggc

SEQ ID NO: 4015864 - RNA, 23 nt, Human T-lymphotropic virus 1
ugaagaauacaccaacaucccca

SEQ ID NO: 4015865 - RNA, 14 nt, Human T-lymphotropic virus 1
ugacauucuccugg

SEQ ID NO: 4015866 - RNA, 18 nt, Human T-lymphotropic virus 1
ugacauucuccuggcaag

SEQ ID NO: 4015867 - RNA, 17 nt, Human T-lymphotropic virus 1
ugacgacaaccccucac

SEQ ID NO: 4015868 - RNA, 14 nt, Human T-lymphotropic virus 1
ugacuuguccagcc

SEQ ID NO: 4015869 - RNA, 15 nt, Human T-lymphotropic virus 1
ugacuuguccagccu

SEQ ID NO: 4015870 - RNA, 12 nt, Human T-lymphotropic virus 1
ugauuacagccc

SEQ ID NO: 4015871 - RNA, 23 nt, Human T-lymphotropic virus 1
ugcagcuggcccauauccugcag

SEQ ID NO: 4015872 - RNA, 18 nt, Human T-lymphotropic virus 1
ugcaggaccaugcauccu

SEQ ID NO: 4015873 - RNA, 17 nt, Human T-lymphotropic virus 1
ugcauccuccgucagcu

SEQ ID NO: 4015874 - RNA, 16 nt, Human T-lymphotropic virus 1
ugcauggccucuccag

SEQ ID NO: 4015875 - RNA, 18 nt, Human T-lymphotropic virus 1
ugccaccccggccagcuc

SEQ ID NO: 4015876 - RNA, 13 nt, Human T-lymphotropic virus 1
ugcccaccacccu

SEQ ID NO: 4015877 - RNA, 23 nt, Human T-lymphotropic virus 1
ugcccaccacccuuuuccagccu

SEQ ID NO: 4015878 - RNA, 15 nt, Human T-lymphotropic virus 1
ugccuauauuuccca

SEQ ID NO: 4015879 - RNA, 22 nt, Human T-lymphotropic virus 1
ugcgcaaauacucccccuuccg

SEQ ID NO: 4015880 - RNA, 12 nt, Human T-lymphotropic virus 1
ugcucuuccugc

SEQ ID NO: 4015881 - RNA, 15 nt, Human T-lymphotropic virus 1
ugcuguacucucaca

SEQ ID NO: 4015882 - RNA, 16 nt, Human T-lymphotropic virus 1
ugcuguacucucacag

SEQ ID NO: 4015883 - RNA, 14 nt, Human T-lymphotropic virus 1
ugcuuuuccuccuc

SEQ ID NO: 4015884 - RNA, 23 nt, Human T-lymphotropic virus 1
uggagccuaccuagacucagccg

SEQ ID NO: 4015885 - RNA, 15 nt, Human T-lymphotropic virus 1
uggaggcuccucaag

SEQ ID NO: 4015886 - RNA, 22 nt, Human T-lymphotropic virus 1
uggcaagccccucccaugcgga

SEQ ID NO: 4015887 - RNA, 16 nt, Human T-lymphotropic virus 1
uggcaccaccacugug

SEQ ID NO: 4015888 - RNA, 17 nt, Human T-lymphotropic virus 1
uggccuacucccuaacc

SEQ ID NO: 4015889 - RNA, 19 nt, Human T-lymphotropic virus 1
ugguccggaaggcccugga

SEQ ID NO: 4015890 - RNA, 19 nt, Human T-lymphotropic virus 1
ugguguuccaguccaagca

SEQ ID NO: 4015891 - RNA, 18 nt, Human T-lymphotropic virus 1
uguauuaaccaacugcca

SEQ ID NO: 4015892 - RNA, 21 nt, Human T-lymphotropic virus 1
ugucacagaacugccgcagua

SEQ ID NO: 4015893 - RNA, 21 nt, Human T-lymphotropic virus 1
uguccuugggcuagaacaccu

SEQ ID NO: 4015894 - RNA, 22 nt, Human T-lymphotropic virus 1
uguccuuuaacucuuccuccaa

SEQ ID NO: 4015895 - RNA, 18 nt, Human T-lymphotropic virus 1
ugucuccgcccuggccau

SEQ ID NO: 4015896 - RNA, 15 nt, Human T-lymphotropic virus 1
uguggugccuccuga

SEQ ID NO: 4015897 - RNA, 17 nt, Human T-lymphotropic virus 1
uguucgaaaugcagcug

SEQ ID NO: 4015898 - RNA, 17 nt, Human T-lymphotropic virus 1
uuaacuggacccacugc

SEQ ID NO: 4015899 - RNA, 17 nt, Human T-lymphotropic virus 1
uuaugcugacccucacu

SEQ ID NO: 4015900 - RNA, 17 nt, Human T-lymphotropic virus 1
uucagacggauccaccu

SEQ ID NO: 4015901 - RNA, 19 nt, Human T-lymphotropic virus 1
uucaggagccaucucagcu

SEQ ID NO: 4015902 - RNA, 11 nt, Human T-lymphotropic virus 1
uucauucaaac

SEQ ID NO: 4015903 - RNA, 18 nt, Human T-lymphotropic virus 1
uuccacucaacccucacc

SEQ ID NO: 4015904 - RNA, 17 nt, Human T-lymphotropic virus 1
uucgcuuccucuucucc

SEQ ID NO: 4015905 - RNA, 19 nt, Human T-lymphotropic virus 1
uucuccuggcaagccccuc

SEQ ID NO: 4015906 - RNA, 16 nt, Human T-lymphotropic virus 1
uugcuuucacuguccc

SEQ ID NO: 4015907 - RNA, 16 nt, Human T-lymphotropic virus 1
uugggcagcaccuccc

SEQ ID NO: 4015908 - RNA, 20 nt, Human T-lymphotropic virus 1
uugucacaaagaucauuccc

SEQ ID NO: 4015909 - RNA, 13 nt, Human T-lymphotropic virus 1
uuucacaccucaa

SEQ ID NO: 4015910 - RNA, 17 nt, Human T-lymphotropic virus 1
uuucgccuucucagccc

SEQ ID NO: 4015911 - RNA, 18 nt, Human T-lymphotropic virus 1
uuugucaagccguccuca

SEQ ID NO: 4015912 - RNA, 22 nt, Human T-lymphotropic virus 1
ccaugcgcaaauacucccccuu

SEQ ID NO: 4015913 - RNA, 21 nt, Human T-lymphotropic virus 1
ccaugcuuauuaucagcccac

SEQ ID NO: 4015914 - RNA, 22 nt, Human T-lymphotropic virus 1
ccauggaaaucaaaacuccuga

SEQ ID NO: 4015915 - RNA, 18 nt, Human T-lymphotropic virus 1
ccauguccccuacaaucc

SEQ ID NO: 4015916 - RNA, 13 nt, Human T-lymphotropic virus 1
cccacuucccagg

SEQ ID NO: 4015917 - RNA, 14 nt, Human T-lymphotropic virus 1
cccacuucccaggg

SEQ ID NO: 4015918 - RNA, 16 nt, Human T-lymphotropic virus 1
cccagaccagccaccc

SEQ ID NO: 4015919 - RNA, 15 nt, Human T-lymphotropic virus 1
cccagagacacauuc

SEQ ID NO: 4015920 - RNA, 23 nt, Human T-lymphotropic virus 1
cccagauugacacccagaccagc

SEQ ID NO: 4015921 - RNA, 18 nt, Human T-lymphotropic virus 1
cccagcaaaccccuggaa

SEQ ID NO: 4015922 - RNA, 17 nt, Human T-lymphotropic virus 1
cccagccaacugccucc

SEQ ID NO: 4015923 - RNA, 21 nt, Human T-lymphotropic virus 1
ccccaaaaccuguacacccuc

SEQ ID NO: 4015924 - RNA, 13 nt, Human T-lymphotropic virus 1
ccccaacauucca

SEQ ID NO: 4015925 - RNA, 19 nt, Human T-lymphotropic virus 1
ccccacacuagccagugcc

SEQ ID NO: 4015926 - RNA, 10 nt, Human T-lymphotropic virus 1
cccccccuug

SEQ ID NO: 4015927 - RNA, 21 nt, Human T-lymphotropic virus 1
cccccuaccuaaacaguucca

SEQ ID NO: 4015928 - RNA, 18 nt, Human T-lymphotropic virus 1
ccccuacaauccaaccag

SEQ ID NO: 4015929 - RNA, 17 nt, Human T-lymphotropic virus 1
ccccuuucaggcccucc

SEQ ID NO: 4015930 - RNA, 14 nt, Human T-lymphotropic virus 1
cccggaggacagcu

SEQ ID NO: 4015931 - RNA, 20 nt, Human T-lymphotropic virus 1
cccgggggcuuagagccucu

SEQ ID NO: 4015932 - RNA, 17 nt, Human T-lymphotropic virus 1
cccguggaggcuccuca

SEQ ID NO: 4015933 - RNA, 19 nt, Human T-lymphotropic virus 1
cccguggaggcuccucaag

SEQ ID NO: 4015934 - RNA, 20 nt, Human T-lymphotropic virus 1
cccuacuaaucaccccuguc

SEQ ID NO: 4015935 - RNA, 16 nt, Human T-lymphotropic virus 1
cccucaaaaacacauc

SEQ ID NO: 4015936 - RNA, 18 nt, Human T-lymphotropic virus 1
cccuccucuacucuccca

SEQ ID NO: 4015937 - RNA, 13 nt, Human T-lymphotropic virus 1
cccucgccucagg

SEQ ID NO: 4015938 - RNA, 21 nt, Human T-lymphotropic virus 1
cccugcaauccugcccagcca

SEQ ID NO: 4015939 - RNA, 14 nt, Human T-lymphotropic virus 1
cccugcuugcucaa

SEQ ID NO: 4015940 - RNA, 17 nt, Human T-lymphotropic virus 1
cccugcuugcucaacuc

SEQ ID NO: 4015941 - RNA, 21 nt, Human T-lymphotropic virus 1
cccugucauaacucccucauc

SEQ ID NO: 4015942 - RNA, 13 nt, Human T-lymphotropic virus 1
cccuguccugcag

SEQ ID NO: 4015943 - RNA, 13 nt, Human T-lymphotropic virus 1
ccgacuccagccg

SEQ ID NO: 4015944 - RNA, 16 nt, Human T-lymphotropic virus 1
ccgauggcagcuucac

SEQ ID NO: 4015945 - RNA, 14 nt, Human T-lymphotropic virus 1
ccgccccuccucua

SEQ ID NO: 4015946 - RNA, 12 nt, Human T-lymphotropic virus 1
ccgcccuggcca

SEQ ID NO: 4015947 - RNA, 23 nt, Human T-lymphotropic virus 1
ccgccuguaaucuugccaauaca

SEQ ID NO: 4015948 - RNA, 21 nt, Human T-lymphotropic virus 1
ccgccuguggugccuccugaa

SEQ ID NO: 4015949 - RNA, 20 nt, Human T-lymphotropic virus 1
ccgccuuaccugaggccgcc

SEQ ID NO: 4015950 - RNA, 14 nt, Human T-lymphotropic virus 1
ccggaggacagcuc

SEQ ID NO: 4015951 - RNA, 12 nt, Human T-lymphotropic virus 1
ccggccagcucg

SEQ ID NO: 4015952 - RNA, 17 nt, Human T-lymphotropic virus 1
ccgucggaggccccgcc

SEQ ID NO: 4015953 - RNA, 12 nt, Human T-lymphotropic virus 1
ccgucuccagcc

SEQ ID NO: 4015954 - RNA, 21 nt, Human T-lymphotropic virus 1
ccuacacaguuucacccauug

SEQ ID NO: 4015955 - RNA, 19 nt, Human T-lymphotropic virus 1
ccuacaccgggccaggaaa

SEQ ID NO: 4015956 - RNA, 12 nt, Human T-lymphotropic virus 1
ccuacagccacc

SEQ ID NO: 4015957 - RNA, 15 nt, Human T-lymphotropic virus 1
ccuaccaccccucau

SEQ ID NO: 4015958 - RNA, 19 nt, Human T-lymphotropic virus 1
ccuacuggccaccugucca

SEQ ID NO: 4015959 - RNA, 12 nt, Human T-lymphotropic virus 1
ccuccagccucc

SEQ ID NO: 4015960 - RNA, 15 nt, Human T-lymphotropic virus 1
ccucccgccuguggu

SEQ ID NO: 4015961 - RNA, 13 nt, Human T-lymphotropic virus 1
ccuccugaacuac

SEQ ID NO: 4015962 - RNA, 13 nt, Human T-lymphotropic virus 1
ccuccugccccgc

SEQ ID NO: 4015963 - RNA, 14 nt, Human T-lymphotropic virus 1
ccuccuuccuccag

SEQ ID NO: 4015964 - RNA, 19 nt, Human T-lymphotropic virus 1
ccucucaggcccccuuuca

SEQ ID NO: 4015965 - RNA, 16 nt, Human T-lymphotropic virus 1
ccugacgugucccccu

SEQ ID NO: 4015966 - RNA, 12 nt, Human T-lymphotropic virus 1
ccugacuugucc

SEQ ID NO: 4015967 - RNA, 15 nt, Human T-lymphotropic virus 1
ccugacuuguccagc

SEQ ID NO: 4015968 - RNA, 22 nt, Human T-lymphotropic virus 1
ccugcccuaaagauggccagcc

SEQ ID NO: 4015969 - RNA, 19 nt, Human T-lymphotropic virus 1
ccuggccccuccugcccca

SEQ ID NO: 4015970 - RNA, 20 nt, Human T-lymphotropic virus 1
ccugucacagaacugccgca

SEQ ID NO: 4015971 - RNA, 19 nt, Human T-lymphotropic virus 1
ccugucauaacucccucau

SEQ ID NO: 4015972 - RNA, 17 nt, Human T-lymphotropic virus 1
ccuguccugcagcucuc

SEQ ID NO: 4015973 - RNA, 22 nt, Human T-lymphotropic virus 1
ccuguccugcagcucucuccug

SEQ ID NO: 4015974 - RNA, 19 nt, Human T-lymphotropic virus 1
ccugugcuaauacgccucc

SEQ ID NO: 4015975 - RNA, 14 nt, Human T-lymphotropic virus 1
ccuuccgccaccgc

SEQ ID NO: 4015976 - RNA, 20 nt, Human T-lymphotropic virus 1
ccuucuagucgacgcuccag

SEQ ID NO: 4015977 - RNA, 14 nt, Human T-lymphotropic virus 1
ccuucuccucuucc

SEQ ID NO: 4015978 - RNA, 15 nt, Human T-lymphotropic virus 1
ccuugcaacacuugg

SEQ ID NO: 4015979 - RNA, 15 nt, Human T-lymphotropic virus 1
ccuugggcagcaccu

SEQ ID NO: 4015980 - RNA, 21 nt, Human T-lymphotropic virus 1
ccuuucauaauuugcaucucc

SEQ ID NO: 4015981 - RNA, 12 nt, Human T-lymphotropic virus 1
cgaacccagcca

SEQ ID NO: 4015982 - RNA, 13 nt, Human T-lymphotropic virus 1
cgacgcuccagga

SEQ ID NO: 4015983 - RNA, 22 nt, Human T-lymphotropic virus 1
cgacuccccuccuuccccaccc

SEQ ID NO: 4015984 - RNA, 15 nt, Human T-lymphotropic virus 1
cgaucgugccagccu

SEQ ID NO: 4015985 - RNA, 14 nt, Human T-lymphotropic virus 1
cgauggcagcuuca

SEQ ID NO: 4015986 - RNA, 20 nt, Human T-lymphotropic virus 1
cgcaaauacucccccuuccg

SEQ ID NO: 4015987 - RNA, 13 nt, Human T-lymphotropic virus 1
cgccuccagccuc

SEQ ID NO: 4015988 - RNA, 17 nt, Human T-lymphotropic virus 1
cgccuguggugccuccu

SEQ ID NO: 4015989 - RNA, 13 nt, Human T-lymphotropic virus 1
cgccuucucagcc

SEQ ID NO: 4015990 - RNA, 14 nt, Human T-lymphotropic virus 1
cgccuucucagccc

SEQ ID NO: 4015991 - RNA, 19 nt, Human T-lymphotropic virus 1
cgcuccugcucuuccugcu

SEQ ID NO: 4015992 - RNA, 18 nt, Human T-lymphotropic virus 1
cgcucuugccacgccugc

SEQ ID NO: 4015993 - RNA, 13 nt, Human T-lymphotropic virus 1
cgcuuccagcccc

SEQ ID NO: 4015994 - RNA, 20 nt, Human T-lymphotropic virus 1
cgcuuccagccccccaccug

SEQ ID NO: 4015995 - RNA, 15 nt, Human T-lymphotropic virus 1
cggaaggcccuggag

SEQ ID NO: 4015996 - RNA, 18 nt, Human T-lymphotropic virus 1
cggacccuugcccuaggc

SEQ ID NO: 4015997 - RNA, 23 nt, Human T-lymphotropic virus 1
cgggcccccugacuuguccagcc

SEQ ID NO: 4015998 - RNA, 17 nt, Human T-lymphotropic virus 1
cggggccuuccucacca

SEQ ID NO: 4015999 - RNA, 18 nt, Human T-lymphotropic virus 1
cggucuggcuugucuccg

SEQ ID NO: 4016000 - RNA, 20 nt, Human T-lymphotropic virus 1
cgucacgcccuacuggccac

SEQ ID NO: 4016001 - RNA, 18 nt, Human T-lymphotropic virus 1
cgucacgcugacagccug

SEQ ID NO: 4016002 - RNA, 16 nt, Human T-lymphotropic virus 1
cguccuauacucuccc

SEQ ID NO: 4016003 - RNA, 15 nt, Human T-lymphotropic virus 1
cgucuccagccccua

SEQ ID NO: 4016004 - RNA, 11 nt, Human T-lymphotropic virus 1
cgugccagccu

SEQ ID NO: 4016005 - RNA, 18 nt, Human T-lymphotropic virus 1
cguucugccgccucccgc

SEQ ID NO: 4016006 - RNA, 19 nt, Human T-lymphotropic virus 1
cuaaacccugcaauccugc

SEQ ID NO: 4016007 - RNA, 18 nt, Human T-lymphotropic virus 1
cuaaucuaguaaguuacu

SEQ ID NO: 4016008 - RNA, 17 nt, Human T-lymphotropic virus 1
cuacacuagcccacuua

SEQ ID NO: 4016009 - RNA, 15 nt, Human T-lymphotropic virus 1
cuacaguccuccucc

SEQ ID NO: 4016010 - RNA, 17 nt, Human T-lymphotropic virus 1
cuacaguccuccuccuu

SEQ ID NO: 4016011 - RNA, 18 nt, Human T-lymphotropic virus 1
cuaccccacacuagccag

SEQ ID NO: 4016012 - RNA, 16 nt, Human T-lymphotropic virus 1
cuaccuagacucagcc

SEQ ID NO: 4016013 - RNA, 15 nt, Human T-lymphotropic virus 1
cuacuggccaccugu

SEQ ID NO: 4016014 - RNA, 12 nt, Human T-lymphotropic virus 1
gcagcaccuccc

SEQ ID NO: 4016015 - RNA, 19 nt, Human T-lymphotropic virus 1
gcagccuauauucucuggg

SEQ ID NO: 4016016 - RNA, 16 nt, Human T-lymphotropic virus 1
gcagcuacuugccuca

SEQ ID NO: 4016017 - RNA, 23 nt, Human T-lymphotropic virus 1
gcagguccucucaggcccccuuu

SEQ ID NO: 4016018 - RNA, 15 nt, Human T-lymphotropic virus 1
gcaucucuccuucac

SEQ ID NO: 4016019 - RNA, 15 nt, Human T-lymphotropic virus 1
gcauguaccucuacc

SEQ ID NO: 4016020 - RNA, 15 nt, Human T-lymphotropic virus 1
gccaccccggccagc

SEQ ID NO: 4016021 - RNA, 15 nt, Human T-lymphotropic virus 1
gccacccugcccuaa

SEQ ID NO: 4016022 - RNA, 21 nt, Human T-lymphotropic virus 1
gccagcucggggccuuccuca

SEQ ID NO: 4016023 - RNA, 23 nt, Human T-lymphotropic virus 1
gccaugcgcaaauacucccccuu

SEQ ID NO: 4016024 - RNA, 21 nt, Human T-lymphotropic virus 1
gcccaccacccuuuuccagcc

SEQ ID NO: 4016025 - RNA, 22 nt, Human T-lymphotropic virus 1
gcccaccacccuuuuccagccu

SEQ ID NO: 4016026 - RNA, 23 nt, Human T-lymphotropic virus 1
gcccaccacccuuuuccagccug

SEQ ID NO: 4016027 - RNA, 18 nt, Human T-lymphotropic virus 1
gcccauauccugcagccc

SEQ ID NO: 4016028 - RNA, 19 nt, Human T-lymphotropic virus 1
gccccauuggcuccuguga

SEQ ID NO: 4016029 - RNA, 22 nt, Human T-lymphotropic virus 1
gccccccuuuuccuugucaccu

SEQ ID NO: 4016030 - RNA, 12 nt, Human T-lymphotropic virus 1
gcccccucaucc

SEQ ID NO: 4016031 - RNA, 17 nt, Human T-lymphotropic virus 1
gccccuauacaggagcc

SEQ ID NO: 4016032 - RNA, 14 nt, Human T-lymphotropic virus 1
gcccgcuuccugcg

SEQ ID NO: 4016033 - RNA, 22 nt, Human T-lymphotropic virus 1
gcccugucacagaacugccgca

SEQ ID NO: 4016034 - RNA, 21 nt, Human T-lymphotropic virus 1
gcccuuucagcagaucaggcc

SEQ ID NO: 4016035 - RNA, 23 nt, Human T-lymphotropic virus 1
gcccuuucagcagaucaggcccu

SEQ ID NO: 4016036 - RNA, 15 nt, Human T-lymphotropic virus 1
gccgccauccacgcc

SEQ ID NO: 4016037 - RNA, 20 nt, Human T-lymphotropic virus 1
gccgccuuaccugaggccgc

SEQ ID NO: 4016038 - RNA, 21 nt, Human T-lymphotropic virus 1
gccgccuuaccugaggccgcc

SEQ ID NO: 4016039 - RNA, 18 nt, Human T-lymphotropic virus 1
gccuaccuagacucagcc

SEQ ID NO: 4016040 - RNA, 21 nt, Human T-lymphotropic virus 1
gccucaggaaagagccuccua

SEQ ID NO: 4016041 - RNA, 14 nt, Human T-lymphotropic virus 1
gccuccagccuccc

SEQ ID NO: 4016042 - RNA, 14 nt, Human T-lymphotropic virus 1
gccuccaggccuug

SEQ ID NO: 4016043 - RNA, 17 nt, Human T-lymphotropic virus 1
gccugacccugcuugcu

SEQ ID NO: 4016044 - RNA, 21 nt, Human T-lymphotropic virus 1
gccuggcaaaacggccuccuu

SEQ ID NO: 4016045 - RNA, 23 nt, Human T-lymphotropic virus 1
gccuggcaaaacggccuccuucc

SEQ ID NO: 4016046 - RNA, 13 nt, Human T-lymphotropic virus 1
gccuucucagccc

SEQ ID NO: 4016047 - RNA, 15 nt, Human T-lymphotropic virus 1
gccuucuccucuucc

SEQ ID NO: 4016048 - RNA, 23 nt, Human T-lymphotropic virus 1
gcgagguggcgcuuuccccccug

SEQ ID NO: 4016049 - RNA, 18 nt, Human T-lymphotropic virus 1
gcgcaaauacucccccuu

SEQ ID NO: 4016050 - RNA, 14 nt, Human T-lymphotropic virus 1
gcgccagcuguccu

SEQ ID NO: 4016051 - RNA, 14 nt, Human T-lymphotropic virus 1
gcgccgugccuucu

SEQ ID NO: 4016052 - RNA, 17 nt, Human T-lymphotropic virus 1
gcgcuccugcucuuccu

SEQ ID NO: 4016053 - RNA, 20 nt, Human T-lymphotropic virus 1
gcgcuccugcucuuccugcu

SEQ ID NO: 4016054 - RNA, 12 nt, Human T-lymphotropic virus 1
gcgcucuugcca

SEQ ID NO: 4016055 - RNA, 12 nt, Human T-lymphotropic virus 1
gcgcuuccagcc

SEQ ID NO: 4016056 - RNA, 13 nt, Human T-lymphotropic virus 1
gcggcaggcccug

SEQ ID NO: 4016057 - RNA, 15 nt, Human T-lymphotropic virus 1
gcggcuuuccucuuc

SEQ ID NO: 4016058 - RNA, 20 nt, Human T-lymphotropic virus 1
gcuaggaucccgcucccgcc

SEQ ID NO: 4016059 - RNA, 19 nt, Human T-lymphotropic virus 1
gcucagcaccagcucaggc

SEQ ID NO: 4016060 - RNA, 12 nt, Human T-lymphotropic virus 1
gcuccaggccau

SEQ ID NO: 4016061 - RNA, 19 nt, Human T-lymphotropic virus 1
gcuccaugucccucgccuc

SEQ ID NO: 4016062 - RNA, 17 nt, Human T-lymphotropic virus 1
gcucgcaucucuccuuc

SEQ ID NO: 4016063 - RNA, 18 nt, Human T-lymphotropic virus 1
gcucuuccugcuuucucc

SEQ ID NO: 4016064 - RNA, 16 nt, Human T-lymphotropic virus 1
gcugggcgcuaccuga

SEQ ID NO: 4016065 - RNA, 18 nt, Human T-lymphotropic virus 1
gcuggggccuuaacuggg

SEQ ID NO: 4016066 - RNA, 12 nt, Human T-lymphotropic virus 1
gcuuccagcccc

SEQ ID NO: 4016067 - RNA, 12 nt, Human T-lymphotropic virus 1
gcuuccucuucu

SEQ ID NO: 4016068 - RNA, 18 nt, Human T-lymphotropic virus 1
gcuuccucuucuccucag

SEQ ID NO: 4016069 - RNA, 21 nt, Human T-lymphotropic virus 1
gcuuccucuucuccucagccc

SEQ ID NO: 4016070 - RNA, 13 nt, Human T-lymphotropic virus 1
ggacagcucagca

SEQ ID NO: 4016071 - RNA, 22 nt, Human T-lymphotropic virus 1
ggacccacugcuuugaccccca

SEQ ID NO: 4016072 - RNA, 14 nt, Human T-lymphotropic virus 1
ggagccaucucagc

SEQ ID NO: 4016073 - RNA, 15 nt, Human T-lymphotropic virus 1
ggaggacagcucagc

SEQ ID NO: 4016074 - RNA, 17 nt, Human T-lymphotropic virus 1
ggaugacauucuccugg

SEQ ID NO: 4016075 - RNA, 17 nt, Human T-lymphotropic virus 1
ggcaagccuucccccaa

SEQ ID NO: 4016076 - RNA, 23 nt, Human T-lymphotropic virus 1
ggcacccgucacgcugacagccu

SEQ ID NO: 4016077 - RNA, 23 nt, Human T-lymphotropic virus 1
ggccacaauggcuucccuaaucu

SEQ ID NO: 4016078 - RNA, 19 nt, Human T-lymphotropic virus 1
ggccaggaaauaacccagu

SEQ ID NO: 4016079 - RNA, 19 nt, Human T-lymphotropic virus 1
ggcccagaauaaggcucug

SEQ ID NO: 4016080 - RNA, 20 nt, Human T-lymphotropic virus 1
ggccccccgaaaucagccag

SEQ ID NO: 4016081 - RNA, 19 nt, Human T-lymphotropic virus 1
ggcccuggaggcaggccau

SEQ ID NO: 4016082 - RNA, 21 nt, Human T-lymphotropic virus 1
ggcgcucccuuggagccuacc

SEQ ID NO: 4016083 - RNA, 17 nt, Human T-lymphotropic virus 1
ggcuacaugccccccua

SEQ ID NO: 4016084 - RNA, 18 nt, Human T-lymphotropic virus 1
ggcucuccacgcuuugcc

SEQ ID NO: 4016085 - RNA, 18 nt, Human T-lymphotropic virus 1
gggcuagaacaccuccca

SEQ ID NO: 4016086 - RNA, 21 nt, Human T-lymphotropic virus 1
ggggacuauguucggcccgcc

SEQ ID NO: 4016087 - RNA, 18 nt, Human T-lymphotropic virus 1
ggggccuuaacugggacc

SEQ ID NO: 4016088 - RNA, 16 nt, Human T-lymphotropic virus 1
guaaguuacuccagcu

SEQ ID NO: 4016089 - RNA, 23 nt, Human T-lymphotropic virus 1
guaccuauacggucccgcugggc

SEQ ID NO: 4016090 - RNA, 20 nt, Human T-lymphotropic virus 1
gucaagccguccucaggcgu

SEQ ID NO: 4016091 - RNA, 23 nt, Human T-lymphotropic virus 1
gucacaaagaucauucccccuuc

SEQ ID NO: 4016092 - RNA, 18 nt, Human T-lymphotropic virus 1
gucacagaacugccgcag

SEQ ID NO: 4016093 - RNA, 15 nt, Human T-lymphotropic virus 1
gucaccgauucaaaa

SEQ ID NO: 4016094 - RNA, 18 nt, Human T-lymphotropic virus 1
gucauaacucccucaucc

SEQ ID NO: 4016095 - RNA, 12 nt, Human T-lymphotropic virus 1
guccaaacccug

SEQ ID NO: 4016096 - RNA, 18 nt, Human T-lymphotropic virus 1
guccugacuggcuggggc

SEQ ID NO: 4016097 - RNA, 19 nt, Human T-lymphotropic virus 1
guccuuuaacucuuccucc

SEQ ID NO: 4016098 - RNA, 21 nt, Human T-lymphotropic virus 1
gucggcccaacgggccgaacu

SEQ ID NO: 4016099 - RNA, 11 nt, Human T-lymphotropic virus 1
gucuccucccc

SEQ ID NO: 4016100 - RNA, 16 nt, Human T-lymphotropic virus 1
gucucuacugugccuu

SEQ ID NO: 4016101 - RNA, 18 nt, Human T-lymphotropic virus 1
gucugcauguaccucuac

SEQ ID NO: 4016102 - RNA, 16 nt, Human T-lymphotropic virus 1
gugaucauaaacaccg

SEQ ID NO: 4016103 - RNA, 19 nt, Human T-lymphotropic virus 1
gugauuacagccccagcug

SEQ ID NO: 4016104 - RNA, 21 nt, Human T-lymphotropic virus 1
guucucaaguaauacuccccu

SEQ ID NO: 4016105 - RNA, 12 nt, Human T-lymphotropic virus 1
guucugcccagu

SEQ ID NO: 4016106 - RNA, 18 nt, Human T-lymphotropic virus 1
guuucgccuucucagccc

SEQ ID NO: 4016107 - RNA, 15 nt, Human T-lymphotropic virus 1
uaaaaugcccauacc

SEQ ID NO: 4016108 - RNA, 22 nt, Human T-lymphotropic virus 1
uaaagacaaaucauaagcucag

SEQ ID NO: 4016109 - RNA, 13 nt, Human T-lymphotropic virus 1
uaaccucucccau

SEQ ID NO: 4016110 - RNA, 20 nt, Human T-lymphotropic virus 1
uaacucccucauccugcccc

SEQ ID NO: 4016111 - RNA, 16 nt, Human T-lymphotropic virus 1
uaacuggacccacugc

SEQ ID NO: 4016112 - RNA, 15 nt, Human T-lymphotropic virus 1
uaaggcucugacguc

SEQ ID NO: 4016113 - RNA, 16 nt, Human T-lymphotropic virus 1
uacaauccaaccagcu

SEQ ID NO: 4016114 - RNA, 18 nt, Human T-lymphotropic virus 1
uacaauccaaccagcucc

SEQ ID NO: 4016115 - RNA, 19 nt, Human T-lymphotropic virus 1
uggacaaagauauuuccca

SEQ ID NO: 4016116 - RNA, 14 nt, Human T-lymphotropic virus 1
uggaggcaggccau

SEQ ID NO: 4016117 - RNA, 24 nt, Human T-lymphotropic virus 1
uggaucccguggaggcuccucaag

SEQ ID NO: 4016118 - RNA, 17 nt, Human T-lymphotropic virus 1
uggcaagccccucccau

SEQ ID NO: 4016119 - RNA, 15 nt, Human T-lymphotropic virus 1
uggcccauauccugc

SEQ ID NO: 4016120 - RNA, 21 nt, Human T-lymphotropic virus 1
uggcccugccuauauuuccca

SEQ ID NO: 4016121 - RNA, 12 nt, Human T-lymphotropic virus 1
uggccucuccag

SEQ ID NO: 4016122 - RNA, 15 nt, Human T-lymphotropic virus 1
ugggaccuuggccuc

SEQ ID NO: 4016123 - RNA, 19 nt, Human T-lymphotropic virus 1
uggggccuuaacugggacc

SEQ ID NO: 4016124 - RNA, 18 nt, Human T-lymphotropic virus 1
ugguguuccaguccaagc

SEQ ID NO: 4016125 - RNA, 19 nt, Human T-lymphotropic virus 1
uguccccuacaauccaacc

SEQ ID NO: 4016126 - RNA, 16 nt, Human T-lymphotropic virus 1
ugucuccgcccuggcc

SEQ ID NO: 4016127 - RNA, 12 nt, Human T-lymphotropic virus 1
ugugaaagcccu

SEQ ID NO: 4016128 - RNA, 13 nt, Human T-lymphotropic virus 1
uguuccuuaaaau

SEQ ID NO: 4016129 - RNA, 22 nt, Human T-lymphotropic virus 1
uguucucaaguaauacuccccu

SEQ ID NO: 4016130 - RNA, 19 nt, Human T-lymphotropic virus 1
uuaagguccuuaccccgcc

SEQ ID NO: 4016131 - RNA, 20 nt, Human T-lymphotropic virus 1
uuaccauuuaacuggaccca

SEQ ID NO: 4016132 - RNA, 18 nt, Human T-lymphotropic virus 1
uuagcgcuuccagccccc

SEQ ID NO: 4016133 - RNA, 19 nt, Human T-lymphotropic virus 1
uuauugcaaccacaucgcc

SEQ ID NO: 4016134 - RNA, 22 nt, Human T-lymphotropic virus 1
uucaaaaauuuaggugcccaga

SEQ ID NO: 4016135 - RNA, 19 nt, Human T-lymphotropic virus 1
uucagacggauccaccucc

SEQ ID NO: 4016136 - RNA, 20 nt, Human T-lymphotropic virus 1
uucagacggauccaccuccc

SEQ ID NO: 4016137 - RNA, 18 nt, Human T-lymphotropic virus 1
uucauucaaacaucugac

SEQ ID NO: 4016138 - RNA, 22 nt, Human T-lymphotropic virus 1
uuccaacugucuaguauagcca

SEQ ID NO: 4016139 - RNA, 16 nt, Human T-lymphotropic virus 1
uuccagccccccaccu

SEQ ID NO: 4016140 - RNA, 13 nt, Human T-lymphotropic virus 1
uuccaguccaagc

SEQ ID NO: 4016141 - RNA, 19 nt, Human T-lymphotropic virus 1
uuccucaccaauguucccu

SEQ ID NO: 4016142 - RNA, 19 nt, Human T-lymphotropic virus 1
uuccucuuugcuccaggcc

SEQ ID NO: 4016143 - RNA, 13 nt, Human T-lymphotropic virus 1
uucuacucucaca

SEQ ID NO: 4016144 - RNA, 22 nt, Human T-lymphotropic virus 1
uucucagccccuugucuccacu

SEQ ID NO: 4016145 - RNA, 15 nt, Human T-lymphotropic virus 1
uucugccgccucccg

SEQ ID NO: 4016146 - RNA, 17 nt, Human T-lymphotropic virus 1
uuggacagagucuucuu

SEQ ID NO: 4016147 - RNA, 14 nt, Human T-lymphotropic virus 1
uuggcuccugugaa

SEQ ID NO: 4016148 - RNA, 13 nt, Human T-lymphotropic virus 1
uuuaacucuuccu

SEQ ID NO: 4016149 - RNA, 11 nt, Human T-lymphotropic virus 1
uuuccuccucc

SEQ ID NO: 4016150 - RNA, 22 nt, Human T-lymphotropic virus 1
uuuucagacggauccaccuccc

SEQ ID NO: 4016151 - RNA, 13 nt, Human T-lymphotropic virus 1
uuuuccuccucuu

SEQ ID NO: 4016152 - RNA, 12 nt, Human T-lymphotropic virus 1
uuuucuuaaaac

SEQ ID NO: 4016153 - RNA, 16 nt, Human T-lymphotropic virus 1
uuuuuccuucucccuu

SEQ ID NO: 4016154 - RNA, 12 nt, Human T-lymphotropic virus 1
uuuuugccaccc

SEQ ID NO: 4016155 - RNA, 13 nt, Human T-lymphotropic virus 1
aaaacaacugccc

SEQ ID NO: 4016156 - RNA, 19 nt, Human T-lymphotropic virus 1
aaaccuguacacccucugg

SEQ ID NO: 4016157 - RNA, 21 nt, Human T-lymphotropic virus 1
aaaucauaagcucagaccucc

SEQ ID NO: 4016158 - RNA, 18 nt, Human T-lymphotropic virus 1
aaaucgaguccugacugg

SEQ ID NO: 4016159 - RNA, 13 nt, Human T-lymphotropic virus 1
aacaguuccagcc

SEQ ID NO: 4016160 - RNA, 15 nt, Human T-lymphotropic virus 1
aaccacaacugaggc

SEQ ID NO: 4016161 - RNA, 11 nt, Human T-lymphotropic virus 1
aacucccucau

SEQ ID NO: 4016162 - RNA, 11 nt, Human T-lymphotropic virus 1
aacuccugcau

SEQ ID NO: 4016163 - RNA, 10 nt, Human T-lymphotropic virus 1
aacugcccca

SEQ ID NO: 4016164 - RNA, 23 nt, Human T-lymphotropic virus 1
aagacccaacaucuauucugcca

SEQ ID NO: 4016165 - RNA, 20 nt, Human T-lymphotropic virus 1
aagcccagauugacacccag

SEQ ID NO: 4016166 - RNA, 18 nt, Human T-lymphotropic virus 1
aagcccuuaugccagugu

SEQ ID NO: 4016167 - RNA, 19 nt, Human T-lymphotropic virus 1
aagcuauagucuccucccc

SEQ ID NO: 4016168 - RNA, 18 nt, Human T-lymphotropic virus 1
aagucagcggccuucucc

SEQ ID NO: 4016169 - RNA, 14 nt, Human T-lymphotropic virus 1
aaguuacuccagcu

SEQ ID NO: 4016170 - RNA, 20 nt, Human T-lymphotropic virus 1
aauacaggcgccagcugucc

SEQ ID NO: 4016171 - RNA, 20 nt, Human T-lymphotropic virus 1
aaucauggaccugccccuau

SEQ ID NO: 4016172 - RNA, 22 nt, Human T-lymphotropic virus 1
aauccuauggacuacucugcca

SEQ ID NO: 4016173 - RNA, 14 nt, Human T-lymphotropic virus 1
aauccugcccagcc

SEQ ID NO: 4016174 - RNA, 13 nt, Human T-lymphotropic virus 1
aaucugcucaaaa

SEQ ID NO: 4016175 - RNA, 16 nt, Human T-lymphotropic virus 1
acaacugaggccucca

SEQ ID NO: 4016176 - RNA, 19 nt, Human T-lymphotropic virus 1
acaccauggguaaguuucu

SEQ ID NO: 4016177 - RNA, 20 nt, Human T-lymphotropic virus 1
acacccagaccagccaccca

SEQ ID NO: 4016178 - RNA, 20 nt, Human T-lymphotropic virus 1
acacccucuggggaggcucc

SEQ ID NO: 4016179 - RNA, 12 nt, Human T-lymphotropic virus 1
acaccucaauau

SEQ ID NO: 4016180 - RNA, 11 nt, Human T-lymphotropic virus 1
acaccuccccu

SEQ ID NO: 4016181 - RNA, 15 nt, Human T-lymphotropic virus 1
acagacggcccucac

SEQ ID NO: 4016182 - RNA, 22 nt, Human T-lymphotropic virus 1
acaguuccuuaucccucgacuc

SEQ ID NO: 4016183 - RNA, 16 nt, Human T-lymphotropic virus 1
acaucgccuccagccu

SEQ ID NO: 4016184 - RNA, 19 nt, Human T-lymphotropic virus 1
acaucgccuccagccuccc

SEQ ID NO: 4016185 - RNA, 12 nt, Human T-lymphotropic virus 1
acaucuccaccc

SEQ ID NO: 4016186 - RNA, 21 nt, Human T-lymphotropic virus 1
accacaggaggcucuucaaga

SEQ ID NO: 4016187 - RNA, 12 nt, Human T-lymphotropic virus 1
cuagacucagcc

SEQ ID NO: 4016188 - RNA, 20 nt, Human T-lymphotropic virus 1
cuaguccaaacccugccccu

SEQ ID NO: 4016189 - RNA, 18 nt, Human T-lymphotropic virus 1
cuagucgacgcuccagga

SEQ ID NO: 4016190 - RNA, 13 nt, Human T-lymphotropic virus 1
cuauacucuccca

SEQ ID NO: 4016191 - RNA, 18 nt, Human T-lymphotropic virus 1
cuauagucuccucccccu

SEQ ID NO: 4016192 - RNA, 19 nt, Human T-lymphotropic virus 1
cuaucuaggcaagccuagc

SEQ ID NO: 4016193 - RNA, 16 nt, Human T-lymphotropic virus 1
cuaucuuacuccacca

SEQ ID NO: 4016194 - RNA, 19 nt, Human T-lymphotropic virus 1
cuaugcuguuucgccuucu

SEQ ID NO: 4016195 - RNA, 16 nt, Human T-lymphotropic virus 1
cuauggacuacucugc

SEQ ID NO: 4016196 - RNA, 21 nt, Human T-lymphotropic virus 1
cucaacccucaccacuccagg

SEQ ID NO: 4016197 - RNA, 17 nt, Human T-lymphotropic virus 1
cucaacgcucucacaga

SEQ ID NO: 4016198 - RNA, 24 nt, Human T-lymphotropic virus 1
cucaacgcucucacagaugcccua

SEQ ID NO: 4016199 - RNA, 20 nt, Human T-lymphotropic virus 1
cucaagaaguuucacaccuc

SEQ ID NO: 4016200 - RNA, 23 nt, Human T-lymphotropic virus 1
cucaauaaaauaacaggagucua

SEQ ID NO: 4016201 - RNA, 22 nt, Human T-lymphotropic virus 1
cucacaguuggagucuccucau

SEQ ID NO: 4016202 - RNA, 15 nt, Human T-lymphotropic virus 1
cucagccccuugucu

SEQ ID NO: 4016203 - RNA, 21 nt, Human T-lymphotropic virus 1
cucagccccuugucuccacuu

SEQ ID NO: 4016204 - RNA, 13 nt, Human T-lymphotropic virus 1
cucagccggcucu

SEQ ID NO: 4016205 - RNA, 19 nt, Human T-lymphotropic virus 1
cucagccggcucuccacgc

SEQ ID NO: 4016206 - RNA, 22 nt, Human T-lymphotropic virus 1
cucaggaaagagccuccuacau

SEQ ID NO: 4016207 - RNA, 23 nt, Human T-lymphotropic virus 1
cucauccucggugauuacagccc

SEQ ID NO: 4016208 - RNA, 17 nt, Human T-lymphotropic virus 1
cuccagccgaucccaga

SEQ ID NO: 4016209 - RNA, 13 nt, Human T-lymphotropic virus 1
cuccagccucccc

SEQ ID NO: 4016210 - RNA, 15 nt, Human T-lymphotropic virus 1
cuccagcuaccaugc

SEQ ID NO: 4016211 - RNA, 17 nt, Human T-lymphotropic virus 1
cuccagcuaccaugcca

SEQ ID NO: 4016212 - RNA, 20 nt, Human T-lymphotropic virus 1
cuccagcuaccaugccaccu

SEQ ID NO: 4016213 - RNA, 23 nt, Human T-lymphotropic virus 1
cuccaggauaugaccccaucugg

SEQ ID NO: 4016214 - RNA, 17 nt, Human T-lymphotropic virus 1
cucccaacgucucuguu

SEQ ID NO: 4016215 - RNA, 19 nt, Human T-lymphotropic virus 1
cuccccccgacuccagccg

SEQ ID NO: 4016216 - RNA, 15 nt, Human T-lymphotropic virus 1
cuccccuccuucccc

SEQ ID NO: 4016217 - RNA, 15 nt, Human T-lymphotropic virus 1
cuccucccccuguca

SEQ ID NO: 4016218 - RNA, 16 nt, Human T-lymphotropic virus 1
cuccucuacucuccca

SEQ ID NO: 4016219 - RNA, 20 nt, Human T-lymphotropic virus 1
cuccugcagcaaccuccucc

SEQ ID NO: 4016220 - RNA, 19 nt, Human T-lymphotropic virus 1
cuccugugaaagcccuuau

SEQ ID NO: 4016221 - RNA, 21 nt, Human T-lymphotropic virus 1
cuccuucacgcgcccgccgcc

SEQ ID NO: 4016222 - RNA, 20 nt, Human T-lymphotropic virus 1
cucgacuccccuccuucccc

SEQ ID NO: 4016223 - RNA, 24 nt, Human T-lymphotropic virus 1
cucggugauuacagccccagcugc

SEQ ID NO: 4016224 - RNA, 15 nt, Human T-lymphotropic virus 1
cucuaccagcuuucc

SEQ ID NO: 4016225 - RNA, 22 nt, Human T-lymphotropic virus 1
cucuauaaaauuucccuuacca

SEQ ID NO: 4016226 - RNA, 14 nt, Human T-lymphotropic virus 1
cucucacacggccu

SEQ ID NO: 4016227 - RNA, 19 nt, Human T-lymphotropic virus 1
cucucacagaugcccuacu

SEQ ID NO: 4016228 - RNA, 14 nt, Human T-lymphotropic virus 1
cucucacagugggc

SEQ ID NO: 4016229 - RNA, 23 nt, Human T-lymphotropic virus 1
cucucaggcccccuuucaggccc

SEQ ID NO: 4016230 - RNA, 13 nt, Human T-lymphotropic virus 1
cucuccagcgccc

SEQ ID NO: 4016231 - RNA, 18 nt, Human T-lymphotropic virus 1
cucuguuccauccccuuc

SEQ ID NO: 4016232 - RNA, 14 nt, Human T-lymphotropic virus 1
cucuucuccucagc

SEQ ID NO: 4016233 - RNA, 20 nt, Human T-lymphotropic virus 1
cucuugccacgccugccgca

SEQ ID NO: 4016234 - RNA, 14 nt, Human T-lymphotropic virus 1
cugaucccaucucc

SEQ ID NO: 4016235 - RNA, 17 nt, Human T-lymphotropic virus 1
cugcaacuacucucaga

SEQ ID NO: 4016236 - RNA, 20 nt, Human T-lymphotropic virus 1
cugcaaggggcaaccacaac

SEQ ID NO: 4016237 - RNA, 21 nt, Human T-lymphotropic virus 1
cugcaauccugcccagccagu

SEQ ID NO: 4016238 - RNA, 22 nt, Human T-lymphotropic virus 1
cugcccuaaagauggccagcca

SEQ ID NO: 4016239 - RNA, 23 nt, Human T-lymphotropic virus 1
cugcccuaaagauggccagccau

SEQ ID NO: 4016240 - RNA, 14 nt, Human T-lymphotropic virus 1
cugccucccaccgc

SEQ ID NO: 4016241 - RNA, 19 nt, Human T-lymphotropic virus 1
cugcuuuuccuccucuuuc

SEQ ID NO: 4016242 - RNA, 13 nt, Human T-lymphotropic virus 1
cuggcaagccccu

SEQ ID NO: 4016243 - RNA, 21 nt, Human T-lymphotropic virus 1
cuggcuacaugccccccuacc

SEQ ID NO: 4016244 - RNA, 18 nt, Human T-lymphotropic virus 1
cuguaccucccugaggca

SEQ ID NO: 4016245 - RNA, 15 nt, Human T-lymphotropic virus 1
cugucauaacucccu

SEQ ID NO: 4016246 - RNA, 19 nt, Human T-lymphotropic virus 1
cuguuugcccaccacccuu

SEQ ID NO: 4016247 - RNA, 22 nt, Human T-lymphotropic virus 1
cuuaauaccgaacccagccaac

SEQ ID NO: 4016248 - RNA, 19 nt, Human T-lymphotropic virus 1
cuucacagucucuacugug

SEQ ID NO: 4016249 - RNA, 22 nt, Human T-lymphotropic virus 1
cuucacagucucuacugugccu

SEQ ID NO: 4016250 - RNA, 19 nt, Human T-lymphotropic virus 1
cuucaccacuccccccgac

SEQ ID NO: 4016251 - RNA, 19 nt, Human T-lymphotropic virus 1
cuucccccgggcccccuga

SEQ ID NO: 4016252 - RNA, 20 nt, Human T-lymphotropic virus 1
cuucccccgggcccccugac

SEQ ID NO: 4016253 - RNA, 14 nt, Human T-lymphotropic virus 1
cuucuccugcagca

SEQ ID NO: 4016254 - RNA, 15 nt, Human T-lymphotropic virus 1
cuucuccugcagcaa

SEQ ID NO: 4016255 - RNA, 14 nt, Human T-lymphotropic virus 1
cuuguccagccugc

SEQ ID NO: 4016256 - RNA, 18 nt, Human T-lymphotropic virus 1
cuugucuccgcccuggcc

SEQ ID NO: 4016257 - RNA, 19 nt, Human T-lymphotropic virus 1
cuuucagcagaucaggccc

SEQ ID NO: 4016258 - RNA, 14 nt, Human T-lymphotropic virus 1
cuuuccccugugau

SEQ ID NO: 4016259 - RNA, 17 nt, Human T-lymphotropic virus 1
cuuuggaacacuuuucu

SEQ ID NO: 4016260 - RNA, 19 nt, Human T-lymphotropic virus 1
cuuuuccuugucaccuguu

SEQ ID NO: 4016261 - RNA, 19 nt, Human T-lymphotropic virus 1
cuuuucuuaaaacaacugc

SEQ ID NO: 4016262 - RNA, 17 nt, Human T-lymphotropic virus 1
gaaccacccauuuccuc

SEQ ID NO: 4016263 - RNA, 19 nt, Human T-lymphotropic virus 1
gaacccuacaccgggccag

SEQ ID NO: 4016264 - RNA, 18 nt, Human T-lymphotropic virus 1
gaacgccuccaggccuug

SEQ ID NO: 4016265 - RNA, 14 nt, Human T-lymphotropic virus 1
gaacuccuaccuua

SEQ ID NO: 4016266 - RNA, 16 nt, Human T-lymphotropic virus 1
gacaaagauauuuccc

SEQ ID NO: 4016267 - RNA, 20 nt, Human T-lymphotropic virus 1
gacaguucaggagggggcuc

SEQ ID NO: 4016268 - RNA, 16 nt, Human T-lymphotropic virus 1
gaccacaggaggcucu

SEQ ID NO: 4016269 - RNA, 20 nt, Human T-lymphotropic virus 1
gacccucacuggcaccacca

SEQ ID NO: 4016270 - RNA, 15 nt, Human T-lymphotropic virus 1
gaccugccccuauac

SEQ ID NO: 4016271 - RNA, 15 nt, Human T-lymphotropic virus 1
gacgucuccccccgg

SEQ ID NO: 4016272 - RNA, 22 nt, Human T-lymphotropic virus 1
gacuaguccaaacccugccccu

SEQ ID NO: 4016273 - RNA, 17 nt, Human T-lymphotropic virus 1
gacucagccggcucucc

SEQ ID NO: 4016274 - RNA, 14 nt, Human T-lymphotropic virus 1
gacuccccuccuuc

SEQ ID NO: 4016275 - RNA, 15 nt, Human T-lymphotropic virus 1
gagccgucuccagcc

SEQ ID NO: 4016276 - RNA, 20 nt, Human T-lymphotropic virus 1
gagguggcgcuuuccccccu

SEQ ID NO: 4016277 - RNA, 18 nt, Human T-lymphotropic virus 1
gauccaccucccaggcag

SEQ ID NO: 4016278 - RNA, 20 nt, Human T-lymphotropic virus 1
gaucucucaucaucuucccc

SEQ ID NO: 4016279 - RNA, 20 nt, Human T-lymphotropic virus 1
gcaaacaucgaaacagcccu

SEQ ID NO: 4016280 - RNA, 16 nt, Human T-lymphotropic virus 1
gcaagccccucccaug

SEQ ID NO: 4016281 - RNA, 14 nt, Human T-lymphotropic virus 1
gcaauccugcccag

SEQ ID NO: 4016282 - RNA, 18 nt, Human T-lymphotropic virus 1
gcacaguuuccuccuccu

SEQ ID NO: 4016283 - RNA, 15 nt, Human T-lymphotropic virus 1
gcaccuuccaaggca

SEQ ID NO: 4016284 - RNA, 17 nt, Human T-lymphotropic virus 1
gcacgcauacggcucaa

SEQ ID NO: 4016285 - RNA, 22 nt, Human T-lymphotropic virus 1
gcacgcauacggcucaauaaaa

SEQ ID NO: 4016286 - RNA, 15 nt, Human T-lymphotropic virus 1
gcagaucaggcccua

SEQ ID NO: 4016287 - RNA, 20 nt, Human T-lymphotropic virus 1
cggaggacagcucagcacca

SEQ ID NO: 4016288 - RNA, 14 nt, Human T-lymphotropic virus 1
cggauccaccuccc

SEQ ID NO: 4016289 - RNA, 19 nt, Human T-lymphotropic virus 1
cgguuuuuccuucucccuu

SEQ ID NO: 4016290 - RNA, 11 nt, Human T-lymphotropic virus 1
cgucaagcaca

SEQ ID NO: 4016291 - RNA, 20 nt, Human T-lymphotropic virus 1
cgucagcuacgacaccuccc

SEQ ID NO: 4016292 - RNA, 18 nt, Human T-lymphotropic virus 1
cguccuauacucucccaa

SEQ ID NO: 4016293 - RNA, 19 nt, Human T-lymphotropic virus 1
cguggccuacucccuaacc

SEQ ID NO: 4016294 - RNA, 17 nt, Human T-lymphotropic virus 1
cguuaucggcucagcuc

SEQ ID NO: 4016295 - RNA, 19 nt, Human T-lymphotropic virus 1
cuaaacaguuccagcccua

SEQ ID NO: 4016296 - RNA, 18 nt, Human T-lymphotropic virus 1
cuaaccacaucuggcaag

SEQ ID NO: 4016297 - RNA, 14 nt, Human T-lymphotropic virus 1
cuacaguccuccuc

SEQ ID NO: 4016298 - RNA, 20 nt, Human T-lymphotropic virus 1
cuacaugccccccuacccca

SEQ ID NO: 4016299 - RNA, 15 nt, Human T-lymphotropic virus 1
cuaccccacacuagc

SEQ ID NO: 4016300 - RNA, 17 nt, Human T-lymphotropic virus 1
cuaccuagacucagccg

SEQ ID NO: 4016301 - RNA, 16 nt, Human T-lymphotropic virus 1
cuaccuuacgccagcc

SEQ ID NO: 4016302 - RNA, 12 nt, Human T-lymphotropic virus 1
cuacucucacac

SEQ ID NO: 4016303 - RNA, 16 nt, Human T-lymphotropic virus 1
cuacuggccaccuguc

SEQ ID NO: 4016304 - RNA, 16 nt, Human T-lymphotropic virus 1
cuagaacaccucccaa

SEQ ID NO: 4016305 - RNA, 13 nt, Human T-lymphotropic virus 1
cuagacucagccg

SEQ ID NO: 4016306 - RNA, 21 nt, Human T-lymphotropic virus 1
cuaugauuuccgggcccugcc

SEQ ID NO: 4016307 - RNA, 18 nt, Human T-lymphotropic virus 1
cuauggacuacucugcca

SEQ ID NO: 4016308 - RNA, 15 nt, Human T-lymphotropic virus 1
cuauuauucagccuc

SEQ ID NO: 4016309 - RNA, 18 nt, Human T-lymphotropic virus 1
cucaagcgagcugcaugc

SEQ ID NO: 4016310 - RNA, 20 nt, Human T-lymphotropic virus 1
cucacaguuggagucuccuc

SEQ ID NO: 4016311 - RNA, 21 nt, Human T-lymphotropic virus 1
cucaccucaaaaaacuuuuca

SEQ ID NO: 4016312 - RNA, 15 nt, Human T-lymphotropic virus 1
cucaccucccuuccu

SEQ ID NO: 4016313 - RNA, 17 nt, Human T-lymphotropic virus 1
cucacggcgcuccugcu

SEQ ID NO: 4016314 - RNA, 19 nt, Human T-lymphotropic virus 1
cucacggcgcuccugcucu

SEQ ID NO: 4016315 - RNA, 14 nt, Human T-lymphotropic virus 1
cucagaccuccggg

SEQ ID NO: 4016316 - RNA, 15 nt, Human T-lymphotropic virus 1
cucagcaccagcuca

SEQ ID NO: 4016317 - RNA, 16 nt, Human T-lymphotropic virus 1
cucagcaccagcucag

SEQ ID NO: 4016318 - RNA, 22 nt, Human T-lymphotropic virus 1
cucagcaccagcucaggcuagg

SEQ ID NO: 4016319 - RNA, 18 nt, Human T-lymphotropic virus 1
cucauacaguacucuucc

SEQ ID NO: 4016320 - RNA, 13 nt, Human T-lymphotropic virus 1
cucauaccacucu

SEQ ID NO: 4016321 - RNA, 22 nt, Human T-lymphotropic virus 1
cucauccugccccccuuuuccu

SEQ ID NO: 4016322 - RNA, 22 nt, Human T-lymphotropic virus 1
cuccaccagcagguccuccggg

SEQ ID NO: 4016323 - RNA, 17 nt, Human T-lymphotropic virus 1
cuccaccucgccuucca

SEQ ID NO: 4016324 - RNA, 18 nt, Human T-lymphotropic virus 1
cuccagccuccccugcca

SEQ ID NO: 4016325 - RNA, 18 nt, Human T-lymphotropic virus 1
cuccaggauaugacccca

SEQ ID NO: 4016326 - RNA, 24 nt, Human T-lymphotropic virus 1
cucccaucaaauccuccuucuccu

SEQ ID NO: 4016327 - RNA, 20 nt, Human T-lymphotropic virus 1
cucccuuggagccuaccuag

SEQ ID NO: 4016328 - RNA, 20 nt, Human T-lymphotropic virus 1
cuccgucagcuacgacaccu

SEQ ID NO: 4016329 - RNA, 11 nt, Human T-lymphotropic virus 1
cuccucagccc

SEQ ID NO: 4016330 - RNA, 15 nt, Human T-lymphotropic virus 1
cuccuccuccuuguc

SEQ ID NO: 4016331 - RNA, 20 nt, Human T-lymphotropic virus 1
cuccucuauaaaauuucccu

SEQ ID NO: 4016332 - RNA, 22 nt, Human T-lymphotropic virus 1
cuccugcagaccuacacaguuu

SEQ ID NO: 4016333 - RNA, 23 nt, Human T-lymphotropic virus 1
cuccugugaaagcccuuaugcca

SEQ ID NO: 4016334 - RNA, 14 nt, Human T-lymphotropic virus 1
cuccuuccuccagg

SEQ ID NO: 4016335 - RNA, 14 nt, Human T-lymphotropic virus 1
cuccuucuccugca

SEQ ID NO: 4016336 - RNA, 22 nt, Human T-lymphotropic virus 1
cuccuucuuguuauccuugcag

SEQ ID NO: 4016337 - RNA, 21 nt, Human T-lymphotropic virus 1
cucgacaaauacaccuugcaa

SEQ ID NO: 4016338 - RNA, 16 nt, Human T-lymphotropic virus 1
cucggggccuuccuca

SEQ ID NO: 4016339 - RNA, 15 nt, Human T-lymphotropic virus 1
cucuaaacccugcaa

SEQ ID NO: 4016340 - RNA, 12 nt, Human T-lymphotropic virus 1
cucuacaguucc

SEQ ID NO: 4016341 - RNA, 16 nt, Human T-lymphotropic virus 1
cucuaccagcuuuccc

SEQ ID NO: 4016342 - RNA, 14 nt, Human T-lymphotropic virus 1
cugacccucacugg

SEQ ID NO: 4016343 - RNA, 18 nt, Human T-lymphotropic virus 1
cugacgucuccccccgga

SEQ ID NO: 4016344 - RNA, 17 nt, Human T-lymphotropic virus 1
cugaucccaucuccagg

SEQ ID NO: 4016345 - RNA, 13 nt, Human T-lymphotropic virus 1
cugcagaccuaca

SEQ ID NO: 4016346 - RNA, 17 nt, Human T-lymphotropic virus 1
cugcagcaaccuccucc

SEQ ID NO: 4016347 - RNA, 17 nt, Human T-lymphotropic virus 1
cugcagcucucuccugc

SEQ ID NO: 4016348 - RNA, 22 nt, Human T-lymphotropic virus 1
cugcauguaccucuaccagcuu

SEQ ID NO: 4016349 - RNA, 21 nt, Human T-lymphotropic virus 1
cugcccuaaagauggccagcc

SEQ ID NO: 4016350 - RNA, 21 nt, Human T-lymphotropic virus 1
cugccggcgcugcucucaucc

SEQ ID NO: 4016351 - RNA, 22 nt, Human T-lymphotropic virus 1
cugccggcgcugcucucauccc

SEQ ID NO: 4016352 - RNA, 21 nt, Human T-lymphotropic virus 1
cugccucccaccgccccuccu

SEQ ID NO: 4016353 - RNA, 22 nt, Human T-lymphotropic virus 1
cugcgccgugccuucuccucuu

SEQ ID NO: 4016354 - RNA, 15 nt, Human T-lymphotropic virus 1
cugcgcucuugccac

SEQ ID NO: 4016355 - RNA, 14 nt, Human T-lymphotropic virus 1
cugcuuuuccuccu

SEQ ID NO: 4016356 - RNA, 15 nt, Human T-lymphotropic virus 1
cugcuuuuccuccuc

SEQ ID NO: 4016357 - RNA, 22 nt, Human T-lymphotropic virus 1
cuggcaaaacggccuccuuccg

SEQ ID NO: 4016358 - RNA, 17 nt, Human T-lymphotropic virus 1
cuggcaagccccuccca

SEQ ID NO: 4016359 - RNA, 22 nt, Human T-lymphotropic virus 1
cuggcccauauccugcagccca

SEQ ID NO: 4016360 - RNA, 18 nt, Human T-lymphotropic virus 1
cuguaaaccaagcacaca

SEQ ID NO: 4016361 - RNA, 19 nt, Human T-lymphotropic virus 1
cuguccugcagcucucucc

SEQ ID NO: 4016362 - RNA, 19 nt, Human T-lymphotropic virus 1
cugucucaacauauuucua

SEQ ID NO: 4016363 - RNA, 16 nt, Human T-lymphotropic virus 1
cuguuucgccuucuca

SEQ ID NO: 4016364 - RNA, 20 nt, Human T-lymphotropic virus 1
cuuccagccccccaccugac

SEQ ID NO: 4016365 - RNA, 13 nt, Human T-lymphotropic virus 1
cuuccccacccag

SEQ ID NO: 4016366 - RNA, 16 nt, Human T-lymphotropic virus 1
cuuccuaaccaagacc

SEQ ID NO: 4016367 - RNA, 19 nt, Human T-lymphotropic virus 1
cuuccucuucuccucagcc

SEQ ID NO: 4016368 - RNA, 20 nt, Human T-lymphotropic virus 1
cuuccuuuucaaauacucag

SEQ ID NO: 4016369 - RNA, 19 nt, Human T-lymphotropic virus 1
cuucuaccccccuccuuua

SEQ ID NO: 4016370 - RNA, 13 nt, Human T-lymphotropic virus 1
cuucucagccccu

SEQ ID NO: 4016371 - RNA, 15 nt, Human T-lymphotropic virus 1
cuucuccucagcccg

SEQ ID NO: 4016372 - RNA, 21 nt, Human T-lymphotropic virus 1
cuugaaaaucgaguccugacu

SEQ ID NO: 4016373 - RNA, 22 nt, Human T-lymphotropic virus 1
cuugcaggaccaugcauccucc

SEQ ID NO: 4016374 - RNA, 21 nt, Human T-lymphotropic virus 1
cuuggccucucacagugggcu

SEQ ID NO: 4016375 - RNA, 20 nt, Human T-lymphotropic virus 1
cuugggcuagaacaccuccc

SEQ ID NO: 4016376 - RNA, 18 nt, Human T-lymphotropic virus 1
cuuuaacucuuccuccaa

SEQ ID NO: 4016377 - RNA, 19 nt, Human T-lymphotropic virus 1
cuuuaacucuuccuccaag

SEQ ID NO: 4016378 - RNA, 14 nt, Human T-lymphotropic virus 1
cuuugccugacccu

SEQ ID NO: 4016379 - RNA, 18 nt, Human T-lymphotropic virus 1
gacaaaucauaagcucag

SEQ ID NO: 4016380 - RNA, 20 nt, Human T-lymphotropic virus 1
gacaaaucauaagcucagac

SEQ ID NO: 4016381 - RNA, 13 nt, Human T-lymphotropic virus 1
gacagcucagcac

SEQ ID NO: 4016382 - RNA, 19 nt, Human T-lymphotropic virus 1
gacauucuccuggcaagcc

SEQ ID NO: 4016383 - RNA, 13 nt, Human T-lymphotropic virus 1
gaccaugcauccu

SEQ ID NO: 4016384 - RNA, 23 nt, Human T-lymphotropic virus 1
gacccacugcuuugacccccaga

SEQ ID NO: 4016385 - RNA, 17 nt, Human T-lymphotropic virus 1
gacccucgaccugcugg

SEQ ID NO: 4016386 - RNA, 12 nt, Human T-lymphotropic virus 1
gacccuugcccu

SEQ ID NO: 4016387 - RNA, 23 nt, Human T-lymphotropic virus 1
gacccuuguuccuuaaaaugccc

SEQ ID NO: 4016388 - RNA, 20 nt, Human T-lymphotropic virus 1
gacguuaccauuuaacugga

SEQ ID NO: 4016389 - RNA, 14 nt, Human T-lymphotropic virus 1
gacucagccggcuc

SEQ ID NO: 4016390 - RNA, 18 nt, Human T-lymphotropic virus 1
gagccaucucagcuaccc

SEQ ID NO: 4016391 - RNA, 16 nt, Human T-lymphotropic virus 1
gagccuaccuagacuc

SEQ ID NO: 4016392 - RNA, 21 nt, Human T-lymphotropic virus 1
gagccuaccuagacucagccg

SEQ ID NO: 4016393 - RNA, 21 nt, Human T-lymphotropic virus 1
gaggacagcucagcaccagcu

SEQ ID NO: 4016394 - RNA, 14 nt, Human T-lymphotropic virus 1
gaggccgccaucca

SEQ ID NO: 4016395 - RNA, 16 nt, Human T-lymphotropic virus 1
gaguacuaccccaagg

SEQ ID NO: 4016396 - RNA, 21 nt, Human T-lymphotropic virus 1
gauccaccucccaggcagccu

SEQ ID NO: 4016397 - RNA, 18 nt, Human T-lymphotropic virus 1
gaucucucaucaucuucc

SEQ ID NO: 4016398 - RNA, 18 nt, Human T-lymphotropic virus 1
gauuacagccccagcugc

SEQ ID NO: 4016399 - RNA, 19 nt, Human T-lymphotropic virus 1
gauuuccgggcccugcccu

SEQ ID NO: 4016400 - RNA, 17 nt, Human T-lymphotropic virus 1
gcaaauacucccccuuc

SEQ ID NO: 4016401 - RNA, 16 nt, Human T-lymphotropic virus 1
gcaauccugcccagcc

SEQ ID NO: 4016402 - RNA, 14 nt, Human T-lymphotropic virus 1
gcaccagcucaggc

SEQ ID NO: 4016403 - RNA, 15 nt, Human T-lymphotropic virus 1
gcaccagcucaggcu

SEQ ID NO: 4016404 - RNA, 19 nt, Human T-lymphotropic virus 1
gcagcccauucggcaagcc

SEQ ID NO: 4016405 - RNA, 16 nt, Human T-lymphotropic virus 1
gcagcuucaccacucc

SEQ ID NO: 4016406 - RNA, 16 nt, Human T-lymphotropic virus 1
gcagguccuccgggca

SEQ ID NO: 4016407 - RNA, 19 nt, Human T-lymphotropic virus 1
gccagcucggggccuuccu

SEQ ID NO: 4016408 - RNA, 23 nt, Human T-lymphotropic virus 1
gccaucuuuaguacuacaguccu

SEQ ID NO: 4016409 - RNA, 23 nt, Human T-lymphotropic virus 1
gccauugccuaucuaggcaagcc

SEQ ID NO: 4016410 - RNA, 20 nt, Human T-lymphotropic virus 1
gcccagaauaaggcucugac

SEQ ID NO: 4016411 - RNA, 19 nt, Human T-lymphotropic virus 1
gccccgccgaucccaaaga

SEQ ID NO: 4016412 - RNA, 17 nt, Human T-lymphotropic virus 1
gccccuucacagucucu

SEQ ID NO: 4016413 - RNA, 16 nt, Human T-lymphotropic virus 1
gccccuugucuccacu

SEQ ID NO: 4016414 - RNA, 14 nt, Human T-lymphotropic virus 1
gcccuacagccacc

SEQ ID NO: 4016415 - RNA, 19 nt, Human T-lymphotropic virus 1
gccgccuguaaucuugcca

SEQ ID NO: 4016416 - RNA, 18 nt, Human T-lymphotropic virus 1
gccgccuuaccugaggcc

SEQ ID NO: 4016417 - RNA, 14 nt, Human T-lymphotropic virus 1
gccgcggcuuuccu

SEQ ID NO: 4016418 - RNA, 13 nt, Human T-lymphotropic virus 1
gccguccucaggc

SEQ ID NO: 4016419 - RNA, 15 nt, Human T-lymphotropic virus 1
gccgucuccagcccc

SEQ ID NO: 4016420 - RNA, 18 nt, Human T-lymphotropic virus 1
gccuccaauauccugcgc

SEQ ID NO: 4016421 - RNA, 23 nt, Human T-lymphotropic virus 1
gccuccaggccuugcaacacuug

SEQ ID NO: 4016422 - RNA, 18 nt, Human T-lymphotropic virus 1
gccucccgccuguggugc

SEQ ID NO: 4016423 - RNA, 12 nt, Human T-lymphotropic virus 1
gccucucaguga

SEQ ID NO: 4016424 - RNA, 15 nt, Human T-lymphotropic virus 1
gccuuaccugaggcc

SEQ ID NO: 4016425 - RNA, 20 nt, Human T-lymphotropic virus 1
uagaucucucaucaucuucc

SEQ ID NO: 4016426 - RNA, 21 nt, Human T-lymphotropic virus 1
uauugcaaccacaucgccucc

SEQ ID NO: 4016427 - RNA, 14 nt, Human T-lymphotropic virus 1
uauuucccaagacu

SEQ ID NO: 4016428 - RNA, 22 nt, Human T-lymphotropic virus 1
uauuuccucuuugcuccaggcc

SEQ ID NO: 4016429 - RNA, 12 nt, Human T-lymphotropic virus 1
ucaaaacuccug

SEQ ID NO: 4016430 - RNA, 14 nt, Human T-lymphotropic virus 1
ucaaauccuccuuc

SEQ ID NO: 4016431 - RNA, 15 nt, Human T-lymphotropic virus 1
ucaagcacaguuucc

SEQ ID NO: 4016432 - RNA, 18 nt, Human T-lymphotropic virus 1
ucaagcacaguuuccucc

SEQ ID NO: 4016433 - RNA, 20 nt, Human T-lymphotropic virus 1
ucaccccuguccugcagcuc

SEQ ID NO: 4016434 - RNA, 14 nt, Human T-lymphotropic virus 1
ucaccucccuuccu

SEQ ID NO: 4016435 - RNA, 13 nt, Human T-lymphotropic virus 1
ucaccuggccccu

SEQ ID NO: 4016436 - RNA, 16 nt, Human T-lymphotropic virus 1
ucacucauacaacccc

SEQ ID NO: 4016437 - RNA, 22 nt, Human T-lymphotropic virus 1
ucagaagcuauuuccucuuugc

SEQ ID NO: 4016438 - RNA, 13 nt, Human T-lymphotropic virus 1
ucagaccuccggg

SEQ ID NO: 4016439 - RNA, 22 nt, Human T-lymphotropic virus 1
ucagaccuccgggaagccaccg

SEQ ID NO: 4016440 - RNA, 19 nt, Human T-lymphotropic virus 1
ucagcaauaaacaaaccca

SEQ ID NO: 4016441 - RNA, 16 nt, Human T-lymphotropic virus 1
ucagcaccagcucagg

SEQ ID NO: 4016442 - RNA, 18 nt, Human T-lymphotropic virus 1
ucagcccacuucccaggg

SEQ ID NO: 4016443 - RNA, 18 nt, Human T-lymphotropic virus 1
ucagcuacgacaccuccc

SEQ ID NO: 4016444 - RNA, 18 nt, Human T-lymphotropic virus 1
ucaggaaagagccuccua

SEQ ID NO: 4016445 - RNA, 12 nt, Human T-lymphotropic virus 1
ucaggcccccuu

SEQ ID NO: 4016446 - RNA, 16 nt, Human T-lymphotropic virus 1
ucaggcccccuuucag

SEQ ID NO: 4016447 - RNA, 20 nt, Human T-lymphotropic virus 1
ucaggcccuacagccacccu

SEQ ID NO: 4016448 - RNA, 14 nt, Human T-lymphotropic virus 1
ucaggcuaggcccu

SEQ ID NO: 4016449 - RNA, 20 nt, Human T-lymphotropic virus 1
ucauaaacaccgccccuugc

SEQ ID NO: 4016450 - RNA, 15 nt, Human T-lymphotropic virus 1
ucauccugccccccu

SEQ ID NO: 4016451 - RNA, 14 nt, Human T-lymphotropic virus 1
ucauggaccugccc

SEQ ID NO: 4016452 - RNA, 17 nt, Human T-lymphotropic virus 1
ucauggaccugccccua

SEQ ID NO: 4016453 - RNA, 20 nt, Human T-lymphotropic virus 1
ucauggaccugccccuauac

SEQ ID NO: 4016454 - RNA, 15 nt, Human T-lymphotropic virus 1
ucauuagugcagcug

SEQ ID NO: 4016455 - RNA, 17 nt, Human T-lymphotropic virus 1
uccaaggacuccaccuc

SEQ ID NO: 4016456 - RNA, 17 nt, Human T-lymphotropic virus 1
uccaaggauaauagccc

SEQ ID NO: 4016457 - RNA, 21 nt, Human T-lymphotropic virus 1
uccaauauccugcgcucuugc

SEQ ID NO: 4016458 - RNA, 19 nt, Human T-lymphotropic virus 1
accucccaggcagccuaua

SEQ ID NO: 4016459 - RNA, 20 nt, Human T-lymphotropic virus 1
accuccuccguucagccucc

SEQ ID NO: 4016460 - RNA, 21 nt, Human T-lymphotropic virus 1
accuccuccguucagccucca

SEQ ID NO: 4016461 - RNA, 23 nt, Human T-lymphotropic virus 1
accucucccaucaaauccuccuu

SEQ ID NO: 4016462 - RNA, 16 nt, Human T-lymphotropic virus 1
accugggaccccaucg

SEQ ID NO: 4016463 - RNA, 20 nt, Human T-lymphotropic virus 1
accuuccaaggcagguccuc

SEQ ID NO: 4016464 - RNA, 21 nt, Human T-lymphotropic virus 1
accuucggacccuugcccuag

SEQ ID NO: 4016465 - RNA, 19 nt, Human T-lymphotropic virus 1
acggcccucacacugcaag

SEQ ID NO: 4016466 - RNA, 21 nt, Human T-lymphotropic virus 1
acucagccggcucuccacgcu

SEQ ID NO: 4016467 - RNA, 16 nt, Human T-lymphotropic virus 1
acuccaaguaucuuua

SEQ ID NO: 4016468 - RNA, 17 nt, Human T-lymphotropic virus 1
acuccagcuaccaugcc

SEQ ID NO: 4016469 - RNA, 21 nt, Human T-lymphotropic virus 1
acuccccuccuuccccaccca

SEQ ID NO: 4016470 - RNA, 18 nt, Human T-lymphotropic virus 1
acucccuaaccacaucug

SEQ ID NO: 4016471 - RNA, 22 nt, Human T-lymphotropic virus 1
acugcaaggggcaaccacaacu

SEQ ID NO: 4016472 - RNA, 18 nt, Human T-lymphotropic virus 1
acugccucccaccgcccc

SEQ ID NO: 4016473 - RNA, 12 nt, Human T-lymphotropic virus 1
acuggccaccug

SEQ ID NO: 4016474 - RNA, 19 nt, Human T-lymphotropic virus 1
acuggcuggggccuuaacu

SEQ ID NO: 4016475 - RNA, 15 nt, Human T-lymphotropic virus 1
acuggugccccaucu

SEQ ID NO: 4016476 - RNA, 17 nt, Human T-lymphotropic virus 1
acuuaugaugcaguccc

SEQ ID NO: 4016477 - RNA, 14 nt, Human T-lymphotropic virus 1
acuuggcacguccu

SEQ ID NO: 4016478 - RNA, 19 nt, Human T-lymphotropic virus 1
acuuugcuuucacuguccc

SEQ ID NO: 4016479 - RNA, 23 nt, Human T-lymphotropic virus 1
acuuuucuuaaaacaacugcccc

SEQ ID NO: 4016480 - RNA, 13 nt, Human T-lymphotropic virus 1
agaagucugagaa

SEQ ID NO: 4016481 - RNA, 21 nt, Human T-lymphotropic virus 1
agacaccuuuucaggagccau

SEQ ID NO: 4016482 - RNA, 13 nt, Human T-lymphotropic virus 1
agacggcccucac

SEQ ID NO: 4016483 - RNA, 23 nt, Human T-lymphotropic virus 1
agacuaguccaaacccugccccu

SEQ ID NO: 4016484 - RNA, 23 nt, Human T-lymphotropic virus 1
agcaaccuccuccguucagccuc

SEQ ID NO: 4016485 - RNA, 14 nt, Human T-lymphotropic virus 1
agccacccugcccu

SEQ ID NO: 4016486 - RNA, 18 nt, Human T-lymphotropic virus 1
agccauaccaaucuaccu

SEQ ID NO: 4016487 - RNA, 19 nt, Human T-lymphotropic virus 1
agccaucaacccccaacuc

SEQ ID NO: 4016488 - RNA, 18 nt, Human T-lymphotropic virus 1
agcccagauugacaccca

SEQ ID NO: 4016489 - RNA, 12 nt, Human T-lymphotropic virus 1
agccccuucaca

SEQ ID NO: 4016490 - RNA, 12 nt, Human T-lymphotropic virus 1
agccgccagugg

SEQ ID NO: 4016491 - RNA, 22 nt, Human T-lymphotropic virus 1
agccggccgcggcuuuccucuu

SEQ ID NO: 4016492 - RNA, 13 nt, Human T-lymphotropic virus 1
agccguccucagg

SEQ ID NO: 4016493 - RNA, 15 nt, Human T-lymphotropic virus 1
agccgucuccagccc

SEQ ID NO: 4016494 - RNA, 22 nt, Human T-lymphotropic virus 1
agccgucuccagccccuacugg

SEQ ID NO: 4016495 - RNA, 21 nt, Human T-lymphotropic virus 1
agccuggcaaaacggccuccu

SEQ ID NO: 4016496 - RNA, 22 nt, Human T-lymphotropic virus 1
agccuggcaaaacggccuccuu

SEQ ID NO: 4016497 - RNA, 13 nt, Human T-lymphotropic virus 1
agcgcuuccagcc

SEQ ID NO: 4016498 - RNA, 16 nt, Human T-lymphotropic virus 1
agcuaccaugccaccu

SEQ ID NO: 4016499 - RNA, 16 nt, Human T-lymphotropic virus 1
agcucagcaccagcuc

SEQ ID NO: 4016500 - RNA, 15 nt, Human T-lymphotropic virus 1
agcucggggccuucc

SEQ ID NO: 4016501 - RNA, 20 nt, Human T-lymphotropic virus 1
agcucggggccuuccucacc

SEQ ID NO: 4016502 - RNA, 17 nt, Human T-lymphotropic virus 1
aggagccaucucagcua

SEQ ID NO: 4016503 - RNA, 20 nt, Human T-lymphotropic virus 1
aggcccuacagccacccugc

SEQ ID NO: 4016504 - RNA, 15 nt, Human T-lymphotropic virus 1
aggcccuccugcccc

SEQ ID NO: 4016505 - RNA, 16 nt, Human T-lymphotropic virus 1
aggcccuccugccccg

SEQ ID NO: 4016506 - RNA, 13 nt, Human T-lymphotropic virus 1
aggcccugucaca

SEQ ID NO: 4016507 - RNA, 13 nt, Human T-lymphotropic virus 1
agguccucucagg

SEQ ID NO: 4016508 - RNA, 18 nt, Human T-lymphotropic virus 1
agguccucucaggccccc

SEQ ID NO: 4016509 - RNA, 22 nt, Human T-lymphotropic virus 1
aguagacuaguccaaacccugc

SEQ ID NO: 4016510 - RNA, 13 nt, Human T-lymphotropic virus 1
aguccuccuccuu

SEQ ID NO: 4016511 - RNA, 20 nt, Human T-lymphotropic virus 1
agucuccucccccugucaua

SEQ ID NO: 4016512 - RNA, 23 nt, Human T-lymphotropic virus 1
aguguuccuaucuuacuccacca

SEQ ID NO: 4016513 - RNA, 13 nt, Human T-lymphotropic virus 1
aguuacuccagcu

SEQ ID NO: 4016514 - RNA, 18 nt, Human T-lymphotropic virus 1
auaacucccucauccugc

SEQ ID NO: 4016515 - RNA, 21 nt, Human T-lymphotropic virus 1
auaccacucuaaacccugcaa

SEQ ID NO: 4016516 - RNA, 15 nt, Human T-lymphotropic virus 1
auacucccccuuccg

SEQ ID NO: 4016517 - RNA, 14 nt, Human T-lymphotropic virus 1
aucaaauccuccuu

SEQ ID NO: 4016518 - RNA, 15 nt, Human T-lymphotropic virus 1
accuagacucagccg

SEQ ID NO: 4016519 - RNA, 19 nt, Human T-lymphotropic virus 1
accucaauauuaaucucca

SEQ ID NO: 4016520 - RNA, 18 nt, Human T-lymphotropic virus 1
accuccuccguucagccu

SEQ ID NO: 4016521 - RNA, 17 nt, Human T-lymphotropic virus 1
accugaacuucaagccc

SEQ ID NO: 4016522 - RNA, 16 nt, Human T-lymphotropic virus 1
accugaggccgccauc

SEQ ID NO: 4016523 - RNA, 16 nt, Human T-lymphotropic virus 1
accuuggccucucaca

SEQ ID NO: 4016524 - RNA, 18 nt, Human T-lymphotropic virus 1
acgccuuuuuccaaaucc

SEQ ID NO: 4016525 - RNA, 17 nt, Human T-lymphotropic virus 1
cccugcaauccugccca

SEQ ID NO: 4016526 - RNA, 16 nt, Human T-lymphotropic virus 1
cccugccccuccuagg

SEQ ID NO: 4016527 - RNA, 18 nt, Human T-lymphotropic virus 1
cccugucauaacucccuc

SEQ ID NO: 4016528 - RNA, 23 nt, Human T-lymphotropic virus 1
cccuugaaaaucgaguccugacu

SEQ ID NO: 4016529 - RNA, 16 nt, Human T-lymphotropic virus 1
ccgaacccagccaacu

SEQ ID NO: 4016530 - RNA, 13 nt, Human T-lymphotropic virus 1
ccgccccuccucu

SEQ ID NO: 4016531 - RNA, 17 nt, Human T-lymphotropic virus 1
ccgccguggccuacucc

SEQ ID NO: 4016532 - RNA, 23 nt, Human T-lymphotropic virus 1
ccggaggacagcucagcaccagc

SEQ ID NO: 4016533 - RNA, 15 nt, Human T-lymphotropic virus 1
ccggcuccauguccc

SEQ ID NO: 4016534 - RNA, 13 nt, Human T-lymphotropic virus 1
ccgucuccagccc

SEQ ID NO: 4016535 - RNA, 16 nt, Human T-lymphotropic virus 1
ccgugccuucuccucu

SEQ ID NO: 4016536 - RNA, 14 nt, Human T-lymphotropic virus 1
ccuaaccacaucug

SEQ ID NO: 4016537 - RNA, 19 nt, Human T-lymphotropic virus 1
ccuaccuaaacaguuccag

SEQ ID NO: 4016538 - RNA, 17 nt, Human T-lymphotropic virus 1
ccuaccuagacucagcc

SEQ ID NO: 4016539 - RNA, 19 nt, Human T-lymphotropic virus 1
ccuacucccuaaccacauc

SEQ ID NO: 4016540 - RNA, 16 nt, Human T-lymphotropic virus 1
ccuaguugauaccaaa

SEQ ID NO: 4016541 - RNA, 17 nt, Human T-lymphotropic virus 1
ccuaucuuacuccacca

SEQ ID NO: 4016542 - RNA, 17 nt, Human T-lymphotropic virus 1
ccuauggacuacucugc

SEQ ID NO: 4016543 - RNA, 15 nt, Human T-lymphotropic virus 1
ccucaagcgagcugc

SEQ ID NO: 4016544 - RNA, 19 nt, Human T-lymphotropic virus 1
ccucacuggcaccaccacu

SEQ ID NO: 4016545 - RNA, 15 nt, Human T-lymphotropic virus 1
ccucauaccacucua

SEQ ID NO: 4016546 - RNA, 19 nt, Human T-lymphotropic virus 1
ccucauuucuacucucaca

SEQ ID NO: 4016547 - RNA, 21 nt, Human T-lymphotropic virus 1
ccuccaaggacuccaccucgc

SEQ ID NO: 4016548 - RNA, 19 nt, Human T-lymphotropic virus 1
ccuccagccuccccugcca

SEQ ID NO: 4016549 - RNA, 16 nt, Human T-lymphotropic virus 1
ccucgacuccccuccu

SEQ ID NO: 4016550 - RNA, 13 nt, Human T-lymphotropic virus 1
ccucuacucuccc

SEQ ID NO: 4016551 - RNA, 14 nt, Human T-lymphotropic virus 1
ccucuacucuccca

SEQ ID NO: 4016552 - RNA, 20 nt, Human T-lymphotropic virus 1
ccucuauaaaauuucccuua

SEQ ID NO: 4016553 - RNA, 18 nt, Human T-lymphotropic virus 1
ccucuggggaggcuccgu

SEQ ID NO: 4016554 - RNA, 13 nt, Human T-lymphotropic virus 1
ccucuuccuuccu

SEQ ID NO: 4016555 - RNA, 16 nt, Human T-lymphotropic virus 1
ccucuucuccucagcc

SEQ ID NO: 4016556 - RNA, 16 nt, Human T-lymphotropic virus 1
ccucuuugcuccaggc

SEQ ID NO: 4016557 - RNA, 19 nt, Human T-lymphotropic virus 1
ccugcaauccugcccagcc

SEQ ID NO: 4016558 - RNA, 17 nt, Human T-lymphotropic virus 1
ccugcagcaaccuccuc

SEQ ID NO: 4016559 - RNA, 19 nt, Human T-lymphotropic virus 1
ccugccaacuacacuagcc

SEQ ID NO: 4016560 - RNA, 14 nt, Human T-lymphotropic virus 1
ccugcccagccagu

SEQ ID NO: 4016561 - RNA, 13 nt, Human T-lymphotropic virus 1
ccugccccccuuu

SEQ ID NO: 4016562 - RNA, 12 nt, Human T-lymphotropic virus 1
ccugcucuuccu

SEQ ID NO: 4016563 - RNA, 14 nt, Human T-lymphotropic virus 1
ccugcuuucuccgg

SEQ ID NO: 4016564 - RNA, 17 nt, Human T-lymphotropic virus 1
ccugcuuucuccgggcg

SEQ ID NO: 4016565 - RNA, 13 nt, Human T-lymphotropic virus 1
ccuggccccuccu

SEQ ID NO: 4016566 - RNA, 13 nt, Human T-lymphotropic virus 1
ccuguacacccuc

SEQ ID NO: 4016567 - RNA, 19 nt, Human T-lymphotropic virus 1
ccugucuuuuccagacccc

SEQ ID NO: 4016568 - RNA, 21 nt, Human T-lymphotropic virus 1
ccuguucgaaaugcagcuggc

SEQ ID NO: 4016569 - RNA, 19 nt, Human T-lymphotropic virus 1
ccuuaacugggaccuuggc

SEQ ID NO: 4016570 - RNA, 24 nt, Human T-lymphotropic virus 1
ccuuaauaccgaacccagccaacu

SEQ ID NO: 4016571 - RNA, 16 nt, Human T-lymphotropic virus 1
ccuuacgccagccccu

SEQ ID NO: 4016572 - RNA, 19 nt, Human T-lymphotropic virus 1
ccuuacgccagccccuuca

SEQ ID NO: 4016573 - RNA, 13 nt, Human T-lymphotropic virus 1
ccuuccuccaggc

SEQ ID NO: 4016574 - RNA, 15 nt, Human T-lymphotropic virus 1
ccuuccuccaggcca

SEQ ID NO: 4016575 - RNA, 16 nt, Human T-lymphotropic virus 1
ccuucggacccuugcc

SEQ ID NO: 4016576 - RNA, 22 nt, Human T-lymphotropic virus 1
ccuucuagucgacgcuccagga

SEQ ID NO: 4016577 - RNA, 14 nt, Human T-lymphotropic virus 1
ccuucucccuucua

SEQ ID NO: 4016578 - RNA, 14 nt, Human T-lymphotropic virus 1
ccuucuccugcagc

SEQ ID NO: 4016579 - RNA, 20 nt, Human T-lymphotropic virus 1
ccuucuucuaccccccuccu

SEQ ID NO: 4016580 - RNA, 14 nt, Human T-lymphotropic virus 1
ccuugaucuccugu

SEQ ID NO: 4016581 - RNA, 17 nt, Human T-lymphotropic virus 1
ccuugaucuccuguucu

SEQ ID NO: 4016582 - RNA, 21 nt, Human T-lymphotropic virus 1
ccuugcccuaggcaccuucca

SEQ ID NO: 4016583 - RNA, 23 nt, Human T-lymphotropic virus 1
ccuugcuauucgccauacuaccc

SEQ ID NO: 4016584 - RNA, 19 nt, Human T-lymphotropic virus 1
ccuuucaggcccuccugcc

SEQ ID NO: 4016585 - RNA, 20 nt, Human T-lymphotropic virus 1
ccuuuuuccaaaucccccua

SEQ ID NO: 4016586 - RNA, 13 nt, Human T-lymphotropic virus 1
cgaaacagcccua

SEQ ID NO: 4016587 - RNA, 18 nt, Human T-lymphotropic virus 1
cgaacccagccaacugcc

SEQ ID NO: 4016588 - RNA, 18 nt, Human T-lymphotropic virus 1
cgaggccuugaucuccug

SEQ ID NO: 4016589 - RNA, 14 nt, Human T-lymphotropic virus 1
cgaucgugccagcc

SEQ ID NO: 4016590 - RNA, 16 nt, Human T-lymphotropic virus 1
cgaucgugccagccua

SEQ ID NO: 4016591 - RNA, 22 nt, Human T-lymphotropic virus 1
cgauggcagcuucaccacuccc

SEQ ID NO: 4016592 - RNA, 17 nt, Human T-lymphotropic virus 1
cgcccuacuggccaccu

SEQ ID NO: 4016593 - RNA, 13 nt, Human T-lymphotropic virus 1
cgccgccuuaccu

SEQ ID NO: 4016594 - RNA, 18 nt, Human T-lymphotropic virus 1
cgccgccuuaccugaggc

SEQ ID NO: 4016595 - RNA, 23 nt, Human T-lymphotropic virus 1
cgccuacaucgucacgcccuacu

SEQ ID NO: 4016596 - RNA, 11 nt, Human T-lymphotropic virus 1
cgccuccagcc

SEQ ID NO: 4016597 - RNA, 12 nt, Human T-lymphotropic virus 1
cgccuccaggcc

SEQ ID NO: 4016598 - RNA, 19 nt, Human T-lymphotropic virus 1
cgccuguggugccuccuga

SEQ ID NO: 4016599 - RNA, 20 nt, Human T-lymphotropic virus 1
cgcucccuuggagccuaccu

SEQ ID NO: 4016600 - RNA, 13 nt, Human T-lymphotropic virus 1
cgcugacagccug

SEQ ID NO: 4016601 - RNA, 21 nt, Human T-lymphotropic virus 1
cgcuuccucuucuccucagcc

SEQ ID NO: 4016602 - RNA, 22 nt, Human T-lymphotropic virus 1
cgcuuccucuucuccucagccc

SEQ ID NO: 4016603 - RNA, 12 nt, Human T-lymphotropic virus 1
cggaaggcccug

SEQ ID NO: 4016604 - RNA, 16 nt, Human T-lymphotropic virus 1
cggaggacagcucagc

SEQ ID NO: 4016605 - RNA, 22 nt, Human T-lymphotropic virus 1
cggcacuagauacgccuggaga

SEQ ID NO: 4016606 - RNA, 12 nt, Human T-lymphotropic virus 1
cggcaggcccug

SEQ ID NO: 4016607 - RNA, 14 nt, Human T-lymphotropic virus 1
cgggaaccacccau

SEQ ID NO: 4016608 - RNA, 23 nt, Human T-lymphotropic virus 1
cgggaaccacccauuuccucccc

SEQ ID NO: 4016609 - RNA, 22 nt, Human T-lymphotropic virus 1
cgggccuuuguccggcgcuccc

SEQ ID NO: 4016610 - RNA, 21 nt, Human T-lymphotropic virus 1
cgucagcuacgacaccucccc

SEQ ID NO: 4016611 - RNA, 12 nt, Human T-lymphotropic virus 1
cgucuccagccc

SEQ ID NO: 4016612 - RNA, 16 nt, Human T-lymphotropic virus 1
cguuaucggcucagcu

SEQ ID NO: 4016613 - RNA, 23 nt, Human T-lymphotropic virus 1
cuaaacccugcaauccugcccag

SEQ ID NO: 4016614 - RNA, 21 nt, Human T-lymphotropic virus 1
cuacacaguuucacccauugc

SEQ ID NO: 4016615 - RNA, 18 nt, Human T-lymphotropic virus 1
cuacaugccccccuaccc

SEQ ID NO: 4016616 - RNA, 21 nt, Human T-lymphotropic virus 1
cuaccagcuuuccccccccau

SEQ ID NO: 4016617 - RNA, 16 nt, Human T-lymphotropic virus 1
cuaccaugccaccuau

SEQ ID NO: 4016618 - RNA, 21 nt, Human T-lymphotropic virus 1
cuaccuaaacaguuccagccc

SEQ ID NO: 4016619 - RNA, 21 nt, Human T-lymphotropic virus 1
cuacucccuaaccacaucugg

SEQ ID NO: 4016620 - RNA, 16 nt, Human T-lymphotropic virus 1
cuacucugccaaacca

SEQ ID NO: 4016621 - RNA, 16 nt, Human T-lymphotropic virus 1
cuagacucagccggcu

SEQ ID NO: 4016622 - RNA, 14 nt, Human T-lymphotropic virus 1
cuaggcaccuucca

SEQ ID NO: 4016623 - RNA, 16 nt, Human T-lymphotropic virus 1
cuaguccaaacccugc

SEQ ID NO: 4016624 - RNA, 13 nt, Human T-lymphotropic virus 1
caccagcucaggc

SEQ ID NO: 4016625 - RNA, 23 nt, Human T-lymphotropic virus 1
caccauggguaaguuucucgcca

SEQ ID NO: 4016626 - RNA, 16 nt, Human T-lymphotropic virus 1
cacccagaccagccac

SEQ ID NO: 4016627 - RNA, 15 nt, Human T-lymphotropic virus 1
caccccggccagcuc

SEQ ID NO: 4016628 - RNA, 24 nt, Human T-lymphotropic virus 1
cacccuccuuccuccaggccaugc

SEQ ID NO: 4016629 - RNA, 18 nt, Human T-lymphotropic virus 1
cacccuugggcagcaccu

SEQ ID NO: 4016630 - RNA, 23 nt, Human T-lymphotropic virus 1
cacccuugggcagcaccucccaa

SEQ ID NO: 4016631 - RNA, 17 nt, Human T-lymphotropic virus 1
cacccuugucgcgcuac

SEQ ID NO: 4016632 - RNA, 17 nt, Human T-lymphotropic virus 1
cacccuuuuccagccug

SEQ ID NO: 4016633 - RNA, 18 nt, Human T-lymphotropic virus 1
caccucccaacccugucu

SEQ ID NO: 4016634 - RNA, 14 nt, Human T-lymphotropic virus 1
caccucgccuucca

SEQ ID NO: 4016635 - RNA, 16 nt, Human T-lymphotropic virus 1
caccuuuucaggagcc

SEQ ID NO: 4016636 - RNA, 19 nt, Human T-lymphotropic virus 1
cacguccuauacucuccca

SEQ ID NO: 4016637 - RNA, 16 nt, Human T-lymphotropic virus 1
cacuccccccgacucc

SEQ ID NO: 4016638 - RNA, 22 nt, Human T-lymphotropic virus 1
cacucuaaccuagaccauaucc

SEQ ID NO: 4016639 - RNA, 19 nt, Human T-lymphotropic virus 1
cacugugguguuccagucc

SEQ ID NO: 4016640 - RNA, 15 nt, Human T-lymphotropic virus 1
cagacaauggcccug

SEQ ID NO: 4016641 - RNA, 22 nt, Human T-lymphotropic virus 1
cagcaaucugcuuuuccuccuc

SEQ ID NO: 4016642 - RNA, 16 nt, Human T-lymphotropic virus 1
cagcaccagcucaggc

SEQ ID NO: 4016643 - RNA, 14 nt, Human T-lymphotropic virus 1
cagcagaucaggcc

SEQ ID NO: 4016644 - RNA, 20 nt, Human T-lymphotropic virus 1
cagcagaucaggcccuacag

SEQ ID NO: 4016645 - RNA, 13 nt, Human T-lymphotropic virus 1
cagccaacugccu

SEQ ID NO: 4016646 - RNA, 14 nt, Human T-lymphotropic virus 1
cagccacccaaaga

SEQ ID NO: 4016647 - RNA, 13 nt, Human T-lymphotropic virus 1
cagccacccugcc

SEQ ID NO: 4016648 - RNA, 15 nt, Human T-lymphotropic virus 1
cagccacccugcccu

SEQ ID NO: 4016649 - RNA, 23 nt, Human T-lymphotropic virus 1
cagccaguuuguucauggacccu

SEQ ID NO: 4016650 - RNA, 18 nt, Human T-lymphotropic virus 1
cagccccuugucuccacu

SEQ ID NO: 4016651 - RNA, 21 nt, Human T-lymphotropic virus 1
cagccuccaaggacuccaccu

SEQ ID NO: 4016652 - RNA, 17 nt, Human T-lymphotropic virus 1
cagcuaccaugccaccu

SEQ ID NO: 4016653 - RNA, 16 nt, Human T-lymphotropic virus 1
cagcucagcaccagcu

SEQ ID NO: 4016654 - RNA, 19 nt, Human T-lymphotropic virus 1
cagcuucaccacucccccc

SEQ ID NO: 4016655 - RNA, 13 nt, Human T-lymphotropic virus 1
caggagccaucuc

SEQ ID NO: 4016656 - RNA, 16 nt, Human T-lymphotropic virus 1
caggagccaucucagc

SEQ ID NO: 4016657 - RNA, 12 nt, Human T-lymphotropic virus 1
caggccauaucg

SEQ ID NO: 4016658 - RNA, 22 nt, Human T-lymphotropic virus 1
cagggcccagaauaaggcucug

SEQ ID NO: 4016659 - RNA, 19 nt, Human T-lymphotropic virus 1
caguccaagcagcaguggc

SEQ ID NO: 4016660 - RNA, 14 nt, Human T-lymphotropic virus 1
caguuccagcccua

SEQ ID NO: 4016661 - RNA, 19 nt, Human T-lymphotropic virus 1
cauaacucccucauccugc

SEQ ID NO: 4016662 - RNA, 19 nt, Human T-lymphotropic virus 1
cauauccucgagcccucua

SEQ ID NO: 4016663 - RNA, 15 nt, Human T-lymphotropic virus 1
cauauccugcagccc

SEQ ID NO: 4016664 - RNA, 20 nt, Human T-lymphotropic virus 1
cauccucggugauuacagcc

SEQ ID NO: 4016665 - RNA, 21 nt, Human T-lymphotropic virus 1
caucguuagcgcuuccagccc

SEQ ID NO: 4016666 - RNA, 18 nt, Human T-lymphotropic virus 1
caugcuuauuaucagccc

SEQ ID NO: 4016667 - RNA, 19 nt, Human T-lymphotropic virus 1
caugcuuauuaucagccca

SEQ ID NO: 4016668 - RNA, 17 nt, Human T-lymphotropic virus 1
cauggacccucgaccug

SEQ ID NO: 4016669 - RNA, 13 nt, Human T-lymphotropic virus 1
cauucccccuucc

SEQ ID NO: 4016670 - RNA, 12 nt, Human T-lymphotropic virus 1
cauucuccuggc

SEQ ID NO: 4016671 - RNA, 22 nt, Human T-lymphotropic virus 1
cauucuccuggcaagccccucc

SEQ ID NO: 4016672 - RNA, 14 nt, Human T-lymphotropic virus 1
cauucuuaaaaccc

SEQ ID NO: 4016673 - RNA, 22 nt, Human T-lymphotropic virus 1
ccaaacccugccccuccuaggg

SEQ ID NO: 4016674 - RNA, 12 nt, Human T-lymphotropic virus 1
ccaacugccaca

SEQ ID NO: 4016675 - RNA, 19 nt, Human T-lymphotropic virus 1
ccaaggauaauagcccguc

SEQ ID NO: 4016676 - RNA, 13 nt, Human T-lymphotropic virus 1
ccaauuccuccac

SEQ ID NO: 4016677 - RNA, 15 nt, Human T-lymphotropic virus 1
ccaauuccuccacca

SEQ ID NO: 4016678 - RNA, 19 nt, Human T-lymphotropic virus 1
ccacaucgccuccagccuc

SEQ ID NO: 4016679 - RNA, 17 nt, Human T-lymphotropic virus 1
ccaccaauuccuccacc

SEQ ID NO: 4016680 - RNA, 16 nt, Human T-lymphotropic virus 1
ccacccauuuccuccc

SEQ ID NO: 4016681 - RNA, 13 nt, Human T-lymphotropic virus 1
ccaccccggccag

SEQ ID NO: 4016682 - RNA, 19 nt, Human T-lymphotropic virus 1
ccacccuccuuccuccagg

SEQ ID NO: 4016683 - RNA, 18 nt, Human T-lymphotropic virus 1
ccaccucgccuuccaacu

SEQ ID NO: 4016684 - RNA, 16 nt, Human T-lymphotropic virus 1
ccacucaacccucacc

SEQ ID NO: 4016685 - RNA, 18 nt, Human T-lymphotropic virus 1
ccacucaacccucaccac

SEQ ID NO: 4016686 - RNA, 18 nt, Human T-lymphotropic virus 1
ccagaacgccuccaggcc

SEQ ID NO: 4016687 - RNA, 23 nt, Human T-lymphotropic virus 1
ccagauugacacccagaccagcc

SEQ ID NO: 4016688 - RNA, 15 nt, Human T-lymphotropic virus 1
ccagcaaaccccugg

SEQ ID NO: 4016689 - RNA, 14 nt, Human T-lymphotropic virus 1
ccagccugccaacu

SEQ ID NO: 4016690 - RNA, 15 nt, Human T-lymphotropic virus 1
ccagcuaccaugcca

SEQ ID NO: 4016691 - RNA, 22 nt, Human T-lymphotropic virus 1
ccagcucggggccuuccucacc

SEQ ID NO: 4016692 - RNA, 19 nt, Human T-lymphotropic virus 1
ccagcuuuccccccccauc

SEQ ID NO: 4016693 - RNA, 20 nt, Human T-lymphotropic virus 1
ccaggcucaacgcucucaca

SEQ ID NO: 4016694 - RNA, 13 nt, Human T-lymphotropic virus 1
ccauagaucucuc

SEQ ID NO: 4016695 - RNA, 22 nt, Human T-lymphotropic virus 1
ccaugcuuauuaucagcccacu

SEQ ID NO: 4016696 - RNA, 16 nt, Human T-lymphotropic virus 1
ccaugucccucgccuc

SEQ ID NO: 4016697 - RNA, 23 nt, Human T-lymphotropic virus 1
ccaugugauuuuuugccaccccg

SEQ ID NO: 4016698 - RNA, 21 nt, Human T-lymphotropic virus 1
ccauuacucucuuauaaaccc

SEQ ID NO: 4016699 - RNA, 15 nt, Human T-lymphotropic virus 1
ccauuuccuccccau

SEQ ID NO: 4016700 - RNA, 13 nt, Human T-lymphotropic virus 1
cccaacuccugca

SEQ ID NO: 4016701 - RNA, 21 nt, Human T-lymphotropic virus 1
cccacccuugggcagcaccuc

SEQ ID NO: 4016702 - RNA, 20 nt, Human T-lymphotropic virus 1
cccacugcuuugacccccag

SEQ ID NO: 4016703 - RNA, 18 nt, Human T-lymphotropic virus 1
cccagaauaaggcucuga

SEQ ID NO: 4016704 - RNA, 21 nt, Human T-lymphotropic virus 1
cccagccaacugccucccacc

SEQ ID NO: 4016705 - RNA, 12 nt, Human T-lymphotropic virus 1
cccauauccugc

SEQ ID NO: 4016706 - RNA, 17 nt, Human T-lymphotropic virus 1
cccaucaccuggccccu

SEQ ID NO: 4016707 - RNA, 23 nt, Human T-lymphotropic virus 1
cccaucaccuggccccuccugcc

SEQ ID NO: 4016708 - RNA, 15 nt, Human T-lymphotropic virus 1
ccccaacauuccacc

SEQ ID NO: 4016709 - RNA, 23 nt, Human T-lymphotropic virus 1
ccccaguguuccuaucuuacucc

SEQ ID NO: 4016710 - RNA, 22 nt, Human T-lymphotropic virus 1
ccccauguuugucaagccgucc

SEQ ID NO: 4016711 - RNA, 18 nt, Human T-lymphotropic virus 1
cccccgaaaucagccagu

SEQ ID NO: 4016712 - RNA, 23 nt, Human T-lymphotropic virus 1
ccccuacaauccaaccagcuccg

SEQ ID NO: 4016713 - RNA, 19 nt, Human T-lymphotropic virus 1
ccccuacuggaaauuucag

SEQ ID NO: 4016714 - RNA, 12 nt, Human T-lymphotropic virus 1
cccgacuccagc

SEQ ID NO: 4016715 - RNA, 13 nt, Human T-lymphotropic virus 1
cccgcuuccugcg

SEQ ID NO: 4016716 - RNA, 16 nt, Human T-lymphotropic virus 1
cccguaauuaaagccc

SEQ ID NO: 4016717 - RNA, 14 nt, Human T-lymphotropic virus 1
cccguggaggcucc

SEQ ID NO: 4016718 - RNA, 15 nt, Human T-lymphotropic virus 1
cccguggaggcuccu

SEQ ID NO: 4016719 - RNA, 17 nt, Human T-lymphotropic virus 1
cccuaauaauucuaccc

SEQ ID NO: 4016720 - RNA, 18 nt, Human T-lymphotropic virus 1
cccuaaucucccaugggu

SEQ ID NO: 4016721 - RNA, 16 nt, Human T-lymphotropic virus 1
cccuacuggccaccug

SEQ ID NO: 4016722 - RNA, 17 nt, Human T-lymphotropic virus 1
cccuccuuccuccaggc

SEQ ID NO: 4016723 - RNA, 16 nt, Human T-lymphotropic virus 1
cccucgaccugcuggc

SEQ ID NO: 4016724 - RNA, 14 nt, Human T-lymphotropic virus 1
cccucgacuccccu

SEQ ID NO: 4016725 - RNA, 22 nt, Human T-lymphotropic virus 1
cccugacuuguccagccugcca

SEQ ID NO: 4016726 - RNA, 15 nt, Human T-lymphotropic virus 1
aaacaguuccagccc

SEQ ID NO: 4016727 - RNA, 15 nt, Human T-lymphotropic virus 1
aaagauggccagcca

SEQ ID NO: 4016728 - RNA, 14 nt, Human T-lymphotropic virus 1
aaauugcacaguau

SEQ ID NO: 4016729 - RNA, 22 nt, Human T-lymphotropic virus 1
aacacuuuucuuaaaacaacug

SEQ ID NO: 4016730 - RNA, 17 nt, Human T-lymphotropic virus 1
aacaucagaugccucaa

SEQ ID NO: 4016731 - RNA, 14 nt, Human T-lymphotropic virus 1
aacaucuugccuag

SEQ ID NO: 4016732 - RNA, 22 nt, Human T-lymphotropic virus 1
aaccaauucauucaaacaucug

SEQ ID NO: 4016733 - RNA, 19 nt, Human T-lymphotropic virus 1
aaccacaacugaggccucc

SEQ ID NO: 4016734 - RNA, 22 nt, Human T-lymphotropic virus 1
aaccacaucgccuccagccucc

SEQ ID NO: 4016735 - RNA, 23 nt, Human T-lymphotropic virus 1
aacgcucuaauggcauucuuaaa

SEQ ID NO: 4016736 - RNA, 19 nt, Human T-lymphotropic virus 1
aagcgcuaguucugcccag

SEQ ID NO: 4016737 - RNA, 16 nt, Human T-lymphotropic virus 1
aagucagcggccuucu

SEQ ID NO: 4016738 - RNA, 19 nt, Human T-lymphotropic virus 1
aagucagcggccuucuccu

SEQ ID NO: 4016739 - RNA, 18 nt, Human T-lymphotropic virus 1
aauagaaaaacuccucua

SEQ ID NO: 4016740 - RNA, 16 nt, Human T-lymphotropic virus 1
aaucauggaccugccc

SEQ ID NO: 4016741 - RNA, 19 nt, Human T-lymphotropic virus 1
aauccuccuucuccugcag

SEQ ID NO: 4016742 - RNA, 20 nt, Human T-lymphotropic virus 1
aaucugcuuuuccuccucuu

SEQ ID NO: 4016743 - RNA, 12 nt, Human T-lymphotropic virus 1
aaugccaaggcg

SEQ ID NO: 4016744 - RNA, 13 nt, Human T-lymphotropic virus 1
acaaaacccagca

SEQ ID NO: 4016745 - RNA, 14 nt, Human T-lymphotropic virus 1
acaaccccucaccu

SEQ ID NO: 4016746 - RNA, 19 nt, Human T-lymphotropic virus 1
acaaccccucaccucaaaa

SEQ ID NO: 4016747 - RNA, 22 nt, Human T-lymphotropic virus 1
acaagcucagaagcuauuuccu

SEQ ID NO: 4016748 - RNA, 13 nt, Human T-lymphotropic virus 1
acaaucaaccacc

SEQ ID NO: 4016749 - RNA, 16 nt, Human T-lymphotropic virus 1
acaauccaaccagcuc

SEQ ID NO: 4016750 - RNA, 20 nt, Human T-lymphotropic virus 1
acacauucccucagcaauaa

SEQ ID NO: 4016751 - RNA, 23 nt, Human T-lymphotropic virus 1
acaccuuuucaggagccaucuca

SEQ ID NO: 4016752 - RNA, 15 nt, Human T-lymphotropic virus 1
acacuagccagugcc

SEQ ID NO: 4016753 - RNA, 11 nt, Human T-lymphotropic virus 1
acagcucagca

SEQ ID NO: 4016754 - RNA, 15 nt, Human T-lymphotropic virus 1
acaguuuccuccucc

SEQ ID NO: 4016755 - RNA, 17 nt, Human T-lymphotropic virus 1
acaucauaacaucucca

SEQ ID NO: 4016756 - RNA, 21 nt, Human T-lymphotropic virus 1
acaucgccuccagccuccccu

SEQ ID NO: 4016757 - RNA, 18 nt, Human T-lymphotropic virus 1
acauggaugacauucucc

SEQ ID NO: 4016758 - RNA, 17 nt, Human T-lymphotropic virus 1
acauuccacccuccuuc

SEQ ID NO: 4016759 - RNA, 19 nt, Human T-lymphotropic virus 1
accacaaaaaucugcucaa

SEQ ID NO: 4016760 - RNA, 16 nt, Human T-lymphotropic virus 1
accacccauuuccucc

SEQ ID NO: 4016761 - RNA, 13 nt, Human T-lymphotropic virus 1
accacccuuuucc

SEQ ID NO: 4016762 - RNA, 23 nt, Human T-lymphotropic virus 1
accacuccccccgacuccagccg

SEQ ID NO: 4016763 - RNA, 16 nt, Human T-lymphotropic virus 1
accacucuaaacccug

SEQ ID NO: 4016764 - RNA, 17 nt, Human T-lymphotropic virus 1
accaugcauccuccguc

SEQ ID NO: 4016765 - RNA, 16 nt, Human T-lymphotropic virus 1
accccuguccugcagc

SEQ ID NO: 4016766 - RNA, 16 nt, Human T-lymphotropic virus 1
acccucgaccugcugg

SEQ ID NO: 4016767 - RNA, 18 nt, Human T-lymphotropic virus 1
acccucgaccugcuggcc

SEQ ID NO: 4016768 - RNA, 17 nt, Human T-lymphotropic virus 1
acccugcaauccugccc

SEQ ID NO: 4016769 - RNA, 18 nt, Human T-lymphotropic virus 1
acccugcaauccugccca

SEQ ID NO: 4016770 - RNA, 13 nt, Human T-lymphotropic virus 1
acccugccccucc

SEQ ID NO: 4016771 - RNA, 20 nt, Human T-lymphotropic virus 1
acccuguucgaaaugcagcu

SEQ ID NO: 4016772 - RNA, 16 nt, Human T-lymphotropic virus 1
acccuugcccuaggca

SEQ ID NO: 4016773 - RNA, 14 nt, Human T-lymphotropic virus 1
acccuuguuccuua

SEQ ID NO: 4016774 - RNA, 23 nt, Human T-lymphotropic virus 1
acccuuguuccuuaaaaugccca

SEQ ID NO: 4016775 - RNA, 16 nt, Human T-lymphotropic virus 1
cucaacccucaccacu

SEQ ID NO: 4016776 - RNA, 21 nt, Human T-lymphotropic virus 1
cucaccucccuuccugugcua

SEQ ID NO: 4016777 - RNA, 23 nt, Human T-lymphotropic virus 1
cucacggcgcuccugcucuuccu

SEQ ID NO: 4016778 - RNA, 23 nt, Human T-lymphotropic virus 1
cucagcaaucugcuuuuccuccu

SEQ ID NO: 4016779 - RNA, 21 nt, Human T-lymphotropic virus 1
cucaggcccccuuucaggccc

SEQ ID NO: 4016780 - RNA, 16 nt, Human T-lymphotropic virus 1
cucaggcuaggcccug

SEQ ID NO: 4016781 - RNA, 19 nt, Human T-lymphotropic virus 1
cucagugaaaaacauuucc

SEQ ID NO: 4016782 - RNA, 22 nt, Human T-lymphotropic virus 1
cucauacaguacucuuccuuuc

SEQ ID NO: 4016783 - RNA, 14 nt, Human T-lymphotropic virus 1
cuccacgcuuugcc

SEQ ID NO: 4016784 - RNA, 16 nt, Human T-lymphotropic virus 1
cuccagccuccccugc

SEQ ID NO: 4016785 - RNA, 19 nt, Human T-lymphotropic virus 1
cuccagccuccccugccaa

SEQ ID NO: 4016786 - RNA, 23 nt, Human T-lymphotropic virus 1
cuccaggccaugcgcaaauacuc

SEQ ID NO: 4016787 - RNA, 20 nt, Human T-lymphotropic virus 1
cucccaucaaauccuccuuc

SEQ ID NO: 4016788 - RNA, 21 nt, Human T-lymphotropic virus 1
cucccccugucauaacucccu

SEQ ID NO: 4016789 - RNA, 11 nt, Human T-lymphotropic virus 1
cucccccuucc

SEQ ID NO: 4016790 - RNA, 19 nt, Human T-lymphotropic virus 1
cucccuuggagccuaccua

SEQ ID NO: 4016791 - RNA, 14 nt, Human T-lymphotropic virus 1
cuccgcccuggcca

SEQ ID NO: 4016792 - RNA, 16 nt, Human T-lymphotropic virus 1
cuccgggaagccaccg

SEQ ID NO: 4016793 - RNA, 17 nt, Human T-lymphotropic virus 1
cuccgggaagccaccgg

SEQ ID NO: 4016794 - RNA, 22 nt, Human T-lymphotropic virus 1
cuccgucagcuacgacaccucc

SEQ ID NO: 4016795 - RNA, 14 nt, Human T-lymphotropic virus 1
cuccguucagccuc

SEQ ID NO: 4016796 - RNA, 15 nt, Human T-lymphotropic virus 1
cuccguugucugcau

SEQ ID NO: 4016797 - RNA, 13 nt, Human T-lymphotropic virus 1
cuccucuuccuuc

SEQ ID NO: 4016798 - RNA, 20 nt, Human T-lymphotropic virus 1
cuccucuuccuuccuuuuca

SEQ ID NO: 4016799 - RNA, 22 nt, Human T-lymphotropic virus 1
cuccugcauuuuuucuuuccua

SEQ ID NO: 4016800 - RNA, 18 nt, Human T-lymphotropic virus 1
cuccuggcaagccccucc

SEQ ID NO: 4016801 - RNA, 18 nt, Human T-lymphotropic virus 1
cuccugugaaagcccuua

SEQ ID NO: 4016802 - RNA, 15 nt, Human T-lymphotropic virus 1
cuccuucuccugcag

SEQ ID NO: 4016803 - RNA, 16 nt, Human T-lymphotropic virus 1
cuccuucuccugcagc

SEQ ID NO: 4016804 - RNA, 22 nt, Human T-lymphotropic virus 1
cuccuuguccuuuaacucuucc

SEQ ID NO: 4016805 - RNA, 12 nt, Human T-lymphotropic virus 1
cucgagaagccu

SEQ ID NO: 4016806 - RNA, 20 nt, Human T-lymphotropic virus 1
cucgccucaggaaagagccu

SEQ ID NO: 4016807 - RNA, 17 nt, Human T-lymphotropic virus 1
cucuacucucccacucu

SEQ ID NO: 4016808 - RNA, 17 nt, Human T-lymphotropic virus 1
cucucaggcccccuuuc

SEQ ID NO: 4016809 - RNA, 18 nt, Human T-lymphotropic virus 1
cucucaggcccccuuuca

SEQ ID NO: 4016810 - RNA, 15 nt, Human T-lymphotropic virus 1
cucucuuauaaaccc

SEQ ID NO: 4016811 - RNA, 17 nt, Human T-lymphotropic virus 1
cucugccaaaccauaca

SEQ ID NO: 4016812 - RNA, 22 nt, Human T-lymphotropic virus 1
cucuguuccauccccuucuucu

SEQ ID NO: 4016813 - RNA, 12 nt, Human T-lymphotropic virus 1
cucuuccuccaa

SEQ ID NO: 4016814 - RNA, 14 nt, Human T-lymphotropic virus 1
cucuuccugcuuuc

SEQ ID NO: 4016815 - RNA, 12 nt, Human T-lymphotropic virus 1
cucuuccuuccu

SEQ ID NO: 4016816 - RNA, 13 nt, Human T-lymphotropic virus 1
cucuucuccucag

SEQ ID NO: 4016817 - RNA, 15 nt, Human T-lymphotropic virus 1
cucuugccacgccug

SEQ ID NO: 4016818 - RNA, 16 nt, Human T-lymphotropic virus 1
cucuuugcuccaggcc

SEQ ID NO: 4016819 - RNA, 16 nt, Human T-lymphotropic virus 1
cugaacuucaagcccu

SEQ ID NO: 4016820 - RNA, 20 nt, Human T-lymphotropic virus 1
cugacaaacccgaccuaccu

SEQ ID NO: 4016821 - RNA, 21 nt, Human T-lymphotropic virus 1
cugacaaacccgaccuaccua

SEQ ID NO: 4016822 - RNA, 15 nt, Human T-lymphotropic virus 1
cugacgucucccccc

SEQ ID NO: 4016823 - RNA, 20 nt, Human T-lymphotropic virus 1
cugacuuguccagccugcca

SEQ ID NO: 4016824 - RNA, 18 nt, Human T-lymphotropic virus 1
cugaucccaucuccaggc

SEQ ID NO: 4016825 - RNA, 18 nt, Human T-lymphotropic virus 1
cugauccccgagaccaaa

SEQ ID NO: 4016826 - RNA, 21 nt, Human T-lymphotropic virus 1
cugcaacuacucucagaggcc

SEQ ID NO: 4016827 - RNA, 16 nt, Human T-lymphotropic virus 1
cugcaauccugcccag

SEQ ID NO: 4016828 - RNA, 19 nt, Human T-lymphotropic virus 1
cugcagcccauucggcaag

SEQ ID NO: 4016829 - RNA, 16 nt, Human T-lymphotropic virus 1
cugcagcucucuccug

SEQ ID NO: 4016830 - RNA, 15 nt, Human T-lymphotropic virus 1
cugcaugcccaagac

SEQ ID NO: 4016831 - RNA, 22 nt, Human T-lymphotropic virus 1
cugccaauaauuaaccucuccc

SEQ ID NO: 4016832 - RNA, 13 nt, Human T-lymphotropic virus 1
cugccccuccuag

SEQ ID NO: 4016833 - RNA, 20 nt, Human T-lymphotropic virus 1
cugcccuaaagauggccagc

SEQ ID NO: 4016834 - RNA, 15 nt, Human T-lymphotropic virus 1
cugccuauauuuccc

SEQ ID NO: 4016835 - RNA, 16 nt, Human T-lymphotropic virus 1
cugccuauauuuccca

SEQ ID NO: 4016836 - RNA, 23 nt, Human T-lymphotropic virus 1
cugccucccaccgccccuccucu

SEQ ID NO: 4016837 - RNA, 13 nt, Human T-lymphotropic virus 1
cugcuagggcacc

SEQ ID NO: 4016838 - RNA, 13 nt, Human T-lymphotropic virus 1
cugcuggcccuuu

SEQ ID NO: 4016839 - RNA, 15 nt, Human T-lymphotropic virus 1
cugcuggcccuuuca

SEQ ID NO: 4016840 - RNA, 16 nt, Human T-lymphotropic virus 1
cuggccaccuguccag

SEQ ID NO: 4016841 - RNA, 14 nt, Human T-lymphotropic virus 1
cuggccccuccugc

SEQ ID NO: 4016842 - RNA, 16 nt, Human T-lymphotropic virus 1
cuggccccuccugccc

SEQ ID NO: 4016843 - RNA, 16 nt, Human T-lymphotropic virus 1
cuuaaaacaacugccc

SEQ ID NO: 4016844 - RNA, 19 nt, Human T-lymphotropic virus 1
cuuacuccaccacagucac

SEQ ID NO: 4016845 - RNA, 14 nt, Human T-lymphotropic virus 1
cuuauaaacccuga

SEQ ID NO: 4016846 - RNA, 15 nt, Human T-lymphotropic virus 1
cuuaugccaguguuu

SEQ ID NO: 4016847 - RNA, 22 nt, Human T-lymphotropic virus 1
cuucauguauggguagacaccu

SEQ ID NO: 4016848 - RNA, 19 nt, Human T-lymphotropic virus 1
cuuccagccccccaccuga

SEQ ID NO: 4016849 - RNA, 18 nt, Human T-lymphotropic virus 1
cuuccaguucugcccccu

SEQ ID NO: 4016850 - RNA, 18 nt, Human T-lymphotropic virus 1
cuucuccugcagcaaccu

SEQ ID NO: 4016851 - RNA, 19 nt, Human T-lymphotropic virus 1
cuucuuuucggauacccag

SEQ ID NO: 4016852 - RNA, 19 nt, Human T-lymphotropic virus 1
cuuggagccuaccuagacu

SEQ ID NO: 4016853 - RNA, 16 nt, Human T-lymphotropic virus 1
cuugggcagcaccucc

SEQ ID NO: 4016854 - RNA, 19 nt, Human T-lymphotropic virus 1
cuuguccagccugccaacu

SEQ ID NO: 4016855 - RNA, 22 nt, Human T-lymphotropic virus 1
cuugucuccgcccuggccaugg

SEQ ID NO: 4016856 - RNA, 15 nt, Human T-lymphotropic virus 1
cuuuggaacacuuuu

SEQ ID NO: 4016857 - RNA, 13 nt, Human T-lymphotropic virus 1
cuuuuccagccug

SEQ ID NO: 4016858 - RNA, 16 nt, Human T-lymphotropic virus 1
cuuuuccuugucaccu

SEQ ID NO: 4016859 - RNA, 19 nt, Human T-lymphotropic virus 1
gaaaggaccacaggaggcu

SEQ ID NO: 4016860 - RNA, 21 nt, Human T-lymphotropic virus 1
gaaauaacccaguauucccag

SEQ ID NO: 4016861 - RNA, 16 nt, Human T-lymphotropic virus 1
gaacccacccuugggc

SEQ ID NO: 4016862 - RNA, 14 nt, Human T-lymphotropic virus 1
gacacccagaccag

SEQ ID NO: 4016863 - RNA, 15 nt, Human T-lymphotropic virus 1
gacaccuccccucgc

SEQ ID NO: 4016864 - RNA, 19 nt, Human T-lymphotropic virus 1
gaccaccaacaccaugggu

SEQ ID NO: 4016865 - RNA, 22 nt, Human T-lymphotropic virus 1
gacccaacaucuauucugccag

SEQ ID NO: 4016866 - RNA, 11 nt, Human T-lymphotropic virus 1
gacccccccuu

SEQ ID NO: 4016867 - RNA, 19 nt, Human T-lymphotropic virus 1
gacccugcuugcucaacuc

SEQ ID NO: 4016868 - RNA, 14 nt, Human T-lymphotropic virus 1
gacccuugcccuag

SEQ ID NO: 4016869 - RNA, 18 nt, Human T-lymphotropic virus 1
gaccuccgggaagccacc

SEQ ID NO: 4016870 - RNA, 17 nt, Human T-lymphotropic virus 1
gacuccaccucgccuuc

SEQ ID NO: 4016871 - RNA, 15 nt, Human T-lymphotropic virus 1
gacuuguccagccug

SEQ ID NO: 4016872 - RNA, 13 nt, Human T-lymphotropic virus 1
gagagaccccccc

SEQ ID NO: 4016873 - RNA, 19 nt, Human T-lymphotropic virus 1
gagagacccccccuugaaa

SEQ ID NO: 4016874 - RNA, 14 nt, Human T-lymphotropic virus 1
gagauucagugggu

SEQ ID NO: 4016875 - RNA, 14 nt, Human T-lymphotropic virus 1
gagcugcaugccca

SEQ ID NO: 4016876 - RNA, 19 nt, Human T-lymphotropic virus 1
gaggacagcucagcaccag

SEQ ID NO: 4016877 - RNA, 18 nt, Human T-lymphotropic virus 1
gaggcuauuauucagccu

SEQ ID NO: 4016878 - RNA, 20 nt, Human T-lymphotropic virus 1
gauacauggaacccacccuu

SEQ ID NO: 4016879 - RNA, 14 nt, Human T-lymphotropic virus 1
gaucaccugggacc

SEQ ID NO: 4016880 - RNA, 22 nt, Human T-lymphotropic virus 1
gaucaggcccuacagccacccu

SEQ ID NO: 4016881 - RNA, 14 nt, Human T-lymphotropic virus 1
gauccaccucccag

SEQ ID NO: 4016882 - RNA, 19 nt, Human T-lymphotropic virus 1
gaucccguggaggcuccuc

SEQ ID NO: 4016883 - RNA, 23 nt, Human T-lymphotropic virus 1
gauucaaaaauuuaggugcccag

SEQ ID NO: 4016884 - RNA, 14 nt, Human T-lymphotropic virus 1
gcaaauacuccccc

SEQ ID NO: 4016885 - RNA, 18 nt, Human T-lymphotropic virus 1
gcaaccacaucgccucca

SEQ ID NO: 4016886 - RNA, 22 nt, Human T-lymphotropic virus 1
gcaauagucaaaaaccacaaaa

SEQ ID NO: 4016887 - RNA, 18 nt, Human T-lymphotropic virus 1
gcacaguaugcugcccag

SEQ ID NO: 4016888 - RNA, 13 nt, Human T-lymphotropic virus 1
gcaccaccacugu

SEQ ID NO: 4016889 - RNA, 22 nt, Human T-lymphotropic virus 1
gcacuaugcuguuucgccuucu

SEQ ID NO: 4016890 - RNA, 18 nt, Human T-lymphotropic virus 1
gcagccuauauucucugg

SEQ ID NO: 4016891 - RNA, 13 nt, Human T-lymphotropic virus 1
gcaguccccaagg

SEQ ID NO: 4016892 - RNA, 14 nt, Human T-lymphotropic virus 1
gcaucagaucaccu

SEQ ID NO: 4016893 - RNA, 13 nt, Human T-lymphotropic virus 1
gcaugcccaagac

SEQ ID NO: 4016894 - RNA, 14 nt, Human T-lymphotropic virus 1
gcauucuuaaaacc

SEQ ID NO: 4016895 - RNA, 19 nt, Human T-lymphotropic virus 1
gccaguucccuuuaaacca

SEQ ID NO: 4016896 - RNA, 20 nt, Human T-lymphotropic virus 1
gcccaccacccuuuuccagc

SEQ ID NO: 4016897 - RNA, 14 nt, Human T-lymphotropic virus 1
gccccagcugcugu

SEQ ID NO: 4016898 - RNA, 19 nt, Human T-lymphotropic virus 1
gcccuacagccacccugcc

SEQ ID NO: 4016899 - RNA, 14 nt, Human T-lymphotropic virus 1
gcccuacuggccac

SEQ ID NO: 4016900 - RNA, 19 nt, Human T-lymphotropic virus 1
gcccuacuuugcuuucacu

SEQ ID NO: 4016901 - RNA, 23 nt, Human T-lymphotropic virus 1
gcccugccuauauuucccaagac

SEQ ID NO: 4016902 - RNA, 16 nt, Human T-lymphotropic virus 1
gccgucuccagccccu

SEQ ID NO: 4016903 - RNA, 22 nt, Human T-lymphotropic virus 1
gccgucuccagccccuacugga

SEQ ID NO: 4016904 - RNA, 23 nt, Human T-lymphotropic virus 1
gccguggccuacucccuaaccac

SEQ ID NO: 4016905 - RNA, 17 nt, Human T-lymphotropic virus 1
gccuaucuaggcaagcc

SEQ ID NO: 4016906 - RNA, 18 nt, Human T-lymphotropic virus 1
gccuaugauuuccgggcc

SEQ ID NO: 4016907 - RNA, 20 nt, Human T-lymphotropic virus 1
gccuaugauuuccgggcccu

SEQ ID NO: 4016908 - RNA, 19 nt, Human T-lymphotropic virus 1
gccucaggaaagagccucc

SEQ ID NO: 4016909 - RNA, 21 nt, Human T-lymphotropic virus 1
gccucccaccgccccuccucu

SEQ ID NO: 4016910 - RNA, 15 nt, Human T-lymphotropic virus 1
gccuucucagccccu

SEQ ID NO: 4016911 - RNA, 18 nt, Human T-lymphotropic virus 1
gccuucuccucuuccuuc

SEQ ID NO: 4016912 - RNA, 16 nt, Human T-lymphotropic virus 1
gcgccgugccuucucc

SEQ ID NO: 4016913 - RNA, 16 nt, Human T-lymphotropic virus 1
gcgcuaguucugccca

SEQ ID NO: 4016914 - RNA, 13 nt, Human T-lymphotropic virus 1
gcgcuccugcucu

SEQ ID NO: 4016915 - RNA, 13 nt, Human T-lymphotropic virus 1
gcgcuuccagccc

SEQ ID NO: 4016916 - RNA, 13 nt, Human T-lymphotropic virus 1
gcuagaacaccuc

SEQ ID NO: 4016917 - RNA, 18 nt, Human T-lymphotropic virus 1
gcucagaagcuauuuccu

SEQ ID NO: 4016918 - RNA, 18 nt, Human T-lymphotropic virus 1
gcucagcaccagcucagg

SEQ ID NO: 4016919 - RNA, 19 nt, Human T-lymphotropic virus 1
gcucaggcuaggcccugac

SEQ ID NO: 4016920 - RNA, 18 nt, Human T-lymphotropic virus 1
gcuccugcucuuccugcu

SEQ ID NO: 4016921 - RNA, 14 nt, Human T-lymphotropic virus 1
gcucucacagaugc

SEQ ID NO: 4016922 - RNA, 19 nt, Human T-lymphotropic virus 1
gcucucacagaugcccuac

SEQ ID NO: 4016923 - RNA, 17 nt, Human T-lymphotropic virus 1
gcucuucaagaagcugc

SEQ ID NO: 4016924 - RNA, 13 nt, Human T-lymphotropic virus 1
gcugcccagaaca

SEQ ID NO: 4016925 - RNA, 14 nt, Human T-lymphotropic virus 1
gcuucaccacuccc

SEQ ID NO: 4016926 - RNA, 16 nt, Human T-lymphotropic virus 1
gcuuccucuucuccuc

SEQ ID NO: 4016927 - RNA, 19 nt, Human T-lymphotropic virus 1
gcuuccucuucuccucagc

SEQ ID NO: 4016928 - RNA, 23 nt, Human T-lymphotropic virus 1
gcuuccucuucuccucagcccgu

SEQ ID NO: 4016929 - RNA, 14 nt, Human T-lymphotropic virus 1
gcuugcucaacucu

SEQ ID NO: 4016930 - RNA, 14 nt, Human T-lymphotropic virus 1
ggaaauaacccagu

SEQ ID NO: 4016931 - RNA, 23 nt, Human T-lymphotropic virus 1
ggacuccaccucgccuuccaacu

SEQ ID NO: 4016932 - RNA, 22 nt, Human T-lymphotropic virus 1
ggagccuaccuagacucagccg

SEQ ID NO: 4016933 - RNA, 21 nt, Human T-lymphotropic virus 1
ggaggcuauuauucagccucu

SEQ ID NO: 4016934 - RNA, 14 nt, Human T-lymphotropic virus 1
ggauccaccuccca

SEQ ID NO: 4016935 - RNA, 15 nt, Human T-lymphotropic virus 1
ggauccaccucccag

SEQ ID NO: 4016936 - RNA, 23 nt, Human T-lymphotropic virus 1
ggcacgccuaugauuuccgggcc

SEQ ID NO: 4016937 - RNA, 15 nt, Human T-lymphotropic virus 1
ggcagguccucucag

SEQ ID NO: 4016938 - RNA, 21 nt, Human T-lymphotropic virus 1
ggcccagaauaaggcucugac

SEQ ID NO: 4016939 - RNA, 15 nt, Human T-lymphotropic virus 1
ggccccuccugcccc

SEQ ID NO: 4016940 - RNA, 16 nt, Human T-lymphotropic virus 1
ggccccuccugcccca

SEQ ID NO: 4016941 - RNA, 22 nt, Human T-lymphotropic virus 1
ggccuacucccuaaccacaucu

SEQ ID NO: 4016942 - RNA, 18 nt, Human T-lymphotropic virus 1
ggcgcucccuuggagccu

SEQ ID NO: 4016943 - RNA, 15 nt, Human T-lymphotropic virus 1
ggcgcuuuccccccu

SEQ ID NO: 4016944 - RNA, 16 nt, Human T-lymphotropic virus 1
ggcucugacgucuccc

SEQ ID NO: 4016945 - RNA, 22 nt, Human T-lymphotropic virus 1
gggccuuaacugggaccuuggc

SEQ ID NO: 4016946 - RNA, 16 nt, Human T-lymphotropic virus 1
gguccggaaggcccug

SEQ ID NO: 4016947 - RNA, 22 nt, Human T-lymphotropic virus 1
ggugccaaucauggaccugccc

SEQ ID NO: 4016948 - RNA, 23 nt, Human T-lymphotropic virus 1
ggugccaaucauggaccugcccc

SEQ ID NO: 4016949 - RNA, 23 nt, Human T-lymphotropic virus 1
guaagcgcuaguucugcccagug

SEQ ID NO: 4016950 - RNA, 19 nt, Human T-lymphotropic virus 1
guacuacaguccuccuccu

SEQ ID NO: 4016951 - RNA, 20 nt, Human T-lymphotropic virus 1
guccaccaauuccuccacca

SEQ ID NO: 4016952 - RNA, 12 nt, Human T-lymphotropic virus 1
guccugcagcuc

SEQ ID NO: 4016953 - RNA, 20 nt, Human T-lymphotropic virus 1
guccugcagcucucuccugc

SEQ ID NO: 4016954 - RNA, 16 nt, Human T-lymphotropic virus 1
gucuauuugcaccacg

SEQ ID NO: 4016955 - RNA, 22 nt, Human T-lymphotropic virus 1
gucuccaaaggaacuccuaccu

SEQ ID NO: 4016956 - RNA, 15 nt, Human T-lymphotropic virus 1
gucuccagccccuac

SEQ ID NO: 4016957 - RNA, 17 nt, Human T-lymphotropic virus 1
gugaaaaacauuuccgu

SEQ ID NO: 4016958 - RNA, 20 nt, Human T-lymphotropic virus 1
gugcagcugcggcaggcccu

SEQ ID NO: 4016959 - RNA, 19 nt, Human T-lymphotropic virus 1
gugccagccuauccacuug

SEQ ID NO: 4016960 - RNA, 19 nt, Human T-lymphotropic virus 1
guucauggacccucgaccu

SEQ ID NO: 4016961 - RNA, 20 nt, Human T-lymphotropic virus 1
guuccuaucuuacuccacca

SEQ ID NO: 4016962 - RNA, 23 nt, Human T-lymphotropic virus 1
guuccuaucuuacuccaccacag

SEQ ID NO: 4016963 - RNA, 18 nt, Human T-lymphotropic virus 1
guuccuuaaaaugcccau

SEQ ID NO: 4016964 - RNA, 23 nt, Human T-lymphotropic virus 1
guuuucagacggauccaccuccc

SEQ ID NO: 4016965 - RNA, 22 nt, Human T-lymphotropic virus 1
uaaaagcguggggacaguucag

SEQ ID NO: 4016966 - RNA, 15 nt, Human T-lymphotropic virus 1
uaacaucuccaccca

SEQ ID NO: 4016967 - RNA, 16 nt, Human T-lymphotropic virus 1
uaacaucuccacccaa

SEQ ID NO: 4016968 - RNA, 13 nt, Human T-lymphotropic virus 1
uacacaguuucac

SEQ ID NO: 4016969 - RNA, 20 nt, Human T-lymphotropic virus 1
uacaccaacauccccauuuc

SEQ ID NO: 4016970 - RNA, 23 nt, Human T-lymphotropic virus 1
uacaggagccgucuccagccccu

SEQ ID NO: 4016971 - RNA, 13 nt, Human T-lymphotropic virus 1
uacaggcgccagc

SEQ ID NO: 4016972 - RNA, 21 nt, Human T-lymphotropic virus 1
uacaguuccuuaucccucgac

SEQ ID NO: 4016973 - RNA, 19 nt, Human T-lymphotropic virus 1
uacaugccccccuacccca

SEQ ID NO: 4016974 - RNA, 19 nt, Human T-lymphotropic virus 1
uaccaaaaacaacugggcc

SEQ ID NO: 4016975 - RNA, 16 nt, Human T-lymphotropic virus 1
uaccgaacccagccaa

SEQ ID NO: 4016976 - RNA, 17 nt, Human T-lymphotropic virus 1
uaccugaacuucaagcc

SEQ ID NO: 4016977 - RNA, 16 nt, Human T-lymphotropic virus 1
uacgacaccuccccuc

SEQ ID NO: 4016978 - RNA, 17 nt, Human T-lymphotropic virus 1
uacucaagaaguuucac

SEQ ID NO: 4016979 - RNA, 12 nt, Human T-lymphotropic virus 1
uacucccccuuc

SEQ ID NO: 4016980 - RNA, 16 nt, Human T-lymphotropic virus 1
uacugauccccgagac

SEQ ID NO: 4016981 - RNA, 13 nt, Human T-lymphotropic virus 1
uacuggccaccug

SEQ ID NO: 4016982 - RNA, 15 nt, Human T-lymphotropic virus 1
uagacuaguccaaac

SEQ ID NO: 4016983 - RNA, 21 nt, Human T-lymphotropic virus 1
aucaaauccuccuucuccugc

SEQ ID NO: 4016984 - RNA, 17 nt, Human T-lymphotropic virus 1
aucaccuggccccuccu

SEQ ID NO: 4016985 - RNA, 20 nt, Human T-lymphotropic virus 1
aucaggcccuacagccaccc

SEQ ID NO: 4016986 - RNA, 22 nt, Human T-lymphotropic virus 1
aucauaaacaccgccccuugcc

SEQ ID NO: 4016987 - RNA, 15 nt, Human T-lymphotropic virus 1
aucauaagcucagac

SEQ ID NO: 4016988 - RNA, 18 nt, Human T-lymphotropic virus 1
aucauaagcucagaccuc

SEQ ID NO: 4016989 - RNA, 16 nt, Human T-lymphotropic virus 1
auccaccucccaggca

SEQ ID NO: 4016990 - RNA, 22 nt, Human T-lymphotropic virus 1
aucccaaagaaaaagaccacca

SEQ ID NO: 4016991 - RNA, 18 nt, Human T-lymphotropic virus 1
auccccgagaccaaauau

SEQ ID NO: 4016992 - RNA, 20 nt, Human T-lymphotropic virus 1
aucccguggaggcuccucaa

SEQ ID NO: 4016993 - RNA, 18 nt, Human T-lymphotropic virus 1
aucccucgacuccccucc

SEQ ID NO: 4016994 - RNA, 19 nt, Human T-lymphotropic virus 1
auccuccuucuccugcagc

SEQ ID NO: 4016995 - RNA, 22 nt, Human T-lymphotropic virus 1
auccucggugauuacagcccca

SEQ ID NO: 4016996 - RNA, 13 nt, Human T-lymphotropic virus 1
auccugcccagcc

SEQ ID NO: 4016997 - RNA, 21 nt, Human T-lymphotropic virus 1
auccuucucaaguucaaucau

SEQ ID NO: 4016998 - RNA, 18 nt, Human T-lymphotropic virus 1
aucgccuccagccucccc

SEQ ID NO: 4016999 - RNA, 13 nt, Human T-lymphotropic virus 1
aucuauucccuca

SEQ ID NO: 4017000 - RNA, 16 nt, Human T-lymphotropic virus 1
aucugguuccuuaaua

SEQ ID NO: 4017001 - RNA, 17 nt, Human T-lymphotropic virus 1
augacauucuccuggca

SEQ ID NO: 4017002 - RNA, 13 nt, Human T-lymphotropic virus 1
augaccccaucug

SEQ ID NO: 4017003 - RNA, 13 nt, Human T-lymphotropic virus 1
augcgcaaauacu

SEQ ID NO: 4017004 - RNA, 17 nt, Human T-lymphotropic virus 1
augcgguuuuuccuucu

SEQ ID NO: 4017005 - RNA, 22 nt, Human T-lymphotropic virus 1
augcucuauccauagcccuaug

SEQ ID NO: 4017006 - RNA, 13 nt, Human T-lymphotropic virus 1
auggaccugcccc

SEQ ID NO: 4017007 - RNA, 15 nt, Human T-lymphotropic virus 1
auuaaccucucccau

SEQ ID NO: 4017008 - RNA, 18 nt, Human T-lymphotropic virus 1
auuauauaaguacuuuac

SEQ ID NO: 4017009 - RNA, 13 nt, Human T-lymphotropic virus 1
auucggcaagccu

SEQ ID NO: 4017010 - RNA, 18 nt, Human T-lymphotropic virus 1
auucuuaaaacccuauua

SEQ ID NO: 4017011 - RNA, 23 nt, Human T-lymphotropic virus 1
auugacacccagaccagccaccc

SEQ ID NO: 4017012 - RNA, 20 nt, Human T-lymphotropic virus 1
caaaaauuuaggugcccaga

SEQ ID NO: 4017013 - RNA, 18 nt, Human T-lymphotropic virus 1
caaaacccgauggcagcu

SEQ ID NO: 4017014 - RNA, 14 nt, Human T-lymphotropic virus 1
caaaacuccugacu

SEQ ID NO: 4017015 - RNA, 16 nt, Human T-lymphotropic virus 1
caaaacuccugacucu

SEQ ID NO: 4017016 - RNA, 20 nt, Human T-lymphotropic virus 1
caaacaucugaccaccccag

SEQ ID NO: 4017017 - RNA, 17 nt, Human T-lymphotropic virus 1
caaacuggaaucacccu

SEQ ID NO: 4017018 - RNA, 22 nt, Human T-lymphotropic virus 1
caacauauuucuagacuccaag

SEQ ID NO: 4017019 - RNA, 12 nt, Human T-lymphotropic virus 1
caacauuccacc

SEQ ID NO: 4017020 - RNA, 17 nt, Human T-lymphotropic virus 1
caacugccccauuggcu

SEQ ID NO: 4017021 - RNA, 13 nt, Human T-lymphotropic virus 1
caagccccuccca

SEQ ID NO: 4017022 - RNA, 14 nt, Human T-lymphotropic virus 1
caagccccucccau

SEQ ID NO: 4017023 - RNA, 23 nt, Human T-lymphotropic virus 1
caagcuauagucuccucccccug

SEQ ID NO: 4017024 - RNA, 14 nt, Human T-lymphotropic virus 1
caagcucagaagcu

SEQ ID NO: 4017025 - RNA, 13 nt, Human T-lymphotropic virus 1
caaggacacaucc

SEQ ID NO: 4017026 - RNA, 22 nt, Human T-lymphotropic virus 1
caaggcgacauuacccauuuca

SEQ ID NO: 4017027 - RNA, 19 nt, Human T-lymphotropic virus 1
caaggcgacuggugcccca

SEQ ID NO: 4017028 - RNA, 18 nt, Human T-lymphotropic virus 1
caauauguguaccucccu

SEQ ID NO: 4017029 - RNA, 22 nt, Human T-lymphotropic virus 1
caauccuauggacuacucugcc

SEQ ID NO: 4017030 - RNA, 18 nt, Human T-lymphotropic virus 1
cacaauggcuucccuaau

SEQ ID NO: 4017031 - RNA, 15 nt, Human T-lymphotropic virus 1
cacacuagccagugc

SEQ ID NO: 4017032 - RNA, 13 nt, Human T-lymphotropic virus 1
cacagaacugccg

SEQ ID NO: 4017033 - RNA, 15 nt, Human T-lymphotropic virus 1
cacaggaggcucuuc

SEQ ID NO: 4017034 - RNA, 18 nt, Human T-lymphotropic virus 1
cacaguaugcugcccaga

SEQ ID NO: 4017035 - RNA, 18 nt, Human T-lymphotropic virus 1
cacaucgccuccagccuc

SEQ ID NO: 4017036 - RNA, 13 nt, Human T-lymphotropic virus 1
cacauucccucag

SEQ ID NO: 4017037 - RNA, 15 nt, Human T-lymphotropic virus 1
caccacccuuuucca

SEQ ID NO: 4017038 - RNA, 21 nt, Human T-lymphotropic virus 1
caccacuccccccgacuccag

SEQ ID NO: 4017039 - RNA, 13 nt, Human T-lymphotropic virus 1
caccccggccagc

SEQ ID NO: 4017040 - RNA, 14 nt, Human T-lymphotropic virus 1
caccccggccagcu

SEQ ID NO: 4017041 - RNA, 22 nt, Human T-lymphotropic virus 1
cacccgucacgcugacagccug

SEQ ID NO: 4017042 - RNA, 13 nt, Human T-lymphotropic virus 1
cacccuccuuccu

SEQ ID NO: 4017043 - RNA, 15 nt, Human T-lymphotropic virus 1
caccgccccuccucu

SEQ ID NO: 4017044 - RNA, 14 nt, Human T-lymphotropic virus 1
caccuggccccucc

SEQ ID NO: 4017045 - RNA, 18 nt, Human T-lymphotropic virus 1
caccuggccccuccugcc

SEQ ID NO: 4017046 - RNA, 19 nt, Human T-lymphotropic virus 1
caccuggccccuccugccc

SEQ ID NO: 4017047 - RNA, 14 nt, Human T-lymphotropic virus 1
caccugggacccca

SEQ ID NO: 4017048 - RNA, 15 nt, Human T-lymphotropic virus 1
cacggcgcuccugcu

SEQ ID NO: 4017049 - RNA, 18 nt, Human T-lymphotropic virus 1
cacguccuauacucuccc

SEQ ID NO: 4017050 - RNA, 19 nt, Human T-lymphotropic virus 1
cacucaacccucaccacuc

SEQ ID NO: 4017051 - RNA, 14 nt, Human T-lymphotropic virus 1
cacucauacaaccc

SEQ ID NO: 4017052 - RNA, 20 nt, Human T-lymphotropic virus 1
cacuccccccgacuccagcc

SEQ ID NO: 4017053 - RNA, 19 nt, Human T-lymphotropic virus 1
cagaacagacgaggccuug

SEQ ID NO: 4017054 - RNA, 15 nt, Human T-lymphotropic virus 1
cagaacgccuccagg

SEQ ID NO: 4017055 - RNA, 16 nt, Human T-lymphotropic virus 1
cagaacgccuccaggc

SEQ ID NO: 4017056 - RNA, 15 nt, Human T-lymphotropic virus 1
cagaagcuauuuccu

SEQ ID NO: 4017057 - RNA, 19 nt, Human T-lymphotropic virus 1
cagacaauggcccugccua

SEQ ID NO: 4017058 - RNA, 14 nt, Human T-lymphotropic virus 1
cagaccagccaccc

SEQ ID NO: 4017059 - RNA, 22 nt, Human T-lymphotropic virus 1
cagacgaggccuugaucuccug

SEQ ID NO: 4017060 - RNA, 21 nt, Human T-lymphotropic virus 1
cagauacccccauuacucucu

SEQ ID NO: 4017061 - RNA, 14 nt, Human T-lymphotropic virus 1
cagaucaggcccua

SEQ ID NO: 4017062 - RNA, 19 nt, Human T-lymphotropic virus 1
cagauugacacccagacca

SEQ ID NO: 4017063 - RNA, 13 nt, Human T-lymphotropic virus 1
cagcaaccuccuc

SEQ ID NO: 4017064 - RNA, 16 nt, Human T-lymphotropic virus 1
cagcaccucccaaccc

SEQ ID NO: 4017065 - RNA, 23 nt, Human T-lymphotropic virus 1
cagcagaucaggcccuacagcca

SEQ ID NO: 4017066 - RNA, 18 nt, Human T-lymphotropic virus 1
cagccaacugccucccac

SEQ ID NO: 4017067 - RNA, 12 nt, Human T-lymphotropic virus 1
cagccccagcug

SEQ ID NO: 4017068 - RNA, 17 nt, Human T-lymphotropic virus 1
cagccgaucccagagac

SEQ ID NO: 4017069 - RNA, 22 nt, Human T-lymphotropic virus 1
cagccuccaaggacuccaccuc

SEQ ID NO: 4017070 - RNA, 14 nt, Human T-lymphotropic virus 1
cagccuccccugcc

SEQ ID NO: 4017071 - RNA, 17 nt, Human T-lymphotropic virus 1
cagcuacgacaccuccc

SEQ ID NO: 4017072 - RNA, 13 nt, Human T-lymphotropic virus 1
cagcucagcacca

SEQ ID NO: 4017073 - RNA, 16 nt, Human T-lymphotropic virus 1
cagcuggcccauaucc

SEQ ID NO: 4017074 - RNA, 19 nt, Human T-lymphotropic virus 1
cagcuggcccauauccugc

SEQ ID NO: 4017075 - RNA, 21 nt, Human T-lymphotropic virus 1
cagcuggcccauauccugcag

SEQ ID NO: 4017076 - RNA, 17 nt, Human T-lymphotropic virus 1
caggagccgucuccagc

SEQ ID NO: 4017077 - RNA, 12 nt, Human T-lymphotropic virus 1
cccaccacccuu

SEQ ID NO: 4017078 - RNA, 21 nt, Human T-lymphotropic virus 1
cccacugcuuugacccccaga

SEQ ID NO: 4017079 - RNA, 20 nt, Human T-lymphotropic virus 1
cccagccaacugccucccac

SEQ ID NO: 4017080 - RNA, 20 nt, Human T-lymphotropic virus 1
cccagcugcuguacucucac

SEQ ID NO: 4017081 - RNA, 18 nt, Human T-lymphotropic virus 1
cccaucaccuggccccuc

SEQ ID NO: 4017082 - RNA, 13 nt, Human T-lymphotropic virus 1
cccaucuccaggc

SEQ ID NO: 4017083 - RNA, 22 nt, Human T-lymphotropic virus 1
cccauguuugucaagccguccu

SEQ ID NO: 4017084 - RNA, 22 nt, Human T-lymphotropic virus 1
cccauugcggacagacggcccu

SEQ ID NO: 4017085 - RNA, 16 nt, Human T-lymphotropic virus 1
cccccaacuccugcau

SEQ ID NO: 4017086 - RNA, 22 nt, Human T-lymphotropic virus 1
cccccggaggacagcucagcac

SEQ ID NO: 4017087 - RNA, 21 nt, Human T-lymphotropic virus 1
cccccugacuuguccagccug

SEQ ID NO: 4017088 - RNA, 14 nt, Human T-lymphotropic virus 1
ccccggacuccggc

SEQ ID NO: 4017089 - RNA, 13 nt, Human T-lymphotropic virus 1
ccccuccuucccc

SEQ ID NO: 4017090 - RNA, 17 nt, Human T-lymphotropic virus 1
ccccuggagggccccgu

SEQ ID NO: 4017091 - RNA, 23 nt, Human T-lymphotropic virus 1
ccccugugaucauaaacaccgcc

SEQ ID NO: 4017092 - RNA, 17 nt, Human T-lymphotropic virus 1
ccccuuccgccaccgca

SEQ ID NO: 4017093 - RNA, 22 nt, Human T-lymphotropic virus 1
ccccuucuucuaccccccuccu

SEQ ID NO: 4017094 - RNA, 14 nt, Human T-lymphotropic virus 1
cccgacuccagccg

SEQ ID NO: 4017095 - RNA, 23 nt, Human T-lymphotropic virus 1
cccgguaagcgcuaguucugccc

SEQ ID NO: 4017096 - RNA, 23 nt, Human T-lymphotropic virus 1
cccguccaccaauuccuccacca

SEQ ID NO: 4017097 - RNA, 18 nt, Human T-lymphotropic virus 1
cccuacaauccaaccagc

SEQ ID NO: 4017098 - RNA, 22 nt, Human T-lymphotropic virus 1
cccuacaauccaaccagcuccg

SEQ ID NO: 4017099 - RNA, 16 nt, Human T-lymphotropic virus 1
cccucaccacuccagg

SEQ ID NO: 4017100 - RNA, 17 nt, Human T-lymphotropic virus 1
cccucaccacuccaggc

SEQ ID NO: 4017101 - RNA, 13 nt, Human T-lymphotropic virus 1
cccucauccucgg

SEQ ID NO: 4017102 - RNA, 16 nt, Human T-lymphotropic virus 1
cccuccuuuacccauc

SEQ ID NO: 4017103 - RNA, 19 nt, Human T-lymphotropic virus 1
cccucgacuccccuccuuc

SEQ ID NO: 4017104 - RNA, 18 nt, Human T-lymphotropic virus 1
cccucuauaccauggaaa

SEQ ID NO: 4017105 - RNA, 23 nt, Human T-lymphotropic virus 1
cccugcccuaaagauggccagcc

SEQ ID NO: 4017106 - RNA, 21 nt, Human T-lymphotropic virus 1
cccuugcccuaggcaccuucc

SEQ ID NO: 4017107 - RNA, 11 nt, Human T-lymphotropic virus 1
ccgaaaacaaa

SEQ ID NO: 4017108 - RNA, 11 nt, Human T-lymphotropic virus 1
ccgaacccagc

SEQ ID NO: 4017109 - RNA, 20 nt, Human T-lymphotropic virus 1
ccgcaguagacuaguccaaa

SEQ ID NO: 4017110 - RNA, 14 nt, Human T-lymphotropic virus 1
ccgccauccacgcc

SEQ ID NO: 4017111 - RNA, 22 nt, Human T-lymphotropic virus 1
ccgcucuuuuuuucgcuuccuc

SEQ ID NO: 4017112 - RNA, 18 nt, Human T-lymphotropic virus 1
ccgggggcuuagagccuc

SEQ ID NO: 4017113 - RNA, 20 nt, Human T-lymphotropic virus 1
ccgucagcuacgacaccucc

SEQ ID NO: 4017114 - RNA, 16 nt, Human T-lymphotropic virus 1
ccguccaccaauuccu

SEQ ID NO: 4017115 - RNA, 14 nt, Human T-lymphotropic virus 1
ccgucuccagcccc

SEQ ID NO: 4017116 - RNA, 13 nt, Human T-lymphotropic virus 1
ccgugccuucucc

SEQ ID NO: 4017117 - RNA, 16 nt, Human T-lymphotropic virus 1
ccguggccuacucccu

SEQ ID NO: 4017118 - RNA, 13 nt, Human T-lymphotropic virus 1
ccguucagccucc

SEQ ID NO: 4017119 - RNA, 19 nt, Human T-lymphotropic virus 1
ccguucagccuccaaggac

SEQ ID NO: 4017120 - RNA, 16 nt, Human T-lymphotropic virus 1
ccguuccacucaaccc

SEQ ID NO: 4017121 - RNA, 22 nt, Human T-lymphotropic virus 1
ccguuccacucaacccucacca

SEQ ID NO: 4017122 - RNA, 19 nt, Human T-lymphotropic virus 1
ccuaaacaguuccagcccu

SEQ ID NO: 4017123 - RNA, 14 nt, Human T-lymphotropic virus 1
ccuaaucaccucac

SEQ ID NO: 4017124 - RNA, 20 nt, Human T-lymphotropic virus 1
ccuacaauccaaccagcucc

SEQ ID NO: 4017125 - RNA, 22 nt, Human T-lymphotropic virus 1
ccuaccuaaacaguuccagccc

SEQ ID NO: 4017126 - RNA, 18 nt, Human T-lymphotropic virus 1
ccuaccuuacgccagccc

SEQ ID NO: 4017127 - RNA, 21 nt, Human T-lymphotropic virus 1
ccuauuguuuuaacaucuugc

SEQ ID NO: 4017128 - RNA, 15 nt, Human T-lymphotropic virus 1
ccucaccacuccagg

SEQ ID NO: 4017129 - RNA, 23 nt, Human T-lymphotropic virus 1
ccucagcaauaaacaaacccauu

SEQ ID NO: 4017130 - RNA, 17 nt, Human T-lymphotropic virus 1
ccucaggaaagagccuc

SEQ ID NO: 4017131 - RNA, 20 nt, Human T-lymphotropic virus 1
ccucauacaguacucuuccu

SEQ ID NO: 4017132 - RNA, 13 nt, Human T-lymphotropic virus 1
ccucauccugccc

SEQ ID NO: 4017133 - RNA, 17 nt, Human T-lymphotropic virus 1
ccuccaauauccugcgc

SEQ ID NO: 4017134 - RNA, 14 nt, Human T-lymphotropic virus 1
ccuccaggccaugc

SEQ ID NO: 4017135 - RNA, 18 nt, Human T-lymphotropic virus 1
ccucccaugcggaccugc

SEQ ID NO: 4017136 - RNA, 16 nt, Human T-lymphotropic virus 1
ccuccccucgcgcguc

SEQ ID NO: 4017137 - RNA, 16 nt, Human T-lymphotropic virus 1
ccuccuccguucagcc

SEQ ID NO: 4017138 - RNA, 19 nt, Human T-lymphotropic virus 1
ccuccucuacucucccacu

SEQ ID NO: 4017139 - RNA, 19 nt, Human T-lymphotropic virus 1
ccucggugauuacagcccc

SEQ ID NO: 4017140 - RNA, 16 nt, Human T-lymphotropic virus 1
ccucuacucucccacu

SEQ ID NO: 4017141 - RNA, 13 nt, Human T-lymphotropic virus 1
ccucuccagcgcc

SEQ ID NO: 4017142 - RNA, 23 nt, Human T-lymphotropic virus 1
ccucucccaucaaauccuccuuc

SEQ ID NO: 4017143 - RNA, 14 nt, Human T-lymphotropic virus 1
ccucuucuccucag

SEQ ID NO: 4017144 - RNA, 17 nt, Human T-lymphotropic virus 1
ccugaucccaucuccag

SEQ ID NO: 4017145 - RNA, 18 nt, Human T-lymphotropic virus 1
ccugcaauccugcccagc

SEQ ID NO: 4017146 - RNA, 16 nt, Human T-lymphotropic virus 1
ccugcagcucucuccu

SEQ ID NO: 4017147 - RNA, 21 nt, Human T-lymphotropic virus 1
ccugccaauaauuaaccucuc

SEQ ID NO: 4017148 - RNA, 21 nt, Human T-lymphotropic virus 1
ccugcccuaaagauggccagc

SEQ ID NO: 4017149 - RNA, 15 nt, Human T-lymphotropic virus 1
ccugcucuuccugcu

SEQ ID NO: 4017150 - RNA, 17 nt, Human T-lymphotropic virus 1
ccugcucuuccugcuuu

SEQ ID NO: 4017151 - RNA, 22 nt, Human T-lymphotropic virus 1
ccugcuggcccuuucagcagau

SEQ ID NO: 4017152 - RNA, 16 nt, Human T-lymphotropic virus 1
ccuggccccuccugcc

SEQ ID NO: 4017153 - RNA, 21 nt, Human T-lymphotropic virus 1
ccugggggcagcuacuugccu

SEQ ID NO: 4017154 - RNA, 13 nt, Human T-lymphotropic virus 1
ccuguaaucuugc

SEQ ID NO: 4017155 - RNA, 18 nt, Human T-lymphotropic virus 1
ccugucauaacucccuca

SEQ ID NO: 4017156 - RNA, 22 nt, Human T-lymphotropic virus 1
ccuguccagagcaucagaucac

SEQ ID NO: 4017157 - RNA, 15 nt, Human T-lymphotropic virus 1
ccuguggugccuccu

SEQ ID NO: 4017158 - RNA, 13 nt, Human T-lymphotropic virus 1
ccuuaccugaggc

SEQ ID NO: 4017159 - RNA, 14 nt, Human T-lymphotropic virus 1
ccuucaaccaauuc

SEQ ID NO: 4017160 - RNA, 14 nt, Human T-lymphotropic virus 1
ccuucucagccccu

SEQ ID NO: 4017161 - RNA, 21 nt, Human T-lymphotropic virus 1
ccuucuccuccgcccgcuucc

SEQ ID NO: 4017162 - RNA, 21 nt, Human T-lymphotropic virus 1
ccuuguccuuuaacucuuccu

SEQ ID NO: 4017163 - RNA, 22 nt, Human T-lymphotropic virus 1
ccuuuucaggagccaucucagc

SEQ ID NO: 4017164 - RNA, 15 nt, Human T-lymphotropic virus 1
ccuuuuccagccugc

SEQ ID NO: 4017165 - RNA, 18 nt, Human T-lymphotropic virus 1
cgacuggugccccaucuc

SEQ ID NO: 4017166 - RNA, 16 nt, Human T-lymphotropic virus 1
cgagcaguaccggugg

SEQ ID NO: 4017167 - RNA, 19 nt, Human T-lymphotropic virus 1
cgcaaaaauaacccacaac

SEQ ID NO: 4017168 - RNA, 19 nt, Human T-lymphotropic virus 1
cgcauacggcucaauaaaa

SEQ ID NO: 4017169 - RNA, 12 nt, Human T-lymphotropic virus 1
cgccccuugccu

SEQ ID NO: 4017170 - RNA, 21 nt, Human T-lymphotropic virus 1
cgccucaggaaagagccuccu

SEQ ID NO: 4017171 - RNA, 15 nt, Human T-lymphotropic virus 1
cgccuccagccuccc

SEQ ID NO: 4017172 - RNA, 13 nt, Human T-lymphotropic virus 1
cgccuccaggccu

SEQ ID NO: 4017173 - RNA, 15 nt, Human T-lymphotropic virus 1
cgcgcuacuccuucu

SEQ ID NO: 4017174 - RNA, 18 nt, Human T-lymphotropic virus 1
cgcguuaucggcucagcu

SEQ ID NO: 4017175 - RNA, 23 nt, Human T-lymphotropic virus 1
cgcguucugccgccucccgccug

SEQ ID NO: 4017176 - RNA, 22 nt, Human T-lymphotropic virus 1
cgcuccaggauaugaccccauc

SEQ ID NO: 4017177 - RNA, 13 nt, Human T-lymphotropic virus 1
cggacccuugccc

SEQ ID NO: 4017178 - RNA, 15 nt, Human T-lymphotropic virus 1
cggaggacagcucag

SEQ ID NO: 4017179 - RNA, 16 nt, Human T-lymphotropic virus 1
uucagccuccaaggac

SEQ ID NO: 4017180 - RNA, 22 nt, Human T-lymphotropic virus 1
uucaggagccaucucagcuacc

SEQ ID NO: 4017181 - RNA, 17 nt, Human T-lymphotropic virus 1
uuccagccccccaccug

SEQ ID NO: 4017182 - RNA, 17 nt, Human T-lymphotropic virus 1
uuccuuuucaaauacuc

SEQ ID NO: 4017183 - RNA, 16 nt, Human T-lymphotropic virus 1
uucgccuucucagccc

SEQ ID NO: 4017184 - RNA, 18 nt, Human T-lymphotropic virus 1
uucgccuucucagccccu

SEQ ID NO: 4017185 - RNA, 19 nt, Human T-lymphotropic virus 1
uucuaccccccuccuuuac

SEQ ID NO: 4017186 - RNA, 16 nt, Human T-lymphotropic virus 1
uucuccucagcccguc

SEQ ID NO: 4017187 - RNA, 22 nt, Human T-lymphotropic virus 1
uugcggacagacggcccucaca

SEQ ID NO: 4017188 - RNA, 18 nt, Human T-lymphotropic virus 1
uuuaagcucaccucccuu

SEQ ID NO: 4017189 - RNA, 14 nt, Human T-lymphotropic virus 1
uuucauaauuugca

SEQ ID NO: 4017190 - RNA, 16 nt, Human T-lymphotropic virus 1
uuuccuccuccuccuu

SEQ ID NO: 4017191 - RNA, 15 nt, Human T-lymphotropic virus 1
aucugcuuuuccucc

SEQ ID NO: 4017192 - RNA, 17 nt, Human T-lymphotropic virus 1
aucugcuuuuccuccuc

SEQ ID NO: 4017193 - RNA, 18 nt, Human T-lymphotropic virus 1
aucugcuuuuccuccucu

SEQ ID NO: 4017194 - RNA, 16 nt, Human T-lymphotropic virus 1
augacaguccuuccga

SEQ ID NO: 4017195 - RNA, 15 nt, Human T-lymphotropic virus 1
augccaaggcguccu

SEQ ID NO: 4017196 - RNA, 20 nt, Human T-lymphotropic virus 1
auggaaaucaaaacuccuga

SEQ ID NO: 4017197 - RNA, 16 nt, Human T-lymphotropic virus 1
auuacagccccagcug

SEQ ID NO: 4017198 - RNA, 19 nt, Human T-lymphotropic virus 1
auuauuucaagcuuccugg

SEQ ID NO: 4017199 - RNA, 14 nt, Human T-lymphotropic virus 1
auucauucaaacau

SEQ ID NO: 4017200 - RNA, 16 nt, Human T-lymphotropic virus 1
auugccuaucuaggca

SEQ ID NO: 4017201 - RNA, 20 nt, Human T-lymphotropic virus 1
auugucacaaagaucauucc

SEQ ID NO: 4017202 - RNA, 13 nt, Human T-lymphotropic virus 1
auuuaaauccuuc

SEQ ID NO: 4017203 - RNA, 12 nt, Human T-lymphotropic virus 1
auuuccucccca

SEQ ID NO: 4017204 - RNA, 20 nt, Human T-lymphotropic virus 1
caaaucauaagcucagaccu

SEQ ID NO: 4017205 - RNA, 18 nt, Human T-lymphotropic virus 1
caaaucccccuaccuaaa

SEQ ID NO: 4017206 - RNA, 16 nt, Human T-lymphotropic virus 1
caacaaugccaaggcg

SEQ ID NO: 4017207 - RNA, 22 nt, Human T-lymphotropic virus 1
caaccacaucgccuccagccuc

SEQ ID NO: 4017208 - RNA, 20 nt, Human T-lymphotropic virus 1
caaccuccuccguucagccu

SEQ ID NO: 4017209 - RNA, 21 nt, Human T-lymphotropic virus 1
caacgucucuguuccaucccc

SEQ ID NO: 4017210 - RNA, 22 nt, Human T-lymphotropic virus 1
caacuacacuagcccacuuaca

SEQ ID NO: 4017211 - RNA, 13 nt, Human T-lymphotropic virus 1
caacuacucucag

SEQ ID NO: 4017212 - RNA, 14 nt, Human T-lymphotropic virus 1
caaggacuccaccu

SEQ ID NO: 4017213 - RNA, 19 nt, Human T-lymphotropic virus 1
caaggacuccaccucgccu

SEQ ID NO: 4017214 - RNA, 21 nt, Human T-lymphotropic virus 1
caaggcguccuguaccucccu

SEQ ID NO: 4017215 - RNA, 22 nt, Human T-lymphotropic virus 1
caaggcguccuguaccucccug

SEQ ID NO: 4017216 - RNA, 19 nt, Human T-lymphotropic virus 1
caauccaaccagcuccgga

SEQ ID NO: 4017217 - RNA, 15 nt, Human T-lymphotropic virus 1
caauccugcccagcc

SEQ ID NO: 4017218 - RNA, 13 nt, Human T-lymphotropic virus 1
caaugccaaggcg

SEQ ID NO: 4017219 - RNA, 14 nt, Human T-lymphotropic virus 1
caauuccuccacca

SEQ ID NO: 4017220 - RNA, 16 nt, Human T-lymphotropic virus 1
cacaaaaaucugcuca

SEQ ID NO: 4017221 - RNA, 22 nt, Human T-lymphotropic virus 1
cacaaauuucaaaccaaggccu

SEQ ID NO: 4017222 - RNA, 15 nt, Human T-lymphotropic virus 1
cacaguuuccuccuc

SEQ ID NO: 4017223 - RNA, 16 nt, Human T-lymphotropic virus 1
cacaguuuccuccucc

SEQ ID NO: 4017224 - RNA, 16 nt, Human T-lymphotropic virus 1
cacaucgccuccagcc

SEQ ID NO: 4017225 - RNA, 17 nt, Human T-lymphotropic virus 1
cacaucgccuccagccu

SEQ ID NO: 4017226 - RNA, 15 nt, Human T-lymphotropic virus 1
caccaauuccuccac

SEQ ID NO: 4017227 - RNA, 19 nt, Human T-lymphotropic virus 1
caccacuccccccgacucc

SEQ ID NO: 4017228 - RNA, 22 nt, Human T-lymphotropic virus 1
caccagcucaggcuaggcccug

SEQ ID NO: 4017229 - RNA, 20 nt, Human T-lymphotropic virus 1
cacccuugggcagcaccucc

SEQ ID NO: 4017230 - RNA, 14 nt, Human T-lymphotropic virus 1
caccgccccuccuc

SEQ ID NO: 4017231 - RNA, 14 nt, Human T-lymphotropic virus 1
caccgccccuugcc

SEQ ID NO: 4017232 - RNA, 17 nt, Human T-lymphotropic virus 1
caccucccaacccuguc

SEQ ID NO: 4017233 - RNA, 21 nt, Human T-lymphotropic virus 1
caccuuuucaggagccaucuc

SEQ ID NO: 4017234 - RNA, 23 nt, Human T-lymphotropic virus 1
cacgcccuacuggccaccugucc

SEQ ID NO: 4017235 - RNA, 21 nt, Human T-lymphotropic virus 1
cacgccugccgcaaaaauaac

SEQ ID NO: 4017236 - RNA, 18 nt, Human T-lymphotropic virus 1
cacgcuaggaucccgcuc

SEQ ID NO: 4017237 - RNA, 19 nt, Human T-lymphotropic virus 1
cacgcuaggaucccgcucc

SEQ ID NO: 4017238 - RNA, 16 nt, Human T-lymphotropic virus 1
cacgcuuugccugacc

SEQ ID NO: 4017239 - RNA, 17 nt, Human T-lymphotropic virus 1
cacggcgcuccugcucu

SEQ ID NO: 4017240 - RNA, 20 nt, Human T-lymphotropic virus 1
cacggcgcuccugcucuucc

SEQ ID NO: 4017241 - RNA, 20 nt, Human T-lymphotropic virus 1
cagaacgccuccaggccuug

SEQ ID NO: 4017242 - RNA, 15 nt, Human T-lymphotropic virus 1
cagaauaaggcucug

SEQ ID NO: 4017243 - RNA, 23 nt, Human T-lymphotropic virus 1
cagacgaggccuugaucuccugu

SEQ ID NO: 4017244 - RNA, 19 nt, Human T-lymphotropic virus 1
cagacggauccaccuccca

SEQ ID NO: 4017245 - RNA, 20 nt, Human T-lymphotropic virus 1
cagacggauccaccucccag

SEQ ID NO: 4017246 - RNA, 17 nt, Human T-lymphotropic virus 1
cagaggccacaauggcu

SEQ ID NO: 4017247 - RNA, 15 nt, Human T-lymphotropic virus 1
cagaucaccugggac

SEQ ID NO: 4017248 - RNA, 23 nt, Human T-lymphotropic virus 1
cagaucaggcccuacagccaccc

SEQ ID NO: 4017249 - RNA, 14 nt, Human T-lymphotropic virus 1
cagcaaaccccugg

SEQ ID NO: 4017250 - RNA, 12 nt, Human T-lymphotropic virus 1
cagcaaccuccu

SEQ ID NO: 4017251 - RNA, 22 nt, Human T-lymphotropic virus 1
cagcaaccuccuccguucagcc

SEQ ID NO: 4017252 - RNA, 13 nt, Human T-lymphotropic virus 1
cagcaccucccaa

SEQ ID NO: 4017253 - RNA, 15 nt, Human T-lymphotropic virus 1
cagcagaucaggccc

SEQ ID NO: 4017254 - RNA, 16 nt, Human T-lymphotropic virus 1
cagccccccaccugac

SEQ ID NO: 4017255 - RNA, 14 nt, Human T-lymphotropic virus 1
cagccccuacugga

SEQ ID NO: 4017256 - RNA, 21 nt, Human T-lymphotropic virus 1
cagccccuucacagucucuac

SEQ ID NO: 4017257 - RNA, 14 nt, Human T-lymphotropic virus 1
cagccggcucucca

SEQ ID NO: 4017258 - RNA, 18 nt, Human T-lymphotropic virus 1
cagccuauccacuuggca

SEQ ID NO: 4017259 - RNA, 22 nt, Human T-lymphotropic virus 1
cagccuggcaaaacggccuccu

SEQ ID NO: 4017260 - RNA, 16 nt, Human T-lymphotropic virus 1
cagcuacgacaccucc

SEQ ID NO: 4017261 - RNA, 13 nt, Human T-lymphotropic virus 1
cagcucucuccug

SEQ ID NO: 4017262 - RNA, 14 nt, Human T-lymphotropic virus 1
caggagccaucuca

SEQ ID NO: 4017263 - RNA, 21 nt, Human T-lymphotropic virus 1
caggagccgucuccagccccu

SEQ ID NO: 4017264 - RNA, 16 nt, Human T-lymphotropic virus 1
caguaugcugcccaga

SEQ ID NO: 4017265 - RNA, 12 nt, Human T-lymphotropic virus 1
caguuccagccc

SEQ ID NO: 4017266 - RNA, 16 nt, Human T-lymphotropic virus 1
cauaccaaucuaccug

SEQ ID NO: 4017267 - RNA, 23 nt, Human T-lymphotropic virus 1
cauccccuucuucuaccccccuc

SEQ ID NO: 4017268 - RNA, 20 nt, Human T-lymphotropic virus 1
cauccgccguggccuacucc

SEQ ID NO: 4017269 - RNA, 17 nt, Human T-lymphotropic virus 1
caucgccuccagccucc

SEQ ID NO: 4017270 - RNA, 18 nt, Human T-lymphotropic virus 1
caucgccuccagccuccc

SEQ ID NO: 4017271 - RNA, 11 nt, Human T-lymphotropic virus 1
caucuccaccc

SEQ ID NO: 4017272 - RNA, 14 nt, Human T-lymphotropic virus 1
caucuccaggcuca

SEQ ID NO: 4017273 - RNA, 11 nt, Human T-lymphotropic virus 1
caucucuccuu

SEQ ID NO: 4017274 - RNA, 23 nt, Human T-lymphotropic virus 1
caugcgcaaauacucccccuucc

SEQ ID NO: 4017275 - RNA, 20 nt, Human T-lymphotropic virus 1
caugcuuauuaucagcccac

SEQ ID NO: 4017276 - RNA, 14 nt, Human T-lymphotropic virus 1
cauggaacccaccc

SEQ ID NO: 4017277 - RNA, 14 nt, Human T-lymphotropic virus 1
cauggccucuccag

SEQ ID NO: 4017278 - RNA, 15 nt, Human T-lymphotropic virus 1
cauggccucuccagc

SEQ ID NO: 4017279 - RNA, 18 nt, Human T-lymphotropic virus 1
cauguaccucuaccagcu

SEQ ID NO: 4017280 - RNA, 22 nt, Human T-lymphotropic virus 1
cauguccccuacaauccaacca

SEQ ID NO: 4017281 - RNA, 13 nt, Human T-lymphotropic virus 1
cauucccucagca

SEQ ID NO: 4017282 - RNA, 21 nt, Human T-lymphotropic virus 1
cauugccuaucuaggcaagcc

SEQ ID NO: 4017283 - RNA, 20 nt, Human T-lymphotropic virus 1
cauuuaacuggacccacugc

SEQ ID NO: 4017284 - RNA, 12 nt, Human T-lymphotropic virus 1
ccaacccugucu

SEQ ID NO: 4017285 - RNA, 17 nt, Human T-lymphotropic virus 1
ccaacgucucuguucca

SEQ ID NO: 4017286 - RNA, 15 nt, Human T-lymphotropic virus 1
ccaacugccucccac

SEQ ID NO: 4017287 - RNA, 23 nt, Human T-lymphotropic virus 1
ccaagcagcaguggccacuuguc

SEQ ID NO: 4017288 - RNA, 16 nt, Human T-lymphotropic virus 1
ccaaggacuccaccuc

SEQ ID NO: 4017289 - RNA, 20 nt, Human T-lymphotropic virus 1
ccaaggcagguccucucagg

SEQ ID NO: 4017290 - RNA, 22 nt, Human T-lymphotropic virus 1
ccaauaauuaaccucucccauc

SEQ ID NO: 4017291 - RNA, 16 nt, Human T-lymphotropic virus 1
ccaaucauggaccugc

SEQ ID NO: 4017292 - RNA, 15 nt, Human T-lymphotropic virus 1
ccaccaauuccucca

SEQ ID NO: 4017293 - RNA, 19 nt, Human T-lymphotropic virus 1
ccaccaauuccuccaccag

SEQ ID NO: 4017294 - RNA, 20 nt, Human T-lymphotropic virus 1
ccaccacccuuuuccagccu

SEQ ID NO: 4017295 - RNA, 15 nt, Human T-lymphotropic virus 1
ccacccauuuccucc

SEQ ID NO: 4017296 - RNA, 16 nt, Human T-lymphotropic virus 1
ccacccuugggcagca

SEQ ID NO: 4017297 - RNA, 14 nt, Human T-lymphotropic virus 1
ccaccgggaaccac

SEQ ID NO: 4017298 - RNA, 15 nt, Human T-lymphotropic virus 1
ccaccucccaggcag

SEQ ID NO: 4017299 - RNA, 17 nt, Human T-lymphotropic virus 1
ccaccucccaggcagcc

SEQ ID NO: 4017300 - RNA, 18 nt, Human T-lymphotropic virus 1
ccaccuguccagagcauc

SEQ ID NO: 4017301 - RNA, 22 nt, Human T-lymphotropic virus 1
ccacgccgguugagucgcguuc

SEQ ID NO: 4017302 - RNA, 13 nt, Human T-lymphotropic virus 1
ccacucuaaaccc

SEQ ID NO: 4017303 - RNA, 15 nt, Human T-lymphotropic virus 1
ccacucuaaccuaga

SEQ ID NO: 4017304 - RNA, 17 nt, Human T-lymphotropic virus 1
ccagaacgccuccaggc

SEQ ID NO: 4017305 - RNA, 20 nt, Human T-lymphotropic virus 1
ccagaccccggacuccggcc

SEQ ID NO: 4017306 - RNA, 16 nt, Human T-lymphotropic virus 1
ccagcagguccuccgg

SEQ ID NO: 4017307 - RNA, 17 nt, Human T-lymphotropic virus 1
ccagcagguccuccggg

SEQ ID NO: 4017308 - RNA, 18 nt, Human T-lymphotropic virus 1
ccagccaacugccuccca

SEQ ID NO: 4017309 - RNA, 18 nt, Human T-lymphotropic virus 1
ccagccuccccugccaau

SEQ ID NO: 4017310 - RNA, 20 nt, Human T-lymphotropic virus 1
ccaggauaugaccccaucug

SEQ ID NO: 4017311 - RNA, 23 nt, Human T-lymphotropic virus 1
ccaggcagccuauauucucuggg

SEQ ID NO: 4017312 - RNA, 12 nt, Human T-lymphotropic virus 1
ccaguucugccc

SEQ ID NO: 4017313 - RNA, 16 nt, Human T-lymphotropic virus 1
ccauacuacccauguc

SEQ ID NO: 4017314 - RNA, 22 nt, Human T-lymphotropic virus 1
ccauugccuaucuaggcaagcc

SEQ ID NO: 4017315 - RNA, 22 nt, Human T-lymphotropic virus 1
ccauuggcuccugugaaagccc

SEQ ID NO: 4017316 - RNA, 14 nt, Human T-lymphotropic virus 1
cccaacuccugcau

SEQ ID NO: 4017317 - RNA, 19 nt, Human T-lymphotropic virus 1
cccagaacagacgaggccu

SEQ ID NO: 4017318 - RNA, 13 nt, Human T-lymphotropic virus 1
cccagaccagcca

SEQ ID NO: 4017319 - RNA, 16 nt, Human T-lymphotropic virus 1
cccagcaaaccccugg

SEQ ID NO: 4017320 - RNA, 12 nt, Human T-lymphotropic virus 1
cccauaccuagg

SEQ ID NO: 4017321 - RNA, 14 nt, Human T-lymphotropic virus 1
cccauauccugcag

SEQ ID NO: 4017322 - RNA, 19 nt, Human T-lymphotropic virus 1
cccaucaccuggccccucc

SEQ ID NO: 4017323 - RNA, 23 nt, Human T-lymphotropic virus 1
cccaugugauuuuuugccacccc

SEQ ID NO: 4017324 - RNA, 18 nt, Human T-lymphotropic virus 1
ccccaacauuccacccuc

SEQ ID NO: 4017325 - RNA, 19 nt, Human T-lymphotropic virus 1
ccccaacauuccacccucc

SEQ ID NO: 4017326 - RNA, 22 nt, Human T-lymphotropic virus 1
gacaaccccucaccucaaaaaa

SEQ ID NO: 4017327 - RNA, 12 nt, Human T-lymphotropic virus 1
gacccccccuug

SEQ ID NO: 4017328 - RNA, 16 nt, Human T-lymphotropic virus 1
gacccucgaccugcug

SEQ ID NO: 4017329 - RNA, 16 nt, Human T-lymphotropic virus 1
gacccuugcccuaggc

SEQ ID NO: 4017330 - RNA, 17 nt, Human T-lymphotropic virus 1
gacuccagccgauccca

SEQ ID NO: 4017331 - RNA, 19 nt, Human T-lymphotropic virus 1
gaggcuauuauucagccuc

SEQ ID NO: 4017332 - RNA, 12 nt, Human T-lymphotropic virus 1
gagucuccucau

SEQ ID NO: 4017333 - RNA, 22 nt, Human T-lymphotropic virus 1
gauagcaaaccgucaagcacag

SEQ ID NO: 4017334 - RNA, 13 nt, Human T-lymphotropic virus 1
gaucaaaaagcca

SEQ ID NO: 4017335 - RNA, 19 nt, Human T-lymphotropic virus 1
gaucacuuuaagcucaccu

SEQ ID NO: 4017336 - RNA, 23 nt, Human T-lymphotropic virus 1
gaucaggcccuacagccacccug

SEQ ID NO: 4017337 - RNA, 16 nt, Human T-lymphotropic virus 1
gauggccagccaucuu

SEQ ID NO: 4017338 - RNA, 13 nt, Human T-lymphotropic virus 1
gauugacacccag

SEQ ID NO: 4017339 - RNA, 14 nt, Human T-lymphotropic virus 1
gauuuuauucuucc

SEQ ID NO: 4017340 - RNA, 18 nt, Human T-lymphotropic virus 1
gcaaaacggccuccuucc

SEQ ID NO: 4017341 - RNA, 15 nt, Human T-lymphotropic virus 1
gcaagccccucccau

SEQ ID NO: 4017342 - RNA, 22 nt, Human T-lymphotropic virus 1
gcaaguccuuccuaaccaagac

SEQ ID NO: 4017343 - RNA, 13 nt, Human T-lymphotropic virus 1
gcaaucugcuuuu

SEQ ID NO: 4017344 - RNA, 16 nt, Human T-lymphotropic virus 1
gcaccagcucaggcua

SEQ ID NO: 4017345 - RNA, 15 nt, Human T-lymphotropic virus 1
gcacccgucacgcug

SEQ ID NO: 4017346 - RNA, 22 nt, Human T-lymphotropic virus 1
gcacguccuauacucucccaac

SEQ ID NO: 4017347 - RNA, 15 nt, Human T-lymphotropic virus 1
gcagcaaccuccucc

SEQ ID NO: 4017348 - RNA, 21 nt, Human T-lymphotropic virus 1
gcagccggccgcggcuuuccu

SEQ ID NO: 4017349 - RNA, 16 nt, Human T-lymphotropic virus 1
gcagcugcggcaggcc

SEQ ID NO: 4017350 - RNA, 21 nt, Human T-lymphotropic virus 1
gccaauacaggcgccagcugu

SEQ ID NO: 4017351 - RNA, 16 nt, Human T-lymphotropic virus 1
gccaccccggccagcu

SEQ ID NO: 4017352 - RNA, 19 nt, Human T-lymphotropic virus 1
gccaccgggaaccacccau

SEQ ID NO: 4017353 - RNA, 17 nt, Human T-lymphotropic virus 1
gccagcuguccuugggc

SEQ ID NO: 4017354 - RNA, 16 nt, Human T-lymphotropic virus 1
gccagugccccugggg

SEQ ID NO: 4017355 - RNA, 13 nt, Human T-lymphotropic virus 1
gccauacuaccca

SEQ ID NO: 4017356 - RNA, 16 nt, Human T-lymphotropic virus 1
gcccauauccugcagc

SEQ ID NO: 4017357 - RNA, 17 nt, Human T-lymphotropic virus 1
gcccccuuucaggcccu

SEQ ID NO: 4017358 - RNA, 15 nt, Human T-lymphotropic virus 1
gccccgccgauccca

SEQ ID NO: 4017359 - RNA, 23 nt, Human T-lymphotropic virus 1
gccccuauacaggagccgucucc

SEQ ID NO: 4017360 - RNA, 13 nt, Human T-lymphotropic virus 1
gccccuccugccc

SEQ ID NO: 4017361 - RNA, 16 nt, Human T-lymphotropic virus 1
gcccgccgccuuaccu

SEQ ID NO: 4017362 - RNA, 19 nt, Human T-lymphotropic virus 1
gcccuaaagauggccagcc

SEQ ID NO: 4017363 - RNA, 13 nt, Human T-lymphotropic virus 1
gcccucacacugc

SEQ ID NO: 4017364 - RNA, 12 nt, Human T-lymphotropic virus 1
gcccugcccuaa

SEQ ID NO: 4017365 - RNA, 19 nt, Human T-lymphotropic virus 1
gccuaccuagacucagccg

SEQ ID NO: 4017366 - RNA, 12 nt, Human T-lymphotropic virus 1
gccuccccugcc

SEQ ID NO: 4017367 - RNA, 16 nt, Human T-lymphotropic virus 1
gccucucacagugggc

SEQ ID NO: 4017368 - RNA, 22 nt, Human T-lymphotropic virus 1
gccuggcaaaacggccuccuuc

SEQ ID NO: 4017369 - RNA, 19 nt, Human T-lymphotropic virus 1
gcgagcugcaugcccaaga

SEQ ID NO: 4017370 - RNA, 23 nt, Human T-lymphotropic virus 1
gcggcaggcccugucacagaacu

SEQ ID NO: 4017371 - RNA, 13 nt, Human T-lymphotropic virus 1
gcuaccaugccac

SEQ ID NO: 4017372 - RNA, 15 nt, Human T-lymphotropic virus 1
gcuaguucugcccag

SEQ ID NO: 4017373 - RNA, 20 nt, Human T-lymphotropic virus 1
gcucaccucccuuccugugc

SEQ ID NO: 4017374 - RNA, 16 nt, Human T-lymphotropic virus 1
gcucaggcuaggcccu

SEQ ID NO: 4017375 - RNA, 18 nt, Human T-lymphotropic virus 1
gcucuccacgcuuugccu

SEQ ID NO: 4017376 - RNA, 17 nt, Human T-lymphotropic virus 1
gcucucuccugcagacc

SEQ ID NO: 4017377 - RNA, 21 nt, Human T-lymphotropic virus 1
gcucuuuuuuucgcuuccucu

SEQ ID NO: 4017378 - RNA, 18 nt, Human T-lymphotropic virus 1
cuacacaguuucacccau

SEQ ID NO: 4017379 - RNA, 13 nt, Human T-lymphotropic virus 1
cuacagccacccu

SEQ ID NO: 4017380 - RNA, 15 nt, Human T-lymphotropic virus 1
cuacagccacccugc

SEQ ID NO: 4017381 - RNA, 22 nt, Human T-lymphotropic virus 1
cuacaucgucacgcccuacugg

SEQ ID NO: 4017382 - RNA, 19 nt, Human T-lymphotropic virus 1
cuaccaccccucauuucua

SEQ ID NO: 4017383 - RNA, 19 nt, Human T-lymphotropic virus 1
cuaccugaacuucaagccc

SEQ ID NO: 4017384 - RNA, 23 nt, Human T-lymphotropic virus 1
cuaccugaacuucaagcccuacu

SEQ ID NO: 4017385 - RNA, 17 nt, Human T-lymphotropic virus 1
cuacgacaccuccccuc

SEQ ID NO: 4017386 - RNA, 15 nt, Human T-lymphotropic virus 1
cuagaacaccuccca

SEQ ID NO: 4017387 - RNA, 20 nt, Human T-lymphotropic virus 1
cuagaacaccucccaaggcc

SEQ ID NO: 4017388 - RNA, 23 nt, Human T-lymphotropic virus 1
cuagaccauauccucgagcccuc

SEQ ID NO: 4017389 - RNA, 20 nt, Human T-lymphotropic virus 1
cuagacucagccggcucucc

SEQ ID NO: 4017390 - RNA, 17 nt, Human T-lymphotropic virus 1
cuaguccaaacccugcc

SEQ ID NO: 4017391 - RNA, 15 nt, Human T-lymphotropic virus 1
cuaguucugcccagu

SEQ ID NO: 4017392 - RNA, 23 nt, Human T-lymphotropic virus 1
cuauggacuacucugccaaacca

SEQ ID NO: 4017393 - RNA, 16 nt, Human T-lymphotropic virus 1
cuauuauucagccucu

SEQ ID NO: 4017394 - RNA, 12 nt, Human T-lymphotropic virus 1
cucacagugggc

SEQ ID NO: 4017395 - RNA, 16 nt, Human T-lymphotropic virus 1
cucaccaauguucccu

SEQ ID NO: 4017396 - RNA, 15 nt, Human T-lymphotropic virus 1
cucaccucaaaaaac

SEQ ID NO: 4017397 - RNA, 21 nt, Human T-lymphotropic virus 1
cucacuggcaccaccacugug

SEQ ID NO: 4017398 - RNA, 17 nt, Human T-lymphotropic virus 1
cucagaagcuauuuccu

SEQ ID NO: 4017399 - RNA, 19 nt, Human T-lymphotropic virus 1
cucagaccuccgggaagcc

SEQ ID NO: 4017400 - RNA, 21 nt, Human T-lymphotropic virus 1
cucagccggcucuccacgcuu

SEQ ID NO: 4017401 - RNA, 20 nt, Human T-lymphotropic virus 1
cucaggaaagagccuccuac

SEQ ID NO: 4017402 - RNA, 19 nt, Human T-lymphotropic virus 1
cucaggcuaggcccugacg

SEQ ID NO: 4017403 - RNA, 22 nt, Human T-lymphotropic virus 1
cucauaccacucuaaacccugc

SEQ ID NO: 4017404 - RNA, 11 nt, Human T-lymphotropic virus 1
cucauuucuac

SEQ ID NO: 4017405 - RNA, 21 nt, Human T-lymphotropic virus 1
cuccaaaggaacuccuaccuu

SEQ ID NO: 4017406 - RNA, 14 nt, Human T-lymphotropic virus 1
cuccaaggacucca

SEQ ID NO: 4017407 - RNA, 21 nt, Human T-lymphotropic virus 1
cuccaccagcagguccuccgg

SEQ ID NO: 4017408 - RNA, 16 nt, Human T-lymphotropic virus 1
cuccagccccuacugg

SEQ ID NO: 4017409 - RNA, 15 nt, Human T-lymphotropic virus 1
cuccaggccuugcaa

SEQ ID NO: 4017410 - RNA, 16 nt, Human T-lymphotropic virus 1
cucccaccgccccucc

SEQ ID NO: 4017411 - RNA, 19 nt, Human T-lymphotropic virus 1
cucccaugcggaccugcaa

SEQ ID NO: 4017412 - RNA, 16 nt, Human T-lymphotropic virus 1
cuccccucaaaaacac

SEQ ID NO: 4017413 - RNA, 18 nt, Human T-lymphotropic virus 1
cuccccuccuuccccacc

SEQ ID NO: 4017414 - RNA, 21 nt, Human T-lymphotropic virus 1
cuccccuccuuccccacccag

SEQ ID NO: 4017415 - RNA, 21 nt, Human T-lymphotropic virus 1
cucccuaaccacaucuggcaa

SEQ ID NO: 4017416 - RNA, 22 nt, Human T-lymphotropic virus 1
cucccuucuagucgacgcucca

SEQ ID NO: 4017417 - RNA, 18 nt, Human T-lymphotropic virus 1
cucccuuggagccuaccu

SEQ ID NO: 4017418 - RNA, 17 nt, Human T-lymphotropic virus 1
cuccucauaccacucua

SEQ ID NO: 4017419 - RNA, 15 nt, Human T-lymphotropic virus 1
cuccucuuccuuccu

SEQ ID NO: 4017420 - RNA, 22 nt, Human T-lymphotropic virus 1
cuccugaacuacguccgccguc

SEQ ID NO: 4017421 - RNA, 19 nt, Human T-lymphotropic virus 1
cuccugcagcaaccuccuc

SEQ ID NO: 4017422 - RNA, 13 nt, Human T-lymphotropic virus 1
cuccugcucuucc

SEQ ID NO: 4017423 - RNA, 13 nt, Human T-lymphotropic virus 1
cuccuuccuccag

SEQ ID NO: 4017424 - RNA, 13 nt, Human T-lymphotropic virus 1
cuccuucuccugc

SEQ ID NO: 4017425 - RNA, 19 nt, Human T-lymphotropic virus 1
cucgacuccccuccuuccc

SEQ ID NO: 4017426 - RNA, 11 nt, Human T-lymphotropic virus 1
cucgcaucucu

SEQ ID NO: 4017427 - RNA, 17 nt, Human T-lymphotropic virus 1
cucuguuccauccccuu

SEQ ID NO: 4017428 - RNA, 19 nt, Human T-lymphotropic virus 1
cucuguuccauccccuucu

SEQ ID NO: 4017429 - RNA, 16 nt, Human T-lymphotropic virus 1
cucuucaagaagcugc

SEQ ID NO: 4017430 - RNA, 15 nt, Human T-lymphotropic virus 1
cucuucuccucagcc

SEQ ID NO: 4017431 - RNA, 16 nt, Human T-lymphotropic virus 1
cucuucuccucagccc

SEQ ID NO: 4017432 - RNA, 15 nt, Human T-lymphotropic virus 1
cucuuugcuccaggc

SEQ ID NO: 4017433 - RNA, 17 nt, Human T-lymphotropic virus 1
cucuuugcuccaggcca

SEQ ID NO: 4017434 - RNA, 17 nt, Human T-lymphotropic virus 1
cugaacuucaagcccua

SEQ ID NO: 4017435 - RNA, 15 nt, Human T-lymphotropic virus 1
cugacagccuggcaa

SEQ ID NO: 4017436 - RNA, 15 nt, Human T-lymphotropic virus 1
cugacccucacuggc

SEQ ID NO: 4017437 - RNA, 17 nt, Human T-lymphotropic virus 1
cugacuuguccagccug

SEQ ID NO: 4017438 - RNA, 14 nt, Human T-lymphotropic virus 1
cugcaauccugccc

SEQ ID NO: 4017439 - RNA, 19 nt, Human T-lymphotropic virus 1
cugccaacuacacuagccc

SEQ ID NO: 4017440 - RNA, 21 nt, Human T-lymphotropic virus 1
cugccaacuacacuagcccac

SEQ ID NO: 4017441 - RNA, 23 nt, Human T-lymphotropic virus 1
cugccaauaauuaaccucuccca

SEQ ID NO: 4017442 - RNA, 20 nt, Human T-lymphotropic virus 1
cugccccauuggcuccugug

SEQ ID NO: 4017443 - RNA, 21 nt, Human T-lymphotropic virus 1
cugccccauuggcuccuguga

SEQ ID NO: 4017444 - RNA, 21 nt, Human T-lymphotropic virus 1
cugccccccuuuuccuuguca

SEQ ID NO: 4017445 - RNA, 13 nt, Human T-lymphotropic virus 1
cugccgccucccg

SEQ ID NO: 4017446 - RNA, 14 nt, Human T-lymphotropic virus 1
cugcgcucuugcca

SEQ ID NO: 4017447 - RNA, 17 nt, Human T-lymphotropic virus 1
cugcuuuuccuccucuu

SEQ ID NO: 4017448 - RNA, 16 nt, Human T-lymphotropic virus 1
cuggcaagccccuccc

SEQ ID NO: 4017449 - RNA, 18 nt, Human T-lymphotropic virus 1
cuggcaagccccucccau

SEQ ID NO: 4017450 - RNA, 12 nt, Human T-lymphotropic virus 1
cuggcaccacca

SEQ ID NO: 4017451 - RNA, 15 nt, Human T-lymphotropic virus 1
cuggccaugggagcc

SEQ ID NO: 4017452 - RNA, 17 nt, Human T-lymphotropic virus 1
cuggcccauauccugca

SEQ ID NO: 4017453 - RNA, 21 nt, Human T-lymphotropic virus 1
cuggcuugucuccgcccuggc

SEQ ID NO: 4017454 - RNA, 14 nt, Human T-lymphotropic virus 1
cugggcgcuaccug

SEQ ID NO: 4017455 - RNA, 16 nt, Human T-lymphotropic virus 1
cuguaaaccaagcaca

SEQ ID NO: 4017456 - RNA, 15 nt, Human T-lymphotropic virus 1
cuguacacccucugg

SEQ ID NO: 4017457 - RNA, 17 nt, Human T-lymphotropic virus 1
cugucacagaacugccg

SEQ ID NO: 4017458 - RNA, 20 nt, Human T-lymphotropic virus 1
cugucauaacucccucaucc

SEQ ID NO: 4017459 - RNA, 21 nt, Human T-lymphotropic virus 1
cugucauaacucccucauccu

SEQ ID NO: 4017460 - RNA, 23 nt, Human T-lymphotropic virus 1
cuguccugcagcucucuccugca

SEQ ID NO: 4017461 - RNA, 14 nt, Human T-lymphotropic virus 1
cuguggugccuccu

SEQ ID NO: 4017462 - RNA, 20 nt, Human T-lymphotropic virus 1
cuguuucgccuucucagccc

SEQ ID NO: 4017463 - RNA, 21 nt, Human T-lymphotropic virus 1
cuuaagguccuuaccccgcca

SEQ ID NO: 4017464 - RNA, 14 nt, Human T-lymphotropic virus 1
cuucaagaagcugc

SEQ ID NO: 4017465 - RNA, 13 nt, Human T-lymphotropic virus 1
cuucaccacuccc

SEQ ID NO: 4017466 - RNA, 20 nt, Human T-lymphotropic virus 1
cuuccucuucuccucagccc

SEQ ID NO: 4017467 - RNA, 23 nt, Human T-lymphotropic virus 1
cuuccuuuucaaauacucagcaa

SEQ ID NO: 4017468 - RNA, 12 nt, Human T-lymphotropic virus 1
cuucucagcccc

SEQ ID NO: 4017469 - RNA, 14 nt, Human T-lymphotropic virus 1
cuucuccucagccc

SEQ ID NO: 4017470 - RNA, 14 nt, Human T-lymphotropic virus 1
cuucuccucuuccu

SEQ ID NO: 4017471 - RNA, 20 nt, Human T-lymphotropic virus 1
cuugcccuaggcaccuucca

SEQ ID NO: 4017472 - RNA, 16 nt, Human T-lymphotropic virus 1
cuuguccuuuaacucu

SEQ ID NO: 4017473 - RNA, 17 nt, Human T-lymphotropic virus 1
cuuucaggcccuccugc

SEQ ID NO: 4017474 - RNA, 18 nt, Human T-lymphotropic virus 1
cuuuucaaauacucagca

SEQ ID NO: 4017475 - RNA, 12 nt, Human T-lymphotropic virus 1
cuuuuccagccu

SEQ ID NO: 4017476 - RNA, 22 nt, Human T-lymphotropic virus 1
cuuuucuuaaaacaacugcccc

SEQ ID NO: 4017477 - RNA, 14 nt, Human T-lymphotropic virus 1
gaacaccucccaag

SEQ ID NO: 4017478 - RNA, 21 nt, Human T-lymphotropic virus 1
gaagccaccgggaaccaccca

SEQ ID NO: 4017479 - RNA, 17 nt, Human T-lymphotropic virus 1
gaagucagcggccuucu

SEQ ID NO: 4017480 - RNA, 23 nt, Human T-lymphotropic virus 1
ccccaugugauuuuuugccaccc

SEQ ID NO: 4017481 - RNA, 20 nt, Human T-lymphotropic virus 1
ccccauuggcuccugugaaa

SEQ ID NO: 4017482 - RNA, 15 nt, Human T-lymphotropic virus 1
cccccaacuccugca

SEQ ID NO: 4017483 - RNA, 18 nt, Human T-lymphotropic virus 1
ccccccuuuuccuuguca

SEQ ID NO: 4017484 - RNA, 13 nt, Human T-lymphotropic virus 1
ccccuacuggaaa

SEQ ID NO: 4017485 - RNA, 20 nt, Human T-lymphotropic virus 1
ccccugacuuguccagccug

SEQ ID NO: 4017486 - RNA, 21 nt, Human T-lymphotropic virus 1
ccccugacuuguccagccugc

SEQ ID NO: 4017487 - RNA, 15 nt, Human T-lymphotropic virus 1
ccccuguccugcagc

SEQ ID NO: 4017488 - RNA, 22 nt, Human T-lymphotropic virus 1
ccccuuucaggcccuccugccc

SEQ ID NO: 4017489 - RNA, 16 nt, Human T-lymphotropic virus 1
cccgaaaucagccagu

SEQ ID NO: 4017490 - RNA, 13 nt, Human T-lymphotropic virus 1
cccgacuccagcc

SEQ ID NO: 4017491 - RNA, 23 nt, Human T-lymphotropic virus 1
cccgccaaucacucauacaaccc

SEQ ID NO: 4017492 - RNA, 21 nt, Human T-lymphotropic virus 1
cccgcgagguggcgcuuuccc

SEQ ID NO: 4017493 - RNA, 21 nt, Human T-lymphotropic virus 1
cccggcacuagauacgccugg

SEQ ID NO: 4017494 - RNA, 22 nt, Human T-lymphotropic virus 1
cccgggggcuuagagccucuca

SEQ ID NO: 4017495 - RNA, 15 nt, Human T-lymphotropic virus 1
cccgucggaggcccc

SEQ ID NO: 4017496 - RNA, 16 nt, Human T-lymphotropic virus 1
cccuacagccacccug

SEQ ID NO: 4017497 - RNA, 21 nt, Human T-lymphotropic virus 1
cccuacuuugcuuucacuguc

SEQ ID NO: 4017498 - RNA, 19 nt, Human T-lymphotropic virus 1
cccucaccacuccaggccu

SEQ ID NO: 4017499 - RNA, 23 nt, Human T-lymphotropic virus 1
cccucccaugcggaccugcaacu

SEQ ID NO: 4017500 - RNA, 16 nt, Human T-lymphotropic virus 1
cccuccuuccuccagg

SEQ ID NO: 4017501 - RNA, 16 nt, Human T-lymphotropic virus 1
cccucgacuccccucc

SEQ ID NO: 4017502 - RNA, 20 nt, Human T-lymphotropic virus 1
cccugacuuguccagccugc

SEQ ID NO: 4017503 - RNA, 20 nt, Human T-lymphotropic virus 1
cccuguccugcagcucucuc

SEQ ID NO: 4017504 - RNA, 22 nt, Human T-lymphotropic virus 1
cccuucuagucgacgcuccagg

SEQ ID NO: 4017505 - RNA, 21 nt, Human T-lymphotropic virus 1
cccuugucgcgcuacuccuuc

SEQ ID NO: 4017506 - RNA, 23 nt, Human T-lymphotropic virus 1
ccgcaguagacuaguccaaaccc

SEQ ID NO: 4017507 - RNA, 20 nt, Human T-lymphotropic virus 1
ccgccuguggugccuccuga

SEQ ID NO: 4017508 - RNA, 14 nt, Human T-lymphotropic virus 1
ccgcggcuuuccuc

SEQ ID NO: 4017509 - RNA, 16 nt, Human T-lymphotropic virus 1
ccggaggacagcucag

SEQ ID NO: 4017510 - RNA, 16 nt, Human T-lymphotropic virus 1
ccggcgcugcucucau

SEQ ID NO: 4017511 - RNA, 14 nt, Human T-lymphotropic virus 1
ccggcuccaugucc

SEQ ID NO: 4017512 - RNA, 20 nt, Human T-lymphotropic virus 1
ccggcuccaugucccucgcc

SEQ ID NO: 4017513 - RNA, 15 nt, Human T-lymphotropic virus 1
ccggcucuccacgcu

SEQ ID NO: 4017514 - RNA, 18 nt, Human T-lymphotropic virus 1
ccgucacgcugacagccu

SEQ ID NO: 4017515 - RNA, 22 nt, Human T-lymphotropic virus 1
ccgucacgcugacagccuggca

SEQ ID NO: 4017516 - RNA, 17 nt, Human T-lymphotropic virus 1
ccguggaggcuccucaa

SEQ ID NO: 4017517 - RNA, 16 nt, Human T-lymphotropic virus 1
ccuaaccaagacccaa

SEQ ID NO: 4017518 - RNA, 19 nt, Human T-lymphotropic virus 1
ccuaaccacaucuggcaag

SEQ ID NO: 4017519 - RNA, 22 nt, Human T-lymphotropic virus 1
ccuaccccacacuagccagugc

SEQ ID NO: 4017520 - RNA, 20 nt, Human T-lymphotropic virus 1
ccuaccuuacgccagccccu

SEQ ID NO: 4017521 - RNA, 15 nt, Human T-lymphotropic virus 1
ccuacuggccaccug

SEQ ID NO: 4017522 - RNA, 23 nt, Human T-lymphotropic virus 1
ccuauacaggagccgucuccagc

SEQ ID NO: 4017523 - RNA, 13 nt, Human T-lymphotropic virus 1
ccuauacucuccc

SEQ ID NO: 4017524 - RNA, 18 nt, Human T-lymphotropic virus 1
ccuccagccuccccugcc

SEQ ID NO: 4017525 - RNA, 20 nt, Human T-lymphotropic virus 1
ccuccgcccgcuuccugcgc

SEQ ID NO: 4017526 - RNA, 15 nt, Human T-lymphotropic virus 1
ccuccuucuccugca

SEQ ID NO: 4017527 - RNA, 21 nt, Human T-lymphotropic virus 1
ccucucccaucaaauccuccu

SEQ ID NO: 4017528 - RNA, 23 nt, Human T-lymphotropic virus 1
ccucuggggaggcuccguugucu

SEQ ID NO: 4017529 - RNA, 13 nt, Human T-lymphotropic virus 1
ccucuucuccuca

SEQ ID NO: 4017530 - RNA, 22 nt, Human T-lymphotropic virus 1
ccugaacuacguccgccgucua

SEQ ID NO: 4017531 - RNA, 16 nt, Human T-lymphotropic virus 1
ccugacuuguccagcc

SEQ ID NO: 4017532 - RNA, 17 nt, Human T-lymphotropic virus 1
ccugacuuguccagccu

SEQ ID NO: 4017533 - RNA, 18 nt, Human T-lymphotropic virus 1
ccugaucccaucuccagg

SEQ ID NO: 4017534 - RNA, 22 nt, Human T-lymphotropic virus 1
ccugcaauccugcccagccagu

SEQ ID NO: 4017535 - RNA, 14 nt, Human T-lymphotropic virus 1
ccugcagcccauuc

SEQ ID NO: 4017536 - RNA, 21 nt, Human T-lymphotropic virus 1
ccugccgcaaaaauaacccac

SEQ ID NO: 4017537 - RNA, 22 nt, Human T-lymphotropic virus 1
ccugccuauauuucccaagacu

SEQ ID NO: 4017538 - RNA, 23 nt, Human T-lymphotropic virus 1
ccugggggcagcuacuugccuca

SEQ ID NO: 4017539 - RNA, 16 nt, Human T-lymphotropic virus 1
ccugucuuuuccagac

SEQ ID NO: 4017540 - RNA, 21 nt, Human T-lymphotropic virus 1
ccuuaauaccgaacccagcca

SEQ ID NO: 4017541 - RNA, 14 nt, Human T-lymphotropic virus 1
ccuuaugccagugu

SEQ ID NO: 4017542 - RNA, 13 nt, Human T-lymphotropic virus 1
ccuucucagcccc

SEQ ID NO: 4017543 - RNA, 14 nt, Human T-lymphotropic virus 1
ccuucuccuccgcc

SEQ ID NO: 4017544 - RNA, 23 nt, Human T-lymphotropic virus 1
ccuucuccuccgcccgcuuccug

SEQ ID NO: 4017545 - RNA, 12 nt, Human T-lymphotropic virus 1
ccuugccuguuu

SEQ ID NO: 4017546 - RNA, 15 nt, Human T-lymphotropic virus 1
ccuuggccucucaca

SEQ ID NO: 4017547 - RNA, 20 nt, Human T-lymphotropic virus 1
ccuugggcuagaacaccucc

SEQ ID NO: 4017548 - RNA, 23 nt, Human T-lymphotropic virus 1
ccuuuaacucuuccuccaaggau

SEQ ID NO: 4017549 - RNA, 13 nt, Human T-lymphotropic virus 1
ccuuuuccagccu

SEQ ID NO: 4017550 - RNA, 15 nt, Human T-lymphotropic virus 1
cgacaaccccucacc

SEQ ID NO: 4017551 - RNA, 15 nt, Human T-lymphotropic virus 1
cgacauuacccauuu

SEQ ID NO: 4017552 - RNA, 13 nt, Human T-lymphotropic virus 1
cgaccugcuggcc

SEQ ID NO: 4017553 - RNA, 22 nt, Human T-lymphotropic virus 1
cgcagccauaccaaucuaccug

SEQ ID NO: 4017554 - RNA, 13 nt, Human T-lymphotropic virus 1
cgcaucucuccuu

SEQ ID NO: 4017555 - RNA, 17 nt, Human T-lymphotropic virus 1
cgcaucucuccuucacg

SEQ ID NO: 4017556 - RNA, 15 nt, Human T-lymphotropic virus 1
cgccauacuacccau

SEQ ID NO: 4017557 - RNA, 20 nt, Human T-lymphotropic virus 1
cgccccuccucuacucuccc

SEQ ID NO: 4017558 - RNA, 23 nt, Human T-lymphotropic virus 1
cgcccuacuggccaccuguccag

SEQ ID NO: 4017559 - RNA, 17 nt, Human T-lymphotropic virus 1
cgccgugccuucuccuc

SEQ ID NO: 4017560 - RNA, 14 nt, Human T-lymphotropic virus 1
cgccguggccuacu

SEQ ID NO: 4017561 - RNA, 18 nt, Human T-lymphotropic virus 1
cgccuuaccugaggccgc

SEQ ID NO: 4017562 - RNA, 15 nt, Human T-lymphotropic virus 1
cgccuucucagcccc

SEQ ID NO: 4017563 - RNA, 17 nt, Human T-lymphotropic virus 1
cgcggcuuuccucuucu

SEQ ID NO: 4017564 - RNA, 21 nt, Human T-lymphotropic virus 1
cgcuaguucugcccaguggau

SEQ ID NO: 4017565 - RNA, 19 nt, Human T-lymphotropic virus 1
cgcucacggcgcuccugcu

SEQ ID NO: 4017566 - RNA, 18 nt, Human T-lymphotropic virus 1
cgcucuaauggcauucuu

SEQ ID NO: 4017567 - RNA, 11 nt, Human T-lymphotropic virus 1
cgcuuuccccc

SEQ ID NO: 4017568 - RNA, 22 nt, Human T-lymphotropic virus 1
cggaaggcccuggaggcaggcc

SEQ ID NO: 4017569 - RNA, 17 nt, Human T-lymphotropic virus 1
cggaggacagcucagca

SEQ ID NO: 4017570 - RNA, 21 nt, Human T-lymphotropic virus 1
cggaggcuauuauucagccuc

SEQ ID NO: 4017571 - RNA, 15 nt, Human T-lymphotropic virus 1
cggaguggcuggcag

SEQ ID NO: 4017572 - RNA, 16 nt, Human T-lymphotropic virus 1
cggauccaccucccag

SEQ ID NO: 4017573 - RNA, 18 nt, Human T-lymphotropic virus 1
cggauccaccucccaggc

SEQ ID NO: 4017574 - RNA, 18 nt, Human T-lymphotropic virus 1
cggcgcuccugcucuucc

SEQ ID NO: 4017575 - RNA, 21 nt, Human T-lymphotropic virus 1
cggcuccaugucccucgccuc

SEQ ID NO: 4017576 - RNA, 20 nt, Human T-lymphotropic virus 1
cggcucuccacgcuuugccu

SEQ ID NO: 4017577 - RNA, 20 nt, Human T-lymphotropic virus 1
cgggccacuaacucucuaac

SEQ ID NO: 4017578 - RNA, 22 nt, Human T-lymphotropic virus 1
cgucacgcccuacuggccaccu

SEQ ID NO: 4017579 - RNA, 21 nt, Human T-lymphotropic virus 1
cgucuccccccggaggacagc

SEQ ID NO: 4017580 - RNA, 14 nt, Human T-lymphotropic virus 1
cguggaggcuccuc

SEQ ID NO: 4017581 - RNA, 21 nt, Human T-lymphotropic virus 1
accacaucgccuccagccucc

SEQ ID NO: 4017582 - RNA, 13 nt, Human T-lymphotropic virus 1
accaugagcccca

SEQ ID NO: 4017583 - RNA, 18 nt, Human T-lymphotropic virus 1
acccagccaacugccucc

SEQ ID NO: 4017584 - RNA, 23 nt, Human T-lymphotropic virus 1
acccagucuacguguuuggagac

SEQ ID NO: 4017585 - RNA, 15 nt, Human T-lymphotropic virus 1
acccccaacuccugc

SEQ ID NO: 4017586 - RNA, 18 nt, Human T-lymphotropic virus 1
acccccauuacucucuua

SEQ ID NO: 4017587 - RNA, 15 nt, Human T-lymphotropic virus 1
accccgccaaucacu

SEQ ID NO: 4017588 - RNA, 21 nt, Human T-lymphotropic virus 1
accccucauuucuacucucac

SEQ ID NO: 4017589 - RNA, 13 nt, Human T-lymphotropic virus 1
acccuccuuccuc

SEQ ID NO: 4017590 - RNA, 14 nt, Human T-lymphotropic virus 1
acccuccuuccucc

SEQ ID NO: 4017591 - RNA, 20 nt, Human T-lymphotropic virus 1
acccuugggcagcaccuccc

SEQ ID NO: 4017592 - RNA, 15 nt, Human T-lymphotropic virus 1
accgccccuccucua

SEQ ID NO: 4017593 - RNA, 23 nt, Human T-lymphotropic virus 1
accggcuccaugucccucgccuc

SEQ ID NO: 4017594 - RNA, 18 nt, Human T-lymphotropic virus 1
accuaaacaguuccagcc

SEQ ID NO: 4017595 - RNA, 21 nt, Human T-lymphotropic virus 1
accugaucccaucuccaggcu

SEQ ID NO: 4017596 - RNA, 19 nt, Human T-lymphotropic virus 1
accugcaacuacucucaga

SEQ ID NO: 4017597 - RNA, 13 nt, Human T-lymphotropic virus 1
accugcuggcccu

SEQ ID NO: 4017598 - RNA, 15 nt, Human T-lymphotropic virus 1
accuggccccuccug

SEQ ID NO: 4017599 - RNA, 20 nt, Human T-lymphotropic virus 1
accuuggccucucacagugg

SEQ ID NO: 4017600 - RNA, 18 nt, Human T-lymphotropic virus 1
acgacaaccccucaccuc

SEQ ID NO: 4017601 - RNA, 17 nt, Human T-lymphotropic virus 1
acgacaccuccccucgc

SEQ ID NO: 4017602 - RNA, 18 nt, Human T-lymphotropic virus 1
acgcccuacuggccaccu

SEQ ID NO: 4017603 - RNA, 22 nt, Human T-lymphotropic virus 1
acgcguuaucggcucagcucua

SEQ ID NO: 4017604 - RNA, 18 nt, Human T-lymphotropic virus 1
acgcuuugccugacccug

SEQ ID NO: 4017605 - RNA, 14 nt, Human T-lymphotropic virus 1
acgucuccccccgg

SEQ ID NO: 4017606 - RNA, 21 nt, Human T-lymphotropic virus 1
acuaauucccaugucucaaua

SEQ ID NO: 4017607 - RNA, 17 nt, Human T-lymphotropic virus 1
acucagcaaucugcuuu

SEQ ID NO: 4017608 - RNA, 22 nt, Human T-lymphotropic virus 1
acuccagccgaucccagagaca

SEQ ID NO: 4017609 - RNA, 14 nt, Human T-lymphotropic virus 1
acuccccuccuucc

SEQ ID NO: 4017610 - RNA, 14 nt, Human T-lymphotropic virus 1
acucucccacucua

SEQ ID NO: 4017611 - RNA, 16 nt, Human T-lymphotropic virus 1
acugccucccaccgcc

SEQ ID NO: 4017612 - RNA, 14 nt, Human T-lymphotropic virus 1
acugucccacagca

SEQ ID NO: 4017613 - RNA, 18 nt, Human T-lymphotropic virus 1
acuuguccagccugccaa

SEQ ID NO: 4017614 - RNA, 19 nt, Human T-lymphotropic virus 1
agacccgucggaggccccg

SEQ ID NO: 4017615 - RNA, 14 nt, Human T-lymphotropic virus 1
agaccuacacaguu

SEQ ID NO: 4017616 - RNA, 17 nt, Human T-lymphotropic virus 1
agacgccuuuuuccaaa

SEQ ID NO: 4017617 - RNA, 22 nt, Human T-lymphotropic virus 1
agacuaguccaaacccugcccc

SEQ ID NO: 4017618 - RNA, 23 nt, Human T-lymphotropic virus 1
agagacacauucccucagcaaua

SEQ ID NO: 4017619 - RNA, 16 nt, Human T-lymphotropic virus 1
agaucaggcccuacag

SEQ ID NO: 4017620 - RNA, 22 nt, Human T-lymphotropic virus 1
agauucaagcuauagucuccuc

SEQ ID NO: 4017621 - RNA, 19 nt, Human T-lymphotropic virus 1
agcacaguuuccuccuccu

SEQ ID NO: 4017622 - RNA, 19 nt, Human T-lymphotropic virus 1
agcacuaauuauacuugca

SEQ ID NO: 4017623 - RNA, 13 nt, Human T-lymphotropic virus 1
agcagcaguggcc

SEQ ID NO: 4017624 - RNA, 14 nt, Human T-lymphotropic virus 1
agccaucuuuagua

SEQ ID NO: 4017625 - RNA, 13 nt, Human T-lymphotropic virus 1
agccccccaccug

SEQ ID NO: 4017626 - RNA, 15 nt, Human T-lymphotropic virus 1
agccccuugucucca

SEQ ID NO: 4017627 - RNA, 19 nt, Human T-lymphotropic virus 1
agccccuugucuccacuug

SEQ ID NO: 4017628 - RNA, 14 nt, Human T-lymphotropic virus 1
agccuccccugcca

SEQ ID NO: 4017629 - RNA, 15 nt, Human T-lymphotropic virus 1
agccuccccugccaa

SEQ ID NO: 4017630 - RNA, 20 nt, Human T-lymphotropic virus 1
agcuacgacaccuccccucg

SEQ ID NO: 4017631 - RNA, 15 nt, Human T-lymphotropic virus 1
agcuacuugccucag

SEQ ID NO: 4017632 - RNA, 13 nt, Human T-lymphotropic virus 1
agcugcaugccca

SEQ ID NO: 4017633 - RNA, 12 nt, Human T-lymphotropic virus 1
aggacagcucag

SEQ ID NO: 4017634 - RNA, 17 nt, Human T-lymphotropic virus 1
aggacagcucagcacca

SEQ ID NO: 4017635 - RNA, 18 nt, Human T-lymphotropic virus 1
aggagccgucuccagccc

SEQ ID NO: 4017636 - RNA, 17 nt, Human T-lymphotropic virus 1
aggcaccuuccaaggca

SEQ ID NO: 4017637 - RNA, 16 nt, Human T-lymphotropic virus 1
aggcagguccucucag

SEQ ID NO: 4017638 - RNA, 20 nt, Human T-lymphotropic virus 1
aggcccuggaggcaggccau

SEQ ID NO: 4017639 - RNA, 20 nt, Human T-lymphotropic virus 1
aggcgacauuacccauuuca

SEQ ID NO: 4017640 - RNA, 13 nt, Human T-lymphotropic virus 1
aggcuaggcccug

SEQ ID NO: 4017641 - RNA, 19 nt, Human T-lymphotropic virus 1
aggcuauuauucagccucu

SEQ ID NO: 4017642 - RNA, 19 nt, Human T-lymphotropic virus 1
agguaaguuuagagcucag

SEQ ID NO: 4017643 - RNA, 21 nt, Human T-lymphotropic virus 1
aguaaguuacuccagcuacca

SEQ ID NO: 4017644 - RNA, 12 nt, Human T-lymphotropic virus 1
aguacuacccca

SEQ ID NO: 4017645 - RNA, 15 nt, Human T-lymphotropic virus 1
aguacuuuacugaca

SEQ ID NO: 4017646 - RNA, 12 nt, Human T-lymphotropic virus 1
aguaugcugccc

SEQ ID NO: 4017647 - RNA, 23 nt, Human T-lymphotropic virus 1
aguauucccaguuaaaaaagcca

SEQ ID NO: 4017648 - RNA, 15 nt, Human T-lymphotropic virus 1
agucagcggccuucu

SEQ ID NO: 4017649 - RNA, 19 nt, Human T-lymphotropic virus 1
aguccaaacccugccccuc

SEQ ID NO: 4017650 - RNA, 19 nt, Human T-lymphotropic virus 1
aguccuuccgauagccuug

SEQ ID NO: 4017651 - RNA, 22 nt, Human T-lymphotropic virus 1
aguguuccuaucuuacuccacc

SEQ ID NO: 4017652 - RNA, 17 nt, Human T-lymphotropic virus 1
aguguuuacucuuuccc

SEQ ID NO: 4017653 - RNA, 12 nt, Human T-lymphotropic virus 1
aguucugccccc

SEQ ID NO: 4017654 - RNA, 18 nt, Human T-lymphotropic virus 1
aguuuccuccuccuccuu

SEQ ID NO: 4017655 - RNA, 21 nt, Human T-lymphotropic virus 1
auacaggagccgucuccagcc

SEQ ID NO: 4017656 - RNA, 16 nt, Human T-lymphotropic virus 1
auacaggcgccagcug

SEQ ID NO: 4017657 - RNA, 19 nt, Human T-lymphotropic virus 1
auacaguacucuuccuuuc

SEQ ID NO: 4017658 - RNA, 22 nt, Human T-lymphotropic virus 1
auacuacccauguccccuacaa

SEQ ID NO: 4017659 - RNA, 16 nt, Human T-lymphotropic virus 1
auagaaaaacuccucu

SEQ ID NO: 4017660 - RNA, 16 nt, Human T-lymphotropic virus 1
aucaccugggacccca

SEQ ID NO: 4017661 - RNA, 23 nt, Human T-lymphotropic virus 1
aucauuaccuucggacccuugcc

SEQ ID NO: 4017662 - RNA, 15 nt, Human T-lymphotropic virus 1
auccaaccagcuccg

SEQ ID NO: 4017663 - RNA, 22 nt, Human T-lymphotropic virus 1
aucccccgggggcuuagagccu

SEQ ID NO: 4017664 - RNA, 20 nt, Human T-lymphotropic virus 1
auccuauggacuacucugcc

SEQ ID NO: 4017665 - RNA, 15 nt, Human T-lymphotropic virus 1
auccugcgcucuugc

SEQ ID NO: 4017666 - RNA, 16 nt, Human T-lymphotropic virus 1
aucgccuccagccucc

SEQ ID NO: 4017667 - RNA, 18 nt, Human T-lymphotropic virus 1
aucgucacgcccuacugg

SEQ ID NO: 4017668 - RNA, 16 nt, Human T-lymphotropic virus 1
aucuccacccaaaccu

SEQ ID NO: 4017669 - RNA, 18 nt, Human T-lymphotropic virus 1
aucucucaucaucuuccc

SEQ ID NO: 4017670 - RNA, 11 nt, Human T-lymphotropic virus 1
aucucuccuuc

SEQ ID NO: 4017671 - RNA, 18 nt, Human T-lymphotropic virus 1
aucugaccaccccagugu

SEQ ID NO: 4017672 - RNA, 22 nt, Human T-lymphotropic virus 1
augacaaugaccaugagcccca

SEQ ID NO: 4017673 - RNA, 21 nt, Human T-lymphotropic virus 1
augacauucuccuggcaagcc

SEQ ID NO: 4017674 - RNA, 17 nt, Human T-lymphotropic virus 1
augcuguuucgccuucu

SEQ ID NO: 4017675 - RNA, 20 nt, Human T-lymphotropic virus 1
auggcagcuucaccacuccc

SEQ ID NO: 4017676 - RNA, 20 nt, Human T-lymphotropic virus 1
auguauuaaccaacugccac

SEQ ID NO: 4017677 - RNA, 15 nt, Human T-lymphotropic virus 1
augucaauuuuacuc

SEQ ID NO: 4017678 - RNA, 18 nt, Human T-lymphotropic virus 1
auuacagcaaguccuucc

SEQ ID NO: 4017679 - RNA, 12 nt, Human T-lymphotropic virus 1
auuauucagccu

SEQ ID NO: 4017680 - RNA, 13 nt, Human T-lymphotropic virus 1
auuauucagccuc

SEQ ID NO: 4017681 - RNA, 21 nt, Human T-lymphotropic virus 1
auucaagcuauagucuccucc

SEQ ID NO: 4017682 - RNA, 23 nt, Human T-lymphotropic virus 1
auucccaguuaaaaaagccaaug

SEQ ID NO: 4017683 - RNA, 21 nt, Human T-lymphotropic virus 1
auugcacaguaugcugcccag

SEQ ID NO: 4017684 - RNA, 23 nt, Human T-lymphotropic virus 1
auuuccucuuugcuccaggccau

SEQ ID NO: 4017685 - RNA, 17 nt, Human T-lymphotropic virus 1
caaaaacaacugggcca

SEQ ID NO: 4017686 - RNA, 19 nt, Human T-lymphotropic virus 1
caaacaucgaaacagcccu

SEQ ID NO: 4017687 - RNA, 18 nt, Human T-lymphotropic virus 1
caaauaauuucaccuaau

SEQ ID NO: 4017688 - RNA, 20 nt, Human T-lymphotropic virus 1
caaccacaucgccuccagcc

SEQ ID NO: 4017689 - RNA, 13 nt, Human T-lymphotropic virus 1
caacuacacuagc

SEQ ID NO: 4017690 - RNA, 21 nt, Human T-lymphotropic virus 1
caacugccccauuggcuccug

SEQ ID NO: 4017691 - RNA, 15 nt, Human T-lymphotropic virus 1
caagccguccucagg

SEQ ID NO: 4017692 - RNA, 17 nt, Human T-lymphotropic virus 1
caaggacuccaccucgc

SEQ ID NO: 4017693 - RNA, 14 nt, Human T-lymphotropic virus 1
caaggcagguccuc

SEQ ID NO: 4017694 - RNA, 17 nt, Human T-lymphotropic virus 1
caaggcagguccucuca

SEQ ID NO: 4017695 - RNA, 18 nt, Human T-lymphotropic virus 1
caauaaacaaacccauug

SEQ ID NO: 4017696 - RNA, 16 nt, Human T-lymphotropic virus 1
caauccugcccagcca

SEQ ID NO: 4017697 - RNA, 23 nt, Human T-lymphotropic virus 1
caauggcccugccuauauuuccc

SEQ ID NO: 4017698 - RNA, 14 nt, Human T-lymphotropic virus 1
cacaucgccuccag

SEQ ID NO: 4017699 - RNA, 19 nt, Human T-lymphotropic virus 1
caccccucauuucuacucu

SEQ ID NO: 4017700 - RNA, 14 nt, Human T-lymphotropic virus 1
cacccuccuuccuc

SEQ ID NO: 4017701 - RNA, 20 nt, Human T-lymphotropic virus 1
cacccuugucgcgcuacucc

SEQ ID NO: 4017702 - RNA, 13 nt, Human T-lymphotropic virus 1
caccgccccuccu

SEQ ID NO: 4017703 - RNA, 20 nt, Human T-lymphotropic virus 1
caccgccccuccucuacucu

SEQ ID NO: 4017704 - RNA, 14 nt, Human T-lymphotropic virus 1
caccucccaaggcc

SEQ ID NO: 4017705 - RNA, 14 nt, Human T-lymphotropic virus 1
caccuuccaaggca

SEQ ID NO: 4017706 - RNA, 16 nt, Human T-lymphotropic virus 1
cacgcauacggcucaa

SEQ ID NO: 4017707 - RNA, 22 nt, Human T-lymphotropic virus 1
cacgcccuacuggccaccuguc

SEQ ID NO: 4017708 - RNA, 15 nt, Human T-lymphotropic virus 1
cacgcugacagccug

SEQ ID NO: 4017709 - RNA, 13 nt, Human T-lymphotropic virus 1
cacuaacucucua

SEQ ID NO: 4017710 - RNA, 20 nt, Human T-lymphotropic virus 1
cacucaacccucaccacucc

SEQ ID NO: 4017711 - RNA, 22 nt, Human T-lymphotropic virus 1
cacuuacaaacuauagaccuua

SEQ ID NO: 4017712 - RNA, 17 nt, Human T-lymphotropic virus 1
cacuuuaagcucaccuc

SEQ ID NO: 4017713 - RNA, 14 nt, Human T-lymphotropic virus 1
cagaacgccuccag

SEQ ID NO: 4017714 - RNA, 17 nt, Human T-lymphotropic virus 1
cagaacgccuccaggcc

SEQ ID NO: 4017715 - RNA, 13 nt, Human T-lymphotropic virus 1
cagaccagccacc

SEQ ID NO: 4017716 - RNA, 13 nt, Human T-lymphotropic virus 1
cagaccuccggga

SEQ ID NO: 4017717 - RNA, 14 nt, Human T-lymphotropic virus 1
cagacggcccucac

SEQ ID NO: 4017718 - RNA, 22 nt, Human T-lymphotropic virus 1
cagacggcccucacacugcaag

SEQ ID NO: 4017719 - RNA, 19 nt, Human T-lymphotropic virus 1
cagagacacauucccucag

SEQ ID NO: 4017720 - RNA, 15 nt, Human T-lymphotropic virus 1
cagccacccaaagac

SEQ ID NO: 4017721 - RNA, 18 nt, Human T-lymphotropic virus 1
cagcccauucggcaagcc

SEQ ID NO: 4017722 - RNA, 16 nt, Human T-lymphotropic virus 1
cagccccuugucucca

SEQ ID NO: 4017723 - RNA, 13 nt, Human T-lymphotropic virus 1
cagccgaucccag

SEQ ID NO: 4017724 - RNA, 20 nt, Human T-lymphotropic virus 1
cagccucuuauucagacccu

SEQ ID NO: 4017725 - RNA, 21 nt, Human T-lymphotropic virus 1
cagccugcuagggcacccguc

SEQ ID NO: 4017726 - RNA, 12 nt, Human T-lymphotropic virus 1
cagcggccuucu

SEQ ID NO: 4017727 - RNA, 18 nt, Human T-lymphotropic virus 1
cagcuacgacaccucccc

SEQ ID NO: 4017728 - RNA, 16 nt, Human T-lymphotropic virus 1
cagcuacuugccucag

SEQ ID NO: 4017729 - RNA, 18 nt, Human T-lymphotropic virus 1
cagcuacuugccucagcu

SEQ ID NO: 4017730 - RNA, 21 nt, Human T-lymphotropic virus 1
cagcucagcaccagcucaggc

SEQ ID NO: 4017731 - RNA, 16 nt, Human T-lymphotropic virus 1
cagcucaggcuaggcc

SEQ ID NO: 4017732 - RNA, 17 nt, Human T-lymphotropic virus 1
cagcucggggccuuccu

SEQ ID NO: 4017733 - RNA, 17 nt, Human T-lymphotropic virus 1
cagcucuacaguuccuu

SEQ ID NO: 4017734 - RNA, 21 nt, Human T-lymphotropic virus 1
cagcuguguuauuacucgaca

SEQ ID NO: 4017735 - RNA, 16 nt, Human T-lymphotropic virus 1
cagcuucaccacuccc

SEQ ID NO: 4017736 - RNA, 21 nt, Human T-lymphotropic virus 1
caggcccccuuucaggcccuc

SEQ ID NO: 4017737 - RNA, 20 nt, Human T-lymphotropic virus 1
caggcccuacagccacccug

SEQ ID NO: 4017738 - RNA, 13 nt, Human T-lymphotropic virus 1
caguaugcugccc

SEQ ID NO: 4017739 - RNA, 21 nt, Human T-lymphotropic virus 1
caguucugcccccucauccuc

SEQ ID NO: 4017740 - RNA, 18 nt, Human T-lymphotropic virus 1
caguuggagucuccucau

SEQ ID NO: 4017741 - RNA, 13 nt, Human T-lymphotropic virus 1
cauaacucccuca

SEQ ID NO: 4017742 - RNA, 14 nt, Human T-lymphotropic virus 1
cauaagcucagacc

SEQ ID NO: 4017743 - RNA, 20 nt, Human T-lymphotropic virus 1
cauaccuagggugccaauca

SEQ ID NO: 4017744 - RNA, 14 nt, Human T-lymphotropic virus 1
cauacggcucaaua

SEQ ID NO: 4017745 - RNA, 17 nt, Human T-lymphotropic virus 1
caucaacccccaacucc

SEQ ID NO: 4017746 - RNA, 15 nt, Human T-lymphotropic virus 1
caucaccuggccccu

SEQ ID NO: 4017747 - RNA, 17 nt, Human T-lymphotropic virus 1
caucaccuggccccucc

SEQ ID NO: 4017748 - RNA, 19 nt, Human T-lymphotropic virus 1
caucauaacaucuccaccc

SEQ ID NO: 4017749 - RNA, 18 nt, Human T-lymphotropic virus 1
caucaucuucccccgggc

SEQ ID NO: 4017750 - RNA, 19 nt, Human T-lymphotropic virus 1
caucccuguaaaccaagca

SEQ ID NO: 4017751 - RNA, 22 nt, Human T-lymphotropic virus 1
cauccgccguggccuacucccu

SEQ ID NO: 4017752 - RNA, 23 nt, Human T-lymphotropic virus 1
cauccucggugauuacagcccca

SEQ ID NO: 4017753 - RNA, 22 nt, Human T-lymphotropic virus 1
caucgccuccagccuccccugc

SEQ ID NO: 4017754 - RNA, 20 nt, Human T-lymphotropic virus 1
caucguuagcgcuuccagcc

SEQ ID NO: 4017755 - RNA, 13 nt, Human T-lymphotropic virus 1
caugccccccuac

SEQ ID NO: 4017756 - RNA, 16 nt, Human T-lymphotropic virus 1
cauggaacccacccuu

SEQ ID NO: 4017757 - RNA, 19 nt, Human T-lymphotropic virus 1
cauggaugacauucuccug

SEQ ID NO: 4017758 - RNA, 16 nt, Human T-lymphotropic virus 1
cauggccucuccagcg

SEQ ID NO: 4017759 - RNA, 14 nt, Human T-lymphotropic virus 1
cauucccccuuccg

SEQ ID NO: 4017760 - RNA, 22 nt, Human T-lymphotropic virus 1
cauuuaacuggacccacugcuu

SEQ ID NO: 4017761 - RNA, 18 nt, Human T-lymphotropic virus 1
ccaaaucccccuaccuaa

SEQ ID NO: 4017762 - RNA, 22 nt, Human T-lymphotropic virus 1
ccaacauuccacccuccuuccu

SEQ ID NO: 4017763 - RNA, 11 nt, Human T-lymphotropic virus 1
ccaacugccac

SEQ ID NO: 4017764 - RNA, 14 nt, Human T-lymphotropic virus 1
ccaaggacuccacc

SEQ ID NO: 4017765 - RNA, 17 nt, Human T-lymphotropic virus 1
ccaauuccuccaccagc

SEQ ID NO: 4017766 - RNA, 16 nt, Human T-lymphotropic virus 1
ccacaucgccuccagc

SEQ ID NO: 4017767 - RNA, 15 nt, Human T-lymphotropic virus 1
ccaccaacaccaugg

SEQ ID NO: 4017768 - RNA, 21 nt, Human T-lymphotropic virus 1
ccacccuccuuccuccaggcc

SEQ ID NO: 4017769 - RNA, 13 nt, Human T-lymphotropic virus 1
ccaccucgccuuc

SEQ ID NO: 4017770 - RNA, 20 nt, Human T-lymphotropic virus 1
ccacguucgcagccauacca

SEQ ID NO: 4017771 - RNA, 14 nt, Human T-lymphotropic virus 1
ccacuugcgcucac

SEQ ID NO: 4017772 - RNA, 13 nt, Human T-lymphotropic virus 1
ccagaccagccac

SEQ ID NO: 4017773 - RNA, 14 nt, Human T-lymphotropic virus 1
ccagaccagccacc

SEQ ID NO: 4017774 - RNA, 18 nt, Human T-lymphotropic virus 1
ccagcuaccaugccaccu

SEQ ID NO: 4017775 - RNA, 20 nt, Human T-lymphotropic virus 1
ccagcugcuguacucucaca

SEQ ID NO: 4017776 - RNA, 16 nt, Human T-lymphotropic virus 1
ccaguucugcccccuc

SEQ ID NO: 4017777 - RNA, 18 nt, Human T-lymphotropic virus 1
ccauaccaaucuaccuga

SEQ ID NO: 4017778 - RNA, 21 nt, Human T-lymphotropic virus 1
ccauaccaaucuaccugaucc

SEQ ID NO: 4017779 - RNA, 17 nt, Human T-lymphotropic virus 1
ccauauccucgagcccu

SEQ ID NO: 4017780 - RNA, 15 nt, Human T-lymphotropic virus 1
ccaucaaauccuccu

SEQ ID NO: 4017781 - RNA, 19 nt, Human T-lymphotropic virus 1
ccaucguuagcgcuuccag

SEQ ID NO: 4017782 - RNA, 15 nt, Human T-lymphotropic virus 1
ccaucucugggggac

SEQ ID NO: 4017783 - RNA, 15 nt, Human T-lymphotropic virus 1
uacagccacccugcc

SEQ ID NO: 4017784 - RNA, 16 nt, Human T-lymphotropic virus 1
uacagccccagcugcu

SEQ ID NO: 4017785 - RNA, 13 nt, Human T-lymphotropic virus 1
uacaugccccccu

SEQ ID NO: 4017786 - RNA, 15 nt, Human T-lymphotropic virus 1
uaccacaggggcccu

SEQ ID NO: 4017787 - RNA, 19 nt, Human T-lymphotropic virus 1
uaccugaucccaucuccag

SEQ ID NO: 4017788 - RNA, 18 nt, Human T-lymphotropic virus 1
uaccuucggacccuugcc

SEQ ID NO: 4017789 - RNA, 12 nt, Human T-lymphotropic virus 1
uacgccagcccc

SEQ ID NO: 4017790 - RNA, 19 nt, Human T-lymphotropic virus 1
uacugacaaacccgaccua

SEQ ID NO: 4017791 - RNA, 21 nt, Human T-lymphotropic virus 1
uagaucucucaucaucuuccc

SEQ ID NO: 4017792 - RNA, 23 nt, Human T-lymphotropic virus 1
uagcgcuuccagccccccaccug

SEQ ID NO: 4017793 - RNA, 18 nt, Human T-lymphotropic virus 1
uaguccaaacccugcccc

SEQ ID NO: 4017794 - RNA, 13 nt, Human T-lymphotropic virus 1
uagucccacccug

SEQ ID NO: 4017795 - RNA, 20 nt, Human T-lymphotropic virus 1
uauggacaaucaaccaccua

SEQ ID NO: 4017796 - RNA, 15 nt, Human T-lymphotropic virus 1
uauuacucgacaaau

SEQ ID NO: 4017797 - RNA, 13 nt, Human T-lymphotropic virus 1
ucaaauccuccuu

SEQ ID NO: 4017798 - RNA, 14 nt, Human T-lymphotropic virus 1
ucaacccccaacuc

SEQ ID NO: 4017799 - RNA, 20 nt, Human T-lymphotropic virus 1
ucaacccccaacuccugcau

SEQ ID NO: 4017800 - RNA, 16 nt, Human T-lymphotropic virus 1
ucaagaagcugccggc

SEQ ID NO: 4017801 - RNA, 20 nt, Human T-lymphotropic virus 1
ucaagaaguuucacaccuca

SEQ ID NO: 4017802 - RNA, 14 nt, Human T-lymphotropic virus 1
ucaagccguccuca

SEQ ID NO: 4017803 - RNA, 17 nt, Human T-lymphotropic virus 1
ucacaaauuucaaacca

SEQ ID NO: 4017804 - RNA, 15 nt, Human T-lymphotropic virus 1
ucacagaacugccgc

SEQ ID NO: 4017805 - RNA, 13 nt, Human T-lymphotropic virus 1
ucaccacuccagg

SEQ ID NO: 4017806 - RNA, 15 nt, Human T-lymphotropic virus 1
ucaccacuccaggcc

SEQ ID NO: 4017807 - RNA, 21 nt, Human T-lymphotropic virus 1
ucacgcgcccgccgccuuacc

SEQ ID NO: 4017808 - RNA, 19 nt, Human T-lymphotropic virus 1
ucacuuaugaugcaguccc

SEQ ID NO: 4017809 - RNA, 14 nt, Human T-lymphotropic virus 1
ucagaccuccggga

SEQ ID NO: 4017810 - RNA, 17 nt, Human T-lymphotropic virus 1
ucagcccacuucccagg

SEQ ID NO: 4017811 - RNA, 15 nt, Human T-lymphotropic virus 1
ucagccuccaaggac

SEQ ID NO: 4017812 - RNA, 18 nt, Human T-lymphotropic virus 1
ucagcggccuucuccucc

SEQ ID NO: 4017813 - RNA, 19 nt, Human T-lymphotropic virus 1
ucagcggccuucuccuccg

SEQ ID NO: 4017814 - RNA, 16 nt, Human T-lymphotropic virus 1
ucagcuacgacaccuc

SEQ ID NO: 4017815 - RNA, 22 nt, Human T-lymphotropic virus 1
ucagcucuacaguuccuuaucc

SEQ ID NO: 4017816 - RNA, 15 nt, Human T-lymphotropic virus 1
ucaggcccccuuuca

SEQ ID NO: 4017817 - RNA, 23 nt, Human T-lymphotropic virus 1
ucaggcguugacgacaaccccuc

SEQ ID NO: 4017818 - RNA, 13 nt, Human T-lymphotropic virus 1
ucauaagcucaga

SEQ ID NO: 4017819 - RNA, 20 nt, Human T-lymphotropic virus 1
ucauccugccccccuuuucc

SEQ ID NO: 4017820 - RNA, 13 nt, Human T-lymphotropic virus 1
ucauggaccugcc

SEQ ID NO: 4017821 - RNA, 12 nt, Human T-lymphotropic virus 1
uccaaacccugc

SEQ ID NO: 4017822 - RNA, 16 nt, Human T-lymphotropic virus 1
uccaaggacuccaccu

SEQ ID NO: 4017823 - RNA, 15 nt, Human T-lymphotropic virus 1
uccaccaauuccucc

SEQ ID NO: 4017824 - RNA, 22 nt, Human T-lymphotropic virus 1
uccaccagcagguccuccgggc

SEQ ID NO: 4017825 - RNA, 11 nt, Human T-lymphotropic virus 1
uccacccuccu

SEQ ID NO: 4017826 - RNA, 22 nt, Human T-lymphotropic virus 1
uccacccuccuuccuccaggcc

SEQ ID NO: 4017827 - RNA, 12 nt, Human T-lymphotropic virus 1
uccaccucccag

SEQ ID NO: 4017828 - RNA, 13 nt, Human T-lymphotropic virus 1
uccaccucccagg

SEQ ID NO: 4017829 - RNA, 15 nt, Human T-lymphotropic virus 1
uccaccucccaggca

SEQ ID NO: 4017830 - RNA, 15 nt, Human T-lymphotropic virus 1
uccacgcuuugccug

SEQ ID NO: 4017831 - RNA, 23 nt, Human T-lymphotropic virus 1
uccacgcuuugccugacccugcu

SEQ ID NO: 4017832 - RNA, 16 nt, Human T-lymphotropic virus 1
uccacucaacccucac

SEQ ID NO: 4017833 - RNA, 12 nt, Human T-lymphotropic virus 1
uccagcccccca

SEQ ID NO: 4017834 - RNA, 14 nt, Human T-lymphotropic virus 1
uccagccugccaac

SEQ ID NO: 4017835 - RNA, 17 nt, Human T-lymphotropic virus 1
uccaguucugcccccuc

SEQ ID NO: 4017836 - RNA, 13 nt, Human T-lymphotropic virus 1
ucccucauccugc

SEQ ID NO: 4017837 - RNA, 17 nt, Human T-lymphotropic virus 1
uccgccguggccuacuc

SEQ ID NO: 4017838 - RNA, 22 nt, Human T-lymphotropic virus 1
uccgucagcuacgacaccuccc

SEQ ID NO: 4017839 - RNA, 15 nt, Human T-lymphotropic virus 1
uccguucagccucca

SEQ ID NO: 4017840 - RNA, 17 nt, Human T-lymphotropic virus 1
uccguuccacucaaccc

SEQ ID NO: 4017841 - RNA, 18 nt, Human T-lymphotropic virus 1
uccuaucuuacuccacca

SEQ ID NO: 4017842 - RNA, 19 nt, Human T-lymphotropic virus 1
uccuccgcccgcuuccugc

SEQ ID NO: 4017843 - RNA, 17 nt, Human T-lymphotropic virus 1
uccucuuugcuccaggc

SEQ ID NO: 4017844 - RNA, 23 nt, Human T-lymphotropic virus 1
uccugcagcucucuccugcagac

SEQ ID NO: 4017845 - RNA, 14 nt, Human T-lymphotropic virus 1
uccugcccagccag

SEQ ID NO: 4017846 - RNA, 16 nt, Human T-lymphotropic virus 1
uccuggcaagccccuc

SEQ ID NO: 4017847 - RNA, 15 nt, Human T-lymphotropic virus 1
uccuuccuccaggcc

SEQ ID NO: 4017848 - RNA, 13 nt, Human T-lymphotropic virus 1
uccuucucccuuc

SEQ ID NO: 4017849 - RNA, 20 nt, Human T-lymphotropic virus 1
uccuucuccugcagcaaccu

SEQ ID NO: 4017850 - RNA, 18 nt, Human T-lymphotropic virus 1
ucgacaaauacaccuugc

SEQ ID NO: 4017851 - RNA, 14 nt, Human T-lymphotropic virus 1
ucgccuccagccuc

SEQ ID NO: 4017852 - RNA, 24 nt, Human T-lymphotropic virus 1
ucuaaacccugcaauccugcccag

SEQ ID NO: 4017853 - RNA, 13 nt, Human T-lymphotropic virus 1
ucuacucucccac

SEQ ID NO: 4017854 - RNA, 15 nt, Human T-lymphotropic virus 1
ucuacucucccacuc

SEQ ID NO: 4017855 - RNA, 21 nt, Human T-lymphotropic virus 1
ucuaguaaguuacuccagcua

SEQ ID NO: 4017856 - RNA, 19 nt, Human T-lymphotropic virus 1
ucuagucgacgcuccagga

SEQ ID NO: 4017857 - RNA, 12 nt, Human T-lymphotropic virus 1
ucuccucagccc

SEQ ID NO: 4017858 - RNA, 12 nt, Human T-lymphotropic virus 1
ucuccuccgccc

SEQ ID NO: 4017859 - RNA, 14 nt, Human T-lymphotropic virus 1
ucucuacugugccu

SEQ ID NO: 4017860 - RNA, 17 nt, Human T-lymphotropic virus 1
ucucuacugugccuuac

SEQ ID NO: 4017861 - RNA, 15 nt, Human T-lymphotropic virus 1
ucugcccccucaucc

SEQ ID NO: 4017862 - RNA, 12 nt, Human T-lymphotropic virus 1
ucugccgccucc

SEQ ID NO: 4017863 - RNA, 18 nt, Human T-lymphotropic virus 1
ucugccgccucccgccug

SEQ ID NO: 4017864 - RNA, 15 nt, Human T-lymphotropic virus 1
ucuuugcuccaggcc

SEQ ID NO: 4017865 - RNA, 13 nt, Human T-lymphotropic virus 1
ucuuuuccagacc

SEQ ID NO: 4017866 - RNA, 23 nt, Human T-lymphotropic virus 1
ugcaaccacaucgccuccagccu

SEQ ID NO: 4017867 - RNA, 15 nt, Human T-lymphotropic virus 1
ugcagcuggcccaua

SEQ ID NO: 4017868 - RNA, 22 nt, Human T-lymphotropic virus 1
ugcauuuuuucuuuccuagcac

SEQ ID NO: 4017869 - RNA, 21 nt, Human T-lymphotropic virus 1
ugccaauaauuaaccucuccc

SEQ ID NO: 4017870 - RNA, 23 nt, Human T-lymphotropic virus 1
ugccaauaauuaaccucucccau

SEQ ID NO: 4017871 - RNA, 15 nt, Human T-lymphotropic virus 1
ugccaccuauucccu

SEQ ID NO: 4017872 - RNA, 19 nt, Human T-lymphotropic virus 1
ugccagccuauccacuugg

SEQ ID NO: 4017873 - RNA, 22 nt, Human T-lymphotropic virus 1
ugcccaagacccgucggaggcc

SEQ ID NO: 4017874 - RNA, 14 nt, Human T-lymphotropic virus 1
ugcccaccacccuu

SEQ ID NO: 4017875 - RNA, 15 nt, Human T-lymphotropic virus 1
ugccccaucucuggg

SEQ ID NO: 4017876 - RNA, 23 nt, Human T-lymphotropic virus 1
ugccccaugugauuuuuugccac

SEQ ID NO: 4017877 - RNA, 19 nt, Human T-lymphotropic virus 1
ugccccauuggcuccugug

SEQ ID NO: 4017878 - RNA, 16 nt, Human T-lymphotropic virus 1
ugcccccucauccucg

SEQ ID NO: 4017879 - RNA, 18 nt, Human T-lymphotropic virus 1
ugcccuaggcaccuucca

SEQ ID NO: 4017880 - RNA, 18 nt, Human T-lymphotropic virus 1
ugccucccaccgccccuc

SEQ ID NO: 4017881 - RNA, 16 nt, Human T-lymphotropic virus 1
ugcucuuccugcuuuc

SEQ ID NO: 4017882 - RNA, 14 nt, Human T-lymphotropic virus 1
ugcuguacucucac

SEQ ID NO: 4017883 - RNA, 17 nt, Human T-lymphotropic virus 1
ugcuuucacugucccac

SEQ ID NO: 4017884 - RNA, 18 nt, Human T-lymphotropic virus 1
uggacaaagauauuuccc

SEQ ID NO: 4017885 - RNA, 17 nt, Human T-lymphotropic virus 1
ugacauucuccuggcaa

SEQ ID NO: 4017886 - RNA, 16 nt, Human T-lymphotropic virus 1
ugaucccaucuccagg

SEQ ID NO: 4017887 - RNA, 20 nt, Human T-lymphotropic virus 1
ugcaaccacaucgccuccag

SEQ ID NO: 4017888 - RNA, 22 nt, Human T-lymphotropic virus 1
ugcaaccacaucgccuccagcc

SEQ ID NO: 4017889 - RNA, 20 nt, Human T-lymphotropic virus 1
ugcaaggggcaaccacaacu

SEQ ID NO: 4017890 - RNA, 14 nt, Human T-lymphotropic virus 1
ugcaauccugccca

SEQ ID NO: 4017891 - RNA, 18 nt, Human T-lymphotropic virus 1
ugcaauccugcccagcca

SEQ ID NO: 4017892 - RNA, 16 nt, Human T-lymphotropic virus 1
ugcacuauucuucagu

SEQ ID NO: 4017893 - RNA, 17 nt, Human T-lymphotropic virus 1
ugcagcaaccuccuccg

SEQ ID NO: 4017894 - RNA, 18 nt, Human T-lymphotropic virus 1
ugcagcucucuccugcag

SEQ ID NO: 4017895 - RNA, 17 nt, Human T-lymphotropic virus 1
ugcagcuggcccauauc

SEQ ID NO: 4017896 - RNA, 20 nt, Human T-lymphotropic virus 1
ugcaggaccaugcauccucc

SEQ ID NO: 4017897 - RNA, 21 nt, Human T-lymphotropic virus 1
ugcaggaccaugcauccuccg

SEQ ID NO: 4017898 - RNA, 17 nt, Human T-lymphotropic virus 1
ugccaacuacacuagcc

SEQ ID NO: 4017899 - RNA, 21 nt, Human T-lymphotropic virus 1
ugcccaccacccuuuuccagc

SEQ ID NO: 4017900 - RNA, 22 nt, Human T-lymphotropic virus 1
ugcccaccacccuuuuccagcc

SEQ ID NO: 4017901 - RNA, 14 nt, Human T-lymphotropic virus 1
ugccccccuuuucc

SEQ ID NO: 4017902 - RNA, 13 nt, Human T-lymphotropic virus 1
ugccccuccuagg

SEQ ID NO: 4017903 - RNA, 14 nt, Human T-lymphotropic virus 1
ugccccuccuaggg

SEQ ID NO: 4017904 - RNA, 20 nt, Human T-lymphotropic virus 1
ugcccuaggcaccuuccaag

SEQ ID NO: 4017905 - RNA, 23 nt, Human T-lymphotropic virus 1
ugcccuaggcaccuuccaaggca

SEQ ID NO: 4017906 - RNA, 23 nt, Human T-lymphotropic virus 1
ugccuuacaacaaugccaaggcg

SEQ ID NO: 4017907 - RNA, 15 nt, Human T-lymphotropic virus 1
ugcgccgugccuucu

SEQ ID NO: 4017908 - RNA, 16 nt, Human T-lymphotropic virus 1
ugcgccgugccuucuc

SEQ ID NO: 4017909 - RNA, 21 nt, Human T-lymphotropic virus 1
ugcgccgugccuucuccucuu

SEQ ID NO: 4017910 - RNA, 19 nt, Human T-lymphotropic virus 1
ugcucaaaauugcacagua

SEQ ID NO: 4017911 - RNA, 13 nt, Human T-lymphotropic virus 1
ugcuccaggccau

SEQ ID NO: 4017912 - RNA, 15 nt, Human T-lymphotropic virus 1
ugcucuauccauagc

SEQ ID NO: 4017913 - RNA, 17 nt, Human T-lymphotropic virus 1
uggacaaucaaccaccu

SEQ ID NO: 4017914 - RNA, 14 nt, Human T-lymphotropic virus 1
uggacccacugcuu

SEQ ID NO: 4017915 - RNA, 22 nt, Human T-lymphotropic virus 1
uggcacguccuauacucuccca

SEQ ID NO: 4017916 - RNA, 20 nt, Human T-lymphotropic virus 1
uggcccauauccugcagccc

SEQ ID NO: 4017917 - RNA, 16 nt, Human T-lymphotropic virus 1
uggccccuccugcccc

SEQ ID NO: 4017918 - RNA, 13 nt, Human T-lymphotropic virus 1
uggccucuccagc

SEQ ID NO: 4017919 - RNA, 14 nt, Human T-lymphotropic virus 1
uggccucuccagcg

SEQ ID NO: 4017920 - RNA, 23 nt, Human T-lymphotropic virus 1
uggcggaggcuauuauucagccu

SEQ ID NO: 4017921 - RNA, 14 nt, Human T-lymphotropic virus 1
ugggucuccaaagg

SEQ ID NO: 4017922 - RNA, 16 nt, Human T-lymphotropic virus 1
uguaccucccuugcua

SEQ ID NO: 4017923 - RNA, 21 nt, Human T-lymphotropic virus 1
uguaucgaucgugccagccua

SEQ ID NO: 4017924 - RNA, 23 nt, Human T-lymphotropic virus 1
uguauuaaccaacugccacaaaa

SEQ ID NO: 4017925 - RNA, 15 nt, Human T-lymphotropic virus 1
ugucaccuguuccca

SEQ ID NO: 4017926 - RNA, 21 nt, Human T-lymphotropic virus 1
uguccugcagcucucuccugc

SEQ ID NO: 4017927 - RNA, 18 nt, Human T-lymphotropic virus 1
ugucgcgcuacuccuucu

SEQ ID NO: 4017928 - RNA, 22 nt, Human T-lymphotropic virus 1
ugucugcauguaccucuaccag

SEQ ID NO: 4017929 - RNA, 20 nt, Human T-lymphotropic virus 1
uguucauggacccucgaccu

SEQ ID NO: 4017930 - RNA, 19 nt, Human T-lymphotropic virus 1
uguuucgccuucucagccc

SEQ ID NO: 4017931 - RNA, 15 nt, Human T-lymphotropic virus 1
uuacgccagccccuu

SEQ ID NO: 4017932 - RNA, 18 nt, Human T-lymphotropic virus 1
uuaucccucgacuccccu

SEQ ID NO: 4017933 - RNA, 15 nt, Human T-lymphotropic virus 1
uucaaauacucagca

SEQ ID NO: 4017934 - RNA, 23 nt, Human T-lymphotropic virus 1
uucacaaauuucaaaccaaggcc

SEQ ID NO: 4017935 - RNA, 15 nt, Human T-lymphotropic virus 1
uucacagucucuacu

SEQ ID NO: 4017936 - RNA, 19 nt, Human T-lymphotropic virus 1
uucaccuaaucaccucacu

SEQ ID NO: 4017937 - RNA, 15 nt, Human T-lymphotropic virus 1
uuccagccccccacc

SEQ ID NO: 4017938 - RNA, 21 nt, Human T-lymphotropic virus 1
uuccaguucugcccccucauc

SEQ ID NO: 4017939 - RNA, 24 nt, Human T-lymphotropic virus 1
uuccuagggcaaauaauuucaccu

SEQ ID NO: 4017940 - RNA, 19 nt, Human T-lymphotropic virus 1
uuccucuucuccucagccc

SEQ ID NO: 4017941 - RNA, 13 nt, Human T-lymphotropic virus 1
uucucagccccuu

SEQ ID NO: 4017942 - RNA, 23 nt, Human T-lymphotropic virus 1
uucuccuccgcccgcuuccugcg

SEQ ID NO: 4017943 - RNA, 22 nt, Human T-lymphotropic virus 1
uucuccugcagcaaccuccucc

SEQ ID NO: 4017944 - RNA, 13 nt, Human T-lymphotropic virus 1
uucuccuggcaag

SEQ ID NO: 4017945 - RNA, 15 nt, Human T-lymphotropic virus 1
uugcccuaggcaccu

SEQ ID NO: 4017946 - RNA, 13 nt, Human T-lymphotropic virus 1
uuggccucucaca

SEQ ID NO: 4017947 - RNA, 22 nt, Human T-lymphotropic virus 1
uuguccuuuaacucuuccucca

SEQ ID NO: 4017948 - RNA, 13 nt, Human T-lymphotropic virus 1
uuuagagcucagg

SEQ ID NO: 4017949 - RNA, 15 nt, Human T-lymphotropic virus 1
uuucacaaauuucaa

SEQ ID NO: 4017950 - RNA, 17 nt, Human T-lymphotropic virus 1
uuuccgggcccugcccu

SEQ ID NO: 4017951 - RNA, 18 nt, Human T-lymphotropic virus 1
uuuguccggcgcucccuu

SEQ ID NO: 4017952 - RNA, 12 nt, Human T-lymphotropic virus 1
uuuuccagccug

SEQ ID NO: 4017953 - RNA, 14 nt, Human T-lymphotropic virus 2
aaaacaaggcucug

SEQ ID NO: 4017954 - RNA, 19 nt, Human T-lymphotropic virus 2
aaaacccgauggcaaaucc

SEQ ID NO: 4017955 - RNA, 13 nt, Human T-lymphotropic virus 2
aaaccaaagccuu

SEQ ID NO: 4017956 - RNA, 22 nt, Human T-lymphotropic virus 2
aaagcugcaugcccaagaccag

SEQ ID NO: 4017957 - RNA, 22 nt, Human T-lymphotropic virus 2
aacaaauggaccaucauuggaa

SEQ ID NO: 4017958 - RNA, 14 nt, Human T-lymphotropic virus 2
aacaaggcucugac

SEQ ID NO: 4017959 - RNA, 23 nt, Human T-lymphotropic virus 2
aacaaucccaaguaaaggcucug

SEQ ID NO: 4017960 - RNA, 21 nt, Human T-lymphotropic virus 2
aacaccuucccccaccucccc

SEQ ID NO: 4017961 - RNA, 17 nt, Human T-lymphotropic virus 2
aacaggaacagcucucc

SEQ ID NO: 4017962 - RNA, 18 nt, Human T-lymphotropic virus 2
aacauacgccguggagcg

SEQ ID NO: 4017963 - RNA, 18 nt, Human T-lymphotropic virus 2
aaccacggcccugacguc

SEQ ID NO: 4017964 - RNA, 20 nt, Human T-lymphotropic virus 2
aacccaucaaaacccaggag

SEQ ID NO: 4017965 - RNA, 18 nt, Human T-lymphotropic virus 2
aaccccaugaggaaaaug

SEQ ID NO: 4017966 - RNA, 21 nt, Human T-lymphotropic virus 2
aacccgugagggcucccugua

SEQ ID NO: 4017967 - RNA, 23 nt, Human T-lymphotropic virus 2
aaccugagcgccuccaggccuua

SEQ ID NO: 4017968 - RNA, 14 nt, Human T-lymphotropic virus 2
aacuccccucaucc

SEQ ID NO: 4017969 - RNA, 17 nt, Human T-lymphotropic virus 2
aagaacuucuauacaaa

SEQ ID NO: 4017970 - RNA, 15 nt, Human T-lymphotropic virus 2
aagcagggcagccau

SEQ ID NO: 4017971 - RNA, 14 nt, Human T-lymphotropic virus 2
aagccaagucccuu

SEQ ID NO: 4017972 - RNA, 22 nt, Human T-lymphotropic virus 2
aaggcagcguacguucucuggg

SEQ ID NO: 4017973 - RNA, 14 nt, Human T-lymphotropic virus 2
aauacacagacucc

SEQ ID NO: 4017974 - RNA, 12 nt, Human T-lymphotropic virus 2
aaucccccuccc

SEQ ID NO: 4017975 - RNA, 18 nt, Human T-lymphotropic virus 2
aauccugucuccucucag

SEQ ID NO: 4017976 - RNA, 19 nt, Human T-lymphotropic virus 2
aauccugucuccucucagc

SEQ ID NO: 4017977 - RNA, 11 nt, Human T-lymphotropic virus 2
aauuuccaccu

SEQ ID NO: 4017978 - RNA, 22 nt, Human T-lymphotropic virus 2
acaaaagggggagcuccuugca

SEQ ID NO: 4017979 - RNA, 12 nt, Human T-lymphotropic virus 2
acaacaacucca

SEQ ID NO: 4017980 - RNA, 19 nt, Human T-lymphotropic virus 2
acaacaacuccaugcguua

SEQ ID NO: 4017981 - RNA, 14 nt, Human T-lymphotropic virus 2
acacagacucccuu

SEQ ID NO: 4017982 - RNA, 15 nt, Human T-lymphotropic virus 2
acacauauucuugcc

SEQ ID NO: 4017983 - RNA, 18 nt, Human T-lymphotropic virus 2
uggcauguacucuacacc

SEQ ID NO: 4017984 - RNA, 13 nt, Human T-lymphotropic virus 2
uggccccugcccc

SEQ ID NO: 4017985 - RNA, 12 nt, Human T-lymphotropic virus 2
uggcgccacacc

SEQ ID NO: 4017986 - RNA, 16 nt, Human T-lymphotropic virus 2
uggcuccacacccccc

SEQ ID NO: 4017987 - RNA, 20 nt, Human T-lymphotropic virus 2
ugggacaaacaccucagccu

SEQ ID NO: 4017988 - RNA, 14 nt, Human T-lymphotropic virus 2
uggugucccgucuc

SEQ ID NO: 4017989 - RNA, 20 nt, Human T-lymphotropic virus 2
uguccuaacccccuccacgu

SEQ ID NO: 4017990 - RNA, 18 nt, Human T-lymphotropic virus 2
ugucucccccaagguucc

SEQ ID NO: 4017991 - RNA, 19 nt, Human T-lymphotropic virus 2
uuacaacaacucucccagc

SEQ ID NO: 4017992 - RNA, 13 nt, Human T-lymphotropic virus 2
uuaggagccuucc

SEQ ID NO: 4017993 - RNA, 19 nt, Human T-lymphotropic virus 2
uuauacaauacuccuccuu

SEQ ID NO: 4017994 - RNA, 18 nt, Human T-lymphotropic virus 2
uuaucccucgccuccccu

SEQ ID NO: 4017995 - RNA, 15 nt, Human T-lymphotropic virus 2
uuauccuccccccuu

SEQ ID NO: 4017996 - RNA, 21 nt, Human T-lymphotropic virus 2
uucaacaggacaucacucccc

SEQ ID NO: 4017997 - RNA, 18 nt, Human T-lymphotropic virus 2
uucaccauuccccagcca

SEQ ID NO: 4017998 - RNA, 17 nt, Human T-lymphotropic virus 2
uuccaaaucccccuccc

SEQ ID NO: 4017999 - RNA, 20 nt, Human T-lymphotropic virus 2
uuccauaaccuuggcagcca

SEQ ID NO: 4018000 - RNA, 16 nt, Human T-lymphotropic virus 2
uucccccaccucccca

SEQ ID NO: 4018001 - RNA, 20 nt, Human T-lymphotropic virus 2
uuccgcccaucaaacccucc

SEQ ID NO: 4018002 - RNA, 13 nt, Human T-lymphotropic virus 2
uuccuccugccuc

SEQ ID NO: 4018003 - RNA, 22 nt, Human T-lymphotropic virus 2
uuccugaagccucuaccccucc

SEQ ID NO: 4018004 - RNA, 11 nt, Human T-lymphotropic virus 2
uuccuuacacc

SEQ ID NO: 4018005 - RNA, 17 nt, Human T-lymphotropic virus 2
uucgaaaccaaagccuu

SEQ ID NO: 4018006 - RNA, 22 nt, Human T-lymphotropic virus 2
uucgaaaccaaagccuuccauc

SEQ ID NO: 4018007 - RNA, 22 nt, Human T-lymphotropic virus 2
uucuuaggacaggucaucuccc

SEQ ID NO: 4018008 - RNA, 20 nt, Human T-lymphotropic virus 2
uuggcaggcgucccggggcc

SEQ ID NO: 4018009 - RNA, 22 nt, Human T-lymphotropic virus 2
uuggccccuguauccuccgcca

SEQ ID NO: 4018010 - RNA, 16 nt, Human T-lymphotropic virus 2
uugguaucuccuccua

SEQ ID NO: 4018011 - RNA, 15 nt, Human T-lymphotropic virus 2
uuugaauuccuccau

SEQ ID NO: 4018012 - RNA, 19 nt, Human T-lymphotropic virus 2
uuuuuccgauggcuccccu

SEQ ID NO: 4018013 - RNA, 15 nt, Human T-lymphotropic virus 2
cguggagcgcagcaa

SEQ ID NO: 4018014 - RNA, 20 nt, Human T-lymphotropic virus 2
cgugggaccgucucccggcc

SEQ ID NO: 4018015 - RNA, 19 nt, Human T-lymphotropic virus 2
cguucuuuccucuucgccg

SEQ ID NO: 4018016 - RNA, 15 nt, Human T-lymphotropic virus 2
cguugucagcucucc

SEQ ID NO: 4018017 - RNA, 20 nt, Human T-lymphotropic virus 2
cguugucagcucuccucucc

SEQ ID NO: 4018018 - RNA, 15 nt, Human T-lymphotropic virus 2
cuaacccccuccacg

SEQ ID NO: 4018019 - RNA, 12 nt, Human T-lymphotropic virus 2
cacuccacauua

SEQ ID NO: 4018020 - RNA, 16 nt, Human T-lymphotropic virus 2
cagaaaaaaauagacc

SEQ ID NO: 4018021 - RNA, 20 nt, Human T-lymphotropic virus 2
cagacacucgugcccgggcc

SEQ ID NO: 4018022 - RNA, 15 nt, Human T-lymphotropic virus 2
cagaccaccaacacc

SEQ ID NO: 4018023 - RNA, 14 nt, Human T-lymphotropic virus 2
cagacgaccccagc

SEQ ID NO: 4018024 - RNA, 15 nt, Human T-lymphotropic virus 2
cagacgaccccagcc

SEQ ID NO: 4018025 - RNA, 16 nt, Human T-lymphotropic virus 2
cagacgaccccagccc

SEQ ID NO: 4018026 - RNA, 22 nt, Human T-lymphotropic virus 2
cagacgaccccagcccccacca

SEQ ID NO: 4018027 - RNA, 22 nt, Human T-lymphotropic virus 2
cagauguaaauuucacccagga

SEQ ID NO: 4018028 - RNA, 22 nt, Human T-lymphotropic virus 2
cagcaagggcuagggcuuccug

SEQ ID NO: 4018029 - RNA, 23 nt, Human T-lymphotropic virus 2
cagcaagggcuagggcuuccuga

SEQ ID NO: 4018030 - RNA, 15 nt, Human T-lymphotropic virus 2
cagccacaccaaccu

SEQ ID NO: 4018031 - RNA, 16 nt, Human T-lymphotropic virus 2
cagccacccagggcga

SEQ ID NO: 4018032 - RNA, 15 nt, Human T-lymphotropic virus 2
cagccacgccccccu

SEQ ID NO: 4018033 - RNA, 18 nt, Human T-lymphotropic virus 2
cagccacgccccccuccu

SEQ ID NO: 4018034 - RNA, 14 nt, Human T-lymphotropic virus 2
cagccccaccaaug

SEQ ID NO: 4018035 - RNA, 21 nt, Human T-lymphotropic virus 2
cagcccccaccaauugcugcc

SEQ ID NO: 4018036 - RNA, 20 nt, Human T-lymphotropic virus 2
cagccccuguagcccaaccc

SEQ ID NO: 4018037 - RNA, 21 nt, Human T-lymphotropic virus 2
cagccguccucaaccccauga

SEQ ID NO: 4018038 - RNA, 14 nt, Human T-lymphotropic virus 2
cagccucucauccu

SEQ ID NO: 4018039 - RNA, 18 nt, Human T-lymphotropic virus 2
cagcuccucugcucuugg

SEQ ID NO: 4018040 - RNA, 22 nt, Human T-lymphotropic virus 2
cagcuuauacaauacuccuccu

SEQ ID NO: 4018041 - RNA, 20 nt, Human T-lymphotropic virus 2
caggagcaauguugcuuccu

SEQ ID NO: 4018042 - RNA, 13 nt, Human T-lymphotropic virus 2
caggagcccccuc

SEQ ID NO: 4018043 - RNA, 20 nt, Human T-lymphotropic virus 2
caggaguccuauacacucca

SEQ ID NO: 4018044 - RNA, 19 nt, Human T-lymphotropic virus 2
caggaguuuuguaccuccu

SEQ ID NO: 4018045 - RNA, 20 nt, Human T-lymphotropic virus 2
caggccaauuuucacccucu

SEQ ID NO: 4018046 - RNA, 21 nt, Human T-lymphotropic virus 2
caggccaauuuucacccucuc

SEQ ID NO: 4018047 - RNA, 16 nt, Human T-lymphotropic virus 2
caggcccgcccuagga

SEQ ID NO: 4018048 - RNA, 20 nt, Human T-lymphotropic virus 2
caggcuacaaccccauggca

SEQ ID NO: 4018049 - RNA, 23 nt, Human T-lymphotropic virus 2
caguaugcagcccaaaauagacg

SEQ ID NO: 4018050 - RNA, 18 nt, Human T-lymphotropic virus 2
cagucauaguccucccgg

SEQ ID NO: 4018051 - RNA, 16 nt, Human T-lymphotropic virus 2
caguucaaacuccucc

SEQ ID NO: 4018052 - RNA, 23 nt, Human T-lymphotropic virus 2
caguuccgacaccuaucugcccu

SEQ ID NO: 4018053 - RNA, 14 nt, Human T-lymphotropic virus 2
cauaaccuuggcag

SEQ ID NO: 4018054 - RNA, 19 nt, Human T-lymphotropic virus 2
cauaaccuuggcagccaac

SEQ ID NO: 4018055 - RNA, 21 nt, Human T-lymphotropic virus 2
cauauucugccaccccagaca

SEQ ID NO: 4018056 - RNA, 18 nt, Human T-lymphotropic virus 2
cauauucuugcccuuccg

SEQ ID NO: 4018057 - RNA, 16 nt, Human T-lymphotropic virus 2
caucagcuuauacaau

SEQ ID NO: 4018058 - RNA, 15 nt, Human T-lymphotropic virus 2
caucgaccauugucc

SEQ ID NO: 4018059 - RNA, 16 nt, Human T-lymphotropic virus 2
caucuacaccaccugg

SEQ ID NO: 4018060 - RNA, 15 nt, Human T-lymphotropic virus 2
caucucccaccuuac

SEQ ID NO: 4018061 - RNA, 18 nt, Human T-lymphotropic virus 2
caucuuucaacccaagca

SEQ ID NO: 4018062 - RNA, 15 nt, Human T-lymphotropic virus 2
caugcagacccuccg

SEQ ID NO: 4018063 - RNA, 22 nt, Human T-lymphotropic virus 2
cauggccuuccaauuucccagg

SEQ ID NO: 4018064 - RNA, 18 nt, Human T-lymphotropic virus 2
cauguauccguccuccag

SEQ ID NO: 4018065 - RNA, 18 nt, Human T-lymphotropic virus 2
cauguccuaacccccucc

SEQ ID NO: 4018066 - RNA, 17 nt, Human T-lymphotropic virus 2
cauugcuaccaaccucg

SEQ ID NO: 4018067 - RNA, 20 nt, Human T-lymphotropic virus 2
cauugcuaccaaccucgccu

SEQ ID NO: 4018068 - RNA, 16 nt, Human T-lymphotropic virus 2
ccaaagccuuccaucc

SEQ ID NO: 4018069 - RNA, 13 nt, Human T-lymphotropic virus 2
ccaacaucccugu

SEQ ID NO: 4018070 - RNA, 13 nt, Human T-lymphotropic virus 2
ccaacccuucccu

SEQ ID NO: 4018071 - RNA, 16 nt, Human T-lymphotropic virus 2
ccaacccuucuccagg

SEQ ID NO: 4018072 - RNA, 13 nt, Human T-lymphotropic virus 2
ccaacucaccugg

SEQ ID NO: 4018073 - RNA, 14 nt, Human T-lymphotropic virus 2
ccaacucaccuggg

SEQ ID NO: 4018074 - RNA, 17 nt, Human T-lymphotropic virus 2
ccaagguuccaccugcc

SEQ ID NO: 4018075 - RNA, 22 nt, Human T-lymphotropic virus 2
ccaauacccaaagcccccaggg

SEQ ID NO: 4018076 - RNA, 23 nt, Human T-lymphotropic virus 2
ccaauaccuuaucccucgccucc

SEQ ID NO: 4018077 - RNA, 13 nt, Human T-lymphotropic virus 2
ccacaccaaccuc

SEQ ID NO: 4018078 - RNA, 12 nt, Human T-lymphotropic virus 2
ccacaccaaggg

SEQ ID NO: 4018079 - RNA, 17 nt, Human T-lymphotropic virus 2
ccacaccccccacccuc

SEQ ID NO: 4018080 - RNA, 15 nt, Human T-lymphotropic virus 2
ccaccaacuucuccc

SEQ ID NO: 4018081 - RNA, 17 nt, Human T-lymphotropic virus 2
ccaccacaguccuccac

SEQ ID NO: 4018082 - RNA, 12 nt, Human T-lymphotropic virus 2
ccaccagcucag

SEQ ID NO: 4018083 - RNA, 21 nt, Human T-lymphotropic virus 2
ccaccauguccgcagccacac

SEQ ID NO: 4018084 - RNA, 17 nt, Human T-lymphotropic virus 2
ccaccuuacccaggcca

SEQ ID NO: 4018085 - RNA, 18 nt, Human T-lymphotropic virus 2
ccacgacuccucaggcca

SEQ ID NO: 4018086 - RNA, 18 nt, Human T-lymphotropic virus 2
ccacgcauggccuuccaa

SEQ ID NO: 4018087 - RNA, 12 nt, Human T-lymphotropic virus 2
ccacuuccccua

SEQ ID NO: 4018088 - RNA, 14 nt, Human T-lymphotropic virus 2
ccagaugucagacu

SEQ ID NO: 4018089 - RNA, 13 nt, Human T-lymphotropic virus 2
ccagccucucauc

SEQ ID NO: 4018090 - RNA, 21 nt, Human T-lymphotropic virus 2
ccagcuaacccuccaggcacu

SEQ ID NO: 4018091 - RNA, 20 nt, Human T-lymphotropic virus 2
ccagcugaccuuacagagca

SEQ ID NO: 4018092 - RNA, 23 nt, Human T-lymphotropic virus 2
ccaggcacugaccacgcauggcc

SEQ ID NO: 4018093 - RNA, 17 nt, Human T-lymphotropic virus 2
ccauaaccuucaccuuc

SEQ ID NO: 4018094 - RNA, 22 nt, Human T-lymphotropic virus 2
ccauacuucgccuucaccauuc

SEQ ID NO: 4018095 - RNA, 13 nt, Human T-lymphotropic virus 2
ccauccucuccaa

SEQ ID NO: 4018096 - RNA, 17 nt, Human T-lymphotropic virus 2
ccauccucuuuccuucc

SEQ ID NO: 4018097 - RNA, 17 nt, Human T-lymphotropic virus 2
ccaucuuaacucuagac

SEQ ID NO: 4018098 - RNA, 14 nt, Human T-lymphotropic virus 2
ccaugacuccgacc

SEQ ID NO: 4018099 - RNA, 20 nt, Human T-lymphotropic virus 2
ccaugucauauucugccacc

SEQ ID NO: 4018100 - RNA, 17 nt, Human T-lymphotropic virus 2
ccauuacuaccacccuc

SEQ ID NO: 4018101 - RNA, 14 nt, Human T-lymphotropic virus 2
ccauuccccagcca

SEQ ID NO: 4018102 - RNA, 15 nt, Human T-lymphotropic virus 2
ccauuccccagccau

SEQ ID NO: 4018103 - RNA, 17 nt, Human T-lymphotropic virus 2
ccauugcaaucccucca

SEQ ID NO: 4018104 - RNA, 20 nt, Human T-lymphotropic virus 2
ccauugcaaucccuccagga

SEQ ID NO: 4018105 - RNA, 14 nt, Human T-lymphotropic virus 2
cccaaagcccccag

SEQ ID NO: 4018106 - RNA, 19 nt, Human T-lymphotropic virus 2
cccaacaaaccuccucccg

SEQ ID NO: 4018107 - RNA, 20 nt, Human T-lymphotropic virus 2
cccaacaaaccuccucccga

SEQ ID NO: 4018108 - RNA, 18 nt, Human T-lymphotropic virus 2
cccaacccuucuccagga

SEQ ID NO: 4018109 - RNA, 22 nt, Human T-lymphotropic virus 2
cccaagagcuuguaucacccuc

SEQ ID NO: 4018110 - RNA, 18 nt, Human T-lymphotropic virus 2
cuccacggccucacccau

SEQ ID NO: 4018111 - RNA, 16 nt, Human T-lymphotropic virus 2
cuccacuaccacccau

SEQ ID NO: 4018112 - RNA, 23 nt, Human T-lymphotropic virus 2
cuccaggaaccacgacuccucag

SEQ ID NO: 4018113 - RNA, 23 nt, Human T-lymphotropic virus 2
cucccaagguaagucuccucuca

SEQ ID NO: 4018114 - RNA, 22 nt, Human T-lymphotropic virus 2
cuccccaagcaguaccagccau

SEQ ID NO: 4018115 - RNA, 17 nt, Human T-lymphotropic virus 2
cuccccccuuuuucccu

SEQ ID NO: 4018116 - RNA, 16 nt, Human T-lymphotropic virus 2
cuccccuaucacucca

SEQ ID NO: 4018117 - RNA, 15 nt, Human T-lymphotropic virus 2
cuccccuccuucccc

SEQ ID NO: 4018118 - RNA, 18 nt, Human T-lymphotropic virus 2
cuccccuccuuccccacc

SEQ ID NO: 4018119 - RNA, 16 nt, Human T-lymphotropic virus 2
cucccgaaccauccuc

SEQ ID NO: 4018120 - RNA, 13 nt, Human T-lymphotropic virus 2
cucccgcuccuca

SEQ ID NO: 4018121 - RNA, 20 nt, Human T-lymphotropic virus 2
cucccucaccgacccucugg

SEQ ID NO: 4018122 - RNA, 22 nt, Human T-lymphotropic virus 2
cucccuuaucuuagcuccccuu

SEQ ID NO: 4018123 - RNA, 19 nt, Human T-lymphotropic virus 2
cuccguccccaaaacaucu

SEQ ID NO: 4018124 - RNA, 20 nt, Human T-lymphotropic virus 2
cuccuccaucccaacccuuc

SEQ ID NO: 4018125 - RNA, 16 nt, Human T-lymphotropic virus 2
cucgcucccguaccuc

SEQ ID NO: 4018126 - RNA, 14 nt, Human T-lymphotropic virus 2
cucguucuuuccuc

SEQ ID NO: 4018127 - RNA, 13 nt, Human T-lymphotropic virus 2
cucuagacaaaua

SEQ ID NO: 4018128 - RNA, 15 nt, Human T-lymphotropic virus 2
cucuugcccaaccac

SEQ ID NO: 4018129 - RNA, 15 nt, Human T-lymphotropic virus 2
cugaaccucuccggg

SEQ ID NO: 4018130 - RNA, 16 nt, Human T-lymphotropic virus 2
cugacgccccaaggcc

SEQ ID NO: 4018131 - RNA, 17 nt, Human T-lymphotropic virus 2
cugacgucccucccccc

SEQ ID NO: 4018132 - RNA, 14 nt, Human T-lymphotropic virus 2
cugagcgccuccag

SEQ ID NO: 4018133 - RNA, 16 nt, Human T-lymphotropic virus 2
cugaggaacuccccuc

SEQ ID NO: 4018134 - RNA, 22 nt, Human T-lymphotropic virus 2
cugccaagccauggccuucccu

SEQ ID NO: 4018135 - RNA, 14 nt, Human T-lymphotropic virus 2
cugccaccccagac

SEQ ID NO: 4018136 - RNA, 13 nt, Human T-lymphotropic virus 2
cugcccgcuccuc

SEQ ID NO: 4018137 - RNA, 14 nt, Human T-lymphotropic virus 2
cugcccgcuccucc

SEQ ID NO: 4018138 - RNA, 21 nt, Human T-lymphotropic virus 2
cugcccuacuacuacuccucc

SEQ ID NO: 4018139 - RNA, 21 nt, Human T-lymphotropic virus 2
cugccguggccgccucaaccc

SEQ ID NO: 4018140 - RNA, 20 nt, Human T-lymphotropic virus 2
cugcuccuccgccaacaguc

SEQ ID NO: 4018141 - RNA, 16 nt, Human T-lymphotropic virus 2
cugcugaugccuuucu

SEQ ID NO: 4018142 - RNA, 13 nt, Human T-lymphotropic virus 2
cuggucacggaga

SEQ ID NO: 4018143 - RNA, 22 nt, Human T-lymphotropic virus 2
cugguggaguaacaggcucccu

SEQ ID NO: 4018144 - RNA, 15 nt, Human T-lymphotropic virus 2
cuguccagagcacca

SEQ ID NO: 4018145 - RNA, 17 nt, Human T-lymphotropic virus 2
cuguccuaaccuucccc

SEQ ID NO: 4018146 - RNA, 13 nt, Human T-lymphotropic virus 2
cuguccuuccaca

SEQ ID NO: 4018147 - RNA, 22 nt, Human T-lymphotropic virus 2
cuguccuucucgguuccucucc

SEQ ID NO: 4018148 - RNA, 19 nt, Human T-lymphotropic virus 2
cuguuggaucucccuucca

SEQ ID NO: 4018149 - RNA, 19 nt, Human T-lymphotropic virus 2
cuuacaagaucuccuccag

SEQ ID NO: 4018150 - RNA, 20 nt, Human T-lymphotropic virus 2
cuuacaccucccaacccuuc

SEQ ID NO: 4018151 - RNA, 19 nt, Human T-lymphotropic virus 2
cuuacccacuuccccuagc

SEQ ID NO: 4018152 - RNA, 18 nt, Human T-lymphotropic virus 2
cuuacccaggccauaguc

SEQ ID NO: 4018153 - RNA, 13 nt, Human T-lymphotropic virus 2
cuuaccccaaagc

SEQ ID NO: 4018154 - RNA, 16 nt, Human T-lymphotropic virus 2
cuuaucuuagcucccc

SEQ ID NO: 4018155 - RNA, 20 nt, Human T-lymphotropic virus 2
cuucaccauuccccagccau

SEQ ID NO: 4018156 - RNA, 12 nt, Human T-lymphotropic virus 2
cuuccaucccuc

SEQ ID NO: 4018157 - RNA, 20 nt, Human T-lymphotropic virus 2
cuuccccacccagagaaccu

SEQ ID NO: 4018158 - RNA, 19 nt, Human T-lymphotropic virus 2
cuuccccguuaaaaaacca

SEQ ID NO: 4018159 - RNA, 20 nt, Human T-lymphotropic virus 2
cuucgaaaaauucgaaacca

SEQ ID NO: 4018160 - RNA, 21 nt, Human T-lymphotropic virus 2
cuucucuaagugcggcuccuc

SEQ ID NO: 4018161 - RNA, 21 nt, Human T-lymphotropic virus 2
cuugacacggcccccugccuu

SEQ ID NO: 4018162 - RNA, 17 nt, Human T-lymphotropic virus 2
cuuggcuccacaccccc

SEQ ID NO: 4018163 - RNA, 12 nt, Human T-lymphotropic virus 2
cuuuccuccugc

SEQ ID NO: 4018164 - RNA, 17 nt, Human T-lymphotropic virus 2
gaaaaacaaggcucuga

SEQ ID NO: 4018165 - RNA, 16 nt, Human T-lymphotropic virus 2
gaaauggaugccugga

SEQ ID NO: 4018166 - RNA, 16 nt, Human T-lymphotropic virus 2
gaacacccauccuucg

SEQ ID NO: 4018167 - RNA, 16 nt, Human T-lymphotropic virus 2
gaaccacgacuccuca

SEQ ID NO: 4018168 - RNA, 15 nt, Human T-lymphotropic virus 2
gaacccacucagccu

SEQ ID NO: 4018169 - RNA, 10 nt, Human T-lymphotropic virus 2
gaaccccagu

SEQ ID NO: 4018170 - RNA, 14 nt, Human T-lymphotropic virus 2
gaacugaaaccacg

SEQ ID NO: 4018171 - RNA, 15 nt, Human T-lymphotropic virus 2
gaacugaaaccacgg

SEQ ID NO: 4018172 - RNA, 16 nt, Human T-lymphotropic virus 2
gaacugcuccucccaa

SEQ ID NO: 4018173 - RNA, 18 nt, Human T-lymphotropic virus 2
gacacccugauccuaggc

SEQ ID NO: 4018174 - RNA, 18 nt, Human T-lymphotropic virus 2
gaccaucuaccuccacca

SEQ ID NO: 4018175 - RNA, 16 nt, Human T-lymphotropic virus 2
gacgaccccagccccc

SEQ ID NO: 4018176 - RNA, 16 nt, Human T-lymphotropic virus 2
gacuacacccccccug

SEQ ID NO: 4018177 - RNA, 14 nt, Human T-lymphotropic virus 2
gacucgccucuccc

SEQ ID NO: 4018178 - RNA, 15 nt, Human T-lymphotropic virus 2
gacuuccugaggaac

SEQ ID NO: 4018179 - RNA, 14 nt, Human T-lymphotropic virus 2
gagccaccaaugcc

SEQ ID NO: 4018180 - RNA, 14 nt, Human T-lymphotropic virus 2
gagcucggcugccc

SEQ ID NO: 4018181 - RNA, 18 nt, Human T-lymphotropic virus 2
gagucucgcaccugcucg

SEQ ID NO: 4018182 - RNA, 21 nt, Human T-lymphotropic virus 2
gaugccuuucuucccucuccc

SEQ ID NO: 4018183 - RNA, 18 nt, Human T-lymphotropic virus 2
gauugguaucuccuccua

SEQ ID NO: 4018184 - RNA, 17 nt, Human T-lymphotropic virus 2
gcaccaacucaccuggg

SEQ ID NO: 4018185 - RNA, 19 nt, Human T-lymphotropic virus 2
gcacgagaagcccuccaga

SEQ ID NO: 4018186 - RNA, 15 nt, Human T-lymphotropic virus 2
gcagcaacagcaacc

SEQ ID NO: 4018187 - RNA, 13 nt, Human T-lymphotropic virus 2
gcagcaagggcua

SEQ ID NO: 4018188 - RNA, 14 nt, Human T-lymphotropic virus 2
gcaggcgucccggg

SEQ ID NO: 4018189 - RNA, 18 nt, Human T-lymphotropic virus 2
gccaacaaagaaugccaa

SEQ ID NO: 4018190 - RNA, 17 nt, Human T-lymphotropic virus 2
gccaagccauggccuuc

SEQ ID NO: 4018191 - RNA, 18 nt, Human T-lymphotropic virus 2
gccacgccccccuccugg

SEQ ID NO: 4018192 - RNA, 16 nt, Human T-lymphotropic virus 2
gccagccacccagggc

SEQ ID NO: 4018193 - RNA, 23 nt, Human T-lymphotropic virus 2
gccaucuuuaguaguucaguccu

SEQ ID NO: 4018194 - RNA, 18 nt, Human T-lymphotropic virus 2
gcccaucaaacccuccag

SEQ ID NO: 4018195 - RNA, 16 nt, Human T-lymphotropic virus 2
gcccauuucccaggau

SEQ ID NO: 4018196 - RNA, 14 nt, Human T-lymphotropic virus 2
gccccaaggccucc

SEQ ID NO: 4018197 - RNA, 20 nt, Human T-lymphotropic virus 2
gccccccgaucucacuagcc

SEQ ID NO: 4018198 - RNA, 21 nt, Human T-lymphotropic virus 2
gcccccuuggggagaugcucc

SEQ ID NO: 4018199 - RNA, 11 nt, Human T-lymphotropic virus 2
gcccuccuggc

SEQ ID NO: 4018200 - RNA, 14 nt, Human T-lymphotropic virus 2
gcccugcccgcucc

SEQ ID NO: 4018201 - RNA, 18 nt, Human T-lymphotropic virus 2
gcccugcccgcuccucca

SEQ ID NO: 4018202 - RNA, 19 nt, Human T-lymphotropic virus 2
gcccugcccgcuccuccau

SEQ ID NO: 4018203 - RNA, 18 nt, Human T-lymphotropic virus 2
gccgcccucuuggcaggc

SEQ ID NO: 4018204 - RNA, 20 nt, Human T-lymphotropic virus 2
gccguccucaaccccaugag

SEQ ID NO: 4018205 - RNA, 23 nt, Human T-lymphotropic virus 2
gccuacaucgacaugcccuccug

SEQ ID NO: 4018206 - RNA, 14 nt, Human T-lymphotropic virus 2
gccuaggcccuccg

SEQ ID NO: 4018207 - RNA, 17 nt, Human T-lymphotropic virus 2
gccugcaccaucuuaac

SEQ ID NO: 4018208 - RNA, 22 nt, Human T-lymphotropic virus 2
gccuuaccccaccuacagacca

SEQ ID NO: 4018209 - RNA, 17 nt, Human T-lymphotropic virus 2
gccuuucuucccucucc

SEQ ID NO: 4018210 - RNA, 21 nt, Human T-lymphotropic virus 2
gccuuuuuuccgauggcuccc

SEQ ID NO: 4018211 - RNA, 15 nt, Human T-lymphotropic virus 2
gcgaaagcacacccc

SEQ ID NO: 4018212 - RNA, 14 nt, Human T-lymphotropic virus 2
ucuucgccgucacu

SEQ ID NO: 4018213 - RNA, 20 nt, Human T-lymphotropic virus 2
ugaacauguccuaacccccu

SEQ ID NO: 4018214 - RNA, 15 nt, Human T-lymphotropic virus 2
ugacacggcccccug

SEQ ID NO: 4018215 - RNA, 21 nt, Human T-lymphotropic virus 2
ugaccgaucccgaccccagag

SEQ ID NO: 4018216 - RNA, 14 nt, Human T-lymphotropic virus 2
ugacgccccaaggc

SEQ ID NO: 4018217 - RNA, 14 nt, Human T-lymphotropic virus 2
ugagcgccuccagg

SEQ ID NO: 4018218 - RNA, 15 nt, Human T-lymphotropic virus 2
ugcaaucccuccagg

SEQ ID NO: 4018219 - RNA, 16 nt, Human T-lymphotropic virus 2
ugcaaucccuccagga

SEQ ID NO: 4018220 - RNA, 16 nt, Human T-lymphotropic virus 2
ugcagccuaggcccuc

SEQ ID NO: 4018221 - RNA, 21 nt, Human T-lymphotropic virus 2
ugccccuuagguagucgcucc

SEQ ID NO: 4018222 - RNA, 12 nt, Human T-lymphotropic virus 2
ugcccgcuccuc

SEQ ID NO: 4018223 - RNA, 13 nt, Human T-lymphotropic virus 2
ugcccgcuccucc

SEQ ID NO: 4018224 - RNA, 15 nt, Human T-lymphotropic virus 2
ugcccgcuccuccau

SEQ ID NO: 4018225 - RNA, 12 nt, Human T-lymphotropic virus 2
ugcccuccuggc

SEQ ID NO: 4018226 - RNA, 14 nt, Human T-lymphotropic virus 2
ugccugguguacag

SEQ ID NO: 4018227 - RNA, 22 nt, Human T-lymphotropic virus 2
ugcuccuccgccaacagucucc

SEQ ID NO: 4018228 - RNA, 13 nt, Human T-lymphotropic virus 2
ugcugccaagcca

SEQ ID NO: 4018229 - RNA, 18 nt, Human T-lymphotropic virus 2
ugcugccaauagccacuc

SEQ ID NO: 4018230 - RNA, 16 nt, Human T-lymphotropic virus 2
uggccccugcccccua

SEQ ID NO: 4018231 - RNA, 15 nt, Human T-lymphotropic virus 2
uggccugcaccaucu

SEQ ID NO: 4018232 - RNA, 22 nt, Human T-lymphotropic virus 2
uggcuccacaccccccacccuc

SEQ ID NO: 4018233 - RNA, 16 nt, Human T-lymphotropic virus 2
ugggaccgucucccgg

SEQ ID NO: 4018234 - RNA, 18 nt, Human T-lymphotropic virus 2
ugggaccgucucccggcc

SEQ ID NO: 4018235 - RNA, 17 nt, Human T-lymphotropic virus 2
uggguagacaccuucuc

SEQ ID NO: 4018236 - RNA, 18 nt, Human T-lymphotropic virus 2
uguaacuauggccccggg

SEQ ID NO: 4018237 - RNA, 15 nt, Human T-lymphotropic virus 2
ugucauauucugcca

SEQ ID NO: 4018238 - RNA, 22 nt, Human T-lymphotropic virus 2
uguccagagcaccaacucaccu

SEQ ID NO: 4018239 - RNA, 14 nt, Human T-lymphotropic virus 2
uguccuaaccuucc

SEQ ID NO: 4018240 - RNA, 21 nt, Human T-lymphotropic virus 2
uguccuaaccuuccccuagac

SEQ ID NO: 4018241 - RNA, 22 nt, Human T-lymphotropic virus 2
uguuuggccccuguauccuccg

SEQ ID NO: 4018242 - RNA, 14 nt, Human T-lymphotropic virus 2
uuagccagccccac

SEQ ID NO: 4018243 - RNA, 13 nt, Human T-lymphotropic virus 2
uuaguaguucagu

SEQ ID NO: 4018244 - RNA, 17 nt, Human T-lymphotropic virus 2
uuaucuuagcuccccuu

SEQ ID NO: 4018245 - RNA, 15 nt, Human T-lymphotropic virus 2
uuaugggacaaacac

SEQ ID NO: 4018246 - RNA, 20 nt, Human T-lymphotropic virus 2
cacauuggauaaaaaagcca

SEQ ID NO: 4018247 - RNA, 16 nt, Human T-lymphotropic virus 2
caccaacaucccuguc

SEQ ID NO: 4018248 - RNA, 18 nt, Human T-lymphotropic virus 2
caccaauuacuccugcau

SEQ ID NO: 4018249 - RNA, 22 nt, Human T-lymphotropic virus 2
cacccaggaagucagccaagug

SEQ ID NO: 4018250 - RNA, 20 nt, Human T-lymphotropic virus 2
cacccaguucaaacuccucc

SEQ ID NO: 4018251 - RNA, 19 nt, Human T-lymphotropic virus 2
caccccacaacaacuccau

SEQ ID NO: 4018252 - RNA, 22 nt, Human T-lymphotropic virus 2
cacccucaccccacaacaacuc

SEQ ID NO: 4018253 - RNA, 14 nt, Human T-lymphotropic virus 2
caccuacagaccau

SEQ ID NO: 4018254 - RNA, 17 nt, Human T-lymphotropic virus 2
caccucagaacccacuc

SEQ ID NO: 4018255 - RNA, 22 nt, Human T-lymphotropic virus 2
caccucagaacccacucagccu

SEQ ID NO: 4018256 - RNA, 11 nt, Human T-lymphotropic virus 2
caccucagccu

SEQ ID NO: 4018257 - RNA, 20 nt, Human T-lymphotropic virus 2
caccuccugaacugcuccuc

SEQ ID NO: 4018258 - RNA, 19 nt, Human T-lymphotropic virus 2
caccucuccuuccccaggg

SEQ ID NO: 4018259 - RNA, 20 nt, Human T-lymphotropic virus 2
caccuuggggauccauccuc

SEQ ID NO: 4018260 - RNA, 15 nt, Human T-lymphotropic virus 2
cacuaccacccauuc

SEQ ID NO: 4018261 - RNA, 21 nt, Human T-lymphotropic virus 2
cacucauguauccguccucca

SEQ ID NO: 4018262 - RNA, 11 nt, Human T-lymphotropic virus 2
cacuccagccc

SEQ ID NO: 4018263 - RNA, 14 nt, Human T-lymphotropic virus 2
cacuccccugcccu

SEQ ID NO: 4018264 - RNA, 17 nt, Human T-lymphotropic virus 2
cacuuauaccccauguc

SEQ ID NO: 4018265 - RNA, 20 nt, Human T-lymphotropic virus 2
cagacaauuaggagccuucc

SEQ ID NO: 4018266 - RNA, 20 nt, Human T-lymphotropic virus 2
cagacgaccccagcccccac

SEQ ID NO: 4018267 - RNA, 22 nt, Human T-lymphotropic virus 2
cagacuauccuucaacaggaca

SEQ ID NO: 4018268 - RNA, 15 nt, Human T-lymphotropic virus 2
cagacucgccucucc

SEQ ID NO: 4018269 - RNA, 19 nt, Human T-lymphotropic virus 2
cagagcaccaacucaccug

SEQ ID NO: 4018270 - RNA, 14 nt, Human T-lymphotropic virus 2
cagcaagggcuagg

SEQ ID NO: 4018271 - RNA, 16 nt, Human T-lymphotropic virus 2
cagccacaccaaccuc

SEQ ID NO: 4018272 - RNA, 13 nt, Human T-lymphotropic virus 2
cagccacccaggg

SEQ ID NO: 4018273 - RNA, 20 nt, Human T-lymphotropic virus 2
cagccacgccccccuccugg

SEQ ID NO: 4018274 - RNA, 13 nt, Human T-lymphotropic virus 2
cagccccacccuc

SEQ ID NO: 4018275 - RNA, 12 nt, Human T-lymphotropic virus 2
cagccuccacca

SEQ ID NO: 4018276 - RNA, 17 nt, Human T-lymphotropic virus 2
cagccuccaccaacuuc

SEQ ID NO: 4018277 - RNA, 13 nt, Human T-lymphotropic virus 2
cagcuaacccucc

SEQ ID NO: 4018278 - RNA, 17 nt, Human T-lymphotropic virus 2
cagcuaacccuccaggc

SEQ ID NO: 4018279 - RNA, 18 nt, Human T-lymphotropic virus 2
cagcuccccucccucgcc

SEQ ID NO: 4018280 - RNA, 19 nt, Human T-lymphotropic virus 2
cagcucugccaaucuuucc

SEQ ID NO: 4018281 - RNA, 18 nt, Human T-lymphotropic virus 2
caggaacagcucuccaga

SEQ ID NO: 4018282 - RNA, 20 nt, Human T-lymphotropic virus 2
caggaacggcccccucuuga

SEQ ID NO: 4018283 - RNA, 21 nt, Human T-lymphotropic virus 2
caggagguggcucgcucccuc

SEQ ID NO: 4018284 - RNA, 15 nt, Human T-lymphotropic virus 2
caggcaauaaccccg

SEQ ID NO: 4018285 - RNA, 18 nt, Human T-lymphotropic virus 2
caggcacuacugaggaaa

SEQ ID NO: 4018286 - RNA, 17 nt, Human T-lymphotropic virus 2
caggccauuucccuccu

SEQ ID NO: 4018287 - RNA, 15 nt, Human T-lymphotropic virus 2
caggcccgcccuagg

SEQ ID NO: 4018288 - RNA, 18 nt, Human T-lymphotropic virus 2
caggcuaauaaccccgcc

SEQ ID NO: 4018289 - RNA, 21 nt, Human T-lymphotropic virus 2
caggggcuucuauaccuccca

SEQ ID NO: 4018290 - RNA, 16 nt, Human T-lymphotropic virus 2
caggucgagcucggcu

SEQ ID NO: 4018291 - RNA, 17 nt, Human T-lymphotropic virus 2
caguucaaacuccucca

SEQ ID NO: 4018292 - RNA, 15 nt, Human T-lymphotropic virus 2
cauaacccugaagca

SEQ ID NO: 4018293 - RNA, 11 nt, Human T-lymphotropic virus 2
cauaggccucg

SEQ ID NO: 4018294 - RNA, 15 nt, Human T-lymphotropic virus 2
cauaguccucccgga

SEQ ID NO: 4018295 - RNA, 15 nt, Human T-lymphotropic virus 2
caucaaaacccagga

SEQ ID NO: 4018296 - RNA, 21 nt, Human T-lymphotropic virus 2
caucacuccccugcccucuca

SEQ ID NO: 4018297 - RNA, 16 nt, Human T-lymphotropic virus 2
caucccaacccuuccc

SEQ ID NO: 4018298 - RNA, 12 nt, Human T-lymphotropic virus 2
caucccccagga

SEQ ID NO: 4018299 - RNA, 16 nt, Human T-lymphotropic virus 2
caucccccaggagccc

SEQ ID NO: 4018300 - RNA, 16 nt, Human T-lymphotropic virus 2
caucccgaucaagaca

SEQ ID NO: 4018301 - RNA, 15 nt, Human T-lymphotropic virus 2
cauccucauucacca

SEQ ID NO: 4018302 - RNA, 15 nt, Human T-lymphotropic virus 2
caugacccuccuagu

SEQ ID NO: 4018303 - RNA, 16 nt, Human T-lymphotropic virus 2
caugaccuaagagcca

SEQ ID NO: 4018304 - RNA, 13 nt, Human T-lymphotropic virus 2
caugcccaagacc

SEQ ID NO: 4018305 - RNA, 22 nt, Human T-lymphotropic virus 2
cauguaacuauggccccgggac

SEQ ID NO: 4018306 - RNA, 19 nt, Human T-lymphotropic virus 2
cauguccuaacccccucca

SEQ ID NO: 4018307 - RNA, 20 nt, Human T-lymphotropic virus 2
cauuacuaccacccucaccu

SEQ ID NO: 4018308 - RNA, 15 nt, Human T-lymphotropic virus 2
cauuauccucccccc

SEQ ID NO: 4018309 - RNA, 22 nt, Human T-lymphotropic virus 2
cauuccccaacaaaccuccucc

SEQ ID NO: 4018310 - RNA, 23 nt, Human T-lymphotropic virus 2
cauuccccaacaaaccuccuccc

SEQ ID NO: 4018311 - RNA, 16 nt, Human T-lymphotropic virus 2
cauugcuaccaaccuc

SEQ ID NO: 4018312 - RNA, 13 nt, Human T-lymphotropic virus 2
ccaaacagacagg

SEQ ID NO: 4018313 - RNA, 16 nt, Human T-lymphotropic virus 2
ccaacauacgccgugg

SEQ ID NO: 4018314 - RNA, 17 nt, Human T-lymphotropic virus 2
ccaacccgucugcacgu

SEQ ID NO: 4018315 - RNA, 22 nt, Human T-lymphotropic virus 2
ccaacccgugagggcucccugu

SEQ ID NO: 4018316 - RNA, 17 nt, Human T-lymphotropic virus 2
ccaagcaguaccagcca

SEQ ID NO: 4018317 - RNA, 15 nt, Human T-lymphotropic virus 2
ccaagguuccaccug

SEQ ID NO: 4018318 - RNA, 20 nt, Human T-lymphotropic virus 2
ccaauuuucacccucucccc

SEQ ID NO: 4018319 - RNA, 23 nt, Human T-lymphotropic virus 2
ccaccaauugcugccaauagcca

SEQ ID NO: 4018320 - RNA, 23 nt, Human T-lymphotropic virus 2
ccaccuccccccccuuccccgga

SEQ ID NO: 4018321 - RNA, 15 nt, Human T-lymphotropic virus 2
ccacgacuccucagg

SEQ ID NO: 4018322 - RNA, 14 nt, Human T-lymphotropic virus 2
ccacgcaaugcuuc

SEQ ID NO: 4018323 - RNA, 14 nt, Human T-lymphotropic virus 2
ccacgcauggccuu

SEQ ID NO: 4018324 - RNA, 22 nt, Human T-lymphotropic virus 2
ccagacaauuaggagccuuccu

SEQ ID NO: 4018325 - RNA, 19 nt, Human T-lymphotropic virus 2
ccagacacucgugcccggg

SEQ ID NO: 4018326 - RNA, 20 nt, Human T-lymphotropic virus 2
ccagacaggcauaaccauuc

SEQ ID NO: 4018327 - RNA, 15 nt, Human T-lymphotropic virus 2
ccagccacccagggc

SEQ ID NO: 4018328 - RNA, 13 nt, Human T-lymphotropic virus 2
ccagcccccacca

SEQ ID NO: 4018329 - RNA, 16 nt, Human T-lymphotropic virus 2
ccagcuaacccuccag

SEQ ID NO: 4018330 - RNA, 17 nt, Human T-lymphotropic virus 2
ccagcuuuccccaccca

SEQ ID NO: 4018331 - RNA, 16 nt, Human T-lymphotropic virus 2
ccaggagcccccucag

SEQ ID NO: 4018332 - RNA, 14 nt, Human T-lymphotropic virus 2
ccauaaccuuggca

SEQ ID NO: 4018333 - RNA, 18 nt, Human T-lymphotropic virus 2
ccaucaaaacccaggagu

SEQ ID NO: 4018334 - RNA, 18 nt, Human T-lymphotropic virus 2
ccaucaaacccuccaggc

SEQ ID NO: 4018335 - RNA, 18 nt, Human T-lymphotropic virus 2
ccauccacaguccucuau

SEQ ID NO: 4018336 - RNA, 24 nt, Human T-lymphotropic virus 2
ccaucuuuaguaguucaguccucc

SEQ ID NO: 4018337 - RNA, 17 nt, Human T-lymphotropic virus 2
ccauguccgcagccaca

SEQ ID NO: 4018338 - RNA, 15 nt, Human T-lymphotropic virus 2
ccauuacuaccaccc

SEQ ID NO: 4018339 - RNA, 22 nt, Human T-lymphotropic virus 2
ccauuacuaccacccucaccuc

SEQ ID NO: 4018340 - RNA, 20 nt, Human T-lymphotropic virus 2
cccacaacucaaacccccuc

SEQ ID NO: 4018341 - RNA, 19 nt, Human T-lymphotropic virus 2
cccacucagccuccaccaa

SEQ ID NO: 4018342 - RNA, 13 nt, Human T-lymphotropic virus 2
cccagcccccacc

SEQ ID NO: 4018343 - RNA, 15 nt, Human T-lymphotropic virus 2
cccaggagcccccuc

SEQ ID NO: 4018344 - RNA, 20 nt, Human T-lymphotropic virus 2
cccauaaaauuugccuaguc

SEQ ID NO: 4018345 - RNA, 17 nt, Human T-lymphotropic virus 2
cccauugguccaugacu

SEQ ID NO: 4018346 - RNA, 20 nt, Human T-lymphotropic virus 2
cccauugguccaugacuccg

SEQ ID NO: 4018347 - RNA, 19 nt, Human T-lymphotropic virus 2
gacaucucgauacucccac

SEQ ID NO: 4018348 - RNA, 13 nt, Human T-lymphotropic virus 2
gaccccagccccc

SEQ ID NO: 4018349 - RNA, 15 nt, Human T-lymphotropic virus 2
gacgaccccagcccc

SEQ ID NO: 4018350 - RNA, 22 nt, Human T-lymphotropic virus 2
gacucaccuuggggauccaucc

SEQ ID NO: 4018351 - RNA, 15 nt, Human T-lymphotropic virus 2
gacuccucaggccaa

SEQ ID NO: 4018352 - RNA, 13 nt, Human T-lymphotropic virus 2
gagacucaccuug

SEQ ID NO: 4018353 - RNA, 18 nt, Human T-lymphotropic virus 2
gagccagccacccagggc

SEQ ID NO: 4018354 - RNA, 16 nt, Human T-lymphotropic virus 2
gagcgcagcaagggcu

SEQ ID NO: 4018355 - RNA, 19 nt, Human T-lymphotropic virus 2
gaggaaggggaaccccucc

SEQ ID NO: 4018356 - RNA, 15 nt, Human T-lymphotropic virus 2
gaggucagcuccucu

SEQ ID NO: 4018357 - RNA, 14 nt, Human T-lymphotropic virus 2
gauccuaggcgcca

SEQ ID NO: 4018358 - RNA, 18 nt, Human T-lymphotropic virus 2
gauguaaauuucacccag

SEQ ID NO: 4018359 - RNA, 21 nt, Human T-lymphotropic virus 2
gauguaaauuucacccaggaa

SEQ ID NO: 4018360 - RNA, 22 nt, Human T-lymphotropic virus 2
gaugucagacucgccucucccu

SEQ ID NO: 4018361 - RNA, 23 nt, Human T-lymphotropic virus 2
gauuccauaaccuuggcagccaa

SEQ ID NO: 4018362 - RNA, 21 nt, Human T-lymphotropic virus 2
gcaagcccuuugcgacuuccu

SEQ ID NO: 4018363 - RNA, 16 nt, Human T-lymphotropic virus 2
gcaagggcuagggcuu

SEQ ID NO: 4018364 - RNA, 21 nt, Human T-lymphotropic virus 2
gcaaucuccuaaaauagucua

SEQ ID NO: 4018365 - RNA, 22 nt, Human T-lymphotropic virus 2
gcagccguccucaaccccauga

SEQ ID NO: 4018366 - RNA, 17 nt, Human T-lymphotropic virus 2
gcagcuauccuacaggg

SEQ ID NO: 4018367 - RNA, 20 nt, Human T-lymphotropic virus 2
gcaggcccgcccuaggagca

SEQ ID NO: 4018368 - RNA, 13 nt, Human T-lymphotropic virus 2
gccaagauccuuc

SEQ ID NO: 4018369 - RNA, 19 nt, Human T-lymphotropic virus 2
gccaagauccuucucacug

SEQ ID NO: 4018370 - RNA, 16 nt, Human T-lymphotropic virus 2
gccaauuuucacccuc

SEQ ID NO: 4018371 - RNA, 23 nt, Human T-lymphotropic virus 2
gccaauuuucacccucucccccg

SEQ ID NO: 4018372 - RNA, 17 nt, Human T-lymphotropic virus 2
gccaccuccccccccuu

SEQ ID NO: 4018373 - RNA, 16 nt, Human T-lymphotropic virus 2
gccaccuguccagagc

SEQ ID NO: 4018374 - RNA, 22 nt, Human T-lymphotropic virus 2
gccaccuguccagagcaccaac

SEQ ID NO: 4018375 - RNA, 13 nt, Human T-lymphotropic virus 2
gccagccacccag

SEQ ID NO: 4018376 - RNA, 13 nt, Human T-lymphotropic virus 2
gccagcucugcca

SEQ ID NO: 4018377 - RNA, 23 nt, Human T-lymphotropic virus 2
gccaggcaauacccgugaccccu

SEQ ID NO: 4018378 - RNA, 23 nt, Human T-lymphotropic virus 2
gccauguaacuauggccccggga

SEQ ID NO: 4018379 - RNA, 15 nt, Human T-lymphotropic virus 2
gccauuacuaccacc

SEQ ID NO: 4018380 - RNA, 22 nt, Human T-lymphotropic virus 2
gccauuacuaccacccucaccu

SEQ ID NO: 4018381 - RNA, 14 nt, Human T-lymphotropic virus 2
gcccagcagagccg

SEQ ID NO: 4018382 - RNA, 21 nt, Human T-lymphotropic virus 2
gcccaucuuacguucccuagc

SEQ ID NO: 4018383 - RNA, 19 nt, Human T-lymphotropic virus 2
gcccccgauguccagcccu

SEQ ID NO: 4018384 - RNA, 17 nt, Human T-lymphotropic virus 2
gccccgucuccagucca

SEQ ID NO: 4018385 - RNA, 18 nt, Human T-lymphotropic virus 2
gccccuggauaugauccu

SEQ ID NO: 4018386 - RNA, 18 nt, Human T-lymphotropic virus 2
gccccuggcuuggcucca

SEQ ID NO: 4018387 - RNA, 21 nt, Human T-lymphotropic virus 2
gccccuggcuuggcuccacac

SEQ ID NO: 4018388 - RNA, 13 nt, Human T-lymphotropic virus 2
gcccugcuuucgu

SEQ ID NO: 4018389 - RNA, 17 nt, Human T-lymphotropic virus 2
gccucuuagacacccac

SEQ ID NO: 4018390 - RNA, 14 nt, Human T-lymphotropic virus 2
gccuggaaccaacc

SEQ ID NO: 4018391 - RNA, 20 nt, Human T-lymphotropic virus 2
gccuucaccauuccccagcc

SEQ ID NO: 4018392 - RNA, 19 nt, Human T-lymphotropic virus 2
gccuuccccgaaccuggcc

SEQ ID NO: 4018393 - RNA, 15 nt, Human T-lymphotropic virus 2
gcgcagcaagggcua

SEQ ID NO: 4018394 - RNA, 22 nt, Human T-lymphotropic virus 2
gcgcuccuuucugcgccgcucc

SEQ ID NO: 4018395 - RNA, 20 nt, Human T-lymphotropic virus 2
gcggacacacuaacagcccc

SEQ ID NO: 4018396 - RNA, 16 nt, Human T-lymphotropic virus 2
gcggcuccuccaugac

SEQ ID NO: 4018397 - RNA, 15 nt, Human T-lymphotropic virus 2
gcuacgacgcuuucu

SEQ ID NO: 4018398 - RNA, 18 nt, Human T-lymphotropic virus 2
gcuccacaccccccaccc

SEQ ID NO: 4018399 - RNA, 22 nt, Human T-lymphotropic virus 2
gcuccacaccccccacccuccg

SEQ ID NO: 4018400 - RNA, 11 nt, Human T-lymphotropic virus 2
gcucuccagaa

SEQ ID NO: 4018401 - RNA, 22 nt, Human T-lymphotropic virus 2
gcugccaagccauggccuuccc

SEQ ID NO: 4018402 - RNA, 23 nt, Human T-lymphotropic virus 2
gcuuaacuuucuccaggcugcuu

SEQ ID NO: 4018403 - RNA, 24 nt, Human T-lymphotropic virus 2
gcuuuccccaacuccaauacccaa

SEQ ID NO: 4018404 - RNA, 18 nt, Human T-lymphotropic virus 2
ggagccuuccucaccaag

SEQ ID NO: 4018405 - RNA, 15 nt, Human T-lymphotropic virus 2
ggaggucagcuccuc

SEQ ID NO: 4018406 - RNA, 19 nt, Human T-lymphotropic virus 2
ggcacgagaagcccuccag

SEQ ID NO: 4018407 - RNA, 20 nt, Human T-lymphotropic virus 2
ggcaggcccgcccuaggagc

SEQ ID NO: 4018408 - RNA, 20 nt, Human T-lymphotropic virus 2
ggcaggcgucccggggccaa

SEQ ID NO: 4018409 - RNA, 13 nt, Human T-lymphotropic virus 2
ggccagccuuccu

SEQ ID NO: 4018410 - RNA, 19 nt, Human T-lymphotropic virus 2
ggccgccucaaccccgccc

SEQ ID NO: 4018411 - RNA, 19 nt, Human T-lymphotropic virus 2
ggccgguaaagcuccacga

SEQ ID NO: 4018412 - RNA, 22 nt, Human T-lymphotropic virus 2
ggccuccccgaggguaccccca

SEQ ID NO: 4018413 - RNA, 18 nt, Human T-lymphotropic virus 2
ggccucggcaccuccuga

SEQ ID NO: 4018414 - RNA, 23 nt, Human T-lymphotropic virus 2
ggcgguacaacaguuugacccca

SEQ ID NO: 4018415 - RNA, 15 nt, Human T-lymphotropic virus 2
ggcuagggcuuccug

SEQ ID NO: 4018416 - RNA, 16 nt, Human T-lymphotropic virus 2
ggcuaucaacccacca

SEQ ID NO: 4018417 - RNA, 14 nt, Human T-lymphotropic virus 2
ggcucgcucccuca

SEQ ID NO: 4018418 - RNA, 22 nt, Human T-lymphotropic virus 2
gggagaucuaaucuccccccau

SEQ ID NO: 4018419 - RNA, 20 nt, Human T-lymphotropic virus 2
gggguuuaaaaacagcccca

SEQ ID NO: 4018420 - RNA, 22 nt, Human T-lymphotropic virus 2
ggguacccccaaagagcccauc

SEQ ID NO: 4018421 - RNA, 16 nt, Human T-lymphotropic virus 2
gguggcucgcucccuc

SEQ ID NO: 4018422 - RNA, 14 nt, Human T-lymphotropic virus 2
guaaaggcucugac

SEQ ID NO: 4018423 - RNA, 16 nt, Human T-lymphotropic virus 2
gucaucuuucaaccca

SEQ ID NO: 4018424 - RNA, 23 nt, Human T-lymphotropic virus 2
guccguggaagacucucuuacac

SEQ ID NO: 4018425 - RNA, 18 nt, Human T-lymphotropic virus 2
guccucaaccccaugagg

SEQ ID NO: 4018426 - RNA, 19 nt, Human T-lymphotropic virus 2
gucuccaaggcccuggagg

SEQ ID NO: 4018427 - RNA, 14 nt, Human T-lymphotropic virus 2
gucuccucucaggu

SEQ ID NO: 4018428 - RNA, 22 nt, Human T-lymphotropic virus 2
guuaugggacaaacaccucagc

SEQ ID NO: 4018429 - RNA, 14 nt, Human T-lymphotropic virus 2
guuccuacacacag

SEQ ID NO: 4018430 - RNA, 21 nt, Human T-lymphotropic virus 2
guugacaaagacaucucccac

SEQ ID NO: 4018431 - RNA, 19 nt, Human T-lymphotropic virus 2
guugagacgccuuccgugg

SEQ ID NO: 4018432 - RNA, 19 nt, Human T-lymphotropic virus 2
uaaaccugagcgccuccag

SEQ ID NO: 4018433 - RNA, 17 nt, Human T-lymphotropic virus 2
uaaacuccccggccuua

SEQ ID NO: 4018434 - RNA, 15 nt, Human T-lymphotropic virus 2
uaaaggaacacccau

SEQ ID NO: 4018435 - RNA, 19 nt, Human T-lymphotropic virus 2
uaagugcggcuccuccaug

SEQ ID NO: 4018436 - RNA, 15 nt, Human T-lymphotropic virus 2
uacaauacuccuccu

SEQ ID NO: 4018437 - RNA, 18 nt, Human T-lymphotropic virus 2
uacacccccaacaucucc

SEQ ID NO: 4018438 - RNA, 20 nt, Human T-lymphotropic virus 2
uacaccucccaacccuucuc

SEQ ID NO: 4018439 - RNA, 20 nt, Human T-lymphotropic virus 2
uacaucccccaggagccccc

SEQ ID NO: 4018440 - RNA, 16 nt, Human T-lymphotropic virus 2
uacaugccauucaaca

SEQ ID NO: 4018441 - RNA, 20 nt, Human T-lymphotropic virus 2
uaccagcuuuccccacccau

SEQ ID NO: 4018442 - RNA, 22 nt, Human T-lymphotropic virus 2
uacccaagcgcuacuugacaca

SEQ ID NO: 4018443 - RNA, 12 nt, Human T-lymphotropic virus 2
uaccccaaagca

SEQ ID NO: 4018444 - RNA, 17 nt, Human T-lymphotropic virus 2
uaccccaccuacagacc

SEQ ID NO: 4018445 - RNA, 23 nt, Human T-lymphotropic virus 2
uaccccucccaaaccaccuccca

SEQ ID NO: 4018446 - RNA, 17 nt, Human T-lymphotropic virus 2
uaccuacauucccucgc

SEQ ID NO: 4018447 - RNA, 14 nt, Human T-lymphotropic virus 2
gcgauuguguacag

SEQ ID NO: 4018448 - RNA, 17 nt, Human T-lymphotropic virus 2
gcgcagcaagggcuagg

SEQ ID NO: 4018449 - RNA, 19 nt, Human T-lymphotropic virus 2
gcgccgcucccgcuccuca

SEQ ID NO: 4018450 - RNA, 13 nt, Human T-lymphotropic virus 2
gcgccuccaggcc

SEQ ID NO: 4018451 - RNA, 16 nt, Human T-lymphotropic virus 2
gcgcucggcuagacuc

SEQ ID NO: 4018452 - RNA, 21 nt, Human T-lymphotropic virus 2
gcggacacacuaacagccccc

SEQ ID NO: 4018453 - RNA, 20 nt, Human T-lymphotropic virus 2
gcggccggggcagccuugcu

SEQ ID NO: 4018454 - RNA, 23 nt, Human T-lymphotropic virus 2
gcuagggcuuccugaaccucucc

SEQ ID NO: 4018455 - RNA, 19 nt, Human T-lymphotropic virus 2
gcuccccucaaaaggcagc

SEQ ID NO: 4018456 - RNA, 16 nt, Human T-lymphotropic virus 2
gcucccguaccuccuc

SEQ ID NO: 4018457 - RNA, 21 nt, Human T-lymphotropic virus 2
gcucccucaccgacccucugg

SEQ ID NO: 4018458 - RNA, 17 nt, Human T-lymphotropic virus 2
gcucccuguauccagac

SEQ ID NO: 4018459 - RNA, 18 nt, Human T-lymphotropic virus 2
gcuccucacgcuccugca

SEQ ID NO: 4018460 - RNA, 18 nt, Human T-lymphotropic virus 2
gcucggcuagacucugcc

SEQ ID NO: 4018461 - RNA, 19 nt, Human T-lymphotropic virus 2
gcucggcuagacucugccu

SEQ ID NO: 4018462 - RNA, 22 nt, Human T-lymphotropic virus 2
gcugaaaaacaaggcucugacg

SEQ ID NO: 4018463 - RNA, 16 nt, Human T-lymphotropic virus 2
gcugccaagccauggc

SEQ ID NO: 4018464 - RNA, 20 nt, Human T-lymphotropic virus 2
gcuuauacaauacuccuccu

SEQ ID NO: 4018465 - RNA, 18 nt, Human T-lymphotropic virus 2
gcuuccugaaccucuccg

SEQ ID NO: 4018466 - RNA, 21 nt, Human T-lymphotropic virus 2
gcuuccugaaccucuccggga

SEQ ID NO: 4018467 - RNA, 19 nt, Human T-lymphotropic virus 2
gcuucuauaccucccagac

SEQ ID NO: 4018468 - RNA, 22 nt, Human T-lymphotropic virus 2
ggaacugaaaccacggcccuga

SEQ ID NO: 4018469 - RNA, 19 nt, Human T-lymphotropic virus 2
ggacacacuaacagccccc

SEQ ID NO: 4018470 - RNA, 14 nt, Human T-lymphotropic virus 2
ggacgaccuaccca

SEQ ID NO: 4018471 - RNA, 14 nt, Human T-lymphotropic virus 2
ggaggccccccccc

SEQ ID NO: 4018472 - RNA, 12 nt, Human T-lymphotropic virus 2
ggcaccuccuga

SEQ ID NO: 4018473 - RNA, 16 nt, Human T-lymphotropic virus 2
ggcagcuauccuacag

SEQ ID NO: 4018474 - RNA, 20 nt, Human T-lymphotropic virus 2
ggcauccucauucaccacau

SEQ ID NO: 4018475 - RNA, 21 nt, Human T-lymphotropic virus 2
ggccccuggcuuggcuccaca

SEQ ID NO: 4018476 - RNA, 12 nt, Human T-lymphotropic virus 2
ggcuggcugcuu

SEQ ID NO: 4018477 - RNA, 18 nt, Human T-lymphotropic virus 2
ggcuucuauaccucccag

SEQ ID NO: 4018478 - RNA, 17 nt, Human T-lymphotropic virus 2
ggcuuuccccaacucca

SEQ ID NO: 4018479 - RNA, 19 nt, Human T-lymphotropic virus 2
gggcuuccugaaccucucc

SEQ ID NO: 4018480 - RNA, 23 nt, Human T-lymphotropic virus 2
gggcuuccugaaccucuccggga

SEQ ID NO: 4018481 - RNA, 21 nt, Human T-lymphotropic virus 2
ggggccucuugcccaaccaca

SEQ ID NO: 4018482 - RNA, 21 nt, Human T-lymphotropic virus 2
gggucucuaaaggaacaccca

SEQ ID NO: 4018483 - RNA, 15 nt, Human T-lymphotropic virus 2
gguaagucuccucuc

SEQ ID NO: 4018484 - RNA, 18 nt, Human T-lymphotropic virus 2
gguagucgcuccccgagg

SEQ ID NO: 4018485 - RNA, 17 nt, Human T-lymphotropic virus 2
gguccuuaccccuccca

SEQ ID NO: 4018486 - RNA, 21 nt, Human T-lymphotropic virus 2
gguggaguaacaggcucccua

SEQ ID NO: 4018487 - RNA, 16 nt, Human T-lymphotropic virus 2
guaccuaugcuccucc

SEQ ID NO: 4018488 - RNA, 17 nt, Human T-lymphotropic virus 2
guaguucaguccucccu

SEQ ID NO: 4018489 - RNA, 17 nt, Human T-lymphotropic virus 2
gucacggagacucaccu

SEQ ID NO: 4018490 - RNA, 21 nt, Human T-lymphotropic virus 2
gucacugaaaacgaaaccuca

SEQ ID NO: 4018491 - RNA, 21 nt, Human T-lymphotropic virus 2
guccagagcaccaacucaccu

SEQ ID NO: 4018492 - RNA, 15 nt, Human T-lymphotropic virus 2
gucccggggccaaca

SEQ ID NO: 4018493 - RNA, 16 nt, Human T-lymphotropic virus 2
gucccggggccaacau

SEQ ID NO: 4018494 - RNA, 13 nt, Human T-lymphotropic virus 2
guccucaacccca

SEQ ID NO: 4018495 - RNA, 14 nt, Human T-lymphotropic virus 2
gucucccccaaggu

SEQ ID NO: 4018496 - RNA, 13 nt, Human T-lymphotropic virus 2
gucuccucucagc

SEQ ID NO: 4018497 - RNA, 15 nt, Human T-lymphotropic virus 2
gucuccucucagccc

SEQ ID NO: 4018498 - RNA, 14 nt, Human T-lymphotropic virus 2
guggacacccaagg

SEQ ID NO: 4018499 - RNA, 22 nt, Human T-lymphotropic virus 2
guggacuacgugcugccaagcc

SEQ ID NO: 4018500 - RNA, 23 nt, Human T-lymphotropic virus 2
guugacaaagacaucucccaccu

SEQ ID NO: 4018501 - RNA, 22 nt, Human T-lymphotropic virus 2
guuuaaaaacagccccacccuc

SEQ ID NO: 4018502 - RNA, 21 nt, Human T-lymphotropic virus 2
uaaaccugagcgccuccaggc

SEQ ID NO: 4018503 - RNA, 23 nt, Human T-lymphotropic virus 2
uaaaugaccuggucuccaaggcc

SEQ ID NO: 4018504 - RNA, 23 nt, Human T-lymphotropic virus 2
uaacugcaacaacuccauuaucc

SEQ ID NO: 4018505 - RNA, 19 nt, Human T-lymphotropic virus 2
uaacugccguggccgccuc

SEQ ID NO: 4018506 - RNA, 17 nt, Human T-lymphotropic virus 2
uaagucuccucucaggu

SEQ ID NO: 4018507 - RNA, 16 nt, Human T-lymphotropic virus 2
uaaugggccagccuuc

SEQ ID NO: 4018508 - RNA, 17 nt, Human T-lymphotropic virus 2
uacaacaacucucccag

SEQ ID NO: 4018509 - RNA, 18 nt, Human T-lymphotropic virus 2
uacaacaacucucccagc

SEQ ID NO: 4018510 - RNA, 19 nt, Human T-lymphotropic virus 2
uacaacaacucucccagcu

SEQ ID NO: 4018511 - RNA, 22 nt, Human T-lymphotropic virus 2
uacaacaguuugaccccaccgc

SEQ ID NO: 4018512 - RNA, 16 nt, Human T-lymphotropic virus 2
uacaaccccaccagcu

SEQ ID NO: 4018513 - RNA, 17 nt, Human T-lymphotropic virus 2
uacacacagggacaguc

SEQ ID NO: 4018514 - RNA, 16 nt, Human T-lymphotropic virus 2
uacaccaucagcagcu

SEQ ID NO: 4018515 - RNA, 23 nt, Human T-lymphotropic virus 2
uacaccaucagcagcuuaacaca

SEQ ID NO: 4018516 - RNA, 17 nt, Human T-lymphotropic virus 2
uacacccccccugcccu

SEQ ID NO: 4018517 - RNA, 12 nt, Human T-lymphotropic virus 2
uacaccucccaa

SEQ ID NO: 4018518 - RNA, 23 nt, Human T-lymphotropic virus 2
uacaccucccaacccuucuccag

SEQ ID NO: 4018519 - RNA, 20 nt, Human T-lymphotropic virus 2
uacacgggccccgucuccag

SEQ ID NO: 4018520 - RNA, 23 nt, Human T-lymphotropic virus 2
uacacuccaacugcugaugccuu

SEQ ID NO: 4018521 - RNA, 21 nt, Human T-lymphotropic virus 2
uacauaugagaguaccccuac

SEQ ID NO: 4018522 - RNA, 21 nt, Human T-lymphotropic virus 2
uacaucccccaggagcccccu

SEQ ID NO: 4018523 - RNA, 15 nt, Human T-lymphotropic virus 2
uaccacccucaccuc

SEQ ID NO: 4018524 - RNA, 17 nt, Human T-lymphotropic virus 2
uacccacuuccccuagc

SEQ ID NO: 4018525 - RNA, 20 nt, Human T-lymphotropic virus 2
uaccgggacccaagagcuug

SEQ ID NO: 4018526 - RNA, 14 nt, Human T-lymphotropic virus 2
uaccuaugcuccuc

SEQ ID NO: 4018527 - RNA, 22 nt, Human T-lymphotropic virus 2
uaccucccagacgaccccagcc

SEQ ID NO: 4018528 - RNA, 15 nt, Human T-lymphotropic virus 2
uaccuuaucccucgc

SEQ ID NO: 4018529 - RNA, 20 nt, Human T-lymphotropic virus 2
uagacuguccuaaccuuccc

SEQ ID NO: 4018530 - RNA, 19 nt, Human T-lymphotropic virus 2
uaggacaggucaucucccc

SEQ ID NO: 4018531 - RNA, 17 nt, Human T-lymphotropic virus 2
uagggcuuccugaaccu

SEQ ID NO: 4018532 - RNA, 14 nt, Human T-lymphotropic virus 2
uauaccauacaacc

SEQ ID NO: 4018533 - RNA, 13 nt, Human T-lymphotropic virus 2
uauaccucccaga

SEQ ID NO: 4018534 - RNA, 16 nt, Human T-lymphotropic virus 2
uauacuuauucccaca

SEQ ID NO: 4018535 - RNA, 13 nt, Human T-lymphotropic virus 2
uauauucugcccu

SEQ ID NO: 4018536 - RNA, 20 nt, Human T-lymphotropic virus 2
uauccagcugaccuuacaga

SEQ ID NO: 4018537 - RNA, 14 nt, Human T-lymphotropic virus 2
ucaaaacauccucc

SEQ ID NO: 4018538 - RNA, 15 nt, Human T-lymphotropic virus 2
ucaaacccuccaggc

SEQ ID NO: 4018539 - RNA, 22 nt, Human T-lymphotropic virus 2
ucaagcaggaggucagcuccuc

SEQ ID NO: 4018540 - RNA, 13 nt, Human T-lymphotropic virus 2
ucacacauuuucc

SEQ ID NO: 4018541 - RNA, 19 nt, Human T-lymphotropic virus 2
ucacauugaaccauacuca

SEQ ID NO: 4018542 - RNA, 20 nt, Human T-lymphotropic virus 2
ucaccucuccuuccccaggg

SEQ ID NO: 4018543 - RNA, 21 nt, Human T-lymphotropic virus 2
ucacgauugguaucuccuccu

SEQ ID NO: 4018544 - RNA, 20 nt, Human T-lymphotropic virus 2
ucagacucgccucucccugg

SEQ ID NO: 4018545 - RNA, 13 nt, Human T-lymphotropic virus 2
ucagcuccccucc

SEQ ID NO: 4018546 - RNA, 16 nt, Human T-lymphotropic virus 2
ucagcuccccucccuc

SEQ ID NO: 4018547 - RNA, 18 nt, Human T-lymphotropic virus 2
ucaggcguggacacccaa

SEQ ID NO: 4018548 - RNA, 16 nt, Human T-lymphotropic virus 2
ucauaguccucccgga

SEQ ID NO: 4018549 - RNA, 19 nt, Human T-lymphotropic virus 2
ucauguauccguccuccag

SEQ ID NO: 4018550 - RNA, 16 nt, Human T-lymphotropic virus 2
uccaaacaccauaggc

SEQ ID NO: 4018551 - RNA, 17 nt, Human T-lymphotropic virus 2
uccaaacaccauaggcc

SEQ ID NO: 4018552 - RNA, 15 nt, Human T-lymphotropic virus 2
uccaaaccccccuac

SEQ ID NO: 4018553 - RNA, 15 nt, Human T-lymphotropic virus 2
uccacaccccccacc

SEQ ID NO: 4018554 - RNA, 20 nt, Human T-lymphotropic virus 2
uccacagcgguuacaaaacc

SEQ ID NO: 4018555 - RNA, 18 nt, Human T-lymphotropic virus 2
uccaccacaguccuccac

SEQ ID NO: 4018556 - RNA, 14 nt, Human T-lymphotropic virus 2
uccacccugccagg

SEQ ID NO: 4018557 - RNA, 15 nt, Human T-lymphotropic virus 2
uccacccugccaggc

SEQ ID NO: 4018558 - RNA, 14 nt, Human T-lymphotropic virus 2
uccacggccucacc

SEQ ID NO: 4018559 - RNA, 20 nt, Human T-lymphotropic virus 2
uccaguaaaagccuucuccu

SEQ ID NO: 4018560 - RNA, 16 nt, Human T-lymphotropic virus 2
ucccagcuaacccucc

SEQ ID NO: 4018561 - RNA, 17 nt, Human T-lymphotropic virus 2
ucccagcuaacccucca

SEQ ID NO: 4018562 - RNA, 21 nt, Human T-lymphotropic virus 2
ucccagcuaacccuccaggca

SEQ ID NO: 4018563 - RNA, 20 nt, Human T-lymphotropic virus 2
uccccaacaaaccuccuccc

SEQ ID NO: 4018564 - RNA, 12 nt, Human T-lymphotropic virus 2
uccccaacucca

SEQ ID NO: 4018565 - RNA, 17 nt, Human T-lymphotropic virus 2
ucccccaggagcccccu

SEQ ID NO: 4018566 - RNA, 14 nt, Human T-lymphotropic virus 2
uccccggccuuacc

SEQ ID NO: 4018567 - RNA, 20 nt, Human T-lymphotropic virus 2
uccccuagcgcccccgccgc

SEQ ID NO: 4018568 - RNA, 14 nt, Human T-lymphotropic virus 2
uccccugcccucuc

SEQ ID NO: 4018569 - RNA, 19 nt, Human T-lymphotropic virus 2
ucccgagccagccacccag

SEQ ID NO: 4018570 - RNA, 20 nt, Human T-lymphotropic virus 2
ucccgagccagccacccagg

SEQ ID NO: 4018571 - RNA, 19 nt, Human T-lymphotropic virus 2
ucccgcugcuccuccgcca

SEQ ID NO: 4018572 - RNA, 13 nt, Human T-lymphotropic virus 2
ucccggggaagac

SEQ ID NO: 4018573 - RNA, 17 nt, Human T-lymphotropic virus 2
ucccucgccuccccucc

SEQ ID NO: 4018574 - RNA, 13 nt, Human T-lymphotropic virus 2
ucccucucccggc

SEQ ID NO: 4018575 - RNA, 21 nt, Human T-lymphotropic virus 2
uccggcccuuaccccaaagca

SEQ ID NO: 4018576 - RNA, 17 nt, Human T-lymphotropic virus 2
uccuacacacagggaca

SEQ ID NO: 4018577 - RNA, 18 nt, Human T-lymphotropic virus 2
uccuaccacuccagcccc

SEQ ID NO: 4018578 - RNA, 19 nt, Human T-lymphotropic virus 2
uccuaccacuccagccccu

SEQ ID NO: 4018579 - RNA, 17 nt, Human T-lymphotropic virus 2
uccuauacacuccaacu

SEQ ID NO: 4018580 - RNA, 18 nt, Human T-lymphotropic virus 2
uccuauauggauaccccg

SEQ ID NO: 4018581 - RNA, 13 nt, Human T-lymphotropic virus 2
uccucacgcuccu

SEQ ID NO: 4018582 - RNA, 23 nt, Human T-lymphotropic virus 2
uccucaggccaauuuucacccuc

SEQ ID NO: 4018583 - RNA, 22 nt, Human T-lymphotropic virus 2
uccuccaguaccuaugcuccuc

SEQ ID NO: 4018584 - RNA, 21 nt, Human T-lymphotropic virus 2
uccuccaucccaacccuuccc

SEQ ID NO: 4018585 - RNA, 19 nt, Human T-lymphotropic virus 2
uccuccgccaaauccaggc

SEQ ID NO: 4018586 - RNA, 16 nt, Human T-lymphotropic virus 2
uccuccgccaccuccc

SEQ ID NO: 4018587 - RNA, 21 nt, Human T-lymphotropic virus 2
uccuccuaccacuccagcccc

SEQ ID NO: 4018588 - RNA, 20 nt, Human T-lymphotropic virus 2
uccugaacugcuccucccaa

SEQ ID NO: 4018589 - RNA, 19 nt, Human T-lymphotropic virus 2
uccuggccccugcccccua

SEQ ID NO: 4018590 - RNA, 14 nt, Human T-lymphotropic virus 2
uccuuuccuccugc

SEQ ID NO: 4018591 - RNA, 17 nt, Human T-lymphotropic virus 2
uccuuuccuccugccuc

SEQ ID NO: 4018592 - RNA, 13 nt, Human T-lymphotropic virus 2
ucgacuuccagca

SEQ ID NO: 4018593 - RNA, 12 nt, Human T-lymphotropic virus 2
ucgcaccugcuc

SEQ ID NO: 4018594 - RNA, 23 nt, Human T-lymphotropic virus 2
ucgcugguggaguaacaggcucc

SEQ ID NO: 4018595 - RNA, 14 nt, Human T-lymphotropic virus 2
ucuacaccaccugg

SEQ ID NO: 4018596 - RNA, 14 nt, Human T-lymphotropic virus 2
ucuacuccuccucg

SEQ ID NO: 4018597 - RNA, 21 nt, Human T-lymphotropic virus 2
ucucagcccauuucccaggau

SEQ ID NO: 4018598 - RNA, 16 nt, Human T-lymphotropic virus 2
ucuccaagcggccucg

SEQ ID NO: 4018599 - RNA, 16 nt, Human T-lymphotropic virus 2
ucuccaauaccuuauc

SEQ ID NO: 4018600 - RNA, 18 nt, Human T-lymphotropic virus 2
ucuccaauaccuuauccc

SEQ ID NO: 4018601 - RNA, 17 nt, Human T-lymphotropic virus 2
ucuccaguccauccugg

SEQ ID NO: 4018602 - RNA, 18 nt, Human T-lymphotropic virus 2
ucuccauagacggcuccc

SEQ ID NO: 4018603 - RNA, 14 nt, Human T-lymphotropic virus 2
ucuccccuaucacu

SEQ ID NO: 4018604 - RNA, 21 nt, Human T-lymphotropic virus 2
ucuccguuaugggacaaacac

SEQ ID NO: 4018605 - RNA, 16 nt, Human T-lymphotropic virus 2
ucucgguuccucucca

SEQ ID NO: 4018606 - RNA, 17 nt, Human T-lymphotropic virus 2
ucucgguuccucuccag

SEQ ID NO: 4018607 - RNA, 21 nt, Human T-lymphotropic virus 2
ucucuaaaggaacacccaucc

SEQ ID NO: 4018608 - RNA, 13 nt, Human T-lymphotropic virus 2
ucugcgccgcucc

SEQ ID NO: 4018609 - RNA, 22 nt, Human T-lymphotropic virus 2
ucugcgccgcucccgcuccuca

SEQ ID NO: 4018610 - RNA, 15 nt, Human T-lymphotropic virus 2
ucuuacaccucccaa

SEQ ID NO: 4018611 - RNA, 16 nt, Human T-lymphotropic virus 2
ucuucccggggaagac

SEQ ID NO: 4018612 - RNA, 23 nt, Human T-lymphotropic virus 2
uucaacaggacaucacuccccug

SEQ ID NO: 4018613 - RNA, 20 nt, Human T-lymphotropic virus 2
uucacccaggaagucagcca

SEQ ID NO: 4018614 - RNA, 14 nt, Human T-lymphotropic virus 2
uuccaccucaggca

SEQ ID NO: 4018615 - RNA, 23 nt, Human T-lymphotropic virus 2
uuccaguaaaagccuucuccucg

SEQ ID NO: 4018616 - RNA, 20 nt, Human T-lymphotropic virus 2
uuccccaacaaaccuccucc

SEQ ID NO: 4018617 - RNA, 22 nt, Human T-lymphotropic virus 2
uuccccaacaaaccuccucccg

SEQ ID NO: 4018618 - RNA, 12 nt, Human T-lymphotropic virus 2
uuccuccugccu

SEQ ID NO: 4018619 - RNA, 19 nt, Human T-lymphotropic virus 2
uucgaaaccaaagccuucc

SEQ ID NO: 4018620 - RNA, 14 nt, Human T-lymphotropic virus 2
uucuccaggaacca

SEQ ID NO: 4018621 - RNA, 17 nt, Human T-lymphotropic virus 2
uugaaccauacucagga

SEQ ID NO: 4018622 - RNA, 12 nt, Human T-lymphotropic virus 2
uuggacagagcc

SEQ ID NO: 4018623 - RNA, 12 nt, Human T-lymphotropic virus 2
uuggcagccccc

SEQ ID NO: 4018624 - RNA, 16 nt, Human T-lymphotropic virus 2
uuguaucacccucacc

SEQ ID NO: 4018625 - RNA, 17 nt, Human T-lymphotropic virus 2
uuucacccaggaaguca

SEQ ID NO: 4018626 - RNA, 12 nt, Human T-lymphotropic virus 2
uuucacccucuc

SEQ ID NO: 4018627 - RNA, 20 nt, Human T-lymphotropic virus 2
uuuccaaaucccccucccca

SEQ ID NO: 4018628 - RNA, 15 nt, Human T-lymphotropic virus 2
uuuucccucgcuccc

SEQ ID NO: 4018629 - RNA, 22 nt, Human T-lymphotropic virus 2
aaaccacuccacauuaacacag

SEQ ID NO: 4018630 - RNA, 12 nt, Human T-lymphotropic virus 2
aaacccuccagg

SEQ ID NO: 4018631 - RNA, 14 nt, Human T-lymphotropic virus 2
aaagcccccagggg

SEQ ID NO: 4018632 - RNA, 15 nt, Human T-lymphotropic virus 2
aaagccuucuccucg

SEQ ID NO: 4018633 - RNA, 18 nt, Human T-lymphotropic virus 2
aaaggcucugacgucucc

SEQ ID NO: 4018634 - RNA, 20 nt, Human T-lymphotropic virus 2
aaaggcucugacgucucccc

SEQ ID NO: 4018635 - RNA, 19 nt, Human T-lymphotropic virus 2
aacaccuacaaucccuaua

SEQ ID NO: 4018636 - RNA, 13 nt, Human T-lymphotropic virus 2
aaccaacacccag

SEQ ID NO: 4018637 - RNA, 19 nt, Human T-lymphotropic virus 2
aaccccaccagcucaggcc

SEQ ID NO: 4018638 - RNA, 18 nt, Human T-lymphotropic virus 2
aaccguaguaugccuaua

SEQ ID NO: 4018639 - RNA, 16 nt, Human T-lymphotropic virus 2
aacuccccucauccaa

SEQ ID NO: 4018640 - RNA, 13 nt, Human T-lymphotropic virus 2
aacugaaaccacg

SEQ ID NO: 4018641 - RNA, 15 nt, Human T-lymphotropic virus 2
aacugcaacaacucc

SEQ ID NO: 4018642 - RNA, 23 nt, Human T-lymphotropic virus 2
aacuucuauacaaaauguuccua

SEQ ID NO: 4018643 - RNA, 17 nt, Human T-lymphotropic virus 2
aagacuuauuccuuaua

SEQ ID NO: 4018644 - RNA, 18 nt, Human T-lymphotropic virus 2
aagcccgcggacacacua

SEQ ID NO: 4018645 - RNA, 20 nt, Human T-lymphotropic virus 2
aagcggccggggcagccuug

SEQ ID NO: 4018646 - RNA, 12 nt, Human T-lymphotropic virus 2
aagucuccucuc

SEQ ID NO: 4018647 - RNA, 14 nt, Human T-lymphotropic virus 2
aauagaccucaccc

SEQ ID NO: 4018648 - RNA, 19 nt, Human T-lymphotropic virus 2
aauagccacuccaaacacc

SEQ ID NO: 4018649 - RNA, 17 nt, Human T-lymphotropic virus 2
aaucagcuaaaugucau

SEQ ID NO: 4018650 - RNA, 13 nt, Human T-lymphotropic virus 2
aaucuuuccacca

SEQ ID NO: 4018651 - RNA, 13 nt, Human T-lymphotropic virus 2
aauguugcuuccu

SEQ ID NO: 4018652 - RNA, 13 nt, Human T-lymphotropic virus 2
acaacaacuccau

SEQ ID NO: 4018653 - RNA, 16 nt, Human T-lymphotropic virus 2
acaacaaugccagggg

SEQ ID NO: 4018654 - RNA, 22 nt, Human T-lymphotropic virus 2
acaacggaccaacgacuacacc

SEQ ID NO: 4018655 - RNA, 23 nt, Human T-lymphotropic virus 2
acaauccugucuccucucagccc

SEQ ID NO: 4018656 - RNA, 18 nt, Human T-lymphotropic virus 2
acaccaagggaagccaag

SEQ ID NO: 4018657 - RNA, 12 nt, Human T-lymphotropic virus 2
acaccucagccu

SEQ ID NO: 4018658 - RNA, 17 nt, Human T-lymphotropic virus 2
acaccuucccccaccuc

SEQ ID NO: 4018659 - RNA, 13 nt, Human T-lymphotropic virus 2
acacuaacagccc

SEQ ID NO: 4018660 - RNA, 17 nt, Human T-lymphotropic virus 2
acagccuuaccccaccu

SEQ ID NO: 4018661 - RNA, 23 nt, Human T-lymphotropic virus 2
acaggcucccuaucucuggcuuc

SEQ ID NO: 4018662 - RNA, 16 nt, Human T-lymphotropic virus 2
acaucacuccccugcc

SEQ ID NO: 4018663 - RNA, 15 nt, Human T-lymphotropic virus 2
acaucccccaggagc

SEQ ID NO: 4018664 - RNA, 22 nt, Human T-lymphotropic virus 2
acauucgccggggccucuugcc

SEQ ID NO: 4018665 - RNA, 22 nt, Human T-lymphotropic virus 2
accacaugggucgauuccauaa

SEQ ID NO: 4018666 - RNA, 12 nt, Human T-lymphotropic virus 2
accacuccagcc

SEQ ID NO: 4018667 - RNA, 14 nt, Human T-lymphotropic virus 2
accacuccugucuc

SEQ ID NO: 4018668 - RNA, 20 nt, Human T-lymphotropic virus 2
accagaugucagacucgccu

SEQ ID NO: 4018669 - RNA, 17 nt, Human T-lymphotropic virus 2
accagcucaggccuggu

SEQ ID NO: 4018670 - RNA, 14 nt, Human T-lymphotropic virus 2
accauuccccagcc

SEQ ID NO: 4018671 - RNA, 18 nt, Human T-lymphotropic virus 2
accauucucgcucuacuc

SEQ ID NO: 4018672 - RNA, 22 nt, Human T-lymphotropic virus 2
accauucucgcucuacuccucc

SEQ ID NO: 4018673 - RNA, 20 nt, Human T-lymphotropic virus 2
acccaggaagucagccaagu

SEQ ID NO: 4018674 - RNA, 13 nt, Human T-lymphotropic virus 2
acccauauaccau

SEQ ID NO: 4018675 - RNA, 15 nt, Human T-lymphotropic virus 2
accccacaacaacuc

SEQ ID NO: 4018676 - RNA, 12 nt, Human T-lymphotropic virus 2
accccaccuaca

SEQ ID NO: 4018677 - RNA, 19 nt, Human T-lymphotropic virus 2
accccgcccuaccucuccu

SEQ ID NO: 4018678 - RNA, 17 nt, Human T-lymphotropic virus 2
accccuacuauucccau

SEQ ID NO: 4018679 - RNA, 20 nt, Human T-lymphotropic virus 2
accccucccaaaccaccucc

SEQ ID NO: 4018680 - RNA, 16 nt, Human T-lymphotropic virus 2
accccucuugggcagc

SEQ ID NO: 4018681 - RNA, 24 nt, Human T-lymphotropic virus 2
acccgauggcaaauccaccacagu

SEQ ID NO: 4018682 - RNA, 19 nt, Human T-lymphotropic virus 2
accgcuugcagccuaggcc

SEQ ID NO: 4018683 - RNA, 14 nt, Human T-lymphotropic virus 2
accuaagagccacc

SEQ ID NO: 4018684 - RNA, 16 nt, Human T-lymphotropic virus 2
accucagaacccacuc

SEQ ID NO: 4018685 - RNA, 14 nt, Human T-lymphotropic virus 2
accucagccuaccc

SEQ ID NO: 4018686 - RNA, 9 nt, Human T-lymphotropic virus 2
accucccaa

SEQ ID NO: 4018687 - RNA, 16 nt, Human T-lymphotropic virus 2
accuccuauucuggga

SEQ ID NO: 4018688 - RNA, 21 nt, Human T-lymphotropic virus 2
accucuccuuccccagggccc

SEQ ID NO: 4018689 - RNA, 15 nt, Human T-lymphotropic virus 2
accuucccccaccuc

SEQ ID NO: 4018690 - RNA, 16 nt, Human T-lymphotropic virus 2
accuucccccaccucc

SEQ ID NO: 4018691 - RNA, 17 nt, Human T-lymphotropic virus 2
accuucccccaccuccc

SEQ ID NO: 4018692 - RNA, 21 nt, Human T-lymphotropic virus 2
accuuccccuagacaaugcca

SEQ ID NO: 4018693 - RNA, 18 nt, Human T-lymphotropic virus 2
accuugaacauguccuaa

SEQ ID NO: 4018694 - RNA, 16 nt, Human T-lymphotropic virus 2
accuuggcagccaacc

SEQ ID NO: 4018695 - RNA, 20 nt, Human T-lymphotropic virus 2
accuuuugcuguccuucucg

SEQ ID NO: 4018696 - RNA, 17 nt, Human T-lymphotropic virus 2
acgccccaaggccucca

SEQ ID NO: 4018697 - RNA, 20 nt, Human T-lymphotropic virus 2
acgcguugucagcucuccuc

SEQ ID NO: 4018698 - RNA, 16 nt, Human T-lymphotropic virus 2
acgcuucuuaggacag

SEQ ID NO: 4018699 - RNA, 16 nt, Human T-lymphotropic virus 2
acggcccccugccuuu

SEQ ID NO: 4018700 - RNA, 19 nt, Human T-lymphotropic virus 2
acggcccugacgucccucc

SEQ ID NO: 4018701 - RNA, 14 nt, Human T-lymphotropic virus 2
acggccucacccau

SEQ ID NO: 4018702 - RNA, 12 nt, Human T-lymphotropic virus 2
acuaacagcccc

SEQ ID NO: 4018703 - RNA, 11 nt, Human T-lymphotropic virus 2
acuaccacccu

SEQ ID NO: 4018704 - RNA, 14 nt, Human T-lymphotropic virus 2
acuacgugcugcca

SEQ ID NO: 4018705 - RNA, 17 nt, Human T-lymphotropic virus 2
acuacuccuccgccacc

SEQ ID NO: 4018706 - RNA, 15 nt, Human T-lymphotropic virus 2
acucaggaccaggca

SEQ ID NO: 4018707 - RNA, 19 nt, Human T-lymphotropic virus 2
acuccaaacaccauaggcc

SEQ ID NO: 4018708 - RNA, 22 nt, Human T-lymphotropic virus 2
acuccagccccuguagcccaac

SEQ ID NO: 4018709 - RNA, 17 nt, Human T-lymphotropic virus 2
acuccccggccuuacca

SEQ ID NO: 4018710 - RNA, 14 nt, Human T-lymphotropic virus 2
acuccuccuuccau

SEQ ID NO: 4018711 - RNA, 24 nt, Human T-lymphotropic virus 2
acucuacacccccaacaucuccau

SEQ ID NO: 4018712 - RNA, 13 nt, Human T-lymphotropic virus 2
acugcaacaacuc

SEQ ID NO: 4018713 - RNA, 16 nt, Human T-lymphotropic virus 2
acugccguggccgccu

SEQ ID NO: 4018714 - RNA, 18 nt, Human T-lymphotropic virus 2
agaaguuuuaagaucucc

SEQ ID NO: 4018715 - RNA, 13 nt, Human T-lymphotropic virus 2
agacaccuucucc

SEQ ID NO: 4018716 - RNA, 22 nt, Human T-lymphotropic virus 2
agacaucucgauacucccacuc

SEQ ID NO: 4018717 - RNA, 16 nt, Human T-lymphotropic virus 2
agacgaccccagcccc

SEQ ID NO: 4018718 - RNA, 17 nt, Human T-lymphotropic virus 2
agacgccuuccguggga

SEQ ID NO: 4018719 - RNA, 19 nt, Human T-lymphotropic virus 2
agacuguccuaaccuuccc

SEQ ID NO: 4018720 - RNA, 14 nt, Human T-lymphotropic virus 2
gucucccggccucg

SEQ ID NO: 4018721 - RNA, 13 nt, Human T-lymphotropic virus 2
gugcggcuccucc

SEQ ID NO: 4018722 - RNA, 15 nt, Human T-lymphotropic virus 2
guggagcgcagcaag

SEQ ID NO: 4018723 - RNA, 17 nt, Human T-lymphotropic virus 2
guggcaagguaggacac

SEQ ID NO: 4018724 - RNA, 17 nt, Human T-lymphotropic virus 2
guggccgccucaacccc

SEQ ID NO: 4018725 - RNA, 17 nt, Human T-lymphotropic virus 2
guggcuugucuccgccc

SEQ ID NO: 4018726 - RNA, 15 nt, Human T-lymphotropic virus 2
guucaucaccucaga

SEQ ID NO: 4018727 - RNA, 16 nt, Human T-lymphotropic virus 2
guuccaacccgugagg

SEQ ID NO: 4018728 - RNA, 20 nt, Human T-lymphotropic virus 2
guuuaaaaacagccccaccc

SEQ ID NO: 4018729 - RNA, 12 nt, Human T-lymphotropic virus 2
uaaaaacagccc

SEQ ID NO: 4018730 - RNA, 20 nt, Human T-lymphotropic virus 2
uaaaagcgcaaggacaguuc

SEQ ID NO: 4018731 - RNA, 13 nt, Human T-lymphotropic virus 2
uaaaggcucugac

SEQ ID NO: 4018732 - RNA, 21 nt, Human T-lymphotropic virus 2
uaacacacuaauuaccgaggc

SEQ ID NO: 4018733 - RNA, 13 nt, Human T-lymphotropic virus 2
uaacccuccaggc

SEQ ID NO: 4018734 - RNA, 13 nt, Human T-lymphotropic virus 2
uaacuuucuccag

SEQ ID NO: 4018735 - RNA, 22 nt, Human T-lymphotropic virus 2
uaagaucucccgcugcuccucc

SEQ ID NO: 4018736 - RNA, 16 nt, Human T-lymphotropic virus 2
uacaauccugucuccu

SEQ ID NO: 4018737 - RNA, 14 nt, Human T-lymphotropic virus 2
uacaaugccccuac

SEQ ID NO: 4018738 - RNA, 21 nt, Human T-lymphotropic virus 2
uacaugccauucaacaagcuc

SEQ ID NO: 4018739 - RNA, 15 nt, Human T-lymphotropic virus 2
uacccaaagccccca

SEQ ID NO: 4018740 - RNA, 12 nt, Human T-lymphotropic virus 2
uacccagccacg

SEQ ID NO: 4018741 - RNA, 23 nt, Human T-lymphotropic virus 2
uaccgacagccuuaccccaccua

SEQ ID NO: 4018742 - RNA, 14 nt, Human T-lymphotropic virus 2
uacuacuccuccgc

SEQ ID NO: 4018743 - RNA, 18 nt, Human T-lymphotropic virus 2
uacucaaauuuauccagc

SEQ ID NO: 4018744 - RNA, 15 nt, Human T-lymphotropic virus 2
uacucaggaccaggc

SEQ ID NO: 4018745 - RNA, 15 nt, Human T-lymphotropic virus 2
uacucuacaccccca

SEQ ID NO: 4018746 - RNA, 15 nt, Human T-lymphotropic virus 2
uagacaccuucuccg

SEQ ID NO: 4018747 - RNA, 22 nt, Human T-lymphotropic virus 2
uagacucugccuuaaacuucac

SEQ ID NO: 4018748 - RNA, 18 nt, Human T-lymphotropic virus 2
uagcagccguccucaacc

SEQ ID NO: 4018749 - RNA, 20 nt, Human T-lymphotropic virus 2
uagcagccguccucaacccc

SEQ ID NO: 4018750 - RNA, 18 nt, Human T-lymphotropic virus 2
uagccuuauccccaaggg

SEQ ID NO: 4018751 - RNA, 13 nt, Human T-lymphotropic virus 2
uaguccucccgga

SEQ ID NO: 4018752 - RNA, 22 nt, Human T-lymphotropic virus 2
uauaaacuccccggccuuacca

SEQ ID NO: 4018753 - RNA, 18 nt, Human T-lymphotropic virus 2
uauaccagcuuuccccac

SEQ ID NO: 4018754 - RNA, 13 nt, Human T-lymphotropic virus 2
uauacccuacaac

SEQ ID NO: 4018755 - RNA, 16 nt, Human T-lymphotropic virus 2
uauccguccuccagga

SEQ ID NO: 4018756 - RNA, 22 nt, Human T-lymphotropic virus 2
ucaaauuuauccagcugaccuu

SEQ ID NO: 4018757 - RNA, 14 nt, Human T-lymphotropic virus 2
ucaagucuccccua

SEQ ID NO: 4018758 - RNA, 15 nt, Human T-lymphotropic virus 2
ucacauuccucccau

SEQ ID NO: 4018759 - RNA, 22 nt, Human T-lymphotropic virus 2
ucacccaggaagucagccaagu

SEQ ID NO: 4018760 - RNA, 15 nt, Human T-lymphotropic virus 2
ucaccuacuggccug

SEQ ID NO: 4018761 - RNA, 23 nt, Human T-lymphotropic virus 2
ucaccucagaacccacucagccu

SEQ ID NO: 4018762 - RNA, 22 nt, Human T-lymphotropic virus 2
ucaccucuccuuccccagggcc

SEQ ID NO: 4018763 - RNA, 15 nt, Human T-lymphotropic virus 2
ucacuccccugcccu

SEQ ID NO: 4018764 - RNA, 17 nt, Human T-lymphotropic virus 2
ucaggcacuacugagga

SEQ ID NO: 4018765 - RNA, 14 nt, Human T-lymphotropic virus 2
ucaucaaaacaucc

SEQ ID NO: 4018766 - RNA, 12 nt, Human T-lymphotropic virus 2
ucaucuccccua

SEQ ID NO: 4018767 - RNA, 17 nt, Human T-lymphotropic virus 2
ucauguauccguccucc

SEQ ID NO: 4018768 - RNA, 20 nt, Human T-lymphotropic virus 2
uccaagugucggcauccuca

SEQ ID NO: 4018769 - RNA, 16 nt, Human T-lymphotropic virus 2
uccacaccccccaccc

SEQ ID NO: 4018770 - RNA, 19 nt, Human T-lymphotropic virus 2
uccaccauguccgcagcca

SEQ ID NO: 4018771 - RNA, 12 nt, Human T-lymphotropic virus 2
uccaccugccuu

SEQ ID NO: 4018772 - RNA, 21 nt, Human T-lymphotropic virus 2
uccagccucucauccuggcau

SEQ ID NO: 4018773 - RNA, 13 nt, Human T-lymphotropic virus 2
uccaugacccucc

SEQ ID NO: 4018774 - RNA, 16 nt, Human T-lymphotropic virus 2
uccaugacuccgaccu

SEQ ID NO: 4018775 - RNA, 18 nt, Human T-lymphotropic virus 2
ucccaaaccaccucccaa

SEQ ID NO: 4018776 - RNA, 13 nt, Human T-lymphotropic virus 2
ucccacucauccc

SEQ ID NO: 4018777 - RNA, 18 nt, Human T-lymphotropic virus 2
ucccagcuaacccuccag

SEQ ID NO: 4018778 - RNA, 23 nt, Human T-lymphotropic virus 2
uccccaaaacaucuacaccaccu

SEQ ID NO: 4018779 - RNA, 12 nt, Human T-lymphotropic virus 2
uccccagggccc

SEQ ID NO: 4018780 - RNA, 12 nt, Human T-lymphotropic virus 2
ucccccaccucc

SEQ ID NO: 4018781 - RNA, 16 nt, Human T-lymphotropic virus 2
ucccccaggagccccc

SEQ ID NO: 4018782 - RNA, 24 nt, Human T-lymphotropic virus 2
ucccccaggagcccccucagcuca

SEQ ID NO: 4018783 - RNA, 13 nt, Human T-lymphotropic virus 2
ucccccguuaucc

SEQ ID NO: 4018784 - RNA, 22 nt, Human T-lymphotropic virus 2
ucccccuaccauugacccaucc

SEQ ID NO: 4018785 - RNA, 23 nt, Human T-lymphotropic virus 2
ucccccuaccauugacccaucca

SEQ ID NO: 4018786 - RNA, 18 nt, Human T-lymphotropic virus 2
uccccuaucacuccaucu

SEQ ID NO: 4018787 - RNA, 16 nt, Human T-lymphotropic virus 2
ucccgaaccauccucu

SEQ ID NO: 4018788 - RNA, 17 nt, Human T-lymphotropic virus 2
ucccgagccagccaccc

SEQ ID NO: 4018789 - RNA, 15 nt, Human T-lymphotropic virus 2
ucccguaccuccucc

SEQ ID NO: 4018790 - RNA, 22 nt, Human T-lymphotropic virus 2
ucccucaccgacccucugguca

SEQ ID NO: 4018791 - RNA, 20 nt, Human T-lymphotropic virus 2
ucccuuaucuuagcuccccu

SEQ ID NO: 4018792 - RNA, 23 nt, Human T-lymphotropic virus 2
uccgcauacacgggccccgucuc

SEQ ID NO: 4018793 - RNA, 23 nt, Human T-lymphotropic virus 2
uccgccaaauccaggcccuucca

SEQ ID NO: 4018794 - RNA, 16 nt, Human T-lymphotropic virus 2
uccgccaacagucucc

SEQ ID NO: 4018795 - RNA, 23 nt, Human T-lymphotropic virus 2
uccgccaccuccccccccuuccc

SEQ ID NO: 4018796 - RNA, 20 nt, Human T-lymphotropic virus 2
uccgcccaucaaacccucca

SEQ ID NO: 4018797 - RNA, 22 nt, Human T-lymphotropic virus 2
uccgcccaucaaacccuccagg

SEQ ID NO: 4018798 - RNA, 21 nt, Human T-lymphotropic virus 2
uccuccaggaacggcccccuc

SEQ ID NO: 4018799 - RNA, 20 nt, Human T-lymphotropic virus 2
uccuccgccaaauccaggcc

SEQ ID NO: 4018800 - RNA, 13 nt, Human T-lymphotropic virus 2
uccuccuuccaua

SEQ ID NO: 4018801 - RNA, 12 nt, Human T-lymphotropic virus 2
uccucucagccc

SEQ ID NO: 4018802 - RNA, 15 nt, Human T-lymphotropic virus 2
uccugaaccucuccg

SEQ ID NO: 4018803 - RNA, 19 nt, Human T-lymphotropic virus 2
uccugaacugcuccuccca

SEQ ID NO: 4018804 - RNA, 12 nt, Human T-lymphotropic virus 2
uccuggccccug

SEQ ID NO: 4018805 - RNA, 12 nt, Human T-lymphotropic virus 2
uccugucuccuc

SEQ ID NO: 4018806 - RNA, 21 nt, Human T-lymphotropic virus 2
uccuguuggaucucccuucca

SEQ ID NO: 4018807 - RNA, 16 nt, Human T-lymphotropic virus 2
uccuuaccccucccac

SEQ ID NO: 4018808 - RNA, 18 nt, Human T-lymphotropic virus 2
uccuuccauaaccuucac

SEQ ID NO: 4018809 - RNA, 20 nt, Human T-lymphotropic virus 2
uccuucucacuggaaaaggg

SEQ ID NO: 4018810 - RNA, 14 nt, Human T-lymphotropic virus 2
ucgaaaccaaagcc

SEQ ID NO: 4018811 - RNA, 22 nt, Human T-lymphotropic virus 2
gaaaaauucgaaaccaaagccu

SEQ ID NO: 4018812 - RNA, 17 nt, Human T-lymphotropic virus 2
gaaaccaaagccuucca

SEQ ID NO: 4018813 - RNA, 21 nt, Human T-lymphotropic virus 2
gaacauguccuaacccccucc

SEQ ID NO: 4018814 - RNA, 19 nt, Human T-lymphotropic virus 2
gaacugcuccucccaaggu

SEQ ID NO: 4018815 - RNA, 21 nt, Human T-lymphotropic virus 2
gaagacucucuuacaccuccc

SEQ ID NO: 4018816 - RNA, 22 nt, Human T-lymphotropic virus 2
gaagacucucuuacaccuccca

SEQ ID NO: 4018817 - RNA, 23 nt, Human T-lymphotropic virus 2
gaagacucucuuacaccucccaa

SEQ ID NO: 4018818 - RNA, 20 nt, Human T-lymphotropic virus 2
gaagccucuaccccucccaa

SEQ ID NO: 4018819 - RNA, 20 nt, Human T-lymphotropic virus 2
gaagucagccaagugucccu

SEQ ID NO: 4018820 - RNA, 15 nt, Human T-lymphotropic virus 2
gaauacaccaacauc

SEQ ID NO: 4018821 - RNA, 17 nt, Human T-lymphotropic virus 2
gacaaacaccucagccu

SEQ ID NO: 4018822 - RNA, 19 nt, Human T-lymphotropic virus 2
gacaauggcgacuagccuc

SEQ ID NO: 4018823 - RNA, 16 nt, Human T-lymphotropic virus 2
gaccaucuaccuccac

SEQ ID NO: 4018824 - RNA, 17 nt, Human T-lymphotropic virus 2
gacccaaaaggucagac

SEQ ID NO: 4018825 - RNA, 14 nt, Human T-lymphotropic virus 2
gaccccagccccca

SEQ ID NO: 4018826 - RNA, 22 nt, Human T-lymphotropic virus 2
gaccuuacgguuauaccccaga

SEQ ID NO: 4018827 - RNA, 19 nt, Human T-lymphotropic virus 2
gacgauuacccccugccca

SEQ ID NO: 4018828 - RNA, 21 nt, Human T-lymphotropic virus 2
gacgcccuacaacaaugccag

SEQ ID NO: 4018829 - RNA, 20 nt, Human T-lymphotropic virus 2
gacgccuuuuuccaaauccc

SEQ ID NO: 4018830 - RNA, 15 nt, Human T-lymphotropic virus 2
gacuacgugcugcca

SEQ ID NO: 4018831 - RNA, 20 nt, Human T-lymphotropic virus 2
gacucucuuacaccucccaa

SEQ ID NO: 4018832 - RNA, 13 nt, Human T-lymphotropic virus 2
gagacgccuuccg

SEQ ID NO: 4018833 - RNA, 22 nt, Human T-lymphotropic virus 2
gagagucucgcaccugcucgcu

SEQ ID NO: 4018834 - RNA, 16 nt, Human T-lymphotropic virus 2
gagccagccacccagg

SEQ ID NO: 4018835 - RNA, 20 nt, Human T-lymphotropic virus 2
gagucgggacuguacccagc

SEQ ID NO: 4018836 - RNA, 18 nt, Human T-lymphotropic virus 2
gauaacugcaacaacucc

SEQ ID NO: 4018837 - RNA, 22 nt, Human T-lymphotropic virus 2
gauaugcauggacuguccuucc

SEQ ID NO: 4018838 - RNA, 20 nt, Human T-lymphotropic virus 2
gauccagccucucauccugg

SEQ ID NO: 4018839 - RNA, 21 nt, Human T-lymphotropic virus 2
gauccagccucucauccuggc

SEQ ID NO: 4018840 - RNA, 22 nt, Human T-lymphotropic virus 2
gaugccuuucuucccucucccg

SEQ ID NO: 4018841 - RNA, 19 nt, Human T-lymphotropic virus 2
gauguaaauuucacccagg

SEQ ID NO: 4018842 - RNA, 17 nt, Human T-lymphotropic virus 2
gcaagggcuagggcuuc

SEQ ID NO: 4018843 - RNA, 21 nt, Human T-lymphotropic virus 2
gcaauguugcuuccucaacau

SEQ ID NO: 4018844 - RNA, 19 nt, Human T-lymphotropic virus 2
gcacaguaugcagcccaaa

SEQ ID NO: 4018845 - RNA, 18 nt, Human T-lymphotropic virus 2
gcacgagaagcccuccag

SEQ ID NO: 4018846 - RNA, 15 nt, Human T-lymphotropic virus 2
gcagccacaccaacc

SEQ ID NO: 4018847 - RNA, 13 nt, Human T-lymphotropic virus 2
gcagccguccuca

SEQ ID NO: 4018848 - RNA, 20 nt, Human T-lymphotropic virus 2
gcaggcuaauaaccccgccc

SEQ ID NO: 4018849 - RNA, 23 nt, Human T-lymphotropic virus 2
gcagggccccuaagaaugcaggc

SEQ ID NO: 4018850 - RNA, 13 nt, Human T-lymphotropic virus 2
gcauggccuucca

SEQ ID NO: 4018851 - RNA, 17 nt, Human T-lymphotropic virus 2
gccaaaaaaucuuacaa

SEQ ID NO: 4018852 - RNA, 19 nt, Human T-lymphotropic virus 2
gccacaccaagggaagcca

SEQ ID NO: 4018853 - RNA, 17 nt, Human T-lymphotropic virus 2
gccacgccccccuccug

SEQ ID NO: 4018854 - RNA, 15 nt, Human T-lymphotropic virus 2
gccagccacccaggg

SEQ ID NO: 4018855 - RNA, 13 nt, Human T-lymphotropic virus 2
gccagccccacca

SEQ ID NO: 4018856 - RNA, 19 nt, Human T-lymphotropic virus 2
gcccagcaaggucuuagac

SEQ ID NO: 4018857 - RNA, 16 nt, Human T-lymphotropic virus 2
gcccaucaaacccucc

SEQ ID NO: 4018858 - RNA, 14 nt, Human T-lymphotropic virus 2
gcccccucagcuca

SEQ ID NO: 4018859 - RNA, 19 nt, Human T-lymphotropic virus 2
gccccuguauccuccgcca

SEQ ID NO: 4018860 - RNA, 15 nt, Human T-lymphotropic virus 2
gcccgcccuaggagc

SEQ ID NO: 4018861 - RNA, 11 nt, Human T-lymphotropic virus 2
gcccugcuuuc

SEQ ID NO: 4018862 - RNA, 13 nt, Human T-lymphotropic virus 2
gccgcccucuugg

SEQ ID NO: 4018863 - RNA, 15 nt, Human T-lymphotropic virus 2
gccguccucaacccc

SEQ ID NO: 4018864 - RNA, 17 nt, Human T-lymphotropic virus 2
gccguccucaaccccau

SEQ ID NO: 4018865 - RNA, 16 nt, Human T-lymphotropic virus 2
gccguucuucaggcca

SEQ ID NO: 4018866 - RNA, 19 nt, Human T-lymphotropic virus 2
gccuccccuccuuccccac

SEQ ID NO: 4018867 - RNA, 17 nt, Human T-lymphotropic virus 2
gccucccgagccagcca

SEQ ID NO: 4018868 - RNA, 19 nt, Human T-lymphotropic virus 2
gccuuaccccaccuacaga

SEQ ID NO: 4018869 - RNA, 17 nt, Human T-lymphotropic virus 2
gcgacuagccucccgag

SEQ ID NO: 4018870 - RNA, 23 nt, Human T-lymphotropic virus 2
gcgagucaucgacccaaaagguc

SEQ ID NO: 4018871 - RNA, 17 nt, Human T-lymphotropic virus 2
gcggcuccuccaugacc

SEQ ID NO: 4018872 - RNA, 21 nt, Human T-lymphotropic virus 2
gcguugucagcucuccucucc

SEQ ID NO: 4018873 - RNA, 18 nt, Human T-lymphotropic virus 2
gcuagccuuauccccaag

SEQ ID NO: 4018874 - RNA, 19 nt, Human T-lymphotropic virus 2
gcuagccuuauccccaagg

SEQ ID NO: 4018875 - RNA, 13 nt, Human T-lymphotropic virus 2
gcuauaggcaggc

SEQ ID NO: 4018876 - RNA, 13 nt, Human T-lymphotropic virus 2
gcuccacaccccc

SEQ ID NO: 4018877 - RNA, 13 nt, Human T-lymphotropic virus 2
gcucccgcuccuc

SEQ ID NO: 4018878 - RNA, 14 nt, Human T-lymphotropic virus 2
gcucuacuccuccu

SEQ ID NO: 4018879 - RNA, 16 nt, Human T-lymphotropic virus 2
gcucuuggcagccccc

SEQ ID NO: 4018880 - RNA, 17 nt, Human T-lymphotropic virus 2
gcugccaagccauggcc

SEQ ID NO: 4018881 - RNA, 21 nt, Human T-lymphotropic virus 2
gcuuccaguaaaagccuucuc

SEQ ID NO: 4018882 - RNA, 14 nt, Human T-lymphotropic virus 2
ggaacagcucucca

SEQ ID NO: 4018883 - RNA, 23 nt, Human T-lymphotropic virus 2
ggaggcccauguuccccccccuu

SEQ ID NO: 4018884 - RNA, 22 nt, Human T-lymphotropic virus 2
ggaugacaauggcgacuagccu

SEQ ID NO: 4018885 - RNA, 24 nt, Human T-lymphotropic virus 2
ggcaccuccugaacugcuccuccc

SEQ ID NO: 4018886 - RNA, 18 nt, Human T-lymphotropic virus 2
ggccaucaagcaggaggu

SEQ ID NO: 4018887 - RNA, 17 nt, Human T-lymphotropic virus 2
ggcccugacgucccucc

SEQ ID NO: 4018888 - RNA, 21 nt, Human T-lymphotropic virus 2
ggcccuugacaacggccuccc

SEQ ID NO: 4018889 - RNA, 16 nt, Human T-lymphotropic virus 2
ggcgacuagccucccg

SEQ ID NO: 4018890 - RNA, 20 nt, Human T-lymphotropic virus 2
ggcucugacgucucccccuu

SEQ ID NO: 4018891 - RNA, 17 nt, Human T-lymphotropic virus 2
ggcugcuuucuccaccc

SEQ ID NO: 4018892 - RNA, 23 nt, Human T-lymphotropic virus 2
ggcuuccaguaaaagccuucucc

SEQ ID NO: 4018893 - RNA, 18 nt, Human T-lymphotropic virus 2
ggcuuccugaaccucucc

SEQ ID NO: 4018894 - RNA, 22 nt, Human T-lymphotropic virus 2
ggcuuccugaaccucuccggga

SEQ ID NO: 4018895 - RNA, 16 nt, Human T-lymphotropic virus 2
gggauccauccucucc

SEQ ID NO: 4018896 - RNA, 14 nt, Human T-lymphotropic virus 2
gggcuaucaaccca

SEQ ID NO: 4018897 - RNA, 18 nt, Human T-lymphotropic virus 2
gggcuucuauaccuccca

SEQ ID NO: 4018898 - RNA, 16 nt, Human T-lymphotropic virus 2
ggggaaccccuccugu

SEQ ID NO: 4018899 - RNA, 22 nt, Human T-lymphotropic virus 2
ggucaccuacuggccugcacca

SEQ ID NO: 4018900 - RNA, 21 nt, Human T-lymphotropic virus 2
ggucucuaaaggaacacccau

SEQ ID NO: 4018901 - RNA, 22 nt, Human T-lymphotropic virus 2
ggucucuaaaggaacacccauc

SEQ ID NO: 4018902 - RNA, 17 nt, Human T-lymphotropic virus 2
gguucgucccccuacca

SEQ ID NO: 4018903 - RNA, 18 nt, Human T-lymphotropic virus 2
gguuuaaaaacagcccca

SEQ ID NO: 4018904 - RNA, 16 nt, Human T-lymphotropic virus 2
guaguucaguccuccc

SEQ ID NO: 4018905 - RNA, 18 nt, Human T-lymphotropic virus 2
guaucacccucaccccac

SEQ ID NO: 4018906 - RNA, 22 nt, Human T-lymphotropic virus 2
gucacugaaaacgaaaccucaa

SEQ ID NO: 4018907 - RNA, 20 nt, Human T-lymphotropic virus 2
gucagaccgucucacacaaa

SEQ ID NO: 4018908 - RNA, 17 nt, Human T-lymphotropic virus 2
guccaugacuccgaccu

SEQ ID NO: 4018909 - RNA, 22 nt, Human T-lymphotropic virus 2
aggcccccccccacacagcccu

SEQ ID NO: 4018910 - RNA, 14 nt, Human T-lymphotropic virus 2
aggcgucccggggc

SEQ ID NO: 4018911 - RNA, 20 nt, Human T-lymphotropic virus 2
aggcucugacgucucccccu

SEQ ID NO: 4018912 - RNA, 20 nt, Human T-lymphotropic virus 2
agggcaagaccaucuaccuc

SEQ ID NO: 4018913 - RNA, 18 nt, Human T-lymphotropic virus 2
aggucagaccgucucaca

SEQ ID NO: 4018914 - RNA, 18 nt, Human T-lymphotropic virus 2
agguggucuauguuccac

SEQ ID NO: 4018915 - RNA, 18 nt, Human T-lymphotropic virus 2
agucaaaauaaaagaugc

SEQ ID NO: 4018916 - RNA, 12 nt, Human T-lymphotropic virus 2
aguccauccugg

SEQ ID NO: 4018917 - RNA, 13 nt, Human T-lymphotropic virus 2
aguccucccuauu

SEQ ID NO: 4018918 - RNA, 15 nt, Human T-lymphotropic virus 2
agucuauaaaagcgc

SEQ ID NO: 4018919 - RNA, 22 nt, Human T-lymphotropic virus 2
aguuauccuaggagagauccag

SEQ ID NO: 4018920 - RNA, 15 nt, Human T-lymphotropic virus 2
aguucaguccucccu

SEQ ID NO: 4018921 - RNA, 23 nt, Human T-lymphotropic virus 2
auagaccucacccuuacccacuu

SEQ ID NO: 4018922 - RNA, 20 nt, Human T-lymphotropic virus 2
auagccacuccaaacaccau

SEQ ID NO: 4018923 - RNA, 12 nt, Human T-lymphotropic virus 2
auaguuccucua

SEQ ID NO: 4018924 - RNA, 14 nt, Human T-lymphotropic virus 2
aucaaaacauccuc

SEQ ID NO: 4018925 - RNA, 13 nt, Human T-lymphotropic virus 2
aucaagacaucuc

SEQ ID NO: 4018926 - RNA, 15 nt, Human T-lymphotropic virus 2
aucaaugcgaaagca

SEQ ID NO: 4018927 - RNA, 22 nt, Human T-lymphotropic virus 2
aucacauuacauaugagaguac

SEQ ID NO: 4018928 - RNA, 13 nt, Human T-lymphotropic virus 2
aucagcuccccuc

SEQ ID NO: 4018929 - RNA, 21 nt, Human T-lymphotropic virus 2
aucagcuccccucccucgccu

SEQ ID NO: 4018930 - RNA, 17 nt, Human T-lymphotropic virus 2
auccaccacaguccucc

SEQ ID NO: 4018931 - RNA, 19 nt, Human T-lymphotropic virus 2
auccacgggcuuuccccaa

SEQ ID NO: 4018932 - RNA, 11 nt, Human T-lymphotropic virus 2
auccagccucu

SEQ ID NO: 4018933 - RNA, 14 nt, Human T-lymphotropic virus 2
auccauccucucca

SEQ ID NO: 4018934 - RNA, 22 nt, Human T-lymphotropic virus 2
auccuacaggggcuggaggaac

SEQ ID NO: 4018935 - RNA, 15 nt, Human T-lymphotropic virus 2
auccucuuuccuucc

SEQ ID NO: 4018936 - RNA, 21 nt, Human T-lymphotropic virus 2
auccucuuuccuucccuugcc

SEQ ID NO: 4018937 - RNA, 23 nt, Human T-lymphotropic virus 2
aucucacuagccuaccgacagcc

SEQ ID NO: 4018938 - RNA, 21 nt, Human T-lymphotropic virus 2
aucucgauacucccacucauc

SEQ ID NO: 4018939 - RNA, 16 nt, Human T-lymphotropic virus 2
aucucuggcuuccagu

SEQ ID NO: 4018940 - RNA, 16 nt, Human T-lymphotropic virus 2
augccaagauccuucu

SEQ ID NO: 4018941 - RNA, 20 nt, Human T-lymphotropic virus 2
augccaagauccuucucacu

SEQ ID NO: 4018942 - RNA, 15 nt, Human T-lymphotropic virus 2
augccauuacuacca

SEQ ID NO: 4018943 - RNA, 15 nt, Human T-lymphotropic virus 2
augcccuccuggcca

SEQ ID NO: 4018944 - RNA, 17 nt, Human T-lymphotropic virus 2
augccuuucuucccucu

SEQ ID NO: 4018945 - RNA, 20 nt, Human T-lymphotropic virus 2
augccuuucuucccucuccc

SEQ ID NO: 4018946 - RNA, 15 nt, Human T-lymphotropic virus 2
auggcagggccccua

SEQ ID NO: 4018947 - RNA, 22 nt, Human T-lymphotropic virus 2
auguaaauuucacccaggaagu

SEQ ID NO: 4018948 - RNA, 21 nt, Human T-lymphotropic virus 2
auuacaauccugucuccucuc

SEQ ID NO: 4018949 - RNA, 15 nt, Human T-lymphotropic virus 2
auuacuaccacccuc

SEQ ID NO: 4018950 - RNA, 13 nt, Human T-lymphotropic virus 2
auuauccuccccc

SEQ ID NO: 4018951 - RNA, 20 nt, Human T-lymphotropic virus 2
auuccccaacaaaccuccuc

SEQ ID NO: 4018952 - RNA, 17 nt, Human T-lymphotropic virus 2
auuuuccacuagcccag

SEQ ID NO: 4018953 - RNA, 22 nt, Human T-lymphotropic virus 2
caaaacaucuacaccaccuggg

SEQ ID NO: 4018954 - RNA, 16 nt, Human T-lymphotropic virus 2
caaaccaccucccaaa

SEQ ID NO: 4018955 - RNA, 20 nt, Human T-lymphotropic virus 2
caaagccuuccaucccuccu

SEQ ID NO: 4018956 - RNA, 22 nt, Human T-lymphotropic virus 2
caacaccauggguaauguuuuc

SEQ ID NO: 4018957 - RNA, 22 nt, Human T-lymphotropic virus 2
caacaguuugaccccaccgcca

SEQ ID NO: 4018958 - RNA, 17 nt, Human T-lymphotropic virus 2
caacauaacugccgugg

SEQ ID NO: 4018959 - RNA, 16 nt, Human T-lymphotropic virus 2
caaccccaugaggaaa

SEQ ID NO: 4018960 - RNA, 16 nt, Human T-lymphotropic virus 2
caacccuucuccagga

SEQ ID NO: 4018961 - RNA, 14 nt, Human T-lymphotropic virus 2
caacucucccagcu

SEQ ID NO: 4018962 - RNA, 22 nt, Human T-lymphotropic virus 2
caagcaggaggucagcuccucu

SEQ ID NO: 4018963 - RNA, 21 nt, Human T-lymphotropic virus 2
caaggccuccacggccucacc

SEQ ID NO: 4018964 - RNA, 16 nt, Human T-lymphotropic virus 2
caagucuccccuagcg

SEQ ID NO: 4018965 - RNA, 19 nt, Human T-lymphotropic virus 2
caauaccuuaucccucgcc

SEQ ID NO: 4018966 - RNA, 11 nt, Human T-lymphotropic virus 2
caaugaggaau

SEQ ID NO: 4018967 - RNA, 16 nt, Human T-lymphotropic virus 2
cacaccaaccuccccg

SEQ ID NO: 4018968 - RNA, 18 nt, Human T-lymphotropic virus 2
cacauuaugggacaaauc

SEQ ID NO: 4018969 - RNA, 14 nt, Human T-lymphotropic virus 2
caccaacaucccug

SEQ ID NO: 4018970 - RNA, 20 nt, Human T-lymphotropic virus 2
caccaagggaagccaagucc

SEQ ID NO: 4018971 - RNA, 17 nt, Human T-lymphotropic virus 2
caccaauuacuccugca

SEQ ID NO: 4018972 - RNA, 15 nt, Human T-lymphotropic virus 2
caccaauugcugcca

SEQ ID NO: 4018973 - RNA, 17 nt, Human T-lymphotropic virus 2
caccauuccccagccau

SEQ ID NO: 4018974 - RNA, 20 nt, Human T-lymphotropic virus 2
cacccagagaaccucaagga

SEQ ID NO: 4018975 - RNA, 16 nt, Human T-lymphotropic virus 2
cacccaggaagucagc

SEQ ID NO: 4018976 - RNA, 21 nt, Human T-lymphotropic virus 2
cacccaguucaaacuccucca

SEQ ID NO: 4018977 - RNA, 22 nt, Human T-lymphotropic virus 2
cacccaguucaaacuccuccaa

SEQ ID NO: 4018978 - RNA, 14 nt, Human T-lymphotropic virus 2
caccccccacccuc

SEQ ID NO: 4018979 - RNA, 15 nt, Human T-lymphotropic virus 2
caccccccacccucc

SEQ ID NO: 4018980 - RNA, 12 nt, Human T-lymphotropic virus 2
cacccucucccc

SEQ ID NO: 4018981 - RNA, 14 nt, Human T-lymphotropic virus 2
caccuccccaagug

SEQ ID NO: 4018982 - RNA, 18 nt, Human T-lymphotropic virus 2
cacgagaagcccuccaga

SEQ ID NO: 4018983 - RNA, 17 nt, Human T-lymphotropic virus 2
cacgccgcaacagacca

SEQ ID NO: 4018984 - RNA, 21 nt, Human T-lymphotropic virus 2
cacgggccccgucuccagucc

SEQ ID NO: 4018985 - RNA, 22 nt, Human T-lymphotropic virus 2
cacgggcuuuccccaacuccaa

SEQ ID NO: 4018986 - RNA, 13 nt, Human T-lymphotropic virus 2
cacuagcccagca

SEQ ID NO: 4018987 - RNA, 16 nt, Human T-lymphotropic virus 2
cacuccaacugcugau

SEQ ID NO: 4018988 - RNA, 19 nt, Human T-lymphotropic virus 2
cacugaaaacgaaaccuca

SEQ ID NO: 4018989 - RNA, 23 nt, Human T-lymphotropic virus 2
cagacccuccggcuggcgguaca

SEQ ID NO: 4018990 - RNA, 23 nt, Human T-lymphotropic virus 2
cagccacaccaaccuccccgacc

SEQ ID NO: 4018991 - RNA, 22 nt, Human T-lymphotropic virus 2
cagccauguaacuauggccccg

SEQ ID NO: 4018992 - RNA, 14 nt, Human T-lymphotropic virus 2
cagccuugcucucc

SEQ ID NO: 4018993 - RNA, 14 nt, Human T-lymphotropic virus 2
cagcuaacccucca

SEQ ID NO: 4018994 - RNA, 21 nt, Human T-lymphotropic virus 2
cagcuccucugcucuuggcag

SEQ ID NO: 4018995 - RNA, 16 nt, Human T-lymphotropic virus 2
cagcucuccucuccaa

SEQ ID NO: 4018996 - RNA, 16 nt, Human T-lymphotropic virus 2
cagcuuuccccaccca

SEQ ID NO: 4018997 - RNA, 17 nt, Human T-lymphotropic virus 2
caggaacagcucuccag

SEQ ID NO: 4018998 - RNA, 22 nt, Human T-lymphotropic virus 2
caggaaccacgacuccucaggc

SEQ ID NO: 4018999 - RNA, 20 nt, Human T-lymphotropic virus 2
caggacaucacuccccugcc

SEQ ID NO: 4019000 - RNA, 20 nt, Human T-lymphotropic virus 2
caggagguggcucgcucccu

SEQ ID NO: 4019001 - RNA, 17 nt, Human T-lymphotropic virus 2
caggauuuggacagagc

SEQ ID NO: 4019002 - RNA, 16 nt, Human T-lymphotropic virus 2
caggcgucccggggcc

SEQ ID NO: 4019003 - RNA, 13 nt, Human T-lymphotropic virus 2
caggcuacaaccc

SEQ ID NO: 4019004 - RNA, 24 nt, Human T-lymphotropic virus 2
caggggcuucuauaccucccagac

SEQ ID NO: 4019005 - RNA, 22 nt, Human T-lymphotropic virus 2
caggucgagcucggcugccccu

SEQ ID NO: 4019006 - RNA, 21 nt, Human T-lymphotropic virus 2
cagguggucuauguuccaccc

SEQ ID NO: 4019007 - RNA, 17 nt, Human T-lymphotropic virus 2
caguaaaagccuucucc

SEQ ID NO: 4019008 - RNA, 17 nt, Human T-lymphotropic virus 2
cagucauaguccucccg

SEQ ID NO: 4019009 - RNA, 14 nt, Human T-lymphotropic virus 2
ccugagcgccucca

SEQ ID NO: 4019010 - RNA, 12 nt, Human T-lymphotropic virus 2
ccugcccgcucc

SEQ ID NO: 4019011 - RNA, 19 nt, Human T-lymphotropic virus 2
ccugccucuuagacaccca

SEQ ID NO: 4019012 - RNA, 16 nt, Human T-lymphotropic virus 2
ccuguauccuccgcca

SEQ ID NO: 4019013 - RNA, 21 nt, Human T-lymphotropic virus 2
ccugucaaaccaucaacucac

SEQ ID NO: 4019014 - RNA, 15 nt, Human T-lymphotropic virus 2
ccugucuccucucag

SEQ ID NO: 4019015 - RNA, 17 nt, Human T-lymphotropic virus 2
ccuguuggaucucccuu

SEQ ID NO: 4019016 - RNA, 19 nt, Human T-lymphotropic virus 2
ccuucaccauuccccagcc

SEQ ID NO: 4019017 - RNA, 13 nt, Human T-lymphotropic virus 2
ccuuccaauuucc

SEQ ID NO: 4019018 - RNA, 15 nt, Human T-lymphotropic virus 2
ccuuccaucccuccu

SEQ ID NO: 4019019 - RNA, 19 nt, Human T-lymphotropic virus 2
ccuuccccuagacaaugcc

SEQ ID NO: 4019020 - RNA, 18 nt, Human T-lymphotropic virus 2
ccuucgacuacacuucuc

SEQ ID NO: 4019021 - RNA, 18 nt, Human T-lymphotropic virus 2
ccuucucgguuccucucc

SEQ ID NO: 4019022 - RNA, 21 nt, Human T-lymphotropic virus 2
ccuugacaacggccuccccga

SEQ ID NO: 4019023 - RNA, 23 nt, Human T-lymphotropic virus 2
ccuugcccugcccgcuccuccau

SEQ ID NO: 4019024 - RNA, 22 nt, Human T-lymphotropic virus 2
cgaacaacaauuagcagccguc

SEQ ID NO: 4019025 - RNA, 24 nt, Human T-lymphotropic virus 2
cgacuuccugaggaacuccccuca

SEQ ID NO: 4019026 - RNA, 17 nt, Human T-lymphotropic virus 2
cgagaagcccuccagac

SEQ ID NO: 4019027 - RNA, 17 nt, Human T-lymphotropic virus 2
cgagguugacaaagaca

SEQ ID NO: 4019028 - RNA, 15 nt, Human T-lymphotropic virus 2
cgauuacccccugcc

SEQ ID NO: 4019029 - RNA, 18 nt, Human T-lymphotropic virus 2
cgauuccauaaccuuggc

SEQ ID NO: 4019030 - RNA, 22 nt, Human T-lymphotropic virus 2
cgcagccacaccaaccuccccg

SEQ ID NO: 4019031 - RNA, 15 nt, Human T-lymphotropic virus 2
cgccccccuccuggc

SEQ ID NO: 4019032 - RNA, 19 nt, Human T-lymphotropic virus 2
cgccgcccucuuggcaggc

SEQ ID NO: 4019033 - RNA, 11 nt, Human T-lymphotropic virus 2
cgccgucacug

SEQ ID NO: 4019034 - RNA, 17 nt, Human T-lymphotropic virus 2
cgcucacauuccuccca

SEQ ID NO: 4019035 - RNA, 12 nt, Human T-lymphotropic virus 2
cgcucccucacc

SEQ ID NO: 4019036 - RNA, 20 nt, Human T-lymphotropic virus 2
cgcucggcuagacucugccu

SEQ ID NO: 4019037 - RNA, 14 nt, Human T-lymphotropic virus 2
cggagacucaccuu

SEQ ID NO: 4019038 - RNA, 15 nt, Human T-lymphotropic virus 2
cggccuugccacccc

SEQ ID NO: 4019039 - RNA, 20 nt, Human T-lymphotropic virus 2
cgggcuuuccccaacuccaa

SEQ ID NO: 4019040 - RNA, 15 nt, Human T-lymphotropic virus 2
cgguuauaccccaga

SEQ ID NO: 4019041 - RNA, 14 nt, Human T-lymphotropic virus 2
cgguuccucuccag

SEQ ID NO: 4019042 - RNA, 21 nt, Human T-lymphotropic virus 2
cgucuccaguccauccuggaa

SEQ ID NO: 4019043 - RNA, 17 nt, Human T-lymphotropic virus 2
cgucucccggccucggc

SEQ ID NO: 4019044 - RNA, 22 nt, Human T-lymphotropic virus 2
cgugcuugacacggcccccugc

SEQ ID NO: 4019045 - RNA, 16 nt, Human T-lymphotropic virus 2
cuaaccuuccccuaga

SEQ ID NO: 4019046 - RNA, 18 nt, Human T-lymphotropic virus 2
cuaagugcggcuccucca

SEQ ID NO: 4019047 - RNA, 13 nt, Human T-lymphotropic virus 2
cuaaucucccccc

SEQ ID NO: 4019048 - RNA, 14 nt, Human T-lymphotropic virus 2
cuacuccuccgcca

SEQ ID NO: 4019049 - RNA, 19 nt, Human T-lymphotropic virus 2
cuagccuaccgacagccuu

SEQ ID NO: 4019050 - RNA, 16 nt, Human T-lymphotropic virus 2
cuagccuuauccccaa

SEQ ID NO: 4019051 - RNA, 18 nt, Human T-lymphotropic virus 2
cuaguagaugccccugga

SEQ ID NO: 4019052 - RNA, 12 nt, Human T-lymphotropic virus 2
cuauaauagacc

SEQ ID NO: 4019053 - RNA, 11 nt, Human T-lymphotropic virus 2
cuaucugcccu

SEQ ID NO: 4019054 - RNA, 17 nt, Human T-lymphotropic virus 2
cuauugcuauaggcagg

SEQ ID NO: 4019055 - RNA, 14 nt, Human T-lymphotropic virus 2
cucaaggacccuca

SEQ ID NO: 4019056 - RNA, 20 nt, Human T-lymphotropic virus 2
cucaccgacccucuggucac

SEQ ID NO: 4019057 - RNA, 22 nt, Human T-lymphotropic virus 2
cucaccuuggggauccauccuc

SEQ ID NO: 4019058 - RNA, 20 nt, Human T-lymphotropic virus 2
cucacgauugguaucuccuc

SEQ ID NO: 4019059 - RNA, 14 nt, Human T-lymphotropic virus 2
cucacgcuccugca

SEQ ID NO: 4019060 - RNA, 14 nt, Human T-lymphotropic virus 2
cucagccuccacca

SEQ ID NO: 4019061 - RNA, 19 nt, Human T-lymphotropic virus 2
cucagccuccaccaacuuc

SEQ ID NO: 4019062 - RNA, 23 nt, Human T-lymphotropic virus 2
cuccaauacccaaagcccccagg

SEQ ID NO: 4019063 - RNA, 15 nt, Human T-lymphotropic virus 2
cuccacaccccccac

SEQ ID NO: 4019064 - RNA, 21 nt, Human T-lymphotropic virus 2
cuccaccaacuucucccccau

SEQ ID NO: 4019065 - RNA, 15 nt, Human T-lymphotropic virus 2
cuccaguccauccug

SEQ ID NO: 4019066 - RNA, 20 nt, Human T-lymphotropic virus 2
cuccauagacggcucccccc

SEQ ID NO: 4019067 - RNA, 13 nt, Human T-lymphotropic virus 2
cuccauuccccaa

SEQ ID NO: 4019068 - RNA, 14 nt, Human T-lymphotropic virus 2
cucccaccuuaccc

SEQ ID NO: 4019069 - RNA, 15 nt, Human T-lymphotropic virus 2
ccccaacaaaccucc

SEQ ID NO: 4019070 - RNA, 18 nt, Human T-lymphotropic virus 2
ccccaacaucuccauucc

SEQ ID NO: 4019071 - RNA, 16 nt, Human T-lymphotropic virus 2
ccccaagguuccaccu

SEQ ID NO: 4019072 - RNA, 19 nt, Human T-lymphotropic virus 2
ccccaagguuccaccugcc

SEQ ID NO: 4019073 - RNA, 15 nt, Human T-lymphotropic virus 2
ccccacacagcccug

SEQ ID NO: 4019074 - RNA, 21 nt, Human T-lymphotropic virus 2
ccccaggucuaauauggaccu

SEQ ID NO: 4019075 - RNA, 13 nt, Human T-lymphotropic virus 2
ccccauggcaggg

SEQ ID NO: 4019076 - RNA, 20 nt, Human T-lymphotropic virus 2
ccccaugucauauucugcca

SEQ ID NO: 4019077 - RNA, 15 nt, Human T-lymphotropic virus 2
cccccaacaucucca

SEQ ID NO: 4019078 - RNA, 12 nt, Human T-lymphotropic virus 2
ccccccuucccc

SEQ ID NO: 4019079 - RNA, 20 nt, Human T-lymphotropic virus 2
cccccguuauccuuuccucc

SEQ ID NO: 4019080 - RNA, 13 nt, Human T-lymphotropic virus 2
cccccucagcuca

SEQ ID NO: 4019081 - RNA, 18 nt, Human T-lymphotropic virus 2
ccccgauguccagcccua

SEQ ID NO: 4019082 - RNA, 14 nt, Human T-lymphotropic virus 2
ccccgucuccaguc

SEQ ID NO: 4019083 - RNA, 19 nt, Human T-lymphotropic virus 2
cccgcugcuccuccgccaa

SEQ ID NO: 4019084 - RNA, 16 nt, Human T-lymphotropic virus 2
cccggguuuccgccug

SEQ ID NO: 4019085 - RNA, 12 nt, Human T-lymphotropic virus 2
cccgucuccagu

SEQ ID NO: 4019086 - RNA, 15 nt, Human T-lymphotropic virus 2
cccucaccgacccuc

SEQ ID NO: 4019087 - RNA, 15 nt, Human T-lymphotropic virus 2
cccuccccccuagga

SEQ ID NO: 4019088 - RNA, 16 nt, Human T-lymphotropic virus 2
cccucccucgccuucc

SEQ ID NO: 4019089 - RNA, 21 nt, Human T-lymphotropic virus 2
cccucgcucccguaccuccuc

SEQ ID NO: 4019090 - RNA, 17 nt, Human T-lymphotropic virus 2
cccucggggaucagcuc

SEQ ID NO: 4019091 - RNA, 19 nt, Human T-lymphotropic virus 2
cccucggggaucagcuccc

SEQ ID NO: 4019092 - RNA, 15 nt, Human T-lymphotropic virus 2
cccugacgucccucc

SEQ ID NO: 4019093 - RNA, 13 nt, Human T-lymphotropic virus 2
cccugauccuagg

SEQ ID NO: 4019094 - RNA, 15 nt, Human T-lymphotropic virus 2
cccuuccaccucagg

SEQ ID NO: 4019095 - RNA, 12 nt, Human T-lymphotropic virus 2
cccuucuccagg

SEQ ID NO: 4019096 - RNA, 21 nt, Human T-lymphotropic virus 2
cccuugcccugcccgcuccuc

SEQ ID NO: 4019097 - RNA, 23 nt, Human T-lymphotropic virus 2
ccgaaccauccucuuuccuuccc

SEQ ID NO: 4019098 - RNA, 23 nt, Human T-lymphotropic virus 2
ccgacgagagucucgcaccugcu

SEQ ID NO: 4019099 - RNA, 17 nt, Human T-lymphotropic virus 2
ccgauggcuccccucaa

SEQ ID NO: 4019100 - RNA, 14 nt, Human T-lymphotropic virus 2
ccgauguccagccc

SEQ ID NO: 4019101 - RNA, 17 nt, Human T-lymphotropic virus 2
ccgcccuaggagcauug

SEQ ID NO: 4019102 - RNA, 16 nt, Human T-lymphotropic virus 2
ccgccucaaccccgcc

SEQ ID NO: 4019103 - RNA, 22 nt, Human T-lymphotropic virus 2
ccgcggacacacuaacagcccc

SEQ ID NO: 4019104 - RNA, 17 nt, Human T-lymphotropic virus 2
ccgcucccgcuccucac

SEQ ID NO: 4019105 - RNA, 12 nt, Human T-lymphotropic virus 2
ccgcuccucacg

SEQ ID NO: 4019106 - RNA, 15 nt, Human T-lymphotropic virus 2
ccgcuccuccauccc

SEQ ID NO: 4019107 - RNA, 21 nt, Human T-lymphotropic virus 2
ccgggauuugaauuccuccau

SEQ ID NO: 4019108 - RNA, 13 nt, Human T-lymphotropic virus 2
ccguccucaaccc

SEQ ID NO: 4019109 - RNA, 13 nt, Human T-lymphotropic virus 2
ccgucuccagucc

SEQ ID NO: 4019110 - RNA, 18 nt, Human T-lymphotropic virus 2
ccgucuccaguccauccu

SEQ ID NO: 4019111 - RNA, 12 nt, Human T-lymphotropic virus 2
ccgucucccggc

SEQ ID NO: 4019112 - RNA, 19 nt, Human T-lymphotropic virus 2
ccguggagcgcagcaaggg

SEQ ID NO: 4019113 - RNA, 15 nt, Human T-lymphotropic virus 2
ccguggccgccucaa

SEQ ID NO: 4019114 - RNA, 14 nt, Human T-lymphotropic virus 2
ccuacacacaggga

SEQ ID NO: 4019115 - RNA, 18 nt, Human T-lymphotropic virus 2
ccuacuuuuauucagucu

SEQ ID NO: 4019116 - RNA, 12 nt, Human T-lymphotropic virus 2
ccuaucuuacau

SEQ ID NO: 4019117 - RNA, 16 nt, Human T-lymphotropic virus 2
ccucaacgccgcccuc

SEQ ID NO: 4019118 - RNA, 18 nt, Human T-lymphotropic virus 2
ccucaccgacccucuggu

SEQ ID NO: 4019119 - RNA, 16 nt, Human T-lymphotropic virus 2
ccuccaccaacuucuc

SEQ ID NO: 4019120 - RNA, 23 nt, Human T-lymphotropic virus 2
ccuccaccauguccgcagccaca

SEQ ID NO: 4019121 - RNA, 18 nt, Human T-lymphotropic virus 2
ccuccaggcggccuugcc

SEQ ID NO: 4019122 - RNA, 20 nt, Human T-lymphotropic virus 2
ccuccaguaccuaugcuccu

SEQ ID NO: 4019123 - RNA, 14 nt, Human T-lymphotropic virus 2
ccuccccuccuucc

SEQ ID NO: 4019124 - RNA, 15 nt, Human T-lymphotropic virus 2
ccucccucgccuucc

SEQ ID NO: 4019125 - RNA, 16 nt, Human T-lymphotropic virus 2
ccuccuaccacuccag

SEQ ID NO: 4019126 - RNA, 19 nt, Human T-lymphotropic virus 2
ccuccuaccacuccagccc

SEQ ID NO: 4019127 - RNA, 21 nt, Human T-lymphotropic virus 2
ccuccuagggaaaccacucca

SEQ ID NO: 4019128 - RNA, 18 nt, Human T-lymphotropic virus 2
ccuccuggccaccugucc

SEQ ID NO: 4019129 - RNA, 22 nt, Human T-lymphotropic virus 2
ccuccuguuggaucucccuucc

SEQ ID NO: 4019130 - RNA, 14 nt, Human T-lymphotropic virus 2
ccucgaacaccuuc

SEQ ID NO: 4019131 - RNA, 14 nt, Human T-lymphotropic virus 2
ccucgccuacaggc

SEQ ID NO: 4019132 - RNA, 13 nt, Human T-lymphotropic virus 2
ccucgccuccccu

SEQ ID NO: 4019133 - RNA, 13 nt, Human T-lymphotropic virus 2
ccucggcaccucc

SEQ ID NO: 4019134 - RNA, 17 nt, Human T-lymphotropic virus 2
ccucggcacuuccgccc

SEQ ID NO: 4019135 - RNA, 20 nt, Human T-lymphotropic virus 2
ccucucaggucgagcucggc

SEQ ID NO: 4019136 - RNA, 17 nt, Human T-lymphotropic virus 2
ccucuccuuccccaggg

SEQ ID NO: 4019137 - RNA, 18 nt, Human T-lymphotropic virus 2
ccucuccuuccccagggc

SEQ ID NO: 4019138 - RNA, 17 nt, Human T-lymphotropic virus 2
ccucugcucuuggcagc

SEQ ID NO: 4019139 - RNA, 15 nt, Human T-lymphotropic virus 2
ccucuggucacggag

SEQ ID NO: 4019140 - RNA, 14 nt, Human T-lymphotropic virus 2
ccugaaccucuccg

SEQ ID NO: 4019141 - RNA, 15 nt, Human T-lymphotropic virus 2
ccugacgucccuccc

SEQ ID NO: 4019142 - RNA, 16 nt, Human T-lymphotropic virus 2
ccugaggaacuccccu

SEQ ID NO: 4019143 - RNA, 16 nt, Human T-lymphotropic virus 2
ccugcccgcuccucca

SEQ ID NO: 4019144 - RNA, 23 nt, Human T-lymphotropic virus 2
ccuggcauguacucuacaccccc

SEQ ID NO: 4019145 - RNA, 22 nt, Human T-lymphotropic virus 2
ccuguccagagcaccaacucac

SEQ ID NO: 4019146 - RNA, 22 nt, Human T-lymphotropic virus 2
ccuuaaaugaccuggucuccaa

SEQ ID NO: 4019147 - RNA, 14 nt, Human T-lymphotropic virus 2
ccuuacccaggcca

SEQ ID NO: 4019148 - RNA, 14 nt, Human T-lymphotropic virus 2
ccuuaccccuccca

SEQ ID NO: 4019149 - RNA, 16 nt, Human T-lymphotropic virus 2
ccuuaccccucccacc

SEQ ID NO: 4019150 - RNA, 21 nt, Human T-lymphotropic virus 2
ccuuagguagucgcuccccga

SEQ ID NO: 4019151 - RNA, 15 nt, Human T-lymphotropic virus 2
ccuucccccaccucc

SEQ ID NO: 4019152 - RNA, 12 nt, Human T-lymphotropic virus 2
ccuucccuugcc

SEQ ID NO: 4019153 - RNA, 11 nt, Human T-lymphotropic virus 2
ccuuccucacc

SEQ ID NO: 4019154 - RNA, 16 nt, Human T-lymphotropic virus 2
ccuucuuuuccccuuc

SEQ ID NO: 4019155 - RNA, 17 nt, Human T-lymphotropic virus 2
ccuugacaacggccucc

SEQ ID NO: 4019156 - RNA, 14 nt, Human T-lymphotropic virus 2
ccuugccaccccua

SEQ ID NO: 4019157 - RNA, 21 nt, Human T-lymphotropic virus 2
ccuuuaugguucaucaccuca

SEQ ID NO: 4019158 - RNA, 14 nt, Human T-lymphotropic virus 2
ccuuucuucccucu

SEQ ID NO: 4019159 - RNA, 16 nt, Human T-lymphotropic virus 2
ccuuucuucccucucc

SEQ ID NO: 4019160 - RNA, 14 nt, Human T-lymphotropic virus 2
cgaacaccuucccc

SEQ ID NO: 4019161 - RNA, 17 nt, Human T-lymphotropic virus 2
cgaacaccuucccccac

SEQ ID NO: 4019162 - RNA, 23 nt, Human T-lymphotropic virus 2
cgaacaccuucccccaccucccc

SEQ ID NO: 4019163 - RNA, 19 nt, Human T-lymphotropic virus 2
cgacagccuuaccccaccu

SEQ ID NO: 4019164 - RNA, 13 nt, Human T-lymphotropic virus 2
cgcauggccuucc

SEQ ID NO: 4019165 - RNA, 18 nt, Human T-lymphotropic virus 2
cgccauuggggccuuccu

SEQ ID NO: 4019166 - RNA, 15 nt, Human T-lymphotropic virus 2
cgcccuacaacaaug

SEQ ID NO: 4019167 - RNA, 15 nt, Human T-lymphotropic virus 2
cgcccucuuggcagg

SEQ ID NO: 4019168 - RNA, 13 nt, Human T-lymphotropic virus 2
cgccggggccucu

SEQ ID NO: 4019169 - RNA, 21 nt, Human T-lymphotropic virus 2
cgccuacaucgacaugcccuc

SEQ ID NO: 4019170 - RNA, 21 nt, Human T-lymphotropic virus 2
cgcucccguaccuccuccggc

SEQ ID NO: 4019171 - RNA, 16 nt, Human T-lymphotropic virus 2
uacguggaacccacca

SEQ ID NO: 4019172 - RNA, 16 nt, Human T-lymphotropic virus 2
uacucaggaccaggca

SEQ ID NO: 4019173 - RNA, 16 nt, Human T-lymphotropic virus 2
uacucuggcuuccaua

SEQ ID NO: 4019174 - RNA, 14 nt, Human T-lymphotropic virus 2
uacuuauucccaca

SEQ ID NO: 4019175 - RNA, 16 nt, Human T-lymphotropic virus 2
uacuucgccuucacca

SEQ ID NO: 4019176 - RNA, 18 nt, Human T-lymphotropic virus 2
uacuuuuagccagcccca

SEQ ID NO: 4019177 - RNA, 19 nt, Human T-lymphotropic virus 2
uagacaaugccauucacaa

SEQ ID NO: 4019178 - RNA, 24 nt, Human T-lymphotropic virus 2
uagccacuccaaacaccauaggcc

SEQ ID NO: 4019179 - RNA, 11 nt, Human T-lymphotropic virus 2
uagccagcccc

SEQ ID NO: 4019180 - RNA, 13 nt, Human T-lymphotropic virus 2
uagccagccccac

SEQ ID NO: 4019181 - RNA, 19 nt, Human T-lymphotropic virus 2
uagccuaccgacagccuua

SEQ ID NO: 4019182 - RNA, 20 nt, Human T-lymphotropic virus 2
uaggccucgaacaccuuccc

SEQ ID NO: 4019183 - RNA, 16 nt, Human T-lymphotropic virus 2
uaucucuggcuuccag

SEQ ID NO: 4019184 - RNA, 18 nt, Human T-lymphotropic virus 2
ucaaaacauccuccgggu

SEQ ID NO: 4019185 - RNA, 14 nt, Human T-lymphotropic virus 2
ucaaaacccaggag

SEQ ID NO: 4019186 - RNA, 18 nt, Human T-lymphotropic virus 2
ucaaacgccaacaaagaa

SEQ ID NO: 4019187 - RNA, 14 nt, Human T-lymphotropic virus 2
ucaaacuccuccaa

SEQ ID NO: 4019188 - RNA, 22 nt, Human T-lymphotropic virus 2
ucaaacuccuccaaaccccccu

SEQ ID NO: 4019189 - RNA, 23 nt, Human T-lymphotropic virus 2
ucaacgccgcccucuuggcaggc

SEQ ID NO: 4019190 - RNA, 21 nt, Human T-lymphotropic virus 2
ucaagcaggaggucagcuccu

SEQ ID NO: 4019191 - RNA, 19 nt, Human T-lymphotropic virus 2
ucaaggacccucaaggucc

SEQ ID NO: 4019192 - RNA, 18 nt, Human T-lymphotropic virus 2
ucaccucagaacccacuc

SEQ ID NO: 4019193 - RNA, 18 nt, Human T-lymphotropic virus 2
ucaccucuccuuccccag

SEQ ID NO: 4019194 - RNA, 19 nt, Human T-lymphotropic virus 2
ucaccucuccuuccccagg

SEQ ID NO: 4019195 - RNA, 12 nt, Human T-lymphotropic virus 2
ucacuccccugc

SEQ ID NO: 4019196 - RNA, 13 nt, Human T-lymphotropic virus 2
ucacuccccugcc

SEQ ID NO: 4019197 - RNA, 13 nt, Human T-lymphotropic virus 2
ucagaacccacuc

SEQ ID NO: 4019198 - RNA, 15 nt, Human T-lymphotropic virus 2
ucagaccgucucaca

SEQ ID NO: 4019199 - RNA, 20 nt, Human T-lymphotropic virus 2
ucagccaagugucccuucga

SEQ ID NO: 4019200 - RNA, 17 nt, Human T-lymphotropic virus 2
ucagcccauuucccagg

SEQ ID NO: 4019201 - RNA, 15 nt, Human T-lymphotropic virus 2
ucaucccccugcggc

SEQ ID NO: 4019202 - RNA, 20 nt, Human T-lymphotropic virus 2
ucaugaccuaagagccacca

SEQ ID NO: 4019203 - RNA, 21 nt, Human T-lymphotropic virus 2
ucauucaugaccuaagagcca

SEQ ID NO: 4019204 - RNA, 13 nt, Human T-lymphotropic virus 2
uccacccugccag

SEQ ID NO: 4019205 - RNA, 21 nt, Human T-lymphotropic virus 2
uccacgggcuuuccccaacuc

SEQ ID NO: 4019206 - RNA, 20 nt, Human T-lymphotropic virus 2
uccagccucucauccuggca

SEQ ID NO: 4019207 - RNA, 21 nt, Human T-lymphotropic virus 2
uccaggaaccacgacuccuca

SEQ ID NO: 4019208 - RNA, 18 nt, Human T-lymphotropic virus 2
uccaguaccuaugcuccu

SEQ ID NO: 4019209 - RNA, 16 nt, Human T-lymphotropic virus 2
uccauaaccuucaccu

SEQ ID NO: 4019210 - RNA, 21 nt, Human T-lymphotropic virus 2
uccauaaccuucaccuucuau

SEQ ID NO: 4019211 - RNA, 13 nt, Human T-lymphotropic virus 2
ucccaacccuucu

SEQ ID NO: 4019212 - RNA, 16 nt, Human T-lymphotropic virus 2
ucccacucaucccccu

SEQ ID NO: 4019213 - RNA, 16 nt, Human T-lymphotropic virus 2
uccccagggccccccg

SEQ ID NO: 4019214 - RNA, 18 nt, Human T-lymphotropic virus 2
ucccccaggagcccccuc

SEQ ID NO: 4019215 - RNA, 20 nt, Human T-lymphotropic virus 2
uccccuccuuccccacccag

SEQ ID NO: 4019216 - RNA, 21 nt, Human T-lymphotropic virus 2
ucccggccucggcaccuccug

SEQ ID NO: 4019217 - RNA, 17 nt, Human T-lymphotropic virus 2
ucccuauauucugcccu

SEQ ID NO: 4019218 - RNA, 21 nt, Human T-lymphotropic virus 2
ucccuaucuuacaucccccag

SEQ ID NO: 4019219 - RNA, 13 nt, Human T-lymphotropic virus 2
ucccucgccuccc

SEQ ID NO: 4019220 - RNA, 22 nt, Human T-lymphotropic virus 2
ucccucgcucccguaccuccuc

SEQ ID NO: 4019221 - RNA, 19 nt, Human T-lymphotropic virus 2
uccgacaccuaucugcccu

SEQ ID NO: 4019222 - RNA, 17 nt, Human T-lymphotropic virus 2
uccgauggcuccccuca

SEQ ID NO: 4019223 - RNA, 21 nt, Human T-lymphotropic virus 2
uccgcagccacaccaaccucc

SEQ ID NO: 4019224 - RNA, 15 nt, Human T-lymphotropic virus 2
uccgccaccuccccc

SEQ ID NO: 4019225 - RNA, 21 nt, Human T-lymphotropic virus 2
uccgccaccuccccccccuuc

SEQ ID NO: 4019226 - RNA, 21 nt, Human T-lymphotropic virus 2
uccgcccaucaaacccuccag

SEQ ID NO: 4019227 - RNA, 16 nt, Human T-lymphotropic virus 2
uccuaccacuccagcc

SEQ ID NO: 4019228 - RNA, 17 nt, Human T-lymphotropic virus 2
uccuaucuacucucuca

SEQ ID NO: 4019229 - RNA, 17 nt, Human T-lymphotropic virus 2
uccucccgaaccauccu

SEQ ID NO: 4019230 - RNA, 17 nt, Human T-lymphotropic virus 2
uccucucagcccauuuc

SEQ ID NO: 4019231 - RNA, 13 nt, Human T-lymphotropic virus 2
uccugaaccucuc

SEQ ID NO: 4019232 - RNA, 15 nt, Human T-lymphotropic virus 2
uccugaacugcuccu

SEQ ID NO: 4019233 - RNA, 13 nt, Human T-lymphotropic virus 2
uccuggccaccug

SEQ ID NO: 4019234 - RNA, 20 nt, Human T-lymphotropic virus 2
ucgaaaccaaagccuuccau

SEQ ID NO: 4019235 - RNA, 21 nt, Human T-lymphotropic virus 2
ucgaacaccuucccccaccuc

SEQ ID NO: 4019236 - RNA, 18 nt, Human T-lymphotropic virus 2
ucgagcucggcugccccu

SEQ ID NO: 4019237 - RNA, 20 nt, Human T-lymphotropic virus 2
ucgcccccgauguccagccc

SEQ ID NO: 4019238 - RNA, 15 nt, Human T-lymphotropic virus 2
ucgccgucacugaaa

SEQ ID NO: 4019239 - RNA, 14 nt, Human T-lymphotropic virus 2
ucuauaccucccag

SEQ ID NO: 4019240 - RNA, 14 nt, Human T-lymphotropic virus 2
ucuauguuccaccc

SEQ ID NO: 4019241 - RNA, 18 nt, Human T-lymphotropic virus 2
ucucagcccauuucccag

SEQ ID NO: 4019242 - RNA, 14 nt, Human T-lymphotropic virus 2
ucuccaaggcccug

SEQ ID NO: 4019243 - RNA, 22 nt, Human T-lymphotropic virus 2
ucucccccaagguuccaccugc

SEQ ID NO: 4019244 - RNA, 12 nt, Human T-lymphotropic virus 2
ucucccuuccac

SEQ ID NO: 4019245 - RNA, 20 nt, Human T-lymphotropic virus 2
ucuccgggagaggucuauug

SEQ ID NO: 4019246 - RNA, 13 nt, Human T-lymphotropic virus 2
ucuccuuccccag

SEQ ID NO: 4019247 - RNA, 15 nt, Human T-lymphotropic virus 2
ucucuuacaccuccc

SEQ ID NO: 4019248 - RNA, 14 nt, Human T-lymphotropic virus 2
ucuuaacaacccca

SEQ ID NO: 4019249 - RNA, 19 nt, Human T-lymphotropic virus 2
ucuuagacacccacaacaa

SEQ ID NO: 4019250 - RNA, 13 nt, Human T-lymphotropic virus 2
ucuucccucuccc

SEQ ID NO: 4019251 - RNA, 13 nt, Human T-lymphotropic virus 2
ucuugcccuuccg

SEQ ID NO: 4019252 - RNA, 12 nt, Human T-lymphotropic virus 2
ucuuggcaggcg

SEQ ID NO: 4019253 - RNA, 15 nt, Human T-lymphotropic virus 2
ugaaccucuccggga

SEQ ID NO: 4019254 - RNA, 15 nt, Human T-lymphotropic virus 2
ugaagccucuacccc

SEQ ID NO: 4019255 - RNA, 11 nt, Human T-lymphotropic virus 2
ugaccccaccg

SEQ ID NO: 4019256 - RNA, 21 nt, Human T-lymphotropic virus 2
ugacccuugcucgcuacaaug

SEQ ID NO: 4019257 - RNA, 17 nt, Human T-lymphotropic virus 2
ugaccuaagagccacca

SEQ ID NO: 4019258 - RNA, 13 nt, Human T-lymphotropic virus 2
ugagcgccuccag

SEQ ID NO: 4019259 - RNA, 15 nt, Human T-lymphotropic virus 2
ugagcgccuccaggc

SEQ ID NO: 4019260 - RNA, 16 nt, Human T-lymphotropic virus 2
ugagcgccuccaggcc

SEQ ID NO: 4019261 - RNA, 23 nt, Human T-lymphotropic virus 2
ugcaacaacuccauuauccuccc

SEQ ID NO: 4019262 - RNA, 20 nt, Human T-lymphotropic virus 2
ugcacguggaaccucgaccu

SEQ ID NO: 4019263 - RNA, 12 nt, Human T-lymphotropic virus 2
ugcagacccucc

SEQ ID NO: 4019264 - RNA, 15 nt, Human T-lymphotropic virus 2
ugcaugcccaagacc

SEQ ID NO: 4019265 - RNA, 18 nt, Human T-lymphotropic virus 2
ugccaagcauggacaucc

SEQ ID NO: 4019266 - RNA, 17 nt, Human T-lymphotropic virus 2
ugccaagccauggccuu

SEQ ID NO: 4019267 - RNA, 20 nt, Human T-lymphotropic virus 2
ugccauuacuaccacccuca

SEQ ID NO: 4019268 - RNA, 15 nt, Human T-lymphotropic virus 2
ugcccaaccacauau

SEQ ID NO: 4019269 - RNA, 19 nt, Human T-lymphotropic virus 2
ugcccgcuccuccauccca

SEQ ID NO: 4019270 - RNA, 23 nt, Human T-lymphotropic virus 2
ugcccuccuggccaccuguccag

SEQ ID NO: 4019271 - RNA, 23 nt, Human T-lymphotropic virus 2
ugccuggaaccaacccucgggga

SEQ ID NO: 4019272 - RNA, 20 nt, Human T-lymphotropic virus 2
ugccuuucuucccucucccg

SEQ ID NO: 4019273 - RNA, 19 nt, Human T-lymphotropic virus 2
ggcucugacgucucccccu

SEQ ID NO: 4019274 - RNA, 18 nt, Human T-lymphotropic virus 2
ggcuuaacuuucuccagg

SEQ ID NO: 4019275 - RNA, 12 nt, Human T-lymphotropic virus 2
ggggccaacaua

SEQ ID NO: 4019276 - RNA, 19 nt, Human T-lymphotropic virus 2
gguaucuccuccuaccacu

SEQ ID NO: 4019277 - RNA, 18 nt, Human T-lymphotropic virus 2
gguccuuaccccucccac

SEQ ID NO: 4019278 - RNA, 22 nt, Human T-lymphotropic virus 2
ggucuaauauggaccuucaaug

SEQ ID NO: 4019279 - RNA, 15 nt, Human T-lymphotropic virus 2
ggucuuuagagacac

SEQ ID NO: 4019280 - RNA, 22 nt, Human T-lymphotropic virus 2
gguguacaggacuucuccccua

SEQ ID NO: 4019281 - RNA, 13 nt, Human T-lymphotropic virus 2
guaaaggcucuga

SEQ ID NO: 4019282 - RNA, 14 nt, Human T-lymphotropic virus 2
guaagucuccucuc

SEQ ID NO: 4019283 - RNA, 18 nt, Human T-lymphotropic virus 2
guacaggacuucuccccu

SEQ ID NO: 4019284 - RNA, 17 nt, Human T-lymphotropic virus 2
guacuacucgccuuccu

SEQ ID NO: 4019285 - RNA, 18 nt, Human T-lymphotropic virus 2
guagucgcuccccgaggg

SEQ ID NO: 4019286 - RNA, 16 nt, Human T-lymphotropic virus 2
guaucuccuccuacca

SEQ ID NO: 4019287 - RNA, 15 nt, Human T-lymphotropic virus 2
gucagcucuccucuc

SEQ ID NO: 4019288 - RNA, 14 nt, Human T-lymphotropic virus 2
gucccgucucaggu

SEQ ID NO: 4019289 - RNA, 16 nt, Human T-lymphotropic virus 2
gucccuccccccuagg

SEQ ID NO: 4019290 - RNA, 21 nt, Human T-lymphotropic virus 2
guccucaaccccaugaggaaa

SEQ ID NO: 4019291 - RNA, 16 nt, Human T-lymphotropic virus 2
guccuccacuaccacc

SEQ ID NO: 4019292 - RNA, 14 nt, Human T-lymphotropic virus 2
gucgcuccccgagg

SEQ ID NO: 4019293 - RNA, 22 nt, Human T-lymphotropic virus 2
gucggcauccucauucaccaca

SEQ ID NO: 4019294 - RNA, 21 nt, Human T-lymphotropic virus 2
gucuauugcuauaggcaggcc

SEQ ID NO: 4019295 - RNA, 20 nt, Human T-lymphotropic virus 2
gucugcacguggaaccucga

SEQ ID NO: 4019296 - RNA, 21 nt, Human T-lymphotropic virus 2
gucuucccggggaagacaaac

SEQ ID NO: 4019297 - RNA, 13 nt, Human T-lymphotropic virus 2
gugagggcucccu

SEQ ID NO: 4019298 - RNA, 12 nt, Human T-lymphotropic virus 2
guggcucgcucc

SEQ ID NO: 4019299 - RNA, 16 nt, Human T-lymphotropic virus 2
gugggaccgucucccg

SEQ ID NO: 4019300 - RNA, 19 nt, Human T-lymphotropic virus 2
guguacaggacuucucccc

SEQ ID NO: 4019301 - RNA, 14 nt, Human T-lymphotropic virus 2
guucaguccucccu

SEQ ID NO: 4019302 - RNA, 14 nt, Human T-lymphotropic virus 2
guucaucaccucag

SEQ ID NO: 4019303 - RNA, 13 nt, Human T-lymphotropic virus 2
guucuuuccucuu

SEQ ID NO: 4019304 - RNA, 22 nt, Human T-lymphotropic virus 2
uaaaccugagcgccuccaggcc

SEQ ID NO: 4019305 - RNA, 13 nt, Human T-lymphotropic virus 2
uaacagcccccuu

SEQ ID NO: 4019306 - RNA, 18 nt, Human T-lymphotropic virus 2
uaauaaccccgcccagca

SEQ ID NO: 4019307 - RNA, 16 nt, Human T-lymphotropic virus 2
uacaacaacucuccca

SEQ ID NO: 4019308 - RNA, 17 nt, Human T-lymphotropic virus 2
uacaagaucuccuccag

SEQ ID NO: 4019309 - RNA, 18 nt, Human T-lymphotropic virus 2
uacaagaucuccuccagu

SEQ ID NO: 4019310 - RNA, 17 nt, Human T-lymphotropic virus 2
uacaccaacaucccugu

SEQ ID NO: 4019311 - RNA, 16 nt, Human T-lymphotropic virus 2
uacacccccaacaucu

SEQ ID NO: 4019312 - RNA, 13 nt, Human T-lymphotropic virus 2
uaccacccucacc

SEQ ID NO: 4019313 - RNA, 16 nt, Human T-lymphotropic virus 2
uaccacuccagccccu

SEQ ID NO: 4019314 - RNA, 18 nt, Human T-lymphotropic virus 2
uaccacuccagccccugu

SEQ ID NO: 4019315 - RNA, 23 nt, Human T-lymphotropic virus 2
uaccauugacccauccacagucc

SEQ ID NO: 4019316 - RNA, 21 nt, Human T-lymphotropic virus 2
uaccccucccaccacuccugu

SEQ ID NO: 4019317 - RNA, 18 nt, Human T-lymphotropic virus 2
uaccgacagccuuacccc

SEQ ID NO: 4019318 - RNA, 11 nt, Human T-lymphotropic virus 2
uaccucccaga

SEQ ID NO: 4019319 - RNA, 13 nt, Human T-lymphotropic virus 2
uacuaccacccuc

SEQ ID NO: 4019320 - RNA, 15 nt, Human T-lymphotropic virus 2
uacuccuccuuccau

SEQ ID NO: 4019321 - RNA, 23 nt, Human T-lymphotropic virus 2
uacucucucaucagcuuauacaa

SEQ ID NO: 4019322 - RNA, 18 nt, Human T-lymphotropic virus 2
uacugaggaaaaaaacuc

SEQ ID NO: 4019323 - RNA, 23 nt, Human T-lymphotropic virus 2
uagaccucacccuuacccacuuc

SEQ ID NO: 4019324 - RNA, 13 nt, Human T-lymphotropic virus 2
uaggaacugaaac

SEQ ID NO: 4019325 - RNA, 14 nt, Human T-lymphotropic virus 2
uaggaacugaaacc

SEQ ID NO: 4019326 - RNA, 13 nt, Human T-lymphotropic virus 2
uaggcaggcccgc

SEQ ID NO: 4019327 - RNA, 13 nt, Human T-lymphotropic virus 2
uagggcuuccuga

SEQ ID NO: 4019328 - RNA, 18 nt, Human T-lymphotropic virus 2
uauacaauacuccuccuu

SEQ ID NO: 4019329 - RNA, 14 nt, Human T-lymphotropic virus 2
uaucaacccaccac

SEQ ID NO: 4019330 - RNA, 19 nt, Human T-lymphotropic virus 2
uaucagcgccguucuucag

SEQ ID NO: 4019331 - RNA, 23 nt, Human T-lymphotropic virus 2
uaugcauggacuguccuuccaca

SEQ ID NO: 4019332 - RNA, 17 nt, Human T-lymphotropic virus 2
uauggccagcucugcca

SEQ ID NO: 4019333 - RNA, 17 nt, Human T-lymphotropic virus 2
uauguuccacccgccua

SEQ ID NO: 4019334 - RNA, 16 nt, Human T-lymphotropic virus 2
uauucagucucacaca

SEQ ID NO: 4019335 - RNA, 16 nt, Human T-lymphotropic virus 2
ucaaacccccucagga

SEQ ID NO: 4019336 - RNA, 23 nt, Human T-lymphotropic virus 2
ucaaacuccuccaaaccccccua

SEQ ID NO: 4019337 - RNA, 14 nt, Human T-lymphotropic virus 2
ucacaaaacccauc

SEQ ID NO: 4019338 - RNA, 16 nt, Human T-lymphotropic virus 2
ucaccauuccccagcc

SEQ ID NO: 4019339 - RNA, 18 nt, Human T-lymphotropic virus 2
ucaccauuccccagccau

SEQ ID NO: 4019340 - RNA, 22 nt, Human T-lymphotropic virus 2
ucaccuuggggauccauccucu

SEQ ID NO: 4019341 - RNA, 17 nt, Human T-lymphotropic virus 2
ucacggagacucaccuu

SEQ ID NO: 4019342 - RNA, 14 nt, Human T-lymphotropic virus 2
ucacuccccugccc

SEQ ID NO: 4019343 - RNA, 17 nt, Human T-lymphotropic virus 2
ucagcucauaggcccug

SEQ ID NO: 4019344 - RNA, 21 nt, Human T-lymphotropic virus 2
ucaggccauuucccuccuagg

SEQ ID NO: 4019345 - RNA, 22 nt, Human T-lymphotropic virus 2
ucaggcguggacacccaaggac

SEQ ID NO: 4019346 - RNA, 11 nt, Human T-lymphotropic virus 2
ucagucucaca

SEQ ID NO: 4019347 - RNA, 22 nt, Human T-lymphotropic virus 2
ucauccaagugucggcauccuc

SEQ ID NO: 4019348 - RNA, 21 nt, Human T-lymphotropic virus 2
uccaagugucggcauccucau

SEQ ID NO: 4019349 - RNA, 19 nt, Human T-lymphotropic virus 2
uccacaccccccacccucc

SEQ ID NO: 4019350 - RNA, 14 nt, Human T-lymphotropic virus 2
uccacauuaacaca

SEQ ID NO: 4019351 - RNA, 19 nt, Human T-lymphotropic virus 2
uccacgacacccugauccu

SEQ ID NO: 4019352 - RNA, 17 nt, Human T-lymphotropic virus 2
uccacuaccacccauuc

SEQ ID NO: 4019353 - RNA, 14 nt, Human T-lymphotropic virus 2
uccacuagcccagc

SEQ ID NO: 4019354 - RNA, 15 nt, Human T-lymphotropic virus 2
uccaguaaaagccuu

SEQ ID NO: 4019355 - RNA, 14 nt, Human T-lymphotropic virus 2
ucccaacccuucuc

SEQ ID NO: 4019356 - RNA, 18 nt, Human T-lymphotropic virus 2
ucccacucaucccccugc

SEQ ID NO: 4019357 - RNA, 18 nt, Human T-lymphotropic virus 2
ucccagacgaccccagcc

SEQ ID NO: 4019358 - RNA, 17 nt, Human T-lymphotropic virus 2
ucccauaggaccuucuu

SEQ ID NO: 4019359 - RNA, 18 nt, Human T-lymphotropic virus 2
uccccaacaaaccuccuc

SEQ ID NO: 4019360 - RNA, 20 nt, Human T-lymphotropic virus 2
uccccaagcaguaccagcca

SEQ ID NO: 4019361 - RNA, 12 nt, Human T-lymphotropic virus 2
uccccagccaug

SEQ ID NO: 4019362 - RNA, 21 nt, Human T-lymphotropic virus 2
uccccagggccccccgaucuc

SEQ ID NO: 4019363 - RNA, 20 nt, Human T-lymphotropic virus 2
ucccccauugguccaugacu

SEQ ID NO: 4019364 - RNA, 21 nt, Human T-lymphotropic virus 2
uccccgaaccuggccuccguc

SEQ ID NO: 4019365 - RNA, 14 nt, Human T-lymphotropic virus 2
uccccggaggccca

SEQ ID NO: 4019366 - RNA, 17 nt, Human T-lymphotropic virus 2
uccccuagguucguccc

SEQ ID NO: 4019367 - RNA, 12 nt, Human T-lymphotropic virus 2
uccccucaucca

SEQ ID NO: 4019368 - RNA, 13 nt, Human T-lymphotropic virus 2
ucccgcugcuccu

SEQ ID NO: 4019369 - RNA, 18 nt, Human T-lymphotropic virus 2
ucccggccucggcaccuc

SEQ ID NO: 4019370 - RNA, 13 nt, Human T-lymphotropic virus 2
ucccggggccaac

SEQ ID NO: 4019371 - RNA, 19 nt, Human T-lymphotropic virus 2
ucccucaccgacccucugg

SEQ ID NO: 4019372 - RNA, 24 nt, Human T-lymphotropic virus 2
ucccucgccauuggggccuuccuc

SEQ ID NO: 4019373 - RNA, 15 nt, Human T-lymphotropic virus 2
ucccucgccuccccu

SEQ ID NO: 4019374 - RNA, 22 nt, Human T-lymphotropic virus 2
ucccucucccggcgcuuuugau

SEQ ID NO: 4019375 - RNA, 18 nt, Human T-lymphotropic virus 2
ucccuuaucuuagcuccc

SEQ ID NO: 4019376 - RNA, 17 nt, Human T-lymphotropic virus 2
acaccucagccuaccca

SEQ ID NO: 4019377 - RNA, 16 nt, Human T-lymphotropic virus 2
acaccuucccccaccu

SEQ ID NO: 4019378 - RNA, 14 nt, Human T-lymphotropic virus 2
acagcccugcuuuc

SEQ ID NO: 4019379 - RNA, 14 nt, Human T-lymphotropic virus 2
acagcucuccagaa

SEQ ID NO: 4019380 - RNA, 16 nt, Human T-lymphotropic virus 2
acaggacaucacuccc

SEQ ID NO: 4019381 - RNA, 20 nt, Human T-lymphotropic virus 2
acaggccaucaagcaggagg

SEQ ID NO: 4019382 - RNA, 20 nt, Human T-lymphotropic virus 2
acauacuuuuagccagcccc

SEQ ID NO: 4019383 - RNA, 21 nt, Human T-lymphotropic virus 2
acaucacuccccugcccucuc

SEQ ID NO: 4019384 - RNA, 14 nt, Human T-lymphotropic virus 2
acaucuacaccacc

SEQ ID NO: 4019385 - RNA, 16 nt, Human T-lymphotropic virus 2
acaucuccauucccca

SEQ ID NO: 4019386 - RNA, 13 nt, Human T-lymphotropic virus 2
acauuuuccacua

SEQ ID NO: 4019387 - RNA, 18 nt, Human T-lymphotropic virus 2
accacccucaccucuccu

SEQ ID NO: 4019388 - RNA, 19 nt, Human T-lymphotropic virus 2
accacgcauggccuuccaa

SEQ ID NO: 4019389 - RNA, 22 nt, Human T-lymphotropic virus 2
accacggcccugacgucccucc

SEQ ID NO: 4019390 - RNA, 19 nt, Human T-lymphotropic virus 2
accauacucaggaccaggc

SEQ ID NO: 4019391 - RNA, 20 nt, Human T-lymphotropic virus 2
accauguccgcagccacacc

SEQ ID NO: 4019392 - RNA, 14 nt, Human T-lymphotropic virus 2
acccacucagccuc

SEQ ID NO: 4019393 - RNA, 15 nt, Human T-lymphotropic virus 2
acccaguucaaacuc

SEQ ID NO: 4019394 - RNA, 23 nt, Human T-lymphotropic virus 2
acccauauaccauacaaccccac

SEQ ID NO: 4019395 - RNA, 17 nt, Human T-lymphotropic virus 2
acccaucaaaacccagg

SEQ ID NO: 4019396 - RNA, 18 nt, Human T-lymphotropic virus 2
accccagcccccaccaau

SEQ ID NO: 4019397 - RNA, 17 nt, Human T-lymphotropic virus 2
acccccaacaucuccau

SEQ ID NO: 4019398 - RNA, 16 nt, Human T-lymphotropic virus 2
accccccacccuccga

SEQ ID NO: 4019399 - RNA, 20 nt, Human T-lymphotropic virus 2
acccccuccacguccuggac

SEQ ID NO: 4019400 - RNA, 21 nt, Human T-lymphotropic virus 2
accccucccaaaccaccuccc

SEQ ID NO: 4019401 - RNA, 18 nt, Human T-lymphotropic virus 2
accccucccaccacuccu

SEQ ID NO: 4019402 - RNA, 16 nt, Human T-lymphotropic virus 2
acccgugaccccucuu

SEQ ID NO: 4019403 - RNA, 19 nt, Human T-lymphotropic virus 2
acccgugagggcucccugu

SEQ ID NO: 4019404 - RNA, 19 nt, Human T-lymphotropic virus 2
acccucaagguccuuaccc

SEQ ID NO: 4019405 - RNA, 15 nt, Human T-lymphotropic virus 2
acccucaccucuccu

SEQ ID NO: 4019406 - RNA, 17 nt, Human T-lymphotropic virus 2
acccuuacccacuuccc

SEQ ID NO: 4019407 - RNA, 19 nt, Human T-lymphotropic virus 2
accuaagagccaccaaugc

SEQ ID NO: 4019408 - RNA, 14 nt, Human T-lymphotropic virus 2
accuacaaucccua

SEQ ID NO: 4019409 - RNA, 17 nt, Human T-lymphotropic virus 2
accuacauucccucgcc

SEQ ID NO: 4019410 - RNA, 23 nt, Human T-lymphotropic virus 2
accuacccaccacaauguuccaa

SEQ ID NO: 4019411 - RNA, 17 nt, Human T-lymphotropic virus 2
accucaacgccgcccuc

SEQ ID NO: 4019412 - RNA, 20 nt, Human T-lymphotropic virus 2
accucgaccuuaauucccua

SEQ ID NO: 4019413 - RNA, 17 nt, Human T-lymphotropic virus 2
accuuaucccucgccuc

SEQ ID NO: 4019414 - RNA, 22 nt, Human T-lymphotropic virus 2
accuucccccaccuccccaagu

SEQ ID NO: 4019415 - RNA, 19 nt, Human T-lymphotropic virus 2
acgauuacccccugcccau

SEQ ID NO: 4019416 - RNA, 13 nt, Human T-lymphotropic virus 2
acgccccaaggcc

SEQ ID NO: 4019417 - RNA, 19 nt, Human T-lymphotropic virus 2
acgccgcaacagaccacca

SEQ ID NO: 4019418 - RNA, 13 nt, Human T-lymphotropic virus 2
acggagacucacc

SEQ ID NO: 4019419 - RNA, 12 nt, Human T-lymphotropic virus 2
acgucccucccc

SEQ ID NO: 4019420 - RNA, 17 nt, Human T-lymphotropic virus 2
acguggaacccaccacc

SEQ ID NO: 4019421 - RNA, 17 nt, Human T-lymphotropic virus 2
acuacacccccccugcc

SEQ ID NO: 4019422 - RNA, 13 nt, Human T-lymphotropic virus 2
acuacugaggaaa

SEQ ID NO: 4019423 - RNA, 22 nt, Human T-lymphotropic virus 2
acucagccuccaccaacuucuc

SEQ ID NO: 4019424 - RNA, 18 nt, Human T-lymphotropic virus 2
acuccaauacccaaagcc

SEQ ID NO: 4019425 - RNA, 22 nt, Human T-lymphotropic virus 2
acuccaauacccaaagccccca

SEQ ID NO: 4019426 - RNA, 22 nt, Human T-lymphotropic virus 2
acuccaucuuaacaaccccagg

SEQ ID NO: 4019427 - RNA, 11 nt, Human T-lymphotropic virus 2
acuccccggcc

SEQ ID NO: 4019428 - RNA, 13 nt, Human T-lymphotropic virus 2
acuccugucuccc

SEQ ID NO: 4019429 - RNA, 15 nt, Human T-lymphotropic virus 2
acucgccuuccuaca

SEQ ID NO: 4019430 - RNA, 19 nt, Human T-lymphotropic virus 2
acucgcuuuuagcuagccu

SEQ ID NO: 4019431 - RNA, 21 nt, Human T-lymphotropic virus 2
acucuacacccccaacaucuc

SEQ ID NO: 4019432 - RNA, 18 nt, Human T-lymphotropic virus 2
acucucuuacaccuccca

SEQ ID NO: 4019433 - RNA, 13 nt, Human T-lymphotropic virus 2
acucugccuuaaa

SEQ ID NO: 4019434 - RNA, 15 nt, Human T-lymphotropic virus 2
acugaaaccacggcc

SEQ ID NO: 4019435 - RNA, 21 nt, Human T-lymphotropic virus 2
acugaccacgcauggccuucc

SEQ ID NO: 4019436 - RNA, 23 nt, Human T-lymphotropic virus 2
acugaccacgcauggccuuccaa

SEQ ID NO: 4019437 - RNA, 16 nt, Human T-lymphotropic virus 2
acugcagggcaagacc

SEQ ID NO: 4019438 - RNA, 13 nt, Human T-lymphotropic virus 2
acugcuccuccca

SEQ ID NO: 4019439 - RNA, 14 nt, Human T-lymphotropic virus 2
acugcuccucccaa

SEQ ID NO: 4019440 - RNA, 22 nt, Human T-lymphotropic virus 2
acugcugaugccuuucuucccu

SEQ ID NO: 4019441 - RNA, 16 nt, Human T-lymphotropic virus 2
acuguacccagccacg

SEQ ID NO: 4019442 - RNA, 19 nt, Human T-lymphotropic virus 2
acuguccuaaccuuccccu

SEQ ID NO: 4019443 - RNA, 13 nt, Human T-lymphotropic virus 2
acuuccagcagcu

SEQ ID NO: 4019444 - RNA, 19 nt, Human T-lymphotropic virus 2
acuuccugaggaacucccc

SEQ ID NO: 4019445 - RNA, 22 nt, Human T-lymphotropic virus 2
acuucgccuucaccauucccca

SEQ ID NO: 4019446 - RNA, 21 nt, Human T-lymphotropic virus 2
acuucuccccuaucacuccau

SEQ ID NO: 4019447 - RNA, 14 nt, Human T-lymphotropic virus 2
agaagcccuccaga

SEQ ID NO: 4019448 - RNA, 16 nt, Human T-lymphotropic virus 2
agacaauuaggagccu

SEQ ID NO: 4019449 - RNA, 23 nt, Human T-lymphotropic virus 2
agacaauuaggagccuuccucac

SEQ ID NO: 4019450 - RNA, 16 nt, Human T-lymphotropic virus 2
agaccaucuaccucca

SEQ ID NO: 4019451 - RNA, 22 nt, Human T-lymphotropic virus 2
agacgccgccgugccguuccaa

SEQ ID NO: 4019452 - RNA, 15 nt, Human T-lymphotropic virus 2
agacuauccuucaac

SEQ ID NO: 4019453 - RNA, 14 nt, Human T-lymphotropic virus 2
agacucgccucucc

SEQ ID NO: 4019454 - RNA, 22 nt, Human T-lymphotropic virus 2
agcaagggcuagggcuuccuga

SEQ ID NO: 4019455 - RNA, 15 nt, Human T-lymphotropic virus 2
agcaccaacucaccu

SEQ ID NO: 4019456 - RNA, 17 nt, Human T-lymphotropic virus 2
agcagcuuaacacacua

SEQ ID NO: 4019457 - RNA, 13 nt, Human T-lymphotropic virus 2
agcauucuaccca

SEQ ID NO: 4019458 - RNA, 13 nt, Human T-lymphotropic virus 2
agccaccaaugcc

SEQ ID NO: 4019459 - RNA, 17 nt, Human T-lymphotropic virus 2
agccacgccccccuccu

SEQ ID NO: 4019460 - RNA, 17 nt, Human T-lymphotropic virus 2
agcccauuucccaggau

SEQ ID NO: 4019461 - RNA, 16 nt, Human T-lymphotropic virus 2
agccuaggcccuccga

SEQ ID NO: 4019462 - RNA, 20 nt, Human T-lymphotropic virus 2
agccucccgagccagccacc

SEQ ID NO: 4019463 - RNA, 15 nt, Human T-lymphotropic virus 2
agcgcagcaagggcu

SEQ ID NO: 4019464 - RNA, 22 nt, Human T-lymphotropic virus 2
agcgcccccgccgccccaguuc

SEQ ID NO: 4019465 - RNA, 14 nt, Human T-lymphotropic virus 2
agcgccuccaggcc

SEQ ID NO: 4019466 - RNA, 23 nt, Human T-lymphotropic virus 2
agcgcugaaaaacaaggcucuga

SEQ ID NO: 4019467 - RNA, 17 nt, Human T-lymphotropic virus 2
agcuaacccuccaggca

SEQ ID NO: 4019468 - RNA, 17 nt, Human T-lymphotropic virus 2
aggaacuccccucaucc

SEQ ID NO: 4019469 - RNA, 19 nt, Human T-lymphotropic virus 2
aggaaggggaaccccuccu

SEQ ID NO: 4019470 - RNA, 19 nt, Human T-lymphotropic virus 2
aggaguuuuguaccuccua

SEQ ID NO: 4019471 - RNA, 15 nt, Human T-lymphotropic virus 2
aggcaggcccgcccu

SEQ ID NO: 4019472 - RNA, 15 nt, Human T-lymphotropic virus 2
ucgaacaccuucccc

SEQ ID NO: 4019473 - RNA, 20 nt, Human T-lymphotropic virus 2
ucgagcucggcugccccuua

SEQ ID NO: 4019474 - RNA, 19 nt, Human T-lymphotropic virus 2
ucgcucccguaccuccucc

SEQ ID NO: 4019475 - RNA, 16 nt, Human T-lymphotropic virus 2
ucuacaacauaacugc

SEQ ID NO: 4019476 - RNA, 21 nt, Human T-lymphotropic virus 2
ucucacauuaugggacaaauc

SEQ ID NO: 4019477 - RNA, 13 nt, Human T-lymphotropic virus 2
ucuccacccugcc

SEQ ID NO: 4019478 - RNA, 22 nt, Human T-lymphotropic virus 2
ucuccaggaaccacgacuccuc

SEQ ID NO: 4019479 - RNA, 19 nt, Human T-lymphotropic virus 2
ucucccaccuuacccaggc

SEQ ID NO: 4019480 - RNA, 20 nt, Human T-lymphotropic virus 2
ucucccagcuaacccuccag

SEQ ID NO: 4019481 - RNA, 14 nt, Human T-lymphotropic virus 2
ucuccccccauccc

SEQ ID NO: 4019482 - RNA, 16 nt, Human T-lymphotropic virus 2
ucucccgcugcuccuc

SEQ ID NO: 4019483 - RNA, 21 nt, Human T-lymphotropic virus 2
ucucccgcugcuccuccgcca

SEQ ID NO: 4019484 - RNA, 22 nt, Human T-lymphotropic virus 2
ucucccggcgcuuuugauccuu

SEQ ID NO: 4019485 - RNA, 14 nt, Human T-lymphotropic virus 2
ucuccucucagccc

SEQ ID NO: 4019486 - RNA, 16 nt, Human T-lymphotropic virus 2
ucuccuuccccagggc

SEQ ID NO: 4019487 - RNA, 16 nt, Human T-lymphotropic virus 2
ucuccuuggccucauc

SEQ ID NO: 4019488 - RNA, 15 nt, Human T-lymphotropic virus 2
ucucgcaccugcucg

SEQ ID NO: 4019489 - RNA, 21 nt, Human T-lymphotropic virus 2
ucucuaagugcggcuccucca

SEQ ID NO: 4019490 - RNA, 12 nt, Human T-lymphotropic virus 2
ucuuuccaccac

SEQ ID NO: 4019491 - RNA, 14 nt, Human T-lymphotropic virus 2
ucuuuccuucccuu

SEQ ID NO: 4019492 - RNA, 21 nt, Human T-lymphotropic virus 2
ugaacauguccuaacccccuc

SEQ ID NO: 4019493 - RNA, 19 nt, Human T-lymphotropic virus 2
ugaagccucuaccccuccc

SEQ ID NO: 4019494 - RNA, 13 nt, Human T-lymphotropic virus 2
ugaauuccuccau

SEQ ID NO: 4019495 - RNA, 19 nt, Human T-lymphotropic virus 2
ugaauuccuccauucucac

SEQ ID NO: 4019496 - RNA, 16 nt, Human T-lymphotropic virus 2
ugacaaagacaucucc

SEQ ID NO: 4019497 - RNA, 17 nt, Human T-lymphotropic virus 2
ugacaacggccuccccg

SEQ ID NO: 4019498 - RNA, 14 nt, Human T-lymphotropic virus 2
ugacacggcccccu

SEQ ID NO: 4019499 - RNA, 20 nt, Human T-lymphotropic virus 2
ugaccacgcauggccuucca

SEQ ID NO: 4019500 - RNA, 16 nt, Human T-lymphotropic virus 2
ugacccauccacaguc

SEQ ID NO: 4019501 - RNA, 17 nt, Human T-lymphotropic virus 2
ugacccauccacagucc

SEQ ID NO: 4019502 - RNA, 18 nt, Human T-lymphotropic virus 2
ugacccauccacaguccu

SEQ ID NO: 4019503 - RNA, 13 nt, Human T-lymphotropic virus 2
ugaccccucuugg

SEQ ID NO: 4019504 - RNA, 15 nt, Human T-lymphotropic virus 2
ugaccuuacagagca

SEQ ID NO: 4019505 - RNA, 17 nt, Human T-lymphotropic virus 2
ugagacgccuuccgugg

SEQ ID NO: 4019506 - RNA, 15 nt, Human T-lymphotropic virus 2
ugagggcucccugua

SEQ ID NO: 4019507 - RNA, 14 nt, Human T-lymphotropic virus 2
ugcaaucccuccag

SEQ ID NO: 4019508 - RNA, 14 nt, Human T-lymphotropic virus 2
ugcagacccuccgg

SEQ ID NO: 4019509 - RNA, 21 nt, Human T-lymphotropic virus 2
ugccauuacuaccacccucac

SEQ ID NO: 4019510 - RNA, 22 nt, Human T-lymphotropic virus 2
ugccauucaacaagcucuacaa

SEQ ID NO: 4019511 - RNA, 22 nt, Human T-lymphotropic virus 2
ugcccacaacucaaacccccuc

SEQ ID NO: 4019512 - RNA, 23 nt, Human T-lymphotropic virus 2
ugccccuacuugggcugccaagc

SEQ ID NO: 4019513 - RNA, 19 nt, Human T-lymphotropic virus 2
ugcccuccuggccaccugu

SEQ ID NO: 4019514 - RNA, 18 nt, Human T-lymphotropic virus 2
ugccugguguacaggacu

SEQ ID NO: 4019515 - RNA, 20 nt, Human T-lymphotropic virus 2
ugcgccgcucccgcuccuca

SEQ ID NO: 4019516 - RNA, 15 nt, Human T-lymphotropic virus 2
ugcggcuccuccaug

SEQ ID NO: 4019517 - RNA, 18 nt, Human T-lymphotropic virus 2
ugcucuuggcagccccca

SEQ ID NO: 4019518 - RNA, 18 nt, Human T-lymphotropic virus 2
ugcugccaagccauggcc

SEQ ID NO: 4019519 - RNA, 18 nt, Human T-lymphotropic virus 2
ugcuuucuccacccugcc

SEQ ID NO: 4019520 - RNA, 19 nt, Human T-lymphotropic virus 2
ugcuuucuccacccugcca

SEQ ID NO: 4019521 - RNA, 16 nt, Human T-lymphotropic virus 2
uggacagagccuccua

SEQ ID NO: 4019522 - RNA, 16 nt, Human T-lymphotropic virus 2
uggacuguccuuccac

SEQ ID NO: 4019523 - RNA, 14 nt, Human T-lymphotropic virus 2
uggauaugauccuu

SEQ ID NO: 4019524 - RNA, 15 nt, Human T-lymphotropic virus 2
uggaucucccuucca

SEQ ID NO: 4019525 - RNA, 16 nt, Human T-lymphotropic virus 2
uggcagcccccaguuc

SEQ ID NO: 4019526 - RNA, 18 nt, Human T-lymphotropic virus 2
uggccccuguauccuccg

SEQ ID NO: 4019527 - RNA, 22 nt, Human T-lymphotropic virus 2
uggcccuugacaacggccuccc

SEQ ID NO: 4019528 - RNA, 22 nt, Human T-lymphotropic virus 2
ugggcaaaccaacacccaguuc

SEQ ID NO: 4019529 - RNA, 14 nt, Human T-lymphotropic virus 2
ugguguacaggacu

SEQ ID NO: 4019530 - RNA, 13 nt, Human T-lymphotropic virus 2
uguaucacccuca

SEQ ID NO: 4019531 - RNA, 21 nt, Human T-lymphotropic virus 2
ugucagacucgccucucccug

SEQ ID NO: 4019532 - RNA, 16 nt, Human T-lymphotropic virus 2
ugucagcucuccucuc

SEQ ID NO: 4019533 - RNA, 16 nt, Human T-lymphotropic virus 2
uuaaacuucacuuccg

SEQ ID NO: 4019534 - RNA, 13 nt, Human T-lymphotropic virus 2
uuacccacuuccc

SEQ ID NO: 4019535 - RNA, 14 nt, Human T-lymphotropic virus 2
uuacccccugccca

SEQ ID NO: 4019536 - RNA, 12 nt, Human T-lymphotropic virus 2
uuagacacccac

SEQ ID NO: 4019537 - RNA, 15 nt, Human T-lymphotropic virus 2
uuagccagccccacc

SEQ ID NO: 4019538 - RNA, 19 nt, Human T-lymphotropic virus 2
uuaucccucgccuccccuc

SEQ ID NO: 4019539 - RNA, 15 nt, Human T-lymphotropic virus 2
uucaaacuccuccaa

SEQ ID NO: 4019540 - RNA, 12 nt, Human T-lymphotropic virus 2
uucacccaggaa

SEQ ID NO: 4019541 - RNA, 15 nt, Human T-lymphotropic virus 2
uucccucgcucccgu

SEQ ID NO: 4019542 - RNA, 19 nt, Human T-lymphotropic virus 2
uuccuacaaugacccuugc

SEQ ID NO: 4019543 - RNA, 19 nt, Human T-lymphotropic virus 2
uuccugaggaacuccccuc

SEQ ID NO: 4019544 - RNA, 15 nt, Human T-lymphotropic virus 2
uucgaaaccaaagcc

SEQ ID NO: 4019545 - RNA, 16 nt, Human T-lymphotropic virus 2
uugccaccccuacugc

SEQ ID NO: 4019546 - RNA, 23 nt, Human T-lymphotropic virus 2
uuggcuccacaccccccacccuc

SEQ ID NO: 4019547 - RNA, 18 nt, Human T-lymphotropic virus 2
uuguaucacccucacccc

SEQ ID NO: 4019548 - RNA, 13 nt, Human T-lymphotropic virus 2
uuguguacaggcc

SEQ ID NO: 4019549 - RNA, 22 nt, Human T-lymphotropic virus 2
uuucccacaucgaccauugucc

SEQ ID NO: 4019550 - RNA, 13 nt, Human T-lymphotropic virus 2
uuuccuucccuug

SEQ ID NO: 4019551 - RNA, 13 nt, Human T-lymphotropic virus 2
uuucuccacccug

SEQ ID NO: 4019552 - RNA, 22 nt, Human T-lymphotropic virus 2
uuugcguggauagauccagccu

SEQ ID NO: 4019553 - RNA, 21 nt, Human T-lymphotropic virus 2
cccccagggggcuaucaaccc

SEQ ID NO: 4019554 - RNA, 12 nt, Human T-lymphotropic virus 2
cccccuccccaa

SEQ ID NO: 4019555 - RNA, 19 nt, Human T-lymphotropic virus 2
cccccuuuuucccucgcuc

SEQ ID NO: 4019556 - RNA, 17 nt, Human T-lymphotropic virus 2
ccccuagcgcccccgcc

SEQ ID NO: 4019557 - RNA, 17 nt, Human T-lymphotropic virus 2
ccccugacgccccaagg

SEQ ID NO: 4019558 - RNA, 21 nt, Human T-lymphotropic virus 2
cccgauguccagcccuaacuc

SEQ ID NO: 4019559 - RNA, 13 nt, Human T-lymphotropic virus 2
cccgcugcuccuc

SEQ ID NO: 4019560 - RNA, 21 nt, Human T-lymphotropic virus 2
cccgggccgguaaagcuccac

SEQ ID NO: 4019561 - RNA, 17 nt, Human T-lymphotropic virus 2
cccgugaccccucuugg

SEQ ID NO: 4019562 - RNA, 17 nt, Human T-lymphotropic virus 2
cccguuauccuuuccuc

SEQ ID NO: 4019563 - RNA, 16 nt, Human T-lymphotropic virus 2
cccuaucuuacauccc

SEQ ID NO: 4019564 - RNA, 22 nt, Human T-lymphotropic virus 2
cccucaagguccuuaccccucc

SEQ ID NO: 4019565 - RNA, 17 nt, Human T-lymphotropic virus 2
cccucaccucuccuucc

SEQ ID NO: 4019566 - RNA, 20 nt, Human T-lymphotropic virus 2
cccuccuaguagaugccccu

SEQ ID NO: 4019567 - RNA, 16 nt, Human T-lymphotropic virus 2
cccucgccuccccucc

SEQ ID NO: 4019568 - RNA, 19 nt, Human T-lymphotropic virus 2
cccucgccuccccuccuuc

SEQ ID NO: 4019569 - RNA, 20 nt, Human T-lymphotropic virus 2
cccucucacgaaacacauuc

SEQ ID NO: 4019570 - RNA, 10 nt, Human T-lymphotropic virus 2
cccucucccg

SEQ ID NO: 4019571 - RNA, 19 nt, Human T-lymphotropic virus 2
cccugcccgcuccuccauc

SEQ ID NO: 4019572 - RNA, 14 nt, Human T-lymphotropic virus 2
cccugcccucucac

SEQ ID NO: 4019573 - RNA, 20 nt, Human T-lymphotropic virus 2
cccuggcuuggcuccacacc

SEQ ID NO: 4019574 - RNA, 23 nt, Human T-lymphotropic virus 2
cccuugcucgcuacaaugccccu

SEQ ID NO: 4019575 - RNA, 17 nt, Human T-lymphotropic virus 2
cccuuuuucccucgcuc

SEQ ID NO: 4019576 - RNA, 19 nt, Human T-lymphotropic virus 2
ccgagccagccacccaggg

SEQ ID NO: 4019577 - RNA, 15 nt, Human T-lymphotropic virus 2
ccgaugcacacucac

SEQ ID NO: 4019578 - RNA, 21 nt, Human T-lymphotropic virus 2
ccgcagccacaccaaccuccc

SEQ ID NO: 4019579 - RNA, 23 nt, Human T-lymphotropic virus 2
ccgcagccacaccaaccuccccg

SEQ ID NO: 4019580 - RNA, 20 nt, Human T-lymphotropic virus 2
ccgcauacacgggccccguc

SEQ ID NO: 4019581 - RNA, 19 nt, Human T-lymphotropic virus 2
ccgcucacauuccucccau

SEQ ID NO: 4019582 - RNA, 13 nt, Human T-lymphotropic virus 2
ccguccuccagga

SEQ ID NO: 4019583 - RNA, 12 nt, Human T-lymphotropic virus 2
ccgucucaggug

SEQ ID NO: 4019584 - RNA, 21 nt, Human T-lymphotropic virus 2
ccuaaccuaauuacuuacucu

SEQ ID NO: 4019585 - RNA, 23 nt, Human T-lymphotropic virus 2
ccuaauuacuuacucuggcuucc

SEQ ID NO: 4019586 - RNA, 21 nt, Human T-lymphotropic virus 2
ccuacuacuacuccuccgcca

SEQ ID NO: 4019587 - RNA, 20 nt, Human T-lymphotropic virus 2
ccuacuuuuauucagucuca

SEQ ID NO: 4019588 - RNA, 21 nt, Human T-lymphotropic virus 2
ccuacuuuuauucagucucac

SEQ ID NO: 4019589 - RNA, 21 nt, Human T-lymphotropic virus 2
ccucagaacccacucagccuc

SEQ ID NO: 4019590 - RNA, 14 nt, Human T-lymphotropic virus 2
ccuccaccaugucc

SEQ ID NO: 4019591 - RNA, 17 nt, Human T-lymphotropic virus 2
ccucccagacgacccca

SEQ ID NO: 4019592 - RNA, 12 nt, Human T-lymphotropic virus 2
ccuccccaagca

SEQ ID NO: 4019593 - RNA, 16 nt, Human T-lymphotropic virus 2
ccuccccccccuuccc

SEQ ID NO: 4019594 - RNA, 19 nt, Human T-lymphotropic virus 2
ccuccccgacccaauuucc

SEQ ID NO: 4019595 - RNA, 18 nt, Human T-lymphotropic virus 2
ccuccgccaaauccaggc

SEQ ID NO: 4019596 - RNA, 17 nt, Human T-lymphotropic virus 2
ccuccuaccacuccagc

SEQ ID NO: 4019597 - RNA, 22 nt, Human T-lymphotropic virus 2
ccuccuaguagaugccccugga

SEQ ID NO: 4019598 - RNA, 15 nt, Human T-lymphotropic virus 2
ccuccuggccaccug

SEQ ID NO: 4019599 - RNA, 23 nt, Human T-lymphotropic virus 2
ccuccuguuggaucucccuucca

SEQ ID NO: 4019600 - RNA, 18 nt, Human T-lymphotropic virus 2
ccucuaacccccgcucac

SEQ ID NO: 4019601 - RNA, 15 nt, Human T-lymphotropic virus 2
ccucuaccccuccca

SEQ ID NO: 4019602 - RNA, 13 nt, Human T-lymphotropic virus 2
ccucucaggucga

SEQ ID NO: 4019603 - RNA, 17 nt, Human T-lymphotropic virus 2
ccugcccgcuccuccau

SEQ ID NO: 4019604 - RNA, 12 nt, Human T-lymphotropic virus 2
ccuggccaccug

SEQ ID NO: 4019605 - RNA, 14 nt, Human T-lymphotropic virus 2
ccuggccaccuguc

SEQ ID NO: 4019606 - RNA, 14 nt, Human T-lymphotropic virus 2
ccuguauccagacu

SEQ ID NO: 4019607 - RNA, 18 nt, Human T-lymphotropic virus 2
ccuuaaacuucacuuccg

SEQ ID NO: 4019608 - RNA, 21 nt, Human T-lymphotropic virus 2
ccuuacgguuauaccccagac

SEQ ID NO: 4019609 - RNA, 22 nt, Human T-lymphotropic virus 2
ccuucaacaggacaucacuccc

SEQ ID NO: 4019610 - RNA, 24 nt, Human T-lymphotropic virus 2
ccuucaaugaauacacagacuccc

SEQ ID NO: 4019611 - RNA, 13 nt, Human T-lymphotropic virus 2
ccuucaccauucc

SEQ ID NO: 4019612 - RNA, 17 nt, Human T-lymphotropic virus 2
ccuuccaauuucccagg

SEQ ID NO: 4019613 - RNA, 14 nt, Human T-lymphotropic virus 2
ccuuccaccucagg

SEQ ID NO: 4019614 - RNA, 16 nt, Human T-lymphotropic virus 2
ccuucccccaccuccc

SEQ ID NO: 4019615 - RNA, 19 nt, Human T-lymphotropic virus 2
ccuucccccaccuccccaa

SEQ ID NO: 4019616 - RNA, 16 nt, Human T-lymphotropic virus 2
ccuuccuacaaugacc

SEQ ID NO: 4019617 - RNA, 23 nt, Human T-lymphotropic virus 2
ccuuccuacaaugacccuugcuc

SEQ ID NO: 4019618 - RNA, 22 nt, Human T-lymphotropic virus 2
ccuucgcaaacaccuacaaucc

SEQ ID NO: 4019619 - RNA, 20 nt, Human T-lymphotropic virus 2
ccuucuuucaaucaaugcga

SEQ ID NO: 4019620 - RNA, 19 nt, Human T-lymphotropic virus 2
cgaacaccuucccccaccu

SEQ ID NO: 4019621 - RNA, 23 nt, Human T-lymphotropic virus 2
cgaaccuggccuccguccccaaa

SEQ ID NO: 4019622 - RNA, 16 nt, Human T-lymphotropic virus 2
cgacaccuaucugccc

SEQ ID NO: 4019623 - RNA, 16 nt, Human T-lymphotropic virus 2
cgaccuuaauucccua

SEQ ID NO: 4019624 - RNA, 13 nt, Human T-lymphotropic virus 2
cgacuacaccccc

SEQ ID NO: 4019625 - RNA, 19 nt, Human T-lymphotropic virus 2
cgacuagccucccgagcca

SEQ ID NO: 4019626 - RNA, 16 nt, Human T-lymphotropic virus 2
cgacuuccugaggaac

SEQ ID NO: 4019627 - RNA, 18 nt, Human T-lymphotropic virus 2
cgagaagcccuccagaca

SEQ ID NO: 4019628 - RNA, 14 nt, Human T-lymphotropic virus 2
cgaucccgacccca

SEQ ID NO: 4019629 - RNA, 13 nt, Human T-lymphotropic virus 2
cgcaaggacaguu

SEQ ID NO: 4019630 - RNA, 16 nt, Human T-lymphotropic virus 2
cgcauacacgggcccc

SEQ ID NO: 4019631 - RNA, 13 nt, Human T-lymphotropic virus 2
cgccacaccaagg

SEQ ID NO: 4019632 - RNA, 22 nt, Human T-lymphotropic virus 2
cgccaccuccccccccuucccc

SEQ ID NO: 4019633 - RNA, 17 nt, Human T-lymphotropic virus 2
cgccauuggggccuucc

SEQ ID NO: 4019634 - RNA, 21 nt, Human T-lymphotropic virus 2
cgccccaaggccuccacggcc

SEQ ID NO: 4019635 - RNA, 11 nt, Human T-lymphotropic virus 2
cgccgcccucu

SEQ ID NO: 4019636 - RNA, 13 nt, Human T-lymphotropic virus 2
cgccgcccucuug

SEQ ID NO: 4019637 - RNA, 14 nt, Human T-lymphotropic virus 2
cgccgcccucuugg

SEQ ID NO: 4019638 - RNA, 15 nt, Human T-lymphotropic virus 2
cgccgcccucuuggc

SEQ ID NO: 4019639 - RNA, 17 nt, Human T-lymphotropic virus 2
cgccgcucccgcuccuc

SEQ ID NO: 4019640 - RNA, 23 nt, Human T-lymphotropic virus 2
cgccuacaucgacaugcccuccu

SEQ ID NO: 4019641 - RNA, 18 nt, Human T-lymphotropic virus 2
cgcucccgcuccucacgc

SEQ ID NO: 4019642 - RNA, 22 nt, Human T-lymphotropic virus 2
cgcugguggaguaacaggcucc

SEQ ID NO: 4019643 - RNA, 19 nt, Human T-lymphotropic virus 2
cggcccuuaccccaaagca

SEQ ID NO: 4019644 - RNA, 17 nt, Human T-lymphotropic virus 2
cggccucggcaccuccu

SEQ ID NO: 4019645 - RNA, 14 nt, Human T-lymphotropic virus 2
cguccucaacccca

SEQ ID NO: 4019646 - RNA, 15 nt, Human T-lymphotropic virus 2
cgugagggcucccug

SEQ ID NO: 4019647 - RNA, 16 nt, Human T-lymphotropic virus 2
aaaacacaacaaaccc

SEQ ID NO: 4019648 - RNA, 17 nt, Human T-lymphotropic virus 2
aaaaucacacauaauua

SEQ ID NO: 4019649 - RNA, 15 nt, Human T-lymphotropic virus 2
aaagaaagaaaccag

SEQ ID NO: 4019650 - RNA, 12 nt, Human T-lymphotropic virus 2
aacaccuucccc

SEQ ID NO: 4019651 - RNA, 13 nt, Human T-lymphotropic virus 2
aacagcucuccag

SEQ ID NO: 4019652 - RNA, 15 nt, Human T-lymphotropic virus 2
aacaggcucccuauc

SEQ ID NO: 4019653 - RNA, 11 nt, Human T-lymphotropic virus 2
aacccccucca

SEQ ID NO: 4019654 - RNA, 20 nt, Human T-lymphotropic virus 2
aaccucgaccuuaauucccu

SEQ ID NO: 4019655 - RNA, 18 nt, Human T-lymphotropic virus 2
aacuccauuauccucccc

SEQ ID NO: 4019656 - RNA, 14 nt, Human T-lymphotropic virus 2
aacucucccagcua

SEQ ID NO: 4019657 - RNA, 18 nt, Human T-lymphotropic virus 2
aagagccaccaaugccau

SEQ ID NO: 4019658 - RNA, 21 nt, Human T-lymphotropic virus 2
aagcaagucacaaaacccauc

SEQ ID NO: 4019659 - RNA, 15 nt, Human T-lymphotropic virus 2
aagccauggccuucc

SEQ ID NO: 4019660 - RNA, 18 nt, Human T-lymphotropic virus 2
aagccauggccuucccuu

SEQ ID NO: 4019661 - RNA, 23 nt, Human T-lymphotropic virus 2
aagcgcaaggacaguucaggagg

SEQ ID NO: 4019662 - RNA, 13 nt, Human T-lymphotropic virus 2
aaggcccuggagg

SEQ ID NO: 4019663 - RNA, 15 nt, Human T-lymphotropic virus 2
aagguaagucuccuc

SEQ ID NO: 4019664 - RNA, 14 nt, Human T-lymphotropic virus 2
aagucuccucucag

SEQ ID NO: 4019665 - RNA, 20 nt, Human T-lymphotropic virus 2
aauacuccuccuuccauaac

SEQ ID NO: 4019666 - RNA, 20 nt, Human T-lymphotropic virus 2
aaugaccuggucuccaaggc

SEQ ID NO: 4019667 - RNA, 13 nt, Human T-lymphotropic virus 2
acaaaaccaaggu

SEQ ID NO: 4019668 - RNA, 15 nt, Human T-lymphotropic virus 2
acaaaaccaaggucc

SEQ ID NO: 4019669 - RNA, 13 nt, Human T-lymphotropic virus 2
acaaaccuccucc

SEQ ID NO: 4019670 - RNA, 20 nt, Human T-lymphotropic virus 2
acaaauggaccaucauugga

SEQ ID NO: 4019671 - RNA, 14 nt, Human T-lymphotropic virus 2
acaagcucuacaac

SEQ ID NO: 4019672 - RNA, 23 nt, Human T-lymphotropic virus 2
acaaucccaaguaaaggcucuga

SEQ ID NO: 4019673 - RNA, 23 nt, Human T-lymphotropic virus 2
acacauaauuacaauccugucuc

SEQ ID NO: 4019674 - RNA, 22 nt, Human T-lymphotropic virus 2
acacauuuuccacuagcccagc

SEQ ID NO: 4019675 - RNA, 19 nt, Human T-lymphotropic virus 2
acaccucagccuacccaag

SEQ ID NO: 4019676 - RNA, 14 nt, Human T-lymphotropic virus 2
acagagccuccuau

SEQ ID NO: 4019677 - RNA, 16 nt, Human T-lymphotropic virus 2
acaggucaucuccccu

SEQ ID NO: 4019678 - RNA, 22 nt, Human T-lymphotropic virus 2
acagucauaguccucccggagg

SEQ ID NO: 4019679 - RNA, 13 nt, Human T-lymphotropic virus 2
accaacacccagu

SEQ ID NO: 4019680 - RNA, 17 nt, Human T-lymphotropic virus 2
accaacaucccugucuc

SEQ ID NO: 4019681 - RNA, 13 nt, Human T-lymphotropic virus 2
accacccucaccu

SEQ ID NO: 4019682 - RNA, 14 nt, Human T-lymphotropic virus 2
accagcucaggccu

SEQ ID NO: 4019683 - RNA, 17 nt, Human T-lymphotropic virus 2
accaucuaccuccacca

SEQ ID NO: 4019684 - RNA, 13 nt, Human T-lymphotropic virus 2
acccacucagccu

SEQ ID NO: 4019685 - RNA, 15 nt, Human T-lymphotropic virus 2
acccacucagccucc

SEQ ID NO: 4019686 - RNA, 17 nt, Human T-lymphotropic virus 2
acccaguucaaacuccu

SEQ ID NO: 4019687 - RNA, 18 nt, Human T-lymphotropic virus 2
acccauuccugaagccuc

SEQ ID NO: 4019688 - RNA, 18 nt, Human T-lymphotropic virus 2
accccagacacucgugcc

SEQ ID NO: 4019689 - RNA, 21 nt, Human T-lymphotropic virus 2
accccaugaggaaaauguuuc

SEQ ID NO: 4019690 - RNA, 15 nt, Human T-lymphotropic virus 2
acccccugcccauaa

SEQ ID NO: 4019691 - RNA, 23 nt, Human T-lymphotropic virus 2
accccuccuguuggaucucccuu

SEQ ID NO: 4019692 - RNA, 13 nt, Human T-lymphotropic virus 2
acccgccuacauc

SEQ ID NO: 4019693 - RNA, 19 nt, Human T-lymphotropic virus 2
acccuccaggcacugacca

SEQ ID NO: 4019694 - RNA, 20 nt, Human T-lymphotropic virus 2
acccuccaggcggccuugcc

SEQ ID NO: 4019695 - RNA, 18 nt, Human T-lymphotropic virus 2
acccucggggaucagcuc

SEQ ID NO: 4019696 - RNA, 23 nt, Human T-lymphotropic virus 2
acccucggggaucagcuccccuc

SEQ ID NO: 4019697 - RNA, 15 nt, Human T-lymphotropic virus 2
acccuucccuuggac

SEQ ID NO: 4019698 - RNA, 15 nt, Human T-lymphotropic virus 2
acccuucuccaggaa

SEQ ID NO: 4019699 - RNA, 14 nt, Human T-lymphotropic virus 2
accuacauucccuc

SEQ ID NO: 4019700 - RNA, 16 nt, Human T-lymphotropic virus 2
accucaacgccgcccu

SEQ ID NO: 4019701 - RNA, 22 nt, Human T-lymphotropic virus 2
accucaacgccgcccucuuggc

SEQ ID NO: 4019702 - RNA, 11 nt, Human T-lymphotropic virus 2
accucagccua

SEQ ID NO: 4019703 - RNA, 19 nt, Human T-lymphotropic virus 2
accucuccuuggccucauc

SEQ ID NO: 4019704 - RNA, 15 nt, Human T-lymphotropic virus 2
accugggaccccauc

SEQ ID NO: 4019705 - RNA, 16 nt, Human T-lymphotropic virus 2
accuuaucccucgccu

SEQ ID NO: 4019706 - RNA, 19 nt, Human T-lymphotropic virus 2
accuucccccaccucccca

SEQ ID NO: 4019707 - RNA, 11 nt, Human T-lymphotropic virus 2
accuuggcagc

SEQ ID NO: 4019708 - RNA, 21 nt, Human T-lymphotropic virus 2
acgacacccugauccuaggcg

SEQ ID NO: 4019709 - RNA, 16 nt, Human T-lymphotropic virus 2
acgccgcccucuuggc

SEQ ID NO: 4019710 - RNA, 12 nt, Human T-lymphotropic virus 2
acggccuccccg

SEQ ID NO: 4019711 - RNA, 21 nt, Human T-lymphotropic virus 2
acuacacccccccugcccuaa

SEQ ID NO: 4019712 - RNA, 22 nt, Human T-lymphotropic virus 2
acuacugaggaaaaaaacuccu

SEQ ID NO: 4019713 - RNA, 13 nt, Human T-lymphotropic virus 2
acucaccugggac

SEQ ID NO: 4019714 - RNA, 13 nt, Human T-lymphotropic virus 2
acucaccuugggg

SEQ ID NO: 4019715 - RNA, 20 nt, Human T-lymphotropic virus 2
acucauguauccguccucca

SEQ ID NO: 4019716 - RNA, 11 nt, Human T-lymphotropic virus 2
acuccagcccc

SEQ ID NO: 4019717 - RNA, 20 nt, Human T-lymphotropic virus 2
acuccaugcguuacaugcca

SEQ ID NO: 4019718 - RNA, 17 nt, Human T-lymphotropic virus 2
acuccccugcccucuca

SEQ ID NO: 4019719 - RNA, 12 nt, Human T-lymphotropic virus 2
acucccuuaucu

SEQ ID NO: 4019720 - RNA, 21 nt, Human T-lymphotropic virus 2
acuccgaccuugaacaugucc

SEQ ID NO: 4019721 - RNA, 17 nt, Human T-lymphotropic virus 2
acuccuccgccaccucc

SEQ ID NO: 4019722 - RNA, 16 nt, Human T-lymphotropic virus 2
acugcaacaacuccau

SEQ ID NO: 4019723 - RNA, 13 nt, Human T-lymphotropic virus 2
acuguccuaaccu

SEQ ID NO: 4019724 - RNA, 13 nt, Human T-lymphotropic virus 2
acuucucccccau

SEQ ID NO: 4019725 - RNA, 20 nt, Human T-lymphotropic virus 2
acuugacacaggagccgacc

SEQ ID NO: 4019726 - RNA, 12 nt, Human T-lymphotropic virus 2
agacaaugccau

SEQ ID NO: 4019727 - RNA, 16 nt, Human T-lymphotropic virus 2
agaccaccaacaccau

SEQ ID NO: 4019728 - RNA, 21 nt, Human T-lymphotropic virus 2
agacucaccuuggggauccau

SEQ ID NO: 4019729 - RNA, 13 nt, Human T-lymphotropic virus 2
agacucugccuua

SEQ ID NO: 4019730 - RNA, 16 nt, Human T-lymphotropic virus 2
agauccagccucucau

SEQ ID NO: 4019731 - RNA, 21 nt, Human T-lymphotropic virus 2
agcaggaggucagcuccucug

SEQ ID NO: 4019732 - RNA, 15 nt, Human T-lymphotropic virus 2
agccacaccaaccuc

SEQ ID NO: 4019733 - RNA, 17 nt, Human T-lymphotropic virus 2
agccaccaaugccauua

SEQ ID NO: 4019734 - RNA, 15 nt, Human T-lymphotropic virus 2
agccccacccucuuc

SEQ ID NO: 4019735 - RNA, 21 nt, Human T-lymphotropic virus 2
agccuaccgacagccuuaccc

SEQ ID NO: 4019736 - RNA, 15 nt, Human T-lymphotropic virus 2
agccuuccaucccuc

SEQ ID NO: 4019737 - RNA, 20 nt, Human T-lymphotropic virus 2
agccuuccaucccuccuauc

SEQ ID NO: 4019738 - RNA, 14 nt, Human T-lymphotropic virus 2
agccuuccucacca

SEQ ID NO: 4019739 - RNA, 13 nt, Human T-lymphotropic virus 2
agcgccuccaggc

SEQ ID NO: 4019740 - RNA, 22 nt, Human T-lymphotropic virus 2
agcgccuuaacguggcccuuga

SEQ ID NO: 4019741 - RNA, 15 nt, Human T-lymphotropic virus 2
agcuaacccuccagg

SEQ ID NO: 4019742 - RNA, 12 nt, Human T-lymphotropic virus 2
agcucuccucuc

SEQ ID NO: 4019743 - RNA, 14 nt, Human T-lymphotropic virus 2
agcucuccucucca

SEQ ID NO: 4019744 - RNA, 20 nt, Human T-lymphotropic virus 2
agcucugccaaucuuuccac

SEQ ID NO: 4019745 - RNA, 19 nt, Human T-lymphotropic virus 2
agcugcaugcccaagacca

SEQ ID NO: 4019746 - RNA, 20 nt, Human T-lymphotropic virus 2
aggaaggggaaccccuccug

SEQ ID NO: 4019747 - RNA, 21 nt, Human T-lymphotropic virus 2
agguccuuaccccucccacca

SEQ ID NO: 4019748 - RNA, 21 nt, Human T-lymphotropic virus 2
agucgggacuguacccagcca

SEQ ID NO: 4019749 - RNA, 21 nt, Human T-lymphotropic virus 2
agucuccccuagcgcccccgc

SEQ ID NO: 4019750 - RNA, 22 nt, Human T-lymphotropic virus 2
agucucuuuuggcgccacacca

SEQ ID NO: 4019751 - RNA, 14 nt, Human T-lymphotropic virus 2
agugucccuucgac

SEQ ID NO: 4019752 - RNA, 19 nt, Human T-lymphotropic virus 2
auaacugcaacaacuccau

SEQ ID NO: 4019753 - RNA, 19 nt, Human T-lymphotropic virus 2
auacccaaagcccccaggg

SEQ ID NO: 4019754 - RNA, 13 nt, Human T-lymphotropic virus 2
auagaccucaccc

SEQ ID NO: 4019755 - RNA, 18 nt, Human T-lymphotropic virus 2
aucaaauaccuacauucc

SEQ ID NO: 4019756 - RNA, 14 nt, Human T-lymphotropic virus 2
aucaagcaggaggu

SEQ ID NO: 4019757 - RNA, 14 nt, Human T-lymphotropic virus 2
auccaggcccuucc

SEQ ID NO: 4019758 - RNA, 17 nt, Human T-lymphotropic virus 2
auccaggcccuuccaca

SEQ ID NO: 4019759 - RNA, 18 nt, Human T-lymphotropic virus 2
aucccaacccuucccuug

SEQ ID NO: 4019760 - RNA, 13 nt, Human T-lymphotropic virus 2
aucccucgccucc

SEQ ID NO: 4019761 - RNA, 14 nt, Human T-lymphotropic virus 2
auccguccuccagg

SEQ ID NO: 4019762 - RNA, 20 nt, Human T-lymphotropic virus 2
auccugucuccucucagccc

SEQ ID NO: 4019763 - RNA, 16 nt, Human T-lymphotropic virus 2
auccuucgcaaacacc

SEQ ID NO: 4019764 - RNA, 14 nt, Human T-lymphotropic virus 2
auccuucucacugg

SEQ ID NO: 4019765 - RNA, 22 nt, Human T-lymphotropic virus 2
auccuuuaugguucaucaccuc

SEQ ID NO: 4019766 - RNA, 15 nt, Human T-lymphotropic virus 2
aucgacaugcccucc

SEQ ID NO: 4019767 - RNA, 19 nt, Human T-lymphotropic virus 2
aucucccaccuuacccagg

SEQ ID NO: 4019768 - RNA, 12 nt, Human T-lymphotropic virus 2
aucucccuucca

SEQ ID NO: 4019769 - RNA, 22 nt, Human T-lymphotropic virus 2
augacauacuuuuagccagccc

SEQ ID NO: 4019770 - RNA, 19 nt, Human T-lymphotropic virus 2
augccaaaaaaucuuacaa

SEQ ID NO: 4019771 - RNA, 13 nt, Human T-lymphotropic virus 2
augccauucacaa

SEQ ID NO: 4019772 - RNA, 14 nt, Human T-lymphotropic virus 2
augcccuccuggcc

SEQ ID NO: 4019773 - RNA, 19 nt, Human T-lymphotropic virus 2
auggccacuuauaccccau

SEQ ID NO: 4019774 - RNA, 19 nt, Human T-lymphotropic virus 2
auguauccguccuccagga

SEQ ID NO: 4019775 - RNA, 20 nt, Human T-lymphotropic virus 2
augucagacucgccucuccc

SEQ ID NO: 4019776 - RNA, 20 nt, Human T-lymphotropic virus 2
auuacaauccugucuccucu

SEQ ID NO: 4019777 - RNA, 14 nt, Human T-lymphotropic virus 2
auuagaccuccuau

SEQ ID NO: 4019778 - RNA, 13 nt, Human T-lymphotropic virus 2
auucagucucaca

SEQ ID NO: 4019779 - RNA, 11 nt, Human T-lymphotropic virus 2
auuccucccau

SEQ ID NO: 4019780 - RNA, 16 nt, Human T-lymphotropic virus 2
auucgaaaccaaagcc

SEQ ID NO: 4019781 - RNA, 19 nt, Human T-lymphotropic virus 2
auugcaaucccuccaggaa

SEQ ID NO: 4019782 - RNA, 16 nt, Human T-lymphotropic virus 2
auugcuauaggcaggc

SEQ ID NO: 4019783 - RNA, 12 nt, Human T-lymphotropic virus 2
auugucuucccg

SEQ ID NO: 4019784 - RNA, 23 nt, Human T-lymphotropic virus 2
auuucacccaggaagucagccaa

SEQ ID NO: 4019785 - RNA, 20 nt, Human T-lymphotropic virus 2
auuuccggcccuuaccccaa

SEQ ID NO: 4019786 - RNA, 16 nt, Human T-lymphotropic virus 2
auuuucacccucuccc

SEQ ID NO: 4019787 - RNA, 14 nt, Human T-lymphotropic virus 2
caaacuccuccaaa

SEQ ID NO: 4019788 - RNA, 17 nt, Human T-lymphotropic virus 2
caaagacaucucccacc

SEQ ID NO: 4019789 - RNA, 19 nt, Human T-lymphotropic virus 2
caaaucccccuccccaagc

SEQ ID NO: 4019790 - RNA, 15 nt, Human T-lymphotropic virus 2
caacaaaccccaggc

SEQ ID NO: 4019791 - RNA, 13 nt, Human T-lymphotropic virus 2
caacaaaccuccu

SEQ ID NO: 4019792 - RNA, 14 nt, Human T-lymphotropic virus 2
caacaaaccuccuc

SEQ ID NO: 4019793 - RNA, 15 nt, Human T-lymphotropic virus 2
caacaaagaaugcca

SEQ ID NO: 4019794 - RNA, 14 nt, Human T-lymphotropic virus 2
caacaacucuccca

SEQ ID NO: 4019795 - RNA, 14 nt, Human T-lymphotropic virus 2
caacaaugccaggg

SEQ ID NO: 4019796 - RNA, 15 nt, Human T-lymphotropic virus 2
caacccuucccuugg

SEQ ID NO: 4019797 - RNA, 17 nt, Human T-lymphotropic virus 2
caacuccaugcguuaca

SEQ ID NO: 4019798 - RNA, 19 nt, Human T-lymphotropic virus 2
caacugcugaugccuuucu

SEQ ID NO: 4019799 - RNA, 22 nt, Human T-lymphotropic virus 2
caagacgccgccgugccguucc

SEQ ID NO: 4019800 - RNA, 22 nt, Human T-lymphotropic virus 2
caagagcuuguaucacccucac

SEQ ID NO: 4019801 - RNA, 18 nt, Human T-lymphotropic virus 2
caagcgcuacuugacaca

SEQ ID NO: 4019802 - RNA, 16 nt, Human T-lymphotropic virus 2
caagguaagucuccuc

SEQ ID NO: 4019803 - RNA, 23 nt, Human T-lymphotropic virus 2
caagguaagucuccucucagguc

SEQ ID NO: 4019804 - RNA, 17 nt, Human T-lymphotropic virus 2
caauacuccuccuucca

SEQ ID NO: 4019805 - RNA, 22 nt, Human T-lymphotropic virus 2
caauagccacuccaaacaccau

SEQ ID NO: 4019806 - RNA, 20 nt, Human T-lymphotropic virus 2
caaucccuauauucugcccu

SEQ ID NO: 4019807 - RNA, 19 nt, Human T-lymphotropic virus 2
caaugcgaaagcacacccc

SEQ ID NO: 4019808 - RNA, 21 nt, Human T-lymphotropic virus 2
caauggcgacuagccucccga

SEQ ID NO: 4019809 - RNA, 22 nt, Human T-lymphotropic virus 2
cacaccaagggaagccaagucc

SEQ ID NO: 4019810 - RNA, 18 nt, Human T-lymphotropic virus 2
cacaccccccacccuccg

SEQ ID NO: 4019811 - RNA, 16 nt, Human T-lymphotropic virus 2
cggcacuuccgcccau

SEQ ID NO: 4019812 - RNA, 18 nt, Human T-lymphotropic virus 2
cggccucggcaccuccug

SEQ ID NO: 4019813 - RNA, 18 nt, Human T-lymphotropic virus 2
cgggacuguacccagcca

SEQ ID NO: 4019814 - RNA, 21 nt, Human T-lymphotropic virus 2
cgggccgguaaagcuccacga

SEQ ID NO: 4019815 - RNA, 17 nt, Human T-lymphotropic virus 2
cggggaucagcuccccu

SEQ ID NO: 4019816 - RNA, 12 nt, Human T-lymphotropic virus 2
cguaccuccucc

SEQ ID NO: 4019817 - RNA, 15 nt, Human T-lymphotropic virus 2
cguaccuccuccggc

SEQ ID NO: 4019818 - RNA, 20 nt, Human T-lymphotropic virus 2
cguggauagauccagccucu

SEQ ID NO: 4019819 - RNA, 22 nt, Human T-lymphotropic virus 2
cuaacccccuccacguccugga

SEQ ID NO: 4019820 - RNA, 19 nt, Human T-lymphotropic virus 2
cuaagugcggcuccuccau

SEQ ID NO: 4019821 - RNA, 18 nt, Human T-lymphotropic virus 2
cuacaacauaacugccgu

SEQ ID NO: 4019822 - RNA, 21 nt, Human T-lymphotropic virus 2
cuacaaugacccuugcucgcu

SEQ ID NO: 4019823 - RNA, 15 nt, Human T-lymphotropic virus 2
cuacaccaccugggg

SEQ ID NO: 4019824 - RNA, 16 nt, Human T-lymphotropic virus 2
cuacaccaccugggga

SEQ ID NO: 4019825 - RNA, 13 nt, Human T-lymphotropic virus 2
cuaccacuccagc

SEQ ID NO: 4019826 - RNA, 15 nt, Human T-lymphotropic virus 2
cuacuccuccgccac

SEQ ID NO: 4019827 - RNA, 18 nt, Human T-lymphotropic virus 2
cuacucucucaucagcuu

SEQ ID NO: 4019828 - RNA, 14 nt, Human T-lymphotropic virus 2
cuagacucugccuu

SEQ ID NO: 4019829 - RNA, 13 nt, Human T-lymphotropic virus 2
cuauaccucccag

SEQ ID NO: 4019830 - RNA, 14 nt, Human T-lymphotropic virus 2
cuauguuccacccg

SEQ ID NO: 4019831 - RNA, 19 nt, Human T-lymphotropic virus 2
cucaacgccgcccucuugg

SEQ ID NO: 4019832 - RNA, 17 nt, Human T-lymphotropic virus 2
cucaaggacccucaagg

SEQ ID NO: 4019833 - RNA, 17 nt, Human T-lymphotropic virus 2
cucacacauuuuccacu

SEQ ID NO: 4019834 - RNA, 17 nt, Human T-lymphotropic virus 2
cucaccucuccuucccc

SEQ ID NO: 4019835 - RNA, 21 nt, Human T-lymphotropic virus 2
cucacgaaacacauuccgcac

SEQ ID NO: 4019836 - RNA, 21 nt, Human T-lymphotropic virus 2
cucacgauugguaucuccucc

SEQ ID NO: 4019837 - RNA, 13 nt, Human T-lymphotropic virus 2
cucagccuccacc

SEQ ID NO: 4019838 - RNA, 15 nt, Human T-lymphotropic virus 2
cuccacccugccagg

SEQ ID NO: 4019839 - RNA, 17 nt, Human T-lymphotropic virus 2
cuccacccugccaggca

SEQ ID NO: 4019840 - RNA, 15 nt, Human T-lymphotropic virus 2
cuccacuaccaccca

SEQ ID NO: 4019841 - RNA, 21 nt, Human T-lymphotropic virus 2
cuccaggcacugaccacgcau

SEQ ID NO: 4019842 - RNA, 17 nt, Human T-lymphotropic virus 2
cuccaggcggccuugcc

SEQ ID NO: 4019843 - RNA, 18 nt, Human T-lymphotropic virus 2
cucccaaaccaccuccca

SEQ ID NO: 4019844 - RNA, 18 nt, Human T-lymphotropic virus 2
cucccagacgaccccagc

SEQ ID NO: 4019845 - RNA, 21 nt, Human T-lymphotropic virus 2
cucccagacgaccccagcccc

SEQ ID NO: 4019846 - RNA, 16 nt, Human T-lymphotropic virus 2
cuccccucaaaaggca

SEQ ID NO: 4019847 - RNA, 17 nt, Human T-lymphotropic virus 2
cucccgagccagccacc

SEQ ID NO: 4019848 - RNA, 20 nt, Human T-lymphotropic virus 2
cucccggccucggcaccucc

SEQ ID NO: 4019849 - RNA, 14 nt, Human T-lymphotropic virus 2
cucccuuccaccuc

SEQ ID NO: 4019850 - RNA, 12 nt, Human T-lymphotropic virus 2
cuccgccaccuc

SEQ ID NO: 4019851 - RNA, 15 nt, Human T-lymphotropic virus 2
cuccuaccacuccag

SEQ ID NO: 4019852 - RNA, 21 nt, Human T-lymphotropic virus 2
cuccuagggaaaccacuccac

SEQ ID NO: 4019853 - RNA, 23 nt, Human T-lymphotropic virus 2
cuccuccaucccaacccuucccu

SEQ ID NO: 4019854 - RNA, 14 nt, Human T-lymphotropic virus 2
cuccuccgccaccu

SEQ ID NO: 4019855 - RNA, 15 nt, Human T-lymphotropic virus 2
cuccuccgccaccuc

SEQ ID NO: 4019856 - RNA, 12 nt, Human T-lymphotropic virus 2
cuccucucaggu

SEQ ID NO: 4019857 - RNA, 16 nt, Human T-lymphotropic virus 2
cuccucugcucuuggc

SEQ ID NO: 4019858 - RNA, 15 nt, Human T-lymphotropic virus 2
cuccugucuccccca

SEQ ID NO: 4019859 - RNA, 21 nt, Human T-lymphotropic virus 2
cuccuuccauaaccuucaccu

SEQ ID NO: 4019860 - RNA, 22 nt, Human T-lymphotropic virus 2
cuccuuccccagggccccccga

SEQ ID NO: 4019861 - RNA, 22 nt, Human T-lymphotropic virus 2
cucgaacaccuucccccaccuc

SEQ ID NO: 4019862 - RNA, 12 nt, Human T-lymphotropic virus 2
cucggcaccucc

SEQ ID NO: 4019863 - RNA, 19 nt, Human T-lymphotropic virus 2
cucggcugccccuuaggua

SEQ ID NO: 4019864 - RNA, 18 nt, Human T-lymphotropic virus 2
cucguaguuuccuuacac

SEQ ID NO: 4019865 - RNA, 22 nt, Human T-lymphotropic virus 2
cucgucauauuguuuggccccu

SEQ ID NO: 4019866 - RNA, 19 nt, Human T-lymphotropic virus 2
cucuaaaggaacacccauc

SEQ ID NO: 4019867 - RNA, 15 nt, Human T-lymphotropic virus 2
cucuacuccuccucg

SEQ ID NO: 4019868 - RNA, 20 nt, Human T-lymphotropic virus 2
cucucccagcuaacccucca

SEQ ID NO: 4019869 - RNA, 16 nt, Human T-lymphotropic virus 2
cucucuuacaccuccc

SEQ ID NO: 4019870 - RNA, 14 nt, Human T-lymphotropic virus 2
cucuuggcagcccc

SEQ ID NO: 4019871 - RNA, 20 nt, Human T-lymphotropic virus 2
cugaaaaacaaggcucugac

SEQ ID NO: 4019872 - RNA, 14 nt, Human T-lymphotropic virus 2
cugaaccucuccgg

SEQ ID NO: 4019873 - RNA, 22 nt, Human T-lymphotropic virus 2
cugaagccucuaccccucccaa

SEQ ID NO: 4019874 - RNA, 19 nt, Human T-lymphotropic virus 2
cugacgauuacccccugcc

SEQ ID NO: 4019875 - RNA, 20 nt, Human T-lymphotropic virus 2
cugagcgccuccaggccuua

SEQ ID NO: 4019876 - RNA, 15 nt, Human T-lymphotropic virus 2
cugaggaacuccccu

SEQ ID NO: 4019877 - RNA, 15 nt, Human T-lymphotropic virus 2
cugcacguggaaccu

SEQ ID NO: 4019878 - RNA, 22 nt, Human T-lymphotropic virus 2
cugcacguggaaccucgaccuu

SEQ ID NO: 4019879 - RNA, 13 nt, Human T-lymphotropic virus 2
cugccaccccaga

SEQ ID NO: 4019880 - RNA, 15 nt, Human T-lymphotropic virus 2
cugcccgcuccucca

SEQ ID NO: 4019881 - RNA, 18 nt, Human T-lymphotropic virus 2
cugccucuuagacaccca

SEQ ID NO: 4019882 - RNA, 12 nt, Human T-lymphotropic virus 2
cugcuccuccca

SEQ ID NO: 4019883 - RNA, 20 nt, Human T-lymphotropic virus 2
cugcuuucuccacccugcca

SEQ ID NO: 4019884 - RNA, 14 nt, Human T-lymphotropic virus 2
cuggccuccguccc

SEQ ID NO: 4019885 - RNA, 19 nt, Human T-lymphotropic virus 2
cuggcugcuuucuccaccc

SEQ ID NO: 4019886 - RNA, 15 nt, Human T-lymphotropic virus 2
cuggucuccaaggcc

SEQ ID NO: 4019887 - RNA, 20 nt, Human T-lymphotropic virus 2
cuggucuccaaggcccugga

SEQ ID NO: 4019888 - RNA, 20 nt, Human T-lymphotropic virus 2
cugguggaguaacaggcucc

SEQ ID NO: 4019889 - RNA, 12 nt, Human T-lymphotropic virus 2
cugucuccucuc

SEQ ID NO: 4019890 - RNA, 13 nt, Human T-lymphotropic virus 2
cugucuccucuca

SEQ ID NO: 4019891 - RNA, 14 nt, Human T-lymphotropic virus 2
cuuaccccaaagca

SEQ ID NO: 4019892 - RNA, 17 nt, Human T-lymphotropic virus 2
cuucaccauuccccagc

SEQ ID NO: 4019893 - RNA, 13 nt, Human T-lymphotropic virus 2
cuuccccacccag

SEQ ID NO: 4019894 - RNA, 22 nt, Human T-lymphotropic virus 2
cuuccgcccaucaaacccucca

SEQ ID NO: 4019895 - RNA, 23 nt, Human T-lymphotropic virus 2
cuuccuacuuuuauucagucuca

SEQ ID NO: 4019896 - RNA, 17 nt, Human T-lymphotropic virus 2
cuucgacuacacuucuc

SEQ ID NO: 4019897 - RNA, 18 nt, Human T-lymphotropic virus 2
cuucgccgucacugaaaa

SEQ ID NO: 4019898 - RNA, 20 nt, Human T-lymphotropic virus 2
cuucgccgucacugaaaacg

SEQ ID NO: 4019899 - RNA, 16 nt, Human T-lymphotropic virus 2
cuucuauaccucccag

SEQ ID NO: 4019900 - RNA, 17 nt, Human T-lymphotropic virus 2
cuucuauaccucccaga

SEQ ID NO: 4019901 - RNA, 19 nt, Human T-lymphotropic virus 2
cuugacacggcccccugcc

SEQ ID NO: 4019902 - RNA, 12 nt, Human T-lymphotropic virus 2
cuugcccuuccg

SEQ ID NO: 4019903 - RNA, 17 nt, Human T-lymphotropic virus 2
cuuuccaccacaacaug

SEQ ID NO: 4019904 - RNA, 17 nt, Human T-lymphotropic virus 2
cuuucuccacccugcca

SEQ ID NO: 4019905 - RNA, 17 nt, Human T-lymphotropic virus 2
cuuuuccccuucaggaa

SEQ ID NO: 4019906 - RNA, 16 nt, Human T-lymphotropic virus 2
gaacaggaacagcucu

SEQ ID NO: 4019907 - RNA, 16 nt, Human T-lymphotropic virus 2
gaacccacucagccuc

SEQ ID NO: 4019908 - RNA, 17 nt, Human T-lymphotropic virus 2
gaacccacucagccucc

SEQ ID NO: 4019909 - RNA, 21 nt, Human T-lymphotropic virus 2
gaacccacucagccuccacca

SEQ ID NO: 4019910 - RNA, 13 nt, Human T-lymphotropic virus 2
gaacugcuccucc

SEQ ID NO: 4019911 - RNA, 22 nt, Human T-lymphotropic virus 2
gacagccuuaccccaccuacag

SEQ ID NO: 4019912 - RNA, 22 nt, Human T-lymphotropic virus 2
ugccuuucuucccucucccggc

SEQ ID NO: 4019913 - RNA, 14 nt, Human T-lymphotropic virus 2
ugcggcuccuccau

SEQ ID NO: 4019914 - RNA, 22 nt, Human T-lymphotropic virus 2
ugcggcuccuccaugacccucc

SEQ ID NO: 4019915 - RNA, 16 nt, Human T-lymphotropic virus 2
ugcuuucuccacccug

SEQ ID NO: 4019916 - RNA, 19 nt, Human T-lymphotropic virus 2
uggaagacucucuuacacc

SEQ ID NO: 4019917 - RNA, 15 nt, Human T-lymphotropic virus 2
uggacuguccuucca

SEQ ID NO: 4019918 - RNA, 21 nt, Human T-lymphotropic virus 2
uggcaggcgucccggggccaa

SEQ ID NO: 4019919 - RNA, 21 nt, Human T-lymphotropic virus 2
uggcagggccccuaagaaugc

SEQ ID NO: 4019920 - RNA, 14 nt, Human T-lymphotropic virus 2
uggccaccugucca

SEQ ID NO: 4019921 - RNA, 20 nt, Human T-lymphotropic virus 2
uggccuuccaauuucccagg

SEQ ID NO: 4019922 - RNA, 16 nt, Human T-lymphotropic virus 2
uggcugcuuucuccac

SEQ ID NO: 4019923 - RNA, 15 nt, Human T-lymphotropic virus 2
uggcuggcugcuuuc

SEQ ID NO: 4019924 - RNA, 20 nt, Human T-lymphotropic virus 2
uggcuuaacuuucuccaggc

SEQ ID NO: 4019925 - RNA, 17 nt, Human T-lymphotropic virus 2
ugggaccgucucccggc

SEQ ID NO: 4019926 - RNA, 20 nt, Human T-lymphotropic virus 2
uguacaggacuucuccccua

SEQ ID NO: 4019927 - RNA, 16 nt, Human T-lymphotropic virus 2
uguauccguccuccag

SEQ ID NO: 4019928 - RNA, 17 nt, Human T-lymphotropic virus 2
uguauccguccuccagg

SEQ ID NO: 4019929 - RNA, 16 nt, Human T-lymphotropic virus 2
uguccgcagccacacc

SEQ ID NO: 4019930 - RNA, 23 nt, Human T-lymphotropic virus 2
uguccuaacccccuccacguccu

SEQ ID NO: 4019931 - RNA, 19 nt, Human T-lymphotropic virus 2
uguggacuacgugcugcca

SEQ ID NO: 4019932 - RNA, 15 nt, Human T-lymphotropic virus 2
uguuccccccccuua

SEQ ID NO: 4019933 - RNA, 20 nt, Human T-lymphotropic virus 2
uguuccuacacacagggaca

SEQ ID NO: 4019934 - RNA, 13 nt, Human T-lymphotropic virus 2
uuagccagcccca

SEQ ID NO: 4019935 - RNA, 22 nt, Human T-lymphotropic virus 2
uucaacaggacaucacuccccu

SEQ ID NO: 4019936 - RNA, 14 nt, Human T-lymphotropic virus 2
uucacccucucccc

SEQ ID NO: 4019937 - RNA, 15 nt, Human T-lymphotropic virus 2
uucaugcagacccuc

SEQ ID NO: 4019938 - RNA, 16 nt, Human T-lymphotropic virus 2
uucaugcagacccucc

SEQ ID NO: 4019939 - RNA, 17 nt, Human T-lymphotropic virus 2
uuccacuagcccagcag

SEQ ID NO: 4019940 - RNA, 17 nt, Human T-lymphotropic virus 2
uuccauaaccuucaccu

SEQ ID NO: 4019941 - RNA, 22 nt, Human T-lymphotropic virus 2
uuccugaggaacuccccucauc

SEQ ID NO: 4019942 - RNA, 13 nt, Human T-lymphotropic virus 2
uuccuucccuugc

SEQ ID NO: 4019943 - RNA, 21 nt, Human T-lymphotropic virus 2
uucucgcucuacuccuccucg

SEQ ID NO: 4019944 - RNA, 15 nt, Human T-lymphotropic virus 2
uugacaaagacaucu

SEQ ID NO: 4019945 - RNA, 17 nt, Human T-lymphotropic virus 2
uugacaacggccucccc

SEQ ID NO: 4019946 - RNA, 22 nt, Human T-lymphotropic virus 2
uuuuccaaaucccccuccccaa

SEQ ID NO: 4019947 - RNA, 14 nt, Human T-lymphotropic virus 2
aaaacgaaaccuca

SEQ ID NO: 4019948 - RNA, 13 nt, Human T-lymphotropic virus 2
aaaauagaccuca

SEQ ID NO: 4019949 - RNA, 15 nt, Human T-lymphotropic virus 2
aaaccaucaacucac

SEQ ID NO: 4019950 - RNA, 12 nt, Human T-lymphotropic virus 2
aaacccaggagu

SEQ ID NO: 4019951 - RNA, 19 nt, Human T-lymphotropic virus 2
aaaccugagcgccuccagg

SEQ ID NO: 4019952 - RNA, 18 nt, Human T-lymphotropic virus 2
aaauucgaaaccaaagcc

SEQ ID NO: 4019953 - RNA, 23 nt, Human T-lymphotropic virus 2
aaauucgaaaccaaagccuucca

SEQ ID NO: 4019954 - RNA, 20 nt, Human T-lymphotropic virus 2
aacacaacaaaccccaggcc

SEQ ID NO: 4019955 - RNA, 14 nt, Human T-lymphotropic virus 2
aacagcucuccaga

SEQ ID NO: 4019956 - RNA, 17 nt, Human T-lymphotropic virus 2
aacaucuccauucccca

SEQ ID NO: 4019957 - RNA, 21 nt, Human T-lymphotropic virus 2
aaccauccucuuuccuucccu

SEQ ID NO: 4019958 - RNA, 17 nt, Human T-lymphotropic virus 2
aacccaggaguccuaua

SEQ ID NO: 4019959 - RNA, 23 nt, Human T-lymphotropic virus 2
aaccccaugaggaaaauguuucc

SEQ ID NO: 4019960 - RNA, 13 nt, Human T-lymphotropic virus 2
aacccuucccuug

SEQ ID NO: 4019961 - RNA, 22 nt, Human T-lymphotropic virus 2
aaccucgaccuuaauucccuaa

SEQ ID NO: 4019962 - RNA, 19 nt, Human T-lymphotropic virus 2
aaccugagcgccuccaggc

SEQ ID NO: 4019963 - RNA, 22 nt, Human T-lymphotropic virus 2
aaccuuccccuagacaaugcca

SEQ ID NO: 4019964 - RNA, 16 nt, Human T-lymphotropic virus 2
aacucuagacaaauau

SEQ ID NO: 4019965 - RNA, 22 nt, Human T-lymphotropic virus 2
aacugccguggccgccucaacc

SEQ ID NO: 4019966 - RNA, 11 nt, Human T-lymphotropic virus 2
aagacaaacaa

SEQ ID NO: 4019967 - RNA, 18 nt, Human T-lymphotropic virus 2
aaggacaaaaccaagguc

SEQ ID NO: 4019968 - RNA, 20 nt, Human T-lymphotropic virus 2
aaggccuccacggccucacc

SEQ ID NO: 4019969 - RNA, 19 nt, Human T-lymphotropic virus 2
aagggcuagggcuuccuga

SEQ ID NO: 4019970 - RNA, 19 nt, Human T-lymphotropic virus 2
aagguaagucuccucucag

SEQ ID NO: 4019971 - RNA, 14 nt, Human T-lymphotropic virus 2
aaucccccucccca

SEQ ID NO: 4019972 - RNA, 16 nt, Human T-lymphotropic virus 2
aauccugucuccucuc

SEQ ID NO: 4019973 - RNA, 18 nt, Human T-lymphotropic virus 2
aauuacaacaacucuccc

SEQ ID NO: 4019974 - RNA, 17 nt, Human T-lymphotropic virus 2
aauucgaaaccaaagcc

SEQ ID NO: 4019975 - RNA, 17 nt, Human T-lymphotropic virus 2
aauuuucacccucuccc

SEQ ID NO: 4019976 - RNA, 19 nt, Human T-lymphotropic virus 2
acaaacaccucagccuacc

SEQ ID NO: 4019977 - RNA, 11 nt, Human T-lymphotropic virus 2
acaaagaaugc

SEQ ID NO: 4019978 - RNA, 21 nt, Human T-lymphotropic virus 2
acaacaugucaaagcaagccc

SEQ ID NO: 4019979 - RNA, 23 nt, Human T-lymphotropic virus 2
acaacucaaacccccucaggagg

SEQ ID NO: 4019980 - RNA, 21 nt, Human T-lymphotropic virus 2
acaacuccauuauccuccccc

SEQ ID NO: 4019981 - RNA, 13 nt, Human T-lymphotropic virus 2
acaauacuccucc

SEQ ID NO: 4019982 - RNA, 16 nt, Human T-lymphotropic virus 2
acacaacaaaccccag

SEQ ID NO: 4019983 - RNA, 20 nt, Human T-lymphotropic virus 2
acacauauucuugcccuucc

SEQ ID NO: 4019984 - RNA, 22 nt, Human T-lymphotropic virus 2
acacauauucuugcccuuccga

SEQ ID NO: 4019985 - RNA, 15 nt, Human T-lymphotropic virus 2
acaccaaccuccccg

SEQ ID NO: 4019986 - RNA, 18 nt, Human T-lymphotropic virus 2
acacccaguucaaacucc

SEQ ID NO: 4019987 - RNA, 16 nt, Human T-lymphotropic virus 2
acagacucccuuaucu

SEQ ID NO: 4019988 - RNA, 17 nt, Human T-lymphotropic virus 2
acagacuugccauaccu

SEQ ID NO: 4019989 - RNA, 21 nt, Human T-lymphotropic virus 2
acagagcaccaauuacuccug

SEQ ID NO: 4019990 - RNA, 13 nt, Human T-lymphotropic virus 2
acaggcuacaacc

SEQ ID NO: 4019991 - RNA, 22 nt, Human T-lymphotropic virus 2
acagggccuaggguacuacucg

SEQ ID NO: 4019992 - RNA, 17 nt, Human T-lymphotropic virus 2
acaguccuccacuacca

SEQ ID NO: 4019993 - RNA, 22 nt, Human T-lymphotropic virus 2
acaguccuccacuaccacccau

SEQ ID NO: 4019994 - RNA, 13 nt, Human T-lymphotropic virus 2
acaucacuccccu

SEQ ID NO: 4019995 - RNA, 20 nt, Human T-lymphotropic virus 2
acaucucgauacucccacuc

SEQ ID NO: 4019996 - RNA, 13 nt, Human T-lymphotropic virus 2
acauuccucccau

SEQ ID NO: 4019997 - RNA, 13 nt, Human T-lymphotropic virus 2
accaaccucgccu

SEQ ID NO: 4019998 - RNA, 20 nt, Human T-lymphotropic virus 2
accaagggaagccaaguccc

SEQ ID NO: 4019999 - RNA, 18 nt, Human T-lymphotropic virus 2
accacggcccugacgucc

SEQ ID NO: 4020000 - RNA, 20 nt, Human T-lymphotropic virus 2
accagccauacuucgccuuc

SEQ ID NO: 4020001 - RNA, 13 nt, Human T-lymphotropic virus 2
accaguauucccu

SEQ ID NO: 4020002 - RNA, 19 nt, Human T-lymphotropic virus 2
accaguuuauguccuuggg

SEQ ID NO: 4020003 - RNA, 14 nt, Human T-lymphotropic virus 2
accauccucuuucc

SEQ ID NO: 4020004 - RNA, 21 nt, Human T-lymphotropic virus 2
accauccucuuuccuucccuu

SEQ ID NO: 4020005 - RNA, 15 nt, Human T-lymphotropic virus 2
accaucuaccuccac

SEQ ID NO: 4020006 - RNA, 21 nt, Human T-lymphotropic virus 2
acccaagcaaaauuggccccu

SEQ ID NO: 4020007 - RNA, 18 nt, Human T-lymphotropic virus 2
acccaauuuccaccuuca

SEQ ID NO: 4020008 - RNA, 17 nt, Human T-lymphotropic virus 2
acccacucagccuccac

SEQ ID NO: 4020009 - RNA, 11 nt, Human T-lymphotropic virus 2
accccaaagca

SEQ ID NO: 4020010 - RNA, 13 nt, Human T-lymphotropic virus 2
accccagccccca

SEQ ID NO: 4020011 - RNA, 17 nt, Human T-lymphotropic virus 2
accccauggcagggccc

SEQ ID NO: 4020012 - RNA, 14 nt, Human T-lymphotropic virus 2
accccccacccucc

SEQ ID NO: 4020013 - RNA, 13 nt, Human T-lymphotropic virus 2
acccccugcccau

SEQ ID NO: 4020014 - RNA, 19 nt, Human T-lymphotropic virus 2
accccuacuauucccauaa

SEQ ID NO: 4020015 - RNA, 13 nt, Human T-lymphotropic virus 2
accccucccacca

SEQ ID NO: 4020016 - RNA, 21 nt, Human T-lymphotropic virus 2
accccuccuguuggaucuccc

SEQ ID NO: 4020017 - RNA, 22 nt, Human T-lymphotropic virus 2
acccggguuuccgccugcgcuc

SEQ ID NO: 4020018 - RNA, 19 nt, Human T-lymphotropic virus 2
acccuuacccacuuccccu

SEQ ID NO: 4020019 - RNA, 14 nt, Human T-lymphotropic virus 2
acccuucuccagga

SEQ ID NO: 4020020 - RNA, 20 nt, Human T-lymphotropic virus 2
accgaucccgaccccagagg

SEQ ID NO: 4020021 - RNA, 15 nt, Human T-lymphotropic virus 2
accucacccuuaccc

SEQ ID NO: 4020022 - RNA, 19 nt, Human T-lymphotropic virus 2
accucagaacccacucagc

SEQ ID NO: 4020023 - RNA, 13 nt, Human T-lymphotropic virus 2
accuccaccaugu

SEQ ID NO: 4020024 - RNA, 20 nt, Human T-lymphotropic virus 2
accucccagacgaccccagc

SEQ ID NO: 4020025 - RNA, 21 nt, Human T-lymphotropic virus 2
accucccagacgaccccagcc

SEQ ID NO: 4020026 - RNA, 18 nt, Human T-lymphotropic virus 2
accuccugaacugcuccu

SEQ ID NO: 4020027 - RNA, 19 nt, Human T-lymphotropic virus 2
accuccugaacugcuccuc

SEQ ID NO: 4020028 - RNA, 13 nt, Human T-lymphotropic virus 2
accucuccuuggc

SEQ ID NO: 4020029 - RNA, 14 nt, Human T-lymphotropic virus 2
accuggccuccguc

SEQ ID NO: 4020030 - RNA, 15 nt, Human T-lymphotropic virus 2
accuuaauucccuaa

SEQ ID NO: 4020031 - RNA, 19 nt, Human T-lymphotropic virus 2
acgaggauuagaccuccua

SEQ ID NO: 4020032 - RNA, 15 nt, Human T-lymphotropic virus 2
acgauuacccccugc

SEQ ID NO: 4020033 - RNA, 21 nt, Human T-lymphotropic virus 2
acgccaacaaagaaugccaaa

SEQ ID NO: 4020034 - RNA, 14 nt, Human T-lymphotropic virus 2
acgccccaaggccu

SEQ ID NO: 4020035 - RNA, 13 nt, Human T-lymphotropic virus 2
acgcccuacaaca

SEQ ID NO: 4020036 - RNA, 15 nt, Human T-lymphotropic virus 2
acgugcugccaagcc

SEQ ID NO: 4020037 - RNA, 16 nt, Human T-lymphotropic virus 2
acuaccacccucaccu

SEQ ID NO: 4020038 - RNA, 15 nt, Human T-lymphotropic virus 2
acuacucgccuuccu

SEQ ID NO: 4020039 - RNA, 15 nt, Human T-lymphotropic virus 2
acuagacuguccuaa

SEQ ID NO: 4020040 - RNA, 19 nt, Human T-lymphotropic virus 2
acuagccuaccgacagccu

SEQ ID NO: 4020041 - RNA, 23 nt, Human T-lymphotropic virus 2
acuagccucccgagccagccacc

SEQ ID NO: 4020042 - RNA, 12 nt, Human T-lymphotropic virus 2
acucaccuggga

SEQ ID NO: 4020043 - RNA, 13 nt, Human T-lymphotropic virus 2
acuccccucaucc

SEQ ID NO: 4020044 - RNA, 22 nt, Human T-lymphotropic virus 2
acuccuccgccaccuccccccc

SEQ ID NO: 4020045 - RNA, 20 nt, Human T-lymphotropic virus 2
acugaaaacgaaaccucaac

SEQ ID NO: 4020046 - RNA, 13 nt, Human T-lymphotropic virus 2
acuguccuuccac

SEQ ID NO: 4020047 - RNA, 22 nt, Human T-lymphotropic virus 2
acuuccccuagcgcugaaaaac

SEQ ID NO: 4020048 - RNA, 20 nt, Human T-lymphotropic virus 2
acuuccugaggaacuccccu

SEQ ID NO: 4020049 - RNA, 12 nt, Human T-lymphotropic virus 2
acuucuauacaa

SEQ ID NO: 4020050 - RNA, 11 nt, Human T-lymphotropic virus 2
agacacccggg

SEQ ID NO: 4020051 - RNA, 20 nt, Human T-lymphotropic virus 2
agacucucuuacaccuccca

SEQ ID NO: 4020052 - RNA, 18 nt, Human T-lymphotropic virus 2
agagauuauaaauauccu

SEQ ID NO: 4020053 - RNA, 18 nt, Human T-lymphotropic virus 2
agagcaccaacucaccug

SEQ ID NO: 4020054 - RNA, 22 nt, Human T-lymphotropic virus 2
agaggucuauugcuauaggcag

SEQ ID NO: 4020055 - RNA, 14 nt, Human T-lymphotropic virus 2
agaugccccuggau

SEQ ID NO: 4020056 - RNA, 17 nt, Human T-lymphotropic virus 2
agcaccaauuacuccug

SEQ ID NO: 4020057 - RNA, 19 nt, Human T-lymphotropic virus 2
agcagccguccucaacccc

SEQ ID NO: 4020058 - RNA, 15 nt, Human T-lymphotropic virus 2
agccacgccccccuc

SEQ ID NO: 4020059 - RNA, 16 nt, Human T-lymphotropic virus 2
agccacgccccccucc

SEQ ID NO: 4020060 - RNA, 18 nt, Human T-lymphotropic virus 2
agccacgccccccuccug

SEQ ID NO: 4020061 - RNA, 16 nt, Human T-lymphotropic virus 2
agccacuccaaacacc

SEQ ID NO: 4020062 - RNA, 19 nt, Human T-lymphotropic virus 2
agccccaccaaugaggaau

SEQ ID NO: 4020063 - RNA, 21 nt, Human T-lymphotropic virus 2
agcccccaccaauugcugcca

SEQ ID NO: 4020064 - RNA, 17 nt, Human T-lymphotropic virus 2
agccccuguagcccaac

SEQ ID NO: 4020065 - RNA, 20 nt, Human T-lymphotropic virus 2
agcccuuugcgacuuccuga

SEQ ID NO: 4020066 - RNA, 18 nt, Human T-lymphotropic virus 2
agccguccucaaccccau

SEQ ID NO: 4020067 - RNA, 16 nt, Human T-lymphotropic virus 2
agccucccgagccagc

SEQ ID NO: 4020068 - RNA, 16 nt, Human T-lymphotropic virus 2
agccucuaccccuccc

SEQ ID NO: 4020069 - RNA, 18 nt, Human T-lymphotropic virus 2
agcgcugaaaaacaaggc

SEQ ID NO: 4020070 - RNA, 18 nt, Human T-lymphotropic virus 2
agcuccucugcucuuggc

SEQ ID NO: 4020071 - RNA, 20 nt, Human T-lymphotropic virus 2
agcuuguaucacccucaccc

SEQ ID NO: 4020072 - RNA, 12 nt, Human T-lymphotropic virus 2
aggaacugaaac

SEQ ID NO: 4020073 - RNA, 14 nt, Human T-lymphotropic virus 2
aggacuucuccccu

SEQ ID NO: 4020074 - RNA, 17 nt, Human T-lymphotropic virus 2
aggagccuuccucacca

SEQ ID NO: 4020075 - RNA, 12 nt, Human T-lymphotropic virus 2
aggcccuuccac

SEQ ID NO: 4020076 - RNA, 15 nt, Human T-lymphotropic virus 2
agggaagccaagucc

SEQ ID NO: 4020077 - RNA, 18 nt, Human T-lymphotropic virus 2
agggcuagggcuuccuga

SEQ ID NO: 4020078 - RNA, 17 nt, Human T-lymphotropic virus 2
agguccuuaccccuccc

SEQ ID NO: 4020079 - RNA, 12 nt, Human T-lymphotropic virus 2
aguauucccuua

SEQ ID NO: 4020080 - RNA, 16 nt, Human T-lymphotropic virus 2
aguccauccuggaagu

SEQ ID NO: 4020081 - RNA, 20 nt, Human T-lymphotropic virus 2
agucuccgacgagagucucg

SEQ ID NO: 4020082 - RNA, 22 nt, Human T-lymphotropic virus 2
auacucccacucaucccccugc

SEQ ID NO: 4020083 - RNA, 15 nt, Human T-lymphotropic virus 2
aucaagucuccccua

SEQ ID NO: 4020084 - RNA, 14 nt, Human T-lymphotropic virus 2
aucagcuccccucc

SEQ ID NO: 4020085 - RNA, 16 nt, Human T-lymphotropic virus 2
aucagcuccccucccu

SEQ ID NO: 4020086 - RNA, 12 nt, Human T-lymphotropic virus 2
aucccucgccuc

SEQ ID NO: 4020087 - RNA, 15 nt, Human T-lymphotropic virus 2
aucccucgccucccc

SEQ ID NO: 4020088 - RNA, 18 nt, Human T-lymphotropic virus 2
aucccucgccuccccucc

SEQ ID NO: 4020089 - RNA, 19 nt, Human T-lymphotropic virus 2
aucccucgccuccccuccu

SEQ ID NO: 4020090 - RNA, 15 nt, Human T-lymphotropic virus 2
auccuaggagagauc

SEQ ID NO: 4020091 - RNA, 17 nt, Human T-lymphotropic virus 2
auccucauucaccacau

SEQ ID NO: 4020092 - RNA, 17 nt, Human T-lymphotropic virus 2
auccucuuuccuucccu

SEQ ID NO: 4020093 - RNA, 12 nt, Human T-lymphotropic virus 2
auccugucuccu

SEQ ID NO: 4020094 - RNA, 16 nt, Human T-lymphotropic virus 2
aucuuggacuguccca

SEQ ID NO: 4020095 - RNA, 15 nt, Human T-lymphotropic virus 2
aucuuuccaccacaa

SEQ ID NO: 4020096 - RNA, 20 nt, Human T-lymphotropic virus 2
augccauuacuaccacccuc

SEQ ID NO: 4020097 - RNA, 14 nt, Human T-lymphotropic virus 2
auggccuucccuua

SEQ ID NO: 4020098 - RNA, 14 nt, Human T-lymphotropic virus 2
augggacaaacacc

SEQ ID NO: 4020099 - RNA, 20 nt, Human T-lymphotropic virus 2
auucagucucacacauuuuc

SEQ ID NO: 4020100 - RNA, 17 nt, Human T-lymphotropic virus 2
auuccauaaccuuggca

SEQ ID NO: 4020101 - RNA, 14 nt, Human T-lymphotropic virus 2
auuccccagccaug

SEQ ID NO: 4020102 - RNA, 15 nt, Human T-lymphotropic virus 2
auucugccaccccag

SEQ ID NO: 4020103 - RNA, 14 nt, Human T-lymphotropic virus 2
auucugcccuucac

SEQ ID NO: 4020104 - RNA, 13 nt, Human T-lymphotropic virus 2
auuggggccuucc

SEQ ID NO: 4020105 - RNA, 20 nt, Human T-lymphotropic virus 2
auuggugucccgucucaggu

SEQ ID NO: 4020106 - RNA, 14 nt, Human T-lymphotropic virus 2
auuucacccaggaa

SEQ ID NO: 4020107 - RNA, 16 nt, Human T-lymphotropic virus 2
caaaacauccuccggg

SEQ ID NO: 4020108 - RNA, 13 nt, Human T-lymphotropic virus 2
caaaccaccuccc

SEQ ID NO: 4020109 - RNA, 14 nt, Human T-lymphotropic virus 2
caaaccaccuccca

SEQ ID NO: 4020110 - RNA, 12 nt, Human T-lymphotropic virus 2
caaacccuccag

SEQ ID NO: 4020111 - RNA, 15 nt, Human T-lymphotropic virus 2
caaaccuccucccga

SEQ ID NO: 4020112 - RNA, 17 nt, Human T-lymphotropic virus 2
caaagccuuccaucccu

SEQ ID NO: 4020113 - RNA, 15 nt, Human T-lymphotropic virus 2
caacaacucucccag

SEQ ID NO: 4020114 - RNA, 21 nt, Human T-lymphotropic virus 2
caacaggacaucacuccccug

SEQ ID NO: 4020115 - RNA, 15 nt, Human T-lymphotropic virus 2
caacaucccugucuc

SEQ ID NO: 4020116 - RNA, 17 nt, Human T-lymphotropic virus 2
caacccaccacuggcuu

SEQ ID NO: 4020117 - RNA, 22 nt, Human T-lymphotropic virus 2
caacgacuacacccccccugcc

SEQ ID NO: 4020118 - RNA, 21 nt, Human T-lymphotropic virus 2
caacgccgcccucuuggcagg

SEQ ID NO: 4020119 - RNA, 22 nt, Human T-lymphotropic virus 2
caagaccaucuaccuccaccau

SEQ ID NO: 4020120 - RNA, 17 nt, Human T-lymphotropic virus 2
caagcaguaccagccau

SEQ ID NO: 4020121 - RNA, 18 nt, Human T-lymphotropic virus 2
caagccauggccuucccu

SEQ ID NO: 4020122 - RNA, 15 nt, Human T-lymphotropic virus 2
caaggacaguucagg

SEQ ID NO: 4020123 - RNA, 12 nt, Human T-lymphotropic virus 2
caaggcucugac

SEQ ID NO: 4020124 - RNA, 20 nt, Human T-lymphotropic virus 2
caagguccuuaccccuccca

SEQ ID NO: 4020125 - RNA, 16 nt, Human T-lymphotropic virus 2
caagguuccaccugcc

SEQ ID NO: 4020126 - RNA, 15 nt, Human T-lymphotropic virus 2
caaguaaaggcucug

SEQ ID NO: 4020127 - RNA, 17 nt, Human T-lymphotropic virus 2
caauagccacuccaaac

SEQ ID NO: 4020128 - RNA, 19 nt, Human T-lymphotropic virus 2
caaucccuauauucugccc

SEQ ID NO: 4020129 - RNA, 14 nt, Human T-lymphotropic virus 2
caauccugucuccu

SEQ ID NO: 4020130 - RNA, 12 nt, Human T-lymphotropic virus 2
caauugcugcca

SEQ ID NO: 4020131 - RNA, 14 nt, Human T-lymphotropic virus 2
caauuucccaggaa

SEQ ID NO: 4020132 - RNA, 20 nt, Human T-lymphotropic virus 2
cacaacaaauggaccaucau

SEQ ID NO: 4020133 - RNA, 16 nt, Human T-lymphotropic virus 2
cacacaaacaauccca

SEQ ID NO: 4020134 - RNA, 20 nt, Human T-lymphotropic virus 2
cacaccccccacccuccgac

SEQ ID NO: 4020135 - RNA, 17 nt, Human T-lymphotropic virus 2
cacacuaacagcccccu

SEQ ID NO: 4020136 - RNA, 15 nt, Human T-lymphotropic virus 2
caccaaccuccccga

SEQ ID NO: 4020137 - RNA, 18 nt, Human T-lymphotropic virus 2
caccaaugauuuccggcc

SEQ ID NO: 4020138 - RNA, 19 nt, Human T-lymphotropic virus 2
caccacaauguuccaaccc

SEQ ID NO: 4020139 - RNA, 22 nt, Human T-lymphotropic virus 2
caccagaugucagacucgccuc

SEQ ID NO: 4020140 - RNA, 19 nt, Human T-lymphotropic virus 2
caccaucuuaacucuagac

SEQ ID NO: 4020141 - RNA, 20 nt, Human T-lymphotropic virus 2
cacccaggaagucagccaag

SEQ ID NO: 4020142 - RNA, 18 nt, Human T-lymphotropic virus 2
caccccacaacaacucca

SEQ ID NO: 4020143 - RNA, 14 nt, Human T-lymphotropic virus 2
cacccucucccccg

SEQ ID NO: 4020144 - RNA, 15 nt, Human T-lymphotropic virus 2
caccgacccucuggu

SEQ ID NO: 4020145 - RNA, 18 nt, Human T-lymphotropic virus 2
caccucagaacccacuca

SEQ ID NO: 4020146 - RNA, 13 nt, Human T-lymphotropic virus 2
caccuccccaagu

SEQ ID NO: 4020147 - RNA, 22 nt, Human T-lymphotropic virus 2
caccucuccuuccccagggccc

SEQ ID NO: 4020148 - RNA, 16 nt, Human T-lymphotropic virus 2
caccuucccccaccuc

SEQ ID NO: 4020149 - RNA, 14 nt, Human T-lymphotropic virus 2
cacggcccccugcc

SEQ ID NO: 4020150 - RNA, 16 nt, Human T-lymphotropic virus 2
cacuaccacccauucc

SEQ ID NO: 4020151 - RNA, 16 nt, Human T-lymphotropic virus 2
cacucagccuccacca

SEQ ID NO: 4020152 - RNA, 19 nt, Human T-lymphotropic virus 2
cacuccaacugcugaugcc

SEQ ID NO: 4020153 - RNA, 19 nt, Human T-lymphotropic virus 2
cacuccaucuuaacaaccc

SEQ ID NO: 4020154 - RNA, 23 nt, Human T-lymphotropic virus 2
cacuggcuuaacuuucuccaggc

SEQ ID NO: 4020155 - RNA, 13 nt, Human T-lymphotropic virus 2
cacuuauacccca

SEQ ID NO: 4020156 - RNA, 19 nt, Human T-lymphotropic virus 2
cacuucucuaagugcggcu

SEQ ID NO: 4020157 - RNA, 21 nt, Human T-lymphotropic virus 2
cagaacccacucagccuccac

SEQ ID NO: 4020158 - RNA, 21 nt, Human T-lymphotropic virus 2
cagacaauuaggagccuuccu

SEQ ID NO: 4020159 - RNA, 17 nt, Human T-lymphotropic virus 2
cagacucgccucucccu

SEQ ID NO: 4020160 - RNA, 18 nt, Human T-lymphotropic virus 2
cagacucgccucucccug

SEQ ID NO: 4020161 - RNA, 14 nt, Human T-lymphotropic virus 2
cagagcaccaacuc

SEQ ID NO: 4020162 - RNA, 19 nt, Human T-lymphotropic virus 2
cagaugucagacucgccuc

SEQ ID NO: 4020163 - RNA, 13 nt, Human T-lymphotropic virus 2
cagcaagggcuag

SEQ ID NO: 4020164 - RNA, 19 nt, Human T-lymphotropic virus 2
cagccacaccaaccucccc

SEQ ID NO: 4020165 - RNA, 21 nt, Human T-lymphotropic virus 2
cagccacgccccccuccuggc

SEQ ID NO: 4020166 - RNA, 22 nt, Human T-lymphotropic virus 2
cagccauacuucgccuucacca

SEQ ID NO: 4020167 - RNA, 17 nt, Human T-lymphotropic virus 2
cagcccauuucccagga

SEQ ID NO: 4020168 - RNA, 16 nt, Human T-lymphotropic virus 2
cagccccaccaaugag

SEQ ID NO: 4020169 - RNA, 17 nt, Human T-lymphotropic virus 2
cagccccacccucuucg

SEQ ID NO: 4020170 - RNA, 16 nt, Human T-lymphotropic virus 2
cagcccccaccaauug

SEQ ID NO: 4020171 - RNA, 11 nt, Human T-lymphotropic virus 2
cagcccccuug

SEQ ID NO: 4020172 - RNA, 15 nt, Human T-lymphotropic virus 2
cagccuaggcccucc

SEQ ID NO: 4020173 - RNA, 22 nt, Human T-lymphotropic virus 2
cagccuuaccccaccuacagac

SEQ ID NO: 4020174 - RNA, 17 nt, Human T-lymphotropic virus 2
cagccuugcucuccaua

SEQ ID NO: 4020175 - RNA, 20 nt, Human T-lymphotropic virus 2
cagcgccguucuucaggcca

SEQ ID NO: 4020176 - RNA, 16 nt, Human T-lymphotropic virus 2
cagcucauaggcccug

SEQ ID NO: 4020177 - RNA, 20 nt, Human T-lymphotropic virus 2
cagcucauaggcccuggcag

SEQ ID NO: 4020178 - RNA, 13 nt, Human T-lymphotropic virus 2
cagcucuccagaa

SEQ ID NO: 4020179 - RNA, 23 nt, Human T-lymphotropic virus 2
cagcucugccaaucuuuccacca

SEQ ID NO: 4020180 - RNA, 23 nt, Human T-lymphotropic virus 2
caggaaccacgacuccucaggcc

SEQ ID NO: 4020181 - RNA, 18 nt, Human T-lymphotropic virus 2
caggagcccccucagcuc

SEQ ID NO: 4020182 - RNA, 23 nt, Human T-lymphotropic virus 2
caggaggaaggggaaccccuccu

SEQ ID NO: 4020183 - RNA, 17 nt, Human T-lymphotropic virus 2
caggagguggcucgcuc

SEQ ID NO: 4020184 - RNA, 13 nt, Human T-lymphotropic virus 2
caggcauaaccau

SEQ ID NO: 4020185 - RNA, 16 nt, Human T-lymphotropic virus 2
caggcuacaaccccau

SEQ ID NO: 4020186 - RNA, 21 nt, Human T-lymphotropic virus 2
caggcuacaaccccauggcag

SEQ ID NO: 4020187 - RNA, 13 nt, Human T-lymphotropic virus 2
cagggcaagacca

SEQ ID NO: 4020188 - RNA, 21 nt, Human T-lymphotropic virus 2
cagggggcuaucaacccacca

SEQ ID NO: 4020189 - RNA, 13 nt, Human T-lymphotropic virus 2
caguaaaagccuu

SEQ ID NO: 4020190 - RNA, 13 nt, Human T-lymphotropic virus 2
caguaccagccau

SEQ ID NO: 4020191 - RNA, 13 nt, Human T-lymphotropic virus 2
caguccuccacua

SEQ ID NO: 4020192 - RNA, 15 nt, Human T-lymphotropic virus 2
cagucucacacauuu

SEQ ID NO: 4020193 - RNA, 13 nt, Human T-lymphotropic virus 2
cauaaaaucccaa

SEQ ID NO: 4020194 - RNA, 19 nt, Human T-lymphotropic virus 2
cauacuuuuagccagcccc

SEQ ID NO: 4020195 - RNA, 17 nt, Human T-lymphotropic virus 2
caucaccggcuggggac

SEQ ID NO: 4020196 - RNA, 17 nt, Human T-lymphotropic virus 2
caucccaacccuucccu

SEQ ID NO: 4020197 - RNA, 13 nt, Human T-lymphotropic virus 2
cauccucuccaag

SEQ ID NO: 4020198 - RNA, 21 nt, Human T-lymphotropic virus 2
caucucccaccuuacccaggc

SEQ ID NO: 4020199 - RNA, 19 nt, Human T-lymphotropic virus 2
caucuuaacaaccccaggu

SEQ ID NO: 4020200 - RNA, 14 nt, Human T-lymphotropic virus 2
caugccauucaaca

SEQ ID NO: 4020201 - RNA, 23 nt, Human T-lymphotropic virus 2
cauggccuuccaauuucccagga

SEQ ID NO: 4020202 - RNA, 15 nt, Human T-lymphotropic virus 2
cauggccuucccuua

SEQ ID NO: 4020203 - RNA, 18 nt, Human T-lymphotropic virus 2
cauguacucuacaccccc

SEQ ID NO: 4020204 - RNA, 16 nt, Human T-lymphotropic virus 2
cauuacuaccacccuc

SEQ ID NO: 4020205 - RNA, 21 nt, Human T-lymphotropic virus 2
cauuccccaacaaaccuccuc

SEQ ID NO: 4020206 - RNA, 16 nt, Human T-lymphotropic virus 2
cauugcaaucccucca

SEQ ID NO: 4020207 - RNA, 19 nt, Human T-lymphotropic virus 2
ccaacaaaccuccucccga

SEQ ID NO: 4020208 - RNA, 17 nt, Human T-lymphotropic virus 2
ccaacccuucuccagga

SEQ ID NO: 4020209 - RNA, 19 nt, Human T-lymphotropic virus 2
ccaaccgucugguccgugg

SEQ ID NO: 4020210 - RNA, 17 nt, Human T-lymphotropic virus 2
ccaaccucgccuacagg

SEQ ID NO: 4020211 - RNA, 22 nt, Human T-lymphotropic virus 2
ccaacuccaauacccaaagccc

SEQ ID NO: 4020212 - RNA, 20 nt, Human T-lymphotropic virus 2
ccaagcaaaauuggccccug

SEQ ID NO: 4020213 - RNA, 21 nt, Human T-lymphotropic virus 2
ccaagcaaaauuggccccugg

SEQ ID NO: 4020214 - RNA, 14 nt, Human T-lymphotropic virus 2
ccaagcggccucgg

SEQ ID NO: 4020215 - RNA, 18 nt, Human T-lymphotropic virus 2
ccaaguaaaggcucugac

SEQ ID NO: 4020216 - RNA, 23 nt, Human T-lymphotropic virus 2
ccaaugccauuacuaccacccuc

SEQ ID NO: 4020217 - RNA, 14 nt, Human T-lymphotropic virus 2
ccacaacaacucca

SEQ ID NO: 4020218 - RNA, 17 nt, Human T-lymphotropic virus 2
ccacaacaacuccaugc

SEQ ID NO: 4020219 - RNA, 19 nt, Human T-lymphotropic virus 2
ccaccaauugcugccaaua

SEQ ID NO: 4020220 - RNA, 18 nt, Human T-lymphotropic virus 2
ccaccauguccgcagcca

SEQ ID NO: 4020221 - RNA, 18 nt, Human T-lymphotropic virus 2
ccacccugccaggcaaua

SEQ ID NO: 4020222 - RNA, 14 nt, Human T-lymphotropic virus 2
ccaccucaggcacu

SEQ ID NO: 4020223 - RNA, 21 nt, Human T-lymphotropic virus 2
ccacgacuccucaggccaauu

SEQ ID NO: 4020224 - RNA, 13 nt, Human T-lymphotropic virus 2
ccacggccucacc

SEQ ID NO: 4020225 - RNA, 20 nt, Human T-lymphotropic virus 2
ccacgggcuuuccccaacuc

SEQ ID NO: 4020226 - RNA, 12 nt, Human T-lymphotropic virus 2
ccacuagcccag

SEQ ID NO: 4020227 - RNA, 18 nt, Human T-lymphotropic virus 2
ccacuuauaccccauguc

SEQ ID NO: 4020228 - RNA, 17 nt, Human T-lymphotropic virus 2
ccagacgaccccagccc

SEQ ID NO: 4020229 - RNA, 22 nt, Human T-lymphotropic virus 2
ccagcagagccgaugcacacuc

SEQ ID NO: 4020230 - RNA, 22 nt, Human T-lymphotropic virus 2
ccagccauacuucgccuucacc

SEQ ID NO: 4020231 - RNA, 22 nt, Human T-lymphotropic virus 2
ccagccccuguagcccaaccca

SEQ ID NO: 4020232 - RNA, 15 nt, Human T-lymphotropic virus 2
ccagccucucauccu

SEQ ID NO: 4020233 - RNA, 16 nt, Human T-lymphotropic virus 2
ccauaaccuuggcagc

SEQ ID NO: 4020234 - RNA, 18 nt, Human T-lymphotropic virus 2
ccauacuucgccuucacc

SEQ ID NO: 4020235 - RNA, 20 nt, Human T-lymphotropic virus 2
ccaucuuacguucccuagcg

SEQ ID NO: 4020236 - RNA, 19 nt, Human T-lymphotropic virus 2
ccaugucauauucugccac

SEQ ID NO: 4020237 - RNA, 18 nt, Human T-lymphotropic virus 2
ccauguccgcagccacac

SEQ ID NO: 4020238 - RNA, 19 nt, Human T-lymphotropic virus 2
ccauguuccccccccuuac

SEQ ID NO: 4020239 - RNA, 22 nt, Human T-lymphotropic virus 2
ccauucucgcucuacuccuccu

SEQ ID NO: 4020240 - RNA, 17 nt, Human T-lymphotropic virus 2
ccauugcuaccaaccuc

SEQ ID NO: 4020241 - RNA, 23 nt, Human T-lymphotropic virus 2
cccacaacucaaacccccucagg

SEQ ID NO: 4020242 - RNA, 21 nt, Human T-lymphotropic virus 2
cccagccauguaacuauggcc

SEQ ID NO: 4020243 - RNA, 21 nt, Human T-lymphotropic virus 2
cccaggauuuggacagagccu

SEQ ID NO: 4020244 - RNA, 17 nt, Human T-lymphotropic virus 2
cccaucaaaacccagga

SEQ ID NO: 4020245 - RNA, 15 nt, Human T-lymphotropic virus 2
cccauggcagggccc

SEQ ID NO: 4020246 - RNA, 17 nt, Human T-lymphotropic virus 2
ccccaagguuccaccug

SEQ ID NO: 4020247 - RNA, 14 nt, Human T-lymphotropic virus 2
ccccagcccccacc

SEQ ID NO: 4020248 - RNA, 23 nt, Human T-lymphotropic virus 2
ccccagggggcuaucaacccacc

SEQ ID NO: 4020249 - RNA, 21 nt, Human T-lymphotropic virus 2
ccccaguucaugcagacccuc

SEQ ID NO: 4020250 - RNA, 17 nt, Human T-lymphotropic virus 2
cccccaagguuccaccu

SEQ ID NO: 4020251 - RNA, 12 nt, Human T-lymphotropic virus 2
ccccccccuucc

SEQ ID NO: 4020252 - RNA, 18 nt, Human T-lymphotropic virus 2
cccccuccacguccugga

SEQ ID NO: 4020253 - RNA, 23 nt, Human T-lymphotropic virus 2
ccccgucuccaguccauccugga

SEQ ID NO: 4020254 - RNA, 21 nt, Human T-lymphotropic virus 2
ccccuggcuuggcuccacacc

SEQ ID NO: 4020255 - RNA, 17 nt, Human T-lymphotropic virus 2
cccgcccuaccucuccu

SEQ ID NO: 4020256 - RNA, 16 nt, Human T-lymphotropic virus 2
cccgcuccucacgcuc

SEQ ID NO: 4020257 - RNA, 13 nt, Human T-lymphotropic virus 2
cccgcuccuccau

SEQ ID NO: 4020258 - RNA, 18 nt, Human T-lymphotropic virus 2
cccgcugcuccuccgcca

SEQ ID NO: 4020259 - RNA, 13 nt, Human T-lymphotropic virus 2
cccguaccuccuc

SEQ ID NO: 4020260 - RNA, 18 nt, Human T-lymphotropic virus 2
cccuaccauugacccauc

SEQ ID NO: 4020261 - RNA, 14 nt, Human T-lymphotropic virus 2
cccuaccucuccuu

SEQ ID NO: 4020262 - RNA, 17 nt, Human T-lymphotropic virus 2
cccuaccucuccuuggc

SEQ ID NO: 4020263 - RNA, 19 nt, Human T-lymphotropic virus 2
cccucaccgacccucuggu

SEQ ID NO: 4020264 - RNA, 22 nt, Human T-lymphotropic virus 2
cccucaccucuccuuccccagg

SEQ ID NO: 4020265 - RNA, 22 nt, Human T-lymphotropic virus 2
cccucagcucauaggcccuggc

SEQ ID NO: 4020266 - RNA, 16 nt, Human T-lymphotropic virus 2
cccucccaccacuccu

SEQ ID NO: 4020267 - RNA, 23 nt, Human T-lymphotropic virus 2
cccuccuguuggaucucccuucc

SEQ ID NO: 4020268 - RNA, 14 nt, Human T-lymphotropic virus 2
cccucgccuccccu

SEQ ID NO: 4020269 - RNA, 14 nt, Human T-lymphotropic virus 2
cccucuuggcaggc

SEQ ID NO: 4020270 - RNA, 16 nt, Human T-lymphotropic virus 2
cccuguagcccaaccc

SEQ ID NO: 4020271 - RNA, 16 nt, Human T-lymphotropic virus 2
cccuuccaccucaggc

SEQ ID NO: 4020272 - RNA, 18 nt, Human T-lymphotropic virus 2
ccgaaccuggccuccguc

SEQ ID NO: 4020273 - RNA, 15 nt, Human T-lymphotropic virus 2
ccgaucucacuagcc

SEQ ID NO: 4020274 - RNA, 14 nt, Human T-lymphotropic virus 2
ccgauggcuccccu

SEQ ID NO: 4020275 - RNA, 17 nt, Human T-lymphotropic virus 2
ccgccaaauccaggccc

SEQ ID NO: 4020276 - RNA, 15 nt, Human T-lymphotropic virus 2
ccgccugcgcucggc

SEQ ID NO: 4020277 - RNA, 16 nt, Human T-lymphotropic virus 2
ccgccugcgcucggcu

SEQ ID NO: 4020278 - RNA, 23 nt, Human T-lymphotropic virus 2
ccgcuccuccaucccaacccuuc

SEQ ID NO: 4020279 - RNA, 15 nt, Human T-lymphotropic virus 2
ccgguaaagcuccac

SEQ ID NO: 4020280 - RNA, 19 nt, Human T-lymphotropic virus 2
ccgucucccggccucggca

SEQ ID NO: 4020281 - RNA, 22 nt, Human T-lymphotropic virus 2
ccguggagcgcagcaagggcua

SEQ ID NO: 4020282 - RNA, 15 nt, Human T-lymphotropic virus 2
ccuaacccccuccac

SEQ ID NO: 4020283 - RNA, 21 nt, Human T-lymphotropic virus 2
ccuaagagccaccaaugccau

SEQ ID NO: 4020284 - RNA, 19 nt, Human T-lymphotropic virus 2
ccuaccauugacccaucca

SEQ ID NO: 4020285 - RNA, 15 nt, Human T-lymphotropic virus 2
ccuagacaaugccau

SEQ ID NO: 4020286 - RNA, 13 nt, Human T-lymphotropic virus 2
ccuaucucuggcu

SEQ ID NO: 4020287 - RNA, 17 nt, Human T-lymphotropic virus 2
ccucaaauaguuccucu

SEQ ID NO: 4020288 - RNA, 14 nt, Human T-lymphotropic virus 2
ccucaacgccgccc

SEQ ID NO: 4020289 - RNA, 23 nt, Human T-lymphotropic virus 2
ccucaagguccuuaccccuccca

SEQ ID NO: 4020290 - RNA, 15 nt, Human T-lymphotropic virus 2
ccucagaacccacuc

SEQ ID NO: 4020291 - RNA, 13 nt, Human T-lymphotropic virus 2
ccuccaccauguc

SEQ ID NO: 4020292 - RNA, 15 nt, Human T-lymphotropic virus 2
ccuccaggccuuaaa

SEQ ID NO: 4020293 - RNA, 18 nt, Human T-lymphotropic virus 2
ccuccaucccaacccuuc

SEQ ID NO: 4020294 - RNA, 19 nt, Human T-lymphotropic virus 2
ccuccaucccaacccuucc

SEQ ID NO: 4020295 - RNA, 14 nt, Human T-lymphotropic virus 2
ccucccaacccuuc

SEQ ID NO: 4020296 - RNA, 17 nt, Human T-lymphotropic virus 2
ccucccaacccuucucc

SEQ ID NO: 4020297 - RNA, 14 nt, Human T-lymphotropic virus 2
ccucccgaaccauc

SEQ ID NO: 4020298 - RNA, 21 nt, Human T-lymphotropic virus 2
ccuccgauuucgacuuccagc

SEQ ID NO: 4020299 - RNA, 14 nt, Human T-lymphotropic virus 2
ccuccgccaccucc

SEQ ID NO: 4020300 - RNA, 13 nt, Human T-lymphotropic virus 2
ccuccuaccacuc

SEQ ID NO: 4020301 - RNA, 15 nt, Human T-lymphotropic virus 2
ccuccuaccacucca

SEQ ID NO: 4020302 - RNA, 17 nt, Human T-lymphotropic virus 2
ccuccugaacugcuccu

SEQ ID NO: 4020303 - RNA, 13 nt, Human T-lymphotropic virus 2
ccuccuggccccu

SEQ ID NO: 4020304 - RNA, 20 nt, Human T-lymphotropic virus 2
ccuccuuccccacccagaga

SEQ ID NO: 4020305 - RNA, 15 nt, Human T-lymphotropic virus 2
ccucgaacaccuucc

SEQ ID NO: 4020306 - RNA, 19 nt, Human T-lymphotropic virus 2
ccucgcucccguaccuccu

SEQ ID NO: 4020307 - RNA, 17 nt, Human T-lymphotropic virus 2
ccucggggaucagcucc

SEQ ID NO: 4020308 - RNA, 23 nt, Human T-lymphotropic virus 2
ccucuaacccccgcucacauucc

SEQ ID NO: 4020309 - RNA, 19 nt, Human T-lymphotropic virus 2
ccucucaggucgagcucgg

SEQ ID NO: 4020310 - RNA, 19 nt, Human T-lymphotropic virus 2
ccucuucgccgucacugaa

SEQ ID NO: 4020311 - RNA, 18 nt, Human T-lymphotropic virus 2
ccugaacugcuccuccca

SEQ ID NO: 4020312 - RNA, 23 nt, Human T-lymphotropic virus 2
ccugacgucccuccccccuagga

SEQ ID NO: 4020313 - RNA, 17 nt, Human T-lymphotropic virus 2
ccugagcgccuccaggc

SEQ ID NO: 4020314 - RNA, 13 nt, Human T-lymphotropic virus 2
ccuggccccugcc

SEQ ID NO: 4020315 - RNA, 14 nt, Human T-lymphotropic virus 2
ccuggggaaaaacc

SEQ ID NO: 4020316 - RNA, 15 nt, Human T-lymphotropic virus 2
ccuuacccacuuccc

SEQ ID NO: 4020317 - RNA, 15 nt, Human T-lymphotropic virus 2
ccuuaccccaaagca

SEQ ID NO: 4020318 - RNA, 19 nt, Human T-lymphotropic virus 2
ccuuaccccucccaccacu

SEQ ID NO: 4020319 - RNA, 20 nt, Human T-lymphotropic virus 2
ccuuaccccucccaccacuc

SEQ ID NO: 4020320 - RNA, 12 nt, Human T-lymphotropic virus 2
ccuuauccccaa

SEQ ID NO: 4020321 - RNA, 17 nt, Human T-lymphotropic virus 2
ccuucaaugacggcuca

SEQ ID NO: 4020322 - RNA, 19 nt, Human T-lymphotropic virus 2
ccuuccgugggaccgucuc

SEQ ID NO: 4020323 - RNA, 18 nt, Human T-lymphotropic virus 2
ccuuucuucccucucccg

SEQ ID NO: 4020324 - RNA, 19 nt, Human T-lymphotropic virus 2
ccuuugcgacuuccugagg

SEQ ID NO: 4020325 - RNA, 23 nt, Human T-lymphotropic virus 2
cgaaccauccucuuuccuucccu

SEQ ID NO: 4020326 - RNA, 12 nt, Human T-lymphotropic virus 2
cgacauaaccag

SEQ ID NO: 4020327 - RNA, 15 nt, Human T-lymphotropic virus 2
cgacuagccucccga

SEQ ID NO: 4020328 - RNA, 17 nt, Human T-lymphotropic virus 2
cgagcucggcugccccu

SEQ ID NO: 4020329 - RNA, 15 nt, Human T-lymphotropic virus 2
cgaucucacuagccu

SEQ ID NO: 4020330 - RNA, 21 nt, Human T-lymphotropic virus 2
cgcaucaagcauucuacccau

SEQ ID NO: 4020331 - RNA, 22 nt, Human T-lymphotropic virus 2
cgccagugggcaaaccaacacc

SEQ ID NO: 4020332 - RNA, 19 nt, Human T-lymphotropic virus 2
cgccauuggggccuuccuc

SEQ ID NO: 4020333 - RNA, 12 nt, Human T-lymphotropic virus 2
cgccccaaggcc

SEQ ID NO: 4020334 - RNA, 16 nt, Human T-lymphotropic virus 2
cgccccccuccuggcc

SEQ ID NO: 4020335 - RNA, 20 nt, Human T-lymphotropic virus 2
cgcccuaccucuccuuggcc

SEQ ID NO: 4020336 - RNA, 12 nt, Human T-lymphotropic virus 2
cgccgucacuga

SEQ ID NO: 4020337 - RNA, 21 nt, Human T-lymphotropic virus 2
cgccucaaccccgcccuaccu

SEQ ID NO: 4020338 - RNA, 18 nt, Human T-lymphotropic virus 2
cgccuuaacguggcccuu

SEQ ID NO: 4020339 - RNA, 18 nt, Human T-lymphotropic virus 2
cgcguugucagcucuccu

SEQ ID NO: 4020340 - RNA, 19 nt, Human T-lymphotropic virus 2
cgcguugucagcucuccuc

SEQ ID NO: 4020341 - RNA, 16 nt, Human T-lymphotropic virus 2
cgcugcuccuccgcca

SEQ ID NO: 4020342 - RNA, 13 nt, Human T-lymphotropic virus 2
cggcaccuccuga

SEQ ID NO: 4020343 - RNA, 14 nt, Human T-lymphotropic virus 2
cggcccccucuuga

SEQ ID NO: 4020344 - RNA, 21 nt, Human T-lymphotropic virus 2
cggcuccuccaugacccuccu

SEQ ID NO: 4020345 - RNA, 18 nt, Human T-lymphotropic virus 2
cggggaucagcuccccuc

SEQ ID NO: 4020346 - RNA, 19 nt, Human T-lymphotropic virus 2
cgucucccggccucggcac

SEQ ID NO: 4020347 - RNA, 18 nt, Human T-lymphotropic virus 2
cguggagcgcagcaaggg

SEQ ID NO: 4020348 - RNA, 20 nt, Human T-lymphotropic virus 2
cguggagcgcagcaagggcu

SEQ ID NO: 4020349 - RNA, 18 nt, Human T-lymphotropic virus 2
cguggauagauccagccu

SEQ ID NO: 4020350 - RNA, 21 nt, Human T-lymphotropic virus 2
cuaacccccgcucacauuccu

SEQ ID NO: 4020351 - RNA, 23 nt, Human T-lymphotropic virus 2
cuaacccccuccacguccuggac

SEQ ID NO: 4020352 - RNA, 15 nt, Human T-lymphotropic virus 2
cuaacccuccaggca

SEQ ID NO: 4020353 - RNA, 14 nt, Human T-lymphotropic virus 2
cuacaacaaugcca

SEQ ID NO: 4020354 - RNA, 19 nt, Human T-lymphotropic virus 2
cuacaacauaacugccgug

SEQ ID NO: 4020355 - RNA, 22 nt, Human T-lymphotropic virus 2
cuacaacauuauggccagcucu

SEQ ID NO: 4020356 - RNA, 15 nt, Human T-lymphotropic virus 2
cuacaaugccccuac

SEQ ID NO: 4020357 - RNA, 13 nt, Human T-lymphotropic virus 2
cuaccccucccaa

SEQ ID NO: 4020358 - RNA, 13 nt, Human T-lymphotropic virus 2
cuacgugcugcca

SEQ ID NO: 4020359 - RNA, 18 nt, Human T-lymphotropic virus 2
cuacgugcugccaagcca

SEQ ID NO: 4020360 - RNA, 15 nt, Human T-lymphotropic virus 2
cuacuccuccucguc

SEQ ID NO: 4020361 - RNA, 19 nt, Human T-lymphotropic virus 2
cuaggaacaggaacagcuc

SEQ ID NO: 4020362 - RNA, 18 nt, Human T-lymphotropic virus 2
cuagggcuuccugaaccu

SEQ ID NO: 4020363 - RNA, 14 nt, Human T-lymphotropic virus 2
cuauaccucccaga

SEQ ID NO: 4020364 - RNA, 17 nt, Human T-lymphotropic virus 2
cuaucuuacauccccca

SEQ ID NO: 4020365 - RNA, 23 nt, Human T-lymphotropic virus 2
cucaaaaggcagcguacguucuc

SEQ ID NO: 4020366 - RNA, 17 nt, Human T-lymphotropic virus 2
cucaaacccccucagga

SEQ ID NO: 4020367 - RNA, 19 nt, Human T-lymphotropic virus 2
cucaaccccgcccuaccuc

SEQ ID NO: 4020368 - RNA, 15 nt, Human T-lymphotropic virus 2
cucacacaaacaauc

SEQ ID NO: 4020369 - RNA, 13 nt, Human T-lymphotropic virus 2
cucacauuccucc

SEQ ID NO: 4020370 - RNA, 15 nt, Human T-lymphotropic virus 2
cucacauuccuccca

SEQ ID NO: 4020371 - RNA, 16 nt, Human T-lymphotropic virus 2
cucacauuccucccau

SEQ ID NO: 4020372 - RNA, 12 nt, Human T-lymphotropic virus 2
cucaccugggac

SEQ ID NO: 4020373 - RNA, 14 nt, Human T-lymphotropic virus 2
cucaccugggaccc

SEQ ID NO: 4020374 - RNA, 22 nt, Human T-lymphotropic virus 2
cucacgauugguaucuccuccu

SEQ ID NO: 4020375 - RNA, 15 nt, Human T-lymphotropic virus 2
cucacgcuccugcag

SEQ ID NO: 4020376 - RNA, 20 nt, Human T-lymphotropic virus 2
cucagaacccacucagccuc

SEQ ID NO: 4020377 - RNA, 16 nt, Human T-lymphotropic virus 2
cucauaggcccuggca

SEQ ID NO: 4020378 - RNA, 22 nt, Human T-lymphotropic virus 2
cucauguauccguccuccagga

SEQ ID NO: 4020379 - RNA, 11 nt, Human T-lymphotropic virus 2
gccccacccuc

SEQ ID NO: 4020380 - RNA, 12 nt, Human T-lymphotropic virus 2
gccccacccucu

SEQ ID NO: 4020381 - RNA, 23 nt, Human T-lymphotropic virus 2
gccccuaagaaugcaggcuaaua

SEQ ID NO: 4020382 - RNA, 12 nt, Human T-lymphotropic virus 2
gcccuccuggcc

SEQ ID NO: 4020383 - RNA, 17 nt, Human T-lymphotropic virus 2
gcccuuaccccaaagca

SEQ ID NO: 4020384 - RNA, 14 nt, Human T-lymphotropic virus 2
gccgucacugaaaa

SEQ ID NO: 4020385 - RNA, 19 nt, Human T-lymphotropic virus 2
gccucaaccccgcccuacc

SEQ ID NO: 4020386 - RNA, 22 nt, Human T-lymphotropic virus 2
gccuccaccaacuucuccccca

SEQ ID NO: 4020387 - RNA, 22 nt, Human T-lymphotropic virus 2
gccuccccuccuuccccaccca

SEQ ID NO: 4020388 - RNA, 21 nt, Human T-lymphotropic virus 2
gccucccgagccagccaccca

SEQ ID NO: 4020389 - RNA, 20 nt, Human T-lymphotropic virus 2
gccucgguugagacgccuuc

SEQ ID NO: 4020390 - RNA, 18 nt, Human T-lymphotropic virus 2
gccucucccuggucuccu

SEQ ID NO: 4020391 - RNA, 20 nt, Human T-lymphotropic virus 2
gccuuaccccaccuacagac

SEQ ID NO: 4020392 - RNA, 18 nt, Human T-lymphotropic virus 2
gccuucaccauuccccag

SEQ ID NO: 4020393 - RNA, 19 nt, Human T-lymphotropic virus 2
gccuucaccauuccccagc

SEQ ID NO: 4020394 - RNA, 21 nt, Human T-lymphotropic virus 2
gcgcccccgccgccccaguuc

SEQ ID NO: 4020395 - RNA, 20 nt, Human T-lymphotropic virus 2
gcuacuugacacaggagccg

SEQ ID NO: 4020396 - RNA, 21 nt, Human T-lymphotropic virus 2
gcuccccucccucgccuuccc

SEQ ID NO: 4020397 - RNA, 15 nt, Human T-lymphotropic virus 2
gcucccucaccgacc

SEQ ID NO: 4020398 - RNA, 19 nt, Human T-lymphotropic virus 2
gcuccucacgcuccugcag

SEQ ID NO: 4020399 - RNA, 20 nt, Human T-lymphotropic virus 2
gcugaaaaacaaggcucuga

SEQ ID NO: 4020400 - RNA, 20 nt, Human T-lymphotropic virus 2
gcugcuuucuccacccugcc

SEQ ID NO: 4020401 - RNA, 22 nt, Human T-lymphotropic virus 2
gcugcuuucuccacccugccag

SEQ ID NO: 4020402 - RNA, 19 nt, Human T-lymphotropic virus 2
gcuuaacuuucuccaggcu

SEQ ID NO: 4020403 - RNA, 16 nt, Human T-lymphotropic virus 2
gcuuggcuccacaccc

SEQ ID NO: 4020404 - RNA, 14 nt, Human T-lymphotropic virus 2
ggaacccaccacca

SEQ ID NO: 4020405 - RNA, 15 nt, Human T-lymphotropic virus 2
ggaagccaagucccu

SEQ ID NO: 4020406 - RNA, 19 nt, Human T-lymphotropic virus 2
ggaauuacaacaacucucc

SEQ ID NO: 4020407 - RNA, 16 nt, Human T-lymphotropic virus 2
ggacaguucaggaggu

SEQ ID NO: 4020408 - RNA, 22 nt, Human T-lymphotropic virus 2
ggacuuacaagaucuccuccag

SEQ ID NO: 4020409 - RNA, 19 nt, Human T-lymphotropic virus 2
ggaggaaggggaaccccuc

SEQ ID NO: 4020410 - RNA, 20 nt, Human T-lymphotropic virus 2
ggaggcccauguuccccccc

SEQ ID NO: 4020411 - RNA, 14 nt, Human T-lymphotropic virus 2
ggcaggcccgcccu

SEQ ID NO: 4020412 - RNA, 19 nt, Human T-lymphotropic virus 2
ggccagccuuccuaucaca

SEQ ID NO: 4020413 - RNA, 18 nt, Human T-lymphotropic virus 2
ggcccccccccacacagc

SEQ ID NO: 4020414 - RNA, 23 nt, Human T-lymphotropic virus 2
ggcccuccgauuucgacuuccag

SEQ ID NO: 4020415 - RNA, 22 nt, Human T-lymphotropic virus 2
ggccucacccauugcaaucaaa

SEQ ID NO: 4020416 - RNA, 21 nt, Human T-lymphotropic virus 2
ggccuccacggccucacccau

SEQ ID NO: 4020417 - RNA, 17 nt, Human T-lymphotropic virus 2
ggccucggcaccuccug

SEQ ID NO: 4020418 - RNA, 18 nt, Human T-lymphotropic virus 2
ggcggccuugccaccccu

SEQ ID NO: 4020419 - RNA, 16 nt, Human T-lymphotropic virus 2
ggcuagacucugccuu

SEQ ID NO: 4020420 - RNA, 17 nt, Human T-lymphotropic virus 2
ggcucccuaucucuggc

SEQ ID NO: 4020421 - RNA, 23 nt, Human T-lymphotropic virus 2
ggcucccuguauccagacugccu

SEQ ID NO: 4020422 - RNA, 16 nt, Human T-lymphotropic virus 2
ggcucugacgucuccc

SEQ ID NO: 4020423 - RNA, 15 nt, Human T-lymphotropic virus 2
uccgauggcuccccu

SEQ ID NO: 4020424 - RNA, 17 nt, Human T-lymphotropic virus 2
uccgcccaucaaacccu

SEQ ID NO: 4020425 - RNA, 23 nt, Human T-lymphotropic virus 2
uccgcccaucaaacccuccaggc

SEQ ID NO: 4020426 - RNA, 18 nt, Human T-lymphotropic virus 2
uccguccccaaaacaucu

SEQ ID NO: 4020427 - RNA, 12 nt, Human T-lymphotropic virus 2
uccuaaccuucc

SEQ ID NO: 4020428 - RNA, 18 nt, Human T-lymphotropic virus 2
uccuacaaugacccuugc

SEQ ID NO: 4020429 - RNA, 13 nt, Human T-lymphotropic virus 2
uccucauucacca

SEQ ID NO: 4020430 - RNA, 19 nt, Human T-lymphotropic virus 2
uccuccaugacccuccuag

SEQ ID NO: 4020431 - RNA, 22 nt, Human T-lymphotropic virus 2
uccuccccccuuuuucccucgc

SEQ ID NO: 4020432 - RNA, 14 nt, Human T-lymphotropic virus 2
uccuccgccaccuc

SEQ ID NO: 4020433 - RNA, 20 nt, Human T-lymphotropic virus 2
uccucuuuccuucccuugcc

SEQ ID NO: 4020434 - RNA, 15 nt, Human T-lymphotropic virus 2
uccugaagccucuac

SEQ ID NO: 4020435 - RNA, 18 nt, Human T-lymphotropic virus 2
uccugaggaacuccccuc

SEQ ID NO: 4020436 - RNA, 20 nt, Human T-lymphotropic virus 2
uccuucccuugcccugcccg

SEQ ID NO: 4020437 - RNA, 21 nt, Human T-lymphotropic virus 2
ucgauacucccacucaucccc

SEQ ID NO: 4020438 - RNA, 14 nt, Human T-lymphotropic virus 2
ucgccucucccugg

SEQ ID NO: 4020439 - RNA, 16 nt, Human T-lymphotropic virus 2
ucgccuucaccauucc

SEQ ID NO: 4020440 - RNA, 12 nt, Human T-lymphotropic virus 2
ucgguuccucuc

SEQ ID NO: 4020441 - RNA, 20 nt, Human T-lymphotropic virus 2
ucuauucgaugaauacacca

SEQ ID NO: 4020442 - RNA, 14 nt, Human T-lymphotropic virus 2
ucuccauuccccaa

SEQ ID NO: 4020443 - RNA, 20 nt, Human T-lymphotropic virus 2
ucuccauuccccaacaaacc

SEQ ID NO: 4020444 - RNA, 22 nt, Human T-lymphotropic virus 2
ucucccagcuaacccuccaggc

SEQ ID NO: 4020445 - RNA, 12 nt, Human T-lymphotropic virus 2
ucuccccuagcg

SEQ ID NO: 4020446 - RNA, 13 nt, Human T-lymphotropic virus 2
ucuccuccuacca

SEQ ID NO: 4020447 - RNA, 20 nt, Human T-lymphotropic virus 2
ucuccuuccccagggccccc

SEQ ID NO: 4020448 - RNA, 18 nt, Human T-lymphotropic virus 2
ucuccuuggccucaucuc

SEQ ID NO: 4020449 - RNA, 19 nt, Human T-lymphotropic virus 2
ucucgcucuacuccuccuc

SEQ ID NO: 4020450 - RNA, 19 nt, Human T-lymphotropic virus 2
ucucguucuuuccucuucg

SEQ ID NO: 4020451 - RNA, 18 nt, Human T-lymphotropic virus 2
ucugccuuaaacuucacu

SEQ ID NO: 4020452 - RNA, 19 nt, Human T-lymphotropic virus 2
ucugcucuuggcagccccc

SEQ ID NO: 4020453 - RNA, 14 nt, Human T-lymphotropic virus 2
ucuucgaacaacaa

SEQ ID NO: 4020454 - RNA, 16 nt, Human T-lymphotropic virus 2
ugaaccauacucagga

SEQ ID NO: 4020455 - RNA, 14 nt, Human T-lymphotropic virus 2
ugaaccucuccggg

SEQ ID NO: 4020456 - RNA, 19 nt, Human T-lymphotropic virus 2
ugaccccaccgccaaggac

SEQ ID NO: 4020457 - RNA, 17 nt, Human T-lymphotropic virus 2
ugaccuggucuccaagg

SEQ ID NO: 4020458 - RNA, 15 nt, Human T-lymphotropic virus 2
ugacgccccaaggcc

SEQ ID NO: 4020459 - RNA, 22 nt, Human T-lymphotropic virus 2
ugacgucccuccccccuaggaa

SEQ ID NO: 4020460 - RNA, 14 nt, Human T-lymphotropic virus 2
ugauccuuuucccg

SEQ ID NO: 4020461 - RNA, 13 nt, Human T-lymphotropic virus 2
ugcagccuaggcc

SEQ ID NO: 4020462 - RNA, 18 nt, Human T-lymphotropic virus 2
ugccaaaaaaucuuacaa

SEQ ID NO: 4020463 - RNA, 21 nt, Human T-lymphotropic virus 2
ugccaagcauggacauccgca

SEQ ID NO: 4020464 - RNA, 15 nt, Human T-lymphotropic virus 2
ugccaagccauggcc

SEQ ID NO: 4020465 - RNA, 18 nt, Human T-lymphotropic virus 2
ugccauuacuaccacccu

SEQ ID NO: 4020466 - RNA, 19 nt, Human T-lymphotropic virus 2
ugcccaagaccagacgcca

SEQ ID NO: 4020467 - RNA, 21 nt, Human T-lymphotropic virus 2
ugcccacaacucaaacccccu

SEQ ID NO: 4020468 - RNA, 21 nt, Human T-lymphotropic virus 2
ugccuuucuucccucucccgg

SEQ ID NO: 4020469 - RNA, 17 nt, Human T-lymphotropic virus 2
ugcuucccuaucuuaca

SEQ ID NO: 4020470 - RNA, 15 nt, Human T-lymphotropic virus 2
cccaagcaguaccag

SEQ ID NO: 4020471 - RNA, 23 nt, Human T-lymphotropic virus 2
cccaaugggcacgagaagcccuc

SEQ ID NO: 4020472 - RNA, 18 nt, Human T-lymphotropic virus 2
cccagcuaacccuccagg

SEQ ID NO: 4020473 - RNA, 19 nt, Human T-lymphotropic virus 2
cccagcuaacccuccaggc

SEQ ID NO: 4020474 - RNA, 20 nt, Human T-lymphotropic virus 2
cccagcuaacccuccaggca

SEQ ID NO: 4020475 - RNA, 21 nt, Human T-lymphotropic virus 2
ccccaggagcccccucagcuc

SEQ ID NO: 4020476 - RNA, 16 nt, Human T-lymphotropic virus 2
ccccauggcagggccc

SEQ ID NO: 4020477 - RNA, 15 nt, Human T-lymphotropic virus 2
cccccaccuccccaa

SEQ ID NO: 4020478 - RNA, 21 nt, Human T-lymphotropic virus 2
cuaacccccuccacguccugg

SEQ ID NO: 4020479 - RNA, 12 nt, Human T-lymphotropic virus 2
cuaacccuccag

SEQ ID NO: 4020480 - RNA, 13 nt, Human T-lymphotropic virus 2
cuaacccuccagg

SEQ ID NO: 4020481 - RNA, 14 nt, Human T-lymphotropic virus 2
cuaacccuccaggc

SEQ ID NO: 4020482 - RNA, 17 nt, Human T-lymphotropic virus 2
cuaacccuccaggcacu

SEQ ID NO: 4020483 - RNA, 19 nt, Human T-lymphotropic virus 2
cuaagagccaccaaugcca

SEQ ID NO: 4020484 - RNA, 21 nt, Human T-lymphotropic virus 2
cuacaucgacaugcccuccug

SEQ ID NO: 4020485 - RNA, 22 nt, Human T-lymphotropic virus 2
cuacaucgacaugcccuccugg

SEQ ID NO: 4020486 - RNA, 16 nt, Human T-lymphotropic virus 2
cuaccacccucaccuc

SEQ ID NO: 4020487 - RNA, 15 nt, Human T-lymphotropic virus 2
cuaccucuccuuggc

SEQ ID NO: 4020488 - RNA, 12 nt, Human T-lymphotropic virus 2
cuacuccuccuc

SEQ ID NO: 4020489 - RNA, 23 nt, Human T-lymphotropic virus 2
cuagucucuuuuggcgccacacc

SEQ ID NO: 4020490 - RNA, 18 nt, Human T-lymphotropic virus 2
cuauaccuauaccagcuu

SEQ ID NO: 4020491 - RNA, 21 nt, Human T-lymphotropic virus 2
cuaucacaagaauuccaggag

SEQ ID NO: 4020492 - RNA, 16 nt, Human T-lymphotropic virus 2
cuauguuccacccgcc

SEQ ID NO: 4020493 - RNA, 16 nt, Human T-lymphotropic virus 2
cucaaacccccucagg

SEQ ID NO: 4020494 - RNA, 16 nt, Human T-lymphotropic virus 2
cucaccgacccucugg

SEQ ID NO: 4020495 - RNA, 20 nt, Human T-lymphotropic virus 2
cucaccucuccuuccccagg

SEQ ID NO: 4020496 - RNA, 13 nt, Human T-lymphotropic virus 2
cucaccuugggga

SEQ ID NO: 4020497 - RNA, 23 nt, Human T-lymphotropic virus 2
cucacuggaaaagggacugccca

SEQ ID NO: 4020498 - RNA, 19 nt, Human T-lymphotropic virus 2
cucagcccauuucccagga

SEQ ID NO: 4020499 - RNA, 18 nt, Human T-lymphotropic virus 2
cuccacaccccccacccu

SEQ ID NO: 4020500 - RNA, 23 nt, Human T-lymphotropic virus 2
cuccaggcggccuugccaccccu

SEQ ID NO: 4020501 - RNA, 19 nt, Human T-lymphotropic virus 2
cuccauagacggcuccccc

SEQ ID NO: 4020502 - RNA, 17 nt, Human T-lymphotropic virus 2
cuccaugacccuccuag

SEQ ID NO: 4020503 - RNA, 21 nt, Human T-lymphotropic virus 2
cuccaugcguuacaugccauu

SEQ ID NO: 4020504 - RNA, 18 nt, Human T-lymphotropic virus 2
cuccauuauccucccccc

SEQ ID NO: 4020505 - RNA, 19 nt, Human T-lymphotropic virus 2
cucccagcuaacccuccag

SEQ ID NO: 4020506 - RNA, 23 nt, Human T-lymphotropic virus 2
cuccccaagcaguaccagccaua

SEQ ID NO: 4020507 - RNA, 15 nt, Human T-lymphotropic virus 2
cuccccccccuuccc

SEQ ID NO: 4020508 - RNA, 16 nt, Human T-lymphotropic virus 2
cuccccgacccaauuu

SEQ ID NO: 4020509 - RNA, 22 nt, Human T-lymphotropic virus 2
cuccccgacccaauuuccaccu

SEQ ID NO: 4020510 - RNA, 16 nt, Human T-lymphotropic virus 2
cucccgcugcuccucc

SEQ ID NO: 4020511 - RNA, 15 nt, Human T-lymphotropic virus 2
cucccguaccuccuc

SEQ ID NO: 4020512 - RNA, 16 nt, Human T-lymphotropic virus 2
cucccguaccuccucc

SEQ ID NO: 4020513 - RNA, 22 nt, Human T-lymphotropic virus 2
cucccucaccgacccucugguc

SEQ ID NO: 4020514 - RNA, 18 nt, Human T-lymphotropic virus 2
cucccuguauccagacug

SEQ ID NO: 4020515 - RNA, 21 nt, Human T-lymphotropic virus 2
cucccuuaucuuagcuccccu

SEQ ID NO: 4020516 - RNA, 23 nt, Human T-lymphotropic virus 2
cuccgccaaauccaggcccuucc

SEQ ID NO: 4020517 - RNA, 23 nt, Human T-lymphotropic virus 2
cuccgccaccuccccccccuucc

SEQ ID NO: 4020518 - RNA, 16 nt, Human T-lymphotropic virus 2
cuccucaggccaauuu

SEQ ID NO: 4020519 - RNA, 12 nt, Human T-lymphotropic virus 2
cuccuccaugac

SEQ ID NO: 4020520 - RNA, 17 nt, Human T-lymphotropic virus 2
cuccuccuaccacucca

SEQ ID NO: 4020521 - RNA, 18 nt, Human T-lymphotropic virus 2
cuccuccuaccacuccag

SEQ ID NO: 4020522 - RNA, 14 nt, Human T-lymphotropic virus 2
cuccucucagccca

SEQ ID NO: 4020523 - RNA, 13 nt, Human T-lymphotropic virus 2
cuccucucagguc

SEQ ID NO: 4020524 - RNA, 23 nt, Human T-lymphotropic virus 2
cuccucuccaauaccuuaucccu

SEQ ID NO: 4020525 - RNA, 19 nt, Human T-lymphotropic virus 2
cuccucugcucuuggcagc

SEQ ID NO: 4020526 - RNA, 18 nt, Human T-lymphotropic virus 2
cuccugaacugcuccucc

SEQ ID NO: 4020527 - RNA, 22 nt, Human T-lymphotropic virus 2
cuccuuccauaaccuucaccuu

SEQ ID NO: 4020528 - RNA, 14 nt, Human T-lymphotropic virus 2
cuccuuccccaggg

SEQ ID NO: 4020529 - RNA, 16 nt, Human T-lymphotropic virus 2
cucgaacaccuucccc

SEQ ID NO: 4020530 - RNA, 22 nt, Human T-lymphotropic virus 2
cucgagguugacaaagacaucu

SEQ ID NO: 4020531 - RNA, 12 nt, Human T-lymphotropic virus 2
cucgcaccugcu

SEQ ID NO: 4020532 - RNA, 17 nt, Human T-lymphotropic virus 2
cucgccucucccugguc

SEQ ID NO: 4020533 - RNA, 12 nt, Human T-lymphotropic virus 2
cucgcucccuca

SEQ ID NO: 4020534 - RNA, 18 nt, Human T-lymphotropic virus 2
cucgguuccucuccaggg

SEQ ID NO: 4020535 - RNA, 21 nt, Human T-lymphotropic virus 2
cucuaagugcggcuccuccau

SEQ ID NO: 4020536 - RNA, 18 nt, Human T-lymphotropic virus 2
cucucacgaaacacauuc

SEQ ID NO: 4020537 - RNA, 19 nt, Human T-lymphotropic virus 2
cucucacgaaacacauucc

SEQ ID NO: 4020538 - RNA, 15 nt, Human T-lymphotropic virus 2
cucuccaagcggccu

SEQ ID NO: 4020539 - RNA, 18 nt, Human T-lymphotropic virus 2
cucucccagcuaacccuc

SEQ ID NO: 4020540 - RNA, 17 nt, Human T-lymphotropic virus 2
cucugacgucucccccu

SEQ ID NO: 4020541 - RNA, 16 nt, Human T-lymphotropic virus 2
cucuuagacacccaca

SEQ ID NO: 4020542 - RNA, 18 nt, Human T-lymphotropic virus 2
cugaaccucuccgggaga

SEQ ID NO: 4020543 - RNA, 21 nt, Human T-lymphotropic virus 2
cugacgccccaaggccuccac

SEQ ID NO: 4020544 - RNA, 16 nt, Human T-lymphotropic virus 2
cugacgucucccccuu

SEQ ID NO: 4020545 - RNA, 15 nt, Human T-lymphotropic virus 2
cugagcgccuccagg

SEQ ID NO: 4020546 - RNA, 13 nt, Human T-lymphotropic virus 2
cugauccuaggcg

SEQ ID NO: 4020547 - RNA, 20 nt, Human T-lymphotropic virus 2
cugcaugguuugcguggaua

SEQ ID NO: 4020548 - RNA, 15 nt, Human T-lymphotropic virus 2
cugccaauagccacu

SEQ ID NO: 4020549 - RNA, 14 nt, Human T-lymphotropic virus 2
cugccuuaaacuuc

SEQ ID NO: 4020550 - RNA, 17 nt, Human T-lymphotropic virus 2
cugcuuucuccacccug

SEQ ID NO: 4020551 - RNA, 18 nt, Human T-lymphotropic virus 2
cuggaaccaacccucggg

SEQ ID NO: 4020552 - RNA, 20 nt, Human T-lymphotropic virus 2
cuggcauguacucuacaccc

SEQ ID NO: 4020553 - RNA, 16 nt, Human T-lymphotropic virus 2
cuggccaccuguccag

SEQ ID NO: 4020554 - RNA, 18 nt, Human T-lymphotropic virus 2
cuggcuuggcuccacacc

SEQ ID NO: 4020555 - RNA, 16 nt, Human T-lymphotropic virus 2
cuggucuccaaggccc

SEQ ID NO: 4020556 - RNA, 15 nt, Human T-lymphotropic virus 2
cuguacccagccacg

SEQ ID NO: 4020557 - RNA, 19 nt, Human T-lymphotropic virus 2
cuguauccuccgccaaauc

SEQ ID NO: 4020558 - RNA, 23 nt, Human T-lymphotropic virus 2
cuguccuaaccuuccccuagaca

SEQ ID NO: 4020559 - RNA, 12 nt, Human T-lymphotropic virus 2
cugucuccccca

SEQ ID NO: 4020560 - RNA, 15 nt, Human T-lymphotropic virus 2
cuuaacaaccccagg

SEQ ID NO: 4020561 - RNA, 16 nt, Human T-lymphotropic virus 2
cuuaacuuucuccagg

SEQ ID NO: 4020562 - RNA, 15 nt, Human T-lymphotropic virus 2
cuuaucaacccagaa

SEQ ID NO: 4020563 - RNA, 19 nt, Human T-lymphotropic virus 2
cuuaucccucgccuccccu

SEQ ID NO: 4020564 - RNA, 15 nt, Human T-lymphotropic virus 2
cuuauucccacauug

SEQ ID NO: 4020565 - RNA, 22 nt, Human T-lymphotropic virus 2
cuucaggccauuucccuccuag

SEQ ID NO: 4020566 - RNA, 17 nt, Human T-lymphotropic virus 2
cuuccaauuucccagga

SEQ ID NO: 4020567 - RNA, 15 nt, Human T-lymphotropic virus 2
cuucccccaccuccc

SEQ ID NO: 4020568 - RNA, 15 nt, Human T-lymphotropic virus 2
cuucgaacaacaauu

SEQ ID NO: 4020569 - RNA, 23 nt, Human T-lymphotropic virus 2
cuucgaacaacaauuagcagccg

SEQ ID NO: 4020570 - RNA, 22 nt, Human T-lymphotropic virus 2
cuucucuaagugcggcuccucc

SEQ ID NO: 4020571 - RNA, 12 nt, Human T-lymphotropic virus 2
cuucuuuucccc

SEQ ID NO: 4020572 - RNA, 17 nt, Human T-lymphotropic virus 2
cuuuccccacccaugac

SEQ ID NO: 4020573 - RNA, 12 nt, Human T-lymphotropic virus 2
cuuuccuucccu

SEQ ID NO: 4020574 - RNA, 23 nt, Human T-lymphotropic virus 2
caccucccaacccuucuccagga

SEQ ID NO: 4020575 - RNA, 22 nt, Human T-lymphotropic virus 2
caccuccccccccuuccccgga

SEQ ID NO: 4020576 - RNA, 11 nt, Human T-lymphotropic virus 2
caccugccuuc

SEQ ID NO: 4020577 - RNA, 22 nt, Human T-lymphotropic virus 2
caccuguccagagcaccaacuc

SEQ ID NO: 4020578 - RNA, 18 nt, Human T-lymphotropic virus 2
cacgauugguaucuccuc

SEQ ID NO: 4020579 - RNA, 16 nt, Human T-lymphotropic virus 2
cacgcaaugcuucccu

SEQ ID NO: 4020580 - RNA, 21 nt, Human T-lymphotropic virus 2
cacggcccugacgucccuccc

SEQ ID NO: 4020581 - RNA, 22 nt, Human T-lymphotropic virus 2
cacgucuggguagacaccuucu

SEQ ID NO: 4020582 - RNA, 23 nt, Human T-lymphotropic virus 2
cacucacgauugguaucuccucc

SEQ ID NO: 4020583 - RNA, 15 nt, Human T-lymphotropic virus 2
cacucagccuccacc

SEQ ID NO: 4020584 - RNA, 16 nt, Human T-lymphotropic virus 2
cacucaucccccugcg

SEQ ID NO: 4020585 - RNA, 13 nt, Human T-lymphotropic virus 2
guccgcagccaca

SEQ ID NO: 4020586 - RNA, 13 nt, Human T-lymphotropic virus 2
guccucccggagg

SEQ ID NO: 4020587 - RNA, 23 nt, Human T-lymphotropic virus 2
gucucccccaagguuccaccugc

SEQ ID NO: 4020588 - RNA, 13 nt, Human T-lymphotropic virus 2
agagcaccaacuc

SEQ ID NO: 4020589 - RNA, 15 nt, Human T-lymphotropic virus 2
agaugagucgccccc

SEQ ID NO: 4020590 - RNA, 22 nt, Human T-lymphotropic virus 2
agauguaaauuucacccaggaa

SEQ ID NO: 4020591 - RNA, 19 nt, Human T-lymphotropic virus 2
agccacaccaaccuccccg

SEQ ID NO: 4020592 - RNA, 15 nt, Human T-lymphotropic virus 2
agccagccacccagg

SEQ ID NO: 4020593 - RNA, 19 nt, Human T-lymphotropic virus 2
agcccaucuuacguucccu

SEQ ID NO: 4020594 - RNA, 14 nt, Human T-lymphotropic virus 2
agcccccucagcuc

SEQ ID NO: 4020595 - RNA, 13 nt, Human T-lymphotropic virus 2
agccuaggcccuc

SEQ ID NO: 4020596 - RNA, 14 nt, Human T-lymphotropic virus 2
agccuccaccaacu

SEQ ID NO: 4020597 - RNA, 20 nt, Human T-lymphotropic virus 2
agccuccaccaacuucuccc

SEQ ID NO: 4020598 - RNA, 20 nt, Human T-lymphotropic virus 2
agcggccucgguugagacgc

SEQ ID NO: 4020599 - RNA, 23 nt, Human T-lymphotropic virus 2
agcucaggccuggucgagagaac

SEQ ID NO: 4020600 - RNA, 13 nt, Human T-lymphotropic virus 2
agcucggcugccc

SEQ ID NO: 4020601 - RNA, 22 nt, Human T-lymphotropic virus 2
aggagguggcucgcucccucac

SEQ ID NO: 4020602 - RNA, 22 nt, Human T-lymphotropic virus 2
aggcaauaaccccgucuucccc

SEQ ID NO: 4020603 - RNA, 15 nt, Human T-lymphotropic virus 2
agggauauccaggaa

SEQ ID NO: 4020604 - RNA, 17 nt, Human T-lymphotropic virus 2
agggucuuuagagacac

SEQ ID NO: 4020605 - RNA, 21 nt, Human T-lymphotropic virus 2
aggucgagcucggcugccccu

SEQ ID NO: 4020606 - RNA, 17 nt, Human T-lymphotropic virus 2
agguggucuauguucca

SEQ ID NO: 4020607 - RNA, 13 nt, Human T-lymphotropic virus 2
aguaccagccaua

SEQ ID NO: 4020608 - RNA, 12 nt, Human T-lymphotropic virus 2
aguccuauacac

SEQ ID NO: 4020609 - RNA, 17 nt, Human T-lymphotropic virus 2
aguccuauacacuccaa

SEQ ID NO: 4020610 - RNA, 16 nt, Human T-lymphotropic virus 2
agucuccucucagguc

SEQ ID NO: 4020611 - RNA, 15 nt, Human T-lymphotropic virus 2
agugcggcuccucca

SEQ ID NO: 4020612 - RNA, 17 nt, Human T-lymphotropic virus 2
agugcggcuccuccaug

SEQ ID NO: 4020613 - RNA, 17 nt, Human T-lymphotropic virus 2
aguguggcuugucuccg

SEQ ID NO: 4020614 - RNA, 16 nt, Human T-lymphotropic virus 2
aguuauccuaggagag

SEQ ID NO: 4020615 - RNA, 12 nt, Human T-lymphotropic virus 2
aguucaggaggu

SEQ ID NO: 4020616 - RNA, 18 nt, Human T-lymphotropic virus 2
auaacugcaacaacucca

SEQ ID NO: 4020617 - RNA, 17 nt, Human T-lymphotropic virus 2
auacaauacuccuccuu

SEQ ID NO: 4020618 - RNA, 14 nt, Human T-lymphotropic virus 2
auaccccagacacu

SEQ ID NO: 4020619 - RNA, 17 nt, Human T-lymphotropic virus 2
auacuucgccuucacca

SEQ ID NO: 4020620 - RNA, 22 nt, Human T-lymphotropic virus 2
auacuuuuagccagccccacca

SEQ ID NO: 4020621 - RNA, 15 nt, Human T-lymphotropic virus 2
aucagcuccccuccc

SEQ ID NO: 4020622 - RNA, 23 nt, Human T-lymphotropic virus 2
aucagcuccccucccucgccuuc

SEQ ID NO: 4020623 - RNA, 10 nt, Human T-lymphotropic virus 2
auccagccuc

SEQ ID NO: 4020624 - RNA, 19 nt, Human T-lymphotropic virus 2
auccagcugaccuuacaga

SEQ ID NO: 4020625 - RNA, 14 nt, Human T-lymphotropic virus 2
aucccgaccccaga

SEQ ID NO: 4020626 - RNA, 13 nt, Human T-lymphotropic virus 2
auccuccccccuu

SEQ ID NO: 4020627 - RNA, 21 nt, Human T-lymphotropic virus 2
auccuccccccuuuuucccuc

SEQ ID NO: 4020628 - RNA, 19 nt, Human T-lymphotropic virus 2
auccucuuuccuucccuug

SEQ ID NO: 4020629 - RNA, 16 nt, Human T-lymphotropic virus 2
auccuuuccuccugcc

SEQ ID NO: 4020630 - RNA, 15 nt, Human T-lymphotropic virus 2
aucuccauuccccaa

SEQ ID NO: 4020631 - RNA, 20 nt, Human T-lymphotropic virus 2
augacaggcuacaaccccau

SEQ ID NO: 4020632 - RNA, 21 nt, Human T-lymphotropic virus 2
augaccuggucuccaaggccc

SEQ ID NO: 4020633 - RNA, 22 nt, Human T-lymphotropic virus 2
augccuggaaccaacccucggg

SEQ ID NO: 4020634 - RNA, 23 nt, Human T-lymphotropic virus 2
augccuuucuucccucucccggc

SEQ ID NO: 4020635 - RNA, 12 nt, Human T-lymphotropic virus 2
auggacacucac

SEQ ID NO: 4020636 - RNA, 18 nt, Human T-lymphotropic virus 2
auggcgacuagccucccg

SEQ ID NO: 4020637 - RNA, 20 nt, Human T-lymphotropic virus 2
augggacaaacaccucagcc

SEQ ID NO: 4020638 - RNA, 19 nt, Human T-lymphotropic virus 2
augguaaauggagguucau

SEQ ID NO: 4020639 - RNA, 18 nt, Human T-lymphotropic virus 2
auguaaauuucacccagg

SEQ ID NO: 4020640 - RNA, 20 nt, Human T-lymphotropic virus 2
auguaaauuucacccaggaa

SEQ ID NO: 4020641 - RNA, 16 nt, Human T-lymphotropic virus 2
augucaugaaccccag

SEQ ID NO: 4020642 - RNA, 19 nt, Human T-lymphotropic virus 2
auuacaaguuauccuagga

SEQ ID NO: 4020643 - RNA, 16 nt, Human T-lymphotropic virus 2
auuccccaacaaaccu

SEQ ID NO: 4020644 - RNA, 22 nt, Human T-lymphotropic virus 2
auucgaaaccaaagccuuccau

SEQ ID NO: 4020645 - RNA, 13 nt, Human T-lymphotropic virus 2
auucugccacccc

SEQ ID NO: 4020646 - RNA, 11 nt, Human T-lymphotropic virus 2
auuggccccug

SEQ ID NO: 4020647 - RNA, 17 nt, Human T-lymphotropic virus 2
auuuccggcccuuaccc

SEQ ID NO: 4020648 - RNA, 20 nt, Human T-lymphotropic virus 2
caaaagggggagcuccuugc

SEQ ID NO: 4020649 - RNA, 18 nt, Human T-lymphotropic virus 2
caaacaccauaggccucg

SEQ ID NO: 4020650 - RNA, 13 nt, Human T-lymphotropic virus 2
caaacccuccagg

SEQ ID NO: 4020651 - RNA, 14 nt, Human T-lymphotropic virus 2
caaacccuccaggc

SEQ ID NO: 4020652 - RNA, 14 nt, Human T-lymphotropic virus 2
caaaccuccucccg

SEQ ID NO: 4020653 - RNA, 15 nt, Human T-lymphotropic virus 2
caaagacaucuccca

SEQ ID NO: 4020654 - RNA, 14 nt, Human T-lymphotropic virus 2
caaagcccccaggg

SEQ ID NO: 4020655 - RNA, 18 nt, Human T-lymphotropic virus 2
caaauccaggcccuucca

SEQ ID NO: 4020656 - RNA, 16 nt, Human T-lymphotropic virus 2
caacaaaccccaggcc

SEQ ID NO: 4020657 - RNA, 16 nt, Human T-lymphotropic virus 2
caacaacucucccagc

SEQ ID NO: 4020658 - RNA, 20 nt, Human T-lymphotropic virus 2
caacagaccaccaacaccau

SEQ ID NO: 4020659 - RNA, 23 nt, Human T-lymphotropic virus 2
caacauacgccguggagcgcagc

SEQ ID NO: 4020660 - RNA, 19 nt, Human T-lymphotropic virus 2
caaccacggaggccccccc

SEQ ID NO: 4020661 - RNA, 11 nt, Human T-lymphotropic virus 2
caaccccacca

SEQ ID NO: 4020662 - RNA, 15 nt, Human T-lymphotropic virus 2
caacccuucuccagg

SEQ ID NO: 4020663 - RNA, 13 nt, Human T-lymphotropic virus 2
caacucaccuggg

SEQ ID NO: 4020664 - RNA, 14 nt, Human T-lymphotropic virus 2
caacuucuccccca

SEQ ID NO: 4020665 - RNA, 13 nt, Human T-lymphotropic virus 2
caagaccaucuac

SEQ ID NO: 4020666 - RNA, 23 nt, Human T-lymphotropic virus 2
caagagcuuguaucacccucacc

SEQ ID NO: 4020667 - RNA, 19 nt, Human T-lymphotropic virus 2
caagauccuucucacugga

SEQ ID NO: 4020668 - RNA, 15 nt, Human T-lymphotropic virus 2
caagaucuccuccag

SEQ ID NO: 4020669 - RNA, 14 nt, Human T-lymphotropic virus 2
caagcccgcggaca

SEQ ID NO: 4020670 - RNA, 18 nt, Human T-lymphotropic virus 2
caagggcuagggcuuccu

SEQ ID NO: 4020671 - RNA, 19 nt, Human T-lymphotropic virus 2
caagguccuuaccccuccc

SEQ ID NO: 4020672 - RNA, 20 nt, Human T-lymphotropic virus 2
caaggugauguaacccauua

SEQ ID NO: 4020673 - RNA, 16 nt, Human T-lymphotropic virus 2
caauagcaguguggcu

SEQ ID NO: 4020674 - RNA, 14 nt, Human T-lymphotropic virus 2
caaucccuccagga

SEQ ID NO: 4020675 - RNA, 22 nt, Human T-lymphotropic virus 2
caauccugucuccucucagccc

SEQ ID NO: 4020676 - RNA, 15 nt, Human T-lymphotropic virus 2
caauguugcuuccuc

SEQ ID NO: 4020677 - RNA, 16 nt, Human T-lymphotropic virus 2
cacaacaaaccccagg

SEQ ID NO: 4020678 - RNA, 17 nt, Human T-lymphotropic virus 2
cacaacaaaccccaggc

SEQ ID NO: 4020679 - RNA, 15 nt, Human T-lymphotropic virus 2
cacaauguuccaacc

SEQ ID NO: 4020680 - RNA, 16 nt, Human T-lymphotropic virus 2
cacaauguuccaaccc

SEQ ID NO: 4020681 - RNA, 23 nt, Human T-lymphotropic virus 2
cacaguccuccacuaccacccau

SEQ ID NO: 4020682 - RNA, 22 nt, Human T-lymphotropic virus 2
caccaacucaccugggacccca

SEQ ID NO: 4020683 - RNA, 16 nt, Human T-lymphotropic virus 2
caccauuccccagcca

SEQ ID NO: 4020684 - RNA, 14 nt, Human T-lymphotropic virus 2
cacccaugacaugg

SEQ ID NO: 4020685 - RNA, 13 nt, Human T-lymphotropic virus 2
cacccccccugcc

SEQ ID NO: 4020686 - RNA, 15 nt, Human T-lymphotropic virus 2
cacccucaccucucc

SEQ ID NO: 4020687 - RNA, 17 nt, Human T-lymphotropic virus 2
cacccucaccucuccuu

SEQ ID NO: 4020688 - RNA, 21 nt, Human T-lymphotropic virus 2
cacccucaccucuccuucccc

SEQ ID NO: 4020689 - RNA, 13 nt, Human T-lymphotropic virus 2
cacccugccaggc

SEQ ID NO: 4020690 - RNA, 17 nt, Human T-lymphotropic virus 2
cacccuuacccacuucc

SEQ ID NO: 4020691 - RNA, 14 nt, Human T-lymphotropic virus 2
caguccauccugga

SEQ ID NO: 4020692 - RNA, 18 nt, Human T-lymphotropic virus 2
caguuugaccccaccgcc

SEQ ID NO: 4020693 - RNA, 14 nt, Human T-lymphotropic virus 2
cauaaccuucaccu

SEQ ID NO: 4020694 - RNA, 14 nt, Human T-lymphotropic virus 2
cauacucaggacca

SEQ ID NO: 4020695 - RNA, 14 nt, Human T-lymphotropic virus 2
cauauucugccacc

SEQ ID NO: 4020696 - RNA, 14 nt, Human T-lymphotropic virus 2
caucaaacccucca

SEQ ID NO: 4020697 - RNA, 23 nt, Human T-lymphotropic virus 2
caucaagcaggaggucagcuccu

SEQ ID NO: 4020698 - RNA, 16 nt, Human T-lymphotropic virus 2
caucaccucagaaccc

SEQ ID NO: 4020699 - RNA, 23 nt, Human T-lymphotropic virus 2
caucccuccuaucuacucucuca

SEQ ID NO: 4020700 - RNA, 15 nt, Human T-lymphotropic virus 2
caucuaccuccacca

SEQ ID NO: 4020701 - RNA, 18 nt, Human T-lymphotropic virus 2
caucucgauacucccacu

SEQ ID NO: 4020702 - RNA, 20 nt, Human T-lymphotropic virus 2
caucucgauacucccacuca

SEQ ID NO: 4020703 - RNA, 22 nt, Human T-lymphotropic virus 2
caugaggaaaauguuucccaca

SEQ ID NO: 4020704 - RNA, 14 nt, Human T-lymphotropic virus 2
caugcccuccuggc

SEQ ID NO: 4020705 - RNA, 21 nt, Human T-lymphotropic virus 2
caugucaggcguggacaccca

SEQ ID NO: 4020706 - RNA, 13 nt, Human T-lymphotropic virus 2
cauuauccucccc

SEQ ID NO: 4020707 - RNA, 12 nt, Human T-lymphotropic virus 2
cauucccucgcc

SEQ ID NO: 4020708 - RNA, 19 nt, Human T-lymphotropic virus 2
cauuccugaagccucuacc

SEQ ID NO: 4020709 - RNA, 21 nt, Human T-lymphotropic virus 2
cauucgccggggccucuugcc

SEQ ID NO: 4020710 - RNA, 17 nt, Human T-lymphotropic virus 2
cauugcaaucccuccag

SEQ ID NO: 4020711 - RNA, 19 nt, Human T-lymphotropic virus 2
cauugcuaccaaccucgcc

SEQ ID NO: 4020712 - RNA, 15 nt, Human T-lymphotropic virus 2
ccaaagcccccaggg

SEQ ID NO: 4020713 - RNA, 17 nt, Human T-lymphotropic virus 2
ccaaaucccccucccca

SEQ ID NO: 4020714 - RNA, 19 nt, Human T-lymphotropic virus 2
ccaacccgucugcacgugg

SEQ ID NO: 4020715 - RNA, 23 nt, Human T-lymphotropic virus 2
ccaacccucggggaucagcuccc

SEQ ID NO: 4020716 - RNA, 14 nt, Human T-lymphotropic virus 2
ccaacccuucccuu

SEQ ID NO: 4020717 - RNA, 19 nt, Human T-lymphotropic virus 2
ccaauggacacucacugaa

SEQ ID NO: 4020718 - RNA, 20 nt, Human T-lymphotropic virus 2
ccacagcgguuacaaaaccg

SEQ ID NO: 4020719 - RNA, 12 nt, Human T-lymphotropic virus 2
ccaccaaugcca

SEQ ID NO: 4020720 - RNA, 18 nt, Human T-lymphotropic virus 2
ccaccaauugcugccaau

SEQ ID NO: 4020721 - RNA, 22 nt, Human T-lymphotropic virus 2
ccaccacuccugucucccccaa

SEQ ID NO: 4020722 - RNA, 20 nt, Human T-lymphotropic virus 2
ccaccucaggcacuacugag

SEQ ID NO: 4020723 - RNA, 16 nt, Human T-lymphotropic virus 2
ccaccuguccagagca

SEQ ID NO: 4020724 - RNA, 14 nt, Human T-lymphotropic virus 2
cucccauaggaccu

SEQ ID NO: 4020725 - RNA, 17 nt, Human T-lymphotropic virus 2
cucccauaggaccuucu

SEQ ID NO: 4020726 - RNA, 20 nt, Human T-lymphotropic virus 2
cuccccaaguggaccaauuu

SEQ ID NO: 4020727 - RNA, 16 nt, Human T-lymphotropic virus 2
cuccccccccuucccc

SEQ ID NO: 4020728 - RNA, 13 nt, Human T-lymphotropic virus 2
cuccccccuagga

SEQ ID NO: 4020729 - RNA, 17 nt, Human T-lymphotropic virus 2
cuccccucauccaagug

SEQ ID NO: 4020730 - RNA, 19 nt, Human T-lymphotropic virus 2
cucccgagccagccaccca

SEQ ID NO: 4020731 - RNA, 16 nt, Human T-lymphotropic virus 2
cucccucgccuucccc

SEQ ID NO: 4020732 - RNA, 20 nt, Human T-lymphotropic virus 2
cucccuuaucuuagcucccc

SEQ ID NO: 4020733 - RNA, 19 nt, Human T-lymphotropic virus 2
cuccguuaugggacaaaca

SEQ ID NO: 4020734 - RNA, 17 nt, Human T-lymphotropic virus 2
cuccuccaucccaaccc

SEQ ID NO: 4020735 - RNA, 17 nt, Human T-lymphotropic virus 2
cuccuccgccaccuccc

SEQ ID NO: 4020736 - RNA, 13 nt, Human T-lymphotropic virus 2
cuccuccuaccac

SEQ ID NO: 4020737 - RNA, 12 nt, Human T-lymphotropic virus 2
cuccucucagcc

SEQ ID NO: 4020738 - RNA, 20 nt, Human T-lymphotropic virus 2
cuccugaacugcuccuccca

SEQ ID NO: 4020739 - RNA, 15 nt, Human T-lymphotropic virus 2
cuccuggccaccugu

SEQ ID NO: 4020740 - RNA, 21 nt, Human T-lymphotropic virus 2
cuccuguuggaucucccuucc

SEQ ID NO: 4020741 - RNA, 19 nt, Human T-lymphotropic virus 2
cucgccuccccuccuuccc

SEQ ID NO: 4020742 - RNA, 13 nt, Human T-lymphotropic virus 2
cucgccucucccu

SEQ ID NO: 4020743 - RNA, 17 nt, Human T-lymphotropic virus 2
cucgcucuacuccuccu

SEQ ID NO: 4020744 - RNA, 19 nt, Human T-lymphotropic virus 2
cucuacacccccaacaucu

SEQ ID NO: 4020745 - RNA, 16 nt, Human T-lymphotropic virus 2
cucucagcccauuucc

SEQ ID NO: 4020746 - RNA, 13 nt, Human T-lymphotropic virus 2
cucucauccuggc

SEQ ID NO: 4020747 - RNA, 22 nt, Human T-lymphotropic virus 2
cucuccagggggaggcacacca

SEQ ID NO: 4020748 - RNA, 13 nt, Human T-lymphotropic virus 2
cucuccucuccaa

SEQ ID NO: 4020749 - RNA, 21 nt, Human T-lymphotropic virus 2
cucucuuacaccucccaaccc

SEQ ID NO: 4020750 - RNA, 21 nt, Human T-lymphotropic virus 2
cucugacgauuacccccugcc

SEQ ID NO: 4020751 - RNA, 18 nt, Human T-lymphotropic virus 2
cugaaaaacaaggcucug

SEQ ID NO: 4020752 - RNA, 14 nt, Human T-lymphotropic virus 2
cugaaaccacggcc

SEQ ID NO: 4020753 - RNA, 17 nt, Human T-lymphotropic virus 2
cugacgauuacccccug

SEQ ID NO: 4020754 - RNA, 17 nt, Human T-lymphotropic virus 2
cugacgccccaaggccu

SEQ ID NO: 4020755 - RNA, 19 nt, Human T-lymphotropic virus 2
cugacgccccaaggccucc

SEQ ID NO: 4020756 - RNA, 22 nt, Human T-lymphotropic virus 2
cugacgucccuccccccuagga

SEQ ID NO: 4020757 - RNA, 15 nt, Human T-lymphotropic virus 2
cugacgucucccccu

SEQ ID NO: 4020758 - RNA, 17 nt, Human T-lymphotropic virus 2
cugcacguggaaccucg

SEQ ID NO: 4020759 - RNA, 20 nt, Human T-lymphotropic virus 2
cugccaagccauggccuucc

SEQ ID NO: 4020760 - RNA, 19 nt, Human T-lymphotropic virus 2
cugccaauagccacuccaa

SEQ ID NO: 4020761 - RNA, 16 nt, Human T-lymphotropic virus 2
cugcccgcuccuccau

SEQ ID NO: 4020762 - RNA, 19 nt, Human T-lymphotropic virus 2
cugcccgcuccuccauccc

SEQ ID NO: 4020763 - RNA, 18 nt, Human T-lymphotropic virus 2
cuggucuccaaggcccug

SEQ ID NO: 4020764 - RNA, 16 nt, Human T-lymphotropic virus 2
cugucccaaugggcac

SEQ ID NO: 4020765 - RNA, 14 nt, Human T-lymphotropic virus 2
cuuaaacuucacuu

SEQ ID NO: 4020766 - RNA, 17 nt, Human T-lymphotropic virus 2
cuuaacuuucuccaggc

SEQ ID NO: 4020767 - RNA, 14 nt, Human T-lymphotropic virus 2
cuuacaccucccaa

SEQ ID NO: 4020768 - RNA, 14 nt, Human T-lymphotropic virus 2
cuuaccccucccac

SEQ ID NO: 4020769 - RNA, 20 nt, Human T-lymphotropic virus 2
cuuccauaaccuucaccuuc

SEQ ID NO: 4020770 - RNA, 17 nt, Human T-lymphotropic virus 2
cuuccaucccuccuauc

SEQ ID NO: 4020771 - RNA, 12 nt, Human T-lymphotropic virus 2
cuuccccuagcg

SEQ ID NO: 4020772 - RNA, 14 nt, Human T-lymphotropic virus 2
cuuccgugggaccg

SEQ ID NO: 4020773 - RNA, 16 nt, Human T-lymphotropic virus 2
cuuccugaaccucucc

SEQ ID NO: 4020774 - RNA, 20 nt, Human T-lymphotropic virus 2
cuuccugaaccucuccggga

SEQ ID NO: 4020775 - RNA, 18 nt, Human T-lymphotropic virus 2
cuucuauaccucccagac

SEQ ID NO: 4020776 - RNA, 20 nt, Human T-lymphotropic virus 2
cuuguaucacccucacccca

SEQ ID NO: 4020777 - RNA, 17 nt, Human T-lymphotropic virus 2
cuugucuccgcccuagc

SEQ ID NO: 4020778 - RNA, 20 nt, Human T-lymphotropic virus 2
cuuguuccccugacgcccca

SEQ ID NO: 4020779 - RNA, 15 nt, Human T-lymphotropic virus 2
cuuuccccaacucca

SEQ ID NO: 4020780 - RNA, 13 nt, Human T-lymphotropic virus 2
cuuuuccccuuca

SEQ ID NO: 4020781 - RNA, 16 nt, Human T-lymphotropic virus 2
cuuuugcuguccuucu

SEQ ID NO: 4020782 - RNA, 20 nt, Human T-lymphotropic virus 2
cuuuuuccaaaucccccucc

SEQ ID NO: 4020783 - RNA, 15 nt, Human T-lymphotropic virus 2
gaaaaaaauagaccu

SEQ ID NO: 4020784 - RNA, 13 nt, Human T-lymphotropic virus 2
gaaaaacaaggcu

SEQ ID NO: 4020785 - RNA, 20 nt, Human T-lymphotropic virus 2
gaaaccaaagccuuccaucc

SEQ ID NO: 4020786 - RNA, 13 nt, Human T-lymphotropic virus 2
gaaccccuccugu

SEQ ID NO: 4020787 - RNA, 13 nt, Human T-lymphotropic virus 2
gaagccaaguccc

SEQ ID NO: 4020788 - RNA, 18 nt, Human T-lymphotropic virus 2
gacaaacaccucagccua

SEQ ID NO: 4020789 - RNA, 15 nt, Human T-lymphotropic virus 2
gacaucucccaccuu

SEQ ID NO: 4020790 - RNA, 17 nt, Human T-lymphotropic virus 2
gaccagacuauccuuca

SEQ ID NO: 4020791 - RNA, 16 nt, Human T-lymphotropic virus 2
gaccuacccaccacaa

SEQ ID NO: 4020792 - RNA, 15 nt, Human T-lymphotropic virus 2
gaccuggucuccaag

SEQ ID NO: 4020793 - RNA, 13 nt, Human T-lymphotropic virus 2
gacggcucccccc

SEQ ID NO: 4020794 - RNA, 14 nt, Human T-lymphotropic virus 2
gacgucccuccccc

SEQ ID NO: 4020795 - RNA, 17 nt, Human T-lymphotropic virus 2
gacgucccuccccccua

SEQ ID NO: 4020796 - RNA, 19 nt, Human T-lymphotropic virus 2
gacuacacccccccugccc

SEQ ID NO: 4020797 - RNA, 19 nt, Human T-lymphotropic virus 2
gagcuuguaucacccucac

SEQ ID NO: 4020798 - RNA, 18 nt, Human T-lymphotropic virus 2
gaggaacuccccucaucc

SEQ ID NO: 4020799 - RNA, 23 nt, Human T-lymphotropic virus 2
gaggaauuacaacaacucuccca

SEQ ID NO: 4020800 - RNA, 14 nt, Human T-lymphotropic virus 2
gagguggcucgcuc

SEQ ID NO: 4020801 - RNA, 15 nt, Human T-lymphotropic virus 2
gauagauccagccuc

SEQ ID NO: 4020802 - RNA, 18 nt, Human T-lymphotropic virus 2
gaucucccuuccaccuca

SEQ ID NO: 4020803 - RNA, 19 nt, Human T-lymphotropic virus 2
gauggcaaauccaccacag

SEQ ID NO: 4020804 - RNA, 17 nt, Human T-lymphotropic virus 2
gaugucagacucgccuc

SEQ ID NO: 4020805 - RNA, 16 nt, Human T-lymphotropic virus 2
gauuacccccugccca

SEQ ID NO: 4020806 - RNA, 21 nt, Human T-lymphotropic virus 2
gauuuccggcccuuaccccaa

SEQ ID NO: 4020807 - RNA, 20 nt, Human T-lymphotropic virus 2
gcaaacaccuacaaucccua

SEQ ID NO: 4020808 - RNA, 14 nt, Human T-lymphotropic virus 2
gcaaaccaacaccc

SEQ ID NO: 4020809 - RNA, 14 nt, Human T-lymphotropic virus 2
gcaaucccuccagg

SEQ ID NO: 4020810 - RNA, 22 nt, Human T-lymphotropic virus 2
gcacugaccacgcauggccuuc

SEQ ID NO: 4020811 - RNA, 16 nt, Human T-lymphotropic virus 2
gcagcaaauccccuag

SEQ ID NO: 4020812 - RNA, 22 nt, Human T-lymphotropic virus 2
gcagcaagggcuagggcuuccu

SEQ ID NO: 4020813 - RNA, 19 nt, Human T-lymphotropic virus 2
gcagccacaccaaccuccc

SEQ ID NO: 4020814 - RNA, 18 nt, Human T-lymphotropic virus 2
gcaggcgucccggggcca

SEQ ID NO: 4020815 - RNA, 19 nt, Human T-lymphotropic virus 2
gcaggcgucccggggccaa

SEQ ID NO: 4020816 - RNA, 21 nt, Human T-lymphotropic virus 2
gcauacacgggccccgucucc

SEQ ID NO: 4020817 - RNA, 17 nt, Human T-lymphotropic virus 2
gccaauuuucacccucu

SEQ ID NO: 4020818 - RNA, 19 nt, Human T-lymphotropic virus 2
gccaauuuucacccucucc

SEQ ID NO: 4020819 - RNA, 15 nt, Human T-lymphotropic virus 2
gccacaccaaccucc

SEQ ID NO: 4020820 - RNA, 14 nt, Human T-lymphotropic virus 2
gccagccacccagg

SEQ ID NO: 4020821 - RNA, 24 nt, Human T-lymphotropic virus 2
gccaggggcuucuauaccucccag

SEQ ID NO: 4020822 - RNA, 24 nt, Human T-lymphotropic virus 2
gccaucuuuaguaguucaguccuc

SEQ ID NO: 4020823 - RNA, 21 nt, Human T-lymphotropic virus 2
gcccaucaaacccuccaggcg

SEQ ID NO: 4020824 - RNA, 16 nt, Human T-lymphotropic virus 2
gccccaaggccuccac

SEQ ID NO: 4020825 - RNA, 15 nt, Human T-lymphotropic virus 2
ccaccuuacccaggc

SEQ ID NO: 4020826 - RNA, 17 nt, Human T-lymphotropic virus 2
ccacgcauggccuucca

SEQ ID NO: 4020827 - RNA, 15 nt, Human T-lymphotropic virus 2
ccacggccucaccca

SEQ ID NO: 4020828 - RNA, 14 nt, Human T-lymphotropic virus 2
ccacgggcuuuccc

SEQ ID NO: 4020829 - RNA, 20 nt, Human T-lymphotropic virus 2
ccacuagcccagcagagccg

SEQ ID NO: 4020830 - RNA, 17 nt, Human T-lymphotropic virus 2
ccagaugagucgccccc

SEQ ID NO: 4020831 - RNA, 23 nt, Human T-lymphotropic virus 2
ccagccauacuucgccuucacca

SEQ ID NO: 4020832 - RNA, 14 nt, Human T-lymphotropic virus 2
ccagcucugccaau

SEQ ID NO: 4020833 - RNA, 19 nt, Human T-lymphotropic virus 2
ccagcuuuccccacccaug

SEQ ID NO: 4020834 - RNA, 19 nt, Human T-lymphotropic virus 2
ccaggcggccuugccaccc

SEQ ID NO: 4020835 - RNA, 22 nt, Human T-lymphotropic virus 2
ccaggggcuucuauaccuccca

SEQ ID NO: 4020836 - RNA, 13 nt, Human T-lymphotropic virus 2
ccaguccauccug

SEQ ID NO: 4020837 - RNA, 19 nt, Human T-lymphotropic virus 2
ccaguucaaacuccuccaa

SEQ ID NO: 4020838 - RNA, 16 nt, Human T-lymphotropic virus 2
ccaucaaaacccagga

SEQ ID NO: 4020839 - RNA, 17 nt, Human T-lymphotropic virus 2
ccaucccaacccuuccc

SEQ ID NO: 4020840 - RNA, 17 nt, Human T-lymphotropic virus 2
ccaucuaccuccaccau

SEQ ID NO: 4020841 - RNA, 20 nt, Human T-lymphotropic virus 2
ccaucuuaacaaccccaggu

SEQ ID NO: 4020842 - RNA, 16 nt, Human T-lymphotropic virus 2
ccaugacuccgaccuu

SEQ ID NO: 4020843 - RNA, 20 nt, Human T-lymphotropic virus 2
ccaugcguuacaugccauuc

SEQ ID NO: 4020844 - RNA, 22 nt, Human T-lymphotropic virus 2
ccaugucauauucugccacccc

SEQ ID NO: 4020845 - RNA, 13 nt, Human T-lymphotropic virus 2
ccauguccgcagc

SEQ ID NO: 4020846 - RNA, 22 nt, Human T-lymphotropic virus 2
ccauuccccaacaaaccuccuc

SEQ ID NO: 4020847 - RNA, 17 nt, Human T-lymphotropic virus 2
ccauuggggccuuccuc

SEQ ID NO: 4020848 - RNA, 16 nt, Human T-lymphotropic virus 2
cccaaggccuccacgg

SEQ ID NO: 4020849 - RNA, 13 nt, Human T-lymphotropic virus 2
cccacacagcccu

SEQ ID NO: 4020850 - RNA, 21 nt, Human T-lymphotropic virus 2
cccaccacaauguuccaaccc

SEQ ID NO: 4020851 - RNA, 18 nt, Human T-lymphotropic virus 2
cccacucagccuccacca

SEQ ID NO: 4020852 - RNA, 17 nt, Human T-lymphotropic virus 2
cccacuuccccuagcgc

SEQ ID NO: 4020853 - RNA, 17 nt, Human T-lymphotropic virus 2
cccagccacgccccccu

SEQ ID NO: 4020854 - RNA, 18 nt, Human T-lymphotropic virus 2
cccagccacgccccccuc

SEQ ID NO: 4020855 - RNA, 14 nt, Human T-lymphotropic virus 2
cccaggagcccccu

SEQ ID NO: 4020856 - RNA, 18 nt, Human T-lymphotropic virus 2
cccaucaaacccuccagg

SEQ ID NO: 4020857 - RNA, 16 nt, Human T-lymphotropic virus 2
cccauugguccaugac

SEQ ID NO: 4020858 - RNA, 21 nt, Human T-lymphotropic virus 2
ccccaaaacaucuacaccacc

SEQ ID NO: 4020859 - RNA, 18 nt, Human T-lymphotropic virus 2
ccccaaagagcccaucuu

SEQ ID NO: 4020860 - RNA, 21 nt, Human T-lymphotropic virus 2
ccccaaagcagggcagccauc

SEQ ID NO: 4020861 - RNA, 19 nt, Human T-lymphotropic virus 2
cccccugcggcagcaacag

SEQ ID NO: 4020862 - RNA, 21 nt, Human T-lymphotropic virus 2
ccccgcucacauuccucccau

SEQ ID NO: 4020863 - RNA, 17 nt, Human T-lymphotropic virus 2
ccccgucuccaguccau

SEQ ID NO: 4020864 - RNA, 15 nt, Human T-lymphotropic virus 2
ccccucccaccacuc

SEQ ID NO: 4020865 - RNA, 13 nt, Human T-lymphotropic virus 2
ccccuccccaagc

SEQ ID NO: 4020866 - RNA, 20 nt, Human T-lymphotropic virus 2
ccccuccuguuggaucuccc

SEQ ID NO: 4020867 - RNA, 19 nt, Human T-lymphotropic virus 2
ccccuguauccuccgccaa

SEQ ID NO: 4020868 - RNA, 23 nt, Human T-lymphotropic virus 2
ccccuuacguggaacccaccacc

SEQ ID NO: 4020869 - RNA, 21 nt, Human T-lymphotropic virus 2
ccccuuagguagucgcucccc

SEQ ID NO: 4020870 - RNA, 23 nt, Human T-lymphotropic virus 2
cccgagccagccacccagggcga

SEQ ID NO: 4020871 - RNA, 20 nt, Human T-lymphotropic virus 2
cccgauggcaaauccaccac

SEQ ID NO: 4020872 - RNA, 17 nt, Human T-lymphotropic virus 2
cccgcgggaugacaggc

SEQ ID NO: 4020873 - RNA, 12 nt, Human T-lymphotropic virus 2
cccgucucaggu

SEQ ID NO: 4020874 - RNA, 18 nt, Human T-lymphotropic virus 2
cccuagguucgucccccu

SEQ ID NO: 4020875 - RNA, 12 nt, Human T-lymphotropic virus 2
cccuaucacucc

SEQ ID NO: 4020876 - RNA, 17 nt, Human T-lymphotropic virus 2
cccuaucucuggcuucc

SEQ ID NO: 4020877 - RNA, 13 nt, Human T-lymphotropic virus 2
cccuccagacagg

SEQ ID NO: 4020878 - RNA, 21 nt, Human T-lymphotropic virus 2
cccuccaggcggccuugccac

SEQ ID NO: 4020879 - RNA, 23 nt, Human T-lymphotropic virus 2
cccuccuaguagaugccccugga

SEQ ID NO: 4020880 - RNA, 17 nt, Human T-lymphotropic virus 2
cccuccuggccccugcc

SEQ ID NO: 4020881 - RNA, 21 nt, Human T-lymphotropic virus 2
cccucggggaucagcuccccu

SEQ ID NO: 4020882 - RNA, 15 nt, Human T-lymphotropic virus 2
cccucguaguuuccu

SEQ ID NO: 4020883 - RNA, 17 nt, Human T-lymphotropic virus 2
cccucuuggcaggcguc

SEQ ID NO: 4020884 - RNA, 20 nt, Human T-lymphotropic virus 2
cccucuugggcagcuauccu

SEQ ID NO: 4020885 - RNA, 15 nt, Human T-lymphotropic virus 2
cccugcccgcuccuc

SEQ ID NO: 4020886 - RNA, 15 nt, Human T-lymphotropic virus 2
cccuuacccacuucc

SEQ ID NO: 4020887 - RNA, 20 nt, Human T-lymphotropic virus 2
cccuucccuuggacccauug

SEQ ID NO: 4020888 - RNA, 14 nt, Human T-lymphotropic virus 2
ccgaucccgacccc

SEQ ID NO: 4020889 - RNA, 23 nt, Human T-lymphotropic virus 2
ccgccaaauccaggcccuuccac

SEQ ID NO: 4020890 - RNA, 16 nt, Human T-lymphotropic virus 2
ccgccgugccguucca

SEQ ID NO: 4020891 - RNA, 15 nt, Human T-lymphotropic virus 2
ccgcucccgcuccuc

SEQ ID NO: 4020892 - RNA, 16 nt, Human T-lymphotropic virus 2
ccgcuccuccauccca

SEQ ID NO: 4020893 - RNA, 21 nt, Human T-lymphotropic virus 2
ccggccucggcaccuccugaa

SEQ ID NO: 4020894 - RNA, 16 nt, Human T-lymphotropic virus 2
ccuacaacaaugccag

SEQ ID NO: 4020895 - RNA, 19 nt, Human T-lymphotropic virus 2
ccuacacacagggacaguc

SEQ ID NO: 4020896 - RNA, 18 nt, Human T-lymphotropic virus 2
ccuaccacuccagccccu

SEQ ID NO: 4020897 - RNA, 15 nt, Human T-lymphotropic virus 2
ccuaccucuccuugg

SEQ ID NO: 4020898 - RNA, 20 nt, Human T-lymphotropic virus 2
ccuacuacuacuccuccgcc

SEQ ID NO: 4020899 - RNA, 20 nt, Human T-lymphotropic virus 2
ccuacuugggcugccaagca

SEQ ID NO: 4020900 - RNA, 19 nt, Human T-lymphotropic virus 2
ccuagcgcccccgccgccc

SEQ ID NO: 4020901 - RNA, 14 nt, Human T-lymphotropic virus 2
ccuaggagcauugu

SEQ ID NO: 4020902 - RNA, 17 nt, Human T-lymphotropic virus 2
ccuagguucgucccccu

SEQ ID NO: 4020903 - RNA, 16 nt, Human T-lymphotropic virus 2
ccuauacacuccaacu

SEQ ID NO: 4020904 - RNA, 20 nt, Human T-lymphotropic virus 2
ccuaucacaagaauuccagg

SEQ ID NO: 4020905 - RNA, 20 nt, Human T-lymphotropic virus 2
ccucaaccccgcccuaccuc

SEQ ID NO: 4020906 - RNA, 22 nt, Human T-lymphotropic virus 2
ccucaaccccgcccuaccucuc

SEQ ID NO: 4020907 - RNA, 19 nt, Human T-lymphotropic virus 2
ccucacccuuacccacuuc

SEQ ID NO: 4020908 - RNA, 15 nt, Human T-lymphotropic virus 2
ccucaccucuccuuc

SEQ ID NO: 4020909 - RNA, 21 nt, Human T-lymphotropic virus 2
ccuccacggccucacccauug

SEQ ID NO: 4020910 - RNA, 18 nt, Human T-lymphotropic virus 2
ccuccaugacccuccuag

SEQ ID NO: 4020911 - RNA, 20 nt, Human T-lymphotropic virus 2
ccucccaaaccaccucccaa

SEQ ID NO: 4020912 - RNA, 15 nt, Human T-lymphotropic virus 2
ccucccaccacuccu

SEQ ID NO: 4020913 - RNA, 23 nt, Human T-lymphotropic virus 2
ccuccccaaguggaccaauuucc

SEQ ID NO: 4020914 - RNA, 20 nt, Human T-lymphotropic virus 2
ccuccccgaggguaccccca

SEQ ID NO: 4020915 - RNA, 18 nt, Human T-lymphotropic virus 2
ccucccgagccagccacc

SEQ ID NO: 4020916 - RNA, 18 nt, Human T-lymphotropic virus 2
ccuccgccaacagucucc

SEQ ID NO: 4020917 - RNA, 23 nt, Human T-lymphotropic virus 2
ccuccggcgacaagacgccgccg

SEQ ID NO: 4020918 - RNA, 19 nt, Human T-lymphotropic virus 2
ccuccuagggaaaccacuc

SEQ ID NO: 4020919 - RNA, 18 nt, Human T-lymphotropic virus 2
ccuccugaacugcuccuc

SEQ ID NO: 4020920 - RNA, 21 nt, Human T-lymphotropic virus 2
ccuccugaacugcuccuccca

SEQ ID NO: 4020921 - RNA, 17 nt, Human T-lymphotropic virus 2
ccuccuggccccugccc

SEQ ID NO: 4020922 - RNA, 16 nt, Human T-lymphotropic virus 2
ccucgccuccccuccu

SEQ ID NO: 4020923 - RNA, 16 nt, Human T-lymphotropic virus 2
ccucuccuuccccagg

SEQ ID NO: 4020924 - RNA, 20 nt, Human T-lymphotropic virus 2
ccucugcucuuggcagcccc

SEQ ID NO: 4020925 - RNA, 14 nt, Human T-lymphotropic virus 2
ccucuucgccguca

SEQ ID NO: 4020926 - RNA, 15 nt, Human T-lymphotropic virus 2
ccucuuuccuucccu

SEQ ID NO: 4020927 - RNA, 14 nt, Japanese encephalitis virus
caggaggacugggu

SEQ ID NO: 4020928 - RNA, 19 nt, Japanese encephalitis virus
caucagcuacuaggcacag

SEQ ID NO: 4020929 - RNA, 19 nt, Japanese encephalitis virus
ccagcaaaagcugccaccg

SEQ ID NO: 4020930 - RNA, 13 nt, Japanese encephalitis virus
ccaggaggacugg

SEQ ID NO: 4020931 - RNA, 14 nt, Japanese encephalitis virus
ccaggaggacuggg

SEQ ID NO: 4020932 - RNA, 17 nt, Japanese encephalitis virus
cccucgaagcuguagag

SEQ ID NO: 4020933 - RNA, 13 nt, Japanese encephalitis virus
ccugcgcagcccc

SEQ ID NO: 4020934 - RNA, 14 nt, Japanese encephalitis virus
ccugcgcagcccca

SEQ ID NO: 4020935 - RNA, 16 nt, Japanese encephalitis virus
cgagguguaaggacua

SEQ ID NO: 4020936 - RNA, 13 nt, Japanese encephalitis virus
cgcagccccagga

SEQ ID NO: 4020937 - RNA, 21 nt, Japanese encephalitis virus
cgcagccccaggaggacuggg

SEQ ID NO: 4020938 - RNA, 14 nt, Japanese encephalitis virus
cggcccaagccccc

SEQ ID NO: 4020939 - RNA, 15 nt, Japanese encephalitis virus
cucagucccaggagg

SEQ ID NO: 4020940 - RNA, 13 nt, Japanese encephalitis virus
cugggaauagacu

SEQ ID NO: 4020941 - RNA, 18 nt, Japanese encephalitis virus
cugucugcgucucagucc

SEQ ID NO: 4020942 - RNA, 17 nt, Japanese encephalitis virus
gaccaacgucaggccac

SEQ ID NO: 4020943 - RNA, 13 nt, Japanese encephalitis virus
gaggacuggguua

SEQ ID NO: 4020944 - RNA, 20 nt, Japanese encephalitis virus
gaggagaccccgcauuugca

SEQ ID NO: 4020945 - RNA, 15 nt, Japanese encephalitis virus
gaggagguggaagga

SEQ ID NO: 4020946 - RNA, 12 nt, Japanese encephalitis virus
gagucaggccag

SEQ ID NO: 4020947 - RNA, 16 nt, Japanese encephalitis virus
gauuuaaaguagaaaa

SEQ ID NO: 4020948 - RNA, 18 nt, Japanese encephalitis virus
gccaccggauacugggua

SEQ ID NO: 4020949 - RNA, 20 nt, Japanese encephalitis virus
gccccaggaggacuggguua

SEQ ID NO: 4020950 - RNA, 18 nt, Japanese encephalitis virus
gccugcgcagccccagga

SEQ ID NO: 4020951 - RNA, 16 nt, Japanese encephalitis virus
ggagguggaaggacua

SEQ ID NO: 4020952 - RNA, 14 nt, Japanese encephalitis virus
ggaugcaauagacg

SEQ ID NO: 4020953 - RNA, 17 nt, Japanese encephalitis virus
guaaggacuagagguua

SEQ ID NO: 4020954 - RNA, 12 nt, Japanese encephalitis virus
gucaggccagca

SEQ ID NO: 4020955 - RNA, 14 nt, Japanese encephalitis virus
gucucggaaguagg

SEQ ID NO: 4020956 - RNA, 12 nt, Japanese encephalitis virus
guuaccaaagcc

SEQ ID NO: 4020957 - RNA, 20 nt, Japanese encephalitis virus
uaucucaacaucagcuacua

SEQ ID NO: 4020958 - RNA, 22 nt, Japanese encephalitis virus
ugaaagaccaacgucaggccac

SEQ ID NO: 4020959 - RNA, 15 nt, Japanese encephalitis virus
ugagcccccacggcc

SEQ ID NO: 4020960 - RNA, 22 nt, Japanese encephalitis virus
ugagcccccacggcccaagccu

SEQ ID NO: 4020961 - RNA, 19 nt, Japanese encephalitis virus
ugcauauggagucaggcca

SEQ ID NO: 4020962 - RNA, 18 nt, Japanese encephalitis virus
ugcaucaaacagcauauu

SEQ ID NO: 4020963 - RNA, 13 nt, Japanese encephalitis virus
uggagucaggcca

SEQ ID NO: 4020964 - RNA, 22 nt, Japanese encephalitis virus
uugaaagaccaacgucaggcca

SEQ ID NO: 4020965 - RNA, 11 nt, Japanese encephalitis virus
uugugccaccc

SEQ ID NO: 4020966 - RNA, 18 nt, Japanese encephalitis virus
uuuaaaguagaaaaguag

SEQ ID NO: 4020967 - RNA, 14 nt, Japanese encephalitis virus
augagaaaaugcau

SEQ ID NO: 4020968 - RNA, 17 nt, Japanese encephalitis virus
caacaauaugcggccca

SEQ ID NO: 4020969 - RNA, 20 nt, Japanese encephalitis virus
caauagacgagguguaagga

SEQ ID NO: 4020970 - RNA, 18 nt, Japanese encephalitis virus
caauaugcggcccaagcc

SEQ ID NO: 4020971 - RNA, 15 nt, Japanese encephalitis virus
cagucccaggaggac

SEQ ID NO: 4020972 - RNA, 19 nt, Japanese encephalitis virus
cagucccaggaggacuggg

SEQ ID NO: 4020973 - RNA, 15 nt, Japanese encephalitis virus
ccccaggaggacugg

SEQ ID NO: 4020974 - RNA, 16 nt, Japanese encephalitis virus
ccccgcauuugcauca

SEQ ID NO: 4020975 - RNA, 19 nt, Japanese encephalitis virus
cccucgaagcuguagagga

SEQ ID NO: 4020976 - RNA, 15 nt, Japanese encephalitis virus
ccugcgcagccccag

SEQ ID NO: 4020977 - RNA, 23 nt, Japanese encephalitis virus
cgagguguaaggacuagagguua

SEQ ID NO: 4020978 - RNA, 16 nt, Japanese encephalitis virus
cgcagccccaggagga

SEQ ID NO: 4020979 - RNA, 17 nt, Japanese encephalitis virus
cuagagguuagaggaga

SEQ ID NO: 4020980 - RNA, 21 nt, Japanese encephalitis virus
cuagagguuagaggagacccc

SEQ ID NO: 4020981 - RNA, 16 nt, Japanese encephalitis virus
cucagucccaggagga

SEQ ID NO: 4020982 - RNA, 14 nt, Japanese encephalitis virus
cucgucuaggaugc

SEQ ID NO: 4020983 - RNA, 22 nt, Japanese encephalitis virus
cugccaccggauacuggguaga

SEQ ID NO: 4020984 - RNA, 15 nt, Japanese encephalitis virus
cugcgcagccccagg

SEQ ID NO: 4020985 - RNA, 19 nt, Japanese encephalitis virus
cugggaauagacugggaga

SEQ ID NO: 4020986 - RNA, 18 nt, Japanese encephalitis virus
gacaccugggaauagacu

SEQ ID NO: 4020987 - RNA, 18 nt, Japanese encephalitis virus
gaccaacgucaggccaca

SEQ ID NO: 4020988 - RNA, 11 nt, Japanese encephalitis virus
gagaccccgca

SEQ ID NO: 4020989 - RNA, 19 nt, Japanese encephalitis virus
gagguuagaggagaccccg

SEQ ID NO: 4020990 - RNA, 24 nt, Japanese encephalitis virus
gaugcaauagacgagguguaagga

SEQ ID NO: 4020991 - RNA, 16 nt, Japanese encephalitis virus
gcaaaagcugccaccg

SEQ ID NO: 4020992 - RNA, 14 nt, Japanese encephalitis virus
gcagccccaggagg

SEQ ID NO: 4020993 - RNA, 15 nt, Japanese encephalitis virus
gcagccccaggagga

SEQ ID NO: 4020994 - RNA, 19 nt, Japanese encephalitis virus
gccagcaaaagcugccacc

SEQ ID NO: 4020995 - RNA, 20 nt, Japanese encephalitis virus
gccgaaguauguagcuggug

SEQ ID NO: 4020996 - RNA, 16 nt, Japanese encephalitis virus
gcgcagccccaggagg

SEQ ID NO: 4020997 - RNA, 20 nt, Japanese encephalitis virus
ggacuagagguuagaggaga

SEQ ID NO: 4020998 - RNA, 22 nt, Japanese encephalitis virus
ggacuagagguuagaggagacc

SEQ ID NO: 4020999 - RNA, 18 nt, Japanese encephalitis virus
ggggugcggccugcgcag

SEQ ID NO: 4021000 - RNA, 19 nt, Japanese encephalitis virus
ggugaggaagaacacagga

SEQ ID NO: 4021001 - RNA, 16 nt, Japanese encephalitis virus
gguggaaggacuagag

SEQ ID NO: 4021002 - RNA, 16 nt, Japanese encephalitis virus
gguguaaggacuagag

SEQ ID NO: 4021003 - RNA, 19 nt, Japanese encephalitis virus
guaaauaauguaaaugaga

SEQ ID NO: 4021004 - RNA, 15 nt, Japanese encephalitis virus
guagaaaaguagacu

SEQ ID NO: 4021005 - RNA, 17 nt, Japanese encephalitis virus
gucucagucccaggagg

SEQ ID NO: 4021006 - RNA, 19 nt, Japanese encephalitis virus
gucugcgucucagucccag

SEQ ID NO: 4021007 - RNA, 22 nt, Japanese encephalitis virus
gugccaccccgcuagggggugc

SEQ ID NO: 4021008 - RNA, 22 nt, Japanese encephalitis virus
guuagaggagaccccguggaaa

SEQ ID NO: 4021009 - RNA, 16 nt, Japanese encephalitis virus
uaaaugagaaaaugca

SEQ ID NO: 4021010 - RNA, 22 nt, Japanese encephalitis virus
uaccaaagccguugagccccca

SEQ ID NO: 4021011 - RNA, 20 nt, Japanese encephalitis virus
uaggaugcaauagacgaggu

SEQ ID NO: 4021012 - RNA, 21 nt, Japanese encephalitis virus
ucagaaccgucucggaaguag

SEQ ID NO: 4021013 - RNA, 15 nt, Japanese encephalitis virus
ucagucccaggagga

SEQ ID NO: 4021014 - RNA, 17 nt, Japanese encephalitis virus
ucccugcucacuggaag

SEQ ID NO: 4021015 - RNA, 21 nt, Japanese encephalitis virus
ucuaucucaacaucagcuacu

SEQ ID NO: 4021016 - RNA, 19 nt, Japanese encephalitis virus
ugcgcagccccaggaggac

SEQ ID NO: 4021017 - RNA, 23 nt, Japanese encephalitis virus
ugcggccugcgcagccccaggag

SEQ ID NO: 4021018 - RNA, 19 nt, Japanese encephalitis virus
ugcgucucagucccaggag

SEQ ID NO: 4021019 - RNA, 12 nt, Japanese encephalitis virus
uuugugccaccc

SEQ ID NO: 4021020 - RNA, 24 nt, Japanese encephalitis virus
aaaaguagacuauguaaauaaugu

SEQ ID NO: 4021021 - RNA, 18 nt, Japanese encephalitis virus
aaguugaaagaccaacgu

SEQ ID NO: 4021022 - RNA, 16 nt, Japanese encephalitis virus
aaugcaugcauaugga

SEQ ID NO: 4021023 - RNA, 22 nt, Japanese encephalitis virus
acaccugggaauagacugggag

SEQ ID NO: 4021024 - RNA, 20 nt, Japanese encephalitis virus
acuggguagacggugcuguc

SEQ ID NO: 4021025 - RNA, 17 nt, Japanese encephalitis virus
agagcgccgaaguaugu

SEQ ID NO: 4021026 - RNA, 13 nt, Japanese encephalitis virus
agagguuagagga

SEQ ID NO: 4021027 - RNA, 15 nt, Japanese encephalitis virus
agcuguagaggaggu

SEQ ID NO: 4021028 - RNA, 16 nt, Japanese encephalitis virus
aggaagaacacaggau

SEQ ID NO: 4021029 - RNA, 19 nt, Japanese encephalitis virus
aggacuggguuaccaaagc

SEQ ID NO: 4021030 - RNA, 14 nt, Japanese encephalitis virus
aggagaccccgcau

SEQ ID NO: 4021031 - RNA, 14 nt, Japanese encephalitis virus
aggagguggaagga

SEQ ID NO: 4021032 - RNA, 14 nt, Japanese encephalitis virus
agguguaaggacua

SEQ ID NO: 4021033 - RNA, 17 nt, Japanese encephalitis virus
auaauguaaaugagaaa

SEQ ID NO: 4021034 - RNA, 15 nt, Japanese encephalitis virus
auuugcaucaaacag

SEQ ID NO: 4021035 - RNA, 14 nt, Japanese encephalitis virus
caacgucaggccac

SEQ ID NO: 4021036 - RNA, 19 nt, Japanese encephalitis virus
cagaaagugagaaagcccu

SEQ ID NO: 4021037 - RNA, 18 nt, Japanese encephalitis virus
cagaaccgucucggaagu

SEQ ID NO: 4021038 - RNA, 21 nt, Japanese encephalitis virus
cagcauauugacaccugggaa

SEQ ID NO: 4021039 - RNA, 15 nt, Japanese encephalitis virus
caggaggacuggguu

SEQ ID NO: 4021040 - RNA, 13 nt, Japanese encephalitis virus
cagucccaggagg

SEQ ID NO: 4021041 - RNA, 22 nt, Japanese encephalitis virus
ccaagcccccucgaagcuguag

SEQ ID NO: 4021042 - RNA, 17 nt, Japanese encephalitis virus
ccacggcccaagccucg

SEQ ID NO: 4021043 - RNA, 22 nt, Japanese encephalitis virus
cgccgaaguauguagcuggugg

SEQ ID NO: 4021044 - RNA, 23 nt, Japanese encephalitis virus
cgucucagucccaggaggacugg

SEQ ID NO: 4021045 - RNA, 18 nt, Japanese encephalitis virus
cuagagguuagaggagac

SEQ ID NO: 4021046 - RNA, 14 nt, Japanese encephalitis virus
cucagucccaggag

SEQ ID NO: 4021047 - RNA, 20 nt, Japanese encephalitis virus
cugcgcagccccaggaggac

SEQ ID NO: 4021048 - RNA, 24 nt, Japanese encephalitis virus
cugcgcagccccaggaggacuggg

SEQ ID NO: 4021049 - RNA, 16 nt, Japanese encephalitis virus
cugggaauagacuggg

SEQ ID NO: 4021050 - RNA, 17 nt, Japanese encephalitis virus
gacugggagaucuucug

SEQ ID NO: 4021051 - RNA, 18 nt, Japanese encephalitis virus
gacuggguuaccaaagcc

SEQ ID NO: 4021052 - RNA, 19 nt, Japanese encephalitis virus
gccacaaauuugugccacc

SEQ ID NO: 4021053 - RNA, 13 nt, Japanese encephalitis virus
gcccaagcccccu

SEQ ID NO: 4021054 - RNA, 11 nt, Japanese encephalitis virus
gcggcccaagc

SEQ ID NO: 4021055 - RNA, 18 nt, Japanese encephalitis virus
gcgucucagucccaggag

SEQ ID NO: 4021056 - RNA, 19 nt, Japanese encephalitis virus
gcgucucagucccaggagg

SEQ ID NO: 4021057 - RNA, 17 nt, Japanese encephalitis virus
gcuacuaggcacagagc

SEQ ID NO: 4021058 - RNA, 13 nt, Japanese encephalitis virus
ggucccugcucac

SEQ ID NO: 4021059 - RNA, 14 nt, Japanese encephalitis virus
gucucagucccagg

SEQ ID NO: 4021060 - RNA, 20 nt, Japanese encephalitis virus
gucucggaaguaggucccug

SEQ ID NO: 4021061 - RNA, 23 nt, Japanese encephalitis virus
gugauuuaaaguagaaaaguaga

SEQ ID NO: 4021062 - RNA, 17 nt, Japanese encephalitis virus
gugcggccugcgcagcc

SEQ ID NO: 4021063 - RNA, 19 nt, Japanese encephalitis virus
guggaaggacuagagguua

SEQ ID NO: 4021064 - RNA, 14 nt, Japanese encephalitis virus
uaugcggcccaagc

SEQ ID NO: 4021065 - RNA, 21 nt, Japanese encephalitis virus
ucaggccacaaauuugugcca

SEQ ID NO: 4021066 - RNA, 23 nt, Japanese encephalitis virus
ucaggccacaaauuugugccacc

SEQ ID NO: 4021067 - RNA, 21 nt, Japanese encephalitis virus
ucaggccagcaaaagcugcca

SEQ ID NO: 4021068 - RNA, 23 nt, Japanese encephalitis virus
ucaggccagcaaaagcugccacc

SEQ ID NO: 4021069 - RNA, 14 nt, Japanese encephalitis virus
ucagucccaggagg

SEQ ID NO: 4021070 - RNA, 16 nt, Japanese encephalitis virus
ucucagucccaggagg

SEQ ID NO: 4021071 - RNA, 16 nt, Japanese encephalitis virus
ugcgcagccccaggag

SEQ ID NO: 4021072 - RNA, 18 nt, Japanese encephalitis virus
ugcgcagccccaggagga

SEQ ID NO: 4021073 - RNA, 22 nt, Japanese encephalitis virus
ugcgcagccccaggaggacugg

SEQ ID NO: 4021074 - RNA, 13 nt, Japanese encephalitis virus
ugcggcccaagcc

SEQ ID NO: 4021075 - RNA, 14 nt, Japanese encephalitis virus
ugcggcccaagccc

SEQ ID NO: 4021076 - RNA, 18 nt, Japanese encephalitis virus
ugcggcccaagcccccuc

SEQ ID NO: 4021077 - RNA, 21 nt, Japanese encephalitis virus
ugcggccugcgcagccccagg

SEQ ID NO: 4021078 - RNA, 17 nt, Japanese encephalitis virus
ugcgucucagucccagg

SEQ ID NO: 4021079 - RNA, 21 nt, Japanese encephalitis virus
ugcgucucagucccaggagga

SEQ ID NO: 4021080 - RNA, 21 nt, Japanese encephalitis virus
uugagcccccacggcccaagc

SEQ ID NO: 4021081 - RNA, 15 nt, Japanese encephalitis virus
uugcaucaaacagca

SEQ ID NO: 4021082 - RNA, 13 nt, Japanese encephalitis virus
agaaagugagaaa

SEQ ID NO: 4021083 - RNA, 22 nt, Japanese encephalitis virus
agaaagugagaaagcccucaga

SEQ ID NO: 4021084 - RNA, 19 nt, Japanese encephalitis virus
agaggagguggaaggacua

SEQ ID NO: 4021085 - RNA, 16 nt, Japanese encephalitis virus
agcaaaagcugccacc

SEQ ID NO: 4021086 - RNA, 13 nt, Japanese encephalitis virus
agccccaggagga

SEQ ID NO: 4021087 - RNA, 20 nt, Japanese encephalitis virus
agcugguggugaggaagaac

SEQ ID NO: 4021088 - RNA, 14 nt, Japanese encephalitis virus
aggaagaacacagg

SEQ ID NO: 4021089 - RNA, 13 nt, Japanese encephalitis virus
aggaggacugggu

SEQ ID NO: 4021090 - RNA, 19 nt, Japanese encephalitis virus
aggccacaaauuugugcca

SEQ ID NO: 4021091 - RNA, 17 nt, Japanese encephalitis virus
aggccagcaaaagcugc

SEQ ID NO: 4021092 - RNA, 19 nt, Japanese encephalitis virus
aggccagcaaaagcugcca

SEQ ID NO: 4021093 - RNA, 20 nt, Japanese encephalitis virus
aggccagcaaaagcugccac

SEQ ID NO: 4021094 - RNA, 18 nt, Japanese encephalitis virus
agguggaaggacuagagg

SEQ ID NO: 4021095 - RNA, 18 nt, Japanese encephalitis virus
agguguaaggacuagagg

SEQ ID NO: 4021096 - RNA, 20 nt, Japanese encephalitis virus
aucucaacaucagcuacuag

SEQ ID NO: 4021097 - RNA, 15 nt, Japanese encephalitis virus
aagcuguagaggagg

SEQ ID NO: 4021098 - RNA, 15 nt, Japanese encephalitis virus
aaggacuagagguua

SEQ ID NO: 4021099 - RNA, 23 nt, Japanese encephalitis virus
aaggacuagagguuagaggagac

SEQ ID NO: 4021100 - RNA, 19 nt, Japanese encephalitis virus
accugggaauagacuggga

SEQ ID NO: 4021101 - RNA, 11 nt, Japanese encephalitis virus
agccccaggag

SEQ ID NO: 4021102 - RNA, 19 nt, Japanese encephalitis virus
agccguugagcccccacgg

SEQ ID NO: 4021103 - RNA, 14 nt, Japanese encephalitis virus
agcuguagaggagg

SEQ ID NO: 4021104 - RNA, 22 nt, Japanese encephalitis virus
aggacuagagguuagaggagac

SEQ ID NO: 4021105 - RNA, 20 nt, Japanese encephalitis virus
aggagaccccgcauuugcau

SEQ ID NO: 4021106 - RNA, 21 nt, Japanese encephalitis virus
aggagguggaaggacuagagg

SEQ ID NO: 4021107 - RNA, 20 nt, Japanese encephalitis virus
aggccacaaauuugugccac

SEQ ID NO: 4021108 - RNA, 11 nt, Japanese encephalitis virus
agucccaggag

SEQ ID NO: 4021109 - RNA, 22 nt, Japanese encephalitis virus
aucuucugcucuaucucaacau

SEQ ID NO: 4021110 - RNA, 19 nt, Japanese encephalitis virus
auguagcugguggugagga

SEQ ID NO: 4021111 - RNA, 22 nt, Japanese encephalitis virus
auugacaccugggaauagacug

SEQ ID NO: 4021112 - RNA, 18 nt, Japanese encephalitis virus
caacaauaugcggcccaa

SEQ ID NO: 4021113 - RNA, 13 nt, Japanese encephalitis virus
caacgucaggcca

SEQ ID NO: 4021114 - RNA, 16 nt, Japanese encephalitis virus
caacgucaggccacaa

SEQ ID NO: 4021115 - RNA, 17 nt, Japanese encephalitis virus
caacgucaggccacaaa

SEQ ID NO: 4021116 - RNA, 18 nt, Japanese encephalitis virus
caccggauacuggguaga

SEQ ID NO: 4021117 - RNA, 22 nt, Japanese encephalitis virus
cagcauauugacaccugggaau

SEQ ID NO: 4021118 - RNA, 14 nt, Japanese encephalitis virus
cagccccaggagga

SEQ ID NO: 4021119 - RNA, 21 nt, Japanese encephalitis virus
cagccccaggaggacuggguu

SEQ ID NO: 4021120 - RNA, 12 nt, Japanese encephalitis virus
caggccagcaaa

SEQ ID NO: 4021121 - RNA, 21 nt, Japanese encephalitis virus
cagucccaggaggacuggguu

SEQ ID NO: 4021122 - RNA, 14 nt, Japanese encephalitis virus
ccaacgucaggcca

SEQ ID NO: 4021123 - RNA, 23 nt, Japanese encephalitis virus
ccacaaauuugugccaccccgcu

SEQ ID NO: 4021124 - RNA, 20 nt, Japanese encephalitis virus
cccaagccucgucuaggaug

SEQ ID NO: 4021125 - RNA, 19 nt, Japanese encephalitis virus
ccgucucggaaguaggucc

SEQ ID NO: 4021126 - RNA, 19 nt, Japanese encephalitis virus
ccugggaauagacugggag

SEQ ID NO: 4021127 - RNA, 20 nt, Japanese encephalitis virus
cgagguguaaggacuagagg

SEQ ID NO: 4021128 - RNA, 15 nt, Japanese encephalitis virus
cgcagccccaggagg

SEQ ID NO: 4021129 - RNA, 20 nt, Japanese encephalitis virus
cggccugcgcagccccagga

SEQ ID NO: 4021130 - RNA, 16 nt, Japanese encephalitis virus
cgucucagucccagga

SEQ ID NO: 4021131 - RNA, 17 nt, Japanese encephalitis virus
cuaggaugcaauagacg

SEQ ID NO: 4021132 - RNA, 12 nt, Japanese encephalitis virus
cucacuggaagu

SEQ ID NO: 4021133 - RNA, 13 nt, Japanese encephalitis virus
cucagucccagga

SEQ ID NO: 4021134 - RNA, 20 nt, Japanese encephalitis virus
cucagucccaggaggacugg

SEQ ID NO: 4021135 - RNA, 20 nt, Japanese encephalitis virus
cugcgucucagucccaggag

SEQ ID NO: 4021136 - RNA, 15 nt, Japanese encephalitis virus
gagaaaaugcaugca

SEQ ID NO: 4021137 - RNA, 20 nt, Japanese encephalitis virus
gagucaggccagcaaaagcu

SEQ ID NO: 4021138 - RNA, 13 nt, Japanese encephalitis virus
gcagccccaggag

SEQ ID NO: 4021139 - RNA, 18 nt, Japanese encephalitis virus
gcauauggagucaggcca

SEQ ID NO: 4021140 - RNA, 16 nt, Japanese encephalitis virus
gccccaggaggacugg

SEQ ID NO: 4021141 - RNA, 23 nt, Japanese encephalitis virus
gcccccacggcccaagccucguc

SEQ ID NO: 4021142 - RNA, 17 nt, Japanese encephalitis virus
gccugcgcagccccagg

SEQ ID NO: 4021143 - RNA, 14 nt, Japanese encephalitis virus
guagcuggugguga

SEQ ID NO: 4021144 - RNA, 12 nt, Japanese encephalitis virus
gucccaggagga

SEQ ID NO: 4021145 - RNA, 16 nt, Japanese encephalitis virus
gucccaggaggacugg

SEQ ID NO: 4021146 - RNA, 22 nt, Japanese encephalitis virus
guugagcccccacggcccaagc

SEQ ID NO: 4021147 - RNA, 23 nt, Japanese encephalitis virus
guugagcccccacggcccaagcc

SEQ ID NO: 4021148 - RNA, 23 nt, Japanese encephalitis virus
uacuggguagacggugcugucug

SEQ ID NO: 4021149 - RNA, 13 nt, Japanese encephalitis virus
uagagguuagagg

SEQ ID NO: 4021150 - RNA, 21 nt, Japanese encephalitis virus
uaucucaacaucagcuacuag

SEQ ID NO: 4021151 - RNA, 15 nt, Japanese encephalitis virus
ucucagucccaggag

SEQ ID NO: 4021152 - RNA, 22 nt, Japanese encephalitis virus
ugcgucucagucccaggaggac

SEQ ID NO: 4021153 - RNA, 14 nt, Japanese encephalitis virus
uggagucaggccag

SEQ ID NO: 4021154 - RNA, 20 nt, Japanese encephalitis virus
uguagcugguggugaggaag

SEQ ID NO: 4021155 - RNA, 18 nt, Japanese encephalitis virus
uuaaaguagaaaaguaga

SEQ ID NO: 4021156 - RNA, 22 nt, Japanese encephalitis virus
uuaccaaagccguugagccccc

SEQ ID NO: 4021157 - RNA, 22 nt, Japanese encephalitis virus
uugacaccugggaauagacugg

SEQ ID NO: 4021158 - RNA, 16 nt, Japanese encephalitis virus
uugagcccccacggcc

SEQ ID NO: 4021159 - RNA, 20 nt, Japanese encephalitis virus
aaguagaaaaguagacuaug

SEQ ID NO: 4021160 - RNA, 18 nt, Japanese encephalitis virus
accugggaauagacuggg

SEQ ID NO: 4021161 - RNA, 18 nt, Japanese encephalitis virus
acuagagguuagaggaga

SEQ ID NO: 4021162 - RNA, 19 nt, Japanese encephalitis virus
acugggagaucuucugcuc

SEQ ID NO: 4021163 - RNA, 22 nt, Japanese encephalitis virus
acugggagaucuucugcucuau

SEQ ID NO: 4021164 - RNA, 16 nt, Japanese encephalitis virus
agacgagguguaagga

SEQ ID NO: 4021165 - RNA, 16 nt, Japanese encephalitis virus
agagguuagaggagac

SEQ ID NO: 4021166 - RNA, 20 nt, Japanese encephalitis virus
agcaaaagcugccaccggau

SEQ ID NO: 4021167 - RNA, 12 nt, Japanese encephalitis virus
agccccaggagg

SEQ ID NO: 4021168 - RNA, 17 nt, Japanese encephalitis virus
agccccaggaggacugg

SEQ ID NO: 4021169 - RNA, 19 nt, Japanese encephalitis virus
agcugguggugaggaagaa

SEQ ID NO: 4021170 - RNA, 15 nt, Japanese encephalitis virus
aggagguggaaggac

SEQ ID NO: 4021171 - RNA, 13 nt, Japanese encephalitis virus
aggcacagagcgc

SEQ ID NO: 4021172 - RNA, 12 nt, Japanese encephalitis virus
agucaggccagc

SEQ ID NO: 4021173 - RNA, 19 nt, Japanese encephalitis virus
agucaggccagcaaaagcu

SEQ ID NO: 4021174 - RNA, 13 nt, Japanese encephalitis virus
agucccaggagga

SEQ ID NO: 4021175 - RNA, 17 nt, Japanese encephalitis virus
agucccaggaggacugg

SEQ ID NO: 4021176 - RNA, 19 nt, Japanese encephalitis virus
agucccaggaggacugggu

SEQ ID NO: 4021177 - RNA, 21 nt, Japanese encephalitis virus
aguugaaagaccaacgucagg

SEQ ID NO: 4021178 - RNA, 20 nt, Japanese encephalitis virus
caagccucgucuaggaugca

SEQ ID NO: 4021179 - RNA, 16 nt, Japanese encephalitis virus
caccggauacugggua

SEQ ID NO: 4021180 - RNA, 21 nt, Japanese encephalitis virus
caccugggaauagacugggag

SEQ ID NO: 4021181 - RNA, 13 nt, Japanese encephalitis virus
cacggcccaagcc

SEQ ID NO: 4021182 - RNA, 12 nt, Japanese encephalitis virus
cagccccaggag

SEQ ID NO: 4021183 - RNA, 13 nt, Japanese encephalitis virus
cagccccaggagg

SEQ ID NO: 4021184 - RNA, 19 nt, Japanese encephalitis virus
cagccccaggaggacuggg

SEQ ID NO: 4021185 - RNA, 16 nt, Marburg virus
agaucaacaugccucc

SEQ ID NO: 4021186 - RNA, 22 nt, Marburg virus
agcaagggcuuucaucaacaau

SEQ ID NO: 4021187 - RNA, 23 nt, Marburg virus
agcaagggcuuucaucaacaaug

SEQ ID NO: 4021188 - RNA, 19 nt, Marburg virus
agcacacccacucagaaug

SEQ ID NO: 4021189 - RNA, 22 nt, Marburg virus
agcaccccaacugaugccacca

SEQ ID NO: 4021190 - RNA, 18 nt, Marburg virus
agcauggccuaaaugggu

SEQ ID NO: 4021191 - RNA, 22 nt, Marburg virus
agcuaugauugucaauaagaca

SEQ ID NO: 4021192 - RNA, 19 nt, Marburg virus
agcuugcuuuacacaagau

SEQ ID NO: 4021193 - RNA, 21 nt, Marburg virus
agcuuuauauguaaugaacaa

SEQ ID NO: 4021194 - RNA, 21 nt, Marburg virus
aggaguguugggacaguguuu

SEQ ID NO: 4021195 - RNA, 13 nt, Marburg virus
aggauuauaucau

SEQ ID NO: 4021196 - RNA, 17 nt, Marburg virus
aggcaguucuaagagaa

SEQ ID NO: 4021197 - RNA, 19 nt, Marburg virus
aggcgucuagccaaucaaa

SEQ ID NO: 4021198 - RNA, 15 nt, Marburg virus
agggacaaauuauug

SEQ ID NO: 4021199 - RNA, 18 nt, Marburg virus
agggagaucaaauuauug

SEQ ID NO: 4021200 - RNA, 20 nt, Marburg virus
aguaagaaaaacuaaugaag

SEQ ID NO: 4021201 - RNA, 12 nt, Marburg virus
aguaaucaaauu

SEQ ID NO: 4021202 - RNA, 21 nt, Marburg virus
aguaauuuauuucugucuuaa

SEQ ID NO: 4021203 - RNA, 18 nt, Marburg virus
agucuucgggcuguuccu

SEQ ID NO: 4021204 - RNA, 15 nt, Marburg virus
agugcacaaaaugau

SEQ ID NO: 4021205 - RNA, 15 nt, Marburg virus
aguuaaauuucuaga

SEQ ID NO: 4021206 - RNA, 16 nt, Marburg virus
aguuccaguaaaaaca

SEQ ID NO: 4021207 - RNA, 17 nt, Marburg virus
auaaaaaucccaacaau

SEQ ID NO: 4021208 - RNA, 18 nt, Marburg virus
auaaacuuguagaauuac

SEQ ID NO: 4021209 - RNA, 15 nt, Marburg virus
auaagguuaaaaaac

SEQ ID NO: 4021210 - RNA, 13 nt, Marburg virus
auaaguuuaagau

SEQ ID NO: 4021211 - RNA, 18 nt, Marburg virus
auaauagugcauuuguau

SEQ ID NO: 4021212 - RNA, 20 nt, Marburg virus
auaaucugauugugagauua

SEQ ID NO: 4021213 - RNA, 15 nt, Marburg virus
auacaaagacacuaa

SEQ ID NO: 4021214 - RNA, 23 nt, Marburg virus
auacccucaccacugcccacagc

SEQ ID NO: 4021215 - RNA, 22 nt, Marburg virus
auacuuaucuacauuaauuccu

SEQ ID NO: 4021216 - RNA, 15 nt, Marburg virus
auaguaauguuuuau

SEQ ID NO: 4021217 - RNA, 13 nt, Marburg virus
auaguauaaagua

SEQ ID NO: 4021218 - RNA, 15 nt, Marburg virus
auauaucaugaaacu

SEQ ID NO: 4021219 - RNA, 19 nt, Marburg virus
auauaucaugaaacucagu

SEQ ID NO: 4021220 - RNA, 22 nt, Marburg virus
auaucgucucaaaccguacaca

SEQ ID NO: 4021221 - RNA, 14 nt, Marburg virus
auauuaaagguuuu

SEQ ID NO: 4021222 - RNA, 16 nt, Marburg virus
auauuucagaaagaaa

SEQ ID NO: 4021223 - RNA, 19 nt, Marburg virus
aucaaacugccaaauccuu

SEQ ID NO: 4021224 - RNA, 15 nt, Marburg virus
aucaagcauauuuca

SEQ ID NO: 4021225 - RNA, 17 nt, Marburg virus
aucacgcgcacaaauua

SEQ ID NO: 4021226 - RNA, 13 nt, Marburg virus
aucagcuaucaaa

SEQ ID NO: 4021227 - RNA, 22 nt, Marburg virus
aucagucuuaucuuaauccaag

SEQ ID NO: 4021228 - RNA, 20 nt, Marburg virus
aucaucuuauuaaauaguug

SEQ ID NO: 4021229 - RNA, 13 nt, Marburg virus
aucuacugaaauc

SEQ ID NO: 4021230 - RNA, 17 nt, Marburg virus
aucuaugcgaugaugag

SEQ ID NO: 4021231 - RNA, 17 nt, Marburg virus
aucuguuugagcaugaa

SEQ ID NO: 4021232 - RNA, 21 nt, Marburg virus
aucuuaaacuugaugaugcag

SEQ ID NO: 4021233 - RNA, 13 nt, Marburg virus
aucuuauuaaaua

SEQ ID NO: 4021234 - RNA, 12 nt, Marburg virus
augaucuucaag

SEQ ID NO: 4021235 - RNA, 18 nt, Marburg virus
augcaaaccauaaggaaa

SEQ ID NO: 4021236 - RNA, 18 nt, Marburg virus
augcaacaagucagugag

SEQ ID NO: 4021237 - RNA, 14 nt, Marburg virus
augcaauuaaucau

SEQ ID NO: 4021238 - RNA, 15 nt, Marburg virus
augcauuaauguuuu

SEQ ID NO: 4021239 - RNA, 22 nt, Marburg virus
augccaccacacucaacaccac

SEQ ID NO: 4021240 - RNA, 17 nt, Marburg virus
augccauugacuuucua

SEQ ID NO: 4021241 - RNA, 20 nt, Marburg virus
augcccccccacaacaccac

SEQ ID NO: 4021242 - RNA, 23 nt, Marburg virus
auggcaucuuuacaccaggaaaa

SEQ ID NO: 4021243 - RNA, 18 nt, Marburg virus
auggcccgaaaaaugcuc

SEQ ID NO: 4021244 - RNA, 18 nt, Marburg virus
augguuugauauucaauu

SEQ ID NO: 4021245 - RNA, 15 nt, Marburg virus
augugugcuugaaua

SEQ ID NO: 4021246 - RNA, 22 nt, Marburg virus
auguugaugaaauuaagggaau

SEQ ID NO: 4021247 - RNA, 20 nt, Marburg virus
auuaaaaaauuaaaaaacuu

SEQ ID NO: 4021248 - RNA, 16 nt, Marburg virus
auuaaaagaaaaagag

SEQ ID NO: 4021249 - RNA, 16 nt, Marburg virus
auuaacuuuuguugca

SEQ ID NO: 4021250 - RNA, 14 nt, Marburg virus
auuaaguguucuuu

SEQ ID NO: 4021251 - RNA, 15 nt, Marburg virus
auuaauccuugaagu

SEQ ID NO: 4021252 - RNA, 15 nt, Marburg virus
auuaauuccuugaau

SEQ ID NO: 4021253 - RNA, 15 nt, Marburg virus
auuacaugagauaac

SEQ ID NO: 4021254 - RNA, 15 nt, Marburg virus
auucgacagcauuaa

SEQ ID NO: 4021255 - RNA, 15 nt, Marburg virus
auugauauugaaccu

SEQ ID NO: 4021256 - RNA, 13 nt, Marburg virus
auugaucaaacac

SEQ ID NO: 4021257 - RNA, 21 nt, Marburg virus
auugauugagcuucucaaaug

SEQ ID NO: 4021258 - RNA, 22 nt, Marburg virus
auugggacaacgaguucuugaa

SEQ ID NO: 4021259 - RNA, 15 nt, Marburg virus
auuguuugggaccaa

SEQ ID NO: 4021260 - RNA, 12 nt, Marburg virus
auuuaagggaac

SEQ ID NO: 4021261 - RNA, 20 nt, Marburg virus
auuucaaaagcauauaugug

SEQ ID NO: 4021262 - RNA, 14 nt, Marburg virus
auuucagaaagaaa

SEQ ID NO: 4021263 - RNA, 21 nt, Marburg virus
auuugaccaaaguaauguuuu

SEQ ID NO: 4021264 - RNA, 11 nt, Marburg virus
auuugaugcau

SEQ ID NO: 4021265 - RNA, 22 nt, Marburg virus
auuuuuggaugcauuucaccag

SEQ ID NO: 4021266 - RNA, 15 nt, Marburg virus
caaaaccaacacaac

SEQ ID NO: 4021267 - RNA, 19 nt, Marburg virus
caaaagcuuccugaugaug

SEQ ID NO: 4021268 - RNA, 13 nt, Marburg virus
caaacacuuggaa

SEQ ID NO: 4021269 - RNA, 20 nt, Marburg virus
caaagagcacuaacaacacg

SEQ ID NO: 4021270 - RNA, 12 nt, Marburg virus
caaauauuggau

SEQ ID NO: 4021271 - RNA, 20 nt, Marburg virus
caacaccacagacccaaaca

SEQ ID NO: 4021272 - RNA, 14 nt, Marburg virus
caacggcacaaccg

SEQ ID NO: 4021273 - RNA, 17 nt, Marburg virus
caacuuaagaaugcauu

SEQ ID NO: 4021274 - RNA, 17 nt, Marburg virus
caagaugucgaaaguuc

SEQ ID NO: 4021275 - RNA, 15 nt, Marburg virus
caagcuucaaaacca

SEQ ID NO: 4021276 - RNA, 22 nt, Marburg virus
caaguccuuucaaaaauugcuu

SEQ ID NO: 4021277 - RNA, 14 nt, Marburg virus
caaucaaaucacuu

SEQ ID NO: 4021278 - RNA, 19 nt, Marburg virus
cacauagguucugauuuag

SEQ ID NO: 4021279 - RNA, 14 nt, Marburg virus
caccaggaaaauac

SEQ ID NO: 4021280 - RNA, 13 nt, Marburg virus
cagaaagaaacga

SEQ ID NO: 4021281 - RNA, 17 nt, Marburg virus
cagaaauguuagccaaa

SEQ ID NO: 4021282 - RNA, 19 nt, Marburg virus
cagaacauuugaugcuuuc

SEQ ID NO: 4021283 - RNA, 15 nt, Marburg virus
gcauuggaauagaag

SEQ ID NO: 4021284 - RNA, 22 nt, Marburg virus
gcauuuguauagauucaauuau

SEQ ID NO: 4021285 - RNA, 17 nt, Marburg virus
gcuccggaacucuccag

SEQ ID NO: 4021286 - RNA, 18 nt, Marburg virus
gcuggccauaucuggcau

SEQ ID NO: 4021287 - RNA, 18 nt, Marburg virus
gcuuaaauguaccaggau

SEQ ID NO: 4021288 - RNA, 22 nt, Marburg virus
gcuucaaaaccaggguuaagag

SEQ ID NO: 4021289 - RNA, 14 nt, Marburg virus
ggacaaauuaauug

SEQ ID NO: 4021290 - RNA, 15 nt, Marburg virus
ggacauguauaucau

SEQ ID NO: 4021291 - RNA, 14 nt, Marburg virus
ggagaaaaugagaa

SEQ ID NO: 4021292 - RNA, 22 nt, Marburg virus
ggauagcuucauuucauucaau

SEQ ID NO: 4021293 - RNA, 23 nt, Marburg virus
ggaucaagcauauuucauucaaa

SEQ ID NO: 4021294 - RNA, 16 nt, Marburg virus
gguuaccuacuuaucu

SEQ ID NO: 4021295 - RNA, 13 nt, Marburg virus
gguuuuuuauucu

SEQ ID NO: 4021296 - RNA, 21 nt, Marburg virus
guauaacaaagaauauaccua

SEQ ID NO: 4021297 - RNA, 12 nt, Marburg virus
guauagagggac

SEQ ID NO: 4021298 - RNA, 13 nt, Marburg virus
guauccucuggag

SEQ ID NO: 4021299 - RNA, 20 nt, Marburg virus
guaugaucgcauugccucca

SEQ ID NO: 4021300 - RNA, 21 nt, Marburg virus
guauucccuauaagugauuua

SEQ ID NO: 4021301 - RNA, 13 nt, Marburg virus
gucagugauuuuu

SEQ ID NO: 4021302 - RNA, 16 nt, Marburg virus
gugaauguaaauuaag

SEQ ID NO: 4021303 - RNA, 22 nt, Marburg virus
gugaguggcuuuuaucaucaaa

SEQ ID NO: 4021304 - RNA, 20 nt, Marburg virus
guguucuuacuaacuugggc

SEQ ID NO: 4021305 - RNA, 17 nt, Marburg virus
guguugaccuuggaaaa

SEQ ID NO: 4021306 - RNA, 18 nt, Marburg virus
guuacacaagagaaggaa

SEQ ID NO: 4021307 - RNA, 16 nt, Marburg virus
guuacagcuauaucua

SEQ ID NO: 4021308 - RNA, 20 nt, Marburg virus
guuagacgccaguuauccau

SEQ ID NO: 4021309 - RNA, 18 nt, Marburg virus
guucauaugcuuucagaa

SEQ ID NO: 4021310 - RNA, 21 nt, Marburg virus
guuucauaugcugccauauuu

SEQ ID NO: 4021311 - RNA, 21 nt, Marburg virus
uaaaaacccaaagucaacaau

SEQ ID NO: 4021312 - RNA, 11 nt, Marburg virus
uaaaagggaaa

SEQ ID NO: 4021313 - RNA, 15 nt, Marburg virus
uaaaauuaauucaca

SEQ ID NO: 4021314 - RNA, 17 nt, Marburg virus
uaaacuugcauauccuu

SEQ ID NO: 4021315 - RNA, 22 nt, Marburg virus
uaaagcuuuaggacaauugcua

SEQ ID NO: 4021316 - RNA, 17 nt, Marburg virus
uaaauauccaucaagca

SEQ ID NO: 4021317 - RNA, 14 nt, Marburg virus
uaaaucuugaccuu

SEQ ID NO: 4021318 - RNA, 12 nt, Marburg virus
uaacaugaagac

SEQ ID NO: 4021319 - RNA, 16 nt, Marburg virus
uaaccauuguaagaau

SEQ ID NO: 4021320 - RNA, 18 nt, Marburg virus
uaaccuuacauugcugcu

SEQ ID NO: 4021321 - RNA, 21 nt, Marburg virus
uaagaaaaacuaaugaagaac

SEQ ID NO: 4021322 - RNA, 16 nt, Marburg virus
uaagaauuaauuuacu

SEQ ID NO: 4021323 - RNA, 12 nt, Marburg virus
uaauaauuuuca

SEQ ID NO: 4021324 - RNA, 15 nt, Marburg virus
uaauaauuuucacaa

SEQ ID NO: 4021325 - RNA, 12 nt, Marburg virus
uaauagaaguag

SEQ ID NO: 4021326 - RNA, 20 nt, Marburg virus
uaaucauguugaugauuuua

SEQ ID NO: 4021327 - RNA, 22 nt, Marburg virus
uaauuguaggauuccacaucau

SEQ ID NO: 4021328 - RNA, 19 nt, Marburg virus
uacaaucacccaauuuacu

SEQ ID NO: 4021329 - RNA, 16 nt, Marburg virus
uacacguuauaucuuu

SEQ ID NO: 4021330 - RNA, 13 nt, Marburg virus
uacauuaauuccu

SEQ ID NO: 4021331 - RNA, 21 nt, Marburg virus
uacauuugccgcaauacugua

SEQ ID NO: 4021332 - RNA, 15 nt, Marburg virus
uaccacagcaaagag

SEQ ID NO: 4021333 - RNA, 21 nt, Marburg virus
uagauuaauccuugaaguaac

SEQ ID NO: 4021334 - RNA, 21 nt, Marburg virus
uagcaaagaaucauuaucauu

SEQ ID NO: 4021335 - RNA, 17 nt, Marburg virus
uauaaaguauaauucuu

SEQ ID NO: 4021336 - RNA, 19 nt, Marburg virus
uauauaaaagaaauaguaa

SEQ ID NO: 4021337 - RNA, 16 nt, Marburg virus
uaucauagucaagagu

SEQ ID NO: 4021338 - RNA, 13 nt, Marburg virus
uauccugaugcaa

SEQ ID NO: 4021339 - RNA, 16 nt, Marburg virus
uaucuuuaccaaauau

SEQ ID NO: 4021340 - RNA, 13 nt, Marburg virus
uaugaugaagaaa

SEQ ID NO: 4021341 - RNA, 16 nt, Marburg virus
uaugccaauuaagaaa

SEQ ID NO: 4021342 - RNA, 13 nt, Marburg virus
uauuacuaacaaa

SEQ ID NO: 4021343 - RNA, 20 nt, Marburg virus
ucaaacaccccaaauuuuca

SEQ ID NO: 4021344 - RNA, 14 nt, Marburg virus
ucaaaugaccaaau

SEQ ID NO: 4021345 - RNA, 22 nt, Marburg virus
ucaacaccacagacccaaacaa

SEQ ID NO: 4021346 - RNA, 12 nt, Marburg virus
ucaacuggaaga

SEQ ID NO: 4021347 - RNA, 16 nt, Marburg virus
ucaagacgcuuauuca

SEQ ID NO: 4021348 - RNA, 19 nt, Marburg virus
ucaauaagugaccccaaau

SEQ ID NO: 4021349 - RNA, 17 nt, Marburg virus
ucaauauccugaugcaa

SEQ ID NO: 4021350 - RNA, 14 nt, Marburg virus
ucaauaugaugcaa

SEQ ID NO: 4021351 - RNA, 11 nt, Marburg virus
ucaccuugaaa

SEQ ID NO: 4021352 - RNA, 12 nt, Marburg virus
ucaggcaauaaa

SEQ ID NO: 4021353 - RNA, 19 nt, Marburg virus
ucauaaucuguuugagcau

SEQ ID NO: 4021354 - RNA, 15 nt, Marburg virus
ucauauuugauucaa

SEQ ID NO: 4021355 - RNA, 18 nt, Marburg virus
ucaucaacaaugccaccc

SEQ ID NO: 4021356 - RNA, 21 nt, Marburg virus
uccaaacauggcagaauuauc

SEQ ID NO: 4021357 - RNA, 16 nt, Marburg virus
uccucucagaaucagu

SEQ ID NO: 4021358 - RNA, 15 nt, Marburg virus
ucgaagaacauuaag

SEQ ID NO: 4021359 - RNA, 18 nt, Marburg virus
ucgauauaauacauacua

SEQ ID NO: 4021360 - RNA, 23 nt, Marburg virus
ucguaguguucuuuuacuggaag

SEQ ID NO: 4021361 - RNA, 21 nt, Marburg virus
ucuacucugaacuaaggaaau

SEQ ID NO: 4021362 - RNA, 21 nt, Marburg virus
ucuauuuuugaugaucuucaa

SEQ ID NO: 4021363 - RNA, 13 nt, Marburg virus
ucuccagaagaca

SEQ ID NO: 4021364 - RNA, 15 nt, Marburg virus
ucugacacaauacau

SEQ ID NO: 4021365 - RNA, 14 nt, Marburg virus
ucugaggauuuaag

SEQ ID NO: 4021366 - RNA, 20 nt, Marburg virus
ucuuaaacuugaugaugcag

SEQ ID NO: 4021367 - RNA, 23 nt, Marburg virus
ucuuaagugaauccuuucuucaa

SEQ ID NO: 4021368 - RNA, 12 nt, Marburg virus
ucuuguuucaaa

SEQ ID NO: 4021369 - RNA, 16 nt, Marburg virus
ugaaaagacuuccaaa

SEQ ID NO: 4021370 - RNA, 20 nt, Marburg virus
ugaaaaggaagaauuauucu

SEQ ID NO: 4021371 - RNA, 18 nt, Marburg virus
ugaacuaccuccacagau

SEQ ID NO: 4021372 - RNA, 13 nt, Marburg virus
ugaacucagugag

SEQ ID NO: 4021373 - RNA, 13 nt, Marburg virus
ugaagaauuuauu

SEQ ID NO: 4021374 - RNA, 20 nt, Marburg virus
ugacuuauuagccagaaguu

SEQ ID NO: 4021375 - RNA, 15 nt, Marburg virus
ugagauuaaaaagac

SEQ ID NO: 4021376 - RNA, 16 nt, Marburg virus
ugaggaagaucaacau

SEQ ID NO: 4021377 - RNA, 20 nt, Marburg virus
ugaugcgagggcauuauuca

SEQ ID NO: 4021378 - RNA, 14 nt, Marburg virus
ugcauaucuuccaa

SEQ ID NO: 4021379 - RNA, 15 nt, Marburg virus
ugcauaucuuccaaa

SEQ ID NO: 4021380 - RNA, 17 nt, Marburg virus
ugcauaucuuccaaaau

SEQ ID NO: 4021381 - RNA, 15 nt, Marburg virus
ugccaugcuuucacu

SEQ ID NO: 4021382 - RNA, 13 nt, Marburg virus
ugcuugaauacgu

SEQ ID NO: 4021383 - RNA, 20 nt, Marburg virus
ugcuuugaaggaucaagaau

SEQ ID NO: 4021384 - RNA, 17 nt, Marburg virus
uggaagacgguuucaaa

SEQ ID NO: 4021385 - RNA, 15 nt, Marburg virus
uggaauagcagauuu

SEQ ID NO: 4021386 - RNA, 19 nt, Marburg virus
uggcucgacgucuuaaaag

SEQ ID NO: 4021387 - RNA, 21 nt, Marburg virus
ugggaaggacacuggaagcaa

SEQ ID NO: 4021388 - RNA, 14 nt, Marburg virus
ugguauauuuuuga

SEQ ID NO: 4021389 - RNA, 15 nt, Marburg virus
ugguuaaaaaugaaa

SEQ ID NO: 4021390 - RNA, 19 nt, Marburg virus
ugguuuauuuucaagcacc

SEQ ID NO: 4021391 - RNA, 17 nt, Marburg virus
uguaauaauuaacuguu

SEQ ID NO: 4021392 - RNA, 19 nt, Marburg virus
uguaauaugccaauuaaga

SEQ ID NO: 4021393 - RNA, 21 nt, Marburg virus
uguaauaugccaauuaagaaa

SEQ ID NO: 4021394 - RNA, 16 nt, Marburg virus
ugugucaaauucauuu

SEQ ID NO: 4021395 - RNA, 18 nt, Marburg virus
uguguuuucaaauuuaua

SEQ ID NO: 4021396 - RNA, 23 nt, Marburg virus
uguuauaugcaugucagugauuu

SEQ ID NO: 4021397 - RNA, 22 nt, Marburg virus
uguuccucccaacccaacaauu

SEQ ID NO: 4021398 - RNA, 15 nt, Marburg virus
uguugauuucaaugu

SEQ ID NO: 4021399 - RNA, 15 nt, Marburg virus
uguuuaggauuucac

SEQ ID NO: 4021400 - RNA, 16 nt, Marburg virus
uuaaaaaccaaaacaa

SEQ ID NO: 4021401 - RNA, 19 nt, Marburg virus
uuaaaaccuaaagucaugu

SEQ ID NO: 4021402 - RNA, 16 nt, Marburg virus
uuaaaacuauaauuca

SEQ ID NO: 4021403 - RNA, 13 nt, Marburg virus
uuaaaauuucagg

SEQ ID NO: 4021404 - RNA, 14 nt, Marburg virus
uuaaagguuuucuu

SEQ ID NO: 4021405 - RNA, 23 nt, Marburg virus
uuaaagguuuucuuuaauauuca

SEQ ID NO: 4021406 - RNA, 18 nt, Marburg virus
uuaagaaucaacuaacaa

SEQ ID NO: 4021407 - RNA, 22 nt, Marburg virus
uuaauauggccaguuccagcaa

SEQ ID NO: 4021408 - RNA, 20 nt, Marburg virus
uuaauugggaacaccaugca

SEQ ID NO: 4021409 - RNA, 13 nt, Marburg virus
aaaacuaugaaga

SEQ ID NO: 4021410 - RNA, 22 nt, Marburg virus
aaaauauuacuuugaucaauuu

SEQ ID NO: 4021411 - RNA, 23 nt, Marburg virus
aaaaugggaaggacacuggaagc

SEQ ID NO: 4021412 - RNA, 12 nt, Marburg virus
aaacaacagaug

SEQ ID NO: 4021413 - RNA, 17 nt, Marburg virus
aaagauguguugaccuu

SEQ ID NO: 4021414 - RNA, 13 nt, Marburg virus
aaagucauguuug

SEQ ID NO: 4021415 - RNA, 18 nt, Marburg virus
aaaucuuacauaggauua

SEQ ID NO: 4021416 - RNA, 23 nt, Marburg virus
aaaucuuaccacagcaaagagca

SEQ ID NO: 4021417 - RNA, 23 nt, Marburg virus
aaaugaggguuacauuuucuaga

SEQ ID NO: 4021418 - RNA, 20 nt, Marburg virus
aaauugaucaaacacuugga

SEQ ID NO: 4021419 - RNA, 14 nt, Marburg virus
aacaaagaauauac

SEQ ID NO: 4021420 - RNA, 14 nt, Marburg virus
aacaacacgaaagg

SEQ ID NO: 4021421 - RNA, 22 nt, Marburg virus
aacaacauagaaaacauauuua

SEQ ID NO: 4021422 - RNA, 13 nt, Marburg virus
aacaauacuguga

SEQ ID NO: 4021423 - RNA, 13 nt, Marburg virus
aacaccuccaaga

SEQ ID NO: 4021424 - RNA, 12 nt, Marburg virus
aacagaaauugu

SEQ ID NO: 4021425 - RNA, 16 nt, Marburg virus
aacauggcagaauuau

SEQ ID NO: 4021426 - RNA, 19 nt, Marburg virus
aacuccacgaagaaucaaa

SEQ ID NO: 4021427 - RNA, 14 nt, Marburg virus
aacuugaugaugca

SEQ ID NO: 4021428 - RNA, 19 nt, Marburg virus
aagaaucaaacaugugcuc

SEQ ID NO: 4021429 - RNA, 15 nt, Marburg virus
aagagaacuucauuu

SEQ ID NO: 4021430 - RNA, 15 nt, Marburg virus
aagauagacagaaca

SEQ ID NO: 4021431 - RNA, 23 nt, Marburg virus
aaggaugggucuguguuuauuca

SEQ ID NO: 4021432 - RNA, 17 nt, Marburg virus
aaggggaugucagaaau

SEQ ID NO: 4021433 - RNA, 20 nt, Marburg virus
aagguggggaggaacaugca

SEQ ID NO: 4021434 - RNA, 16 nt, Marburg virus
aaguauuuuuauaaaa

SEQ ID NO: 4021435 - RNA, 23 nt, Marburg virus
aauaacgauugauuaagaaaaac

SEQ ID NO: 4021436 - RNA, 13 nt, Marburg virus
aauaauagugcau

SEQ ID NO: 4021437 - RNA, 18 nt, Marburg virus
aauaaucaccaauucauu

SEQ ID NO: 4021438 - RNA, 17 nt, Marburg virus
aauaccacuauguuaua

SEQ ID NO: 4021439 - RNA, 18 nt, Marburg virus
aauacugugaauuauucu

SEQ ID NO: 4021440 - RNA, 15 nt, Marburg virus
aauagccuugucaug

SEQ ID NO: 4021441 - RNA, 13 nt, Marburg virus
aauaguugucaua

SEQ ID NO: 4021442 - RNA, 16 nt, Marburg virus
aauauaaaugaaaaca

SEQ ID NO: 4021443 - RNA, 16 nt, Marburg virus
aauaucccuugugaau

SEQ ID NO: 4021444 - RNA, 22 nt, Marburg virus
aauauuaaguguguauugauua

SEQ ID NO: 4021445 - RNA, 17 nt, Marburg virus
aauauuacuuugaucaa

SEQ ID NO: 4021446 - RNA, 21 nt, Marburg virus
aaucacagaggauugagucau

SEQ ID NO: 4021447 - RNA, 13 nt, Marburg virus
aaucaccaauuca

SEQ ID NO: 4021448 - RNA, 12 nt, Marburg virus
aaucauuaucau

SEQ ID NO: 4021449 - RNA, 13 nt, Marburg virus
aauccgaaauugc

SEQ ID NO: 4021450 - RNA, 19 nt, Marburg virus
aaucuugaccuuaauucca

SEQ ID NO: 4021451 - RNA, 20 nt, Marburg virus
aaucuugagggacaaauuau

SEQ ID NO: 4021452 - RNA, 21 nt, Marburg virus
aauuaaaaaauuaaaaaacuu

SEQ ID NO: 4021453 - RNA, 16 nt, Marburg virus
aauuacgacacacaga

SEQ ID NO: 4021454 - RNA, 14 nt, Marburg virus
aauuauacccacaa

SEQ ID NO: 4021455 - RNA, 18 nt, Marburg virus
aauuauccuaacaugaag

SEQ ID NO: 4021456 - RNA, 21 nt, Marburg virus
aauuauugccauguacuugga

SEQ ID NO: 4021457 - RNA, 13 nt, Marburg virus
aauucagcaagca

SEQ ID NO: 4021458 - RNA, 19 nt, Marburg virus
aauucgacagcauuaaaaa

SEQ ID NO: 4021459 - RNA, 22 nt, Marburg virus
aauugauaaaauauuacuuuga

SEQ ID NO: 4021460 - RNA, 18 nt, Marburg virus
aauugcuauaaugauaca

SEQ ID NO: 4021461 - RNA, 13 nt, Marburg virus
aauuucuugaaaa

SEQ ID NO: 4021462 - RNA, 21 nt, Marburg virus
acaaagaauugauaaaauauu

SEQ ID NO: 4021463 - RNA, 17 nt, Marburg virus
acaacuugccugcaaau

SEQ ID NO: 4021464 - RNA, 13 nt, Marburg virus
acaagauaaucuu

SEQ ID NO: 4021465 - RNA, 16 nt, Marburg virus
acaauaaguuuaacua

SEQ ID NO: 4021466 - RNA, 17 nt, Marburg virus
acaaucuaggugauugu

SEQ ID NO: 4021467 - RNA, 20 nt, Marburg virus
acacaacaucuuguauauuu

SEQ ID NO: 4021468 - RNA, 14 nt, Marburg virus
acacauacaugcaa

SEQ ID NO: 4021469 - RNA, 18 nt, Marburg virus
acagccacugaaaaugaa

SEQ ID NO: 4021470 - RNA, 16 nt, Marburg virus
acaugcaauacuugaa

SEQ ID NO: 4021471 - RNA, 17 nt, Marburg virus
acaugcuacaauauaag

SEQ ID NO: 4021472 - RNA, 19 nt, Marburg virus
accaagcaauugacuucuc

SEQ ID NO: 4021473 - RNA, 16 nt, Marburg virus
accaucuuaauagaag

SEQ ID NO: 4021474 - RNA, 18 nt, Marburg virus
acccauuguucuaccaac

SEQ ID NO: 4021475 - RNA, 19 nt, Marburg virus
accuugauaaucuaacaaa

SEQ ID NO: 4021476 - RNA, 22 nt, Marburg virus
accuugccuuccgauaugaauu

SEQ ID NO: 4021477 - RNA, 13 nt, Marburg virus
accuuggaaaauc

SEQ ID NO: 4021478 - RNA, 22 nt, Marburg virus
accuuucuguugauuucaaugu

SEQ ID NO: 4021479 - RNA, 18 nt, Marburg virus
acggguuaauaaaugcuc

SEQ ID NO: 4021480 - RNA, 15 nt, Marburg virus
acuaaucaauucacc

SEQ ID NO: 4021481 - RNA, 15 nt, Marburg virus
acuauggugaugcga

SEQ ID NO: 4021482 - RNA, 18 nt, Marburg virus
acucaucauauaugcaac

SEQ ID NO: 4021483 - RNA, 12 nt, Marburg virus
acugagagggaa

SEQ ID NO: 4021484 - RNA, 17 nt, Marburg virus
acuggccgaaaaugcuc

SEQ ID NO: 4021485 - RNA, 12 nt, Marburg virus
acuguggcugcg

SEQ ID NO: 4021486 - RNA, 18 nt, Marburg virus
acuugauagaaugucaag

SEQ ID NO: 4021487 - RNA, 19 nt, Marburg virus
acuugaugaugcagcucug

SEQ ID NO: 4021488 - RNA, 20 nt, Marburg virus
acuugcauauccuuuguuga

SEQ ID NO: 4021489 - RNA, 12 nt, Marburg virus
agaagaaaaaac

SEQ ID NO: 4021490 - RNA, 17 nt, Marburg virus
agaaugcauuagaauuu

SEQ ID NO: 4021491 - RNA, 23 nt, Marburg virus
agaauuauucauccaaguuguuu

SEQ ID NO: 4021492 - RNA, 20 nt, Marburg virus
agacgugccguucaaagagu

SEQ ID NO: 4021493 - RNA, 14 nt, Marburg virus
agacuuccaaacau

SEQ ID NO: 4021494 - RNA, 13 nt, Marburg virus
agaguccaugaaa

SEQ ID NO: 4021495 - RNA, 20 nt, Marburg virus
agauacgagguuauauaauu

SEQ ID NO: 4021496 - RNA, 16 nt, Marburg virus
agcauaaaaaucccaa

SEQ ID NO: 4021497 - RNA, 15 nt, Marburg virus
aggauaaaaggacaa

SEQ ID NO: 4021498 - RNA, 21 nt, Marburg virus
aggauuuuucuccuaaggaaa

SEQ ID NO: 4021499 - RNA, 19 nt, Marburg virus
agggaacagaaagaagcau

SEQ ID NO: 4021500 - RNA, 16 nt, Marburg virus
agggguuucauaugcu

SEQ ID NO: 4021501 - RNA, 15 nt, Marburg virus
aguaaaggacaauga

SEQ ID NO: 4021502 - RNA, 14 nt, Marburg virus
aguaagaaaaacua

SEQ ID NO: 4021503 - RNA, 16 nt, Marburg virus
aguauaaaguauaauu

SEQ ID NO: 4021504 - RNA, 17 nt, Marburg virus
aguauacucgcuucaau

SEQ ID NO: 4021505 - RNA, 18 nt, Marburg virus
aguauacuguaacauaua

SEQ ID NO: 4021506 - RNA, 20 nt, Marburg virus
agucccucgcccaugucaaa

SEQ ID NO: 4021507 - RNA, 16 nt, Marburg virus
agugauaagagucaaa

SEQ ID NO: 4021508 - RNA, 23 nt, Marburg virus
agugaucuuuccgaguugauaca

SEQ ID NO: 4021509 - RNA, 14 nt, Marburg virus
aguucuuuaaauuu

SEQ ID NO: 4021510 - RNA, 20 nt, Marburg virus
auaacauccgguucaggguc

SEQ ID NO: 4021511 - RNA, 17 nt, Marburg virus
auaacccaccggauugu

SEQ ID NO: 4021512 - RNA, 15 nt, Marburg virus
auaagcuaucaaaua

SEQ ID NO: 4021513 - RNA, 20 nt, Marburg virus
auaaguuuaagauaucuuaa

SEQ ID NO: 4021514 - RNA, 23 nt, Marburg virus
auaaucaccaauucauuguaaau

SEQ ID NO: 4021515 - RNA, 16 nt, Marburg virus
auaauccgaaaugcug

SEQ ID NO: 4021516 - RNA, 14 nt, Marburg virus
auaauuuucacaau

SEQ ID NO: 4021517 - RNA, 16 nt, Marburg virus
auaccuacccugauuu

SEQ ID NO: 4021518 - RNA, 23 nt, Marburg virus
auacgucgauauaauacauacua

SEQ ID NO: 4021519 - RNA, 13 nt, Marburg virus
auauaucaugaaa

SEQ ID NO: 4021520 - RNA, 17 nt, Marburg virus
auaucggacauucaaag

SEQ ID NO: 4021521 - RNA, 17 nt, Marburg virus
auaucuuccaaaauaua

SEQ ID NO: 4021522 - RNA, 15 nt, Marburg virus
auauuaaguguguau

SEQ ID NO: 4021523 - RNA, 19 nt, Marburg virus
auauuacuuugaucaauuu

SEQ ID NO: 4021524 - RNA, 18 nt, Marburg virus
auauucaaggucaaaacc

SEQ ID NO: 4021525 - RNA, 17 nt, Marburg virus
auauuucauucaaacac

SEQ ID NO: 4021526 - RNA, 14 nt, Marburg virus
aucagccuaaaauc

SEQ ID NO: 4021527 - RNA, 23 nt, Marburg virus
auccaagggauaaaaacucuccc

SEQ ID NO: 4021528 - RNA, 21 nt, Marburg virus
auccaucuuaagugaauccuu

SEQ ID NO: 4021529 - RNA, 13 nt, Marburg virus
auccuauuuuccu

SEQ ID NO: 4021530 - RNA, 21 nt, Marburg virus
auccuugaucaacaccaugac

SEQ ID NO: 4021531 - RNA, 20 nt, Marburg virus
aucgucucaaaccguacaca

SEQ ID NO: 4021532 - RNA, 22 nt, Marburg virus
aucguugagauuaaaaagacua

SEQ ID NO: 4021533 - RNA, 19 nt, Marburg virus
aucuaauucucauuguuaa

SEQ ID NO: 4021534 - RNA, 14 nt, Marburg virus
aucuagaacaaauu

SEQ ID NO: 4021535 - RNA, 17 nt, Marburg virus
aaaaaucccaacaaugg

SEQ ID NO: 4021536 - RNA, 19 nt, Marburg virus
aaaaaugaggguuacauuu

SEQ ID NO: 4021537 - RNA, 14 nt, Marburg virus
aaaacaccaccaau

SEQ ID NO: 4021538 - RNA, 12 nt, Marburg virus
aaaacacugccu

SEQ ID NO: 4021539 - RNA, 13 nt, Marburg virus
aaacacuuggaac

SEQ ID NO: 4021540 - RNA, 13 nt, Marburg virus
aaaccaagcaauu

SEQ ID NO: 4021541 - RNA, 18 nt, Marburg virus
aaaccauaaggaaaaaug

SEQ ID NO: 4021542 - RNA, 22 nt, Marburg virus
aaagagcacuaacaacacgaaa

SEQ ID NO: 4021543 - RNA, 18 nt, Marburg virus
aaaguugcugauuccccu

SEQ ID NO: 4021544 - RNA, 22 nt, Marburg virus
aaauauuggacaaguaacaaug

SEQ ID NO: 4021545 - RNA, 20 nt, Marburg virus
aaaucaacuugggagauuuu

SEQ ID NO: 4021546 - RNA, 18 nt, Marburg virus
aaauccuugcuguuggau

SEQ ID NO: 4021547 - RNA, 16 nt, Marburg virus
aaaugcuguaagcuua

SEQ ID NO: 4021548 - RNA, 21 nt, Marburg virus
aaauuaaaauccaguguuaug

SEQ ID NO: 4021549 - RNA, 18 nt, Marburg virus
aaauuaauucacacaagg

SEQ ID NO: 4021550 - RNA, 15 nt, Marburg virus
aacaagaagaagaaa

SEQ ID NO: 4021551 - RNA, 17 nt, Marburg virus
aacacgugggaaauaug

SEQ ID NO: 4021552 - RNA, 12 nt, Marburg virus
aaccaaaacaau

SEQ ID NO: 4021553 - RNA, 13 nt, Marburg virus
aaccaugaaaauc

SEQ ID NO: 4021554 - RNA, 14 nt, Marburg virus
aaccgauggaaaag

SEQ ID NO: 4021555 - RNA, 16 nt, Marburg virus
aaccguacacaaguag

SEQ ID NO: 4021556 - RNA, 19 nt, Marburg virus
aacgacuugucuuaauuca

SEQ ID NO: 4021557 - RNA, 15 nt, Marburg virus
aacuaaacuugcaua

SEQ ID NO: 4021558 - RNA, 19 nt, Marburg virus
aacuacagaagggacaaug

SEQ ID NO: 4021559 - RNA, 13 nt, Marburg virus
aacuaugaagaac

SEQ ID NO: 4021560 - RNA, 14 nt, Marburg virus
aacuccauuccccc

SEQ ID NO: 4021561 - RNA, 12 nt, Marburg virus
aacuguugcaua

SEQ ID NO: 4021562 - RNA, 21 nt, Marburg virus
aacuuguaccucuaaggaaaa

SEQ ID NO: 4021563 - RNA, 11 nt, Marburg virus
aagaaggaaac

SEQ ID NO: 4021564 - RNA, 20 nt, Marburg virus
aagacauguguaggaacaug

SEQ ID NO: 4021565 - RNA, 15 nt, Marburg virus
aagacuuccaaacau

SEQ ID NO: 4021566 - RNA, 14 nt, Marburg virus
aagaucaacaugcc

SEQ ID NO: 4021567 - RNA, 12 nt, Marburg virus
aagaugaacaaa

SEQ ID NO: 4021568 - RNA, 16 nt, Marburg virus
aagcaagggcuuucau

SEQ ID NO: 4021569 - RNA, 14 nt, Marburg virus
aagcaccugagaac

SEQ ID NO: 4021570 - RNA, 16 nt, Marburg virus
aagcacgccacagcaa

SEQ ID NO: 4021571 - RNA, 15 nt, Marburg virus
aagccgaaauuuauc

SEQ ID NO: 4021572 - RNA, 20 nt, Marburg virus
aagcugaucagcuugcaaga

SEQ ID NO: 4021573 - RNA, 15 nt, Marburg virus
aaguuuuguuacuga

SEQ ID NO: 4021574 - RNA, 22 nt, Marburg virus
aauacccucaccacugcccaca

SEQ ID NO: 4021575 - RNA, 14 nt, Marburg virus
aauaguaauguuuu

SEQ ID NO: 4021576 - RNA, 17 nt, Marburg virus
aauagugguaucaucuu

SEQ ID NO: 4021577 - RNA, 22 nt, Marburg virus
aauauaaaagaacgaucugcug

SEQ ID NO: 4021578 - RNA, 15 nt, Marburg virus
aauauccugaugcaa

SEQ ID NO: 4021579 - RNA, 12 nt, Marburg virus
aauaugaugcaa

SEQ ID NO: 4021580 - RNA, 19 nt, Marburg virus
aauaugccaauuaagaaaa

SEQ ID NO: 4021581 - RNA, 14 nt, Marburg virus
aaucauuaauuccu

SEQ ID NO: 4021582 - RNA, 15 nt, Marburg virus
aaucccucagagaag

SEQ ID NO: 4021583 - RNA, 17 nt, Marburg virus
aaucgaaggacuuuaua

SEQ ID NO: 4021584 - RNA, 13 nt, Marburg virus
aaucgauguuaug

SEQ ID NO: 4021585 - RNA, 19 nt, Marburg virus
aaucuaggugauugugaaa

SEQ ID NO: 4021586 - RNA, 18 nt, Marburg virus
aaucuugagggacaaauu

SEQ ID NO: 4021587 - RNA, 14 nt, Marburg virus
aaugaacaaaccag

SEQ ID NO: 4021588 - RNA, 20 nt, Marburg virus
aauguuacggaaaaaagcau

SEQ ID NO: 4021589 - RNA, 14 nt, Marburg virus
aauuaauucacaca

SEQ ID NO: 4021590 - RNA, 12 nt, Marburg virus
aauuacaugaga

SEQ ID NO: 4021591 - RNA, 21 nt, Marburg virus
aauuauccuuuauuaagaaaa

SEQ ID NO: 4021592 - RNA, 16 nt, Marburg virus
aauucaaguuuacuga

SEQ ID NO: 4021593 - RNA, 19 nt, Marburg virus
aauugcuauaaugauacaa

SEQ ID NO: 4021594 - RNA, 14 nt, Marburg virus
aauuucaacuggaa

SEQ ID NO: 4021595 - RNA, 22 nt, Marburg virus
aauuuugcgaggaauuauaaaa

SEQ ID NO: 4021596 - RNA, 12 nt, Marburg virus
acaaaacaccac

SEQ ID NO: 4021597 - RNA, 10 nt, Marburg virus
acaacaaugu

SEQ ID NO: 4021598 - RNA, 19 nt, Marburg virus
acaacauagaaaacauauu

SEQ ID NO: 4021599 - RNA, 23 nt, Marburg virus
acaacauauugugucaaauucau

SEQ ID NO: 4021600 - RNA, 14 nt, Marburg virus
acaauacugugaau

SEQ ID NO: 4021601 - RNA, 14 nt, Marburg virus
acaaucaaaucacu

SEQ ID NO: 4021602 - RNA, 11 nt, Marburg virus
acacuggaagc

SEQ ID NO: 4021603 - RNA, 16 nt, Marburg virus
acagccacugaaaaug

SEQ ID NO: 4021604 - RNA, 16 nt, Marburg virus
acaguuuuuuguauua

SEQ ID NO: 4021605 - RNA, 17 nt, Marburg virus
acaugaaaauuggauug

SEQ ID NO: 4021606 - RNA, 14 nt, Marburg virus
accaaauacuggga

SEQ ID NO: 4021607 - RNA, 18 nt, Marburg virus
accaacugaucgugaaga

SEQ ID NO: 4021608 - RNA, 19 nt, Marburg virus
accaacugaucgugaagaa

SEQ ID NO: 4021609 - RNA, 14 nt, Marburg virus
accaaucauauucc

SEQ ID NO: 4021610 - RNA, 20 nt, Marburg virus
accacuauguuauaugcaug

SEQ ID NO: 4021611 - RNA, 16 nt, Marburg virus
accacugcaccagcug

SEQ ID NO: 4021612 - RNA, 19 nt, Marburg virus
accauaaggaaaaaugagc

SEQ ID NO: 4021613 - RNA, 19 nt, Marburg virus
acuaaaaaucgaagaauau

SEQ ID NO: 4021614 - RNA, 12 nt, Marburg virus
acuaaacauuuc

SEQ ID NO: 4021615 - RNA, 17 nt, Marburg virus
acucuggagaaaaugag

SEQ ID NO: 4021616 - RNA, 19 nt, Marburg virus
acuuacuugggcuugaaga

SEQ ID NO: 4021617 - RNA, 23 nt, Marburg virus
acuuucccucuacucugaacuaa

SEQ ID NO: 4021618 - RNA, 14 nt, Marburg virus
agaaaaaccaauga

SEQ ID NO: 4021619 - RNA, 19 nt, Marburg virus
agaaagcagucccaccaau

SEQ ID NO: 4021620 - RNA, 19 nt, Marburg virus
agaaccacugcaccagcug

SEQ ID NO: 4021621 - RNA, 14 nt, Marburg virus
agaauuaccgugga

SEQ ID NO: 4021622 - RNA, 15 nt, Marburg virus
agacccaaacaauga

SEQ ID NO: 4021623 - RNA, 13 nt, Marburg virus
agacuugaacaca

SEQ ID NO: 4021624 - RNA, 21 nt, Marburg virus
agauauugggaaauuggauga

SEQ ID NO: 4021625 - RNA, 15 nt, Marburg virus
agaucaaacccacaa

SEQ ID NO: 4021626 - RNA, 14 nt, Marburg virus
agaucgauaucuuu

SEQ ID NO: 4021627 - RNA, 13 nt, Marburg virus
agauuauaugauu

SEQ ID NO: 4021628 - RNA, 17 nt, Marburg virus
agcaauuacaacacaua

SEQ ID NO: 4021629 - RNA, 17 nt, Marburg virus
agcacagccacugaaaa

SEQ ID NO: 4021630 - RNA, 13 nt, Marburg virus
agcacgccacagc

SEQ ID NO: 4021631 - RNA, 17 nt, Marburg virus
agcauggauauucauag

SEQ ID NO: 4021632 - RNA, 17 nt, Marburg virus
agcuguauacaaacaca

SEQ ID NO: 4021633 - RNA, 16 nt, Marburg virus
agcuucucggacaaua

SEQ ID NO: 4021634 - RNA, 21 nt, Marburg virus
agcuuguaguaaggggaccau

SEQ ID NO: 4021635 - RNA, 17 nt, Marburg virus
agcuuuuauucagaaua

SEQ ID NO: 4021636 - RNA, 22 nt, Marburg virus
aggaaaucuuaccacagcaaag

SEQ ID NO: 4021637 - RNA, 14 nt, Marburg virus
aggaagaauuauuc

SEQ ID NO: 4021638 - RNA, 15 nt, Marburg virus
aggacaaagaggguc

SEQ ID NO: 4021639 - RNA, 13 nt, Marburg virus
aggacacuggaag

SEQ ID NO: 4021640 - RNA, 22 nt, Marburg virus
aggacagguguaccucccaaga

SEQ ID NO: 4021641 - RNA, 15 nt, Marburg virus
aggauuuaagggaac

SEQ ID NO: 4021642 - RNA, 22 nt, Marburg virus
aggcagauaucggacauucaaa

SEQ ID NO: 4021643 - RNA, 13 nt, Marburg virus
agggcauuauuca

SEQ ID NO: 4021644 - RNA, 24 nt, Marburg virus
agguauaacacgugggaaauaugu

SEQ ID NO: 4021645 - RNA, 13 nt, Marburg virus
aguauaaaguaua

SEQ ID NO: 4021646 - RNA, 21 nt, Marburg virus
agucaaagguguuccagcaug

SEQ ID NO: 4021647 - RNA, 19 nt, Marburg virus
agucuuaucuuaauccaag

SEQ ID NO: 4021648 - RNA, 15 nt, Marburg virus
agugaauacauucuu

SEQ ID NO: 4021649 - RNA, 15 nt, Marburg virus
agugguaucaucuua

SEQ ID NO: 4021650 - RNA, 18 nt, Marburg virus
agugugcugaaaauguua

SEQ ID NO: 4021651 - RNA, 15 nt, Marburg virus
aguuccaaauacaaa

SEQ ID NO: 4021652 - RNA, 23 nt, Marburg virus
aguucucacaagauuaguuugua

SEQ ID NO: 4021653 - RNA, 19 nt, Marburg virus
auaaaaaucccaacaaugg

SEQ ID NO: 4021654 - RNA, 15 nt, Marburg virus
auaaaauaaacaaga

SEQ ID NO: 4021655 - RNA, 14 nt, Marburg virus
auaaaugcuccaau

SEQ ID NO: 4021656 - RNA, 15 nt, Marburg virus
auaaggaaaaaugag

SEQ ID NO: 4021657 - RNA, 22 nt, Marburg virus
auaagugauuuacuugauagaa

SEQ ID NO: 4021658 - RNA, 15 nt, Marburg virus
auaaguuuaagauau

SEQ ID NO: 4021659 - RNA, 22 nt, Marburg virus
auagauccuugaucaacaccau

SEQ ID NO: 4021660 - RNA, 17 nt, Marburg virus
auagauucaauuauccu

SEQ ID NO: 4021661 - RNA, 18 nt, Marburg virus
auauaaguggcuuaaauu

SEQ ID NO: 4021662 - RNA, 14 nt, Marburg virus
auaucauaaauaua

SEQ ID NO: 4021663 - RNA, 11 nt, Marburg virus
auauuaaauau

SEQ ID NO: 4021664 - RNA, 18 nt, Marburg virus
aucauauuuuaacuucca

SEQ ID NO: 4021665 - RNA, 16 nt, Marburg virus
aucccucuggaaaauc

SEQ ID NO: 4021666 - RNA, 19 nt, Marburg virus
aucccucuggaaaauccuu

SEQ ID NO: 4021667 - RNA, 16 nt, Marburg virus
auccuuucuucaauau

SEQ ID NO: 4021668 - RNA, 14 nt, Marburg virus
aucgaugagcucaa

SEQ ID NO: 4021669 - RNA, 17 nt, Marburg virus
aucggacauucaaagca

SEQ ID NO: 4021670 - RNA, 12 nt, Marburg virus
aucgugaagaaa

SEQ ID NO: 4021671 - RNA, 16 nt, Marburg virus
aucucagcuuguugaa

SEQ ID NO: 4021672 - RNA, 23 nt, Marburg virus
aucuugaccuuaauuccacagca

SEQ ID NO: 4021673 - RNA, 21 nt, Marburg virus
aucuugagggacaaauuauug

SEQ ID NO: 4021674 - RNA, 19 nt, Marburg virus
augacaagugacaaaauuu

SEQ ID NO: 4021675 - RNA, 15 nt, Marburg virus
augaucaguucaaag

SEQ ID NO: 4021676 - RNA, 17 nt, Marburg virus
augcagccgacaagaug

SEQ ID NO: 4021677 - RNA, 13 nt, Marburg virus
auguccaaacacu

SEQ ID NO: 4021678 - RNA, 17 nt, Marburg virus
auguuacggaaaaaagc

SEQ ID NO: 4021679 - RNA, 20 nt, Marburg virus
auguugaugauuuuaaauac

SEQ ID NO: 4021680 - RNA, 23 nt, Marburg virus
auguuguaaaugaccacggaaaa

SEQ ID NO: 4021681 - RNA, 12 nt, Marburg virus
auuaaaaacaag

SEQ ID NO: 4021682 - RNA, 16 nt, Marburg virus
auuaaauaguugucau

SEQ ID NO: 4021683 - RNA, 14 nt, Marburg virus
auuaagaaaaacua

SEQ ID NO: 4021684 - RNA, 19 nt, Marburg virus
auuaagaaaaacuaugaag

SEQ ID NO: 4021685 - RNA, 21 nt, Marburg virus
auuaaguguucuuuguuagaa

SEQ ID NO: 4021686 - RNA, 22 nt, Marburg virus
auuacuuguuacuauuguguga

SEQ ID NO: 4021687 - RNA, 13 nt, Marburg virus
auuauagaggaac

SEQ ID NO: 4021688 - RNA, 18 nt, Marburg virus
auuauccuaacaugaaga

SEQ ID NO: 4021689 - RNA, 19 nt, Marburg virus
auucaagacgcuuauucau

SEQ ID NO: 4021690 - RNA, 18 nt, Marburg virus
auucaagauuuaaaaugc

SEQ ID NO: 4021691 - RNA, 16 nt, Marburg virus
auucaccuacaaucuc

SEQ ID NO: 4021692 - RNA, 22 nt, Marburg virus
auuccccggugguuuauuuuca

SEQ ID NO: 4021693 - RNA, 21 nt, Marburg virus
auucuaagugaaggagagaau

SEQ ID NO: 4021694 - RNA, 21 nt, Marburg virus
auucucccaccucuuuaaaaa

SEQ ID NO: 4021695 - RNA, 13 nt, Marburg virus
auugauauugaac

SEQ ID NO: 4021696 - RNA, 14 nt, Marburg virus
auugaucaaacacu

SEQ ID NO: 4021697 - RNA, 14 nt, Marburg virus
auuguaagaauuaa

SEQ ID NO: 4021698 - RNA, 15 nt, Marburg virus
auuguggacauguau

SEQ ID NO: 4021699 - RNA, 23 nt, Marburg virus
auuuaaagagauuucuuguugca

SEQ ID NO: 4021700 - RNA, 17 nt, Marburg virus
auuuauaacuaaccauu

SEQ ID NO: 4021701 - RNA, 19 nt, Marburg virus
auuucaggcaauaaagcug

SEQ ID NO: 4021702 - RNA, 16 nt, Marburg virus
auuucauucaaacacc

SEQ ID NO: 4021703 - RNA, 14 nt, Marburg virus
auuucauucaaugu

SEQ ID NO: 4021704 - RNA, 22 nt, Marburg virus
auuucguaguuaaauuucuaga

SEQ ID NO: 4021705 - RNA, 13 nt, Marburg virus
auuucuuuaauaa

SEQ ID NO: 4021706 - RNA, 15 nt, Marburg virus
auuugucguaucuuu

SEQ ID NO: 4021707 - RNA, 22 nt, Marburg virus
caaaaaagucuucgggcuguuc

SEQ ID NO: 4021708 - RNA, 19 nt, Marburg virus
caaaacuauccaucauauu

SEQ ID NO: 4021709 - RNA, 21 nt, Marburg virus
caaagacgaucuuugaugaau

SEQ ID NO: 4021710 - RNA, 17 nt, Marburg virus
caaaguaaugaaaauag

SEQ ID NO: 4021711 - RNA, 24 nt, Marburg virus
caaauuauugccauguacuuggaa

SEQ ID NO: 4021712 - RNA, 23 nt, Marburg virus
caaccagggagaucaaauuauug

SEQ ID NO: 4021713 - RNA, 23 nt, Marburg virus
caacuacgaaccuccauacauuu

SEQ ID NO: 4021714 - RNA, 18 nt, Marburg virus
caagaacgccuaguggaa

SEQ ID NO: 4021715 - RNA, 16 nt, Marburg virus
caagaauacaacucca

SEQ ID NO: 4021716 - RNA, 22 nt, Marburg virus
caagggcuuucaucaacaaugc

SEQ ID NO: 4021717 - RNA, 20 nt, Marburg virus
caauaucccuugugaaucau

SEQ ID NO: 4021718 - RNA, 13 nt, Marburg virus
caauaugaugcaa

SEQ ID NO: 4021719 - RNA, 21 nt, Marburg virus
caauaugaugcaauuaaucau

SEQ ID NO: 4021720 - RNA, 18 nt, Marburg virus
caaucauacacauaauaa

SEQ ID NO: 4021721 - RNA, 17 nt, Marburg virus
caaucugggaucauauu

SEQ ID NO: 4021722 - RNA, 12 nt, Marburg virus
caaucuguaaaa

SEQ ID NO: 4021723 - RNA, 15 nt, Marburg virus
caauggaacacaaac

SEQ ID NO: 4021724 - RNA, 12 nt, Marburg virus
caauugauuuug

SEQ ID NO: 4021725 - RNA, 14 nt, Marburg virus
cacaaguagggaaa

SEQ ID NO: 4021726 - RNA, 17 nt, Marburg virus
cacaauucagcaagcau

SEQ ID NO: 4021727 - RNA, 14 nt, Marburg virus
cacagagcacagcc

SEQ ID NO: 4021728 - RNA, 13 nt, Marburg virus
cacugcccacagc

SEQ ID NO: 4021729 - RNA, 15 nt, Marburg virus
cagaguggcaacaaa

SEQ ID NO: 4021730 - RNA, 21 nt, Marburg virus
cagcaagaaggaaacaacaca

SEQ ID NO: 4021731 - RNA, 13 nt, Marburg virus
cagcauggcugcc

SEQ ID NO: 4021732 - RNA, 19 nt, Marburg virus
caggaaaucuuaccacagc

SEQ ID NO: 4021733 - RNA, 20 nt, Marburg virus
caggaaaucuuaccacagca

SEQ ID NO: 4021734 - RNA, 19 nt, Marburg virus
caggguccggagaacagga

SEQ ID NO: 4021735 - RNA, 23 nt, Marburg virus
caguaaaagaagguaugaugaag

SEQ ID NO: 4021736 - RNA, 23 nt, Marburg virus
cauacacccgaauuugccaccca

SEQ ID NO: 4021737 - RNA, 15 nt, Marburg virus
cauacuguggcugcg

SEQ ID NO: 4021738 - RNA, 15 nt, Marburg virus
caucuuauuaaauag

SEQ ID NO: 4021739 - RNA, 17 nt, Marburg virus
caugcccccccacaaca

SEQ ID NO: 4021740 - RNA, 20 nt, Marburg virus
caugcccccccacaacacca

SEQ ID NO: 4021741 - RNA, 15 nt, Marburg virus
caugguauaaaacca

SEQ ID NO: 4021742 - RNA, 21 nt, Marburg virus
cauguugaugauuuuaaauac

SEQ ID NO: 4021743 - RNA, 21 nt, Marburg virus
cauuauucagugcuacaaauu

SEQ ID NO: 4021744 - RNA, 11 nt, Marburg virus
cauucaacuua

SEQ ID NO: 4021745 - RNA, 16 nt, Marburg virus
ccaaaccgcaucaucu

SEQ ID NO: 4021746 - RNA, 17 nt, Marburg virus
ccaaaccgcaucaucua

SEQ ID NO: 4021747 - RNA, 19 nt, Marburg virus
ccaacaauggaccacugcu

SEQ ID NO: 4021748 - RNA, 11 nt, Marburg virus
ccaacaggaaa

SEQ ID NO: 4021749 - RNA, 23 nt, Marburg virus
ccaacccgaccacacaacaucuu

SEQ ID NO: 4021750 - RNA, 23 nt, Marburg virus
ccacaugucucuuuaucagucuu

SEQ ID NO: 4021751 - RNA, 15 nt, Marburg virus
ccaccucuuuaaaaa

SEQ ID NO: 4021752 - RNA, 12 nt, Marburg virus
ccauaaggaaaa

SEQ ID NO: 4021753 - RNA, 13 nt, Marburg virus
cccacaacaccac

SEQ ID NO: 4021754 - RNA, 16 nt, Marburg virus
cccagcacacccacuc

SEQ ID NO: 4021755 - RNA, 13 nt, Marburg virus
ccgucacaugaau

SEQ ID NO: 4021756 - RNA, 13 nt, Marburg virus
ccuaaggaaaauc

SEQ ID NO: 4021757 - RNA, 19 nt, Marburg virus
ccugcgauuuucaaagauc

SEQ ID NO: 4021758 - RNA, 18 nt, Marburg virus
cgaaauugcguaauugua

SEQ ID NO: 4021759 - RNA, 23 nt, Marburg virus
cguaguguucuuuuacuggaagg

SEQ ID NO: 4021760 - RNA, 21 nt, Marburg virus
cguaugcgaauccaacgcuca

SEQ ID NO: 4021761 - RNA, 13 nt, Marburg virus
cgucucuuucuaa

SEQ ID NO: 4021762 - RNA, 22 nt, Marburg virus
cuaaacgaaguaacaacaagag

SEQ ID NO: 4021763 - RNA, 22 nt, Marburg virus
cuaaugcuuaucauuaucacuu

SEQ ID NO: 4021764 - RNA, 14 nt, Marburg virus
cuacuaacaacacc

SEQ ID NO: 4021765 - RNA, 16 nt, Marburg virus
cuagaacaaauuuuaa

SEQ ID NO: 4021766 - RNA, 13 nt, Marburg virus
cuaucaaaucagc

SEQ ID NO: 4021767 - RNA, 21 nt, Marburg virus
cuaugaagaacauuaagaaga

SEQ ID NO: 4021768 - RNA, 13 nt, Marburg virus
cucauaacauccg

SEQ ID NO: 4021769 - RNA, 19 nt, Marburg virus
cugaacuaccuccacagau

SEQ ID NO: 4021770 - RNA, 20 nt, Marburg virus
cugcugguuuaauuaaaaac

SEQ ID NO: 4021771 - RNA, 22 nt, Marburg virus
cuguaaucaacacugcuguauc

SEQ ID NO: 4021772 - RNA, 16 nt, Marburg virus
cuguuuuaauuaagaa

SEQ ID NO: 4021773 - RNA, 17 nt, Marburg virus
cuguuuuaauuaagaaa

SEQ ID NO: 4021774 - RNA, 16 nt, Marburg virus
cuuauauugaugcauu

SEQ ID NO: 4021775 - RNA, 14 nt, Marburg virus
cuucauaaucuguu

SEQ ID NO: 4021776 - RNA, 20 nt, Marburg virus
cuugaagacauaguuaagac

SEQ ID NO: 4021777 - RNA, 14 nt, Marburg virus
cuuuacaccaggaa

SEQ ID NO: 4021778 - RNA, 13 nt, Marburg virus
cuuuuacuggaag

SEQ ID NO: 4021779 - RNA, 12 nt, Marburg virus
cuuuuuaagaau

SEQ ID NO: 4021780 - RNA, 16 nt, Marburg virus
gaaaaacuaugaagaa

SEQ ID NO: 4021781 - RNA, 22 nt, Marburg virus
gaaauacaaccuugccuuccga

SEQ ID NO: 4021782 - RNA, 15 nt, Marburg virus
gaaaucaacuuggga

SEQ ID NO: 4021783 - RNA, 21 nt, Marburg virus
gaaauuauccuaacaugaaga

SEQ ID NO: 4021784 - RNA, 18 nt, Marburg virus
gaacaaauugaccaaauc

SEQ ID NO: 4021785 - RNA, 23 nt, Marburg virus
gaaccaggaguguugggacagug

SEQ ID NO: 4021786 - RNA, 11 nt, Marburg virus
gaacuaaggaa

SEQ ID NO: 4021787 - RNA, 18 nt, Marburg virus
gaacuuuugcuauugaug

SEQ ID NO: 4021788 - RNA, 16 nt, Marburg virus
gaaggacacuggaagc

SEQ ID NO: 4021789 - RNA, 13 nt, Marburg virus
gaaguaacaacaa

SEQ ID NO: 4021790 - RNA, 16 nt, Marburg virus
gaaguauccucuggag

SEQ ID NO: 4021791 - RNA, 20 nt, Marburg virus
gaauacaacuccacgaagaa

SEQ ID NO: 4021792 - RNA, 22 nt, Marburg virus
gaauccuuucuucaauaugcag

SEQ ID NO: 4021793 - RNA, 21 nt, Marburg virus
gaaugucugccaugcuuucac

SEQ ID NO: 4021794 - RNA, 16 nt, Marburg virus
gaauuacagcaaucau

SEQ ID NO: 4021795 - RNA, 15 nt, Marburg virus
gaauugauaaaauau

SEQ ID NO: 4021796 - RNA, 15 nt, Marburg virus
gacaaguaacaaugg

SEQ ID NO: 4021797 - RNA, 17 nt, Marburg virus
gacccaaacaaugauga

SEQ ID NO: 4021798 - RNA, 23 nt, Marburg virus
gacuggccgaaaaugcucuccag

SEQ ID NO: 4021799 - RNA, 23 nt, Marburg virus
gacuuccaaacauggcagaauua

SEQ ID NO: 4021800 - RNA, 17 nt, Marburg virus
gaggcaguucuaagaga

SEQ ID NO: 4021801 - RNA, 17 nt, Marburg virus
gaucaaaugaccaaaua

SEQ ID NO: 4021802 - RNA, 22 nt, Marburg virus
gaugcaauuaaucauguugaug

SEQ ID NO: 4021803 - RNA, 19 nt, Marburg virus
gauguguugaccuuggaaa

SEQ ID NO: 4021804 - RNA, 20 nt, Marburg virus
gauuuagaucuauuguucau

SEQ ID NO: 4021805 - RNA, 13 nt, Marburg virus
gcaagaaggaaac

SEQ ID NO: 4021806 - RNA, 21 nt, Marburg virus
gcaagaaggaaacaacacaga

SEQ ID NO: 4021807 - RNA, 20 nt, Marburg virus
gcagauaucggacauucaaa

SEQ ID NO: 4021808 - RNA, 17 nt, Marburg virus
gcagucccaccaaucau

SEQ ID NO: 4021809 - RNA, 18 nt, Marburg virus
gcauuagaauuucuugaa

SEQ ID NO: 4021810 - RNA, 22 nt, Marburg virus
gcauuuaacuccauaucuuaga

SEQ ID NO: 4021811 - RNA, 13 nt, Marburg virus
gccaauuaagaaa

SEQ ID NO: 4021812 - RNA, 13 nt, Marburg virus
gccaucugauuua

SEQ ID NO: 4021813 - RNA, 17 nt, Marburg virus
gcccacagcccguccag

SEQ ID NO: 4021814 - RNA, 14 nt, Marburg virus
gcccuggaaucgaa

SEQ ID NO: 4021815 - RNA, 17 nt, Marburg virus
gcgucuagccaaucaaa

SEQ ID NO: 4021816 - RNA, 15 nt, Marburg virus
gcuaauuucuugagg

SEQ ID NO: 4021817 - RNA, 18 nt, Marburg virus
ggaaaauccuuauuauug

SEQ ID NO: 4021818 - RNA, 13 nt, Marburg virus
ggacaaauuauug

SEQ ID NO: 4021819 - RNA, 16 nt, Marburg virus
ggagauuuuuaagaag

SEQ ID NO: 4021820 - RNA, 21 nt, Marburg virus
ggauuuuucuccuaaggaaaa

SEQ ID NO: 4021821 - RNA, 23 nt, Marburg virus
gggaggauuuuucuccuaaggaa

SEQ ID NO: 4021822 - RNA, 11 nt, Marburg virus
gguaugacuga

SEQ ID NO: 4021823 - RNA, 19 nt, Marburg virus
gguaugacugagugaucag

SEQ ID NO: 4021824 - RNA, 16 nt, Marburg virus
gguuacauuuucuaga

SEQ ID NO: 4021825 - RNA, 20 nt, Marburg virus
guaagaaaaacuaaugaaga

SEQ ID NO: 4021826 - RNA, 18 nt, Marburg virus
guagauuauaugauuuuu

SEQ ID NO: 4021827 - RNA, 18 nt, Marburg virus
guccaaacacucgcagaa

SEQ ID NO: 4021828 - RNA, 13 nt, Marburg virus
gucuaaugucaaa

SEQ ID NO: 4021829 - RNA, 18 nt, Marburg virus
gucuuaagugugauuuuc

SEQ ID NO: 4021830 - RNA, 17 nt, Marburg virus
gugaucaguauauuuua

SEQ ID NO: 4021831 - RNA, 21 nt, Marburg virus
guguaacggaucccucuggaa

SEQ ID NO: 4021832 - RNA, 19 nt, Marburg virus
guuaacuggacaacagauc

SEQ ID NO: 4021833 - RNA, 15 nt, Marburg virus
guuagaauuauucau

SEQ ID NO: 4021834 - RNA, 17 nt, Marburg virus
guuauauaauuacucau

SEQ ID NO: 4021835 - RNA, 21 nt, Marburg virus
guuuaaccacauaauaauguu

SEQ ID NO: 4021836 - RNA, 18 nt, Marburg virus
guuuacguauuguugauu

SEQ ID NO: 4021837 - RNA, 20 nt, Marburg virus
guuucaccuuucuguugauu

SEQ ID NO: 4021838 - RNA, 15 nt, Marburg virus
guuuuaauuaagaaa

SEQ ID NO: 4021839 - RNA, 17 nt, Marburg virus
uaaaaaugaaacaacag

SEQ ID NO: 4021840 - RNA, 14 nt, Marburg virus
uaaaaugcaacaac

SEQ ID NO: 4021841 - RNA, 17 nt, Marburg virus
uaacagguaugacugag

SEQ ID NO: 4021842 - RNA, 20 nt, Marburg virus
uaagaaaaacuaugaagaac

SEQ ID NO: 4021843 - RNA, 14 nt, Marburg virus
uaauaauuuucaca

SEQ ID NO: 4021844 - RNA, 16 nt, Marburg virus
uaaucuaacaaaucgu

SEQ ID NO: 4021845 - RNA, 17 nt, Marburg virus
uaaugaaccaacaguca

SEQ ID NO: 4021846 - RNA, 16 nt, Marburg virus
uaauucucauuguuaa

SEQ ID NO: 4021847 - RNA, 21 nt, Marburg virus
uaauucucauuguuaacaguu

SEQ ID NO: 4021848 - RNA, 15 nt, Marburg virus
uaauugggaacacca

SEQ ID NO: 4021849 - RNA, 19 nt, Marburg virus
uaauuucaacuggaagaac

SEQ ID NO: 4021850 - RNA, 21 nt, Marburg virus
uacaacuucccuucauauuug

SEQ ID NO: 4021851 - RNA, 14 nt, Marburg virus
uacaagucaggaaa

SEQ ID NO: 4021852 - RNA, 16 nt, Marburg virus
uacccggcaacaacac

SEQ ID NO: 4021853 - RNA, 11 nt, Marburg virus
uagaauuauuc

SEQ ID NO: 4021854 - RNA, 22 nt, Marburg virus
uagacagcuugcuuuacacaag

SEQ ID NO: 4021855 - RNA, 16 nt, Marburg virus
uagagaucaugaccuu

SEQ ID NO: 4021856 - RNA, 17 nt, Marburg virus
uagauuaauccuugaag

SEQ ID NO: 4021857 - RNA, 21 nt, Marburg virus
uaguaauguuuuauaaacaau

SEQ ID NO: 4021858 - RNA, 13 nt, Marburg virus
uaguauaaaguau

SEQ ID NO: 4021859 - RNA, 14 nt, Marburg virus
uauaagcaucucuu

SEQ ID NO: 4021860 - RNA, 19 nt, Marburg virus
uauagauucaauuauccuu

SEQ ID NO: 4021861 - RNA, 23 nt, Marburg virus
uauauuuuauaaaccaagcaauu

SEQ ID NO: 4021862 - RNA, 22 nt, Marburg virus
uauccaucuuaagugaauccuu

SEQ ID NO: 4021863 - RNA, 20 nt, Marburg virus
uauucuuaagcuaucuuaaa

SEQ ID NO: 4021864 - RNA, 17 nt, Marburg virus
uauuugaauauucaaac

SEQ ID NO: 4021865 - RNA, 20 nt, Marburg virus
ucaaaaaagaugaacaaaaa

SEQ ID NO: 4021866 - RNA, 15 nt, Marburg virus
ucaaauaacaaucac

SEQ ID NO: 4021867 - RNA, 13 nt, Marburg virus
ucaaauugaucaa

SEQ ID NO: 4021868 - RNA, 11 nt, Marburg virus
ucaacaagcuu

SEQ ID NO: 4021869 - RNA, 14 nt, Marburg virus
ucaacuaacaacau

SEQ ID NO: 4021870 - RNA, 17 nt, Marburg virus
ucaacuggaagaaccac

SEQ ID NO: 4021871 - RNA, 14 nt, Marburg virus
ucaacuuaagaaug

SEQ ID NO: 4021872 - RNA, 20 nt, Marburg virus
ucaagcauauuucauucaaa

SEQ ID NO: 4021873 - RNA, 18 nt, Marburg virus
ucaaggucaaaacccuca

SEQ ID NO: 4021874 - RNA, 21 nt, Marburg virus
ucaaucugggaucauauuuua

SEQ ID NO: 4021875 - RNA, 23 nt, Marburg virus
ucaauguuagcaauaaauuuauu

SEQ ID NO: 4021876 - RNA, 12 nt, Marburg virus
ucaugaaacuca

SEQ ID NO: 4021877 - RNA, 23 nt, Marburg virus
ucaugaaacucaguugcccucca

SEQ ID NO: 4021878 - RNA, 17 nt, Marburg virus
ucauugugcccuucauu

SEQ ID NO: 4021879 - RNA, 19 nt, Marburg virus
uccaaggggaugucagaaa

SEQ ID NO: 4021880 - RNA, 13 nt, Marburg virus
uccacaacaaugu

SEQ ID NO: 4021881 - RNA, 18 nt, Marburg virus
uccagcaauuacaacaca

SEQ ID NO: 4021882 - RNA, 22 nt, Marburg virus
uccaugcccccccacaacacca

SEQ ID NO: 4021883 - RNA, 13 nt, Marburg virus
uccuaacaugaag

SEQ ID NO: 4021884 - RNA, 23 nt, Marburg virus
uccuaaggaaaauccuuauuauu

SEQ ID NO: 4021885 - RNA, 16 nt, Marburg virus
uccuugaucaacacca

SEQ ID NO: 4021886 - RNA, 13 nt, Marburg virus
ucgcccaugucaa

SEQ ID NO: 4021887 - RNA, 22 nt, Marburg virus
ucguaauuucaacuggaagaac

SEQ ID NO: 4021888 - RNA, 17 nt, Marburg virus
ucuaauuaacaacuugu

SEQ ID NO: 4021889 - RNA, 13 nt, Marburg virus
ucuccuaaggaaa

SEQ ID NO: 4021890 - RNA, 14 nt, Marburg virus
ucuccuaaggaaaa

SEQ ID NO: 4021891 - RNA, 19 nt, Marburg virus
ucuccuaaggaaaauccuu

SEQ ID NO: 4021892 - RNA, 15 nt, Marburg virus
ucucgaggcaaggac

SEQ ID NO: 4021893 - RNA, 12 nt, Marburg virus
ucugauuuagag

SEQ ID NO: 4021894 - RNA, 15 nt, Marburg virus
ucugcauaagaagca

SEQ ID NO: 4021895 - RNA, 14 nt, Marburg virus
ucuuaaaagggaaa

SEQ ID NO: 4021896 - RNA, 17 nt, Marburg virus
ucuuuaauauucagaaa

SEQ ID NO: 4021897 - RNA, 12 nt, Marburg virus
ucuuuucucaac

SEQ ID NO: 4021898 - RNA, 20 nt, Marburg virus
ugaaaauguuauugauugag

SEQ ID NO: 4021899 - RNA, 13 nt, Marburg virus
ugaaagaguuaaa

SEQ ID NO: 4021900 - RNA, 14 nt, Marburg virus
ugaacuaaggaaau

SEQ ID NO: 4021901 - RNA, 14 nt, Marburg virus
ugaagaacauuaag

SEQ ID NO: 4021902 - RNA, 14 nt, Marburg virus
ugaagaacauuaau

SEQ ID NO: 4021903 - RNA, 17 nt, Marburg virus
ugaauggcuucaacaac

SEQ ID NO: 4021904 - RNA, 22 nt, Marburg virus
ugagacaacauaagcuaucaaa

SEQ ID NO: 4021905 - RNA, 16 nt, Marburg virus
ugagccacuuucccuc

SEQ ID NO: 4021906 - RNA, 20 nt, Marburg virus
ugcacuauccuacuguuuug

SEQ ID NO: 4021907 - RNA, 22 nt, Marburg virus
ugcagaaagcagucccaccaau

SEQ ID NO: 4021908 - RNA, 22 nt, Marburg virus
ugcagcccuugucuaaugucaa

SEQ ID NO: 4021909 - RNA, 16 nt, Marburg virus
ugcuuacuuaaaugag

SEQ ID NO: 4021910 - RNA, 22 nt, Marburg virus
uggaugcaaaccauaaggaaaa

SEQ ID NO: 4021911 - RNA, 18 nt, Marburg virus
ugggaaggacacuggaag

SEQ ID NO: 4021912 - RNA, 19 nt, Marburg virus
ugggacaacgaguucuuga

SEQ ID NO: 4021913 - RNA, 22 nt, Marburg virus
uguaacguagagucgaagaaca

SEQ ID NO: 4021914 - RNA, 23 nt, Marburg virus
uguaagaaauuagggaaauacug

SEQ ID NO: 4021915 - RNA, 17 nt, Marburg virus
uguaccucuaaggaaaa

SEQ ID NO: 4021916 - RNA, 20 nt, Marburg virus
ugugaauguaaauuaagaaa

SEQ ID NO: 4021917 - RNA, 22 nt, Marburg virus
ugugugaguggcuuuuaucauc

SEQ ID NO: 4021918 - RNA, 19 nt, Marburg virus
uguugaauuaauuguuacu

SEQ ID NO: 4021919 - RNA, 14 nt, Marburg virus
uguuuacuagagca

SEQ ID NO: 4021920 - RNA, 19 nt, Marburg virus
uguuuauucaucugagcaa

SEQ ID NO: 4021921 - RNA, 13 nt, Marburg virus
uuaaaauauucuu

SEQ ID NO: 4021922 - RNA, 14 nt, Marburg virus
uuaaaauuaauuca

SEQ ID NO: 4021923 - RNA, 21 nt, Marburg virus
uuaaauuagcauggauauuca

SEQ ID NO: 4021924 - RNA, 19 nt, Marburg virus
uuaauauaauguaagaaau

SEQ ID NO: 4021925 - RNA, 14 nt, Marburg virus
uuaauuuacucuuu

SEQ ID NO: 4021926 - RNA, 23 nt, Marburg virus
uuacgacacacagagcacagcca

SEQ ID NO: 4021927 - RNA, 12 nt, Marburg virus
uuagaauuauuc

SEQ ID NO: 4021928 - RNA, 13 nt, Marburg virus
uuagaauuauuca

SEQ ID NO: 4021929 - RNA, 16 nt, Marburg virus
uuagaucuauuguuca

SEQ ID NO: 4021930 - RNA, 15 nt, Marburg virus
uuauauaauuacuca

SEQ ID NO: 4021931 - RNA, 14 nt, Marburg virus
uuaucuacauuaau

SEQ ID NO: 4021932 - RNA, 15 nt, Marburg virus
uuauggugugaagaa

SEQ ID NO: 4021933 - RNA, 18 nt, Marburg virus
uucacauguacuguugau

SEQ ID NO: 4021934 - RNA, 21 nt, Marburg virus
uucaccagauucuaagugaag

SEQ ID NO: 4021935 - RNA, 13 nt, Marburg virus
uucagaaagaaac

SEQ ID NO: 4021936 - RNA, 23 nt, Marburg virus
uuccuucugaaauaguaagaaaa

SEQ ID NO: 4021937 - RNA, 20 nt, Marburg virus
uucgauacacguuauaucuu

SEQ ID NO: 4021938 - RNA, 14 nt, Marburg virus
uucuugaacucagu

SEQ ID NO: 4021939 - RNA, 16 nt, Marburg virus
uucuuuaauauucaga

SEQ ID NO: 4021940 - RNA, 15 nt, Marburg virus
uugacaaucaaauca

SEQ ID NO: 4021941 - RNA, 15 nt, Marburg virus
uuggagcguucagga

SEQ ID NO: 4021942 - RNA, 18 nt, Marburg virus
uuguaccucuaaggaaaa

SEQ ID NO: 4021943 - RNA, 20 nt, Marburg virus
ucggaacaaauugaccaaau

SEQ ID NO: 4021944 - RNA, 20 nt, Marburg virus
ucuaaacgaaguaacaacaa

SEQ ID NO: 4021945 - RNA, 18 nt, Marburg virus
ucuacccggcaacaacac

SEQ ID NO: 4021946 - RNA, 19 nt, Marburg virus
ucuguaaaaaucuuaaaac

SEQ ID NO: 4021947 - RNA, 20 nt, Marburg virus
ucuucaagguucccuggcca

SEQ ID NO: 4021948 - RNA, 18 nt, Marburg virus
ugaaaacaauggcaagau

SEQ ID NO: 4021949 - RNA, 14 nt, Marburg virus
ugaaacaacagaug

SEQ ID NO: 4021950 - RNA, 15 nt, Marburg virus
ugaaauuaagggaau

SEQ ID NO: 4021951 - RNA, 15 nt, Marburg virus
ugaaggcauaucuua

SEQ ID NO: 4021952 - RNA, 16 nt, Marburg virus
ugaauccuuucuucaa

SEQ ID NO: 4021953 - RNA, 17 nt, Marburg virus
ugacuauccuaaaugca

SEQ ID NO: 4021954 - RNA, 13 nt, Marburg virus
ugaggaccucaua

SEQ ID NO: 4021955 - RNA, 16 nt, Marburg virus
ugauauucaauuguua

SEQ ID NO: 4021956 - RNA, 13 nt, Marburg virus
ugauauuucuugu

SEQ ID NO: 4021957 - RNA, 18 nt, Marburg virus
ugauauuucuuguuucaa

SEQ ID NO: 4021958 - RNA, 11 nt, Marburg virus
ugaugaugcag

SEQ ID NO: 4021959 - RNA, 20 nt, Marburg virus
ugauggcccgaaaaaugcuc

SEQ ID NO: 4021960 - RNA, 17 nt, Marburg virus
ugcaacaagucagugag

SEQ ID NO: 4021961 - RNA, 21 nt, Marburg virus
ugcaagcgaugugugcuugaa

SEQ ID NO: 4021962 - RNA, 23 nt, Marburg virus
ugcugaucacggugcaaaccagu

SEQ ID NO: 4021963 - RNA, 23 nt, Marburg virus
ugcuguaagcuuacaagcuucaa

SEQ ID NO: 4021964 - RNA, 14 nt, Marburg virus
ugcuuuaaaugguu

SEQ ID NO: 4021965 - RNA, 12 nt, Marburg virus
uggaaggaacaa

SEQ ID NO: 4021966 - RNA, 20 nt, Marburg virus
uggaugcauuucaccagauu

SEQ ID NO: 4021967 - RNA, 20 nt, Marburg virus
uggcuuagaugauaacagau

SEQ ID NO: 4021968 - RNA, 21 nt, Marburg virus
ugggucaccgucucuuucuaa

SEQ ID NO: 4021969 - RNA, 23 nt, Marburg virus
uggguuuauaucuagaacaaauu

SEQ ID NO: 4021970 - RNA, 21 nt, Marburg virus
uguaagcuuacaagcuucaaa

SEQ ID NO: 4021971 - RNA, 16 nt, Marburg virus
uguauagauucaauua

SEQ ID NO: 4021972 - RNA, 12 nt, Marburg virus
ugugaauuauuc

SEQ ID NO: 4021973 - RNA, 12 nt, Marburg virus
uguuagaauuau

SEQ ID NO: 4021974 - RNA, 22 nt, Marburg virus
uguuagcaauaaauuuauuaaa

SEQ ID NO: 4021975 - RNA, 22 nt, Marburg virus
uguuaugggugauaaucaaugu

SEQ ID NO: 4021976 - RNA, 22 nt, Marburg virus
uguugcauuggaauagaagacu

SEQ ID NO: 4021977 - RNA, 13 nt, Marburg virus
uuaaaaaccaaaa

SEQ ID NO: 4021978 - RNA, 19 nt, Marburg virus
uuaaaauuaauucacacaa

SEQ ID NO: 4021979 - RNA, 22 nt, Marburg virus
uuaaauuagcauggauauucau

SEQ ID NO: 4021980 - RNA, 17 nt, Marburg virus
uuaagaaucaacuaaca

SEQ ID NO: 4021981 - RNA, 14 nt, Marburg virus
uuaaucauguugau

SEQ ID NO: 4021982 - RNA, 14 nt, Marburg virus
uuaauucaaucuuu

SEQ ID NO: 4021983 - RNA, 19 nt, Marburg virus
uuacaccaggaaaauacug

SEQ ID NO: 4021984 - RNA, 12 nt, Marburg virus
uuaccacagcaa

SEQ ID NO: 4021985 - RNA, 14 nt, Marburg virus
uuauccuaacauga

SEQ ID NO: 4021986 - RNA, 20 nt, Marburg virus
uuauuaaauaguugucauau

SEQ ID NO: 4021987 - RNA, 16 nt, Marburg virus
uuauuugaauauucaa

SEQ ID NO: 4021988 - RNA, 12 nt, Marburg virus
uucaacuggaag

SEQ ID NO: 4021989 - RNA, 14 nt, Marburg virus
uucaccuacaaucu

SEQ ID NO: 4021990 - RNA, 21 nt, Marburg virus
uucacugaagggaacauagca

SEQ ID NO: 4021991 - RNA, 20 nt, Marburg virus
uucauaugcugccauauuua

SEQ ID NO: 4021992 - RNA, 13 nt, Marburg virus
uuccauucaauau

SEQ ID NO: 4021993 - RNA, 19 nt, Marburg virus
uucuaggaggguuaucauu

SEQ ID NO: 4021994 - RNA, 19 nt, Marburg virus
uucucacuuuuuaagaauc

SEQ ID NO: 4021995 - RNA, 14 nt, Marburg virus
uucuuauauugcuu

SEQ ID NO: 4021996 - RNA, 21 nt, Marburg virus
uugaauccggagaaauuguuc

SEQ ID NO: 4021997 - RNA, 16 nt, Marburg virus
uugaggaucuugcuug

SEQ ID NO: 4021998 - RNA, 18 nt, Marburg virus
uugagggacaaauuauug

SEQ ID NO: 4021999 - RNA, 18 nt, Marburg virus
uugauuaaagcuuuagga

SEQ ID NO: 4022000 - RNA, 12 nt, Marburg virus
uugauuaagaaa

SEQ ID NO: 4022001 - RNA, 14 nt, Marburg virus
uugccauguuuacu

SEQ ID NO: 4022002 - RNA, 11 nt, Marburg virus
uuguaccucua

SEQ ID NO: 4022003 - RNA, 20 nt, Marburg virus
uuguauagucauuauucaca

SEQ ID NO: 4022004 - RNA, 14 nt, Marburg virus
uugucaauaagaca

SEQ ID NO: 4022005 - RNA, 20 nt, Marburg virus
uugugagauuauaaacuugu

SEQ ID NO: 4022006 - RNA, 23 nt, Marburg virus
uuuaauuaaaaaccaaaacaauu

SEQ ID NO: 4022007 - RNA, 16 nt, Marburg virus
uuuacguauuguugau

SEQ ID NO: 4022008 - RNA, 13 nt, Marburg virus
uuucaacuggaag

SEQ ID NO: 4022009 - RNA, 22 nt, Marburg virus
uuucguggagcaugaaccucuu

SEQ ID NO: 4022010 - RNA, 19 nt, Marburg virus
uuugacgugcgcuggaauu

SEQ ID NO: 4022011 - RNA, 19 nt, Marburg virus
uuugaugaaucuucuaguu

SEQ ID NO: 4022012 - RNA, 13 nt, Marburg virus
uuugauucaagau

SEQ ID NO: 4022013 - RNA, 15 nt, Marburg virus
uuugauuuacuaaca

SEQ ID NO: 4022014 - RNA, 15 nt, Marburg virus
uuuguugcaauucaa

SEQ ID NO: 4022015 - RNA, 23 nt, Marburg virus
uuuugcaagcgaugugugcuuga

SEQ ID NO: 4022016 - RNA, 15 nt, Marburg virus
uuuuguguuuucaaa

SEQ ID NO: 4022017 - RNA, 20 nt, Marburg virus
uuuuugcaaacauauugaaa

SEQ ID NO: 4022018 - RNA, 14 nt, Marburg virus
ucuauuugaugcau

SEQ ID NO: 4022019 - RNA, 18 nt, Marburg virus
ucucaaaccguacacaag

SEQ ID NO: 4022020 - RNA, 15 nt, Marburg virus
ucuuaauagaaguag

SEQ ID NO: 4022021 - RNA, 14 nt, Marburg virus
ucuuauugcgagac

SEQ ID NO: 4022022 - RNA, 14 nt, Marburg virus
ucuucaagaauaca

SEQ ID NO: 4022023 - RNA, 14 nt, Marburg virus
ucuuuuacuggaag

SEQ ID NO: 4022024 - RNA, 20 nt, Marburg virus
ugaaaauagccuugucaugu

SEQ ID NO: 4022025 - RNA, 22 nt, Marburg virus
ugaaacuuuuuguguuuucaaa

SEQ ID NO: 4022026 - RNA, 20 nt, Marburg virus
ugaacuaaggaaauuucucu

SEQ ID NO: 4022027 - RNA, 19 nt, Marburg virus
ugaauggcuucaacaacag

SEQ ID NO: 4022028 - RNA, 14 nt, Marburg virus
ugaauuaauuguua

SEQ ID NO: 4022029 - RNA, 13 nt, Marburg virus
ugaggauuuaagg

SEQ ID NO: 4022030 - RNA, 18 nt, Marburg virus
ugaugcagaguuaagaau

SEQ ID NO: 4022031 - RNA, 23 nt, Marburg virus
ugauuuuuuauaaguuuaagaua

SEQ ID NO: 4022032 - RNA, 22 nt, Marburg virus
ugcaacaaccccguggaaggag

SEQ ID NO: 4022033 - RNA, 21 nt, Marburg virus
ugcaaucucuacuaacaacac

SEQ ID NO: 4022034 - RNA, 17 nt, Marburg virus
ugcccccccacaacacc

SEQ ID NO: 4022035 - RNA, 22 nt, Marburg virus
ugcuacaaauucuuuuuucaau

SEQ ID NO: 4022036 - RNA, 20 nt, Marburg virus
uggaaauuuaaaauuucagg

SEQ ID NO: 4022037 - RNA, 16 nt, Marburg virus
uggagaaaaugagaac

SEQ ID NO: 4022038 - RNA, 19 nt, Marburg virus
uggcuuaaauuagcaugga

SEQ ID NO: 4022039 - RNA, 13 nt, Marburg virus
ugggcuuucagga

SEQ ID NO: 4022040 - RNA, 22 nt, Marburg virus
ugguaccgugaccaaaacuuga

SEQ ID NO: 4022041 - RNA, 13 nt, Marburg virus
ugucaauaagaca

SEQ ID NO: 4022042 - RNA, 13 nt, Marburg virus
ugugauuuucacc

SEQ ID NO: 4022043 - RNA, 14 nt, Marburg virus
uguuagauuucagu

SEQ ID NO: 4022044 - RNA, 13 nt, Marburg virus
uguuaucaaacag

SEQ ID NO: 4022045 - RNA, 23 nt, Marburg virus
uguugauauagcuaauuucuuga

SEQ ID NO: 4022046 - RNA, 14 nt, Marburg virus
uguugcauaucuuc

SEQ ID NO: 4022047 - RNA, 22 nt, Marburg virus
uguuggaggcacaguacauuau

SEQ ID NO: 4022048 - RNA, 19 nt, Marburg virus
uguuuggaauagcagauuu

SEQ ID NO: 4022049 - RNA, 15 nt, Marburg virus
uguuuuaucaugauu

SEQ ID NO: 4022050 - RNA, 16 nt, Marburg virus
uuaaauuugaccaaag

SEQ ID NO: 4022051 - RNA, 16 nt, Marburg virus
uuaacuccauaucuua

SEQ ID NO: 4022052 - RNA, 13 nt, Marburg virus
uuaauuaagaaaa

SEQ ID NO: 4022053 - RNA, 18 nt, Marburg virus
uuacauaggauuauauca

SEQ ID NO: 4022054 - RNA, 11 nt, Marburg virus
uuacuggaagg

SEQ ID NO: 4022055 - RNA, 23 nt, Marburg virus
uuauacccacaagagauacuguu

SEQ ID NO: 4022056 - RNA, 15 nt, Marburg virus
uucaacagaaauugu

SEQ ID NO: 4022057 - RNA, 15 nt, Marburg virus
uucaacuaaacuugc

SEQ ID NO: 4022058 - RNA, 19 nt, Marburg virus
uucaaguuuacugaagacu

SEQ ID NO: 4022059 - RNA, 21 nt, Marburg virus
uucaauaugaugcaauuaauc

SEQ ID NO: 4022060 - RNA, 17 nt, Marburg virus
uucauugcuaaguaaac

SEQ ID NO: 4022061 - RNA, 19 nt, Marburg virus
uucggcugaggaagaucaa

SEQ ID NO: 4022062 - RNA, 13 nt, Marburg virus
uucuuguuucaaa

SEQ ID NO: 4022063 - RNA, 23 nt, Marburg virus
uugacuucucacuuuuuaagaau

SEQ ID NO: 4022064 - RNA, 13 nt, Marburg virus
uugagucauauua

SEQ ID NO: 4022065 - RNA, 14 nt, Marburg virus
uugaugacuggaaa

SEQ ID NO: 4022066 - RNA, 20 nt, Marburg virus
uugcaagcgaugugugcuug

SEQ ID NO: 4022067 - RNA, 22 nt, Marburg virus
uugcauuuaacuccauaucuua

SEQ ID NO: 4022068 - RNA, 23 nt, Marburg virus
uugccucuguuucuucuguuuuc

SEQ ID NO: 4022069 - RNA, 15 nt, Marburg virus
uuggacaaguaacaa

SEQ ID NO: 4022070 - RNA, 20 nt, Marburg virus
uuguuacugagagggaacag

SEQ ID NO: 4022071 - RNA, 13 nt, Marburg virus
uuuaauauucaga

SEQ ID NO: 4022072 - RNA, 18 nt, Marburg virus
uuuaguagcguuaccuuu

SEQ ID NO: 4022073 - RNA, 13 nt, Marburg virus
uuuauaaacaauu

SEQ ID NO: 4022074 - RNA, 15 nt, Marburg virus
uuucaccuugaaaga

SEQ ID NO: 4022075 - RNA, 17 nt, Marburg virus
uuucacuuuagaggcaa

SEQ ID NO: 4022076 - RNA, 13 nt, Marburg virus
uuucauucaaugu

SEQ ID NO: 4022077 - RNA, 12 nt, Marburg virus
uuuccuucucau

SEQ ID NO: 4022078 - RNA, 12 nt, Marburg virus
uuucuucaauau

SEQ ID NO: 4022079 - RNA, 17 nt, Marburg virus
uuucuucagaacuguuc

SEQ ID NO: 4022080 - RNA, 14 nt, Marburg virus
uuugauauucaauu

SEQ ID NO: 4022081 - RNA, 16 nt, Marburg virus
uuuuaaacuaccucuu

SEQ ID NO: 4022082 - RNA, 21 nt, Marburg virus
uuuucacauagguucugauuu

SEQ ID NO: 4022083 - RNA, 19 nt, Marburg virus
uuuucuuuaauauucagaa

SEQ ID NO: 4022084 - RNA, 13 nt, Marburg virus
cuccacaacaaug

SEQ ID NO: 4022085 - RNA, 23 nt, Marburg virus
cucccucaccacaaccaagcacg

SEQ ID NO: 4022086 - RNA, 13 nt, Marburg virus
cuccuaaggaaaa

SEQ ID NO: 4022087 - RNA, 16 nt, Marburg virus
cuccuaccaacauccg

SEQ ID NO: 4022088 - RNA, 15 nt, Marburg virus
cuccuccuccaaaag

SEQ ID NO: 4022089 - RNA, 12 nt, Marburg virus
cucuaaggaaaa

SEQ ID NO: 4022090 - RNA, 15 nt, Marburg virus
cucucagaaucaguu

SEQ ID NO: 4022091 - RNA, 17 nt, Marburg virus
cucucuacaaaagcauu

SEQ ID NO: 4022092 - RNA, 21 nt, Marburg virus
cucugaugacaagugacaaaa

SEQ ID NO: 4022093 - RNA, 14 nt, Marburg virus
cugaaaucaacuug

SEQ ID NO: 4022094 - RNA, 15 nt, Marburg virus
cugaacccaacaaaa

SEQ ID NO: 4022095 - RNA, 16 nt, Marburg virus
cugaucccacuuguaa

SEQ ID NO: 4022096 - RNA, 23 nt, Marburg virus
cuggaagaaccacugcaccagcu

SEQ ID NO: 4022097 - RNA, 20 nt, Marburg virus
cuggcgcccauccaaggaca

SEQ ID NO: 4022098 - RNA, 21 nt, Marburg virus
cuuaaaaccuaaagucauguu

SEQ ID NO: 4022099 - RNA, 15 nt, Marburg virus
cuucaagaauacaac

SEQ ID NO: 4022100 - RNA, 22 nt, Marburg virus
cuugaaggcauaucuuaauaag

SEQ ID NO: 4022101 - RNA, 13 nt, Marburg virus
cuuuauuaagaaa

SEQ ID NO: 4022102 - RNA, 22 nt, Marburg virus
cuuucacuuuagaggcaauaau

SEQ ID NO: 4022103 - RNA, 19 nt, Marburg virus
gaaaaacuaugaagaacau

SEQ ID NO: 4022104 - RNA, 22 nt, Marburg virus
gaaaacacugccuacucuggag

SEQ ID NO: 4022105 - RNA, 15 nt, Marburg virus
gaaaauguuauugau

SEQ ID NO: 4022106 - RNA, 12 nt, Marburg virus
gaagggacaaug

SEQ ID NO: 4022107 - RNA, 17 nt, Marburg virus
gaagguaugaugaagaa

SEQ ID NO: 4022108 - RNA, 23 nt, Marburg virus
gacaaguaacaauggaacacaaa

SEQ ID NO: 4022109 - RNA, 16 nt, Marburg virus
gacaagugacaaaauu

SEQ ID NO: 4022110 - RNA, 16 nt, Marburg virus
gaccugauuguugcau

SEQ ID NO: 4022111 - RNA, 12 nt, Marburg virus
gacgcuuauuca

SEQ ID NO: 4022112 - RNA, 16 nt, Marburg virus
gacgucuucauugaga

SEQ ID NO: 4022113 - RNA, 17 nt, Marburg virus
gagauuaaaaagacuac

SEQ ID NO: 4022114 - RNA, 23 nt, Marburg virus
gauaagagucaaaaacuuccaaa

SEQ ID NO: 4022115 - RNA, 13 nt, Marburg virus
gaucgcccuccau

SEQ ID NO: 4022116 - RNA, 12 nt, Marburg virus
gaucuacuuaua

SEQ ID NO: 4022117 - RNA, 16 nt, Marburg virus
gaugcauuaauguuuu

SEQ ID NO: 4022118 - RNA, 16 nt, Marburg virus
gaugcauuggacgaug

SEQ ID NO: 4022119 - RNA, 21 nt, Marburg virus
gaugggucuguguuuauucau

SEQ ID NO: 4022120 - RNA, 14 nt, Marburg virus
gauugauuaagaaa

SEQ ID NO: 4022121 - RNA, 22 nt, Marburg virus
gauuuucucgaggcaaggacag

SEQ ID NO: 4022122 - RNA, 15 nt, Marburg virus
gcaaacauauugaaa

SEQ ID NO: 4022123 - RNA, 18 nt, Marburg virus
gcaagaaggaaacaacac

SEQ ID NO: 4022124 - RNA, 21 nt, Marburg virus
gcaaucuguaaaaaucuuaaa

SEQ ID NO: 4022125 - RNA, 14 nt, Marburg virus
gcaauuacaugaga

SEQ ID NO: 4022126 - RNA, 12 nt, Marburg virus
gcacaaaaugau

SEQ ID NO: 4022127 - RNA, 12 nt, Marburg virus
gcacgccacagc

SEQ ID NO: 4022128 - RNA, 22 nt, Marburg virus
gcagacuuuuccuugaaucaaa

SEQ ID NO: 4022129 - RNA, 18 nt, Marburg virus
gcauauccuuuguugaua

SEQ ID NO: 4022130 - RNA, 13 nt, Marburg virus
gcaucccgcaguc

SEQ ID NO: 4022131 - RNA, 15 nt, Marburg virus
gcaugaauguugauc

SEQ ID NO: 4022132 - RNA, 22 nt, Marburg virus
gcauuaaaaacauuucuucaga

SEQ ID NO: 4022133 - RNA, 13 nt, Marburg virus
gcuucaauacaac

SEQ ID NO: 4022134 - RNA, 20 nt, Marburg virus
ggaaaggacauuuuccuuaa

SEQ ID NO: 4022135 - RNA, 21 nt, Marburg virus
ggaacauagcagcuaugauug

SEQ ID NO: 4022136 - RNA, 20 nt, Marburg virus
ggaguccaucugcauaagaa

SEQ ID NO: 4022137 - RNA, 17 nt, Marburg virus
ggauauuaaauauccau

SEQ ID NO: 4022138 - RNA, 15 nt, Marburg virus
ggaucagcuaucaaa

SEQ ID NO: 4022139 - RNA, 14 nt, Marburg virus
ggcugcguugcuca

SEQ ID NO: 4022140 - RNA, 13 nt, Marburg virus
ggucauuaagaag

SEQ ID NO: 4022141 - RNA, 13 nt, Marburg virus
gguugaugacugg

SEQ ID NO: 4022142 - RNA, 21 nt, Marburg virus
gguuuggaguuuccuuacucu

SEQ ID NO: 4022143 - RNA, 15 nt, Marburg virus
guauacucgcuucaa

SEQ ID NO: 4022144 - RNA, 17 nt, Marburg virus
guaucuuuaccaaauau

SEQ ID NO: 4022145 - RNA, 17 nt, Marburg virus
guauuacuuacuugggc

SEQ ID NO: 4022146 - RNA, 17 nt, Marburg virus
guuaaaaacuaaauuaa

SEQ ID NO: 4022147 - RNA, 16 nt, Marburg virus
guuacugaucuugaga

SEQ ID NO: 4022148 - RNA, 17 nt, Marburg virus
guucauaugcuuucaga

SEQ ID NO: 4022149 - RNA, 13 nt, Marburg virus
guugacaaucaaa

SEQ ID NO: 4022150 - RNA, 19 nt, Marburg virus
guugaucccggcggaucag

SEQ ID NO: 4022151 - RNA, 12 nt, Marburg virus
guugcccuccaa

SEQ ID NO: 4022152 - RNA, 17 nt, Marburg virus
uaaaaaucccaacaaug

SEQ ID NO: 4022153 - RNA, 12 nt, Marburg virus
uaaaccaagcaa

SEQ ID NO: 4022154 - RNA, 14 nt, Marburg virus
uaaauaguugucau

SEQ ID NO: 4022155 - RNA, 13 nt, Marburg virus
uaaauauaaaaga

SEQ ID NO: 4022156 - RNA, 21 nt, Marburg virus
uaacaacaagaguccaugaaa

SEQ ID NO: 4022157 - RNA, 17 nt, Marburg virus
uaacaauggaacacaaa

SEQ ID NO: 4022158 - RNA, 19 nt, Marburg virus
uaacuggacaacagaucau

SEQ ID NO: 4022159 - RNA, 15 nt, Marburg virus
uaacuuuucaauguu

SEQ ID NO: 4022160 - RNA, 19 nt, Marburg virus
uaagaaauuagggaaauac

SEQ ID NO: 4022161 - RNA, 21 nt, Marburg virus
uaagacuggccgaaaaugcuc

SEQ ID NO: 4022162 - RNA, 18 nt, Marburg virus
uaauaaucaccaauucau

SEQ ID NO: 4022163 - RNA, 13 nt, Marburg virus
uaauagugcauuu

SEQ ID NO: 4022164 - RNA, 15 nt, Marburg virus
uaaucaccaauucau

SEQ ID NO: 4022165 - RNA, 21 nt, Marburg virus
uaauuaacuguuggcuuagau

SEQ ID NO: 4022166 - RNA, 15 nt, Marburg virus
uacaugcaauacuug

SEQ ID NO: 4022167 - RNA, 19 nt, Marburg virus
uaccucuaaggaaaaucau

SEQ ID NO: 4022168 - RNA, 18 nt, Marburg virus
uacguuacguuuucucug

SEQ ID NO: 4022169 - RNA, 14 nt, Marburg virus
uacuauugugugag

SEQ ID NO: 4022170 - RNA, 16 nt, Marburg virus
uacuuaagucauucuu

SEQ ID NO: 4022171 - RNA, 17 nt, Marburg virus
uacuugggcuugaagac

SEQ ID NO: 4022172 - RNA, 13 nt, Marburg virus
uagaauuucuuga

SEQ ID NO: 4022173 - RNA, 18 nt, Marburg virus
uagaucacggaucaagca

SEQ ID NO: 4022174 - RNA, 22 nt, Marburg virus
uagcaacaugaugguuguuacu

SEQ ID NO: 4022175 - RNA, 19 nt, Marburg virus
uagcucaaguccuuucaaa

SEQ ID NO: 4022176 - RNA, 19 nt, Marburg virus
uagcugucuugauugcucu

SEQ ID NO: 4022177 - RNA, 15 nt, Marburg virus
uaguguucuuuuacu

SEQ ID NO: 4022178 - RNA, 15 nt, Marburg virus
uaguuaaauuucuag

SEQ ID NO: 4022179 - RNA, 22 nt, Marburg virus
uaguuaugaauguuuuaucaug

SEQ ID NO: 4022180 - RNA, 13 nt, Marburg virus
uauaaaauuaaaa

SEQ ID NO: 4022181 - RNA, 16 nt, Marburg virus
uauaaacuuguagaau

SEQ ID NO: 4022182 - RNA, 19 nt, Marburg virus
uauacucgcuucaauacaa

SEQ ID NO: 4022183 - RNA, 19 nt, Marburg virus
uaucagccuaaaaucugau

SEQ ID NO: 4022184 - RNA, 20 nt, Marburg virus
uaugaauguuuuaucaugau

SEQ ID NO: 4022185 - RNA, 16 nt, Marburg virus
uaugcaugucagugau

SEQ ID NO: 4022186 - RNA, 20 nt, Marburg virus
uauuaaagguuuucuuuaau

SEQ ID NO: 4022187 - RNA, 13 nt, Marburg virus
uauuaaauaucca

SEQ ID NO: 4022188 - RNA, 18 nt, Marburg virus
uauuagccccaaucuguu

SEQ ID NO: 4022189 - RNA, 16 nt, Marburg virus
uauucagugcuacaaa

SEQ ID NO: 4022190 - RNA, 20 nt, Marburg virus
uauuccuucugaaauaguaa

SEQ ID NO: 4022191 - RNA, 16 nt, Marburg virus
uauuucaacuuaagaa

SEQ ID NO: 4022192 - RNA, 16 nt, Marburg virus
uauuucggaacaaauu

SEQ ID NO: 4022193 - RNA, 17 nt, Marburg virus
ucaaaggcgacaagcac

SEQ ID NO: 4022194 - RNA, 22 nt, Marburg virus
ucaacaauacugugaauuauuc

SEQ ID NO: 4022195 - RNA, 16 nt, Marburg virus
ucaacaaugccaccca

SEQ ID NO: 4022196 - RNA, 20 nt, Marburg virus
ucaagaauuacagcaaucau

SEQ ID NO: 4022197 - RNA, 17 nt, Marburg virus
ucaagauuuaaaaugca

SEQ ID NO: 4022198 - RNA, 15 nt, Marburg virus
ucaaguaugcaaauu

SEQ ID NO: 4022199 - RNA, 21 nt, Marburg virus
ucaauacaacuucccuucaua

SEQ ID NO: 4022200 - RNA, 14 nt, Marburg virus
ucaauaugcagcau

SEQ ID NO: 4022201 - RNA, 14 nt, Marburg virus
ucacaguaaucaaa

SEQ ID NO: 4022202 - RNA, 20 nt, Marburg virus
ucauaguuuaaccacauaau

SEQ ID NO: 4022203 - RNA, 15 nt, Marburg virus
ucauaugcuuucaga

SEQ ID NO: 4022204 - RNA, 17 nt, Marburg virus
ucauaugcuuucagaau

SEQ ID NO: 4022205 - RNA, 16 nt, Marburg virus
ucaugggcccuucaua

SEQ ID NO: 4022206 - RNA, 19 nt, Marburg virus
ucauucaaacaccccaaau

SEQ ID NO: 4022207 - RNA, 17 nt, Marburg virus
uccagaguggcaacaaa

SEQ ID NO: 4022208 - RNA, 13 nt, Marburg virus
uccaugccccccc

SEQ ID NO: 4022209 - RNA, 14 nt, Marburg virus
ucccagagaagaca

SEQ ID NO: 4022210 - RNA, 20 nt, Marburg virus
ucccucagagaaguuacaca

SEQ ID NO: 4022211 - RNA, 20 nt, Marburg virus
uccucggaguaguuccucca

SEQ ID NO: 4022212 - RNA, 16 nt, Marburg virus
ucgggcuguuccuccc

SEQ ID NO: 4022213 - RNA, 15 nt, Marburg virus
ucuacuaacaacacc

SEQ ID NO: 4022214 - RNA, 19 nt, Marburg virus
acauuggggaaagaacuag

SEQ ID NO: 4022215 - RNA, 18 nt, Marburg virus
accaaauaugacaaaugg

SEQ ID NO: 4022216 - RNA, 17 nt, Marburg virus
accaaucauauuccccg

SEQ ID NO: 4022217 - RNA, 19 nt, Marburg virus
accacaacggcaccaaaua

SEQ ID NO: 4022218 - RNA, 19 nt, Marburg virus
accaccucguaauuucaac

SEQ ID NO: 4022219 - RNA, 17 nt, Marburg virus
accaggaucaagggaaa

SEQ ID NO: 4022220 - RNA, 16 nt, Marburg virus
accucuaaggaaaauc

SEQ ID NO: 4022221 - RNA, 20 nt, Marburg virus
accuugaaagaguuaaaugg

SEQ ID NO: 4022222 - RNA, 16 nt, Marburg virus
acgccacagcaagaag

SEQ ID NO: 4022223 - RNA, 17 nt, Marburg virus
acucugaacuaaggaaa

SEQ ID NO: 4022224 - RNA, 18 nt, Marburg virus
acucuggagaaaaugaga

SEQ ID NO: 4022225 - RNA, 18 nt, Marburg virus
acucuucauguuguaaau

SEQ ID NO: 4022226 - RNA, 18 nt, Marburg virus
acugcugguuuaauuaaa

SEQ ID NO: 4022227 - RNA, 22 nt, Marburg virus
acugcugguuuaauuaaaaacc

SEQ ID NO: 4022228 - RNA, 15 nt, Marburg virus
acuguuuuaauuaag

SEQ ID NO: 4022229 - RNA, 13 nt, Marburg virus
acuuaaaugagca

SEQ ID NO: 4022230 - RNA, 16 nt, Marburg virus
agaagaagaaaaaacu

SEQ ID NO: 4022231 - RNA, 16 nt, Marburg virus
agaagcauuauugcau

SEQ ID NO: 4022232 - RNA, 23 nt, Marburg virus
agaagccuugcuagcagauggac

SEQ ID NO: 4022233 - RNA, 20 nt, Marburg virus
agaauauggugauccccaga

SEQ ID NO: 4022234 - RNA, 14 nt, Marburg virus
agaaucaguuguuu

SEQ ID NO: 4022235 - RNA, 19 nt, Marburg virus
agacacuaaacauuucaaa

SEQ ID NO: 4022236 - RNA, 23 nt, Marburg virus
agacuuuuccuugaaucaaauau

SEQ ID NO: 4022237 - RNA, 22 nt, Marburg virus
agagucacaaccgaggaaagga

SEQ ID NO: 4022238 - RNA, 14 nt, Marburg virus
agaguuaaaaacua

SEQ ID NO: 4022239 - RNA, 22 nt, Marburg virus
aucuaggugauugugaaaagac

SEQ ID NO: 4022240 - RNA, 15 nt, Marburg virus
aucuugagaaauaca

SEQ ID NO: 4022241 - RNA, 11 nt, Marburg virus
augaacaaaaa

SEQ ID NO: 4022242 - RNA, 19 nt, Marburg virus
augaagaacauuaagaaaa

SEQ ID NO: 4022243 - RNA, 17 nt, Marburg virus
augauuuuaaauaccua

SEQ ID NO: 4022244 - RNA, 15 nt, Marburg virus
augcaaaacuaucca

SEQ ID NO: 4022245 - RNA, 23 nt, Marburg virus
augcaaaccauaaggaaaaauga

SEQ ID NO: 4022246 - RNA, 20 nt, Marburg virus
augggugauaaucaauguau

SEQ ID NO: 4022247 - RNA, 15 nt, Marburg virus
augucagaaauguua

SEQ ID NO: 4022248 - RNA, 18 nt, Marburg virus
augugaauguaaauuaag

SEQ ID NO: 4022249 - RNA, 20 nt, Marburg virus
augugcguagagguuaauuu

SEQ ID NO: 4022250 - RNA, 18 nt, Marburg virus
auuaaaaaauuaaaaaac

SEQ ID NO: 4022251 - RNA, 15 nt, Marburg virus
auuaagaaaaacuau

SEQ ID NO: 4022252 - RNA, 12 nt, Marburg virus
auuaaguucuuu

SEQ ID NO: 4022253 - RNA, 16 nt, Marburg virus
auuaauuccuugaaug

SEQ ID NO: 4022254 - RNA, 19 nt, Marburg virus
auuacacauuaaccaugaa

SEQ ID NO: 4022255 - RNA, 19 nt, Marburg virus
auuacuacggguuaugaug

SEQ ID NO: 4022256 - RNA, 17 nt, Marburg virus
auuauaaacuuguagaa

SEQ ID NO: 4022257 - RNA, 16 nt, Marburg virus
auucaauuguuaucau

SEQ ID NO: 4022258 - RNA, 16 nt, Marburg virus
auucagaaaagguuuu

SEQ ID NO: 4022259 - RNA, 22 nt, Marburg virus
auuccuugaauguccagcauca

SEQ ID NO: 4022260 - RNA, 21 nt, Marburg virus
auugacuccucaacaauacug

SEQ ID NO: 4022261 - RNA, 23 nt, Marburg virus
auugacuucucacuuuuuaagaa

SEQ ID NO: 4022262 - RNA, 21 nt, Marburg virus
auugugcuaaugcuuaucauu

SEQ ID NO: 4022263 - RNA, 23 nt, Marburg virus
auuuaacuccauaucuuagacaa

SEQ ID NO: 4022264 - RNA, 23 nt, Marburg virus
auuuaaguauuuuuauaaaagac

SEQ ID NO: 4022265 - RNA, 21 nt, Marburg virus
auuuacugguauaaaauagug

SEQ ID NO: 4022266 - RNA, 15 nt, Marburg virus
auuuauauuuacugg

SEQ ID NO: 4022267 - RNA, 14 nt, Marburg virus
auuucaacuggaag

SEQ ID NO: 4022268 - RNA, 16 nt, Marburg virus
auuuuccuuaauuaau

SEQ ID NO: 4022269 - RNA, 22 nt, Marburg virus
caaaauacccucaccacugccc

SEQ ID NO: 4022270 - RNA, 24 nt, Marburg virus
caaaauauaucuuuugcaagcgau

SEQ ID NO: 4022271 - RNA, 14 nt, Marburg virus
caaacccacaagca

SEQ ID NO: 4022272 - RNA, 16 nt, Marburg virus
caaagagcacuaacaa

SEQ ID NO: 4022273 - RNA, 23 nt, Marburg virus
caaagagcacuaacaacacgaaa

SEQ ID NO: 4022274 - RNA, 23 nt, Marburg virus
caaauguuacggaaaaaagcaua

SEQ ID NO: 4022275 - RNA, 20 nt, Marburg virus
caacugaugccaccacacuc

SEQ ID NO: 4022276 - RNA, 17 nt, Marburg virus
caacuguugcauaucuu

SEQ ID NO: 4022277 - RNA, 22 nt, Marburg virus
caagaaaccgauggaaaagcug

SEQ ID NO: 4022278 - RNA, 16 nt, Marburg virus
caagcacgccacagca

SEQ ID NO: 4022279 - RNA, 15 nt, Marburg virus
caaucucuacuaaca

SEQ ID NO: 4022280 - RNA, 19 nt, Marburg virus
caaucucuacuaacaacac

SEQ ID NO: 4022281 - RNA, 13 nt, Marburg virus
caauguauaacaa

SEQ ID NO: 4022282 - RNA, 14 nt, Marburg virus
caauuaaucauguu

SEQ ID NO: 4022283 - RNA, 20 nt, Marburg virus
caauuacgacacacagagca

SEQ ID NO: 4022284 - RNA, 19 nt, Marburg virus
cacaagagauacuguuuua

SEQ ID NO: 4022285 - RNA, 18 nt, Marburg virus
cacaauggauuugcauuu

SEQ ID NO: 4022286 - RNA, 16 nt, Marburg virus
cacagcaaagagcacu

SEQ ID NO: 4022287 - RNA, 23 nt, Marburg virus
cacccacucccucaccacaacca

SEQ ID NO: 4022288 - RNA, 16 nt, Marburg virus
caccuccaagaacaac

SEQ ID NO: 4022289 - RNA, 19 nt, Marburg virus
cacuauguuauaugcaugu

SEQ ID NO: 4022290 - RNA, 17 nt, Marburg virus
cacuccauuccauaucc

SEQ ID NO: 4022291 - RNA, 16 nt, Marburg virus
cagcaauuacaacaca

SEQ ID NO: 4022292 - RNA, 17 nt, Marburg virus
cagucccucccccaccc

SEQ ID NO: 4022293 - RNA, 19 nt, Marburg virus
cagugauaagagucaaaaa

SEQ ID NO: 4022294 - RNA, 13 nt, Marburg virus
cauauuuuaacuu

SEQ ID NO: 4022295 - RNA, 19 nt, Marburg virus
caugacuugauucagagag

SEQ ID NO: 4022296 - RNA, 18 nt, Marburg virus
cauuggacgaugauuuau

SEQ ID NO: 4022297 - RNA, 16 nt, Marburg virus
cauuguugcaucauuu

SEQ ID NO: 4022298 - RNA, 16 nt, Marburg virus
cauuuaucucaacuug

SEQ ID NO: 4022299 - RNA, 13 nt, Marburg virus
cauuugaugcuuu

SEQ ID NO: 4022300 - RNA, 14 nt, Marburg virus
ccagcauggcugcc

SEQ ID NO: 4022301 - RNA, 16 nt, Marburg virus
ccaugcuuucacuuua

SEQ ID NO: 4022302 - RNA, 16 nt, Marburg virus
cccccuccuccuccaa

SEQ ID NO: 4022303 - RNA, 20 nt, Marburg virus
cccucgaucugacacaauac

SEQ ID NO: 4022304 - RNA, 18 nt, Marburg virus
ccuaacaugaagaccaca

SEQ ID NO: 4022305 - RNA, 14 nt, Marburg virus
cggagaacaggaac

SEQ ID NO: 4022306 - RNA, 12 nt, Marburg virus
cgguacaggaau

SEQ ID NO: 4022307 - RNA, 15 nt, Marburg virus
cguugcucacaggca

SEQ ID NO: 4022308 - RNA, 21 nt, Marburg virus
cuaaaauaauaagugauuuaa

SEQ ID NO: 4022309 - RNA, 13 nt, Marburg virus
cuaaacauuucaa

SEQ ID NO: 4022310 - RNA, 14 nt, Marburg virus
cuaacaacacgaaa

SEQ ID NO: 4022311 - RNA, 15 nt, Marburg virus
cuaagugaaggagag

SEQ ID NO: 4022312 - RNA, 16 nt, Marburg virus
cuaauauuacuaacaa

SEQ ID NO: 4022313 - RNA, 13 nt, Marburg virus
cuaaugauuguaa

SEQ ID NO: 4022314 - RNA, 16 nt, Marburg virus
cuagaaugucaaugug

SEQ ID NO: 4022315 - RNA, 18 nt, Marburg virus
cuagaugaucaguucaaa

SEQ ID NO: 4022316 - RNA, 20 nt, Marburg virus
cuagcucaaguccuuucaaa

SEQ ID NO: 4022317 - RNA, 21 nt, Marburg virus
cucacaagauuaguuuguauu

SEQ ID NO: 4022318 - RNA, 19 nt, Marburg virus
cucaccacugcccacagcc

SEQ ID NO: 4022319 - RNA, 19 nt, Marburg virus
cucaccgucccuuuucauu

SEQ ID NO: 4022320 - RNA, 16 nt, Marburg virus
cugaaauaguaagaaa

SEQ ID NO: 4022321 - RNA, 20 nt, Marburg virus
cugauuguugcauuggaaua

SEQ ID NO: 4022322 - RNA, 22 nt, Marburg virus
cugcuuuaaaugguuaauuaag

SEQ ID NO: 4022323 - RNA, 12 nt, Marburg virus
cugguuuucuua

SEQ ID NO: 4022324 - RNA, 22 nt, Marburg virus
cugugacugaacccaacaaaac

SEQ ID NO: 4022325 - RNA, 23 nt, Marburg virus
cuuaauccaagggauaaaaacuc

SEQ ID NO: 4022326 - RNA, 20 nt, Marburg virus
cuuacuugggcuugaagaca

SEQ ID NO: 4022327 - RNA, 18 nt, Marburg virus
cuuagaugauaacagaua

SEQ ID NO: 4022328 - RNA, 18 nt, Marburg virus
cuuaguuggaauuaacuu

SEQ ID NO: 4022329 - RNA, 22 nt, Marburg virus
cuuauugcgagacuugaacaca

SEQ ID NO: 4022330 - RNA, 13 nt, Marburg virus
cuucaauaugcag

SEQ ID NO: 4022331 - RNA, 20 nt, Marburg virus
cuucagcacccucucuguau

SEQ ID NO: 4022332 - RNA, 15 nt, Marburg virus
cuucauaaucuguuu

SEQ ID NO: 4022333 - RNA, 12 nt, Marburg virus
cuucauuucauu

SEQ ID NO: 4022334 - RNA, 20 nt, Marburg virus
cuugaacucagugaggagac

SEQ ID NO: 4022335 - RNA, 13 nt, Marburg virus
cuugauuaaaaac

SEQ ID NO: 4022336 - RNA, 14 nt, Marburg virus
cuuucacuuuagag

SEQ ID NO: 4022337 - RNA, 15 nt, Marburg virus
cuuucuuuuugcaaa

SEQ ID NO: 4022338 - RNA, 16 nt, Marburg virus
cuuugauuuacuaaca

SEQ ID NO: 4022339 - RNA, 17 nt, Marburg virus
cuuuguuagaauuauuc

SEQ ID NO: 4022340 - RNA, 24 nt, Marburg virus
cuuuguugauacccuugagagaca

SEQ ID NO: 4022341 - RNA, 12 nt, Marburg virus
cuuuuucacaua

SEQ ID NO: 4022342 - RNA, 19 nt, Marburg virus
gaaaaggaagaauuauucu

SEQ ID NO: 4022343 - RNA, 23 nt, Marburg virus
gaaaauaaucuauuuaaaaauga

SEQ ID NO: 4022344 - RNA, 15 nt, Marburg virus
gaaaauccuuauuau

SEQ ID NO: 4022345 - RNA, 14 nt, Marburg virus
gaaaggccccacca

SEQ ID NO: 4022346 - RNA, 12 nt, Marburg virus
gaacucagugag

SEQ ID NO: 4022347 - RNA, 17 nt, Marburg virus
gaaucaaacaugugcuc

SEQ ID NO: 4022348 - RNA, 19 nt, Marburg virus
gaaucuauuugaccucaga

SEQ ID NO: 4022349 - RNA, 13 nt, Marburg virus
gacagaacacaaa

SEQ ID NO: 4022350 - RNA, 17 nt, Marburg virus
gacauguauaucaugug

SEQ ID NO: 4022351 - RNA, 18 nt, Marburg virus
gaccaaauaauagugcau

SEQ ID NO: 4022352 - RNA, 13 nt, Marburg virus
gagcaauuuaagg

SEQ ID NO: 4022353 - RNA, 16 nt, Marburg virus
gagcacuaacaacacg

SEQ ID NO: 4022354 - RNA, 14 nt, Marburg virus
gaggagacguucuc

SEQ ID NO: 4022355 - RNA, 18 nt, Marburg virus
gaggauaaaaggacaaag

SEQ ID NO: 4022356 - RNA, 16 nt, Marburg virus
gauccuauuacuuguu

SEQ ID NO: 4022357 - RNA, 15 nt, Marburg virus
gauccuccuaccaac

SEQ ID NO: 4022358 - RNA, 15 nt, Marburg virus
gaugcaauuaaucau

SEQ ID NO: 4022359 - RNA, 20 nt, Marburg virus
gaugcgagggcauuauucag

SEQ ID NO: 4022360 - RNA, 19 nt, Marburg virus
gauuaguuuguauugauuu

SEQ ID NO: 4022361 - RNA, 23 nt, Marburg virus
gcaaagagcacuaacaacacgaa

SEQ ID NO: 4022362 - RNA, 15 nt, Marburg virus
gcaauuaaucauguu

SEQ ID NO: 4022363 - RNA, 16 nt, Marburg virus
gcacaaaaugauuuuc

SEQ ID NO: 4022364 - RNA, 20 nt, Marburg virus
gcauccaacucaauauccug

SEQ ID NO: 4022365 - RNA, 22 nt, Marburg virus
aaaaacccaaagucaacaauua

SEQ ID NO: 4022366 - RNA, 13 nt, Marburg virus
aaaaacuaaauua

SEQ ID NO: 4022367 - RNA, 18 nt, Marburg virus
aaaaagaugaacaaaaag

SEQ ID NO: 4022368 - RNA, 22 nt, Marburg virus
aaaacauauuuauccuugugua

SEQ ID NO: 4022369 - RNA, 15 nt, Marburg virus
aaaacaugcuacaau

SEQ ID NO: 4022370 - RNA, 20 nt, Marburg virus
aaaacccagcaguauugaaa

SEQ ID NO: 4022371 - RNA, 18 nt, Marburg virus
uuacaacacauacaugca

SEQ ID NO: 4022372 - RNA, 12 nt, Marburg virus
uuacacauuaac

SEQ ID NO: 4022373 - RNA, 20 nt, Marburg virus
uuagaaaaauucacauguac

SEQ ID NO: 4022374 - RNA, 19 nt, Marburg virus
uuauaggaacagauuuaga

SEQ ID NO: 4022375 - RNA, 14 nt, Marburg virus
uuaucauucucaag

SEQ ID NO: 4022376 - RNA, 12 nt, Marburg virus
uuauuaagaaaa

SEQ ID NO: 4022377 - RNA, 20 nt, Marburg virus
uucaaacaccccaaauuuuc

SEQ ID NO: 4022378 - RNA, 13 nt, Marburg virus
uucaacuggaaga

SEQ ID NO: 4022379 - RNA, 18 nt, Marburg virus
uucaagacgcuuauucau

SEQ ID NO: 4022380 - RNA, 18 nt, Marburg virus
uucaaguuuacugaagac

SEQ ID NO: 4022381 - RNA, 19 nt, Marburg virus
uucaauguuaguuacucaa

SEQ ID NO: 4022382 - RNA, 13 nt, Marburg virus
uucaauuauccuu

SEQ ID NO: 4022383 - RNA, 15 nt, Marburg virus
uucauaaucuguuug

SEQ ID NO: 4022384 - RNA, 14 nt, Marburg virus
uucccauagaucaa

SEQ ID NO: 4022385 - RNA, 17 nt, Marburg virus
uuccuauaaucugauug

SEQ ID NO: 4022386 - RNA, 22 nt, Marburg virus
uuccuccagugauaagagucaa

SEQ ID NO: 4022387 - RNA, 22 nt, Marburg virus
uuccuguaugaucgcauugccu

SEQ ID NO: 4022388 - RNA, 19 nt, Marburg virus
uucugaaauaguaagaaaa

SEQ ID NO: 4022389 - RNA, 23 nt, Marburg virus
uucuuaagcuaucuuaaacuuga

SEQ ID NO: 4022390 - RNA, 20 nt, Marburg virus
uugaaaaggaagaauuauuc

SEQ ID NO: 4022391 - RNA, 15 nt, Marburg virus
uugagagaggaacaa

SEQ ID NO: 4022392 - RNA, 21 nt, Marburg virus
uugauacaaagacacuaaaca

SEQ ID NO: 4022393 - RNA, 21 nt, Marburg virus
uugauccaguuccaaauacaa

SEQ ID NO: 4022394 - RNA, 13 nt, Marburg virus
uugcuuuacacaa

SEQ ID NO: 4022395 - RNA, 22 nt, Marburg virus
uuguaagaauuaauuuacucuu

SEQ ID NO: 4022396 - RNA, 14 nt, Marburg virus
uuguauauuucaga

SEQ ID NO: 4022397 - RNA, 20 nt, Marburg virus
uuguccaggaauauuucgga

SEQ ID NO: 4022398 - RNA, 14 nt, Marburg virus
uugugaaucaucaa

SEQ ID NO: 4022399 - RNA, 14 nt, Marburg virus
uuguugauacccuu

SEQ ID NO: 4022400 - RNA, 16 nt, Marburg virus
uuuauaacuaaccauu

SEQ ID NO: 4022401 - RNA, 20 nt, Marburg virus
uuuauacugcugguuuaauu

SEQ ID NO: 4022402 - RNA, 19 nt, Marburg virus
uuuauauguaaugaacaau

SEQ ID NO: 4022403 - RNA, 14 nt, Marburg virus
uuuuggaugcaaac

SEQ ID NO: 4022404 - RNA, 18 nt, Marburg virus
uuuuuccacuaaucaauu

SEQ ID NO: 4022405 - RNA, 16 nt, Marburg virus
uuuuuguguuuucaaa

SEQ ID NO: 4022406 - RNA, 19 nt, Marburg virus
aaaaccaggguuaagagua

SEQ ID NO: 4022407 - RNA, 14 nt, Marburg virus
aaaacuaaugaaga

SEQ ID NO: 4022408 - RNA, 14 nt, Marburg virus
aaaacuaugaagaa

SEQ ID NO: 4022409 - RNA, 14 nt, Marburg virus
aaaaggaagaauua

SEQ ID NO: 4022410 - RNA, 13 nt, Marburg virus
aaaaguuagaaua

SEQ ID NO: 4022411 - RNA, 14 nt, Marburg virus
aaaauccaguguua

SEQ ID NO: 4022412 - RNA, 14 nt, Marburg virus
aaaauuaaaaaacu

SEQ ID NO: 4022413 - RNA, 22 nt, Marburg virus
aaacaauuuggucugcagguug

SEQ ID NO: 4022414 - RNA, 15 nt, Marburg virus
aaacagacauauaca

SEQ ID NO: 4022415 - RNA, 15 nt, Marburg virus
aaacuuguagaauua

SEQ ID NO: 4022416 - RNA, 22 nt, Marburg virus
aaauacugggauggcauuguug

SEQ ID NO: 4022417 - RNA, 20 nt, Marburg virus
aaauagccuugucauguuag

SEQ ID NO: 4022418 - RNA, 21 nt, Marburg virus
aaaugcuccccaauacagaca

SEQ ID NO: 4022419 - RNA, 20 nt, Marburg virus
aacaacaagaguccaugaaa

SEQ ID NO: 4022420 - RNA, 22 nt, Marburg virus
aacauauugugucaaauucauu

SEQ ID NO: 4022421 - RNA, 13 nt, Marburg virus
aaccaagcaauug

SEQ ID NO: 4022422 - RNA, 14 nt, Marburg virus
aaccuagaugauca

SEQ ID NO: 4022423 - RNA, 18 nt, Marburg virus
aacgccuaguggaaaacg

SEQ ID NO: 4022424 - RNA, 12 nt, Marburg virus
aacuaaggaaau

SEQ ID NO: 4022425 - RNA, 21 nt, Marburg virus
aacuaauauuacuaacaaaag

SEQ ID NO: 4022426 - RNA, 18 nt, Marburg virus
aacuaccuccacagauca

SEQ ID NO: 4022427 - RNA, 23 nt, Marburg virus
aacuauaauucaggggaaauuga

SEQ ID NO: 4022428 - RNA, 23 nt, Marburg virus
aacuuguaccucuaaggaaaauc

SEQ ID NO: 4022429 - RNA, 19 nt, Marburg virus
aagaauuuggagcguucag

SEQ ID NO: 4022430 - RNA, 22 nt, Marburg virus
aagacuuguccaggaauauuuc

SEQ ID NO: 4022431 - RNA, 15 nt, Marburg virus
aaggaaacaacacag

SEQ ID NO: 4022432 - RNA, 17 nt, Marburg virus
aaggaauucgacagcau

SEQ ID NO: 4022433 - RNA, 15 nt, Marburg virus
aauaacgauugauua

SEQ ID NO: 4022434 - RNA, 21 nt, Marburg virus
aauaacgauugauuaagaaaa

SEQ ID NO: 4022435 - RNA, 20 nt, Marburg virus
aauaagugaccccaaauuca

SEQ ID NO: 4022436 - RNA, 17 nt, Marburg virus
aauagauccuugaucaa

SEQ ID NO: 4022437 - RNA, 17 nt, Marburg virus
aauagugcauuuguaua

SEQ ID NO: 4022438 - RNA, 14 nt, Marburg virus
aauauccugaugca

SEQ ID NO: 4022439 - RNA, 22 nt, Marburg virus
aauaugcagcauccaacucaau

SEQ ID NO: 4022440 - RNA, 23 nt, Marburg virus
aauauggccaguuccagcaauua

SEQ ID NO: 4022441 - RNA, 13 nt, Marburg virus
aauauucagaaaa

SEQ ID NO: 4022442 - RNA, 23 nt, Marburg virus
aaucagcaggguauaacuccaaa

SEQ ID NO: 4022443 - RNA, 22 nt, Marburg virus
aaucauacacauaauaaccauu

SEQ ID NO: 4022444 - RNA, 20 nt, Marburg virus
aaucaucaaccagugugcaa

SEQ ID NO: 4022445 - RNA, 21 nt, Marburg virus
aaucaucauccacgugcaaga

SEQ ID NO: 4022446 - RNA, 23 nt, Marburg virus
aaucaugaagaacauuaagaaaa

SEQ ID NO: 4022447 - RNA, 19 nt, Marburg virus
aaucuuuuggaugcaaacc

SEQ ID NO: 4022448 - RNA, 20 nt, Marburg virus
aaugaaaauagccuugucau

SEQ ID NO: 4022449 - RNA, 21 nt, Marburg virus
aauguugaucaaaugaccaaa

SEQ ID NO: 4022450 - RNA, 16 nt, Marburg virus
aauuacagcaaucauu

SEQ ID NO: 4022451 - RNA, 21 nt, Marburg virus
aauuauccuaacaugaagacc

SEQ ID NO: 4022452 - RNA, 18 nt, Marburg virus
aauuauccuguauaacaa

SEQ ID NO: 4022453 - RNA, 19 nt, Marburg virus
aauucaagacgcuuauuca

SEQ ID NO: 4022454 - RNA, 22 nt, Marburg virus
aauucacauguacuguugauau

SEQ ID NO: 4022455 - RNA, 15 nt, Marburg virus
aauugaccaaaucaa

SEQ ID NO: 4022456 - RNA, 13 nt, Marburg virus
aauuuucaaucau

SEQ ID NO: 4022457 - RNA, 14 nt, Marburg virus
acaacaucuuguau

SEQ ID NO: 4022458 - RNA, 20 nt, Marburg virus
acaaugcagcccuugucuaa

SEQ ID NO: 4022459 - RNA, 14 nt, Marburg virus
acaccaggaaaaua

SEQ ID NO: 4022460 - RNA, 21 nt, Marburg virus
acagaagggacaauguugaug

SEQ ID NO: 4022461 - RNA, 17 nt, Marburg virus
acagacccaaacaauga

SEQ ID NO: 4022462 - RNA, 15 nt, Marburg virus
acauaccaaauacug

SEQ ID NO: 4022463 - RNA, 20 nt, Marburg virus
acaugaagaccacaugucuc

SEQ ID NO: 4022464 - RNA, 22 nt, Marburg virus
acauucuuauauugcuugauua

SEQ ID NO: 4022465 - RNA, 21 nt, Marburg virus
cagaauguugcgugaaggaaa

SEQ ID NO: 4022466 - RNA, 14 nt, Marburg virus
cagcaaagagcacu

SEQ ID NO: 4022467 - RNA, 21 nt, Marburg virus
cagcaaagagcacuaacaaca

SEQ ID NO: 4022468 - RNA, 14 nt, Marburg virus
cagcuguauacaaa

SEQ ID NO: 4022469 - RNA, 21 nt, Marburg virus
caggaaaucuuaccacagcaa

SEQ ID NO: 4022470 - RNA, 17 nt, Marburg virus
caguagugcagaaagca

SEQ ID NO: 4022471 - RNA, 13 nt, Marburg virus
caucuuaauagaa

SEQ ID NO: 4022472 - RNA, 19 nt, Marburg virus
caugaagaacauuaagaaa

SEQ ID NO: 4022473 - RNA, 13 nt, Marburg virus
cauuauucacaua

SEQ ID NO: 4022474 - RNA, 19 nt, Marburg virus
cauuguucuaccaacaguc

SEQ ID NO: 4022475 - RNA, 20 nt, Marburg virus
cauuguucuaccaacaguca

SEQ ID NO: 4022476 - RNA, 11 nt, Marburg virus
cauuuucuaga

SEQ ID NO: 4022477 - RNA, 16 nt, Marburg virus
cauuuuuggaugcauu

SEQ ID NO: 4022478 - RNA, 14 nt, Marburg virus
ccaagcaauugacu

SEQ ID NO: 4022479 - RNA, 20 nt, Marburg virus
ccaauuacgacacacagagc

SEQ ID NO: 4022480 - RNA, 23 nt, Marburg virus
ccagagaucaaacccacaagcac

SEQ ID NO: 4022481 - RNA, 22 nt, Marburg virus
ccaucugauuuaacuuaauaaa

SEQ ID NO: 4022482 - RNA, 14 nt, Marburg virus
ccauguacuuggaa

SEQ ID NO: 4022483 - RNA, 17 nt, Marburg virus
cccaacaauggaccacu

SEQ ID NO: 4022484 - RNA, 14 nt, Marburg virus
cccacaacaccacu

SEQ ID NO: 4022485 - RNA, 15 nt, Marburg virus
ccgaggaaaggacau

SEQ ID NO: 4022486 - RNA, 19 nt, Marburg virus
ccuuagaaaaauucacaug

SEQ ID NO: 4022487 - RNA, 19 nt, Marburg virus
cgaaaggccccaccacaac

SEQ ID NO: 4022488 - RNA, 18 nt, Marburg virus
cguaguuaaauuucuaga

SEQ ID NO: 4022489 - RNA, 17 nt, Marburg virus
cuaagugaaggagagaa

SEQ ID NO: 4022490 - RNA, 15 nt, Marburg virus
cuaauauuacuaaca

SEQ ID NO: 4022491 - RNA, 13 nt, Marburg virus
cuacaaaacacca

SEQ ID NO: 4022492 - RNA, 18 nt, Marburg virus
cuacuuaucuacuuugau

SEQ ID NO: 4022493 - RNA, 22 nt, Marburg virus
cuaggaggguuaucauuuuuga

SEQ ID NO: 4022494 - RNA, 15 nt, Marburg virus
cucaacaccacagac

SEQ ID NO: 4022495 - RNA, 18 nt, Marburg virus
cucaccacugcccacagc

SEQ ID NO: 4022496 - RNA, 22 nt, Marburg virus
uugugugucagcuguauacaaa

SEQ ID NO: 4022497 - RNA, 13 nt, Marburg virus
uuuaacuuccauu

SEQ ID NO: 4022498 - RNA, 13 nt, Marburg virus
uuuacugaagacu

SEQ ID NO: 4022499 - RNA, 13 nt, Marburg virus
uuuauaggaacag

SEQ ID NO: 4022500 - RNA, 19 nt, Marburg virus
uuuauaucuagaacaaauu

SEQ ID NO: 4022501 - RNA, 19 nt, Marburg virus
uuucacauagguucugauu

SEQ ID NO: 4022502 - RNA, 13 nt, Marburg virus
uuugaaggaucaa

SEQ ID NO: 4022503 - RNA, 17 nt, Marburg virus
uuuguauagauucaauu

SEQ ID NO: 4022504 - RNA, 20 nt, Marburg virus
uuuuauauauuauagaggaa

SEQ ID NO: 4022505 - RNA, 14 nt, Marburg virus
uuuucauucaaucu

SEQ ID NO: 4022506 - RNA, 21 nt, Marburg virus
aaaaagaguugaauauaggaa

SEQ ID NO: 4022507 - RNA, 10 nt, Marburg virus
aaaacaugcu

SEQ ID NO: 4022508 - RNA, 18 nt, Marburg virus
aaaacuaaauuaaaauua

SEQ ID NO: 4022509 - RNA, 12 nt, Marburg virus
aaaagaaauagu

SEQ ID NO: 4022510 - RNA, 16 nt, Marburg virus
aaaauagccuugucau

SEQ ID NO: 4022511 - RNA, 15 nt, Marburg virus
aaaaucccaacaaug

SEQ ID NO: 4022512 - RNA, 21 nt, Marburg virus
aaaauucacauguacuguuga

SEQ ID NO: 4022513 - RNA, 15 nt, Marburg virus
aaaccauaaggaaaa

SEQ ID NO: 4022514 - RNA, 23 nt, Marburg virus
aaacuauaauucaggggaaauug

SEQ ID NO: 4022515 - RNA, 16 nt, Marburg virus
aaagaacccaguguug

SEQ ID NO: 4022516 - RNA, 19 nt, Marburg virus
aaagcauucccuagcaaca

SEQ ID NO: 4022517 - RNA, 14 nt, Marburg virus
aaagguuuucuuua

SEQ ID NO: 4022518 - RNA, 15 nt, Marburg virus
aaauauaaaagaacg

SEQ ID NO: 4022519 - RNA, 16 nt, Marburg virus
aaaucuuaccacagca

SEQ ID NO: 4022520 - RNA, 20 nt, Marburg virus
aaaugggaaggacacuggaa

SEQ ID NO: 4022521 - RNA, 13 nt, Marburg virus
aaauguccaaaca

SEQ ID NO: 4022522 - RNA, 20 nt, Marburg virus
aaauuaauugggaacaccau

SEQ ID NO: 4022523 - RNA, 19 nt, Marburg virus
aaauuagcauggauauuca

SEQ ID NO: 4022524 - RNA, 14 nt, Marburg virus
aacaacacagacca

SEQ ID NO: 4022525 - RNA, 16 nt, Marburg virus
aacaagaaauuauccu

SEQ ID NO: 4022526 - RNA, 19 nt, Marburg virus
aacaauggcaagaugugga

SEQ ID NO: 4022527 - RNA, 17 nt, Marburg virus
aacaccuccaagaacaa

SEQ ID NO: 4022528 - RNA, 13 nt, Marburg virus
aacagaagauaac

SEQ ID NO: 4022529 - RNA, 17 nt, Marburg virus
aacagaucauuaucacu

SEQ ID NO: 4022530 - RNA, 12 nt, Marburg virus
aacaugaaaauu

SEQ ID NO: 4022531 - RNA, 15 nt, Marburg virus
aacauggcagaauua

SEQ ID NO: 4022532 - RNA, 14 nt, Marburg virus
aacauuucuucaga

SEQ ID NO: 4022533 - RNA, 23 nt, Marburg virus
aaccgaggaaaggacauuuuccu

SEQ ID NO: 4022534 - RNA, 17 nt, Marburg virus
aacggcaccaaauauga

SEQ ID NO: 4022535 - RNA, 22 nt, Marburg virus
aacuaaugaagaacauuaauug

SEQ ID NO: 4022536 - RNA, 22 nt, Marburg virus
aacuguuggcuuagaugauaac

SEQ ID NO: 4022537 - RNA, 15 nt, Marburg virus
aacuugaugaugcag

SEQ ID NO: 4022538 - RNA, 16 nt, Marburg virus
aacuuuauuaaaacua

SEQ ID NO: 4022539 - RNA, 16 nt, Marburg virus
aagauaaacaggagca

SEQ ID NO: 4022540 - RNA, 17 nt, Marburg virus
aagcgaugggcuuucag

SEQ ID NO: 4022541 - RNA, 19 nt, Marburg virus
aagggauaaaaacucuccc

SEQ ID NO: 4022542 - RNA, 23 nt, Marburg virus
aaguaacuggaaguuuauaggaa

SEQ ID NO: 4022543 - RNA, 14 nt, Marburg virus
aaguaaugaaaaua

SEQ ID NO: 4022544 - RNA, 12 nt, Marburg virus
aaguaauguuuu

SEQ ID NO: 4022545 - RNA, 22 nt, Marburg virus
aaguuaacuggacaacagauca

SEQ ID NO: 4022546 - RNA, 19 nt, Marburg virus
aaguugacaaucaaaucac

SEQ ID NO: 4022547 - RNA, 21 nt, Marburg virus
aauaaaugcuccaauugauuu

SEQ ID NO: 4022548 - RNA, 19 nt, Marburg virus
aauaacguuccuuagacaa

SEQ ID NO: 4022549 - RNA, 12 nt, Marburg virus
aauaagauguuc

SEQ ID NO: 4022550 - RNA, 18 nt, Marburg virus
aauacaacuccacgaaga

SEQ ID NO: 4022551 - RNA, 19 nt, Marburg virus
aauacagacaagacuuuua

SEQ ID NO: 4022552 - RNA, 24 nt, Marburg virus
aauacugggauggcauuguugcau

SEQ ID NO: 4022553 - RNA, 19 nt, Marburg virus
aauaguugucauauaacag

SEQ ID NO: 4022554 - RNA, 21 nt, Marburg virus
aauauaccuacccugauuuau

SEQ ID NO: 4022555 - RNA, 15 nt, Marburg virus
aauaugaugcaauua

SEQ ID NO: 4022556 - RNA, 15 nt, Marburg virus
aaucaaacugccaaa

SEQ ID NO: 4022557 - RNA, 23 nt, Marburg virus
aaucaaauuuauuugaauauuca

SEQ ID NO: 4022558 - RNA, 22 nt, Marburg virus
aaucaacuaacaacauagaaaa

SEQ ID NO: 4022559 - RNA, 14 nt, Marburg virus
aaucaccaauucau

SEQ ID NO: 4022560 - RNA, 17 nt, Marburg virus
aaucacgcgcacaaauu

SEQ ID NO: 4022561 - RNA, 17 nt, Marburg virus
aaucaucaaccagugug

SEQ ID NO: 4022562 - RNA, 16 nt, Marburg virus
aauccggagaaauugu

SEQ ID NO: 4022563 - RNA, 21 nt, Marburg virus
aaucuuuuggaugcaaaccau

SEQ ID NO: 4022564 - RNA, 18 nt, Marburg virus
aaugaaacaacagaugca

SEQ ID NO: 4022565 - RNA, 18 nt, Marburg virus
aauuaacuuuuguugcaa

SEQ ID NO: 4022566 - RNA, 22 nt, Marburg virus
aauuaacuuuuguugcaauuca

SEQ ID NO: 4022567 - RNA, 14 nt, Marburg virus
aauuaaucauguug

SEQ ID NO: 4022568 - RNA, 16 nt, Marburg virus
aauuagggaaauacug

SEQ ID NO: 4022569 - RNA, 14 nt, Marburg virus
acaaguaacaaugg

SEQ ID NO: 4022570 - RNA, 22 nt, Marburg virus
acaauggauuugcauuuaacuc

SEQ ID NO: 4022571 - RNA, 22 nt, Marburg virus
acacagagcacagccacugaaa

SEQ ID NO: 4022572 - RNA, 23 nt, Marburg virus
acacuagaucacggaucaagcau

SEQ ID NO: 4022573 - RNA, 15 nt, Marburg virus
acacuggaagcaauu

SEQ ID NO: 4022574 - RNA, 16 nt, Marburg virus
acacuggaagcaauuu

SEQ ID NO: 4022575 - RNA, 18 nt, Marburg virus
acagaaggggaggaagcc

SEQ ID NO: 4022576 - RNA, 23 nt, Marburg virus
acagaggauugagucauauuaug

SEQ ID NO: 4022577 - RNA, 15 nt, Marburg virus
acagcaagaaggaaa

SEQ ID NO: 4022578 - RNA, 17 nt, Marburg virus
acagcuugcuuuacaca

SEQ ID NO: 4022579 - RNA, 15 nt, Marburg virus
acauguuuaagauuc

SEQ ID NO: 4022580 - RNA, 14 nt, Marburg virus
accgucacaugaau

SEQ ID NO: 4022581 - RNA, 20 nt, Marburg virus
accucaacgguguucaacug

SEQ ID NO: 4022582 - RNA, 15 nt, Marburg virus
acgacacacagagca

SEQ ID NO: 4022583 - RNA, 14 nt, Marburg virus
acuaacuucaauaa

SEQ ID NO: 4022584 - RNA, 23 nt, Marburg virus
acuacguuacguuuucucugaug

SEQ ID NO: 4022585 - RNA, 15 nt, Marburg virus
acuagaccaucuuaa

SEQ ID NO: 4022586 - RNA, 20 nt, Marburg virus
acuagauuauauaaaagaaa

SEQ ID NO: 4022587 - RNA, 16 nt, Marburg virus
acugaaaaugaacaaa

SEQ ID NO: 4022588 - RNA, 22 nt, Marburg virus
acugaaaaugaacaaaccagug

SEQ ID NO: 4022589 - RNA, 23 nt, Marburg virus
acuuaagucauucuuuuuaaaau

SEQ ID NO: 4022590 - RNA, 14 nt, Marburg virus
agaaucaaacaugu

SEQ ID NO: 4022591 - RNA, 15 nt, Marburg virus
agacaagacuuuuag

SEQ ID NO: 4022592 - RNA, 21 nt, Marburg virus
agacagggcuacugcugugaa

SEQ ID NO: 4022593 - RNA, 22 nt, Marburg virus
agacaugccauugacuuucuac

SEQ ID NO: 4022594 - RNA, 21 nt, Marburg virus
agacauguguaggaacaugaa

SEQ ID NO: 4022595 - RNA, 18 nt, Marburg virus
agauaaccccaguguuaa

SEQ ID NO: 4022596 - RNA, 18 nt, Marburg virus
agaucaaacccacaagca

SEQ ID NO: 4022597 - RNA, 15 nt, Marburg virus
agaugauaacagaua

SEQ ID NO: 4022598 - RNA, 16 nt, Marburg virus
agcaaacgaaagaugu

SEQ ID NO: 4022599 - RNA, 14 nt, Marburg virus
agcacgccacagca

SEQ ID NO: 4022600 - RNA, 22 nt, Marburg virus
agcagauggacuagcaaaagca

SEQ ID NO: 4022601 - RNA, 20 nt, Marburg virus
agccgacaagaugucgaaag

SEQ ID NO: 4022602 - RNA, 18 nt, Marburg virus
agcguaugcgaauccaac

SEQ ID NO: 4022603 - RNA, 15 nt, Marburg virus
aggaucaagaauuac

SEQ ID NO: 4022604 - RNA, 14 nt, Marburg virus
aggaucaagggaaa

SEQ ID NO: 4022605 - RNA, 23 nt, Marburg virus
aggauuauaucauucucuucgau

SEQ ID NO: 4022606 - RNA, 22 nt, Marburg virus
aggauuuuucuccuaaggaaaa

SEQ ID NO: 4022607 - RNA, 14 nt, Marburg virus
aggcauaucuuaau

SEQ ID NO: 4022608 - RNA, 15 nt, Marburg virus
agggaacaauuuaau

SEQ ID NO: 4022609 - RNA, 16 nt, Marburg virus
aggugaguuauacaac

SEQ ID NO: 4022610 - RNA, 23 nt, Marburg virus
agguuuuuuauucucuucuuucu

SEQ ID NO: 4022611 - RNA, 20 nt, Marburg virus
aguaaacucaacugaugaug

SEQ ID NO: 4022612 - RNA, 18 nt, Marburg virus
agucucaauuggaaauuu

SEQ ID NO: 4022613 - RNA, 19 nt, Marburg virus
agugaauccuuucuucaau

SEQ ID NO: 4022614 - RNA, 13 nt, Marburg virus
aguuaauuauccu

SEQ ID NO: 4022615 - RNA, 16 nt, Marburg virus
aguuacucaaauauua

SEQ ID NO: 4022616 - RNA, 14 nt, Marburg virus
auaaagcugagugu

SEQ ID NO: 4022617 - RNA, 12 nt, Marburg virus
auaagagucaaa

SEQ ID NO: 4022618 - RNA, 17 nt, Marburg virus
auaaguggcuuaaauua

SEQ ID NO: 4022619 - RNA, 13 nt, Marburg virus
auaaucugauugu

SEQ ID NO: 4022620 - RNA, 17 nt, Marburg virus
auacaaagacgaucuuu

SEQ ID NO: 4022621 - RNA, 18 nt, Marburg virus
auacacccgaauuugcca

SEQ ID NO: 4022622 - RNA, 13 nt, Marburg virus
auaccaaauacug

SEQ ID NO: 4022623 - RNA, 21 nt, Marburg virus
auacuguuuuaauuaagaaaa

SEQ ID NO: 4022624 - RNA, 19 nt, Marburg virus
auaguagcaaagaaucauu

SEQ ID NO: 4022625 - RNA, 17 nt, Marburg virus
aucaacaaugccaccca

SEQ ID NO: 4022626 - RNA, 18 nt, Marburg virus
aucaagggaaauaauaac

SEQ ID NO: 4022627 - RNA, 22 nt, Marburg virus
aucacccuuguagaguuaaaaa

SEQ ID NO: 4022628 - RNA, 19 nt, Marburg virus
aucagauauugggaaauug

SEQ ID NO: 4022629 - RNA, 15 nt, Marburg virus
aucagcuaucaaauc

SEQ ID NO: 4022630 - RNA, 17 nt, Marburg virus
aucuacauuaauuccuu

SEQ ID NO: 4022631 - RNA, 20 nt, Marburg virus
aucuauuguucauaugcuuu

SEQ ID NO: 4022632 - RNA, 20 nt, Marburg virus
aucuauuugaccucagacau

SEQ ID NO: 4022633 - RNA, 20 nt, Marburg virus
aucugagcaaggugagacac

SEQ ID NO: 4022634 - RNA, 15 nt, Marburg virus
aucuugaccuuaauu

SEQ ID NO: 4022635 - RNA, 23 nt, Marburg virus
aucuuuacaccaggaaaauacug

SEQ ID NO: 4022636 - RNA, 20 nt, Marburg virus
aucuuuccgaguugauacaa

SEQ ID NO: 4022637 - RNA, 21 nt, Marburg virus
augaacaauaucccuugugaa

SEQ ID NO: 4022638 - RNA, 15 nt, Marburg virus
augaauguugaucaa

SEQ ID NO: 4022639 - RNA, 11 nt, Marburg virus
augacuggaaa

SEQ ID NO: 4022640 - RNA, 13 nt, Marburg virus
augacuugauuca

SEQ ID NO: 4022641 - RNA, 14 nt, Marburg virus
augaucaguucaaa

SEQ ID NO: 4022642 - RNA, 21 nt, Marburg virus
augccaccacacucaacacca

SEQ ID NO: 4022643 - RNA, 18 nt, Marburg virus
augcuccggaacucucca

SEQ ID NO: 4022644 - RNA, 18 nt, Marburg virus
auggacuagcaaaagcau

SEQ ID NO: 4022645 - RNA, 15 nt, Marburg virus
auguaaugaacaaua

SEQ ID NO: 4022646 - RNA, 18 nt, Marburg virus
augucgaaaguucuugaa

SEQ ID NO: 4022647 - RNA, 13 nt, Marburg virus
auguuauaugcau

SEQ ID NO: 4022648 - RNA, 22 nt, Marburg virus
auguucacucuucauguuguaa

SEQ ID NO: 4022649 - RNA, 20 nt, Marburg virus
auuaacgacuugucuuaauu

SEQ ID NO: 4022650 - RNA, 16 nt, Marburg virus
auuaaguucuuuaaau

SEQ ID NO: 4022651 - RNA, 12 nt, Marburg virus
auuauaugauuu

SEQ ID NO: 4022652 - RNA, 13 nt, Marburg virus
auucaaagcacuc

SEQ ID NO: 4022653 - RNA, 21 nt, Marburg virus
auucaauuguuaucauaguca

SEQ ID NO: 4022654 - RNA, 14 nt, Marburg virus
auugauuaagaaaa

SEQ ID NO: 4022655 - RNA, 23 nt, Marburg virus
auugauuaagaaaaaccaaugau

SEQ ID NO: 4022656 - RNA, 19 nt, Marburg virus
auugccauguacuuggaag

SEQ ID NO: 4022657 - RNA, 21 nt, Marburg virus
auuuaucugaguccuuagaaa

SEQ ID NO: 4022658 - RNA, 22 nt, Marburg virus
auuuauucgauuggaugcacuu

SEQ ID NO: 4022659 - RNA, 20 nt, Marburg virus
auuucguggagcaugaaccu

SEQ ID NO: 4022660 - RNA, 21 nt, Marburg virus
auuuuaacuuccauucaauau

SEQ ID NO: 4022661 - RNA, 22 nt, Marburg virus
caaaagcauucccuagcaacau

SEQ ID NO: 4022662 - RNA, 20 nt, Marburg virus
caaacaguucgugaaaauau

SEQ ID NO: 4022663 - RNA, 20 nt, Marburg virus
caaagugcuuggaccugauu

SEQ ID NO: 4022664 - RNA, 15 nt, Marburg virus
caaauuuauuugaau

SEQ ID NO: 4022665 - RNA, 13 nt, Marburg virus
caacaccacagac

SEQ ID NO: 4022666 - RNA, 18 nt, Marburg virus
caacaccuccaagaacaa

SEQ ID NO: 4022667 - RNA, 20 nt, Marburg virus
caacacgaaaggccccacca

SEQ ID NO: 4022668 - RNA, 18 nt, Marburg virus
caacccgaccacacaaca

SEQ ID NO: 4022669 - RNA, 19 nt, Marburg virus
caagaagaagaaaaaacua

SEQ ID NO: 4022670 - RNA, 12 nt, Marburg virus
caagaaggaaac

SEQ ID NO: 4022671 - RNA, 19 nt, Marburg virus
caagauguaaucucuuuug

SEQ ID NO: 4022672 - RNA, 16 nt, Marburg virus
caauauccugaugcaa

SEQ ID NO: 4022673 - RNA, 15 nt, Marburg virus
caauaugaugcaauu

SEQ ID NO: 4022674 - RNA, 16 nt, Marburg virus
caauggaacacaaacg

SEQ ID NO: 4022675 - RNA, 23 nt, Marburg virus
cacaagguggggaggaacaugca

SEQ ID NO: 4022676 - RNA, 14 nt, Marburg virus
cacagcaagaagga

SEQ ID NO: 4022677 - RNA, 23 nt, Marburg virus
cacagcaagaaggaaacaacaca

SEQ ID NO: 4022678 - RNA, 16 nt, Marburg virus
caccaaucaucaucca

SEQ ID NO: 4022679 - RNA, 13 nt, Marburg virus
caccacaauucag

SEQ ID NO: 4022680 - RNA, 17 nt, Marburg virus
caccucguaauuucaac

SEQ ID NO: 4022681 - RNA, 13 nt, Marburg virus
cagaaagaagcau

SEQ ID NO: 4022682 - RNA, 19 nt, Marburg virus
cagagaaguuacacaagag

SEQ ID NO: 4022683 - RNA, 23 nt, Marburg virus
cagagaucaaacccacaagcacc

SEQ ID NO: 4022684 - RNA, 22 nt, Marburg virus
cagauggacuagcaaaagcauu

SEQ ID NO: 4022685 - RNA, 18 nt, Marburg virus
cagcaggguauaacucca

SEQ ID NO: 4022686 - RNA, 12 nt, Marburg virus
cagcauugacuc

SEQ ID NO: 4022687 - RNA, 17 nt, Marburg virus
caggaguguugggacag

SEQ ID NO: 4022688 - RNA, 23 nt, Marburg virus
cagucccucgcccaugucaaaaa

SEQ ID NO: 4022689 - RNA, 22 nt, Marburg virus
cagugauaagagucaaaaacuu

SEQ ID NO: 4022690 - RNA, 18 nt, Marburg virus
caguucuaagagaacaca

SEQ ID NO: 4022691 - RNA, 15 nt, Marburg virus
cauagaaaacauauu

SEQ ID NO: 4022692 - RNA, 21 nt, Marburg virus
cauaguuuaaccacauaauaa

SEQ ID NO: 4022693 - RNA, 15 nt, Marburg virus
cauauucaaggucaa

SEQ ID NO: 4022694 - RNA, 21 nt, Marburg virus
cauauugugucaaauucauuu

SEQ ID NO: 4022695 - RNA, 19 nt, Marburg virus
caucucuuuuacauacauu

SEQ ID NO: 4022696 - RNA, 15 nt, Marburg virus
caugcgcaaucugua

SEQ ID NO: 4022697 - RNA, 18 nt, Marburg virus
cauugagagguauaacac

SEQ ID NO: 4022698 - RNA, 16 nt, Marburg virus
cauugccuccacaaca

SEQ ID NO: 4022699 - RNA, 14 nt, Marburg virus
ccaacccaacaauu

SEQ ID NO: 4022700 - RNA, 17 nt, Marburg virus
ccaagcacgccacagca

SEQ ID NO: 4022701 - RNA, 17 nt, Marburg virus
ccaagccaaaucuuuca

SEQ ID NO: 4022702 - RNA, 18 nt, Marburg virus
ccaauauauaaaauuaaa

SEQ ID NO: 4022703 - RNA, 21 nt, Marburg virus
ccaaugauggauauuaaauau

SEQ ID NO: 4022704 - RNA, 21 nt, Marburg virus
ccaauuacgacacacagagca

SEQ ID NO: 4022705 - RNA, 14 nt, Marburg virus
ccacaaccaagcac

SEQ ID NO: 4022706 - RNA, 16 nt, Marburg virus
ccacacucaacaccac

SEQ ID NO: 4022707 - RNA, 17 nt, Marburg virus
ccacagcaagaaggaaa

SEQ ID NO: 4022708 - RNA, 19 nt, Marburg virus
ccacugaaaaugaacaaac

SEQ ID NO: 4022709 - RNA, 13 nt, Marburg virus
ccagagaagacaa

SEQ ID NO: 4022710 - RNA, 22 nt, Marburg virus
ccagagaucaaacccacaagca

SEQ ID NO: 4022711 - RNA, 15 nt, Marburg virus
ccaguuauccaucuu

SEQ ID NO: 4022712 - RNA, 14 nt, Marburg virus
ccauccaaggacaa

SEQ ID NO: 4022713 - RNA, 16 nt, Marburg virus
cccccucgaaaacaac

SEQ ID NO: 4022714 - RNA, 12 nt, Marburg virus
cccuccaaaccu

SEQ ID NO: 4022715 - RNA, 13 nt, Marburg virus
ccggaacucucca

SEQ ID NO: 4022716 - RNA, 18 nt, Marburg virus
ccuccaaaagacaugugu

SEQ ID NO: 4022717 - RNA, 22 nt, Marburg virus
ccucguaauuucaacuggaaga

SEQ ID NO: 4022718 - RNA, 16 nt, Marburg virus
cgacacacagagcaca

SEQ ID NO: 4022719 - RNA, 16 nt, Marburg virus
cgcaaccaccaaaccg

SEQ ID NO: 4022720 - RNA, 22 nt, Marburg virus
cuaaagucauguuugaaacuuu

SEQ ID NO: 4022721 - RNA, 19 nt, Marburg virus
cuaauauuacuaacaaaag

SEQ ID NO: 4022722 - RNA, 21 nt, Marburg virus
cuaaucuacugaaaucaacuu

SEQ ID NO: 4022723 - RNA, 14 nt, Marburg virus
cuacaaaacaccac

SEQ ID NO: 4022724 - RNA, 15 nt, Marburg virus
cuagagcaauuuaag

SEQ ID NO: 4022725 - RNA, 13 nt, Marburg virus
cuauuugaugcau

SEQ ID NO: 4022726 - RNA, 23 nt, Marburg virus
cucaaauauuauugcucauaauu

SEQ ID NO: 4022727 - RNA, 18 nt, Marburg virus
cucaauuggaaauuuaaa

SEQ ID NO: 4022728 - RNA, 10 nt, Marburg virus
cucacaggca

SEQ ID NO: 4022729 - RNA, 20 nt, Marburg virus
cucuaaugauuguaauaauu

SEQ ID NO: 4022730 - RNA, 22 nt, Marburg virus
cucuacucugaacuaaggaaau

SEQ ID NO: 4022731 - RNA, 23 nt, Marburg virus
cucugaugacaagugacaaaauu

SEQ ID NO: 4022732 - RNA, 12 nt, Marburg virus
cugauaauuuaa

SEQ ID NO: 4022733 - RNA, 12 nt, Marburg virus
cugaugccacca

SEQ ID NO: 4022734 - RNA, 16 nt, Marburg virus
cugaugccaccacacu

SEQ ID NO: 4022735 - RNA, 21 nt, Marburg virus
cugcaaucucuacuaacaaca

SEQ ID NO: 4022736 - RNA, 14 nt, Marburg virus
cugcauaagaagca

SEQ ID NO: 4022737 - RNA, 17 nt, Marburg virus
cuguuacucgugcauuu

SEQ ID NO: 4022738 - RNA, 21 nt, Marburg virus
cuuaaauuauacccacaagag

SEQ ID NO: 4022739 - RNA, 15 nt, Marburg virus
cuuauauugaugcau

SEQ ID NO: 4022740 - RNA, 13 nt, Marburg virus
cuucagaacuguu

SEQ ID NO: 4022741 - RNA, 18 nt, Marburg virus
cuucucacuuuuuaagaa

SEQ ID NO: 4022742 - RNA, 20 nt, Marburg virus
cuugggagauuuuuaagaag

SEQ ID NO: 4022743 - RNA, 16 nt, Marburg virus
cuuguaguaaggggac

SEQ ID NO: 4022744 - RNA, 17 nt, Marburg virus
cuuguuguggugagaca

SEQ ID NO: 4022745 - RNA, 15 nt, Marburg virus
cuuucaucaacaaug

SEQ ID NO: 4022746 - RNA, 18 nt, Marburg virus
gaaaaacuaaugaagaac

SEQ ID NO: 4022747 - RNA, 20 nt, Marburg virus
gaaaaacuaaugaagaacau

SEQ ID NO: 4022748 - RNA, 17 nt, Marburg virus
gaaaaacuaugaagaac

SEQ ID NO: 4022749 - RNA, 17 nt, Marburg virus
gaaaaaggauguucuua

SEQ ID NO: 4022750 - RNA, 18 nt, Marburg virus
gaaaagguuuuuuauucu

SEQ ID NO: 4022751 - RNA, 12 nt, Marburg virus
gaaaauaaucua

SEQ ID NO: 4022752 - RNA, 15 nt, Marburg virus
gaaaaucuaauucuc

SEQ ID NO: 4022753 - RNA, 19 nt, Marburg virus
gaagguaugaugaagaaaa

SEQ ID NO: 4022754 - RNA, 20 nt, Marburg virus
gaauacauucuuauauugcu

SEQ ID NO: 4022755 - RNA, 22 nt, Marburg virus
gaauacauucuuauauugcuug

SEQ ID NO: 4022756 - RNA, 19 nt, Marburg virus
gaauauuucggaacaaauu

SEQ ID NO: 4022757 - RNA, 13 nt, Marburg virus
gaauuugccaccc

SEQ ID NO: 4022758 - RNA, 21 nt, Marburg virus
gacaagaugucgaaaguucuu

SEQ ID NO: 4022759 - RNA, 21 nt, Marburg virus
gacaaugauuauuguuugaaa

SEQ ID NO: 4022760 - RNA, 18 nt, Marburg virus
gacccaaacaaugaugau

SEQ ID NO: 4022761 - RNA, 19 nt, Marburg virus
gacuucuacuaauaaauau

SEQ ID NO: 4022762 - RNA, 21 nt, Marburg virus
gaggauaaaaggacaaagagg

SEQ ID NO: 4022763 - RNA, 17 nt, Marburg virus
gauuaguuuguauugau

SEQ ID NO: 4022764 - RNA, 16 nt, Marburg virus
gauuccacaucauauu

SEQ ID NO: 4022765 - RNA, 17 nt, Marburg virus
gauuucagucaaagaga

SEQ ID NO: 4022766 - RNA, 20 nt, Marburg virus
gcaaagagcacuaacaacac

SEQ ID NO: 4022767 - RNA, 23 nt, Marburg virus
gcaagggcuuucaucaacaaugc

SEQ ID NO: 4022768 - RNA, 22 nt, Marburg virus
gcaauaccucaacgguguucaa

SEQ ID NO: 4022769 - RNA, 14 nt, Marburg virus
gcauuggaauagaa

SEQ ID NO: 4022770 - RNA, 16 nt, Marburg virus
gccaguuccagcaauu

SEQ ID NO: 4022771 - RNA, 13 nt, Marburg virus
gccuacucuggag

SEQ ID NO: 4022772 - RNA, 23 nt, Marburg virus
gccuacucuggagaaaaugagaa

SEQ ID NO: 4022773 - RNA, 17 nt, Marburg virus
gccucauacgaucauuu

SEQ ID NO: 4022774 - RNA, 14 nt, Marburg virus
gcgcacaaauuaac

SEQ ID NO: 4022775 - RNA, 23 nt, Marburg virus
gcuacugagcccuucuucuaauc

SEQ ID NO: 4022776 - RNA, 17 nt, Marburg virus
gcucgacgucuuaaaag

SEQ ID NO: 4022777 - RNA, 14 nt, Marburg virus
gcugugaaccagga

SEQ ID NO: 4022778 - RNA, 15 nt, Marburg virus
gcuuacuuaaaugag

SEQ ID NO: 4022779 - RNA, 20 nt, Marburg virus
ggaacaugaaaauuggauug

SEQ ID NO: 4022780 - RNA, 15 nt, Marburg virus
ggacaaugauuauug

SEQ ID NO: 4022781 - RNA, 14 nt, Marburg virus
ggaccugauuguug

SEQ ID NO: 4022782 - RNA, 14 nt, Marburg virus
ggaucccucuggaa

SEQ ID NO: 4022783 - RNA, 17 nt, Marburg virus
ggaugcuucggugcucu

SEQ ID NO: 4022784 - RNA, 20 nt, Marburg virus
ggaugcuucggugcucuuca

SEQ ID NO: 4022785 - RNA, 14 nt, Marburg virus
ggcagcagggcuca

SEQ ID NO: 4022786 - RNA, 22 nt, Marburg virus
ggccaagcagacuuuuccuuga

SEQ ID NO: 4022787 - RNA, 24 nt, Marburg virus
ggugacuuaaaccuagaugaucag

SEQ ID NO: 4022788 - RNA, 21 nt, Marburg virus
guaagaaaaacuaaugaagaa

SEQ ID NO: 4022789 - RNA, 15 nt, Marburg virus
guaagagugauuaag

SEQ ID NO: 4022790 - RNA, 14 nt, Marburg virus
guaccucuaaggaa

SEQ ID NO: 4022791 - RNA, 22 nt, Marburg virus
guaguguucuuuuacuggaagg

SEQ ID NO: 4022792 - RNA, 17 nt, Marburg virus
guauagucauuauucac

SEQ ID NO: 4022793 - RNA, 20 nt, Marburg virus
guaugcaaauugggacaacg

SEQ ID NO: 4022794 - RNA, 17 nt, Marburg virus
gucaugggcccuucaua

SEQ ID NO: 4022795 - RNA, 19 nt, Marburg virus
gucguaucuuuaccaaaua

SEQ ID NO: 4022796 - RNA, 20 nt, Marburg virus
gucuauuucaacuuaagaau

SEQ ID NO: 4022797 - RNA, 18 nt, Marburg virus
gucucaaaccguacacaa

SEQ ID NO: 4022798 - RNA, 23 nt, Marburg virus
gugagacaacauaagcuaucaaa

SEQ ID NO: 4022799 - RNA, 20 nt, Marburg virus
gugagacaguccucucagaa

SEQ ID NO: 4022800 - RNA, 23 nt, Marburg virus
gugugaaaaauuucuuuaauaag

SEQ ID NO: 4022801 - RNA, 13 nt, Marburg virus
guuaccuacuuau

SEQ ID NO: 4022802 - RNA, 17 nt, Marburg virus
guuagauuucagucaaa

SEQ ID NO: 4022803 - RNA, 22 nt, Marburg virus
guuaucguugagauuaaaaaga

SEQ ID NO: 4022804 - RNA, 16 nt, Marburg virus
guucacucuucauguu

SEQ ID NO: 4022805 - RNA, 15 nt, Marburg virus
guugagauuaaaaag

SEQ ID NO: 4022806 - RNA, 18 nt, Marburg virus
guuuauaggaacagauuu

SEQ ID NO: 4022807 - RNA, 17 nt, Marburg virus
guuuauaucuagaacaa

SEQ ID NO: 4022808 - RNA, 17 nt, Marburg virus
uaaaaaucgaagaauau

SEQ ID NO: 4022809 - RNA, 19 nt, Marburg virus
uaaaagaacgaucugcugu

SEQ ID NO: 4022810 - RNA, 23 nt, Marburg virus
uaaaagaagguaugaugaagaaa

SEQ ID NO: 4022811 - RNA, 15 nt, Marburg virus
uaaaaucugauccgu

SEQ ID NO: 4022812 - RNA, 13 nt, Marburg virus
uaaauuaagaaaa

SEQ ID NO: 4022813 - RNA, 20 nt, Marburg virus
uaaauuugaccaaaguaaug

SEQ ID NO: 4022814 - RNA, 18 nt, Marburg virus
uaagagaacacagucaaa

SEQ ID NO: 4022815 - RNA, 12 nt, Marburg virus
uaagcuaucaaa

SEQ ID NO: 4022816 - RNA, 21 nt, Marburg virus
uaaggaaaauccuuauuauug

SEQ ID NO: 4022817 - RNA, 12 nt, Marburg virus
uaauaaaugcuc

SEQ ID NO: 4022818 - RNA, 14 nt, Marburg virus
uaauauuacuaaca

SEQ ID NO: 4022819 - RNA, 13 nt, Marburg virus
uaaucauguugau

SEQ ID NO: 4022820 - RNA, 20 nt, Marburg virus
uacacaaguagggaaaucac

SEQ ID NO: 4022821 - RNA, 20 nt, Marburg virus
uacagcaaucauuaauuccu

SEQ ID NO: 4022822 - RNA, 19 nt, Marburg virus
uacuauugugugagacaac

SEQ ID NO: 4022823 - RNA, 23 nt, Marburg virus
uacucuaaugauuguaauaauua

SEQ ID NO: 4022824 - RNA, 10 nt, Marburg virus
uacuggaagg

SEQ ID NO: 4022825 - RNA, 15 nt, Marburg virus
uacugugacugaacc

SEQ ID NO: 4022826 - RNA, 16 nt, Marburg virus
uagacagaacacaaag

SEQ ID NO: 4022827 - RNA, 20 nt, Marburg virus
uagagaucaugaccuugaua

SEQ ID NO: 4022828 - RNA, 16 nt, Marburg virus
uagagucgaagaacau

SEQ ID NO: 4022829 - RNA, 20 nt, Marburg virus
uagcuucauuucauucaaug

SEQ ID NO: 4022830 - RNA, 13 nt, Marburg virus
uaggaacaugaaa

SEQ ID NO: 4022831 - RNA, 20 nt, Marburg virus
uaguagcguuaccuuucaau

SEQ ID NO: 4022832 - RNA, 12 nt, Marburg virus
uaguauacugua

SEQ ID NO: 4022833 - RNA, 13 nt, Marburg virus
uagucauuauuca

SEQ ID NO: 4022834 - RNA, 17 nt, Marburg virus
uaguuacucaaauauua

SEQ ID NO: 4022835 - RNA, 13 nt, Marburg virus
uauaaaaaucuug

SEQ ID NO: 4022836 - RNA, 15 nt, Marburg virus
uauagauucaauuau

SEQ ID NO: 4022837 - RNA, 19 nt, Marburg virus
uauaggaacagauuuagag

SEQ ID NO: 4022838 - RNA, 20 nt, Marburg virus
uauaucuugauugcuaaaaa

SEQ ID NO: 4022839 - RNA, 16 nt, Marburg virus
uaucauucucaaggau

SEQ ID NO: 4022840 - RNA, 14 nt, Marburg virus
uauccuaaaugcaa

SEQ ID NO: 4022841 - RNA, 16 nt, Marburg virus
uaucggacauucaaag

SEQ ID NO: 4022842 - RNA, 22 nt, Marburg virus
uauuauagaggaacuaauauua

SEQ ID NO: 4022843 - RNA, 14 nt, Marburg virus
uauucuauaucuug

SEQ ID NO: 4022844 - RNA, 14 nt, Marburg virus
uauucucucuacaa

SEQ ID NO: 4022845 - RNA, 14 nt, Marburg virus
uauugaaauaaagu

SEQ ID NO: 4022846 - RNA, 19 nt, Marburg virus
uauuuacuaaaucuuacau

SEQ ID NO: 4022847 - RNA, 12 nt, Marburg virus
uauuucaacuua

SEQ ID NO: 4022848 - RNA, 21 nt, Marburg virus
uauuuucaagcaccugagaac

SEQ ID NO: 4022849 - RNA, 16 nt, Marburg virus
ucaaacccacaagcac

SEQ ID NO: 4022850 - RNA, 20 nt, Marburg virus
ucaaacccacaagcacccca

SEQ ID NO: 4022851 - RNA, 20 nt, Marburg virus
ucaaagagagugccagagca

SEQ ID NO: 4022852 - RNA, 19 nt, Marburg virus
ucaaaggcgacaagcacug

SEQ ID NO: 4022853 - RNA, 14 nt, Marburg virus
ucaacaacagacaa

SEQ ID NO: 4022854 - RNA, 21 nt, Marburg virus
ucaauaugaugcaauuaauca

SEQ ID NO: 4022855 - RNA, 17 nt, Marburg virus
ucacaaaauagaauaau

SEQ ID NO: 4022856 - RNA, 22 nt, Marburg virus
ucacaccagugguaacuuuuca

SEQ ID NO: 4022857 - RNA, 23 nt, Marburg virus
ucacaggcagcuauacaaucacc

SEQ ID NO: 4022858 - RNA, 14 nt, Marburg virus
ucacuaagcaaggg

SEQ ID NO: 4022859 - RNA, 13 nt, Marburg virus
ucagaucacagua

SEQ ID NO: 4022860 - RNA, 22 nt, Marburg virus
ucaguucaaagggaaugucugc

SEQ ID NO: 4022861 - RNA, 21 nt, Marburg virus
ucauacgaucauuuuauucuu

SEQ ID NO: 4022862 - RNA, 18 nt, Marburg virus
ucauauuugauucaagau

SEQ ID NO: 4022863 - RNA, 21 nt, Marburg virus
ucauuaauuccuggauuuaga

SEQ ID NO: 4022864 - RNA, 21 nt, Marburg virus
ucauucaaacaccccaaauuu

SEQ ID NO: 4022865 - RNA, 19 nt, Marburg virus
ucauugcuaaguaaacuca

SEQ ID NO: 4022866 - RNA, 14 nt, Marburg virus
uccacgugcaagau

SEQ ID NO: 4022867 - RNA, 15 nt, Marburg virus
uccagaagacagaag

SEQ ID NO: 4022868 - RNA, 18 nt, Marburg virus
uccaucugcauaagaagc

SEQ ID NO: 4022869 - RNA, 21 nt, Marburg virus
uccaugcccccccacaacacc

SEQ ID NO: 4022870 - RNA, 19 nt, Marburg virus
uccauucaauaugaugcaa

SEQ ID NO: 4022871 - RNA, 11 nt, Marburg virus
ucccaacaaug

SEQ ID NO: 4022872 - RNA, 13 nt, Marburg virus
uccccaauacaga

SEQ ID NO: 4022873 - RNA, 16 nt, Marburg virus
uccucaacaauacugu

SEQ ID NO: 4022874 - RNA, 16 nt, Marburg virus
uccuccaaaagacaug

SEQ ID NO: 4022875 - RNA, 16 nt, Marburg virus
ucgcuaguuaugaaug

SEQ ID NO: 4022876 - RNA, 13 nt, Measles virus
uuaguacaaccua

SEQ ID NO: 4022877 - RNA, 20 nt, Measles virus
uucagaucggucaaugcagu

SEQ ID NO: 4022878 - RNA, 18 nt, Measles virus
uucuauucccagcuuugu

SEQ ID NO: 4022879 - RNA, 22 nt, Measles virus
uucuauucccagcuuugucugg

SEQ ID NO: 4022880 - RNA, 11 nt, Measles virus
uugccacagcu

SEQ ID NO: 4022881 - RNA, 20 nt, Measles virus
uuggagucaucggaccagau

SEQ ID NO: 4022882 - RNA, 18 nt, Measles virus
uuggccaccccugacccu

SEQ ID NO: 4022883 - RNA, 17 nt, Measles virus
uugucacaacugagcau

SEQ ID NO: 4022884 - RNA, 17 nt, Measles virus
aaaaugagggcaugcca

SEQ ID NO: 4022885 - RNA, 19 nt, Measles virus
aaaugauuauaaacaaugu

SEQ ID NO: 4022886 - RNA, 20 nt, Measles virus
aaccacugcuuuacugaaau

SEQ ID NO: 4022887 - RNA, 13 nt, Measles virus
aaccccacaaccg

SEQ ID NO: 4022888 - RNA, 14 nt, Measles virus
aacccuccucacac

SEQ ID NO: 4022889 - RNA, 13 nt, Measles virus
aacuuugaaaaua

SEQ ID NO: 4022890 - RNA, 20 nt, Measles virus
aagaagcagaucaacaggca

SEQ ID NO: 4022891 - RNA, 22 nt, Measles virus
aagacaucaguaucccacagcc

SEQ ID NO: 4022892 - RNA, 21 nt, Measles virus
aagauaguagcuauccuggag

SEQ ID NO: 4022893 - RNA, 15 nt, Measles virus
aagaucauuggugau

SEQ ID NO: 4022894 - RNA, 12 nt, Measles virus
aagcacacccac

SEQ ID NO: 4022895 - RNA, 15 nt, Measles virus
aaggacaccucucaa

SEQ ID NO: 4022896 - RNA, 17 nt, Measles virus
aaggacaccucucaagc

SEQ ID NO: 4022897 - RNA, 13 nt, Measles virus
aaggccccucccc

SEQ ID NO: 4022898 - RNA, 20 nt, Measles virus
aagggaaccgggucacggag

SEQ ID NO: 4022899 - RNA, 18 nt, Measles virus
aagggaccaaaagaucaa

SEQ ID NO: 4022900 - RNA, 20 nt, Measles virus
aaggucgcucugauccucua

SEQ ID NO: 4022901 - RNA, 17 nt, Measles virus
aaggugucagcuuccag

SEQ ID NO: 4022902 - RNA, 18 nt, Measles virus
aaguuucuauucccagcu

SEQ ID NO: 4022903 - RNA, 21 nt, Measles virus
aauacgaaguuucuauuccca

SEQ ID NO: 4022904 - RNA, 16 nt, Measles virus
aaucagccuaaaguca

SEQ ID NO: 4022905 - RNA, 22 nt, Measles virus
aaucaguuccuagcugucucaa

SEQ ID NO: 4022906 - RNA, 21 nt, Measles virus
aauccagccggcuagaggagg

SEQ ID NO: 4022907 - RNA, 14 nt, Measles virus
aaucugaaaacagc

SEQ ID NO: 4022908 - RNA, 14 nt, Measles virus
aauucgcagcccuc

SEQ ID NO: 4022909 - RNA, 12 nt, Measles virus
aauucuaccugg

SEQ ID NO: 4022910 - RNA, 22 nt, Measles virus
acaacccaggacaggaccgagc

SEQ ID NO: 4022911 - RNA, 19 nt, Measles virus
acacaaggccaccaccagc

SEQ ID NO: 4022912 - RNA, 20 nt, Measles virus
acacaccuguauucuucacu

SEQ ID NO: 4022913 - RNA, 13 nt, Measles virus
acacaugagcagu

SEQ ID NO: 4022914 - RNA, 20 nt, Measles virus
acaccucagagauucacuga

SEQ ID NO: 4022915 - RNA, 21 nt, Measles virus
acacugugucagaacaucaag

SEQ ID NO: 4022916 - RNA, 17 nt, Measles virus
acaguagaacucagagg

SEQ ID NO: 4022917 - RNA, 22 nt, Measles virus
accaacccccgaccagacccag

SEQ ID NO: 4022918 - RNA, 19 nt, Measles virus
accagaucuuauacccuga

SEQ ID NO: 4022919 - RNA, 14 nt, Measles virus
accaucagggccag

SEQ ID NO: 4022920 - RNA, 22 nt, Measles virus
acccagccaccgacaauccaag

SEQ ID NO: 4022921 - RNA, 18 nt, Measles virus
accccccgaaaaccagag

SEQ ID NO: 4022922 - RNA, 13 nt, Measles virus
acccuggaaggac

SEQ ID NO: 4022923 - RNA, 15 nt, Measles virus
accgcauccagcauc

SEQ ID NO: 4022924 - RNA, 16 nt, Measles virus
accgcauccccacagc

SEQ ID NO: 4022925 - RNA, 13 nt, Measles virus
accggggaucugc

SEQ ID NO: 4022926 - RNA, 14 nt, Measles virus
acgacuucagagau

SEQ ID NO: 4022927 - RNA, 20 nt, Measles virus
acgaggauaaucagaagaua

SEQ ID NO: 4022928 - RNA, 21 nt, Measles virus
acucaacccgaaccagcaccc

SEQ ID NO: 4022929 - RNA, 13 nt, Measles virus
acucacucuggga

SEQ ID NO: 4022930 - RNA, 20 nt, Measles virus
acuccacacucuggcugucu

SEQ ID NO: 4022931 - RNA, 15 nt, Measles virus
acuccacggaccaag

SEQ ID NO: 4022932 - RNA, 17 nt, Measles virus
acuccggaacccuaauc

SEQ ID NO: 4022933 - RNA, 18 nt, Measles virus
acuccggaacccuaaucc

SEQ ID NO: 4022934 - RNA, 16 nt, Measles virus
acucgaucgagcauca

SEQ ID NO: 4022935 - RNA, 16 nt, Measles virus
acucucaauguuccuc

SEQ ID NO: 4022936 - RNA, 12 nt, Measles virus
acucuccaaaca

SEQ ID NO: 4022937 - RNA, 19 nt, Measles virus
acugagaugaggucaguga

SEQ ID NO: 4022938 - RNA, 21 nt, Measles virus
acuggaaaucauuugcuggag

SEQ ID NO: 4022939 - RNA, 13 nt, Measles virus
acuugggaaggau

SEQ ID NO: 4022940 - RNA, 23 nt, Measles virus
agaaaucuccaggcaucaagcac

SEQ ID NO: 4022941 - RNA, 14 nt, Measles virus
agaacaucaagcac

SEQ ID NO: 4022942 - RNA, 12 nt, Measles virus
agaacucaugaa

SEQ ID NO: 4022943 - RNA, 11 nt, Measles virus
agaagaaugcu

SEQ ID NO: 4022944 - RNA, 23 nt, Measles virus
agacaucagaauuaagaaaaacg

SEQ ID NO: 4022945 - RNA, 12 nt, Measles virus
agacccagcacc

SEQ ID NO: 4022946 - RNA, 17 nt, Measles virus
agaccgaauaaaugccu

SEQ ID NO: 4022947 - RNA, 19 nt, Measles virus
agaccgcagugcccagcaa

SEQ ID NO: 4022948 - RNA, 17 nt, Measles virus
agacggggggccccccc

SEQ ID NO: 4022949 - RNA, 20 nt, Measles virus
agagaucucacuugguguau

SEQ ID NO: 4022950 - RNA, 16 nt, Measles virus
agagucauagauccug

SEQ ID NO: 4022951 - RNA, 18 nt, Measles virus
agaguugucacaacugag

SEQ ID NO: 4022952 - RNA, 17 nt, Measles virus
agauccgugagcuccua

SEQ ID NO: 4022953 - RNA, 20 nt, Measles virus
agaugauauuggcuguucag

SEQ ID NO: 4022954 - RNA, 19 nt, Measles virus
agauucaagguuaguccca

SEQ ID NO: 4022955 - RNA, 21 nt, Measles virus
agauuucccacaagucuccuc

SEQ ID NO: 4022956 - RNA, 19 nt, Measles virus
agcaaguguggacaccagg

SEQ ID NO: 4022957 - RNA, 18 nt, Measles virus
agcacccucucaggagga

SEQ ID NO: 4022958 - RNA, 18 nt, Measles virus
agcaccgccuaaaaaacg

SEQ ID NO: 4022959 - RNA, 16 nt, Measles virus
agcaucaggucaagga

SEQ ID NO: 4022960 - RNA, 19 nt, Measles virus
agccaccgacaauccaaga

SEQ ID NO: 4022961 - RNA, 15 nt, Measles virus
agccauggcagcaug

SEQ ID NO: 4022962 - RNA, 19 nt, Measles virus
agccgacaacuccagggaa

SEQ ID NO: 4022963 - RNA, 20 nt, Measles virus
agccgucggguuuguuccug

SEQ ID NO: 4022964 - RNA, 16 nt, Measles virus
agcguuaccugaugac

SEQ ID NO: 4022965 - RNA, 12 nt, Measles virus
agcugcucagau

SEQ ID NO: 4022966 - RNA, 21 nt, Measles virus
agcuguucuccgauguccaag

SEQ ID NO: 4022967 - RNA, 15 nt, Measles virus
aggaacccccagcaa

SEQ ID NO: 4022968 - RNA, 17 nt, Measles virus
aggaccagaacaacauc

SEQ ID NO: 4022969 - RNA, 14 nt, Measles virus
aggcauuauuugca

SEQ ID NO: 4022970 - RNA, 23 nt, Measles virus
aggccacaacccgcgcaccccag

SEQ ID NO: 4022971 - RNA, 13 nt, Measles virus
aggccgagcacug

SEQ ID NO: 4022972 - RNA, 13 nt, Measles virus
aggccuaaagccu

SEQ ID NO: 4022973 - RNA, 19 nt, Measles virus
aggcuccgaauugagggag

SEQ ID NO: 4022974 - RNA, 17 nt, Measles virus
agggacaucaaaauccu

SEQ ID NO: 4022975 - RNA, 20 nt, Measles virus
agggcucaaauugcucagau

SEQ ID NO: 4022976 - RNA, 17 nt, Measles virus
aggggugguagggauag

SEQ ID NO: 4022977 - RNA, 16 nt, Measles virus
aggugauaggaaggau

SEQ ID NO: 4022978 - RNA, 16 nt, Measles virus
agguuaaugacagaga

SEQ ID NO: 4022979 - RNA, 15 nt, Measles virus
aguaagaauccaggc

SEQ ID NO: 4022980 - RNA, 15 nt, Measles virus
aguagcuauccugga

SEQ ID NO: 4022981 - RNA, 16 nt, Measles virus
agucaauuaagaagca

SEQ ID NO: 4022982 - RNA, 16 nt, Measles virus
agucagauacaugugg

SEQ ID NO: 4022983 - RNA, 21 nt, Measles virus
agucccucacgcuuacagccu

SEQ ID NO: 4022984 - RNA, 18 nt, Measles virus
agugaaccgaucacauga

SEQ ID NO: 4022985 - RNA, 14 nt, Measles virus
agugaucugacaau

SEQ ID NO: 4022986 - RNA, 12 nt, Measles virus
aguuaggcauua

SEQ ID NO: 4022987 - RNA, 15 nt, Measles virus
aguuauuaacagaga

SEQ ID NO: 4022988 - RNA, 22 nt, Measles virus
aguucaaccugucuuacagccu

SEQ ID NO: 4022989 - RNA, 19 nt, Measles virus
aguuccagaggacagcugc

SEQ ID NO: 4022990 - RNA, 22 nt, Measles virus
auaacaguagaacucagaggug

SEQ ID NO: 4022991 - RNA, 12 nt, Measles virus
auaacuggaaau

SEQ ID NO: 4022992 - RNA, 21 nt, Measles virus
auacccgaaaacgaccccccu

SEQ ID NO: 4022993 - RNA, 17 nt, Measles virus
auaggaagugcaagcua

SEQ ID NO: 4022994 - RNA, 12 nt, Measles virus
auauuaaagaaa

SEQ ID NO: 4022995 - RNA, 16 nt, Measles virus
auauuaaagaaaacuu

SEQ ID NO: 4022996 - RNA, 17 nt, Measles virus
aucaguaucccacagcc

SEQ ID NO: 4022997 - RNA, 20 nt, Measles virus
aucauaggcagagauucagg

SEQ ID NO: 4022998 - RNA, 20 nt, Measles virus
aucaugauugccauuccugg

SEQ ID NO: 4022999 - RNA, 12 nt, Measles virus
auccagcaucaa

SEQ ID NO: 4023000 - RNA, 22 nt, Measles virus
aucccaaucugcguccuccucg

SEQ ID NO: 4023001 - RNA, 16 nt, Measles virus
aucggcucacuggccg

SEQ ID NO: 4023002 - RNA, 18 nt, Measles virus
aucuuacagggacaucaa

SEQ ID NO: 4023003 - RNA, 16 nt, Measles virus
augacagccagaaggc

SEQ ID NO: 4023004 - RNA, 22 nt, Measles virus
augcacaacucggguucaagaa

SEQ ID NO: 4023005 - RNA, 17 nt, Measles virus
augccucuuagccugga

SEQ ID NO: 4023006 - RNA, 13 nt, Measles virus
augucgcuguccc

SEQ ID NO: 4023007 - RNA, 22 nt, Measles virus
auuacaaguggaaugcuucaca

SEQ ID NO: 4023008 - RNA, 22 nt, Measles virus
auuagacuccaucgugcagcca

SEQ ID NO: 4023009 - RNA, 20 nt, Measles virus
auuauuaacuugggaguuua

SEQ ID NO: 4023010 - RNA, 17 nt, Measles virus
auuugcaauauauuaaa

SEQ ID NO: 4023011 - RNA, 14 nt, Measles virus
caaaaaacucuggu

SEQ ID NO: 4023012 - RNA, 20 nt, Measles virus
caaaaaggaaaggccacaac

SEQ ID NO: 4023013 - RNA, 22 nt, Measles virus
caaaaaggaaaggccacaaccc

SEQ ID NO: 4023014 - RNA, 19 nt, Measles virus
caaaacuuagggccaagga

SEQ ID NO: 4023015 - RNA, 19 nt, Measles virus
caaacccgccggccccccc

SEQ ID NO: 4023016 - RNA, 16 nt, Measles virus
caaaccgcaaaagaca

SEQ ID NO: 4023017 - RNA, 16 nt, Measles virus
caaacucaguuccaau

SEQ ID NO: 4023018 - RNA, 13 nt, Measles virus
caaaggagccaac

SEQ ID NO: 4023019 - RNA, 18 nt, Measles virus
caaagggaaacugcucag

SEQ ID NO: 4023020 - RNA, 18 nt, Measles virus
caaauuggauuaugauca

SEQ ID NO: 4023021 - RNA, 10 nt, Measles virus
caacaaugug

SEQ ID NO: 4023022 - RNA, 15 nt, Measles virus
caacacggacagaug

SEQ ID NO: 4023023 - RNA, 19 nt, Measles virus
caacauguauauuaccuga

SEQ ID NO: 4023024 - RNA, 21 nt, Measles virus
caaccagaucuuauacccuga

SEQ ID NO: 4023025 - RNA, 19 nt, Measles virus
caacccgaaccagcaccca

SEQ ID NO: 4023026 - RNA, 22 nt, Measles virus
caacccgaaccagcacccaaga

SEQ ID NO: 4023027 - RNA, 20 nt, Measles virus
caaccgcauccccacagcuc

SEQ ID NO: 4023028 - RNA, 18 nt, Measles virus
caaccucuucacuguucc

SEQ ID NO: 4023029 - RNA, 18 nt, Measles virus
caacugaaggcggugcac

SEQ ID NO: 4023030 - RNA, 17 nt, Measles virus
caacuuaccugccaacc

SEQ ID NO: 4023031 - RNA, 17 nt, Measles virus
caagcgagaggccagcc

SEQ ID NO: 4023032 - RNA, 14 nt, Measles virus
caaggccaccacca

SEQ ID NO: 4023033 - RNA, 19 nt, Measles virus
caaggcgauuggcccuggg

SEQ ID NO: 4023034 - RNA, 17 nt, Measles virus
caaguggaaugcuucac

SEQ ID NO: 4023035 - RNA, 15 nt, Measles virus
caaguguuacacaac

SEQ ID NO: 4023036 - RNA, 19 nt, Measles virus
caauauauuaaagaaaacu

SEQ ID NO: 4023037 - RNA, 14 nt, Measles virus
caaugaagaccuua

SEQ ID NO: 4023038 - RNA, 14 nt, Measles virus
caaugccgcacuga

SEQ ID NO: 4023039 - RNA, 19 nt, Measles virus
caauguaccuaaaggacaa

SEQ ID NO: 4023040 - RNA, 12 nt, Measles virus
caauucucaaac

SEQ ID NO: 4023041 - RNA, 16 nt, Measles virus
cacaaugacagagauc

SEQ ID NO: 4023042 - RNA, 17 nt, Measles virus
cacaaugucaccacaac

SEQ ID NO: 4023043 - RNA, 15 nt, Measles virus
cacagagguguuauc

SEQ ID NO: 4023044 - RNA, 15 nt, Measles virus
cacagccgccagcca

SEQ ID NO: 4023045 - RNA, 16 nt, Measles virus
cacagguaggcacacc

SEQ ID NO: 4023046 - RNA, 18 nt, Measles virus
cacauuagaagcacaggc

SEQ ID NO: 4023047 - RNA, 16 nt, Measles virus
caccagaugcugauga

SEQ ID NO: 4023048 - RNA, 14 nt, Measles virus
caccgcauccagca

SEQ ID NO: 4023049 - RNA, 13 nt, Measles virus
caccucucaagca

SEQ ID NO: 4023050 - RNA, 14 nt, Measles virus
caccugcaaggaag

SEQ ID NO: 4023051 - RNA, 15 nt, Measles virus
caccugcaaggaaga

SEQ ID NO: 4023052 - RNA, 19 nt, Measles virus
cacggaccaagcgagaggc

SEQ ID NO: 4023053 - RNA, 14 nt, Measles virus
cacgucgacacaga

SEQ ID NO: 4023054 - RNA, 16 nt, Measles virus
cacgucgacacagagu

SEQ ID NO: 4023055 - RNA, 23 nt, Measles virus
cacucccacgacuggagccgaug

SEQ ID NO: 4023056 - RNA, 23 nt, Measles virus
cacugcccgguggucgaggugaa

SEQ ID NO: 4023057 - RNA, 18 nt, Measles virus
cacuugcugcucuccaaa

SEQ ID NO: 4023058 - RNA, 17 nt, Measles virus
cagaagacuccacggac

SEQ ID NO: 4023059 - RNA, 21 nt, Measles virus
cagaaggaggggagauccacg

SEQ ID NO: 4023060 - RNA, 22 nt, Measles virus
cagaaggaggggagauccacga

SEQ ID NO: 4023061 - RNA, 18 nt, Measles virus
cagaggucaauucucaaa

SEQ ID NO: 4023062 - RNA, 19 nt, Measles virus
cagauccucuccccccggc

SEQ ID NO: 4023063 - RNA, 17 nt, Measles virus
cagcagggcucaaugaa

SEQ ID NO: 4023064 - RNA, 18 nt, Measles virus
cagccaaccaaccaucca

SEQ ID NO: 4023065 - RNA, 17 nt, Measles virus
cagccagcagccgacag

SEQ ID NO: 4023066 - RNA, 22 nt, Measles virus
cagccccgacacaaggccacca

SEQ ID NO: 4023067 - RNA, 16 nt, Measles virus
cagccggcuagaggag

SEQ ID NO: 4023068 - RNA, 21 nt, Measles virus
cagcugcacagucacucggga

SEQ ID NO: 4023069 - RNA, 12 nt, Measles virus
cagcugcucaga

SEQ ID NO: 4023070 - RNA, 16 nt, Measles virus
cagcuuacgggacccc

SEQ ID NO: 4023071 - RNA, 14 nt, Measles virus
cagcuuugucuggu

SEQ ID NO: 4023072 - RNA, 14 nt, Measles virus
caggccgagcacug

SEQ ID NO: 4023073 - RNA, 17 nt, Measles virus
caggcuggugccccagg

SEQ ID NO: 4023074 - RNA, 22 nt, Measles virus
cagggcaaccaaucaguuccua

SEQ ID NO: 4023075 - RNA, 11 nt, Measles virus
cagggcccacu

SEQ ID NO: 4023076 - RNA, 17 nt, Measles virus
caguaacggcugcugaa

SEQ ID NO: 4023077 - RNA, 16 nt, Measles virus
caguagaacucagagg

SEQ ID NO: 4023078 - RNA, 16 nt, Measles virus
caguagggccagcacu

SEQ ID NO: 4023079 - RNA, 22 nt, Measles virus
caguaucccacagccucuccaa

SEQ ID NO: 4023080 - RNA, 22 nt, Measles virus
caguccacacaaguaccaggaa

SEQ ID NO: 4023081 - RNA, 13 nt, Measles virus
cagugauggcagg

SEQ ID NO: 4023082 - RNA, 19 nt, Measles virus
cauaagagccucagcacca

SEQ ID NO: 4023083 - RNA, 20 nt, Measles virus
cauaagagccucagcaccaa

SEQ ID NO: 4023084 - RNA, 16 nt, Measles virus
cauaugacaaacuauu

SEQ ID NO: 4023085 - RNA, 22 nt, Measles virus
caucagggccaggugcaccugc

SEQ ID NO: 4023086 - RNA, 17 nt, Measles virus
caucaguaucccacagc

SEQ ID NO: 4023087 - RNA, 13 nt, Measles virus
caucgacaaugca

SEQ ID NO: 4023088 - RNA, 15 nt, Measles virus
caucgacaaugcaga

SEQ ID NO: 4023089 - RNA, 16 nt, Measles virus
caugacccugaguuca

SEQ ID NO: 4023090 - RNA, 12 nt, Measles virus
caugccagaggg

SEQ ID NO: 4023091 - RNA, 13 nt, Measles virus
caugccucucagc

SEQ ID NO: 4023092 - RNA, 15 nt, Measles virus
cauguuucugcuggg

SEQ ID NO: 4023093 - RNA, 15 nt, Measles virus
cauuauaaaaaacuu

SEQ ID NO: 4023094 - RNA, 22 nt, Measles virus
ccaaccucuucacuguuccaau

SEQ ID NO: 4023095 - RNA, 21 nt, Measles virus
ccaauauaacucuccucaaua

SEQ ID NO: 4023096 - RNA, 22 nt, Measles virus
ccaaugguuugagcccuuucug

SEQ ID NO: 4023097 - RNA, 19 nt, Measles virus
ccacaacccgcgcacccca

SEQ ID NO: 4023098 - RNA, 18 nt, Measles virus
ccacaaccgaaccgcaca

SEQ ID NO: 4023099 - RNA, 21 nt, Measles virus
ccacaaccgaaccgcacaagc

SEQ ID NO: 4023100 - RNA, 22 nt, Measles virus
ccaccaaccgcauccccacagc

SEQ ID NO: 4023101 - RNA, 14 nt, Measles virus
ccaccaccagccau

SEQ ID NO: 4023102 - RNA, 17 nt, Measles virus
ccaccgcauccagcauc

SEQ ID NO: 4023103 - RNA, 17 nt, Measles virus
ccacuaacccuccucac

SEQ ID NO: 4023104 - RNA, 15 nt, Measles virus
ccagacuugaagcag

SEQ ID NO: 4023105 - RNA, 20 nt, Measles virus
ccagagggagcccccaacca

SEQ ID NO: 4023106 - RNA, 14 nt, Measles virus
ccagaguccagacc

SEQ ID NO: 4023107 - RNA, 15 nt, Measles virus
ccagaguccagacca

SEQ ID NO: 4023108 - RNA, 16 nt, Measles virus
ccagccaaccaaccau

SEQ ID NO: 4023109 - RNA, 23 nt, Measles virus
ccagccaaccaaccauccacucc

SEQ ID NO: 4023110 - RNA, 20 nt, Measles virus
ccaggcaguuuugcagccau

SEQ ID NO: 4023111 - RNA, 19 nt, Measles virus
ccaggggccgacagccagc

SEQ ID NO: 4023112 - RNA, 13 nt, Measles virus
ccagguccacaca

SEQ ID NO: 4023113 - RNA, 23 nt, Measles virus
ccaguccaugcugaacucucaag

SEQ ID NO: 4023114 - RNA, 17 nt, Measles virus
ccaucaguuccucaaga

SEQ ID NO: 4023115 - RNA, 17 nt, Measles virus
ccaugcugaacucucaa

SEQ ID NO: 4023116 - RNA, 18 nt, Measles virus
cccaaaaaaaggccccca

SEQ ID NO: 4023117 - RNA, 22 nt, Measles virus
cccaaguauguugcaacccaag

SEQ ID NO: 4023118 - RNA, 14 nt, Measles virus
cccaccccacacac

SEQ ID NO: 4023119 - RNA, 17 nt, Measles virus
cccacuaacccuccuca

SEQ ID NO: 4023120 - RNA, 15 nt, Measles virus
cccagcacccagcca

SEQ ID NO: 4023121 - RNA, 19 nt, Measles virus
cccagcuuacgggacccca

SEQ ID NO: 4023122 - RNA, 18 nt, Measles virus
cccaggggccgacagcca

SEQ ID NO: 4023123 - RNA, 13 nt, Measles virus
cccaguagggcca

SEQ ID NO: 4023124 - RNA, 17 nt, Measles virus
cccaguagggccagcac

SEQ ID NO: 4023125 - RNA, 19 nt, Measles virus
ccccacuaacccuccucac

SEQ ID NO: 4023126 - RNA, 17 nt, Measles virus
ccccaggggccgacagc

SEQ ID NO: 4023127 - RNA, 23 nt, Measles virus
ccccaggggccgacagccagcau

SEQ ID NO: 4023128 - RNA, 14 nt, Measles virus
ccccaguagggcca

SEQ ID NO: 4023129 - RNA, 21 nt, Measles virus
ccccccaaaaaaaggccccca

SEQ ID NO: 4023130 - RNA, 19 nt, Measles virus
ccccucauaaugacagcca

SEQ ID NO: 4023131 - RNA, 14 nt, Measles virus
cccgaaccagcacc

SEQ ID NO: 4023132 - RNA, 20 nt, Measles virus
cccgauccggcgggcagcca

SEQ ID NO: 4023133 - RNA, 22 nt, Measles virus
cccgaugaguccucugcuccaa

SEQ ID NO: 4023134 - RNA, 23 nt, Measles virus
cccgaugaguccucugcuccaag

SEQ ID NO: 4023135 - RNA, 15 nt, Measles virus
cccggugcccacagg

SEQ ID NO: 4023136 - RNA, 17 nt, Measles virus
cccggugcccacaggua

SEQ ID NO: 4023137 - RNA, 20 nt, Measles virus
cccucaagaaaucuccaggc

SEQ ID NO: 4023138 - RNA, 15 nt, Measles virus
cccugggggaccccc

SEQ ID NO: 4023139 - RNA, 15 nt, Measles virus
ccgaaaaccagaggg

SEQ ID NO: 4023140 - RNA, 15 nt, Measles virus
ccgaccagacccagc

SEQ ID NO: 4023141 - RNA, 19 nt, Measles virus
ccgaccagacccagcaccc

SEQ ID NO: 4023142 - RNA, 13 nt, Measles virus
ccgacgcuguccg

SEQ ID NO: 4023143 - RNA, 12 nt, Measles virus
ccgagcacuggc

SEQ ID NO: 4023144 - RNA, 22 nt, Measles virus
ccgagcccaucggcucacuggc

SEQ ID NO: 4023145 - RNA, 16 nt, Measles virus
ccgaggaccagaacaa

SEQ ID NO: 4023146 - RNA, 20 nt, Measles virus
ccgaguguuugaaguagggg

SEQ ID NO: 4023147 - RNA, 13 nt, Measles virus
ccuaaagccugau

SEQ ID NO: 4023148 - RNA, 22 nt, Measles virus
ccucacgcuuacagccuggagg

SEQ ID NO: 4023149 - RNA, 19 nt, Measles virus
ccucauaaugacagccaga

SEQ ID NO: 4023150 - RNA, 11 nt, Measles virus
ccuccagaaga

SEQ ID NO: 4023151 - RNA, 17 nt, Measles virus
ccucgugggacccccga

SEQ ID NO: 4023152 - RNA, 21 nt, Measles virus
ccucugcuccaagaaugccuc

SEQ ID NO: 4023153 - RNA, 20 nt, Measles virus
ccugucauuauuuggcccca

SEQ ID NO: 4023154 - RNA, 16 nt, Measles virus
cgaaccgcacaagcga

SEQ ID NO: 4023155 - RNA, 23 nt, Measles virus
cgaaggucgcuccgaacacagac

SEQ ID NO: 4023156 - RNA, 22 nt, Measles virus
cgacagcaaguguggacaccag

SEQ ID NO: 4023157 - RNA, 14 nt, Measles virus
cgacagccagcauc

SEQ ID NO: 4023158 - RNA, 23 nt, Measles virus
cgaccacggcaaccgaaccagag

SEQ ID NO: 4023159 - RNA, 20 nt, Measles virus
cgaccagacccagcacccag

SEQ ID NO: 4023160 - RNA, 13 nt, Measles virus
cgaccccccucau

SEQ ID NO: 4023161 - RNA, 18 nt, Measles virus
cgacuccuuagacagauc

SEQ ID NO: 4023162 - RNA, 20 nt, Measles virus
cgaggacugccaugccccaa

SEQ ID NO: 4023163 - RNA, 22 nt, Measles virus
cgaugaaucugaaaacagcgau

SEQ ID NO: 4023164 - RNA, 17 nt, Measles virus
cgcaagaaccccacaac

SEQ ID NO: 4023165 - RNA, 16 nt, Measles virus
cgcgcaccccagcccc

SEQ ID NO: 4023166 - RNA, 19 nt, Measles virus
cggagauauccauccaggc

SEQ ID NO: 4023167 - RNA, 22 nt, Measles virus
cggcccccccggugcccacagg

SEQ ID NO: 4023168 - RNA, 16 nt, Measles virus
cggcuaucgugacagg

SEQ ID NO: 4023169 - RNA, 15 nt, Measles virus
cggucuccuccucuu

SEQ ID NO: 4023170 - RNA, 13 nt, Measles virus
cggugcccacagg

SEQ ID NO: 4023171 - RNA, 18 nt, Measles virus
cgguguaccugcacagaa

SEQ ID NO: 4023172 - RNA, 21 nt, Measles virus
cguugauaacuggaaaucauu

SEQ ID NO: 4023173 - RNA, 20 nt, Measles virus
cuaaguuccacaaugacaga

SEQ ID NO: 4023174 - RNA, 13 nt, Measles virus
cuacccuccauca

SEQ ID NO: 4023175 - RNA, 19 nt, Measles virus
cuagugugaaauagacauc

SEQ ID NO: 4023176 - RNA, 23 nt, Measles virus
cuaucacaauucccuaucagggg

SEQ ID NO: 4023177 - RNA, 21 nt, Measles virus
cucaacucuacuggaggccag

SEQ ID NO: 4023178 - RNA, 23 nt, Measles virus
cucaagaaaucuccaggcaucaa

SEQ ID NO: 4023179 - RNA, 16 nt, Measles virus
cucaagcuucagguga

SEQ ID NO: 4023180 - RNA, 15 nt, Measles virus
cucaaugaaaaacug

SEQ ID NO: 4023181 - RNA, 13 nt, Measles virus
cucagaaucuggu

SEQ ID NO: 4023182 - RNA, 17 nt, Measles virus
cuccaaacacccaccgg

SEQ ID NO: 4023183 - RNA, 15 nt, Measles virus
cuccaauccagaggc

SEQ ID NO: 4023184 - RNA, 17 nt, Measles virus
cuccaggcaucaagcac

SEQ ID NO: 4023185 - RNA, 17 nt, Measles virus
cuccucgugggaccccc

SEQ ID NO: 4023186 - RNA, 17 nt, Measles virus
cucgacagaacccagac

SEQ ID NO: 4023187 - RNA, 14 nt, Measles virus
cucguuccagccau

SEQ ID NO: 4023188 - RNA, 12 nt, Measles virus
cucuccccccgg

SEQ ID NO: 4023189 - RNA, 21 nt, Measles virus
cucuucacuguuccaaucaag

SEQ ID NO: 4023190 - RNA, 18 nt, Measles virus
cucuucgucaucaagcaa

SEQ ID NO: 4023191 - RNA, 13 nt, Measles virus
cugaagaacucau

SEQ ID NO: 4023192 - RNA, 14 nt, Measles virus
cugcagaaggaggg

SEQ ID NO: 4023193 - RNA, 19 nt, Measles virus
cugccauauucauggcagu

SEQ ID NO: 4023194 - RNA, 15 nt, Measles virus
cuggcugucucagga

SEQ ID NO: 4023195 - RNA, 23 nt, Measles virus
cuggucaggaucuccaauauguu

SEQ ID NO: 4023196 - RNA, 14 nt, Measles virus
cugucuuacagccu

SEQ ID NO: 4023197 - RNA, 15 nt, Measles virus
cuguuaacucuccaa

SEQ ID NO: 4023198 - RNA, 22 nt, Measles virus
cuuaggaguuauccggcccacu

SEQ ID NO: 4023199 - RNA, 15 nt, Measles virus
cuuauguuuugcugg

SEQ ID NO: 4023200 - RNA, 22 nt, Measles virus
cuuccaggguugaacaugcugu

SEQ ID NO: 4023201 - RNA, 22 nt, Measles virus
cuugaccaaaacggguuuucug

SEQ ID NO: 4023202 - RNA, 19 nt, Measles virus
cuugucuguuaaucugagu

SEQ ID NO: 4023203 - RNA, 15 nt, Measles virus
cuuuacugaaauaca

SEQ ID NO: 4023204 - RNA, 16 nt, Measles virus
gaaaauacgaaguuuc

SEQ ID NO: 4023205 - RNA, 16 nt, Measles virus
gaaaggucaugccaua

SEQ ID NO: 4023206 - RNA, 12 nt, Measles virus
gaaagucacagg

SEQ ID NO: 4023207 - RNA, 20 nt, Measles virus
gaaccaauuagagaugcacu

SEQ ID NO: 4023208 - RNA, 15 nt, Measles virus
gaaccgaucacauga

SEQ ID NO: 4023209 - RNA, 15 nt, Measles virus
gaagaagggggagac

SEQ ID NO: 4023210 - RNA, 16 nt, Measles virus
gaaugcuuuauguaca

SEQ ID NO: 4023211 - RNA, 21 nt, Measles virus
gacacaaggccaccaccagcc

SEQ ID NO: 4023212 - RNA, 18 nt, Measles virus
gacaccgggaaucccaga

SEQ ID NO: 4023213 - RNA, 19 nt, Measles virus
gacagcaaguguggacacc

SEQ ID NO: 4023214 - RNA, 11 nt, Measles virus
gacagccagaa

SEQ ID NO: 4023215 - RNA, 17 nt, Measles virus
gacaggaccgagccacc

SEQ ID NO: 4023216 - RNA, 15 nt, Measles virus
gacauacaucugaca

SEQ ID NO: 4023217 - RNA, 15 nt, Measles virus
gacaugcuuccagca

SEQ ID NO: 4023218 - RNA, 15 nt, Measles virus
gaccuuguugcuaua

SEQ ID NO: 4023219 - RNA, 17 nt, Measles virus
gacuccuuagacagauc

SEQ ID NO: 4023220 - RNA, 22 nt, Measles virus
gagcccaucggcucacuggccg

SEQ ID NO: 4023221 - RNA, 11 nt, Measles virus
gagcucagccg

SEQ ID NO: 4023222 - RNA, 20 nt, Measles virus
gaggcaaucagacaagcagg

SEQ ID NO: 4023223 - RNA, 20 nt, Measles virus
gaggggagguuaaugacaga

SEQ ID NO: 4023224 - RNA, 20 nt, Measles virus
gagugggcaccauugaagga

SEQ ID NO: 4023225 - RNA, 14 nt, Measles virus
gauaacaggauucc

SEQ ID NO: 4023226 - RNA, 18 nt, Measles virus
gauccauaagagccucag

SEQ ID NO: 4023227 - RNA, 21 nt, Measles virus
gaucccugggggacccccaaa

SEQ ID NO: 4023228 - RNA, 15 nt, Measles virus
gauggcagaagagca

SEQ ID NO: 4023229 - RNA, 17 nt, Measles virus
gauguaacuaacucgau

SEQ ID NO: 4023230 - RNA, 16 nt, Measles virus
gcaaccaccgcaucca

SEQ ID NO: 4023231 - RNA, 16 nt, Measles virus
gcacacccaccccaca

SEQ ID NO: 4023232 - RNA, 20 nt, Measles virus
gcaccaaucuagauguaacu

SEQ ID NO: 4023233 - RNA, 22 nt, Measles virus
gcacccaagagcgaucccuggg

SEQ ID NO: 4023234 - RNA, 21 nt, Measles virus
gcacuugcugcucuccaaagg

SEQ ID NO: 4023235 - RNA, 18 nt, Measles virus
gcagaucaacaggcaaaa

SEQ ID NO: 4023236 - RNA, 15 nt, Measles virus
gcagccaaaaugccu

SEQ ID NO: 4023237 - RNA, 21 nt, Measles virus
gcagccaucaguuccucaaga

SEQ ID NO: 4023238 - RNA, 17 nt, Measles virus
gcaggcuggugccccag

SEQ ID NO: 4023239 - RNA, 19 nt, Measles virus
gcaguucgggucucagcaa

SEQ ID NO: 4023240 - RNA, 13 nt, Measles virus
gcauccccacagc

SEQ ID NO: 4023241 - RNA, 21 nt, Measles virus
gcaucgcgaggaagcacaccc

SEQ ID NO: 4023242 - RNA, 15 nt, Measles virus
gcaugcugcagacac

SEQ ID NO: 4023243 - RNA, 11 nt, Measles virus
gccaaccccau

SEQ ID NO: 4023244 - RNA, 21 nt, Measles virus
gccacaacccgcgcaccccag

SEQ ID NO: 4023245 - RNA, 18 nt, Measles virus
gccaccaccagccauccc

SEQ ID NO: 4023246 - RNA, 16 nt, Measles virus
gccaccagcucccaga

SEQ ID NO: 4023247 - RNA, 15 nt, Measles virus
gccaucaccccgcaa

SEQ ID NO: 4023248 - RNA, 17 nt, Measles virus
gcccccaggggccgaca

SEQ ID NO: 4023249 - RNA, 19 nt, Measles virus
gcccccccggugcccacag

SEQ ID NO: 4023250 - RNA, 15 nt, Measles virus
gccuaaucugagcag

SEQ ID NO: 4023251 - RNA, 22 nt, Measles virus
gccuccggggguccaccaaguc

SEQ ID NO: 4023252 - RNA, 15 nt, Measles virus
gccucuuagccugga

SEQ ID NO: 4023253 - RNA, 18 nt, Measles virus
gccuucuacaaagacaac

SEQ ID NO: 4023254 - RNA, 11 nt, Measles virus
gcgaaccugau

SEQ ID NO: 4023255 - RNA, 21 nt, Measles virus
gcgaugacgacgcugaaacuu

SEQ ID NO: 4023256 - RNA, 16 nt, Measles virus
gcgauuggcccuggga

SEQ ID NO: 4023257 - RNA, 13 nt, Measles virus
gcgcuuggaggag

SEQ ID NO: 4023258 - RNA, 17 nt, Measles virus
gcggagauauccaucca

SEQ ID NO: 4023259 - RNA, 22 nt, Measles virus
gcguccuccucgugggaccccc

SEQ ID NO: 4023260 - RNA, 13 nt, Measles virus
gcguugccacagc

SEQ ID NO: 4023261 - RNA, 22 nt, Measles virus
gcguugccacagcugcucagau

SEQ ID NO: 4023262 - RNA, 12 nt, Measles virus
gcucucaagagu

SEQ ID NO: 4023263 - RNA, 22 nt, Measles virus
gcucucaaggccgagcccaucg

SEQ ID NO: 4023264 - RNA, 13 nt, Measles virus
gcugacaaucaag

SEQ ID NO: 4023265 - RNA, 17 nt, Measles virus
gcugacucuaucauggu

SEQ ID NO: 4023266 - RNA, 21 nt, Measles virus
gcuggggguuguugaggacag

SEQ ID NO: 4023267 - RNA, 19 nt, Measles virus
ggaagcacacccaccccac

SEQ ID NO: 4023268 - RNA, 12 nt, Measles virus
ggacaaggcacu

SEQ ID NO: 4023269 - RNA, 17 nt, Measles virus
ggagauauccauccagg

SEQ ID NO: 4023270 - RNA, 18 nt, Measles virus
ggauaccgagauucaagg

SEQ ID NO: 4023271 - RNA, 23 nt, Measles virus
ggcaccgcgcccccaccccccga

SEQ ID NO: 4023272 - RNA, 20 nt, Measles virus
ggcagaagagcaggcacgcc

SEQ ID NO: 4023273 - RNA, 16 nt, Measles virus
ggcaggcuggugcccc

SEQ ID NO: 4023274 - RNA, 19 nt, Measles virus
ggcaggcuggugccccagg

SEQ ID NO: 4023275 - RNA, 18 nt, Measles virus
ggcauccgacuccuuaga

SEQ ID NO: 4023276 - RNA, 19 nt, Measles virus
ggcaugggagucagcugca

SEQ ID NO: 4023277 - RNA, 23 nt, Measles virus
ggccacaacccgcgcaccccagc

SEQ ID NO: 4023278 - RNA, 17 nt, Measles virus
ggccaccaccagccauc

SEQ ID NO: 4023279 - RNA, 17 nt, Measles virus
ggcucaaauugcucaga

SEQ ID NO: 4023280 - RNA, 15 nt, Measles virus
ggcuccgaauugagg

SEQ ID NO: 4023281 - RNA, 15 nt, Measles virus
ggcuggugccccagg

SEQ ID NO: 4023282 - RNA, 12 nt, Measles virus
gggccagcacuu

SEQ ID NO: 4023283 - RNA, 15 nt, Measles virus
gggucucagcaaacc

SEQ ID NO: 4023284 - RNA, 14 nt, Measles virus
gggugcaagaucau

SEQ ID NO: 4023285 - RNA, 16 nt, Measles virus
ggguugaacaugcugu

SEQ ID NO: 4023286 - RNA, 14 nt, Measles virus
ggucaaugcagugg

SEQ ID NO: 4023287 - RNA, 23 nt, Measles virus
ggucaugccauauuuuguggaau

SEQ ID NO: 4023288 - RNA, 14 nt, Measles virus
gguccacacagccg

SEQ ID NO: 4023289 - RNA, 13 nt, Measles virus
gguguaucaaccc

SEQ ID NO: 4023290 - RNA, 21 nt, Measles virus
gguuacucuggaggagcagau

SEQ ID NO: 4023291 - RNA, 21 nt, Measles virus
gguuggacguagggacaaauc

SEQ ID NO: 4023292 - RNA, 20 nt, Measles virus
gguuuaucgagcacuagcau

SEQ ID NO: 4023293 - RNA, 21 nt, Measles virus
guauuacaccguucccagaag

SEQ ID NO: 4023294 - RNA, 24 nt, Measles virus
guauuacaccguucccagaagaau

SEQ ID NO: 4023295 - RNA, 13 nt, Measles virus
gucaauucucaaa

SEQ ID NO: 4023296 - RNA, 18 nt, Measles virus
gucacuaugacaucccag

SEQ ID NO: 4023297 - RNA, 18 nt, Measles virus
guccagaccacccugggc

SEQ ID NO: 4023298 - RNA, 12 nt, Measles virus
guccucugcucc

SEQ ID NO: 4023299 - RNA, 18 nt, Measles virus
guccucugcuccaagaau

SEQ ID NO: 4023300 - RNA, 23 nt, Measles virus
gucggcaugggacaucaaagggu

SEQ ID NO: 4023301 - RNA, 22 nt, Measles virus
gugauugccuccuaaguuccac

SEQ ID NO: 4023302 - RNA, 18 nt, Measles virus
gugucaucuauagucacu

SEQ ID NO: 4023303 - RNA, 12 nt, Measles virus
guuaauugaagc

SEQ ID NO: 4023304 - RNA, 13 nt, Measles virus
guucaagaagacc

SEQ ID NO: 4023305 - RNA, 13 nt, Measles virus
guuccucaagaau

SEQ ID NO: 4023306 - RNA, 14 nt, Measles virus
uaaagaaaacuuug

SEQ ID NO: 4023307 - RNA, 14 nt, Measles virus
uaaaucacaaaccc

SEQ ID NO: 4023308 - RNA, 17 nt, Measles virus
uaacaaaaagggagaac

SEQ ID NO: 4023309 - RNA, 16 nt, Measles virus
uaauccgcuccauuau

SEQ ID NO: 4023310 - RNA, 13 nt, Measles virus
uaaugacagagac

SEQ ID NO: 4023311 - RNA, 14 nt, Measles virus
uacaaaaccaacca

SEQ ID NO: 4023312 - RNA, 17 nt, Measles virus
uacaacaacaccccacu

SEQ ID NO: 4023313 - RNA, 22 nt, Measles virus
uaccaccuacagugauggcagg

SEQ ID NO: 4023314 - RNA, 20 nt, Measles virus
uacgauccucccaagggaac

SEQ ID NO: 4023315 - RNA, 22 nt, Measles virus
uagaagacaaagagucaacaag

SEQ ID NO: 4023316 - RNA, 16 nt, Measles virus
uagggugcaagaucau

SEQ ID NO: 4023317 - RNA, 16 nt, Measles virus
uaguagcuauccugga

SEQ ID NO: 4023318 - RNA, 15 nt, Measles virus
uauauuaaagaaaac

SEQ ID NO: 4023319 - RNA, 14 nt, Measles virus
uaucacaagggaac

SEQ ID NO: 4023320 - RNA, 20 nt, Measles virus
uauccaaauuguaaucagga

SEQ ID NO: 4023321 - RNA, 15 nt, Measles virus
uaucgcugacaauca

SEQ ID NO: 4023322 - RNA, 22 nt, Measles virus
uaucucgaauuuugaugaguca

SEQ ID NO: 4023323 - RNA, 17 nt, Measles virus
uauguuuugcuggcugu

SEQ ID NO: 4023324 - RNA, 15 nt, Measles virus
uauucccagcuuugu

SEQ ID NO: 4023325 - RNA, 17 nt, Measles virus
uauucccagcuuugucu

SEQ ID NO: 4023326 - RNA, 19 nt, Measles virus
uauuuaacauagaagacaa

SEQ ID NO: 4023327 - RNA, 14 nt, Measles virus
ucaaauuguagcca

SEQ ID NO: 4023328 - RNA, 20 nt, Measles virus
ucaaauuguagccaugcugg

SEQ ID NO: 4023329 - RNA, 22 nt, Measles virus
ucaagacugagaugaggucagu

SEQ ID NO: 4023330 - RNA, 10 nt, Measles virus
ucaaggaaac

SEQ ID NO: 4023331 - RNA, 16 nt, Measles virus
ucaaggacgugcugac

SEQ ID NO: 4023332 - RNA, 13 nt, Measles virus
ucaaggagaaaau

SEQ ID NO: 4023333 - RNA, 14 nt, Measles virus
ucaaggccgagccc

SEQ ID NO: 4023334 - RNA, 16 nt, Measles virus
ucaagguuagucccaa

SEQ ID NO: 4023335 - RNA, 16 nt, Measles virus
ucacagggaagauucu

SEQ ID NO: 4023336 - RNA, 15 nt, Measles virus
ucacgcuuacagccu

SEQ ID NO: 4023337 - RNA, 20 nt, Measles virus
ucacuaugacaucccaggga

SEQ ID NO: 4023338 - RNA, 14 nt, Measles virus
ucacucgggaagau

SEQ ID NO: 4023339 - RNA, 17 nt, Measles virus
ucacuguuccaaucaag

SEQ ID NO: 4023340 - RNA, 20 nt, Measles virus
ucagcaacugcaugguggcu

SEQ ID NO: 4023341 - RNA, 20 nt, Measles virus
ucagcauauccacccuggaa

SEQ ID NO: 4023342 - RNA, 13 nt, Measles virus
ucaggagucccca

SEQ ID NO: 4023343 - RNA, 20 nt, Measles virus
ucauaaugacagccagaagg

SEQ ID NO: 4023344 - RNA, 14 nt, Measles virus
ucaugccagagggg

SEQ ID NO: 4023345 - RNA, 17 nt, Measles virus
uccacacucuggcuguc

SEQ ID NO: 4023346 - RNA, 22 nt, Measles virus
uccagcaggcguguaaggguaa

SEQ ID NO: 4023347 - RNA, 16 nt, Measles virus
uccagggaaugacuaa

SEQ ID NO: 4023348 - RNA, 16 nt, Measles virus
uccaguguccaucaug

SEQ ID NO: 4023349 - RNA, 21 nt, Measles virus
uccauaagagccucagcacca

SEQ ID NO: 4023350 - RNA, 19 nt, Measles virus
ucccagacucggccaucac

SEQ ID NO: 4023351 - RNA, 16 nt, Measles virus
uccccacccccaaagg

SEQ ID NO: 4023352 - RNA, 22 nt, Measles virus
ucccucacgcuuacagccugga

SEQ ID NO: 4023353 - RNA, 20 nt, Measles virus
uccgauguccaagacaucaa

SEQ ID NO: 4023354 - RNA, 22 nt, Measles virus
uccggaacccuaauccugcccu

SEQ ID NO: 4023355 - RNA, 15 nt, Measles virus
uccgggcucucaagg

SEQ ID NO: 4023356 - RNA, 13 nt, Measles virus
ucgaucgcuccga

SEQ ID NO: 4023357 - RNA, 18 nt, Measles virus
ucgcagcccucugucaca

SEQ ID NO: 4023358 - RNA, 16 nt, Measles virus
ucgcucugauccucua

SEQ ID NO: 4023359 - RNA, 19 nt, Measles virus
ucggaaccaucagggccag

SEQ ID NO: 4023360 - RNA, 11 nt, Measles virus
ucguuccagcc

SEQ ID NO: 4023361 - RNA, 13 nt, Measles virus
ucuauucccagcu

SEQ ID NO: 4023362 - RNA, 21 nt, Measles virus
ucucaaagggaaacugcucag

SEQ ID NO: 4023363 - RNA, 21 nt, Measles virus
ucuccaagucccccggucucc

SEQ ID NO: 4023364 - RNA, 17 nt, Measles virus
ucuucacauuagaagca

SEQ ID NO: 4023365 - RNA, 18 nt, Measles virus
ugaaagaaaaggagauca

SEQ ID NO: 4023366 - RNA, 17 nt, Measles virus
ugaagugggccugagga

SEQ ID NO: 4023367 - RNA, 14 nt, Measles virus
ugacaaucaagcaa

SEQ ID NO: 4023368 - RNA, 15 nt, Measles virus
ugacaccacucuuca

SEQ ID NO: 4023369 - RNA, 14 nt, Measles virus
ugacaucccaggga

SEQ ID NO: 4023370 - RNA, 22 nt, Measles virus
ugacccucccccugcaugcugc

SEQ ID NO: 4023371 - RNA, 16 nt, Measles virus
ugaugucaaacucagu

SEQ ID NO: 4023372 - RNA, 18 nt, Measles virus
ugcauccgggcucucaag

SEQ ID NO: 4023373 - RNA, 23 nt, Measles virus
ugcccaaguauguugcaacccaa

SEQ ID NO: 4023374 - RNA, 15 nt, Measles virus
ugccucucagcaauu

SEQ ID NO: 4023375 - RNA, 16 nt, Measles virus
ugccucuuagccugga

SEQ ID NO: 4023376 - RNA, 14 nt, Measles virus
ugcuccaagaaugc

SEQ ID NO: 4023377 - RNA, 16 nt, Measles virus
ugcucuccaaagggaa

SEQ ID NO: 4023378 - RNA, 22 nt, Measles virus
uggacacccgaaucugguacca

SEQ ID NO: 4023379 - RNA, 14 nt, Measles virus
uggaggccagggca

SEQ ID NO: 4023380 - RNA, 22 nt, Measles virus
uggcugucucaggaguccccaa

SEQ ID NO: 4023381 - RNA, 14 nt, Measles virus
uguaaucaacacau

SEQ ID NO: 4023382 - RNA, 22 nt, Measles virus
ugucaggaaauacaugaaucag

SEQ ID NO: 4023383 - RNA, 22 nt, Measles virus
ugucucaaagggaaacugcuca

SEQ ID NO: 4023384 - RNA, 18 nt, Measles virus
ugugcagccaaaaugccu

SEQ ID NO: 4023385 - RNA, 17 nt, Measles virus
uguggacaccaggcggc

SEQ ID NO: 4023386 - RNA, 14 nt, Measles virus
uuaaagaaaacuuu

SEQ ID NO: 4023387 - RNA, 20 nt, Measles virus
uuaacucuccaaacacccac

SEQ ID NO: 4023388 - RNA, 18 nt, Measles virus
uuacauccugauugcagu

SEQ ID NO: 4023389 - RNA, 13 nt, Measles virus
uugaacaugcugu

SEQ ID NO: 4023390 - RNA, 16 nt, Measles virus
uuuaaucggccagaag

SEQ ID NO: 4023391 - RNA, 23 nt, Measles virus
uuuacagucaagacugagaugag

SEQ ID NO: 4023392 - RNA, 18 nt, Measles virus
gcagaugucgaacucaau

SEQ ID NO: 4023393 - RNA, 22 nt, Measles virus
gcauggucagaaauaucagaca

SEQ ID NO: 4023394 - RNA, 14 nt, Measles virus
gccaaaaugccuug

SEQ ID NO: 4023395 - RNA, 20 nt, Measles virus
gccaaccaaccauccacucc

SEQ ID NO: 4023396 - RNA, 16 nt, Measles virus
gccaaggaugagcacg

SEQ ID NO: 4023397 - RNA, 17 nt, Measles virus
gccacagcugcucagau

SEQ ID NO: 4023398 - RNA, 14 nt, Measles virus
gccaccaccagcca

SEQ ID NO: 4023399 - RNA, 21 nt, Measles virus
gccacucaacccgaaccagca

SEQ ID NO: 4023400 - RNA, 16 nt, Measles virus
gccagagagaaucaaa

SEQ ID NO: 4023401 - RNA, 12 nt, Measles virus
gccagccagcag

SEQ ID NO: 4023402 - RNA, 11 nt, Measles virus
gccauggcagc

SEQ ID NO: 4023403 - RNA, 12 nt, Measles virus
gccauggcagca

SEQ ID NO: 4023404 - RNA, 23 nt, Measles virus
gcccacagguaggcacaccaacc

SEQ ID NO: 4023405 - RNA, 18 nt, Measles virus
gcccacuacaaucagagg

SEQ ID NO: 4023406 - RNA, 12 nt, Measles virus
gcccccaccccc

SEQ ID NO: 4023407 - RNA, 17 nt, Measles virus
gcccccaccccccgaaa

SEQ ID NO: 4023408 - RNA, 22 nt, Measles virus
gccccgacacaaggccaccacc

SEQ ID NO: 4023409 - RNA, 17 nt, Measles virus
gccgacagccagcaucg

SEQ ID NO: 4023410 - RNA, 14 nt, Measles virus
gccggcccccccgg

SEQ ID NO: 4023411 - RNA, 13 nt, Measles virus
gcgagaggccagc

SEQ ID NO: 4023412 - RNA, 15 nt, Measles virus
gcgagaggccagcca

SEQ ID NO: 4023413 - RNA, 21 nt, Measles virus
gcgagcauucgggucccugcc

SEQ ID NO: 4023414 - RNA, 13 nt, Measles virus
gcgaucccugggg

SEQ ID NO: 4023415 - RNA, 17 nt, Measles virus
gcgguguaccugcacag

SEQ ID NO: 4023416 - RNA, 17 nt, Measles virus
gcucaaauugcucagau

SEQ ID NO: 4023417 - RNA, 20 nt, Measles virus
gcugaaaaucuaaucucaaa

SEQ ID NO: 4023418 - RNA, 16 nt, Measles virus
gcugacaaucaagcaa

SEQ ID NO: 4023419 - RNA, 18 nt, Measles virus
gcuggugccccaggucag

SEQ ID NO: 4023420 - RNA, 17 nt, Measles virus
gcuucaaguaggagaca

SEQ ID NO: 4023421 - RNA, 18 nt, Measles virus
ggaaacuacuaaucaggc

SEQ ID NO: 4023422 - RNA, 15 nt, Measles virus
ggaacccccagcaac

SEQ ID NO: 4023423 - RNA, 19 nt, Measles virus
ggaacccuaauccugcccu

SEQ ID NO: 4023424 - RNA, 17 nt, Measles virus
ggaaccuaauagccaau

SEQ ID NO: 4023425 - RNA, 14 nt, Measles virus
ggaagagucagaua

SEQ ID NO: 4023426 - RNA, 16 nt, Measles virus
ggaagccauggcagca

SEQ ID NO: 4023427 - RNA, 18 nt, Measles virus
ggacagcgauccccuagg

SEQ ID NO: 4023428 - RNA, 13 nt, Measles virus
ggaccgagccacc

SEQ ID NO: 4023429 - RNA, 15 nt, Measles virus
ggagccgauggcaga

SEQ ID NO: 4023430 - RNA, 20 nt, Measles virus
ggaguacgacuucagagauc

SEQ ID NO: 4023431 - RNA, 14 nt, Measles virus
ggcacgccauguca

SEQ ID NO: 4023432 - RNA, 16 nt, Measles virus
ggcagaagagcaggca

SEQ ID NO: 4023433 - RNA, 15 nt, Measles virus
ggcauugcacuucac

SEQ ID NO: 4023434 - RNA, 13 nt, Measles virus
ggccaccaccagc

SEQ ID NO: 4023435 - RNA, 13 nt, Measles virus
ggccagccagcag

SEQ ID NO: 4023436 - RNA, 18 nt, Measles virus
ggccgacagccagcaucg

SEQ ID NO: 4023437 - RNA, 15 nt, Measles virus
ggccgucgaggaagc

SEQ ID NO: 4023438 - RNA, 18 nt, Measles virus
ggccuaggcuccgaauug

SEQ ID NO: 4023439 - RNA, 19 nt, Measles virus
ggccugaggacaccucaga

SEQ ID NO: 4023440 - RNA, 21 nt, Measles virus
ggcguugccacagcugcucag

SEQ ID NO: 4023441 - RNA, 21 nt, Measles virus
gggaaaggaacccccagcaac

SEQ ID NO: 4023442 - RNA, 16 nt, Measles virus
gggaccaaaagaucaa

SEQ ID NO: 4023443 - RNA, 21 nt, Measles virus
gggagauccacgagcuccuga

SEQ ID NO: 4023444 - RNA, 17 nt, Measles virus
gggaggacaucaaggag

SEQ ID NO: 4023445 - RNA, 18 nt, Measles virus
gggaguacgacuucagag

SEQ ID NO: 4023446 - RNA, 17 nt, Measles virus
gggcucaaauugcucag

SEQ ID NO: 4023447 - RNA, 17 nt, Measles virus
gguucagggcuucugau

SEQ ID NO: 4023448 - RNA, 20 nt, Measles virus
cguacagcagggcucaauga

SEQ ID NO: 4023449 - RNA, 13 nt, Measles virus
cuaacccuccuca

SEQ ID NO: 4023450 - RNA, 18 nt, Measles virus
cuaaguuccacaaugaca

SEQ ID NO: 4023451 - RNA, 17 nt, Measles virus
cuaaucugagcaguaaa

SEQ ID NO: 4023452 - RNA, 16 nt, Measles virus
cuacaccgcagagauc

SEQ ID NO: 4023453 - RNA, 21 nt, Measles virus
cuagauuacauuuucauaacu

SEQ ID NO: 4023454 - RNA, 16 nt, Measles virus
cuagguaguuaggcau

SEQ ID NO: 4023455 - RNA, 19 nt, Measles virus
cuaucaggggucagggaaa

SEQ ID NO: 4023456 - RNA, 16 nt, Measles virus
cuauucccagcuuugu

SEQ ID NO: 4023457 - RNA, 21 nt, Measles virus
cucaaagggaaacugcucagg

SEQ ID NO: 4023458 - RNA, 22 nt, Measles virus
cucaaagggaaacugcucaggg

SEQ ID NO: 4023459 - RNA, 17 nt, Measles virus
cucaacccgaaccagca

SEQ ID NO: 4023460 - RNA, 22 nt, Measles virus
cucaaggugaacgucucugcca

SEQ ID NO: 4023461 - RNA, 18 nt, Measles virus
cucaaucccgaccugaaa

SEQ ID NO: 4023462 - RNA, 16 nt, Measles virus
cucacgcuuacagccu

SEQ ID NO: 4023463 - RNA, 18 nt, Measles virus
cuccaucgugcagccauc

SEQ ID NO: 4023464 - RNA, 14 nt, Measles virus
cuccgaacacagac

SEQ ID NO: 4023465 - RNA, 16 nt, Measles virus
cuccggcuucccucug

SEQ ID NO: 4023466 - RNA, 18 nt, Measles virus
cuccggcuucccucuggc

SEQ ID NO: 4023467 - RNA, 17 nt, Measles virus
cuccuaaaaaagggaaa

SEQ ID NO: 4023468 - RNA, 13 nt, Measles virus
cucucaucucaca

SEQ ID NO: 4023469 - RNA, 18 nt, Measles virus
cugaaaaucuaaucucaa

SEQ ID NO: 4023470 - RNA, 21 nt, Measles virus
cugaaaaugucaggaaauaca

SEQ ID NO: 4023471 - RNA, 23 nt, Measles virus
cugaaagaaaaggagaucaagga

SEQ ID NO: 4023472 - RNA, 14 nt, Measles virus
cugagucugacagu

SEQ ID NO: 4023473 - RNA, 14 nt, Measles virus
cugcaacugaggga

SEQ ID NO: 4023474 - RNA, 18 nt, Measles virus
cugcacagucacucggga

SEQ ID NO: 4023475 - RNA, 19 nt, Measles virus
cugcacagucacucgggaa

SEQ ID NO: 4023476 - RNA, 12 nt, Measles virus
cugcaugcugca

SEQ ID NO: 4023477 - RNA, 19 nt, Measles virus
cugcccuagguaguuaggc

SEQ ID NO: 4023478 - RNA, 18 nt, Measles virus
cugcucagggcccacuac

SEQ ID NO: 4023479 - RNA, 18 nt, Measles virus
cuggagccgauggcagaa

SEQ ID NO: 4023480 - RNA, 12 nt, Measles virus
cuggaggccagg

SEQ ID NO: 4023481 - RNA, 15 nt, Measles virus
cuggaggccagggca

SEQ ID NO: 4023482 - RNA, 19 nt, Measles virus
cuggccgaaguucucaaga

SEQ ID NO: 4023483 - RNA, 12 nt, Measles virus
cugggggacccc

SEQ ID NO: 4023484 - RNA, 15 nt, Measles virus
cuuaccugccaaccc

SEQ ID NO: 4023485 - RNA, 20 nt, Measles virus
gaaacugcagaaggagggga

SEQ ID NO: 4023486 - RNA, 15 nt, Measles virus
gaaacugcucagggc

SEQ ID NO: 4023487 - RNA, 17 nt, Measles virus
gaaauucaucucugaca

SEQ ID NO: 4023488 - RNA, 15 nt, Measles virus
gaacagccccgacac

SEQ ID NO: 4023489 - RNA, 11 nt, Measles virus
gaaccagcacc

SEQ ID NO: 4023490 - RNA, 20 nt, Measles virus
gaacccuaauccugcccuag

SEQ ID NO: 4023491 - RNA, 15 nt, Measles virus
gaaccgggucacgga

SEQ ID NO: 4023492 - RNA, 19 nt, Measles virus
gaagacuccacggaccaag

SEQ ID NO: 4023493 - RNA, 22 nt, Measles virus
gaagcagaucaacaggcaaaau

SEQ ID NO: 4023494 - RNA, 17 nt, Measles virus
gacaacacggacagaug

SEQ ID NO: 4023495 - RNA, 21 nt, Measles virus
gacaccacucuucaagaucau

SEQ ID NO: 4023496 - RNA, 21 nt, Measles virus
gacaccucagagauucacuga

SEQ ID NO: 4023497 - RNA, 18 nt, Measles virus
gacagauccucucccccc

SEQ ID NO: 4023498 - RNA, 19 nt, Measles virus
gacagguggugcaacccaa

SEQ ID NO: 4023499 - RNA, 17 nt, Measles virus
gaccaagcgagaggcca

SEQ ID NO: 4023500 - RNA, 20 nt, Measles virus
gaccacccugggccaccagc

SEQ ID NO: 4023501 - RNA, 15 nt, Measles virus
gacccagcacccagc

SEQ ID NO: 4023502 - RNA, 19 nt, Measles virus
gacucggccaucaccccgc

SEQ ID NO: 4023503 - RNA, 20 nt, Measles virus
gacugccaugccccaacaua

SEQ ID NO: 4023504 - RNA, 20 nt, Measles virus
gagacaugcuuccagcaggc

SEQ ID NO: 4023505 - RNA, 17 nt, Measles virus
gagacgaugaaucugaa

SEQ ID NO: 4023506 - RNA, 10 nt, Measles virus
gagaucccag

SEQ ID NO: 4023507 - RNA, 19 nt, Measles virus
gagucagauacauguggaa

SEQ ID NO: 4023508 - RNA, 20 nt, Measles virus
gaguugucacaacugagcau

SEQ ID NO: 4023509 - RNA, 13 nt, Measles virus
gauaacuggaaau

SEQ ID NO: 4023510 - RNA, 17 nt, Measles virus
gaucaauacugugcaga

SEQ ID NO: 4023511 - RNA, 21 nt, Measles virus
gaucacacacgguucagggau

SEQ ID NO: 4023512 - RNA, 18 nt, Measles virus
gaucccugggggaccccc

SEQ ID NO: 4023513 - RNA, 22 nt, Measles virus
gaucugacaauguaccuaaagg

SEQ ID NO: 4023514 - RNA, 13 nt, Measles virus
gauggccaaggau

SEQ ID NO: 4023515 - RNA, 22 nt, Measles virus
gauuaugaucaauacugugcag

SEQ ID NO: 4023516 - RNA, 23 nt, Measles virus
gcaaaccaugccucucagcaauu

SEQ ID NO: 4023517 - RNA, 18 nt, Measles virus
gcaaccgaaccagagucc

SEQ ID NO: 4023518 - RNA, 17 nt, Measles virus
gcaacuggaaggccccu

SEQ ID NO: 4023519 - RNA, 17 nt, Measles virus
gcacuccacacucuggc

SEQ ID NO: 4023520 - RNA, 21 nt, Measles virus
gcagcccucugucacagggaa

SEQ ID NO: 4023521 - RNA, 22 nt, Measles virus
gcaggcaguucgggucucagca

SEQ ID NO: 4023522 - RNA, 18 nt, Measles virus
gcaguaacggcugcugaa

SEQ ID NO: 4023523 - RNA, 18 nt, Measles virus
gcauaguuuacauccuga

SEQ ID NO: 4023524 - RNA, 17 nt, Measles virus
gcauccccacagcuccc

SEQ ID NO: 4023525 - RNA, 22 nt, Measles virus
gcaucuuagagagcagaggaau

SEQ ID NO: 4023526 - RNA, 17 nt, Measles virus
gcauuggugaacucaac

SEQ ID NO: 4023527 - RNA, 14 nt, Measles virus
gccaaccccaugcc

SEQ ID NO: 4023528 - RNA, 18 nt, Measles virus
gccagcacuuccgagaca

SEQ ID NO: 4023529 - RNA, 12 nt, Measles virus
gccaggugcacc

SEQ ID NO: 4023530 - RNA, 16 nt, Measles virus
gccaucaguuccucaa

SEQ ID NO: 4023531 - RNA, 18 nt, Measles virus
gccauggcagcaugguca

SEQ ID NO: 4023532 - RNA, 18 nt, Measles virus
gcccagcaauacccgaaa

SEQ ID NO: 4023533 - RNA, 12 nt, Measles virus
gccccccccaaa

SEQ ID NO: 4023534 - RNA, 18 nt, Measles virus
gcccccccggugcccaca

SEQ ID NO: 4023535 - RNA, 18 nt, Measles virus
gccccgacacaaggccac

SEQ ID NO: 4023536 - RNA, 20 nt, Measles virus
gcccuagguaguuaggcauu

SEQ ID NO: 4023537 - RNA, 22 nt, Measles virus
gccgaaguucucaagaagcccg

SEQ ID NO: 4023538 - RNA, 12 nt, Measles virus
gccgacagccag

SEQ ID NO: 4023539 - RNA, 12 nt, Measles virus
gccgauggcaga

SEQ ID NO: 4023540 - RNA, 18 nt, Measles virus
gccgucgaggaagccaug

SEQ ID NO: 4023541 - RNA, 23 nt, Measles virus
gccgucgaggaagccauggcagc

SEQ ID NO: 4023542 - RNA, 22 nt, Measles virus
gccgucggguuuguuccugaca

SEQ ID NO: 4023543 - RNA, 22 nt, Measles virus
gccuucuacaaagacaacccac

SEQ ID NO: 4023544 - RNA, 13 nt, Measles virus
gccuuggccaaaa

SEQ ID NO: 4023545 - RNA, 19 nt, Measles virus
gcgaauggagacaugcuuc

SEQ ID NO: 4023546 - RNA, 17 nt, Measles virus
gcgauccuggguccccc

SEQ ID NO: 4023547 - RNA, 19 nt, Measles virus
gcuccgaacacagaccacc

SEQ ID NO: 4023548 - RNA, 23 nt, Measles virus
gcuccgaacacagaccaccaacc

SEQ ID NO: 4023549 - RNA, 14 nt, Measles virus
gcugaugaagauaa

SEQ ID NO: 4023550 - RNA, 18 nt, Measles virus
gcugcugaagaacucaug

SEQ ID NO: 4023551 - RNA, 19 nt, Measles virus
gcuguucaggguguccaag

SEQ ID NO: 4023552 - RNA, 16 nt, Measles virus
gcuuacagccuggagg

SEQ ID NO: 4023553 - RNA, 23 nt, Measles virus
gcuuuaccucucaucucacagag

SEQ ID NO: 4023554 - RNA, 16 nt, Measles virus
gcuuuauguacauguu

SEQ ID NO: 4023555 - RNA, 12 nt, Measles virus
gcuuugucuggu

SEQ ID NO: 4023556 - RNA, 18 nt, Measles virus
ggaauccccucaagaaau

SEQ ID NO: 4023557 - RNA, 22 nt, Measles virus
ggacaaugggauggccaaggau

SEQ ID NO: 4023558 - RNA, 14 nt, Measles virus
ggacagcugcugaa

SEQ ID NO: 4023559 - RNA, 15 nt, Measles virus
ggacuugggaaggau

SEQ ID NO: 4023560 - RNA, 21 nt, Measles virus
ggagauccacgagcuccugaa

SEQ ID NO: 4023561 - RNA, 12 nt, Measles virus
ggagcaaaguga

SEQ ID NO: 4023562 - RNA, 14 nt, Measles virus
ggagccgauggcag

SEQ ID NO: 4023563 - RNA, 20 nt, Measles virus
cagaccacccugggccacca

SEQ ID NO: 4023564 - RNA, 14 nt, Measles virus
cagagauucacuga

SEQ ID NO: 4023565 - RNA, 16 nt, Measles virus
cagagggagcccccaa

SEQ ID NO: 4023566 - RNA, 17 nt, Measles virus
cagaguccagaccaccc

SEQ ID NO: 4023567 - RNA, 19 nt, Measles virus
cagauacuauacagaaauc

SEQ ID NO: 4023568 - RNA, 21 nt, Measles virus
cagauagggcugccagugaac

SEQ ID NO: 4023569 - RNA, 19 nt, Measles virus
cagcaacuggaaggccccu

SEQ ID NO: 4023570 - RNA, 16 nt, Measles virus
cagcacccagccaccg

SEQ ID NO: 4023571 - RNA, 20 nt, Measles virus
cagccccgacacaaggccac

SEQ ID NO: 4023572 - RNA, 21 nt, Measles virus
cagccccgacacaaggccacc

SEQ ID NO: 4023573 - RNA, 19 nt, Measles virus
cagcccucugucacaggga

SEQ ID NO: 4023574 - RNA, 16 nt, Measles virus
cagccgacaacuccag

SEQ ID NO: 4023575 - RNA, 17 nt, Measles virus
cagccgccagccaacca

SEQ ID NO: 4023576 - RNA, 16 nt, Measles virus
cagccuuggccaaaau

SEQ ID NO: 4023577 - RNA, 15 nt, Measles virus
caggaccgagccacc

SEQ ID NO: 4023578 - RNA, 20 nt, Measles virus
caggcaguucgggucucagc

SEQ ID NO: 4023579 - RNA, 20 nt, Measles virus
caggcauacccacuagugug

SEQ ID NO: 4023580 - RNA, 19 nt, Measles virus
cagggccaggugcaccugc

SEQ ID NO: 4023581 - RNA, 23 nt, Measles virus
cagggcuucugauguugaaacug

SEQ ID NO: 4023582 - RNA, 16 nt, Measles virus
caggggucagggaaag

SEQ ID NO: 4023583 - RNA, 19 nt, Measles virus
caguaacggcugcugaaaa

SEQ ID NO: 4023584 - RNA, 20 nt, Measles virus
caguaaugauuucagcaacu

SEQ ID NO: 4023585 - RNA, 20 nt, Measles virus
caguaucccacagccucucc

SEQ ID NO: 4023586 - RNA, 13 nt, Measles virus
caguggaggugau

SEQ ID NO: 4023587 - RNA, 15 nt, Measles virus
cauaaaauuaaugcc

SEQ ID NO: 4023588 - RNA, 15 nt, Measles virus
cauaaugacagccag

SEQ ID NO: 4023589 - RNA, 18 nt, Measles virus
cauaaugacagccagaag

SEQ ID NO: 4023590 - RNA, 19 nt, Measles virus
cauaaugacagccagaagg

SEQ ID NO: 4023591 - RNA, 15 nt, Measles virus
cauacaucugacagg

SEQ ID NO: 4023592 - RNA, 13 nt, Measles virus
caucaggucaagg

SEQ ID NO: 4023593 - RNA, 14 nt, Measles virus
cauccagcaucaag

SEQ ID NO: 4023594 - RNA, 13 nt, Measles virus
cauccgcggucag

SEQ ID NO: 4023595 - RNA, 15 nt, Measles virus
caucucacagaggug

SEQ ID NO: 4023596 - RNA, 11 nt, Measles virus
caugcuuccag

SEQ ID NO: 4023597 - RNA, 13 nt, Measles virus
cauguggaaacug

SEQ ID NO: 4023598 - RNA, 13 nt, Measles virus
cauuauuugcaau

SEQ ID NO: 4023599 - RNA, 18 nt, Measles virus
cauuguuauaaaaaacuu

SEQ ID NO: 4023600 - RNA, 19 nt, Measles virus
ccaaaauacacgaggauaa

SEQ ID NO: 4023601 - RNA, 16 nt, Measles virus
ccaaaggagacaccgg

SEQ ID NO: 4023602 - RNA, 22 nt, Measles virus
ccaaccgacaugcgauccuggg

SEQ ID NO: 4023603 - RNA, 15 nt, Measles virus
ccaagcgagaggcca

SEQ ID NO: 4023604 - RNA, 17 nt, Measles virus
ccaagcgagaggccagc

SEQ ID NO: 4023605 - RNA, 20 nt, Measles virus
ccaagcgagaggccagccag

SEQ ID NO: 4023606 - RNA, 22 nt, Measles virus
ccaagcgagaggccagccagca

SEQ ID NO: 4023607 - RNA, 23 nt, Measles virus
ccaagcgagaggccagccagcag

SEQ ID NO: 4023608 - RNA, 22 nt, Measles virus
ccaagucccccggucuccuccu

SEQ ID NO: 4023609 - RNA, 22 nt, Measles virus
ccaaucaguuccuagcugucuc

SEQ ID NO: 4023610 - RNA, 24 nt, Measles virus
ccaaucaguuccuagcugucucaa

SEQ ID NO: 4023611 - RNA, 15 nt, Measles virus
ccaauccagaggcaa

SEQ ID NO: 4023612 - RNA, 15 nt, Measles virus
ccaaugccugaggga

SEQ ID NO: 4023613 - RNA, 15 nt, Measles virus
ccacagcucccggga

SEQ ID NO: 4023614 - RNA, 15 nt, Measles virus
ccacagcugcucaga

SEQ ID NO: 4023615 - RNA, 12 nt, Measles virus
ccacccuggaag

SEQ ID NO: 4023616 - RNA, 14 nt, Measles virus
ccacccuggaagga

SEQ ID NO: 4023617 - RNA, 15 nt, Measles virus
ccacccugggccacc

SEQ ID NO: 4023618 - RNA, 18 nt, Measles virus
ccacccugggccaccagc

SEQ ID NO: 4023619 - RNA, 14 nt, Measles virus
ccaccggcuagagg

SEQ ID NO: 4023620 - RNA, 23 nt, Measles virus
ccacucaacccgaaccagcaccc

SEQ ID NO: 4023621 - RNA, 20 nt, Measles virus
ccacugauggauaucaauga

SEQ ID NO: 4023622 - RNA, 16 nt, Measles virus
ccagaaggcccggaca

SEQ ID NO: 4023623 - RNA, 14 nt, Measles virus
ccagagagaaucaa

SEQ ID NO: 4023624 - RNA, 15 nt, Measles virus
ccagcacccaagagc

SEQ ID NO: 4023625 - RNA, 14 nt, Measles virus
ccagcacccagcca

SEQ ID NO: 4023626 - RNA, 13 nt, Measles virus
ccagccagcagcc

SEQ ID NO: 4023627 - RNA, 16 nt, Measles virus
ccagcuuacgggaccc

SEQ ID NO: 4023628 - RNA, 23 nt, Measles virus
ccaggcaguuuugcagccaucag

SEQ ID NO: 4023629 - RNA, 22 nt, Measles virus
ccauccaagucgggagcaggag

SEQ ID NO: 4023630 - RNA, 22 nt, Measles virus
ccauuccuggacuugggaagga

SEQ ID NO: 4023631 - RNA, 16 nt, Measles virus
cccacagccucuccaa

SEQ ID NO: 4023632 - RNA, 17 nt, Measles virus
cccacuacaaucagagg

SEQ ID NO: 4023633 - RNA, 20 nt, Measles virus
cccacucucauauuccauau

SEQ ID NO: 4023634 - RNA, 21 nt, Measles virus
cccagaccccggcccgcggca

SEQ ID NO: 4023635 - RNA, 17 nt, Measles virus
cccagacucggccauca

SEQ ID NO: 4023636 - RNA, 15 nt, Measles virus
cccagcaauacccga

SEQ ID NO: 4023637 - RNA, 18 nt, Measles virus
cccagcacccagccaccg

SEQ ID NO: 4023638 - RNA, 15 nt, Measles virus
cccagccaccgacaa

SEQ ID NO: 4023639 - RNA, 12 nt, Measles virus
cccagcuuuguc

SEQ ID NO: 4023640 - RNA, 19 nt, Measles virus
ccccaaaaaaaggccccca

SEQ ID NO: 4023641 - RNA, 13 nt, Measles virus
ccccacagcuccc

SEQ ID NO: 4023642 - RNA, 20 nt, Measles virus
ccccagcuuacgggacccca

SEQ ID NO: 4023643 - RNA, 21 nt, Measles virus
ccccaggggccgacagccagc

SEQ ID NO: 4023644 - RNA, 13 nt, Measles virus
cccccucccccaa

SEQ ID NO: 4023645 - RNA, 16 nt, Measles virus
ccccuagggccuccaa

SEQ ID NO: 4023646 - RNA, 19 nt, Measles virus
cccgaaaacgaccccccuc

SEQ ID NO: 4023647 - RNA, 20 nt, Measles virus
cccgaccagacccagcaccc

SEQ ID NO: 4023648 - RNA, 11 nt, Measles virus
cccgccagaga

SEQ ID NO: 4023649 - RNA, 13 nt, Measles virus
cccgcgcacccca

SEQ ID NO: 4023650 - RNA, 20 nt, Measles virus
cccuaggcguugccacagcu

SEQ ID NO: 4023651 - RNA, 12 nt, Measles virus
ccgaccagaccc

SEQ ID NO: 4023652 - RNA, 19 nt, Measles virus
ccgaggaacuccucaaaga

SEQ ID NO: 4023653 - RNA, 15 nt, Measles virus
ccgcuggacaccccg

SEQ ID NO: 4023654 - RNA, 22 nt, Measles virus
ccggcccccccggugcccacag

SEQ ID NO: 4023655 - RNA, 19 nt, Measles virus
ccgggaaucccagaaucaa

SEQ ID NO: 4023656 - RNA, 16 nt, Measles virus
ccucaagaaaucucca

SEQ ID NO: 4023657 - RNA, 23 nt, Measles virus
ccucccccaacgcaagaacccca

SEQ ID NO: 4023658 - RNA, 15 nt, Measles virus
ccucucaggaggaga

SEQ ID NO: 4023659 - RNA, 13 nt, Measles virus
ccucugucacagg

SEQ ID NO: 4023660 - RNA, 14 nt, Measles virus
ccugaggacaccuc

SEQ ID NO: 4023661 - RNA, 19 nt, Measles virus
ccugaggacaccucagaga

SEQ ID NO: 4023662 - RNA, 13 nt, Measles virus
ccugccaacccca

SEQ ID NO: 4023663 - RNA, 20 nt, Measles virus
ccugggccaccagcucccag

SEQ ID NO: 4023664 - RNA, 23 nt, Measles virus
ccuuagacagauccucucccccc

SEQ ID NO: 4023665 - RNA, 21 nt, Measles virus
cgaacucaaucccgaccugaa

SEQ ID NO: 4023666 - RNA, 22 nt, Measles virus
cgacuggagccgauggcagaag

SEQ ID NO: 4023667 - RNA, 18 nt, Measles virus
cgagcaucaggucaagga

SEQ ID NO: 4023668 - RNA, 19 nt, Measles virus
cgaggaagccauggcagca

SEQ ID NO: 4023669 - RNA, 21 nt, Measles virus
cgaggaagccauggcagcaug

SEQ ID NO: 4023670 - RNA, 14 nt, Measles virus
cgaucgagcaucag

SEQ ID NO: 4023671 - RNA, 14 nt, Measles virus
gggaaacugcucag

SEQ ID NO: 4023672 - RNA, 23 nt, Measles virus
gggaagaucaucgacaaugcaga

SEQ ID NO: 4023673 - RNA, 15 nt, Measles virus
gggaaucccagaauc

SEQ ID NO: 4023674 - RNA, 16 nt, Measles virus
gggagaaguugaguca

SEQ ID NO: 4023675 - RNA, 17 nt, Measles virus
gggcaccauugaaggau

SEQ ID NO: 4023676 - RNA, 20 nt, Measles virus
ggguuacaguguuaucaugu

SEQ ID NO: 4023677 - RNA, 21 nt, Measles virus
ggguuguugaggacagcgauc

SEQ ID NO: 4023678 - RNA, 19 nt, Measles virus
ggucaggaucuccaauaug

SEQ ID NO: 4023679 - RNA, 14 nt, Measles virus
ggucagggaucugg

SEQ ID NO: 4023680 - RNA, 15 nt, Measles virus
ggugaacucaacucu

SEQ ID NO: 4023681 - RNA, 15 nt, Measles virus
ggugccccaggucag

SEQ ID NO: 4023682 - RNA, 16 nt, Measles virus
gguuacucuggaggag

SEQ ID NO: 4023683 - RNA, 22 nt, Measles virus
guacagcagggcucaaugaaaa

SEQ ID NO: 4023684 - RNA, 22 nt, Measles virus
guaguuaggcauuauuugcaau

SEQ ID NO: 4023685 - RNA, 14 nt, Measles virus
gugaugucauagag

SEQ ID NO: 4023686 - RNA, 11 nt, Measles virus
gugcccacagg

SEQ ID NO: 4023687 - RNA, 21 nt, Measles virus
gugggacccccgaggaccaac

SEQ ID NO: 4023688 - RNA, 12 nt, Measles virus
gugugaaauaga

SEQ ID NO: 4023689 - RNA, 22 nt, Measles virus
guucaaccugucuuacagccug

SEQ ID NO: 4023690 - RNA, 20 nt, Measles virus
guuccuagcugucucaaagg

SEQ ID NO: 4023691 - RNA, 19 nt, Measles virus
guugaacuccggaacccua

SEQ ID NO: 4023692 - RNA, 21 nt, Measles virus
uaaagaaaacuuugaaaauac

SEQ ID NO: 4023693 - RNA, 22 nt, Measles virus
uaaccacugcuuuacugaaaua

SEQ ID NO: 4023694 - RNA, 14 nt, Measles virus
uaacggcugcugaa

SEQ ID NO: 4023695 - RNA, 18 nt, Measles virus
uaaucaagacccugacaa

SEQ ID NO: 4023696 - RNA, 16 nt, Measles virus
uaaugacagccagaag

SEQ ID NO: 4023697 - RNA, 15 nt, Measles virus
uacaaagacaaccca

SEQ ID NO: 4023698 - RNA, 19 nt, Measles virus
uacaaccuaaauccauuau

SEQ ID NO: 4023699 - RNA, 16 nt, Measles virus
uacagucaagacugag

SEQ ID NO: 4023700 - RNA, 12 nt, Measles virus
uacgaaguuucu

SEQ ID NO: 4023701 - RNA, 19 nt, Measles virus
uagagaugcacuuaaugca

SEQ ID NO: 4023702 - RNA, 12 nt, Measles virus
uagccaugcugg

SEQ ID NO: 4023703 - RNA, 19 nt, Measles virus
uagcugucucaaagggaaa

SEQ ID NO: 4023704 - RNA, 22 nt, Measles virus
uaggauaguuauuaacagagaa

SEQ ID NO: 4023705 - RNA, 20 nt, Measles virus
uagggaguacgacuucagag

SEQ ID NO: 4023706 - RNA, 17 nt, Measles virus
uagguaguuaggcauua

SEQ ID NO: 4023707 - RNA, 15 nt, Measles virus
uauaacucuccucaa

SEQ ID NO: 4023708 - RNA, 24 nt, Measles virus
uauacaaaaccaaccacaacaaug

SEQ ID NO: 4023709 - RNA, 18 nt, Measles virus
uauauuaaagaaaacuuu

SEQ ID NO: 4023710 - RNA, 19 nt, Measles virus
uaucccgccaaugaagaac

SEQ ID NO: 4023711 - RNA, 18 nt, Measles virus
uauguuuugcuggcuguu

SEQ ID NO: 4023712 - RNA, 21 nt, Measles virus
ucaaaacagccuuggccaaaa

SEQ ID NO: 4023713 - RNA, 17 nt, Measles virus
ucaacccgccagagaga

SEQ ID NO: 4023714 - RNA, 22 nt, Measles virus
ucaagaagcccguugccagccg

SEQ ID NO: 4023715 - RNA, 16 nt, Measles virus
ucaagacucauccagu

SEQ ID NO: 4023716 - RNA, 23 nt, Measles virus
ucaagcaaaaugggcugucccga

SEQ ID NO: 4023717 - RNA, 17 nt, Measles virus
ucaaggacgugcugaca

SEQ ID NO: 4023718 - RNA, 16 nt, Measles virus
ucaauuaagaagcaga

SEQ ID NO: 4023719 - RNA, 19 nt, Measles virus
ucacaugaugucacccaga

SEQ ID NO: 4023720 - RNA, 18 nt, Measles virus
ucagacaagcagggcagg

SEQ ID NO: 4023721 - RNA, 20 nt, Measles virus
ucagagauucacugaccuag

SEQ ID NO: 4023722 - RNA, 15 nt, Measles virus
ucagaguugucacaa

SEQ ID NO: 4023723 - RNA, 22 nt, Measles virus
ucagauacuauacagaaauccu

SEQ ID NO: 4023724 - RNA, 22 nt, Measles virus
ucagcauauccacccuggaagg

SEQ ID NO: 4023725 - RNA, 11 nt, Measles virus
ucagcuuccag

SEQ ID NO: 4023726 - RNA, 22 nt, Measles virus
ucagcuuccagcucgucaagcu

SEQ ID NO: 4023727 - RNA, 22 nt, Measles virus
ucaggauuuauuuaacauagaa

SEQ ID NO: 4023728 - RNA, 15 nt, Measles virus
ucaggggucagggaa

SEQ ID NO: 4023729 - RNA, 20 nt, Measles virus
ucaguaaggagucucaacau

SEQ ID NO: 4023730 - RNA, 15 nt, Measles virus
ucaucgacaaugcag

SEQ ID NO: 4023731 - RNA, 21 nt, Measles virus
ucaugauugccauuccuggac

SEQ ID NO: 4023732 - RNA, 15 nt, Measles virus
ucaugggucucaagg

SEQ ID NO: 4023733 - RNA, 19 nt, Measles virus
ucauuauuuggccccagcu

SEQ ID NO: 4023734 - RNA, 12 nt, Measles virus
uccaaagggaau

SEQ ID NO: 4023735 - RNA, 11 nt, Measles virus
uccaaauugua

SEQ ID NO: 4023736 - RNA, 19 nt, Measles virus
uccaagacuacaucaauaa

SEQ ID NO: 4023737 - RNA, 15 nt, Measles virus
uccaagcuagaauca

SEQ ID NO: 4023738 - RNA, 14 nt, Measles virus
uccacaaugucacc

SEQ ID NO: 4023739 - RNA, 14 nt, Measles virus
uccaccacauccga

SEQ ID NO: 4023740 - RNA, 21 nt, Measles virus
uccacucccacgacuggagcc

SEQ ID NO: 4023741 - RNA, 11 nt, Measles virus
uccagaagacu

SEQ ID NO: 4023742 - RNA, 20 nt, Measles virus
uccaugcugaacucucaagc

SEQ ID NO: 4023743 - RNA, 14 nt, Measles virus
uccccacagcuccc

SEQ ID NO: 4023744 - RNA, 19 nt, Measles virus
ucccccggucuccuccucu

SEQ ID NO: 4023745 - RNA, 17 nt, Measles virus
ucccgaccugaaaccca

SEQ ID NO: 4023746 - RNA, 17 nt, Measles virus
uccggaacccuaauccu

SEQ ID NO: 4023747 - RNA, 13 nt, Measles virus
uccuagcugucuc

SEQ ID NO: 4023748 - RNA, 19 nt, Measles virus
uccuccucgugggaccccc

SEQ ID NO: 4023749 - RNA, 19 nt, Measles virus
uccucgugggacccccgag

SEQ ID NO: 4023750 - RNA, 17 nt, Measles virus
uccugaaacuccaaucc

SEQ ID NO: 4023751 - RNA, 23 nt, Measles virus
ucgugggacccccgaggaccaac

SEQ ID NO: 4023752 - RNA, 17 nt, Measles virus
ucuacuggaggccaggg

SEQ ID NO: 4023753 - RNA, 14 nt, Measles virus
ucuauucccagcuu

SEQ ID NO: 4023754 - RNA, 13 nt, Measles virus
ucucaagcaucau

SEQ ID NO: 4023755 - RNA, 17 nt, Measles virus
ucugaaaacagcgaugu

SEQ ID NO: 4023756 - RNA, 20 nt, Measles virus
ucugacaaaauuaaauuccu

SEQ ID NO: 4023757 - RNA, 12 nt, Measles virus
ucugacaaugua

SEQ ID NO: 4023758 - RNA, 15 nt, Measles virus
ucuggugccgucacu

SEQ ID NO: 4023759 - RNA, 22 nt, Measles virus
ucuugugauuuaaucggccaga

SEQ ID NO: 4023760 - RNA, 16 nt, Measles virus
ugaaacacagauuucc

SEQ ID NO: 4023761 - RNA, 22 nt, Measles virus
ugaacuccggaacccuaauccu

SEQ ID NO: 4023762 - RNA, 16 nt, Measles virus
ugacaggggagauuuu

SEQ ID NO: 4023763 - RNA, 15 nt, Measles virus
ugacaucccagggaa

SEQ ID NO: 4023764 - RNA, 23 nt, Measles virus
ugacccucccccugcaugcugca

SEQ ID NO: 4023765 - RNA, 23 nt, Measles virus
ugagaugaggucagugauuaaau

SEQ ID NO: 4023766 - RNA, 17 nt, Measles virus
ugagggaggacaucaag

SEQ ID NO: 4023767 - RNA, 12 nt, Measles virus
ugaugacauaca

SEQ ID NO: 4023768 - RNA, 17 nt, Measles virus
ugcaacccaaugugcuc

SEQ ID NO: 4023769 - RNA, 22 nt, Measles virus
ugcaaggaagaggaggcaggca

SEQ ID NO: 4023770 - RNA, 16 nt, Measles virus
ugcagaacuucuagga

SEQ ID NO: 4023771 - RNA, 15 nt, Measles virus
ugcaucaauccucug

SEQ ID NO: 4023772 - RNA, 16 nt, Measles virus
ugccaaccccaugcca

SEQ ID NO: 4023773 - RNA, 15 nt, Measles virus
ugccacagcugcuca

SEQ ID NO: 4023774 - RNA, 21 nt, Measles virus
ugcccaauauaacucuccuca

SEQ ID NO: 4023775 - RNA, 13 nt, Measles virus
ugccucucagcaa

SEQ ID NO: 4023776 - RNA, 12 nt, Measles virus
ugcgauccuggg

SEQ ID NO: 4023777 - RNA, 20 nt, Measles virus
ugcggagauauccauccagg

SEQ ID NO: 4023778 - RNA, 21 nt, Measles virus
ugcuccaagaaugccuccggg

SEQ ID NO: 4023779 - RNA, 17 nt, Measles virus
ugcucuccaaagggaau

SEQ ID NO: 4023780 - RNA, 14 nt, Measles virus
ugcugaacucucaa

SEQ ID NO: 4023781 - RNA, 16 nt, Measles virus
ugcugcagacacaauc

SEQ ID NO: 4023782 - RNA, 21 nt, Measles virus
ugcugcucuccaaagggaaug

SEQ ID NO: 4023783 - RNA, 19 nt, Measles virus
uggagacaugcuuccagca

SEQ ID NO: 4023784 - RNA, 17 nt, Measles virus
uggaggaugccaaggaa

SEQ ID NO: 4023785 - RNA, 18 nt, Measles virus
uggcaaguauuuuaagga

SEQ ID NO: 4023786 - RNA, 18 nt, Measles virus
uggccgucgaggaagcca

SEQ ID NO: 4023787 - RNA, 13 nt, Measles virus
uggcugcugaaga

SEQ ID NO: 4023788 - RNA, 23 nt, Measles virus
ugggcaugggagucagcugcaca

SEQ ID NO: 4023789 - RNA, 16 nt, Measles virus
uguaccuaaaggacaa

SEQ ID NO: 4023790 - RNA, 21 nt, Measles virus
uuaagucgagguuacaaugug

SEQ ID NO: 4023791 - RNA, 16 nt, Measles virus
aaacuuugaaaauacg

SEQ ID NO: 4023792 - RNA, 18 nt, Measles virus
aaacuuugaaaauacgaa

SEQ ID NO: 4023793 - RNA, 15 nt, Measles virus
aaagaaaacuuugaa

SEQ ID NO: 4023794 - RNA, 13 nt, Measles virus
aaagaucucaaag

SEQ ID NO: 4023795 - RNA, 18 nt, Measles virus
aaaggaacccccagcaac

SEQ ID NO: 4023796 - RNA, 19 nt, Measles virus
aaaggugucagcuuccagc

SEQ ID NO: 4023797 - RNA, 14 nt, Measles virus
aaauacgaaguuuc

SEQ ID NO: 4023798 - RNA, 17 nt, Measles virus
aaauacgaaguuucuau

SEQ ID NO: 4023799 - RNA, 20 nt, Measles virus
aaaugauuauaaacaaugug

SEQ ID NO: 4023800 - RNA, 20 nt, Measles virus
aaaugccuucuacaaagaca

SEQ ID NO: 4023801 - RNA, 14 nt, Measles virus
aaauucgcagcccu

SEQ ID NO: 4023802 - RNA, 20 nt, Measles virus
aacagccuuggccaaaauac

SEQ ID NO: 4023803 - RNA, 22 nt, Measles virus
aaccagagggagcccccaacca

SEQ ID NO: 4023804 - RNA, 18 nt, Measles virus
aacccgcgcaccccagcc

SEQ ID NO: 4023805 - RNA, 17 nt, Measles virus
aacccuaauccugcccu

SEQ ID NO: 4023806 - RNA, 18 nt, Measles virus
aacccuaauccugcccua

SEQ ID NO: 4023807 - RNA, 20 nt, Measles virus
aaccgcacaagcgaccgagg

SEQ ID NO: 4023808 - RNA, 18 nt, Measles virus
aaccgcauccccacagcu

SEQ ID NO: 4023809 - RNA, 19 nt, Measles virus
aaccucuucacuguuccaa

SEQ ID NO: 4023810 - RNA, 24 nt, Measles virus
aagaaaacuuugaaaauacgaagu

SEQ ID NO: 4023811 - RNA, 16 nt, Measles virus
aagcaucaugauugcc

SEQ ID NO: 4023812 - RNA, 18 nt, Measles virus
aagcuaggugucuggaaa

SEQ ID NO: 4023813 - RNA, 19 nt, Measles virus
aagcuaggugucuggaaau

SEQ ID NO: 4023814 - RNA, 15 nt, Measles virus
aaggaaaggccacaa

SEQ ID NO: 4023815 - RNA, 15 nt, Measles virus
aaggaagauccguga

SEQ ID NO: 4023816 - RNA, 21 nt, Measles virus
aaggcccccaggggccgacag

SEQ ID NO: 4023817 - RNA, 13 nt, Measles virus
aagggagaaguug

SEQ ID NO: 4023818 - RNA, 17 nt, Measles virus
aauauauuaaagaaaac

SEQ ID NO: 4023819 - RNA, 17 nt, Measles virus
aaucccgaccugaaacc

SEQ ID NO: 4023820 - RNA, 22 nt, Measles virus
aauucgcuguacuccaaaguca

SEQ ID NO: 4023821 - RNA, 17 nt, Measles virus
acaaggaagauccguga

SEQ ID NO: 4023822 - RNA, 19 nt, Measles virus
acaaugucaccacaacgag

SEQ ID NO: 4023823 - RNA, 23 nt, Measles virus
acacaaggccaccaccagccauc

SEQ ID NO: 4023824 - RNA, 14 nt, Measles virus
acagaacagccccg

SEQ ID NO: 4023825 - RNA, 14 nt, Measles virus
acagagaucuacga

SEQ ID NO: 4023826 - RNA, 15 nt, Measles virus
acagcagggcucaau

SEQ ID NO: 4023827 - RNA, 14 nt, Measles virus
acaguagaacucag

SEQ ID NO: 4023828 - RNA, 15 nt, Measles virus
acauccuaagggaag

SEQ ID NO: 4023829 - RNA, 13 nt, Measles virus
acaugcuuccagc

SEQ ID NO: 4023830 - RNA, 16 nt, Measles virus
acaugcuuccagcagg

SEQ ID NO: 4023831 - RNA, 13 nt, Measles virus
accacugcuuuac

SEQ ID NO: 4023832 - RNA, 12 nt, Measles virus
accagacccagc

SEQ ID NO: 4023833 - RNA, 24 nt, Measles virus
accaguccaugcugaacucucaag

SEQ ID NO: 4023834 - RNA, 17 nt, Measles virus
acccacauccuaaggga

SEQ ID NO: 4023835 - RNA, 19 nt, Measles virus
acccgaaccagcacccaag

SEQ ID NO: 4023836 - RNA, 21 nt, Measles virus
acccgaaccagcacccaagag

SEQ ID NO: 4023837 - RNA, 15 nt, Measles virus
acccgccggcccccc

SEQ ID NO: 4023838 - RNA, 20 nt, Measles virus
acccugacaagauccuaaca

SEQ ID NO: 4023839 - RNA, 17 nt, Measles virus
accgaaccagaguccag

SEQ ID NO: 4023840 - RNA, 14 nt, Measles virus
accgcauccccaca

SEQ ID NO: 4023841 - RNA, 15 nt, Measles virus
accgcgcccccaccc

SEQ ID NO: 4023842 - RNA, 15 nt, Measles virus
accucgguccuccca

SEQ ID NO: 4023843 - RNA, 16 nt, Measles virus
accugcaacugaggga

SEQ ID NO: 4023844 - RNA, 20 nt, Measles virus
acgaucuugccaaguuccac

SEQ ID NO: 4023845 - RNA, 15 nt, Measles virus
acgcaagaaccccac

SEQ ID NO: 4023846 - RNA, 14 nt, Measles virus
acguacagcagggc

SEQ ID NO: 4023847 - RNA, 15 nt, Measles virus
acuaacccuccucac

SEQ ID NO: 4023848 - RNA, 21 nt, Measles virus
acuaacucgaucgagcaucag

SEQ ID NO: 4023849 - RNA, 20 nt, Measles virus
acucaacccgaaccagcacc

SEQ ID NO: 4023850 - RNA, 23 nt, Measles virus
acucaauuccccacccccaaagg

SEQ ID NO: 4023851 - RNA, 16 nt, Measles virus
acucccacgacuggag

SEQ ID NO: 4023852 - RNA, 22 nt, Measles virus
acuccuuagacagauccucucc

SEQ ID NO: 4023853 - RNA, 12 nt, Measles virus
acucuggaggag

SEQ ID NO: 4023854 - RNA, 21 nt, Measles virus
acugcagaugucgaacucaau

SEQ ID NO: 4023855 - RNA, 16 nt, Measles virus
acuuagggccaaggaa

SEQ ID NO: 4023856 - RNA, 16 nt, Measles virus
agaaaacuuugaaaau

SEQ ID NO: 4023857 - RNA, 21 nt, Measles virus
agaaucaaauuggauuaugau

SEQ ID NO: 4023858 - RNA, 22 nt, Measles virus
agaaucccgagugggcaccauu

SEQ ID NO: 4023859 - RNA, 12 nt, Measles virus
agacccugacaa

SEQ ID NO: 4023860 - RNA, 16 nt, Measles virus
agagcaagccuggaaa

SEQ ID NO: 4023861 - RNA, 17 nt, Measles virus
agagcaagccuggaaac

SEQ ID NO: 4023862 - RNA, 13 nt, Measles virus
agaggaggaucgg

SEQ ID NO: 4023863 - RNA, 16 nt, Measles virus
agaggaggcaggcagu

SEQ ID NO: 4023864 - RNA, 14 nt, Measles virus
agauaacagccggc

SEQ ID NO: 4023865 - RNA, 18 nt, Measles virus
agaucaacaggcaaaaua

SEQ ID NO: 4023866 - RNA, 20 nt, Measles virus
agaucucaaagaaagucaca

SEQ ID NO: 4023867 - RNA, 20 nt, Measles virus
agaugcacuuaaugcaauga

SEQ ID NO: 4023868 - RNA, 20 nt, Measles virus
agaugcugacucuaucaugg

SEQ ID NO: 4023869 - RNA, 13 nt, Measles virus
agauuucccacaa

SEQ ID NO: 4023870 - RNA, 23 nt, Measles virus
agauuuucucauuuuucagaagu

SEQ ID NO: 4023871 - RNA, 15 nt, Measles virus
agcaaagugauugcc

SEQ ID NO: 4023872 - RNA, 14 nt, Measles virus
agcacccucucagg

SEQ ID NO: 4023873 - RNA, 16 nt, Measles virus
agcagggcucaaugaa

SEQ ID NO: 4023874 - RNA, 16 nt, Measles virus
agcaguaaagggucag

SEQ ID NO: 4023875 - RNA, 14 nt, Measles virus
agcccaccugaaau

SEQ ID NO: 4023876 - RNA, 11 nt, Measles virus
agcccccucca

SEQ ID NO: 4023877 - RNA, 23 nt, Measles virus
agcccguugccagccgacaacuc

SEQ ID NO: 4023878 - RNA, 14 nt, Measles virus
agcccucugucaca

SEQ ID NO: 4023879 - RNA, 15 nt, Measles virus
agccuaaucugagca

SEQ ID NO: 4023880 - RNA, 13 nt, Measles virus
agccucagcacca

SEQ ID NO: 4023881 - RNA, 14 nt, Measles virus
agccugaaagaaaa

SEQ ID NO: 4023882 - RNA, 15 nt, Measles virus
caggcaucaagcacu

SEQ ID NO: 4023883 - RNA, 15 nt, Measles virus
cagguaggcacacca

SEQ ID NO: 4023884 - RNA, 15 nt, Measles virus
caguaucccacagcc

SEQ ID NO: 4023885 - RNA, 18 nt, Measles virus
caguaucccacagccucu

SEQ ID NO: 4023886 - RNA, 14 nt, Measles virus
cagucaguaaugau

SEQ ID NO: 4023887 - RNA, 13 nt, Measles virus
cauacuugccaua

SEQ ID NO: 4023888 - RNA, 15 nt, Measles virus
cauaucacucacucu

SEQ ID NO: 4023889 - RNA, 18 nt, Measles virus
cauaucacucacucuggg

SEQ ID NO: 4023890 - RNA, 21 nt, Measles virus
caucgcgaggaagcacaccca

SEQ ID NO: 4023891 - RNA, 21 nt, Measles virus
caucuuagagagcagaggaau

SEQ ID NO: 4023892 - RNA, 22 nt, Measles virus
caugaugucacccagacaucag

SEQ ID NO: 4023893 - RNA, 22 nt, Measles virus
caugccaagugaucgcugaaaa

SEQ ID NO: 4023894 - RNA, 17 nt, Measles virus
caugcuuccagcaggcg

SEQ ID NO: 4023895 - RNA, 21 nt, Measles virus
cauggcagcauggucagaaau

SEQ ID NO: 4023896 - RNA, 16 nt, Measles virus
cauuagaagcacaggc

SEQ ID NO: 4023897 - RNA, 16 nt, Measles virus
cauucgggucccugcc

SEQ ID NO: 4023898 - RNA, 20 nt, Measles virus
cauugcacuucaccagucca

SEQ ID NO: 4023899 - RNA, 22 nt, Measles virus
cauuguuauaaaaaacuuagga

SEQ ID NO: 4023900 - RNA, 18 nt, Measles virus
ccaagcgagaggccagcc

SEQ ID NO: 4023901 - RNA, 19 nt, Measles virus
ccaagcgagaggccagcca

SEQ ID NO: 4023902 - RNA, 15 nt, Measles virus
ccaaggaacacacac

SEQ ID NO: 4023903 - RNA, 19 nt, Measles virus
ccaauauaacucuccucaa

SEQ ID NO: 4023904 - RNA, 23 nt, Measles virus
ccaaucugcguccuccucguggg

SEQ ID NO: 4023905 - RNA, 18 nt, Measles virus
ccacacagccgccagcca

SEQ ID NO: 4023906 - RNA, 13 nt, Measles virus
ccacagcugcuca

SEQ ID NO: 4023907 - RNA, 18 nt, Measles virus
ccacagguaggcacacca

SEQ ID NO: 4023908 - RNA, 15 nt, Measles virus
ccaccagcucccaga

SEQ ID NO: 4023909 - RNA, 17 nt, Measles virus
ccaccagcucccagacu

SEQ ID NO: 4023910 - RNA, 13 nt, Measles virus
ccaccgacaaucc

SEQ ID NO: 4023911 - RNA, 20 nt, Measles virus
ccaccuacagugauggcagg

SEQ ID NO: 4023912 - RNA, 14 nt, Measles virus
ccagaaucaagacu

SEQ ID NO: 4023913 - RNA, 15 nt, Measles virus
ccagcacccagccac

SEQ ID NO: 4023914 - RNA, 15 nt, Measles virus
ccagcagccgacagc

SEQ ID NO: 4023915 - RNA, 18 nt, Measles virus
ccagcaggcguguaaggg

SEQ ID NO: 4023916 - RNA, 15 nt, Measles virus
ccagccagcagccga

SEQ ID NO: 4023917 - RNA, 19 nt, Measles virus
ccaggacaggaccgagcca

SEQ ID NO: 4023918 - RNA, 21 nt, Measles virus
ccaggcaguuuugcagccauc

SEQ ID NO: 4023919 - RNA, 15 nt, Measles virus
ccaggcaucaagcac

SEQ ID NO: 4023920 - RNA, 17 nt, Measles virus
ccaggcaucaagcacug

SEQ ID NO: 4023921 - RNA, 19 nt, Measles virus
ccaggcggcccaagcacag

SEQ ID NO: 4023922 - RNA, 22 nt, Measles virus
ccagucaguaaugauuucagca

SEQ ID NO: 4023923 - RNA, 17 nt, Measles virus
ccaguuccagaggacag

SEQ ID NO: 4023924 - RNA, 20 nt, Measles virus
ccauaucugcggagauaucc

SEQ ID NO: 4023925 - RNA, 14 nt, Measles virus
ccaucaccccgcaa

SEQ ID NO: 4023926 - RNA, 15 nt, Measles virus
ccaucaguuccucaa

SEQ ID NO: 4023927 - RNA, 13 nt, Measles virus
ccaucgacaaucu

SEQ ID NO: 4023928 - RNA, 22 nt, Measles virus
cccaaaaaaaggcccccagggg

SEQ ID NO: 4023929 - RNA, 21 nt, Measles virus
cccaaccgcaggcauccgacu

SEQ ID NO: 4023930 - RNA, 17 nt, Measles virus
cccaacgaccccacugc

SEQ ID NO: 4023931 - RNA, 18 nt, Measles virus
cccaacgcaagaacccca

SEQ ID NO: 4023932 - RNA, 22 nt, Measles virus
cccaagcacagaacagccccga

SEQ ID NO: 4023933 - RNA, 22 nt, Measles virus
cccagaaucaagacucauccag

SEQ ID NO: 4023934 - RNA, 15 nt, Measles virus
cccaguagggccagc

SEQ ID NO: 4023935 - RNA, 16 nt, Measles virus
cccaguagggccagca

SEQ ID NO: 4023936 - RNA, 18 nt, Measles virus
cccauuaaaaagggcaca

SEQ ID NO: 4023937 - RNA, 21 nt, Measles virus
cccauuaaaaagggcacagac

SEQ ID NO: 4023938 - RNA, 18 nt, Measles virus
ccccaguagggccagcac

SEQ ID NO: 4023939 - RNA, 16 nt, Measles virus
ccccgaaaaccagagg

SEQ ID NO: 4023940 - RNA, 21 nt, Measles virus
ccccgauccggcgggcagcca

SEQ ID NO: 4023941 - RNA, 16 nt, Measles virus
cccgaaccagcaccca

SEQ ID NO: 4023942 - RNA, 21 nt, Measles virus
cccggacaaaaaagcccccuc

SEQ ID NO: 4023943 - RNA, 23 nt, Measles virus
cccgggaaaggaacccccagcaa

SEQ ID NO: 4023944 - RNA, 18 nt, Measles virus
cccuaggcguugccacag

SEQ ID NO: 4023945 - RNA, 16 nt, Measles virus
ccgaacacagaccacc

SEQ ID NO: 4023946 - RNA, 16 nt, Measles virus
ccgaggaacuccucaa

SEQ ID NO: 4023947 - RNA, 15 nt, Measles virus
ccgcagugcccagca

SEQ ID NO: 4023948 - RNA, 16 nt, Measles virus
ccgcccccgaacccca

SEQ ID NO: 4023949 - RNA, 15 nt, Measles virus
ccggcgggcagccac

SEQ ID NO: 4023950 - RNA, 14 nt, Measles virus
ccgguguuccauau

SEQ ID NO: 4023951 - RNA, 21 nt, Measles virus
ccguuauggacucgcuaucug

SEQ ID NO: 4023952 - RNA, 19 nt, Measles virus
ccuaucaggggucagggaa

SEQ ID NO: 4023953 - RNA, 18 nt, Measles virus
ccucacgcuuacagccug

SEQ ID NO: 4023954 - RNA, 18 nt, Measles virus
ccucucaucucacagagg

SEQ ID NO: 4023955 - RNA, 16 nt, Measles virus
ccucugucacagggaa

SEQ ID NO: 4023956 - RNA, 17 nt, Measles virus
ccucugucacagggaag

SEQ ID NO: 4023957 - RNA, 20 nt, Measles virus
ccugaaacccaucauaggca

SEQ ID NO: 4023958 - RNA, 14 nt, Measles virus
ccugcacucgggaa

SEQ ID NO: 4023959 - RNA, 17 nt, Measles virus
ccugcggggaauguccc

SEQ ID NO: 4023960 - RNA, 13 nt, Measles virus
cgaaccagcaccc

SEQ ID NO: 4023961 - RNA, 18 nt, Measles virus
cgaaguuucuauucccag

SEQ ID NO: 4023962 - RNA, 21 nt, Measles virus
cgaauaaaugccuucuacaaa

SEQ ID NO: 4023963 - RNA, 17 nt, Measles virus
cgaauuuugaugaguca

SEQ ID NO: 4023964 - RNA, 24 nt, Measles virus
cgacagcaaguguggacaccaggc

SEQ ID NO: 4023965 - RNA, 11 nt, Measles virus
cgacagccagc

SEQ ID NO: 4023966 - RNA, 16 nt, Measles virus
cgaccagacccagcac

SEQ ID NO: 4023967 - RNA, 22 nt, Measles virus
cgagauucaagguuagucccaa

SEQ ID NO: 4023968 - RNA, 15 nt, Measles virus
cgaggaacuccucaa

SEQ ID NO: 4023969 - RNA, 23 nt, Measles virus
cgaggaacuccucaaagaggcca

SEQ ID NO: 4023970 - RNA, 12 nt, Measles virus
cgaggaagccau

SEQ ID NO: 4023971 - RNA, 21 nt, Measles virus
cgcauccccacagcucccggg

SEQ ID NO: 4023972 - RNA, 16 nt, Measles virus
cgcccccaccccccga

SEQ ID NO: 4023973 - RNA, 21 nt, Measles virus
cgcuggacaccccgcagaggu

SEQ ID NO: 4023974 - RNA, 13 nt, Measles virus
cggauucuccaac

SEQ ID NO: 4023975 - RNA, 15 nt, Measles virus
cggcuucccucuggc

SEQ ID NO: 4023976 - RNA, 19 nt, Measles virus
cgggaaaggaacccccagc

SEQ ID NO: 4023977 - RNA, 13 nt, Measles virus
cguacagcagggc

SEQ ID NO: 4023978 - RNA, 19 nt, Measles virus
cguugccacagcugcucag

SEQ ID NO: 4023979 - RNA, 23 nt, Measles virus
cuaaguuggaggaugccaaggaa

SEQ ID NO: 4023980 - RNA, 22 nt, Measles virus
cuacaccgcagagauccauaag

SEQ ID NO: 4023981 - RNA, 21 nt, Measles virus
cuaccuccaugacccugaguu

SEQ ID NO: 4023982 - RNA, 14 nt, Measles virus
cuacuggaggccag

SEQ ID NO: 4023983 - RNA, 16 nt, Measles virus
cuacuggaggccaggg

SEQ ID NO: 4023984 - RNA, 16 nt, Measles virus
cuaggcguugccacag

SEQ ID NO: 4023985 - RNA, 17 nt, Measles virus
cuagguaguuaggcauu

SEQ ID NO: 4023986 - RNA, 17 nt, Measles virus
cuaucccgccaaugaag

SEQ ID NO: 4023987 - RNA, 23 nt, Measles virus
cucaaagggaaacugcucagggc

SEQ ID NO: 4023988 - RNA, 16 nt, Measles virus
cucaaauugcucagau

SEQ ID NO: 4023989 - RNA, 18 nt, Measles virus
cucaacuuaccugccaac

SEQ ID NO: 4023990 - RNA, 13 nt, Measles virus
cucacucugggau

SEQ ID NO: 4023991 - RNA, 17 nt, Measles virus
cucaguuccaaucuggu

SEQ ID NO: 4023992 - RNA, 16 nt, Measles virus
cuccaauccagaggca

SEQ ID NO: 4023993 - RNA, 16 nt, Measles virus
cuccaucgugcagcca

SEQ ID NO: 4023994 - RNA, 19 nt, Measles virus
cuccaucgugcagccaucu

SEQ ID NO: 4023995 - RNA, 20 nt, Measles virus
cuccggaacccuaauccugc

SEQ ID NO: 4023996 - RNA, 18 nt, Measles virus
cuccggggguccaccaag

SEQ ID NO: 4023997 - RNA, 14 nt, Measles virus
cuccuuagacagau

SEQ ID NO: 4023998 - RNA, 12 nt, Measles virus
cucguuccagcc

SEQ ID NO: 4023999 - RNA, 15 nt, Measles virus
cucguuccagccauc

SEQ ID NO: 4024000 - RNA, 14 nt, Measles virus
cucugcuccaagaa

SEQ ID NO: 4024001 - RNA, 22 nt, Measles virus
cucugggauggugggcauggga

SEQ ID NO: 4024002 - RNA, 14 nt, Measles virus
cucugucacaggga

SEQ ID NO: 4024003 - RNA, 15 nt, Measles virus
cucugucacagggaa

SEQ ID NO: 4024004 - RNA, 20 nt, Measles virus
cugaugacucuccuugauga

SEQ ID NO: 4024005 - RNA, 19 nt, Measles virus
cuggaaggccccucccccc

SEQ ID NO: 4024006 - RNA, 20 nt, Measles virus
cuggagccacuuucacuugc

SEQ ID NO: 4024007 - RNA, 13 nt, Measles virus
cugggccaccagc

SEQ ID NO: 4024008 - RNA, 18 nt, Measles virus
agcgagaggccagccagc

SEQ ID NO: 4024009 - RNA, 18 nt, Measles virus
agcuaggugucuggaaau

SEQ ID NO: 4024010 - RNA, 14 nt, Measles virus
agcuauccuggagu

SEQ ID NO: 4024011 - RNA, 13 nt, Measles virus
aggaacccccagc

SEQ ID NO: 4024012 - RNA, 13 nt, Measles virus
aggacagcugcug

SEQ ID NO: 4024013 - RNA, 13 nt, Measles virus
aggaccaaccccg

SEQ ID NO: 4024014 - RNA, 20 nt, Measles virus
aggagacuacugagaacagu

SEQ ID NO: 4024015 - RNA, 17 nt, Measles virus
aggcacaccaacccccg

SEQ ID NO: 4024016 - RNA, 18 nt, Measles virus
aggcauuauuugcaauau

SEQ ID NO: 4024017 - RNA, 20 nt, Measles virus
aggcccggacaaaaaagccc

SEQ ID NO: 4024018 - RNA, 16 nt, Measles virus
aggcguugccacagcu

SEQ ID NO: 4024019 - RNA, 16 nt, Measles virus
agggaaacugcucagg

SEQ ID NO: 4024020 - RNA, 23 nt, Measles virus
agguaguuaggcauuauuugcaa

SEQ ID NO: 4024021 - RNA, 17 nt, Measles virus
aggugacccaaccgcag

SEQ ID NO: 4024022 - RNA, 13 nt, Measles virus
agucagugauaag

SEQ ID NO: 4024023 - RNA, 18 nt, Measles virus
agucccaaccucuucacu

SEQ ID NO: 4024024 - RNA, 19 nt, Measles virus
agucccccggucuccuccu

SEQ ID NO: 4024025 - RNA, 22 nt, Measles virus
agucgagguuacaaugugucau

SEQ ID NO: 4024026 - RNA, 17 nt, Measles virus
agucgggagcaggaggu

SEQ ID NO: 4024027 - RNA, 21 nt, Measles virus
agugcguugauaacuggaaau

SEQ ID NO: 4024028 - RNA, 19 nt, Measles virus
aguggacacccgaaucugg

SEQ ID NO: 4024029 - RNA, 13 nt, Measles virus
aguuaggcauuau

SEQ ID NO: 4024030 - RNA, 15 nt, Measles virus
aguuccuagcugucu

SEQ ID NO: 4024031 - RNA, 16 nt, Measles virus
aguuucuauucccagc

SEQ ID NO: 4024032 - RNA, 20 nt, Measles virus
aguuucuauucccagcuuug

SEQ ID NO: 4024033 - RNA, 18 nt, Measles virus
auaaaugccuucuacaaa

SEQ ID NO: 4024034 - RNA, 18 nt, Measles virus
auaacugaugacauacau

SEQ ID NO: 4024035 - RNA, 21 nt, Measles virus
auacaggagacuacugagaac

SEQ ID NO: 4024036 - RNA, 20 nt, Measles virus
auacgaaguuucuauuccca

SEQ ID NO: 4024037 - RNA, 12 nt, Measles virus
auagacaucaga

SEQ ID NO: 4024038 - RNA, 13 nt, Measles virus
auauuaaagaaaa

SEQ ID NO: 4024039 - RNA, 15 nt, Measles virus
aucacaagggaaccu

SEQ ID NO: 4024040 - RNA, 23 nt, Measles virus
aucacaagggaaccuaauagcca

SEQ ID NO: 4024041 - RNA, 20 nt, Measles virus
aucagaagauaaucuccaag

SEQ ID NO: 4024042 - RNA, 19 nt, Measles virus
aucagaggucaauucucaa

SEQ ID NO: 4024043 - RNA, 17 nt, Measles virus
aucaguaaggagucuca

SEQ ID NO: 4024044 - RNA, 15 nt, Measles virus
aucaguaucccacag

SEQ ID NO: 4024045 - RNA, 14 nt, Measles virus
auccacccuggaag

SEQ ID NO: 4024046 - RNA, 17 nt, Measles virus
auccacccuggaaggac

SEQ ID NO: 4024047 - RNA, 19 nt, Measles virus
auccagccggcuagaggag

SEQ ID NO: 4024048 - RNA, 17 nt, Measles virus
aucccugggggaccccc

SEQ ID NO: 4024049 - RNA, 23 nt, Measles virus
aucgcugaaaaucuaaucucaaa

SEQ ID NO: 4024050 - RNA, 13 nt, Measles virus
aucucaaagaaag

SEQ ID NO: 4024051 - RNA, 16 nt, Measles virus
aucugagagcaagccu

SEQ ID NO: 4024052 - RNA, 22 nt, Measles virus
augacaaguugcgaauggagac

SEQ ID NO: 4024053 - RNA, 15 nt, Measles virus
augcaaugacccaga

SEQ ID NO: 4024054 - RNA, 12 nt, Measles virus
augccucucagc

SEQ ID NO: 4024055 - RNA, 19 nt, Measles virus
augccucuuagccuggaca

SEQ ID NO: 4024056 - RNA, 23 nt, Measles virus
auggacucgcuaucugucaacca

SEQ ID NO: 4024057 - RNA, 18 nt, Measles virus
auggagacaugcuuccag

SEQ ID NO: 4024058 - RNA, 21 nt, Measles virus
auggcaggcuggugccccagg

SEQ ID NO: 4024059 - RNA, 21 nt, Measles virus
augucaaaaacggacuggaau

SEQ ID NO: 4024060 - RNA, 18 nt, Measles virus
auguggaaguugggaaug

SEQ ID NO: 4024061 - RNA, 13 nt, Measles virus
auguuuacagccc

SEQ ID NO: 4024062 - RNA, 21 nt, Measles virus
auuaaagaaaacuuugaaaau

SEQ ID NO: 4024063 - RNA, 21 nt, Measles virus
auuaagaagcagaucaacagg

SEQ ID NO: 4024064 - RNA, 23 nt, Measles virus
auuagaagcacaggcaaaaugag

SEQ ID NO: 4024065 - RNA, 20 nt, Measles virus
auucgcagcccucugucaca

SEQ ID NO: 4024066 - RNA, 19 nt, Measles virus
auuugcaauauauuaaaga

SEQ ID NO: 4024067 - RNA, 13 nt, Measles virus
auuuuaaggacaa

SEQ ID NO: 4024068 - RNA, 14 nt, Measles virus
auuuugagcaacca

SEQ ID NO: 4024069 - RNA, 20 nt, Measles virus
caaaacagccuuggccaaaa

SEQ ID NO: 4024070 - RNA, 14 nt, Measles virus
caaaauugcuucag

SEQ ID NO: 4024071 - RNA, 18 nt, Measles virus
caaacaugucgcuguccc

SEQ ID NO: 4024072 - RNA, 19 nt, Measles virus
caaaccgcaaaagacauca

SEQ ID NO: 4024073 - RNA, 18 nt, Measles virus
caaccauccacucccacg

SEQ ID NO: 4024074 - RNA, 21 nt, Measles virus
caacccgaaccagcacccaag

SEQ ID NO: 4024075 - RNA, 23 nt, Measles virus
caaccgacaugcgauccuggguc

SEQ ID NO: 4024076 - RNA, 18 nt, Measles virus
caaccgcauccccacagc

SEQ ID NO: 4024077 - RNA, 18 nt, Measles virus
caaccugucuuacagccu

SEQ ID NO: 4024078 - RNA, 20 nt, Measles virus
caaccugucuuacagccuga

SEQ ID NO: 4024079 - RNA, 16 nt, Measles virus
caacuccagggaauga

SEQ ID NO: 4024080 - RNA, 17 nt, Measles virus
caagaaaucuccaggca

SEQ ID NO: 4024081 - RNA, 16 nt, Measles virus
caagacggggggcccc

SEQ ID NO: 4024082 - RNA, 16 nt, Measles virus
caagauccuaacauac

SEQ ID NO: 4024083 - RNA, 19 nt, Measles virus
caagcaaaaugggcugucc

SEQ ID NO: 4024084 - RNA, 17 nt, Measles virus
caagcgaccgaggugac

SEQ ID NO: 4024085 - RNA, 14 nt, Measles virus
caagcgagaggcca

SEQ ID NO: 4024086 - RNA, 19 nt, Measles virus
caagcgagaggccagccag

SEQ ID NO: 4024087 - RNA, 17 nt, Measles virus
caaggacgugcugacac

SEQ ID NO: 4024088 - RNA, 20 nt, Measles virus
caaggccaccaccagccauc

SEQ ID NO: 4024089 - RNA, 18 nt, Measles virus
caaguauuuuaaggacaa

SEQ ID NO: 4024090 - RNA, 23 nt, Measles virus
caagucccccggucuccuccucu

SEQ ID NO: 4024091 - RNA, 15 nt, Measles virus
caaucaaggaagcag

SEQ ID NO: 4024092 - RNA, 17 nt, Measles virus
caaucagacaagcaggg

SEQ ID NO: 4024093 - RNA, 19 nt, Measles virus
caaucagacaagcagggca

SEQ ID NO: 4024094 - RNA, 23 nt, Measles virus
caaucaguuccuagcugucucaa

SEQ ID NO: 4024095 - RNA, 13 nt, Measles virus
caaugaagaccuu

SEQ ID NO: 4024096 - RNA, 21 nt, Measles virus
cacaacccgcgcaccccagcc

SEQ ID NO: 4024097 - RNA, 18 nt, Measles virus
cacaaggccaccaccagc

SEQ ID NO: 4024098 - RNA, 20 nt, Measles virus
cacagacgcgagauuggccu

SEQ ID NO: 4024099 - RNA, 21 nt, Measles virus
caccaaccgcauccccacagc

SEQ ID NO: 4024100 - RNA, 14 nt, Measles virus
caccacucuucaag

SEQ ID NO: 4024101 - RNA, 23 nt, Measles virus
caccaggcggcccaagcacagaa

SEQ ID NO: 4024102 - RNA, 21 nt, Measles virus
cacccaagagcgaucccuggg

SEQ ID NO: 4024103 - RNA, 16 nt, Measles virus
caccccccgaaaacca

SEQ ID NO: 4024104 - RNA, 19 nt, Measles virus
caccccccgaaaaccagag

SEQ ID NO: 4024105 - RNA, 13 nt, Measles virus
caccucagagauu

SEQ ID NO: 4024106 - RNA, 14 nt, Measles virus
cacgcuuacagccu

SEQ ID NO: 4024107 - RNA, 15 nt, Measles virus
cacuaacccuccuca

SEQ ID NO: 4024108 - RNA, 23 nt, Measles virus
cacucaacccgaaccagcaccca

SEQ ID NO: 4024109 - RNA, 17 nt, Measles virus
cacucaauuccccaccc

SEQ ID NO: 4024110 - RNA, 18 nt, Measles virus
cacuggccgucgaggaag

SEQ ID NO: 4024111 - RNA, 13 nt, Measles virus
cacuuaaugcaau

SEQ ID NO: 4024112 - RNA, 19 nt, Measles virus
cacuuaaugcaaugaccca

SEQ ID NO: 4024113 - RNA, 14 nt, Measles virus
cagaacaacauccg

SEQ ID NO: 4024114 - RNA, 21 nt, Measles virus
cagaacaacauccgccuaccc

SEQ ID NO: 4024115 - RNA, 12 nt, Measles virus
cagaacccagac

SEQ ID NO: 4024116 - RNA, 23 nt, Measles virus
cagaagauaaucuccaagcuaga

SEQ ID NO: 4024117 - RNA, 15 nt, Measles virus
cagaaucaagacuca

SEQ ID NO: 4024118 - RNA, 22 nt, Measles virus
cagaccacccugggccaccagc

SEQ ID NO: 4024119 - RNA, 13 nt, Measles virus
cagacccagcacc

SEQ ID NO: 4024120 - RNA, 14 nt, Measles virus
cagacccagcaccc

SEQ ID NO: 4024121 - RNA, 18 nt, Measles virus
cagacucggccaucaccc

SEQ ID NO: 4024122 - RNA, 17 nt, Measles virus
cagaggucaauucucaa

SEQ ID NO: 4024123 - RNA, 11 nt, Measles virus
cagauccucuc

SEQ ID NO: 4024124 - RNA, 22 nt, Measles virus
cagaugucgaacucaaucccga

SEQ ID NO: 4024125 - RNA, 18 nt, Measles virus
cagauguggcugcugaag

SEQ ID NO: 4024126 - RNA, 18 nt, Measles virus
cagcaaguguggacacca

SEQ ID NO: 4024127 - RNA, 23 nt, Measles virus
cagcaauuggaucaacugaaggc

SEQ ID NO: 4024128 - RNA, 18 nt, Measles virus
cagccaucaguuccucaa

SEQ ID NO: 4024129 - RNA, 22 nt, Measles virus
cagcuuccagcucgucaagcua

SEQ ID NO: 4024130 - RNA, 17 nt, Measles virus
caggaccgagccaccug

SEQ ID NO: 4024131 - RNA, 19 nt, Measles virus
caggaccgagccaccugca

SEQ ID NO: 4024132 - RNA, 23 nt, Measles virus
caggcaguuuugcagccaucagu

SEQ ID NO: 4024133 - RNA, 12 nt, Measles virus
uaacaggauucc

SEQ ID NO: 4024134 - RNA, 13 nt, Measles virus
uaaggagucucaa

SEQ ID NO: 4024135 - RNA, 14 nt, Measles virus
uaaucaacacauug

SEQ ID NO: 4024136 - RNA, 24 nt, Measles virus
uacaaugugucaucuauagucacu

SEQ ID NO: 4024137 - RNA, 14 nt, Measles virus
uacccgaugagucc

SEQ ID NO: 4024138 - RNA, 17 nt, Measles virus
uaccugcaacugaggga

SEQ ID NO: 4024139 - RNA, 18 nt, Measles virus
uagcugucucaaagggaa

SEQ ID NO: 4024140 - RNA, 15 nt, Measles virus
uaggcauuauuugca

SEQ ID NO: 4024141 - RNA, 21 nt, Measles virus
uagggaguacgacuucagaga

SEQ ID NO: 4024142 - RNA, 15 nt, Measles virus
uauaggcucucaaga

SEQ ID NO: 4024143 - RNA, 23 nt, Measles virus
uaucaacggaugauccagugaua

SEQ ID NO: 4024144 - RNA, 16 nt, Measles virus
uaucaaugaagaccuu

SEQ ID NO: 4024145 - RNA, 13 nt, Measles virus
uauccauccaggc

SEQ ID NO: 4024146 - RNA, 22 nt, Measles virus
uaucgcugacaaucaagcaaaa

SEQ ID NO: 4024147 - RNA, 14 nt, Measles virus
uauuaacagagaac

SEQ ID NO: 4024148 - RNA, 14 nt, Measles virus
uauucccagcuuug

SEQ ID NO: 4024149 - RNA, 15 nt, Measles virus
ucaaagaggccacug

SEQ ID NO: 4024150 - RNA, 19 nt, Measles virus
ucaaagggaaacugcucag

SEQ ID NO: 4024151 - RNA, 19 nt, Measles virus
ucaaccugucuuacagccu

SEQ ID NO: 4024152 - RNA, 18 nt, Measles virus
ucaagaaaucuccaggca

SEQ ID NO: 4024153 - RNA, 22 nt, Measles virus
ucaagcaaccaccgcauccagc

SEQ ID NO: 4024154 - RNA, 14 nt, Measles virus
ucacacacgguuca

SEQ ID NO: 4024155 - RNA, 22 nt, Measles virus
ucacugaccuagugaaauucau

SEQ ID NO: 4024156 - RNA, 22 nt, Measles virus
ucacuggccgucgaggaagcca

SEQ ID NO: 4024157 - RNA, 19 nt, Measles virus
ucagacaacccaggacagg

SEQ ID NO: 4024158 - RNA, 19 nt, Measles virus
ucagacaagcagggcagga

SEQ ID NO: 4024159 - RNA, 18 nt, Measles virus
ucagaucggucaaugcag

SEQ ID NO: 4024160 - RNA, 17 nt, Measles virus
ucagcugcacagucacu

SEQ ID NO: 4024161 - RNA, 22 nt, Measles virus
ucaggcaauugaggcaaucaga

SEQ ID NO: 4024162 - RNA, 21 nt, Measles virus
ucagggcccacuacaaucaga

SEQ ID NO: 4024163 - RNA, 15 nt, Measles virus
ucaguaucccacagc

SEQ ID NO: 4024164 - RNA, 16 nt, Measles virus
ucauaaugacagccag

SEQ ID NO: 4024165 - RNA, 11 nt, Measles virus
ucaucaagcaa

SEQ ID NO: 4024166 - RNA, 20 nt, Measles virus
uccaagacggggggcccccc

SEQ ID NO: 4024167 - RNA, 16 nt, Measles virus
uccagaccacccuggg

SEQ ID NO: 4024168 - RNA, 15 nt, Measles virus
uccagaggacagcug

SEQ ID NO: 4024169 - RNA, 20 nt, Measles virus
uccaggcaguuuugcagcca

SEQ ID NO: 4024170 - RNA, 23 nt, Measles virus
uccaggcaguuuugcagccauca

SEQ ID NO: 4024171 - RNA, 21 nt, Measles virus
ucccgggaaaggaacccccag

SEQ ID NO: 4024172 - RNA, 14 nt, Measles virus
uccgauacaaccua

SEQ ID NO: 4024173 - RNA, 21 nt, Measles virus
uccggaacccuaauccugccc

SEQ ID NO: 4024174 - RNA, 16 nt, Measles virus
uccggguuugggggcu

SEQ ID NO: 4024175 - RNA, 16 nt, Measles virus
uccuaaaaaagggaaa

SEQ ID NO: 4024176 - RNA, 20 nt, Measles virus
ucggcaugggacaucaaagg

SEQ ID NO: 4024177 - RNA, 13 nt, Measles virus
ucuacaacaacac

SEQ ID NO: 4024178 - RNA, 17 nt, Measles virus
ucuauucccagcuuugu

SEQ ID NO: 4024179 - RNA, 13 nt, Measles virus
ucucaaagggaaa

SEQ ID NO: 4024180 - RNA, 17 nt, Measles virus
ucuccgauguccaagac

SEQ ID NO: 4024181 - RNA, 15 nt, Measles virus
ucugcguccuccucg

SEQ ID NO: 4024182 - RNA, 17 nt, Measles virus
ucuggagaaagcgauga

SEQ ID NO: 4024183 - RNA, 16 nt, Measles virus
ucuggcugucucagga

SEQ ID NO: 4024184 - RNA, 12 nt, Measles virus
ucugucaaccag

SEQ ID NO: 4024185 - RNA, 19 nt, Measles virus
ucuucacugguaguucagu

SEQ ID NO: 4024186 - RNA, 19 nt, Measles virus
ucuucucgaagggaccaaa

SEQ ID NO: 4024187 - RNA, 22 nt, Measles virus
ugaaauucaucucugacaaaau

SEQ ID NO: 4024188 - RNA, 15 nt, Measles virus
ugaacucaacucuac

SEQ ID NO: 4024189 - RNA, 21 nt, Measles virus
ugaagcaguaacggcugcuga

SEQ ID NO: 4024190 - RNA, 23 nt, Measles virus
ugacuaucccgccaaugaagaac

SEQ ID NO: 4024191 - RNA, 18 nt, Measles virus
ugagcuuaaaaucaaaau

SEQ ID NO: 4024192 - RNA, 24 nt, Measles virus
ugagcuugaucggguugcuagcca

SEQ ID NO: 4024193 - RNA, 16 nt, Measles virus
ugaggacaccucagag

SEQ ID NO: 4024194 - RNA, 17 nt, Measles virus
ugaggacaccucagaga

SEQ ID NO: 4024195 - RNA, 14 nt, Measles virus
ugauuauaaacaau

SEQ ID NO: 4024196 - RNA, 19 nt, Measles virus
ugauuauaaacaaugugga

SEQ ID NO: 4024197 - RNA, 16 nt, Measles virus
ugcaagaucauccaca

SEQ ID NO: 4024198 - RNA, 15 nt, Measles virus
ugcacuuaaugcaau

SEQ ID NO: 4024199 - RNA, 17 nt, Measles virus
ugcguccuccucguggg

SEQ ID NO: 4024200 - RNA, 20 nt, Measles virus
ugcugcagacacaauccgga

SEQ ID NO: 4024201 - RNA, 18 nt, Measles virus
ugcugccgaucacugccc

SEQ ID NO: 4024202 - RNA, 19 nt, Measles virus
ugcugcucuccaaagggaa

SEQ ID NO: 4024203 - RNA, 21 nt, Measles virus
uggcaguacuguuaacucucc

SEQ ID NO: 4024204 - RNA, 15 nt, Measles virus
ugggaaggaucccaa

SEQ ID NO: 4024205 - RNA, 16 nt, Measles virus
ugguaauucuaccugg

SEQ ID NO: 4024206 - RNA, 14 nt, Measles virus
ugguggacauauca

SEQ ID NO: 4024207 - RNA, 20 nt, Measles virus
uguaucaacccgccagagag

SEQ ID NO: 4024208 - RNA, 15 nt, Measles virus
ugucacagggaagau

SEQ ID NO: 4024209 - RNA, 19 nt, Measles virus
ugugucagaacaucaagca

SEQ ID NO: 4024210 - RNA, 18 nt, Measles virus
uguuaucgcugacaauca

SEQ ID NO: 4024211 - RNA, 19 nt, Measles virus
uuacaccguucccagaaga

SEQ ID NO: 4024212 - RNA, 14 nt, Measles virus
uuauaaacaaugug

SEQ ID NO: 4024213 - RNA, 15 nt, Measles virus
uuaucacaagggaac

SEQ ID NO: 4024214 - RNA, 19 nt, Measles virus
uuaugccucuuagccugga

SEQ ID NO: 4024215 - RNA, 14 nt, Measles virus
uucaagaagaccuu

SEQ ID NO: 4024216 - RNA, 18 nt, Measles virus
uucagaguguagcuucaa

SEQ ID NO: 4024217 - RNA, 19 nt, Measles virus
uucuauucccagcuuuguc

SEQ ID NO: 4024218 - RNA, 11 nt, Measles virus
uugcuggcugu

SEQ ID NO: 4024219 - RNA, 18 nt, Measles virus
uuggacguagggacaaau

SEQ ID NO: 4024220 - RNA, 16 nt, Measles virus
uuguagccaugcugga

SEQ ID NO: 4024221 - RNA, 19 nt, Measles virus
gguugcuagccauugcagg

SEQ ID NO: 4024222 - RNA, 22 nt, Measles virus
guacgacuucagagaucucacu

SEQ ID NO: 4024223 - RNA, 13 nt, Measles virus
guagaacucagag

SEQ ID NO: 4024224 - RNA, 15 nt, Measles virus
guagggccagcacuu

SEQ ID NO: 4024225 - RNA, 16 nt, Measles virus
gucaacaaggaagauc

SEQ ID NO: 4024226 - RNA, 16 nt, Measles virus
gucagggaucuggaga

SEQ ID NO: 4024227 - RNA, 15 nt, Measles virus
gucuuuugggaaccg

SEQ ID NO: 4024228 - RNA, 16 nt, Measles virus
gugaaauagacaucag

SEQ ID NO: 4024229 - RNA, 16 nt, Measles virus
gugucagcuuccagcu

SEQ ID NO: 4024230 - RNA, 22 nt, Measles virus
guguucuacaacaacaccccac

SEQ ID NO: 4024231 - RNA, 18 nt, Measles virus
guuacaguguuaucaugu

SEQ ID NO: 4024232 - RNA, 15 nt, Measles virus
guuccagaggacagc

SEQ ID NO: 4024233 - RNA, 18 nt, Measles virus
guugaaacugcagaagga

SEQ ID NO: 4024234 - RNA, 14 nt, Measles virus
guuucuauucccag

SEQ ID NO: 4024235 - RNA, 18 nt, Measles virus
guuucuauucccagcuuu

SEQ ID NO: 4024236 - RNA, 14 nt, Measles virus
uaaacaauguggaa

SEQ ID NO: 4024237 - RNA, 15 nt, Measles virus
uaaagggggucccaa

SEQ ID NO: 4024238 - RNA, 17 nt, Measles virus
uaacauacauugcugcc

SEQ ID NO: 4024239 - RNA, 20 nt, Measles virus
uaacucuccucaauaacugc

SEQ ID NO: 4024240 - RNA, 14 nt, Measles virus
uaaugacagccaga

SEQ ID NO: 4024241 - RNA, 23 nt, Measles virus
uaaugacagccagaaggcccgga

SEQ ID NO: 4024242 - RNA, 13 nt, Measles virus
uacaaaaugaggg

SEQ ID NO: 4024243 - RNA, 22 nt, Measles virus
uacaaagacaacccacauccua

SEQ ID NO: 4024244 - RNA, 22 nt, Measles virus
uacaccguucccagaagaaugc

SEQ ID NO: 4024245 - RNA, 13 nt, Measles virus
uacauugcugccg

SEQ ID NO: 4024246 - RNA, 19 nt, Measles virus
uacgauccucccaagggaa

SEQ ID NO: 4024247 - RNA, 18 nt, Measles virus
uacugggcaucuuagaga

SEQ ID NO: 4024248 - RNA, 15 nt, Measles virus
uagacagauccucuc

SEQ ID NO: 4024249 - RNA, 20 nt, Measles virus
uagaccgcagugcccagcaa

SEQ ID NO: 4024250 - RNA, 20 nt, Measles virus
uagacuccaucgugcagcca

SEQ ID NO: 4024251 - RNA, 13 nt, Measles virus
uagcuauccugga

SEQ ID NO: 4024252 - RNA, 13 nt, Measles virus
uagggauccccgc

SEQ ID NO: 4024253 - RNA, 22 nt, Measles virus
uagggcucaaauugcucagaua

SEQ ID NO: 4024254 - RNA, 16 nt, Measles virus
uaguaagaauccaggc

SEQ ID NO: 4024255 - RNA, 12 nt, Measles virus
uaguuaggcauu

SEQ ID NO: 4024256 - RNA, 21 nt, Measles virus
uaguuauuaacagagaacauc

SEQ ID NO: 4024257 - RNA, 15 nt, Measles virus
ucaaacucaguucca

SEQ ID NO: 4024258 - RNA, 20 nt, Measles virus
ucaagcuucaggugaagggu

SEQ ID NO: 4024259 - RNA, 15 nt, Measles virus
ucaagguuaguccca

SEQ ID NO: 4024260 - RNA, 15 nt, Measles virus
ucacaugaugucacc

SEQ ID NO: 4024261 - RNA, 15 nt, Measles virus
ucagaacaucaagca

SEQ ID NO: 4024262 - RNA, 21 nt, Measles virus
ucagaagauaaucuccaagcu

SEQ ID NO: 4024263 - RNA, 16 nt, Measles virus
ucagauacauguggaa

SEQ ID NO: 4024264 - RNA, 13 nt, Measles virus
ucagggccaggug

SEQ ID NO: 4024265 - RNA, 22 nt, Measles virus
ucagggcccacuacaaucagag

SEQ ID NO: 4024266 - RNA, 14 nt, Measles virus
ucauccacaauguc

SEQ ID NO: 4024267 - RNA, 22 nt, Measles virus
uccaaagggaaugggauucagu

SEQ ID NO: 4024268 - RNA, 19 nt, Measles virus
uccacacagccgccagcca

SEQ ID NO: 4024269 - RNA, 23 nt, Measles virus
uccacacucuggcugucucagga

SEQ ID NO: 4024270 - RNA, 22 nt, Measles virus
uccagaccacccugggccacca

SEQ ID NO: 4024271 - RNA, 20 nt, Measles virus
uccagccggcuagaggagga

SEQ ID NO: 4024272 - RNA, 23 nt, Measles virus
ucccgggaaaggaacccccagca

SEQ ID NO: 4024273 - RNA, 15 nt, Measles virus
uccuaaaaaagggaa

SEQ ID NO: 4024274 - RNA, 18 nt, Measles virus
uccuccucuucucgaagg

SEQ ID NO: 4024275 - RNA, 15 nt, Measles virus
ucgaagggaccaaaa

SEQ ID NO: 4024276 - RNA, 13 nt, Measles virus
ucgacaaugcaga

SEQ ID NO: 4024277 - RNA, 15 nt, Measles virus
ucuauucccagcuuu

SEQ ID NO: 4024278 - RNA, 21 nt, Measles virus
ucucaaacaugucgcuguccc

SEQ ID NO: 4024279 - RNA, 21 nt, Measles virus
ucugagcuugaucggguugcu

SEQ ID NO: 4024280 - RNA, 23 nt, Measles virus
ucuuacagggacaucaaaauccu

SEQ ID NO: 4024281 - RNA, 13 nt, Measles virus
ucuucaagaucau

SEQ ID NO: 4024282 - RNA, 12 nt, Measles virus
ucuucaaugcaa

SEQ ID NO: 4024283 - RNA, 13 nt, Measles virus
ucuucccugcacu

SEQ ID NO: 4024284 - RNA, 18 nt, Measles virus
ugaaaauacgaaguuucu

SEQ ID NO: 4024285 - RNA, 20 nt, Measles virus
ugaaaauacgaaguuucuau

SEQ ID NO: 4024286 - RNA, 15 nt, Measles virus
ugaagugggccugag

SEQ ID NO: 4024287 - RNA, 23 nt, Measles virus
ugaagugggccugaggacaccuc

SEQ ID NO: 4024288 - RNA, 17 nt, Measles virus
ugagcaagacucuccau

SEQ ID NO: 4024289 - RNA, 20 nt, Measles virus
aaguugggaaugucaucaag

SEQ ID NO: 4024290 - RNA, 21 nt, Measles virus
aauaaaugccuucuacaaaga

SEQ ID NO: 4024291 - RNA, 12 nt, Measles virus
aauacaggagac

SEQ ID NO: 4024292 - RNA, 13 nt, Measles virus
aauacaugauguu

SEQ ID NO: 4024293 - RNA, 13 nt, Measles virus
aauacgaaguuuc

SEQ ID NO: 4024294 - RNA, 21 nt, Measles virus
aaucgcagauagggcugccag

SEQ ID NO: 4024295 - RNA, 16 nt, Measles virus
aaucugguggacauau

SEQ ID NO: 4024296 - RNA, 13 nt, Measles virus
aaugacagccaga

SEQ ID NO: 4024297 - RNA, 21 nt, Measles virus
aaugcccaauauaacucuccu

SEQ ID NO: 4024298 - RNA, 13 nt, Measles virus
acaacccacaucc

SEQ ID NO: 4024299 - RNA, 15 nt, Measles virus
acaaccuaaauccau

SEQ ID NO: 4024300 - RNA, 21 nt, Measles virus
acaccaggcggcccaagcaca

SEQ ID NO: 4024301 - RNA, 19 nt, Measles virus
acaccccacuaacccuccu

SEQ ID NO: 4024302 - RNA, 18 nt, Measles virus
acacucaauuccccaccc

SEQ ID NO: 4024303 - RNA, 21 nt, Measles virus
acagccagaaggcccggacaa

SEQ ID NO: 4024304 - RNA, 14 nt, Measles virus
acagcugcucagau

SEQ ID NO: 4024305 - RNA, 13 nt, Measles virus
acagugauggcag

SEQ ID NO: 4024306 - RNA, 19 nt, Measles virus
acaucaguaucccacagcc

SEQ ID NO: 4024307 - RNA, 17 nt, Measles virus
acaugcuuccagcaggc

SEQ ID NO: 4024308 - RNA, 17 nt, Measles virus
acaugggacaaaaaacu

SEQ ID NO: 4024309 - RNA, 22 nt, Measles virus
accacccugggccaccagcucc

SEQ ID NO: 4024310 - RNA, 16 nt, Measles virus
accagacccagcaccc

SEQ ID NO: 4024311 - RNA, 23 nt, Measles virus
accccgcaaaaaggaaaggccac

SEQ ID NO: 4024312 - RNA, 19 nt, Measles virus
acccucucaggaggagacg

SEQ ID NO: 4024313 - RNA, 13 nt, Measles virus
acccugacaagau

SEQ ID NO: 4024314 - RNA, 17 nt, Measles virus
accgcauccagcaucaa

SEQ ID NO: 4024315 - RNA, 17 nt, Measles virus
accgcauccccacagcu

SEQ ID NO: 4024316 - RNA, 20 nt, Measles virus
accgcauccccacagcuccc

SEQ ID NO: 4024317 - RNA, 13 nt, Measles virus
accgcuggacacc

SEQ ID NO: 4024318 - RNA, 18 nt, Measles virus
accuacgauacuuccagg

SEQ ID NO: 4024319 - RNA, 16 nt, Measles virus
accuccaugacccuga

SEQ ID NO: 4024320 - RNA, 19 nt, Measles virus
accugcaaggaagaggagg

SEQ ID NO: 4024321 - RNA, 18 nt, Measles virus
accugucuuacagccuga

SEQ ID NO: 4024322 - RNA, 20 nt, Measles virus
acgagcuccugaaacuccaa

SEQ ID NO: 4024323 - RNA, 16 nt, Measles virus
acgguucagggaugga

SEQ ID NO: 4024324 - RNA, 14 nt, Measles virus
acuaacccuccuca

SEQ ID NO: 4024325 - RNA, 18 nt, Measles virus
acuaugacaucccaggga

SEQ ID NO: 4024326 - RNA, 17 nt, Measles virus
acucaacucuacuggag

SEQ ID NO: 4024327 - RNA, 16 nt, Measles virus
acucagaggugcuuuc

SEQ ID NO: 4024328 - RNA, 19 nt, Measles virus
acuccaucgugcagccauc

SEQ ID NO: 4024329 - RNA, 14 nt, Measles virus
acugaaauacauga

SEQ ID NO: 4024330 - RNA, 13 nt, Measles virus
acugcagaaggag

SEQ ID NO: 4024331 - RNA, 22 nt, Measles virus
acuggagccgauggcagaagag

SEQ ID NO: 4024332 - RNA, 15 nt, Measles virus
acuuagggccaagga

SEQ ID NO: 4024333 - RNA, 14 nt, Measles virus
acuuaucaugaguu

SEQ ID NO: 4024334 - RNA, 22 nt, Measles virus
acuuugaaaauacgaaguuucu

SEQ ID NO: 4024335 - RNA, 21 nt, Measles virus
agacuccaucgugcagccauc

SEQ ID NO: 4024336 - RNA, 18 nt, Measles virus
agaggggagguuaaugac

SEQ ID NO: 4024337 - RNA, 20 nt, Measles virus
agagguguuaucgcugacaa

SEQ ID NO: 4024338 - RNA, 14 nt, Measles virus
agaucucaaagaaa

SEQ ID NO: 4024339 - RNA, 19 nt, Measles virus
agaugucgaacucaauccc

SEQ ID NO: 4024340 - RNA, 15 nt, Measles virus
agauguuuuccuuaa

SEQ ID NO: 4024341 - RNA, 19 nt, Measles virus
agauguuuuccuuaaugau

SEQ ID NO: 4024342 - RNA, 22 nt, Measles virus
agcaagacucuccaugcacaac

SEQ ID NO: 4024343 - RNA, 14 nt, Measles virus
agccgacaacucca

SEQ ID NO: 4024344 - RNA, 16 nt, Measles virus
agccgacaacuccagg

SEQ ID NO: 4024345 - RNA, 17 nt, Measles virus
agccgcucauuuucuua

SEQ ID NO: 4024346 - RNA, 16 nt, Measles virus
agccucagcaccaauc

SEQ ID NO: 4024347 - RNA, 22 nt, Measles virus
agccugaaagaaaaggagauca

SEQ ID NO: 4024348 - RNA, 12 nt, Measles virus
agcgagaggcca

SEQ ID NO: 4024349 - RNA, 13 nt, Measles virus
agcugucucaaag

SEQ ID NO: 4024350 - RNA, 21 nt, Measles virus
agcugucucaaagggaaacug

SEQ ID NO: 4024351 - RNA, 19 nt, Measles virus
agcuugggaaaacucucaa

SEQ ID NO: 4024352 - RNA, 16 nt, Measles virus
aggacaccucagagau

SEQ ID NO: 4024353 - RNA, 18 nt, Measles virus
aggacaccucucaagcau

SEQ ID NO: 4024354 - RNA, 17 nt, Measles virus
aggacaggaccgagcca

SEQ ID NO: 4024355 - RNA, 13 nt, Measles virus
aggacaucaagga

SEQ ID NO: 4024356 - RNA, 11 nt, Measles virus
aggcaggcagu

SEQ ID NO: 4024357 - RNA, 17 nt, Measles virus
aggcauuauuugcaaua

SEQ ID NO: 4024358 - RNA, 12 nt, Measles virus
aggcccccaggg

SEQ ID NO: 4024359 - RNA, 22 nt, Measles virus
aggcguugccacagcugcucag

SEQ ID NO: 4024360 - RNA, 19 nt, Measles virus
agggcucaaauugcucaga

SEQ ID NO: 4024361 - RNA, 18 nt, Measles virus
agggucagaguugucaca

SEQ ID NO: 4024362 - RNA, 18 nt, Measles virus
agggucgaucgcuccgau

SEQ ID NO: 4024363 - RNA, 17 nt, Measles virus
agguccacacagccgcc

SEQ ID NO: 4024364 - RNA, 18 nt, Measles virus
aguaggagacacaagaga

SEQ ID NO: 4024365 - RNA, 20 nt, Measles virus
agugcguugauaacuggaaa

SEQ ID NO: 4024366 - RNA, 23 nt, Measles virus
agugguauaccacugugcccaag

SEQ ID NO: 4024367 - RNA, 20 nt, Measles virus
aguucucaagaagcccguug

SEQ ID NO: 4024368 - RNA, 14 nt, Measles virus
aguuguccuggcag

SEQ ID NO: 4024369 - RNA, 18 nt, Measles virus
aguuucuauucccagcuu

SEQ ID NO: 4024370 - RNA, 21 nt, Measles virus
auagaagacaaagagucaaca

SEQ ID NO: 4024371 - RNA, 16 nt, Measles virus
auagaccuuauguuuu

SEQ ID NO: 4024372 - RNA, 17 nt, Measles virus
auaggaaggaugaaugc

SEQ ID NO: 4024373 - RNA, 18 nt, Measles virus
auaggaaggaugaaugcu

SEQ ID NO: 4024374 - RNA, 22 nt, Measles virus
auaucacucacucugggauggu

SEQ ID NO: 4024375 - RNA, 16 nt, Measles virus
aucaguaucccacagc

SEQ ID NO: 4024376 - RNA, 22 nt, Measles virus
aucaguuccuagcugucucaaa

SEQ ID NO: 4024377 - RNA, 15 nt, Measles virus
auccaacuuaucaaa

SEQ ID NO: 4024378 - RNA, 23 nt, Measles virus
auccaggcaguuuugcagccauc

SEQ ID NO: 4024379 - RNA, 23 nt, Measles virus
auccagugauagauaggcuuuac

SEQ ID NO: 4024380 - RNA, 22 nt, Measles virus
aucccagaauaaugaagaaggg

SEQ ID NO: 4024381 - RNA, 13 nt, Measles virus
auccuaagggaag

SEQ ID NO: 4024382 - RNA, 20 nt, Measles virus
aucgagcaucaggucaagga

SEQ ID NO: 4024383 - RNA, 20 nt, Measles virus
aucuuauacccugaaguuca

SEQ ID NO: 4024384 - RNA, 12 nt, Measles virus
augacagccaga

SEQ ID NO: 4024385 - RNA, 19 nt, Measles virus
augacucguuccagccauc

SEQ ID NO: 4024386 - RNA, 15 nt, Measles virus
augcgcuuggaggag

SEQ ID NO: 4024387 - RNA, 19 nt, Measles virus
augggagucagcugcacag

SEQ ID NO: 4024388 - RNA, 16 nt, Measles virus
augucaucaaguccaa

SEQ ID NO: 4024389 - RNA, 19 nt, Measles virus
auguguauuggcugacuau

SEQ ID NO: 4024390 - RNA, 17 nt, Measles virus
auguugcugcagggggc

SEQ ID NO: 4024391 - RNA, 17 nt, Measles virus
auuaagaagcagaucaa

SEQ ID NO: 4024392 - RNA, 13 nt, Measles virus
auuaaugcccaau

SEQ ID NO: 4024393 - RNA, 16 nt, Measles virus
auuauguuuacagccc

SEQ ID NO: 4024394 - RNA, 19 nt, Measles virus
auucagaucggucaaugca

SEQ ID NO: 4024395 - RNA, 23 nt, Measles virus
auuggcaaguauuuuaaggacaa

SEQ ID NO: 4024396 - RNA, 21 nt, Measles virus
auuucagcaacugcauggugg

SEQ ID NO: 4024397 - RNA, 20 nt, Measles virus
auuugcaauauauuaaagaa

SEQ ID NO: 4024398 - RNA, 11 nt, Measles virus
caaaaaagccc

SEQ ID NO: 4024399 - RNA, 22 nt, Measles virus
caaaaaagcccccuccagaaga

SEQ ID NO: 4024400 - RNA, 21 nt, Measles virus
caaaacggguuuucugaugaa

SEQ ID NO: 4024401 - RNA, 16 nt, Measles virus
caaagaaagucacagg

SEQ ID NO: 4024402 - RNA, 11 nt, Measles virus
caaaggagaca

SEQ ID NO: 4024403 - RNA, 18 nt, Measles virus
caacccgaaccagcaccc

SEQ ID NO: 4024404 - RNA, 23 nt, Measles virus
caacccgaaccagcacccaagag

SEQ ID NO: 4024405 - RNA, 23 nt, Measles virus
caaccuacgauacuuccaggguu

SEQ ID NO: 4024406 - RNA, 18 nt, Measles virus
caacgagaccgaauaaau

SEQ ID NO: 4024407 - RNA, 17 nt, Measles virus
caacgaucuugccaagu

SEQ ID NO: 4024408 - RNA, 19 nt, Measles virus
caacucuugaaacacagau

SEQ ID NO: 4024409 - RNA, 22 nt, Measles virus
caacuggaaggccccucccccc

SEQ ID NO: 4024410 - RNA, 13 nt, Measles virus
caagaagaccuua

SEQ ID NO: 4024411 - RNA, 19 nt, Measles virus
caagacaucaaaacagccu

SEQ ID NO: 4024412 - RNA, 17 nt, Measles virus
caagcagggcaggagau

SEQ ID NO: 4024413 - RNA, 15 nt, Measles virus
caagcgagaggccag

SEQ ID NO: 4024414 - RNA, 15 nt, Measles virus
caaggccaccaccag

SEQ ID NO: 4024415 - RNA, 13 nt, Measles virus
caaguaggagaca

SEQ ID NO: 4024416 - RNA, 13 nt, Measles virus
caagucuccucuu

SEQ ID NO: 4024417 - RNA, 18 nt, Measles virus
caauauauuaaagaaaac

SEQ ID NO: 4024418 - RNA, 21 nt, Measles virus
cgcagaauacaggagacuacu

SEQ ID NO: 4024419 - RNA, 21 nt, Measles virus
cgcagcccucugucacaggga

SEQ ID NO: 4024420 - RNA, 17 nt, Measles virus
cgcagugcccagcaaua

SEQ ID NO: 4024421 - RNA, 13 nt, Measles virus
cgcgcaccccagc

SEQ ID NO: 4024422 - RNA, 16 nt, Measles virus
cgcggcaccgcgcccc

SEQ ID NO: 4024423 - RNA, 21 nt, Measles virus
cgcuccgaacacagaccacca

SEQ ID NO: 4024424 - RNA, 17 nt, Measles virus
cgcugacaaucaagcaa

SEQ ID NO: 4024425 - RNA, 19 nt, Measles virus
cggaagcguuaccugauga

SEQ ID NO: 4024426 - RNA, 12 nt, Measles virus
cggaccaagcga

SEQ ID NO: 4024427 - RNA, 15 nt, Measles virus
cggaccaagcgagag

SEQ ID NO: 4024428 - RNA, 21 nt, Measles virus
cggaccaagcgagaggccagc

SEQ ID NO: 4024429 - RNA, 17 nt, Measles virus
cggcaccgcgcccccac

SEQ ID NO: 4024430 - RNA, 23 nt, Measles virus
cggucagggaucuggagaaagcg

SEQ ID NO: 4024431 - RNA, 20 nt, Measles virus
caauauauuaaagaaaacuu

SEQ ID NO: 4024432 - RNA, 11 nt, Measles virus
caaucaaggaa

SEQ ID NO: 4024433 - RNA, 15 nt, Measles virus
caaucugagagcaag

SEQ ID NO: 4024434 - RNA, 22 nt, Measles virus
caaucugcguccuccucguggg

SEQ ID NO: 4024435 - RNA, 19 nt, Measles virus
cacaauccggaaugcucaa

SEQ ID NO: 4024436 - RNA, 19 nt, Measles virus
cacagauuucccacaaguc

SEQ ID NO: 4024437 - RNA, 17 nt, Measles virus
cacagccucuccaaguc

SEQ ID NO: 4024438 - RNA, 23 nt, Measles virus
caccaaccgcauccccacagcuc

SEQ ID NO: 4024439 - RNA, 19 nt, Measles virus
caccaggcggcccaagcac

SEQ ID NO: 4024440 - RNA, 21 nt, Measles virus
caccaggcggcccaagcacag

SEQ ID NO: 4024441 - RNA, 13 nt, Measles virus
cacccccaaagga

SEQ ID NO: 4024442 - RNA, 18 nt, Measles virus
caccgacaauccaagacg

SEQ ID NO: 4024443 - RNA, 19 nt, Measles virus
caccugcaaggaagaggag

SEQ ID NO: 4024444 - RNA, 17 nt, Measles virus
cacgcuuacagccugga

SEQ ID NO: 4024445 - RNA, 15 nt, Measles virus
cacgucgacacagag

SEQ ID NO: 4024446 - RNA, 17 nt, Measles virus
cacgucgacacagaguc

SEQ ID NO: 4024447 - RNA, 23 nt, Measles virus
cacugugucagaacaucaagcac

SEQ ID NO: 4024448 - RNA, 20 nt, Measles virus
cagaagagcaggcacgccau

SEQ ID NO: 4024449 - RNA, 23 nt, Measles virus
cagaaucugguggacauaucacu

SEQ ID NO: 4024450 - RNA, 17 nt, Measles virus
cagacaacccaggacag

SEQ ID NO: 4024451 - RNA, 14 nt, Measles virus
cagaccacccuggg

SEQ ID NO: 4024452 - RNA, 17 nt, Measles virus
aaaaaacggauucucca

SEQ ID NO: 4024453 - RNA, 18 nt, Measles virus
aaaacuuagggccaagga

SEQ ID NO: 4024454 - RNA, 10 nt, Measles virus
aaaccagagg

SEQ ID NO: 4024455 - RNA, 13 nt, Measles virus
aaacuuugaaaau

SEQ ID NO: 4024456 - RNA, 14 nt, Measles virus
aaagaucucaaaga

SEQ ID NO: 4024457 - RNA, 11 nt, Measles virus
aaaggccccca

SEQ ID NO: 4024458 - RNA, 18 nt, Measles virus
aaauacgaaguuucuauu

SEQ ID NO: 4024459 - RNA, 19 nt, Measles virus
aaaugacuuacaaaaugag

SEQ ID NO: 4024460 - RNA, 22 nt, Measles virus
aacaaaacuuagggccaaggaa

SEQ ID NO: 4024461 - RNA, 18 nt, Measles virus
aacaaguugguaugucaa

SEQ ID NO: 4024462 - RNA, 20 nt, Measles virus
aacaaguugguaugucaaga

SEQ ID NO: 4024463 - RNA, 18 nt, Measles virus
aaccaaccacaacaaugu

SEQ ID NO: 4024464 - RNA, 16 nt, Measles virus
aaccagaguccagacc

SEQ ID NO: 4024465 - RNA, 20 nt, Measles virus
aaccaugccucucagcaauu

SEQ ID NO: 4024466 - RNA, 14 nt, Measles virus
aacccuaauccugc

SEQ ID NO: 4024467 - RNA, 18 nt, Measles virus
aaccgaucacaugauguc

SEQ ID NO: 4024468 - RNA, 22 nt, Measles virus
aacucaguuccaaucugguaau

SEQ ID NO: 4024469 - RNA, 14 nt, Measles virus
aacugaugacauac

SEQ ID NO: 4024470 - RNA, 16 nt, Measles virus
aacuuugaaaauacga

SEQ ID NO: 4024471 - RNA, 15 nt, Measles virus
aagaaccuagccuua

SEQ ID NO: 4024472 - RNA, 14 nt, Measles virus
aagcacacccaccc

SEQ ID NO: 4024473 - RNA, 20 nt, Measles virus
aagcaguaacggcugcugaa

SEQ ID NO: 4024474 - RNA, 19 nt, Measles virus
aagcgagaggccagccagc

SEQ ID NO: 4024475 - RNA, 22 nt, Measles virus
aagcgaugacgacgcugaaacu

SEQ ID NO: 4024476 - RNA, 15 nt, Measles virus
aaggucaugccauau

SEQ ID NO: 4024477 - RNA, 13 nt, Measles virus
aaucggccagaag

SEQ ID NO: 4024478 - RNA, 18 nt, Measles virus
aaugagcaagacucucca

SEQ ID NO: 4024479 - RNA, 16 nt, Measles virus
aaugaugaccaaggac

SEQ ID NO: 4024480 - RNA, 19 nt, Measles virus
aaugcccaauauaacucuc

SEQ ID NO: 4024481 - RNA, 17 nt, Measles virus
aaugccgcacugauaca

SEQ ID NO: 4024482 - RNA, 12 nt, Measles virus
aaugccuccggg

SEQ ID NO: 4024483 - RNA, 19 nt, Measles virus
aaugucaggaaauacauga

SEQ ID NO: 4024484 - RNA, 23 nt, Measles virus
acaaguugguaugucaagaccag

SEQ ID NO: 4024485 - RNA, 13 nt, Measles virus
acaaugggauggc

SEQ ID NO: 4024486 - RNA, 14 nt, Measles virus
acacaaggccacca

SEQ ID NO: 4024487 - RNA, 16 nt, Measles virus
acacacgguucaggga

SEQ ID NO: 4024488 - RNA, 18 nt, Measles virus
acacagauuucccacaag

SEQ ID NO: 4024489 - RNA, 22 nt, Measles virus
acagcaaguguggacaccaggc

SEQ ID NO: 4024490 - RNA, 23 nt, Measles virus
acagccuuggccaaaauacacga

SEQ ID NO: 4024491 - RNA, 21 nt, Measles virus
acauacaucugacaggggaga

SEQ ID NO: 4024492 - RNA, 13 nt, Measles virus
acaucaaaacagc

SEQ ID NO: 4024493 - RNA, 18 nt, Measles virus
acauccugauugcagugu

SEQ ID NO: 4024494 - RNA, 12 nt, Measles virus
acaucuuaugau

SEQ ID NO: 4024495 - RNA, 14 nt, Measles virus
acaugcuuccagca

SEQ ID NO: 4024496 - RNA, 16 nt, Measles virus
accaaccauccacucc

SEQ ID NO: 4024497 - RNA, 19 nt, Measles virus
accaccgcauccagcauca

SEQ ID NO: 4024498 - RNA, 15 nt, Measles virus
accagaacaacaucc

SEQ ID NO: 4024499 - RNA, 14 nt, Measles virus
accagacccagcac

SEQ ID NO: 4024500 - RNA, 17 nt, Measles virus
accagagggagccccca

SEQ ID NO: 4024501 - RNA, 13 nt, Measles virus
accaguuccagag

SEQ ID NO: 4024502 - RNA, 16 nt, Measles virus
accaguuccagaggac

SEQ ID NO: 4024503 - RNA, 14 nt, Measles virus
acccaccccacaca

SEQ ID NO: 4024504 - RNA, 23 nt, Measles virus
acccacugauggauaucaaugaa

SEQ ID NO: 4024505 - RNA, 19 nt, Measles virus
acccgaugaguccucugcu

SEQ ID NO: 4024506 - RNA, 19 nt, Measles virus
acccgcgcaccccagcccc

SEQ ID NO: 4024507 - RNA, 15 nt, Measles virus
acccuaauccugccc

SEQ ID NO: 4024508 - RNA, 16 nt, Measles virus
acccuggaaggacacc

SEQ ID NO: 4024509 - RNA, 20 nt, Measles virus
acccugggccaccagcuccc

SEQ ID NO: 4024510 - RNA, 12 nt, Measles virus
accgaaccagag

SEQ ID NO: 4024511 - RNA, 23 nt, Measles virus
accgguucauuuuaucacaaggg

SEQ ID NO: 4024512 - RNA, 16 nt, Measles virus
acgcuuacagccugga

SEQ ID NO: 4024513 - RNA, 17 nt, Measles virus
acuggagccgauggcag

SEQ ID NO: 4024514 - RNA, 20 nt, Measles virus
acuggaggccagggcaacca

SEQ ID NO: 4024515 - RNA, 16 nt, Measles virus
acuggguuacaguguu

SEQ ID NO: 4024516 - RNA, 12 nt, Measles virus
cagcuuccagcu

SEQ ID NO: 4024517 - RNA, 15 nt, Measles virus
caggaaauacaugaa

SEQ ID NO: 4024518 - RNA, 18 nt, Measles virus
caggaccgagccaccugc

SEQ ID NO: 4024519 - RNA, 22 nt, Measles virus
caggaguccccaaagaucucaa

SEQ ID NO: 4024520 - RNA, 13 nt, Measles virus
caggaucuccaau

SEQ ID NO: 4024521 - RNA, 15 nt, Measles virus
caggcauccgacucc

SEQ ID NO: 4024522 - RNA, 18 nt, Measles virus
caggcuggugccccaggu

SEQ ID NO: 4024523 - RNA, 16 nt, Measles virus
caggguguccaagacu

SEQ ID NO: 4024524 - RNA, 17 nt, Measles virus
caggugcggcccuaggc

SEQ ID NO: 4024525 - RNA, 21 nt, Measles virus
caguacuguuaacucuccaaa

SEQ ID NO: 4024526 - RNA, 12 nt, Measles virus
caguagggccag

SEQ ID NO: 4024527 - RNA, 18 nt, Measles virus
caguucgggucucagcaa

SEQ ID NO: 4024528 - RNA, 18 nt, Measles virus
cauaagagccucagcacc

SEQ ID NO: 4024529 - RNA, 16 nt, Measles virus
cauaaugacagccaga

SEQ ID NO: 4024530 - RNA, 12 nt, Measles virus
caucaagcaccg

SEQ ID NO: 4024531 - RNA, 13 nt, Measles virus
caucaauccucug

SEQ ID NO: 4024532 - RNA, 15 nt, Measles virus
caucaauccucugca

SEQ ID NO: 4024533 - RNA, 17 nt, Measles virus
caucauaggcagagauu

SEQ ID NO: 4024534 - RNA, 17 nt, Measles virus
cauccacucccacgacu

SEQ ID NO: 4024535 - RNA, 15 nt, Measles virus
cauccugauugcagu

SEQ ID NO: 4024536 - RNA, 16 nt, Measles virus
caugaugucacccaga

SEQ ID NO: 4024537 - RNA, 22 nt, Measles virus
caugauguucuugaccaaaacg

SEQ ID NO: 4024538 - RNA, 13 nt, Measles virus
caugccagagggg

SEQ ID NO: 4024539 - RNA, 15 nt, Measles virus
caugccucucagcaa

SEQ ID NO: 4024540 - RNA, 23 nt, Measles virus
caugcugugguuuauuauguuua

SEQ ID NO: 4024541 - RNA, 13 nt, Measles virus
caugcuuccagca

SEQ ID NO: 4024542 - RNA, 13 nt, Measles virus
caugucaaaaacg

SEQ ID NO: 4024543 - RNA, 14 nt, Measles virus
cauguuucugagcu

SEQ ID NO: 4024544 - RNA, 14 nt, Measles virus
cauuggugaugaag

SEQ ID NO: 4024545 - RNA, 17 nt, Measles virus
ccaaacccgccggcccc

SEQ ID NO: 4024546 - RNA, 22 nt, Measles virus
ccaaccccgaaggucgcuccga

SEQ ID NO: 4024547 - RNA, 13 nt, Measles virus
ccaaccucuucac

SEQ ID NO: 4024548 - RNA, 21 nt, Measles virus
ccaagcgagaggccagccagc

SEQ ID NO: 4024549 - RNA, 12 nt, Measles virus
ccaauauguuuu

SEQ ID NO: 4024550 - RNA, 20 nt, Measles virus
ccaaucugcguccuccucgu

SEQ ID NO: 4024551 - RNA, 14 nt, Measles virus
ccacaacccgcgca

SEQ ID NO: 4024552 - RNA, 21 nt, Measles virus
ccacaacccgcgcaccccagc

SEQ ID NO: 4024553 - RNA, 21 nt, Measles virus
ccacauccuaagggaaguagg

SEQ ID NO: 4024554 - RNA, 12 nt, Measles virus
ccaccagcuccc

SEQ ID NO: 4024555 - RNA, 15 nt, Measles virus
ccaccgcauccagca

SEQ ID NO: 4024556 - RNA, 19 nt, Measles virus
ccagaagacuccacggacc

SEQ ID NO: 4024557 - RNA, 13 nt, Measles virus
ccagaaggcccgg

SEQ ID NO: 4024558 - RNA, 13 nt, Measles virus
ccagacccagcac

SEQ ID NO: 4024559 - RNA, 17 nt, Measles virus
ccagaguccagaccacc

SEQ ID NO: 4024560 - RNA, 16 nt, Measles virus
ccagcacccagccacc

SEQ ID NO: 4024561 - RNA, 21 nt, Measles virus
ccagcacuuccgagacaccca

SEQ ID NO: 4024562 - RNA, 16 nt, Measles virus
ccagcagccgacagca

SEQ ID NO: 4024563 - RNA, 20 nt, Measles virus
ccagcucccagacucggcca

SEQ ID NO: 4024564 - RNA, 19 nt, Measles virus
ccaggcaucaagcacuggg

SEQ ID NO: 4024565 - RNA, 20 nt, Measles virus
ccaggcggcccaagcacaga

SEQ ID NO: 4024566 - RNA, 22 nt, Measles virus
ccaggcggcccaagcacagaac

SEQ ID NO: 4024567 - RNA, 16 nt, Measles virus
ccagggaauguacggg

SEQ ID NO: 4024568 - RNA, 14 nt, Measles virus
ccaggucagaguca

SEQ ID NO: 4024569 - RNA, 15 nt, Measles virus
ccaucgugcagccau

SEQ ID NO: 4024570 - RNA, 15 nt, Measles virus
ccaugccucucagca

SEQ ID NO: 4024571 - RNA, 21 nt, Measles virus
ccaugcugaacucucaagcca

SEQ ID NO: 4024572 - RNA, 20 nt, Measles virus
ccauuauaaaaaacuuagga

SEQ ID NO: 4024573 - RNA, 14 nt, Measles virus
cccaagcacagaac

SEQ ID NO: 4024574 - RNA, 20 nt, Measles virus
cccaaguauguugcaaccca

SEQ ID NO: 4024575 - RNA, 20 nt, Measles virus
cccaauauaacucuccucaa

SEQ ID NO: 4024576 - RNA, 19 nt, Measles virus
cccacuacaaucagagguc

SEQ ID NO: 4024577 - RNA, 23 nt, Measles virus
cccagaauaaugaagaaggggga

SEQ ID NO: 4024578 - RNA, 21 nt, Measles virus
cccaggggccgacagccagca

SEQ ID NO: 4024579 - RNA, 22 nt, Measles virus
ccccgacacaaggccaccacca

SEQ ID NO: 4024580 - RNA, 20 nt, Measles virus
ccccgaccagacccagcacc

SEQ ID NO: 4024581 - RNA, 13 nt, Measles virus
cccgaaccagcac

SEQ ID NO: 4024582 - RNA, 16 nt, Measles virus
cccgacacaaggccac

SEQ ID NO: 4024583 - RNA, 19 nt, Measles virus
cccgauaguuaccaauaag

SEQ ID NO: 4024584 - RNA, 22 nt, Measles virus
cccgauccggcgggcagccacu

SEQ ID NO: 4024585 - RNA, 20 nt, Measles virus
cccgcgcaccccagccccga

SEQ ID NO: 4024586 - RNA, 14 nt, Measles virus
cccguugccagccg

SEQ ID NO: 4024587 - RNA, 19 nt, Measles virus
cccuaggcguugccacagc

SEQ ID NO: 4024588 - RNA, 20 nt, Measles virus
ccgaaccccaguagggccag

SEQ ID NO: 4024589 - RNA, 12 nt, Measles virus
ccgacagccagc

SEQ ID NO: 4024590 - RNA, 17 nt, Measles virus
ccgagaucccagaauaa

SEQ ID NO: 4024591 - RNA, 14 nt, Measles virus
ccgagcacuggccg

SEQ ID NO: 4024592 - RNA, 22 nt, Measles virus
ccgaggugacccaaccgcaggc

SEQ ID NO: 4024593 - RNA, 21 nt, Measles virus
ccgauccggcgggcagccacu

SEQ ID NO: 4024594 - RNA, 17 nt, Measles virus
ccgcauccccacagcuc

SEQ ID NO: 4024595 - RNA, 14 nt, Measles virus
ccguucccagaaga

SEQ ID NO: 4024596 - RNA, 23 nt, Measles virus
ccuagguaguuaggcauuauuug

SEQ ID NO: 4024597 - RNA, 13 nt, Measles virus
ccucaagaaaucu

SEQ ID NO: 4024598 - RNA, 20 nt, Measles virus
ccucauaaugacagccagaa

SEQ ID NO: 4024599 - RNA, 18 nt, Measles virus
ccucccccugcaugcugc

SEQ ID NO: 4024600 - RNA, 20 nt, Measles virus
ccucggaaccaucagggcca

SEQ ID NO: 4024601 - RNA, 23 nt, Measles virus
ccugaaacuccaauccagaggca

SEQ ID NO: 4024602 - RNA, 22 nt, Measles virus
ccugaucuuacagggacaucaa

SEQ ID NO: 4024603 - RNA, 16 nt, Measles virus
ccugucuuacagccug

SEQ ID NO: 4024604 - RNA, 20 nt, Measles virus
ccuuaaccacugcuuuacug

SEQ ID NO: 4024605 - RNA, 15 nt, Measles virus
ccuucuacaaagaca

SEQ ID NO: 4024606 - RNA, 15 nt, Measles virus
cgaaaaccagaggga

SEQ ID NO: 4024607 - RNA, 13 nt, Measles virus
cgaauaaaugccu

SEQ ID NO: 4024608 - RNA, 14 nt, Measles virus
cgacaacacggaca

SEQ ID NO: 4024609 - RNA, 19 nt, Measles virus
cgaccagacccagcaccca

SEQ ID NO: 4024610 - RNA, 12 nt, Measles virus
cgaccccacugc

SEQ ID NO: 4024611 - RNA, 22 nt, Measles virus
cgaccccccucauaaugacagc

SEQ ID NO: 4024612 - RNA, 16 nt, Measles virus
cgagaggccagccagc

SEQ ID NO: 4024613 - RNA, 16 nt, Measles virus
cgagcauucggguccc

SEQ ID NO: 4024614 - RNA, 19 nt, Measles virus
cgagcuccugaaacuccaa

SEQ ID NO: 4024615 - RNA, 18 nt, Measles virus
cgaggaagccauggcagc

SEQ ID NO: 4024616 - RNA, 20 nt, Measles virus
cgaggaagccauggcagcau

SEQ ID NO: 4024617 - RNA, 16 nt, Measles virus
cgauccucccaaggga

SEQ ID NO: 4024618 - RNA, 20 nt, Measles virus
cgcggcaccgcgcccccacc

SEQ ID NO: 4024619 - RNA, 17 nt, Measles virus
cgcuggacaccccgcag

SEQ ID NO: 4024620 - RNA, 19 nt, Measles virus
cggaaccaucagggccagg

SEQ ID NO: 4024621 - RNA, 20 nt, Measles virus
cggaccaguuccagaggaca

SEQ ID NO: 4024622 - RNA, 21 nt, Measles virus
cggaugauccagugauagaua

SEQ ID NO: 4024623 - RNA, 11 nt, Measles virus
cggccagaagc

SEQ ID NO: 4024624 - RNA, 12 nt, Measles virus
cggcccccccgg

SEQ ID NO: 4024625 - RNA, 17 nt, Measles virus
cgggaacuucaggagaa

SEQ ID NO: 4024626 - RNA, 14 nt, Measles virus
cuaacccuccucac

SEQ ID NO: 4024627 - RNA, 13 nt, Measles virus
cuaauccugcccu

SEQ ID NO: 4024628 - RNA, 18 nt, Measles virus
cuacacugugucagaaca

SEQ ID NO: 4024629 - RNA, 18 nt, Measles virus
cuagcugucucaaaggga

SEQ ID NO: 4024630 - RNA, 17 nt, Measles virus
cuaucaggggucaggga

SEQ ID NO: 4024631 - RNA, 13 nt, Measles virus
cucaaagaggcca

SEQ ID NO: 4024632 - RNA, 19 nt, Measles virus
cucaaauugcucagauacu

SEQ ID NO: 4024633 - RNA, 15 nt, Measles virus
cucagaaucuggugg

SEQ ID NO: 4024634 - RNA, 18 nt, Measles virus
cucagauaacagccggca

SEQ ID NO: 4024635 - RNA, 14 nt, Measles virus
cuccaaacacccac

SEQ ID NO: 4024636 - RNA, 19 nt, Measles virus
cuccaagaaugccuccggg

SEQ ID NO: 4024637 - RNA, 17 nt, Measles virus
cuccacacucuggcugu

SEQ ID NO: 4024638 - RNA, 21 nt, Measles virus
cuccacggaccaagcgagagg

SEQ ID NO: 4024639 - RNA, 19 nt, Measles virus
cucccccugcaugcugcag

SEQ ID NO: 4024640 - RNA, 20 nt, Measles virus
cuccucgugggacccccgag

SEQ ID NO: 4024641 - RNA, 21 nt, Measles virus
cucgaucgagcaucaggucaa

SEQ ID NO: 4024642 - RNA, 10 nt, Measles virus
cucuccucaa

SEQ ID NO: 4024643 - RNA, 15 nt, Measles virus
cucugauccucuaca

SEQ ID NO: 4024644 - RNA, 14 nt, Measles virus
cucuggcugucuca

SEQ ID NO: 4024645 - RNA, 17 nt, Measles virus
acugguaguucaguuga

SEQ ID NO: 4024646 - RNA, 15 nt, Measles virus
acuguuaacucucca

SEQ ID NO: 4024647 - RNA, 13 nt, Measles virus
agaagacaaagag

SEQ ID NO: 4024648 - RNA, 12 nt, Measles virus
agaauaaugaag

SEQ ID NO: 4024649 - RNA, 16 nt, Measles virus
agacuauuaugaugau

SEQ ID NO: 4024650 - RNA, 13 nt, Measles virus
agagagcagagga

SEQ ID NO: 4024651 - RNA, 18 nt, Measles virus
agaucauccacaauguca

SEQ ID NO: 4024652 - RNA, 13 nt, Measles virus
agauccacagcaa

SEQ ID NO: 4024653 - RNA, 17 nt, Measles virus
agauccacgagcuccug

SEQ ID NO: 4024654 - RNA, 16 nt, Measles virus
agauccauaagagccu

SEQ ID NO: 4024655 - RNA, 21 nt, Measles virus
agaucgcagaauacaggagac

SEQ ID NO: 4024656 - RNA, 18 nt, Measles virus
agaucucaaagaaaguca

SEQ ID NO: 4024657 - RNA, 20 nt, Measles virus
agauguggcugcugaagaac

SEQ ID NO: 4024658 - RNA, 17 nt, Measles virus
agauuacauuuucauaa

SEQ ID NO: 4024659 - RNA, 13 nt, Measles virus
agauuuggcuguu

SEQ ID NO: 4024660 - RNA, 18 nt, Measles virus
agcaaaaugggcuguccc

SEQ ID NO: 4024661 - RNA, 21 nt, Measles virus
agcaacuggaaggccccuccc

SEQ ID NO: 4024662 - RNA, 18 nt, Measles virus
agcaaguguggacaccag

SEQ ID NO: 4024663 - RNA, 13 nt, Measles virus
agcagaugcaaga

SEQ ID NO: 4024664 - RNA, 13 nt, Measles virus
agccaugcuggag

SEQ ID NO: 4024665 - RNA, 17 nt, Measles virus
agccccgacacaaggcc

SEQ ID NO: 4024666 - RNA, 17 nt, Measles virus
agccuaaucugagcagu

SEQ ID NO: 4024667 - RNA, 13 nt, Measles virus
agcgagaggccag

SEQ ID NO: 4024668 - RNA, 21 nt, Measles virus
agcgagaggccagccagcagc

SEQ ID NO: 4024669 - RNA, 15 nt, Measles virus
agcuuccagcucguc

SEQ ID NO: 4024670 - RNA, 20 nt, Measles virus
aggaaccagguccacacagc

SEQ ID NO: 4024671 - RNA, 13 nt, Measles virus
aggaacuccucaa

SEQ ID NO: 4024672 - RNA, 15 nt, Measles virus
aggagaaagaagagu

SEQ ID NO: 4024673 - RNA, 19 nt, Measles virus
aggagacuacugagaacag

SEQ ID NO: 4024674 - RNA, 12 nt, Measles virus
aggaugccaagg

SEQ ID NO: 4024675 - RNA, 13 nt, Measles virus
aggaugccaagga

SEQ ID NO: 4024676 - RNA, 14 nt, Measles virus
aggaugccaaggaa

SEQ ID NO: 4024677 - RNA, 23 nt, Measles virus
aggcggcccaagcacagaacagc

SEQ ID NO: 4024678 - RNA, 15 nt, Measles virus
agggaaacugcucag

SEQ ID NO: 4024679 - RNA, 17 nt, Measles virus
aggugcaccugcgggga

SEQ ID NO: 4024680 - RNA, 14 nt, Measles virus
aggugucuggaaau

SEQ ID NO: 4024681 - RNA, 19 nt, Measles virus
agguguuaucgcugacaau

SEQ ID NO: 4024682 - RNA, 22 nt, Measles virus
agguguugguagauccacagca

SEQ ID NO: 4024683 - RNA, 23 nt, Measles virus
agguuuuccaaugccugagggac

SEQ ID NO: 4024684 - RNA, 16 nt, Measles virus
aguacuguuaacucuc

SEQ ID NO: 4024685 - RNA, 13 nt, Measles virus
aguaucccacagc

SEQ ID NO: 4024686 - RNA, 22 nt, Measles virus
agucagauacauguggaaacug

SEQ ID NO: 4024687 - RNA, 17 nt, Measles virus
agucaucggaccagaua

SEQ ID NO: 4024688 - RNA, 20 nt, Measles virus
aguggagccuaccuccauga

SEQ ID NO: 4024689 - RNA, 12 nt, Measles virus
aguuaugacucg

SEQ ID NO: 4024690 - RNA, 18 nt, Measles virus
aguuccagaggacagcug

SEQ ID NO: 4024691 - RNA, 17 nt, Measles virus
aguuucuauucccagcu

SEQ ID NO: 4024692 - RNA, 12 nt, Measles virus
auaauaaugaag

SEQ ID NO: 4024693 - RNA, 12 nt, Measles virus
auaccuaccugc

SEQ ID NO: 4024694 - RNA, 20 nt, Measles virus
auagaagacaaagagucaac

SEQ ID NO: 4024695 - RNA, 15 nt, Measles virus
auagcacccucucag

SEQ ID NO: 4024696 - RNA, 17 nt, Measles virus
auaguaagaauccaggc

SEQ ID NO: 4024697 - RNA, 16 nt, Measles virus
auaucagcauauccac

SEQ ID NO: 4024698 - RNA, 17 nt, Measles virus
aucaauccaccacaucc

SEQ ID NO: 4024699 - RNA, 16 nt, Measles virus
aucaggggucagggaa

SEQ ID NO: 4024700 - RNA, 17 nt, Measles virus
aucauguuuaugaucac

SEQ ID NO: 4024701 - RNA, 20 nt, Measles virus
auccacgagcuccugaaacu

SEQ ID NO: 4024702 - RNA, 20 nt, Measles virus
auccacucccacgacuggag

SEQ ID NO: 4024703 - RNA, 17 nt, Measles virus
aucccaaucugcguccu

SEQ ID NO: 4024704 - RNA, 13 nt, Measles virus
aucccacagccuc

SEQ ID NO: 4024705 - RNA, 14 nt, Measles virus
auccccacagcucc

SEQ ID NO: 4024706 - RNA, 15 nt, Measles virus
auccgacgcuguccg

SEQ ID NO: 4024707 - RNA, 21 nt, Measles virus
auccgugagcuccuaaaaaag

SEQ ID NO: 4024708 - RNA, 16 nt, Measles virus
auccucccaagggaac

SEQ ID NO: 4024709 - RNA, 15 nt, Measles virus
aucggucaaugcagu

SEQ ID NO: 4024710 - RNA, 14 nt, Measles virus
aucuaaucucaaac

SEQ ID NO: 4024711 - RNA, 19 nt, Measles virus
augaagguacuuaucauga

SEQ ID NO: 4024712 - RNA, 17 nt, Measles virus
augagacucugaugaaa

SEQ ID NO: 4024713 - RNA, 18 nt, Measles virus
augcauccgggcucucaa

SEQ ID NO: 4024714 - RNA, 14 nt, Measles virus
augcauuggugaac

SEQ ID NO: 4024715 - RNA, 16 nt, Measles virus
augccucucagcaauu

SEQ ID NO: 4024716 - RNA, 16 nt, Measles virus
augccucuuagccugg

SEQ ID NO: 4024717 - RNA, 20 nt, Measles virus
augccucuuagccuggacag

SEQ ID NO: 4024718 - RNA, 19 nt, Measles virus
augccuucuacaaagacaa

SEQ ID NO: 4024719 - RNA, 19 nt, Measles virus
augcucaagcuucagguga

SEQ ID NO: 4024720 - RNA, 16 nt, Measles virus
auuauugcaaaaugaa

SEQ ID NO: 4024721 - RNA, 12 nt, Measles virus
auuauuugcaau

SEQ ID NO: 4024722 - RNA, 18 nt, Measles virus
auugcuaaguuggaggau

SEQ ID NO: 4024723 - RNA, 15 nt, Measles virus
auuguagccaugcug

SEQ ID NO: 4024724 - RNA, 13 nt, Measles virus
auuuaacauagaa

SEQ ID NO: 4024725 - RNA, 18 nt, Measles virus
auuuaacauagaagacaa

SEQ ID NO: 4024726 - RNA, 17 nt, Measles virus
caaaaaaaggcccccag

SEQ ID NO: 4024727 - RNA, 22 nt, Measles virus
caaaacggguuuucugaugaag

SEQ ID NO: 4024728 - RNA, 20 nt, Measles virus
caaaauugcuucaggauucg

SEQ ID NO: 4024729 - RNA, 23 nt, Measles virus
caaaguuaugacucguuccagcc

SEQ ID NO: 4024730 - RNA, 19 nt, Measles virus
caaaguucuguagaccgca

SEQ ID NO: 4024731 - RNA, 13 nt, Measles virus
caacaccccacua

SEQ ID NO: 4024732 - RNA, 21 nt, Measles virus
caacauccgccuacccuccau

SEQ ID NO: 4024733 - RNA, 18 nt, Measles virus
caacccgcgcaccccagc

SEQ ID NO: 4024734 - RNA, 17 nt, Measles virus
caaccgcauccccacag

SEQ ID NO: 4024735 - RNA, 23 nt, Measles virus
caacucggguucaagaagaccuu

SEQ ID NO: 4024736 - RNA, 20 nt, Measles virus
caacucuacuggaggccagg

SEQ ID NO: 4024737 - RNA, 21 nt, Measles virus
caagcacagaacagccccgac

SEQ ID NO: 4024738 - RNA, 23 nt, Measles virus
caagucuccucuucgucaucaag

SEQ ID NO: 4024739 - RNA, 22 nt, Measles virus
caauauauuaaagaaaacuuug

SEQ ID NO: 4024740 - RNA, 18 nt, Measles virus
caaucagacaagcagggc

SEQ ID NO: 4024741 - RNA, 19 nt, Measles virus
caauccagaggcaacaacu

SEQ ID NO: 4024742 - RNA, 18 nt, Measles virus
caaucugcguccuccucg

SEQ ID NO: 4024743 - RNA, 19 nt, Measles virus
cacaaggccaccaccagcc

SEQ ID NO: 4024744 - RNA, 13 nt, Measles virus
cacagaccaccaa

SEQ ID NO: 4024745 - RNA, 17 nt, Measles virus
cacagccgccagccaac

SEQ ID NO: 4024746 - RNA, 13 nt, Measles virus
cacagcugcucag

SEQ ID NO: 4024747 - RNA, 20 nt, Measles virus
cacagucacucgggaagaug

SEQ ID NO: 4024748 - RNA, 12 nt, Measles virus
cacaugagcagu

SEQ ID NO: 4024749 - RNA, 14 nt, Measles virus
caccaccagccauc

SEQ ID NO: 4024750 - RNA, 15 nt, Measles virus
caccagcucccagac

SEQ ID NO: 4024751 - RNA, 14 nt, Measles virus
caccaggcggccca

SEQ ID NO: 4024752 - RNA, 15 nt, Measles virus
cacccagccaccgac

SEQ ID NO: 4024753 - RNA, 23 nt, Measles virus
caccccgcaaaaaggaaaggcca

SEQ ID NO: 4024754 - RNA, 22 nt, Measles virus
caccggcccugcaucacgcagu

SEQ ID NO: 4024755 - RNA, 16 nt, Measles virus
cacgccaugucaaaaa

SEQ ID NO: 4024756 - RNA, 23 nt, Measles virus
cacucaauuccccacccccaaag

SEQ ID NO: 4024757 - RNA, 22 nt, Measles virus
cacuggccgaaguucucaagaa

SEQ ID NO: 4024758 - RNA, 14 nt, Measles virus
cagaacccagaccc

SEQ ID NO: 4024759 - RNA, 18 nt, Measles virus
cagaacccagaccccggc

SEQ ID NO: 4024760 - RNA, 15 nt, Measles virus
cagacccagcaccca

SEQ ID NO: 4024761 - RNA, 12 nt, Measles virus
cagaccccggcc

SEQ ID NO: 4024762 - RNA, 16 nt, Measles virus
cagagaucucacuugg

SEQ ID NO: 4024763 - RNA, 21 nt, Measles virus
cagagggagcccccaaccaaa

SEQ ID NO: 4024764 - RNA, 14 nt, Measles virus
cagaguccagacca

SEQ ID NO: 4024765 - RNA, 21 nt, Measles virus
cagaguccagaccacccuggg

SEQ ID NO: 4024766 - RNA, 16 nt, Measles virus
cagaguugucacaacu

SEQ ID NO: 4024767 - RNA, 20 nt, Measles virus
cagauccucuccccccggca

SEQ ID NO: 4024768 - RNA, 21 nt, Measles virus
cagcaacuggaaggccccucc

SEQ ID NO: 4024769 - RNA, 17 nt, Measles virus
cagcaucaagcccaccu

SEQ ID NO: 4024770 - RNA, 20 nt, Measles virus
cagccaucuacaccgcagag

SEQ ID NO: 4024771 - RNA, 17 nt, Measles virus
cagccccgacacaaggc

SEQ ID NO: 4024772 - RNA, 23 nt, Measles virus
cagccccgauccggcgggcagcc

SEQ ID NO: 4024773 - RNA, 14 nt, Measles virus
cagccgacagcaag

SEQ ID NO: 4024774 - RNA, 12 nt, Measles virus
cagccugaaaga

SEQ ID NO: 4024775 - RNA, 16 nt, Measles virus
aaaauacgaaguuucu

SEQ ID NO: 4024776 - RNA, 13 nt, Measles virus
aaaauaucagcau

SEQ ID NO: 4024777 - RNA, 16 nt, Measles virus
aaaccaugccucucag

SEQ ID NO: 4024778 - RNA, 14 nt, Measles virus
aaacucaguuccaa

SEQ ID NO: 4024779 - RNA, 17 nt, Measles virus
aaacuuagggugcaaga

SEQ ID NO: 4024780 - RNA, 21 nt, Measles virus
aaaggugucagcuuccagcuc

SEQ ID NO: 4024781 - RNA, 15 nt, Measles virus
aaagucauuguguau

SEQ ID NO: 4024782 - RNA, 15 nt, Measles virus
aacauaccuaccugc

SEQ ID NO: 4024783 - RNA, 14 nt, Measles virus
aacccagaccccgg

SEQ ID NO: 4024784 - RNA, 17 nt, Measles virus
aaccgcauccccacagc

SEQ ID NO: 4024785 - RNA, 21 nt, Measles virus
aacggugugaccauccaaguc

SEQ ID NO: 4024786 - RNA, 19 nt, Measles virus
aagaaaacuuugaaaauac

SEQ ID NO: 4024787 - RNA, 15 nt, Measles virus
aagacccugacaaga

SEQ ID NO: 4024788 - RNA, 14 nt, Measles virus
aagacucauccagu

SEQ ID NO: 4024789 - RNA, 15 nt, Measles virus
aagcagggcaggaga

SEQ ID NO: 4024790 - RNA, 16 nt, Measles virus
aagccauggcagcaug

SEQ ID NO: 4024791 - RNA, 22 nt, Measles virus
aagcgguuaagggaauccaaga

SEQ ID NO: 4024792 - RNA, 15 nt, Measles virus
aaggacgugcugaca

SEQ ID NO: 4024793 - RNA, 23 nt, Measles virus
aaggcacuccacacucuggcugu

SEQ ID NO: 4024794 - RNA, 22 nt, Measles virus
aagucccccggucuccuccucu

SEQ ID NO: 4024795 - RNA, 16 nt, Measles virus
aaguucucaagaagcc

SEQ ID NO: 4024796 - RNA, 17 nt, Measles virus
uuaauauguugcugcag

SEQ ID NO: 4024797 - RNA, 14 nt, Measles virus
cuggggaaugcaau

SEQ ID NO: 4024798 - RNA, 17 nt, Measles virus
cuggugccgucacuucu

SEQ ID NO: 4024799 - RNA, 23 nt, Measles virus
cuuaccugccaaccccaugccag

SEQ ID NO: 4024800 - RNA, 17 nt, Measles virus
cuuagagagcagaggaa

SEQ ID NO: 4024801 - RNA, 15 nt, Measles virus
cuuagggccaaggaa

SEQ ID NO: 4024802 - RNA, 14 nt, Measles virus
cuuaucaaauugua

SEQ ID NO: 4024803 - RNA, 21 nt, Measles virus
cuuaucucgaauuuugaugag

SEQ ID NO: 4024804 - RNA, 12 nt, Measles virus
cuucaaugcaaa

SEQ ID NO: 4024805 - RNA, 16 nt, Measles virus
cuuccagcucgucaag

SEQ ID NO: 4024806 - RNA, 17 nt, Measles virus
cuugccaaguuccacca

SEQ ID NO: 4024807 - RNA, 19 nt, Measles virus
cuugggaaaacucucaaug

SEQ ID NO: 4024808 - RNA, 15 nt, Measles virus
cuuucaugccagagg

SEQ ID NO: 4024809 - RNA, 20 nt, Measles virus
gaaaauacgaaguuucuauu

SEQ ID NO: 4024810 - RNA, 15 nt, Measles virus
gaaauacaugaauca

SEQ ID NO: 4024811 - RNA, 15 nt, Measles virus
gaaauagacaucaga

SEQ ID NO: 4024812 - RNA, 10 nt, Measles virus
gaaccagagu

SEQ ID NO: 4024813 - RNA, 12 nt, Measles virus
gaaccagcaccc

SEQ ID NO: 4024814 - RNA, 14 nt, Measles virus
gaaccagcacccaa

SEQ ID NO: 4024815 - RNA, 17 nt, Measles virus
gaacuccggaacccuaa

SEQ ID NO: 4024816 - RNA, 19 nt, Measles virus
gaacuccucaaagaggcca

SEQ ID NO: 4024817 - RNA, 13 nt, Measles virus
gaagccauggcag

SEQ ID NO: 4024818 - RNA, 14 nt, Measles virus
gaauacaggagacu

SEQ ID NO: 4024819 - RNA, 16 nt, Measles virus
gaaugucaucaagucc

SEQ ID NO: 4024820 - RNA, 17 nt, Measles virus
gacaccaggcggcccaa

SEQ ID NO: 4024821 - RNA, 19 nt, Measles virus
gacaccucagagauucacu

SEQ ID NO: 4024822 - RNA, 14 nt, Measles virus
gacacuaacucacg

SEQ ID NO: 4024823 - RNA, 20 nt, Measles virus
gacaguugagcuuaaaauca

SEQ ID NO: 4024824 - RNA, 22 nt, Measles virus
gaccaagcgagaggccagccag

SEQ ID NO: 4024825 - RNA, 15 nt, Measles virus
gaccacccugggcca

SEQ ID NO: 4024826 - RNA, 18 nt, Measles virus
gaccacccugggccacca

SEQ ID NO: 4024827 - RNA, 14 nt, Measles virus
gaccccggcccgcg

SEQ ID NO: 4024828 - RNA, 17 nt, Measles virus
gaccgcagugcccagca

SEQ ID NO: 4024829 - RNA, 20 nt, Measles virus
gaccggggaucugcucccau

SEQ ID NO: 4024830 - RNA, 15 nt, Measles virus
gaccuuauguuuugc

SEQ ID NO: 4024831 - RNA, 16 nt, Measles virus
gacuccuuagacagau

SEQ ID NO: 4024832 - RNA, 20 nt, Measles virus
gacuccuuagacagauccuc

SEQ ID NO: 4024833 - RNA, 16 nt, Measles virus
gacuuacaaaaugagg

SEQ ID NO: 4024834 - RNA, 12 nt, Measles virus
gacuucagagau

SEQ ID NO: 4024835 - RNA, 18 nt, Measles virus
gagaucuacgauuucgac

SEQ ID NO: 4024836 - RNA, 18 nt, Measles virus
gagcccuuucuguuuugg

SEQ ID NO: 4024837 - RNA, 14 nt, Measles virus
gagccgauggcaga

SEQ ID NO: 4024838 - RNA, 20 nt, Measles virus
gaggacagcugcugaaggaa

SEQ ID NO: 4024839 - RNA, 21 nt, Measles virus
gaggugaacggugugaccauc

SEQ ID NO: 4024840 - RNA, 21 nt, Measles virus
gagguguuaucgcugacaauc

SEQ ID NO: 4024841 - RNA, 14 nt, Measles virus
gagucaacaaggaa

SEQ ID NO: 4024842 - RNA, 23 nt, Measles virus
gaguccucugcuccaagaaugcc

SEQ ID NO: 4024843 - RNA, 19 nt, Measles virus
gauaucaaaggagccaacg

SEQ ID NO: 4024844 - RNA, 16 nt, Measles virus
gauccucuccccccgg

SEQ ID NO: 4024845 - RNA, 14 nt, Measles virus
gaucggucaaugca

SEQ ID NO: 4024846 - RNA, 23 nt, Measles virus
gaucugacaauguaccuaaagga

SEQ ID NO: 4024847 - RNA, 20 nt, Measles virus
gauggcagaagagcaggcac

SEQ ID NO: 4024848 - RNA, 18 nt, Measles virus
gcaaccaccgcauccagc

SEQ ID NO: 4024849 - RNA, 18 nt, Measles virus
gcaaguguggacaccagg

SEQ ID NO: 4024850 - RNA, 16 nt, Measles virus
gcaauauauuaaagaa

SEQ ID NO: 4024851 - RNA, 15 nt, Measles virus
gcaaugacccagaau

SEQ ID NO: 4024852 - RNA, 11 nt, Measles virus
gcacacccacc

SEQ ID NO: 4024853 - RNA, 18 nt, Measles virus
gcacuuaaugcaaugacc

SEQ ID NO: 4024854 - RNA, 15 nt, Measles virus
gcagugcccagcaau

SEQ ID NO: 4024855 - RNA, 16 nt, Measles virus
gcagugcccagcaaua

SEQ ID NO: 4024856 - RNA, 20 nt, Measles virus
gcauccccacagcucccggg

SEQ ID NO: 4024857 - RNA, 16 nt, Measles virus
gccacagcugcucaga

SEQ ID NO: 4024858 - RNA, 15 nt, Measles virus
gccaccaccagccau

SEQ ID NO: 4024859 - RNA, 13 nt, Measles virus
gccaccagcuccc

SEQ ID NO: 4024860 - RNA, 18 nt, Measles virus
gccagccgacaacuccag

SEQ ID NO: 4024861 - RNA, 19 nt, Measles virus
gccauaggaggagacacac

SEQ ID NO: 4024862 - RNA, 17 nt, Measles virus
gcccaccugaaauuguc

SEQ ID NO: 4024863 - RNA, 20 nt, Measles virus
gccccgacacaaggccacca

SEQ ID NO: 4024864 - RNA, 21 nt, Measles virus
gccccgacacaaggccaccac

SEQ ID NO: 4024865 - RNA, 13 nt, Measles virus
gccgacagccagc

SEQ ID NO: 4024866 - RNA, 14 nt, Measles virus
gccgacagccagca

SEQ ID NO: 4024867 - RNA, 14 nt, Measles virus
gccgccagccaacc

SEQ ID NO: 4024868 - RNA, 20 nt, Measles virus
gccuacccuccaucauuguu

SEQ ID NO: 4024869 - RNA, 18 nt, Measles virus
gccugaaagaaaaggaga

SEQ ID NO: 4024870 - RNA, 19 nt, Measles virus
gcgaccgaggugacccaac

SEQ ID NO: 4024871 - RNA, 14 nt, Measles virus
gcggcccaagcaca

SEQ ID NO: 4024872 - RNA, 15 nt, Measles virus
gcuaaguuggaggau

SEQ ID NO: 4024873 - RNA, 18 nt, Measles virus
gcuagccauugcaggcau

SEQ ID NO: 4024874 - RNA, 13 nt, Measles virus
gcuauccuggagu

SEQ ID NO: 4024875 - RNA, 13 nt, Measles virus
gcucaagcuucag

SEQ ID NO: 4024876 - RNA, 21 nt, Measles virus
gcucccagacucggccaucac

SEQ ID NO: 4024877 - RNA, 13 nt, Measles virus
gcugcagacacaa

SEQ ID NO: 4024878 - RNA, 13 nt, Measles virus
gcugucccgacaa

SEQ ID NO: 4024879 - RNA, 24 nt, Measles virus
gcuuuaccucucaucucacagagg

SEQ ID NO: 4024880 - RNA, 17 nt, Measles virus
ggaagaggaggcaggca

SEQ ID NO: 4024881 - RNA, 16 nt, Measles virus
ggacagcugcugaagg

SEQ ID NO: 4024882 - RNA, 17 nt, Measles virus
ggacagcugcugaagga

SEQ ID NO: 4024883 - RNA, 18 nt, Measles virus
ggaccagauauugaggag

SEQ ID NO: 4024884 - RNA, 19 nt, Measles virus
ggaccgagccaccugcaag

SEQ ID NO: 4024885 - RNA, 14 nt, Measles virus
ggacguagggacaa

SEQ ID NO: 4024886 - RNA, 13 nt, Measles virus
ggagaucaaggaa

SEQ ID NO: 4024887 - RNA, 22 nt, Measles virus
ggagaugauauuggcuguucag

SEQ ID NO: 4024888 - RNA, 19 nt, Measles virus
ggagccaacgaucuugcca

SEQ ID NO: 4024889 - RNA, 18 nt, Measles virus
ggagucaucggaccagau

SEQ ID NO: 4024890 - RNA, 14 nt, Measles virus
ggaucaacugaagg

SEQ ID NO: 4024891 - RNA, 20 nt, Measles virus
ggaucuccaauauguuuugg

SEQ ID NO: 4024892 - RNA, 22 nt, Measles virus
ggccacaacccgcgcaccccag

SEQ ID NO: 4024893 - RNA, 18 nt, Measles virus
ggcggcccaagcacagaa

SEQ ID NO: 4024894 - RNA, 14 nt, Measles virus
ggcugcugaagaac

SEQ ID NO: 4024895 - RNA, 19 nt, Measles virus
gggcucaaauugcucagau

SEQ ID NO: 4024896 - RNA, 18 nt, Measles virus
ggucaauucucaaacaug

SEQ ID NO: 4024897 - RNA, 18 nt, Measles virus
ggucagggaucuggagaa

SEQ ID NO: 4024898 - RNA, 17 nt, Measles virus
gguguaccugcacagaa

SEQ ID NO: 4024899 - RNA, 16 nt, Measles virus
gguucagggcuucuga

SEQ ID NO: 4024900 - RNA, 15 nt, Measles virus
guaccugcacagaau

SEQ ID NO: 4024901 - RNA, 14 nt, Measles virus
guacgggggaacuu

SEQ ID NO: 4024902 - RNA, 21 nt, Measles virus
guaggauaguuauuaacagag

SEQ ID NO: 4024903 - RNA, 18 nt, Measles virus
gucaaaaacggacuggaa

SEQ ID NO: 4024904 - RNA, 22 nt, Measles virus
gucaauucucaaacaugucgcu

SEQ ID NO: 4024905 - RNA, 23 nt, Measles virus
gucagaaauaucagacaacccag

SEQ ID NO: 4024906 - RNA, 23 nt, Measles virus
guccaagacaucaaaacagccuu

SEQ ID NO: 4024907 - RNA, 22 nt, Measles virus
gucccaaccucuucacuguucc

SEQ ID NO: 4024908 - RNA, 21 nt, Measles virus
gucccucacgcuuacagccug

SEQ ID NO: 4024909 - RNA, 18 nt, Measles virus
gugaaauagacaucagaa

SEQ ID NO: 4024910 - RNA, 16 nt, Measles virus
gugaacucaacucuac

SEQ ID NO: 4024911 - RNA, 18 nt, Measles virus
gugcuugcggacucagaa

SEQ ID NO: 4024912 - RNA, 13 nt, Measles virus
guggaaugcuuca

SEQ ID NO: 4024913 - RNA, 20 nt, Measles virus
guggcugcugaagaacucau

SEQ ID NO: 4024914 - RNA, 16 nt, Measles virus
guuaucgcugacaauc

SEQ ID NO: 4024915 - RNA, 24 nt, Measles virus
guucagaguguagcuucaaguagg

SEQ ID NO: 4024916 - RNA, 17 nt, Measles virus
guuccagaggacagcug

SEQ ID NO: 4024917 - RNA, 18 nt, Measles virus
guuccuagcugucucaaa

SEQ ID NO: 4024918 - RNA, 18 nt, Measles virus
guugagcuuaaaaucaaa

SEQ ID NO: 4024919 - RNA, 23 nt, Measles virus
guugaggacagcgauccccuagg

SEQ ID NO: 4024920 - RNA, 18 nt, Measles virus
guugggaaugucaucaag

SEQ ID NO: 4024921 - RNA, 11 nt, Measles virus
guuucuauucc

SEQ ID NO: 4024922 - RNA, 23 nt, Measles virus
guuugaaguagggguuaucagaa

SEQ ID NO: 4024923 - RNA, 20 nt, Measles virus
cucuucucgaagggaccaaa

SEQ ID NO: 4024924 - RNA, 15 nt, Measles virus
cugaaaaugucagga

SEQ ID NO: 4024925 - RNA, 16 nt, Measles virus
cugaaaaugucaggaa

SEQ ID NO: 4024926 - RNA, 16 nt, Measles virus
cugaggacaccucaga

SEQ ID NO: 4024927 - RNA, 18 nt, Measles virus
cugaucuuacagggacau

SEQ ID NO: 4024928 - RNA, 16 nt, Measles virus
cugcaaggaagaggag

SEQ ID NO: 4024929 - RNA, 12 nt, Measles virus
cugcacucggga

SEQ ID NO: 4024930 - RNA, 23 nt, Measles virus
cugcguccuccucgugggacccc

SEQ ID NO: 4024931 - RNA, 16 nt, Measles virus
cugcucagggcccacu

SEQ ID NO: 4024932 - RNA, 23 nt, Measles virus
cugcuggggguuguugaggacag

SEQ ID NO: 4024933 - RNA, 21 nt, Measles virus
cuggaaggacaccucucaagc

SEQ ID NO: 4024934 - RNA, 19 nt, Measles virus
cugggccaccagcucccag

SEQ ID NO: 4024935 - RNA, 19 nt, Measles virus
cugguaauucuaccugguc

SEQ ID NO: 4024936 - RNA, 19 nt, Measles virus
cugucucaaagggaaacug

SEQ ID NO: 4024937 - RNA, 15 nt, Measles virus
cugugugcagccaaa

SEQ ID NO: 4024938 - RNA, 22 nt, Measles virus
cuuacagggacaucaaaauccu

SEQ ID NO: 4024939 - RNA, 21 nt, Measles virus
cuuagguguaaucaacacauu

SEQ ID NO: 4024940 - RNA, 11 nt, Measles virus
cuucagagauc

SEQ ID NO: 4024941 - RNA, 14 nt, Measles virus
cuucuaggaagagu

SEQ ID NO: 4024942 - RNA, 17 nt, Measles virus
cuugaucggguugcuag

SEQ ID NO: 4024943 - RNA, 16 nt, Measles virus
cuuggaggagauauca

SEQ ID NO: 4024944 - RNA, 18 nt, Measles virus
gaaagguccuaacaacag

SEQ ID NO: 4024945 - RNA, 16 nt, Measles virus
gaagcccaguccacac

SEQ ID NO: 4024946 - RNA, 12 nt, Measles virus
gaaucccagaau

SEQ ID NO: 4024947 - RNA, 18 nt, Measles virus
gacaaaaaacucuggugc

SEQ ID NO: 4024948 - RNA, 22 nt, Measles virus
gacaaaaaagcccccuccagaa

SEQ ID NO: 4024949 - RNA, 20 nt, Measles virus
gacaaaauuaaauuccuuaa

SEQ ID NO: 4024950 - RNA, 19 nt, Measles virus
gacaaacuauuuugagcaa

SEQ ID NO: 4024951 - RNA, 19 nt, Measles virus
gacaacacggacagaugac

SEQ ID NO: 4024952 - RNA, 20 nt, Measles virus
gacacaauccggaaugcuca

SEQ ID NO: 4024953 - RNA, 21 nt, Measles virus
gacaccgggaaucccagaauc

SEQ ID NO: 4024954 - RNA, 16 nt, Measles virus
gacagguggugcaacc

SEQ ID NO: 4024955 - RNA, 15 nt, Measles virus
gacagugaucugaca

SEQ ID NO: 4024956 - RNA, 17 nt, Measles virus
gacauacaucugacagg

SEQ ID NO: 4024957 - RNA, 16 nt, Measles virus
gacaucaaaauccuau

SEQ ID NO: 4024958 - RNA, 14 nt, Measles virus
gacaucccagggaa

SEQ ID NO: 4024959 - RNA, 20 nt, Measles virus
gaccaaaacggguuuucuga

SEQ ID NO: 4024960 - RNA, 14 nt, Measles virus
gacccagcacccag

SEQ ID NO: 4024961 - RNA, 16 nt, Measles virus
gacccagcacccagcc

SEQ ID NO: 4024962 - RNA, 22 nt, Measles virus
gacccccgaggaccaaccccga

SEQ ID NO: 4024963 - RNA, 18 nt, Measles virus
gacccuacacugugucag

SEQ ID NO: 4024964 - RNA, 18 nt, Measles virus
gaccgaauaaaugccuuc

SEQ ID NO: 4024965 - RNA, 22 nt, Measles virus
gacuaucccgccaaugaagaac

SEQ ID NO: 4024966 - RNA, 14 nt, Measles virus
gacucguuccagcc

SEQ ID NO: 4024967 - RNA, 20 nt, Measles virus
gacugagaugaggucaguga

SEQ ID NO: 4024968 - RNA, 16 nt, Measles virus
gacugugugcagccaa

SEQ ID NO: 4024969 - RNA, 15 nt, Measles virus
gagaggccagccagc

SEQ ID NO: 4024970 - RNA, 17 nt, Measles virus
gagauauccauccaggc

SEQ ID NO: 4024971 - RNA, 23 nt, Measles virus
gagauccauaagagccucagcac

SEQ ID NO: 4024972 - RNA, 21 nt, Measles virus
gagaugauauuggcuguucag

SEQ ID NO: 4024973 - RNA, 23 nt, Measles virus
gagcacgauuugacuaaggcacu

SEQ ID NO: 4024974 - RNA, 18 nt, Measles virus
gagcaucaggucaaggac

SEQ ID NO: 4024975 - RNA, 14 nt, Measles virus
gagccucagcacca

SEQ ID NO: 4024976 - RNA, 15 nt, Measles virus
gagcuccugaaacuc

SEQ ID NO: 4024977 - RNA, 22 nt, Measles virus
gaggaacuccucaaagaggcca

SEQ ID NO: 4024978 - RNA, 15 nt, Measles virus
gaggccagccagcag

SEQ ID NO: 4024979 - RNA, 17 nt, Measles virus
gaggggacugugugcag

SEQ ID NO: 4024980 - RNA, 21 nt, Measles virus
gaggggagguuaaugacagag

SEQ ID NO: 4024981 - RNA, 16 nt, Measles virus
gaggugcuuuccuuaa

SEQ ID NO: 4024982 - RNA, 18 nt, Measles virus
gaguccucugcuccaaga

SEQ ID NO: 4024983 - RNA, 16 nt, Measles virus
gauaaucagaagauaa

SEQ ID NO: 4024984 - RNA, 23 nt, Measles virus
gaucuggagaaagcgaugacgac

SEQ ID NO: 4024985 - RNA, 19 nt, Measles virus
gaugcugacucuaucaugg

SEQ ID NO: 4024986 - RNA, 12 nt, Measles virus
gaugucacccag

SEQ ID NO: 4024987 - RNA, 17 nt, Measles virus
gaugucacccagacauc

SEQ ID NO: 4024988 - RNA, 20 nt, Measles virus
gauuauaaacaauguggaag

SEQ ID NO: 4024989 - RNA, 17 nt, Measles virus
gcaaccgaaccagaguc

SEQ ID NO: 4024990 - RNA, 13 nt, Measles virus
gcaacugagggau

SEQ ID NO: 4024991 - RNA, 15 nt, Measles virus
gcaagaucauccaca

SEQ ID NO: 4024992 - RNA, 15 nt, Measles virus
gcaagccuggaaacu

SEQ ID NO: 4024993 - RNA, 17 nt, Measles virus
gcaauauauuaaagaaa

SEQ ID NO: 4024994 - RNA, 16 nt, Measles virus
gcacaccaacccccga

SEQ ID NO: 4024995 - RNA, 23 nt, Measles virus
gcacagaacagccccgacacaag

SEQ ID NO: 4024996 - RNA, 21 nt, Measles virus
ugagcuccuaaaaaagggaaa

SEQ ID NO: 4024997 - RNA, 15 nt, Measles virus
ugaggcaaucagaca

SEQ ID NO: 4024998 - RNA, 15 nt, Measles virus
ugaguccucugcucc

SEQ ID NO: 4024999 - RNA, 18 nt, Measles virus
ugaugaagguacuuauca

SEQ ID NO: 4025000 - RNA, 23 nt, Measles virus
ugcagauguggcugcugaagaac

SEQ ID NO: 4025001 - RNA, 21 nt, Measles virus
ugccagccgacaacuccaggg

SEQ ID NO: 4025002 - RNA, 22 nt, Measles virus
ugccagccgacaacuccaggga

SEQ ID NO: 4025003 - RNA, 20 nt, Measles virus
ugccauauuuuguggaauca

SEQ ID NO: 4025004 - RNA, 22 nt, Measles virus
ugcccaauauaacucuccucaa

SEQ ID NO: 4025005 - RNA, 22 nt, Measles virus
ugcccacagguaggcacaccaa

SEQ ID NO: 4025006 - RNA, 23 nt, Measles virus
ugcuggggguuguugaggacagc

SEQ ID NO: 4025007 - RNA, 14 nt, Measles virus
ugcuucaggauucg

SEQ ID NO: 4025008 - RNA, 11 nt, Measles virus
uggcugcugaa

SEQ ID NO: 4025009 - RNA, 15 nt, Measles virus
uggcugcugaagaac

SEQ ID NO: 4025010 - RNA, 21 nt, Measles virus
ugggaaagccuaaucugagca

SEQ ID NO: 4025011 - RNA, 17 nt, Measles virus
ugggauggugggcaugg

SEQ ID NO: 4025012 - RNA, 21 nt, Measles virus
ugggcaugggagucagcugca

SEQ ID NO: 4025013 - RNA, 16 nt, Measles virus
ugguaguucaguugag

SEQ ID NO: 4025014 - RNA, 17 nt, Measles virus
uguaaggucgcucugau

SEQ ID NO: 4025015 - RNA, 14 nt, Measles virus
uguagccaugcugg

SEQ ID NO: 4025016 - RNA, 15 nt, Measles virus
ugucagcuuccagcu

SEQ ID NO: 4025017 - RNA, 20 nt, Measles virus
uguucuacaacaacacccca

SEQ ID NO: 4025018 - RNA, 15 nt, Measles virus
uuaaagaaaacuuug

SEQ ID NO: 4025019 - RNA, 18 nt, Measles virus
uuaaagaaaacuuugaaa

SEQ ID NO: 4025020 - RNA, 23 nt, Measles virus
uuaaucaagacccugacaagauc

SEQ ID NO: 4025021 - RNA, 16 nt, Measles virus
uuaaucggccagaagc

SEQ ID NO: 4025022 - RNA, 17 nt, Measles virus
uuacugaaauacaugau

SEQ ID NO: 4025023 - RNA, 24 nt, Measles virus
uuagacguacagcagggcucaaug

SEQ ID NO: 4025024 - RNA, 17 nt, Measles virus
uuaggcauuauuugcaa

SEQ ID NO: 4025025 - RNA, 23 nt, Measles virus
uuaugacucguuccagccaucaa

SEQ ID NO: 4025026 - RNA, 13 nt, Measles virus
uuaugaucacagc

SEQ ID NO: 4025027 - RNA, 19 nt, Measles virus
uuauuugcaauauauuaaa

SEQ ID NO: 4025028 - RNA, 23 nt, Measles virus
uuccuagcugucucaaagggaaa

SEQ ID NO: 4025029 - RNA, 15 nt, Measles virus
uugcaauauauuaaa

SEQ ID NO: 4025030 - RNA, 17 nt, Measles virus
uugccacagcugcucag

SEQ ID NO: 4025031 - RNA, 15 nt, Measles virus
uuggccaccccugac

SEQ ID NO: 4025032 - RNA, 17 nt, Measles virus
uugguagauccacagca

SEQ ID NO: 4025033 - RNA, 20 nt, Measles virus
ggaggcuuguagauguuuuc

SEQ ID NO: 4025034 - RNA, 15 nt, Measles virus
ggauaacaggauucc

SEQ ID NO: 4025035 - RNA, 13 nt, Measles virus
ggcaccauugaag

SEQ ID NO: 4025036 - RNA, 22 nt, Measles virus
ggcaguucgggucucagcaaac

SEQ ID NO: 4025037 - RNA, 18 nt, Measles virus
ggcaguuuugcagccauc

SEQ ID NO: 4025038 - RNA, 18 nt, Measles virus
ggccgaaguucucaagaa

SEQ ID NO: 4025039 - RNA, 13 nt, Measles virus
ggccgagcccauc

SEQ ID NO: 4025040 - RNA, 21 nt, Measles virus
ggccgagcccaucggcucacu

SEQ ID NO: 4025041 - RNA, 18 nt, Measles virus
gggaaaaaggugagcuca

SEQ ID NO: 4025042 - RNA, 15 nt, Molluscum contagiosum virus
ugccugugggauggc

SEQ ID NO: 4025043 - RNA, 24 nt, Molluscum contagiosum virus
ugccuuggcgcccgugccgccggc

SEQ ID NO: 4025044 - RNA, 19 nt, Molluscum contagiosum virus
ugcgaagacgagcgcgugc

SEQ ID NO: 4025045 - RNA, 13 nt, Molluscum contagiosum virus
ugcgaaggucauc

SEQ ID NO: 4025046 - RNA, 21 nt, Molluscum contagiosum virus
ugcgaaguuggucaacaacac

SEQ ID NO: 4025047 - RNA, 14 nt, Molluscum contagiosum virus
ugcgacagcugcug

SEQ ID NO: 4025048 - RNA, 14 nt, Molluscum contagiosum virus
ugcgaccggcaaca

SEQ ID NO: 4025049 - RNA, 17 nt, Molluscum contagiosum virus
ugcgagaacucgcgugc

SEQ ID NO: 4025050 - RNA, 16 nt, Molluscum contagiosum virus
ugcgagccagccaggc

SEQ ID NO: 4025051 - RNA, 18 nt, Molluscum contagiosum virus
ugcgagccagccaggcgc

SEQ ID NO: 4025052 - RNA, 17 nt, Molluscum contagiosum virus
ugcgagcggcgcgcgcu

SEQ ID NO: 4025053 - RNA, 16 nt, Molluscum contagiosum virus
ugcgaggccugcgugg

SEQ ID NO: 4025054 - RNA, 22 nt, Molluscum contagiosum virus
ugcgagggagccucgcuggugu

SEQ ID NO: 4025055 - RNA, 19 nt, Molluscum contagiosum virus
ugcgagucucuguaacaag

SEQ ID NO: 4025056 - RNA, 19 nt, Molluscum contagiosum virus
ugcgcaacgcgggccaggc

SEQ ID NO: 4025057 - RNA, 18 nt, Molluscum contagiosum virus
ugcgcaagcucagccucu

SEQ ID NO: 4025058 - RNA, 14 nt, Molluscum contagiosum virus
ugcgcacgugcgcg

SEQ ID NO: 4025059 - RNA, 16 nt, Molluscum contagiosum virus
ugcgcagcguccggca

SEQ ID NO: 4025060 - RNA, 18 nt, Molluscum contagiosum virus
ugcgcaucccugcgcacc

SEQ ID NO: 4025061 - RNA, 23 nt, Molluscum contagiosum virus
ugcgcaucccugcgcaccugcac

SEQ ID NO: 4025062 - RNA, 15 nt, Molluscum contagiosum virus
ugcgcauggccacgc

SEQ ID NO: 4025063 - RNA, 13 nt, Molluscum contagiosum virus
ugcgcccacgagu

SEQ ID NO: 4025064 - RNA, 13 nt, Molluscum contagiosum virus
ugcgccucggacu

SEQ ID NO: 4025065 - RNA, 16 nt, Molluscum contagiosum virus
ugcgcgacaugcugcc

SEQ ID NO: 4025066 - RNA, 12 nt, Molluscum contagiosum virus
ugcgcgagcagc

SEQ ID NO: 4025067 - RNA, 20 nt, Molluscum contagiosum virus
ugcgcgagcgcgcgcugcgc

SEQ ID NO: 4025068 - RNA, 13 nt, Molluscum contagiosum virus
ugcgcgcgcgcgu

SEQ ID NO: 4025069 - RNA, 18 nt, Molluscum contagiosum virus
ugcgcgcgcucauggcgc

SEQ ID NO: 4025070 - RNA, 19 nt, Molluscum contagiosum virus
ugcgcgcugcgggcgccgg

SEQ ID NO: 4025071 - RNA, 18 nt, Molluscum contagiosum virus
ugcgcgggaugcuggacg

SEQ ID NO: 4025072 - RNA, 13 nt, Molluscum contagiosum virus
ugcgcggggcagg

SEQ ID NO: 4025073 - RNA, 15 nt, Molluscum contagiosum virus
ugcgcguccgcaaag

SEQ ID NO: 4025074 - RNA, 17 nt, Molluscum contagiosum virus
ugcgcgugcugggcccc

SEQ ID NO: 4025075 - RNA, 20 nt, Molluscum contagiosum virus
ugcgcgugugcagcagguag

SEQ ID NO: 4025076 - RNA, 17 nt, Molluscum contagiosum virus
ugcgcguucgcaaagac

SEQ ID NO: 4025077 - RNA, 21 nt, Molluscum contagiosum virus
ugcgcuacguuccgcgcgggg

SEQ ID NO: 4025078 - RNA, 15 nt, Molluscum contagiosum virus
ugcgcuccaugcugc

SEQ ID NO: 4025079 - RNA, 17 nt, Molluscum contagiosum virus
ugcgcugucucuccgag

SEQ ID NO: 4025080 - RNA, 17 nt, Molluscum contagiosum virus
ugcgcuucggcucccag

SEQ ID NO: 4025081 - RNA, 18 nt, Molluscum contagiosum virus
ugcgcuuuuuuuguccug

SEQ ID NO: 4025082 - RNA, 20 nt, Molluscum contagiosum virus
ugcggagacuguuaggcauc

SEQ ID NO: 4025083 - RNA, 15 nt, Molluscum contagiosum virus
ugcggccaccagcgc

SEQ ID NO: 4025084 - RNA, 17 nt, Molluscum contagiosum virus
ugcggcgcgggcaagca

SEQ ID NO: 4025085 - RNA, 22 nt, Molluscum contagiosum virus
ugcggcgcgugccgcugcgcgg

SEQ ID NO: 4025086 - RNA, 18 nt, Molluscum contagiosum virus
ugcggcuccaacagcagc

SEQ ID NO: 4025087 - RNA, 22 nt, Molluscum contagiosum virus
ugcguacacauggccgcgcgcu

SEQ ID NO: 4025088 - RNA, 15 nt, Molluscum contagiosum virus
ugcgucccagcagcu

SEQ ID NO: 4025089 - RNA, 19 nt, Molluscum contagiosum virus
ugcgucccagcagcugcuc

SEQ ID NO: 4025090 - RNA, 16 nt, Molluscum contagiosum virus
ugcguuuccagggcag

SEQ ID NO: 4025091 - RNA, 16 nt, Molluscum contagiosum virus
ugcuacgcgagcacug

SEQ ID NO: 4025092 - RNA, 14 nt, Molluscum contagiosum virus
ugcuauuaccugac

SEQ ID NO: 4025093 - RNA, 15 nt, Molluscum contagiosum virus
ugcuccacgcgcagc

SEQ ID NO: 4025094 - RNA, 17 nt, Molluscum contagiosum virus
ugcucccgaggcgcgcu

SEQ ID NO: 4025095 - RNA, 17 nt, Molluscum contagiosum virus
ugcucccucgcgcgcag

SEQ ID NO: 4025096 - RNA, 15 nt, Molluscum contagiosum virus
ugcuccgaggaggca

SEQ ID NO: 4025097 - RNA, 19 nt, Molluscum contagiosum virus
ugcucgcuugccgcuugag

SEQ ID NO: 4025098 - RNA, 21 nt, Molluscum contagiosum virus
ugcucgguagcguggagcugg

SEQ ID NO: 4025099 - RNA, 16 nt, Molluscum contagiosum virus
ugcucuaccuggugcu

SEQ ID NO: 4025100 - RNA, 18 nt, Molluscum contagiosum virus
ugcucuaccuggugcugg

SEQ ID NO: 4025101 - RNA, 19 nt, Molluscum contagiosum virus
ugcucuacgcaacacggcg

SEQ ID NO: 4025102 - RNA, 16 nt, Molluscum contagiosum virus
ugcugaagaaggagcc

SEQ ID NO: 4025103 - RNA, 11 nt, Molluscum contagiosum virus
ugcugcagcuc

SEQ ID NO: 4025104 - RNA, 13 nt, Molluscum contagiosum virus
ugcugcaggcgua

SEQ ID NO: 4025105 - RNA, 18 nt, Molluscum contagiosum virus
ugcugccgcgcggcacgc

SEQ ID NO: 4025106 - RNA, 19 nt, Molluscum contagiosum virus
ugcugcgccacgugcgcau

SEQ ID NO: 4025107 - RNA, 19 nt, Molluscum contagiosum virus
ugcugcgcgcgccaugguu

SEQ ID NO: 4025108 - RNA, 22 nt, Molluscum contagiosum virus
ugcugcgcuucgccgcgcgcgc

SEQ ID NO: 4025109 - RNA, 15 nt, Molluscum contagiosum virus
ugcuggacacucgcg

SEQ ID NO: 4025110 - RNA, 16 nt, Molluscum contagiosum virus
ugcuggacgcgcacgc

SEQ ID NO: 4025111 - RNA, 23 nt, Molluscum contagiosum virus
ugcuggacgcgcacgcgggacgc

SEQ ID NO: 4025112 - RNA, 14 nt, Molluscum contagiosum virus
ugcuggagggcacg

SEQ ID NO: 4025113 - RNA, 19 nt, Molluscum contagiosum virus
ugcuggccaucgagcuucc

SEQ ID NO: 4025114 - RNA, 13 nt, Molluscum contagiosum virus
ugcuggcgggcgc

SEQ ID NO: 4025115 - RNA, 12 nt, Molluscum contagiosum virus
ugcugggcgugg

SEQ ID NO: 4025116 - RNA, 20 nt, Molluscum contagiosum virus
ugcuggucaagaaggcgcug

SEQ ID NO: 4025117 - RNA, 15 nt, Molluscum contagiosum virus
ugcugguggugcugg

SEQ ID NO: 4025118 - RNA, 19 nt, Molluscum contagiosum virus
ugcugguggugcuggagcg

SEQ ID NO: 4025119 - RNA, 24 nt, Molluscum contagiosum virus
ugcuucggcggcugugcccgcggc

SEQ ID NO: 4025120 - RNA, 13 nt, Molluscum contagiosum virus
ugcuugcgcacga

SEQ ID NO: 4025121 - RNA, 23 nt, Molluscum contagiosum virus
ugcuuugcgcgcguaugcgaaca

SEQ ID NO: 4025122 - RNA, 13 nt, Molluscum contagiosum virus
uggaaaggaggcu

SEQ ID NO: 4025123 - RNA, 11 nt, Molluscum contagiosum virus
uggaagaacag

SEQ ID NO: 4025124 - RNA, 16 nt, Molluscum contagiosum virus
uggaauugugcugcug

SEQ ID NO: 4025125 - RNA, 20 nt, Molluscum contagiosum virus
uggacacgcugcgcgugcug

SEQ ID NO: 4025126 - RNA, 21 nt, Molluscum contagiosum virus
uggaccacaagcaguaccugc

SEQ ID NO: 4025127 - RNA, 15 nt, Molluscum contagiosum virus
uggaccugcgccagc

SEQ ID NO: 4025128 - RNA, 17 nt, Molluscum contagiosum virus
uggacgcgcaagugugc

SEQ ID NO: 4025129 - RNA, 13 nt, Molluscum contagiosum virus
uggacgcuccgag

SEQ ID NO: 4025130 - RNA, 14 nt, Molluscum contagiosum virus
uggacgcuccgagc

SEQ ID NO: 4025131 - RNA, 17 nt, Molluscum contagiosum virus
uggacguguccgacgcg

SEQ ID NO: 4025132 - RNA, 10 nt, Molluscum contagiosum virus
uggacugugc

SEQ ID NO: 4025133 - RNA, 23 nt, Molluscum contagiosum virus
uggagaaagaagugugccugcug

SEQ ID NO: 4025134 - RNA, 23 nt, Molluscum contagiosum virus
uggagacggaggugguggccaag

SEQ ID NO: 4025135 - RNA, 14 nt, Molluscum contagiosum virus
uggagacggcagug

SEQ ID NO: 4025136 - RNA, 16 nt, Molluscum contagiosum virus
uggagacggcaguguc

SEQ ID NO: 4025137 - RNA, 17 nt, Molluscum contagiosum virus
uggagcacuuccgcgcg

SEQ ID NO: 4025138 - RNA, 19 nt, Molluscum contagiosum virus
uggagcacuuccgcgcgcu

SEQ ID NO: 4025139 - RNA, 22 nt, Molluscum contagiosum virus
uggagcagacguacgagcaggc

SEQ ID NO: 4025140 - RNA, 16 nt, Molluscum contagiosum virus
uggagcgcgcggacgc

SEQ ID NO: 4025141 - RNA, 16 nt, Molluscum contagiosum virus
uggagcuagcgcgcgc

SEQ ID NO: 4025142 - RNA, 18 nt, Molluscum contagiosum virus
uggagcugccgcugcgcg

SEQ ID NO: 4025143 - RNA, 19 nt, Molluscum contagiosum virus
uggagggcuccucuucaga

SEQ ID NO: 4025144 - RNA, 14 nt, Molluscum contagiosum virus
uggaguacuucaag

SEQ ID NO: 4025145 - RNA, 13 nt, Molluscum contagiosum virus
uggaugcugcucg

SEQ ID NO: 4025146 - RNA, 13 nt, Molluscum contagiosum virus
uggcaaacaggca

SEQ ID NO: 4025147 - RNA, 14 nt, Molluscum contagiosum virus
uggcaaaggcaggg

SEQ ID NO: 4025148 - RNA, 19 nt, Molluscum contagiosum virus
uggcaauccugguacgcgc

SEQ ID NO: 4025149 - RNA, 23 nt, Molluscum contagiosum virus
uggcacccuucugaggggcagug

SEQ ID NO: 4025150 - RNA, 15 nt, Molluscum contagiosum virus
uggcaccgcgcgcgc

SEQ ID NO: 4025151 - RNA, 15 nt, Molluscum contagiosum virus
uggcaccggaagcaa

SEQ ID NO: 4025152 - RNA, 14 nt, Molluscum contagiosum virus
uggcacgcgagcaa

SEQ ID NO: 4025153 - RNA, 16 nt, Molluscum contagiosum virus
uggcauccggcacgca

SEQ ID NO: 4025154 - RNA, 15 nt, Molluscum contagiosum virus
uggcauucucggaca

SEQ ID NO: 4025155 - RNA, 22 nt, Molluscum contagiosum virus
uggccaaggucucgagcuccag

SEQ ID NO: 4025156 - RNA, 13 nt, Molluscum contagiosum virus
uggcccccgccuu

SEQ ID NO: 4025157 - RNA, 13 nt, Molluscum contagiosum virus
cgcgcgcggcacg

SEQ ID NO: 4025158 - RNA, 12 nt, Molluscum contagiosum virus
cgcgcgcgugcc

SEQ ID NO: 4025159 - RNA, 20 nt, Molluscum contagiosum virus
cgcgcgcguuugucgcgggc

SEQ ID NO: 4025160 - RNA, 20 nt, Molluscum contagiosum virus
cgcgcgcuaccugcgcaagc

SEQ ID NO: 4025161 - RNA, 16 nt, Molluscum contagiosum virus
cgcgcgcuacgcgccg

SEQ ID NO: 4025162 - RNA, 20 nt, Molluscum contagiosum virus
cgcgcgcuaggggugccgcu

SEQ ID NO: 4025163 - RNA, 16 nt, Molluscum contagiosum virus
cgcgcgcucagcgccg

SEQ ID NO: 4025164 - RNA, 13 nt, Molluscum contagiosum virus
cgcgcgcucgcgc

SEQ ID NO: 4025165 - RNA, 14 nt, Molluscum contagiosum virus
cgcgcgcugcgcgc

SEQ ID NO: 4025166 - RNA, 20 nt, Molluscum contagiosum virus
cgcgcggaagcccgccucgu

SEQ ID NO: 4025167 - RNA, 17 nt, Molluscum contagiosum virus
cgcgcggcaagccuggc

SEQ ID NO: 4025168 - RNA, 12 nt, Molluscum contagiosum virus
cgcgcggcagca

SEQ ID NO: 4025169 - RNA, 14 nt, Molluscum contagiosum virus
cgcgcggcagcagc

SEQ ID NO: 4025170 - RNA, 15 nt, Molluscum contagiosum virus
cgcgcggcgcucugc

SEQ ID NO: 4025171 - RNA, 18 nt, Molluscum contagiosum virus
cgcgcggcuaagcucugc

SEQ ID NO: 4025172 - RNA, 16 nt, Molluscum contagiosum virus
cgcgcggugcugcgcc

SEQ ID NO: 4025173 - RNA, 16 nt, Molluscum contagiosum virus
cgcgcgucugcgagug

SEQ ID NO: 4025174 - RNA, 14 nt, Molluscum contagiosum virus
cgcgcgugccgggc

SEQ ID NO: 4025175 - RNA, 16 nt, Molluscum contagiosum virus
cgcgcgugugcauggc

SEQ ID NO: 4025176 - RNA, 22 nt, Molluscum contagiosum virus
cgcgcguguuugugcugucccu

SEQ ID NO: 4025177 - RNA, 18 nt, Molluscum contagiosum virus
cgcgcguugcugcccgug

SEQ ID NO: 4025178 - RNA, 21 nt, Molluscum contagiosum virus
cgcgcuauucaaagcugugcg

SEQ ID NO: 4025179 - RNA, 17 nt, Molluscum contagiosum virus
cgcgcuauucucguggc

SEQ ID NO: 4025180 - RNA, 14 nt, Molluscum contagiosum virus
cgcgcucacugcag

SEQ ID NO: 4025181 - RNA, 14 nt, Molluscum contagiosum virus
cgcgcuccgagucg

SEQ ID NO: 4025182 - RNA, 15 nt, Molluscum contagiosum virus
cgcgcucgcgcuucc

SEQ ID NO: 4025183 - RNA, 23 nt, Molluscum contagiosum virus
cgcgcucgcgggagcgggagggc

SEQ ID NO: 4025184 - RNA, 15 nt, Molluscum contagiosum virus
cgcgcucgcgugccg

SEQ ID NO: 4025185 - RNA, 20 nt, Molluscum contagiosum virus
cgcgcucgcucgcgcuccgc

SEQ ID NO: 4025186 - RNA, 18 nt, Molluscum contagiosum virus
cgcgcucgggaagcacgu

SEQ ID NO: 4025187 - RNA, 21 nt, Molluscum contagiosum virus
cgcgcugagcgcggagcuggc

SEQ ID NO: 4025188 - RNA, 14 nt, Molluscum contagiosum virus
cgcgcugccagcgg

SEQ ID NO: 4025189 - RNA, 13 nt, Molluscum contagiosum virus
cgcgcugcgcaag

SEQ ID NO: 4025190 - RNA, 12 nt, Molluscum contagiosum virus
cgcgcugcgccg

SEQ ID NO: 4025191 - RNA, 14 nt, Molluscum contagiosum virus
cgcgcugcgcgccg

SEQ ID NO: 4025192 - RNA, 15 nt, Molluscum contagiosum virus
cgcgcugcgggcgcc

SEQ ID NO: 4025193 - RNA, 12 nt, Molluscum contagiosum virus
cgcgcugcucug

SEQ ID NO: 4025194 - RNA, 21 nt, Molluscum contagiosum virus
cgcgcuggacuugcgcgagcg

SEQ ID NO: 4025195 - RNA, 18 nt, Molluscum contagiosum virus
cgcgcuggcgcgcgcgcu

SEQ ID NO: 4025196 - RNA, 17 nt, Molluscum contagiosum virus
cgcgcuucugccccguc

SEQ ID NO: 4025197 - RNA, 11 nt, Molluscum contagiosum virus
cgcgcuuuguc

SEQ ID NO: 4025198 - RNA, 16 nt, Molluscum contagiosum virus
cgcggaagaauuccuu

SEQ ID NO: 4025199 - RNA, 15 nt, Molluscum contagiosum virus
cgcggacgcgcccug

SEQ ID NO: 4025200 - RNA, 13 nt, Molluscum contagiosum virus
cgcggacgcgggc

SEQ ID NO: 4025201 - RNA, 15 nt, Molluscum contagiosum virus
cgcggagaccaccgc

SEQ ID NO: 4025202 - RNA, 22 nt, Molluscum contagiosum virus
cgcggagcgcuagcagggcggc

SEQ ID NO: 4025203 - RNA, 12 nt, Molluscum contagiosum virus
cgcggagcugug

SEQ ID NO: 4025204 - RNA, 20 nt, Molluscum contagiosum virus
cgcggauauggcgcgccgag

SEQ ID NO: 4025205 - RNA, 17 nt, Molluscum contagiosum virus
cgcggaugccacgcagc

SEQ ID NO: 4025206 - RNA, 19 nt, Molluscum contagiosum virus
cgcggaugccacgcagcug

SEQ ID NO: 4025207 - RNA, 20 nt, Molluscum contagiosum virus
cgcggaugccacgcagcugg

SEQ ID NO: 4025208 - RNA, 15 nt, Molluscum contagiosum virus
cgcggcaacagcacg

SEQ ID NO: 4025209 - RNA, 16 nt, Molluscum contagiosum virus
cgcggccaugcuccug

SEQ ID NO: 4025210 - RNA, 14 nt, Molluscum contagiosum virus
cgcggccgcggagg

SEQ ID NO: 4025211 - RNA, 15 nt, Molluscum contagiosum virus
cgcggccgcggaggg

SEQ ID NO: 4025212 - RNA, 13 nt, Molluscum contagiosum virus
cgcggccugggcc

SEQ ID NO: 4025213 - RNA, 20 nt, Molluscum contagiosum virus
cgcggcgagugcggccacca

SEQ ID NO: 4025214 - RNA, 14 nt, Molluscum contagiosum virus
cgcggcgcgccggc

SEQ ID NO: 4025215 - RNA, 12 nt, Molluscum contagiosum virus
cgcggcgcggcg

SEQ ID NO: 4025216 - RNA, 12 nt, Molluscum contagiosum virus
cgcggcgcucug

SEQ ID NO: 4025217 - RNA, 22 nt, Molluscum contagiosum virus
cgcggcgcucugccaccgcggc

SEQ ID NO: 4025218 - RNA, 22 nt, Molluscum contagiosum virus
cgcggcgguugcccgccugccg

SEQ ID NO: 4025219 - RNA, 17 nt, Molluscum contagiosum virus
cgcggcgugugcgggcu

SEQ ID NO: 4025220 - RNA, 12 nt, Molluscum contagiosum virus
cgcggcguuccc

SEQ ID NO: 4025221 - RNA, 18 nt, Molluscum contagiosum virus
cgcggcuaccacgggccc

SEQ ID NO: 4025222 - RNA, 23 nt, Molluscum contagiosum virus
cgcggcuaccacgggcccgcgcg

SEQ ID NO: 4025223 - RNA, 17 nt, Molluscum contagiosum virus
cgcggcuuacacacgca

SEQ ID NO: 4025224 - RNA, 12 nt, Molluscum contagiosum virus
cgcgggccaggc

SEQ ID NO: 4025225 - RNA, 13 nt, Molluscum contagiosum virus
cgcgggccgccgc

SEQ ID NO: 4025226 - RNA, 17 nt, Molluscum contagiosum virus
cgcgggccuguccgcgg

SEQ ID NO: 4025227 - RNA, 21 nt, Molluscum contagiosum virus
cgcgggccuguccgcgggcgc

SEQ ID NO: 4025228 - RNA, 12 nt, Molluscum contagiosum virus
cgcgggcgcacg

SEQ ID NO: 4025229 - RNA, 12 nt, Molluscum contagiosum virus
cgcgggcgcaga

SEQ ID NO: 4025230 - RNA, 22 nt, Molluscum contagiosum virus
cgcgggcgccggcguccgcggc

SEQ ID NO: 4025231 - RNA, 20 nt, Molluscum contagiosum virus
cgcgggcgcgcgccagcagc

SEQ ID NO: 4025232 - RNA, 14 nt, Molluscum contagiosum virus
cgcgggcgcgcgcg

SEQ ID NO: 4025233 - RNA, 18 nt, Molluscum contagiosum virus
cgcgggcgcgcggcaagc

SEQ ID NO: 4025234 - RNA, 16 nt, Molluscum contagiosum virus
cgcgggcggcggcccg

SEQ ID NO: 4025235 - RNA, 19 nt, Molluscum contagiosum virus
cgcgggcguguccgcgggc

SEQ ID NO: 4025236 - RNA, 17 nt, Molluscum contagiosum virus
cgcgguccagccgcacc

SEQ ID NO: 4025237 - RNA, 13 nt, Molluscum contagiosum virus
cgcggucgggccc

SEQ ID NO: 4025238 - RNA, 14 nt, Molluscum contagiosum virus
cgcggucgggcccc

SEQ ID NO: 4025239 - RNA, 14 nt, Molluscum contagiosum virus
cgcggugcagcugc

SEQ ID NO: 4025240 - RNA, 17 nt, Molluscum contagiosum virus
cgcggugcgcgcgugcg

SEQ ID NO: 4025241 - RNA, 17 nt, Molluscum contagiosum virus
cgcgguugagcgccgug

SEQ ID NO: 4025242 - RNA, 16 nt, Molluscum contagiosum virus
cgcguaaagagcgucc

SEQ ID NO: 4025243 - RNA, 20 nt, Molluscum contagiosum virus
cgcguacauaaaauggacca

SEQ ID NO: 4025244 - RNA, 13 nt, Molluscum contagiosum virus
cgcguagcagcgc

SEQ ID NO: 4025245 - RNA, 17 nt, Molluscum contagiosum virus
cgcguaguacgcuacgc

SEQ ID NO: 4025246 - RNA, 20 nt, Molluscum contagiosum virus
cgcgucaucgcugcacgcga

SEQ ID NO: 4025247 - RNA, 12 nt, Molluscum contagiosum virus
cgcguccacgca

SEQ ID NO: 4025248 - RNA, 14 nt, Molluscum contagiosum virus
cugcuuccuccucc

SEQ ID NO: 4025249 - RNA, 19 nt, Molluscum contagiosum virus
cuggacgggcacgagcacg

SEQ ID NO: 4025250 - RNA, 18 nt, Molluscum contagiosum virus
cuggacggugcuggugcu

SEQ ID NO: 4025251 - RNA, 14 nt, Molluscum contagiosum virus
cuggagcaagcgcg

SEQ ID NO: 4025252 - RNA, 14 nt, Molluscum contagiosum virus
cuggagcugccgcu

SEQ ID NO: 4025253 - RNA, 19 nt, Molluscum contagiosum virus
cuggagcugccgcugcgcg

SEQ ID NO: 4025254 - RNA, 14 nt, Molluscum contagiosum virus
cuggaggugaguca

SEQ ID NO: 4025255 - RNA, 20 nt, Molluscum contagiosum virus
cuggaguuuaaugacgcgca

SEQ ID NO: 4025256 - RNA, 13 nt, Molluscum contagiosum virus
cuggaugcugcuc

SEQ ID NO: 4025257 - RNA, 17 nt, Molluscum contagiosum virus
cuggcaccgcgcgcgcu

SEQ ID NO: 4025258 - RNA, 20 nt, Molluscum contagiosum virus
cuggcccugcuugacgcgag

SEQ ID NO: 4025259 - RNA, 13 nt, Molluscum contagiosum virus
cuggccucugcca

SEQ ID NO: 4025260 - RNA, 14 nt, Molluscum contagiosum virus
cuggccucugccug

SEQ ID NO: 4025261 - RNA, 21 nt, Molluscum contagiosum virus
cuggcgaaaccugggcgccgc

SEQ ID NO: 4025262 - RNA, 20 nt, Molluscum contagiosum virus
cuggcgauguccaugucgcg

SEQ ID NO: 4025263 - RNA, 17 nt, Molluscum contagiosum virus
cuggcgcgguccagccg

SEQ ID NO: 4025264 - RNA, 23 nt, Molluscum contagiosum virus
cuggcgcuaccuaccggcagcau

SEQ ID NO: 4025265 - RNA, 18 nt, Molluscum contagiosum virus
cuggcucgcgccugcgcu

SEQ ID NO: 4025266 - RNA, 16 nt, Molluscum contagiosum virus
cuggcucguacugcug

SEQ ID NO: 4025267 - RNA, 18 nt, Molluscum contagiosum virus
cuggcucguacugcugca

SEQ ID NO: 4025268 - RNA, 15 nt, Molluscum contagiosum virus
cuggcuucuccaccu

SEQ ID NO: 4025269 - RNA, 18 nt, Molluscum contagiosum virus
cugggcacaagcuuucuc

SEQ ID NO: 4025270 - RNA, 23 nt, Molluscum contagiosum virus
cugggcgguugccugcacaagca

SEQ ID NO: 4025271 - RNA, 20 nt, Molluscum contagiosum virus
cuggucgagcaccugucgcg

SEQ ID NO: 4025272 - RNA, 17 nt, Molluscum contagiosum virus
cuggugcgcccgcggca

SEQ ID NO: 4025273 - RNA, 16 nt, Molluscum contagiosum virus
cugguggagcacuucc

SEQ ID NO: 4025274 - RNA, 13 nt, Molluscum contagiosum virus
cugguggccgcac

SEQ ID NO: 4025275 - RNA, 22 nt, Molluscum contagiosum virus
cuggugucgagcucgcgcgcca

SEQ ID NO: 4025276 - RNA, 13 nt, Molluscum contagiosum virus
cugguucaugcug

SEQ ID NO: 4025277 - RNA, 15 nt, Molluscum contagiosum virus
cugguucugcucgca

SEQ ID NO: 4025278 - RNA, 20 nt, Molluscum contagiosum virus
cugguuugcgcucucagagc

SEQ ID NO: 4025279 - RNA, 20 nt, Molluscum contagiosum virus
cuguaaauggaccacaagca

SEQ ID NO: 4025280 - RNA, 14 nt, Molluscum contagiosum virus
cuguaccuggugcg

SEQ ID NO: 4025281 - RNA, 16 nt, Molluscum contagiosum virus
cuguacgugcugcccg

SEQ ID NO: 4025282 - RNA, 21 nt, Molluscum contagiosum virus
cugucaucaccccgcugggcc

SEQ ID NO: 4025283 - RNA, 14 nt, Molluscum contagiosum virus
cugucccucugugc

SEQ ID NO: 4025284 - RNA, 12 nt, Molluscum contagiosum virus
cuguccgaggac

SEQ ID NO: 4025285 - RNA, 23 nt, Molluscum contagiosum virus
cugucuuuuccucacgucgcugg

SEQ ID NO: 4025286 - RNA, 14 nt, Molluscum contagiosum virus
cugugagcgcgccg

SEQ ID NO: 4025287 - RNA, 23 nt, Molluscum contagiosum virus
cugugcauugcgucuuacugcug

SEQ ID NO: 4025288 - RNA, 17 nt, Molluscum contagiosum virus
cugugcccuggaagcuu

SEQ ID NO: 4025289 - RNA, 13 nt, Molluscum contagiosum virus
cugugccgcagca

SEQ ID NO: 4025290 - RNA, 21 nt, Molluscum contagiosum virus
cugugccuaggaggagaacuc

SEQ ID NO: 4025291 - RNA, 14 nt, Molluscum contagiosum virus
cugugccugcaaga

SEQ ID NO: 4025292 - RNA, 21 nt, Molluscum contagiosum virus
cugugcgcgacgccugcuagc

SEQ ID NO: 4025293 - RNA, 20 nt, Molluscum contagiosum virus
cugugucgcgcgagcaaaga

SEQ ID NO: 4025294 - RNA, 15 nt, Molluscum contagiosum virus
cuguuacggacggcg

SEQ ID NO: 4025295 - RNA, 14 nt, Molluscum contagiosum virus
cuguucugcuugga

SEQ ID NO: 4025296 - RNA, 23 nt, Molluscum contagiosum virus
cuguugccuggagggcagugcca

SEQ ID NO: 4025297 - RNA, 18 nt, Molluscum contagiosum virus
cuuacgcuacagcagccg

SEQ ID NO: 4025298 - RNA, 14 nt, Molluscum contagiosum virus
cuuacugcugcaau

SEQ ID NO: 4025299 - RNA, 23 nt, Molluscum contagiosum virus
cuuagcuucagaacggaggacag

SEQ ID NO: 4025300 - RNA, 20 nt, Molluscum contagiosum virus
cuucaagaacgacacggagc

SEQ ID NO: 4025301 - RNA, 17 nt, Molluscum contagiosum virus
cuucaccugcauugagc

SEQ ID NO: 4025302 - RNA, 19 nt, Molluscum contagiosum virus
cuucacggagaucaggcag

SEQ ID NO: 4025303 - RNA, 24 nt, Molluscum contagiosum virus
cuucacggcguucaccuuggcgcu

SEQ ID NO: 4025304 - RNA, 21 nt, Molluscum contagiosum virus
cuuccacgaaaucgccgcgcg

SEQ ID NO: 4025305 - RNA, 20 nt, Molluscum contagiosum virus
cuuccccgcacaagggcagc

SEQ ID NO: 4025306 - RNA, 22 nt, Molluscum contagiosum virus
cuucccgacgucuuccccaaga

SEQ ID NO: 4025307 - RNA, 23 nt, Molluscum contagiosum virus
cuuccgcgagcacguggacagca

SEQ ID NO: 4025308 - RNA, 20 nt, Molluscum contagiosum virus
cuuccgcggcgugcagggcg

SEQ ID NO: 4025309 - RNA, 15 nt, Molluscum contagiosum virus
cuuccggcagcugga

SEQ ID NO: 4025310 - RNA, 20 nt, Molluscum contagiosum virus
cuuccggcagcuggagcugc

SEQ ID NO: 4025311 - RNA, 16 nt, Molluscum contagiosum virus
cuuccugcuggcgcgc

SEQ ID NO: 4025312 - RNA, 15 nt, Molluscum contagiosum virus
cuuccuuugcucuac

SEQ ID NO: 4025313 - RNA, 22 nt, Molluscum contagiosum virus
cuucgacagcgugcgcgggcac

SEQ ID NO: 4025314 - RNA, 21 nt, Molluscum contagiosum virus
cuucgacguugacgagcgcgu

SEQ ID NO: 4025315 - RNA, 16 nt, Molluscum contagiosum virus
cuucgacuucuccgcg

SEQ ID NO: 4025316 - RNA, 21 nt, Molluscum contagiosum virus
cuucgaggugcgcgagucgcg

SEQ ID NO: 4025317 - RNA, 23 nt, Molluscum contagiosum virus
cuucgcagaggacagcuccuucu

SEQ ID NO: 4025318 - RNA, 17 nt, Molluscum contagiosum virus
cuucgcgcccgacgagc

SEQ ID NO: 4025319 - RNA, 17 nt, Molluscum contagiosum virus
cuucggcggcugugccc

SEQ ID NO: 4025320 - RNA, 17 nt, Molluscum contagiosum virus
cuucggggacacaagga

SEQ ID NO: 4025321 - RNA, 16 nt, Molluscum contagiosum virus
cuucgugcugaagacg

SEQ ID NO: 4025322 - RNA, 20 nt, Molluscum contagiosum virus
cuucucgcagcguuccagga

SEQ ID NO: 4025323 - RNA, 17 nt, Molluscum contagiosum virus
cuucucgccgcaccaca

SEQ ID NO: 4025324 - RNA, 16 nt, Molluscum contagiosum virus
cuucugcugcacacac

SEQ ID NO: 4025325 - RNA, 14 nt, Molluscum contagiosum virus
cuucuugcgcggcg

SEQ ID NO: 4025326 - RNA, 21 nt, Molluscum contagiosum virus
cuugaauugagugcgggucac

SEQ ID NO: 4025327 - RNA, 14 nt, Molluscum contagiosum virus
cuugacaggcgcgc

SEQ ID NO: 4025328 - RNA, 17 nt, Molluscum contagiosum virus
cuugauaaaagcacagu

SEQ ID NO: 4025329 - RNA, 23 nt, Molluscum contagiosum virus
cuugcagacaaggagaugggcac

SEQ ID NO: 4025330 - RNA, 18 nt, Molluscum contagiosum virus
cuugcgcacggaccucaa

SEQ ID NO: 4025331 - RNA, 19 nt, Molluscum contagiosum virus
cuugcgcguucgcaaagac

SEQ ID NO: 4025332 - RNA, 13 nt, Molluscum contagiosum virus
cuugcggcacgca

SEQ ID NO: 4025333 - RNA, 21 nt, Molluscum contagiosum virus
cuugcuagcaacuugcucuac

SEQ ID NO: 4025334 - RNA, 24 nt, Molluscum contagiosum virus
cuugcucgaaguagccuccguagc

SEQ ID NO: 4025335 - RNA, 23 nt, Molluscum contagiosum virus
cuugcucuucgaccucugcuuca

SEQ ID NO: 4025336 - RNA, 11 nt, Molluscum contagiosum virus
cuugcuuccag

SEQ ID NO: 4025337 - RNA, 21 nt, Molluscum contagiosum virus
cuuggcaauggcgcgcagcuc

SEQ ID NO: 4025338 - RNA, 14 nt, Molluscum contagiosum virus
cuuggcgggcaccg

SEQ ID NO: 4025339 - RNA, 19 nt, Molluscum contagiosum virus
cuuggcguucgcagugccc

SEQ ID NO: 4025340 - RNA, 18 nt, Molluscum contagiosum virus
cuugggagcaaggccugg

SEQ ID NO: 4025341 - RNA, 16 nt, Molluscum contagiosum virus
cuuggggaagacgucg

SEQ ID NO: 4025342 - RNA, 18 nt, Molluscum contagiosum virus
cuuggugcucauccuccc

SEQ ID NO: 4025343 - RNA, 20 nt, Molluscum contagiosum virus
cuugguguucugcgcgccgc

SEQ ID NO: 4025344 - RNA, 13 nt, Molluscum contagiosum virus
cuuguccgcggac

SEQ ID NO: 4025345 - RNA, 16 nt, Molluscum contagiosum virus
cuuguccgcggacgcg

SEQ ID NO: 4025346 - RNA, 22 nt, Molluscum contagiosum virus
cuuguccgcggacgcgggccug

SEQ ID NO: 4025347 - RNA, 14 nt, Molluscum contagiosum virus
cuugucgagacagg

SEQ ID NO: 4025348 - RNA, 21 nt, Molluscum contagiosum virus
cuuuaacgcgugcggugacuu

SEQ ID NO: 4025349 - RNA, 12 nt, Molluscum contagiosum virus
cuuucccccaca

SEQ ID NO: 4025350 - RNA, 17 nt, Molluscum contagiosum virus
cuuucguggucaucaag

SEQ ID NO: 4025351 - RNA, 19 nt, Molluscum contagiosum virus
ccgccgggaauaccggaga

SEQ ID NO: 4025352 - RNA, 16 nt, Molluscum contagiosum virus
ccgccggucuccacgu

SEQ ID NO: 4025353 - RNA, 24 nt, Molluscum contagiosum virus
ccgccgucgcccggcaggcucccg

SEQ ID NO: 4025354 - RNA, 22 nt, Molluscum contagiosum virus
ccgccuacggggcugcuccggc

SEQ ID NO: 4025355 - RNA, 17 nt, Molluscum contagiosum virus
ccgccucgagcacgccu

SEQ ID NO: 4025356 - RNA, 12 nt, Molluscum contagiosum virus
ccgccugcaugu

SEQ ID NO: 4025357 - RNA, 12 nt, Molluscum contagiosum virus
ccgcgaagagca

SEQ ID NO: 4025358 - RNA, 15 nt, Molluscum contagiosum virus
ccgcgaagagcacga

SEQ ID NO: 4025359 - RNA, 17 nt, Molluscum contagiosum virus
ccgcgaaguccugggcg

SEQ ID NO: 4025360 - RNA, 19 nt, Molluscum contagiosum virus
ccgcgagcacuggcuggcg

SEQ ID NO: 4025361 - RNA, 19 nt, Molluscum contagiosum virus
ccgcgagcgcaugcgcgcc

SEQ ID NO: 4025362 - RNA, 22 nt, Molluscum contagiosum virus
ccgcgaggacccgcgcuuuguc

SEQ ID NO: 4025363 - RNA, 16 nt, Molluscum contagiosum virus
ccgcgcaaaagcacag

SEQ ID NO: 4025364 - RNA, 12 nt, Molluscum contagiosum virus
ccgcgcaccgcg

SEQ ID NO: 4025365 - RNA, 21 nt, Molluscum contagiosum virus
ccgcgcagcucguugcgcagc

SEQ ID NO: 4025366 - RNA, 15 nt, Molluscum contagiosum virus
ccgcgccagcgacag

SEQ ID NO: 4025367 - RNA, 21 nt, Molluscum contagiosum virus
ccgcgcccaagaagaagcagc

SEQ ID NO: 4025368 - RNA, 14 nt, Molluscum contagiosum virus
ccgcgccgaaacac

SEQ ID NO: 4025369 - RNA, 15 nt, Molluscum contagiosum virus
ccgcgcgaacaaaaa

SEQ ID NO: 4025370 - RNA, 16 nt, Molluscum contagiosum virus
ccgcgcgagcgcgccc

SEQ ID NO: 4025371 - RNA, 17 nt, Molluscum contagiosum virus
ccgcgcgagcgcgcccc

SEQ ID NO: 4025372 - RNA, 18 nt, Molluscum contagiosum virus
ccgcgcgcccgcugcgcg

SEQ ID NO: 4025373 - RNA, 15 nt, Molluscum contagiosum virus
cacggccggcgccgc

SEQ ID NO: 4025374 - RNA, 17 nt, Molluscum contagiosum virus
cacggccuucgcgcugc

SEQ ID NO: 4025375 - RNA, 18 nt, Molluscum contagiosum virus
cacggccuucgcguuccg

SEQ ID NO: 4025376 - RNA, 20 nt, Molluscum contagiosum virus
cacggccuucuccucgcucu

SEQ ID NO: 4025377 - RNA, 23 nt, Molluscum contagiosum virus
cacggcgacaacgacagagcccg

SEQ ID NO: 4025378 - RNA, 13 nt, Molluscum contagiosum virus
cacggcgagcugc

SEQ ID NO: 4025379 - RNA, 17 nt, Molluscum contagiosum virus
cacggcgagcugccaug

SEQ ID NO: 4025380 - RNA, 16 nt, Molluscum contagiosum virus
cacggcgcucgccucu

SEQ ID NO: 4025381 - RNA, 23 nt, Molluscum contagiosum virus
cacggcuguaaugugcuggucaa

SEQ ID NO: 4025382 - RNA, 16 nt, Molluscum contagiosum virus
cacgggggcugccggc

SEQ ID NO: 4025383 - RNA, 15 nt, Molluscum contagiosum virus
cacgguccugggcga

SEQ ID NO: 4025384 - RNA, 23 nt, Molluscum contagiosum virus
cacggugugcuacugcacugcag

SEQ ID NO: 4025385 - RNA, 21 nt, Molluscum contagiosum virus
cacgguucgcggcgcgcggcg

SEQ ID NO: 4025386 - RNA, 16 nt, Molluscum contagiosum virus
cacgugcagcggcgcc

SEQ ID NO: 4025387 - RNA, 16 nt, Molluscum contagiosum virus
cacgugccaagaccug

SEQ ID NO: 4025388 - RNA, 18 nt, Molluscum contagiosum virus
cacgugcgcuggcccacg

SEQ ID NO: 4025389 - RNA, 20 nt, Molluscum contagiosum virus
cacgugcucaagugcgucga

SEQ ID NO: 4025390 - RNA, 19 nt, Molluscum contagiosum virus
cacgugcugcugcggcugc

SEQ ID NO: 4025391 - RNA, 22 nt, Molluscum contagiosum virus
cacguggccaaggucucgagcu

SEQ ID NO: 4025392 - RNA, 19 nt, Molluscum contagiosum virus
cacguuccagagcacugcg

SEQ ID NO: 4025393 - RNA, 18 nt, Molluscum contagiosum virus
cacguugccgcgcgcugc

SEQ ID NO: 4025394 - RNA, 16 nt, Molluscum contagiosum virus
cacuacaagcagccgc

SEQ ID NO: 4025395 - RNA, 16 nt, Molluscum contagiosum virus
cacuccgucgcgcucg

SEQ ID NO: 4025396 - RNA, 14 nt, Molluscum contagiosum virus
cacuccucggcgcu

SEQ ID NO: 4025397 - RNA, 12 nt, Molluscum contagiosum virus
cacucgagaaga

SEQ ID NO: 4025398 - RNA, 15 nt, Molluscum contagiosum virus
cacucgagaagaggg

SEQ ID NO: 4025399 - RNA, 16 nt, Molluscum contagiosum virus
cacucgauggacgcca

SEQ ID NO: 4025400 - RNA, 21 nt, Molluscum contagiosum virus
cacucgcgcguccgcaaagac

SEQ ID NO: 4025401 - RNA, 16 nt, Molluscum contagiosum virus
cacucguggcaacaac

SEQ ID NO: 4025402 - RNA, 16 nt, Molluscum contagiosum virus
cacucuuucacgcugc

SEQ ID NO: 4025403 - RNA, 21 nt, Molluscum contagiosum virus
cacucuuucacgcugcacgag

SEQ ID NO: 4025404 - RNA, 12 nt, Molluscum contagiosum virus
cacugcagcagc

SEQ ID NO: 4025405 - RNA, 19 nt, Molluscum contagiosum virus
cacugcgcgcgcggcgcag

SEQ ID NO: 4025406 - RNA, 20 nt, Molluscum contagiosum virus
cacugcggcaacgagcacgu

SEQ ID NO: 4025407 - RNA, 17 nt, Molluscum contagiosum virus
cacugcuacgagccgcu

SEQ ID NO: 4025408 - RNA, 15 nt, Molluscum contagiosum virus
cacugcucgcgcacg

SEQ ID NO: 4025409 - RNA, 14 nt, Molluscum contagiosum virus
cacugucgcgcagc

SEQ ID NO: 4025410 - RNA, 14 nt, Molluscum contagiosum virus
cacuuccgcgcgcu

SEQ ID NO: 4025411 - RNA, 19 nt, Molluscum contagiosum virus
cacuuccgugagcaguccc

SEQ ID NO: 4025412 - RNA, 22 nt, Molluscum contagiosum virus
cacuuccugcuagaaugcgugu

SEQ ID NO: 4025413 - RNA, 14 nt, Molluscum contagiosum virus
cacuugcacgcgca

SEQ ID NO: 4025414 - RNA, 21 nt, Molluscum contagiosum virus
cacuugcgcguucgcaaagac

SEQ ID NO: 4025415 - RNA, 14 nt, Molluscum contagiosum virus
cagaacugccuggu

SEQ ID NO: 4025416 - RNA, 17 nt, Molluscum contagiosum virus
cagaagacggaguccuc

SEQ ID NO: 4025417 - RNA, 22 nt, Molluscum contagiosum virus
cagaaggcguaugcgccaagcc

SEQ ID NO: 4025418 - RNA, 17 nt, Molluscum contagiosum virus
cagacaaagacaguccg

SEQ ID NO: 4025419 - RNA, 15 nt, Molluscum contagiosum virus
cagaccaagaagccc

SEQ ID NO: 4025420 - RNA, 19 nt, Molluscum contagiosum virus
cagaccccugaaaggcauc

SEQ ID NO: 4025421 - RNA, 21 nt, Molluscum contagiosum virus
cagacccgaaagcugcccugc

SEQ ID NO: 4025422 - RNA, 21 nt, Molluscum contagiosum virus
cagacgcagcgcgagcugugc

SEQ ID NO: 4025423 - RNA, 14 nt, Molluscum contagiosum virus
cagacgccgagcgg

SEQ ID NO: 4025424 - RNA, 22 nt, Molluscum contagiosum virus
cagagacacacgcuugcgcaug

SEQ ID NO: 4025425 - RNA, 12 nt, Molluscum contagiosum virus
cagagcacgaga

SEQ ID NO: 4025426 - RNA, 18 nt, Molluscum contagiosum virus
cagagccgcgugcgccgc

SEQ ID NO: 4025427 - RNA, 15 nt, Molluscum contagiosum virus
cagagcugcccgcca

SEQ ID NO: 4025428 - RNA, 16 nt, Molluscum contagiosum virus
cagagucgccgcugcg

SEQ ID NO: 4025429 - RNA, 23 nt, Molluscum contagiosum virus
cagauccgggcgcugcaccgcuu

SEQ ID NO: 4025430 - RNA, 21 nt, Molluscum contagiosum virus
cagauguucucgccaguggcc

SEQ ID NO: 4025431 - RNA, 12 nt, Molluscum contagiosum virus
cagcaagcgcac

SEQ ID NO: 4025432 - RNA, 13 nt, Molluscum contagiosum virus
cagcaagcucgau

SEQ ID NO: 4025433 - RNA, 19 nt, Molluscum contagiosum virus
cagcacaaacucgcagaac

SEQ ID NO: 4025434 - RNA, 23 nt, Molluscum contagiosum virus
cagcacaaagagcacggacagca

SEQ ID NO: 4025435 - RNA, 23 nt, Molluscum contagiosum virus
cagcacaugcaggccgagaugag

SEQ ID NO: 4025436 - RNA, 22 nt, Molluscum contagiosum virus
cagcaccaaggacguguacgug

SEQ ID NO: 4025437 - RNA, 14 nt, Molluscum contagiosum virus
cagcacgcgcgggc

SEQ ID NO: 4025438 - RNA, 23 nt, Molluscum contagiosum virus
cagcacgcgcucguccgccgcgu

SEQ ID NO: 4025439 - RNA, 19 nt, Molluscum contagiosum virus
cagcacggggucguagucc

SEQ ID NO: 4025440 - RNA, 14 nt, Molluscum contagiosum virus
cagcacuucgcaga

SEQ ID NO: 4025441 - RNA, 16 nt, Molluscum contagiosum virus
cagcagagcugcccgc

SEQ ID NO: 4025442 - RNA, 18 nt, Molluscum contagiosum virus
cagcagaggaguagcgug

SEQ ID NO: 4025443 - RNA, 16 nt, Molluscum contagiosum virus
cagcagccccgacgcc

SEQ ID NO: 4025444 - RNA, 18 nt, Molluscum contagiosum virus
cagcagccgcagcccacg

SEQ ID NO: 4025445 - RNA, 13 nt, Molluscum contagiosum virus
cagcagcgccagc

SEQ ID NO: 4025446 - RNA, 12 nt, Molluscum contagiosum virus
cagcagcgugca

SEQ ID NO: 4025447 - RNA, 12 nt, Molluscum contagiosum virus
cagcagcugcuc

SEQ ID NO: 4025448 - RNA, 16 nt, Molluscum contagiosum virus
cagcagcuggccggcu

SEQ ID NO: 4025449 - RNA, 14 nt, Molluscum contagiosum virus
cagcagcuggcgcg

SEQ ID NO: 4025450 - RNA, 15 nt, Molluscum contagiosum virus
cagcaggugcacgug

SEQ ID NO: 4025451 - RNA, 12 nt, Molluscum contagiosum virus
cagcaguccgcc

SEQ ID NO: 4025452 - RNA, 16 nt, Molluscum contagiosum virus
cagcagugccagcagc

SEQ ID NO: 4025453 - RNA, 20 nt, Molluscum contagiosum virus
cagcaugaacucgcugcugc

SEQ ID NO: 4025454 - RNA, 17 nt, Molluscum contagiosum virus
cagccacgaagagucgc

SEQ ID NO: 4025455 - RNA, 18 nt, Molluscum contagiosum virus
cagccacgacucgcgucu

SEQ ID NO: 4025456 - RNA, 21 nt, Molluscum contagiosum virus
cagccaugaggacagcuugcu

SEQ ID NO: 4025457 - RNA, 23 nt, Molluscum contagiosum virus
cagccauggccuguaguagcagc

SEQ ID NO: 4025458 - RNA, 14 nt, Molluscum contagiosum virus
cagccgcgcggcag

SEQ ID NO: 4025459 - RNA, 16 nt, Molluscum contagiosum virus
cagccgcugcgccgcc

SEQ ID NO: 4025460 - RNA, 13 nt, Molluscum contagiosum virus
cagccgcugcugc

SEQ ID NO: 4025461 - RNA, 14 nt, Molluscum contagiosum virus
cagccgcugcugcu

SEQ ID NO: 4025462 - RNA, 20 nt, Molluscum contagiosum virus
cagccuagaaacgacgggcg

SEQ ID NO: 4025463 - RNA, 15 nt, Molluscum contagiosum virus
cagccucaaccugaa

SEQ ID NO: 4025464 - RNA, 19 nt, Molluscum contagiosum virus
cagccugacggcagcaagc

SEQ ID NO: 4025465 - RNA, 24 nt, Molluscum contagiosum virus
cagccugcuggcaccgcgcgcgcu

SEQ ID NO: 4025466 - RNA, 21 nt, Molluscum contagiosum virus
cagccuguuuuuaucgagccg

SEQ ID NO: 4025467 - RNA, 20 nt, Molluscum contagiosum virus
cagcgacagacaccggccuu

SEQ ID NO: 4025468 - RNA, 18 nt, Molluscum contagiosum virus
cagcgacuacgcgcugcu

SEQ ID NO: 4025469 - RNA, 17 nt, Molluscum contagiosum virus
cagcgagcucaaggaca

SEQ ID NO: 4025470 - RNA, 19 nt, Molluscum contagiosum virus
cagcgauugcccgcgcgcg

SEQ ID NO: 4025471 - RNA, 14 nt, Molluscum contagiosum virus
cagcgcagcagcgc

SEQ ID NO: 4025472 - RNA, 21 nt, Molluscum contagiosum virus
cagcgcccgcguacacgugca

SEQ ID NO: 4025473 - RNA, 15 nt, Molluscum contagiosum virus
cagcgccgccaccuc

SEQ ID NO: 4025474 - RNA, 19 nt, Molluscum contagiosum virus
cagcgcgcccaccagcagc

SEQ ID NO: 4025475 - RNA, 13 nt, Molluscum contagiosum virus
cccgggcggcgcg

SEQ ID NO: 4025476 - RNA, 16 nt, Molluscum contagiosum virus
cccgggcggcgcgccg

SEQ ID NO: 4025477 - RNA, 15 nt, Molluscum contagiosum virus
cccgggggcgcuucc

SEQ ID NO: 4025478 - RNA, 20 nt, Molluscum contagiosum virus
cccggguuugugcccgagcu

SEQ ID NO: 4025479 - RNA, 20 nt, Molluscum contagiosum virus
cccguaaagaagcggugcag

SEQ ID NO: 4025480 - RNA, 21 nt, Molluscum contagiosum virus
cccguaggcgggccugcgccc

SEQ ID NO: 4025481 - RNA, 19 nt, Molluscum contagiosum virus
cccgugcuggagggcacgc

SEQ ID NO: 4025482 - RNA, 15 nt, Molluscum contagiosum virus
cccgugucgggcugc

SEQ ID NO: 4025483 - RNA, 13 nt, Molluscum contagiosum virus
cccguuccugggc

SEQ ID NO: 4025484 - RNA, 17 nt, Molluscum contagiosum virus
cccuacgcgcgcgugcu

SEQ ID NO: 4025485 - RNA, 23 nt, Molluscum contagiosum virus
cccucccugguaguccugcuagc

SEQ ID NO: 4025486 - RNA, 22 nt, Molluscum contagiosum virus
cccucgagcaaugcgagcaagg

SEQ ID NO: 4025487 - RNA, 16 nt, Molluscum contagiosum virus
cccucgcaagcugagc

SEQ ID NO: 4025488 - RNA, 17 nt, Molluscum contagiosum virus
cccucguccggcgcucg

SEQ ID NO: 4025489 - RNA, 14 nt, Molluscum contagiosum virus
cccucgucgcgcuu

SEQ ID NO: 4025490 - RNA, 14 nt, Molluscum contagiosum virus
cccucgugcugggc

SEQ ID NO: 4025491 - RNA, 18 nt, Molluscum contagiosum virus
cccucgugguugcgcagc

SEQ ID NO: 4025492 - RNA, 20 nt, Molluscum contagiosum virus
cccugcuaguccgcguacag

SEQ ID NO: 4025493 - RNA, 13 nt, Molluscum contagiosum virus
cccuggacgacgu

SEQ ID NO: 4025494 - RNA, 18 nt, Molluscum contagiosum virus
cccuggcagccgagccgg

SEQ ID NO: 4025495 - RNA, 21 nt, Molluscum contagiosum virus
cccugucgcgcacgagcgcgg

SEQ ID NO: 4025496 - RNA, 15 nt, Molluscum contagiosum virus
ccgaacugcucugcg

SEQ ID NO: 4025497 - RNA, 14 nt, Molluscum contagiosum virus
ccgacacgcgcccg

SEQ ID NO: 4025498 - RNA, 20 nt, Molluscum contagiosum virus
ccgaccgugcccuggaccuc

SEQ ID NO: 4025499 - RNA, 18 nt, Molluscum contagiosum virus
ccgacgccuuccugcugg

SEQ ID NO: 4025500 - RNA, 14 nt, Molluscum contagiosum virus
ccgacggcacgggc

SEQ ID NO: 4025501 - RNA, 18 nt, Molluscum contagiosum virus
ccgacgggccgccgcccg

SEQ ID NO: 4025502 - RNA, 17 nt, Molluscum contagiosum virus
ccgacugcccgcgcccu

SEQ ID NO: 4025503 - RNA, 17 nt, Molluscum contagiosum virus
ccgagaaaaagcugucg

SEQ ID NO: 4025504 - RNA, 17 nt, Molluscum contagiosum virus
ccgagagcaugcugucu

SEQ ID NO: 4025505 - RNA, 18 nt, Molluscum contagiosum virus
ccgagaucacggcgugcg

SEQ ID NO: 4025506 - RNA, 21 nt, Molluscum contagiosum virus
ccgagcagaaggaagggcccg

SEQ ID NO: 4025507 - RNA, 15 nt, Molluscum contagiosum virus
ccgagcagcggggac

SEQ ID NO: 4025508 - RNA, 13 nt, Molluscum contagiosum virus
ccgagcccgagcc

SEQ ID NO: 4025509 - RNA, 14 nt, Molluscum contagiosum virus
ccgagcccgcggcg

SEQ ID NO: 4025510 - RNA, 19 nt, Molluscum contagiosum virus
ccgagcccggccagacuac

SEQ ID NO: 4025511 - RNA, 19 nt, Molluscum contagiosum virus
ccgagccgggggaacacgc

SEQ ID NO: 4025512 - RNA, 16 nt, Molluscum contagiosum virus
ccgagcgccgccagcu

SEQ ID NO: 4025513 - RNA, 13 nt, Molluscum contagiosum virus
ccgagcgcgcgcg

SEQ ID NO: 4025514 - RNA, 22 nt, Molluscum contagiosum virus
ccgagcgcuacgacgacaugca

SEQ ID NO: 4025515 - RNA, 18 nt, Molluscum contagiosum virus
ccgagcggcaagccgugc

SEQ ID NO: 4025516 - RNA, 22 nt, Molluscum contagiosum virus
ccgagcuucuaaaucgcgcgcg

SEQ ID NO: 4025517 - RNA, 18 nt, Molluscum contagiosum virus
ccgaggcagguuccggug

SEQ ID NO: 4025518 - RNA, 20 nt, Molluscum contagiosum virus
ccgaggcguccagcggcugc

SEQ ID NO: 4025519 - RNA, 15 nt, Molluscum contagiosum virus
ccgagggcgugcgcu

SEQ ID NO: 4025520 - RNA, 21 nt, Molluscum contagiosum virus
ccgaguacuacuacacugucg

SEQ ID NO: 4025521 - RNA, 22 nt, Molluscum contagiosum virus
ccgagucgagcacgcgcgagcg

SEQ ID NO: 4025522 - RNA, 15 nt, Molluscum contagiosum virus
ccgagucgcgccucg

SEQ ID NO: 4025523 - RNA, 22 nt, Molluscum contagiosum virus
ccgagucguacacgcagagcca

SEQ ID NO: 4025524 - RNA, 12 nt, Molluscum contagiosum virus
ccgagugcuggc

SEQ ID NO: 4025525 - RNA, 14 nt, Molluscum contagiosum virus
ccgcaagcacggaa

SEQ ID NO: 4025526 - RNA, 19 nt, Molluscum contagiosum virus
ccgcaagugcacgcggcgc

SEQ ID NO: 4025527 - RNA, 22 nt, Molluscum contagiosum virus
ccgcaagugcacgcggcgcgug

SEQ ID NO: 4025528 - RNA, 19 nt, Molluscum contagiosum virus
ccgcacaagggcagcucaa

SEQ ID NO: 4025529 - RNA, 11 nt, Molluscum contagiosum virus
ccgcaccgagc

SEQ ID NO: 4025530 - RNA, 16 nt, Molluscum contagiosum virus
ccgcacgugcugcgcu

SEQ ID NO: 4025531 - RNA, 14 nt, Molluscum contagiosum virus
ccgcacguggaguc

SEQ ID NO: 4025532 - RNA, 18 nt, Molluscum contagiosum virus
ccgcacguggagucacga

SEQ ID NO: 4025533 - RNA, 21 nt, Molluscum contagiosum virus
ccgcagaacacgggggcugcc

SEQ ID NO: 4025534 - RNA, 13 nt, Molluscum contagiosum virus
ccgcagcccgagc

SEQ ID NO: 4025535 - RNA, 16 nt, Molluscum contagiosum virus
ccgcagcggcgccacc

SEQ ID NO: 4025536 - RNA, 22 nt, Molluscum contagiosum virus
ccgcaggaaaggcaccccgcag

SEQ ID NO: 4025537 - RNA, 18 nt, Molluscum contagiosum virus
ccgcaggaaaggcacccg

SEQ ID NO: 4025538 - RNA, 21 nt, Molluscum contagiosum virus
ccgcaggaaagguacccgcag

SEQ ID NO: 4025539 - RNA, 19 nt, Molluscum contagiosum virus
ccgcaggcccggcggcccg

SEQ ID NO: 4025540 - RNA, 20 nt, Molluscum contagiosum virus
ccgcaguaccaguaccugcu

SEQ ID NO: 4025541 - RNA, 18 nt, Molluscum contagiosum virus
ccgcaugggcccuggcgg

SEQ ID NO: 4025542 - RNA, 21 nt, Molluscum contagiosum virus
ccgccccuaaauaugaaccac

SEQ ID NO: 4025543 - RNA, 13 nt, Molluscum contagiosum virus
ccgcccgcgcuuc

SEQ ID NO: 4025544 - RNA, 18 nt, Molluscum contagiosum virus
ccgcccgcggacucgugc

SEQ ID NO: 4025545 - RNA, 18 nt, Molluscum contagiosum virus
ccgccgacaacgcacccg

SEQ ID NO: 4025546 - RNA, 21 nt, Molluscum contagiosum virus
ccgccgagauggagcucacgc

SEQ ID NO: 4025547 - RNA, 16 nt, Molluscum contagiosum virus
ccgccgcugccgcgcg

SEQ ID NO: 4025548 - RNA, 22 nt, Molluscum contagiosum virus
ccgccggcgccgcuaccagcuc

SEQ ID NO: 4025549 - RNA, 21 nt, Molluscum contagiosum virus
ggcugccgcugccugugccca

SEQ ID NO: 4025550 - RNA, 22 nt, Molluscum contagiosum virus
ggcugccgcugccugugcccag

SEQ ID NO: 4025551 - RNA, 17 nt, Molluscum contagiosum virus
ggcugcucccucucgag

SEQ ID NO: 4025552 - RNA, 17 nt, Molluscum contagiosum virus
ggcugcucucggcagcg

SEQ ID NO: 4025553 - RNA, 17 nt, Molluscum contagiosum virus
ggcuggaccugcgccag

SEQ ID NO: 4025554 - RNA, 18 nt, Molluscum contagiosum virus
ggcugucgcccggcagcg

SEQ ID NO: 4025555 - RNA, 15 nt, Molluscum contagiosum virus
ggcuguggacaugau

SEQ ID NO: 4025556 - RNA, 13 nt, Molluscum contagiosum virus
ggcuguguuccag

SEQ ID NO: 4025557 - RNA, 17 nt, Molluscum contagiosum virus
ggcuuccgacaacucgc

SEQ ID NO: 4025558 - RNA, 12 nt, Molluscum contagiosum virus
ggcuuggacagc

SEQ ID NO: 4025559 - RNA, 20 nt, Molluscum contagiosum virus
ggcuuggacuccgaggcagg

SEQ ID NO: 4025560 - RNA, 16 nt, Molluscum contagiosum virus
ggcuuguagucgcccc

SEQ ID NO: 4025561 - RNA, 20 nt, Molluscum contagiosum virus
gggaaaacgcgcggcagcag

SEQ ID NO: 4025562 - RNA, 19 nt, Molluscum contagiosum virus
gggaacgaggaaaggcacc

SEQ ID NO: 4025563 - RNA, 23 nt, Molluscum contagiosum virus
gggaacgaggaaaggcaccccga

SEQ ID NO: 4025564 - RNA, 21 nt, Molluscum contagiosum virus
gggaagcccucaggggcucuc

SEQ ID NO: 4025565 - RNA, 16 nt, Molluscum contagiosum virus
gggaccucuuucucgc

SEQ ID NO: 4025566 - RNA, 15 nt, Molluscum contagiosum virus
gggcaaugggcacgc

SEQ ID NO: 4025567 - RNA, 20 nt, Molluscum contagiosum virus
gggcacccagcccugguuug

SEQ ID NO: 4025568 - RNA, 13 nt, Molluscum contagiosum virus
gggcacgagcacg

SEQ ID NO: 4025569 - RNA, 13 nt, Molluscum contagiosum virus
gggcacgcgcgca

SEQ ID NO: 4025570 - RNA, 15 nt, Molluscum contagiosum virus
gggcacugcgcacgg

SEQ ID NO: 4025571 - RNA, 13 nt, Molluscum contagiosum virus
gggcacuucucgc

SEQ ID NO: 4025572 - RNA, 17 nt, Molluscum contagiosum virus
gggcacuucucgcgcga

SEQ ID NO: 4025573 - RNA, 17 nt, Molluscum contagiosum virus
gggcaucaugagccagu

SEQ ID NO: 4025574 - RNA, 16 nt, Molluscum contagiosum virus
gggcaugcacagcugc

SEQ ID NO: 4025575 - RNA, 14 nt, Molluscum contagiosum virus
gggcccgccuccgg

SEQ ID NO: 4025576 - RNA, 16 nt, Molluscum contagiosum virus
gggcccgcgaaggaga

SEQ ID NO: 4025577 - RNA, 19 nt, Molluscum contagiosum virus
gggcccgugcucaggccag

SEQ ID NO: 4025578 - RNA, 16 nt, Molluscum contagiosum virus
gggccgcgagcgcggg

SEQ ID NO: 4025579 - RNA, 13 nt, Molluscum contagiosum virus
gggcgcgugcugg

SEQ ID NO: 4025580 - RNA, 13 nt, Molluscum contagiosum virus
gggcgcuccgagc

SEQ ID NO: 4025581 - RNA, 13 nt, Molluscum contagiosum virus
gggcgcugcaccg

SEQ ID NO: 4025582 - RNA, 12 nt, Molluscum contagiosum virus
gggcgcugcucg

SEQ ID NO: 4025583 - RNA, 21 nt, Molluscum contagiosum virus
gggcggcgucgcgcgcgaccu

SEQ ID NO: 4025584 - RNA, 18 nt, Molluscum contagiosum virus
gggcgucgugcaccugga

SEQ ID NO: 4025585 - RNA, 23 nt, Molluscum contagiosum virus
gggcguguccgcgggcgcgcgcc

SEQ ID NO: 4025586 - RNA, 17 nt, Molluscum contagiosum virus
gggcuccuucuucagca

SEQ ID NO: 4025587 - RNA, 17 nt, Molluscum contagiosum virus
gggcuucgccgccggag

SEQ ID NO: 4025588 - RNA, 21 nt, Molluscum contagiosum virus
ggggacucucccgucgccgga

SEQ ID NO: 4025589 - RNA, 11 nt, Molluscum contagiosum virus
ggggcuggaca

SEQ ID NO: 4025590 - RNA, 15 nt, Molluscum contagiosum virus
ggggcuggcagaaga

SEQ ID NO: 4025591 - RNA, 22 nt, Molluscum contagiosum virus
ggggcugucgcuggaggauucu

SEQ ID NO: 4025592 - RNA, 22 nt, Molluscum contagiosum virus
ggguaaugcagauuggaggagg

SEQ ID NO: 4025593 - RNA, 14 nt, Molluscum contagiosum virus
ggguacacgugcuu

SEQ ID NO: 4025594 - RNA, 13 nt, Molluscum contagiosum virus
ggguaccgugcgc

SEQ ID NO: 4025595 - RNA, 12 nt, Molluscum contagiosum virus
gggucacgcaga

SEQ ID NO: 4025596 - RNA, 17 nt, Molluscum contagiosum virus
uccacgcgugcugcgcg

SEQ ID NO: 4025597 - RNA, 17 nt, Molluscum contagiosum virus
uccacgugguccaccag

SEQ ID NO: 4025598 - RNA, 17 nt, Molluscum contagiosum virus
uccacuuucucuauuca

SEQ ID NO: 4025599 - RNA, 16 nt, Molluscum contagiosum virus
uccagcccugugcccg

SEQ ID NO: 4025600 - RNA, 20 nt, Molluscum contagiosum virus
uccagccgucgccgcgcccg

SEQ ID NO: 4025601 - RNA, 21 nt, Molluscum contagiosum virus
uccagcgcgcccucgcgcgcg

SEQ ID NO: 4025602 - RNA, 14 nt, Molluscum contagiosum virus
uccagcgcgcucga

SEQ ID NO: 4025603 - RNA, 19 nt, Molluscum contagiosum virus
uccagcgcgcucgaggcgc

SEQ ID NO: 4025604 - RNA, 16 nt, Molluscum contagiosum virus
uccaggaucacgaugu

SEQ ID NO: 4025605 - RNA, 18 nt, Molluscum contagiosum virus
uccaggcgccgcaccuca

SEQ ID NO: 4025606 - RNA, 14 nt, Molluscum contagiosum virus
uccaguaccagcuc

SEQ ID NO: 4025607 - RNA, 14 nt, Molluscum contagiosum virus
uccccagcgccgcc

SEQ ID NO: 4025608 - RNA, 19 nt, Molluscum contagiosum virus
uccccgcgcaagagccgcc

SEQ ID NO: 4025609 - RNA, 22 nt, Molluscum contagiosum virus
uccccgguucaaauccugguuc

SEQ ID NO: 4025610 - RNA, 17 nt, Molluscum contagiosum virus
ucccgcuggcggcacgu

SEQ ID NO: 4025611 - RNA, 12 nt, Molluscum contagiosum virus
ucccggcugccg

SEQ ID NO: 4025612 - RNA, 14 nt, Molluscum contagiosum virus
ucccgucgagcacg

SEQ ID NO: 4025613 - RNA, 11 nt, Molluscum contagiosum virus
ucccucugugc

SEQ ID NO: 4025614 - RNA, 19 nt, Molluscum contagiosum virus
uccgaccucuuuccgcgcu

SEQ ID NO: 4025615 - RNA, 16 nt, Molluscum contagiosum virus
uccgagcgcgcgcgcu

SEQ ID NO: 4025616 - RNA, 16 nt, Molluscum contagiosum virus
uccgagcggcugcucg

SEQ ID NO: 4025617 - RNA, 16 nt, Molluscum contagiosum virus
uccgcacacgcgcgcg

SEQ ID NO: 4025618 - RNA, 20 nt, Molluscum contagiosum virus
uccgcacacgcgcgcgugcu

SEQ ID NO: 4025619 - RNA, 16 nt, Molluscum contagiosum virus
uccgcacgaggagccc

SEQ ID NO: 4025620 - RNA, 19 nt, Molluscum contagiosum virus
uccgcccccagguggagcu

SEQ ID NO: 4025621 - RNA, 15 nt, Molluscum contagiosum virus
uccgcccgcgcuucu

SEQ ID NO: 4025622 - RNA, 18 nt, Molluscum contagiosum virus
uccgcgaaguccugggcg

SEQ ID NO: 4025623 - RNA, 21 nt, Molluscum contagiosum virus
uccgcgacuaccugcugcuga

SEQ ID NO: 4025624 - RNA, 19 nt, Molluscum contagiosum virus
uccgcgagcuaaucagcgc

SEQ ID NO: 4025625 - RNA, 22 nt, Molluscum contagiosum virus
uccgcgggcgcgcgccagcagc

SEQ ID NO: 4025626 - RNA, 20 nt, Molluscum contagiosum virus
uccgcucgugccacugccgc

SEQ ID NO: 4025627 - RNA, 16 nt, Molluscum contagiosum virus
uccgcuguacgugcug

SEQ ID NO: 4025628 - RNA, 12 nt, Molluscum contagiosum virus
uccggcagcugg

SEQ ID NO: 4025629 - RNA, 14 nt, Molluscum contagiosum virus
uccggccuguaaau

SEQ ID NO: 4025630 - RNA, 23 nt, Molluscum contagiosum virus
uccggcgcggccuggccacgccg

SEQ ID NO: 4025631 - RNA, 13 nt, Molluscum contagiosum virus
uccggcgcucgcc

SEQ ID NO: 4025632 - RNA, 20 nt, Molluscum contagiosum virus
uccggcgugagcucgucgcg

SEQ ID NO: 4025633 - RNA, 21 nt, Molluscum contagiosum virus
uccggcuuagcuggcgcccgu

SEQ ID NO: 4025634 - RNA, 21 nt, Molluscum contagiosum virus
uccggcuuuauuuccggcucc

SEQ ID NO: 4025635 - RNA, 18 nt, Molluscum contagiosum virus
uccggucgcccuccgccg

SEQ ID NO: 4025636 - RNA, 18 nt, Molluscum contagiosum virus
uccgugccauuucguuga

SEQ ID NO: 4025637 - RNA, 23 nt, Molluscum contagiosum virus
uccuagagcagaaggugcgcagc

SEQ ID NO: 4025638 - RNA, 16 nt, Molluscum contagiosum virus
uccucaaggcgcacga

SEQ ID NO: 4025639 - RNA, 15 nt, Molluscum contagiosum virus
uccucaccuuccugg

SEQ ID NO: 4025640 - RNA, 18 nt, Molluscum contagiosum virus
uccucgacaaugagcacu

SEQ ID NO: 4025641 - RNA, 16 nt, Molluscum contagiosum virus
uccugaacaagcugca

SEQ ID NO: 4025642 - RNA, 18 nt, Molluscum contagiosum virus
uccugcauuucaugcgcg

SEQ ID NO: 4025643 - RNA, 17 nt, Molluscum contagiosum virus
uccugcgcccauuccug

SEQ ID NO: 4025644 - RNA, 13 nt, Molluscum contagiosum virus
uccugcggcgcug

SEQ ID NO: 4025645 - RNA, 11 nt, Molluscum contagiosum virus
uccugcugccg

SEQ ID NO: 4025646 - RNA, 12 nt, Molluscum contagiosum virus
uccugcugguuc

SEQ ID NO: 4025647 - RNA, 19 nt, Molluscum contagiosum virus
uccuggcacuggcgcgcac

SEQ ID NO: 4025648 - RNA, 12 nt, Molluscum contagiosum virus
uccuggccaagg

SEQ ID NO: 4025649 - RNA, 22 nt, Molluscum contagiosum virus
uccuggcucgcgagugugcaug

SEQ ID NO: 4025650 - RNA, 20 nt, Molluscum contagiosum virus
uccuguagcaaggggucugc

SEQ ID NO: 4025651 - RNA, 19 nt, Molluscum contagiosum virus
uccuuccggagacaccagc

SEQ ID NO: 4025652 - RNA, 15 nt, Molluscum contagiosum virus
uccuucuucagcagg

SEQ ID NO: 4025653 - RNA, 16 nt, Molluscum contagiosum virus
uccuugcgcuuguccu

SEQ ID NO: 4025654 - RNA, 20 nt, Molluscum contagiosum virus
uccuugcuccucgcacgggc

SEQ ID NO: 4025655 - RNA, 22 nt, Molluscum contagiosum virus
ucgaaaaggcugauccugcgcg

SEQ ID NO: 4025656 - RNA, 14 nt, Molluscum contagiosum virus
ucgaagcagugcuc

SEQ ID NO: 4025657 - RNA, 16 nt, Molluscum contagiosum virus
ucgacagagaaguccc

SEQ ID NO: 4025658 - RNA, 17 nt, Molluscum contagiosum virus
ucgacagcauccuggag

SEQ ID NO: 4025659 - RNA, 13 nt, Molluscum contagiosum virus
ucgacagcgugcg

SEQ ID NO: 4025660 - RNA, 13 nt, Molluscum contagiosum virus
ucgaccugcacga

SEQ ID NO: 4025661 - RNA, 15 nt, Molluscum contagiosum virus
ucgacgccaacuucg

SEQ ID NO: 4025662 - RNA, 19 nt, Molluscum contagiosum virus
ucgacgcggugcgcgcgug

SEQ ID NO: 4025663 - RNA, 20 nt, Molluscum contagiosum virus
ucgacgcggugcgcgcgugc

SEQ ID NO: 4025664 - RNA, 23 nt, Molluscum contagiosum virus
ucgacgcgugcauggcacgcgag

SEQ ID NO: 4025665 - RNA, 17 nt, Molluscum contagiosum virus
ucgacgugaucgcgcag

SEQ ID NO: 4025666 - RNA, 12 nt, Molluscum contagiosum virus
ucgacguggacc

SEQ ID NO: 4025667 - RNA, 23 nt, Molluscum contagiosum virus
ucgacugcguugucuccuccuga

SEQ ID NO: 4025668 - RNA, 20 nt, Molluscum contagiosum virus
ucgagaagacggggcgcacg

SEQ ID NO: 4025669 - RNA, 18 nt, Molluscum contagiosum virus
ucgagaccacgcgcgcug

SEQ ID NO: 4025670 - RNA, 19 nt, Molluscum contagiosum virus
ucgagaccacgcgcgcugc

SEQ ID NO: 4025671 - RNA, 13 nt, Molluscum contagiosum virus
ucgagaccucgcg

SEQ ID NO: 4025672 - RNA, 20 nt, Molluscum contagiosum virus
ucgagaugcucuacgugcug

SEQ ID NO: 4025673 - RNA, 20 nt, Molluscum contagiosum virus
ucgagcagauucacgagcuc

SEQ ID NO: 4025674 - RNA, 19 nt, Molluscum contagiosum virus
ucgagcgagcuacgcgcuc

SEQ ID NO: 4025675 - RNA, 22 nt, Molluscum contagiosum virus
ucgagcgcgccgcgcgcucgcg

SEQ ID NO: 4025676 - RNA, 14 nt, Molluscum contagiosum virus
ucgagcgcgcgccu

SEQ ID NO: 4025677 - RNA, 17 nt, Molluscum contagiosum virus
ucgaggcacucgucgcg

SEQ ID NO: 4025678 - RNA, 14 nt, Molluscum contagiosum virus
ucgaggugugccug

SEQ ID NO: 4025679 - RNA, 19 nt, Molluscum contagiosum virus
ucgagugcucccgaggcgc

SEQ ID NO: 4025680 - RNA, 15 nt, Molluscum contagiosum virus
ucgaguucgcucgcu

SEQ ID NO: 4025681 - RNA, 23 nt, Molluscum contagiosum virus
ucgaugacagcaucgggcugucg

SEQ ID NO: 4025682 - RNA, 17 nt, Molluscum contagiosum virus
ucgauggacgccagcuu

SEQ ID NO: 4025683 - RNA, 20 nt, Molluscum contagiosum virus
ucgauggcgccguuggccac

SEQ ID NO: 4025684 - RNA, 18 nt, Molluscum contagiosum virus
ucgcaagucucccucgcg

SEQ ID NO: 4025685 - RNA, 20 nt, Molluscum contagiosum virus
ucgcaaucugacggugcaac

SEQ ID NO: 4025686 - RNA, 19 nt, Molluscum contagiosum virus
ucgcacgcuagcgagcgcc

SEQ ID NO: 4025687 - RNA, 20 nt, Molluscum contagiosum virus
ucgcagcguuccaggaacgc

SEQ ID NO: 4025688 - RNA, 23 nt, Molluscum contagiosum virus
ucgccagaagucagaguccgacc

SEQ ID NO: 4025689 - RNA, 19 nt, Molluscum contagiosum virus
ucgccgaacggcagacccc

SEQ ID NO: 4025690 - RNA, 14 nt, Molluscum contagiosum virus
ucgccgcgggcugg

SEQ ID NO: 4025691 - RNA, 15 nt, Molluscum contagiosum virus
uguuuguugucccac

SEQ ID NO: 4025692 - RNA, 18 nt, Molluscum contagiosum virus
uuaaacaacacgcgcgag

SEQ ID NO: 4025693 - RNA, 16 nt, Molluscum contagiosum virus
uuaccaagucgcgcuc

SEQ ID NO: 4025694 - RNA, 19 nt, Molluscum contagiosum virus
uuagcacacgcgcgcgcag

SEQ ID NO: 4025695 - RNA, 16 nt, Molluscum contagiosum virus
uuaggcaucucgugca

SEQ ID NO: 4025696 - RNA, 20 nt, Molluscum contagiosum virus
uucaccuucggaacugcgga

SEQ ID NO: 4025697 - RNA, 21 nt, Molluscum contagiosum virus
uucagagugacgcugcaagac

SEQ ID NO: 4025698 - RNA, 16 nt, Molluscum contagiosum virus
uucaggaacaaggcca

SEQ ID NO: 4025699 - RNA, 23 nt, Molluscum contagiosum virus
uuccacgaccgcaagugcacgcg

SEQ ID NO: 4025700 - RNA, 20 nt, Molluscum contagiosum virus
uuccacuacaagcagccgca

SEQ ID NO: 4025701 - RNA, 19 nt, Molluscum contagiosum virus
uuccccuccuagcccagca

SEQ ID NO: 4025702 - RNA, 16 nt, Molluscum contagiosum virus
uucccgcggcgugccc

SEQ ID NO: 4025703 - RNA, 13 nt, Molluscum contagiosum virus
uucccgugcaagg

SEQ ID NO: 4025704 - RNA, 14 nt, Molluscum contagiosum virus
uucccguuccuggg

SEQ ID NO: 4025705 - RNA, 18 nt, Molluscum contagiosum virus
uuccgacccggcucgcuc

SEQ ID NO: 4025706 - RNA, 22 nt, Molluscum contagiosum virus
uuccggagacaccagcuccgcc

SEQ ID NO: 4025707 - RNA, 16 nt, Molluscum contagiosum virus
uuccggccuguaaaug

SEQ ID NO: 4025708 - RNA, 17 nt, Molluscum contagiosum virus
acugcccggcggcaagc

SEQ ID NO: 4025709 - RNA, 20 nt, Molluscum contagiosum virus
acugcgcgcacugcucgcgc

SEQ ID NO: 4025710 - RNA, 16 nt, Molluscum contagiosum virus
acugcgcgcgcggcgc

SEQ ID NO: 4025711 - RNA, 16 nt, Molluscum contagiosum virus
acugcggacucgcgag

SEQ ID NO: 4025712 - RNA, 22 nt, Molluscum contagiosum virus
acugcggugacgguccugcgcg

SEQ ID NO: 4025713 - RNA, 19 nt, Molluscum contagiosum virus
acugcuagugcuggccgcc

SEQ ID NO: 4025714 - RNA, 14 nt, Molluscum contagiosum virus
acugcucgcgcacg

SEQ ID NO: 4025715 - RNA, 19 nt, Molluscum contagiosum virus
acugcugcaaucugcgcuc

SEQ ID NO: 4025716 - RNA, 12 nt, Molluscum contagiosum virus
acugcugggcgu

SEQ ID NO: 4025717 - RNA, 20 nt, Molluscum contagiosum virus
acuggacugagccgcaagca

SEQ ID NO: 4025718 - RNA, 19 nt, Molluscum contagiosum virus
acugggaggacacgcgcac

SEQ ID NO: 4025719 - RNA, 18 nt, Molluscum contagiosum virus
acugucgcgcagcugcgc

SEQ ID NO: 4025720 - RNA, 17 nt, Molluscum contagiosum virus
acuguguucccggcugc

SEQ ID NO: 4025721 - RNA, 18 nt, Molluscum contagiosum virus
acuguugcuuccggggcg

SEQ ID NO: 4025722 - RNA, 15 nt, Molluscum contagiosum virus
acuguugguuaauuu

SEQ ID NO: 4025723 - RNA, 21 nt, Molluscum contagiosum virus
acuuaacggccaauaaaugau

SEQ ID NO: 4025724 - RNA, 22 nt, Molluscum contagiosum virus
acuuaucccagaaaacgcacug

SEQ ID NO: 4025725 - RNA, 22 nt, Molluscum contagiosum virus
acuucacggcguucaccuuggc

SEQ ID NO: 4025726 - RNA, 23 nt, Molluscum contagiosum virus
acuuccguugcgagaacgggcgc

SEQ ID NO: 4025727 - RNA, 20 nt, Molluscum contagiosum virus
acuucgcagacgacucgcug

SEQ ID NO: 4025728 - RNA, 15 nt, Molluscum contagiosum virus
acuugcgcguccaca

SEQ ID NO: 4025729 - RNA, 20 nt, Molluscum contagiosum virus
acuugcgcguucgcaaagac

SEQ ID NO: 4025730 - RNA, 13 nt, Molluscum contagiosum virus
acuugcugcggag

SEQ ID NO: 4025731 - RNA, 16 nt, Molluscum contagiosum virus
acuugcugguugccgc

SEQ ID NO: 4025732 - RNA, 16 nt, Molluscum contagiosum virus
acuugugcgcccccgc

SEQ ID NO: 4025733 - RNA, 17 nt, Molluscum contagiosum virus
acuuugagcgagugccg

SEQ ID NO: 4025734 - RNA, 15 nt, Molluscum contagiosum virus
acuuugucgcacgag

SEQ ID NO: 4025735 - RNA, 16 nt, Molluscum contagiosum virus
acuuuuccugcgucgc

SEQ ID NO: 4025736 - RNA, 20 nt, Molluscum contagiosum virus
agaaaggcacccaccaggaa

SEQ ID NO: 4025737 - RNA, 14 nt, Molluscum contagiosum virus
agaacugccugguc

SEQ ID NO: 4025738 - RNA, 13 nt, Molluscum contagiosum virus
agaagaacagcac

SEQ ID NO: 4025739 - RNA, 14 nt, Molluscum contagiosum virus
agaagaacagcacg

SEQ ID NO: 4025740 - RNA, 23 nt, Molluscum contagiosum virus
agaagacggcgcgcgcgcuagcc

SEQ ID NO: 4025741 - RNA, 15 nt, Molluscum contagiosum virus
agaagaggccagcac

SEQ ID NO: 4025742 - RNA, 12 nt, Molluscum contagiosum virus
agaagaggccgg

SEQ ID NO: 4025743 - RNA, 18 nt, Molluscum contagiosum virus
agaagagggucgugcagg

SEQ ID NO: 4025744 - RNA, 18 nt, Molluscum contagiosum virus
agaagcccgggucggcaa

SEQ ID NO: 4025745 - RNA, 18 nt, Molluscum contagiosum virus
agaaguucugcacagcac

SEQ ID NO: 4025746 - RNA, 18 nt, Molluscum contagiosum virus
agaaugacuuagccacug

SEQ ID NO: 4025747 - RNA, 23 nt, Molluscum contagiosum virus
agacauauguucuucgacaacau

SEQ ID NO: 4025748 - RNA, 14 nt, Molluscum contagiosum virus
agaccaccagcacc

SEQ ID NO: 4025749 - RNA, 15 nt, Molluscum contagiosum virus
agaccuuccuccagg

SEQ ID NO: 4025750 - RNA, 16 nt, Molluscum contagiosum virus
agacgacucgcugcca

SEQ ID NO: 4025751 - RNA, 20 nt, Molluscum contagiosum virus
agacgcagcgcgagcugugc

SEQ ID NO: 4025752 - RNA, 12 nt, Molluscum contagiosum virus
agacgcugcugc

SEQ ID NO: 4025753 - RNA, 14 nt, Molluscum contagiosum virus
agacgcugcugcac

SEQ ID NO: 4025754 - RNA, 13 nt, Molluscum contagiosum virus
agacguagagcag

SEQ ID NO: 4025755 - RNA, 18 nt, Molluscum contagiosum virus
agacgucccgcagugugc

SEQ ID NO: 4025756 - RNA, 18 nt, Molluscum contagiosum virus
agacuauaugcgaagcgu

SEQ ID NO: 4025757 - RNA, 18 nt, Molluscum contagiosum virus
agacugagugcugagcca

SEQ ID NO: 4025758 - RNA, 22 nt, Molluscum contagiosum virus
agacuggagcacggacugggag

SEQ ID NO: 4025759 - RNA, 20 nt, Molluscum contagiosum virus
agacuugccgucucgcgcuc

SEQ ID NO: 4025760 - RNA, 13 nt, Molluscum contagiosum virus
agagaaaggcacc

SEQ ID NO: 4025761 - RNA, 21 nt, Molluscum contagiosum virus
agagaacaacgaaaacugaaa

SEQ ID NO: 4025762 - RNA, 13 nt, Molluscum contagiosum virus
agagaaccugugc

SEQ ID NO: 4025763 - RNA, 21 nt, Molluscum contagiosum virus
agagacgcugccggcaacgcu

SEQ ID NO: 4025764 - RNA, 12 nt, Molluscum contagiosum virus
agagcagugccg

SEQ ID NO: 4025765 - RNA, 18 nt, Molluscum contagiosum virus
agagcccgccgggcaccg

SEQ ID NO: 4025766 - RNA, 11 nt, Molluscum contagiosum virus
agagccgccgg

SEQ ID NO: 4025767 - RNA, 14 nt, Molluscum contagiosum virus
agagccgccggggc

SEQ ID NO: 4025768 - RNA, 14 nt, Molluscum contagiosum virus
agagccgcuccugg

SEQ ID NO: 4025769 - RNA, 16 nt, Molluscum contagiosum virus
agagccugcugcucuu

SEQ ID NO: 4025770 - RNA, 19 nt, Molluscum contagiosum virus
agagcguccagccgcagcc

SEQ ID NO: 4025771 - RNA, 15 nt, Molluscum contagiosum virus
agaggacagcuccuu

SEQ ID NO: 4025772 - RNA, 14 nt, Molluscum contagiosum virus
agaggccagcacaa

SEQ ID NO: 4025773 - RNA, 18 nt, Molluscum contagiosum virus
agagggucgugcaggucg

SEQ ID NO: 4025774 - RNA, 18 nt, Molluscum contagiosum virus
agaggugcgugccccucg

SEQ ID NO: 4025775 - RNA, 12 nt, Molluscum contagiosum virus
agaucacggcgu

SEQ ID NO: 4025776 - RNA, 18 nt, Molluscum contagiosum virus
agaucaggcagcugcugc

SEQ ID NO: 4025777 - RNA, 20 nt, Molluscum contagiosum virus
agaucaggcagcugcugcgc

SEQ ID NO: 4025778 - RNA, 15 nt, Molluscum contagiosum virus
agaucgacugcgccu

SEQ ID NO: 4025779 - RNA, 13 nt, Molluscum contagiosum virus
agauggcugcucu

SEQ ID NO: 4025780 - RNA, 23 nt, Molluscum contagiosum virus
agauuggaggaggaagcaggucu

SEQ ID NO: 4025781 - RNA, 14 nt, Molluscum contagiosum virus
agcaagcgcccgcg

SEQ ID NO: 4025782 - RNA, 24 nt, Molluscum contagiosum virus
agcacacgguagagcugcgagaac

SEQ ID NO: 4025783 - RNA, 14 nt, Molluscum contagiosum virus
agcaccaagaagcg

SEQ ID NO: 4025784 - RNA, 16 nt, Molluscum contagiosum virus
agcaccgccugcugca

SEQ ID NO: 4025785 - RNA, 22 nt, Molluscum contagiosum virus
agcaccgcgccccacugugcca

SEQ ID NO: 4025786 - RNA, 20 nt, Molluscum contagiosum virus
agcacggcuuccggcaccac

SEQ ID NO: 4025787 - RNA, 19 nt, Molluscum contagiosum virus
agcacguuaaucacgauga

SEQ ID NO: 4025788 - RNA, 17 nt, Molluscum contagiosum virus
agcacugcgcgcgcggc

SEQ ID NO: 4025789 - RNA, 17 nt, Molluscum contagiosum virus
agcagccccgacgccag

SEQ ID NO: 4025790 - RNA, 14 nt, Molluscum contagiosum virus
agcagcccgcaggc

SEQ ID NO: 4025791 - RNA, 15 nt, Molluscum contagiosum virus
agcagccgcagccca

SEQ ID NO: 4025792 - RNA, 13 nt, Molluscum contagiosum virus
agcagcgccugca

SEQ ID NO: 4025793 - RNA, 19 nt, Molluscum contagiosum virus
agcagcuccagcauggcgc

SEQ ID NO: 4025794 - RNA, 17 nt, Molluscum contagiosum virus
caaacugugcuccugag

SEQ ID NO: 4025795 - RNA, 15 nt, Molluscum contagiosum virus
caaagacgggcccgc

SEQ ID NO: 4025796 - RNA, 18 nt, Molluscum contagiosum virus
caaagaucgcgguggcag

SEQ ID NO: 4025797 - RNA, 15 nt, Molluscum contagiosum virus
caaagccggccccgc

SEQ ID NO: 4025798 - RNA, 12 nt, Molluscum contagiosum virus
caaagcgcggcc

SEQ ID NO: 4025799 - RNA, 13 nt, Molluscum contagiosum virus
caaagcgcggccg

SEQ ID NO: 4025800 - RNA, 15 nt, Molluscum contagiosum virus
caaaggcaggggccg

SEQ ID NO: 4025801 - RNA, 14 nt, Molluscum contagiosum virus
caaagucgcgcgcg

SEQ ID NO: 4025802 - RNA, 17 nt, Molluscum contagiosum virus
caaagucgcgcgcggcc

SEQ ID NO: 4025803 - RNA, 18 nt, Molluscum contagiosum virus
caaaugcgucccagcagc

SEQ ID NO: 4025804 - RNA, 13 nt, Molluscum contagiosum virus
caaauggagauga

SEQ ID NO: 4025805 - RNA, 13 nt, Molluscum contagiosum virus
caacaagcugcug

SEQ ID NO: 4025806 - RNA, 22 nt, Molluscum contagiosum virus
caacacgaucaaggugcagaac

SEQ ID NO: 4025807 - RNA, 15 nt, Molluscum contagiosum virus
caacacgcuguugcu

SEQ ID NO: 4025808 - RNA, 15 nt, Molluscum contagiosum virus
caacagcgcaagcug

SEQ ID NO: 4025809 - RNA, 18 nt, Molluscum contagiosum virus
caacaggagcauuccuug

SEQ ID NO: 4025810 - RNA, 19 nt, Molluscum contagiosum virus
caacccgcggcgcgccgca

SEQ ID NO: 4025811 - RNA, 15 nt, Molluscum contagiosum virus
caaccgccugcucuc

SEQ ID NO: 4025812 - RNA, 23 nt, Molluscum contagiosum virus
caaccgccugcucucgcgcgcca

SEQ ID NO: 4025813 - RNA, 22 nt, Molluscum contagiosum virus
caaccgcugcuauuaccugaga

SEQ ID NO: 4025814 - RNA, 23 nt, Molluscum contagiosum virus
caaccuguuaaauggacgugcuc

SEQ ID NO: 4025815 - RNA, 14 nt, Molluscum contagiosum virus
caacgaggucuucc

SEQ ID NO: 4025816 - RNA, 14 nt, Molluscum contagiosum virus
caacgaguacgagc

SEQ ID NO: 4025817 - RNA, 13 nt, Molluscum contagiosum virus
caacgcgcgcgcg

SEQ ID NO: 4025818 - RNA, 19 nt, Molluscum contagiosum virus
caacgcgcgcgugcugucc

SEQ ID NO: 4025819 - RNA, 13 nt, Molluscum contagiosum virus
caacgcggacgcg

SEQ ID NO: 4025820 - RNA, 15 nt, Molluscum contagiosum virus
caacgcgggccaggc

SEQ ID NO: 4025821 - RNA, 19 nt, Molluscum contagiosum virus
caacgggcucgugcuggag

SEQ ID NO: 4025822 - RNA, 17 nt, Molluscum contagiosum virus
caacguaguacugcagc

SEQ ID NO: 4025823 - RNA, 18 nt, Molluscum contagiosum virus
caacguaguacugcagca

SEQ ID NO: 4025824 - RNA, 22 nt, Molluscum contagiosum virus
caacguaguacugcagcagcuc

SEQ ID NO: 4025825 - RNA, 20 nt, Molluscum contagiosum virus
caacgucgcacuggccugca

SEQ ID NO: 4025826 - RNA, 18 nt, Molluscum contagiosum virus
caacguggcgcugaccuc

SEQ ID NO: 4025827 - RNA, 21 nt, Molluscum contagiosum virus
caacucgcgcugcagcaccug

SEQ ID NO: 4025828 - RNA, 18 nt, Molluscum contagiosum virus
caacucugcucgugcccg

SEQ ID NO: 4025829 - RNA, 15 nt, Molluscum contagiosum virus
caagaagacggcgcg

SEQ ID NO: 4025830 - RNA, 21 nt, Molluscum contagiosum virus
caagaccgugacggccgugua

SEQ ID NO: 4025831 - RNA, 12 nt, Molluscum contagiosum virus
caagagccaugu

SEQ ID NO: 4025832 - RNA, 15 nt, Molluscum contagiosum virus
caagagcuggucgcc

SEQ ID NO: 4025833 - RNA, 15 nt, Molluscum contagiosum virus
caagaggggagccag

SEQ ID NO: 4025834 - RNA, 17 nt, Molluscum contagiosum virus
gacuggcacgcgccgcg

SEQ ID NO: 4025835 - RNA, 16 nt, Molluscum contagiosum virus
gacuggcuucggggac

SEQ ID NO: 4025836 - RNA, 17 nt, Molluscum contagiosum virus
gacugucgacagagaag

SEQ ID NO: 4025837 - RNA, 20 nt, Molluscum contagiosum virus
gacuguguucccggcugccg

SEQ ID NO: 4025838 - RNA, 14 nt, Molluscum contagiosum virus
gacuuagccacugu

SEQ ID NO: 4025839 - RNA, 19 nt, Molluscum contagiosum virus
gacuucuugcgcggcggcc

SEQ ID NO: 4025840 - RNA, 17 nt, Molluscum contagiosum virus
gacuuguguugagccuu

SEQ ID NO: 4025841 - RNA, 18 nt, Molluscum contagiosum virus
gacuuuguccugagccuu

SEQ ID NO: 4025842 - RNA, 16 nt, Molluscum contagiosum virus
gagaaagacgucccgc

SEQ ID NO: 4025843 - RNA, 14 nt, Molluscum contagiosum virus
gagaaaggcaccca

SEQ ID NO: 4025844 - RNA, 21 nt, Molluscum contagiosum virus
gagaaaggcacccaccaggaa

SEQ ID NO: 4025845 - RNA, 19 nt, Molluscum contagiosum virus
gagaaaugcgcacacuugc

SEQ ID NO: 4025846 - RNA, 18 nt, Molluscum contagiosum virus
gagaaccgccgucaacau

SEQ ID NO: 4025847 - RNA, 17 nt, Molluscum contagiosum virus
gagaagaacagcacgaa

SEQ ID NO: 4025848 - RNA, 17 nt, Molluscum contagiosum virus
gagaagaccuguucuuu

SEQ ID NO: 4025849 - RNA, 17 nt, Molluscum contagiosum virus
gagaagaugcugcgcgu

SEQ ID NO: 4025850 - RNA, 18 nt, Molluscum contagiosum virus
gagaauaaaugagcagca

SEQ ID NO: 4025851 - RNA, 12 nt, Molluscum contagiosum virus
gagaccagccgc

SEQ ID NO: 4025852 - RNA, 20 nt, Molluscum contagiosum virus
gagaccuggucacacuggug

SEQ ID NO: 4025853 - RNA, 14 nt, Molluscum contagiosum virus
gagacgcggccgcg

SEQ ID NO: 4025854 - RNA, 16 nt, Molluscum contagiosum virus
gagacgugcggcacgc

SEQ ID NO: 4025855 - RNA, 17 nt, Molluscum contagiosum virus
gagacgugcggcacgcu

SEQ ID NO: 4025856 - RNA, 18 nt, Molluscum contagiosum virus
gagacgugcggcacgcug

SEQ ID NO: 4025857 - RNA, 14 nt, Molluscum contagiosum virus
gagacguugccgga

SEQ ID NO: 4025858 - RNA, 12 nt, Molluscum contagiosum virus
gagacucuggaa

SEQ ID NO: 4025859 - RNA, 21 nt, Molluscum contagiosum virus
gagacugcuacgucgcggcgc

SEQ ID NO: 4025860 - RNA, 13 nt, Molluscum contagiosum virus
gagagacaacaaa

SEQ ID NO: 4025861 - RNA, 19 nt, Molluscum contagiosum virus
gagagccgcuccuggucuu

SEQ ID NO: 4025862 - RNA, 12 nt, Molluscum contagiosum virus
gagagccuucgu

SEQ ID NO: 4025863 - RNA, 13 nt, Molluscum contagiosum virus
gagagcgcgcgca

SEQ ID NO: 4025864 - RNA, 15 nt, Molluscum contagiosum virus
gagagcgugagcagg

SEQ ID NO: 4025865 - RNA, 20 nt, Molluscum contagiosum virus
gagaucacggcgugcgcgag

SEQ ID NO: 4025866 - RNA, 20 nt, Molluscum contagiosum virus
gagaucuuugaccgcuucga

SEQ ID NO: 4025867 - RNA, 21 nt, Molluscum contagiosum virus
gagcaagcgagagaggaguga

SEQ ID NO: 4025868 - RNA, 14 nt, Molluscum contagiosum virus
gagcaaggccuggc

SEQ ID NO: 4025869 - RNA, 14 nt, Molluscum contagiosum virus
gagcaagucugcgc

SEQ ID NO: 4025870 - RNA, 17 nt, Molluscum contagiosum virus
gagcaauggcggccugc

SEQ ID NO: 4025871 - RNA, 17 nt, Molluscum contagiosum virus
gagcacaacgaacaugu

SEQ ID NO: 4025872 - RNA, 17 nt, Molluscum contagiosum virus
gagcacauacacgcgca

SEQ ID NO: 4025873 - RNA, 21 nt, Molluscum contagiosum virus
gagcaccgaacaaaugcagag

SEQ ID NO: 4025874 - RNA, 16 nt, Molluscum contagiosum virus
gagcacugcgcgcgcg

SEQ ID NO: 4025875 - RNA, 18 nt, Molluscum contagiosum virus
gagcacuguacgcacgca

SEQ ID NO: 4025876 - RNA, 16 nt, Molluscum contagiosum virus
gagcacuuccgcgcgc

SEQ ID NO: 4025877 - RNA, 14 nt, Molluscum contagiosum virus
gagcacuugccgcg

SEQ ID NO: 4025878 - RNA, 18 nt, Molluscum contagiosum virus
gagcaggacgugcacgug

SEQ ID NO: 4025879 - RNA, 20 nt, Molluscum contagiosum virus
gagcagguucucgcacagua

SEQ ID NO: 4025880 - RNA, 12 nt, Molluscum contagiosum virus
gagcagugccgc

SEQ ID NO: 4025881 - RNA, 18 nt, Molluscum contagiosum virus
gagcagugccgccgcgca

SEQ ID NO: 4025882 - RNA, 13 nt, Molluscum contagiosum virus
gagccauguuucc

SEQ ID NO: 4025883 - RNA, 12 nt, Molluscum contagiosum virus
gagccccgcgga

SEQ ID NO: 4025884 - RNA, 14 nt, Molluscum contagiosum virus
gagcccgccgggca

SEQ ID NO: 4025885 - RNA, 12 nt, Molluscum contagiosum virus
gagccgccgggg

SEQ ID NO: 4025886 - RNA, 13 nt, Molluscum contagiosum virus
gagccggcugccc

SEQ ID NO: 4025887 - RNA, 15 nt, Molluscum contagiosum virus
gagccgggacgcgga

SEQ ID NO: 4025888 - RNA, 22 nt, Molluscum contagiosum virus
gagccucccccgcgcacugcca

SEQ ID NO: 4025889 - RNA, 13 nt, Molluscum contagiosum virus
gagccucuggaag

SEQ ID NO: 4025890 - RNA, 17 nt, Molluscum contagiosum virus
gagccuuuuggcggcgc

SEQ ID NO: 4025891 - RNA, 21 nt, Molluscum contagiosum virus
gagcgagugcgcgugcgccug

SEQ ID NO: 4025892 - RNA, 20 nt, Molluscum contagiosum virus
gagcgcaguuguuugucgcg

SEQ ID NO: 4025893 - RNA, 20 nt, Molluscum contagiosum virus
gagcgcccgugcuugcgcac

SEQ ID NO: 4025894 - RNA, 12 nt, Molluscum contagiosum virus
gagcgcgcgugc

SEQ ID NO: 4025895 - RNA, 21 nt, Molluscum contagiosum virus
gagcgcggcuuacacacgcac

SEQ ID NO: 4025896 - RNA, 16 nt, Molluscum contagiosum virus
gagcgcguccaugagc

SEQ ID NO: 4025897 - RNA, 23 nt, Molluscum contagiosum virus
gagcgcgucugcucucggcggcc

SEQ ID NO: 4025898 - RNA, 12 nt, Molluscum contagiosum virus
gagcggcacggg

SEQ ID NO: 4025899 - RNA, 14 nt, Molluscum contagiosum virus
gagcggccuccgga

SEQ ID NO: 4025900 - RNA, 22 nt, Molluscum contagiosum virus
gagcggccuccggagaagcuuu

SEQ ID NO: 4025901 - RNA, 21 nt, Molluscum contagiosum virus
gagcggcgccgacaacgugcu

SEQ ID NO: 4025902 - RNA, 23 nt, Molluscum contagiosum virus
gagcggcgcgcgcugagcgcgga

SEQ ID NO: 4025903 - RNA, 18 nt, Molluscum contagiosum virus
gagcgggguacaggcgcg

SEQ ID NO: 4025904 - RNA, 20 nt, Molluscum contagiosum virus
gagcguacucgggccgcgag

SEQ ID NO: 4025905 - RNA, 22 nt, Molluscum contagiosum virus
gagcucaaucucgcccagcacc

SEQ ID NO: 4025906 - RNA, 17 nt, Molluscum contagiosum virus
gagcucgguagccaggc

SEQ ID NO: 4025907 - RNA, 19 nt, Molluscum contagiosum virus
gagcucugucccgcaagcc

SEQ ID NO: 4025908 - RNA, 16 nt, Molluscum contagiosum virus
gagcugcgugugccgg

SEQ ID NO: 4025909 - RNA, 12 nt, Molluscum contagiosum virus
gagcuggccacu

SEQ ID NO: 4025910 - RNA, 13 nt, Molluscum contagiosum virus
gagcuggcugggc

SEQ ID NO: 4025911 - RNA, 21 nt, Molluscum contagiosum virus
gagcuugcgcgcggugcgggc

SEQ ID NO: 4025912 - RNA, 14 nt, Molluscum contagiosum virus
gagcuuugugcgac

SEQ ID NO: 4025913 - RNA, 17 nt, Molluscum contagiosum virus
gaggaacuagugcugcu

SEQ ID NO: 4025914 - RNA, 23 nt, Molluscum contagiosum virus
gaggaacucgaggcucuguucug

SEQ ID NO: 4025915 - RNA, 15 nt, Molluscum contagiosum virus
gaggacacgcgcacg

SEQ ID NO: 4025916 - RNA, 22 nt, Molluscum contagiosum virus
gaggacgcgggcguguccgcgg

SEQ ID NO: 4025917 - RNA, 15 nt, Molluscum contagiosum virus
gaggacggcgugcgc

SEQ ID NO: 4025918 - RNA, 13 nt, Molluscum contagiosum virus
gaggaggcaagcg

SEQ ID NO: 4025919 - RNA, 17 nt, Molluscum contagiosum virus
gaggcacgggcucgauc

SEQ ID NO: 4025920 - RNA, 16 nt, Molluscum contagiosum virus
gaggcacucgucgcgc

SEQ ID NO: 4025921 - RNA, 16 nt, Molluscum contagiosum virus
gaggcagccgcggcgc

SEQ ID NO: 4025922 - RNA, 20 nt, Molluscum contagiosum virus
gaggcagugcuugagcaucu

SEQ ID NO: 4025923 - RNA, 17 nt, Molluscum contagiosum virus
gaggcaugucgcggugc

SEQ ID NO: 4025924 - RNA, 13 nt, Molluscum contagiosum virus
gaggccagcacaa

SEQ ID NO: 4025925 - RNA, 16 nt, Molluscum contagiosum virus
gaggccagcacaagcc

SEQ ID NO: 4025926 - RNA, 14 nt, Molluscum contagiosum virus
gaggcccaggccau

SEQ ID NO: 4025927 - RNA, 19 nt, Molluscum contagiosum virus
gaggccggccgugcagagc

SEQ ID NO: 4025928 - RNA, 22 nt, Molluscum contagiosum virus
gaggccugcugaagaaggagcc

SEQ ID NO: 4025929 - RNA, 17 nt, Molluscum contagiosum virus
gaggcgcguccgcggcc

SEQ ID NO: 4025930 - RNA, 20 nt, Molluscum contagiosum virus
gaggcgcuagugcagaugag

SEQ ID NO: 4025931 - RNA, 17 nt, Molluscum contagiosum virus
gaggcgcuugggcacug

SEQ ID NO: 4025932 - RNA, 12 nt, Molluscum contagiosum virus
gaggcggcacug

SEQ ID NO: 4025933 - RNA, 16 nt, Molluscum contagiosum virus
gaggcggcacugcuag

SEQ ID NO: 4025934 - RNA, 20 nt, Molluscum contagiosum virus
gaggcuccugccgucgcccg

SEQ ID NO: 4025935 - RNA, 14 nt, Molluscum contagiosum virus
gagggacacgcacu

SEQ ID NO: 4025936 - RNA, 16 nt, Molluscum contagiosum virus
gccggaacucgcgcgc

SEQ ID NO: 4025937 - RNA, 20 nt, Molluscum contagiosum virus
gccggaccagauccgggcgc

SEQ ID NO: 4025938 - RNA, 20 nt, Molluscum contagiosum virus
gccggcacccgugcgcgcgc

SEQ ID NO: 4025939 - RNA, 18 nt, Molluscum contagiosum virus
gccggcaucuucggcgug

SEQ ID NO: 4025940 - RNA, 13 nt, Molluscum contagiosum virus
gccggccgccggc

SEQ ID NO: 4025941 - RNA, 15 nt, Molluscum contagiosum virus
gccggccgccggcgc

SEQ ID NO: 4025942 - RNA, 16 nt, Molluscum contagiosum virus
gccggcgcgugagcgc

SEQ ID NO: 4025943 - RNA, 21 nt, Molluscum contagiosum virus
gccggcgcuucuacugcgcac

SEQ ID NO: 4025944 - RNA, 21 nt, Molluscum contagiosum virus
gccggcucagcguggagcacc

SEQ ID NO: 4025945 - RNA, 22 nt, Molluscum contagiosum virus
gccggcuguaaauggacccgcu

SEQ ID NO: 4025946 - RNA, 19 nt, Molluscum contagiosum virus
gccgggaauaccggagaca

SEQ ID NO: 4025947 - RNA, 15 nt, Molluscum contagiosum virus
gccgggcaccggcgc

SEQ ID NO: 4025948 - RNA, 18 nt, Molluscum contagiosum virus
gccgggcuugcucccucg

SEQ ID NO: 4025949 - RNA, 24 nt, Molluscum contagiosum virus
gccgggcuugcucccucgcgcgca

SEQ ID NO: 4025950 - RNA, 13 nt, Molluscum contagiosum virus
gccgggggaacac

SEQ ID NO: 4025951 - RNA, 16 nt, Molluscum contagiosum virus
gccgguacugcggaca

SEQ ID NO: 4025952 - RNA, 18 nt, Molluscum contagiosum virus
gccggucuccacguggcc

SEQ ID NO: 4025953 - RNA, 17 nt, Molluscum contagiosum virus
ggcauccggccgaggca

SEQ ID NO: 4025954 - RNA, 21 nt, Molluscum contagiosum virus
ggccaaagucuuccuggggcu

SEQ ID NO: 4025955 - RNA, 17 nt, Molluscum contagiosum virus
ggccacgaacacggcgc

SEQ ID NO: 4025956 - RNA, 20 nt, Molluscum contagiosum virus
ggccacgcacucgcuggccu

SEQ ID NO: 4025957 - RNA, 17 nt, Molluscum contagiosum virus
ggccagcagcuccuggu

SEQ ID NO: 4025958 - RNA, 14 nt, Molluscum contagiosum virus
ggccagccucaucg

SEQ ID NO: 4025959 - RNA, 17 nt, Molluscum contagiosum virus
ggccagcuucaucaagc

SEQ ID NO: 4025960 - RNA, 16 nt, Molluscum contagiosum virus
ggccaggcacuggccc

SEQ ID NO: 4025961 - RNA, 17 nt, Molluscum contagiosum virus
ggccaggcacuggcccu

SEQ ID NO: 4025962 - RNA, 12 nt, Molluscum contagiosum virus
ggccaggccgcg

SEQ ID NO: 4025963 - RNA, 19 nt, Molluscum contagiosum virus
ggccaggccuugcucccaa

SEQ ID NO: 4025964 - RNA, 21 nt, Molluscum contagiosum virus
ggccaggcgcggucgcccgcc

SEQ ID NO: 4025965 - RNA, 18 nt, Molluscum contagiosum virus
ggccauggagcgcccgcu

SEQ ID NO: 4025966 - RNA, 14 nt, Molluscum contagiosum virus
ggcccaggccaugg

SEQ ID NO: 4025967 - RNA, 17 nt, Molluscum contagiosum virus
ggcccaggccauggagc

SEQ ID NO: 4025968 - RNA, 15 nt, Molluscum contagiosum virus
ggcccgcgcucgccg

SEQ ID NO: 4025969 - RNA, 16 nt, Molluscum contagiosum virus
ggcccgcggcgcgccg

SEQ ID NO: 4025970 - RNA, 21 nt, Molluscum contagiosum virus
ggcccgcguggcaagggcucc

SEQ ID NO: 4025971 - RNA, 22 nt, Molluscum contagiosum virus
ggcccuaaauaaugaaccugca

SEQ ID NO: 4025972 - RNA, 23 nt, Molluscum contagiosum virus
ggcccuaaauaaugaaccugcac

SEQ ID NO: 4025973 - RNA, 15 nt, Molluscum contagiosum virus
ggccgaacugcucug

SEQ ID NO: 4025974 - RNA, 13 nt, Molluscum contagiosum virus
ggccgcacgcgua

SEQ ID NO: 4025975 - RNA, 13 nt, Molluscum contagiosum virus
ggccgccgugugc

SEQ ID NO: 4025976 - RNA, 18 nt, Molluscum contagiosum virus
ggccgcgcccacgggcuu

SEQ ID NO: 4025977 - RNA, 18 nt, Molluscum contagiosum virus
ggccgcggcgcggcggaa

SEQ ID NO: 4025978 - RNA, 12 nt, Molluscum contagiosum virus
ggccgcuccaga

SEQ ID NO: 4025979 - RNA, 17 nt, Molluscum contagiosum virus
ggccgcuccagagccgc

SEQ ID NO: 4025980 - RNA, 18 nt, Molluscum contagiosum virus
ggccgucgggcgccaaca

SEQ ID NO: 4025981 - RNA, 21 nt, Molluscum contagiosum virus
ggccguucgcgcgccaguacg

SEQ ID NO: 4025982 - RNA, 15 nt, Molluscum contagiosum virus
ggccuacgugcugcg

SEQ ID NO: 4025983 - RNA, 14 nt, Molluscum contagiosum virus
ggccuccggagaag

SEQ ID NO: 4025984 - RNA, 14 nt, Molluscum contagiosum virus
ggccucgccuccgg

SEQ ID NO: 4025985 - RNA, 20 nt, Molluscum contagiosum virus
ggccucguccuggaggggug

SEQ ID NO: 4025986 - RNA, 17 nt, Molluscum contagiosum virus
ggccucugccugcaagg

SEQ ID NO: 4025987 - RNA, 16 nt, Molluscum contagiosum virus
ggccugcguggacagc

SEQ ID NO: 4025988 - RNA, 13 nt, Molluscum contagiosum virus
ggccuguccgcgg

SEQ ID NO: 4025989 - RNA, 20 nt, Molluscum contagiosum virus
ggccuguucggcaugcagcg

SEQ ID NO: 4025990 - RNA, 15 nt, Molluscum contagiosum virus
ggcgacgacagcgac

SEQ ID NO: 4025991 - RNA, 23 nt, Molluscum contagiosum virus
ggcgacgcguacguguccaugca

SEQ ID NO: 4025992 - RNA, 24 nt, Molluscum contagiosum virus
ggcgacgcguacguguccaugcac

SEQ ID NO: 4025993 - RNA, 20 nt, Molluscum contagiosum virus
ggcgacgucaaccgggcucu

SEQ ID NO: 4025994 - RNA, 14 nt, Molluscum contagiosum virus
ggcgacuuguagug

SEQ ID NO: 4025995 - RNA, 14 nt, Molluscum contagiosum virus
ggcgagcgcugccg

SEQ ID NO: 4025996 - RNA, 19 nt, Molluscum contagiosum virus
ggcgaguccccgagcagcg

SEQ ID NO: 4025997 - RNA, 13 nt, Molluscum contagiosum virus
ggcgagucgcggg

SEQ ID NO: 4025998 - RNA, 14 nt, Molluscum contagiosum virus
ggcgaucugcucgc

SEQ ID NO: 4025999 - RNA, 20 nt, Molluscum contagiosum virus
ggcgcaacgcuggccgccau

SEQ ID NO: 4026000 - RNA, 14 nt, Molluscum contagiosum virus
ggcgcacgcgagca

SEQ ID NO: 4026001 - RNA, 20 nt, Molluscum contagiosum virus
ggcgcacggccugcggcagg

SEQ ID NO: 4026002 - RNA, 22 nt, Molluscum contagiosum virus
ggaaucguuccuucugcuagga

SEQ ID NO: 4026003 - RNA, 23 nt, Molluscum contagiosum virus
ggaauuugcggcgcgggcaagca

SEQ ID NO: 4026004 - RNA, 16 nt, Molluscum contagiosum virus
ggacaaagucgcgcgc

SEQ ID NO: 4026005 - RNA, 19 nt, Molluscum contagiosum virus
ggacagagcccgcggcgca

SEQ ID NO: 4026006 - RNA, 12 nt, Molluscum contagiosum virus
ggacagugccuc

SEQ ID NO: 4026007 - RNA, 18 nt, Molluscum contagiosum virus
ggacagugccuccgcgga

SEQ ID NO: 4026008 - RNA, 16 nt, Molluscum contagiosum virus
ggaccuaaagcugcug

SEQ ID NO: 4026009 - RNA, 20 nt, Molluscum contagiosum virus
ggaccugcgccagcgccugu

SEQ ID NO: 4026010 - RNA, 21 nt, Molluscum contagiosum virus
ggaccuuggcgcgccgcugcc

SEQ ID NO: 4026011 - RNA, 23 nt, Molluscum contagiosum virus
ggaccuuggcgcgccgcugcccg

SEQ ID NO: 4026012 - RNA, 22 nt, Molluscum contagiosum virus
ggacgaagcugugcaagagcuc

SEQ ID NO: 4026013 - RNA, 19 nt, Molluscum contagiosum virus
ggacgagagggcgcgcguc

SEQ ID NO: 4026014 - RNA, 14 nt, Molluscum contagiosum virus
ggacgagcagagcc

SEQ ID NO: 4026015 - RNA, 14 nt, Molluscum contagiosum virus
ggacgagcugcuuc

SEQ ID NO: 4026016 - RNA, 18 nt, Molluscum contagiosum virus
ggacgccagcuugagcac

SEQ ID NO: 4026017 - RNA, 20 nt, Molluscum contagiosum virus
ggacgcccuccucgaccugc

SEQ ID NO: 4026018 - RNA, 19 nt, Molluscum contagiosum virus
ggacgcgggcguguccgcg

SEQ ID NO: 4026019 - RNA, 19 nt, Molluscum contagiosum virus
ggacgcguucuccaggaac

SEQ ID NO: 4026020 - RNA, 13 nt, Molluscum contagiosum virus
ggacggagagcgc

SEQ ID NO: 4026021 - RNA, 14 nt, Molluscum contagiosum virus
ggacggagagcgcg

SEQ ID NO: 4026022 - RNA, 16 nt, Molluscum contagiosum virus
ggacuccgaggcaggu

SEQ ID NO: 4026023 - RNA, 14 nt, Molluscum contagiosum virus
ggacuuccgcgcgc

SEQ ID NO: 4026024 - RNA, 13 nt, Molluscum contagiosum virus
ggacuucucuguc

SEQ ID NO: 4026025 - RNA, 17 nt, Molluscum contagiosum virus
ggacuuuucgcgcgugc

SEQ ID NO: 4026026 - RNA, 20 nt, Molluscum contagiosum virus
ggagaaagaagugugccugc

SEQ ID NO: 4026027 - RNA, 15 nt, Molluscum contagiosum virus
ggagaacaugcucgc

SEQ ID NO: 4026028 - RNA, 14 nt, Molluscum contagiosum virus
ggagaacggacaaa

SEQ ID NO: 4026029 - RNA, 23 nt, Molluscum contagiosum virus
ggagacaccagcuccgccgggaa

SEQ ID NO: 4026030 - RNA, 23 nt, Molluscum contagiosum virus
ggagacggccguuuuugggacag

SEQ ID NO: 4026031 - RNA, 17 nt, Molluscum contagiosum virus
ggagacuugagcccaga

SEQ ID NO: 4026032 - RNA, 21 nt, Molluscum contagiosum virus
ggagcaagucugcgcaggaca

SEQ ID NO: 4026033 - RNA, 19 nt, Molluscum contagiosum virus
ggagcaccgcguggcgcgc

SEQ ID NO: 4026034 - RNA, 17 nt, Molluscum contagiosum virus
ggagcagccccguaggc

SEQ ID NO: 4026035 - RNA, 22 nt, Molluscum contagiosum virus
ggagcccacguugccgcgcgcu

SEQ ID NO: 4026036 - RNA, 22 nt, Molluscum contagiosum virus
ggagcccgaccccaagaagaac

SEQ ID NO: 4026037 - RNA, 20 nt, Molluscum contagiosum virus
ggagcccuugaucgacaugg

SEQ ID NO: 4026038 - RNA, 22 nt, Molluscum contagiosum virus
ggagccgcggcaguccgagcug

SEQ ID NO: 4026039 - RNA, 17 nt, Molluscum contagiosum virus
ggagccucccccgcgca

SEQ ID NO: 4026040 - RNA, 21 nt, Molluscum contagiosum virus
ggagccucccccgcgcacugc

SEQ ID NO: 4026041 - RNA, 23 nt, Molluscum contagiosum virus
ggagcgagugcgcgugcgccugc

SEQ ID NO: 4026042 - RNA, 21 nt, Molluscum contagiosum virus
ggagcgcaaaugccgagcgca

SEQ ID NO: 4026043 - RNA, 14 nt, Molluscum contagiosum virus
ggagcgcgcgcagg

SEQ ID NO: 4026044 - RNA, 19 nt, Molluscum contagiosum virus
ggagcgcuucuagcucgcg

SEQ ID NO: 4026045 - RNA, 14 nt, Molluscum contagiosum virus
ggagcggaccccgg

SEQ ID NO: 4026046 - RNA, 14 nt, Molluscum contagiosum virus
ggagcggcauucga

SEQ ID NO: 4026047 - RNA, 17 nt, Molluscum contagiosum virus
ggagcuagcgcgcgccg

SEQ ID NO: 4026048 - RNA, 20 nt, Molluscum contagiosum virus
ggaggcagcgcuuguuucgc

SEQ ID NO: 4026049 - RNA, 13 nt, Molluscum contagiosum virus
ggaggcgcuagug

SEQ ID NO: 4026050 - RNA, 20 nt, Molluscum contagiosum virus
ggaggcgcuagugcagauga

SEQ ID NO: 4026051 - RNA, 14 nt, Molluscum contagiosum virus
ggagggagagcugc

SEQ ID NO: 4026052 - RNA, 21 nt, Molluscum contagiosum virus
ggaggugcgcgacuccaucug

SEQ ID NO: 4026053 - RNA, 13 nt, Molluscum contagiosum virus
ggagguuggaagc

SEQ ID NO: 4026054 - RNA, 23 nt, Molluscum contagiosum virus
ggaguacagccgcgcggcagaca

SEQ ID NO: 4026055 - RNA, 16 nt, Molluscum contagiosum virus
ggagucacgaccgacc

SEQ ID NO: 4026056 - RNA, 12 nt, Molluscum contagiosum virus
gccggugcugcg

SEQ ID NO: 4026057 - RNA, 14 nt, Molluscum contagiosum virus
gccgguggcgcgcg

SEQ ID NO: 4026058 - RNA, 16 nt, Molluscum contagiosum virus
gccguccaugugcccg

SEQ ID NO: 4026059 - RNA, 18 nt, Molluscum contagiosum virus
gccguccaugugcccgcg

SEQ ID NO: 4026060 - RNA, 14 nt, Molluscum contagiosum virus
gccguccgccucga

SEQ ID NO: 4026061 - RNA, 19 nt, Molluscum contagiosum virus
gccgucgcccggcaggcuc

SEQ ID NO: 4026062 - RNA, 18 nt, Molluscum contagiosum virus
gccgugaccuucgugcuu

SEQ ID NO: 4026063 - RNA, 16 nt, Molluscum contagiosum virus
gccgugagcacgagau

SEQ ID NO: 4026064 - RNA, 15 nt, Molluscum contagiosum virus
gccgugcccgccgac

SEQ ID NO: 4026065 - RNA, 13 nt, Molluscum contagiosum virus
gccgugccuggca

SEQ ID NO: 4026066 - RNA, 17 nt, Molluscum contagiosum virus
gccgugcgcgcacacga

SEQ ID NO: 4026067 - RNA, 22 nt, Molluscum contagiosum virus
gccgugcugucucucgcccgac

SEQ ID NO: 4026068 - RNA, 14 nt, Molluscum contagiosum virus
gccguggcgugcuu

SEQ ID NO: 4026069 - RNA, 14 nt, Molluscum contagiosum virus
gccgugggcgccgc

SEQ ID NO: 4026070 - RNA, 16 nt, Molluscum contagiosum virus
gccuacgaggugcgcg

SEQ ID NO: 4026071 - RNA, 19 nt, Molluscum contagiosum virus
gccucagccgagcgccgcc

SEQ ID NO: 4026072 - RNA, 13 nt, Molluscum contagiosum virus
gccuccaagaaga

SEQ ID NO: 4026073 - RNA, 20 nt, Molluscum contagiosum virus
gccuccaagaagaggccagc

SEQ ID NO: 4026074 - RNA, 20 nt, Molluscum contagiosum virus
gccuccgaacaaugaggaga

SEQ ID NO: 4026075 - RNA, 14 nt, Molluscum contagiosum virus
gccuccgacuaccu

SEQ ID NO: 4026076 - RNA, 21 nt, Molluscum contagiosum virus
gccucgcauucuucuccgaug

SEQ ID NO: 4026077 - RNA, 15 nt, Molluscum contagiosum virus
gccucgcgagggcuc

SEQ ID NO: 4026078 - RNA, 20 nt, Molluscum contagiosum virus
gccucgcgcgcacugcggga

SEQ ID NO: 4026079 - RNA, 23 nt, Molluscum contagiosum virus
gccucgcggacgagaaugacuua

SEQ ID NO: 4026080 - RNA, 14 nt, Molluscum contagiosum virus
gccucgucguccac

SEQ ID NO: 4026081 - RNA, 18 nt, Molluscum contagiosum virus
gccugcaaggaggucaag

SEQ ID NO: 4026082 - RNA, 17 nt, Molluscum contagiosum virus
gccugcacuacugcucc

SEQ ID NO: 4026083 - RNA, 17 nt, Molluscum contagiosum virus
gccugccagcagagcug

SEQ ID NO: 4026084 - RNA, 16 nt, Molluscum contagiosum virus
gccugccagcgccagc

SEQ ID NO: 4026085 - RNA, 20 nt, Molluscum contagiosum virus
gccugcgcccgcaaaccuug

SEQ ID NO: 4026086 - RNA, 20 nt, Molluscum contagiosum virus
gccugcgcgagcaagcgccc

SEQ ID NO: 4026087 - RNA, 16 nt, Molluscum contagiosum virus
gccugcgggcggcaca

SEQ ID NO: 4026088 - RNA, 13 nt, Molluscum contagiosum virus
gccugcugcucuu

SEQ ID NO: 4026089 - RNA, 17 nt, Molluscum contagiosum virus
gccuggcguccgcacgc

SEQ ID NO: 4026090 - RNA, 15 nt, Molluscum contagiosum virus
gccugguacaaguca

SEQ ID NO: 4026091 - RNA, 15 nt, Molluscum contagiosum virus
gccuguaccugcucg

SEQ ID NO: 4026092 - RNA, 20 nt, Molluscum contagiosum virus
gccuguccgcgggcgcacgc

SEQ ID NO: 4026093 - RNA, 13 nt, Molluscum contagiosum virus
gccugugcccugg

SEQ ID NO: 4026094 - RNA, 17 nt, Molluscum contagiosum virus
gccugugcccuggaagc

SEQ ID NO: 4026095 - RNA, 20 nt, Molluscum contagiosum virus
gccuguuuuuaucgagccgc

SEQ ID NO: 4026096 - RNA, 18 nt, Molluscum contagiosum virus
gccuuccgcgcgggcaug

SEQ ID NO: 4026097 - RNA, 13 nt, Molluscum contagiosum virus
gccuuccugcugg

SEQ ID NO: 4026098 - RNA, 14 nt, Molluscum contagiosum virus
gccuuccugcuggc

SEQ ID NO: 4026099 - RNA, 15 nt, Molluscum contagiosum virus
gccuuccugcuggcg

SEQ ID NO: 4026100 - RNA, 21 nt, Molluscum contagiosum virus
gccuucguggagcccgugcug

SEQ ID NO: 4026101 - RNA, 18 nt, Molluscum contagiosum virus
gccuucuccucgcucugc

SEQ ID NO: 4026102 - RNA, 17 nt, Molluscum contagiosum virus
gccuucuucgugcugug

SEQ ID NO: 4026103 - RNA, 23 nt, Molluscum contagiosum virus
gccuucuucgugcugugccuagg

SEQ ID NO: 4026104 - RNA, 18 nt, Molluscum contagiosum virus
gcgaacacggauacgcgc

SEQ ID NO: 4026105 - RNA, 18 nt, Molluscum contagiosum virus
gcgaacaucucggcuccg

SEQ ID NO: 4026106 - RNA, 23 nt, Molluscum contagiosum virus
gcgaaccauuuuuugccccgcgc

SEQ ID NO: 4026107 - RNA, 18 nt, Molluscum contagiosum virus
gcgaaccgcggcagccuu

SEQ ID NO: 4026108 - RNA, 13 nt, Molluscum contagiosum virus
gcgaacgccggcg

SEQ ID NO: 4026109 - RNA, 13 nt, Molluscum contagiosum virus
gcgaaggagagag

SEQ ID NO: 4026110 - RNA, 11 nt, Molluscum contagiosum virus
gcgacacuugc

SEQ ID NO: 4026111 - RNA, 13 nt, Molluscum contagiosum virus
gcgacagcugcug

SEQ ID NO: 4026112 - RNA, 18 nt, Molluscum contagiosum virus
gcgacaugccucgcggcc

SEQ ID NO: 4026113 - RNA, 20 nt, Molluscum contagiosum virus
gcgaccuacgaggugcugcg

SEQ ID NO: 4026114 - RNA, 16 nt, Molluscum contagiosum virus
gcgaccugcugcgaga

SEQ ID NO: 4026115 - RNA, 15 nt, Molluscum contagiosum virus
gcgacgacagcgacg

SEQ ID NO: 4026116 - RNA, 23 nt, Molluscum contagiosum virus
gcgacgacgacuucggcgcaacg

SEQ ID NO: 4026117 - RNA, 21 nt, Molluscum contagiosum virus
gcgacgccauuuucgugcgcg

SEQ ID NO: 4026118 - RNA, 19 nt, Molluscum contagiosum virus
gcgacgccguccgcgcagc

SEQ ID NO: 4026119 - RNA, 21 nt, Molluscum contagiosum virus
gcgacggaaccguggugcgcg

SEQ ID NO: 4026120 - RNA, 19 nt, Molluscum contagiosum virus
gcgacgggaaccgugcugg

SEQ ID NO: 4026121 - RNA, 21 nt, Molluscum contagiosum virus
gcgacuccuuugcgagcacug

SEQ ID NO: 4026122 - RNA, 20 nt, Molluscum contagiosum virus
gcgagaccgcuagagugcgc

SEQ ID NO: 4026123 - RNA, 22 nt, Molluscum contagiosum virus
gcgagaccgcuagagugcgcgg

SEQ ID NO: 4026124 - RNA, 16 nt, Molluscum contagiosum virus
gcgagacgcugcugca

SEQ ID NO: 4026125 - RNA, 15 nt, Molluscum contagiosum virus
gcgagacgggcacgc

SEQ ID NO: 4026126 - RNA, 17 nt, Molluscum contagiosum virus
gcgagaucaacgcgcgc

SEQ ID NO: 4026127 - RNA, 19 nt, Molluscum contagiosum virus
gcgagaugcgcggacagag

SEQ ID NO: 4026128 - RNA, 23 nt, Molluscum contagiosum virus
gcgagauugagagcgcuggcuuc

SEQ ID NO: 4026129 - RNA, 15 nt, Molluscum contagiosum virus
gcgagcacagcgcgc

SEQ ID NO: 4026130 - RNA, 20 nt, Molluscum contagiosum virus
gcgagcacccccgcugcacg

SEQ ID NO: 4026131 - RNA, 15 nt, Molluscum contagiosum virus
gcgagcagcugcugc

SEQ ID NO: 4026132 - RNA, 14 nt, Molluscum contagiosum virus
gcgagcaggcgcag

SEQ ID NO: 4026133 - RNA, 19 nt, Molluscum contagiosum virus
gcgagcaggcgcaggccgc

SEQ ID NO: 4026134 - RNA, 15 nt, Molluscum contagiosum virus
gcgagcaugccgccg

SEQ ID NO: 4026135 - RNA, 14 nt, Molluscum contagiosum virus
gcgagccagccagg

SEQ ID NO: 4026136 - RNA, 21 nt, Molluscum contagiosum virus
gcgagcgcaugcgcgccgcgc

SEQ ID NO: 4026137 - RNA, 14 nt, Molluscum contagiosum virus
gcgcgagcugugca

SEQ ID NO: 4026138 - RNA, 12 nt, Molluscum contagiosum virus
gcgcgagcuugc

SEQ ID NO: 4026139 - RNA, 16 nt, Molluscum contagiosum virus
gcgcgagugcaaggag

SEQ ID NO: 4026140 - RNA, 12 nt, Molluscum contagiosum virus
gcgcgagugugc

SEQ ID NO: 4026141 - RNA, 21 nt, Molluscum contagiosum virus
gcgcgagugugugcaucccuc

SEQ ID NO: 4026142 - RNA, 13 nt, Molluscum contagiosum virus
gcgcgcaagcgcu

SEQ ID NO: 4026143 - RNA, 21 nt, Molluscum contagiosum virus
gcgcgcacgaacgcaacucgc

SEQ ID NO: 4026144 - RNA, 13 nt, Molluscum contagiosum virus
gcgcgcacgcgca

SEQ ID NO: 4026145 - RNA, 14 nt, Molluscum contagiosum virus
gcgcgcacgcgcac

SEQ ID NO: 4026146 - RNA, 17 nt, Molluscum contagiosum virus
gcgcgcacugcgggacc

SEQ ID NO: 4026147 - RNA, 18 nt, Molluscum contagiosum virus
gcgcgcacugcucgcgca

SEQ ID NO: 4026148 - RNA, 14 nt, Molluscum contagiosum virus
gcgcgcaguugugc

SEQ ID NO: 4026149 - RNA, 18 nt, Molluscum contagiosum virus
gcgcgcauacgcgccgcg

SEQ ID NO: 4026150 - RNA, 16 nt, Molluscum contagiosum virus
gcgcgcaucgcgggca

SEQ ID NO: 4026151 - RNA, 21 nt, Molluscum contagiosum virus
gcgcgccaacgacuagcgugc

SEQ ID NO: 4026152 - RNA, 13 nt, Molluscum contagiosum virus
gcgcgccagcacg

SEQ ID NO: 4026153 - RNA, 17 nt, Molluscum contagiosum virus
gcgcgccaguacgcaug

SEQ ID NO: 4026154 - RNA, 23 nt, Molluscum contagiosum virus
gcgcgcccaccagcagccaggcu

SEQ ID NO: 4026155 - RNA, 14 nt, Molluscum contagiosum virus
gcgcgcccaggcgc

SEQ ID NO: 4026156 - RNA, 20 nt, Molluscum contagiosum virus
gcgcgcccccgugcuguguu

SEQ ID NO: 4026157 - RNA, 17 nt, Molluscum contagiosum virus
gcgcgcccgcugcgcgc

SEQ ID NO: 4026158 - RNA, 20 nt, Molluscum contagiosum virus
gcgcgccgaguacugcugcg

SEQ ID NO: 4026159 - RNA, 14 nt, Molluscum contagiosum virus
gcgcgccgcaaagc

SEQ ID NO: 4026160 - RNA, 19 nt, Molluscum contagiosum virus
gcgcgccgcagaacacggg

SEQ ID NO: 4026161 - RNA, 15 nt, Molluscum contagiosum virus
gcgcgccgcgggccg

SEQ ID NO: 4026162 - RNA, 16 nt, Molluscum contagiosum virus
cagccgucgccgcgcc

SEQ ID NO: 4026163 - RNA, 16 nt, Molluscum contagiosum virus
cagccucgagcgccgu

SEQ ID NO: 4026164 - RNA, 13 nt, Molluscum contagiosum virus
cagccucuacucc

SEQ ID NO: 4026165 - RNA, 19 nt, Molluscum contagiosum virus
cagccugcuggcaccgcgc

SEQ ID NO: 4026166 - RNA, 23 nt, Molluscum contagiosum virus
cagccuguguugcgcgcgccugc

SEQ ID NO: 4026167 - RNA, 13 nt, Molluscum contagiosum virus
cagcgacgcgacg

SEQ ID NO: 4026168 - RNA, 22 nt, Molluscum contagiosum virus
cagcgcgacuagccugugcccu

SEQ ID NO: 4026169 - RNA, 16 nt, Molluscum contagiosum virus
cagcgcgccaccacca

SEQ ID NO: 4026170 - RNA, 20 nt, Molluscum contagiosum virus
cagcgcgcccaccagcagcc

SEQ ID NO: 4026171 - RNA, 21 nt, Molluscum contagiosum virus
cagcgcgcccaccagcagcca

SEQ ID NO: 4026172 - RNA, 12 nt, Molluscum contagiosum virus
cagcgcgcgcac

SEQ ID NO: 4026173 - RNA, 13 nt, Molluscum contagiosum virus
cagcgcgcggaag

SEQ ID NO: 4026174 - RNA, 17 nt, Molluscum contagiosum virus
cagcgcgcggagaucgc

SEQ ID NO: 4026175 - RNA, 20 nt, Molluscum contagiosum virus
cagcgcgcucgaggcgccgu

SEQ ID NO: 4026176 - RNA, 20 nt, Molluscum contagiosum virus
cagcgcuagccccagcacca

SEQ ID NO: 4026177 - RNA, 16 nt, Molluscum contagiosum virus
cagcggauagcuuuuc

SEQ ID NO: 4026178 - RNA, 13 nt, Molluscum contagiosum virus
cagcggcgccgca

SEQ ID NO: 4026179 - RNA, 17 nt, Molluscum contagiosum virus
cagcggcgccgcagcuu

SEQ ID NO: 4026180 - RNA, 18 nt, Molluscum contagiosum virus
cagcggcgccgcagcuuu

SEQ ID NO: 4026181 - RNA, 18 nt, Molluscum contagiosum virus
cagcgggaaacugcugcc

SEQ ID NO: 4026182 - RNA, 18 nt, Molluscum contagiosum virus
cagcggggacucucccgu

SEQ ID NO: 4026183 - RNA, 18 nt, Molluscum contagiosum virus
cagcgucgcgcgccgugc

SEQ ID NO: 4026184 - RNA, 13 nt, Molluscum contagiosum virus
cagcgucgcggag

SEQ ID NO: 4026185 - RNA, 17 nt, Molluscum contagiosum virus
cagcgucgcggagcgcg

SEQ ID NO: 4026186 - RNA, 19 nt, Molluscum contagiosum virus
cagcgugccgcggcacugg

SEQ ID NO: 4026187 - RNA, 18 nt, Molluscum contagiosum virus
cagcgugcgcgggcacgc

SEQ ID NO: 4026188 - RNA, 23 nt, Molluscum contagiosum virus
cagcgugcgcgggcacgccgcag

SEQ ID NO: 4026189 - RNA, 18 nt, Molluscum contagiosum virus
cagcguuacguacagcgg

SEQ ID NO: 4026190 - RNA, 19 nt, Molluscum contagiosum virus
cagcuaccgcgcgcgcaag

SEQ ID NO: 4026191 - RNA, 13 nt, Molluscum contagiosum virus
cagcuaugcgccc

SEQ ID NO: 4026192 - RNA, 20 nt, Molluscum contagiosum virus
cagcucaagacgcugcuggc

SEQ ID NO: 4026193 - RNA, 14 nt, Molluscum contagiosum virus
cagcucaagcugcu

SEQ ID NO: 4026194 - RNA, 17 nt, Molluscum contagiosum virus
cagcucgccgcgcgccg

SEQ ID NO: 4026195 - RNA, 18 nt, Molluscum contagiosum virus
cagcucgccgcgcgccgc

SEQ ID NO: 4026196 - RNA, 20 nt, Molluscum contagiosum virus
cagcucgccgcgcgccgcug

SEQ ID NO: 4026197 - RNA, 23 nt, Molluscum contagiosum virus
cagcucgccgcgcgccgcugcuc

SEQ ID NO: 4026198 - RNA, 23 nt, Molluscum contagiosum virus
cagcucgcgccgccgcgccgcug

SEQ ID NO: 4026199 - RNA, 16 nt, Molluscum contagiosum virus
cagcucggaggcgcag

SEQ ID NO: 4026200 - RNA, 20 nt, Molluscum contagiosum virus
cagcucggaggcgcagacgu

SEQ ID NO: 4026201 - RNA, 15 nt, Molluscum contagiosum virus
cagcucugcagcgcc

SEQ ID NO: 4026202 - RNA, 16 nt, Molluscum contagiosum virus
cagcucugggcgcgcu

SEQ ID NO: 4026203 - RNA, 14 nt, Molluscum contagiosum virus
cagcugcaggaccu

SEQ ID NO: 4026204 - RNA, 18 nt, Molluscum contagiosum virus
cagcugcaggaccugcug

SEQ ID NO: 4026205 - RNA, 14 nt, Molluscum contagiosum virus
cagcugcugcucgc

SEQ ID NO: 4026206 - RNA, 20 nt, Molluscum contagiosum virus
cagcuggacggugcuggugc

SEQ ID NO: 4026207 - RNA, 15 nt, Molluscum contagiosum virus
cagcuggcgcccgcg

SEQ ID NO: 4026208 - RNA, 15 nt, Molluscum contagiosum virus
cagcuguuucugccg

SEQ ID NO: 4026209 - RNA, 19 nt, Molluscum contagiosum virus
cagcuguuucugccgcgcc

SEQ ID NO: 4026210 - RNA, 15 nt, Molluscum contagiosum virus
cagcuucugcucgcg

SEQ ID NO: 4026211 - RNA, 13 nt, Molluscum contagiosum virus
cagcuugcugcug

SEQ ID NO: 4026212 - RNA, 14 nt, Molluscum contagiosum virus
caggaaaggcaccc

SEQ ID NO: 4026213 - RNA, 19 nt, Molluscum contagiosum virus
caggaaaggcaccccgcag

SEQ ID NO: 4026214 - RNA, 18 nt, Molluscum contagiosum virus
caggaaaggcacccgcag

SEQ ID NO: 4026215 - RNA, 14 nt, Molluscum contagiosum virus
caggaaagguaccc

SEQ ID NO: 4026216 - RNA, 19 nt, Molluscum contagiosum virus
caggaaagguaccccgcag

SEQ ID NO: 4026217 - RNA, 23 nt, Molluscum contagiosum virus
caggaaagguacccgcaggaaag

SEQ ID NO: 4026218 - RNA, 23 nt, Molluscum contagiosum virus
caggaaaggucgggcccgagcag

SEQ ID NO: 4026219 - RNA, 14 nt, Molluscum contagiosum virus
caggaacgccgcca

SEQ ID NO: 4026220 - RNA, 15 nt, Molluscum contagiosum virus
caggagaacuacaaa

SEQ ID NO: 4026221 - RNA, 18 nt, Molluscum contagiosum virus
caggaucggagcgcagcu

SEQ ID NO: 4026222 - RNA, 21 nt, Molluscum contagiosum virus
caggcacgacgccgacaccgg

SEQ ID NO: 4026223 - RNA, 15 nt, Molluscum contagiosum virus
caggcagcugcugcg

SEQ ID NO: 4026224 - RNA, 21 nt, Molluscum contagiosum virus
caggcagugccgccgcgcgcg

SEQ ID NO: 4026225 - RNA, 22 nt, Molluscum contagiosum virus
caggccgcuagcaggcgucgcg

SEQ ID NO: 4026226 - RNA, 23 nt, Molluscum contagiosum virus
caggccggucgcggaagacgugc

SEQ ID NO: 4026227 - RNA, 15 nt, Molluscum contagiosum virus
caggccuccuucccu

SEQ ID NO: 4026228 - RNA, 17 nt, Molluscum contagiosum virus
caggcgauaggacauga

SEQ ID NO: 4026229 - RNA, 14 nt, Molluscum contagiosum virus
caggcgcagcgcgg

SEQ ID NO: 4026230 - RNA, 14 nt, Molluscum contagiosum virus
caggcgcaggccgc

SEQ ID NO: 4026231 - RNA, 21 nt, Molluscum contagiosum virus
caggcgccaucgcgcgugacu

SEQ ID NO: 4026232 - RNA, 17 nt, Molluscum contagiosum virus
caggcgccgcaccucac

SEQ ID NO: 4026233 - RNA, 20 nt, Molluscum contagiosum virus
caggcgcgaacucgcggcag

SEQ ID NO: 4026234 - RNA, 16 nt, Molluscum contagiosum virus
caggcgcgccauggcg

SEQ ID NO: 4026235 - RNA, 22 nt, Molluscum contagiosum virus
caggcgcggcagccgcagaugc

SEQ ID NO: 4026236 - RNA, 20 nt, Molluscum contagiosum virus
caggcgcggucgcccgccga

SEQ ID NO: 4026237 - RNA, 22 nt, Molluscum contagiosum virus
caggcgcgugcccugcacgcgc

SEQ ID NO: 4026238 - RNA, 20 nt, Molluscum contagiosum virus
caggcggccgcguugcagca

SEQ ID NO: 4026239 - RNA, 12 nt, Molluscum contagiosum virus
caggcucccgcu

SEQ ID NO: 4026240 - RNA, 19 nt, Molluscum contagiosum virus
caggcucuaagcgcacgcg

SEQ ID NO: 4026241 - RNA, 15 nt, Molluscum contagiosum virus
cagggcgugcuugcc

SEQ ID NO: 4026242 - RNA, 20 nt, Molluscum contagiosum virus
cagguagugguccaccagcu

SEQ ID NO: 4026243 - RNA, 17 nt, Molluscum contagiosum virus
caggucaucgacgagca

SEQ ID NO: 4026244 - RNA, 20 nt, Molluscum contagiosum virus
caggucaucgacgagcacga

SEQ ID NO: 4026245 - RNA, 18 nt, Molluscum contagiosum virus
caggucaucgggcugcag

SEQ ID NO: 4026246 - RNA, 20 nt, Molluscum contagiosum virus
caggucaucgggcugcagcc

SEQ ID NO: 4026247 - RNA, 22 nt, Molluscum contagiosum virus
caggucggccagcagcuccugg

SEQ ID NO: 4026248 - RNA, 23 nt, Molluscum contagiosum virus
caggucggccagcagcuccuggu

SEQ ID NO: 4026249 - RNA, 15 nt, Molluscum contagiosum virus
caguaccagauuagc

SEQ ID NO: 4026250 - RNA, 21 nt, Molluscum contagiosum virus
caguagcgaaugcagugcccg

SEQ ID NO: 4026251 - RNA, 11 nt, Molluscum contagiosum virus
cagucccagca

SEQ ID NO: 4026252 - RNA, 16 nt, Molluscum contagiosum virus
cagucggugccagauu

SEQ ID NO: 4026253 - RNA, 14 nt, Molluscum contagiosum virus
cagucgucgccgau

SEQ ID NO: 4026254 - RNA, 22 nt, Molluscum contagiosum virus
cagugcaguggcuacuggagga

SEQ ID NO: 4026255 - RNA, 14 nt, Molluscum contagiosum virus
cagugccagcagcc

SEQ ID NO: 4026256 - RNA, 22 nt, Molluscum contagiosum virus
cagugccgacgugugccgcucg

SEQ ID NO: 4026257 - RNA, 15 nt, Molluscum contagiosum virus
aaaacggccgucucc

SEQ ID NO: 4026258 - RNA, 17 nt, Molluscum contagiosum virus
aaaagcacaguccaacc

SEQ ID NO: 4026259 - RNA, 23 nt, Molluscum contagiosum virus
aaaaggccggguuuuuucccaug

SEQ ID NO: 4026260 - RNA, 15 nt, Molluscum contagiosum virus
aaacacgagacugag

SEQ ID NO: 4026261 - RNA, 20 nt, Molluscum contagiosum virus
aaacacggccuccagcagcg

SEQ ID NO: 4026262 - RNA, 19 nt, Molluscum contagiosum virus
aaacauguagcgcgcgccg

SEQ ID NO: 4026263 - RNA, 22 nt, Molluscum contagiosum virus
aaagacggggccgcgaaagagg

SEQ ID NO: 4026264 - RNA, 19 nt, Molluscum contagiosum virus
aaaggcaaagccugcugcg

SEQ ID NO: 4026265 - RNA, 13 nt, Molluscum contagiosum virus
aaaggcacacccc

SEQ ID NO: 4026266 - RNA, 20 nt, Molluscum contagiosum virus
aaaggcaccccgaaggaaag

SEQ ID NO: 4026267 - RNA, 14 nt, Molluscum contagiosum virus
aaaggcaccugcgg

SEQ ID NO: 4026268 - RNA, 20 nt, Molluscum contagiosum virus
aaaggcgggcccgcgaacga

SEQ ID NO: 4026269 - RNA, 22 nt, Molluscum contagiosum virus
aaagggcugcuugcgaccccag

SEQ ID NO: 4026270 - RNA, 18 nt, Molluscum contagiosum virus
aaaggugcgauggacgac

SEQ ID NO: 4026271 - RNA, 16 nt, Molluscum contagiosum virus
aacaagagcuuacuag

SEQ ID NO: 4026272 - RNA, 18 nt, Molluscum contagiosum virus
aacaagaucaccccgcag

SEQ ID NO: 4026273 - RNA, 13 nt, Molluscum contagiosum virus
aacacgagacuga

SEQ ID NO: 4026274 - RNA, 18 nt, Molluscum contagiosum virus
aacagcaccguugccgcg

SEQ ID NO: 4026275 - RNA, 13 nt, Molluscum contagiosum virus
aacagcagcuggc

SEQ ID NO: 4026276 - RNA, 13 nt, Molluscum contagiosum virus
agaguugcgcgag

SEQ ID NO: 4026277 - RNA, 19 nt, Molluscum contagiosum virus
agaucaaccgcaaggaaaa

SEQ ID NO: 4026278 - RNA, 14 nt, Molluscum contagiosum virus
agaucaacgcgcgc

SEQ ID NO: 4026279 - RNA, 16 nt, Molluscum contagiosum virus
agaucaggcagcugcu

SEQ ID NO: 4026280 - RNA, 19 nt, Molluscum contagiosum virus
agauccguaguagccgcaa

SEQ ID NO: 4026281 - RNA, 13 nt, Molluscum contagiosum virus
agauggacacagc

SEQ ID NO: 4026282 - RNA, 23 nt, Molluscum contagiosum virus
agcaaccucgggaagcccucagg

SEQ ID NO: 4026283 - RNA, 22 nt, Molluscum contagiosum virus
agcaacgcgacgauggccacgc

SEQ ID NO: 4026284 - RNA, 19 nt, Molluscum contagiosum virus
agcaacugcacagggauuc

SEQ ID NO: 4026285 - RNA, 9 nt, Molluscum contagiosum virus
agcaaggag

SEQ ID NO: 4026286 - RNA, 13 nt, Molluscum contagiosum virus
agcaaggggucug

SEQ ID NO: 4026287 - RNA, 18 nt, Molluscum contagiosum virus
agcaagucugcgcaggac

SEQ ID NO: 4026288 - RNA, 16 nt, Molluscum contagiosum virus
agcaccaagaagcggc

SEQ ID NO: 4026289 - RNA, 15 nt, Molluscum contagiosum virus
agcaccgcaugggcc

SEQ ID NO: 4026290 - RNA, 22 nt, Molluscum contagiosum virus
agcaccucaacuguugccugga

SEQ ID NO: 4026291 - RNA, 19 nt, Molluscum contagiosum virus
agcacgaugcccagcagcg

SEQ ID NO: 4026292 - RNA, 13 nt, Molluscum contagiosum virus
agcacgcaacugc

SEQ ID NO: 4026293 - RNA, 21 nt, Molluscum contagiosum virus
agcacgccagguguuccugcc

SEQ ID NO: 4026294 - RNA, 14 nt, Molluscum contagiosum virus
agcacgccuccaag

SEQ ID NO: 4026295 - RNA, 17 nt, Molluscum contagiosum virus
agcacgccuccaagaag

SEQ ID NO: 4026296 - RNA, 13 nt, Molluscum contagiosum virus
agcacgccuggcg

SEQ ID NO: 4026297 - RNA, 15 nt, Molluscum contagiosum virus
agcacgcgugugcga

SEQ ID NO: 4026298 - RNA, 16 nt, Molluscum contagiosum virus
agcacguccucgguca

SEQ ID NO: 4026299 - RNA, 21 nt, Molluscum contagiosum virus
agcacguuguucuugcgcgug

SEQ ID NO: 4026300 - RNA, 14 nt, Molluscum contagiosum virus
agcagaccaagaag

SEQ ID NO: 4026301 - RNA, 13 nt, Molluscum contagiosum virus
agcagagccggga

SEQ ID NO: 4026302 - RNA, 22 nt, Molluscum contagiosum virus
agcagcaaacugugcuccugag

SEQ ID NO: 4026303 - RNA, 14 nt, Molluscum contagiosum virus
agcagcgcuagccc

SEQ ID NO: 4026304 - RNA, 15 nt, Molluscum contagiosum virus
agcagcggcgcgugc

SEQ ID NO: 4026305 - RNA, 19 nt, Molluscum contagiosum virus
agcagcggucucggcagca

SEQ ID NO: 4026306 - RNA, 21 nt, Molluscum contagiosum virus
agcagcgugcauagugggcuu

SEQ ID NO: 4026307 - RNA, 20 nt, Molluscum contagiosum virus
agcagcugcugcgcacgugc

SEQ ID NO: 4026308 - RNA, 16 nt, Molluscum contagiosum virus
agcagcuggccggcuc

SEQ ID NO: 4026309 - RNA, 15 nt, Molluscum contagiosum virus
agcaggaucggagcg

SEQ ID NO: 4026310 - RNA, 15 nt, Molluscum contagiosum virus
agcaggugcacgugc

SEQ ID NO: 4026311 - RNA, 17 nt, Molluscum contagiosum virus
agcaguaccugcuaacu

SEQ ID NO: 4026312 - RNA, 16 nt, Molluscum contagiosum virus
agcagugccagcagcc

SEQ ID NO: 4026313 - RNA, 15 nt, Molluscum contagiosum virus
agcagugccgcucgc

SEQ ID NO: 4026314 - RNA, 20 nt, Molluscum contagiosum virus
agcauguccgacuccaagga

SEQ ID NO: 4026315 - RNA, 21 nt, Molluscum contagiosum virus
agcauucccggcgcgcgcggc

SEQ ID NO: 4026316 - RNA, 15 nt, Molluscum contagiosum virus
agccagacgcagagc

SEQ ID NO: 4026317 - RNA, 15 nt, Molluscum contagiosum virus
agccagccaggcgcc

SEQ ID NO: 4026318 - RNA, 18 nt, Molluscum contagiosum virus
agccagcucgcagccucc

SEQ ID NO: 4026319 - RNA, 13 nt, Molluscum contagiosum virus
agcccacgugcca

SEQ ID NO: 4026320 - RNA, 18 nt, Molluscum contagiosum virus
agccccagaaggucgugc

SEQ ID NO: 4026321 - RNA, 12 nt, Molluscum contagiosum virus
agcccccucaga

SEQ ID NO: 4026322 - RNA, 14 nt, Molluscum contagiosum virus
agccccgcgccggc

SEQ ID NO: 4026323 - RNA, 13 nt, Molluscum contagiosum virus
agccccucgagca

SEQ ID NO: 4026324 - RNA, 18 nt, Molluscum contagiosum virus
agcccgaguucgcggcgc

SEQ ID NO: 4026325 - RNA, 21 nt, Molluscum contagiosum virus
agcccgcaggccgggcaccca

SEQ ID NO: 4026326 - RNA, 14 nt, Molluscum contagiosum virus
agcccgcgcgcgag

SEQ ID NO: 4026327 - RNA, 17 nt, Molluscum contagiosum virus
agcccgcggcgcgcagc

SEQ ID NO: 4026328 - RNA, 23 nt, Molluscum contagiosum virus
agcccgggcccgugcccgagccc

SEQ ID NO: 4026329 - RNA, 14 nt, Molluscum contagiosum virus
agcccgugcuggag

SEQ ID NO: 4026330 - RNA, 15 nt, Molluscum contagiosum virus
agccgcaggccaggu

SEQ ID NO: 4026331 - RNA, 22 nt, Molluscum contagiosum virus
agccgccgcuacuacggagcga

SEQ ID NO: 4026332 - RNA, 21 nt, Molluscum contagiosum virus
agccgcgugcgccgccgcagg

SEQ ID NO: 4026333 - RNA, 23 nt, Molluscum contagiosum virus
agccgcucguccagcugcgcgag

SEQ ID NO: 4026334 - RNA, 18 nt, Molluscum contagiosum virus
agccgcugcgccgccagc

SEQ ID NO: 4026335 - RNA, 19 nt, Molluscum contagiosum virus
agccucccccgcgcacugc

SEQ ID NO: 4026336 - RNA, 17 nt, Molluscum contagiosum virus
agccugaggccgcggag

SEQ ID NO: 4026337 - RNA, 21 nt, Molluscum contagiosum virus
agccugugcccuggaagcuuc

SEQ ID NO: 4026338 - RNA, 21 nt, Molluscum contagiosum virus
agccuucuucgugcugugccu

SEQ ID NO: 4026339 - RNA, 14 nt, Molluscum contagiosum virus
agcgaguugagcag

SEQ ID NO: 4026340 - RNA, 17 nt, Molluscum contagiosum virus
agcgcaugcgcgccgcg

SEQ ID NO: 4026341 - RNA, 23 nt, Molluscum contagiosum virus
agcgccacuagcaaggcgccgcg

SEQ ID NO: 4026342 - RNA, 22 nt, Molluscum contagiosum virus
agcgccgccucgcgcgcacugc

SEQ ID NO: 4026343 - RNA, 15 nt, Molluscum contagiosum virus
agcgccgcucgcacg

SEQ ID NO: 4026344 - RNA, 19 nt, Molluscum contagiosum virus
agcgccgcucgcacggcga

SEQ ID NO: 4026345 - RNA, 18 nt, Molluscum contagiosum virus
agcgcgcccaccagcagc

SEQ ID NO: 4026346 - RNA, 23 nt, Molluscum contagiosum virus
agcgcgcccaccagcagccaggc

SEQ ID NO: 4026347 - RNA, 14 nt, Molluscum contagiosum virus
agcgcgccucucga

SEQ ID NO: 4026348 - RNA, 18 nt, Molluscum contagiosum virus
agcgcgccucucgaggcc

SEQ ID NO: 4026349 - RNA, 21 nt, Molluscum contagiosum virus
agcgcgcgccgucggccucgg

SEQ ID NO: 4026350 - RNA, 13 nt, Molluscum contagiosum virus
agcgcgcugcgcc

SEQ ID NO: 4026351 - RNA, 15 nt, Molluscum contagiosum virus
agcgcgcuggacuug

SEQ ID NO: 4026352 - RNA, 18 nt, Molluscum contagiosum virus
agcgcggccgcgcucguc

SEQ ID NO: 4026353 - RNA, 14 nt, Molluscum contagiosum virus
agcgcggccguggc

SEQ ID NO: 4026354 - RNA, 17 nt, Molluscum contagiosum virus
agcgcggggguguugcu

SEQ ID NO: 4026355 - RNA, 19 nt, Molluscum contagiosum virus
agcgcgugacgcucacggc

SEQ ID NO: 4026356 - RNA, 18 nt, Molluscum contagiosum virus
agcgcgugcgcaggagca

SEQ ID NO: 4026357 - RNA, 15 nt, Molluscum contagiosum virus
agcgcgugcucuuuc

SEQ ID NO: 4026358 - RNA, 17 nt, Molluscum contagiosum virus
agcgcguucgcgcgugc

SEQ ID NO: 4026359 - RNA, 12 nt, Molluscum contagiosum virus
agcgcuaccuga

SEQ ID NO: 4026360 - RNA, 20 nt, Molluscum contagiosum virus
agcgcuacgacgacaugcac

SEQ ID NO: 4026361 - RNA, 22 nt, Molluscum contagiosum virus
agcgcuggagcuggcugggcac

SEQ ID NO: 4026362 - RNA, 14 nt, Molluscum contagiosum virus
agcgcuggcuucuu

SEQ ID NO: 4026363 - RNA, 21 nt, Molluscum contagiosum virus
agcgcuucuuccggcagcugg

SEQ ID NO: 4026364 - RNA, 19 nt, Molluscum contagiosum virus
agcggcauucgaaccugga

SEQ ID NO: 4026365 - RNA, 13 nt, Molluscum contagiosum virus
agcggccuguucu

SEQ ID NO: 4026366 - RNA, 20 nt, Molluscum contagiosum virus
agcggcgacuugcugcggag

SEQ ID NO: 4026367 - RNA, 12 nt, Molluscum contagiosum virus
agcggcgccgac

SEQ ID NO: 4026368 - RNA, 14 nt, Molluscum contagiosum virus
agcggcggacagca

SEQ ID NO: 4026369 - RNA, 19 nt, Molluscum contagiosum virus
agcgggcaaugggcacgcu

SEQ ID NO: 4026370 - RNA, 15 nt, Molluscum contagiosum virus
agcggucucggcagc

SEQ ID NO: 4026371 - RNA, 21 nt, Molluscum contagiosum virus
agcggugcagcuacugcgugc

SEQ ID NO: 4026372 - RNA, 13 nt, Molluscum contagiosum virus
agcgguugaccag

SEQ ID NO: 4026373 - RNA, 13 nt, Molluscum contagiosum virus
agcgucaguguug

SEQ ID NO: 4026374 - RNA, 14 nt, Molluscum contagiosum virus
agcguccagccgca

SEQ ID NO: 4026375 - RNA, 16 nt, Molluscum contagiosum virus
agcguccgcauccuca

SEQ ID NO: 4026376 - RNA, 16 nt, Molluscum contagiosum virus
agcgucgcgcgccgug

SEQ ID NO: 4026377 - RNA, 23 nt, Molluscum contagiosum virus
agcgucgcgcgccgugccuggca

SEQ ID NO: 4026378 - RNA, 21 nt, Molluscum contagiosum virus
agcgugacaaucucugcgccg

SEQ ID NO: 4026379 - RNA, 11 nt, Molluscum contagiosum virus
agcguggagcu

SEQ ID NO: 4026380 - RNA, 21 nt, Molluscum contagiosum virus
aacagcauuagcgccaaggcg

SEQ ID NO: 4026381 - RNA, 11 nt, Molluscum contagiosum virus
aacagcuucac

SEQ ID NO: 4026382 - RNA, 15 nt, Molluscum contagiosum virus
aacaggcacuucgca

SEQ ID NO: 4026383 - RNA, 19 nt, Molluscum contagiosum virus
aacaggggccguucgcgcg

SEQ ID NO: 4026384 - RNA, 18 nt, Molluscum contagiosum virus
aacaucuaugcacggcac

SEQ ID NO: 4026385 - RNA, 15 nt, Molluscum contagiosum virus
aacaugaaggaaagu

SEQ ID NO: 4026386 - RNA, 15 nt, Molluscum contagiosum virus
aacauggugcuggcc

SEQ ID NO: 4026387 - RNA, 14 nt, Molluscum contagiosum virus
aacaugugccugcu

SEQ ID NO: 4026388 - RNA, 20 nt, Molluscum contagiosum virus
aaccacagcucuccgagaca

SEQ ID NO: 4026389 - RNA, 21 nt, Molluscum contagiosum virus
aacccgcauugggccuugauu

SEQ ID NO: 4026390 - RNA, 15 nt, Molluscum contagiosum virus
aaccgcgugcgcagu

SEQ ID NO: 4026391 - RNA, 14 nt, Molluscum contagiosum virus
aaccugggcgccgc

SEQ ID NO: 4026392 - RNA, 13 nt, Molluscum contagiosum virus
aacgacgggcgcg

SEQ ID NO: 4026393 - RNA, 12 nt, Molluscum contagiosum virus
aacgagcucucc

SEQ ID NO: 4026394 - RNA, 17 nt, Molluscum contagiosum virus
aacgaggaaaggcaccc

SEQ ID NO: 4026395 - RNA, 22 nt, Molluscum contagiosum virus
aacgcaaggugugcgcgcugca

SEQ ID NO: 4026396 - RNA, 19 nt, Molluscum contagiosum virus
aacgcacaaaacacaaaaa

SEQ ID NO: 4026397 - RNA, 21 nt, Molluscum contagiosum virus
aacgcgacgauggccacgcag

SEQ ID NO: 4026398 - RNA, 16 nt, Molluscum contagiosum virus
aacgcgcgcgccucgc

SEQ ID NO: 4026399 - RNA, 22 nt, Molluscum contagiosum virus
aacgcgcgcucgucaaugcgca

SEQ ID NO: 4026400 - RNA, 17 nt, Molluscum contagiosum virus
aacgcggcgugugcggg

SEQ ID NO: 4026401 - RNA, 14 nt, Molluscum contagiosum virus
aacgcgggccaggc

SEQ ID NO: 4026402 - RNA, 12 nt, Molluscum contagiosum virus
aacgugcugcuc

SEQ ID NO: 4026403 - RNA, 16 nt, Molluscum contagiosum virus
aacugcagcagcuggc

SEQ ID NO: 4026404 - RNA, 17 nt, Molluscum contagiosum virus
aacugcccggcggcaag

SEQ ID NO: 4026405 - RNA, 12 nt, Molluscum contagiosum virus
aacugcugggcg

SEQ ID NO: 4026406 - RNA, 12 nt, Molluscum contagiosum virus
aacuucgcgcug

SEQ ID NO: 4026407 - RNA, 22 nt, Molluscum contagiosum virus
aacuugcucuacuggcggcgcc

SEQ ID NO: 4026408 - RNA, 13 nt, Molluscum contagiosum virus
aacuuuuccugcg

SEQ ID NO: 4026409 - RNA, 18 nt, Molluscum contagiosum virus
aagaacaugugcuccgcc

SEQ ID NO: 4026410 - RNA, 16 nt, Molluscum contagiosum virus
aagaagugugccugcu

SEQ ID NO: 4026411 - RNA, 15 nt, Molluscum contagiosum virus
aagaccauggggcua

SEQ ID NO: 4026412 - RNA, 22 nt, Molluscum contagiosum virus
aagacgcuggugaucacgcacg

SEQ ID NO: 4026413 - RNA, 22 nt, Molluscum contagiosum virus
aagacguggacgaggccaaccu

SEQ ID NO: 4026414 - RNA, 13 nt, Molluscum contagiosum virus
aagacuggcucag

SEQ ID NO: 4026415 - RNA, 16 nt, Molluscum contagiosum virus
aagagcguccagccgc

SEQ ID NO: 4026416 - RNA, 22 nt, Molluscum contagiosum virus
aagauauacaccaggcgcgugc

SEQ ID NO: 4026417 - RNA, 21 nt, Molluscum contagiosum virus
aagcacgcaacgucgcacugg

SEQ ID NO: 4026418 - RNA, 11 nt, Molluscum contagiosum virus
aagcacugccu

SEQ ID NO: 4026419 - RNA, 16 nt, Molluscum contagiosum virus
aagcagcaaacugugc

SEQ ID NO: 4026420 - RNA, 16 nt, Molluscum contagiosum virus
aagcgcccgugaugca

SEQ ID NO: 4026421 - RNA, 18 nt, Molluscum contagiosum virus
aagcgcccucguguacga

SEQ ID NO: 4026422 - RNA, 14 nt, Molluscum contagiosum virus
aagcgcgcucgggc

SEQ ID NO: 4026423 - RNA, 13 nt, Molluscum contagiosum virus
aagcgcggccgcg

SEQ ID NO: 4026424 - RNA, 17 nt, Molluscum contagiosum virus
aagcgucgugcuccacg

SEQ ID NO: 4026425 - RNA, 11 nt, Molluscum contagiosum virus
aagcucagccu

SEQ ID NO: 4026426 - RNA, 13 nt, Molluscum contagiosum virus
aagcuccugcugg

SEQ ID NO: 4026427 - RNA, 22 nt, Molluscum contagiosum virus
aagcuggcgggugccgugcccc

SEQ ID NO: 4026428 - RNA, 15 nt, Molluscum contagiosum virus
aaggacuaccagcuc

SEQ ID NO: 4026429 - RNA, 19 nt, Molluscum contagiosum virus
aaggaucucugcccucaga

SEQ ID NO: 4026430 - RNA, 23 nt, Molluscum contagiosum virus
aaggaugccugccagcagagcug

SEQ ID NO: 4026431 - RNA, 16 nt, Molluscum contagiosum virus
aaggcauaccugugcc

SEQ ID NO: 4026432 - RNA, 13 nt, Molluscum contagiosum virus
acccuggcugcug

SEQ ID NO: 4026433 - RNA, 21 nt, Molluscum contagiosum virus
acccuuaacucguagcuagcg

SEQ ID NO: 4026434 - RNA, 12 nt, Molluscum contagiosum virus
acccuuggcagc

SEQ ID NO: 4026435 - RNA, 22 nt, Molluscum contagiosum virus
accgagcaagcuggaggcugcc

SEQ ID NO: 4026436 - RNA, 20 nt, Molluscum contagiosum virus
accgcagacaaagacagucc

SEQ ID NO: 4026437 - RNA, 18 nt, Molluscum contagiosum virus
accgcaugggcccuggcg

SEQ ID NO: 4026438 - RNA, 20 nt, Molluscum contagiosum virus
accgcccuuguggacgcgcg

SEQ ID NO: 4026439 - RNA, 14 nt, Molluscum contagiosum virus
accgccgcggccgc

SEQ ID NO: 4026440 - RNA, 14 nt, Molluscum contagiosum virus
accgccugcgggag

SEQ ID NO: 4026441 - RNA, 17 nt, Molluscum contagiosum virus
accgcgacaugccucgc

SEQ ID NO: 4026442 - RNA, 19 nt, Molluscum contagiosum virus
accgcgcgcacgcggcgcu

SEQ ID NO: 4026443 - RNA, 14 nt, Molluscum contagiosum virus
accgcggcagccuu

SEQ ID NO: 4026444 - RNA, 14 nt, Molluscum contagiosum virus
accgcggcgcggag

SEQ ID NO: 4026445 - RNA, 12 nt, Molluscum contagiosum virus
accgcgggcacg

SEQ ID NO: 4026446 - RNA, 16 nt, Molluscum contagiosum virus
accgcgggcacgggca

SEQ ID NO: 4026447 - RNA, 14 nt, Molluscum contagiosum virus
accgcgggcgcaga

SEQ ID NO: 4026448 - RNA, 13 nt, Molluscum contagiosum virus
accgcgucaagau

SEQ ID NO: 4026449 - RNA, 20 nt, Molluscum contagiosum virus
accgcgucaagaucaaccgc

SEQ ID NO: 4026450 - RNA, 23 nt, Molluscum contagiosum virus
accgcguccgcuaccgcagccac

SEQ ID NO: 4026451 - RNA, 17 nt, Molluscum contagiosum virus
accgcguggacaacagc

SEQ ID NO: 4026452 - RNA, 21 nt, Molluscum contagiosum virus
accgcguugccgcccgccgag

SEQ ID NO: 4026453 - RNA, 19 nt, Molluscum contagiosum virus
accgcugcuucguaaagcu

SEQ ID NO: 4026454 - RNA, 22 nt, Molluscum contagiosum virus
accgcuggggcgugacucggcc

SEQ ID NO: 4026455 - RNA, 17 nt, Molluscum contagiosum virus
accggagacaccagcuc

SEQ ID NO: 4026456 - RNA, 22 nt, Molluscum contagiosum virus
accggcagcgcgauugcuggag

SEQ ID NO: 4026457 - RNA, 18 nt, Molluscum contagiosum virus
accgggagcauagcaaga

SEQ ID NO: 4026458 - RNA, 21 nt, Molluscum contagiosum virus
accgggguccgcuccuucuca

SEQ ID NO: 4026459 - RNA, 13 nt, Molluscum contagiosum virus
accgucaccgcag

SEQ ID NO: 4026460 - RNA, 18 nt, Molluscum contagiosum virus
accuacgaggugcugcgc

SEQ ID NO: 4026461 - RNA, 21 nt, Molluscum contagiosum virus
accucacucacaugugcugcc

SEQ ID NO: 4026462 - RNA, 21 nt, Molluscum contagiosum virus
accuccuucgcguaccaagcc

SEQ ID NO: 4026463 - RNA, 17 nt, Molluscum contagiosum virus
accucgcgcgccgccgc

SEQ ID NO: 4026464 - RNA, 21 nt, Molluscum contagiosum virus
accugauuuucccgggcggcg

SEQ ID NO: 4026465 - RNA, 19 nt, Molluscum contagiosum virus
accugcacgacccucuucg

SEQ ID NO: 4026466 - RNA, 16 nt, Molluscum contagiosum virus
accugcgacagcugcu

SEQ ID NO: 4026467 - RNA, 13 nt, Molluscum contagiosum virus
accugcugccgag

SEQ ID NO: 4026468 - RNA, 15 nt, Molluscum contagiosum virus
accugggcaggccgc

SEQ ID NO: 4026469 - RNA, 17 nt, Molluscum contagiosum virus
accugucggagcaggac

SEQ ID NO: 4026470 - RNA, 14 nt, Molluscum contagiosum virus
accuuccugggcgg

SEQ ID NO: 4026471 - RNA, 19 nt, Molluscum contagiosum virus
acgaacauguccaaggagc

SEQ ID NO: 4026472 - RNA, 17 nt, Molluscum contagiosum virus
acgaacgacagcgccgc

SEQ ID NO: 4026473 - RNA, 21 nt, Molluscum contagiosum virus
acgaacggacgccuuuugugc

SEQ ID NO: 4026474 - RNA, 17 nt, Molluscum contagiosum virus
acgaagacgaagcgcuc

SEQ ID NO: 4026475 - RNA, 20 nt, Molluscum contagiosum virus
acgacacgagggccuuggcg

SEQ ID NO: 4026476 - RNA, 13 nt, Molluscum contagiosum virus
acgacacuggcgc

SEQ ID NO: 4026477 - RNA, 20 nt, Molluscum contagiosum virus
acgacagcgccgccaccucg

SEQ ID NO: 4026478 - RNA, 22 nt, Molluscum contagiosum virus
acgaccgacccaucggagaagu

SEQ ID NO: 4026479 - RNA, 13 nt, Molluscum contagiosum virus
acgacggcacgcu

SEQ ID NO: 4026480 - RNA, 15 nt, Molluscum contagiosum virus
acgacggucacgcaa

SEQ ID NO: 4026481 - RNA, 15 nt, Molluscum contagiosum virus
acgacgugcugcugc

SEQ ID NO: 4026482 - RNA, 15 nt, Molluscum contagiosum virus
acgacuuccgcggcg

SEQ ID NO: 4026483 - RNA, 16 nt, Molluscum contagiosum virus
acgacuuccgcggcgu

SEQ ID NO: 4026484 - RNA, 18 nt, Molluscum contagiosum virus
acgagcacugccugccgc

SEQ ID NO: 4026485 - RNA, 15 nt, Molluscum contagiosum virus
acgagcagcugcugc

SEQ ID NO: 4026486 - RNA, 14 nt, Molluscum contagiosum virus
acgagcgcaucagc

SEQ ID NO: 4026487 - RNA, 15 nt, Molluscum contagiosum virus
cgcgcgaucgcggcc

SEQ ID NO: 4026488 - RNA, 14 nt, Molluscum contagiosum virus
cgcgcgcaccugca

SEQ ID NO: 4026489 - RNA, 18 nt, Molluscum contagiosum virus
cgcgcgcacgcgaacgcc

SEQ ID NO: 4026490 - RNA, 15 nt, Molluscum contagiosum virus
cgcgcgcagcaccgc

SEQ ID NO: 4026491 - RNA, 14 nt, Molluscum contagiosum virus
cgcgcgcaggcucg

SEQ ID NO: 4026492 - RNA, 16 nt, Molluscum contagiosum virus
cgcgcgccagcagcgc

SEQ ID NO: 4026493 - RNA, 13 nt, Molluscum contagiosum virus
cgcgcgccagcua

SEQ ID NO: 4026494 - RNA, 19 nt, Molluscum contagiosum virus
cgcgcgccgcagaacacgg

SEQ ID NO: 4026495 - RNA, 12 nt, Molluscum contagiosum virus
cgcgcgccgcgg

SEQ ID NO: 4026496 - RNA, 20 nt, Molluscum contagiosum virus
cgcgcgccgguagggugccg

SEQ ID NO: 4026497 - RNA, 17 nt, Molluscum contagiosum virus
cgcgcgccgugccuggc

SEQ ID NO: 4026498 - RNA, 13 nt, Molluscum contagiosum virus
cgcgcgccugcug

SEQ ID NO: 4026499 - RNA, 22 nt, Molluscum contagiosum virus
cgcgcgcgauguacaagcccgu

SEQ ID NO: 4026500 - RNA, 14 nt, Molluscum contagiosum virus
cgcgcgcgucgucg

SEQ ID NO: 4026501 - RNA, 14 nt, Molluscum contagiosum virus
cgcgcgcucacccu

SEQ ID NO: 4026502 - RNA, 17 nt, Molluscum contagiosum virus
cgcgcgcugcgcgccgc

SEQ ID NO: 4026503 - RNA, 18 nt, Molluscum contagiosum virus
cgcgcgcugcgcgcggac

SEQ ID NO: 4026504 - RNA, 14 nt, Molluscum contagiosum virus
cgcgcgcugcucug

SEQ ID NO: 4026505 - RNA, 18 nt, Molluscum contagiosum virus
cgcgcggcaagccuggcu

SEQ ID NO: 4026506 - RNA, 13 nt, Molluscum contagiosum virus
cgcgcggcagacg

SEQ ID NO: 4026507 - RNA, 13 nt, Molluscum contagiosum virus
cgcgcggcagcag

SEQ ID NO: 4026508 - RNA, 21 nt, Molluscum contagiosum virus
cgcgcggcuuggcgcccuucc

SEQ ID NO: 4026509 - RNA, 20 nt, Molluscum contagiosum virus
cgcgcggggcacugcgcacg

SEQ ID NO: 4026510 - RNA, 18 nt, Molluscum contagiosum virus
cgcgcggugcugcgccag

SEQ ID NO: 4026511 - RNA, 13 nt, Molluscum contagiosum virus
cgcgcgucacgga

SEQ ID NO: 4026512 - RNA, 18 nt, Molluscum contagiosum virus
cgcgcgucgagggcgccg

SEQ ID NO: 4026513 - RNA, 15 nt, Molluscum contagiosum virus
cgcgcgugagcacgg

SEQ ID NO: 4026514 - RNA, 13 nt, Molluscum contagiosum virus
cgcgcgugcaguu

SEQ ID NO: 4026515 - RNA, 16 nt, Molluscum contagiosum virus
cgcgcguugccugaga

SEQ ID NO: 4026516 - RNA, 23 nt, Molluscum contagiosum virus
cgcgcguugccugagaagcugua

SEQ ID NO: 4026517 - RNA, 14 nt, Molluscum contagiosum virus
cgcgcuacgcgccg

SEQ ID NO: 4026518 - RNA, 16 nt, Molluscum contagiosum virus
cgcgcuacgcgccgag

SEQ ID NO: 4026519 - RNA, 22 nt, Molluscum contagiosum virus
cgcgcuacugcgcgcacugcuc

SEQ ID NO: 4026520 - RNA, 17 nt, Molluscum contagiosum virus
cgcgcucacccugcacg

SEQ ID NO: 4026521 - RNA, 16 nt, Molluscum contagiosum virus
cgcgcucacugcagca

SEQ ID NO: 4026522 - RNA, 13 nt, Molluscum contagiosum virus
cgcgcucgcgcag

SEQ ID NO: 4026523 - RNA, 17 nt, Molluscum contagiosum virus
cgcgcucgcgugccgcg

SEQ ID NO: 4026524 - RNA, 20 nt, Molluscum contagiosum virus
cgcgcucgcgugccgcggac

SEQ ID NO: 4026525 - RNA, 15 nt, Molluscum contagiosum virus
cgcgcucgucaaugc

SEQ ID NO: 4026526 - RNA, 21 nt, Molluscum contagiosum virus
cgcgcucgucaaugcgcacgu

SEQ ID NO: 4026527 - RNA, 18 nt, Molluscum contagiosum virus
cgcgcucguccgccgcgu

SEQ ID NO: 4026528 - RNA, 19 nt, Molluscum contagiosum virus
cgaagcaugucaggccggu

SEQ ID NO: 4026529 - RNA, 20 nt, Molluscum contagiosum virus
cgaaggucaucaccagccug

SEQ ID NO: 4026530 - RNA, 23 nt, Molluscum contagiosum virus
cgaagguuuugugccgagcggca

SEQ ID NO: 4026531 - RNA, 13 nt, Molluscum contagiosum virus
cgacagcgacgag

SEQ ID NO: 4026532 - RNA, 14 nt, Molluscum contagiosum virus
cgacagcgccgcca

SEQ ID NO: 4026533 - RNA, 16 nt, Molluscum contagiosum virus
cgacagcgcgcgcacg

SEQ ID NO: 4026534 - RNA, 13 nt, Molluscum contagiosum virus
cgaccacgugcca

SEQ ID NO: 4026535 - RNA, 15 nt, Molluscum contagiosum virus
cgacccguaccccga

SEQ ID NO: 4026536 - RNA, 22 nt, Molluscum contagiosum virus
cgaccgcuuucgcaaacaagca

SEQ ID NO: 4026537 - RNA, 17 nt, Molluscum contagiosum virus
cgaccuacuccuggcca

SEQ ID NO: 4026538 - RNA, 19 nt, Molluscum contagiosum virus
cgaccucuuuccgcgcuuu

SEQ ID NO: 4026539 - RNA, 14 nt, Molluscum contagiosum virus
cgaccugcacgacc

SEQ ID NO: 4026540 - RNA, 12 nt, Molluscum contagiosum virus
cgaccugcugcg

SEQ ID NO: 4026541 - RNA, 17 nt, Molluscum contagiosum virus
cgacgacagcgacgaga

SEQ ID NO: 4026542 - RNA, 14 nt, Molluscum contagiosum virus
cgacgagcacgagc

SEQ ID NO: 4026543 - RNA, 14 nt, Molluscum contagiosum virus
cgacgaggugcgcg

SEQ ID NO: 4026544 - RNA, 16 nt, Molluscum contagiosum virus
cgacgagugcgccgcg

SEQ ID NO: 4026545 - RNA, 18 nt, Molluscum contagiosum virus
cgacgccccggcgcgaaa

SEQ ID NO: 4026546 - RNA, 19 nt, Molluscum contagiosum virus
cgacgcgagaaagaccuug

SEQ ID NO: 4026547 - RNA, 19 nt, Molluscum contagiosum virus
cgacgcguucuagcagcgu

SEQ ID NO: 4026548 - RNA, 17 nt, Molluscum contagiosum virus
cgacggcacgggcacgc

SEQ ID NO: 4026549 - RNA, 23 nt, Molluscum contagiosum virus
cgacggcgccucgagcgcgcugg

SEQ ID NO: 4026550 - RNA, 15 nt, Molluscum contagiosum virus
cgacgggcgcgcuuc

SEQ ID NO: 4026551 - RNA, 18 nt, Molluscum contagiosum virus
cgacgggcgcgcuucuca

SEQ ID NO: 4026552 - RNA, 20 nt, Molluscum contagiosum virus
cgacggugugccgcuggugg

SEQ ID NO: 4026553 - RNA, 16 nt, Molluscum contagiosum virus
cgacgguuuccgcgcc

SEQ ID NO: 4026554 - RNA, 17 nt, Molluscum contagiosum virus
cgacgugaucgcgcagg

SEQ ID NO: 4026555 - RNA, 15 nt, Molluscum contagiosum virus
cgacgugcgcgcugc

SEQ ID NO: 4026556 - RNA, 13 nt, Molluscum contagiosum virus
cgacgugcgcgug

SEQ ID NO: 4026557 - RNA, 14 nt, Molluscum contagiosum virus
cgacguggagccug

SEQ ID NO: 4026558 - RNA, 17 nt, Molluscum contagiosum virus
cgacucggugcucaugc

SEQ ID NO: 4026559 - RNA, 13 nt, Molluscum contagiosum virus
cgacugccagcca

SEQ ID NO: 4026560 - RNA, 20 nt, Molluscum contagiosum virus
cgacugcgccuucugccugc

SEQ ID NO: 4026561 - RNA, 18 nt, Molluscum contagiosum virus
cgacuugcugcggagcgc

SEQ ID NO: 4026562 - RNA, 20 nt, Molluscum contagiosum virus
cgacuugcugcggagcgccu

SEQ ID NO: 4026563 - RNA, 13 nt, Molluscum contagiosum virus
cgacuuuucgcgc

SEQ ID NO: 4026564 - RNA, 15 nt, Molluscum contagiosum virus
cgagaaaugcgcaca

SEQ ID NO: 4026565 - RNA, 15 nt, Molluscum contagiosum virus
cgagaacuggcgcag

SEQ ID NO: 4026566 - RNA, 15 nt, Molluscum contagiosum virus
cgagaagacggggcg

SEQ ID NO: 4026567 - RNA, 16 nt, Molluscum contagiosum virus
cgagaccagccgcgag

SEQ ID NO: 4026568 - RNA, 19 nt, Molluscum contagiosum virus
cgagaccuacgucaagcag

SEQ ID NO: 4026569 - RNA, 17 nt, Molluscum contagiosum virus
cgagaccuuccuccagg

SEQ ID NO: 4026570 - RNA, 13 nt, Molluscum contagiosum virus
cgagacgcugcug

SEQ ID NO: 4026571 - RNA, 21 nt, Molluscum contagiosum virus
cgagagaggagugaagggugu

SEQ ID NO: 4026572 - RNA, 13 nt, Molluscum contagiosum virus
cgagagcgcgcgc

SEQ ID NO: 4026573 - RNA, 21 nt, Molluscum contagiosum virus
cgagagcggagaaaaggaagc

SEQ ID NO: 4026574 - RNA, 12 nt, Molluscum contagiosum virus
cgagagcggcgu

SEQ ID NO: 4026575 - RNA, 15 nt, Molluscum contagiosum virus
cgagagcuacagcau

SEQ ID NO: 4026576 - RNA, 15 nt, Molluscum contagiosum virus
cgagauggagcucac

SEQ ID NO: 4026577 - RNA, 18 nt, Molluscum contagiosum virus
cgagauucguggcgagca

SEQ ID NO: 4026578 - RNA, 21 nt, Molluscum contagiosum virus
cgagauucguggcgagcaucu

SEQ ID NO: 4026579 - RNA, 14 nt, Molluscum contagiosum virus
cgagcaaggcgcgc

SEQ ID NO: 4026580 - RNA, 20 nt, Molluscum contagiosum virus
cgagcaccugucgcgcgagc

SEQ ID NO: 4026581 - RNA, 22 nt, Molluscum contagiosum virus
cgagcacggccgccaccgcgcg

SEQ ID NO: 4026582 - RNA, 19 nt, Molluscum contagiosum virus
cgagcacguggacagcauc

SEQ ID NO: 4026583 - RNA, 16 nt, Molluscum contagiosum virus
cgagcacguuccaaaa

SEQ ID NO: 4026584 - RNA, 13 nt, Molluscum contagiosum virus
cgagcagcugcug

SEQ ID NO: 4026585 - RNA, 19 nt, Molluscum contagiosum virus
cgagcagcugcugcgcacg

SEQ ID NO: 4026586 - RNA, 17 nt, Molluscum contagiosum virus
cgagcagcugcuucucu

SEQ ID NO: 4026587 - RNA, 16 nt, Molluscum contagiosum virus
cgagcaggcgcagcgc

SEQ ID NO: 4026588 - RNA, 15 nt, Molluscum contagiosum virus
cgagcaguccgccuc

SEQ ID NO: 4026589 - RNA, 22 nt, Molluscum contagiosum virus
cgagcaguccgccucgagcacg

SEQ ID NO: 4026590 - RNA, 13 nt, Molluscum contagiosum virus
cgagcauuccgag

SEQ ID NO: 4026591 - RNA, 23 nt, Molluscum contagiosum virus
cgagccaaggaugccugccagca

SEQ ID NO: 4026592 - RNA, 12 nt, Molluscum contagiosum virus
cgagccagccag

SEQ ID NO: 4026593 - RNA, 14 nt, Molluscum contagiosum virus
cgagcccgcggcgc

SEQ ID NO: 4026594 - RNA, 21 nt, Molluscum contagiosum virus
cgagcccuucuuuccggcgcg

SEQ ID NO: 4026595 - RNA, 17 nt, Molluscum contagiosum virus
cgagccgcgcgagcgcg

SEQ ID NO: 4026596 - RNA, 19 nt, Molluscum contagiosum virus
cgagcgacuacaccuggcg

SEQ ID NO: 4026597 - RNA, 13 nt, Molluscum contagiosum virus
cgagcgagcacgc

SEQ ID NO: 4026598 - RNA, 19 nt, Molluscum contagiosum virus
cgagcgcacgccgcucucg

SEQ ID NO: 4026599 - RNA, 13 nt, Molluscum contagiosum virus
cgagcgcaucagc

SEQ ID NO: 4026600 - RNA, 23 nt, Molluscum contagiosum virus
cgagcgcauucgcgcgcccccgc

SEQ ID NO: 4026601 - RNA, 13 nt, Molluscum contagiosum virus
cgagcgccacuag

SEQ ID NO: 4026602 - RNA, 17 nt, Molluscum contagiosum virus
cgagcgccgcgugcgcg

SEQ ID NO: 4026603 - RNA, 21 nt, Molluscum contagiosum virus
cgagcgcgagauucuggcgcg

SEQ ID NO: 4026604 - RNA, 17 nt, Molluscum contagiosum virus
cgagcgcgcgugcucgc

SEQ ID NO: 4026605 - RNA, 14 nt, Molluscum contagiosum virus
cgagcgcgggcgcg

SEQ ID NO: 4026606 - RNA, 14 nt, Molluscum contagiosum virus
cgagcggcgcgcgc

SEQ ID NO: 4026607 - RNA, 20 nt, Molluscum contagiosum virus
cgagcgggcaaugggcacgc

SEQ ID NO: 4026608 - RNA, 15 nt, Molluscum contagiosum virus
cgagcguugucuuga

SEQ ID NO: 4026609 - RNA, 17 nt, Molluscum contagiosum virus
cgagcucgcgcgccagc

SEQ ID NO: 4026610 - RNA, 22 nt, Molluscum contagiosum virus
cgagcucuuccccgcgggccgc

SEQ ID NO: 4026611 - RNA, 15 nt, Molluscum contagiosum virus
cgagcugcgggcgcg

SEQ ID NO: 4026612 - RNA, 16 nt, Molluscum contagiosum virus
cgagcugcugcgcgcc

SEQ ID NO: 4026613 - RNA, 23 nt, Molluscum contagiosum virus
cgaggaccggcgcaacgagcagc

SEQ ID NO: 4026614 - RNA, 20 nt, Molluscum contagiosum virus
caccagacaaagucgacgac

SEQ ID NO: 4026615 - RNA, 14 nt, Molluscum contagiosum virus
caccagcaccagca

SEQ ID NO: 4026616 - RNA, 14 nt, Molluscum contagiosum virus
caccagcugccgcu

SEQ ID NO: 4026617 - RNA, 22 nt, Molluscum contagiosum virus
caccagcuggacggugcuggug

SEQ ID NO: 4026618 - RNA, 11 nt, Molluscum contagiosum virus
caccaggaacg

SEQ ID NO: 4026619 - RNA, 14 nt, Molluscum contagiosum virus
caccccgcagcuca

SEQ ID NO: 4026620 - RNA, 16 nt, Molluscum contagiosum virus
caccccgcugggccgc

SEQ ID NO: 4026621 - RNA, 19 nt, Molluscum contagiosum virus
cacccgagggcgugcgcuu

SEQ ID NO: 4026622 - RNA, 15 nt, Molluscum contagiosum virus
cacccgcaacaagga

SEQ ID NO: 4026623 - RNA, 18 nt, Molluscum contagiosum virus
cacccgcaacaaggaaag

SEQ ID NO: 4026624 - RNA, 13 nt, Molluscum contagiosum virus
cacccgcaggaaa

SEQ ID NO: 4026625 - RNA, 19 nt, Molluscum contagiosum virus
caccgaggagccgcgcuuc

SEQ ID NO: 4026626 - RNA, 18 nt, Molluscum contagiosum virus
caccgcaugggcccuggc

SEQ ID NO: 4026627 - RNA, 17 nt, Molluscum contagiosum virus
caccgccgagauggagc

SEQ ID NO: 4026628 - RNA, 18 nt, Molluscum contagiosum virus
caccgcgacaugccucgc

SEQ ID NO: 4026629 - RNA, 23 nt, Molluscum contagiosum virus
caccgcgccgaaacacggccucc

SEQ ID NO: 4026630 - RNA, 18 nt, Molluscum contagiosum virus
caccgcggcgcggagcgc

SEQ ID NO: 4026631 - RNA, 21 nt, Molluscum contagiosum virus
caccgggauggucucgcugcu

SEQ ID NO: 4026632 - RNA, 20 nt, Molluscum contagiosum virus
caccgggguccgcuccuucu

SEQ ID NO: 4026633 - RNA, 22 nt, Molluscum contagiosum virus
caccguaccgcgcccgccagca

SEQ ID NO: 4026634 - RNA, 17 nt, Molluscum contagiosum virus
caccguugacgagcugg

SEQ ID NO: 4026635 - RNA, 17 nt, Molluscum contagiosum virus
caccguugccgcggcag

SEQ ID NO: 4026636 - RNA, 12 nt, Molluscum contagiosum virus
caccuccagguc

SEQ ID NO: 4026637 - RNA, 15 nt, Molluscum contagiosum virus
caccucgagcucguu

SEQ ID NO: 4026638 - RNA, 13 nt, Molluscum contagiosum virus
caccugcggcugc

SEQ ID NO: 4026639 - RNA, 18 nt, Molluscum contagiosum virus
caccuggcgagcgcucug

SEQ ID NO: 4026640 - RNA, 23 nt, Molluscum contagiosum virus
caccuuggcgcugcacaguucac

SEQ ID NO: 4026641 - RNA, 18 nt, Molluscum contagiosum virus
caccuuucauucgcuggu

SEQ ID NO: 4026642 - RNA, 17 nt, Molluscum contagiosum virus
cacgaagacuacggcac

SEQ ID NO: 4026643 - RNA, 20 nt, Molluscum contagiosum virus
cacgaagcggcggacagcaa

SEQ ID NO: 4026644 - RNA, 14 nt, Molluscum contagiosum virus
cacgaaucgcucgc

SEQ ID NO: 4026645 - RNA, 22 nt, Molluscum contagiosum virus
cacgacgcuuucguccgccgcu

SEQ ID NO: 4026646 - RNA, 21 nt, Molluscum contagiosum virus
cacgacggacuucuugcgcgg

SEQ ID NO: 4026647 - RNA, 21 nt, Molluscum contagiosum virus
cacgacguacgagugcuggag

SEQ ID NO: 4026648 - RNA, 13 nt, Molluscum contagiosum virus
cacgagacugagu

SEQ ID NO: 4026649 - RNA, 21 nt, Molluscum contagiosum virus
cacgagaugggcccgcgcgcg

SEQ ID NO: 4026650 - RNA, 14 nt, Molluscum contagiosum virus
cacgagcacugccu

SEQ ID NO: 4026651 - RNA, 18 nt, Molluscum contagiosum virus
cacgagcaguccgccucg

SEQ ID NO: 4026652 - RNA, 14 nt, Molluscum contagiosum virus
cacgagcgcggcaa

SEQ ID NO: 4026653 - RNA, 20 nt, Molluscum contagiosum virus
cacgagcugacgcagacgca

SEQ ID NO: 4026654 - RNA, 20 nt, Molluscum contagiosum virus
cacgaggcagccgcggcgcc

SEQ ID NO: 4026655 - RNA, 19 nt, Molluscum contagiosum virus
cacgaugugcgcgcgacgu

SEQ ID NO: 4026656 - RNA, 20 nt, Molluscum contagiosum virus
cacgcaacgucgcacuggcc

SEQ ID NO: 4026657 - RNA, 18 nt, Molluscum contagiosum virus
cacgcaagcccgcgcgcg

SEQ ID NO: 4026658 - RNA, 13 nt, Molluscum contagiosum virus
cacgcacgcgcgg

SEQ ID NO: 4026659 - RNA, 13 nt, Molluscum contagiosum virus
cacgcacgcgcuc

SEQ ID NO: 4026660 - RNA, 12 nt, Molluscum contagiosum virus
cacgcagagcca

SEQ ID NO: 4026661 - RNA, 18 nt, Molluscum contagiosum virus
cacgcaggacuggcaccu

SEQ ID NO: 4026662 - RNA, 19 nt, Molluscum contagiosum virus
cacgccaagcgcuugcucu

SEQ ID NO: 4026663 - RNA, 17 nt, Molluscum contagiosum virus
cacgcccgcaaugcagu

SEQ ID NO: 4026664 - RNA, 14 nt, Molluscum contagiosum virus
cacgcccgcgcugc

SEQ ID NO: 4026665 - RNA, 13 nt, Molluscum contagiosum virus
cacgcccgcgucc

SEQ ID NO: 4026666 - RNA, 22 nt, Molluscum contagiosum virus
cacgccgaccauuuccugcgag

SEQ ID NO: 4026667 - RNA, 22 nt, Molluscum contagiosum virus
cacgccgacuuccgacgggccg

SEQ ID NO: 4026668 - RNA, 12 nt, Molluscum contagiosum virus
cacgccgcagcg

SEQ ID NO: 4026669 - RNA, 13 nt, Molluscum contagiosum virus
cacgccgcucggc

SEQ ID NO: 4026670 - RNA, 22 nt, Molluscum contagiosum virus
cacgccuucguggagcccgugc

SEQ ID NO: 4026671 - RNA, 15 nt, Molluscum contagiosum virus
cacgcgagcaauggc

SEQ ID NO: 4026672 - RNA, 18 nt, Molluscum contagiosum virus
cacgcgagcacgccugca

SEQ ID NO: 4026673 - RNA, 14 nt, Molluscum contagiosum virus
cacgcgcaaggucu

SEQ ID NO: 4026674 - RNA, 18 nt, Molluscum contagiosum virus
cacgcgcacgcucucgcu

SEQ ID NO: 4026675 - RNA, 13 nt, Molluscum contagiosum virus
cacgcgcccgaag

SEQ ID NO: 4026676 - RNA, 15 nt, Molluscum contagiosum virus
cacgcgcgagcggag

SEQ ID NO: 4026677 - RNA, 20 nt, Molluscum contagiosum virus
cacgcgcgagcggagcgggc

SEQ ID NO: 4026678 - RNA, 13 nt, Molluscum contagiosum virus
cacgcgcgcgcag

SEQ ID NO: 4026679 - RNA, 14 nt, Molluscum contagiosum virus
cacgcgcgggcgca

SEQ ID NO: 4026680 - RNA, 11 nt, Molluscum contagiosum virus
cacgcgcuucg

SEQ ID NO: 4026681 - RNA, 21 nt, Molluscum contagiosum virus
cacgcgggacgcgugccuggc

SEQ ID NO: 4026682 - RNA, 21 nt, Molluscum contagiosum virus
cacgcgggcccaccgcgccag

SEQ ID NO: 4026683 - RNA, 14 nt, Molluscum contagiosum virus
cacgcgucgcgcag

SEQ ID NO: 4026684 - RNA, 16 nt, Molluscum contagiosum virus
cacgcgucgcgcgccg

SEQ ID NO: 4026685 - RNA, 15 nt, Molluscum contagiosum virus
cacgcgugcugcgcg

SEQ ID NO: 4026686 - RNA, 16 nt, Molluscum contagiosum virus
cacgcuacgcagcgcg

SEQ ID NO: 4026687 - RNA, 15 nt, Molluscum contagiosum virus
cacgcucgaggagga

SEQ ID NO: 4026688 - RNA, 23 nt, Molluscum contagiosum virus
cacgcucgcgacgugcgcgcugc

SEQ ID NO: 4026689 - RNA, 15 nt, Molluscum contagiosum virus
cacgcucucgcuggc

SEQ ID NO: 4026690 - RNA, 22 nt, Molluscum contagiosum virus
cacgcugcgcgugcugggcccc

SEQ ID NO: 4026691 - RNA, 14 nt, Molluscum contagiosum virus
cacgcugcgcucgg

SEQ ID NO: 4026692 - RNA, 22 nt, Molluscum contagiosum virus
cacgcugcugcgugcgcgcgau

SEQ ID NO: 4026693 - RNA, 14 nt, Molluscum contagiosum virus
cacggacaugguca

SEQ ID NO: 4026694 - RNA, 17 nt, Molluscum contagiosum virus
cacggacgagcccuucg

SEQ ID NO: 4026695 - RNA, 19 nt, Molluscum contagiosum virus
cacggacucgagccccaga

SEQ ID NO: 4026696 - RNA, 19 nt, Molluscum contagiosum virus
cacggacucgccgcgcgcc

SEQ ID NO: 4026697 - RNA, 15 nt, Molluscum contagiosum virus
cacggauacgcgcac

SEQ ID NO: 4026698 - RNA, 22 nt, Molluscum contagiosum virus
cacggccgacggcacgggcacg

SEQ ID NO: 4026699 - RNA, 20 nt, Molluscum contagiosum virus
ccgcgguguccuugcgccgc

SEQ ID NO: 4026700 - RNA, 14 nt, Molluscum contagiosum virus
ccgcguacacgugc

SEQ ID NO: 4026701 - RNA, 20 nt, Molluscum contagiosum virus
ccgcguacgcacgugccgug

SEQ ID NO: 4026702 - RNA, 21 nt, Molluscum contagiosum virus
ccgcguagcuagcucugcgcg

SEQ ID NO: 4026703 - RNA, 22 nt, Molluscum contagiosum virus
ccgcgucgcgcacgcgcgcuua

SEQ ID NO: 4026704 - RNA, 17 nt, Molluscum contagiosum virus
ccgcgugcaugcccagc

SEQ ID NO: 4026705 - RNA, 15 nt, Molluscum contagiosum virus
ccgcgugcgccgccg

SEQ ID NO: 4026706 - RNA, 18 nt, Molluscum contagiosum virus
ccgcgugcgugcacagcg

SEQ ID NO: 4026707 - RNA, 14 nt, Molluscum contagiosum virus
ccgcgugcucugcu

SEQ ID NO: 4026708 - RNA, 17 nt, Molluscum contagiosum virus
ccgcgugcucugcuccg

SEQ ID NO: 4026709 - RNA, 17 nt, Molluscum contagiosum virus
ccgcuccggucaccgcg

SEQ ID NO: 4026710 - RNA, 16 nt, Molluscum contagiosum virus
ccgcuccuggucuucc

SEQ ID NO: 4026711 - RNA, 18 nt, Molluscum contagiosum virus
ccgcucggcacugcuggc

SEQ ID NO: 4026712 - RNA, 22 nt, Molluscum contagiosum virus
ccgcucguccagcugcgcgagc

SEQ ID NO: 4026713 - RNA, 18 nt, Molluscum contagiosum virus
ccgcugagcgcagcacac

SEQ ID NO: 4026714 - RNA, 16 nt, Molluscum contagiosum virus
ccgcugcccgcgcacg

SEQ ID NO: 4026715 - RNA, 15 nt, Molluscum contagiosum virus
ccgcugccgcgcgcg

SEQ ID NO: 4026716 - RNA, 18 nt, Molluscum contagiosum virus
ccgcugccgucgcgcgcu

SEQ ID NO: 4026717 - RNA, 18 nt, Molluscum contagiosum virus
ccgcugcgcaucugcgag

SEQ ID NO: 4026718 - RNA, 16 nt, Molluscum contagiosum virus
ccgcugcgccggcugc

SEQ ID NO: 4026719 - RNA, 23 nt, Molluscum contagiosum virus
ccgcugcgcgcucuggagccucc

SEQ ID NO: 4026720 - RNA, 13 nt, Molluscum contagiosum virus
ccgcugcgcggag

SEQ ID NO: 4026721 - RNA, 15 nt, Molluscum contagiosum virus
ccgcugcgcggagcu

SEQ ID NO: 4026722 - RNA, 16 nt, Molluscum contagiosum virus
ccgcugcuccugcucu

SEQ ID NO: 4026723 - RNA, 12 nt, Molluscum contagiosum virus
ccgcugcuggaa

SEQ ID NO: 4026724 - RNA, 13 nt, Molluscum contagiosum virus
ccgcugcuggaac

SEQ ID NO: 4026725 - RNA, 16 nt, Molluscum contagiosum virus
ccgcuggacgccucgg

SEQ ID NO: 4026726 - RNA, 18 nt, Molluscum contagiosum virus
ccgcuggacgccucggga

SEQ ID NO: 4026727 - RNA, 23 nt, Molluscum contagiosum virus
ccgcuggggcggagagcuccggc

SEQ ID NO: 4026728 - RNA, 13 nt, Molluscum contagiosum virus
ccgcuuccuggca

SEQ ID NO: 4026729 - RNA, 12 nt, Molluscum contagiosum virus
ccggacagagcc

SEQ ID NO: 4026730 - RNA, 23 nt, Molluscum contagiosum virus
ccggaccagauccgggcgcugca

SEQ ID NO: 4026731 - RNA, 22 nt, Molluscum contagiosum virus
ccggacgauaaauggaccucaa

SEQ ID NO: 4026732 - RNA, 15 nt, Molluscum contagiosum virus
ccggacgcgcgaacu

SEQ ID NO: 4026733 - RNA, 16 nt, Molluscum contagiosum virus
ccggagacaccagcuc

SEQ ID NO: 4026734 - RNA, 19 nt, Molluscum contagiosum virus
ccggagacaccagcuccgc

SEQ ID NO: 4026735 - RNA, 17 nt, Molluscum contagiosum virus
ccggaggaaggacagug

SEQ ID NO: 4026736 - RNA, 21 nt, Molluscum contagiosum virus
ccggcacgugccccgcgcgug

SEQ ID NO: 4026737 - RNA, 19 nt, Molluscum contagiosum virus
ccggcaguagcagcgccgg

SEQ ID NO: 4026738 - RNA, 15 nt, Molluscum contagiosum virus
ccggccccgcgaacg

SEQ ID NO: 4026739 - RNA, 14 nt, Molluscum contagiosum virus
ccggccgaggcacg

SEQ ID NO: 4026740 - RNA, 17 nt, Molluscum contagiosum virus
ccggccuuguucgcgcu

SEQ ID NO: 4026741 - RNA, 16 nt, Molluscum contagiosum virus
ccggcgagaugcgagc

SEQ ID NO: 4026742 - RNA, 20 nt, Molluscum contagiosum virus
ccggcgcaacgagcagcccg

SEQ ID NO: 4026743 - RNA, 14 nt, Molluscum contagiosum virus
ccggcgcccgccac

SEQ ID NO: 4026744 - RNA, 20 nt, Molluscum contagiosum virus
ccggcgcgagaugcucgccg

SEQ ID NO: 4026745 - RNA, 22 nt, Molluscum contagiosum virus
ccggcgcgcgcgcgcaggcucg

SEQ ID NO: 4026746 - RNA, 15 nt, Molluscum contagiosum virus
ccggcgcggcgagcc

SEQ ID NO: 4026747 - RNA, 14 nt, Molluscum contagiosum virus
ccggcgcgugagcg

SEQ ID NO: 4026748 - RNA, 21 nt, Molluscum contagiosum virus
ccggcgcuugccccucguccg

SEQ ID NO: 4026749 - RNA, 14 nt, Molluscum contagiosum virus
ccggcggccucccu

SEQ ID NO: 4026750 - RNA, 15 nt, Molluscum contagiosum virus
ccggcggcgcaagca

SEQ ID NO: 4026751 - RNA, 15 nt, Molluscum contagiosum virus
ccggcgugagcucgu

SEQ ID NO: 4026752 - RNA, 16 nt, Molluscum contagiosum virus
ccggcgugagcucguc

SEQ ID NO: 4026753 - RNA, 22 nt, Molluscum contagiosum virus
ccggcguucacggacucgagcc

SEQ ID NO: 4026754 - RNA, 18 nt, Molluscum contagiosum virus
ccggcguuggcuuucugu

SEQ ID NO: 4026755 - RNA, 17 nt, Molluscum contagiosum virus
ccgggaaaaucaggucc

SEQ ID NO: 4026756 - RNA, 15 nt, Molluscum contagiosum virus
ccgggcccgggcccg

SEQ ID NO: 4026757 - RNA, 14 nt, Molluscum contagiosum virus
ccgggccugcggcg

SEQ ID NO: 4026758 - RNA, 18 nt, Molluscum contagiosum virus
ccgggcgccgcggcugcc

SEQ ID NO: 4026759 - RNA, 16 nt, Molluscum contagiosum virus
ccgggcucgggcucga

SEQ ID NO: 4026760 - RNA, 15 nt, Molluscum contagiosum virus
ccgggcuugcucccu

SEQ ID NO: 4026761 - RNA, 14 nt, Molluscum contagiosum virus
ccggugccagcucu

SEQ ID NO: 4026762 - RNA, 23 nt, Molluscum contagiosum virus
ccggugcugcggcgcgugccgcu

SEQ ID NO: 4026763 - RNA, 17 nt, Molluscum contagiosum virus
ccgguggaagagcccgc

SEQ ID NO: 4026764 - RNA, 13 nt, Molluscum contagiosum virus
ccggugucagccc

SEQ ID NO: 4026765 - RNA, 15 nt, Molluscum contagiosum virus
ccggugucagccccg

SEQ ID NO: 4026766 - RNA, 15 nt, Molluscum contagiosum virus
ccguacucgcguccg

SEQ ID NO: 4026767 - RNA, 17 nt, Molluscum contagiosum virus
ccguaggcgggccugcg

SEQ ID NO: 4026768 - RNA, 21 nt, Molluscum contagiosum virus
ccguaggcgggccugcgcccg

SEQ ID NO: 4026769 - RNA, 19 nt, Molluscum contagiosum virus
ccguccgccucgagcacgc

SEQ ID NO: 4026770 - RNA, 13 nt, Molluscum contagiosum virus
ccguccucgcucg

SEQ ID NO: 4026771 - RNA, 19 nt, Molluscum contagiosum virus
ccguccucgcucgugcucu

SEQ ID NO: 4026772 - RNA, 19 nt, Molluscum contagiosum virus
ccguccuugcucuggcucu

SEQ ID NO: 4026773 - RNA, 12 nt, Molluscum contagiosum virus
ccgucgcgagcu

SEQ ID NO: 4026774 - RNA, 14 nt, Molluscum contagiosum virus
ccgucgucgccgcc

SEQ ID NO: 4026775 - RNA, 13 nt, Molluscum contagiosum virus
ccgucugcugcuc

SEQ ID NO: 4026776 - RNA, 22 nt, Molluscum contagiosum virus
ccgugacagagugccuggcgcg

SEQ ID NO: 4026777 - RNA, 12 nt, Molluscum contagiosum virus
ccgugagcgcgc

SEQ ID NO: 4026778 - RNA, 18 nt, Molluscum contagiosum virus
ccgugcaguugagagcag

SEQ ID NO: 4026779 - RNA, 15 nt, Molluscum contagiosum virus
ccgugcccgagcccg

SEQ ID NO: 4026780 - RNA, 17 nt, Molluscum contagiosum virus
ccgugccgccggcgccg

SEQ ID NO: 4026781 - RNA, 15 nt, Molluscum contagiosum virus
ccgugcuugcgcacg

SEQ ID NO: 4026782 - RNA, 16 nt, Molluscum contagiosum virus
ccguggugcgcgaccu

SEQ ID NO: 4026783 - RNA, 20 nt, Molluscum contagiosum virus
ccguguaagcccgcuaugaa

SEQ ID NO: 4026784 - RNA, 14 nt, Molluscum contagiosum virus
ccguguaccgccgc

SEQ ID NO: 4026785 - RNA, 18 nt, Molluscum contagiosum virus
ccguguaccgccgcggcc

SEQ ID NO: 4026786 - RNA, 22 nt, Molluscum contagiosum virus
ccguguauccaagaggccguca

SEQ ID NO: 4026787 - RNA, 18 nt, Molluscum contagiosum virus
ccguguccgguacugcug

SEQ ID NO: 4026788 - RNA, 22 nt, Molluscum contagiosum virus
ccguuccacuacaagcagccgc

SEQ ID NO: 4026789 - RNA, 16 nt, Molluscum contagiosum virus
ccuacagcgcgcugca

SEQ ID NO: 4026790 - RNA, 16 nt, Molluscum contagiosum virus
cacggccgcgcgcgac

SEQ ID NO: 4026791 - RNA, 15 nt, Molluscum contagiosum virus
cacggccuucgcgcu

SEQ ID NO: 4026792 - RNA, 22 nt, Molluscum contagiosum virus
cacggccuucgcgcugcccgcg

SEQ ID NO: 4026793 - RNA, 17 nt, Molluscum contagiosum virus
cacggcggacgcgccua

SEQ ID NO: 4026794 - RNA, 12 nt, Molluscum contagiosum virus
cacggcucugcg

SEQ ID NO: 4026795 - RNA, 22 nt, Molluscum contagiosum virus
cacgggcaugcacagcugcucg

SEQ ID NO: 4026796 - RNA, 17 nt, Molluscum contagiosum virus
cacgggcgggacagaca

SEQ ID NO: 4026797 - RNA, 15 nt, Molluscum contagiosum virus
cacgguagagcugcg

SEQ ID NO: 4026798 - RNA, 17 nt, Molluscum contagiosum virus
cacgguccugggcgacg

SEQ ID NO: 4026799 - RNA, 22 nt, Molluscum contagiosum virus
cacguacuugcugguugccgcu

SEQ ID NO: 4026800 - RNA, 19 nt, Molluscum contagiosum virus
cacguaggggacgcgcggu

SEQ ID NO: 4026801 - RNA, 18 nt, Molluscum contagiosum virus
cacguccucaagcgcccu

SEQ ID NO: 4026802 - RNA, 21 nt, Molluscum contagiosum virus
cacgucgacaaguccaccuuc

SEQ ID NO: 4026803 - RNA, 16 nt, Molluscum contagiosum virus
cacgugcacgcgcacg

SEQ ID NO: 4026804 - RNA, 20 nt, Molluscum contagiosum virus
cacgugccagagucgccgcu

SEQ ID NO: 4026805 - RNA, 21 nt, Molluscum contagiosum virus
cacgugccccgcgcgugcagu

SEQ ID NO: 4026806 - RNA, 14 nt, Molluscum contagiosum virus
cacgugcucgcggu

SEQ ID NO: 4026807 - RNA, 14 nt, Molluscum contagiosum virus
cacgugcugcagcu

SEQ ID NO: 4026808 - RNA, 12 nt, Molluscum contagiosum virus
cacgugcugcug

SEQ ID NO: 4026809 - RNA, 17 nt, Molluscum contagiosum virus
cacgugcugcugcggcu

SEQ ID NO: 4026810 - RNA, 17 nt, Molluscum contagiosum virus
cacguggagucacgacc

SEQ ID NO: 4026811 - RNA, 21 nt, Molluscum contagiosum virus
cacguggagucacgaccgacc

SEQ ID NO: 4026812 - RNA, 14 nt, Molluscum contagiosum virus
cacgugguccacca

SEQ ID NO: 4026813 - RNA, 16 nt, Molluscum contagiosum virus
cacguugccgcgcgcu

SEQ ID NO: 4026814 - RNA, 12 nt, Molluscum contagiosum virus
cacuagcgcagg

SEQ ID NO: 4026815 - RNA, 17 nt, Molluscum contagiosum virus
cacucacaugugcugcc

SEQ ID NO: 4026816 - RNA, 19 nt, Molluscum contagiosum virus
cacucgauggacgccagcu

SEQ ID NO: 4026817 - RNA, 20 nt, Molluscum contagiosum virus
cacucgcgaacuacgagcgc

SEQ ID NO: 4026818 - RNA, 22 nt, Molluscum contagiosum virus
cacucgcgaacuacgagcgcac

SEQ ID NO: 4026819 - RNA, 19 nt, Molluscum contagiosum virus
cacucgcucucucagggug

SEQ ID NO: 4026820 - RNA, 20 nt, Molluscum contagiosum virus
cacucguggcaacaacauga

SEQ ID NO: 4026821 - RNA, 14 nt, Molluscum contagiosum virus
cacucucgcgcgug

SEQ ID NO: 4026822 - RNA, 13 nt, Molluscum contagiosum virus
cacugcagcagcc

SEQ ID NO: 4026823 - RNA, 18 nt, Molluscum contagiosum virus
cacugccacggcugcaag

SEQ ID NO: 4026824 - RNA, 13 nt, Molluscum contagiosum virus
cacugccugccgc

SEQ ID NO: 4026825 - RNA, 17 nt, Molluscum contagiosum virus
cacugccugccgccucg

SEQ ID NO: 4026826 - RNA, 18 nt, Molluscum contagiosum virus
cacugcggcaacgagcac

SEQ ID NO: 4026827 - RNA, 15 nt, Molluscum contagiosum virus
cacugugccagcagc

SEQ ID NO: 4026828 - RNA, 16 nt, Molluscum contagiosum virus
cacugugccagcagca

SEQ ID NO: 4026829 - RNA, 12 nt, Molluscum contagiosum virus
cacugugcuggc

SEQ ID NO: 4026830 - RNA, 13 nt, Molluscum contagiosum virus
cacugugcuggcg

SEQ ID NO: 4026831 - RNA, 18 nt, Molluscum contagiosum virus
cacuuccgugagcagucc

SEQ ID NO: 4026832 - RNA, 16 nt, Molluscum contagiosum virus
cacuugccgggcgacg

SEQ ID NO: 4026833 - RNA, 19 nt, Molluscum contagiosum virus
cacuugccgggcgacggcg

SEQ ID NO: 4026834 - RNA, 16 nt, Molluscum contagiosum virus
cagaaaacgcacuguc

SEQ ID NO: 4026835 - RNA, 14 nt, Molluscum contagiosum virus
cagaacguggucaa

SEQ ID NO: 4026836 - RNA, 15 nt, Molluscum contagiosum virus
cagaaucgcuuugcc

SEQ ID NO: 4026837 - RNA, 15 nt, Molluscum contagiosum virus
cagacaacaccagcg

SEQ ID NO: 4026838 - RNA, 19 nt, Molluscum contagiosum virus
cagacaacaccagcgugcc

SEQ ID NO: 4026839 - RNA, 22 nt, Molluscum contagiosum virus
cagacaugucguaccugguggc

SEQ ID NO: 4026840 - RNA, 12 nt, Molluscum contagiosum virus
cagaccaagaag

SEQ ID NO: 4026841 - RNA, 18 nt, Molluscum contagiosum virus
cagacccgaaagcugccc

SEQ ID NO: 4026842 - RNA, 16 nt, Molluscum contagiosum virus
cagacgcagagccaug

SEQ ID NO: 4026843 - RNA, 13 nt, Molluscum contagiosum virus
cagacgcgcgucc

SEQ ID NO: 4026844 - RNA, 23 nt, Molluscum contagiosum virus
cagacgcgcguccgcaggcguca

SEQ ID NO: 4026845 - RNA, 21 nt, Molluscum contagiosum virus
cagagaaaggcacccaccagg

SEQ ID NO: 4026846 - RNA, 21 nt, Molluscum contagiosum virus
cagagaaaucccaagagccau

SEQ ID NO: 4026847 - RNA, 22 nt, Molluscum contagiosum virus
cagagaccgucaaccugcugcc

SEQ ID NO: 4026848 - RNA, 16 nt, Molluscum contagiosum virus
cagagauccgcccgcg

SEQ ID NO: 4026849 - RNA, 14 nt, Molluscum contagiosum virus
cagagcaaggcgag

SEQ ID NO: 4026850 - RNA, 20 nt, Molluscum contagiosum virus
cagagcauuagcagcgagga

SEQ ID NO: 4026851 - RNA, 18 nt, Molluscum contagiosum virus
cagagcccgggagagugg

SEQ ID NO: 4026852 - RNA, 13 nt, Molluscum contagiosum virus
cagagccugcugc

SEQ ID NO: 4026853 - RNA, 16 nt, Molluscum contagiosum virus
cagagccugcugcucu

SEQ ID NO: 4026854 - RNA, 22 nt, Molluscum contagiosum virus
cagauaguuuggacgagcugcu

SEQ ID NO: 4026855 - RNA, 23 nt, Molluscum contagiosum virus
cagauaguuuggacgagcugcuu

SEQ ID NO: 4026856 - RNA, 14 nt, Molluscum contagiosum virus
cagaucgcgagagg

SEQ ID NO: 4026857 - RNA, 20 nt, Molluscum contagiosum virus
cagaucgcgagaggagacgg

SEQ ID NO: 4026858 - RNA, 19 nt, Molluscum contagiosum virus
cagcaaacugugcuccuga

SEQ ID NO: 4026859 - RNA, 23 nt, Molluscum contagiosum virus
cagcaaacugugcuccugaggaa

SEQ ID NO: 4026860 - RNA, 17 nt, Molluscum contagiosum virus
cagcaacugcacaggga

SEQ ID NO: 4026861 - RNA, 17 nt, Molluscum contagiosum virus
cagcacaggccccagca

SEQ ID NO: 4026862 - RNA, 19 nt, Molluscum contagiosum virus
cagcacaugcaggccgaga

SEQ ID NO: 4026863 - RNA, 13 nt, Molluscum contagiosum virus
cagcaccagguag

SEQ ID NO: 4026864 - RNA, 16 nt, Molluscum contagiosum virus
cagcaccgcgccgcga

SEQ ID NO: 4026865 - RNA, 16 nt, Molluscum contagiosum virus
cagcacgggcggaagc

SEQ ID NO: 4026866 - RNA, 12 nt, Molluscum contagiosum virus
cagcacugcgcc

SEQ ID NO: 4026867 - RNA, 12 nt, Molluscum contagiosum virus
cagcagccaggc

SEQ ID NO: 4026868 - RNA, 17 nt, Molluscum contagiosum virus
cagcagccaggcuaggc

SEQ ID NO: 4026869 - RNA, 19 nt, Molluscum contagiosum virus
cagcagccccgacgccagc

SEQ ID NO: 4026870 - RNA, 14 nt, Molluscum contagiosum virus
cagcagccgcagcc

SEQ ID NO: 4026871 - RNA, 23 nt, Molluscum contagiosum virus
cagcagccgcagcccacgugcca

SEQ ID NO: 4026872 - RNA, 22 nt, Molluscum contagiosum virus
cagcagccucguucacggcuag

SEQ ID NO: 4026873 - RNA, 14 nt, Molluscum contagiosum virus
cagcagcgagacca

SEQ ID NO: 4026874 - RNA, 14 nt, Molluscum contagiosum virus
cagcagcgccagcu

SEQ ID NO: 4026875 - RNA, 15 nt, Molluscum contagiosum virus
cagcagcgccagcuu

SEQ ID NO: 4026876 - RNA, 21 nt, Molluscum contagiosum virus
cagcagcgcgacuagccugug

SEQ ID NO: 4026877 - RNA, 17 nt, Molluscum contagiosum virus
cagcagcggcgcgugcu

SEQ ID NO: 4026878 - RNA, 16 nt, Molluscum contagiosum virus
cagcagcuccugguag

SEQ ID NO: 4026879 - RNA, 21 nt, Molluscum contagiosum virus
cagcaggagcacgccuggcgg

SEQ ID NO: 4026880 - RNA, 20 nt, Molluscum contagiosum virus
cagcaggugcacgugcugca

SEQ ID NO: 4026881 - RNA, 20 nt, Molluscum contagiosum virus
cagcagucaguuccgcggcg

SEQ ID NO: 4026882 - RNA, 15 nt, Molluscum contagiosum virus
cagcaguccgccguc

SEQ ID NO: 4026883 - RNA, 22 nt, Molluscum contagiosum virus
cagcauccuggaguuuaaugac

SEQ ID NO: 4026884 - RNA, 16 nt, Molluscum contagiosum virus
cagcaucgggcugucg

SEQ ID NO: 4026885 - RNA, 14 nt, Molluscum contagiosum virus
cagcaugcgugcaa

SEQ ID NO: 4026886 - RNA, 22 nt, Molluscum contagiosum virus
cagccacggccgcgcugguggc

SEQ ID NO: 4026887 - RNA, 15 nt, Molluscum contagiosum virus
cagccaggcgccggc

SEQ ID NO: 4026888 - RNA, 18 nt, Molluscum contagiosum virus
cagccaugaggacagcuu

SEQ ID NO: 4026889 - RNA, 13 nt, Molluscum contagiosum virus
cagccaugugucu

SEQ ID NO: 4026890 - RNA, 12 nt, Molluscum contagiosum virus
cagcccacgcug

SEQ ID NO: 4026891 - RNA, 14 nt, Molluscum contagiosum virus
cagcccccucuugg

SEQ ID NO: 4026892 - RNA, 21 nt, Molluscum contagiosum virus
cagcccgacuucucgcgcgac

SEQ ID NO: 4026893 - RNA, 14 nt, Molluscum contagiosum virus
cagcccugugcccg

SEQ ID NO: 4026894 - RNA, 12 nt, Molluscum contagiosum virus
agcguggagcug

SEQ ID NO: 4026895 - RNA, 20 nt, Molluscum contagiosum virus
agcgugguguucgccggcau

SEQ ID NO: 4026896 - RNA, 19 nt, Molluscum contagiosum virus
agcgugucagcagcgcgag

SEQ ID NO: 4026897 - RNA, 16 nt, Molluscum contagiosum virus
agcguuucugccggag

SEQ ID NO: 4026898 - RNA, 15 nt, Molluscum contagiosum virus
agcuaaaagagcugc

SEQ ID NO: 4026899 - RNA, 15 nt, Molluscum contagiosum virus
agcuagacuggagca

SEQ ID NO: 4026900 - RNA, 12 nt, Molluscum contagiosum virus
agcuagcucugc

SEQ ID NO: 4026901 - RNA, 13 nt, Molluscum contagiosum virus
agcucagcaggcu

SEQ ID NO: 4026902 - RNA, 12 nt, Molluscum contagiosum virus
agcucagccucu

SEQ ID NO: 4026903 - RNA, 22 nt, Molluscum contagiosum virus
agcuccagcauagaacacagcu

SEQ ID NO: 4026904 - RNA, 21 nt, Molluscum contagiosum virus
agcuccgcgacgaacucgaca

SEQ ID NO: 4026905 - RNA, 14 nt, Molluscum contagiosum virus
agcuccggcugcuc

SEQ ID NO: 4026906 - RNA, 17 nt, Molluscum contagiosum virus
agcucgccaaagcgcgc

SEQ ID NO: 4026907 - RNA, 22 nt, Molluscum contagiosum virus
agcucgccaaagcgcgccuucc

SEQ ID NO: 4026908 - RNA, 18 nt, Molluscum contagiosum virus
agcucgccaugugcgaag

SEQ ID NO: 4026909 - RNA, 22 nt, Molluscum contagiosum virus
agcucgugccugucggcacauc

SEQ ID NO: 4026910 - RNA, 20 nt, Molluscum contagiosum virus
agcucugcgcaaccuggauu

SEQ ID NO: 4026911 - RNA, 14 nt, Molluscum contagiosum virus
agcucuucgacagc

SEQ ID NO: 4026912 - RNA, 16 nt, Molluscum contagiosum virus
agcucuucguggccaa

SEQ ID NO: 4026913 - RNA, 16 nt, Molluscum contagiosum virus
agcugcaaacauugcc

SEQ ID NO: 4026914 - RNA, 16 nt, Molluscum contagiosum virus
agcugcaccggcgcga

SEQ ID NO: 4026915 - RNA, 14 nt, Molluscum contagiosum virus
agcugcacgugcag

SEQ ID NO: 4026916 - RNA, 15 nt, Molluscum contagiosum virus
agcugcagagcgugc

SEQ ID NO: 4026917 - RNA, 20 nt, Molluscum contagiosum virus
agcugcagagcgugcugguc

SEQ ID NO: 4026918 - RNA, 18 nt, Molluscum contagiosum virus
agcugcaggaccugcugg

SEQ ID NO: 4026919 - RNA, 14 nt, Molluscum contagiosum virus
agcugcgccugcag

SEQ ID NO: 4026920 - RNA, 23 nt, Molluscum contagiosum virus
agcugcucaucggcgagcucuuu

SEQ ID NO: 4026921 - RNA, 14 nt, Molluscum contagiosum virus
agcugcugcgcgag

SEQ ID NO: 4026922 - RNA, 13 nt, Molluscum contagiosum virus
agcugcugcgcua

SEQ ID NO: 4026923 - RNA, 22 nt, Molluscum contagiosum virus
agcugggcucggaguccgcgcc

SEQ ID NO: 4026924 - RNA, 17 nt, Molluscum contagiosum virus
agcugguagagaacgac

SEQ ID NO: 4026925 - RNA, 21 nt, Molluscum contagiosum virus
agcuguagcaggaucggagcg

SEQ ID NO: 4026926 - RNA, 17 nt, Molluscum contagiosum virus
agcugucgcgcagcagc

SEQ ID NO: 4026927 - RNA, 15 nt, Molluscum contagiosum virus
agcugugcaagagcu

SEQ ID NO: 4026928 - RNA, 13 nt, Molluscum contagiosum virus
agcugugccgcag

SEQ ID NO: 4026929 - RNA, 18 nt, Molluscum contagiosum virus
agcuucaucaagcacggc

SEQ ID NO: 4026930 - RNA, 15 nt, Molluscum contagiosum virus
agcuucgcgagcccg

SEQ ID NO: 4026931 - RNA, 12 nt, Molluscum contagiosum virus
agcuuucagagu

SEQ ID NO: 4026932 - RNA, 23 nt, Molluscum contagiosum virus
agcuuugugcgaccugcugcgag

SEQ ID NO: 4026933 - RNA, 13 nt, Molluscum contagiosum virus
aggaaacgcagca

SEQ ID NO: 4026934 - RNA, 15 nt, Molluscum contagiosum virus
aggaaaggcacccac

SEQ ID NO: 4026935 - RNA, 22 nt, Molluscum contagiosum virus
aggaaaggccccccgcaacaag

SEQ ID NO: 4026936 - RNA, 13 nt, Molluscum contagiosum virus
aggaacaaggcca

SEQ ID NO: 4026937 - RNA, 20 nt, Molluscum contagiosum virus
aggaacucuacgacaugcuc

SEQ ID NO: 4026938 - RNA, 22 nt, Molluscum contagiosum virus
aggaacugcccgcgucgcgcac

SEQ ID NO: 4026939 - RNA, 16 nt, Molluscum contagiosum virus
aggacacgcgcacgcg

SEQ ID NO: 4026940 - RNA, 21 nt, Molluscum contagiosum virus
aggacgacgacacagcccugg

SEQ ID NO: 4026941 - RNA, 14 nt, Molluscum contagiosum virus
aggacuaccagcuc

SEQ ID NO: 4026942 - RNA, 19 nt, Molluscum contagiosum virus
aggagagagagacaugcac

SEQ ID NO: 4026943 - RNA, 17 nt, Molluscum contagiosum virus
aggagagcggcgccccu

SEQ ID NO: 4026944 - RNA, 21 nt, Molluscum contagiosum virus
aggagauggaacugcagcagc

SEQ ID NO: 4026945 - RNA, 12 nt, Molluscum contagiosum virus
aggagcccuugc

SEQ ID NO: 4026946 - RNA, 19 nt, Molluscum contagiosum virus
aggagcuccgugcugcggc

SEQ ID NO: 4026947 - RNA, 23 nt, Molluscum contagiosum virus
aggaguccgugacagagugccug

SEQ ID NO: 4026948 - RNA, 14 nt, Molluscum contagiosum virus
aggauacgcccgcg

SEQ ID NO: 4026949 - RNA, 21 nt, Molluscum contagiosum virus
aggaucggagcgcagcugccg

SEQ ID NO: 4026950 - RNA, 18 nt, Molluscum contagiosum virus
aggcaaagccugcugcgc

SEQ ID NO: 4026951 - RNA, 14 nt, Molluscum contagiosum virus
aggcaaagcggggc

SEQ ID NO: 4026952 - RNA, 22 nt, Molluscum contagiosum virus
aggcacccaccaggaacaggga

SEQ ID NO: 4026953 - RNA, 19 nt, Molluscum contagiosum virus
aggcaccccgaaaggcacc

SEQ ID NO: 4026954 - RNA, 12 nt, Molluscum contagiosum virus
aggcaccugcag

SEQ ID NO: 4026955 - RNA, 22 nt, Molluscum contagiosum virus
aggcaccugcaggaaaggcacc

SEQ ID NO: 4026956 - RNA, 15 nt, Molluscum contagiosum virus
aggcacgaggcagcc

SEQ ID NO: 4026957 - RNA, 20 nt, Molluscum contagiosum virus
aggcagccgcggcgcccggu

SEQ ID NO: 4026958 - RNA, 13 nt, Molluscum contagiosum virus
aggcaggagccuc

SEQ ID NO: 4026959 - RNA, 21 nt, Molluscum contagiosum virus
aggcaggccccgcaccagugc

SEQ ID NO: 4026960 - RNA, 15 nt, Molluscum contagiosum virus
aggcagugcuugagc

SEQ ID NO: 4026961 - RNA, 14 nt, Molluscum contagiosum virus
aggccagcacaagc

SEQ ID NO: 4026962 - RNA, 13 nt, Molluscum contagiosum virus
aggccauggagcg

SEQ ID NO: 4026963 - RNA, 19 nt, Molluscum contagiosum virus
aggccgagaugagcggcgc

SEQ ID NO: 4026964 - RNA, 17 nt, Molluscum contagiosum virus
aggccgcgcccaagaag

SEQ ID NO: 4026965 - RNA, 17 nt, Molluscum contagiosum virus
aggccuacgugcugcgc

SEQ ID NO: 4026966 - RNA, 16 nt, Molluscum contagiosum virus
aggccuccuucccuga

SEQ ID NO: 4026967 - RNA, 22 nt, Molluscum contagiosum virus
aggccuggccuucuaccacagg

SEQ ID NO: 4026968 - RNA, 17 nt, Molluscum contagiosum virus
aggccuucgcgcccgac

SEQ ID NO: 4026969 - RNA, 15 nt, Molluscum contagiosum virus
aggcgcagcgcggcc

SEQ ID NO: 4026970 - RNA, 24 nt, Molluscum contagiosum virus
aggcgcgccauggcgagcuagugc

SEQ ID NO: 4026971 - RNA, 20 nt, Molluscum contagiosum virus
aggcgcgcucuacgagacuc

SEQ ID NO: 4026972 - RNA, 18 nt, Molluscum contagiosum virus
aggcgcggcagccgcaga

SEQ ID NO: 4026973 - RNA, 22 nt, Molluscum contagiosum virus
aggcgcggucgcccgccgagcu

SEQ ID NO: 4026974 - RNA, 18 nt, Molluscum contagiosum virus
aggcgcuugggcacugcu

SEQ ID NO: 4026975 - RNA, 13 nt, Molluscum contagiosum virus
aggcggccguguc

SEQ ID NO: 4026976 - RNA, 16 nt, Molluscum contagiosum virus
aggcguccugcgggag

SEQ ID NO: 4026977 - RNA, 14 nt, Molluscum contagiosum virus
aggcucgagcgcgc

SEQ ID NO: 4026978 - RNA, 21 nt, Molluscum contagiosum virus
aggcucgagcgcgcgccugcu

SEQ ID NO: 4026979 - RNA, 19 nt, Molluscum contagiosum virus
aggcuucgaggugcgcgag

SEQ ID NO: 4026980 - RNA, 13 nt, Molluscum contagiosum virus
agggcagccucaa

SEQ ID NO: 4026981 - RNA, 15 nt, Molluscum contagiosum virus
agggcgcgcgucgag

SEQ ID NO: 4026982 - RNA, 23 nt, Molluscum contagiosum virus
agggcguccguaagucgaagagg

SEQ ID NO: 4026983 - RNA, 16 nt, Molluscum contagiosum virus
aggggcaagcucgcgc

SEQ ID NO: 4026984 - RNA, 14 nt, Molluscum contagiosum virus
agggguccgcgucu

SEQ ID NO: 4026985 - RNA, 15 nt, Molluscum contagiosum virus
agggucacgcgcaca

SEQ ID NO: 4026986 - RNA, 16 nt, Molluscum contagiosum virus
agggugccgaggcgcu

SEQ ID NO: 4026987 - RNA, 13 nt, Molluscum contagiosum virus
aggguggcuugcu

SEQ ID NO: 4026988 - RNA, 13 nt, Molluscum contagiosum virus
aggguguggccua

SEQ ID NO: 4026989 - RNA, 20 nt, Molluscum contagiosum virus
agguagugguccaccagcug

SEQ ID NO: 4026990 - RNA, 16 nt, Molluscum contagiosum virus
aggucacgacgagcga

SEQ ID NO: 4026991 - RNA, 16 nt, Molluscum contagiosum virus
aggucaucaccagccu

SEQ ID NO: 4026992 - RNA, 22 nt, Molluscum contagiosum virus
aggucaucaccagccugcucac

SEQ ID NO: 4026993 - RNA, 18 nt, Molluscum contagiosum virus
aggucgagcgcgccgcgc

SEQ ID NO: 4026994 - RNA, 16 nt, Molluscum contagiosum virus
aggucuuccacaugcc

SEQ ID NO: 4026995 - RNA, 15 nt, Molluscum contagiosum virus
aggugcugcgccacg

SEQ ID NO: 4026996 - RNA, 13 nt, Molluscum contagiosum virus
aggugcugggcga

SEQ ID NO: 4026997 - RNA, 16 nt, Molluscum contagiosum virus
agguggcacccuggcu

SEQ ID NO: 4026998 - RNA, 16 nt, Molluscum contagiosum virus
gaugcucaagcacugc

SEQ ID NO: 4026999 - RNA, 21 nt, Molluscum contagiosum virus
gaugcuggacgggcacgagca

SEQ ID NO: 4027000 - RNA, 17 nt, Molluscum contagiosum virus
gauggaaggcgaccagc

SEQ ID NO: 4027001 - RNA, 16 nt, Molluscum contagiosum virus
gauggacgccagcuug

SEQ ID NO: 4027002 - RNA, 22 nt, Molluscum contagiosum virus
gauggaggcccaggccauggag

SEQ ID NO: 4027003 - RNA, 23 nt, Molluscum contagiosum virus
gauggcaagucucgcuuccggga

SEQ ID NO: 4027004 - RNA, 14 nt, Molluscum contagiosum virus
gauggcgcagcucc

SEQ ID NO: 4027005 - RNA, 23 nt, Molluscum contagiosum virus
gauggcgccugcuucgcgccgcc

SEQ ID NO: 4027006 - RNA, 16 nt, Molluscum contagiosum virus
gaugggcuccagguuc

SEQ ID NO: 4027007 - RNA, 19 nt, Molluscum contagiosum virus
gauggucacgcgcaaggcc

SEQ ID NO: 4027008 - RNA, 17 nt, Molluscum contagiosum virus
gauggucucgcugcugg

SEQ ID NO: 4027009 - RNA, 15 nt, Molluscum contagiosum virus
gaugugacaacaugu

SEQ ID NO: 4027010 - RNA, 18 nt, Molluscum contagiosum virus
gauuacaucgaaaccauc

SEQ ID NO: 4027011 - RNA, 19 nt, Molluscum contagiosum virus
gcaaacauguagcgcgcgc

SEQ ID NO: 4027012 - RNA, 15 nt, Molluscum contagiosum virus
gcaaacgcacgcgcg

SEQ ID NO: 4027013 - RNA, 18 nt, Molluscum contagiosum virus
gcaaagacggacccgcga

SEQ ID NO: 4027014 - RNA, 19 nt, Molluscum contagiosum virus
gcaaaugccgagcgcacgc

SEQ ID NO: 4027015 - RNA, 20 nt, Molluscum contagiosum virus
gcaaauuccguccccucucc

SEQ ID NO: 4027016 - RNA, 14 nt, Molluscum contagiosum virus
gcaaccagcuggcg

SEQ ID NO: 4027017 - RNA, 11 nt, Molluscum contagiosum virus
gcaaccccgcg

SEQ ID NO: 4027018 - RNA, 16 nt, Molluscum contagiosum virus
gcaaccccgcgcugcg

SEQ ID NO: 4027019 - RNA, 21 nt, Molluscum contagiosum virus
gcaaccucacucacaugugcu

SEQ ID NO: 4027020 - RNA, 22 nt, Molluscum contagiosum virus
gcaacgcaaacgcacgcgcgcg

SEQ ID NO: 4027021 - RNA, 15 nt, Molluscum contagiosum virus
gcaacgucgcacugg

SEQ ID NO: 4027022 - RNA, 22 nt, Molluscum contagiosum virus
gcaacguugcgcguucagcgca

SEQ ID NO: 4027023 - RNA, 14 nt, Molluscum contagiosum virus
gcaacucgcgcugc

SEQ ID NO: 4027024 - RNA, 21 nt, Molluscum contagiosum virus
gcaagaccaucaucgcgcugc

SEQ ID NO: 4027025 - RNA, 20 nt, Molluscum contagiosum virus
gcaagagccgccggggccca

SEQ ID NO: 4027026 - RNA, 19 nt, Molluscum contagiosum virus
gcaagauucuucgcgaagg

SEQ ID NO: 4027027 - RNA, 13 nt, Molluscum contagiosum virus
gcaagcauggucu

SEQ ID NO: 4027028 - RNA, 14 nt, Molluscum contagiosum virus
gcaagcgcccgcga

SEQ ID NO: 4027029 - RNA, 14 nt, Molluscum contagiosum virus
gcaagcgcgcucgg

SEQ ID NO: 4027030 - RNA, 22 nt, Molluscum contagiosum virus
gcaagcgcuacuugcuggcgcg

SEQ ID NO: 4027031 - RNA, 14 nt, Molluscum contagiosum virus
gcaagcguacgcgu

SEQ ID NO: 4027032 - RNA, 16 nt, Molluscum contagiosum virus
gcaagcuucgggccgc

SEQ ID NO: 4027033 - RNA, 24 nt, Molluscum contagiosum virus
gcaagcuucgggccgcugccgucg

SEQ ID NO: 4027034 - RNA, 14 nt, Molluscum contagiosum virus
gcaaggaagcaaca

SEQ ID NO: 4027035 - RNA, 16 nt, Molluscum contagiosum virus
gcaagugcacaccaga

SEQ ID NO: 4027036 - RNA, 16 nt, Molluscum contagiosum virus
cuaccgcgcgcgcaag

SEQ ID NO: 4027037 - RNA, 14 nt, Molluscum contagiosum virus
cuaccgcgcgggag

SEQ ID NO: 4027038 - RNA, 16 nt, Molluscum contagiosum virus
cuaccugaagcuggac

SEQ ID NO: 4027039 - RNA, 17 nt, Molluscum contagiosum virus
cuacgagacucuggaag

SEQ ID NO: 4027040 - RNA, 12 nt, Molluscum contagiosum virus
cuacgaggugcu

SEQ ID NO: 4027041 - RNA, 19 nt, Molluscum contagiosum virus
cuacgaggugcugcgccac

SEQ ID NO: 4027042 - RNA, 16 nt, Molluscum contagiosum virus
cuacgaguucugcauc

SEQ ID NO: 4027043 - RNA, 21 nt, Molluscum contagiosum virus
cuacggcgugcugugccugcg

SEQ ID NO: 4027044 - RNA, 15 nt, Molluscum contagiosum virus
cuacgucaagcaggc

SEQ ID NO: 4027045 - RNA, 12 nt, Molluscum contagiosum virus
cuacgucuccuc

SEQ ID NO: 4027046 - RNA, 15 nt, Molluscum contagiosum virus
cuacguuccgcgcgg

SEQ ID NO: 4027047 - RNA, 13 nt, Molluscum contagiosum virus
cuacuccuggcca

SEQ ID NO: 4027048 - RNA, 23 nt, Molluscum contagiosum virus
cuacuggccgcgauucugcucuu

SEQ ID NO: 4027049 - RNA, 19 nt, Molluscum contagiosum virus
cuacuucgaggccggcaag

SEQ ID NO: 4027050 - RNA, 13 nt, Molluscum contagiosum virus
cuagcacgggcgg

SEQ ID NO: 4027051 - RNA, 14 nt, Molluscum contagiosum virus
cuagccgccgcugc

SEQ ID NO: 4027052 - RNA, 16 nt, Molluscum contagiosum virus
cuagccgugcgcgcac

SEQ ID NO: 4027053 - RNA, 15 nt, Molluscum contagiosum virus
cuagcgcuggcugca

SEQ ID NO: 4027054 - RNA, 22 nt, Molluscum contagiosum virus
cuagcugugcgcuacguggcgc

SEQ ID NO: 4027055 - RNA, 22 nt, Molluscum contagiosum virus
cuaggacuagcauuccuucaca

SEQ ID NO: 4027056 - RNA, 12 nt, Molluscum contagiosum virus
cuaggcgcggcg

SEQ ID NO: 4027057 - RNA, 22 nt, Molluscum contagiosum virus
cuaugagcggcacgggaaggcu

SEQ ID NO: 4027058 - RNA, 15 nt, Molluscum contagiosum virus
cuaugcccagccuga

SEQ ID NO: 4027059 - RNA, 19 nt, Molluscum contagiosum virus
cuauguucuucgcagagga

SEQ ID NO: 4027060 - RNA, 18 nt, Molluscum contagiosum virus
cucaacgcgauggcgcag

SEQ ID NO: 4027061 - RNA, 19 nt, Molluscum contagiosum virus
cucaacgugggcaccugca

SEQ ID NO: 4027062 - RNA, 16 nt, Molluscum contagiosum virus
cucaagcaccugcgcu

SEQ ID NO: 4027063 - RNA, 15 nt, Molluscum contagiosum virus
cucaagcacugccuc

SEQ ID NO: 4027064 - RNA, 16 nt, Molluscum contagiosum virus
cucaagcacugccuca

SEQ ID NO: 4027065 - RNA, 14 nt, Molluscum contagiosum virus
cucaagcuggcaac

SEQ ID NO: 4027066 - RNA, 16 nt, Molluscum contagiosum virus
cucacaccuagagcac

SEQ ID NO: 4027067 - RNA, 16 nt, Molluscum contagiosum virus
cucacaugugcugccg

SEQ ID NO: 4027068 - RNA, 13 nt, Molluscum contagiosum virus
cucaccgcgcaca

SEQ ID NO: 4027069 - RNA, 17 nt, Molluscum contagiosum virus
cucacgcccucucgagg

SEQ ID NO: 4027070 - RNA, 16 nt, Molluscum contagiosum virus
cucacgcgcuaccgca

SEQ ID NO: 4027071 - RNA, 12 nt, Molluscum contagiosum virus
cucacgcuguuu

SEQ ID NO: 4027072 - RNA, 20 nt, Molluscum contagiosum virus
cucacggcgagcgcgcccuu

SEQ ID NO: 4027073 - RNA, 19 nt, Molluscum contagiosum virus
cucagccucuacuccacua

SEQ ID NO: 4027074 - RNA, 17 nt, Molluscum contagiosum virus
cagcaggaugcuggugu

SEQ ID NO: 4027075 - RNA, 22 nt, Molluscum contagiosum virus
cagcaggcacgacgccgacacc

SEQ ID NO: 4027076 - RNA, 23 nt, Molluscum contagiosum virus
cagcaggcacuccagcgcgcccu

SEQ ID NO: 4027077 - RNA, 22 nt, Molluscum contagiosum virus
cagcaggugcacgugcugcagc

SEQ ID NO: 4027078 - RNA, 21 nt, Molluscum contagiosum virus
cagcagguucgugcgcaugaa

SEQ ID NO: 4027079 - RNA, 17 nt, Molluscum contagiosum virus
cagcagugccagcagcc

SEQ ID NO: 4027080 - RNA, 16 nt, Molluscum contagiosum virus
cagcauguugcucuac

SEQ ID NO: 4027081 - RNA, 20 nt, Molluscum contagiosum virus
cagcauuagcgccaaggcgc

SEQ ID NO: 4027082 - RNA, 17 nt, Molluscum contagiosum virus
cagcauucccggcgcgc

SEQ ID NO: 4027083 - RNA, 18 nt, Molluscum contagiosum virus
cagccaucgugcgcgacu

SEQ ID NO: 4027084 - RNA, 14 nt, Molluscum contagiosum virus
cagccaugaggaca

SEQ ID NO: 4027085 - RNA, 20 nt, Molluscum contagiosum virus
cagccccgcgccagcagucc

SEQ ID NO: 4027086 - RNA, 13 nt, Molluscum contagiosum virus
cagccccugcugc

SEQ ID NO: 4027087 - RNA, 14 nt, Molluscum contagiosum virus
cagcccgcggugcg

SEQ ID NO: 4027088 - RNA, 18 nt, Molluscum contagiosum virus
cagccgagcgccgccagc

SEQ ID NO: 4027089 - RNA, 15 nt, Molluscum contagiosum virus
cagccgcacggcgcc

SEQ ID NO: 4027090 - RNA, 20 nt, Molluscum contagiosum virus
cagccgcacggcgcccagga

SEQ ID NO: 4027091 - RNA, 20 nt, Molluscum contagiosum virus
cagccgcaguaccaguaccu

SEQ ID NO: 4027092 - RNA, 14 nt, Molluscum contagiosum virus
cagccgcgagcgcg

SEQ ID NO: 4027093 - RNA, 13 nt, Molluscum contagiosum virus
cagccgcugcgcc

SEQ ID NO: 4027094 - RNA, 21 nt, Molluscum contagiosum virus
cagccgcugcgccgccagcgu

SEQ ID NO: 4027095 - RNA, 20 nt, Molluscum contagiosum virus
cagccgucgccgcgcccgcg

SEQ ID NO: 4027096 - RNA, 20 nt, Molluscum contagiosum virus
cagccgugagcucccgcgcc

SEQ ID NO: 4027097 - RNA, 15 nt, Molluscum contagiosum virus
cagccguggagucca

SEQ ID NO: 4027098 - RNA, 17 nt, Molluscum contagiosum virus
cagccugacggcagcaa

SEQ ID NO: 4027099 - RNA, 19 nt, Molluscum contagiosum virus
cagccugcucacgcccgag

SEQ ID NO: 4027100 - RNA, 16 nt, Molluscum contagiosum virus
cagccugcuggcaccg

SEQ ID NO: 4027101 - RNA, 18 nt, Molluscum contagiosum virus
cagccugcuggcaccgcg

SEQ ID NO: 4027102 - RNA, 20 nt, Molluscum contagiosum virus
cagcgacgagcagcugcuuc

SEQ ID NO: 4027103 - RNA, 16 nt, Molluscum contagiosum virus
cagcgccagccugcug

SEQ ID NO: 4027104 - RNA, 15 nt, Molluscum contagiosum virus
cagcgccugcuugcg

SEQ ID NO: 4027105 - RNA, 16 nt, Molluscum contagiosum virus
cagcgcgaaccauuuu

SEQ ID NO: 4027106 - RNA, 14 nt, Molluscum contagiosum virus
cagcgcgcagaagc

SEQ ID NO: 4027107 - RNA, 21 nt, Molluscum contagiosum virus
cagcgcgcggagaucgccgcg

SEQ ID NO: 4027108 - RNA, 12 nt, Molluscum contagiosum virus
cagcgcgcggcg

SEQ ID NO: 4027109 - RNA, 22 nt, Molluscum contagiosum virus
cagcgcuugcgcgccaacuccu

SEQ ID NO: 4027110 - RNA, 21 nt, Molluscum contagiosum virus
cagcggacguggucgcgcgcg

SEQ ID NO: 4027111 - RNA, 23 nt, Molluscum contagiosum virus
cagcggacguggucgcgcgcgcu

SEQ ID NO: 4027112 - RNA, 15 nt, Molluscum contagiosum virus
cagcggaugcagaac

SEQ ID NO: 4027113 - RNA, 19 nt, Molluscum contagiosum virus
cagcggcaaaggcccgcga

SEQ ID NO: 4027114 - RNA, 18 nt, Molluscum contagiosum virus
cagcggcugcccgcggag

SEQ ID NO: 4027115 - RNA, 20 nt, Molluscum contagiosum virus
cagcgguggucuccgcgggc

SEQ ID NO: 4027116 - RNA, 24 nt, Molluscum contagiosum virus
cagcguagcggacgaagcugugca

SEQ ID NO: 4027117 - RNA, 16 nt, Molluscum contagiosum virus
cagcgugguguucgcc

SEQ ID NO: 4027118 - RNA, 23 nt, Molluscum contagiosum virus
cagcguguugcuguuccacauca

SEQ ID NO: 4027119 - RNA, 14 nt, Molluscum contagiosum virus
cagcguuccaggaa

SEQ ID NO: 4027120 - RNA, 16 nt, Molluscum contagiosum virus
cagcuacugcgugcga

SEQ ID NO: 4027121 - RNA, 19 nt, Molluscum contagiosum virus
cagcuaggauccugcucaa

SEQ ID NO: 4027122 - RNA, 18 nt, Molluscum contagiosum virus
cagcucaagacgcugcug

SEQ ID NO: 4027123 - RNA, 15 nt, Molluscum contagiosum virus
cagcucaagcugcuc

SEQ ID NO: 4027124 - RNA, 21 nt, Molluscum contagiosum virus
cagcucacgagauggcugcuc

SEQ ID NO: 4027125 - RNA, 20 nt, Molluscum contagiosum virus
cagcucauagcccaugcgca

SEQ ID NO: 4027126 - RNA, 17 nt, Molluscum contagiosum virus
cagcuccagcauggcgc

SEQ ID NO: 4027127 - RNA, 14 nt, Molluscum contagiosum virus
cagcuccgccggga

SEQ ID NO: 4027128 - RNA, 19 nt, Molluscum contagiosum virus
cagcuccuagcgcgcgugu

SEQ ID NO: 4027129 - RNA, 18 nt, Molluscum contagiosum virus
cagcucgcgccgccgcgc

SEQ ID NO: 4027130 - RNA, 20 nt, Molluscum contagiosum virus
cagcucggcgagagcgcgca

SEQ ID NO: 4027131 - RNA, 21 nt, Molluscum contagiosum virus
cagcucggcgagagcgcgcag

SEQ ID NO: 4027132 - RNA, 22 nt, Molluscum contagiosum virus
cagcucggguuccagcuccggc

SEQ ID NO: 4027133 - RNA, 23 nt, Molluscum contagiosum virus
cagcugcaggaccugcugguggu

SEQ ID NO: 4027134 - RNA, 16 nt, Molluscum contagiosum virus
cagcuggcgcgcgccg

SEQ ID NO: 4027135 - RNA, 13 nt, Molluscum contagiosum virus
cagcuguuucugc

SEQ ID NO: 4027136 - RNA, 23 nt, Molluscum contagiosum virus
cagcuugguaaugagcagcacgc

SEQ ID NO: 4027137 - RNA, 18 nt, Molluscum contagiosum virus
caggaaaggcacccgcaa

SEQ ID NO: 4027138 - RNA, 13 nt, Molluscum contagiosum virus
caggaacagggaa

SEQ ID NO: 4027139 - RNA, 15 nt, Molluscum contagiosum virus
caggaacaucugcaa

SEQ ID NO: 4027140 - RNA, 17 nt, Molluscum contagiosum virus
caggaagcuggcgcggu

SEQ ID NO: 4027141 - RNA, 17 nt, Molluscum contagiosum virus
caggaccgucaccgcag

SEQ ID NO: 4027142 - RNA, 14 nt, Molluscum contagiosum virus
caggaccugcuggu

SEQ ID NO: 4027143 - RNA, 18 nt, Molluscum contagiosum virus
caggaccuuaacgccguc

SEQ ID NO: 4027144 - RNA, 14 nt, Molluscum contagiosum virus
caggacuggcaccu

SEQ ID NO: 4027145 - RNA, 18 nt, Molluscum contagiosum virus
caggaguccgugacagag

SEQ ID NO: 4027146 - RNA, 15 nt, Molluscum contagiosum virus
caggaugcugguguc

SEQ ID NO: 4027147 - RNA, 19 nt, Molluscum contagiosum virus
caggcaagaggggagccag

SEQ ID NO: 4027148 - RNA, 19 nt, Molluscum contagiosum virus
caggcacuccagcgcgccc

SEQ ID NO: 4027149 - RNA, 17 nt, Molluscum contagiosum virus
caggcacuggcccugcu

SEQ ID NO: 4027150 - RNA, 17 nt, Molluscum contagiosum virus
caggcauggcauggcgc

SEQ ID NO: 4027151 - RNA, 13 nt, Molluscum contagiosum virus
caggccgcggcag

SEQ ID NO: 4027152 - RNA, 14 nt, Molluscum contagiosum virus
caggccgcggcagc

SEQ ID NO: 4027153 - RNA, 19 nt, Molluscum contagiosum virus
caggcgauaggacaugacu

SEQ ID NO: 4027154 - RNA, 17 nt, Molluscum contagiosum virus
caggcgcgcaagugcgu

SEQ ID NO: 4027155 - RNA, 22 nt, Molluscum contagiosum virus
caggcggucuuccagcacugcg

SEQ ID NO: 4027156 - RNA, 19 nt, Molluscum contagiosum virus
caggcggugggcgccgcgg

SEQ ID NO: 4027157 - RNA, 22 nt, Molluscum contagiosum virus
caggcggugggcgccgcggccu

SEQ ID NO: 4027158 - RNA, 20 nt, Molluscum contagiosum virus
caggcucuaagcgcacgcgc

SEQ ID NO: 4027159 - RNA, 15 nt, Molluscum contagiosum virus
cagggaaagagcacg

SEQ ID NO: 4027160 - RNA, 20 nt, Molluscum contagiosum virus
cagggaaaugcgggaggcuc

SEQ ID NO: 4027161 - RNA, 18 nt, Molluscum contagiosum virus
cagggagcugcggacgcg

SEQ ID NO: 4027162 - RNA, 22 nt, Molluscum contagiosum virus
cagggcacgaucgcgagacccc

SEQ ID NO: 4027163 - RNA, 20 nt, Molluscum contagiosum virus
cagguagcgcgccgcaaagc

SEQ ID NO: 4027164 - RNA, 23 nt, Molluscum contagiosum virus
caggucaacuccgagcgcgcgcg

SEQ ID NO: 4027165 - RNA, 16 nt, Molluscum contagiosum virus
caggucuucaacgagg

SEQ ID NO: 4027166 - RNA, 17 nt, Molluscum contagiosum virus
cagguggccgcgcgcgc

SEQ ID NO: 4027167 - RNA, 17 nt, Molluscum contagiosum virus
caguaaauagccaugcu

SEQ ID NO: 4027168 - RNA, 20 nt, Molluscum contagiosum virus
caguaccgugucaaacugcu

SEQ ID NO: 4027169 - RNA, 12 nt, Molluscum contagiosum virus
cagucagcggcg

SEQ ID NO: 4027170 - RNA, 13 nt, Molluscum contagiosum virus
cagucccagcacc

SEQ ID NO: 4027171 - RNA, 15 nt, Molluscum contagiosum virus
caguccgagcuguuc

SEQ ID NO: 4027172 - RNA, 18 nt, Molluscum contagiosum virus
cagucgcaguacccgagc

SEQ ID NO: 4027173 - RNA, 17 nt, Molluscum contagiosum virus
cagucucgcgcuuccag

SEQ ID NO: 4027174 - RNA, 14 nt, Molluscum contagiosum virus
cagugccgcucgcu

SEQ ID NO: 4027175 - RNA, 16 nt, Molluscum contagiosum virus
cagugccgcucgcugu

SEQ ID NO: 4027176 - RNA, 21 nt, Molluscum contagiosum virus
cccgcgaaggagagagagaca

SEQ ID NO: 4027177 - RNA, 21 nt, Molluscum contagiosum virus
cccgcgcaagagccgccgggg

SEQ ID NO: 4027178 - RNA, 14 nt, Molluscum contagiosum virus
cccgcgcacgagcu

SEQ ID NO: 4027179 - RNA, 19 nt, Molluscum contagiosum virus
cccgcgcgcgagcuggagc

SEQ ID NO: 4027180 - RNA, 15 nt, Molluscum contagiosum virus
cccgcgcgcgugccg

SEQ ID NO: 4027181 - RNA, 18 nt, Molluscum contagiosum virus
cccgcgcggcucgcgcac

SEQ ID NO: 4027182 - RNA, 16 nt, Molluscum contagiosum virus
cccgcgcucgccgcac

SEQ ID NO: 4027183 - RNA, 17 nt, Molluscum contagiosum virus
cccgcggaagugcgagc

SEQ ID NO: 4027184 - RNA, 18 nt, Molluscum contagiosum virus
cccgcggaagugcgagcc

SEQ ID NO: 4027185 - RNA, 20 nt, Molluscum contagiosum virus
cccgcggagaccaccgcugg

SEQ ID NO: 4027186 - RNA, 13 nt, Molluscum contagiosum virus
cccgcggcgcacg

SEQ ID NO: 4027187 - RNA, 21 nt, Molluscum contagiosum virus
cccgcggcgcgcagcucgccg

SEQ ID NO: 4027188 - RNA, 17 nt, Molluscum contagiosum virus
cccgcggcgugcccguc

SEQ ID NO: 4027189 - RNA, 20 nt, Molluscum contagiosum virus
cccgcggcuaccacgggccc

SEQ ID NO: 4027190 - RNA, 23 nt, Molluscum contagiosum virus
cccgcguccgugcgcagggcaau

SEQ ID NO: 4027191 - RNA, 16 nt, Molluscum contagiosum virus
cccgcgucgcgcgccg

SEQ ID NO: 4027192 - RNA, 17 nt, Molluscum contagiosum virus
cccggcacgugccccgc

SEQ ID NO: 4027193 - RNA, 22 nt, Molluscum contagiosum virus
cccggcgaacaccccgagcugg

SEQ ID NO: 4027194 - RNA, 21 nt, Molluscum contagiosum virus
cccgugccgccggcgccgcua

SEQ ID NO: 4027195 - RNA, 22 nt, Molluscum contagiosum virus
cccguggccgagccgcuggccg

SEQ ID NO: 4027196 - RNA, 14 nt, Molluscum contagiosum virus
cccguggcgcgccg

SEQ ID NO: 4027197 - RNA, 20 nt, Molluscum contagiosum virus
cccguggcgcgccggcgcgg

SEQ ID NO: 4027198 - RNA, 12 nt, Molluscum contagiosum virus
cccguguacaac

SEQ ID NO: 4027199 - RNA, 16 nt, Molluscum contagiosum virus
cccgugugcgggcacg

SEQ ID NO: 4027200 - RNA, 17 nt, Molluscum contagiosum virus
cccguguucgcggagcu

SEQ ID NO: 4027201 - RNA, 12 nt, Molluscum contagiosum virus
cccguugcugcg

SEQ ID NO: 4027202 - RNA, 15 nt, Molluscum contagiosum virus
cccuaagggcccgcu

SEQ ID NO: 4027203 - RNA, 20 nt, Molluscum contagiosum virus
cccucacaccuagagcacga

SEQ ID NO: 4027204 - RNA, 15 nt, Molluscum contagiosum virus
cccucaggggcucuc

SEQ ID NO: 4027205 - RNA, 18 nt, Molluscum contagiosum virus
cccuccagguccuccagc

SEQ ID NO: 4027206 - RNA, 22 nt, Molluscum contagiosum virus
cccucuaaauggccgcgccgcg

SEQ ID NO: 4027207 - RNA, 22 nt, Molluscum contagiosum virus
cccugauguuccgcgugagagc

SEQ ID NO: 4027208 - RNA, 20 nt, Molluscum contagiosum virus
cccugcuugcccgcgccgca

SEQ ID NO: 4027209 - RNA, 22 nt, Molluscum contagiosum virus
cccuggagcgcagucccagcac

SEQ ID NO: 4027210 - RNA, 16 nt, Molluscum contagiosum virus
cccuggcugcugcgcg

SEQ ID NO: 4027211 - RNA, 20 nt, Molluscum contagiosum virus
cccuuccgaguucuggccgc

SEQ ID NO: 4027212 - RNA, 20 nt, Molluscum contagiosum virus
cccuucuuuccggcgcggcc

SEQ ID NO: 4027213 - RNA, 16 nt, Molluscum contagiosum virus
ccgaagaagaaaagac

SEQ ID NO: 4027214 - RNA, 17 nt, Molluscum contagiosum virus
ccgaagcaaaagcgcuc

SEQ ID NO: 4027215 - RNA, 16 nt, Molluscum contagiosum virus
ccgaagucuaggcagc

SEQ ID NO: 4027216 - RNA, 17 nt, Molluscum contagiosum virus
ccgacacguugcacugc

SEQ ID NO: 4027217 - RNA, 22 nt, Molluscum contagiosum virus
ccgacaucgugccgaagagcgu

SEQ ID NO: 4027218 - RNA, 18 nt, Molluscum contagiosum virus
ccgacgccagcgcgccca

SEQ ID NO: 4027219 - RNA, 16 nt, Molluscum contagiosum virus
ccgacgccgccaaugc

SEQ ID NO: 4027220 - RNA, 16 nt, Molluscum contagiosum virus
ccgacugccgccgccg

SEQ ID NO: 4027221 - RNA, 21 nt, Molluscum contagiosum virus
ccgagcaacucgcgagagaca

SEQ ID NO: 4027222 - RNA, 14 nt, Molluscum contagiosum virus
ccgagcaagcgggc

SEQ ID NO: 4027223 - RNA, 15 nt, Molluscum contagiosum virus
ccgagcccgcccccg

SEQ ID NO: 4027224 - RNA, 18 nt, Molluscum contagiosum virus
ccgagcccgggcccgugc

SEQ ID NO: 4027225 - RNA, 13 nt, Molluscum contagiosum virus
ccgagcggggacg

SEQ ID NO: 4027226 - RNA, 20 nt, Molluscum contagiosum virus
ccgagcgugaccagugcgug

SEQ ID NO: 4027227 - RNA, 13 nt, Molluscum contagiosum virus
ccgagcuguucaa

SEQ ID NO: 4027228 - RNA, 21 nt, Molluscum contagiosum virus
ccgaggacgagccccgcgccg

SEQ ID NO: 4027229 - RNA, 20 nt, Molluscum contagiosum virus
ccgaggacuuccgcgcgcuc

SEQ ID NO: 4027230 - RNA, 18 nt, Molluscum contagiosum virus
ccgaggagagcggcgccc

SEQ ID NO: 4027231 - RNA, 12 nt, Molluscum contagiosum virus
ccgaggaggcgc

SEQ ID NO: 4027232 - RNA, 22 nt, Molluscum contagiosum virus
ccgagguggcacccuggcugcu

SEQ ID NO: 4027233 - RNA, 23 nt, Molluscum contagiosum virus
ccgagguggcacccuggcugcug

SEQ ID NO: 4027234 - RNA, 18 nt, Molluscum contagiosum virus
ccgaguauucgcccauca

SEQ ID NO: 4027235 - RNA, 12 nt, Molluscum contagiosum virus
ccgauguccugc

SEQ ID NO: 4027236 - RNA, 14 nt, Molluscum contagiosum virus
ccgauguccugcgg

SEQ ID NO: 4027237 - RNA, 19 nt, Molluscum contagiosum virus
ccgaugugagcaagcugca

SEQ ID NO: 4027238 - RNA, 14 nt, Molluscum contagiosum virus
ccgcaaccagcugc

SEQ ID NO: 4027239 - RNA, 13 nt, Molluscum contagiosum virus
ccgcaacgagguc

SEQ ID NO: 4027240 - RNA, 18 nt, Molluscum contagiosum virus
ccgcaagaagcgaaacac

SEQ ID NO: 4027241 - RNA, 21 nt, Molluscum contagiosum virus
ccgcaaggaaaacugcauccu

SEQ ID NO: 4027242 - RNA, 19 nt, Molluscum contagiosum virus
ccgcaauuacgugcgcgag

SEQ ID NO: 4027243 - RNA, 17 nt, Molluscum contagiosum virus
ccgcaccagugccgacg

SEQ ID NO: 4027244 - RNA, 17 nt, Molluscum contagiosum virus
ccgcacggcgcccagga

SEQ ID NO: 4027245 - RNA, 15 nt, Molluscum contagiosum virus
ccgcagcaagcagcc

SEQ ID NO: 4027246 - RNA, 17 nt, Molluscum contagiosum virus
ccgcagcaagcagccgc

SEQ ID NO: 4027247 - RNA, 23 nt, Molluscum contagiosum virus
ccgcagcacgcgugugcgagcac

SEQ ID NO: 4027248 - RNA, 13 nt, Molluscum contagiosum virus
ccgcagccacggc

SEQ ID NO: 4027249 - RNA, 16 nt, Molluscum contagiosum virus
ccgcagcccacgugcc

SEQ ID NO: 4027250 - RNA, 16 nt, Molluscum contagiosum virus
ccgcagcccgagcgcg

SEQ ID NO: 4027251 - RNA, 22 nt, Molluscum contagiosum virus
ccgcagcccgagcgcgcgugcg

SEQ ID NO: 4027252 - RNA, 18 nt, Molluscum contagiosum virus
ccgcagccggagcuugcg

SEQ ID NO: 4027253 - RNA, 17 nt, Molluscum contagiosum virus
ccgcaggaaaggcaccc

SEQ ID NO: 4027254 - RNA, 16 nt, Molluscum contagiosum virus
ccgcaggcgcgcgcca

SEQ ID NO: 4027255 - RNA, 20 nt, Molluscum contagiosum virus
ccgcaggcgucaugcgcgcg

SEQ ID NO: 4027256 - RNA, 15 nt, Molluscum contagiosum virus
ccgcaguaccaguac

SEQ ID NO: 4027257 - RNA, 24 nt, Molluscum contagiosum virus
ccgcaguaccaguaccugcugccg

SEQ ID NO: 4027258 - RNA, 18 nt, Molluscum contagiosum virus
ccgcaguaccggccaagg

SEQ ID NO: 4027259 - RNA, 17 nt, Molluscum contagiosum virus
ccgcauguccacggaca

SEQ ID NO: 4027260 - RNA, 21 nt, Molluscum contagiosum virus
ccgccaacgcggacgcgcagc

SEQ ID NO: 4027261 - RNA, 12 nt, Molluscum contagiosum virus
ccgccagcacca

SEQ ID NO: 4027262 - RNA, 13 nt, Molluscum contagiosum virus
ccgcccgcgcccg

SEQ ID NO: 4027263 - RNA, 22 nt, Molluscum contagiosum virus
ccgccgacgccuuccugcuggc

SEQ ID NO: 4027264 - RNA, 22 nt, Molluscum contagiosum virus
ccgccgcgaggacccgcgcuuu

SEQ ID NO: 4027265 - RNA, 14 nt, Molluscum contagiosum virus
ccgccgcgcgcgau

SEQ ID NO: 4027266 - RNA, 16 nt, Molluscum contagiosum virus
ccgccgcgugcccguc

SEQ ID NO: 4027267 - RNA, 17 nt, Molluscum contagiosum virus
ccgccgggccugcggcg

SEQ ID NO: 4027268 - RNA, 19 nt, Molluscum contagiosum virus
ccgccguacccggggagaa

SEQ ID NO: 4027269 - RNA, 14 nt, Molluscum contagiosum virus
ccgccuguaccugc

SEQ ID NO: 4027270 - RNA, 23 nt, Molluscum contagiosum virus
ccgcgaacgagaaaugcgcacac

SEQ ID NO: 4027271 - RNA, 17 nt, Molluscum contagiosum virus
ccgcgacgaacucgaca

SEQ ID NO: 4027272 - RNA, 17 nt, Molluscum contagiosum virus
ccgcgagcacuggcugg

SEQ ID NO: 4027273 - RNA, 18 nt, Molluscum contagiosum virus
ccgcgcaaaagcacagca

SEQ ID NO: 4027274 - RNA, 23 nt, Molluscum contagiosum virus
ccgcgccccacugugccagcagc

SEQ ID NO: 4027275 - RNA, 15 nt, Molluscum contagiosum virus
ccgcgcccgccagca

SEQ ID NO: 4027276 - RNA, 15 nt, Molluscum contagiosum virus
ccgcgcccucgcucg

SEQ ID NO: 4027277 - RNA, 21 nt, Molluscum contagiosum virus
ccgcgccgaaacacggccucc

SEQ ID NO: 4027278 - RNA, 16 nt, Molluscum contagiosum virus
cucagccgagcgccgc

SEQ ID NO: 4027279 - RNA, 22 nt, Molluscum contagiosum virus
cucaguugcgacggaaccgugg

SEQ ID NO: 4027280 - RNA, 18 nt, Molluscum contagiosum virus
cucauccaccugcgcaac

SEQ ID NO: 4027281 - RNA, 22 nt, Molluscum contagiosum virus
cucauccacgcggaggacggcg

SEQ ID NO: 4027282 - RNA, 17 nt, Molluscum contagiosum virus
cucauccucccugcggg

SEQ ID NO: 4027283 - RNA, 17 nt, Molluscum contagiosum virus
cucaucggcgagcucuu

SEQ ID NO: 4027284 - RNA, 19 nt, Molluscum contagiosum virus
cucauuguucggaggcugc

SEQ ID NO: 4027285 - RNA, 16 nt, Molluscum contagiosum virus
cuccaagaagaggccg

SEQ ID NO: 4027286 - RNA, 16 nt, Molluscum contagiosum virus
cuccacaugccuucag

SEQ ID NO: 4027287 - RNA, 13 nt, Molluscum contagiosum virus
cuccacgcccgag

SEQ ID NO: 4027288 - RNA, 20 nt, Molluscum contagiosum virus
cuccacgcccgagggcgggc

SEQ ID NO: 4027289 - RNA, 13 nt, Molluscum contagiosum virus
cuccagcgccagc

SEQ ID NO: 4027290 - RNA, 20 nt, Molluscum contagiosum virus
cuccagcgcgcccucgcgcg

SEQ ID NO: 4027291 - RNA, 19 nt, Molluscum contagiosum virus
cuccaggggaaugaucgac

SEQ ID NO: 4027292 - RNA, 12 nt, Molluscum contagiosum virus
cucccgcggccg

SEQ ID NO: 4027293 - RNA, 17 nt, Molluscum contagiosum virus
cucccugguaguccugc

SEQ ID NO: 4027294 - RNA, 19 nt, Molluscum contagiosum virus
cuccgaccgugcccuggac

SEQ ID NO: 4027295 - RNA, 17 nt, Molluscum contagiosum virus
cuccgacgugcugcgca

SEQ ID NO: 4027296 - RNA, 19 nt, Molluscum contagiosum virus
cuccgacuaccuaggcacu

SEQ ID NO: 4027297 - RNA, 17 nt, Molluscum contagiosum virus
cuccgacuccgagcgcg

SEQ ID NO: 4027298 - RNA, 15 nt, Molluscum contagiosum virus
cuccgaguccagcuu

SEQ ID NO: 4027299 - RNA, 15 nt, Molluscum contagiosum virus
cuccgcacagaggga

SEQ ID NO: 4027300 - RNA, 12 nt, Molluscum contagiosum virus
cuccgcacgugg

SEQ ID NO: 4027301 - RNA, 12 nt, Molluscum contagiosum virus
cuccgcgcggcg

SEQ ID NO: 4027302 - RNA, 22 nt, Molluscum contagiosum virus
cuccggcgucgaaacacugcgg

SEQ ID NO: 4027303 - RNA, 14 nt, Molluscum contagiosum virus
cuccgggcgcacaa

SEQ ID NO: 4027304 - RNA, 18 nt, Molluscum contagiosum virus
cuccuccacguccaggcc

SEQ ID NO: 4027305 - RNA, 15 nt, Molluscum contagiosum virus
cuccucucgcgaucu

SEQ ID NO: 4027306 - RNA, 13 nt, Molluscum contagiosum virus
cuccugagaagca

SEQ ID NO: 4027307 - RNA, 18 nt, Molluscum contagiosum virus
cuccugaggaagcaagac

SEQ ID NO: 4027308 - RNA, 18 nt, Molluscum contagiosum virus
cuccuuugcgagcacugu

SEQ ID NO: 4027309 - RNA, 22 nt, Molluscum contagiosum virus
cucgaacucgugcgccgcgccg

SEQ ID NO: 4027310 - RNA, 17 nt, Molluscum contagiosum virus
cucgacaaggaggcuuu

SEQ ID NO: 4027311 - RNA, 14 nt, Molluscum contagiosum virus
cucgacgcgcugcu

SEQ ID NO: 4027312 - RNA, 22 nt, Molluscum contagiosum virus
cucgagcaggucaucgggcugc

SEQ ID NO: 4027313 - RNA, 18 nt, Molluscum contagiosum virus
cucgagccccagaagguc

SEQ ID NO: 4027314 - RNA, 20 nt, Molluscum contagiosum virus
cucgaggaccucgcgcgccg

SEQ ID NO: 4027315 - RNA, 22 nt, Molluscum contagiosum virus
cucgaggcgcuugggcacugcu

SEQ ID NO: 4027316 - RNA, 12 nt, Molluscum contagiosum virus
cucgagggcgcc

SEQ ID NO: 4027317 - RNA, 12 nt, Molluscum contagiosum virus
cucgcagccucc

SEQ ID NO: 4027318 - RNA, 22 nt, Molluscum contagiosum virus
cucgcaggcggugggcgccgcg

SEQ ID NO: 4027319 - RNA, 19 nt, Molluscum contagiosum virus
cucgccaaagcgcgccuuc

SEQ ID NO: 4027320 - RNA, 21 nt, Molluscum contagiosum virus
cucgccgcgcgccgcugcucg

SEQ ID NO: 4027321 - RNA, 12 nt, Molluscum contagiosum virus
cucgccggcgag

SEQ ID NO: 4027322 - RNA, 13 nt, Molluscum contagiosum virus
cucgccggcgaga

SEQ ID NO: 4027323 - RNA, 23 nt, Molluscum contagiosum virus
cucgccggcgagaugcgagcgcg

SEQ ID NO: 4027324 - RNA, 17 nt, Molluscum contagiosum virus
cucgccuccgggcgcac

SEQ ID NO: 4027325 - RNA, 22 nt, Molluscum contagiosum virus
cucgccugcgaaaaagcccgcg

SEQ ID NO: 4027326 - RNA, 22 nt, Molluscum contagiosum virus
cucgcgagaaguucugcacagc

SEQ ID NO: 4027327 - RNA, 14 nt, Molluscum contagiosum virus
cucgcgagcgccac

SEQ ID NO: 4027328 - RNA, 19 nt, Molluscum contagiosum virus
cucgcgagcgccacuagca

SEQ ID NO: 4027329 - RNA, 16 nt, Molluscum contagiosum virus
cucgcgagggcucguc

SEQ ID NO: 4027330 - RNA, 19 nt, Molluscum contagiosum virus
cucgcgcaaguccagcgcg

SEQ ID NO: 4027331 - RNA, 12 nt, Molluscum contagiosum virus
cucgcgcacgcg

SEQ ID NO: 4027332 - RNA, 21 nt, Molluscum contagiosum virus
cucgcgcgacacgagcgaguu

SEQ ID NO: 4027333 - RNA, 17 nt, Molluscum contagiosum virus
cucgcgcgacuggcacg

SEQ ID NO: 4027334 - RNA, 14 nt, Molluscum contagiosum virus
cucgcgcgcacgcg

SEQ ID NO: 4027335 - RNA, 17 nt, Molluscum contagiosum virus
cucgcgcguccgcaaag

SEQ ID NO: 4027336 - RNA, 15 nt, Molluscum contagiosum virus
cucgcgcuuccccgc

SEQ ID NO: 4027337 - RNA, 17 nt, Molluscum contagiosum virus
cucgcgggcguggggag

SEQ ID NO: 4027338 - RNA, 21 nt, Molluscum contagiosum virus
cucgcgggcguggggagcugg

SEQ ID NO: 4027339 - RNA, 17 nt, Molluscum contagiosum virus
cucgcggggcaagcgcg

SEQ ID NO: 4027340 - RNA, 16 nt, Molluscum contagiosum virus
cucgcggugacaggca

SEQ ID NO: 4027341 - RNA, 23 nt, Molluscum contagiosum virus
cucgcguuagcgcuggcccgugc

SEQ ID NO: 4027342 - RNA, 19 nt, Molluscum contagiosum virus
cucgcucauccacgcggag

SEQ ID NO: 4027343 - RNA, 13 nt, Molluscum contagiosum virus
cucgcugccuggu

SEQ ID NO: 4027344 - RNA, 18 nt, Molluscum contagiosum virus
cucgcugcuccccgccag

SEQ ID NO: 4027345 - RNA, 13 nt, Molluscum contagiosum virus
cucgcugcugcuc

SEQ ID NO: 4027346 - RNA, 14 nt, Molluscum contagiosum virus
cucgcugcugcucu

SEQ ID NO: 4027347 - RNA, 16 nt, Molluscum contagiosum virus
cucgcugcugcucuuc

SEQ ID NO: 4027348 - RNA, 12 nt, Molluscum contagiosum virus
cucgcugcuggg

SEQ ID NO: 4027349 - RNA, 19 nt, Molluscum contagiosum virus
cucgcuggugugcacugau

SEQ ID NO: 4027350 - RNA, 14 nt, Molluscum contagiosum virus
cucgcuugcccgga

SEQ ID NO: 4027351 - RNA, 16 nt, Molluscum contagiosum virus
cucggaagagcguccg

SEQ ID NO: 4027352 - RNA, 19 nt, Molluscum contagiosum virus
cucggacagugccuccgcg

SEQ ID NO: 4027353 - RNA, 20 nt, Molluscum contagiosum virus
cucggaggggcuccgggccc

SEQ ID NO: 4027354 - RNA, 14 nt, Molluscum contagiosum virus
cucggcaacgccag

SEQ ID NO: 4027355 - RNA, 20 nt, Molluscum contagiosum virus
cucggcaugugcgcaccgcg

SEQ ID NO: 4027356 - RNA, 16 nt, Molluscum contagiosum virus
cucggcgcgcgccgcg

SEQ ID NO: 4027357 - RNA, 17 nt, Molluscum contagiosum virus
cucggcguggugcuggc

SEQ ID NO: 4027358 - RNA, 23 nt, Molluscum contagiosum virus
cucggcguuggccacgaacacgg

SEQ ID NO: 4027359 - RNA, 15 nt, Molluscum contagiosum virus
cucggcuucugcugc

SEQ ID NO: 4027360 - RNA, 16 nt, Molluscum contagiosum virus
cucggcuucugcugca

SEQ ID NO: 4027361 - RNA, 16 nt, Molluscum contagiosum virus
cucgggccggcgcgcc

SEQ ID NO: 4027362 - RNA, 20 nt, Molluscum contagiosum virus
cucguaaaagacgcgcucgc

SEQ ID NO: 4027363 - RNA, 14 nt, Molluscum contagiosum virus
cucguacugcugca

SEQ ID NO: 4027364 - RNA, 19 nt, Molluscum contagiosum virus
cucgucgcugcggacaaga

SEQ ID NO: 4027365 - RNA, 16 nt, Molluscum contagiosum virus
cucgucuugcgcgcca

SEQ ID NO: 4027366 - RNA, 15 nt, Molluscum contagiosum virus
cucgugccgccugcg

SEQ ID NO: 4027367 - RNA, 19 nt, Molluscum contagiosum virus
cucgugccuuuugcgcgcu

SEQ ID NO: 4027368 - RNA, 18 nt, Molluscum contagiosum virus
cucgugcuggagcagggc

SEQ ID NO: 4027369 - RNA, 16 nt, Molluscum contagiosum virus
cucgugcugggccugc

SEQ ID NO: 4027370 - RNA, 23 nt, Molluscum contagiosum virus
cucguggaucgcgcgcaccugca

SEQ ID NO: 4027371 - RNA, 19 nt, Molluscum contagiosum virus
cucguggcguugcugcugc

SEQ ID NO: 4027372 - RNA, 15 nt, Molluscum contagiosum virus
cucguggucgccgcg

SEQ ID NO: 4027373 - RNA, 18 nt, Molluscum contagiosum virus
cucguguacgagaaguuc

SEQ ID NO: 4027374 - RNA, 23 nt, Molluscum contagiosum virus
cucguucgcgggaccgcccuugu

SEQ ID NO: 4027375 - RNA, 16 nt, Molluscum contagiosum virus
cucguucgcgggcccg

SEQ ID NO: 4027376 - RNA, 14 nt, Molluscum contagiosum virus
cucuacuuccacga

SEQ ID NO: 4027377 - RNA, 18 nt, Molluscum contagiosum virus
cucuaggagcuccgugcu

SEQ ID NO: 4027378 - RNA, 17 nt, Molluscum contagiosum virus
cucuccgagacacgcga

SEQ ID NO: 4027379 - RNA, 15 nt, Molluscum contagiosum virus
cucucgagcacuucc

SEQ ID NO: 4027380 - RNA, 13 nt, Molluscum contagiosum virus
cucucgaggcgga

SEQ ID NO: 4027381 - RNA, 23 nt, Molluscum contagiosum virus
cuucguggcgcugggcgcgccgc

SEQ ID NO: 4027382 - RNA, 15 nt, Molluscum contagiosum virus
cuucuaccacagguu

SEQ ID NO: 4027383 - RNA, 15 nt, Molluscum contagiosum virus
cuucucgaacuccag

SEQ ID NO: 4027384 - RNA, 18 nt, Molluscum contagiosum virus
cuucucgagugcacguaa

SEQ ID NO: 4027385 - RNA, 19 nt, Molluscum contagiosum virus
cuucucugcgaucgcgggc

SEQ ID NO: 4027386 - RNA, 20 nt, Molluscum contagiosum virus
cuucuucgcaagugcacacc

SEQ ID NO: 4027387 - RNA, 18 nt, Molluscum contagiosum virus
cuucuucgugcugugccu

SEQ ID NO: 4027388 - RNA, 20 nt, Molluscum contagiosum virus
cuucuuuacgggcgccagcu

SEQ ID NO: 4027389 - RNA, 23 nt, Molluscum contagiosum virus
cuugaaggacgcguucuccagga

SEQ ID NO: 4027390 - RNA, 16 nt, Molluscum contagiosum virus
cuugagcaccaagaag

SEQ ID NO: 4027391 - RNA, 21 nt, Molluscum contagiosum virus
cuugauuucgcgcagcaggca

SEQ ID NO: 4027392 - RNA, 18 nt, Molluscum contagiosum virus
cuugcacgggcaugcaca

SEQ ID NO: 4027393 - RNA, 14 nt, Molluscum contagiosum virus
cuugcauguucucu

SEQ ID NO: 4027394 - RNA, 19 nt, Molluscum contagiosum virus
cuugcgcgcggugcgggcg

SEQ ID NO: 4027395 - RNA, 19 nt, Molluscum contagiosum virus
cuugcgcggaagaagcugc

SEQ ID NO: 4027396 - RNA, 18 nt, Molluscum contagiosum virus
cuugcgcguccgcaaagc

SEQ ID NO: 4027397 - RNA, 13 nt, Molluscum contagiosum virus
cuugcggcacaca

SEQ ID NO: 4027398 - RNA, 15 nt, Molluscum contagiosum virus
cuuggaagagucgcg

SEQ ID NO: 4027399 - RNA, 21 nt, Molluscum contagiosum virus
cuuggacagcaagcagcgcgc

SEQ ID NO: 4027400 - RNA, 20 nt, Molluscum contagiosum virus
cuuggcaauggcgcgcagcu

SEQ ID NO: 4027401 - RNA, 16 nt, Molluscum contagiosum virus
cuuggccccucccggu

SEQ ID NO: 4027402 - RNA, 19 nt, Molluscum contagiosum virus
cuuggcgcccuuccuggag

SEQ ID NO: 4027403 - RNA, 16 nt, Molluscum contagiosum virus
cuuggcgggcagcggc

SEQ ID NO: 4027404 - RNA, 13 nt, Molluscum contagiosum virus
cuugugacccgca

SEQ ID NO: 4027405 - RNA, 13 nt, Molluscum contagiosum virus
cuuguugugcuuu

SEQ ID NO: 4027406 - RNA, 13 nt, Molluscum contagiosum virus
cuuguugugggcu

SEQ ID NO: 4027407 - RNA, 21 nt, Molluscum contagiosum virus
cuuguuuuuguacccuugcuc

SEQ ID NO: 4027408 - RNA, 18 nt, Molluscum contagiosum virus
cuuucacgcugcacgagc

SEQ ID NO: 4027409 - RNA, 17 nt, Molluscum contagiosum virus
cuuucccgggcacugua

SEQ ID NO: 4027410 - RNA, 17 nt, Molluscum contagiosum virus
cuuuccggccuguaaau

SEQ ID NO: 4027411 - RNA, 19 nt, Molluscum contagiosum virus
cuuucucacgcccgcgcug

SEQ ID NO: 4027412 - RNA, 16 nt, Molluscum contagiosum virus
cuuugcgaacgcgcaa

SEQ ID NO: 4027413 - RNA, 13 nt, Molluscum contagiosum virus
cuuugcggacgcg

SEQ ID NO: 4027414 - RNA, 19 nt, Molluscum contagiosum virus
cuuugugcgaccugcugcg

SEQ ID NO: 4027415 - RNA, 20 nt, Molluscum contagiosum virus
cuuugugcgaccugcugcga

SEQ ID NO: 4027416 - RNA, 21 nt, Molluscum contagiosum virus
cuuuguggucaagacuggccu

SEQ ID NO: 4027417 - RNA, 15 nt, Molluscum contagiosum virus
cuuuugccgcggcgc

SEQ ID NO: 4027418 - RNA, 12 nt, Molluscum contagiosum virus
cuuuuugcugau

SEQ ID NO: 4027419 - RNA, 15 nt, Molluscum contagiosum virus
cuuuuuuuguccugu

SEQ ID NO: 4027420 - RNA, 17 nt, Molluscum contagiosum virus
gaaaacgcgcggcagca

SEQ ID NO: 4027421 - RNA, 17 nt, Molluscum contagiosum virus
gaaaacguagacagugc

SEQ ID NO: 4027422 - RNA, 23 nt, Molluscum contagiosum virus
gaaacgcacagccccugcugcuc

SEQ ID NO: 4027423 - RNA, 13 nt, Molluscum contagiosum virus
gaaacuggacuga

SEQ ID NO: 4027424 - RNA, 18 nt, Molluscum contagiosum virus
gaaagagcacgcgcucgc

SEQ ID NO: 4027425 - RNA, 17 nt, Molluscum contagiosum virus
gaaagcagcaaacugug

SEQ ID NO: 4027426 - RNA, 16 nt, Molluscum contagiosum virus
gaaagcgccgcgcgcg

SEQ ID NO: 4027427 - RNA, 21 nt, Molluscum contagiosum virus
gaaagguaccccgcaggaaag

SEQ ID NO: 4027428 - RNA, 16 nt, Molluscum contagiosum virus
gaaaucgcaaagcacg

SEQ ID NO: 4027429 - RNA, 17 nt, Molluscum contagiosum virus
gaacaccacacgcgcgg

SEQ ID NO: 4027430 - RNA, 16 nt, Molluscum contagiosum virus
gaacacggacacuugg

SEQ ID NO: 4027431 - RNA, 18 nt, Molluscum contagiosum virus
gaacacgggggcugccgg

SEQ ID NO: 4027432 - RNA, 20 nt, Molluscum contagiosum virus
gaacaguacuuugucgcacg

SEQ ID NO: 4027433 - RNA, 18 nt, Molluscum contagiosum virus
gaacagucgcgcgccugc

SEQ ID NO: 4027434 - RNA, 15 nt, Molluscum contagiosum virus
gaacauaugucuccc

SEQ ID NO: 4027435 - RNA, 16 nt, Molluscum contagiosum virus
gaaccauuuuuugccc

SEQ ID NO: 4027436 - RNA, 22 nt, Molluscum contagiosum virus
gaaccccucgugcugggccugc

SEQ ID NO: 4027437 - RNA, 19 nt, Molluscum contagiosum virus
gaacccgcauugggccuug

SEQ ID NO: 4027438 - RNA, 22 nt, Molluscum contagiosum virus
gaacgacaccgcgacccagaag

SEQ ID NO: 4027439 - RNA, 16 nt, Molluscum contagiosum virus
gaacgagccugccgcg

SEQ ID NO: 4027440 - RNA, 17 nt, Molluscum contagiosum virus
gaacgaggcugcugccg

SEQ ID NO: 4027441 - RNA, 16 nt, Molluscum contagiosum virus
gaacgcgcaagugugc

SEQ ID NO: 4027442 - RNA, 18 nt, Molluscum contagiosum virus
gaacgcgcaagugugcgc

SEQ ID NO: 4027443 - RNA, 22 nt, Molluscum contagiosum virus
gaacgcgugaugucugucccgc

SEQ ID NO: 4027444 - RNA, 17 nt, Molluscum contagiosum virus
gaacguggucaagaucc

SEQ ID NO: 4027445 - RNA, 18 nt, Molluscum contagiosum virus
gaacguuauccccuccaa

SEQ ID NO: 4027446 - RNA, 16 nt, Molluscum contagiosum virus
gaacucgagcacguag

SEQ ID NO: 4027447 - RNA, 14 nt, Molluscum contagiosum virus
gaacucgaggcucu

SEQ ID NO: 4027448 - RNA, 14 nt, Molluscum contagiosum virus
gaacucgcugcugc

SEQ ID NO: 4027449 - RNA, 19 nt, Molluscum contagiosum virus
gaacucggcuucugcugca

SEQ ID NO: 4027450 - RNA, 15 nt, Molluscum contagiosum virus
gaacucuacgccgcg

SEQ ID NO: 4027451 - RNA, 20 nt, Molluscum contagiosum virus
gaacugacugcugcccccgc

SEQ ID NO: 4027452 - RNA, 16 nt, Molluscum contagiosum virus
gaacugcagcagcugg

SEQ ID NO: 4027453 - RNA, 19 nt, Molluscum contagiosum virus
gaacuggacgccguugcgc

SEQ ID NO: 4027454 - RNA, 17 nt, Molluscum contagiosum virus
gaacuggcgcagcagga

SEQ ID NO: 4027455 - RNA, 17 nt, Molluscum contagiosum virus
gaacuucuacgccaaga

SEQ ID NO: 4027456 - RNA, 18 nt, Molluscum contagiosum virus
gaagaaacagccaugugu

SEQ ID NO: 4027457 - RNA, 17 nt, Molluscum contagiosum virus
gaagaagcagcagacca

SEQ ID NO: 4027458 - RNA, 14 nt, Molluscum contagiosum virus
gaagaaggagccca

SEQ ID NO: 4027459 - RNA, 14 nt, Molluscum contagiosum virus
gaagaaggagcccu

SEQ ID NO: 4027460 - RNA, 12 nt, Molluscum contagiosum virus
gaagacgugcuu

SEQ ID NO: 4027461 - RNA, 21 nt, Molluscum contagiosum virus
gaagacguuuacguccacgcg

SEQ ID NO: 4027462 - RNA, 19 nt, Molluscum contagiosum virus
gaagaggccggcacaagcc

SEQ ID NO: 4027463 - RNA, 18 nt, Molluscum contagiosum virus
gaagaguggcucacagcc

SEQ ID NO: 4027464 - RNA, 17 nt, Molluscum contagiosum virus
gaagaucaagcacgcua

SEQ ID NO: 4027465 - RNA, 17 nt, Molluscum contagiosum virus
gaagaugcugcgcgugg

SEQ ID NO: 4027466 - RNA, 18 nt, Molluscum contagiosum virus
gaagcagugcucgggaga

SEQ ID NO: 4027467 - RNA, 13 nt, Molluscum contagiosum virus
gaagcccucaggg

SEQ ID NO: 4027468 - RNA, 12 nt, Molluscum contagiosum virus
gaagcgcgcccc

SEQ ID NO: 4027469 - RNA, 22 nt, Molluscum contagiosum virus
gaagcgcucgcucgcgcgcagc

SEQ ID NO: 4027470 - RNA, 13 nt, Molluscum contagiosum virus
gaagcggaacucu

SEQ ID NO: 4027471 - RNA, 11 nt, Molluscum contagiosum virus
gaagcuuucag

SEQ ID NO: 4027472 - RNA, 19 nt, Molluscum contagiosum virus
gaaggacgcguucuccagg

SEQ ID NO: 4027473 - RNA, 12 nt, Molluscum contagiosum virus
gaaggagcccuu

SEQ ID NO: 4027474 - RNA, 18 nt, Molluscum contagiosum virus
gaaggcauaccugugcca

SEQ ID NO: 4027475 - RNA, 11 nt, Molluscum contagiosum virus
gaaggcggcga

SEQ ID NO: 4027476 - RNA, 14 nt, Molluscum contagiosum virus
gaagggcccgcggc

SEQ ID NO: 4027477 - RNA, 18 nt, Molluscum contagiosum virus
gaagguacuucccgagga

SEQ ID NO: 4027478 - RNA, 21 nt, Molluscum contagiosum virus
gaaguccaucggugggcucgc

SEQ ID NO: 4027479 - RNA, 15 nt, Molluscum contagiosum virus
gaaguccucucuccc

SEQ ID NO: 4027480 - RNA, 22 nt, Molluscum contagiosum virus
gaaguccucucuccccuucaga

SEQ ID NO: 4027481 - RNA, 17 nt, Molluscum contagiosum virus
gaagucgcuagaggaga

SEQ ID NO: 4027482 - RNA, 18 nt, Molluscum contagiosum virus
gaagucguuaggcggcuc

SEQ ID NO: 4027483 - RNA, 18 nt, Molluscum contagiosum virus
gaagugacuagcgcuggc

SEQ ID NO: 4027484 - RNA, 21 nt, Molluscum contagiosum virus
gcacaacgggcucgugcugga

SEQ ID NO: 4027485 - RNA, 23 nt, Molluscum contagiosum virus
gcacaacuugggcccgccuccgg

SEQ ID NO: 4027486 - RNA, 21 nt, Molluscum contagiosum virus
gcacaagccguccgccucgag

SEQ ID NO: 4027487 - RNA, 22 nt, Molluscum contagiosum virus
gcacaccccuguaacaaggaaa

SEQ ID NO: 4027488 - RNA, 18 nt, Molluscum contagiosum virus
gcacaccucgagcccgag

SEQ ID NO: 4027489 - RNA, 17 nt, Molluscum contagiosum virus
gcacacgagugcccgcg

SEQ ID NO: 4027490 - RNA, 18 nt, Molluscum contagiosum virus
gcacacgcgcgcgugcug

SEQ ID NO: 4027491 - RNA, 18 nt, Molluscum contagiosum virus
gcacaguccaacccgcgg

SEQ ID NO: 4027492 - RNA, 17 nt, Molluscum contagiosum virus
gcacaguucacggcgcu

SEQ ID NO: 4027493 - RNA, 19 nt, Molluscum contagiosum virus
gcacaguucacggcgcucg

SEQ ID NO: 4027494 - RNA, 16 nt, Molluscum contagiosum virus
gcacaugcagcugcag

SEQ ID NO: 4027495 - RNA, 18 nt, Molluscum contagiosum virus
gcacaugugcgugcaccu

SEQ ID NO: 4027496 - RNA, 15 nt, Molluscum contagiosum virus
gcaccacgugcuccg

SEQ ID NO: 4027497 - RNA, 23 nt, Molluscum contagiosum virus
gcaccagcaccggcguguggcuc

SEQ ID NO: 4027498 - RNA, 15 nt, Molluscum contagiosum virus
gcaccagguagagca

SEQ ID NO: 4027499 - RNA, 21 nt, Molluscum contagiosum virus
gcaccccgaaaggcacccgca

SEQ ID NO: 4027500 - RNA, 14 nt, Molluscum contagiosum virus
gcaccccgcaggaa

SEQ ID NO: 4027501 - RNA, 13 nt, Molluscum contagiosum virus
gcacccgcaggaa

SEQ ID NO: 4027502 - RNA, 21 nt, Molluscum contagiosum virus
gcacccuccgcacagagggac

SEQ ID NO: 4027503 - RNA, 16 nt, Molluscum contagiosum virus
gcaccgagcaagcugg

SEQ ID NO: 4027504 - RNA, 14 nt, Molluscum contagiosum virus
gcaccgagugcugg

SEQ ID NO: 4027505 - RNA, 19 nt, Molluscum contagiosum virus
gcaccgccugcugcagcuc

SEQ ID NO: 4027506 - RNA, 15 nt, Molluscum contagiosum virus
gcaccgccuggugcu

SEQ ID NO: 4027507 - RNA, 18 nt, Molluscum contagiosum virus
gcaccgccuggugcugcg

SEQ ID NO: 4027508 - RNA, 19 nt, Molluscum contagiosum virus
gcaccgccuggugcugcgc

SEQ ID NO: 4027509 - RNA, 22 nt, Molluscum contagiosum virus
gcaccgccuggugcugcgcgac

SEQ ID NO: 4027510 - RNA, 22 nt, Molluscum contagiosum virus
gcaccgcgccccacugugccag

SEQ ID NO: 4027511 - RNA, 14 nt, Molluscum contagiosum virus
gcaccgcgcgcgcu

SEQ ID NO: 4027512 - RNA, 14 nt, Molluscum contagiosum virus
gcaccgcggcgacg

SEQ ID NO: 4027513 - RNA, 21 nt, Molluscum contagiosum virus
gcaccgcggcgacgucaaccg

SEQ ID NO: 4027514 - RNA, 14 nt, Molluscum contagiosum virus
gcaccgcguggcgc

SEQ ID NO: 4027515 - RNA, 21 nt, Molluscum contagiosum virus
gcaccgcguugccgcccgccg

SEQ ID NO: 4027516 - RNA, 18 nt, Molluscum contagiosum virus
gcaccggcgcucacugcg

SEQ ID NO: 4027517 - RNA, 13 nt, Molluscum contagiosum virus
gcaccgggcgccg

SEQ ID NO: 4027518 - RNA, 21 nt, Molluscum contagiosum virus
gcaccguaccgcgcccgccag

SEQ ID NO: 4027519 - RNA, 23 nt, Molluscum contagiosum virus
gcaccucccugugaacgcaccgc

SEQ ID NO: 4027520 - RNA, 12 nt, Molluscum contagiosum virus
gcaccugcagga

SEQ ID NO: 4027521 - RNA, 18 nt, Molluscum contagiosum virus
gcaccugcaucgcgccgc

SEQ ID NO: 4027522 - RNA, 16 nt, Molluscum contagiosum virus
gcaccuggaacgcgac

SEQ ID NO: 4027523 - RNA, 18 nt, Molluscum contagiosum virus
gcacgaccacgcuggcac

SEQ ID NO: 4027524 - RNA, 15 nt, Molluscum contagiosum virus
gcacgacccucuucg

SEQ ID NO: 4027525 - RNA, 15 nt, Molluscum contagiosum virus
gcacgacccucuucu

SEQ ID NO: 4027526 - RNA, 16 nt, Molluscum contagiosum virus
gcacgagccggcgccg

SEQ ID NO: 4027527 - RNA, 19 nt, Molluscum contagiosum virus
gcacgagcgcgggcgcccg

SEQ ID NO: 4027528 - RNA, 15 nt, Molluscum contagiosum virus
gcacgagcugcugcg

SEQ ID NO: 4027529 - RNA, 16 nt, Molluscum contagiosum virus
gcacgagcugcugcgc

SEQ ID NO: 4027530 - RNA, 12 nt, Molluscum contagiosum virus
gcacgaggagcc

SEQ ID NO: 4027531 - RNA, 16 nt, Molluscum contagiosum virus
gcacgaugcccagcag

SEQ ID NO: 4027532 - RNA, 14 nt, Molluscum contagiosum virus
gcacgauguacucc

SEQ ID NO: 4027533 - RNA, 15 nt, Molluscum contagiosum virus
gcacgcaacugcccg

SEQ ID NO: 4027534 - RNA, 12 nt, Molluscum contagiosum virus
gcacgcacacga

SEQ ID NO: 4027535 - RNA, 21 nt, Molluscum contagiosum virus
gcacgccgcucggcacugcug

SEQ ID NO: 4027536 - RNA, 17 nt, Molluscum contagiosum virus
gcacgccuccaagaaga

SEQ ID NO: 4027537 - RNA, 18 nt, Molluscum contagiosum virus
gcacgcgaacgccuacgc

SEQ ID NO: 4027538 - RNA, 16 nt, Molluscum contagiosum virus
gcacgcgcacacgcug

SEQ ID NO: 4027539 - RNA, 17 nt, Molluscum contagiosum virus
gcacgcgcacacgcuga

SEQ ID NO: 4027540 - RNA, 15 nt, Molluscum contagiosum virus
gcacgcgcacgcgcc

SEQ ID NO: 4027541 - RNA, 15 nt, Molluscum contagiosum virus
gcacgcgccgcgcgg

SEQ ID NO: 4027542 - RNA, 18 nt, Molluscum contagiosum virus
gcacgcgcgacaucuucc

SEQ ID NO: 4027543 - RNA, 12 nt, Molluscum contagiosum virus
gcacgcgcucgc

SEQ ID NO: 4027544 - RNA, 22 nt, Molluscum contagiosum virus
gcacgcguaaacgcggugagug

SEQ ID NO: 4027545 - RNA, 21 nt, Molluscum contagiosum virus
gcacgcuagcgagcgcccgug

SEQ ID NO: 4027546 - RNA, 17 nt, Molluscum contagiosum virus
gcacgcuguccaggcgc

SEQ ID NO: 4027547 - RNA, 17 nt, Molluscum contagiosum virus
gcacgcuuguccgcgga

SEQ ID NO: 4027548 - RNA, 20 nt, Molluscum contagiosum virus
gcacgcuugugcgcacgcug

SEQ ID NO: 4027549 - RNA, 23 nt, Molluscum contagiosum virus
gcacggacaugagcuugcgcacg

SEQ ID NO: 4027550 - RNA, 23 nt, Molluscum contagiosum virus
gcacggcaagacgacacgagggc

SEQ ID NO: 4027551 - RNA, 18 nt, Molluscum contagiosum virus
gcacggcccgggugcgcg

SEQ ID NO: 4027552 - RNA, 16 nt, Molluscum contagiosum virus
gcacggccggcgccgc

SEQ ID NO: 4027553 - RNA, 18 nt, Molluscum contagiosum virus
gcacggccggcgccgcgc

SEQ ID NO: 4027554 - RNA, 16 nt, Molluscum contagiosum virus
gcacggcgacucuggc

SEQ ID NO: 4027555 - RNA, 13 nt, Molluscum contagiosum virus
gcacggcuaccac

SEQ ID NO: 4027556 - RNA, 13 nt, Molluscum contagiosum virus
gcacgggcacgcc

SEQ ID NO: 4027557 - RNA, 19 nt, Molluscum contagiosum virus
gcacgggccggggccucgc

SEQ ID NO: 4027558 - RNA, 14 nt, Molluscum contagiosum virus
gcacgggcucgagc

SEQ ID NO: 4027559 - RNA, 22 nt, Molluscum contagiosum virus
gcacguccucggucaccacucc

SEQ ID NO: 4027560 - RNA, 23 nt, Molluscum contagiosum virus
gcacgucgaagaccaccagcacc

SEQ ID NO: 4027561 - RNA, 20 nt, Molluscum contagiosum virus
gcacgucuucgccgugugcg

SEQ ID NO: 4027562 - RNA, 19 nt, Molluscum contagiosum virus
gcacguggaaucacggcca

SEQ ID NO: 4027563 - RNA, 14 nt, Molluscum contagiosum virus
gcacguggcgcugc

SEQ ID NO: 4027564 - RNA, 22 nt, Molluscum contagiosum virus
gcacgugugcaggaacugcccg

SEQ ID NO: 4027565 - RNA, 14 nt, Molluscum contagiosum virus
gcacguuccaaaag

SEQ ID NO: 4027566 - RNA, 17 nt, Molluscum contagiosum virus
gcacguuugcgucugcg

SEQ ID NO: 4027567 - RNA, 20 nt, Molluscum contagiosum virus
gcacuccagcgcgcccucgc

SEQ ID NO: 4027568 - RNA, 14 nt, Molluscum contagiosum virus
gcacugcgccaagg

SEQ ID NO: 4027569 - RNA, 13 nt, Molluscum contagiosum virus
gcacugcgcgcgc

SEQ ID NO: 4027570 - RNA, 12 nt, Molluscum contagiosum virus
gcacugcuacga

SEQ ID NO: 4027571 - RNA, 23 nt, Molluscum contagiosum virus
gcacugcuacgagccgcuguccg

SEQ ID NO: 4027572 - RNA, 14 nt, Molluscum contagiosum virus
gcacuuccgcgcgc

SEQ ID NO: 4027573 - RNA, 23 nt, Molluscum contagiosum virus
gcacuugcaggccuccuucccug

SEQ ID NO: 4027574 - RNA, 22 nt, Molluscum contagiosum virus
gcagaaacagccgugcuccgag

SEQ ID NO: 4027575 - RNA, 14 nt, Molluscum contagiosum virus
gcagacaacaccag

SEQ ID NO: 4027576 - RNA, 13 nt, Molluscum contagiosum virus
gcagacacagacg

SEQ ID NO: 4027577 - RNA, 14 nt, Molluscum contagiosum virus
gcagaccccuugcu

SEQ ID NO: 4027578 - RNA, 14 nt, Molluscum contagiosum virus
gcagacggcaaguu

SEQ ID NO: 4027579 - RNA, 16 nt, Molluscum contagiosum virus
gcagagccgcgaaagc

SEQ ID NO: 4027580 - RNA, 15 nt, Molluscum contagiosum virus
gcagagccgggacgc

SEQ ID NO: 4027581 - RNA, 21 nt, Molluscum contagiosum virus
gcagagcuccccgcgcgcagc

SEQ ID NO: 4027582 - RNA, 15 nt, Molluscum contagiosum virus
gcagaggauacccgu

SEQ ID NO: 4027583 - RNA, 17 nt, Molluscum contagiosum virus
gcagaggcgcguccgcg

SEQ ID NO: 4027584 - RNA, 24 nt, Molluscum contagiosum virus
gcagcaccgcacgccagcagcaga

SEQ ID NO: 4027585 - RNA, 14 nt, Molluscum contagiosum virus
gcagcagcgugcau

SEQ ID NO: 4027586 - RNA, 15 nt, Molluscum contagiosum virus
gcagcagcuccucca

SEQ ID NO: 4027587 - RNA, 21 nt, Molluscum contagiosum virus
gggcgcgcggcaagccuggcu

SEQ ID NO: 4027588 - RNA, 21 nt, Molluscum contagiosum virus
gggcgcgguagcucgugccug

SEQ ID NO: 4027589 - RNA, 15 nt, Molluscum contagiosum virus
gggcggaagcuccug

SEQ ID NO: 4027590 - RNA, 16 nt, Molluscum contagiosum virus
gggcggccgcagcaag

SEQ ID NO: 4027591 - RNA, 12 nt, Molluscum contagiosum virus
gggcgugcucac

SEQ ID NO: 4027592 - RNA, 17 nt, Molluscum contagiosum virus
gggcucagcaaggaggg

SEQ ID NO: 4027593 - RNA, 22 nt, Molluscum contagiosum virus
gggcucugucguugucgccgug

SEQ ID NO: 4027594 - RNA, 21 nt, Molluscum contagiosum virus
gggcugccggcgcgugagcgc

SEQ ID NO: 4027595 - RNA, 14 nt, Molluscum contagiosum virus
ggggaaccgcugcu

SEQ ID NO: 4027596 - RNA, 14 nt, Molluscum contagiosum virus
ggggagggcggcaa

SEQ ID NO: 4027597 - RNA, 19 nt, Molluscum contagiosum virus
ggggcugucagaggauucu

SEQ ID NO: 4027598 - RNA, 16 nt, Molluscum contagiosum virus
gggguguuuccuugcc

SEQ ID NO: 4027599 - RNA, 21 nt, Molluscum contagiosum virus
gggucgugcaggucgaggagg

SEQ ID NO: 4027600 - RNA, 18 nt, Molluscum contagiosum virus
ggguggcuugcugcagua

SEQ ID NO: 4027601 - RNA, 13 nt, Molluscum contagiosum virus
gguaacgcgcgcg

SEQ ID NO: 4027602 - RNA, 13 nt, Molluscum contagiosum virus
gguacagaugagu

SEQ ID NO: 4027603 - RNA, 21 nt, Molluscum contagiosum virus
gguacccgcaaccccgcgcgu

SEQ ID NO: 4027604 - RNA, 13 nt, Molluscum contagiosum virus
gguacccgcagga

SEQ ID NO: 4027605 - RNA, 21 nt, Molluscum contagiosum virus
gguacccgcaggaaaggcacc

SEQ ID NO: 4027606 - RNA, 12 nt, Molluscum contagiosum virus
gguagcggaggc

SEQ ID NO: 4027607 - RNA, 16 nt, Molluscum contagiosum virus
gguaugcgaggccugc

SEQ ID NO: 4027608 - RNA, 21 nt, Molluscum contagiosum virus
ggucaacggcacagucuggga

SEQ ID NO: 4027609 - RNA, 16 nt, Molluscum contagiosum virus
ggucaacuccgagcgc

SEQ ID NO: 4027610 - RNA, 20 nt, Molluscum contagiosum virus
ggucaacuccgagcgcgcgc

SEQ ID NO: 4027611 - RNA, 19 nt, Molluscum contagiosum virus
ggucaccacuccgucgcgc

SEQ ID NO: 4027612 - RNA, 17 nt, Molluscum contagiosum virus
ggucacgcaagcuuugu

SEQ ID NO: 4027613 - RNA, 21 nt, Molluscum contagiosum virus
ggucacgcgcaaggccgcgcc

SEQ ID NO: 4027614 - RNA, 23 nt, Molluscum contagiosum virus
ggucacgcgcaaggccgcgccca

SEQ ID NO: 4027615 - RNA, 18 nt, Molluscum contagiosum virus
ggucaucgggcugcagcc

SEQ ID NO: 4027616 - RNA, 15 nt, Molluscum contagiosum virus
gguccaccagcugcc

SEQ ID NO: 4027617 - RNA, 19 nt, Molluscum contagiosum virus
gguccgcguuggcagcggc

SEQ ID NO: 4027618 - RNA, 22 nt, Molluscum contagiosum virus
gguccgcuccuucucagggcuu

SEQ ID NO: 4027619 - RNA, 17 nt, Molluscum contagiosum virus
gguccgggugcgagucu

SEQ ID NO: 4027620 - RNA, 19 nt, Molluscum contagiosum virus
gguccugcgcgguggcuua

SEQ ID NO: 4027621 - RNA, 20 nt, Molluscum contagiosum virus
ggucgacgacgcgcgcacgu

SEQ ID NO: 4027622 - RNA, 15 nt, Molluscum contagiosum virus
ggucgacgagugcgc

SEQ ID NO: 4027623 - RNA, 19 nt, Molluscum contagiosum virus
ggucgacgggaacgagguc

SEQ ID NO: 4027624 - RNA, 16 nt, Molluscum contagiosum virus
ggucgagcgcgccgcg

SEQ ID NO: 4027625 - RNA, 21 nt, Molluscum contagiosum virus
ggucgagcgcgccgcgcgcuc

SEQ ID NO: 4027626 - RNA, 16 nt, Molluscum contagiosum virus
ggucgccuacgaggug

SEQ ID NO: 4027627 - RNA, 18 nt, Molluscum contagiosum virus
ggucgcgcgcgcucugcc

SEQ ID NO: 4027628 - RNA, 14 nt, Molluscum contagiosum virus
ggucgugcgagacu

SEQ ID NO: 4027629 - RNA, 14 nt, Molluscum contagiosum virus
ggucucggcagcag

SEQ ID NO: 4027630 - RNA, 18 nt, Molluscum contagiosum virus
ggucuucccgcuggcggc

SEQ ID NO: 4027631 - RNA, 22 nt, Molluscum contagiosum virus
ggucuugccgaagccgcaggcc

SEQ ID NO: 4027632 - RNA, 17 nt, Molluscum contagiosum virus
ggugcagccgcugcugc

SEQ ID NO: 4027633 - RNA, 12 nt, Molluscum contagiosum virus
ggugccgcgcgc

SEQ ID NO: 4027634 - RNA, 19 nt, Molluscum contagiosum virus
ggugccggccgccggcgcc

SEQ ID NO: 4027635 - RNA, 18 nt, Molluscum contagiosum virus
ggugccuggcguccgcac

SEQ ID NO: 4027636 - RNA, 20 nt, Molluscum contagiosum virus
ggugccuggcguccgcacgc

SEQ ID NO: 4027637 - RNA, 21 nt, Molluscum contagiosum virus
ggugcucguggaaaagcaggg

SEQ ID NO: 4027638 - RNA, 13 nt, Molluscum contagiosum virus
gguggcaggcgcg

SEQ ID NO: 4027639 - RNA, 17 nt, Molluscum contagiosum virus
gguggcaggcgcgcgcg

SEQ ID NO: 4027640 - RNA, 19 nt, Molluscum contagiosum virus
gguggcgcgcgagcugcug

SEQ ID NO: 4027641 - RNA, 18 nt, Molluscum contagiosum virus
gguguacgaaaguacuuu

SEQ ID NO: 4027642 - RNA, 18 nt, Molluscum contagiosum virus
ggugugcacaugcccgug

SEQ ID NO: 4027643 - RNA, 12 nt, Molluscum contagiosum virus
gguugccaggca

SEQ ID NO: 4027644 - RNA, 20 nt, Molluscum contagiosum virus
gguugcccgccugccgcgag

SEQ ID NO: 4027645 - RNA, 17 nt, Molluscum contagiosum virus
guaagucgaagaggguc

SEQ ID NO: 4027646 - RNA, 20 nt, Molluscum contagiosum virus
guaauccaugucgagcccug

SEQ ID NO: 4027647 - RNA, 20 nt, Molluscum contagiosum virus
guacacguagaggaaguaga

SEQ ID NO: 4027648 - RNA, 16 nt, Molluscum contagiosum virus
guacaggcgcggcagc

SEQ ID NO: 4027649 - RNA, 18 nt, Molluscum contagiosum virus
guacagugcgcgcacaaa

SEQ ID NO: 4027650 - RNA, 18 nt, Molluscum contagiosum virus
guacaucgacuacgcgcu

SEQ ID NO: 4027651 - RNA, 14 nt, Molluscum contagiosum virus
guacccgcaggaaa

SEQ ID NO: 4027652 - RNA, 14 nt, Molluscum contagiosum virus
guaccgugcgcgug

SEQ ID NO: 4027653 - RNA, 22 nt, Molluscum contagiosum virus
guaccugggcaggccgcccacg

SEQ ID NO: 4027654 - RNA, 12 nt, Molluscum contagiosum virus
guaccuggugcg

SEQ ID NO: 4027655 - RNA, 15 nt, Molluscum contagiosum virus
guacgacgugcugcu

SEQ ID NO: 4027656 - RNA, 18 nt, Molluscum contagiosum virus
guacgagcagcugcugcg

SEQ ID NO: 4027657 - RNA, 23 nt, Molluscum contagiosum virus
guacgcaugcgcgguccuguccg

SEQ ID NO: 4027658 - RNA, 21 nt, Molluscum contagiosum virus
guacgcgccggggcgcgcgcu

SEQ ID NO: 4027659 - RNA, 13 nt, Molluscum contagiosum virus
guacgcgugcagg

SEQ ID NO: 4027660 - RNA, 13 nt, Molluscum contagiosum virus
guacgugcugccc

SEQ ID NO: 4027661 - RNA, 18 nt, Molluscum contagiosum virus
guacuaucagagacaggg

SEQ ID NO: 4027662 - RNA, 19 nt, Molluscum contagiosum virus
guacucaacgcgauggcgc

SEQ ID NO: 4027663 - RNA, 18 nt, Molluscum contagiosum virus
guacucgcugcuccccgc

SEQ ID NO: 4027664 - RNA, 17 nt, Molluscum contagiosum virus
guacuucuacgagcagc

SEQ ID NO: 4027665 - RNA, 16 nt, Molluscum contagiosum virus
guacuuucacgacugu

SEQ ID NO: 4027666 - RNA, 14 nt, Molluscum contagiosum virus
guagcagcgccugc

SEQ ID NO: 4027667 - RNA, 14 nt, Molluscum contagiosum virus
guagccgcgacgca

SEQ ID NO: 4027668 - RNA, 18 nt, Molluscum contagiosum virus
guagccgcgacgcaagcg

SEQ ID NO: 4027669 - RNA, 23 nt, Molluscum contagiosum virus
guagcgagcaggcgcaggccgcg

SEQ ID NO: 4027670 - RNA, 14 nt, Molluscum contagiosum virus
guagcgugcgccug

SEQ ID NO: 4027671 - RNA, 14 nt, Molluscum contagiosum virus
guagcuagcucugc

SEQ ID NO: 4027672 - RNA, 14 nt, Molluscum contagiosum virus
guagcuggcaguca

SEQ ID NO: 4027673 - RNA, 16 nt, Molluscum contagiosum virus
guagguacccgcaacc

SEQ ID NO: 4027674 - RNA, 23 nt, Molluscum contagiosum virus
guaguccaggugguagcggaggc

SEQ ID NO: 4027675 - RNA, 18 nt, Molluscum contagiosum virus
guauacucgacgcgcgcg

SEQ ID NO: 4027676 - RNA, 19 nt, Molluscum contagiosum virus
guaugaaucuacggcuguu

SEQ ID NO: 4027677 - RNA, 11 nt, Molluscum contagiosum virus
guauuuccagc

SEQ ID NO: 4027678 - RNA, 21 nt, Molluscum contagiosum virus
gucaagacucgcccgcgcgcg

SEQ ID NO: 4027679 - RNA, 23 nt, Molluscum contagiosum virus
gucaagaugcugguucugcgcug

SEQ ID NO: 4027680 - RNA, 15 nt, Molluscum contagiosum virus
gucaagcaggcaugc

SEQ ID NO: 4027681 - RNA, 22 nt, Molluscum contagiosum virus
gucaccaccgcuucgugucugu

SEQ ID NO: 4027682 - RNA, 12 nt, Molluscum contagiosum virus
gucaccgcgucc

SEQ ID NO: 4027683 - RNA, 17 nt, Molluscum contagiosum virus
gucacgcgucgcgcgcc

SEQ ID NO: 4027684 - RNA, 22 nt, Molluscum contagiosum virus
gucacgcugaucuucuaccugg

SEQ ID NO: 4027685 - RNA, 20 nt, Molluscum contagiosum virus
gucacggccuucgcgcugcc

SEQ ID NO: 4027686 - RNA, 19 nt, Molluscum contagiosum virus
gucacugcuagugcuggcc

SEQ ID NO: 4027687 - RNA, 22 nt, Molluscum contagiosum virus
gucacugcuagugcuggccgcc

SEQ ID NO: 4027688 - RNA, 20 nt, Molluscum contagiosum virus
gucagcggcggccccugccu

SEQ ID NO: 4027689 - RNA, 13 nt, Molluscum contagiosum virus
uacaugcgugcua

SEQ ID NO: 4027690 - RNA, 21 nt, Molluscum contagiosum virus
uacaugcucaagcaccugcgc

SEQ ID NO: 4027691 - RNA, 20 nt, Molluscum contagiosum virus
uaccacgagcacugccugcc

SEQ ID NO: 4027692 - RNA, 14 nt, Molluscum contagiosum virus
uaccgcgcgcacgc

SEQ ID NO: 4027693 - RNA, 17 nt, Molluscum contagiosum virus
uaccgggucgcggggcc

SEQ ID NO: 4027694 - RNA, 14 nt, Molluscum contagiosum virus
uaccugaagcugga

SEQ ID NO: 4027695 - RNA, 21 nt, Molluscum contagiosum virus
uacgagcacauacacgcgcau

SEQ ID NO: 4027696 - RNA, 16 nt, Molluscum contagiosum virus
uacgagcagcugcugc

SEQ ID NO: 4027697 - RNA, 23 nt, Molluscum contagiosum virus
uacgagcccaucaaggcgcgcau

SEQ ID NO: 4027698 - RNA, 23 nt, Molluscum contagiosum virus
uacgccaagaggacgagcugcua

SEQ ID NO: 4027699 - RNA, 14 nt, Molluscum contagiosum virus
uacgccagcgacgc

SEQ ID NO: 4027700 - RNA, 12 nt, Molluscum contagiosum virus
uacgcgagcacu

SEQ ID NO: 4027701 - RNA, 15 nt, Molluscum contagiosum virus
uacgcgccggggcgc

SEQ ID NO: 4027702 - RNA, 19 nt, Molluscum contagiosum virus
uacgcgcgcguaacagcgc

SEQ ID NO: 4027703 - RNA, 20 nt, Molluscum contagiosum virus
uacgcgcugcggcgcucgca

SEQ ID NO: 4027704 - RNA, 15 nt, Molluscum contagiosum virus
uacgcuacagcagcc

SEQ ID NO: 4027705 - RNA, 21 nt, Molluscum contagiosum virus
uacgucgcgcgcucgcucgcg

SEQ ID NO: 4027706 - RNA, 14 nt, Molluscum contagiosum virus
uacgucuccucgcg

SEQ ID NO: 4027707 - RNA, 14 nt, Molluscum contagiosum virus
uacucaugcugcuc

SEQ ID NO: 4027708 - RNA, 12 nt, Molluscum contagiosum virus
uacuccugcugg

SEQ ID NO: 4027709 - RNA, 19 nt, Molluscum contagiosum virus
uacugcugcaggcaaagcg

SEQ ID NO: 4027710 - RNA, 15 nt, Molluscum contagiosum virus
uacuuccugcagcug

SEQ ID NO: 4027711 - RNA, 21 nt, Molluscum contagiosum virus
uacuucggacgcgaacugccc

SEQ ID NO: 4027712 - RNA, 14 nt, Molluscum contagiosum virus
uacuucgucaagca

SEQ ID NO: 4027713 - RNA, 21 nt, Molluscum contagiosum virus
uagaccuuuacgucgcgcgcu

SEQ ID NO: 4027714 - RNA, 18 nt, Molluscum contagiosum virus
uagacuggcuucggggac

SEQ ID NO: 4027715 - RNA, 23 nt, Molluscum contagiosum virus
uagagcacgaagcuacgcuccgu

SEQ ID NO: 4027716 - RNA, 21 nt, Molluscum contagiosum virus
uagagcuggcaccgggcgccg

SEQ ID NO: 4027717 - RNA, 18 nt, Molluscum contagiosum virus
uagcaagcacgccaggug

SEQ ID NO: 4027718 - RNA, 18 nt, Molluscum contagiosum virus
uagcaccgcaugggcccu

SEQ ID NO: 4027719 - RNA, 13 nt, Molluscum contagiosum virus
uagcagagcacga

SEQ ID NO: 4027720 - RNA, 16 nt, Molluscum contagiosum virus
uagcagcgccugcacg

SEQ ID NO: 4027721 - RNA, 17 nt, Molluscum contagiosum virus
uagcagcgugcgcacca

SEQ ID NO: 4027722 - RNA, 13 nt, Molluscum contagiosum virus
uagccuacguggc

SEQ ID NO: 4027723 - RNA, 16 nt, Molluscum contagiosum virus
uagcgcccguggcgcc

SEQ ID NO: 4027724 - RNA, 19 nt, Molluscum contagiosum virus
uagcggacgaagcugugca

SEQ ID NO: 4027725 - RNA, 15 nt, Molluscum contagiosum virus
uagcgguguugcugu

SEQ ID NO: 4027726 - RNA, 15 nt, Molluscum contagiosum virus
uagcuggcgcccgua

SEQ ID NO: 4027727 - RNA, 21 nt, Molluscum contagiosum virus
uagggcaucgagaacgccgcg

SEQ ID NO: 4027728 - RNA, 22 nt, Molluscum contagiosum virus
uaggucggaagaaggcgccuac

SEQ ID NO: 4027729 - RNA, 18 nt, Molluscum contagiosum virus
uaguagcagcuucuugga

SEQ ID NO: 4027730 - RNA, 11 nt, Molluscum contagiosum virus
uaguccugcua

SEQ ID NO: 4027731 - RNA, 17 nt, Molluscum contagiosum virus
uagugaaccgcauuugu

SEQ ID NO: 4027732 - RNA, 19 nt, Molluscum contagiosum virus
uagugccgagcucgccucc

SEQ ID NO: 4027733 - RNA, 14 nt, Molluscum contagiosum virus
uaguggcgcucgcg

SEQ ID NO: 4027734 - RNA, 17 nt, Molluscum contagiosum virus
uaguugcagcccaccag

SEQ ID NO: 4027735 - RNA, 18 nt, Molluscum contagiosum virus
uaguugcgagccagccag

SEQ ID NO: 4027736 - RNA, 22 nt, Molluscum contagiosum virus
uaucccagaaaacgcacugucg

SEQ ID NO: 4027737 - RNA, 13 nt, Molluscum contagiosum virus
uaugcccagccug

SEQ ID NO: 4027738 - RNA, 13 nt, Molluscum contagiosum virus
uaugucuccccuu

SEQ ID NO: 4027739 - RNA, 20 nt, Molluscum contagiosum virus
uauuggacguccacaaagcc

SEQ ID NO: 4027740 - RNA, 19 nt, Molluscum contagiosum virus
ucaacagugcgugccaggc

SEQ ID NO: 4027741 - RNA, 14 nt, Molluscum contagiosum virus
ucaacgcgcgcgug

SEQ ID NO: 4027742 - RNA, 17 nt, Molluscum contagiosum virus
ucaacgcgcgcgugcug

SEQ ID NO: 4027743 - RNA, 16 nt, Molluscum contagiosum virus
ucaagaacaccaagag

SEQ ID NO: 4027744 - RNA, 17 nt, Molluscum contagiosum virus
ucaagaagcccaaggag

SEQ ID NO: 4027745 - RNA, 15 nt, Molluscum contagiosum virus
ucaagaaggcgcugg

SEQ ID NO: 4027746 - RNA, 16 nt, Molluscum contagiosum virus
ucaagacucgcccgcg

SEQ ID NO: 4027747 - RNA, 15 nt, Molluscum contagiosum virus
ucaagaggugcgugc

SEQ ID NO: 4027748 - RNA, 15 nt, Molluscum contagiosum virus
ucaagcaggcaugca

SEQ ID NO: 4027749 - RNA, 17 nt, Molluscum contagiosum virus
ucaagcaggcaugcaag

SEQ ID NO: 4027750 - RNA, 21 nt, Molluscum contagiosum virus
ucaagcagguggccgcgcgcg

SEQ ID NO: 4027751 - RNA, 21 nt, Molluscum contagiosum virus
ucaaggacaucuacagccgcc

SEQ ID NO: 4027752 - RNA, 17 nt, Molluscum contagiosum virus
ucaaggcgcgcaucgcg

SEQ ID NO: 4027753 - RNA, 23 nt, Molluscum contagiosum virus
ucaauggcgcgcgagcacagcgc

SEQ ID NO: 4027754 - RNA, 17 nt, Molluscum contagiosum virus
ucacaaagggguccgcg

SEQ ID NO: 4027755 - RNA, 21 nt, Molluscum contagiosum virus
ucacaagcaccgccugcugca

SEQ ID NO: 4027756 - RNA, 15 nt, Molluscum contagiosum virus
ucacaugugcugccg

SEQ ID NO: 4027757 - RNA, 16 nt, Molluscum contagiosum virus
ucacaugugcugccgg

SEQ ID NO: 4027758 - RNA, 23 nt, Molluscum contagiosum virus
ucaccagcuacgagccgcugcuc

SEQ ID NO: 4027759 - RNA, 23 nt, Molluscum contagiosum virus
ucaccaucaacaucuacaaggag

SEQ ID NO: 4027760 - RNA, 18 nt, Molluscum contagiosum virus
ucacgaugugcgcgcgac

SEQ ID NO: 4027761 - RNA, 21 nt, Molluscum contagiosum virus
ucacgcccuucaacgcgcgug

SEQ ID NO: 4027762 - RNA, 20 nt, Molluscum contagiosum virus
ucacgccgguggcgcgcgag

SEQ ID NO: 4027763 - RNA, 23 nt, Molluscum contagiosum virus
ucacgcgcgauggcgccugcuuc

SEQ ID NO: 4027764 - RNA, 15 nt, Molluscum contagiosum virus
ucacgcucgcgacgu

SEQ ID NO: 4027765 - RNA, 18 nt, Molluscum contagiosum virus
ucacggacucgagcccca

SEQ ID NO: 4027766 - RNA, 15 nt, Molluscum contagiosum virus
ucacggcgcucgccu

SEQ ID NO: 4027767 - RNA, 20 nt, Molluscum contagiosum virus
ucacgucaauggcgcgcgag

SEQ ID NO: 4027768 - RNA, 12 nt, Molluscum contagiosum virus
ucacuuucgcgc

SEQ ID NO: 4027769 - RNA, 16 nt, Molluscum contagiosum virus
ucacuuucgcgcgcac

SEQ ID NO: 4027770 - RNA, 12 nt, Molluscum contagiosum virus
ucagaggauucu

SEQ ID NO: 4027771 - RNA, 16 nt, Molluscum contagiosum virus
ucagaggauucuugca

SEQ ID NO: 4027772 - RNA, 15 nt, Molluscum contagiosum virus
ucagccccgcgccag

SEQ ID NO: 4027773 - RNA, 18 nt, Molluscum contagiosum virus
ucagccccgggcccgcau

SEQ ID NO: 4027774 - RNA, 17 nt, Molluscum contagiosum virus
ucagcgcgcgcagcacc

SEQ ID NO: 4027775 - RNA, 19 nt, Molluscum contagiosum virus
ucagcggcacugcgcgcau

SEQ ID NO: 4027776 - RNA, 19 nt, Molluscum contagiosum virus
ucagcggcggccccugccu

SEQ ID NO: 4027777 - RNA, 13 nt, Molluscum contagiosum virus
ucagcggcggucu

SEQ ID NO: 4027778 - RNA, 22 nt, Molluscum contagiosum virus
ucagcuccgacgugaccucgcu

SEQ ID NO: 4027779 - RNA, 14 nt, Molluscum contagiosum virus
ucaggccggucgcg

SEQ ID NO: 4027780 - RNA, 22 nt, Molluscum contagiosum virus
ucagugggcguuacagcaccuu

SEQ ID NO: 4027781 - RNA, 15 nt, Molluscum contagiosum virus
ucauccucuaccgcc

SEQ ID NO: 4027782 - RNA, 23 nt, Molluscum contagiosum virus
ucaucgugcccgguacgcucgcg

SEQ ID NO: 4027783 - RNA, 13 nt, Molluscum contagiosum virus
ucauggcgccgcu

SEQ ID NO: 4027784 - RNA, 17 nt, Molluscum contagiosum virus
uccaaaagacagaggcc

SEQ ID NO: 4027785 - RNA, 16 nt, Molluscum contagiosum virus
uccaagaagaggccag

SEQ ID NO: 4027786 - RNA, 20 nt, Molluscum contagiosum virus
uccaaggaggucccuagccu

SEQ ID NO: 4027787 - RNA, 20 nt, Molluscum contagiosum virus
uccaccggcagcgcauccga

SEQ ID NO: 4027788 - RNA, 18 nt, Molluscum contagiosum virus
uccacgcgugcgcgccag

SEQ ID NO: 4027789 - RNA, 13 nt, Molluscum contagiosum virus
uccacgcgugcug

SEQ ID NO: 4027790 - RNA, 13 nt, Molluscum contagiosum virus
uccacggacaugg

SEQ ID NO: 4027791 - RNA, 14 nt, Molluscum contagiosum virus
uccacggcgcgcac

SEQ ID NO: 4027792 - RNA, 14 nt, Molluscum contagiosum virus
agacaacaccagcg

SEQ ID NO: 4027793 - RNA, 13 nt, Molluscum contagiosum virus
agacacgagcgcg

SEQ ID NO: 4027794 - RNA, 15 nt, Molluscum contagiosum virus
agacacgcuggucag

SEQ ID NO: 4027795 - RNA, 14 nt, Molluscum contagiosum virus
agacaggccggggc

SEQ ID NO: 4027796 - RNA, 22 nt, Molluscum contagiosum virus
agacaucaucgcggagcugcgc

SEQ ID NO: 4027797 - RNA, 20 nt, Molluscum contagiosum virus
agacauuucuccuccggggc

SEQ ID NO: 4027798 - RNA, 12 nt, Molluscum contagiosum virus
agaccacgcgcg

SEQ ID NO: 4027799 - RNA, 13 nt, Molluscum contagiosum virus
agaccacgcgcgc

SEQ ID NO: 4027800 - RNA, 16 nt, Molluscum contagiosum virus
agaccucgcgcuuccg

SEQ ID NO: 4027801 - RNA, 13 nt, Molluscum contagiosum virus
agacgagggaugc

SEQ ID NO: 4027802 - RNA, 14 nt, Molluscum contagiosum virus
agacgcagcgcgag

SEQ ID NO: 4027803 - RNA, 19 nt, Molluscum contagiosum virus
agacgcguaccagcgccug

SEQ ID NO: 4027804 - RNA, 22 nt, Molluscum contagiosum virus
agacggaguccucgacaaugag

SEQ ID NO: 4027805 - RNA, 16 nt, Molluscum contagiosum virus
agacgugcugcgcgcc

SEQ ID NO: 4027806 - RNA, 17 nt, Molluscum contagiosum virus
agacguggugcucgugg

SEQ ID NO: 4027807 - RNA, 16 nt, Molluscum contagiosum virus
agacugacgccgaugu

SEQ ID NO: 4027808 - RNA, 14 nt, Molluscum contagiosum virus
agacugagucucca

SEQ ID NO: 4027809 - RNA, 21 nt, Molluscum contagiosum virus
agacugcuacgucgcggcgca

SEQ ID NO: 4027810 - RNA, 21 nt, Molluscum contagiosum virus
agacuucuccgaccgugcccu

SEQ ID NO: 4027811 - RNA, 20 nt, Molluscum contagiosum virus
agacuucuugcacgcucggc

SEQ ID NO: 4027812 - RNA, 14 nt, Molluscum contagiosum virus
agacuugugcccau

SEQ ID NO: 4027813 - RNA, 17 nt, Molluscum contagiosum virus
agagaaaggcacccacc

SEQ ID NO: 4027814 - RNA, 21 nt, Molluscum contagiosum virus
agagaccgucaaccugcugcc

SEQ ID NO: 4027815 - RNA, 17 nt, Molluscum contagiosum virus
agagcacgcgcucgcgc

SEQ ID NO: 4027816 - RNA, 14 nt, Molluscum contagiosum virus
agagcacugcgcgu

SEQ ID NO: 4027817 - RNA, 15 nt, Molluscum contagiosum virus
agagcccgccgggca

SEQ ID NO: 4027818 - RNA, 19 nt, Molluscum contagiosum virus
agagcccggacacguagcc

SEQ ID NO: 4027819 - RNA, 15 nt, Molluscum contagiosum virus
agagccgcgugcgcc

SEQ ID NO: 4027820 - RNA, 15 nt, Molluscum contagiosum virus
agagcgcgcggcgcc

SEQ ID NO: 4027821 - RNA, 17 nt, Molluscum contagiosum virus
agagcguccagccgcag

SEQ ID NO: 4027822 - RNA, 12 nt, Molluscum contagiosum virus
agagcugcugcg

SEQ ID NO: 4027823 - RNA, 13 nt, Molluscum contagiosum virus
agaggaaaggcgc

SEQ ID NO: 4027824 - RNA, 19 nt, Molluscum contagiosum virus
agaggccagcacaagccgu

SEQ ID NO: 4027825 - RNA, 19 nt, Molluscum contagiosum virus
agaggccggcacaagccgu

SEQ ID NO: 4027826 - RNA, 23 nt, Molluscum contagiosum virus
agaucaaccgcaaggaaaacugc

SEQ ID NO: 4027827 - RNA, 19 nt, Molluscum contagiosum virus
agauggucacgcgcaaggc

SEQ ID NO: 4027828 - RNA, 22 nt, Molluscum contagiosum virus
agauucggaggcggagcugccc

SEQ ID NO: 4027829 - RNA, 15 nt, Molluscum contagiosum virus
agcaagcucaagaag

SEQ ID NO: 4027830 - RNA, 23 nt, Molluscum contagiosum virus
agcaagcugcaagccagcccgcu

SEQ ID NO: 4027831 - RNA, 15 nt, Molluscum contagiosum virus
agcaaugcgcaaggc

SEQ ID NO: 4027832 - RNA, 17 nt, Molluscum contagiosum virus
agcaaugcgcaaggccg

SEQ ID NO: 4027833 - RNA, 13 nt, Molluscum contagiosum virus
agcacagcaggag

SEQ ID NO: 4027834 - RNA, 15 nt, Molluscum contagiosum virus
agcaccgcacgccag

SEQ ID NO: 4027835 - RNA, 17 nt, Molluscum contagiosum virus
agcaccgcaugggcccu

SEQ ID NO: 4027836 - RNA, 18 nt, Molluscum contagiosum virus
agcacggccgccaccgcg

SEQ ID NO: 4027837 - RNA, 19 nt, Molluscum contagiosum virus
agcacggccgccaccgcgc

SEQ ID NO: 4027838 - RNA, 20 nt, Molluscum contagiosum virus
agcacggcuugccgcucggc

SEQ ID NO: 4027839 - RNA, 21 nt, Molluscum contagiosum virus
agcacggcuugccgcucggca

SEQ ID NO: 4027840 - RNA, 17 nt, Molluscum contagiosum virus
agcacugccugccgccu

SEQ ID NO: 4027841 - RNA, 19 nt, Molluscum contagiosum virus
agcagacguacgagcaggc

SEQ ID NO: 4027842 - RNA, 22 nt, Molluscum contagiosum virus
agcagcaccgcacgccagcagc

SEQ ID NO: 4027843 - RNA, 17 nt, Molluscum contagiosum virus
agcagcgcgacuagccu

SEQ ID NO: 4027844 - RNA, 23 nt, Molluscum contagiosum virus
agcagcgcgacuagccugugccc

SEQ ID NO: 4027845 - RNA, 20 nt, Molluscum contagiosum virus
agcagcgcgagcuugccccu

SEQ ID NO: 4027846 - RNA, 14 nt, Molluscum contagiosum virus
agcagcgcgcgcag

SEQ ID NO: 4027847 - RNA, 18 nt, Molluscum contagiosum virus
agcagcggggacucuccc

SEQ ID NO: 4027848 - RNA, 14 nt, Molluscum contagiosum virus
agcagcuccagcau

SEQ ID NO: 4027849 - RNA, 19 nt, Molluscum contagiosum virus
agcaggacgacgacacagc

SEQ ID NO: 4027850 - RNA, 15 nt, Molluscum contagiosum virus
agcaggcacuccagc

SEQ ID NO: 4027851 - RNA, 22 nt, Molluscum contagiosum virus
agcaggcuguguuccagcucgg

SEQ ID NO: 4027852 - RNA, 13 nt, Molluscum contagiosum virus
agcaguaguugcu

SEQ ID NO: 4027853 - RNA, 17 nt, Molluscum contagiosum virus
agcauuagcgccaaggc

SEQ ID NO: 4027854 - RNA, 20 nt, Molluscum contagiosum virus
agcccauuaucgucacggcc

SEQ ID NO: 4027855 - RNA, 18 nt, Molluscum contagiosum virus
agccccgcggacggacga

SEQ ID NO: 4027856 - RNA, 17 nt, Molluscum contagiosum virus
agcccgcggcgcacggu

SEQ ID NO: 4027857 - RNA, 20 nt, Molluscum contagiosum virus
agcccggaagcuugcucagc

SEQ ID NO: 4027858 - RNA, 14 nt, Molluscum contagiosum virus
agccgagcgccgcc

SEQ ID NO: 4027859 - RNA, 14 nt, Molluscum contagiosum virus
agccgcagccgcgc

SEQ ID NO: 4027860 - RNA, 13 nt, Molluscum contagiosum virus
agccgccuggccg

SEQ ID NO: 4027861 - RNA, 20 nt, Molluscum contagiosum virus
agccgccuggccgaacugcu

SEQ ID NO: 4027862 - RNA, 16 nt, Molluscum contagiosum virus
agccgcucguccagcu

SEQ ID NO: 4027863 - RNA, 19 nt, Molluscum contagiosum virus
agccguucucguggcaagc

SEQ ID NO: 4027864 - RNA, 14 nt, Molluscum contagiosum virus
agccugcugcucuu

SEQ ID NO: 4027865 - RNA, 17 nt, Molluscum contagiosum virus
agcgacgagcagcugcu

SEQ ID NO: 4027866 - RNA, 22 nt, Molluscum contagiosum virus
agcgacgagcagcugcuucucu

SEQ ID NO: 4027867 - RNA, 15 nt, Molluscum contagiosum virus
agcgagcgcccgugc

SEQ ID NO: 4027868 - RNA, 13 nt, Molluscum contagiosum virus
agcgagcgcgggc

SEQ ID NO: 4027869 - RNA, 15 nt, Molluscum contagiosum virus
agcgagugcgcgugc

SEQ ID NO: 4027870 - RNA, 16 nt, Molluscum contagiosum virus
agcgaguucgcacgcu

SEQ ID NO: 4027871 - RNA, 17 nt, Molluscum contagiosum virus
agcgauguuuugaugag

SEQ ID NO: 4027872 - RNA, 21 nt, Molluscum contagiosum virus
agcgcaggcaguugccgcagc

SEQ ID NO: 4027873 - RNA, 17 nt, Molluscum contagiosum virus
agcgccacgagcagugc

SEQ ID NO: 4027874 - RNA, 22 nt, Molluscum contagiosum virus
agcgcccgugcuugcgcacgga

SEQ ID NO: 4027875 - RNA, 15 nt, Molluscum contagiosum virus
agcgccgccaugcug

SEQ ID NO: 4027876 - RNA, 15 nt, Molluscum contagiosum virus
agcgccgcgcgcggc

SEQ ID NO: 4027877 - RNA, 13 nt, Molluscum contagiosum virus
agcgcgagcuugc

SEQ ID NO: 4027878 - RNA, 20 nt, Molluscum contagiosum virus
agcgcgcccaccagcagcca

SEQ ID NO: 4027879 - RNA, 12 nt, Molluscum contagiosum virus
agcgcgccgcgc

SEQ ID NO: 4027880 - RNA, 16 nt, Molluscum contagiosum virus
agcgcgcgacugucuu

SEQ ID NO: 4027881 - RNA, 15 nt, Molluscum contagiosum virus
agcgcgcgccuugca

SEQ ID NO: 4027882 - RNA, 19 nt, Molluscum contagiosum virus
agcgcggaggcgcuaccuc

SEQ ID NO: 4027883 - RNA, 20 nt, Molluscum contagiosum virus
agcgcggggguguugcugau

SEQ ID NO: 4027884 - RNA, 15 nt, Molluscum contagiosum virus
agcgcgugcccgcag

SEQ ID NO: 4027885 - RNA, 23 nt, Molluscum contagiosum virus
agcgcgugccgcucggaggcuug

SEQ ID NO: 4027886 - RNA, 11 nt, Molluscum contagiosum virus
agcgcgugucu

SEQ ID NO: 4027887 - RNA, 22 nt, Molluscum contagiosum virus
agcgcugccugugcuacgcgag

SEQ ID NO: 4027888 - RNA, 16 nt, Molluscum contagiosum virus
agcgcuggagcuggcu

SEQ ID NO: 4027889 - RNA, 23 nt, Molluscum contagiosum virus
agcgcuucuagcucgcgcgcggc

SEQ ID NO: 4027890 - RNA, 23 nt, Molluscum contagiosum virus
agcgcuugcucuucgaccucugc

SEQ ID NO: 4027891 - RNA, 17 nt, Molluscum contagiosum virus
agcggacguggucgcgc

SEQ ID NO: 4027892 - RNA, 15 nt, Molluscum contagiosum virus
agcggagaaaaggaa

SEQ ID NO: 4027893 - RNA, 21 nt, Molluscum contagiosum virus
agcggagaaaaggaagcuugc

SEQ ID NO: 4027894 - RNA, 19 nt, Molluscum contagiosum virus
agcggauaugcgccugugc

SEQ ID NO: 4027895 - RNA, 19 nt, Molluscum contagiosum virus
caaggcaugcgcgcagugc

SEQ ID NO: 4027896 - RNA, 19 nt, Molluscum contagiosum virus
caaggccgcgcccaagaag

SEQ ID NO: 4027897 - RNA, 20 nt, Molluscum contagiosum virus
caaggccgcgggcgcggagu

SEQ ID NO: 4027898 - RNA, 16 nt, Molluscum contagiosum virus
caaggccguccccgga

SEQ ID NO: 4027899 - RNA, 22 nt, Molluscum contagiosum virus
caaggcgcgcaucgcgggcacg

SEQ ID NO: 4027900 - RNA, 19 nt, Molluscum contagiosum virus
caagggacugcgcccgugc

SEQ ID NO: 4027901 - RNA, 20 nt, Molluscum contagiosum virus
caagggcggucccgcgaacg

SEQ ID NO: 4027902 - RNA, 20 nt, Molluscum contagiosum virus
caaguacaugcacgucgaca

SEQ ID NO: 4027903 - RNA, 15 nt, Molluscum contagiosum virus
caaguccagcgcgcu

SEQ ID NO: 4027904 - RNA, 19 nt, Molluscum contagiosum virus
caagucguuugcucggggc

SEQ ID NO: 4027905 - RNA, 15 nt, Molluscum contagiosum virus
caagucucccucgcg

SEQ ID NO: 4027906 - RNA, 19 nt, Molluscum contagiosum virus
caagugggcgucgaccugg

SEQ ID NO: 4027907 - RNA, 21 nt, Molluscum contagiosum virus
caaucccacguacgagcagcu

SEQ ID NO: 4027908 - RNA, 15 nt, Molluscum contagiosum virus
caaugaggagaggaa

SEQ ID NO: 4027909 - RNA, 15 nt, Molluscum contagiosum virus
caaugcgcaaggccg

SEQ ID NO: 4027910 - RNA, 17 nt, Molluscum contagiosum virus
caaugcgcacgugcucg

SEQ ID NO: 4027911 - RNA, 22 nt, Molluscum contagiosum virus
cacaaacucgcagaacugcugc

SEQ ID NO: 4027912 - RNA, 18 nt, Molluscum contagiosum virus
cacaaagagacgcggccg

SEQ ID NO: 4027913 - RNA, 19 nt, Molluscum contagiosum virus
cacaaagagcacggacagc

SEQ ID NO: 4027914 - RNA, 19 nt, Molluscum contagiosum virus
cacaaagccaaccccgagc

SEQ ID NO: 4027915 - RNA, 20 nt, Molluscum contagiosum virus
cacaaagggguccgcgucug

SEQ ID NO: 4027916 - RNA, 22 nt, Molluscum contagiosum virus
cacaacuugggcccgccuccgg

SEQ ID NO: 4027917 - RNA, 20 nt, Molluscum contagiosum virus
cacaagauggcgcagcacuu

SEQ ID NO: 4027918 - RNA, 17 nt, Molluscum contagiosum virus
cacaagccguccgccuc

SEQ ID NO: 4027919 - RNA, 22 nt, Molluscum contagiosum virus
cacaagccguccgccucgagca

SEQ ID NO: 4027920 - RNA, 18 nt, Molluscum contagiosum virus
cacaagccguugucuugg

SEQ ID NO: 4027921 - RNA, 14 nt, Molluscum contagiosum virus
cacacaccgcgagc

SEQ ID NO: 4027922 - RNA, 14 nt, Molluscum contagiosum virus
cacacacggaagcu

SEQ ID NO: 4027923 - RNA, 15 nt, Molluscum contagiosum virus
cacaccgcguggaca

SEQ ID NO: 4027924 - RNA, 15 nt, Molluscum contagiosum virus
cacacgcaccgccug

SEQ ID NO: 4027925 - RNA, 16 nt, Molluscum contagiosum virus
cacacucacgcgucca

SEQ ID NO: 4027926 - RNA, 22 nt, Molluscum contagiosum virus
cacacucgcgcguccacaaggg

SEQ ID NO: 4027927 - RNA, 16 nt, Molluscum contagiosum virus
cacacucgcgcguccg

SEQ ID NO: 4027928 - RNA, 14 nt, Molluscum contagiosum virus
cacacuugcgcguu

SEQ ID NO: 4027929 - RNA, 12 nt, Molluscum contagiosum virus
cacagcacaggc

SEQ ID NO: 4027930 - RNA, 19 nt, Molluscum contagiosum virus
cacaguccaacccgcggcg

SEQ ID NO: 4027931 - RNA, 23 nt, Molluscum contagiosum virus
cacagucuccacgcgugcgcgcc

SEQ ID NO: 4027932 - RNA, 16 nt, Molluscum contagiosum virus
cacaguucacggcgcu

SEQ ID NO: 4027933 - RNA, 13 nt, Molluscum contagiosum virus
cacauccgcuacc

SEQ ID NO: 4027934 - RNA, 16 nt, Molluscum contagiosum virus
cacaucggcacugcuc

SEQ ID NO: 4027935 - RNA, 18 nt, Molluscum contagiosum virus
cacauuccucggcgcaca

SEQ ID NO: 4027936 - RNA, 17 nt, Molluscum contagiosum virus
cacauugcgaggcaccg

SEQ ID NO: 4027937 - RNA, 13 nt, Molluscum contagiosum virus
cacauugcugcug

SEQ ID NO: 4027938 - RNA, 15 nt, Molluscum contagiosum virus
cacauugcugcugca

SEQ ID NO: 4027939 - RNA, 18 nt, Molluscum contagiosum virus
caccacggccgacggcac

SEQ ID NO: 4027940 - RNA, 12 nt, Molluscum contagiosum virus
caccagcaccag

SEQ ID NO: 4027941 - RNA, 13 nt, Molluscum contagiosum virus
caccagcagccag

SEQ ID NO: 4027942 - RNA, 14 nt, Molluscum contagiosum virus
caccagcgcggccg

SEQ ID NO: 4027943 - RNA, 14 nt, Molluscum contagiosum virus
caccauccugcgcu

SEQ ID NO: 4027944 - RNA, 16 nt, Molluscum contagiosum virus
cacccaccaggaacga

SEQ ID NO: 4027945 - RNA, 23 nt, Molluscum contagiosum virus
caccccgaaaggcacccgcagga

SEQ ID NO: 4027946 - RNA, 12 nt, Molluscum contagiosum virus
caccgaggagcc

SEQ ID NO: 4027947 - RNA, 16 nt, Molluscum contagiosum virus
caccgcaucccccgcg

SEQ ID NO: 4027948 - RNA, 21 nt, Molluscum contagiosum virus
caccgcaugggcccuggcggc

SEQ ID NO: 4027949 - RNA, 21 nt, Molluscum contagiosum virus
caccgccuguaccugcucggg

SEQ ID NO: 4027950 - RNA, 19 nt, Molluscum contagiosum virus
caccgcgggcgugcccggc

SEQ ID NO: 4027951 - RNA, 22 nt, Molluscum contagiosum virus
caccgcguccgcuaccgcagcc

SEQ ID NO: 4027952 - RNA, 20 nt, Molluscum contagiosum virus
caccguggaggagccgcccg

SEQ ID NO: 4027953 - RNA, 19 nt, Molluscum contagiosum virus
caccguugccgcggcagug

SEQ ID NO: 4027954 - RNA, 21 nt, Molluscum contagiosum virus
caccuaaauggacgcgccgcg

SEQ ID NO: 4027955 - RNA, 15 nt, Molluscum contagiosum virus
caccucaccgcgcac

SEQ ID NO: 4027956 - RNA, 16 nt, Molluscum contagiosum virus
caccugcacgacguac

SEQ ID NO: 4027957 - RNA, 15 nt, Molluscum contagiosum virus
caccugcacgagccg

SEQ ID NO: 4027958 - RNA, 16 nt, Molluscum contagiosum virus
caccugcacgagccgg

SEQ ID NO: 4027959 - RNA, 14 nt, Molluscum contagiosum virus
caccugcaggaaag

SEQ ID NO: 4027960 - RNA, 13 nt, Molluscum contagiosum virus
caccugcgacgcc

SEQ ID NO: 4027961 - RNA, 22 nt, Molluscum contagiosum virus
caccuggcgagcgcucugcauu

SEQ ID NO: 4027962 - RNA, 18 nt, Molluscum contagiosum virus
caccuucggaacugcgga

SEQ ID NO: 4027963 - RNA, 16 nt, Molluscum contagiosum virus
caccuuuuccacgcgg

SEQ ID NO: 4027964 - RNA, 19 nt, Molluscum contagiosum virus
cacgaacgacagcgccgcc

SEQ ID NO: 4027965 - RNA, 22 nt, Molluscum contagiosum virus
cacgaagagucgcgccuggagc

SEQ ID NO: 4027966 - RNA, 15 nt, Molluscum contagiosum virus
cacgaccacgcuggc

SEQ ID NO: 4027967 - RNA, 13 nt, Molluscum contagiosum virus
cacgacccucuuc

SEQ ID NO: 4027968 - RNA, 13 nt, Molluscum contagiosum virus
cacgaccgcgcac

SEQ ID NO: 4027969 - RNA, 23 nt, Molluscum contagiosum virus
cacgacggaacguuggcccgcaa

SEQ ID NO: 4027970 - RNA, 15 nt, Molluscum contagiosum virus
cacgacucgcgucug

SEQ ID NO: 4027971 - RNA, 21 nt, Molluscum contagiosum virus
cacgacucgcgucugcaaggc

SEQ ID NO: 4027972 - RNA, 12 nt, Molluscum contagiosum virus
cacgacucucaa

SEQ ID NO: 4027973 - RNA, 21 nt, Molluscum contagiosum virus
cacgagacugagugcugagcc

SEQ ID NO: 4027974 - RNA, 15 nt, Molluscum contagiosum virus
cacgagcacugccug

SEQ ID NO: 4027975 - RNA, 13 nt, Molluscum contagiosum virus
cacgagcgcggca

SEQ ID NO: 4027976 - RNA, 19 nt, Molluscum contagiosum virus
cacgagcugacgcagacgc

SEQ ID NO: 4027977 - RNA, 14 nt, Molluscum contagiosum virus
cacgagcugcugcg

SEQ ID NO: 4027978 - RNA, 13 nt, Molluscum contagiosum virus
cacgagcugcugu

SEQ ID NO: 4027979 - RNA, 13 nt, Molluscum contagiosum virus
cacgaggagcccc

SEQ ID NO: 4027980 - RNA, 15 nt, Molluscum contagiosum virus
cacgagggccuuggc

SEQ ID NO: 4027981 - RNA, 14 nt, Molluscum contagiosum virus
cacgcaaacaaaac

SEQ ID NO: 4027982 - RNA, 15 nt, Molluscum contagiosum virus
cacgcacucgcuggc

SEQ ID NO: 4027983 - RNA, 20 nt, Molluscum contagiosum virus
cacgcaggacuggcaccugc

SEQ ID NO: 4027984 - RNA, 17 nt, Molluscum contagiosum virus
cacgccaagcgcuugcu

SEQ ID NO: 4027985 - RNA, 23 nt, Molluscum contagiosum virus
cacgccagcagcagaggaguagc

SEQ ID NO: 4027986 - RNA, 15 nt, Molluscum contagiosum virus
cacgccagguguucc

SEQ ID NO: 4027987 - RNA, 19 nt, Molluscum contagiosum virus
cacgcccgaggaccggcgc

SEQ ID NO: 4027988 - RNA, 21 nt, Molluscum contagiosum virus
cacgccgcagcgcuggagcug

SEQ ID NO: 4027989 - RNA, 13 nt, Molluscum contagiosum virus
cacgccgcccgag

SEQ ID NO: 4027990 - RNA, 22 nt, Molluscum contagiosum virus
cacgccgcucggcacugcuggc

SEQ ID NO: 4027991 - RNA, 20 nt, Molluscum contagiosum virus
cacgccgguggcgcgcgagc

SEQ ID NO: 4027992 - RNA, 14 nt, Molluscum contagiosum virus
cacgccuccaagaa

SEQ ID NO: 4027993 - RNA, 20 nt, Molluscum contagiosum virus
cacgcgaauguccggcgcug

SEQ ID NO: 4027994 - RNA, 21 nt, Molluscum contagiosum virus
cacgcgaauguccggcgcugg

SEQ ID NO: 4027995 - RNA, 18 nt, Molluscum contagiosum virus
cacgcgcaaggccgcgcc

SEQ ID NO: 4027996 - RNA, 16 nt, Molluscum contagiosum virus
cacgcgcaaggucuuc

SEQ ID NO: 4027997 - RNA, 13 nt, Molluscum contagiosum virus
cacgcgcacgggc

SEQ ID NO: 4027998 - RNA, 20 nt, Molluscum contagiosum virus
gcgucgagggcgccgggcgc

SEQ ID NO: 4027999 - RNA, 22 nt, Molluscum contagiosum virus
gcgucgcacaguucacggcgcu

SEQ ID NO: 4028000 - RNA, 16 nt, Molluscum contagiosum virus
gcgucgcgcacgcgcg

SEQ ID NO: 4028001 - RNA, 17 nt, Molluscum contagiosum virus
gcgucgcgcaggcgccc

SEQ ID NO: 4028002 - RNA, 23 nt, Molluscum contagiosum virus
gcgucggucaccaccaccuccag

SEQ ID NO: 4028003 - RNA, 20 nt, Molluscum contagiosum virus
gcgucgugcaccuggagcag

SEQ ID NO: 4028004 - RNA, 18 nt, Molluscum contagiosum virus
gcgucgugcuccacgcgc

SEQ ID NO: 4028005 - RNA, 14 nt, Molluscum contagiosum virus
gcgucucccgcggc

SEQ ID NO: 4028006 - RNA, 17 nt, Molluscum contagiosum virus
gcgucucugcgcagagc

SEQ ID NO: 4028007 - RNA, 21 nt, Molluscum contagiosum virus
gcgugacaaucucugcgccgc

SEQ ID NO: 4028008 - RNA, 22 nt, Molluscum contagiosum virus
gcgugacccucuucgacuuacg

SEQ ID NO: 4028009 - RNA, 20 nt, Molluscum contagiosum virus
gcgugcauagugggcuugcg

SEQ ID NO: 4028010 - RNA, 15 nt, Molluscum contagiosum virus
gcgugcaugcccagc

SEQ ID NO: 4028011 - RNA, 15 nt, Molluscum contagiosum virus
gcgugccgcggacgc

SEQ ID NO: 4028012 - RNA, 21 nt, Molluscum contagiosum virus
gcgugccgcggcacugggugc

SEQ ID NO: 4028013 - RNA, 14 nt, Molluscum contagiosum virus
gcgugcgagcagag

SEQ ID NO: 4028014 - RNA, 13 nt, Molluscum contagiosum virus
gcgugcgccucgc

SEQ ID NO: 4028015 - RNA, 17 nt, Molluscum contagiosum virus
gcucuucgagacgcugc

SEQ ID NO: 4028016 - RNA, 13 nt, Molluscum contagiosum virus
gcugacgcgcagu

SEQ ID NO: 4028017 - RNA, 17 nt, Molluscum contagiosum virus
gcugaguuacguggccg

SEQ ID NO: 4028018 - RNA, 22 nt, Molluscum contagiosum virus
gcugaugcuagcgugugccgcc

SEQ ID NO: 4028019 - RNA, 19 nt, Molluscum contagiosum virus
gcugcaaagcgcggccgcg

SEQ ID NO: 4028020 - RNA, 19 nt, Molluscum contagiosum virus
gcugcaaggcgcgcgcugg

SEQ ID NO: 4028021 - RNA, 17 nt, Molluscum contagiosum virus
gcugcaaucugcgcucc

SEQ ID NO: 4028022 - RNA, 23 nt, Molluscum contagiosum virus
gcugcacaguucacggcgcucgc

SEQ ID NO: 4028023 - RNA, 18 nt, Molluscum contagiosum virus
gcugcacaugugcgugca

SEQ ID NO: 4028024 - RNA, 17 nt, Molluscum contagiosum virus
gcugcagaacugccugg

SEQ ID NO: 4028025 - RNA, 14 nt, Molluscum contagiosum virus
gcugcagagcgugc

SEQ ID NO: 4028026 - RNA, 19 nt, Molluscum contagiosum virus
gcugccaauaccaggccac

SEQ ID NO: 4028027 - RNA, 15 nt, Molluscum contagiosum virus
gcugccagcucgaca

SEQ ID NO: 4028028 - RNA, 17 nt, Molluscum contagiosum virus
gcugcccgcgcagcgcc

SEQ ID NO: 4028029 - RNA, 14 nt, Molluscum contagiosum virus
gcugcccgcgcgcg

SEQ ID NO: 4028030 - RNA, 16 nt, Molluscum contagiosum virus
gcugcccuuuagcgug

SEQ ID NO: 4028031 - RNA, 21 nt, Molluscum contagiosum virus
gcugcccuuuagcguggcgcg

SEQ ID NO: 4028032 - RNA, 22 nt, Molluscum contagiosum virus
gcugccgcgcguuuucccgagg

SEQ ID NO: 4028033 - RNA, 14 nt, Molluscum contagiosum virus
gcugccgcugcgcg

SEQ ID NO: 4028034 - RNA, 18 nt, Molluscum contagiosum virus
gcugccgcuucgugcgcg

SEQ ID NO: 4028035 - RNA, 22 nt, Molluscum contagiosum virus
gcugccggcaacgcugccgcug

SEQ ID NO: 4028036 - RNA, 22 nt, Molluscum contagiosum virus
gcugccgguggaagagcccgca

SEQ ID NO: 4028037 - RNA, 16 nt, Molluscum contagiosum virus
gcugccgucgcgcgcu

SEQ ID NO: 4028038 - RNA, 13 nt, Molluscum contagiosum virus
gcugcgagagcau

SEQ ID NO: 4028039 - RNA, 14 nt, Molluscum contagiosum virus
gcugcgcacgggcg

SEQ ID NO: 4028040 - RNA, 16 nt, Molluscum contagiosum virus
gcugcgccacugccac

SEQ ID NO: 4028041 - RNA, 14 nt, Molluscum contagiosum virus
gcugcgccugcagg

SEQ ID NO: 4028042 - RNA, 16 nt, Molluscum contagiosum virus
gcugcgcgccgccgac

SEQ ID NO: 4028043 - RNA, 18 nt, Molluscum contagiosum virus
gcugcgcgcgcucgcgca

SEQ ID NO: 4028044 - RNA, 16 nt, Molluscum contagiosum virus
gcugcgcgcucuggag

SEQ ID NO: 4028045 - RNA, 17 nt, Molluscum contagiosum virus
gcugcgcgcucuggagc

SEQ ID NO: 4028046 - RNA, 16 nt, Molluscum contagiosum virus
gcugcgcggcgccgca

SEQ ID NO: 4028047 - RNA, 22 nt, Molluscum contagiosum virus
gcugcgcuacauguaugccagc

SEQ ID NO: 4028048 - RNA, 19 nt, Molluscum contagiosum virus
gcugcgcuccaugcugccg

SEQ ID NO: 4028049 - RNA, 19 nt, Molluscum contagiosum virus
gcugcgcucggcgcgcgcc

SEQ ID NO: 4028050 - RNA, 20 nt, Molluscum contagiosum virus
gcugcgcuucuauugccgcg

SEQ ID NO: 4028051 - RNA, 14 nt, Molluscum contagiosum virus
gcugcggcugcugc

SEQ ID NO: 4028052 - RNA, 18 nt, Molluscum contagiosum virus
gcugcggcugcuggagcu

SEQ ID NO: 4028053 - RNA, 20 nt, Molluscum contagiosum virus
gcugcgucacaagcaccgcc

SEQ ID NO: 4028054 - RNA, 12 nt, Molluscum contagiosum virus
gcugcgugcgcg

SEQ ID NO: 4028055 - RNA, 13 nt, Molluscum contagiosum virus
gcugcgugugccg

SEQ ID NO: 4028056 - RNA, 14 nt, Molluscum contagiosum virus
gcugcgugugccgg

SEQ ID NO: 4028057 - RNA, 19 nt, Molluscum contagiosum virus
gcugcuagagaaccugugc

SEQ ID NO: 4028058 - RNA, 20 nt, Molluscum contagiosum virus
gcugcuagagaaccugugcg

SEQ ID NO: 4028059 - RNA, 20 nt, Molluscum contagiosum virus
gcugcuccgugcccacgagc

SEQ ID NO: 4028060 - RNA, 20 nt, Molluscum contagiosum virus
gcugcucgcgcgcgcacgcc

SEQ ID NO: 4028061 - RNA, 14 nt, Molluscum contagiosum virus
gcugcugcgcacgu

SEQ ID NO: 4028062 - RNA, 15 nt, Molluscum contagiosum virus
gcugcugcgcgcgcu

SEQ ID NO: 4028063 - RNA, 14 nt, Molluscum contagiosum virus
gcugcugcggcucc

SEQ ID NO: 4028064 - RNA, 17 nt, Molluscum contagiosum virus
gcugcuucgcgaccacg

SEQ ID NO: 4028065 - RNA, 17 nt, Molluscum contagiosum virus
gcuggaccccgagcugc

SEQ ID NO: 4028066 - RNA, 20 nt, Molluscum contagiosum virus
gcuggaccugcgccagcgcc

SEQ ID NO: 4028067 - RNA, 22 nt, Molluscum contagiosum virus
gcuggacgggcacgagcacguc

SEQ ID NO: 4028068 - RNA, 13 nt, Molluscum contagiosum virus
gcuggacggugcu

SEQ ID NO: 4028069 - RNA, 14 nt, Molluscum contagiosum virus
gcuggacggugcug

SEQ ID NO: 4028070 - RNA, 21 nt, Molluscum contagiosum virus
gcuggacuuccugcugcgcag

SEQ ID NO: 4028071 - RNA, 23 nt, Molluscum contagiosum virus
gcuggacuuccugcugcgcagca

SEQ ID NO: 4028072 - RNA, 17 nt, Molluscum contagiosum virus
gcuggagcgagugcgcg

SEQ ID NO: 4028073 - RNA, 14 nt, Molluscum contagiosum virus
gcuggagcuggcug

SEQ ID NO: 4028074 - RNA, 16 nt, Molluscum contagiosum virus
gcuggagggcacgcug

SEQ ID NO: 4028075 - RNA, 18 nt, Molluscum contagiosum virus
gcuggagggcacgcugca

SEQ ID NO: 4028076 - RNA, 12 nt, Molluscum contagiosum virus
gcuggccaacac

SEQ ID NO: 4028077 - RNA, 23 nt, Molluscum contagiosum virus
gcuggcgaaaccugggcgccgcg

SEQ ID NO: 4028078 - RNA, 18 nt, Molluscum contagiosum virus
gcuggcgcgcgccgagcc

SEQ ID NO: 4028079 - RNA, 22 nt, Molluscum contagiosum virus
gcuggcgcuaccuaccggcagc

SEQ ID NO: 4028080 - RNA, 16 nt, Molluscum contagiosum virus
gcuggcggggcuggca

SEQ ID NO: 4028081 - RNA, 21 nt, Molluscum contagiosum virus
gcuggcgugcgcagugcugcg

SEQ ID NO: 4028082 - RNA, 20 nt, Molluscum contagiosum virus
gcuggcguugccgagcgagc

SEQ ID NO: 4028083 - RNA, 19 nt, Molluscum contagiosum virus
gcugggaaagggcugcuug

SEQ ID NO: 4028084 - RNA, 19 nt, Molluscum contagiosum virus
gcugggccccuacgugguc

SEQ ID NO: 4028085 - RNA, 19 nt, Molluscum contagiosum virus
gcugggcgguugccugcac

SEQ ID NO: 4028086 - RNA, 14 nt, Molluscum contagiosum virus
gcugggcguggcgc

SEQ ID NO: 4028087 - RNA, 17 nt, Molluscum contagiosum virus
gcugggcguggcgcacc

SEQ ID NO: 4028088 - RNA, 17 nt, Molluscum contagiosum virus
gcuggugcucgccugca

SEQ ID NO: 4028089 - RNA, 15 nt, Molluscum contagiosum virus
gcugguggugcugga

SEQ ID NO: 4028090 - RNA, 15 nt, Molluscum contagiosum virus
gcuggugugcacuga

SEQ ID NO: 4028091 - RNA, 18 nt, Molluscum contagiosum virus
gcugguuaccaagggcau

SEQ ID NO: 4028092 - RNA, 15 nt, Molluscum contagiosum virus
gcugguucugcgcug

SEQ ID NO: 4028093 - RNA, 21 nt, Molluscum contagiosum virus
gcugucaacagugcgugccag

SEQ ID NO: 4028094 - RNA, 20 nt, Molluscum contagiosum virus
gcugucccaagacucugccg

SEQ ID NO: 4028095 - RNA, 12 nt, Molluscum contagiosum virus
gcugucucuguc

SEQ ID NO: 4028096 - RNA, 18 nt, Molluscum contagiosum virus
gcugugagcgcgccgcuc

SEQ ID NO: 4028097 - RNA, 22 nt, Molluscum contagiosum virus
gcugugccuaggaggagaacuc

SEQ ID NO: 4028098 - RNA, 18 nt, Molluscum contagiosum virus
gcuucaaguuccuggagc

SEQ ID NO: 4028099 - RNA, 16 nt, Molluscum contagiosum virus
gcuucacgugcuugcc

SEQ ID NO: 4028100 - RNA, 18 nt, Molluscum contagiosum virus
gcuucacgugcuugcccg

SEQ ID NO: 4028101 - RNA, 23 nt, Molluscum contagiosum virus
gcuucaggcaagaggggagccag

SEQ ID NO: 4028102 - RNA, 22 nt, Molluscum contagiosum virus
gcuuccccgcacaagggcagcu

SEQ ID NO: 4028103 - RNA, 23 nt, Molluscum contagiosum virus
gcuucccgaguacuacuacacug

SEQ ID NO: 4028104 - RNA, 13 nt, Molluscum contagiosum virus
gcuuccggcacca

SEQ ID NO: 4028105 - RNA, 23 nt, Molluscum contagiosum virus
gcuuccucuacaccagcuggacg

SEQ ID NO: 4028106 - RNA, 18 nt, Molluscum contagiosum virus
gcuucggcggcugugccc

SEQ ID NO: 4028107 - RNA, 14 nt, Molluscum contagiosum virus
gcuucggcucccag

SEQ ID NO: 4028108 - RNA, 16 nt, Molluscum contagiosum virus
gcuucgucuucaccug

SEQ ID NO: 4028109 - RNA, 20 nt, Molluscum contagiosum virus
gcuucuccaccuucaggacg

SEQ ID NO: 4028110 - RNA, 16 nt, Molluscum contagiosum virus
gcuucuuugcgcgcau

SEQ ID NO: 4028111 - RNA, 13 nt, Molluscum contagiosum virus
gcuugcagacaag

SEQ ID NO: 4028112 - RNA, 18 nt, Molluscum contagiosum virus
gcuugcauguucucuuug

SEQ ID NO: 4028113 - RNA, 19 nt, Molluscum contagiosum virus
gcuugccgugccuagcguu

SEQ ID NO: 4028114 - RNA, 14 nt, Molluscum contagiosum virus
gcuugcggcacgca

SEQ ID NO: 4028115 - RNA, 22 nt, Molluscum contagiosum virus
gcuugcucuucgaccucugcuu

SEQ ID NO: 4028116 - RNA, 20 nt, Molluscum contagiosum virus
gcuuggacuccgaggcaggu

SEQ ID NO: 4028117 - RNA, 17 nt, Molluscum contagiosum virus
ggcacccucagaccaga

SEQ ID NO: 4028118 - RNA, 11 nt, Molluscum contagiosum virus
ggcacccuggc

SEQ ID NO: 4028119 - RNA, 17 nt, Molluscum contagiosum virus
ggcacccuggcugcugc

SEQ ID NO: 4028120 - RNA, 23 nt, Molluscum contagiosum virus
ggcaccgccguguugcguagagc

SEQ ID NO: 4028121 - RNA, 12 nt, Molluscum contagiosum virus
ggcaccgcgcgc

SEQ ID NO: 4028122 - RNA, 12 nt, Molluscum contagiosum virus
ggcacgagcacg

SEQ ID NO: 4028123 - RNA, 23 nt, Molluscum contagiosum virus
ggcacgaucgcgagacccccguu

SEQ ID NO: 4028124 - RNA, 17 nt, Molluscum contagiosum virus
ggcacgcgagcgcgagu

SEQ ID NO: 4028125 - RNA, 23 nt, Molluscum contagiosum virus
ggcacgcugcguuuccagggcag

SEQ ID NO: 4028126 - RNA, 19 nt, Molluscum contagiosum virus
ggcacggcacccgccagcu

SEQ ID NO: 4028127 - RNA, 21 nt, Molluscum contagiosum virus
ggcacggcacccgccagcuuu

SEQ ID NO: 4028128 - RNA, 20 nt, Molluscum contagiosum virus
ggcacgggaaggcucucaac

SEQ ID NO: 4028129 - RNA, 13 nt, Molluscum contagiosum virus
ggcacgugccccg

SEQ ID NO: 4028130 - RNA, 14 nt, Molluscum contagiosum virus
ggcacgugcugcug

SEQ ID NO: 4028131 - RNA, 16 nt, Molluscum contagiosum virus
ggcacugcuacgagcc

SEQ ID NO: 4028132 - RNA, 19 nt, Molluscum contagiosum virus
ggcacugcuggcgcgcgcg

SEQ ID NO: 4028133 - RNA, 24 nt, Molluscum contagiosum virus
ggcagaaacucuccgacgugcugc

SEQ ID NO: 4028134 - RNA, 14 nt, Molluscum contagiosum virus
ggcagaagcucauu

SEQ ID NO: 4028135 - RNA, 20 nt, Molluscum contagiosum virus
ggcagaccccuugcuacagg

SEQ ID NO: 4028136 - RNA, 14 nt, Molluscum contagiosum virus
ggcagacgccagcg

SEQ ID NO: 4028137 - RNA, 16 nt, Molluscum contagiosum virus
ggcagcagcgugcaua

SEQ ID NO: 4028138 - RNA, 19 nt, Molluscum contagiosum virus
ggcagcccgucggccacag

SEQ ID NO: 4028139 - RNA, 13 nt, Molluscum contagiosum virus
ggcagccgcugga

SEQ ID NO: 4028140 - RNA, 16 nt, Molluscum contagiosum virus
ggcagcgccagcgaga

SEQ ID NO: 4028141 - RNA, 23 nt, Molluscum contagiosum virus
ggcagcgccgcgcgcgcgcguga

SEQ ID NO: 4028142 - RNA, 17 nt, Molluscum contagiosum virus
ggcagcuggagcugccg

SEQ ID NO: 4028143 - RNA, 18 nt, Molluscum contagiosum virus
ggcagcuggagcugccgc

SEQ ID NO: 4028144 - RNA, 19 nt, Molluscum contagiosum virus
ggcagcuucugcucgcgca

SEQ ID NO: 4028145 - RNA, 12 nt, Molluscum contagiosum virus
ggcaggcgcugc

SEQ ID NO: 4028146 - RNA, 21 nt, Molluscum contagiosum virus
ggcaucgucucgcucuuccgc

SEQ ID NO: 4028147 - RNA, 17 nt, Molluscum contagiosum virus
ggcaucgugcucuucgc

SEQ ID NO: 4028148 - RNA, 21 nt, Molluscum contagiosum virus
ggcaucuucggcguguucaug

SEQ ID NO: 4028149 - RNA, 18 nt, Molluscum contagiosum virus
ggcaugcaaggcggacgc

SEQ ID NO: 4028150 - RNA, 15 nt, Molluscum contagiosum virus
ggcaugcgcgcagug

SEQ ID NO: 4028151 - RNA, 15 nt, Molluscum contagiosum virus
ggcauggagggcgag

SEQ ID NO: 4028152 - RNA, 14 nt, Molluscum contagiosum virus
ggcaugggcaagga

SEQ ID NO: 4028153 - RNA, 15 nt, Molluscum contagiosum virus
ggccaaccuccugca

SEQ ID NO: 4028154 - RNA, 23 nt, Molluscum contagiosum virus
ggccaaggucucgagcuccaggg

SEQ ID NO: 4028155 - RNA, 16 nt, Molluscum contagiosum virus
ggccacgcacucgcug

SEQ ID NO: 4028156 - RNA, 22 nt, Molluscum contagiosum virus
ggccaucgagcuucccgagguc

SEQ ID NO: 4028157 - RNA, 21 nt, Molluscum contagiosum virus
ggccaugaucauggcgccgcu

SEQ ID NO: 4028158 - RNA, 16 nt, Molluscum contagiosum virus
ggcccgccuccgggca

SEQ ID NO: 4028159 - RNA, 16 nt, Molluscum contagiosum virus
ggcccgcgcgugaagg

SEQ ID NO: 4028160 - RNA, 17 nt, Molluscum contagiosum virus
ggcccgcgcgugaagga

SEQ ID NO: 4028161 - RNA, 13 nt, Molluscum contagiosum virus
ggcccgugcccga

SEQ ID NO: 4028162 - RNA, 17 nt, Molluscum contagiosum virus
ggccgccauccgcgagc

SEQ ID NO: 4028163 - RNA, 17 nt, Molluscum contagiosum virus
ggccgccgcccgcgaau

SEQ ID NO: 4028164 - RNA, 13 nt, Molluscum contagiosum virus
ggccgcgagcgcg

SEQ ID NO: 4028165 - RNA, 13 nt, Molluscum contagiosum virus
ggccgcgcucguc

SEQ ID NO: 4028166 - RNA, 17 nt, Molluscum contagiosum virus
ggccggcgggcgcgugc

SEQ ID NO: 4028167 - RNA, 13 nt, Molluscum contagiosum virus
ggccggucgcgga

SEQ ID NO: 4028168 - RNA, 13 nt, Molluscum contagiosum virus
ggccguccccgga

SEQ ID NO: 4028169 - RNA, 14 nt, Molluscum contagiosum virus
ggccgugcccgccg

SEQ ID NO: 4028170 - RNA, 22 nt, Molluscum contagiosum virus
ggccgugcucacggacucgccg

SEQ ID NO: 4028171 - RNA, 17 nt, Molluscum contagiosum virus
ggccucgccuccgggcg

SEQ ID NO: 4028172 - RNA, 14 nt, Molluscum contagiosum virus
ggccugcggcggcg

SEQ ID NO: 4028173 - RNA, 20 nt, Molluscum contagiosum virus
ggccugcguggacagcaucc

SEQ ID NO: 4028174 - RNA, 15 nt, Molluscum contagiosum virus
ggccugcugaagaag

SEQ ID NO: 4028175 - RNA, 15 nt, Molluscum contagiosum virus
ggccuguaccugcga

SEQ ID NO: 4028176 - RNA, 14 nt, Molluscum contagiosum virus
ggccuguccgcgga

SEQ ID NO: 4028177 - RNA, 18 nt, Molluscum contagiosum virus
ggcgaacaccccgagcug

SEQ ID NO: 4028178 - RNA, 15 nt, Molluscum contagiosum virus
ggcgacacggagacg

SEQ ID NO: 4028179 - RNA, 17 nt, Molluscum contagiosum virus
ggcgacgagggcgccaa

SEQ ID NO: 4028180 - RNA, 14 nt, Molluscum contagiosum virus
ggcgagauugagcu

SEQ ID NO: 4028181 - RNA, 17 nt, Molluscum contagiosum virus
ggcgagcuagugcacac

SEQ ID NO: 4028182 - RNA, 18 nt, Molluscum contagiosum virus
ggcgagucgcgggcgcgc

SEQ ID NO: 4028183 - RNA, 19 nt, Molluscum contagiosum virus
ggcgcaaccgcgugcgugc

SEQ ID NO: 4028184 - RNA, 18 nt, Molluscum contagiosum virus
ggcgcaacgcuggccgcc

SEQ ID NO: 4028185 - RNA, 17 nt, Molluscum contagiosum virus
ggcgcacaaucucgccg

SEQ ID NO: 4028186 - RNA, 19 nt, Molluscum contagiosum virus
ggcgcaccugcuagagcau

SEQ ID NO: 4028187 - RNA, 22 nt, Molluscum contagiosum virus
ggcgcacggucuucucggugga

SEQ ID NO: 4028188 - RNA, 20 nt, Molluscum contagiosum virus
ggcgcagcuccuagcgcgcg

SEQ ID NO: 4028189 - RNA, 17 nt, Molluscum contagiosum virus
ggcgcaucagagaagug

SEQ ID NO: 4028190 - RNA, 19 nt, Molluscum contagiosum virus
ggcgcaucagagaagugcu

SEQ ID NO: 4028191 - RNA, 18 nt, Molluscum contagiosum virus
ggcgcauccucuccauca

SEQ ID NO: 4028192 - RNA, 21 nt, Molluscum contagiosum virus
ggcgccaccggcagugcuugc

SEQ ID NO: 4028193 - RNA, 21 nt, Molluscum contagiosum virus
ggcgccagaacauugccacgc

SEQ ID NO: 4028194 - RNA, 14 nt, Molluscum contagiosum virus
ggcgcccgugccgc

SEQ ID NO: 4028195 - RNA, 16 nt, Molluscum contagiosum virus
ggcgcccgugccgccg

SEQ ID NO: 4028196 - RNA, 21 nt, Molluscum contagiosum virus
ggcgcccgugccgccggcgcc

SEQ ID NO: 4028197 - RNA, 22 nt, Molluscum contagiosum virus
ggcgccgcgcugaugcuagcgu

SEQ ID NO: 4028198 - RNA, 23 nt, Molluscum contagiosum virus
ggcgccgcgcugaugcuagcgug

SEQ ID NO: 4028199 - RNA, 19 nt, Molluscum contagiosum virus
ggcgccgcugcuggaacag

SEQ ID NO: 4028200 - RNA, 16 nt, Molluscum contagiosum virus
ggcgccuguuuccgcu

SEQ ID NO: 4028201 - RNA, 16 nt, Molluscum contagiosum virus
ggcgcgaaaagucggg

SEQ ID NO: 4028202 - RNA, 22 nt, Molluscum contagiosum virus
ggcgcgagcgacggcaggcccu

SEQ ID NO: 4028203 - RNA, 15 nt, Molluscum contagiosum virus
ggcgcgcccagcgcc

SEQ ID NO: 4028204 - RNA, 22 nt, Molluscum contagiosum virus
ggcgcgccgucucgcggggcaa

SEQ ID NO: 4028205 - RNA, 13 nt, Molluscum contagiosum virus
ggcgcgcgagcac

SEQ ID NO: 4028206 - RNA, 17 nt, Molluscum contagiosum virus
ggcgcgcgagcugcugc

SEQ ID NO: 4028207 - RNA, 14 nt, Molluscum contagiosum virus
ggcgcgcgccagca

SEQ ID NO: 4028208 - RNA, 15 nt, Molluscum contagiosum virus
ggcgcgcgccagcag

SEQ ID NO: 4028209 - RNA, 16 nt, Molluscum contagiosum virus
ggcgcgcgcugcgcac

SEQ ID NO: 4028210 - RNA, 14 nt, Molluscum contagiosum virus
ggcgcgcggagagc

SEQ ID NO: 4028211 - RNA, 14 nt, Molluscum contagiosum virus
ggcgcgcguacgcg

SEQ ID NO: 4028212 - RNA, 20 nt, Molluscum contagiosum virus
ggcgcgcugugagcgcgccg

SEQ ID NO: 4028213 - RNA, 23 nt, Molluscum contagiosum virus
ggcgcggccucuuuuugcgccgc

SEQ ID NO: 4028214 - RNA, 21 nt, Molluscum contagiosum virus
ggcgcgugagcgccuaccgca

SEQ ID NO: 4028215 - RNA, 20 nt, Molluscum contagiosum virus
ggcgcgugccgcugcgcgga

SEQ ID NO: 4028216 - RNA, 21 nt, Molluscum contagiosum virus
ggcgcguugcucccgucgagc

SEQ ID NO: 4028217 - RNA, 13 nt, Molluscum contagiosum virus
ggcgcucacugcg

SEQ ID NO: 4028218 - RNA, 14 nt, Molluscum contagiosum virus
ggcggaagcuccug

SEQ ID NO: 4028219 - RNA, 23 nt, Molluscum contagiosum virus
ggcggagacgucuucgcgagcgu

SEQ ID NO: 4028220 - RNA, 20 nt, Molluscum contagiosum virus
ggugcaaccgcugcucgaca

SEQ ID NO: 4028221 - RNA, 15 nt, Molluscum contagiosum virus
ggugcacgugcugca

SEQ ID NO: 4028222 - RNA, 21 nt, Molluscum contagiosum virus
ggugcagccgcugcugcugca

SEQ ID NO: 4028223 - RNA, 17 nt, Molluscum contagiosum virus
ggugcauacgcagaggc

SEQ ID NO: 4028224 - RNA, 20 nt, Molluscum contagiosum virus
ggugcccgccaagagcuggu

SEQ ID NO: 4028225 - RNA, 19 nt, Molluscum contagiosum virus
ggugccguccccgcgcuca

SEQ ID NO: 4028226 - RNA, 15 nt, Molluscum contagiosum virus
ggugcgcccgcggca

SEQ ID NO: 4028227 - RNA, 19 nt, Molluscum contagiosum virus
ggugcgccugcacuacugc

SEQ ID NO: 4028228 - RNA, 22 nt, Molluscum contagiosum virus
ggugcugcgcgacaugcugccc

SEQ ID NO: 4028229 - RNA, 17 nt, Molluscum contagiosum virus
ggugcuggugcugguca

SEQ ID NO: 4028230 - RNA, 18 nt, Molluscum contagiosum virus
ggugcuguccuucugguu

SEQ ID NO: 4028231 - RNA, 21 nt, Molluscum contagiosum virus
gguggugggcgggugucuggg

SEQ ID NO: 4028232 - RNA, 19 nt, Molluscum contagiosum virus
ggugguuggcgugcucgcu

SEQ ID NO: 4028233 - RNA, 17 nt, Molluscum contagiosum virus
gguucccggugcugcug

SEQ ID NO: 4028234 - RNA, 18 nt, Molluscum contagiosum virus
gguuccggugucagcccc

SEQ ID NO: 4028235 - RNA, 14 nt, Molluscum contagiosum virus
gguuccgugcgcuc

SEQ ID NO: 4028236 - RNA, 19 nt, Molluscum contagiosum virus
gguugcgcacguuggccac

SEQ ID NO: 4028237 - RNA, 18 nt, Molluscum contagiosum virus
gguugcgcggggcaggca

SEQ ID NO: 4028238 - RNA, 19 nt, Molluscum contagiosum virus
guaaccaugaagaugucgc

SEQ ID NO: 4028239 - RNA, 22 nt, Molluscum contagiosum virus
guacaauacccgcuuccgcggc

SEQ ID NO: 4028240 - RNA, 16 nt, Molluscum contagiosum virus
guacacgcagagccag

SEQ ID NO: 4028241 - RNA, 17 nt, Molluscum contagiosum virus
guacagcuccccgcgca

SEQ ID NO: 4028242 - RNA, 15 nt, Molluscum contagiosum virus
guacauccgcgagca

SEQ ID NO: 4028243 - RNA, 21 nt, Molluscum contagiosum virus
guacaugcccggccucgccuc

SEQ ID NO: 4028244 - RNA, 19 nt, Molluscum contagiosum virus
guaccaccguggaggagcc

SEQ ID NO: 4028245 - RNA, 17 nt, Molluscum contagiosum virus
guacccgcaaccccgcg

SEQ ID NO: 4028246 - RNA, 12 nt, Molluscum contagiosum virus
guacccuggcag

SEQ ID NO: 4028247 - RNA, 19 nt, Molluscum contagiosum virus
guaccugcaggcucuaagc

SEQ ID NO: 4028248 - RNA, 22 nt, Molluscum contagiosum virus
guaccugcgacagcugcugcuc

SEQ ID NO: 4028249 - RNA, 16 nt, Molluscum contagiosum virus
guacgacgguuuccgc

SEQ ID NO: 4028250 - RNA, 22 nt, Molluscum contagiosum virus
guacgagcagcugcugcgcacg

SEQ ID NO: 4028251 - RNA, 16 nt, Molluscum contagiosum virus
guacgagcaggcgcag

SEQ ID NO: 4028252 - RNA, 23 nt, Molluscum contagiosum virus
guacgcaacuugugcgcccccgc

SEQ ID NO: 4028253 - RNA, 21 nt, Molluscum contagiosum virus
guacgcgugcgcuggcgcgcg

SEQ ID NO: 4028254 - RNA, 22 nt, Molluscum contagiosum virus
guacgcucuccaugcgcgcgcg

SEQ ID NO: 4028255 - RNA, 22 nt, Molluscum contagiosum virus
guacggcccgaaggccaccucg

SEQ ID NO: 4028256 - RNA, 15 nt, Molluscum contagiosum virus
guacggcgguucgca

SEQ ID NO: 4028257 - RNA, 18 nt, Molluscum contagiosum virus
guacggugccguccccgc

SEQ ID NO: 4028258 - RNA, 16 nt, Molluscum contagiosum virus
guacguacagugcgcg

SEQ ID NO: 4028259 - RNA, 18 nt, Molluscum contagiosum virus
guacgucuuucccagaag

SEQ ID NO: 4028260 - RNA, 15 nt, Molluscum contagiosum virus
guacuacuuccgcaa

SEQ ID NO: 4028261 - RNA, 14 nt, Molluscum contagiosum virus
guacuucuacggga

SEQ ID NO: 4028262 - RNA, 16 nt, Molluscum contagiosum virus
guagagcaacaugcug

SEQ ID NO: 4028263 - RNA, 17 nt, Molluscum contagiosum virus
guagagcagcgcuagcc

SEQ ID NO: 4028264 - RNA, 17 nt, Molluscum contagiosum virus
guagccgcgacgcaagc

SEQ ID NO: 4028265 - RNA, 12 nt, Molluscum contagiosum virus
guagcgcgccgc

SEQ ID NO: 4028266 - RNA, 20 nt, Molluscum contagiosum virus
guagggggguggggagacuu

SEQ ID NO: 4028267 - RNA, 13 nt, Molluscum contagiosum virus
guagguacccgca

SEQ ID NO: 4028268 - RNA, 19 nt, Molluscum contagiosum virus
guagguacccgcaaccccg

SEQ ID NO: 4028269 - RNA, 20 nt, Molluscum contagiosum virus
guagugguccaccagcugcc

SEQ ID NO: 4028270 - RNA, 20 nt, Molluscum contagiosum virus
guauauacuccccgcgcgcg

SEQ ID NO: 4028271 - RNA, 20 nt, Molluscum contagiosum virus
guauccaagaggccgucaca

SEQ ID NO: 4028272 - RNA, 24 nt, Molluscum contagiosum virus
guaugcguaguaguagcgcucgcc

SEQ ID NO: 4028273 - RNA, 22 nt, Molluscum contagiosum virus
gucaagaacaauuacuccagcg

SEQ ID NO: 4028274 - RNA, 13 nt, Molluscum contagiosum virus
gucaccgcuccgc

SEQ ID NO: 4028275 - RNA, 21 nt, Molluscum contagiosum virus
gucagccgcacggcgcccagg

SEQ ID NO: 4028276 - RNA, 12 nt, Molluscum contagiosum virus
gucaggcaaaag

SEQ ID NO: 4028277 - RNA, 16 nt, Molluscum contagiosum virus
gucaucgggcugcagc

SEQ ID NO: 4028278 - RNA, 16 nt, Molluscum contagiosum virus
gucaugcgacugccag

SEQ ID NO: 4028279 - RNA, 17 nt, Molluscum contagiosum virus
guccaccagcacgaagc

SEQ ID NO: 4028280 - RNA, 16 nt, Molluscum contagiosum virus
guccacgacgagccug

SEQ ID NO: 4028281 - RNA, 14 nt, Molluscum contagiosum virus
guccacgcgcccga

SEQ ID NO: 4028282 - RNA, 20 nt, Molluscum contagiosum virus
guccacggcgcgcaccuaca

SEQ ID NO: 4028283 - RNA, 17 nt, Molluscum contagiosum virus
guccacgugguccacca

SEQ ID NO: 4028284 - RNA, 19 nt, Molluscum contagiosum virus
guccagcgcguccaugcug

SEQ ID NO: 4028285 - RNA, 13 nt, Molluscum contagiosum virus
guccaugcccacg

SEQ ID NO: 4028286 - RNA, 23 nt, Molluscum contagiosum virus
guccaugucgcgcaucaccgagc

SEQ ID NO: 4028287 - RNA, 15 nt, Molluscum contagiosum virus
guccccggcgccggc

SEQ ID NO: 4028288 - RNA, 19 nt, Molluscum contagiosum virus
guccgacaccagcggcagg

SEQ ID NO: 4028289 - RNA, 17 nt, Molluscum contagiosum virus
guccgagccggacgcgc

SEQ ID NO: 4028290 - RNA, 18 nt, Molluscum contagiosum virus
guccgcagcggcgccacc

SEQ ID NO: 4028291 - RNA, 21 nt, Molluscum contagiosum virus
guccgcaggcgucaugcgcgc

SEQ ID NO: 4028292 - RNA, 17 nt, Molluscum contagiosum virus
guccgcauccucaaccg

SEQ ID NO: 4028293 - RNA, 21 nt, Molluscum contagiosum virus
guccgcccccagguggagcug

SEQ ID NO: 4028294 - RNA, 22 nt, Molluscum contagiosum virus
guccgccucgagcacgccucca

SEQ ID NO: 4028295 - RNA, 23 nt, Molluscum contagiosum virus
guccgcggacgcgggccuguccg

SEQ ID NO: 4028296 - RNA, 15 nt, Molluscum contagiosum virus
guccgcggggcuccu

SEQ ID NO: 4028297 - RNA, 16 nt, Molluscum contagiosum virus
guccggggaggagcuc

SEQ ID NO: 4028298 - RNA, 16 nt, Molluscum contagiosum virus
guccucgacaaugagc

SEQ ID NO: 4028299 - RNA, 20 nt, Molluscum contagiosum virus
guccugcgcgguggcuuacg

SEQ ID NO: 4028300 - RNA, 20 nt, Molluscum contagiosum virus
guccuguguuuucagggcuc

SEQ ID NO: 4028301 - RNA, 16 nt, Molluscum contagiosum virus
gucgagcgcgccgcgc

SEQ ID NO: 4028302 - RNA, 19 nt, Molluscum contagiosum virus
gucgaggccuucgcgcccg

SEQ ID NO: 4028303 - RNA, 17 nt, Molluscum contagiosum virus
gucgcaguacccgagcu

SEQ ID NO: 4028304 - RNA, 22 nt, Molluscum contagiosum virus
gucgcaguacccgagcugugcc

SEQ ID NO: 4028305 - RNA, 22 nt, Molluscum contagiosum virus
gucgcauccgaccucuuuccgc

SEQ ID NO: 4028306 - RNA, 17 nt, Molluscum contagiosum virus
gucgccgcgggcuggga

SEQ ID NO: 4028307 - RNA, 22 nt, Molluscum contagiosum virus
gucgcgcgcuaccugcgcaagc

SEQ ID NO: 4028308 - RNA, 20 nt, Molluscum contagiosum virus
gucgcguuccaggugcuggg

SEQ ID NO: 4028309 - RNA, 16 nt, Molluscum contagiosum virus
gucggccagcagcucc

SEQ ID NO: 4028310 - RNA, 23 nt, Molluscum contagiosum virus
gucggcccgaguauacucgacgc

SEQ ID NO: 4028311 - RNA, 18 nt, Molluscum contagiosum virus
gucgggccccugcgcgag

SEQ ID NO: 4028312 - RNA, 22 nt, Molluscum contagiosum virus
aggcgcgcaagugcgugucccu

SEQ ID NO: 4028313 - RNA, 18 nt, Molluscum contagiosum virus
aggcgcugucgcgcaggc

SEQ ID NO: 4028314 - RNA, 15 nt, Molluscum contagiosum virus
aggcgggccugcgcc

SEQ ID NO: 4028315 - RNA, 19 nt, Molluscum contagiosum virus
aggcguccagcggcugccc

SEQ ID NO: 4028316 - RNA, 23 nt, Molluscum contagiosum virus
aggcucuguucugcuuggacgac

SEQ ID NO: 4028317 - RNA, 16 nt, Molluscum contagiosum virus
aggcugcugccgcgcg

SEQ ID NO: 4028318 - RNA, 20 nt, Molluscum contagiosum virus
agggaggcucgagcgcgcgc

SEQ ID NO: 4028319 - RNA, 23 nt, Molluscum contagiosum virus
agggcagaacaguaacugcugca

SEQ ID NO: 4028320 - RNA, 14 nt, Molluscum contagiosum virus
agggcagcucaagc

SEQ ID NO: 4028321 - RNA, 19 nt, Molluscum contagiosum virus
agggcagcucaagcugcuc

SEQ ID NO: 4028322 - RNA, 18 nt, Molluscum contagiosum virus
agggcgggcacgugcugc

SEQ ID NO: 4028323 - RNA, 19 nt, Molluscum contagiosum virus
agguaguuugcggagcaga

SEQ ID NO: 4028324 - RNA, 17 nt, Molluscum contagiosum virus
aggucgagcgcgccgcg

SEQ ID NO: 4028325 - RNA, 20 nt, Molluscum contagiosum virus
aggucggccagcagcuccug

SEQ ID NO: 4028326 - RNA, 21 nt, Molluscum contagiosum virus
aggucuuccauugcauggaca

SEQ ID NO: 4028327 - RNA, 14 nt, Molluscum contagiosum virus
aggugcacgcgcug

SEQ ID NO: 4028328 - RNA, 14 nt, Molluscum contagiosum virus
agguugcgcagagc

SEQ ID NO: 4028329 - RNA, 22 nt, Molluscum contagiosum virus
aguaccagccgcugcgccgcca

SEQ ID NO: 4028330 - RNA, 13 nt, Molluscum contagiosum virus
aguaccagcucgc

SEQ ID NO: 4028331 - RNA, 14 nt, Molluscum contagiosum virus
aguaccgcgcgcac

SEQ ID NO: 4028332 - RNA, 15 nt, Molluscum contagiosum virus
aguaccggccaaggc

SEQ ID NO: 4028333 - RNA, 21 nt, Molluscum contagiosum virus
aguacgcucuccaugcgcgcg

SEQ ID NO: 4028334 - RNA, 23 nt, Molluscum contagiosum virus
aguacuucuacgggaagcugcac

SEQ ID NO: 4028335 - RNA, 19 nt, Molluscum contagiosum virus
aguagcgcucgcccagcuc

SEQ ID NO: 4028336 - RNA, 15 nt, Molluscum contagiosum virus
agucacgaccgaccc

SEQ ID NO: 4028337 - RNA, 18 nt, Molluscum contagiosum virus
agucacuucucggaagcg

SEQ ID NO: 4028338 - RNA, 21 nt, Molluscum contagiosum virus
aguccagcgcgcucgaggcgc

SEQ ID NO: 4028339 - RNA, 13 nt, Molluscum contagiosum virus
aguccagcuucuc

SEQ ID NO: 4028340 - RNA, 20 nt, Molluscum contagiosum virus
aguccgucacggacagcagc

SEQ ID NO: 4028341 - RNA, 22 nt, Molluscum contagiosum virus
agucgcaguacccgagcugugc

SEQ ID NO: 4028342 - RNA, 15 nt, Molluscum contagiosum virus
agucgcuagaggaga

SEQ ID NO: 4028343 - RNA, 18 nt, Molluscum contagiosum virus
agucguuugcucggggcu

SEQ ID NO: 4028344 - RNA, 22 nt, Molluscum contagiosum virus
agucguuugcucggggcugucg

SEQ ID NO: 4028345 - RNA, 16 nt, Molluscum contagiosum virus
agucuuccuggggcug

SEQ ID NO: 4028346 - RNA, 21 nt, Molluscum contagiosum virus
agugccgggcgccggcucugc

SEQ ID NO: 4028347 - RNA, 17 nt, Molluscum contagiosum virus
agugcgagccgugaccu

SEQ ID NO: 4028348 - RNA, 19 nt, Molluscum contagiosum virus
agugcgcgugucuggagcc

SEQ ID NO: 4028349 - RNA, 21 nt, Molluscum contagiosum virus
agugcgucgacguggagccug

SEQ ID NO: 4028350 - RNA, 15 nt, Molluscum contagiosum virus
agugcgugccaggcg

SEQ ID NO: 4028351 - RNA, 22 nt, Molluscum contagiosum virus
agugcguuugccagaagcccug

SEQ ID NO: 4028352 - RNA, 20 nt, Molluscum contagiosum virus
agugcucccgaggcgcgcuc

SEQ ID NO: 4028353 - RNA, 14 nt, Molluscum contagiosum virus
agugcugcugggcg

SEQ ID NO: 4028354 - RNA, 14 nt, Molluscum contagiosum virus
aguggcaagggccu

SEQ ID NO: 4028355 - RNA, 15 nt, Molluscum contagiosum virus
aguuccgaucgcgag

SEQ ID NO: 4028356 - RNA, 20 nt, Molluscum contagiosum virus
aguucgagcugcugcgcgag

SEQ ID NO: 4028357 - RNA, 19 nt, Molluscum contagiosum virus
aguucucgcguucgcguuc

SEQ ID NO: 4028358 - RNA, 13 nt, Molluscum contagiosum virus
aguucuuggugga

SEQ ID NO: 4028359 - RNA, 16 nt, Molluscum contagiosum virus
aguugcgagccagcca

SEQ ID NO: 4028360 - RNA, 21 nt, Molluscum contagiosum virus
auaccaagucuucggaguggg

SEQ ID NO: 4028361 - RNA, 10 nt, Molluscum contagiosum virus
auacgcgcuc

SEQ ID NO: 4028362 - RNA, 16 nt, Molluscum contagiosum virus
auaucugucgccgcgg

SEQ ID NO: 4028363 - RNA, 18 nt, Molluscum contagiosum virus
auauggccgugcgcgacg

SEQ ID NO: 4028364 - RNA, 22 nt, Molluscum contagiosum virus
aucaaggauuuaaauggcgcgc

SEQ ID NO: 4028365 - RNA, 23 nt, Molluscum contagiosum virus
aucaccagcuacgagccgcugcu

SEQ ID NO: 4028366 - RNA, 18 nt, Molluscum contagiosum virus
aucaggcagcugcugcgc

SEQ ID NO: 4028367 - RNA, 15 nt, Molluscum contagiosum virus
auccaaacccccgag

SEQ ID NO: 4028368 - RNA, 17 nt, Molluscum contagiosum virus
auccacgcgugcugcgc

SEQ ID NO: 4028369 - RNA, 16 nt, Molluscum contagiosum virus
aucccaagagccaugu

SEQ ID NO: 4028370 - RNA, 14 nt, Molluscum contagiosum virus
aucccccgccagga

SEQ ID NO: 4028371 - RNA, 14 nt, Molluscum contagiosum virus
auccugaaguccau

SEQ ID NO: 4028372 - RNA, 15 nt, Molluscum contagiosum virus
auccugguuccucuc

SEQ ID NO: 4028373 - RNA, 17 nt, Molluscum contagiosum virus
auccugguuccucuccu

SEQ ID NO: 4028374 - RNA, 20 nt, Molluscum contagiosum virus
auccuguucgcgcugcucgc

SEQ ID NO: 4028375 - RNA, 18 nt, Molluscum contagiosum virus
aucgagcuucccgagguc

SEQ ID NO: 4028376 - RNA, 23 nt, Molluscum contagiosum virus
aucgccuuugugacaaggaugga

SEQ ID NO: 4028377 - RNA, 15 nt, Molluscum contagiosum virus
aucgcgcgcaccugc

SEQ ID NO: 4028378 - RNA, 13 nt, Molluscum contagiosum virus
aucgcgcgcgggc

SEQ ID NO: 4028379 - RNA, 18 nt, Molluscum contagiosum virus
aucgcgcucaggaccagu

SEQ ID NO: 4028380 - RNA, 17 nt, Molluscum contagiosum virus
aucgcgugcuugcugcg

SEQ ID NO: 4028381 - RNA, 19 nt, Molluscum contagiosum virus
aucgcgugcuugcugcgcu

SEQ ID NO: 4028382 - RNA, 18 nt, Molluscum contagiosum virus
aucguuccuggccaagga

SEQ ID NO: 4028383 - RNA, 18 nt, Molluscum contagiosum virus
aucucuggauugucuuuu

SEQ ID NO: 4028384 - RNA, 23 nt, Molluscum contagiosum virus
aucugacggugcaaccgcugcuc

SEQ ID NO: 4028385 - RNA, 19 nt, Molluscum contagiosum virus
aucugcgccuccgguacgu

SEQ ID NO: 4028386 - RNA, 16 nt, Molluscum contagiosum virus
aucugcgcgugcuguc

SEQ ID NO: 4028387 - RNA, 17 nt, Molluscum contagiosum virus
aucugcgcuccacgccc

SEQ ID NO: 4028388 - RNA, 11 nt, Molluscum contagiosum virus
aucuuacaggc

SEQ ID NO: 4028389 - RNA, 14 nt, Molluscum contagiosum virus
aucuucgugcugaa

SEQ ID NO: 4028390 - RNA, 18 nt, Molluscum contagiosum virus
aucuugguggugaccgag

SEQ ID NO: 4028391 - RNA, 19 nt, Molluscum contagiosum virus
augaaaagcauccaggccu

SEQ ID NO: 4028392 - RNA, 14 nt, Molluscum contagiosum virus
augaacagcuucac

SEQ ID NO: 4028393 - RNA, 18 nt, Molluscum contagiosum virus
augaagaugucgccgcgu

SEQ ID NO: 4028394 - RNA, 17 nt, Molluscum contagiosum virus
augaagcucucgcgcgc

SEQ ID NO: 4028395 - RNA, 16 nt, Molluscum contagiosum virus
augacggcgggaaggg

SEQ ID NO: 4028396 - RNA, 12 nt, Molluscum contagiosum virus
augagcagcacc

SEQ ID NO: 4028397 - RNA, 17 nt, Molluscum contagiosum virus
augaggacagcuugcug

SEQ ID NO: 4028398 - RNA, 14 nt, Molluscum contagiosum virus
augaggcugcucuc

SEQ ID NO: 4028399 - RNA, 21 nt, Molluscum contagiosum virus
augaguaccuguaugaucugc

SEQ ID NO: 4028400 - RNA, 14 nt, Molluscum contagiosum virus
augauugucaagca

SEQ ID NO: 4028401 - RNA, 12 nt, Molluscum contagiosum virus
augcacacacuc

SEQ ID NO: 4028402 - RNA, 18 nt, Molluscum contagiosum virus
augcagauuggaggagga

SEQ ID NO: 4028403 - RNA, 13 nt, Molluscum contagiosum virus
augccacgcagcu

SEQ ID NO: 4028404 - RNA, 20 nt, Molluscum contagiosum virus
augcgaggccugcguggaca

SEQ ID NO: 4028405 - RNA, 14 nt, Molluscum contagiosum virus
augcgccugcacuu

SEQ ID NO: 4028406 - RNA, 18 nt, Molluscum contagiosum virus
augcgcgggaugcuggac

SEQ ID NO: 4028407 - RNA, 19 nt, Molluscum contagiosum virus
augcggauccuccggauga

SEQ ID NO: 4028408 - RNA, 18 nt, Molluscum contagiosum virus
augcgucccagcagcugc

SEQ ID NO: 4028409 - RNA, 18 nt, Molluscum contagiosum virus
augcgucuuccugcugcc

SEQ ID NO: 4028410 - RNA, 18 nt, Molluscum contagiosum virus
augcucacguacgacugc

SEQ ID NO: 4028411 - RNA, 21 nt, Molluscum contagiosum virus
augcucgcuugccggcggcgc

SEQ ID NO: 4028412 - RNA, 12 nt, Molluscum contagiosum virus
augcugcgcacg

SEQ ID NO: 4028413 - RNA, 20 nt, Molluscum contagiosum virus
augcuuuuguuacucucaga

SEQ ID NO: 4028414 - RNA, 14 nt, Molluscum contagiosum virus
caagguggggcgca

SEQ ID NO: 4028415 - RNA, 16 nt, Molluscum contagiosum virus
caagucaccgcuccgc

SEQ ID NO: 4028416 - RNA, 21 nt, Molluscum contagiosum virus
caagucggggcccucggcgcg

SEQ ID NO: 4028417 - RNA, 17 nt, Molluscum contagiosum virus
caagucuucggaguggg

SEQ ID NO: 4028418 - RNA, 20 nt, Molluscum contagiosum virus
caagugcgcgugucuggagc

SEQ ID NO: 4028419 - RNA, 22 nt, Molluscum contagiosum virus
caagugcgucgacguggagccu

SEQ ID NO: 4028420 - RNA, 18 nt, Molluscum contagiosum virus
caaguucgcugcuggcag

SEQ ID NO: 4028421 - RNA, 18 nt, Molluscum contagiosum virus
caauacucuguagcaucu

SEQ ID NO: 4028422 - RNA, 14 nt, Molluscum contagiosum virus
caauacugcgggcu

SEQ ID NO: 4028423 - RNA, 12 nt, Molluscum contagiosum virus
caaucuguccag

SEQ ID NO: 4028424 - RNA, 14 nt, Molluscum contagiosum virus
caaugaggagagga

SEQ ID NO: 4028425 - RNA, 16 nt, Molluscum contagiosum virus
caaugaggagaggaac

SEQ ID NO: 4028426 - RNA, 18 nt, Molluscum contagiosum virus
caaugcgcacgugcucgc

SEQ ID NO: 4028427 - RNA, 19 nt, Molluscum contagiosum virus
caaugcgcacgugcucgcg

SEQ ID NO: 4028428 - RNA, 16 nt, Molluscum contagiosum virus
cacaaagacgggcccg

SEQ ID NO: 4028429 - RNA, 22 nt, Molluscum contagiosum virus
cacaaagagcacggacagcacc

SEQ ID NO: 4028430 - RNA, 16 nt, Molluscum contagiosum virus
cacaaagcccuccuga

SEQ ID NO: 4028431 - RNA, 14 nt, Molluscum contagiosum virus
cacaaaucguccga

SEQ ID NO: 4028432 - RNA, 20 nt, Molluscum contagiosum virus
cacaacuugggcccgccucc

SEQ ID NO: 4028433 - RNA, 16 nt, Molluscum contagiosum virus
cacaagauggcgcagc

SEQ ID NO: 4028434 - RNA, 20 nt, Molluscum contagiosum virus
cacaagcaguaccugcuaac

SEQ ID NO: 4028435 - RNA, 16 nt, Molluscum contagiosum virus
cacaagggcagcucaa

SEQ ID NO: 4028436 - RNA, 23 nt, Molluscum contagiosum virus
cacaagggcagcucaagcugcuc

SEQ ID NO: 4028437 - RNA, 20 nt, Molluscum contagiosum virus
cacaagucucgcgcgggcag

SEQ ID NO: 4028438 - RNA, 13 nt, Molluscum contagiosum virus
cacacacacacuc

SEQ ID NO: 4028439 - RNA, 10 nt, Molluscum contagiosum virus
cacacacacu

SEQ ID NO: 4028440 - RNA, 15 nt, Molluscum contagiosum virus
cacacucacgcgucc

SEQ ID NO: 4028441 - RNA, 22 nt, Molluscum contagiosum virus
cacacucacgcguccacaaaga

SEQ ID NO: 4028442 - RNA, 12 nt, Molluscum contagiosum virus
cacacucgcucu

SEQ ID NO: 4028443 - RNA, 17 nt, Molluscum contagiosum virus
cacacuugcacgcgcac

SEQ ID NO: 4028444 - RNA, 19 nt, Molluscum contagiosum virus
cacacuugcacgcgcacgc

SEQ ID NO: 4028445 - RNA, 16 nt, Molluscum contagiosum virus
cacacuugcgcguccg

SEQ ID NO: 4028446 - RNA, 21 nt, Molluscum contagiosum virus
cacacuugcgcguucgcaaag

SEQ ID NO: 4028447 - RNA, 13 nt, Molluscum contagiosum virus
cacagcaaaagcu

SEQ ID NO: 4028448 - RNA, 20 nt, Molluscum contagiosum virus
cacagccccugcugcucgcg

SEQ ID NO: 4028449 - RNA, 21 nt, Molluscum contagiosum virus
cacaguccaacccgcggcgcg

SEQ ID NO: 4028450 - RNA, 15 nt, Molluscum contagiosum virus
cacaucggcacugcu

SEQ ID NO: 4028451 - RNA, 18 nt, Molluscum contagiosum virus
cacaucucucagggcagc

SEQ ID NO: 4028452 - RNA, 18 nt, Molluscum contagiosum virus
cacauugcugcugcaggc

SEQ ID NO: 4028453 - RNA, 20 nt, Molluscum contagiosum virus
caccaagaagcggcccugca

SEQ ID NO: 4028454 - RNA, 15 nt, Molluscum contagiosum virus
caccaccagcacgcu

SEQ ID NO: 4028455 - RNA, 15 nt, Molluscum contagiosum virus
caccagcaccagcac

SEQ ID NO: 4028456 - RNA, 17 nt, Molluscum contagiosum virus
caccagcaccagcacaa

SEQ ID NO: 4028457 - RNA, 14 nt, Molluscum contagiosum virus
caccagcagccagg

SEQ ID NO: 4028458 - RNA, 15 nt, Molluscum contagiosum virus
caccagcagccaggc

SEQ ID NO: 4028459 - RNA, 17 nt, Molluscum contagiosum virus
caccagcuccgccggga

SEQ ID NO: 4028460 - RNA, 14 nt, Molluscum contagiosum virus
caccaugcgcacag

SEQ ID NO: 4028461 - RNA, 15 nt, Molluscum contagiosum virus
cacccaccaggaaca

SEQ ID NO: 4028462 - RNA, 22 nt, Molluscum contagiosum virus
caccccgaaaggcacccgcagg

SEQ ID NO: 4028463 - RNA, 13 nt, Molluscum contagiosum virus
cacccgcgcggcu

SEQ ID NO: 4028464 - RNA, 13 nt, Molluscum contagiosum virus
cacccgcgcucga

SEQ ID NO: 4028465 - RNA, 14 nt, Molluscum contagiosum virus
cacccgugcccgcu

SEQ ID NO: 4028466 - RNA, 13 nt, Molluscum contagiosum virus
caccgagcccgcc

SEQ ID NO: 4028467 - RNA, 19 nt, Molluscum contagiosum virus
caccgagcgcuacgacgac

SEQ ID NO: 4028468 - RNA, 15 nt, Molluscum contagiosum virus
caccgcaugggcccu

SEQ ID NO: 4028469 - RNA, 16 nt, Molluscum contagiosum virus
caccgccugcugcagc

SEQ ID NO: 4028470 - RNA, 22 nt, Molluscum contagiosum virus
caccgcgacaugccucgcggcc

SEQ ID NO: 4028471 - RNA, 22 nt, Molluscum contagiosum virus
caccgcggcgcggagcgcuucu

SEQ ID NO: 4028472 - RNA, 12 nt, Molluscum contagiosum virus
caccgcuccgca

SEQ ID NO: 4028473 - RNA, 16 nt, Molluscum contagiosum virus
caccgcuccgcagccg

SEQ ID NO: 4028474 - RNA, 19 nt, Molluscum contagiosum virus
caccggccuuuugucguuc

SEQ ID NO: 4028475 - RNA, 21 nt, Molluscum contagiosum virus
caccggcggguccgcaggcuc

SEQ ID NO: 4028476 - RNA, 23 nt, Molluscum contagiosum virus
caccgggauggucucgcugcugg

SEQ ID NO: 4028477 - RNA, 13 nt, Molluscum contagiosum virus
caccgggcgccgc

SEQ ID NO: 4028478 - RNA, 14 nt, Molluscum contagiosum virus
caccgggcgccgcg

SEQ ID NO: 4028479 - RNA, 20 nt, Molluscum contagiosum virus
caccucaagaagacgcagag

SEQ ID NO: 4028480 - RNA, 19 nt, Molluscum contagiosum virus
caccucaccgcgcacaucu

SEQ ID NO: 4028481 - RNA, 22 nt, Molluscum contagiosum virus
caccucugcgcggcccgcgggc

SEQ ID NO: 4028482 - RNA, 22 nt, Molluscum contagiosum virus
caccugcacgagccggcgccgu

SEQ ID NO: 4028483 - RNA, 18 nt, Molluscum contagiosum virus
caccugcaucgcgccgcc

SEQ ID NO: 4028484 - RNA, 18 nt, Molluscum contagiosum virus
caccugcgcuuccucuac

SEQ ID NO: 4028485 - RNA, 21 nt, Molluscum contagiosum virus
caccuggcgagcgcucugcau

SEQ ID NO: 4028486 - RNA, 20 nt, Molluscum contagiosum virus
caccuuggcgcugcacaguu

SEQ ID NO: 4028487 - RNA, 21 nt, Molluscum contagiosum virus
caccuuucauucgcuggugcg

SEQ ID NO: 4028488 - RNA, 22 nt, Molluscum contagiosum virus
cacgaaggacgcgcuugcgcgg

SEQ ID NO: 4028489 - RNA, 17 nt, Molluscum contagiosum virus
cacgaccgcgcacgcag

SEQ ID NO: 4028490 - RNA, 22 nt, Molluscum contagiosum virus
cacgacggaacguuggcccgca

SEQ ID NO: 4028491 - RNA, 16 nt, Molluscum contagiosum virus
cacgacguacgagugc

SEQ ID NO: 4028492 - RNA, 17 nt, Molluscum contagiosum virus
cacgagauggcugcucu

SEQ ID NO: 4028493 - RNA, 16 nt, Molluscum contagiosum virus
cacgagcacugccugc

SEQ ID NO: 4028494 - RNA, 20 nt, Molluscum contagiosum virus
cacgagcacugccugccgcc

SEQ ID NO: 4028495 - RNA, 21 nt, Molluscum contagiosum virus
cacgagcgaaaacgcgugucu

SEQ ID NO: 4028496 - RNA, 23 nt, Molluscum contagiosum virus
cacgagcgaguugagcaggucgg

SEQ ID NO: 4028497 - RNA, 11 nt, Molluscum contagiosum virus
cacgagcugcu

SEQ ID NO: 4028498 - RNA, 14 nt, Molluscum contagiosum virus
cacgagcugcugcc

SEQ ID NO: 4028499 - RNA, 20 nt, Molluscum contagiosum virus
cacgaggacugggaacccgu

SEQ ID NO: 4028500 - RNA, 20 nt, Molluscum contagiosum virus
cacgagggccuuggcggcgc

SEQ ID NO: 4028501 - RNA, 21 nt, Molluscum contagiosum virus
cacgaggggcaagcucgcgcu

SEQ ID NO: 4028502 - RNA, 17 nt, Molluscum contagiosum virus
cacgagugcuugcgcgg

SEQ ID NO: 4028503 - RNA, 14 nt, Molluscum contagiosum virus
cacgaugcgcucgu

SEQ ID NO: 4028504 - RNA, 20 nt, Molluscum contagiosum virus
cacgcaaaugcgcgcgaacg

SEQ ID NO: 4028505 - RNA, 21 nt, Molluscum contagiosum virus
cacgcaagcuuugugcucgcu

SEQ ID NO: 4028506 - RNA, 20 nt, Molluscum contagiosum virus
cacgcaaggcaugcgcgcag

SEQ ID NO: 4028507 - RNA, 23 nt, Molluscum contagiosum virus
cacgcaaggcaugcgcgcagugc

SEQ ID NO: 4028508 - RNA, 16 nt, Molluscum contagiosum virus
cacgcaaucgcgcgcg

SEQ ID NO: 4028509 - RNA, 19 nt, Molluscum contagiosum virus
cacgcaccgcgacaugccu

SEQ ID NO: 4028510 - RNA, 15 nt, Molluscum contagiosum virus
cacgcacgaccucac

SEQ ID NO: 4028511 - RNA, 17 nt, Molluscum contagiosum virus
cacgcacuugcgcgccu

SEQ ID NO: 4028512 - RNA, 19 nt, Molluscum contagiosum virus
cacgcagcuggcgggcgug

SEQ ID NO: 4028513 - RNA, 20 nt, Molluscum contagiosum virus
cacgccgcagcgcuggagcu

SEQ ID NO: 4028514 - RNA, 19 nt, Molluscum contagiosum virus
cacgccgcucggcacugcu

SEQ ID NO: 4028515 - RNA, 23 nt, Molluscum contagiosum virus
cacgccuuggcaauggcgcgcag

SEQ ID NO: 4028516 - RNA, 22 nt, Molluscum contagiosum virus
ccgguacguacagugcgcgcac

SEQ ID NO: 4028517 - RNA, 12 nt, Molluscum contagiosum virus
ccggugccuggc

SEQ ID NO: 4028518 - RNA, 17 nt, Molluscum contagiosum virus
ccggugcgugcccagca

SEQ ID NO: 4028519 - RNA, 20 nt, Molluscum contagiosum virus
ccggugcgugcccagcaggu

SEQ ID NO: 4028520 - RNA, 13 nt, Molluscum contagiosum virus
ccggugcucgccc

SEQ ID NO: 4028521 - RNA, 17 nt, Molluscum contagiosum virus
ccgguggcgcgcgagcu

SEQ ID NO: 4028522 - RNA, 16 nt, Molluscum contagiosum virus
ccguaagucgaagagg

SEQ ID NO: 4028523 - RNA, 22 nt, Molluscum contagiosum virus
ccguaccccgagggcgcgaccg

SEQ ID NO: 4028524 - RNA, 21 nt, Molluscum contagiosum virus
ccguacgcaacuugugcgccc

SEQ ID NO: 4028525 - RNA, 21 nt, Molluscum contagiosum virus
ccguagugcucaucgugcccg

SEQ ID NO: 4028526 - RNA, 15 nt, Molluscum contagiosum virus
ccgucagccucugug

SEQ ID NO: 4028527 - RNA, 22 nt, Molluscum contagiosum virus
ccgucagggaugccagugcagu

SEQ ID NO: 4028528 - RNA, 15 nt, Molluscum contagiosum virus
ccgucgccgcgcccg

SEQ ID NO: 4028529 - RNA, 13 nt, Molluscum contagiosum virus
ccgucgcgcucga

SEQ ID NO: 4028530 - RNA, 16 nt, Molluscum contagiosum virus
ccgucggggcagggaa

SEQ ID NO: 4028531 - RNA, 12 nt, Molluscum contagiosum virus
ccgucucgcgcu

SEQ ID NO: 4028532 - RNA, 18 nt, Molluscum contagiosum virus
ccgucuugcgcacacacu

SEQ ID NO: 4028533 - RNA, 12 nt, Molluscum contagiosum virus
ccgugcaccucc

SEQ ID NO: 4028534 - RNA, 18 nt, Molluscum contagiosum virus
ccgugccgccggcgccgc

SEQ ID NO: 4028535 - RNA, 23 nt, Molluscum contagiosum virus
ccgugcugcggcaaccgcgcccg

SEQ ID NO: 4028536 - RNA, 13 nt, Molluscum contagiosum virus
ccguggcgcgccg

SEQ ID NO: 4028537 - RNA, 16 nt, Molluscum contagiosum virus
gcggcaaccgcgcccg

SEQ ID NO: 4028538 - RNA, 16 nt, Molluscum contagiosum virus
gcggcaagccgugcuu

SEQ ID NO: 4028539 - RNA, 14 nt, Molluscum contagiosum virus
gcggcaagccuggc

SEQ ID NO: 4028540 - RNA, 20 nt, Molluscum contagiosum virus
gcggcaaucuucgugcgcuc

SEQ ID NO: 4028541 - RNA, 19 nt, Molluscum contagiosum virus
gcggcacgggcucgagcuc

SEQ ID NO: 4028542 - RNA, 15 nt, Molluscum contagiosum virus
gcggcacgucguccg

SEQ ID NO: 4028543 - RNA, 23 nt, Molluscum contagiosum virus
gcggcacguuugcgucugcgagg

SEQ ID NO: 4028544 - RNA, 16 nt, Molluscum contagiosum virus
gcggcagcuaccgcgc

SEQ ID NO: 4028545 - RNA, 16 nt, Molluscum contagiosum virus
gcggcaggcgcugcgc

SEQ ID NO: 4028546 - RNA, 17 nt, Molluscum contagiosum virus
gcggcagugcuggugaa

SEQ ID NO: 4028547 - RNA, 12 nt, Molluscum contagiosum virus
gcggcauccuga

SEQ ID NO: 4028548 - RNA, 18 nt, Molluscum contagiosum virus
gcggccacgcucgcgcgc

SEQ ID NO: 4028549 - RNA, 19 nt, Molluscum contagiosum virus
gcggccacgcucgcgcgca

SEQ ID NO: 4028550 - RNA, 14 nt, Molluscum contagiosum virus
gcggccacucuccc

SEQ ID NO: 4028551 - RNA, 15 nt, Molluscum contagiosum virus
gcggccacucucccg

SEQ ID NO: 4028552 - RNA, 14 nt, Molluscum contagiosum virus
gcggcccgcggcgc

SEQ ID NO: 4028553 - RNA, 13 nt, Molluscum contagiosum virus
gcggcccgcgggc

SEQ ID NO: 4028554 - RNA, 17 nt, Molluscum contagiosum virus
gcggccgagucacgccc

SEQ ID NO: 4028555 - RNA, 23 nt, Molluscum contagiosum virus
gcggccuguucuuccaguggcgc

SEQ ID NO: 4028556 - RNA, 19 nt, Molluscum contagiosum virus
gcggcgacuugcugcggag

SEQ ID NO: 4028557 - RNA, 13 nt, Molluscum contagiosum virus
gcggcgccuugcu

SEQ ID NO: 4028558 - RNA, 14 nt, Molluscum contagiosum virus
gcggcgcgcagcuc

SEQ ID NO: 4028559 - RNA, 14 nt, Molluscum contagiosum virus
gcggcgcgcccagc

SEQ ID NO: 4028560 - RNA, 19 nt, Molluscum contagiosum virus
gcggcgcgccgcccgggaa

SEQ ID NO: 4028561 - RNA, 17 nt, Molluscum contagiosum virus
gcggcgcgcgcugagcg

SEQ ID NO: 4028562 - RNA, 18 nt, Molluscum contagiosum virus
gcggcgcguacucgcgcc

SEQ ID NO: 4028563 - RNA, 14 nt, Molluscum contagiosum virus
gcggcgcgugccgc

SEQ ID NO: 4028564 - RNA, 19 nt, Molluscum contagiosum virus
gcggcgcgugccgcugcgc

SEQ ID NO: 4028565 - RNA, 19 nt, Molluscum contagiosum virus
gcggcgcguuuucgcggcc

SEQ ID NO: 4028566 - RNA, 17 nt, Molluscum contagiosum virus
gcggcgcucguggcgcg

SEQ ID NO: 4028567 - RNA, 23 nt, Molluscum contagiosum virus
gcggcgcucugccaccgcggcgc

SEQ ID NO: 4028568 - RNA, 19 nt, Molluscum contagiosum virus
gcggcgcuugauguccgcg

SEQ ID NO: 4028569 - RNA, 22 nt, Molluscum contagiosum virus
gcggcgcuuucgcccgccgcgc

SEQ ID NO: 4028570 - RNA, 14 nt, Molluscum contagiosum virus
gcggcggagacuga

SEQ ID NO: 4028571 - RNA, 15 nt, Molluscum contagiosum virus
gcggcgggugccgcc

SEQ ID NO: 4028572 - RNA, 12 nt, Molluscum contagiosum virus
gcggcgugcagg

SEQ ID NO: 4028573 - RNA, 16 nt, Molluscum contagiosum virus
gcggcuaagcucugcg

SEQ ID NO: 4028574 - RNA, 15 nt, Molluscum contagiosum virus
gcggcugcccgcgga

SEQ ID NO: 4028575 - RNA, 13 nt, Molluscum contagiosum virus
gcggcugugcccg

SEQ ID NO: 4028576 - RNA, 19 nt, Molluscum contagiosum virus
gcgggacgcgugccuggcu

SEQ ID NO: 4028577 - RNA, 22 nt, Molluscum contagiosum virus
gcgggcacggcuaccacgagca

SEQ ID NO: 4028578 - RNA, 16 nt, Molluscum contagiosum virus
gcgggcacgggcaccg

SEQ ID NO: 4028579 - RNA, 20 nt, Molluscum contagiosum virus
gcgggcacgugcugcugcgg

SEQ ID NO: 4028580 - RNA, 17 nt, Molluscum contagiosum virus
gcgggccaggcacuggc

SEQ ID NO: 4028581 - RNA, 20 nt, Molluscum contagiosum virus
gcgggccaguacuacucggc

SEQ ID NO: 4028582 - RNA, 20 nt, Molluscum contagiosum virus
gcgggcccgccuuuguggac

SEQ ID NO: 4028583 - RNA, 18 nt, Molluscum contagiosum virus
gcgggcccgcgaacgaga

SEQ ID NO: 4028584 - RNA, 19 nt, Molluscum contagiosum virus
gcgggcccgugcucaggcc

SEQ ID NO: 4028585 - RNA, 20 nt, Molluscum contagiosum virus
gcgggccuguccgcgggcgc

SEQ ID NO: 4028586 - RNA, 18 nt, Molluscum contagiosum virus
gcgggcgaaagcgccgcg

SEQ ID NO: 4028587 - RNA, 19 nt, Molluscum contagiosum virus
gcgggcgaaagcgccgcgc

SEQ ID NO: 4028588 - RNA, 14 nt, Molluscum contagiosum virus
gcgggcgcgcgcca

SEQ ID NO: 4028589 - RNA, 16 nt, Molluscum contagiosum virus
gcgggcggcgucgcgc

SEQ ID NO: 4028590 - RNA, 23 nt, Molluscum contagiosum virus
gcggggacucucccgucgccgga

SEQ ID NO: 4028591 - RNA, 21 nt, Molluscum contagiosum virus
gcggggcucguccucgggcgc

SEQ ID NO: 4028592 - RNA, 23 nt, Molluscum contagiosum virus
gcgggugccgccgugggcgccgc

SEQ ID NO: 4028593 - RNA, 17 nt, Molluscum contagiosum virus
gcggucaggccgggcgc

SEQ ID NO: 4028594 - RNA, 19 nt, Molluscum contagiosum virus
gcggucaggccgggcgcgg

SEQ ID NO: 4028595 - RNA, 22 nt, Molluscum contagiosum virus
gcggucuuccagcacugcgcca

SEQ ID NO: 4028596 - RNA, 24 nt, Molluscum contagiosum virus
gcggucuuggcaugcgugcuucac

SEQ ID NO: 4028597 - RNA, 16 nt, Molluscum contagiosum virus
gcggugacuugccgug

SEQ ID NO: 4028598 - RNA, 12 nt, Molluscum contagiosum virus
gcgguggugaaa

SEQ ID NO: 4028599 - RNA, 11 nt, Molluscum contagiosum virus
gcgguggugca

SEQ ID NO: 4028600 - RNA, 21 nt, Molluscum contagiosum virus
gcgguguccuugcgccgccaa

SEQ ID NO: 4028601 - RNA, 20 nt, Molluscum contagiosum virus
gcguaagagcgugaacauac

SEQ ID NO: 4028602 - RNA, 16 nt, Molluscum contagiosum virus
gcguacagcgcgcgug

SEQ ID NO: 4028603 - RNA, 20 nt, Molluscum contagiosum virus
gcguacgcgugcgcuggcgc

SEQ ID NO: 4028604 - RNA, 21 nt, Molluscum contagiosum virus
gcguacucaacgcgauggcgc

SEQ ID NO: 4028605 - RNA, 15 nt, Molluscum contagiosum virus
gcguagcaugcucgu

SEQ ID NO: 4028606 - RNA, 22 nt, Molluscum contagiosum virus
gcguagcggacgaagcugugca

SEQ ID NO: 4028607 - RNA, 15 nt, Molluscum contagiosum virus
gcguaucggagucag

SEQ ID NO: 4028608 - RNA, 18 nt, Molluscum contagiosum virus
gcguaucggagucaggca

SEQ ID NO: 4028609 - RNA, 18 nt, Molluscum contagiosum virus
gcgucacaagcaccgccu

SEQ ID NO: 4028610 - RNA, 17 nt, Molluscum contagiosum virus
gcgucaucgcugcacgc

SEQ ID NO: 4028611 - RNA, 17 nt, Molluscum contagiosum virus
gcguccacgaugcgcuc

SEQ ID NO: 4028612 - RNA, 13 nt, Molluscum contagiosum virus
gcguccgcgcagc

SEQ ID NO: 4028613 - RNA, 13 nt, Molluscum contagiosum virus
gcguccggugcuc

SEQ ID NO: 4028614 - RNA, 20 nt, Molluscum contagiosum virus
gcguccguaagucgaagagg

SEQ ID NO: 4028615 - RNA, 22 nt, Molluscum contagiosum virus
gcguccguaagucgaagagggu

SEQ ID NO: 4028616 - RNA, 17 nt, Molluscum contagiosum virus
gcguccguucacgggca

SEQ ID NO: 4028617 - RNA, 23 nt, Molluscum contagiosum virus
gcguccuucuuugcgugcgccuc

SEQ ID NO: 4028618 - RNA, 14 nt, Molluscum contagiosum virus
acggacgcccuccu

SEQ ID NO: 4028619 - RNA, 12 nt, Molluscum contagiosum virus
acggacgcggcc

SEQ ID NO: 4028620 - RNA, 14 nt, Molluscum contagiosum virus
acggacggcgcacg

SEQ ID NO: 4028621 - RNA, 22 nt, Molluscum contagiosum virus
acggagaucaggcagcugcugc

SEQ ID NO: 4028622 - RNA, 15 nt, Molluscum contagiosum virus
acggagauggacaca

SEQ ID NO: 4028623 - RNA, 23 nt, Molluscum contagiosum virus
acggagcgcgucuauccugucag

SEQ ID NO: 4028624 - RNA, 20 nt, Molluscum contagiosum virus
acggaggucuacaacgagcu

SEQ ID NO: 4028625 - RNA, 12 nt, Molluscum contagiosum virus
acggccgcgcgc

SEQ ID NO: 4028626 - RNA, 16 nt, Molluscum contagiosum virus
acggccggcgccgcgc

SEQ ID NO: 4028627 - RNA, 13 nt, Molluscum contagiosum virus
acggccuucgcgc

SEQ ID NO: 4028628 - RNA, 18 nt, Molluscum contagiosum virus
acggccuucgcgcugccc

SEQ ID NO: 4028629 - RNA, 20 nt, Molluscum contagiosum virus
acggcgacgacagcgacgag

SEQ ID NO: 4028630 - RNA, 16 nt, Molluscum contagiosum virus
acggcgacgagggcgc

SEQ ID NO: 4028631 - RNA, 14 nt, Molluscum contagiosum virus
acggcgcccaggaa

SEQ ID NO: 4028632 - RNA, 22 nt, Molluscum contagiosum virus
acggcgcgcgcgcuagccgccg

SEQ ID NO: 4028633 - RNA, 20 nt, Molluscum contagiosum virus
acggcgcggaucugcgcaca

SEQ ID NO: 4028634 - RNA, 14 nt, Molluscum contagiosum virus
acggcgcugcgcgu

SEQ ID NO: 4028635 - RNA, 16 nt, Molluscum contagiosum virus
acggcgugcuggccag

SEQ ID NO: 4028636 - RNA, 17 nt, Molluscum contagiosum virus
acggcgugcugugccug

SEQ ID NO: 4028637 - RNA, 17 nt, Molluscum contagiosum virus
acggcugcucgcugccu

SEQ ID NO: 4028638 - RNA, 14 nt, Molluscum contagiosum virus
acgggcacgcgcgc

SEQ ID NO: 4028639 - RNA, 19 nt, Molluscum contagiosum virus
acgggcacgcgcgcgccuu

SEQ ID NO: 4028640 - RNA, 17 nt, Molluscum contagiosum virus
acgggcgugcgcagcag

SEQ ID NO: 4028641 - RNA, 20 nt, Molluscum contagiosum virus
acgggcgugcgcagcagcuc

SEQ ID NO: 4028642 - RNA, 14 nt, Molluscum contagiosum virus
acgguccugggcga

SEQ ID NO: 4028643 - RNA, 19 nt, Molluscum contagiosum virus
acggugcaaccgcugcucg

SEQ ID NO: 4028644 - RNA, 13 nt, Molluscum contagiosum virus
acguaaagacggc

SEQ ID NO: 4028645 - RNA, 16 nt, Molluscum contagiosum virus
acguacgagcaggcgc

SEQ ID NO: 4028646 - RNA, 18 nt, Molluscum contagiosum virus
acguccccgaacugcugg

SEQ ID NO: 4028647 - RNA, 14 nt, Molluscum contagiosum virus
acguccuagagcag

SEQ ID NO: 4028648 - RNA, 18 nt, Molluscum contagiosum virus
acguccuugucgaacgac

SEQ ID NO: 4028649 - RNA, 15 nt, Molluscum contagiosum virus
acgucgcgcgcucgc

SEQ ID NO: 4028650 - RNA, 14 nt, Molluscum contagiosum virus
acgucguagcgcuc

SEQ ID NO: 4028651 - RNA, 16 nt, Molluscum contagiosum virus
acgucuccucgcgcac

SEQ ID NO: 4028652 - RNA, 20 nt, Molluscum contagiosum virus
acgucuuccccaagaccugc

SEQ ID NO: 4028653 - RNA, 14 nt, Molluscum contagiosum virus
acgucuucuaccgc

SEQ ID NO: 4028654 - RNA, 16 nt, Molluscum contagiosum virus
acgugaccucgcugcu

SEQ ID NO: 4028655 - RNA, 16 nt, Molluscum contagiosum virus
acgugacgcgccucga

SEQ ID NO: 4028656 - RNA, 17 nt, Molluscum contagiosum virus
acgugcacguggcgcac

SEQ ID NO: 4028657 - RNA, 23 nt, Molluscum contagiosum virus
acgugcagcggcgccacgagcgc

SEQ ID NO: 4028658 - RNA, 20 nt, Molluscum contagiosum virus
acgugccaagaccugggcgu

SEQ ID NO: 4028659 - RNA, 14 nt, Molluscum contagiosum virus
acgugcgcaucccu

SEQ ID NO: 4028660 - RNA, 16 nt, Molluscum contagiosum virus
acgugcuccgaggagg

SEQ ID NO: 4028661 - RNA, 13 nt, Molluscum contagiosum virus
acgugcugcugca

SEQ ID NO: 4028662 - RNA, 18 nt, Molluscum contagiosum virus
acgugcugcugcagaacu

SEQ ID NO: 4028663 - RNA, 15 nt, Molluscum contagiosum virus
acgugcugcugcggc

SEQ ID NO: 4028664 - RNA, 19 nt, Molluscum contagiosum virus
acgugcuucacgaccuggu

SEQ ID NO: 4028665 - RNA, 18 nt, Molluscum contagiosum virus
acgugcuuccccgccauc

SEQ ID NO: 4028666 - RNA, 17 nt, Molluscum contagiosum virus
acgugcuugcgcgcgag

SEQ ID NO: 4028667 - RNA, 23 nt, Molluscum contagiosum virus
acguguacaugaugcccugguga

SEQ ID NO: 4028668 - RNA, 21 nt, Molluscum contagiosum virus
acguugcgcguucagcgcacg

SEQ ID NO: 4028669 - RNA, 16 nt, Molluscum contagiosum virus
acuaagcuaaaagagc

SEQ ID NO: 4028670 - RNA, 19 nt, Molluscum contagiosum virus
acuaccgcaaccagcugcu

SEQ ID NO: 4028671 - RNA, 18 nt, Molluscum contagiosum virus
acuaccuggcggcgcugg

SEQ ID NO: 4028672 - RNA, 20 nt, Molluscum contagiosum virus
acuaccuggcggcgcuggag

SEQ ID NO: 4028673 - RNA, 15 nt, Molluscum contagiosum virus
acuacgcacuggcga

SEQ ID NO: 4028674 - RNA, 14 nt, Molluscum contagiosum virus
acuacgcgcugcgg

SEQ ID NO: 4028675 - RNA, 14 nt, Molluscum contagiosum virus
acuagcacgggcgg

SEQ ID NO: 4028676 - RNA, 21 nt, Molluscum contagiosum virus
acuaugcgucuuccugcugcc

SEQ ID NO: 4028677 - RNA, 20 nt, Molluscum contagiosum virus
acuauguucuucgcagagga

SEQ ID NO: 4028678 - RNA, 12 nt, Molluscum contagiosum virus
acucagcgggca

SEQ ID NO: 4028679 - RNA, 13 nt, Molluscum contagiosum virus
acuccacgcccgg

SEQ ID NO: 4028680 - RNA, 17 nt, Molluscum contagiosum virus
acuccagcgcgcccucg

SEQ ID NO: 4028681 - RNA, 20 nt, Molluscum contagiosum virus
acuccuuugcgagcacugua

SEQ ID NO: 4028682 - RNA, 18 nt, Molluscum contagiosum virus
acucgcgcgcgccgggcc

SEQ ID NO: 4028683 - RNA, 20 nt, Molluscum contagiosum virus
acucgcgcgcgccgggccgc

SEQ ID NO: 4028684 - RNA, 22 nt, Molluscum contagiosum virus
acucgcuacugcaacguggcgc

SEQ ID NO: 4028685 - RNA, 20 nt, Molluscum contagiosum virus
acucgcuggccucugccugc

SEQ ID NO: 4028686 - RNA, 15 nt, Molluscum contagiosum virus
acucggugcucaugc

SEQ ID NO: 4028687 - RNA, 19 nt, Molluscum contagiosum virus
acucggugcucaugcgcgg

SEQ ID NO: 4028688 - RNA, 15 nt, Molluscum contagiosum virus
acucugugaccugcg

SEQ ID NO: 4028689 - RNA, 20 nt, Molluscum contagiosum virus
acucuucccguuccugggca

SEQ ID NO: 4028690 - RNA, 15 nt, Molluscum contagiosum virus
acugaaaagcuaucc

SEQ ID NO: 4028691 - RNA, 14 nt, Molluscum contagiosum virus
acugacugcugccc

SEQ ID NO: 4028692 - RNA, 23 nt, Molluscum contagiosum virus
acugacugcugcccccgccgcgg

SEQ ID NO: 4028693 - RNA, 13 nt, Molluscum contagiosum virus
acugcaacgugag

SEQ ID NO: 4028694 - RNA, 16 nt, Molluscum contagiosum virus
acugcagcagcuccuc

SEQ ID NO: 4028695 - RNA, 20 nt, Molluscum contagiosum virus
acugccaaagcuaugcgcag

SEQ ID NO: 4028696 - RNA, 21 nt, Molluscum contagiosum virus
acugccacgcggagcucgcca

SEQ ID NO: 4028697 - RNA, 11 nt, Molluscum contagiosum virus
acugccgccgc

SEQ ID NO: 4028698 - RNA, 18 nt, Molluscum contagiosum virus
acugccugccgccucgga

SEQ ID NO: 4028699 - RNA, 18 nt, Molluscum contagiosum virus
acugcgacauccacauga

SEQ ID NO: 4028700 - RNA, 15 nt, Molluscum contagiosum virus
acugcgcgcacugcu

SEQ ID NO: 4028701 - RNA, 21 nt, Molluscum contagiosum virus
acugcuacgucgcggcgcacg

SEQ ID NO: 4028702 - RNA, 18 nt, Molluscum contagiosum virus
acugcuagcgacgcggac

SEQ ID NO: 4028703 - RNA, 22 nt, Molluscum contagiosum virus
acugcugcaggcaaagcggggc

SEQ ID NO: 4028704 - RNA, 16 nt, Molluscum contagiosum virus
acuggaagaacaggcc

SEQ ID NO: 4028705 - RNA, 13 nt, Molluscum contagiosum virus
acuggcaccugcg

SEQ ID NO: 4028706 - RNA, 20 nt, Molluscum contagiosum virus
acuggcaccugcggcugcgg

SEQ ID NO: 4028707 - RNA, 16 nt, Molluscum contagiosum virus
acuggcacgcgccgcg

SEQ ID NO: 4028708 - RNA, 18 nt, Molluscum contagiosum virus
acuggcgcccggcgccga

SEQ ID NO: 4028709 - RNA, 16 nt, Molluscum contagiosum virus
acugucgcgcagcugc

SEQ ID NO: 4028710 - RNA, 23 nt, Molluscum contagiosum virus
acugucuuuuccucacgucgcug

SEQ ID NO: 4028711 - RNA, 21 nt, Molluscum contagiosum virus
acuuauuuuuguguuuugugc

SEQ ID NO: 4028712 - RNA, 17 nt, Molluscum contagiosum virus
acuucauccucuaccgc

SEQ ID NO: 4028713 - RNA, 13 nt, Molluscum contagiosum virus
acuucccgaggac

SEQ ID NO: 4028714 - RNA, 14 nt, Molluscum contagiosum virus
acuuccgcaacgag

SEQ ID NO: 4028715 - RNA, 17 nt, Molluscum contagiosum virus
acuuccuugcgcaggac

SEQ ID NO: 4028716 - RNA, 20 nt, Molluscum contagiosum virus
acuucgacgcggugcgcgcg

SEQ ID NO: 4028717 - RNA, 15 nt, Molluscum contagiosum virus
acuugcacgcgcacg

SEQ ID NO: 4028718 - RNA, 19 nt, Molluscum contagiosum virus
acuugcgcguccgcaaagc

SEQ ID NO: 4028719 - RNA, 20 nt, Molluscum contagiosum virus
acuugucaggccggccgugg

SEQ ID NO: 4028720 - RNA, 23 nt, Molluscum contagiosum virus
acuuuggcuacgacggcgacgag

SEQ ID NO: 4028721 - RNA, 18 nt, Molluscum contagiosum virus
cgaagagggucgugcagg

SEQ ID NO: 4028722 - RNA, 21 nt, Molluscum contagiosum virus
cgaagaguggcucacagccgu

SEQ ID NO: 4028723 - RNA, 14 nt, Molluscum contagiosum virus
cgaagcaggcgcca

SEQ ID NO: 4028724 - RNA, 16 nt, Molluscum contagiosum virus
cgaagcccagcuucag

SEQ ID NO: 4028725 - RNA, 16 nt, Molluscum contagiosum virus
cgaagcugcgcuugcg

SEQ ID NO: 4028726 - RNA, 14 nt, Molluscum contagiosum virus
cgaaguccugggcg

SEQ ID NO: 4028727 - RNA, 18 nt, Molluscum contagiosum virus
cgaaguuccugcauuuca

SEQ ID NO: 4028728 - RNA, 20 nt, Molluscum contagiosum virus
cgaaguuggucaacaacacg

SEQ ID NO: 4028729 - RNA, 23 nt, Molluscum contagiosum virus
cgacaacacgcuguugcugcugc

SEQ ID NO: 4028730 - RNA, 12 nt, Molluscum contagiosum virus
cgacaaggaaag

SEQ ID NO: 4028731 - RNA, 17 nt, Molluscum contagiosum virus
cgacacgcgcccgccgc

SEQ ID NO: 4028732 - RNA, 17 nt, Molluscum contagiosum virus
cgacacugugcuggcgc

SEQ ID NO: 4028733 - RNA, 22 nt, Molluscum contagiosum virus
cgacaugcacacgcaccgccug

SEQ ID NO: 4028734 - RNA, 18 nt, Molluscum contagiosum virus
cgacaugccucgcggccc

SEQ ID NO: 4028735 - RNA, 16 nt, Molluscum contagiosum virus
cgacauguacauagcc

SEQ ID NO: 4028736 - RNA, 21 nt, Molluscum contagiosum virus
cgaccugcacgacccucuucg

SEQ ID NO: 4028737 - RNA, 15 nt, Molluscum contagiosum virus
cgaccuggaagccgc

SEQ ID NO: 4028738 - RNA, 23 nt, Molluscum contagiosum virus
cgaccuggaagccgccagccacg

SEQ ID NO: 4028739 - RNA, 15 nt, Molluscum contagiosum virus
cgacgagugcgccgc

SEQ ID NO: 4028740 - RNA, 15 nt, Molluscum contagiosum virus
cgacgccagcgcgcc

SEQ ID NO: 4028741 - RNA, 23 nt, Molluscum contagiosum virus
cgacgccagcgcgcccaccagca

SEQ ID NO: 4028742 - RNA, 15 nt, Molluscum contagiosum virus
cgacgccaucaggaa

SEQ ID NO: 4028743 - RNA, 20 nt, Molluscum contagiosum virus
cgacgccuuguucaccaucc

SEQ ID NO: 4028744 - RNA, 22 nt, Molluscum contagiosum virus
cgacgcgaucuuccgcgacgag

SEQ ID NO: 4028745 - RNA, 22 nt, Molluscum contagiosum virus
cgacgcgcgcggcaagcagcgu

SEQ ID NO: 4028746 - RNA, 18 nt, Molluscum contagiosum virus
cgacgcgcggcagacgcc

SEQ ID NO: 4028747 - RNA, 21 nt, Molluscum contagiosum virus
cgacgcgcguggagcgcgcgg

SEQ ID NO: 4028748 - RNA, 17 nt, Molluscum contagiosum virus
cgacgcggaggucgagc

SEQ ID NO: 4028749 - RNA, 17 nt, Molluscum contagiosum virus
cgacgcgugcauggcac

SEQ ID NO: 4028750 - RNA, 18 nt, Molluscum contagiosum virus
cgacggcgugcuggccag

SEQ ID NO: 4028751 - RNA, 19 nt, Molluscum contagiosum virus
cgacggucacgcaagcuuu

SEQ ID NO: 4028752 - RNA, 21 nt, Molluscum contagiosum virus
cgacgucaaccgggcucucgc

SEQ ID NO: 4028753 - RNA, 17 nt, Molluscum contagiosum virus
cgacguccuagagcaga

SEQ ID NO: 4028754 - RNA, 18 nt, Molluscum contagiosum virus
cgacgugccugccaucua

SEQ ID NO: 4028755 - RNA, 23 nt, Molluscum contagiosum virus
cgacguuuucuuugcgcucauca

SEQ ID NO: 4028756 - RNA, 18 nt, Molluscum contagiosum virus
cgacuagcgugcgcagca

SEQ ID NO: 4028757 - RNA, 20 nt, Molluscum contagiosum virus
cgacuagcgugcgcagcauu

SEQ ID NO: 4028758 - RNA, 19 nt, Molluscum contagiosum virus
cgacucgagcgagcuacgc

SEQ ID NO: 4028759 - RNA, 22 nt, Molluscum contagiosum virus
cgacucggacacguugcagcag

SEQ ID NO: 4028760 - RNA, 19 nt, Molluscum contagiosum virus
cgacucggaugcgcugccg

SEQ ID NO: 4028761 - RNA, 19 nt, Molluscum contagiosum virus
cgacucggugcucaugcgc

SEQ ID NO: 4028762 - RNA, 15 nt, Molluscum contagiosum virus
cgacucucaacgagc

SEQ ID NO: 4028763 - RNA, 16 nt, Molluscum contagiosum virus
cgacucucaacgagcg

SEQ ID NO: 4028764 - RNA, 16 nt, Molluscum contagiosum virus
cgacuucggcgcaacg

SEQ ID NO: 4028765 - RNA, 19 nt, Molluscum contagiosum virus
cgagaaaaagcugucgcgc

SEQ ID NO: 4028766 - RNA, 23 nt, Molluscum contagiosum virus
cgagaaaaagcugucgcgcagca

SEQ ID NO: 4028767 - RNA, 18 nt, Molluscum contagiosum virus
cgagaaagucaugcucgc

SEQ ID NO: 4028768 - RNA, 18 nt, Molluscum contagiosum virus
cgagaccacgcgcgcugc

SEQ ID NO: 4028769 - RNA, 16 nt, Molluscum contagiosum virus
cgagacggaaauguug

SEQ ID NO: 4028770 - RNA, 15 nt, Molluscum contagiosum virus
cgagacucuggaagc

SEQ ID NO: 4028771 - RNA, 23 nt, Molluscum contagiosum virus
cgagacugagugcugagccacaa

SEQ ID NO: 4028772 - RNA, 22 nt, Molluscum contagiosum virus
cgagacugcuacgucgcggcgc

SEQ ID NO: 4028773 - RNA, 23 nt, Molluscum contagiosum virus
cgagacuugugcccauguccuuu

SEQ ID NO: 4028774 - RNA, 14 nt, Molluscum contagiosum virus
cgagagaauggagc

SEQ ID NO: 4028775 - RNA, 16 nt, Molluscum contagiosum virus
cgagcaacaggggccg

SEQ ID NO: 4028776 - RNA, 15 nt, Molluscum contagiosum virus
cgagcaaugcgagca

SEQ ID NO: 4028777 - RNA, 20 nt, Molluscum contagiosum virus
cgagcaauugcugggcacaa

SEQ ID NO: 4028778 - RNA, 16 nt, Molluscum contagiosum virus
cgagcacagcgcgcgg

SEQ ID NO: 4028779 - RNA, 20 nt, Molluscum contagiosum virus
cgagcacccccgcugcacgc

SEQ ID NO: 4028780 - RNA, 21 nt, Molluscum contagiosum virus
cgagcacgccaaccaccacgu

SEQ ID NO: 4028781 - RNA, 14 nt, Molluscum contagiosum virus
cgagcacugcgcgc

SEQ ID NO: 4028782 - RNA, 23 nt, Molluscum contagiosum virus
cgagcagcccgugcgccugccgc

SEQ ID NO: 4028783 - RNA, 14 nt, Molluscum contagiosum virus
cgagcaggcgcagc

SEQ ID NO: 4028784 - RNA, 20 nt, Molluscum contagiosum virus
cgagcaguccgccucgagca

SEQ ID NO: 4028785 - RNA, 13 nt, Molluscum contagiosum virus
cgagccagccagg

SEQ ID NO: 4028786 - RNA, 14 nt, Molluscum contagiosum virus
cgagccagccaggc

SEQ ID NO: 4028787 - RNA, 20 nt, Molluscum contagiosum virus
cgagccagccaggcgccggc

SEQ ID NO: 4028788 - RNA, 22 nt, Molluscum contagiosum virus
cgagcccgggcccgugcccgag

SEQ ID NO: 4028789 - RNA, 17 nt, Molluscum contagiosum virus
cgagccggacgcgcgaa

SEQ ID NO: 4028790 - RNA, 15 nt, Molluscum contagiosum virus
cgagcgaaccgcggc

SEQ ID NO: 4028791 - RNA, 18 nt, Molluscum contagiosum virus
cgagcgaaccgcggcagc

SEQ ID NO: 4028792 - RNA, 16 nt, Molluscum contagiosum virus
cgagcgcaugcgcgcc

SEQ ID NO: 4028793 - RNA, 22 nt, Molluscum contagiosum virus
cgagcgccacuagcaaggcgcc

SEQ ID NO: 4028794 - RNA, 15 nt, Molluscum contagiosum virus
cgagcgccgcgugcg

SEQ ID NO: 4028795 - RNA, 19 nt, Molluscum contagiosum virus
cgagcgccgcucgcacggc

SEQ ID NO: 4028796 - RNA, 14 nt, Molluscum contagiosum virus
cgagcgccugcgag

SEQ ID NO: 4028797 - RNA, 16 nt, Molluscum contagiosum virus
cgagcgcgccgcgcgc

SEQ ID NO: 4028798 - RNA, 20 nt, Molluscum contagiosum virus
cgagcgcggcaacagcacga

SEQ ID NO: 4028799 - RNA, 16 nt, Molluscum contagiosum virus
cgagcgcgucugcucu

SEQ ID NO: 4028800 - RNA, 13 nt, Molluscum contagiosum virus
cgagcgcgugcuc

SEQ ID NO: 4028801 - RNA, 16 nt, Molluscum contagiosum virus
cgagcgcgugucuacc

SEQ ID NO: 4028802 - RNA, 17 nt, Molluscum contagiosum virus
cgagcggagcgggcacg

SEQ ID NO: 4028803 - RNA, 23 nt, Molluscum contagiosum virus
cgagcgggcaaugggcacgcucu

SEQ ID NO: 4028804 - RNA, 22 nt, Molluscum contagiosum virus
cgagcgugaccagugcgugcuc

SEQ ID NO: 4028805 - RNA, 14 nt, Molluscum contagiosum virus
cgagcuacugcgcg

SEQ ID NO: 4028806 - RNA, 15 nt, Molluscum contagiosum virus
cgagcuacugcgcgc

SEQ ID NO: 4028807 - RNA, 13 nt, Molluscum contagiosum virus
cgagcuagugcac

SEQ ID NO: 4028808 - RNA, 22 nt, Molluscum contagiosum virus
cgagcucgccuccuugcccgag

SEQ ID NO: 4028809 - RNA, 21 nt, Molluscum contagiosum virus
cgagcucgcgcgccagcacgc

SEQ ID NO: 4028810 - RNA, 21 nt, Molluscum contagiosum virus
cgagcucuccgaagagcagaa

SEQ ID NO: 4028811 - RNA, 12 nt, Molluscum contagiosum virus
cgagcugccaug

SEQ ID NO: 4028812 - RNA, 14 nt, Molluscum contagiosum virus
cgagcugcggcgcg

SEQ ID NO: 4028813 - RNA, 20 nt, Molluscum contagiosum virus
cgagcugcgugugccggugc

SEQ ID NO: 4028814 - RNA, 20 nt, Molluscum contagiosum virus
cgagcugcuaacaacaugag

SEQ ID NO: 4028815 - RNA, 16 nt, Molluscum contagiosum virus
cgagcugcuagcggca

SEQ ID NO: 4028816 - RNA, 14 nt, Molluscum contagiosum virus
cgagcugcugcgcg

SEQ ID NO: 4028817 - RNA, 14 nt, Molluscum contagiosum virus
cgagcugugcauug

SEQ ID NO: 4028818 - RNA, 17 nt, Molluscum contagiosum virus
cgagcuucgucuucacc

SEQ ID NO: 4028819 - RNA, 22 nt, Molluscum contagiosum virus
cgagcuucgucuucaccugcau

SEQ ID NO: 4028820 - RNA, 14 nt, Molluscum contagiosum virus
cgaggaaacgcagc

SEQ ID NO: 4028821 - RNA, 21 nt, Molluscum contagiosum virus
cgaggaacucuacgacaugcu

SEQ ID NO: 4028822 - RNA, 13 nt, Molluscum contagiosum virus
cgaggagaaagua

SEQ ID NO: 4028823 - RNA, 14 nt, Molluscum contagiosum virus
cgaggagcacggca

SEQ ID NO: 4028824 - RNA, 15 nt, Molluscum contagiosum virus
cgaggagggcguccg

SEQ ID NO: 4028825 - RNA, 16 nt, Molluscum contagiosum virus
cgaggccgcgcucuuc

SEQ ID NO: 4028826 - RNA, 14 nt, Molluscum contagiosum virus
cgaggccggcaagc

SEQ ID NO: 4028827 - RNA, 13 nt, Molluscum contagiosum virus
cgaggccuacagc

SEQ ID NO: 4028828 - RNA, 20 nt, Molluscum contagiosum virus
cgaggccuacagcgcgcugc

SEQ ID NO: 4028829 - RNA, 16 nt, Molluscum contagiosum virus
cgaggccuacgugcug

SEQ ID NO: 4028830 - RNA, 22 nt, Molluscum contagiosum virus
cgaggccuacgugcugcgcacg

SEQ ID NO: 4028831 - RNA, 17 nt, Molluscum contagiosum virus
cgaggccuucgcgcccg

SEQ ID NO: 4028832 - RNA, 19 nt, Molluscum contagiosum virus
cgaggcguccagcggcugc

SEQ ID NO: 4028833 - RNA, 20 nt, Molluscum contagiosum virus
cgagggagccucgcuggugu

SEQ ID NO: 4028834 - RNA, 20 nt, Molluscum contagiosum virus
cgagggccuuggcggcgcgg

SEQ ID NO: 4028835 - RNA, 17 nt, Molluscum contagiosum virus
cgagggcgccgggcgca

SEQ ID NO: 4028836 - RNA, 23 nt, Molluscum contagiosum virus
cgagggcgggcacgugcugcugc

SEQ ID NO: 4028837 - RNA, 23 nt, Molluscum contagiosum virus
cgagguggcacccuggcugcugc

SEQ ID NO: 4028838 - RNA, 21 nt, Molluscum contagiosum virus
cgaguacgcucuccaugcgcg

SEQ ID NO: 4028839 - RNA, 22 nt, Molluscum contagiosum virus
cgaguacgcucuccaugcgcgc

SEQ ID NO: 4028840 - RNA, 14 nt, Molluscum contagiosum virus
cgaguacugcugcg

SEQ ID NO: 4028841 - RNA, 16 nt, Molluscum contagiosum virus
cgaguacugcugcggc

SEQ ID NO: 4028842 - RNA, 15 nt, Molluscum contagiosum virus
cgaguccagcuucuc

SEQ ID NO: 4028843 - RNA, 15 nt, Molluscum contagiosum virus
cgagucgcgggcgcg

SEQ ID NO: 4028844 - RNA, 17 nt, Molluscum contagiosum virus
cgagucucuguaacaag

SEQ ID NO: 4028845 - RNA, 17 nt, Molluscum contagiosum virus
cgagugcgccgcgcccg

SEQ ID NO: 4028846 - RNA, 14 nt, Molluscum contagiosum virus
cgagugcuggagca

SEQ ID NO: 4028847 - RNA, 12 nt, Molluscum contagiosum virus
cgagugugcaug

SEQ ID NO: 4028848 - RNA, 16 nt, Molluscum contagiosum virus
cgagugugcgcgcccc

SEQ ID NO: 4028849 - RNA, 18 nt, Molluscum contagiosum virus
cgagugugugcaucccuc

SEQ ID NO: 4028850 - RNA, 17 nt, Molluscum contagiosum virus
cgauacccuuggcagca

SEQ ID NO: 4028851 - RNA, 15 nt, Molluscum contagiosum virus
cgauccuguccaucu

SEQ ID NO: 4028852 - RNA, 13 nt, Molluscum contagiosum virus
cgaucgcagcagu

SEQ ID NO: 4028853 - RNA, 16 nt, Molluscum contagiosum virus
cgaucgcgcucaggac

SEQ ID NO: 4028854 - RNA, 20 nt, Molluscum contagiosum virus
cgaucgcgucacguccucaa

SEQ ID NO: 4028855 - RNA, 17 nt, Molluscum contagiosum virus
cgaugccaacagacuug

SEQ ID NO: 4028856 - RNA, 20 nt, Molluscum contagiosum virus
cgauggcguggcggauguca

SEQ ID NO: 4028857 - RNA, 13 nt, Molluscum contagiosum virus
cgaugggaggcgg

SEQ ID NO: 4028858 - RNA, 18 nt, Molluscum contagiosum virus
cgaugguggcgcugcugc

SEQ ID NO: 4028859 - RNA, 21 nt, Molluscum contagiosum virus
cgauuaucguggacgagcaga

SEQ ID NO: 4028860 - RNA, 13 nt, Molluscum contagiosum virus
cgauugccccugg

SEQ ID NO: 4028861 - RNA, 20 nt, Molluscum contagiosum virus
cgauugcguguuggcuucug

SEQ ID NO: 4028862 - RNA, 22 nt, Molluscum contagiosum virus
cgcaaaaaacgaaaagccagac

SEQ ID NO: 4028863 - RNA, 12 nt, Molluscum contagiosum virus
cgcaaacacugu

SEQ ID NO: 4028864 - RNA, 15 nt, Molluscum contagiosum virus
cgcaaagccggcccc

SEQ ID NO: 4028865 - RNA, 14 nt, Molluscum contagiosum virus
cgcaacaaggaaag

SEQ ID NO: 4028866 - RNA, 13 nt, Molluscum contagiosum virus
cgcaacacggcgg

SEQ ID NO: 4028867 - RNA, 18 nt, Molluscum contagiosum virus
cgcaaccgcgugcgugca

SEQ ID NO: 4028868 - RNA, 22 nt, Molluscum contagiosum virus
cgcaaccucuuccggaggcagc

SEQ ID NO: 4028869 - RNA, 12 nt, Molluscum contagiosum virus
cgcaacgagguc

SEQ ID NO: 4028870 - RNA, 23 nt, Molluscum contagiosum virus
cgcaacgucgcacuggccugcaa

SEQ ID NO: 4028871 - RNA, 18 nt, Molluscum contagiosum virus
cgcaacuagggagcggca

SEQ ID NO: 4028872 - RNA, 22 nt, Molluscum contagiosum virus
cgcaagaacaaccagacgugcu

SEQ ID NO: 4028873 - RNA, 12 nt, Molluscum contagiosum virus
cgcaagcagcuc

SEQ ID NO: 4028874 - RNA, 19 nt, Molluscum contagiosum virus
cgcaagcccgcgcgcgagc

SEQ ID NO: 4028875 - RNA, 19 nt, Molluscum contagiosum virus
cgcaaggacaccgcgggcg

SEQ ID NO: 4028876 - RNA, 20 nt, Molluscum contagiosum virus
cgcaaggcaugcgcgcagug

SEQ ID NO: 4028877 - RNA, 23 nt, Molluscum contagiosum virus
cgcaaggugugcgcgcugcacgc

SEQ ID NO: 4028878 - RNA, 18 nt, Molluscum contagiosum virus
cgcaagucucccucgcgc

SEQ ID NO: 4028879 - RNA, 20 nt, Molluscum contagiosum virus
cgcaaugcagugcaccagca

SEQ ID NO: 4028880 - RNA, 14 nt, Molluscum contagiosum virus
cgcacaaacgcgcg

SEQ ID NO: 4028881 - RNA, 15 nt, Molluscum contagiosum virus
cgcacaagggcagcu

SEQ ID NO: 4028882 - RNA, 23 nt, Molluscum contagiosum virus
cgcacacgaaucgcucgcggugc

SEQ ID NO: 4028883 - RNA, 20 nt, Molluscum contagiosum virus
cgcacacgagugcccgcgcg

SEQ ID NO: 4028884 - RNA, 18 nt, Molluscum contagiosum virus
cgcacacucgcgcguccg

SEQ ID NO: 4028885 - RNA, 16 nt, Molluscum contagiosum virus
cgcacacuugcgcguu

SEQ ID NO: 4028886 - RNA, 16 nt, Molluscum contagiosum virus
cgcacagucuugcgca

SEQ ID NO: 4028887 - RNA, 10 nt, Molluscum contagiosum virus
cgcaccagug

SEQ ID NO: 4028888 - RNA, 14 nt, Molluscum contagiosum virus
cgcacccgccacga

SEQ ID NO: 4028889 - RNA, 21 nt, Molluscum contagiosum virus
cgcaccgccuggugcugcgcg

SEQ ID NO: 4028890 - RNA, 14 nt, Molluscum contagiosum virus
cgcaccucaccgcg

SEQ ID NO: 4028891 - RNA, 23 nt, Molluscum contagiosum virus
cgcaccuuuggugcagaucucgc

SEQ ID NO: 4028892 - RNA, 15 nt, Molluscum contagiosum virus
cgcacgaccacgcug

SEQ ID NO: 4028893 - RNA, 17 nt, Molluscum contagiosum virus
cgcacgaccacgugcag

SEQ ID NO: 4028894 - RNA, 15 nt, Molluscum contagiosum virus
cgcacgagcugcugc

SEQ ID NO: 4028895 - RNA, 20 nt, Molluscum contagiosum virus
cgcacgauguacuccaccau

SEQ ID NO: 4028896 - RNA, 17 nt, Molluscum contagiosum virus
cgccguuggccaccugg

SEQ ID NO: 4028897 - RNA, 20 nt, Molluscum contagiosum virus
cgccguuucgcaagucuccc

SEQ ID NO: 4028898 - RNA, 15 nt, Molluscum contagiosum virus
cgccucgagcacgcc

SEQ ID NO: 4028899 - RNA, 23 nt, Molluscum contagiosum virus
cgccucgggaaaacgcgcggcag

SEQ ID NO: 4028900 - RNA, 17 nt, Molluscum contagiosum virus
cgccugcacgcgcacuu

SEQ ID NO: 4028901 - RNA, 14 nt, Molluscum contagiosum virus
cgccugcacuacug

SEQ ID NO: 4028902 - RNA, 15 nt, Molluscum contagiosum virus
cgccugccgcgagca

SEQ ID NO: 4028903 - RNA, 20 nt, Molluscum contagiosum virus
cgccuggccgaacugcucug

SEQ ID NO: 4028904 - RNA, 18 nt, Molluscum contagiosum virus
cgccuguaccugcucggg

SEQ ID NO: 4028905 - RNA, 15 nt, Molluscum contagiosum virus
cgccuuccugcuggc

SEQ ID NO: 4028906 - RNA, 22 nt, Molluscum contagiosum virus
cgccuucguggagcccgugcug

SEQ ID NO: 4028907 - RNA, 18 nt, Molluscum contagiosum virus
cgccuucugcaagcugcc

SEQ ID NO: 4028908 - RNA, 18 nt, Molluscum contagiosum virus
cgcgaaacuggacugagc

SEQ ID NO: 4028909 - RNA, 15 nt, Molluscum contagiosum virus
cgcgaaagaacacgg

SEQ ID NO: 4028910 - RNA, 22 nt, Molluscum contagiosum virus
cgcgaacgagaaaugcgcacac

SEQ ID NO: 4028911 - RNA, 16 nt, Molluscum contagiosum virus
cgcgaacgcguccacg

SEQ ID NO: 4028912 - RNA, 20 nt, Molluscum contagiosum virus
cgcgaacgcguccacggcgc

SEQ ID NO: 4028913 - RNA, 19 nt, Molluscum contagiosum virus
cgcgaacucgcggcagugc

SEQ ID NO: 4028914 - RNA, 22 nt, Molluscum contagiosum virus
cgcgaaguuccugcauuucaug

SEQ ID NO: 4028915 - RNA, 20 nt, Molluscum contagiosum virus
cgcgaauuggccgcggagga

SEQ ID NO: 4028916 - RNA, 16 nt, Molluscum contagiosum virus
cgcgacaggggccaca

SEQ ID NO: 4028917 - RNA, 15 nt, Molluscum contagiosum virus
cgcgaccgcaccgag

SEQ ID NO: 4028918 - RNA, 20 nt, Molluscum contagiosum virus
cgcgacgccguccgcgcagc

SEQ ID NO: 4028919 - RNA, 15 nt, Molluscum contagiosum virus
cgcgacgggaaccgu

SEQ ID NO: 4028920 - RNA, 18 nt, Molluscum contagiosum virus
cgcgacuggcacgcgccg

SEQ ID NO: 4028921 - RNA, 17 nt, Molluscum contagiosum virus
cgcgagcaagcgcccgc

SEQ ID NO: 4028922 - RNA, 14 nt, Molluscum contagiosum virus
cgcgagcgcaugcg

SEQ ID NO: 4028923 - RNA, 22 nt, Molluscum contagiosum virus
cgcgagcgcgcccccgagcugc

SEQ ID NO: 4028924 - RNA, 16 nt, Molluscum contagiosum virus
cgcgagcgcgcgcugc

SEQ ID NO: 4028925 - RNA, 13 nt, Molluscum contagiosum virus
cgcgagcgcgggc

SEQ ID NO: 4028926 - RNA, 17 nt, Molluscum contagiosum virus
cgcgagcucgcgucauc

SEQ ID NO: 4028927 - RNA, 14 nt, Molluscum contagiosum virus
cgcgagcugcugcg

SEQ ID NO: 4028928 - RNA, 14 nt, Molluscum contagiosum virus
cgcgagugugcaug

SEQ ID NO: 4028929 - RNA, 14 nt, Molluscum contagiosum virus
cgcgagugugcgug

SEQ ID NO: 4028930 - RNA, 15 nt, Molluscum contagiosum virus
cgcgauggcgccugc

SEQ ID NO: 4028931 - RNA, 15 nt, Molluscum contagiosum virus
cgcgauucugcucuu

SEQ ID NO: 4028932 - RNA, 16 nt, Molluscum contagiosum virus
cgcgcaaccagcuggc

SEQ ID NO: 4028933 - RNA, 15 nt, Molluscum contagiosum virus
cgcgcaagcgcugcu

SEQ ID NO: 4028934 - RNA, 20 nt, Molluscum contagiosum virus
cgcgcaagucaccgcuccgc

SEQ ID NO: 4028935 - RNA, 22 nt, Molluscum contagiosum virus
cgcgcaagugugcgcaucccuc

SEQ ID NO: 4028936 - RNA, 15 nt, Molluscum contagiosum virus
cgcgcaauagcgccc

SEQ ID NO: 4028937 - RNA, 20 nt, Molluscum contagiosum virus
cgcgcacaucggcacugcuc

SEQ ID NO: 4028938 - RNA, 17 nt, Molluscum contagiosum virus
cgcgcaccugcacgagc

SEQ ID NO: 4028939 - RNA, 13 nt, Molluscum contagiosum virus
cgcgcacgcgcgc

SEQ ID NO: 4028940 - RNA, 16 nt, Molluscum contagiosum virus
cgcgcacugcucgcgc

SEQ ID NO: 4028941 - RNA, 20 nt, Molluscum contagiosum virus
cgcgcagaagccaacacgca

SEQ ID NO: 4028942 - RNA, 11 nt, Molluscum contagiosum virus
cgcgcagcagc

SEQ ID NO: 4028943 - RNA, 19 nt, Molluscum contagiosum virus
cgcgcauacgcgccgcgcg

SEQ ID NO: 4028944 - RNA, 16 nt, Molluscum contagiosum virus
cgcgcaugacagccau

SEQ ID NO: 4028945 - RNA, 16 nt, Molluscum contagiosum virus
cgcgcaugaggcggcg

SEQ ID NO: 4028946 - RNA, 15 nt, Molluscum contagiosum virus
cgcgcaugcucgcgc

SEQ ID NO: 4028947 - RNA, 15 nt, Molluscum contagiosum virus
cgcgccagcaguccg

SEQ ID NO: 4028948 - RNA, 22 nt, Molluscum contagiosum virus
cgcgccauggcgagcuagugca

SEQ ID NO: 4028949 - RNA, 18 nt, Molluscum contagiosum virus
cgcgcccaagaagaagca

SEQ ID NO: 4028950 - RNA, 12 nt, Molluscum contagiosum virus
cgcgcccacggg

SEQ ID NO: 4028951 - RNA, 22 nt, Molluscum contagiosum virus
cgcgcccgcgucgcgcgccgcg

SEQ ID NO: 4028952 - RNA, 15 nt, Molluscum contagiosum virus
cgcgcccgcugcgcg

SEQ ID NO: 4028953 - RNA, 20 nt, Molluscum contagiosum virus
cgcgcccugcgcgcgagagc

SEQ ID NO: 4028954 - RNA, 19 nt, Molluscum contagiosum virus
cgcgccgaggacgcgcccg

SEQ ID NO: 4028955 - RNA, 16 nt, Molluscum contagiosum virus
cgcgccgcgccgcacg

SEQ ID NO: 4028956 - RNA, 16 nt, Molluscum contagiosum virus
cgcgccgcgcugcugg

SEQ ID NO: 4028957 - RNA, 14 nt, Molluscum contagiosum virus
cgcgccggccagcg

SEQ ID NO: 4028958 - RNA, 21 nt, Molluscum contagiosum virus
cgcgccggccagcgagucucg

SEQ ID NO: 4028959 - RNA, 20 nt, Molluscum contagiosum virus
cgcgccggggcgcgcgcugc

SEQ ID NO: 4028960 - RNA, 20 nt, Molluscum contagiosum virus
cgcgccucucgaggccggca

SEQ ID NO: 4028961 - RNA, 14 nt, Molluscum contagiosum virus
cgcgccugcgcgag

SEQ ID NO: 4028962 - RNA, 15 nt, Molluscum contagiosum virus
cgcgccugcgcgagc

SEQ ID NO: 4028963 - RNA, 16 nt, Molluscum contagiosum virus
cgcgccugcgcgagca

SEQ ID NO: 4028964 - RNA, 14 nt, Molluscum contagiosum virus
cgcgccugcuggcg

SEQ ID NO: 4028965 - RNA, 18 nt, Molluscum contagiosum virus
cgcgccugcuggcgggga

SEQ ID NO: 4028966 - RNA, 18 nt, Molluscum contagiosum virus
cgcgccuugagcgcgccg

SEQ ID NO: 4028967 - RNA, 21 nt, Molluscum contagiosum virus
cgcgccuugcagcgcagcagc

SEQ ID NO: 4028968 - RNA, 13 nt, Molluscum contagiosum virus
cgcgcgaacgugc

SEQ ID NO: 4028969 - RNA, 15 nt, Molluscum contagiosum virus
cgcgcgaacucucau

SEQ ID NO: 4028970 - RNA, 20 nt, Molluscum contagiosum virus
cgcgcgaacucucaucgagc

SEQ ID NO: 4028971 - RNA, 22 nt, Molluscum contagiosum virus
cgcgcgacgugugcucugugcg

SEQ ID NO: 4028972 - RNA, 22 nt, Molluscum contagiosum virus
cgcgcgagaagucgggcuggcg

SEQ ID NO: 4028973 - RNA, 19 nt, Molluscum contagiosum virus
cgcgcgagcggagcgggca

SEQ ID NO: 4028974 - RNA, 15 nt, Molluscum contagiosum virus
cgcgcgagcugcugc

SEQ ID NO: 4028975 - RNA, 14 nt, Molluscum contagiosum virus
cgcgcgagugugcg

SEQ ID NO: 4028976 - RNA, 16 nt, Molluscum contagiosum virus
cgcgcgcaagcgccgc

SEQ ID NO: 4028977 - RNA, 17 nt, Molluscum contagiosum virus
cgcgcgcaagcgccgcu

SEQ ID NO: 4028978 - RNA, 21 nt, Molluscum contagiosum virus
cgcgcgcaagucgcgcgcugc

SEQ ID NO: 4028979 - RNA, 16 nt, Molluscum contagiosum virus
cgcgcgcacgcgcacg

SEQ ID NO: 4028980 - RNA, 14 nt, Molluscum contagiosum virus
cgcgcgcacugcgg

SEQ ID NO: 4028981 - RNA, 11 nt, Molluscum contagiosum virus
cgcgcgcagca

SEQ ID NO: 4028982 - RNA, 16 nt, Molluscum contagiosum virus
cgcgcgcagcaggugc

SEQ ID NO: 4028983 - RNA, 22 nt, Molluscum contagiosum virus
cgcgcgcagcaggugcacgugc

SEQ ID NO: 4028984 - RNA, 17 nt, Molluscum contagiosum virus
cgcgcgcaggaaagguc

SEQ ID NO: 4028985 - RNA, 17 nt, Molluscum contagiosum virus
cgcgcgcaugcucgcgc

SEQ ID NO: 4028986 - RNA, 12 nt, Molluscum contagiosum virus
cgcgcgccagca

SEQ ID NO: 4028987 - RNA, 22 nt, Molluscum contagiosum virus
cgcgcgccagcaagcucgaugc

SEQ ID NO: 4028988 - RNA, 20 nt, Molluscum contagiosum virus
cgcgcgccagcacgcgcucg

SEQ ID NO: 4028989 - RNA, 21 nt, Molluscum contagiosum virus
cgcgcgccagcuaugcgcccg

SEQ ID NO: 4028990 - RNA, 21 nt, Molluscum contagiosum virus
cgcgcgcccgcugcgcgcucu

SEQ ID NO: 4028991 - RNA, 14 nt, Molluscum contagiosum virus
cgcgcgccgcgggc

SEQ ID NO: 4028992 - RNA, 19 nt, Molluscum contagiosum virus
cgcgcgccgcugucacgcg

SEQ ID NO: 4028993 - RNA, 13 nt, Molluscum contagiosum virus
cgcgcgccgggcc

SEQ ID NO: 4028994 - RNA, 15 nt, Molluscum contagiosum virus
cgcgcgccgucggcc

SEQ ID NO: 4028995 - RNA, 14 nt, Molluscum contagiosum virus
cgcgcgccugcgcg

SEQ ID NO: 4028996 - RNA, 13 nt, Molluscum contagiosum virus
cgcgcgcgccagc

SEQ ID NO: 4028997 - RNA, 14 nt, Molluscum contagiosum virus
cgcgcgcgccgcag

SEQ ID NO: 4028998 - RNA, 13 nt, Molluscum contagiosum virus
cgcgcgcgcgccg

SEQ ID NO: 4028999 - RNA, 16 nt, Molluscum contagiosum virus
cguucacuugcgcgcg

SEQ ID NO: 4029000 - RNA, 20 nt, Molluscum contagiosum virus
cguucacuugcgcgcgugcc

SEQ ID NO: 4029001 - RNA, 19 nt, Molluscum contagiosum virus
cguuccaaaagacagaggc

SEQ ID NO: 4029002 - RNA, 21 nt, Molluscum contagiosum virus
cguucgcaacaaaagagcgcg

SEQ ID NO: 4029003 - RNA, 12 nt, Molluscum contagiosum virus
cguucgcggagc

SEQ ID NO: 4029004 - RNA, 17 nt, Molluscum contagiosum virus
cguugcagcagcacagg

SEQ ID NO: 4029005 - RNA, 16 nt, Molluscum contagiosum virus
cuaaaagagcugcugc

SEQ ID NO: 4029006 - RNA, 18 nt, Molluscum contagiosum virus
cuaagcgcaagccagagc

SEQ ID NO: 4029007 - RNA, 15 nt, Molluscum contagiosum virus
cuacaaaacugaaaa

SEQ ID NO: 4029008 - RNA, 21 nt, Molluscum contagiosum virus
cuacacauuccucggcgcaca

SEQ ID NO: 4029009 - RNA, 13 nt, Molluscum contagiosum virus
cuacaccagcugg

SEQ ID NO: 4029010 - RNA, 18 nt, Molluscum contagiosum virus
cuacacgcacgaccucac

SEQ ID NO: 4029011 - RNA, 19 nt, Molluscum contagiosum virus
cuacacgccgcuggagcac

SEQ ID NO: 4029012 - RNA, 16 nt, Molluscum contagiosum virus
cuacacugucgcgcag

SEQ ID NO: 4029013 - RNA, 20 nt, Molluscum contagiosum virus
cuacaguuccgaucgcgaga

SEQ ID NO: 4029014 - RNA, 15 nt, Molluscum contagiosum virus
cuacaucgacaagca

SEQ ID NO: 4029015 - RNA, 18 nt, Molluscum contagiosum virus
cuaccaacucugugaccu

SEQ ID NO: 4029016 - RNA, 18 nt, Molluscum contagiosum virus
cuaccaagaacagagaaa

SEQ ID NO: 4029017 - RNA, 18 nt, Molluscum contagiosum virus
cuaccacgagcacugccu

SEQ ID NO: 4029018 - RNA, 19 nt, Molluscum contagiosum virus
cuaccacgagcacugccug

SEQ ID NO: 4029019 - RNA, 14 nt, Molluscum contagiosum virus
cuaccgcgcgcgca

SEQ ID NO: 4029020 - RNA, 14 nt, Molluscum contagiosum virus
cuaccugaagcugg

SEQ ID NO: 4029021 - RNA, 15 nt, Molluscum contagiosum virus
cuaccugaagcugga

SEQ ID NO: 4029022 - RNA, 14 nt, Molluscum contagiosum virus
cuaccuggugcugg

SEQ ID NO: 4029023 - RNA, 16 nt, Molluscum contagiosum virus
cuacgagcagcgcuug

SEQ ID NO: 4029024 - RNA, 15 nt, Molluscum contagiosum virus
cuacgaggugcugcg

SEQ ID NO: 4029025 - RNA, 22 nt, Molluscum contagiosum virus
cuacgcaacacggcggugcccg

SEQ ID NO: 4029026 - RNA, 15 nt, Molluscum contagiosum virus
cuacgcagcgcgcgg

SEQ ID NO: 4029027 - RNA, 22 nt, Molluscum contagiosum virus
cuacgcgagcacugcgcgcgcg

SEQ ID NO: 4029028 - RNA, 20 nt, Molluscum contagiosum virus
cuacgcgcgcguaacagcgc

SEQ ID NO: 4029029 - RNA, 22 nt, Molluscum contagiosum virus
cuacgcuccguaaccaugaaga

SEQ ID NO: 4029030 - RNA, 14 nt, Molluscum contagiosum virus
cuacuacacugucg

SEQ ID NO: 4029031 - RNA, 18 nt, Molluscum contagiosum virus
cuacugcaacguggcgcc

SEQ ID NO: 4029032 - RNA, 18 nt, Molluscum contagiosum virus
cuacugggaggacacgcg

SEQ ID NO: 4029033 - RNA, 21 nt, Molluscum contagiosum virus
cuagaaugcguguggugacuc

SEQ ID NO: 4029034 - RNA, 21 nt, Molluscum contagiosum virus
cuagcacguuaaucacgauga

SEQ ID NO: 4029035 - RNA, 22 nt, Molluscum contagiosum virus
cuagcagacaacugcgucucaa

SEQ ID NO: 4029036 - RNA, 21 nt, Molluscum contagiosum virus
cuagcagcgugcgcaccagcu

SEQ ID NO: 4029037 - RNA, 21 nt, Molluscum contagiosum virus
cuagcauuccuucacacagac

SEQ ID NO: 4029038 - RNA, 18 nt, Molluscum contagiosum virus
cuagcccagcacgcgcgg

SEQ ID NO: 4029039 - RNA, 18 nt, Molluscum contagiosum virus
cuagccgugcgcgcacac

SEQ ID NO: 4029040 - RNA, 15 nt, Molluscum contagiosum virus
cuagcgcugcucuac

SEQ ID NO: 4029041 - RNA, 17 nt, Molluscum contagiosum virus
cuagcucgcgcgcggca

SEQ ID NO: 4029042 - RNA, 13 nt, Molluscum contagiosum virus
cuagucagcggcg

SEQ ID NO: 4029043 - RNA, 19 nt, Molluscum contagiosum virus
cuagugccgagcucgccuc

SEQ ID NO: 4029044 - RNA, 20 nt, Molluscum contagiosum virus
cuaucagagacaggggggag

SEQ ID NO: 4029045 - RNA, 14 nt, Molluscum contagiosum virus
cuaugcccagccug

SEQ ID NO: 4029046 - RNA, 22 nt, Molluscum contagiosum virus
cucaacauccaaaccaacguga

SEQ ID NO: 4029047 - RNA, 16 nt, Molluscum contagiosum virus
cucaacucguaggaca

SEQ ID NO: 4029048 - RNA, 17 nt, Molluscum contagiosum virus
cucaacuguugccugga

SEQ ID NO: 4029049 - RNA, 19 nt, Molluscum contagiosum virus
cucaacuguugccuggagg

SEQ ID NO: 4029050 - RNA, 20 nt, Molluscum contagiosum virus
cucaagagccgcuucgggcu

SEQ ID NO: 4029051 - RNA, 17 nt, Molluscum contagiosum virus
cucaagaucguuuugca

SEQ ID NO: 4029052 - RNA, 22 nt, Molluscum contagiosum virus
cucaaggacuaccagcucuucg

SEQ ID NO: 4029053 - RNA, 17 nt, Molluscum contagiosum virus
cucaaucucgcccagca

SEQ ID NO: 4029054 - RNA, 18 nt, Molluscum contagiosum virus
cucacaccuagagcacga

SEQ ID NO: 4029055 - RNA, 13 nt, Molluscum contagiosum virus
cucacagccgugg

SEQ ID NO: 4029056 - RNA, 15 nt, Molluscum contagiosum virus
cucacaucugucccu

SEQ ID NO: 4029057 - RNA, 18 nt, Molluscum contagiosum virus
cucacggcggcgcucaac

SEQ ID NO: 4029058 - RNA, 21 nt, Molluscum contagiosum virus
cucacgugcugaucacgcucg

SEQ ID NO: 4029059 - RNA, 17 nt, Molluscum contagiosum virus
cucacucacaugugcug

SEQ ID NO: 4029060 - RNA, 15 nt, Molluscum contagiosum virus
cucagaaauacaccg

SEQ ID NO: 4029061 - RNA, 13 nt, Molluscum contagiosum virus
cucagaccagagu

SEQ ID NO: 4029062 - RNA, 14 nt, Molluscum contagiosum virus
cucagcaaggaggg

SEQ ID NO: 4029063 - RNA, 21 nt, Molluscum contagiosum virus
cucagcaggcuguguuccagc

SEQ ID NO: 4029064 - RNA, 21 nt, Molluscum contagiosum virus
cucaggacaaagucgcgcgcg

SEQ ID NO: 4029065 - RNA, 21 nt, Molluscum contagiosum virus
cucauggcgcgcaaccagcug

SEQ ID NO: 4029066 - RNA, 18 nt, Molluscum contagiosum virus
cuccaagaagaggccggc

SEQ ID NO: 4029067 - RNA, 14 nt, Molluscum contagiosum virus
cuccaaggucgagc

SEQ ID NO: 4029068 - RNA, 20 nt, Molluscum contagiosum virus
cuccacgucgaucagcuccg

SEQ ID NO: 4029069 - RNA, 15 nt, Molluscum contagiosum virus
cuccagaaucgcuuu

SEQ ID NO: 4029070 - RNA, 10 nt, Molluscum contagiosum virus
cuccagagcc

SEQ ID NO: 4029071 - RNA, 16 nt, Molluscum contagiosum virus
cuccaggaacgcgccg

SEQ ID NO: 4029072 - RNA, 18 nt, Molluscum contagiosum virus
cuccaggaacgcgccgcg

SEQ ID NO: 4029073 - RNA, 17 nt, Molluscum contagiosum virus
cuccagguccuccagcg

SEQ ID NO: 4029074 - RNA, 21 nt, Molluscum contagiosum virus
cucccgcacgcaccgcgacau

SEQ ID NO: 4029075 - RNA, 12 nt, Molluscum contagiosum virus
cucccgcccagc

SEQ ID NO: 4029076 - RNA, 16 nt, Molluscum contagiosum virus
cucccgcccagcgugg

SEQ ID NO: 4029077 - RNA, 21 nt, Molluscum contagiosum virus
cucccgcggccgccacuguug

SEQ ID NO: 4029078 - RNA, 20 nt, Molluscum contagiosum virus
cucccggcggcaagcgagau

SEQ ID NO: 4029079 - RNA, 19 nt, Molluscum contagiosum virus
cucccggcuuccgacaacu

SEQ ID NO: 4029080 - RNA, 15 nt, Molluscum contagiosum virus
cucccgggcucuguc

SEQ ID NO: 4029081 - RNA, 12 nt, Molluscum contagiosum virus
cucccgucgagc

SEQ ID NO: 4029082 - RNA, 16 nt, Molluscum contagiosum virus
cucccgucgagcacga

SEQ ID NO: 4029083 - RNA, 14 nt, Molluscum contagiosum virus
cucccguggcgcgc

SEQ ID NO: 4029084 - RNA, 18 nt, Molluscum contagiosum virus
cuccgacuaccuaggcac

SEQ ID NO: 4029085 - RNA, 20 nt, Molluscum contagiosum virus
cuccggaggccgcucccgcg

SEQ ID NO: 4029086 - RNA, 13 nt, Molluscum contagiosum virus
cuccggcugcucc

SEQ ID NO: 4029087 - RNA, 19 nt, Molluscum contagiosum virus
cuccggcuuagcuggcgcc

SEQ ID NO: 4029088 - RNA, 21 nt, Molluscum contagiosum virus
cuccguacagcuccccgcgca

SEQ ID NO: 4029089 - RNA, 17 nt, Molluscum contagiosum virus
cuccguggugcgcgucu

SEQ ID NO: 4029090 - RNA, 19 nt, Molluscum contagiosum virus
cuccuacacauuccucggc

SEQ ID NO: 4029091 - RNA, 14 nt, Molluscum contagiosum virus
cuccuccaaucugc

SEQ ID NO: 4029092 - RNA, 15 nt, Molluscum contagiosum virus
cuccuccggggcgca

SEQ ID NO: 4029093 - RNA, 16 nt, Molluscum contagiosum virus
cuccucgcacgggcgc

SEQ ID NO: 4029094 - RNA, 15 nt, Molluscum contagiosum virus
cuccucgcucugcuc

SEQ ID NO: 4029095 - RNA, 11 nt, Molluscum contagiosum virus
cuccugaugcc

SEQ ID NO: 4029096 - RNA, 15 nt, Molluscum contagiosum virus
cuccugccgucgccc

SEQ ID NO: 4029097 - RNA, 14 nt, Molluscum contagiosum virus
cuccuuagacaaaa

SEQ ID NO: 4029098 - RNA, 22 nt, Molluscum contagiosum virus
cucgaacgcgcgugcgcgugcc

SEQ ID NO: 4029099 - RNA, 19 nt, Molluscum contagiosum virus
cucgaacuccaggcgcacc

SEQ ID NO: 4029100 - RNA, 16 nt, Molluscum contagiosum virus
cucgacgggcgcagcc

SEQ ID NO: 4029101 - RNA, 15 nt, Molluscum contagiosum virus
cucgacugcguuguc

SEQ ID NO: 4029102 - RNA, 13 nt, Molluscum contagiosum virus
cugcgcgagccgc

SEQ ID NO: 4029103 - RNA, 19 nt, Molluscum contagiosum virus
cugcgcgaguaccugggca

SEQ ID NO: 4029104 - RNA, 16 nt, Molluscum contagiosum virus
cugcgcgcacugcucg

SEQ ID NO: 4029105 - RNA, 20 nt, Molluscum contagiosum virus
cugcgcgcgcggcgcagugc

SEQ ID NO: 4029106 - RNA, 17 nt, Molluscum contagiosum virus
cugcgcgcgcuacugcg

SEQ ID NO: 4029107 - RNA, 18 nt, Molluscum contagiosum virus
cugcgcgcgcucgcgcag

SEQ ID NO: 4029108 - RNA, 13 nt, Molluscum contagiosum virus
cugcgcgcggacu

SEQ ID NO: 4029109 - RNA, 11 nt, Molluscum contagiosum virus
cugcgcggagc

SEQ ID NO: 4029110 - RNA, 15 nt, Molluscum contagiosum virus
cugcgcggcggcagc

SEQ ID NO: 4029111 - RNA, 14 nt, Molluscum contagiosum virus
cugcgcggcgugcg

SEQ ID NO: 4029112 - RNA, 17 nt, Molluscum contagiosum virus
cugcgcgucugugcgcg

SEQ ID NO: 4029113 - RNA, 17 nt, Molluscum contagiosum virus
cugcgcgugcugggccc

SEQ ID NO: 4029114 - RNA, 16 nt, Molluscum contagiosum virus
cugcgcucggcgcgcg

SEQ ID NO: 4029115 - RNA, 14 nt, Molluscum contagiosum virus
cugcgcuucgagcu

SEQ ID NO: 4029116 - RNA, 22 nt, Molluscum contagiosum virus
cugcgcuuugcccccgaggugg

SEQ ID NO: 4029117 - RNA, 18 nt, Molluscum contagiosum virus
cugcggcaaccgcgcccg

SEQ ID NO: 4029118 - RNA, 17 nt, Molluscum contagiosum virus
cugcggcgcgugcugag

SEQ ID NO: 4029119 - RNA, 22 nt, Molluscum contagiosum virus
cugcggcugcuggagcuagcgc

SEQ ID NO: 4029120 - RNA, 14 nt, Molluscum contagiosum virus
cugcggugucaacu

SEQ ID NO: 4029121 - RNA, 16 nt, Molluscum contagiosum virus
cugcgguucacgcccg

SEQ ID NO: 4029122 - RNA, 21 nt, Molluscum contagiosum virus
cugcgugugccggugcugcgg

SEQ ID NO: 4029123 - RNA, 12 nt, Molluscum contagiosum virus
cugcguucgagc

SEQ ID NO: 4029124 - RNA, 14 nt, Molluscum contagiosum virus
cugcguuuccaggg

SEQ ID NO: 4029125 - RNA, 16 nt, Molluscum contagiosum virus
cugcguuuccagggca

SEQ ID NO: 4029126 - RNA, 22 nt, Molluscum contagiosum virus
cugcucaugcgcaagcagcucg

SEQ ID NO: 4029127 - RNA, 18 nt, Molluscum contagiosum virus
cugcucauggucgucucc

SEQ ID NO: 4029128 - RNA, 16 nt, Molluscum contagiosum virus
cugcuccccgccagca

SEQ ID NO: 4029129 - RNA, 18 nt, Molluscum contagiosum virus
cugcuccccgccagcacc

SEQ ID NO: 4029130 - RNA, 14 nt, Molluscum contagiosum virus
cugcucgacgggcg

SEQ ID NO: 4029131 - RNA, 20 nt, Molluscum contagiosum virus
cugcucgacgggcgcagcca

SEQ ID NO: 4029132 - RNA, 18 nt, Molluscum contagiosum virus
cugcucgcgcaucugccg

SEQ ID NO: 4029133 - RNA, 21 nt, Molluscum contagiosum virus
cugcucucggcagcgucgcgg

SEQ ID NO: 4029134 - RNA, 15 nt, Molluscum contagiosum virus
cugcugaagaaggag

SEQ ID NO: 4029135 - RNA, 20 nt, Molluscum contagiosum virus
cugcugcaaagcgcggccgc

SEQ ID NO: 4029136 - RNA, 17 nt, Molluscum contagiosum virus
cugcugcagaacugccu

SEQ ID NO: 4029137 - RNA, 13 nt, Molluscum contagiosum virus
cugcugcgcgccg

SEQ ID NO: 4029138 - RNA, 23 nt, Molluscum contagiosum virus
cugcugcgcuccaugcugccgga

SEQ ID NO: 4029139 - RNA, 16 nt, Molluscum contagiosum virus
cugcugcucgaagccu

SEQ ID NO: 4029140 - RNA, 13 nt, Molluscum contagiosum virus
cugcugcugcaaa

SEQ ID NO: 4029141 - RNA, 14 nt, Molluscum contagiosum virus
cugcuggagcuagc

SEQ ID NO: 4029142 - RNA, 18 nt, Molluscum contagiosum virus
cugcuggcaccgcgcgcg

SEQ ID NO: 4029143 - RNA, 14 nt, Molluscum contagiosum virus
cugcuggcccugcu

SEQ ID NO: 4029144 - RNA, 15 nt, Molluscum contagiosum virus
cugcuggcggggaaa

SEQ ID NO: 4029145 - RNA, 20 nt, Molluscum contagiosum virus
cugcugguggugcuggagcg

SEQ ID NO: 4029146 - RNA, 15 nt, Molluscum contagiosum virus
cugcugguucugcuc

SEQ ID NO: 4029147 - RNA, 16 nt, Molluscum contagiosum virus
cuggaaggagcugggc

SEQ ID NO: 4029148 - RNA, 17 nt, Molluscum contagiosum virus
cuggacggugcuggugc

SEQ ID NO: 4029149 - RNA, 21 nt, Molluscum contagiosum virus
cuggacugagccgcaagcaca

SEQ ID NO: 4029150 - RNA, 17 nt, Molluscum contagiosum virus
cuggacuuccugcugcg

SEQ ID NO: 4029151 - RNA, 22 nt, Molluscum contagiosum virus
cuggagaccugucgugcaaugg

SEQ ID NO: 4029152 - RNA, 16 nt, Molluscum contagiosum virus
cuggaggcaaucuguc

SEQ ID NO: 4029153 - RNA, 17 nt, Molluscum contagiosum virus
cuggagggucacgcgca

SEQ ID NO: 4029154 - RNA, 20 nt, Molluscum contagiosum virus
cuggcaaugagggcgaggcc

SEQ ID NO: 4029155 - RNA, 23 nt, Molluscum contagiosum virus
cuggcaccgggcgccgcggcugc

SEQ ID NO: 4029156 - RNA, 17 nt, Molluscum contagiosum virus
cuggcaccugcggcugc

SEQ ID NO: 4029157 - RNA, 18 nt, Molluscum contagiosum virus
cuggcagugccgggcgcc

SEQ ID NO: 4029158 - RNA, 14 nt, Molluscum contagiosum virus
cuggccaacacuac

SEQ ID NO: 4029159 - RNA, 21 nt, Molluscum contagiosum virus
cuggccaaggacgacaacacu

SEQ ID NO: 4029160 - RNA, 16 nt, Molluscum contagiosum virus
cuggcccugcuugacg

SEQ ID NO: 4029161 - RNA, 14 nt, Molluscum contagiosum virus
cuggccgagcguga

SEQ ID NO: 4029162 - RNA, 22 nt, Molluscum contagiosum virus
cuggccgaugccuaugccgagg

SEQ ID NO: 4029163 - RNA, 21 nt, Molluscum contagiosum virus
cuggccgcauuuucucuggag

SEQ ID NO: 4029164 - RNA, 19 nt, Molluscum contagiosum virus
cuggccgcgauucugcucu

SEQ ID NO: 4029165 - RNA, 14 nt, Molluscum contagiosum virus
cuggccggcucgcu

SEQ ID NO: 4029166 - RNA, 18 nt, Molluscum contagiosum virus
cuggccgugcccgccgac

SEQ ID NO: 4029167 - RNA, 17 nt, Molluscum contagiosum virus
cuggcgagcgcucugca

SEQ ID NO: 4029168 - RNA, 18 nt, Molluscum contagiosum virus
cuggcgagcgcucugcau

SEQ ID NO: 4029169 - RNA, 17 nt, Molluscum contagiosum virus
cuggcgcucgcgcgcac

SEQ ID NO: 4029170 - RNA, 14 nt, Molluscum contagiosum virus
cuggcggagacacu

SEQ ID NO: 4029171 - RNA, 14 nt, Molluscum contagiosum virus
cuggcggcgcacgc

SEQ ID NO: 4029172 - RNA, 14 nt, Molluscum contagiosum virus
cuggcgggcgcggu

SEQ ID NO: 4029173 - RNA, 20 nt, Molluscum contagiosum virus
cuggcggggcuggcagaaga

SEQ ID NO: 4029174 - RNA, 13 nt, Molluscum contagiosum virus
cuggcggugcucu

SEQ ID NO: 4029175 - RNA, 16 nt, Molluscum contagiosum virus
cuggcguggcaaaggc

SEQ ID NO: 4029176 - RNA, 16 nt, Molluscum contagiosum virus
cuggcguugcgcggcg

SEQ ID NO: 4029177 - RNA, 11 nt, Molluscum contagiosum virus
cuggcuccugu

SEQ ID NO: 4029178 - RNA, 19 nt, Molluscum contagiosum virus
cuggcucgcgccugcgcuu

SEQ ID NO: 4029179 - RNA, 22 nt, Molluscum contagiosum virus
cuggcugcugcgcgaccgcacc

SEQ ID NO: 4029180 - RNA, 17 nt, Molluscum contagiosum virus
cugggaggacacgcgca

SEQ ID NO: 4029181 - RNA, 20 nt, Molluscum contagiosum virus
cugggaggacacgcgcacgc

SEQ ID NO: 4029182 - RNA, 17 nt, Molluscum contagiosum virus
cugggauaacaggcgug

SEQ ID NO: 4029183 - RNA, 15 nt, Molluscum contagiosum virus
cugggcacaagcuuu

SEQ ID NO: 4029184 - RNA, 21 nt, Molluscum contagiosum virus
cugggcgcgugcgagcggcgc

SEQ ID NO: 4029185 - RNA, 17 nt, Molluscum contagiosum virus
cugggcgucgugcaccu

SEQ ID NO: 4029186 - RNA, 21 nt, Molluscum contagiosum virus
cugguacgcgcgcgcgcucac

SEQ ID NO: 4029187 - RNA, 17 nt, Molluscum contagiosum virus
cuguaaauggacccgcu

SEQ ID NO: 4029188 - RNA, 23 nt, Molluscum contagiosum virus
cuguaggggagggcggcaagcuu

SEQ ID NO: 4029189 - RNA, 15 nt, Molluscum contagiosum virus
cugucaagacgggca

SEQ ID NO: 4029190 - RNA, 23 nt, Molluscum contagiosum virus
cuguccaaggugaacgaccucaa

SEQ ID NO: 4029191 - RNA, 16 nt, Molluscum contagiosum virus
cugucccuugauccag

SEQ ID NO: 4029192 - RNA, 22 nt, Molluscum contagiosum virus
cuguccgcggaugcaggcacug

SEQ ID NO: 4029193 - RNA, 18 nt, Molluscum contagiosum virus
cuguccgcgggcgcacgc

SEQ ID NO: 4029194 - RNA, 21 nt, Molluscum contagiosum virus
cuguccgcgggcgcgggccug

SEQ ID NO: 4029195 - RNA, 21 nt, Molluscum contagiosum virus
cugucgccgcgggcugggaaa

SEQ ID NO: 4029196 - RNA, 15 nt, Molluscum contagiosum virus
cugucgugcaauggc

SEQ ID NO: 4029197 - RNA, 19 nt, Molluscum contagiosum virus
cugugcccuggaagcuucc

SEQ ID NO: 4029198 - RNA, 13 nt, Molluscum contagiosum virus
cugugccugcaag

SEQ ID NO: 4029199 - RNA, 21 nt, Molluscum contagiosum virus
cugugcgcgaggagacguaga

SEQ ID NO: 4029200 - RNA, 14 nt, Molluscum contagiosum virus
cugugcggcacgcc

SEQ ID NO: 4029201 - RNA, 14 nt, Molluscum contagiosum virus
cugugcucgcgccu

SEQ ID NO: 4029202 - RNA, 18 nt, Molluscum contagiosum virus
cuguucggcaugcagcgc

SEQ ID NO: 4029203 - RNA, 14 nt, Molluscum contagiosum virus
cuguugcugcugcc

SEQ ID NO: 4029204 - RNA, 20 nt, Molluscum contagiosum virus
cuuacugcagcagcuccagc

SEQ ID NO: 4029205 - RNA, 12 nt, Molluscum contagiosum virus
gaaguggccguc

SEQ ID NO: 4029206 - RNA, 18 nt, Molluscum contagiosum virus
gaaguggccgucgcgagc

SEQ ID NO: 4029207 - RNA, 14 nt, Molluscum contagiosum virus
gaaucacggccagu

SEQ ID NO: 4029208 - RNA, 17 nt, Molluscum contagiosum virus
gacaacucgcgggcaug

SEQ ID NO: 4029209 - RNA, 21 nt, Molluscum contagiosum virus
gacaacugcgucucaagacaa

SEQ ID NO: 4029210 - RNA, 15 nt, Molluscum contagiosum virus
gacaagacaacacuc

SEQ ID NO: 4029211 - RNA, 22 nt, Molluscum contagiosum virus
gacaagcgcgucugcaucgugg

SEQ ID NO: 4029212 - RNA, 16 nt, Molluscum contagiosum virus
gacaaggaaaggcacc

SEQ ID NO: 4029213 - RNA, 22 nt, Molluscum contagiosum virus
gacaaucucugcgccgcgcgcg

SEQ ID NO: 4029214 - RNA, 15 nt, Molluscum contagiosum virus
gacaccagcggcagg

SEQ ID NO: 4029215 - RNA, 12 nt, Molluscum contagiosum virus
gacaccgcgggc

SEQ ID NO: 4029216 - RNA, 19 nt, Molluscum contagiosum virus
gacacgagcaccgaacaaa

SEQ ID NO: 4029217 - RNA, 14 nt, Molluscum contagiosum virus
gacacgagggccuu

SEQ ID NO: 4029218 - RNA, 22 nt, Molluscum contagiosum virus
gacacgagggccuuggcggcgc

SEQ ID NO: 4029219 - RNA, 23 nt, Molluscum contagiosum virus
gacacgaggucacucgcuacugc

SEQ ID NO: 4029220 - RNA, 16 nt, Molluscum contagiosum virus
gacacgcgugcaugcg

SEQ ID NO: 4029221 - RNA, 19 nt, Molluscum contagiosum virus
gacacgcugcgcgugcugg

SEQ ID NO: 4029222 - RNA, 23 nt, Molluscum contagiosum virus
gacacgcugcgcgugcugggccc

SEQ ID NO: 4029223 - RNA, 15 nt, Molluscum contagiosum virus
gacacguacacgcug

SEQ ID NO: 4029224 - RNA, 14 nt, Molluscum contagiosum virus
gacacguugcacug

SEQ ID NO: 4029225 - RNA, 12 nt, Molluscum contagiosum virus
gacacugugcug

SEQ ID NO: 4029226 - RNA, 23 nt, Molluscum contagiosum virus
gacagcaaacagccuguguugcg

SEQ ID NO: 4029227 - RNA, 15 nt, Molluscum contagiosum virus
gacagcauccuggag

SEQ ID NO: 4029228 - RNA, 14 nt, Molluscum contagiosum virus
gacaucaucgcgga

SEQ ID NO: 4029229 - RNA, 12 nt, Molluscum contagiosum virus
gacaugccucgc

SEQ ID NO: 4029230 - RNA, 13 nt, Molluscum contagiosum virus
gacaugcgcacgc

SEQ ID NO: 4029231 - RNA, 22 nt, Molluscum contagiosum virus
gacaugcugugcggcacgccug

SEQ ID NO: 4029232 - RNA, 13 nt, Molluscum contagiosum virus
gacauggagcgca

SEQ ID NO: 4029233 - RNA, 13 nt, Molluscum contagiosum virus
gaccaccagcacc

SEQ ID NO: 4029234 - RNA, 23 nt, Molluscum contagiosum virus
gaccagauccgggcgcugcaccg

SEQ ID NO: 4029235 - RNA, 14 nt, Molluscum contagiosum virus
gaccagcugguccu

SEQ ID NO: 4029236 - RNA, 15 nt, Molluscum contagiosum virus
gaccccgagcugcgg

SEQ ID NO: 4029237 - RNA, 21 nt, Molluscum contagiosum virus
gacccgccggugcuugggcuc

SEQ ID NO: 4029238 - RNA, 16 nt, Molluscum contagiosum virus
gacccucuucgacuua

SEQ ID NO: 4029239 - RNA, 17 nt, Molluscum contagiosum virus
gaccgcagacaaagaca

SEQ ID NO: 4029240 - RNA, 20 nt, Molluscum contagiosum virus
gaccucccgcccagcguggc

SEQ ID NO: 4029241 - RNA, 16 nt, Molluscum contagiosum virus
gaccucccggcggcaa

SEQ ID NO: 4029242 - RNA, 22 nt, Molluscum contagiosum virus
gaccucgcgcuuccggcggcuc

SEQ ID NO: 4029243 - RNA, 14 nt, Molluscum contagiosum virus
gaccugcacgaccc

SEQ ID NO: 4029244 - RNA, 15 nt, Molluscum contagiosum virus
gaccugcacgacccu

SEQ ID NO: 4029245 - RNA, 17 nt, Molluscum contagiosum virus
gaccugcugcgagagca

SEQ ID NO: 4029246 - RNA, 22 nt, Molluscum contagiosum virus
gaccugucgugcaauggcaggu

SEQ ID NO: 4029247 - RNA, 18 nt, Molluscum contagiosum virus
gaccuuccuccagggcac

SEQ ID NO: 4029248 - RNA, 21 nt, Molluscum contagiosum virus
gaccuuggcgcgccgcugccc

SEQ ID NO: 4029249 - RNA, 13 nt, Molluscum contagiosum virus
gacgaagcugugc

SEQ ID NO: 4029250 - RNA, 16 nt, Molluscum contagiosum virus
gacgacgccgagcccg

SEQ ID NO: 4029251 - RNA, 14 nt, Molluscum contagiosum virus
gacgacggcugcuc

SEQ ID NO: 4029252 - RNA, 18 nt, Molluscum contagiosum virus
gacgacuucggcgcaacg

SEQ ID NO: 4029253 - RNA, 20 nt, Molluscum contagiosum virus
gacgagaccacgguccuggg

SEQ ID NO: 4029254 - RNA, 15 nt, Molluscum contagiosum virus
gacgagagggcgcgc

SEQ ID NO: 4029255 - RNA, 18 nt, Molluscum contagiosum virus
gacgagauggucacgcgc

SEQ ID NO: 4029256 - RNA, 18 nt, Molluscum contagiosum virus
gacgagcagagccgggac

SEQ ID NO: 4029257 - RNA, 20 nt, Molluscum contagiosum virus
gacgagcagagccgggacgc

SEQ ID NO: 4029258 - RNA, 14 nt, Molluscum contagiosum virus
gacgagcugcuucg

SEQ ID NO: 4029259 - RNA, 16 nt, Molluscum contagiosum virus
gacgagugcgccgcgc

SEQ ID NO: 4029260 - RNA, 15 nt, Molluscum contagiosum virus
gacgcacuagacugu

SEQ ID NO: 4029261 - RNA, 19 nt, Molluscum contagiosum virus
gacgcaggaugcuggggcu

SEQ ID NO: 4029262 - RNA, 20 nt, Molluscum contagiosum virus
gacgcauagucaucaaagca

SEQ ID NO: 4029263 - RNA, 16 nt, Molluscum contagiosum virus
gacgcccuccucgacc

SEQ ID NO: 4029264 - RNA, 20 nt, Molluscum contagiosum virus
gacgccgacaacagugaaga

SEQ ID NO: 4029265 - RNA, 19 nt, Molluscum contagiosum virus
gacgccgauguccugcgga

SEQ ID NO: 4029266 - RNA, 16 nt, Molluscum contagiosum virus
gacgccggcgcccgcg

SEQ ID NO: 4029267 - RNA, 23 nt, Molluscum contagiosum virus
gacgccgucgaugaaggcgcggc

SEQ ID NO: 4029268 - RNA, 15 nt, Molluscum contagiosum virus
gacgcgaacugcccg

SEQ ID NO: 4029269 - RNA, 19 nt, Molluscum contagiosum virus
gacgcgacgccguccgcgc

SEQ ID NO: 4029270 - RNA, 15 nt, Molluscum contagiosum virus
gacgcgcgagugugc

SEQ ID NO: 4029271 - RNA, 20 nt, Molluscum contagiosum virus
gacgcgcguggagcgcgcgg

SEQ ID NO: 4029272 - RNA, 24 nt, Molluscum contagiosum virus
gacgcgcguggagcgcgcggacgc

SEQ ID NO: 4029273 - RNA, 22 nt, Molluscum contagiosum virus
gacgcggaugccacgcagcugg

SEQ ID NO: 4029274 - RNA, 23 nt, Molluscum contagiosum virus
gacgcggccgcggagggaggcuc

SEQ ID NO: 4029275 - RNA, 18 nt, Molluscum contagiosum virus
gacgcgggccuguccgcg

SEQ ID NO: 4029276 - RNA, 13 nt, Molluscum contagiosum virus
gacgcggugcgcg

SEQ ID NO: 4029277 - RNA, 19 nt, Molluscum contagiosum virus
gacgcguacauccgcgagc

SEQ ID NO: 4029278 - RNA, 18 nt, Molluscum contagiosum virus
gacgcgugcauggcacgc

SEQ ID NO: 4029279 - RNA, 23 nt, Molluscum contagiosum virus
gacgcgugcauggcacgcgagca

SEQ ID NO: 4029280 - RNA, 18 nt, Molluscum contagiosum virus
gacgcguucuccaggaac

SEQ ID NO: 4029281 - RNA, 18 nt, Molluscum contagiosum virus
gacgcuuucguccgccgc

SEQ ID NO: 4029282 - RNA, 17 nt, Molluscum contagiosum virus
gacggaaccguggugcg

SEQ ID NO: 4029283 - RNA, 17 nt, Molluscum contagiosum virus
gacggaauuugcggcgc

SEQ ID NO: 4029284 - RNA, 18 nt, Molluscum contagiosum virus
gacggacgaagagacgcc

SEQ ID NO: 4029285 - RNA, 21 nt, Molluscum contagiosum virus
gacggacuucuugcgcggcgg

SEQ ID NO: 4029286 - RNA, 16 nt, Molluscum contagiosum virus
gacggaggucugcuuu

SEQ ID NO: 4029287 - RNA, 16 nt, Molluscum contagiosum virus
gacggcaguguccugg

SEQ ID NO: 4029288 - RNA, 22 nt, Molluscum contagiosum virus
gacggcccccuuacgcuacagc

SEQ ID NO: 4029289 - RNA, 15 nt, Molluscum contagiosum virus
gacggcgacgacagc

SEQ ID NO: 4029290 - RNA, 14 nt, Molluscum contagiosum virus
gacggcgugcgccg

SEQ ID NO: 4029291 - RNA, 23 nt, Molluscum contagiosum virus
gacggcugguguuaccgggucgc

SEQ ID NO: 4029292 - RNA, 19 nt, Molluscum contagiosum virus
gacggcuucauccgcgcgc

SEQ ID NO: 4029293 - RNA, 15 nt, Molluscum contagiosum virus
gacgggaacgagguc

SEQ ID NO: 4029294 - RNA, 22 nt, Molluscum contagiosum virus
gacgggagagguugcgcggggc

SEQ ID NO: 4029295 - RNA, 15 nt, Molluscum contagiosum virus
gacgggcacgagcac

SEQ ID NO: 4029296 - RNA, 22 nt, Molluscum contagiosum virus
gacgggccccuguuggccccgc

SEQ ID NO: 4029297 - RNA, 19 nt, Molluscum contagiosum virus
gacggucguccuggagccu

SEQ ID NO: 4029298 - RNA, 12 nt, Molluscum contagiosum virus
gacggugcugcg

SEQ ID NO: 4029299 - RNA, 15 nt, Molluscum contagiosum virus
gacggugcugcgcac

SEQ ID NO: 4029300 - RNA, 16 nt, Molluscum contagiosum virus
gacguacgagcaggcg

SEQ ID NO: 4029301 - RNA, 17 nt, Molluscum contagiosum virus
gacguacgagugcugga

SEQ ID NO: 4029302 - RNA, 12 nt, Molluscum contagiosum virus
gacguagagcag

SEQ ID NO: 4029303 - RNA, 22 nt, Molluscum contagiosum virus
gacgucgcggccacgcacucgc

SEQ ID NO: 4029304 - RNA, 18 nt, Molluscum contagiosum virus
gacgugcccuacgcgcgc

SEQ ID NO: 4029305 - RNA, 14 nt, Molluscum contagiosum virus
gacgugcgcgcugc

SEQ ID NO: 4029306 - RNA, 14 nt, Molluscum contagiosum virus
gacgugcggcacgc

SEQ ID NO: 4029307 - RNA, 12 nt, Molluscum contagiosum virus
gagguggccaag

SEQ ID NO: 4029308 - RNA, 16 nt, Molluscum contagiosum virus
gaguacgacgcggagg

SEQ ID NO: 4029309 - RNA, 21 nt, Molluscum contagiosum virus
gaguacgacgguuuccgcgcc

SEQ ID NO: 4029310 - RNA, 22 nt, Molluscum contagiosum virus
gagucacgaccgacccaucgga

SEQ ID NO: 4029311 - RNA, 16 nt, Molluscum contagiosum virus
gagucgagcacgcgcg

SEQ ID NO: 4029312 - RNA, 14 nt, Molluscum contagiosum virus
gagucgcgccucga

SEQ ID NO: 4029313 - RNA, 12 nt, Molluscum contagiosum virus
gagugacgccuc

SEQ ID NO: 4029314 - RNA, 13 nt, Molluscum contagiosum virus
gaguguuccccaa

SEQ ID NO: 4029315 - RNA, 16 nt, Molluscum contagiosum virus
gaguugcgcgagaacu

SEQ ID NO: 4029316 - RNA, 22 nt, Molluscum contagiosum virus
gaguuugcaaguucgcugcugg

SEQ ID NO: 4029317 - RNA, 14 nt, Molluscum contagiosum virus
gauaaaagcacagu

SEQ ID NO: 4029318 - RNA, 20 nt, Molluscum contagiosum virus
gauacccuuggcagcaacug

SEQ ID NO: 4029319 - RNA, 23 nt, Molluscum contagiosum virus
gauagcuuuucaguuuuguccuc

SEQ ID NO: 4029320 - RNA, 14 nt, Molluscum contagiosum virus
gauaggacaugacu

SEQ ID NO: 4029321 - RNA, 16 nt, Molluscum contagiosum virus
gaucacaaguccgcgg

SEQ ID NO: 4029322 - RNA, 16 nt, Molluscum contagiosum virus
gaucacgaugugcgcg

SEQ ID NO: 4029323 - RNA, 15 nt, Molluscum contagiosum virus
gaucacggcgugcgc

SEQ ID NO: 4029324 - RNA, 19 nt, Molluscum contagiosum virus
gaucauggcgccgcugcgg

SEQ ID NO: 4029325 - RNA, 13 nt, Molluscum contagiosum virus
gauccgggcgcug

SEQ ID NO: 4029326 - RNA, 22 nt, Molluscum contagiosum virus
gauccuccggaugaacagcuuc

SEQ ID NO: 4029327 - RNA, 14 nt, Molluscum contagiosum virus
gaucgacgaggacc

SEQ ID NO: 4029328 - RNA, 14 nt, Molluscum contagiosum virus
gaucgcgagaacgc

SEQ ID NO: 4029329 - RNA, 19 nt, Molluscum contagiosum virus
gaucguuccuggccaagga

SEQ ID NO: 4029330 - RNA, 22 nt, Molluscum contagiosum virus
gaucuccacgucgaucagcucc

SEQ ID NO: 4029331 - RNA, 21 nt, Molluscum contagiosum virus
gaucucgcgcacgaccacgug

SEQ ID NO: 4029332 - RNA, 16 nt, Molluscum contagiosum virus
gaugaacgcgcugcgc

SEQ ID NO: 4029333 - RNA, 16 nt, Molluscum contagiosum virus
gaugaaguuggucacc

SEQ ID NO: 4029334 - RNA, 17 nt, Molluscum contagiosum virus
gaugacgggcacgcuca

SEQ ID NO: 4029335 - RNA, 18 nt, Molluscum contagiosum virus
gaugaguaccgcgggcgc

SEQ ID NO: 4029336 - RNA, 15 nt, Molluscum contagiosum virus
gaugcaggcacugcc

SEQ ID NO: 4029337 - RNA, 17 nt, Molluscum contagiosum virus
gaugcucaagcacugcc

SEQ ID NO: 4029338 - RNA, 21 nt, Molluscum contagiosum virus
gaugcugaacgaucucugacc

SEQ ID NO: 4029339 - RNA, 13 nt, Molluscum contagiosum virus
gaugcuggggcuc

SEQ ID NO: 4029340 - RNA, 14 nt, Molluscum contagiosum virus
gauggacgccagcu

SEQ ID NO: 4029341 - RNA, 13 nt, Molluscum contagiosum virus
gauggcguggcgg

SEQ ID NO: 4029342 - RNA, 14 nt, Molluscum contagiosum virus
gauggcucgcgggc

SEQ ID NO: 4029343 - RNA, 19 nt, Molluscum contagiosum virus
gaugguggcgcugcugccc

SEQ ID NO: 4029344 - RNA, 18 nt, Molluscum contagiosum virus
gauguacgcgugcaggaa

SEQ ID NO: 4029345 - RNA, 20 nt, Molluscum contagiosum virus
gaugucgucgaagcccagcu

SEQ ID NO: 4029346 - RNA, 17 nt, Molluscum contagiosum virus
gauuccgucccccgcgg

SEQ ID NO: 4029347 - RNA, 22 nt, Molluscum contagiosum virus
gauucggaggcggagcugcccg

SEQ ID NO: 4029348 - RNA, 23 nt, Molluscum contagiosum virus
gauucgugcucguguugugccug

SEQ ID NO: 4029349 - RNA, 15 nt, Molluscum contagiosum virus
gauugcccgcgcgcg

SEQ ID NO: 4029350 - RNA, 15 nt, Molluscum contagiosum virus
gauuguagagacgcu

SEQ ID NO: 4029351 - RNA, 11 nt, Molluscum contagiosum virus
gcaaacgcuga

SEQ ID NO: 4029352 - RNA, 16 nt, Molluscum contagiosum virus
gcaaacgcugacggcg

SEQ ID NO: 4029353 - RNA, 18 nt, Molluscum contagiosum virus
gcaaacgcugacggcgcu

SEQ ID NO: 4029354 - RNA, 17 nt, Molluscum contagiosum virus
gcaaagcggggcgcgcg

SEQ ID NO: 4029355 - RNA, 19 nt, Molluscum contagiosum virus
gcaaaggcccgcgagcacg

SEQ ID NO: 4029356 - RNA, 20 nt, Molluscum contagiosum virus
gcaaaugcgucccagcagcu

SEQ ID NO: 4029357 - RNA, 16 nt, Molluscum contagiosum virus
gcaacaaaagagcgcg

SEQ ID NO: 4029358 - RNA, 16 nt, Molluscum contagiosum virus
gcaacaaggaaaggca

SEQ ID NO: 4029359 - RNA, 22 nt, Molluscum contagiosum virus
gcaacaaggaaaggcaccugca

SEQ ID NO: 4029360 - RNA, 20 nt, Molluscum contagiosum virus
gcaaccagcuggcgcccgcg

SEQ ID NO: 4029361 - RNA, 19 nt, Molluscum contagiosum virus
gcaacgcacaaaacacaaa

SEQ ID NO: 4029362 - RNA, 12 nt, Molluscum contagiosum virus
gcaacguggcgc

SEQ ID NO: 4029363 - RNA, 15 nt, Molluscum contagiosum virus
gcaacguggcgccgc

SEQ ID NO: 4029364 - RNA, 16 nt, Molluscum contagiosum virus
gcaacucgcgcugcag

SEQ ID NO: 4029365 - RNA, 18 nt, Molluscum contagiosum virus
gcaagacccagcaaggcc

SEQ ID NO: 4029366 - RNA, 14 nt, Molluscum contagiosum virus
gcaagcccagcagc

SEQ ID NO: 4029367 - RNA, 13 nt, Molluscum contagiosum virus
gcaagcgcaagcc

SEQ ID NO: 4029368 - RNA, 13 nt, Molluscum contagiosum virus
acaaagucgcgcg

SEQ ID NO: 4029369 - RNA, 20 nt, Molluscum contagiosum virus
ucgccuccuugcccgaggag

SEQ ID NO: 4029370 - RNA, 21 nt, Molluscum contagiosum virus
ucgccuucuugcuggcgcucg

SEQ ID NO: 4029371 - RNA, 14 nt, Molluscum contagiosum virus
ucgcgaacgcgucc

SEQ ID NO: 4029372 - RNA, 13 nt, Molluscum contagiosum virus
ucgcgaccuggcg

SEQ ID NO: 4029373 - RNA, 18 nt, Molluscum contagiosum virus
ucgcgacgacgagcacua

SEQ ID NO: 4029374 - RNA, 17 nt, Molluscum contagiosum virus
ucgcgcacagaaagcca

SEQ ID NO: 4029375 - RNA, 14 nt, Molluscum contagiosum virus
ucgcgcacgcgcac

SEQ ID NO: 4029376 - RNA, 13 nt, Molluscum contagiosum virus
ucgcgccugcgcu

SEQ ID NO: 4029377 - RNA, 17 nt, Molluscum contagiosum virus
ucgcgcgcaccugcacg

SEQ ID NO: 4029378 - RNA, 12 nt, Molluscum contagiosum virus
ucgcgcgccagc

SEQ ID NO: 4029379 - RNA, 14 nt, Molluscum contagiosum virus
ucgcgcgccgcaaa

SEQ ID NO: 4029380 - RNA, 12 nt, Molluscum contagiosum virus
ucgcgcgccgcg

SEQ ID NO: 4029381 - RNA, 22 nt, Molluscum contagiosum virus
ucgcgcgccgcgcuggcgcgcg

SEQ ID NO: 4029382 - RNA, 15 nt, Molluscum contagiosum virus
ucgcgcgccugcgcg

SEQ ID NO: 4029383 - RNA, 11 nt, Molluscum contagiosum virus
ucgcgcgcgac

SEQ ID NO: 4029384 - RNA, 17 nt, Molluscum contagiosum virus
ucgcgcgcgcucugccg

SEQ ID NO: 4029385 - RNA, 21 nt, Molluscum contagiosum virus
ucgcgcgcguaaagagcgucc

SEQ ID NO: 4029386 - RNA, 16 nt, Molluscum contagiosum virus
ucgcgcgugcgcagca

SEQ ID NO: 4029387 - RNA, 17 nt, Molluscum contagiosum virus
ucgcgcucuacgccagc

SEQ ID NO: 4029388 - RNA, 13 nt, Molluscum contagiosum virus
ucgcgcugcagca

SEQ ID NO: 4029389 - RNA, 15 nt, Molluscum contagiosum virus
ucgcgcuuccgcgag

SEQ ID NO: 4029390 - RNA, 18 nt, Molluscum contagiosum virus
ucgcgcuuuuuucuucgc

SEQ ID NO: 4029391 - RNA, 15 nt, Molluscum contagiosum virus
ucgcggagcgcacga

SEQ ID NO: 4029392 - RNA, 15 nt, Molluscum contagiosum virus
ucgcggagcugcgcg

SEQ ID NO: 4029393 - RNA, 12 nt, Molluscum contagiosum virus
ucgcggagcugu

SEQ ID NO: 4029394 - RNA, 19 nt, Molluscum contagiosum virus
ucgcgggaccgcccuugug

SEQ ID NO: 4029395 - RNA, 19 nt, Molluscum contagiosum virus
ucgcgggcccgccuuugug

SEQ ID NO: 4029396 - RNA, 22 nt, Molluscum contagiosum virus
ucgcggucgacgagugcgccgc

SEQ ID NO: 4029397 - RNA, 19 nt, Molluscum contagiosum virus
ucgcgguggcaggcgcgcg

SEQ ID NO: 4029398 - RNA, 17 nt, Molluscum contagiosum virus
ucgcucagccccagcag

SEQ ID NO: 4029399 - RNA, 16 nt, Molluscum contagiosum virus
ucgcucgcucagcccc

SEQ ID NO: 4029400 - RNA, 21 nt, Molluscum contagiosum virus
ucgcugcugggcaucgugcuc

SEQ ID NO: 4029401 - RNA, 16 nt, Molluscum contagiosum virus
ucgcuggccucugccu

SEQ ID NO: 4029402 - RNA, 23 nt, Molluscum contagiosum virus
ucgcuguccuuccgacccggcuc

SEQ ID NO: 4029403 - RNA, 20 nt, Molluscum contagiosum virus
ucgcuugccggcggcgcaag

SEQ ID NO: 4029404 - RNA, 20 nt, Molluscum contagiosum virus
ucggacgcagacgcgcgucc

SEQ ID NO: 4029405 - RNA, 13 nt, Molluscum contagiosum virus
ucggagaagaaca

SEQ ID NO: 4029406 - RNA, 14 nt, Molluscum contagiosum virus
ucggagcgcagcug

SEQ ID NO: 4029407 - RNA, 18 nt, Molluscum contagiosum virus
ucggagcgcagcugccgg

SEQ ID NO: 4029408 - RNA, 16 nt, Molluscum contagiosum virus
ucggaggcggagcugc

SEQ ID NO: 4029409 - RNA, 14 nt, Molluscum contagiosum virus
ucggcagcgucgcg

SEQ ID NO: 4029410 - RNA, 14 nt, Molluscum contagiosum virus
ucggcuucugcugc

SEQ ID NO: 4029411 - RNA, 20 nt, Molluscum contagiosum virus
ucgggcgccaacacgagcgc

SEQ ID NO: 4029412 - RNA, 20 nt, Molluscum contagiosum virus
ucguaaaagacgcgcucgcg

SEQ ID NO: 4029413 - RNA, 14 nt, Molluscum contagiosum virus
ucguacucaacaag

SEQ ID NO: 4029414 - RNA, 15 nt, Molluscum contagiosum virus
ucguaguccagcgcg

SEQ ID NO: 4029415 - RNA, 13 nt, Molluscum contagiosum virus
ucgucaacaacac

SEQ ID NO: 4029416 - RNA, 17 nt, Molluscum contagiosum virus
ucgucacggccuucgcg

SEQ ID NO: 4029417 - RNA, 15 nt, Molluscum contagiosum virus
ucgucccgcgcuccg

SEQ ID NO: 4029418 - RNA, 15 nt, Molluscum contagiosum virus
ucguccuggagccua

SEQ ID NO: 4029419 - RNA, 16 nt, Molluscum contagiosum virus
ucgucgaagcccagcu

SEQ ID NO: 4029420 - RNA, 20 nt, Molluscum contagiosum virus
ucgucuuugcgaacgcgcaa

SEQ ID NO: 4029421 - RNA, 17 nt, Molluscum contagiosum virus
ucgugcaccacgugcuc

SEQ ID NO: 4029422 - RNA, 21 nt, Molluscum contagiosum virus
ucgugcaccagcgcgcagaag

SEQ ID NO: 4029423 - RNA, 17 nt, Molluscum contagiosum virus
ucgugcccgcacacgca

SEQ ID NO: 4029424 - RNA, 17 nt, Molluscum contagiosum virus
ucgugcuccacgcgcag

SEQ ID NO: 4029425 - RNA, 21 nt, Molluscum contagiosum virus
ucgugcucguguguccgcacg

SEQ ID NO: 4029426 - RNA, 20 nt, Molluscum contagiosum virus
ucgugcucguguugugccug

SEQ ID NO: 4029427 - RNA, 13 nt, Molluscum contagiosum virus
ucgugcuggagca

SEQ ID NO: 4029428 - RNA, 21 nt, Molluscum contagiosum virus
ucguggaggaaacacccgcgc

SEQ ID NO: 4029429 - RNA, 20 nt, Molluscum contagiosum virus
ucgugggauaggcacacacg

SEQ ID NO: 4029430 - RNA, 22 nt, Molluscum contagiosum virus
ucgugguggaggacgacaauac

SEQ ID NO: 4029431 - RNA, 15 nt, Molluscum contagiosum virus
ucgugguugcgcacg

SEQ ID NO: 4029432 - RNA, 21 nt, Molluscum contagiosum virus
ucguuccacgauggaacggcg

SEQ ID NO: 4029433 - RNA, 16 nt, Molluscum contagiosum virus
ucuacgagacucugga

SEQ ID NO: 4029434 - RNA, 15 nt, Molluscum contagiosum virus
ucuacgccagcgacg

SEQ ID NO: 4029435 - RNA, 21 nt, Molluscum contagiosum virus
ucuacgccgcgcaccuggagu

SEQ ID NO: 4029436 - RNA, 17 nt, Molluscum contagiosum virus
ucuacgggaagcugcac

SEQ ID NO: 4029437 - RNA, 19 nt, Molluscum contagiosum virus
ucuacguguccgcauccgc

SEQ ID NO: 4029438 - RNA, 18 nt, Molluscum contagiosum virus
ucuccaggaacgcgccgc

SEQ ID NO: 4029439 - RNA, 16 nt, Molluscum contagiosum virus
ucucccucgcgcgcau

SEQ ID NO: 4029440 - RNA, 19 nt, Molluscum contagiosum virus
ucuccgcucucgagcucac

SEQ ID NO: 4029441 - RNA, 22 nt, Molluscum contagiosum virus
ucucgauggcgccguuggccac

SEQ ID NO: 4029442 - RNA, 14 nt, Molluscum contagiosum virus
ucucgcacgcggag

SEQ ID NO: 4029443 - RNA, 13 nt, Molluscum contagiosum virus
ucucgcccagcac

SEQ ID NO: 4029444 - RNA, 12 nt, Molluscum contagiosum virus
ucucgcgcacga

SEQ ID NO: 4029445 - RNA, 13 nt, Molluscum contagiosum virus
ucucgcgcucgcc

SEQ ID NO: 4029446 - RNA, 18 nt, Molluscum contagiosum virus
ucucgcggugacaggcag

SEQ ID NO: 4029447 - RNA, 14 nt, Molluscum contagiosum virus
ucucggcggccgga

SEQ ID NO: 4029448 - RNA, 17 nt, Molluscum contagiosum virus
ucugccaccaugcgcac

SEQ ID NO: 4029449 - RNA, 20 nt, Molluscum contagiosum virus
ucugccaccgcggcgcggag

SEQ ID NO: 4029450 - RNA, 23 nt, Molluscum contagiosum virus
ucugcgagcgccugcgagcagcc

SEQ ID NO: 4029451 - RNA, 15 nt, Molluscum contagiosum virus
ucugcgagcgcgaau

SEQ ID NO: 4029452 - RNA, 15 nt, Molluscum contagiosum virus
ucugcgcccgcggag

SEQ ID NO: 4029453 - RNA, 14 nt, Molluscum contagiosum virus
ucugcgcgagcagc

SEQ ID NO: 4029454 - RNA, 22 nt, Molluscum contagiosum virus
ucugcgcgcaagucaccgcucc

SEQ ID NO: 4029455 - RNA, 19 nt, Molluscum contagiosum virus
ucugcgcuccacgcccgag

SEQ ID NO: 4029456 - RNA, 20 nt, Molluscum contagiosum virus
ucugcugcacacaccgcgag

SEQ ID NO: 4029457 - RNA, 16 nt, Molluscum contagiosum virus
ucugggcgcgugcgag

SEQ ID NO: 4029458 - RNA, 19 nt, Molluscum contagiosum virus
ucugguuccugcgcuccga

SEQ ID NO: 4029459 - RNA, 15 nt, Molluscum contagiosum virus
ucuucaccugcauug

SEQ ID NO: 4029460 - RNA, 13 nt, Molluscum contagiosum virus
ucuucagaggaca

SEQ ID NO: 4029461 - RNA, 20 nt, Molluscum contagiosum virus
ucuuccagaagguacugaac

SEQ ID NO: 4029462 - RNA, 20 nt, Molluscum contagiosum virus
ucuucgagacgcugcgcgac

SEQ ID NO: 4029463 - RNA, 22 nt, Molluscum contagiosum virus
ucuucgcgcugguuugcgcgag

SEQ ID NO: 4029464 - RNA, 14 nt, Molluscum contagiosum virus
ucuugcgugccuuc

SEQ ID NO: 4029465 - RNA, 16 nt, Molluscum contagiosum virus
ucuuggcaugcgugcu

SEQ ID NO: 4029466 - RNA, 15 nt, Molluscum contagiosum virus
ucuugguugccaggc

SEQ ID NO: 4029467 - RNA, 18 nt, Molluscum contagiosum virus
ucuuguugcuggggccug

SEQ ID NO: 4029468 - RNA, 18 nt, Molluscum contagiosum virus
ucuuguugucugcggacg

SEQ ID NO: 4029469 - RNA, 18 nt, Molluscum contagiosum virus
ucuuuccccuccuagccc

SEQ ID NO: 4029470 - RNA, 18 nt, Molluscum contagiosum virus
ucuuugcggacgcgcgag

SEQ ID NO: 4029471 - RNA, 15 nt, Molluscum contagiosum virus
accgcgcgguccgcc

SEQ ID NO: 4029472 - RNA, 19 nt, Molluscum contagiosum virus
accgcguccgcuaccgcag

SEQ ID NO: 4029473 - RNA, 16 nt, Molluscum contagiosum virus
accgcgugcgugcaca

SEQ ID NO: 4029474 - RNA, 22 nt, Molluscum contagiosum virus
accgcguggacaacagcacgac

SEQ ID NO: 4029475 - RNA, 15 nt, Molluscum contagiosum virus
accgcguugccgccc

SEQ ID NO: 4029476 - RNA, 22 nt, Molluscum contagiosum virus
accgcuucuuuacgggcgccag

SEQ ID NO: 4029477 - RNA, 16 nt, Molluscum contagiosum virus
accggagacaccagcu

SEQ ID NO: 4029478 - RNA, 11 nt, Molluscum contagiosum virus
accggagaggg

SEQ ID NO: 4029479 - RNA, 20 nt, Molluscum contagiosum virus
accggccaaggcaaaguucu

SEQ ID NO: 4029480 - RNA, 16 nt, Molluscum contagiosum virus
accgucgcguggugcu

SEQ ID NO: 4029481 - RNA, 18 nt, Molluscum contagiosum virus
accguggaggagccgccc

SEQ ID NO: 4029482 - RNA, 12 nt, Molluscum contagiosum virus
accuacaugagu

SEQ ID NO: 4029483 - RNA, 12 nt, Molluscum contagiosum virus
accuaggcacuc

SEQ ID NO: 4029484 - RNA, 16 nt, Molluscum contagiosum virus
accuccugcuuugcac

SEQ ID NO: 4029485 - RNA, 15 nt, Molluscum contagiosum virus
accucgcgcgccgcc

SEQ ID NO: 4029486 - RNA, 14 nt, Molluscum contagiosum virus
accucgcugcugag

SEQ ID NO: 4029487 - RNA, 14 nt, Molluscum contagiosum virus
accucuacacgcac

SEQ ID NO: 4029488 - RNA, 17 nt, Molluscum contagiosum virus
accugcaggaaaggcac

SEQ ID NO: 4029489 - RNA, 19 nt, Molluscum contagiosum virus
accugcauugagcucgcgc

SEQ ID NO: 4029490 - RNA, 21 nt, Molluscum contagiosum virus
accugcugcgagagcaugccu

SEQ ID NO: 4029491 - RNA, 15 nt, Molluscum contagiosum virus
accuggcggcgcugg

SEQ ID NO: 4029492 - RNA, 14 nt, Molluscum contagiosum virus
accugucgcgcgag

SEQ ID NO: 4029493 - RNA, 15 nt, Molluscum contagiosum virus
accugucgugcaaug

SEQ ID NO: 4029494 - RNA, 23 nt, Molluscum contagiosum virus
accuguucuuucagcgcgcgcag

SEQ ID NO: 4029495 - RNA, 18 nt, Molluscum contagiosum virus
accuucaggacgcaggac

SEQ ID NO: 4029496 - RNA, 21 nt, Molluscum contagiosum virus
accuuccuccagggcacgauc

SEQ ID NO: 4029497 - RNA, 17 nt, Molluscum contagiosum virus
accuucggaacugcgga

SEQ ID NO: 4029498 - RNA, 18 nt, Molluscum contagiosum virus
accuuggugcucauccuc

SEQ ID NO: 4029499 - RNA, 15 nt, Molluscum contagiosum virus
acgaaccgugcgagc

SEQ ID NO: 4029500 - RNA, 15 nt, Molluscum contagiosum virus
acgaacgacagcgcc

SEQ ID NO: 4029501 - RNA, 14 nt, Molluscum contagiosum virus
acgaacgcugcagc

SEQ ID NO: 4029502 - RNA, 13 nt, Molluscum contagiosum virus
acgaacuggcaau

SEQ ID NO: 4029503 - RNA, 14 nt, Molluscum contagiosum virus
acgaagcugugcaa

SEQ ID NO: 4029504 - RNA, 23 nt, Molluscum contagiosum virus
acgaaucgcucgcggugcagcug

SEQ ID NO: 4029505 - RNA, 15 nt, Molluscum contagiosum virus
acgacagaccccuga

SEQ ID NO: 4029506 - RNA, 15 nt, Molluscum contagiosum virus
acgacaugcucgcgc

SEQ ID NO: 4029507 - RNA, 16 nt, Molluscum contagiosum virus
acgacaugcugugcgg

SEQ ID NO: 4029508 - RNA, 18 nt, Molluscum contagiosum virus
acgaccgcgcacgcagca

SEQ ID NO: 4029509 - RNA, 14 nt, Molluscum contagiosum virus
acgacgccgagccc

SEQ ID NO: 4029510 - RNA, 18 nt, Molluscum contagiosum virus
acgacgggcgcgcuucuc

SEQ ID NO: 4029511 - RNA, 20 nt, Molluscum contagiosum virus
acgacguacgagugcuggag

SEQ ID NO: 4029512 - RNA, 15 nt, Molluscum contagiosum virus
acgacuagcgugcgc

SEQ ID NO: 4029513 - RNA, 15 nt, Molluscum contagiosum virus
acgacucgcugccag

SEQ ID NO: 4029514 - RNA, 20 nt, Molluscum contagiosum virus
acgagauggucacgcgcaag

SEQ ID NO: 4029515 - RNA, 16 nt, Molluscum contagiosum virus
acgagcacugccugcc

SEQ ID NO: 4029516 - RNA, 23 nt, Molluscum contagiosum virus
acgagcacugccugccgccucgg

SEQ ID NO: 4029517 - RNA, 17 nt, Molluscum contagiosum virus
acgagcagcccgugcgc

SEQ ID NO: 4029518 - RNA, 16 nt, Molluscum contagiosum virus
acgagcaggcgcagcg

SEQ ID NO: 4029519 - RNA, 15 nt, Molluscum contagiosum virus
acgagcagugccgcc

SEQ ID NO: 4029520 - RNA, 19 nt, Molluscum contagiosum virus
acgagccgcugcuccugcu

SEQ ID NO: 4029521 - RNA, 21 nt, Molluscum contagiosum virus
acgagccgcugcuccugcucu

SEQ ID NO: 4029522 - RNA, 22 nt, Molluscum contagiosum virus
acgagccgcugcuccugcucug

SEQ ID NO: 4029523 - RNA, 17 nt, Molluscum contagiosum virus
acgaggagcacggcauc

SEQ ID NO: 4029524 - RNA, 20 nt, Molluscum contagiosum virus
acgaggccuacgugcugcgc

SEQ ID NO: 4029525 - RNA, 20 nt, Molluscum contagiosum virus
acgaggucgcguccacgcag

SEQ ID NO: 4029526 - RNA, 23 nt, Molluscum contagiosum virus
acgaggucgcguccacgcaggac

SEQ ID NO: 4029527 - RNA, 20 nt, Molluscum contagiosum virus
acgaggucuuccauugcaug

SEQ ID NO: 4029528 - RNA, 13 nt, Molluscum contagiosum virus
acgaggugcugcg

SEQ ID NO: 4029529 - RNA, 15 nt, Molluscum contagiosum virus
acgagugcgccgcgc

SEQ ID NO: 4029530 - RNA, 18 nt, Molluscum contagiosum virus
acgauaaauggaccucaa

SEQ ID NO: 4029531 - RNA, 15 nt, Molluscum contagiosum virus
acgaugcgcucgugg

SEQ ID NO: 4029532 - RNA, 22 nt, Molluscum contagiosum virus
acgaugucggaacccagaaaga

SEQ ID NO: 4029533 - RNA, 22 nt, Molluscum contagiosum virus
acgauuccgcuguacgugcugc

SEQ ID NO: 4029534 - RNA, 23 nt, Molluscum contagiosum virus
acgcaaagucaucugccucgugg

SEQ ID NO: 4029535 - RNA, 18 nt, Molluscum contagiosum virus
acgcaagcugaggcgugc

SEQ ID NO: 4029536 - RNA, 23 nt, Molluscum contagiosum virus
acgcacacgacgacggcugcucg

SEQ ID NO: 4029537 - RNA, 22 nt, Molluscum contagiosum virus
acgcacacgagugcccgcgcgc

SEQ ID NO: 4029538 - RNA, 23 nt, Molluscum contagiosum virus
acgcaccgccuggugcugcgcga

SEQ ID NO: 4029539 - RNA, 14 nt, Molluscum contagiosum virus
acgcacgaccucac

SEQ ID NO: 4029540 - RNA, 12 nt, Molluscum contagiosum virus
acgcacgcgcgc

SEQ ID NO: 4029541 - RNA, 19 nt, Molluscum contagiosum virus
acgcacgcuugccuuggcg

SEQ ID NO: 4029542 - RNA, 14 nt, Molluscum contagiosum virus
acgcacucgcuggc

SEQ ID NO: 4029543 - RNA, 14 nt, Molluscum contagiosum virus
acgcagcaggcacg

SEQ ID NO: 4029544 - RNA, 18 nt, Molluscum contagiosum virus
acgcagcgcgagcugugc

SEQ ID NO: 4029545 - RNA, 15 nt, Molluscum contagiosum virus
acgcagucgccuucc

SEQ ID NO: 4029546 - RNA, 23 nt, Molluscum contagiosum virus
acgccaaccaccacguggaccug

SEQ ID NO: 4029547 - RNA, 14 nt, Molluscum contagiosum virus
acgccaagcgucgc

SEQ ID NO: 4029548 - RNA, 19 nt, Molluscum contagiosum virus
acgcccuccucgaccugca

SEQ ID NO: 4029549 - RNA, 22 nt, Molluscum contagiosum virus
acgcccuccucgaccugcacga

SEQ ID NO: 4029550 - RNA, 16 nt, Molluscum contagiosum virus
acgcccucgccugcga

SEQ ID NO: 4029551 - RNA, 16 nt, Molluscum contagiosum virus
acgccgaagagccgcg

SEQ ID NO: 4029552 - RNA, 20 nt, Molluscum contagiosum virus
acgccgaccauuuccugcga

SEQ ID NO: 4029553 - RNA, 14 nt, Molluscum contagiosum virus
acgccgagcgggca

SEQ ID NO: 4029554 - RNA, 18 nt, Molluscum contagiosum virus
acgccggggggcgccaag

SEQ ID NO: 4029555 - RNA, 20 nt, Molluscum contagiosum virus
acgccgugacggcccaccuu

SEQ ID NO: 4029556 - RNA, 15 nt, Molluscum contagiosum virus
acgccgugcgcgugc

SEQ ID NO: 4029557 - RNA, 23 nt, Molluscum contagiosum virus
acgccgugcgcgugcggcggcgc

SEQ ID NO: 4029558 - RNA, 17 nt, Molluscum contagiosum virus
acgccugcuagcggccu

SEQ ID NO: 4029559 - RNA, 17 nt, Molluscum contagiosum virus
acgccuggcggcagcac

SEQ ID NO: 4029560 - RNA, 15 nt, Molluscum contagiosum virus
acgccuuccugcugg

SEQ ID NO: 4029561 - RNA, 15 nt, Molluscum contagiosum virus
acgccuucuuccugc

SEQ ID NO: 4029562 - RNA, 19 nt, Molluscum contagiosum virus
acgccuucuuccugcgcgu

SEQ ID NO: 4029563 - RNA, 16 nt, Molluscum contagiosum virus
acgcgaaacuggacug

SEQ ID NO: 4029564 - RNA, 12 nt, Molluscum contagiosum virus
acgcgagacugu

SEQ ID NO: 4029565 - RNA, 12 nt, Molluscum contagiosum virus
acgcgagcacug

SEQ ID NO: 4029566 - RNA, 23 nt, Molluscum contagiosum virus
acgcgagcggcuuuucgccggag

SEQ ID NO: 4029567 - RNA, 15 nt, Molluscum contagiosum virus
acgcgauggcgcagc

SEQ ID NO: 4029568 - RNA, 15 nt, Molluscum contagiosum virus
acgcgcacgcgcgag

SEQ ID NO: 4029569 - RNA, 14 nt, Molluscum contagiosum virus
acgcgcagcucgac

SEQ ID NO: 4029570 - RNA, 21 nt, Molluscum contagiosum virus
acgcgcccacgugccaagacc

SEQ ID NO: 4029571 - RNA, 18 nt, Molluscum contagiosum virus
acgcgccggggcgcgcgc

SEQ ID NO: 4029572 - RNA, 13 nt, Molluscum contagiosum virus
acgcgcgcgcagg

SEQ ID NO: 4029573 - RNA, 18 nt, Molluscum contagiosum virus
acgcgcggcagacgccag

SEQ ID NO: 4029574 - RNA, 13 nt, Molluscum contagiosum virus
acgcgggccaggc

SEQ ID NO: 4029575 - RNA, 14 nt, Molluscum contagiosum virus
acgcgggccaggca

SEQ ID NO: 4029576 - RNA, 23 nt, Molluscum contagiosum virus
acgcgggccaggcacuggcccug

SEQ ID NO: 4029577 - RNA, 15 nt, Molluscum contagiosum virus
acgcguccacggcgc

SEQ ID NO: 4029578 - RNA, 20 nt, Molluscum contagiosum virus
acgcgugcauggcacgcgag

SEQ ID NO: 4029579 - RNA, 22 nt, Molluscum contagiosum virus
acgcgugccuggcuugcgcgcg

SEQ ID NO: 4029580 - RNA, 15 nt, Molluscum contagiosum virus
acgcgugcgcgccag

SEQ ID NO: 4029581 - RNA, 19 nt, Molluscum contagiosum virus
acgcgugcugcgcggcgcc

SEQ ID NO: 4029582 - RNA, 14 nt, Molluscum contagiosum virus
acgcuacagcagcc

SEQ ID NO: 4029583 - RNA, 16 nt, Molluscum contagiosum virus
acgcuacgcagcgcgc

SEQ ID NO: 4029584 - RNA, 22 nt, Molluscum contagiosum virus
acgcucaacgugggcaccugca

SEQ ID NO: 4029585 - RNA, 23 nt, Molluscum contagiosum virus
acgcucuacggcgccuucgucgc

SEQ ID NO: 4029586 - RNA, 22 nt, Molluscum contagiosum virus
acgcugccggcaacgcugccgc

SEQ ID NO: 4029587 - RNA, 12 nt, Molluscum contagiosum virus
acgcugcgcacg

SEQ ID NO: 4029588 - RNA, 15 nt, Molluscum contagiosum virus
acgcugcgcgacgag

SEQ ID NO: 4029589 - RNA, 19 nt, Molluscum contagiosum virus
acgcugcgcgugcugggcc

SEQ ID NO: 4029590 - RNA, 19 nt, Molluscum contagiosum virus
acgcugcugcacagcuucc

SEQ ID NO: 4029591 - RNA, 21 nt, Molluscum contagiosum virus
acgcuggcucgcgccugcgcu

SEQ ID NO: 4029592 - RNA, 16 nt, Molluscum contagiosum virus
acgcuguccaggcgcu

SEQ ID NO: 4029593 - RNA, 15 nt, Molluscum contagiosum virus
acgcuugccuuggcg

SEQ ID NO: 4029594 - RNA, 16 nt, Molluscum contagiosum virus
acgcuuggcgggcagc

SEQ ID NO: 4029595 - RNA, 19 nt, Molluscum contagiosum virus
acggacgcccuccucgacc

SEQ ID NO: 4029596 - RNA, 16 nt, Molluscum contagiosum virus
acggagaccuggucac

SEQ ID NO: 4029597 - RNA, 16 nt, Molluscum contagiosum virus
acggagagcgcgcggc

SEQ ID NO: 4029598 - RNA, 18 nt, Molluscum contagiosum virus
acggagcuacaaaacuga

SEQ ID NO: 4029599 - RNA, 13 nt, Molluscum contagiosum virus
acggaggucugcu

SEQ ID NO: 4029600 - RNA, 13 nt, Molluscum contagiosum virus
acggcacagucug

SEQ ID NO: 4029601 - RNA, 13 nt, Molluscum contagiosum virus
acggcacggaccc

SEQ ID NO: 4029602 - RNA, 22 nt, Molluscum contagiosum virus
acggcacgugcguacgcggcgc

SEQ ID NO: 4029603 - RNA, 20 nt, Molluscum contagiosum virus
acggcacuaaggccgucagc

SEQ ID NO: 4029604 - RNA, 22 nt, Molluscum contagiosum virus
acggcccgaaggccaccucgca

SEQ ID NO: 4029605 - RNA, 14 nt, Molluscum contagiosum virus
acggcgagcgccgc

SEQ ID NO: 4029606 - RNA, 18 nt, Molluscum contagiosum virus
acggcgaguucugccggc

SEQ ID NO: 4029607 - RNA, 18 nt, Molluscum contagiosum virus
acggcgauucgugcucgu

SEQ ID NO: 4029608 - RNA, 13 nt, Molluscum contagiosum virus
acggcgcgcgcgc

SEQ ID NO: 4029609 - RNA, 19 nt, Molluscum contagiosum virus
acggcgcggaucugcgcac

SEQ ID NO: 4029610 - RNA, 17 nt, Molluscum contagiosum virus
acggcggcacccgccgc

SEQ ID NO: 4029611 - RNA, 15 nt, Molluscum contagiosum virus
acggcggcgcucaac

SEQ ID NO: 4029612 - RNA, 17 nt, Molluscum contagiosum virus
acggcgugacggugcug

SEQ ID NO: 4029613 - RNA, 22 nt, Molluscum contagiosum virus
acggcgugacggugcugcgcac

SEQ ID NO: 4029614 - RNA, 15 nt, Molluscum contagiosum virus
acggcgugcgccgcu

SEQ ID NO: 4029615 - RNA, 14 nt, Molluscum contagiosum virus
acggcgugcgcgag

SEQ ID NO: 4029616 - RNA, 22 nt, Molluscum contagiosum virus
acggcugcaagcacaacgggcu

SEQ ID NO: 4029617 - RNA, 14 nt, Molluscum contagiosum virus
acgggaaccgugcu

SEQ ID NO: 4029618 - RNA, 15 nt, Molluscum contagiosum virus
acgggaagcuuucag

SEQ ID NO: 4029619 - RNA, 23 nt, Molluscum contagiosum virus
acgggcacgccgugggcagcuuc

SEQ ID NO: 4029620 - RNA, 22 nt, Molluscum contagiosum virus
acgggcccgcguggcaagggcu

SEQ ID NO: 4029621 - RNA, 18 nt, Molluscum contagiosum virus
acgggcucgaucugcgcc

SEQ ID NO: 4029622 - RNA, 16 nt, Molluscum contagiosum virus
acgggcucgugcugga

SEQ ID NO: 4029623 - RNA, 16 nt, Molluscum contagiosum virus
acgguagcuagcucug

SEQ ID NO: 4029624 - RNA, 15 nt, Molluscum contagiosum virus
acggucacgcaagcu

SEQ ID NO: 4029625 - RNA, 13 nt, Molluscum contagiosum virus
acgguccugggcg

SEQ ID NO: 4029626 - RNA, 19 nt, Molluscum contagiosum virus
acggucguccuggagccua

SEQ ID NO: 4029627 - RNA, 16 nt, Molluscum contagiosum virus
acggucuuccaggucu

SEQ ID NO: 4029628 - RNA, 15 nt, Molluscum contagiosum virus
acggugcagccgcug

SEQ ID NO: 4029629 - RNA, 15 nt, Molluscum contagiosum virus
acggugcugcgcacg

SEQ ID NO: 4029630 - RNA, 14 nt, Molluscum contagiosum virus
acguagagcagcgc

SEQ ID NO: 4029631 - RNA, 15 nt, Molluscum contagiosum virus
acguagagcagcgcu

SEQ ID NO: 4029632 - RNA, 15 nt, Molluscum contagiosum virus
acguaguacugcagc

SEQ ID NO: 4029633 - RNA, 19 nt, Molluscum contagiosum virus
acguccaggccgcggcagc

SEQ ID NO: 4029634 - RNA, 19 nt, Molluscum contagiosum virus
acguccccgaacugcuggg

SEQ ID NO: 4029635 - RNA, 21 nt, Molluscum contagiosum virus
acguccccgaacugcugggcg

SEQ ID NO: 4029636 - RNA, 15 nt, Molluscum contagiosum virus
acgugaucgcgcagg

SEQ ID NO: 4029637 - RNA, 15 nt, Molluscum contagiosum virus
acgugcccuacgcgc

SEQ ID NO: 4029638 - RNA, 17 nt, Molluscum contagiosum virus
acgugcgcgagcucgag

SEQ ID NO: 4029639 - RNA, 17 nt, Molluscum contagiosum virus
acgugcgcgcugcgcgc

SEQ ID NO: 4029640 - RNA, 21 nt, Molluscum contagiosum virus
acgugcgucuuuuugcggcgc

SEQ ID NO: 4029641 - RNA, 15 nt, Molluscum contagiosum virus
acgugcgugcccaag

SEQ ID NO: 4029642 - RNA, 21 nt, Molluscum contagiosum virus
acgugcuacuacuguaaggcg

SEQ ID NO: 4029643 - RNA, 17 nt, Molluscum contagiosum virus
acgugcugcagcguaug

SEQ ID NO: 4029644 - RNA, 14 nt, Molluscum contagiosum virus
acgugcugcgcacg

SEQ ID NO: 4029645 - RNA, 13 nt, Molluscum contagiosum virus
acgugcugcugcg

SEQ ID NO: 4029646 - RNA, 21 nt, Molluscum contagiosum virus
acgugcugcuggcccugcuag

SEQ ID NO: 4029647 - RNA, 14 nt, Molluscum contagiosum virus
acgugcuugcgcgc

SEQ ID NO: 4029648 - RNA, 15 nt, Molluscum contagiosum virus
acguggacguggaua

SEQ ID NO: 4029649 - RNA, 23 nt, Molluscum contagiosum virus
acguggucgcgcgcgcucugccg

SEQ ID NO: 4029650 - RNA, 21 nt, Molluscum contagiosum virus
acguucgagaccagccgcgag

SEQ ID NO: 4029651 - RNA, 17 nt, Molluscum contagiosum virus
acguuuucaagcgcgag

SEQ ID NO: 4029652 - RNA, 17 nt, Molluscum contagiosum virus
acuaagccgcgugcugg

SEQ ID NO: 4029653 - RNA, 19 nt, Molluscum contagiosum virus
acuaagccgcgugcuggcg

SEQ ID NO: 4029654 - RNA, 18 nt, Molluscum contagiosum virus
acuacaaggugcuguccu

SEQ ID NO: 4029655 - RNA, 14 nt, Molluscum contagiosum virus
acucaacaagcugc

SEQ ID NO: 4029656 - RNA, 18 nt, Molluscum contagiosum virus
acuccaaggagggcaaga

SEQ ID NO: 4029657 - RNA, 14 nt, Molluscum contagiosum virus
acuccgagcgcgac

SEQ ID NO: 4029658 - RNA, 13 nt, Molluscum contagiosum virus
acuccugcuggcg

SEQ ID NO: 4029659 - RNA, 24 nt, Molluscum contagiosum virus
acuccuuccggagacaccagcucc

SEQ ID NO: 4029660 - RNA, 19 nt, Molluscum contagiosum virus
acuccuuucgacgcugccu

SEQ ID NO: 4029661 - RNA, 23 nt, Molluscum contagiosum virus
acucgagccccagaaggucgugc

SEQ ID NO: 4029662 - RNA, 24 nt, Molluscum contagiosum virus
acucgcagcucacgagauggcugc

SEQ ID NO: 4029663 - RNA, 22 nt, Molluscum contagiosum virus
acucgcgcgcgccgggccgcgg

SEQ ID NO: 4029664 - RNA, 20 nt, Molluscum contagiosum virus
acucgcgcguccacaagggc

SEQ ID NO: 4029665 - RNA, 17 nt, Molluscum contagiosum virus
acucgcgcguccgcaaa

SEQ ID NO: 4029666 - RNA, 14 nt, Molluscum contagiosum virus
acucgcggcaagua

SEQ ID NO: 4029667 - RNA, 20 nt, Molluscum contagiosum virus
acucgcguccgcaucggcgc

SEQ ID NO: 4029668 - RNA, 19 nt, Molluscum contagiosum virus
acucgcguccgcgcagcuc

SEQ ID NO: 4029669 - RNA, 14 nt, Molluscum contagiosum virus
acucgcugcugcuc

SEQ ID NO: 4029670 - RNA, 13 nt, Molluscum contagiosum virus
acucggacacugg

SEQ ID NO: 4029671 - RNA, 17 nt, Molluscum contagiosum virus
acucucccgggcucugu

SEQ ID NO: 4029672 - RNA, 21 nt, Molluscum contagiosum virus
acugaaaacuuaucccagaaa

SEQ ID NO: 4029673 - RNA, 13 nt, Molluscum contagiosum virus
acugcaagaucua

SEQ ID NO: 4029674 - RNA, 12 nt, Molluscum contagiosum virus
acugcagcagcu

SEQ ID NO: 4029675 - RNA, 22 nt, Molluscum contagiosum virus
acugcaggccccuacacgcaac

SEQ ID NO: 4029676 - RNA, 14 nt, Molluscum contagiosum virus
acugccacgcggag

SEQ ID NO: 4029677 - RNA, 21 nt, Molluscum contagiosum virus
acugcccgcgcccugcacgac

SEQ ID NO: 4029678 - RNA, 18 nt, Molluscum contagiosum virus
ugaacagcuucacgauga

SEQ ID NO: 4029679 - RNA, 17 nt, Molluscum contagiosum virus
ugaacucgcugcugcuc

SEQ ID NO: 4029680 - RNA, 18 nt, Molluscum contagiosum virus
ugaagaaggagcccuugc

SEQ ID NO: 4029681 - RNA, 13 nt, Molluscum contagiosum virus
ugaagcucucgcg

SEQ ID NO: 4029682 - RNA, 15 nt, Molluscum contagiosum virus
ugaaggcgcggcuac

SEQ ID NO: 4029683 - RNA, 20 nt, Molluscum contagiosum virus
ugacacaccgcguggacaac

SEQ ID NO: 4029684 - RNA, 16 nt, Molluscum contagiosum virus
ugacagacuaggcaau

SEQ ID NO: 4029685 - RNA, 15 nt, Molluscum contagiosum virus
ugaccagcuccacgu

SEQ ID NO: 4029686 - RNA, 18 nt, Molluscum contagiosum virus
ugaccggagcggcggacg

SEQ ID NO: 4029687 - RNA, 17 nt, Molluscum contagiosum virus
ugaccucgcugcugagc

SEQ ID NO: 4029688 - RNA, 12 nt, Molluscum contagiosum virus
ugacgcgcacgc

SEQ ID NO: 4029689 - RNA, 13 nt, Molluscum contagiosum virus
ugacggagccgcg

SEQ ID NO: 4029690 - RNA, 15 nt, Molluscum contagiosum virus
ugacggcagcaagcg

SEQ ID NO: 4029691 - RNA, 21 nt, Molluscum contagiosum virus
ugacggccggcgggcgcgugc

SEQ ID NO: 4029692 - RNA, 17 nt, Molluscum contagiosum virus
ugacgucuuccagacgc

SEQ ID NO: 4029693 - RNA, 21 nt, Molluscum contagiosum virus
ugagaauaaaauagcagagca

SEQ ID NO: 4029694 - RNA, 17 nt, Molluscum contagiosum virus
ugagcagcaaaacugaa

SEQ ID NO: 4029695 - RNA, 20 nt, Molluscum contagiosum virus
ugagcaggucggccagcagc

SEQ ID NO: 4029696 - RNA, 19 nt, Molluscum contagiosum virus
ugaggggcaguguuccugg

SEQ ID NO: 4029697 - RNA, 19 nt, Molluscum contagiosum virus
ugagguacuccacgcccgg

SEQ ID NO: 4029698 - RNA, 22 nt, Molluscum contagiosum virus
ugaguaccgcgggcgcagacgc

SEQ ID NO: 4029699 - RNA, 15 nt, Molluscum contagiosum virus
ugagugcugagccac

SEQ ID NO: 4029700 - RNA, 19 nt, Molluscum contagiosum virus
ugcaacaggagcauuccuu

SEQ ID NO: 4029701 - RNA, 14 nt, Molluscum contagiosum virus
ugcacaccggcgcg

SEQ ID NO: 4029702 - RNA, 14 nt, Molluscum contagiosum virus
ugcacagcguagcg

SEQ ID NO: 4029703 - RNA, 20 nt, Molluscum contagiosum virus
ugcaccagcaccggcgugug

SEQ ID NO: 4029704 - RNA, 13 nt, Molluscum contagiosum virus
ugcacccuccgca

SEQ ID NO: 4029705 - RNA, 19 nt, Molluscum contagiosum virus
ugcaccgagugcuggccga

SEQ ID NO: 4029706 - RNA, 18 nt, Molluscum contagiosum virus
ugcacgagccggcgccgu

SEQ ID NO: 4029707 - RNA, 15 nt, Molluscum contagiosum virus
ugcacgcacgcgcgg

SEQ ID NO: 4029708 - RNA, 19 nt, Molluscum contagiosum virus
ugcacgcacgcgcgggcau

SEQ ID NO: 4029709 - RNA, 13 nt, Molluscum contagiosum virus
ugcacgcgcacgc

SEQ ID NO: 4029710 - RNA, 14 nt, Molluscum contagiosum virus
ugcacgcgggcgcc

SEQ ID NO: 4029711 - RNA, 19 nt, Molluscum contagiosum virus
ugcacgggcaugcacagcu

SEQ ID NO: 4029712 - RNA, 13 nt, Molluscum contagiosum virus
ugcacgugcagcg

SEQ ID NO: 4029713 - RNA, 14 nt, Molluscum contagiosum virus
ugcacgugcagcgg

SEQ ID NO: 4029714 - RNA, 15 nt, Molluscum contagiosum virus
ugcacuuccaguaug

SEQ ID NO: 4029715 - RNA, 17 nt, Molluscum contagiosum virus
ugcagaaacagccgugc

SEQ ID NO: 4029716 - RNA, 14 nt, Molluscum contagiosum virus
ugcagaaccugcgg

SEQ ID NO: 4029717 - RNA, 14 nt, Molluscum contagiosum virus
ugcagagcgugcug

SEQ ID NO: 4029718 - RNA, 15 nt, Molluscum contagiosum virus
ugcagagcgugcugg

SEQ ID NO: 4029719 - RNA, 13 nt, Molluscum contagiosum virus
ugcagcagcacag

SEQ ID NO: 4029720 - RNA, 21 nt, Molluscum contagiosum virus
ugcagcagccccgacgccagc

SEQ ID NO: 4029721 - RNA, 23 nt, Molluscum contagiosum virus
ugcagcccgacgcgggcgcgcac

SEQ ID NO: 4029722 - RNA, 14 nt, Molluscum contagiosum virus
ugcagcgcagcagc

SEQ ID NO: 4029723 - RNA, 14 nt, Molluscum contagiosum virus
ugcagcgccgcgcg

SEQ ID NO: 4029724 - RNA, 16 nt, Molluscum contagiosum virus
ugcagcggcgccacga

SEQ ID NO: 4029725 - RNA, 18 nt, Molluscum contagiosum virus
ugcagcugccgcagagcc

SEQ ID NO: 4029726 - RNA, 18 nt, Molluscum contagiosum virus
ugcaguugagagcagcgg

SEQ ID NO: 4029727 - RNA, 13 nt, Molluscum contagiosum virus
ugcaucgugggca

SEQ ID NO: 4029728 - RNA, 16 nt, Molluscum contagiosum virus
ugcauggacauccuca

SEQ ID NO: 4029729 - RNA, 16 nt, Molluscum contagiosum virus
ugcauggcggcggcca

SEQ ID NO: 4029730 - RNA, 20 nt, Molluscum contagiosum virus
ugcauguuuguucgcgcgcc

SEQ ID NO: 4029731 - RNA, 20 nt, Molluscum contagiosum virus
ugccaccaugcgcacagcac

SEQ ID NO: 4029732 - RNA, 17 nt, Molluscum contagiosum virus
ugccacgcagcuggcgg

SEQ ID NO: 4029733 - RNA, 21 nt, Molluscum contagiosum virus
ugccacguacuugcugguugc

SEQ ID NO: 4029734 - RNA, 16 nt, Molluscum contagiosum virus
ugccagcggcgccgca

SEQ ID NO: 4029735 - RNA, 19 nt, Molluscum contagiosum virus
ugccagcgggaaacugcug

SEQ ID NO: 4029736 - RNA, 21 nt, Molluscum contagiosum virus
ugccagcgggaaacugcugcc

SEQ ID NO: 4029737 - RNA, 23 nt, Molluscum contagiosum virus
ugccagcgggaaacugcugcccg

SEQ ID NO: 4029738 - RNA, 14 nt, Molluscum contagiosum virus
ugccaggcaacgca

SEQ ID NO: 4029739 - RNA, 14 nt, Molluscum contagiosum virus
ugccauggcagcuc

SEQ ID NO: 4029740 - RNA, 18 nt, Molluscum contagiosum virus
ugcccaagugcgcguguc

SEQ ID NO: 4029741 - RNA, 23 nt, Molluscum contagiosum virus
ugccccaugcccgaccacgugcc

SEQ ID NO: 4029742 - RNA, 14 nt, Molluscum contagiosum virus
ugcccgaggagagc

SEQ ID NO: 4029743 - RNA, 22 nt, Molluscum contagiosum virus
ugcccgccugccgcgagcacug

SEQ ID NO: 4029744 - RNA, 15 nt, Molluscum contagiosum virus
ugcccgcgcccugca

SEQ ID NO: 4029745 - RNA, 16 nt, Molluscum contagiosum virus
ugcccgcgcccugcac

SEQ ID NO: 4029746 - RNA, 15 nt, Molluscum contagiosum virus
ugcccgcgcgcgacu

SEQ ID NO: 4029747 - RNA, 22 nt, Molluscum contagiosum virus
ugcccgcuccgcucgcgcgugc

SEQ ID NO: 4029748 - RNA, 15 nt, Molluscum contagiosum virus
ugcccggacagagcc

SEQ ID NO: 4029749 - RNA, 20 nt, Molluscum contagiosum virus
ugcccggccucgccuccggg

SEQ ID NO: 4029750 - RNA, 20 nt, Molluscum contagiosum virus
ugcccggcggcaagcccgga

SEQ ID NO: 4029751 - RNA, 18 nt, Molluscum contagiosum virus
ugcccgguacgcucgcgc

SEQ ID NO: 4029752 - RNA, 14 nt, Molluscum contagiosum virus
ugccgagcgcacgc

SEQ ID NO: 4029753 - RNA, 16 nt, Molluscum contagiosum virus
ugccgcaguacgugac

SEQ ID NO: 4029754 - RNA, 23 nt, Molluscum contagiosum virus
ugccgccaggaaaacggaaacag

SEQ ID NO: 4029755 - RNA, 16 nt, Molluscum contagiosum virus
ugccgcgcgcgccgca

SEQ ID NO: 4029756 - RNA, 20 nt, Molluscum contagiosum virus
ugccgcggacgccggcgccc

SEQ ID NO: 4029757 - RNA, 14 nt, Molluscum contagiosum virus
ugccgcggcacugg

SEQ ID NO: 4029758 - RNA, 21 nt, Molluscum contagiosum virus
ugccgcucgcaagaguucaaa

SEQ ID NO: 4029759 - RNA, 22 nt, Molluscum contagiosum virus
ugccgcucggaggcuugccccg

SEQ ID NO: 4029760 - RNA, 19 nt, Molluscum contagiosum virus
ugccggcgcaaucucgcgg

SEQ ID NO: 4029761 - RNA, 15 nt, Molluscum contagiosum virus
ugccggcucagcgug

SEQ ID NO: 4029762 - RNA, 17 nt, Molluscum contagiosum virus
ugccggcucagcgugga

SEQ ID NO: 4029763 - RNA, 23 nt, Molluscum contagiosum virus
ugccggggaugaacgcgcugcgc

SEQ ID NO: 4029764 - RNA, 16 nt, Molluscum contagiosum virus
ugccgguggaagagcc

SEQ ID NO: 4029765 - RNA, 13 nt, Molluscum contagiosum virus
ugccuacucgcga

SEQ ID NO: 4029766 - RNA, 11 nt, Molluscum contagiosum virus
ugccugcgcuu

SEQ ID NO: 4029767 - RNA, 16 nt, Molluscum contagiosum virus
ugccugcugcgcuucu

SEQ ID NO: 4029768 - RNA, 18 nt, Molluscum contagiosum virus
ugccuggagggcagugcc

SEQ ID NO: 4029769 - RNA, 16 nt, Molluscum contagiosum virus
ugccuggcagugccgg

SEQ ID NO: 4029770 - RNA, 14 nt, Molluscum contagiosum virus
ugccuguggcgcac

SEQ ID NO: 4029771 - RNA, 17 nt, Molluscum contagiosum virus
aucaccccgcugggccg

SEQ ID NO: 4029772 - RNA, 17 nt, Molluscum contagiosum virus
aucacggccgggauuug

SEQ ID NO: 4029773 - RNA, 13 nt, Molluscum contagiosum virus
aucagagaagugc

SEQ ID NO: 4029774 - RNA, 20 nt, Molluscum contagiosum virus
aucagguccacguggugguu

SEQ ID NO: 4029775 - RNA, 14 nt, Molluscum contagiosum virus
aucaugagccaguc

SEQ ID NO: 4029776 - RNA, 21 nt, Molluscum contagiosum virus
aucccagaaaacgcacugucg

SEQ ID NO: 4029777 - RNA, 21 nt, Molluscum contagiosum virus
auccgcgcgcucucacgcuuc

SEQ ID NO: 4029778 - RNA, 17 nt, Molluscum contagiosum virus
auccucccugcgggcgc

SEQ ID NO: 4029779 - RNA, 14 nt, Molluscum contagiosum virus
auccugguuccucu

SEQ ID NO: 4029780 - RNA, 14 nt, Molluscum contagiosum virus
aucgacaagaucaa

SEQ ID NO: 4029781 - RNA, 16 nt, Molluscum contagiosum virus
aucgagaugcgccgca

SEQ ID NO: 4029782 - RNA, 18 nt, Molluscum contagiosum virus
aucgagaugcucaagcac

SEQ ID NO: 4029783 - RNA, 18 nt, Molluscum contagiosum virus
aucgcagcagugccagca

SEQ ID NO: 4029784 - RNA, 14 nt, Molluscum contagiosum virus
aucgccagcaucaa

SEQ ID NO: 4029785 - RNA, 22 nt, Molluscum contagiosum virus
aucgcgucacguccucaagcgc

SEQ ID NO: 4029786 - RNA, 21 nt, Molluscum contagiosum virus
aucucgcccagcaccuggaac

SEQ ID NO: 4029787 - RNA, 19 nt, Molluscum contagiosum virus
aucucgccggcuguaaaug

SEQ ID NO: 4029788 - RNA, 23 nt, Molluscum contagiosum virus
aucugacggucguccuggagccu

SEQ ID NO: 4029789 - RNA, 19 nt, Molluscum contagiosum virus
aucugcgacacgcuggcga

SEQ ID NO: 4029790 - RNA, 19 nt, Molluscum contagiosum virus
aucugcgugacccucuucg

SEQ ID NO: 4029791 - RNA, 14 nt, Molluscum contagiosum virus
augaaggcgcggcu

SEQ ID NO: 4029792 - RNA, 20 nt, Molluscum contagiosum virus
augacuaugcgucuuccugc

SEQ ID NO: 4029793 - RNA, 17 nt, Molluscum contagiosum virus
augcaugcggagcuggc

SEQ ID NO: 4029794 - RNA, 20 nt, Molluscum contagiosum virus
augccagacccgaaagcugc

SEQ ID NO: 4029795 - RNA, 17 nt, Molluscum contagiosum virus
augccgccgcguacgcg

SEQ ID NO: 4029796 - RNA, 16 nt, Molluscum contagiosum virus
augcgacugccagcca

SEQ ID NO: 4029797 - RNA, 16 nt, Molluscum contagiosum virus
augcgcaagcagcucg

SEQ ID NO: 4029798 - RNA, 19 nt, Molluscum contagiosum virus
augcgcgggaugcuggacg

SEQ ID NO: 4029799 - RNA, 17 nt, Molluscum contagiosum virus
augcgcgguccuguccg

SEQ ID NO: 4029800 - RNA, 15 nt, Molluscum contagiosum virus
augcgcgugcggcgc

SEQ ID NO: 4029801 - RNA, 13 nt, Molluscum contagiosum virus
augcggcaggcgc

SEQ ID NO: 4029802 - RNA, 20 nt, Molluscum contagiosum virus
augcggcguacgcgcaggga

SEQ ID NO: 4029803 - RNA, 20 nt, Molluscum contagiosum virus
augcguaguaguagcgcucg

SEQ ID NO: 4029804 - RNA, 19 nt, Molluscum contagiosum virus
augcgucuuccugcugccg

SEQ ID NO: 4029805 - RNA, 19 nt, Molluscum contagiosum virus
augcucaagcaccugcgcu

SEQ ID NO: 4029806 - RNA, 17 nt, Molluscum contagiosum virus
augcugcgcgagcgcgc

SEQ ID NO: 4029807 - RNA, 22 nt, Molluscum contagiosum virus
augcugcgcgagcgcgcgcugc

SEQ ID NO: 4029808 - RNA, 16 nt, Molluscum contagiosum virus
augcuggacgggcacg

SEQ ID NO: 4029809 - RNA, 21 nt, Molluscum contagiosum virus
augcugguucugcgcugccag

SEQ ID NO: 4029810 - RNA, 22 nt, Molluscum contagiosum virus
augcuucccccuugcgucuccg

SEQ ID NO: 4029811 - RNA, 22 nt, Molluscum contagiosum virus
auggacauccucaccuuccugg

SEQ ID NO: 4029812 - RNA, 12 nt, Molluscum contagiosum virus
auggacgucgcg

SEQ ID NO: 4029813 - RNA, 15 nt, Molluscum contagiosum virus
auggaugcuggaugg

SEQ ID NO: 4029814 - RNA, 19 nt, Molluscum contagiosum virus
augggcacaagucucgcgc

SEQ ID NO: 4029815 - RNA, 20 nt, Molluscum contagiosum virus
augggcgugcucacgcugcc

SEQ ID NO: 4029816 - RNA, 16 nt, Molluscum contagiosum virus
auggucuuacgcgcuc

SEQ ID NO: 4029817 - RNA, 17 nt, Molluscum contagiosum virus
augguggcgcugcugcc

SEQ ID NO: 4029818 - RNA, 17 nt, Molluscum contagiosum virus
augguguacgaaaguac

SEQ ID NO: 4029819 - RNA, 19 nt, Molluscum contagiosum virus
augguugugcuuguucucu

SEQ ID NO: 4029820 - RNA, 15 nt, Molluscum contagiosum virus
auguacgucgucauc

SEQ ID NO: 4029821 - RNA, 19 nt, Molluscum contagiosum virus
augucacgcucacgcaguc

SEQ ID NO: 4029822 - RNA, 16 nt, Molluscum contagiosum virus
augugcgagaacuggc

SEQ ID NO: 4029823 - RNA, 20 nt, Molluscum contagiosum virus
auguucucuuuguuccugcg

SEQ ID NO: 4029824 - RNA, 23 nt, Molluscum contagiosum virus
auguucuucgcagaggacagcuc

SEQ ID NO: 4029825 - RNA, 16 nt, Molluscum contagiosum virus
auguugcucuaccugg

SEQ ID NO: 4029826 - RNA, 20 nt, Molluscum contagiosum virus
auucggcguacgugcgccag

SEQ ID NO: 4029827 - RNA, 22 nt, Molluscum contagiosum virus
auucucguggcguugcugcugc

SEQ ID NO: 4029828 - RNA, 23 nt, Molluscum contagiosum virus
auucuuguacgggcgugcgcagc

SEQ ID NO: 4029829 - RNA, 19 nt, Molluscum contagiosum virus
auugggugguggccacagc

SEQ ID NO: 4029830 - RNA, 16 nt, Molluscum contagiosum virus
auuguagagacgcugc

SEQ ID NO: 4029831 - RNA, 13 nt, Molluscum contagiosum virus
auuucacaagugg

SEQ ID NO: 4029832 - RNA, 16 nt, Molluscum contagiosum virus
caaaaacugaaaagcg

SEQ ID NO: 4029833 - RNA, 19 nt, Molluscum contagiosum virus
caaaacugaaaaaggauca

SEQ ID NO: 4029834 - RNA, 14 nt, Molluscum contagiosum virus
caaaagcacagcag

SEQ ID NO: 4029835 - RNA, 21 nt, Molluscum contagiosum virus
cagcgcgcgcagcaccgcggc

SEQ ID NO: 4029836 - RNA, 22 nt, Molluscum contagiosum virus
cagcgcgcgcagcaccgcggcg

SEQ ID NO: 4029837 - RNA, 17 nt, Molluscum contagiosum virus
cagcgcgcucgaggcgc

SEQ ID NO: 4029838 - RNA, 16 nt, Molluscum contagiosum virus
cagcgcguccaugcug

SEQ ID NO: 4029839 - RNA, 18 nt, Molluscum contagiosum virus
cagcgcgugcgcaggagc

SEQ ID NO: 4029840 - RNA, 20 nt, Molluscum contagiosum virus
cagcgcuuguuucgcaugca

SEQ ID NO: 4029841 - RNA, 19 nt, Molluscum contagiosum virus
cagcggaagaaacagccau

SEQ ID NO: 4029842 - RNA, 21 nt, Molluscum contagiosum virus
cagcggaagaaacagccaugu

SEQ ID NO: 4029843 - RNA, 16 nt, Molluscum contagiosum virus
cagcggcacugcgcgc

SEQ ID NO: 4029844 - RNA, 14 nt, Molluscum contagiosum virus
cagcggcaggcggc

SEQ ID NO: 4029845 - RNA, 13 nt, Molluscum contagiosum virus
cagcggcgcgugc

SEQ ID NO: 4029846 - RNA, 16 nt, Molluscum contagiosum virus
cagcggcgcgugcucc

SEQ ID NO: 4029847 - RNA, 22 nt, Molluscum contagiosum virus
cagcggcuuguagucgcccccg

SEQ ID NO: 4029848 - RNA, 16 nt, Molluscum contagiosum virus
cagcgggcgcugcucg

SEQ ID NO: 4029849 - RNA, 22 nt, Molluscum contagiosum virus
cagcgguggucuccgcgggcag

SEQ ID NO: 4029850 - RNA, 22 nt, Molluscum contagiosum virus
cagcguagcggacgaagcugug

SEQ ID NO: 4029851 - RNA, 21 nt, Molluscum contagiosum virus
cagcgugacaaucucugcgcc

SEQ ID NO: 4029852 - RNA, 14 nt, Molluscum contagiosum virus
cagcgugccgcggc

SEQ ID NO: 4029853 - RNA, 16 nt, Molluscum contagiosum virus
cagcgugccgcggcac

SEQ ID NO: 4029854 - RNA, 14 nt, Molluscum contagiosum virus
cagcuaagccggag

SEQ ID NO: 4029855 - RNA, 19 nt, Molluscum contagiosum virus
cagcuacgagccgcugcuc

SEQ ID NO: 4029856 - RNA, 19 nt, Molluscum contagiosum virus
cagcuacgaucgcgcucag

SEQ ID NO: 4029857 - RNA, 13 nt, Molluscum contagiosum virus
cagcucaagcugc

SEQ ID NO: 4029858 - RNA, 16 nt, Molluscum contagiosum virus
cagcucaagcugcuca

SEQ ID NO: 4029859 - RNA, 16 nt, Molluscum contagiosum virus
cagcucagcaggcugu

SEQ ID NO: 4029860 - RNA, 16 nt, Molluscum contagiosum virus
cagcucauagcccaug

SEQ ID NO: 4029861 - RNA, 20 nt, Molluscum contagiosum virus
cagcuccagcauggcgccac

SEQ ID NO: 4029862 - RNA, 12 nt, Molluscum contagiosum virus
cagcuccuccac

SEQ ID NO: 4029863 - RNA, 13 nt, Molluscum contagiosum virus
cagcuccugguag

SEQ ID NO: 4029864 - RNA, 13 nt, Molluscum contagiosum virus
cagcucgccgcgc

SEQ ID NO: 4029865 - RNA, 19 nt, Molluscum contagiosum virus
cagcucgccgcgcgccgcu

SEQ ID NO: 4029866 - RNA, 12 nt, Molluscum contagiosum virus
cagcucgcgcag

SEQ ID NO: 4029867 - RNA, 17 nt, Molluscum contagiosum virus
cagcucggggcugucag

SEQ ID NO: 4029868 - RNA, 17 nt, Molluscum contagiosum virus
cagcucguugcgcagcc

SEQ ID NO: 4029869 - RNA, 15 nt, Molluscum contagiosum virus
cagcugcgcgagccg

SEQ ID NO: 4029870 - RNA, 16 nt, Molluscum contagiosum virus
cagcugcgcgagccgc

SEQ ID NO: 4029871 - RNA, 18 nt, Molluscum contagiosum virus
cagcugcgcgagccgcug

SEQ ID NO: 4029872 - RNA, 14 nt, Molluscum contagiosum virus
cagcugcugcgcuu

SEQ ID NO: 4029873 - RNA, 21 nt, Molluscum contagiosum virus
cagcugcugcgcuucgccgcg

SEQ ID NO: 4029874 - RNA, 22 nt, Molluscum contagiosum virus
cagcugcugcgcuucgccgcgc

SEQ ID NO: 4029875 - RNA, 20 nt, Molluscum contagiosum virus
cagcugcuucucuucaugaa

SEQ ID NO: 4029876 - RNA, 15 nt, Molluscum contagiosum virus
cagcuggagcugccg

SEQ ID NO: 4029877 - RNA, 21 nt, Molluscum contagiosum virus
cagcuggcgcgcgccgagccc

SEQ ID NO: 4029878 - RNA, 12 nt, Molluscum contagiosum virus
cagcuucugcuc

SEQ ID NO: 4029879 - RNA, 17 nt, Molluscum contagiosum virus
cagcuucuuggagcccu

SEQ ID NO: 4029880 - RNA, 14 nt, Molluscum contagiosum virus
caggaacaaggcca

SEQ ID NO: 4029881 - RNA, 21 nt, Molluscum contagiosum virus
caggaacgaggaaaggcacac

SEQ ID NO: 4029882 - RNA, 18 nt, Molluscum contagiosum virus
caggaacgcaccacggcc

SEQ ID NO: 4029883 - RNA, 16 nt, Molluscum contagiosum virus
caggaacgcgccgcgg

SEQ ID NO: 4029884 - RNA, 14 nt, Molluscum contagiosum virus
caggaacgcgcgcu

SEQ ID NO: 4029885 - RNA, 16 nt, Molluscum contagiosum virus
caggaccugcuggugg

SEQ ID NO: 4029886 - RNA, 13 nt, Molluscum contagiosum virus
caggaccuggcug

SEQ ID NO: 4029887 - RNA, 23 nt, Molluscum contagiosum virus
caggagccucuguccugcgugcu

SEQ ID NO: 4029888 - RNA, 17 nt, Molluscum contagiosum virus
caggaggaccgcgagcg

SEQ ID NO: 4029889 - RNA, 22 nt, Molluscum contagiosum virus
caggcaguugccgcagcgggcu

SEQ ID NO: 4029890 - RNA, 18 nt, Molluscum contagiosum virus
caggcauggcauggcgcg

SEQ ID NO: 4029891 - RNA, 16 nt, Molluscum contagiosum virus
caggccaggugcagcg

SEQ ID NO: 4029892 - RNA, 21 nt, Molluscum contagiosum virus
caggccauggagcgcccgcug

SEQ ID NO: 4029893 - RNA, 21 nt, Molluscum contagiosum virus
aggcacccgcaacaaggaaag

SEQ ID NO: 4029894 - RNA, 19 nt, Molluscum contagiosum virus
aggcaccugcggcucgcac

SEQ ID NO: 4029895 - RNA, 15 nt, Molluscum contagiosum virus
aggcagccgcggcgc

SEQ ID NO: 4029896 - RNA, 14 nt, Molluscum contagiosum virus
aggcaggggccgcc

SEQ ID NO: 4029897 - RNA, 16 nt, Molluscum contagiosum virus
aggcauaccugugcca

SEQ ID NO: 4029898 - RNA, 18 nt, Molluscum contagiosum virus
aggccaacgccagcugua

SEQ ID NO: 4029899 - RNA, 18 nt, Molluscum contagiosum virus
aggcccacuuccgugagc

SEQ ID NO: 4029900 - RNA, 18 nt, Molluscum contagiosum virus
aggccggagacguaccca

SEQ ID NO: 4029901 - RNA, 18 nt, Molluscum contagiosum virus
aggccggcacgagcaguc

SEQ ID NO: 4029902 - RNA, 22 nt, Molluscum contagiosum virus
aggccgucagcgucgacggcgc

SEQ ID NO: 4029903 - RNA, 21 nt, Molluscum contagiosum virus
aggccguccccggaaagcagc

SEQ ID NO: 4029904 - RNA, 13 nt, Molluscum contagiosum virus
aggccugcugaag

SEQ ID NO: 4029905 - RNA, 20 nt, Molluscum contagiosum virus
aggccugcugaagaaggagc

SEQ ID NO: 4029906 - RNA, 22 nt, Molluscum contagiosum virus
aggccuucgcgcccgacgagcu

SEQ ID NO: 4029907 - RNA, 23 nt, Molluscum contagiosum virus
aggcgcacccucacaccuagagc

SEQ ID NO: 4029908 - RNA, 13 nt, Molluscum contagiosum virus
aggcgcaggccgc

SEQ ID NO: 4029909 - RNA, 16 nt, Molluscum contagiosum virus
aggcgccgaagagugc

SEQ ID NO: 4029910 - RNA, 19 nt, Molluscum contagiosum virus
aggcgccgucgacgcugac

SEQ ID NO: 4029911 - RNA, 17 nt, Molluscum contagiosum virus
aggcgcgccauggcgag

SEQ ID NO: 4029912 - RNA, 14 nt, Molluscum contagiosum virus
aggcgcgugcccug

SEQ ID NO: 4029913 - RNA, 13 nt, Molluscum contagiosum virus
aggcgcuggugga

SEQ ID NO: 4029914 - RNA, 17 nt, Molluscum contagiosum virus
aggcgcugucgcgcagg

SEQ ID NO: 4029915 - RNA, 19 nt, Molluscum contagiosum virus
aggcgcugucgcgcaggcu

SEQ ID NO: 4029916 - RNA, 16 nt, Molluscum contagiosum virus
aggcgucaugcgcgcg

SEQ ID NO: 4029917 - RNA, 16 nt, Molluscum contagiosum virus
aggcugcucccucucg

SEQ ID NO: 4029918 - RNA, 21 nt, Molluscum contagiosum virus
aggcuuucuuccucgacgagg

SEQ ID NO: 4029919 - RNA, 16 nt, Molluscum contagiosum virus
agggagccucgcuggu

SEQ ID NO: 4029920 - RNA, 18 nt, Molluscum contagiosum virus
agggaugcgcacacuugc

SEQ ID NO: 4029921 - RNA, 15 nt, Molluscum contagiosum virus
agggcacgcugcaca

SEQ ID NO: 4029922 - RNA, 21 nt, Molluscum contagiosum virus
agggcgaguccccgagcagcg

SEQ ID NO: 4029923 - RNA, 16 nt, Molluscum contagiosum virus
agggcggagccccgag

SEQ ID NO: 4029924 - RNA, 18 nt, Molluscum contagiosum virus
agggcggcgccugcgccu

SEQ ID NO: 4029925 - RNA, 19 nt, Molluscum contagiosum virus
agggcgugcuugccuggaa

SEQ ID NO: 4029926 - RNA, 17 nt, Molluscum contagiosum virus
agggcuacgaguucugc

SEQ ID NO: 4029927 - RNA, 19 nt, Molluscum contagiosum virus
agggcuccuucuucagcag

SEQ ID NO: 4029928 - RNA, 22 nt, Molluscum contagiosum virus
agggcuccuucuucagcaggcc

SEQ ID NO: 4029929 - RNA, 16 nt, Molluscum contagiosum virus
agggcucgccaugcug

SEQ ID NO: 4029930 - RNA, 12 nt, Molluscum contagiosum virus
aggggagccagc

SEQ ID NO: 4029931 - RNA, 20 nt, Molluscum contagiosum virus
aggggccguucgcgcgccag

SEQ ID NO: 4029932 - RNA, 23 nt, Molluscum contagiosum virus
aggggugccgcugcgcuggaugc

SEQ ID NO: 4029933 - RNA, 15 nt, Molluscum contagiosum virus
aggucacgacgagcg

SEQ ID NO: 4029934 - RNA, 13 nt, Molluscum contagiosum virus
aggucgagcgcgc

SEQ ID NO: 4029935 - RNA, 13 nt, Molluscum contagiosum virus
aggucgaggaggg

SEQ ID NO: 4029936 - RNA, 16 nt, Molluscum contagiosum virus
aggucuacgaggagca

SEQ ID NO: 4029937 - RNA, 13 nt, Molluscum contagiosum virus
aggucuuggggaa

SEQ ID NO: 4029938 - RNA, 16 nt, Molluscum contagiosum virus
aggugcacgugcugca

SEQ ID NO: 4029939 - RNA, 18 nt, Molluscum contagiosum virus
agguguuccugccgggag

SEQ ID NO: 4029940 - RNA, 18 nt, Molluscum contagiosum virus
agguugcgcggggcaggc

SEQ ID NO: 4029941 - RNA, 14 nt, Molluscum contagiosum virus
aguaccugcugccg

SEQ ID NO: 4029942 - RNA, 13 nt, Molluscum contagiosum virus
aguagcgagcagg

SEQ ID NO: 4029943 - RNA, 17 nt, Molluscum contagiosum virus
aguaucggcaacauuua

SEQ ID NO: 4029944 - RNA, 19 nt, Molluscum contagiosum virus
agucacacuacgcuggcuc

SEQ ID NO: 4029945 - RNA, 21 nt, Molluscum contagiosum virus
agucacgaccgacccaucgga

SEQ ID NO: 4029946 - RNA, 16 nt, Molluscum contagiosum virus
agucagcggcggcccc

SEQ ID NO: 4029947 - RNA, 20 nt, Molluscum contagiosum virus
agucaggcaaaagccgccgc

SEQ ID NO: 4029948 - RNA, 23 nt, Molluscum contagiosum virus
agucauucucuucgaaggcagcg

SEQ ID NO: 4029949 - RNA, 23 nt, Molluscum contagiosum virus
aguccacggguaccgugcgcgug

SEQ ID NO: 4029950 - RNA, 23 nt, Molluscum contagiosum virus
aguccaucggugggcucgcgcuu

SEQ ID NO: 4029951 - RNA, 23 nt, Molluscum contagiosum virus
aguccccgguucaaauccugguu

SEQ ID NO: 4029952 - RNA, 21 nt, Molluscum contagiosum virus
aguccucgacaaugagcacuu

SEQ ID NO: 4029953 - RNA, 17 nt, Molluscum contagiosum virus
agucgagcacgcgcgag

SEQ ID NO: 4029954 - RNA, 23 nt, Molluscum contagiosum virus
agucgcccguguucgcggagcug

SEQ ID NO: 4029955 - RNA, 20 nt, Molluscum contagiosum virus
agucgcccugcccgcgcgag

SEQ ID NO: 4029956 - RNA, 16 nt, Molluscum contagiosum virus
agucgcuagaggagau

SEQ ID NO: 4029957 - RNA, 17 nt, Molluscum contagiosum virus
agucggcguggccaggc

SEQ ID NO: 4029958 - RNA, 19 nt, Molluscum contagiosum virus
agucguacacgcagagcca

SEQ ID NO: 4029959 - RNA, 21 nt, Molluscum contagiosum virus
agucuuccuggggcuggacag

SEQ ID NO: 4029960 - RNA, 19 nt, Molluscum contagiosum virus
agugacuagcgcuggcugc

SEQ ID NO: 4029961 - RNA, 12 nt, Molluscum contagiosum virus
agugcaccagca

SEQ ID NO: 4029962 - RNA, 13 nt, Molluscum contagiosum virus
agugcaccagcac

SEQ ID NO: 4029963 - RNA, 23 nt, Molluscum contagiosum virus
agugcauccgcaacguggcgcug

SEQ ID NO: 4029964 - RNA, 18 nt, Molluscum contagiosum virus
gcucgcacccgcgccgcg

SEQ ID NO: 4029965 - RNA, 19 nt, Molluscum contagiosum virus
gcucgcacccgcgccgcgg

SEQ ID NO: 4029966 - RNA, 20 nt, Molluscum contagiosum virus
gcucgccuccuugcccgagg

SEQ ID NO: 4029967 - RNA, 15 nt, Molluscum contagiosum virus
gcucgcgcacgcgca

SEQ ID NO: 4029968 - RNA, 22 nt, Molluscum contagiosum virus
gcucgcgccugaaccugggcgc

SEQ ID NO: 4029969 - RNA, 15 nt, Molluscum contagiosum virus
gcucgcgcgccagca

SEQ ID NO: 4029970 - RNA, 16 nt, Molluscum contagiosum virus
gcucgcgcgccagcac

SEQ ID NO: 4029971 - RNA, 17 nt, Molluscum contagiosum virus
gcucgcggugcagcugc

SEQ ID NO: 4029972 - RNA, 14 nt, Molluscum contagiosum virus
gcucgcggugccgg

SEQ ID NO: 4029973 - RNA, 20 nt, Molluscum contagiosum virus
gcucgcgugccgcggacgcc

SEQ ID NO: 4029974 - RNA, 18 nt, Molluscum contagiosum virus
gcucgcgugcgugcugcg

SEQ ID NO: 4029975 - RNA, 16 nt, Molluscum contagiosum virus
gcucgcucgcgcgcag

SEQ ID NO: 4029976 - RNA, 13 nt, Molluscum contagiosum virus
gcucgcugccugg

SEQ ID NO: 4029977 - RNA, 16 nt, Molluscum contagiosum virus
gcucgcuugcccggag

SEQ ID NO: 4029978 - RNA, 14 nt, Molluscum contagiosum virus
gcucggaguccgcg

SEQ ID NO: 4029979 - RNA, 14 nt, Molluscum contagiosum virus
gcucggcccgcgga

SEQ ID NO: 4029980 - RNA, 13 nt, Molluscum contagiosum virus
gcucggcgagagc

SEQ ID NO: 4029981 - RNA, 16 nt, Molluscum contagiosum virus
gcucggcgagagcgcg

SEQ ID NO: 4029982 - RNA, 19 nt, Molluscum contagiosum virus
gcucggcguggugcuggcc

SEQ ID NO: 4029983 - RNA, 22 nt, Molluscum contagiosum virus
gcucgggcuagcaagcacgcca

SEQ ID NO: 4029984 - RNA, 19 nt, Molluscum contagiosum virus
gcucgguagccaggcgccg

SEQ ID NO: 4029985 - RNA, 20 nt, Molluscum contagiosum virus
gcucgguuggcggcgccgcg

SEQ ID NO: 4029986 - RNA, 22 nt, Molluscum contagiosum virus
gcucgucaaugcgcacgugcuc

SEQ ID NO: 4029987 - RNA, 15 nt, Molluscum contagiosum virus
gcucguccagcugcg

SEQ ID NO: 4029988 - RNA, 20 nt, Molluscum contagiosum virus
gcucgugcucucugcgcagg

SEQ ID NO: 4029989 - RNA, 14 nt, Molluscum contagiosum virus
gcucgugcucuugg

SEQ ID NO: 4029990 - RNA, 15 nt, Molluscum contagiosum virus
gcucgugcuggagca

SEQ ID NO: 4029991 - RNA, 15 nt, Molluscum contagiosum virus
gcucguugcgcagcc

SEQ ID NO: 4029992 - RNA, 18 nt, Molluscum contagiosum virus
gcucuaagcgcacgcgcg

SEQ ID NO: 4029993 - RNA, 13 nt, Molluscum contagiosum virus
gcucuccaugcgc

SEQ ID NO: 4029994 - RNA, 23 nt, Molluscum contagiosum virus
gcucucggccauggaggcgcuag

SEQ ID NO: 4029995 - RNA, 21 nt, Molluscum contagiosum virus
gcucugacaacacgagccucg

SEQ ID NO: 4029996 - RNA, 17 nt, Molluscum contagiosum virus
gcucugauuacauccug

SEQ ID NO: 4029997 - RNA, 15 nt, Molluscum contagiosum virus
gcucugcagcgccgc

SEQ ID NO: 4029998 - RNA, 22 nt, Molluscum contagiosum virus
gcucuggagccucccccgcgca

SEQ ID NO: 4029999 - RNA, 15 nt, Molluscum contagiosum virus
gcggcacgcgagcgc

SEQ ID NO: 4030000 - RNA, 14 nt, Molluscum contagiosum virus
gcggcacugcgcgc

SEQ ID NO: 4030001 - RNA, 15 nt, Molluscum contagiosum virus
gcggcagcagccucg

SEQ ID NO: 4030002 - RNA, 13 nt, Molluscum contagiosum virus
gcggcagcgccag

SEQ ID NO: 4030003 - RNA, 23 nt, Molluscum contagiosum virus
gcggcagcucugcagcgccgcgc

SEQ ID NO: 4030004 - RNA, 13 nt, Molluscum contagiosum virus
gcggcaggcgcug

SEQ ID NO: 4030005 - RNA, 19 nt, Molluscum contagiosum virus
gcggccaaccgccugcucu

SEQ ID NO: 4030006 - RNA, 22 nt, Molluscum contagiosum virus
gcggccacgcacucgcuggccu

SEQ ID NO: 4030007 - RNA, 12 nt, Molluscum contagiosum virus
gcggccgccauc

SEQ ID NO: 4030008 - RNA, 15 nt, Molluscum contagiosum virus
gcggccgcgagacgc

SEQ ID NO: 4030009 - RNA, 15 nt, Molluscum contagiosum virus
gcggccguggcacug

SEQ ID NO: 4030010 - RNA, 14 nt, Molluscum contagiosum virus
gcggccguggcugc

SEQ ID NO: 4030011 - RNA, 19 nt, Molluscum contagiosum virus
gcggccucccucgucgcgc

SEQ ID NO: 4030012 - RNA, 21 nt, Molluscum contagiosum virus
gcggcgagcgcauucgcgcgc

SEQ ID NO: 4030013 - RNA, 15 nt, Molluscum contagiosum virus
gcggcgcacgcggcu

SEQ ID NO: 4030014 - RNA, 22 nt, Molluscum contagiosum virus
gcggcgccgacaacgugcugcu

SEQ ID NO: 4030015 - RNA, 15 nt, Molluscum contagiosum virus
gcggcgccguggcgc

SEQ ID NO: 4030016 - RNA, 20 nt, Molluscum contagiosum virus
gcggcgccugcgccuggcau

SEQ ID NO: 4030017 - RNA, 16 nt, Molluscum contagiosum virus
gcggcgcgaagcaggc

SEQ ID NO: 4030018 - RNA, 18 nt, Molluscum contagiosum virus
gcggcgcgacggcgacgc

SEQ ID NO: 4030019 - RNA, 18 nt, Molluscum contagiosum virus
gcggcgcuacuggccgcg

SEQ ID NO: 4030020 - RNA, 20 nt, Molluscum contagiosum virus
gcggcgcuugauguccgcga

SEQ ID NO: 4030021 - RNA, 22 nt, Molluscum contagiosum virus
gcggcggccacgcucgcgcgca

SEQ ID NO: 4030022 - RNA, 14 nt, Molluscum contagiosum virus
gcggcgggguccuc

SEQ ID NO: 4030023 - RNA, 14 nt, Molluscum contagiosum virus
gcggcgucgcgcgc

SEQ ID NO: 4030024 - RNA, 13 nt, Molluscum contagiosum virus
gcggcgugcaggg

SEQ ID NO: 4030025 - RNA, 12 nt, Molluscum contagiosum virus
gcggcgugcccg

SEQ ID NO: 4030026 - RNA, 21 nt, Molluscum contagiosum virus
gcggcguguuccggcagcgcc

SEQ ID NO: 4030027 - RNA, 22 nt, Molluscum contagiosum virus
gcggcuagcaccgcaugggccc

SEQ ID NO: 4030028 - RNA, 18 nt, Molluscum contagiosum virus
gcggcuccaacagcagcu

SEQ ID NO: 4030029 - RNA, 14 nt, Molluscum contagiosum virus
gcggcuccgcgcgc

SEQ ID NO: 4030030 - RNA, 15 nt, Molluscum contagiosum virus
gcggcucucgcggcc

SEQ ID NO: 4030031 - RNA, 19 nt, Molluscum contagiosum virus
gcggcuggaccugcgccag

SEQ ID NO: 4030032 - RNA, 21 nt, Molluscum contagiosum virus
gcgggaagaaggugcucagca

SEQ ID NO: 4030033 - RNA, 20 nt, Molluscum contagiosum virus
gcgggaccgcccuuguggac

SEQ ID NO: 4030034 - RNA, 22 nt, Molluscum contagiosum virus
gcgggaccugguucaugcuggc

SEQ ID NO: 4030035 - RNA, 18 nt, Molluscum contagiosum virus
gcgggacgcgugccuggc

SEQ ID NO: 4030036 - RNA, 18 nt, Molluscum contagiosum virus
gcgggagggcgcaacucc

SEQ ID NO: 4030037 - RNA, 16 nt, Molluscum contagiosum virus
gcgggcaagcagggcc

SEQ ID NO: 4030038 - RNA, 18 nt, Molluscum contagiosum virus
gcgggcacggcuaccacg

SEQ ID NO: 4030039 - RNA, 19 nt, Molluscum contagiosum virus
gcgggcacgugcugcugcg

SEQ ID NO: 4030040 - RNA, 22 nt, Molluscum contagiosum virus
gcgggcacgugcugcugcggcu

SEQ ID NO: 4030041 - RNA, 21 nt, Molluscum contagiosum virus
gcgggcauguccuuggcggug

SEQ ID NO: 4030042 - RNA, 19 nt, Molluscum contagiosum virus
gcgggccaggcacuggccc

SEQ ID NO: 4030043 - RNA, 22 nt, Molluscum contagiosum virus
gcgggccaguacuacucggcgc

SEQ ID NO: 4030044 - RNA, 18 nt, Molluscum contagiosum virus
gcgggccaugucugugcg

SEQ ID NO: 4030045 - RNA, 22 nt, Molluscum contagiosum virus
gcgggcccgugcucaggccagc

SEQ ID NO: 4030046 - RNA, 15 nt, Molluscum contagiosum virus
gcgggccgcgcgcac

SEQ ID NO: 4030047 - RNA, 18 nt, Molluscum contagiosum virus
gcgggccuguccgcgggc

SEQ ID NO: 4030048 - RNA, 14 nt, Molluscum contagiosum virus
gcgggcgcaggccc

SEQ ID NO: 4030049 - RNA, 15 nt, Molluscum contagiosum virus
gcgggcgcgcgcgga

SEQ ID NO: 4030050 - RNA, 17 nt, Molluscum contagiosum virus
gcgggcguguccgcggg

SEQ ID NO: 4030051 - RNA, 19 nt, Molluscum contagiosum virus
gcgggcucuuccaccggca

SEQ ID NO: 4030052 - RNA, 13 nt, Molluscum contagiosum virus
gcgggcugggaaa

SEQ ID NO: 4030053 - RNA, 18 nt, Molluscum contagiosum virus
gcgggugccgccgugggc

SEQ ID NO: 4030054 - RNA, 19 nt, Molluscum contagiosum virus
gcggucgacgagugcgccg

SEQ ID NO: 4030055 - RNA, 20 nt, Molluscum contagiosum virus
gcggucgcgagccacgcgca

SEQ ID NO: 4030056 - RNA, 13 nt, Molluscum contagiosum virus
gcggugcagcgcc

SEQ ID NO: 4030057 - RNA, 14 nt, Molluscum contagiosum virus
gcggugcagcgccc

SEQ ID NO: 4030058 - RNA, 21 nt, Molluscum contagiosum virus
gcgguggucuccgcgggcagc

SEQ ID NO: 4030059 - RNA, 21 nt, Molluscum contagiosum virus
gcgguuguagcgguugaccag

SEQ ID NO: 4030060 - RNA, 14 nt, Molluscum contagiosum virus
gcguaacagcgcgc

SEQ ID NO: 4030061 - RNA, 20 nt, Molluscum contagiosum virus
gcguaaugcuggcgcguccg

SEQ ID NO: 4030062 - RNA, 13 nt, Molluscum contagiosum virus
gcguacagcgcgc

SEQ ID NO: 4030063 - RNA, 20 nt, Molluscum contagiosum virus
gcguacagcgcgcgugccgc

SEQ ID NO: 4030064 - RNA, 21 nt, Molluscum contagiosum virus
gcguacaucccgcacgugggc

SEQ ID NO: 4030065 - RNA, 18 nt, Molluscum contagiosum virus
gcguacgcgccggggcgc

SEQ ID NO: 4030066 - RNA, 18 nt, Molluscum contagiosum virus
gcguacgcgucgcggagg

SEQ ID NO: 4030067 - RNA, 21 nt, Molluscum contagiosum virus
gcguagagcaauacguggcgc

SEQ ID NO: 4030068 - RNA, 21 nt, Molluscum contagiosum virus
gcguagcggacgaagcugugc

SEQ ID NO: 4030069 - RNA, 21 nt, Molluscum contagiosum virus
gcguccagccgcagccgcgcu

SEQ ID NO: 4030070 - RNA, 12 nt, Molluscum contagiosum virus
gcguccaugagc

SEQ ID NO: 4030071 - RNA, 13 nt, Molluscum contagiosum virus
gcguccgcaggcg

SEQ ID NO: 4030072 - RNA, 14 nt, Molluscum contagiosum virus
gcguccggcgcucg

SEQ ID NO: 4030073 - RNA, 20 nt, Molluscum contagiosum virus
gcguccggcgcuugccccuc

SEQ ID NO: 4030074 - RNA, 16 nt, Molluscum contagiosum virus
gcgucgagggcgccgg

SEQ ID NO: 4030075 - RNA, 14 nt, Molluscum contagiosum virus
gcgucgccugagcu

SEQ ID NO: 4030076 - RNA, 16 nt, Molluscum contagiosum virus
gcgucgcgcaggcgcc

SEQ ID NO: 4030077 - RNA, 19 nt, Molluscum contagiosum virus
gcgucgcgcgccgcgcugg

SEQ ID NO: 4030078 - RNA, 20 nt, Molluscum contagiosum virus
gcgucgcggagcgcgcacgg

SEQ ID NO: 4030079 - RNA, 19 nt, Molluscum contagiosum virus
gcgucgugcuccacgcgca

SEQ ID NO: 4030080 - RNA, 14 nt, Molluscum contagiosum virus
gcgucuccgcgcgg

SEQ ID NO: 4030081 - RNA, 22 nt, Molluscum contagiosum virus
gcgucucucugucucccgccgc

SEQ ID NO: 4030082 - RNA, 16 nt, Molluscum contagiosum virus
gcgucuuacugcugca

SEQ ID NO: 4030083 - RNA, 21 nt, Molluscum contagiosum virus
gcgucuuccugcugccgggag

SEQ ID NO: 4030084 - RNA, 15 nt, Molluscum contagiosum virus
gcgugacccucuucg

SEQ ID NO: 4030085 - RNA, 14 nt, Molluscum contagiosum virus
gcgugacggugcug

SEQ ID NO: 4030086 - RNA, 20 nt, Molluscum contagiosum virus
gcgugacucggccgcggggc

SEQ ID NO: 4030087 - RNA, 21 nt, Molluscum contagiosum virus
gcgugcacccuccgcacagag

SEQ ID NO: 4030088 - RNA, 15 nt, Molluscum contagiosum virus
gcgugcaguuucucc

SEQ ID NO: 4030089 - RNA, 14 nt, Molluscum contagiosum virus
gcgugccgcccgag

SEQ ID NO: 4030090 - RNA, 15 nt, Molluscum contagiosum virus
gcgugccgcugcgcg

SEQ ID NO: 4030091 - RNA, 15 nt, Molluscum contagiosum virus
gcgugccuguggcgc

SEQ ID NO: 4030092 - RNA, 16 nt, Molluscum contagiosum virus
gcgugcgccgugcguc

SEQ ID NO: 4030093 - RNA, 15 nt, Molluscum contagiosum virus
gcgugcgcgggcacg

SEQ ID NO: 4030094 - RNA, 17 nt, Molluscum contagiosum virus
gcgugcguacgugcacg

SEQ ID NO: 4030095 - RNA, 15 nt, Molluscum contagiosum virus
gcgugcucacgcccu

SEQ ID NO: 4030096 - RNA, 17 nt, Molluscum contagiosum virus
gcgugcucacgcugccc

SEQ ID NO: 4030097 - RNA, 17 nt, Molluscum contagiosum virus
gcgugcucgguagcgug

SEQ ID NO: 4030098 - RNA, 14 nt, Molluscum contagiosum virus
gcgugcugcagccc

SEQ ID NO: 4030099 - RNA, 16 nt, Molluscum contagiosum virus
gcgugcuucacgugcu

SEQ ID NO: 4030100 - RNA, 22 nt, Molluscum contagiosum virus
gcguggacagcaucccugccac

SEQ ID NO: 4030101 - RNA, 17 nt, Molluscum contagiosum virus
gcgugggugaggagcuc

SEQ ID NO: 4030102 - RNA, 17 nt, Molluscum contagiosum virus
gcgugguguucgccggc

SEQ ID NO: 4030103 - RNA, 18 nt, Molluscum contagiosum virus
gcuggcgcacuggggcga

SEQ ID NO: 4030104 - RNA, 16 nt, Molluscum contagiosum virus
gcuggcgcgcgcgcaa

SEQ ID NO: 4030105 - RNA, 16 nt, Molluscum contagiosum virus
gcuggcgcucggcgug

SEQ ID NO: 4030106 - RNA, 21 nt, Molluscum contagiosum virus
gcuggcgcucggcguggugcu

SEQ ID NO: 4030107 - RNA, 22 nt, Molluscum contagiosum virus
gcuggcgcucggcguggugcug

SEQ ID NO: 4030108 - RNA, 12 nt, Molluscum contagiosum virus
gcuggcggggac

SEQ ID NO: 4030109 - RNA, 22 nt, Molluscum contagiosum virus
gcuggcuucuuguugucugcgg

SEQ ID NO: 4030110 - RNA, 20 nt, Molluscum contagiosum virus
gcugggauaacaggcgugcg

SEQ ID NO: 4030111 - RNA, 18 nt, Molluscum contagiosum virus
gcuggggcucgcgcaaua

SEQ ID NO: 4030112 - RNA, 16 nt, Molluscum contagiosum virus
gcugucagaggauucu

SEQ ID NO: 4030113 - RNA, 17 nt, Molluscum contagiosum virus
gcugugccgcagcaacc

SEQ ID NO: 4030114 - RNA, 14 nt, Molluscum contagiosum virus
gcuguucgcggcgc

SEQ ID NO: 4030115 - RNA, 16 nt, Molluscum contagiosum virus
gcuguugcugcugccg

SEQ ID NO: 4030116 - RNA, 15 nt, Molluscum contagiosum virus
gcuuacacacgcacc

SEQ ID NO: 4030117 - RNA, 22 nt, Molluscum contagiosum virus
gcuuagcacacgcgcgcgcagg

SEQ ID NO: 4030118 - RNA, 17 nt, Molluscum contagiosum virus
gcuuccgucugcugcuc

SEQ ID NO: 4030119 - RNA, 17 nt, Molluscum contagiosum virus
gcuucgccgcgcgcgcc

SEQ ID NO: 4030120 - RNA, 19 nt, Molluscum contagiosum virus
gcuucgccgcgcgcgccag

SEQ ID NO: 4030121 - RNA, 20 nt, Molluscum contagiosum virus
gcuucggaacgcucuucgca

SEQ ID NO: 4030122 - RNA, 19 nt, Molluscum contagiosum virus
gcuucggcggcugugcccg

SEQ ID NO: 4030123 - RNA, 19 nt, Molluscum contagiosum virus
gcuucuggcaaacgcacug

SEQ ID NO: 4030124 - RNA, 20 nt, Molluscum contagiosum virus
gcuucuggcaaacgcacugu

SEQ ID NO: 4030125 - RNA, 17 nt, Molluscum contagiosum virus
gcuucuuccggcagcug

SEQ ID NO: 4030126 - RNA, 17 nt, Molluscum contagiosum virus
gcuugcagacaaggaga

SEQ ID NO: 4030127 - RNA, 14 nt, Molluscum contagiosum virus
gcuugccccucgug

SEQ ID NO: 4030128 - RNA, 19 nt, Molluscum contagiosum virus
gcuugcccgaccuuggugc

SEQ ID NO: 4030129 - RNA, 13 nt, Molluscum contagiosum virus
gcuugccgcuuga

SEQ ID NO: 4030130 - RNA, 17 nt, Molluscum contagiosum virus
gcuugcucagcagcuuc

SEQ ID NO: 4030131 - RNA, 15 nt, Molluscum contagiosum virus
gcuugcugcaguaug

SEQ ID NO: 4030132 - RNA, 15 nt, Molluscum contagiosum virus
gcuuggcgggcagcg

SEQ ID NO: 4030133 - RNA, 17 nt, Molluscum contagiosum virus
gcuuguugucgagcaga

SEQ ID NO: 4030134 - RNA, 18 nt, Molluscum contagiosum virus
ggaaaacuguaggggagg

SEQ ID NO: 4030135 - RNA, 15 nt, Molluscum contagiosum virus
ggaaagauagggcau

SEQ ID NO: 4030136 - RNA, 15 nt, Molluscum contagiosum virus
ggaaaggcacccacc

SEQ ID NO: 4030137 - RNA, 14 nt, Molluscum contagiosum virus
ggaacagggaaaaa

SEQ ID NO: 4030138 - RNA, 18 nt, Molluscum contagiosum virus
ggaacaggugcgcaagca

SEQ ID NO: 4030139 - RNA, 21 nt, Molluscum contagiosum virus
ggaacggcucaccgcgcagaa

SEQ ID NO: 4030140 - RNA, 14 nt, Molluscum contagiosum virus
ggaacucgcgcgcg

SEQ ID NO: 4030141 - RNA, 21 nt, Molluscum contagiosum virus
ggaacucuacgacaugcucgc

SEQ ID NO: 4030142 - RNA, 15 nt, Molluscum contagiosum virus
ggaagacgucgggaa

SEQ ID NO: 4030143 - RNA, 14 nt, Molluscum contagiosum virus
ggaagacgugcugc

SEQ ID NO: 4030144 - RNA, 18 nt, Molluscum contagiosum virus
ggaagcaacgacaaggaa

SEQ ID NO: 4030145 - RNA, 19 nt, Molluscum contagiosum virus
cucgaagccuucgcagaga

SEQ ID NO: 4030146 - RNA, 15 nt, Molluscum contagiosum virus
cucgacaaugagcac

SEQ ID NO: 4030147 - RNA, 18 nt, Molluscum contagiosum virus
cucgacauuucgcgccug

SEQ ID NO: 4030148 - RNA, 20 nt, Molluscum contagiosum virus
cucgaccaaaugcgcgugcg

SEQ ID NO: 4030149 - RNA, 20 nt, Molluscum contagiosum virus
cucgacgcguucuagcagcg

SEQ ID NO: 4030150 - RNA, 20 nt, Molluscum contagiosum virus
cucgacugcguugucuccuc

SEQ ID NO: 4030151 - RNA, 16 nt, Molluscum contagiosum virus
cucgagaagagggucg

SEQ ID NO: 4030152 - RNA, 18 nt, Molluscum contagiosum virus
cucgagagggagcagccu

SEQ ID NO: 4030153 - RNA, 13 nt, Molluscum contagiosum virus
cucgagcacgccu

SEQ ID NO: 4030154 - RNA, 11 nt, Molluscum contagiosum virus
cucgagcacgu

SEQ ID NO: 4030155 - RNA, 19 nt, Molluscum contagiosum virus
cucgagcgagcuacgcgcu

SEQ ID NO: 4030156 - RNA, 18 nt, Molluscum contagiosum virus
cucgagcgcgcgccugcu

SEQ ID NO: 4030157 - RNA, 14 nt, Molluscum contagiosum virus
cucgagcuccaggg

SEQ ID NO: 4030158 - RNA, 23 nt, Molluscum contagiosum virus
cucgagcuuccucaaggcgcacg

SEQ ID NO: 4030159 - RNA, 21 nt, Molluscum contagiosum virus
cucgaggccggcacgagcagu

SEQ ID NO: 4030160 - RNA, 19 nt, Molluscum contagiosum virus
cucgaggcgcuugggcacu

SEQ ID NO: 4030161 - RNA, 22 nt, Molluscum contagiosum virus
cucgaggucgugcaggccgugc

SEQ ID NO: 4030162 - RNA, 23 nt, Molluscum contagiosum virus
cucgaggucgugcaggccgugcu

SEQ ID NO: 4030163 - RNA, 22 nt, Molluscum contagiosum virus
cucgcagcguuccaggaacgcc

SEQ ID NO: 4030164 - RNA, 23 nt, Molluscum contagiosum virus
cucgcaggcgaggucacacucga

SEQ ID NO: 4030165 - RNA, 13 nt, Molluscum contagiosum virus
cucgcccagcucg

SEQ ID NO: 4030166 - RNA, 20 nt, Molluscum contagiosum virus
cucgcccgcgcgcgcgcgaa

SEQ ID NO: 4030167 - RNA, 14 nt, Molluscum contagiosum virus
cucgcgagaaguuc

SEQ ID NO: 4030168 - RNA, 14 nt, Molluscum contagiosum virus
cucgcgagcacuuu

SEQ ID NO: 4030169 - RNA, 22 nt, Molluscum contagiosum virus
cucgcgagcguuucugccggag

SEQ ID NO: 4030170 - RNA, 17 nt, Molluscum contagiosum virus
cucgcgcaucugccgcg

SEQ ID NO: 4030171 - RNA, 21 nt, Molluscum contagiosum virus
cucgcgcgcagcacaccgucg

SEQ ID NO: 4030172 - RNA, 15 nt, Molluscum contagiosum virus
cucgcgcgcagcucg

SEQ ID NO: 4030173 - RNA, 15 nt, Molluscum contagiosum virus
cucgcgcgcagggcg

SEQ ID NO: 4030174 - RNA, 13 nt, Molluscum contagiosum virus
cucgcgcgccacc

SEQ ID NO: 4030175 - RNA, 13 nt, Molluscum contagiosum virus
cucgcgcgccagc

SEQ ID NO: 4030176 - RNA, 14 nt, Molluscum contagiosum virus
cucgcgcgccagca

SEQ ID NO: 4030177 - RNA, 16 nt, Molluscum contagiosum virus
cucgcgcgcgagcacg

SEQ ID NO: 4030178 - RNA, 16 nt, Molluscum contagiosum virus
cucgcgcgcgcacgcc

SEQ ID NO: 4030179 - RNA, 13 nt, Molluscum contagiosum virus
cucgcggcagugc

SEQ ID NO: 4030180 - RNA, 22 nt, Molluscum contagiosum virus
cucgcggucgggccccugcgcg

SEQ ID NO: 4030181 - RNA, 16 nt, Molluscum contagiosum virus
cucgcggugcagcugc

SEQ ID NO: 4030182 - RNA, 14 nt, Molluscum contagiosum virus
cucgcguccgcauc

SEQ ID NO: 4030183 - RNA, 18 nt, Molluscum contagiosum virus
cucgcgucugcaaggccu

SEQ ID NO: 4030184 - RNA, 24 nt, Molluscum contagiosum virus
cucgcucaucaccgacacgcgccc

SEQ ID NO: 4030185 - RNA, 19 nt, Molluscum contagiosum virus
cucgcucggaaagagcgcg

SEQ ID NO: 4030186 - RNA, 23 nt, Molluscum contagiosum virus
cucgcucggaaagagcgcgcgaa

SEQ ID NO: 4030187 - RNA, 22 nt, Molluscum contagiosum virus
cucgcugccagagauccgcccg

SEQ ID NO: 4030188 - RNA, 12 nt, Molluscum contagiosum virus
cucgcugcugcc

SEQ ID NO: 4030189 - RNA, 21 nt, Molluscum contagiosum virus
cucgcugcugcucuuccagga

SEQ ID NO: 4030190 - RNA, 15 nt, Molluscum contagiosum virus
cucgcuggcuccgcu

SEQ ID NO: 4030191 - RNA, 11 nt, Molluscum contagiosum virus
cucggacagug

SEQ ID NO: 4030192 - RNA, 20 nt, Molluscum contagiosum virus
cucggcacugcuggcgcgcg

SEQ ID NO: 4030193 - RNA, 17 nt, Molluscum contagiosum virus
cucggcguccgcagcgg

SEQ ID NO: 4030194 - RNA, 17 nt, Molluscum contagiosum virus
cucgggccggcgcgccg

SEQ ID NO: 4030195 - RNA, 23 nt, Molluscum contagiosum virus
cucgguagcguggagcuggucca

SEQ ID NO: 4030196 - RNA, 23 nt, Molluscum contagiosum virus
cucgguuggcggcgccgcgaucu

SEQ ID NO: 4030197 - RNA, 16 nt, Molluscum contagiosum virus
cucguccggcgcucgc

SEQ ID NO: 4030198 - RNA, 14 nt, Molluscum contagiosum virus
cucgucgcugcgga

SEQ ID NO: 4030199 - RNA, 22 nt, Molluscum contagiosum virus
cucgugcaugacggcgcgagcc

SEQ ID NO: 4030200 - RNA, 20 nt, Molluscum contagiosum virus
cucgugccgccugcgcgcac

SEQ ID NO: 4030201 - RNA, 14 nt, Molluscum contagiosum virus
cucguggacagccu

SEQ ID NO: 4030202 - RNA, 20 nt, Molluscum contagiosum virus
cucguggacagccugcaccg

SEQ ID NO: 4030203 - RNA, 21 nt, Molluscum contagiosum virus
cucguggacagccugcaccga

SEQ ID NO: 4030204 - RNA, 20 nt, Molluscum contagiosum virus
cucguggcguugcugcugcg

SEQ ID NO: 4030205 - RNA, 18 nt, Molluscum contagiosum virus
cucgugggauaggcacac

SEQ ID NO: 4030206 - RNA, 14 nt, Molluscum contagiosum virus
cucuaccuggugcu

SEQ ID NO: 4030207 - RNA, 21 nt, Molluscum contagiosum virus
cucuacgccgcgcaccuggag

SEQ ID NO: 4030208 - RNA, 12 nt, Molluscum contagiosum virus
cucuaggagcuc

SEQ ID NO: 4030209 - RNA, 12 nt, Molluscum contagiosum virus
cucucagcggca

SEQ ID NO: 4030210 - RNA, 15 nt, Molluscum contagiosum virus
cucuccgaagaagaa

SEQ ID NO: 4030211 - RNA, 12 nt, Molluscum contagiosum virus
cucucgagcacu

SEQ ID NO: 4030212 - RNA, 20 nt, Molluscum contagiosum virus
cucucggagaaguggccggc

SEQ ID NO: 4030213 - RNA, 22 nt, Molluscum contagiosum virus
cucucgggcucgcgggacgacg

SEQ ID NO: 4030214 - RNA, 13 nt, Molluscum contagiosum virus
cucucguggggag

SEQ ID NO: 4030215 - RNA, 20 nt, Molluscum contagiosum virus
cucugacccgcgccuacucc

SEQ ID NO: 4030216 - RNA, 13 nt, Molluscum contagiosum virus
cucugccugcaag

SEQ ID NO: 4030217 - RNA, 14 nt, Molluscum contagiosum virus
cucugcgagcgccu

SEQ ID NO: 4030218 - RNA, 14 nt, Molluscum contagiosum virus
cucugcgcagagcg

SEQ ID NO: 4030219 - RNA, 18 nt, Molluscum contagiosum virus
cucugcgcagguagcggc

SEQ ID NO: 4030220 - RNA, 21 nt, Molluscum contagiosum virus
cucugcgcgagcagcugcugc

SEQ ID NO: 4030221 - RNA, 21 nt, Molluscum contagiosum virus
cucugcgcgcaagucaccgcu

SEQ ID NO: 4030222 - RNA, 24 nt, Molluscum contagiosum virus
cucugcguaagcgccugcacacgc

SEQ ID NO: 4030223 - RNA, 16 nt, Molluscum contagiosum virus
cucuggaaggagcugg

SEQ ID NO: 4030224 - RNA, 12 nt, Molluscum contagiosum virus
cucuggcuccag

SEQ ID NO: 4030225 - RNA, 16 nt, Molluscum contagiosum virus
cucuggcuccagggga

SEQ ID NO: 4030226 - RNA, 15 nt, Molluscum contagiosum virus
cucugucgacagucu

SEQ ID NO: 4030227 - RNA, 23 nt, Molluscum contagiosum virus
cucuguugcguuggcgccagccu

SEQ ID NO: 4030228 - RNA, 15 nt, Molluscum contagiosum virus
cucuucgcaggcgug

SEQ ID NO: 4030229 - RNA, 18 nt, Molluscum contagiosum virus
cucuucggggacggcgug

SEQ ID NO: 4030230 - RNA, 14 nt, Molluscum contagiosum virus
cugaaccugggcgc

SEQ ID NO: 4030231 - RNA, 15 nt, Molluscum contagiosum virus
gcccgagcgcgcgug

SEQ ID NO: 4030232 - RNA, 17 nt, Molluscum contagiosum virus
gcccgagcgucaguguu

SEQ ID NO: 4030233 - RNA, 23 nt, Molluscum contagiosum virus
gcccgaggacgagccccgcgccg

SEQ ID NO: 4030234 - RNA, 22 nt, Molluscum contagiosum virus
gcccgagggcgggcacgugcug

SEQ ID NO: 4030235 - RNA, 17 nt, Molluscum contagiosum virus
gcccgaguucgcggcgc

SEQ ID NO: 4030236 - RNA, 16 nt, Molluscum contagiosum virus
gcccgccgcccaaggg

SEQ ID NO: 4030237 - RNA, 17 nt, Molluscum contagiosum virus
gcccgccucgucgucca

SEQ ID NO: 4030238 - RNA, 17 nt, Molluscum contagiosum virus
gcccgccugccgcgagc

SEQ ID NO: 4030239 - RNA, 20 nt, Molluscum contagiosum virus
gcccgcgcacgagcugcugc

SEQ ID NO: 4030240 - RNA, 23 nt, Molluscum contagiosum virus
gcccgcgcacgagcugcugcccg

SEQ ID NO: 4030241 - RNA, 12 nt, Molluscum contagiosum virus
gcccgcgccgca

SEQ ID NO: 4030242 - RNA, 17 nt, Molluscum contagiosum virus
gcccgcgcgcgacuacg

SEQ ID NO: 4030243 - RNA, 21 nt, Molluscum contagiosum virus
gcccgcgcucuuacugcagca

SEQ ID NO: 4030244 - RNA, 15 nt, Molluscum contagiosum virus
gcccgcggcgcacgg

SEQ ID NO: 4030245 - RNA, 15 nt, Molluscum contagiosum virus
gcccgcggcgcgcag

SEQ ID NO: 4030246 - RNA, 16 nt, Molluscum contagiosum virus
gcccgcgucgcgcgcc

SEQ ID NO: 4030247 - RNA, 14 nt, Molluscum contagiosum virus
gcccgcgugcaccc

SEQ ID NO: 4030248 - RNA, 18 nt, Molluscum contagiosum virus
gcccgcugcgcgcucugg

SEQ ID NO: 4030249 - RNA, 23 nt, Molluscum contagiosum virus
gcccgcuggcggcgcacgcgagc

SEQ ID NO: 4030250 - RNA, 22 nt, Molluscum contagiosum virus
gcccggaagcuugcucagcagc

SEQ ID NO: 4030251 - RNA, 22 nt, Molluscum contagiosum virus
gcccggcaggcucccgcugucg

SEQ ID NO: 4030252 - RNA, 18 nt, Molluscum contagiosum virus
gcccgguacgcucgcgcu

SEQ ID NO: 4030253 - RNA, 20 nt, Molluscum contagiosum virus
gcccgugccgccggcgccgc

SEQ ID NO: 4030254 - RNA, 15 nt, Molluscum contagiosum virus
gcccgugcgccugcc

SEQ ID NO: 4030255 - RNA, 19 nt, Molluscum contagiosum virus
gcccgugcuggagggcacg

SEQ ID NO: 4030256 - RNA, 15 nt, Molluscum contagiosum virus
gcccguggugggccg

SEQ ID NO: 4030257 - RNA, 16 nt, Molluscum contagiosum virus
gcccuacgcgcgcgug

SEQ ID NO: 4030258 - RNA, 15 nt, Molluscum contagiosum virus
gcccuccucgaccug

SEQ ID NO: 4030259 - RNA, 16 nt, Molluscum contagiosum virus
gcccugcuagugcgcg

SEQ ID NO: 4030260 - RNA, 15 nt, Molluscum contagiosum virus
gcccuuccuggaggg

SEQ ID NO: 4030261 - RNA, 14 nt, Molluscum contagiosum virus
gcccuucuugacgc

SEQ ID NO: 4030262 - RNA, 22 nt, Molluscum contagiosum virus
gcccuucuugacgcgagacugu

SEQ ID NO: 4030263 - RNA, 15 nt, Molluscum contagiosum virus
gccgacagcgcgcgc

SEQ ID NO: 4030264 - RNA, 16 nt, Molluscum contagiosum virus
gccgacgugugccgcu

SEQ ID NO: 4030265 - RNA, 16 nt, Molluscum contagiosum virus
gccgagccgcuggccg

SEQ ID NO: 4030266 - RNA, 17 nt, Molluscum contagiosum virus
gccgagccgcuggccga

SEQ ID NO: 4030267 - RNA, 14 nt, Molluscum contagiosum virus
gccgagccggggga

SEQ ID NO: 4030268 - RNA, 15 nt, Molluscum contagiosum virus
gccgagcgcacgccg

SEQ ID NO: 4030269 - RNA, 21 nt, Molluscum contagiosum virus
gccgagcgugaccagugcgug

SEQ ID NO: 4030270 - RNA, 19 nt, Molluscum contagiosum virus
gccgagcucuuccccgcgg

SEQ ID NO: 4030271 - RNA, 13 nt, Molluscum contagiosum virus
gccgaggcgcugc

SEQ ID NO: 4030272 - RNA, 19 nt, Molluscum contagiosum virus
gccgaguaccgcgcgcacg

SEQ ID NO: 4030273 - RNA, 20 nt, Molluscum contagiosum virus
gccgaugcagugcggaugug

SEQ ID NO: 4030274 - RNA, 13 nt, Molluscum contagiosum virus
gccgcaaacacug

SEQ ID NO: 4030275 - RNA, 14 nt, Molluscum contagiosum virus
gccgcaagcacacg

SEQ ID NO: 4030276 - RNA, 16 nt, Molluscum contagiosum virus
gccgcacgcugcugcg

SEQ ID NO: 4030277 - RNA, 21 nt, Molluscum contagiosum virus
gccgcacgcugcugcgugcgc

SEQ ID NO: 4030278 - RNA, 13 nt, Molluscum contagiosum virus
gccgcacgugcug

SEQ ID NO: 4030279 - RNA, 19 nt, Molluscum contagiosum virus
gccgcagaacacgggggcu

SEQ ID NO: 4030280 - RNA, 23 nt, Molluscum contagiosum virus
gccgcagagccgcgaaagcgucg

SEQ ID NO: 4030281 - RNA, 19 nt, Molluscum contagiosum virus
gccgcagcccgagcgcgcg

SEQ ID NO: 4030282 - RNA, 11 nt, Molluscum contagiosum virus
gccgcaggaac

SEQ ID NO: 4030283 - RNA, 16 nt, Molluscum contagiosum virus
gccgcaggccaggugc

SEQ ID NO: 4030284 - RNA, 16 nt, Molluscum contagiosum virus
gccgcaggcgcgcgcc

SEQ ID NO: 4030285 - RNA, 22 nt, Molluscum contagiosum virus
gccgcaugcaccuacgcgccga

SEQ ID NO: 4030286 - RNA, 14 nt, Molluscum contagiosum virus
gccgccagccacga

SEQ ID NO: 4030287 - RNA, 16 nt, Molluscum contagiosum virus
gccgccaugcugcgcg

SEQ ID NO: 4030288 - RNA, 17 nt, Molluscum contagiosum virus
gccgccaugcugcgcga

SEQ ID NO: 4030289 - RNA, 17 nt, Molluscum contagiosum virus
gccgccgcaggcccggc

SEQ ID NO: 4030290 - RNA, 21 nt, Molluscum contagiosum virus
gccgccgcguacgcgccgggg

SEQ ID NO: 4030291 - RNA, 22 nt, Molluscum contagiosum virus
gccgccggugcgugcccagcag

SEQ ID NO: 4030292 - RNA, 16 nt, Molluscum contagiosum virus
gccgccucgcgcgcac

SEQ ID NO: 4030293 - RNA, 23 nt, Molluscum contagiosum virus
gccgccugcgcgcacccgagggc

SEQ ID NO: 4030294 - RNA, 23 nt, Molluscum contagiosum virus
gccgcgaaagaggaaagcgcaca

SEQ ID NO: 4030295 - RNA, 14 nt, Molluscum contagiosum virus
gccgcgcaccugga

SEQ ID NO: 4030296 - RNA, 17 nt, Molluscum contagiosum virus
gccgcgccgcugcgccg

SEQ ID NO: 4030297 - RNA, 20 nt, Molluscum contagiosum virus
gccgcgccuugagcgcgccg

SEQ ID NO: 4030298 - RNA, 13 nt, Molluscum contagiosum virus
gccgcgcgcgcac

SEQ ID NO: 4030299 - RNA, 20 nt, Molluscum contagiosum virus
gccgcgcugcuccgugccca

SEQ ID NO: 4030300 - RNA, 23 nt, Molluscum contagiosum virus
gccgcgcuucacggagaucaggc

SEQ ID NO: 4030301 - RNA, 22 nt, Molluscum contagiosum virus
gccgcggaacugacugcugccc

SEQ ID NO: 4030302 - RNA, 14 nt, Molluscum contagiosum virus
gccgcggcagcucu

SEQ ID NO: 4030303 - RNA, 14 nt, Molluscum contagiosum virus
gccgcggcgggggc

SEQ ID NO: 4030304 - RNA, 12 nt, Molluscum contagiosum virus
gccgcgggcaca

SEQ ID NO: 4030305 - RNA, 23 nt, Molluscum contagiosum virus
gccgcggugccgggcgucuccgc

SEQ ID NO: 4030306 - RNA, 16 nt, Molluscum contagiosum virus
gccgcgugcgccgccg

SEQ ID NO: 4030307 - RNA, 15 nt, Molluscum contagiosum virus
gccgcgugcucgugu

SEQ ID NO: 4030308 - RNA, 12 nt, Molluscum contagiosum virus
gccgcgugcugg

SEQ ID NO: 4030309 - RNA, 15 nt, Molluscum contagiosum virus
gccgcguugcagcag

SEQ ID NO: 4030310 - RNA, 12 nt, Molluscum contagiosum virus
gccgcuccagag

SEQ ID NO: 4030311 - RNA, 17 nt, Molluscum contagiosum virus
gccgcucggcccgcgga

SEQ ID NO: 4030312 - RNA, 16 nt, Molluscum contagiosum virus
gccgcucgucgcugcg

SEQ ID NO: 4030313 - RNA, 17 nt, Molluscum contagiosum virus
gccgcugcgccgccagc

SEQ ID NO: 4030314 - RNA, 18 nt, Molluscum contagiosum virus
gccgcugcgcuugcucac

SEQ ID NO: 4030315 - RNA, 13 nt, Molluscum contagiosum virus
gccgcuggacgcc

SEQ ID NO: 4030316 - RNA, 15 nt, Molluscum contagiosum virus
gccgcuucgggcuca

SEQ ID NO: 4030317 - RNA, 15 nt, Molluscum contagiosum virus
gccgcuucuugacgc

SEQ ID NO: 4030318 - RNA, 22 nt, Molluscum contagiosum virus
gcagcgucgcggagcgcgcacg

SEQ ID NO: 4030319 - RNA, 21 nt, Molluscum contagiosum virus
gcagcgugcgcaccagcugca

SEQ ID NO: 4030320 - RNA, 13 nt, Molluscum contagiosum virus
gcagcgugucaag

SEQ ID NO: 4030321 - RNA, 23 nt, Molluscum contagiosum virus
gcagcguugcuauuaccugaccg

SEQ ID NO: 4030322 - RNA, 20 nt, Molluscum contagiosum virus
gcagcuaccgcgcgcgcaag

SEQ ID NO: 4030323 - RNA, 16 nt, Molluscum contagiosum virus
gcagcuacugcgugcg

SEQ ID NO: 4030324 - RNA, 14 nt, Molluscum contagiosum virus
gcagcuccagcaug

SEQ ID NO: 4030325 - RNA, 12 nt, Molluscum contagiosum virus
gcagcuccgcga

SEQ ID NO: 4030326 - RNA, 18 nt, Molluscum contagiosum virus
gcagcuccuagcgcgcgu

SEQ ID NO: 4030327 - RNA, 17 nt, Molluscum contagiosum virus
gcagcucugcagcgccg

SEQ ID NO: 4030328 - RNA, 12 nt, Molluscum contagiosum virus
gcagcugccgca

SEQ ID NO: 4030329 - RNA, 15 nt, Molluscum contagiosum virus
gcagcugcugcgcac

SEQ ID NO: 4030330 - RNA, 15 nt, Molluscum contagiosum virus
gcagcugcugcgcuc

SEQ ID NO: 4030331 - RNA, 17 nt, Molluscum contagiosum virus
gcagcuucuuggagccc

SEQ ID NO: 4030332 - RNA, 20 nt, Molluscum contagiosum virus
gcagcuucuuggagcccuug

SEQ ID NO: 4030333 - RNA, 21 nt, Molluscum contagiosum virus
gcaggaaagguaccccgcagg

SEQ ID NO: 4030334 - RNA, 17 nt, Molluscum contagiosum virus
gcaggaacgcgcgcucg

SEQ ID NO: 4030335 - RNA, 17 nt, Molluscum contagiosum virus
gcaggaagcuggcgcgg

SEQ ID NO: 4030336 - RNA, 18 nt, Molluscum contagiosum virus
gcaggaccuggcuggcgc

SEQ ID NO: 4030337 - RNA, 19 nt, Molluscum contagiosum virus
gcaggagcacgccuggcgg

SEQ ID NO: 4030338 - RNA, 18 nt, Molluscum contagiosum virus
gcaggcaaagcggggcgc

SEQ ID NO: 4030339 - RNA, 14 nt, Molluscum contagiosum virus
gcaggccgugcuca

SEQ ID NO: 4030340 - RNA, 13 nt, Molluscum contagiosum virus
gcaggcgagguca

SEQ ID NO: 4030341 - RNA, 21 nt, Molluscum contagiosum virus
gcaggcgcugcgcggcgcgcg

SEQ ID NO: 4030342 - RNA, 12 nt, Molluscum contagiosum virus
gcaggcuguguu

SEQ ID NO: 4030343 - RNA, 22 nt, Molluscum contagiosum virus
gcagggaaagagcacgcgcucg

SEQ ID NO: 4030344 - RNA, 19 nt, Molluscum contagiosum virus
gcaggucaacuccgagcgc

SEQ ID NO: 4030345 - RNA, 18 nt, Molluscum contagiosum virus
gcagguggccgcgcgcgc

SEQ ID NO: 4030346 - RNA, 14 nt, Molluscum contagiosum virus
gcagguucucgcac

SEQ ID NO: 4030347 - RNA, 18 nt, Molluscum contagiosum virus
gcagguugaagcucucgc

SEQ ID NO: 4030348 - RNA, 18 nt, Molluscum contagiosum virus
gcaguaccggccaaggca

SEQ ID NO: 4030349 - RNA, 17 nt, Molluscum contagiosum virus
gcagucacgacuguguu

SEQ ID NO: 4030350 - RNA, 14 nt, Molluscum contagiosum virus
gcagucgccuuccu

SEQ ID NO: 4030351 - RNA, 16 nt, Molluscum contagiosum virus
gcagugcaccagcacc

SEQ ID NO: 4030352 - RNA, 18 nt, Molluscum contagiosum virus
gcagugccaagguucugg

SEQ ID NO: 4030353 - RNA, 17 nt, Molluscum contagiosum virus
gcagugccgccgcgcgc

SEQ ID NO: 4030354 - RNA, 17 nt, Molluscum contagiosum virus
gcagugcggccagcacc

SEQ ID NO: 4030355 - RNA, 22 nt, Molluscum contagiosum virus
gcagugcucgcacacgugcacg

SEQ ID NO: 4030356 - RNA, 17 nt, Molluscum contagiosum virus
gcaguguuucgacgccg

SEQ ID NO: 4030357 - RNA, 16 nt, Molluscum contagiosum virus
gcauacacuuccugcu

SEQ ID NO: 4030358 - RNA, 14 nt, Molluscum contagiosum virus
gcauagucaucaaa

SEQ ID NO: 4030359 - RNA, 22 nt, Molluscum contagiosum virus
gcaucccugcgcaccugcacga

SEQ ID NO: 4030360 - RNA, 21 nt, Molluscum contagiosum virus
gcaucgcaguucggcgacacg

SEQ ID NO: 4030361 - RNA, 16 nt, Molluscum contagiosum virus
gcaucgcgcugcuggu

SEQ ID NO: 4030362 - RNA, 17 nt, Molluscum contagiosum virus
gcaucggcggcagcgcc

SEQ ID NO: 4030363 - RNA, 21 nt, Molluscum contagiosum virus
gcaugcgcccucacgugcuga

SEQ ID NO: 4030364 - RNA, 14 nt, Molluscum contagiosum virus
gcaugcgccugcac

SEQ ID NO: 4030365 - RNA, 14 nt, Molluscum contagiosum virus
gcaugcgcgccgcg

SEQ ID NO: 4030366 - RNA, 22 nt, Molluscum contagiosum virus
gcaugcgcgccgcgcugcuggc

SEQ ID NO: 4030367 - RNA, 23 nt, Molluscum contagiosum virus
gcauggacauccucaccuuccug

SEQ ID NO: 4030368 - RNA, 14 nt, Molluscum contagiosum virus
gcauggagggcgag

SEQ ID NO: 4030369 - RNA, 14 nt, Molluscum contagiosum virus
gcauggcggcggcc

SEQ ID NO: 4030370 - RNA, 14 nt, Molluscum contagiosum virus
gcaugguggugaga

SEQ ID NO: 4030371 - RNA, 20 nt, Molluscum contagiosum virus
gcauguccuuggcggugcgc

SEQ ID NO: 4030372 - RNA, 20 nt, Molluscum contagiosum virus
gcaugugcgcaccgcgggcu

SEQ ID NO: 4030373 - RNA, 14 nt, Molluscum contagiosum virus
gcauuaaacaacac

SEQ ID NO: 4030374 - RNA, 21 nt, Molluscum contagiosum virus
gcauuccgagccgccggucuc

SEQ ID NO: 4030375 - RNA, 16 nt, Molluscum contagiosum virus
gcauuccuuguccugg

SEQ ID NO: 4030376 - RNA, 16 nt, Molluscum contagiosum virus
gccaacuucgucucga

SEQ ID NO: 4030377 - RNA, 18 nt, Molluscum contagiosum virus
gccaagcguuggcgcccg

SEQ ID NO: 4030378 - RNA, 20 nt, Molluscum contagiosum virus
gccacaccccguacggcgca

SEQ ID NO: 4030379 - RNA, 23 nt, Molluscum contagiosum virus
gccaccucgcacgugugcaggaa

SEQ ID NO: 4030380 - RNA, 17 nt, Molluscum contagiosum virus
gccacgaacacggcgcg

SEQ ID NO: 4030381 - RNA, 15 nt, Molluscum contagiosum virus
gccacgcccgggccc

SEQ ID NO: 4030382 - RNA, 18 nt, Molluscum contagiosum virus
gccacgcggagcucgcca

SEQ ID NO: 4030383 - RNA, 15 nt, Molluscum contagiosum virus
gccacggccgcgcgc

SEQ ID NO: 4030384 - RNA, 15 nt, Molluscum contagiosum virus
gccacuguugcuucc

SEQ ID NO: 4030385 - RNA, 14 nt, Molluscum contagiosum virus
gccagacgcagagc

SEQ ID NO: 4030386 - RNA, 13 nt, Molluscum contagiosum virus
gccagagucgccg

SEQ ID NO: 4030387 - RNA, 19 nt, Molluscum contagiosum virus
gccagcacgcgcucguccg

SEQ ID NO: 4030388 - RNA, 17 nt, Molluscum contagiosum virus
gccagccaucgugcgcg

SEQ ID NO: 4030389 - RNA, 19 nt, Molluscum contagiosum virus
gccagccgcucguccagcu

SEQ ID NO: 4030390 - RNA, 22 nt, Molluscum contagiosum virus
gccagccucaucgugagccugg

SEQ ID NO: 4030391 - RNA, 16 nt, Molluscum contagiosum virus
gccagcgacgcgacgc

SEQ ID NO: 4030392 - RNA, 22 nt, Molluscum contagiosum virus
gccagcgauugcccgcgcgcgg

SEQ ID NO: 4030393 - RNA, 17 nt, Molluscum contagiosum virus
gccagcgcgcccaccag

SEQ ID NO: 4030394 - RNA, 21 nt, Molluscum contagiosum virus
gccagcgcgcccaccagcagc

SEQ ID NO: 4030395 - RNA, 14 nt, Molluscum contagiosum virus
gccagcggcgccgc

SEQ ID NO: 4030396 - RNA, 22 nt, Molluscum contagiosum virus
gccagcgggaaacugcugcccg

SEQ ID NO: 4030397 - RNA, 16 nt, Molluscum contagiosum virus
gccagcgucgcgcgcc

SEQ ID NO: 4030398 - RNA, 21 nt, Molluscum contagiosum virus
gccagcucgacacugugcugg

SEQ ID NO: 4030399 - RNA, 15 nt, Molluscum contagiosum virus
gccagcuugagcaca

SEQ ID NO: 4030400 - RNA, 11 nt, Molluscum contagiosum virus
gccaggaacga

SEQ ID NO: 4030401 - RNA, 22 nt, Molluscum contagiosum virus
gccaguagcgaaugcagugccc

SEQ ID NO: 4030402 - RNA, 20 nt, Molluscum contagiosum virus
gccagucgcgacgcgcuugc

SEQ ID NO: 4030403 - RNA, 14 nt, Molluscum contagiosum virus
gccaucgagcuucc

SEQ ID NO: 4030404 - RNA, 14 nt, Molluscum contagiosum virus
gccaugaggacagc

SEQ ID NO: 4030405 - RNA, 18 nt, Molluscum contagiosum virus
gccaugccaacgcaccgg

SEQ ID NO: 4030406 - RNA, 20 nt, Molluscum contagiosum virus
gccauggagcgcccgcugcu

SEQ ID NO: 4030407 - RNA, 19 nt, Molluscum contagiosum virus
gcccacggcggcacccgcc

SEQ ID NO: 4030408 - RNA, 15 nt, Molluscum contagiosum virus
gcccacgugccagcu

SEQ ID NO: 4030409 - RNA, 14 nt, Molluscum contagiosum virus
gcccagcacgcgcg

SEQ ID NO: 4030410 - RNA, 17 nt, Molluscum contagiosum virus
gcccagcguggccagcu

SEQ ID NO: 4030411 - RNA, 23 nt, Molluscum contagiosum virus
gcccagcucgaugggcuccaggu

SEQ ID NO: 4030412 - RNA, 18 nt, Molluscum contagiosum virus
gcccaggcgcgcgcucag

SEQ ID NO: 4030413 - RNA, 16 nt, Molluscum contagiosum virus
gcccaugcucgagccu

SEQ ID NO: 4030414 - RNA, 20 nt, Molluscum contagiosum virus
gccccacugugccagcagca

SEQ ID NO: 4030415 - RNA, 14 nt, Molluscum contagiosum virus
gcccccgugcugug

SEQ ID NO: 4030416 - RNA, 11 nt, Molluscum contagiosum virus
gccccgcgcgc

SEQ ID NO: 4030417 - RNA, 15 nt, Molluscum contagiosum virus
gccccgggcccgcau

SEQ ID NO: 4030418 - RNA, 22 nt, Molluscum contagiosum virus
gccccguaggcgggccugcgcc

SEQ ID NO: 4030419 - RNA, 12 nt, Molluscum contagiosum virus
gccccucgagca

SEQ ID NO: 4030420 - RNA, 12 nt, Molluscum contagiosum virus
gccccugggcuu

SEQ ID NO: 4030421 - RNA, 22 nt, Molluscum contagiosum virus
gcccgacacguugcacugcgcg

SEQ ID NO: 4030422 - RNA, 14 nt, Molluscum contagiosum virus
gagggcgaggccuu

SEQ ID NO: 4030423 - RNA, 15 nt, Molluscum contagiosum virus
gagggcgcgcuggag

SEQ ID NO: 4030424 - RNA, 13 nt, Molluscum contagiosum virus
gagggucgugcag

SEQ ID NO: 4030425 - RNA, 19 nt, Molluscum contagiosum virus
gagguaguuugcggagcag

SEQ ID NO: 4030426 - RNA, 19 nt, Molluscum contagiosum virus
gaggugggaaugcccgcaa

SEQ ID NO: 4030427 - RNA, 16 nt, Molluscum contagiosum virus
gaguacagccgcgcgg

SEQ ID NO: 4030428 - RNA, 13 nt, Molluscum contagiosum virus
gaguaccgcgcgc

SEQ ID NO: 4030429 - RNA, 23 nt, Molluscum contagiosum virus
gaguacgcucuccaugcgcgcgc

SEQ ID NO: 4030430 - RNA, 18 nt, Molluscum contagiosum virus
gagucacgcuugcagaca

SEQ ID NO: 4030431 - RNA, 16 nt, Molluscum contagiosum virus
gagugaaggguguggc

SEQ ID NO: 4030432 - RNA, 14 nt, Molluscum contagiosum virus
gagugcuggagcag

SEQ ID NO: 4030433 - RNA, 16 nt, Molluscum contagiosum virus
gagugcuggagcagac

SEQ ID NO: 4030434 - RNA, 20 nt, Molluscum contagiosum virus
gauacuuccgguguccccgg

SEQ ID NO: 4030435 - RNA, 14 nt, Molluscum contagiosum virus
gaucaacgcgcgcg

SEQ ID NO: 4030436 - RNA, 13 nt, Molluscum contagiosum virus
gaucaccgaggag

SEQ ID NO: 4030437 - RNA, 18 nt, Molluscum contagiosum virus
gaucacgccgugacggcc

SEQ ID NO: 4030438 - RNA, 16 nt, Molluscum contagiosum virus
gaucacggcgugcgcg

SEQ ID NO: 4030439 - RNA, 17 nt, Molluscum contagiosum virus
gaucagccccgcgccag

SEQ ID NO: 4030440 - RNA, 18 nt, Molluscum contagiosum virus
gaucccugcccgcgugag

SEQ ID NO: 4030441 - RNA, 21 nt, Molluscum contagiosum virus
gauccuccggaugaacagcuu

SEQ ID NO: 4030442 - RNA, 15 nt, Molluscum contagiosum virus
gaucgcgcucuuccc

SEQ ID NO: 4030443 - RNA, 11 nt, Molluscum contagiosum virus
gaucucugccc

SEQ ID NO: 4030444 - RNA, 16 nt, Molluscum contagiosum virus
gaucuugaugaccacg

SEQ ID NO: 4030445 - RNA, 22 nt, Molluscum contagiosum virus
gaucuuugcuguggaaaacugu

SEQ ID NO: 4030446 - RNA, 21 nt, Molluscum contagiosum virus
gaugaaaagcgugauguugag

SEQ ID NO: 4030447 - RNA, 17 nt, Molluscum contagiosum virus
gaugaguaccgcgggcg

SEQ ID NO: 4030448 - RNA, 15 nt, Molluscum contagiosum virus
gaugccugccagcag

SEQ ID NO: 4030449 - RNA, 18 nt, Molluscum contagiosum virus
gaugccuuucaggggucu

SEQ ID NO: 4030450 - RNA, 14 nt, Molluscum contagiosum virus
gaugcgccuuuucc

SEQ ID NO: 4030451 - RNA, 15 nt, Molluscum contagiosum virus
gaugcgcggacagag

SEQ ID NO: 4030452 - RNA, 20 nt, Molluscum contagiosum virus
gaugcgguccgacucggugc

SEQ ID NO: 4030453 - RNA, 15 nt, Molluscum contagiosum virus
gaugcucgcuugccg

SEQ ID NO: 4030454 - RNA, 20 nt, Molluscum contagiosum virus
gauggaccgguuccgugcgc

SEQ ID NO: 4030455 - RNA, 19 nt, Molluscum contagiosum virus
gauggcgcgcgugggcucg

SEQ ID NO: 4030456 - RNA, 12 nt, Molluscum contagiosum virus
gauggcgcugag

SEQ ID NO: 4030457 - RNA, 16 nt, Molluscum contagiosum virus
gauggcguccucgcuc

SEQ ID NO: 4030458 - RNA, 17 nt, Molluscum contagiosum virus
gaugguggcgcugcugc

SEQ ID NO: 4030459 - RNA, 14 nt, Molluscum contagiosum virus
gauguucucgccag

SEQ ID NO: 4030460 - RNA, 21 nt, Molluscum contagiosum virus
gauuagcaacugccccaugcc

SEQ ID NO: 4030461 - RNA, 20 nt, Molluscum contagiosum virus
gauuccgcuguacgugcugc

SEQ ID NO: 4030462 - RNA, 17 nt, Molluscum contagiosum virus
gauuucgcgcagcaggc

SEQ ID NO: 4030463 - RNA, 18 nt, Molluscum contagiosum virus
gauuugauggcugcucau

SEQ ID NO: 4030464 - RNA, 14 nt, Molluscum contagiosum virus
gcaaaagcgcucgc

SEQ ID NO: 4030465 - RNA, 18 nt, Molluscum contagiosum virus
gcaaacaagcagucucau

SEQ ID NO: 4030466 - RNA, 21 nt, Molluscum contagiosum virus
gcaaagaaugcaugcggagcu

SEQ ID NO: 4030467 - RNA, 15 nt, Molluscum contagiosum virus
gcaaagccugcugcg

SEQ ID NO: 4030468 - RNA, 18 nt, Molluscum contagiosum virus
gcaaagccugcugcgcgc

SEQ ID NO: 4030469 - RNA, 20 nt, Molluscum contagiosum virus
gcaaagccugcugcgcgcgc

SEQ ID NO: 4030470 - RNA, 18 nt, Molluscum contagiosum virus
gcaaagcggggcgcgcgc

SEQ ID NO: 4030471 - RNA, 22 nt, Molluscum contagiosum virus
gcaaaggaguuggcgcgcaagc

SEQ ID NO: 4030472 - RNA, 19 nt, Molluscum contagiosum virus
gcaaaguucucgcguucgc

SEQ ID NO: 4030473 - RNA, 20 nt, Molluscum contagiosum virus
gcaaaugccgagcgcacgcc

SEQ ID NO: 4030474 - RNA, 13 nt, Molluscum contagiosum virus
gcaaaugcgcugc

SEQ ID NO: 4030475 - RNA, 18 nt, Molluscum contagiosum virus
gcaacaaggaaaggcacc

SEQ ID NO: 4030476 - RNA, 13 nt, Molluscum contagiosum virus
gcaacaggggccg

SEQ ID NO: 4030477 - RNA, 14 nt, Molluscum contagiosum virus
gcaaccagcugcug

SEQ ID NO: 4030478 - RNA, 22 nt, Molluscum contagiosum virus
gcaaccucgggaagcccucagg

SEQ ID NO: 4030479 - RNA, 19 nt, Molluscum contagiosum virus
gcaacgacaaggaaaggca

SEQ ID NO: 4030480 - RNA, 18 nt, Molluscum contagiosum virus
gcaacgagcacgugugcg

SEQ ID NO: 4030481 - RNA, 20 nt, Molluscum contagiosum virus
gcaacgagcagcccgugcgc

SEQ ID NO: 4030482 - RNA, 23 nt, Molluscum contagiosum virus
gcaacgcgacgauggccacgcag

SEQ ID NO: 4030483 - RNA, 18 nt, Molluscum contagiosum virus
gcaacgcgcgcgcgcugg

SEQ ID NO: 4030484 - RNA, 17 nt, Molluscum contagiosum virus
gcaacgcgggccaggca

SEQ ID NO: 4030485 - RNA, 16 nt, Molluscum contagiosum virus
gcaacggcggcgcaag

SEQ ID NO: 4030486 - RNA, 16 nt, Molluscum contagiosum virus
gcaacgucgcacuggc

SEQ ID NO: 4030487 - RNA, 18 nt, Molluscum contagiosum virus
gcaacgugcugcgccgcc

SEQ ID NO: 4030488 - RNA, 21 nt, Molluscum contagiosum virus
gcaagaagaucgcggcgccgc

SEQ ID NO: 4030489 - RNA, 17 nt, Molluscum contagiosum virus
gcaagaagcgaaacacg

SEQ ID NO: 4030490 - RNA, 13 nt, Molluscum contagiosum virus
gcaagacccagca

SEQ ID NO: 4030491 - RNA, 19 nt, Molluscum contagiosum virus
gcaagacccagcaaggccc

SEQ ID NO: 4030492 - RNA, 18 nt, Molluscum contagiosum virus
gcaagagccgccggggcc

SEQ ID NO: 4030493 - RNA, 21 nt, Molluscum contagiosum virus
gcaagaugacgacgggagagg

SEQ ID NO: 4030494 - RNA, 16 nt, Molluscum contagiosum virus
gcaagcagcgcgcgca

SEQ ID NO: 4030495 - RNA, 16 nt, Molluscum contagiosum virus
gcaagccagcccgcug

SEQ ID NO: 4030496 - RNA, 21 nt, Molluscum contagiosum virus
gcaagcccggaagcuugcuca

SEQ ID NO: 4030497 - RNA, 20 nt, Molluscum contagiosum virus
gcaagcgcguucgcgcgugc

SEQ ID NO: 4030498 - RNA, 15 nt, Molluscum contagiosum virus
gcaagcgggccagua

SEQ ID NO: 4030499 - RNA, 17 nt, Molluscum contagiosum virus
gcaagcguacgcgucgc

SEQ ID NO: 4030500 - RNA, 18 nt, Molluscum contagiosum virus
gcaagcugagcgcgcugc

SEQ ID NO: 4030501 - RNA, 17 nt, Molluscum contagiosum virus
gcaagcuuugugcucgc

SEQ ID NO: 4030502 - RNA, 15 nt, Molluscum contagiosum virus
gcaaggcccacuucc

SEQ ID NO: 4030503 - RNA, 12 nt, Molluscum contagiosum virus
gcaaggccuggc

SEQ ID NO: 4030504 - RNA, 17 nt, Molluscum contagiosum virus
gcaaggcgcgcgcuggc

SEQ ID NO: 4030505 - RNA, 16 nt, Molluscum contagiosum virus
gcaagguuuacgccgu

SEQ ID NO: 4030506 - RNA, 17 nt, Molluscum contagiosum virus
gcaaguaccagccgcug

SEQ ID NO: 4030507 - RNA, 19 nt, Molluscum contagiosum virus
gcaaguccagcgcgcucga

SEQ ID NO: 4030508 - RNA, 21 nt, Molluscum contagiosum virus
gcaagucugcgcaggacauga

SEQ ID NO: 4030509 - RNA, 14 nt, Molluscum contagiosum virus
gcaaguucgcugcu

SEQ ID NO: 4030510 - RNA, 14 nt, Molluscum contagiosum virus
gcaaugcgugcgug

SEQ ID NO: 4030511 - RNA, 15 nt, Molluscum contagiosum virus
gcaauggcgcgcagc

SEQ ID NO: 4030512 - RNA, 16 nt, Molluscum contagiosum virus
gcaauggcgcgcagcu

SEQ ID NO: 4030513 - RNA, 21 nt, Molluscum contagiosum virus
gcaauggcggccugcccugcu

SEQ ID NO: 4030514 - RNA, 17 nt, Molluscum contagiosum virus
gcaauugcugggcacaa

SEQ ID NO: 4030515 - RNA, 15 nt, Molluscum contagiosum virus
gcacaaacacgcgcg

SEQ ID NO: 4030516 - RNA, 16 nt, Molluscum contagiosum virus
gcacaaacacgcgcgc

SEQ ID NO: 4030517 - RNA, 14 nt, Molluscum contagiosum virus
gcacaaacgcgacu

SEQ ID NO: 4030518 - RNA, 20 nt, Molluscum contagiosum virus
gcacaagccguccgccucga

SEQ ID NO: 4030519 - RNA, 23 nt, Molluscum contagiosum virus
gcacaagccguccgccucgagca

SEQ ID NO: 4030520 - RNA, 13 nt, Molluscum contagiosum virus
gcacaagggcagc

SEQ ID NO: 4030521 - RNA, 15 nt, Molluscum contagiosum virus
gcacacaccgcgagc

SEQ ID NO: 4030522 - RNA, 10 nt, Molluscum contagiosum virus
gcacaccccg

SEQ ID NO: 4030523 - RNA, 22 nt, Molluscum contagiosum virus
gcacacgacgacggcugcucgc

SEQ ID NO: 4030524 - RNA, 18 nt, Molluscum contagiosum virus
gcacacgagugcccgcgc

SEQ ID NO: 4030525 - RNA, 14 nt, Molluscum contagiosum virus
gcacacgcgcgcgc

SEQ ID NO: 4030526 - RNA, 20 nt, Molluscum contagiosum virus
gcacacgcgcgcgugcugcu

SEQ ID NO: 4030527 - RNA, 17 nt, Molluscum contagiosum virus
gcacacgcgucgcgcag

SEQ ID NO: 4030528 - RNA, 16 nt, Molluscum contagiosum virus
gcacagaaagccaacg

SEQ ID NO: 4030529 - RNA, 19 nt, Molluscum contagiosum virus
gcacagacggcgcgcucgg

SEQ ID NO: 4030530 - RNA, 21 nt, Molluscum contagiosum virus
gcacagccccugcugcucgcg

SEQ ID NO: 4030531 - RNA, 19 nt, Molluscum contagiosum virus
gcacagcgcgcggaagccc

SEQ ID NO: 4030532 - RNA, 18 nt, Molluscum contagiosum virus
gcacagggauucgccgcg

SEQ ID NO: 4030533 - RNA, 18 nt, Molluscum contagiosum virus
gcacaguccagcccgcgg

SEQ ID NO: 4030534 - RNA, 11 nt, Molluscum contagiosum virus
gcacaguucac

SEQ ID NO: 4030535 - RNA, 20 nt, Molluscum contagiosum virus
gcacaguucacggcgcuugc

SEQ ID NO: 4030536 - RNA, 17 nt, Molluscum contagiosum virus
gcacaucggcacugcuc

SEQ ID NO: 4030537 - RNA, 16 nt, Molluscum contagiosum virus
gcaccagguagagcaa

SEQ ID NO: 4030538 - RNA, 17 nt, Molluscum contagiosum virus
gcacccaccaggaacga

SEQ ID NO: 4030539 - RNA, 21 nt, Molluscum contagiosum virus
gcaccccgaaggaaaggcccc

SEQ ID NO: 4030540 - RNA, 13 nt, Molluscum contagiosum virus
gcacccgagggcg

SEQ ID NO: 4030541 - RNA, 16 nt, Molluscum contagiosum virus
gcacccgcaacaagga

SEQ ID NO: 4030542 - RNA, 11 nt, Molluscum contagiosum virus
gcacccgcagg

SEQ ID NO: 4030543 - RNA, 16 nt, Molluscum contagiosum virus
gcaccgccguguugcg

SEQ ID NO: 4030544 - RNA, 21 nt, Molluscum contagiosum virus
gcaccgcgacaggggccacaa

SEQ ID NO: 4030545 - RNA, 12 nt, Molluscum contagiosum virus
gcaccgcggcga

SEQ ID NO: 4030546 - RNA, 22 nt, Molluscum contagiosum virus
gcaccggcaacagcgcgacgcc

SEQ ID NO: 4030547 - RNA, 15 nt, Molluscum contagiosum virus
gcaccggcagcgcga

SEQ ID NO: 4030548 - RNA, 19 nt, Molluscum contagiosum virus
gcaccguaccgcgcccgcc

SEQ ID NO: 4030549 - RNA, 23 nt, Molluscum contagiosum virus
gcaccuacgcgccgacaugcgca

SEQ ID NO: 4030550 - RNA, 13 nt, Molluscum contagiosum virus
gcaccugcaggaa

SEQ ID NO: 4030551 - RNA, 15 nt, Molluscum contagiosum virus
gcaccugcaggaaag

SEQ ID NO: 4030552 - RNA, 15 nt, Molluscum contagiosum virus
gcaccugcggcugcg

SEQ ID NO: 4030553 - RNA, 22 nt, Molluscum contagiosum virus
gcaccugcuagagcauauccug

SEQ ID NO: 4030554 - RNA, 23 nt, Molluscum contagiosum virus
gcaccuuuggugcagaucucgcg

SEQ ID NO: 4030555 - RNA, 15 nt, Molluscum contagiosum virus
gcacgaacggacgcc

SEQ ID NO: 4030556 - RNA, 13 nt, Molluscum contagiosum virus
gcacgaaggacgc

SEQ ID NO: 4030557 - RNA, 20 nt, Molluscum contagiosum virus
gcacgagcaguccgccucga

SEQ ID NO: 4030558 - RNA, 13 nt, Molluscum contagiosum virus
gcacgagcgcggg

SEQ ID NO: 4030559 - RNA, 17 nt, Molluscum contagiosum virus
gcacgagcugcugcgcg

SEQ ID NO: 4030560 - RNA, 13 nt, Molluscum contagiosum virus
gcacgaggagccc

SEQ ID NO: 4030561 - RNA, 23 nt, Molluscum contagiosum virus
gcacgaggcagccgcggcgcccg

SEQ ID NO: 4030562 - RNA, 15 nt, Molluscum contagiosum virus
gcacgagggcacagg

SEQ ID NO: 4030563 - RNA, 23 nt, Molluscum contagiosum virus
gcacgagggcacaggguuccgcg

SEQ ID NO: 4030564 - RNA, 18 nt, Molluscum contagiosum virus
gcacgauggggcgcucgg

SEQ ID NO: 4030565 - RNA, 18 nt, Molluscum contagiosum virus
gcacgaugucggaaccca

SEQ ID NO: 4030566 - RNA, 24 nt, Molluscum contagiosum virus
gcacgcacacgacgacggcugcuc

SEQ ID NO: 4030567 - RNA, 22 nt, Molluscum contagiosum virus
gcacgcacggcccgggugcgcg

SEQ ID NO: 4030568 - RNA, 17 nt, Molluscum contagiosum virus
gcacgcauguacgcggc

SEQ ID NO: 4030569 - RNA, 13 nt, Molluscum contagiosum virus
gcacgccagcagc

SEQ ID NO: 4030570 - RNA, 14 nt, Molluscum contagiosum virus
gcacgccagccugg

SEQ ID NO: 4030571 - RNA, 15 nt, Molluscum contagiosum virus
gcacgccagccugga

SEQ ID NO: 4030572 - RNA, 18 nt, Molluscum contagiosum virus
gcacgccagguguuccug

SEQ ID NO: 4030573 - RNA, 22 nt, Molluscum contagiosum virus
gcacgccagguguuccugccgg

SEQ ID NO: 4030574 - RNA, 14 nt, Molluscum contagiosum virus
gcacgccuccaaga

SEQ ID NO: 4030575 - RNA, 21 nt, Molluscum contagiosum virus
gcacgcgcacagucuugcgca

SEQ ID NO: 4030576 - RNA, 16 nt, Molluscum contagiosum virus
gcacgcgcacgcgcac

SEQ ID NO: 4030577 - RNA, 18 nt, Molluscum contagiosum virus
gcacgcgcacgcucucgc

SEQ ID NO: 4030578 - RNA, 15 nt, Molluscum contagiosum virus
gcacgcgcgcagacg

SEQ ID NO: 4030579 - RNA, 14 nt, Molluscum contagiosum virus
gcacgcgggcgccg

SEQ ID NO: 4030580 - RNA, 18 nt, Molluscum contagiosum virus
gcacgcuagcgagcgccc

SEQ ID NO: 4030581 - RNA, 21 nt, Molluscum contagiosum virus
gcacgcucauacuccugcugg

SEQ ID NO: 4030582 - RNA, 16 nt, Molluscum contagiosum virus
gcacgcugcgcacggg

SEQ ID NO: 4030583 - RNA, 16 nt, Molluscum contagiosum virus
gcacgcugcguuucca

SEQ ID NO: 4030584 - RNA, 23 nt, Molluscum contagiosum virus
gcacgcugcuguccuucaagaac

SEQ ID NO: 4030585 - RNA, 18 nt, Molluscum contagiosum virus
gcacgcuguccaggcgcu

SEQ ID NO: 4030586 - RNA, 21 nt, Molluscum contagiosum virus
gcacgcuugccuuggcgcccg

SEQ ID NO: 4030587 - RNA, 15 nt, Molluscum contagiosum virus
gcacgcuuguccgcg

SEQ ID NO: 4030588 - RNA, 22 nt, Molluscum contagiosum virus
gcacggcacgugcguacgcggc

SEQ ID NO: 4030589 - RNA, 18 nt, Molluscum contagiosum virus
gcacgggcacgcgcgcgc

SEQ ID NO: 4030590 - RNA, 22 nt, Molluscum contagiosum virus
gcacggugaucaugagcgugga

SEQ ID NO: 4030591 - RNA, 14 nt, Molluscum contagiosum virus
gcacggugugcuac

SEQ ID NO: 4030592 - RNA, 19 nt, Molluscum contagiosum virus
gcacgucuucgccgugugc

SEQ ID NO: 4030593 - RNA, 23 nt, Molluscum contagiosum virus
gcacgugccccgcgcgugcaguu

SEQ ID NO: 4030594 - RNA, 18 nt, Molluscum contagiosum virus
gcacgugcugcagcugcg

SEQ ID NO: 4030595 - RNA, 19 nt, Molluscum contagiosum virus
gcacuaccgcaaccagcug

SEQ ID NO: 4030596 - RNA, 19 nt, Molluscum contagiosum virus
gcacuacucgucuugcgcg

SEQ ID NO: 4030597 - RNA, 17 nt, Molluscum contagiosum virus
gcacugauguuuucauu

SEQ ID NO: 4030598 - RNA, 17 nt, Molluscum contagiosum virus
gcacuggccugcaaacg

SEQ ID NO: 4030599 - RNA, 14 nt, Molluscum contagiosum virus
gcacuggcgcgcac

SEQ ID NO: 4030600 - RNA, 15 nt, Molluscum contagiosum virus
gcacuuuggccucgc

SEQ ID NO: 4030601 - RNA, 17 nt, Molluscum contagiosum virus
gcagaaggaagggcccg

SEQ ID NO: 4030602 - RNA, 16 nt, Molluscum contagiosum virus
gcagacaaggagaugg

SEQ ID NO: 4030603 - RNA, 22 nt, Molluscum contagiosum virus
gcagacgacucgcugccagaga

SEQ ID NO: 4030604 - RNA, 21 nt, Molluscum contagiosum virus
gcagacgccgagcgggcaaug

SEQ ID NO: 4030605 - RNA, 17 nt, Molluscum contagiosum virus
gcagagcgagggcgacg

SEQ ID NO: 4030606 - RNA, 13 nt, Molluscum contagiosum virus
gcagagcugcccg

SEQ ID NO: 4030607 - RNA, 21 nt, Molluscum contagiosum virus
gcagagguaaucccgagcuuc

SEQ ID NO: 4030608 - RNA, 13 nt, Molluscum contagiosum virus
gcagcaaacugug

SEQ ID NO: 4030609 - RNA, 20 nt, Molluscum contagiosum virus
gcagcaaacugugcuccuga

SEQ ID NO: 4030610 - RNA, 20 nt, Molluscum contagiosum virus
gcagcaaagggcggccgcag

SEQ ID NO: 4030611 - RNA, 20 nt, Molluscum contagiosum virus
gcagcacaugcaggccgaga

SEQ ID NO: 4030612 - RNA, 16 nt, Molluscum contagiosum virus
gcagcacgcgaugagc

SEQ ID NO: 4030613 - RNA, 20 nt, Molluscum contagiosum virus
gcagcagaggaguagcgugc

SEQ ID NO: 4030614 - RNA, 15 nt, Molluscum contagiosum virus
gcagccacggccgcg

SEQ ID NO: 4030615 - RNA, 20 nt, Molluscum contagiosum virus
gcagccccgacgccagcgcg

SEQ ID NO: 4030616 - RNA, 22 nt, Molluscum contagiosum virus
gcagccccguaggcgggccugc

SEQ ID NO: 4030617 - RNA, 20 nt, Molluscum contagiosum virus
gcagccgcggcgcccggugc

SEQ ID NO: 4030618 - RNA, 23 nt, Molluscum contagiosum virus
gcagccgcggcgcccggugccag

SEQ ID NO: 4030619 - RNA, 21 nt, Molluscum contagiosum virus
gcagccgcguagcuagcucug

SEQ ID NO: 4030620 - RNA, 16 nt, Molluscum contagiosum virus
gcagccucaaccugaa

SEQ ID NO: 4030621 - RNA, 22 nt, Molluscum contagiosum virus
gcagccuccgguuuucgcggga

SEQ ID NO: 4030622 - RNA, 18 nt, Molluscum contagiosum virus
gcagcgcccggugcggcg

SEQ ID NO: 4030623 - RNA, 20 nt, Molluscum contagiosum virus
gcagcgccgcgcgcgcgcgu

SEQ ID NO: 4030624 - RNA, 23 nt, Molluscum contagiosum virus
gcagcgccuguaccccgaacggc

SEQ ID NO: 4030625 - RNA, 16 nt, Molluscum contagiosum virus
gcagcgcuagccccag

SEQ ID NO: 4030626 - RNA, 15 nt, Molluscum contagiosum virus
gcagcgcuggagcug

SEQ ID NO: 4030627 - RNA, 18 nt, Molluscum contagiosum virus
gcagcgcuugcgcgccaa

SEQ ID NO: 4030628 - RNA, 19 nt, Molluscum contagiosum virus
gcagcggcgccacgagcgc

SEQ ID NO: 4030629 - RNA, 20 nt, Molluscum contagiosum virus
cugcugcccccgccgcggcg

SEQ ID NO: 4030630 - RNA, 17 nt, Molluscum contagiosum virus
cugcugcggcugcugga

SEQ ID NO: 4030631 - RNA, 20 nt, Molluscum contagiosum virus
cugcugcgguaucuacacuc

SEQ ID NO: 4030632 - RNA, 22 nt, Molluscum contagiosum virus
cugcugcugcaaagcgcggccg

SEQ ID NO: 4030633 - RNA, 18 nt, Molluscum contagiosum virus
cugcuggcagacacagac

SEQ ID NO: 4030634 - RNA, 18 nt, Molluscum contagiosum virus
cugcugggcguggcgcac

SEQ ID NO: 4030635 - RNA, 20 nt, Molluscum contagiosum virus
cugcuggugcucgccugcau

SEQ ID NO: 4030636 - RNA, 22 nt, Molluscum contagiosum virus
cugcugguggugcuggagcggc

SEQ ID NO: 4030637 - RNA, 16 nt, Molluscum contagiosum virus
cugcugguucugcucg

SEQ ID NO: 4030638 - RNA, 20 nt, Molluscum contagiosum virus
cugcuguacucgccguucca

SEQ ID NO: 4030639 - RNA, 17 nt, Molluscum contagiosum virus
cugcuucacgcugcucg

SEQ ID NO: 4030640 - RNA, 19 nt, Molluscum contagiosum virus
cugcuuccgcaccuggucg

SEQ ID NO: 4030641 - RNA, 13 nt, Molluscum contagiosum virus
cugcuuccuccuc

SEQ ID NO: 4030642 - RNA, 15 nt, Molluscum contagiosum virus
cugcuugcggcacac

SEQ ID NO: 4030643 - RNA, 16 nt, Molluscum contagiosum virus
cugcuuugucugcagg

SEQ ID NO: 4030644 - RNA, 17 nt, Molluscum contagiosum virus
cuggaagaacaggccgc

SEQ ID NO: 4030645 - RNA, 19 nt, Molluscum contagiosum virus
cuggacgccguugcgcgug

SEQ ID NO: 4030646 - RNA, 15 nt, Molluscum contagiosum virus
cuggacgggcacgag

SEQ ID NO: 4030647 - RNA, 20 nt, Molluscum contagiosum virus
cuggacgggcacgagcacgu

SEQ ID NO: 4030648 - RNA, 15 nt, Molluscum contagiosum virus
cuggacugagccgca

SEQ ID NO: 4030649 - RNA, 15 nt, Molluscum contagiosum virus
cuggacugugcuucc

SEQ ID NO: 4030650 - RNA, 22 nt, Molluscum contagiosum virus
cuggagcaagcgcguucgcgcg

SEQ ID NO: 4030651 - RNA, 20 nt, Molluscum contagiosum virus
cuggagcgagugcgcgugcg

SEQ ID NO: 4030652 - RNA, 13 nt, Molluscum contagiosum virus
cuggagcgcaaau

SEQ ID NO: 4030653 - RNA, 17 nt, Molluscum contagiosum virus
cuggagcuggcugggca

SEQ ID NO: 4030654 - RNA, 19 nt, Molluscum contagiosum virus
cuggaggcaaucuguccag

SEQ ID NO: 4030655 - RNA, 17 nt, Molluscum contagiosum virus
cuggagggcacgcugca

SEQ ID NO: 4030656 - RNA, 17 nt, Molluscum contagiosum virus
cuggagguucguccgcu

SEQ ID NO: 4030657 - RNA, 19 nt, Molluscum contagiosum virus
cuggaguaccggcucaaga

SEQ ID NO: 4030658 - RNA, 21 nt, Molluscum contagiosum virus
cuggaguacuucaagcacgag

SEQ ID NO: 4030659 - RNA, 23 nt, Molluscum contagiosum virus
cuggaguuuaaugacgcgcacgc

SEQ ID NO: 4030660 - RNA, 17 nt, Molluscum contagiosum virus
cuggcacuugcgcagcc

SEQ ID NO: 4030661 - RNA, 18 nt, Molluscum contagiosum virus
cuggccaucgagcuuccc

SEQ ID NO: 4030662 - RNA, 14 nt, Molluscum contagiosum virus
cuggcccugcuagu

SEQ ID NO: 4030663 - RNA, 16 nt, Molluscum contagiosum virus
cuggcgcgcgccgagc

SEQ ID NO: 4030664 - RNA, 16 nt, Molluscum contagiosum virus
cuggcgcgcgcgcugc

SEQ ID NO: 4030665 - RNA, 17 nt, Molluscum contagiosum virus
cuggcgcguccguucac

SEQ ID NO: 4030666 - RNA, 22 nt, Molluscum contagiosum virus
cuggcuccugugucgcgcgagc

SEQ ID NO: 4030667 - RNA, 14 nt, Molluscum contagiosum virus
cugggaaagggcug

SEQ ID NO: 4030668 - RNA, 20 nt, Molluscum contagiosum virus
cugggaacaccacacgcgcg

SEQ ID NO: 4030669 - RNA, 13 nt, Molluscum contagiosum virus
cugggcaggccgc

SEQ ID NO: 4030670 - RNA, 15 nt, Molluscum contagiosum virus
cugggcgcgccgcgc

SEQ ID NO: 4030671 - RNA, 16 nt, Molluscum contagiosum virus
cugggcgguugccugc

SEQ ID NO: 4030672 - RNA, 15 nt, Molluscum contagiosum virus
cugguaguccugcua

SEQ ID NO: 4030673 - RNA, 19 nt, Molluscum contagiosum virus
cuggugcucgccugcaucu

SEQ ID NO: 4030674 - RNA, 17 nt, Molluscum contagiosum virus
cuggugcugcgcgacau

SEQ ID NO: 4030675 - RNA, 21 nt, Molluscum contagiosum virus
cuggugggcgugcggcgcacc

SEQ ID NO: 4030676 - RNA, 23 nt, Molluscum contagiosum virus
cuggugguaauggguaugggcuu

SEQ ID NO: 4030677 - RNA, 20 nt, Molluscum contagiosum virus
cugguggugcuggagcggca

SEQ ID NO: 4030678 - RNA, 15 nt, Molluscum contagiosum virus
cugguuccucuccuc

SEQ ID NO: 4030679 - RNA, 17 nt, Molluscum contagiosum virus
cugguuccucuccucau

SEQ ID NO: 4030680 - RNA, 17 nt, Molluscum contagiosum virus
cuguaaauggaccacaa

SEQ ID NO: 4030681 - RNA, 18 nt, Molluscum contagiosum virus
cuguaccugcgacagcug

SEQ ID NO: 4030682 - RNA, 15 nt, Molluscum contagiosum virus
cuguacgugcugccc

SEQ ID NO: 4030683 - RNA, 17 nt, Molluscum contagiosum virus
cuguaggggagggcggc

SEQ ID NO: 4030684 - RNA, 18 nt, Molluscum contagiosum virus
cuguccgacgucacgcug

SEQ ID NO: 4030685 - RNA, 12 nt, Molluscum contagiosum virus
cuguccgcggac

SEQ ID NO: 4030686 - RNA, 16 nt, Molluscum contagiosum virus
cuguccgcggaugcag

SEQ ID NO: 4030687 - RNA, 13 nt, Molluscum contagiosum virus
cuguccgugggcg

SEQ ID NO: 4030688 - RNA, 15 nt, Molluscum contagiosum virus
cugucgccgcgggcu

SEQ ID NO: 4030689 - RNA, 15 nt, Molluscum contagiosum virus
cugucgcgcagcugc

SEQ ID NO: 4030690 - RNA, 17 nt, Molluscum contagiosum virus
cugucgcgcagcugcgc

SEQ ID NO: 4030691 - RNA, 12 nt, Molluscum contagiosum virus
cugugagcgcgc

SEQ ID NO: 4030692 - RNA, 15 nt, Molluscum contagiosum virus
cugugagcgcgccgc

SEQ ID NO: 4030693 - RNA, 16 nt, Molluscum contagiosum virus
cugugcgcgacgccug

SEQ ID NO: 4030694 - RNA, 15 nt, Molluscum contagiosum virus
cugugcggagggugc

SEQ ID NO: 4030695 - RNA, 19 nt, Molluscum contagiosum virus
cugugcggagggugcacgc

SEQ ID NO: 4030696 - RNA, 21 nt, Molluscum contagiosum virus
cugugcuacgcgagcacugcg

SEQ ID NO: 4030697 - RNA, 15 nt, Molluscum contagiosum virus
cugugcuucccgaaa

SEQ ID NO: 4030698 - RNA, 13 nt, Molluscum contagiosum virus
cuguggcgcacac

SEQ ID NO: 4030699 - RNA, 15 nt, Molluscum contagiosum virus
cuguucggcaugcag

SEQ ID NO: 4030700 - RNA, 17 nt, Molluscum contagiosum virus
cuguuugccacggccgc

SEQ ID NO: 4030701 - RNA, 20 nt, Molluscum contagiosum virus
cuuaacucagcgggcagaca

SEQ ID NO: 4030702 - RNA, 14 nt, Molluscum contagiosum virus
cuuagccacugugc

SEQ ID NO: 4030703 - RNA, 15 nt, Molluscum contagiosum virus
cuuagccacugugcu

SEQ ID NO: 4030704 - RNA, 20 nt, Molluscum contagiosum virus
cuuagcuuccgucugcugcu

SEQ ID NO: 4030705 - RNA, 16 nt, Molluscum contagiosum virus
cuucaaguuccuggag

SEQ ID NO: 4030706 - RNA, 21 nt, Molluscum contagiosum virus
cuuccaggcgccgcaccucac

SEQ ID NO: 4030707 - RNA, 19 nt, Molluscum contagiosum virus
cuuccccaagaccugcuuc

SEQ ID NO: 4030708 - RNA, 21 nt, Molluscum contagiosum virus
cuuccccguccuugcucuggc

SEQ ID NO: 4030709 - RNA, 14 nt, Molluscum contagiosum virus
cuucccgaggacgc

SEQ ID NO: 4030710 - RNA, 14 nt, Molluscum contagiosum virus
cuuccgcgacgagc

SEQ ID NO: 4030711 - RNA, 21 nt, Molluscum contagiosum virus
cuuccggcccgacacacuccu

SEQ ID NO: 4030712 - RNA, 17 nt, Molluscum contagiosum virus
cuuccggugccggccgc

SEQ ID NO: 4030713 - RNA, 23 nt, Molluscum contagiosum virus
cuuccuggaguaccggcucaaga

SEQ ID NO: 4030714 - RNA, 14 nt, Molluscum contagiosum virus
cuucgaagaggucu

SEQ ID NO: 4030715 - RNA, 19 nt, Molluscum contagiosum virus
cuucgaggaacuugcacgc

SEQ ID NO: 4030716 - RNA, 21 nt, Molluscum contagiosum virus
cuucgcacgcaaaugcgcgcg

SEQ ID NO: 4030717 - RNA, 22 nt, Molluscum contagiosum virus
cuucgcagagaccgucaaccug

SEQ ID NO: 4030718 - RNA, 22 nt, Molluscum contagiosum virus
cuucgcgaaggcaaccgcgacg

SEQ ID NO: 4030719 - RNA, 21 nt, Molluscum contagiosum virus
cuucggcgcaacgcuggccgc

SEQ ID NO: 4030720 - RNA, 15 nt, Molluscum contagiosum virus
cuucguggagcccgu

SEQ ID NO: 4030721 - RNA, 21 nt, Molluscum contagiosum virus
cuucguggccaaagucuuccu

SEQ ID NO: 4030722 - RNA, 20 nt, Molluscum contagiosum virus
cuucguggccuaccugcagg

SEQ ID NO: 4030723 - RNA, 21 nt, Molluscum contagiosum virus
cuucucgcagcguuccaggaa

SEQ ID NO: 4030724 - RNA, 14 nt, Molluscum contagiosum virus
cuucugcaagcugc

SEQ ID NO: 4030725 - RNA, 13 nt, Molluscum contagiosum virus
cuucugccugccc

SEQ ID NO: 4030726 - RNA, 18 nt, Molluscum contagiosum virus
cuucuucgcgagccacuc

SEQ ID NO: 4030727 - RNA, 22 nt, Molluscum contagiosum virus
cuugagcacacgguagagcugc

SEQ ID NO: 4030728 - RNA, 14 nt, Molluscum contagiosum virus
cuugagcgcgccgc

SEQ ID NO: 4030729 - RNA, 19 nt, Molluscum contagiosum virus
cuugaucgacauggagcgc

SEQ ID NO: 4030730 - RNA, 14 nt, Molluscum contagiosum virus
cuugccccucgucc

SEQ ID NO: 4030731 - RNA, 19 nt, Molluscum contagiosum virus
cuugccgcuugagcagcaa

SEQ ID NO: 4030732 - RNA, 21 nt, Molluscum contagiosum virus
cuugcgagcgcugccugugcu

SEQ ID NO: 4030733 - RNA, 15 nt, Molluscum contagiosum virus
cugaagaaggagccc

SEQ ID NO: 4030734 - RNA, 19 nt, Molluscum contagiosum virus
cugacccucgcggcucugg

SEQ ID NO: 4030735 - RNA, 14 nt, Molluscum contagiosum virus
cugacgcgcagugc

SEQ ID NO: 4030736 - RNA, 13 nt, Molluscum contagiosum virus
cugacggcagcaa

SEQ ID NO: 4030737 - RNA, 15 nt, Molluscum contagiosum virus
cugacggcagcaagc

SEQ ID NO: 4030738 - RNA, 13 nt, Molluscum contagiosum virus
cugacggcgcugc

SEQ ID NO: 4030739 - RNA, 21 nt, Molluscum contagiosum virus
cugacggucguccuggagccu

SEQ ID NO: 4030740 - RNA, 13 nt, Molluscum contagiosum virus
cugacugcugccc

SEQ ID NO: 4030741 - RNA, 21 nt, Molluscum contagiosum virus
cugagauauacaaagaagcgc

SEQ ID NO: 4030742 - RNA, 21 nt, Molluscum contagiosum virus
cugagauccacgcgugcugcg

SEQ ID NO: 4030743 - RNA, 13 nt, Molluscum contagiosum virus
cugagcgcggagc

SEQ ID NO: 4030744 - RNA, 17 nt, Molluscum contagiosum virus
cugagcgcggagcuggc

SEQ ID NO: 4030745 - RNA, 23 nt, Molluscum contagiosum virus
cugagcgggguacaggcgcggca

SEQ ID NO: 4030746 - RNA, 17 nt, Molluscum contagiosum virus
cugaugcccaggcgcgu

SEQ ID NO: 4030747 - RNA, 14 nt, Molluscum contagiosum virus
cugauuacauccug

SEQ ID NO: 4030748 - RNA, 20 nt, Molluscum contagiosum virus
cugcaagaggcgcugucgcg

SEQ ID NO: 4030749 - RNA, 13 nt, Molluscum contagiosum virus
cugcaagccagcc

SEQ ID NO: 4030750 - RNA, 16 nt, Molluscum contagiosum virus
cugcaccgagugcugg

SEQ ID NO: 4030751 - RNA, 13 nt, Molluscum contagiosum virus
cugcacgagcugc

SEQ ID NO: 4030752 - RNA, 23 nt, Molluscum contagiosum virus
cugcacgcucuucgagacgcugc

SEQ ID NO: 4030753 - RNA, 22 nt, Molluscum contagiosum virus
cugcacgggcacgccgugggca

SEQ ID NO: 4030754 - RNA, 21 nt, Molluscum contagiosum virus
cugcacgugcagcggcgccac

SEQ ID NO: 4030755 - RNA, 13 nt, Molluscum contagiosum virus
cugcagcagcccc

SEQ ID NO: 4030756 - RNA, 16 nt, Molluscum contagiosum virus
cugcagcagcuccagc

SEQ ID NO: 4030757 - RNA, 20 nt, Molluscum contagiosum virus
cugcagcagcuccagcaugg

SEQ ID NO: 4030758 - RNA, 16 nt, Molluscum contagiosum virus
cugcagcccgacgcgg

SEQ ID NO: 4030759 - RNA, 21 nt, Molluscum contagiosum virus
cugcagcccgacgcgggcgcg

SEQ ID NO: 4030760 - RNA, 16 nt, Molluscum contagiosum virus
cugcagcccuuccacg

SEQ ID NO: 4030761 - RNA, 23 nt, Molluscum contagiosum virus
cugcagcgccgcgcgguugagcu

SEQ ID NO: 4030762 - RNA, 16 nt, Molluscum contagiosum virus
cugcagcugcgcgagc

SEQ ID NO: 4030763 - RNA, 17 nt, Molluscum contagiosum virus
cugcaggaccugcuggu

SEQ ID NO: 4030764 - RNA, 19 nt, Molluscum contagiosum virus
cugcaggaccugcuggugg

SEQ ID NO: 4030765 - RNA, 14 nt, Molluscum contagiosum virus
cugcaggcagaagc

SEQ ID NO: 4030766 - RNA, 16 nt, Molluscum contagiosum virus
cugcaucuagccuccu

SEQ ID NO: 4030767 - RNA, 20 nt, Molluscum contagiosum virus
cugccaauaccaggccacgu

SEQ ID NO: 4030768 - RNA, 13 nt, Molluscum contagiosum virus
cugccacaugcag

SEQ ID NO: 4030769 - RNA, 21 nt, Molluscum contagiosum virus
cugccaccaugcgcacagcac

SEQ ID NO: 4030770 - RNA, 15 nt, Molluscum contagiosum virus
cugccaccgcggcgc

SEQ ID NO: 4030771 - RNA, 17 nt, Molluscum contagiosum virus
cugccagcucgacacug

SEQ ID NO: 4030772 - RNA, 23 nt, Molluscum contagiosum virus
cugccauggcagcucggaggcgc

SEQ ID NO: 4030773 - RNA, 16 nt, Molluscum contagiosum virus
cugcccccgccaugcc

SEQ ID NO: 4030774 - RNA, 15 nt, Molluscum contagiosum virus
cugcccgcgcgcgac

SEQ ID NO: 4030775 - RNA, 13 nt, Molluscum contagiosum virus
cugcccgcggaga

SEQ ID NO: 4030776 - RNA, 21 nt, Molluscum contagiosum virus
cugcccuuuagcguggcgcgc

SEQ ID NO: 4030777 - RNA, 14 nt, Molluscum contagiosum virus
cugccgcagagccg

SEQ ID NO: 4030778 - RNA, 18 nt, Molluscum contagiosum virus
cugccgcgcaugcuggag

SEQ ID NO: 4030779 - RNA, 17 nt, Molluscum contagiosum virus
cugccggcucaagcugg

SEQ ID NO: 4030780 - RNA, 22 nt, Molluscum contagiosum virus
cugccgguggaagagcccgcac

SEQ ID NO: 4030781 - RNA, 20 nt, Molluscum contagiosum virus
cugccguuuuacacagggcu

SEQ ID NO: 4030782 - RNA, 15 nt, Molluscum contagiosum virus
cugccuggugcacac

SEQ ID NO: 4030783 - RNA, 15 nt, Molluscum contagiosum virus
cugcgaguccuccuc

SEQ ID NO: 4030784 - RNA, 17 nt, Molluscum contagiosum virus
cugcgcaagcucagccu

SEQ ID NO: 4030785 - RNA, 14 nt, Molluscum contagiosum virus
cugcgcaccugcac

SEQ ID NO: 4030786 - RNA, 20 nt, Molluscum contagiosum virus
cugcgcacgcuugugcgcac

SEQ ID NO: 4030787 - RNA, 22 nt, Molluscum contagiosum virus
cugcgcacgcuugugcgcacgc

SEQ ID NO: 4030788 - RNA, 13 nt, Molluscum contagiosum virus
cugcgcaggugca

SEQ ID NO: 4030789 - RNA, 18 nt, Molluscum contagiosum virus
cugcgccacugccacggc

SEQ ID NO: 4030790 - RNA, 20 nt, Molluscum contagiosum virus
cugcgccacugccacggcug

SEQ ID NO: 4030791 - RNA, 22 nt, Molluscum contagiosum virus
cugcgcccgcaaaccuuggccc

SEQ ID NO: 4030792 - RNA, 15 nt, Molluscum contagiosum virus
cugcgccgccagcgu

SEQ ID NO: 4030793 - RNA, 20 nt, Molluscum contagiosum virus
cugcgccuucugccugcccg

SEQ ID NO: 4030794 - RNA, 16 nt, Molluscum contagiosum virus
cugcgcgagcagcugc

SEQ ID NO: 4030795 - RNA, 20 nt, Molluscum contagiosum virus
cugcgcgagccgcugcacgc

SEQ ID NO: 4030796 - RNA, 13 nt, Molluscum contagiosum virus
cugcgcgcacugc

SEQ ID NO: 4030797 - RNA, 18 nt, Molluscum contagiosum virus
cugcgcgcacugcucgcg

SEQ ID NO: 4030798 - RNA, 18 nt, Molluscum contagiosum virus
cugcgcgcguugccugag

SEQ ID NO: 4030799 - RNA, 22 nt, Molluscum contagiosum virus
cugcgcgcguugccugagaagc

SEQ ID NO: 4030800 - RNA, 17 nt, Molluscum contagiosum virus
cugcgcgcucuggagcc

SEQ ID NO: 4030801 - RNA, 19 nt, Molluscum contagiosum virus
cugcgcgcucuggagccuc

SEQ ID NO: 4030802 - RNA, 18 nt, Molluscum contagiosum virus
cugcgcguggaguacagc

SEQ ID NO: 4030803 - RNA, 23 nt, Molluscum contagiosum virus
cugcgcguggaguacagccgcgc

SEQ ID NO: 4030804 - RNA, 16 nt, Molluscum contagiosum virus
cugcgcuacauguaug

SEQ ID NO: 4030805 - RNA, 21 nt, Molluscum contagiosum virus
cugcgcugccagcucgacacu

SEQ ID NO: 4030806 - RNA, 16 nt, Molluscum contagiosum virus
cugcggcgcgugccgc

SEQ ID NO: 4030807 - RNA, 22 nt, Molluscum contagiosum virus
cugcggcgcgugccgcugcgcg

SEQ ID NO: 4030808 - RNA, 12 nt, Molluscum contagiosum virus
cugcggcgcucg

SEQ ID NO: 4030809 - RNA, 21 nt, Molluscum contagiosum virus
cugcggcuccaacagcagcug

SEQ ID NO: 4030810 - RNA, 12 nt, Molluscum contagiosum virus
cugcggcugcug

SEQ ID NO: 4030811 - RNA, 13 nt, Molluscum contagiosum virus
cugcgggcgccgg

SEQ ID NO: 4030812 - RNA, 20 nt, Molluscum contagiosum virus
cugcgggcgccgggcgcgcc

SEQ ID NO: 4030813 - RNA, 15 nt, Molluscum contagiosum virus
cugcgggcgcgaccu

SEQ ID NO: 4030814 - RNA, 15 nt, Molluscum contagiosum virus
cugcgggcggcacac

SEQ ID NO: 4030815 - RNA, 23 nt, Molluscum contagiosum virus
cugcguaagcgccugcacacgcg

SEQ ID NO: 4030816 - RNA, 19 nt, Molluscum contagiosum virus
cugcguacacauggccgcg

SEQ ID NO: 4030817 - RNA, 16 nt, Molluscum contagiosum virus
cugcgucucgcggccg

SEQ ID NO: 4030818 - RNA, 22 nt, Molluscum contagiosum virus
cugcguguacgacgugcugcug

SEQ ID NO: 4030819 - RNA, 14 nt, Molluscum contagiosum virus
cugcguugcgcguc

SEQ ID NO: 4030820 - RNA, 17 nt, Molluscum contagiosum virus
cugcguugcgcgucaug

SEQ ID NO: 4030821 - RNA, 19 nt, Molluscum contagiosum virus
cugcguugucuccuccuga

SEQ ID NO: 4030822 - RNA, 18 nt, Molluscum contagiosum virus
cugcguuuugcgcggcac

SEQ ID NO: 4030823 - RNA, 20 nt, Molluscum contagiosum virus
cugcuacaugcacagacagc

SEQ ID NO: 4030824 - RNA, 19 nt, Molluscum contagiosum virus
cugcuagagaaccugugcg

SEQ ID NO: 4030825 - RNA, 22 nt, Molluscum contagiosum virus
cugcuagugcgcgccaagaaca

SEQ ID NO: 4030826 - RNA, 20 nt, Molluscum contagiosum virus
cugcuccgcggaggccaagc

SEQ ID NO: 4030827 - RNA, 19 nt, Molluscum contagiosum virus
cugcucgcacccgcgccgc

SEQ ID NO: 4030828 - RNA, 16 nt, Molluscum contagiosum virus
cugcucgcgcucgcgg

SEQ ID NO: 4030829 - RNA, 21 nt, Molluscum contagiosum virus
cugcucgcgugcgugcugcgc

SEQ ID NO: 4030830 - RNA, 13 nt, Molluscum contagiosum virus
cugcucgggcugc

SEQ ID NO: 4030831 - RNA, 18 nt, Molluscum contagiosum virus
cugcucuacuuccacgag

SEQ ID NO: 4030832 - RNA, 13 nt, Molluscum contagiosum virus
cugcucuggagca

SEQ ID NO: 4030833 - RNA, 18 nt, Molluscum contagiosum virus
cugcucuugaugcugaac

SEQ ID NO: 4030834 - RNA, 13 nt, Molluscum contagiosum virus
cugcugagcgggg

SEQ ID NO: 4030835 - RNA, 15 nt, Molluscum contagiosum virus
cugcugcaaucugcg

SEQ ID NO: 4030836 - RNA, 15 nt, Molluscum contagiosum virus
cugcugcacacaccg

SEQ ID NO: 4030837 - RNA, 21 nt, Molluscum contagiosum virus
ucccgcugagcgcagcacacu

SEQ ID NO: 4030838 - RNA, 21 nt, Molluscum contagiosum virus
ucccggcgcgcgcggcgcgcc

SEQ ID NO: 4030839 - RNA, 14 nt, Molluscum contagiosum virus
ucccggcggcaagc

SEQ ID NO: 4030840 - RNA, 14 nt, Molluscum contagiosum virus
ucccugcauacacu

SEQ ID NO: 4030841 - RNA, 18 nt, Molluscum contagiosum virus
ucccugguaguccugcua

SEQ ID NO: 4030842 - RNA, 20 nt, Molluscum contagiosum virus
uccgaccgugcccuggaccu

SEQ ID NO: 4030843 - RNA, 22 nt, Molluscum contagiosum virus
uccgacggaacgagccugccgc

SEQ ID NO: 4030844 - RNA, 21 nt, Molluscum contagiosum virus
uccgagaaugggagggggaca

SEQ ID NO: 4030845 - RNA, 13 nt, Molluscum contagiosum virus
uccgcaacguggc

SEQ ID NO: 4030846 - RNA, 15 nt, Molluscum contagiosum virus
uccgcaauuacgugc

SEQ ID NO: 4030847 - RNA, 18 nt, Molluscum contagiosum virus
uccgcaauuacgugcgcg

SEQ ID NO: 4030848 - RNA, 23 nt, Molluscum contagiosum virus
uccgcaggcgucaugcgcgcgcg

SEQ ID NO: 4030849 - RNA, 20 nt, Molluscum contagiosum virus
uccgccucgagcacgccucc

SEQ ID NO: 4030850 - RNA, 20 nt, Molluscum contagiosum virus
uccgcgaaguccugggcgag

SEQ ID NO: 4030851 - RNA, 19 nt, Molluscum contagiosum virus
uccgcgcggcgcucugcca

SEQ ID NO: 4030852 - RNA, 18 nt, Molluscum contagiosum virus
uccgcgggcgcacgcuug

SEQ ID NO: 4030853 - RNA, 14 nt, Molluscum contagiosum virus
uccgcgggcgcgcg

SEQ ID NO: 4030854 - RNA, 20 nt, Molluscum contagiosum virus
uccggacgugcacgcacgcg

SEQ ID NO: 4030855 - RNA, 13 nt, Molluscum contagiosum virus
uccggagccaagc

SEQ ID NO: 4030856 - RNA, 19 nt, Molluscum contagiosum virus
uccggcggcuccgcgcgcg

SEQ ID NO: 4030857 - RNA, 20 nt, Molluscum contagiosum virus
uccgggcagauagcaaccuc

SEQ ID NO: 4030858 - RNA, 14 nt, Molluscum contagiosum virus
uccgucgcgcucga

SEQ ID NO: 4030859 - RNA, 12 nt, Molluscum contagiosum virus
uccgugucguuc

SEQ ID NO: 4030860 - RNA, 13 nt, Molluscum contagiosum virus
uccguugcacgug

SEQ ID NO: 4030861 - RNA, 15 nt, Molluscum contagiosum virus
uccucccugcgggcg

SEQ ID NO: 4030862 - RNA, 20 nt, Molluscum contagiosum virus
uccucgaaggcgugcgccgu

SEQ ID NO: 4030863 - RNA, 16 nt, Molluscum contagiosum virus
uccucgaccugcacga

SEQ ID NO: 4030864 - RNA, 20 nt, Molluscum contagiosum virus
uccucggcgcacacuccucg

SEQ ID NO: 4030865 - RNA, 14 nt, Molluscum contagiosum virus
uccucucuccccuu

SEQ ID NO: 4030866 - RNA, 13 nt, Molluscum contagiosum virus
uccugcgcuccga

SEQ ID NO: 4030867 - RNA, 20 nt, Molluscum contagiosum virus
uccuggaguaccggcucaag

SEQ ID NO: 4030868 - RNA, 14 nt, Molluscum contagiosum virus
uccuggccaacagg

SEQ ID NO: 4030869 - RNA, 11 nt, Molluscum contagiosum virus
uccugggcgac

SEQ ID NO: 4030870 - RNA, 22 nt, Molluscum contagiosum virus
uccuuccggagacaccagcucc

SEQ ID NO: 4030871 - RNA, 15 nt, Molluscum contagiosum virus
uccuuucgacgcugc

SEQ ID NO: 4030872 - RNA, 23 nt, Molluscum contagiosum virus
ucgaaaaggcugauccugcgcgu

SEQ ID NO: 4030873 - RNA, 19 nt, Molluscum contagiosum virus
ucgaacgacggcccccuua

SEQ ID NO: 4030874 - RNA, 22 nt, Molluscum contagiosum virus
ucgaagacgucggggcgcgugc

SEQ ID NO: 4030875 - RNA, 14 nt, Molluscum contagiosum virus
ucgaagcgagaggu

SEQ ID NO: 4030876 - RNA, 19 nt, Molluscum contagiosum virus
ucgaaggcgugcgccgugc

SEQ ID NO: 4030877 - RNA, 19 nt, Molluscum contagiosum virus
ucgacaagaucaaggucac

SEQ ID NO: 4030878 - RNA, 19 nt, Molluscum contagiosum virus
ucgacccguaccccgaggg

SEQ ID NO: 4030879 - RNA, 23 nt, Molluscum contagiosum virus
ucgaccucugcuucacgcugcuc

SEQ ID NO: 4030880 - RNA, 22 nt, Molluscum contagiosum virus
ucgaccugcacgacccucuucg

SEQ ID NO: 4030881 - RNA, 16 nt, Molluscum contagiosum virus
ucgacgcgcugcucuc

SEQ ID NO: 4030882 - RNA, 20 nt, Molluscum contagiosum virus
ucgacgggaacgaggucauc

SEQ ID NO: 4030883 - RNA, 13 nt, Molluscum contagiosum virus
ucgacgggcgcag

SEQ ID NO: 4030884 - RNA, 15 nt, Molluscum contagiosum virus
ucgacgugcagacgc

SEQ ID NO: 4030885 - RNA, 19 nt, Molluscum contagiosum virus
ucgacgugcagacgcucaa

SEQ ID NO: 4030886 - RNA, 21 nt, Molluscum contagiosum virus
ucgacgugguacuggcgcccg

SEQ ID NO: 4030887 - RNA, 15 nt, Molluscum contagiosum virus
ucgacuacacgcgcu

SEQ ID NO: 4030888 - RNA, 23 nt, Molluscum contagiosum virus
ucgacuuacggacgcccuccucg

SEQ ID NO: 4030889 - RNA, 16 nt, Molluscum contagiosum virus
ucgagacccacaaugg

SEQ ID NO: 4030890 - RNA, 19 nt, Molluscum contagiosum virus
ucgagaccucgcgcuuccg

SEQ ID NO: 4030891 - RNA, 20 nt, Molluscum contagiosum virus
ucgagaccucgcgcuuccgg

SEQ ID NO: 4030892 - RNA, 15 nt, Molluscum contagiosum virus
ucgagacgcugcgcg

SEQ ID NO: 4030893 - RNA, 23 nt, Molluscum contagiosum virus
ucgagcaccucaacuguugccug

SEQ ID NO: 4030894 - RNA, 19 nt, Molluscum contagiosum virus
ucgagcaccugucgcgcga

SEQ ID NO: 4030895 - RNA, 14 nt, Molluscum contagiosum virus
ucgagcacgcgcga

SEQ ID NO: 4030896 - RNA, 14 nt, Molluscum contagiosum virus
ucgagcccgagccc

SEQ ID NO: 4030897 - RNA, 20 nt, Molluscum contagiosum virus
ucgagccgcgcuucgagcac

SEQ ID NO: 4030898 - RNA, 22 nt, Molluscum contagiosum virus
ucgagcgcgcuggacuugcgcg

SEQ ID NO: 4030899 - RNA, 23 nt, Molluscum contagiosum virus
ucgagcuccgagggcgcgugcuc

SEQ ID NO: 4030900 - RNA, 17 nt, Molluscum contagiosum virus
ucgagcugacucggaca

SEQ ID NO: 4030901 - RNA, 17 nt, Molluscum contagiosum virus
ucgagcuucggacgagc

SEQ ID NO: 4030902 - RNA, 19 nt, Molluscum contagiosum virus
ucgaggagggcguccguaa

SEQ ID NO: 4030903 - RNA, 14 nt, Molluscum contagiosum virus
ucgaggccuucgcg

SEQ ID NO: 4030904 - RNA, 15 nt, Molluscum contagiosum virus
ucgaucucgcgcacg

SEQ ID NO: 4030905 - RNA, 16 nt, Molluscum contagiosum virus
cguccacgaugcgcuc

SEQ ID NO: 4030906 - RNA, 12 nt, Molluscum contagiosum virus
cguccacgcgcc

SEQ ID NO: 4030907 - RNA, 17 nt, Molluscum contagiosum virus
cgucgaagaccaccagc

SEQ ID NO: 4030908 - RNA, 19 nt, Molluscum contagiosum virus
cgucgaaguccgucacgga

SEQ ID NO: 4030909 - RNA, 15 nt, Molluscum contagiosum virus
cgucgaccuggaagc

SEQ ID NO: 4030910 - RNA, 21 nt, Molluscum contagiosum virus
cgucgcccggcaggcucccgc

SEQ ID NO: 4030911 - RNA, 15 nt, Molluscum contagiosum virus
cgucgcgcgccgugc

SEQ ID NO: 4030912 - RNA, 17 nt, Molluscum contagiosum virus
cgucgcggccacgcacu

SEQ ID NO: 4030913 - RNA, 23 nt, Molluscum contagiosum virus
cgucguagcaaaugcgcugcucg

SEQ ID NO: 4030914 - RNA, 12 nt, Molluscum contagiosum virus
cgucgucaagga

SEQ ID NO: 4030915 - RNA, 21 nt, Molluscum contagiosum virus
cgucguccggaggcacgggcu

SEQ ID NO: 4030916 - RNA, 15 nt, Molluscum contagiosum virus
cgucgugcuccacgc

SEQ ID NO: 4030917 - RNA, 22 nt, Molluscum contagiosum virus
cgucucgcggaagaauuccuuc

SEQ ID NO: 4030918 - RNA, 20 nt, Molluscum contagiosum virus
cgucucggagaagaacagca

SEQ ID NO: 4030919 - RNA, 14 nt, Molluscum contagiosum virus
cgucugcaaggccu

SEQ ID NO: 4030920 - RNA, 21 nt, Molluscum contagiosum virus
cgucuggggauggccacggga

SEQ ID NO: 4030921 - RNA, 20 nt, Molluscum contagiosum virus
cgucuucacuccgcacagcu

SEQ ID NO: 4030922 - RNA, 20 nt, Molluscum contagiosum virus
cgucuuugcgaacgcgcaag

SEQ ID NO: 4030923 - RNA, 20 nt, Molluscum contagiosum virus
cgucuuuuugcggcgccgcc

SEQ ID NO: 4030924 - RNA, 15 nt, Molluscum contagiosum virus
cgugaacgaggcugc

SEQ ID NO: 4030925 - RNA, 20 nt, Molluscum contagiosum virus
cgugacaaucucugcgccgc

SEQ ID NO: 4030926 - RNA, 18 nt, Molluscum contagiosum virus
cgugacggugcugcgcac

SEQ ID NO: 4030927 - RNA, 21 nt, Molluscum contagiosum virus
cgugagagcaaagaaugcaug

SEQ ID NO: 4030928 - RNA, 21 nt, Molluscum contagiosum virus
cgugaucgcgcaggcgcgcca

SEQ ID NO: 4030929 - RNA, 14 nt, Molluscum contagiosum virus
cgugcaagcccagc

SEQ ID NO: 4030930 - RNA, 17 nt, Molluscum contagiosum virus
cgugcaccucaagaaga

SEQ ID NO: 4030931 - RNA, 22 nt, Molluscum contagiosum virus
cgugcacgugguuugcucgauc

SEQ ID NO: 4030932 - RNA, 18 nt, Molluscum contagiosum virus
cgugcacucgagaagagg

SEQ ID NO: 4030933 - RNA, 21 nt, Molluscum contagiosum virus
cgugcagacgcucaacguggg

SEQ ID NO: 4030934 - RNA, 16 nt, Molluscum contagiosum virus
cgugcagcggcgccac

SEQ ID NO: 4030935 - RNA, 17 nt, Molluscum contagiosum virus
cgugcagcggcgccacg

SEQ ID NO: 4030936 - RNA, 21 nt, Molluscum contagiosum virus
cuuugcggcacgggcucgagc

SEQ ID NO: 4030937 - RNA, 13 nt, Molluscum contagiosum virus
cuuuucuaggccu

SEQ ID NO: 4030938 - RNA, 18 nt, Molluscum contagiosum virus
cuuuuuaaauggccgaga

SEQ ID NO: 4030939 - RNA, 16 nt, Molluscum contagiosum virus
gaaaaaagagccggcu

SEQ ID NO: 4030940 - RNA, 11 nt, Molluscum contagiosum virus
gaaaacugcau

SEQ ID NO: 4030941 - RNA, 13 nt, Molluscum contagiosum virus
gaaaacuuguggc

SEQ ID NO: 4030942 - RNA, 14 nt, Molluscum contagiosum virus
gaaaagcgcgagcc

SEQ ID NO: 4030943 - RNA, 17 nt, Molluscum contagiosum virus
gaaacacccgcgcucga

SEQ ID NO: 4030944 - RNA, 22 nt, Molluscum contagiosum virus
gaaacagcaccguugccgcggc

SEQ ID NO: 4030945 - RNA, 13 nt, Molluscum contagiosum virus
gaaacaugugucu

SEQ ID NO: 4030946 - RNA, 16 nt, Molluscum contagiosum virus
gaaacgggagucacuu

SEQ ID NO: 4030947 - RNA, 18 nt, Molluscum contagiosum virus
gaaacuggacugagccgc

SEQ ID NO: 4030948 - RNA, 13 nt, Molluscum contagiosum virus
gaaagaaaacgug

SEQ ID NO: 4030949 - RNA, 21 nt, Molluscum contagiosum virus
gaaagauauacaccaggcgcg

SEQ ID NO: 4030950 - RNA, 22 nt, Molluscum contagiosum virus
gaaagcgucgugugcgcgcacg

SEQ ID NO: 4030951 - RNA, 22 nt, Molluscum contagiosum virus
gaaaggcacccaccaggaacga

SEQ ID NO: 4030952 - RNA, 16 nt, Molluscum contagiosum virus
gaaaggcacccgcagg

SEQ ID NO: 4030953 - RNA, 14 nt, Molluscum contagiosum virus
gaaaggcaugauuc

SEQ ID NO: 4030954 - RNA, 12 nt, Molluscum contagiosum virus
gaaaugacggcg

SEQ ID NO: 4030955 - RNA, 19 nt, Molluscum contagiosum virus
gaacaaugaggagaggaac

SEQ ID NO: 4030956 - RNA, 21 nt, Molluscum contagiosum virus
gaacaccuccugcuuugcacg

SEQ ID NO: 4030957 - RNA, 21 nt, Molluscum contagiosum virus
gaacagagaaaggcacccacc

SEQ ID NO: 4030958 - RNA, 22 nt, Molluscum contagiosum virus
gaacaguaacugcugcagugug

SEQ ID NO: 4030959 - RNA, 17 nt, Molluscum contagiosum virus
gaacauguugugcucgu

SEQ ID NO: 4030960 - RNA, 17 nt, Molluscum contagiosum virus
gaaccugcacgcggcgu

SEQ ID NO: 4030961 - RNA, 23 nt, Molluscum contagiosum virus
gaacgccggcgcggggcucgucc

SEQ ID NO: 4030962 - RNA, 20 nt, Molluscum contagiosum virus
gaacgccgugcgcgugcggc

SEQ ID NO: 4030963 - RNA, 14 nt, Molluscum contagiosum virus
gaacgcgcgcucgu

SEQ ID NO: 4030964 - RNA, 17 nt, Molluscum contagiosum virus
gaacggaacacagugcg

SEQ ID NO: 4030965 - RNA, 22 nt, Molluscum contagiosum virus
gaacgucuucuaccgcccgcug

SEQ ID NO: 4030966 - RNA, 17 nt, Molluscum contagiosum virus
gaacucgugcgccgcgc

SEQ ID NO: 4030967 - RNA, 20 nt, Molluscum contagiosum virus
gaacucuacgccgcgcaccu

SEQ ID NO: 4030968 - RNA, 16 nt, Molluscum contagiosum virus
gaacugacugcugccc

SEQ ID NO: 4030969 - RNA, 14 nt, Molluscum contagiosum virus
gaacugcagcagcu

SEQ ID NO: 4030970 - RNA, 14 nt, Molluscum contagiosum virus
gaagaacgcggcgu

SEQ ID NO: 4030971 - RNA, 23 nt, Molluscum contagiosum virus
gaagaagaaaagacgagcugugc

SEQ ID NO: 4030972 - RNA, 22 nt, Molluscum contagiosum virus
gaagacauugccuuuugcacag

SEQ ID NO: 4030973 - RNA, 22 nt, Molluscum contagiosum virus
gaagacgcguaccagcgccugc

SEQ ID NO: 4030974 - RNA, 15 nt, Molluscum contagiosum virus
gaagacggcgcgcgc

SEQ ID NO: 4030975 - RNA, 23 nt, Molluscum contagiosum virus
gaagagacgccaagcgucgcgac

SEQ ID NO: 4030976 - RNA, 19 nt, Molluscum contagiosum virus
gaagaggccagcacaagcc

SEQ ID NO: 4030977 - RNA, 20 nt, Molluscum contagiosum virus
gaagaggccagcacaagccg

SEQ ID NO: 4030978 - RNA, 20 nt, Molluscum contagiosum virus
gaagaggccggcacaagccg

SEQ ID NO: 4030979 - RNA, 15 nt, Molluscum contagiosum virus
gaagaguuggacagc

SEQ ID NO: 4030980 - RNA, 21 nt, Molluscum contagiosum virus
gaagcaagacccagcaaggcc

SEQ ID NO: 4030981 - RNA, 14 nt, Molluscum contagiosum virus
gaagcacguagcuc

SEQ ID NO: 4030982 - RNA, 17 nt, Molluscum contagiosum virus
gaagcaggcgccaucgc

SEQ ID NO: 4030983 - RNA, 15 nt, Molluscum contagiosum virus
gaagcccagcuucag

SEQ ID NO: 4030984 - RNA, 14 nt, Molluscum contagiosum virus
gaagccgcaggcca

SEQ ID NO: 4030985 - RNA, 17 nt, Molluscum contagiosum virus
gaagcgaaaggacgcgc

SEQ ID NO: 4030986 - RNA, 14 nt, Molluscum contagiosum virus
gaagcggugcagcg

SEQ ID NO: 4030987 - RNA, 13 nt, Molluscum contagiosum virus
cggcgcucugcca

SEQ ID NO: 4030988 - RNA, 14 nt, Molluscum contagiosum virus
cggcgcugcgcgug

SEQ ID NO: 4030989 - RNA, 21 nt, Molluscum contagiosum virus
cggcggagaugacgggcacgc

SEQ ID NO: 4030990 - RNA, 14 nt, Molluscum contagiosum virus
cggcggcccgcggc

SEQ ID NO: 4030991 - RNA, 14 nt, Molluscum contagiosum virus
cggcggcgcgugcu

SEQ ID NO: 4030992 - RNA, 13 nt, Molluscum contagiosum virus
cggcggcuuucuc

SEQ ID NO: 4030993 - RNA, 15 nt, Molluscum contagiosum virus
cggcgggcgcgugcu

SEQ ID NO: 4030994 - RNA, 14 nt, Molluscum contagiosum virus
cggcggggcugcug

SEQ ID NO: 4030995 - RNA, 16 nt, Molluscum contagiosum virus
cggcggggcugcuggc

SEQ ID NO: 4030996 - RNA, 19 nt, Molluscum contagiosum virus
cggcgucgucgugaacgcg

SEQ ID NO: 4030997 - RNA, 15 nt, Molluscum contagiosum virus
cggcgugugcgggcu

SEQ ID NO: 4030998 - RNA, 17 nt, Molluscum contagiosum virus
cggcguguuccggcagc

SEQ ID NO: 4030999 - RNA, 13 nt, Molluscum contagiosum virus
cggcuaaagagag

SEQ ID NO: 4031000 - RNA, 15 nt, Molluscum contagiosum virus
cggcuaggcgcggcg

SEQ ID NO: 4031001 - RNA, 20 nt, Molluscum contagiosum virus
cggcucagcguggagcaccu

SEQ ID NO: 4031002 - RNA, 17 nt, Molluscum contagiosum virus
cggcuccuugagaauca

SEQ ID NO: 4031003 - RNA, 15 nt, Molluscum contagiosum virus
cggcucugcguugcg

SEQ ID NO: 4031004 - RNA, 16 nt, Molluscum contagiosum virus
cggcugccgcugccug

SEQ ID NO: 4031005 - RNA, 15 nt, Molluscum contagiosum virus
cggcuuccggcacca

SEQ ID NO: 4031006 - RNA, 18 nt, Molluscum contagiosum virus
cggcuuccggcaccacgu

SEQ ID NO: 4031007 - RNA, 15 nt, Molluscum contagiosum virus
cgggaagcacagucc

SEQ ID NO: 4031008 - RNA, 12 nt, Molluscum contagiosum virus
cgggaagcugca

SEQ ID NO: 4031009 - RNA, 16 nt, Molluscum contagiosum virus
cgggaaggggugaugg

SEQ ID NO: 4031010 - RNA, 21 nt, Molluscum contagiosum virus
cgggaauaccggagacaccag

SEQ ID NO: 4031011 - RNA, 21 nt, Molluscum contagiosum virus
cgggaccgcagacaaagacag

SEQ ID NO: 4031012 - RNA, 21 nt, Molluscum contagiosum virus
cgggaccucuuucucgcgccg

SEQ ID NO: 4031013 - RNA, 22 nt, Molluscum contagiosum virus
cgggacgagagggcgcgcgucg

SEQ ID NO: 4031014 - RNA, 14 nt, Molluscum contagiosum virus
cgggagaguggccg

SEQ ID NO: 4031015 - RNA, 22 nt, Molluscum contagiosum virus
cgcgugcggugacuugccgugu

SEQ ID NO: 4031016 - RNA, 21 nt, Molluscum contagiosum virus
cgcgugcugcgcggcgccgca

SEQ ID NO: 4031017 - RNA, 20 nt, Molluscum contagiosum virus
cgcgugcuggacgcgcacgc

SEQ ID NO: 4031018 - RNA, 16 nt, Molluscum contagiosum virus
cgcgugcugggccccu

SEQ ID NO: 4031019 - RNA, 19 nt, Molluscum contagiosum virus
cgcgugucuacccggcacg

SEQ ID NO: 4031020 - RNA, 15 nt, Molluscum contagiosum virus
cgcguguuugugcug

SEQ ID NO: 4031021 - RNA, 17 nt, Molluscum contagiosum virus
cgcguucgacagcucuu

SEQ ID NO: 4031022 - RNA, 13 nt, Molluscum contagiosum virus
cgcguucuccagg

SEQ ID NO: 4031023 - RNA, 23 nt, Molluscum contagiosum virus
cgcguugucgagaauagcugggg

SEQ ID NO: 4031024 - RNA, 19 nt, Molluscum contagiosum virus
cgcguuugucgcgggcgcg

SEQ ID NO: 4031025 - RNA, 17 nt, Molluscum contagiosum virus
cgcuaaagaucgugcgc

SEQ ID NO: 4031026 - RNA, 14 nt, Molluscum contagiosum virus
cgcuacagcagccg

SEQ ID NO: 4031027 - RNA, 19 nt, Molluscum contagiosum virus
cgcuacccguugcugcgcc

SEQ ID NO: 4031028 - RNA, 16 nt, Molluscum contagiosum virus
cgcuagagcgcggcgc

SEQ ID NO: 4031029 - RNA, 21 nt, Molluscum contagiosum virus
cgcuagcaggcgucgcgcaca

SEQ ID NO: 4031030 - RNA, 16 nt, Molluscum contagiosum virus
cgcuagccgccgcugc

SEQ ID NO: 4031031 - RNA, 18 nt, Molluscum contagiosum virus
cgcuaggggugccgcugc

SEQ ID NO: 4031032 - RNA, 23 nt, Molluscum contagiosum virus
cgcuaugccgcgugcucugcucc

SEQ ID NO: 4031033 - RNA, 19 nt, Molluscum contagiosum virus
cgcucacagcuucgcgagc

SEQ ID NO: 4031034 - RNA, 16 nt, Molluscum contagiosum virus
cgcucacugcagcagc

SEQ ID NO: 4031035 - RNA, 19 nt, Molluscum contagiosum virus
cgcucauccacgcggagga

SEQ ID NO: 4031036 - RNA, 12 nt, Molluscum contagiosum virus
cgcuccaugcug

SEQ ID NO: 4031037 - RNA, 18 nt, Molluscum contagiosum virus
cgcuccgagcggcugcuc

SEQ ID NO: 4031038 - RNA, 13 nt, Molluscum contagiosum virus
cgcuccgcucgcg

SEQ ID NO: 4031039 - RNA, 14 nt, Molluscum contagiosum virus
cgcuccgcucgcgc

SEQ ID NO: 4031040 - RNA, 17 nt, Molluscum contagiosum virus
cgcuccgcucgcgcgug

SEQ ID NO: 4031041 - RNA, 23 nt, Molluscum contagiosum virus
cgcucgaggaccucgcgcgccgc

SEQ ID NO: 4031042 - RNA, 14 nt, Molluscum contagiosum virus
cgcucgcccagcuc

SEQ ID NO: 4031043 - RNA, 15 nt, Molluscum contagiosum virus
cgcucgccuuucccc

SEQ ID NO: 4031044 - RNA, 14 nt, Molluscum contagiosum virus
cgcucgcgagaagu

SEQ ID NO: 4031045 - RNA, 23 nt, Molluscum contagiosum virus
cgcucgcgcgugcucgacucgga

SEQ ID NO: 4031046 - RNA, 15 nt, Molluscum contagiosum virus
cgcucgcgcugcuuc

SEQ ID NO: 4031047 - RNA, 11 nt, Molluscum contagiosum virus
cgcucgcuaga

SEQ ID NO: 4031048 - RNA, 18 nt, Molluscum contagiosum virus
cgcucgcuagaggacgcc

SEQ ID NO: 4031049 - RNA, 16 nt, Molluscum contagiosum virus
cgcucgcucgcucagc

SEQ ID NO: 4031050 - RNA, 15 nt, Molluscum contagiosum virus
cgcucggcugccgug

SEQ ID NO: 4031051 - RNA, 16 nt, Molluscum contagiosum virus
cgcucucucagggugg

SEQ ID NO: 4031052 - RNA, 19 nt, Molluscum contagiosum virus
cgcucugccaccgcggcgc

SEQ ID NO: 4031053 - RNA, 15 nt, Molluscum contagiosum virus
cgcucuuacugcagc

SEQ ID NO: 4031054 - RNA, 21 nt, Molluscum contagiosum virus
cgcucuuuugcaagcgcgaaa

SEQ ID NO: 4031055 - RNA, 17 nt, Molluscum contagiosum virus
cgcugagcaagcucaag

SEQ ID NO: 4031056 - RNA, 13 nt, Molluscum contagiosum virus
cgcugcagcaccu

SEQ ID NO: 4031057 - RNA, 16 nt, Molluscum contagiosum virus
cgcugccaacgcggac

SEQ ID NO: 4031058 - RNA, 19 nt, Molluscum contagiosum virus
cgcugccaacgcggaccgc

SEQ ID NO: 4031059 - RNA, 15 nt, Molluscum contagiosum virus
cgcugcccgcgcaca

SEQ ID NO: 4031060 - RNA, 15 nt, Molluscum contagiosum virus
cgcugccggcaacgc

SEQ ID NO: 4031061 - RNA, 18 nt, Molluscum contagiosum virus
cgcugccuggugcacaca

SEQ ID NO: 4031062 - RNA, 18 nt, Molluscum contagiosum virus
cgcugcgcggagcucgcg

SEQ ID NO: 4031063 - RNA, 17 nt, Molluscum contagiosum virus
cgcugcgcgugcugggc

SEQ ID NO: 4031064 - RNA, 19 nt, Molluscum contagiosum virus
cgcugcgcgugcugggccc

SEQ ID NO: 4031065 - RNA, 22 nt, Molluscum contagiosum virus
cgcugcggcgcucgcagcacau

SEQ ID NO: 4031066 - RNA, 21 nt, Molluscum contagiosum virus
cgcugcguuuccagggcagua

SEQ ID NO: 4031067 - RNA, 13 nt, Molluscum contagiosum virus
cgcugcuccugcu

SEQ ID NO: 4031068 - RNA, 22 nt, Molluscum contagiosum virus
cgcugcucuacgucuccucgcg

SEQ ID NO: 4031069 - RNA, 15 nt, Molluscum contagiosum virus
cgcugcuggcgcaca

SEQ ID NO: 4031070 - RNA, 15 nt, Molluscum contagiosum virus
cgcugcuguccuuca

SEQ ID NO: 4031071 - RNA, 19 nt, Molluscum contagiosum virus
cgcugcuucccgcugagcg

SEQ ID NO: 4031072 - RNA, 14 nt, Molluscum contagiosum virus
cgcuggagcacgac

SEQ ID NO: 4031073 - RNA, 18 nt, Molluscum contagiosum virus
cgcuggagcuggcugggc

SEQ ID NO: 4031074 - RNA, 22 nt, Molluscum contagiosum virus
cgcuggcccacgcuggcgcucg

SEQ ID NO: 4031075 - RNA, 15 nt, Molluscum contagiosum virus
cgcuggccucugccu

SEQ ID NO: 4031076 - RNA, 22 nt, Molluscum contagiosum virus
cgcuggccucugccugcaagga

SEQ ID NO: 4031077 - RNA, 17 nt, Molluscum contagiosum virus
cgcuggcgugcgcagug

SEQ ID NO: 4031078 - RNA, 17 nt, Molluscum contagiosum virus
cgcuggcucgcgccugc

SEQ ID NO: 4031079 - RNA, 16 nt, Molluscum contagiosum virus
cgcugggccgcaugca

SEQ ID NO: 4031080 - RNA, 14 nt, Molluscum contagiosum virus
cgcugggcgcgccg

SEQ ID NO: 4031081 - RNA, 21 nt, Molluscum contagiosum virus
cgcuggugggcgugcggcgca

SEQ ID NO: 4031082 - RNA, 23 nt, Molluscum contagiosum virus
cgcuggugggcgugcggcgcacc

SEQ ID NO: 4031083 - RNA, 16 nt, Molluscum contagiosum virus
cgcuggugugcacuga

SEQ ID NO: 4031084 - RNA, 20 nt, Molluscum contagiosum virus
cgcuguacgugcugcccgug

SEQ ID NO: 4031085 - RNA, 18 nt, Molluscum contagiosum virus
cgcugugagcgcgccgcu

SEQ ID NO: 4031086 - RNA, 16 nt, Molluscum contagiosum virus
cgcuuccggcggcucc

SEQ ID NO: 4031087 - RNA, 14 nt, Molluscum contagiosum virus
cgcuucgagcacgc

SEQ ID NO: 4031088 - RNA, 17 nt, Molluscum contagiosum virus
cgcuucgggcucagcaa

SEQ ID NO: 4031089 - RNA, 13 nt, Molluscum contagiosum virus
cgcuugaaggacg

SEQ ID NO: 4031090 - RNA, 15 nt, Molluscum contagiosum virus
cggaaaacgcccgag

SEQ ID NO: 4031091 - RNA, 20 nt, Molluscum contagiosum virus
cggaaacgaacgcugcagcu

SEQ ID NO: 4031092 - RNA, 14 nt, Molluscum contagiosum virus
cggaaccguggugc

SEQ ID NO: 4031093 - RNA, 21 nt, Molluscum contagiosum virus
cggaacgcgugaggaggcggc

SEQ ID NO: 4031094 - RNA, 17 nt, Molluscum contagiosum virus
cggaagacaaggcugcg

SEQ ID NO: 4031095 - RNA, 14 nt, Molluscum contagiosum virus
cggaagcccgccuc

SEQ ID NO: 4031096 - RNA, 18 nt, Molluscum contagiosum virus
cggaagcucacaucuguc

SEQ ID NO: 4031097 - RNA, 13 nt, Molluscum contagiosum virus
acgagcgccgcga

SEQ ID NO: 4031098 - RNA, 16 nt, Molluscum contagiosum virus
acgagcugcugcccgc

SEQ ID NO: 4031099 - RNA, 22 nt, Molluscum contagiosum virus
acgaggccuacgugcugcgcac

SEQ ID NO: 4031100 - RNA, 16 nt, Molluscum contagiosum virus
acgagugcccgcgcgc

SEQ ID NO: 4031101 - RNA, 14 nt, Molluscum contagiosum virus
acgcaaaagaggcc

SEQ ID NO: 4031102 - RNA, 16 nt, Molluscum contagiosum virus
acgcaagcccgcgcgc

SEQ ID NO: 4031103 - RNA, 19 nt, Molluscum contagiosum virus
acgcaagcccgcgcgcgag

SEQ ID NO: 4031104 - RNA, 17 nt, Molluscum contagiosum virus
acgcaaggcaugcgcgc

SEQ ID NO: 4031105 - RNA, 17 nt, Molluscum contagiosum virus
acgcaaggugugcgcgc

SEQ ID NO: 4031106 - RNA, 14 nt, Molluscum contagiosum virus
acgcaaucgcgcgc

SEQ ID NO: 4031107 - RNA, 15 nt, Molluscum contagiosum virus
acgcacaaaacacaa

SEQ ID NO: 4031108 - RNA, 14 nt, Molluscum contagiosum virus
acgcacacucgcgc

SEQ ID NO: 4031109 - RNA, 14 nt, Molluscum contagiosum virus
acgcacgcgcgggc

SEQ ID NO: 4031110 - RNA, 16 nt, Molluscum contagiosum virus
acgcacuucacggcgu

SEQ ID NO: 4031111 - RNA, 15 nt, Molluscum contagiosum virus
acgcagaaguggcgc

SEQ ID NO: 4031112 - RNA, 14 nt, Molluscum contagiosum virus
acgcagaggcgcgu

SEQ ID NO: 4031113 - RNA, 16 nt, Molluscum contagiosum virus
acgcagcucuuccacg

SEQ ID NO: 4031114 - RNA, 18 nt, Molluscum contagiosum virus
acgcaggaugcuggggcu

SEQ ID NO: 4031115 - RNA, 18 nt, Molluscum contagiosum virus
acgccagcagcagaggag

SEQ ID NO: 4031116 - RNA, 14 nt, Molluscum contagiosum virus
acgccagccuggag

SEQ ID NO: 4031117 - RNA, 15 nt, Molluscum contagiosum virus
acgccaucaggaaug

SEQ ID NO: 4031118 - RNA, 17 nt, Molluscum contagiosum virus
acgccauuuucgugcgc

SEQ ID NO: 4031119 - RNA, 13 nt, Molluscum contagiosum virus
acgccgagcgggc

SEQ ID NO: 4031120 - RNA, 22 nt, Molluscum contagiosum virus
acgccggggggcgccaaguccg

SEQ ID NO: 4031121 - RNA, 23 nt, Molluscum contagiosum virus
acgccgugggcagcuucugcucg

SEQ ID NO: 4031122 - RNA, 23 nt, Molluscum contagiosum virus
acgccuccaagaagaggccagca

SEQ ID NO: 4031123 - RNA, 23 nt, Molluscum contagiosum virus
acgccuccaagaagaggccggca

SEQ ID NO: 4031124 - RNA, 17 nt, Molluscum contagiosum virus
acgccuuccugcuggcg

SEQ ID NO: 4031125 - RNA, 13 nt, Molluscum contagiosum virus
acgcgagcggagc

SEQ ID NO: 4031126 - RNA, 20 nt, Molluscum contagiosum virus
acgcgaucuuccgcgacgag

SEQ ID NO: 4031127 - RNA, 21 nt, Molluscum contagiosum virus
acgcgcagcuguuucugccgc

SEQ ID NO: 4031128 - RNA, 18 nt, Molluscum contagiosum virus
acgcgcaugaggcggcgc

SEQ ID NO: 4031129 - RNA, 15 nt, Molluscum contagiosum virus
acgcgcccuaagggc

SEQ ID NO: 4031130 - RNA, 14 nt, Molluscum contagiosum virus
acgcgccgcgcgag

SEQ ID NO: 4031131 - RNA, 22 nt, Molluscum contagiosum virus
acgcgccgcgcgcuuacuaagc

SEQ ID NO: 4031132 - RNA, 15 nt, Molluscum contagiosum virus
acgcgcgagcggagc

SEQ ID NO: 4031133 - RNA, 24 nt, Molluscum contagiosum virus
acgcgcgagugugugcaucccucg

SEQ ID NO: 4031134 - RNA, 17 nt, Molluscum contagiosum virus
acgcgcgcacaucggca

SEQ ID NO: 4031135 - RNA, 15 nt, Molluscum contagiosum virus
acgcgcgcggcaagc

SEQ ID NO: 4031136 - RNA, 20 nt, Molluscum contagiosum virus
acgcgcgcguaacagcgcgc

SEQ ID NO: 4031137 - RNA, 13 nt, Molluscum contagiosum virus
acgcgcgcuuagc

SEQ ID NO: 4031138 - RNA, 15 nt, Molluscum contagiosum virus
acgcgcucguccgcc

SEQ ID NO: 4031139 - RNA, 14 nt, Molluscum contagiosum virus
acgcgcugcggcgc

SEQ ID NO: 4031140 - RNA, 16 nt, Molluscum contagiosum virus
acgcggccaugcuccu

SEQ ID NO: 4031141 - RNA, 19 nt, Molluscum contagiosum virus
acgcggcgcgugucgcgga

SEQ ID NO: 4031142 - RNA, 21 nt, Molluscum contagiosum virus
acgcggcucuggagcggccac

SEQ ID NO: 4031143 - RNA, 15 nt, Molluscum contagiosum virus
acgcgggccaggcac

SEQ ID NO: 4031144 - RNA, 12 nt, Molluscum contagiosum virus
acgcgggccugu

SEQ ID NO: 4031145 - RNA, 14 nt, Molluscum contagiosum virus
acgcgggccugucc

SEQ ID NO: 4031146 - RNA, 13 nt, Molluscum contagiosum virus
acgcgggcgccgg

SEQ ID NO: 4031147 - RNA, 15 nt, Molluscum contagiosum virus
acgcggugagugcgc

SEQ ID NO: 4031148 - RNA, 17 nt, Molluscum contagiosum virus
acgcggugcgcgcgugc

SEQ ID NO: 4031149 - RNA, 15 nt, Molluscum contagiosum virus
acgcguacauccgcg

SEQ ID NO: 4031150 - RNA, 17 nt, Molluscum contagiosum virus
acgcguacauccgcgag

SEQ ID NO: 4031151 - RNA, 14 nt, Molluscum contagiosum virus
acgcguaccagcgc

SEQ ID NO: 4031152 - RNA, 16 nt, Molluscum contagiosum virus
acgcguacguguccau

SEQ ID NO: 4031153 - RNA, 22 nt, Molluscum contagiosum virus
acgcguagcacgaaggacgcgc

SEQ ID NO: 4031154 - RNA, 23 nt, Molluscum contagiosum virus
acgcguccgccucuuccucgugc

SEQ ID NO: 4031155 - RNA, 23 nt, Molluscum contagiosum virus
acgcgucgcgcaggcgcccaacg

SEQ ID NO: 4031156 - RNA, 18 nt, Molluscum contagiosum virus
acgcuaccugaagcugga

SEQ ID NO: 4031157 - RNA, 16 nt, Molluscum contagiosum virus
acgcucacggccuucg

SEQ ID NO: 4031158 - RNA, 17 nt, Molluscum contagiosum virus
acgcucuccaugcgcgc

SEQ ID NO: 4031159 - RNA, 16 nt, Molluscum contagiosum virus
acgcugcggcggcgca

SEQ ID NO: 4031160 - RNA, 14 nt, Molluscum contagiosum virus
acgcugcugcacag

SEQ ID NO: 4031161 - RNA, 19 nt, Molluscum contagiosum virus
acgcuggacuuccugcugc

SEQ ID NO: 4031162 - RNA, 15 nt, Molluscum contagiosum virus
acgcuggcgcucggc

SEQ ID NO: 4031163 - RNA, 13 nt, Molluscum contagiosum virus
acgcuggcggcgc

SEQ ID NO: 4031164 - RNA, 18 nt, Molluscum contagiosum virus
acgcuguacaugccgcag

SEQ ID NO: 4031165 - RNA, 20 nt, Molluscum contagiosum virus
acgcuguccaggcgcugcac

SEQ ID NO: 4031166 - RNA, 16 nt, Molluscum contagiosum virus
acgcuguugcugcugc

SEQ ID NO: 4031167 - RNA, 16 nt, Molluscum contagiosum virus
acggaaacagcaccgu

SEQ ID NO: 4031168 - RNA, 16 nt, Molluscum contagiosum virus
acggacgcccuccucg

SEQ ID NO: 4031169 - RNA, 11 nt, Molluscum contagiosum virus
acggacgccuu

SEQ ID NO: 4031170 - RNA, 15 nt, Molluscum contagiosum virus
acggacucgccgcgc

SEQ ID NO: 4031171 - RNA, 20 nt, Molluscum contagiosum virus
acggacugggagcaccgcgu

SEQ ID NO: 4031172 - RNA, 12 nt, Molluscum contagiosum virus
acggacuucuug

SEQ ID NO: 4031173 - RNA, 13 nt, Molluscum contagiosum virus
acggagcgcgcgc

SEQ ID NO: 4031174 - RNA, 17 nt, Molluscum contagiosum virus
acggagcggaucgugcu

SEQ ID NO: 4031175 - RNA, 21 nt, Molluscum contagiosum virus
acggagcuacaaaacugaaaa

SEQ ID NO: 4031176 - RNA, 22 nt, Molluscum contagiosum virus
acggcaaacgccacugggucug

SEQ ID NO: 4031177 - RNA, 21 nt, Molluscum contagiosum virus
acggcaagacgacacgagggc

SEQ ID NO: 4031178 - RNA, 14 nt, Molluscum contagiosum virus
acggcacgcugagc

SEQ ID NO: 4031179 - RNA, 15 nt, Molluscum contagiosum virus
acggcagacggcaag

SEQ ID NO: 4031180 - RNA, 12 nt, Molluscum contagiosum virus
acggcccaccuu

SEQ ID NO: 4031181 - RNA, 16 nt, Molluscum contagiosum virus
acggcccaccuucuug

SEQ ID NO: 4031182 - RNA, 14 nt, Molluscum contagiosum virus
acggccgcgcgcga

SEQ ID NO: 4031183 - RNA, 12 nt, Molluscum contagiosum virus
acggccugcggc

SEQ ID NO: 4031184 - RNA, 18 nt, Molluscum contagiosum virus
acggcgacgcgaucgugc

SEQ ID NO: 4031185 - RNA, 20 nt, Molluscum contagiosum virus
acggcgccuucgucgcgcgc

SEQ ID NO: 4031186 - RNA, 23 nt, Molluscum contagiosum virus
acggcgcgcgcgcuagccgccgc

SEQ ID NO: 4031187 - RNA, 19 nt, Molluscum contagiosum virus
acggcgcgggcgcgcccga

SEQ ID NO: 4031188 - RNA, 18 nt, Molluscum contagiosum virus
acggcgcucgccucuggg

SEQ ID NO: 4031189 - RNA, 22 nt, Molluscum contagiosum virus
acggcggcgcaagcgcaagccg

SEQ ID NO: 4031190 - RNA, 15 nt, Molluscum contagiosum virus
acggcggugcccgcc

SEQ ID NO: 4031191 - RNA, 15 nt, Molluscum contagiosum virus
acggcgugcuggcca

SEQ ID NO: 4031192 - RNA, 18 nt, Molluscum contagiosum virus
acggcuucauccgcgcgc

SEQ ID NO: 4031193 - RNA, 13 nt, Molluscum contagiosum virus
acgggccgccgcc

SEQ ID NO: 4031194 - RNA, 17 nt, Molluscum contagiosum virus
acgggcgcgcguacgcg

SEQ ID NO: 4031195 - RNA, 21 nt, Molluscum contagiosum virus
acgggcgcuauugcgcggcgc

SEQ ID NO: 4031196 - RNA, 19 nt, Molluscum contagiosum virus
acgggcucugugcggacau

SEQ ID NO: 4031197 - RNA, 17 nt, Molluscum contagiosum virus
acggguguacaaagagc

SEQ ID NO: 4031198 - RNA, 21 nt, Molluscum contagiosum virus
acggucuugccgaagccgcag

SEQ ID NO: 4031199 - RNA, 20 nt, Molluscum contagiosum virus
acggugcagccgcugcugcu

SEQ ID NO: 4031200 - RNA, 15 nt, Molluscum contagiosum virus
acguacagugcgcgc

SEQ ID NO: 4031201 - RNA, 22 nt, Molluscum contagiosum virus
acguacgagcagcugcugcgca

SEQ ID NO: 4031202 - RNA, 18 nt, Molluscum contagiosum virus
acgucauuguaaaacgac

SEQ ID NO: 4031203 - RNA, 20 nt, Molluscum contagiosum virus
acgucuggcucguacugcug

SEQ ID NO: 4031204 - RNA, 23 nt, Molluscum contagiosum virus
acgucuggcucguacugcugcag

SEQ ID NO: 4031205 - RNA, 19 nt, Molluscum contagiosum virus
acgugacagucagcggcgu

SEQ ID NO: 4031206 - RNA, 15 nt, Molluscum contagiosum virus
acgugcacgcgcacg

SEQ ID NO: 4031207 - RNA, 14 nt, Molluscum contagiosum virus
acgugcagcggcgc

SEQ ID NO: 4031208 - RNA, 19 nt, Molluscum contagiosum virus
acgugccaagaccugggcg

SEQ ID NO: 4031209 - RNA, 15 nt, Molluscum contagiosum virus
acgugcuccgugugc

SEQ ID NO: 4031210 - RNA, 19 nt, Molluscum contagiosum virus
acgugcugcagcugcgcga

SEQ ID NO: 4031211 - RNA, 18 nt, Molluscum contagiosum virus
acguggacaagucacugc

SEQ ID NO: 4031212 - RNA, 21 nt, Molluscum contagiosum virus
acguggagccugaggccgcgg

SEQ ID NO: 4031213 - RNA, 13 nt, Molluscum contagiosum virus
acguggcgccgcu

SEQ ID NO: 4031214 - RNA, 22 nt, Molluscum contagiosum virus
acguguacgcacggggccgcac

SEQ ID NO: 4031215 - RNA, 23 nt, Molluscum contagiosum virus
acgugugcucugugcgcgcagac

SEQ ID NO: 4031216 - RNA, 23 nt, Molluscum contagiosum virus
acguuugcgucugcgaggcgcgc

SEQ ID NO: 4031217 - RNA, 20 nt, Molluscum contagiosum virus
acuaagaacguaaaaaagag

SEQ ID NO: 4031218 - RNA, 18 nt, Molluscum contagiosum virus
acuaagcuaaaagagcug

SEQ ID NO: 4031219 - RNA, 15 nt, Molluscum contagiosum virus
acuacacugucgcgc

SEQ ID NO: 4031220 - RNA, 18 nt, Molluscum contagiosum virus
acuaccacgucggcgaga

SEQ ID NO: 4031221 - RNA, 14 nt, Molluscum contagiosum virus
acuaccucuuugag

SEQ ID NO: 4031222 - RNA, 15 nt, Molluscum contagiosum virus
acuacgcgcugcuag

SEQ ID NO: 4031223 - RNA, 15 nt, Molluscum contagiosum virus
acuacuacacugucg

SEQ ID NO: 4031224 - RNA, 20 nt, Molluscum contagiosum virus
acuagcguagcaugcucguc

SEQ ID NO: 4031225 - RNA, 17 nt, Molluscum contagiosum virus
acucaacaagcugcugg

SEQ ID NO: 4031226 - RNA, 21 nt, Molluscum contagiosum virus
acucaauucaaguuugacaag

SEQ ID NO: 4031227 - RNA, 12 nt, Molluscum contagiosum virus
acucaggaagcg

SEQ ID NO: 4031228 - RNA, 19 nt, Molluscum contagiosum virus
acuccaagugaacuacagu

SEQ ID NO: 4031229 - RNA, 15 nt, Molluscum contagiosum virus
acuccaucugcgcga

SEQ ID NO: 4031230 - RNA, 13 nt, Molluscum contagiosum virus
acuccgagcgcgc

SEQ ID NO: 4031231 - RNA, 19 nt, Molluscum contagiosum virus
acuccgcgaggagauucgc

SEQ ID NO: 4031232 - RNA, 24 nt, Molluscum contagiosum virus
acuccguggaggaucgcuacgugc

SEQ ID NO: 4031233 - RNA, 21 nt, Molluscum contagiosum virus
acucgaacgcaaggugugcgc

SEQ ID NO: 4031234 - RNA, 22 nt, Molluscum contagiosum virus
acucgagcacguagugcucguc

SEQ ID NO: 4031235 - RNA, 21 nt, Molluscum contagiosum virus
acucgagcgagcuacgcgcuc

SEQ ID NO: 4031236 - RNA, 19 nt, Molluscum contagiosum virus
acucgcagaacugcugcgc

SEQ ID NO: 4031237 - RNA, 15 nt, Molluscum contagiosum virus
acucgcgcugcagca

SEQ ID NO: 4031238 - RNA, 14 nt, Molluscum contagiosum virus
acucgcugccagag

SEQ ID NO: 4031239 - RNA, 13 nt, Molluscum contagiosum virus
acucgcugcuccc

SEQ ID NO: 4031240 - RNA, 16 nt, Molluscum contagiosum virus
acucgcugcugcucuu

SEQ ID NO: 4031241 - RNA, 18 nt, Molluscum contagiosum virus
acucgcugcugcucuucc

SEQ ID NO: 4031242 - RNA, 21 nt, Molluscum contagiosum virus
acucgucgagcacgaagacgu

SEQ ID NO: 4031243 - RNA, 17 nt, Molluscum contagiosum virus
acucucaucgagcaccu

SEQ ID NO: 4031244 - RNA, 13 nt, Molluscum contagiosum virus
acugcagcacguc

SEQ ID NO: 4031245 - RNA, 12 nt, Molluscum contagiosum virus
acugcagcagcc

SEQ ID NO: 4031246 - RNA, 13 nt, Molluscum contagiosum virus
acugcagcagccc

SEQ ID NO: 4031247 - RNA, 13 nt, Molluscum contagiosum virus
acugcagcagcuc

SEQ ID NO: 4031248 - RNA, 17 nt, Molluscum contagiosum virus
acugcccgcgcccugca

SEQ ID NO: 4031249 - RNA, 16 nt, Molluscum contagiosum virus
acugccgccgccgcga

SEQ ID NO: 4031250 - RNA, 17 nt, Molluscum contagiosum virus
acugccgccgccgcgag

SEQ ID NO: 4031251 - RNA, 22 nt, Molluscum contagiosum virus
acugccuggucacagacacgcu

SEQ ID NO: 4031252 - RNA, 15 nt, Molluscum contagiosum virus
acugcgccaaggugg

SEQ ID NO: 4031253 - RNA, 18 nt, Molluscum contagiosum virus
acugcggacaccagaacc

SEQ ID NO: 4031254 - RNA, 16 nt, Molluscum contagiosum virus
acugcguugucuccuc

SEQ ID NO: 4031255 - RNA, 19 nt, Molluscum contagiosum virus
acugcguugucuccuccug

SEQ ID NO: 4031256 - RNA, 22 nt, Molluscum contagiosum virus
acugcugcccccgccgcggcgc

SEQ ID NO: 4031257 - RNA, 18 nt, Molluscum contagiosum virus
acuggaagaacaggccgc

SEQ ID NO: 4031258 - RNA, 19 nt, Molluscum contagiosum virus
acuggagcacggacuggga

SEQ ID NO: 4031259 - RNA, 17 nt, Molluscum contagiosum virus
acuggcacgcgccgcgc

SEQ ID NO: 4031260 - RNA, 15 nt, Molluscum contagiosum virus
acuggcgcagcagga

SEQ ID NO: 4031261 - RNA, 20 nt, Molluscum contagiosum virus
acugggaacccguggccgag

SEQ ID NO: 4031262 - RNA, 14 nt, Molluscum contagiosum virus
acugggagcuuucc

SEQ ID NO: 4031263 - RNA, 22 nt, Molluscum contagiosum virus
acugggcuucaaguuccuggag

SEQ ID NO: 4031264 - RNA, 22 nt, Molluscum contagiosum virus
acuguaggggagggcggcaagc

SEQ ID NO: 4031265 - RNA, 22 nt, Molluscum contagiosum virus
acugucgacagagaaguccccg

SEQ ID NO: 4031266 - RNA, 22 nt, Molluscum contagiosum virus
acugucucugcgcgagcagcug

SEQ ID NO: 4031267 - RNA, 14 nt, Molluscum contagiosum virus
acugugccagcagc

SEQ ID NO: 4031268 - RNA, 23 nt, Molluscum contagiosum virus
acuucacggcguucaccuuggcg

SEQ ID NO: 4031269 - RNA, 19 nt, Molluscum contagiosum virus
acuucccgacgucuucccc

SEQ ID NO: 4031270 - RNA, 13 nt, Molluscum contagiosum virus
acuuccgcgcgcu

SEQ ID NO: 4031271 - RNA, 19 nt, Molluscum contagiosum virus
acuuccgcgcgcucuugca

SEQ ID NO: 4031272 - RNA, 14 nt, Molluscum contagiosum virus
acuugcacgcgcac

SEQ ID NO: 4031273 - RNA, 16 nt, Molluscum contagiosum virus
acuugcgcgccuguca

SEQ ID NO: 4031274 - RNA, 19 nt, Molluscum contagiosum virus
acuugcggcgcuagcgccc

SEQ ID NO: 4031275 - RNA, 15 nt, Molluscum contagiosum virus
acuuuaucucucacu

SEQ ID NO: 4031276 - RNA, 15 nt, Molluscum contagiosum virus
agaaacgacgggcgc

SEQ ID NO: 4031277 - RNA, 23 nt, Molluscum contagiosum virus
agaaaggcacccaccaggaacag

SEQ ID NO: 4031278 - RNA, 18 nt, Molluscum contagiosum virus
agaaaugcgcacacuugc

SEQ ID NO: 4031279 - RNA, 21 nt, Molluscum contagiosum virus
agaagacauugccuuuugcac

SEQ ID NO: 4031280 - RNA, 12 nt, Molluscum contagiosum virus
agaagaggccag

SEQ ID NO: 4031281 - RNA, 17 nt, Molluscum contagiosum virus
agaagaggccagcacaa

SEQ ID NO: 4031282 - RNA, 18 nt, Molluscum contagiosum virus
agaaggagcccuugccac

SEQ ID NO: 4031283 - RNA, 14 nt, Molluscum contagiosum virus
agacaccagcuccg

SEQ ID NO: 4031284 - RNA, 15 nt, Molluscum contagiosum virus
agacaggccggggcc

SEQ ID NO: 4031285 - RNA, 15 nt, Molluscum contagiosum virus
agaccaccagcacca

SEQ ID NO: 4031286 - RNA, 17 nt, Molluscum contagiosum virus
agacccgaaagcugccc

SEQ ID NO: 4031287 - RNA, 18 nt, Molluscum contagiosum virus
agaccuggucacacuggu

SEQ ID NO: 4031288 - RNA, 14 nt, Molluscum contagiosum virus
agacgagcugugcg

SEQ ID NO: 4031289 - RNA, 14 nt, Molluscum contagiosum virus
agacgcgcucgcgc

SEQ ID NO: 4031290 - RNA, 16 nt, Molluscum contagiosum virus
agacgcguaccagcgc

SEQ ID NO: 4031291 - RNA, 14 nt, Molluscum contagiosum virus
agacgcugcgcgac

SEQ ID NO: 4031292 - RNA, 16 nt, Molluscum contagiosum virus
agacgugcggcacgcu

SEQ ID NO: 4031293 - RNA, 12 nt, Molluscum contagiosum virus
agacuuccuugc

SEQ ID NO: 4031294 - RNA, 15 nt, Molluscum contagiosum virus
agagaaccugugcgc

SEQ ID NO: 4031295 - RNA, 16 nt, Molluscum contagiosum virus
agagcacggacagcac

SEQ ID NO: 4031296 - RNA, 23 nt, Molluscum contagiosum virus
agagcccaaggggagacauaugu

SEQ ID NO: 4031297 - RNA, 16 nt, Molluscum contagiosum virus
agagcuccccgcgcgc

SEQ ID NO: 4031298 - RNA, 18 nt, Molluscum contagiosum virus
agagcuggcaccgggcgc

SEQ ID NO: 4031299 - RNA, 19 nt, Molluscum contagiosum virus
agagcuuacuagacuggcu

SEQ ID NO: 4031300 - RNA, 14 nt, Molluscum contagiosum virus
agaggagauggcaa

SEQ ID NO: 4031301 - RNA, 16 nt, Molluscum contagiosum virus
agaggggagccagccu

SEQ ID NO: 4031302 - RNA, 12 nt, Molluscum contagiosum virus
agaggggcaaca

SEQ ID NO: 4031303 - RNA, 15 nt, Molluscum contagiosum virus
agagggucgugcagg

SEQ ID NO: 4031304 - RNA, 22 nt, Molluscum contagiosum virus
agagguugagcuuggugcagcg

SEQ ID NO: 4031305 - RNA, 23 nt, Molluscum contagiosum virus
acgcuggcacggccggcgccgcg

SEQ ID NO: 4031306 - RNA, 20 nt, Molluscum contagiosum virus
acgcuggccgugcccgccga

SEQ ID NO: 4031307 - RNA, 15 nt, Molluscum contagiosum virus
acgcuguugcugcug

SEQ ID NO: 4031308 - RNA, 17 nt, Molluscum contagiosum virus
acgcuguugcugcugcc

SEQ ID NO: 4031309 - RNA, 15 nt, Molluscum contagiosum virus
agaaaaauacgugua

SEQ ID NO: 4031310 - RNA, 21 nt, Molluscum contagiosum virus
agaaagaccuugucagugggc

SEQ ID NO: 4031311 - RNA, 16 nt, Molluscum contagiosum virus
agaacaugcucgccag

SEQ ID NO: 4031312 - RNA, 22 nt, Molluscum contagiosum virus
agaacaugugcuccgccaacgc

SEQ ID NO: 4031313 - RNA, 20 nt, Molluscum contagiosum virus
agaacccguauuuccagcgu

SEQ ID NO: 4031314 - RNA, 21 nt, Molluscum contagiosum virus
agaagagggucgugcaggucg

SEQ ID NO: 4031315 - RNA, 19 nt, Molluscum contagiosum virus
agaagugugccugcugcgc

SEQ ID NO: 4031316 - RNA, 23 nt, Molluscum contagiosum virus
agaaguugccgcaggaaccgcgu

SEQ ID NO: 4031317 - RNA, 14 nt, Molluscum contagiosum virus
agaaugacuuagcc

SEQ ID NO: 4031318 - RNA, 20 nt, Molluscum contagiosum virus
agaauuucgacagcauccug

SEQ ID NO: 4031319 - RNA, 21 nt, Molluscum contagiosum virus
agacaacacucgugcucgugu

SEQ ID NO: 4031320 - RNA, 12 nt, Molluscum contagiosum virus
agacaccagcuc

SEQ ID NO: 4031321 - RNA, 15 nt, Molluscum contagiosum virus
agacaccagcuccgc

SEQ ID NO: 4031322 - RNA, 18 nt, Molluscum contagiosum virus
agacagcacggcacgugc

SEQ ID NO: 4031323 - RNA, 18 nt, Molluscum contagiosum virus
agacauaguaccaugacg

SEQ ID NO: 4031324 - RNA, 18 nt, Molluscum contagiosum virus
agacaugucguaccuggu

SEQ ID NO: 4031325 - RNA, 16 nt, Molluscum contagiosum virus
agacgcgcucgcgcuc

SEQ ID NO: 4031326 - RNA, 15 nt, Molluscum contagiosum virus
agacgcuagcugugc

SEQ ID NO: 4031327 - RNA, 17 nt, Molluscum contagiosum virus
agacgcuccauucucuc

SEQ ID NO: 4031328 - RNA, 15 nt, Molluscum contagiosum virus
agacgcugcugcaca

SEQ ID NO: 4031329 - RNA, 15 nt, Molluscum contagiosum virus
agacgugcugcgcgc

SEQ ID NO: 4031330 - RNA, 21 nt, Molluscum contagiosum virus
agacuaccggcaguagcagcg

SEQ ID NO: 4031331 - RNA, 16 nt, Molluscum contagiosum virus
agacuggagcacggac

SEQ ID NO: 4031332 - RNA, 21 nt, Molluscum contagiosum virus
agacuuucugcagucagauug

SEQ ID NO: 4031333 - RNA, 20 nt, Molluscum contagiosum virus
agagcaagcgagagaggagu

SEQ ID NO: 4031334 - RNA, 21 nt, Molluscum contagiosum virus
agagcacugcgcgucugugcg

SEQ ID NO: 4031335 - RNA, 17 nt, Molluscum contagiosum virus
agagcaucgagcuggug

SEQ ID NO: 4031336 - RNA, 17 nt, Molluscum contagiosum virus
agagcauuagcagcgag

SEQ ID NO: 4031337 - RNA, 11 nt, Molluscum contagiosum virus
agagcccgcac

SEQ ID NO: 4031338 - RNA, 15 nt, Molluscum contagiosum virus
agagccgccggggcc

SEQ ID NO: 4031339 - RNA, 20 nt, Molluscum contagiosum virus
agagcgguuccugcuucucg

SEQ ID NO: 4031340 - RNA, 21 nt, Molluscum contagiosum virus
agagcuccccgcgcgcagcgc

SEQ ID NO: 4031341 - RNA, 23 nt, Molluscum contagiosum virus
agagcuccccgcgcgcagcgcgu

SEQ ID NO: 4031342 - RNA, 22 nt, Molluscum contagiosum virus
agagcucguggacagccugcac

SEQ ID NO: 4031343 - RNA, 14 nt, Molluscum contagiosum virus
agaggaaagcgcac

SEQ ID NO: 4031344 - RNA, 14 nt, Molluscum contagiosum virus
agaggacgagcugc

SEQ ID NO: 4031345 - RNA, 14 nt, Molluscum contagiosum virus
agagggcagaacag

SEQ ID NO: 4031346 - RNA, 14 nt, Molluscum contagiosum virus
agagggucgugcag

SEQ ID NO: 4031347 - RNA, 13 nt, Molluscum contagiosum virus
agaucaggcagcu

SEQ ID NO: 4031348 - RNA, 21 nt, Molluscum contagiosum virus
agaucaggcagcugcugcgcu

SEQ ID NO: 4031349 - RNA, 16 nt, Molluscum contagiosum virus
agaucgcgagaggaga

SEQ ID NO: 4031350 - RNA, 17 nt, Molluscum contagiosum virus
agaugcgagcgcgucug

SEQ ID NO: 4031351 - RNA, 13 nt, Molluscum contagiosum virus
agaugcgcggaca

SEQ ID NO: 4031352 - RNA, 13 nt, Molluscum contagiosum virus
agcaaccucggga

SEQ ID NO: 4031353 - RNA, 23 nt, Molluscum contagiosum virus
agcaacgcgaccuacgaggugcu

SEQ ID NO: 4031354 - RNA, 18 nt, Molluscum contagiosum virus
agcaagacccagcaaggc

SEQ ID NO: 4031355 - RNA, 15 nt, Molluscum contagiosum virus
agcaagcagccgcac

SEQ ID NO: 4031356 - RNA, 14 nt, Molluscum contagiosum virus
agcaaggggucugc

SEQ ID NO: 4031357 - RNA, 14 nt, Molluscum contagiosum virus
agcacaccgucgcg

SEQ ID NO: 4031358 - RNA, 15 nt, Molluscum contagiosum virus
agcacagcaggagca

SEQ ID NO: 4031359 - RNA, 15 nt, Molluscum contagiosum virus
agcaccaagaagcgg

SEQ ID NO: 4031360 - RNA, 22 nt, Molluscum contagiosum virus
agcaccaagaagcggcccugca

SEQ ID NO: 4031361 - RNA, 21 nt, Molluscum contagiosum virus
agcaccgccugcugcagcucc

SEQ ID NO: 4031362 - RNA, 21 nt, Molluscum contagiosum virus
agcaccggcggguccgcaggc

SEQ ID NO: 4031363 - RNA, 15 nt, Molluscum contagiosum virus
agcaccugcgcuucc

SEQ ID NO: 4031364 - RNA, 16 nt, Molluscum contagiosum virus
agcacgacggucuucc

SEQ ID NO: 4031365 - RNA, 22 nt, Molluscum contagiosum virus
agcacgccuccaagaagaggcc

SEQ ID NO: 4031366 - RNA, 14 nt, Molluscum contagiosum virus
agcacgggcggaag

SEQ ID NO: 4031367 - RNA, 18 nt, Molluscum contagiosum virus
agcacgggcggaagcucc

SEQ ID NO: 4031368 - RNA, 18 nt, Molluscum contagiosum virus
agcacgggcgggacagac

SEQ ID NO: 4031369 - RNA, 16 nt, Molluscum contagiosum virus
agcacgucuugcgcgg

SEQ ID NO: 4031370 - RNA, 16 nt, Molluscum contagiosum virus
agcacguuguucuugc

SEQ ID NO: 4031371 - RNA, 17 nt, Molluscum contagiosum virus
agcacuguacgcacgca

SEQ ID NO: 4031372 - RNA, 20 nt, Molluscum contagiosum virus
agcacuucucgccgcaccac

SEQ ID NO: 4031373 - RNA, 20 nt, Molluscum contagiosum virus
agcagcgugcauagugggcu

SEQ ID NO: 4031374 - RNA, 23 nt, Molluscum contagiosum virus
agcagcucggcgagagcgcgcag

SEQ ID NO: 4031375 - RNA, 20 nt, Molluscum contagiosum virus
agcagcucggggcugucaga

SEQ ID NO: 4031376 - RNA, 18 nt, Molluscum contagiosum virus
agcagcugcugcgcuucg

SEQ ID NO: 4031377 - RNA, 11 nt, Molluscum contagiosum virus
agcaggcacuc

SEQ ID NO: 4031378 - RNA, 20 nt, Molluscum contagiosum virus
agcagguucucgcacaguac

SEQ ID NO: 4031379 - RNA, 19 nt, Molluscum contagiosum virus
agcauauccugauuucguu

SEQ ID NO: 4031380 - RNA, 14 nt, Molluscum contagiosum virus
agcaucccugccac

SEQ ID NO: 4031381 - RNA, 23 nt, Molluscum contagiosum virus
agcaugccgccgcguacgcgccg

SEQ ID NO: 4031382 - RNA, 21 nt, Molluscum contagiosum virus
agcaugcugucucugucccug

SEQ ID NO: 4031383 - RNA, 13 nt, Molluscum contagiosum virus
agcauggccgcgu

SEQ ID NO: 4031384 - RNA, 10 nt, Molluscum contagiosum virus
agcaugucac

SEQ ID NO: 4031385 - RNA, 13 nt, Molluscum contagiosum virus
agccagccaggcg

SEQ ID NO: 4031386 - RNA, 19 nt, Molluscum contagiosum virus
agccaugaggacagcuugc

SEQ ID NO: 4031387 - RNA, 13 nt, Molluscum contagiosum virus
agcccgagcgcgc

SEQ ID NO: 4031388 - RNA, 14 nt, Molluscum contagiosum virus
agcccgcggugcgc

SEQ ID NO: 4031389 - RNA, 15 nt, Molluscum contagiosum virus
agcccgggcccgugc

SEQ ID NO: 4031390 - RNA, 22 nt, Molluscum contagiosum virus
agcccgugcuggagggcacgcu

SEQ ID NO: 4031391 - RNA, 20 nt, Molluscum contagiosum virus
agccgcccgcggacucgugc

SEQ ID NO: 4031392 - RNA, 21 nt, Molluscum contagiosum virus
agccgccugccgcgcucgugc

SEQ ID NO: 4031393 - RNA, 13 nt, Molluscum contagiosum virus
agccgcgaaagcg

SEQ ID NO: 4031394 - RNA, 13 nt, Molluscum contagiosum virus
agccgcggaggcc

SEQ ID NO: 4031395 - RNA, 19 nt, Molluscum contagiosum virus
agccgcguagcuagcucug

SEQ ID NO: 4031396 - RNA, 20 nt, Molluscum contagiosum virus
agccgcgugcuggcggggcu

SEQ ID NO: 4031397 - RNA, 15 nt, Molluscum contagiosum virus
agccgcugcuccugc

SEQ ID NO: 4031398 - RNA, 18 nt, Molluscum contagiosum virus
agccgcuucgggcucagc

SEQ ID NO: 4031399 - RNA, 21 nt, Molluscum contagiosum virus
agccguccgccucgagcacgc

SEQ ID NO: 4031400 - RNA, 19 nt, Molluscum contagiosum virus
agccucaucgugagccugg

SEQ ID NO: 4031401 - RNA, 20 nt, Molluscum contagiosum virus
agccucaucgugagccuggu

SEQ ID NO: 4031402 - RNA, 24 nt, Molluscum contagiosum virus
agccucaucgugagccuggucgag

SEQ ID NO: 4031403 - RNA, 20 nt, Molluscum contagiosum virus
agccucgagcgccgugcagu

SEQ ID NO: 4031404 - RNA, 24 nt, Molluscum contagiosum virus
agccucuggaaggagcugggcucg

SEQ ID NO: 4031405 - RNA, 13 nt, Molluscum contagiosum virus
agccugaggccgc

SEQ ID NO: 4031406 - RNA, 17 nt, Molluscum contagiosum virus
agccugcaccgagugcu

SEQ ID NO: 4031407 - RNA, 13 nt, Molluscum contagiosum virus
agccugccgcgag

SEQ ID NO: 4031408 - RNA, 12 nt, Molluscum contagiosum virus
agccugcucacg

SEQ ID NO: 4031409 - RNA, 15 nt, Molluscum contagiosum virus
agcgacgagcagcug

SEQ ID NO: 4031410 - RNA, 19 nt, Molluscum contagiosum virus
agcgagucaucggcgaguu

SEQ ID NO: 4031411 - RNA, 15 nt, Molluscum contagiosum virus
agcgcaaaugccgag

SEQ ID NO: 4031412 - RNA, 16 nt, Molluscum contagiosum virus
agcgcagcacacuugu

SEQ ID NO: 4031413 - RNA, 22 nt, Molluscum contagiosum virus
agcgccacgcccucgccugcga

SEQ ID NO: 4031414 - RNA, 16 nt, Molluscum contagiosum virus
agcgccagccugcugg

SEQ ID NO: 4031415 - RNA, 23 nt, Molluscum contagiosum virus
agcgccagcuuggugcgcucgag

SEQ ID NO: 4031416 - RNA, 22 nt, Molluscum contagiosum virus
agcgccgccagcuccgcgcggc

SEQ ID NO: 4031417 - RNA, 18 nt, Molluscum contagiosum virus
agcgccgccaugcugcgc

SEQ ID NO: 4031418 - RNA, 21 nt, Molluscum contagiosum virus
agcgccgccaugcugcgcgag

SEQ ID NO: 4031419 - RNA, 17 nt, Molluscum contagiosum virus
agcgccgcucgcacggc

SEQ ID NO: 4031420 - RNA, 21 nt, Molluscum contagiosum virus
agcgccggcgaccagcucuug

SEQ ID NO: 4031421 - RNA, 19 nt, Molluscum contagiosum virus
agcgccgucucgcggaaga

SEQ ID NO: 4031422 - RNA, 20 nt, Molluscum contagiosum virus
agcgcgaguacaagcucgac

SEQ ID NO: 4031423 - RNA, 15 nt, Molluscum contagiosum virus
agcgcgcaguugugc

SEQ ID NO: 4031424 - RNA, 17 nt, Molluscum contagiosum virus
agcgcgcccaccagcag

SEQ ID NO: 4031425 - RNA, 17 nt, Molluscum contagiosum virus
agcgcgccgcgcgcucg

SEQ ID NO: 4031426 - RNA, 18 nt, Molluscum contagiosum virus
agcgcgccgcucgcgcuc

SEQ ID NO: 4031427 - RNA, 13 nt, Molluscum contagiosum virus
agcgcgccucucg

SEQ ID NO: 4031428 - RNA, 22 nt, Molluscum contagiosum virus
agcgcgcgccgacgugcgcgug

SEQ ID NO: 4031429 - RNA, 16 nt, Molluscum contagiosum virus
agcgcgcgccugcugg

SEQ ID NO: 4031430 - RNA, 15 nt, Molluscum contagiosum virus
agcgcgcgcugcgcg

SEQ ID NO: 4031431 - RNA, 13 nt, Molluscum contagiosum virus
agcgcgcugcaca

SEQ ID NO: 4031432 - RNA, 15 nt, Molluscum contagiosum virus
agcgcgcugcacacc

SEQ ID NO: 4031433 - RNA, 14 nt, Molluscum contagiosum virus
agcgcggagcuggc

SEQ ID NO: 4031434 - RNA, 20 nt, Molluscum contagiosum virus
agcgcguucgcgcgugcugg

SEQ ID NO: 4031435 - RNA, 17 nt, Molluscum contagiosum virus
agcgcuucuuccggcag

SEQ ID NO: 4031436 - RNA, 21 nt, Molluscum contagiosum virus
agcggccuguucuuccagugg

SEQ ID NO: 4031437 - RNA, 14 nt, Molluscum contagiosum virus
agcggcgagcuuug

SEQ ID NO: 4031438 - RNA, 16 nt, Molluscum contagiosum virus
agcggcgcgcgcugag

SEQ ID NO: 4031439 - RNA, 18 nt, Molluscum contagiosum virus
agcggcuuuucgccggag

SEQ ID NO: 4031440 - RNA, 18 nt, Molluscum contagiosum virus
agcguacggcccgaaggc

SEQ ID NO: 4031441 - RNA, 16 nt, Molluscum contagiosum virus
agcguacucgggccgc

SEQ ID NO: 4031442 - RNA, 22 nt, Molluscum contagiosum virus
agcgucgcggagcgcgcacggc

SEQ ID NO: 4031443 - RNA, 15 nt, Molluscum contagiosum virus
agcgugccgcggcac

SEQ ID NO: 4031444 - RNA, 14 nt, Molluscum contagiosum virus
agcguggagcaccu

SEQ ID NO: 4031445 - RNA, 14 nt, Molluscum contagiosum virus
agcgugucgaagcg

SEQ ID NO: 4031446 - RNA, 20 nt, Molluscum contagiosum virus
agcgugugccgccgcacuau

SEQ ID NO: 4031447 - RNA, 16 nt, Molluscum contagiosum virus
agcuacgaucgcgcuc

SEQ ID NO: 4031448 - RNA, 17 nt, Molluscum contagiosum virus
agcuagcucugcgcgcg

SEQ ID NO: 4031449 - RNA, 14 nt, Molluscum contagiosum virus
agcucaaucucgcc

SEQ ID NO: 4031450 - RNA, 23 nt, Molluscum contagiosum virus
agcucccgcgccacgagcgccgc

SEQ ID NO: 4031451 - RNA, 21 nt, Molluscum contagiosum virus
agcucgacugcguugucuccu

SEQ ID NO: 4031452 - RNA, 22 nt, Molluscum contagiosum virus
agcucgccgcgcgccgcugcuc

SEQ ID NO: 4031453 - RNA, 23 nt, Molluscum contagiosum virus
agcucgcguccacgaugcgcucg

SEQ ID NO: 4031454 - RNA, 13 nt, Molluscum contagiosum virus
agcucggguucca

SEQ ID NO: 4031455 - RNA, 22 nt, Molluscum contagiosum virus
agcucuccgagacacgcgagcg

SEQ ID NO: 4031456 - RNA, 17 nt, Molluscum contagiosum virus
agcucuucguggccaaa

SEQ ID NO: 4031457 - RNA, 20 nt, Molluscum contagiosum virus
agcugacccucgcggcucug

SEQ ID NO: 4031458 - RNA, 23 nt, Molluscum contagiosum virus
agcugcccgaguuucggaagagc

SEQ ID NO: 4031459 - RNA, 15 nt, Molluscum contagiosum virus
agcugcuagcggcag

SEQ ID NO: 4031460 - RNA, 16 nt, Molluscum contagiosum virus
agcuggccggcucgcu

SEQ ID NO: 4031461 - RNA, 15 nt, Molluscum contagiosum virus
agcugguccagggcu

SEQ ID NO: 4031462 - RNA, 16 nt, Molluscum contagiosum virus
agcuggugauccugga

SEQ ID NO: 4031463 - RNA, 18 nt, Molluscum contagiosum virus
agcuucuuggagcccuug

SEQ ID NO: 4031464 - RNA, 23 nt, Molluscum contagiosum virus
agcuugacgcguacauccgcgag

SEQ ID NO: 4031465 - RNA, 13 nt, Molluscum contagiosum virus
aggaaagcgcaca

SEQ ID NO: 4031466 - RNA, 18 nt, Molluscum contagiosum virus
aggaaagcgcacacuugc

SEQ ID NO: 4031467 - RNA, 22 nt, Molluscum contagiosum virus
aggaaaggcacccgcaggaaag

SEQ ID NO: 4031468 - RNA, 22 nt, Molluscum contagiosum virus
aggaaaggcaccugcaggaaag

SEQ ID NO: 4031469 - RNA, 16 nt, Molluscum contagiosum virus
aggaaauguaguucuc

SEQ ID NO: 4031470 - RNA, 17 nt, Molluscum contagiosum virus
aggaacucgaggcucug

SEQ ID NO: 4031471 - RNA, 23 nt, Molluscum contagiosum virus
aggaagcuggcgcgguccagccg

SEQ ID NO: 4031472 - RNA, 18 nt, Molluscum contagiosum virus
aggaauguguacgacgcg

SEQ ID NO: 4031473 - RNA, 17 nt, Molluscum contagiosum virus
aggacaaagucgcgcgc

SEQ ID NO: 4031474 - RNA, 12 nt, Molluscum contagiosum virus
aggacaccgcgg

SEQ ID NO: 4031475 - RNA, 13 nt, Molluscum contagiosum virus
aggacgcgugcaa

SEQ ID NO: 4031476 - RNA, 14 nt, Molluscum contagiosum virus
aggagagagagaca

SEQ ID NO: 4031477 - RNA, 13 nt, Molluscum contagiosum virus
aggagagcggcgc

SEQ ID NO: 4031478 - RNA, 16 nt, Molluscum contagiosum virus
aggagccucuguccug

SEQ ID NO: 4031479 - RNA, 19 nt, Molluscum contagiosum virus
aggagcucuucgacagcgu

SEQ ID NO: 4031480 - RNA, 15 nt, Molluscum contagiosum virus
aggagggcagccuca

SEQ ID NO: 4031481 - RNA, 23 nt, Molluscum contagiosum virus
aggaguuggcgcgcaagcgcugc

SEQ ID NO: 4031482 - RNA, 18 nt, Molluscum contagiosum virus
aggaucacgaugugcgcg

SEQ ID NO: 4031483 - RNA, 20 nt, Molluscum contagiosum virus
aggaugccugccagcagagc

SEQ ID NO: 4031484 - RNA, 13 nt, Molluscum contagiosum virus
aggauggacaaag

SEQ ID NO: 4031485 - RNA, 18 nt, Molluscum contagiosum virus
aggcaaagcggggcgcgc

SEQ ID NO: 4031486 - RNA, 16 nt, Molluscum contagiosum virus
aggcacaccccuguaa

SEQ ID NO: 4031487 - RNA, 17 nt, Molluscum contagiosum virus
aggcacccaccaggaac

SEQ ID NO: 4031488 - RNA, 16 nt, Molluscum contagiosum virus
aggcacuccagcgcgc

SEQ ID NO: 4031489 - RNA, 13 nt, Molluscum contagiosum virus
aggcacuccgcgc

SEQ ID NO: 4031490 - RNA, 19 nt, Molluscum contagiosum virus
aggcacucgucgcgcugcu

SEQ ID NO: 4031491 - RNA, 13 nt, Molluscum contagiosum virus
aggcagaagcuca

SEQ ID NO: 4031492 - RNA, 15 nt, Molluscum contagiosum virus
aggcagcugcugcgc

SEQ ID NO: 4031493 - RNA, 23 nt, Molluscum contagiosum virus
aggcaggccccgcaccagugccg

SEQ ID NO: 4031494 - RNA, 19 nt, Molluscum contagiosum virus
aggccaacuaccuggggcu

SEQ ID NO: 4031495 - RNA, 18 nt, Molluscum contagiosum virus
aggccagcacaagccguc

SEQ ID NO: 4031496 - RNA, 12 nt, Molluscum contagiosum virus
aggcccaggcca

SEQ ID NO: 4031497 - RNA, 19 nt, Molluscum contagiosum virus
aggccccccgcaacaagga

SEQ ID NO: 4031498 - RNA, 22 nt, Molluscum contagiosum virus
aggccccccgcaacaaggaaag

SEQ ID NO: 4031499 - RNA, 18 nt, Molluscum contagiosum virus
aggccgcccacgcucaac

SEQ ID NO: 4031500 - RNA, 22 nt, Molluscum contagiosum virus
aggccggcaagcucaagcccgg

SEQ ID NO: 4031501 - RNA, 14 nt, Molluscum contagiosum virus
aggccggcacaagc

SEQ ID NO: 4031502 - RNA, 23 nt, Molluscum contagiosum virus
aggccgggcgcgguagcucgugc

SEQ ID NO: 4031503 - RNA, 15 nt, Molluscum contagiosum virus
aggccugcguggaca

SEQ ID NO: 4031504 - RNA, 19 nt, Molluscum contagiosum virus
aggccuucgcgcccgacga

SEQ ID NO: 4031505 - RNA, 14 nt, Molluscum contagiosum virus
aggccuugcuccca

SEQ ID NO: 4031506 - RNA, 21 nt, Molluscum contagiosum virus
aggcgaccagcugguccugaa

SEQ ID NO: 4031507 - RNA, 16 nt, Molluscum contagiosum virus
aggcgaggucacacuc

SEQ ID NO: 4031508 - RNA, 22 nt, Molluscum contagiosum virus
aggcgccgcaccucaccgcgca

SEQ ID NO: 4031509 - RNA, 21 nt, Molluscum contagiosum virus
aggcgccgcguacgcacgugc

SEQ ID NO: 4031510 - RNA, 12 nt, Molluscum contagiosum virus
acgaagcugugc

SEQ ID NO: 4031511 - RNA, 23 nt, Molluscum contagiosum virus
acgacaagcguaagccaccgcgc

SEQ ID NO: 4031512 - RNA, 18 nt, Molluscum contagiosum virus
acgacaaggaaaggcacc

SEQ ID NO: 4031513 - RNA, 20 nt, Molluscum contagiosum virus
acgacacagcccuggacgac

SEQ ID NO: 4031514 - RNA, 14 nt, Molluscum contagiosum virus
acgacaugcacacg

SEQ ID NO: 4031515 - RNA, 15 nt, Molluscum contagiosum virus
acgaccacgugcagg

SEQ ID NO: 4031516 - RNA, 23 nt, Molluscum contagiosum virus
acgacugcuuugacacgcucauc

SEQ ID NO: 4031517 - RNA, 16 nt, Molluscum contagiosum virus
acgagaaaugcgcaca

SEQ ID NO: 4031518 - RNA, 12 nt, Molluscum contagiosum virus
acgagagggcgc

SEQ ID NO: 4031519 - RNA, 19 nt, Molluscum contagiosum virus
acgagaugggcccgcgcgc

SEQ ID NO: 4031520 - RNA, 19 nt, Molluscum contagiosum virus
acgagcagcgcuugcgcgc

SEQ ID NO: 4031521 - RNA, 13 nt, Molluscum contagiosum virus
acgagcagcugcu

SEQ ID NO: 4031522 - RNA, 16 nt, Molluscum contagiosum virus
acgagcagcugcugcg

SEQ ID NO: 4031523 - RNA, 16 nt, Molluscum contagiosum virus
acgagcgcgugccgcu

SEQ ID NO: 4031524 - RNA, 13 nt, Molluscum contagiosum virus
acgagcugcugcc

SEQ ID NO: 4031525 - RNA, 16 nt, Molluscum contagiosum virus
acgagcugcugcgcgc

SEQ ID NO: 4031526 - RNA, 20 nt, Molluscum contagiosum virus
acgagcugcugcgcgccgcc

SEQ ID NO: 4031527 - RNA, 14 nt, Molluscum contagiosum virus
acgagcugugcgag

SEQ ID NO: 4031528 - RNA, 13 nt, Molluscum contagiosum virus
acgaggagccccg

SEQ ID NO: 4031529 - RNA, 14 nt, Molluscum contagiosum virus
acgaggccuacagc

SEQ ID NO: 4031530 - RNA, 23 nt, Molluscum contagiosum virus
acgaggccuacgugcugcgcacg

SEQ ID NO: 4031531 - RNA, 14 nt, Molluscum contagiosum virus
acgaggugcugcgc

SEQ ID NO: 4031532 - RNA, 23 nt, Molluscum contagiosum virus
acgaguucugcaucuucugccag

SEQ ID NO: 4031533 - RNA, 23 nt, Molluscum contagiosum virus
acgaucuucuucuugcgcaccuc

SEQ ID NO: 4031534 - RNA, 22 nt, Molluscum contagiosum virus
acgaugcaaacauguagcgcgc

SEQ ID NO: 4031535 - RNA, 14 nt, Molluscum contagiosum virus
acgcaaaugcgcgc

SEQ ID NO: 4031536 - RNA, 21 nt, Molluscum contagiosum virus
acgcaaccuacuugcucgugu

SEQ ID NO: 4031537 - RNA, 15 nt, Molluscum contagiosum virus
acgcaagcguacgcg

SEQ ID NO: 4031538 - RNA, 21 nt, Molluscum contagiosum virus
acgcacagccccugcugcucg

SEQ ID NO: 4031539 - RNA, 18 nt, Molluscum contagiosum virus
acgcacagggcugcgugg

SEQ ID NO: 4031540 - RNA, 22 nt, Molluscum contagiosum virus
acgcagaccacggcgcgccgcc

SEQ ID NO: 4031541 - RNA, 16 nt, Molluscum contagiosum virus
acgccagguguuccug

SEQ ID NO: 4031542 - RNA, 22 nt, Molluscum contagiosum virus
acgcccgagggcgggcacgugc

SEQ ID NO: 4031543 - RNA, 14 nt, Molluscum contagiosum virus
acgccgagcccgag

SEQ ID NO: 4031544 - RNA, 17 nt, Molluscum contagiosum virus
acgccgccagcgacgag

SEQ ID NO: 4031545 - RNA, 16 nt, Molluscum contagiosum virus
acgccguccgcgcagc

SEQ ID NO: 4031546 - RNA, 15 nt, Molluscum contagiosum virus
acgccguguaccgcc

SEQ ID NO: 4031547 - RNA, 14 nt, Molluscum contagiosum virus
acgccuagccugca

SEQ ID NO: 4031548 - RNA, 16 nt, Molluscum contagiosum virus
acgccuagccugcagu

SEQ ID NO: 4031549 - RNA, 18 nt, Molluscum contagiosum virus
acgccuccaagaagaggc

SEQ ID NO: 4031550 - RNA, 16 nt, Molluscum contagiosum virus
acgccuucguggagcc

SEQ ID NO: 4031551 - RNA, 15 nt, Molluscum contagiosum virus
acgcgaaacuggacu

SEQ ID NO: 4031552 - RNA, 20 nt, Molluscum contagiosum virus
acgcgaaacuggacugagcc

SEQ ID NO: 4031553 - RNA, 23 nt, Molluscum contagiosum virus
acgcgaaguuccugcauuucaug

SEQ ID NO: 4031554 - RNA, 23 nt, Molluscum contagiosum virus
acgcgaccuucacucgcucgcgc

SEQ ID NO: 4031555 - RNA, 22 nt, Molluscum contagiosum virus
acgcgacgcgcguggagcgcgc

SEQ ID NO: 4031556 - RNA, 18 nt, Molluscum contagiosum virus
acgcgacggugugccgcu

SEQ ID NO: 4031557 - RNA, 21 nt, Molluscum contagiosum virus
acgcgcaaggccgcgcccaag

SEQ ID NO: 4031558 - RNA, 24 nt, Molluscum contagiosum virus
acgcgcaagugugcgcaucccucg

SEQ ID NO: 4031559 - RNA, 13 nt, Molluscum contagiosum virus
acgcgcacacgcu

SEQ ID NO: 4031560 - RNA, 18 nt, Molluscum contagiosum virus
acgcgcacuugccuggcg

SEQ ID NO: 4031561 - RNA, 12 nt, Molluscum contagiosum virus
acgcgcagcugu

SEQ ID NO: 4031562 - RNA, 15 nt, Molluscum contagiosum virus
acgcgcccuggagcg

SEQ ID NO: 4031563 - RNA, 19 nt, Molluscum contagiosum virus
acgcgccucgagcagguca

SEQ ID NO: 4031564 - RNA, 14 nt, Molluscum contagiosum virus
acgcgcgugguaca

SEQ ID NO: 4031565 - RNA, 21 nt, Molluscum contagiosum virus
acgcgcuaccgcaagcucaug

SEQ ID NO: 4031566 - RNA, 18 nt, Molluscum contagiosum virus
acgcgcugcuagagaacc

SEQ ID NO: 4031567 - RNA, 18 nt, Molluscum contagiosum virus
acgcgcuugcgcggaaga

SEQ ID NO: 4031568 - RNA, 15 nt, Molluscum contagiosum virus
acgcggacgcgcagc

SEQ ID NO: 4031569 - RNA, 23 nt, Molluscum contagiosum virus
acgcggaggucgagcgcgccgcg

SEQ ID NO: 4031570 - RNA, 17 nt, Molluscum contagiosum virus
acgcggaugccacgcag

SEQ ID NO: 4031571 - RNA, 22 nt, Molluscum contagiosum virus
acgcggcguacaucgacuacgc

SEQ ID NO: 4031572 - RNA, 14 nt, Molluscum contagiosum virus
acgcggugcgcgcg

SEQ ID NO: 4031573 - RNA, 23 nt, Molluscum contagiosum virus
acgcgugcugcgcggcgccgcag

SEQ ID NO: 4031574 - RNA, 17 nt, Molluscum contagiosum virus
acgcuacagcagccgca

SEQ ID NO: 4031575 - RNA, 23 nt, Molluscum contagiosum virus
acgcucaucucgcagacgcagcg

SEQ ID NO: 4031576 - RNA, 19 nt, Molluscum contagiosum virus
acgcucgcgacgugcgcgc

SEQ ID NO: 4031577 - RNA, 17 nt, Molluscum contagiosum virus
acgcucggcugccgugc

SEQ ID NO: 4031578 - RNA, 23 nt, Molluscum contagiosum virus
acgcugcagcuaggauccugcuc

SEQ ID NO: 4031579 - RNA, 16 nt, Molluscum contagiosum virus
acgcugcgcgugcugg

SEQ ID NO: 4031580 - RNA, 20 nt, Molluscum contagiosum virus
acgcugcgcgugcugggccc

SEQ ID NO: 4031581 - RNA, 20 nt, Molluscum contagiosum virus
acgcugcucgugcugcucug

SEQ ID NO: 4031582 - RNA, 17 nt, Molluscum contagiosum virus
acgcuggucacgcgcuu

SEQ ID NO: 4031583 - RNA, 18 nt, Molluscum contagiosum virus
acgcuucgcauugaccuc

SEQ ID NO: 4031584 - RNA, 19 nt, Molluscum contagiosum virus
acgcuuguccgcggacgcg

SEQ ID NO: 4031585 - RNA, 16 nt, Molluscum contagiosum virus
acggacaugagcuugc

SEQ ID NO: 4031586 - RNA, 12 nt, Molluscum contagiosum virus
acggacccgcga

SEQ ID NO: 4031587 - RNA, 15 nt, Molluscum contagiosum virus
acggacccgcgaacg

SEQ ID NO: 4031588 - RNA, 21 nt, Molluscum contagiosum virus
acggacuuuucgcgcgugcgc

SEQ ID NO: 4031589 - RNA, 20 nt, Molluscum contagiosum virus
acggcaaacgccacuggguc

SEQ ID NO: 4031590 - RNA, 22 nt, Molluscum contagiosum virus
acggcaaguuccuggugugcca

SEQ ID NO: 4031591 - RNA, 15 nt, Molluscum contagiosum virus
acggcacgcugagca

SEQ ID NO: 4031592 - RNA, 17 nt, Molluscum contagiosum virus
acggcccgggugcgcgc

SEQ ID NO: 4031593 - RNA, 19 nt, Molluscum contagiosum virus
acggcccgggugcgcgcgc

SEQ ID NO: 4031594 - RNA, 13 nt, Molluscum contagiosum virus
acggccgucuccu

SEQ ID NO: 4031595 - RNA, 23 nt, Molluscum contagiosum virus
acggccuucuccucgcucugcuc

SEQ ID NO: 4031596 - RNA, 14 nt, Molluscum contagiosum virus
acggcgacgacagc

SEQ ID NO: 4031597 - RNA, 20 nt, Molluscum contagiosum virus
acggcgacuuguagugcccg

SEQ ID NO: 4031598 - RNA, 15 nt, Molluscum contagiosum virus
acggcgagcgccgcu

SEQ ID NO: 4031599 - RNA, 13 nt, Molluscum contagiosum virus
acggcgagcgcgc

SEQ ID NO: 4031600 - RNA, 21 nt, Molluscum contagiosum virus
acggcgccuucgucgcgcgcu

SEQ ID NO: 4031601 - RNA, 14 nt, Molluscum contagiosum virus
acggcgcgcaccua

SEQ ID NO: 4031602 - RNA, 13 nt, Molluscum contagiosum virus
acggcgcgcagcg

SEQ ID NO: 4031603 - RNA, 14 nt, Molluscum contagiosum virus
acggcgcucgccuc

SEQ ID NO: 4031604 - RNA, 20 nt, Molluscum contagiosum virus
acggcgcucgccucugggcg

SEQ ID NO: 4031605 - RNA, 19 nt, Molluscum contagiosum virus
acggcggcacccgccgcgg

SEQ ID NO: 4031606 - RNA, 17 nt, Molluscum contagiosum virus
acggcuaggcgcggcgg

SEQ ID NO: 4031607 - RNA, 19 nt, Molluscum contagiosum virus
acggcugccggcccccgga

SEQ ID NO: 4031608 - RNA, 16 nt, Molluscum contagiosum virus
acggcuguaaugugcu

SEQ ID NO: 4031609 - RNA, 14 nt, Molluscum contagiosum virus
acgggaacgagguc

SEQ ID NO: 4031610 - RNA, 20 nt, Molluscum contagiosum virus
acgggaagcugcacgugcag

SEQ ID NO: 4031611 - RNA, 15 nt, Molluscum contagiosum virus
acgggcacgagcacg

SEQ ID NO: 4031612 - RNA, 15 nt, Molluscum contagiosum virus
agcggcaagccgugc

SEQ ID NO: 4031613 - RNA, 21 nt, Molluscum contagiosum virus
agcggccacucucccgggcuc

SEQ ID NO: 4031614 - RNA, 14 nt, Molluscum contagiosum virus
agcggcgacuugcu

SEQ ID NO: 4031615 - RNA, 22 nt, Molluscum contagiosum virus
agcggcugcccgcggagaccac

SEQ ID NO: 4031616 - RNA, 14 nt, Molluscum contagiosum virus
agcgggaaacugcu

SEQ ID NO: 4031617 - RNA, 21 nt, Molluscum contagiosum virus
agcguacggcccgaaggccac

SEQ ID NO: 4031618 - RNA, 18 nt, Molluscum contagiosum virus
agcguccggcaugcgcgc

SEQ ID NO: 4031619 - RNA, 17 nt, Molluscum contagiosum virus
agcgucgaacuucuccu

SEQ ID NO: 4031620 - RNA, 14 nt, Molluscum contagiosum virus
agcgugcagacgac

SEQ ID NO: 4031621 - RNA, 16 nt, Molluscum contagiosum virus
agcgugcccuucuccg

SEQ ID NO: 4031622 - RNA, 22 nt, Molluscum contagiosum virus
agcgugcccuucuccgaggaaa

SEQ ID NO: 4031623 - RNA, 18 nt, Molluscum contagiosum virus
agcgugcgcgggcacgcc

SEQ ID NO: 4031624 - RNA, 20 nt, Molluscum contagiosum virus
agcguggcgcgcgagcugcu

SEQ ID NO: 4031625 - RNA, 19 nt, Molluscum contagiosum virus
agcguugucuugaugcugu

SEQ ID NO: 4031626 - RNA, 18 nt, Molluscum contagiosum virus
agcuaaaagagcugcugc

SEQ ID NO: 4031627 - RNA, 14 nt, Molluscum contagiosum virus
agcuagugcacacc

SEQ ID NO: 4031628 - RNA, 16 nt, Molluscum contagiosum virus
agcucaagacgcugcu

SEQ ID NO: 4031629 - RNA, 16 nt, Molluscum contagiosum virus
agcucacggcugugga

SEQ ID NO: 4031630 - RNA, 12 nt, Molluscum contagiosum virus
agcucagcaggc

SEQ ID NO: 4031631 - RNA, 16 nt, Molluscum contagiosum virus
agcucauagcccaugc

SEQ ID NO: 4031632 - RNA, 19 nt, Molluscum contagiosum virus
agcuccgcgacuaccugcu

SEQ ID NO: 4031633 - RNA, 14 nt, Molluscum contagiosum virus
agcucgcgcgcgag

SEQ ID NO: 4031634 - RNA, 21 nt, Molluscum contagiosum virus
agcucgguuggcggcgccgcg

SEQ ID NO: 4031635 - RNA, 19 nt, Molluscum contagiosum virus
agcucguggacagccugca

SEQ ID NO: 4031636 - RNA, 15 nt, Molluscum contagiosum virus
agcucucgcgcgcag

SEQ ID NO: 4031637 - RNA, 21 nt, Molluscum contagiosum virus
agcucugauuacauccugccc

SEQ ID NO: 4031638 - RNA, 22 nt, Molluscum contagiosum virus
agcucugauuacauccugcccu

SEQ ID NO: 4031639 - RNA, 17 nt, Molluscum contagiosum virus
agcugcaccggcgcgag

SEQ ID NO: 4031640 - RNA, 15 nt, Molluscum contagiosum virus
agcugcacgugcagc

SEQ ID NO: 4031641 - RNA, 19 nt, Molluscum contagiosum virus
agcugccauggcagcucgg

SEQ ID NO: 4031642 - RNA, 21 nt, Molluscum contagiosum virus
agcugcccuuuagcguggcgc

SEQ ID NO: 4031643 - RNA, 14 nt, Molluscum contagiosum virus
agcugcugcgcucc

SEQ ID NO: 4031644 - RNA, 14 nt, Molluscum contagiosum virus
agcugcugcggcuc

SEQ ID NO: 4031645 - RNA, 21 nt, Molluscum contagiosum virus
agcuggacggugcuggugcug

SEQ ID NO: 4031646 - RNA, 13 nt, Molluscum contagiosum virus
agcuggagcugcc

SEQ ID NO: 4031647 - RNA, 16 nt, Molluscum contagiosum virus
agcuggcguugccgag

SEQ ID NO: 4031648 - RNA, 17 nt, Molluscum contagiosum virus
agcuguaccuggugcgc

SEQ ID NO: 4031649 - RNA, 16 nt, Molluscum contagiosum virus
agcuguccgagccgga

SEQ ID NO: 4031650 - RNA, 13 nt, Molluscum contagiosum virus
agcugugccaucu

SEQ ID NO: 4031651 - RNA, 17 nt, Molluscum contagiosum virus
agcuuacuagacuggcu

SEQ ID NO: 4031652 - RNA, 19 nt, Molluscum contagiosum virus
agcuuccucaaggcgcacg

SEQ ID NO: 4031653 - RNA, 15 nt, Molluscum contagiosum virus
agcuucggacgagcu

SEQ ID NO: 4031654 - RNA, 15 nt, Molluscum contagiosum virus
agcuucucgccagaa

SEQ ID NO: 4031655 - RNA, 16 nt, Molluscum contagiosum virus
aggaaaggcaccccga

SEQ ID NO: 4031656 - RNA, 15 nt, Molluscum contagiosum virus
aggaaaggcacccgc

SEQ ID NO: 4031657 - RNA, 21 nt, Molluscum contagiosum virus
aggaaaggcacccgcaacaag

SEQ ID NO: 4031658 - RNA, 13 nt, Molluscum contagiosum virus
aggaacgaaaguc

SEQ ID NO: 4031659 - RNA, 23 nt, Molluscum contagiosum virus
aggaacgaggaaaggcacacccc

SEQ ID NO: 4031660 - RNA, 15 nt, Molluscum contagiosum virus
aggaacugcccgcgu

SEQ ID NO: 4031661 - RNA, 17 nt, Molluscum contagiosum virus
aggaagcaggucuuggg

SEQ ID NO: 4031662 - RNA, 21 nt, Molluscum contagiosum virus
aggaccucgcgcgccgccgca

SEQ ID NO: 4031663 - RNA, 13 nt, Molluscum contagiosum virus
aggacgagcugcu

SEQ ID NO: 4031664 - RNA, 22 nt, Molluscum contagiosum virus
aggacgccggcaagccgagcca

SEQ ID NO: 4031665 - RNA, 14 nt, Molluscum contagiosum virus
aggacgcgcggagc

SEQ ID NO: 4031666 - RNA, 17 nt, Molluscum contagiosum virus
aggagacguagagcagc

SEQ ID NO: 4031667 - RNA, 15 nt, Molluscum contagiosum virus
aggagagagagacau

SEQ ID NO: 4031668 - RNA, 14 nt, Molluscum contagiosum virus
aggagccgcccgcg

SEQ ID NO: 4031669 - RNA, 21 nt, Molluscum contagiosum virus
aggagccucuguccugcgugc

SEQ ID NO: 4031670 - RNA, 12 nt, Molluscum contagiosum virus
aggagcuguccg

SEQ ID NO: 4031671 - RNA, 19 nt, Molluscum contagiosum virus
aggagcuguccgagccgga

SEQ ID NO: 4031672 - RNA, 18 nt, Molluscum contagiosum virus
aggaggccaacgccagcu

SEQ ID NO: 4031673 - RNA, 15 nt, Molluscum contagiosum virus
aggagggagagcugc

SEQ ID NO: 4031674 - RNA, 17 nt, Molluscum contagiosum virus
aggaucacggcucugcg

SEQ ID NO: 4031675 - RNA, 19 nt, Molluscum contagiosum virus
aggaucggagcgcagcugc

SEQ ID NO: 4031676 - RNA, 14 nt, Molluscum contagiosum virus
aggaugcuggggcu

SEQ ID NO: 4031677 - RNA, 20 nt, Molluscum contagiosum virus
aggcaaaagccgccgcgcgc

SEQ ID NO: 4031678 - RNA, 20 nt, Molluscum contagiosum virus
aggcaaagcggggcgcgcgc

SEQ ID NO: 4031679 - RNA, 13 nt, Molluscum contagiosum virus
aggcaaaguucuc

SEQ ID NO: 4031680 - RNA, 13 nt, Molluscum contagiosum virus
aggcaagcgggcu

SEQ ID NO: 4031681 - RNA, 22 nt, Molluscum contagiosum virus
aggcacaccccuguaacaagga

SEQ ID NO: 4031682 - RNA, 12 nt, Molluscum contagiosum virus
aggcacccgcaa

SEQ ID NO: 4031683 - RNA, 20 nt, Molluscum contagiosum virus
aggcaccugcggcucgcacu

SEQ ID NO: 4031684 - RNA, 14 nt, Molluscum contagiosum virus
aggcagcugcugcg

SEQ ID NO: 4031685 - RNA, 15 nt, Molluscum contagiosum virus
aggccaccucgcacg

SEQ ID NO: 4031686 - RNA, 22 nt, Molluscum contagiosum virus
aggcccacuuccgugagcaguc

SEQ ID NO: 4031687 - RNA, 18 nt, Molluscum contagiosum virus
aggccccgcaccagugcc

SEQ ID NO: 4031688 - RNA, 14 nt, Molluscum contagiosum virus
aggccgagaugagc

SEQ ID NO: 4031689 - RNA, 19 nt, Molluscum contagiosum virus
aggccggucgcggaagacg

SEQ ID NO: 4031690 - RNA, 16 nt, Molluscum contagiosum virus
aggccucagccgagcg

SEQ ID NO: 4031691 - RNA, 23 nt, Molluscum contagiosum virus
aggccucagccgagcgccgccag

SEQ ID NO: 4031692 - RNA, 23 nt, Molluscum contagiosum virus
aggcgcaccuugacgccgcgcgc

SEQ ID NO: 4031693 - RNA, 24 nt, Molluscum contagiosum virus
aggcgcugguggaggagccgugga

SEQ ID NO: 4031694 - RNA, 11 nt, Molluscum contagiosum virus
aggcggcuccu

SEQ ID NO: 4031695 - RNA, 17 nt, Molluscum contagiosum virus
aggcggugggcgccgcg

SEQ ID NO: 4031696 - RNA, 17 nt, Molluscum contagiosum virus
aggcguaugcgccaagc

SEQ ID NO: 4031697 - RNA, 15 nt, Molluscum contagiosum virus
aggcucgagcugcau

SEQ ID NO: 4031698 - RNA, 18 nt, Molluscum contagiosum virus
aggcucgagcugcaucuu

SEQ ID NO: 4031699 - RNA, 19 nt, Molluscum contagiosum virus
aggcucgucguggacgcuc

SEQ ID NO: 4031700 - RNA, 14 nt, Molluscum contagiosum virus
aggcugcucccucu

SEQ ID NO: 4031701 - RNA, 13 nt, Molluscum contagiosum virus
aggcugcugccgc

SEQ ID NO: 4031702 - RNA, 14 nt, Molluscum contagiosum virus
agggaggcucgagc

SEQ ID NO: 4031703 - RNA, 22 nt, Molluscum contagiosum virus
agggaggcucgagcgcgcgccu

SEQ ID NO: 4031704 - RNA, 17 nt, Molluscum contagiosum virus
agggcagcucaagcugc

SEQ ID NO: 4031705 - RNA, 18 nt, Molluscum contagiosum virus
agggccugcgggcggcac

SEQ ID NO: 4031706 - RNA, 22 nt, Molluscum contagiosum virus
agggccugcgggcggcacacac

SEQ ID NO: 4031707 - RNA, 19 nt, Molluscum contagiosum virus
agggcgaccggagagggga

SEQ ID NO: 4031708 - RNA, 13 nt, Molluscum contagiosum virus
agggcgagucucc

SEQ ID NO: 4031709 - RNA, 19 nt, Molluscum contagiosum virus
agggcgcgcgucgagggcg

SEQ ID NO: 4031710 - RNA, 15 nt, Molluscum contagiosum virus
agggcgggcacgugc

SEQ ID NO: 4031711 - RNA, 21 nt, Molluscum contagiosum virus
agggcuccuucuucagcaggc

SEQ ID NO: 4031712 - RNA, 20 nt, Molluscum contagiosum virus
agggcuuccccccacggcag

SEQ ID NO: 4031713 - RNA, 19 nt, Molluscum contagiosum virus
aggggugauggcggugagc

SEQ ID NO: 4031714 - RNA, 22 nt, Molluscum contagiosum virus
agggguguuuccuugccuucuc

SEQ ID NO: 4031715 - RNA, 16 nt, Molluscum contagiosum virus
cgagggaugcgcacac

SEQ ID NO: 4031716 - RNA, 20 nt, Molluscum contagiosum virus
cgagggcgcgaccggcgugc

SEQ ID NO: 4031717 - RNA, 17 nt, Molluscum contagiosum virus
cgagggcgggcacgugc

SEQ ID NO: 4031718 - RNA, 16 nt, Molluscum contagiosum virus
cgagggcucguccucu

SEQ ID NO: 4031719 - RNA, 14 nt, Molluscum contagiosum virus
cgaggucgcgucca

SEQ ID NO: 4031720 - RNA, 19 nt, Molluscum contagiosum virus
cgaggugcgcgcaacacug

SEQ ID NO: 4031721 - RNA, 23 nt, Molluscum contagiosum virus
cgaggugcugcgccacgugcgca

SEQ ID NO: 4031722 - RNA, 20 nt, Molluscum contagiosum virus
cgagguggcacccuggcugc

SEQ ID NO: 4031723 - RNA, 12 nt, Molluscum contagiosum virus
cgaguaccgcgc

SEQ ID NO: 4031724 - RNA, 18 nt, Molluscum contagiosum virus
cgaguacugcugcggcuc

SEQ ID NO: 4031725 - RNA, 20 nt, Molluscum contagiosum virus
cgaguauacucgacgcgcgc

SEQ ID NO: 4031726 - RNA, 14 nt, Molluscum contagiosum virus
cgagucgcgccgag

SEQ ID NO: 4031727 - RNA, 18 nt, Molluscum contagiosum virus
cgagucguacacgcagag

SEQ ID NO: 4031728 - RNA, 12 nt, Molluscum contagiosum virus
cgagugcgcgug

SEQ ID NO: 4031729 - RNA, 15 nt, Molluscum contagiosum virus
cgagugcuggagcag

SEQ ID NO: 4031730 - RNA, 14 nt, Molluscum contagiosum virus
cgagugugugcauc

SEQ ID NO: 4031731 - RNA, 14 nt, Molluscum contagiosum virus
cgaguucacggcga

SEQ ID NO: 4031732 - RNA, 19 nt, Molluscum contagiosum virus
cgaguucugccggcucagc

SEQ ID NO: 4031733 - RNA, 17 nt, Molluscum contagiosum virus
cgaguugcgucucccgc

SEQ ID NO: 4031734 - RNA, 17 nt, Molluscum contagiosum virus
cgauaacaucugcuaua

SEQ ID NO: 4031735 - RNA, 18 nt, Molluscum contagiosum virus
cgauacaaaacaugcugu

SEQ ID NO: 4031736 - RNA, 20 nt, Molluscum contagiosum virus
cgauacaaaacaugcuguau

SEQ ID NO: 4031737 - RNA, 15 nt, Molluscum contagiosum virus
cgauaucgaucacgc

SEQ ID NO: 4031738 - RNA, 14 nt, Molluscum contagiosum virus
cgaucaagacauuu

SEQ ID NO: 4031739 - RNA, 19 nt, Molluscum contagiosum virus
cgaucuuccgcgacgagcu

SEQ ID NO: 4031740 - RNA, 18 nt, Molluscum contagiosum virus
cgaugagcgucucggugc

SEQ ID NO: 4031741 - RNA, 23 nt, Molluscum contagiosum virus
cgauggaaggcgaccagcugguc

SEQ ID NO: 4031742 - RNA, 20 nt, Molluscum contagiosum virus
cgaugguggcgcugcugccc

SEQ ID NO: 4031743 - RNA, 17 nt, Molluscum contagiosum virus
cgaugugacaacaugug

SEQ ID NO: 4031744 - RNA, 20 nt, Molluscum contagiosum virus
cgcaaaaggcacgaggcagc

SEQ ID NO: 4031745 - RNA, 18 nt, Molluscum contagiosum virus
cgcaaagucaucugccuc

SEQ ID NO: 4031746 - RNA, 13 nt, Molluscum contagiosum virus
cgcaaaucuguuc

SEQ ID NO: 4031747 - RNA, 23 nt, Molluscum contagiosum virus
cgcaacaaaagagcgcgccucuc

SEQ ID NO: 4031748 - RNA, 15 nt, Molluscum contagiosum virus
cgcaacacugcagaa

SEQ ID NO: 4031749 - RNA, 15 nt, Molluscum contagiosum virus
cgcaacauguccgca

SEQ ID NO: 4031750 - RNA, 14 nt, Molluscum contagiosum virus
cgcaagagccgccg

SEQ ID NO: 4031751 - RNA, 18 nt, Molluscum contagiosum virus
cgcaagcaccggcagcgc

SEQ ID NO: 4031752 - RNA, 12 nt, Molluscum contagiosum virus
cgcaagccagag

SEQ ID NO: 4031753 - RNA, 14 nt, Molluscum contagiosum virus
cgcaagcgcugcuc

SEQ ID NO: 4031754 - RNA, 19 nt, Molluscum contagiosum virus
cgcaagcgcugcucguaga

SEQ ID NO: 4031755 - RNA, 13 nt, Molluscum contagiosum virus
cgcaagcgugugu

SEQ ID NO: 4031756 - RNA, 18 nt, Molluscum contagiosum virus
cgcaaggaaaacugcauc

SEQ ID NO: 4031757 - RNA, 16 nt, Molluscum contagiosum virus
cgcaaggccgcgccca

SEQ ID NO: 4031758 - RNA, 20 nt, Molluscum contagiosum virus
cgcaaggugugcgcgcugca

SEQ ID NO: 4031759 - RNA, 14 nt, Molluscum contagiosum virus
cgcacaaccacagc

SEQ ID NO: 4031760 - RNA, 20 nt, Molluscum contagiosum virus
cgcacacgaaucgcucgcgg

SEQ ID NO: 4031761 - RNA, 21 nt, Molluscum contagiosum virus
cgcacacgcgucgggaagugu

SEQ ID NO: 4031762 - RNA, 16 nt, Molluscum contagiosum virus
cgcacacuugcgcguc

SEQ ID NO: 4031763 - RNA, 18 nt, Molluscum contagiosum virus
cgcacacuugcgcguccg

SEQ ID NO: 4031764 - RNA, 21 nt, Molluscum contagiosum virus
cgcacagacauggcccgcgcg

SEQ ID NO: 4031765 - RNA, 21 nt, Molluscum contagiosum virus
cgcacagucuccacgcgugcg

SEQ ID NO: 4031766 - RNA, 14 nt, Molluscum contagiosum virus
cgcaccagcugcaa

SEQ ID NO: 4031767 - RNA, 15 nt, Molluscum contagiosum virus
cgcaccagcugcaaa

SEQ ID NO: 4031768 - RNA, 13 nt, Molluscum contagiosum virus
cgcacccgcgccg

SEQ ID NO: 4031769 - RNA, 15 nt, Molluscum contagiosum virus
cgcaccuccuucgcg

SEQ ID NO: 4031770 - RNA, 20 nt, Molluscum contagiosum virus
cgcacgaagacuacggcacu

SEQ ID NO: 4031771 - RNA, 23 nt, Molluscum contagiosum virus
cgcacgagcugcugcccgccuuc

SEQ ID NO: 4031772 - RNA, 13 nt, Molluscum contagiosum virus
cgcacgaggagcc

SEQ ID NO: 4031773 - RNA, 15 nt, Molluscum contagiosum virus
cgcacgaggagcccc

SEQ ID NO: 4031774 - RNA, 14 nt, Molluscum contagiosum virus
cgcacgcagcaggc

SEQ ID NO: 4031775 - RNA, 22 nt, Molluscum contagiosum virus
cgcacgcagcaggcacgacgcc

SEQ ID NO: 4031776 - RNA, 16 nt, Molluscum contagiosum virus
cgcacgcucucgcugg

SEQ ID NO: 4031777 - RNA, 14 nt, Molluscum contagiosum virus
cgcacggaccucaa

SEQ ID NO: 4031778 - RNA, 15 nt, Molluscum contagiosum virus
cgcacggcagcggcg

SEQ ID NO: 4031779 - RNA, 19 nt, Molluscum contagiosum virus
cgcacggcuaggcgcggcg

SEQ ID NO: 4031780 - RNA, 24 nt, Molluscum contagiosum virus
cgcacggugugcuacugcacugca

SEQ ID NO: 4031781 - RNA, 21 nt, Molluscum contagiosum virus
cgcacgucuucgccgugugcg

SEQ ID NO: 4031782 - RNA, 15 nt, Molluscum contagiosum virus
cgcacgugcgcgccg

SEQ ID NO: 4031783 - RNA, 13 nt, Molluscum contagiosum virus
cgcacgugcugcg

SEQ ID NO: 4031784 - RNA, 16 nt, Molluscum contagiosum virus
cgcacucgcuggccuc

SEQ ID NO: 4031785 - RNA, 15 nt, Molluscum contagiosum virus
cgcacuucacggcgu

SEQ ID NO: 4031786 - RNA, 20 nt, Molluscum contagiosum virus
cgcagaaguggcgcugugcg

SEQ ID NO: 4031787 - RNA, 22 nt, Molluscum contagiosum virus
cgcagaggcgcguccgcggccg

SEQ ID NO: 4031788 - RNA, 17 nt, Molluscum contagiosum virus
cgcagcccacgugccag

SEQ ID NO: 4031789 - RNA, 15 nt, Molluscum contagiosum virus
cgcagcccgagcgcg

SEQ ID NO: 4031790 - RNA, 21 nt, Molluscum contagiosum virus
cgcagcccgagcgcgcgugcg

SEQ ID NO: 4031791 - RNA, 13 nt, Molluscum contagiosum virus
cgcagcgcccgcg

SEQ ID NO: 4031792 - RNA, 16 nt, Molluscum contagiosum virus
cgcagcgcgagcugug

SEQ ID NO: 4031793 - RNA, 18 nt, Molluscum contagiosum virus
cgcagcgcgagcugugca

SEQ ID NO: 4031794 - RNA, 17 nt, Molluscum contagiosum virus
cgcagcguccggcaugc

SEQ ID NO: 4031795 - RNA, 16 nt, Molluscum contagiosum virus
cgcagcugccggggcc

SEQ ID NO: 4031796 - RNA, 15 nt, Molluscum contagiosum virus
cgcagcugcgccugc

SEQ ID NO: 4031797 - RNA, 19 nt, Molluscum contagiosum virus
cgcaggaaaggucgggccc

SEQ ID NO: 4031798 - RNA, 14 nt, Molluscum contagiosum virus
cgcaggaccgcgac

SEQ ID NO: 4031799 - RNA, 21 nt, Molluscum contagiosum virus
cgcaggacgcggucgcgcccu

SEQ ID NO: 4031800 - RNA, 18 nt, Molluscum contagiosum virus
cgcaggacuggcaccugc

SEQ ID NO: 4031801 - RNA, 13 nt, Molluscum contagiosum virus
cgcaggccaggug

SEQ ID NO: 4031802 - RNA, 22 nt, Molluscum contagiosum virus
cgcaguaccaguaccugcugcc

SEQ ID NO: 4031803 - RNA, 18 nt, Molluscum contagiosum virus
cgcaguacccgagcugug

SEQ ID NO: 4031804 - RNA, 14 nt, Molluscum contagiosum virus
cgcagucccagcac

SEQ ID NO: 4031805 - RNA, 16 nt, Molluscum contagiosum virus
cgcagucgcaguaccc

SEQ ID NO: 4031806 - RNA, 21 nt, Molluscum contagiosum virus
cgcaguucggcgacacgcccg

SEQ ID NO: 4031807 - RNA, 23 nt, Molluscum contagiosum virus
cgcaguugugcguacccuggcag

SEQ ID NO: 4031808 - RNA, 17 nt, Molluscum contagiosum virus
cgcaguuuuuuuccgca

SEQ ID NO: 4031809 - RNA, 21 nt, Molluscum contagiosum virus
cgcaucagagaagugcuccgc

SEQ ID NO: 4031810 - RNA, 17 nt, Molluscum contagiosum virus
cgcaucccccgcguugu

SEQ ID NO: 4031811 - RNA, 16 nt, Molluscum contagiosum virus
cgcaugcaccuacgcg

SEQ ID NO: 4031812 - RNA, 22 nt, Molluscum contagiosum virus
cgcauggggaacagcuuggcac

SEQ ID NO: 4031813 - RNA, 15 nt, Molluscum contagiosum virus
cgcauguccacggac

SEQ ID NO: 4031814 - RNA, 16 nt, Molluscum contagiosum virus
cgcauucgcgcgcccc

SEQ ID NO: 4031815 - RNA, 16 nt, Molluscum contagiosum virus
cgcauuggcagcgcuu

SEQ ID NO: 4031816 - RNA, 22 nt, Molluscum contagiosum virus
cgccaaccaccacguggaccug

SEQ ID NO: 4031817 - RNA, 20 nt, Molluscum contagiosum virus
cgccaacgcggacgcgcagc

SEQ ID NO: 4031818 - RNA, 18 nt, Molluscum contagiosum virus
cgccaagccugcucacgg

SEQ ID NO: 4031819 - RNA, 22 nt, Molluscum contagiosum virus
cgccaagccugcucacggcggc

SEQ ID NO: 4031820 - RNA, 15 nt, Molluscum contagiosum virus
cgccaauggagccgc

SEQ ID NO: 4031821 - RNA, 16 nt, Molluscum contagiosum virus
cgccaccggcagugcu

SEQ ID NO: 4031822 - RNA, 19 nt, Molluscum contagiosum virus
cgccacgaagaacgcggcg

SEQ ID NO: 4031823 - RNA, 16 nt, Molluscum contagiosum virus
cgccacgagcgccgcg

SEQ ID NO: 4031824 - RNA, 21 nt, Molluscum contagiosum virus
cgccacgagcgccgcgacgcc

SEQ ID NO: 4031825 - RNA, 18 nt, Molluscum contagiosum virus
cgccacugcggcaacgag

SEQ ID NO: 4031826 - RNA, 18 nt, Molluscum contagiosum virus
cgccagcaguccgccguc

SEQ ID NO: 4031827 - RNA, 15 nt, Molluscum contagiosum virus
cgccagcgacgcgac

SEQ ID NO: 4031828 - RNA, 18 nt, Molluscum contagiosum virus
cgccagcgucgcgcgccg

SEQ ID NO: 4031829 - RNA, 21 nt, Molluscum contagiosum virus
cgccagcuaagccggagcagc

SEQ ID NO: 4031830 - RNA, 17 nt, Molluscum contagiosum virus
cgccagcuguagcagga

SEQ ID NO: 4031831 - RNA, 18 nt, Molluscum contagiosum virus
cgccagguguuccugccg

SEQ ID NO: 4031832 - RNA, 20 nt, Molluscum contagiosum virus
cgccauccgcgagcuaauca

SEQ ID NO: 4031833 - RNA, 18 nt, Molluscum contagiosum virus
cgccauccggcacugcgu

SEQ ID NO: 4031834 - RNA, 13 nt, Molluscum contagiosum virus
cgcccacgugcca

SEQ ID NO: 4031835 - RNA, 19 nt, Molluscum contagiosum virus
cgcccgacuuuucgcgccg

SEQ ID NO: 4031836 - RNA, 13 nt, Molluscum contagiosum virus
cgcccgagcgcgu

SEQ ID NO: 4031837 - RNA, 21 nt, Molluscum contagiosum virus
cgcccgcaaugcagugcacca

SEQ ID NO: 4031838 - RNA, 13 nt, Molluscum contagiosum virus
cgcccgccgagua

SEQ ID NO: 4031839 - RNA, 15 nt, Molluscum contagiosum virus
cgcccgccgaguacc

SEQ ID NO: 4031840 - RNA, 14 nt, Molluscum contagiosum virus
cgcccgcggcgcac

SEQ ID NO: 4031841 - RNA, 20 nt, Molluscum contagiosum virus
cgcccguguucgcggagcug

SEQ ID NO: 4031842 - RNA, 22 nt, Molluscum contagiosum virus
cgcccucacgugcugaucacgc

SEQ ID NO: 4031843 - RNA, 21 nt, Molluscum contagiosum virus
cgccgaaacacggccuccagc

SEQ ID NO: 4031844 - RNA, 19 nt, Molluscum contagiosum virus
cgccgacaacgcacccgcg

SEQ ID NO: 4031845 - RNA, 22 nt, Molluscum contagiosum virus
cgccgacugccgccgccgcgag

SEQ ID NO: 4031846 - RNA, 20 nt, Molluscum contagiosum virus
cgccgacuuccgacgggccg

SEQ ID NO: 4031847 - RNA, 17 nt, Molluscum contagiosum virus
cgccgagcccgagcccg

SEQ ID NO: 4031848 - RNA, 23 nt, Molluscum contagiosum virus
cgccgaggacuaccuggcggcgc

SEQ ID NO: 4031849 - RNA, 22 nt, Molluscum contagiosum virus
cgccgcaccucaccgcgcacau

SEQ ID NO: 4031850 - RNA, 15 nt, Molluscum contagiosum virus
cgccgccagcuccgc

SEQ ID NO: 4031851 - RNA, 15 nt, Molluscum contagiosum virus
cgccgccaugcugcg

SEQ ID NO: 4031852 - RNA, 17 nt, Molluscum contagiosum virus
cgccgccaugcugcgcg

SEQ ID NO: 4031853 - RNA, 13 nt, Molluscum contagiosum virus
cgccgccucgcgc

SEQ ID NO: 4031854 - RNA, 14 nt, Molluscum contagiosum virus
cgccgcgcgccgcg

SEQ ID NO: 4031855 - RNA, 14 nt, Molluscum contagiosum virus
cgccgcgcgcgccg

SEQ ID NO: 4031856 - RNA, 15 nt, Molluscum contagiosum virus
cgccgcggccgcgag

SEQ ID NO: 4031857 - RNA, 21 nt, Molluscum contagiosum virus
cgccgcgggcgcagagccugc

SEQ ID NO: 4031858 - RNA, 16 nt, Molluscum contagiosum virus
cgccgcguacgcgccg

SEQ ID NO: 4031859 - RNA, 15 nt, Molluscum contagiosum virus
cgccgcgugcccguc

SEQ ID NO: 4031860 - RNA, 18 nt, Molluscum contagiosum virus
cgccgcucggaauuccuu

SEQ ID NO: 4031861 - RNA, 18 nt, Molluscum contagiosum virus
cgccgcugcccgcgcacg

SEQ ID NO: 4031862 - RNA, 17 nt, Molluscum contagiosum virus
cgccgcugcgcaucugc

SEQ ID NO: 4031863 - RNA, 12 nt, Molluscum contagiosum virus
cgccgcugcgcc

SEQ ID NO: 4031864 - RNA, 16 nt, Molluscum contagiosum virus
cgccggacagcucagc

SEQ ID NO: 4031865 - RNA, 19 nt, Molluscum contagiosum virus
cgccggcauccggccgagg

SEQ ID NO: 4031866 - RNA, 14 nt, Molluscum contagiosum virus
cgccggcgcgcgcg

SEQ ID NO: 4031867 - RNA, 18 nt, Molluscum contagiosum virus
cgccggcgcggcgagccg

SEQ ID NO: 4031868 - RNA, 14 nt, Molluscum contagiosum virus
cgccgggccccugu

SEQ ID NO: 4031869 - RNA, 19 nt, Molluscum contagiosum virus
cgccggugcgugcccagca

SEQ ID NO: 4031870 - RNA, 16 nt, Molluscum contagiosum virus
cgccguccgcgcagcc

SEQ ID NO: 4031871 - RNA, 22 nt, Molluscum contagiosum virus
cgccgugggcagcuucugcucg

SEQ ID NO: 4031872 - RNA, 15 nt, Molluscum contagiosum virus
cgccguuggccaccu

SEQ ID NO: 4031873 - RNA, 13 nt, Molluscum contagiosum virus
cgccuagcuccag

SEQ ID NO: 4031874 - RNA, 17 nt, Molluscum contagiosum virus
cgccucgcgcgcacugc

SEQ ID NO: 4031875 - RNA, 21 nt, Molluscum contagiosum virus
cgccucggacuucgacgcgcg

SEQ ID NO: 4031876 - RNA, 17 nt, Molluscum contagiosum virus
cgccucucgaggccggc

SEQ ID NO: 4031877 - RNA, 22 nt, Molluscum contagiosum virus
cgccucugggcgucgcacaguu

SEQ ID NO: 4031878 - RNA, 18 nt, Molluscum contagiosum virus
cgccugccgcgagcacug

SEQ ID NO: 4031879 - RNA, 15 nt, Molluscum contagiosum virus
cgccugcucucgcgc

SEQ ID NO: 4031880 - RNA, 21 nt, Molluscum contagiosum virus
cgccugcucucgcgcgccagc

SEQ ID NO: 4031881 - RNA, 12 nt, Molluscum contagiosum virus
cgccuggagcgc

SEQ ID NO: 4031882 - RNA, 14 nt, Molluscum contagiosum virus
cgccugugccugca

SEQ ID NO: 4031883 - RNA, 16 nt, Molluscum contagiosum virus
cgccugugccugcaag

SEQ ID NO: 4031884 - RNA, 13 nt, Molluscum contagiosum virus
cgccuucugccug

SEQ ID NO: 4031885 - RNA, 18 nt, Molluscum contagiosum virus
cgccuugcagcgcagcag

SEQ ID NO: 4031886 - RNA, 12 nt, Molluscum contagiosum virus
cgccuuuccccg

SEQ ID NO: 4031887 - RNA, 13 nt, Molluscum contagiosum virus
cgccuuugcgcug

SEQ ID NO: 4031888 - RNA, 21 nt, Molluscum contagiosum virus
cgcgaaaaccggaggcugcgc

SEQ ID NO: 4031889 - RNA, 22 nt, Molluscum contagiosum virus
cgcgaaagaggaaagcgcacac

SEQ ID NO: 4031890 - RNA, 19 nt, Molluscum contagiosum virus
cgcgaacgugcgaacacgg

SEQ ID NO: 4031891 - RNA, 23 nt, Molluscum contagiosum virus
cgcgaacuacuuccugcagcugu

SEQ ID NO: 4031892 - RNA, 16 nt, Molluscum contagiosum virus
cgcgaaguuccugcau

SEQ ID NO: 4031893 - RNA, 17 nt, Molluscum contagiosum virus
cgcgacaugccucgcgg

SEQ ID NO: 4031894 - RNA, 17 nt, Molluscum contagiosum virus
cgcgaccuacuccuggc

SEQ ID NO: 4031895 - RNA, 22 nt, Molluscum contagiosum virus
cgcgacgcaaaagaggccugcu

SEQ ID NO: 4031896 - RNA, 21 nt, Molluscum contagiosum virus
cgcgacgccguccgcgcagcc

SEQ ID NO: 4031897 - RNA, 17 nt, Molluscum contagiosum virus
cgcgacgcguccgccuc

SEQ ID NO: 4031898 - RNA, 17 nt, Molluscum contagiosum virus
cgcgacggugugccgcu

SEQ ID NO: 4031899 - RNA, 23 nt, Molluscum contagiosum virus
cgcgacggugugccgcugguggg

SEQ ID NO: 4031900 - RNA, 18 nt, Molluscum contagiosum virus
cgcgacguccuagagcag

SEQ ID NO: 4031901 - RNA, 17 nt, Molluscum contagiosum virus
cgcgagacgggcacgcg

SEQ ID NO: 4031902 - RNA, 23 nt, Molluscum contagiosum virus
cgcgagagcuacagcaugcgugc

SEQ ID NO: 4031903 - RNA, 13 nt, Molluscum contagiosum virus
cgcgagaugcgcg

SEQ ID NO: 4031904 - RNA, 19 nt, Molluscum contagiosum virus
cgcgagaugcgcggacaga

SEQ ID NO: 4031905 - RNA, 22 nt, Molluscum contagiosum virus
cgcgagcacccccgcugcacgc

SEQ ID NO: 4031906 - RNA, 12 nt, Molluscum contagiosum virus
cgcgagcagcug

SEQ ID NO: 4031907 - RNA, 22 nt, Molluscum contagiosum virus
cgcgagcaguucgcgcgccugc

SEQ ID NO: 4031908 - RNA, 14 nt, Molluscum contagiosum virus
cgcgagcaugccgc

SEQ ID NO: 4031909 - RNA, 23 nt, Molluscum contagiosum virus
cgcgagcgcaugcgcgccgcgcu

SEQ ID NO: 4031910 - RNA, 14 nt, Molluscum contagiosum virus
cgcgagcgcgcgcu

SEQ ID NO: 4031911 - RNA, 12 nt, Molluscum contagiosum virus
cgcgagcugcua

SEQ ID NO: 4031912 - RNA, 13 nt, Molluscum contagiosum virus
cgcgagcugcugc

SEQ ID NO: 4031913 - RNA, 20 nt, Molluscum contagiosum virus
cgcgaggcaugucgcggugc

SEQ ID NO: 4031914 - RNA, 17 nt, Molluscum contagiosum virus
cgcgagggcgcgcugga

SEQ ID NO: 4031915 - RNA, 18 nt, Molluscum contagiosum virus
cgcgagucgcgccgagga

SEQ ID NO: 4031916 - RNA, 12 nt, Molluscum contagiosum virus
cgcgagugugca

SEQ ID NO: 4031917 - RNA, 23 nt, Molluscum contagiosum virus
cgcgaguugcgucucccgcggcc

SEQ ID NO: 4031918 - RNA, 19 nt, Molluscum contagiosum virus
cgcgaucuuccgcgacgag

SEQ ID NO: 4031919 - RNA, 14 nt, Molluscum contagiosum virus
cgcgaugugcaccu

SEQ ID NO: 4031920 - RNA, 22 nt, Molluscum contagiosum virus
cgcggacuucucgcucacgcgc

SEQ ID NO: 4031921 - RNA, 15 nt, Molluscum contagiosum virus
cgcggagcgcgcacg

SEQ ID NO: 4031922 - RNA, 21 nt, Molluscum contagiosum virus
cgcggaggucgagcgcgccgc

SEQ ID NO: 4031923 - RNA, 18 nt, Molluscum contagiosum virus
cgcggauauggcgcgccg

SEQ ID NO: 4031924 - RNA, 17 nt, Molluscum contagiosum virus
cgcggaucugcgcacac

SEQ ID NO: 4031925 - RNA, 17 nt, Molluscum contagiosum virus
cgcggaugcaggcacug

SEQ ID NO: 4031926 - RNA, 16 nt, Molluscum contagiosum virus
cgcggaugccacgcag

SEQ ID NO: 4031927 - RNA, 17 nt, Molluscum contagiosum virus
cgcggcagcucugcagc

SEQ ID NO: 4031928 - RNA, 21 nt, Molluscum contagiosum virus
cgcggccacgcacucgcuggc

SEQ ID NO: 4031929 - RNA, 22 nt, Molluscum contagiosum virus
cgcggccauggucacgcgcacg

SEQ ID NO: 4031930 - RNA, 19 nt, Molluscum contagiosum virus
cgcggcccgcgggcugcaa

SEQ ID NO: 4031931 - RNA, 12 nt, Molluscum contagiosum virus
cgcggccgccac

SEQ ID NO: 4031932 - RNA, 19 nt, Molluscum contagiosum virus
cgcggccguggcacugacg

SEQ ID NO: 4031933 - RNA, 12 nt, Molluscum contagiosum virus
cgcggcgcacaa

SEQ ID NO: 4031934 - RNA, 18 nt, Molluscum contagiosum virus
cgcggcgcacggugugcu

SEQ ID NO: 4031935 - RNA, 17 nt, Molluscum contagiosum virus
cgcggcgccuugcuagu

SEQ ID NO: 4031936 - RNA, 12 nt, Molluscum contagiosum virus
cgcggcgcgccg

SEQ ID NO: 4031937 - RNA, 13 nt, Molluscum contagiosum virus
cgcggcgcgccgg

SEQ ID NO: 4031938 - RNA, 16 nt, Molluscum contagiosum virus
cgcggcgcgugccagu

SEQ ID NO: 4031939 - RNA, 17 nt, Molluscum contagiosum virus
cgcggcgcuacuggccg

SEQ ID NO: 4031940 - RNA, 22 nt, Molluscum contagiosum virus
cgcggcgggcgaaagcgccgcg

SEQ ID NO: 4031941 - RNA, 18 nt, Molluscum contagiosum virus
cgcggcgugugcgggcuc

SEQ ID NO: 4031942 - RNA, 23 nt, Molluscum contagiosum virus
cgcggcuagcaccgcaugggccc

SEQ ID NO: 4031943 - RNA, 17 nt, Molluscum contagiosum virus
cgcggcuuggcgcccuu

SEQ ID NO: 4031944 - RNA, 13 nt, Molluscum contagiosum virus
cgcgggcccgugc

SEQ ID NO: 4031945 - RNA, 16 nt, Molluscum contagiosum virus
cgcgggccgccgggcc

SEQ ID NO: 4031946 - RNA, 19 nt, Molluscum contagiosum virus
cgcgggccuguccgcgggc

SEQ ID NO: 4031947 - RNA, 22 nt, Molluscum contagiosum virus
cgcgggccuguccgcgggcgcg

SEQ ID NO: 4031948 - RNA, 14 nt, Molluscum contagiosum virus
cgcgggcgcgcccg

SEQ ID NO: 4031949 - RNA, 13 nt, Molluscum contagiosum virus
cgcgggcgcggag

SEQ ID NO: 4031950 - RNA, 17 nt, Molluscum contagiosum virus
cgcgggcguguccgcgg

SEQ ID NO: 4031951 - RNA, 19 nt, Molluscum contagiosum virus
cgcgggcucaagucgcccu

SEQ ID NO: 4031952 - RNA, 13 nt, Molluscum contagiosum virus
cgcggggcuccuc

SEQ ID NO: 4031953 - RNA, 22 nt, Molluscum contagiosum virus
cgcggggcucguccucgggcgc

SEQ ID NO: 4031954 - RNA, 13 nt, Molluscum contagiosum virus
cgcgguccagccg

SEQ ID NO: 4031955 - RNA, 19 nt, Molluscum contagiosum virus
cgcgguccuguccgcggac

SEQ ID NO: 4031956 - RNA, 20 nt, Molluscum contagiosum virus
cgcggucgacgagugcgccg

SEQ ID NO: 4031957 - RNA, 22 nt, Molluscum contagiosum virus
cgcggucgacgagugcgccgcg

SEQ ID NO: 4031958 - RNA, 19 nt, Molluscum contagiosum virus
cgcggugagugcgcgcacg

SEQ ID NO: 4031959 - RNA, 13 nt, Molluscum contagiosum virus
cgcgguggcaggc

SEQ ID NO: 4031960 - RNA, 16 nt, Molluscum contagiosum virus
cgcgguggccgcgccg

SEQ ID NO: 4031961 - RNA, 19 nt, Molluscum contagiosum virus
cgcgguggccgcgccgggc

SEQ ID NO: 4031962 - RNA, 20 nt, Molluscum contagiosum virus
cgcguacagcgcgcgugccg

SEQ ID NO: 4031963 - RNA, 17 nt, Molluscum contagiosum virus
cgcgucacggauacugu

SEQ ID NO: 4031964 - RNA, 20 nt, Molluscum contagiosum virus
cgcguccacaaagacggggc

SEQ ID NO: 4031965 - RNA, 23 nt, Molluscum contagiosum virus
cgcguccacaaagacggggccgc

SEQ ID NO: 4031966 - RNA, 21 nt, Molluscum contagiosum virus
cgcguccacaaaggcgggccc

SEQ ID NO: 4031967 - RNA, 21 nt, Molluscum contagiosum virus
cgcguccgcaucggcgccgcc

SEQ ID NO: 4031968 - RNA, 15 nt, Molluscum contagiosum virus
cgcgucgagggcgcc

SEQ ID NO: 4031969 - RNA, 19 nt, Molluscum contagiosum virus
cgcgucgcggucgcggagc

SEQ ID NO: 4031970 - RNA, 20 nt, Molluscum contagiosum virus
cgcgucguagacgcgcccgu

SEQ ID NO: 4031971 - RNA, 19 nt, Molluscum contagiosum virus
cgcgucguucucuaccagc

SEQ ID NO: 4031972 - RNA, 17 nt, Molluscum contagiosum virus
cgcgugaguccgcggcg

SEQ ID NO: 4031973 - RNA, 14 nt, Molluscum contagiosum virus
cgcgugcauggcac

SEQ ID NO: 4031974 - RNA, 13 nt, Molluscum contagiosum virus
cgcgugccgcugc

SEQ ID NO: 4031975 - RNA, 19 nt, Molluscum contagiosum virus
cgcgugccgcugcgcggag

SEQ ID NO: 4031976 - RNA, 16 nt, Molluscum contagiosum virus
cgcgugccucugccag

SEQ ID NO: 4031977 - RNA, 12 nt, Molluscum contagiosum virus
cgcgugcgcgug

SEQ ID NO: 4031978 - RNA, 16 nt, Molluscum contagiosum virus
cgcgugcgugcugcgc

SEQ ID NO: 4031979 - RNA, 19 nt, Molluscum contagiosum virus
cgcgugcucacgcccuuca

SEQ ID NO: 4031980 - RNA, 15 nt, Molluscum contagiosum virus
cgcgugcucgcgagc

SEQ ID NO: 4031981 - RNA, 23 nt, Molluscum contagiosum virus
cgcgugcucugcuccgcggaggc

SEQ ID NO: 4031982 - RNA, 14 nt, Molluscum contagiosum virus
cgcgugcuggacgc

SEQ ID NO: 4031983 - RNA, 22 nt, Molluscum contagiosum virus
cgcgugcuggacgcgcacgcgg

SEQ ID NO: 4031984 - RNA, 19 nt, Molluscum contagiosum virus
cgcguggugcuuacugcgg

SEQ ID NO: 4031985 - RNA, 16 nt, Molluscum contagiosum virus
cgcgugucgcggagca

SEQ ID NO: 4031986 - RNA, 22 nt, Molluscum contagiosum virus
cgcgugucugcgcucgccugcu

SEQ ID NO: 4031987 - RNA, 16 nt, Molluscum contagiosum virus
cgcgugucuggagccc

SEQ ID NO: 4031988 - RNA, 14 nt, Molluscum contagiosum virus
cgcguucacaaagg

SEQ ID NO: 4031989 - RNA, 15 nt, Molluscum contagiosum virus
cgcguucggaacgcg

SEQ ID NO: 4031990 - RNA, 17 nt, Molluscum contagiosum virus
cgcguucuccaggaacg

SEQ ID NO: 4031991 - RNA, 18 nt, Molluscum contagiosum virus
cgcguugccgcccgccga

SEQ ID NO: 4031992 - RNA, 16 nt, Molluscum contagiosum virus
cgcguuucggccugca

SEQ ID NO: 4031993 - RNA, 16 nt, Molluscum contagiosum virus
cgcguuuucgcggccu

SEQ ID NO: 4031994 - RNA, 18 nt, Molluscum contagiosum virus
cgcucaacgugggcaccu

SEQ ID NO: 4031995 - RNA, 22 nt, Molluscum contagiosum virus
cgcuccggucaccgcguccgcu

SEQ ID NO: 4031996 - RNA, 15 nt, Molluscum contagiosum virus
cgcuccuucucaggg

SEQ ID NO: 4031997 - RNA, 22 nt, Molluscum contagiosum virus
cgcucgaacgcgcgugcgcgug

SEQ ID NO: 4031998 - RNA, 20 nt, Molluscum contagiosum virus
cgcucgagcuccgagggcgc

SEQ ID NO: 4031999 - RNA, 13 nt, Molluscum contagiosum virus
cgcucgagggcgc

SEQ ID NO: 4032000 - RNA, 22 nt, Molluscum contagiosum virus
cgcucgcgcaaguccagcgcgc

SEQ ID NO: 4032001 - RNA, 12 nt, Molluscum contagiosum virus
cgcucgcucagc

SEQ ID NO: 4032002 - RNA, 15 nt, Molluscum contagiosum virus
cgcucggcacucgcu

SEQ ID NO: 4032003 - RNA, 16 nt, Molluscum contagiosum virus
cgcucggcccgcggac

SEQ ID NO: 4032004 - RNA, 18 nt, Molluscum contagiosum virus
cgcucggcguggugcugg

SEQ ID NO: 4032005 - RNA, 20 nt, Molluscum contagiosum virus
cgcucggcguggugcuggcc

SEQ ID NO: 4032006 - RNA, 12 nt, Molluscum contagiosum virus
cgcucgggccgg

SEQ ID NO: 4032007 - RNA, 21 nt, Molluscum contagiosum virus
cgcucgggccggcgcgccgcg

SEQ ID NO: 4032008 - RNA, 17 nt, Molluscum contagiosum virus
cgcucguccagcugcgc

SEQ ID NO: 4032009 - RNA, 16 nt, Molluscum contagiosum virus
cgcucuacgccagcga

SEQ ID NO: 4032010 - RNA, 17 nt, Molluscum contagiosum virus
cgcucuccaugcgcgcg

SEQ ID NO: 4032011 - RNA, 17 nt, Molluscum contagiosum virus
cgcucuuacugcagcag

SEQ ID NO: 4032012 - RNA, 12 nt, Molluscum contagiosum virus
cgcugagcgcag

SEQ ID NO: 4032013 - RNA, 16 nt, Molluscum contagiosum virus
cgcugaguuacguggc

SEQ ID NO: 4032014 - RNA, 22 nt, Molluscum contagiosum virus
cgcugaucaccgaggagccgcg

SEQ ID NO: 4032015 - RNA, 16 nt, Molluscum contagiosum virus
cgcugcaaggcgcgcg

SEQ ID NO: 4032016 - RNA, 12 nt, Molluscum contagiosum virus
cgcugccagaga

SEQ ID NO: 4032017 - RNA, 17 nt, Molluscum contagiosum virus
cgcugcccgcgcacaac

SEQ ID NO: 4032018 - RNA, 22 nt, Molluscum contagiosum virus
cgcugccugugcuacgcgagca

SEQ ID NO: 4032019 - RNA, 11 nt, Molluscum contagiosum virus
cgcugcgccac

SEQ ID NO: 4032020 - RNA, 14 nt, Molluscum contagiosum virus
cgcugcgccacugc

SEQ ID NO: 4032021 - RNA, 18 nt, Molluscum contagiosum virus
cgcugcgccggcugcgcc

SEQ ID NO: 4032022 - RNA, 14 nt, Molluscum contagiosum virus
cgcugcgcgccgcg

SEQ ID NO: 4032023 - RNA, 17 nt, Molluscum contagiosum virus
cgcugcgcgcucuggag

SEQ ID NO: 4032024 - RNA, 21 nt, Molluscum contagiosum virus
cgcugcgcgcucuggagccuc

SEQ ID NO: 4032025 - RNA, 13 nt, Molluscum contagiosum virus
cgcugcgcggcgc

SEQ ID NO: 4032026 - RNA, 18 nt, Molluscum contagiosum virus
cgcugcgcucggcgcgcg

SEQ ID NO: 4032027 - RNA, 19 nt, Molluscum contagiosum virus
cgcugcggcaacugccugc

SEQ ID NO: 4032028 - RNA, 21 nt, Molluscum contagiosum virus
cgcugcggcaacugccugcgc

SEQ ID NO: 4032029 - RNA, 18 nt, Molluscum contagiosum virus
cgcugcggcggcgcaacg

SEQ ID NO: 4032030 - RNA, 15 nt, Molluscum contagiosum virus
cgcugcgggcgccgg

SEQ ID NO: 4032031 - RNA, 20 nt, Molluscum contagiosum virus
cgcugcuagagaaccugugc

SEQ ID NO: 4032032 - RNA, 21 nt, Molluscum contagiosum virus
cgcugcuagagaaccugugcg

SEQ ID NO: 4032033 - RNA, 18 nt, Molluscum contagiosum virus
cgcugcuauacgcgccag

SEQ ID NO: 4032034 - RNA, 16 nt, Molluscum contagiosum virus
cgcugcuccccgccag

SEQ ID NO: 4032035 - RNA, 14 nt, Molluscum contagiosum virus
cgcugcuccugcuc

SEQ ID NO: 4032036 - RNA, 16 nt, Molluscum contagiosum virus
cgcugcuccugcucug

SEQ ID NO: 4032037 - RNA, 13 nt, Molluscum contagiosum virus
cgcugcucgcgcu

SEQ ID NO: 4032038 - RNA, 20 nt, Molluscum contagiosum virus
cgcugcucuacuuccacgag

SEQ ID NO: 4032039 - RNA, 14 nt, Molluscum contagiosum virus
cgcugcugcacagc

SEQ ID NO: 4032040 - RNA, 16 nt, Molluscum contagiosum virus
cgcugcugcgugcgcg

SEQ ID NO: 4032041 - RNA, 14 nt, Molluscum contagiosum virus
cgcuggacgccucg

SEQ ID NO: 4032042 - RNA, 18 nt, Molluscum contagiosum virus
cgcuggacuuccugcugc

SEQ ID NO: 4032043 - RNA, 18 nt, Molluscum contagiosum virus
cgcuggacuugcgcgagc

SEQ ID NO: 4032044 - RNA, 20 nt, Molluscum contagiosum virus
cgcuggagaaagaagugugc

SEQ ID NO: 4032045 - RNA, 16 nt, Molluscum contagiosum virus
cgcuggagacggcagu

SEQ ID NO: 4032046 - RNA, 15 nt, Molluscum contagiosum virus
cgcuggccgugcccg

SEQ ID NO: 4032047 - RNA, 16 nt, Molluscum contagiosum virus
cgcuggccgugcccgc

SEQ ID NO: 4032048 - RNA, 16 nt, Molluscum contagiosum virus
cgcuggccucugccug

SEQ ID NO: 4032049 - RNA, 14 nt, Molluscum contagiosum virus
cgcuggcgcgcgcg

SEQ ID NO: 4032050 - RNA, 20 nt, Molluscum contagiosum virus
cgcuggugggcgugcggcgc

SEQ ID NO: 4032051 - RNA, 21 nt, Molluscum contagiosum virus
cgcugguuugcgcgagcugcg

SEQ ID NO: 4032052 - RNA, 16 nt, Molluscum contagiosum virus
cgcuguacaugccgca

SEQ ID NO: 4032053 - RNA, 18 nt, Molluscum contagiosum virus
cgcuguauucggcguacg

SEQ ID NO: 4032054 - RNA, 16 nt, Molluscum contagiosum virus
cgcuguugcugcugcc

SEQ ID NO: 4032055 - RNA, 16 nt, Molluscum contagiosum virus
cgcuucugccugcucc

SEQ ID NO: 4032056 - RNA, 19 nt, Molluscum contagiosum virus
cgcuugcccggagccggcg

SEQ ID NO: 4032057 - RNA, 14 nt, Molluscum contagiosum virus
cgcuugcucgaagu

SEQ ID NO: 4032058 - RNA, 14 nt, Molluscum contagiosum virus
cgcuuguccucuug

SEQ ID NO: 4032059 - RNA, 12 nt, Molluscum contagiosum virus
cgcuuugcgcgg

SEQ ID NO: 4032060 - RNA, 22 nt, Molluscum contagiosum virus
cggaaaaaaacugcgcacgcgg

SEQ ID NO: 4032061 - RNA, 17 nt, Molluscum contagiosum virus
cggaaacgaacgcugca

SEQ ID NO: 4032062 - RNA, 16 nt, Molluscum contagiosum virus
cggaaccguggugcgc

SEQ ID NO: 4032063 - RNA, 21 nt, Molluscum contagiosum virus
cggaacucgcgcgcgccgggc

SEQ ID NO: 4032064 - RNA, 18 nt, Molluscum contagiosum virus
cggaagacgcgagcggcu

SEQ ID NO: 4032065 - RNA, 20 nt, Molluscum contagiosum virus
cggaagucggcguggccagg

SEQ ID NO: 4032066 - RNA, 21 nt, Molluscum contagiosum virus
cggaauuugcggcgcgggcaa

SEQ ID NO: 4032067 - RNA, 16 nt, Molluscum contagiosum virus
cggacaagacaacacu

SEQ ID NO: 4032068 - RNA, 16 nt, Molluscum contagiosum virus
cggacacgggugagcu

SEQ ID NO: 4032069 - RNA, 17 nt, Molluscum contagiosum virus
cggacacguacacgcug

SEQ ID NO: 4032070 - RNA, 17 nt, Molluscum contagiosum virus
cggacacguugcagcag

SEQ ID NO: 4032071 - RNA, 18 nt, Molluscum contagiosum virus
cggacacguugcagcagc

SEQ ID NO: 4032072 - RNA, 19 nt, Molluscum contagiosum virus
cggacacguugcagcagca

SEQ ID NO: 4032073 - RNA, 21 nt, Molluscum contagiosum virus
cggacagugccuccgcggacg

SEQ ID NO: 4032074 - RNA, 18 nt, Molluscum contagiosum virus
cggacaugagcuugcgca

SEQ ID NO: 4032075 - RNA, 16 nt, Molluscum contagiosum virus
cggacgaagagacgcc

SEQ ID NO: 4032076 - RNA, 17 nt, Molluscum contagiosum virus
cggacgaagcugugcaa

SEQ ID NO: 4032077 - RNA, 22 nt, Molluscum contagiosum virus
cggacgaucuuacaggccaccg

SEQ ID NO: 4032078 - RNA, 15 nt, Molluscum contagiosum virus
cggacgcaggaugcu

SEQ ID NO: 4032079 - RNA, 23 nt, Molluscum contagiosum virus
cggacgcccuccucgaccugcac

SEQ ID NO: 4032080 - RNA, 22 nt, Molluscum contagiosum virus
cggacgccuuuugugcagcgcg

SEQ ID NO: 4032081 - RNA, 14 nt, Molluscum contagiosum virus
cggacgcgcagcug

SEQ ID NO: 4032082 - RNA, 15 nt, Molluscum contagiosum virus
cggacgcgcagcugu

SEQ ID NO: 4032083 - RNA, 14 nt, Molluscum contagiosum virus
cggacggcuuuguc

SEQ ID NO: 4032084 - RNA, 14 nt, Molluscum contagiosum virus
cggacgugcacgca

SEQ ID NO: 4032085 - RNA, 14 nt, Molluscum contagiosum virus
cggacucgcgagca

SEQ ID NO: 4032086 - RNA, 19 nt, Molluscum contagiosum virus
cggacuucgacgcgcggca

SEQ ID NO: 4032087 - RNA, 20 nt, Molluscum contagiosum virus
cggacuucgacgcgcggcag

SEQ ID NO: 4032088 - RNA, 20 nt, Molluscum contagiosum virus
cggacuuuucgcgcgugcgc

SEQ ID NO: 4032089 - RNA, 17 nt, Molluscum contagiosum virus
cggagaacaugcucgcc

SEQ ID NO: 4032090 - RNA, 18 nt, Molluscum contagiosum virus
cggagacaccagcuccgc

SEQ ID NO: 4032091 - RNA, 18 nt, Molluscum contagiosum virus
cggagacagugacagacu

SEQ ID NO: 4032092 - RNA, 19 nt, Molluscum contagiosum virus
cggagaccuggucacacug

SEQ ID NO: 4032093 - RNA, 13 nt, Molluscum contagiosum virus
cggagagcagugc

SEQ ID NO: 4032094 - RNA, 19 nt, Molluscum contagiosum virus
cggagagcuccggcugcuc

SEQ ID NO: 4032095 - RNA, 13 nt, Molluscum contagiosum virus
cggagaggggacg

SEQ ID NO: 4032096 - RNA, 18 nt, Molluscum contagiosum virus
cggagaucaggcagcugc

SEQ ID NO: 4032097 - RNA, 14 nt, Molluscum contagiosum virus
cggagcgcagcugc

SEQ ID NO: 4032098 - RNA, 21 nt, Molluscum contagiosum virus
cggagcgcgcacggcagcggc

SEQ ID NO: 4032099 - RNA, 21 nt, Molluscum contagiosum virus
cggagcggaucgugcuggaga

SEQ ID NO: 4032100 - RNA, 19 nt, Molluscum contagiosum virus
cggagcuggccacucucgc

SEQ ID NO: 4032101 - RNA, 18 nt, Molluscum contagiosum virus
cggagcuggcguugccga

SEQ ID NO: 4032102 - RNA, 19 nt, Molluscum contagiosum virus
cggagcugugccgcagcaa

SEQ ID NO: 4032103 - RNA, 17 nt, Molluscum contagiosum virus
cggaggacucggaggcc

SEQ ID NO: 4032104 - RNA, 15 nt, Molluscum contagiosum virus
cggaggcggagcugc

SEQ ID NO: 4032105 - RNA, 14 nt, Molluscum contagiosum virus
cggagggcgaggcc

SEQ ID NO: 4032106 - RNA, 18 nt, Molluscum contagiosum virus
cggaggucuacaacgagc

SEQ ID NO: 4032107 - RNA, 20 nt, Molluscum contagiosum virus
cggaguccucgacaaugagc

SEQ ID NO: 4032108 - RNA, 17 nt, Molluscum contagiosum virus
cggaucugcgcacacgu

SEQ ID NO: 4032109 - RNA, 15 nt, Molluscum contagiosum virus
cggaugucacgcaga

SEQ ID NO: 4032110 - RNA, 22 nt, Molluscum contagiosum virus
cggcaaaugcgucccagcagcu

SEQ ID NO: 4032111 - RNA, 22 nt, Molluscum contagiosum virus
cggcaagcgagaucccuccgag

SEQ ID NO: 4032112 - RNA, 21 nt, Molluscum contagiosum virus
cggcacacaugcuagcgggca

SEQ ID NO: 4032113 - RNA, 15 nt, Molluscum contagiosum virus
cggcacccgccagcu

SEQ ID NO: 4032114 - RNA, 16 nt, Molluscum contagiosum virus
cggcacccgccagcuu

SEQ ID NO: 4032115 - RNA, 16 nt, Molluscum contagiosum virus
cggcacccgugcgcgc

SEQ ID NO: 4032116 - RNA, 13 nt, Molluscum contagiosum virus
cggcaccgcgccg

SEQ ID NO: 4032117 - RNA, 15 nt, Molluscum contagiosum virus
cggcaccugucgcgc

SEQ ID NO: 4032118 - RNA, 16 nt, Molluscum contagiosum virus
cggcacgggcacgcgc

SEQ ID NO: 4032119 - RNA, 13 nt, Molluscum contagiosum virus
cggcacgucgucc

SEQ ID NO: 4032120 - RNA, 15 nt, Molluscum contagiosum virus
cggcacucgcguccg

SEQ ID NO: 4032121 - RNA, 13 nt, Molluscum contagiosum virus
cggcacugcgcgc

SEQ ID NO: 4032122 - RNA, 12 nt, Molluscum contagiosum virus
cggcacugcuag

SEQ ID NO: 4032123 - RNA, 13 nt, Molluscum contagiosum virus
cggcacugcuagc

SEQ ID NO: 4032124 - RNA, 13 nt, Molluscum contagiosum virus
cggcacugcuggc

SEQ ID NO: 4032125 - RNA, 14 nt, Molluscum contagiosum virus
cggcacugcuggcg

SEQ ID NO: 4032126 - RNA, 13 nt, Molluscum contagiosum virus
cgggcgcgcgcca

SEQ ID NO: 4032127 - RNA, 14 nt, Molluscum contagiosum virus
cgggcgcgcgccag

SEQ ID NO: 4032128 - RNA, 15 nt, Molluscum contagiosum virus
cgggcgcggcaccag

SEQ ID NO: 4032129 - RNA, 19 nt, Molluscum contagiosum virus
cgggcgcuauugcgcggcg

SEQ ID NO: 4032130 - RNA, 14 nt, Molluscum contagiosum virus
cgggcggcgcgccg

SEQ ID NO: 4032131 - RNA, 22 nt, Molluscum contagiosum virus
cgggcgucaagacucgcccgcg

SEQ ID NO: 4032132 - RNA, 20 nt, Molluscum contagiosum virus
cgggcguguccgcgggcgcg

SEQ ID NO: 4032133 - RNA, 13 nt, Molluscum contagiosum virus
cgggcucgagcuc

SEQ ID NO: 4032134 - RNA, 19 nt, Molluscum contagiosum virus
cgggcucuuccaccggcag

SEQ ID NO: 4032135 - RNA, 21 nt, Molluscum contagiosum virus
cgggcugcacgacggucacgc

SEQ ID NO: 4032136 - RNA, 15 nt, Molluscum contagiosum virus
cgggcugcagcccuu

SEQ ID NO: 4032137 - RNA, 14 nt, Molluscum contagiosum virus
cgggcuucgccgcc

SEQ ID NO: 4032138 - RNA, 21 nt, Molluscum contagiosum virus
cgggcuucgcgacgacgagca

SEQ ID NO: 4032139 - RNA, 22 nt, Molluscum contagiosum virus
cggggccuguucggcaugcagc

SEQ ID NO: 4032140 - RNA, 15 nt, Molluscum contagiosum virus
cgggggcgcuucccc

SEQ ID NO: 4032141 - RNA, 20 nt, Molluscum contagiosum virus
cgggguaccacagucggugc

SEQ ID NO: 4032142 - RNA, 17 nt, Molluscum contagiosum virus
cggguccgucuuugcgg

SEQ ID NO: 4032143 - RNA, 20 nt, Molluscum contagiosum virus
cgggugcccggacagagccc

SEQ ID NO: 4032144 - RNA, 18 nt, Molluscum contagiosum virus
cgguagcguggagcuggu

SEQ ID NO: 4032145 - RNA, 22 nt, Molluscum contagiosum virus
cgguagggugccgaggcgcugc

SEQ ID NO: 4032146 - RNA, 13 nt, Molluscum contagiosum virus
cggucgacgagug

SEQ ID NO: 4032147 - RNA, 23 nt, Molluscum contagiosum virus
cggucgacgagugcgccgcgccc

SEQ ID NO: 4032148 - RNA, 16 nt, Molluscum contagiosum virus
cggugaccggagcggc

SEQ ID NO: 4032149 - RNA, 21 nt, Molluscum contagiosum virus
cggugcucuucggggacggcg

SEQ ID NO: 4032150 - RNA, 15 nt, Molluscum contagiosum virus
cggugcugcgccagg

SEQ ID NO: 4032151 - RNA, 13 nt, Molluscum contagiosum virus
cggugcugcugcc

SEQ ID NO: 4032152 - RNA, 14 nt, Molluscum contagiosum virus
cgguguccucuuca

SEQ ID NO: 4032153 - RNA, 22 nt, Molluscum contagiosum virus
cguaaaagugagagauaaaguc

SEQ ID NO: 4032154 - RNA, 17 nt, Molluscum contagiosum virus
cguacagcgggcgcugc

SEQ ID NO: 4032155 - RNA, 21 nt, Molluscum contagiosum virus
cguacaucgacuacgcgcugc

SEQ ID NO: 4032156 - RNA, 15 nt, Molluscum contagiosum virus
cguaccagcgccugc

SEQ ID NO: 4032157 - RNA, 17 nt, Molluscum contagiosum virus
cguacgagcagcugcug

SEQ ID NO: 4032158 - RNA, 13 nt, Molluscum contagiosum virus
cguacgagcaggc

SEQ ID NO: 4032159 - RNA, 19 nt, Molluscum contagiosum virus
cguacgagcaggcgcagcg

SEQ ID NO: 4032160 - RNA, 21 nt, Molluscum contagiosum virus
cguacgagcaggcgcagcgcg

SEQ ID NO: 4032161 - RNA, 15 nt, Molluscum contagiosum virus
cguacgugcgccagc

SEQ ID NO: 4032162 - RNA, 18 nt, Molluscum contagiosum virus
cguacucaacaagcugcu

SEQ ID NO: 4032163 - RNA, 19 nt, Molluscum contagiosum virus
cguacucgcguccgcgcag

SEQ ID NO: 4032164 - RNA, 23 nt, Molluscum contagiosum virus
cguacuugcugguugccgcucgc

SEQ ID NO: 4032165 - RNA, 23 nt, Molluscum contagiosum virus
cguagacgcgcccguccuccguc

SEQ ID NO: 4032166 - RNA, 13 nt, Molluscum contagiosum virus
cguagcgcgucuc

SEQ ID NO: 4032167 - RNA, 18 nt, Molluscum contagiosum virus
cguaguccagcgcgucca

SEQ ID NO: 4032168 - RNA, 16 nt, Molluscum contagiosum virus
cguauggaucuucuca

SEQ ID NO: 4032169 - RNA, 15 nt, Molluscum contagiosum virus
cgucaaccugcugcc

SEQ ID NO: 4032170 - RNA, 22 nt, Molluscum contagiosum virus
cgucaagcagguggccgcgcgc

SEQ ID NO: 4032171 - RNA, 14 nt, Molluscum contagiosum virus
cgucacguacucgc

SEQ ID NO: 4032172 - RNA, 21 nt, Molluscum contagiosum virus
cgucagccucugugcggcgcc

SEQ ID NO: 4032173 - RNA, 14 nt, Molluscum contagiosum virus
cgucauggagcagg

SEQ ID NO: 4032174 - RNA, 16 nt, Molluscum contagiosum virus
cgucauggagcaggag

SEQ ID NO: 4032175 - RNA, 13 nt, Molluscum contagiosum virus
cgucaugugcgug

SEQ ID NO: 4032176 - RNA, 17 nt, Molluscum contagiosum virus
cguccacaaaggcgggc

SEQ ID NO: 4032177 - RNA, 14 nt, Molluscum contagiosum virus
cguccacaggcgcg

SEQ ID NO: 4032178 - RNA, 17 nt, Molluscum contagiosum virus
cguccacgcaggacugg

SEQ ID NO: 4032179 - RNA, 20 nt, Molluscum contagiosum virus
cguccacgcaggacuggcac

SEQ ID NO: 4032180 - RNA, 16 nt, Molluscum contagiosum virus
cguccagccgcagccg

SEQ ID NO: 4032181 - RNA, 17 nt, Molluscum contagiosum virus
cguccagccgcagccgc

SEQ ID NO: 4032182 - RNA, 17 nt, Molluscum contagiosum virus
cguccagcugcgcgagc

SEQ ID NO: 4032183 - RNA, 15 nt, Molluscum contagiosum virus
cgucccagcagcugc

SEQ ID NO: 4032184 - RNA, 18 nt, Molluscum contagiosum virus
cguccgcacgaggagccc

SEQ ID NO: 4032185 - RNA, 15 nt, Molluscum contagiosum virus
cguccgcggcacgcg

SEQ ID NO: 4032186 - RNA, 18 nt, Molluscum contagiosum virus
cguccgcggggcuccucg

SEQ ID NO: 4032187 - RNA, 15 nt, Molluscum contagiosum virus
cguccggcaugcgcg

SEQ ID NO: 4032188 - RNA, 13 nt, Molluscum contagiosum virus
cguccggcgcucg

SEQ ID NO: 4032189 - RNA, 16 nt, Molluscum contagiosum virus
cguccggcgcucgccu

SEQ ID NO: 4032190 - RNA, 15 nt, Molluscum contagiosum virus
cguccuguagcaagg

SEQ ID NO: 4032191 - RNA, 12 nt, Molluscum contagiosum virus
cgucgacggcgc

SEQ ID NO: 4032192 - RNA, 19 nt, Molluscum contagiosum virus
cgucgaugaaggcgcggcu

SEQ ID NO: 4032193 - RNA, 19 nt, Molluscum contagiosum virus
cgucgccggacagcucagc

SEQ ID NO: 4032194 - RNA, 13 nt, Molluscum contagiosum virus
cgucgcgcgccgc

SEQ ID NO: 4032195 - RNA, 13 nt, Molluscum contagiosum virus
cgucgcgcgcucg

SEQ ID NO: 4032196 - RNA, 14 nt, Molluscum contagiosum virus
cgucgcggagcgcg

SEQ ID NO: 4032197 - RNA, 23 nt, Molluscum contagiosum virus
cgucggcggcaugcgcgcgcagc

SEQ ID NO: 4032198 - RNA, 21 nt, Molluscum contagiosum virus
cgucggcuuggacagcaagca

SEQ ID NO: 4032199 - RNA, 24 nt, Molluscum contagiosum virus
cgucgggaaguguugccgccggcc

SEQ ID NO: 4032200 - RNA, 16 nt, Molluscum contagiosum virus
cgucguccggaggcac

SEQ ID NO: 4032201 - RNA, 14 nt, Molluscum contagiosum virus
cgucucggagaaga

SEQ ID NO: 4032202 - RNA, 20 nt, Molluscum contagiosum virus
cgucugcucucggcggccgg

SEQ ID NO: 4032203 - RNA, 22 nt, Molluscum contagiosum virus
cgucuuaacucagcgggcagac

SEQ ID NO: 4032204 - RNA, 24 nt, Molluscum contagiosum virus
cgucuuaacucagcgggcagacag

SEQ ID NO: 4032205 - RNA, 13 nt, Molluscum contagiosum virus
cgucuuacugcug

SEQ ID NO: 4032206 - RNA, 16 nt, Molluscum contagiosum virus
cgucuuaugcauccug

SEQ ID NO: 4032207 - RNA, 18 nt, Molluscum contagiosum virus
cgucuuccccaagaccug

SEQ ID NO: 4032208 - RNA, 14 nt, Molluscum contagiosum virus
cgucuucuaccgcc

SEQ ID NO: 4032209 - RNA, 14 nt, Molluscum contagiosum virus
cgugaacgaggcug

SEQ ID NO: 4032210 - RNA, 18 nt, Molluscum contagiosum virus
cgugaccuugugcgcgca

SEQ ID NO: 4032211 - RNA, 18 nt, Molluscum contagiosum virus
cgugagcucccgcgccac

SEQ ID NO: 4032212 - RNA, 23 nt, Molluscum contagiosum virus
cgugaggaagaccuuggacacgu

SEQ ID NO: 4032213 - RNA, 19 nt, Molluscum contagiosum virus
cgugaggaggcggcacugc

SEQ ID NO: 4032214 - RNA, 16 nt, Molluscum contagiosum virus
cgugaugugcgcacag

SEQ ID NO: 4032215 - RNA, 18 nt, Molluscum contagiosum virus
cgugaugugcgcacagac

SEQ ID NO: 4032216 - RNA, 15 nt, Molluscum contagiosum virus
cgugcaacaggagca

SEQ ID NO: 4032217 - RNA, 14 nt, Molluscum contagiosum virus
cgugcaccuggagc

SEQ ID NO: 4032218 - RNA, 17 nt, Molluscum contagiosum virus
cgugcaggaacgcgcgc

SEQ ID NO: 4032219 - RNA, 20 nt, Molluscum contagiosum virus
cgugcaggaacgcgcgcucg

SEQ ID NO: 4032220 - RNA, 22 nt, Molluscum contagiosum virus
cgugcagggcgugcuugccugg

SEQ ID NO: 4032221 - RNA, 12 nt, Molluscum contagiosum virus
cgugcaggucga

SEQ ID NO: 4032222 - RNA, 14 nt, Molluscum contagiosum virus
cgugcaguugagag

SEQ ID NO: 4032223 - RNA, 18 nt, Molluscum contagiosum virus
cgugccacugccgccguu

SEQ ID NO: 4032224 - RNA, 19 nt, Molluscum contagiosum virus
cgugcccacgagcgccagc

SEQ ID NO: 4032225 - RNA, 17 nt, Molluscum contagiosum virus
cgugcccgccgacugcc

SEQ ID NO: 4032226 - RNA, 18 nt, Molluscum contagiosum virus
cgugccgcugcgcggagc

SEQ ID NO: 4032227 - RNA, 23 nt, Molluscum contagiosum virus
cgugccggaaauagcgcgcuagc

SEQ ID NO: 4032228 - RNA, 16 nt, Molluscum contagiosum virus
cgugccucugccagcc

SEQ ID NO: 4032229 - RNA, 23 nt, Molluscum contagiosum virus
gcagcagcucggggcugucagag

SEQ ID NO: 4032230 - RNA, 20 nt, Molluscum contagiosum virus
gcagcagcuggccggcucgc

SEQ ID NO: 4032231 - RNA, 20 nt, Molluscum contagiosum virus
gcagcauucccggcgcgcgc

SEQ ID NO: 4032232 - RNA, 21 nt, Molluscum contagiosum virus
gcagcauucccggcgcgcgcg

SEQ ID NO: 4032233 - RNA, 22 nt, Molluscum contagiosum virus
gcagcauucccggcgcgcgcgg

SEQ ID NO: 4032234 - RNA, 18 nt, Molluscum contagiosum virus
gcagcccgacgcgggcgc

SEQ ID NO: 4032235 - RNA, 19 nt, Molluscum contagiosum virus
gcagcccgugcgccugccg

SEQ ID NO: 4032236 - RNA, 13 nt, Molluscum contagiosum virus
gcagccgcugcug

SEQ ID NO: 4032237 - RNA, 22 nt, Molluscum contagiosum virus
gcagccuccgaacaaugaggag

SEQ ID NO: 4032238 - RNA, 18 nt, Molluscum contagiosum virus
gcagcgccagcuuggugc

SEQ ID NO: 4032239 - RNA, 23 nt, Molluscum contagiosum virus
gcagcgcccgcguacacgugcac

SEQ ID NO: 4032240 - RNA, 13 nt, Molluscum contagiosum virus
gcagcgccgcgcg

SEQ ID NO: 4032241 - RNA, 21 nt, Molluscum contagiosum virus
gcagcgcgcaaaaggcacgag

SEQ ID NO: 4032242 - RNA, 20 nt, Molluscum contagiosum virus
gcagcgcgugacgcucacgg

SEQ ID NO: 4032243 - RNA, 20 nt, Molluscum contagiosum virus
gcagcgcgugcgcaggagca

SEQ ID NO: 4032244 - RNA, 19 nt, Molluscum contagiosum virus
gcagcggcaaaggcccgcg

SEQ ID NO: 4032245 - RNA, 16 nt, Molluscum contagiosum virus
gcagcggcgccacgag

SEQ ID NO: 4032246 - RNA, 14 nt, Molluscum contagiosum virus
gcagcggcgcgugc

SEQ ID NO: 4032247 - RNA, 19 nt, Molluscum contagiosum virus
gcagcucaagacgcugcug

SEQ ID NO: 4032248 - RNA, 18 nt, Molluscum contagiosum virus
gcagcucggcgagagcgc

SEQ ID NO: 4032249 - RNA, 19 nt, Molluscum contagiosum virus
gcagcugcaggaccugcug

SEQ ID NO: 4032250 - RNA, 16 nt, Molluscum contagiosum virus
gcagcugccgcagagc

SEQ ID NO: 4032251 - RNA, 18 nt, Molluscum contagiosum virus
gcagcugccgcagagccg

SEQ ID NO: 4032252 - RNA, 12 nt, Molluscum contagiosum virus
gcagcugcugcg

SEQ ID NO: 4032253 - RNA, 18 nt, Molluscum contagiosum virus
gcagcugcugcgcacgug

SEQ ID NO: 4032254 - RNA, 15 nt, Molluscum contagiosum virus
gcagcugcuucucuu

SEQ ID NO: 4032255 - RNA, 17 nt, Molluscum contagiosum virus
gcagcuguccaagguga

SEQ ID NO: 4032256 - RNA, 13 nt, Molluscum contagiosum virus
gcagcuucugcuc

SEQ ID NO: 4032257 - RNA, 16 nt, Molluscum contagiosum virus
gcaggaaaggcacccg

SEQ ID NO: 4032258 - RNA, 19 nt, Molluscum contagiosum virus
gcaggaggaccgcgagcgc

SEQ ID NO: 4032259 - RNA, 19 nt, Molluscum contagiosum virus
gcaggaucggagcgcagcu

SEQ ID NO: 4032260 - RNA, 18 nt, Molluscum contagiosum virus
gcaggauuuccucgcgga

SEQ ID NO: 4032261 - RNA, 18 nt, Molluscum contagiosum virus
gcaggcacgacgccgaca

SEQ ID NO: 4032262 - RNA, 19 nt, Molluscum contagiosum virus
gcaggccccgcaccagugc

SEQ ID NO: 4032263 - RNA, 21 nt, Molluscum contagiosum virus
gcaggcccggcggcccgcggc

SEQ ID NO: 4032264 - RNA, 12 nt, Molluscum contagiosum virus
gcaggccucuuu

SEQ ID NO: 4032265 - RNA, 14 nt, Molluscum contagiosum virus
gcaggcgcugcgcg

SEQ ID NO: 4032266 - RNA, 15 nt, Molluscum contagiosum virus
gcaggcgucgcgcac

SEQ ID NO: 4032267 - RNA, 23 nt, Molluscum contagiosum virus
gcaggcgucgcgcacagaaagcc

SEQ ID NO: 4032268 - RNA, 18 nt, Molluscum contagiosum virus
gcaggcucuaagcgcacg

SEQ ID NO: 4032269 - RNA, 20 nt, Molluscum contagiosum virus
gcagggaaagagcacgcgcu

SEQ ID NO: 4032270 - RNA, 16 nt, Molluscum contagiosum virus
gcagggagcugcggac

SEQ ID NO: 4032271 - RNA, 19 nt, Molluscum contagiosum virus
gcaggucaucgacgagcac

SEQ ID NO: 4032272 - RNA, 19 nt, Molluscum contagiosum virus
gcaggucaucgggcugcag

SEQ ID NO: 4032273 - RNA, 19 nt, Molluscum contagiosum virus
gcaggucggccagcagcuc

SEQ ID NO: 4032274 - RNA, 17 nt, Molluscum contagiosum virus
gcagguuccggugucag

SEQ ID NO: 4032275 - RNA, 21 nt, Molluscum contagiosum virus
gcagguuugcacccgcgcagc

SEQ ID NO: 4032276 - RNA, 14 nt, Molluscum contagiosum virus
gcagucacgacugu

SEQ ID NO: 4032277 - RNA, 17 nt, Molluscum contagiosum virus
gcagucaguuccgcggc

SEQ ID NO: 4032278 - RNA, 19 nt, Molluscum contagiosum virus
gcaguccgccgucgcccgg

SEQ ID NO: 4032279 - RNA, 22 nt, Molluscum contagiosum virus
gcagugccgccgcgcaaaagca

SEQ ID NO: 4032280 - RNA, 19 nt, Molluscum contagiosum virus
gcagugccgccgcgcgcgc

SEQ ID NO: 4032281 - RNA, 14 nt, Molluscum contagiosum virus
gcagugccgcucgc

SEQ ID NO: 4032282 - RNA, 12 nt, Molluscum contagiosum virus
gcagugccuugu

SEQ ID NO: 4032283 - RNA, 16 nt, Molluscum contagiosum virus
gcagugcggaugugcu

SEQ ID NO: 4032284 - RNA, 13 nt, Molluscum contagiosum virus
gcagugcucgcac

SEQ ID NO: 4032285 - RNA, 18 nt, Molluscum contagiosum virus
gcagugcucuuuaguaca

SEQ ID NO: 4032286 - RNA, 16 nt, Molluscum contagiosum virus
gcaguucgagcugcug

SEQ ID NO: 4032287 - RNA, 22 nt, Molluscum contagiosum virus
gcauauaaaucauggccgcgcc

SEQ ID NO: 4032288 - RNA, 16 nt, Molluscum contagiosum virus
gcaucagcaacaagcu

SEQ ID NO: 4032289 - RNA, 22 nt, Molluscum contagiosum virus
gcaucaugaaagaacgacucgc

SEQ ID NO: 4032290 - RNA, 14 nt, Molluscum contagiosum virus
gcaucccugcgcac

SEQ ID NO: 4032291 - RNA, 20 nt, Molluscum contagiosum virus
gcauccucuccaucaucgag

SEQ ID NO: 4032292 - RNA, 22 nt, Molluscum contagiosum virus
gcauccugaugacggcagacgg

SEQ ID NO: 4032293 - RNA, 19 nt, Molluscum contagiosum virus
gcaucggcggcagcgccag

SEQ ID NO: 4032294 - RNA, 20 nt, Molluscum contagiosum virus
gcaucuagucagcggcgguc

SEQ ID NO: 4032295 - RNA, 16 nt, Molluscum contagiosum virus
gcaucuccacgucggc

SEQ ID NO: 4032296 - RNA, 14 nt, Molluscum contagiosum virus
gcaucugcgagcgc

SEQ ID NO: 4032297 - RNA, 16 nt, Molluscum contagiosum virus
gcaugcacagcugcuc

SEQ ID NO: 4032298 - RNA, 14 nt, Molluscum contagiosum virus
gcaugcccagcaug

SEQ ID NO: 4032299 - RNA, 15 nt, Molluscum contagiosum virus
gcaugcgcgcgcagc

SEQ ID NO: 4032300 - RNA, 14 nt, Molluscum contagiosum virus
gcaugcuugaggcg

SEQ ID NO: 4032301 - RNA, 15 nt, Molluscum contagiosum virus
gcauggcgagcccuu

SEQ ID NO: 4032302 - RNA, 17 nt, Molluscum contagiosum virus
gcauggcggcggccacg

SEQ ID NO: 4032303 - RNA, 19 nt, Molluscum contagiosum virus
gcaugggcccuggcggcuu

SEQ ID NO: 4032304 - RNA, 18 nt, Molluscum contagiosum virus
gcaugugcgagcgcagcu

SEQ ID NO: 4032305 - RNA, 15 nt, Molluscum contagiosum virus
gcauuacccccccuu

SEQ ID NO: 4032306 - RNA, 21 nt, Molluscum contagiosum virus
gcauugcgucuuacugcugca

SEQ ID NO: 4032307 - RNA, 14 nt, Molluscum contagiosum virus
gccaaaaggcucag

SEQ ID NO: 4032308 - RNA, 12 nt, Molluscum contagiosum virus
gccaaagccgcg

SEQ ID NO: 4032309 - RNA, 21 nt, Molluscum contagiosum virus
gccaacacgcaaucgcgcgcg

SEQ ID NO: 4032310 - RNA, 17 nt, Molluscum contagiosum virus
gccaacccucgcaagcu

SEQ ID NO: 4032311 - RNA, 15 nt, Molluscum contagiosum virus
gccaacgccagcugu

SEQ ID NO: 4032312 - RNA, 20 nt, Molluscum contagiosum virus
gccaagaccugggcgucgug

SEQ ID NO: 4032313 - RNA, 20 nt, Molluscum contagiosum virus
gccaaggaugccugccagca

SEQ ID NO: 4032314 - RNA, 23 nt, Molluscum contagiosum virus
gccaaggaugccugccagcagag

SEQ ID NO: 4032315 - RNA, 21 nt, Molluscum contagiosum virus
gccaagguucuggacgugucc

SEQ ID NO: 4032316 - RNA, 13 nt, Molluscum contagiosum virus
gccaccgcggcgc

SEQ ID NO: 4032317 - RNA, 20 nt, Molluscum contagiosum virus
gccacgaagaacgcggcgug

SEQ ID NO: 4032318 - RNA, 21 nt, Molluscum contagiosum virus
gccacgagcgccgcgugcgcg

SEQ ID NO: 4032319 - RNA, 14 nt, Molluscum contagiosum virus
gccacgcagcuggc

SEQ ID NO: 4032320 - RNA, 14 nt, Molluscum contagiosum virus
gccacgccagcccg

SEQ ID NO: 4032321 - RNA, 14 nt, Molluscum contagiosum virus
gccacgcggagcuc

SEQ ID NO: 4032322 - RNA, 22 nt, Molluscum contagiosum virus
gccacucgcauugcguuggcaa

SEQ ID NO: 4032323 - RNA, 18 nt, Molluscum contagiosum virus
gccacucuccuucagugu

SEQ ID NO: 4032324 - RNA, 18 nt, Molluscum contagiosum virus
gccacuggaagaacaggc

SEQ ID NO: 4032325 - RNA, 14 nt, Molluscum contagiosum virus
gccagaagugaaau

SEQ ID NO: 4032326 - RNA, 16 nt, Molluscum contagiosum virus
gccagcacgcgcucgu

SEQ ID NO: 4032327 - RNA, 22 nt, Molluscum contagiosum virus
gccagcagcgcccggugcggcg

SEQ ID NO: 4032328 - RNA, 20 nt, Molluscum contagiosum virus
gccagcccgacuucucgcgc

SEQ ID NO: 4032329 - RNA, 13 nt, Molluscum contagiosum virus
gccagccuggagu

SEQ ID NO: 4032330 - RNA, 21 nt, Molluscum contagiosum virus
gccagcgacaccgacgaggug

SEQ ID NO: 4032331 - RNA, 16 nt, Molluscum contagiosum virus
gccuucgcgcugcccg

SEQ ID NO: 4032332 - RNA, 21 nt, Molluscum contagiosum virus
gccuucgcguuccggcggcug

SEQ ID NO: 4032333 - RNA, 15 nt, Molluscum contagiosum virus
gccuucguggagccc

SEQ ID NO: 4032334 - RNA, 16 nt, Molluscum contagiosum virus
gccuucugcaagcugc

SEQ ID NO: 4032335 - RNA, 18 nt, Molluscum contagiosum virus
gccuucugcaagcugccc

SEQ ID NO: 4032336 - RNA, 15 nt, Molluscum contagiosum virus
gccuucuugcuggcg

SEQ ID NO: 4032337 - RNA, 20 nt, Molluscum contagiosum virus
gccuucuugcuggcgcucgc

SEQ ID NO: 4032338 - RNA, 19 nt, Molluscum contagiosum virus
gccuuucgaguccccagac

SEQ ID NO: 4032339 - RNA, 20 nt, Molluscum contagiosum virus
gcgaaaccugggcgccgcgc

SEQ ID NO: 4032340 - RNA, 12 nt, Molluscum contagiosum virus
gcgaaccgcggc

SEQ ID NO: 4032341 - RNA, 14 nt, Molluscum contagiosum virus
gcgaacgcgcaagu

SEQ ID NO: 4032342 - RNA, 12 nt, Molluscum contagiosum virus
gcgaacugcccg

SEQ ID NO: 4032343 - RNA, 21 nt, Molluscum contagiosum virus
gcgaauguccggcgcuggaga

SEQ ID NO: 4032344 - RNA, 22 nt, Molluscum contagiosum virus
gcgaauuggccgcggaggacuc

SEQ ID NO: 4032345 - RNA, 15 nt, Molluscum contagiosum virus
gcgacaacgacagag

SEQ ID NO: 4032346 - RNA, 18 nt, Molluscum contagiosum virus
gcgacacgcccgcguccc

SEQ ID NO: 4032347 - RNA, 18 nt, Molluscum contagiosum virus
gcgacaugcugcccgcgc

SEQ ID NO: 4032348 - RNA, 13 nt, Molluscum contagiosum virus
gcgaccagcucuu

SEQ ID NO: 4032349 - RNA, 13 nt, Molluscum contagiosum virus
gcgaccagcuggu

SEQ ID NO: 4032350 - RNA, 16 nt, Molluscum contagiosum virus
gcgaccagcugguccu

SEQ ID NO: 4032351 - RNA, 14 nt, Molluscum contagiosum virus
gcgacgacagcgac

SEQ ID NO: 4032352 - RNA, 19 nt, Molluscum contagiosum virus
gcgacgagcucacgccgga

SEQ ID NO: 4032353 - RNA, 20 nt, Molluscum contagiosum virus
gcgacgcaaaagaggccugc

SEQ ID NO: 4032354 - RNA, 15 nt, Molluscum contagiosum virus
gcgacgccguccgcg

SEQ ID NO: 4032355 - RNA, 19 nt, Molluscum contagiosum virus
gcgacggaaccguggugcg

SEQ ID NO: 4032356 - RNA, 21 nt, Molluscum contagiosum virus
gcgacgugugcucugugcgcg

SEQ ID NO: 4032357 - RNA, 17 nt, Molluscum contagiosum virus
gcgacguucgagaccag

SEQ ID NO: 4032358 - RNA, 14 nt, Molluscum contagiosum virus
gcgagacgggcacg

SEQ ID NO: 4032359 - RNA, 14 nt, Molluscum contagiosum virus
gcgagacugugccg

SEQ ID NO: 4032360 - RNA, 16 nt, Molluscum contagiosum virus
gcgagacugugccgcu

SEQ ID NO: 4032361 - RNA, 17 nt, Molluscum contagiosum virus
gcgagaucccuccgaga

SEQ ID NO: 4032362 - RNA, 17 nt, Molluscum contagiosum virus
gcgagauucuggcgcgc

SEQ ID NO: 4032363 - RNA, 20 nt, Molluscum contagiosum virus
gcgagcagugugaugccgcg

SEQ ID NO: 4032364 - RNA, 17 nt, Molluscum contagiosum virus
gcgagcaguucgcgcgc

SEQ ID NO: 4032365 - RNA, 19 nt, Molluscum contagiosum virus
gcgagcaguucgcgcgccu

SEQ ID NO: 4032366 - RNA, 13 nt, Molluscum contagiosum virus
gcgagcaugccgc

SEQ ID NO: 4032367 - RNA, 15 nt, Molluscum contagiosum virus
gcgagccagccaggc

SEQ ID NO: 4032368 - RNA, 20 nt, Molluscum contagiosum virus
gcgagcgcaugcgcgccgcg

SEQ ID NO: 4032369 - RNA, 15 nt, Molluscum contagiosum virus
gcgagcgccgcucgc

SEQ ID NO: 4032370 - RNA, 21 nt, Molluscum contagiosum virus
gcgagcgcgucugcucucggc

SEQ ID NO: 4032371 - RNA, 18 nt, Molluscum contagiosum virus
gcgagcguuucugccgga

SEQ ID NO: 4032372 - RNA, 19 nt, Molluscum contagiosum virus
gcgagcuaaucagcgccau

SEQ ID NO: 4032373 - RNA, 15 nt, Molluscum contagiosum virus
gcgagcucaaggaca

SEQ ID NO: 4032374 - RNA, 12 nt, Molluscum contagiosum virus
gcgagcucgaga

SEQ ID NO: 4032375 - RNA, 15 nt, Molluscum contagiosum virus
gcgagcucgucgcgc

SEQ ID NO: 4032376 - RNA, 18 nt, Molluscum contagiosum virus
gcgagcugaggcaacauc

SEQ ID NO: 4032377 - RNA, 18 nt, Molluscum contagiosum virus
gcgaucgcagcagugcca

SEQ ID NO: 4032378 - RNA, 17 nt, Molluscum contagiosum virus
gcgaugaacccgcauug

SEQ ID NO: 4032379 - RNA, 22 nt, Molluscum contagiosum virus
gcgauggaaggcgaccagcugg

SEQ ID NO: 4032380 - RNA, 20 nt, Molluscum contagiosum virus
gcgcaacauguccgcaagca

SEQ ID NO: 4032381 - RNA, 17 nt, Molluscum contagiosum virus
gcgcaaccgcgugcgug

SEQ ID NO: 4032382 - RNA, 13 nt, Molluscum contagiosum virus
gcgcaacgcgggc

SEQ ID NO: 4032383 - RNA, 22 nt, Molluscum contagiosum virus
gcgcaagaugacgacgggagag

SEQ ID NO: 4032384 - RNA, 20 nt, Molluscum contagiosum virus
gcgcaagucaccgcuccgca

SEQ ID NO: 4032385 - RNA, 21 nt, Molluscum contagiosum virus
gcgcaagugugcgcaucccuc

SEQ ID NO: 4032386 - RNA, 14 nt, Molluscum contagiosum virus
gcgcacacgucagc

SEQ ID NO: 4032387 - RNA, 23 nt, Molluscum contagiosum virus
gcgcaccgcguugccgcccgccg

SEQ ID NO: 4032388 - RNA, 19 nt, Molluscum contagiosum virus
gcgcacgaccacgugcagg

SEQ ID NO: 4032389 - RNA, 18 nt, Molluscum contagiosum virus
gcgcacgagcgcgggcgc

SEQ ID NO: 4032390 - RNA, 12 nt, Molluscum contagiosum virus
gcgcacgcagca

SEQ ID NO: 4032391 - RNA, 14 nt, Molluscum contagiosum virus
gcgcacgcagcagg

SEQ ID NO: 4032392 - RNA, 18 nt, Molluscum contagiosum virus
gcgcacgcgagcacgccu

SEQ ID NO: 4032393 - RNA, 18 nt, Molluscum contagiosum virus
gcgcacgcgcacgggccu

SEQ ID NO: 4032394 - RNA, 17 nt, Molluscum contagiosum virus
gcgcacgcuuguccgcg

SEQ ID NO: 4032395 - RNA, 19 nt, Molluscum contagiosum virus
gcgcacgcuugugcgcacg

SEQ ID NO: 4032396 - RNA, 12 nt, Molluscum contagiosum virus
gcgcacggaccu

SEQ ID NO: 4032397 - RNA, 16 nt, Molluscum contagiosum virus
gcgcacgugcgcgccg

SEQ ID NO: 4032398 - RNA, 13 nt, Molluscum contagiosum virus
gcgcacgugcguc

SEQ ID NO: 4032399 - RNA, 18 nt, Molluscum contagiosum virus
gcgcacucgggugcccgg

SEQ ID NO: 4032400 - RNA, 16 nt, Molluscum contagiosum virus
gcgcagacgcggugga

SEQ ID NO: 4032401 - RNA, 23 nt, Molluscum contagiosum virus
gcgcagcaggcacuccagcgcgc

SEQ ID NO: 4032402 - RNA, 20 nt, Molluscum contagiosum virus
gcgcagcaggugcacgugcu

SEQ ID NO: 4032403 - RNA, 13 nt, Molluscum contagiosum virus
gcgcagccacgac

SEQ ID NO: 4032404 - RNA, 17 nt, Molluscum contagiosum virus
gcgcagggagcugcgga

SEQ ID NO: 4032405 - RNA, 19 nt, Molluscum contagiosum virus
gcgcagguagcggcucgcg

SEQ ID NO: 4032406 - RNA, 21 nt, Molluscum contagiosum virus
gcgcagucccagcaccgcgcc

SEQ ID NO: 4032407 - RNA, 17 nt, Molluscum contagiosum virus
gcgcagugcggccagca

SEQ ID NO: 4032408 - RNA, 19 nt, Molluscum contagiosum virus
gcgcagugcggccagcacc

SEQ ID NO: 4032409 - RNA, 23 nt, Molluscum contagiosum virus
gcgcaguucgagcugcugcgcga

SEQ ID NO: 4032410 - RNA, 15 nt, Molluscum contagiosum virus
gcgcauacgcgccgc

SEQ ID NO: 4032411 - RNA, 14 nt, Molluscum contagiosum virus
gcgcaucagagaag

SEQ ID NO: 4032412 - RNA, 18 nt, Molluscum contagiosum virus
gcgcaucagagaagugcu

SEQ ID NO: 4032413 - RNA, 18 nt, Molluscum contagiosum virus
gcgcaucggcggcagcgc

SEQ ID NO: 4032414 - RNA, 20 nt, Molluscum contagiosum virus
gcgcaugcggcaggcgcugc

SEQ ID NO: 4032415 - RNA, 18 nt, Molluscum contagiosum virus
gcgcaugcucgcgcucuc

SEQ ID NO: 4032416 - RNA, 15 nt, Molluscum contagiosum virus
gcgcauucgcgcgcc

SEQ ID NO: 4032417 - RNA, 16 nt, Molluscum contagiosum virus
gcgcauucgcgcgccc

SEQ ID NO: 4032418 - RNA, 20 nt, Molluscum contagiosum virus
gcgcauuuaccggcgcuugc

SEQ ID NO: 4032419 - RNA, 22 nt, Molluscum contagiosum virus
gcgccacgagcgccgcgugcgc

SEQ ID NO: 4032420 - RNA, 17 nt, Molluscum contagiosum virus
gcgcccaacgcccgcgc

SEQ ID NO: 4032421 - RNA, 18 nt, Molluscum contagiosum virus
gcgcccaaggccgcgggc

SEQ ID NO: 4032422 - RNA, 13 nt, Molluscum contagiosum virus
gcgcccaccagca

SEQ ID NO: 4032423 - RNA, 13 nt, Molluscum contagiosum virus
gcgcccacgggcu

SEQ ID NO: 4032424 - RNA, 14 nt, Molluscum contagiosum virus
gcgcccgacgagcu

SEQ ID NO: 4032425 - RNA, 16 nt, Molluscum contagiosum virus
gcgcccgacgagcuug

SEQ ID NO: 4032426 - RNA, 13 nt, Molluscum contagiosum virus
gcgcccgacucgc

SEQ ID NO: 4032427 - RNA, 13 nt, Molluscum contagiosum virus
gcgcccgccagca

SEQ ID NO: 4032428 - RNA, 16 nt, Molluscum contagiosum virus
gcgcccggcgcccgca

SEQ ID NO: 4032429 - RNA, 15 nt, Molluscum contagiosum virus
gcgcccucgcgcgcg

SEQ ID NO: 4032430 - RNA, 22 nt, Molluscum contagiosum virus
gcgcccuggagcgcagucccag

SEQ ID NO: 4032431 - RNA, 21 nt, Molluscum contagiosum virus
gcgccgacaugcgcacgcgcg

SEQ ID NO: 4032432 - RNA, 16 nt, Molluscum contagiosum virus
gcgccgaggacgcgcc

SEQ ID NO: 4032433 - RNA, 14 nt, Molluscum contagiosum virus
gcgccgaugcagug

SEQ ID NO: 4032434 - RNA, 15 nt, Molluscum contagiosum virus
gcucgccgcacgcga

SEQ ID NO: 4032435 - RNA, 14 nt, Molluscum contagiosum virus
gcucgccgcgcgcc

SEQ ID NO: 4032436 - RNA, 23 nt, Molluscum contagiosum virus
gcucgcgacgugcgcgcugcgcg

SEQ ID NO: 4032437 - RNA, 14 nt, Molluscum contagiosum virus
gcucgcgagugugc

SEQ ID NO: 4032438 - RNA, 18 nt, Molluscum contagiosum virus
gcucgcgcaaguccagcg

SEQ ID NO: 4032439 - RNA, 20 nt, Molluscum contagiosum virus
gcucgcgcaaguccagcgcg

SEQ ID NO: 4032440 - RNA, 12 nt, Molluscum contagiosum virus
gcucgcgcgcau

SEQ ID NO: 4032441 - RNA, 16 nt, Molluscum contagiosum virus
gcucgcgcucgggaag

SEQ ID NO: 4032442 - RNA, 14 nt, Molluscum contagiosum virus
gcucgcgugccgcg

SEQ ID NO: 4032443 - RNA, 18 nt, Molluscum contagiosum virus
gcucgcuaaucugccgcg

SEQ ID NO: 4032444 - RNA, 21 nt, Molluscum contagiosum virus
gcucgcuuagccaacagcgca

SEQ ID NO: 4032445 - RNA, 13 nt, Molluscum contagiosum virus
gcucgcuugcccg

SEQ ID NO: 4032446 - RNA, 23 nt, Molluscum contagiosum virus
gcucgcuugccggcggcgcaagc

SEQ ID NO: 4032447 - RNA, 16 nt, Molluscum contagiosum virus
gcucggaagagcgucc

SEQ ID NO: 4032448 - RNA, 15 nt, Molluscum contagiosum virus
gcucggacacacgca

SEQ ID NO: 4032449 - RNA, 17 nt, Molluscum contagiosum virus
gcucggacacacgcacc

SEQ ID NO: 4032450 - RNA, 14 nt, Molluscum contagiosum virus
gcucggaggcgcag

SEQ ID NO: 4032451 - RNA, 16 nt, Molluscum contagiosum virus
gcucggcugccgugcg

SEQ ID NO: 4032452 - RNA, 20 nt, Molluscum contagiosum virus
gcucgggccggcgcgccgcg

SEQ ID NO: 4032453 - RNA, 18 nt, Molluscum contagiosum virus
gcucggguuccagcuccg

SEQ ID NO: 4032454 - RNA, 21 nt, Molluscum contagiosum virus
gcucggugucgguaccugcag

SEQ ID NO: 4032455 - RNA, 16 nt, Molluscum contagiosum virus
gcucgguuggcggcgc

SEQ ID NO: 4032456 - RNA, 16 nt, Molluscum contagiosum virus
gcucguggacagccug

SEQ ID NO: 4032457 - RNA, 17 nt, Molluscum contagiosum virus
gcucgugguugcgcacg

SEQ ID NO: 4032458 - RNA, 17 nt, Molluscum contagiosum virus
gcucguguugugccugc

SEQ ID NO: 4032459 - RNA, 19 nt, Molluscum contagiosum virus
gcucuacgagacucuggaa

SEQ ID NO: 4032460 - RNA, 14 nt, Molluscum contagiosum virus
gcucuacgccagcg

SEQ ID NO: 4032461 - RNA, 20 nt, Molluscum contagiosum virus
gcucuacggcgaguucugcc

SEQ ID NO: 4032462 - RNA, 16 nt, Molluscum contagiosum virus
gcucucgcugcugccc

SEQ ID NO: 4032463 - RNA, 22 nt, Molluscum contagiosum virus
gcucugcgugcuugugcgccug

SEQ ID NO: 4032464 - RNA, 20 nt, Molluscum contagiosum virus
gcucugucccgcaagccaca

SEQ ID NO: 4032465 - RNA, 23 nt, Molluscum contagiosum virus
gcugaaggcauaccugugccagc

SEQ ID NO: 4032466 - RNA, 17 nt, Molluscum contagiosum virus
gcugaccgagcgugggc

SEQ ID NO: 4032467 - RNA, 16 nt, Molluscum contagiosum virus
gcugagcccuuugaug

SEQ ID NO: 4032468 - RNA, 19 nt, Molluscum contagiosum virus
gcugagcgcggagcuggcg

SEQ ID NO: 4032469 - RNA, 14 nt, Molluscum contagiosum virus
gcugagcgggguac

SEQ ID NO: 4032470 - RNA, 16 nt, Molluscum contagiosum virus
gcugagcuagugccga

SEQ ID NO: 4032471 - RNA, 20 nt, Molluscum contagiosum virus
gcugagcuagugccgagcuc

SEQ ID NO: 4032472 - RNA, 19 nt, Molluscum contagiosum virus
gcugaguuacguggccgcg

SEQ ID NO: 4032473 - RNA, 21 nt, Molluscum contagiosum virus
gcugaucaccgaggagccgcg

SEQ ID NO: 4032474 - RNA, 22 nt, Molluscum contagiosum virus
gcugcaaagcgcggccgcgcuc

SEQ ID NO: 4032475 - RNA, 16 nt, Molluscum contagiosum virus
gcugcaaggcgcgcgc

SEQ ID NO: 4032476 - RNA, 18 nt, Molluscum contagiosum virus
gcugcaauaacaacgacc

SEQ ID NO: 4032477 - RNA, 14 nt, Molluscum contagiosum virus
gcugcacgugcagc

SEQ ID NO: 4032478 - RNA, 18 nt, Molluscum contagiosum virus
gcugcacgugcagcggcg

SEQ ID NO: 4032479 - RNA, 18 nt, Molluscum contagiosum virus
gcugcaggaccugcuggu

SEQ ID NO: 4032480 - RNA, 14 nt, Molluscum contagiosum virus
gcugcccccgccgc

SEQ ID NO: 4032481 - RNA, 14 nt, Molluscum contagiosum virus
gcugcccgugcccg

SEQ ID NO: 4032482 - RNA, 20 nt, Molluscum contagiosum virus
gcugcccuuuagcguggcgc

SEQ ID NO: 4032483 - RNA, 14 nt, Molluscum contagiosum virus
gcugccgcagagcc

SEQ ID NO: 4032484 - RNA, 15 nt, Molluscum contagiosum virus
gcugccgcugcgcga

SEQ ID NO: 4032485 - RNA, 20 nt, Molluscum contagiosum virus
gcugcgcgacaugcugcccg

SEQ ID NO: 4032486 - RNA, 18 nt, Molluscum contagiosum virus
gcugcgcgacgaggaggc

SEQ ID NO: 4032487 - RNA, 21 nt, Molluscum contagiosum virus
gcugcgcgacgucgucaagga

SEQ ID NO: 4032488 - RNA, 18 nt, Molluscum contagiosum virus
gcugcgcgagcgcgcgcu

SEQ ID NO: 4032489 - RNA, 15 nt, Molluscum contagiosum virus
gcugcgcgcccaggc

SEQ ID NO: 4032490 - RNA, 13 nt, Molluscum contagiosum virus
gcugcgcgccgcg

SEQ ID NO: 4032491 - RNA, 13 nt, Molluscum contagiosum virus
gcugcgcuaccac

SEQ ID NO: 4032492 - RNA, 16 nt, Molluscum contagiosum virus
gcugcgcuggaugcug

SEQ ID NO: 4032493 - RNA, 23 nt, Molluscum contagiosum virus
gcugcggacgcgggccgcgcgca

SEQ ID NO: 4032494 - RNA, 17 nt, Molluscum contagiosum virus
gcugcggcaacugccug

SEQ ID NO: 4032495 - RNA, 13 nt, Molluscum contagiosum virus
gcugcggcgcucg

SEQ ID NO: 4032496 - RNA, 20 nt, Molluscum contagiosum virus
gcugcggcucuacccggagg

SEQ ID NO: 4032497 - RNA, 23 nt, Molluscum contagiosum virus
gcugcgguagcggacgcggugac

SEQ ID NO: 4032498 - RNA, 15 nt, Molluscum contagiosum virus
gcugcuccccgccag

SEQ ID NO: 4032499 - RNA, 15 nt, Molluscum contagiosum virus
gcugcuccugcucug

SEQ ID NO: 4032500 - RNA, 17 nt, Molluscum contagiosum virus
gcugcucgacgggcgca

SEQ ID NO: 4032501 - RNA, 19 nt, Molluscum contagiosum virus
gcugcucgacgggcgcagc

SEQ ID NO: 4032502 - RNA, 20 nt, Molluscum contagiosum virus
gcugcucgugcugcucugcg

SEQ ID NO: 4032503 - RNA, 16 nt, Molluscum contagiosum virus
gcugcucucggcagcg

SEQ ID NO: 4032504 - RNA, 16 nt, Molluscum contagiosum virus
gcugcucugcgugcuu

SEQ ID NO: 4032505 - RNA, 17 nt, Molluscum contagiosum virus
gcugcugcccggcagcg

SEQ ID NO: 4032506 - RNA, 14 nt, Molluscum contagiosum virus
gcugcugcucgcac

SEQ ID NO: 4032507 - RNA, 22 nt, Molluscum contagiosum virus
gcugcuggccaacccucgcaag

SEQ ID NO: 4032508 - RNA, 17 nt, Molluscum contagiosum virus
gcugcuggcccugcuag

SEQ ID NO: 4032509 - RNA, 17 nt, Molluscum contagiosum virus
gcugcuggcggugcucu

SEQ ID NO: 4032510 - RNA, 21 nt, Molluscum contagiosum virus
gcugcuggugcucgccugcau

SEQ ID NO: 4032511 - RNA, 17 nt, Molluscum contagiosum virus
gcugcugguucugcucg

SEQ ID NO: 4032512 - RNA, 20 nt, Molluscum contagiosum virus
gcugcuuccgcaccuggucg

SEQ ID NO: 4032513 - RNA, 22 nt, Molluscum contagiosum virus
gcuggagaacggcgugcgagug

SEQ ID NO: 4032514 - RNA, 21 nt, Molluscum contagiosum virus
gcuggagcgagugcgcgugcg

SEQ ID NO: 4032515 - RNA, 17 nt, Molluscum contagiosum virus
gcuggagcugccgcugc

SEQ ID NO: 4032516 - RNA, 12 nt, Molluscum contagiosum virus
gcuggcacgcga

SEQ ID NO: 4032517 - RNA, 18 nt, Molluscum contagiosum virus
gcuggcccugcuagugcg

SEQ ID NO: 4032518 - RNA, 15 nt, Molluscum contagiosum virus
gcuggccucugccug

SEQ ID NO: 4032519 - RNA, 16 nt, Molluscum contagiosum virus
gcuggcgcgcugcgug

SEQ ID NO: 4032520 - RNA, 23 nt, Molluscum contagiosum virus
gcuggcgcguccguucacgggca

SEQ ID NO: 4032521 - RNA, 14 nt, Molluscum contagiosum virus
gcuggcggcgcacg

SEQ ID NO: 4032522 - RNA, 15 nt, Molluscum contagiosum virus
gcuggcggggaaagc

SEQ ID NO: 4032523 - RNA, 13 nt, Molluscum contagiosum virus
gcuggcggugcuc

SEQ ID NO: 4032524 - RNA, 18 nt, Molluscum contagiosum virus
gcugggcgguugccugca

SEQ ID NO: 4032525 - RNA, 15 nt, Molluscum contagiosum virus
gcuggugggcgugcg

SEQ ID NO: 4032526 - RNA, 16 nt, Molluscum contagiosum virus
gcugguggugcuggag

SEQ ID NO: 4032527 - RNA, 14 nt, Molluscum contagiosum virus
gcugguucugcucg

SEQ ID NO: 4032528 - RNA, 18 nt, Molluscum contagiosum virus
gcugguucugcucgcagg

SEQ ID NO: 4032529 - RNA, 14 nt, Molluscum contagiosum virus
gcuguaccuggugc

SEQ ID NO: 4032530 - RNA, 18 nt, Molluscum contagiosum virus
gcuguccuucugguuccu

SEQ ID NO: 4032531 - RNA, 19 nt, Molluscum contagiosum virus
gcugucgcgcagcagcuac

SEQ ID NO: 4032532 - RNA, 20 nt, Molluscum contagiosum virus
gcugugcccgcggcguuccc

SEQ ID NO: 4032533 - RNA, 14 nt, Molluscum contagiosum virus
gcugugcgagccag

SEQ ID NO: 4032534 - RNA, 14 nt, Molluscum contagiosum virus
gcuguggacaugau

SEQ ID NO: 4032535 - RNA, 18 nt, Molluscum contagiosum virus
gcuguugcugcugccgcg

SEQ ID NO: 4032536 - RNA, 13 nt, Molluscum contagiosum virus
gcuguuucugccg

SEQ ID NO: 4032537 - RNA, 21 nt, Molluscum contagiosum virus
ugcgcucggaggggcuccggg

SEQ ID NO: 4032538 - RNA, 16 nt, Molluscum contagiosum virus
ugcgcuucgccgcgcg

SEQ ID NO: 4032539 - RNA, 16 nt, Molluscum contagiosum virus
ugcgcuucggcuccca

SEQ ID NO: 4032540 - RNA, 18 nt, Molluscum contagiosum virus
ugcgcuugggcgucgucu

SEQ ID NO: 4032541 - RNA, 11 nt, Molluscum contagiosum virus
ugcggacaugc

SEQ ID NO: 4032542 - RNA, 20 nt, Molluscum contagiosum virus
ugcggacgcaggaugcuggg

SEQ ID NO: 4032543 - RNA, 16 nt, Molluscum contagiosum virus
ugcggacgcgggccgc

SEQ ID NO: 4032544 - RNA, 18 nt, Molluscum contagiosum virus
ugcggaugugcuagcugc

SEQ ID NO: 4032545 - RNA, 19 nt, Molluscum contagiosum virus
ugcggcaacugccugcgcu

SEQ ID NO: 4032546 - RNA, 16 nt, Molluscum contagiosum virus
ugcggcacgggcucga

SEQ ID NO: 4032547 - RNA, 17 nt, Molluscum contagiosum virus
ugcggcacgggcucgag

SEQ ID NO: 4032548 - RNA, 13 nt, Molluscum contagiosum virus
ugcggcaggcgcu

SEQ ID NO: 4032549 - RNA, 18 nt, Molluscum contagiosum virus
ugcggcaggcgcugcgcg

SEQ ID NO: 4032550 - RNA, 23 nt, Molluscum contagiosum virus
ugcggcgcgggcaagcagggccu

SEQ ID NO: 4032551 - RNA, 20 nt, Molluscum contagiosum virus
ugcggcgcgugccgcugcgc

SEQ ID NO: 4032552 - RNA, 17 nt, Molluscum contagiosum virus
ugcggcgcgugcugagc

SEQ ID NO: 4032553 - RNA, 15 nt, Molluscum contagiosum virus
ugcggcggcgcacgc

SEQ ID NO: 4032554 - RNA, 17 nt, Molluscum contagiosum virus
ugcgggcgcaggcccgc

SEQ ID NO: 4032555 - RNA, 17 nt, Molluscum contagiosum virus
ugcgggcuagcacgcau

SEQ ID NO: 4032556 - RNA, 20 nt, Molluscum contagiosum virus
ugcgggucucggggcuccgc

SEQ ID NO: 4032557 - RNA, 15 nt, Molluscum contagiosum virus
ugcgguacaugcugu

SEQ ID NO: 4032558 - RNA, 20 nt, Molluscum contagiosum virus
ugcggugacgguccugcgcg

SEQ ID NO: 4032559 - RNA, 22 nt, Molluscum contagiosum virus
ugcguagagcaaaggaagagcc

SEQ ID NO: 4032560 - RNA, 13 nt, Molluscum contagiosum virus
ugcgucccagcag

SEQ ID NO: 4032561 - RNA, 16 nt, Molluscum contagiosum virus
ugcgugacccucuucg

SEQ ID NO: 4032562 - RNA, 15 nt, Molluscum contagiosum virus
ugcgugccccucgug

SEQ ID NO: 4032563 - RNA, 15 nt, Molluscum contagiosum virus
ugcgugcgcugcgcg

SEQ ID NO: 4032564 - RNA, 17 nt, Molluscum contagiosum virus
ugcguguuggcuucugc

SEQ ID NO: 4032565 - RNA, 22 nt, Molluscum contagiosum virus
ugcguuggcgccagccuggcgg

SEQ ID NO: 4032566 - RNA, 14 nt, Molluscum contagiosum virus
ugcuacaggacguc

SEQ ID NO: 4032567 - RNA, 19 nt, Molluscum contagiosum virus
ugcuagagcauauccugau

SEQ ID NO: 4032568 - RNA, 16 nt, Molluscum contagiosum virus
ugcucaagcaccugcg

SEQ ID NO: 4032569 - RNA, 16 nt, Molluscum contagiosum virus
ugcucacgcugcgcuc

SEQ ID NO: 4032570 - RNA, 15 nt, Molluscum contagiosum virus
ugcucaugcgcaagc

SEQ ID NO: 4032571 - RNA, 13 nt, Molluscum contagiosum virus
ugcucccucucga

SEQ ID NO: 4032572 - RNA, 17 nt, Molluscum contagiosum virus
ugcuccugcucuguugc

SEQ ID NO: 4032573 - RNA, 23 nt, Molluscum contagiosum virus
ugcucgagauucguggcgagcau

SEQ ID NO: 4032574 - RNA, 17 nt, Molluscum contagiosum virus
ugcucgccagcagguuc

SEQ ID NO: 4032575 - RNA, 20 nt, Molluscum contagiosum virus
ugcucgcggagggcagcauc

SEQ ID NO: 4032576 - RNA, 22 nt, Molluscum contagiosum virus
ugcucuacuggcggcgcccgug

SEQ ID NO: 4032577 - RNA, 22 nt, Molluscum contagiosum virus
ugcucuacuuccacgagcugac

SEQ ID NO: 4032578 - RNA, 22 nt, Molluscum contagiosum virus
ugcugcaguaugaaucuacggc

SEQ ID NO: 4032579 - RNA, 18 nt, Molluscum contagiosum virus
ugcugccaauaccaggcc

SEQ ID NO: 4032580 - RNA, 20 nt, Molluscum contagiosum virus
ugcugccgggagaggaaagg

SEQ ID NO: 4032581 - RNA, 20 nt, Molluscum contagiosum virus
ugcugccucccaagcagcgc

SEQ ID NO: 4032582 - RNA, 15 nt, Molluscum contagiosum virus
ugcugcgcagcaucc

SEQ ID NO: 4032583 - RNA, 16 nt, Molluscum contagiosum virus
ugcugcgcuacaugua

SEQ ID NO: 4032584 - RNA, 17 nt, Molluscum contagiosum virus
ugcugcgcuacauguau

SEQ ID NO: 4032585 - RNA, 23 nt, Molluscum contagiosum virus
ugcuggaacgcuuggcgggcagc

SEQ ID NO: 4032586 - RNA, 15 nt, Molluscum contagiosum virus
ugcuggacgcgcacg

SEQ ID NO: 4032587 - RNA, 15 nt, Molluscum contagiosum virus
ugcuggagggcacgc

SEQ ID NO: 4032588 - RNA, 22 nt, Molluscum contagiosum virus
ugcuggcgcucgcgcgcacgcg

SEQ ID NO: 4032589 - RNA, 17 nt, Molluscum contagiosum virus
ugcuggcggggcuggca

SEQ ID NO: 4032590 - RNA, 14 nt, Molluscum contagiosum virus
ugcugucccucugu

SEQ ID NO: 4032591 - RNA, 13 nt, Molluscum contagiosum virus
ugcuuccuccucc

SEQ ID NO: 4032592 - RNA, 15 nt, Molluscum contagiosum virus
ugcuuccuccuccaa

SEQ ID NO: 4032593 - RNA, 14 nt, Molluscum contagiosum virus
ugcuucugcgcugg

SEQ ID NO: 4032594 - RNA, 11 nt, Molluscum contagiosum virus
ugcuugcuucc

SEQ ID NO: 4032595 - RNA, 16 nt, Molluscum contagiosum virus
ugcuugugcgccugug

SEQ ID NO: 4032596 - RNA, 20 nt, Molluscum contagiosum virus
uggaacggcgacuuguagug

SEQ ID NO: 4032597 - RNA, 15 nt, Molluscum contagiosum virus
uggaaggcgaccagc

SEQ ID NO: 4032598 - RNA, 16 nt, Molluscum contagiosum virus
uggacagcaagcagcg

SEQ ID NO: 4032599 - RNA, 17 nt, Molluscum contagiosum virus
uggacagcaagcagcgc

SEQ ID NO: 4032600 - RNA, 20 nt, Molluscum contagiosum virus
uggaccgguuccgugcgcuc

SEQ ID NO: 4032601 - RNA, 19 nt, Molluscum contagiosum virus
uggacgacaugcugugcgg

SEQ ID NO: 4032602 - RNA, 14 nt, Molluscum contagiosum virus
uggacgagcagagc

SEQ ID NO: 4032603 - RNA, 19 nt, Molluscum contagiosum virus
uggacgaugguggcgcugc

SEQ ID NO: 4032604 - RNA, 21 nt, Molluscum contagiosum virus
uggacgaugguggcgcugcug

SEQ ID NO: 4032605 - RNA, 19 nt, Molluscum contagiosum virus
uggacgccguugcgcguga

SEQ ID NO: 4032606 - RNA, 11 nt, Molluscum contagiosum virus
uggacgcgcac

SEQ ID NO: 4032607 - RNA, 20 nt, Molluscum contagiosum virus
uggacgcgccgcgcgagugc

SEQ ID NO: 4032608 - RNA, 17 nt, Molluscum contagiosum virus
uggacgucgcggccacg

SEQ ID NO: 4032609 - RNA, 19 nt, Molluscum contagiosum virus
uggacgugcugcuggcccu

SEQ ID NO: 4032610 - RNA, 22 nt, Molluscum contagiosum virus
uggacgugggcgaacugcccgg

SEQ ID NO: 4032611 - RNA, 16 nt, Molluscum contagiosum virus
uggacuccgaggcagg

SEQ ID NO: 4032612 - RNA, 12 nt, Molluscum contagiosum virus
uggacugagccg

SEQ ID NO: 4032613 - RNA, 16 nt, Molluscum contagiosum virus
uggacuucaggauggc

SEQ ID NO: 4032614 - RNA, 21 nt, Molluscum contagiosum virus
uggacuuuggcgugaccaugg

SEQ ID NO: 4032615 - RNA, 17 nt, Molluscum contagiosum virus
uggagaucgacaagauc

SEQ ID NO: 4032616 - RNA, 19 nt, Molluscum contagiosum virus
uggagcaagcgcguucgcg

SEQ ID NO: 4032617 - RNA, 21 nt, Molluscum contagiosum virus
uggagcagacguacgagcagg

SEQ ID NO: 4032618 - RNA, 14 nt, Molluscum contagiosum virus
uggagcccgugcug

SEQ ID NO: 4032619 - RNA, 19 nt, Molluscum contagiosum virus
uggagccucccccgcgcac

SEQ ID NO: 4032620 - RNA, 18 nt, Molluscum contagiosum virus
uggagcgagugcgcgugc

SEQ ID NO: 4032621 - RNA, 12 nt, Molluscum contagiosum virus
uggaggagccgc

SEQ ID NO: 4032622 - RNA, 17 nt, Molluscum contagiosum virus
uggagggcacgcugcac

SEQ ID NO: 4032623 - RNA, 22 nt, Molluscum contagiosum virus
uggagggcagugccaagguucu

SEQ ID NO: 4032624 - RNA, 17 nt, Molluscum contagiosum virus
uggagggucacgcgcac

SEQ ID NO: 4032625 - RNA, 22 nt, Molluscum contagiosum virus
uggaguccaugcccacgcgcaa

SEQ ID NO: 4032626 - RNA, 21 nt, Molluscum contagiosum virus
uggcacccuggcugcugcgcg

SEQ ID NO: 4032627 - RNA, 23 nt, Molluscum contagiosum virus
uggcaccgcgcgcgcuccgagac

SEQ ID NO: 4032628 - RNA, 18 nt, Molluscum contagiosum virus
uggcacggccggcgccgc

SEQ ID NO: 4032629 - RNA, 19 nt, Molluscum contagiosum virus
uggcacggccggcgccgcg

SEQ ID NO: 4032630 - RNA, 22 nt, Molluscum contagiosum virus
uggcaugcgcccucacgugcug

SEQ ID NO: 4032631 - RNA, 21 nt, Molluscum contagiosum virus
uggccaagcgcuccaacuucc

SEQ ID NO: 4032632 - RNA, 15 nt, Molluscum contagiosum virus
uggccagccucaucg

SEQ ID NO: 4032633 - RNA, 13 nt, Molluscum contagiosum virus
uggccgagccgcu

SEQ ID NO: 4032634 - RNA, 15 nt, Molluscum contagiosum virus
uggcgagcgcugccg

SEQ ID NO: 4032635 - RNA, 14 nt, Molluscum contagiosum virus
uggcgccugcgcgc

SEQ ID NO: 4032636 - RNA, 21 nt, Molluscum contagiosum virus
uggcgcugcacaguucacggc

SEQ ID NO: 4032637 - RNA, 15 nt, Molluscum contagiosum virus
uggcgcugggcgcgc

SEQ ID NO: 4032638 - RNA, 21 nt, Molluscum contagiosum virus
uggcgcugggcgcgccgcgcg

SEQ ID NO: 4032639 - RNA, 11 nt, Molluscum contagiosum virus
cgccugcuggc

SEQ ID NO: 4032640 - RNA, 13 nt, Molluscum contagiosum virus
cgccuuccugcug

SEQ ID NO: 4032641 - RNA, 14 nt, Molluscum contagiosum virus
cgccuucugccugc

SEQ ID NO: 4032642 - RNA, 15 nt, Molluscum contagiosum virus
cgccuugccgaggag

SEQ ID NO: 4032643 - RNA, 13 nt, Molluscum contagiosum virus
cgcgaaacuggac

SEQ ID NO: 4032644 - RNA, 20 nt, Molluscum contagiosum virus
cgcgaaacuggacugagccg

SEQ ID NO: 4032645 - RNA, 22 nt, Molluscum contagiosum virus
cgcgaaagcgucgugcuccacg

SEQ ID NO: 4032646 - RNA, 20 nt, Molluscum contagiosum virus
cgcgaacgaggagggcagcc

SEQ ID NO: 4032647 - RNA, 19 nt, Molluscum contagiosum virus
cgcgaauuggccgcggagg

SEQ ID NO: 4032648 - RNA, 22 nt, Molluscum contagiosum virus
ucgcguccacgaugcgcucgug

SEQ ID NO: 4032649 - RNA, 18 nt, Molluscum contagiosum virus
ucgcugcgcaggugcacg

SEQ ID NO: 4032650 - RNA, 17 nt, Molluscum contagiosum virus
ucgcugcuccccgccag

SEQ ID NO: 4032651 - RNA, 22 nt, Molluscum contagiosum virus
ucgcugcuccccgccagcacca

SEQ ID NO: 4032652 - RNA, 23 nt, Molluscum contagiosum virus
ucgcuugccggcggcgcaagcac

SEQ ID NO: 4032653 - RNA, 20 nt, Molluscum contagiosum virus
ucggacggaggucugcuuug

SEQ ID NO: 4032654 - RNA, 15 nt, Molluscum contagiosum virus
ucggaggcugcuccc

SEQ ID NO: 4032655 - RNA, 13 nt, Molluscum contagiosum virus
ucggaugcgcugc

SEQ ID NO: 4032656 - RNA, 21 nt, Molluscum contagiosum virus
ucggcacaucucucagggcag

SEQ ID NO: 4032657 - RNA, 12 nt, Molluscum contagiosum virus
ucggcaccgcgc

SEQ ID NO: 4032658 - RNA, 12 nt, Molluscum contagiosum virus
ucggcacugcuc

SEQ ID NO: 4032659 - RNA, 14 nt, Molluscum contagiosum virus
ucggcaugcagcgc

SEQ ID NO: 4032660 - RNA, 12 nt, Molluscum contagiosum virus
ucggccagcagc

SEQ ID NO: 4032661 - RNA, 17 nt, Molluscum contagiosum virus
ucggcgacacgcccgcg

SEQ ID NO: 4032662 - RNA, 22 nt, Molluscum contagiosum virus
ucggcgcuacgcacuucacggc

SEQ ID NO: 4032663 - RNA, 15 nt, Molluscum contagiosum virus
ucggcggcaugcgcg

SEQ ID NO: 4032664 - RNA, 22 nt, Molluscum contagiosum virus
ucggcggcaugcgcgcgcagca

SEQ ID NO: 4032665 - RNA, 13 nt, Molluscum contagiosum virus
ucggcguacgugc

SEQ ID NO: 4032666 - RNA, 15 nt, Molluscum contagiosum virus
ucggcguggccaggc

SEQ ID NO: 4032667 - RNA, 16 nt, Molluscum contagiosum virus
ucggcguuggccacga

SEQ ID NO: 4032668 - RNA, 15 nt, Molluscum contagiosum virus
ucgggaagcccucag

SEQ ID NO: 4032669 - RNA, 16 nt, Molluscum contagiosum virus
ucgggccccugcgcga

SEQ ID NO: 4032670 - RNA, 19 nt, Molluscum contagiosum virus
ucgggccgcugccgucgcg

SEQ ID NO: 4032671 - RNA, 18 nt, Molluscum contagiosum virus
ucggggcccucggcgcgc

SEQ ID NO: 4032672 - RNA, 16 nt, Molluscum contagiosum virus
ucggguacacgugcuu

SEQ ID NO: 4032673 - RNA, 14 nt, Molluscum contagiosum virus
ucggugcucaugcg

SEQ ID NO: 4032674 - RNA, 16 nt, Molluscum contagiosum virus
ucggugcucaugcgcg

SEQ ID NO: 4032675 - RNA, 16 nt, Molluscum contagiosum virus
ucguccggcgcucgcc

SEQ ID NO: 4032676 - RNA, 15 nt, Molluscum contagiosum virus
ucgucgagcacgaag

SEQ ID NO: 4032677 - RNA, 21 nt, Molluscum contagiosum virus
ucgugcaaagcaucgacgugc

SEQ ID NO: 4032678 - RNA, 16 nt, Molluscum contagiosum virus
ucgugcccgcacacgc

SEQ ID NO: 4032679 - RNA, 20 nt, Molluscum contagiosum virus
ucgugccgccugcgcgcacc

SEQ ID NO: 4032680 - RNA, 21 nt, Molluscum contagiosum virus
ucgugccgccugcgcgcaccc

SEQ ID NO: 4032681 - RNA, 16 nt, Molluscum contagiosum virus
ucgugccugucucgca

SEQ ID NO: 4032682 - RNA, 20 nt, Molluscum contagiosum virus
ucgugccuuuugcgcgcugc

SEQ ID NO: 4032683 - RNA, 12 nt, Molluscum contagiosum virus
ucgugcgcgacu

SEQ ID NO: 4032684 - RNA, 23 nt, Molluscum contagiosum virus
ucgugcgcgacuuggggcucgcc

SEQ ID NO: 4032685 - RNA, 21 nt, Molluscum contagiosum virus
ucguggcguugcugcugcgcg

SEQ ID NO: 4032686 - RNA, 23 nt, Molluscum contagiosum virus
ucgugguugcgcacguuggccac

SEQ ID NO: 4032687 - RNA, 15 nt, Molluscum contagiosum virus
ucgugugcgcgcacg

SEQ ID NO: 4032688 - RNA, 19 nt, Molluscum contagiosum virus
ucguguguccgcacgcaca

SEQ ID NO: 4032689 - RNA, 20 nt, Molluscum contagiosum virus
ucguuugcucggggcugucg

SEQ ID NO: 4032690 - RNA, 18 nt, Molluscum contagiosum virus
ucuaagcgcacgcgcgac

SEQ ID NO: 4032691 - RNA, 15 nt, Molluscum contagiosum virus
ucuacgaggagcacg

SEQ ID NO: 4032692 - RNA, 22 nt, Molluscum contagiosum virus
ucuacgccagcgacgcgacgcc

SEQ ID NO: 4032693 - RNA, 16 nt, Molluscum contagiosum virus
ucucagcggcacugcg

SEQ ID NO: 4032694 - RNA, 21 nt, Molluscum contagiosum virus
ucucagggcagcgaaaaguag

SEQ ID NO: 4032695 - RNA, 15 nt, Molluscum contagiosum virus
ucucagggugguuug

SEQ ID NO: 4032696 - RNA, 12 nt, Molluscum contagiosum virus
ucuccacaaaga

SEQ ID NO: 4032697 - RNA, 13 nt, Molluscum contagiosum virus
ucuccaggaacgc

SEQ ID NO: 4032698 - RNA, 15 nt, Molluscum contagiosum virus
ucuccgaccgugccc

SEQ ID NO: 4032699 - RNA, 21 nt, Molluscum contagiosum virus
ucuccgcgcugcacuacaacc

SEQ ID NO: 4032700 - RNA, 18 nt, Molluscum contagiosum virus
ucuccgcgggcagccgcu

SEQ ID NO: 4032701 - RNA, 18 nt, Molluscum contagiosum virus
ucuccggaggccgcuccc

SEQ ID NO: 4032702 - RNA, 22 nt, Molluscum contagiosum virus
ucuccuccuugauuucgcgcag

SEQ ID NO: 4032703 - RNA, 16 nt, Molluscum contagiosum virus
ucucgagacgcugccu

SEQ ID NO: 4032704 - RNA, 20 nt, Molluscum contagiosum virus
ucucgcagacgcagcgcgag

SEQ ID NO: 4032705 - RNA, 20 nt, Molluscum contagiosum virus
ucucgcgcgggcagggcgac

SEQ ID NO: 4032706 - RNA, 20 nt, Molluscum contagiosum virus
ucucguucgcgaccuggcgc

SEQ ID NO: 4032707 - RNA, 13 nt, Molluscum contagiosum virus
ucucugcauguuu

SEQ ID NO: 4032708 - RNA, 13 nt, Molluscum contagiosum virus
ucucugcccucag

SEQ ID NO: 4032709 - RNA, 19 nt, Molluscum contagiosum virus
ucugaaaggacaugggcac

SEQ ID NO: 4032710 - RNA, 20 nt, Molluscum contagiosum virus
ucugacacuugcggcgcuag

SEQ ID NO: 4032711 - RNA, 20 nt, Molluscum contagiosum virus
ucugcaaggccuguccgacg

SEQ ID NO: 4032712 - RNA, 13 nt, Molluscum contagiosum virus
ucugcagcgccgc

SEQ ID NO: 4032713 - RNA, 19 nt, Molluscum contagiosum virus
gucuccacgcgugcgcgcc

SEQ ID NO: 4032714 - RNA, 12 nt, Molluscum contagiosum virus
gucucgcgcgcc

SEQ ID NO: 4032715 - RNA, 15 nt, Molluscum contagiosum virus
gucucgcgcucgccu

SEQ ID NO: 4032716 - RNA, 16 nt, Molluscum contagiosum virus
gucucggggcuccgcc

SEQ ID NO: 4032717 - RNA, 15 nt, Molluscum contagiosum virus
gucucugcgcagagc

SEQ ID NO: 4032718 - RNA, 21 nt, Molluscum contagiosum virus
gucucugcgcgagcagcugcu

SEQ ID NO: 4032719 - RNA, 16 nt, Molluscum contagiosum virus
gucugaccgcgggcac

SEQ ID NO: 4032720 - RNA, 20 nt, Molluscum contagiosum virus
gucugcuuugucugcaggca

SEQ ID NO: 4032721 - RNA, 20 nt, Molluscum contagiosum virus
gucuggcucguacugcugca

SEQ ID NO: 4032722 - RNA, 13 nt, Molluscum contagiosum virus
gucugugcgcgag

SEQ ID NO: 4032723 - RNA, 21 nt, Molluscum contagiosum virus
gucuucgcguagucagggccu

SEQ ID NO: 4032724 - RNA, 20 nt, Molluscum contagiosum virus
gucuucuuguugugcuuuga

SEQ ID NO: 4032725 - RNA, 15 nt, Molluscum contagiosum virus
gucuugcgcagcgcc

SEQ ID NO: 4032726 - RNA, 17 nt, Molluscum contagiosum virus
gugaaucugacacuugc

SEQ ID NO: 4032727 - RNA, 14 nt, Molluscum contagiosum virus
gugacacgagccgu

SEQ ID NO: 4032728 - RNA, 22 nt, Molluscum contagiosum virus
gugaccauggacacgcugcgcg

SEQ ID NO: 4032729 - RNA, 17 nt, Molluscum contagiosum virus
gugaccauuacuucugu

SEQ ID NO: 4032730 - RNA, 19 nt, Molluscum contagiosum virus
gugacgcugcaagacggaa

SEQ ID NO: 4032731 - RNA, 21 nt, Molluscum contagiosum virus
gugcaagagcucguggacagc

SEQ ID NO: 4032732 - RNA, 21 nt, Molluscum contagiosum virus
gugcaauuccguccagugaaa

SEQ ID NO: 4032733 - RNA, 19 nt, Molluscum contagiosum virus
gugcacgcacgcgcgggca

SEQ ID NO: 4032734 - RNA, 20 nt, Molluscum contagiosum virus
gugcacgcggcgcgugucgc

SEQ ID NO: 4032735 - RNA, 16 nt, Molluscum contagiosum virus
gugcagcgcgugcgca

SEQ ID NO: 4032736 - RNA, 16 nt, Molluscum contagiosum virus
gugcagcggcgccacg

SEQ ID NO: 4032737 - RNA, 17 nt, Molluscum contagiosum virus
gugcauacgcagaggcg

SEQ ID NO: 4032738 - RNA, 21 nt, Molluscum contagiosum virus
gugcaugacggcgcgagccag

SEQ ID NO: 4032739 - RNA, 13 nt, Molluscum contagiosum virus
gugcauggcacgc

SEQ ID NO: 4032740 - RNA, 20 nt, Molluscum contagiosum virus
gugccagagucgccgcugcg

SEQ ID NO: 4032741 - RNA, 21 nt, Molluscum contagiosum virus
gugccagagucgccgcugcgc

SEQ ID NO: 4032742 - RNA, 20 nt, Molluscum contagiosum virus
gugccagcguacggcccgaa

SEQ ID NO: 4032743 - RNA, 15 nt, Molluscum contagiosum virus
gugccaucucgcaca

SEQ ID NO: 4032744 - RNA, 17 nt, Molluscum contagiosum virus
gugcccaugcucgagcc

SEQ ID NO: 4032745 - RNA, 15 nt, Molluscum contagiosum virus
gugcccgccaagagc

SEQ ID NO: 4032746 - RNA, 13 nt, Molluscum contagiosum virus
gugcccgcgcgcu

SEQ ID NO: 4032747 - RNA, 17 nt, Molluscum contagiosum virus
gugccgaggcgcugccg

SEQ ID NO: 4032748 - RNA, 17 nt, Molluscum contagiosum virus
gugccgccgcgcgcgcc

SEQ ID NO: 4032749 - RNA, 14 nt, Molluscum contagiosum virus
gugccgccgugggc

SEQ ID NO: 4032750 - RNA, 18 nt, Molluscum contagiosum virus
gugccgcucggaggcuug

SEQ ID NO: 4032751 - RNA, 22 nt, Molluscum contagiosum virus
gugccgcugcgcuggaugcugc

SEQ ID NO: 4032752 - RNA, 16 nt, Molluscum contagiosum virus
gugccguccccgcgcu

SEQ ID NO: 4032753 - RNA, 18 nt, Molluscum contagiosum virus
gugccugcaagaggcgcu

SEQ ID NO: 4032754 - RNA, 19 nt, Molluscum contagiosum virus
gugccugccaucuacgagc

SEQ ID NO: 4032755 - RNA, 21 nt, Molluscum contagiosum virus
gugccuggcguccgcacgcac

SEQ ID NO: 4032756 - RNA, 18 nt, Molluscum contagiosum virus
gugcgaaggcucgagcug

SEQ ID NO: 4032757 - RNA, 12 nt, Molluscum contagiosum virus
gugcgaagggcu

SEQ ID NO: 4032758 - RNA, 13 nt, Molluscum contagiosum virus
gugcgagcacgag

SEQ ID NO: 4032759 - RNA, 17 nt, Molluscum contagiosum virus
gugcgcaaagcaacugc

SEQ ID NO: 4032760 - RNA, 16 nt, Molluscum contagiosum virus
gugcgcaccagcugca

SEQ ID NO: 4032761 - RNA, 19 nt, Molluscum contagiosum virus
gugcgcagcauucccggcg

SEQ ID NO: 4032762 - RNA, 23 nt, Molluscum contagiosum virus
gugcgcaucccugcgcaccugca

SEQ ID NO: 4032763 - RNA, 19 nt, Molluscum contagiosum virus
gugcgccgccgcaggcccg

SEQ ID NO: 4032764 - RNA, 17 nt, Molluscum contagiosum virus
gugcgccucgcaggcga

SEQ ID NO: 4032765 - RNA, 21 nt, Molluscum contagiosum virus
gugcgccucggacuucgacgc

SEQ ID NO: 4032766 - RNA, 16 nt, Molluscum contagiosum virus
gugcgccugcagccug

SEQ ID NO: 4032767 - RNA, 14 nt, Molluscum contagiosum virus
gugcgccugugcug

SEQ ID NO: 4032768 - RNA, 16 nt, Molluscum contagiosum virus
gugcgccuucgucacg

SEQ ID NO: 4032769 - RNA, 14 nt, Molluscum contagiosum virus
gugcgcgacgggcu

SEQ ID NO: 4032770 - RNA, 14 nt, Molluscum contagiosum virus
gugcgcgcacggcu

SEQ ID NO: 4032771 - RNA, 14 nt, Molluscum contagiosum virus
gugcgcgcugcacg

SEQ ID NO: 4032772 - RNA, 18 nt, Molluscum contagiosum virus
gugcgcgcugcgcgcgcu

SEQ ID NO: 4032773 - RNA, 19 nt, Molluscum contagiosum virus
gugcgcgcugcgcgcgcuc

SEQ ID NO: 4032774 - RNA, 16 nt, Molluscum contagiosum virus
gugcgcgugcgccugc

SEQ ID NO: 4032775 - RNA, 12 nt, Molluscum contagiosum virus
gugcggagagcc

SEQ ID NO: 4032776 - RNA, 24 nt, Molluscum contagiosum virus
gugcggagggugcacgcgggcgcc

SEQ ID NO: 4032777 - RNA, 19 nt, Molluscum contagiosum virus
gugcggccaccagcgcggc

SEQ ID NO: 4032778 - RNA, 23 nt, Molluscum contagiosum virus
gugcgucacguacucgcugcucc

SEQ ID NO: 4032779 - RNA, 16 nt, Molluscum contagiosum virus
gugcgugccaggcgua

SEQ ID NO: 4032780 - RNA, 18 nt, Molluscum contagiosum virus
gugcgugguguccacgcg

SEQ ID NO: 4032781 - RNA, 13 nt, Molluscum contagiosum virus
gugcucaggccag

SEQ ID NO: 4032782 - RNA, 17 nt, Molluscum contagiosum virus
gugcuccacgcgcagcu

SEQ ID NO: 4032783 - RNA, 12 nt, Molluscum contagiosum virus
gugcucggcgug

SEQ ID NO: 4032784 - RNA, 20 nt, Molluscum contagiosum virus
gugcucuucggggacggcgu

SEQ ID NO: 4032785 - RNA, 21 nt, Molluscum contagiosum virus
gugcugaagacgcuggccgug

SEQ ID NO: 4032786 - RNA, 13 nt, Molluscum contagiosum virus
gugcugcgccacg

SEQ ID NO: 4032787 - RNA, 16 nt, Molluscum contagiosum virus
gugcuggagcagggcu

SEQ ID NO: 4032788 - RNA, 21 nt, Molluscum contagiosum virus
gugcuggagggcacgcugcac

SEQ ID NO: 4032789 - RNA, 22 nt, Molluscum contagiosum virus
gugcuggucaagaacaugugcu

SEQ ID NO: 4032790 - RNA, 16 nt, Molluscum contagiosum virus
gugcuguugccgcgcu

SEQ ID NO: 4032791 - RNA, 14 nt, Molluscum contagiosum virus
gugcuugccuggaa

SEQ ID NO: 4032792 - RNA, 16 nt, Molluscum contagiosum virus
gugcuugcgcacggac

SEQ ID NO: 4032793 - RNA, 17 nt, Molluscum contagiosum virus
guggacgaugguggcgc

SEQ ID NO: 4032794 - RNA, 23 nt, Molluscum contagiosum virus
guggacgcgcgagugugugcauc

SEQ ID NO: 4032795 - RNA, 20 nt, Molluscum contagiosum virus
guggaggcgacuggcgacac

SEQ ID NO: 4032796 - RNA, 13 nt, Molluscum contagiosum virus
guggcaagggcuc

SEQ ID NO: 4032797 - RNA, 17 nt, Molluscum contagiosum virus
guggcacccuggcugcu

SEQ ID NO: 4032798 - RNA, 20 nt, Molluscum contagiosum virus
guggcacccuggcugcugcg

SEQ ID NO: 4032799 - RNA, 11 nt, Molluscum contagiosum virus
guggccacagc

SEQ ID NO: 4032800 - RNA, 14 nt, Molluscum contagiosum virus
guggccuacguggc

SEQ ID NO: 4032801 - RNA, 20 nt, Molluscum contagiosum virus
guggcgcacacggacgagcc

SEQ ID NO: 4032802 - RNA, 14 nt, Molluscum contagiosum virus
guggcgcaccugcu

SEQ ID NO: 4032803 - RNA, 14 nt, Molluscum contagiosum virus
guggcgcugggcgc

SEQ ID NO: 4032804 - RNA, 15 nt, Molluscum contagiosum virus
guggcgcuuggcgag

SEQ ID NO: 4032805 - RNA, 21 nt, Molluscum contagiosum virus
guggcguccgcacgaggagcc

SEQ ID NO: 4032806 - RNA, 20 nt, Molluscum contagiosum virus
guggcguugcugcugcgcgc

SEQ ID NO: 4032807 - RNA, 14 nt, Molluscum contagiosum virus
guggucaagacugg

SEQ ID NO: 4032808 - RNA, 16 nt, Molluscum contagiosum virus
guggugacucgccgug

SEQ ID NO: 4032809 - RNA, 12 nt, Molluscum contagiosum virus
guggugcgcgac

SEQ ID NO: 4032810 - RNA, 17 nt, Molluscum contagiosum virus
guggugcucguggaaaa

SEQ ID NO: 4032811 - RNA, 18 nt, Molluscum contagiosum virus
gugguggccaagauccug

SEQ ID NO: 4032812 - RNA, 14 nt, Molluscum contagiosum virus
guguacaaagagcu

SEQ ID NO: 4032813 - RNA, 15 nt, Molluscum contagiosum virus
guguaccgccgcggc

SEQ ID NO: 4032814 - RNA, 15 nt, Molluscum contagiosum virus
gugucgagcucgcgc

SEQ ID NO: 4032815 - RNA, 14 nt, Molluscum contagiosum virus
gugugagucgcccu

SEQ ID NO: 4032816 - RNA, 21 nt, Molluscum contagiosum virus
gugugcgcgcugcacgccgcc

SEQ ID NO: 4032817 - RNA, 22 nt, Molluscum contagiosum virus
guguggcuugcgggacagagcu

SEQ ID NO: 4032818 - RNA, 16 nt, Molluscum contagiosum virus
guguucccggcugccg

SEQ ID NO: 4032819 - RNA, 13 nt, Molluscum contagiosum virus
guguuggccaggc

SEQ ID NO: 4032820 - RNA, 23 nt, Molluscum contagiosum virus
guguuuuuuuuguuuggacccau

SEQ ID NO: 4032821 - RNA, 14 nt, Molluscum contagiosum virus
guuacggagaccug

SEQ ID NO: 4032822 - RNA, 16 nt, Molluscum contagiosum virus
guucacggcgcucgcc

SEQ ID NO: 4032823 - RNA, 15 nt, Molluscum contagiosum virus
guuccagcagcgcca

SEQ ID NO: 4032824 - RNA, 14 nt, Molluscum contagiosum virus
guucccauggaugc

SEQ ID NO: 4032825 - RNA, 19 nt, Molluscum contagiosum virus
guuccggacgugcacgcac

SEQ ID NO: 4032826 - RNA, 15 nt, Molluscum contagiosum virus
guuccuggugugcca

SEQ ID NO: 4032827 - RNA, 16 nt, Molluscum contagiosum virus
guuccuggugugccag

SEQ ID NO: 4032828 - RNA, 14 nt, Molluscum contagiosum virus
guucgacaaggacg

SEQ ID NO: 4032829 - RNA, 22 nt, Molluscum contagiosum virus
guucgagaagacggggcgcacg

SEQ ID NO: 4032830 - RNA, 24 nt, Molluscum contagiosum virus
guucgagaagacggggcgcacgcc

SEQ ID NO: 4032831 - RNA, 14 nt, Molluscum contagiosum virus
guucgagcugcugc

SEQ ID NO: 4032832 - RNA, 14 nt, Molluscum contagiosum virus
guucugaauaaucu

SEQ ID NO: 4032833 - RNA, 22 nt, Molluscum contagiosum virus
guucugaauaaucucgagcagg

SEQ ID NO: 4032834 - RNA, 15 nt, Molluscum contagiosum virus
guucugcgcgccgcu

SEQ ID NO: 4032835 - RNA, 16 nt, Molluscum contagiosum virus
guucugcgcgccgcuc

SEQ ID NO: 4032836 - RNA, 15 nt, Molluscum contagiosum virus
guucugcgcugccag

SEQ ID NO: 4032837 - RNA, 14 nt, Molluscum contagiosum virus
guucugcucgcagg

SEQ ID NO: 4032838 - RNA, 20 nt, Molluscum contagiosum virus
guucuggacguguccgacgc

SEQ ID NO: 4032839 - RNA, 17 nt, Molluscum contagiosum virus
guucuucgcagaggaca

SEQ ID NO: 4032840 - RNA, 19 nt, Molluscum contagiosum virus
guucuucgcagaggacagc

SEQ ID NO: 4032841 - RNA, 11 nt, Molluscum contagiosum virus
guugccaggca

SEQ ID NO: 4032842 - RNA, 13 nt, Molluscum contagiosum virus
guugccaggcaca

SEQ ID NO: 4032843 - RNA, 17 nt, Molluscum contagiosum virus
guugccaggcacacgca

SEQ ID NO: 4032844 - RNA, 23 nt, Molluscum contagiosum virus
guugccaggcacacgcagugcca

SEQ ID NO: 4032845 - RNA, 22 nt, Molluscum contagiosum virus
guugccgcgcgcugcucuggag

SEQ ID NO: 4032846 - RNA, 13 nt, Molluscum contagiosum virus
guugccgugccca

SEQ ID NO: 4032847 - RNA, 19 nt, Molluscum contagiosum virus
guugcgagccagccaggcg

SEQ ID NO: 4032848 - RNA, 12 nt, Molluscum contagiosum virus
guugcgcgcgcc

SEQ ID NO: 4032849 - RNA, 17 nt, Molluscum contagiosum virus
guugcguuggcgccagc

SEQ ID NO: 4032850 - RNA, 18 nt, Molluscum contagiosum virus
guugcguuggcgccagcc

SEQ ID NO: 4032851 - RNA, 18 nt, Molluscum contagiosum virus
guuggcacccuucugagg

SEQ ID NO: 4032852 - RNA, 18 nt, Molluscum contagiosum virus
guuggcgccagccuggcg

SEQ ID NO: 4032853 - RNA, 23 nt, Molluscum contagiosum virus
guuguucguacucaacaagcugc

SEQ ID NO: 4032854 - RNA, 18 nt, Molluscum contagiosum virus
guuuacgcucggcugccg

SEQ ID NO: 4032855 - RNA, 17 nt, Molluscum contagiosum virus
guuuacguccacgcgcc

SEQ ID NO: 4032856 - RNA, 21 nt, Molluscum contagiosum virus
guuugacgcccggugccuggc

SEQ ID NO: 4032857 - RNA, 22 nt, Molluscum contagiosum virus
guuugcacccgcgcagcgugcc

SEQ ID NO: 4032858 - RNA, 20 nt, Molluscum contagiosum virus
guuugccacggccgcgcgcg

SEQ ID NO: 4032859 - RNA, 21 nt, Molluscum contagiosum virus
guuugcggaugcucgcuugcc

SEQ ID NO: 4032860 - RNA, 17 nt, Molluscum contagiosum virus
guuuucacgcaaggaag

SEQ ID NO: 4032861 - RNA, 16 nt, Molluscum contagiosum virus
guuuuguguuggccag

SEQ ID NO: 4032862 - RNA, 22 nt, Molluscum contagiosum virus
uaaacaaacgugcaugcacaua

SEQ ID NO: 4032863 - RNA, 15 nt, Molluscum contagiosum virus
uaaacgcggugagug

SEQ ID NO: 4032864 - RNA, 17 nt, Molluscum contagiosum virus
uaaagaagcggugcagc

SEQ ID NO: 4032865 - RNA, 16 nt, Molluscum contagiosum virus
uaacgugauccgagac

SEQ ID NO: 4032866 - RNA, 12 nt, Molluscum contagiosum virus
uaacuauguucu

SEQ ID NO: 4032867 - RNA, 18 nt, Molluscum contagiosum virus
uaagcgccccgagcacgu

SEQ ID NO: 4032868 - RNA, 16 nt, Molluscum contagiosum virus
uaauugaaaggcagaa

SEQ ID NO: 4032869 - RNA, 18 nt, Molluscum contagiosum virus
uacacgcgcuuugucgcg

SEQ ID NO: 4032870 - RNA, 14 nt, Molluscum contagiosum virus
uacagcgcgcugca

SEQ ID NO: 4032871 - RNA, 22 nt, Molluscum contagiosum virus
uaccagcucgucaacggugcgc

SEQ ID NO: 4032872 - RNA, 13 nt, Molluscum contagiosum virus
uacccgcaggaaa

SEQ ID NO: 4032873 - RNA, 15 nt, Molluscum contagiosum virus
uaccggcucaagaac

SEQ ID NO: 4032874 - RNA, 18 nt, Molluscum contagiosum virus
uaccugcaggaggaccgc

SEQ ID NO: 4032875 - RNA, 14 nt, Molluscum contagiosum virus
uaccugcgcaagcu

SEQ ID NO: 4032876 - RNA, 19 nt, Molluscum contagiosum virus
uaccuguguuucguacgcg

SEQ ID NO: 4032877 - RNA, 17 nt, Molluscum contagiosum virus
uacgagacucuggaagc

SEQ ID NO: 4032878 - RNA, 22 nt, Molluscum contagiosum virus
uacgagccgcuguccgaggacu

SEQ ID NO: 4032879 - RNA, 14 nt, Molluscum contagiosum virus
uacgcgccggggcg

SEQ ID NO: 4032880 - RNA, 18 nt, Molluscum contagiosum virus
uacgcgcgcgugcugcua

SEQ ID NO: 4032881 - RNA, 17 nt, Molluscum contagiosum virus
uacgcggcgggguccuc

SEQ ID NO: 4032882 - RNA, 14 nt, Molluscum contagiosum virus
uacucaacaagcug

SEQ ID NO: 4032883 - RNA, 19 nt, Molluscum contagiosum virus
uacugcagcagcuccucca

SEQ ID NO: 4032884 - RNA, 23 nt, Molluscum contagiosum virus
uacugcgcgcguugccugagaag

SEQ ID NO: 4032885 - RNA, 20 nt, Molluscum contagiosum virus
uacuucaucuucaagccgca

SEQ ID NO: 4032886 - RNA, 17 nt, Molluscum contagiosum virus
uacuuggaagagucgcg

SEQ ID NO: 4032887 - RNA, 13 nt, Molluscum contagiosum virus
uagaccuccuugc

SEQ ID NO: 4032888 - RNA, 18 nt, Molluscum contagiosum virus
uagacugucgacagagaa

SEQ ID NO: 4032889 - RNA, 15 nt, Molluscum contagiosum virus
uagaggagauggcaa

SEQ ID NO: 4032890 - RNA, 16 nt, Molluscum contagiosum virus
uagcaaaugcgcugcu

SEQ ID NO: 4032891 - RNA, 10 nt, Molluscum contagiosum virus
uagcagagca

SEQ ID NO: 4032892 - RNA, 20 nt, Molluscum contagiosum virus
uagcagcgugcgcaccagcu

SEQ ID NO: 4032893 - RNA, 17 nt, Molluscum contagiosum virus
uagcagcuucuuggagc

SEQ ID NO: 4032894 - RNA, 13 nt, Molluscum contagiosum virus
uagcccagcacgc

SEQ ID NO: 4032895 - RNA, 17 nt, Molluscum contagiosum virus
uagccgcgacgcaagcg

SEQ ID NO: 4032896 - RNA, 19 nt, Molluscum contagiosum virus
uagcgcgccgcaaagcuca

SEQ ID NO: 4032897 - RNA, 18 nt, Molluscum contagiosum virus
uagcgcgcgugugcaugg

SEQ ID NO: 4032898 - RNA, 21 nt, Molluscum contagiosum virus
uagcgugagagcaaagaaugc

SEQ ID NO: 4032899 - RNA, 16 nt, Molluscum contagiosum virus
uagcguugguaacaag

SEQ ID NO: 4032900 - RNA, 19 nt, Molluscum contagiosum virus
uagcucgugccugucggca

SEQ ID NO: 4032901 - RNA, 21 nt, Molluscum contagiosum virus
uaggcacacacgaacgcacgc

SEQ ID NO: 4032902 - RNA, 15 nt, Molluscum contagiosum virus
uagguacccgcaacc

SEQ ID NO: 4032903 - RNA, 14 nt, Molluscum contagiosum virus
uaguagcgcucgcc

SEQ ID NO: 4032904 - RNA, 19 nt, Molluscum contagiosum virus
uaguagcgcucgcccagcu

SEQ ID NO: 4032905 - RNA, 12 nt, Molluscum contagiosum virus
uauacuccaaaa

SEQ ID NO: 4032906 - RNA, 20 nt, Molluscum contagiosum virus
uauacuccccgcgcgcgugc

SEQ ID NO: 4032907 - RNA, 22 nt, Molluscum contagiosum virus
uaugcgaagcgucgagccccug

SEQ ID NO: 4032908 - RNA, 15 nt, Molluscum contagiosum virus
ucaaauauugugcau

SEQ ID NO: 4032909 - RNA, 19 nt, Molluscum contagiosum virus
ucaacaagcugcuggcaca

SEQ ID NO: 4032910 - RNA, 22 nt, Molluscum contagiosum virus
ucaaccccucggaggaaaagca

SEQ ID NO: 4032911 - RNA, 14 nt, Molluscum contagiosum virus
ucaaccugcugccu

SEQ ID NO: 4032912 - RNA, 22 nt, Molluscum contagiosum virus
ucaacgcgauggcgcagcuccu

SEQ ID NO: 4032913 - RNA, 19 nt, Molluscum contagiosum virus
ucaacgcgcgcgugcuguc

SEQ ID NO: 4032914 - RNA, 17 nt, Molluscum contagiosum virus
ucaacggcacagucugg

SEQ ID NO: 4032915 - RNA, 19 nt, Molluscum contagiosum virus
ucaacuccgagcgcgcgcg

SEQ ID NO: 4032916 - RNA, 18 nt, Molluscum contagiosum virus
ucaacuguugccuggagg

SEQ ID NO: 4032917 - RNA, 15 nt, Molluscum contagiosum virus
ucaacuucgcgcugu

SEQ ID NO: 4032918 - RNA, 19 nt, Molluscum contagiosum virus
ucaagauccaagcgcaaca

SEQ ID NO: 4032919 - RNA, 15 nt, Molluscum contagiosum virus
ucaagcaccugcgcu

SEQ ID NO: 4032920 - RNA, 21 nt, Molluscum contagiosum virus
ucaagcacggcuuccggcacc

SEQ ID NO: 4032921 - RNA, 19 nt, Molluscum contagiosum virus
ucaagcuggcaacgcagau

SEQ ID NO: 4032922 - RNA, 18 nt, Molluscum contagiosum virus
ucacaagcaccgccugcu

SEQ ID NO: 4032923 - RNA, 17 nt, Molluscum contagiosum virus
ucaccccgcugggccgc

SEQ ID NO: 4032924 - RNA, 16 nt, Molluscum contagiosum virus
ucaccuuccugggcgg

SEQ ID NO: 4032925 - RNA, 19 nt, Molluscum contagiosum virus
ucaccuucggaacugcgga

SEQ ID NO: 4032926 - RNA, 17 nt, Molluscum contagiosum virus
ucacgcguccacaaaga

SEQ ID NO: 4032927 - RNA, 15 nt, Molluscum contagiosum virus
ucacgcuagcgggcc

SEQ ID NO: 4032928 - RNA, 17 nt, Molluscum contagiosum virus
ucacggagcgcgcgcag

SEQ ID NO: 4032929 - RNA, 22 nt, Molluscum contagiosum virus
ucacggcaaacgccacuggguc

SEQ ID NO: 4032930 - RNA, 16 nt, Molluscum contagiosum virus
ucacggccuucgcgcu

SEQ ID NO: 4032931 - RNA, 23 nt, Molluscum contagiosum virus
ucacggcgacaacgacagagccc

SEQ ID NO: 4032932 - RNA, 18 nt, Molluscum contagiosum virus
ucacgucaauggcgcgcg

SEQ ID NO: 4032933 - RNA, 22 nt, Molluscum contagiosum virus
ucacgugcugaucacgcucgcg

SEQ ID NO: 4032934 - RNA, 18 nt, Molluscum contagiosum virus
ucacgugcuugcccgacc

SEQ ID NO: 4032935 - RNA, 22 nt, Molluscum contagiosum virus
ucacuucucggaagcgcccgug

SEQ ID NO: 4032936 - RNA, 13 nt, Molluscum contagiosum virus
ucacuuucgcgcg

SEQ ID NO: 4032937 - RNA, 23 nt, Molluscum contagiosum virus
ucagaaauacaccggcuuggcca

SEQ ID NO: 4032938 - RNA, 13 nt, Molluscum contagiosum virus
ucagccgagcgcc

SEQ ID NO: 4032939 - RNA, 17 nt, Molluscum contagiosum virus
ucagccucugugcggcg

SEQ ID NO: 4032940 - RNA, 13 nt, Molluscum contagiosum virus
ucagcgcgcgcag

SEQ ID NO: 4032941 - RNA, 16 nt, Molluscum contagiosum virus
ucaggagcauggccgc

SEQ ID NO: 4032942 - RNA, 19 nt, Molluscum contagiosum virus
ucaggcaagaggggagcca

SEQ ID NO: 4032943 - RNA, 16 nt, Molluscum contagiosum virus
ucagguacguguccac

SEQ ID NO: 4032944 - RNA, 23 nt, Molluscum contagiosum virus
ucaguuuuguccuccccacgaga

SEQ ID NO: 4032945 - RNA, 13 nt, Molluscum contagiosum virus
ucaucgcggagcu

SEQ ID NO: 4032946 - RNA, 13 nt, Molluscum contagiosum virus
ucauggugcccau

SEQ ID NO: 4032947 - RNA, 17 nt, Molluscum contagiosum virus
uccaacuuccacgucuc

SEQ ID NO: 4032948 - RNA, 23 nt, Molluscum contagiosum virus
uccaagaacaauacaaacaacaa

SEQ ID NO: 4032949 - RNA, 14 nt, Molluscum contagiosum virus
uccaagaagaggcc

SEQ ID NO: 4032950 - RNA, 17 nt, Molluscum contagiosum virus
uccaagaagaggccagc

SEQ ID NO: 4032951 - RNA, 21 nt, Molluscum contagiosum virus
uccacaaagcccuccugagaa

SEQ ID NO: 4032952 - RNA, 20 nt, Molluscum contagiosum virus
uccacauuacgcucguggaa

SEQ ID NO: 4032953 - RNA, 12 nt, Molluscum contagiosum virus
uccaccugcgca

SEQ ID NO: 4032954 - RNA, 16 nt, Molluscum contagiosum virus
uccaccugcgcaacgu

SEQ ID NO: 4032955 - RNA, 20 nt, Molluscum contagiosum virus
uccacgauggaacggcgacu

SEQ ID NO: 4032956 - RNA, 16 nt, Molluscum contagiosum virus
uccacgccuucgugga

SEQ ID NO: 4032957 - RNA, 14 nt, Molluscum contagiosum virus
uccacgcgcgugag

SEQ ID NO: 4032958 - RNA, 20 nt, Molluscum contagiosum virus
uccacgcugcguucgagcug

SEQ ID NO: 4032959 - RNA, 23 nt, Molluscum contagiosum virus
uccacggguaccgugcgcgugag

SEQ ID NO: 4032960 - RNA, 12 nt, Molluscum contagiosum virus
uccagcgcauca

SEQ ID NO: 4032961 - RNA, 17 nt, Molluscum contagiosum virus
uccaggcgccgcaccuc

SEQ ID NO: 4032962 - RNA, 17 nt, Molluscum contagiosum virus
uccaggugcugggcgag

SEQ ID NO: 4032963 - RNA, 16 nt, Molluscum contagiosum virus
uccaugcgcgcgcgau

SEQ ID NO: 4032964 - RNA, 16 nt, Molluscum contagiosum virus
ucccaagacucugccg

SEQ ID NO: 4032965 - RNA, 14 nt, Molluscum contagiosum virus
ucccaggaagacgu

SEQ ID NO: 4032966 - RNA, 13 nt, Molluscum contagiosum virus
uccccaagaccug

SEQ ID NO: 4032967 - RNA, 16 nt, Molluscum contagiosum virus
uccccgaacugcuggg

SEQ ID NO: 4032968 - RNA, 17 nt, Molluscum contagiosum virus
uccccgaacugcugggc

SEQ ID NO: 4032969 - RNA, 16 nt, Molluscum contagiosum virus
uccccgccagcaccau

SEQ ID NO: 4032970 - RNA, 22 nt, Molluscum contagiosum virus
uccccgcgcucacugcagcagc

SEQ ID NO: 4032971 - RNA, 15 nt, Molluscum contagiosum virus
uccccgcgggccgcc

SEQ ID NO: 4032972 - RNA, 13 nt, Molluscum contagiosum virus
ucccgcgcuccga

SEQ ID NO: 4032973 - RNA, 21 nt, Molluscum contagiosum virus
ucccgcggccgccacuguugc

SEQ ID NO: 4032974 - RNA, 19 nt, Molluscum contagiosum virus
ucccgggcggcgcgccgcg

SEQ ID NO: 4032975 - RNA, 15 nt, Molluscum contagiosum virus
ucccucgucgcgcuu

SEQ ID NO: 4032976 - RNA, 22 nt, Molluscum contagiosum virus
ucccugcauacacuuccugcua

SEQ ID NO: 4032977 - RNA, 16 nt, Molluscum contagiosum virus
uccgaaaaaggcccgg

SEQ ID NO: 4032978 - RNA, 20 nt, Molluscum contagiosum virus
uccgacuccuuccggagaca

SEQ ID NO: 4032979 - RNA, 22 nt, Molluscum contagiosum virus
uccgagcgaaccgcggcagccu

SEQ ID NO: 4032980 - RNA, 20 nt, Molluscum contagiosum virus
uccgaggaaacgcagcacuu

SEQ ID NO: 4032981 - RNA, 21 nt, Molluscum contagiosum virus
uccgaggacgacgccgagccc

SEQ ID NO: 4032982 - RNA, 18 nt, Molluscum contagiosum virus
uccgaugugagcaagcug

SEQ ID NO: 4032983 - RNA, 18 nt, Molluscum contagiosum virus
uccgcaauucuagcgcga

SEQ ID NO: 4032984 - RNA, 19 nt, Molluscum contagiosum virus
uccgcacagagggacagca

SEQ ID NO: 4032985 - RNA, 20 nt, Molluscum contagiosum virus
uccgcacuuuaaaaggccgg

SEQ ID NO: 4032986 - RNA, 20 nt, Molluscum contagiosum virus
uccgcgacguccuagagcag

SEQ ID NO: 4032987 - RNA, 19 nt, Molluscum contagiosum virus
uccgcguacagcgcgcgug

SEQ ID NO: 4032988 - RNA, 17 nt, Molluscum contagiosum virus
uccggaugaacagcuuc

SEQ ID NO: 4032989 - RNA, 12 nt, Molluscum contagiosum virus
uccggcagcgcc

SEQ ID NO: 4032990 - RNA, 22 nt, Molluscum contagiosum virus
uccggccuguaaauggaccaca

SEQ ID NO: 4032991 - RNA, 20 nt, Molluscum contagiosum virus
uccggcgcucgccccuuccc

SEQ ID NO: 4032992 - RNA, 14 nt, Molluscum contagiosum virus
uccggcgcucgccu

SEQ ID NO: 4032993 - RNA, 15 nt, Molluscum contagiosum virus
uccggcgcuggagaa

SEQ ID NO: 4032994 - RNA, 15 nt, Molluscum contagiosum virus
uccggcggcuggacc

SEQ ID NO: 4032995 - RNA, 22 nt, Molluscum contagiosum virus
uccgggcacguccgccucggaa

SEQ ID NO: 4032996 - RNA, 14 nt, Molluscum contagiosum virus
uccgggcgcuccga

SEQ ID NO: 4032997 - RNA, 12 nt, Molluscum contagiosum virus
uccgggcgcugc

SEQ ID NO: 4032998 - RNA, 20 nt, Molluscum contagiosum virus
uccgucacggacagcagcuc

SEQ ID NO: 4032999 - RNA, 17 nt, Molluscum contagiosum virus
uccgugcccacgagcgc

SEQ ID NO: 4033000 - RNA, 21 nt, Molluscum contagiosum virus
uccuacgaguugagccguucu

SEQ ID NO: 4033001 - RNA, 13 nt, Molluscum contagiosum virus
uccuccagggcac

SEQ ID NO: 4033002 - RNA, 18 nt, Molluscum contagiosum virus
uccucgcuccgcagcagg

SEQ ID NO: 4033003 - RNA, 19 nt, Molluscum contagiosum virus
uccucucacgcccucucga

SEQ ID NO: 4033004 - RNA, 15 nt, Molluscum contagiosum virus
uccuggggcuggaca

SEQ ID NO: 4033005 - RNA, 16 nt, Molluscum contagiosum virus
uccuggggcuggacag

SEQ ID NO: 4033006 - RNA, 14 nt, Molluscum contagiosum virus
uccuguccucucga

SEQ ID NO: 4033007 - RNA, 18 nt, Molluscum contagiosum virus
uccuucugguuccugcgc

SEQ ID NO: 4033008 - RNA, 20 nt, Molluscum contagiosum virus
uccuucuucaaguaccuguc

SEQ ID NO: 4033009 - RNA, 12 nt, Molluscum contagiosum virus
uccuuguccugg

SEQ ID NO: 4033010 - RNA, 19 nt, Molluscum contagiosum virus
ucgaacaccuccugcuuug

SEQ ID NO: 4033011 - RNA, 15 nt, Molluscum contagiosum virus
ucgaacgcgcgugcg

SEQ ID NO: 4033012 - RNA, 17 nt, Molluscum contagiosum virus
ucgaacgcgcgugcgcg

SEQ ID NO: 4033013 - RNA, 13 nt, Molluscum contagiosum virus
ucgaagaggucuc

SEQ ID NO: 4033014 - RNA, 19 nt, Molluscum contagiosum virus
ucgaaggagcccgucuaca

SEQ ID NO: 4033015 - RNA, 15 nt, Molluscum contagiosum virus
ucgacacugugcugg

SEQ ID NO: 4033016 - RNA, 17 nt, Molluscum contagiosum virus
ucgacccuucgcgcgcg

SEQ ID NO: 4033017 - RNA, 22 nt, Molluscum contagiosum virus
ucgacgacgaugacaucuggag

SEQ ID NO: 4033018 - RNA, 17 nt, Molluscum contagiosum virus
ucgacgagugcgccgcg

SEQ ID NO: 4033019 - RNA, 21 nt, Molluscum contagiosum virus
ucgacgcggugcgcgcgugcg

SEQ ID NO: 4033020 - RNA, 16 nt, Molluscum contagiosum virus
ucgacgggcgcagcca

SEQ ID NO: 4033021 - RNA, 11 nt, Molluscum contagiosum virus
ugccagcagca

SEQ ID NO: 4033022 - RNA, 19 nt, Molluscum contagiosum virus
ugccagcgccagccugcug

SEQ ID NO: 4033023 - RNA, 18 nt, Molluscum contagiosum virus
ugccagcggcgccgcagc

SEQ ID NO: 4033024 - RNA, 18 nt, Molluscum contagiosum virus
ugccaggcggucuuccag

SEQ ID NO: 4033025 - RNA, 21 nt, Molluscum contagiosum virus
ugcccaugcucgagccugcca

SEQ ID NO: 4033026 - RNA, 22 nt, Molluscum contagiosum virus
ugcccauguccuuucagacagc

SEQ ID NO: 4033027 - RNA, 13 nt, Molluscum contagiosum virus
ugcccccgaggug

SEQ ID NO: 4033028 - RNA, 16 nt, Molluscum contagiosum virus
ugcccgaguuugcccg

SEQ ID NO: 4033029 - RNA, 17 nt, Molluscum contagiosum virus
ugcccgcgcacgagcug

SEQ ID NO: 4033030 - RNA, 16 nt, Molluscum contagiosum virus
ugcccgcgcgcggaca

SEQ ID NO: 4033031 - RNA, 20 nt, Molluscum contagiosum virus
ugcccgcggagaccaccgcu

SEQ ID NO: 4033032 - RNA, 23 nt, Molluscum contagiosum virus
ugcccgcgggggcguggcagaua

SEQ ID NO: 4033033 - RNA, 21 nt, Molluscum contagiosum virus
ugcccggccucgccuccgggc

SEQ ID NO: 4033034 - RNA, 21 nt, Molluscum contagiosum virus
ugccgagcgugcaagaagucu

SEQ ID NO: 4033035 - RNA, 22 nt, Molluscum contagiosum virus
ugccgagcucugucccgcaagc

SEQ ID NO: 4033036 - RNA, 23 nt, Molluscum contagiosum virus
ugccgcgccuugagcgcgccgcg

SEQ ID NO: 4033037 - RNA, 18 nt, Molluscum contagiosum virus
ugccgcgcgcuacgcgcc

SEQ ID NO: 4033038 - RNA, 15 nt, Molluscum contagiosum virus
ugccgcgggacgaga

SEQ ID NO: 4033039 - RNA, 15 nt, Molluscum contagiosum virus
ugccgcuggugggcg

SEQ ID NO: 4033040 - RNA, 24 nt, Molluscum contagiosum virus
ugccggaaauagcgcgcuagcucc

SEQ ID NO: 4033041 - RNA, 19 nt, Molluscum contagiosum virus
ugccggggaugaacgcgcu

SEQ ID NO: 4033042 - RNA, 15 nt, Molluscum contagiosum virus
ugccgugagcacgag

SEQ ID NO: 4033043 - RNA, 16 nt, Molluscum contagiosum virus
ugccuaugccgaggug

SEQ ID NO: 4033044 - RNA, 16 nt, Molluscum contagiosum virus
ugccugcaaggagguc

SEQ ID NO: 4033045 - RNA, 23 nt, Molluscum contagiosum virus
ugccugcgcaacgcgggccaggc

SEQ ID NO: 4033046 - RNA, 19 nt, Molluscum contagiosum virus
ugccuggagggcagugcca

SEQ ID NO: 4033047 - RNA, 22 nt, Molluscum contagiosum virus
ugccuggagggcagugccaagg

SEQ ID NO: 4033048 - RNA, 16 nt, Molluscum contagiosum virus
ugccuuggcgcccgug

SEQ ID NO: 4033049 - RNA, 17 nt, Molluscum contagiosum virus
ugccuuucaggggucug

SEQ ID NO: 4033050 - RNA, 13 nt, Molluscum contagiosum virus
ugcgacugccagc

SEQ ID NO: 4033051 - RNA, 19 nt, Molluscum contagiosum virus
ugcgagcggcgcgcgcuga

SEQ ID NO: 4033052 - RNA, 20 nt, Molluscum contagiosum virus
ugcgcaacgcgggccaggca

SEQ ID NO: 4033053 - RNA, 22 nt, Molluscum contagiosum virus
ugcgcaacgucuuccgcgcgcu

SEQ ID NO: 4033054 - RNA, 17 nt, Molluscum contagiosum virus
ugcgcaacgugcugcgc

SEQ ID NO: 4033055 - RNA, 14 nt, Molluscum contagiosum virus
ugcgcacagacggc

SEQ ID NO: 4033056 - RNA, 16 nt, Molluscum contagiosum virus
ugcgcaccgcgggcug

SEQ ID NO: 4033057 - RNA, 16 nt, Molluscum contagiosum virus
ugcgcacgcgcgucau

SEQ ID NO: 4033058 - RNA, 22 nt, Molluscum contagiosum virus
ugcgcacggaccucaaggaggc

SEQ ID NO: 4033059 - RNA, 15 nt, Molluscum contagiosum virus
ugcgcacgugcgcgc

SEQ ID NO: 4033060 - RNA, 23 nt, Molluscum contagiosum virus
ugcgcagagcuccccgcgcgcag

SEQ ID NO: 4033061 - RNA, 18 nt, Molluscum contagiosum virus
ugcgcaggagcagucucu

SEQ ID NO: 4033062 - RNA, 11 nt, Molluscum contagiosum virus
ugcgcauggug

SEQ ID NO: 4033063 - RNA, 22 nt, Molluscum contagiosum virus
ugcgcaugguggcgauccuguc

SEQ ID NO: 4033064 - RNA, 18 nt, Molluscum contagiosum virus
ugcgcauuggcagcgcuu

SEQ ID NO: 4033065 - RNA, 14 nt, Molluscum contagiosum virus
ugcgccacugccac

SEQ ID NO: 4033066 - RNA, 13 nt, Molluscum contagiosum virus
ugcgcccgcaaac

SEQ ID NO: 4033067 - RNA, 14 nt, Molluscum contagiosum virus
ugcgccugccggcg

SEQ ID NO: 4033068 - RNA, 20 nt, Molluscum contagiosum virus
ugcgcgacuccaucugcgcg

SEQ ID NO: 4033069 - RNA, 13 nt, Molluscum contagiosum virus
ugcgcgagucgcg

SEQ ID NO: 4033070 - RNA, 21 nt, Molluscum contagiosum virus
ugcgcgcacggcuaggcgcgg

SEQ ID NO: 4033071 - RNA, 11 nt, Molluscum contagiosum virus
ugcgcgccgcg

SEQ ID NO: 4033072 - RNA, 21 nt, Molluscum contagiosum virus
ugcgcgcgcccucgcgcgcag

SEQ ID NO: 4033073 - RNA, 18 nt, Molluscum contagiosum virus
ugcgcgcgcuacugcgcg

SEQ ID NO: 4033074 - RNA, 11 nt, Molluscum contagiosum virus
ugcgcgcgugc

SEQ ID NO: 4033075 - RNA, 19 nt, Molluscum contagiosum virus
ugcgcgcguugccugagaa

SEQ ID NO: 4033076 - RNA, 13 nt, Molluscum contagiosum virus
ugcgcggcgccgc

SEQ ID NO: 4033077 - RNA, 14 nt, Molluscum contagiosum virus
ugcgcggggcaggc

SEQ ID NO: 4033078 - RNA, 22 nt, Molluscum contagiosum virus
ugcgcggggcaggcagugccgc

SEQ ID NO: 4033079 - RNA, 16 nt, Molluscum contagiosum virus
ugcgcgugccucugcc

SEQ ID NO: 4033080 - RNA, 19 nt, Molluscum contagiosum virus
ugcgcgugccucugccagc

SEQ ID NO: 4033081 - RNA, 17 nt, Molluscum contagiosum virus
ugcgcgugcgccugccg

SEQ ID NO: 4033082 - RNA, 11 nt, Molluscum contagiosum virus
ugcgcgugucu

SEQ ID NO: 4033083 - RNA, 17 nt, Molluscum contagiosum virus
ugcgcgugucuggagcc

SEQ ID NO: 4033084 - RNA, 22 nt, Molluscum contagiosum virus
ugcgcgugucuggagcccacgu

SEQ ID NO: 4033085 - RNA, 15 nt, Molluscum contagiosum virus
ugcgcgugugcagca

SEQ ID NO: 4033086 - RNA, 18 nt, Molluscum contagiosum virus
ugcgcuacguuccgcgcg

SEQ ID NO: 4033087 - RNA, 14 nt, Molluscum contagiosum virus
ugcgcuccaugcug

SEQ ID NO: 4033088 - RNA, 19 nt, Molluscum contagiosum virus
ugcgcucgagcuccgaggg

SEQ ID NO: 4033089 - RNA, 17 nt, Molluscum contagiosum virus
ugcgcugccagcucgac

SEQ ID NO: 4033090 - RNA, 21 nt, Molluscum contagiosum virus
ugcgcugccgguggaagagcc

SEQ ID NO: 4033091 - RNA, 22 nt, Molluscum contagiosum virus
ugcgcuuagaccuuuacgucgc

SEQ ID NO: 4033092 - RNA, 18 nt, Molluscum contagiosum virus
ugcgcuugcucacgcugc

SEQ ID NO: 4033093 - RNA, 13 nt, Molluscum contagiosum virus
ugcggagcuggcc

SEQ ID NO: 4033094 - RNA, 19 nt, Molluscum contagiosum virus
ugcggcaggaagcuggcgc

SEQ ID NO: 4033095 - RNA, 14 nt, Molluscum contagiosum virus
ugcggcaggcgcug

SEQ ID NO: 4033096 - RNA, 21 nt, Molluscum contagiosum virus
ugcggcgcgugccgcugcgcg

SEQ ID NO: 4033097 - RNA, 21 nt, Molluscum contagiosum virus
ugcgggagccaugaaagaaaa

SEQ ID NO: 4033098 - RNA, 14 nt, Molluscum contagiosum virus
ugcgggcuguucca

SEQ ID NO: 4033099 - RNA, 14 nt, Molluscum contagiosum virus
ugcguaaugcuggc

SEQ ID NO: 4033100 - RNA, 18 nt, Molluscum contagiosum virus
ugcgucgacguggagccu

SEQ ID NO: 4033101 - RNA, 22 nt, Molluscum contagiosum virus
ugcgugaggaagaccuuggaca

SEQ ID NO: 4033102 - RNA, 14 nt, Molluscum contagiosum virus
ugcgugcccagcag

SEQ ID NO: 4033103 - RNA, 16 nt, Molluscum contagiosum virus
ugcguggacagcaucc

SEQ ID NO: 4033104 - RNA, 17 nt, Molluscum contagiosum virus
ugcguugucuccuccug

SEQ ID NO: 4033105 - RNA, 12 nt, Molluscum contagiosum virus
ugcuaacaacau

SEQ ID NO: 4033106 - RNA, 23 nt, Molluscum contagiosum virus
ugcuaacggacgcggccaugcuc

SEQ ID NO: 4033107 - RNA, 20 nt, Molluscum contagiosum virus
ugcuacgucgcggcgcacgg

SEQ ID NO: 4033108 - RNA, 21 nt, Molluscum contagiosum virus
ugcuagcccgcaccugcgccg

SEQ ID NO: 4033109 - RNA, 17 nt, Molluscum contagiosum virus
ugcuagcgacgcggaca

SEQ ID NO: 4033110 - RNA, 21 nt, Molluscum contagiosum virus
ugcucaccgccgagauggagc

SEQ ID NO: 4033111 - RNA, 23 nt, Molluscum contagiosum virus
ugcucaccgccgagauggagcuc

SEQ ID NO: 4033112 - RNA, 13 nt, Molluscum contagiosum virus
ugcuccaugacag

SEQ ID NO: 4033113 - RNA, 22 nt, Molluscum contagiosum virus
ugcuccccgaaauggcccccgc

SEQ ID NO: 4033114 - RNA, 21 nt, Molluscum contagiosum virus
ugcucccgguccuugcuccuc

SEQ ID NO: 4033115 - RNA, 13 nt, Molluscum contagiosum virus
ugcucccucgcgc

SEQ ID NO: 4033116 - RNA, 19 nt, Molluscum contagiosum virus
ugcucccucgcgcgcagcu

SEQ ID NO: 4033117 - RNA, 12 nt, Molluscum contagiosum virus
ugcuccgaggag

SEQ ID NO: 4033118 - RNA, 19 nt, Molluscum contagiosum virus
ugcuccgcacguggaauca

SEQ ID NO: 4033119 - RNA, 19 nt, Molluscum contagiosum virus
ugcuccgcacguggaguca

SEQ ID NO: 4033120 - RNA, 15 nt, Molluscum contagiosum virus
ugcucgcacccgcgc

SEQ ID NO: 4033121 - RNA, 16 nt, Molluscum contagiosum virus
ugcucgcaggcggugg

SEQ ID NO: 4033122 - RNA, 22 nt, Molluscum contagiosum virus
ugcucgcgccugaaccugggcg

SEQ ID NO: 4033123 - RNA, 19 nt, Molluscum contagiosum virus
caagaucaccccgcagcuc

SEQ ID NO: 4033124 - RNA, 17 nt, Molluscum contagiosum virus
caagaucguuuugcacu

SEQ ID NO: 4033125 - RNA, 22 nt, Molluscum contagiosum virus
caagauuguagagacgcugccg

SEQ ID NO: 4033126 - RNA, 16 nt, Molluscum contagiosum virus
caagcacaacgggcuc

SEQ ID NO: 4033127 - RNA, 19 nt, Molluscum contagiosum virus
caagcacacgacggaacgu

SEQ ID NO: 4033128 - RNA, 14 nt, Molluscum contagiosum virus
caagcacggcuucc

SEQ ID NO: 4033129 - RNA, 21 nt, Molluscum contagiosum virus
caagcacuacauggacgugcu

SEQ ID NO: 4033130 - RNA, 13 nt, Molluscum contagiosum virus
caagccagagcuu

SEQ ID NO: 4033131 - RNA, 20 nt, Molluscum contagiosum virus
caagcccagcagcgaggccg

SEQ ID NO: 4033132 - RNA, 19 nt, Molluscum contagiosum virus
caagccccccucacggcga

SEQ ID NO: 4033133 - RNA, 20 nt, Molluscum contagiosum virus
caagcccgaguucgcggcgc

SEQ ID NO: 4033134 - RNA, 15 nt, Molluscum contagiosum virus
caagccgcaggcgcg

SEQ ID NO: 4033135 - RNA, 16 nt, Molluscum contagiosum virus
caagccgcaggcgcgc

SEQ ID NO: 4033136 - RNA, 16 nt, Molluscum contagiosum virus
caagccguccgccucg

SEQ ID NO: 4033137 - RNA, 12 nt, Molluscum contagiosum virus
caagccugcuca

SEQ ID NO: 4033138 - RNA, 21 nt, Molluscum contagiosum virus
caagcgcaccguugacgagcu

SEQ ID NO: 4033139 - RNA, 23 nt, Molluscum contagiosum virus
caagcgcguucgcgcgugcugga

SEQ ID NO: 4033140 - RNA, 15 nt, Molluscum contagiosum virus
caagcugagcgcgcu

SEQ ID NO: 4033141 - RNA, 19 nt, Molluscum contagiosum virus
caaggaaaacugcauccug

SEQ ID NO: 4033142 - RNA, 23 nt, Molluscum contagiosum virus
caaggaaaggcacccgcaggaaa

SEQ ID NO: 4033143 - RNA, 19 nt, Molluscum contagiosum virus
caaggagaugggcacggca

SEQ ID NO: 4033144 - RNA, 13 nt, Molluscum contagiosum virus
caaggaggucaug

SEQ ID NO: 4033145 - RNA, 16 nt, Molluscum contagiosum virus
caaggccgcgggcgcg

SEQ ID NO: 4033146 - RNA, 21 nt, Molluscum contagiosum virus
caaggcgcgcaucgcgggcac

SEQ ID NO: 4033147 - RNA, 18 nt, Molluscum contagiosum virus
caagggcaucccgccgcu

SEQ ID NO: 4033148 - RNA, 12 nt, Molluscum contagiosum virus
caagggcuccuu

SEQ ID NO: 4033149 - RNA, 22 nt, Molluscum contagiosum virus
caaggucuacguguccgcaucc

SEQ ID NO: 4033150 - RNA, 17 nt, Molluscum contagiosum virus
caagguuugcgggcgca

SEQ ID NO: 4033151 - RNA, 21 nt, Molluscum contagiosum virus
caaguacaacccaaacauguc

SEQ ID NO: 4033152 - RNA, 22 nt, Molluscum contagiosum virus
caaguaccagccgcugcgccgc

SEQ ID NO: 4033153 - RNA, 18 nt, Molluscum contagiosum virus
caagucaccgcuccgcag

SEQ ID NO: 4033154 - RNA, 16 nt, Molluscum contagiosum virus
caagucgcgcgcugcg

SEQ ID NO: 4033155 - RNA, 21 nt, Molluscum contagiosum virus
caagugcacaccagacaaagu

SEQ ID NO: 4033156 - RNA, 16 nt, Molluscum contagiosum virus
caaguucgcugcuggc

SEQ ID NO: 4033157 - RNA, 14 nt, Molluscum contagiosum virus
caauacccgcuucc

SEQ ID NO: 4033158 - RNA, 17 nt, Molluscum contagiosum virus
caauggacacgcacugg

SEQ ID NO: 4033159 - RNA, 16 nt, Molluscum contagiosum virus
caauggcgcgcgagca

SEQ ID NO: 4033160 - RNA, 17 nt, Molluscum contagiosum virus
caauggcgcgcgagcac

SEQ ID NO: 4033161 - RNA, 20 nt, Molluscum contagiosum virus
caauucaaaggugcucaccc

SEQ ID NO: 4033162 - RNA, 15 nt, Molluscum contagiosum virus
cacaaguccgcggcu

SEQ ID NO: 4033163 - RNA, 15 nt, Molluscum contagiosum virus
cacacacgaacgcac

SEQ ID NO: 4033164 - RNA, 16 nt, Molluscum contagiosum virus
cacacacuugcucucu

SEQ ID NO: 4033165 - RNA, 19 nt, Molluscum contagiosum virus
cacaccccuguaacaagga

SEQ ID NO: 4033166 - RNA, 18 nt, Molluscum contagiosum virus
cacaccugugcccugucc

SEQ ID NO: 4033167 - RNA, 14 nt, Molluscum contagiosum virus
cacacgcagugcca

SEQ ID NO: 4033168 - RNA, 18 nt, Molluscum contagiosum virus
cacacuacgcuggcucgc

SEQ ID NO: 4033169 - RNA, 16 nt, Molluscum contagiosum virus
cacacucgcgcgucca

SEQ ID NO: 4033170 - RNA, 16 nt, Molluscum contagiosum virus
cacacuggugcgcgug

SEQ ID NO: 4033171 - RNA, 21 nt, Molluscum contagiosum virus
cacagcaggagcacgccuggc

SEQ ID NO: 4033172 - RNA, 22 nt, Molluscum contagiosum virus
cacagccauuaacgaagagugg

SEQ ID NO: 4033173 - RNA, 15 nt, Molluscum contagiosum virus
cacagccccugcugc

SEQ ID NO: 4033174 - RNA, 22 nt, Molluscum contagiosum virus
cacaggugcguaaugcuggcgc

SEQ ID NO: 4033175 - RNA, 15 nt, Molluscum contagiosum virus
cacaguucacggcgc

SEQ ID NO: 4033176 - RNA, 19 nt, Molluscum contagiosum virus
cacaguucacggcgcucgc

SEQ ID NO: 4033177 - RNA, 21 nt, Molluscum contagiosum virus
cacauaguggcuuguugucga

SEQ ID NO: 4033178 - RNA, 21 nt, Molluscum contagiosum virus
cacaucaugggcucgggcaag

SEQ ID NO: 4033179 - RNA, 17 nt, Molluscum contagiosum virus
cacaugccgcgcugcuc

SEQ ID NO: 4033180 - RNA, 23 nt, Molluscum contagiosum virus
cacauguguuuguagccgcgcga

SEQ ID NO: 4033181 - RNA, 13 nt, Molluscum contagiosum virus
cacauugcgaggc

SEQ ID NO: 4033182 - RNA, 18 nt, Molluscum contagiosum virus
caccagcgcgcagaagcc

SEQ ID NO: 4033183 - RNA, 13 nt, Molluscum contagiosum virus
caccagcgcggcc

SEQ ID NO: 4033184 - RNA, 17 nt, Molluscum contagiosum virus
caccagcgugcccuucu

SEQ ID NO: 4033185 - RNA, 11 nt, Molluscum contagiosum virus
caccaggaaca

SEQ ID NO: 4033186 - RNA, 17 nt, Molluscum contagiosum virus
caccaggaacagggaaa

SEQ ID NO: 4033187 - RNA, 23 nt, Molluscum contagiosum virus
caccagugccgacgugugccgcu

SEQ ID NO: 4033188 - RNA, 17 nt, Molluscum contagiosum virus
caccccgaaaggcaccc

SEQ ID NO: 4033189 - RNA, 17 nt, Molluscum contagiosum virus
caccccgcugggccgca

SEQ ID NO: 4033190 - RNA, 16 nt, Molluscum contagiosum virus
caccccuguaacaagg

SEQ ID NO: 4033191 - RNA, 16 nt, Molluscum contagiosum virus
cacccgagcggggacg

SEQ ID NO: 4033192 - RNA, 14 nt, Molluscum contagiosum virus
cacccgcaacaagg

SEQ ID NO: 4033193 - RNA, 19 nt, Molluscum contagiosum virus
cacccgcaggaaaggcacc

SEQ ID NO: 4033194 - RNA, 13 nt, Molluscum contagiosum virus
cacccgcgccgcg

SEQ ID NO: 4033195 - RNA, 16 nt, Molluscum contagiosum virus
cacccgugcgcgcgcu

SEQ ID NO: 4033196 - RNA, 18 nt, Molluscum contagiosum virus
caccgacacgcgcccgcc

SEQ ID NO: 4033197 - RNA, 14 nt, Molluscum contagiosum virus
caccgcacgccagc

SEQ ID NO: 4033198 - RNA, 14 nt, Molluscum contagiosum virus
caccgcaugggccc

SEQ ID NO: 4033199 - RNA, 16 nt, Molluscum contagiosum virus
caccgcaugggcccug

SEQ ID NO: 4033200 - RNA, 19 nt, Molluscum contagiosum virus
caccgccuggugcugcgcg

SEQ ID NO: 4033201 - RNA, 20 nt, Molluscum contagiosum virus
caccgcgagcaccacuacug

SEQ ID NO: 4033202 - RNA, 15 nt, Molluscum contagiosum virus
caccgcggcgcggag

SEQ ID NO: 4033203 - RNA, 16 nt, Molluscum contagiosum virus
caccgcguggcgcgcg

SEQ ID NO: 4033204 - RNA, 13 nt, Molluscum contagiosum virus
caccggcagcgcg

SEQ ID NO: 4033205 - RNA, 17 nt, Molluscum contagiosum virus
caccgggcgccgcggcu

SEQ ID NO: 4033206 - RNA, 16 nt, Molluscum contagiosum virus
caccguaccgcgcccg

SEQ ID NO: 4033207 - RNA, 16 nt, Molluscum contagiosum virus
caccuagagcacgaag

SEQ ID NO: 4033208 - RNA, 13 nt, Molluscum contagiosum virus
caccucgcacgug

SEQ ID NO: 4033209 - RNA, 15 nt, Molluscum contagiosum virus
caccucugcgcggcc

SEQ ID NO: 4033210 - RNA, 17 nt, Molluscum contagiosum virus
caccucugcgcggcccg

SEQ ID NO: 4033211 - RNA, 20 nt, Molluscum contagiosum virus
caccugcaggaaaggcaccc

SEQ ID NO: 4033212 - RNA, 11 nt, Molluscum contagiosum virus
caccugcgcaa

SEQ ID NO: 4033213 - RNA, 18 nt, Molluscum contagiosum virus
caccugcggcucgcacuu

SEQ ID NO: 4033214 - RNA, 14 nt, Molluscum contagiosum virus
caccuuccugggcg

SEQ ID NO: 4033215 - RNA, 17 nt, Molluscum contagiosum virus
caccuucggaacugcgg

SEQ ID NO: 4033216 - RNA, 15 nt, Molluscum contagiosum virus
cacgaccgcaagugc

SEQ ID NO: 4033217 - RNA, 17 nt, Molluscum contagiosum virus
cacgagcaguccgccuc

SEQ ID NO: 4033218 - RNA, 22 nt, Molluscum contagiosum virus
cacgagcaguccgccucgagca

SEQ ID NO: 4033219 - RNA, 13 nt, Molluscum contagiosum virus
cacgagcccgcaa

SEQ ID NO: 4033220 - RNA, 18 nt, Molluscum contagiosum virus
cacgagugcccgcgcgcu

SEQ ID NO: 4033221 - RNA, 14 nt, Molluscum contagiosum virus
cacgaguuucuuca

SEQ ID NO: 4033222 - RNA, 18 nt, Molluscum contagiosum virus
cacgaucaaggugcagaa

SEQ ID NO: 4033223 - RNA, 19 nt, Molluscum contagiosum virus
cacgaucaaggugcagaac

SEQ ID NO: 4033224 - RNA, 17 nt, Molluscum contagiosum virus
cacgaugcgcucguggu

SEQ ID NO: 4033225 - RNA, 18 nt, Molluscum contagiosum virus
cacgcaaaugcgcgcgaa

SEQ ID NO: 4033226 - RNA, 15 nt, Molluscum contagiosum virus
cacgcacacgacgac

SEQ ID NO: 4033227 - RNA, 17 nt, Molluscum contagiosum virus
cgcgacaagcgcgucug

SEQ ID NO: 4033228 - RNA, 15 nt, Molluscum contagiosum virus
cgcgacaugcugccc

SEQ ID NO: 4033229 - RNA, 15 nt, Molluscum contagiosum virus
cgcgaccuccgcucu

SEQ ID NO: 4033230 - RNA, 15 nt, Molluscum contagiosum virus
cgcgacgagcagacg

SEQ ID NO: 4033231 - RNA, 13 nt, Molluscum contagiosum virus
cgcgacgcgcgug

SEQ ID NO: 4033232 - RNA, 22 nt, Molluscum contagiosum virus
cgcgacggcgugcuggccagcc

SEQ ID NO: 4033233 - RNA, 19 nt, Molluscum contagiosum virus
cgcgacgugugcucugugc

SEQ ID NO: 4033234 - RNA, 21 nt, Molluscum contagiosum virus
cgcgacuccaucugcgcgacg

SEQ ID NO: 4033235 - RNA, 15 nt, Molluscum contagiosum virus
cgcgacuucgcccgu

SEQ ID NO: 4033236 - RNA, 12 nt, Molluscum contagiosum virus
cgcgagaacuuu

SEQ ID NO: 4033237 - RNA, 14 nt, Molluscum contagiosum virus
cgcgagaugcgcgg

SEQ ID NO: 4033238 - RNA, 18 nt, Molluscum contagiosum virus
cgcgagcaagcgcccgcg

SEQ ID NO: 4033239 - RNA, 22 nt, Molluscum contagiosum virus
cgcgagcaagcgcccgcgagcg

SEQ ID NO: 4033240 - RNA, 13 nt, Molluscum contagiosum virus
cgcgagcaccacu

SEQ ID NO: 4033241 - RNA, 16 nt, Molluscum contagiosum virus
cgcgagcacccccgcu

SEQ ID NO: 4033242 - RNA, 18 nt, Molluscum contagiosum virus
cgcgagcacgccugcacg

SEQ ID NO: 4033243 - RNA, 18 nt, Molluscum contagiosum virus
cgcgagcagcugcugcgc

SEQ ID NO: 4033244 - RNA, 22 nt, Molluscum contagiosum virus
cgcgagcaugccgccgcguacg

SEQ ID NO: 4033245 - RNA, 19 nt, Molluscum contagiosum virus
cgcgagcgacggcaggccc

SEQ ID NO: 4033246 - RNA, 13 nt, Molluscum contagiosum virus
cgcgagcgccacu

SEQ ID NO: 4033247 - RNA, 16 nt, Molluscum contagiosum virus
cgcgagcgccacuagc

SEQ ID NO: 4033248 - RNA, 14 nt, Molluscum contagiosum virus
cgcgagcgcgcccc

SEQ ID NO: 4033249 - RNA, 15 nt, Molluscum contagiosum virus
cgcgagcugcgggcg

SEQ ID NO: 4033250 - RNA, 20 nt, Molluscum contagiosum virus
cgcgaguugcgucucccgcg

SEQ ID NO: 4033251 - RNA, 21 nt, Molluscum contagiosum virus
cgcgaucuuccgcgacgagcu

SEQ ID NO: 4033252 - RNA, 18 nt, Molluscum contagiosum virus
cgcgcaaaaggcacgagg

SEQ ID NO: 4033253 - RNA, 15 nt, Molluscum contagiosum virus
cgcgcaacacugcag

SEQ ID NO: 4033254 - RNA, 18 nt, Molluscum contagiosum virus
cgcgcaaccagcuggcgc

SEQ ID NO: 4033255 - RNA, 23 nt, Molluscum contagiosum virus
cgcgcaaguccagcgcgcucgag

SEQ ID NO: 4033256 - RNA, 14 nt, Molluscum contagiosum virus
cgcgcacacgcuga

SEQ ID NO: 4033257 - RNA, 16 nt, Molluscum contagiosum virus
cgcgcacgagcgcggg

SEQ ID NO: 4033258 - RNA, 14 nt, Molluscum contagiosum virus
cgcgcacgcgcacg

SEQ ID NO: 4033259 - RNA, 14 nt, Molluscum contagiosum virus
cgcgcacgcgcgac

SEQ ID NO: 4033260 - RNA, 15 nt, Molluscum contagiosum virus
cgcgcacgcgcgagc

SEQ ID NO: 4033261 - RNA, 13 nt, Molluscum contagiosum virus
cgcgcacgcggcg

SEQ ID NO: 4033262 - RNA, 19 nt, Molluscum contagiosum virus
cgcgcacgcucucgcuggc

SEQ ID NO: 4033263 - RNA, 16 nt, Molluscum contagiosum virus
cgcgcacgcugcgcac

SEQ ID NO: 4033264 - RNA, 20 nt, Molluscum contagiosum virus
cgcgcacuaccgcaaccagc

SEQ ID NO: 4033265 - RNA, 13 nt, Molluscum contagiosum virus
cgcgcagaagcca

SEQ ID NO: 4033266 - RNA, 17 nt, Molluscum contagiosum virus
cgcgcagaagcccgggu

SEQ ID NO: 4033267 - RNA, 13 nt, Molluscum contagiosum virus
cgcgcagacgcgg

SEQ ID NO: 4033268 - RNA, 21 nt, Molluscum contagiosum virus
cgcgcagacguggugcucgug

SEQ ID NO: 4033269 - RNA, 21 nt, Molluscum contagiosum virus
cgcgcagcacaccgucgcgug

SEQ ID NO: 4033270 - RNA, 11 nt, Molluscum contagiosum virus
cgcgcagcgcc

SEQ ID NO: 4033271 - RNA, 13 nt, Molluscum contagiosum virus
cgcgcagcgcccg

SEQ ID NO: 4033272 - RNA, 13 nt, Molluscum contagiosum virus
cgcgcagcgugcc

SEQ ID NO: 4033273 - RNA, 15 nt, Molluscum contagiosum virus
cgcgcagcucgacgc

SEQ ID NO: 4033274 - RNA, 14 nt, Molluscum contagiosum virus
cgcgcagcugcgcc

SEQ ID NO: 4033275 - RNA, 22 nt, Molluscum contagiosum virus
cgcgcaggaccgucaccgcagu

SEQ ID NO: 4033276 - RNA, 14 nt, Molluscum contagiosum virus
cgcgcaggcucgca

SEQ ID NO: 4033277 - RNA, 20 nt, Molluscum contagiosum virus
cgcgcauacgcgccgcgcgc

SEQ ID NO: 4033278 - RNA, 22 nt, Molluscum contagiosum virus
cgcgcaucggcggcagcgccag

SEQ ID NO: 4033279 - RNA, 22 nt, Molluscum contagiosum virus
cgcgcauggggaacagcuuggc

SEQ ID NO: 4033280 - RNA, 14 nt, Molluscum contagiosum virus
cgcgccagcagcgc

SEQ ID NO: 4033281 - RNA, 13 nt, Molluscum contagiosum virus
cgcgccagcgaca

SEQ ID NO: 4033282 - RNA, 21 nt, Molluscum contagiosum virus
cgcgccaugguuuccgugucc

SEQ ID NO: 4033283 - RNA, 19 nt, Molluscum contagiosum virus
cgcgcccaaggccgcgggc

SEQ ID NO: 4033284 - RNA, 14 nt, Molluscum contagiosum virus
cgcgcccaccagca

SEQ ID NO: 4033285 - RNA, 12 nt, Molluscum contagiosum virus
cgcgcccgccgc

SEQ ID NO: 4033286 - RNA, 15 nt, Molluscum contagiosum virus
cgcgcccggcgcccg

SEQ ID NO: 4033287 - RNA, 18 nt, Molluscum contagiosum virus
cgcgcccggcgggcacau

SEQ ID NO: 4033288 - RNA, 22 nt, Molluscum contagiosum virus
cgcgcccugcacgaccgcggac

SEQ ID NO: 4033289 - RNA, 19 nt, Molluscum contagiosum virus
cgcgcccuugcacucgacc

SEQ ID NO: 4033290 - RNA, 22 nt, Molluscum contagiosum virus
cgcgccgaggacgcgcccggga

SEQ ID NO: 4033291 - RNA, 21 nt, Molluscum contagiosum virus
cgcgccgaggacuaccuggcg

SEQ ID NO: 4033292 - RNA, 14 nt, Molluscum contagiosum virus
cgcgccgcccggga

SEQ ID NO: 4033293 - RNA, 15 nt, Molluscum contagiosum virus
cgcgccgcgcgcuua

SEQ ID NO: 4033294 - RNA, 14 nt, Molluscum contagiosum virus
cgcgccgcgcugcu

SEQ ID NO: 4033295 - RNA, 12 nt, Molluscum contagiosum virus
cgcgccgcggcg

SEQ ID NO: 4033296 - RNA, 18 nt, Molluscum contagiosum virus
cgcgccgcgggcgcagag

SEQ ID NO: 4033297 - RNA, 16 nt, Molluscum contagiosum virus
cgcgccgcugcucgcu

SEQ ID NO: 4033298 - RNA, 23 nt, Molluscum contagiosum virus
cgcgccgggaaugcugcgcacgc

SEQ ID NO: 4033299 - RNA, 19 nt, Molluscum contagiosum virus
cgcgccgggccgcgguggc

SEQ ID NO: 4033300 - RNA, 15 nt, Molluscum contagiosum virus
cgcgccgggcgccag

SEQ ID NO: 4033301 - RNA, 18 nt, Molluscum contagiosum virus
cgcgccgucucgcggggc

SEQ ID NO: 4033302 - RNA, 13 nt, Molluscum contagiosum virus
cgcgccugcuggc

SEQ ID NO: 4033303 - RNA, 17 nt, Molluscum contagiosum virus
cgcgccuuuccggccug

SEQ ID NO: 4033304 - RNA, 21 nt, Molluscum contagiosum virus
cgcgcgacgugugcucugugc

SEQ ID NO: 4033305 - RNA, 13 nt, Molluscum contagiosum virus
cgcgcgacuacgc

SEQ ID NO: 4033306 - RNA, 16 nt, Molluscum contagiosum virus
cgcgcgagaagucggg

SEQ ID NO: 4033307 - RNA, 21 nt, Molluscum contagiosum virus
cgcgcgagcaugccgccgcgu

SEQ ID NO: 4033308 - RNA, 19 nt, Molluscum contagiosum virus
cgcgcgagcgcuacaugca

SEQ ID NO: 4033309 - RNA, 20 nt, Molluscum contagiosum virus
cgcgcgagcugcuagcggca

SEQ ID NO: 4033310 - RNA, 14 nt, Molluscum contagiosum virus
cgcgcgagcugcug

SEQ ID NO: 4033311 - RNA, 13 nt, Molluscum contagiosum virus
cgcgcgagcugga

SEQ ID NO: 4033312 - RNA, 17 nt, Molluscum contagiosum virus
cgcgcgagugccagcga

SEQ ID NO: 4033313 - RNA, 16 nt, Molluscum contagiosum virus
cgcgcgagugugugca

SEQ ID NO: 4033314 - RNA, 13 nt, Molluscum contagiosum virus
cgcgcgcacgcga

SEQ ID NO: 4033315 - RNA, 13 nt, Molluscum contagiosum virus
cgcgcgcacugcg

SEQ ID NO: 4033316 - RNA, 11 nt, Molluscum contagiosum virus
cgcgcgcagua

SEQ ID NO: 4033317 - RNA, 18 nt, Molluscum contagiosum virus
cgcgcgcauacgcgccgc

SEQ ID NO: 4033318 - RNA, 19 nt, Molluscum contagiosum virus
cgcgcgcccgcugcgcgcu

SEQ ID NO: 4033319 - RNA, 17 nt, Molluscum contagiosum virus
cgcgcgccgcaaaagca

SEQ ID NO: 4033320 - RNA, 22 nt, Molluscum contagiosum virus
cgcguccacggguagcagcgcc

SEQ ID NO: 4033321 - RNA, 16 nt, Molluscum contagiosum virus
cgcguccgccucuucc

SEQ ID NO: 4033322 - RNA, 14 nt, Molluscum contagiosum virus
cgcgucgcgcgccg

SEQ ID NO: 4033323 - RNA, 12 nt, Molluscum contagiosum virus
cgcgucgcggag

SEQ ID NO: 4033324 - RNA, 17 nt, Molluscum contagiosum virus
cgcgucugcaaggccug

SEQ ID NO: 4033325 - RNA, 13 nt, Molluscum contagiosum virus
cgcgucugcucuc

SEQ ID NO: 4033326 - RNA, 17 nt, Molluscum contagiosum virus
cgcgugacuaccuugug

SEQ ID NO: 4033327 - RNA, 18 nt, Molluscum contagiosum virus
cgcgugcauggcacgcga

SEQ ID NO: 4033328 - RNA, 15 nt, Molluscum contagiosum virus
cgcgugccgcccgag

SEQ ID NO: 4033329 - RNA, 18 nt, Molluscum contagiosum virus
cgcgugccucugccagcc

SEQ ID NO: 4033330 - RNA, 22 nt, Molluscum contagiosum virus
cgcgugcgccgccgcaggcccg

SEQ ID NO: 4033331 - RNA, 13 nt, Molluscum contagiosum virus
cgcgugcgccugc

SEQ ID NO: 4033332 - RNA, 20 nt, Molluscum contagiosum virus
cgcgugcgcgugccucugcc

SEQ ID NO: 4033333 - RNA, 20 nt, Molluscum contagiosum virus
cgcgugcggcggcgcgugcu

SEQ ID NO: 4033334 - RNA, 16 nt, Molluscum contagiosum virus
cacgcacacgacgacg

SEQ ID NO: 4033335 - RNA, 15 nt, Molluscum contagiosum virus
cacgcacgcgcgggc

SEQ ID NO: 4033336 - RNA, 19 nt, Molluscum contagiosum virus
cacgcacggcccgggugcg

SEQ ID NO: 4033337 - RNA, 11 nt, Molluscum contagiosum virus
cacgcagagcc

SEQ ID NO: 4033338 - RNA, 14 nt, Molluscum contagiosum virus
cacgcagugccacg

SEQ ID NO: 4033339 - RNA, 15 nt, Molluscum contagiosum virus
cacgcccgcgcugcg

SEQ ID NO: 4033340 - RNA, 16 nt, Molluscum contagiosum virus
cacgcccgcgucccga

SEQ ID NO: 4033341 - RNA, 21 nt, Molluscum contagiosum virus
cacgccgcucucgugcaaagc

SEQ ID NO: 4033342 - RNA, 20 nt, Molluscum contagiosum virus
cacgccgggaaacgcacagc

SEQ ID NO: 4033343 - RNA, 15 nt, Molluscum contagiosum virus
cacgccugcacgcgc

SEQ ID NO: 4033344 - RNA, 22 nt, Molluscum contagiosum virus
cacgccuggcggcagcacgggc

SEQ ID NO: 4033345 - RNA, 16 nt, Molluscum contagiosum virus
cacgccuucguggagc

SEQ ID NO: 4033346 - RNA, 18 nt, Molluscum contagiosum virus
cacgccuucguggagccc

SEQ ID NO: 4033347 - RNA, 18 nt, Molluscum contagiosum virus
cacgcgaauguccggcgc

SEQ ID NO: 4033348 - RNA, 21 nt, Molluscum contagiosum virus
cacgcgagcaauggcggccug

SEQ ID NO: 4033349 - RNA, 14 nt, Molluscum contagiosum virus
cacgcgcaaggccg

SEQ ID NO: 4033350 - RNA, 17 nt, Molluscum contagiosum virus
cacgcgcacgcgcacac

SEQ ID NO: 4033351 - RNA, 18 nt, Molluscum contagiosum virus
cacgcgcacuugccuggc

SEQ ID NO: 4033352 - RNA, 15 nt, Molluscum contagiosum virus
cacgcgcccgccgcc

SEQ ID NO: 4033353 - RNA, 11 nt, Molluscum contagiosum virus
cacgcgccgcg

SEQ ID NO: 4033354 - RNA, 14 nt, Molluscum contagiosum virus
cacgcgccgcgcgg

SEQ ID NO: 4033355 - RNA, 23 nt, Molluscum contagiosum virus
cacgcgcgccgcugucacgcgag

SEQ ID NO: 4033356 - RNA, 23 nt, Molluscum contagiosum virus
cacgcgcgcgccuuuccggccug

SEQ ID NO: 4033357 - RNA, 14 nt, Molluscum contagiosum virus
cacgcgcgcugccg

SEQ ID NO: 4033358 - RNA, 22 nt, Molluscum contagiosum virus
cacgcgcgugagcacgggcgag

SEQ ID NO: 4033359 - RNA, 16 nt, Molluscum contagiosum virus
cacgcgcucuccagag

SEQ ID NO: 4033360 - RNA, 21 nt, Molluscum contagiosum virus
cacgcgcuucguggacgagcg

SEQ ID NO: 4033361 - RNA, 12 nt, Molluscum contagiosum virus
cacgcgggcgcc

SEQ ID NO: 4033362 - RNA, 19 nt, Molluscum contagiosum virus
cacgcgguuucgaucgcgc

SEQ ID NO: 4033363 - RNA, 21 nt, Molluscum contagiosum virus
cacgcuagcgagcgcccgugc

SEQ ID NO: 4033364 - RNA, 22 nt, Molluscum contagiosum virus
cacgcuagucguuggcgcgccc

SEQ ID NO: 4033365 - RNA, 21 nt, Molluscum contagiosum virus
cacgcucauacuccugcuggc

SEQ ID NO: 4033366 - RNA, 15 nt, Molluscum contagiosum virus
cacgcugcgcgugcu

SEQ ID NO: 4033367 - RNA, 20 nt, Molluscum contagiosum virus
cacgcugcucgugcugcucu

SEQ ID NO: 4033368 - RNA, 18 nt, Molluscum contagiosum virus
cacgcugcugcgugcgcg

SEQ ID NO: 4033369 - RNA, 18 nt, Molluscum contagiosum virus
cacgcuggcacggccggc

SEQ ID NO: 4033370 - RNA, 22 nt, Molluscum contagiosum virus
cacgcuggcacggccggcgccg

SEQ ID NO: 4033371 - RNA, 18 nt, Molluscum contagiosum virus
cacgcuggucacgcgcuu

SEQ ID NO: 4033372 - RNA, 13 nt, Molluscum contagiosum virus
cacgcuugccuug

SEQ ID NO: 4033373 - RNA, 21 nt, Molluscum contagiosum virus
cacgcuuguccgcggacgcgg

SEQ ID NO: 4033374 - RNA, 14 nt, Molluscum contagiosum virus
cacggacagcaccc

SEQ ID NO: 4033375 - RNA, 21 nt, Molluscum contagiosum virus
cacggacuuuucgcgcgugcg

SEQ ID NO: 4033376 - RNA, 17 nt, Molluscum contagiosum virus
cacggagaucaggcagc

SEQ ID NO: 4033377 - RNA, 17 nt, Molluscum contagiosum virus
cacggauacgcgcacac

SEQ ID NO: 4033378 - RNA, 17 nt, Molluscum contagiosum virus
cacggcacccgccagcu

SEQ ID NO: 4033379 - RNA, 21 nt, Molluscum contagiosum virus
cacggcacgugcguacgcggc

SEQ ID NO: 4033380 - RNA, 18 nt, Molluscum contagiosum virus
cacggcccgggugcgcgc

SEQ ID NO: 4033381 - RNA, 22 nt, Molluscum contagiosum virus
ccgcgcgcgacuacgcacuggc

SEQ ID NO: 4033382 - RNA, 19 nt, Molluscum contagiosum virus
ccgcgcgcgcaagcgccgc

SEQ ID NO: 4033383 - RNA, 16 nt, Molluscum contagiosum virus
ccgcgcgcgcagcgcg

SEQ ID NO: 4033384 - RNA, 12 nt, Molluscum contagiosum virus
ccgcgcgcgccg

SEQ ID NO: 4033385 - RNA, 15 nt, Molluscum contagiosum virus
ccgcgcgcucgcgcu

SEQ ID NO: 4033386 - RNA, 22 nt, Molluscum contagiosum virus
ccgcgcguuuucccgaggcguc

SEQ ID NO: 4033387 - RNA, 19 nt, Molluscum contagiosum virus
ccgcgcucacugcagcagc

SEQ ID NO: 4033388 - RNA, 12 nt, Molluscum contagiosum virus
ccgcgcucgaca

SEQ ID NO: 4033389 - RNA, 14 nt, Molluscum contagiosum virus
ccgcgcugcgcaag

SEQ ID NO: 4033390 - RNA, 13 nt, Molluscum contagiosum virus
ccgcgcugcgcgg

SEQ ID NO: 4033391 - RNA, 15 nt, Molluscum contagiosum virus
ccgcgcugcuggcca

SEQ ID NO: 4033392 - RNA, 16 nt, Molluscum contagiosum virus
ccgcgcuucgagcacg

SEQ ID NO: 4033393 - RNA, 14 nt, Molluscum contagiosum virus
ccgcggacgcgcag

SEQ ID NO: 4033394 - RNA, 17 nt, Molluscum contagiosum virus
ccgcggagaccaccgcu

SEQ ID NO: 4033395 - RNA, 23 nt, Molluscum contagiosum virus
ccgcggagaccaccgcuggggcg

SEQ ID NO: 4033396 - RNA, 20 nt, Molluscum contagiosum virus
ccgcggaugcaggcacugcc

SEQ ID NO: 4033397 - RNA, 19 nt, Molluscum contagiosum virus
ccgcggcacaugcagcugc

SEQ ID NO: 4033398 - RNA, 22 nt, Molluscum contagiosum virus
ccgcggcacugggugcccgagc

SEQ ID NO: 4033399 - RNA, 18 nt, Molluscum contagiosum virus
ccgcggccgagucacgcc

SEQ ID NO: 4033400 - RNA, 14 nt, Molluscum contagiosum virus
ccgcggcgcccacg

SEQ ID NO: 4033401 - RNA, 13 nt, Molluscum contagiosum virus
ccgcggcgcggcg

SEQ ID NO: 4033402 - RNA, 21 nt, Molluscum contagiosum virus
ccgcggcgugcagggcgugcu

SEQ ID NO: 4033403 - RNA, 20 nt, Molluscum contagiosum virus
ccgcggcuaccacgggcccg

SEQ ID NO: 4033404 - RNA, 13 nt, Molluscum contagiosum virus
ccgcgggcgcacg

SEQ ID NO: 4033405 - RNA, 17 nt, Molluscum contagiosum virus
ccgcgggcgcgcgccag

SEQ ID NO: 4033406 - RNA, 15 nt, Molluscum contagiosum virus
ccgcgggcgugcccg

SEQ ID NO: 4033407 - RNA, 14 nt, Molluscum contagiosum virus
ccgcgggcugcaag

SEQ ID NO: 4033408 - RNA, 18 nt, Molluscum contagiosum virus
ccgcguacagcgcgcgug

SEQ ID NO: 4033409 - RNA, 17 nt, Molluscum contagiosum virus
ccgcguacgcgccgggg

SEQ ID NO: 4033410 - RNA, 20 nt, Molluscum contagiosum virus
ccgcgucguagacgcgcccg

SEQ ID NO: 4033411 - RNA, 12 nt, Molluscum contagiosum virus
ccgcgugcaccc

SEQ ID NO: 4033412 - RNA, 13 nt, Molluscum contagiosum virus
ccgcgugcgccgc

SEQ ID NO: 4033413 - RNA, 17 nt, Molluscum contagiosum virus
ccgcgugcgccgccgca

SEQ ID NO: 4033414 - RNA, 13 nt, Molluscum contagiosum virus
ccgcgugcuggcg

SEQ ID NO: 4033415 - RNA, 16 nt, Molluscum contagiosum virus
ccgcguggcgcgcgac

SEQ ID NO: 4033416 - RNA, 16 nt, Molluscum contagiosum virus
ccgcuagagugcgcgg

SEQ ID NO: 4033417 - RNA, 22 nt, Molluscum contagiosum virus
ccgcucacagcuucgcgagccc

SEQ ID NO: 4033418 - RNA, 14 nt, Molluscum contagiosum virus
ccgcuccagagccg

SEQ ID NO: 4033419 - RNA, 16 nt, Molluscum contagiosum virus
ccgcugccgcgcgcgc

SEQ ID NO: 4033420 - RNA, 22 nt, Molluscum contagiosum virus
ccgcugccgucgcgcgcugugg

SEQ ID NO: 4033421 - RNA, 18 nt, Molluscum contagiosum virus
ccgcugccugugcccagu

SEQ ID NO: 4033422 - RNA, 14 nt, Molluscum contagiosum virus
ccgcugcgccgcca

SEQ ID NO: 4033423 - RNA, 21 nt, Molluscum contagiosum virus
ccgcugcuucguaaagcuggc

SEQ ID NO: 4033424 - RNA, 17 nt, Molluscum contagiosum virus
ccgcugucacgcgagcu

SEQ ID NO: 4033425 - RNA, 18 nt, Molluscum contagiosum virus
ccgcuucgagugcucccg

SEQ ID NO: 4033426 - RNA, 17 nt, Molluscum contagiosum virus
ccgcuucgugcgcggag

SEQ ID NO: 4033427 - RNA, 19 nt, Molluscum contagiosum virus
ccggaaagaagggcucgcc

SEQ ID NO: 4033428 - RNA, 15 nt, Molluscum contagiosum virus
ccggaacgccgugcg

SEQ ID NO: 4033429 - RNA, 13 nt, Molluscum contagiosum virus
ccggacagcucag

SEQ ID NO: 4033430 - RNA, 17 nt, Molluscum contagiosum virus
ccggacgugcacgcacg

SEQ ID NO: 4033431 - RNA, 14 nt, Molluscum contagiosum virus
ccggagacaccagc

SEQ ID NO: 4033432 - RNA, 17 nt, Molluscum contagiosum virus
ccggcacgagcaguccg

SEQ ID NO: 4033433 - RNA, 22 nt, Molluscum contagiosum virus
ccggcagcgacuacgcgcugcu

SEQ ID NO: 4033434 - RNA, 15 nt, Molluscum contagiosum virus
ccggcagcgcauccg

SEQ ID NO: 4033435 - RNA, 13 nt, Molluscum contagiosum virus
ccggcagcgccgc

SEQ ID NO: 4033436 - RNA, 19 nt, Molluscum contagiosum virus
ccggcagcgcgccuagcuc

SEQ ID NO: 4033437 - RNA, 14 nt, Molluscum contagiosum virus
ccggcaguagcagc

SEQ ID NO: 4033438 - RNA, 16 nt, Molluscum contagiosum virus
ccggcauccggccgag

SEQ ID NO: 4033439 - RNA, 19 nt, Molluscum contagiosum virus
ccggcaucgcgcugcuggu

SEQ ID NO: 4033440 - RNA, 19 nt, Molluscum contagiosum virus
ccggccuuguucgcgcuuc

SEQ ID NO: 4033441 - RNA, 20 nt, Molluscum contagiosum virus
ccggccuuguucgcgcuucu

SEQ ID NO: 4033442 - RNA, 17 nt, Molluscum contagiosum virus
ccggcgcccgcagcgcg

SEQ ID NO: 4033443 - RNA, 14 nt, Molluscum contagiosum virus
ccggcgcgcgcgcg

SEQ ID NO: 4033444 - RNA, 15 nt, Molluscum contagiosum virus
ccggcgcgcgcgcgc

SEQ ID NO: 4033445 - RNA, 11 nt, Molluscum contagiosum virus
ccggcgcggcc

SEQ ID NO: 4033446 - RNA, 19 nt, Molluscum contagiosum virus
ccggcggcauugugguguu

SEQ ID NO: 4033447 - RNA, 17 nt, Molluscum contagiosum virus
ccggcggcuggaccugc

SEQ ID NO: 4033448 - RNA, 20 nt, Molluscum contagiosum virus
ccggcguccggcgcucgccc

SEQ ID NO: 4033449 - RNA, 14 nt, Molluscum contagiosum virus
ccggcguuggcuuu

SEQ ID NO: 4033450 - RNA, 21 nt, Molluscum contagiosum virus
ccggcguuggcuuucugugcg

SEQ ID NO: 4033451 - RNA, 18 nt, Molluscum contagiosum virus
ccggcucaagaacaccaa

SEQ ID NO: 4033452 - RNA, 10 nt, Molluscum contagiosum virus
ccggcugccc

SEQ ID NO: 4033453 - RNA, 13 nt, Molluscum contagiosum virus
ccggcugcuccuc

SEQ ID NO: 4033454 - RNA, 16 nt, Molluscum contagiosum virus
ccgggaaggcaggccc

SEQ ID NO: 4033455 - RNA, 13 nt, Molluscum contagiosum virus
ccgggcacgcccg

SEQ ID NO: 4033456 - RNA, 13 nt, Molluscum contagiosum virus
ccgggcccgggcc

SEQ ID NO: 4033457 - RNA, 15 nt, Molluscum contagiosum virus
ccgggccugcggcgg

SEQ ID NO: 4033458 - RNA, 16 nt, Molluscum contagiosum virus
ccgggcgccggcucug

SEQ ID NO: 4033459 - RNA, 12 nt, Molluscum contagiosum virus
ccgggcgcgcca

SEQ ID NO: 4033460 - RNA, 21 nt, Molluscum contagiosum virus
ccgggcgcuccgagcggcugc

SEQ ID NO: 4033461 - RNA, 17 nt, Molluscum contagiosum virus
ccgggcggcgcgccgcg

SEQ ID NO: 4033462 - RNA, 23 nt, Molluscum contagiosum virus
ccggggagaagaugcugcgcgug

SEQ ID NO: 4033463 - RNA, 15 nt, Molluscum contagiosum virus
ccggggcccaugcuc

SEQ ID NO: 4033464 - RNA, 22 nt, Molluscum contagiosum virus
guaguugcgagccagccaggcg

SEQ ID NO: 4033465 - RNA, 19 nt, Molluscum contagiosum virus
guauauacuccccgcgcgc

SEQ ID NO: 4033466 - RNA, 15 nt, Molluscum contagiosum virus
gucacaagcaccgcc

SEQ ID NO: 4033467 - RNA, 13 nt, Molluscum contagiosum virus
gucacacuacgcu

SEQ ID NO: 4033468 - RNA, 20 nt, Molluscum contagiosum virus
gucacgacuguguucccggc

SEQ ID NO: 4033469 - RNA, 21 nt, Molluscum contagiosum virus
gucacgcaagcuuugugcucg

SEQ ID NO: 4033470 - RNA, 18 nt, Molluscum contagiosum virus
gucacgcuagcgggccug

SEQ ID NO: 4033471 - RNA, 17 nt, Molluscum contagiosum virus
gucacugcuagugcugg

SEQ ID NO: 4033472 - RNA, 13 nt, Molluscum contagiosum virus
gucagaggauucu

SEQ ID NO: 4033473 - RNA, 17 nt, Molluscum contagiosum virus
gucagcggcgugcugca

SEQ ID NO: 4033474 - RNA, 15 nt, Molluscum contagiosum virus
gucaucggagagccc

SEQ ID NO: 4033475 - RNA, 14 nt, Molluscum contagiosum virus
gucaugcgcgcgcg

SEQ ID NO: 4033476 - RNA, 13 nt, Molluscum contagiosum virus
gucaugugcgugg

SEQ ID NO: 4033477 - RNA, 20 nt, Molluscum contagiosum virus
guccaacccgcggcgcgccg

SEQ ID NO: 4033478 - RNA, 22 nt, Molluscum contagiosum virus
guccacgugguccaccagcacg

SEQ ID NO: 4033479 - RNA, 13 nt, Molluscum contagiosum virus
guccagcccgcgg

SEQ ID NO: 4033480 - RNA, 16 nt, Molluscum contagiosum virus
guccagcggcugcccg

SEQ ID NO: 4033481 - RNA, 17 nt, Molluscum contagiosum virus
guccagcuucucgaagg

SEQ ID NO: 4033482 - RNA, 16 nt, Molluscum contagiosum virus
guccaggcgcugcacg

SEQ ID NO: 4033483 - RNA, 23 nt, Molluscum contagiosum virus
guccaucggugggcucgcgcuuu

SEQ ID NO: 4033484 - RNA, 16 nt, Molluscum contagiosum virus
guccccgaacugcugg

SEQ ID NO: 4033485 - RNA, 17 nt, Molluscum contagiosum virus
guccccgaacugcuggg

SEQ ID NO: 4033486 - RNA, 23 nt, Molluscum contagiosum virus
guccccgagcagcggggacucuc

SEQ ID NO: 4033487 - RNA, 18 nt, Molluscum contagiosum virus
guccccgcgcucacugca

SEQ ID NO: 4033488 - RNA, 21 nt, Molluscum contagiosum virus
guccccguccgugucgagcug

SEQ ID NO: 4033489 - RNA, 19 nt, Molluscum contagiosum virus
gucccgcgaacgagggaca

SEQ ID NO: 4033490 - RNA, 14 nt, Molluscum contagiosum virus
gucccgcgcuccga

SEQ ID NO: 4033491 - RNA, 22 nt, Molluscum contagiosum virus
gucccgcuaaagaucgugcgcu

SEQ ID NO: 4033492 - RNA, 15 nt, Molluscum contagiosum virus
guccgagcuguucaa

SEQ ID NO: 4033493 - RNA, 13 nt, Molluscum contagiosum virus
guccgcacgcaca

SEQ ID NO: 4033494 - RNA, 22 nt, Molluscum contagiosum virus
guccgcuccuucucagggcuuc

SEQ ID NO: 4033495 - RNA, 15 nt, Molluscum contagiosum virus
guccucggccagagc

SEQ ID NO: 4033496 - RNA, 17 nt, Molluscum contagiosum virus
guccugcgcgguggcuu

SEQ ID NO: 4033497 - RNA, 20 nt, Molluscum contagiosum virus
gucgaagagggucgugcagg

SEQ ID NO: 4033498 - RNA, 12 nt, Molluscum contagiosum virus
gucgagagcgcg

SEQ ID NO: 4033499 - RNA, 18 nt, Molluscum contagiosum virus
gucgagcaccugucgcgc

SEQ ID NO: 4033500 - RNA, 15 nt, Molluscum contagiosum virus
gucgagcgcgccgcg

SEQ ID NO: 4033501 - RNA, 15 nt, Molluscum contagiosum virus
gucgcaaccccgcgc

SEQ ID NO: 4033502 - RNA, 19 nt, Molluscum contagiosum virus
gucgcacaguucacggcgc

SEQ ID NO: 4033503 - RNA, 20 nt, Molluscum contagiosum virus
gucgcacaguucacggcgcu

SEQ ID NO: 4033504 - RNA, 12 nt, Molluscum contagiosum virus
gucgcacuggcc

SEQ ID NO: 4033505 - RNA, 21 nt, Molluscum contagiosum virus
gucgcaguacccgagcugugc

SEQ ID NO: 4033506 - RNA, 20 nt, Molluscum contagiosum virus
gucgccuacgaggugcgcga

SEQ ID NO: 4033507 - RNA, 13 nt, Molluscum contagiosum virus
gucgcgcagcugc

SEQ ID NO: 4033508 - RNA, 18 nt, Molluscum contagiosum virus
gucgcgcgagaagucggg

SEQ ID NO: 4033509 - RNA, 20 nt, Molluscum contagiosum virus
gucggagcaggacgacgaca

SEQ ID NO: 4033510 - RNA, 22 nt, Molluscum contagiosum virus
gucggcgauguacgcgugcagg

SEQ ID NO: 4033511 - RNA, 18 nt, Molluscum contagiosum virus
gucgguaugcgaggccug

SEQ ID NO: 4033512 - RNA, 20 nt, Molluscum contagiosum virus
gucgucaaaggcaaagccug

SEQ ID NO: 4033513 - RNA, 16 nt, Molluscum contagiosum virus
gucgugcaccuggagc

SEQ ID NO: 4033514 - RNA, 15 nt, Molluscum contagiosum virus
gucgugcaggccgug

SEQ ID NO: 4033515 - RNA, 18 nt, Molluscum contagiosum virus
gucuacaacgagcucucc

SEQ ID NO: 4033516 - RNA, 21 nt, Molluscum contagiosum virus
gucucccaggaagacgugcug

SEQ ID NO: 4033517 - RNA, 16 nt, Molluscum contagiosum virus
gucucccgcggccgcc

SEQ ID NO: 4033518 - RNA, 14 nt, Molluscum contagiosum virus
gucuccguccccgg

SEQ ID NO: 4033519 - RNA, 14 nt, Molluscum contagiosum virus
gucuccuccugaug

SEQ ID NO: 4033520 - RNA, 20 nt, Molluscum contagiosum virus
gucucgaacucgugcgccgc

SEQ ID NO: 4033521 - RNA, 15 nt, Molluscum contagiosum virus
gucucgcgcuuccag

SEQ ID NO: 4033522 - RNA, 22 nt, Molluscum contagiosum virus
gucucgcggggcaagcgcgcuc

SEQ ID NO: 4033523 - RNA, 18 nt, Molluscum contagiosum virus
gucucgcucuuccgcgag

SEQ ID NO: 4033524 - RNA, 17 nt, Molluscum contagiosum virus
gucucggagaagaacag

SEQ ID NO: 4033525 - RNA, 14 nt, Molluscum contagiosum virus
gucucggggcuccg

SEQ ID NO: 4033526 - RNA, 22 nt, Molluscum contagiosum virus
gucucucguucgcgggcccgcc

SEQ ID NO: 4033527 - RNA, 13 nt, Molluscum contagiosum virus
gucugcaagcgug

SEQ ID NO: 4033528 - RNA, 14 nt, Molluscum contagiosum virus
gucuuccagcacug

SEQ ID NO: 4033529 - RNA, 19 nt, Molluscum contagiosum virus
gugaacgaggcugcugccg

SEQ ID NO: 4033530 - RNA, 14 nt, Molluscum contagiosum virus
gugacggcccaccu

SEQ ID NO: 4033531 - RNA, 18 nt, Molluscum contagiosum virus
gugacggcccaccuucuu

SEQ ID NO: 4033532 - RNA, 20 nt, Molluscum contagiosum virus
gugagcucgccaauggagcc

SEQ ID NO: 4033533 - RNA, 12 nt, Molluscum contagiosum virus
gugaguccgcgg

SEQ ID NO: 4033534 - RNA, 13 nt, Molluscum contagiosum virus
gugcaccuggagc

SEQ ID NO: 4033535 - RNA, 15 nt, Molluscum contagiosum virus
gugcaccuggagcag

SEQ ID NO: 4033536 - RNA, 15 nt, Molluscum contagiosum virus
gugcacgcacgcgcg

SEQ ID NO: 4033537 - RNA, 22 nt, Molluscum contagiosum virus
gugcacgcgggcgccggcgucc

SEQ ID NO: 4033538 - RNA, 17 nt, Molluscum contagiosum virus
gugcacguccugcgagu

SEQ ID NO: 4033539 - RNA, 17 nt, Molluscum contagiosum virus
gugcacguggcgcacac

SEQ ID NO: 4033540 - RNA, 17 nt, Molluscum contagiosum virus
gugcacuagcacgggcg

SEQ ID NO: 4033541 - RNA, 22 nt, Molluscum contagiosum virus
gugcauggcggcggccacgcuc

SEQ ID NO: 4033542 - RNA, 23 nt, Molluscum contagiosum virus
gugcauggcggcggccacgcucg

SEQ ID NO: 4033543 - RNA, 22 nt, Molluscum contagiosum virus
gugcauugcgucuuacugcugc

SEQ ID NO: 4033544 - RNA, 18 nt, Molluscum contagiosum virus
gugcccaguuauucucug

SEQ ID NO: 4033545 - RNA, 13 nt, Molluscum contagiosum virus
gugcccgccaaga

SEQ ID NO: 4033546 - RNA, 17 nt, Molluscum contagiosum virus
gugccgacgugugccgc

SEQ ID NO: 4033547 - RNA, 20 nt, Molluscum contagiosum virus
gugccgccgugggcgccgcg

SEQ ID NO: 4033548 - RNA, 16 nt, Molluscum contagiosum virus
gugccgcucgcugucc

SEQ ID NO: 4033549 - RNA, 21 nt, Molluscum contagiosum virus
gugccgcugcgcggagcucgc

SEQ ID NO: 4033550 - RNA, 21 nt, Molluscum contagiosum virus
gugccgggcgccggcucugcc

SEQ ID NO: 4033551 - RNA, 16 nt, Molluscum contagiosum virus
gugccguucacgcaca

SEQ ID NO: 4033552 - RNA, 20 nt, Molluscum contagiosum virus
gugccuccgcggacgcgccc

SEQ ID NO: 4033553 - RNA, 22 nt, Molluscum contagiosum virus
gugccugcgcaacgcgggccag

SEQ ID NO: 4033554 - RNA, 18 nt, Molluscum contagiosum virus
gugccuggcagugccggg

SEQ ID NO: 4033555 - RNA, 15 nt, Molluscum contagiosum virus
gugccuggcuugcgc

SEQ ID NO: 4033556 - RNA, 20 nt, Molluscum contagiosum virus
gugccuggcuugcgcgcgcc

SEQ ID NO: 4033557 - RNA, 17 nt, Molluscum contagiosum virus
gugccugucucgcaagc

SEQ ID NO: 4033558 - RNA, 18 nt, Molluscum contagiosum virus
gugccugucucgcaagca

SEQ ID NO: 4033559 - RNA, 18 nt, Molluscum contagiosum virus
gugccuguggcgcacacg

SEQ ID NO: 4033560 - RNA, 14 nt, Molluscum contagiosum virus
gugccuuguucuga

SEQ ID NO: 4033561 - RNA, 21 nt, Molluscum contagiosum virus
gugcgaacacggauacgcgca

SEQ ID NO: 4033562 - RNA, 17 nt, Molluscum contagiosum virus
gugcgaccugcugcgag

SEQ ID NO: 4033563 - RNA, 16 nt, Molluscum contagiosum virus
gugcgagaucgacugc

SEQ ID NO: 4033564 - RNA, 21 nt, Molluscum contagiosum virus
gugcgcacagacggcgcgcuc

SEQ ID NO: 4033565 - RNA, 15 nt, Molluscum contagiosum virus
gugcgccaguccgcg

SEQ ID NO: 4033566 - RNA, 13 nt, Molluscum contagiosum virus
gugcgccgcgccc

SEQ ID NO: 4033567 - RNA, 23 nt, Molluscum contagiosum virus
gugcgccucggacuucgacgcgc

SEQ ID NO: 4033568 - RNA, 20 nt, Molluscum contagiosum virus
gggcagcucaagcugcucau

SEQ ID NO: 4033569 - RNA, 18 nt, Molluscum contagiosum virus
gggcagcuucugcucgcg

SEQ ID NO: 4033570 - RNA, 18 nt, Molluscum contagiosum virus
gggcaggcagugccgccg

SEQ ID NO: 4033571 - RNA, 22 nt, Molluscum contagiosum virus
gggccaggcacuggcccugcuu

SEQ ID NO: 4033572 - RNA, 13 nt, Molluscum contagiosum virus
gggcccgcgcgcg

SEQ ID NO: 4033573 - RNA, 16 nt, Molluscum contagiosum virus
gggccgcgaaagagga

SEQ ID NO: 4033574 - RNA, 11 nt, Molluscum contagiosum virus
gggccgcgagg

SEQ ID NO: 4033575 - RNA, 17 nt, Molluscum contagiosum virus
gggccgcgaggcauguc

SEQ ID NO: 4033576 - RNA, 12 nt, Molluscum contagiosum virus
gggccgcggcgc

SEQ ID NO: 4033577 - RNA, 20 nt, Molluscum contagiosum virus
gggccgcggcgcggcggaag

SEQ ID NO: 4033578 - RNA, 19 nt, Molluscum contagiosum virus
gggccuuuucacuggccgu

SEQ ID NO: 4033579 - RNA, 21 nt, Molluscum contagiosum virus
gggcgaacugcccggcggcaa

SEQ ID NO: 4033580 - RNA, 17 nt, Molluscum contagiosum virus
gggcgagagacagcacg

SEQ ID NO: 4033581 - RNA, 13 nt, Molluscum contagiosum virus
gggcgagcagugu

SEQ ID NO: 4033582 - RNA, 15 nt, Molluscum contagiosum virus
gggcgcgcaccccgu

SEQ ID NO: 4033583 - RNA, 17 nt, Molluscum contagiosum virus
gggcgcgcacuaccgca

SEQ ID NO: 4033584 - RNA, 14 nt, Molluscum contagiosum virus
gggcgcgggccugu

SEQ ID NO: 4033585 - RNA, 15 nt, Molluscum contagiosum virus
gggcgcuuccccguc

SEQ ID NO: 4033586 - RNA, 17 nt, Molluscum contagiosum virus
gggcucgugcuggagca

SEQ ID NO: 4033587 - RNA, 19 nt, Molluscum contagiosum virus
gggcucugccaccaugcgc

SEQ ID NO: 4033588 - RNA, 14 nt, Molluscum contagiosum virus
gggcugcgcggcgg

SEQ ID NO: 4033589 - RNA, 21 nt, Molluscum contagiosum virus
ggggaaugaucgacucgagca

SEQ ID NO: 4033590 - RNA, 22 nt, Molluscum contagiosum virus
ggggacgcgacgcgcguggagc

SEQ ID NO: 4033591 - RNA, 21 nt, Molluscum contagiosum virus
ggggagcauguccgacuccaa

SEQ ID NO: 4033592 - RNA, 10 nt, Molluscum contagiosum virus
gggggcagca

SEQ ID NO: 4033593 - RNA, 22 nt, Molluscum contagiosum virus
ggguaguugcgagccagccagg

SEQ ID NO: 4033594 - RNA, 10 nt, Molluscum contagiosum virus
ggguguacaa

SEQ ID NO: 4033595 - RNA, 22 nt, Molluscum contagiosum virus
gguaccccgcaggaaaggcacc

SEQ ID NO: 4033596 - RNA, 14 nt, Molluscum contagiosum virus
gguaccugcaggcu

SEQ ID NO: 4033597 - RNA, 16 nt, Molluscum contagiosum virus
gguaccugcaggcucu

SEQ ID NO: 4033598 - RNA, 14 nt, Molluscum contagiosum virus
gguacucaugcugc

SEQ ID NO: 4033599 - RNA, 18 nt, Molluscum contagiosum virus
gguacuggcgcccggcgc

SEQ ID NO: 4033600 - RNA, 16 nt, Molluscum contagiosum virus
ggucaagggugugggc

SEQ ID NO: 4033601 - RNA, 13 nt, Molluscum contagiosum virus
ggucacgcgcaca

SEQ ID NO: 4033602 - RNA, 14 nt, Molluscum contagiosum virus
ggucaucgggcugc

SEQ ID NO: 4033603 - RNA, 21 nt, Molluscum contagiosum virus
gguccaccagcugccgcuuga

SEQ ID NO: 4033604 - RNA, 18 nt, Molluscum contagiosum virus
gguccaccugcgacgccu

SEQ ID NO: 4033605 - RNA, 17 nt, Molluscum contagiosum virus
ggucgacgacgcgcgca

SEQ ID NO: 4033606 - RNA, 20 nt, Molluscum contagiosum virus
ggucgagcgcgccgcgcgcu

SEQ ID NO: 4033607 - RNA, 17 nt, Molluscum contagiosum virus
ggucgaguucacggcga

SEQ ID NO: 4033608 - RNA, 19 nt, Molluscum contagiosum virus
ggucgccuacgaggugcgc

SEQ ID NO: 4033609 - RNA, 18 nt, Molluscum contagiosum virus
ggucguccuggagccuag

SEQ ID NO: 4033610 - RNA, 20 nt, Molluscum contagiosum virus
ggucguguacacgccgggaa

SEQ ID NO: 4033611 - RNA, 18 nt, Molluscum contagiosum virus
ggucgugugcguacuggg

SEQ ID NO: 4033612 - RNA, 17 nt, Molluscum contagiosum virus
ggucuccgcgggcagcc

SEQ ID NO: 4033613 - RNA, 17 nt, Molluscum contagiosum virus
ggucucggggcuccgcc

SEQ ID NO: 4033614 - RNA, 14 nt, Molluscum contagiosum virus
ggugaaaauccagg

SEQ ID NO: 4033615 - RNA, 20 nt, Molluscum contagiosum virus
ggugagccguuccacacaga

SEQ ID NO: 4033616 - RNA, 12 nt, Molluscum contagiosum virus
ggugaggagcuc

SEQ ID NO: 4033617 - RNA, 18 nt, Molluscum contagiosum virus
ggugagugcgcgcacgaa

SEQ ID NO: 4033618 - RNA, 14 nt, Molluscum contagiosum virus
ggugcaaccgcugc

SEQ ID NO: 4033619 - RNA, 23 nt, Molluscum contagiosum virus
ggugccggaguuuguagcucuag

SEQ ID NO: 4033620 - RNA, 14 nt, Molluscum contagiosum virus
ggugccggccgccg

SEQ ID NO: 4033621 - RNA, 17 nt, Molluscum contagiosum virus
ggugcgcgacgggcucu

SEQ ID NO: 4033622 - RNA, 13 nt, Molluscum contagiosum virus
ggugcgcgcgcgc

SEQ ID NO: 4033623 - RNA, 14 nt, Molluscum contagiosum virus
ggugcgugcgggag

SEQ ID NO: 4033624 - RNA, 12 nt, Molluscum contagiosum virus
ggugcuggccau

SEQ ID NO: 4033625 - RNA, 22 nt, Molluscum contagiosum virus
gguggagguuuuccuguggccg

SEQ ID NO: 4033626 - RNA, 17 nt, Molluscum contagiosum virus
gguggccaacggcgcca

SEQ ID NO: 4033627 - RNA, 23 nt, Molluscum contagiosum virus
ggugucgagcucgcgcgccagca

SEQ ID NO: 4033628 - RNA, 18 nt, Molluscum contagiosum virus
gguucagguagcgcgccg

SEQ ID NO: 4033629 - RNA, 18 nt, Molluscum contagiosum virus
gguuccgagguagcucca

SEQ ID NO: 4033630 - RNA, 17 nt, Molluscum contagiosum virus
gguuccgcgccugccca

SEQ ID NO: 4033631 - RNA, 12 nt, Molluscum contagiosum virus
gguucugcgcug

SEQ ID NO: 4033632 - RNA, 20 nt, Molluscum contagiosum virus
gguugccaggcacacgcagu

SEQ ID NO: 4033633 - RNA, 14 nt, Molluscum contagiosum virus
gguugccgcucgca

SEQ ID NO: 4033634 - RNA, 23 nt, Molluscum contagiosum virus
gguugcgcggggcaggcagugcc

SEQ ID NO: 4033635 - RNA, 23 nt, Molluscum contagiosum virus
guaacaaggaaaaggcacacccc

SEQ ID NO: 4033636 - RNA, 14 nt, Molluscum contagiosum virus
guaacagcgcgcga

SEQ ID NO: 4033637 - RNA, 19 nt, Molluscum contagiosum virus
guacaauacaccuuucauu

SEQ ID NO: 4033638 - RNA, 23 nt, Molluscum contagiosum virus
guacaauacaccuuucauucgcu

SEQ ID NO: 4033639 - RNA, 19 nt, Molluscum contagiosum virus
guacacauggccgcgcgcu

SEQ ID NO: 4033640 - RNA, 13 nt, Molluscum contagiosum virus
guacacgcagagc

SEQ ID NO: 4033641 - RNA, 17 nt, Molluscum contagiosum virus
guaccaccguggaggag

SEQ ID NO: 4033642 - RNA, 15 nt, Molluscum contagiosum virus
guaccagccgcugcg

SEQ ID NO: 4033643 - RNA, 22 nt, Molluscum contagiosum virus
guaccagcucgcgccgccgcgc

SEQ ID NO: 4033644 - RNA, 18 nt, Molluscum contagiosum virus
guaccaguaccugcugcc

SEQ ID NO: 4033645 - RNA, 15 nt, Molluscum contagiosum virus
guaccccgcaggaaa

SEQ ID NO: 4033646 - RNA, 21 nt, Molluscum contagiosum virus
guacccgagcugugccaacau

SEQ ID NO: 4033647 - RNA, 19 nt, Molluscum contagiosum virus
guaccgccgcggccgcgag

SEQ ID NO: 4033648 - RNA, 14 nt, Molluscum contagiosum virus
guaccgcgcgcacg

SEQ ID NO: 4033649 - RNA, 17 nt, Molluscum contagiosum virus
guaccgcgcgcacgcgg

SEQ ID NO: 4033650 - RNA, 23 nt, Molluscum contagiosum virus
guacgacgugcugcugcagaacu

SEQ ID NO: 4033651 - RNA, 16 nt, Molluscum contagiosum virus
guacgcacgugccgug

SEQ ID NO: 4033652 - RNA, 14 nt, Molluscum contagiosum virus
guacgcggaggcgc

SEQ ID NO: 4033653 - RNA, 16 nt, Molluscum contagiosum virus
gcgcgcgcgcgccgga

SEQ ID NO: 4033654 - RNA, 15 nt, Molluscum contagiosum virus
gcgcgcgcgcggcgc

SEQ ID NO: 4033655 - RNA, 13 nt, Molluscum contagiosum virus
gcgcgcgcggcgc

SEQ ID NO: 4033656 - RNA, 20 nt, Molluscum contagiosum virus
gcgcgcggagaggacgcgug

SEQ ID NO: 4033657 - RNA, 17 nt, Molluscum contagiosum virus
gcgcgcggcacgccgcu

SEQ ID NO: 4033658 - RNA, 19 nt, Molluscum contagiosum virus
gcgcgcgugccuguggcgc

SEQ ID NO: 4033659 - RNA, 22 nt, Molluscum contagiosum virus
gcgcgcguucauuugcgugagg

SEQ ID NO: 4033660 - RNA, 12 nt, Molluscum contagiosum virus
gcgcgcguugcc

SEQ ID NO: 4033661 - RNA, 15 nt, Molluscum contagiosum virus
gcgcgcuaccugcgc

SEQ ID NO: 4033662 - RNA, 16 nt, Molluscum contagiosum virus
gcgcgcuacugcgcgc

SEQ ID NO: 4033663 - RNA, 19 nt, Molluscum contagiosum virus
gcgcgcuagagcgcggcgc

SEQ ID NO: 4033664 - RNA, 23 nt, Molluscum contagiosum virus
gcgcgcuauucaaagcugugcgu

SEQ ID NO: 4033665 - RNA, 20 nt, Molluscum contagiosum virus
gcgcgcuauucucguggcgu

SEQ ID NO: 4033666 - RNA, 19 nt, Molluscum contagiosum virus
gcgcgcucauggcgcgcaa

SEQ ID NO: 4033667 - RNA, 13 nt, Molluscum contagiosum virus
gcgcgcuccgaga

SEQ ID NO: 4033668 - RNA, 15 nt, Molluscum contagiosum virus
gcgcgcucuacgaga

SEQ ID NO: 4033669 - RNA, 13 nt, Molluscum contagiosum virus
gcgcgcugccgcg

SEQ ID NO: 4033670 - RNA, 13 nt, Molluscum contagiosum virus
gcgcgcugcgaac

SEQ ID NO: 4033671 - RNA, 13 nt, Molluscum contagiosum virus
gcgcgcugcgcac

SEQ ID NO: 4033672 - RNA, 21 nt, Molluscum contagiosum virus
gcgcgcugguuaccaagggca

SEQ ID NO: 4033673 - RNA, 12 nt, Molluscum contagiosum virus
gcgcgcuucuca

SEQ ID NO: 4033674 - RNA, 14 nt, Molluscum contagiosum virus
gcgcggcaagcagc

SEQ ID NO: 4033675 - RNA, 15 nt, Molluscum contagiosum virus
gcgcggcagccgcag

SEQ ID NO: 4033676 - RNA, 13 nt, Molluscum contagiosum virus
gcgcggcgcagug

SEQ ID NO: 4033677 - RNA, 15 nt, Molluscum contagiosum virus
gcgcggcgcgccgcc

SEQ ID NO: 4033678 - RNA, 22 nt, Molluscum contagiosum virus
gcgcggcgcgugccagucgcgc

SEQ ID NO: 4033679 - RNA, 13 nt, Molluscum contagiosum virus
gcgcggcggcagc

SEQ ID NO: 4033680 - RNA, 17 nt, Molluscum contagiosum virus
gcgcggcuagcaccgca

SEQ ID NO: 4033681 - RNA, 14 nt, Molluscum contagiosum virus
gcgcggcucgcgca

SEQ ID NO: 4033682 - RNA, 18 nt, Molluscum contagiosum virus
gcgcggcuuacacacgca

SEQ ID NO: 4033683 - RNA, 16 nt, Molluscum contagiosum virus
gcgcgggagcucacgg

SEQ ID NO: 4033684 - RNA, 17 nt, Molluscum contagiosum virus
gcgcgggaugcuggacg

SEQ ID NO: 4033685 - RNA, 14 nt, Molluscum contagiosum virus
gcgcgggccugucc

SEQ ID NO: 4033686 - RNA, 15 nt, Molluscum contagiosum virus
gcgcgggccuguccg

SEQ ID NO: 4033687 - RNA, 18 nt, Molluscum contagiosum virus
gcgcggggcacugcgcac

SEQ ID NO: 4033688 - RNA, 19 nt, Molluscum contagiosum virus
gcgcggggcacugcgcacg

SEQ ID NO: 4033689 - RNA, 21 nt, Molluscum contagiosum virus
gcgcggggcacugcgcacgga

SEQ ID NO: 4033690 - RNA, 17 nt, Molluscum contagiosum virus
gcgcgguccuguccgcg

SEQ ID NO: 4033691 - RNA, 16 nt, Molluscum contagiosum virus
gcgcggugcugcgcca

SEQ ID NO: 4033692 - RNA, 18 nt, Molluscum contagiosum virus
gcgcguacucgcgccgcg

SEQ ID NO: 4033693 - RNA, 22 nt, Molluscum contagiosum virus
gcgcguaugcgaacagccgccg

SEQ ID NO: 4033694 - RNA, 16 nt, Molluscum contagiosum virus
gcgcgucucugcgcag

SEQ ID NO: 4033695 - RNA, 17 nt, Molluscum contagiosum virus
gcgcgugagcacgggcg

SEQ ID NO: 4033696 - RNA, 14 nt, Molluscum contagiosum virus
gcgcgugcccgcag

SEQ ID NO: 4033697 - RNA, 21 nt, Molluscum contagiosum virus
gcgcgugcguacgugcacgug

SEQ ID NO: 4033698 - RNA, 12 nt, Molluscum contagiosum virus
gcgcgugcucga

SEQ ID NO: 4033699 - RNA, 13 nt, Molluscum contagiosum virus
gcgcgugcugcug

SEQ ID NO: 4033700 - RNA, 14 nt, Molluscum contagiosum virus
gcgcgugcuggacg

SEQ ID NO: 4033701 - RNA, 14 nt, Molluscum contagiosum virus
gcgcguggcucgcg

SEQ ID NO: 4033702 - RNA, 20 nt, Molluscum contagiosum virus
gcgcguucuuugugcggcuc

SEQ ID NO: 4033703 - RNA, 16 nt, Molluscum contagiosum virus
gcgcguuugucgcggg

SEQ ID NO: 4033704 - RNA, 17 nt, Molluscum contagiosum virus
gcgcuagagcgcggcgc

SEQ ID NO: 4033705 - RNA, 16 nt, Molluscum contagiosum virus
gcgcuagugaaccgca

SEQ ID NO: 4033706 - RNA, 13 nt, Molluscum contagiosum virus
gcgcuagugcaga

SEQ ID NO: 4033707 - RNA, 19 nt, Molluscum contagiosum virus
gcgcucacugcagcagccc

SEQ ID NO: 4033708 - RNA, 20 nt, Molluscum contagiosum virus
gcgcucgaacgcgcgugcgc

SEQ ID NO: 4033709 - RNA, 17 nt, Molluscum contagiosum virus
gcgcucgacgcgugcau

SEQ ID NO: 4033710 - RNA, 15 nt, Molluscum contagiosum virus
gcgcucgccccuucc

SEQ ID NO: 4033711 - RNA, 20 nt, Molluscum contagiosum virus
gcgcucgcucgcgcgcagcu

SEQ ID NO: 4033712 - RNA, 17 nt, Molluscum contagiosum virus
gcgcucguacucguugc

SEQ ID NO: 4033713 - RNA, 23 nt, Molluscum contagiosum virus
gcgcucgucaaugcgcacgugcu

SEQ ID NO: 4033714 - RNA, 13 nt, Molluscum contagiosum virus
gcgcucugccgcc

SEQ ID NO: 4033715 - RNA, 22 nt, Molluscum contagiosum virus
gcgcugcacaguucacggcgcu

SEQ ID NO: 4033716 - RNA, 13 nt, Molluscum contagiosum virus
gcgcugcaccgcu

SEQ ID NO: 4033717 - RNA, 17 nt, Molluscum contagiosum virus
gcgcugcagcaccugca

SEQ ID NO: 4033718 - RNA, 13 nt, Molluscum contagiosum virus
gcgcugcgcaagc

SEQ ID NO: 4033719 - RNA, 16 nt, Molluscum contagiosum virus
gcgcugcgcaagcgcu

SEQ ID NO: 4033720 - RNA, 12 nt, Molluscum contagiosum virus
gcgcugcgccgc

SEQ ID NO: 4033721 - RNA, 19 nt, Molluscum contagiosum virus
gcgcugcuacaagcggugc

SEQ ID NO: 4033722 - RNA, 22 nt, Molluscum contagiosum virus
gcgcugcucgccgucgcagaag

SEQ ID NO: 4033723 - RNA, 17 nt, Molluscum contagiosum virus
gcgcugcucgcgcucgc

SEQ ID NO: 4033724 - RNA, 12 nt, Molluscum contagiosum virus
gcgcugcugccc

SEQ ID NO: 4033725 - RNA, 14 nt, Molluscum contagiosum virus
gcgcuggagaaaga

SEQ ID NO: 4033726 - RNA, 15 nt, Molluscum contagiosum virus
gcgcugguggaggag

SEQ ID NO: 4033727 - RNA, 16 nt, Molluscum contagiosum virus
gcgcugguggaggagc

SEQ ID NO: 4033728 - RNA, 18 nt, Molluscum contagiosum virus
gcgcuguauaguccccgg

SEQ ID NO: 4033729 - RNA, 14 nt, Molluscum contagiosum virus
gcgcugucgcgcag

SEQ ID NO: 4033730 - RNA, 22 nt, Molluscum contagiosum virus
gcgcuuccgcgagucugccagc

SEQ ID NO: 4033731 - RNA, 21 nt, Molluscum contagiosum virus
gcgcuucguggacgagcgcua

SEQ ID NO: 4033732 - RNA, 14 nt, Molluscum contagiosum virus
gcgcuugggcacug

SEQ ID NO: 4033733 - RNA, 17 nt, Molluscum contagiosum virus
gcgcuugggcacugcua

SEQ ID NO: 4033734 - RNA, 16 nt, Molluscum contagiosum virus
gcgcuuugcgcggcgu

SEQ ID NO: 4033735 - RNA, 19 nt, Molluscum contagiosum virus
gcggaaaaaaacugcgcac

SEQ ID NO: 4033736 - RNA, 15 nt, Molluscum contagiosum virus
gcggaaacaagcaca

SEQ ID NO: 4033737 - RNA, 16 nt, Molluscum contagiosum virus
gcggaagcccgagcgc

SEQ ID NO: 4033738 - RNA, 12 nt, Molluscum contagiosum virus
gcggacgcgggc

SEQ ID NO: 4033739 - RNA, 19 nt, Molluscum contagiosum virus
gcggacgcgggccgcgcgc

SEQ ID NO: 4033740 - RNA, 16 nt, Molluscum contagiosum virus
gcggacgcgggccugu

SEQ ID NO: 4033741 - RNA, 14 nt, Molluscum contagiosum virus
gcggagagcagugc

SEQ ID NO: 4033742 - RNA, 18 nt, Molluscum contagiosum virus
gcggagagcagugccgcu

SEQ ID NO: 4033743 - RNA, 21 nt, Molluscum contagiosum virus
gcggagagcagugccgcucgc

SEQ ID NO: 4033744 - RNA, 20 nt, Molluscum contagiosum virus
gcggagaucgccgcgcaagu

SEQ ID NO: 4033745 - RNA, 23 nt, Molluscum contagiosum virus
gcggagccggccuagagcuggca

SEQ ID NO: 4033746 - RNA, 23 nt, Molluscum contagiosum virus
gcggagcgcuagcagggcggcgc

SEQ ID NO: 4033747 - RNA, 20 nt, Molluscum contagiosum virus
gcggagcugugccaucucgc

SEQ ID NO: 4033748 - RNA, 19 nt, Molluscum contagiosum virus
gcggagggugcacgcgggc

SEQ ID NO: 4033749 - RNA, 19 nt, Molluscum contagiosum virus
gcggauacuucgcgcgucg

SEQ ID NO: 4033750 - RNA, 19 nt, Molluscum contagiosum virus
gcggcaaaggcccgcgagc

SEQ ID NO: 4033751 - RNA, 14 nt, Molluscum contagiosum virus
gcggcaaccgcgcc

SEQ ID NO: 4033752 - RNA, 21 nt, Molluscum contagiosum virus
gcggcacacaugcuagcgggc

SEQ ID NO: 4033753 - RNA, 19 nt, Molluscum contagiosum virus
gcggcacccgccgcggugc

SEQ ID NO: 4033754 - RNA, 16 nt, Molluscum contagiosum virus
gcggcaccugucgcgc

SEQ ID NO: 4033755 - RNA, 14 nt, Molluscum contagiosum virus
gcggcacuugcagg

SEQ ID NO: 4033756 - RNA, 14 nt, Molluscum contagiosum virus
gcggcaggcgcugc

SEQ ID NO: 4033757 - RNA, 21 nt, Molluscum contagiosum virus
gcggcagguuugcacccgcgc

SEQ ID NO: 4033758 - RNA, 22 nt, Molluscum contagiosum virus
gcggcauugugguguucgcagg

SEQ ID NO: 4033759 - RNA, 20 nt, Molluscum contagiosum virus
gcggccaaccgccugcucuc

SEQ ID NO: 4033760 - RNA, 19 nt, Molluscum contagiosum virus
gcggccauggucacgcgca

SEQ ID NO: 4033761 - RNA, 21 nt, Molluscum contagiosum virus
gcggcccuucguguucgcgga

SEQ ID NO: 4033762 - RNA, 23 nt, Molluscum contagiosum virus
gcggccgggaucggacgcagacg

SEQ ID NO: 4033763 - RNA, 22 nt, Molluscum contagiosum virus
gcggcgccacgagcgccgcgac

SEQ ID NO: 4033764 - RNA, 14 nt, Molluscum contagiosum virus
gcggcgccgcagcu

SEQ ID NO: 4033765 - RNA, 13 nt, Molluscum contagiosum virus
gcggcgcgccgcg

SEQ ID NO: 4033766 - RNA, 14 nt, Molluscum contagiosum virus
gcggcgcgccggcc

SEQ ID NO: 4033767 - RNA, 15 nt, Molluscum contagiosum virus
gcggcgcgccggccc

SEQ ID NO: 4033768 - RNA, 23 nt, Molluscum contagiosum virus
gcggcgcgcgcugagcgcggagc

SEQ ID NO: 4033769 - RNA, 14 nt, Molluscum contagiosum virus
gcggcgcggcugcu

SEQ ID NO: 4033770 - RNA, 19 nt, Molluscum contagiosum virus
gcggcgcguacucgcgccg

SEQ ID NO: 4033771 - RNA, 15 nt, Molluscum contagiosum virus
gcggcgcgugcugag

SEQ ID NO: 4033772 - RNA, 15 nt, Molluscum contagiosum virus
gcggcgcgugucgcg

SEQ ID NO: 4033773 - RNA, 17 nt, Molluscum contagiosum virus
gcggcgcgugucgcgga

SEQ ID NO: 4033774 - RNA, 15 nt, Molluscum contagiosum virus
gcggcgcucgcagca

SEQ ID NO: 4033775 - RNA, 19 nt, Molluscum contagiosum virus
gcggcggaaguggugcccg

SEQ ID NO: 4033776 - RNA, 14 nt, Molluscum contagiosum virus
gcggcggccccugc

SEQ ID NO: 4033777 - RNA, 17 nt, Molluscum contagiosum virus
gcggcggcguaggccug

SEQ ID NO: 4033778 - RNA, 16 nt, Molluscum contagiosum virus
gcggcggggcugcugg

SEQ ID NO: 4033779 - RNA, 16 nt, Molluscum contagiosum virus
gcggcguacgcgcagg

SEQ ID NO: 4033780 - RNA, 17 nt, Molluscum contagiosum virus
gcggcgugcugcagccc

SEQ ID NO: 4033781 - RNA, 13 nt, Molluscum contagiosum virus
gcggcugcuggag

SEQ ID NO: 4033782 - RNA, 21 nt, Molluscum contagiosum virus
gcggcuuuaacguuagcacua

SEQ ID NO: 4033783 - RNA, 20 nt, Molluscum contagiosum virus
gcgggaagaggacgccggca

SEQ ID NO: 4033784 - RNA, 18 nt, Molluscum contagiosum virus
gcgggacagagcucggca

SEQ ID NO: 4033785 - RNA, 21 nt, Molluscum contagiosum virus
gcgggacgcgugccuggcuug

SEQ ID NO: 4033786 - RNA, 14 nt, Molluscum contagiosum virus
gcgggcacggcuac

SEQ ID NO: 4033787 - RNA, 12 nt, Molluscum contagiosum virus
gcgggccaggca

SEQ ID NO: 4033788 - RNA, 23 nt, Molluscum contagiosum virus
gcgggccaggcacuggcccugcu

SEQ ID NO: 4033789 - RNA, 18 nt, Molluscum contagiosum virus
gcgggcccgugcucaggc

SEQ ID NO: 4033790 - RNA, 17 nt, Molluscum contagiosum virus
gcgggccuguaccugcg

SEQ ID NO: 4033791 - RNA, 20 nt, Molluscum contagiosum virus
gcgggccuguaccugcgaca

SEQ ID NO: 4033792 - RNA, 17 nt, Molluscum contagiosum virus
gcgggccuguccgcggg

SEQ ID NO: 4033793 - RNA, 24 nt, Molluscum contagiosum virus
gcgggccuguccgcgggcgcacgc

SEQ ID NO: 4033794 - RNA, 22 nt, Molluscum contagiosum virus
gcgggcgcgcgccagcagcgcc

SEQ ID NO: 4033795 - RNA, 23 nt, Molluscum contagiosum virus
gcgggcucuuccaccggcagcgc

SEQ ID NO: 4033796 - RNA, 22 nt, Molluscum contagiosum virus
gcgggcuguuccaagaagacua

SEQ ID NO: 4033797 - RNA, 14 nt, Molluscum contagiosum virus
gcggggagcucugc

SEQ ID NO: 4033798 - RNA, 20 nt, Molluscum contagiosum virus
gcgguccuguccgcggacgc

SEQ ID NO: 4033799 - RNA, 20 nt, Molluscum contagiosum virus
gcggucucggcagcagcgug

SEQ ID NO: 4033800 - RNA, 23 nt, Molluscum contagiosum virus
gcggucugaaacacggaggagcg

SEQ ID NO: 4033801 - RNA, 16 nt, Molluscum contagiosum virus
gcggugcgugcgggag

SEQ ID NO: 4033802 - RNA, 20 nt, Molluscum contagiosum virus
gcgguggccgcgccgggcgc

SEQ ID NO: 4033803 - RNA, 22 nt, Molluscum contagiosum virus
gcgguguaugcucgucgccggg

SEQ ID NO: 4033804 - RNA, 20 nt, Molluscum contagiosum virus
gcguacacauggccgcgcgc

SEQ ID NO: 4033805 - RNA, 19 nt, Molluscum contagiosum virus
gcguacgugcacguggcgc

SEQ ID NO: 4033806 - RNA, 16 nt, Molluscum contagiosum virus
gcguacuccguggugc

SEQ ID NO: 4033807 - RNA, 13 nt, Molluscum contagiosum virus
gcguagccgccgc

SEQ ID NO: 4033808 - RNA, 18 nt, Molluscum contagiosum virus
gcguagcuagcucugcgc

SEQ ID NO: 4033809 - RNA, 19 nt, Molluscum contagiosum virus
gcguaguaguagcgcucgc

SEQ ID NO: 4033810 - RNA, 22 nt, Molluscum contagiosum virus
gcgucaagacucgcccgcgcgc

SEQ ID NO: 4033811 - RNA, 15 nt, Molluscum contagiosum virus
gcgucacguacucgc

SEQ ID NO: 4033812 - RNA, 16 nt, Molluscum contagiosum virus
gcgucaucgcugcacg

SEQ ID NO: 4033813 - RNA, 15 nt, Molluscum contagiosum virus
gcgucaugcgcgcgc

SEQ ID NO: 4033814 - RNA, 15 nt, Molluscum contagiosum virus
gcguccacggcgcgc

SEQ ID NO: 4033815 - RNA, 22 nt, Molluscum contagiosum virus
gcguccgcaaagccggccccgc

SEQ ID NO: 4033816 - RNA, 24 nt, Molluscum contagiosum virus
gcguccggcaugcgcgcgcugcca

SEQ ID NO: 4033817 - RNA, 14 nt, Molluscum contagiosum virus
gcguccggcgcuug

SEQ ID NO: 4033818 - RNA, 17 nt, Molluscum contagiosum virus
gcguccgugcgcagggc

SEQ ID NO: 4033819 - RNA, 12 nt, Molluscum contagiosum virus
gcgucgcgcagg

SEQ ID NO: 4033820 - RNA, 17 nt, Molluscum contagiosum virus
gcgucgcgcgccgcgcu

SEQ ID NO: 4033821 - RNA, 17 nt, Molluscum contagiosum virus
gcgucgcgcgccgugcc

SEQ ID NO: 4033822 - RNA, 21 nt, Molluscum contagiosum virus
gcgucgugcuccacgcgcagc

SEQ ID NO: 4033823 - RNA, 13 nt, Molluscum contagiosum virus
gcgucgugugcgc

SEQ ID NO: 4033824 - RNA, 14 nt, Molluscum contagiosum virus
gcgucgugugcgcg

SEQ ID NO: 4033825 - RNA, 18 nt, Molluscum contagiosum virus
gcgugaacaauacaugcu

SEQ ID NO: 4033826 - RNA, 23 nt, Molluscum contagiosum virus
gcgugacaaucucugcgccgcgc

SEQ ID NO: 4033827 - RNA, 13 nt, Molluscum contagiosum virus
gcgugaccagugc

SEQ ID NO: 4033828 - RNA, 19 nt, Molluscum contagiosum virus
gcgugaccauggacacgcu

SEQ ID NO: 4033829 - RNA, 19 nt, Molluscum contagiosum virus
gcgugcaagcccagcagcg

SEQ ID NO: 4033830 - RNA, 18 nt, Molluscum contagiosum virus
gcgugcagggcgugcuug

SEQ ID NO: 4033831 - RNA, 16 nt, Molluscum contagiosum virus
gcgugcaugcccagca

SEQ ID NO: 4033832 - RNA, 16 nt, Molluscum contagiosum virus
gcgugcauuuuuccgc

SEQ ID NO: 4033833 - RNA, 19 nt, Molluscum contagiosum virus
gcgugccgggcuugcuccc

SEQ ID NO: 4033834 - RNA, 19 nt, Molluscum contagiosum virus
gcgugccuggcuugcgcgc

SEQ ID NO: 4033835 - RNA, 21 nt, Molluscum contagiosum virus
gcgugccuggcuugcgcgcgc

SEQ ID NO: 4033836 - RNA, 22 nt, Molluscum contagiosum virus
gcgugcgauugccccugggcuu

SEQ ID NO: 4033837 - RNA, 13 nt, Molluscum contagiosum virus
gcgugcgcuggcg

SEQ ID NO: 4033838 - RNA, 18 nt, Molluscum contagiosum virus
gcgugcggaucggcacug

SEQ ID NO: 4033839 - RNA, 13 nt, Molluscum contagiosum virus
gcgugcgugcaca

SEQ ID NO: 4033840 - RNA, 12 nt, Molluscum contagiosum virus
gcgugcuggacg

SEQ ID NO: 4033841 - RNA, 18 nt, Molluscum contagiosum virus
gcgugcuuuuucugugcg

SEQ ID NO: 4033842 - RNA, 14 nt, Molluscum contagiosum virus
gcguggacaacagc

SEQ ID NO: 4033843 - RNA, 18 nt, Molluscum contagiosum virus
gcguggcgcgcgagcugc

SEQ ID NO: 4033844 - RNA, 22 nt, Molluscum contagiosum virus
gcguggcuuugucggugugcuu

SEQ ID NO: 4033845 - RNA, 19 nt, Molluscum contagiosum virus
gcgugggcagccgccuggc

SEQ ID NO: 4033846 - RNA, 16 nt, Molluscum contagiosum virus
gcgugucugcgcucgc

SEQ ID NO: 4033847 - RNA, 14 nt, Molluscum contagiosum virus
gcgugugccggugc

SEQ ID NO: 4033848 - RNA, 19 nt, Molluscum contagiosum virus
gcguguuccggcagcgccg

SEQ ID NO: 4033849 - RNA, 17 nt, Molluscum contagiosum virus
gcguguuugugcugucc

SEQ ID NO: 4033850 - RNA, 23 nt, Molluscum contagiosum virus
gcguucaccuuggcgcugcacag

SEQ ID NO: 4033851 - RNA, 19 nt, Molluscum contagiosum virus
gcguugcucccgucgagca

SEQ ID NO: 4033852 - RNA, 14 nt, Molluscum contagiosum virus
gcguugucgagaau

SEQ ID NO: 4033853 - RNA, 12 nt, Molluscum contagiosum virus
gcuaagcucugc

SEQ ID NO: 4033854 - RNA, 16 nt, Molluscum contagiosum virus
gcuaaucugccgcggc

SEQ ID NO: 4033855 - RNA, 17 nt, Molluscum contagiosum virus
gcuacccguugcugcgc

SEQ ID NO: 4033856 - RNA, 21 nt, Molluscum contagiosum virus
gcuaccgcagccacggccgcg

SEQ ID NO: 4033857 - RNA, 17 nt, Molluscum contagiosum virus
gcuaccugaagcuggac

SEQ ID NO: 4033858 - RNA, 19 nt, Molluscum contagiosum virus
gcuaccugaagcuggacgu

SEQ ID NO: 4033859 - RNA, 21 nt, Molluscum contagiosum virus
gcuaccugcgcaagcucagcc

SEQ ID NO: 4033860 - RNA, 22 nt, Molluscum contagiosum virus
gcuaccugcgcaagcucagccu

SEQ ID NO: 4033861 - RNA, 20 nt, Molluscum contagiosum virus
gccaggcggucuuccagcac

SEQ ID NO: 4033862 - RNA, 14 nt, Molluscum contagiosum virus
gccaggcguagcgc

SEQ ID NO: 4033863 - RNA, 15 nt, Molluscum contagiosum virus
gccaggcuaggcgcg

SEQ ID NO: 4033864 - RNA, 22 nt, Molluscum contagiosum virus
gccaggcuaggcgcgacugcac

SEQ ID NO: 4033865 - RNA, 18 nt, Molluscum contagiosum virus
gccaggugcgaaggcucg

SEQ ID NO: 4033866 - RNA, 14 nt, Molluscum contagiosum virus
gccaguggccagcg

SEQ ID NO: 4033867 - RNA, 19 nt, Molluscum contagiosum virus
gccaucgaaacucugcacg

SEQ ID NO: 4033868 - RNA, 14 nt, Molluscum contagiosum virus
gccaugcgcuugcg

SEQ ID NO: 4033869 - RNA, 14 nt, Molluscum contagiosum virus
gccaugcuccugau

SEQ ID NO: 4033870 - RNA, 16 nt, Molluscum contagiosum virus
gccaugcuccugaucu

SEQ ID NO: 4033871 - RNA, 22 nt, Molluscum contagiosum virus
gccauggaggcgcuagugcaga

SEQ ID NO: 4033872 - RNA, 18 nt, Molluscum contagiosum virus
gcccaagaagaagcagca

SEQ ID NO: 4033873 - RNA, 17 nt, Molluscum contagiosum virus
gcccaccuucuugucgc

SEQ ID NO: 4033874 - RNA, 22 nt, Molluscum contagiosum virus
gcccacgagcgccagccugugc

SEQ ID NO: 4033875 - RNA, 14 nt, Molluscum contagiosum virus
gcccacgcgcaagg

SEQ ID NO: 4033876 - RNA, 18 nt, Molluscum contagiosum virus
gcccacguugccgcgcgc

SEQ ID NO: 4033877 - RNA, 19 nt, Molluscum contagiosum virus
gcccacguugccgcgcgcu

SEQ ID NO: 4033878 - RNA, 14 nt, Molluscum contagiosum virus
gcccacuuccguga

SEQ ID NO: 4033879 - RNA, 22 nt, Molluscum contagiosum virus
gcccagaacaugucgagaccuu

SEQ ID NO: 4033880 - RNA, 19 nt, Molluscum contagiosum virus
gcccagccugacggcagca

SEQ ID NO: 4033881 - RNA, 10 nt, Molluscum contagiosum virus
gcccagcgcc

SEQ ID NO: 4033882 - RNA, 13 nt, Molluscum contagiosum virus
gcccagcgccacg

SEQ ID NO: 4033883 - RNA, 15 nt, Molluscum contagiosum virus
gcccagcguggccag

SEQ ID NO: 4033884 - RNA, 21 nt, Molluscum contagiosum virus
gcccaggccauggagcgcccg

SEQ ID NO: 4033885 - RNA, 17 nt, Molluscum contagiosum virus
gcccaugcucaccgccg

SEQ ID NO: 4033886 - RNA, 19 nt, Molluscum contagiosum virus
gccccacugugccagcagc

SEQ ID NO: 4033887 - RNA, 20 nt, Molluscum contagiosum virus
gccccagaaggucgugcgag

SEQ ID NO: 4033888 - RNA, 20 nt, Molluscum contagiosum virus
gcccccgcaaaagaugaaaa

SEQ ID NO: 4033889 - RNA, 19 nt, Molluscum contagiosum virus
gccccgacgccagcgcgcc

SEQ ID NO: 4033890 - RNA, 21 nt, Molluscum contagiosum virus
gccccguccucgcucgugcuc

SEQ ID NO: 4033891 - RNA, 23 nt, Molluscum contagiosum virus
gccccucgugugucggcccggag

SEQ ID NO: 4033892 - RNA, 16 nt, Molluscum contagiosum virus
gccccugccuuugcca

SEQ ID NO: 4033893 - RNA, 11 nt, Molluscum contagiosum virus
gccccugcugc

SEQ ID NO: 4033894 - RNA, 22 nt, Molluscum contagiosum virus
gcccgacuuuggcuacgacggc

SEQ ID NO: 4033895 - RNA, 20 nt, Molluscum contagiosum virus
gcccgacuuuucgcgccgcg

SEQ ID NO: 4033896 - RNA, 21 nt, Molluscum contagiosum virus
gcccgacuuuucgcgccgcgg

SEQ ID NO: 4033897 - RNA, 13 nt, Molluscum contagiosum virus
gcccgagcccggc

SEQ ID NO: 4033898 - RNA, 20 nt, Molluscum contagiosum virus
gcccgagcgcguccaugagc

SEQ ID NO: 4033899 - RNA, 20 nt, Molluscum contagiosum virus
gcccgaggagagcggcgccc

SEQ ID NO: 4033900 - RNA, 16 nt, Molluscum contagiosum virus
gcccgagggcgggcac

SEQ ID NO: 4033901 - RNA, 22 nt, Molluscum contagiosum virus
gcccgaguagaagagcguggac

SEQ ID NO: 4033902 - RNA, 22 nt, Molluscum contagiosum virus
gcccgaguauacucgacgcgcg

SEQ ID NO: 4033903 - RNA, 18 nt, Molluscum contagiosum virus
gcccgaguuugcccgcgg

SEQ ID NO: 4033904 - RNA, 14 nt, Molluscum contagiosum virus
gcccgccgggcacc

SEQ ID NO: 4033905 - RNA, 23 nt, Molluscum contagiosum virus
gcccgccgggcaccggcgcucac

SEQ ID NO: 4033906 - RNA, 22 nt, Molluscum contagiosum virus
gcccgccuacggggcugcuccg

SEQ ID NO: 4033907 - RNA, 16 nt, Molluscum contagiosum virus
gcccgcgaacgagaga

SEQ ID NO: 4033908 - RNA, 17 nt, Molluscum contagiosum virus
gcccgcgcccgcgccgc

SEQ ID NO: 4033909 - RNA, 13 nt, Molluscum contagiosum virus
gcccgcgcgcgca

SEQ ID NO: 4033910 - RNA, 18 nt, Molluscum contagiosum virus
gcccgcgcucgccgcacg

SEQ ID NO: 4033911 - RNA, 15 nt, Molluscum contagiosum virus
gcccgcggacgcgca

SEQ ID NO: 4033912 - RNA, 20 nt, Molluscum contagiosum virus
gcccgcggacucgugcacca

SEQ ID NO: 4033913 - RNA, 19 nt, Molluscum contagiosum virus
gcccgcggagaccaccgcu

SEQ ID NO: 4033914 - RNA, 22 nt, Molluscum contagiosum virus
gcccgcggcacaugcagcugca

SEQ ID NO: 4033915 - RNA, 23 nt, Molluscum contagiosum virus
gcccgcguacacgugcacgcgca

SEQ ID NO: 4033916 - RNA, 16 nt, Molluscum contagiosum virus
gcccgcgucccgacag

SEQ ID NO: 4033917 - RNA, 16 nt, Molluscum contagiosum virus
gcccggaucugguccg

SEQ ID NO: 4033918 - RNA, 14 nt, Molluscum contagiosum virus
gcccggcaccgcgg

SEQ ID NO: 4033919 - RNA, 16 nt, Molluscum contagiosum virus
gcccggcggcccgcgg

SEQ ID NO: 4033920 - RNA, 23 nt, Molluscum contagiosum virus
gcccgggagaguggccgcuccag

SEQ ID NO: 4033921 - RNA, 12 nt, Molluscum contagiosum virus
gcccgugcucag

SEQ ID NO: 4033922 - RNA, 17 nt, Molluscum contagiosum virus
gcccgugcuugcgcacg

SEQ ID NO: 4033923 - RNA, 22 nt, Molluscum contagiosum virus
gcccguguucgcggagcugugc

SEQ ID NO: 4033924 - RNA, 22 nt, Molluscum contagiosum virus
gcccuacgcgcgcgugcugcua

SEQ ID NO: 4033925 - RNA, 20 nt, Molluscum contagiosum virus
gcccuccucgaccugcacga

SEQ ID NO: 4033926 - RNA, 15 nt, Molluscum contagiosum virus
gcccucgcgcgcagc

SEQ ID NO: 4033927 - RNA, 15 nt, Molluscum contagiosum virus
gcccugcacgaccgc

SEQ ID NO: 4033928 - RNA, 22 nt, Molluscum contagiosum virus
gcccugcucaugcgcaagcagc

SEQ ID NO: 4033929 - RNA, 18 nt, Molluscum contagiosum virus
gcccuggagcgcaguccc

SEQ ID NO: 4033930 - RNA, 20 nt, Molluscum contagiosum virus
gccgaccauuuccugcgagu

SEQ ID NO: 4033931 - RNA, 16 nt, Molluscum contagiosum virus
gccgacggcacgggca

SEQ ID NO: 4033932 - RNA, 16 nt, Molluscum contagiosum virus
gccgagauggagcuca

SEQ ID NO: 4033933 - RNA, 17 nt, Molluscum contagiosum virus
gccgagcgccgccagcu

SEQ ID NO: 4033934 - RNA, 20 nt, Molluscum contagiosum virus
gccgagcgccgccagcuccg

SEQ ID NO: 4033935 - RNA, 15 nt, Molluscum contagiosum virus
gccgaggcgcugccg

SEQ ID NO: 4033936 - RNA, 20 nt, Molluscum contagiosum virus
gccgaguaccgcgcgcacgc

SEQ ID NO: 4033937 - RNA, 22 nt, Molluscum contagiosum virus
ccgugcccgccgacugccgccg

SEQ ID NO: 4033938 - RNA, 23 nt, Molluscum contagiosum virus
ccgugcugcgucacaagcaccgc

SEQ ID NO: 4033939 - RNA, 18 nt, Molluscum contagiosum virus
ccguggaggagccgcccg

SEQ ID NO: 4033940 - RNA, 12 nt, Molluscum contagiosum virus
ccgugggcggca

SEQ ID NO: 4033941 - RNA, 22 nt, Molluscum contagiosum virus
ccguguucgcggagcugugccg

SEQ ID NO: 4033942 - RNA, 19 nt, Molluscum contagiosum virus
ccguugcacgugcgugccc

SEQ ID NO: 4033943 - RNA, 20 nt, Molluscum contagiosum virus
ccuacgagcacauacacgcg

SEQ ID NO: 4033944 - RNA, 21 nt, Molluscum contagiosum virus
ccuagcgcgcgugugcauggc

SEQ ID NO: 4033945 - RNA, 14 nt, Molluscum contagiosum virus
ccuagcuccagcgu

SEQ ID NO: 4033946 - RNA, 21 nt, Molluscum contagiosum virus
ccuagcuucugcguugccagc

SEQ ID NO: 4033947 - RNA, 15 nt, Molluscum contagiosum virus
ccucagccgagcgcc

SEQ ID NO: 4033948 - RNA, 20 nt, Molluscum contagiosum virus
ccuccaagaagaggccagca

SEQ ID NO: 4033949 - RNA, 22 nt, Molluscum contagiosum virus
ccuccacguccaggccgcggca

SEQ ID NO: 4033950 - RNA, 17 nt, Molluscum contagiosum virus
ccuccagcagcggcgcg

SEQ ID NO: 4033951 - RNA, 14 nt, Molluscum contagiosum virus
ccuccagggcacga

SEQ ID NO: 4033952 - RNA, 18 nt, Molluscum contagiosum virus
ccucccucgucgcgcuuc

SEQ ID NO: 4033953 - RNA, 16 nt, Molluscum contagiosum virus
ccuccgagcgcgcgug

SEQ ID NO: 4033954 - RNA, 18 nt, Molluscum contagiosum virus
ccuccgcggacgcgcccu

SEQ ID NO: 4033955 - RNA, 19 nt, Molluscum contagiosum virus
ccuccuagcccagcacgcg

SEQ ID NO: 4033956 - RNA, 15 nt, Molluscum contagiosum virus
ccuccugaugcccgc

SEQ ID NO: 4033957 - RNA, 21 nt, Molluscum contagiosum virus
ccuccuugauuucgcgcagca

SEQ ID NO: 4033958 - RNA, 20 nt, Molluscum contagiosum virus
ccucgaaggcgugcgccgug

SEQ ID NO: 4033959 - RNA, 17 nt, Molluscum contagiosum virus
ccucgacgcgcugcucu

SEQ ID NO: 4033960 - RNA, 22 nt, Molluscum contagiosum virus
ccucgagcacgccuccaagaag

SEQ ID NO: 4033961 - RNA, 19 nt, Molluscum contagiosum virus
ccucgccaaagaggacgug

SEQ ID NO: 4033962 - RNA, 14 nt, Molluscum contagiosum virus
ccucgcgcacagac

SEQ ID NO: 4033963 - RNA, 16 nt, Molluscum contagiosum virus
ccucgcgcgcagcuuu

SEQ ID NO: 4033964 - RNA, 17 nt, Molluscum contagiosum virus
ccucgcguagcagcgcc

SEQ ID NO: 4033965 - RNA, 20 nt, Molluscum contagiosum virus
ccucgcguagcagcgccugc

SEQ ID NO: 4033966 - RNA, 15 nt, Molluscum contagiosum virus
ccucgcucugcucuu

SEQ ID NO: 4033967 - RNA, 18 nt, Molluscum contagiosum virus
ccucggcacucgcguccg

SEQ ID NO: 4033968 - RNA, 13 nt, Molluscum contagiosum virus
ccucggcgcacac

SEQ ID NO: 4033969 - RNA, 16 nt, Molluscum contagiosum virus
ccucggcgcacacucc

SEQ ID NO: 4033970 - RNA, 19 nt, Molluscum contagiosum virus
ccucgggccgcagccgcgc

SEQ ID NO: 4033971 - RNA, 22 nt, Molluscum contagiosum virus
ccucgucgaucauguccacagc

SEQ ID NO: 4033972 - RNA, 18 nt, Molluscum contagiosum virus
ccucgucguccacaggcg

SEQ ID NO: 4033973 - RNA, 20 nt, Molluscum contagiosum virus
ccucgugggauaggcacaca

SEQ ID NO: 4033974 - RNA, 22 nt, Molluscum contagiosum virus
ccucgugggauaggcacacacg

SEQ ID NO: 4033975 - RNA, 15 nt, Molluscum contagiosum virus
ccucuacaccagcug

SEQ ID NO: 4033976 - RNA, 19 nt, Molluscum contagiosum virus
ccucucgaggccggcacga

SEQ ID NO: 4033977 - RNA, 22 nt, Molluscum contagiosum virus
ccucucgaggccggcacgagca

SEQ ID NO: 4033978 - RNA, 20 nt, Molluscum contagiosum virus
ccucugcgagcgccugcgag

SEQ ID NO: 4033979 - RNA, 19 nt, Molluscum contagiosum virus
ccugaaccugggcgcgcac

SEQ ID NO: 4033980 - RNA, 14 nt, Molluscum contagiosum virus
ccugagaagcugua

SEQ ID NO: 4033981 - RNA, 16 nt, Molluscum contagiosum virus
ccugagaaggagcgga

SEQ ID NO: 4033982 - RNA, 20 nt, Molluscum contagiosum virus
ccugaugacggcagacggca

SEQ ID NO: 4033983 - RNA, 17 nt, Molluscum contagiosum virus
ccugaugcccgcgagau

SEQ ID NO: 4033984 - RNA, 21 nt, Molluscum contagiosum virus
ccugcaaacgcgaaacuggac

SEQ ID NO: 4033985 - RNA, 15 nt, Molluscum contagiosum virus
ccugcaccaccagug

SEQ ID NO: 4033986 - RNA, 16 nt, Molluscum contagiosum virus
ccugcaccaccagugc

SEQ ID NO: 4033987 - RNA, 18 nt, Molluscum contagiosum virus
ccugcaccgagugcuggc

SEQ ID NO: 4033988 - RNA, 14 nt, Molluscum contagiosum virus
ccugcacgcacgcg

SEQ ID NO: 4033989 - RNA, 13 nt, Molluscum contagiosum virus
ccugcacgcgcac

SEQ ID NO: 4033990 - RNA, 21 nt, Molluscum contagiosum virus
ccugcacuucggacaccucac

SEQ ID NO: 4033991 - RNA, 22 nt, Molluscum contagiosum virus
ccugcaggaaaggcacccgcag

SEQ ID NO: 4033992 - RNA, 18 nt, Molluscum contagiosum virus
ccugcauuucaugcgcgg

SEQ ID NO: 4033993 - RNA, 13 nt, Molluscum contagiosum virus
ccugccagcagag

SEQ ID NO: 4033994 - RNA, 18 nt, Molluscum contagiosum virus
ccugccgcgagcacuggc

SEQ ID NO: 4033995 - RNA, 17 nt, Molluscum contagiosum virus
ccugcgacagcugcugc

SEQ ID NO: 4033996 - RNA, 22 nt, Molluscum contagiosum virus
ccugcgacagcugcugcucgca

SEQ ID NO: 4033997 - RNA, 20 nt, Molluscum contagiosum virus
ccugcgauacccuuggcagc

SEQ ID NO: 4033998 - RNA, 18 nt, Molluscum contagiosum virus
ccugcgcgcgagagcuuc

SEQ ID NO: 4033999 - RNA, 16 nt, Molluscum contagiosum virus
ccugcggaacgcgcau

SEQ ID NO: 4034000 - RNA, 19 nt, Molluscum contagiosum virus
ccugcggacccgccggugc

SEQ ID NO: 4034001 - RNA, 22 nt, Molluscum contagiosum virus
ccugcggacccgccggugcuug

SEQ ID NO: 4034002 - RNA, 18 nt, Molluscum contagiosum virus
ccugcggcucgcacuugc

SEQ ID NO: 4034003 - RNA, 19 nt, Molluscum contagiosum virus
ccugcggguaguugcgagc

SEQ ID NO: 4034004 - RNA, 22 nt, Molluscum contagiosum virus
ccugcguggacagcaucccugc

SEQ ID NO: 4034005 - RNA, 20 nt, Molluscum contagiosum virus
ccugcucucgcgcgccagca

SEQ ID NO: 4034006 - RNA, 13 nt, Molluscum contagiosum virus
ccugcugcagcuc

SEQ ID NO: 4034007 - RNA, 16 nt, Molluscum contagiosum virus
ccugcugcagcuccgc

SEQ ID NO: 4034008 - RNA, 21 nt, Molluscum contagiosum virus
ccugcugcgagagcaugccua

SEQ ID NO: 4034009 - RNA, 21 nt, Molluscum contagiosum virus
ccugcuggcaccgcgcgcgcu

SEQ ID NO: 4034010 - RNA, 15 nt, Molluscum contagiosum virus
ccugcuggcgcgcug

SEQ ID NO: 4034011 - RNA, 14 nt, Molluscum contagiosum virus
ccugcuggcgugcg

SEQ ID NO: 4034012 - RNA, 20 nt, Molluscum contagiosum virus
ccugcugguggugcuggagc

SEQ ID NO: 4034013 - RNA, 21 nt, Molluscum contagiosum virus
ccugcugguucagguagcgcg

SEQ ID NO: 4034014 - RNA, 20 nt, Molluscum contagiosum virus
ccuggaacgcgaccuucacu

SEQ ID NO: 4034015 - RNA, 11 nt, Molluscum contagiosum virus
ccuggagccua

SEQ ID NO: 4034016 - RNA, 19 nt, Molluscum contagiosum virus
ccuggaguaccggcucaag

SEQ ID NO: 4034017 - RNA, 16 nt, Molluscum contagiosum virus
ccuggcagugccgggc

SEQ ID NO: 4034018 - RNA, 19 nt, Molluscum contagiosum virus
ccuggccgaacugcucugc

SEQ ID NO: 4034019 - RNA, 20 nt, Molluscum contagiosum virus
ccuggcgagcgcucugcauu

SEQ ID NO: 4034020 - RNA, 23 nt, Molluscum contagiosum virus
ccuggcgcgugcgagcagaggca

SEQ ID NO: 4034021 - RNA, 15 nt, Molluscum contagiosum virus
ccuggcggcagcacg

SEQ ID NO: 4034022 - RNA, 15 nt, Molluscum contagiosum virus
ccuggcguccgcacg

SEQ ID NO: 4034023 - RNA, 17 nt, Molluscum contagiosum virus
ccuggcguccgcacgca

SEQ ID NO: 4034024 - RNA, 15 nt, Molluscum contagiosum virus
ccuggcuugcgcgcg

SEQ ID NO: 4034025 - RNA, 18 nt, Molluscum contagiosum virus
gcacgcgccgcgcggcuc

SEQ ID NO: 4034026 - RNA, 16 nt, Molluscum contagiosum virus
gcacgcgcgggcgcag

SEQ ID NO: 4034027 - RNA, 20 nt, Molluscum contagiosum virus
gcacgcgcucguccgccgcg

SEQ ID NO: 4034028 - RNA, 18 nt, Molluscum contagiosum virus
gcacgcugagcaagcuca

SEQ ID NO: 4034029 - RNA, 13 nt, Molluscum contagiosum virus
gcacggacagcac

SEQ ID NO: 4034030 - RNA, 16 nt, Molluscum contagiosum virus
gcacggacugggagca

SEQ ID NO: 4034031 - RNA, 18 nt, Molluscum contagiosum virus
gcacggcacccgccagcu

SEQ ID NO: 4034032 - RNA, 16 nt, Molluscum contagiosum virus
gcacggcgcccaggaa

SEQ ID NO: 4034033 - RNA, 18 nt, Molluscum contagiosum virus
gcacggcuuccggcacca

SEQ ID NO: 4034034 - RNA, 12 nt, Molluscum contagiosum virus
gcacgggcgcag

SEQ ID NO: 4034035 - RNA, 18 nt, Molluscum contagiosum virus
gcacgggcucgagcucuu

SEQ ID NO: 4034036 - RNA, 14 nt, Molluscum contagiosum virus
gcacguagugcucg

SEQ ID NO: 4034037 - RNA, 20 nt, Molluscum contagiosum virus
gcacgugcagcggcgccacg

SEQ ID NO: 4034038 - RNA, 13 nt, Molluscum contagiosum virus
gcacgugcugcgc

SEQ ID NO: 4034039 - RNA, 12 nt, Molluscum contagiosum virus
gcacgugcugcu

SEQ ID NO: 4034040 - RNA, 13 nt, Molluscum contagiosum virus
gcacgugcugcug

SEQ ID NO: 4034041 - RNA, 14 nt, Molluscum contagiosum virus
gcacgugcugcugc

SEQ ID NO: 4034042 - RNA, 22 nt, Molluscum contagiosum virus
gcacguggagucacgaccgacc

SEQ ID NO: 4034043 - RNA, 14 nt, Molluscum contagiosum virus
gcacguggcgcaca

SEQ ID NO: 4034044 - RNA, 19 nt, Molluscum contagiosum virus
gcacguuccaaaagacaga

SEQ ID NO: 4034045 - RNA, 23 nt, Molluscum contagiosum virus
gcacguuccaaaagacagaggcc

SEQ ID NO: 4034046 - RNA, 21 nt, Molluscum contagiosum virus
gcacuacauggacgugcugcu

SEQ ID NO: 4034047 - RNA, 14 nt, Molluscum contagiosum virus
gcacuacugcucca

SEQ ID NO: 4034048 - RNA, 21 nt, Molluscum contagiosum virus
gcacuagacugucgacagaga

SEQ ID NO: 4034049 - RNA, 19 nt, Molluscum contagiosum virus
gcacuagcacgggcgggac

SEQ ID NO: 4034050 - RNA, 18 nt, Molluscum contagiosum virus
gcacuauggacgcuugcu

SEQ ID NO: 4034051 - RNA, 22 nt, Molluscum contagiosum virus
gcacuauggacgcuugcuagca

SEQ ID NO: 4034052 - RNA, 16 nt, Molluscum contagiosum virus
gcacuccgcgcaccgc

SEQ ID NO: 4034053 - RNA, 20 nt, Molluscum contagiosum virus
gcacucguggcaacaacaug

SEQ ID NO: 4034054 - RNA, 19 nt, Molluscum contagiosum virus
gcacugcgcgcaugccuug

SEQ ID NO: 4034055 - RNA, 20 nt, Molluscum contagiosum virus
gcacugcgcgucugugcgcg

SEQ ID NO: 4034056 - RNA, 18 nt, Molluscum contagiosum virus
gcacugcucacggugcgc

SEQ ID NO: 4034057 - RNA, 19 nt, Molluscum contagiosum virus
cgugcagggcgugcuugcc

SEQ ID NO: 4034058 - RNA, 13 nt, Molluscum contagiosum virus
cgugccagcucau

SEQ ID NO: 4034059 - RNA, 15 nt, Molluscum contagiosum virus
cgugcccgagcccgc

SEQ ID NO: 4034060 - RNA, 15 nt, Molluscum contagiosum virus
cgugccgcugcgcgg

SEQ ID NO: 4034061 - RNA, 21 nt, Molluscum contagiosum virus
cgugccucugccagccgcucg

SEQ ID NO: 4034062 - RNA, 21 nt, Molluscum contagiosum virus
cgugcgccaguccgcggcgcg

SEQ ID NO: 4034063 - RNA, 17 nt, Molluscum contagiosum virus
cgugcgccucgcaggcg

SEQ ID NO: 4034064 - RNA, 12 nt, Molluscum contagiosum virus
cgugcgcgcugc

SEQ ID NO: 4034065 - RNA, 18 nt, Molluscum contagiosum virus
cgugcguacucaacgcga

SEQ ID NO: 4034066 - RNA, 14 nt, Molluscum contagiosum virus
cgugcgugcacagc

SEQ ID NO: 4034067 - RNA, 16 nt, Molluscum contagiosum virus
cgugcguuccgggccc

SEQ ID NO: 4034068 - RNA, 17 nt, Molluscum contagiosum virus
cgugcguuccgggcccg

SEQ ID NO: 4034069 - RNA, 16 nt, Molluscum contagiosum virus
cgugcuccacgcgcag

SEQ ID NO: 4034070 - RNA, 20 nt, Molluscum contagiosum virus
cgugcuccacgcgcagcuuc

SEQ ID NO: 4034071 - RNA, 23 nt, Molluscum contagiosum virus
cgugcucgcucggcaacgccagc

SEQ ID NO: 4034072 - RNA, 21 nt, Molluscum contagiosum virus
cgugcucuuucccugccccga

SEQ ID NO: 4034073 - RNA, 18 nt, Molluscum contagiosum virus
cgugcugcgcgcccaggc

SEQ ID NO: 4034074 - RNA, 18 nt, Molluscum contagiosum virus
cgugcugcgcuaccacga

SEQ ID NO: 4034075 - RNA, 20 nt, Molluscum contagiosum virus
cgugcugcucugcgugcuug

SEQ ID NO: 4034076 - RNA, 19 nt, Molluscum contagiosum virus
cgugcuguugccgcgcucg

SEQ ID NO: 4034077 - RNA, 16 nt, Molluscum contagiosum virus
cguggacgaggccaac

SEQ ID NO: 4034078 - RNA, 19 nt, Molluscum contagiosum virus
cguggaggacaccgccgua

SEQ ID NO: 4034079 - RNA, 20 nt, Molluscum contagiosum virus
cguggaggacaccgccguac

SEQ ID NO: 4034080 - RNA, 18 nt, Molluscum contagiosum virus
cguggaguccaugcccac

SEQ ID NO: 4034081 - RNA, 18 nt, Molluscum contagiosum virus
cguggaucgcgcgcaccu

SEQ ID NO: 4034082 - RNA, 17 nt, Molluscum contagiosum virus
cguggccaggccgcgcc

SEQ ID NO: 4034083 - RNA, 19 nt, Molluscum contagiosum virus
cguggccuaccugcaggag

SEQ ID NO: 4034084 - RNA, 23 nt, Molluscum contagiosum virus
cguggcgccauugcucgcggugc

SEQ ID NO: 4034085 - RNA, 13 nt, Molluscum contagiosum virus
cguggcgcgccgg

SEQ ID NO: 4034086 - RNA, 17 nt, Molluscum contagiosum virus
cguggcgcgcgagcugc

SEQ ID NO: 4034087 - RNA, 21 nt, Molluscum contagiosum virus
cguggcgcugggcgcgccgcg

SEQ ID NO: 4034088 - RNA, 17 nt, Molluscum contagiosum virus
cguggcucgcgaccgca

SEQ ID NO: 4034089 - RNA, 18 nt, Molluscum contagiosum virus
cgugggcucggacuuggc

SEQ ID NO: 4034090 - RNA, 20 nt, Molluscum contagiosum virus
cgugguacacguagaggaag

SEQ ID NO: 4034091 - RNA, 16 nt, Molluscum contagiosum virus
cguggucgccgcggcc

SEQ ID NO: 4034092 - RNA, 19 nt, Molluscum contagiosum virus
cguggucgcgcgcgcucug

SEQ ID NO: 4034093 - RNA, 20 nt, Molluscum contagiosum virus
cguggugguuggcgugcucg

SEQ ID NO: 4034094 - RNA, 14 nt, Molluscum contagiosum virus
cgugguugcgcagc

SEQ ID NO: 4034095 - RNA, 23 nt, Molluscum contagiosum virus
cguguacaugaugcccuggugaa

SEQ ID NO: 4034096 - RNA, 16 nt, Molluscum contagiosum virus
cguguacguaauccau

SEQ ID NO: 4034097 - RNA, 22 nt, Molluscum contagiosum virus
cguguccgacgccgccaaugcu

SEQ ID NO: 4034098 - RNA, 18 nt, Molluscum contagiosum virus
cguguccuacacgccgcu

SEQ ID NO: 4034099 - RNA, 19 nt, Molluscum contagiosum virus
cguguuccggcagcgccgc

SEQ ID NO: 4034100 - RNA, 17 nt, Molluscum contagiosum virus
cguuagcguugguaaca

SEQ ID NO: 4034101 - RNA, 16 nt, Molluscum contagiosum virus
cguuccacuacaagca

SEQ ID NO: 4034102 - RNA, 17 nt, Molluscum contagiosum virus
cguuccaggaacgccgc

SEQ ID NO: 4034103 - RNA, 17 nt, Molluscum contagiosum virus
cguucccaagcaaagcc

SEQ ID NO: 4034104 - RNA, 20 nt, Molluscum contagiosum virus
cguuccggcggcuggaccug

SEQ ID NO: 4034105 - RNA, 12 nt, Molluscum contagiosum virus
cguuccuggcca

SEQ ID NO: 4034106 - RNA, 18 nt, Molluscum contagiosum virus
cguucgacuacacgcgcu

SEQ ID NO: 4034107 - RNA, 13 nt, Molluscum contagiosum virus
cguucuccaggaa

SEQ ID NO: 4034108 - RNA, 12 nt, Molluscum contagiosum virus
cguugccugcac

SEQ ID NO: 4034109 - RNA, 15 nt, Molluscum contagiosum virus
cguugcugcccgugc

SEQ ID NO: 4034110 - RNA, 13 nt, Molluscum contagiosum virus
cguuggcgccagc

SEQ ID NO: 4034111 - RNA, 22 nt, Molluscum contagiosum virus
cguuggcgcgcccggcgcccgc

SEQ ID NO: 4034112 - RNA, 13 nt, Molluscum contagiosum virus
cguuggcuuucug

SEQ ID NO: 4034113 - RNA, 21 nt, Molluscum contagiosum virus
cguuucugccggaguaaauga

SEQ ID NO: 4034114 - RNA, 18 nt, Molluscum contagiosum virus
cguuuucgcggccuuaaa

SEQ ID NO: 4034115 - RNA, 20 nt, Molluscum contagiosum virus
cuaacggacgcggccaugcu

SEQ ID NO: 4034116 - RNA, 18 nt, Molluscum contagiosum virus
cuaagcuaaaagagcugc

SEQ ID NO: 4034117 - RNA, 22 nt, Molluscum contagiosum virus
cuacaagcggugcagcuacugc

SEQ ID NO: 4034118 - RNA, 10 nt, Molluscum contagiosum virus
cuacaaggug

SEQ ID NO: 4034119 - RNA, 17 nt, Molluscum contagiosum virus
cuacaccagcuggacgg

SEQ ID NO: 4034120 - RNA, 20 nt, Molluscum contagiosum virus
cuacaccgagaucaugggcg

SEQ ID NO: 4034121 - RNA, 16 nt, Molluscum contagiosum virus
cuacagcgcgcugcac

SEQ ID NO: 4034122 - RNA, 16 nt, Molluscum contagiosum virus
cuaccacgagcacugc

SEQ ID NO: 4034123 - RNA, 12 nt, Molluscum contagiosum virus
uacacuuccugc

SEQ ID NO: 4034124 - RNA, 15 nt, Molluscum contagiosum virus
uacagccgccugccg

SEQ ID NO: 4034125 - RNA, 16 nt, Molluscum contagiosum virus
uacaggcgcggcagcc

SEQ ID NO: 4034126 - RNA, 14 nt, Molluscum contagiosum virus
uaccccgcaggaaa

SEQ ID NO: 4034127 - RNA, 18 nt, Molluscum contagiosum virus
uaccgacguuuucuuugc

SEQ ID NO: 4034128 - RNA, 19 nt, Molluscum contagiosum virus
uaccggagacaccagcucc

SEQ ID NO: 4034129 - RNA, 20 nt, Molluscum contagiosum virus
uaccggagacaccagcuccg

SEQ ID NO: 4034130 - RNA, 21 nt, Molluscum contagiosum virus
uaccugaagcuggacgugggc

SEQ ID NO: 4034131 - RNA, 17 nt, Molluscum contagiosum virus
uaccugcgacagcugcu

SEQ ID NO: 4034132 - RNA, 17 nt, Molluscum contagiosum virus
uaccugguggagcacuu

SEQ ID NO: 4034133 - RNA, 16 nt, Molluscum contagiosum virus
uacgagagcgcaugcc

SEQ ID NO: 4034134 - RNA, 13 nt, Molluscum contagiosum virus
uacgagcagcugc

SEQ ID NO: 4034135 - RNA, 13 nt, Molluscum contagiosum virus
uacgagcaggcgc

SEQ ID NO: 4034136 - RNA, 14 nt, Molluscum contagiosum virus
uacgagcaggcgca

SEQ ID NO: 4034137 - RNA, 19 nt, Molluscum contagiosum virus
uacgagcccaucaaggcgc

SEQ ID NO: 4034138 - RNA, 23 nt, Molluscum contagiosum virus
uacgagccgcugcuccugcucug

SEQ ID NO: 4034139 - RNA, 19 nt, Molluscum contagiosum virus
uacgaggugcugcgccacg

SEQ ID NO: 4034140 - RNA, 17 nt, Molluscum contagiosum virus
uacgaucgcgcucagga

SEQ ID NO: 4034141 - RNA, 14 nt, Molluscum contagiosum virus
uacgcgcagggagc

SEQ ID NO: 4034142 - RNA, 15 nt, Molluscum contagiosum virus
uacgcgcgcgugcug

SEQ ID NO: 4034143 - RNA, 23 nt, Molluscum contagiosum virus
uacgcuacagcagccgcagccca

SEQ ID NO: 4034144 - RNA, 15 nt, Molluscum contagiosum virus
uacggacggcgcacg

SEQ ID NO: 4034145 - RNA, 19 nt, Molluscum contagiosum virus
uacgggcgcuauugcgcgg

SEQ ID NO: 4034146 - RNA, 21 nt, Molluscum contagiosum virus
uacucgagcacggccgccacc

SEQ ID NO: 4034147 - RNA, 19 nt, Molluscum contagiosum virus
uacugcaacguggcgccgc

SEQ ID NO: 4034148 - RNA, 16 nt, Molluscum contagiosum virus
uacugcagcagcuccu

SEQ ID NO: 4034149 - RNA, 18 nt, Molluscum contagiosum virus
uacuucuacgagcagcgc

SEQ ID NO: 4034150 - RNA, 14 nt, Molluscum contagiosum virus
uacuugcugguugc

SEQ ID NO: 4034151 - RNA, 23 nt, Molluscum contagiosum virus
uacuuguugugcacgcuguccag

SEQ ID NO: 4034152 - RNA, 18 nt, Molluscum contagiosum virus
uagaagagcgguuccugc

SEQ ID NO: 4034153 - RNA, 15 nt, Molluscum contagiosum virus
uagcaacuugcucua

SEQ ID NO: 4034154 - RNA, 14 nt, Molluscum contagiosum virus
uagcagagcacgag

SEQ ID NO: 4034155 - RNA, 21 nt, Molluscum contagiosum virus
uagcagggcggcgccugcgcc

SEQ ID NO: 4034156 - RNA, 23 nt, Molluscum contagiosum virus
uagcaugucacgcgucgcgcgcc

SEQ ID NO: 4034157 - RNA, 19 nt, Molluscum contagiosum virus
uagcccaggaacaucugca

SEQ ID NO: 4034158 - RNA, 14 nt, Molluscum contagiosum virus
uagcgccacgagca

SEQ ID NO: 4034159 - RNA, 12 nt, Molluscum contagiosum virus
uagcgcgcgugu

SEQ ID NO: 4034160 - RNA, 16 nt, Molluscum contagiosum virus
uagcgcucgugcacca

SEQ ID NO: 4034161 - RNA, 22 nt, Molluscum contagiosum virus
uagcggcggcguaggccugcgg

SEQ ID NO: 4034162 - RNA, 16 nt, Molluscum contagiosum virus
uaggcgggccugcgcc

SEQ ID NO: 4034163 - RNA, 18 nt, Molluscum contagiosum virus
uagugguccaccagcugc

SEQ ID NO: 4034164 - RNA, 17 nt, Molluscum contagiosum virus
uauacucgacgcgcgcg

SEQ ID NO: 4034165 - RNA, 22 nt, Molluscum contagiosum virus
uauaguccccggcgccggcacc

SEQ ID NO: 4034166 - RNA, 19 nt, Molluscum contagiosum virus
uaugccgcgugcucugcuc

SEQ ID NO: 4034167 - RNA, 14 nt, Molluscum contagiosum virus
uaugcgaggccugc

SEQ ID NO: 4034168 - RNA, 18 nt, Molluscum contagiosum virus
uauuuccggcuccggcuu

SEQ ID NO: 4034169 - RNA, 21 nt, Molluscum contagiosum virus
ucaaauccugguuccucuccu

SEQ ID NO: 4034170 - RNA, 18 nt, Molluscum contagiosum virus
ucaacagcuacaccgaga

SEQ ID NO: 4034171 - RNA, 16 nt, Molluscum contagiosum virus
ucaaccgcaaggaaaa

SEQ ID NO: 4034172 - RNA, 18 nt, Molluscum contagiosum virus
ucaaccucgagaagaccu

SEQ ID NO: 4034173 - RNA, 15 nt, Molluscum contagiosum virus
ucaacgagcgcauca

SEQ ID NO: 4034174 - RNA, 17 nt, Molluscum contagiosum virus
ucaacgcgauggcgcag

SEQ ID NO: 4034175 - RNA, 13 nt, Molluscum contagiosum virus
ucaacgcgcgugc

SEQ ID NO: 4034176 - RNA, 21 nt, Molluscum contagiosum virus
ucaacgcgcgugcguacgugc

SEQ ID NO: 4034177 - RNA, 17 nt, Molluscum contagiosum virus
ucaacucguaggacaac

SEQ ID NO: 4034178 - RNA, 13 nt, Molluscum contagiosum virus
ucaagaagaacaa

SEQ ID NO: 4034179 - RNA, 21 nt, Molluscum contagiosum virus
ucaagacauuucuccuccggg

SEQ ID NO: 4034180 - RNA, 16 nt, Molluscum contagiosum virus
ucaagacgcugcuggc

SEQ ID NO: 4034181 - RNA, 15 nt, Molluscum contagiosum virus
ucaagacgcugguga

SEQ ID NO: 4034182 - RNA, 13 nt, Molluscum contagiosum virus
ucaagauccaagc

SEQ ID NO: 4034183 - RNA, 21 nt, Molluscum contagiosum virus
ucaagcagcgcgccaccacca

SEQ ID NO: 4034184 - RNA, 17 nt, Molluscum contagiosum virus
ucaaugcgcacgugcuc

SEQ ID NO: 4034185 - RNA, 21 nt, Molluscum contagiosum virus
ucacagguagugguccaccag

SEQ ID NO: 4034186 - RNA, 14 nt, Molluscum contagiosum virus
ucaccagccugcuc

SEQ ID NO: 4034187 - RNA, 16 nt, Molluscum contagiosum virus
ucaccccgcagcucaa

SEQ ID NO: 4034188 - RNA, 20 nt, Molluscum contagiosum virus
ucaccgccuguaccugcucg

SEQ ID NO: 4034189 - RNA, 22 nt, Molluscum contagiosum virus
ucaccgggauggucucgcugcu

SEQ ID NO: 4034190 - RNA, 13 nt, Molluscum contagiosum virus
ucaccuuccuggg

SEQ ID NO: 4034191 - RNA, 14 nt, Molluscum contagiosum virus
ucaccuuccugggc

SEQ ID NO: 4034192 - RNA, 18 nt, Molluscum contagiosum virus
ucaccuuggcgcugcaca

SEQ ID NO: 4034193 - RNA, 20 nt, Molluscum contagiosum virus
ucacgaccgacccaucggag

SEQ ID NO: 4034194 - RNA, 15 nt, Molluscum contagiosum virus
ucacgaccugguaga

SEQ ID NO: 4034195 - RNA, 12 nt, Molluscum contagiosum virus
ucacgcaagcuu

SEQ ID NO: 4034196 - RNA, 22 nt, Molluscum contagiosum virus
ucacgcacacgaaucgcucgcg

SEQ ID NO: 4034197 - RNA, 16 nt, Molluscum contagiosum virus
ucacgcccgcgcugcg

SEQ ID NO: 4034198 - RNA, 15 nt, Molluscum contagiosum virus
ucacgcccucucgag

SEQ ID NO: 4034199 - RNA, 18 nt, Molluscum contagiosum virus
ucacgccgguggcgcgcg

SEQ ID NO: 4034200 - RNA, 19 nt, Molluscum contagiosum virus
ucacgcgcuaccgcaagcu

SEQ ID NO: 4034201 - RNA, 16 nt, Molluscum contagiosum virus
ucacgcgcuucgugga

SEQ ID NO: 4034202 - RNA, 23 nt, Molluscum contagiosum virus
ucacgcugcccgcgccgcccgug

SEQ ID NO: 4034203 - RNA, 18 nt, Molluscum contagiosum virus
ucacggcuguggacauga

SEQ ID NO: 4034204 - RNA, 14 nt, Molluscum contagiosum virus
ucacugcagcagcc

SEQ ID NO: 4034205 - RNA, 15 nt, Molluscum contagiosum virus
ucacuuucgcgcgca

SEQ ID NO: 4034206 - RNA, 21 nt, Molluscum contagiosum virus
ucagagaaaucccaagagcca

SEQ ID NO: 4034207 - RNA, 11 nt, Molluscum contagiosum virus
ucagcaaggag

SEQ ID NO: 4034208 - RNA, 16 nt, Molluscum contagiosum virus
ucagcacacgucggag

SEQ ID NO: 4034209 - RNA, 18 nt, Molluscum contagiosum virus
ucagcaccaaggacgugu

SEQ ID NO: 4034210 - RNA, 17 nt, Molluscum contagiosum virus
ucagccccgcgccagca

SEQ ID NO: 4034211 - RNA, 21 nt, Molluscum contagiosum virus
ucagccccgggcccgcaugca

SEQ ID NO: 4034212 - RNA, 19 nt, Molluscum contagiosum virus
ucagccgagcgccgccagc

SEQ ID NO: 4034213 - RNA, 12 nt, Molluscum contagiosum virus
ucagcgcgcgca

SEQ ID NO: 4034214 - RNA, 16 nt, Molluscum contagiosum virus
ucagcgggcagacagg

SEQ ID NO: 4034215 - RNA, 14 nt, Molluscum contagiosum virus
ucagcgucgacggc

SEQ ID NO: 4034216 - RNA, 18 nt, Molluscum contagiosum virus
ucaggaacaaggccaaag

SEQ ID NO: 4034217 - RNA, 20 nt, Molluscum contagiosum virus
ucaggacaaagucgcgcgcg

SEQ ID NO: 4034218 - RNA, 19 nt, Molluscum contagiosum virus
ucaggcaaaagccgccgcg

SEQ ID NO: 4034219 - RNA, 23 nt, Molluscum contagiosum virus
ucaggcaaaagccgccgcgcgcg

SEQ ID NO: 4034220 - RNA, 15 nt, Molluscum contagiosum virus
ucaggcagcugcugc

SEQ ID NO: 4034221 - RNA, 16 nt, Molluscum contagiosum virus
ucauacuccugcuggc

SEQ ID NO: 4034222 - RNA, 13 nt, Molluscum contagiosum virus
ucauagcgccacg

SEQ ID NO: 4034223 - RNA, 15 nt, Molluscum contagiosum virus
ucaucgacgagcacg

SEQ ID NO: 4034224 - RNA, 23 nt, Molluscum contagiosum virus
ucaugagccagucucgcgcuucc

SEQ ID NO: 4034225 - RNA, 14 nt, Molluscum contagiosum virus
ucaugcgcguggcu

SEQ ID NO: 4034226 - RNA, 22 nt, Molluscum contagiosum virus
ucauuguaaaacgacagacccc

SEQ ID NO: 4034227 - RNA, 19 nt, Molluscum contagiosum virus
ggagucacgaccgacccau

SEQ ID NO: 4034228 - RNA, 17 nt, Molluscum contagiosum virus
ggaguccaugcccacgc

SEQ ID NO: 4034229 - RNA, 19 nt, Molluscum contagiosum virus
ggaguccgugacagagugc

SEQ ID NO: 4034230 - RNA, 12 nt, Molluscum contagiosum virus
ggauacgcgcac

SEQ ID NO: 4034231 - RNA, 22 nt, Molluscum contagiosum virus
ggauagccccucgagcagcggu

SEQ ID NO: 4034232 - RNA, 15 nt, Molluscum contagiosum virus
ggaucacggcucugc

SEQ ID NO: 4034233 - RNA, 16 nt, Molluscum contagiosum virus
ggaucagccccgcgcc

SEQ ID NO: 4034234 - RNA, 13 nt, Molluscum contagiosum virus
ggaugccugucuu

SEQ ID NO: 4034235 - RNA, 13 nt, Molluscum contagiosum virus
ggauggccacggg

SEQ ID NO: 4034236 - RNA, 20 nt, Molluscum contagiosum virus
ggcaaagcggggcgcgcgcc

SEQ ID NO: 4034237 - RNA, 21 nt, Molluscum contagiosum virus
ggcaacaacgucacgcucgag

SEQ ID NO: 4034238 - RNA, 13 nt, Molluscum contagiosum virus
ggcaacugccugc

SEQ ID NO: 4034239 - RNA, 17 nt, Molluscum contagiosum virus
ggcaagaggggagccag

SEQ ID NO: 4034240 - RNA, 20 nt, Molluscum contagiosum virus
ggcaagcucccgcugcgcuu

SEQ ID NO: 4034241 - RNA, 18 nt, Molluscum contagiosum virus
ggcaagcuucgggccgcu

SEQ ID NO: 4034242 - RNA, 13 nt, Molluscum contagiosum virus
ggcaagggcuccu

SEQ ID NO: 4034243 - RNA, 22 nt, Molluscum contagiosum virus
ggcaaguuccuggugugccagc

SEQ ID NO: 4034244 - RNA, 22 nt, Molluscum contagiosum virus
ggcaauguuugcggaugcucgc

SEQ ID NO: 4034245 - RNA, 12 nt, Molluscum contagiosum virus
ggcacagucugg

SEQ ID NO: 4034246 - RNA, 24 nt, Molluscum contagiosum virus
ggcacagucugggagguguccggg

SEQ ID NO: 4034247 - RNA, 19 nt, Molluscum contagiosum virus
ggcacagugcuggacacuc

SEQ ID NO: 4034248 - RNA, 17 nt, Molluscum contagiosum virus
ggcacauggacggcgcc

SEQ ID NO: 4034249 - RNA, 15 nt, Molluscum contagiosum virus
ggcacccgcaggaaa

SEQ ID NO: 4034250 - RNA, 21 nt, Molluscum contagiosum virus
ggcacccgcaggaaagguacc

SEQ ID NO: 4034251 - RNA, 16 nt, Molluscum contagiosum virus
ggcacccuggcugcug

SEQ ID NO: 4034252 - RNA, 21 nt, Molluscum contagiosum virus
ggcaccugcaggaaaggcacc

SEQ ID NO: 4034253 - RNA, 20 nt, Molluscum contagiosum virus
ggcaccugcaucgcgccgcc

SEQ ID NO: 4034254 - RNA, 12 nt, Molluscum contagiosum virus
ggcacgcagacc

SEQ ID NO: 4034255 - RNA, 14 nt, Molluscum contagiosum virus
ggcacgcagcucuu

SEQ ID NO: 4034256 - RNA, 16 nt, Molluscum contagiosum virus
ggcacgcagcucuucc

SEQ ID NO: 4034257 - RNA, 13 nt, Molluscum contagiosum virus
ggcacgcugagca

SEQ ID NO: 4034258 - RNA, 21 nt, Molluscum contagiosum virus
ggcacgggcucgagcucuucu

SEQ ID NO: 4034259 - RNA, 20 nt, Molluscum contagiosum virus
ggcacgggcucgaucugcgc

SEQ ID NO: 4034260 - RNA, 21 nt, Molluscum contagiosum virus
ggcacguuugcgucugcgagg

SEQ ID NO: 4034261 - RNA, 16 nt, Molluscum contagiosum virus
ggcacuccgcgcaccg

SEQ ID NO: 4034262 - RNA, 13 nt, Molluscum contagiosum virus
ggcagacuaagaa

SEQ ID NO: 4034263 - RNA, 23 nt, Molluscum contagiosum virus
ggcagauagcucgcgcgcgagca

SEQ ID NO: 4034264 - RNA, 13 nt, Molluscum contagiosum virus
ggcagcagcgugc

SEQ ID NO: 4034265 - RNA, 23 nt, Molluscum contagiosum virus
ggcagcgacuacgcgcugcuaga

SEQ ID NO: 4034266 - RNA, 21 nt, Molluscum contagiosum virus
ggcagcgcgauugcuggaggu

SEQ ID NO: 4034267 - RNA, 23 nt, Molluscum contagiosum virus
ggcagcggcaaaggcccgcgagc

SEQ ID NO: 4034268 - RNA, 17 nt, Molluscum contagiosum virus
ggcagcucaagcugcuc

SEQ ID NO: 4034269 - RNA, 16 nt, Molluscum contagiosum virus
ggcagcucggaggcgc

SEQ ID NO: 4034270 - RNA, 16 nt, Molluscum contagiosum virus
ggcagcuucugcucgc

SEQ ID NO: 4034271 - RNA, 23 nt, Molluscum contagiosum virus
ggcaggcagugccgccgcgcgcg

SEQ ID NO: 4034272 - RNA, 21 nt, Molluscum contagiosum virus
ggcagggaaagagcacgcgcu

SEQ ID NO: 4034273 - RNA, 15 nt, Molluscum contagiosum virus
ggcaggggccgccgc

SEQ ID NO: 4034274 - RNA, 16 nt, Molluscum contagiosum virus
ggcaguacgcgcgugg

SEQ ID NO: 4034275 - RNA, 19 nt, Molluscum contagiosum virus
ggcaguggcgugacagguc

SEQ ID NO: 4034276 - RNA, 19 nt, Molluscum contagiosum virus
gcgcgccugccgccugcag

SEQ ID NO: 4034277 - RNA, 14 nt, Molluscum contagiosum virus
gcgcgccugcgcga

SEQ ID NO: 4034278 - RNA, 14 nt, Molluscum contagiosum virus
gcgcgccugcuggc

SEQ ID NO: 4034279 - RNA, 22 nt, Molluscum contagiosum virus
gcgcgcgacgacguugugcucc

SEQ ID NO: 4034280 - RNA, 17 nt, Molluscum contagiosum virus
gcgcgcgagcugcugcg

SEQ ID NO: 4034281 - RNA, 19 nt, Molluscum contagiosum virus
gcgcgcgccaagugcuccg

SEQ ID NO: 4034282 - RNA, 21 nt, Molluscum contagiosum virus
gcgcgcgccauccagcgcauc

SEQ ID NO: 4034283 - RNA, 14 nt, Molluscum contagiosum virus
gcgcgcgccuugca

SEQ ID NO: 4034284 - RNA, 14 nt, Molluscum contagiosum virus
gcgcgcgcgcaggc

SEQ ID NO: 4034285 - RNA, 14 nt, Molluscum contagiosum virus
gcgcgcggcaagca

SEQ ID NO: 4034286 - RNA, 21 nt, Molluscum contagiosum virus
gcgcgcgucgagggcgccggg

SEQ ID NO: 4034287 - RNA, 14 nt, Molluscum contagiosum virus
gcgcgcgugccgcg

SEQ ID NO: 4034288 - RNA, 14 nt, Molluscum contagiosum virus
gcgcgcgugccggg

SEQ ID NO: 4034289 - RNA, 16 nt, Molluscum contagiosum virus
gcgcgcgugcggacgc

SEQ ID NO: 4034290 - RNA, 12 nt, Molluscum contagiosum virus
gcgcgcgugcuc

SEQ ID NO: 4034291 - RNA, 15 nt, Molluscum contagiosum virus
gcgcgcgugcucgcg

SEQ ID NO: 4034292 - RNA, 21 nt, Molluscum contagiosum virus
gcgcgcguuugucgcgggcgc

SEQ ID NO: 4034293 - RNA, 23 nt, Molluscum contagiosum virus
gcgcgcuaguggcaagggccugc

SEQ ID NO: 4034294 - RNA, 22 nt, Molluscum contagiosum virus
gcgcgcucgaacgcgcgugcgc

SEQ ID NO: 4034295 - RNA, 16 nt, Molluscum contagiosum virus
gcgcgcugcacaccga

SEQ ID NO: 4034296 - RNA, 12 nt, Molluscum contagiosum virus
gcgcgcugcgcc

SEQ ID NO: 4034297 - RNA, 15 nt, Molluscum contagiosum virus
gcgcgcugcgcgccg

SEQ ID NO: 4034298 - RNA, 20 nt, Molluscum contagiosum virus
gcgcgcugcucuggagcaag

SEQ ID NO: 4034299 - RNA, 15 nt, Molluscum contagiosum virus
gcgcggagaucgccg

SEQ ID NO: 4034300 - RNA, 19 nt, Molluscum contagiosum virus
gcgcggagaucgccgcgca

SEQ ID NO: 4034301 - RNA, 13 nt, Molluscum contagiosum virus
gcgcggcacgccc

SEQ ID NO: 4034302 - RNA, 17 nt, Molluscum contagiosum virus
gcgcggcagacgccagc

SEQ ID NO: 4034303 - RNA, 13 nt, Molluscum contagiosum virus
gcgcggcagcagc

SEQ ID NO: 4034304 - RNA, 18 nt, Molluscum contagiosum virus
gcgcggcagcagccucgu

SEQ ID NO: 4034305 - RNA, 14 nt, Molluscum contagiosum virus
gcgcggcagccgca

SEQ ID NO: 4034306 - RNA, 16 nt, Molluscum contagiosum virus
gcgcggcccgagcagg

SEQ ID NO: 4034307 - RNA, 18 nt, Molluscum contagiosum virus
gcgcggcccgagcaggac

SEQ ID NO: 4034308 - RNA, 13 nt, Molluscum contagiosum virus
gcgcggccgcgcu

SEQ ID NO: 4034309 - RNA, 16 nt, Molluscum contagiosum virus
gcgcggccuggccacg

SEQ ID NO: 4034310 - RNA, 13 nt, Molluscum contagiosum virus
gcgcggcgcgccg

SEQ ID NO: 4034311 - RNA, 17 nt, Molluscum contagiosum virus
gcgcggcgcucugccac

SEQ ID NO: 4034312 - RNA, 21 nt, Molluscum contagiosum virus
gcgcggcgcuuucgcccgccg

SEQ ID NO: 4034313 - RNA, 20 nt, Molluscum contagiosum virus
gcgcggcgguguaugcucgu

SEQ ID NO: 4034314 - RNA, 22 nt, Molluscum contagiosum virus
gcgcggcguggcgcugaggaag

SEQ ID NO: 4034315 - RNA, 14 nt, Molluscum contagiosum virus
gcgcgggagcucac

SEQ ID NO: 4034316 - RNA, 16 nt, Molluscum contagiosum virus
gcgcgggcacgccgca

SEQ ID NO: 4034317 - RNA, 17 nt, Molluscum contagiosum virus
gcgcgggccuguccgcg

SEQ ID NO: 4034318 - RNA, 17 nt, Molluscum contagiosum virus
gcgcggggcacugcgca

SEQ ID NO: 4034319 - RNA, 22 nt, Molluscum contagiosum virus
gcgcggggcaggcagugccgcc

SEQ ID NO: 4034320 - RNA, 18 nt, Molluscum contagiosum virus
gcgcgguaacgcgcgcgc

SEQ ID NO: 4034321 - RNA, 16 nt, Molluscum contagiosum virus
gcgcgguccagccgca

SEQ ID NO: 4034322 - RNA, 15 nt, Molluscum contagiosum virus
gcgcgguccuguccg

SEQ ID NO: 4034323 - RNA, 17 nt, Molluscum contagiosum virus
gcgcguacucgcgccgc

SEQ ID NO: 4034324 - RNA, 19 nt, Molluscum contagiosum virus
gcgcgucugcgaguggcgc

SEQ ID NO: 4034325 - RNA, 15 nt, Molluscum contagiosum virus
gcgcgucugugcgcg

SEQ ID NO: 4034326 - RNA, 23 nt, Molluscum contagiosum virus
gcgcgugacacaccgcguggaca

SEQ ID NO: 4034327 - RNA, 17 nt, Molluscum contagiosum virus
gcgcgugaguccgcggc

SEQ ID NO: 4034328 - RNA, 12 nt, Molluscum contagiosum virus
gcgcgugcaguu

SEQ ID NO: 4034329 - RNA, 20 nt, Molluscum contagiosum virus
gcgcgugccagucgcgcgag

SEQ ID NO: 4034330 - RNA, 20 nt, Molluscum contagiosum virus
gcgcgugccuguggcgcaca

SEQ ID NO: 4034331 - RNA, 13 nt, Molluscum contagiosum virus
gcgcgugcgcagg

SEQ ID NO: 4034332 - RNA, 12 nt, Molluscum contagiosum virus
gcgcgugcucgg

SEQ ID NO: 4034333 - RNA, 16 nt, Molluscum contagiosum virus
gcgcgugcugcggcug

SEQ ID NO: 4034334 - RNA, 15 nt, Molluscum contagiosum virus
gcgcgugcugggccc

SEQ ID NO: 4034335 - RNA, 16 nt, Molluscum contagiosum virus
gcgcguggaguacagc

SEQ ID NO: 4034336 - RNA, 14 nt, Molluscum contagiosum virus
gcgcgugugcagca

SEQ ID NO: 4034337 - RNA, 15 nt, Molluscum contagiosum virus
gcgcguucagcgcac

SEQ ID NO: 4034338 - RNA, 19 nt, Molluscum contagiosum virus
gcgcguucauuugcgugag

SEQ ID NO: 4034339 - RNA, 16 nt, Molluscum contagiosum virus
gcgcuacgacgacaug

SEQ ID NO: 4034340 - RNA, 17 nt, Molluscum contagiosum virus
gcgcucacugcgaucgc

SEQ ID NO: 4034341 - RNA, 16 nt, Molluscum contagiosum virus
gcgcuccacgcccgag

SEQ ID NO: 4034342 - RNA, 14 nt, Molluscum contagiosum virus
gcgcucgagcuccg

SEQ ID NO: 4034343 - RNA, 24 nt, Molluscum contagiosum virus
gcgcucgauuuaacucuagcgaga

SEQ ID NO: 4034344 - RNA, 21 nt, Molluscum contagiosum virus
gcgcucuucaagaacagucgc

SEQ ID NO: 4034345 - RNA, 22 nt, Molluscum contagiosum virus
gcgcugaaggcauaccugugcc

SEQ ID NO: 4034346 - RNA, 19 nt, Molluscum contagiosum virus
gcgcugaucaccgaggagc

SEQ ID NO: 4034347 - RNA, 16 nt, Molluscum contagiosum virus
gcgcugcacaccgagc

SEQ ID NO: 4034348 - RNA, 18 nt, Molluscum contagiosum virus
gcgcugcacgccgccagc

SEQ ID NO: 4034349 - RNA, 14 nt, Molluscum contagiosum virus
gcgcugcagcaccu

SEQ ID NO: 4034350 - RNA, 16 nt, Molluscum contagiosum virus
gcgcugcucuggagca

SEQ ID NO: 4034351 - RNA, 18 nt, Molluscum contagiosum virus
gcgcugcugacacgcucu

SEQ ID NO: 4034352 - RNA, 22 nt, Molluscum contagiosum virus
gcgcuggagaaagaagugugcc

SEQ ID NO: 4034353 - RNA, 17 nt, Molluscum contagiosum virus
gcgcuggagcuggcugg

SEQ ID NO: 4034354 - RNA, 17 nt, Molluscum contagiosum virus
gagggaugcacacacuc

SEQ ID NO: 4034355 - RNA, 23 nt, Molluscum contagiosum virus
gagggcagugccaagguucugga

SEQ ID NO: 4034356 - RNA, 13 nt, Molluscum contagiosum virus
cuuggcgcgccgc

SEQ ID NO: 4034357 - RNA, 17 nt, Molluscum contagiosum virus
cuuggcguucgcagugc

SEQ ID NO: 4034358 - RNA, 11 nt, Molluscum contagiosum virus
cuugggcacug

SEQ ID NO: 4034359 - RNA, 17 nt, Molluscum contagiosum virus
cuugguggugaccgaga

SEQ ID NO: 4034360 - RNA, 17 nt, Molluscum contagiosum virus
cuuguucucggagaaca

SEQ ID NO: 4034361 - RNA, 20 nt, Molluscum contagiosum virus
cuuguugucgagcagauuca

SEQ ID NO: 4034362 - RNA, 15 nt, Molluscum contagiosum virus
cuuguugucugcgga

SEQ ID NO: 4034363 - RNA, 16 nt, Molluscum contagiosum virus
cuuuacgggcgccagc

SEQ ID NO: 4034364 - RNA, 19 nt, Molluscum contagiosum virus
cuuuccccuccuagcccag

SEQ ID NO: 4034365 - RNA, 13 nt, Molluscum contagiosum virus
cuuucgacgcugc

SEQ ID NO: 4034366 - RNA, 15 nt, Molluscum contagiosum virus
cuuucucacgcgcua

SEQ ID NO: 4034367 - RNA, 14 nt, Molluscum contagiosum virus
cuuucucagagaaa

SEQ ID NO: 4034368 - RNA, 21 nt, Molluscum contagiosum virus
cuuugaggaacuagugcugcu

SEQ ID NO: 4034369 - RNA, 19 nt, Molluscum contagiosum virus
cuuuggccucgcgagggcu

SEQ ID NO: 4034370 - RNA, 15 nt, Molluscum contagiosum virus
cuuuggcgugaccau

SEQ ID NO: 4034371 - RNA, 20 nt, Molluscum contagiosum virus
cuuuuccgcgaaguccuggg

SEQ ID NO: 4034372 - RNA, 21 nt, Molluscum contagiosum virus
cuuuucgcgccgcgggcacau

SEQ ID NO: 4034373 - RNA, 20 nt, Molluscum contagiosum virus
cuuuuuccugaacaagcugc

SEQ ID NO: 4034374 - RNA, 13 nt, Molluscum contagiosum virus
gaaaaaaacugcg

SEQ ID NO: 4034375 - RNA, 12 nt, Molluscum contagiosum virus
gaaaaaguucuu

SEQ ID NO: 4034376 - RNA, 19 nt, Molluscum contagiosum virus
gaaaacggaaacagcaccg

SEQ ID NO: 4034377 - RNA, 18 nt, Molluscum contagiosum virus
gaaacagccgugcuccga

SEQ ID NO: 4034378 - RNA, 15 nt, Molluscum contagiosum virus
gaaacaugugucuga

SEQ ID NO: 4034379 - RNA, 19 nt, Molluscum contagiosum virus
gaaaccucaccucugcgcg

SEQ ID NO: 4034380 - RNA, 22 nt, Molluscum contagiosum virus
gaaacgcacagccccugcugcu

SEQ ID NO: 4034381 - RNA, 12 nt, Molluscum contagiosum virus
gaaacugcugcc

SEQ ID NO: 4034382 - RNA, 13 nt, Molluscum contagiosum virus
gaaagaagaagga

SEQ ID NO: 4034383 - RNA, 12 nt, Molluscum contagiosum virus
gaaagcgccgcg

SEQ ID NO: 4034384 - RNA, 23 nt, Molluscum contagiosum virus
gaaagcgucgugcuccacgcgca

SEQ ID NO: 4034385 - RNA, 20 nt, Molluscum contagiosum virus
gaaagcuucugucgcuucgc

SEQ ID NO: 4034386 - RNA, 19 nt, Molluscum contagiosum virus
gaaaggcacccaccaggaa

SEQ ID NO: 4034387 - RNA, 17 nt, Molluscum contagiosum virus
gaaaggcaccccgcagg

SEQ ID NO: 4034388 - RNA, 14 nt, Molluscum contagiosum virus
gaaaggcacccgca

SEQ ID NO: 4034389 - RNA, 17 nt, Molluscum contagiosum virus
gaaaggcacccgcagga

SEQ ID NO: 4034390 - RNA, 20 nt, Molluscum contagiosum virus
gaaaggcaccugcggcucgc

SEQ ID NO: 4034391 - RNA, 16 nt, Molluscum contagiosum virus
gaacaaaaaacaacuc

SEQ ID NO: 4034392 - RNA, 23 nt, Molluscum contagiosum virus
gaacaagucgucgaucgccucga

SEQ ID NO: 4034393 - RNA, 18 nt, Molluscum contagiosum virus
gaacaaugaggagaggaa

SEQ ID NO: 4034394 - RNA, 14 nt, Molluscum contagiosum virus
gaacaccuccugcu

SEQ ID NO: 4034395 - RNA, 20 nt, Molluscum contagiosum virus
gaacagagaaaggcacccac

SEQ ID NO: 4034396 - RNA, 17 nt, Molluscum contagiosum virus
gaacagcuucacgauga

SEQ ID NO: 4034397 - RNA, 18 nt, Molluscum contagiosum virus
gaacagggaaaaaucccc

SEQ ID NO: 4034398 - RNA, 18 nt, Molluscum contagiosum virus
gaacccgcauugggccuu

SEQ ID NO: 4034399 - RNA, 23 nt, Molluscum contagiosum virus
gaaccuggaacucuacgccgcgc

SEQ ID NO: 4034400 - RNA, 20 nt, Molluscum contagiosum virus
gaaccugggcaucgucucgc

SEQ ID NO: 4034401 - RNA, 21 nt, Molluscum contagiosum virus
gaacgagagacacgcacacuc

SEQ ID NO: 4034402 - RNA, 15 nt, Molluscum contagiosum virus
gaacgaggcugcugc

SEQ ID NO: 4034403 - RNA, 19 nt, Molluscum contagiosum virus
gaacgaggcugcugccgcg

SEQ ID NO: 4034404 - RNA, 17 nt, Molluscum contagiosum virus
gaacgauuuuacgcaca

SEQ ID NO: 4034405 - RNA, 20 nt, Molluscum contagiosum virus
gaacgauuuuacgcacacga

SEQ ID NO: 4034406 - RNA, 12 nt, Molluscum contagiosum virus
gaacgcgccgcg

SEQ ID NO: 4034407 - RNA, 19 nt, Molluscum contagiosum virus
gaacgcgccgcggaugucc

SEQ ID NO: 4034408 - RNA, 23 nt, Molluscum contagiosum virus
gaacgcguccacggcgcgcaccu

SEQ ID NO: 4034409 - RNA, 18 nt, Molluscum contagiosum virus
gaacgucuucgagagccu

SEQ ID NO: 4034410 - RNA, 14 nt, Molluscum contagiosum virus
gaacuagugcugcu

SEQ ID NO: 4034411 - RNA, 15 nt, Molluscum contagiosum virus
gaacuagugcugcug

SEQ ID NO: 4034412 - RNA, 16 nt, Molluscum contagiosum virus
gaacuagugcugcugg

SEQ ID NO: 4034413 - RNA, 12 nt, Molluscum contagiosum virus
gaacuccaggcg

SEQ ID NO: 4034414 - RNA, 22 nt, Molluscum contagiosum virus
gaacucuacacguggaauugcg

SEQ ID NO: 4034415 - RNA, 15 nt, Molluscum contagiosum virus
gaacugacugcugcc

SEQ ID NO: 4034416 - RNA, 13 nt, Molluscum contagiosum virus
gaacugcagcagc

SEQ ID NO: 4034417 - RNA, 16 nt, Molluscum contagiosum virus
gaacugcccgcgucgc

SEQ ID NO: 4034418 - RNA, 23 nt, Molluscum contagiosum virus
gaacugcugggcguggcgcaccu

SEQ ID NO: 4034419 - RNA, 20 nt, Molluscum contagiosum virus
gaagacgagcgcgugccgcu

SEQ ID NO: 4034420 - RNA, 12 nt, Molluscum contagiosum virus
gaagagucgcgc

SEQ ID NO: 4034421 - RNA, 14 nt, Molluscum contagiosum virus
gaagagucgcgccu

SEQ ID NO: 4034422 - RNA, 19 nt, Molluscum contagiosum virus
gaagcaagacccagcaagg

SEQ ID NO: 4034423 - RNA, 16 nt, Molluscum contagiosum virus
gaagcacguagcucgc

SEQ ID NO: 4034424 - RNA, 14 nt, Molluscum contagiosum virus
gaagcagcagacca

SEQ ID NO: 4034425 - RNA, 15 nt, Molluscum contagiosum virus
gaagcccgucggggc

SEQ ID NO: 4034426 - RNA, 14 nt, Molluscum contagiosum virus
gaagccgccagcca

SEQ ID NO: 4034427 - RNA, 22 nt, Molluscum contagiosum virus
gaagccuucuucgugcugugcc

SEQ ID NO: 4034428 - RNA, 16 nt, Molluscum contagiosum virus
gaagcugcacgugcag

SEQ ID NO: 4034429 - RNA, 11 nt, Molluscum contagiosum virus
gaagcugucaa

SEQ ID NO: 4034430 - RNA, 17 nt, Molluscum contagiosum virus
gaagcugugcaagagcu

SEQ ID NO: 4034431 - RNA, 21 nt, Molluscum contagiosum virus
gaaggaucccugcccgcguga

SEQ ID NO: 4034432 - RNA, 19 nt, Molluscum contagiosum virus
gaaguccaucggugggcuc

SEQ ID NO: 4034433 - RNA, 14 nt, Molluscum contagiosum virus
gaagugcuccgcac

SEQ ID NO: 4034434 - RNA, 23 nt, Molluscum contagiosum virus
gaagugcuccgcacguggaguca

SEQ ID NO: 4034435 - RNA, 18 nt, Molluscum contagiosum virus
gaauaaaauagcagagca

SEQ ID NO: 4034436 - RNA, 19 nt, Molluscum contagiosum virus
gaauaaaauagcagagcac

SEQ ID NO: 4034437 - RNA, 21 nt, Molluscum contagiosum virus
gaauaccggagacaccagcuc

SEQ ID NO: 4034438 - RNA, 23 nt, Molluscum contagiosum virus
gaaucgcucgcggugcagcugcc

SEQ ID NO: 4034439 - RNA, 22 nt, Molluscum contagiosum virus
gaaugacuuagccacugugcug

SEQ ID NO: 4034440 - RNA, 12 nt, Molluscum contagiosum virus
gaaugcccgcaa

SEQ ID NO: 4034441 - RNA, 20 nt, Molluscum contagiosum virus
gaauuuuuauauggcaagcu

SEQ ID NO: 4034442 - RNA, 13 nt, Molluscum contagiosum virus
gacaaagucgcgc

SEQ ID NO: 4034443 - RNA, 17 nt, Molluscum contagiosum virus
gacaaagucgcgcgcgg

SEQ ID NO: 4034444 - RNA, 21 nt, Molluscum contagiosum virus
gacaagcuagacuggagcacg

SEQ ID NO: 4034445 - RNA, 18 nt, Molluscum contagiosum virus
gacaaggaaaggcaccca

SEQ ID NO: 4034446 - RNA, 13 nt, Molluscum contagiosum virus
gacaaggagggag

SEQ ID NO: 4034447 - RNA, 17 nt, Molluscum contagiosum virus
gacaaguacaugcacgu

SEQ ID NO: 4034448 - RNA, 16 nt, Molluscum contagiosum virus
gacacacuccuguccu

SEQ ID NO: 4034449 - RNA, 15 nt, Molluscum contagiosum virus
gacaccagcuccgcc

SEQ ID NO: 4034450 - RNA, 19 nt, Molluscum contagiosum virus
gacaccgacgaggugcgcg

SEQ ID NO: 4034451 - RNA, 20 nt, Molluscum contagiosum virus
gacaccgcgacccagaagcg

SEQ ID NO: 4034452 - RNA, 18 nt, Molluscum contagiosum virus
gacaccgcguuuguggcg

SEQ ID NO: 4034453 - RNA, 19 nt, Molluscum contagiosum virus
gacacgggugagcucgcca

SEQ ID NO: 4034454 - RNA, 16 nt, Molluscum contagiosum virus
gacacguugcagcagc

SEQ ID NO: 4034455 - RNA, 22 nt, Molluscum contagiosum virus
gacacguugcagcagcacaggu

SEQ ID NO: 4034456 - RNA, 21 nt, Molluscum contagiosum virus
gacagagcucggcaacacaaa

SEQ ID NO: 4034457 - RNA, 16 nt, Molluscum contagiosum virus
gacagagugccuggcg

SEQ ID NO: 4034458 - RNA, 18 nt, Molluscum contagiosum virus
gacagagugccuggcgcg

SEQ ID NO: 4034459 - RNA, 13 nt, Molluscum contagiosum virus
gacagcaucccug

SEQ ID NO: 4034460 - RNA, 16 nt, Molluscum contagiosum virus
gacagcgacgagaucu

SEQ ID NO: 4034461 - RNA, 15 nt, Molluscum contagiosum virus
gacagcgcgcgcacg

SEQ ID NO: 4034462 - RNA, 16 nt, Molluscum contagiosum virus
gacagcgcgcgcacgc

SEQ ID NO: 4034463 - RNA, 13 nt, Molluscum contagiosum virus
gacagcgugcgcg

SEQ ID NO: 4034464 - RNA, 15 nt, Molluscum contagiosum virus
gacagcgugcgcggg

SEQ ID NO: 4034465 - RNA, 13 nt, Molluscum contagiosum virus
gacagcucagcag

SEQ ID NO: 4034466 - RNA, 23 nt, Molluscum contagiosum virus
gacagggugccuacucgcgacgc

SEQ ID NO: 4034467 - RNA, 19 nt, Molluscum contagiosum virus
gacagucagcggcgugcug

SEQ ID NO: 4034468 - RNA, 16 nt, Molluscum contagiosum virus
gacaucacgcguucgc

SEQ ID NO: 4034469 - RNA, 16 nt, Molluscum contagiosum virus
gacaugcacacgcacc

SEQ ID NO: 4034470 - RNA, 13 nt, Molluscum contagiosum virus
gacaugcugugcg

SEQ ID NO: 4034471 - RNA, 14 nt, Molluscum contagiosum virus
gaccaaggagggag

SEQ ID NO: 4034472 - RNA, 14 nt, Molluscum contagiosum virus
gaccaccagcacca

SEQ ID NO: 4034473 - RNA, 13 nt, Molluscum contagiosum virus
gaccacgcgcgcu

SEQ ID NO: 4034474 - RNA, 18 nt, Molluscum contagiosum virus
gacccccuccccagcgcc

SEQ ID NO: 4034475 - RNA, 23 nt, Molluscum contagiosum virus
gacccgcgaacgagggaugcaca

SEQ ID NO: 4034476 - RNA, 17 nt, Molluscum contagiosum virus
gacccucgcggcucugg

SEQ ID NO: 4034477 - RNA, 17 nt, Molluscum contagiosum virus
gaccgacccaucggaga

SEQ ID NO: 4034478 - RNA, 19 nt, Molluscum contagiosum virus
gaccgacccaucggagaag

SEQ ID NO: 4034479 - RNA, 20 nt, Molluscum contagiosum virus
gaccgcgaacugcaacguga

SEQ ID NO: 4034480 - RNA, 15 nt, Molluscum contagiosum virus
gaccgcgggcacggg

SEQ ID NO: 4034481 - RNA, 14 nt, Molluscum contagiosum virus
gaccgucaaccugc

SEQ ID NO: 4034482 - RNA, 14 nt, Molluscum contagiosum virus
gaccgucacgacuc

SEQ ID NO: 4034483 - RNA, 23 nt, Molluscum contagiosum virus
gaccgucagccucugugcggcgc

SEQ ID NO: 4034484 - RNA, 11 nt, Molluscum contagiosum virus
gaccugcuggu

SEQ ID NO: 4034485 - RNA, 13 nt, Molluscum contagiosum virus
gaccugcuggugg

SEQ ID NO: 4034486 - RNA, 19 nt, Molluscum contagiosum virus
gaccuuggugcucauccuc

SEQ ID NO: 4034487 - RNA, 17 nt, Molluscum contagiosum virus
gacgaagcgcucgcucg

SEQ ID NO: 4034488 - RNA, 18 nt, Molluscum contagiosum virus
gacgaaggcaagcucccg

SEQ ID NO: 4034489 - RNA, 22 nt, Molluscum contagiosum virus
gacgacaauacggugcagccgc

SEQ ID NO: 4034490 - RNA, 16 nt, Molluscum contagiosum virus
gacgacaugcacacgc

SEQ ID NO: 4034491 - RNA, 20 nt, Molluscum contagiosum virus
gacgacggcugcucgcugcc

SEQ ID NO: 4034492 - RNA, 16 nt, Molluscum contagiosum virus
gacgagacgugggcaa

SEQ ID NO: 4034493 - RNA, 17 nt, Molluscum contagiosum virus
gacgagccccgcgccgg

SEQ ID NO: 4034494 - RNA, 16 nt, Molluscum contagiosum virus
gacgagcgcgugcccg

SEQ ID NO: 4034495 - RNA, 20 nt, Molluscum contagiosum virus
gacgagcugugcgagccagu

SEQ ID NO: 4034496 - RNA, 14 nt, Molluscum contagiosum virus
gacgaggagcuguc

SEQ ID NO: 4034497 - RNA, 19 nt, Molluscum contagiosum virus
gacgaugguggcgcugcug

SEQ ID NO: 4034498 - RNA, 24 nt, Molluscum contagiosum virus
gacgcacagucuccacgcgugcgc

SEQ ID NO: 4034499 - RNA, 23 nt, Molluscum contagiosum virus
gacgccccaaaagugaagaucaa

SEQ ID NO: 4034500 - RNA, 19 nt, Molluscum contagiosum virus
gacgccgccaaugcugccg

SEQ ID NO: 4034501 - RNA, 22 nt, Molluscum contagiosum virus
gacgccucgggaaaacgcgcgg

SEQ ID NO: 4034502 - RNA, 15 nt, Molluscum contagiosum virus
gacgcgagacugugc

SEQ ID NO: 4034503 - RNA, 16 nt, Molluscum contagiosum virus
gacgcgaucuuccgcg

SEQ ID NO: 4034504 - RNA, 16 nt, Molluscum contagiosum virus
gacgcgcaagugugcg

SEQ ID NO: 4034505 - RNA, 15 nt, Molluscum contagiosum virus
gacgcgcagcucgac

SEQ ID NO: 4034506 - RNA, 17 nt, Molluscum contagiosum virus
gacgcgccucgagcagg

SEQ ID NO: 4034507 - RNA, 16 nt, Molluscum contagiosum virus
gacgcgcggcagacgc

SEQ ID NO: 4034508 - RNA, 16 nt, Molluscum contagiosum virus
gacgcgcuugcgcgga

SEQ ID NO: 4034509 - RNA, 22 nt, Molluscum contagiosum virus
gacgcgggccuguccgcgggcg

SEQ ID NO: 4034510 - RNA, 19 nt, Molluscum contagiosum virus
gacgcgugcaagcccagca

SEQ ID NO: 4034511 - RNA, 15 nt, Molluscum contagiosum virus
gacgcuagcugugcg

SEQ ID NO: 4034512 - RNA, 16 nt, Molluscum contagiosum virus
gacgcuagcugugcgc

SEQ ID NO: 4034513 - RNA, 16 nt, Molluscum contagiosum virus
gacgcucaacgugggc

SEQ ID NO: 4034514 - RNA, 14 nt, Molluscum contagiosum virus
gacgcucacggccu

SEQ ID NO: 4034515 - RNA, 20 nt, Molluscum contagiosum virus
gacgcugcaagacggaagac

SEQ ID NO: 4034516 - RNA, 16 nt, Molluscum contagiosum virus
gacgcugcggcggcgc

SEQ ID NO: 4034517 - RNA, 15 nt, Molluscum contagiosum virus
gacgcuggugaucac

SEQ ID NO: 4034518 - RNA, 23 nt, Molluscum contagiosum virus
gacgcuggugaucacgcacgaag

SEQ ID NO: 4034519 - RNA, 13 nt, Molluscum contagiosum virus
gacggacccgcga

SEQ ID NO: 4034520 - RNA, 19 nt, Molluscum contagiosum virus
gacggagagcgcgcggcgc

SEQ ID NO: 4034521 - RNA, 21 nt, Molluscum contagiosum virus
gacggaggucuacaacgagcu

SEQ ID NO: 4034522 - RNA, 22 nt, Molluscum contagiosum virus
gacggcaccguaccgcgcccgc

SEQ ID NO: 4034523 - RNA, 12 nt, Molluscum contagiosum virus
gacggcgagcgc

SEQ ID NO: 4034524 - RNA, 15 nt, Molluscum contagiosum virus
gacggcgugcgccgc

SEQ ID NO: 4034525 - RNA, 20 nt, Molluscum contagiosum virus
gacggcugcucgcugccugg

SEQ ID NO: 4034526 - RNA, 19 nt, Molluscum contagiosum virus
gacggcugguguuaccggg

SEQ ID NO: 4034527 - RNA, 21 nt, Molluscum contagiosum virus
gacggcugguguuaccggguc

SEQ ID NO: 4034528 - RNA, 23 nt, Molluscum contagiosum virus
gacgggcucaucccgggacacga

SEQ ID NO: 4034529 - RNA, 21 nt, Molluscum contagiosum virus
gacggggagcauguccgacuc

SEQ ID NO: 4034530 - RNA, 18 nt, Molluscum contagiosum virus
gacggugcugcgcacgga

SEQ ID NO: 4034531 - RNA, 16 nt, Molluscum contagiosum virus
gacggugugccgcugg

SEQ ID NO: 4034532 - RNA, 22 nt, Molluscum contagiosum virus
gacguacgagcaggcgcagcgc

SEQ ID NO: 4034533 - RNA, 15 nt, Molluscum contagiosum virus
gacgucaaccgggcu

SEQ ID NO: 4034534 - RNA, 19 nt, Molluscum contagiosum virus
gacgugcugcugcagaacu

SEQ ID NO: 4034535 - RNA, 18 nt, Molluscum contagiosum virus
gacgugcugcuggcccug

SEQ ID NO: 4034536 - RNA, 19 nt, Molluscum contagiosum virus
gacguggaccuuggcgcgc

SEQ ID NO: 4034537 - RNA, 22 nt, Molluscum contagiosum virus
gacguggaccuuggcgcgccgc

SEQ ID NO: 4034538 - RNA, 17 nt, Molluscum contagiosum virus
gacguggucgcgcgcgc

SEQ ID NO: 4034539 - RNA, 21 nt, Molluscum contagiosum virus
gacguguguccgagaucacgg

SEQ ID NO: 4034540 - RNA, 21 nt, Molluscum contagiosum virus
gacuacaccuggcgagcgcuc

SEQ ID NO: 4034541 - RNA, 13 nt, Molluscum contagiosum virus
gacuacgcacggc

SEQ ID NO: 4034542 - RNA, 17 nt, Molluscum contagiosum virus
gacuacuacguggugcg

SEQ ID NO: 4034543 - RNA, 24 nt, Molluscum contagiosum virus
gacuaucaggcgauaggacaugac

SEQ ID NO: 4034544 - RNA, 22 nt, Molluscum contagiosum virus
gacuaugcgucuuccugcugcc

SEQ ID NO: 4034545 - RNA, 21 nt, Molluscum contagiosum virus
gacucagcauguugcucuacc

SEQ ID NO: 4034546 - RNA, 14 nt, Molluscum contagiosum virus
gacuccaaggaggu

SEQ ID NO: 4034547 - RNA, 22 nt, Molluscum contagiosum virus
gacuccuuccggagacaccagc

SEQ ID NO: 4034548 - RNA, 20 nt, Molluscum contagiosum virus
gacuccuuugcgagcacugu

SEQ ID NO: 4034549 - RNA, 17 nt, Molluscum contagiosum virus
gacucgcgcccgcuccc

SEQ ID NO: 4034550 - RNA, 14 nt, Molluscum contagiosum virus
gacucgucgagcac

SEQ ID NO: 4034551 - RNA, 22 nt, Molluscum contagiosum virus
gacucucguucuuccggcagcg

SEQ ID NO: 4034552 - RNA, 19 nt, Molluscum contagiosum virus
gacugcccgcgcccugcac

SEQ ID NO: 4034553 - RNA, 22 nt, Molluscum contagiosum virus
gacugcggacgggaagcuuuca

SEQ ID NO: 4034554 - RNA, 19 nt, Molluscum contagiosum virus
gacugcuacgucgcggcgc

SEQ ID NO: 4034555 - RNA, 15 nt, Molluscum contagiosum virus
gacugcugcccccgc

SEQ ID NO: 4034556 - RNA, 19 nt, Molluscum contagiosum virus
gacugcugcccccgccgcg

SEQ ID NO: 4034557 - RNA, 14 nt, Molluscum contagiosum virus
cgcgcucuucccgu

SEQ ID NO: 4034558 - RNA, 14 nt, Molluscum contagiosum virus
cgcgcugcgcacgu

SEQ ID NO: 4034559 - RNA, 13 nt, Molluscum contagiosum virus
cgcgcugcgccac

SEQ ID NO: 4034560 - RNA, 18 nt, Molluscum contagiosum virus
cgcgcugcgcgccgcgcc

SEQ ID NO: 4034561 - RNA, 19 nt, Molluscum contagiosum virus
cgcgcuggacuugcgcgag

SEQ ID NO: 4034562 - RNA, 24 nt, Molluscum contagiosum virus
cgcgcuuagcacacgcgcgcgcag

SEQ ID NO: 4034563 - RNA, 18 nt, Molluscum contagiosum virus
cgcgcuuccgcgagucug

SEQ ID NO: 4034564 - RNA, 16 nt, Molluscum contagiosum virus
cgcgcuuugcgcggcg

SEQ ID NO: 4034565 - RNA, 16 nt, Molluscum contagiosum virus
cgcggaagaagcugcg

SEQ ID NO: 4034566 - RNA, 17 nt, Molluscum contagiosum virus
cgcggaagaucgcgucg

SEQ ID NO: 4034567 - RNA, 22 nt, Molluscum contagiosum virus
cgcggaagcccgagcgcgucca

SEQ ID NO: 4034568 - RNA, 23 nt, Molluscum contagiosum virus
cgcggacacguuccagagcacug

SEQ ID NO: 4034569 - RNA, 13 nt, Molluscum contagiosum virus
cgcggaccgcgcc

SEQ ID NO: 4034570 - RNA, 14 nt, Molluscum contagiosum virus
cgcggagaagugcg

SEQ ID NO: 4034571 - RNA, 20 nt, Molluscum contagiosum virus
cgcggagaagugcgcagcuu

SEQ ID NO: 4034572 - RNA, 15 nt, Molluscum contagiosum virus
cgcggagcugcgcgc

SEQ ID NO: 4034573 - RNA, 14 nt, Molluscum contagiosum virus
cgcggagcugugcc

SEQ ID NO: 4034574 - RNA, 13 nt, Molluscum contagiosum virus
cgcggagggcagc

SEQ ID NO: 4034575 - RNA, 22 nt, Molluscum contagiosum virus
cgcggauguccuugaugccgug

SEQ ID NO: 4034576 - RNA, 21 nt, Molluscum contagiosum virus
cgcggcaaaugcgucccagca

SEQ ID NO: 4034577 - RNA, 23 nt, Molluscum contagiosum virus
cgcggcaaaugcgucccagcagc

SEQ ID NO: 4034578 - RNA, 18 nt, Molluscum contagiosum virus
cgcggcaagccuggcucc

SEQ ID NO: 4034579 - RNA, 18 nt, Molluscum contagiosum virus
cgcggcacaugcagcugc

SEQ ID NO: 4034580 - RNA, 19 nt, Molluscum contagiosum virus
cgcggcacaugcagcugca

SEQ ID NO: 4034581 - RNA, 16 nt, Molluscum contagiosum virus
cgcggcaccugucgcg

SEQ ID NO: 4034582 - RNA, 15 nt, Molluscum contagiosum virus
cgcggcacugggugc

SEQ ID NO: 4034583 - RNA, 20 nt, Molluscum contagiosum virus
cgcggcacugggugcccgag

SEQ ID NO: 4034584 - RNA, 15 nt, Molluscum contagiosum virus
cgcggcagacgccag

SEQ ID NO: 4034585 - RNA, 13 nt, Molluscum contagiosum virus
cgcggcagcagcc

SEQ ID NO: 4034586 - RNA, 13 nt, Molluscum contagiosum virus
cgcggcaguggcc

SEQ ID NO: 4034587 - RNA, 21 nt, Molluscum contagiosum virus
cgcggccaugcuccugaucug

SEQ ID NO: 4034588 - RNA, 22 nt, Molluscum contagiosum virus
cgcggccgagucacgccccagc

SEQ ID NO: 4034589 - RNA, 13 nt, Molluscum contagiosum virus
cgcggccgcgaga

SEQ ID NO: 4034590 - RNA, 13 nt, Molluscum contagiosum virus
cgcggcgagccgc

SEQ ID NO: 4034591 - RNA, 22 nt, Molluscum contagiosum virus
cgcggcgagugcggccaccagc

SEQ ID NO: 4034592 - RNA, 12 nt, Molluscum contagiosum virus
cgcggcgcagug

SEQ ID NO: 4034593 - RNA, 21 nt, Molluscum contagiosum virus
cgcggcgcgcagcucgccgcg

SEQ ID NO: 4034594 - RNA, 14 nt, Molluscum contagiosum virus
cgcggcgcgcccag

SEQ ID NO: 4034595 - RNA, 15 nt, Molluscum contagiosum virus
cgcggcgcgcccagc

SEQ ID NO: 4034596 - RNA, 14 nt, Molluscum contagiosum virus
cgcggcgcgccgcc

SEQ ID NO: 4034597 - RNA, 23 nt, Molluscum contagiosum virus
cgcggcggagaugacgggcacgc

SEQ ID NO: 4034598 - RNA, 19 nt, Molluscum contagiosum virus
cgcggcuaccacgggcccg

SEQ ID NO: 4034599 - RNA, 22 nt, Molluscum contagiosum virus
cgcgggccuguccgcgggcgca

SEQ ID NO: 4034600 - RNA, 13 nt, Molluscum contagiosum virus
cgcgggcgcagag

SEQ ID NO: 4034601 - RNA, 18 nt, Molluscum contagiosum virus
cgcgggcgccggcguccg

SEQ ID NO: 4034602 - RNA, 13 nt, Molluscum contagiosum virus
cgcggggcaagcg

SEQ ID NO: 4034603 - RNA, 17 nt, Molluscum contagiosum virus
cgcggucgcccgccgag

SEQ ID NO: 4034604 - RNA, 18 nt, Molluscum contagiosum virus
cgcggucgcccgccgagc

SEQ ID NO: 4034605 - RNA, 13 nt, Molluscum contagiosum virus
cgcggucgcggag

SEQ ID NO: 4034606 - RNA, 21 nt, Molluscum contagiosum virus
cgcggucgggccccugcgcga

SEQ ID NO: 4034607 - RNA, 17 nt, Molluscum contagiosum virus
cgcggugugcacaugcc

SEQ ID NO: 4034608 - RNA, 18 nt, Molluscum contagiosum virus
cgcguacauccgcgagca

SEQ ID NO: 4034609 - RNA, 18 nt, Molluscum contagiosum virus
cgcguaccuacucgccgu

SEQ ID NO: 4034610 - RNA, 13 nt, Molluscum contagiosum virus
cgcguacgaagag

SEQ ID NO: 4034611 - RNA, 14 nt, Molluscum contagiosum virus
cgcguagcagcgcc

SEQ ID NO: 4034612 - RNA, 13 nt, Molluscum contagiosum virus
cgcguccaugcug

SEQ ID NO: 4034613 - RNA, 13 nt, Molluscum contagiosum virus
cgcguccgcgcag

SEQ ID NO: 4034614 - RNA, 12 nt, Molluscum contagiosum virus
cgcgucgcgcag

SEQ ID NO: 4034615 - RNA, 16 nt, Molluscum contagiosum virus
cgcgucgcgcgccgcg

SEQ ID NO: 4034616 - RNA, 14 nt, Molluscum contagiosum virus
cgcgucgcggaggg

SEQ ID NO: 4034617 - RNA, 18 nt, Molluscum contagiosum virus
cgcgucggucaccaccac

SEQ ID NO: 4034618 - RNA, 16 nt, Molluscum contagiosum virus
cgcgugacacaccgcg

SEQ ID NO: 4034619 - RNA, 15 nt, Molluscum contagiosum virus
cgcgugagagccauu

SEQ ID NO: 4034620 - RNA, 23 nt, Molluscum contagiosum virus
cgcgugaggaggcggcacugcua

SEQ ID NO: 4034621 - RNA, 19 nt, Molluscum contagiosum virus
cgcgugcaagcccagcagc

SEQ ID NO: 4034622 - RNA, 14 nt, Molluscum contagiosum virus
cgcgugcaggaacg

SEQ ID NO: 4034623 - RNA, 19 nt, Molluscum contagiosum virus
cgcgugcaugcgagcgcgg

SEQ ID NO: 4034624 - RNA, 19 nt, Molluscum contagiosum virus
cgcgugccagucgcgcgag

SEQ ID NO: 4034625 - RNA, 14 nt, Molluscum contagiosum virus
cgcgugccgcggac

SEQ ID NO: 4034626 - RNA, 20 nt, Molluscum contagiosum virus
cgcgugccgggcuugcuccc

SEQ ID NO: 4034627 - RNA, 14 nt, Molluscum contagiosum virus
cgcgugccuguggc

SEQ ID NO: 4034628 - RNA, 22 nt, Molluscum contagiosum virus
cgcgugccuguggcgcacacgc

SEQ ID NO: 4034629 - RNA, 17 nt, Molluscum contagiosum virus
cgcgugcgagcggcgcg

SEQ ID NO: 4034630 - RNA, 21 nt, Molluscum contagiosum virus
cgcgugcgagcggcgcgcgcu

SEQ ID NO: 4034631 - RNA, 20 nt, Molluscum contagiosum virus
cgcgugcgccgccgcaggcc

SEQ ID NO: 4034632 - RNA, 14 nt, Molluscum contagiosum virus
cgcgugcgcgccag

SEQ ID NO: 4034633 - RNA, 14 nt, Molluscum contagiosum virus
cgcgugcugcggcu

SEQ ID NO: 4034634 - RNA, 14 nt, Molluscum contagiosum virus
cgcgugcugggccc

SEQ ID NO: 4034635 - RNA, 19 nt, Molluscum contagiosum virus
cgcguguuugugcuguccc

SEQ ID NO: 4034636 - RNA, 17 nt, Molluscum contagiosum virus
cgcguucgcguacggcg

SEQ ID NO: 4034637 - RNA, 20 nt, Molluscum contagiosum virus
cgcuaaucugccgcggcgga

SEQ ID NO: 4034638 - RNA, 13 nt, Molluscum contagiosum virus
cgcuacagcagcc

SEQ ID NO: 4034639 - RNA, 22 nt, Molluscum contagiosum virus
cgcuacccguugcugcgccacg

SEQ ID NO: 4034640 - RNA, 22 nt, Molluscum contagiosum virus
cgcuacgacgacaugcacacgc

SEQ ID NO: 4034641 - RNA, 23 nt, Molluscum contagiosum virus
cgcuacuugcuggcgcgcggaga

SEQ ID NO: 4034642 - RNA, 21 nt, Molluscum contagiosum virus
cgcuagcagggcggcgccugc

SEQ ID NO: 4034643 - RNA, 22 nt, Molluscum contagiosum virus
cgcuaggggugccgcugcgcug

SEQ ID NO: 4034644 - RNA, 16 nt, Molluscum contagiosum virus
cgcuaugccgcgugcu

SEQ ID NO: 4034645 - RNA, 23 nt, Molluscum contagiosum virus
cgcucacagcuucgcgagcccgg

SEQ ID NO: 4034646 - RNA, 19 nt, Molluscum contagiosum virus
cgcucauacuccugcuggc

SEQ ID NO: 4034647 - RNA, 18 nt, Molluscum contagiosum virus
cgcucauccacgcggagg

SEQ ID NO: 4034648 - RNA, 15 nt, Molluscum contagiosum virus
cgcuccacgcccgag

SEQ ID NO: 4034649 - RNA, 16 nt, Molluscum contagiosum virus
cgcuccagagccgcgu

SEQ ID NO: 4034650 - RNA, 20 nt, Molluscum contagiosum virus
cgcuccgagucguacacgca

SEQ ID NO: 4034651 - RNA, 22 nt, Molluscum contagiosum virus
cgcucgaggaccucgcgcgccg

SEQ ID NO: 4034652 - RNA, 14 nt, Molluscum contagiosum virus
cgcucgagggcgcc

SEQ ID NO: 4034653 - RNA, 14 nt, Molluscum contagiosum virus
cgcucgccccuucc

SEQ ID NO: 4034654 - RNA, 14 nt, Molluscum contagiosum virus
cgcucgccucuggg

SEQ ID NO: 4034655 - RNA, 16 nt, Molluscum contagiosum virus
cgcucgccucugggcg

SEQ ID NO: 4034656 - RNA, 22 nt, Molluscum contagiosum virus
cgcucgcgcgcaugcucgcgcu

SEQ ID NO: 4034657 - RNA, 12 nt, Molluscum contagiosum virus
cgcucgcgcucc

SEQ ID NO: 4034658 - RNA, 14 nt, Molluscum contagiosum virus
cgcucgcgugccgc

SEQ ID NO: 4034659 - RNA, 21 nt, Molluscum contagiosum virus
cgcucgcgugccgcggacgcc

SEQ ID NO: 4034660 - RNA, 12 nt, Molluscum contagiosum virus
cgcucgcugucc

SEQ ID NO: 4034661 - RNA, 22 nt, Molluscum contagiosum virus
cgguugccugcacaagcaggag

SEQ ID NO: 4034662 - RNA, 17 nt, Molluscum contagiosum virus
cgguuugcuaacaggaa

SEQ ID NO: 4034663 - RNA, 18 nt, Molluscum contagiosum virus
cguaacaauggacacgca

SEQ ID NO: 4034664 - RNA, 14 nt, Molluscum contagiosum virus
cguaagccaccgcg

SEQ ID NO: 4034665 - RNA, 21 nt, Molluscum contagiosum virus
cguaauccaugucgagcccug

SEQ ID NO: 4034666 - RNA, 17 nt, Molluscum contagiosum virus
cguacagcuccccgcgc

SEQ ID NO: 4034667 - RNA, 13 nt, Molluscum contagiosum virus
cguacccuggcag

SEQ ID NO: 4034668 - RNA, 18 nt, Molluscum contagiosum virus
cguacgcacgugccgugc

SEQ ID NO: 4034669 - RNA, 20 nt, Molluscum contagiosum virus
cguacgcgccggggcgcgcg

SEQ ID NO: 4034670 - RNA, 12 nt, Molluscum contagiosum virus
cguacgcggagg

SEQ ID NO: 4034671 - RNA, 17 nt, Molluscum contagiosum virus
cguacgcgucgcggagg

SEQ ID NO: 4034672 - RNA, 23 nt, Molluscum contagiosum virus
cguacucgcugcuccccgccagc

SEQ ID NO: 4034673 - RNA, 12 nt, Molluscum contagiosum virus
cguacugcugca

SEQ ID NO: 4034674 - RNA, 21 nt, Molluscum contagiosum virus
cguagacagugcggcgcggcu

SEQ ID NO: 4034675 - RNA, 19 nt, Molluscum contagiosum virus
cguagacgauuuugccgca

SEQ ID NO: 4034676 - RNA, 13 nt, Molluscum contagiosum virus
cguagagcagcgc

SEQ ID NO: 4034677 - RNA, 14 nt, Molluscum contagiosum virus
cguagagcagcgcu

SEQ ID NO: 4034678 - RNA, 17 nt, Molluscum contagiosum virus
cguaguacugcagcagc

SEQ ID NO: 4034679 - RNA, 19 nt, Molluscum contagiosum virus
cguauccucgacgcgcugc

SEQ ID NO: 4034680 - RNA, 15 nt, Molluscum contagiosum virus
cgucaagcagcgcgc

SEQ ID NO: 4034681 - RNA, 17 nt, Molluscum contagiosum virus
cgucaagcagcgcgcca

SEQ ID NO: 4034682 - RNA, 19 nt, Molluscum contagiosum virus
cgucaugcgacugccagcc

SEQ ID NO: 4034683 - RNA, 20 nt, Molluscum contagiosum virus
cguccacaaagcccuccuga

SEQ ID NO: 4034684 - RNA, 15 nt, Molluscum contagiosum virus
cguccacaggcgcga

SEQ ID NO: 4034685 - RNA, 20 nt, Molluscum contagiosum virus
cguccaugugcccgcggcgc

SEQ ID NO: 4034686 - RNA, 15 nt, Molluscum contagiosum virus
cguccccggaaagca

SEQ ID NO: 4034687 - RNA, 14 nt, Molluscum contagiosum virus
cguccccucuccgg

SEQ ID NO: 4034688 - RNA, 14 nt, Molluscum contagiosum virus
cgucccgacagcag

SEQ ID NO: 4034689 - RNA, 15 nt, Molluscum contagiosum virus
cguccgcgcagcucg

SEQ ID NO: 4034690 - RNA, 20 nt, Molluscum contagiosum virus
cguccgcucgugccacugcc

SEQ ID NO: 4034691 - RNA, 19 nt, Molluscum contagiosum virus
cguccgugcgcagggcaau

SEQ ID NO: 4034692 - RNA, 16 nt, Molluscum contagiosum virus
cgucgcacaguucacg

SEQ ID NO: 4034693 - RNA, 15 nt, Molluscum contagiosum virus
cgucgccgcgcccgc

SEQ ID NO: 4034694 - RNA, 13 nt, Molluscum contagiosum virus
cgucgccugagcu

SEQ ID NO: 4034695 - RNA, 14 nt, Molluscum contagiosum virus
cgucgcgccgcucg

SEQ ID NO: 4034696 - RNA, 19 nt, Molluscum contagiosum virus
cgucgcggagggcgaggcc

SEQ ID NO: 4034697 - RNA, 17 nt, Molluscum contagiosum virus
cgucgcggucgcggagc

SEQ ID NO: 4034698 - RNA, 20 nt, Molluscum contagiosum virus
cgucgggcgccaacacgagc

SEQ ID NO: 4034699 - RNA, 15 nt, Molluscum contagiosum virus
cgucuccaacaagcu

SEQ ID NO: 4034700 - RNA, 11 nt, Molluscum contagiosum virus
cgucucgagcu

SEQ ID NO: 4034701 - RNA, 14 nt, Molluscum contagiosum virus
cgucucgcucuucc

SEQ ID NO: 4034702 - RNA, 13 nt, Molluscum contagiosum virus
cgucucggagaag

SEQ ID NO: 4034703 - RNA, 13 nt, Molluscum contagiosum virus
cgucugcugcucg

SEQ ID NO: 4034704 - RNA, 14 nt, Molluscum contagiosum virus
cgucuuaacucagc

SEQ ID NO: 4034705 - RNA, 14 nt, Molluscum contagiosum virus
cgucuuacugcugc

SEQ ID NO: 4034706 - RNA, 15 nt, Molluscum contagiosum virus
cgucuuacugcugca

SEQ ID NO: 4034707 - RNA, 20 nt, Molluscum contagiosum virus
cgucuugacaggcgcgcaag

SEQ ID NO: 4034708 - RNA, 21 nt, Molluscum contagiosum virus
cgucuugacaggcgcgcaagu

SEQ ID NO: 4034709 - RNA, 20 nt, Molluscum contagiosum virus
cgucuuucccagaagggcuu

SEQ ID NO: 4034710 - RNA, 21 nt, Molluscum contagiosum virus
cgucuuuuugcggcgccgccg

SEQ ID NO: 4034711 - RNA, 18 nt, Molluscum contagiosum virus
cgugaacgaggcugcugc

SEQ ID NO: 4034712 - RNA, 17 nt, Molluscum contagiosum virus
cgugaacuccaaggucg

SEQ ID NO: 4034713 - RNA, 15 nt, Molluscum contagiosum virus
cgugacaaucucugc

SEQ ID NO: 4034714 - RNA, 20 nt, Molluscum contagiosum virus
cgugacagagugccuggcgc

SEQ ID NO: 4034715 - RNA, 13 nt, Molluscum contagiosum virus
cgugacagucagc

SEQ ID NO: 4034716 - RNA, 19 nt, Molluscum contagiosum virus
cgugacucggccgcggggc

SEQ ID NO: 4034717 - RNA, 14 nt, Molluscum contagiosum virus
cgugagcgcgcucu

SEQ ID NO: 4034718 - RNA, 20 nt, Molluscum contagiosum virus
cgugaggaggcggcacugcu

SEQ ID NO: 4034719 - RNA, 13 nt, Molluscum contagiosum virus
cgugcaagcccag

SEQ ID NO: 4034720 - RNA, 19 nt, Molluscum contagiosum virus
cgugcacccuccgcacaga

SEQ ID NO: 4034721 - RNA, 17 nt, Molluscum contagiosum virus
cgugcacuagcacgggc

SEQ ID NO: 4034722 - RNA, 14 nt, Molluscum contagiosum virus
cgugcagggcgugc

SEQ ID NO: 4034723 - RNA, 16 nt, Molluscum contagiosum virus
cgugcauggcacgcga

SEQ ID NO: 4034724 - RNA, 21 nt, Molluscum contagiosum virus
cgugcccgguacgcucgcgcu

SEQ ID NO: 4034725 - RNA, 15 nt, Molluscum contagiosum virus
cgugcccuggaccuc

SEQ ID NO: 4034726 - RNA, 13 nt, Molluscum contagiosum virus
cgugccgccggcg

SEQ ID NO: 4034727 - RNA, 17 nt, Molluscum contagiosum virus
cgugccgccggcgccgc

SEQ ID NO: 4034728 - RNA, 17 nt, Molluscum contagiosum virus
cgugccuggcagugccg

SEQ ID NO: 4034729 - RNA, 14 nt, Molluscum contagiosum virus
cgugcgcagcacgg

SEQ ID NO: 4034730 - RNA, 16 nt, Molluscum contagiosum virus
cgugcgcagcagcucg

SEQ ID NO: 4034731 - RNA, 20 nt, Molluscum contagiosum virus
cgugcgcagcagcucggggc

SEQ ID NO: 4034732 - RNA, 18 nt, Molluscum contagiosum virus
cgugcgcagugcugcgcg

SEQ ID NO: 4034733 - RNA, 23 nt, Molluscum contagiosum virus
cgugcgcaucccugcgcaccugc

SEQ ID NO: 4034734 - RNA, 13 nt, Molluscum contagiosum virus
cgugcgccgccgc

SEQ ID NO: 4034735 - RNA, 16 nt, Molluscum contagiosum virus
cgugcgcgagacuugu

SEQ ID NO: 4034736 - RNA, 12 nt, Molluscum contagiosum virus
cgugcgcgagcu

SEQ ID NO: 4034737 - RNA, 14 nt, Molluscum contagiosum virus
cgugcgcugcgcgc

SEQ ID NO: 4034738 - RNA, 14 nt, Molluscum contagiosum virus
cgugcgcuuugagg

SEQ ID NO: 4034739 - RNA, 17 nt, Molluscum contagiosum virus
cgugcggcggcgcgugc

SEQ ID NO: 4034740 - RNA, 13 nt, Molluscum contagiosum virus
cgugcucacgcug

SEQ ID NO: 4034741 - RNA, 17 nt, Molluscum contagiosum virus
cgugcucacgcugcccg

SEQ ID NO: 4034742 - RNA, 19 nt, Molluscum contagiosum virus
cgugcucaggccagcaucu

SEQ ID NO: 4034743 - RNA, 22 nt, Molluscum contagiosum virus
cgugcuccucgcguagcagcgc

SEQ ID NO: 4034744 - RNA, 14 nt, Molluscum contagiosum virus
cgugcucgcgagcg

SEQ ID NO: 4034745 - RNA, 21 nt, Molluscum contagiosum virus
cgugcucgcgagcguuucugc

SEQ ID NO: 4034746 - RNA, 20 nt, Molluscum contagiosum virus
cgugcucgguagcguggagc

SEQ ID NO: 4034747 - RNA, 19 nt, Molluscum contagiosum virus
cgugcucugcuccgcggag

SEQ ID NO: 4034748 - RNA, 20 nt, Molluscum contagiosum virus
cgugcucugcuccgcggagg

SEQ ID NO: 4034749 - RNA, 14 nt, Molluscum contagiosum virus
cgugcugaucacgc

SEQ ID NO: 4034750 - RNA, 17 nt, Molluscum contagiosum virus
cgugcugcagcugcgcg

SEQ ID NO: 4034751 - RNA, 14 nt, Molluscum contagiosum virus
cgugcugcggcugc

SEQ ID NO: 4034752 - RNA, 12 nt, Molluscum contagiosum virus
cgugcugcugcg

SEQ ID NO: 4034753 - RNA, 19 nt, Molluscum contagiosum virus
cgugcuggagggcacgcug

SEQ ID NO: 4034754 - RNA, 13 nt, Molluscum contagiosum virus
cguggacaacagc

SEQ ID NO: 4034755 - RNA, 17 nt, Molluscum contagiosum virus
cguggacaacagcacga

SEQ ID NO: 4034756 - RNA, 19 nt, Molluscum contagiosum virus
cguggaccuuggcgcgccg

SEQ ID NO: 4034757 - RNA, 19 nt, Molluscum contagiosum virus
cguggacgagcgcuaccug

SEQ ID NO: 4034758 - RNA, 14 nt, Molluscum contagiosum virus
cguggaggagccgc

SEQ ID NO: 4034759 - RNA, 19 nt, Molluscum contagiosum virus
cguggauaccaugcucucg

SEQ ID NO: 4034760 - RNA, 14 nt, Molluscum contagiosum virus
cguggccagcuuca

SEQ ID NO: 4034761 - RNA, 14 nt, Molluscum contagiosum virus
cguggccaggccgc

SEQ ID NO: 4034762 - RNA, 18 nt, Molluscum contagiosum virus
cguggccaggccgcgccg

SEQ ID NO: 4034763 - RNA, 17 nt, Molluscum contagiosum virus
cguggccguagugcuca

SEQ ID NO: 4034764 - RNA, 16 nt, Molluscum contagiosum virus
cguggcgccgcugcug

SEQ ID NO: 4034765 - RNA, 14 nt, Molluscum contagiosum virus
cguggcgcgccggc

SEQ ID NO: 4034766 - RNA, 17 nt, Molluscum contagiosum virus
cgaggacgacgccgagc

SEQ ID NO: 4034767 - RNA, 17 nt, Molluscum contagiosum virus
cgaggacuuccgcgcgc

SEQ ID NO: 4034768 - RNA, 19 nt, Molluscum contagiosum virus
cgaggaggcgcccucgcgc

SEQ ID NO: 4034769 - RNA, 21 nt, Molluscum contagiosum virus
cgaggauacgcccgcgaaaga

SEQ ID NO: 4034770 - RNA, 20 nt, Molluscum contagiosum virus
cgaggcagccgcggcgcccg

SEQ ID NO: 4034771 - RNA, 21 nt, Molluscum contagiosum virus
cgaggccggccgugcagagca

SEQ ID NO: 4034772 - RNA, 14 nt, Molluscum contagiosum virus
cgaggccugcgugg

SEQ ID NO: 4034773 - RNA, 19 nt, Molluscum contagiosum virus
cgaggcgcuugggcacugc

SEQ ID NO: 4034774 - RNA, 20 nt, Molluscum contagiosum virus
cgaggcguccagcggcugcc

SEQ ID NO: 4034775 - RNA, 12 nt, Molluscum contagiosum virus
cgaggcugcugc

SEQ ID NO: 4034776 - RNA, 13 nt, Molluscum contagiosum virus
cgagggccuuggc

SEQ ID NO: 4034777 - RNA, 16 nt, Molluscum contagiosum virus
cgagggcgaguccccg

SEQ ID NO: 4034778 - RNA, 22 nt, Molluscum contagiosum virus
cgagggggacgugcccuacgcg

SEQ ID NO: 4034779 - RNA, 14 nt, Molluscum contagiosum virus
cgaguaccgcgcgc

SEQ ID NO: 4034780 - RNA, 20 nt, Molluscum contagiosum virus
cgaguacgccaucguggugg

SEQ ID NO: 4034781 - RNA, 16 nt, Molluscum contagiosum virus
cgaguacgcucuccau

SEQ ID NO: 4034782 - RNA, 17 nt, Molluscum contagiosum virus
cgagucaaugacacgag

SEQ ID NO: 4034783 - RNA, 20 nt, Molluscum contagiosum virus
cgagugcccgcgcgcuguau

SEQ ID NO: 4034784 - RNA, 18 nt, Molluscum contagiosum virus
ccuccacguccaggccgc

SEQ ID NO: 4034785 - RNA, 16 nt, Molluscum contagiosum virus
ccuccagcagcggcgc

SEQ ID NO: 4034786 - RNA, 15 nt, Molluscum contagiosum virus
ccuccccagcgccgc

SEQ ID NO: 4034787 - RNA, 18 nt, Molluscum contagiosum virus
ccuccgcacacgcgcgcg

SEQ ID NO: 4034788 - RNA, 18 nt, Molluscum contagiosum virus
ccuccgguacguacagug

SEQ ID NO: 4034789 - RNA, 18 nt, Molluscum contagiosum virus
ccuccugcaccugcugga

SEQ ID NO: 4034790 - RNA, 18 nt, Molluscum contagiosum virus
ccuccugcuuugcacgcg

SEQ ID NO: 4034791 - RNA, 20 nt, Molluscum contagiosum virus
ccucgacaaugagcacuugc

SEQ ID NO: 4034792 - RNA, 15 nt, Molluscum contagiosum virus
ccucgaccugcacga

SEQ ID NO: 4034793 - RNA, 23 nt, Molluscum contagiosum virus
ccucgacgcguucuagcagcgug

SEQ ID NO: 4034794 - RNA, 12 nt, Molluscum contagiosum virus
ccucgagcacgc

SEQ ID NO: 4034795 - RNA, 13 nt, Molluscum contagiosum virus
ccucgagcagcgg

SEQ ID NO: 4034796 - RNA, 23 nt, Molluscum contagiosum virus
ccucgagcaggucaucgggcugc

SEQ ID NO: 4034797 - RNA, 15 nt, Molluscum contagiosum virus
ccucgagcgccgccg

SEQ ID NO: 4034798 - RNA, 15 nt, Molluscum contagiosum virus
ccucgagcgcgcugg

SEQ ID NO: 4034799 - RNA, 23 nt, Molluscum contagiosum virus
ccucgcaggcgaggucacacucg

SEQ ID NO: 4034800 - RNA, 19 nt, Molluscum contagiosum virus
ccucgccgaacggcagacc

SEQ ID NO: 4034801 - RNA, 12 nt, Molluscum contagiosum virus
ccucgcgcacag

SEQ ID NO: 4034802 - RNA, 15 nt, Molluscum contagiosum virus
ccucgcgcgcacugc

SEQ ID NO: 4034803 - RNA, 19 nt, Molluscum contagiosum virus
ccucgcgcgcagcacaccg

SEQ ID NO: 4034804 - RNA, 18 nt, Molluscum contagiosum virus
ccucgcgcgcgcgcggcg

SEQ ID NO: 4034805 - RNA, 16 nt, Molluscum contagiosum virus
ccucgcguagcagcgc

SEQ ID NO: 4034806 - RNA, 20 nt, Molluscum contagiosum virus
ccucggaggaaaagcacgcg

SEQ ID NO: 4034807 - RNA, 13 nt, Molluscum contagiosum virus
ccucggcgcgccg

SEQ ID NO: 4034808 - RNA, 20 nt, Molluscum contagiosum virus
ccucgggaaaacgcgcggca

SEQ ID NO: 4034809 - RNA, 17 nt, Molluscum contagiosum virus
ccucgucguccacaggc

SEQ ID NO: 4034810 - RNA, 20 nt, Molluscum contagiosum virus
ccucguggucgccgcggccg

SEQ ID NO: 4034811 - RNA, 18 nt, Molluscum contagiosum virus
ccucgugguugcgcagca

SEQ ID NO: 4034812 - RNA, 20 nt, Molluscum contagiosum virus
ccucuccaucaucgagcugc

SEQ ID NO: 4034813 - RNA, 12 nt, Molluscum contagiosum virus
ccucugcgagcg

SEQ ID NO: 4034814 - RNA, 13 nt, Molluscum contagiosum virus
ccucugcgcggcc

SEQ ID NO: 4034815 - RNA, 23 nt, Molluscum contagiosum virus
ccucugcgcggcccgcgggcugc

SEQ ID NO: 4034816 - RNA, 15 nt, Molluscum contagiosum virus
ccucuuuugcgucgc

SEQ ID NO: 4034817 - RNA, 16 nt, Molluscum contagiosum virus
ccugaacaagcugcac

SEQ ID NO: 4034818 - RNA, 17 nt, Molluscum contagiosum virus
ccugcacuacugcucca

SEQ ID NO: 4034819 - RNA, 21 nt, Molluscum contagiosum virus
ccugcaucgcgccgcccgggc

SEQ ID NO: 4034820 - RNA, 22 nt, Molluscum contagiosum virus
ccugccgcgagcacuggcuggc

SEQ ID NO: 4034821 - RNA, 12 nt, Molluscum contagiosum virus
ccugccuguggg

SEQ ID NO: 4034822 - RNA, 23 nt, Molluscum contagiosum virus
ccugcgaaaaagcccgcggguac

SEQ ID NO: 4034823 - RNA, 14 nt, Molluscum contagiosum virus
ccugcgacagcugc

SEQ ID NO: 4034824 - RNA, 21 nt, Molluscum contagiosum virus
ccugcgcaacgugcugcgccg

SEQ ID NO: 4034825 - RNA, 22 nt, Molluscum contagiosum virus
ccugcgccgccucaugcgcgug

SEQ ID NO: 4034826 - RNA, 19 nt, Molluscum contagiosum virus
ccugcgcgagcaagcgccc

SEQ ID NO: 4034827 - RNA, 15 nt, Molluscum contagiosum virus
ccugcgcgagcaguu

SEQ ID NO: 4034828 - RNA, 21 nt, Molluscum contagiosum virus
ccugcgcgcggcaguggcgug

SEQ ID NO: 4034829 - RNA, 14 nt, Molluscum contagiosum virus
ccugcgcuagugaa

SEQ ID NO: 4034830 - RNA, 17 nt, Molluscum contagiosum virus
ccugcggcugcggcgcg

SEQ ID NO: 4034831 - RNA, 19 nt, Molluscum contagiosum virus
ccugcgggagauccuggcg

SEQ ID NO: 4034832 - RNA, 12 nt, Molluscum contagiosum virus
ccugcgggcgcu

SEQ ID NO: 4034833 - RNA, 16 nt, Molluscum contagiosum virus
ccugcuagugcgcgcc

SEQ ID NO: 4034834 - RNA, 14 nt, Molluscum contagiosum virus
ccugcucgggcugc

SEQ ID NO: 4034835 - RNA, 23 nt, Molluscum contagiosum virus
ccugcugaagaaggagcccuugc

SEQ ID NO: 4034836 - RNA, 14 nt, Molluscum contagiosum virus
ccugcugccgagcu

SEQ ID NO: 4034837 - RNA, 15 nt, Molluscum contagiosum virus
ccugcugccucccaa

SEQ ID NO: 4034838 - RNA, 15 nt, Molluscum contagiosum virus
ccugcuggcaccgcg

SEQ ID NO: 4034839 - RNA, 19 nt, Molluscum contagiosum virus
ccugcugguggugcuggag

SEQ ID NO: 4034840 - RNA, 14 nt, Molluscum contagiosum virus
ccuggagcgcaguc

SEQ ID NO: 4034841 - RNA, 21 nt, Molluscum contagiosum virus
ccuggcgagcgcucugcauug

SEQ ID NO: 4034842 - RNA, 18 nt, Molluscum contagiosum virus
ccuggcggcagcacgggc

SEQ ID NO: 4034843 - RNA, 14 nt, Molluscum contagiosum virus
ccuggcggcgcugg

SEQ ID NO: 4034844 - RNA, 18 nt, Molluscum contagiosum virus
ccuggcggcgcuggagac

SEQ ID NO: 4034845 - RNA, 21 nt, Molluscum contagiosum virus
ccuggcucgcgagugugcaug

SEQ ID NO: 4034846 - RNA, 13 nt, Molluscum contagiosum virus
ccugguggagcac

SEQ ID NO: 4034847 - RNA, 15 nt, Molluscum contagiosum virus
ccugguggagcacuu

SEQ ID NO: 4034848 - RNA, 18 nt, Molluscum contagiosum virus
ccuggugugccagcggcg

SEQ ID NO: 4034849 - RNA, 20 nt, Molluscum contagiosum virus
ccugucaucaccccgcuggg

SEQ ID NO: 4034850 - RNA, 19 nt, Molluscum contagiosum virus
ccugucgcgcacgagcgcg

SEQ ID NO: 4034851 - RNA, 15 nt, Molluscum contagiosum virus
ccugucggagcagga

SEQ ID NO: 4034852 - RNA, 18 nt, Molluscum contagiosum virus
ccugucggcacaucucuc

SEQ ID NO: 4034853 - RNA, 17 nt, Molluscum contagiosum virus
ccugugaacgcaccgcc

SEQ ID NO: 4034854 - RNA, 14 nt, Molluscum contagiosum virus
ccugugcccugucc

SEQ ID NO: 4034855 - RNA, 23 nt, Molluscum contagiosum virus
ccugugcgccaacaaccacucuu

SEQ ID NO: 4034856 - RNA, 16 nt, Molluscum contagiosum virus
ccuguguugcgcgcgc

SEQ ID NO: 4034857 - RNA, 21 nt, Molluscum contagiosum virus
ccuguuaaauggacgugcucc

SEQ ID NO: 4034858 - RNA, 20 nt, Molluscum contagiosum virus
ccuucaggacgcaggacgcg

SEQ ID NO: 4034859 - RNA, 21 nt, Molluscum contagiosum virus
ccuucgacguugacgagcgcg

SEQ ID NO: 4034860 - RNA, 14 nt, Molluscum contagiosum virus
ccuucgcgcgcgcg

SEQ ID NO: 4034861 - RNA, 21 nt, Molluscum contagiosum virus
ccuucgguuucuaugcccagc

SEQ ID NO: 4034862 - RNA, 16 nt, Molluscum contagiosum virus
ccuucugcaagcugcc

SEQ ID NO: 4034863 - RNA, 14 nt, Molluscum contagiosum virus
ccuucugccugccc

SEQ ID NO: 4034864 - RNA, 14 nt, Molluscum contagiosum virus
ccuucuugcuggcg

SEQ ID NO: 4034865 - RNA, 14 nt, Molluscum contagiosum virus
ccuugaagggcaca

SEQ ID NO: 4034866 - RNA, 14 nt, Molluscum contagiosum virus
ccuugagcgcgccg

SEQ ID NO: 4034867 - RNA, 18 nt, Molluscum contagiosum virus
ccuugauaaaagcacagu

SEQ ID NO: 4034868 - RNA, 15 nt, Molluscum contagiosum virus
ccuugcacucgcgcu

SEQ ID NO: 4034869 - RNA, 18 nt, Molluscum contagiosum virus
ccuugcuacaggacgucc

SEQ ID NO: 4034870 - RNA, 18 nt, Molluscum contagiosum virus
ccuugcucgcuugccgcu

SEQ ID NO: 4034871 - RNA, 14 nt, Molluscum contagiosum virus
ccuuggacacgugc

SEQ ID NO: 4034872 - RNA, 13 nt, Molluscum contagiosum virus
ccuuggcgcgccg

SEQ ID NO: 4034873 - RNA, 12 nt, Molluscum contagiosum virus
ccuuguccuggc

SEQ ID NO: 4034874 - RNA, 20 nt, Molluscum contagiosum virus
ccuuguucaccauccagccg

SEQ ID NO: 4034875 - RNA, 14 nt, Molluscum contagiosum virus
ccuuuacugcaaga

SEQ ID NO: 4034876 - RNA, 19 nt, Molluscum contagiosum virus
ccuuugcgcugucucuccg

SEQ ID NO: 4034877 - RNA, 23 nt, Molluscum contagiosum virus
ccuuugcggcgagcgcuaucucu

SEQ ID NO: 4034878 - RNA, 22 nt, Molluscum contagiosum virus
cgaaagaggaaagcgcacacuu

SEQ ID NO: 4034879 - RNA, 21 nt, Molluscum contagiosum virus
cgaaaggcacccgcaggaaag

SEQ ID NO: 4034880 - RNA, 16 nt, Molluscum contagiosum virus
cgaacaccgacaagga

SEQ ID NO: 4034881 - RNA, 23 nt, Molluscum contagiosum virus
cgaacgacgguaaacucuugcac

SEQ ID NO: 4034882 - RNA, 18 nt, Molluscum contagiosum virus
cgaacucgugcgccgcgc

SEQ ID NO: 4034883 - RNA, 20 nt, Molluscum contagiosum virus
cgaacucucaucgagcaccu

SEQ ID NO: 4034884 - RNA, 23 nt, Molluscum contagiosum virus
cgaagaccaccagcaccagcaca

SEQ ID NO: 4034885 - RNA, 19 nt, Molluscum contagiosum virus
cgaagacgcguaccagcgc

SEQ ID NO: 4034886 - RNA, 13 nt, Molluscum contagiosum virus
cgaagaggucucu

SEQ ID NO: 4034887 - RNA, 13 nt, Molluscum contagiosum virus
cgaagcaaaagcg

SEQ ID NO: 4034888 - RNA, 19 nt, Molluscum contagiosum virus
cagugcggccagcaccgcg

SEQ ID NO: 4034889 - RNA, 16 nt, Molluscum contagiosum virus
cagugcgugcacuguc

SEQ ID NO: 4034890 - RNA, 15 nt, Molluscum contagiosum virus
cagugcuugagcauc

SEQ ID NO: 4034891 - RNA, 20 nt, Molluscum contagiosum virus
cagugugccguucacgcaca

SEQ ID NO: 4034892 - RNA, 17 nt, Molluscum contagiosum virus
caguguuucgacgccgg

SEQ ID NO: 4034893 - RNA, 14 nt, Molluscum contagiosum virus
caguucgagcugcu

SEQ ID NO: 4034894 - RNA, 22 nt, Molluscum contagiosum virus
ccuaccggcagcaugcucacgu

SEQ ID NO: 4034895 - RNA, 17 nt, Molluscum contagiosum virus
ccuagcguuucgcgaag

SEQ ID NO: 4034896 - RNA, 21 nt, Molluscum contagiosum virus
ccuaguucgagaagacggggc

SEQ ID NO: 4034897 - RNA, 21 nt, Molluscum contagiosum virus
ccuaucccggagcgcggggca

SEQ ID NO: 4034898 - RNA, 21 nt, Molluscum contagiosum virus
ccucaagaagacgcagagcga

SEQ ID NO: 4034899 - RNA, 18 nt, Molluscum contagiosum virus
ccucaccucugcgcggcc

SEQ ID NO: 4034900 - RNA, 16 nt, Molluscum contagiosum virus
ccucacggcgagcgcg

SEQ ID NO: 4034901 - RNA, 20 nt, Molluscum contagiosum virus
ccucacggcgagcgcgcccu

SEQ ID NO: 4034902 - RNA, 12 nt, Molluscum contagiosum virus
ccucacgugcug

SEQ ID NO: 4034903 - RNA, 20 nt, Molluscum contagiosum virus
ccucacucacaugugcugcc

SEQ ID NO: 4034904 - RNA, 17 nt, Molluscum contagiosum virus
ccucagccgagcgccgc

SEQ ID NO: 4034905 - RNA, 23 nt, Molluscum contagiosum virus
ccucauuguucggaggcugcucc

SEQ ID NO: 4034906 - RNA, 14 nt, Molluscum contagiosum virus
ccuccaagaagagg

SEQ ID NO: 4034907 - RNA, 23 nt, Molluscum contagiosum virus
acaucgacaagcacgucuuugac

SEQ ID NO: 4034908 - RNA, 13 nt, Molluscum contagiosum virus
acaugcagcugca

SEQ ID NO: 4034909 - RNA, 14 nt, Molluscum contagiosum virus
acaugcagcugcag

SEQ ID NO: 4034910 - RNA, 19 nt, Molluscum contagiosum virus
acaugcagcugcaggaccu

SEQ ID NO: 4034911 - RNA, 12 nt, Molluscum contagiosum virus
acaugccgcgcu

SEQ ID NO: 4034912 - RNA, 23 nt, Molluscum contagiosum virus
acaugcuagcgggcaagcgcuuc

SEQ ID NO: 4034913 - RNA, 23 nt, Molluscum contagiosum virus
acaugcucgacgugaucgcgcag

SEQ ID NO: 4034914 - RNA, 20 nt, Molluscum contagiosum virus
acaugcuucgcgcaaacaag

SEQ ID NO: 4034915 - RNA, 15 nt, Molluscum contagiosum virus
acauggaccgcguca

SEQ ID NO: 4034916 - RNA, 18 nt, Molluscum contagiosum virus
acaugucguaccuggugg

SEQ ID NO: 4034917 - RNA, 19 nt, Molluscum contagiosum virus
accaagguggggcgcaucc

SEQ ID NO: 4034918 - RNA, 15 nt, Molluscum contagiosum virus
accaccaccagcacg

SEQ ID NO: 4034919 - RNA, 16 nt, Molluscum contagiosum virus
accaccagcaccagca

SEQ ID NO: 4034920 - RNA, 14 nt, Molluscum contagiosum virus
accaccgcuggggc

SEQ ID NO: 4034921 - RNA, 14 nt, Molluscum contagiosum virus
accacgagcacugc

SEQ ID NO: 4034922 - RNA, 16 nt, Molluscum contagiosum virus
accacgagcacugccu

SEQ ID NO: 4034923 - RNA, 18 nt, Molluscum contagiosum virus
accacgagcacugccugc

SEQ ID NO: 4034924 - RNA, 13 nt, Molluscum contagiosum virus
accacgugccaga

SEQ ID NO: 4034925 - RNA, 15 nt, Molluscum contagiosum virus
accacguggaccuga

SEQ ID NO: 4034926 - RNA, 13 nt, Molluscum contagiosum virus
accagcagccagg

SEQ ID NO: 4034927 - RNA, 20 nt, Molluscum contagiosum virus
accagcggcaggcggccgcg

SEQ ID NO: 4034928 - RNA, 21 nt, Molluscum contagiosum virus
accagcuacgagccgcugcuc

SEQ ID NO: 4034929 - RNA, 23 nt, Molluscum contagiosum virus
accagcuccgccgggaauaccgg

SEQ ID NO: 4034930 - RNA, 15 nt, Molluscum contagiosum virus
accagcucgcgcagu

SEQ ID NO: 4034931 - RNA, 19 nt, Molluscum contagiosum virus
accagcucuucguggccaa

SEQ ID NO: 4034932 - RNA, 18 nt, Molluscum contagiosum virus
accaggcgcgugcccugc

SEQ ID NO: 4034933 - RNA, 15 nt, Molluscum contagiosum virus
accagguacuccuug

SEQ ID NO: 4034934 - RNA, 14 nt, Molluscum contagiosum virus
accagguagagcaa

SEQ ID NO: 4034935 - RNA, 14 nt, Molluscum contagiosum virus
accaguaccugcug

SEQ ID NO: 4034936 - RNA, 23 nt, Molluscum contagiosum virus
accauccagccgucgccgcgccc

SEQ ID NO: 4034937 - RNA, 13 nt, Molluscum contagiosum virus
acccagcaaggcc

SEQ ID NO: 4034938 - RNA, 18 nt, Molluscum contagiosum virus
acccaucggagaagugcu

SEQ ID NO: 4034939 - RNA, 21 nt, Molluscum contagiosum virus
acccaucggagaagugcuccg

SEQ ID NO: 4034940 - RNA, 14 nt, Molluscum contagiosum virus
accccgaaaggcac

SEQ ID NO: 4034941 - RNA, 18 nt, Molluscum contagiosum virus
accccgaaggaaaggccc

SEQ ID NO: 4034942 - RNA, 21 nt, Molluscum contagiosum virus
accccgaaggaaaggcccccc

SEQ ID NO: 4034943 - RNA, 14 nt, Molluscum contagiosum virus
accccgagcugcgg

SEQ ID NO: 4034944 - RNA, 21 nt, Molluscum contagiosum virus
accccgagcugcggcgcgugc

SEQ ID NO: 4034945 - RNA, 18 nt, Molluscum contagiosum virus
accccgcaggaaaggcac

SEQ ID NO: 4034946 - RNA, 13 nt, Molluscum contagiosum virus
accccgccgcgua

SEQ ID NO: 4034947 - RNA, 14 nt, Molluscum contagiosum virus
accccgcugggccg

SEQ ID NO: 4034948 - RNA, 20 nt, Molluscum contagiosum virus
accccuugcuacaggacguc

SEQ ID NO: 4034949 - RNA, 21 nt, Molluscum contagiosum virus
acccgcaggaaaggcaccccg

SEQ ID NO: 4034950 - RNA, 13 nt, Molluscum contagiosum virus
acccggcacgugc

SEQ ID NO: 4034951 - RNA, 16 nt, Molluscum contagiosum virus
acccggcucgcucauc

SEQ ID NO: 4034952 - RNA, 18 nt, Molluscum contagiosum virus
acccgugcgcgcgcugag

SEQ ID NO: 4034953 - RNA, 23 nt, Molluscum contagiosum virus
acccucgcaagcugagcgcgcug

SEQ ID NO: 4034954 - RNA, 13 nt, Molluscum contagiosum virus
acccucuucgacu

SEQ ID NO: 4034955 - RNA, 12 nt, Molluscum contagiosum virus
acccugauaugc

SEQ ID NO: 4034956 - RNA, 16 nt, Molluscum contagiosum virus
cagcccugugcccgag

SEQ ID NO: 4034957 - RNA, 13 nt, Molluscum contagiosum virus
cagccgagccggg

SEQ ID NO: 4034958 - RNA, 20 nt, Molluscum contagiosum virus
cagccgagcgccgccagcuc

SEQ ID NO: 4034959 - RNA, 18 nt, Molluscum contagiosum virus
cagccgcagaugcgcagc

SEQ ID NO: 4034960 - RNA, 13 nt, Molluscum contagiosum virus
cagccgcgcggca

SEQ ID NO: 4034961 - RNA, 19 nt, Molluscum contagiosum virus
cagccgcguagcuagcucu

SEQ ID NO: 4034962 - RNA, 19 nt, Molluscum contagiosum virus
cagccgcugcgccgccagc

SEQ ID NO: 4034963 - RNA, 14 nt, Molluscum contagiosum virus
cagccgcuggacgc

SEQ ID NO: 4034964 - RNA, 23 nt, Molluscum contagiosum virus
aaggcauccucgccgaacggcag

SEQ ID NO: 4034965 - RNA, 17 nt, Molluscum contagiosum virus
aaggccaaagccgcgga

SEQ ID NO: 4034966 - RNA, 16 nt, Molluscum contagiosum virus
aagguacccgcaggaa

SEQ ID NO: 4034967 - RNA, 13 nt, Molluscum contagiosum virus
aaguccaccuucu

SEQ ID NO: 4034968 - RNA, 21 nt, Molluscum contagiosum virus
aagugcacaccagacaaaguc

SEQ ID NO: 4034969 - RNA, 18 nt, Molluscum contagiosum virus
aagugcuccgcacgugga

SEQ ID NO: 4034970 - RNA, 11 nt, Molluscum contagiosum virus
aaguuccugca

SEQ ID NO: 4034971 - RNA, 18 nt, Molluscum contagiosum virus
aaucucgccggcuguaaa

SEQ ID NO: 4034972 - RNA, 21 nt, Molluscum contagiosum virus
aaugacgcgcacgccagccug

SEQ ID NO: 4034973 - RNA, 20 nt, Molluscum contagiosum virus
aaugagcacuugccgcgccu

SEQ ID NO: 4034974 - RNA, 14 nt, Molluscum contagiosum virus
aaugcgcacacuug

SEQ ID NO: 4034975 - RNA, 23 nt, Molluscum contagiosum virus
aaugugcuggucaagaacaugug

SEQ ID NO: 4034976 - RNA, 20 nt, Molluscum contagiosum virus
aauguguacgacgcgcccac

SEQ ID NO: 4034977 - RNA, 15 nt, Molluscum contagiosum virus
acaaccacagcucuc

SEQ ID NO: 4034978 - RNA, 24 nt, Molluscum contagiosum virus
acaaccacucuuucacgcugcacg

SEQ ID NO: 4034979 - RNA, 23 nt, Molluscum contagiosum virus
acaacguaguacugcagcagcuc

SEQ ID NO: 4034980 - RNA, 15 nt, Molluscum contagiosum virus
acaagaagcgcuucu

SEQ ID NO: 4034981 - RNA, 18 nt, Molluscum contagiosum virus
acaagcuagacuggagca

SEQ ID NO: 4034982 - RNA, 16 nt, Molluscum contagiosum virus
acaagcugcuggcaca

SEQ ID NO: 4034983 - RNA, 17 nt, Molluscum contagiosum virus
acaaggaaaggcaccca

SEQ ID NO: 4034984 - RNA, 16 nt, Molluscum contagiosum virus
acaaggaaaggcaccu

SEQ ID NO: 4034985 - RNA, 18 nt, Molluscum contagiosum virus
acaaggacggagaguugu

SEQ ID NO: 4034986 - RNA, 19 nt, Molluscum contagiosum virus
acaaggagggagagcugcc

SEQ ID NO: 4034987 - RNA, 22 nt, Molluscum contagiosum virus
acaagggcagcucaagcugcuc

SEQ ID NO: 4034988 - RNA, 18 nt, Molluscum contagiosum virus
acaaucucugcgccgcgc

SEQ ID NO: 4034989 - RNA, 14 nt, Molluscum contagiosum virus
acacauuccucggc

SEQ ID NO: 4034990 - RNA, 12 nt, Molluscum contagiosum virus
acaccagcugga

SEQ ID NO: 4034991 - RNA, 20 nt, Molluscum contagiosum virus
acaccauccugcgcuuugcc

SEQ ID NO: 4034992 - RNA, 22 nt, Molluscum contagiosum virus
acacgcugaguuacguggccgc

SEQ ID NO: 4034993 - RNA, 21 nt, Molluscum contagiosum virus
acacguuggaggacguggaca

SEQ ID NO: 4034994 - RNA, 17 nt, Molluscum contagiosum virus
acacugucucugcgcga

SEQ ID NO: 4034995 - RNA, 21 nt, Molluscum contagiosum virus
acacuugcgcguucgcaaaga

SEQ ID NO: 4034996 - RNA, 16 nt, Molluscum contagiosum virus
acacuuuccgucgucg

SEQ ID NO: 4034997 - RNA, 19 nt, Molluscum contagiosum virus
acagacauggcccgcgcgg

SEQ ID NO: 4034998 - RNA, 21 nt, Molluscum contagiosum virus
acagacggcgcgcucggagac

SEQ ID NO: 4034999 - RNA, 16 nt, Molluscum contagiosum virus
acagagugccuggcgc

SEQ ID NO: 4035000 - RNA, 14 nt, Molluscum contagiosum virus
acagcagccgcagc

SEQ ID NO: 4035001 - RNA, 18 nt, Molluscum contagiosum virus
acagcauccccaacaucc

SEQ ID NO: 4035002 - RNA, 11 nt, Molluscum contagiosum virus
acagcaucccu

SEQ ID NO: 4035003 - RNA, 21 nt, Molluscum contagiosum virus
acagccccugcugcucgcgga

SEQ ID NO: 4035004 - RNA, 16 nt, Molluscum contagiosum virus
acagccgccugccgcg

SEQ ID NO: 4035005 - RNA, 18 nt, Molluscum contagiosum virus
acagccgccugccgcgcu

SEQ ID NO: 4035006 - RNA, 12 nt, Molluscum contagiosum virus
acagccgcgcgg

SEQ ID NO: 4035007 - RNA, 18 nt, Molluscum contagiosum virus
acagccuguguugcgcgc

SEQ ID NO: 4035008 - RNA, 14 nt, Molluscum contagiosum virus
acagcgcgcgcacg

SEQ ID NO: 4035009 - RNA, 18 nt, Molluscum contagiosum virus
acagcgggcgcugcucgc

SEQ ID NO: 4035010 - RNA, 16 nt, Molluscum contagiosum virus
acagcgugcgcgggca

SEQ ID NO: 4035011 - RNA, 18 nt, Molluscum contagiosum virus
acagcgugcgcgggcacg

SEQ ID NO: 4035012 - RNA, 17 nt, Molluscum contagiosum virus
acagcuccccgcgcaag

SEQ ID NO: 4035013 - RNA, 22 nt, Molluscum contagiosum virus
acaggccgcuagcaggcgucgc

SEQ ID NO: 4035014 - RNA, 16 nt, Molluscum contagiosum virus
acaguaggacaugucc

SEQ ID NO: 4035015 - RNA, 15 nt, Molluscum contagiosum virus
acauccggcacgugc

SEQ ID NO: 4035016 - RNA, 22 nt, Molluscum contagiosum virus
aaaaacgcgcccccguccgugc

SEQ ID NO: 4035017 - RNA, 19 nt, Molluscum contagiosum virus
aaaaaucccccgccaggaa

SEQ ID NO: 4035018 - RNA, 14 nt, Molluscum contagiosum virus
aaaaggcacacccc

SEQ ID NO: 4035019 - RNA, 18 nt, Molluscum contagiosum virus
aaaccucugagcgagcgc

SEQ ID NO: 4035020 - RNA, 22 nt, Molluscum contagiosum virus
aaacgcacagccccugcugcuc

SEQ ID NO: 4035021 - RNA, 19 nt, Molluscum contagiosum virus
aaacgcugacggcgcugcg

SEQ ID NO: 4035022 - RNA, 18 nt, Molluscum contagiosum virus
aaacgcuggcgagcaaga

SEQ ID NO: 4035023 - RNA, 19 nt, Molluscum contagiosum virus
aaagaagcggugcagcgcc

SEQ ID NO: 4035024 - RNA, 20 nt, Molluscum contagiosum virus
aaagacggacccgcgaacga

SEQ ID NO: 4035025 - RNA, 14 nt, Molluscum contagiosum virus
aaagagcugcugcg

SEQ ID NO: 4035026 - RNA, 21 nt, Molluscum contagiosum virus
aaagcacagcaggagcacgcc

SEQ ID NO: 4035027 - RNA, 20 nt, Molluscum contagiosum virus
aaagccggccccgcgaacga

SEQ ID NO: 4035028 - RNA, 20 nt, Molluscum contagiosum virus
aaagcgaaguuugccagcgu

SEQ ID NO: 4035029 - RNA, 18 nt, Molluscum contagiosum virus
aaagcuaugcgcagcugc

SEQ ID NO: 4035030 - RNA, 20 nt, Molluscum contagiosum virus
aaagcuggccgaggucuucc

SEQ ID NO: 4035031 - RNA, 15 nt, Molluscum contagiosum virus
aaaguacgagagcgc

SEQ ID NO: 4035032 - RNA, 21 nt, Molluscum contagiosum virus
aaauagccaugcuggucacgc

SEQ ID NO: 4035033 - RNA, 18 nt, Molluscum contagiosum virus
aaauccugguuccucucc

SEQ ID NO: 4035034 - RNA, 13 nt, Molluscum contagiosum virus
aaaucgcaaagca

SEQ ID NO: 4035035 - RNA, 22 nt, Molluscum contagiosum virus
aaauggccuugcgagcgcugcc

SEQ ID NO: 4035036 - RNA, 19 nt, Molluscum contagiosum virus
aaauggcugcgaccaagac

SEQ ID NO: 4035037 - RNA, 23 nt, Molluscum contagiosum virus
aacaacuugggagcaaggccugg

SEQ ID NO: 4035038 - RNA, 23 nt, Molluscum contagiosum virus
aacacagugcguuugccagaagc

SEQ ID NO: 4035039 - RNA, 14 nt, Molluscum contagiosum virus
aacaccuccugcuu

SEQ ID NO: 4035040 - RNA, 17 nt, Molluscum contagiosum virus
aacacugucucugcgcg

SEQ ID NO: 4035041 - RNA, 12 nt, Molluscum contagiosum virus
aacagcagcugg

SEQ ID NO: 4035042 - RNA, 22 nt, Molluscum contagiosum virus
aacagcuuggcacagugcugga

SEQ ID NO: 4035043 - RNA, 22 nt, Molluscum contagiosum virus
aacauccugccacaccagcugg

SEQ ID NO: 4035044 - RNA, 15 nt, Molluscum contagiosum virus
aacauugccacgcaa

SEQ ID NO: 4035045 - RNA, 19 nt, Molluscum contagiosum virus
aacccguggccgagccgcu

SEQ ID NO: 4035046 - RNA, 18 nt, Molluscum contagiosum virus
cagugcucgcacacgugc

SEQ ID NO: 4035047 - RNA, 16 nt, Molluscum contagiosum virus
cagugugugaucacgu

SEQ ID NO: 4035048 - RNA, 18 nt, Molluscum contagiosum virus
caguuccaccucgagcuc

SEQ ID NO: 4035049 - RNA, 17 nt, Molluscum contagiosum virus
caguucgagcugcugcg

SEQ ID NO: 4035050 - RNA, 18 nt, Molluscum contagiosum virus
caguucgagcugcugcgc

SEQ ID NO: 4035051 - RNA, 15 nt, Molluscum contagiosum virus
caguucggccgcacg

SEQ ID NO: 4035052 - RNA, 14 nt, Molluscum contagiosum virus
caguugagagcagc

SEQ ID NO: 4035053 - RNA, 13 nt, Molluscum contagiosum virus
cauacgcagaggc

SEQ ID NO: 4035054 - RNA, 15 nt, Molluscum contagiosum virus
cauagcgccacgagc

SEQ ID NO: 4035055 - RNA, 18 nt, Molluscum contagiosum virus
cauaguacgauggaugcu

SEQ ID NO: 4035056 - RNA, 16 nt, Molluscum contagiosum virus
caucaccccgcugggc

SEQ ID NO: 4035057 - RNA, 16 nt, Molluscum contagiosum virus
caucagcaacaagcuc

SEQ ID NO: 4035058 - RNA, 16 nt, Molluscum contagiosum virus
caucaucgagcugcag

SEQ ID NO: 4035059 - RNA, 17 nt, Molluscum contagiosum virus
caucaucgcggagcugc

SEQ ID NO: 4035060 - RNA, 20 nt, Molluscum contagiosum virus
cauccucaccuuccugggcg

SEQ ID NO: 4035061 - RNA, 19 nt, Molluscum contagiosum virus
cauccugccacaccagcug

SEQ ID NO: 4035062 - RNA, 20 nt, Molluscum contagiosum virus
caucgagaugcucaagcacu

SEQ ID NO: 4035063 - RNA, 15 nt, Molluscum contagiosum virus
caucgagcugcagag

SEQ ID NO: 4035064 - RNA, 12 nt, Molluscum contagiosum virus
caucgcgcugcu

SEQ ID NO: 4035065 - RNA, 14 nt, Molluscum contagiosum virus
caucgcgcugcucu

SEQ ID NO: 4035066 - RNA, 17 nt, Molluscum contagiosum virus
caucgcggagcugcgcg

SEQ ID NO: 4035067 - RNA, 16 nt, Molluscum contagiosum virus
caucggcgccgccccg

SEQ ID NO: 4035068 - RNA, 16 nt, Molluscum contagiosum virus
caucggcggcagcgcc

SEQ ID NO: 4035069 - RNA, 16 nt, Molluscum contagiosum virus
caucuacugcgacauc

SEQ ID NO: 4035070 - RNA, 18 nt, Molluscum contagiosum virus
caucuagccuccuugucu

SEQ ID NO: 4035071 - RNA, 18 nt, Molluscum contagiosum virus
caucucgcacacugcagc

SEQ ID NO: 4035072 - RNA, 22 nt, Molluscum contagiosum virus
caucugccucguggaacaaaga

SEQ ID NO: 4035073 - RNA, 20 nt, Molluscum contagiosum virus
caucuucaagccgcaggcgc

SEQ ID NO: 4035074 - RNA, 18 nt, Molluscum contagiosum virus
caugaagaugucgccgcg

SEQ ID NO: 4035075 - RNA, 22 nt, Molluscum contagiosum virus
caugacugcggacgggaagcuu

SEQ ID NO: 4035076 - RNA, 13 nt, Molluscum contagiosum virus
caugaggcagugc

SEQ ID NO: 4035077 - RNA, 17 nt, Molluscum contagiosum virus
caugaguuucuggugcc

SEQ ID NO: 4035078 - RNA, 19 nt, Molluscum contagiosum virus
caugcacagccgcuuucug

SEQ ID NO: 4035079 - RNA, 16 nt, Molluscum contagiosum virus
caugcacagcugcucg

SEQ ID NO: 4035080 - RNA, 19 nt, Molluscum contagiosum virus
caugcccggccucgccucc

SEQ ID NO: 4035081 - RNA, 16 nt, Molluscum contagiosum virus
caugccgcgcugcucc

SEQ ID NO: 4035082 - RNA, 23 nt, Molluscum contagiosum virus
caugccggggaugaacgcgcugc

SEQ ID NO: 4035083 - RNA, 22 nt, Molluscum contagiosum virus
caugccuccguuucccgcggcg

SEQ ID NO: 4035084 - RNA, 18 nt, Molluscum contagiosum virus
caugcgcaagcagcucgg

SEQ ID NO: 4035085 - RNA, 19 nt, Molluscum contagiosum virus
caugcgcaagcagcucggc

SEQ ID NO: 4035086 - RNA, 15 nt, Molluscum contagiosum virus
caugcgcagugccuu

SEQ ID NO: 4035087 - RNA, 20 nt, Molluscum contagiosum virus
caugcgcgcagugccgcuga

SEQ ID NO: 4035088 - RNA, 14 nt, Molluscum contagiosum virus
caugcgcgccgcgc

SEQ ID NO: 4035089 - RNA, 17 nt, Molluscum contagiosum virus
caugcgcgccgcgcugc

SEQ ID NO: 4035090 - RNA, 18 nt, Molluscum contagiosum virus
caugcgcgccgcgcugcu

SEQ ID NO: 4035091 - RNA, 19 nt, Molluscum contagiosum virus
caugcgcgccgcgcugcug

SEQ ID NO: 4035092 - RNA, 14 nt, Molluscum contagiosum virus
caugcgcgcgcugc

SEQ ID NO: 4035093 - RNA, 18 nt, Molluscum contagiosum virus
caugcgcuugcggucgcg

SEQ ID NO: 4035094 - RNA, 13 nt, Molluscum contagiosum virus
caugcggagcugg

SEQ ID NO: 4035095 - RNA, 16 nt, Molluscum contagiosum virus
caugcggagcuggccg

SEQ ID NO: 4035096 - RNA, 17 nt, Molluscum contagiosum virus
caugcggcaggcgcugc

SEQ ID NO: 4035097 - RNA, 20 nt, Molluscum contagiosum virus
caugcggcaggcgcugcgcg

SEQ ID NO: 4035098 - RNA, 14 nt, Molluscum contagiosum virus
caugcgugcuucac

SEQ ID NO: 4035099 - RNA, 20 nt, Molluscum contagiosum virus
caugcucaagcaccugcgcu

SEQ ID NO: 4035100 - RNA, 17 nt, Molluscum contagiosum virus
caugcugcccgcgcgcg

SEQ ID NO: 4035101 - RNA, 17 nt, Molluscum contagiosum virus
caugcugcgcgagcgcg

SEQ ID NO: 4035102 - RNA, 21 nt, Molluscum contagiosum virus
caugcugcgcgagcgcgcgcu

SEQ ID NO: 4035103 - RNA, 16 nt, Molluscum contagiosum virus
cauggaaagcuucucg

SEQ ID NO: 4035104 - RNA, 15 nt, Molluscum contagiosum virus
cauggacgugcugcu

SEQ ID NO: 4035105 - RNA, 23 nt, Molluscum contagiosum virus
cauggagagcguacucgggccgc

SEQ ID NO: 4035106 - RNA, 20 nt, Molluscum contagiosum virus
cauggagcgcccgcugcucu

SEQ ID NO: 4035107 - RNA, 20 nt, Molluscum contagiosum virus
cauggccacgcccgggcccg

SEQ ID NO: 4035108 - RNA, 13 nt, Molluscum contagiosum virus
cauggccgcgucc

SEQ ID NO: 4035109 - RNA, 22 nt, Molluscum contagiosum virus
cauggccuguaguagcagcuuc

SEQ ID NO: 4035110 - RNA, 20 nt, Molluscum contagiosum virus
cauggucgcauccgaccucu

SEQ ID NO: 4035111 - RNA, 15 nt, Molluscum contagiosum virus
caugucacgcucacg

SEQ ID NO: 4035112 - RNA, 13 nt, Molluscum contagiosum virus
cauguccggcccg

SEQ ID NO: 4035113 - RNA, 21 nt, Molluscum contagiosum virus
caugucgagaccuuccuccag

SEQ ID NO: 4035114 - RNA, 23 nt, Molluscum contagiosum virus
caugugcgagaacuggcgcagca

SEQ ID NO: 4035115 - RNA, 14 nt, Molluscum contagiosum virus
cauguuuccugcgg

SEQ ID NO: 4035116 - RNA, 19 nt, Molluscum contagiosum virus
cauguuuguucgcgcgccg

SEQ ID NO: 4035117 - RNA, 19 nt, Molluscum contagiosum virus
cauugcgaggcaccgcccg

SEQ ID NO: 4035118 - RNA, 20 nt, Molluscum contagiosum virus
cauuucacaaguggucuuug

SEQ ID NO: 4035119 - RNA, 18 nt, Molluscum contagiosum virus
cauuuucucuggagagcg

SEQ ID NO: 4035120 - RNA, 18 nt, Molluscum contagiosum virus
ccaacacguuuucuuuca

SEQ ID NO: 4035121 - RNA, 18 nt, Molluscum contagiosum virus
ccaacacuaccacagcca

SEQ ID NO: 4035122 - RNA, 14 nt, Molluscum contagiosum virus
ccaacagcagcugg

SEQ ID NO: 4035123 - RNA, 16 nt, Molluscum contagiosum virus
ccaacagcagcuggcg

SEQ ID NO: 4035124 - RNA, 23 nt, Molluscum contagiosum virus
ccaacagcagcuggcgcgcgccg

SEQ ID NO: 4035125 - RNA, 22 nt, Molluscum contagiosum virus
ccaacccucgcaagcugagcgc

SEQ ID NO: 4035126 - RNA, 16 nt, Molluscum contagiosum virus
ccaaccuccugcaccu

SEQ ID NO: 4035127 - RNA, 15 nt, Molluscum contagiosum virus
ccaacgauggcgugg

SEQ ID NO: 4035128 - RNA, 16 nt, Molluscum contagiosum virus
ccaacgcccgcgcccg

SEQ ID NO: 4035129 - RNA, 20 nt, Molluscum contagiosum virus
ccaacuagacaaggggccau

SEQ ID NO: 4035130 - RNA, 17 nt, Molluscum contagiosum virus
ccaagaagaggccagca

SEQ ID NO: 4035131 - RNA, 12 nt, Molluscum contagiosum virus
ccaagaccuggg

SEQ ID NO: 4035132 - RNA, 19 nt, Molluscum contagiosum virus
ccaagaggccgucacaugc

SEQ ID NO: 4035133 - RNA, 13 nt, Molluscum contagiosum virus
ccaagcacgcgcg

SEQ ID NO: 4035134 - RNA, 13 nt, Molluscum contagiosum virus
ccaagccugcuca

SEQ ID NO: 4035135 - RNA, 15 nt, Molluscum contagiosum virus
ccaaggacgacaaca

SEQ ID NO: 4035136 - RNA, 20 nt, Molluscum contagiosum virus
ccaaggacuucgagaccuac

SEQ ID NO: 4035137 - RNA, 20 nt, Molluscum contagiosum virus
ccaaggccgcgggcgcggag

SEQ ID NO: 4035138 - RNA, 19 nt, Molluscum contagiosum virus
ccaaggugaacgaccucaa

SEQ ID NO: 4035139 - RNA, 13 nt, Molluscum contagiosum virus
ccaagugcgcgug

SEQ ID NO: 4035140 - RNA, 21 nt, Molluscum contagiosum virus
ccaaucccaguaguggcggca

SEQ ID NO: 4035141 - RNA, 15 nt, Molluscum contagiosum virus
ccacaaagacgggcc

SEQ ID NO: 4035142 - RNA, 17 nt, Molluscum contagiosum virus
ccaccacguggaccuga

SEQ ID NO: 4035143 - RNA, 18 nt, Molluscum contagiosum virus
ccaccagcagccaggcua

SEQ ID NO: 4035144 - RNA, 14 nt, Molluscum contagiosum virus
ccaccgcggcgcgg

SEQ ID NO: 4035145 - RNA, 19 nt, Molluscum contagiosum virus
ccaccgucuccccccuguc

SEQ ID NO: 4035146 - RNA, 15 nt, Molluscum contagiosum virus
ccaccuucaggacgc

SEQ ID NO: 4035147 - RNA, 19 nt, Molluscum contagiosum virus
ccacgaacgacagcgccgc

SEQ ID NO: 4035148 - RNA, 16 nt, Molluscum contagiosum virus
ccacgaccgcaagugc

SEQ ID NO: 4035149 - RNA, 13 nt, Molluscum contagiosum virus
ccgcgccgcgccg

SEQ ID NO: 4035150 - RNA, 16 nt, Molluscum contagiosum virus
ccgcgccuugagcgcg

SEQ ID NO: 4035151 - RNA, 15 nt, Molluscum contagiosum virus
ccgcgcgagcgcgcc

SEQ ID NO: 4035152 - RNA, 13 nt, Molluscum contagiosum virus
ccgcgcgcacgcg

SEQ ID NO: 4035153 - RNA, 12 nt, Molluscum contagiosum virus
ccgcgcgcgcca

SEQ ID NO: 4035154 - RNA, 13 nt, Molluscum contagiosum virus
ccgcgcgcgccag

SEQ ID NO: 4035155 - RNA, 20 nt, Molluscum contagiosum virus
ccgcgcgcggugcugcgcca

SEQ ID NO: 4035156 - RNA, 20 nt, Molluscum contagiosum virus
ccgcgcgcugcucuggagca

SEQ ID NO: 4035157 - RNA, 18 nt, Molluscum contagiosum virus
ccgcgcggcgcucugcca

SEQ ID NO: 4035158 - RNA, 12 nt, Molluscum contagiosum virus
ccgcgcguugcu

SEQ ID NO: 4035159 - RNA, 14 nt, Molluscum contagiosum virus
ccgcgcucgccgca

SEQ ID NO: 4035160 - RNA, 17 nt, Molluscum contagiosum virus
ccgcgcucgugccgccu

SEQ ID NO: 4035161 - RNA, 15 nt, Molluscum contagiosum virus
ccgcgcugcuccgug

SEQ ID NO: 4035162 - RNA, 21 nt, Molluscum contagiosum virus
ccgcgcuggcgcgcgcgcugc

SEQ ID NO: 4035163 - RNA, 12 nt, Molluscum contagiosum virus
ccgcgcuucugc

SEQ ID NO: 4035164 - RNA, 15 nt, Molluscum contagiosum virus
ccgcgcuuugcgcgg

SEQ ID NO: 4035165 - RNA, 14 nt, Molluscum contagiosum virus
ccgcggagcugugc

SEQ ID NO: 4035166 - RNA, 16 nt, Molluscum contagiosum virus
ccgcggagcugugcca

SEQ ID NO: 4035167 - RNA, 15 nt, Molluscum contagiosum virus
ccgcggccugggcca

SEQ ID NO: 4035168 - RNA, 16 nt, Molluscum contagiosum virus
ccgcggcgcccacggc

SEQ ID NO: 4035169 - RNA, 17 nt, Molluscum contagiosum virus
ccgcggcgcgcagcucg

SEQ ID NO: 4035170 - RNA, 13 nt, Molluscum contagiosum virus
ccgcggcgcgccg

SEQ ID NO: 4035171 - RNA, 14 nt, Molluscum contagiosum virus
ccgcggcgugcccg

SEQ ID NO: 4035172 - RNA, 22 nt, Molluscum contagiosum virus
ccgcgggcacauggacggcgcc

SEQ ID NO: 4035173 - RNA, 22 nt, Molluscum contagiosum virus
ccgcgggcagccgcuggacgcc

SEQ ID NO: 4035174 - RNA, 16 nt, Molluscum contagiosum virus
ccgcgggccgccgccc

SEQ ID NO: 4035175 - RNA, 19 nt, Molluscum contagiosum virus
ccgcgggcgcacgcuuguc

SEQ ID NO: 4035176 - RNA, 17 nt, Molluscum contagiosum virus
ccgcgggcgcagagccu

SEQ ID NO: 4035177 - RNA, 14 nt, Molluscum contagiosum virus
ccgcggggcuccuc

SEQ ID NO: 4035178 - RNA, 23 nt, Molluscum contagiosum virus
ccgcguagcuagcucugcgcgcg

SEQ ID NO: 4035179 - RNA, 15 nt, Molluscum contagiosum virus
ccgcgucgcgcgccg

SEQ ID NO: 4035180 - RNA, 20 nt, Molluscum contagiosum virus
ccgcgugcacccuccgcaca

SEQ ID NO: 4035181 - RNA, 18 nt, Molluscum contagiosum virus
ccgcgugcaugcccagca

SEQ ID NO: 4035182 - RNA, 13 nt, Molluscum contagiosum virus
ccgcgugcucgug

SEQ ID NO: 4035183 - RNA, 14 nt, Molluscum contagiosum virus
ccgcgugcucgugu

SEQ ID NO: 4035184 - RNA, 13 nt, Molluscum contagiosum virus
ccgcgugcucugc

SEQ ID NO: 4035185 - RNA, 21 nt, Molluscum contagiosum virus
ccgcguggcaagggcuccuuc

SEQ ID NO: 4035186 - RNA, 20 nt, Molluscum contagiosum virus
ccgcuaccgcagccacggcc

SEQ ID NO: 4035187 - RNA, 20 nt, Molluscum contagiosum virus
ccgcugcgcuucgagcugcc

SEQ ID NO: 4035188 - RNA, 18 nt, Molluscum contagiosum virus
ccgcugcuccugcucugu

SEQ ID NO: 4035189 - RNA, 18 nt, Molluscum contagiosum virus
ccgcuggcggcgcacgcg

SEQ ID NO: 4035190 - RNA, 17 nt, Molluscum contagiosum virus
ccgcuguacgugcugcc

SEQ ID NO: 4035191 - RNA, 19 nt, Molluscum contagiosum virus
ccgcuguacgugcugcccg

SEQ ID NO: 4035192 - RNA, 20 nt, Molluscum contagiosum virus
ccgcuuucgcaaacaagcau

SEQ ID NO: 4035193 - RNA, 20 nt, Molluscum contagiosum virus
ccggacgauaaauggaccuc

SEQ ID NO: 4035194 - RNA, 14 nt, Molluscum contagiosum virus
ccggacguccaucc

SEQ ID NO: 4035195 - RNA, 18 nt, Molluscum contagiosum virus
ccggagacaccagcuccg

SEQ ID NO: 4035196 - RNA, 14 nt, Molluscum contagiosum virus
ccggaucagccccg

SEQ ID NO: 4035197 - RNA, 20 nt, Molluscum contagiosum virus
ccggcaccacgugcgcuggc

SEQ ID NO: 4035198 - RNA, 18 nt, Molluscum contagiosum virus
ccggcacccgugcgcgcg

SEQ ID NO: 4035199 - RNA, 14 nt, Molluscum contagiosum virus
ccggcacgugcccg

SEQ ID NO: 4035200 - RNA, 16 nt, Molluscum contagiosum virus
ccggcagcgacuacgc

SEQ ID NO: 4035201 - RNA, 14 nt, Molluscum contagiosum virus
ccggcagcgccgcg

SEQ ID NO: 4035202 - RNA, 19 nt, Molluscum contagiosum virus
ccggcagcgccgcgcgcgc

SEQ ID NO: 4035203 - RNA, 16 nt, Molluscum contagiosum virus
ccggcagcgcgccuag

SEQ ID NO: 4035204 - RNA, 18 nt, Molluscum contagiosum virus
ccggcagcuggagcugcc

SEQ ID NO: 4035205 - RNA, 21 nt, Molluscum contagiosum virus
ccggcagcuggagcugccgcu

SEQ ID NO: 4035206 - RNA, 18 nt, Molluscum contagiosum virus
ccggcaguagcagcgccg

SEQ ID NO: 4035207 - RNA, 15 nt, Molluscum contagiosum virus
ccggcagugcuugcu

SEQ ID NO: 4035208 - RNA, 16 nt, Molluscum contagiosum virus
ccggcaucgcgcugcu

SEQ ID NO: 4035209 - RNA, 23 nt, Molluscum contagiosum virus
ccggcaucgcgcugcuggugcuc

SEQ ID NO: 4035210 - RNA, 15 nt, Molluscum contagiosum virus
ccggccgugcagagc

SEQ ID NO: 4035211 - RNA, 17 nt, Molluscum contagiosum virus
ccggccucgccuccggg

SEQ ID NO: 4035212 - RNA, 23 nt, Molluscum contagiosum virus
ccggcgagaugcgagcgcgucug

SEQ ID NO: 4035213 - RNA, 20 nt, Molluscum contagiosum virus
ccggcgcaucagagaagugc

SEQ ID NO: 4035214 - RNA, 20 nt, Molluscum contagiosum virus
ccggcgcgcgcggcgcgccc

SEQ ID NO: 4035215 - RNA, 15 nt, Molluscum contagiosum virus
ccggcgcggccuggc

SEQ ID NO: 4035216 - RNA, 12 nt, Molluscum contagiosum virus
ccggcgcuugcg

SEQ ID NO: 4035217 - RNA, 20 nt, Molluscum contagiosum virus
ccggcggcaagcccggaagc

SEQ ID NO: 4035218 - RNA, 14 nt, Molluscum contagiosum virus
ccggcgggcgcgug

SEQ ID NO: 4035219 - RNA, 18 nt, Molluscum contagiosum virus
ccggcguguggcucuucu

SEQ ID NO: 4035220 - RNA, 13 nt, Molluscum contagiosum virus
ccggcugcccugu

SEQ ID NO: 4035221 - RNA, 12 nt, Molluscum contagiosum virus
ccggcugccgcu

SEQ ID NO: 4035222 - RNA, 18 nt, Molluscum contagiosum virus
ccggcugccgcugccugu

SEQ ID NO: 4035223 - RNA, 21 nt, Molluscum contagiosum virus
ccgggaaagcaaccacacgcg

SEQ ID NO: 4035224 - RNA, 22 nt, Molluscum contagiosum virus
ccgggaacgaggaaaggcaccc

SEQ ID NO: 4035225 - RNA, 22 nt, Molluscum contagiosum virus
ccgggcagauagcaaccucggg

SEQ ID NO: 4035226 - RNA, 15 nt, Molluscum contagiosum virus
ccgggcccgagcccg

SEQ ID NO: 4035227 - RNA, 21 nt, Molluscum contagiosum virus
ccgggcccggguuugugcccg

SEQ ID NO: 4035228 - RNA, 12 nt, Molluscum contagiosum virus
ccgggcgcacaa

SEQ ID NO: 4035229 - RNA, 18 nt, Molluscum contagiosum virus
ccgggcgccggcucugcc

SEQ ID NO: 4035230 - RNA, 17 nt, Molluscum contagiosum virus
ccgggcucuuccggccc

SEQ ID NO: 4035231 - RNA, 18 nt, Molluscum contagiosum virus
ccgggcucuuccggcccg

SEQ ID NO: 4035232 - RNA, 14 nt, Molluscum contagiosum virus
ccgguacugcugca

SEQ ID NO: 4035233 - RNA, 14 nt, Molluscum contagiosum virus
ccguaccgcgcccg

SEQ ID NO: 4035234 - RNA, 13 nt, Molluscum contagiosum virus
ccgucccccgcgg

SEQ ID NO: 4035235 - RNA, 15 nt, Molluscum contagiosum virus
ccgucccccgcggag

SEQ ID NO: 4035236 - RNA, 23 nt, Molluscum contagiosum virus
ccguccgccucgagcacgccucc

SEQ ID NO: 4035237 - RNA, 17 nt, Molluscum contagiosum virus
ccguccuugcucuggcu

SEQ ID NO: 4035238 - RNA, 13 nt, Molluscum contagiosum virus
ccgucgcccggca

SEQ ID NO: 4035239 - RNA, 18 nt, Molluscum contagiosum virus
ccgucggaagucggcgug

SEQ ID NO: 4035240 - RNA, 13 nt, Molluscum contagiosum virus
ccgucgucgccgu

SEQ ID NO: 4035241 - RNA, 22 nt, Molluscum contagiosum virus
ccgucuccacaaagacgggccc

SEQ ID NO: 4035242 - RNA, 16 nt, Molluscum contagiosum virus
ccgugaacgaggcugc

SEQ ID NO: 4035243 - RNA, 19 nt, Molluscum contagiosum virus
ccgugagcagucccgagga

SEQ ID NO: 4035244 - RNA, 19 nt, Molluscum contagiosum virus
ccgugcaccucccugugaa

SEQ ID NO: 4035245 - RNA, 13 nt, Molluscum contagiosum virus
ccgugccccugcu

SEQ ID NO: 4035246 - RNA, 19 nt, Molluscum contagiosum virus
ccgugccgccggcgccgcu

SEQ ID NO: 4035247 - RNA, 16 nt, Molluscum contagiosum virus
ccgugccuggcagugc

SEQ ID NO: 4035248 - RNA, 11 nt, Molluscum contagiosum virus
ccgugcgagcu

SEQ ID NO: 4035249 - RNA, 14 nt, Molluscum contagiosum virus
ccgugcucaggcca

SEQ ID NO: 4035250 - RNA, 17 nt, Molluscum contagiosum virus
ccgugcucaggccagca

SEQ ID NO: 4035251 - RNA, 22 nt, Molluscum contagiosum virus
ccgugcugcggcaaccgcgccc

SEQ ID NO: 4035252 - RNA, 16 nt, Molluscum contagiosum virus
cucucggcagcgucgc

SEQ ID NO: 4035253 - RNA, 21 nt, Molluscum contagiosum virus
cucucggcagcgucgcggagc

SEQ ID NO: 4035254 - RNA, 17 nt, Molluscum contagiosum virus
cucucggccauggaggc

SEQ ID NO: 4035255 - RNA, 16 nt, Molluscum contagiosum virus
cucugauuacauccug

SEQ ID NO: 4035256 - RNA, 22 nt, Molluscum contagiosum virus
cucugccaccaugcgcacagca

SEQ ID NO: 4035257 - RNA, 12 nt, Molluscum contagiosum virus
cucugccgcccg

SEQ ID NO: 4035258 - RNA, 13 nt, Molluscum contagiosum virus
cucugcgcgagca

SEQ ID NO: 4035259 - RNA, 20 nt, Molluscum contagiosum virus
cucugcgcgcaagucaccgc

SEQ ID NO: 4035260 - RNA, 19 nt, Molluscum contagiosum virus
cucuggcuugcgcuuagac

SEQ ID NO: 4035261 - RNA, 18 nt, Molluscum contagiosum virus
cucugggcgucgcacagu

SEQ ID NO: 4035262 - RNA, 14 nt, Molluscum contagiosum virus
cucugucucccgcc

SEQ ID NO: 4035263 - RNA, 15 nt, Molluscum contagiosum virus
cucuguucugcuugg

SEQ ID NO: 4035264 - RNA, 13 nt, Molluscum contagiosum virus
cucuuccggcccg

SEQ ID NO: 4035265 - RNA, 21 nt, Molluscum contagiosum virus
cucuucucgcagcguuccagg

SEQ ID NO: 4035266 - RNA, 13 nt, Molluscum contagiosum virus
cucuuuguuccug

SEQ ID NO: 4035267 - RNA, 17 nt, Molluscum contagiosum virus
cugacccccuccccagc

SEQ ID NO: 4035268 - RNA, 22 nt, Molluscum contagiosum virus
cugacccccuccccagcgccgc

SEQ ID NO: 4035269 - RNA, 21 nt, Molluscum contagiosum virus
cugaccgacggcgacgacagc

SEQ ID NO: 4035270 - RNA, 22 nt, Molluscum contagiosum virus
cugagaagcaaugcgcaaggcc

SEQ ID NO: 4035271 - RNA, 13 nt, Molluscum contagiosum virus
cugagaggaccuc

SEQ ID NO: 4035272 - RNA, 16 nt, Molluscum contagiosum virus
cugagcaagcucaaga

SEQ ID NO: 4035273 - RNA, 17 nt, Molluscum contagiosum virus
cugagcaagcucaagaa

SEQ ID NO: 4035274 - RNA, 18 nt, Molluscum contagiosum virus
cugagcgcgcugcgccgc

SEQ ID NO: 4035275 - RNA, 20 nt, Molluscum contagiosum virus
cugagcgugucgaagcgcgc

SEQ ID NO: 4035276 - RNA, 21 nt, Molluscum contagiosum virus
cugaggaagcaagacccagca

SEQ ID NO: 4035277 - RNA, 15 nt, Molluscum contagiosum virus
cugagggcgcucgau

SEQ ID NO: 4035278 - RNA, 15 nt, Molluscum contagiosum virus
cugagguuggccagc

SEQ ID NO: 4035279 - RNA, 17 nt, Molluscum contagiosum virus
cugauaguaccacugug

SEQ ID NO: 4035280 - RNA, 21 nt, Molluscum contagiosum virus
cugaucaccgaggagccgcgc

SEQ ID NO: 4035281 - RNA, 22 nt, Molluscum contagiosum virus
cugcaacucgcgcugcagcacc

SEQ ID NO: 4035282 - RNA, 18 nt, Molluscum contagiosum virus
cugcacacaccgcgagca

SEQ ID NO: 4035283 - RNA, 20 nt, Molluscum contagiosum virus
cugcacagcuuccuggagua

SEQ ID NO: 4035284 - RNA, 11 nt, Molluscum contagiosum virus
cugcaccacca

SEQ ID NO: 4035285 - RNA, 23 nt, Molluscum contagiosum virus
cugcacgacggucacgcaagcuu

SEQ ID NO: 4035286 - RNA, 17 nt, Molluscum contagiosum virus
cugcacgacguacgagu

SEQ ID NO: 4035287 - RNA, 17 nt, Molluscum contagiosum virus
cugcacgagcugcugua

SEQ ID NO: 4035288 - RNA, 22 nt, Molluscum contagiosum virus
cugcacgcgcacuugccuggcg

SEQ ID NO: 4035289 - RNA, 16 nt, Molluscum contagiosum virus
cugcacgcuacggcug

SEQ ID NO: 4035290 - RNA, 15 nt, Molluscum contagiosum virus
cugcacgggcacgcc

SEQ ID NO: 4035291 - RNA, 23 nt, Molluscum contagiosum virus
cugcacgucgaagaccaccagca

SEQ ID NO: 4035292 - RNA, 20 nt, Molluscum contagiosum virus
cugcagagcgugcuggucaa

SEQ ID NO: 4035293 - RNA, 14 nt, Molluscum contagiosum virus
cugcaggaaaggca

SEQ ID NO: 4035294 - RNA, 18 nt, Molluscum contagiosum virus
cugcaucuuuuuuaugca

SEQ ID NO: 4035295 - RNA, 17 nt, Molluscum contagiosum virus
cugccagccgcucgucc

SEQ ID NO: 4035296 - RNA, 13 nt, Molluscum contagiosum virus
cugcccgcgcgag

SEQ ID NO: 4035297 - RNA, 14 nt, Molluscum contagiosum virus
cugccgcgcaauac

SEQ ID NO: 4035298 - RNA, 21 nt, Molluscum contagiosum virus
cugccggcgcgugagcgccua

SEQ ID NO: 4035299 - RNA, 14 nt, Molluscum contagiosum virus
cugccgggagagcc

SEQ ID NO: 4035300 - RNA, 16 nt, Molluscum contagiosum virus
cugccgggagagccgc

SEQ ID NO: 4035301 - RNA, 21 nt, Molluscum contagiosum virus
cugccgguggaagagcccgca

SEQ ID NO: 4035302 - RNA, 19 nt, Molluscum contagiosum virus
cugccgucgcgcgcugugg

SEQ ID NO: 4035303 - RNA, 12 nt, Molluscum contagiosum virus
cugccuggugca

SEQ ID NO: 4035304 - RNA, 16 nt, Molluscum contagiosum virus
cugccuggugcacaca

SEQ ID NO: 4035305 - RNA, 17 nt, Molluscum contagiosum virus
cugcgacagcugcugcu

SEQ ID NO: 4035306 - RNA, 17 nt, Molluscum contagiosum virus
cugcgagaucguggacg

SEQ ID NO: 4035307 - RNA, 12 nt, Molluscum contagiosum virus
cugcgagcagcc

SEQ ID NO: 4035308 - RNA, 19 nt, Molluscum contagiosum virus
cugcgagcgccugcgagca

SEQ ID NO: 4035309 - RNA, 18 nt, Molluscum contagiosum virus
cugcgaggcgcgcacgcu

SEQ ID NO: 4035310 - RNA, 14 nt, Molluscum contagiosum virus
cugcgaguggcgcg

SEQ ID NO: 4035311 - RNA, 14 nt, Molluscum contagiosum virus
cugcgcaagcucag

SEQ ID NO: 4035312 - RNA, 22 nt, Molluscum contagiosum virus
cugcgcacacgucagccgcacg

SEQ ID NO: 4035313 - RNA, 19 nt, Molluscum contagiosum virus
cugcgcagggacgcgcuuu

SEQ ID NO: 4035314 - RNA, 22 nt, Molluscum contagiosum virus
cugcgcauggccacgcccgggc

SEQ ID NO: 4035315 - RNA, 14 nt, Molluscum contagiosum virus
cugcgccagucgcg

SEQ ID NO: 4035316 - RNA, 15 nt, Molluscum contagiosum virus
cugcgcccauuccug

SEQ ID NO: 4035317 - RNA, 18 nt, Molluscum contagiosum virus
cugcgccggcugcgccac

SEQ ID NO: 4035318 - RNA, 16 nt, Molluscum contagiosum virus
cugcgcgccgccgacg

SEQ ID NO: 4035319 - RNA, 14 nt, Molluscum contagiosum virus
cugcgcgccgcgcc

SEQ ID NO: 4035320 - RNA, 12 nt, Molluscum contagiosum virus
cugcgcgccgcu

SEQ ID NO: 4035321 - RNA, 14 nt, Molluscum contagiosum virus
cugcgcgccgcucg

SEQ ID NO: 4035322 - RNA, 14 nt, Molluscum contagiosum virus
cugcgcgcgcggcg

SEQ ID NO: 4035323 - RNA, 17 nt, Molluscum contagiosum virus
cugcgcgcuagggucca

SEQ ID NO: 4035324 - RNA, 18 nt, Molluscum contagiosum virus
cugcgcggcccgcgggcu

SEQ ID NO: 4035325 - RNA, 19 nt, Molluscum contagiosum virus
cugcgcgucugugcgcgcu

SEQ ID NO: 4035326 - RNA, 16 nt, Molluscum contagiosum virus
cugcgcgugcugggcc

SEQ ID NO: 4035327 - RNA, 15 nt, Molluscum contagiosum virus
cugcgcuccaugcug

SEQ ID NO: 4035328 - RNA, 16 nt, Molluscum contagiosum virus
cugcgcuccgacgcgg

SEQ ID NO: 4035329 - RNA, 16 nt, Molluscum contagiosum virus
cugcgcucgccugcuu

SEQ ID NO: 4035330 - RNA, 16 nt, Molluscum contagiosum virus
cugcgcugccagcucg

SEQ ID NO: 4035331 - RNA, 19 nt, Molluscum contagiosum virus
cugcgcuggaugcugcucg

SEQ ID NO: 4035332 - RNA, 17 nt, Molluscum contagiosum virus
cugcgcuugcgcgugag

SEQ ID NO: 4035333 - RNA, 23 nt, Molluscum contagiosum virus
cugcgcuuuuuuuguccuguguu

SEQ ID NO: 4035334 - RNA, 14 nt, Molluscum contagiosum virus
cugcggaacgcgca

SEQ ID NO: 4035335 - RNA, 19 nt, Molluscum contagiosum virus
cugcggacgcaaaucuguu

SEQ ID NO: 4035336 - RNA, 23 nt, Molluscum contagiosum virus
cugcggacgcgggccgcgcgcac

SEQ ID NO: 4035337 - RNA, 22 nt, Molluscum contagiosum virus
cugcggagcgccuucugcaagc

SEQ ID NO: 4035338 - RNA, 18 nt, Molluscum contagiosum virus
cugcggcucuacccggag

SEQ ID NO: 4035339 - RNA, 13 nt, Molluscum contagiosum virus
cugcggcugcugg

SEQ ID NO: 4035340 - RNA, 15 nt, Molluscum contagiosum virus
cugcggcugcuggag

SEQ ID NO: 4035341 - RNA, 16 nt, Molluscum contagiosum virus
cugcggcugcuggagc

SEQ ID NO: 4035342 - RNA, 23 nt, Molluscum contagiosum virus
cugcggguaguugcgagccagcc

SEQ ID NO: 4035343 - RNA, 18 nt, Molluscum contagiosum virus
cugcgucacaagcaccgc

SEQ ID NO: 4035344 - RNA, 24 nt, Molluscum contagiosum virus
cugcgugcgauugccccugggcuu

SEQ ID NO: 4035345 - RNA, 20 nt, Molluscum contagiosum virus
cugcguggacagcaucccug

SEQ ID NO: 4035346 - RNA, 22 nt, Molluscum contagiosum virus
cugcuacaagcggugcagcuac

SEQ ID NO: 4035347 - RNA, 16 nt, Molluscum contagiosum virus
cugcuagugcgcgcca

SEQ ID NO: 4035348 - RNA, 15 nt, Molluscum contagiosum virus
cugcucaugcgcaag

SEQ ID NO: 4035349 - RNA, 21 nt, Molluscum contagiosum virus
cugcucgaagccuucgcagag

SEQ ID NO: 4035350 - RNA, 15 nt, Molluscum contagiosum virus
cugcucgacgggcgc

SEQ ID NO: 4035351 - RNA, 14 nt, Molluscum contagiosum virus
cugcucgcgcacgc

SEQ ID NO: 4035352 - RNA, 15 nt, Molluscum contagiosum virus
cugcucgcgcacgcg

SEQ ID NO: 4035353 - RNA, 16 nt, Molluscum contagiosum virus
cugcucgcgcgcgcac

SEQ ID NO: 4035354 - RNA, 20 nt, Molluscum contagiosum virus
cugcucgcugccuggugcac

SEQ ID NO: 4035355 - RNA, 14 nt, Molluscum contagiosum virus
gaagugugccugcu

SEQ ID NO: 4035356 - RNA, 22 nt, Molluscum contagiosum virus
gaaguguugccgccggccuugu

SEQ ID NO: 4035357 - RNA, 18 nt, Molluscum contagiosum virus
gaaucgagaugcgccgca

SEQ ID NO: 4035358 - RNA, 13 nt, Molluscum contagiosum virus
gaaucuugccugu

SEQ ID NO: 4035359 - RNA, 19 nt, Molluscum contagiosum virus
gaauguguacgacgcgccc

SEQ ID NO: 4035360 - RNA, 18 nt, Molluscum contagiosum virus
gaauuaaacaaacgugca

SEQ ID NO: 4035361 - RNA, 19 nt, Molluscum contagiosum virus
gacaaaggcauuuuccugu

SEQ ID NO: 4035362 - RNA, 12 nt, Molluscum contagiosum virus
gacaacgugcug

SEQ ID NO: 4035363 - RNA, 17 nt, Molluscum contagiosum virus
gacaagcuagacuggag

SEQ ID NO: 4035364 - RNA, 19 nt, Molluscum contagiosum virus
gacaagcuagacuggagca

SEQ ID NO: 4035365 - RNA, 18 nt, Molluscum contagiosum virus
gacaaggagaugggcacg

SEQ ID NO: 4035366 - RNA, 15 nt, Molluscum contagiosum virus
gacaaugagcacuug

SEQ ID NO: 4035367 - RNA, 22 nt, Molluscum contagiosum virus
gacacgcgugcaugcgagcgcg

SEQ ID NO: 4035368 - RNA, 14 nt, Molluscum contagiosum virus
gacacgcgugucug

SEQ ID NO: 4035369 - RNA, 17 nt, Molluscum contagiosum virus
gacacgcgugucugcgc

SEQ ID NO: 4035370 - RNA, 20 nt, Molluscum contagiosum virus
gacacgcugcgcgugcuggg

SEQ ID NO: 4035371 - RNA, 22 nt, Molluscum contagiosum virus
gacacggagcggaucgugcugg

SEQ ID NO: 4035372 - RNA, 13 nt, Molluscum contagiosum virus
gacacugugcugg

SEQ ID NO: 4035373 - RNA, 18 nt, Molluscum contagiosum virus
gacagcaagcagcgcgcg

SEQ ID NO: 4035374 - RNA, 21 nt, Molluscum contagiosum virus
gacagcaagcagcgcgcgcag

SEQ ID NO: 4035375 - RNA, 20 nt, Molluscum contagiosum virus
gacagcacaaacacgcgcgc

SEQ ID NO: 4035376 - RNA, 13 nt, Molluscum contagiosum virus
gacagcauccugg

SEQ ID NO: 4035377 - RNA, 14 nt, Molluscum contagiosum virus
gacagcucagcagg

SEQ ID NO: 4035378 - RNA, 16 nt, Molluscum contagiosum virus
gacagcuugcugcugu

SEQ ID NO: 4035379 - RNA, 14 nt, Molluscum contagiosum virus
gacaggaugccugu

SEQ ID NO: 4035380 - RNA, 20 nt, Molluscum contagiosum virus
gacaggcgcgcaagugcgug

SEQ ID NO: 4035381 - RNA, 17 nt, Molluscum contagiosum virus
gacagugccuccgcgga

SEQ ID NO: 4035382 - RNA, 16 nt, Molluscum contagiosum virus
gacaucuacagccgcc

SEQ ID NO: 4035383 - RNA, 18 nt, Molluscum contagiosum virus
gacaugcacacgcaccgc

SEQ ID NO: 4035384 - RNA, 19 nt, Molluscum contagiosum virus
gacaugucguaccuggugg

SEQ ID NO: 4035385 - RNA, 15 nt, Molluscum contagiosum virus
gaccacgcuggcacg

SEQ ID NO: 4035386 - RNA, 17 nt, Molluscum contagiosum virus
gaccacggcgcgccgcc

SEQ ID NO: 4035387 - RNA, 22 nt, Molluscum contagiosum virus
gaccacgugccagagucgccgc

SEQ ID NO: 4035388 - RNA, 17 nt, Molluscum contagiosum virus
gacccagaagcgagagc

SEQ ID NO: 4035389 - RNA, 15 nt, Molluscum contagiosum virus
gacccaucggagaag

SEQ ID NO: 4035390 - RNA, 19 nt, Molluscum contagiosum virus
gacccgcgaacgagggaug

SEQ ID NO: 4035391 - RNA, 15 nt, Molluscum contagiosum virus
gaccggcgucggcaa

SEQ ID NO: 4035392 - RNA, 14 nt, Molluscum contagiosum virus
gaccuacuccuggc

SEQ ID NO: 4035393 - RNA, 15 nt, Molluscum contagiosum virus
gaccucacagcgccg

SEQ ID NO: 4035394 - RNA, 23 nt, Molluscum contagiosum virus
gaccugauuuucccgggcggcgc

SEQ ID NO: 4035395 - RNA, 23 nt, Molluscum contagiosum virus
gaccugggcgucgugcaccugga

SEQ ID NO: 4035396 - RNA, 16 nt, Molluscum contagiosum virus
gaccugucgugcaaug

SEQ ID NO: 4035397 - RNA, 15 nt, Molluscum contagiosum virus
gaccuuggugcucau

SEQ ID NO: 4035398 - RNA, 18 nt, Molluscum contagiosum virus
gacgaagagacgccaagc

SEQ ID NO: 4035399 - RNA, 22 nt, Molluscum contagiosum virus
gacgacaugcugugcggcacgc

SEQ ID NO: 4035400 - RNA, 20 nt, Molluscum contagiosum virus
gacgcagacgacgcccaagc

SEQ ID NO: 4035401 - RNA, 17 nt, Molluscum contagiosum virus
gacgcagagccaugccc

SEQ ID NO: 4035402 - RNA, 15 nt, Molluscum contagiosum virus
gacgcagcgcgagcu

SEQ ID NO: 4035403 - RNA, 19 nt, Molluscum contagiosum virus
gacgcagcgcgagcugugc

SEQ ID NO: 4035404 - RNA, 18 nt, Molluscum contagiosum virus
gacgcaggaugcuggggc

SEQ ID NO: 4035405 - RNA, 20 nt, Molluscum contagiosum virus
gacgccaagcgucgcgacgc

SEQ ID NO: 4035406 - RNA, 20 nt, Molluscum contagiosum virus
gacgccagcgauugcccgcg

SEQ ID NO: 4035407 - RNA, 20 nt, Molluscum contagiosum virus
gacgcccggcaccgcggcgg

SEQ ID NO: 4035408 - RNA, 14 nt, Molluscum contagiosum virus
gacgccuuccugcu

SEQ ID NO: 4035409 - RNA, 16 nt, Molluscum contagiosum virus
gacgccuuccugcugg

SEQ ID NO: 4035410 - RNA, 17 nt, Molluscum contagiosum virus
gacgccuuuugugcagc

SEQ ID NO: 4035411 - RNA, 15 nt, Molluscum contagiosum virus
gacgcgaugacacgc

SEQ ID NO: 4035412 - RNA, 18 nt, Molluscum contagiosum virus
gacgcgcaagugugcgca

SEQ ID NO: 4035413 - RNA, 17 nt, Molluscum contagiosum virus
gacgcgcagcucgacgc

SEQ ID NO: 4035414 - RNA, 16 nt, Molluscum contagiosum virus
gacgcgcgagugugcg

SEQ ID NO: 4035415 - RNA, 17 nt, Molluscum contagiosum virus
gacgcgcgcggcaagca

SEQ ID NO: 4035416 - RNA, 15 nt, Molluscum contagiosum virus
gacgcgcggcggcgc

SEQ ID NO: 4035417 - RNA, 16 nt, Molluscum contagiosum virus
gacgcggccgcggagg

SEQ ID NO: 4035418 - RNA, 13 nt, Molluscum contagiosum virus
gacgcgggccugu

SEQ ID NO: 4035419 - RNA, 22 nt, Molluscum contagiosum virus
gacgcgggcguguccgcgggcg

SEQ ID NO: 4035420 - RNA, 13 nt, Molluscum contagiosum virus
gacgcggucgcgc

SEQ ID NO: 4035421 - RNA, 14 nt, Molluscum contagiosum virus
gacgcuagcugugc

SEQ ID NO: 4035422 - RNA, 14 nt, Molluscum contagiosum virus
gacgcuggcggcgc

SEQ ID NO: 4035423 - RNA, 15 nt, Molluscum contagiosum virus
gacggaaccguggug

SEQ ID NO: 4035424 - RNA, 20 nt, Molluscum contagiosum virus
gacggcacgggcacgcgcgc

SEQ ID NO: 4035425 - RNA, 16 nt, Molluscum contagiosum virus
gacggccggcgggcgc

SEQ ID NO: 4035426 - RNA, 18 nt, Molluscum contagiosum virus
gacggcgacgacagcgac

SEQ ID NO: 4035427 - RNA, 18 nt, Molluscum contagiosum virus
gacggcgccucgagcgcg

SEQ ID NO: 4035428 - RNA, 15 nt, Molluscum contagiosum virus
gacggcgcgcagcgc

SEQ ID NO: 4035429 - RNA, 12 nt, Molluscum contagiosum virus
gacggcgcgcgc

SEQ ID NO: 4035430 - RNA, 14 nt, Molluscum contagiosum virus
gacggcgcugcgcg

SEQ ID NO: 4035431 - RNA, 18 nt, Molluscum contagiosum virus
gacggcgugcgccgcucc

SEQ ID NO: 4035432 - RNA, 13 nt, Molluscum contagiosum virus
gacgggcccgcga

SEQ ID NO: 4035433 - RNA, 13 nt, Molluscum contagiosum virus
gacggggcgcacg

SEQ ID NO: 4035434 - RNA, 16 nt, Molluscum contagiosum virus
gacggucacgcaagcu

SEQ ID NO: 4035435 - RNA, 17 nt, Molluscum contagiosum virus
gacggugcuggugcugg

SEQ ID NO: 4035436 - RNA, 20 nt, Molluscum contagiosum virus
gacggugugccgcugguggg

SEQ ID NO: 4035437 - RNA, 18 nt, Molluscum contagiosum virus
gacguacgagcaggcgca

SEQ ID NO: 4035438 - RNA, 16 nt, Molluscum contagiosum virus
gacgucaaccgggcuc

SEQ ID NO: 4035439 - RNA, 20 nt, Molluscum contagiosum virus
gacgucaaccgggcucucgc

SEQ ID NO: 4035440 - RNA, 11 nt, Molluscum contagiosum virus
gacgucgcggc

SEQ ID NO: 4035441 - RNA, 16 nt, Molluscum contagiosum virus
gacgugaucgcgcagg

SEQ ID NO: 4035442 - RNA, 19 nt, Molluscum contagiosum virus
gacgugaucgcgcaggcgc

SEQ ID NO: 4035443 - RNA, 20 nt, Molluscum contagiosum virus
gacgugaucgcgcaggcgcg

SEQ ID NO: 4035444 - RNA, 14 nt, Molluscum contagiosum virus
gacgugcugcgcaa

SEQ ID NO: 4035445 - RNA, 23 nt, Molluscum contagiosum virus
gacgugcugcgcgcccaggcgcg

SEQ ID NO: 4035446 - RNA, 14 nt, Molluscum contagiosum virus
gacgugcugcugca

SEQ ID NO: 4035447 - RNA, 13 nt, Molluscum contagiosum virus
gacgugcugcugg

SEQ ID NO: 4035448 - RNA, 17 nt, Molluscum contagiosum virus
gacgugcuucacgaccu

SEQ ID NO: 4035449 - RNA, 18 nt, Molluscum contagiosum virus
gacguggacguggauacc

SEQ ID NO: 4035450 - RNA, 22 nt, Molluscum contagiosum virus
gacguggauaccaugcucucgc

SEQ ID NO: 4035451 - RNA, 19 nt, Molluscum contagiosum virus
gacgugguacuggcgcccg

SEQ ID NO: 4035452 - RNA, 23 nt, Molluscum contagiosum virus
gacgugugcucugugcgcgcaga

SEQ ID NO: 4035453 - RNA, 20 nt, Molluscum contagiosum virus
gacuaccuggcggcgcugga

SEQ ID NO: 4035454 - RNA, 23 nt, Molluscum contagiosum virus
gacuaccuggcggcgcuggagac

SEQ ID NO: 4035455 - RNA, 19 nt, Molluscum contagiosum virus
gacuacgcacggcggacgc

SEQ ID NO: 4035456 - RNA, 21 nt, Molluscum contagiosum virus
gacuagaugcguccuaugcau

SEQ ID NO: 4035457 - RNA, 12 nt, Molluscum contagiosum virus
gacucagcaugu

SEQ ID NO: 4035458 - RNA, 23 nt, Molluscum contagiosum virus
gcuuagaccuuuacgucgcgcgc

SEQ ID NO: 4035459 - RNA, 17 nt, Molluscum contagiosum virus
gcuuagcacacgcgcgc

SEQ ID NO: 4035460 - RNA, 21 nt, Molluscum contagiosum virus
gcuuagcuuccgucugcugcu

SEQ ID NO: 4035461 - RNA, 23 nt, Molluscum contagiosum virus
gcuucacgcugcucgugcugcuc

SEQ ID NO: 4035462 - RNA, 16 nt, Molluscum contagiosum virus
gcuucauccgcgcgcu

SEQ ID NO: 4035463 - RNA, 15 nt, Molluscum contagiosum virus
gcuucccgaguacua

SEQ ID NO: 4035464 - RNA, 14 nt, Molluscum contagiosum virus
gcuuccggugccgg

SEQ ID NO: 4035465 - RNA, 14 nt, Molluscum contagiosum virus
gcuuccuuuucucc

SEQ ID NO: 4035466 - RNA, 14 nt, Molluscum contagiosum virus
gcuucgccgcgcgc

SEQ ID NO: 4035467 - RNA, 19 nt, Molluscum contagiosum virus
gcuucggcucccagcagcg

SEQ ID NO: 4035468 - RNA, 13 nt, Molluscum contagiosum virus
gcuucgggcucag

SEQ ID NO: 4035469 - RNA, 13 nt, Molluscum contagiosum virus
gcuucgucuucac

SEQ ID NO: 4035470 - RNA, 20 nt, Molluscum contagiosum virus
gcuucuacugcgcacccgcc

SEQ ID NO: 4035471 - RNA, 19 nt, Molluscum contagiosum virus
gcuucuuuacgggcgccag

SEQ ID NO: 4035472 - RNA, 15 nt, Molluscum contagiosum virus
gcuugccccucgucc

SEQ ID NO: 4035473 - RNA, 19 nt, Molluscum contagiosum virus
gcuugcucccucgcgcgca

SEQ ID NO: 4035474 - RNA, 13 nt, Molluscum contagiosum virus
gcuugcugcgcug

SEQ ID NO: 4035475 - RNA, 22 nt, Molluscum contagiosum virus
gcuugcuucggcggcugugccc

SEQ ID NO: 4035476 - RNA, 18 nt, Molluscum contagiosum virus
gcuuggacagcaagcagc

SEQ ID NO: 4035477 - RNA, 15 nt, Molluscum contagiosum virus
gcuuggccggaacgc

SEQ ID NO: 4035478 - RNA, 21 nt, Molluscum contagiosum virus
gcuuggccggaacgccgugcg

SEQ ID NO: 4035479 - RNA, 17 nt, Molluscum contagiosum virus
gcuuggugcgcucgagc

SEQ ID NO: 4035480 - RNA, 23 nt, Molluscum contagiosum virus
gcuuugaggaacuagugcugcug

SEQ ID NO: 4035481 - RNA, 19 nt, Molluscum contagiosum virus
gcuuugugcgaccugcugc

SEQ ID NO: 4035482 - RNA, 16 nt, Molluscum contagiosum virus
gcuuuuuuuguccugu

SEQ ID NO: 4035483 - RNA, 17 nt, Molluscum contagiosum virus
ggaaaaaucccccgcca

SEQ ID NO: 4035484 - RNA, 22 nt, Molluscum contagiosum virus
ggaaaccucaccucugcgcggc

SEQ ID NO: 4035485 - RNA, 23 nt, Molluscum contagiosum virus
ggaaacgcacagccccugcugcu

SEQ ID NO: 4035486 - RNA, 17 nt, Molluscum contagiosum virus
ggaaacgcuggcgagca

SEQ ID NO: 4035487 - RNA, 22 nt, Molluscum contagiosum virus
ggaaagcuggcgggugccgugc

SEQ ID NO: 4035488 - RNA, 19 nt, Molluscum contagiosum virus
ggaacaccacacgcgcggc

SEQ ID NO: 4035489 - RNA, 23 nt, Molluscum contagiosum virus
ggaacgaggucaucuucgugcug

SEQ ID NO: 4035490 - RNA, 16 nt, Molluscum contagiosum virus
ggaacgccgccacgcc

SEQ ID NO: 4035491 - RNA, 13 nt, Molluscum contagiosum virus
ggaacgcgccgcg

SEQ ID NO: 4035492 - RNA, 22 nt, Molluscum contagiosum virus
ggaacgcuuggcgggcagcggc

SEQ ID NO: 4035493 - RNA, 22 nt, Molluscum contagiosum virus
ggaacucggcuucugcugcaca

SEQ ID NO: 4035494 - RNA, 16 nt, Molluscum contagiosum virus
ggaacucuacgacaug

SEQ ID NO: 4035495 - RNA, 19 nt, Molluscum contagiosum virus
ggaagcaacgacaaggaaa

SEQ ID NO: 4035496 - RNA, 20 nt, Molluscum contagiosum virus
ggaagcaacgacaaggaaag

SEQ ID NO: 4035497 - RNA, 15 nt, Molluscum contagiosum virus
ggaagccgccagcca

SEQ ID NO: 4035498 - RNA, 15 nt, Molluscum contagiosum virus
ggaagcugcacgugc

SEQ ID NO: 4035499 - RNA, 20 nt, Molluscum contagiosum virus
ggaaggacagugucuuguca

SEQ ID NO: 4035500 - RNA, 15 nt, Molluscum contagiosum virus
ggaaggcgaccagcu

SEQ ID NO: 4035501 - RNA, 15 nt, Molluscum contagiosum virus
ggaauaccggagaca

SEQ ID NO: 4035502 - RNA, 16 nt, Molluscum contagiosum virus
ggacaccgcgggcgug

SEQ ID NO: 4035503 - RNA, 19 nt, Molluscum contagiosum virus
ggacacgggugagcucgcc

SEQ ID NO: 4035504 - RNA, 16 nt, Molluscum contagiosum virus
ggacacuggcaccgga

SEQ ID NO: 4035505 - RNA, 22 nt, Molluscum contagiosum virus
ggacagagcccgcggcgcacgg

SEQ ID NO: 4035506 - RNA, 18 nt, Molluscum contagiosum virus
ggacagcaagcagcgcgc

SEQ ID NO: 4035507 - RNA, 15 nt, Molluscum contagiosum virus
ggacagccugcaccg

SEQ ID NO: 4035508 - RNA, 14 nt, Molluscum contagiosum virus
ggacagcggaagaa

SEQ ID NO: 4035509 - RNA, 19 nt, Molluscum contagiosum virus
ggacaugagcuugcgcacg

SEQ ID NO: 4035510 - RNA, 14 nt, Molluscum contagiosum virus
ggaccugcgccagc

SEQ ID NO: 4035511 - RNA, 15 nt, Molluscum contagiosum virus
ggaccugcugguggu

SEQ ID NO: 4035512 - RNA, 18 nt, Molluscum contagiosum virus
ggacgaagcugugcaaga

SEQ ID NO: 4035513 - RNA, 15 nt, Molluscum contagiosum virus
ggacgcacagggcug

SEQ ID NO: 4035514 - RNA, 19 nt, Molluscum contagiosum virus
ggacgcaggaugcuggggc

SEQ ID NO: 4035515 - RNA, 20 nt, Molluscum contagiosum virus
ggacgccagcuugagcacac

SEQ ID NO: 4035516 - RNA, 12 nt, Molluscum contagiosum virus
ggacgcgcaagu

SEQ ID NO: 4035517 - RNA, 19 nt, Molluscum contagiosum virus
ggacgcgcuugcgcggaag

SEQ ID NO: 4035518 - RNA, 24 nt, Molluscum contagiosum virus
ggacgcggugaccggagcggcgga

SEQ ID NO: 4035519 - RNA, 11 nt, Molluscum contagiosum virus
ggacggagguc

SEQ ID NO: 4035520 - RNA, 23 nt, Molluscum contagiosum virus
ggacgugcccuacgcgcgcgugc

SEQ ID NO: 4035521 - RNA, 22 nt, Molluscum contagiosum virus
ggacgugcuccgaguccagcuu

SEQ ID NO: 4035522 - RNA, 17 nt, Molluscum contagiosum virus
ggacguggucgcgcgcg

SEQ ID NO: 4035523 - RNA, 14 nt, Molluscum contagiosum virus
ggacuacgcacggc

SEQ ID NO: 4035524 - RNA, 13 nt, Molluscum contagiosum virus
ggacuuuucgcgc

SEQ ID NO: 4035525 - RNA, 18 nt, Molluscum contagiosum virus
ggagaacgcgaggccggc

SEQ ID NO: 4035526 - RNA, 13 nt, Molluscum contagiosum virus
ggagacguagagc

SEQ ID NO: 4035527 - RNA, 15 nt, Molluscum contagiosum virus
ggagagagagacaug

SEQ ID NO: 4035528 - RNA, 14 nt, Molluscum contagiosum virus
ggagagcgcgcggc

SEQ ID NO: 4035529 - RNA, 22 nt, Molluscum contagiosum virus
ggagagguugcgcggggcaggc

SEQ ID NO: 4035530 - RNA, 15 nt, Molluscum contagiosum virus
ggagaugacgggcac

SEQ ID NO: 4035531 - RNA, 16 nt, Molluscum contagiosum virus
ggagaugacgggcacg

SEQ ID NO: 4035532 - RNA, 22 nt, Molluscum contagiosum virus
ggagccaagcaacggcggcgca

SEQ ID NO: 4035533 - RNA, 15 nt, Molluscum contagiosum virus
ggagcccgugcugga

SEQ ID NO: 4035534 - RNA, 12 nt, Molluscum contagiosum virus
ggagccgcggca

SEQ ID NO: 4035535 - RNA, 21 nt, Molluscum contagiosum virus
ggagccggccuagagcuggca

SEQ ID NO: 4035536 - RNA, 23 nt, Molluscum contagiosum virus
ggagcgacauagcgcaccagcug

SEQ ID NO: 4035537 - RNA, 19 nt, Molluscum contagiosum virus
ggagcgcagucccagcacc

SEQ ID NO: 4035538 - RNA, 13 nt, Molluscum contagiosum virus
ggagcgcgcacgg

SEQ ID NO: 4035539 - RNA, 20 nt, Molluscum contagiosum virus
ggagcucgacucgagcgagc

SEQ ID NO: 4035540 - RNA, 17 nt, Molluscum contagiosum virus
ggagcugcgcgagacgc

SEQ ID NO: 4035541 - RNA, 17 nt, Molluscum contagiosum virus
ggagcugguccagggcu

SEQ ID NO: 4035542 - RNA, 14 nt, Molluscum contagiosum virus
ggaggacacgcgca

SEQ ID NO: 4035543 - RNA, 20 nt, Molluscum contagiosum virus
ggaggaucgcuacgugcgca

SEQ ID NO: 4035544 - RNA, 14 nt, Molluscum contagiosum virus
ggaggcaagcgggc

SEQ ID NO: 4035545 - RNA, 18 nt, Molluscum contagiosum virus
ggaggccaacgccagcug

SEQ ID NO: 4035546 - RNA, 19 nt, Molluscum contagiosum virus
ggaggccgucuucgccggc

SEQ ID NO: 4035547 - RNA, 20 nt, Molluscum contagiosum virus
ggaggccgucuucgccggca

SEQ ID NO: 4035548 - RNA, 21 nt, Molluscum contagiosum virus
ggaggcgcuaccucgcgggag

SEQ ID NO: 4035549 - RNA, 19 nt, Molluscum contagiosum virus
ggaggcgcuagugcagaug

SEQ ID NO: 4035550 - RNA, 16 nt, Molluscum contagiosum virus
ggaggcggcacugcua

SEQ ID NO: 4035551 - RNA, 20 nt, Molluscum contagiosum virus
ggaggcggcacugcuagcga

SEQ ID NO: 4035552 - RNA, 15 nt, Molluscum contagiosum virus
ggaggcucgagcgcg

SEQ ID NO: 4035553 - RNA, 18 nt, Molluscum contagiosum virus
ggagggcacgcugcacau

SEQ ID NO: 4035554 - RNA, 14 nt, Molluscum contagiosum virus
ggagguuggaagca

SEQ ID NO: 4035555 - RNA, 18 nt, Molluscum contagiosum virus
ggaguagcgugcgccugc

SEQ ID NO: 4035556 - RNA, 12 nt, Molluscum contagiosum virus
ggaguccaugcc

SEQ ID NO: 4035557 - RNA, 18 nt, Molluscum contagiosum virus
ggaguccucgacaaugag

SEQ ID NO: 4035558 - RNA, 18 nt, Molluscum contagiosum virus
ggauacagcgcggagaga

SEQ ID NO: 4035559 - RNA, 21 nt, Molluscum contagiosum virus
ggauacagcgcggagagaaca

SEQ ID NO: 4035560 - RNA, 20 nt, Molluscum contagiosum virus
gucaggccggucgcggaaga

SEQ ID NO: 4035561 - RNA, 13 nt, Molluscum contagiosum virus
gucaucgggcugc

SEQ ID NO: 4035562 - RNA, 16 nt, Molluscum contagiosum virus
guccaacccgcggcgc

SEQ ID NO: 4035563 - RNA, 22 nt, Molluscum contagiosum virus
guccacgaacgacagcgccgcc

SEQ ID NO: 4035564 - RNA, 20 nt, Molluscum contagiosum virus
guccagccgcaccgggacga

SEQ ID NO: 4035565 - RNA, 19 nt, Molluscum contagiosum virus
guccagcggcugcccgcgg

SEQ ID NO: 4035566 - RNA, 18 nt, Molluscum contagiosum virus
gucccagcaccgcgccgc

SEQ ID NO: 4035567 - RNA, 20 nt, Molluscum contagiosum virus
gucccagcagcugcuccgcc

SEQ ID NO: 4035568 - RNA, 15 nt, Molluscum contagiosum virus
guccgcacgcacgga

SEQ ID NO: 4035569 - RNA, 17 nt, Molluscum contagiosum virus
guccgcaucggcgccgc

SEQ ID NO: 4035570 - RNA, 16 nt, Molluscum contagiosum virus
guccgccucgagcacg

SEQ ID NO: 4035571 - RNA, 15 nt, Molluscum contagiosum virus
guccgcgggcgcacg

SEQ ID NO: 4035572 - RNA, 19 nt, Molluscum contagiosum virus
guccgcgggcgcgcgccag

SEQ ID NO: 4035573 - RNA, 20 nt, Molluscum contagiosum virus
guccgcuccuucucagggcu

SEQ ID NO: 4035574 - RNA, 17 nt, Molluscum contagiosum virus
guccggaggcacgggcu

SEQ ID NO: 4035575 - RNA, 14 nt, Molluscum contagiosum virus
guccggcgcucgcc

SEQ ID NO: 4035576 - RNA, 15 nt, Molluscum contagiosum virus
guccggcgcucgccu

SEQ ID NO: 4035577 - RNA, 15 nt, Molluscum contagiosum virus
guccggcgcuugccc

SEQ ID NO: 4035578 - RNA, 16 nt, Molluscum contagiosum virus
guccgguacugcugca

SEQ ID NO: 4035579 - RNA, 18 nt, Molluscum contagiosum virus
guccgguguccacgacac

SEQ ID NO: 4035580 - RNA, 16 nt, Molluscum contagiosum virus
guccgucacggacagc

SEQ ID NO: 4035581 - RNA, 19 nt, Molluscum contagiosum virus
guccuacacgccgcuggag

SEQ ID NO: 4035582 - RNA, 20 nt, Molluscum contagiosum virus
guccucgugggauaggcaca

SEQ ID NO: 4035583 - RNA, 14 nt, Molluscum contagiosum virus
guccugaacagcau

SEQ ID NO: 4035584 - RNA, 12 nt, Molluscum contagiosum virus
guccuggagccu

SEQ ID NO: 4035585 - RNA, 22 nt, Molluscum contagiosum virus
guccuuuuuugugucuacggac

SEQ ID NO: 4035586 - RNA, 13 nt, Molluscum contagiosum virus
gucgacagagaag

SEQ ID NO: 4035587 - RNA, 21 nt, Molluscum contagiosum virus
gucgaccuggaagccgccagc

SEQ ID NO: 4035588 - RNA, 18 nt, Molluscum contagiosum virus
gucgacgagugcgccgcg

SEQ ID NO: 4035589 - RNA, 12 nt, Molluscum contagiosum virus
gucgacggcgcc

SEQ ID NO: 4035590 - RNA, 19 nt, Molluscum contagiosum virus
gucgacgggaacgagguca

SEQ ID NO: 4035591 - RNA, 16 nt, Molluscum contagiosum virus
gucgacguggagccug

SEQ ID NO: 4035592 - RNA, 19 nt, Molluscum contagiosum virus
gucgaggagggcguccgua

SEQ ID NO: 4035593 - RNA, 14 nt, Molluscum contagiosum virus
gucgaggccuucgc

SEQ ID NO: 4035594 - RNA, 15 nt, Molluscum contagiosum virus
gucgaguucgcucgc

SEQ ID NO: 4035595 - RNA, 23 nt, Molluscum contagiosum virus
gucgcagcagcggucucggcagc

SEQ ID NO: 4035596 - RNA, 19 nt, Molluscum contagiosum virus
gucgcccggcaggcucccg

SEQ ID NO: 4035597 - RNA, 18 nt, Molluscum contagiosum virus
gucgcgagugugcgcgcc

SEQ ID NO: 4035598 - RNA, 11 nt, Molluscum contagiosum virus
gucgcgcacgc

SEQ ID NO: 4035599 - RNA, 21 nt, Molluscum contagiosum virus
gucgcgcaucaccgagcgaga

SEQ ID NO: 4035600 - RNA, 16 nt, Molluscum contagiosum virus
gucgcgccgaggacgc

SEQ ID NO: 4035601 - RNA, 12 nt, Molluscum contagiosum virus
gucggagcagga

SEQ ID NO: 4035602 - RNA, 22 nt, Molluscum contagiosum virus
gucggcaccgcgccgaaacacg

SEQ ID NO: 4035603 - RNA, 18 nt, Molluscum contagiosum virus
gucggcggcaugcgcgcg

SEQ ID NO: 4035604 - RNA, 16 nt, Molluscum contagiosum virus
gucgugcaggccgugc

SEQ ID NO: 4035605 - RNA, 20 nt, Molluscum contagiosum virus
gucgugcgcguucggaacgc

SEQ ID NO: 4035606 - RNA, 13 nt, Molluscum contagiosum virus
gucuaccccgcgu

SEQ ID NO: 4035607 - RNA, 18 nt, Molluscum contagiosum virus
gucuccccuugggcucug

SEQ ID NO: 4035608 - RNA, 21 nt, Molluscum contagiosum virus
gucucgaaccgaggccgcgcu

SEQ ID NO: 4035609 - RNA, 15 nt, Molluscum contagiosum virus
gucucgaugugacaa

SEQ ID NO: 4035610 - RNA, 19 nt, Molluscum contagiosum virus
gucucgaugugacaacaug

SEQ ID NO: 4035611 - RNA, 14 nt, Molluscum contagiosum virus
gucucgcgcucgcc

SEQ ID NO: 4035612 - RNA, 14 nt, Molluscum contagiosum virus
gucucgcugcuggg

SEQ ID NO: 4035613 - RNA, 15 nt, Molluscum contagiosum virus
gucucucugucuccc

SEQ ID NO: 4035614 - RNA, 13 nt, Molluscum contagiosum virus
gucucugcgcgag

SEQ ID NO: 4035615 - RNA, 13 nt, Molluscum contagiosum virus
gucugcaaggccu

SEQ ID NO: 4035616 - RNA, 15 nt, Molluscum contagiosum virus
gucugggaggugucc

SEQ ID NO: 4035617 - RNA, 18 nt, Molluscum contagiosum virus
gucuuaacucagcgggca

SEQ ID NO: 4035618 - RNA, 14 nt, Molluscum contagiosum virus
gucuuacugcugca

SEQ ID NO: 4035619 - RNA, 18 nt, Molluscum contagiosum virus
gucuuaugcauccugaug

SEQ ID NO: 4035620 - RNA, 13 nt, Molluscum contagiosum virus
gucuucuaccgcc

SEQ ID NO: 4035621 - RNA, 23 nt, Molluscum contagiosum virus
gucuugccgaagccgcaggccag

SEQ ID NO: 4035622 - RNA, 16 nt, Molluscum contagiosum virus
gugaaguccucucucc

SEQ ID NO: 4035623 - RNA, 15 nt, Molluscum contagiosum virus
gugacaaucucugcg

SEQ ID NO: 4035624 - RNA, 20 nt, Molluscum contagiosum virus
gugacaaucucugcgccgcg

SEQ ID NO: 4035625 - RNA, 23 nt, Molluscum contagiosum virus
gugacaaucucugcgccgcgcgc

SEQ ID NO: 4035626 - RNA, 21 nt, Molluscum contagiosum virus
gugacuagcgcuggcugcagg

SEQ ID NO: 4035627 - RNA, 14 nt, Molluscum contagiosum virus
gugacucggccgcg

SEQ ID NO: 4035628 - RNA, 19 nt, Molluscum contagiosum virus
gugacucggccgcggggcg

SEQ ID NO: 4035629 - RNA, 21 nt, Molluscum contagiosum virus
gugagaaaguucccguccgcg

SEQ ID NO: 4035630 - RNA, 23 nt, Molluscum contagiosum virus
gugcaaaucgcguacgguguccu

SEQ ID NO: 4035631 - RNA, 19 nt, Molluscum contagiosum virus
gugcacagcguagcggacg

SEQ ID NO: 4035632 - RNA, 18 nt, Molluscum contagiosum virus
gugcacauugcugcugca

SEQ ID NO: 4035633 - RNA, 14 nt, Molluscum contagiosum virus
gugcaccagcaccg

SEQ ID NO: 4035634 - RNA, 23 nt, Molluscum contagiosum virus
gugcacccuccgcacagagggac

SEQ ID NO: 4035635 - RNA, 12 nt, Molluscum contagiosum virus
gugcaccuggag

SEQ ID NO: 4035636 - RNA, 21 nt, Molluscum contagiosum virus
gugcacgcuguccaggcgcug

SEQ ID NO: 4035637 - RNA, 21 nt, Molluscum contagiosum virus
gugcagcugccgcagagccgc

SEQ ID NO: 4035638 - RNA, 17 nt, Molluscum contagiosum virus
gugcaggaacgcgcgcu

SEQ ID NO: 4035639 - RNA, 18 nt, Molluscum contagiosum virus
gugcaguggcuacuggag

SEQ ID NO: 4035640 - RNA, 18 nt, Molluscum contagiosum virus
gugcauggcacgcgagca

SEQ ID NO: 4035641 - RNA, 16 nt, Molluscum contagiosum virus
gugcauggcggcggcc

SEQ ID NO: 4035642 - RNA, 17 nt, Molluscum contagiosum virus
gugccagcagcauuuug

SEQ ID NO: 4035643 - RNA, 18 nt, Molluscum contagiosum virus
gugcccacgcuggcgcgc

SEQ ID NO: 4035644 - RNA, 19 nt, Molluscum contagiosum virus
gugcccaugcucgagccug

SEQ ID NO: 4035645 - RNA, 13 nt, Molluscum contagiosum virus
gugcccgagcccg

SEQ ID NO: 4035646 - RNA, 18 nt, Molluscum contagiosum virus
gugccgacgugugccgcu

SEQ ID NO: 4035647 - RNA, 16 nt, Molluscum contagiosum virus
gugccgaggcgcugcc

SEQ ID NO: 4035648 - RNA, 16 nt, Molluscum contagiosum virus
gugccgccgugggcgc

SEQ ID NO: 4035649 - RNA, 13 nt, Molluscum contagiosum virus
gugccgcugcgcg

SEQ ID NO: 4035650 - RNA, 15 nt, Molluscum contagiosum virus
gugccgggcgccggc

SEQ ID NO: 4035651 - RNA, 13 nt, Molluscum contagiosum virus
gugccucugccag

SEQ ID NO: 4035652 - RNA, 19 nt, Molluscum contagiosum virus
gugccugcaagaggcgcug

SEQ ID NO: 4035653 - RNA, 13 nt, Molluscum contagiosum virus
gugcgaaggcucg

SEQ ID NO: 4035654 - RNA, 22 nt, Molluscum contagiosum virus
gugcgacucgucgagcacgaag

SEQ ID NO: 4035655 - RNA, 22 nt, Molluscum contagiosum virus
gugcgccgcgccgaaguacuuu

SEQ ID NO: 4035656 - RNA, 19 nt, Molluscum contagiosum virus
gugcgcgacggcgagcucu

SEQ ID NO: 4035657 - RNA, 18 nt, Molluscum contagiosum virus
gugcgcgacuuggggcuc

SEQ ID NO: 4035658 - RNA, 15 nt, Molluscum contagiosum virus
gugcgcgagcugagg

SEQ ID NO: 4035659 - RNA, 22 nt, Molluscum contagiosum virus
gugcgcgguggugcugggcgug

SEQ ID NO: 4035660 - RNA, 17 nt, Molluscum contagiosum virus
gugcgcgugacacaccg

SEQ ID NO: 4035661 - RNA, 19 nt, Molluscum contagiosum virus
gugcgcgugucuggagccc

SEQ ID NO: 4035662 - RNA, 21 nt, Molluscum contagiosum virus
gugcgcucgcuagaggacgcc

SEQ ID NO: 4035663 - RNA, 18 nt, Molluscum contagiosum virus
uccacggguagcagcgcc

SEQ ID NO: 4035664 - RNA, 19 nt, Molluscum contagiosum virus
uccacguccgacucggaca

SEQ ID NO: 4035665 - RNA, 19 nt, Molluscum contagiosum virus
uccacgucgaucagcuccg

SEQ ID NO: 4035666 - RNA, 21 nt, Molluscum contagiosum virus
uccagcccgcggugcgcacau

SEQ ID NO: 4035667 - RNA, 20 nt, Molluscum contagiosum virus
uccagcggcugcccgcggag

SEQ ID NO: 4035668 - RNA, 22 nt, Molluscum contagiosum virus
uccagcucggguuccagcuccg

SEQ ID NO: 4035669 - RNA, 14 nt, Molluscum contagiosum virus
uccagcugcgcgag

SEQ ID NO: 4035670 - RNA, 24 nt, Molluscum contagiosum virus
uccagguggccaacggcgccaucg

SEQ ID NO: 4035671 - RNA, 15 nt, Molluscum contagiosum virus
uccagugaaaugacg

SEQ ID NO: 4035672 - RNA, 16 nt, Molluscum contagiosum virus
uccaguggcgcccgug

SEQ ID NO: 4035673 - RNA, 17 nt, Molluscum contagiosum virus
uccccaagaccugcuuc

SEQ ID NO: 4035674 - RNA, 17 nt, Molluscum contagiosum virus
ucccccgccaggaacga

SEQ ID NO: 4035675 - RNA, 21 nt, Molluscum contagiosum virus
uccccgcacaagggcagcuca

SEQ ID NO: 4035676 - RNA, 14 nt, Molluscum contagiosum virus
uccccgccagcacc

SEQ ID NO: 4035677 - RNA, 17 nt, Molluscum contagiosum virus
uccccgcgggccgccgc

SEQ ID NO: 4035678 - RNA, 13 nt, Molluscum contagiosum virus
ucccgacagcaga

SEQ ID NO: 4035679 - RNA, 18 nt, Molluscum contagiosum virus
ucccgaggcguccagcgg

SEQ ID NO: 4035680 - RNA, 18 nt, Molluscum contagiosum virus
ucccgcgccacgagcgcc

SEQ ID NO: 4035681 - RNA, 21 nt, Molluscum contagiosum virus
ucccgcgccacgagcgccgcg

SEQ ID NO: 4035682 - RNA, 20 nt, Molluscum contagiosum virus
ucccggcugccgcugccugu

SEQ ID NO: 4035683 - RNA, 15 nt, Molluscum contagiosum virus
ucccgggcggcgcgc

SEQ ID NO: 4035684 - RNA, 18 nt, Molluscum contagiosum virus
ucccugccacaugcagua

SEQ ID NO: 4035685 - RNA, 16 nt, Molluscum contagiosum virus
uccgacccggcucgcu

SEQ ID NO: 4035686 - RNA, 17 nt, Molluscum contagiosum virus
uccgacccgugcugcuu

SEQ ID NO: 4035687 - RNA, 16 nt, Molluscum contagiosum virus
uccgaccgugcccugg

SEQ ID NO: 4035688 - RNA, 18 nt, Molluscum contagiosum virus
uccgagccggacgcgcga

SEQ ID NO: 4035689 - RNA, 14 nt, Molluscum contagiosum virus
uccgaggacgacgc

SEQ ID NO: 4035690 - RNA, 21 nt, Molluscum contagiosum virus
uccgcaggcgucaugcgcgcg

SEQ ID NO: 4035691 - RNA, 22 nt, Molluscum contagiosum virus
uccgccucggaaaacgcccgag

SEQ ID NO: 4035692 - RNA, 18 nt, Molluscum contagiosum virus
uccgcgacgaacucgaca

SEQ ID NO: 4035693 - RNA, 15 nt, Molluscum contagiosum virus
uccgcggcacgcgag

SEQ ID NO: 4035694 - RNA, 15 nt, Molluscum contagiosum virus
uccgcguacagcgcg

SEQ ID NO: 4035695 - RNA, 17 nt, Molluscum contagiosum virus
uccgcucgcgcugcuuc

SEQ ID NO: 4035696 - RNA, 12 nt, Molluscum contagiosum virus
uccgcucucgag

SEQ ID NO: 4035697 - RNA, 16 nt, Molluscum contagiosum virus
uccggcagcuggagcu

SEQ ID NO: 4035698 - RNA, 22 nt, Molluscum contagiosum virus
uccggcggcuggaccugcgcca

SEQ ID NO: 4035699 - RNA, 18 nt, Molluscum contagiosum virus
uccgggcacguccgccuc

SEQ ID NO: 4035700 - RNA, 14 nt, Molluscum contagiosum virus
uccggggcgcaagc

SEQ ID NO: 4035701 - RNA, 16 nt, Molluscum contagiosum virus
uccucaccuuccuggg

SEQ ID NO: 4035702 - RNA, 20 nt, Molluscum contagiosum virus
uccuccaauccuccugccgc

SEQ ID NO: 4035703 - RNA, 22 nt, Molluscum contagiosum virus
uccucgagagggagcagccucc

SEQ ID NO: 4035704 - RNA, 13 nt, Molluscum contagiosum virus
uccucggcgcaca

SEQ ID NO: 4035705 - RNA, 20 nt, Molluscum contagiosum virus
uccucuacaccagcuggacg

SEQ ID NO: 4035706 - RNA, 15 nt, Molluscum contagiosum virus
uccucuuggccccuc

SEQ ID NO: 4035707 - RNA, 16 nt, Molluscum contagiosum virus
uccugccgucgcccgu

SEQ ID NO: 4035708 - RNA, 19 nt, Molluscum contagiosum virus
uccugcugccgggagagga

SEQ ID NO: 4035709 - RNA, 21 nt, Molluscum contagiosum virus
uccugcuggcgcgcugcgugc

SEQ ID NO: 4035710 - RNA, 14 nt, Molluscum contagiosum virus
uccuggcaauccug

SEQ ID NO: 4035711 - RNA, 22 nt, Molluscum contagiosum virus
uccugguaguugcagcccacca

SEQ ID NO: 4035712 - RNA, 13 nt, Molluscum contagiosum virus
uccuggugugcca

SEQ ID NO: 4035713 - RNA, 19 nt, Molluscum contagiosum virus
uccuguagcaaggggucug

SEQ ID NO: 4035714 - RNA, 22 nt, Molluscum contagiosum virus
uccuucgaagaggucucucaaa

SEQ ID NO: 4035715 - RNA, 23 nt, Molluscum contagiosum virus
ucgaacgcaaggugugcgcgcug

SEQ ID NO: 4035716 - RNA, 14 nt, Molluscum contagiosum virus
ucgaacgcgcgugc

SEQ ID NO: 4035717 - RNA, 19 nt, Molluscum contagiosum virus
ucgaagaccaccagcacca

SEQ ID NO: 4035718 - RNA, 16 nt, Molluscum contagiosum virus
ucgaagcccagcuuca

SEQ ID NO: 4035719 - RNA, 17 nt, Molluscum contagiosum virus
ucgaagcccagcuucag

SEQ ID NO: 4035720 - RNA, 18 nt, Molluscum contagiosum virus
ucgaccaaaugcgcgugc

SEQ ID NO: 4035721 - RNA, 16 nt, Molluscum contagiosum virus
ucgacgacgcgcgcac

SEQ ID NO: 4035722 - RNA, 17 nt, Molluscum contagiosum virus
ucgacgacgcgcgcacg

SEQ ID NO: 4035723 - RNA, 13 nt, Molluscum contagiosum virus
ucgacgcgcgcgg

SEQ ID NO: 4035724 - RNA, 18 nt, Molluscum contagiosum virus
ucgacggcuucauccgcg

SEQ ID NO: 4035725 - RNA, 20 nt, Molluscum contagiosum virus
ucgacggcuucauccgcgcg

SEQ ID NO: 4035726 - RNA, 20 nt, Molluscum contagiosum virus
ucgacugcgccuucugccug

SEQ ID NO: 4035727 - RNA, 18 nt, Molluscum contagiosum virus
ucgagacgcugccugacg

SEQ ID NO: 4035728 - RNA, 16 nt, Molluscum contagiosum virus
ucgagcaccugucgcg

SEQ ID NO: 4035729 - RNA, 14 nt, Molluscum contagiosum virus
ucgagcaggucauc

SEQ ID NO: 4035730 - RNA, 16 nt, Molluscum contagiosum virus
ucgagcgcgccgcgcg

SEQ ID NO: 4035731 - RNA, 18 nt, Molluscum contagiosum virus
ucgagcgcgccgcgcgcu

SEQ ID NO: 4035732 - RNA, 22 nt, Molluscum contagiosum virus
ucgagcgcgcgccugcuggcgg

SEQ ID NO: 4035733 - RNA, 17 nt, Molluscum contagiosum virus
ucgagcgcgcuggacuu

SEQ ID NO: 4035734 - RNA, 16 nt, Molluscum contagiosum virus
ucgagcuuccucaagg

SEQ ID NO: 4035735 - RNA, 16 nt, Molluscum contagiosum virus
ucgaggccuucgcgcc

SEQ ID NO: 4035736 - RNA, 17 nt, Molluscum contagiosum virus
ucgagggcgaggccaag

SEQ ID NO: 4035737 - RNA, 12 nt, Molluscum contagiosum virus
ucgagggcgccg

SEQ ID NO: 4035738 - RNA, 23 nt, Molluscum contagiosum virus
ucgagggggacgugcccuacgcg

SEQ ID NO: 4035739 - RNA, 17 nt, Molluscum contagiosum virus
ucgaugacagcaucggg

SEQ ID NO: 4035740 - RNA, 20 nt, Molluscum contagiosum virus
ucgcaagcugagcgcgcugc

SEQ ID NO: 4035741 - RNA, 22 nt, Molluscum contagiosum virus
ucgcaagucucccucgcgcgca

SEQ ID NO: 4035742 - RNA, 14 nt, Molluscum contagiosum virus
ucgcacacugcagc

SEQ ID NO: 4035743 - RNA, 15 nt, Molluscum contagiosum virus
ucgcacacugcagca

SEQ ID NO: 4035744 - RNA, 22 nt, Molluscum contagiosum virus
ucgcacgcuagcgagcgcccgu

SEQ ID NO: 4035745 - RNA, 19 nt, Molluscum contagiosum virus
ucgcagacgcagcgcgagc

SEQ ID NO: 4035746 - RNA, 23 nt, Molluscum contagiosum virus
ucgccggaggaaggacagugucu

SEQ ID NO: 4035747 - RNA, 19 nt, Molluscum contagiosum virus
ucgccggcaucgcgcugcu

SEQ ID NO: 4035748 - RNA, 17 nt, Molluscum contagiosum virus
ucgccuucuugcuggcg

SEQ ID NO: 4035749 - RNA, 20 nt, Molluscum contagiosum virus
ucgccuucuugcuggcgcuc

SEQ ID NO: 4035750 - RNA, 22 nt, Molluscum contagiosum virus
ucgcgagcacuuuggccucgcg

SEQ ID NO: 4035751 - RNA, 16 nt, Molluscum contagiosum virus
ucgcgagcguuucugc

SEQ ID NO: 4035752 - RNA, 23 nt, Molluscum contagiosum virus
ucgcgaucugcgugacccucuuc

SEQ ID NO: 4035753 - RNA, 19 nt, Molluscum contagiosum virus
ucgcgcaucaccgagcgag

SEQ ID NO: 4035754 - RNA, 14 nt, Molluscum contagiosum virus
ucgcgcccugcgcg

SEQ ID NO: 4035755 - RNA, 15 nt, Molluscum contagiosum virus
ucgcgccgcucggaa

SEQ ID NO: 4035756 - RNA, 19 nt, Molluscum contagiosum virus
ucgcgccugaaccugggcg

SEQ ID NO: 4035757 - RNA, 14 nt, Molluscum contagiosum virus
ucgcgcgagaaguc

SEQ ID NO: 4035758 - RNA, 23 nt, Molluscum contagiosum virus
ucgcgcgccaguacgcaugcgcg

SEQ ID NO: 4035759 - RNA, 21 nt, Molluscum contagiosum virus
ucgcgcgccgcgcuggcgcgc

SEQ ID NO: 4035760 - RNA, 17 nt, Molluscum contagiosum virus
ucgcgcgccugcgcgag

SEQ ID NO: 4035761 - RNA, 18 nt, Molluscum contagiosum virus
ucgcgcguccgcaaagac

SEQ ID NO: 4035762 - RNA, 21 nt, Molluscum contagiosum virus
ucgcgcgucgcggucgcggag

SEQ ID NO: 4035763 - RNA, 12 nt, Molluscum contagiosum virus
ucgcgcgugcug

SEQ ID NO: 4035764 - RNA, 15 nt, Molluscum contagiosum virus
ucgcgcucgcgggag

SEQ ID NO: 4035765 - RNA, 14 nt, Molluscum contagiosum virus
aacccucgcaagcu

SEQ ID NO: 4035766 - RNA, 14 nt, Molluscum contagiosum virus
aacgcccaauucug

SEQ ID NO: 4035767 - RNA, 19 nt, Molluscum contagiosum virus
aacgcgaggccggccgugc

SEQ ID NO: 4035768 - RNA, 19 nt, Molluscum contagiosum virus
aacgcgcaagugugcgcau

SEQ ID NO: 4035769 - RNA, 14 nt, Molluscum contagiosum virus
aacgcgcgcucguc

SEQ ID NO: 4035770 - RNA, 18 nt, Molluscum contagiosum virus
aacgcggugagugcgcgc

SEQ ID NO: 4035771 - RNA, 12 nt, Molluscum contagiosum virus
aacgcugccgcu

SEQ ID NO: 4035772 - RNA, 22 nt, Molluscum contagiosum virus
aacggcggcgcaagcgcaagcc

SEQ ID NO: 4035773 - RNA, 15 nt, Molluscum contagiosum virus
aacgugcugcgccgc

SEQ ID NO: 4035774 - RNA, 20 nt, Molluscum contagiosum virus
aacuacuuccugcagcuguc

SEQ ID NO: 4035775 - RNA, 21 nt, Molluscum contagiosum virus
aacucgcgugccuuguucuga

SEQ ID NO: 4035776 - RNA, 14 nt, Molluscum contagiosum virus
aacucguaggacaa

SEQ ID NO: 4035777 - RNA, 14 nt, Molluscum contagiosum virus
aacucugcucgugc

SEQ ID NO: 4035778 - RNA, 18 nt, Molluscum contagiosum virus
aagaaacgggagucacuu

SEQ ID NO: 4035779 - RNA, 17 nt, Molluscum contagiosum virus
aagaaacucaggaagcg

SEQ ID NO: 4035780 - RNA, 14 nt, Molluscum contagiosum virus
aagaacaccaagag

SEQ ID NO: 4035781 - RNA, 22 nt, Molluscum contagiosum virus
aagaagaggccagcacaagccg

SEQ ID NO: 4035782 - RNA, 22 nt, Molluscum contagiosum virus
aagaagaggccggcacaagccg

SEQ ID NO: 4035783 - RNA, 22 nt, Molluscum contagiosum virus
aagagccauguuuccugcggcg

SEQ ID NO: 4035784 - RNA, 16 nt, Molluscum contagiosum virus
aagaggacguguacgc

SEQ ID NO: 4035785 - RNA, 18 nt, Molluscum contagiosum virus
aagaggccggcacaagcc

SEQ ID NO: 4035786 - RNA, 14 nt, Molluscum contagiosum virus
aagaugcugcgcgu

SEQ ID NO: 4035787 - RNA, 20 nt, Molluscum contagiosum virus
aagcaagacccagcaaggcc

SEQ ID NO: 4035788 - RNA, 15 nt, Molluscum contagiosum virus
aagcacaguccagcc

SEQ ID NO: 4035789 - RNA, 15 nt, Molluscum contagiosum virus
aagcacgagcugcug

SEQ ID NO: 4035790 - RNA, 20 nt, Molluscum contagiosum virus
aagcacgccagguguuccug

SEQ ID NO: 4035791 - RNA, 14 nt, Molluscum contagiosum virus
aagcccagcuucag

SEQ ID NO: 4035792 - RNA, 14 nt, Molluscum contagiosum virus
aagcgccgcgcgcg

SEQ ID NO: 4035793 - RNA, 18 nt, Molluscum contagiosum virus
aagcgcgaguacaagcuc

SEQ ID NO: 4035794 - RNA, 16 nt, Molluscum contagiosum virus
aagcgcucgcggcucg

SEQ ID NO: 4035795 - RNA, 12 nt, Molluscum contagiosum virus
aagcggugcagc

SEQ ID NO: 4035796 - RNA, 19 nt, Molluscum contagiosum virus
aagcugcacgugcagcggc

SEQ ID NO: 4035797 - RNA, 19 nt, Molluscum contagiosum virus
aagcuggaggcugccccuc

SEQ ID NO: 4035798 - RNA, 22 nt, Molluscum contagiosum virus
aagcuggccgaggucuuccaca

SEQ ID NO: 4035799 - RNA, 19 nt, Molluscum contagiosum virus
aagcuguaccuggugcgcc

SEQ ID NO: 4035800 - RNA, 15 nt, Molluscum contagiosum virus
aagcugucgcgcagc

SEQ ID NO: 4035801 - RNA, 14 nt, Molluscum contagiosum virus
aaggaaaacugcau

SEQ ID NO: 4035802 - RNA, 22 nt, Molluscum contagiosum virus
aaggacuaccagcucuucgugg

SEQ ID NO: 4035803 - RNA, 17 nt, Molluscum contagiosum virus
aaggcacccaccaggaa

SEQ ID NO: 4035804 - RNA, 23 nt, Molluscum contagiosum virus
aaggcaccccgcaggaaagguac

SEQ ID NO: 4035805 - RNA, 22 nt, Molluscum contagiosum virus
aaggcacccgcaggaaagguac

SEQ ID NO: 4035806 - RNA, 20 nt, Molluscum contagiosum virus
aaggcaccugcaggaaaggc

SEQ ID NO: 4035807 - RNA, 15 nt, Molluscum contagiosum virus
aaggccguccccgga

SEQ ID NO: 4035808 - RNA, 12 nt, Molluscum contagiosum virus
aaggcgccgcgu

SEQ ID NO: 4035809 - RNA, 15 nt, Molluscum contagiosum virus
aagguggccaagcgc

SEQ ID NO: 4035810 - RNA, 23 nt, Molluscum contagiosum virus
aaguaccagccgcugcgccgcca

SEQ ID NO: 4035811 - RNA, 14 nt, Molluscum contagiosum virus
aagucaugcucgcg

SEQ ID NO: 4035812 - RNA, 12 nt, Molluscum contagiosum virus
aaguccagcgcg

SEQ ID NO: 4035813 - RNA, 22 nt, Molluscum contagiosum virus
aaguccgcccccagguggagcu

SEQ ID NO: 4035814 - RNA, 13 nt, Molluscum contagiosum virus
aagucugcgcagg

SEQ ID NO: 4035815 - RNA, 14 nt, Molluscum contagiosum virus
aagugacuagcgcu

SEQ ID NO: 4035816 - RNA, 16 nt, Molluscum contagiosum virus
aagugugcgcaucccu

SEQ ID NO: 4035817 - RNA, 21 nt, Molluscum contagiosum virus
aauaccggagacaccagcucc

SEQ ID NO: 4035818 - RNA, 24 nt, Molluscum contagiosum virus
aaucccacguacgagcagcugcug

SEQ ID NO: 4035819 - RNA, 12 nt, Molluscum contagiosum virus
aaugacgcgcac

SEQ ID NO: 4035820 - RNA, 23 nt, Molluscum contagiosum virus
aaugacgcgcacgccagccugga

SEQ ID NO: 4035821 - RNA, 18 nt, Molluscum contagiosum virus
aaugcaugcggagcuggc

SEQ ID NO: 4035822 - RNA, 18 nt, Molluscum contagiosum virus
aauggacacgcacuggcg

SEQ ID NO: 4035823 - RNA, 13 nt, Molluscum contagiosum virus
acaaaaacugaaa

SEQ ID NO: 4035824 - RNA, 21 nt, Molluscum contagiosum virus
acaaacacgcgcgcgcgaagg

SEQ ID NO: 4035825 - RNA, 16 nt, Molluscum contagiosum virus
acaaagggguccgcgu

SEQ ID NO: 4035826 - RNA, 14 nt, Molluscum contagiosum virus
acaaccacagcucu

SEQ ID NO: 4035827 - RNA, 19 nt, Molluscum contagiosum virus
acaacucauagcgccacga

SEQ ID NO: 4035828 - RNA, 22 nt, Molluscum contagiosum virus
acaacuccggcgucgaaacacu

SEQ ID NO: 4035829 - RNA, 16 nt, Molluscum contagiosum virus
acaacucugcucgugc

SEQ ID NO: 4035830 - RNA, 23 nt, Molluscum contagiosum virus
acaagaagcgcuucuuugcgcgc

SEQ ID NO: 4035831 - RNA, 20 nt, Molluscum contagiosum virus
acaagauggcgcagcacuuc

SEQ ID NO: 4035832 - RNA, 22 nt, Molluscum contagiosum virus
acaagcguaagccaccgcgcag

SEQ ID NO: 4035833 - RNA, 16 nt, Molluscum contagiosum virus
acaagcguguucgugc

SEQ ID NO: 4035834 - RNA, 16 nt, Molluscum contagiosum virus
acaaggaaaggcaccc

SEQ ID NO: 4035835 - RNA, 20 nt, Molluscum contagiosum virus
acaaggaaaggcacccacca

SEQ ID NO: 4035836 - RNA, 16 nt, Molluscum contagiosum virus
acaaggaggcuuucuu

SEQ ID NO: 4035837 - RNA, 14 nt, Molluscum contagiosum virus
acaagggcagcuca

SEQ ID NO: 4035838 - RNA, 21 nt, Molluscum contagiosum virus
acaagucgucgaucgccucga

SEQ ID NO: 4035839 - RNA, 23 nt, Molluscum contagiosum virus
acaaugaggagaggaaccaggau

SEQ ID NO: 4035840 - RNA, 12 nt, Molluscum contagiosum virus
acacacucgcgc

SEQ ID NO: 4035841 - RNA, 16 nt, Molluscum contagiosum virus
acacacucgcgcgucc

SEQ ID NO: 4035842 - RNA, 12 nt, Molluscum contagiosum virus
acacagggcuuc

SEQ ID NO: 4035843 - RNA, 16 nt, Molluscum contagiosum virus
acacauggccgcgcgc

SEQ ID NO: 4035844 - RNA, 12 nt, Molluscum contagiosum virus
acaccaugcagc

SEQ ID NO: 4035845 - RNA, 18 nt, Molluscum contagiosum virus
acacccgugcccgcuccg

SEQ ID NO: 4035846 - RNA, 12 nt, Molluscum contagiosum virus
acaccuccugcu

SEQ ID NO: 4035847 - RNA, 16 nt, Molluscum contagiosum virus
acacgagggccuuggc

SEQ ID NO: 4035848 - RNA, 14 nt, Molluscum contagiosum virus
acacgccgcuggag

SEQ ID NO: 4035849 - RNA, 14 nt, Molluscum contagiosum virus
acacgcgcgcgugc

SEQ ID NO: 4035850 - RNA, 19 nt, Molluscum contagiosum virus
acacgcgcgcgugcugcug

SEQ ID NO: 4035851 - RNA, 15 nt, Molluscum contagiosum virus
acacgcgucgcgcag

SEQ ID NO: 4035852 - RNA, 16 nt, Molluscum contagiosum virus
acacggauacgcgcac

SEQ ID NO: 4035853 - RNA, 18 nt, Molluscum contagiosum virus
acacgucagccgcacggc

SEQ ID NO: 4035854 - RNA, 14 nt, Molluscum contagiosum virus
acacgucuugcaga

SEQ ID NO: 4035855 - RNA, 15 nt, Molluscum contagiosum virus
acacucuucgcaggc

SEQ ID NO: 4035856 - RNA, 21 nt, Molluscum contagiosum virus
acacugcagaaacagccgugc

SEQ ID NO: 4035857 - RNA, 15 nt, Molluscum contagiosum virus
acacuuuccgucguc

SEQ ID NO: 4035858 - RNA, 13 nt, Molluscum contagiosum virus
acagacggcgcgc

SEQ ID NO: 4035859 - RNA, 18 nt, Molluscum contagiosum virus
acagacgugcacaaagcc

SEQ ID NO: 4035860 - RNA, 16 nt, Molluscum contagiosum virus
acagagaaaggcaccc

SEQ ID NO: 4035861 - RNA, 13 nt, Molluscum contagiosum virus
acagagccccguu

SEQ ID NO: 4035862 - RNA, 17 nt, Molluscum contagiosum virus
acagagcccgcggcgca

SEQ ID NO: 4035863 - RNA, 13 nt, Molluscum contagiosum virus
acagagggacagc

SEQ ID NO: 4035864 - RNA, 16 nt, Molluscum contagiosum virus
acagcacggcacgugc

SEQ ID NO: 4035865 - RNA, 13 nt, Molluscum contagiosum virus
acagcagccgcag

SEQ ID NO: 4035866 - RNA, 14 nt, Molluscum contagiosum virus
acagcauccuggag

SEQ ID NO: 4035867 - RNA, 23 nt, Molluscum contagiosum virus
acagccgccugccgcgcucgugc

SEQ ID NO: 4035868 - RNA, 22 nt, Molluscum contagiosum virus
cacgcgcacgggccugcgcgcu

SEQ ID NO: 4035869 - RNA, 23 nt, Molluscum contagiosum virus
cacgcgcgagcggagcgggcacg

SEQ ID NO: 4035870 - RNA, 13 nt, Molluscum contagiosum virus
cacgcgcgggcau

SEQ ID NO: 4035871 - RNA, 11 nt, Molluscum contagiosum virus
cacgcggccau

SEQ ID NO: 4035872 - RNA, 21 nt, Molluscum contagiosum virus
cacgcggcgcgugucgcggag

SEQ ID NO: 4035873 - RNA, 15 nt, Molluscum contagiosum virus
cacgcgggcgccggc

SEQ ID NO: 4035874 - RNA, 22 nt, Molluscum contagiosum virus
cacgcgguugcaauagacacgg

SEQ ID NO: 4035875 - RNA, 22 nt, Molluscum contagiosum virus
cacgcgugcugcgcggcgccgc

SEQ ID NO: 4035876 - RNA, 24 nt, Molluscum contagiosum virus
cacgcgugcugcgcggcgccgcag

SEQ ID NO: 4035877 - RNA, 16 nt, Molluscum contagiosum virus
cacgcgugucugcgcu

SEQ ID NO: 4035878 - RNA, 18 nt, Molluscum contagiosum virus
cacgcgugucugcgcucg

SEQ ID NO: 4035879 - RNA, 18 nt, Molluscum contagiosum virus
cacgcuacggcugccggc

SEQ ID NO: 4035880 - RNA, 13 nt, Molluscum contagiosum virus
cacgcuagcgggc

SEQ ID NO: 4035881 - RNA, 24 nt, Molluscum contagiosum virus
cacgcucaucucgcagacgcagcg

SEQ ID NO: 4035882 - RNA, 18 nt, Molluscum contagiosum virus
cacgcugacgcgcagugc

SEQ ID NO: 4035883 - RNA, 18 nt, Molluscum contagiosum virus
cacgcugcucgugcugcu

SEQ ID NO: 4035884 - RNA, 23 nt, Molluscum contagiosum virus
cacgcugcucgugcugcucugcg

SEQ ID NO: 4035885 - RNA, 19 nt, Molluscum contagiosum virus
cacgcuggucacgcgcuuc

SEQ ID NO: 4035886 - RNA, 14 nt, Molluscum contagiosum virus
cacgcuguccaggc

SEQ ID NO: 4035887 - RNA, 18 nt, Molluscum contagiosum virus
cacgcuguugcugcugcc

SEQ ID NO: 4035888 - RNA, 19 nt, Molluscum contagiosum virus
cacgcuugugcgcacgcug

SEQ ID NO: 4035889 - RNA, 20 nt, Molluscum contagiosum virus
cacggacccgggcgcggcac

SEQ ID NO: 4035890 - RNA, 20 nt, Molluscum contagiosum virus
cacggacucgccgcgcgccg

SEQ ID NO: 4035891 - RNA, 23 nt, Molluscum contagiosum virus
cacggagacgucuggggauggcc

SEQ ID NO: 4035892 - RNA, 18 nt, Molluscum contagiosum virus
cacggcacccgccagcuu

SEQ ID NO: 4035893 - RNA, 18 nt, Molluscum contagiosum virus
cacggccuccagcagcgg

SEQ ID NO: 4035894 - RNA, 22 nt, Molluscum contagiosum virus
cacggcgacaacgacagagccc

SEQ ID NO: 4035895 - RNA, 13 nt, Molluscum contagiosum virus
cacggcgagcgcg

SEQ ID NO: 4035896 - RNA, 18 nt, Molluscum contagiosum virus
cacggcguucaccuuggc

SEQ ID NO: 4035897 - RNA, 22 nt, Molluscum contagiosum virus
cacggcguucaccuuggcgcug

SEQ ID NO: 4035898 - RNA, 18 nt, Molluscum contagiosum virus
cacggcuugccgcucggc

SEQ ID NO: 4035899 - RNA, 14 nt, Molluscum contagiosum virus
cacgggaaggcucu

SEQ ID NO: 4035900 - RNA, 17 nt, Molluscum contagiosum virus
cacgggaaggcucucaa

SEQ ID NO: 4035901 - RNA, 21 nt, Molluscum contagiosum virus
cacgggcaugcacagcugcuc

SEQ ID NO: 4035902 - RNA, 14 nt, Molluscum contagiosum virus
cacguacgagcagc

SEQ ID NO: 4035903 - RNA, 22 nt, Molluscum contagiosum virus
cacguccuccaauccuccugcc

SEQ ID NO: 4035904 - RNA, 14 nt, Molluscum contagiosum virus
cacgucuucgccgu

SEQ ID NO: 4035905 - RNA, 20 nt, Molluscum contagiosum virus
cacgugccccgcgcgugcag

SEQ ID NO: 4035906 - RNA, 18 nt, Molluscum contagiosum virus
cacgugcugcagcugcgc

SEQ ID NO: 4035907 - RNA, 23 nt, Molluscum contagiosum virus
cacgugcugcugcggcugcugga

SEQ ID NO: 4035908 - RNA, 17 nt, Molluscum contagiosum virus
cacguggaaucacggcc

SEQ ID NO: 4035909 - RNA, 15 nt, Molluscum contagiosum virus
cacguggaccugauu

SEQ ID NO: 4035910 - RNA, 20 nt, Molluscum contagiosum virus
cacguugccgcgcgcugcuc

SEQ ID NO: 4035911 - RNA, 22 nt, Molluscum contagiosum virus
cacguugggguugucgggcgcu

SEQ ID NO: 4035912 - RNA, 19 nt, Molluscum contagiosum virus
cacguuuuucgcgggcgcc

SEQ ID NO: 4035913 - RNA, 19 nt, Molluscum contagiosum virus
cacuaccgcaaccagcugc

SEQ ID NO: 4035914 - RNA, 18 nt, Molluscum contagiosum virus
cacuagcaaggcgccgcg

SEQ ID NO: 4035915 - RNA, 16 nt, Molluscum contagiosum virus
cacuccagcgcgcccu

SEQ ID NO: 4035916 - RNA, 14 nt, Molluscum contagiosum virus
cacuccgucgcgcu

SEQ ID NO: 4035917 - RNA, 21 nt, Molluscum contagiosum virus
cacucgcuggccucugccugc

SEQ ID NO: 4035918 - RNA, 21 nt, Molluscum contagiosum virus
cacugacgguacucaugcugc

SEQ ID NO: 4035919 - RNA, 15 nt, Molluscum contagiosum virus
cacugccacggcugc

SEQ ID NO: 4035920 - RNA, 15 nt, Molluscum contagiosum virus
cacugcguacacaug

SEQ ID NO: 4035921 - RNA, 11 nt, Molluscum contagiosum virus
cacugcuggcg

SEQ ID NO: 4035922 - RNA, 15 nt, Molluscum contagiosum virus
cacugcuggcgcgcg

SEQ ID NO: 4035923 - RNA, 19 nt, Molluscum contagiosum virus
cacuggaagaacaggccgc

SEQ ID NO: 4035924 - RNA, 13 nt, Molluscum contagiosum virus
cacuggaggugag

SEQ ID NO: 4035925 - RNA, 11 nt, Molluscum contagiosum virus
cacuggcccug

SEQ ID NO: 4035926 - RNA, 22 nt, Molluscum contagiosum virus
cacugggaacaccacacgcgcg

SEQ ID NO: 4035927 - RNA, 15 nt, Molluscum contagiosum virus
cacuguaaucgucac

SEQ ID NO: 4035928 - RNA, 19 nt, Molluscum contagiosum virus
cacugucguaacaauggac

SEQ ID NO: 4035929 - RNA, 19 nt, Molluscum contagiosum virus
cacugugcugacccccucc

SEQ ID NO: 4035930 - RNA, 17 nt, Molluscum contagiosum virus
cacugugcuggcgcacu

SEQ ID NO: 4035931 - RNA, 15 nt, Molluscum contagiosum virus
cacuucgucaagcag

SEQ ID NO: 4035932 - RNA, 22 nt, Molluscum contagiosum virus
cacuucucgagaccucgcgcuu

SEQ ID NO: 4035933 - RNA, 20 nt, Molluscum contagiosum virus
cacuugcgcgcgugccugug

SEQ ID NO: 4035934 - RNA, 15 nt, Molluscum contagiosum virus
cagaaacucuccgac

SEQ ID NO: 4035935 - RNA, 15 nt, Molluscum contagiosum virus
cagaagcgagagcgc

SEQ ID NO: 4035936 - RNA, 23 nt, Molluscum contagiosum virus
cagaaggcguaugcgccaagccu

SEQ ID NO: 4035937 - RNA, 21 nt, Molluscum contagiosum virus
cagaaggggggguaaugcaga

SEQ ID NO: 4035938 - RNA, 18 nt, Molluscum contagiosum virus
cagacgcagagccaugcc

SEQ ID NO: 4035939 - RNA, 17 nt, Molluscum contagiosum virus
cagacgcagcgcgagcu

SEQ ID NO: 4035940 - RNA, 17 nt, Molluscum contagiosum virus
cagacgugcacaaagcc

SEQ ID NO: 4035941 - RNA, 15 nt, Molluscum contagiosum virus
cagacguggugcucg

SEQ ID NO: 4035942 - RNA, 14 nt, Molluscum contagiosum virus
cagagaaaggcacc

SEQ ID NO: 4035943 - RNA, 19 nt, Molluscum contagiosum virus
cagagaaaggcacccacca

SEQ ID NO: 4035944 - RNA, 23 nt, Molluscum contagiosum virus
cagagaaaggcacccaccaggaa

SEQ ID NO: 4035945 - RNA, 22 nt, Molluscum contagiosum virus
cagagaaaucccaagagccaug

SEQ ID NO: 4035946 - RNA, 17 nt, Molluscum contagiosum virus
cagagcacugcgcgucu

SEQ ID NO: 4035947 - RNA, 17 nt, Molluscum contagiosum virus
cagagcauuagcagcga

SEQ ID NO: 4035948 - RNA, 23 nt, Molluscum contagiosum virus
cagagcccaaggggagacauaug

SEQ ID NO: 4035949 - RNA, 13 nt, Molluscum contagiosum virus
cagagccgggacg

SEQ ID NO: 4035950 - RNA, 15 nt, Molluscum contagiosum virus
cagagccugcugcuc

SEQ ID NO: 4035951 - RNA, 12 nt, Molluscum contagiosum virus
cagagcgccagc

SEQ ID NO: 4035952 - RNA, 17 nt, Molluscum contagiosum virus
cagagcgugcuggucaa

SEQ ID NO: 4035953 - RNA, 19 nt, Molluscum contagiosum virus
cagagcuccccgcgcgcag

SEQ ID NO: 4035954 - RNA, 19 nt, Molluscum contagiosum virus
cagagcugcccgccagaag

SEQ ID NO: 4035955 - RNA, 15 nt, Molluscum contagiosum virus
cagaggacuuuaucu

SEQ ID NO: 4035956 - RNA, 19 nt, Molluscum contagiosum virus
cagauaguuuggacgagcu

SEQ ID NO: 4035957 - RNA, 17 nt, Molluscum contagiosum virus
cagauccgggcgcugca

SEQ ID NO: 4035958 - RNA, 22 nt, Molluscum contagiosum virus
cagauccgggcgcugcaccgcu

SEQ ID NO: 4035959 - RNA, 16 nt, Molluscum contagiosum virus
cagaucgcgagaggag

SEQ ID NO: 4035960 - RNA, 18 nt, Molluscum contagiosum virus
cagauucacgagcucggu

SEQ ID NO: 4035961 - RNA, 22 nt, Molluscum contagiosum virus
cagauucggaggcggagcugcc

SEQ ID NO: 4035962 - RNA, 16 nt, Molluscum contagiosum virus
cagcaaacagccugug

SEQ ID NO: 4035963 - RNA, 17 nt, Molluscum contagiosum virus
cagcacaccgucgcgug

SEQ ID NO: 4035964 - RNA, 14 nt, Molluscum contagiosum virus
cagcaccaucacgu

SEQ ID NO: 4035965 - RNA, 15 nt, Molluscum contagiosum virus
cagcaccgcgccgcg

SEQ ID NO: 4035966 - RNA, 12 nt, Molluscum contagiosum virus
cagcaccugcag

SEQ ID NO: 4035967 - RNA, 17 nt, Molluscum contagiosum virus
cagcaccugcaguucca

SEQ ID NO: 4035968 - RNA, 22 nt, Molluscum contagiosum virus
cagcacgggccggggccucgcg

SEQ ID NO: 4035969 - RNA, 21 nt, Molluscum contagiosum virus
cagcagcggcgcgugcuccuc

SEQ ID NO: 4035970 - RNA, 15 nt, Molluscum contagiosum virus
ccacgagcagugccg

SEQ ID NO: 4035971 - RNA, 22 nt, Molluscum contagiosum virus
ccacgagcgccgcgugcgcgcg

SEQ ID NO: 4035972 - RNA, 19 nt, Molluscum contagiosum virus
ccacgagcguguccaggug

SEQ ID NO: 4035973 - RNA, 21 nt, Molluscum contagiosum virus
ccacgcagcuggcgggcgugc

SEQ ID NO: 4035974 - RNA, 13 nt, Molluscum contagiosum virus
ccacgcgugcgcg

SEQ ID NO: 4035975 - RNA, 17 nt, Molluscum contagiosum virus
ccacgcgugcugcgcgg

SEQ ID NO: 4035976 - RNA, 15 nt, Molluscum contagiosum virus
ccacggcgagcugcc

SEQ ID NO: 4035977 - RNA, 18 nt, Molluscum contagiosum virus
ccacggguaccgugcgcg

SEQ ID NO: 4035978 - RNA, 19 nt, Molluscum contagiosum virus
ccacguacgagcagcugcu

SEQ ID NO: 4035979 - RNA, 13 nt, Molluscum contagiosum virus
ccacgugcgcugg

SEQ ID NO: 4035980 - RNA, 22 nt, Molluscum contagiosum virus
ccacgugcgcuggcccacgcug

SEQ ID NO: 4035981 - RNA, 20 nt, Molluscum contagiosum virus
ccacuccgucgcgcucgaag

SEQ ID NO: 4035982 - RNA, 11 nt, Molluscum contagiosum virus
ccacugggaac

SEQ ID NO: 4035983 - RNA, 19 nt, Molluscum contagiosum virus
ccagacaaagucgacgaca

SEQ ID NO: 4035984 - RNA, 13 nt, Molluscum contagiosum virus
ccagacgcagagc

SEQ ID NO: 4035985 - RNA, 17 nt, Molluscum contagiosum virus
ccagagccuucucggug

SEQ ID NO: 4035986 - RNA, 21 nt, Molluscum contagiosum virus
ccagaggguggcuugcugcag

SEQ ID NO: 4035987 - RNA, 17 nt, Molluscum contagiosum virus
ccagauccgggcgcugc

SEQ ID NO: 4035988 - RNA, 20 nt, Molluscum contagiosum virus
ccagauguucucgccagugg

SEQ ID NO: 4035989 - RNA, 20 nt, Molluscum contagiosum virus
ccagauuagcaacugcccca

SEQ ID NO: 4035990 - RNA, 20 nt, Molluscum contagiosum virus
ccagauugccggcgcgcgcu

SEQ ID NO: 4035991 - RNA, 12 nt, Molluscum contagiosum virus
ccagcacgcgcg

SEQ ID NO: 4035992 - RNA, 9 nt, Molluscum contagiosum virus
ccagcagcg

SEQ ID NO: 4035993 - RNA, 13 nt, Molluscum contagiosum virus
ccagcagcgccag

SEQ ID NO: 4035994 - RNA, 15 nt, Molluscum contagiosum virus
ccagcagcugcuccg

SEQ ID NO: 4035995 - RNA, 18 nt, Molluscum contagiosum virus
ccagcagguagcuggcag

SEQ ID NO: 4035996 - RNA, 12 nt, Molluscum contagiosum virus
ccagccgcagcc

SEQ ID NO: 4035997 - RNA, 23 nt, Molluscum contagiosum virus
ccagccgcucguccagcugcgcg

SEQ ID NO: 4035998 - RNA, 15 nt, Molluscum contagiosum virus
ccagccgcugcgccg

SEQ ID NO: 4035999 - RNA, 21 nt, Molluscum contagiosum virus
ccagccugcucacgcccgagg

SEQ ID NO: 4036000 - RNA, 22 nt, Molluscum contagiosum virus
ccagccuggcggccaaccgccu

SEQ ID NO: 4036001 - RNA, 23 nt, Molluscum contagiosum virus
ccagcgagaucaacgcgcgcgug

SEQ ID NO: 4036002 - RNA, 14 nt, Molluscum contagiosum virus
ccagcgccuccgcg

SEQ ID NO: 4036003 - RNA, 15 nt, Molluscum contagiosum virus
ccagcgcgcagaagc

SEQ ID NO: 4036004 - RNA, 16 nt, Molluscum contagiosum virus
ccagcgcgcccaccag

SEQ ID NO: 4036005 - RNA, 13 nt, Molluscum contagiosum virus
ccagcggcgccgc

SEQ ID NO: 4036006 - RNA, 16 nt, Molluscum contagiosum virus
ccagcggcgccgcagc

SEQ ID NO: 4036007 - RNA, 13 nt, Molluscum contagiosum virus
ccagcggcugccc

SEQ ID NO: 4036008 - RNA, 18 nt, Molluscum contagiosum virus
ccagcguacggcccgaag

SEQ ID NO: 4036009 - RNA, 18 nt, Molluscum contagiosum virus
ccagcguggccagcuuca

SEQ ID NO: 4036010 - RNA, 14 nt, Molluscum contagiosum virus
ccagcuccgccggg

SEQ ID NO: 4036011 - RNA, 13 nt, Molluscum contagiosum virus
ccagcuccgcgcg

SEQ ID NO: 4036012 - RNA, 19 nt, Molluscum contagiosum virus
ccagcucuuggcgggcacc

SEQ ID NO: 4036013 - RNA, 14 nt, Molluscum contagiosum virus
ccagcugcaaacau

SEQ ID NO: 4036014 - RNA, 22 nt, Molluscum contagiosum virus
ccagcugcaaacauugccuggc

SEQ ID NO: 4036015 - RNA, 20 nt, Molluscum contagiosum virus
ccagcuucaucaagcacggc

SEQ ID NO: 4036016 - RNA, 12 nt, Molluscum contagiosum virus
ccaggaucacga

SEQ ID NO: 4036017 - RNA, 17 nt, Molluscum contagiosum virus
ccaggcacacgcagugc

SEQ ID NO: 4036018 - RNA, 13 nt, Molluscum contagiosum virus
ccagucgcgcgag

SEQ ID NO: 4036019 - RNA, 15 nt, Molluscum contagiosum virus
ccagucucgcgcuuc

SEQ ID NO: 4036020 - RNA, 20 nt, Molluscum contagiosum virus
ccagugcgccucggacuucg

SEQ ID NO: 4036021 - RNA, 17 nt, Molluscum contagiosum virus
ccauacgccuagccugc

SEQ ID NO: 4036022 - RNA, 23 nt, Molluscum contagiosum virus
ccaucggagaagugcuccgcacg

SEQ ID NO: 4036023 - RNA, 14 nt, Molluscum contagiosum virus
ccaucggugggcuc

SEQ ID NO: 4036024 - RNA, 13 nt, Molluscum contagiosum virus
ccaucguggugga

SEQ ID NO: 4036025 - RNA, 17 nt, Molluscum contagiosum virus
ccaugcccacgcgcaag

SEQ ID NO: 4036026 - RNA, 18 nt, Molluscum contagiosum virus
ccaugcccgaccacgugc

SEQ ID NO: 4036027 - RNA, 16 nt, Molluscum contagiosum virus
ccaugucgaacaccuc

SEQ ID NO: 4036028 - RNA, 16 nt, Molluscum contagiosum virus
ccauguuuccugcggc

SEQ ID NO: 4036029 - RNA, 22 nt, Molluscum contagiosum virus
cccaagagccauguuuccugcg

SEQ ID NO: 4036030 - RNA, 22 nt, Molluscum contagiosum virus
cccaagcgcaccguugacgagc

SEQ ID NO: 4036031 - RNA, 14 nt, Molluscum contagiosum virus
cccaagugcgcgug

SEQ ID NO: 4036032 - RNA, 11 nt, Molluscum contagiosum virus
cccaccaggaa

SEQ ID NO: 4036033 - RNA, 14 nt, Molluscum contagiosum virus
cccacgcuguacau

SEQ ID NO: 4036034 - RNA, 19 nt, Molluscum contagiosum virus
cccacguacgagcagcugc

SEQ ID NO: 4036035 - RNA, 16 nt, Molluscum contagiosum virus
cccacgugccagcuca

SEQ ID NO: 4036036 - RNA, 15 nt, Molluscum contagiosum virus
cccacugugccagca

SEQ ID NO: 4036037 - RNA, 14 nt, Molluscum contagiosum virus
cccagcguggccag

SEQ ID NO: 4036038 - RNA, 21 nt, Molluscum contagiosum virus
cccaggaagacgugcugcgcg

SEQ ID NO: 4036039 - RNA, 15 nt, Molluscum contagiosum virus
cccaugcccgaccac

SEQ ID NO: 4036040 - RNA, 16 nt, Molluscum contagiosum virus
cccauuagugugccuc

SEQ ID NO: 4036041 - RNA, 16 nt, Molluscum contagiosum virus
cccccagguggagcug

SEQ ID NO: 4036042 - RNA, 13 nt, Molluscum contagiosum virus
ccccgaaggaaag

SEQ ID NO: 4036043 - RNA, 16 nt, Molluscum contagiosum virus
ccccgacgccagcgcg

SEQ ID NO: 4036044 - RNA, 15 nt, Molluscum contagiosum virus
ccccgcacaagggca

SEQ ID NO: 4036045 - RNA, 21 nt, Molluscum contagiosum virus
ccccgcaggaaaggcaccccg

SEQ ID NO: 4036046 - RNA, 12 nt, Molluscum contagiosum virus
ccccgccagcac

SEQ ID NO: 4036047 - RNA, 13 nt, Molluscum contagiosum virus
ccccgccgcggcg

SEQ ID NO: 4036048 - RNA, 15 nt, Molluscum contagiosum virus
ccccgcgcgugcagu

SEQ ID NO: 4036049 - RNA, 14 nt, Molluscum contagiosum virus
ccccgcgcugcgcg

SEQ ID NO: 4036050 - RNA, 13 nt, Molluscum contagiosum virus
ccccgcugggccg

SEQ ID NO: 4036051 - RNA, 18 nt, Molluscum contagiosum virus
ccccgguucccggugcug

SEQ ID NO: 4036052 - RNA, 21 nt, Molluscum contagiosum virus
ccccguccgugucgagcugcc

SEQ ID NO: 4036053 - RNA, 19 nt, Molluscum contagiosum virus
ccccuagaagaccacaucc

SEQ ID NO: 4036054 - RNA, 23 nt, Molluscum contagiosum virus
ccccuugcgucuccgcgaguccu

SEQ ID NO: 4036055 - RNA, 13 nt, Molluscum contagiosum virus
cccgaacugcugg

SEQ ID NO: 4036056 - RNA, 15 nt, Molluscum contagiosum virus
cccgaacugcugggc

SEQ ID NO: 4036057 - RNA, 22 nt, Molluscum contagiosum virus
cccgacacguugcacugcgcgg

SEQ ID NO: 4036058 - RNA, 19 nt, Molluscum contagiosum virus
cccgacuuuucgcgccgcg

SEQ ID NO: 4036059 - RNA, 15 nt, Molluscum contagiosum virus
cccgagcccgcggcg

SEQ ID NO: 4036060 - RNA, 12 nt, Molluscum contagiosum virus
cccgaggacgcg

SEQ ID NO: 4036061 - RNA, 16 nt, Molluscum contagiosum virus
cccgaggacgcgggcg

SEQ ID NO: 4036062 - RNA, 17 nt, Molluscum contagiosum virus
cccgaggagagcggcgc

SEQ ID NO: 4036063 - RNA, 17 nt, Molluscum contagiosum virus
cccgaggcguccagcgg

SEQ ID NO: 4036064 - RNA, 21 nt, Molluscum contagiosum virus
cccgaggucaagggugugggc

SEQ ID NO: 4036065 - RNA, 21 nt, Molluscum contagiosum virus
cccgaguuccuguugcgcgag

SEQ ID NO: 4036066 - RNA, 15 nt, Molluscum contagiosum virus
cccgcaaccccgcgc

SEQ ID NO: 4036067 - RNA, 13 nt, Molluscum contagiosum virus
cccgcaagccaca

SEQ ID NO: 4036068 - RNA, 19 nt, Molluscum contagiosum virus
cccgccagcaccaugcgug

SEQ ID NO: 4036069 - RNA, 14 nt, Molluscum contagiosum virus
cccgcccagcgugg

SEQ ID NO: 4036070 - RNA, 16 nt, Molluscum contagiosum virus
cccgccgcgugcccgu

SEQ ID NO: 4036071 - RNA, 17 nt, Molluscum contagiosum virus
cccgccugccgcgagca

SEQ ID NO: 4036072 - RNA, 22 nt, Molluscum contagiosum virus
cccgcgaacgagggacacgcac

SEQ ID NO: 4036073 - RNA, 13 nt, Molluscum contagiosum virus
ccgugcuugcuag

SEQ ID NO: 4036074 - RNA, 20 nt, Molluscum contagiosum virus
ccgugggcagcuucugcucg

SEQ ID NO: 4036075 - RNA, 13 nt, Molluscum contagiosum virus
ccgugggcgccgc

SEQ ID NO: 4036076 - RNA, 18 nt, Molluscum contagiosum virus
ccguguccuacacgccgc

SEQ ID NO: 4036077 - RNA, 18 nt, Molluscum contagiosum virus
ccgugucgggcugcaucu

SEQ ID NO: 4036078 - RNA, 17 nt, Molluscum contagiosum virus
ccgugugcgaagggcuu

SEQ ID NO: 4036079 - RNA, 14 nt, Molluscum contagiosum virus
ccuaccgcgcggga

SEQ ID NO: 4036080 - RNA, 24 nt, Molluscum contagiosum virus
ccuacgaggugcugcgccacgugc

SEQ ID NO: 4036081 - RNA, 17 nt, Molluscum contagiosum virus
ccuacgcuaccugaagc

SEQ ID NO: 4036082 - RNA, 22 nt, Molluscum contagiosum virus
ccuacgcuaccugaagcuggac

SEQ ID NO: 4036083 - RNA, 21 nt, Molluscum contagiosum virus
ccuacguggcgucgcgccgcu

SEQ ID NO: 4036084 - RNA, 14 nt, Molluscum contagiosum virus
ccuagacacgagcg

SEQ ID NO: 4036085 - RNA, 23 nt, Molluscum contagiosum virus
ccuagagcuggcaccgggcgccg

SEQ ID NO: 4036086 - RNA, 20 nt, Molluscum contagiosum virus
ccuagaggaugcggauccuc

SEQ ID NO: 4036087 - RNA, 11 nt, Molluscum contagiosum virus
ccuagcuccag

SEQ ID NO: 4036088 - RNA, 19 nt, Molluscum contagiosum virus
ccuauaaauggacgcgcuc

SEQ ID NO: 4036089 - RNA, 16 nt, Molluscum contagiosum virus
ccucccaagcagcgcg

SEQ ID NO: 4036090 - RNA, 14 nt, Molluscum contagiosum virus
ccuccgagcgcgcg

SEQ ID NO: 4036091 - RNA, 13 nt, Molluscum contagiosum virus
ccuccgcucugag

SEQ ID NO: 4036092 - RNA, 23 nt, Molluscum contagiosum virus
ccuccgguuuucgcgggagcggc

SEQ ID NO: 4036093 - RNA, 21 nt, Molluscum contagiosum virus
ccuccguguccgacgccgcca

SEQ ID NO: 4036094 - RNA, 22 nt, Molluscum contagiosum virus
ccucgacgaggccuacagcgcg

SEQ ID NO: 4036095 - RNA, 18 nt, Molluscum contagiosum virus
ccucgagaaagucaugcu

SEQ ID NO: 4036096 - RNA, 15 nt, Molluscum contagiosum virus
ccucgagaagaccug

SEQ ID NO: 4036097 - RNA, 16 nt, Molluscum contagiosum virus
ccucgagcacgccucc

SEQ ID NO: 4036098 - RNA, 13 nt, Molluscum contagiosum virus
ccucgagcgccgc

SEQ ID NO: 4036099 - RNA, 18 nt, Molluscum contagiosum virus
ccucgcaagcugagcgcg

SEQ ID NO: 4036100 - RNA, 22 nt, Molluscum contagiosum virus
ccucgcaggcgaggucacacuc

SEQ ID NO: 4036101 - RNA, 15 nt, Molluscum contagiosum virus
ccucgcuccgcagca

SEQ ID NO: 4036102 - RNA, 22 nt, Molluscum contagiosum virus
ccucggacuucgacgcgcggca

SEQ ID NO: 4036103 - RNA, 20 nt, Molluscum contagiosum virus
ccucgugcucggcgugaucu

SEQ ID NO: 4036104 - RNA, 21 nt, Molluscum contagiosum virus
ccucgugcugggccugccgca

SEQ ID NO: 4036105 - RNA, 16 nt, Molluscum contagiosum virus
ccucucgugcgucgug

SEQ ID NO: 4036106 - RNA, 16 nt, Molluscum contagiosum virus
ccucucuccccuucag

SEQ ID NO: 4036107 - RNA, 14 nt, Molluscum contagiosum virus
ccucugccugcaag

SEQ ID NO: 4036108 - RNA, 19 nt, Molluscum contagiosum virus
ccucuggaaggagcugggc

SEQ ID NO: 4036109 - RNA, 15 nt, Molluscum contagiosum virus
ccucuuuugggcacg

SEQ ID NO: 4036110 - RNA, 17 nt, Molluscum contagiosum virus
ccucuuuuugcgccgca

SEQ ID NO: 4036111 - RNA, 15 nt, Molluscum contagiosum virus
ccugaacaagcugca

SEQ ID NO: 4036112 - RNA, 12 nt, Molluscum contagiosum virus
ccugacggcagc

SEQ ID NO: 4036113 - RNA, 15 nt, Molluscum contagiosum virus
ccugaugacggcaga

SEQ ID NO: 4036114 - RNA, 14 nt, Molluscum contagiosum virus
ccugcaccugcugg

SEQ ID NO: 4036115 - RNA, 15 nt, Molluscum contagiosum virus
ccugcaccugcugga

SEQ ID NO: 4036116 - RNA, 19 nt, Molluscum contagiosum virus
ccugcaggaaaggcacccg

SEQ ID NO: 4036117 - RNA, 21 nt, Molluscum contagiosum virus
ccugcaggaaaggcacccgca

SEQ ID NO: 4036118 - RNA, 14 nt, Molluscum contagiosum virus
ccugccagcagagc

SEQ ID NO: 4036119 - RNA, 23 nt, Molluscum contagiosum virus
ccugcgcaacgcgggccaggcac

SEQ ID NO: 4036120 - RNA, 14 nt, Molluscum contagiosum virus
ccugcgcgagcagu

SEQ ID NO: 4036121 - RNA, 12 nt, Molluscum contagiosum virus
ccugcgcgugcg

SEQ ID NO: 4036122 - RNA, 13 nt, Molluscum contagiosum virus
ccugcggcucgca

SEQ ID NO: 4036123 - RNA, 20 nt, Molluscum contagiosum virus
ccugcgggcggcacacacuu

SEQ ID NO: 4036124 - RNA, 16 nt, Molluscum contagiosum virus
ccugcucaugcgcaag

SEQ ID NO: 4036125 - RNA, 17 nt, Molluscum contagiosum virus
ccugcucgggcugcgcg

SEQ ID NO: 4036126 - RNA, 18 nt, Molluscum contagiosum virus
ccugcugccgagcuucgu

SEQ ID NO: 4036127 - RNA, 14 nt, Molluscum contagiosum virus
ccugcugcgcagca

SEQ ID NO: 4036128 - RNA, 13 nt, Molluscum contagiosum virus
ccugcugcgcgcg

SEQ ID NO: 4036129 - RNA, 14 nt, Molluscum contagiosum virus
ccugcuggcaccgc

SEQ ID NO: 4036130 - RNA, 18 nt, Molluscum contagiosum virus
ccugcugguggugcugga

SEQ ID NO: 4036131 - RNA, 23 nt, Molluscum contagiosum virus
ccuggaacgcgagacgggcacgc

SEQ ID NO: 4036132 - RNA, 19 nt, Molluscum contagiosum virus
ccuggagggucacgcgcac

SEQ ID NO: 4036133 - RNA, 16 nt, Molluscum contagiosum virus
ccuggauaucgagcgc

SEQ ID NO: 4036134 - RNA, 21 nt, Molluscum contagiosum virus
ccuggauaucgagcgcgagau

SEQ ID NO: 4036135 - RNA, 21 nt, Molluscum contagiosum virus
ccuggcacuggcgcgcacgcg

SEQ ID NO: 4036136 - RNA, 18 nt, Molluscum contagiosum virus
ccuggcagugccgggcgc

SEQ ID NO: 4036137 - RNA, 19 nt, Molluscum contagiosum virus
ccuggcgagcgcucugcau

SEQ ID NO: 4036138 - RNA, 15 nt, Molluscum contagiosum virus
ccuggcugcugcgcg

SEQ ID NO: 4036139 - RNA, 18 nt, Molluscum contagiosum virus
ccuggcuugcgcgcgccc

SEQ ID NO: 4036140 - RNA, 15 nt, Molluscum contagiosum virus
ccugggcaggccgcc

SEQ ID NO: 4036141 - RNA, 20 nt, Molluscum contagiosum virus
ccuggucgagcaccugucgc

SEQ ID NO: 4036142 - RNA, 18 nt, Molluscum contagiosum virus
ccuggugcgcccgcggca

SEQ ID NO: 4036143 - RNA, 15 nt, Molluscum contagiosum virus
ccuguaacaaggaaa

SEQ ID NO: 4036144 - RNA, 22 nt, Molluscum contagiosum virus
ccugucaucaccccgcugggcc

SEQ ID NO: 4036145 - RNA, 15 nt, Molluscum contagiosum virus
ccuguccgcgggcgc

SEQ ID NO: 4036146 - RNA, 17 nt, Molluscum contagiosum virus
ccugucggcacaucucu

SEQ ID NO: 4036147 - RNA, 20 nt, Molluscum contagiosum virus
ccugucggcacaucucucag

SEQ ID NO: 4036148 - RNA, 21 nt, Molluscum contagiosum virus
ccugugcccgaccccgccguc

SEQ ID NO: 4036149 - RNA, 20 nt, Molluscum contagiosum virus
ccugugcugugcagaacuuc

SEQ ID NO: 4036150 - RNA, 22 nt, Molluscum contagiosum virus
ccuguucggcaugcagcgcagg

SEQ ID NO: 4036151 - RNA, 13 nt, Molluscum contagiosum virus
ccuguucuuccag

SEQ ID NO: 4036152 - RNA, 18 nt, Molluscum contagiosum virus
ccuguucuuucagcgcgc

SEQ ID NO: 4036153 - RNA, 23 nt, Molluscum contagiosum virus
ccuucgacguugacgagcgcgug

SEQ ID NO: 4036154 - RNA, 18 nt, Molluscum contagiosum virus
ccuucgccaaugacggcg

SEQ ID NO: 4036155 - RNA, 17 nt, Molluscum contagiosum virus
ccuucgcggagcgcacg

SEQ ID NO: 4036156 - RNA, 20 nt, Molluscum contagiosum virus
ccuucgcuugucgugcuucc

SEQ ID NO: 4036157 - RNA, 22 nt, Molluscum contagiosum virus
ccuucgcuugucgugcuuccug

SEQ ID NO: 4036158 - RNA, 19 nt, Molluscum contagiosum virus
ccuucucgucgagagcgcg

SEQ ID NO: 4036159 - RNA, 14 nt, Molluscum contagiosum virus
ccuugcagcgcagc

SEQ ID NO: 4036160 - RNA, 16 nt, Molluscum contagiosum virus
ccuugcucuggcucuc

SEQ ID NO: 4036161 - RNA, 17 nt, Molluscum contagiosum virus
ccuugcuggcacgcgag

SEQ ID NO: 4036162 - RNA, 23 nt, Molluscum contagiosum virus
ccuuguccgagcgaaccgcggca

SEQ ID NO: 4036163 - RNA, 22 nt, Molluscum contagiosum virus
ccuugucgagacaggccggggc

SEQ ID NO: 4036164 - RNA, 15 nt, Molluscum contagiosum virus
ccuuguggacgcgcg

SEQ ID NO: 4036165 - RNA, 20 nt, Molluscum contagiosum virus
ccuuuguucuuagcagcgcc

SEQ ID NO: 4036166 - RNA, 22 nt, Molluscum contagiosum virus
ccuuuguucuuagcagcgccgc

SEQ ID NO: 4036167 - RNA, 23 nt, Molluscum contagiosum virus
ccuuuugcgcgcugcgggcgccg

SEQ ID NO: 4036168 - RNA, 15 nt, Molluscum contagiosum virus
cgaaaucgcaaagca

SEQ ID NO: 4036169 - RNA, 22 nt, Molluscum contagiosum virus
cgaacaagacgcuagcugugcg

SEQ ID NO: 4036170 - RNA, 16 nt, Molluscum contagiosum virus
cgaacaccuccugcuu

SEQ ID NO: 4036171 - RNA, 12 nt, Molluscum contagiosum virus
cgaacagagcgc

SEQ ID NO: 4036172 - RNA, 20 nt, Molluscum contagiosum virus
cgaacgagggacacgcacuu

SEQ ID NO: 4036173 - RNA, 20 nt, Molluscum contagiosum virus
cgaacguuauccccuccaag

SEQ ID NO: 4036174 - RNA, 21 nt, Molluscum contagiosum virus
cgaacugcccggcggcaagcc

SEQ ID NO: 4036175 - RNA, 12 nt, Molluscum contagiosum virus
cgaacugcuggg

SEQ ID NO: 4036176 - RNA, 18 nt, Molluscum contagiosum virus
cgaagaccaccagcacca

SEQ ID NO: 4036177 - RNA, 19 nt, Molluscum contagiosum virus
cgaagacgucguagcgcuc

SEQ ID NO: 4036178 - RNA, 23 nt, Molluscum contagiosum virus
cgaagagcacgaugcccagcagc

SEQ ID NO: 4036179 - RNA, 19 nt, Molluscum contagiosum virus
cgaagaguuggacagccau

SEQ ID NO: 4036180 - RNA, 23 nt, Molluscum contagiosum virus
cgaagccuucgcagagaccguca

SEQ ID NO: 4036181 - RNA, 14 nt, Molluscum contagiosum virus
cgaagcgcgcagcg

SEQ ID NO: 4036182 - RNA, 19 nt, Molluscum contagiosum virus
cgaaggcaaccgcgacgag

SEQ ID NO: 4036183 - RNA, 16 nt, Molluscum contagiosum virus
cgaagucuaggcagcg

SEQ ID NO: 4036184 - RNA, 19 nt, Molluscum contagiosum virus
cgaaguuggucaacaacac

SEQ ID NO: 4036185 - RNA, 11 nt, Molluscum contagiosum virus
cgaaguuucac

SEQ ID NO: 4036186 - RNA, 15 nt, Molluscum contagiosum virus
cgaauccuuuacugc

SEQ ID NO: 4036187 - RNA, 19 nt, Molluscum contagiosum virus
cgacaaggaaaggcaccca

SEQ ID NO: 4036188 - RNA, 15 nt, Molluscum contagiosum virus
cgacagagcccggga

SEQ ID NO: 4036189 - RNA, 17 nt, Molluscum contagiosum virus
cgacagcauccuggagu

SEQ ID NO: 4036190 - RNA, 12 nt, Molluscum contagiosum virus
cgacagcucuuc

SEQ ID NO: 4036191 - RNA, 13 nt, Molluscum contagiosum virus
cgacaggaacgca

SEQ ID NO: 4036192 - RNA, 18 nt, Molluscum contagiosum virus
cgacaggaacgcaccacg

SEQ ID NO: 4036193 - RNA, 11 nt, Molluscum contagiosum virus
cgaccagcugg

SEQ ID NO: 4036194 - RNA, 19 nt, Molluscum contagiosum virus
cgaccauuuccugcgagug

SEQ ID NO: 4036195 - RNA, 20 nt, Molluscum contagiosum virus
cgacccaucggagaagugcu

SEQ ID NO: 4036196 - RNA, 12 nt, Molluscum contagiosum virus
cgaccccaagaa

SEQ ID NO: 4036197 - RNA, 16 nt, Molluscum contagiosum virus
cgaccgcgcacgcagc

SEQ ID NO: 4036198 - RNA, 16 nt, Molluscum contagiosum virus
cgaccuacgaggugcu

SEQ ID NO: 4036199 - RNA, 13 nt, Molluscum contagiosum virus
cgacgagcagcug

SEQ ID NO: 4036200 - RNA, 18 nt, Molluscum contagiosum virus
cgacgaggccuacagcgc

SEQ ID NO: 4036201 - RNA, 14 nt, Molluscum contagiosum virus
cgacgauggccacg

SEQ ID NO: 4036202 - RNA, 19 nt, Molluscum contagiosum virus
cgacgcaaaagaggccugc

SEQ ID NO: 4036203 - RNA, 17 nt, Molluscum contagiosum virus
cgacgccgagcccgagc

SEQ ID NO: 4036204 - RNA, 17 nt, Molluscum contagiosum virus
cgacgccguccgcgcag

SEQ ID NO: 4036205 - RNA, 14 nt, Molluscum contagiosum virus
cgacgcgcugcucu

SEQ ID NO: 4036206 - RNA, 19 nt, Molluscum contagiosum virus
cgacgcuuucguccgccgc

SEQ ID NO: 4036207 - RNA, 21 nt, Molluscum contagiosum virus
cgacggaacgagccugccgcg

SEQ ID NO: 4036208 - RNA, 13 nt, Molluscum contagiosum virus
cgacggcugcucg

SEQ ID NO: 4036209 - RNA, 20 nt, Molluscum contagiosum virus
cgacggucuuccaggucuuc

SEQ ID NO: 4036210 - RNA, 15 nt, Molluscum contagiosum virus
cgacguacgagugcu

SEQ ID NO: 4036211 - RNA, 20 nt, Molluscum contagiosum virus
cgacgucacgcuggucacgc

SEQ ID NO: 4036212 - RNA, 14 nt, Molluscum contagiosum virus
cgacgugcagacgc

SEQ ID NO: 4036213 - RNA, 21 nt, Molluscum contagiosum virus
cgacgugcugcugcagaacug

SEQ ID NO: 4036214 - RNA, 16 nt, Molluscum contagiosum virus
cgacuagccugugccc

SEQ ID NO: 4036215 - RNA, 21 nt, Molluscum contagiosum virus
cgacuagcgugcgcagcauuc

SEQ ID NO: 4036216 - RNA, 13 nt, Molluscum contagiosum virus
cgacuucucgcgc

SEQ ID NO: 4036217 - RNA, 18 nt, Molluscum contagiosum virus
cgacuuuguccugagccu

SEQ ID NO: 4036218 - RNA, 13 nt, Molluscum contagiosum virus
cgagaacuggcgc

SEQ ID NO: 4036219 - RNA, 17 nt, Molluscum contagiosum virus
cgagaacuggcgcagca

SEQ ID NO: 4036220 - RNA, 20 nt, Molluscum contagiosum virus
cgagaagaccuguucuuuca

SEQ ID NO: 4036221 - RNA, 20 nt, Molluscum contagiosum virus
cgagaagacggggcgcacgc

SEQ ID NO: 4036222 - RNA, 17 nt, Molluscum contagiosum virus
cgagaccagccgcgagc

SEQ ID NO: 4036223 - RNA, 15 nt, Molluscum contagiosum virus
cgagacgcugcgcga

SEQ ID NO: 4036224 - RNA, 21 nt, Molluscum contagiosum virus
cgagacggaaauguuguuuga

SEQ ID NO: 4036225 - RNA, 21 nt, Molluscum contagiosum virus
cgagacuucuccgaccgugcc

SEQ ID NO: 4036226 - RNA, 22 nt, Molluscum contagiosum virus
cgagaucacggcgugcgcgaga

SEQ ID NO: 4036227 - RNA, 13 nt, Molluscum contagiosum virus
cgagaugcucgcc

SEQ ID NO: 4036228 - RNA, 15 nt, Molluscum contagiosum virus
cgagauucguggcga

SEQ ID NO: 4036229 - RNA, 19 nt, Molluscum contagiosum virus
cgagcaauugcugggcaca

SEQ ID NO: 4036230 - RNA, 23 nt, Molluscum contagiosum virus
cgagcacccccgcugcacgcucu

SEQ ID NO: 4036231 - RNA, 22 nt, Molluscum contagiosum virus
cgagcacgccuccaagaagagg

SEQ ID NO: 4036232 - RNA, 17 nt, Molluscum contagiosum virus
cgagcacgccugcacgc

SEQ ID NO: 4036233 - RNA, 18 nt, Molluscum contagiosum virus
cgagcacgccugcacgcg

SEQ ID NO: 4036234 - RNA, 14 nt, Molluscum contagiosum virus
cgagcacgggcgcc

SEQ ID NO: 4036235 - RNA, 16 nt, Molluscum contagiosum virus
cgagcacuacgugcuc

SEQ ID NO: 4036236 - RNA, 16 nt, Molluscum contagiosum virus
cgagcacugccugccg

SEQ ID NO: 4036237 - RNA, 15 nt, Molluscum contagiosum virus
cgagcacugcgcgcg

SEQ ID NO: 4036238 - RNA, 22 nt, Molluscum contagiosum virus
cgagcagcgcuugcgcgccaac

SEQ ID NO: 4036239 - RNA, 23 nt, Molluscum contagiosum virus
cgagcaggucaucgggcugcagc

SEQ ID NO: 4036240 - RNA, 18 nt, Molluscum contagiosum virus
cgagcaguccgccucgag

SEQ ID NO: 4036241 - RNA, 16 nt, Molluscum contagiosum virus
cgagcaguucgcgcgc

SEQ ID NO: 4036242 - RNA, 14 nt, Molluscum contagiosum virus
cgagcaucugcgcg

SEQ ID NO: 4036243 - RNA, 16 nt, Molluscum contagiosum virus
cgagcaucugcgcgug

SEQ ID NO: 4036244 - RNA, 18 nt, Molluscum contagiosum virus
cgagcaugucacgcucac

SEQ ID NO: 4036245 - RNA, 15 nt, Molluscum contagiosum virus
cgagccaaggaugcc

SEQ ID NO: 4036246 - RNA, 16 nt, Molluscum contagiosum virus
cgagccccgcgccggc

SEQ ID NO: 4036247 - RNA, 17 nt, Molluscum contagiosum virus
cgagcccgagcccgggc

SEQ ID NO: 4036248 - RNA, 19 nt, Molluscum contagiosum virus
cgagcccgcggcgcgcagc

SEQ ID NO: 4036249 - RNA, 15 nt, Molluscum contagiosum virus
cgagccgcgcgagcg

SEQ ID NO: 4036250 - RNA, 21 nt, Molluscum contagiosum virus
cgagcgaaaacgcgugucuuc

SEQ ID NO: 4036251 - RNA, 19 nt, Molluscum contagiosum virus
cgagcgaaccgcggcagcc

SEQ ID NO: 4036252 - RNA, 14 nt, Molluscum contagiosum virus
cgagcgccagccug

SEQ ID NO: 4036253 - RNA, 18 nt, Molluscum contagiosum virus
cgagcgccagccugugcg

SEQ ID NO: 4036254 - RNA, 15 nt, Molluscum contagiosum virus
cgagcgccgcucgca

SEQ ID NO: 4036255 - RNA, 16 nt, Molluscum contagiosum virus
cgagcgccugcgagca

SEQ ID NO: 4036256 - RNA, 15 nt, Molluscum contagiosum virus
cgagcgcgcgccugc

SEQ ID NO: 4036257 - RNA, 18 nt, Molluscum contagiosum virus
cgagcgcgcgccugcugg

SEQ ID NO: 4036258 - RNA, 16 nt, Molluscum contagiosum virus
cgagcgcuaucucugg

SEQ ID NO: 4036259 - RNA, 23 nt, Molluscum contagiosum virus
cgagcgcugccgcuucgugcgcg

SEQ ID NO: 4036260 - RNA, 15 nt, Molluscum contagiosum virus
cgagcgcuucuuccg

SEQ ID NO: 4036261 - RNA, 23 nt, Molluscum contagiosum virus
cgagcgcuucuuccggcagcugg

SEQ ID NO: 4036262 - RNA, 21 nt, Molluscum contagiosum virus
cgagcggcuuuucgccggagg

SEQ ID NO: 4036263 - RNA, 13 nt, Molluscum contagiosum virus
cgagcguguccag

SEQ ID NO: 4036264 - RNA, 19 nt, Molluscum contagiosum virus
cgagcucgcgcgccagcac

SEQ ID NO: 4036265 - RNA, 11 nt, Molluscum contagiosum virus
cgagcugcuag

SEQ ID NO: 4036266 - RNA, 16 nt, Molluscum contagiosum virus
cgagcugugcgagcca

SEQ ID NO: 4036267 - RNA, 18 nt, Molluscum contagiosum virus
cgaggaaaggcaccccga

SEQ ID NO: 4036268 - RNA, 18 nt, Molluscum contagiosum virus
cgaggaauuugcccccac

SEQ ID NO: 4036269 - RNA, 13 nt, Molluscum contagiosum virus
cgaggaccccgcc

SEQ ID NO: 4036270 - RNA, 20 nt, Molluscum contagiosum virus
cgaggaccggcgcaacgagc

SEQ ID NO: 4036271 - RNA, 18 nt, Molluscum contagiosum virus
cgaggaccucgcgcgccg

SEQ ID NO: 4036272 - RNA, 20 nt, Molluscum contagiosum virus
cgaggacgagccccgcgccg

SEQ ID NO: 4036273 - RNA, 20 nt, Molluscum contagiosum virus
cgaggacuuccgcgcgcucu

SEQ ID NO: 4036274 - RNA, 21 nt, Molluscum contagiosum virus
cgaggccaaccuccugcaccu

SEQ ID NO: 4036275 - RNA, 23 nt, Molluscum contagiosum virus
cgaggccugcguggacagcaucc

SEQ ID NO: 4036276 - RNA, 21 nt, Molluscum contagiosum virus
cgaggcgccgaagagugcgca

SEQ ID NO: 4036277 - RNA, 18 nt, Molluscum contagiosum virus
cgaggcguccagcggcug

SEQ ID NO: 4036278 - RNA, 18 nt, Molluscum contagiosum virus
cugcucuccgcgggaaga

SEQ ID NO: 4036279 - RNA, 12 nt, Molluscum contagiosum virus
cugcucuggagc

SEQ ID NO: 4036280 - RNA, 18 nt, Molluscum contagiosum virus
cugcugcacacaccgcga

SEQ ID NO: 4036281 - RNA, 21 nt, Molluscum contagiosum virus
cugcugcacacaccgcgagca

SEQ ID NO: 4036282 - RNA, 21 nt, Molluscum contagiosum virus
cugcugcacagcuuccuggag

SEQ ID NO: 4036283 - RNA, 21 nt, Molluscum contagiosum virus
cugcugcccgcgcagcgccac

SEQ ID NO: 4036284 - RNA, 18 nt, Molluscum contagiosum virus
cugcugccgagcuucguc

SEQ ID NO: 4036285 - RNA, 16 nt, Molluscum contagiosum virus
cugcugcgcagcaucc

SEQ ID NO: 4036286 - RNA, 14 nt, Molluscum contagiosum virus
cugcugcucuucca

SEQ ID NO: 4036287 - RNA, 21 nt, Molluscum contagiosum virus
cugcuggcgcgcgcgcgccgg

SEQ ID NO: 4036288 - RNA, 15 nt, Molluscum contagiosum virus
cugcuggcggugcuc

SEQ ID NO: 4036289 - RNA, 17 nt, Molluscum contagiosum virus
cugcuggugcucgccug

SEQ ID NO: 4036290 - RNA, 22 nt, Molluscum contagiosum virus
cugcuggugcucgccugcaucu

SEQ ID NO: 4036291 - RNA, 18 nt, Molluscum contagiosum virus
cugcugguggugcuggag

SEQ ID NO: 4036292 - RNA, 13 nt, Molluscum contagiosum virus
cugcuguuggccu

SEQ ID NO: 4036293 - RNA, 12 nt, Molluscum contagiosum virus
cugcuguuucug

SEQ ID NO: 4036294 - RNA, 23 nt, Molluscum contagiosum virus
cugcuucccgcugagcgcagcac

SEQ ID NO: 4036295 - RNA, 18 nt, Molluscum contagiosum virus
cugcuuccgcaccugguc

SEQ ID NO: 4036296 - RNA, 17 nt, Molluscum contagiosum virus
cugcuugcccgcgccgc

SEQ ID NO: 4036297 - RNA, 14 nt, Molluscum contagiosum virus
cuggaccugcgcca

SEQ ID NO: 4036298 - RNA, 15 nt, Molluscum contagiosum virus
cuggacgccucggga

SEQ ID NO: 4036299 - RNA, 16 nt, Molluscum contagiosum virus
cuggacgggcacgagc

SEQ ID NO: 4036300 - RNA, 20 nt, Molluscum contagiosum virus
cuggagaaagaagugugccu

SEQ ID NO: 4036301 - RNA, 19 nt, Molluscum contagiosum virus
cuggagaccugucgugcaa

SEQ ID NO: 4036302 - RNA, 14 nt, Molluscum contagiosum virus
cuggagcagguucu

SEQ ID NO: 4036303 - RNA, 18 nt, Molluscum contagiosum virus
cuggagcuggcugggcac

SEQ ID NO: 4036304 - RNA, 18 nt, Molluscum contagiosum virus
cuggaguuuaaugacgcg

SEQ ID NO: 4036305 - RNA, 19 nt, Molluscum contagiosum virus
cuggcacaaaucgaggcgc

SEQ ID NO: 4036306 - RNA, 15 nt, Molluscum contagiosum virus
cuggcaccgggcgcc

SEQ ID NO: 4036307 - RNA, 17 nt, Molluscum contagiosum virus
cuggcaccgggcgccgc

SEQ ID NO: 4036308 - RNA, 12 nt, Molluscum contagiosum virus
cuggcaccugcg

SEQ ID NO: 4036309 - RNA, 14 nt, Molluscum contagiosum virus
cuggcacgcgccgc

SEQ ID NO: 4036310 - RNA, 17 nt, Molluscum contagiosum virus
cuggcacuggcgcgcac

SEQ ID NO: 4036311 - RNA, 21 nt, Molluscum contagiosum virus
cuggcacuggcgcgcacgcgc

SEQ ID NO: 4036312 - RNA, 21 nt, Molluscum contagiosum virus
cuggcagugccgggcgccggc

SEQ ID NO: 4036313 - RNA, 22 nt, Molluscum contagiosum virus
cuggcagugccgggcgccggcu

SEQ ID NO: 4036314 - RNA, 11 nt, Molluscum contagiosum virus
cuggccaacac

SEQ ID NO: 4036315 - RNA, 19 nt, Molluscum contagiosum virus
cuggccgaacugcucugcg

SEQ ID NO: 4036316 - RNA, 17 nt, Molluscum contagiosum virus
cuggccgaggucuucca

SEQ ID NO: 4036317 - RNA, 14 nt, Molluscum contagiosum virus
cuggccgaugccua

SEQ ID NO: 4036318 - RNA, 19 nt, Molluscum contagiosum virus
cuggcgaaaccugggcgcc

SEQ ID NO: 4036319 - RNA, 13 nt, Molluscum contagiosum virus
cuggcgagcacgu

SEQ ID NO: 4036320 - RNA, 13 nt, Molluscum contagiosum virus
cuggcgcagcagg

SEQ ID NO: 4036321 - RNA, 21 nt, Molluscum contagiosum virus
cuggcgcgcggagagcagugc

SEQ ID NO: 4036322 - RNA, 17 nt, Molluscum contagiosum virus
cuggcgcgugcgagcag

SEQ ID NO: 4036323 - RNA, 21 nt, Molluscum contagiosum virus
cuggcgcgugcgagcagaggc

SEQ ID NO: 4036324 - RNA, 16 nt, Molluscum contagiosum virus
cuggcggcgcacgcga

SEQ ID NO: 4036325 - RNA, 14 nt, Molluscum contagiosum virus
cuggcggggcuggc

SEQ ID NO: 4036326 - RNA, 16 nt, Molluscum contagiosum virus
cuggcggggcuggcag

SEQ ID NO: 4036327 - RNA, 22 nt, Molluscum contagiosum virus
cuggcucagaacgacaccgcga

SEQ ID NO: 4036328 - RNA, 14 nt, Molluscum contagiosum virus
cuggcuccgcugga

SEQ ID NO: 4036329 - RNA, 20 nt, Molluscum contagiosum virus
cuggcuuccgacgucaagca

SEQ ID NO: 4036330 - RNA, 15 nt, Molluscum contagiosum virus
cugggaaagggcugc

SEQ ID NO: 4036331 - RNA, 19 nt, Molluscum contagiosum virus
cugggaacaccacacgcgc

SEQ ID NO: 4036332 - RNA, 16 nt, Molluscum contagiosum virus
cugggaacccguggcc

SEQ ID NO: 4036333 - RNA, 21 nt, Molluscum contagiosum virus
cugggcaacgcgcgcgcgcug

SEQ ID NO: 4036334 - RNA, 23 nt, Molluscum contagiosum virus
cugggccaucgaaacucugcacg

SEQ ID NO: 4036335 - RNA, 22 nt, Molluscum contagiosum virus
cugggccccuacguggucaugg

SEQ ID NO: 4036336 - RNA, 17 nt, Molluscum contagiosum virus
cugggcguggcgcaccu

SEQ ID NO: 4036337 - RNA, 14 nt, Molluscum contagiosum virus
cuggggcuagcgcu

SEQ ID NO: 4036338 - RNA, 23 nt, Molluscum contagiosum virus
cuggucaagaaggcgcuggugga

SEQ ID NO: 4036339 - RNA, 14 nt, Molluscum contagiosum virus
cuggugcgcccgcg

SEQ ID NO: 4036340 - RNA, 17 nt, Molluscum contagiosum virus
cugguucugcgcugcca

SEQ ID NO: 4036341 - RNA, 14 nt, Molluscum contagiosum virus
cuguaaauggaccc

SEQ ID NO: 4036342 - RNA, 15 nt, Molluscum contagiosum virus
cuguaacaaggaaaa

SEQ ID NO: 4036343 - RNA, 14 nt, Molluscum contagiosum virus
cuguaccggcucag

SEQ ID NO: 4036344 - RNA, 16 nt, Molluscum contagiosum virus
cuguaugaucugcagu

SEQ ID NO: 4036345 - RNA, 18 nt, Molluscum contagiosum virus
cugucccuugauccaggc

SEQ ID NO: 4036346 - RNA, 21 nt, Molluscum contagiosum virus
cuguccgcggacgcgggccug

SEQ ID NO: 4036347 - RNA, 22 nt, Molluscum contagiosum virus
cugucguaacaauggacacgca

SEQ ID NO: 4036348 - RNA, 18 nt, Molluscum contagiosum virus
cugugagcgcgccgcucg

SEQ ID NO: 4036349 - RNA, 23 nt, Molluscum contagiosum virus
cugugcagaacuucucgcgagcg

SEQ ID NO: 4036350 - RNA, 14 nt, Molluscum contagiosum virus
cugugcgagccagu

SEQ ID NO: 4036351 - RNA, 18 nt, Molluscum contagiosum virus
cugugcuacgcgagcacu

SEQ ID NO: 4036352 - RNA, 20 nt, Molluscum contagiosum virus
cugugcuacgcgagcacugc

SEQ ID NO: 4036353 - RNA, 21 nt, Molluscum contagiosum virus
cuguguggaacggcucaccgc

SEQ ID NO: 4036354 - RNA, 21 nt, Molluscum contagiosum virus
cuguucggcaugcagcgcagg

SEQ ID NO: 4036355 - RNA, 16 nt, Molluscum contagiosum virus
cuuaacucagcgggca

SEQ ID NO: 4036356 - RNA, 12 nt, Molluscum contagiosum virus
cuuacugcugca

SEQ ID NO: 4036357 - RNA, 14 nt, Molluscum contagiosum virus
cuucaagcacgagc

SEQ ID NO: 4036358 - RNA, 18 nt, Molluscum contagiosum virus
cuucaagcacgagcugcu

SEQ ID NO: 4036359 - RNA, 19 nt, Molluscum contagiosum virus
cuucaaguuccuggagccc

SEQ ID NO: 4036360 - RNA, 22 nt, Molluscum contagiosum virus
cuucaggcaagaggggagccag

SEQ ID NO: 4036361 - RNA, 17 nt, Molluscum contagiosum virus
cuucauccgcgcgcucu

SEQ ID NO: 4036362 - RNA, 17 nt, Molluscum contagiosum virus
cuucccguuccugggca

SEQ ID NO: 4036363 - RNA, 13 nt, Molluscum contagiosum virus
cuuccgcggcgug

SEQ ID NO: 4036364 - RNA, 20 nt, Molluscum contagiosum virus
cuuccggagacaccagcucc

SEQ ID NO: 4036365 - RNA, 17 nt, Molluscum contagiosum virus
cuuccggaggcagcgcu

SEQ ID NO: 4036366 - RNA, 14 nt, Molluscum contagiosum virus
cuuccggcagcgcg

SEQ ID NO: 4036367 - RNA, 15 nt, Molluscum contagiosum virus
cuuccgucugcugcu

SEQ ID NO: 4036368 - RNA, 11 nt, Molluscum contagiosum virus
cuuccugcagc

SEQ ID NO: 4036369 - RNA, 12 nt, Molluscum contagiosum virus
cuuccugcuggc

SEQ ID NO: 4036370 - RNA, 20 nt, Molluscum contagiosum virus
cuuccuuuccgugcuugaca

SEQ ID NO: 4036371 - RNA, 19 nt, Molluscum contagiosum virus
cuucgaaggcagcgaaggc

SEQ ID NO: 4036372 - RNA, 20 nt, Molluscum contagiosum virus
cuucgacggcuucauccgcg

SEQ ID NO: 4036373 - RNA, 20 nt, Molluscum contagiosum virus
cuucgcagaggacagcuccu

SEQ ID NO: 4036374 - RNA, 20 nt, Molluscum contagiosum virus
cuucgcgaaggcaaccgcga

SEQ ID NO: 4036375 - RNA, 17 nt, Molluscum contagiosum virus
cuucgcgaugugcaccu

SEQ ID NO: 4036376 - RNA, 18 nt, Molluscum contagiosum virus
cuucgcguagucagggcc

SEQ ID NO: 4036377 - RNA, 15 nt, Molluscum contagiosum virus
cuucgggccgcugcc

SEQ ID NO: 4036378 - RNA, 20 nt, Molluscum contagiosum virus
cuucguaaagcuggccgagg

SEQ ID NO: 4036379 - RNA, 16 nt, Molluscum contagiosum virus
cuucgucaagcagcgc

SEQ ID NO: 4036380 - RNA, 14 nt, Molluscum contagiosum virus
cuucguggcgcugg

SEQ ID NO: 4036381 - RNA, 17 nt, Molluscum contagiosum virus
gacucagcauguugcuc

SEQ ID NO: 4036382 - RNA, 21 nt, Molluscum contagiosum virus
gacuccaaggaggucccuagc

SEQ ID NO: 4036383 - RNA, 20 nt, Molluscum contagiosum virus
gacuccaucugcgcgacgcc

SEQ ID NO: 4036384 - RNA, 22 nt, Molluscum contagiosum virus
gacuccgaggcagguuccggug

SEQ ID NO: 4036385 - RNA, 12 nt, Molluscum contagiosum virus
gacucgcagcuc

SEQ ID NO: 4036386 - RNA, 21 nt, Molluscum contagiosum virus
gacucgcgucugcaaggccug

SEQ ID NO: 4036387 - RNA, 13 nt, Molluscum contagiosum virus
gacucgcugccag

SEQ ID NO: 4036388 - RNA, 18 nt, Molluscum contagiosum virus
gacucggaugcgcugccg

SEQ ID NO: 4036389 - RNA, 12 nt, Molluscum contagiosum virus
gacucggugcuc

SEQ ID NO: 4036390 - RNA, 19 nt, Molluscum contagiosum virus
gacucuggcuucuccaccu

SEQ ID NO: 4036391 - RNA, 20 nt, Molluscum contagiosum virus
gacugacgccgauguccugc

SEQ ID NO: 4036392 - RNA, 22 nt, Molluscum contagiosum virus
gacugcgccuucugccugcccg

SEQ ID NO: 4036393 - RNA, 22 nt, Molluscum contagiosum virus
gacugcguugucuccuccugau

SEQ ID NO: 4036394 - RNA, 17 nt, Molluscum contagiosum virus
gacugcuacgucgcggc

SEQ ID NO: 4036395 - RNA, 23 nt, Molluscum contagiosum virus
gacugcugcccccgccgcggcgc

SEQ ID NO: 4036396 - RNA, 14 nt, Molluscum contagiosum virus
gacuggcacgcgcc

SEQ ID NO: 4036397 - RNA, 16 nt, Molluscum contagiosum virus
gacuggcacgcgccgc

SEQ ID NO: 4036398 - RNA, 14 nt, Molluscum contagiosum virus
gacugugccgcucc

SEQ ID NO: 4036399 - RNA, 18 nt, Molluscum contagiosum virus
gacuuagccacugugcug

SEQ ID NO: 4036400 - RNA, 17 nt, Molluscum contagiosum virus
gacuugugcccaugucc

SEQ ID NO: 4036401 - RNA, 23 nt, Molluscum contagiosum virus
gagaaaggcacccaccaggaaca

SEQ ID NO: 4036402 - RNA, 23 nt, Molluscum contagiosum virus
gagaacgcaagcguacgcgucgc

SEQ ID NO: 4036403 - RNA, 15 nt, Molluscum contagiosum virus
gagaacucgcgugcc

SEQ ID NO: 4036404 - RNA, 18 nt, Molluscum contagiosum virus
gagaagagggucgugcag

SEQ ID NO: 4036405 - RNA, 17 nt, Molluscum contagiosum virus
gagaagcuguaccuggu

SEQ ID NO: 4036406 - RNA, 18 nt, Molluscum contagiosum virus
gagaagcuguaccuggug

SEQ ID NO: 4036407 - RNA, 18 nt, Molluscum contagiosum virus
gagaagugaaaauaaaga

SEQ ID NO: 4036408 - RNA, 12 nt, Molluscum contagiosum virus
gagacaccagcu

SEQ ID NO: 4036409 - RNA, 15 nt, Molluscum contagiosum virus
gagacacgaguuucu

SEQ ID NO: 4036410 - RNA, 14 nt, Molluscum contagiosum virus
gagacauauguucu

SEQ ID NO: 4036411 - RNA, 18 nt, Molluscum contagiosum virus
gagacaucaucgcggagc

SEQ ID NO: 4036412 - RNA, 14 nt, Molluscum contagiosum virus
gagaccgucaaccu

SEQ ID NO: 4036413 - RNA, 20 nt, Molluscum contagiosum virus
gagaccgucaaccugcugcc

SEQ ID NO: 4036414 - RNA, 20 nt, Molluscum contagiosum virus
gagacggaaauguuguuuga

SEQ ID NO: 4036415 - RNA, 21 nt, Molluscum contagiosum virus
gagacugacgccgauguccug

SEQ ID NO: 4036416 - RNA, 23 nt, Molluscum contagiosum virus
gagacuucuccgaccgugcccug

SEQ ID NO: 4036417 - RNA, 22 nt, Molluscum contagiosum virus
gagacuugugcccauguccuuu

SEQ ID NO: 4036418 - RNA, 12 nt, Molluscum contagiosum virus
gagagacagcac

SEQ ID NO: 4036419 - RNA, 20 nt, Molluscum contagiosum virus
gagagccgccuuugcgcugu

SEQ ID NO: 4036420 - RNA, 14 nt, Molluscum contagiosum virus
gagagcgugagcag

SEQ ID NO: 4036421 - RNA, 14 nt, Molluscum contagiosum virus
gagagguugcgcgg

SEQ ID NO: 4036422 - RNA, 23 nt, Molluscum contagiosum virus
gagaucaggcagcugcugcgcuc

SEQ ID NO: 4036423 - RNA, 16 nt, Molluscum contagiosum virus
gagaucccuccgagac

SEQ ID NO: 4036424 - RNA, 23 nt, Molluscum contagiosum virus
gagaugauuccgucccccgcgga

SEQ ID NO: 4036425 - RNA, 20 nt, Molluscum contagiosum virus
gagaugcgccuuuuccgcga

SEQ ID NO: 4036426 - RNA, 23 nt, Molluscum contagiosum virus
gagcaagcgagagaggagugaag

SEQ ID NO: 4036427 - RNA, 14 nt, Molluscum contagiosum virus
gagcaagcgcccgc

SEQ ID NO: 4036428 - RNA, 15 nt, Molluscum contagiosum virus
gagcaaugcgagcaa

SEQ ID NO: 4036429 - RNA, 20 nt, Molluscum contagiosum virus
gagcacaaagagacgcggcc

SEQ ID NO: 4036430 - RNA, 16 nt, Molluscum contagiosum virus
gagcaccgcguggcgc

SEQ ID NO: 4036431 - RNA, 22 nt, Molluscum contagiosum virus
gagcacgacuacggcgagccca

SEQ ID NO: 4036432 - RNA, 21 nt, Molluscum contagiosum virus
gagcacgagcauuccgagccg

SEQ ID NO: 4036433 - RNA, 12 nt, Molluscum contagiosum virus
gagcacgcgcga

SEQ ID NO: 4036434 - RNA, 19 nt, Molluscum contagiosum virus
gagcacguccucugcgagc

SEQ ID NO: 4036435 - RNA, 15 nt, Molluscum contagiosum virus
gagcacugcgcgcgc

SEQ ID NO: 4036436 - RNA, 13 nt, Molluscum contagiosum virus
gagcacuggcugg

SEQ ID NO: 4036437 - RNA, 15 nt, Molluscum contagiosum virus
gagcacuuuggccuc

SEQ ID NO: 4036438 - RNA, 22 nt, Molluscum contagiosum virus
gagcagcccgugcgccugccgc

SEQ ID NO: 4036439 - RNA, 23 nt, Molluscum contagiosum virus
gagcagcccgugcgccugccgcg

SEQ ID NO: 4036440 - RNA, 19 nt, Molluscum contagiosum virus
gagcagcgcuagccccagc

SEQ ID NO: 4036441 - RNA, 13 nt, Molluscum contagiosum virus
gagcagcugcugc

SEQ ID NO: 4036442 - RNA, 14 nt, Molluscum contagiosum virus
gagcagugccgccg

SEQ ID NO: 4036443 - RNA, 18 nt, Molluscum contagiosum virus
gagcagugccgcucgcug

SEQ ID NO: 4036444 - RNA, 20 nt, Molluscum contagiosum virus
gagcagugccgcucgcuguc

SEQ ID NO: 4036445 - RNA, 16 nt, Molluscum contagiosum virus
gagcaguuccggucuc

SEQ ID NO: 4036446 - RNA, 19 nt, Molluscum contagiosum virus
gagcaguucgcgcgccugc

SEQ ID NO: 4036447 - RNA, 22 nt, Molluscum contagiosum virus
gagcaugccgccgcguacgcgc

SEQ ID NO: 4036448 - RNA, 19 nt, Molluscum contagiosum virus
gagccgcgcgagcgcgccc

SEQ ID NO: 4036449 - RNA, 12 nt, Molluscum contagiosum virus
gagccugcugcu

SEQ ID NO: 4036450 - RNA, 21 nt, Molluscum contagiosum virus
gagccuucucgucgagagcgc

SEQ ID NO: 4036451 - RNA, 22 nt, Molluscum contagiosum virus
gagcgaguucgcacgcuagcga

SEQ ID NO: 4036452 - RNA, 16 nt, Molluscum contagiosum virus
gagcgaguugagcagg

SEQ ID NO: 4036453 - RNA, 13 nt, Molluscum contagiosum virus
gagcgcagcugcc

SEQ ID NO: 4036454 - RNA, 15 nt, Molluscum contagiosum virus
gagcgcagucccagc

SEQ ID NO: 4036455 - RNA, 14 nt, Molluscum contagiosum virus
gagcgcaugcgcgc

SEQ ID NO: 4036456 - RNA, 20 nt, Molluscum contagiosum virus
gagcgcauucgcgcgccccc

SEQ ID NO: 4036457 - RNA, 12 nt, Molluscum contagiosum virus
gagcgcgcacga

SEQ ID NO: 4036458 - RNA, 22 nt, Molluscum contagiosum virus
gagcgcgcggcgccgagcaacu

SEQ ID NO: 4036459 - RNA, 18 nt, Molluscum contagiosum virus
gagcgcggcaacagcacg

SEQ ID NO: 4036460 - RNA, 21 nt, Molluscum contagiosum virus
gagcgcuucuuccggcagcug

SEQ ID NO: 4036461 - RNA, 22 nt, Molluscum contagiosum virus
gagcggaccccggugggggcaa

SEQ ID NO: 4036462 - RNA, 20 nt, Molluscum contagiosum virus
gagcggcacgggaaggcucu

SEQ ID NO: 4036463 - RNA, 19 nt, Molluscum contagiosum virus
gagcgggcaaugggcacgc

SEQ ID NO: 4036464 - RNA, 15 nt, Molluscum contagiosum virus
gagcgucgaacuucu

SEQ ID NO: 4036465 - RNA, 14 nt, Molluscum contagiosum virus
gagcguugucuuga

SEQ ID NO: 4036466 - RNA, 16 nt, Molluscum contagiosum virus
gagcuccccgcgcgca

SEQ ID NO: 4036467 - RNA, 17 nt, Molluscum contagiosum virus
gagcuccgcgcaugcca

SEQ ID NO: 4036468 - RNA, 14 nt, Molluscum contagiosum virus
gagcuccggcugcu

SEQ ID NO: 4036469 - RNA, 19 nt, Molluscum contagiosum virus
gagcuccgugcugcggcaa

SEQ ID NO: 4036470 - RNA, 18 nt, Molluscum contagiosum virus
gagcucgguagccaggcg

SEQ ID NO: 4036471 - RNA, 16 nt, Molluscum contagiosum virus
gagcucgucgcgcgcg

SEQ ID NO: 4036472 - RNA, 21 nt, Molluscum contagiosum virus
gagcucuucgacagcgugcgc

SEQ ID NO: 4036473 - RNA, 13 nt, Molluscum contagiosum virus
gagcugcagagcg

SEQ ID NO: 4036474 - RNA, 19 nt, Molluscum contagiosum virus
gagcugcagagcgugcugg

SEQ ID NO: 4036475 - RNA, 11 nt, Molluscum contagiosum virus
gagcugcugcc

SEQ ID NO: 4036476 - RNA, 15 nt, Molluscum contagiosum virus
gagcugcugcgcuac

SEQ ID NO: 4036477 - RNA, 20 nt, Molluscum contagiosum virus
gagcuggccgaagucgcagc

SEQ ID NO: 4036478 - RNA, 18 nt, Molluscum contagiosum virus
gagcugugccgcagcaac

SEQ ID NO: 4036479 - RNA, 22 nt, Molluscum contagiosum virus
gagcuguucaacaucguggcgc

SEQ ID NO: 4036480 - RNA, 13 nt, Molluscum contagiosum virus
gaggaaaggcaca

SEQ ID NO: 4036481 - RNA, 18 nt, Molluscum contagiosum virus
gaggaaaggcacaccccu

SEQ ID NO: 4036482 - RNA, 19 nt, Molluscum contagiosum virus
gaggaacuagugcugcugg

SEQ ID NO: 4036483 - RNA, 14 nt, Molluscum contagiosum virus
gaggaccccgccgc

SEQ ID NO: 4036484 - RNA, 15 nt, Molluscum contagiosum virus
gaggaccgcgagcgc

SEQ ID NO: 4036485 - RNA, 15 nt, Molluscum contagiosum virus
gaggaccucgcgcgc

SEQ ID NO: 4036486 - RNA, 20 nt, Molluscum contagiosum virus
gaggacgccggcaagccgag

SEQ ID NO: 4036487 - RNA, 23 nt, Molluscum contagiosum virus
gaggacgccggcaagccgagcca

SEQ ID NO: 4036488 - RNA, 21 nt, Molluscum contagiosum virus
gaggacgcgggcguguccgcg

SEQ ID NO: 4036489 - RNA, 15 nt, Molluscum contagiosum virus
gaggacggcgcgggc

SEQ ID NO: 4036490 - RNA, 16 nt, Molluscum contagiosum virus
gaggacuuccgcgcgc

SEQ ID NO: 4036491 - RNA, 23 nt, Molluscum contagiosum virus
gaggagauggaacugcagcagcu

SEQ ID NO: 4036492 - RNA, 14 nt, Molluscum contagiosum virus
gaggagccgcccgc

SEQ ID NO: 4036493 - RNA, 14 nt, Molluscum contagiosum virus
gaggagcucgacuc

SEQ ID NO: 4036494 - RNA, 23 nt, Molluscum contagiosum virus
gaggcccugcuugcccgcgccgc

SEQ ID NO: 4036495 - RNA, 16 nt, Molluscum contagiosum virus
gaggccggcacaagcc

SEQ ID NO: 4036496 - RNA, 14 nt, Molluscum contagiosum virus
gaggccuucgcgcc

SEQ ID NO: 4036497 - RNA, 19 nt, Molluscum contagiosum virus
gaggcgcuaccucgcggga

SEQ ID NO: 4036498 - RNA, 16 nt, Molluscum contagiosum virus
gaggcgcuagugcaga

SEQ ID NO: 4036499 - RNA, 20 nt, Molluscum contagiosum virus
gaggcgcugccgcgggacga

SEQ ID NO: 4036500 - RNA, 15 nt, Molluscum contagiosum virus
gaggcggcacugcua

SEQ ID NO: 4036501 - RNA, 14 nt, Molluscum contagiosum virus
gaggcucuguucug

SEQ ID NO: 4036502 - RNA, 12 nt, Molluscum contagiosum virus
gaggcugcucuc

SEQ ID NO: 4036503 - RNA, 21 nt, Molluscum contagiosum virus
gagggcagccucaaccugaac

SEQ ID NO: 4036504 - RNA, 20 nt, Molluscum contagiosum virus
gagggccuuggcggcgcggc

SEQ ID NO: 4036505 - RNA, 17 nt, Molluscum contagiosum virus
gaggggcaguguuccug

SEQ ID NO: 4036506 - RNA, 15 nt, Molluscum contagiosum virus
gagggucacgcgcac

SEQ ID NO: 4036507 - RNA, 15 nt, Molluscum contagiosum virus
gagggucgugcaggu

SEQ ID NO: 4036508 - RNA, 18 nt, Molluscum contagiosum virus
gaggucaagggugugggc

SEQ ID NO: 4036509 - RNA, 17 nt, Molluscum contagiosum virus
gaggucaugaccaagga

SEQ ID NO: 4036510 - RNA, 17 nt, Molluscum contagiosum virus
gaggucgagcgcgccgc

SEQ ID NO: 4036511 - RNA, 14 nt, Molluscum contagiosum virus
gaggucuagccgug

SEQ ID NO: 4036512 - RNA, 13 nt, Molluscum contagiosum virus
gaggugcgcgcaa

SEQ ID NO: 4036513 - RNA, 20 nt, Molluscum contagiosum virus
gagguucguccgcucgugcc

SEQ ID NO: 4036514 - RNA, 22 nt, Molluscum contagiosum virus
gaguaccgcgcgcacgcggcgc

SEQ ID NO: 4036515 - RNA, 23 nt, Molluscum contagiosum virus
gaguacgagcgcguaagaccaug

SEQ ID NO: 4036516 - RNA, 14 nt, Molluscum contagiosum virus
gagugacgccucga

SEQ ID NO: 4036517 - RNA, 22 nt, Molluscum contagiosum virus
gagugcgggagcaagucugcgc

SEQ ID NO: 4036518 - RNA, 13 nt, Molluscum contagiosum virus
gagugcugagcca

SEQ ID NO: 4036519 - RNA, 15 nt, Molluscum contagiosum virus
gagugcugagccaca

SEQ ID NO: 4036520 - RNA, 17 nt, Molluscum contagiosum virus
gagugcuggagcagacg

SEQ ID NO: 4036521 - RNA, 19 nt, Molluscum contagiosum virus
gagugcuggccgagcguga

SEQ ID NO: 4036522 - RNA, 22 nt, Molluscum contagiosum virus
gaguggcguccgcacgaggagc

SEQ ID NO: 4036523 - RNA, 18 nt, Molluscum contagiosum virus
gaguggcucacagccgug

SEQ ID NO: 4036524 - RNA, 14 nt, Molluscum contagiosum virus
gaguucaacacgca

SEQ ID NO: 4036525 - RNA, 23 nt, Molluscum contagiosum virus
gauacacauugcguguggggcau

SEQ ID NO: 4036526 - RNA, 16 nt, Molluscum contagiosum virus
gauaugcgccugugcc

SEQ ID NO: 4036527 - RNA, 17 nt, Molluscum contagiosum virus
gaucaccccgcagcuca

SEQ ID NO: 4036528 - RNA, 15 nt, Molluscum contagiosum virus
gaucacgaugugcgc

SEQ ID NO: 4036529 - RNA, 18 nt, Molluscum contagiosum virus
gaucaggcagcugcugcg

SEQ ID NO: 4036530 - RNA, 15 nt, Molluscum contagiosum virus
gauccacgcgugcug

SEQ ID NO: 4036531 - RNA, 14 nt, Molluscum contagiosum virus
gaucgcgcucuucc

SEQ ID NO: 4036532 - RNA, 16 nt, Molluscum contagiosum virus
gaucgcgguggcaggc

SEQ ID NO: 4036533 - RNA, 15 nt, Molluscum contagiosum virus
gaucggacucagcau

SEQ ID NO: 4036534 - RNA, 21 nt, Molluscum contagiosum virus
gaucuccacgucgaucagcuc

SEQ ID NO: 4036535 - RNA, 17 nt, Molluscum contagiosum virus
gaugaacaccauccugc

SEQ ID NO: 4036536 - RNA, 16 nt, Molluscum contagiosum virus
gaugaacuaccgugug

SEQ ID NO: 4036537 - RNA, 22 nt, Molluscum contagiosum virus
gaugcaaacauguagcgcgcgc

SEQ ID NO: 4036538 - RNA, 19 nt, Molluscum contagiosum virus
gaugccguuuucuccgugc

SEQ ID NO: 4036539 - RNA, 23 nt, Molluscum contagiosum virus
gaugcucaagcacugccucaugu

SEQ ID NO: 4036540 - RNA, 18 nt, Molluscum contagiosum virus
gaugcucuacgugcugca

SEQ ID NO: 4036541 - RNA, 13 nt, Molluscum contagiosum virus
gaugcugcgcgug

SEQ ID NO: 4036542 - RNA, 14 nt, Molluscum contagiosum virus
gauggucucgcugc

SEQ ID NO: 4036543 - RNA, 20 nt, Molluscum contagiosum virus
gauguagguacccgcaaccc

SEQ ID NO: 4036544 - RNA, 19 nt, Molluscum contagiosum virus
gauucacuuucgucgccuc

SEQ ID NO: 4036545 - RNA, 19 nt, Molluscum contagiosum virus
gauucccaucgacgagguc

SEQ ID NO: 4036546 - RNA, 13 nt, Molluscum contagiosum virus
gauuucgcgcagc

SEQ ID NO: 4036547 - RNA, 14 nt, Molluscum contagiosum virus
gauuucgcgcagca

SEQ ID NO: 4036548 - RNA, 22 nt, Molluscum contagiosum virus
gcaaaagcgcucgcggcucggc

SEQ ID NO: 4036549 - RNA, 13 nt, Molluscum contagiosum virus
gcaaacgcacugu

SEQ ID NO: 4036550 - RNA, 21 nt, Molluscum contagiosum virus
gcaaacgcugacggcgcugcg

SEQ ID NO: 4036551 - RNA, 23 nt, Molluscum contagiosum virus
gcaaacgcuguuuucacgcaagg

SEQ ID NO: 4036552 - RNA, 22 nt, Molluscum contagiosum virus
gcaaagaaugcaugcggagcug

SEQ ID NO: 4036553 - RNA, 16 nt, Molluscum contagiosum virus
gcaaagacgagggaug

SEQ ID NO: 4036554 - RNA, 14 nt, Molluscum contagiosum virus
gcaacaaagaggaa

SEQ ID NO: 4036555 - RNA, 20 nt, Molluscum contagiosum virus
gcaacaaggaaaggcacccg

SEQ ID NO: 4036556 - RNA, 19 nt, Molluscum contagiosum virus
gcaacaggaaagcuucugu

SEQ ID NO: 4036557 - RNA, 18 nt, Molluscum contagiosum virus
gcaaccagcuggcgcccg

SEQ ID NO: 4036558 - RNA, 15 nt, Molluscum contagiosum virus
gcaaccgcgcccgcg

SEQ ID NO: 4036559 - RNA, 15 nt, Molluscum contagiosum virus
gcaaccgcgugcgug

SEQ ID NO: 4036560 - RNA, 23 nt, Molluscum contagiosum virus
gcaaccucgggaagcccucaggg

SEQ ID NO: 4036561 - RNA, 13 nt, Molluscum contagiosum virus
gcaacgcgggcca

SEQ ID NO: 4036562 - RNA, 18 nt, Molluscum contagiosum virus
gcaacgcgggccaggcac

SEQ ID NO: 4036563 - RNA, 18 nt, Molluscum contagiosum virus
gcaacguugugcgcaacg

SEQ ID NO: 4036564 - RNA, 12 nt, Molluscum contagiosum virus
gcaacugccugc

SEQ ID NO: 4036565 - RNA, 20 nt, Molluscum contagiosum virus
gcaagaagaucgcggcgccg

SEQ ID NO: 4036566 - RNA, 15 nt, Molluscum contagiosum virus
gcaagagccgccggg

SEQ ID NO: 4036567 - RNA, 16 nt, Molluscum contagiosum virus
gcaagaggggagccag

SEQ ID NO: 4036568 - RNA, 20 nt, Molluscum contagiosum virus
gcaagcaccggcagcgcgau

SEQ ID NO: 4036569 - RNA, 23 nt, Molluscum contagiosum virus
gcaagcccgcgcgcgagcuggag

SEQ ID NO: 4036570 - RNA, 13 nt, Molluscum contagiosum virus
gcaagccuggcuc

SEQ ID NO: 4036571 - RNA, 15 nt, Molluscum contagiosum virus
gcaagccuggcuccu

SEQ ID NO: 4036572 - RNA, 13 nt, Molluscum contagiosum virus
gcaagcgcccgcg

SEQ ID NO: 4036573 - RNA, 21 nt, Molluscum contagiosum virus
gcaagcgccgccaugcugcgc

SEQ ID NO: 4036574 - RNA, 14 nt, Molluscum contagiosum virus
gcaagcgcguucgc

SEQ ID NO: 4036575 - RNA, 16 nt, Molluscum contagiosum virus
gcaagcgcguucgcgc

SEQ ID NO: 4036576 - RNA, 20 nt, Molluscum contagiosum virus
gcaagcguacgcgucgcgga

SEQ ID NO: 4036577 - RNA, 16 nt, Molluscum contagiosum virus
gcaagcugagcgcgcu

SEQ ID NO: 4036578 - RNA, 15 nt, Molluscum contagiosum virus
gcaagcuuugugcuc

SEQ ID NO: 4036579 - RNA, 14 nt, Molluscum contagiosum virus
gcaaggcggacgcc

SEQ ID NO: 4036580 - RNA, 15 nt, Molluscum contagiosum virus
gcaagggcuccuucu

SEQ ID NO: 4036581 - RNA, 16 nt, Molluscum contagiosum virus
gcaaguacaacccaaa

SEQ ID NO: 4036582 - RNA, 14 nt, Molluscum contagiosum virus
gcaagucucccucg

SEQ ID NO: 4036583 - RNA, 21 nt, Molluscum contagiosum virus
gcaaucgcgugcuugcugcgc

SEQ ID NO: 4036584 - RNA, 16 nt, Molluscum contagiosum virus
gcaaugcgugcgugcg

SEQ ID NO: 4036585 - RNA, 14 nt, Molluscum contagiosum virus
gcacaaaacacaaa

SEQ ID NO: 4036586 - RNA, 17 nt, Molluscum contagiosum virus
ggaucggagcgcagcug

SEQ ID NO: 4036587 - RNA, 21 nt, Molluscum contagiosum virus
ggaugcuggugucgagcucgc

SEQ ID NO: 4036588 - RNA, 23 nt, Molluscum contagiosum virus
ggcaaagaguugcgcgagaacuc

SEQ ID NO: 4036589 - RNA, 20 nt, Molluscum contagiosum virus
ggcaaccgcgcccgcgcgcu

SEQ ID NO: 4036590 - RNA, 22 nt, Molluscum contagiosum virus
ggcaagaccaucaucgcgcugc

SEQ ID NO: 4036591 - RNA, 10 nt, Molluscum contagiosum virus
ggcaagccug

SEQ ID NO: 4036592 - RNA, 18 nt, Molluscum contagiosum virus
ggcaaugccgaugcuagc

SEQ ID NO: 4036593 - RNA, 20 nt, Molluscum contagiosum virus
ggcacacacuugcacgcgca

SEQ ID NO: 4036594 - RNA, 17 nt, Molluscum contagiosum virus
ggcacccaccaggaacg

SEQ ID NO: 4036595 - RNA, 17 nt, Molluscum contagiosum virus
ggcaccccgaaggaaag

SEQ ID NO: 4036596 - RNA, 18 nt, Molluscum contagiosum virus
ggcacccgcaggaaaggc

SEQ ID NO: 4036597 - RNA, 18 nt, Molluscum contagiosum virus
ggcacccgugcgcgcgcu

SEQ ID NO: 4036598 - RNA, 15 nt, Molluscum contagiosum virus
ggcacccuggcugcu

SEQ ID NO: 4036599 - RNA, 21 nt, Molluscum contagiosum virus
ggcacccuggcugcugcgcga

SEQ ID NO: 4036600 - RNA, 20 nt, Molluscum contagiosum virus
ggcaccgcggcgggugccgc

SEQ ID NO: 4036601 - RNA, 20 nt, Molluscum contagiosum virus
ggcaccguaccgcgcccgcc

SEQ ID NO: 4036602 - RNA, 14 nt, Molluscum contagiosum virus
ggcaccugcaggaa

SEQ ID NO: 4036603 - RNA, 15 nt, Molluscum contagiosum virus
ggcaccugcaggaaa

SEQ ID NO: 4036604 - RNA, 17 nt, Molluscum contagiosum virus
ggcacgagcaguccgcc

SEQ ID NO: 4036605 - RNA, 15 nt, Molluscum contagiosum virus
ggcacgcacaaaguu

SEQ ID NO: 4036606 - RNA, 18 nt, Molluscum contagiosum virus
ggcacgccgcagcgcugg

SEQ ID NO: 4036607 - RNA, 12 nt, Molluscum contagiosum virus
ggcacgggcucg

SEQ ID NO: 4036608 - RNA, 22 nt, Molluscum contagiosum virus
ggcacgugcugcugcggcugcu

SEQ ID NO: 4036609 - RNA, 16 nt, Molluscum contagiosum virus
ggcacugcguacacau

SEQ ID NO: 4036610 - RNA, 22 nt, Molluscum contagiosum virus
ggcagaacaguaacugcugcag

SEQ ID NO: 4036611 - RNA, 14 nt, Molluscum contagiosum virus
ggcagauagcucgc

SEQ ID NO: 4036612 - RNA, 14 nt, Molluscum contagiosum virus
ggcagcaacugcac

SEQ ID NO: 4036613 - RNA, 20 nt, Molluscum contagiosum virus
ggcagcaacugcacagggau

SEQ ID NO: 4036614 - RNA, 14 nt, Molluscum contagiosum virus
ggcagccgccuggc

SEQ ID NO: 4036615 - RNA, 15 nt, Molluscum contagiosum virus
ggcagcgccgcgcgc

SEQ ID NO: 4036616 - RNA, 16 nt, Molluscum contagiosum virus
ggcagcgccgcgcgcg

SEQ ID NO: 4036617 - RNA, 12 nt, Molluscum contagiosum virus
ggcagcugcugc

SEQ ID NO: 4036618 - RNA, 20 nt, Molluscum contagiosum virus
ggcaggagccucuguccugc

SEQ ID NO: 4036619 - RNA, 17 nt, Molluscum contagiosum virus
ggcaggccgcccacgcu

SEQ ID NO: 4036620 - RNA, 21 nt, Molluscum contagiosum virus
ggcaggcggccgcguugcagc

SEQ ID NO: 4036621 - RNA, 12 nt, Molluscum contagiosum virus
ggcaggcucccg

SEQ ID NO: 4036622 - RNA, 22 nt, Molluscum contagiosum virus
ggcagugcuugcuucggcggcu

SEQ ID NO: 4036623 - RNA, 21 nt, Molluscum contagiosum virus
ggcauaccugugccagcgccu

SEQ ID NO: 4036624 - RNA, 16 nt, Molluscum contagiosum virus
ggcaucaugagccagu

SEQ ID NO: 4036625 - RNA, 21 nt, Molluscum contagiosum virus
ggcaugcgcgcagugccgcug

SEQ ID NO: 4036626 - RNA, 13 nt, Molluscum contagiosum virus
ggccacgcucgcg

SEQ ID NO: 4036627 - RNA, 14 nt, Molluscum contagiosum virus
ggccacgcucgcgc

SEQ ID NO: 4036628 - RNA, 17 nt, Molluscum contagiosum virus
ggccacgcucgcgcgca

SEQ ID NO: 4036629 - RNA, 19 nt, Molluscum contagiosum virus
ggccacucucccgggcucu

SEQ ID NO: 4036630 - RNA, 20 nt, Molluscum contagiosum virus
ggccacucucccgggcucug

SEQ ID NO: 4036631 - RNA, 21 nt, Molluscum contagiosum virus
ggccagcacaagccguccgcc

SEQ ID NO: 4036632 - RNA, 15 nt, Molluscum contagiosum virus
ggccagcgugcagac

SEQ ID NO: 4036633 - RNA, 23 nt, Molluscum contagiosum virus
ggccaugaucauggcgccgcugc

SEQ ID NO: 4036634 - RNA, 16 nt, Molluscum contagiosum virus
ggccaugucugugcgc

SEQ ID NO: 4036635 - RNA, 23 nt, Molluscum contagiosum virus
ggcccaccuucuugucgcgcgcc

SEQ ID NO: 4036636 - RNA, 13 nt, Molluscum contagiosum virus
ggccccugcgcga

SEQ ID NO: 4036637 - RNA, 17 nt, Molluscum contagiosum virus
ggcccgcgcggagacgc

SEQ ID NO: 4036638 - RNA, 20 nt, Molluscum contagiosum virus
ggcccgugcucaggccagca

SEQ ID NO: 4036639 - RNA, 22 nt, Molluscum contagiosum virus
ggcccuucuugacgcgagacug

SEQ ID NO: 4036640 - RNA, 23 nt, Molluscum contagiosum virus
ggcccuucuugacgcgagacugu

SEQ ID NO: 4036641 - RNA, 23 nt, Molluscum contagiosum virus
ggcccuuuucuaggccucagccg

SEQ ID NO: 4036642 - RNA, 19 nt, Molluscum contagiosum virus
ggccgaagucgcagcagcg

SEQ ID NO: 4036643 - RNA, 12 nt, Molluscum contagiosum virus
ggccgacggcac

SEQ ID NO: 4036644 - RNA, 15 nt, Molluscum contagiosum virus
ggccgacggcacggg

SEQ ID NO: 4036645 - RNA, 14 nt, Molluscum contagiosum virus
ggccgagcgugacc

SEQ ID NO: 4036646 - RNA, 16 nt, Molluscum contagiosum virus
ggccgaggcacgcggu

SEQ ID NO: 4036647 - RNA, 14 nt, Molluscum contagiosum virus
ggccgcacucgccg

SEQ ID NO: 4036648 - RNA, 13 nt, Molluscum contagiosum virus
ggccgcaugcacc

SEQ ID NO: 4036649 - RNA, 21 nt, Molluscum contagiosum virus
ggccgcaugcaccuacgcgcc

SEQ ID NO: 4036650 - RNA, 18 nt, Molluscum contagiosum virus
ggccgcauuuucucugga

SEQ ID NO: 4036651 - RNA, 14 nt, Molluscum contagiosum virus
ggccgcccacgcuc

SEQ ID NO: 4036652 - RNA, 19 nt, Molluscum contagiosum virus
ggccgcccacgcucaacca

SEQ ID NO: 4036653 - RNA, 19 nt, Molluscum contagiosum virus
ggccgcgaggcaugucgcg

SEQ ID NO: 4036654 - RNA, 19 nt, Molluscum contagiosum virus
ggccgcggaggacucggag

SEQ ID NO: 4036655 - RNA, 22 nt, Molluscum contagiosum virus
ggccgcggaggacucggaggcc

SEQ ID NO: 4036656 - RNA, 14 nt, Molluscum contagiosum virus
ggccgcuagcaggc

SEQ ID NO: 4036657 - RNA, 16 nt, Molluscum contagiosum virus
ggccgcuccagagccg

SEQ ID NO: 4036658 - RNA, 15 nt, Molluscum contagiosum virus
ggccggcgcgccgcg

SEQ ID NO: 4036659 - RNA, 17 nt, Molluscum contagiosum virus
ggccgucgcgagcuugg

SEQ ID NO: 4036660 - RNA, 14 nt, Molluscum contagiosum virus
ggccgugcagagca

SEQ ID NO: 4036661 - RNA, 13 nt, Molluscum contagiosum virus
ggccugcacggcu

SEQ ID NO: 4036662 - RNA, 18 nt, Molluscum contagiosum virus
ggccugcccugcucaugc

SEQ ID NO: 4036663 - RNA, 17 nt, Molluscum contagiosum virus
ggccugcguggacagca

SEQ ID NO: 4036664 - RNA, 14 nt, Molluscum contagiosum virus
ggccugcugaagaa

SEQ ID NO: 4036665 - RNA, 20 nt, Molluscum contagiosum virus
ggccugcugaagaaggagcc

SEQ ID NO: 4036666 - RNA, 14 nt, Molluscum contagiosum virus
ggccugugcugugc

SEQ ID NO: 4036667 - RNA, 17 nt, Molluscum contagiosum virus
ggccuguucggcaugca

SEQ ID NO: 4036668 - RNA, 19 nt, Molluscum contagiosum virus
ggccuucuaccacagguuu

SEQ ID NO: 4036669 - RNA, 23 nt, Molluscum contagiosum virus
ggccuucuaccacagguuucuca

SEQ ID NO: 4036670 - RNA, 14 nt, Molluscum contagiosum virus
ggccuugggcacuu

SEQ ID NO: 4036671 - RNA, 16 nt, Molluscum contagiosum virus
ggccuuuagcagcggc

SEQ ID NO: 4036672 - RNA, 20 nt, Molluscum contagiosum virus
ggcgaacaucucggcuccgc

SEQ ID NO: 4036673 - RNA, 18 nt, Molluscum contagiosum virus
ggcgacaacgacagagcc

SEQ ID NO: 4036674 - RNA, 19 nt, Molluscum contagiosum virus
ggcgacaacgacagagccc

SEQ ID NO: 4036675 - RNA, 18 nt, Molluscum contagiosum virus
ggcgaccagcugguccug

SEQ ID NO: 4036676 - RNA, 20 nt, Molluscum contagiosum virus
ggcgacguucgagaccagcc

SEQ ID NO: 4036677 - RNA, 18 nt, Molluscum contagiosum virus
ggcgagacgugcggcacg

SEQ ID NO: 4036678 - RNA, 19 nt, Molluscum contagiosum virus
ggcgagcaucugcgcgugc

SEQ ID NO: 4036679 - RNA, 14 nt, Molluscum contagiosum virus
ggcgagcgcucugc

SEQ ID NO: 4036680 - RNA, 23 nt, Molluscum contagiosum virus
ggcgagucucccguggcgcgccg

SEQ ID NO: 4036681 - RNA, 23 nt, Molluscum contagiosum virus
ggcgcaaccgcgugcgugcacag

SEQ ID NO: 4036682 - RNA, 16 nt, Molluscum contagiosum virus
ggcgcaacgcuggccg

SEQ ID NO: 4036683 - RNA, 15 nt, Molluscum contagiosum virus
ggcgcaagcgcaagc

SEQ ID NO: 4036684 - RNA, 24 nt, Molluscum contagiosum virus
ggcgcacacuccucggcgcuacgc

SEQ ID NO: 4036685 - RNA, 20 nt, Molluscum contagiosum virus
ggcgcacauuaguagcgagc

SEQ ID NO: 4036686 - RNA, 17 nt, Molluscum contagiosum virus
ggcgcaccugcuagagc

SEQ ID NO: 4036687 - RNA, 19 nt, Molluscum contagiosum virus
ggcgcaccuuuggugcaga

SEQ ID NO: 4036688 - RNA, 18 nt, Molluscum contagiosum virus
ggcgcacgccgaagagcc

SEQ ID NO: 4036689 - RNA, 20 nt, Molluscum contagiosum virus
ggcgcacgccgaagagccgc

SEQ ID NO: 4036690 - RNA, 15 nt, Molluscum contagiosum virus
ggcgcacgcggcucu

SEQ ID NO: 4036691 - RNA, 12 nt, Molluscum contagiosum virus
ggcgcacgcuug

SEQ ID NO: 4036692 - RNA, 24 nt, Molluscum contagiosum virus
ggcgcacggugugcuacugcacug

SEQ ID NO: 4036693 - RNA, 14 nt, Molluscum contagiosum virus
ggcgcagcaggaug

SEQ ID NO: 4036694 - RNA, 15 nt, Molluscum contagiosum virus
ggcgcagcgcggccu

SEQ ID NO: 4036695 - RNA, 16 nt, Molluscum contagiosum virus
ggcgcaggccgcgccc

SEQ ID NO: 4036696 - RNA, 22 nt, Molluscum contagiosum virus
ggcgcaggugcgggcuagcacg

SEQ ID NO: 4036697 - RNA, 18 nt, Molluscum contagiosum virus
ggcgcauccuccacgcug

SEQ ID NO: 4036698 - RNA, 22 nt, Molluscum contagiosum virus
ggcgcaucucgauucacaucuu

SEQ ID NO: 4036699 - RNA, 16 nt, Molluscum contagiosum virus
ggcgccaaccgcgagc

SEQ ID NO: 4036700 - RNA, 19 nt, Molluscum contagiosum virus
ggcgccagcuaagccggag

SEQ ID NO: 4036701 - RNA, 16 nt, Molluscum contagiosum virus
ggcgcccuuccuggag

SEQ ID NO: 4036702 - RNA, 16 nt, Molluscum contagiosum virus
ggcgccgaugcagugc

SEQ ID NO: 4036703 - RNA, 18 nt, Molluscum contagiosum virus
ggcgccgccccgccagca

SEQ ID NO: 4036704 - RNA, 17 nt, Molluscum contagiosum virus
ggcgccgcgcugaugcu

SEQ ID NO: 4036705 - RNA, 18 nt, Molluscum contagiosum virus
ggcgccgcuaccagcucg

SEQ ID NO: 4036706 - RNA, 14 nt, Molluscum contagiosum virus
ggcgccgcugcugg

SEQ ID NO: 4036707 - RNA, 16 nt, Molluscum contagiosum virus
ggcgccggcgcgcgcg

SEQ ID NO: 4036708 - RNA, 20 nt, Molluscum contagiosum virus
ggcgccguccaugugcccgc

SEQ ID NO: 4036709 - RNA, 17 nt, Molluscum contagiosum virus
ggcgcgaagcaggcgcc

SEQ ID NO: 4036710 - RNA, 20 nt, Molluscum contagiosum virus
ggcgcgagaugcucgccggc

SEQ ID NO: 4036711 - RNA, 21 nt, Molluscum contagiosum virus
ggcgcgagaugcucgccggca

SEQ ID NO: 4036712 - RNA, 15 nt, Molluscum contagiosum virus
ggcgcgcagcucgcc

SEQ ID NO: 4036713 - RNA, 16 nt, Molluscum contagiosum virus
ggcgcgcagcucgccg

SEQ ID NO: 4036714 - RNA, 13 nt, Molluscum contagiosum virus
ggcgcgcccagcg

SEQ ID NO: 4036715 - RNA, 14 nt, Molluscum contagiosum virus
ggcgcgccgccggu

SEQ ID NO: 4036716 - RNA, 11 nt, Molluscum contagiosum virus
ggcgcgccgcg

SEQ ID NO: 4036717 - RNA, 21 nt, Molluscum contagiosum virus
ggcgcgccgcgggccgccggg

SEQ ID NO: 4036718 - RNA, 20 nt, Molluscum contagiosum virus
ggcgcgccuaguucgagaag

SEQ ID NO: 4036719 - RNA, 19 nt, Molluscum contagiosum virus
ggcgcgcgagcacagcgcg

SEQ ID NO: 4036720 - RNA, 23 nt, Molluscum contagiosum virus
ggcgcgcgagcacagcgcgcgga

SEQ ID NO: 4036721 - RNA, 16 nt, Molluscum contagiosum virus
ggcgcgcgagcugcua

SEQ ID NO: 4036722 - RNA, 15 nt, Molluscum contagiosum virus
ggcgcgcgcgcgccg

SEQ ID NO: 4036723 - RNA, 13 nt, Molluscum contagiosum virus
ggcgcgcgugcuu

SEQ ID NO: 4036724 - RNA, 17 nt, Molluscum contagiosum virus
ggcgcgggagcucacgg

SEQ ID NO: 4036725 - RNA, 13 nt, Molluscum contagiosum virus
ggcgcgggcgcgc

SEQ ID NO: 4036726 - RNA, 17 nt, Molluscum contagiosum virus
ggcgcggucgcccgccg

SEQ ID NO: 4036727 - RNA, 12 nt, Molluscum contagiosum virus
ggcgcgugccgc

SEQ ID NO: 4036728 - RNA, 17 nt, Molluscum contagiosum virus
ggcgcguuucggccugc

SEQ ID NO: 4036729 - RNA, 18 nt, Molluscum contagiosum virus
ggcgcguuuucgcggccu

SEQ ID NO: 4036730 - RNA, 16 nt, Molluscum contagiosum virus
ggcgcucgccuuuccc

SEQ ID NO: 4036731 - RNA, 14 nt, Molluscum contagiosum virus
ggcgcucgcgcgca

SEQ ID NO: 4036732 - RNA, 21 nt, Molluscum contagiosum virus
ggcgcucggcguggugcuggc

SEQ ID NO: 4036733 - RNA, 13 nt, Molluscum contagiosum virus
ggcgcugcucgcg

SEQ ID NO: 4036734 - RNA, 20 nt, Molluscum contagiosum virus
ggcgcugucgcgcaggcucu

SEQ ID NO: 4036735 - RNA, 13 nt, Molluscum contagiosum virus
ggcgcuuggcgag

SEQ ID NO: 4036736 - RNA, 15 nt, Molluscum contagiosum virus
ggcggaaguggugcc

SEQ ID NO: 4036737 - RNA, 17 nt, Molluscum contagiosum virus
ggcggcaagcuuugcuu

SEQ ID NO: 4036738 - RNA, 14 nt, Molluscum contagiosum virus
ggcggcacccgccg

SEQ ID NO: 4036739 - RNA, 21 nt, Molluscum contagiosum virus
ggcggcacccgccgcggugcc

SEQ ID NO: 4036740 - RNA, 16 nt, Molluscum contagiosum virus
ggcggccaaccgccug

SEQ ID NO: 4036741 - RNA, 19 nt, Molluscum contagiosum virus
ggcggcgcacgcggcucug

SEQ ID NO: 4036742 - RNA, 14 nt, Molluscum contagiosum virus
ggcggcggccacgc

SEQ ID NO: 4036743 - RNA, 16 nt, Molluscum contagiosum virus
ggcggcgucgcgcgcg

SEQ ID NO: 4036744 - RNA, 13 nt, Molluscum contagiosum virus
ggcggggcugcug

SEQ ID NO: 4036745 - RNA, 14 nt, Molluscum contagiosum virus
ggcgggggcagcag

SEQ ID NO: 4036746 - RNA, 19 nt, Molluscum contagiosum virus
ggcguacgcgcagggagcu

SEQ ID NO: 4036747 - RNA, 14 nt, Molluscum contagiosum virus
ggcguacgugcgcc

SEQ ID NO: 4036748 - RNA, 18 nt, Molluscum contagiosum virus
ggcguacgugcgccagcu

SEQ ID NO: 4036749 - RNA, 21 nt, Molluscum contagiosum virus
ggcguccggcgcuugccccuc

SEQ ID NO: 4036750 - RNA, 17 nt, Molluscum contagiosum virus
ggcguccggugcucgcc

SEQ ID NO: 4036751 - RNA, 21 nt, Molluscum contagiosum virus
ggcguccggugcucgccccuc

SEQ ID NO: 4036752 - RNA, 18 nt, Molluscum contagiosum virus
ggcgucgugcaccuggag

SEQ ID NO: 4036753 - RNA, 16 nt, Molluscum contagiosum virus
ggcgugcucagcacca

SEQ ID NO: 4036754 - RNA, 16 nt, Molluscum contagiosum virus
ggcgugcugugccugc

SEQ ID NO: 4036755 - RNA, 13 nt, Molluscum contagiosum virus
ggcuaagcucugc

SEQ ID NO: 4036756 - RNA, 18 nt, Molluscum contagiosum virus
ggcuccuucuucagcagg

SEQ ID NO: 4036757 - RNA, 15 nt, Molluscum contagiosum virus
ggcucgaggugugcc

SEQ ID NO: 4036758 - RNA, 21 nt, Molluscum contagiosum virus
ggcucgcggcuaggacuagca

SEQ ID NO: 4036759 - RNA, 19 nt, Molluscum contagiosum virus
ggcucguacugcugcaggc

SEQ ID NO: 4036760 - RNA, 19 nt, Molluscum contagiosum virus
ggcucucaacugcaggccc

SEQ ID NO: 4036761 - RNA, 21 nt, Molluscum contagiosum virus
ggcugcagcccuuccacgaca

SEQ ID NO: 4036762 - RNA, 13 nt, Molluscum contagiosum virus
ggcugcccgcgga

SEQ ID NO: 4036763 - RNA, 20 nt, Molluscum contagiosum virus
ggcugccggcgcgugagcgc

SEQ ID NO: 4036764 - RNA, 23 nt, Molluscum contagiosum virus
ggcugccguuuuacacagggcuu

SEQ ID NO: 4036765 - RNA, 16 nt, Molluscum contagiosum virus
ggcugcugccgcgcgu

SEQ ID NO: 4036766 - RNA, 18 nt, Molluscum contagiosum virus
ggcugcuggcggugcucu

SEQ ID NO: 4036767 - RNA, 19 nt, Molluscum contagiosum virus
ggcuggaccugcgccagcg

SEQ ID NO: 4036768 - RNA, 15 nt, Molluscum contagiosum virus
ggcuguguuccagcu

SEQ ID NO: 4036769 - RNA, 22 nt, Molluscum contagiosum virus
gggaauaccggagacaccagcu

SEQ ID NO: 4036770 - RNA, 21 nt, Molluscum contagiosum virus
gggacacgcacuugcgcgccu

SEQ ID NO: 4036771 - RNA, 13 nt, Molluscum contagiosum virus
gggacggaauuug

SEQ ID NO: 4036772 - RNA, 17 nt, Molluscum contagiosum virus
gggagccagccucucuc

SEQ ID NO: 4036773 - RNA, 17 nt, Molluscum contagiosum virus
gggaugcgcacacuugc

SEQ ID NO: 4036774 - RNA, 21 nt, Molluscum contagiosum virus
gggauugaccucgcgacggga

SEQ ID NO: 4036775 - RNA, 22 nt, Molluscum contagiosum virus
gggauuugccgguugcgcgugu

SEQ ID NO: 4036776 - RNA, 13 nt, Molluscum contagiosum virus
gggcaagcucgcg

SEQ ID NO: 4036777 - RNA, 20 nt, Molluscum contagiosum virus
gggcaagcucgcgcugcuga

SEQ ID NO: 4036778 - RNA, 19 nt, Molluscum contagiosum virus
gggcacauggacggcgccu

SEQ ID NO: 4036779 - RNA, 18 nt, Molluscum contagiosum virus
gggcacggcacccgccag

SEQ ID NO: 4036780 - RNA, 19 nt, Molluscum contagiosum virus
gggcagggaaagagcacgc

SEQ ID NO: 4036781 - RNA, 14 nt, Molluscum contagiosum virus
gggcccugugccuc

SEQ ID NO: 4036782 - RNA, 17 nt, Molluscum contagiosum virus
gggcccugugccucuug

SEQ ID NO: 4036783 - RNA, 12 nt, Molluscum contagiosum virus
gggccgcgaggc

SEQ ID NO: 4036784 - RNA, 20 nt, Molluscum contagiosum virus
gggccuguucggcaugcagc

SEQ ID NO: 4036785 - RNA, 15 nt, Molluscum contagiosum virus
gggcgagcaguguga

SEQ ID NO: 4036786 - RNA, 11 nt, Molluscum contagiosum virus
gggcgccagcu

SEQ ID NO: 4036787 - RNA, 14 nt, Molluscum contagiosum virus
gggcgccgcggccu

SEQ ID NO: 4036788 - RNA, 17 nt, Molluscum contagiosum virus
gggcgcgaccggcgugc

SEQ ID NO: 4036789 - RNA, 20 nt, Molluscum contagiosum virus
gggcgcgaccuuagcgaggu

SEQ ID NO: 4036790 - RNA, 18 nt, Molluscum contagiosum virus
gggcgcgcgccagcagcg

SEQ ID NO: 4036791 - RNA, 20 nt, Molluscum contagiosum virus
gugcgcucggaggggcuccg

SEQ ID NO: 4036792 - RNA, 14 nt, Molluscum contagiosum virus
gugcguacccuggc

SEQ ID NO: 4036793 - RNA, 15 nt, Molluscum contagiosum virus
gugcguacccuggca

SEQ ID NO: 4036794 - RNA, 13 nt, Molluscum contagiosum virus
gugcgugcccagc

SEQ ID NO: 4036795 - RNA, 19 nt, Molluscum contagiosum virus
gugcgugcccagcagguag

SEQ ID NO: 4036796 - RNA, 15 nt, Molluscum contagiosum virus
gugcgugcgcugcgc

SEQ ID NO: 4036797 - RNA, 14 nt, Molluscum contagiosum virus
gugcuccacgcgca

SEQ ID NO: 4036798 - RNA, 22 nt, Molluscum contagiosum virus
gugcuccacgcgcagcuucucu

SEQ ID NO: 4036799 - RNA, 17 nt, Molluscum contagiosum virus
gugcuccgaggaggcaa

SEQ ID NO: 4036800 - RNA, 14 nt, Molluscum contagiosum virus
gugcucgcacacgu

SEQ ID NO: 4036801 - RNA, 17 nt, Molluscum contagiosum virus
gugcucgcacacgugca

SEQ ID NO: 4036802 - RNA, 22 nt, Molluscum contagiosum virus
gugcucgcgagcguuucugccg

SEQ ID NO: 4036803 - RNA, 22 nt, Molluscum contagiosum virus
gugcucguggaaaagcagggcc

SEQ ID NO: 4036804 - RNA, 20 nt, Molluscum contagiosum virus
gugcucguguguccgcacgc

SEQ ID NO: 4036805 - RNA, 13 nt, Molluscum contagiosum virus
gugcugcgcacgc

SEQ ID NO: 4036806 - RNA, 17 nt, Molluscum contagiosum virus
gugcugcgccacgugcg

SEQ ID NO: 4036807 - RNA, 16 nt, Molluscum contagiosum virus
gugcugcgcgcccagg

SEQ ID NO: 4036808 - RNA, 20 nt, Molluscum contagiosum virus
gugcugcgcgcccaggcgcg

SEQ ID NO: 4036809 - RNA, 16 nt, Molluscum contagiosum virus
gugcugcgucacaagc

SEQ ID NO: 4036810 - RNA, 17 nt, Molluscum contagiosum virus
gugcugcucugcgugcu

SEQ ID NO: 4036811 - RNA, 23 nt, Molluscum contagiosum virus
gugcugcugcggcugcuggagcu

SEQ ID NO: 4036812 - RNA, 12 nt, Molluscum contagiosum virus
gugcuggggcua

SEQ ID NO: 4036813 - RNA, 19 nt, Molluscum contagiosum virus
gugcuggggcuagcgcugc

SEQ ID NO: 4036814 - RNA, 16 nt, Molluscum contagiosum virus
gugcuggugcugguca

SEQ ID NO: 4036815 - RNA, 21 nt, Molluscum contagiosum virus
gugcugucccucugugcggag

SEQ ID NO: 4036816 - RNA, 22 nt, Molluscum contagiosum virus
gugcuguccuacuucgucaagc

SEQ ID NO: 4036817 - RNA, 18 nt, Molluscum contagiosum virus
guggagccugaggccgcg

SEQ ID NO: 4036818 - RNA, 19 nt, Molluscum contagiosum virus
guggaguuuagcaagguca

SEQ ID NO: 4036819 - RNA, 16 nt, Molluscum contagiosum virus
guggcaugcgcccuca

SEQ ID NO: 4036820 - RNA, 23 nt, Molluscum contagiosum virus
guggccaaagucuuccuggggcu

SEQ ID NO: 4036821 - RNA, 18 nt, Molluscum contagiosum virus
guggccaacggcgccauc

SEQ ID NO: 4036822 - RNA, 21 nt, Molluscum contagiosum virus
guggccaacuucgcggucgac

SEQ ID NO: 4036823 - RNA, 15 nt, Molluscum contagiosum virus
guggccaaggucucg

SEQ ID NO: 4036824 - RNA, 18 nt, Molluscum contagiosum virus
guggccgagccgcuggcc

SEQ ID NO: 4036825 - RNA, 21 nt, Molluscum contagiosum virus
guggccgcgccgggcgccaga

SEQ ID NO: 4036826 - RNA, 22 nt, Molluscum contagiosum virus
guggccgcgccgggcgccagaa

SEQ ID NO: 4036827 - RNA, 18 nt, Molluscum contagiosum virus
guggcgccgaugcagugc

SEQ ID NO: 4036828 - RNA, 20 nt, Molluscum contagiosum virus
guggcgcgcgagcugcugcg

SEQ ID NO: 4036829 - RNA, 14 nt, Molluscum contagiosum virus
guggcggcucugcc

SEQ ID NO: 4036830 - RNA, 17 nt, Molluscum contagiosum virus
guggcguugcugcugcg

SEQ ID NO: 4036831 - RNA, 13 nt, Molluscum contagiosum virus
gugggccgcggcg

SEQ ID NO: 4036832 - RNA, 20 nt, Molluscum contagiosum virus
gugggcgacgugaagacgcu

SEQ ID NO: 4036833 - RNA, 23 nt, Molluscum contagiosum virus
gugggcgccgcggcgggggcagc

SEQ ID NO: 4036834 - RNA, 14 nt, Molluscum contagiosum virus
gugguccaccagcu

SEQ ID NO: 4036835 - RNA, 16 nt, Molluscum contagiosum virus
guggugcugggcgugg

SEQ ID NO: 4036836 - RNA, 20 nt, Molluscum contagiosum virus
guguacgacgugcugcugca

SEQ ID NO: 4036837 - RNA, 21 nt, Molluscum contagiosum virus
gugucaacuucgcgcuguacc

SEQ ID NO: 4036838 - RNA, 18 nt, Molluscum contagiosum virus
gugucgagcucgcgcgcc

SEQ ID NO: 4036839 - RNA, 14 nt, Molluscum contagiosum virus
gugugcacauugcu

SEQ ID NO: 4036840 - RNA, 21 nt, Molluscum contagiosum virus
gugugccuguuugccacggcc

SEQ ID NO: 4036841 - RNA, 13 nt, Molluscum contagiosum virus
guguucugcgcgc

SEQ ID NO: 4036842 - RNA, 16 nt, Molluscum contagiosum virus
guguuggccaggcgcg

SEQ ID NO: 4036843 - RNA, 14 nt, Molluscum contagiosum virus
guguuuugugccug

SEQ ID NO: 4036844 - RNA, 17 nt, Molluscum contagiosum virus
guuaaauggacgugcuc

SEQ ID NO: 4036845 - RNA, 14 nt, Molluscum contagiosum virus
guuaaucacgauga

SEQ ID NO: 4036846 - RNA, 14 nt, Molluscum contagiosum virus
guuccacuccugug

SEQ ID NO: 4036847 - RNA, 16 nt, Molluscum contagiosum virus
guuccagcagcgccag

SEQ ID NO: 4036848 - RNA, 12 nt, Molluscum contagiosum virus
guuccagcuccg

SEQ ID NO: 4036849 - RNA, 16 nt, Molluscum contagiosum virus
guucccgcucaaccuc

SEQ ID NO: 4036850 - RNA, 17 nt, Molluscum contagiosum virus
guuccgcgccugcccau

SEQ ID NO: 4036851 - RNA, 16 nt, Molluscum contagiosum virus
guuccggcagcgccgc

SEQ ID NO: 4036852 - RNA, 17 nt, Molluscum contagiosum virus
guuccggcagcgccgcg

SEQ ID NO: 4036853 - RNA, 17 nt, Molluscum contagiosum virus
guuccggugucagcccc

SEQ ID NO: 4036854 - RNA, 20 nt, Molluscum contagiosum virus
guuccguucgucagagggac

SEQ ID NO: 4036855 - RNA, 20 nt, Molluscum contagiosum virus
guucgcaaagacgagggaug

SEQ ID NO: 4036856 - RNA, 15 nt, Molluscum contagiosum virus
guucgcaacaaaaga

SEQ ID NO: 4036857 - RNA, 13 nt, Molluscum contagiosum virus
guucgcgcugcuc

SEQ ID NO: 4036858 - RNA, 13 nt, Molluscum contagiosum virus
guucgcugcuggc

SEQ ID NO: 4036859 - RNA, 20 nt, Molluscum contagiosum virus
guucuccacguccgacucgg

SEQ ID NO: 4036860 - RNA, 12 nt, Molluscum contagiosum virus
guucuccaggaa

SEQ ID NO: 4036861 - RNA, 18 nt, Molluscum contagiosum virus
guucucuuuguuccugcg

SEQ ID NO: 4036862 - RNA, 19 nt, Molluscum contagiosum virus
guucugcgcugccagcucg

SEQ ID NO: 4036863 - RNA, 20 nt, Molluscum contagiosum virus
guucuuuccggacgauaaau

SEQ ID NO: 4036864 - RNA, 14 nt, Molluscum contagiosum virus
guugcacgugcgug

SEQ ID NO: 4036865 - RNA, 18 nt, Molluscum contagiosum virus
guugcgagccagccaggc

SEQ ID NO: 4036866 - RNA, 16 nt, Molluscum contagiosum virus
guugcgcgugugcagc

SEQ ID NO: 4036867 - RNA, 14 nt, Molluscum contagiosum virus
guugcgguggugca

SEQ ID NO: 4036868 - RNA, 22 nt, Molluscum contagiosum virus
guugcugcugccgcgcggcacg

SEQ ID NO: 4036869 - RNA, 21 nt, Molluscum contagiosum virus
guuggcgcgcaagcgcugcuc

SEQ ID NO: 4036870 - RNA, 16 nt, Molluscum contagiosum virus
guugucuugaugcugu

SEQ ID NO: 4036871 - RNA, 19 nt, Molluscum contagiosum virus
guugugcacgcuguccagg

SEQ ID NO: 4036872 - RNA, 20 nt, Molluscum contagiosum virus
guuuacaucggcuccgcgcc

SEQ ID NO: 4036873 - RNA, 22 nt, Molluscum contagiosum virus
guuuccugcggcgcugcuacaa

SEQ ID NO: 4036874 - RNA, 17 nt, Molluscum contagiosum virus
guuucugccgcgccucc

SEQ ID NO: 4036875 - RNA, 15 nt, Molluscum contagiosum virus
guuugcacccgcgca

SEQ ID NO: 4036876 - RNA, 20 nt, Molluscum contagiosum virus
guuuucuuucauggcucccg

SEQ ID NO: 4036877 - RNA, 19 nt, Molluscum contagiosum virus
uaaagaguuccagcagcgc

SEQ ID NO: 4036878 - RNA, 16 nt, Molluscum contagiosum virus
uaaauggaccucaaga

SEQ ID NO: 4036879 - RNA, 15 nt, Molluscum contagiosum virus
uaaauggcgcgcgcg

SEQ ID NO: 4036880 - RNA, 12 nt, Molluscum contagiosum virus
uaacaucugcua

SEQ ID NO: 4036881 - RNA, 23 nt, Molluscum contagiosum virus
uaagaguccacugccaaagcuau

SEQ ID NO: 4036882 - RNA, 15 nt, Molluscum contagiosum virus
uaaggcggaccgcgc

SEQ ID NO: 4036883 - RNA, 16 nt, Molluscum contagiosum virus
uaagggcccgcuggcg

SEQ ID NO: 4036884 - RNA, 20 nt, Molluscum contagiosum virus
uaagggcggacgcacuagac

SEQ ID NO: 4036885 - RNA, 16 nt, Molluscum contagiosum virus
uacaaaacaugcugua

SEQ ID NO: 4036886 - RNA, 18 nt, Molluscum contagiosum virus
uacacgcagagccagcgc

SEQ ID NO: 4036887 - RNA, 17 nt, Molluscum contagiosum virus
uacacgugcacgcgcac

SEQ ID NO: 4036888 - RNA, 14 nt, Molluscum contagiosum virus
uacacuuccugcua

SEQ ID NO: 4036889 - RNA, 20 nt, Molluscum contagiosum virus
uacagaugccacgaccgcgc

SEQ ID NO: 4036890 - RNA, 18 nt, Molluscum contagiosum virus
uacagcaugcgugcaaca

SEQ ID NO: 4036891 - RNA, 14 nt, Molluscum contagiosum virus
uacagcgcgcgugc

SEQ ID NO: 4036892 - RNA, 14 nt, Molluscum contagiosum virus
uacagugcgcgcac

SEQ ID NO: 4036893 - RNA, 15 nt, Molluscum contagiosum virus
uacaucggacuggcg

SEQ ID NO: 4036894 - RNA, 15 nt, Molluscum contagiosum virus
acgggcacgccgcgg

SEQ ID NO: 4036895 - RNA, 19 nt, Molluscum contagiosum virus
acgggcccgcgaaggagag

SEQ ID NO: 4036896 - RNA, 15 nt, Molluscum contagiosum virus
acggguaccgugcgc

SEQ ID NO: 4036897 - RNA, 16 nt, Molluscum contagiosum virus
acgguaaacucuugca

SEQ ID NO: 4036898 - RNA, 18 nt, Molluscum contagiosum virus
acggucguccuggagccu

SEQ ID NO: 4036899 - RNA, 14 nt, Molluscum contagiosum virus
acguacagcgggcg

SEQ ID NO: 4036900 - RNA, 19 nt, Molluscum contagiosum virus
acguacgagugcuggagca

SEQ ID NO: 4036901 - RNA, 20 nt, Molluscum contagiosum virus
acguacucgcugcuccccgc

SEQ ID NO: 4036902 - RNA, 21 nt, Molluscum contagiosum virus
acguacuggugcccaccccgc

SEQ ID NO: 4036903 - RNA, 21 nt, Molluscum contagiosum virus
acguaguacugcagcagcucc

SEQ ID NO: 4036904 - RNA, 23 nt, Molluscum contagiosum virus
acguaugcguaguaguagcgcuc

SEQ ID NO: 4036905 - RNA, 15 nt, Molluscum contagiosum virus
acgucaauggcgcgc

SEQ ID NO: 4036906 - RNA, 22 nt, Molluscum contagiosum virus
acguccaggccgcggcagcucu

SEQ ID NO: 4036907 - RNA, 12 nt, Molluscum contagiosum virus
acgucuucgccg

SEQ ID NO: 4036908 - RNA, 13 nt, Molluscum contagiosum virus
acgucuuucucga

SEQ ID NO: 4036909 - RNA, 19 nt, Molluscum contagiosum virus
acgugaccucgcugcugag

SEQ ID NO: 4036910 - RNA, 19 nt, Molluscum contagiosum virus
acgugacgcgccucgagca

SEQ ID NO: 4036911 - RNA, 16 nt, Molluscum contagiosum virus
acgugacugagggcgc

SEQ ID NO: 4036912 - RNA, 18 nt, Molluscum contagiosum virus
acgugcagcggcgccacg

SEQ ID NO: 4036913 - RNA, 20 nt, Molluscum contagiosum virus
acgugcgccagcucugggcg

SEQ ID NO: 4036914 - RNA, 21 nt, Molluscum contagiosum virus
acgugcgccagcucugggcgc

SEQ ID NO: 4036915 - RNA, 17 nt, Molluscum contagiosum virus
acgugcguacgcggcgc

SEQ ID NO: 4036916 - RNA, 22 nt, Molluscum contagiosum virus
acgugcgugguguccacgcgcg

SEQ ID NO: 4036917 - RNA, 20 nt, Molluscum contagiosum virus
acgugcugcagcugcgcgag

SEQ ID NO: 4036918 - RNA, 13 nt, Molluscum contagiosum virus
acgugcugcgccg

SEQ ID NO: 4036919 - RNA, 19 nt, Molluscum contagiosum virus
acguggauaccaugcucuc

SEQ ID NO: 4036920 - RNA, 17 nt, Molluscum contagiosum virus
acgugguccaccagcac

SEQ ID NO: 4036921 - RNA, 17 nt, Molluscum contagiosum virus
acguguccgcauccgcc

SEQ ID NO: 4036922 - RNA, 20 nt, Molluscum contagiosum virus
acguugcgcguucagcgcac

SEQ ID NO: 4036923 - RNA, 23 nt, Molluscum contagiosum virus
acguuuucuuugcgcucaucaag

SEQ ID NO: 4036924 - RNA, 21 nt, Molluscum contagiosum virus
acuacauggacgugcugcugg

SEQ ID NO: 4036925 - RNA, 20 nt, Molluscum contagiosum virus
acuaccgcaaccagcugcug

SEQ ID NO: 4036926 - RNA, 13 nt, Molluscum contagiosum virus
acuaccugcugcu

SEQ ID NO: 4036927 - RNA, 20 nt, Molluscum contagiosum virus
acuacugcuccauggagcgc

SEQ ID NO: 4036928 - RNA, 15 nt, Molluscum contagiosum virus
acuacuuccugcagc

SEQ ID NO: 4036929 - RNA, 18 nt, Molluscum contagiosum virus
acuagcacgggcgggaca

SEQ ID NO: 4036930 - RNA, 14 nt, Molluscum contagiosum virus
acuagcgugcgcag

SEQ ID NO: 4036931 - RNA, 14 nt, Molluscum contagiosum virus
acuagugcugcugg

SEQ ID NO: 4036932 - RNA, 16 nt, Molluscum contagiosum virus
acucaacaagcugcug

SEQ ID NO: 4036933 - RNA, 14 nt, Molluscum contagiosum virus
acuccaaggagggc

SEQ ID NO: 4036934 - RNA, 20 nt, Molluscum contagiosum virus
acuccaaggucgagcugacu

SEQ ID NO: 4036935 - RNA, 19 nt, Molluscum contagiosum virus
acuccgaggcagguuccgg

SEQ ID NO: 4036936 - RNA, 23 nt, Molluscum contagiosum virus
acuccguuuuucugugcucgcgc

SEQ ID NO: 4036937 - RNA, 12 nt, Molluscum contagiosum virus
acuccuguccuc

SEQ ID NO: 4036938 - RNA, 22 nt, Molluscum contagiosum virus
acuccuuccggagacaccagcu

SEQ ID NO: 4036939 - RNA, 20 nt, Molluscum contagiosum virus
acucgagcacguagugcucg

SEQ ID NO: 4036940 - RNA, 12 nt, Molluscum contagiosum virus
acucgcugcugc

SEQ ID NO: 4036941 - RNA, 21 nt, Molluscum contagiosum virus
acucgcugcugcucuuccagg

SEQ ID NO: 4036942 - RNA, 18 nt, Molluscum contagiosum virus
acucggacacguugcagc

SEQ ID NO: 4036943 - RNA, 15 nt, Molluscum contagiosum virus
acucggcaugugcgc

SEQ ID NO: 4036944 - RNA, 17 nt, Molluscum contagiosum virus
acucggcuucugcugca

SEQ ID NO: 4036945 - RNA, 18 nt, Molluscum contagiosum virus
acucggcuucugcugcac

SEQ ID NO: 4036946 - RNA, 13 nt, Molluscum contagiosum virus
acucgggugcccg

SEQ ID NO: 4036947 - RNA, 19 nt, Molluscum contagiosum virus
acucgugcgccgcgccgaa

SEQ ID NO: 4036948 - RNA, 18 nt, Molluscum contagiosum virus
acucuuguuuguuguccc

SEQ ID NO: 4036949 - RNA, 13 nt, Molluscum contagiosum virus
acugacugcugcc

SEQ ID NO: 4036950 - RNA, 16 nt, Molluscum contagiosum virus
acugagugcugagcca

SEQ ID NO: 4036951 - RNA, 16 nt, Molluscum contagiosum virus
acugcaagaucuauca

SEQ ID NO: 4036952 - RNA, 21 nt, Molluscum contagiosum virus
acugcacugcagcgagcucgc

SEQ ID NO: 4036953 - RNA, 14 nt, Molluscum contagiosum virus
acugcagcagcccc

SEQ ID NO: 4036954 - RNA, 17 nt, Molluscum contagiosum virus
acugcagcgagcucgcg

SEQ ID NO: 4036955 - RNA, 18 nt, Molluscum contagiosum virus
acugccccaugcccgacc

SEQ ID NO: 4036956 - RNA, 14 nt, Molluscum contagiosum virus
acugccgccaggaa

SEQ ID NO: 4036957 - RNA, 13 nt, Molluscum contagiosum virus
acugccuggucac

SEQ ID NO: 4036958 - RNA, 22 nt, Molluscum contagiosum virus
acugcgaucgcagcagugccag

SEQ ID NO: 4036959 - RNA, 18 nt, Molluscum contagiosum virus
acugcgccuucugccugc

SEQ ID NO: 4036960 - RNA, 12 nt, Molluscum contagiosum virus
acugcgcgcaug

SEQ ID NO: 4036961 - RNA, 14 nt, Molluscum contagiosum virus
acugcuacgucgcg

SEQ ID NO: 4036962 - RNA, 19 nt, Molluscum contagiosum virus
acugcucgcgcacgcgcac

SEQ ID NO: 4036963 - RNA, 22 nt, Molluscum contagiosum virus
acugcugcaaucugcgcuccac

SEQ ID NO: 4036964 - RNA, 19 nt, Molluscum contagiosum virus
acugcugcaguguguacgg

SEQ ID NO: 4036965 - RNA, 17 nt, Molluscum contagiosum virus
acugcugcccccgccgc

SEQ ID NO: 4036966 - RNA, 22 nt, Molluscum contagiosum virus
acugcugcccgcgcagcgccac

SEQ ID NO: 4036967 - RNA, 12 nt, Molluscum contagiosum virus
acuggacugagc

SEQ ID NO: 4036968 - RNA, 14 nt, Molluscum contagiosum virus
acuggacugagccg

SEQ ID NO: 4036969 - RNA, 22 nt, Molluscum contagiosum virus
acuggagaccugucgugcaaug

SEQ ID NO: 4036970 - RNA, 14 nt, Molluscum contagiosum virus
acuggagcacggac

SEQ ID NO: 4036971 - RNA, 23 nt, Molluscum contagiosum virus
acuggcaaugagggcgaggccgc

SEQ ID NO: 4036972 - RNA, 15 nt, Molluscum contagiosum virus
acuggcaccugcggc

SEQ ID NO: 4036973 - RNA, 16 nt, Molluscum contagiosum virus
acuggcaccugcggcu

SEQ ID NO: 4036974 - RNA, 19 nt, Molluscum contagiosum virus
acuggccgcgauucugcuc

SEQ ID NO: 4036975 - RNA, 15 nt, Molluscum contagiosum virus
acuggccguguaagu

SEQ ID NO: 4036976 - RNA, 18 nt, Molluscum contagiosum virus
acuggcgcgcacgcgcac

SEQ ID NO: 4036977 - RNA, 20 nt, Molluscum contagiosum virus
acuggggcgaucgcgucacg

SEQ ID NO: 4036978 - RNA, 23 nt, Molluscum contagiosum virus
acugucucugcgcgagcagcugc

SEQ ID NO: 4036979 - RNA, 23 nt, Molluscum contagiosum virus
acuguugccuggagggcagugcc

SEQ ID NO: 4036980 - RNA, 17 nt, Molluscum contagiosum virus
acuucaagcacgagcug

SEQ ID NO: 4036981 - RNA, 14 nt, Molluscum contagiosum virus
acuuccacgagcug

SEQ ID NO: 4036982 - RNA, 18 nt, Molluscum contagiosum virus
acuuccgcgcgcucuugc

SEQ ID NO: 4036983 - RNA, 15 nt, Molluscum contagiosum virus
acuuccuugcgcagg

SEQ ID NO: 4036984 - RNA, 23 nt, Molluscum contagiosum virus
acuugagcaccaagaagcggccc

SEQ ID NO: 4036985 - RNA, 15 nt, Molluscum contagiosum virus
acuugccguguucua

SEQ ID NO: 4036986 - RNA, 20 nt, Molluscum contagiosum virus
acuugcgcguccacaaaggc

SEQ ID NO: 4036987 - RNA, 19 nt, Molluscum contagiosum virus
acuugcgcguucgcaaaga

SEQ ID NO: 4036988 - RNA, 16 nt, Molluscum contagiosum virus
acuugcuuccucuccc

SEQ ID NO: 4036989 - RNA, 14 nt, Molluscum contagiosum virus
acuugugcgccccc

SEQ ID NO: 4036990 - RNA, 22 nt, Molluscum contagiosum virus
agaacaagaagcgcuucuuugc

SEQ ID NO: 4036991 - RNA, 14 nt, Molluscum contagiosum virus
agaagcggcccugc

SEQ ID NO: 4036992 - RNA, 16 nt, Molluscum contagiosum virus
agaagcggcccugcac

SEQ ID NO: 4036993 - RNA, 15 nt, Molluscum contagiosum virus
agaaggagcccuugc

SEQ ID NO: 4036994 - RNA, 15 nt, Molluscum contagiosum virus
agaagugugccugcu

SEQ ID NO: 4036995 - RNA, 12 nt, Molluscum contagiosum virus
agaauagcuggg

SEQ ID NO: 4036996 - RNA, 20 nt, Molluscum contagiosum virus
agguacccgcaaccccgcgc

SEQ ID NO: 4036997 - RNA, 22 nt, Molluscum contagiosum virus
aggucaucgacgagcacgagca

SEQ ID NO: 4036998 - RNA, 18 nt, Molluscum contagiosum virus
aggucggaagaaggcgcc

SEQ ID NO: 4036999 - RNA, 22 nt, Molluscum contagiosum virus
aggugcagaaccugcgggugga

SEQ ID NO: 4037000 - RNA, 20 nt, Molluscum contagiosum virus
aggugcgaaggcucgagcug

SEQ ID NO: 4037001 - RNA, 20 nt, Molluscum contagiosum virus
agguggccaacggcgccauc

SEQ ID NO: 4037002 - RNA, 19 nt, Molluscum contagiosum virus
aguaccagauuagcaacug

SEQ ID NO: 4037003 - RNA, 12 nt, Molluscum contagiosum virus
aguaccugggca

SEQ ID NO: 4037004 - RNA, 22 nt, Molluscum contagiosum virus
aguacgagcgcguaagaccaug

SEQ ID NO: 4037005 - RNA, 17 nt, Molluscum contagiosum virus
aguacgauggaugcugg

SEQ ID NO: 4037006 - RNA, 22 nt, Molluscum contagiosum virus
aguacgcgcgugguacagauga

SEQ ID NO: 4037007 - RNA, 18 nt, Molluscum contagiosum virus
agucaaugacacgagccc

SEQ ID NO: 4037008 - RNA, 20 nt, Molluscum contagiosum virus
agucacugcuagugcuggcc

SEQ ID NO: 4037009 - RNA, 16 nt, Molluscum contagiosum virus
agucagaguccgaccc

SEQ ID NO: 4037010 - RNA, 12 nt, Molluscum contagiosum virus
agucagcggcgg

SEQ ID NO: 4037011 - RNA, 16 nt, Molluscum contagiosum virus
aguccaugcccacgcg

SEQ ID NO: 4037012 - RNA, 20 nt, Molluscum contagiosum virus
aguccgacccgugcugcuug

SEQ ID NO: 4037013 - RNA, 22 nt, Molluscum contagiosum virus
aguccgcccccagguggagcug

SEQ ID NO: 4037014 - RNA, 17 nt, Molluscum contagiosum virus
aguccgcgcccaaggcc

SEQ ID NO: 4037015 - RNA, 11 nt, Molluscum contagiosum virus
aguccugggcg

SEQ ID NO: 4037016 - RNA, 13 nt, Molluscum contagiosum virus
aguccugggcgag

SEQ ID NO: 4037017 - RNA, 12 nt, Molluscum contagiosum virus
agucugcgcagg

SEQ ID NO: 4037018 - RNA, 15 nt, Molluscum contagiosum virus
agucuucaagacugg

SEQ ID NO: 4037019 - RNA, 19 nt, Molluscum contagiosum virus
agugaaggguguggccuac

SEQ ID NO: 4037020 - RNA, 23 nt, Molluscum contagiosum virus
agugaaggguguggccuacgugg

SEQ ID NO: 4037021 - RNA, 16 nt, Molluscum contagiosum virus
agugacagacuaggca

SEQ ID NO: 4037022 - RNA, 17 nt, Molluscum contagiosum virus
agugcagaugaggcugc

SEQ ID NO: 4037023 - RNA, 22 nt, Molluscum contagiosum virus
agugcccggaauuauguguagu

SEQ ID NO: 4037024 - RNA, 15 nt, Molluscum contagiosum virus
agugccgagcgugca

SEQ ID NO: 4037025 - RNA, 11 nt, Molluscum contagiosum virus
agugccgccgc

SEQ ID NO: 4037026 - RNA, 17 nt, Molluscum contagiosum virus
agugcgccgcgcccgcg

SEQ ID NO: 4037027 - RNA, 13 nt, Molluscum contagiosum virus
agugcggaugugc

SEQ ID NO: 4037028 - RNA, 15 nt, Molluscum contagiosum virus
agugcggccagcacc

SEQ ID NO: 4037029 - RNA, 19 nt, Molluscum contagiosum virus
agugcgggagcaagucugc

SEQ ID NO: 4037030 - RNA, 23 nt, Molluscum contagiosum virus
agugcgggagcaagucugcgcag

SEQ ID NO: 4037031 - RNA, 20 nt, Molluscum contagiosum virus
agugcgucgacguggagccu

SEQ ID NO: 4037032 - RNA, 11 nt, Molluscum contagiosum virus
agugcucuuua

SEQ ID NO: 4037033 - RNA, 23 nt, Molluscum contagiosum virus
agugcuuugucgcaaccccgcgc

SEQ ID NO: 4037034 - RNA, 20 nt, Molluscum contagiosum virus
aguggcguccgcacgaggag

SEQ ID NO: 4037035 - RNA, 21 nt, Molluscum contagiosum virus
aguggcucuagaguacuaggu

SEQ ID NO: 4037036 - RNA, 18 nt, Molluscum contagiosum virus
agugguccaccagcugcc

SEQ ID NO: 4037037 - RNA, 16 nt, Molluscum contagiosum virus
aguuccuggugugcca

SEQ ID NO: 4037038 - RNA, 13 nt, Molluscum contagiosum virus
aguucggccgcac

SEQ ID NO: 4037039 - RNA, 23 nt, Molluscum contagiosum virus
aguucucgggcucgggcaggucg

SEQ ID NO: 4037040 - RNA, 19 nt, Molluscum contagiosum virus
aguugcgagccagccaggc

SEQ ID NO: 4037041 - RNA, 20 nt, Molluscum contagiosum virus
aguugcgagccagccaggcg

SEQ ID NO: 4037042 - RNA, 16 nt, Molluscum contagiosum virus
auacaaaguugaccac

SEQ ID NO: 4037043 - RNA, 19 nt, Molluscum contagiosum virus
auaccaugcucucgcugcu

SEQ ID NO: 4037044 - RNA, 20 nt, Molluscum contagiosum virus
auacccuuggcagcaacugc

SEQ ID NO: 4037045 - RNA, 15 nt, Molluscum contagiosum virus
auaccggagacacca

SEQ ID NO: 4037046 - RNA, 16 nt, Molluscum contagiosum virus
auacgccuagccugca

SEQ ID NO: 4037047 - RNA, 13 nt, Molluscum contagiosum virus
auagcagagcacg

SEQ ID NO: 4037048 - RNA, 18 nt, Molluscum contagiosum virus
auagccccucgagcagcg

SEQ ID NO: 4037049 - RNA, 18 nt, Molluscum contagiosum virus
auagucaucaaagcacaa

SEQ ID NO: 4037050 - RNA, 23 nt, Molluscum contagiosum virus
auauggcgcgccgaguacugcug

SEQ ID NO: 4037051 - RNA, 18 nt, Molluscum contagiosum virus
aucaacaucuacaaggag

SEQ ID NO: 4037052 - RNA, 17 nt, Molluscum contagiosum virus
aucaaccgcaaggaaaa

SEQ ID NO: 4037053 - RNA, 18 nt, Molluscum contagiosum virus
aucaaggccuacggcaag

SEQ ID NO: 4037054 - RNA, 17 nt, Molluscum contagiosum virus
aucacggcgugcgcgag

SEQ ID NO: 4037055 - RNA, 20 nt, Molluscum contagiosum virus
aucagcuccgacgugaccuc

SEQ ID NO: 4037056 - RNA, 17 nt, Molluscum contagiosum virus
aucaggcagcugcugcg

SEQ ID NO: 4037057 - RNA, 11 nt, Molluscum contagiosum virus
aucaugagcca

SEQ ID NO: 4037058 - RNA, 17 nt, Molluscum contagiosum virus
auccaaaccaacgugag

SEQ ID NO: 4037059 - RNA, 19 nt, Molluscum contagiosum virus
auccacauuacgcucgugg

SEQ ID NO: 4037060 - RNA, 21 nt, Molluscum contagiosum virus
auccagcgcaucaugcgcuuc

SEQ ID NO: 4037061 - RNA, 17 nt, Molluscum contagiosum virus
auccaugucgagcccug

SEQ ID NO: 4037062 - RNA, 22 nt, Molluscum contagiosum virus
aucccacguacgagcagcugcu

SEQ ID NO: 4037063 - RNA, 18 nt, Molluscum contagiosum virus
aucccccgccaggaacga

SEQ ID NO: 4037064 - RNA, 20 nt, Molluscum contagiosum virus
aucccggaacgcaaguacaa

SEQ ID NO: 4037065 - RNA, 16 nt, Molluscum contagiosum virus
auccucaaccgcugca

SEQ ID NO: 4037066 - RNA, 19 nt, Molluscum contagiosum virus
auccucgccgaacggcaga

SEQ ID NO: 4037067 - RNA, 19 nt, Molluscum contagiosum virus
aucgacauggucgcauccg

SEQ ID NO: 4037068 - RNA, 13 nt, Molluscum contagiosum virus
aucgacgagcacg

SEQ ID NO: 4037069 - RNA, 12 nt, Molluscum contagiosum virus
aucgacgagguc

SEQ ID NO: 4037070 - RNA, 23 nt, Molluscum contagiosum virus
aucgacugcgccuucugccugcc

SEQ ID NO: 4037071 - RNA, 21 nt, Molluscum contagiosum virus
aucgagauggaggcccaggcc

SEQ ID NO: 4037072 - RNA, 16 nt, Molluscum contagiosum virus
aucgagcugguggccu

SEQ ID NO: 4037073 - RNA, 15 nt, Molluscum contagiosum virus
aucgcgagaggagac

SEQ ID NO: 4037074 - RNA, 16 nt, Molluscum contagiosum virus
aucgcgcugcuggugc

SEQ ID NO: 4037075 - RNA, 14 nt, Molluscum contagiosum virus
aucggcacugcuca

SEQ ID NO: 4037076 - RNA, 17 nt, Molluscum contagiosum virus
aucuccaacuagacaag

SEQ ID NO: 4037077 - RNA, 20 nt, Molluscum contagiosum virus
aucucgcacacugcagcacg

SEQ ID NO: 4037078 - RNA, 12 nt, Molluscum contagiosum virus
aucucugcgccg

SEQ ID NO: 4037079 - RNA, 14 nt, Molluscum contagiosum virus
aucucugcgccgcg

SEQ ID NO: 4037080 - RNA, 17 nt, Molluscum contagiosum virus
aucugcaacucgcgcug

SEQ ID NO: 4037081 - RNA, 14 nt, Molluscum contagiosum virus
aucuugaugaccac

SEQ ID NO: 4037082 - RNA, 19 nt, Molluscum contagiosum virus
augaacaccauccugcgcu

SEQ ID NO: 4037083 - RNA, 23 nt, Molluscum contagiosum virus
augaagcucucgcgcgcagggcg

SEQ ID NO: 4037084 - RNA, 21 nt, Molluscum contagiosum virus
augacacgcgugucugcgcuc

SEQ ID NO: 4037085 - RNA, 12 nt, Molluscum contagiosum virus
augaccaaggag

SEQ ID NO: 4037086 - RNA, 22 nt, Molluscum contagiosum virus
augagaauaaaauagcagagca

SEQ ID NO: 4037087 - RNA, 17 nt, Molluscum contagiosum virus
augagccagucucgcgc

SEQ ID NO: 4037088 - RNA, 13 nt, Molluscum contagiosum virus
augaggcugcucu

SEQ ID NO: 4037089 - RNA, 17 nt, Molluscum contagiosum virus
augagguacuccacgcc

SEQ ID NO: 4037090 - RNA, 18 nt, Molluscum contagiosum virus
augaguaccgcgggcgca

SEQ ID NO: 4037091 - RNA, 17 nt, Molluscum contagiosum virus
augcacacgcaccgccu

SEQ ID NO: 4037092 - RNA, 13 nt, Molluscum contagiosum virus
augcacagcugcu

SEQ ID NO: 4037093 - RNA, 21 nt, Molluscum contagiosum virus
augccagacccgaaagcugcc

SEQ ID NO: 4037094 - RNA, 15 nt, Molluscum contagiosum virus
augcccgcaaugcaa

SEQ ID NO: 4037095 - RNA, 19 nt, Molluscum contagiosum virus
augccgcgugcucugcucc

SEQ ID NO: 4037096 - RNA, 22 nt, Molluscum contagiosum virus
augcgcccucacgugcugauca

SEQ ID NO: 4037097 - RNA, 19 nt, Molluscum contagiosum virus
augcgcuugcggucgcgag

SEQ ID NO: 4037098 - RNA, 23 nt, Molluscum contagiosum virus
cgcgauugcguguuggcuucugc

SEQ ID NO: 4037099 - RNA, 23 nt, Molluscum contagiosum virus
cgcgauuuacuucgacgcggugc

SEQ ID NO: 4037100 - RNA, 16 nt, Molluscum contagiosum virus
cgcgcaaaagcacagc

SEQ ID NO: 4037101 - RNA, 13 nt, Molluscum contagiosum virus
cgcgcaagugcgu

SEQ ID NO: 4037102 - RNA, 14 nt, Molluscum contagiosum virus
cgcgcaagugugcg

SEQ ID NO: 4037103 - RNA, 18 nt, Molluscum contagiosum virus
cgcgcaagugugcgcauc

SEQ ID NO: 4037104 - RNA, 16 nt, Molluscum contagiosum virus
cgcgcaauagcgcccg

SEQ ID NO: 4037105 - RNA, 17 nt, Molluscum contagiosum virus
cgcgcaauagcgcccgu

SEQ ID NO: 4037106 - RNA, 13 nt, Molluscum contagiosum virus
cgcgcacacgcug

SEQ ID NO: 4037107 - RNA, 17 nt, Molluscum contagiosum virus
cgcgcacgagcgcgggc

SEQ ID NO: 4037108 - RNA, 14 nt, Molluscum contagiosum virus
cgcgcacgcggcgc

SEQ ID NO: 4037109 - RNA, 21 nt, Molluscum contagiosum virus
cgcgcacgcggcgcucguggc

SEQ ID NO: 4037110 - RNA, 22 nt, Molluscum contagiosum virus
cgcgcacguaccuucgcggagc

SEQ ID NO: 4037111 - RNA, 13 nt, Molluscum contagiosum virus
cgcgcacugcucg

SEQ ID NO: 4037112 - RNA, 21 nt, Molluscum contagiosum virus
cgcgcagcucgccgcgcgccg

SEQ ID NO: 4037113 - RNA, 17 nt, Molluscum contagiosum virus
cgcgcaggcgcgccaug

SEQ ID NO: 4037114 - RNA, 18 nt, Molluscum contagiosum virus
cgcgcaguucgagcugcu

SEQ ID NO: 4037115 - RNA, 14 nt, Molluscum contagiosum virus
cgcgcaguugugcg

SEQ ID NO: 4037116 - RNA, 13 nt, Molluscum contagiosum virus
cgcgcaucagcac

SEQ ID NO: 4037117 - RNA, 14 nt, Molluscum contagiosum virus
cgcgcaucgcgggc

SEQ ID NO: 4037118 - RNA, 21 nt, Molluscum contagiosum virus
cgcgccaacgacuagcgugcg

SEQ ID NO: 4037119 - RNA, 15 nt, Molluscum contagiosum virus
cgcgccauggcgagc

SEQ ID NO: 4037120 - RNA, 16 nt, Molluscum contagiosum virus
cgcgcccaccagcagc

SEQ ID NO: 4037121 - RNA, 17 nt, Molluscum contagiosum virus
cgcgcccaccagcagcc

SEQ ID NO: 4037122 - RNA, 12 nt, Molluscum contagiosum virus
cgcgcccucgcg

SEQ ID NO: 4037123 - RNA, 20 nt, Molluscum contagiosum virus
cgcgccgaggacuaccuggc

SEQ ID NO: 4037124 - RNA, 12 nt, Molluscum contagiosum virus
cgcgccgcaaac

SEQ ID NO: 4037125 - RNA, 16 nt, Molluscum contagiosum virus
cgcgccgcacgugcug

SEQ ID NO: 4037126 - RNA, 19 nt, Molluscum contagiosum virus
cgcgccgcgcgcgccggga

SEQ ID NO: 4037127 - RNA, 17 nt, Molluscum contagiosum virus
cgcgccgcgcugcuggc

SEQ ID NO: 4037128 - RNA, 12 nt, Molluscum contagiosum virus
cgcgccgcgggc

SEQ ID NO: 4037129 - RNA, 16 nt, Molluscum contagiosum virus
cgcgccgcgggccgcc

SEQ ID NO: 4037130 - RNA, 15 nt, Molluscum contagiosum virus
cgcgccgcucgcgcu

SEQ ID NO: 4037131 - RNA, 20 nt, Molluscum contagiosum virus
cgcgccgcugucacgcgagc

SEQ ID NO: 4037132 - RNA, 19 nt, Molluscum contagiosum virus
cgcgccggcccgagcguca

SEQ ID NO: 4037133 - RNA, 15 nt, Molluscum contagiosum virus
cgcgccggcgcggcg

SEQ ID NO: 4037134 - RNA, 20 nt, Molluscum contagiosum virus
cgcgccggcguucgcggagc

SEQ ID NO: 4037135 - RNA, 15 nt, Molluscum contagiosum virus
cgcgccuaccgcgcg

SEQ ID NO: 4037136 - RNA, 15 nt, Molluscum contagiosum virus
cgcgccuuccgcgcg

SEQ ID NO: 4037137 - RNA, 20 nt, Molluscum contagiosum virus
cgcgcgacuggcacgcgccg

SEQ ID NO: 4037138 - RNA, 16 nt, Molluscum contagiosum virus
cgcgcgagcugcugcg

SEQ ID NO: 4037139 - RNA, 13 nt, Molluscum contagiosum virus
cgcgcgagggcgc

SEQ ID NO: 4037140 - RNA, 22 nt, Molluscum contagiosum virus
cgcgcgagugugugcaucccuc

SEQ ID NO: 4037141 - RNA, 16 nt, Molluscum contagiosum virus
cgcgcgaucgcggcca

SEQ ID NO: 4037142 - RNA, 14 nt, Molluscum contagiosum virus
cgcgcgcaagaaca

SEQ ID NO: 4037143 - RNA, 19 nt, Molluscum contagiosum virus
cgcgcgcaagcgccgcucg

SEQ ID NO: 4037144 - RNA, 20 nt, Molluscum contagiosum virus
cgcgcgcacaucggcacugc

SEQ ID NO: 4037145 - RNA, 13 nt, Molluscum contagiosum virus
cgcgcgcagcaca

SEQ ID NO: 4037146 - RNA, 15 nt, Molluscum contagiosum virus
cgcgcgcagcacacc

SEQ ID NO: 4037147 - RNA, 13 nt, Molluscum contagiosum virus
cgcgcgcagcucg

SEQ ID NO: 4037148 - RNA, 14 nt, Molluscum contagiosum virus
cgcgcgcagggcgc

SEQ ID NO: 4037149 - RNA, 16 nt, Molluscum contagiosum virus
cgcgcgcaugcucgcg

SEQ ID NO: 4037150 - RNA, 11 nt, Molluscum contagiosum virus
cgcgcgccaca

SEQ ID NO: 4037151 - RNA, 17 nt, Molluscum contagiosum virus
cgcgcgcccgcugcgcg

SEQ ID NO: 4037152 - RNA, 11 nt, Molluscum contagiosum virus
cgcgcgccgag

SEQ ID NO: 4037153 - RNA, 13 nt, Molluscum contagiosum virus
cgcgcgccgcgcg

SEQ ID NO: 4037154 - RNA, 15 nt, Molluscum contagiosum virus
cgcgcgccugcuggc

SEQ ID NO: 4037155 - RNA, 12 nt, Molluscum contagiosum virus
cgcgcgcgccag

SEQ ID NO: 4037156 - RNA, 13 nt, Molluscum contagiosum virus
cgcgcgcgcgcag

SEQ ID NO: 4037157 - RNA, 18 nt, Molluscum contagiosum virus
cgcgcgcggagaggacgc

SEQ ID NO: 4037158 - RNA, 11 nt, Molluscum contagiosum virus
cgcgcgcggca

SEQ ID NO: 4037159 - RNA, 16 nt, Molluscum contagiosum virus
cgcgcgcuacugcgcg

SEQ ID NO: 4037160 - RNA, 21 nt, Molluscum contagiosum virus
cgcgcgcuagccgccgcugcc

SEQ ID NO: 4037161 - RNA, 22 nt, Molluscum contagiosum virus
cgcgcgcuagccgccgcugccg

SEQ ID NO: 4037162 - RNA, 16 nt, Molluscum contagiosum virus
cgcgcgcuaggggugc

SEQ ID NO: 4037163 - RNA, 13 nt, Molluscum contagiosum virus
cgcgcgcuccgag

SEQ ID NO: 4037164 - RNA, 17 nt, Molluscum contagiosum virus
cgcgcgcucgcucgcgc

SEQ ID NO: 4037165 - RNA, 13 nt, Molluscum contagiosum virus
cgcgcgcugagcg

SEQ ID NO: 4037166 - RNA, 13 nt, Molluscum contagiosum virus
cgcgcgcugcgcg

SEQ ID NO: 4037167 - RNA, 13 nt, Molluscum contagiosum virus
cgcgcgcugcucu

SEQ ID NO: 4037168 - RNA, 13 nt, Molluscum contagiosum virus
cgcgcggacagcc

SEQ ID NO: 4037169 - RNA, 23 nt, Molluscum contagiosum virus
cgcgcggaugcuggcgagcacgu

SEQ ID NO: 4037170 - RNA, 14 nt, Molluscum contagiosum virus
cgcgcggcgccgag

SEQ ID NO: 4037171 - RNA, 17 nt, Molluscum contagiosum virus
cgcgcggugcugcgcca

SEQ ID NO: 4037172 - RNA, 14 nt, Molluscum contagiosum virus
cgcgcguccacaag

SEQ ID NO: 4037173 - RNA, 20 nt, Molluscum contagiosum virus
cgcgcgucugcgaguggcgc

SEQ ID NO: 4037174 - RNA, 23 nt, Molluscum contagiosum virus
cgcgcgugccuguggcgcacacg

SEQ ID NO: 4037175 - RNA, 14 nt, Molluscum contagiosum virus
cgcgcgugcuggac

SEQ ID NO: 4037176 - RNA, 16 nt, Molluscum contagiosum virus
cgcgcguugcugcccg

SEQ ID NO: 4037177 - RNA, 20 nt, Molluscum contagiosum virus
cgcgcuacguacucuccaac

SEQ ID NO: 4037178 - RNA, 20 nt, Molluscum contagiosum virus
cgcgcuauucaaagcugugc

SEQ ID NO: 4037179 - RNA, 19 nt, Molluscum contagiosum virus
cgcgcucacugcagcagcc

SEQ ID NO: 4037180 - RNA, 19 nt, Molluscum contagiosum virus
cgcgcucgcucgcgcuccg

SEQ ID NO: 4037181 - RNA, 11 nt, Molluscum contagiosum virus
cgcgcucugcc

SEQ ID NO: 4037182 - RNA, 12 nt, Molluscum contagiosum virus
cgcgcucuuccc

SEQ ID NO: 4037183 - RNA, 16 nt, Molluscum contagiosum virus
cgcgcugagcgcggag

SEQ ID NO: 4037184 - RNA, 21 nt, Molluscum contagiosum virus
cgcgcugcacgccgccagcga

SEQ ID NO: 4037185 - RNA, 15 nt, Molluscum contagiosum virus
cgcgcugcagcaccu

SEQ ID NO: 4037186 - RNA, 16 nt, Molluscum contagiosum virus
cgcgcugcagcaccug

SEQ ID NO: 4037187 - RNA, 14 nt, Molluscum contagiosum virus
cgcgcugcgccacu

SEQ ID NO: 4037188 - RNA, 15 nt, Molluscum contagiosum virus
cgcgcugcgcgcgcu

SEQ ID NO: 4037189 - RNA, 12 nt, Molluscum contagiosum virus
cgcgcugcucuc

SEQ ID NO: 4037190 - RNA, 17 nt, Molluscum contagiosum virus
cgcgcugcucuggagca

SEQ ID NO: 4037191 - RNA, 12 nt, Molluscum contagiosum virus
cgcgcugcugcu

SEQ ID NO: 4037192 - RNA, 14 nt, Molluscum contagiosum virus
cgcgcugcuggugc

SEQ ID NO: 4037193 - RNA, 13 nt, Molluscum contagiosum virus
cgcgcuugcgcgg

SEQ ID NO: 4037194 - RNA, 22 nt, Molluscum contagiosum virus
cgcgcuuuuugccgcucacagc

SEQ ID NO: 4037195 - RNA, 16 nt, Molluscum contagiosum virus
cgcggaacugacugcu

SEQ ID NO: 4037196 - RNA, 18 nt, Molluscum contagiosum virus
cgcggaacugacugcugc

SEQ ID NO: 4037197 - RNA, 21 nt, Molluscum contagiosum virus
cgcggacagagcccgcggcgc

SEQ ID NO: 4037198 - RNA, 17 nt, Molluscum contagiosum virus
cgcggaccuaaagcugc

SEQ ID NO: 4037199 - RNA, 21 nt, Molluscum contagiosum virus
cgcggaccuaaagcugcuggc

SEQ ID NO: 4037200 - RNA, 17 nt, Molluscum contagiosum virus
cgcggacggcgcgcagc

SEQ ID NO: 4037201 - RNA, 19 nt, Molluscum contagiosum virus
cgcggacucgugcaccacg

SEQ ID NO: 4037202 - RNA, 20 nt, Molluscum contagiosum virus
cggcacuguguccccugagc

SEQ ID NO: 4037203 - RNA, 22 nt, Molluscum contagiosum virus
cggcagcacgggcggaagcucc

SEQ ID NO: 4037204 - RNA, 14 nt, Molluscum contagiosum virus
cggcagcagccucg

SEQ ID NO: 4037205 - RNA, 19 nt, Molluscum contagiosum virus
cggcagccgcagaugcgca

SEQ ID NO: 4037206 - RNA, 13 nt, Molluscum contagiosum virus
cggcagcgccgcg

SEQ ID NO: 4037207 - RNA, 16 nt, Molluscum contagiosum virus
cggcagcgccgcgcgc

SEQ ID NO: 4037208 - RNA, 17 nt, Molluscum contagiosum virus
cggcagcgucgcggagc

SEQ ID NO: 4037209 - RNA, 17 nt, Molluscum contagiosum virus
cggcagcuaccgcgcgc

SEQ ID NO: 4037210 - RNA, 17 nt, Molluscum contagiosum virus
cggcagcuggagcugcc

SEQ ID NO: 4037211 - RNA, 21 nt, Molluscum contagiosum virus
cggcagcuggagcugccgcug

SEQ ID NO: 4037212 - RNA, 16 nt, Molluscum contagiosum virus
cggcaggaagcuggcg

SEQ ID NO: 4037213 - RNA, 18 nt, Molluscum contagiosum virus
cggcaguguccugguucu

SEQ ID NO: 4037214 - RNA, 15 nt, Molluscum contagiosum virus
cggcaucgcgcugcu

SEQ ID NO: 4037215 - RNA, 18 nt, Molluscum contagiosum virus
cggccaaccgccugcucu

SEQ ID NO: 4037216 - RNA, 12 nt, Molluscum contagiosum virus
cggccaccagcg

SEQ ID NO: 4037217 - RNA, 14 nt, Molluscum contagiosum virus
cggccacgcucgcg

SEQ ID NO: 4037218 - RNA, 15 nt, Molluscum contagiosum virus
cggcccgagcaggac

SEQ ID NO: 4037219 - RNA, 14 nt, Molluscum contagiosum virus
cggccgcgcucguc

SEQ ID NO: 4037220 - RNA, 13 nt, Molluscum contagiosum virus
cggccgcggacca

SEQ ID NO: 4037221 - RNA, 19 nt, Molluscum contagiosum virus
cggccggauugccgcagcc

SEQ ID NO: 4037222 - RNA, 22 nt, Molluscum contagiosum virus
cggccguggcaaacaggcacac

SEQ ID NO: 4037223 - RNA, 21 nt, Molluscum contagiosum virus
cggccguguacaugcucaagc

SEQ ID NO: 4037224 - RNA, 13 nt, Molluscum contagiosum virus
cggccguugccgg

SEQ ID NO: 4037225 - RNA, 19 nt, Molluscum contagiosum virus
cggccuccagcagcggcgc

SEQ ID NO: 4037226 - RNA, 22 nt, Molluscum contagiosum virus
cggccugcccugcucaugcgca

SEQ ID NO: 4037227 - RNA, 15 nt, Molluscum contagiosum virus
cggccuguucuucca

SEQ ID NO: 4037228 - RNA, 15 nt, Molluscum contagiosum virus
cggccuuagugccgu

SEQ ID NO: 4037229 - RNA, 21 nt, Molluscum contagiosum virus
cggcgaacaucucggcuccgc

SEQ ID NO: 4037230 - RNA, 22 nt, Molluscum contagiosum virus
cggcgagcgcauucgcgcgccc

SEQ ID NO: 4037231 - RNA, 14 nt, Molluscum contagiosum virus
cggcgagcgcgccc

SEQ ID NO: 4037232 - RNA, 14 nt, Molluscum contagiosum virus
cggcgauguacgcg

SEQ ID NO: 4037233 - RNA, 16 nt, Molluscum contagiosum virus
cggcgauguacgcgug

SEQ ID NO: 4037234 - RNA, 17 nt, Molluscum contagiosum virus
cggcgcccggugccagc

SEQ ID NO: 4037235 - RNA, 18 nt, Molluscum contagiosum virus
cggcgcccgugagcaugg

SEQ ID NO: 4037236 - RNA, 23 nt, Molluscum contagiosum virus
cggcgccgacaacgugcugcuca

SEQ ID NO: 4037237 - RNA, 22 nt, Molluscum contagiosum virus
cggcgccgcuaccagcucgcgc

SEQ ID NO: 4037238 - RNA, 13 nt, Molluscum contagiosum virus
cggcgcgaagcag

SEQ ID NO: 4037239 - RNA, 14 nt, Molluscum contagiosum virus
cggcgcgcccagcg

SEQ ID NO: 4037240 - RNA, 18 nt, Molluscum contagiosum virus
cggcgcgccgcacgcugc

SEQ ID NO: 4037241 - RNA, 19 nt, Molluscum contagiosum virus
cggcgcgcgcgcgcaggcu

SEQ ID NO: 4037242 - RNA, 14 nt, Molluscum contagiosum virus
cggcgcgcgcggcg

SEQ ID NO: 4037243 - RNA, 13 nt, Molluscum contagiosum virus
cggcgcggagcgc

SEQ ID NO: 4037244 - RNA, 20 nt, Molluscum contagiosum virus
cggcgcggaucugcgcacac

SEQ ID NO: 4037245 - RNA, 21 nt, Molluscum contagiosum virus
cggcgcggcuagcaccgcaug

SEQ ID NO: 4037246 - RNA, 20 nt, Molluscum contagiosum virus
cggcgcgggcaagcagggcc

SEQ ID NO: 4037247 - RNA, 16 nt, Molluscum contagiosum virus
cggcgcgugccgcugc

SEQ ID NO: 4037248 - RNA, 16 nt, Molluscum contagiosum virus
cggcgcgugcuccucg

SEQ ID NO: 4037249 - RNA, 23 nt, Molluscum contagiosum virus
cggcgcgugcugcggcugcugcc

SEQ ID NO: 4037250 - RNA, 15 nt, Molluscum contagiosum virus
cggcgcuaugccgcg

SEQ ID NO: 4037251 - RNA, 14 nt, Molluscum contagiosum virus
cggcgcucacugcg

SEQ ID NO: 4037252 - RNA, 19 nt, Molluscum contagiosum virus
cggcgcuuucgcccgccgc

SEQ ID NO: 4037253 - RNA, 12 nt, Molluscum contagiosum virus
cggcggccacgc

SEQ ID NO: 4037254 - RNA, 12 nt, Molluscum contagiosum virus
cggcggcgcaac

SEQ ID NO: 4037255 - RNA, 22 nt, Molluscum contagiosum virus
cggcggcuuucucacgcccgcg

SEQ ID NO: 4037256 - RNA, 15 nt, Molluscum contagiosum virus
cggcggggcugcugg

SEQ ID NO: 4037257 - RNA, 15 nt, Molluscum contagiosum virus
cggcgggggcagcag

SEQ ID NO: 4037258 - RNA, 13 nt, Molluscum contagiosum virus
cggcgggugccgc

SEQ ID NO: 4037259 - RNA, 16 nt, Molluscum contagiosum virus
cggcguccggugcucg

SEQ ID NO: 4037260 - RNA, 18 nt, Molluscum contagiosum virus
cggcguccggugcucgcc

SEQ ID NO: 4037261 - RNA, 19 nt, Molluscum contagiosum virus
cggcguccucuuuugggca

SEQ ID NO: 4037262 - RNA, 22 nt, Molluscum contagiosum virus
cggcgugagcucgucgcggaag

SEQ ID NO: 4037263 - RNA, 14 nt, Molluscum contagiosum virus
cggcgugcugugcc

SEQ ID NO: 4037264 - RNA, 22 nt, Molluscum contagiosum virus
cggcguggccaggccgcgccgg

SEQ ID NO: 4037265 - RNA, 16 nt, Molluscum contagiosum virus
cggcguggugcuggcc

SEQ ID NO: 4037266 - RNA, 17 nt, Molluscum contagiosum virus
cggcgugugcgcgagcu

SEQ ID NO: 4037267 - RNA, 15 nt, Molluscum contagiosum virus
cggcguuucucaggu

SEQ ID NO: 4037268 - RNA, 14 nt, Molluscum contagiosum virus
cggcuagaccuccu

SEQ ID NO: 4037269 - RNA, 13 nt, Molluscum contagiosum virus
cggcucaagaaca

SEQ ID NO: 4037270 - RNA, 15 nt, Molluscum contagiosum virus
cggcucuggagcggc

SEQ ID NO: 4037271 - RNA, 12 nt, Molluscum contagiosum virus
cggcugcccugu

SEQ ID NO: 4037272 - RNA, 13 nt, Molluscum contagiosum virus
cggcugcugccug

SEQ ID NO: 4037273 - RNA, 17 nt, Molluscum contagiosum virus
cggcugugcccgcggcg

SEQ ID NO: 4037274 - RNA, 14 nt, Molluscum contagiosum virus
cggcuucugcugca

SEQ ID NO: 4037275 - RNA, 17 nt, Molluscum contagiosum virus
cggcuucugcugcacac

SEQ ID NO: 4037276 - RNA, 17 nt, Molluscum contagiosum virus
cggcuuggacagcaagc

SEQ ID NO: 4037277 - RNA, 16 nt, Molluscum contagiosum virus
cggcuuguagucgccc

SEQ ID NO: 4037278 - RNA, 17 nt, Molluscum contagiosum virus
cgggaaaacgcgcggca

SEQ ID NO: 4037279 - RNA, 23 nt, Molluscum contagiosum virus
cgggaacgaggaaaggcaccccg

SEQ ID NO: 4037280 - RNA, 23 nt, Molluscum contagiosum virus
cgggaagcugcacgugcagcggc

SEQ ID NO: 4037281 - RNA, 22 nt, Molluscum contagiosum virus
cgggaaggggugauggcgguga

SEQ ID NO: 4037282 - RNA, 22 nt, Molluscum contagiosum virus
cgggaggcguccugcgggagca

SEQ ID NO: 4037283 - RNA, 19 nt, Molluscum contagiosum virus
cgggaggcucucgagcacu

SEQ ID NO: 4037284 - RNA, 21 nt, Molluscum contagiosum virus
cgggaucggacgcagacgcgc

SEQ ID NO: 4037285 - RNA, 17 nt, Molluscum contagiosum virus
cgggcaaugggcacgcu

SEQ ID NO: 4037286 - RNA, 23 nt, Molluscum contagiosum virus
cgggcacauccgcuaccuggugg

SEQ ID NO: 4037287 - RNA, 18 nt, Molluscum contagiosum virus
cgggcacauggacggcgc

SEQ ID NO: 4037288 - RNA, 15 nt, Molluscum contagiosum virus
cgggcacgagcacgu

SEQ ID NO: 4037289 - RNA, 22 nt, Molluscum contagiosum virus
cgggcacgcucauacuccugcu

SEQ ID NO: 4037290 - RNA, 16 nt, Molluscum contagiosum virus
cgggcacgugcugcug

SEQ ID NO: 4037291 - RNA, 21 nt, Molluscum contagiosum virus
cgggcacgugcugcugcggcu

SEQ ID NO: 4037292 - RNA, 17 nt, Molluscum contagiosum virus
cgggcaugcacagcugc

SEQ ID NO: 4037293 - RNA, 16 nt, Molluscum contagiosum virus
cgggccccugcgcgag

SEQ ID NO: 4037294 - RNA, 22 nt, Molluscum contagiosum virus
cgggcccgccuuuguggacgcg

SEQ ID NO: 4037295 - RNA, 14 nt, Molluscum contagiosum virus
cgggcccgcgaacg

SEQ ID NO: 4037296 - RNA, 22 nt, Molluscum contagiosum virus
cgggcccggguuugugcccgag

SEQ ID NO: 4037297 - RNA, 17 nt, Molluscum contagiosum virus
cgggcccgugcccgagc

SEQ ID NO: 4037298 - RNA, 22 nt, Molluscum contagiosum virus
cgggcccgugcucaggccagca

SEQ ID NO: 4037299 - RNA, 15 nt, Molluscum contagiosum virus
cgggccugcgcccgc

SEQ ID NO: 4037300 - RNA, 16 nt, Molluscum contagiosum virus
cgggccugcgcccgca

SEQ ID NO: 4037301 - RNA, 21 nt, Molluscum contagiosum virus
cgggccuguaccugcgacagc

SEQ ID NO: 4037302 - RNA, 22 nt, Molluscum contagiosum virus
cgggcgagagacagcacggcac

SEQ ID NO: 4037303 - RNA, 20 nt, Molluscum contagiosum virus
cgggcgcagagccugcugcu

SEQ ID NO: 4037304 - RNA, 15 nt, Molluscum contagiosum virus
cgugccuggcagugc

SEQ ID NO: 4037305 - RNA, 14 nt, Molluscum contagiosum virus
cgugcgagcggcgc

SEQ ID NO: 4037306 - RNA, 22 nt, Molluscum contagiosum virus
cgugcgagcggcgcgcgcugag

SEQ ID NO: 4037307 - RNA, 16 nt, Molluscum contagiosum virus
cgugcgcaggagcagu

SEQ ID NO: 4037308 - RNA, 17 nt, Molluscum contagiosum virus
cgugcgcgcacacgacg

SEQ ID NO: 4037309 - RNA, 20 nt, Molluscum contagiosum virus
cgugcgcgugcggcggcgcg

SEQ ID NO: 4037310 - RNA, 16 nt, Molluscum contagiosum virus
cgugcgcuggcgcgcg

SEQ ID NO: 4037311 - RNA, 17 nt, Molluscum contagiosum virus
cgugcgggcgagcaugu

SEQ ID NO: 4037312 - RNA, 17 nt, Molluscum contagiosum virus
cgugcguacgugcacgu

SEQ ID NO: 4037313 - RNA, 14 nt, Molluscum contagiosum virus
cgugcuagcccgca

SEQ ID NO: 4037314 - RNA, 22 nt, Molluscum contagiosum virus
cgugcuagcccgcaccugcgcc

SEQ ID NO: 4037315 - RNA, 15 nt, Molluscum contagiosum virus
cgugcucaggccagc

SEQ ID NO: 4037316 - RNA, 14 nt, Molluscum contagiosum virus
cgugcuccacgcgc

SEQ ID NO: 4037317 - RNA, 17 nt, Molluscum contagiosum virus
cgugcuccacgcgcagc

SEQ ID NO: 4037318 - RNA, 23 nt, Molluscum contagiosum virus
cgugcucgguagcguggagcugg

SEQ ID NO: 4037319 - RNA, 14 nt, Molluscum contagiosum virus
cgugcugcagcugc

SEQ ID NO: 4037320 - RNA, 17 nt, Molluscum contagiosum virus
cgugcugcgccgccugc

SEQ ID NO: 4037321 - RNA, 23 nt, Molluscum contagiosum virus
cgugcugcggcaaccgcgcccgc

SEQ ID NO: 4037322 - RNA, 15 nt, Molluscum contagiosum virus
cgugcugcugcagaa

SEQ ID NO: 4037323 - RNA, 19 nt, Molluscum contagiosum virus
cgugcuggacgcgcacgcg

SEQ ID NO: 4037324 - RNA, 20 nt, Molluscum contagiosum virus
cgugcuggagggcacgcugc

SEQ ID NO: 4037325 - RNA, 21 nt, Molluscum contagiosum virus
cgugcuuacggacaggaugcc

SEQ ID NO: 4037326 - RNA, 14 nt, Molluscum contagiosum virus
cgugcuugcgcacg

SEQ ID NO: 4037327 - RNA, 17 nt, Molluscum contagiosum virus
cgugcuugugcgccugu

SEQ ID NO: 4037328 - RNA, 12 nt, Molluscum contagiosum virus
cguggacagcau

SEQ ID NO: 4037329 - RNA, 12 nt, Molluscum contagiosum virus
cguggacgagca

SEQ ID NO: 4037330 - RNA, 16 nt, Molluscum contagiosum virus
cguggaggaaacaccc

SEQ ID NO: 4037331 - RNA, 20 nt, Molluscum contagiosum virus
cguggagucacgaccgaccc

SEQ ID NO: 4037332 - RNA, 20 nt, Molluscum contagiosum virus
cguggaucgcgcgcaccugc

SEQ ID NO: 4037333 - RNA, 14 nt, Molluscum contagiosum virus
cguggccgagccgc

SEQ ID NO: 4037334 - RNA, 16 nt, Molluscum contagiosum virus
cguggcgagcaucugc

SEQ ID NO: 4037335 - RNA, 17 nt, Molluscum contagiosum virus
cguggcgccgcugcugg

SEQ ID NO: 4037336 - RNA, 21 nt, Molluscum contagiosum virus
cguggcgcgcgacgugugcuc

SEQ ID NO: 4037337 - RNA, 14 nt, Molluscum contagiosum virus
cguggcgcgcgagc

SEQ ID NO: 4037338 - RNA, 20 nt, Molluscum contagiosum virus
cguggcgcugggcgcgccgc

SEQ ID NO: 4037339 - RNA, 22 nt, Molluscum contagiosum virus
cguggcgugcuuguagcgcaag

SEQ ID NO: 4037340 - RNA, 15 nt, Molluscum contagiosum virus
cguggcguugcugcu

SEQ ID NO: 4037341 - RNA, 12 nt, Molluscum contagiosum virus
cgugggcgccgc

SEQ ID NO: 4037342 - RNA, 16 nt, Molluscum contagiosum virus
cgugggcggcauccug

SEQ ID NO: 4037343 - RNA, 19 nt, Molluscum contagiosum virus
cgugggcggcauccugaug

SEQ ID NO: 4037344 - RNA, 17 nt, Molluscum contagiosum virus
cguggggagcuggagcg

SEQ ID NO: 4037345 - RNA, 17 nt, Molluscum contagiosum virus
cguggucgccgcggccg

SEQ ID NO: 4037346 - RNA, 23 nt, Molluscum contagiosum virus
cguggucgcgcgcgcucugccgc

SEQ ID NO: 4037347 - RNA, 13 nt, Molluscum contagiosum virus
cguggugggccgc

SEQ ID NO: 4037348 - RNA, 15 nt, Molluscum contagiosum virus
cgugguguccacgcg

SEQ ID NO: 4037349 - RNA, 19 nt, Molluscum contagiosum virus
cgugucagcagcgcgagcu

SEQ ID NO: 4037350 - RNA, 13 nt, Molluscum contagiosum virus
cgugucgagcugc

SEQ ID NO: 4037351 - RNA, 21 nt, Molluscum contagiosum virus
cgugucugguguauccaggau

SEQ ID NO: 4037352 - RNA, 14 nt, Molluscum contagiosum virus
cgugugcgagcacg

SEQ ID NO: 4037353 - RNA, 16 nt, Molluscum contagiosum virus
cgugugcgggcacggc

SEQ ID NO: 4037354 - RNA, 16 nt, Molluscum contagiosum virus
cguguuccggcagcgc

SEQ ID NO: 4037355 - RNA, 21 nt, Molluscum contagiosum virus
cguuccagagcacugcgcguc

SEQ ID NO: 4037356 - RNA, 15 nt, Molluscum contagiosum virus
cguucgcgcgccagu

SEQ ID NO: 4037357 - RNA, 18 nt, Molluscum contagiosum virus
cguucucuaccagcucgu

SEQ ID NO: 4037358 - RNA, 14 nt, Molluscum contagiosum virus
cguugcugcgccac

SEQ ID NO: 4037359 - RNA, 16 nt, Molluscum contagiosum virus
cguugcugcugcgcgc

SEQ ID NO: 4037360 - RNA, 15 nt, Molluscum contagiosum virus
cguuguccgcgucca

SEQ ID NO: 4037361 - RNA, 17 nt, Molluscum contagiosum virus
cguuuucgucauggagc

SEQ ID NO: 4037362 - RNA, 22 nt, Molluscum contagiosum virus
cuaaagucgcgcgugcgcagca

SEQ ID NO: 4037363 - RNA, 16 nt, Molluscum contagiosum virus
cuaacggacgcggcca

SEQ ID NO: 4037364 - RNA, 24 nt, Molluscum contagiosum virus
cuacagcagccgcagcccacgugc

SEQ ID NO: 4037365 - RNA, 15 nt, Molluscum contagiosum virus
cuacauggacgugcu

SEQ ID NO: 4037366 - RNA, 19 nt, Molluscum contagiosum virus
cuacauggacgugcugcug

SEQ ID NO: 4037367 - RNA, 21 nt, Molluscum contagiosum virus
cuacauggacgugcugcuggc

SEQ ID NO: 4037368 - RNA, 13 nt, Molluscum contagiosum virus
cuaccacgucggc

SEQ ID NO: 4037369 - RNA, 16 nt, Molluscum contagiosum virus
cuaccagcucgcgcag

SEQ ID NO: 4037370 - RNA, 19 nt, Molluscum contagiosum virus
cuaccggcaguagcagcgc

SEQ ID NO: 4037371 - RNA, 16 nt, Molluscum contagiosum virus
cuaccuggugcugggg

SEQ ID NO: 4037372 - RNA, 14 nt, Molluscum contagiosum virus
cuacgagcagcgcu

SEQ ID NO: 4037373 - RNA, 20 nt, Molluscum contagiosum virus
cuacgcgagcacugcgcgcg

SEQ ID NO: 4037374 - RNA, 15 nt, Molluscum contagiosum virus
cuacgggaagcugca

SEQ ID NO: 4037375 - RNA, 12 nt, Molluscum contagiosum virus
cuacuacacugu

SEQ ID NO: 4037376 - RNA, 20 nt, Molluscum contagiosum virus
cuacugcgcacccgccacga

SEQ ID NO: 4037377 - RNA, 19 nt, Molluscum contagiosum virus
cuacugggaggacacgcgc

SEQ ID NO: 4037378 - RNA, 22 nt, Molluscum contagiosum virus
cuagacuucuugguggacagcc

SEQ ID NO: 4037379 - RNA, 19 nt, Molluscum contagiosum virus
cuagagaaccugugcgcgg

SEQ ID NO: 4037380 - RNA, 21 nt, Molluscum contagiosum virus
cuagagcagaaggugcgcagc

SEQ ID NO: 4037381 - RNA, 15 nt, Molluscum contagiosum virus
cuagcaaggcgccgc

SEQ ID NO: 4037382 - RNA, 14 nt, Molluscum contagiosum virus
cuagcccagcacgc

SEQ ID NO: 4037383 - RNA, 22 nt, Molluscum contagiosum virus
cuagccgccgcugccgcgcgcg

SEQ ID NO: 4037384 - RNA, 20 nt, Molluscum contagiosum virus
cuagccgugaacgaggcugc

SEQ ID NO: 4037385 - RNA, 18 nt, Molluscum contagiosum virus
cuagccuccuugucuucc

SEQ ID NO: 4037386 - RNA, 13 nt, Molluscum contagiosum virus
cuagccugugccc

SEQ ID NO: 4037387 - RNA, 17 nt, Molluscum contagiosum virus
cuagccugugcccugga

SEQ ID NO: 4037388 - RNA, 20 nt, Molluscum contagiosum virus
cuagccugugcccuggaagc

SEQ ID NO: 4037389 - RNA, 17 nt, Molluscum contagiosum virus
cuagcgagcgcccgugc

SEQ ID NO: 4037390 - RNA, 21 nt, Molluscum contagiosum virus
cuagcgggcaagcgcuucccu

SEQ ID NO: 4037391 - RNA, 18 nt, Molluscum contagiosum virus
cuagcgggccuguaccug

SEQ ID NO: 4037392 - RNA, 18 nt, Molluscum contagiosum virus
cuagcgugagagcaaaga

SEQ ID NO: 4037393 - RNA, 16 nt, Molluscum contagiosum virus
cuagcgugcgcagcau

SEQ ID NO: 4037394 - RNA, 13 nt, Molluscum contagiosum virus
cuagcgugugccg

SEQ ID NO: 4037395 - RNA, 14 nt, Molluscum contagiosum virus
cuagcucugcgcgc

SEQ ID NO: 4037396 - RNA, 23 nt, Molluscum contagiosum virus
cuagcugugcgcuacguggcgcg

SEQ ID NO: 4037397 - RNA, 17 nt, Molluscum contagiosum virus
cuagugccgagcucgcc

SEQ ID NO: 4037398 - RNA, 21 nt, Molluscum contagiosum virus
cuauguaaagaaacgcgcccg

SEQ ID NO: 4037399 - RNA, 20 nt, Molluscum contagiosum virus
cuauuaccugaccgacggcg

SEQ ID NO: 4037400 - RNA, 23 nt, Molluscum contagiosum virus
cuauucucguggcguugcugcug

SEQ ID NO: 4037401 - RNA, 17 nt, Molluscum contagiosum virus
cucaagacgcugcuggc

SEQ ID NO: 4037402 - RNA, 15 nt, Molluscum contagiosum virus
cucacggacucgccg

SEQ ID NO: 4037403 - RNA, 19 nt, Molluscum contagiosum virus
cucacggccuucgcguucc

SEQ ID NO: 4037404 - RNA, 23 nt, Molluscum contagiosum virus
cucacucacaugugcugccggcu

SEQ ID NO: 4037405 - RNA, 15 nt, Molluscum contagiosum virus
cucagcauguugcuc

SEQ ID NO: 4037406 - RNA, 20 nt, Molluscum contagiosum virus
gccagcgacgagcagcugcu

SEQ ID NO: 4037407 - RNA, 23 nt, Molluscum contagiosum virus
gccagcgagaucaacgcgcgcgu

SEQ ID NO: 4037408 - RNA, 20 nt, Molluscum contagiosum virus
gccagcgagucucgcgcgcc

SEQ ID NO: 4037409 - RNA, 14 nt, Molluscum contagiosum virus
gccagcgcgcgccu

SEQ ID NO: 4037410 - RNA, 14 nt, Molluscum contagiosum virus
gccagcgggaaacu

SEQ ID NO: 4037411 - RNA, 20 nt, Molluscum contagiosum virus
gccagcgucgcgcgccgugc

SEQ ID NO: 4037412 - RNA, 23 nt, Molluscum contagiosum virus
gccagcuccgcgcggcgcucugc

SEQ ID NO: 4037413 - RNA, 18 nt, Molluscum contagiosum virus
gccagcucgacacugugc

SEQ ID NO: 4037414 - RNA, 23 nt, Molluscum contagiosum virus
gccagcuuggugcgcucgagcuc

SEQ ID NO: 4037415 - RNA, 16 nt, Molluscum contagiosum virus
gccagcuuucccuagc

SEQ ID NO: 4037416 - RNA, 19 nt, Molluscum contagiosum virus
gccaggcgccggcgcgcgc

SEQ ID NO: 4037417 - RNA, 22 nt, Molluscum contagiosum virus
gccaggcgcggucgcccgccga

SEQ ID NO: 4037418 - RNA, 14 nt, Molluscum contagiosum virus
gccagugcaguggc

SEQ ID NO: 4037419 - RNA, 16 nt, Molluscum contagiosum virus
gccagugcgugcacug

SEQ ID NO: 4037420 - RNA, 23 nt, Molluscum contagiosum virus
gccagugcuuugucgcaaccccg

SEQ ID NO: 4037421 - RNA, 13 nt, Molluscum contagiosum virus
gccaucaauucaa

SEQ ID NO: 4037422 - RNA, 20 nt, Molluscum contagiosum virus
gccaugaacaacauggugcu

SEQ ID NO: 4037423 - RNA, 22 nt, Molluscum contagiosum virus
gccaugaacaacauggugcugg

SEQ ID NO: 4037424 - RNA, 14 nt, Molluscum contagiosum virus
gccaugcugcgcga

SEQ ID NO: 4037425 - RNA, 24 nt, Molluscum contagiosum virus
gccauggaggcgcuagugcagaug

SEQ ID NO: 4037426 - RNA, 19 nt, Molluscum contagiosum virus
gccauggucacgcgcacgc

SEQ ID NO: 4037427 - RNA, 13 nt, Molluscum contagiosum virus
gcccaggccaugg

SEQ ID NO: 4037428 - RNA, 16 nt, Molluscum contagiosum virus
gccccaugcccgacca

SEQ ID NO: 4037429 - RNA, 14 nt, Molluscum contagiosum virus
gcccccgagcgcuu

SEQ ID NO: 4037430 - RNA, 16 nt, Molluscum contagiosum virus
gcccccgccaugccaa

SEQ ID NO: 4037431 - RNA, 13 nt, Molluscum contagiosum virus
gcccccgccgcgg

SEQ ID NO: 4037432 - RNA, 22 nt, Molluscum contagiosum virus
gcccccgguucccggugcugcu

SEQ ID NO: 4037433 - RNA, 16 nt, Molluscum contagiosum virus
gccccgacgccagcgc

SEQ ID NO: 4037434 - RNA, 15 nt, Molluscum contagiosum virus
gccccgagacccgca

SEQ ID NO: 4037435 - RNA, 14 nt, Molluscum contagiosum virus
gccccgcgccagca

SEQ ID NO: 4037436 - RNA, 15 nt, Molluscum contagiosum virus
gccccgcgccagcag

SEQ ID NO: 4037437 - RNA, 21 nt, Molluscum contagiosum virus
gccccgcgcgcccgcugcgcg

SEQ ID NO: 4037438 - RNA, 19 nt, Molluscum contagiosum virus
gccccguccucgcucgugc

SEQ ID NO: 4037439 - RNA, 13 nt, Molluscum contagiosum virus
gccccugcugcuc

SEQ ID NO: 4037440 - RNA, 14 nt, Molluscum contagiosum virus
gccccugcugcucg

SEQ ID NO: 4037441 - RNA, 15 nt, Molluscum contagiosum virus
gcccgacgcgggcgc

SEQ ID NO: 4037442 - RNA, 17 nt, Molluscum contagiosum virus
gcccgacucgcagcuca

SEQ ID NO: 4037443 - RNA, 22 nt, Molluscum contagiosum virus
gcccgagcaggacgugcacgug

SEQ ID NO: 4037444 - RNA, 18 nt, Molluscum contagiosum virus
gcccgagcccggccagac

SEQ ID NO: 4037445 - RNA, 19 nt, Molluscum contagiosum virus
gcccgaggagagcggcgcc

SEQ ID NO: 4037446 - RNA, 15 nt, Molluscum contagiosum virus
gcccgaguccgcgcu

SEQ ID NO: 4037447 - RNA, 19 nt, Molluscum contagiosum virus
gcccgaguuucggaagagc

SEQ ID NO: 4037448 - RNA, 17 nt, Molluscum contagiosum virus
gcccgcaaugcagugca

SEQ ID NO: 4037449 - RNA, 20 nt, Molluscum contagiosum virus
gcccgcaaugcagugcacca

SEQ ID NO: 4037450 - RNA, 17 nt, Molluscum contagiosum virus
gcccgcaccugcgccgc

SEQ ID NO: 4037451 - RNA, 12 nt, Molluscum contagiosum virus
gcccgccagcau

SEQ ID NO: 4037452 - RNA, 13 nt, Molluscum contagiosum virus
gcccgccagcaug

SEQ ID NO: 4037453 - RNA, 13 nt, Molluscum contagiosum virus
gcccgcccgcgcu

SEQ ID NO: 4037454 - RNA, 14 nt, Molluscum contagiosum virus
gcccgccuccgggc

SEQ ID NO: 4037455 - RNA, 18 nt, Molluscum contagiosum virus
gcccgcgaaggagagaga

SEQ ID NO: 4037456 - RNA, 20 nt, Molluscum contagiosum virus
gcccgcgagcacgggcgcca

SEQ ID NO: 4037457 - RNA, 22 nt, Molluscum contagiosum virus
gcccgcgcacgagcugcugccc

SEQ ID NO: 4037458 - RNA, 22 nt, Molluscum contagiosum virus
gcccgcgcgagacuugugccca

SEQ ID NO: 4037459 - RNA, 22 nt, Molluscum contagiosum virus
gcccgcgcuucugccugcuccc

SEQ ID NO: 4037460 - RNA, 14 nt, Molluscum contagiosum virus
gcccgcggcgcgcc

SEQ ID NO: 4037461 - RNA, 19 nt, Molluscum contagiosum virus
gcccgcgggcugcaagauu

SEQ ID NO: 4037462 - RNA, 15 nt, Molluscum contagiosum virus
gcccgcgggggcgug

SEQ ID NO: 4037463 - RNA, 16 nt, Molluscum contagiosum virus
gcccgcgucgcgcacg

SEQ ID NO: 4037464 - RNA, 18 nt, Molluscum contagiosum virus
gcccgcgugcacccuccg

SEQ ID NO: 4037465 - RNA, 13 nt, Molluscum contagiosum virus
gcccgcugcgcau

SEQ ID NO: 4037466 - RNA, 14 nt, Molluscum contagiosum virus
gcccggaagcuugc

SEQ ID NO: 4037467 - RNA, 20 nt, Molluscum contagiosum virus
gcccggacacguagcccagg

SEQ ID NO: 4037468 - RNA, 14 nt, Molluscum contagiosum virus
gcccggcgggcucu

SEQ ID NO: 4037469 - RNA, 23 nt, Molluscum contagiosum virus
gcccggcguuggcuuucugugcg

SEQ ID NO: 4037470 - RNA, 20 nt, Molluscum contagiosum virus
gcccgggcguagccuagcca

SEQ ID NO: 4037471 - RNA, 15 nt, Molluscum contagiosum virus
gcccgguacgcucgc

SEQ ID NO: 4037472 - RNA, 12 nt, Molluscum contagiosum virus
gcccguccuccg

SEQ ID NO: 4037473 - RNA, 17 nt, Molluscum contagiosum virus
gcccgucggggcaggga

SEQ ID NO: 4037474 - RNA, 18 nt, Molluscum contagiosum virus
gcccgucuuuccuggcuc

SEQ ID NO: 4037475 - RNA, 21 nt, Molluscum contagiosum virus
gcccgugcccgaguuugcccg

SEQ ID NO: 4037476 - RNA, 15 nt, Molluscum contagiosum virus
gcccgugccgccggc

SEQ ID NO: 4037477 - RNA, 19 nt, Molluscum contagiosum virus
gcccgugcucaggccagca

SEQ ID NO: 4037478 - RNA, 13 nt, Molluscum contagiosum virus
gcccugcucaugc

SEQ ID NO: 4037479 - RNA, 18 nt, Molluscum contagiosum virus
gccgaagucgcagcagcg

SEQ ID NO: 4037480 - RNA, 15 nt, Molluscum contagiosum virus
gccgaaucgucggca

SEQ ID NO: 4037481 - RNA, 15 nt, Molluscum contagiosum virus
gccgacaugcgcacg

SEQ ID NO: 4037482 - RNA, 22 nt, Molluscum contagiosum virus
gccgacgccuuccugcuggcgc

SEQ ID NO: 4037483 - RNA, 16 nt, Molluscum contagiosum virus
gccgagcaauugcugg

SEQ ID NO: 4037484 - RNA, 20 nt, Molluscum contagiosum virus
gccgagccaaggaugccugc

SEQ ID NO: 4037485 - RNA, 19 nt, Molluscum contagiosum virus
gccgagcggcaagccgugc

SEQ ID NO: 4037486 - RNA, 21 nt, Molluscum contagiosum virus
gccgagcgggcaaugggcacg

SEQ ID NO: 4037487 - RNA, 15 nt, Molluscum contagiosum virus
gccgagcucgccucc

SEQ ID NO: 4037488 - RNA, 15 nt, Molluscum contagiosum virus
gccgaggucuuccac

SEQ ID NO: 4037489 - RNA, 13 nt, Molluscum contagiosum virus
gccgaugcagugc

SEQ ID NO: 4037490 - RNA, 12 nt, Molluscum contagiosum virus
gccgaugccuau

SEQ ID NO: 4037491 - RNA, 23 nt, Molluscum contagiosum virus
gccgaugccuaugccgagguggc

SEQ ID NO: 4037492 - RNA, 14 nt, Molluscum contagiosum virus
gccgcaaccucuuc

SEQ ID NO: 4037493 - RNA, 21 nt, Molluscum contagiosum virus
gccgcacaaccacagcucucc

SEQ ID NO: 4037494 - RNA, 18 nt, Molluscum contagiosum virus
gccgcacgcugcugcgug

SEQ ID NO: 4037495 - RNA, 16 nt, Molluscum contagiosum virus
gccgcacucgccgcgg

SEQ ID NO: 4037496 - RNA, 19 nt, Molluscum contagiosum virus
gccgcaggaaccgcgugcg

SEQ ID NO: 4037497 - RNA, 17 nt, Molluscum contagiosum virus
gccgcagugcucgcaca

SEQ ID NO: 4037498 - RNA, 14 nt, Molluscum contagiosum virus
gccgccaccucggc

SEQ ID NO: 4037499 - RNA, 13 nt, Molluscum contagiosum virus
gccgccagcgacg

SEQ ID NO: 4037500 - RNA, 13 nt, Molluscum contagiosum virus
gccgccauccuga

SEQ ID NO: 4037501 - RNA, 16 nt, Molluscum contagiosum virus
gccgcccaagggcgua

SEQ ID NO: 4037502 - RNA, 17 nt, Molluscum contagiosum virus
gccgccgacgccuuccu

SEQ ID NO: 4037503 - RNA, 13 nt, Molluscum contagiosum virus
gccgccgcaggcc

SEQ ID NO: 4037504 - RNA, 14 nt, Molluscum contagiosum virus
gccgccgcaggccc

SEQ ID NO: 4037505 - RNA, 13 nt, Molluscum contagiosum virus
gccgccgcccgcg

SEQ ID NO: 4037506 - RNA, 15 nt, Molluscum contagiosum virus
gccgccgcugccgcg

SEQ ID NO: 4037507 - RNA, 21 nt, Molluscum contagiosum virus
gccgccgcugccgcgcgcgcc

SEQ ID NO: 4037508 - RNA, 15 nt, Molluscum contagiosum virus
gccgccgcuggggcg

SEQ ID NO: 4037509 - RNA, 18 nt, Molluscum contagiosum virus
gcgcguacgcugcucgag

SEQ ID NO: 4037510 - RNA, 17 nt, Molluscum contagiosum virus
gcgcguccgcaggcguc

SEQ ID NO: 4037511 - RNA, 15 nt, Molluscum contagiosum virus
gcgcgucgcggucgc

SEQ ID NO: 4037512 - RNA, 12 nt, Molluscum contagiosum virus
gcgcgugccugu

SEQ ID NO: 4037513 - RNA, 13 nt, Molluscum contagiosum virus
gcgcgugcgucuc

SEQ ID NO: 4037514 - RNA, 23 nt, Molluscum contagiosum virus
gcgcgugcucgacucggaugcgc

SEQ ID NO: 4037515 - RNA, 17 nt, Molluscum contagiosum virus
gcgcgugcuggacgcgc

SEQ ID NO: 4037516 - RNA, 19 nt, Molluscum contagiosum virus
gcgcgugcuggacgcgcac

SEQ ID NO: 4037517 - RNA, 16 nt, Molluscum contagiosum virus
gcgcgugcugucagug

SEQ ID NO: 4037518 - RNA, 15 nt, Molluscum contagiosum virus
gcgcguggaggacac

SEQ ID NO: 4037519 - RNA, 17 nt, Molluscum contagiosum virus
gcgcguggcucgcgacc

SEQ ID NO: 4037520 - RNA, 17 nt, Molluscum contagiosum virus
gcgcgugucuggagccc

SEQ ID NO: 4037521 - RNA, 17 nt, Molluscum contagiosum virus
gcgcguucagcgcacgc

SEQ ID NO: 4037522 - RNA, 15 nt, Molluscum contagiosum virus
gcgcguucggaacgc

SEQ ID NO: 4037523 - RNA, 12 nt, Molluscum contagiosum virus
gcgcuaccugau

SEQ ID NO: 4037524 - RNA, 17 nt, Molluscum contagiosum virus
gcgcuacuugcuggcgc

SEQ ID NO: 4037525 - RNA, 16 nt, Molluscum contagiosum virus
gcgcuagccccagcac

SEQ ID NO: 4037526 - RNA, 14 nt, Molluscum contagiosum virus
gcgcucaggaccag

SEQ ID NO: 4037527 - RNA, 11 nt, Molluscum contagiosum virus
gcgcucaucaa

SEQ ID NO: 4037528 - RNA, 16 nt, Molluscum contagiosum virus
gcgcucgagcuccgag

SEQ ID NO: 4037529 - RNA, 14 nt, Molluscum contagiosum virus
gcgcucgccucugg

SEQ ID NO: 4037530 - RNA, 13 nt, Molluscum contagiosum virus
gcgcucgcgcagg

SEQ ID NO: 4037531 - RNA, 19 nt, Molluscum contagiosum virus
gcgcucgcgcgcacgcgca

SEQ ID NO: 4037532 - RNA, 15 nt, Molluscum contagiosum virus
gcgcucggaggggcu

SEQ ID NO: 4037533 - RNA, 14 nt, Molluscum contagiosum virus
gcgcucgugucuag

SEQ ID NO: 4037534 - RNA, 20 nt, Molluscum contagiosum virus
gcgcucuacgagacucugga

SEQ ID NO: 4037535 - RNA, 17 nt, Molluscum contagiosum virus
gcgcucucagagcauua

SEQ ID NO: 4037536 - RNA, 17 nt, Molluscum contagiosum virus
gcgcucuggagccuccc

SEQ ID NO: 4037537 - RNA, 20 nt, Molluscum contagiosum virus
gcgcucuucguggugcucac

SEQ ID NO: 4037538 - RNA, 16 nt, Molluscum contagiosum virus
gcgcugccagcucgac

SEQ ID NO: 4037539 - RNA, 17 nt, Molluscum contagiosum virus
gcgcugccagcucgaca

SEQ ID NO: 4037540 - RNA, 13 nt, Molluscum contagiosum virus
gcgcugcgccacu

SEQ ID NO: 4037541 - RNA, 22 nt, Molluscum contagiosum virus
gcgcugcgccacugccacggcu

SEQ ID NO: 4037542 - RNA, 14 nt, Molluscum contagiosum virus
gcgcugcgcgcgcu

SEQ ID NO: 4037543 - RNA, 17 nt, Molluscum contagiosum virus
gcgcugcgcgcgcucgc

SEQ ID NO: 4037544 - RNA, 20 nt, Molluscum contagiosum virus
gcgcugcgcgcgcucgcgca

SEQ ID NO: 4037545 - RNA, 19 nt, Molluscum contagiosum virus
gcgcugcgcggcggcagcu

SEQ ID NO: 4037546 - RNA, 20 nt, Molluscum contagiosum virus
gcgcugcuggugcucgccug

SEQ ID NO: 4037547 - RNA, 13 nt, Molluscum contagiosum virus
gcgcugcugguuc

SEQ ID NO: 4037548 - RNA, 19 nt, Molluscum contagiosum virus
gcgcuggagaaagaagugu

SEQ ID NO: 4037549 - RNA, 16 nt, Molluscum contagiosum virus
gcgcuggaugcugcuc

SEQ ID NO: 4037550 - RNA, 16 nt, Molluscum contagiosum virus
gcgcuggcccacgcug

SEQ ID NO: 4037551 - RNA, 19 nt, Molluscum contagiosum virus
gcgcugguuaccaagggca

SEQ ID NO: 4037552 - RNA, 21 nt, Molluscum contagiosum virus
gcgcuucggcucccagcagcg

SEQ ID NO: 4037553 - RNA, 18 nt, Molluscum contagiosum virus
gcgcuucuuccggcagcu

SEQ ID NO: 4037554 - RNA, 21 nt, Molluscum contagiosum virus
gcgcuugcucacgcugcgcuc

SEQ ID NO: 4037555 - RNA, 22 nt, Molluscum contagiosum virus
gcggaccgucagccucugugcg

SEQ ID NO: 4037556 - RNA, 13 nt, Molluscum contagiosum virus
gcggacgccggcg

SEQ ID NO: 4037557 - RNA, 13 nt, Molluscum contagiosum virus
gcggacgcgcagc

SEQ ID NO: 4037558 - RNA, 19 nt, Molluscum contagiosum virus
gcggacgcgggccuguccg

SEQ ID NO: 4037559 - RNA, 20 nt, Molluscum contagiosum virus
gcggagaaaaggaagcuugc

SEQ ID NO: 4037560 - RNA, 15 nt, Molluscum contagiosum virus
gcggagcgcacgaag

SEQ ID NO: 4037561 - RNA, 11 nt, Molluscum contagiosum virus
gcggagcuggc

SEQ ID NO: 4037562 - RNA, 17 nt, Molluscum contagiosum virus
gcggaucgugcuggaga

SEQ ID NO: 4037563 - RNA, 17 nt, Molluscum contagiosum virus
gcggcaaaggcccgcga

SEQ ID NO: 4037564 - RNA, 24 nt, Molluscum contagiosum virus
gcggcaaaugcgucccagcagcug

SEQ ID NO: 4037565 - RNA, 15 nt, Molluscum contagiosum virus
gcggcaaccgcgccc

SEQ ID NO: 4037566 - RNA, 16 nt, Molluscum contagiosum virus
gcggcaacgagcacgu

SEQ ID NO: 4037567 - RNA, 14 nt, Molluscum contagiosum virus
gcggcaagcuuugc

SEQ ID NO: 4037568 - RNA, 20 nt, Molluscum contagiosum virus
gcggcacaugcagcugcagg

SEQ ID NO: 4037569 - RNA, 14 nt, Molluscum contagiosum virus
gcggcacccgccgc

SEQ ID NO: 4037570 - RNA, 18 nt, Molluscum contagiosum virus
gcggcacgcccuggcccu

SEQ ID NO: 4037571 - RNA, 18 nt, Molluscum contagiosum virus
gcggcacgccgcucggca

SEQ ID NO: 4037572 - RNA, 18 nt, Molluscum contagiosum virus
gcggcacugggugcccga

SEQ ID NO: 4037573 - RNA, 22 nt, Molluscum contagiosum virus
gcggcagacaacaccagcgugc

SEQ ID NO: 4037574 - RNA, 10 nt, Molluscum contagiosum virus
gcggcagcag

SEQ ID NO: 4037575 - RNA, 18 nt, Molluscum contagiosum virus
gcggcagcuaccgcgcgc

SEQ ID NO: 4037576 - RNA, 23 nt, Molluscum contagiosum virus
gcggcaggcgcugcgcggcgcgc

SEQ ID NO: 4037577 - RNA, 14 nt, Molluscum contagiosum virus
gcggcauccugaug

SEQ ID NO: 4037578 - RNA, 15 nt, Molluscum contagiosum virus
gcggcaugcgcgcgc

SEQ ID NO: 4037579 - RNA, 18 nt, Molluscum contagiosum virus
gcggccaccagcgcggcc

SEQ ID NO: 4037580 - RNA, 13 nt, Molluscum contagiosum virus
gcggccacucucc

SEQ ID NO: 4037581 - RNA, 22 nt, Molluscum contagiosum virus
gcggccacucucccgggcucug

SEQ ID NO: 4037582 - RNA, 20 nt, Molluscum contagiosum virus
gcggccgagucacgccccag

SEQ ID NO: 4037583 - RNA, 18 nt, Molluscum contagiosum virus
gcggccgcgcucgucggc

SEQ ID NO: 4037584 - RNA, 15 nt, Molluscum contagiosum virus
gcggccguugccgga

SEQ ID NO: 4037585 - RNA, 16 nt, Molluscum contagiosum virus
gcggccuggccacgcc

SEQ ID NO: 4037586 - RNA, 18 nt, Molluscum contagiosum virus
gcggcgcaagcaccggca

SEQ ID NO: 4037587 - RNA, 21 nt, Molluscum contagiosum virus
gcggcgcacaaucucgccggc

SEQ ID NO: 4037588 - RNA, 14 nt, Molluscum contagiosum virus
gcggcgcgccgcgc

SEQ ID NO: 4037589 - RNA, 22 nt, Molluscum contagiosum virus
gcggcgcguccucggccagagc

SEQ ID NO: 4037590 - RNA, 14 nt, Molluscum contagiosum virus
gcggcgcgugucgc

SEQ ID NO: 4037591 - RNA, 16 nt, Molluscum contagiosum virus
gcggcgcucguggcgc

SEQ ID NO: 4037592 - RNA, 15 nt, Molluscum contagiosum virus
gcggcgcucugccac

SEQ ID NO: 4037593 - RNA, 13 nt, Molluscum contagiosum virus
gcggcggacagca

SEQ ID NO: 4037594 - RNA, 22 nt, Molluscum contagiosum virus
gcggcuacgaugaacuaccgug

SEQ ID NO: 4037595 - RNA, 13 nt, Molluscum contagiosum virus
gcggcugcggcgc

SEQ ID NO: 4037596 - RNA, 14 nt, Molluscum contagiosum virus
gcggcuggaccugc

SEQ ID NO: 4037597 - RNA, 17 nt, Molluscum contagiosum virus
gcggcugugcccgcggc

SEQ ID NO: 4037598 - RNA, 19 nt, Molluscum contagiosum virus
gcggcugugcccgcggcgu

SEQ ID NO: 4037599 - RNA, 17 nt, Molluscum contagiosum virus
gcggcuuucucacgccc

SEQ ID NO: 4037600 - RNA, 14 nt, Molluscum contagiosum virus
gcgggaagggguga

SEQ ID NO: 4037601 - RNA, 22 nt, Molluscum contagiosum virus
gcgggaccucuuucucgcgccg

SEQ ID NO: 4037602 - RNA, 18 nt, Molluscum contagiosum virus
gcgggaggcucucgagca

SEQ ID NO: 4037603 - RNA, 20 nt, Molluscum contagiosum virus
gcgggaggcucucgagcacu

SEQ ID NO: 4037604 - RNA, 17 nt, Molluscum contagiosum virus
gcgggcaagcagggccu

SEQ ID NO: 4037605 - RNA, 15 nt, Molluscum contagiosum virus
gcgggccaggcacug

SEQ ID NO: 4037606 - RNA, 20 nt, Molluscum contagiosum virus
gcgggcccgcgaacgagaga

SEQ ID NO: 4037607 - RNA, 13 nt, Molluscum contagiosum virus
gcgggccugcgcc

SEQ ID NO: 4037608 - RNA, 14 nt, Molluscum contagiosum virus
gcgggccugcgccc

SEQ ID NO: 4037609 - RNA, 17 nt, Molluscum contagiosum virus
gcgggccugcgcccgca

SEQ ID NO: 4037610 - RNA, 19 nt, Molluscum contagiosum virus
gcgggccuguaccugcgac

SEQ ID NO: 4037611 - RNA, 19 nt, Molluscum contagiosum virus
gcgggccuuugccgcugcc

SEQ ID NO: 4037612 - RNA, 14 nt, Molluscum contagiosum virus
ucgcgcucuucccg

SEQ ID NO: 4037613 - RNA, 23 nt, Molluscum contagiosum virus
ucgcgcuuuuccagguggccaac

SEQ ID NO: 4037614 - RNA, 14 nt, Molluscum contagiosum virus
ucgcggacggcgcg

SEQ ID NO: 4037615 - RNA, 15 nt, Molluscum contagiosum virus
ucgcggacggcgcgc

SEQ ID NO: 4037616 - RNA, 14 nt, Molluscum contagiosum virus
ucgcggagcgcacg

SEQ ID NO: 4037617 - RNA, 16 nt, Molluscum contagiosum virus
ucgcggcgcuacuggc

SEQ ID NO: 4037618 - RNA, 18 nt, Molluscum contagiosum virus
ucgcgggcacgagcaugu

SEQ ID NO: 4037619 - RNA, 14 nt, Molluscum contagiosum virus
ucgcgggcgccgcg

SEQ ID NO: 4037620 - RNA, 13 nt, Molluscum contagiosum virus
ucgcggugcagcu

SEQ ID NO: 4037621 - RNA, 14 nt, Molluscum contagiosum virus
ucgcguccgcgcag

SEQ ID NO: 4037622 - RNA, 23 nt, Molluscum contagiosum virus
ucgcguggugcuuacugcgggcu

SEQ ID NO: 4037623 - RNA, 15 nt, Molluscum contagiosum virus
ucgcugcacgcgaau

SEQ ID NO: 4037624 - RNA, 12 nt, Molluscum contagiosum virus
ucgcugccuggu

SEQ ID NO: 4037625 - RNA, 18 nt, Molluscum contagiosum virus
ucgcugcuccccgccagc

SEQ ID NO: 4037626 - RNA, 17 nt, Molluscum contagiosum virus
ucggagcaggacgacga

SEQ ID NO: 4037627 - RNA, 16 nt, Molluscum contagiosum virus
ucggaugcgcugccgg

SEQ ID NO: 4037628 - RNA, 19 nt, Molluscum contagiosum virus
ucggcgagacgugcggcac

SEQ ID NO: 4037629 - RNA, 21 nt, Molluscum contagiosum virus
ucggcgcuaugccgcgugcuc

SEQ ID NO: 4037630 - RNA, 15 nt, Molluscum contagiosum virus
ucggcguacgugcgc

SEQ ID NO: 4037631 - RNA, 23 nt, Molluscum contagiosum virus
ucggcuuggacagcaagcagcgc

SEQ ID NO: 4037632 - RNA, 15 nt, Molluscum contagiosum virus
ucgggccccugcgcg

SEQ ID NO: 4037633 - RNA, 19 nt, Molluscum contagiosum virus
ucgggcugcagcccuucca

SEQ ID NO: 4037634 - RNA, 19 nt, Molluscum contagiosum virus
ucggggcccucggcgcgcc

SEQ ID NO: 4037635 - RNA, 12 nt, Molluscum contagiosum virus
ucggggcuguca

SEQ ID NO: 4037636 - RNA, 20 nt, Molluscum contagiosum virus
ucgggugcccggacagagcc

SEQ ID NO: 4037637 - RNA, 18 nt, Molluscum contagiosum virus
ucgguagccaggcgccgg

SEQ ID NO: 4037638 - RNA, 22 nt, Molluscum contagiosum virus
ucggugccagauugccggcgcg

SEQ ID NO: 4037639 - RNA, 14 nt, Molluscum contagiosum virus
ucggugggcucgcg

SEQ ID NO: 4037640 - RNA, 14 nt, Molluscum contagiosum virus
ucgucaaugcgcac

SEQ ID NO: 4037641 - RNA, 15 nt, Molluscum contagiosum virus
ucgucaaugcgcacg

SEQ ID NO: 4037642 - RNA, 14 nt, Molluscum contagiosum virus
ucgucacgcuagcg

SEQ ID NO: 4037643 - RNA, 12 nt, Molluscum contagiosum virus
ucguccacaggc

SEQ ID NO: 4037644 - RNA, 19 nt, Molluscum contagiosum virus
ucgugcaauggcaggugcg

SEQ ID NO: 4037645 - RNA, 21 nt, Molluscum contagiosum virus
ucgugccugucggcacaucuc

SEQ ID NO: 4037646 - RNA, 20 nt, Molluscum contagiosum virus
ucgugcucguguguccgcac

SEQ ID NO: 4037647 - RNA, 22 nt, Molluscum contagiosum virus
ucgugcucguguguccgcacgc

SEQ ID NO: 4037648 - RNA, 18 nt, Molluscum contagiosum virus
ucguggacgagcagagcc

SEQ ID NO: 4037649 - RNA, 18 nt, Molluscum contagiosum virus
ucguggccaacuucgcgg

SEQ ID NO: 4037650 - RNA, 22 nt, Molluscum contagiosum virus
ucguggggaggacaaaacugaa

SEQ ID NO: 4037651 - RNA, 19 nt, Molluscum contagiosum virus
ucguucgcggggccggcuu

SEQ ID NO: 4037652 - RNA, 16 nt, Molluscum contagiosum virus
ucguuggcgcgcccgg

SEQ ID NO: 4037653 - RNA, 19 nt, Molluscum contagiosum virus
ucuacggcgugcugugccu

SEQ ID NO: 4037654 - RNA, 23 nt, Molluscum contagiosum virus
ucuacuaaaguacgagagcgcau

SEQ ID NO: 4037655 - RNA, 20 nt, Molluscum contagiosum virus
ucuacugcgacauccacaug

SEQ ID NO: 4037656 - RNA, 17 nt, Molluscum contagiosum virus
ucuacuggcggcgcccg

SEQ ID NO: 4037657 - RNA, 15 nt, Molluscum contagiosum virus
ucuagcucgcgcgcg

SEQ ID NO: 4037658 - RNA, 13 nt, Molluscum contagiosum virus
ucuaguucccaug

SEQ ID NO: 4037659 - RNA, 18 nt, Molluscum contagiosum virus
ucucagcggcacugcgcg

SEQ ID NO: 4037660 - RNA, 23 nt, Molluscum contagiosum virus
ucuccaagaagacggcgcgcgcg

SEQ ID NO: 4037661 - RNA, 20 nt, Molluscum contagiosum virus
ucuccacgucgaucagcucc

SEQ ID NO: 4037662 - RNA, 20 nt, Molluscum contagiosum virus
ucuccaucaucgagcugcag

SEQ ID NO: 4037663 - RNA, 16 nt, Molluscum contagiosum virus
ucucccgggcucuguc

SEQ ID NO: 4037664 - RNA, 17 nt, Molluscum contagiosum virus
ucuccgagacacgcgag

SEQ ID NO: 4037665 - RNA, 14 nt, Molluscum contagiosum virus
ucucgccggcugua

SEQ ID NO: 4037666 - RNA, 20 nt, Molluscum contagiosum virus
ucucgcggggcaagcgcgcu

SEQ ID NO: 4037667 - RNA, 19 nt, Molluscum contagiosum virus
ucucggcagcgucgcggag

SEQ ID NO: 4037668 - RNA, 21 nt, Molluscum contagiosum virus
ucucuccccuucagaggacuu

SEQ ID NO: 4037669 - RNA, 14 nt, Molluscum contagiosum virus
ucucucgagagaca

SEQ ID NO: 4037670 - RNA, 20 nt, Molluscum contagiosum virus
ucucugcgaucgcgggcacg

SEQ ID NO: 4037671 - RNA, 13 nt, Molluscum contagiosum virus
ucucugcgcgcaa

SEQ ID NO: 4037672 - RNA, 13 nt, Molluscum contagiosum virus
ucugccucgugga

SEQ ID NO: 4037673 - RNA, 20 nt, Molluscum contagiosum virus
ucugcgugcuugugcgccug

SEQ ID NO: 4037674 - RNA, 14 nt, Molluscum contagiosum virus
ucugcuccgcggag

SEQ ID NO: 4037675 - RNA, 12 nt, Molluscum contagiosum virus
ucugcucgcagu

SEQ ID NO: 4037676 - RNA, 16 nt, Molluscum contagiosum virus
ucugucccgcaagcca

SEQ ID NO: 4037677 - RNA, 16 nt, Molluscum contagiosum virus
ucuuaugcauccugau

SEQ ID NO: 4037678 - RNA, 18 nt, Molluscum contagiosum virus
ucuucaggaacaaggcca

SEQ ID NO: 4037679 - RNA, 11 nt, Molluscum contagiosum virus
ucuuccacaug

SEQ ID NO: 4037680 - RNA, 15 nt, Molluscum contagiosum virus
ucuuccccgagagcu

SEQ ID NO: 4037681 - RNA, 22 nt, Molluscum contagiosum virus
ucuucgaaguggccgucgcgag

SEQ ID NO: 4037682 - RNA, 20 nt, Molluscum contagiosum virus
ucuucgacaacaugcucgug

SEQ ID NO: 4037683 - RNA, 23 nt, Molluscum contagiosum virus
ucuucgagacgcugcgcgacgag

SEQ ID NO: 4037684 - RNA, 21 nt, Molluscum contagiosum virus
ucuucgggaaggaacaaugcu

SEQ ID NO: 4037685 - RNA, 14 nt, Molluscum contagiosum virus
ucuuuccggcgcgg

SEQ ID NO: 4037686 - RNA, 20 nt, Molluscum contagiosum virus
ugaaaggcaccugcggcucg

SEQ ID NO: 4037687 - RNA, 12 nt, Molluscum contagiosum virus
ugaacaagcugc

SEQ ID NO: 4037688 - RNA, 17 nt, Molluscum contagiosum virus
ugaaccugggcgcgcac

SEQ ID NO: 4037689 - RNA, 17 nt, Molluscum contagiosum virus
ugaacgcgcugcgccac

SEQ ID NO: 4037690 - RNA, 22 nt, Molluscum contagiosum virus
ugaaggacgcguucuccaggaa

SEQ ID NO: 4037691 - RNA, 13 nt, Molluscum contagiosum virus
ugaaggcauaccu

SEQ ID NO: 4037692 - RNA, 14 nt, Molluscum contagiosum virus
ugacaggcgcgcaa

SEQ ID NO: 4037693 - RNA, 21 nt, Molluscum contagiosum virus
ugacaggcgcgcaagugcgug

SEQ ID NO: 4037694 - RNA, 17 nt, Molluscum contagiosum virus
ugaccauggacacgcug

SEQ ID NO: 4037695 - RNA, 21 nt, Molluscum contagiosum virus
ugaccuucaccaucaacaucu

SEQ ID NO: 4037696 - RNA, 18 nt, Molluscum contagiosum virus
ugacgaagcugcgcuugc

SEQ ID NO: 4037697 - RNA, 21 nt, Molluscum contagiosum virus
ugacgauuaucguggacgagc

SEQ ID NO: 4037698 - RNA, 21 nt, Molluscum contagiosum virus
ugacgcgcacgccagccugga

SEQ ID NO: 4037699 - RNA, 19 nt, Molluscum contagiosum virus
ugacgcguacauccgcgag

SEQ ID NO: 4037700 - RNA, 18 nt, Molluscum contagiosum virus
ugacggcgcugcgcgugg

SEQ ID NO: 4037701 - RNA, 15 nt, Molluscum contagiosum virus
ugacgguccugcgcg

SEQ ID NO: 4037702 - RNA, 11 nt, Molluscum contagiosum virus
ugagaagcugu

SEQ ID NO: 4037703 - RNA, 14 nt, Molluscum contagiosum virus
ugagcaagcucaag

SEQ ID NO: 4037704 - RNA, 21 nt, Molluscum contagiosum virus
ugagcagcaccgcacgccagc

SEQ ID NO: 4037705 - RNA, 21 nt, Molluscum contagiosum virus
ugagcaggucggccagcagcu

SEQ ID NO: 4037706 - RNA, 22 nt, Molluscum contagiosum virus
ugagcaggucggccagcagcuc

SEQ ID NO: 4037707 - RNA, 19 nt, Molluscum contagiosum virus
ugagccacaaacacucgcg

SEQ ID NO: 4037708 - RNA, 17 nt, Molluscum contagiosum virus
ugagcgcgccgcucgcg

SEQ ID NO: 4037709 - RNA, 23 nt, Molluscum contagiosum virus
ugagcggcacgggaaggcucuca

SEQ ID NO: 4037710 - RNA, 21 nt, Molluscum contagiosum virus
ugagcgggguacaggcgcggc

SEQ ID NO: 4037711 - RNA, 15 nt, Molluscum contagiosum virus
ugagcuagugccgag

SEQ ID NO: 4037712 - RNA, 22 nt, Molluscum contagiosum virus
ugaggcagugcuugagcaucuc

SEQ ID NO: 4037713 - RNA, 16 nt, Molluscum contagiosum virus
ugagucacgcuugcag

SEQ ID NO: 4037714 - RNA, 14 nt, Molluscum contagiosum virus
uggcggaugucacg

SEQ ID NO: 4037715 - RNA, 23 nt, Molluscum contagiosum virus
uggcggccugcccugcucaugcg

SEQ ID NO: 4037716 - RNA, 13 nt, Molluscum contagiosum virus
uggcggggcuggc

SEQ ID NO: 4037717 - RNA, 18 nt, Molluscum contagiosum virus
uggcggugcggcgcacgc

SEQ ID NO: 4037718 - RNA, 23 nt, Molluscum contagiosum virus
uggcgugaccauggacacgcugc

SEQ ID NO: 4037719 - RNA, 20 nt, Molluscum contagiosum virus
uggcucuagaguacuaggug

SEQ ID NO: 4037720 - RNA, 15 nt, Molluscum contagiosum virus
uggcuucggggacac

SEQ ID NO: 4037721 - RNA, 17 nt, Molluscum contagiosum virus
uggcuucggggacacaa

SEQ ID NO: 4037722 - RNA, 17 nt, Molluscum contagiosum virus
ugggaaagggcugcuug

SEQ ID NO: 4037723 - RNA, 14 nt, Molluscum contagiosum virus
ugggagaacacgag

SEQ ID NO: 4037724 - RNA, 15 nt, Molluscum contagiosum virus
ugggcacugcuacga

SEQ ID NO: 4037725 - RNA, 21 nt, Molluscum contagiosum virus
ugggcacugcuacgagccgcu

SEQ ID NO: 4037726 - RNA, 23 nt, Molluscum contagiosum virus
ugggcaucgucucgcucuuccgc

SEQ ID NO: 4037727 - RNA, 12 nt, Molluscum contagiosum virus
ugggcccgccuc

SEQ ID NO: 4037728 - RNA, 17 nt, Molluscum contagiosum virus
ugggccgaaucgucggc

SEQ ID NO: 4037729 - RNA, 12 nt, Molluscum contagiosum virus
ugggcgcgccgc

SEQ ID NO: 4037730 - RNA, 16 nt, Molluscum contagiosum virus
ugggcuucggaacgcu

SEQ ID NO: 4037731 - RNA, 14 nt, Molluscum contagiosum virus
uggggcucgccggc

SEQ ID NO: 4037732 - RNA, 13 nt, Molluscum contagiosum virus
ugguacagaugag

SEQ ID NO: 4037733 - RNA, 14 nt, Molluscum contagiosum virus
ugguaguugcagcc

SEQ ID NO: 4037734 - RNA, 16 nt, Molluscum contagiosum virus
ugguccaccagcugcc

SEQ ID NO: 4037735 - RNA, 19 nt, Molluscum contagiosum virus
ugguccaccagcugccgcu

SEQ ID NO: 4037736 - RNA, 16 nt, Molluscum contagiosum virus
uggucucgcugcuggg

SEQ ID NO: 4037737 - RNA, 17 nt, Molluscum contagiosum virus
uggucuucccgcuggcg

SEQ ID NO: 4037738 - RNA, 12 nt, Molluscum contagiosum virus
uggugcagaucu

SEQ ID NO: 4037739 - RNA, 17 nt, Molluscum contagiosum virus
uggugcgcccgcggcac

SEQ ID NO: 4037740 - RNA, 21 nt, Molluscum contagiosum virus
uggugcugcgcgacaugcugc

SEQ ID NO: 4037741 - RNA, 13 nt, Molluscum contagiosum virus
uggugggcacgca

SEQ ID NO: 4037742 - RNA, 18 nt, Molluscum contagiosum virus
uggugggccgcggcgcgg

SEQ ID NO: 4037743 - RNA, 14 nt, Molluscum contagiosum virus
uguaacaaggaaaa

SEQ ID NO: 4037744 - RNA, 19 nt, Molluscum contagiosum virus
uguaccugcgacagcugcu

SEQ ID NO: 4037745 - RNA, 17 nt, Molluscum contagiosum virus
uguacgacgugcugcug

SEQ ID NO: 4037746 - RNA, 22 nt, Molluscum contagiosum virus
uguacgggcgugcgcagcagcu

SEQ ID NO: 4037747 - RNA, 14 nt, Molluscum contagiosum virus
uguacgugcugccc

SEQ ID NO: 4037748 - RNA, 16 nt, Molluscum contagiosum virus
uguagaacgccaggaa

SEQ ID NO: 4037749 - RNA, 16 nt, Molluscum contagiosum virus
uguagagacgcugccg

SEQ ID NO: 4037750 - RNA, 17 nt, Molluscum contagiosum virus
uguagcgguugaccagc

SEQ ID NO: 4037751 - RNA, 22 nt, Molluscum contagiosum virus
uguccaaggugaacgaccucaa

SEQ ID NO: 4037752 - RNA, 17 nt, Molluscum contagiosum virus
uguccacaaaaccaaaa

SEQ ID NO: 4037753 - RNA, 17 nt, Molluscum contagiosum virus
uguccgcgggcgcacgc

SEQ ID NO: 4037754 - RNA, 12 nt, Molluscum contagiosum virus
uguccucucgag

SEQ ID NO: 4037755 - RNA, 16 nt, Molluscum contagiosum virus
uguccugcgugcuucc

SEQ ID NO: 4037756 - RNA, 22 nt, Molluscum contagiosum virus
uguccuucugguuccugcgcuc

SEQ ID NO: 4037757 - RNA, 22 nt, Molluscum contagiosum virus
ugucgucaaaggcaaagccugc

SEQ ID NO: 4037758 - RNA, 19 nt, Molluscum contagiosum virus
ugucugggcgagagcuuuu

SEQ ID NO: 4037759 - RNA, 18 nt, Molluscum contagiosum virus
ugucuugaugcuguuacu

SEQ ID NO: 4037760 - RNA, 21 nt, Molluscum contagiosum virus
ugugacacgagccgugugcuc

SEQ ID NO: 4037761 - RNA, 24 nt, Molluscum contagiosum virus
ugugaugauuugauggcugcucau

SEQ ID NO: 4037762 - RNA, 13 nt, Molluscum contagiosum virus
ugugcaggaacug

SEQ ID NO: 4037763 - RNA, 14 nt, Molluscum contagiosum virus
ugugccugcgcaac

SEQ ID NO: 4037764 - RNA, 21 nt, Molluscum contagiosum virus
ugugcgagaacuggcgcagca

SEQ ID NO: 4037765 - RNA, 12 nt, Molluscum contagiosum virus
ugugcgagcgca

SEQ ID NO: 4037766 - RNA, 16 nt, Molluscum contagiosum virus
ugugcgcacgcugacc

SEQ ID NO: 4037767 - RNA, 16 nt, Molluscum contagiosum virus
ugugcgugacacgcga

SEQ ID NO: 4037768 - RNA, 14 nt, Molluscum contagiosum virus
ugugcgugcaccuc

SEQ ID NO: 4037769 - RNA, 17 nt, Molluscum contagiosum virus
ugugcuacugcacugca

SEQ ID NO: 4037770 - RNA, 23 nt, Molluscum contagiosum virus
uguguacgacgcgcccacgugcc

SEQ ID NO: 4037771 - RNA, 22 nt, Molluscum contagiosum virus
ugugucgcgagugugcgcgccc

SEQ ID NO: 4037772 - RNA, 23 nt, Molluscum contagiosum virus
uguguucccggcugccgcugccu

SEQ ID NO: 4037773 - RNA, 12 nt, Molluscum contagiosum virus
uguuauuucagu

SEQ ID NO: 4037774 - RNA, 20 nt, Molluscum contagiosum virus
uguucgcggacggcgcgcag

SEQ ID NO: 4037775 - RNA, 13 nt, Molluscum contagiosum virus
uguugagccuucu

SEQ ID NO: 4037776 - RNA, 15 nt, Molluscum contagiosum virus
uguugcguagagcaa

SEQ ID NO: 4037777 - RNA, 19 nt, Molluscum contagiosum virus
uguuggaagucguggccgu

SEQ ID NO: 4037778 - RNA, 14 nt, Molluscum contagiosum virus
uguugucucucgag

SEQ ID NO: 4037779 - RNA, 21 nt, Molluscum contagiosum virus
uguuucgcaugcacagccgcu

SEQ ID NO: 4037780 - RNA, 14 nt, Molluscum contagiosum virus
uguuuucauuucgc

SEQ ID NO: 4037781 - RNA, 18 nt, Molluscum contagiosum virus
uuacggacgcccuccucg

SEQ ID NO: 4037782 - RNA, 14 nt, Molluscum contagiosum virus
uucaccugcauuga

SEQ ID NO: 4037783 - RNA, 19 nt, Molluscum contagiosum virus
uucaccuuggcgcugcaca

SEQ ID NO: 4037784 - RNA, 20 nt, Molluscum contagiosum virus
uucacgcaaggaagcaacaa

SEQ ID NO: 4037785 - RNA, 20 nt, Molluscum contagiosum virus
uucacgcugcacgagcugcu

SEQ ID NO: 4037786 - RNA, 18 nt, Molluscum contagiosum virus
uucaguguuuuaauuuuc

SEQ ID NO: 4037787 - RNA, 14 nt, Molluscum contagiosum virus
uuccacgcuugcac

SEQ ID NO: 4037788 - RNA, 23 nt, Molluscum contagiosum virus
uuccagcucggguuccagcuccg

SEQ ID NO: 4037789 - RNA, 19 nt, Molluscum contagiosum virus
uucccggcugccgcugccu

SEQ ID NO: 4037790 - RNA, 21 nt, Molluscum contagiosum virus
uuccgacaacucgcgcuggcc

SEQ ID NO: 4037791 - RNA, 13 nt, Molluscum contagiosum virus
uuccgcgacgagc

SEQ ID NO: 4037792 - RNA, 23 nt, Molluscum contagiosum virus
uuccgucccccgcggagcugugc

SEQ ID NO: 4037793 - RNA, 14 nt, Molluscum contagiosum virus
uuccguccccucuc

SEQ ID NO: 4037794 - RNA, 18 nt, Molluscum contagiosum virus
uuccugaacaagcugcac

SEQ ID NO: 4037795 - RNA, 16 nt, Molluscum contagiosum virus
uuccugcugcgcagca

SEQ ID NO: 4037796 - RNA, 21 nt, Molluscum contagiosum virus
uuccuggcacuggcgcgcacg

SEQ ID NO: 4037797 - RNA, 19 nt, Molluscum contagiosum virus
uucgacuucuccgcgcugc

SEQ ID NO: 4037798 - RNA, 20 nt, Molluscum contagiosum virus
uucgcaagucucccucgcgc

SEQ ID NO: 4037799 - RNA, 15 nt, Molluscum contagiosum virus
uucgcacgaccacgc

SEQ ID NO: 4037800 - RNA, 13 nt, Molluscum contagiosum virus
uucgccgcgcgcg

SEQ ID NO: 4037801 - RNA, 14 nt, Molluscum contagiosum virus
uucgccggaggaag

SEQ ID NO: 4037802 - RNA, 22 nt, Molluscum contagiosum virus
uucgcgaccuggcgcgugcgag

SEQ ID NO: 4037803 - RNA, 20 nt, Molluscum contagiosum virus
uucguguucgcggacggcgc

SEQ ID NO: 4037804 - RNA, 20 nt, Molluscum contagiosum virus
uucguugagaccgccgcuga

SEQ ID NO: 4037805 - RNA, 21 nt, Molluscum contagiosum virus
uucuacgggaagcugcacgug

SEQ ID NO: 4037806 - RNA, 13 nt, Molluscum contagiosum virus
uucucaaauaaag

SEQ ID NO: 4037807 - RNA, 21 nt, Molluscum contagiosum virus
uucucauagcauauaaaucau

SEQ ID NO: 4037808 - RNA, 22 nt, Molluscum contagiosum virus
uucugcgcgccgcucgucgcug

SEQ ID NO: 4037809 - RNA, 13 nt, Molluscum contagiosum virus
uucugcgcugcca

SEQ ID NO: 4037810 - RNA, 16 nt, Molluscum contagiosum virus
uucuggcgcgcgugcc

SEQ ID NO: 4037811 - RNA, 17 nt, Molluscum contagiosum virus
uucuggucuggaaacac

SEQ ID NO: 4037812 - RNA, 22 nt, Molluscum contagiosum virus
uucuucgcagaggacagcuccu

SEQ ID NO: 4037813 - RNA, 13 nt, Molluscum contagiosum virus
uugaaaggcagaa

SEQ ID NO: 4037814 - RNA, 20 nt, Molluscum contagiosum virus
uugaacaucuaugcacggca

SEQ ID NO: 4037815 - RNA, 22 nt, Molluscum contagiosum virus
uugaccgcuucgagugcucccg

SEQ ID NO: 4037816 - RNA, 14 nt, Molluscum contagiosum virus
uggcacuggcgcgc

SEQ ID NO: 4037817 - RNA, 14 nt, Molluscum contagiosum virus
uggcaggcgcgcgc

SEQ ID NO: 4037818 - RNA, 21 nt, Molluscum contagiosum virus
uggcaugcgcccucacgugcu

SEQ ID NO: 4037819 - RNA, 13 nt, Molluscum contagiosum virus
uggcaugcgugcu

SEQ ID NO: 4037820 - RNA, 18 nt, Molluscum contagiosum virus
uggcaugcgugcuucacg

SEQ ID NO: 4037821 - RNA, 19 nt, Molluscum contagiosum virus
uggccaaagucuuccuggg

SEQ ID NO: 4037822 - RNA, 22 nt, Molluscum contagiosum virus
uggccaacaggaauguguacga

SEQ ID NO: 4037823 - RNA, 19 nt, Molluscum contagiosum virus
uggccacucucgcgcguga

SEQ ID NO: 4037824 - RNA, 20 nt, Molluscum contagiosum virus
uggcccuuuucuaggccuca

SEQ ID NO: 4037825 - RNA, 17 nt, Molluscum contagiosum virus
uggccgagccgcuggcc

SEQ ID NO: 4037826 - RNA, 19 nt, Molluscum contagiosum virus
uggccgcgauucugcucuu

SEQ ID NO: 4037827 - RNA, 23 nt, Molluscum contagiosum virus
uggccgcgcccucgcucgagggc

SEQ ID NO: 4037828 - RNA, 22 nt, Molluscum contagiosum virus
uggccgcgcgcgcacgcaagcc

SEQ ID NO: 4037829 - RNA, 19 nt, Molluscum contagiosum virus
uggccucugccugcaagga

SEQ ID NO: 4037830 - RNA, 16 nt, Molluscum contagiosum virus
uggccuguaguagcag

SEQ ID NO: 4037831 - RNA, 20 nt, Molluscum contagiosum virus
uggcgaaaccugggcgccgc

SEQ ID NO: 4037832 - RNA, 22 nt, Molluscum contagiosum virus
uggcgagcaucugcgcgugcug

SEQ ID NO: 4037833 - RNA, 16 nt, Molluscum contagiosum virus
uggcgcaccugcuaga

SEQ ID NO: 4037834 - RNA, 22 nt, Molluscum contagiosum virus
uggcgcagcaggaugcuggugu

SEQ ID NO: 4037835 - RNA, 21 nt, Molluscum contagiosum virus
uggcgccgcugcuggaacagg

SEQ ID NO: 4037836 - RNA, 17 nt, Molluscum contagiosum virus
uggcgcgcccggcgccc

SEQ ID NO: 4037837 - RNA, 19 nt, Molluscum contagiosum virus
uggcgcgcccggcgcccgc

SEQ ID NO: 4037838 - RNA, 15 nt, Molluscum contagiosum virus
uggcgcgcgagcugc

SEQ ID NO: 4037839 - RNA, 17 nt, Molluscum contagiosum virus
uggcgcgcgcgcugcgc

SEQ ID NO: 4037840 - RNA, 20 nt, Molluscum contagiosum virus
uggcgcgcgcggucgacggg

SEQ ID NO: 4037841 - RNA, 16 nt, Molluscum contagiosum virus
uggcgcucgcgcgcac

SEQ ID NO: 4037842 - RNA, 20 nt, Molluscum contagiosum virus
uggcguccgcacgaggagcc

SEQ ID NO: 4037843 - RNA, 13 nt, Molluscum contagiosum virus
uggcgugacaggu

SEQ ID NO: 4037844 - RNA, 15 nt, Molluscum contagiosum virus
uggcugugcgcccac

SEQ ID NO: 4037845 - RNA, 20 nt, Molluscum contagiosum virus
uggcuucuccaccuucagga

SEQ ID NO: 4037846 - RNA, 21 nt, Molluscum contagiosum virus
ugggaacaccacacgcgcggc

SEQ ID NO: 4037847 - RNA, 19 nt, Molluscum contagiosum virus
ugggaggacacgcgcacgc

SEQ ID NO: 4037848 - RNA, 21 nt, Molluscum contagiosum virus
ugggcaacgcgcgcgcgcugg

SEQ ID NO: 4037849 - RNA, 17 nt, Molluscum contagiosum virus
ugggcagccgccuggcc

SEQ ID NO: 4037850 - RNA, 17 nt, Molluscum contagiosum virus
ugggcagcuucugcucg

SEQ ID NO: 4037851 - RNA, 22 nt, Molluscum contagiosum virus
ugggcgucgcacaguucacggc

SEQ ID NO: 4037852 - RNA, 17 nt, Molluscum contagiosum virus
ugggcgugcggcgcacc

SEQ ID NO: 4037853 - RNA, 16 nt, Molluscum contagiosum virus
ugggcguggcgcaccu

SEQ ID NO: 4037854 - RNA, 14 nt, Molluscum contagiosum virus
ugggcuucaaguuc

SEQ ID NO: 4037855 - RNA, 15 nt, Molluscum contagiosum virus
ugguaacaagagcuu

SEQ ID NO: 4037856 - RNA, 14 nt, Molluscum contagiosum virus
uggucaacagcuac

SEQ ID NO: 4037857 - RNA, 16 nt, Molluscum contagiosum virus
uggucaacagcuacac

SEQ ID NO: 4037858 - RNA, 15 nt, Molluscum contagiosum virus
uggucacgcgcacgc

SEQ ID NO: 4037859 - RNA, 20 nt, Molluscum contagiosum virus
uggucgagggcgaggccaag

SEQ ID NO: 4037860 - RNA, 18 nt, Molluscum contagiosum virus
uggugccgcgcgcuacgc

SEQ ID NO: 4037861 - RNA, 21 nt, Molluscum contagiosum virus
uggugcgcgacgacggcacgc

SEQ ID NO: 4037862 - RNA, 13 nt, Molluscum contagiosum virus
ugguggagcacuu

SEQ ID NO: 4037863 - RNA, 20 nt, Molluscum contagiosum virus
ugguggccaagauccuguac

SEQ ID NO: 4037864 - RNA, 21 nt, Molluscum contagiosum virus
ugguguauccaggaucacgau

SEQ ID NO: 4037865 - RNA, 18 nt, Molluscum contagiosum virus
ugguguccacgcgcguga

SEQ ID NO: 4037866 - RNA, 16 nt, Molluscum contagiosum virus
ggacucgccgcgcgcc

SEQ ID NO: 4037867 - RNA, 16 nt, Molluscum contagiosum virus
ggacugggaacccgug

SEQ ID NO: 4037868 - RNA, 13 nt, Molluscum contagiosum virus
ggacuucuugcgc

SEQ ID NO: 4037869 - RNA, 17 nt, Molluscum contagiosum virus
ggagaacaugcucgcca

SEQ ID NO: 4037870 - RNA, 16 nt, Molluscum contagiosum virus
ggagaagugcuccgca

SEQ ID NO: 4037871 - RNA, 17 nt, Molluscum contagiosum virus
ggagaagugcuccgcac

SEQ ID NO: 4037872 - RNA, 17 nt, Molluscum contagiosum virus
ggagacaccagcuccgc

SEQ ID NO: 4037873 - RNA, 17 nt, Molluscum contagiosum virus
ggagacagggugccuac

SEQ ID NO: 4037874 - RNA, 18 nt, Molluscum contagiosum virus
uaccggcaguagcagcgc

SEQ ID NO: 4037875 - RNA, 21 nt, Molluscum contagiosum virus
uaccugcgacagcugcugcuc

SEQ ID NO: 4037876 - RNA, 12 nt, Molluscum contagiosum virus
uaccugcugcug

SEQ ID NO: 4037877 - RNA, 13 nt, Molluscum contagiosum virus
uaccuugaagaaa

SEQ ID NO: 4037878 - RNA, 14 nt, Molluscum contagiosum virus
uacgaaaguacuuu

SEQ ID NO: 4037879 - RNA, 19 nt, Molluscum contagiosum virus
uacgacaugcucgcgcucu

SEQ ID NO: 4037880 - RNA, 14 nt, Molluscum contagiosum virus
uacgacgacaugca

SEQ ID NO: 4037881 - RNA, 20 nt, Molluscum contagiosum virus
uacgacgcgcccacgugcca

SEQ ID NO: 4037882 - RNA, 21 nt, Molluscum contagiosum virus
uacgcacgcacguggcgcugc

SEQ ID NO: 4037883 - RNA, 13 nt, Molluscum contagiosum virus
uacgcgccagugc

SEQ ID NO: 4037884 - RNA, 22 nt, Molluscum contagiosum virus
uacgcgccggggcgcgcgcugc

SEQ ID NO: 4037885 - RNA, 14 nt, Molluscum contagiosum virus
uacgcgucgcggag

SEQ ID NO: 4037886 - RNA, 14 nt, Molluscum contagiosum virus
uacgcuacagcagc

SEQ ID NO: 4037887 - RNA, 14 nt, Molluscum contagiosum virus
uacgcucgcgcugu

SEQ ID NO: 4037888 - RNA, 17 nt, Molluscum contagiosum virus
uacggacggcgcacgca

SEQ ID NO: 4037889 - RNA, 20 nt, Molluscum contagiosum virus
uacgggaagcugcacgugca

SEQ ID NO: 4037890 - RNA, 17 nt, Molluscum contagiosum virus
uacuccacuaccaacuc

SEQ ID NO: 4037891 - RNA, 13 nt, Molluscum contagiosum virus
uacugcacugcag

SEQ ID NO: 4037892 - RNA, 21 nt, Molluscum contagiosum virus
uacugccgccaggaaaacgga

SEQ ID NO: 4037893 - RNA, 17 nt, Molluscum contagiosum virus
uacuuccgguguccccg

SEQ ID NO: 4037894 - RNA, 17 nt, Molluscum contagiosum virus
uacuucgucaagcagcg

SEQ ID NO: 4037895 - RNA, 21 nt, Molluscum contagiosum virus
uagacagugcggcgcggcugc

SEQ ID NO: 4037896 - RNA, 21 nt, Molluscum contagiosum virus
uagagcaaaggaagagcccgc

SEQ ID NO: 4037897 - RNA, 16 nt, Molluscum contagiosum virus
uagagcaauacguggc

SEQ ID NO: 4037898 - RNA, 20 nt, Molluscum contagiosum virus
uagagcagaaggugcgcagc

SEQ ID NO: 4037899 - RNA, 14 nt, Molluscum contagiosum virus
uagcaaggcgccgc

SEQ ID NO: 4037900 - RNA, 15 nt, Molluscum contagiosum virus
uagcacacgcgcgcg

SEQ ID NO: 4037901 - RNA, 22 nt, Molluscum contagiosum virus
uagcaccgcaugggcccuggcg

SEQ ID NO: 4037902 - RNA, 18 nt, Molluscum contagiosum virus
uagcagcgccugcacgca

SEQ ID NO: 4037903 - RNA, 14 nt, Molluscum contagiosum virus
uagcagcgugcgca

SEQ ID NO: 4037904 - RNA, 21 nt, Molluscum contagiosum virus
uagcagcuucuuggagcccuu

SEQ ID NO: 4037905 - RNA, 21 nt, Molluscum contagiosum virus
uagcaggaucggagcgcagcu

SEQ ID NO: 4037906 - RNA, 18 nt, Molluscum contagiosum virus
uagcagggcggcgccugc

SEQ ID NO: 4037907 - RNA, 14 nt, Molluscum contagiosum virus
uagccgccgcugcc

SEQ ID NO: 4037908 - RNA, 14 nt, Molluscum contagiosum virus
uagccuccuugucu

SEQ ID NO: 4037909 - RNA, 23 nt, Molluscum contagiosum virus
uagcgucugggugcccaaacagc

SEQ ID NO: 4037910 - RNA, 16 nt, Molluscum contagiosum virus
uagcgugugccgccgc

SEQ ID NO: 4037911 - RNA, 16 nt, Molluscum contagiosum virus
uagcguucccaagcaa

SEQ ID NO: 4037912 - RNA, 14 nt, Molluscum contagiosum virus
uaggacaugacugc

SEQ ID NO: 4037913 - RNA, 17 nt, Molluscum contagiosum virus
uaggcacuccgcgcacc

SEQ ID NO: 4037914 - RNA, 17 nt, Molluscum contagiosum virus
uaguccgcguacagcgc

SEQ ID NO: 4037915 - RNA, 15 nt, Molluscum contagiosum virus
uaguugcgagccagc

SEQ ID NO: 4037916 - RNA, 18 nt, Molluscum contagiosum virus
ucaaagcacaacaagaag

SEQ ID NO: 4037917 - RNA, 18 nt, Molluscum contagiosum virus
ucaaaggcaaagccugcu

SEQ ID NO: 4037918 - RNA, 13 nt, Molluscum contagiosum virus
ucaacaagcugcu

SEQ ID NO: 4037919 - RNA, 13 nt, Molluscum contagiosum virus
ucaaccugcugcc

SEQ ID NO: 4037920 - RNA, 15 nt, Molluscum contagiosum virus
ucaaccugcugccuc

SEQ ID NO: 4037921 - RNA, 20 nt, Molluscum contagiosum virus
ucaacgugggcaccugcauc

SEQ ID NO: 4037922 - RNA, 19 nt, Molluscum contagiosum virus
ucaacuacaaggugcuguc

SEQ ID NO: 4037923 - RNA, 14 nt, Molluscum contagiosum virus
ucaacuuccacauc

SEQ ID NO: 4037924 - RNA, 16 nt, Molluscum contagiosum virus
ucaagaacaauuacuc

SEQ ID NO: 4037925 - RNA, 22 nt, Molluscum contagiosum virus
ucaagaacagucgcgcgccugc

SEQ ID NO: 4037926 - RNA, 19 nt, Molluscum contagiosum virus
ucaagcaccugcgcuuccu

SEQ ID NO: 4037927 - RNA, 16 nt, Molluscum contagiosum virus
ucaagcacgagcugcu

SEQ ID NO: 4037928 - RNA, 17 nt, Molluscum contagiosum virus
ucaagcacggcuuccgg

SEQ ID NO: 4037929 - RNA, 22 nt, Molluscum contagiosum virus
ucaagcacggcuuccggcacca

SEQ ID NO: 4037930 - RNA, 23 nt, Molluscum contagiosum virus
ucaagcacuacauggacgugcug

SEQ ID NO: 4037931 - RNA, 19 nt, Molluscum contagiosum virus
ucaagcagguggccgcgcg

SEQ ID NO: 4037932 - RNA, 22 nt, Molluscum contagiosum virus
ucaagccgcaggcgcgcgccau

SEQ ID NO: 4037933 - RNA, 19 nt, Molluscum contagiosum virus
ucaaucucgcccagcaccu

SEQ ID NO: 4037934 - RNA, 14 nt, Molluscum contagiosum virus
ucaccaccaccucc

SEQ ID NO: 4037935 - RNA, 14 nt, Molluscum contagiosum virus
ucaccauccagccg

SEQ ID NO: 4037936 - RNA, 21 nt, Molluscum contagiosum virus
ucacgacuguguucccggcug

SEQ ID NO: 4037937 - RNA, 11 nt, Molluscum contagiosum virus
ucacgccgccc

SEQ ID NO: 4037938 - RNA, 15 nt, Molluscum contagiosum virus
ucacgcugcgcucgg

SEQ ID NO: 4037939 - RNA, 20 nt, Molluscum contagiosum virus
ucacgcugcucgugcugcuc

SEQ ID NO: 4037940 - RNA, 16 nt, Molluscum contagiosum virus
ucacggcgcucgccuc

SEQ ID NO: 4037941 - RNA, 14 nt, Molluscum contagiosum virus
ucacggcucugcgu

SEQ ID NO: 4037942 - RNA, 13 nt, Molluscum contagiosum virus
ucacucgcucgcg

SEQ ID NO: 4037943 - RNA, 16 nt, Molluscum contagiosum virus
ucacugcagcagcccc

SEQ ID NO: 4037944 - RNA, 13 nt, Molluscum contagiosum virus
ucagaacgacacc

SEQ ID NO: 4037945 - RNA, 16 nt, Molluscum contagiosum virus
ucgcacccgcgccgcg

SEQ ID NO: 4037946 - RNA, 14 nt, Molluscum contagiosum virus
ucgcagcguuccag

SEQ ID NO: 4037947 - RNA, 15 nt, Molluscum contagiosum virus
ucgcagugcccgggg

SEQ ID NO: 4037948 - RNA, 16 nt, Molluscum contagiosum virus
ucgccaaugacggcgu

SEQ ID NO: 4037949 - RNA, 22 nt, Molluscum contagiosum virus
ucgccagcaucaagggcaaggg

SEQ ID NO: 4037950 - RNA, 20 nt, Molluscum contagiosum virus
ucgcccguguucgcggagcu

SEQ ID NO: 4037951 - RNA, 18 nt, Molluscum contagiosum virus
ucgccgaacggcagaccc

SEQ ID NO: 4037952 - RNA, 17 nt, Molluscum contagiosum virus
ucgccgcgcgcgccagc

SEQ ID NO: 4037953 - RNA, 16 nt, Molluscum contagiosum virus
ucgccggacagcucag

SEQ ID NO: 4037954 - RNA, 21 nt, Molluscum contagiosum virus
ucgccggcaucgcgcugcugg

SEQ ID NO: 4037955 - RNA, 19 nt, Molluscum contagiosum virus
ucgccgggccccugucgcg

SEQ ID NO: 4037956 - RNA, 17 nt, Molluscum contagiosum virus
ucgcgacgacgagcacu

SEQ ID NO: 4037957 - RNA, 18 nt, Molluscum contagiosum virus
ucgcgcaaguccagcgcg

SEQ ID NO: 4037958 - RNA, 14 nt, Molluscum contagiosum virus
ucgcgcagcagcua

SEQ ID NO: 4037959 - RNA, 23 nt, Molluscum contagiosum virus
ucgcgcagcaggcacuccagcgc

SEQ ID NO: 4037960 - RNA, 14 nt, Molluscum contagiosum virus
ucgcgcaggucauc

SEQ ID NO: 4037961 - RNA, 16 nt, Molluscum contagiosum virus
ucgcgcccugcgcgcg

SEQ ID NO: 4037962 - RNA, 15 nt, Molluscum contagiosum virus
ucgcgcgccugccgc

SEQ ID NO: 4037963 - RNA, 13 nt, Molluscum contagiosum virus
ucgcgcgcgggcu

SEQ ID NO: 4037964 - RNA, 17 nt, Molluscum contagiosum virus
ucgcgcgcuaccugcgc

SEQ ID NO: 4037965 - RNA, 11 nt, Molluscum contagiosum virus
ucgcgcuuccc

SEQ ID NO: 4037966 - RNA, 13 nt, Molluscum contagiosum virus
ucgcgcuuugcgc

SEQ ID NO: 4037967 - RNA, 16 nt, Molluscum contagiosum virus
ucgcggagcgcgcacg

SEQ ID NO: 4037968 - RNA, 21 nt, Molluscum contagiosum virus
ucgcggagcugugccgcagca

SEQ ID NO: 4037969 - RNA, 12 nt, Molluscum contagiosum virus
ucgcggagggcg

SEQ ID NO: 4037970 - RNA, 20 nt, Molluscum contagiosum virus
ucgcgggauacgggcgcuau

SEQ ID NO: 4037971 - RNA, 12 nt, Molluscum contagiosum virus
ucgcgggcgccg

SEQ ID NO: 4037972 - RNA, 13 nt, Molluscum contagiosum virus
ucgcgggcgcgcg

SEQ ID NO: 4037973 - RNA, 22 nt, Molluscum contagiosum virus
ucgcgggcgcgcgcggagagga

SEQ ID NO: 4037974 - RNA, 19 nt, Molluscum contagiosum virus
ucgcgggcguggggagcug

SEQ ID NO: 4037975 - RNA, 13 nt, Molluscum contagiosum virus
ucgcggugccgga

SEQ ID NO: 4037976 - RNA, 16 nt, Molluscum contagiosum virus
ucgcgguggcaggcgc

SEQ ID NO: 4037977 - RNA, 20 nt, Molluscum contagiosum virus
ucgcguaccaagccgugacg

SEQ ID NO: 4037978 - RNA, 24 nt, Molluscum contagiosum virus
ucgcguaccaagccgugacgcugc

SEQ ID NO: 4037979 - RNA, 22 nt, Molluscum contagiosum virus
ucgcguagcagcgccugcacgc

SEQ ID NO: 4037980 - RNA, 15 nt, Molluscum contagiosum virus
ggagacguagagcag

SEQ ID NO: 4037981 - RNA, 23 nt, Molluscum contagiosum virus
ggagacgucguggauggcguccu

SEQ ID NO: 4037982 - RNA, 18 nt, Molluscum contagiosum virus
ggagagcacuucucgccg

SEQ ID NO: 4037983 - RNA, 15 nt, Molluscum contagiosum virus
ggagaggacgcgugc

SEQ ID NO: 4037984 - RNA, 15 nt, Molluscum contagiosum virus
ggagaucaggcagcu

SEQ ID NO: 4037985 - RNA, 21 nt, Molluscum contagiosum virus
ggagcaccgcguggcgcgcga

SEQ ID NO: 4037986 - RNA, 20 nt, Molluscum contagiosum virus
ggagcacgccuggcggcagc

SEQ ID NO: 4037987 - RNA, 20 nt, Molluscum contagiosum virus
ggagcagacguacgagcagg

SEQ ID NO: 4037988 - RNA, 16 nt, Molluscum contagiosum virus
ggagcccgugcuggag

SEQ ID NO: 4037989 - RNA, 16 nt, Molluscum contagiosum virus
ggagcccuugaucgac

SEQ ID NO: 4037990 - RNA, 23 nt, Molluscum contagiosum virus
ggagcgcuucuagcucgcgcgcg

SEQ ID NO: 4037991 - RNA, 13 nt, Molluscum contagiosum virus
ggagcuagcgcgc

SEQ ID NO: 4037992 - RNA, 14 nt, Molluscum contagiosum virus
ggagcugccgcugc

SEQ ID NO: 4037993 - RNA, 14 nt, Molluscum contagiosum virus
ggagcugcggacgc

SEQ ID NO: 4037994 - RNA, 13 nt, Molluscum contagiosum virus
ggagcugugccgc

SEQ ID NO: 4037995 - RNA, 16 nt, Molluscum contagiosum virus
ggagcuuuccuugcgc

SEQ ID NO: 4037996 - RNA, 18 nt, Molluscum contagiosum virus
ggaggaccacgccgacca

SEQ ID NO: 4037997 - RNA, 20 nt, Molluscum contagiosum virus
ggaggaccgcgagcgcaugc

SEQ ID NO: 4037998 - RNA, 16 nt, Molluscum contagiosum virus
ggaggcgcuagugcag

SEQ ID NO: 4037999 - RNA, 17 nt, Molluscum contagiosum virus
ggagguuggaagcacgc

SEQ ID NO: 4038000 - RNA, 21 nt, Molluscum contagiosum virus
ggagucaggcaaaagccgccg

SEQ ID NO: 4038001 - RNA, 22 nt, Molluscum contagiosum virus
ggauaccaugcucucgcugcug

SEQ ID NO: 4038002 - RNA, 13 nt, Molluscum contagiosum virus
ggaucacggcucu

SEQ ID NO: 4038003 - RNA, 18 nt, Molluscum contagiosum virus
ggaugccacgcagcuggc

SEQ ID NO: 4038004 - RNA, 17 nt, Molluscum contagiosum virus
ggaugccuuucaggggu

SEQ ID NO: 4038005 - RNA, 16 nt, Molluscum contagiosum virus
ggcaaagccugcugcg

SEQ ID NO: 4038006 - RNA, 22 nt, Molluscum contagiosum virus
ggcaaagccugcugcgcgcgcc

SEQ ID NO: 4038007 - RNA, 19 nt, Molluscum contagiosum virus
ggcaacaugcggagacugu

SEQ ID NO: 4038008 - RNA, 19 nt, Molluscum contagiosum virus
ggcaaccgcgacgagcaga

SEQ ID NO: 4038009 - RNA, 19 nt, Molluscum contagiosum virus
ggcaacugccugcgcuagu

SEQ ID NO: 4038010 - RNA, 23 nt, Molluscum contagiosum virus
ggcaagaccaucaucgcgcugcu

SEQ ID NO: 4038011 - RNA, 14 nt, Molluscum contagiosum virus
ggcaagaggggagc

SEQ ID NO: 4038012 - RNA, 18 nt, Molluscum contagiosum virus
ggcaagaggggagccagc

SEQ ID NO: 4038013 - RNA, 14 nt, Molluscum contagiosum virus
ggcaagccgagcca

SEQ ID NO: 4038014 - RNA, 22 nt, Molluscum contagiosum virus
ggcaagcgccgccaugcugcgc

SEQ ID NO: 4038015 - RNA, 17 nt, Molluscum contagiosum virus
ggcaaucgcgugcuugc

SEQ ID NO: 4038016 - RNA, 21 nt, Molluscum contagiosum virus
ggcacaggguuccgcgccugc

SEQ ID NO: 4038017 - RNA, 14 nt, Molluscum contagiosum virus
ggcacagucuggga

SEQ ID NO: 4038018 - RNA, 16 nt, Molluscum contagiosum virus
ggcacauccgcuaccu

SEQ ID NO: 4038019 - RNA, 19 nt, Molluscum contagiosum virus
ggcacaucucucagggcag

SEQ ID NO: 4038020 - RNA, 18 nt, Molluscum contagiosum virus
ggcacccaccaggaacga

SEQ ID NO: 4038021 - RNA, 15 nt, Molluscum contagiosum virus
ggcaccccgaaggaa

SEQ ID NO: 4038022 - RNA, 14 nt, Molluscum contagiosum virus
ggcaccccgcagga

SEQ ID NO: 4038023 - RNA, 17 nt, Molluscum contagiosum virus
ggcaccccgcaggaaag

SEQ ID NO: 4038024 - RNA, 18 nt, Molluscum contagiosum virus
ggcacccgcaacaaggaa

SEQ ID NO: 4038025 - RNA, 19 nt, Molluscum contagiosum virus
ggcacccgcaacaaggaaa

SEQ ID NO: 4038026 - RNA, 22 nt, Molluscum contagiosum virus
ggcacccgcaacaaggaaaggc

SEQ ID NO: 4038027 - RNA, 21 nt, Molluscum contagiosum virus
ggcacccgccgcggugccggg

SEQ ID NO: 4038028 - RNA, 16 nt, Molluscum contagiosum virus
ggcaccugcaggaaag

SEQ ID NO: 4038029 - RNA, 21 nt, Molluscum contagiosum virus
ggcacgaggcagccgcggcgc

SEQ ID NO: 4038030 - RNA, 16 nt, Molluscum contagiosum virus
ggcacgggcacgcgcg

SEQ ID NO: 4038031 - RNA, 12 nt, Molluscum contagiosum virus
ggcacguccgcc

SEQ ID NO: 4038032 - RNA, 21 nt, Molluscum contagiosum virus
ggcacguggcuaugagcggca

SEQ ID NO: 4038033 - RNA, 15 nt, Molluscum contagiosum virus
ggcacuccagcgcgc

SEQ ID NO: 4038034 - RNA, 14 nt, Molluscum contagiosum virus
ggcacuucucgcgc

SEQ ID NO: 4038035 - RNA, 12 nt, Molluscum contagiosum virus
ggcagaagcuca

SEQ ID NO: 4038036 - RNA, 20 nt, Molluscum contagiosum virus
ggcagcaggaagacgcauag

SEQ ID NO: 4038037 - RNA, 15 nt, Molluscum contagiosum virus
ggcagccuugcgaga

SEQ ID NO: 4038038 - RNA, 21 nt, Molluscum contagiosum virus
ggcagcgucgcggagcgcgca

SEQ ID NO: 4038039 - RNA, 17 nt, Molluscum contagiosum virus
ggcagcuaccgcgcgcg

SEQ ID NO: 4038040 - RNA, 18 nt, Molluscum contagiosum virus
ggcagcucugcagcgccg

SEQ ID NO: 4038041 - RNA, 17 nt, Molluscum contagiosum virus
ggcagggaaagagcacg

SEQ ID NO: 4038042 - RNA, 13 nt, Molluscum contagiosum virus
ggcaggucgcggu

SEQ ID NO: 4038043 - RNA, 17 nt, Molluscum contagiosum virus
ggcaguagcagcgccgg

SEQ ID NO: 4038044 - RNA, 14 nt, Molluscum contagiosum virus
ggcagugcuugagc

SEQ ID NO: 4038045 - RNA, 17 nt, Molluscum contagiosum virus
ggcauaccugugccagc

SEQ ID NO: 4038046 - RNA, 15 nt, Molluscum contagiosum virus
ggcaucaugagccag

SEQ ID NO: 4038047 - RNA, 15 nt, Molluscum contagiosum virus
ggcaucgcgcugcug

SEQ ID NO: 4038048 - RNA, 14 nt, Molluscum contagiosum virus
ggcaugcuugaggc

SEQ ID NO: 4038049 - RNA, 12 nt, Molluscum contagiosum virus
ggcauggagggc

SEQ ID NO: 4038050 - RNA, 15 nt, Molluscum contagiosum virus
ggccaaagccgcgga

SEQ ID NO: 4038051 - RNA, 19 nt, Molluscum contagiosum virus
ggccaaagccgcggaggcc

SEQ ID NO: 4038052 - RNA, 22 nt, Molluscum contagiosum virus
ggccaccucgcacgugugcagg

SEQ ID NO: 4038053 - RNA, 21 nt, Molluscum contagiosum virus
ggccacgggauguuggagcgc

SEQ ID NO: 4038054 - RNA, 21 nt, Molluscum contagiosum virus
ggccacucucccgggcucugu

SEQ ID NO: 4038055 - RNA, 16 nt, Molluscum contagiosum virus
ggccagcgcgcggcgc

SEQ ID NO: 4038056 - RNA, 12 nt, Molluscum contagiosum virus
ggccaggcgcgg

SEQ ID NO: 4038057 - RNA, 22 nt, Molluscum contagiosum virus
ggccauggagcgcccgcugcuc

SEQ ID NO: 4038058 - RNA, 17 nt, Molluscum contagiosum virus
ggcccaccgcgccagcg

SEQ ID NO: 4038059 - RNA, 21 nt, Molluscum contagiosum virus
ggcccacgcuggcgcucggcg

SEQ ID NO: 4038060 - RNA, 15 nt, Molluscum contagiosum virus
ggccccuacgugguc

SEQ ID NO: 4038061 - RNA, 16 nt, Molluscum contagiosum virus
ggcccgagcagaagga

SEQ ID NO: 4038062 - RNA, 14 nt, Molluscum contagiosum virus
ggcccgcgagcacg

SEQ ID NO: 4038063 - RNA, 18 nt, Molluscum contagiosum virus
ggccgaagucuaggcagc

SEQ ID NO: 4038064 - RNA, 23 nt, Molluscum contagiosum virus
ggccgaaucgucggcacgcugca

SEQ ID NO: 4038065 - RNA, 23 nt, Molluscum contagiosum virus
ggccgagcgugaccagugcgugc

SEQ ID NO: 4038066 - RNA, 12 nt, Molluscum contagiosum virus
ggccgcacgcgu

SEQ ID NO: 4038067 - RNA, 17 nt, Molluscum contagiosum virus
ggccgccacuguugcuu

SEQ ID NO: 4038068 - RNA, 15 nt, Molluscum contagiosum virus
ggccgccgggccugc

SEQ ID NO: 4038069 - RNA, 16 nt, Molluscum contagiosum virus
ggccgcgccgcgccga

SEQ ID NO: 4038070 - RNA, 20 nt, Molluscum contagiosum virus
ggccgcgcucgucggcggca

SEQ ID NO: 4038071 - RNA, 21 nt, Molluscum contagiosum virus
ggccgcggaggacucggaggc

SEQ ID NO: 4038072 - RNA, 13 nt, Molluscum contagiosum virus
ggccggcgcgccg

SEQ ID NO: 4038073 - RNA, 22 nt, Molluscum contagiosum virus
ggccguagugcucaucgugccc

SEQ ID NO: 4038074 - RNA, 21 nt, Molluscum contagiosum virus
ggccguguacaugcucaagca

SEQ ID NO: 4038075 - RNA, 14 nt, Molluscum contagiosum virus
ggccuaccugcagg

SEQ ID NO: 4038076 - RNA, 15 nt, Molluscum contagiosum virus
ggccuccuucccuga

SEQ ID NO: 4038077 - RNA, 14 nt, Molluscum contagiosum virus
ggccucguccugga

SEQ ID NO: 4038078 - RNA, 17 nt, Molluscum contagiosum virus
ggccucguccuggaggg

SEQ ID NO: 4038079 - RNA, 17 nt, Molluscum contagiosum virus
ggccugcggcaggaagc

SEQ ID NO: 4038080 - RNA, 21 nt, Molluscum contagiosum virus
ggccugcugaagaaggagccc

SEQ ID NO: 4038081 - RNA, 22 nt, Molluscum contagiosum virus
ggccuguccgcggaugcaggca

SEQ ID NO: 4038082 - RNA, 15 nt, Molluscum contagiosum virus
ggcgaccagcucuug

SEQ ID NO: 4038083 - RNA, 21 nt, Molluscum contagiosum virus
ggcgacgacagcgacgagauc

SEQ ID NO: 4038084 - RNA, 20 nt, Molluscum contagiosum virus
ggcgacuggcgacacauugc

SEQ ID NO: 4038085 - RNA, 19 nt, Molluscum contagiosum virus
ggcgagacgugcggcacgc

SEQ ID NO: 4038086 - RNA, 15 nt, Molluscum contagiosum virus
ggcgagauugagcuc

SEQ ID NO: 4038087 - RNA, 22 nt, Molluscum contagiosum virus
ggcgagcaagauggugucgccg

SEQ ID NO: 4038088 - RNA, 23 nt, Molluscum contagiosum virus
ggcgagcgcacgucuacgacauc

SEQ ID NO: 4038089 - RNA, 19 nt, Molluscum contagiosum virus
ggcgagcgccgcucgcacg

SEQ ID NO: 4038090 - RNA, 21 nt, Molluscum contagiosum virus
ggcgcacaacuugggcccgcc

SEQ ID NO: 4038091 - RNA, 20 nt, Molluscum contagiosum virus
ggcgcacgcuuguccgcgga

SEQ ID NO: 4038092 - RNA, 14 nt, Molluscum contagiosum virus
ggcgcagagccugc

SEQ ID NO: 4038093 - RNA, 19 nt, Molluscum contagiosum virus
ggcgcagcuccuagcgcgc

SEQ ID NO: 4038094 - RNA, 20 nt, Molluscum contagiosum virus
ggcgccaaguccgagcaagc

SEQ ID NO: 4038095 - RNA, 14 nt, Molluscum contagiosum virus
ggcgcccgcggaca

SEQ ID NO: 4038096 - RNA, 21 nt, Molluscum contagiosum virus
ggcgcccgugcucgcgggccu

SEQ ID NO: 4038097 - RNA, 17 nt, Molluscum contagiosum virus
ggcgccgaugcagugcg

SEQ ID NO: 4038098 - RNA, 16 nt, Molluscum contagiosum virus
ggcgccgcggcugccu

SEQ ID NO: 4038099 - RNA, 16 nt, Molluscum contagiosum virus
ggcgccgcuaccagcu

SEQ ID NO: 4038100 - RNA, 15 nt, Molluscum contagiosum virus
ggcgccggcucugcc

SEQ ID NO: 4038101 - RNA, 19 nt, Molluscum contagiosum virus
ggcgccuucgucgcgcgcu

SEQ ID NO: 4038102 - RNA, 18 nt, Molluscum contagiosum virus
ggcgcgagaugcucgccg

SEQ ID NO: 4038103 - RNA, 19 nt, Molluscum contagiosum virus
ggcgcgagcgacggcaggc

SEQ ID NO: 4038104 - RNA, 13 nt, Molluscum contagiosum virus
ggcgcgccgcacg

SEQ ID NO: 4038105 - RNA, 20 nt, Molluscum contagiosum virus
ggcgcgccgccggugcgugc

SEQ ID NO: 4038106 - RNA, 15 nt, Molluscum contagiosum virus
ggcgcgccgcgcgcg

SEQ ID NO: 4038107 - RNA, 13 nt, Molluscum contagiosum virus
ggcgcgcgccagc

SEQ ID NO: 4038108 - RNA, 16 nt, Molluscum contagiosum virus
ggcgcgcgccagcagc

SEQ ID NO: 4038109 - RNA, 17 nt, Molluscum contagiosum virus
ggcgcgcgcgcuagccg

SEQ ID NO: 4038110 - RNA, 14 nt, Molluscum contagiosum virus
ggcgcgcgcgcugc

SEQ ID NO: 4038111 - RNA, 18 nt, Molluscum contagiosum virus
ggcgcgcgcgcuggcgug

SEQ ID NO: 4038112 - RNA, 13 nt, Molluscum contagiosum virus
ggcgcgcgcucag

SEQ ID NO: 4038113 - RNA, 18 nt, Molluscum contagiosum virus
ggcgcgcgcugcgcacgu

SEQ ID NO: 4038114 - RNA, 21 nt, Molluscum contagiosum virus
ggcgcgcgucgagggcgccgg

SEQ ID NO: 4038115 - RNA, 19 nt, Molluscum contagiosum virus
ggcgcgcucgcgugcuagg

SEQ ID NO: 4038116 - RNA, 16 nt, Molluscum contagiosum virus
ggcgcgcugugagcgc

SEQ ID NO: 4038117 - RNA, 14 nt, Molluscum contagiosum virus
ggcgcggccucuuu

SEQ ID NO: 4038118 - RNA, 14 nt, Molluscum contagiosum virus
ggcgcggcgagccg

SEQ ID NO: 4038119 - RNA, 14 nt, Molluscum contagiosum virus
ggcgcggcugcucg

SEQ ID NO: 4038120 - RNA, 14 nt, Molluscum contagiosum virus
ggcgcgguccagcc

SEQ ID NO: 4038121 - RNA, 15 nt, Molluscum contagiosum virus
ggcgcgguccagccg

SEQ ID NO: 4038122 - RNA, 14 nt, Molluscum contagiosum virus
ggcgcgugcgagca

SEQ ID NO: 4038123 - RNA, 11 nt, Molluscum contagiosum virus
ggcgcgugcuc

SEQ ID NO: 4038124 - RNA, 18 nt, Molluscum contagiosum virus
ggcgcuagugcagaugag

SEQ ID NO: 4038125 - RNA, 22 nt, Molluscum contagiosum virus
ggcgcuaugccgcgugcucugc

SEQ ID NO: 4038126 - RNA, 20 nt, Molluscum contagiosum virus
ggcgcucgcagcacaugcag

SEQ ID NO: 4038127 - RNA, 12 nt, Molluscum contagiosum virus
ggcgcugucgcg

SEQ ID NO: 4038128 - RNA, 18 nt, Molluscum contagiosum virus
ggcgcuugggcacugcua

SEQ ID NO: 4038129 - RNA, 17 nt, Molluscum contagiosum virus
ggcgcuuucgcccgccg

SEQ ID NO: 4038130 - RNA, 18 nt, Molluscum contagiosum virus
ggcgcuuucgcccgccgc

SEQ ID NO: 4038131 - RNA, 15 nt, Molluscum contagiosum virus
ggcggcaagcccgga

SEQ ID NO: 4038132 - RNA, 17 nt, Molluscum contagiosum virus
ggcggcccgcggcgcgc

SEQ ID NO: 4038133 - RNA, 20 nt, Molluscum contagiosum virus
ggcggccucccucgucgcgc

SEQ ID NO: 4038134 - RNA, 12 nt, Molluscum contagiosum virus
ggcggcgcaagg

SEQ ID NO: 4038135 - RNA, 17 nt, Molluscum contagiosum virus
ggcggcgcaaggacacc

SEQ ID NO: 4038136 - RNA, 12 nt, Molluscum contagiosum virus
ggcggcgcggcu

SEQ ID NO: 4038137 - RNA, 14 nt, Molluscum contagiosum virus
ggcggcgcuggaga

SEQ ID NO: 4038138 - RNA, 13 nt, Molluscum contagiosum virus
ggcggcgucgcgc

SEQ ID NO: 4038139 - RNA, 19 nt, Molluscum contagiosum virus
ggcgguggcggcucugccg

SEQ ID NO: 4038140 - RNA, 15 nt, Molluscum contagiosum virus
ggcggugggcgccgc

SEQ ID NO: 4038141 - RNA, 17 nt, Molluscum contagiosum virus
ggcguccggcgcuugcc

SEQ ID NO: 4038142 - RNA, 16 nt, Molluscum contagiosum virus
ggcgucgcgcacagaa

SEQ ID NO: 4038143 - RNA, 19 nt, Molluscum contagiosum virus
ggcgugcauuuuuccgcuu

SEQ ID NO: 4038144 - RNA, 22 nt, Molluscum contagiosum virus
ggcgugcgccgugcgucucucu

SEQ ID NO: 4038145 - RNA, 13 nt, Molluscum contagiosum virus
ggcgugcucacgc

SEQ ID NO: 4038146 - RNA, 12 nt, Molluscum contagiosum virus
ggcgugcucagc

SEQ ID NO: 4038147 - RNA, 11 nt, Molluscum contagiosum virus
ggcgugcucgc

SEQ ID NO: 4038148 - RNA, 19 nt, Molluscum contagiosum virus
ggcguguccgcgggcgcgc

SEQ ID NO: 4038149 - RNA, 21 nt, Molluscum contagiosum virus
ggcgugugcgcgagcugaggc

SEQ ID NO: 4038150 - RNA, 19 nt, Molluscum contagiosum virus
ggcguguuccggcagcgcc

SEQ ID NO: 4038151 - RNA, 13 nt, Molluscum contagiosum virus
ggcucacagccgu

SEQ ID NO: 4038152 - RNA, 20 nt, Molluscum contagiosum virus
ggcucacagccguggagucc

SEQ ID NO: 4038153 - RNA, 23 nt, Molluscum contagiosum virus
ggcuccgaaccccucgugcuggg

SEQ ID NO: 4038154 - RNA, 18 nt, Molluscum contagiosum virus
ggcuccggcuuggacucc

SEQ ID NO: 4038155 - RNA, 20 nt, Molluscum contagiosum virus
ggcuccuacaucgacaagca

SEQ ID NO: 4038156 - RNA, 13 nt, Molluscum contagiosum virus
ggcucgccaugcu

SEQ ID NO: 4038157 - RNA, 16 nt, Molluscum contagiosum virus
ggcucgcgagugugca

SEQ ID NO: 4038158 - RNA, 20 nt, Molluscum contagiosum virus
ggcucgcgcacuacucgucu

SEQ ID NO: 4038159 - RNA, 14 nt, Molluscum contagiosum virus
ggcucguacugcug

SEQ ID NO: 4038160 - RNA, 20 nt, Molluscum contagiosum virus
ggcucguccucgggcgccaa

SEQ ID NO: 4038161 - RNA, 16 nt, Molluscum contagiosum virus
ggcucgugcuggagca

SEQ ID NO: 4038162 - RNA, 19 nt, Molluscum contagiosum virus
ggcucugugcggacaugcc

SEQ ID NO: 4038163 - RNA, 22 nt, Molluscum contagiosum virus
ggcucuguucugcuuggacgac

SEQ ID NO: 4038164 - RNA, 13 nt, Molluscum contagiosum virus
ggcugcagcccuu

SEQ ID NO: 4038165 - RNA, 21 nt, Molluscum contagiosum virus
ggcugcccuguuacggacggc

SEQ ID NO: 4038166 - RNA, 23 nt, Molluscum contagiosum virus
ggcugcucgcugccuggugcaca

SEQ ID NO: 4038167 - RNA, 18 nt, Molluscum contagiosum virus
ggcugcucuccgaagaag

SEQ ID NO: 4038168 - RNA, 18 nt, Molluscum contagiosum virus
ggcugggaaagggcugcu

SEQ ID NO: 4038169 - RNA, 16 nt, Molluscum contagiosum virus
ggcuugccccgcgcgu

SEQ ID NO: 4038170 - RNA, 18 nt, Molluscum contagiosum virus
ggcuuuauuuccggcucc

SEQ ID NO: 4038171 - RNA, 12 nt, Molluscum contagiosum virus
ggcuuugacaug

SEQ ID NO: 4038172 - RNA, 15 nt, Molluscum contagiosum virus
ggcuuugacaugcac

SEQ ID NO: 4038173 - RNA, 16 nt, Molluscum contagiosum virus
ggcuuugacaugcacc

SEQ ID NO: 4038174 - RNA, 18 nt, Molluscum contagiosum virus
gggaaagaugaagcucuc

SEQ ID NO: 4038175 - RNA, 13 nt, Molluscum contagiosum virus
gggaacgaggaaa

SEQ ID NO: 4038176 - RNA, 12 nt, Molluscum contagiosum virus
gggaagcacagu

SEQ ID NO: 4038177 - RNA, 19 nt, Molluscum contagiosum virus
gggaagcacguagcucgcg

SEQ ID NO: 4038178 - RNA, 18 nt, Molluscum contagiosum virus
gggagcauguccgacucc

SEQ ID NO: 4038179 - RNA, 13 nt, Molluscum contagiosum virus
gggaucuugcgug

SEQ ID NO: 4038180 - RNA, 14 nt, Molluscum contagiosum virus
gggcaacgcgcgcg

SEQ ID NO: 4038181 - RNA, 18 nt, Molluscum contagiosum virus
gggcaccugcaucgcgcc

SEQ ID NO: 4038182 - RNA, 18 nt, Molluscum contagiosum virus
gggcacgcccgcgguguc

SEQ ID NO: 4038183 - RNA, 15 nt, Molluscum contagiosum virus
gggcacgccgugggc

SEQ ID NO: 4038184 - RNA, 13 nt, Molluscum contagiosum virus
gggcacgcgcgcg

SEQ ID NO: 4038185 - RNA, 23 nt, Molluscum contagiosum virus
gggcacgcucauacuccugcugg

SEQ ID NO: 4038186 - RNA, 21 nt, Molluscum contagiosum virus
gggcagccgcuggacgccucg

SEQ ID NO: 4038187 - RNA, 17 nt, Molluscum contagiosum virus
gggcagcucaagcugcu

SEQ ID NO: 4038188 - RNA, 14 nt, Molluscum contagiosum virus
gcgcacggcuaggc

SEQ ID NO: 4038189 - RNA, 18 nt, Molluscum contagiosum virus
gcgcacgggccugcgcgc

SEQ ID NO: 4038190 - RNA, 13 nt, Molluscum contagiosum virus
gcgcacugcggga

SEQ ID NO: 4038191 - RNA, 15 nt, Molluscum contagiosum virus
gcgcagagcuccccg

SEQ ID NO: 4038192 - RNA, 23 nt, Molluscum contagiosum virus
gcgcagagcuccccgcgcgcagc

SEQ ID NO: 4038193 - RNA, 14 nt, Molluscum contagiosum virus
gcgcaggccgcgcc

SEQ ID NO: 4038194 - RNA, 16 nt, Molluscum contagiosum virus
gcgcaggccgcgcccg

SEQ ID NO: 4038195 - RNA, 14 nt, Molluscum contagiosum virus
gcgcagucccagca

SEQ ID NO: 4038196 - RNA, 18 nt, Molluscum contagiosum virus
gcgcagugcggccagcac

SEQ ID NO: 4038197 - RNA, 13 nt, Molluscum contagiosum virus
gcgcagugcugcg

SEQ ID NO: 4038198 - RNA, 19 nt, Molluscum contagiosum virus
gcgcaguucgagcugcugc

SEQ ID NO: 4038199 - RNA, 20 nt, Molluscum contagiosum virus
gcgcauacgcgccgcgcgcu

SEQ ID NO: 4038200 - RNA, 20 nt, Molluscum contagiosum virus
gacgcgugcaagcccagcag

SEQ ID NO: 4038201 - RNA, 18 nt, Molluscum contagiosum virus
gacgcguucuagcagcgu

SEQ ID NO: 4038202 - RNA, 21 nt, Molluscum contagiosum virus
gacgcguucuagcagcgugcg

SEQ ID NO: 4038203 - RNA, 17 nt, Molluscum contagiosum virus
gacgcucgggccggcgc

SEQ ID NO: 4038204 - RNA, 22 nt, Molluscum contagiosum virus
gacgcugccggcaacgcugccg

SEQ ID NO: 4038205 - RNA, 15 nt, Molluscum contagiosum virus
gacggaacgagccug

SEQ ID NO: 4038206 - RNA, 16 nt, Molluscum contagiosum virus
gacggagacagugaca

SEQ ID NO: 4038207 - RNA, 19 nt, Molluscum contagiosum virus
gacggcaccguaccgcgcc

SEQ ID NO: 4038208 - RNA, 16 nt, Molluscum contagiosum virus
gacggcacgggcacgc

SEQ ID NO: 4038209 - RNA, 11 nt, Molluscum contagiosum virus
gacggcaggcc

SEQ ID NO: 4038210 - RNA, 17 nt, Molluscum contagiosum virus
gacggccguuuuuggga

SEQ ID NO: 4038211 - RNA, 13 nt, Molluscum contagiosum virus
gacggcgcgcagc

SEQ ID NO: 4038212 - RNA, 14 nt, Molluscum contagiosum virus
gacggcgcgggcgc

SEQ ID NO: 4038213 - RNA, 14 nt, Molluscum contagiosum virus
gacggcuaaagaga

SEQ ID NO: 4038214 - RNA, 14 nt, Molluscum contagiosum virus
gacgggcacgagca

SEQ ID NO: 4038215 - RNA, 17 nt, Molluscum contagiosum virus
gacgggccgccgcccgc

SEQ ID NO: 4038216 - RNA, 22 nt, Molluscum contagiosum virus
gacgggcgcagccacgacucgc

SEQ ID NO: 4038217 - RNA, 17 nt, Molluscum contagiosum virus
gacggugcugcgcacgg

SEQ ID NO: 4038218 - RNA, 23 nt, Molluscum contagiosum virus
gacgucaaccgggcucucgcgga

SEQ ID NO: 4038219 - RNA, 22 nt, Molluscum contagiosum virus
gacguccacaaagcccuccuga

SEQ ID NO: 4038220 - RNA, 21 nt, Molluscum contagiosum virus
gacgugaucguuccuggccaa

SEQ ID NO: 4038221 - RNA, 16 nt, Molluscum contagiosum virus
gacgugcugcugcaga

SEQ ID NO: 4038222 - RNA, 14 nt, Molluscum contagiosum virus
gacgugcugcuggc

SEQ ID NO: 4038223 - RNA, 17 nt, Molluscum contagiosum virus
gacguggugcucgugga

SEQ ID NO: 4038224 - RNA, 21 nt, Molluscum contagiosum virus
gacuaccuggcggcgcuggag

SEQ ID NO: 4038225 - RNA, 17 nt, Molluscum contagiosum virus
gacuacgcgcugcuaga

SEQ ID NO: 4038226 - RNA, 14 nt, Molluscum contagiosum virus
gacuagccugugcc

SEQ ID NO: 4038227 - RNA, 15 nt, Molluscum contagiosum virus
gacuagccugugccc

SEQ ID NO: 4038228 - RNA, 17 nt, Molluscum contagiosum virus
gacuagccugugcccug

SEQ ID NO: 4038229 - RNA, 19 nt, Molluscum contagiosum virus
gacuaugcgucuuccugcu

SEQ ID NO: 4038230 - RNA, 21 nt, Molluscum contagiosum virus
gacucgagcgagcuacgcgcu

SEQ ID NO: 4038231 - RNA, 17 nt, Molluscum contagiosum virus
gacucggaugcgcugcc

SEQ ID NO: 4038232 - RNA, 15 nt, Molluscum contagiosum virus
gacucuggaagccuu

SEQ ID NO: 4038233 - RNA, 13 nt, Molluscum contagiosum virus
gacugcgcccgug

SEQ ID NO: 4038234 - RNA, 14 nt, Molluscum contagiosum virus
gacuggcaccugcg

SEQ ID NO: 4038235 - RNA, 15 nt, Molluscum contagiosum virus
gacuuacggacgccc

SEQ ID NO: 4038236 - RNA, 15 nt, Molluscum contagiosum virus
gacuuccgacgggcc

SEQ ID NO: 4038237 - RNA, 18 nt, Molluscum contagiosum virus
gacuucuccgaccgugcc

SEQ ID NO: 4038238 - RNA, 13 nt, Molluscum contagiosum virus
gacuugcugcgga

SEQ ID NO: 4038239 - RNA, 20 nt, Molluscum contagiosum virus
gacuugcugcggagcgccuu

SEQ ID NO: 4038240 - RNA, 12 nt, Molluscum contagiosum virus
gagaaaggcacc

SEQ ID NO: 4038241 - RNA, 16 nt, Molluscum contagiosum virus
gagaaaggcacccacc

SEQ ID NO: 4038242 - RNA, 18 nt, Molluscum contagiosum virus
gagaacucgcgugccuug

SEQ ID NO: 4038243 - RNA, 21 nt, Molluscum contagiosum virus
gagaagcuuuaguccaugccg

SEQ ID NO: 4038244 - RNA, 15 nt, Molluscum contagiosum virus
gagacaggggggaga

SEQ ID NO: 4038245 - RNA, 18 nt, Molluscum contagiosum virus
gagaccagccgcgagcgc

SEQ ID NO: 4038246 - RNA, 12 nt, Molluscum contagiosum virus
gagacggcagug

SEQ ID NO: 4038247 - RNA, 17 nt, Molluscum contagiosum virus
gagacuaccggcaguag

SEQ ID NO: 4038248 - RNA, 13 nt, Molluscum contagiosum virus
gagacucuggaag

SEQ ID NO: 4038249 - RNA, 18 nt, Molluscum contagiosum virus
gagacuuccuugcgcagg

SEQ ID NO: 4038250 - RNA, 14 nt, Molluscum contagiosum virus
gagacuugugccca

SEQ ID NO: 4038251 - RNA, 17 nt, Molluscum contagiosum virus
gagagacagcacggcac

SEQ ID NO: 4038252 - RNA, 20 nt, Molluscum contagiosum virus
gagagccuucgucauccucg

SEQ ID NO: 4038253 - RNA, 17 nt, Molluscum contagiosum virus
gagagcgcgcggcgccg

SEQ ID NO: 4038254 - RNA, 19 nt, Molluscum contagiosum virus
gagagcguacucgggccgc

SEQ ID NO: 4038255 - RNA, 17 nt, Molluscum contagiosum virus
gagaggaaaggcgcacc

SEQ ID NO: 4038256 - RNA, 16 nt, Molluscum contagiosum virus
gagagugacgccucga

SEQ ID NO: 4038257 - RNA, 19 nt, Molluscum contagiosum virus
gagaucaacgcgcgcgugc

SEQ ID NO: 4038258 - RNA, 19 nt, Molluscum contagiosum virus
gagaugacgggcacgcuca

SEQ ID NO: 4038259 - RNA, 19 nt, Molluscum contagiosum virus
gagaugcgguccgacucgg

SEQ ID NO: 4038260 - RNA, 20 nt, Molluscum contagiosum virus
gagaugcgguccgacucggu

SEQ ID NO: 4038261 - RNA, 23 nt, Molluscum contagiosum virus
gagauggcugcucucggcagcgu

SEQ ID NO: 4038262 - RNA, 23 nt, Molluscum contagiosum virus
gagaugggcccgcgcgcgcagcg

SEQ ID NO: 4038263 - RNA, 16 nt, Molluscum contagiosum virus
gagcaauggcggccug

SEQ ID NO: 4038264 - RNA, 23 nt, Molluscum contagiosum virus
gagcacaaagagacgcggccgcg

SEQ ID NO: 4038265 - RNA, 21 nt, Molluscum contagiosum virus
gagcaccaagaagcggcccug

SEQ ID NO: 4038266 - RNA, 20 nt, Molluscum contagiosum virus
gagcacgccugcacgcgcac

SEQ ID NO: 4038267 - RNA, 17 nt, Molluscum contagiosum virus
gagcacgcgcucgcgca

SEQ ID NO: 4038268 - RNA, 22 nt, Molluscum contagiosum virus
gagcacgcuuuccuuugcggcg

SEQ ID NO: 4038269 - RNA, 18 nt, Molluscum contagiosum virus
gagcacguggacagcauc

SEQ ID NO: 4038270 - RNA, 21 nt, Molluscum contagiosum virus
gagcacugcgcgucugugcgc

SEQ ID NO: 4038271 - RNA, 20 nt, Molluscum contagiosum virus
gagcacuggcuggcguucga

SEQ ID NO: 4038272 - RNA, 12 nt, Molluscum contagiosum virus
gagcagcugcug

SEQ ID NO: 4038273 - RNA, 22 nt, Molluscum contagiosum virus
gagcagcugcugcgcuucgccg

SEQ ID NO: 4038274 - RNA, 21 nt, Molluscum contagiosum virus
gagcaggacgacgacacagcc

SEQ ID NO: 4038275 - RNA, 18 nt, Molluscum contagiosum virus
gagcaggcgcagcgcggc

SEQ ID NO: 4038276 - RNA, 15 nt, Molluscum contagiosum virus
gagcagggcuacgag

SEQ ID NO: 4038277 - RNA, 20 nt, Molluscum contagiosum virus
gagcaggguuuucacgcagg

SEQ ID NO: 4038278 - RNA, 16 nt, Molluscum contagiosum virus
gagcaguucgcgcgcc

SEQ ID NO: 4038279 - RNA, 20 nt, Molluscum contagiosum virus
gagcauguugucgaagaaca

SEQ ID NO: 4038280 - RNA, 19 nt, Molluscum contagiosum virus
gagccauucuuaauccagu

SEQ ID NO: 4038281 - RNA, 16 nt, Molluscum contagiosum virus
gagcccgaccccaaga

SEQ ID NO: 4038282 - RNA, 22 nt, Molluscum contagiosum virus
gagcccgaucuugaaugucgcg

SEQ ID NO: 4038283 - RNA, 13 nt, Molluscum contagiosum virus
gagcccgcggcgc

SEQ ID NO: 4038284 - RNA, 18 nt, Molluscum contagiosum virus
gagcccggaucagccccg

SEQ ID NO: 4038285 - RNA, 12 nt, Molluscum contagiosum virus
gagccgcccgcg

SEQ ID NO: 4038286 - RNA, 14 nt, Molluscum contagiosum virus
gagccgcccgcgga

SEQ ID NO: 4038287 - RNA, 14 nt, Molluscum contagiosum virus
gagccugccgcgag

SEQ ID NO: 4038288 - RNA, 20 nt, Molluscum contagiosum virus
gagcgaaccgcggcagccuu

SEQ ID NO: 4038289 - RNA, 18 nt, Molluscum contagiosum virus
gagcgacauagcgcacca

SEQ ID NO: 4038290 - RNA, 14 nt, Molluscum contagiosum virus
gagcgagcacgcca

SEQ ID NO: 4038291 - RNA, 15 nt, Molluscum contagiosum virus
gagcgagugccgagc

SEQ ID NO: 4038292 - RNA, 16 nt, Molluscum contagiosum virus
gagcgcgcgcacgcga

SEQ ID NO: 4038293 - RNA, 18 nt, Molluscum contagiosum virus
gagcgcgcgccugcuggc

SEQ ID NO: 4038294 - RNA, 15 nt, Molluscum contagiosum virus
gagcgcggcaacagc

SEQ ID NO: 4038295 - RNA, 13 nt, Molluscum contagiosum virus
gagcgcugccgcu

SEQ ID NO: 4038296 - RNA, 14 nt, Molluscum contagiosum virus
gagcggagcuggcc

SEQ ID NO: 4038297 - RNA, 20 nt, Molluscum contagiosum virus
gagcggcgacuugcugcgga

SEQ ID NO: 4038298 - RNA, 14 nt, Molluscum contagiosum virus
gagcggcgcgcgcu

SEQ ID NO: 4038299 - RNA, 15 nt, Molluscum contagiosum virus
gagcgugucagcagc

SEQ ID NO: 4038300 - RNA, 18 nt, Molluscum contagiosum virus
gagcucacgccggaccag

SEQ ID NO: 4038301 - RNA, 22 nt, Molluscum contagiosum virus
gagcucacgccggaccagaucc

SEQ ID NO: 4038302 - RNA, 22 nt, Molluscum contagiosum virus
gagcucgacugcguugucuccu

SEQ ID NO: 4038303 - RNA, 15 nt, Molluscum contagiosum virus
gagcucgccuccuug

SEQ ID NO: 4038304 - RNA, 13 nt, Molluscum contagiosum virus
gagcucgcgcgca

SEQ ID NO: 4038305 - RNA, 23 nt, Molluscum contagiosum virus
gagcucgcgcgccagcacgcgcu

SEQ ID NO: 4038306 - RNA, 14 nt, Molluscum contagiosum virus
gagcugccauggca

SEQ ID NO: 4038307 - RNA, 14 nt, Molluscum contagiosum virus
gagcugcgugugcc

SEQ ID NO: 4038308 - RNA, 17 nt, Molluscum contagiosum virus
gagcugcugcccgccuu

SEQ ID NO: 4038309 - RNA, 20 nt, Molluscum contagiosum virus
gagcugcugcccgccuucga

SEQ ID NO: 4038310 - RNA, 23 nt, Molluscum contagiosum virus
gagcugcugcgcgaguaccuggg

SEQ ID NO: 4038311 - RNA, 23 nt, Molluscum contagiosum virus
gagcugggauaacaggcgugcgc

SEQ ID NO: 4038312 - RNA, 16 nt, Molluscum contagiosum virus
gagcugugcgagccag

SEQ ID NO: 4038313 - RNA, 16 nt, Molluscum contagiosum virus
gagcuucgucuucacc

SEQ ID NO: 4038314 - RNA, 20 nt, Molluscum contagiosum virus
gagcuucgucuucaccugca

SEQ ID NO: 4038315 - RNA, 15 nt, Molluscum contagiosum virus
gagcuugcgcacgcc

SEQ ID NO: 4038316 - RNA, 16 nt, Molluscum contagiosum virus
gaggaaaggcacaccc

SEQ ID NO: 4038317 - RNA, 14 nt, Molluscum contagiosum virus
gaggaaaggcgcac

SEQ ID NO: 4038318 - RNA, 13 nt, Molluscum contagiosum virus
gaggacacgcgca

SEQ ID NO: 4038319 - RNA, 17 nt, Molluscum contagiosum virus
gaggaccacgccgacca

SEQ ID NO: 4038320 - RNA, 12 nt, Molluscum contagiosum virus
gaggacgcgggc

SEQ ID NO: 4038321 - RNA, 17 nt, Molluscum contagiosum virus
gaggacggcgcgggcgc

SEQ ID NO: 4038322 - RNA, 14 nt, Molluscum contagiosum virus
gaggacuaccuggc

SEQ ID NO: 4038323 - RNA, 14 nt, Molluscum contagiosum virus
gaggagagcggcgc

SEQ ID NO: 4038324 - RNA, 16 nt, Molluscum contagiosum virus
gaggaggcaagcgggc

SEQ ID NO: 4038325 - RNA, 16 nt, Molluscum contagiosum virus
gaggaggcgcccucgc

SEQ ID NO: 4038326 - RNA, 16 nt, Molluscum contagiosum virus
gaggcccugcuugccc

SEQ ID NO: 4038327 - RNA, 18 nt, Molluscum contagiosum virus
gaggcgcgcacgcugcgc

SEQ ID NO: 4038328 - RNA, 21 nt, Molluscum contagiosum virus
gaggcgcguccgcggccggga

SEQ ID NO: 4038329 - RNA, 17 nt, Molluscum contagiosum virus
gagggccuuggcggcgc

SEQ ID NO: 4038330 - RNA, 21 nt, Molluscum contagiosum virus
gagggcgaguccccgagcagc

SEQ ID NO: 4038331 - RNA, 22 nt, Molluscum contagiosum virus
gagggcgagucucccguggcgc

SEQ ID NO: 4038332 - RNA, 15 nt, Molluscum contagiosum virus
gagggcgccgggcgc

SEQ ID NO: 4038333 - RNA, 23 nt, Molluscum contagiosum virus
gagggcgggcacgugcugcugcg

SEQ ID NO: 4038334 - RNA, 20 nt, Molluscum contagiosum virus
gaggggaaagaugaagcucu

SEQ ID NO: 4038335 - RNA, 20 nt, Molluscum contagiosum virus
gaggguggcuugcugcagua

SEQ ID NO: 4038336 - RNA, 15 nt, Molluscum contagiosum virus
gagguggcacccugg

SEQ ID NO: 4038337 - RNA, 11 nt, Molluscum contagiosum virus
gagguggccaa

SEQ ID NO: 4038338 - RNA, 12 nt, Molluscum contagiosum virus
gaggugugccug

SEQ ID NO: 4038339 - RNA, 15 nt, Molluscum contagiosum virus
gagguucuccagaau

SEQ ID NO: 4038340 - RNA, 18 nt, Molluscum contagiosum virus
gaguacgacgcggagguc

SEQ ID NO: 4038341 - RNA, 19 nt, Molluscum contagiosum virus
gaguauacucgacgcgcgc

SEQ ID NO: 4038342 - RNA, 12 nt, Molluscum contagiosum virus
gagucacgaccg

SEQ ID NO: 4038343 - RNA, 17 nt, Molluscum contagiosum virus
gaguccacugccaaagc

SEQ ID NO: 4038344 - RNA, 10 nt, Molluscum contagiosum virus
gaguccgcgc

SEQ ID NO: 4038345 - RNA, 13 nt, Molluscum contagiosum virus
gaguccgcggcga

SEQ ID NO: 4038346 - RNA, 19 nt, Molluscum contagiosum virus
gagucgccgcugcgcaucu

SEQ ID NO: 4038347 - RNA, 11 nt, Molluscum contagiosum virus
gagucgcgccu

SEQ ID NO: 4038348 - RNA, 13 nt, Molluscum contagiosum virus
gaguggcucacag

SEQ ID NO: 4038349 - RNA, 21 nt, Molluscum contagiosum virus
gagugucucgaaccgaggccg

SEQ ID NO: 4038350 - RNA, 17 nt, Molluscum contagiosum virus
gauaaaguccucugaag

SEQ ID NO: 4038351 - RNA, 20 nt, Molluscum contagiosum virus
gauacacauugcgugugggg

SEQ ID NO: 4038352 - RNA, 22 nt, Molluscum contagiosum virus
gauagcgauggcuguuccggcg

SEQ ID NO: 4038353 - RNA, 22 nt, Molluscum contagiosum virus
gaucccuucgcguccacgggua

SEQ ID NO: 4038354 - RNA, 21 nt, Molluscum contagiosum virus
gaucugcucgcagucgucgcc

SEQ ID NO: 4038355 - RNA, 20 nt, Molluscum contagiosum virus
gaugaguaccgcgggcgcag

SEQ ID NO: 4038356 - RNA, 22 nt, Molluscum contagiosum virus
gaugcagugcggaugugcuagc

SEQ ID NO: 4038357 - RNA, 20 nt, Molluscum contagiosum virus
gaugccgugguacacguaga

SEQ ID NO: 4038358 - RNA, 14 nt, Molluscum contagiosum virus
gaugcgcagcgucc

SEQ ID NO: 4038359 - RNA, 13 nt, Molluscum contagiosum virus
gaugcgcaugcgg

SEQ ID NO: 4038360 - RNA, 23 nt, Molluscum contagiosum virus
gaugcgguccgacucggugcuca

SEQ ID NO: 4038361 - RNA, 16 nt, Molluscum contagiosum virus
gaugcuagcgugugcc

SEQ ID NO: 4038362 - RNA, 18 nt, Molluscum contagiosum virus
gccugcacuacugcucca

SEQ ID NO: 4038363 - RNA, 15 nt, Molluscum contagiosum virus
gccugccagcagagc

SEQ ID NO: 4038364 - RNA, 23 nt, Molluscum contagiosum virus
gccugccagcgccagccugcugg

SEQ ID NO: 4038365 - RNA, 14 nt, Molluscum contagiosum virus
gccugcccgugugc

SEQ ID NO: 4038366 - RNA, 15 nt, Molluscum contagiosum virus
gccugccgcgagcac

SEQ ID NO: 4038367 - RNA, 18 nt, Molluscum contagiosum virus
gccugccgcgcaugcugg

SEQ ID NO: 4038368 - RNA, 20 nt, Molluscum contagiosum virus
gccugccgcgcaugcuggag

SEQ ID NO: 4038369 - RNA, 22 nt, Molluscum contagiosum virus
gccugccgcgcaugcuggagac

SEQ ID NO: 4038370 - RNA, 16 nt, Molluscum contagiosum virus
gccugcgcgagcaagc

SEQ ID NO: 4038371 - RNA, 16 nt, Molluscum contagiosum virus
gccugcucucgaagca

SEQ ID NO: 4038372 - RNA, 20 nt, Molluscum contagiosum virus
gccugcugggagcuugcacg

SEQ ID NO: 4038373 - RNA, 20 nt, Molluscum contagiosum virus
gccuggagggcagugccaag

SEQ ID NO: 4038374 - RNA, 16 nt, Molluscum contagiosum virus
gccuggcaugcuugag

SEQ ID NO: 4038375 - RNA, 19 nt, Molluscum contagiosum virus
gccuggccgaacugcucug

SEQ ID NO: 4038376 - RNA, 12 nt, Molluscum contagiosum virus
gccuggcuugcg

SEQ ID NO: 4038377 - RNA, 19 nt, Molluscum contagiosum virus
gccuggucacagacacgcu

SEQ ID NO: 4038378 - RNA, 16 nt, Molluscum contagiosum virus
gccugugccugcaaga

SEQ ID NO: 4038379 - RNA, 13 nt, Molluscum contagiosum virus
gccugugcuggcg

SEQ ID NO: 4038380 - RNA, 13 nt, Molluscum contagiosum virus
gccuuccugcgcc

SEQ ID NO: 4038381 - RNA, 13 nt, Molluscum contagiosum virus
gccuucucggugu

SEQ ID NO: 4038382 - RNA, 17 nt, Molluscum contagiosum virus
gccuugagcgcgccgcg

SEQ ID NO: 4038383 - RNA, 22 nt, Molluscum contagiosum virus
gccuuuguucuuagcagcgccg

SEQ ID NO: 4038384 - RNA, 13 nt, Molluscum contagiosum virus
gcgaaagaacacg

SEQ ID NO: 4038385 - RNA, 15 nt, Molluscum contagiosum virus
gcgaacgagggacac

SEQ ID NO: 4038386 - RNA, 17 nt, Molluscum contagiosum virus
gcgaacgccagaaaaca

SEQ ID NO: 4038387 - RNA, 16 nt, Molluscum contagiosum virus
gcgaacgugcgaacac

SEQ ID NO: 4038388 - RNA, 16 nt, Molluscum contagiosum virus
gcgaagagccccacca

SEQ ID NO: 4038389 - RNA, 16 nt, Molluscum contagiosum virus
gcgaaguccugggcga

SEQ ID NO: 4038390 - RNA, 16 nt, Molluscum contagiosum virus
gcgaccagcucuuggc

SEQ ID NO: 4038391 - RNA, 23 nt, Molluscum contagiosum virus
gcgaccagcucuuggcgggcacc

SEQ ID NO: 4038392 - RNA, 21 nt, Molluscum contagiosum virus
gcgaccaguacaucaccgcca

SEQ ID NO: 4038393 - RNA, 13 nt, Molluscum contagiosum virus
gcgacccagaagc

SEQ ID NO: 4038394 - RNA, 15 nt, Molluscum contagiosum virus
gcgaccgcgaacugc

SEQ ID NO: 4038395 - RNA, 16 nt, Molluscum contagiosum virus
gcgaccuacuccuggc

SEQ ID NO: 4038396 - RNA, 19 nt, Molluscum contagiosum virus
gcgaccuacuccuggccaa

SEQ ID NO: 4038397 - RNA, 15 nt, Molluscum contagiosum virus
gcgacgacgagcacu

SEQ ID NO: 4038398 - RNA, 16 nt, Molluscum contagiosum virus
gcgacgacgagcacua

SEQ ID NO: 4038399 - RNA, 20 nt, Molluscum contagiosum virus
gcgacgccauuuucgugcgc

SEQ ID NO: 4038400 - RNA, 15 nt, Molluscum contagiosum virus
gcgacgccccggcgc

SEQ ID NO: 4038401 - RNA, 16 nt, Molluscum contagiosum virus
gcgacggugugccgcu

SEQ ID NO: 4038402 - RNA, 19 nt, Molluscum contagiosum virus
gcgacgugaagacgcuggc

SEQ ID NO: 4038403 - RNA, 14 nt, Molluscum contagiosum virus
gcgacuacaccugg

SEQ ID NO: 4038404 - RNA, 16 nt, Molluscum contagiosum virus
gcgacuccaucugcgc

SEQ ID NO: 4038405 - RNA, 21 nt, Molluscum contagiosum virus
gcgacuccaucugcgcgacgc

SEQ ID NO: 4038406 - RNA, 19 nt, Molluscum contagiosum virus
gcgacuggcacgcgccgcg

SEQ ID NO: 4038407 - RNA, 14 nt, Molluscum contagiosum virus
gcgacuuggggcuc

SEQ ID NO: 4038408 - RNA, 20 nt, Molluscum contagiosum virus
gcgacuuuguccugagccuu

SEQ ID NO: 4038409 - RNA, 21 nt, Molluscum contagiosum virus
gcgagaccaucccggugauga

SEQ ID NO: 4038410 - RNA, 17 nt, Molluscum contagiosum virus
gcgagaccgcuagagug

SEQ ID NO: 4038411 - RNA, 14 nt, Molluscum contagiosum virus
gcgagagcgcgcgc

SEQ ID NO: 4038412 - RNA, 20 nt, Molluscum contagiosum virus
gcgagcaagcgcccgcgagc

SEQ ID NO: 4038413 - RNA, 14 nt, Molluscum contagiosum virus
gcgagcacgggcgc

SEQ ID NO: 4038414 - RNA, 22 nt, Molluscum contagiosum virus
gcgagcacugcgcgcgcggcgc

SEQ ID NO: 4038415 - RNA, 16 nt, Molluscum contagiosum virus
gcgagccagccaggcg

SEQ ID NO: 4038416 - RNA, 16 nt, Molluscum contagiosum virus
gcgagcgacggcaggc

SEQ ID NO: 4038417 - RNA, 15 nt, Molluscum contagiosum virus
gcgagcgcgcgcugc

SEQ ID NO: 4038418 - RNA, 15 nt, Molluscum contagiosum virus
gcgagcgcgucugcu

SEQ ID NO: 4038419 - RNA, 20 nt, Molluscum contagiosum virus
gcgagcggcuuuucgccgga

SEQ ID NO: 4038420 - RNA, 17 nt, Molluscum contagiosum virus
gcgagcguuucugccgg

SEQ ID NO: 4038421 - RNA, 17 nt, Molluscum contagiosum virus
gcgaggacaacucgcgg

SEQ ID NO: 4038422 - RNA, 13 nt, Molluscum contagiosum virus
gcgaggcgcgcac

SEQ ID NO: 4038423 - RNA, 23 nt, Molluscum contagiosum virus
gcgagggcgaguccccgagcagc

SEQ ID NO: 4038424 - RNA, 18 nt, Molluscum contagiosum virus
gcgaguccccgagcagcg

SEQ ID NO: 4038425 - RNA, 18 nt, Molluscum contagiosum virus
gcgagucucccguggcgc

SEQ ID NO: 4038426 - RNA, 19 nt, Molluscum contagiosum virus
gcgagucucccguggcgcg

SEQ ID NO: 4038427 - RNA, 19 nt, Molluscum contagiosum virus
gcgaucacaaguccgcggc

SEQ ID NO: 4038428 - RNA, 21 nt, Molluscum contagiosum virus
gcgauccuugcguacuuggaa

SEQ ID NO: 4038429 - RNA, 19 nt, Molluscum contagiosum virus
gcgaucgcggccaugcgcu

SEQ ID NO: 4038430 - RNA, 17 nt, Molluscum contagiosum virus
gcgauugccccugggcu

SEQ ID NO: 4038431 - RNA, 13 nt, Molluscum contagiosum virus
gcgcaaaagcaca

SEQ ID NO: 4038432 - RNA, 14 nt, Molluscum contagiosum virus
gcgcaacacggccu

SEQ ID NO: 4038433 - RNA, 15 nt, Molluscum contagiosum virus
gcgcaaccagcuggc

SEQ ID NO: 4038434 - RNA, 17 nt, Molluscum contagiosum virus
gcgcaacgagcagcccg

SEQ ID NO: 4038435 - RNA, 18 nt, Molluscum contagiosum virus
gcgcaacgagcagcccgu

SEQ ID NO: 4038436 - RNA, 16 nt, Molluscum contagiosum virus
gcgcaacgcgggccag

SEQ ID NO: 4038437 - RNA, 17 nt, Molluscum contagiosum virus
gcgcaacgcgggccagg

SEQ ID NO: 4038438 - RNA, 12 nt, Molluscum contagiosum virus
gcgcaacgugcu

SEQ ID NO: 4038439 - RNA, 15 nt, Molluscum contagiosum virus
gcgcaagagccgccg

SEQ ID NO: 4038440 - RNA, 21 nt, Molluscum contagiosum virus
gcgcaagcagcucggcgagag

SEQ ID NO: 4038441 - RNA, 19 nt, Molluscum contagiosum virus
gcgcaagcauggucuucgc

SEQ ID NO: 4038442 - RNA, 19 nt, Molluscum contagiosum virus
gcgcaaggacaccgcgggc

SEQ ID NO: 4038443 - RNA, 15 nt, Molluscum contagiosum virus
gcgcaaggccgcgcc

SEQ ID NO: 4038444 - RNA, 17 nt, Molluscum contagiosum virus
gcgcaagucaccgcucc

SEQ ID NO: 4038445 - RNA, 18 nt, Molluscum contagiosum virus
gcgcaagucaccgcuccg

SEQ ID NO: 4038446 - RNA, 13 nt, Molluscum contagiosum virus
gcgcaagugcgug

SEQ ID NO: 4038447 - RNA, 23 nt, Molluscum contagiosum virus
gcgcaagugggcgucgaccugga

SEQ ID NO: 4038448 - RNA, 12 nt, Molluscum contagiosum virus
gcgcaagugugc

SEQ ID NO: 4038449 - RNA, 17 nt, Molluscum contagiosum virus
gcgcaauacugcgggcu

SEQ ID NO: 4038450 - RNA, 14 nt, Molluscum contagiosum virus
gcgcacaacuuggg

SEQ ID NO: 4038451 - RNA, 21 nt, Molluscum contagiosum virus
gcgcacacgcgucgggaagug

SEQ ID NO: 4038452 - RNA, 13 nt, Molluscum contagiosum virus
gcgcaccgcgggc

SEQ ID NO: 4038453 - RNA, 17 nt, Molluscum contagiosum virus
gcgcaccgcgggcugga

SEQ ID NO: 4038454 - RNA, 21 nt, Molluscum contagiosum virus
gcgcaccgcguugccgcccgc

SEQ ID NO: 4038455 - RNA, 22 nt, Molluscum contagiosum virus
gcgcaccugcacgagccggcgc

SEQ ID NO: 4038456 - RNA, 22 nt, Molluscum contagiosum virus
gcgcacgaagcggcggacagca

SEQ ID NO: 4038457 - RNA, 17 nt, Molluscum contagiosum virus
gcgcacgaccacgugca

SEQ ID NO: 4038458 - RNA, 17 nt, Molluscum contagiosum virus
gcgcacgagcugcugcc

SEQ ID NO: 4038459 - RNA, 24 nt, Molluscum contagiosum virus
gcgcacgcaagcccgcgcgcgagc

SEQ ID NO: 4038460 - RNA, 18 nt, Molluscum contagiosum virus
gcgcacgccgcucucgug

SEQ ID NO: 4038461 - RNA, 15 nt, Molluscum contagiosum virus
gcgcacgcgagcacg

SEQ ID NO: 4038462 - RNA, 20 nt, Molluscum contagiosum virus
gcgcacgcgcgagcaugccg

SEQ ID NO: 4038463 - RNA, 22 nt, Molluscum contagiosum virus
gcgcacgcgggacgcgugccug

SEQ ID NO: 4038464 - RNA, 21 nt, Molluscum contagiosum virus
gcgcacgcuagucguuggcgc

SEQ ID NO: 4038465 - RNA, 17 nt, Molluscum contagiosum virus
gcgcacgcugcgcacgg

SEQ ID NO: 4038466 - RNA, 16 nt, Molluscum contagiosum virus
gccgaugccuaugccg

SEQ ID NO: 4038467 - RNA, 16 nt, Molluscum contagiosum virus
gccgcaaacacugucu

SEQ ID NO: 4038468 - RNA, 22 nt, Molluscum contagiosum virus
gccgccagcuccgcgcggcgcu

SEQ ID NO: 4038469 - RNA, 14 nt, Molluscum contagiosum virus
gccgccaugcugcg

SEQ ID NO: 4038470 - RNA, 14 nt, Molluscum contagiosum virus
gccgcccacgcuca

SEQ ID NO: 4038471 - RNA, 15 nt, Molluscum contagiosum virus
gccgcccguguacaa

SEQ ID NO: 4038472 - RNA, 14 nt, Molluscum contagiosum virus
gccgccgggccugc

SEQ ID NO: 4038473 - RNA, 14 nt, Molluscum contagiosum virus
gccgccggugcgug

SEQ ID NO: 4038474 - RNA, 21 nt, Molluscum contagiosum virus
gccgccggugcgugcccagca

SEQ ID NO: 4038475 - RNA, 14 nt, Molluscum contagiosum virus
gccgccgugggcgc

SEQ ID NO: 4038476 - RNA, 15 nt, Molluscum contagiosum virus
gccgccucgcgcgca

SEQ ID NO: 4038477 - RNA, 19 nt, Molluscum contagiosum virus
gccgcgagacgcagacgac

SEQ ID NO: 4038478 - RNA, 15 nt, Molluscum contagiosum virus
gccgcgcaccuggag

SEQ ID NO: 4038479 - RNA, 12 nt, Molluscum contagiosum virus
gccgcgcccgcg

SEQ ID NO: 4038480 - RNA, 18 nt, Molluscum contagiosum virus
gccgcgcccgcggcgcac

SEQ ID NO: 4038481 - RNA, 18 nt, Molluscum contagiosum virus
gccgcgccuagccgugcg

SEQ ID NO: 4038482 - RNA, 20 nt, Molluscum contagiosum virus
gccgcgccuagccgugcgcg

SEQ ID NO: 4038483 - RNA, 17 nt, Molluscum contagiosum virus
gccgcgcgagugccagc

SEQ ID NO: 4038484 - RNA, 18 nt, Molluscum contagiosum virus
gccgcgcgccgcugcucg

SEQ ID NO: 4038485 - RNA, 18 nt, Molluscum contagiosum virus
gccgcgcgcggugcugcg

SEQ ID NO: 4038486 - RNA, 19 nt, Molluscum contagiosum virus
gccgcgcgcuacgcgccga

SEQ ID NO: 4038487 - RNA, 13 nt, Molluscum contagiosum virus
gccgcgcgcucgc

SEQ ID NO: 4038488 - RNA, 16 nt, Molluscum contagiosum virus
gccgcgcggcacgccc

SEQ ID NO: 4038489 - RNA, 15 nt, Molluscum contagiosum virus
gccgcgcggcagaca

SEQ ID NO: 4038490 - RNA, 17 nt, Molluscum contagiosum virus
gccgcgcucgugccgcc

SEQ ID NO: 4038491 - RNA, 13 nt, Molluscum contagiosum virus
gccgcgcucgugu

SEQ ID NO: 4038492 - RNA, 15 nt, Molluscum contagiosum virus
gccgcgcugcuggcc

SEQ ID NO: 4038493 - RNA, 19 nt, Molluscum contagiosum virus
gccgcgcugguggccgcac

SEQ ID NO: 4038494 - RNA, 19 nt, Molluscum contagiosum virus
gccgcggacgccggcgccc

SEQ ID NO: 4038495 - RNA, 21 nt, Molluscum contagiosum virus
gccgcggacgccggcgcccgc

SEQ ID NO: 4038496 - RNA, 19 nt, Molluscum contagiosum virus
gccgcggagaagugcgcag

SEQ ID NO: 4038497 - RNA, 14 nt, Molluscum contagiosum virus
gccgcggaggacuc

SEQ ID NO: 4038498 - RNA, 23 nt, Molluscum contagiosum virus
gccgcggaggacucggaggccgu

SEQ ID NO: 4038499 - RNA, 12 nt, Molluscum contagiosum virus
gccgcggaggga

SEQ ID NO: 4038500 - RNA, 13 nt, Molluscum contagiosum virus
gccgcggccgccg

SEQ ID NO: 4038501 - RNA, 15 nt, Molluscum contagiosum virus
gccgcggccgcgaga

SEQ ID NO: 4038502 - RNA, 21 nt, Molluscum contagiosum virus
gccgcguacgcacgugccgug

SEQ ID NO: 4038503 - RNA, 12 nt, Molluscum contagiosum virus
gccgcgugcccg

SEQ ID NO: 4038504 - RNA, 13 nt, Molluscum contagiosum virus
gccgcgugcgccg

SEQ ID NO: 4038505 - RNA, 14 nt, Molluscum contagiosum virus
gccgcgugcgcgcg

SEQ ID NO: 4038506 - RNA, 20 nt, Molluscum contagiosum virus
gccgcgugcgcgcgguacuc

SEQ ID NO: 4038507 - RNA, 15 nt, Molluscum contagiosum virus
gccgcgugcucugcu

SEQ ID NO: 4038508 - RNA, 13 nt, Molluscum contagiosum virus
gccgcgugcuggc

SEQ ID NO: 4038509 - RNA, 20 nt, Molluscum contagiosum virus
gccgcuccuucgaagagguc

SEQ ID NO: 4038510 - RNA, 19 nt, Molluscum contagiosum virus
gccgcucgcaagaguucaa

SEQ ID NO: 4038511 - RNA, 19 nt, Molluscum contagiosum virus
gccgcucguccagcugcgc

SEQ ID NO: 4038512 - RNA, 16 nt, Molluscum contagiosum virus
gccgcugcccgcgcac

SEQ ID NO: 4038513 - RNA, 13 nt, Molluscum contagiosum virus
gccgcugcgccgc

SEQ ID NO: 4038514 - RNA, 14 nt, Molluscum contagiosum virus
gccgcugcgccgcc

SEQ ID NO: 4038515 - RNA, 14 nt, Molluscum contagiosum virus
gccgcuggacgccu

SEQ ID NO: 4038516 - RNA, 21 nt, Molluscum contagiosum virus
gccgcuggugggcgugcggcg

SEQ ID NO: 4038517 - RNA, 14 nt, Molluscum contagiosum virus
gccgcuuccuggca

SEQ ID NO: 4038518 - RNA, 19 nt, Molluscum contagiosum virus
gccgcuucgugcgcggaga

SEQ ID NO: 4038519 - RNA, 23 nt, Molluscum contagiosum virus
gccggaaauagcgcgcuagcucc

SEQ ID NO: 4038520 - RNA, 23 nt, Molluscum contagiosum virus
gccggcaacgcugccgcuggcgc

SEQ ID NO: 4038521 - RNA, 17 nt, Molluscum contagiosum virus
gccggcaaggggccagc

SEQ ID NO: 4038522 - RNA, 17 nt, Molluscum contagiosum virus
gccggcacccgugcgcg

SEQ ID NO: 4038523 - RNA, 19 nt, Molluscum contagiosum virus
gccggcgcccgcgugcacc

SEQ ID NO: 4038524 - RNA, 13 nt, Molluscum contagiosum virus
gccggcgcggcga

SEQ ID NO: 4038525 - RNA, 14 nt, Molluscum contagiosum virus
gccggcgcggcgag

SEQ ID NO: 4038526 - RNA, 20 nt, Molluscum contagiosum virus
gccggcgcuucuacugcgca

SEQ ID NO: 4038527 - RNA, 14 nt, Molluscum contagiosum virus
gccggcggcgcaag

SEQ ID NO: 4038528 - RNA, 17 nt, Molluscum contagiosum virus
gccggcguucgcggagc

SEQ ID NO: 4038529 - RNA, 17 nt, Molluscum contagiosum virus
gccggcucaagcuggca

SEQ ID NO: 4038530 - RNA, 16 nt, Molluscum contagiosum virus
gccggcucugccuccg

SEQ ID NO: 4038531 - RNA, 13 nt, Molluscum contagiosum virus
gccggcugcccug

SEQ ID NO: 4038532 - RNA, 18 nt, Molluscum contagiosum virus
gccgggcacgcccgcggu

SEQ ID NO: 4038533 - RNA, 19 nt, Molluscum contagiosum virus
gccgggcgccggcucugcc

SEQ ID NO: 4038534 - RNA, 15 nt, Molluscum contagiosum virus
gccgggggaacacgc

SEQ ID NO: 4038535 - RNA, 17 nt, Molluscum contagiosum virus
gccgguacucgugcguc

SEQ ID NO: 4038536 - RNA, 14 nt, Molluscum contagiosum virus
gccgguacugcgga

SEQ ID NO: 4038537 - RNA, 14 nt, Molluscum contagiosum virus
gccgguggaagagc

SEQ ID NO: 4038538 - RNA, 16 nt, Molluscum contagiosum virus
gccguacccggggaga

SEQ ID NO: 4038539 - RNA, 13 nt, Molluscum contagiosum virus
gccguaguccggc

SEQ ID NO: 4038540 - RNA, 19 nt, Molluscum contagiosum virus
gccguagucuucgugcgug

SEQ ID NO: 4038541 - RNA, 14 nt, Molluscum contagiosum virus
gccguagugcucau

SEQ ID NO: 4038542 - RNA, 22 nt, Molluscum contagiosum virus
gccguagugcucaucgugcccg

SEQ ID NO: 4038543 - RNA, 13 nt, Molluscum contagiosum virus
gccgucacggccg

SEQ ID NO: 4038544 - RNA, 17 nt, Molluscum contagiosum virus
gccgucgccgcgcccgc

SEQ ID NO: 4038545 - RNA, 18 nt, Molluscum contagiosum virus
gccgucgcgagcuuggcc

SEQ ID NO: 4038546 - RNA, 15 nt, Molluscum contagiosum virus
gccgucgggcgccaa

SEQ ID NO: 4038547 - RNA, 22 nt, Molluscum contagiosum virus
gccgucuccucucgcgaucugc

SEQ ID NO: 4038548 - RNA, 16 nt, Molluscum contagiosum virus
gccgucucgcgcucgc

SEQ ID NO: 4038549 - RNA, 19 nt, Molluscum contagiosum virus
gccgugaacgaggcugcug

SEQ ID NO: 4038550 - RNA, 15 nt, Molluscum contagiosum virus
gccgugacgcugcgg

SEQ ID NO: 4038551 - RNA, 20 nt, Molluscum contagiosum virus
gccguguacaugcucaagca

SEQ ID NO: 4038552 - RNA, 22 nt, Molluscum contagiosum virus
gccguguccuacacgccgcugg

SEQ ID NO: 4038553 - RNA, 15 nt, Molluscum contagiosum virus
gccgugucggcaccg

SEQ ID NO: 4038554 - RNA, 22 nt, Molluscum contagiosum virus
gccuagagcuggcaccgggcgc

SEQ ID NO: 4038555 - RNA, 14 nt, Molluscum contagiosum virus
gccuagccugcagu

SEQ ID NO: 4038556 - RNA, 13 nt, Molluscum contagiosum virus
gccucccccgcgc

SEQ ID NO: 4038557 - RNA, 22 nt, Molluscum contagiosum virus
gccuccgaggacgacgccgagc

SEQ ID NO: 4038558 - RNA, 15 nt, Molluscum contagiosum virus
gccucgagcacgccu

SEQ ID NO: 4038559 - RNA, 16 nt, Molluscum contagiosum virus
gccucgaugccaacag

SEQ ID NO: 4038560 - RNA, 20 nt, Molluscum contagiosum virus
gccucgcaggcgaggucaca

SEQ ID NO: 4038561 - RNA, 20 nt, Molluscum contagiosum virus
gccucgccuccgggcgcaca

SEQ ID NO: 4038562 - RNA, 23 nt, Molluscum contagiosum virus
gccucggacggaggucugcuuug

SEQ ID NO: 4038563 - RNA, 16 nt, Molluscum contagiosum virus
gccucucucggagaag

SEQ ID NO: 4038564 - RNA, 18 nt, Molluscum contagiosum virus
gccucucucggagaagug

SEQ ID NO: 4038565 - RNA, 23 nt, Molluscum contagiosum virus
gccucugccagccgcucguccag

SEQ ID NO: 4038566 - RNA, 15 nt, Molluscum contagiosum virus
gccucugccucgugc

SEQ ID NO: 4038567 - RNA, 21 nt, Molluscum contagiosum virus
gccucugccugcaaggagguc

SEQ ID NO: 4038568 - RNA, 16 nt, Molluscum contagiosum virus
gccugagaagcuguac

SEQ ID NO: 4038569 - RNA, 12 nt, Molluscum contagiosum virus
gccugcacggcu

SEQ ID NO: 4038570 - RNA, 16 nt, Molluscum contagiosum virus
ugggaaaccucaccuc

SEQ ID NO: 4038571 - RNA, 16 nt, Molluscum contagiosum virus
ugggagcuuuccuugc

SEQ ID NO: 4038572 - RNA, 17 nt, Molluscum contagiosum virus
ugggauaacaggcgugc

SEQ ID NO: 4038573 - RNA, 21 nt, Molluscum contagiosum virus
ugggcaccugcaucgcgccgc

SEQ ID NO: 4038574 - RNA, 17 nt, Molluscum contagiosum virus
ugggcacgcucuacggc

SEQ ID NO: 4038575 - RNA, 23 nt, Molluscum contagiosum virus
ugggcacgcucuacggcgugcug

SEQ ID NO: 4038576 - RNA, 18 nt, Molluscum contagiosum virus
ugggcaggccgcccacgc

SEQ ID NO: 4038577 - RNA, 16 nt, Molluscum contagiosum virus
ugggcgagagcuuuuc

SEQ ID NO: 4038578 - RNA, 17 nt, Molluscum contagiosum virus
ugggcggcauccugaug

SEQ ID NO: 4038579 - RNA, 18 nt, Molluscum contagiosum virus
uggggagacuugagccca

SEQ ID NO: 4038580 - RNA, 14 nt, Molluscum contagiosum virus
ugguacagaugagu

SEQ ID NO: 4038581 - RNA, 13 nt, Molluscum contagiosum virus
uggucacgcgcac

SEQ ID NO: 4038582 - RNA, 13 nt, Molluscum contagiosum virus
ugguccaccagcu

SEQ ID NO: 4038583 - RNA, 16 nt, Molluscum contagiosum virus
ugguccggcgugagcu

SEQ ID NO: 4038584 - RNA, 13 nt, Molluscum contagiosum virus
uggucgcgcgcgc

SEQ ID NO: 4038585 - RNA, 14 nt, Molluscum contagiosum virus
uggucgcgcgcgcu

SEQ ID NO: 4038586 - RNA, 20 nt, Molluscum contagiosum virus
uggucgcgcgcgcucugccg

SEQ ID NO: 4038587 - RNA, 13 nt, Molluscum contagiosum virus
uggugcacacaca

SEQ ID NO: 4038588 - RNA, 16 nt, Molluscum contagiosum virus
ugguggacagccuuug

SEQ ID NO: 4038589 - RNA, 22 nt, Molluscum contagiosum virus
ugguguacgaaaguacuuuugc

SEQ ID NO: 4038590 - RNA, 20 nt, Molluscum contagiosum virus
uggugugccagcggcgccgc

SEQ ID NO: 4038591 - RNA, 15 nt, Molluscum contagiosum virus
ugguguucugcgcgc

SEQ ID NO: 4038592 - RNA, 13 nt, Molluscum contagiosum virus
ugguucaugcugg

SEQ ID NO: 4038593 - RNA, 18 nt, Molluscum contagiosum virus
ugguugccaggcacacgc

SEQ ID NO: 4038594 - RNA, 15 nt, Molluscum contagiosum virus
ugguugccgcucgca

SEQ ID NO: 4038595 - RNA, 11 nt, Molluscum contagiosum virus
uguaacaagga

SEQ ID NO: 4038596 - RNA, 18 nt, Molluscum contagiosum virus
uguaauaguacacuuuga

SEQ ID NO: 4038597 - RNA, 19 nt, Molluscum contagiosum virus
uguagcaucugcgacacgc

SEQ ID NO: 4038598 - RNA, 16 nt, Molluscum contagiosum virus
uguagucgcccccgug

SEQ ID NO: 4038599 - RNA, 15 nt, Molluscum contagiosum virus
uguaguuaaaugacg

SEQ ID NO: 4038600 - RNA, 20 nt, Molluscum contagiosum virus
uguauaguccccggcgccgg

SEQ ID NO: 4038601 - RNA, 11 nt, Molluscum contagiosum virus
ugucaagcacu

SEQ ID NO: 4038602 - RNA, 20 nt, Molluscum contagiosum virus
ugucacgcgucgcgcgccgc

SEQ ID NO: 4038603 - RNA, 15 nt, Molluscum contagiosum virus
uguccacgacacugg

SEQ ID NO: 4038604 - RNA, 13 nt, Molluscum contagiosum virus
ugucccgcaagcc

SEQ ID NO: 4038605 - RNA, 13 nt, Molluscum contagiosum virus
uguccucuucaca

SEQ ID NO: 4038606 - RNA, 12 nt, Molluscum contagiosum virus
uguccugagccu

SEQ ID NO: 4038607 - RNA, 16 nt, Molluscum contagiosum virus
ugucgccgcgggcugg

SEQ ID NO: 4038608 - RNA, 20 nt, Molluscum contagiosum virus
ugucgucaaaggcaaagccu

SEQ ID NO: 4038609 - RNA, 13 nt, Molluscum contagiosum virus
ugucguggaggaa

SEQ ID NO: 4038610 - RNA, 22 nt, Molluscum contagiosum virus
ugucucugcgcgagcagcugcu

SEQ ID NO: 4038611 - RNA, 12 nt, Molluscum contagiosum virus
ugucuuccgcuc

SEQ ID NO: 4038612 - RNA, 12 nt, Molluscum contagiosum virus
ugugagcaagcu

SEQ ID NO: 4038613 - RNA, 14 nt, Molluscum contagiosum virus
ugugagcgcgccgc

SEQ ID NO: 4038614 - RNA, 22 nt, Molluscum contagiosum virus
ugugcacaugcccgugcaccuc

SEQ ID NO: 4038615 - RNA, 16 nt, Molluscum contagiosum virus
ugugcccaguuauucu

SEQ ID NO: 4038616 - RNA, 16 nt, Molluscum contagiosum virus
ugugccugcgcaacgc

SEQ ID NO: 4038617 - RNA, 19 nt, Molluscum contagiosum virus
ugugcgacucgucgagcac

SEQ ID NO: 4038618 - RNA, 18 nt, Molluscum contagiosum virus
ugugcggagggugcacgc

SEQ ID NO: 4038619 - RNA, 20 nt, Molluscum contagiosum virus
ugugcggcucgagacccaca

SEQ ID NO: 4038620 - RNA, 13 nt, Molluscum contagiosum virus
ugugcuacugcac

SEQ ID NO: 4038621 - RNA, 17 nt, Molluscum contagiosum virus
uguggcgccgaugcagu

SEQ ID NO: 4038622 - RNA, 15 nt, Molluscum contagiosum virus
uguguuuugugccug

SEQ ID NO: 4038623 - RNA, 17 nt, Molluscum contagiosum virus
uguucacaccaugcagc

SEQ ID NO: 4038624 - RNA, 13 nt, Molluscum contagiosum virus
uguucacgugcuc

SEQ ID NO: 4038625 - RNA, 14 nt, Molluscum contagiosum virus
uguugcucuaccug

SEQ ID NO: 4038626 - RNA, 16 nt, Molluscum contagiosum virus
uguuggcgcgguccgc

SEQ ID NO: 4038627 - RNA, 22 nt, Molluscum contagiosum virus
uguuuccgcucgcgcugcuucc

SEQ ID NO: 4038628 - RNA, 17 nt, Molluscum contagiosum virus
uuaacuaagcuaaaaga

SEQ ID NO: 4038629 - RNA, 13 nt, Molluscum contagiosum virus
uuaaucacgauga

SEQ ID NO: 4038630 - RNA, 13 nt, Molluscum contagiosum virus
uuacggagcuaca

SEQ ID NO: 4038631 - RNA, 16 nt, Molluscum contagiosum virus
uuagcacacgcgcgcg

SEQ ID NO: 4038632 - RNA, 17 nt, Molluscum contagiosum virus
uuagcguggcgcgcgag

SEQ ID NO: 4038633 - RNA, 20 nt, Molluscum contagiosum virus
uuagcuuccgucugcugcuc

SEQ ID NO: 4038634 - RNA, 15 nt, Molluscum contagiosum virus
uuauugaaaauaaag

SEQ ID NO: 4038635 - RNA, 20 nt, Molluscum contagiosum virus
uucaagacuggcacuugcgc

SEQ ID NO: 4038636 - RNA, 17 nt, Molluscum contagiosum virus
uucaaguuugacaaggg

SEQ ID NO: 4038637 - RNA, 22 nt, Molluscum contagiosum virus
uucacaagguagucacgcgcga

SEQ ID NO: 4038638 - RNA, 13 nt, Molluscum contagiosum virus
uuccacgucucca

SEQ ID NO: 4038639 - RNA, 18 nt, Molluscum contagiosum virus
uuccagcacugcgccaag

SEQ ID NO: 4038640 - RNA, 21 nt, Molluscum contagiosum virus
uucccgaggcguccagcggcu

SEQ ID NO: 4038641 - RNA, 15 nt, Molluscum contagiosum virus
uuccgacgggccgcc

SEQ ID NO: 4038642 - RNA, 20 nt, Molluscum contagiosum virus
uuccgagccgccggucucca

SEQ ID NO: 4038643 - RNA, 20 nt, Molluscum contagiosum virus
uuccgagcucgcaaacacaa

SEQ ID NO: 4038644 - RNA, 22 nt, Molluscum contagiosum virus
uuccgcgagcacguggacagca

SEQ ID NO: 4038645 - RNA, 12 nt, Molluscum contagiosum virus
uuccgcucgcgc

SEQ ID NO: 4038646 - RNA, 13 nt, Molluscum contagiosum virus
uuccggcaccacg

SEQ ID NO: 4038647 - RNA, 13 nt, Molluscum contagiosum virus
uuccggcgcggcc

SEQ ID NO: 4038648 - RNA, 21 nt, Molluscum contagiosum virus
uuccggcgcggccuggccacg

SEQ ID NO: 4038649 - RNA, 10 nt, Molluscum contagiosum virus
uuccgggccc

SEQ ID NO: 4038650 - RNA, 17 nt, Molluscum contagiosum virus
uuccgugcuugacaagu

SEQ ID NO: 4038651 - RNA, 21 nt, Molluscum contagiosum virus
uuccucgacgaggccuacagc

SEQ ID NO: 4038652 - RNA, 11 nt, Molluscum contagiosum virus
uuccugcuggc

SEQ ID NO: 4038653 - RNA, 20 nt, Molluscum contagiosum virus
uucgaccucugcuucacgcu

SEQ ID NO: 4038654 - RNA, 17 nt, Molluscum contagiosum virus
uucgagaccagccgcga

SEQ ID NO: 4038655 - RNA, 18 nt, Molluscum contagiosum virus
uucgcagaggacagcucc

SEQ ID NO: 4038656 - RNA, 20 nt, Molluscum contagiosum virus
uucgccccgagaauaccguc

SEQ ID NO: 4038657 - RNA, 23 nt, Molluscum contagiosum virus
uucgcgaaggcaaccgcgacgag

SEQ ID NO: 4038658 - RNA, 13 nt, Molluscum contagiosum virus
uucgcgccgccgc

SEQ ID NO: 4038659 - RNA, 21 nt, Molluscum contagiosum virus
uucgcggagcugugccgcagc

SEQ ID NO: 4038660 - RNA, 22 nt, Molluscum contagiosum virus
uucgggcgcaaucacggcugua

SEQ ID NO: 4038661 - RNA, 14 nt, Molluscum contagiosum virus
ugcucgcgcucgcg

SEQ ID NO: 4038662 - RNA, 17 nt, Molluscum contagiosum virus
ugcucgcggagggcagc

SEQ ID NO: 4038663 - RNA, 21 nt, Molluscum contagiosum virus
ugcucgcggucgggccccugc

SEQ ID NO: 4038664 - RNA, 16 nt, Molluscum contagiosum virus
ugcucggacacacgca

SEQ ID NO: 4038665 - RNA, 23 nt, Molluscum contagiosum virus
ugcucuacuggcggcgcccguga

SEQ ID NO: 4038666 - RNA, 16 nt, Molluscum contagiosum virus
ugcucugugcgcgcag

SEQ ID NO: 4038667 - RNA, 19 nt, Molluscum contagiosum virus
ugcugcacagcuuccugga

SEQ ID NO: 4038668 - RNA, 21 nt, Molluscum contagiosum virus
ugcugcccccgccgcggcgcc

SEQ ID NO: 4038669 - RNA, 20 nt, Molluscum contagiosum virus
ugcugcccgccuucgacggc

SEQ ID NO: 4038670 - RNA, 13 nt, Molluscum contagiosum virus
ugcugcgagagca

SEQ ID NO: 4038671 - RNA, 16 nt, Molluscum contagiosum virus
ugcugcgcacggaggg

SEQ ID NO: 4038672 - RNA, 14 nt, Molluscum contagiosum virus
ugcugcgcagcauc

SEQ ID NO: 4038673 - RNA, 13 nt, Molluscum contagiosum virus
ugcugcgccacgu

SEQ ID NO: 4038674 - RNA, 11 nt, Molluscum contagiosum virus
ugcugcgcgac

SEQ ID NO: 4038675 - RNA, 15 nt, Molluscum contagiosum virus
ugcugcgcgcgccau

SEQ ID NO: 4038676 - RNA, 13 nt, Molluscum contagiosum virus
ugcugcgcgcgcu

SEQ ID NO: 4038677 - RNA, 15 nt, Molluscum contagiosum virus
ugcugcgcggcgccg

SEQ ID NO: 4038678 - RNA, 15 nt, Molluscum contagiosum virus
ugcugcggcugcugg

SEQ ID NO: 4038679 - RNA, 23 nt, Molluscum contagiosum virus
ugcugcucaaggacuaccagcuc

SEQ ID NO: 4038680 - RNA, 14 nt, Molluscum contagiosum virus
ugcugcucgacggg

SEQ ID NO: 4038681 - RNA, 16 nt, Molluscum contagiosum virus
ugcugcugcagaacug

SEQ ID NO: 4038682 - RNA, 19 nt, Molluscum contagiosum virus
ugcugcuggcccugcuagu

SEQ ID NO: 4038683 - RNA, 22 nt, Molluscum contagiosum virus
ugcugcuuguugugggcucgcg

SEQ ID NO: 4038684 - RNA, 15 nt, Molluscum contagiosum virus
ugcuggacgggcacg

SEQ ID NO: 4038685 - RNA, 19 nt, Molluscum contagiosum virus
ugcuggcaccgcgcgcgcu

SEQ ID NO: 4038686 - RNA, 22 nt, Molluscum contagiosum virus
ugcuggcgaaaccugggcgccg

SEQ ID NO: 4038687 - RNA, 19 nt, Molluscum contagiosum virus
ugcuggcgagcacguccuc

SEQ ID NO: 4038688 - RNA, 22 nt, Molluscum contagiosum virus
ugcuggcgcgcgcgcgccggaa

SEQ ID NO: 4038689 - RNA, 12 nt, Molluscum contagiosum virus
ugcuggcgcgcu

SEQ ID NO: 4038690 - RNA, 15 nt, Molluscum contagiosum virus
ugcuggcggggcugg

SEQ ID NO: 4038691 - RNA, 15 nt, Molluscum contagiosum virus
ugcuggugcucgccu

SEQ ID NO: 4038692 - RNA, 15 nt, Molluscum contagiosum virus
ugcugguucugcucg

SEQ ID NO: 4038693 - RNA, 18 nt, Molluscum contagiosum virus
ugcugguucugcucgcag

SEQ ID NO: 4038694 - RNA, 15 nt, Molluscum contagiosum virus
ugcugugccugcgca

SEQ ID NO: 4038695 - RNA, 18 nt, Molluscum contagiosum virus
ugcuugcccgaccuuggu

SEQ ID NO: 4038696 - RNA, 21 nt, Molluscum contagiosum virus
ugcuuugucugcaggcagaag

SEQ ID NO: 4038697 - RNA, 18 nt, Molluscum contagiosum virus
uggaacaggugcgcaagc

SEQ ID NO: 4038698 - RNA, 23 nt, Molluscum contagiosum virus
uggaacgagagugugcaugcugu

SEQ ID NO: 4038699 - RNA, 20 nt, Molluscum contagiosum virus
uggaacugcagcagcuggcc

SEQ ID NO: 4038700 - RNA, 13 nt, Molluscum contagiosum virus
uggacagcaagca

SEQ ID NO: 4038701 - RNA, 15 nt, Molluscum contagiosum virus
uggacagcaagcagc

SEQ ID NO: 4038702 - RNA, 21 nt, Molluscum contagiosum virus
uggacagcaagcagcgcgcgc

SEQ ID NO: 4038703 - RNA, 12 nt, Molluscum contagiosum virus
uggacagcaucc

SEQ ID NO: 4038704 - RNA, 13 nt, Molluscum contagiosum virus
uggacagccauga

SEQ ID NO: 4038705 - RNA, 23 nt, Molluscum contagiosum virus
uggacagccugcaccgagugcug

SEQ ID NO: 4038706 - RNA, 21 nt, Molluscum contagiosum virus
uggacauccucaccuuccugg

SEQ ID NO: 4038707 - RNA, 14 nt, Molluscum contagiosum virus
uggacgaggccaac

SEQ ID NO: 4038708 - RNA, 16 nt, Molluscum contagiosum virus
uggacgcacagggcug

SEQ ID NO: 4038709 - RNA, 21 nt, Molluscum contagiosum virus
uggacgcacagggcugcgugg

SEQ ID NO: 4038710 - RNA, 23 nt, Molluscum contagiosum virus
uggacgccggggggcgccaaguc

SEQ ID NO: 4038711 - RNA, 14 nt, Molluscum contagiosum virus
uggacgcgcacgcg

SEQ ID NO: 4038712 - RNA, 17 nt, Molluscum contagiosum virus
uggacgcgccgcgcgag

SEQ ID NO: 4038713 - RNA, 12 nt, Molluscum contagiosum virus
uggacuucagga

SEQ ID NO: 4038714 - RNA, 15 nt, Molluscum contagiosum virus
uggagaacggcgugc

SEQ ID NO: 4038715 - RNA, 20 nt, Molluscum contagiosum virus
uggagaacggcgugcgagug

SEQ ID NO: 4038716 - RNA, 21 nt, Molluscum contagiosum virus
uggagcccacguugccgcgcg

SEQ ID NO: 4038717 - RNA, 21 nt, Molluscum contagiosum virus
uggagcccgugcuggagggca

SEQ ID NO: 4038718 - RNA, 17 nt, Molluscum contagiosum virus
uggagccgcugcugcgg

SEQ ID NO: 4038719 - RNA, 19 nt, Molluscum contagiosum virus
uggagcgccuugccgagga

SEQ ID NO: 4038720 - RNA, 17 nt, Molluscum contagiosum virus
uggaggaggaagcaggu

SEQ ID NO: 4038721 - RNA, 15 nt, Molluscum contagiosum virus
uggaggauucuugua

SEQ ID NO: 4038722 - RNA, 19 nt, Molluscum contagiosum virus
uggagggguguuuccuugc

SEQ ID NO: 4038723 - RNA, 17 nt, Molluscum contagiosum virus
uggaggugcgcgacucc

SEQ ID NO: 4038724 - RNA, 21 nt, Molluscum contagiosum virus
uggaguccaugcccacgcgca

SEQ ID NO: 4038725 - RNA, 16 nt, Molluscum contagiosum virus
uggauaccaugcucuc

SEQ ID NO: 4038726 - RNA, 19 nt, Molluscum contagiosum virus
uggauuucggcgcgcgugc

SEQ ID NO: 4038727 - RNA, 15 nt, Molluscum contagiosum virus
uggcaaaccacgagc

SEQ ID NO: 4038728 - RNA, 19 nt, Molluscum contagiosum virus
uggcaacgcaaacgcacgc

SEQ ID NO: 4038729 - RNA, 17 nt, Molluscum contagiosum virus
uggcaacgcgggggcca

SEQ ID NO: 4038730 - RNA, 15 nt, Molluscum contagiosum virus
uggcacccuggcugc

SEQ ID NO: 4038731 - RNA, 16 nt, Molluscum contagiosum virus
uggcacccuggcugcu

SEQ ID NO: 4038732 - RNA, 17 nt, Molluscum contagiosum virus
uggcacccuggcugcug

SEQ ID NO: 4038733 - RNA, 16 nt, Molluscum contagiosum virus
uggcaccgggcgccgc

SEQ ID NO: 4038734 - RNA, 16 nt, Molluscum contagiosum virus
uggcacuagccuccuu

SEQ ID NO: 4038735 - RNA, 20 nt, Molluscum contagiosum virus
uggcagcggcaaaggcccgc

SEQ ID NO: 4038736 - RNA, 17 nt, Molluscum contagiosum virus
uggcauggcgcgcucgc

SEQ ID NO: 4038737 - RNA, 14 nt, Molluscum contagiosum virus
uggccaaggucucg

SEQ ID NO: 4038738 - RNA, 13 nt, Molluscum contagiosum virus
uggccauggugga

SEQ ID NO: 4038739 - RNA, 19 nt, Molluscum contagiosum virus
uggccgcauuuucucugga

SEQ ID NO: 4038740 - RNA, 17 nt, Molluscum contagiosum virus
uggccgcuccagagccg

SEQ ID NO: 4038741 - RNA, 18 nt, Molluscum contagiosum virus
uggccguagugcucaucg

SEQ ID NO: 4038742 - RNA, 19 nt, Molluscum contagiosum virus
uggccuaccugcaggagga

SEQ ID NO: 4038743 - RNA, 22 nt, Molluscum contagiosum virus
uggccucugccugcaaggaggu

SEQ ID NO: 4038744 - RNA, 21 nt, Molluscum contagiosum virus
uggccuguaguagcagcuucu

SEQ ID NO: 4038745 - RNA, 20 nt, Molluscum contagiosum virus
uggcgagcaucugcgcgugc

SEQ ID NO: 4038746 - RNA, 18 nt, Molluscum contagiosum virus
uggcgagcuagugcacac

SEQ ID NO: 4038747 - RNA, 16 nt, Molluscum contagiosum virus
uggcgauagcgauggc

SEQ ID NO: 4038748 - RNA, 17 nt, Molluscum contagiosum virus
uggcgaucugcucgcag

SEQ ID NO: 4038749 - RNA, 19 nt, Molluscum contagiosum virus
uggcgcccgaggacgagcc

SEQ ID NO: 4038750 - RNA, 20 nt, Molluscum contagiosum virus
uggcgcccuuuggcuagcac

SEQ ID NO: 4038751 - RNA, 12 nt, Molluscum contagiosum virus
uggcgcgccgcu

SEQ ID NO: 4038752 - RNA, 15 nt, Molluscum contagiosum virus
uggcgcgccgcugcc

SEQ ID NO: 4038753 - RNA, 14 nt, Molluscum contagiosum virus
uggcgcgcgagcug

SEQ ID NO: 4038754 - RNA, 19 nt, Molluscum contagiosum virus
uggcgcgcgagcugcuagc

SEQ ID NO: 4038755 - RNA, 14 nt, Molluscum contagiosum virus
uggcgcgcgugccg

SEQ ID NO: 4038756 - RNA, 18 nt, Molluscum contagiosum virus
uggcgcgguccagccgca

SEQ ID NO: 4038757 - RNA, 18 nt, Molluscum contagiosum virus
uggcgcucgcgcgcacgc

SEQ ID NO: 4038758 - RNA, 22 nt, Molluscum contagiosum virus
uggcggccaaccgccugcucuc

SEQ ID NO: 4038759 - RNA, 13 nt, Molluscum contagiosum virus
uggcggcgcacgc

SEQ ID NO: 4038760 - RNA, 16 nt, Molluscum contagiosum virus
acgaaagcaaaggagu

SEQ ID NO: 4038761 - RNA, 20 nt, Molluscum contagiosum virus
acgaaucgccgucuuuacgu

SEQ ID NO: 4038762 - RNA, 13 nt, Molluscum contagiosum virus
acgacaaggaaag

SEQ ID NO: 4038763 - RNA, 22 nt, Molluscum contagiosum virus
acgacaaggaaaggcacccacc

SEQ ID NO: 4038764 - RNA, 18 nt, Molluscum contagiosum virus
acgacaauacggugcagc

SEQ ID NO: 4038765 - RNA, 22 nt, Molluscum contagiosum virus
acgacaugcugugcggcacgcc

SEQ ID NO: 4038766 - RNA, 15 nt, Molluscum contagiosum virus
acgacccucuucgac

SEQ ID NO: 4038767 - RNA, 22 nt, Molluscum contagiosum virus
acgaccgcaagugcacgcggcg

SEQ ID NO: 4038768 - RNA, 23 nt, Molluscum contagiosum virus
acgaccgcaagugcacgcggcgc

SEQ ID NO: 4038769 - RNA, 23 nt, Molluscum contagiosum virus
acgacgacggcugcucgcugccu

SEQ ID NO: 4038770 - RNA, 13 nt, Molluscum contagiosum virus
acgacgagcacua

SEQ ID NO: 4038771 - RNA, 19 nt, Molluscum contagiosum virus
acgacgcgcccacgugcca

SEQ ID NO: 4038772 - RNA, 15 nt, Molluscum contagiosum virus
acgacggcugcucgc

SEQ ID NO: 4038773 - RNA, 22 nt, Molluscum contagiosum virus
acgacggcugcucgcugccugg

SEQ ID NO: 4038774 - RNA, 22 nt, Molluscum contagiosum virus
acgacucgcgucugcaaggccu

SEQ ID NO: 4038775 - RNA, 14 nt, Molluscum contagiosum virus
acgacucgcugcca

SEQ ID NO: 4038776 - RNA, 21 nt, Molluscum contagiosum virus
acgacuuccgcggcgugcagg

SEQ ID NO: 4038777 - RNA, 13 nt, Molluscum contagiosum virus
acgagaaugacuu

SEQ ID NO: 4038778 - RNA, 14 nt, Molluscum contagiosum virus
acgagcagcugcug

SEQ ID NO: 4038779 - RNA, 17 nt, Molluscum contagiosum virus
acgagcagcugcugcgc

SEQ ID NO: 4038780 - RNA, 14 nt, Molluscum contagiosum virus
acgagcaggcgcag

SEQ ID NO: 4038781 - RNA, 22 nt, Molluscum contagiosum virus
acgagcaggcgcagcgcggccu

SEQ ID NO: 4038782 - RNA, 14 nt, Molluscum contagiosum virus
acgagcaguccgcc

SEQ ID NO: 4038783 - RNA, 16 nt, Molluscum contagiosum virus
acgagccccgcgccgg

SEQ ID NO: 4038784 - RNA, 14 nt, Molluscum contagiosum virus
acgagcccgcaaga

SEQ ID NO: 4038785 - RNA, 13 nt, Molluscum contagiosum virus
acgagccgcugcu

SEQ ID NO: 4038786 - RNA, 20 nt, Molluscum contagiosum virus
acgagcgccagccugugcgc

SEQ ID NO: 4038787 - RNA, 19 nt, Molluscum contagiosum virus
acgagcugacgcagacgca

SEQ ID NO: 4038788 - RNA, 13 nt, Molluscum contagiosum virus
acgagcugcugua

SEQ ID NO: 4038789 - RNA, 18 nt, Molluscum contagiosum virus
acgagcugugcgagccag

SEQ ID NO: 4038790 - RNA, 15 nt, Molluscum contagiosum virus
acgaggaaaggcacc

SEQ ID NO: 4038791 - RNA, 16 nt, Molluscum contagiosum virus
acgaggaaaggcaccc

SEQ ID NO: 4038792 - RNA, 13 nt, Molluscum contagiosum virus
acgaggacuggga

SEQ ID NO: 4038793 - RNA, 16 nt, Molluscum contagiosum virus
acgagggaugcgcaca

SEQ ID NO: 4038794 - RNA, 13 nt, Molluscum contagiosum virus
acgaggugcgcgc

SEQ ID NO: 4038795 - RNA, 17 nt, Molluscum contagiosum virus
acgaggugcgcgcaaca

SEQ ID NO: 4038796 - RNA, 16 nt, Molluscum contagiosum virus
acgcaacgucgcacug

SEQ ID NO: 4038797 - RNA, 20 nt, Molluscum contagiosum virus
acgcaacgucgcacuggccu

SEQ ID NO: 4038798 - RNA, 14 nt, Molluscum contagiosum virus
acgcaacugcccgc

SEQ ID NO: 4038799 - RNA, 18 nt, Molluscum contagiosum virus
acgcacacucgcgcgucc

SEQ ID NO: 4038800 - RNA, 19 nt, Molluscum contagiosum virus
acgcacagccccugcugcu

SEQ ID NO: 4038801 - RNA, 16 nt, Molluscum contagiosum virus
acgcaccgccuggugc

SEQ ID NO: 4038802 - RNA, 17 nt, Molluscum contagiosum virus
acgcacgcacguggcgc

SEQ ID NO: 4038803 - RNA, 15 nt, Molluscum contagiosum virus
acgcacgcgcgggca

SEQ ID NO: 4038804 - RNA, 14 nt, Molluscum contagiosum virus
acgcacuugcgcgc

SEQ ID NO: 4038805 - RNA, 23 nt, Molluscum contagiosum virus
acgcagcuguggcgccugcgcgc

SEQ ID NO: 4038806 - RNA, 20 nt, Molluscum contagiosum virus
acgcaggaccuggcuggcgc

SEQ ID NO: 4038807 - RNA, 17 nt, Molluscum contagiosum virus
acgcaggaugcuggggc

SEQ ID NO: 4038808 - RNA, 21 nt, Molluscum contagiosum virus
acgcagucgccuuccugcgcc

SEQ ID NO: 4038809 - RNA, 17 nt, Molluscum contagiosum virus
acgcauguacgcggcgg

SEQ ID NO: 4038810 - RNA, 23 nt, Molluscum contagiosum virus
acgccaacuucgucucgagcuuc

SEQ ID NO: 4038811 - RNA, 13 nt, Molluscum contagiosum virus
acgccagcgacgc

SEQ ID NO: 4038812 - RNA, 12 nt, Molluscum contagiosum virus
acgccagcgcgc

SEQ ID NO: 4038813 - RNA, 18 nt, Molluscum contagiosum virus
acgccgagcccgagcccg

SEQ ID NO: 4038814 - RNA, 19 nt, Molluscum contagiosum virus
acgccgcgcaccuggagua

SEQ ID NO: 4038815 - RNA, 22 nt, Molluscum contagiosum virus
acgccgcguucuucguggcgcu

SEQ ID NO: 4038816 - RNA, 14 nt, Molluscum contagiosum virus
acgccgcuggagca

SEQ ID NO: 4038817 - RNA, 12 nt, Molluscum contagiosum virus
acgccggcaagc

SEQ ID NO: 4038818 - RNA, 18 nt, Molluscum contagiosum virus
acgccgggcacgcccgcg

SEQ ID NO: 4038819 - RNA, 15 nt, Molluscum contagiosum virus
acgccuucguggagc

SEQ ID NO: 4038820 - RNA, 16 nt, Molluscum contagiosum virus
acgcgaacugcccgag

SEQ ID NO: 4038821 - RNA, 17 nt, Molluscum contagiosum virus
acgcgacuucgcccgug

SEQ ID NO: 4038822 - RNA, 18 nt, Molluscum contagiosum virus
acgcgcacgcgcacacgc

SEQ ID NO: 4038823 - RNA, 16 nt, Molluscum contagiosum virus
acgcgcacgggccugc

SEQ ID NO: 4038824 - RNA, 20 nt, Molluscum contagiosum virus
acgcgcacgggccugcgcgc

SEQ ID NO: 4038825 - RNA, 15 nt, Molluscum contagiosum virus
acgcgcagugcggcc

SEQ ID NO: 4038826 - RNA, 23 nt, Molluscum contagiosum virus
acgcgccagugcgugcacugucu

SEQ ID NO: 4038827 - RNA, 18 nt, Molluscum contagiosum virus
acgcgcccuggagcgcag

SEQ ID NO: 4038828 - RNA, 19 nt, Molluscum contagiosum virus
acgcgccgacaugcgcacg

SEQ ID NO: 4038829 - RNA, 22 nt, Molluscum contagiosum virus
acgcgccgaggacuaccuggcg

SEQ ID NO: 4038830 - RNA, 17 nt, Molluscum contagiosum virus
acgcgcgcgccucgcca

SEQ ID NO: 4038831 - RNA, 17 nt, Molluscum contagiosum virus
acgcgcgcgugcugcua

SEQ ID NO: 4038832 - RNA, 14 nt, Molluscum contagiosum virus
acgcgcggcggcgc

SEQ ID NO: 4038833 - RNA, 22 nt, Molluscum contagiosum virus
acgcgcguccgcaggcgucaug

SEQ ID NO: 4038834 - RNA, 17 nt, Molluscum contagiosum virus
acgcgcguggagcgcgc

SEQ ID NO: 4038835 - RNA, 20 nt, Molluscum contagiosum virus
acgcgcugcgccacugccac

SEQ ID NO: 4038836 - RNA, 14 nt, Molluscum contagiosum virus
acgcgcuugcgcgg

SEQ ID NO: 4038837 - RNA, 19 nt, Molluscum contagiosum virus
acgcggcucuggagcggcc

SEQ ID NO: 4038838 - RNA, 23 nt, Molluscum contagiosum virus
acgcggugugcacaugcccgugc

SEQ ID NO: 4038839 - RNA, 23 nt, Molluscum contagiosum virus
acgcguacguguccaugcacgac

SEQ ID NO: 4038840 - RNA, 16 nt, Molluscum contagiosum virus
acgcgucgcgcgccgc

SEQ ID NO: 4038841 - RNA, 21 nt, Molluscum contagiosum virus
acgcgugccuggcuugcgcgc

SEQ ID NO: 4038842 - RNA, 15 nt, Molluscum contagiosum virus
acgcgugcugcgcgg

SEQ ID NO: 4038843 - RNA, 13 nt, Molluscum contagiosum virus
acgcgugugcgag

SEQ ID NO: 4038844 - RNA, 21 nt, Molluscum contagiosum virus
acgcguucuagcagcgugcgc

SEQ ID NO: 4038845 - RNA, 23 nt, Molluscum contagiosum virus
acgcuaaagucgcgcgugcgcag

SEQ ID NO: 4038846 - RNA, 15 nt, Molluscum contagiosum virus
acgcuagcuacgagu

SEQ ID NO: 4038847 - RNA, 13 nt, Molluscum contagiosum virus
acgcucacggccu

SEQ ID NO: 4038848 - RNA, 20 nt, Molluscum contagiosum virus
acgcucgcgcgcaugcucgc

SEQ ID NO: 4038849 - RNA, 22 nt, Molluscum contagiosum virus
acgcucgcgcuguauucggcgu

SEQ ID NO: 4038850 - RNA, 21 nt, Molluscum contagiosum virus
acgcugcacaugugcgugcac

SEQ ID NO: 4038851 - RNA, 18 nt, Molluscum contagiosum virus
acgcugcacgagcugcug

SEQ ID NO: 4038852 - RNA, 15 nt, Molluscum contagiosum virus
acgcugcggcggcgc

SEQ ID NO: 4038853 - RNA, 16 nt, Molluscum contagiosum virus
acgcugcucgugcugc

SEQ ID NO: 4038854 - RNA, 18 nt, Molluscum contagiosum virus
caguccgcggcgcgccgg

SEQ ID NO: 4038855 - RNA, 19 nt, Molluscum contagiosum virus
cagucgccuuccugcgccc

SEQ ID NO: 4038856 - RNA, 14 nt, Molluscum contagiosum virus
cagucuccacgcgu

SEQ ID NO: 4038857 - RNA, 12 nt, Molluscum contagiosum virus
cagucucgcgcu

SEQ ID NO: 4038858 - RNA, 20 nt, Molluscum contagiosum virus
cagugccgccgcgcaaaagc

SEQ ID NO: 4038859 - RNA, 19 nt, Molluscum contagiosum virus
cagugcggcgcggcugcuc

SEQ ID NO: 4038860 - RNA, 15 nt, Molluscum contagiosum virus
cagugcgugccaggc

SEQ ID NO: 4038861 - RNA, 9 nt, Molluscum contagiosum virus
cagugucuu

SEQ ID NO: 4038862 - RNA, 20 nt, Molluscum contagiosum virus
caguuagaaaugcuugcuuc

SEQ ID NO: 4038863 - RNA, 14 nt, Molluscum contagiosum virus
caguuccgaucgcg

SEQ ID NO: 4038864 - RNA, 15 nt, Molluscum contagiosum virus
caguucgagcugcug

SEQ ID NO: 4038865 - RNA, 16 nt, Molluscum contagiosum virus
caguucgagcugcugc

SEQ ID NO: 4038866 - RNA, 17 nt, Molluscum contagiosum virus
caguucggccgcacgug

SEQ ID NO: 4038867 - RNA, 19 nt, Molluscum contagiosum virus
cauacgcagaggcgcgucc

SEQ ID NO: 4038868 - RNA, 14 nt, Molluscum contagiosum virus
cauacuccugcugg

SEQ ID NO: 4038869 - RNA, 15 nt, Molluscum contagiosum virus
cauacuccugcuggc

SEQ ID NO: 4038870 - RNA, 19 nt, Molluscum contagiosum virus
cauagcccaugcgcagugc

SEQ ID NO: 4038871 - RNA, 17 nt, Molluscum contagiosum virus
cauagcgcaccagcugc

SEQ ID NO: 4038872 - RNA, 14 nt, Molluscum contagiosum virus
cauagcgccacgag

SEQ ID NO: 4038873 - RNA, 13 nt, Molluscum contagiosum virus
caucaccccgcug

SEQ ID NO: 4038874 - RNA, 22 nt, Molluscum contagiosum virus
caucagagaagugcuccgcacg

SEQ ID NO: 4038875 - RNA, 18 nt, Molluscum contagiosum virus
caucaucgccagcaucaa

SEQ ID NO: 4038876 - RNA, 19 nt, Molluscum contagiosum virus
caucccgcacgugggcuac

SEQ ID NO: 4038877 - RNA, 20 nt, Molluscum contagiosum virus
cauccuugauaaaagcacag

SEQ ID NO: 4038878 - RNA, 21 nt, Molluscum contagiosum virus
caucgagcugcagagcgugcu

SEQ ID NO: 4038879 - RNA, 13 nt, Molluscum contagiosum virus
caucgcgcugcug

SEQ ID NO: 4038880 - RNA, 15 nt, Molluscum contagiosum virus
caucgcgcugcuggu

SEQ ID NO: 4038881 - RNA, 18 nt, Molluscum contagiosum virus
caucgcgcugcuggugcu

SEQ ID NO: 4038882 - RNA, 21 nt, Molluscum contagiosum virus
caucggagaagugcuccgcac

SEQ ID NO: 4038883 - RNA, 22 nt, Molluscum contagiosum virus
caucggagaagugcuccgcacg

SEQ ID NO: 4038884 - RNA, 14 nt, Molluscum contagiosum virus
caucgggcugcagc

SEQ ID NO: 4038885 - RNA, 21 nt, Molluscum contagiosum virus
caucgggcugcagcccuucca

SEQ ID NO: 4038886 - RNA, 15 nt, Molluscum contagiosum virus
caucuacagccgccu

SEQ ID NO: 4038887 - RNA, 17 nt, Molluscum contagiosum virus
caucucgauggcgccgu

SEQ ID NO: 4038888 - RNA, 22 nt, Molluscum contagiosum virus
caucucgcacacugcagcacgu

SEQ ID NO: 4038889 - RNA, 17 nt, Molluscum contagiosum virus
caucucgcagacgcagc

SEQ ID NO: 4038890 - RNA, 15 nt, Molluscum contagiosum virus
caucucgugcaugac

SEQ ID NO: 4038891 - RNA, 16 nt, Molluscum contagiosum virus
caucucucagggcagc

SEQ ID NO: 4038892 - RNA, 16 nt, Molluscum contagiosum virus
caucuucaagccgcag

SEQ ID NO: 4038893 - RNA, 21 nt, Molluscum contagiosum virus
caugaacaacauggugcuggc

SEQ ID NO: 4038894 - RNA, 23 nt, Molluscum contagiosum virus
caugaacucgcugcugcucuucc

SEQ ID NO: 4038895 - RNA, 16 nt, Molluscum contagiosum virus
caugaccgcucgcgga

SEQ ID NO: 4038896 - RNA, 15 nt, Molluscum contagiosum virus
caugacgacgccgga

SEQ ID NO: 4038897 - RNA, 16 nt, Molluscum contagiosum virus
caugaggggcggagac

SEQ ID NO: 4038898 - RNA, 15 nt, Molluscum contagiosum virus
caugcacagcugcuc

SEQ ID NO: 4038899 - RNA, 14 nt, Molluscum contagiosum virus
caugcccggccucg

SEQ ID NO: 4038900 - RNA, 14 nt, Molluscum contagiosum virus
caugcgacugccag

SEQ ID NO: 4038901 - RNA, 16 nt, Molluscum contagiosum virus
caugcgacugccagcc

SEQ ID NO: 4038902 - RNA, 17 nt, Molluscum contagiosum virus
caugcgcaagcagcucg

SEQ ID NO: 4038903 - RNA, 19 nt, Molluscum contagiosum virus
caugcgcaagcgcuaugcu

SEQ ID NO: 4038904 - RNA, 14 nt, Molluscum contagiosum virus
caugcgcccucacg

SEQ ID NO: 4038905 - RNA, 16 nt, Molluscum contagiosum virus
caugcgcgcgcgcucg

SEQ ID NO: 4038906 - RNA, 14 nt, Molluscum contagiosum virus
caugcggagcuggc

SEQ ID NO: 4038907 - RNA, 23 nt, Molluscum contagiosum virus
caugcucgcggucgggccccugc

SEQ ID NO: 4038908 - RNA, 21 nt, Molluscum contagiosum virus
caugcugucucugucccugca

SEQ ID NO: 4038909 - RNA, 20 nt, Molluscum contagiosum virus
caugcugugcggcacgccug

SEQ ID NO: 4038910 - RNA, 16 nt, Molluscum contagiosum virus
caugucacgcucacgc

SEQ ID NO: 4038911 - RNA, 22 nt, Molluscum contagiosum virus
caugucgagaccuuccuccagg

SEQ ID NO: 4038912 - RNA, 21 nt, Molluscum contagiosum virus
cauguugcucuaccuggugcu

SEQ ID NO: 4038913 - RNA, 19 nt, Molluscum contagiosum virus
cauuguaaaacgacagacc

SEQ ID NO: 4038914 - RNA, 14 nt, Molluscum contagiosum virus
ccaaaucgccgccc

SEQ ID NO: 4038915 - RNA, 22 nt, Molluscum contagiosum virus
ccaacacguuuucuuucauggc

SEQ ID NO: 4038916 - RNA, 23 nt, Molluscum contagiosum virus
ccaacacguuuucuuucauggcu

SEQ ID NO: 4038917 - RNA, 16 nt, Molluscum contagiosum virus
ccaacacuaccacagc

SEQ ID NO: 4038918 - RNA, 15 nt, Molluscum contagiosum virus
ccaaccgccugcucu

SEQ ID NO: 4038919 - RNA, 15 nt, Molluscum contagiosum virus
ccaacuaccuggggc

SEQ ID NO: 4038920 - RNA, 23 nt, Molluscum contagiosum virus
ccaagaacaauacaaacaacaac

SEQ ID NO: 4038921 - RNA, 23 nt, Molluscum contagiosum virus
ccaagaacagagaaaggcaccca

SEQ ID NO: 4038922 - RNA, 19 nt, Molluscum contagiosum virus
ccaagaagaggccagcaca

SEQ ID NO: 4038923 - RNA, 19 nt, Molluscum contagiosum virus
ccaagcacauucucaacca

SEQ ID NO: 4038924 - RNA, 16 nt, Molluscum contagiosum virus
ccaaggacgacaacac

SEQ ID NO: 4038925 - RNA, 20 nt, Molluscum contagiosum virus
ccaagggcguagagcaauac

SEQ ID NO: 4038926 - RNA, 20 nt, Molluscum contagiosum virus
ccaaguccgagcaagcgggc

SEQ ID NO: 4038927 - RNA, 16 nt, Molluscum contagiosum virus
ccaagucgcgcucuuc

SEQ ID NO: 4038928 - RNA, 22 nt, Molluscum contagiosum virus
ccaagugcgcgugucuggagcc

SEQ ID NO: 4038929 - RNA, 20 nt, Molluscum contagiosum virus
ccacaaagcccuccugagaa

SEQ ID NO: 4038930 - RNA, 22 nt, Molluscum contagiosum virus
ccacaccgggaauggccgcgag

SEQ ID NO: 4038931 - RNA, 19 nt, Molluscum contagiosum virus
ccacaugaccaagcacauu

SEQ ID NO: 4038932 - RNA, 22 nt, Molluscum contagiosum virus
ccacauuucaaaaacgcgcccc

SEQ ID NO: 4038933 - RNA, 11 nt, Molluscum contagiosum virus
ccaccaccagc

SEQ ID NO: 4038934 - RNA, 12 nt, Molluscum contagiosum virus
ccaccagcacca

SEQ ID NO: 4038935 - RNA, 14 nt, Molluscum contagiosum virus
ccaccagcaccagc

SEQ ID NO: 4038936 - RNA, 13 nt, Molluscum contagiosum virus
ccaccagcagcca

SEQ ID NO: 4038937 - RNA, 14 nt, Molluscum contagiosum virus
ccaccagcagccag

SEQ ID NO: 4038938 - RNA, 12 nt, Molluscum contagiosum virus
ccaccagcugcc

SEQ ID NO: 4038939 - RNA, 14 nt, Molluscum contagiosum virus
ccaccaggaacagg

SEQ ID NO: 4038940 - RNA, 20 nt, Molluscum contagiosum virus
ccacgagcguguccaggugc

SEQ ID NO: 4038941 - RNA, 21 nt, Molluscum contagiosum virus
ccacgcccgagggcgggcacg

SEQ ID NO: 4038942 - RNA, 14 nt, Molluscum contagiosum virus
ccacgcccgggccc

SEQ ID NO: 4038943 - RNA, 19 nt, Molluscum contagiosum virus
ccacgccgucgaaguacuu

SEQ ID NO: 4038944 - RNA, 14 nt, Molluscum contagiosum virus
ccacgcgggcccgu

SEQ ID NO: 4038945 - RNA, 14 nt, Molluscum contagiosum virus
ccacgcgugcugcg

SEQ ID NO: 4038946 - RNA, 18 nt, Molluscum contagiosum virus
ccacgcucgcgcgcaugc

SEQ ID NO: 4038947 - RNA, 13 nt, Molluscum contagiosum virus
ccacggcgcgccg

SEQ ID NO: 4038948 - RNA, 20 nt, Molluscum contagiosum virus
ccacggcgcgccgccggugc

SEQ ID NO: 4038949 - RNA, 16 nt, Molluscum contagiosum virus
ccacgggcuucgcugc

SEQ ID NO: 4038950 - RNA, 16 nt, Molluscum contagiosum virus
ccacggguaccgugcg

SEQ ID NO: 4038951 - RNA, 15 nt, Molluscum contagiosum virus
ccacgugccagaguc

SEQ ID NO: 4038952 - RNA, 18 nt, Molluscum contagiosum virus
ccacgugccagagucgcc

SEQ ID NO: 4038953 - RNA, 18 nt, Molluscum contagiosum virus
ccacgugcgcuggcccac

SEQ ID NO: 4038954 - RNA, 15 nt, Molluscum contagiosum virus
ccacgugcucaagug

SEQ ID NO: 4038955 - RNA, 23 nt, Molluscum contagiosum virus
ccacgugguccaccagcacgaag

SEQ ID NO: 4038956 - RNA, 19 nt, Molluscum contagiosum virus
ccacguggugguuggcgug

SEQ ID NO: 4038957 - RNA, 19 nt, Molluscum contagiosum virus
ccacguugccgcgcgcugc

SEQ ID NO: 4038958 - RNA, 15 nt, Molluscum contagiosum virus
ccacugugccagcag

SEQ ID NO: 4038959 - RNA, 17 nt, Molluscum contagiosum virus
ccagaggguggcuugcu

SEQ ID NO: 4038960 - RNA, 14 nt, Molluscum contagiosum virus
ccagcacugcgcca

SEQ ID NO: 4038961 - RNA, 12 nt, Molluscum contagiosum virus
ccagcagcgaga

SEQ ID NO: 4038962 - RNA, 16 nt, Molluscum contagiosum virus
ccagcagcuccuggua

SEQ ID NO: 4038963 - RNA, 12 nt, Molluscum contagiosum virus
ccagcagcugcu

SEQ ID NO: 4038964 - RNA, 15 nt, Molluscum contagiosum virus
ccagccacgaagagu

SEQ ID NO: 4038965 - RNA, 16 nt, Molluscum contagiosum virus
ccagccaucgugcgcg

SEQ ID NO: 4038966 - RNA, 15 nt, Molluscum contagiosum virus
ccagcccgcggugcg

SEQ ID NO: 4038967 - RNA, 19 nt, Molluscum contagiosum virus
ccagcccgcugcgcauggc

SEQ ID NO: 4038968 - RNA, 22 nt, Molluscum contagiosum virus
ccagcgacaccgacgaggugcg

SEQ ID NO: 4038969 - RNA, 14 nt, Molluscum contagiosum virus
ccagcgacgagcag

SEQ ID NO: 4038970 - RNA, 18 nt, Molluscum contagiosum virus
ccagcgauugcccgcgcg

SEQ ID NO: 4038971 - RNA, 18 nt, Molluscum contagiosum virus
ccagcgccucugcgagau

SEQ ID NO: 4038972 - RNA, 20 nt, Molluscum contagiosum virus
ccagcgcgcccaccagcagc

SEQ ID NO: 4038973 - RNA, 22 nt, Molluscum contagiosum virus
ccagcgcgcgccuugcagcgca

SEQ ID NO: 4038974 - RNA, 19 nt, Molluscum contagiosum virus
ccagcgcgcucgaggcgcc

SEQ ID NO: 4038975 - RNA, 21 nt, Molluscum contagiosum virus
ccagcggauaugcgccugugc

SEQ ID NO: 4038976 - RNA, 11 nt, Molluscum contagiosum virus
ccagcggcgcc

SEQ ID NO: 4038977 - RNA, 23 nt, Molluscum contagiosum virus
ccagcguaaugaagcgcugugcg

SEQ ID NO: 4038978 - RNA, 16 nt, Molluscum contagiosum virus
ccagcgucgcgcgccg

SEQ ID NO: 4038979 - RNA, 22 nt, Molluscum contagiosum virus
ccagcgugcagacgaccgucac

SEQ ID NO: 4038980 - RNA, 15 nt, Molluscum contagiosum virus
ccagcgugugaccgc

SEQ ID NO: 4038981 - RNA, 19 nt, Molluscum contagiosum virus
ccagcuaagccggagcagc

SEQ ID NO: 4038982 - RNA, 15 nt, Molluscum contagiosum virus
ccagcuccgccggga

SEQ ID NO: 4038983 - RNA, 21 nt, Molluscum contagiosum virus
ccagcucggguuccagcuccg

SEQ ID NO: 4038984 - RNA, 23 nt, Molluscum contagiosum virus
ccagcucggguuccagcuccggc

SEQ ID NO: 4038985 - RNA, 13 nt, Molluscum contagiosum virus
ccagcugcgcgag

SEQ ID NO: 4038986 - RNA, 18 nt, Molluscum contagiosum virus
ccagcuggacggugcugg

SEQ ID NO: 4038987 - RNA, 21 nt, Molluscum contagiosum virus
ccaggaaaacggaaacagcac

SEQ ID NO: 4038988 - RNA, 23 nt, Molluscum contagiosum virus
ccaggaaaggcaggagccucugu

SEQ ID NO: 4038989 - RNA, 15 nt, Molluscum contagiosum virus
ccaggaacaguaccg

SEQ ID NO: 4038990 - RNA, 14 nt, Molluscum contagiosum virus
ccaggaacgcgccg

SEQ ID NO: 4038991 - RNA, 12 nt, Molluscum contagiosum virus
ccaggcacuggc

SEQ ID NO: 4038992 - RNA, 13 nt, Molluscum contagiosum virus
ccaggccgcgccg

SEQ ID NO: 4038993 - RNA, 11 nt, Molluscum contagiosum virus
ccaggcgccgg

SEQ ID NO: 4038994 - RNA, 13 nt, Molluscum contagiosum virus
ccaggugcugggc

SEQ ID NO: 4038995 - RNA, 14 nt, Molluscum contagiosum virus
ccaggugcugggcg

SEQ ID NO: 4038996 - RNA, 21 nt, Molluscum contagiosum virus
ccaguagcgaaugcagugccc

SEQ ID NO: 4038997 - RNA, 17 nt, Molluscum contagiosum virus
ccagucgcgcgagaagu

SEQ ID NO: 4038998 - RNA, 20 nt, Molluscum contagiosum virus
ccagucucgaugugacaaca

SEQ ID NO: 4038999 - RNA, 17 nt, Molluscum contagiosum virus
ccagugcgugcacuguc

SEQ ID NO: 4039000 - RNA, 15 nt, Molluscum contagiosum virus
ccaucgaaacucugc

SEQ ID NO: 4039001 - RNA, 12 nt, Molluscum contagiosum virus
ccaucuccuugu

SEQ ID NO: 4039002 - RNA, 22 nt, Molluscum contagiosum virus
ccaugaacaacauggugcuggc

SEQ ID NO: 4039003 - RNA, 18 nt, Molluscum contagiosum virus
ccaugaucauggcgccgc

SEQ ID NO: 4039004 - RNA, 15 nt, Molluscum contagiosum virus
ccaugcgcagugccu

SEQ ID NO: 4039005 - RNA, 15 nt, Molluscum contagiosum virus
ccaugcuccugaucu

SEQ ID NO: 4039006 - RNA, 12 nt, Molluscum contagiosum virus
ccaugcugaucu

SEQ ID NO: 4039007 - RNA, 17 nt, Molluscum contagiosum virus
ccauggacacgcugcgc

SEQ ID NO: 4039008 - RNA, 20 nt, Molluscum contagiosum virus
ccauggagcgcccgcugcuc

SEQ ID NO: 4039009 - RNA, 23 nt, Molluscum contagiosum virus
ccauggcgagcuagugcacaccg

SEQ ID NO: 4039010 - RNA, 16 nt, Molluscum contagiosum virus
ccauggucacgcgcac

SEQ ID NO: 4039011 - RNA, 16 nt, Molluscum contagiosum virus
ccaugugucuuguggc

SEQ ID NO: 4039012 - RNA, 20 nt, Molluscum contagiosum virus
cccaaaagugaagaucaagc

SEQ ID NO: 4039013 - RNA, 16 nt, Molluscum contagiosum virus
cccaagggcguagagc

SEQ ID NO: 4039014 - RNA, 14 nt, Molluscum contagiosum virus
cccaccagcagcca

SEQ ID NO: 4039015 - RNA, 17 nt, Molluscum contagiosum virus
cccaccagcagccaggc

SEQ ID NO: 4039016 - RNA, 12 nt, Molluscum contagiosum virus
cccacgagcgcc

SEQ ID NO: 4039017 - RNA, 12 nt, Molluscum contagiosum virus
cccacgcuggcg

SEQ ID NO: 4039018 - RNA, 14 nt, Molluscum contagiosum virus
cccacugugccagc

SEQ ID NO: 4039019 - RNA, 19 nt, Molluscum contagiosum virus
cccagaaaacgcacugucg

SEQ ID NO: 4039020 - RNA, 16 nt, Molluscum contagiosum virus
cccagcagcgaggccg

SEQ ID NO: 4039021 - RNA, 20 nt, Molluscum contagiosum virus
cccagcucgaugggcuccag

SEQ ID NO: 4039022 - RNA, 20 nt, Molluscum contagiosum virus
cccaggccauggagcgcccg

SEQ ID NO: 4039023 - RNA, 17 nt, Molluscum contagiosum virus
cccaggcgcgcgcucag

SEQ ID NO: 4039024 - RNA, 23 nt, Molluscum contagiosum virus
cccauacucgaacgcaaggugug

SEQ ID NO: 4039025 - RNA, 19 nt, Molluscum contagiosum virus
cccaugcucaccgccgaga

SEQ ID NO: 4039026 - RNA, 23 nt, Molluscum contagiosum virus
ccccaaaagugaagaucaagcac

SEQ ID NO: 4039027 - RNA, 21 nt, Molluscum contagiosum virus
ccccaugcccgaccacgugcc

SEQ ID NO: 4039028 - RNA, 12 nt, Molluscum contagiosum virus
cccccgcggagc

SEQ ID NO: 4039029 - RNA, 20 nt, Molluscum contagiosum virus
ccccgaacugcugggcgugg

SEQ ID NO: 4039030 - RNA, 22 nt, Molluscum contagiosum virus
ccccgagggcgcgaccggcgug

SEQ ID NO: 4039031 - RNA, 16 nt, Molluscum contagiosum virus
ccccgcgcgcagcgcg

SEQ ID NO: 4039032 - RNA, 20 nt, Molluscum contagiosum virus
ccccgcgcgcccgcugcgcg

SEQ ID NO: 4039033 - RNA, 19 nt, Molluscum contagiosum virus
ccccgcugggccgcaugca

SEQ ID NO: 4039034 - RNA, 15 nt, Molluscum contagiosum virus
ccccggcgccggcac

SEQ ID NO: 4039035 - RNA, 19 nt, Molluscum contagiosum virus
ccccugcugcucgcggagg

SEQ ID NO: 4039036 - RNA, 13 nt, Molluscum contagiosum virus
cccgacucgcagc

SEQ ID NO: 4039037 - RNA, 16 nt, Molluscum contagiosum virus
cccgacuuuucgcgcc

SEQ ID NO: 4039038 - RNA, 18 nt, Molluscum contagiosum virus
cccgacuuuucgcgccgc

SEQ ID NO: 4039039 - RNA, 16 nt, Molluscum contagiosum virus
cccgagagugacgccu

SEQ ID NO: 4039040 - RNA, 12 nt, Molluscum contagiosum virus
cccgagcccgcg

SEQ ID NO: 4039041 - RNA, 22 nt, Molluscum contagiosum virus
cccgagcccgcggcgcgcagcu

SEQ ID NO: 4039042 - RNA, 16 nt, Molluscum contagiosum virus
cccgagcuacugcgcg

SEQ ID NO: 4039043 - RNA, 21 nt, Molluscum contagiosum virus
cccgagcucgacugcguuguc

SEQ ID NO: 4039044 - RNA, 15 nt, Molluscum contagiosum virus
cccgagcugcgugug

SEQ ID NO: 4039045 - RNA, 17 nt, Molluscum contagiosum virus
cccgagcugcgugugcc

SEQ ID NO: 4039046 - RNA, 14 nt, Molluscum contagiosum virus
cccgagcuggugau

SEQ ID NO: 4039047 - RNA, 20 nt, Molluscum contagiosum virus
cccgcaaaccuuggcccuuu

SEQ ID NO: 4039048 - RNA, 23 nt, Molluscum contagiosum virus
cccgcaggaaaggcaccccgcag

SEQ ID NO: 4039049 - RNA, 23 nt, Molluscum contagiosum virus
cccgcaggaaagguaccccgcag

SEQ ID NO: 4039050 - RNA, 17 nt, Molluscum contagiosum virus
cccgccagaagugaaau

SEQ ID NO: 4039051 - RNA, 13 nt, Molluscum contagiosum virus
cccgcgaagagca

SEQ ID NO: 4039052 - RNA, 17 nt, Molluscum contagiosum virus
cccgcgagcacgggcgc

SEQ ID NO: 4039053 - RNA, 14 nt, Molluscum contagiosum virus
cccgcgauuuacuu

SEQ ID NO: 4039054 - RNA, 22 nt, Molluscum contagiosum virus
cccgcgcaagagccgccggggc

SEQ ID NO: 4039055 - RNA, 15 nt, Molluscum contagiosum virus
cccgcgcagcgugcc

SEQ ID NO: 4039056 - RNA, 18 nt, Molluscum contagiosum virus
cccgcgcguugcugcccg

SEQ ID NO: 4039057 - RNA, 13 nt, Molluscum contagiosum virus
cccgcgcucgccg

SEQ ID NO: 4039058 - RNA, 17 nt, Molluscum contagiosum virus
cccgcggacgcgcagcu

SEQ ID NO: 4039059 - RNA, 16 nt, Molluscum contagiosum virus
cccgcggcgugcccgu

SEQ ID NO: 4039060 - RNA, 18 nt, Molluscum contagiosum virus
cccgcggcgugcccgucu

SEQ ID NO: 4039061 - RNA, 12 nt, Molluscum contagiosum virus
cccgcgggccgc

SEQ ID NO: 4039062 - RNA, 18 nt, Molluscum contagiosum virus
cccgcuaugaacagcgcg

SEQ ID NO: 4039063 - RNA, 14 nt, Molluscum contagiosum virus
cccgcugcgcgcuc

SEQ ID NO: 4039064 - RNA, 13 nt, Molluscum contagiosum virus
cccgcugcucuac

SEQ ID NO: 4039065 - RNA, 17 nt, Molluscum contagiosum virus
cccgcuggcggcgcacg

SEQ ID NO: 4039066 - RNA, 19 nt, Molluscum contagiosum virus
cccgcuggcggcgcacgcg

SEQ ID NO: 4039067 - RNA, 16 nt, Molluscum contagiosum virus
cccgcuuccgcggccg

SEQ ID NO: 4039068 - RNA, 17 nt, Molluscum contagiosum virus
cccggaaagcagcaaac

SEQ ID NO: 4039069 - RNA, 14 nt, Molluscum contagiosum virus
cccggaauuccgug

SEQ ID NO: 4039070 - RNA, 17 nt, Molluscum contagiosum virus
cccggaucagccccgcg

SEQ ID NO: 4039071 - RNA, 18 nt, Molluscum contagiosum virus
cccggcacgugccccgcg

SEQ ID NO: 4039072 - RNA, 17 nt, Molluscum contagiosum virus
cccggcaggcucccgcu

SEQ ID NO: 4039073 - RNA, 21 nt, Molluscum contagiosum virus
cccggcaggcucccgcugucg

SEQ ID NO: 4039074 - RNA, 15 nt, Molluscum contagiosum virus
cccggccucgccucc

SEQ ID NO: 4039075 - RNA, 21 nt, Molluscum contagiosum virus
cccggcggcccgcggcgcgcc

SEQ ID NO: 4039076 - RNA, 17 nt, Molluscum contagiosum virus
cccggcgggcucuuccu

SEQ ID NO: 4039077 - RNA, 14 nt, Molluscum contagiosum virus
cccgggcccggguu

SEQ ID NO: 4039078 - RNA, 17 nt, Molluscum contagiosum virus
cccguaggcgggccugc

SEQ ID NO: 4039079 - RNA, 17 nt, Molluscum contagiosum virus
cccguccucgcucgugc

SEQ ID NO: 4039080 - RNA, 16 nt, Molluscum contagiosum virus
cccguccuugcucugg

SEQ ID NO: 4039081 - RNA, 21 nt, Molluscum contagiosum virus
cccgucuccacaaagacgggc

SEQ ID NO: 4039082 - RNA, 14 nt, Molluscum contagiosum virus
cccgugcgcgcgcu

SEQ ID NO: 4039083 - RNA, 22 nt, Molluscum contagiosum virus
cccgugcucaggccagcaucuu

SEQ ID NO: 4039084 - RNA, 20 nt, Molluscum contagiosum virus
cccgugcuggagggcacgcu

SEQ ID NO: 4039085 - RNA, 16 nt, Molluscum contagiosum virus
cccgugcuugcgcacg

SEQ ID NO: 4039086 - RNA, 11 nt, Molluscum contagiosum virus
cccgugguggg

SEQ ID NO: 4039087 - RNA, 19 nt, Molluscum contagiosum virus
cccgugucgggcugcaucu

SEQ ID NO: 4039088 - RNA, 21 nt, Molluscum contagiosum virus
cccguguucgcggagcugugc

SEQ ID NO: 4039089 - RNA, 18 nt, Molluscum contagiosum virus
cccucaggggcucuccua

SEQ ID NO: 4039090 - RNA, 19 nt, Molluscum contagiosum virus
cccucgcgcgcgcgcggcg

SEQ ID NO: 4039091 - RNA, 15 nt, Molluscum contagiosum virus
cccucguguacgaga

SEQ ID NO: 4039092 - RNA, 18 nt, Molluscum contagiosum virus
cccugcccgcgcgagacu

SEQ ID NO: 4039093 - RNA, 14 nt, Molluscum contagiosum virus
cccugcccgcguga

SEQ ID NO: 4039094 - RNA, 16 nt, Molluscum contagiosum virus
cccugguaguccugcu

SEQ ID NO: 4039095 - RNA, 19 nt, Molluscum contagiosum virus
cccugguuugcgcucucag

SEQ ID NO: 4039096 - RNA, 21 nt, Molluscum contagiosum virus
cccugguuugcgcucucagag

SEQ ID NO: 4039097 - RNA, 12 nt, Molluscum contagiosum virus
ccgaaagcugcc

SEQ ID NO: 4039098 - RNA, 15 nt, Molluscum contagiosum virus
ccgaagucgcagcag

SEQ ID NO: 4039099 - RNA, 17 nt, Molluscum contagiosum virus
ccgacaacgugcugcuc

SEQ ID NO: 4039100 - RNA, 22 nt, Molluscum contagiosum virus
ccgacaaggagggagagcugcc

SEQ ID NO: 4039101 - RNA, 14 nt, Molluscum contagiosum virus
ccgacggcgacgac

SEQ ID NO: 4039102 - RNA, 14 nt, Molluscum contagiosum virus
ccgacuccaaggag

SEQ ID NO: 4039103 - RNA, 17 nt, Molluscum contagiosum virus
ccgacuccuuccggaga

SEQ ID NO: 4039104 - RNA, 16 nt, Molluscum contagiosum virus
ccgacucgcagcucac

SEQ ID NO: 4039105 - RNA, 16 nt, Molluscum contagiosum virus
ccgacuuuucgcgccg

SEQ ID NO: 4039106 - RNA, 22 nt, Molluscum contagiosum virus
ccgagcaacucgcgagagacac

SEQ ID NO: 4039107 - RNA, 17 nt, Molluscum contagiosum virus
ccgagcaauugcugggc

SEQ ID NO: 4039108 - RNA, 20 nt, Molluscum contagiosum virus
ccgagcagaaggaagggccc

SEQ ID NO: 4039109 - RNA, 20 nt, Molluscum contagiosum virus
ccgagcccgcggcgcgcagc

SEQ ID NO: 4039110 - RNA, 19 nt, Molluscum contagiosum virus
ccgagccggacgcgcgaac

SEQ ID NO: 4039111 - RNA, 18 nt, Molluscum contagiosum virus
ccgagcgcgcgcgcugcu

SEQ ID NO: 4039112 - RNA, 23 nt, Molluscum contagiosum virus
ccgagcgcguccaugagcaucuc

SEQ ID NO: 4039113 - RNA, 22 nt, Molluscum contagiosum virus
ccgagcugcggcgcgugcugag

SEQ ID NO: 4039114 - RNA, 21 nt, Molluscum contagiosum virus
ccgaggacgacgccgagcccg

SEQ ID NO: 4039115 - RNA, 13 nt, Molluscum contagiosum virus
ccgaggaggugcu

SEQ ID NO: 4039116 - RNA, 15 nt, Molluscum contagiosum virus
ccgagggcgcgaccg

SEQ ID NO: 4039117 - RNA, 22 nt, Molluscum contagiosum virus
ccgaguauacucgacgcgcgcg

SEQ ID NO: 4039118 - RNA, 15 nt, Molluscum contagiosum virus
ccgagucacgcccca

SEQ ID NO: 4039119 - RNA, 15 nt, Molluscum contagiosum virus
ccgaucgcgagaacg

SEQ ID NO: 4039120 - RNA, 16 nt, Molluscum contagiosum virus
ccgaugcagugcggau

SEQ ID NO: 4039121 - RNA, 20 nt, Molluscum contagiosum virus
ccgcaaaauguagacgggcu

SEQ ID NO: 4039122 - RNA, 18 nt, Molluscum contagiosum virus
ccgcaaacacugucucug

SEQ ID NO: 4039123 - RNA, 14 nt, Molluscum contagiosum virus
ccgcaccagugccg

SEQ ID NO: 4039124 - RNA, 23 nt, Molluscum contagiosum virus
ccgcacuauggacgcuugcuagc

SEQ ID NO: 4039125 - RNA, 14 nt, Molluscum contagiosum virus
ccgcacucgccgcg

SEQ ID NO: 4039126 - RNA, 15 nt, Molluscum contagiosum virus
ccgcagaugcgcagc

SEQ ID NO: 4039127 - RNA, 16 nt, Molluscum contagiosum virus
ccgcagcaagcagccg

SEQ ID NO: 4039128 - RNA, 18 nt, Molluscum contagiosum virus
ccgcagcacgcgugugcg

SEQ ID NO: 4039129 - RNA, 15 nt, Molluscum contagiosum virus
ccgcagccacggccg

SEQ ID NO: 4039130 - RNA, 19 nt, Molluscum contagiosum virus
ccgcagcgcuggagcuggc

SEQ ID NO: 4039131 - RNA, 23 nt, Molluscum contagiosum virus
ccgcaggaaagguacccgcagga

SEQ ID NO: 4039132 - RNA, 18 nt, Molluscum contagiosum virus
ccgcaggaaccgcgugcg

SEQ ID NO: 4039133 - RNA, 17 nt, Molluscum contagiosum virus
ccgcaggccgggcaccc

SEQ ID NO: 4039134 - RNA, 22 nt, Molluscum contagiosum virus
ccgcaggcgucaugcgcgcgcg

SEQ ID NO: 4039135 - RNA, 20 nt, Molluscum contagiosum virus
ccgcagugcucgcacacgug

SEQ ID NO: 4039136 - RNA, 23 nt, Molluscum contagiosum virus
ccgcaguuggucaccgccuguac

SEQ ID NO: 4039137 - RNA, 16 nt, Molluscum contagiosum virus
ccgcauugggccuuga

SEQ ID NO: 4039138 - RNA, 20 nt, Molluscum contagiosum virus
ccgcauuuucucuggagagc

SEQ ID NO: 4039139 - RNA, 13 nt, Molluscum contagiosum virus
ccgccagcaccau

SEQ ID NO: 4039140 - RNA, 19 nt, Molluscum contagiosum virus
ccgccagcgucgcgcgccg

SEQ ID NO: 4039141 - RNA, 22 nt, Molluscum contagiosum virus
ccgccauuuccgagcgcgcacg

SEQ ID NO: 4039142 - RNA, 14 nt, Molluscum contagiosum virus
ccgcccccaggugg

SEQ ID NO: 4039143 - RNA, 22 nt, Molluscum contagiosum virus
ccgcccgggcguagccuagcca

SEQ ID NO: 4039144 - RNA, 21 nt, Molluscum contagiosum virus
ccgcccuuguggacgcgcgag

SEQ ID NO: 4039145 - RNA, 18 nt, Molluscum contagiosum virus
ccgccgcaacauagucaa

SEQ ID NO: 4039146 - RNA, 19 nt, Molluscum contagiosum virus
ccgccgcgcaaaagcacag

SEQ ID NO: 4039147 - RNA, 14 nt, Molluscum contagiosum virus
ccgccgcgugcccg

SEQ ID NO: 4039148 - RNA, 14 nt, Molluscum contagiosum virus
ccgccggcgccgcu

SEQ ID NO: 4039149 - RNA, 19 nt, Molluscum contagiosum virus
ccgccggugcgugcccagc

SEQ ID NO: 4039150 - RNA, 17 nt, Molluscum contagiosum virus
ccgccgucggcgugccg

SEQ ID NO: 4039151 - RNA, 14 nt, Molluscum contagiosum virus
ccgccugcugcagc

SEQ ID NO: 4039152 - RNA, 15 nt, Molluscum contagiosum virus
ccgcgacccagaagc

SEQ ID NO: 4039153 - RNA, 18 nt, Molluscum contagiosum virus
ccgcgagcacuggcuggc

SEQ ID NO: 4039154 - RNA, 20 nt, Molluscum contagiosum virus
ccgcgagcuaaucagcgcca

SEQ ID NO: 4039155 - RNA, 21 nt, Molluscum contagiosum virus
ccgcgaggacccgcgcuuugu

SEQ ID NO: 4039156 - RNA, 23 nt, Molluscum contagiosum virus
ccgcgcaauacgguggaggcgac

SEQ ID NO: 4039157 - RNA, 17 nt, Molluscum contagiosum virus
ccgcgcacugccacgcg

SEQ ID NO: 4039158 - RNA, 13 nt, Molluscum contagiosum virus
ccgcgcagcgugc

SEQ ID NO: 4039159 - RNA, 12 nt, Molluscum contagiosum virus
ccgcgccacgag

SEQ ID NO: 4039160 - RNA, 14 nt, Molluscum contagiosum virus
ccgcgccagcaguc

SEQ ID NO: 4039161 - RNA, 13 nt, Molluscum contagiosum virus
ccgcgccagcgac

SEQ ID NO: 4039162 - RNA, 17 nt, Molluscum contagiosum virus
ccgcgcccgcgcgcuuu

SEQ ID NO: 4039163 - RNA, 18 nt, Molluscum contagiosum virus
ccgcgcccgcggcgcacg

SEQ ID NO: 4039164 - RNA, 20 nt, Molluscum contagiosum virus
ccgcgcccgcggcgcacggc

SEQ ID NO: 4039165 - RNA, 21 nt, Molluscum contagiosum virus
ccgcgcccggcgggcacaucc

SEQ ID NO: 4039166 - RNA, 23 nt, Molluscum contagiosum virus
ccgcgccgaaacacggccuccag

SEQ ID NO: 4039167 - RNA, 22 nt, Molluscum contagiosum virus
ccgcgcgaacaaaaaacaacuc

SEQ ID NO: 4039168 - RNA, 21 nt, Molluscum contagiosum virus
ccgcgcgcgagcuggagcgcg

SEQ ID NO: 4039169 - RNA, 17 nt, Molluscum contagiosum virus
ccgcgcgcgccagcuau

SEQ ID NO: 4039170 - RNA, 20 nt, Molluscum contagiosum virus
ccgcgcgcgccagcuaugcg

SEQ ID NO: 4039171 - RNA, 16 nt, Molluscum contagiosum virus
ccgcgcgcgcgcgaac

SEQ ID NO: 4039172 - RNA, 21 nt, Molluscum contagiosum virus
ccgcgcguacgcugcucgaga

SEQ ID NO: 4039173 - RNA, 11 nt, Molluscum contagiosum virus
ccgcgcgucug

SEQ ID NO: 4039174 - RNA, 17 nt, Molluscum contagiosum virus
ccgcgcgucugcgagug

SEQ ID NO: 4039175 - RNA, 14 nt, Molluscum contagiosum virus
ccgcgcgugcaguu

SEQ ID NO: 4039176 - RNA, 15 nt, Molluscum contagiosum virus
ccgcgcucacugcag

SEQ ID NO: 4039177 - RNA, 21 nt, Molluscum contagiosum virus
ccgcgcucgccgcacgcgaag

SEQ ID NO: 4039178 - RNA, 23 nt, Molluscum contagiosum virus
ccgcgcugaugcuagcgugugcc

SEQ ID NO: 4039179 - RNA, 13 nt, Molluscum contagiosum virus
ccgcgcugcuggc

SEQ ID NO: 4039180 - RNA, 19 nt, Molluscum contagiosum virus
ccgcgcugguggccgcacu

SEQ ID NO: 4039181 - RNA, 16 nt, Molluscum contagiosum virus
ccgcgcuucugccugc

SEQ ID NO: 4039182 - RNA, 17 nt, Molluscum contagiosum virus
ccgcggaagugcgagcc

SEQ ID NO: 4039183 - RNA, 18 nt, Molluscum contagiosum virus
ccgcggacgccggcgccc

SEQ ID NO: 4039184 - RNA, 18 nt, Molluscum contagiosum virus
ccgcggacgcgggccugu

SEQ ID NO: 4039185 - RNA, 14 nt, Molluscum contagiosum virus
ccgcggacucgugc

SEQ ID NO: 4039186 - RNA, 20 nt, Molluscum contagiosum virus
ccgcggagggaggcucgagc

SEQ ID NO: 4039187 - RNA, 20 nt, Molluscum contagiosum virus
ccgcggcgugcagggcgugc

SEQ ID NO: 4039188 - RNA, 16 nt, Molluscum contagiosum virus
ccgcggcgugcccguc

SEQ ID NO: 4039189 - RNA, 17 nt, Molluscum contagiosum virus
ccgcggcugccucgugc

SEQ ID NO: 4039190 - RNA, 21 nt, Molluscum contagiosum virus
ccgcgggcgcagacgccgagc

SEQ ID NO: 4039191 - RNA, 18 nt, Molluscum contagiosum virus
ccgcgggcuggacugugc

SEQ ID NO: 4039192 - RNA, 22 nt, Molluscum contagiosum virus
ccgcggugcguugugcggggcu

SEQ ID NO: 4039193 - RNA, 17 nt, Molluscum contagiosum virus
ccgcgguggccgcgccg

SEQ ID NO: 4039194 - RNA, 23 nt, Molluscum contagiosum virus
ccgcguacacgugcacgcgcacg

SEQ ID NO: 4039195 - RNA, 22 nt, Molluscum contagiosum virus
ccgcguaccaccguggaggagc

SEQ ID NO: 4039196 - RNA, 14 nt, Molluscum contagiosum virus
ccgcguacgcgccg

SEQ ID NO: 4039197 - RNA, 15 nt, Molluscum contagiosum virus
ccgcgugcacccucc

SEQ ID NO: 4039198 - RNA, 15 nt, Molluscum contagiosum virus
ccgcgugcgugcaca

SEQ ID NO: 4039199 - RNA, 18 nt, Molluscum contagiosum virus
ccgcgugcucugcuccgc

SEQ ID NO: 4039200 - RNA, 12 nt, Molluscum contagiosum virus
ccgcgugcuggc

SEQ ID NO: 4039201 - RNA, 21 nt, Molluscum contagiosum virus
ccgcguucuucguggcgcugg

SEQ ID NO: 4039202 - RNA, 15 nt, Molluscum contagiosum virus
ccgcuaccagcucgc

SEQ ID NO: 4039203 - RNA, 19 nt, Molluscum contagiosum virus
ccgcuagagugcgcggaag

SEQ ID NO: 4039204 - RNA, 14 nt, Molluscum contagiosum virus
ccgcucgcgcugcu

SEQ ID NO: 4039205 - RNA, 15 nt, Molluscum contagiosum virus
ccgcucggaauuccu

SEQ ID NO: 4039206 - RNA, 16 nt, Molluscum contagiosum virus
ccgcucggcacugcug

SEQ ID NO: 4039207 - RNA, 19 nt, Molluscum contagiosum virus
ccgcucguccagcugcgcg

SEQ ID NO: 4039208 - RNA, 15 nt, Molluscum contagiosum virus
ccgcucguguuuguc

SEQ ID NO: 4039209 - RNA, 14 nt, Molluscum contagiosum virus
ccgcugagcgcagc

SEQ ID NO: 4039210 - RNA, 15 nt, Molluscum contagiosum virus
ccgcugagcgcagca

SEQ ID NO: 4039211 - RNA, 23 nt, Molluscum contagiosum virus
ccgcugcgcuggaugcugcucga

SEQ ID NO: 4039212 - RNA, 14 nt, Molluscum contagiosum virus
ccgcugcucgacau

SEQ ID NO: 4039213 - RNA, 23 nt, Molluscum contagiosum virus
ccgcuggaccccgagcugcggcg

SEQ ID NO: 4039214 - RNA, 19 nt, Molluscum contagiosum virus
ccgcuggggcggagagcuc

SEQ ID NO: 4039215 - RNA, 17 nt, Molluscum contagiosum virus
ccgcuggugggcgugcg

SEQ ID NO: 4039216 - RNA, 15 nt, Molluscum contagiosum virus
ccgcuuccuggcacu

SEQ ID NO: 4039217 - RNA, 21 nt, Molluscum contagiosum virus
ccgcuuccuggcacuggcgcg

SEQ ID NO: 4039218 - RNA, 20 nt, Molluscum contagiosum virus
ccggaaagauauacaccagg

SEQ ID NO: 4039219 - RNA, 17 nt, Molluscum contagiosum virus
ccggaauguagccuuug

SEQ ID NO: 4039220 - RNA, 15 nt, Molluscum contagiosum virus
ccggagacaccagcu

SEQ ID NO: 4039221 - RNA, 14 nt, Molluscum contagiosum virus
ccggagcgcggggc

SEQ ID NO: 4039222 - RNA, 23 nt, Molluscum contagiosum virus
ccggcaacgcugccgcuggcgcu

SEQ ID NO: 4039223 - RNA, 15 nt, Molluscum contagiosum virus
ccggcacgugccccg

SEQ ID NO: 4039224 - RNA, 14 nt, Molluscum contagiosum virus
ccggcagcgcgccu

SEQ ID NO: 4039225 - RNA, 15 nt, Molluscum contagiosum virus
ccggcagcuggagcu

SEQ ID NO: 4039226 - RNA, 16 nt, Molluscum contagiosum virus
ccggcagcuggagcug

SEQ ID NO: 4039227 - RNA, 17 nt, Molluscum contagiosum virus
ccggcagcuggagcugc

SEQ ID NO: 4039228 - RNA, 20 nt, Molluscum contagiosum virus
ccggcccgacacacuccugu

SEQ ID NO: 4039229 - RNA, 16 nt, Molluscum contagiosum virus
ccggccuagagcuggc

SEQ ID NO: 4039230 - RNA, 19 nt, Molluscum contagiosum virus
ccggcgaaccgacugcccg

SEQ ID NO: 4039231 - RNA, 23 nt, Molluscum contagiosum virus
ccggcgccgacagcgcgcgcacg

SEQ ID NO: 4039232 - RNA, 13 nt, Molluscum contagiosum virus
ccggcgcgccgcg

SEQ ID NO: 4039233 - RNA, 20 nt, Molluscum contagiosum virus
ccggcgcggcgagccgcgcg

SEQ ID NO: 4039234 - RNA, 15 nt, Molluscum contagiosum virus
ccggcgcucgccccu

SEQ ID NO: 4039235 - RNA, 13 nt, Molluscum contagiosum virus
ccggcgcucgccu

SEQ ID NO: 4039236 - RNA, 17 nt, Molluscum contagiosum virus
ccggcggcaagcgagau

SEQ ID NO: 4039237 - RNA, 20 nt, Molluscum contagiosum virus
ccggcggcccgcggcgcgcc

SEQ ID NO: 4039238 - RNA, 21 nt, Molluscum contagiosum virus
ccggcggcuggaccugcgcca

SEQ ID NO: 4039239 - RNA, 12 nt, Molluscum contagiosum virus
ccggcucugccu

SEQ ID NO: 4039240 - RNA, 15 nt, Molluscum contagiosum virus
ccgggaaacgcacag

SEQ ID NO: 4039241 - RNA, 20 nt, Molluscum contagiosum virus
ccgggagagccgcuccuggu

SEQ ID NO: 4039242 - RNA, 23 nt, Molluscum contagiosum virus
ccgggauuugccgguugcgcgug

SEQ ID NO: 4039243 - RNA, 20 nt, Molluscum contagiosum virus
ccgggccccugucgcgcacg

SEQ ID NO: 4039244 - RNA, 21 nt, Molluscum contagiosum virus
ccgggccugcggcggcgcacg

SEQ ID NO: 4039245 - RNA, 15 nt, Molluscum contagiosum virus
ccgggcgcugcaccg

SEQ ID NO: 4039246 - RNA, 23 nt, Molluscum contagiosum virus
ccggggaugaacgcgcugcgcca

SEQ ID NO: 4039247 - RNA, 21 nt, Molluscum contagiosum virus
ccggggcgcgcgcugcgcacg

SEQ ID NO: 4039248 - RNA, 23 nt, Molluscum contagiosum virus
cacgcgacgacgcacgcuugccu

SEQ ID NO: 4039249 - RNA, 19 nt, Molluscum contagiosum virus
cacgcgacggugugccgcu

SEQ ID NO: 4039250 - RNA, 21 nt, Molluscum contagiosum virus
cacgcgacggugugccgcugg

SEQ ID NO: 4039251 - RNA, 17 nt, Molluscum contagiosum virus
cacgcgagcggagcugg

SEQ ID NO: 4039252 - RNA, 13 nt, Molluscum contagiosum virus
cacgcgcacacgc

SEQ ID NO: 4039253 - RNA, 16 nt, Molluscum contagiosum virus
cacgcgcacgcgcgag

SEQ ID NO: 4039254 - RNA, 22 nt, Molluscum contagiosum virus
cggcagcgucgcggagcgcgca

SEQ ID NO: 4039255 - RNA, 15 nt, Molluscum contagiosum virus
cggcagcucugcagc

SEQ ID NO: 4039256 - RNA, 17 nt, Molluscum contagiosum virus
cggcagcucugcagcgc

SEQ ID NO: 4039257 - RNA, 12 nt, Molluscum contagiosum virus
cggcagcuggag

SEQ ID NO: 4039258 - RNA, 17 nt, Molluscum contagiosum virus
cggcaggcgcugcgcgg

SEQ ID NO: 4039259 - RNA, 22 nt, Molluscum contagiosum virus
cggcaggcucccgcugucgcgc

SEQ ID NO: 4039260 - RNA, 22 nt, Molluscum contagiosum virus
cggcagguuugcacccgcgcag

SEQ ID NO: 4039261 - RNA, 15 nt, Molluscum contagiosum virus
cggcaguagcagcgc

SEQ ID NO: 4039262 - RNA, 21 nt, Molluscum contagiosum virus
cggcaguggccgucgggcgcc

SEQ ID NO: 4039263 - RNA, 22 nt, Molluscum contagiosum virus
cggcaugugcgcaccgcgggcu

SEQ ID NO: 4039264 - RNA, 16 nt, Molluscum contagiosum virus
cggccaaccgccugcu

SEQ ID NO: 4039265 - RNA, 23 nt, Molluscum contagiosum virus
cggccagagccuucucgguguag

SEQ ID NO: 4039266 - RNA, 21 nt, Molluscum contagiosum virus
cggccagcgugcagacgaccg

SEQ ID NO: 4039267 - RNA, 23 nt, Molluscum contagiosum virus
cggcccccuuacgcuacagcagc

SEQ ID NO: 4039268 - RNA, 20 nt, Molluscum contagiosum virus
cggcccgaguacgcucucca

SEQ ID NO: 4039269 - RNA, 12 nt, Molluscum contagiosum virus
cggcccgcggac

SEQ ID NO: 4039270 - RNA, 13 nt, Molluscum contagiosum virus
cggccgccggcgc

SEQ ID NO: 4039271 - RNA, 22 nt, Molluscum contagiosum virus
cggccgcgagacgcagacgacg

SEQ ID NO: 4039272 - RNA, 15 nt, Molluscum contagiosum virus
cggccgcggaccacg

SEQ ID NO: 4039273 - RNA, 14 nt, Molluscum contagiosum virus
cggccgcguugcag

SEQ ID NO: 4039274 - RNA, 14 nt, Molluscum contagiosum virus
cggccguggcugcg

SEQ ID NO: 4039275 - RNA, 21 nt, Molluscum contagiosum virus
cggccguguccuacacgccgc

SEQ ID NO: 4039276 - RNA, 13 nt, Molluscum contagiosum virus
cggccuccagcag

SEQ ID NO: 4039277 - RNA, 21 nt, Molluscum contagiosum virus
cggccugcacggcuaccgcga

SEQ ID NO: 4039278 - RNA, 13 nt, Molluscum contagiosum virus
cggccugcccugc

SEQ ID NO: 4039279 - RNA, 19 nt, Molluscum contagiosum virus
cggccugcccugcucaugc

SEQ ID NO: 4039280 - RNA, 12 nt, Molluscum contagiosum virus
cggccuggccac

SEQ ID NO: 4039281 - RNA, 15 nt, Molluscum contagiosum virus
cggcgaacaccccga

SEQ ID NO: 4039282 - RNA, 23 nt, Molluscum contagiosum virus
cggcgaaccgacugcccgcgccc

SEQ ID NO: 4039283 - RNA, 21 nt, Molluscum contagiosum virus
cggcgagacgugcggcacgcu

SEQ ID NO: 4039284 - RNA, 13 nt, Molluscum contagiosum virus
cggcgcaacgcca

SEQ ID NO: 4039285 - RNA, 18 nt, Molluscum contagiosum virus
cggcgcaagcaccggcag

SEQ ID NO: 4039286 - RNA, 15 nt, Molluscum contagiosum virus
cggcgcaaucucgcg

SEQ ID NO: 4039287 - RNA, 20 nt, Molluscum contagiosum virus
cggcgcacacuccucggcgc

SEQ ID NO: 4039288 - RNA, 18 nt, Molluscum contagiosum virus
cggcgccaccggcagugc

SEQ ID NO: 4039289 - RNA, 22 nt, Molluscum contagiosum virus
cggcgccacgagcgccgcgacg

SEQ ID NO: 4039290 - RNA, 22 nt, Molluscum contagiosum virus
cggcgccccuccuaucucaaag

SEQ ID NO: 4039291 - RNA, 11 nt, Molluscum contagiosum virus
cggcgcccgca

SEQ ID NO: 4039292 - RNA, 15 nt, Molluscum contagiosum virus
cggcgcccgcgugca

SEQ ID NO: 4039293 - RNA, 22 nt, Molluscum contagiosum virus
cggcgcccgcgugcacccuccg

SEQ ID NO: 4039294 - RNA, 20 nt, Molluscum contagiosum virus
cggcgcccgugagcauggag

SEQ ID NO: 4039295 - RNA, 14 nt, Molluscum contagiosum virus
cggcgccgacagcg

SEQ ID NO: 4039296 - RNA, 21 nt, Molluscum contagiosum virus
cggcgccgacagcgcgcgcac

SEQ ID NO: 4039297 - RNA, 16 nt, Molluscum contagiosum virus
cggcgcgagaugcucg

SEQ ID NO: 4039298 - RNA, 12 nt, Molluscum contagiosum virus
cggcgcgcaccu

SEQ ID NO: 4039299 - RNA, 13 nt, Molluscum contagiosum virus
cggcgcgcagcgc

SEQ ID NO: 4039300 - RNA, 14 nt, Molluscum contagiosum virus
cggcgcgcagcgcg

SEQ ID NO: 4039301 - RNA, 12 nt, Molluscum contagiosum virus
cggcgcgccggc

SEQ ID NO: 4039302 - RNA, 15 nt, Molluscum contagiosum virus
cggcgcgccggcccg

SEQ ID NO: 4039303 - RNA, 13 nt, Molluscum contagiosum virus
cggcgcgcgccgc

SEQ ID NO: 4039304 - RNA, 16 nt, Molluscum contagiosum virus
cggcgcgcgcgcgcag

SEQ ID NO: 4039305 - RNA, 16 nt, Molluscum contagiosum virus
cggcgcgcgcgcuagc

SEQ ID NO: 4039306 - RNA, 15 nt, Molluscum contagiosum virus
cggcgcgggcaagca

SEQ ID NO: 4039307 - RNA, 21 nt, Molluscum contagiosum virus
cggcgcguccucggccagagc

SEQ ID NO: 4039308 - RNA, 19 nt, Molluscum contagiosum virus
cggcgcgugccgcugcgcg

SEQ ID NO: 4039309 - RNA, 16 nt, Molluscum contagiosum virus
cggcgcucgccuuucc

SEQ ID NO: 4039310 - RNA, 22 nt, Molluscum contagiosum virus
cggcgcucgccuuuccccggcg

SEQ ID NO: 4039311 - RNA, 15 nt, Molluscum contagiosum virus
cggcggcaagcgaga

SEQ ID NO: 4039312 - RNA, 14 nt, Molluscum contagiosum virus
cggcggcgcgaagc

SEQ ID NO: 4039313 - RNA, 19 nt, Molluscum contagiosum virus
cggcggcugugcccgcggc

SEQ ID NO: 4039314 - RNA, 20 nt, Molluscum contagiosum virus
cggcggcuuucucacgcccg

SEQ ID NO: 4039315 - RNA, 16 nt, Molluscum contagiosum virus
cggcgggaagggguga

SEQ ID NO: 4039316 - RNA, 22 nt, Molluscum contagiosum virus
cggcgggcacauccgcuaccug

SEQ ID NO: 4039317 - RNA, 21 nt, Molluscum contagiosum virus
cggcggggcugcuggcggugc

SEQ ID NO: 4039318 - RNA, 21 nt, Molluscum contagiosum virus
cggcguccgcagcggcgccac

SEQ ID NO: 4039319 - RNA, 19 nt, Molluscum contagiosum virus
cggcguccgcggcacgcga

SEQ ID NO: 4039320 - RNA, 19 nt, Molluscum contagiosum virus
cggcguccggugcucgccc

SEQ ID NO: 4039321 - RNA, 19 nt, Molluscum contagiosum virus
cggcgucgaaacacugcgg

SEQ ID NO: 4039322 - RNA, 22 nt, Molluscum contagiosum virus
cggcgucgcgcgcgaccuccgc

SEQ ID NO: 4039323 - RNA, 16 nt, Molluscum contagiosum virus
cggcgugcuggccagc

SEQ ID NO: 4039324 - RNA, 14 nt, Molluscum contagiosum virus
cggcguggccaggc

SEQ ID NO: 4039325 - RNA, 14 nt, Molluscum contagiosum virus
cggcguucgcggag

SEQ ID NO: 4039326 - RNA, 21 nt, Molluscum contagiosum virus
cggcuaagcucugcguuuugc

SEQ ID NO: 4039327 - RNA, 19 nt, Molluscum contagiosum virus
cggcucaccgcgcagaagc

SEQ ID NO: 4039328 - RNA, 16 nt, Molluscum contagiosum virus
cggcucagcguggagc

SEQ ID NO: 4039329 - RNA, 14 nt, Molluscum contagiosum virus
cggcucccagcagc

SEQ ID NO: 4039330 - RNA, 18 nt, Molluscum contagiosum virus
cggcucuggagcggccac

SEQ ID NO: 4039331 - RNA, 17 nt, Molluscum contagiosum virus
cggcugccgcugccugu

SEQ ID NO: 4039332 - RNA, 22 nt, Molluscum contagiosum virus
cggcugcucgcugccuggugca

SEQ ID NO: 4039333 - RNA, 15 nt, Molluscum contagiosum virus
cggcuguggacauga

SEQ ID NO: 4039334 - RNA, 15 nt, Molluscum contagiosum virus
cgggaaacugcugcc

SEQ ID NO: 4039335 - RNA, 22 nt, Molluscum contagiosum virus
cgggaaggcaggccccgcacca

SEQ ID NO: 4039336 - RNA, 21 nt, Molluscum contagiosum virus
cgggaaguguugccgccggcc

SEQ ID NO: 4039337 - RNA, 20 nt, Molluscum contagiosum virus
cgggaauaccggagacacca

SEQ ID NO: 4039338 - RNA, 22 nt, Molluscum contagiosum virus
cgggaauaccggagacaccagc

SEQ ID NO: 4039339 - RNA, 23 nt, Molluscum contagiosum virus
cgggaauaccggagacaccagcu

SEQ ID NO: 4039340 - RNA, 19 nt, Molluscum contagiosum virus
cgggaaugcugcgcacgcu

SEQ ID NO: 4039341 - RNA, 22 nt, Molluscum contagiosum virus
cgggaccgcccuuguggacgcg

SEQ ID NO: 4039342 - RNA, 13 nt, Molluscum contagiosum virus
cgggacgcgugcc

SEQ ID NO: 4039343 - RNA, 17 nt, Molluscum contagiosum virus
cgggagcaacgaaccgu

SEQ ID NO: 4039344 - RNA, 21 nt, Molluscum contagiosum virus
cgggagcaagucugcgcagga

SEQ ID NO: 4039345 - RNA, 18 nt, Molluscum contagiosum virus
cgggauggucucgcugcu

SEQ ID NO: 4039346 - RNA, 23 nt, Molluscum contagiosum virus
cgggcacgccgcagcgcuggagc

SEQ ID NO: 4039347 - RNA, 21 nt, Molluscum contagiosum virus
cgggcacgcgcgcgccuuucc

SEQ ID NO: 4039348 - RNA, 20 nt, Molluscum contagiosum virus
cgggcacgcucauacuccug

SEQ ID NO: 4039349 - RNA, 17 nt, Molluscum contagiosum virus
cgggcacgugcugcugc

SEQ ID NO: 4039350 - RNA, 18 nt, Molluscum contagiosum virus
cgggcaugcacagcugcu

SEQ ID NO: 4039351 - RNA, 18 nt, Molluscum contagiosum virus
cgggcccaccgcgccagc

SEQ ID NO: 4039352 - RNA, 17 nt, Molluscum contagiosum virus
cgggccccugcgcgagc

SEQ ID NO: 4039353 - RNA, 18 nt, Molluscum contagiosum virus
cgggccccugcgcgagca

SEQ ID NO: 4039354 - RNA, 21 nt, Molluscum contagiosum virus
cgggccccugucgcgcacgag

SEQ ID NO: 4039355 - RNA, 12 nt, Molluscum contagiosum virus
cgggcccgccuu

SEQ ID NO: 4039356 - RNA, 16 nt, Molluscum contagiosum virus
cgggcccgugcccgag

SEQ ID NO: 4039357 - RNA, 21 nt, Molluscum contagiosum virus
cgugaggaggcggcacugcua

SEQ ID NO: 4039358 - RNA, 14 nt, Molluscum contagiosum virus
cgugcaccucaaga

SEQ ID NO: 4039359 - RNA, 15 nt, Molluscum contagiosum virus
cgugcaccucaagaa

SEQ ID NO: 4039360 - RNA, 19 nt, Molluscum contagiosum virus
cgugcacguggcgcacacg

SEQ ID NO: 4039361 - RNA, 21 nt, Molluscum contagiosum virus
cgugcacguggcgcacacgga

SEQ ID NO: 4039362 - RNA, 13 nt, Molluscum contagiosum virus
cgugcagcggcgc

SEQ ID NO: 4039363 - RNA, 16 nt, Molluscum contagiosum virus
cgugcaguuucuccuc

SEQ ID NO: 4039364 - RNA, 15 nt, Molluscum contagiosum virus
cgugcaugcccagca

SEQ ID NO: 4039365 - RNA, 18 nt, Molluscum contagiosum virus
cgugcauggcacgcgagc

SEQ ID NO: 4039366 - RNA, 16 nt, Molluscum contagiosum virus
cgugccacugccgccg

SEQ ID NO: 4039367 - RNA, 14 nt, Molluscum contagiosum virus
cgugccccgcgcgu

SEQ ID NO: 4039368 - RNA, 18 nt, Molluscum contagiosum virus
cgugccgcggcacugggu

SEQ ID NO: 4039369 - RNA, 13 nt, Molluscum contagiosum virus
cgugcgagcagag

SEQ ID NO: 4039370 - RNA, 17 nt, Molluscum contagiosum virus
cgugcgcaccaucuuca

SEQ ID NO: 4039371 - RNA, 13 nt, Molluscum contagiosum virus
cgugcgcagcagc

SEQ ID NO: 4039372 - RNA, 19 nt, Molluscum contagiosum virus
cgugcgcgacggcgagcuc

SEQ ID NO: 4039373 - RNA, 13 nt, Molluscum contagiosum virus
cgugcgcgccagg

SEQ ID NO: 4039374 - RNA, 15 nt, Molluscum contagiosum virus
cgugcgcgcugcgcg

SEQ ID NO: 4039375 - RNA, 16 nt, Molluscum contagiosum virus
cgugcgcgggcacgcc

SEQ ID NO: 4039376 - RNA, 17 nt, Molluscum contagiosum virus
cgugcgcuggcccacgc

SEQ ID NO: 4039377 - RNA, 17 nt, Molluscum contagiosum virus
cgugcguacucaacgcg

SEQ ID NO: 4039378 - RNA, 15 nt, Molluscum contagiosum virus
cgugcucacgcugcc

SEQ ID NO: 4039379 - RNA, 13 nt, Molluscum contagiosum virus
cgugcuccacgcg

SEQ ID NO: 4039380 - RNA, 17 nt, Molluscum contagiosum virus
cgugcuccucgcguagc

SEQ ID NO: 4039381 - RNA, 16 nt, Molluscum contagiosum virus
cgugcucguguguccg

SEQ ID NO: 4039382 - RNA, 15 nt, Molluscum contagiosum virus
cgugcucugcuccgc

SEQ ID NO: 4039383 - RNA, 17 nt, Molluscum contagiosum virus
cgugcugcccguggugg

SEQ ID NO: 4039384 - RNA, 15 nt, Molluscum contagiosum virus
cgugcuggagcaggg

SEQ ID NO: 4039385 - RNA, 13 nt, Molluscum contagiosum virus
cgugcugucagug

SEQ ID NO: 4039386 - RNA, 17 nt, Molluscum contagiosum virus
cgugcuuacggacagga

SEQ ID NO: 4039387 - RNA, 17 nt, Molluscum contagiosum virus
cgugcuuguagcgcaag

SEQ ID NO: 4039388 - RNA, 18 nt, Molluscum contagiosum virus
cguggaaaagcagggccc

SEQ ID NO: 4039389 - RNA, 18 nt, Molluscum contagiosum virus
cguggcaaacaggcacac

SEQ ID NO: 4039390 - RNA, 15 nt, Molluscum contagiosum virus
cguggcgcgcgagcu

SEQ ID NO: 4039391 - RNA, 19 nt, Molluscum contagiosum virus
cguggcgcgcgagcugcua

SEQ ID NO: 4039392 - RNA, 22 nt, Molluscum contagiosum virus
cguggcgcuuggcgagcgcugc

SEQ ID NO: 4039393 - RNA, 23 nt, Molluscum contagiosum virus
cguggcgcuuggcgagcgcugcc

SEQ ID NO: 4039394 - RNA, 16 nt, Molluscum contagiosum virus
cguggcguugcugcug

SEQ ID NO: 4039395 - RNA, 17 nt, Molluscum contagiosum virus
cguggcguugcugcugc

SEQ ID NO: 4039396 - RNA, 18 nt, Molluscum contagiosum virus
cguggcguugcugcugcg

SEQ ID NO: 4039397 - RNA, 22 nt, Molluscum contagiosum virus
cguggcuaugagcggcacggga

SEQ ID NO: 4039398 - RNA, 22 nt, Molluscum contagiosum virus
cgugggcaccugcaucgcgccg

SEQ ID NO: 4039399 - RNA, 13 nt, Molluscum contagiosum virus
cgugggcagccgc

SEQ ID NO: 4039400 - RNA, 13 nt, Molluscum contagiosum virus
cgugggcagcuuc

SEQ ID NO: 4039401 - RNA, 16 nt, Molluscum contagiosum virus
cgugggcgccgcggcg

SEQ ID NO: 4039402 - RNA, 19 nt, Molluscum contagiosum virus
cguggucgagggcgaggcc

SEQ ID NO: 4039403 - RNA, 18 nt, Molluscum contagiosum virus
cguguaccgccgcggccg

SEQ ID NO: 4039404 - RNA, 20 nt, Molluscum contagiosum virus
cguguacgacgugcugcugc

SEQ ID NO: 4039405 - RNA, 23 nt, Molluscum contagiosum virus
cguguguccgcacgcacacgacg

SEQ ID NO: 4039406 - RNA, 20 nt, Molluscum contagiosum virus
cguuacggagaccuggucac

SEQ ID NO: 4039407 - RNA, 19 nt, Molluscum contagiosum virus
cguuagcguugguaacaag

SEQ ID NO: 4039408 - RNA, 17 nt, Molluscum contagiosum virus
gcacauccgcuaccugg

SEQ ID NO: 4039409 - RNA, 20 nt, Molluscum contagiosum virus
gcacaucucucagggcagcg

SEQ ID NO: 4039410 - RNA, 19 nt, Molluscum contagiosum virus
gcacaugugcgugcaccuc

SEQ ID NO: 4039411 - RNA, 21 nt, Molluscum contagiosum virus
gcacaugugcgugcaccucaa

SEQ ID NO: 4039412 - RNA, 12 nt, Molluscum contagiosum virus
gcacauugcugc

SEQ ID NO: 4039413 - RNA, 14 nt, Molluscum contagiosum virus
gcacauugcugcug

SEQ ID NO: 4039414 - RNA, 15 nt, Molluscum contagiosum virus
gcacccaccaggaac

SEQ ID NO: 4039415 - RNA, 17 nt, Molluscum contagiosum virus
gcacccaccaggaacag

SEQ ID NO: 4039416 - RNA, 16 nt, Molluscum contagiosum virus
gcaccccgcaggaaag

SEQ ID NO: 4039417 - RNA, 18 nt, Molluscum contagiosum virus
gcacccgcaggaaaggca

SEQ ID NO: 4039418 - RNA, 13 nt, Molluscum contagiosum virus
gcacccgcgcggc

SEQ ID NO: 4039419 - RNA, 13 nt, Molluscum contagiosum virus
gcacccuggcugc

SEQ ID NO: 4039420 - RNA, 17 nt, Molluscum contagiosum virus
gcacccuggcugcugcg

SEQ ID NO: 4039421 - RNA, 18 nt, Molluscum contagiosum virus
gcacccuggcugcugcgc

SEQ ID NO: 4039422 - RNA, 21 nt, Molluscum contagiosum virus
gcacccuucugaggggcagug

SEQ ID NO: 4039423 - RNA, 15 nt, Molluscum contagiosum virus
gcaccgagugcuggc

SEQ ID NO: 4039424 - RNA, 17 nt, Molluscum contagiosum virus
gcaccgcacgccagcag

SEQ ID NO: 4039425 - RNA, 18 nt, Molluscum contagiosum virus
gcaccgcaugggcccugg

SEQ ID NO: 4039426 - RNA, 16 nt, Molluscum contagiosum virus
gcaccgcgcgcgcucc

SEQ ID NO: 4039427 - RNA, 17 nt, Molluscum contagiosum virus
gcaccgcguggcgcgcg

SEQ ID NO: 4039428 - RNA, 20 nt, Molluscum contagiosum virus
gcaccgcguugccgcccgcc

SEQ ID NO: 4039429 - RNA, 20 nt, Molluscum contagiosum virus
gcaccucaacuguugccugg

SEQ ID NO: 4039430 - RNA, 15 nt, Molluscum contagiosum virus
gcaccugcacgagcc

SEQ ID NO: 4039431 - RNA, 17 nt, Molluscum contagiosum virus
gcaccugcaucgcgccg

SEQ ID NO: 4039432 - RNA, 13 nt, Molluscum contagiosum virus
gcaccugcgccgc

SEQ ID NO: 4039433 - RNA, 14 nt, Molluscum contagiosum virus
gcaccugcuggaac

SEQ ID NO: 4039434 - RNA, 16 nt, Molluscum contagiosum virus
gcaccuggucgagcac

SEQ ID NO: 4039435 - RNA, 19 nt, Molluscum contagiosum virus
gcacgaaggacgcgcuugc

SEQ ID NO: 4039436 - RNA, 15 nt, Molluscum contagiosum virus
gcacgaccacgcugg

SEQ ID NO: 4039437 - RNA, 21 nt, Molluscum contagiosum virus
gcacgaccucacagcgccgga

SEQ ID NO: 4039438 - RNA, 20 nt, Molluscum contagiosum virus
gcacgacguacgagugcugg

SEQ ID NO: 4039439 - RNA, 23 nt, Molluscum contagiosum virus
gcacgagcaguccgccucgagca

SEQ ID NO: 4039440 - RNA, 14 nt, Molluscum contagiosum virus
gcacgagcugcugc

SEQ ID NO: 4039441 - RNA, 15 nt, Molluscum contagiosum virus
gcacgagcugcugcc

SEQ ID NO: 4039442 - RNA, 18 nt, Molluscum contagiosum virus
gcacgauguacuccacca

SEQ ID NO: 4039443 - RNA, 15 nt, Molluscum contagiosum virus
gcacgcagcucuucc

SEQ ID NO: 4039444 - RNA, 22 nt, Molluscum contagiosum virus
gcacgcccuggcccucggggcu

SEQ ID NO: 4039445 - RNA, 16 nt, Molluscum contagiosum virus
gcacgccgugggcagc

SEQ ID NO: 4039446 - RNA, 22 nt, Molluscum contagiosum virus
gcacgcgaugagcgucucggug

SEQ ID NO: 4039447 - RNA, 21 nt, Molluscum contagiosum virus
gcacgcgcacgggccugcgcg

SEQ ID NO: 4039448 - RNA, 16 nt, Molluscum contagiosum virus
gcacgcgcgagcaugc

SEQ ID NO: 4039449 - RNA, 23 nt, Molluscum contagiosum virus
gcacgcgcgagcaugccgccgcg

SEQ ID NO: 4039450 - RNA, 13 nt, Molluscum contagiosum virus
gcacgcggcgcuc

SEQ ID NO: 4039451 - RNA, 14 nt, Molluscum contagiosum virus
gcacgcggcucugg

SEQ ID NO: 4039452 - RNA, 17 nt, Molluscum contagiosum virus
gcacgcggcucuggagc

SEQ ID NO: 4039453 - RNA, 18 nt, Molluscum contagiosum virus
gcacgcuacggcugccgg

SEQ ID NO: 4039454 - RNA, 20 nt, Molluscum contagiosum virus
gcacgcucauacuccugcug

SEQ ID NO: 4039455 - RNA, 17 nt, Molluscum contagiosum virus
gcacgcucggcacucgc

SEQ ID NO: 4039456 - RNA, 22 nt, Molluscum contagiosum virus
gcacgcucuacggcgugcugug

SEQ ID NO: 4039457 - RNA, 19 nt, Molluscum contagiosum virus
gcacgcugagcaagcucaa

SEQ ID NO: 4039458 - RNA, 20 nt, Molluscum contagiosum virus
gcacgcugcguuuccagggc

SEQ ID NO: 4039459 - RNA, 19 nt, Molluscum contagiosum virus
gcacgcugcugcgugcgcg

SEQ ID NO: 4039460 - RNA, 18 nt, Molluscum contagiosum virus
gcacgcuugugcgcacgc

SEQ ID NO: 4039461 - RNA, 15 nt, Molluscum contagiosum virus
gcacggacagcaccc

SEQ ID NO: 4039462 - RNA, 19 nt, Molluscum contagiosum virus
gcacggacccgggcgcggc

SEQ ID NO: 4039463 - RNA, 15 nt, Molluscum contagiosum virus
gcacggccggcgccg

SEQ ID NO: 4039464 - RNA, 17 nt, Molluscum contagiosum virus
gcacggccggcgccgcg

SEQ ID NO: 4039465 - RNA, 15 nt, Molluscum contagiosum virus
gcacggcgcccagga

SEQ ID NO: 4039466 - RNA, 19 nt, Molluscum contagiosum virus
gcacggcuaccacgagcac

SEQ ID NO: 4039467 - RNA, 17 nt, Molluscum contagiosum virus
gcacggcuaggcgcggc

SEQ ID NO: 4039468 - RNA, 15 nt, Molluscum contagiosum virus
gcacgggcucgagcu

SEQ ID NO: 4039469 - RNA, 20 nt, Molluscum contagiosum virus
gcacgggcucgaucugcgcc

SEQ ID NO: 4039470 - RNA, 17 nt, Molluscum contagiosum virus
gcacgucuuugacccca

SEQ ID NO: 4039471 - RNA, 19 nt, Molluscum contagiosum virus
gcacgugccccgcgcgugc

SEQ ID NO: 4039472 - RNA, 24 nt, Molluscum contagiosum virus
gcacgugggcuacaagugcauccg

SEQ ID NO: 4039473 - RNA, 17 nt, Molluscum contagiosum virus
gcacgugugcggagagc

SEQ ID NO: 4039474 - RNA, 18 nt, Molluscum contagiosum virus
gcacgugugcggagagcc

SEQ ID NO: 4039475 - RNA, 21 nt, Molluscum contagiosum virus
gcacguuguucuugcgcgugg

SEQ ID NO: 4039476 - RNA, 14 nt, Molluscum contagiosum virus
gcacucgcgcucgc

SEQ ID NO: 4039477 - RNA, 14 nt, Molluscum contagiosum virus
gcacugagaaguga

SEQ ID NO: 4039478 - RNA, 18 nt, Molluscum contagiosum virus
gcacugcagcgagcucgc

SEQ ID NO: 4039479 - RNA, 19 nt, Molluscum contagiosum virus
gcacugccacgcggagcuc

SEQ ID NO: 4039480 - RNA, 21 nt, Molluscum contagiosum virus
gcacugccacgcggagcucgc

SEQ ID NO: 4039481 - RNA, 21 nt, Molluscum contagiosum virus
gcacugccgcguccucagguu

SEQ ID NO: 4039482 - RNA, 15 nt, Molluscum contagiosum virus
gcacugccugccgcc

SEQ ID NO: 4039483 - RNA, 18 nt, Molluscum contagiosum virus
gcacugcgcgucugugcg

SEQ ID NO: 4039484 - RNA, 16 nt, Molluscum contagiosum virus
gcacugcucgcgcacg

SEQ ID NO: 4039485 - RNA, 17 nt, Molluscum contagiosum virus
gcacugcucgcgcacgc

SEQ ID NO: 4039486 - RNA, 16 nt, Molluscum contagiosum virus
gcacugcuggcgcgcg

SEQ ID NO: 4039487 - RNA, 22 nt, Molluscum contagiosum virus
gcacuggcuggcguucgacggc

SEQ ID NO: 4039488 - RNA, 16 nt, Molluscum contagiosum virus
gcacuggggcgaucgc

SEQ ID NO: 4039489 - RNA, 18 nt, Molluscum contagiosum virus
gcacuguguccccugagc

SEQ ID NO: 4039490 - RNA, 17 nt, Molluscum contagiosum virus
gcagaacugcugcgcgc

SEQ ID NO: 4039491 - RNA, 20 nt, Molluscum contagiosum virus
gcagaagacggaguccucga

SEQ ID NO: 4039492 - RNA, 17 nt, Molluscum contagiosum virus
gcagacaaagacagucc

SEQ ID NO: 4039493 - RNA, 19 nt, Molluscum contagiosum virus
gcagaccaagaagcccgag

SEQ ID NO: 4039494 - RNA, 12 nt, Molluscum contagiosum virus
gcagagcacgag

SEQ ID NO: 4039495 - RNA, 20 nt, Molluscum contagiosum virus
gcagagguaaucccgagcuu

SEQ ID NO: 4039496 - RNA, 18 nt, Molluscum contagiosum virus
gcagaucgcgagaggaga

SEQ ID NO: 4039497 - RNA, 14 nt, Molluscum contagiosum virus
gcagauuggaggag

SEQ ID NO: 4039498 - RNA, 16 nt, Molluscum contagiosum virus
gcagcaagcagccgca

SEQ ID NO: 4039499 - RNA, 22 nt, Molluscum contagiosum virus
gcagcagaccaagaagcccgag

SEQ ID NO: 4039500 - RNA, 21 nt, Molluscum contagiosum virus
gcagcaggaugcuggugucga

SEQ ID NO: 4039501 - RNA, 15 nt, Molluscum contagiosum virus
gcagcaggcacucca

SEQ ID NO: 4039502 - RNA, 19 nt, Molluscum contagiosum virus
gcagcaggugcacgugcug

SEQ ID NO: 4039503 - RNA, 20 nt, Molluscum contagiosum virus
gcagcaggugcacgugcugc

SEQ ID NO: 4039504 - RNA, 16 nt, Molluscum contagiosum virus
gcagcagugccagcag

SEQ ID NO: 4039505 - RNA, 17 nt, Molluscum contagiosum virus
gcagcagugccagcagc

SEQ ID NO: 4039506 - RNA, 20 nt, Molluscum contagiosum virus
gcagcauuuuggugggcacg

SEQ ID NO: 4039507 - RNA, 17 nt, Molluscum contagiosum virus
gcagcccgagcgcgcgu

SEQ ID NO: 4039508 - RNA, 14 nt, Molluscum contagiosum virus
gcagccgcgcucgu

SEQ ID NO: 4039509 - RNA, 18 nt, Molluscum contagiosum virus
gcagccgcugcugcugca

SEQ ID NO: 4039510 - RNA, 15 nt, Molluscum contagiosum virus
gcagccgcuggacgc

SEQ ID NO: 4039511 - RNA, 14 nt, Molluscum contagiosum virus
gcagccucaaccug

SEQ ID NO: 4039512 - RNA, 17 nt, Molluscum contagiosum virus
gcagcgcccggugcggc

SEQ ID NO: 4039513 - RNA, 13 nt, Molluscum contagiosum virus
gcagcgccggcag

SEQ ID NO: 4039514 - RNA, 14 nt, Molluscum contagiosum virus
gcagcgcgccacca

SEQ ID NO: 4039515 - RNA, 13 nt, Molluscum contagiosum virus
gcagcgcgcgcag

SEQ ID NO: 4039516 - RNA, 15 nt, Molluscum contagiosum virus
gcagcggcaaaggcc

SEQ ID NO: 4039517 - RNA, 12 nt, Molluscum contagiosum virus
gcagcgugccgc

SEQ ID NO: 4039518 - RNA, 13 nt, Molluscum contagiosum virus
gcagcugcaggac

SEQ ID NO: 4039519 - RNA, 14 nt, Molluscum contagiosum virus
gcagcugcgccugc

SEQ ID NO: 4039520 - RNA, 17 nt, Molluscum contagiosum virus
gcagcugcgcgagccgc

SEQ ID NO: 4039521 - RNA, 18 nt, Molluscum contagiosum virus
gcagcuggagcugccgcu

SEQ ID NO: 4039522 - RNA, 21 nt, Molluscum contagiosum virus
gcagcuggcgcgcgccgagcc

SEQ ID NO: 4039523 - RNA, 20 nt, Molluscum contagiosum virus
gcagcuggcgggcgugccca

SEQ ID NO: 4039524 - RNA, 16 nt, Molluscum contagiosum virus
gcagcuucugcucgcg

SEQ ID NO: 4039525 - RNA, 21 nt, Molluscum contagiosum virus
gcaggaaagguacccgcagga

SEQ ID NO: 4039526 - RNA, 17 nt, Molluscum contagiosum virus
gcaggaaccgcgugcgc

SEQ ID NO: 4039527 - RNA, 16 nt, Molluscum contagiosum virus
gcaggagcacgccugg

SEQ ID NO: 4039528 - RNA, 17 nt, Molluscum contagiosum virus
gcaggagcacgccuggc

SEQ ID NO: 4039529 - RNA, 21 nt, Molluscum contagiosum virus
gcaggaucggagcgcagcugc

SEQ ID NO: 4039530 - RNA, 13 nt, Molluscum contagiosum virus
gcaggaugcuggg

SEQ ID NO: 4039531 - RNA, 16 nt, Molluscum contagiosum virus
gcaggaugcuggggcu

SEQ ID NO: 4039532 - RNA, 16 nt, Molluscum contagiosum virus
gcaggcacgacgccga

SEQ ID NO: 4039533 - RNA, 17 nt, Molluscum contagiosum virus
gcaggcacgacgccgac

SEQ ID NO: 4039534 - RNA, 14 nt, Molluscum contagiosum virus
gcaggccaggugca

SEQ ID NO: 4039535 - RNA, 22 nt, Molluscum contagiosum virus
gcaggccccgcaccagugccga

SEQ ID NO: 4039536 - RNA, 13 nt, Molluscum contagiosum virus
gcaggccgcccac

SEQ ID NO: 4039537 - RNA, 16 nt, Molluscum contagiosum virus
gcaggcgcaggccgcg

SEQ ID NO: 4039538 - RNA, 13 nt, Molluscum contagiosum virus
gcaggcgcgcgcg

SEQ ID NO: 4039539 - RNA, 14 nt, Molluscum contagiosum virus
gcaggcgugcucag

SEQ ID NO: 4039540 - RNA, 16 nt, Molluscum contagiosum virus
gcagggcccgcgcucg

SEQ ID NO: 4039541 - RNA, 17 nt, Molluscum contagiosum virus
gcagggcccgcgcucgc

SEQ ID NO: 4039542 - RNA, 15 nt, Molluscum contagiosum virus
gcaggucggccagca

SEQ ID NO: 4039543 - RNA, 21 nt, Molluscum contagiosum virus
gcaguaugugaacacgacaug

SEQ ID NO: 4039544 - RNA, 14 nt, Molluscum contagiosum virus
gcaguccgccucga

SEQ ID NO: 4039545 - RNA, 17 nt, Molluscum contagiosum virus
gcaguccgccucgagca

SEQ ID NO: 4039546 - RNA, 19 nt, Molluscum contagiosum virus
gcagucgccuuccugcgcc

SEQ ID NO: 4039547 - RNA, 16 nt, Molluscum contagiosum virus
gcaguggccgucgggc

SEQ ID NO: 4039548 - RNA, 18 nt, Molluscum contagiosum virus
gcaguuccaccucgagcu

SEQ ID NO: 4039549 - RNA, 23 nt, Molluscum contagiosum virus
gcaguuccgauauacgggcccug

SEQ ID NO: 4039550 - RNA, 22 nt, Molluscum contagiosum virus
gcaguucggcgacacgcccgcg

SEQ ID NO: 4039551 - RNA, 13 nt, Molluscum contagiosum virus
gcaguuggucacc

SEQ ID NO: 4039552 - RNA, 18 nt, Molluscum contagiosum virus
gcauaccugugccagcgc

SEQ ID NO: 4039553 - RNA, 19 nt, Molluscum contagiosum virus
gcauagugggcuugcggca

SEQ ID NO: 4039554 - RNA, 21 nt, Molluscum contagiosum virus
gcaucagagaagugcuccgca

SEQ ID NO: 4039555 - RNA, 23 nt, Molluscum contagiosum virus
gcauccugaugacggcagacggc

SEQ ID NO: 4039556 - RNA, 13 nt, Molluscum contagiosum virus
gcaucgagaacgc

SEQ ID NO: 4039557 - RNA, 20 nt, Molluscum contagiosum virus
gcaucgcgggcacgcagcuc

SEQ ID NO: 4039558 - RNA, 20 nt, Molluscum contagiosum virus
gcaucgugcucuucgcggga

SEQ ID NO: 4039559 - RNA, 15 nt, Molluscum contagiosum virus
gcaucuucugccagg

SEQ ID NO: 4039560 - RNA, 23 nt, Molluscum contagiosum virus
gcaucuucuuguuguugugacac

SEQ ID NO: 4039561 - RNA, 22 nt, Molluscum contagiosum virus
gcaugaaaggcaccugcggcuc

SEQ ID NO: 4039562 - RNA, 15 nt, Molluscum contagiosum virus
gcaugaacucgcugc

SEQ ID NO: 4039563 - RNA, 14 nt, Molluscum contagiosum virus
gcaugcacagcugc

SEQ ID NO: 4039564 - RNA, 23 nt, Molluscum contagiosum virus
gcaugcgcgguccuguccgcgga

SEQ ID NO: 4039565 - RNA, 22 nt, Molluscum contagiosum virus
gcaugcucacguacgacugcuu

SEQ ID NO: 4039566 - RNA, 20 nt, Molluscum contagiosum virus
gcaugcucgcgcucucgguc

SEQ ID NO: 4039567 - RNA, 21 nt, Molluscum contagiosum virus
gcauggagagcguacucgggc

SEQ ID NO: 4039568 - RNA, 16 nt, Molluscum contagiosum virus
gcaugucacgcgucgc

SEQ ID NO: 4039569 - RNA, 14 nt, Molluscum contagiosum virus
gcauguccuuggcg

SEQ ID NO: 4039570 - RNA, 19 nt, Molluscum contagiosum virus
gcauguccuuggcggugcg

SEQ ID NO: 4039571 - RNA, 20 nt, Molluscum contagiosum virus
gccaacacgcaaucgcgcgc

SEQ ID NO: 4039572 - RNA, 16 nt, Molluscum contagiosum virus
gccaacgccagcugua

SEQ ID NO: 4039573 - RNA, 17 nt, Molluscum contagiosum virus
gccaacuaccuggggcu

SEQ ID NO: 4039574 - RNA, 13 nt, Molluscum contagiosum virus
gccaagaacaagc

SEQ ID NO: 4039575 - RNA, 20 nt, Molluscum contagiosum virus
gccaagguuugcgggcgcag

SEQ ID NO: 4039576 - RNA, 13 nt, Molluscum contagiosum virus
gccaaugacggcg

SEQ ID NO: 4039577 - RNA, 21 nt, Molluscum contagiosum virus
gccaccgcgcgguccgccagu

SEQ ID NO: 4039578 - RNA, 22 nt, Molluscum contagiosum virus
gccacgaagagucgcgccugga

SEQ ID NO: 4039579 - RNA, 18 nt, Molluscum contagiosum virus
gccacgcagaucaggagc

SEQ ID NO: 4039580 - RNA, 15 nt, Molluscum contagiosum virus
gccacgcagcuggcg

SEQ ID NO: 4039581 - RNA, 13 nt, Molluscum contagiosum virus
gccacgcccgggc

SEQ ID NO: 4039582 - RNA, 23 nt, Molluscum contagiosum virus
gccacgcgggcccgugcucaggc

SEQ ID NO: 4039583 - RNA, 14 nt, Molluscum contagiosum virus
gccacggccgcgcu

SEQ ID NO: 4039584 - RNA, 18 nt, Molluscum contagiosum virus
gccacggcgagcugccau

SEQ ID NO: 4039585 - RNA, 17 nt, Molluscum contagiosum virus
gccacggcugcaagcac

SEQ ID NO: 4039586 - RNA, 21 nt, Molluscum contagiosum virus
gccacugccacggcugcaagc

SEQ ID NO: 4039587 - RNA, 16 nt, Molluscum contagiosum virus
gccagcaccaugcgug

SEQ ID NO: 4039588 - RNA, 16 nt, Molluscum contagiosum virus
gccagcagcuccuggu

SEQ ID NO: 4039589 - RNA, 13 nt, Molluscum contagiosum virus
gccagccaggcgc

SEQ ID NO: 4039590 - RNA, 22 nt, Molluscum contagiosum virus
gccagccgcucguccagcugcg

SEQ ID NO: 4039591 - RNA, 20 nt, Molluscum contagiosum virus
gccagccucaucgugagccu

SEQ ID NO: 4039592 - RNA, 17 nt, Molluscum contagiosum virus
gccagccugcuggcacc

SEQ ID NO: 4039593 - RNA, 16 nt, Molluscum contagiosum virus
gccagccugugcgcca

SEQ ID NO: 4039594 - RNA, 23 nt, Molluscum contagiosum virus
gccagcgagucucgcgcgccacc

SEQ ID NO: 4039595 - RNA, 15 nt, Molluscum contagiosum virus
gccagcgauugcccg

SEQ ID NO: 4039596 - RNA, 16 nt, Molluscum contagiosum virus
gccagcguacggcccg

SEQ ID NO: 4039597 - RNA, 20 nt, Molluscum contagiosum virus
gccagcguacggcccgaagg

SEQ ID NO: 4039598 - RNA, 17 nt, Molluscum contagiosum virus
gccagcgugcagacgac

SEQ ID NO: 4039599 - RNA, 18 nt, Molluscum contagiosum virus
gccagcuccgcgcggcgc

SEQ ID NO: 4039600 - RNA, 16 nt, Molluscum contagiosum virus
gccagcuuggugcgcu

SEQ ID NO: 4039601 - RNA, 19 nt, Molluscum contagiosum virus
gccagcuuggugcgcucga

SEQ ID NO: 4039602 - RNA, 22 nt, Molluscum contagiosum virus
gccaggcacacgcagugccacg

SEQ ID NO: 4039603 - RNA, 15 nt, Molluscum contagiosum virus
gccagguguuccugc

SEQ ID NO: 4039604 - RNA, 15 nt, Molluscum contagiosum virus
gccaguccgcggcgc

SEQ ID NO: 4039605 - RNA, 16 nt, Molluscum contagiosum virus
gccagucgcgccucgc

SEQ ID NO: 4039606 - RNA, 21 nt, Molluscum contagiosum virus
gccagugcuuugucgcaaccc

SEQ ID NO: 4039607 - RNA, 15 nt, Molluscum contagiosum virus
gccauccacgugggc

SEQ ID NO: 4039608 - RNA, 19 nt, Molluscum contagiosum virus
gccaucgagaugcucaagc

SEQ ID NO: 4039609 - RNA, 22 nt, Molluscum contagiosum virus
gccaucgugcgcgacuuggggc

SEQ ID NO: 4039610 - RNA, 20 nt, Molluscum contagiosum virus
gccaucucgcacacugcagc

SEQ ID NO: 4039611 - RNA, 19 nt, Molluscum contagiosum virus
gccaugaucauggcgccgc

SEQ ID NO: 4039612 - RNA, 16 nt, Molluscum contagiosum virus
gccauggagcgcccgc

SEQ ID NO: 4039613 - RNA, 16 nt, Molluscum contagiosum virus
gccaugucugugcgcg

SEQ ID NO: 4039614 - RNA, 22 nt, Molluscum contagiosum virus
gccauguuuccugcggcgcugc

SEQ ID NO: 4039615 - RNA, 14 nt, Molluscum contagiosum virus
gccauugugacacg

SEQ ID NO: 4039616 - RNA, 14 nt, Molluscum contagiosum virus
gcccaccagcagcc

SEQ ID NO: 4039617 - RNA, 18 nt, Molluscum contagiosum virus
gcccaccagcagccaggc

SEQ ID NO: 4039618 - RNA, 19 nt, Molluscum contagiosum virus
gcccaccagcagccaggcu

SEQ ID NO: 4039619 - RNA, 15 nt, Molluscum contagiosum virus
gcccacguugccgcg

SEQ ID NO: 4039620 - RNA, 14 nt, Molluscum contagiosum virus
gcccagcuucagca

SEQ ID NO: 4039621 - RNA, 21 nt, Molluscum contagiosum virus
gcccaucaaggcgcgcaucgc

SEQ ID NO: 4039622 - RNA, 18 nt, Molluscum contagiosum virus
gccccaaaagugaagauc

SEQ ID NO: 4039623 - RNA, 15 nt, Molluscum contagiosum virus
gccccacugugccag

SEQ ID NO: 4039624 - RNA, 18 nt, Molluscum contagiosum virus
gccccacugugccagcag

SEQ ID NO: 4039625 - RNA, 20 nt, Molluscum contagiosum virus
gccccagcaccagguagagc

SEQ ID NO: 4039626 - RNA, 16 nt, Molluscum contagiosum virus
gcccccgagcugcgug

SEQ ID NO: 4039627 - RNA, 12 nt, Molluscum contagiosum virus
gcccccgugcug

SEQ ID NO: 4039628 - RNA, 14 nt, Molluscum contagiosum virus
gccccgacgccagc

SEQ ID NO: 4039629 - RNA, 15 nt, Molluscum contagiosum virus
gccccgacgccagcg

SEQ ID NO: 4039630 - RNA, 17 nt, Molluscum contagiosum virus
gccccgacgccagcgcg

SEQ ID NO: 4039631 - RNA, 16 nt, Molluscum contagiosum virus
gccccgcaccagugcc

SEQ ID NO: 4039632 - RNA, 17 nt, Molluscum contagiosum virus
gccccgcgcgugcaguu

SEQ ID NO: 4039633 - RNA, 20 nt, Molluscum contagiosum virus
gccccgcgcguugcugcccg

SEQ ID NO: 4039634 - RNA, 15 nt, Molluscum contagiosum virus
gccccugcgcgagca

SEQ ID NO: 4039635 - RNA, 16 nt, Molluscum contagiosum virus
gccccugggcuucugg

SEQ ID NO: 4039636 - RNA, 14 nt, Molluscum contagiosum virus
gcccgaagccguag

SEQ ID NO: 4039637 - RNA, 18 nt, Molluscum contagiosum virus
gcccgacacguugcacug

SEQ ID NO: 4039638 - RNA, 19 nt, Molluscum contagiosum virus
gcccgacuuuucgcgccgc

SEQ ID NO: 4039639 - RNA, 12 nt, Molluscum contagiosum virus
gcccgagcccga

SEQ ID NO: 4039640 - RNA, 17 nt, Molluscum contagiosum virus
gcccgagcccgagcccg

SEQ ID NO: 4039641 - RNA, 17 nt, Molluscum contagiosum virus
gcccgagcgcgcgugcg

SEQ ID NO: 4039642 - RNA, 24 nt, Molluscum contagiosum virus
gcccgagcuaaauggacgcggacc

SEQ ID NO: 4039643 - RNA, 13 nt, Molluscum contagiosum virus
gcccgcacacgca

SEQ ID NO: 4039644 - RNA, 20 nt, Molluscum contagiosum virus
gcccgccagcauggcgagcc

SEQ ID NO: 4039645 - RNA, 15 nt, Molluscum contagiosum virus
gcccgccgacugccg

SEQ ID NO: 4039646 - RNA, 17 nt, Molluscum contagiosum virus
gcccgccgacugccgcc

SEQ ID NO: 4039647 - RNA, 14 nt, Molluscum contagiosum virus
gcccgccugccgcg

SEQ ID NO: 4039648 - RNA, 20 nt, Molluscum contagiosum virus
gcccgccuuuguggacgcgc

SEQ ID NO: 4039649 - RNA, 19 nt, Molluscum contagiosum virus
gcccgcgagauugagagcg

SEQ ID NO: 4039650 - RNA, 13 nt, Molluscum contagiosum virus
gcccgcgcggaga

SEQ ID NO: 4039651 - RNA, 21 nt, Molluscum contagiosum virus
gcccgcgcugcgcaagcgcua

SEQ ID NO: 4039652 - RNA, 21 nt, Molluscum contagiosum virus
gcccgcggacaucgacgccaa

SEQ ID NO: 4039653 - RNA, 22 nt, Molluscum contagiosum virus
gcccgcggacaucgacgccaac

SEQ ID NO: 4039654 - RNA, 19 nt, Molluscum contagiosum virus
gcccgcggacucgugcacc

SEQ ID NO: 4039655 - RNA, 19 nt, Molluscum contagiosum virus
gcccgcugcgcgcucugga

SEQ ID NO: 4039656 - RNA, 21 nt, Molluscum contagiosum virus
gcccggcagcgacuacgcgcu

SEQ ID NO: 4039657 - RNA, 15 nt, Molluscum contagiosum virus
gcccggcgcccgcag

SEQ ID NO: 4039658 - RNA, 18 nt, Molluscum contagiosum virus
gcccgguuuuccggggac

SEQ ID NO: 4039659 - RNA, 18 nt, Molluscum contagiosum virus
gcccucaggggcucuccu

SEQ ID NO: 4039660 - RNA, 14 nt, Molluscum contagiosum virus
gcccuccucgaccu

SEQ ID NO: 4039661 - RNA, 18 nt, Molluscum contagiosum virus
gcccuccucgaccugcac

SEQ ID NO: 4039662 - RNA, 19 nt, Molluscum contagiosum virus
gcccuccucgaccugcacg

SEQ ID NO: 4039663 - RNA, 19 nt, Molluscum contagiosum virus
gcccucgcgcgcgcgcggc

SEQ ID NO: 4039664 - RNA, 23 nt, Molluscum contagiosum virus
gcccuuauacaaaguugaccacc

SEQ ID NO: 4039665 - RNA, 22 nt, Molluscum contagiosum virus
gcccuucguguucgcggacggc

SEQ ID NO: 4039666 - RNA, 16 nt, Molluscum contagiosum virus
gccgaacggcagaccc

SEQ ID NO: 4039667 - RNA, 16 nt, Molluscum contagiosum virus
gccgaacugcucugcg

SEQ ID NO: 4039668 - RNA, 21 nt, Molluscum contagiosum virus
gccgacaacgcacccgcgcgg

SEQ ID NO: 4039669 - RNA, 20 nt, Molluscum contagiosum virus
gccgacuuccgacgggccgc

SEQ ID NO: 4039670 - RNA, 21 nt, Molluscum contagiosum virus
gccgagaaaaagcugucgcgc

SEQ ID NO: 4039671 - RNA, 18 nt, Molluscum contagiosum virus
gccgagcgccgccagcuc

SEQ ID NO: 4039672 - RNA, 14 nt, Molluscum contagiosum virus
gccgagcgugacca

SEQ ID NO: 4039673 - RNA, 13 nt, Molluscum contagiosum virus
gccgagcucgccu

SEQ ID NO: 4039674 - RNA, 13 nt, Molluscum contagiosum virus
gccgagguggcac

SEQ ID NO: 4039675 - RNA, 16 nt, Molluscum contagiosum virus
gccgagguggcacccu

SEQ ID NO: 4039676 - RNA, 16 nt, Molluscum contagiosum virus
gccgaguacugcugcg

SEQ ID NO: 4039677 - RNA, 14 nt, Molluscum contagiosum virus
gccgcaaaagcaag

SEQ ID NO: 4039678 - RNA, 15 nt, Molluscum contagiosum virus
gccgcaaccucuucc

SEQ ID NO: 4039679 - RNA, 14 nt, Molluscum contagiosum virus
gccgcacggcgccc

SEQ ID NO: 4039680 - RNA, 14 nt, Molluscum contagiosum virus
gccgcacgugcugc

SEQ ID NO: 4039681 - RNA, 12 nt, Molluscum contagiosum virus
cgcgcugcuggu

SEQ ID NO: 4039682 - RNA, 14 nt, Molluscum contagiosum virus
cgcgcugcuucccg

SEQ ID NO: 4039683 - RNA, 20 nt, Molluscum contagiosum virus
cgcgcugcuucccgcugagc

SEQ ID NO: 4039684 - RNA, 15 nt, Molluscum contagiosum virus
cgcggaaacaugugu

SEQ ID NO: 4039685 - RNA, 19 nt, Molluscum contagiosum virus
cgcggaacugacugcugcc

SEQ ID NO: 4039686 - RNA, 13 nt, Molluscum contagiosum virus
cgcggaacuggac

SEQ ID NO: 4039687 - RNA, 19 nt, Molluscum contagiosum virus
cgcggacacauugcgaggc

SEQ ID NO: 4039688 - RNA, 22 nt, Molluscum contagiosum virus
cgcggacacauugcgaggcacc

SEQ ID NO: 4039689 - RNA, 16 nt, Molluscum contagiosum virus
cgcggacucgugcacc

SEQ ID NO: 4039690 - RNA, 13 nt, Molluscum contagiosum virus
cgcggaggcgcaa

SEQ ID NO: 4039691 - RNA, 17 nt, Molluscum contagiosum virus
cgcggagggcgaggccu

SEQ ID NO: 4039692 - RNA, 20 nt, Molluscum contagiosum virus
cgcggaggucgagcgcgccg

SEQ ID NO: 4039693 - RNA, 18 nt, Molluscum contagiosum virus
cgcggaucugcgcacacg

SEQ ID NO: 4039694 - RNA, 14 nt, Molluscum contagiosum virus
cgcggaugcgaccg

SEQ ID NO: 4039695 - RNA, 21 nt, Molluscum contagiosum virus
cgcggcaagccuggcuccugu

SEQ ID NO: 4039696 - RNA, 21 nt, Molluscum contagiosum virus
cgcggcaccugucgcgcgccg

SEQ ID NO: 4039697 - RNA, 16 nt, Molluscum contagiosum virus
cgcggcagacgccagc

SEQ ID NO: 4039698 - RNA, 12 nt, Molluscum contagiosum virus
cgcggcagugcu

SEQ ID NO: 4039699 - RNA, 18 nt, Molluscum contagiosum virus
cgcggccaugcgcuugcg

SEQ ID NO: 4039700 - RNA, 14 nt, Molluscum contagiosum virus
cgcggcccgcgggc

SEQ ID NO: 4039701 - RNA, 14 nt, Molluscum contagiosum virus
cgcggccgcgcucg

SEQ ID NO: 4039702 - RNA, 12 nt, Molluscum contagiosum virus
cgcggccgcggc

SEQ ID NO: 4039703 - RNA, 12 nt, Molluscum contagiosum virus
cgcggccugggc

SEQ ID NO: 4039704 - RNA, 17 nt, Molluscum contagiosum virus
cgcggcgagucgcgggc

SEQ ID NO: 4039705 - RNA, 19 nt, Molluscum contagiosum virus
cgcggcgagucgcgggcgc

SEQ ID NO: 4039706 - RNA, 23 nt, Molluscum contagiosum virus
cgcggcgcacaaucucgccggcu

SEQ ID NO: 4039707 - RNA, 13 nt, Molluscum contagiosum virus
cgcggcgcagugc

SEQ ID NO: 4039708 - RNA, 13 nt, Molluscum contagiosum virus
cgcggcgcgccgc

SEQ ID NO: 4039709 - RNA, 20 nt, Molluscum contagiosum virus
cgcggcgcguacucgcgccg

SEQ ID NO: 4039710 - RNA, 14 nt, Molluscum contagiosum virus
cgcggcgcucugcc

SEQ ID NO: 4039711 - RNA, 21 nt, Molluscum contagiosum virus
cgcggcgcuuucgcccgccgc

SEQ ID NO: 4039712 - RNA, 22 nt, Molluscum contagiosum virus
cgcggcggagaugacgggcacg

SEQ ID NO: 4039713 - RNA, 15 nt, Molluscum contagiosum virus
cgcggcggcagcuac

SEQ ID NO: 4039714 - RNA, 16 nt, Molluscum contagiosum virus
cgcggcgggggcagca

SEQ ID NO: 4039715 - RNA, 14 nt, Molluscum contagiosum virus
cgcggcgguugccc

SEQ ID NO: 4039716 - RNA, 14 nt, Molluscum contagiosum virus
cgcggcgugcccgu

SEQ ID NO: 4039717 - RNA, 15 nt, Molluscum contagiosum virus
cgcggcguucccgcu

SEQ ID NO: 4039718 - RNA, 14 nt, Molluscum contagiosum virus
cgcggcuagcaccg

SEQ ID NO: 4039719 - RNA, 20 nt, Molluscum contagiosum virus
cgcgggccuguccgcgggcg

SEQ ID NO: 4039720 - RNA, 17 nt, Molluscum contagiosum virus
cgcgggccuuugccgcu

SEQ ID NO: 4039721 - RNA, 20 nt, Molluscum contagiosum virus
cgcgggccuuugccgcugcc

SEQ ID NO: 4039722 - RNA, 19 nt, Molluscum contagiosum virus
cgcgggcgcagagccugcu

SEQ ID NO: 4039723 - RNA, 21 nt, Molluscum contagiosum virus
cgcgggcguguccgcgggcgc

SEQ ID NO: 4039724 - RNA, 20 nt, Molluscum contagiosum virus
cgcgggcucaagucgcccuu

SEQ ID NO: 4039725 - RNA, 22 nt, Molluscum contagiosum virus
cgcgggcugggaaagggcugcu

SEQ ID NO: 4039726 - RNA, 16 nt, Molluscum contagiosum virus
cgcgguaacgcgcgcg

SEQ ID NO: 4039727 - RNA, 17 nt, Molluscum contagiosum virus
cgcgguccuguccgcgg

SEQ ID NO: 4039728 - RNA, 16 nt, Molluscum contagiosum virus
cgcggucgcccgccga

SEQ ID NO: 4039729 - RNA, 17 nt, Molluscum contagiosum virus
cgcggucgcgcccuugc

SEQ ID NO: 4039730 - RNA, 17 nt, Molluscum contagiosum virus
cgcggucgggccccugc

SEQ ID NO: 4039731 - RNA, 18 nt, Molluscum contagiosum virus
cgcggugagugcgcgcac

SEQ ID NO: 4039732 - RNA, 15 nt, Molluscum contagiosum virus
cgcggugcgggcgcg

SEQ ID NO: 4039733 - RNA, 16 nt, Molluscum contagiosum virus
cgcggugcugcgccag

SEQ ID NO: 4039734 - RNA, 17 nt, Molluscum contagiosum virus
cgcgguggccgcgccgg

SEQ ID NO: 4039735 - RNA, 17 nt, Molluscum contagiosum virus
cgcguaaaagacuggcu

SEQ ID NO: 4039736 - RNA, 14 nt, Molluscum contagiosum virus
cgcguacagcgcgc

SEQ ID NO: 4039737 - RNA, 14 nt, Molluscum contagiosum virus
cgcguacauccgcg

SEQ ID NO: 4039738 - RNA, 17 nt, Molluscum contagiosum virus
cgcguacauccgcgagc

SEQ ID NO: 4039739 - RNA, 15 nt, Molluscum contagiosum virus
cgcguaccagcgccu

SEQ ID NO: 4039740 - RNA, 15 nt, Molluscum contagiosum virus
cgcguacucgcgccg

SEQ ID NO: 4039741 - RNA, 18 nt, Molluscum contagiosum virus
cgcgucaucgcugcacgc

SEQ ID NO: 4039742 - RNA, 19 nt, Molluscum contagiosum virus
cgcguccacgaacgacagc

SEQ ID NO: 4039743 - RNA, 22 nt, Molluscum contagiosum virus
cgcguccacgaacgacagcgcc

SEQ ID NO: 4039744 - RNA, 20 nt, Molluscum contagiosum virus
cgcguccucagguugcucgc

SEQ ID NO: 4039745 - RNA, 16 nt, Molluscum contagiosum virus
cgcgucgcgcgccgca

SEQ ID NO: 4039746 - RNA, 19 nt, Molluscum contagiosum virus
cgcgucguagacgcgcccg

SEQ ID NO: 4039747 - RNA, 14 nt, Molluscum contagiosum virus
cgcgucgucgccgu

SEQ ID NO: 4039748 - RNA, 18 nt, Molluscum contagiosum virus
cgcgucugcgaguggcgc

SEQ ID NO: 4039749 - RNA, 12 nt, Molluscum contagiosum virus
cgcgucugcucu

SEQ ID NO: 4039750 - RNA, 15 nt, Molluscum contagiosum virus
cgcgucugugcgcgc

SEQ ID NO: 4039751 - RNA, 15 nt, Molluscum contagiosum virus
cgcgugaguccgcgg

SEQ ID NO: 4039752 - RNA, 14 nt, Molluscum contagiosum virus
cgcgugccgggcuu

SEQ ID NO: 4039753 - RNA, 14 nt, Molluscum contagiosum virus
cgcgugccuggcuu

SEQ ID NO: 4039754 - RNA, 15 nt, Molluscum contagiosum virus
cgcgugcgcagcacg

SEQ ID NO: 4039755 - RNA, 22 nt, Molluscum contagiosum virus
cgcgugcugagcuagugccgag

SEQ ID NO: 4039756 - RNA, 15 nt, Molluscum contagiosum virus
cgcgugcugcuacgc

SEQ ID NO: 4039757 - RNA, 18 nt, Molluscum contagiosum virus
cgcgugcuugcugcgcug

SEQ ID NO: 4039758 - RNA, 18 nt, Molluscum contagiosum virus
cgcguggcgaucugcucg

SEQ ID NO: 4039759 - RNA, 14 nt, Molluscum contagiosum virus
cgcguggugcuuac

SEQ ID NO: 4039760 - RNA, 21 nt, Molluscum contagiosum virus
cgcuacauguaugccagcgag

SEQ ID NO: 4039761 - RNA, 20 nt, Molluscum contagiosum virus
cgcuaccagcucgcgcaguu

SEQ ID NO: 4039762 - RNA, 17 nt, Molluscum contagiosum virus
cgcuaccuaccggcagc

SEQ ID NO: 4039763 - RNA, 18 nt, Molluscum contagiosum virus
cgcuaccugaugcgcaug

SEQ ID NO: 4039764 - RNA, 14 nt, Molluscum contagiosum virus
cgcuaugccgcgug

SEQ ID NO: 4039765 - RNA, 16 nt, Molluscum contagiosum virus
cgcucauacuccugcu

SEQ ID NO: 4039766 - RNA, 22 nt, Molluscum contagiosum virus
cgcucauacuccugcuggcgug

SEQ ID NO: 4039767 - RNA, 20 nt, Molluscum contagiosum virus
cgcucaucaccgacacgcgc

SEQ ID NO: 4039768 - RNA, 21 nt, Molluscum contagiosum virus
cgcucaucaccgacacgcgcc

SEQ ID NO: 4039769 - RNA, 21 nt, Molluscum contagiosum virus
cgcucaucucgcagacgcagc

SEQ ID NO: 4039770 - RNA, 16 nt, Molluscum contagiosum virus
cgcuccgcagccggag

SEQ ID NO: 4039771 - RNA, 18 nt, Molluscum contagiosum virus
cgcucgaggaggaccacg

SEQ ID NO: 4039772 - RNA, 14 nt, Molluscum contagiosum virus
cgcucgccaccgcg

SEQ ID NO: 4039773 - RNA, 20 nt, Molluscum contagiosum virus
cgcucgcgacgugcgcgcug

SEQ ID NO: 4039774 - RNA, 23 nt, Molluscum contagiosum virus
cgcucgcgcaaguccagcgcgcu

SEQ ID NO: 4039775 - RNA, 13 nt, Molluscum contagiosum virus
cgcucgcgcuucc

SEQ ID NO: 4039776 - RNA, 18 nt, Molluscum contagiosum virus
cgcucgcggugcagcugc

SEQ ID NO: 4039777 - RNA, 18 nt, Molluscum contagiosum virus
cgcucgcgugccgcggac

SEQ ID NO: 4039778 - RNA, 18 nt, Molluscum contagiosum virus
cgcucggaaagagcgcgc

SEQ ID NO: 4039779 - RNA, 16 nt, Molluscum contagiosum virus
cgcucggcacugcugg

SEQ ID NO: 4039780 - RNA, 18 nt, Molluscum contagiosum virus
cgcucggcgcgcgccgcg

SEQ ID NO: 4039781 - RNA, 23 nt, Molluscum contagiosum virus
cgcucgucggcggcaugcgcgcg

SEQ ID NO: 4039782 - RNA, 19 nt, Molluscum contagiosum virus
cgcucgugccgccugcgcg

SEQ ID NO: 4039783 - RNA, 19 nt, Molluscum contagiosum virus
cgcucucgggcaugcacuu

SEQ ID NO: 4039784 - RNA, 13 nt, Molluscum contagiosum virus
cgcucugccgccc

SEQ ID NO: 4039785 - RNA, 21 nt, Molluscum contagiosum virus
cgcucuuacugcagcagcucc

SEQ ID NO: 4039786 - RNA, 22 nt, Molluscum contagiosum virus
cgcugagcaagcucaagaagcc

SEQ ID NO: 4039787 - RNA, 14 nt, Molluscum contagiosum virus
cgcugagcgcagca

SEQ ID NO: 4039788 - RNA, 18 nt, Molluscum contagiosum virus
cgcugagcgcggagcugg

SEQ ID NO: 4039789 - RNA, 13 nt, Molluscum contagiosum virus
cgcugcacgcucu

SEQ ID NO: 4039790 - RNA, 13 nt, Molluscum contagiosum virus
cgcugcagcuagg

SEQ ID NO: 4039791 - RNA, 15 nt, Molluscum contagiosum virus
cgcugcccgcgccgc

SEQ ID NO: 4039792 - RNA, 19 nt, Molluscum contagiosum virus
cgcugccgcgcgcgccgca

SEQ ID NO: 4039793 - RNA, 20 nt, Molluscum contagiosum virus
cgcugccgcgcgcgccgcag

SEQ ID NO: 4039794 - RNA, 23 nt, Molluscum contagiosum virus
cgcugccgcuucgugcgcggaga

SEQ ID NO: 4039795 - RNA, 22 nt, Molluscum contagiosum virus
cgcugccgguggaagagcccgc

SEQ ID NO: 4039796 - RNA, 12 nt, Molluscum contagiosum virus
cgcugcgccgcu

SEQ ID NO: 4039797 - RNA, 19 nt, Molluscum contagiosum virus
cgcugcgccgcuuccuggc

SEQ ID NO: 4039798 - RNA, 14 nt, Molluscum contagiosum virus
cgcugcgcgacgag

SEQ ID NO: 4039799 - RNA, 13 nt, Molluscum contagiosum virus
cgcugcgcgccgc

SEQ ID NO: 4039800 - RNA, 14 nt, Molluscum contagiosum virus
cgcugcgcgcucug

SEQ ID NO: 4039801 - RNA, 17 nt, Molluscum contagiosum virus
cgcugcgcggagcucgc

SEQ ID NO: 4039802 - RNA, 21 nt, Molluscum contagiosum virus
cgcugcgcuggaugcugcucg

SEQ ID NO: 4039803 - RNA, 12 nt, Molluscum contagiosum virus
cgcugcgggcgc

SEQ ID NO: 4039804 - RNA, 13 nt, Molluscum contagiosum virus
cgcugcgggcgcc

SEQ ID NO: 4039805 - RNA, 14 nt, Molluscum contagiosum virus
cgcugcgggcgccg

SEQ ID NO: 4039806 - RNA, 18 nt, Molluscum contagiosum virus
cgcugcuacaagcggugc

SEQ ID NO: 4039807 - RNA, 23 nt, Molluscum contagiosum virus
cgcugcuagagaaccugugcgcg

SEQ ID NO: 4039808 - RNA, 18 nt, Molluscum contagiosum virus
cgcugcucgugcugcucu

SEQ ID NO: 4039809 - RNA, 15 nt, Molluscum contagiosum virus
cgcugcucuggagca

SEQ ID NO: 4039810 - RNA, 16 nt, Molluscum contagiosum virus
cgcugcuggcgcacau

SEQ ID NO: 4039811 - RNA, 18 nt, Molluscum contagiosum virus
cgcugcugguucugcucg

SEQ ID NO: 4039812 - RNA, 19 nt, Molluscum contagiosum virus
cgcuggaccccgagcugcg

SEQ ID NO: 4039813 - RNA, 16 nt, Molluscum contagiosum virus
cgcuggaugcugcucg

SEQ ID NO: 4039814 - RNA, 20 nt, Molluscum contagiosum virus
cgcuggccgugcccgccgac

SEQ ID NO: 4039815 - RNA, 15 nt, Molluscum contagiosum virus
cgcuggccucugcca

SEQ ID NO: 4039816 - RNA, 18 nt, Molluscum contagiosum virus
cgcuggcgcgcgcgcugc

SEQ ID NO: 4039817 - RNA, 15 nt, Molluscum contagiosum virus
cgcuggcggcgcacg

SEQ ID NO: 4039818 - RNA, 15 nt, Molluscum contagiosum virus
cgcuggucacgcgcu

SEQ ID NO: 4039819 - RNA, 22 nt, Molluscum contagiosum virus
cgcuguauaguccccggcgccg

SEQ ID NO: 4039820 - RNA, 15 nt, Molluscum contagiosum virus
cgcugucgcgcgucg

SEQ ID NO: 4039821 - RNA, 15 nt, Molluscum contagiosum virus
cgcuguugcugcugc

SEQ ID NO: 4039822 - RNA, 21 nt, Molluscum contagiosum virus
cgcuguuuggaauugugcugc

SEQ ID NO: 4039823 - RNA, 15 nt, Molluscum contagiosum virus
cgcuuagcacacgcg

SEQ ID NO: 4039824 - RNA, 13 nt, Molluscum contagiosum virus
cgcuuccgcggcc

SEQ ID NO: 4039825 - RNA, 14 nt, Molluscum contagiosum virus
cgcuucggcuccca

SEQ ID NO: 4039826 - RNA, 15 nt, Molluscum contagiosum virus
cgcuucgggcucagc

SEQ ID NO: 4039827 - RNA, 19 nt, Molluscum contagiosum virus
cgcuugccuuggcgcccgu

SEQ ID NO: 4039828 - RNA, 16 nt, Molluscum contagiosum virus
cgcuugcucacgcugc

SEQ ID NO: 4039829 - RNA, 15 nt, Molluscum contagiosum virus
cgcuuguccgcggac

SEQ ID NO: 4039830 - RNA, 16 nt, Molluscum contagiosum virus
cgcuuucgcccgccgc

SEQ ID NO: 4039831 - RNA, 16 nt, Molluscum contagiosum virus
cgcuuucguccgccgc

SEQ ID NO: 4039832 - RNA, 14 nt, Molluscum contagiosum virus
cggaaagagcgcgc

SEQ ID NO: 4039833 - RNA, 20 nt, Molluscum contagiosum virus
cggaaagagcgcgcgaagca

SEQ ID NO: 4039834 - RNA, 23 nt, Molluscum contagiosum virus
cggaaagauauacaccaggcgcg

SEQ ID NO: 4039835 - RNA, 13 nt, Molluscum contagiosum virus
cggaacucgaaga

SEQ ID NO: 4039836 - RNA, 18 nt, Molluscum contagiosum virus
cggaagaauuccuucccg

SEQ ID NO: 4039837 - RNA, 14 nt, Molluscum contagiosum virus
cggaagcuccugcu

SEQ ID NO: 4039838 - RNA, 22 nt, Molluscum contagiosum virus
cggacaagacaacacucgugcu

SEQ ID NO: 4039839 - RNA, 12 nt, Molluscum contagiosum virus
cggacagcaccc

SEQ ID NO: 4039840 - RNA, 21 nt, Molluscum contagiosum virus
cggacagcaccccgaagacgu

SEQ ID NO: 4039841 - RNA, 18 nt, Molluscum contagiosum virus
cggacagcagcucgccgu

SEQ ID NO: 4039842 - RNA, 14 nt, Molluscum contagiosum virus
cggacagcucagca

SEQ ID NO: 4039843 - RNA, 22 nt, Molluscum contagiosum virus
cggacgcccuccucgaccugca

SEQ ID NO: 4039844 - RNA, 16 nt, Molluscum contagiosum virus
cggacgcggccaugcu

SEQ ID NO: 4039845 - RNA, 22 nt, Molluscum contagiosum virus
cggacgcgggccgcgcgcacaa

SEQ ID NO: 4039846 - RNA, 17 nt, Molluscum contagiosum virus
cggacgcgggccugucc

SEQ ID NO: 4039847 - RNA, 15 nt, Molluscum contagiosum virus
cggacggcgcgcagc

SEQ ID NO: 4039848 - RNA, 15 nt, Molluscum contagiosum virus
cggacuucucgcuca

SEQ ID NO: 4039849 - RNA, 18 nt, Molluscum contagiosum virus
cggacuucuugcgcggcg

SEQ ID NO: 4039850 - RNA, 20 nt, Molluscum contagiosum virus
cggagaacaugcucgccagc

SEQ ID NO: 4039851 - RNA, 21 nt, Molluscum contagiosum virus
cggagagcagugccgcucgcu

SEQ ID NO: 4039852 - RNA, 20 nt, Molluscum contagiosum virus
cggagagcuccggcugcucc

SEQ ID NO: 4039853 - RNA, 18 nt, Molluscum contagiosum virus
cggagauggacacagcaa

SEQ ID NO: 4039854 - RNA, 14 nt, Molluscum contagiosum virus
cggagccgcggcag

SEQ ID NO: 4039855 - RNA, 15 nt, Molluscum contagiosum virus
cggagcgcacgaagc

SEQ ID NO: 4039856 - RNA, 16 nt, Molluscum contagiosum virus
cggagcgcagcugccg

SEQ ID NO: 4039857 - RNA, 23 nt, Molluscum contagiosum virus
cggagcgccuucugcaagcugcc

SEQ ID NO: 4039858 - RNA, 16 nt, Molluscum contagiosum virus
cggagcgcuagcaggg

SEQ ID NO: 4039859 - RNA, 12 nt, Molluscum contagiosum virus
cggagcugugcc

SEQ ID NO: 4039860 - RNA, 13 nt, Molluscum contagiosum virus
cggagcugugccg

SEQ ID NO: 4039861 - RNA, 19 nt, Molluscum contagiosum virus
cggaggagcgauccacgag

SEQ ID NO: 4039862 - RNA, 20 nt, Molluscum contagiosum virus
cggaggcacgggcucgaucu

SEQ ID NO: 4039863 - RNA, 18 nt, Molluscum contagiosum virus
cggaggccgcucccgcga

SEQ ID NO: 4039864 - RNA, 22 nt, Molluscum contagiosum virus
cggaggcgcaaccgcgugcgug

SEQ ID NO: 4039865 - RNA, 11 nt, Molluscum contagiosum virus
cggaggcugcu

SEQ ID NO: 4039866 - RNA, 16 nt, Molluscum contagiosum virus
cggaggcugcucccuc

SEQ ID NO: 4039867 - RNA, 20 nt, Molluscum contagiosum virus
cggaucagccccgcgccagc

SEQ ID NO: 4039868 - RNA, 21 nt, Molluscum contagiosum virus
cggaucagccccgcgccagca

SEQ ID NO: 4039869 - RNA, 16 nt, Molluscum contagiosum virus
cggaugcaggcacugc

SEQ ID NO: 4039870 - RNA, 18 nt, Molluscum contagiosum virus
cggaugccacgcagcugg

SEQ ID NO: 4039871 - RNA, 18 nt, Molluscum contagiosum virus
cggaugucacgcagaagu

SEQ ID NO: 4039872 - RNA, 12 nt, Molluscum contagiosum virus
cggauugccgca

SEQ ID NO: 4039873 - RNA, 14 nt, Molluscum contagiosum virus
cggcaaaggcccgc

SEQ ID NO: 4039874 - RNA, 18 nt, Molluscum contagiosum virus
cggcaaaggcccgcgagc

SEQ ID NO: 4039875 - RNA, 20 nt, Molluscum contagiosum virus
cggcacacacuugcacgcgc

SEQ ID NO: 4039876 - RNA, 22 nt, Molluscum contagiosum virus
cggcacacaugcuagcgggcaa

SEQ ID NO: 4039877 - RNA, 23 nt, Molluscum contagiosum virus
cggcacccgugcgcgcgcugaga

SEQ ID NO: 4039878 - RNA, 22 nt, Molluscum contagiosum virus
cggcacggacccgggcgcggca

SEQ ID NO: 4039879 - RNA, 19 nt, Molluscum contagiosum virus
cggcacgggcacgcgcgcg

SEQ ID NO: 4039880 - RNA, 13 nt, Molluscum contagiosum virus
cggcacugggugc

SEQ ID NO: 4039881 - RNA, 14 nt, Molluscum contagiosum virus
cggcagacgccagc

SEQ ID NO: 4039882 - RNA, 16 nt, Molluscum contagiosum virus
cggcagcaagcgcacc

SEQ ID NO: 4039883 - RNA, 15 nt, Molluscum contagiosum virus
cggcagcagcgugca

SEQ ID NO: 4039884 - RNA, 16 nt, Molluscum contagiosum virus
cggcagccgcagaugc

SEQ ID NO: 4039885 - RNA, 20 nt, Molluscum contagiosum virus
cggcagcgacuacgcgcugc

SEQ ID NO: 4039886 - RNA, 13 nt, Molluscum contagiosum virus
cggcagcgccagc

SEQ ID NO: 4039887 - RNA, 17 nt, Molluscum contagiosum virus
cggcagcgccgcgcgcg

SEQ ID NO: 4039888 - RNA, 13 nt, Molluscum contagiosum virus
cggcagcgcgccu

SEQ ID NO: 4039889 - RNA, 16 nt, Molluscum contagiosum virus
cacgcgcacgcucucg

SEQ ID NO: 4039890 - RNA, 13 nt, Molluscum contagiosum virus
cacgcgcccgccg

SEQ ID NO: 4039891 - RNA, 16 nt, Molluscum contagiosum virus
cacgcgccgcgcggcu

SEQ ID NO: 4039892 - RNA, 15 nt, Molluscum contagiosum virus
cacgcgcgcgcgaag

SEQ ID NO: 4039893 - RNA, 17 nt, Molluscum contagiosum virus
cacgcgcgcgugcugcu

SEQ ID NO: 4039894 - RNA, 13 nt, Molluscum contagiosum virus
cacgcgcucgcgc

SEQ ID NO: 4039895 - RNA, 20 nt, Molluscum contagiosum virus
cacgcgggcccgugcucagg

SEQ ID NO: 4039896 - RNA, 16 nt, Molluscum contagiosum virus
cacgcguacgaagagc

SEQ ID NO: 4039897 - RNA, 18 nt, Molluscum contagiosum virus
cacgcgucgcgcaggcgc

SEQ ID NO: 4039898 - RNA, 18 nt, Molluscum contagiosum virus
cacgcgugcugcgcggcg

SEQ ID NO: 4039899 - RNA, 17 nt, Molluscum contagiosum virus
cacgcuacgcagcgcgc

SEQ ID NO: 4039900 - RNA, 19 nt, Molluscum contagiosum virus
cacgcucauacuccugcug

SEQ ID NO: 4039901 - RNA, 17 nt, Molluscum contagiosum virus
cacgcucgcgacgugcg

SEQ ID NO: 4039902 - RNA, 18 nt, Molluscum contagiosum virus
cacgcucgcgcgcaugcu

SEQ ID NO: 4039903 - RNA, 15 nt, Molluscum contagiosum virus
cacgcugcacgagcu

SEQ ID NO: 4039904 - RNA, 19 nt, Molluscum contagiosum virus
cacgcugcgcacgggcgcg

SEQ ID NO: 4039905 - RNA, 18 nt, Molluscum contagiosum virus
cacgcugcgcucggcgcg

SEQ ID NO: 4039906 - RNA, 22 nt, Molluscum contagiosum virus
cacgcugcguuuccagggcagu

SEQ ID NO: 4039907 - RNA, 16 nt, Molluscum contagiosum virus
cacgcuggcgcucggc

SEQ ID NO: 4039908 - RNA, 22 nt, Molluscum contagiosum virus
cacggaaacgaacgcugcagcu

SEQ ID NO: 4039909 - RNA, 16 nt, Molluscum contagiosum virus
cacggacccgggcgcg

SEQ ID NO: 4039910 - RNA, 23 nt, Molluscum contagiosum virus
cacggccuucuccucgcucugcu

SEQ ID NO: 4039911 - RNA, 17 nt, Molluscum contagiosum virus
cacggcgcccaggaaca

SEQ ID NO: 4039912 - RNA, 14 nt, Molluscum contagiosum virus
cacggcgcgcaccu

SEQ ID NO: 4039913 - RNA, 17 nt, Molluscum contagiosum virus
cacggcgcucgccucug

SEQ ID NO: 4039914 - RNA, 14 nt, Molluscum contagiosum virus
cacggcuugccgcu

SEQ ID NO: 4039915 - RNA, 17 nt, Molluscum contagiosum virus
cacgggcccgcgcguga

SEQ ID NO: 4039916 - RNA, 14 nt, Molluscum contagiosum virus
cacgggccugcgcg

SEQ ID NO: 4039917 - RNA, 19 nt, Molluscum contagiosum virus
cacgggcucgaucugcgcc

SEQ ID NO: 4039918 - RNA, 20 nt, Molluscum contagiosum virus
cacgggcucgaucugcgccu

SEQ ID NO: 4039919 - RNA, 20 nt, Molluscum contagiosum virus
cacgguguccacgaugaacg

SEQ ID NO: 4039920 - RNA, 16 nt, Molluscum contagiosum virus
cacguacucgcugcuc

SEQ ID NO: 4039921 - RNA, 13 nt, Molluscum contagiosum virus
cacguagaggaag

SEQ ID NO: 4039922 - RNA, 14 nt, Molluscum contagiosum virus
cacguccaggccgc

SEQ ID NO: 4039923 - RNA, 22 nt, Molluscum contagiosum virus
cacguccguugcacgugcgugc

SEQ ID NO: 4039924 - RNA, 19 nt, Molluscum contagiosum virus
cacgucgacaaguccaccu

SEQ ID NO: 4039925 - RNA, 14 nt, Molluscum contagiosum virus
cacgucggcccgag

SEQ ID NO: 4039926 - RNA, 19 nt, Molluscum contagiosum virus
cacgucggcgagacgugcg

SEQ ID NO: 4039927 - RNA, 19 nt, Molluscum contagiosum virus
cacgugaacuccaaggucg

SEQ ID NO: 4039928 - RNA, 17 nt, Molluscum contagiosum virus
cacgugcagcggcgcca

SEQ ID NO: 4039929 - RNA, 20 nt, Molluscum contagiosum virus
cacgugcugaucacgcucgc

SEQ ID NO: 4039930 - RNA, 23 nt, Molluscum contagiosum virus
cacgugcugcagcugcgcgagcc

SEQ ID NO: 4039931 - RNA, 13 nt, Molluscum contagiosum virus
cacgugcugcgcu

SEQ ID NO: 4039932 - RNA, 14 nt, Molluscum contagiosum virus
cacgugcugcugcg

SEQ ID NO: 4039933 - RNA, 19 nt, Molluscum contagiosum virus
cacguggaaucacggccag

SEQ ID NO: 4039934 - RNA, 19 nt, Molluscum contagiosum virus
cacguggaauugcggccag

SEQ ID NO: 4039935 - RNA, 21 nt, Molluscum contagiosum virus
cacguggugguuggcgugcuc

SEQ ID NO: 4039936 - RNA, 23 nt, Molluscum contagiosum virus
cacguggugguuggcgugcucgc

SEQ ID NO: 4039937 - RNA, 15 nt, Molluscum contagiosum virus
cacguugcacugcgc

SEQ ID NO: 4039938 - RNA, 15 nt, Molluscum contagiosum virus
cacguugcagcagca

SEQ ID NO: 4039939 - RNA, 11 nt, Molluscum contagiosum virus
cacguuggagg

SEQ ID NO: 4039940 - RNA, 23 nt, Molluscum contagiosum virus
cacuaccgcaaccagcugcuguc

SEQ ID NO: 4039941 - RNA, 23 nt, Molluscum contagiosum virus
cacuacucgucuugcgcgccacu

SEQ ID NO: 4039942 - RNA, 14 nt, Molluscum contagiosum virus
cacucgcgcucgcg

SEQ ID NO: 4039943 - RNA, 15 nt, Molluscum contagiosum virus
cacuggcccugcuug

SEQ ID NO: 4039944 - RNA, 20 nt, Molluscum contagiosum virus
cacuggcgcgcacgcgcacg

SEQ ID NO: 4039945 - RNA, 21 nt, Molluscum contagiosum virus
cacugucucugcgcgagcagc

SEQ ID NO: 4039946 - RNA, 15 nt, Molluscum contagiosum virus
cacuguguccccuga

SEQ ID NO: 4039947 - RNA, 15 nt, Molluscum contagiosum virus
cacuucggacaccuc

SEQ ID NO: 4039948 - RNA, 22 nt, Molluscum contagiosum virus
cacuugcacgcgcacgcgcccu

SEQ ID NO: 4039949 - RNA, 22 nt, Molluscum contagiosum virus
cacuugcgcgcgugccuguggc

SEQ ID NO: 4039950 - RNA, 21 nt, Molluscum contagiosum virus
cagaccagagugacgucuucc

SEQ ID NO: 4039951 - RNA, 15 nt, Molluscum contagiosum virus
cagacggcgcgcucg

SEQ ID NO: 4039952 - RNA, 20 nt, Molluscum contagiosum virus
cagacguacgagcaggcgca

SEQ ID NO: 4039953 - RNA, 13 nt, Molluscum contagiosum virus
cagacuaggcaau

SEQ ID NO: 4039954 - RNA, 14 nt, Molluscum contagiosum virus
cagacuucuccaag

SEQ ID NO: 4039955 - RNA, 15 nt, Molluscum contagiosum virus
cagacuuucugcagu

SEQ ID NO: 4039956 - RNA, 20 nt, Molluscum contagiosum virus
cagagccaugcccgggcgug

SEQ ID NO: 4039957 - RNA, 18 nt, Molluscum contagiosum virus
cagagcccgcggcgcacg

SEQ ID NO: 4039958 - RNA, 23 nt, Molluscum contagiosum virus
cagagcccgggagaguggccgcu

SEQ ID NO: 4039959 - RNA, 20 nt, Molluscum contagiosum virus
cagagcgccagcgccuccgc

SEQ ID NO: 4039960 - RNA, 23 nt, Molluscum contagiosum virus
cagagcgugcuggucaacagcua

SEQ ID NO: 4039961 - RNA, 21 nt, Molluscum contagiosum virus
cagaggauucuugcacgggca

SEQ ID NO: 4039962 - RNA, 18 nt, Molluscum contagiosum virus
cagaggcgcguccgcggc

SEQ ID NO: 4039963 - RNA, 20 nt, Molluscum contagiosum virus
cagagguaaucccgagcuuc

SEQ ID NO: 4039964 - RNA, 21 nt, Molluscum contagiosum virus
cagaguccgacccgugcugcu

SEQ ID NO: 4039965 - RNA, 16 nt, Molluscum contagiosum virus
cagagugccuggcgcg

SEQ ID NO: 4039966 - RNA, 16 nt, Molluscum contagiosum virus
cagaugaggcugcucu

SEQ ID NO: 4039967 - RNA, 17 nt, Molluscum contagiosum virus
cagaugaggcugcucuc

SEQ ID NO: 4039968 - RNA, 24 nt, Molluscum contagiosum virus
cagcaaaacugaauaaguauucgc

SEQ ID NO: 4039969 - RNA, 22 nt, Molluscum contagiosum virus
cagcaaacugugcuccugagga

SEQ ID NO: 4039970 - RNA, 14 nt, Molluscum contagiosum virus
cagcaagcagcgcg

SEQ ID NO: 4039971 - RNA, 22 nt, Molluscum contagiosum virus
cagcacaaagagcacggacagc

SEQ ID NO: 4039972 - RNA, 11 nt, Molluscum contagiosum virus
cagcagccagg

SEQ ID NO: 4039973 - RNA, 16 nt, Molluscum contagiosum virus
cagcagccgcagccca

SEQ ID NO: 4039974 - RNA, 21 nt, Molluscum contagiosum virus
cagcagccgcguagcuagcuc

SEQ ID NO: 4039975 - RNA, 12 nt, Molluscum contagiosum virus
cagcagccucgu

SEQ ID NO: 4039976 - RNA, 16 nt, Molluscum contagiosum virus
cagcagcgcgaagcuc

SEQ ID NO: 4039977 - RNA, 22 nt, Molluscum contagiosum virus
cagcagcgcgacuagccugugc

SEQ ID NO: 4039978 - RNA, 13 nt, Molluscum contagiosum virus
cagcagcgugcau

SEQ ID NO: 4039979 - RNA, 14 nt, Molluscum contagiosum virus
cagcagcuccagca

SEQ ID NO: 4039980 - RNA, 23 nt, Molluscum contagiosum virus
cagcagcuccagcauggcgccac

SEQ ID NO: 4039981 - RNA, 16 nt, Molluscum contagiosum virus
cagcaggccucuuuug

SEQ ID NO: 4039982 - RNA, 17 nt, Molluscum contagiosum virus
cagcaggugcacgugcu

SEQ ID NO: 4039983 - RNA, 15 nt, Molluscum contagiosum virus
cagcaucccugccac

SEQ ID NO: 4039984 - RNA, 22 nt, Molluscum contagiosum virus
cagcaugaacucgcugcugcuc

SEQ ID NO: 4039985 - RNA, 15 nt, Molluscum contagiosum virus
cagcauggcgccaca

SEQ ID NO: 4039986 - RNA, 16 nt, Molluscum contagiosum virus
cagcauucccggcgcg

SEQ ID NO: 4039987 - RNA, 24 nt, Molluscum contagiosum virus
cagccaggcuaggcgcgacugcac

SEQ ID NO: 4039988 - RNA, 14 nt, Molluscum contagiosum virus
cagccccgcgccag

SEQ ID NO: 4039989 - RNA, 15 nt, Molluscum contagiosum virus
cagccccugcugcuc

SEQ ID NO: 4039990 - RNA, 16 nt, Molluscum contagiosum virus
cagccccugcugcucg

SEQ ID NO: 4039991 - RNA, 15 nt, Molluscum contagiosum virus
cagcccgacuucucg

SEQ ID NO: 4039992 - RNA, 22 nt, Molluscum contagiosum virus
cagcccgacuucucgcgcgacu

SEQ ID NO: 4039993 - RNA, 15 nt, Molluscum contagiosum virus
cagccgagcgccgcc

SEQ ID NO: 4039994 - RNA, 19 nt, Molluscum contagiosum virus
cagccgagcgccgccagcu

SEQ ID NO: 4039995 - RNA, 16 nt, Molluscum contagiosum virus
cagccgcaccgggacg

SEQ ID NO: 4039996 - RNA, 14 nt, Molluscum contagiosum virus
cagccgcacggcgc

SEQ ID NO: 4039997 - RNA, 19 nt, Molluscum contagiosum virus
cagccgccugccgcgcucg

SEQ ID NO: 4039998 - RNA, 22 nt, Molluscum contagiosum virus
cagccgcucguccagcugcgcg

SEQ ID NO: 4039999 - RNA, 19 nt, Molluscum contagiosum virus
cagccguggaguccaugcc

SEQ ID NO: 4040000 - RNA, 22 nt, Molluscum contagiosum virus
cagccuccgguuuucgcgggag

SEQ ID NO: 4040001 - RNA, 21 nt, Molluscum contagiosum virus
cagccuccgugcgccaguccg

SEQ ID NO: 4040002 - RNA, 20 nt, Molluscum contagiosum virus
cagccucugugcggcgccgu

SEQ ID NO: 4040003 - RNA, 13 nt, Molluscum contagiosum virus
cagccuguuuuua

SEQ ID NO: 4040004 - RNA, 19 nt, Molluscum contagiosum virus
cagcgacgagcagcugcuu

SEQ ID NO: 4040005 - RNA, 20 nt, Molluscum contagiosum virus
cagcgagaucaacgcgcgcg

SEQ ID NO: 4040006 - RNA, 24 nt, Molluscum contagiosum virus
cagcgauugcccgcgcgcggacag

SEQ ID NO: 4040007 - RNA, 10 nt, Molluscum contagiosum virus
cagcgcagca

SEQ ID NO: 4040008 - RNA, 18 nt, Molluscum contagiosum virus
cagcgcagcagcgcgacu

SEQ ID NO: 4040009 - RNA, 18 nt, Molluscum contagiosum virus
cagcgccagccugcuggc

SEQ ID NO: 4040010 - RNA, 20 nt, Molluscum contagiosum virus
cagcgccagccugcuggcac

SEQ ID NO: 4040011 - RNA, 14 nt, Molluscum contagiosum virus
cagcgccgccaccu

SEQ ID NO: 4040012 - RNA, 20 nt, Molluscum contagiosum virus
cagcgccgccaccucggcgu

SEQ ID NO: 4040013 - RNA, 13 nt, Molluscum contagiosum virus
cagcgccgccucg

SEQ ID NO: 4040014 - RNA, 14 nt, Molluscum contagiosum virus
cagcgccgcgcggu

SEQ ID NO: 4040015 - RNA, 18 nt, Molluscum contagiosum virus
cagcgccugcuugcgcac

SEQ ID NO: 4040016 - RNA, 15 nt, Molluscum contagiosum virus
cagcgcgagcugugc

SEQ ID NO: 4040017 - RNA, 15 nt, Molluscum contagiosum virus
cagcgcgcagaagcc

SEQ ID NO: 4040018 - RNA, 16 nt, Molluscum contagiosum virus
cagcgcgcgacugucu

SEQ ID NO: 4040019 - RNA, 15 nt, Molluscum contagiosum virus
cagcgcuagccccag

SEQ ID NO: 4040020 - RNA, 22 nt, Molluscum contagiosum virus
cagcgcuuuguugccucaguac

SEQ ID NO: 4040021 - RNA, 17 nt, Molluscum contagiosum virus
cagcggcaaaggcccgc

SEQ ID NO: 4040022 - RNA, 20 nt, Molluscum contagiosum virus
cagcggcaaaggcccgcgag

SEQ ID NO: 4040023 - RNA, 21 nt, Molluscum contagiosum virus
cagcggcgccaccggcagugc

SEQ ID NO: 4040024 - RNA, 14 nt, Molluscum contagiosum virus
cagcggcgccgcag

SEQ ID NO: 4040025 - RNA, 18 nt, Molluscum contagiosum virus
cagcggcgugcugcagcc

SEQ ID NO: 4040026 - RNA, 17 nt, Molluscum contagiosum virus
cagcgggcgcugcucgc

SEQ ID NO: 4040027 - RNA, 21 nt, Molluscum contagiosum virus
cagcgggcuacucgagcacgg

SEQ ID NO: 4040028 - RNA, 17 nt, Molluscum contagiosum virus
cagcggucucggcagca

SEQ ID NO: 4040029 - RNA, 20 nt, Molluscum contagiosum virus
cagcguacggcccgaaggcc

SEQ ID NO: 4040030 - RNA, 17 nt, Molluscum contagiosum virus
cagcguggagcaccugg

SEQ ID NO: 4040031 - RNA, 18 nt, Molluscum contagiosum virus
cagcguguucggggccgc

SEQ ID NO: 4040032 - RNA, 20 nt, Molluscum contagiosum virus
cagcuacgagccgcugcucc

SEQ ID NO: 4040033 - RNA, 19 nt, Molluscum contagiosum virus
cagcucaagacgcugcugg

SEQ ID NO: 4040034 - RNA, 17 nt, Molluscum contagiosum virus
cagcucaagcugcucau

SEQ ID NO: 4040035 - RNA, 23 nt, Molluscum contagiosum virus
cagcuccgcgacuaccugcugcu

SEQ ID NO: 4040036 - RNA, 15 nt, Molluscum contagiosum virus
cagcuccgcgcggcg

SEQ ID NO: 4040037 - RNA, 18 nt, Molluscum contagiosum virus
cagcucgaugggcuccag

SEQ ID NO: 4040038 - RNA, 12 nt, Molluscum contagiosum virus
cagcucgcgccg

SEQ ID NO: 4040039 - RNA, 16 nt, Molluscum contagiosum virus
cagcucggcgagagcg

SEQ ID NO: 4040040 - RNA, 18 nt, Molluscum contagiosum virus
cagcucgucaacggugcg

SEQ ID NO: 4040041 - RNA, 19 nt, Molluscum contagiosum virus
cagcucguugcgcagccgg

SEQ ID NO: 4040042 - RNA, 12 nt, Molluscum contagiosum virus
cagcugcgcgag

SEQ ID NO: 4040043 - RNA, 19 nt, Molluscum contagiosum virus
cagcugcugucgcucgugg

SEQ ID NO: 4040044 - RNA, 23 nt, Molluscum contagiosum virus
cagcuuagcuuccgucugcugcu

SEQ ID NO: 4040045 - RNA, 16 nt, Molluscum contagiosum virus
cagcuucgcgagcccg

SEQ ID NO: 4040046 - RNA, 21 nt, Molluscum contagiosum virus
cagcuucuuggagcccuugau

SEQ ID NO: 4040047 - RNA, 17 nt, Molluscum contagiosum virus
caggaaagguaccccgc

SEQ ID NO: 4040048 - RNA, 18 nt, Molluscum contagiosum virus
caggaaagguacccgcag

SEQ ID NO: 4040049 - RNA, 20 nt, Molluscum contagiosum virus
caggaacgaggaaaggcaca

SEQ ID NO: 4040050 - RNA, 18 nt, Molluscum contagiosum virus
caggaacugcccgcgucg

SEQ ID NO: 4040051 - RNA, 17 nt, Molluscum contagiosum virus
caggaagcgcgucauga

SEQ ID NO: 4040052 - RNA, 15 nt, Molluscum contagiosum virus
caggaagcuggcgcg

SEQ ID NO: 4040053 - RNA, 21 nt, Molluscum contagiosum virus
caggacgacgacacagcccug

SEQ ID NO: 4040054 - RNA, 15 nt, Molluscum contagiosum virus
caggacgugcacgug

SEQ ID NO: 4040055 - RNA, 16 nt, Molluscum contagiosum virus
caggagcagucucugc

SEQ ID NO: 4040056 - RNA, 19 nt, Molluscum contagiosum virus
caggagcauggccgcgucc

SEQ ID NO: 4040057 - RNA, 12 nt, Molluscum contagiosum virus
caggcacuccag

SEQ ID NO: 4040058 - RNA, 14 nt, Molluscum contagiosum virus
caggcagcugcugc

SEQ ID NO: 4040059 - RNA, 18 nt, Molluscum contagiosum virus
caggcagugccgccgcgc

SEQ ID NO: 4040060 - RNA, 14 nt, Molluscum contagiosum virus
caggccaggugcag

SEQ ID NO: 4040061 - RNA, 18 nt, Molluscum contagiosum virus
caggccccgcaccagugc

SEQ ID NO: 4040062 - RNA, 21 nt, Molluscum contagiosum virus
caggccgcccacgcucaacca

SEQ ID NO: 4040063 - RNA, 23 nt, Molluscum contagiosum virus
caggccgggcgcgguagcucgug

SEQ ID NO: 4040064 - RNA, 17 nt, Molluscum contagiosum virus
caggccggucgcggaag

SEQ ID NO: 4040065 - RNA, 21 nt, Molluscum contagiosum virus
caggccucuuuugcgucgcga

SEQ ID NO: 4040066 - RNA, 16 nt, Molluscum contagiosum virus
caggcgcagcgcggcc

SEQ ID NO: 4040067 - RNA, 22 nt, Molluscum contagiosum virus
caggcgccgcaccucaccgcgc

SEQ ID NO: 4040068 - RNA, 14 nt, Molluscum contagiosum virus
caggcgccggcgcg

SEQ ID NO: 4040069 - RNA, 18 nt, Molluscum contagiosum virus
caggcgcgcaagugcgug

SEQ ID NO: 4040070 - RNA, 14 nt, Molluscum contagiosum virus
caggcgcgcgcgau

SEQ ID NO: 4040071 - RNA, 18 nt, Molluscum contagiosum virus
caggcgcggucgcccgcc

SEQ ID NO: 4040072 - RNA, 18 nt, Molluscum contagiosum virus
caggcgcugcgcggcgcg

SEQ ID NO: 4040073 - RNA, 18 nt, Molluscum contagiosum virus
caggcggugggcgccgcg

SEQ ID NO: 4040074 - RNA, 16 nt, Molluscum contagiosum virus
caggcguagcgcgucu

SEQ ID NO: 4040075 - RNA, 21 nt, Molluscum contagiosum virus
caggcgucaugcgcgcgcgcu

SEQ ID NO: 4040076 - RNA, 21 nt, Molluscum contagiosum virus
caggcuguguuccagcucggg

SEQ ID NO: 4040077 - RNA, 21 nt, Molluscum contagiosum virus
cagggaaaaaucccccgccag

SEQ ID NO: 4040078 - RNA, 23 nt, Molluscum contagiosum virus
cagggaaagagcacgcgcucgcg

SEQ ID NO: 4040079 - RNA, 22 nt, Molluscum contagiosum virus
cagggcccgcgcucgccgcacg

SEQ ID NO: 4040080 - RNA, 21 nt, Molluscum contagiosum virus
caggguuuucacgcaggaccu

SEQ ID NO: 4040081 - RNA, 14 nt, Molluscum contagiosum virus
caggucggccagca

SEQ ID NO: 4040082 - RNA, 14 nt, Molluscum contagiosum virus
cagguggagcuguc

SEQ ID NO: 4040083 - RNA, 20 nt, Molluscum contagiosum virus
cagguggccgcgcgcgcacg

SEQ ID NO: 4040084 - RNA, 20 nt, Molluscum contagiosum virus
cagguucucgcacaguacca

SEQ ID NO: 4040085 - RNA, 20 nt, Molluscum contagiosum virus
caguaacgguaccuggcuug

SEQ ID NO: 4040086 - RNA, 17 nt, Molluscum contagiosum virus
caguacaugcccggccu

SEQ ID NO: 4040087 - RNA, 16 nt, Molluscum contagiosum virus
caguaccaguaccugc

SEQ ID NO: 4040088 - RNA, 15 nt, Molluscum contagiosum virus
caguaccgugucaaa

SEQ ID NO: 4040089 - RNA, 23 nt, Molluscum contagiosum virus
caguaccgugucaaacugcuugu

SEQ ID NO: 4040090 - RNA, 14 nt, Molluscum contagiosum virus
caguaccugcugcc

SEQ ID NO: 4040091 - RNA, 15 nt, Molluscum contagiosum virus
caguaccugcugccg

SEQ ID NO: 4040092 - RNA, 21 nt, Molluscum contagiosum virus
caguaggacauguccggcccg

SEQ ID NO: 4040093 - RNA, 17 nt, Molluscum contagiosum virus
cagucccagcaccgcgc

SEQ ID NO: 4040094 - RNA, 21 nt, Molluscum contagiosum virus
cagucccagcaccgcgccgcg

SEQ ID NO: 4040095 - RNA, 22 nt, Molluscum contagiosum virus
ucucacgcgcuaccgcaagcuc

SEQ ID NO: 4040096 - RNA, 21 nt, Molluscum contagiosum virus
ucucagagcuccgcgcaugcc

SEQ ID NO: 4040097 - RNA, 22 nt, Molluscum contagiosum virus
ucucagagcuccgcgcaugcca

SEQ ID NO: 4040098 - RNA, 16 nt, Molluscum contagiosum virus
ucuccaugucgucaaa

SEQ ID NO: 4040099 - RNA, 17 nt, Molluscum contagiosum virus
ucucccgccgcgugccc

SEQ ID NO: 4040100 - RNA, 22 nt, Molluscum contagiosum virus
ucuccgaagagcagaaggcgua

SEQ ID NO: 4040101 - RNA, 14 nt, Molluscum contagiosum virus
ucuccgcgcugcac

SEQ ID NO: 4040102 - RNA, 12 nt, Molluscum contagiosum virus
ucucgaggccgg

SEQ ID NO: 4040103 - RNA, 22 nt, Molluscum contagiosum virus
ucucgcagacgcagcgcgagcu

SEQ ID NO: 4040104 - RNA, 19 nt, Molluscum contagiosum virus
ucucgcuggcuccgcugga

SEQ ID NO: 4040105 - RNA, 17 nt, Molluscum contagiosum virus
ucucggacagugccucc

SEQ ID NO: 4040106 - RNA, 17 nt, Molluscum contagiosum virus
ucucgggugugugccug

SEQ ID NO: 4040107 - RNA, 19 nt, Molluscum contagiosum virus
ucucguggcguugcugcug

SEQ ID NO: 4040108 - RNA, 20 nt, Molluscum contagiosum virus
ucucugauaguaccacugug

SEQ ID NO: 4040109 - RNA, 13 nt, Molluscum contagiosum virus
ucucugcgccgcg

SEQ ID NO: 4040110 - RNA, 13 nt, Molluscum contagiosum virus
ucucuucaugaaa

SEQ ID NO: 4040111 - RNA, 11 nt, Molluscum contagiosum virus
ucugcaagcug

SEQ ID NO: 4040112 - RNA, 15 nt, Molluscum contagiosum virus
ucugcacgggcacgc

SEQ ID NO: 4040113 - RNA, 17 nt, Molluscum contagiosum virus
ucugcagcgccgcgcgg

SEQ ID NO: 4040114 - RNA, 18 nt, Molluscum contagiosum virus
ucugccaccgcggcgcgg

SEQ ID NO: 4040115 - RNA, 16 nt, Molluscum contagiosum virus
ucugccgcccgcgccc

SEQ ID NO: 4040116 - RNA, 15 nt, Molluscum contagiosum virus
ucugccggaguaaau

SEQ ID NO: 4040117 - RNA, 16 nt, Molluscum contagiosum virus
ucugccguucggcgag

SEQ ID NO: 4040118 - RNA, 22 nt, Molluscum contagiosum virus
ucugcgcagguagcggcucgcg

SEQ ID NO: 4040119 - RNA, 19 nt, Molluscum contagiosum virus
ucugcgcccgcggagaaag

SEQ ID NO: 4040120 - RNA, 15 nt, Molluscum contagiosum virus
ucugcgccgcgcgcg

SEQ ID NO: 4040121 - RNA, 18 nt, Molluscum contagiosum virus
ucugcgcgagcagcugcu

SEQ ID NO: 4040122 - RNA, 24 nt, Molluscum contagiosum virus
ucugcgcgcgguaacgcgcgcgcc

SEQ ID NO: 4040123 - RNA, 17 nt, Molluscum contagiosum virus
ucugcguugcgcgucau

SEQ ID NO: 4040124 - RNA, 17 nt, Molluscum contagiosum virus
ucuggacguguccgacg

SEQ ID NO: 4040125 - RNA, 20 nt, Molluscum contagiosum virus
ucuggcguacucgugucaca

SEQ ID NO: 4040126 - RNA, 19 nt, Molluscum contagiosum virus
ucuggcucguacugcugca

SEQ ID NO: 4040127 - RNA, 19 nt, Molluscum contagiosum virus
ucuguccgucuugcgcaca

SEQ ID NO: 4040128 - RNA, 19 nt, Molluscum contagiosum virus
ucugucguggaggaaacac

SEQ ID NO: 4040129 - RNA, 16 nt, Molluscum contagiosum virus
ucugugaccugcgcca

SEQ ID NO: 4040130 - RNA, 23 nt, Molluscum contagiosum virus
ucuuacggagcuacaaaacugaa

SEQ ID NO: 4040131 - RNA, 20 nt, Molluscum contagiosum virus
ucuucaccugcauugagcuc

SEQ ID NO: 4040132 - RNA, 20 nt, Molluscum contagiosum virus
ucuuccacgccuucguggag

SEQ ID NO: 4040133 - RNA, 19 nt, Molluscum contagiosum virus
ucuuccagcacugcgccaa

SEQ ID NO: 4040134 - RNA, 20 nt, Molluscum contagiosum virus
ucuuccccgcgggccgccgc

SEQ ID NO: 4040135 - RNA, 16 nt, Molluscum contagiosum virus
ucuucccgugcaaggu

SEQ ID NO: 4040136 - RNA, 20 nt, Molluscum contagiosum virus
ucuucccguuccugggcaac

SEQ ID NO: 4040137 - RNA, 14 nt, Molluscum contagiosum virus
ucuuccggcccgac

SEQ ID NO: 4040138 - RNA, 15 nt, Molluscum contagiosum virus
ucuucguggcgcugg

SEQ ID NO: 4040139 - RNA, 19 nt, Molluscum contagiosum virus
ucuucguggcgcugggcgc

SEQ ID NO: 4040140 - RNA, 20 nt, Molluscum contagiosum virus
ucuugaaaugauugguucuu

SEQ ID NO: 4040141 - RNA, 22 nt, Molluscum contagiosum virus
ucuugacgcccauuaaauggcc

SEQ ID NO: 4040142 - RNA, 15 nt, Molluscum contagiosum virus
ucuuucauggcuccc

SEQ ID NO: 4040143 - RNA, 24 nt, Molluscum contagiosum virus
ucuuugccccccccccgacgcgag

SEQ ID NO: 4040144 - RNA, 18 nt, Molluscum contagiosum virus
ucuuugcgaacgcgcaag

SEQ ID NO: 4040145 - RNA, 20 nt, Molluscum contagiosum virus
ucuuugcgcgcggggcacug

SEQ ID NO: 4040146 - RNA, 16 nt, Molluscum contagiosum virus
ugaaaauaaagaggcu

SEQ ID NO: 4040147 - RNA, 11 nt, Molluscum contagiosum virus
ugaacaagcug

SEQ ID NO: 4040148 - RNA, 18 nt, Molluscum contagiosum virus
ugaacaauacaugcugga

SEQ ID NO: 4040149 - RNA, 12 nt, Molluscum contagiosum virus
ugaacgcgcugc

SEQ ID NO: 4040150 - RNA, 14 nt, Molluscum contagiosum virus
ugaacucgcugcug

SEQ ID NO: 4040151 - RNA, 15 nt, Molluscum contagiosum virus
ugaacucgcugcugc

SEQ ID NO: 4040152 - RNA, 22 nt, Molluscum contagiosum virus
ugaacucuucccguuccugggc

SEQ ID NO: 4040153 - RNA, 12 nt, Molluscum contagiosum virus
ugaaggcgcggc

SEQ ID NO: 4040154 - RNA, 17 nt, Molluscum contagiosum virus
ugaaguccucucucccc

SEQ ID NO: 4040155 - RNA, 14 nt, Molluscum contagiosum virus
ugaaucccacaaau

SEQ ID NO: 4040156 - RNA, 15 nt, Molluscum contagiosum virus
ugacacgcgugucug

SEQ ID NO: 4040157 - RNA, 11 nt, Molluscum contagiosum virus
ugacagcaucg

SEQ ID NO: 4040158 - RNA, 16 nt, Molluscum contagiosum virus
ugaccgcuucgagugc

SEQ ID NO: 4040159 - RNA, 16 nt, Molluscum contagiosum virus
ugacggcgcugcgcgu

SEQ ID NO: 4040160 - RNA, 20 nt, Molluscum contagiosum virus
ugacggcgguucucgcgcuu

SEQ ID NO: 4040161 - RNA, 19 nt, Molluscum contagiosum virus
ugacggcgucucucgaaca

SEQ ID NO: 4040162 - RNA, 16 nt, Molluscum contagiosum virus
ugacgguacucaugcu

SEQ ID NO: 4040163 - RNA, 19 nt, Molluscum contagiosum virus
ugacucggacacuggaggu

SEQ ID NO: 4040164 - RNA, 17 nt, Molluscum contagiosum virus
ugagaggaccucccggc

SEQ ID NO: 4040165 - RNA, 13 nt, Molluscum contagiosum virus
ugagcucgcgcgc

SEQ ID NO: 4040166 - RNA, 14 nt, Molluscum contagiosum virus
ugaggcugcucucc

SEQ ID NO: 4040167 - RNA, 14 nt, Molluscum contagiosum virus
ugagugcugagcca

SEQ ID NO: 4040168 - RNA, 15 nt, Molluscum contagiosum virus
ugaucccggaacgca

SEQ ID NO: 4040169 - RNA, 23 nt, Molluscum contagiosum virus
ugaucuccacaugccuucaggaa

SEQ ID NO: 4040170 - RNA, 22 nt, Molluscum contagiosum virus
ugcaaccgcugcucgacauuaa

SEQ ID NO: 4040171 - RNA, 22 nt, Molluscum contagiosum virus
ugcaacucgcgcugcagcaccu

SEQ ID NO: 4040172 - RNA, 22 nt, Molluscum contagiosum virus
ugcaagagcucguggacagccu

SEQ ID NO: 4040173 - RNA, 16 nt, Molluscum contagiosum virus
ugcacaccggcgcgcu

SEQ ID NO: 4040174 - RNA, 20 nt, Molluscum contagiosum virus
ugcacccgcgcagcgugccg

SEQ ID NO: 4040175 - RNA, 16 nt, Molluscum contagiosum virus
ugcaccuacgcgccga

SEQ ID NO: 4040176 - RNA, 22 nt, Molluscum contagiosum virus
ugcaccugcuggaacgcuuggc

SEQ ID NO: 4040177 - RNA, 22 nt, Molluscum contagiosum virus
ugcacgacguacgagugcugga

SEQ ID NO: 4040178 - RNA, 21 nt, Molluscum contagiosum virus
ugcacgcgugugguugcuugc

SEQ ID NO: 4040179 - RNA, 17 nt, Molluscum contagiosum virus
ugcacggggaagcacgc

SEQ ID NO: 4040180 - RNA, 15 nt, Molluscum contagiosum virus
ugcacguccugcgag

SEQ ID NO: 4040181 - RNA, 21 nt, Molluscum contagiosum virus
ugcacuuucaacucucuaccu

SEQ ID NO: 4040182 - RNA, 18 nt, Molluscum contagiosum virus
ugcagauuggaggaggaa

SEQ ID NO: 4040183 - RNA, 23 nt, Molluscum contagiosum virus
ugcagcguuacguacagcgggcg

SEQ ID NO: 4040184 - RNA, 20 nt, Molluscum contagiosum virus
ugcagcugcaggaccugcug

SEQ ID NO: 4040185 - RNA, 12 nt, Molluscum contagiosum virus
ugcagcugcgcg

SEQ ID NO: 4040186 - RNA, 18 nt, Molluscum contagiosum virus
ugcagcugcgcgagccgc

SEQ ID NO: 4040187 - RNA, 17 nt, Molluscum contagiosum virus
ugcaggauuuccucgcg

SEQ ID NO: 4040188 - RNA, 17 nt, Molluscum contagiosum virus
ugcaguuccaccucgag

SEQ ID NO: 4040189 - RNA, 18 nt, Molluscum contagiosum virus
ugcaguuucuccucgaag

SEQ ID NO: 4040190 - RNA, 15 nt, Molluscum contagiosum virus
ugcaugcccagcaug

SEQ ID NO: 4040191 - RNA, 17 nt, Molluscum contagiosum virus
ugccacaugcaguacgc

SEQ ID NO: 4040192 - RNA, 21 nt, Molluscum contagiosum virus
ugccaccaugcgcacagcacu

SEQ ID NO: 4040193 - RNA, 18 nt, Molluscum contagiosum virus
ugccacgaccgcgcacgc

SEQ ID NO: 4040194 - RNA, 22 nt, Molluscum contagiosum virus
ugccagagucgccgcugcgcau

SEQ ID NO: 4040195 - RNA, 21 nt, Molluscum contagiosum virus
gucguccggaggcacgggcuc

SEQ ID NO: 4040196 - RNA, 17 nt, Molluscum contagiosum virus
gucgugcaccuggagca

SEQ ID NO: 4040197 - RNA, 15 nt, Molluscum contagiosum virus
gucgugcaggucgag

SEQ ID NO: 4040198 - RNA, 22 nt, Molluscum contagiosum virus
gucgugcuuccugcaaacuuga

SEQ ID NO: 4040199 - RNA, 19 nt, Molluscum contagiosum virus
gucguuccggacgugcacg

SEQ ID NO: 4040200 - RNA, 21 nt, Molluscum contagiosum virus
gucucaugguggccggccgcc

SEQ ID NO: 4040201 - RNA, 15 nt, Molluscum contagiosum virus
ucgacguggagccug

SEQ ID NO: 4040202 - RNA, 15 nt, Molluscum contagiosum virus
ucgacguugacgagc

SEQ ID NO: 4040203 - RNA, 17 nt, Molluscum contagiosum virus
ucgagaagaccuguucu

SEQ ID NO: 4040204 - RNA, 21 nt, Molluscum contagiosum virus
ucgagaagacggggcgcacgc

SEQ ID NO: 4040205 - RNA, 14 nt, Molluscum contagiosum virus
ucgagacaggccgg

SEQ ID NO: 4040206 - RNA, 15 nt, Molluscum contagiosum virus
ucgagcacgcgcgag

SEQ ID NO: 4040207 - RNA, 21 nt, Molluscum contagiosum virus
ucgagcauuugcucgcucgga

SEQ ID NO: 4040208 - RNA, 19 nt, Molluscum contagiosum virus
ucgagcgcgcgccugcugg

SEQ ID NO: 4040209 - RNA, 20 nt, Molluscum contagiosum virus
ucgagcgcgcgccugcuggc

SEQ ID NO: 4040210 - RNA, 13 nt, Molluscum contagiosum virus
ucgagcgcgcugg

SEQ ID NO: 4040211 - RNA, 17 nt, Molluscum contagiosum virus
ucgagcugcugcgcgag

SEQ ID NO: 4040212 - RNA, 15 nt, Molluscum contagiosum virus
ucgagcuuccucaag

SEQ ID NO: 4040213 - RNA, 19 nt, Molluscum contagiosum virus
ucgagcuucggacgagcuc

SEQ ID NO: 4040214 - RNA, 21 nt, Molluscum contagiosum virus
ucgaggcgcuugggcacugcu

SEQ ID NO: 4040215 - RNA, 16 nt, Molluscum contagiosum virus
ucgagggggacgugcc

SEQ ID NO: 4040216 - RNA, 12 nt, Molluscum contagiosum virus
ucgaucagcucc

SEQ ID NO: 4040217 - RNA, 14 nt, Molluscum contagiosum virus
ucgcaacaaaagag

SEQ ID NO: 4040218 - RNA, 20 nt, Molluscum contagiosum virus
ucgcaaccccgcgcugcgcg

SEQ ID NO: 4040219 - RNA, 18 nt, Molluscum contagiosum virus
ucgcagaacugcugcgcg

SEQ ID NO: 4040220 - RNA, 16 nt, Molluscum contagiosum virus
ucgcagacgacucgcu

SEQ ID NO: 4040221 - RNA, 20 nt, Molluscum contagiosum virus
ucgcagacgacucgcugcca

SEQ ID NO: 4040222 - RNA, 21 nt, Molluscum contagiosum virus
ucgcagacgcagcgcgagcug

SEQ ID NO: 4040223 - RNA, 16 nt, Molluscum contagiosum virus
ucgcagcagugccagc

SEQ ID NO: 4040224 - RNA, 20 nt, Molluscum contagiosum virus
ucgcagccuccgugcgccag

SEQ ID NO: 4040225 - RNA, 13 nt, Molluscum contagiosum virus
ucgcaggcgugcu

SEQ ID NO: 4040226 - RNA, 22 nt, Molluscum contagiosum virus
ucgcagggggggcuugcggucu

SEQ ID NO: 4040227 - RNA, 12 nt, Molluscum contagiosum virus
ucgcagugcccg

SEQ ID NO: 4040228 - RNA, 22 nt, Molluscum contagiosum virus
ucgcauuaaacaacacgcgcga

SEQ ID NO: 4040229 - RNA, 11 nt, Molluscum contagiosum virus
ucgccaaagag

SEQ ID NO: 4040230 - RNA, 22 nt, Molluscum contagiosum virus
ucgcccaucaucgccagcauca

SEQ ID NO: 4040231 - RNA, 23 nt, Molluscum contagiosum virus
ucgcccggcaggcucccgcuguc

SEQ ID NO: 4040232 - RNA, 16 nt, Molluscum contagiosum virus
ucgcccugcccgcgcg

SEQ ID NO: 4040233 - RNA, 19 nt, Molluscum contagiosum virus
ucgccgcgcgccgcugcuc

SEQ ID NO: 4040234 - RNA, 16 nt, Molluscum contagiosum virus
ucgccggcaccacggu

SEQ ID NO: 4040235 - RNA, 22 nt, Molluscum contagiosum virus
ucgccguguuggaagucguggc

SEQ ID NO: 4040236 - RNA, 17 nt, Molluscum contagiosum virus
ucgccuccgggcgcaca

SEQ ID NO: 4040237 - RNA, 15 nt, Molluscum contagiosum virus
ucgccuuccugcgcc

SEQ ID NO: 4040238 - RNA, 18 nt, Molluscum contagiosum virus
ucgccuuugugacaagga

SEQ ID NO: 4040239 - RNA, 18 nt, Molluscum contagiosum virus
ucgcgaccuggcgcgugc

SEQ ID NO: 4040240 - RNA, 14 nt, Molluscum contagiosum virus
ucgcgacgugcgcg

SEQ ID NO: 4040241 - RNA, 19 nt, Molluscum contagiosum virus
ucgcgagaaguucugcaca

SEQ ID NO: 4040242 - RNA, 14 nt, Molluscum contagiosum virus
ucgcgagcgccacu

SEQ ID NO: 4040243 - RNA, 22 nt, Molluscum contagiosum virus
ucgcgcacgaccacgugcagga

SEQ ID NO: 4040244 - RNA, 16 nt, Molluscum contagiosum virus
ucgcgcacgcgcacgc

SEQ ID NO: 4040245 - RNA, 18 nt, Molluscum contagiosum virus
ucgcgcccugcgcgcgag

SEQ ID NO: 4040246 - RNA, 22 nt, Molluscum contagiosum virus
ucgcgcgacuggcacgcgccgc

SEQ ID NO: 4040247 - RNA, 18 nt, Molluscum contagiosum virus
ucgcgcgccgccgcaaca

SEQ ID NO: 4040248 - RNA, 16 nt, Molluscum contagiosum virus
ucgcgcgccgcgcugg

SEQ ID NO: 4040249 - RNA, 14 nt, Molluscum contagiosum virus
ucgcgcgccugccg

SEQ ID NO: 4040250 - RNA, 13 nt, Molluscum contagiosum virus
ucgcgcgccugcg

SEQ ID NO: 4040251 - RNA, 20 nt, Molluscum contagiosum virus
ucgcgcgccugcgcgagcaa

SEQ ID NO: 4040252 - RNA, 18 nt, Molluscum contagiosum virus
ucgcgcgcuaccugcgca

SEQ ID NO: 4040253 - RNA, 13 nt, Molluscum contagiosum virus
ucgcgcgugcgca

SEQ ID NO: 4040254 - RNA, 19 nt, Molluscum contagiosum virus
ucgcgcucuucaagaacag

SEQ ID NO: 4040255 - RNA, 16 nt, Molluscum contagiosum virus
ucgcgcugcucuucgc

SEQ ID NO: 4040256 - RNA, 19 nt, Molluscum contagiosum virus
ucgcgcuuccggcggcucc

SEQ ID NO: 4040257 - RNA, 15 nt, Molluscum contagiosum virus
ucgcggagggcagca

SEQ ID NO: 4040258 - RNA, 13 nt, Molluscum contagiosum virus
ucgcgggcacgag

SEQ ID NO: 4040259 - RNA, 13 nt, Molluscum contagiosum virus
ucgcgggcgccgc

SEQ ID NO: 4040260 - RNA, 16 nt, Molluscum contagiosum virus
ucgcgucacguccuca

SEQ ID NO: 4040261 - RNA, 15 nt, Molluscum contagiosum virus
ucgcuggaggauucu

SEQ ID NO: 4040262 - RNA, 18 nt, Molluscum contagiosum virus
ucgcuugcccggagccgg

SEQ ID NO: 4040263 - RNA, 17 nt, Molluscum contagiosum virus
ucggaacccagaaagaa

SEQ ID NO: 4040264 - RNA, 14 nt, Molluscum contagiosum virus
ucggaacgcuaucc

SEQ ID NO: 4040265 - RNA, 14 nt, Molluscum contagiosum virus
ucggaagagcgucc

SEQ ID NO: 4040266 - RNA, 18 nt, Molluscum contagiosum virus
ucggacagugccuccgcg

SEQ ID NO: 4040267 - RNA, 15 nt, Molluscum contagiosum virus
ucggacuuggccccu

SEQ ID NO: 4040268 - RNA, 14 nt, Molluscum contagiosum virus
ucggagaagugcuc

SEQ ID NO: 4040269 - RNA, 17 nt, Molluscum contagiosum virus
ucggaggcggagcugcc

SEQ ID NO: 4040270 - RNA, 15 nt, Molluscum contagiosum virus
ucggcaugcagcgca

SEQ ID NO: 4040271 - RNA, 18 nt, Molluscum contagiosum virus
ucggcgcgccgucucgcg

SEQ ID NO: 4040272 - RNA, 17 nt, Molluscum contagiosum virus
ucggcggcagcgccagc

SEQ ID NO: 4040273 - RNA, 12 nt, Molluscum contagiosum virus
ucggcggccgga

SEQ ID NO: 4040274 - RNA, 17 nt, Molluscum contagiosum virus
ucggcggcugugcccgc

SEQ ID NO: 4040275 - RNA, 14 nt, Molluscum contagiosum virus
ucggcguggccagg

SEQ ID NO: 4040276 - RNA, 18 nt, Molluscum contagiosum virus
ucggcguggccaggccgc

SEQ ID NO: 4040277 - RNA, 14 nt, Molluscum contagiosum virus
ucggcguuggccac

SEQ ID NO: 4040278 - RNA, 14 nt, Molluscum contagiosum virus
ucgggccggcgcgc

SEQ ID NO: 4040279 - RNA, 16 nt, Molluscum contagiosum virus
ucgggcuagcaagcac

SEQ ID NO: 4040280 - RNA, 23 nt, Molluscum contagiosum virus
ucgggcuagcaagcacgccaggu

SEQ ID NO: 4040281 - RNA, 13 nt, Molluscum contagiosum virus
ucgggcugcgcgg

SEQ ID NO: 4040282 - RNA, 22 nt, Molluscum contagiosum virus
ucggggcagggaaagagcacgc

SEQ ID NO: 4040283 - RNA, 15 nt, Molluscum contagiosum virus
ucggggcugacggcc

SEQ ID NO: 4040284 - RNA, 12 nt, Molluscum contagiosum virus
ucgucagaggga

SEQ ID NO: 4040285 - RNA, 13 nt, Molluscum contagiosum virus
ucguccgcucgug

SEQ ID NO: 4040286 - RNA, 16 nt, Molluscum contagiosum virus
ucguccgcucgugcca

SEQ ID NO: 4040287 - RNA, 20 nt, Molluscum contagiosum virus
ucguccgcucgugccacugc

SEQ ID NO: 4040288 - RNA, 22 nt, Molluscum contagiosum virus
ucgucgaucgccucgacgcugg

SEQ ID NO: 4040289 - RNA, 13 nt, Molluscum contagiosum virus
ucgucgccgggcc

SEQ ID NO: 4040290 - RNA, 21 nt, Molluscum contagiosum virus
ucgucuccgggggcgcgcugg

SEQ ID NO: 4040291 - RNA, 16 nt, Molluscum contagiosum virus
ucgucugcgucucgcg

SEQ ID NO: 4040292 - RNA, 18 nt, Molluscum contagiosum virus
ucgugcugggccugccgc

SEQ ID NO: 4040293 - RNA, 14 nt, Molluscum contagiosum virus
ucgugcugugccua

SEQ ID NO: 4040294 - RNA, 18 nt, Molluscum contagiosum virus
ucguggaucgcgcgcacc

SEQ ID NO: 4040295 - RNA, 17 nt, Molluscum contagiosum virus
ucguggccguagugcuc

SEQ ID NO: 4040296 - RNA, 18 nt, Molluscum contagiosum virus
ucguggcguugcugcugc

SEQ ID NO: 4040297 - RNA, 13 nt, Molluscum contagiosum virus
ucgugucuguguu

SEQ ID NO: 4040298 - RNA, 19 nt, Molluscum contagiosum virus
ucguucgcgggcccgccuu

SEQ ID NO: 4040299 - RNA, 18 nt, Molluscum contagiosum virus
ucuacagccgccugccgc

SEQ ID NO: 4040300 - RNA, 20 nt, Molluscum contagiosum virus
ucuacggcgugcugugccug

SEQ ID NO: 4040301 - RNA, 14 nt, Molluscum contagiosum virus
ucuagccuccuugu

SEQ ID NO: 4040302 - RNA, 20 nt, Molluscum contagiosum virus
ucucaaccaccugagccucu

SEQ ID NO: 4040303 - RNA, 18 nt, Molluscum contagiosum virus
cgggcccuucuugacgcg

SEQ ID NO: 4040304 - RNA, 15 nt, Molluscum contagiosum virus
cgggccggcgcgccg

SEQ ID NO: 4040305 - RNA, 13 nt, Molluscum contagiosum virus
cgggccuguccgc

SEQ ID NO: 4040306 - RNA, 14 nt, Molluscum contagiosum virus
cgggccuguccgcg

SEQ ID NO: 4040307 - RNA, 22 nt, Molluscum contagiosum virus
cgggccuguccgcgggcgcacg

SEQ ID NO: 4040308 - RNA, 16 nt, Molluscum contagiosum virus
cgggcgaaagcgccgc

SEQ ID NO: 4040309 - RNA, 18 nt, Molluscum contagiosum virus
cgggcgaaagcgccgcgc

SEQ ID NO: 4040310 - RNA, 17 nt, Molluscum contagiosum virus
cgggcgcagacgccgag

SEQ ID NO: 4040311 - RNA, 21 nt, Molluscum contagiosum virus
cgggcgcagagccugcugcuc

SEQ ID NO: 4040312 - RNA, 21 nt, Molluscum contagiosum virus
cgggcgccgcgcaauagcgcc

SEQ ID NO: 4040313 - RNA, 14 nt, Molluscum contagiosum virus
cgggcgccgcggcu

SEQ ID NO: 4040314 - RNA, 14 nt, Molluscum contagiosum virus
cgggcgccggcguc

SEQ ID NO: 4040315 - RNA, 17 nt, Molluscum contagiosum virus
cgggcgccggcucugcc

SEQ ID NO: 4040316 - RNA, 13 nt, Molluscum contagiosum virus
cgggcgcgccaac

SEQ ID NO: 4040317 - RNA, 21 nt, Molluscum contagiosum virus
cgggcgcgccaacgacuagcg

SEQ ID NO: 4040318 - RNA, 15 nt, Molluscum contagiosum virus
cgggcgcgcgccagc

SEQ ID NO: 4040319 - RNA, 15 nt, Molluscum contagiosum virus
cgggcgcgcgcggag

SEQ ID NO: 4040320 - RNA, 14 nt, Molluscum contagiosum virus
cgggcgcggcgucg

SEQ ID NO: 4040321 - RNA, 18 nt, Molluscum contagiosum virus
cgggcgcuccgagcggcu

SEQ ID NO: 4040322 - RNA, 15 nt, Molluscum contagiosum virus
cgggcggaagcuccu

SEQ ID NO: 4040323 - RNA, 15 nt, Molluscum contagiosum virus
cgggcggcgcgccgc

SEQ ID NO: 4040324 - RNA, 18 nt, Molluscum contagiosum virus
cgggcguggggagcugga

SEQ ID NO: 4040325 - RNA, 18 nt, Molluscum contagiosum virus
cgggcugcgcggcggugu

SEQ ID NO: 4040326 - RNA, 20 nt, Molluscum contagiosum virus
cgggcugucgcccggcagcg

SEQ ID NO: 4040327 - RNA, 24 nt, Molluscum contagiosum virus
cgggcuugcucccucgcgcgcagc

SEQ ID NO: 4040328 - RNA, 15 nt, Molluscum contagiosum virus
cggggcccaugcuca

SEQ ID NO: 4040329 - RNA, 12 nt, Molluscum contagiosum virus
cggggccgcacg

SEQ ID NO: 4040330 - RNA, 17 nt, Molluscum contagiosum virus
cggggccggcuuugcgg

SEQ ID NO: 4040331 - RNA, 14 nt, Molluscum contagiosum virus
cgggggcgcuuccc

SEQ ID NO: 4040332 - RNA, 20 nt, Molluscum contagiosum virus
cggguaccgugcgcgugagc

SEQ ID NO: 4040333 - RNA, 15 nt, Molluscum contagiosum virus
cgggucgcggggccc

SEQ ID NO: 4040334 - RNA, 14 nt, Molluscum contagiosum virus
cgggugcauacgca

SEQ ID NO: 4040335 - RNA, 17 nt, Molluscum contagiosum virus
cgggugcccggacagag

SEQ ID NO: 4040336 - RNA, 11 nt, Molluscum contagiosum virus
cgguacugcug

SEQ ID NO: 4040337 - RNA, 16 nt, Molluscum contagiosum virus
cggucaacggcacagu

SEQ ID NO: 4040338 - RNA, 18 nt, Molluscum contagiosum virus
cggucaacggcacagucu

SEQ ID NO: 4040339 - RNA, 12 nt, Molluscum contagiosum virus
cggucagacuuu

SEQ ID NO: 4040340 - RNA, 15 nt, Molluscum contagiosum virus
cgguccagccgcacc

SEQ ID NO: 4040341 - RNA, 15 nt, Molluscum contagiosum virus
cggucgcccgccgag

SEQ ID NO: 4040342 - RNA, 15 nt, Molluscum contagiosum virus
cggucucggcagcag

SEQ ID NO: 4040343 - RNA, 16 nt, Molluscum contagiosum virus
cggugcaaccgcugcu

SEQ ID NO: 4040344 - RNA, 17 nt, Molluscum contagiosum virus
cggugcagccgcugcug

SEQ ID NO: 4040345 - RNA, 18 nt, Molluscum contagiosum virus
cggugcagcugccgcaga

SEQ ID NO: 4040346 - RNA, 15 nt, Molluscum contagiosum virus
cggugcccgccaaga

SEQ ID NO: 4040347 - RNA, 17 nt, Molluscum contagiosum virus
cggugcccgccaagagc

SEQ ID NO: 4040348 - RNA, 23 nt, Molluscum contagiosum virus
cggugcccgccaagagcuggucg

SEQ ID NO: 4040349 - RNA, 17 nt, Molluscum contagiosum virus
cggugccggccgccggc

SEQ ID NO: 4040350 - RNA, 15 nt, Molluscum contagiosum virus
cgguggcaggcgcgc

SEQ ID NO: 4040351 - RNA, 22 nt, Molluscum contagiosum virus
cgguggccgcgccgggcgccag

SEQ ID NO: 4040352 - RNA, 13 nt, Molluscum contagiosum virus
cggugggcgccgc

SEQ ID NO: 4040353 - RNA, 19 nt, Molluscum contagiosum virus
cggugggcgccgcggccug

SEQ ID NO: 4040354 - RNA, 20 nt, Molluscum contagiosum virus
cgguggucuccgcgggcagc

SEQ ID NO: 4040355 - RNA, 23 nt, Molluscum contagiosum virus
cgguggucuccgcgggcagccgc

SEQ ID NO: 4040356 - RNA, 18 nt, Molluscum contagiosum virus
cgguggugcgccugcacu

SEQ ID NO: 4040357 - RNA, 22 nt, Molluscum contagiosum virus
cggugucgguaccugcaggcuc

SEQ ID NO: 4040358 - RNA, 14 nt, Molluscum contagiosum virus
cgguugagcgccgu

SEQ ID NO: 4040359 - RNA, 19 nt, Molluscum contagiosum virus
cgguugcgcgugugcagca

SEQ ID NO: 4040360 - RNA, 20 nt, Molluscum contagiosum virus
cguaaagcuggccgaggucu

SEQ ID NO: 4040361 - RNA, 17 nt, Molluscum contagiosum virus
cguacagcgcgcgugcc

SEQ ID NO: 4040362 - RNA, 15 nt, Molluscum contagiosum virus
cguacgagcagcugc

SEQ ID NO: 4040363 - RNA, 18 nt, Molluscum contagiosum virus
cguacgagcagcugcugc

SEQ ID NO: 4040364 - RNA, 14 nt, Molluscum contagiosum virus
cguacgagcaggcg

SEQ ID NO: 4040365 - RNA, 16 nt, Molluscum contagiosum virus
cguacgagcaggcgca

SEQ ID NO: 4040366 - RNA, 19 nt, Molluscum contagiosum virus
cguacgcgcagggagcugc

SEQ ID NO: 4040367 - RNA, 20 nt, Molluscum contagiosum virus
cguacucgcguccgcgcagc

SEQ ID NO: 4040368 - RNA, 23 nt, Molluscum contagiosum virus
cguagacagugcggcgcggcugc

SEQ ID NO: 4040369 - RNA, 21 nt, Molluscum contagiosum virus
cguagcaaaugcgcugcucgc

SEQ ID NO: 4040370 - RNA, 19 nt, Molluscum contagiosum virus
cguagcagcgccugcacgc

SEQ ID NO: 4040371 - RNA, 19 nt, Molluscum contagiosum virus
cguagcggacgaagcugug

SEQ ID NO: 4040372 - RNA, 21 nt, Molluscum contagiosum virus
cguagcggacgaagcugugca

SEQ ID NO: 4040373 - RNA, 18 nt, Molluscum contagiosum virus
cgucaagcagcgcgccac

SEQ ID NO: 4040374 - RNA, 15 nt, Molluscum contagiosum virus
cgucacggccggcgc

SEQ ID NO: 4040375 - RNA, 14 nt, Molluscum contagiosum virus
cgucacggccuucg

SEQ ID NO: 4040376 - RNA, 22 nt, Molluscum contagiosum virus
cgucagggaugccagugcagug

SEQ ID NO: 4040377 - RNA, 22 nt, Molluscum contagiosum virus
cguccacaaagcccuccugaga

SEQ ID NO: 4040378 - RNA, 13 nt, Molluscum contagiosum virus
cguccacaaaggc

SEQ ID NO: 4040379 - RNA, 20 nt, Molluscum contagiosum virus
cguccacggguagcagcgcc

SEQ ID NO: 4040380 - RNA, 18 nt, Molluscum contagiosum virus
cguccaugugcccgcggc

SEQ ID NO: 4040381 - RNA, 15 nt, Molluscum contagiosum virus
cguccgcauccucaa

SEQ ID NO: 4040382 - RNA, 16 nt, Molluscum contagiosum virus
cguccuagagcagaag

SEQ ID NO: 4040383 - RNA, 18 nt, Molluscum contagiosum virus
cguccucaagcgcccucg

SEQ ID NO: 4040384 - RNA, 15 nt, Molluscum contagiosum virus
cguccuugcucuggc

SEQ ID NO: 4040385 - RNA, 18 nt, Molluscum contagiosum virus
cgucgaagaccaccagca

SEQ ID NO: 4040386 - RNA, 22 nt, Molluscum contagiosum virus
cgucgaccuggaagccgccagc

SEQ ID NO: 4040387 - RNA, 15 nt, Molluscum contagiosum virus
cgucgagggcgccgg

SEQ ID NO: 4040388 - RNA, 20 nt, Molluscum contagiosum virus
cgucgcacaguucacggcgc

SEQ ID NO: 4040389 - RNA, 18 nt, Molluscum contagiosum virus
cgucgcccggcaggcucc

SEQ ID NO: 4040390 - RNA, 17 nt, Molluscum contagiosum virus
cgucgccggacagcuca

SEQ ID NO: 4040391 - RNA, 14 nt, Molluscum contagiosum virus
cgucgccgggcccc

SEQ ID NO: 4040392 - RNA, 13 nt, Molluscum contagiosum virus
cgucgcgcaggcg

SEQ ID NO: 4040393 - RNA, 21 nt, Molluscum contagiosum virus
cgucgcggagcgcgcacggca

SEQ ID NO: 4040394 - RNA, 17 nt, Molluscum contagiosum virus
cgucgggaaguguugcc

SEQ ID NO: 4040395 - RNA, 20 nt, Molluscum contagiosum virus
cgucggucaccaccaccucc

SEQ ID NO: 4040396 - RNA, 23 nt, Molluscum contagiosum virus
cgucguagcgcucgugcaccagc

SEQ ID NO: 4040397 - RNA, 14 nt, Molluscum contagiosum virus
cgucgucgucgucg

SEQ ID NO: 4040398 - RNA, 18 nt, Molluscum contagiosum virus
cgucuccgggggcgcgcu

SEQ ID NO: 4040399 - RNA, 21 nt, Molluscum contagiosum virus
cgucucgcggggcaagcgcgc

SEQ ID NO: 4040400 - RNA, 19 nt, Molluscum contagiosum virus
cgucugcgaggcgcgcacg

SEQ ID NO: 4040401 - RNA, 20 nt, Molluscum contagiosum virus
cgucuuugcggacgcgcgag

SEQ ID NO: 4040402 - RNA, 15 nt, Molluscum contagiosum virus
cgugaauguacgcgg

SEQ ID NO: 4040403 - RNA, 18 nt, Molluscum contagiosum virus
cgugacacuaccgucgcc

SEQ ID NO: 4040404 - RNA, 15 nt, Molluscum contagiosum virus
cgugaccauggacac

SEQ ID NO: 4040405 - RNA, 19 nt, Molluscum contagiosum virus
cgugaccauggacacgcug

SEQ ID NO: 4040406 - RNA, 12 nt, Molluscum contagiosum virus
cgugacggugcu

SEQ ID NO: 4040407 - RNA, 13 nt, Molluscum contagiosum virus
gcgccucgcaggc

SEQ ID NO: 4040408 - RNA, 14 nt, Molluscum contagiosum virus
gcgccugcacacgc

SEQ ID NO: 4040409 - RNA, 23 nt, Molluscum contagiosum virus
gcgccuuggcggggaucuugcgu

SEQ ID NO: 4040410 - RNA, 23 nt, Molluscum contagiosum virus
gcgcgaacucucaucgagcaccu

SEQ ID NO: 4040411 - RNA, 20 nt, Molluscum contagiosum virus
gcgcgaccuacuccuggcca

SEQ ID NO: 4040412 - RNA, 20 nt, Molluscum contagiosum virus
gcgcgagauucuggcgcgcg

SEQ ID NO: 4040413 - RNA, 13 nt, Molluscum contagiosum virus
gcgcgagcagcug

SEQ ID NO: 4040414 - RNA, 15 nt, Molluscum contagiosum virus
gcgcgagcaugccgc

SEQ ID NO: 4040415 - RNA, 15 nt, Molluscum contagiosum virus
gcgcgagcgacggca

SEQ ID NO: 4040416 - RNA, 21 nt, Molluscum contagiosum virus
gcgcgcaaccagcuggcgccc

SEQ ID NO: 4040417 - RNA, 19 nt, Molluscum contagiosum virus
gcgcgcacaagauggcgca

SEQ ID NO: 4040418 - RNA, 23 nt, Molluscum contagiosum virus
gcgcgcacaucggcacugcucac

SEQ ID NO: 4040419 - RNA, 14 nt, Molluscum contagiosum virus
gcgcgcaccugcac

SEQ ID NO: 4040420 - RNA, 12 nt, Molluscum contagiosum virus
gcgcgcacggca

SEQ ID NO: 4040421 - RNA, 15 nt, Molluscum contagiosum virus
gcgcgcacggcagcg

SEQ ID NO: 4040422 - RNA, 13 nt, Molluscum contagiosum virus
gcgcgcacugcuc

SEQ ID NO: 4040423 - RNA, 18 nt, Molluscum contagiosum virus
gcgcgcagcaggugcacg

SEQ ID NO: 4040424 - RNA, 14 nt, Molluscum contagiosum virus
gcgcgcaggcucgc

SEQ ID NO: 4040425 - RNA, 22 nt, Molluscum contagiosum virus
gcgcgcaucggcggcagcgcca

SEQ ID NO: 4040426 - RNA, 16 nt, Molluscum contagiosum virus
gcgcgcauuuaccggc

SEQ ID NO: 4040427 - RNA, 17 nt, Molluscum contagiosum virus
gcgcgccaagugcuccg

SEQ ID NO: 4040428 - RNA, 19 nt, Molluscum contagiosum virus
gcgcgcccgcugcgcgcuc

SEQ ID NO: 4040429 - RNA, 19 nt, Molluscum contagiosum virus
gcgcgcccggcgcccgcag

SEQ ID NO: 4040430 - RNA, 16 nt, Molluscum contagiosum virus
gcgcgccgacgugcgc

SEQ ID NO: 4040431 - RNA, 17 nt, Molluscum contagiosum virus
gcgcgccgacgugcgcg

SEQ ID NO: 4040432 - RNA, 13 nt, Molluscum contagiosum virus
gcgcgccgccgca

SEQ ID NO: 4040433 - RNA, 17 nt, Molluscum contagiosum virus
gcgcgccgcgcuggcgc

SEQ ID NO: 4040434 - RNA, 21 nt, Molluscum contagiosum virus
gcgcgccgguagggugccgag

SEQ ID NO: 4040435 - RNA, 19 nt, Molluscum contagiosum virus
gcgcgccgugccuggcagu

SEQ ID NO: 4040436 - RNA, 18 nt, Molluscum contagiosum virus
gcgcgccugccgccugca

SEQ ID NO: 4040437 - RNA, 13 nt, Molluscum contagiosum virus
gcgcgcgagcaca

SEQ ID NO: 4040438 - RNA, 15 nt, Molluscum contagiosum virus
gcgcgcgcacgcgcg

SEQ ID NO: 4040439 - RNA, 15 nt, Molluscum contagiosum virus
gcgcgcgcagcaccg

SEQ ID NO: 4040440 - RNA, 15 nt, Molluscum contagiosum virus
gcgcgcgccagcagc

SEQ ID NO: 4040441 - RNA, 12 nt, Molluscum contagiosum virus
gcgcgcgccgca

SEQ ID NO: 4040442 - RNA, 15 nt, Molluscum contagiosum virus
gcgcgcgccggaacu

SEQ ID NO: 4040443 - RNA, 13 nt, Molluscum contagiosum virus
gcgcgcgcgcagg

SEQ ID NO: 4040444 - RNA, 13 nt, Molluscum contagiosum virus
gcgcgcgcgcgag

SEQ ID NO: 4040445 - RNA, 14 nt, Molluscum contagiosum virus
gcgcgcgcgcgcag

SEQ ID NO: 4040446 - RNA, 15 nt, Molluscum contagiosum virus
gcgcgcgcucugccg

SEQ ID NO: 4040447 - RNA, 16 nt, Molluscum contagiosum virus
gcgcgcgguacucggc

SEQ ID NO: 4040448 - RNA, 14 nt, Molluscum contagiosum virus
gcgcgcgugccgcc

SEQ ID NO: 4040449 - RNA, 13 nt, Molluscum contagiosum virus
gcgcgcgugccgg

SEQ ID NO: 4040450 - RNA, 13 nt, Molluscum contagiosum virus
gcgcgcgugcucg

SEQ ID NO: 4040451 - RNA, 14 nt, Molluscum contagiosum virus
gcgcgcgugcugcu

SEQ ID NO: 4040452 - RNA, 16 nt, Molluscum contagiosum virus
gcgcgcucgaggcgcc

SEQ ID NO: 4040453 - RNA, 13 nt, Molluscum contagiosum virus
gcgcgcucugccg

SEQ ID NO: 4040454 - RNA, 22 nt, Molluscum contagiosum virus
gcgcgcucugccgcccgcgccc

SEQ ID NO: 4040455 - RNA, 13 nt, Molluscum contagiosum virus
gcgcgcugcacac

SEQ ID NO: 4040456 - RNA, 15 nt, Molluscum contagiosum virus
gcgcgcugcacgccg

SEQ ID NO: 4040457 - RNA, 13 nt, Molluscum contagiosum virus
gcgcgcugcgcgc

SEQ ID NO: 4040458 - RNA, 15 nt, Molluscum contagiosum virus
gcgcgcugcgggcgc

SEQ ID NO: 4040459 - RNA, 12 nt, Molluscum contagiosum virus
gcgcgcugugag

SEQ ID NO: 4040460 - RNA, 15 nt, Molluscum contagiosum virus
gcgcgcuuagcacac

SEQ ID NO: 4040461 - RNA, 13 nt, Molluscum contagiosum virus
gcgcggacagccu

SEQ ID NO: 4040462 - RNA, 22 nt, Molluscum contagiosum virus
gcgcggagacuuccuugcgcag

SEQ ID NO: 4040463 - RNA, 13 nt, Molluscum contagiosum virus
gcgcggagcucgc

SEQ ID NO: 4040464 - RNA, 14 nt, Molluscum contagiosum virus
gcgcggagcucgcg

SEQ ID NO: 4040465 - RNA, 20 nt, Molluscum contagiosum virus
gcgcggauauggcgcgccga

SEQ ID NO: 4040466 - RNA, 16 nt, Molluscum contagiosum virus
gcgcggaucugcgcac

SEQ ID NO: 4040467 - RNA, 17 nt, Molluscum contagiosum virus
gcgcggcaagcagcgug

SEQ ID NO: 4040468 - RNA, 14 nt, Molluscum contagiosum virus
gcgcggcacgcccu

SEQ ID NO: 4040469 - RNA, 22 nt, Molluscum contagiosum virus
gcgcggccauggucacgcgcac

SEQ ID NO: 4040470 - RNA, 17 nt, Molluscum contagiosum virus
gcgcggcgcgcccagcg

SEQ ID NO: 4040471 - RNA, 22 nt, Molluscum contagiosum virus
gcgcggcgcguccucggccaga

SEQ ID NO: 4040472 - RNA, 21 nt, Molluscum contagiosum virus
gcgcggcuuggcgcccuuccu

SEQ ID NO: 4040473 - RNA, 13 nt, Molluscum contagiosum virus
gcgcggggcacug

SEQ ID NO: 4040474 - RNA, 16 nt, Molluscum contagiosum virus
gcgcgguagcucgugc

SEQ ID NO: 4040475 - RNA, 19 nt, Molluscum contagiosum virus
gcgcgucugcaucgugggc

SEQ ID NO: 4040476 - RNA, 15 nt, Molluscum contagiosum virus
gcgcgugaguccgcg

SEQ ID NO: 4040477 - RNA, 18 nt, Molluscum contagiosum virus
gcgcgugccgcugcgcgg

SEQ ID NO: 4040478 - RNA, 21 nt, Molluscum contagiosum virus
gcgcgugcgagcggcgcgcgc

SEQ ID NO: 4040479 - RNA, 13 nt, Molluscum contagiosum virus
gcgcgugcgcgug

SEQ ID NO: 4040480 - RNA, 12 nt, Molluscum contagiosum virus
gcgcgugcucgc

SEQ ID NO: 4040481 - RNA, 19 nt, Molluscum contagiosum virus
gcgcgugugcagcagguag

SEQ ID NO: 4040482 - RNA, 23 nt, Molluscum contagiosum virus
gcgcguugcucccgucgagcacg

SEQ ID NO: 4040483 - RNA, 14 nt, Molluscum contagiosum virus
gcgcuacguggcgc

SEQ ID NO: 4040484 - RNA, 19 nt, Molluscum contagiosum virus
gcgcuagccgccgcugccg

SEQ ID NO: 4040485 - RNA, 22 nt, Molluscum contagiosum virus
gcgcuagcuccacgugccgcuc

SEQ ID NO: 4040486 - RNA, 16 nt, Molluscum contagiosum virus
gcgcuauugcgcggcg

SEQ ID NO: 4040487 - RNA, 18 nt, Molluscum contagiosum virus
gcgcuccgagcggcugcu

SEQ ID NO: 4040488 - RNA, 19 nt, Molluscum contagiosum virus
gcgcucgcucgcgcgcagc

SEQ ID NO: 4040489 - RNA, 15 nt, Molluscum contagiosum virus
gcgcucgcucgcgcu

SEQ ID NO: 4040490 - RNA, 12 nt, Molluscum contagiosum virus
gcgcucuucccg

SEQ ID NO: 4040491 - RNA, 13 nt, Molluscum contagiosum virus
gcgcugaaggcau

SEQ ID NO: 4040492 - RNA, 17 nt, Molluscum contagiosum virus
gcgcugagcgcggagcu

SEQ ID NO: 4040493 - RNA, 14 nt, Molluscum contagiosum virus
gcgcugcccgcgca

SEQ ID NO: 4040494 - RNA, 16 nt, Molluscum contagiosum virus
gcgcugcccgcgcaca

SEQ ID NO: 4040495 - RNA, 19 nt, Molluscum contagiosum virus
gcgcugcgccgcuuccugg

SEQ ID NO: 4040496 - RNA, 11 nt, Molluscum contagiosum virus
gcgcugcgcgg

SEQ ID NO: 4040497 - RNA, 14 nt, Molluscum contagiosum virus
gcgcugcgcggcgg

SEQ ID NO: 4040498 - RNA, 20 nt, Molluscum contagiosum virus
gcgcugcuauacgcgccagu

SEQ ID NO: 4040499 - RNA, 13 nt, Molluscum contagiosum virus
gcgcugcucgccg

SEQ ID NO: 4040500 - RNA, 14 nt, Molluscum contagiosum virus
gcgcugcucgcgcu

SEQ ID NO: 4040501 - RNA, 18 nt, Molluscum contagiosum virus
gcgcugcucgcgcucgcg

SEQ ID NO: 4040502 - RNA, 14 nt, Molluscum contagiosum virus
gcgcugcucuucgc

SEQ ID NO: 4040503 - RNA, 16 nt, Molluscum contagiosum virus
gcgcugcugcuucugc

SEQ ID NO: 4040504 - RNA, 13 nt, Molluscum contagiosum virus
gcgcugcuggugc

SEQ ID NO: 4040505 - RNA, 20 nt, Molluscum contagiosum virus
gcgcugcugguucugcucgc

SEQ ID NO: 4040506 - RNA, 22 nt, Molluscum contagiosum virus
gcgcugcugguucugcucgcag

SEQ ID NO: 4040507 - RNA, 14 nt, Molluscum contagiosum virus
gcgcuggaugcugc

SEQ ID NO: 4040508 - RNA, 17 nt, Molluscum contagiosum virus
gcgcuggaugcugcucg

SEQ ID NO: 4040509 - RNA, 21 nt, Molluscum contagiosum virus
gcgcugucgcgcaggcucugg

SEQ ID NO: 4040510 - RNA, 14 nt, Molluscum contagiosum virus
gcgcuuccgcgagu

SEQ ID NO: 4040511 - RNA, 21 nt, Molluscum contagiosum virus
gcgcuuccucuacaccagcug

SEQ ID NO: 4040512 - RNA, 13 nt, Molluscum contagiosum virus
gcgcuucuauugc

SEQ ID NO: 4040513 - RNA, 19 nt, Molluscum contagiosum virus
gcgcuucuauugccgcgug

SEQ ID NO: 4040514 - RNA, 13 nt, Molluscum contagiosum virus
gcgcuugcucacg

SEQ ID NO: 4040515 - RNA, 16 nt, Molluscum contagiosum virus
gcggaaguggugcccg

SEQ ID NO: 4040516 - RNA, 18 nt, Molluscum contagiosum virus
gcggacagagcccgcggc

SEQ ID NO: 4040517 - RNA, 20 nt, Molluscum contagiosum virus
gcggaccuaaagcugcuggc

SEQ ID NO: 4040518 - RNA, 14 nt, Molluscum contagiosum virus
gcggacgccggcgc

SEQ ID NO: 4040519 - RNA, 14 nt, Molluscum contagiosum virus
gcggacguggucgc

SEQ ID NO: 4040520 - RNA, 18 nt, Molluscum contagiosum virus
gcggacguggucgcgcgc

SEQ ID NO: 4040521 - RNA, 21 nt, Molluscum contagiosum virus
gcggagacuuccuugcgcagg

SEQ ID NO: 4040522 - RNA, 17 nt, Molluscum contagiosum virus
gcggagaucgccgcgca

SEQ ID NO: 4040523 - RNA, 18 nt, Molluscum contagiosum virus
gcggagaugacgggcacg

SEQ ID NO: 4040524 - RNA, 19 nt, Molluscum contagiosum virus
gcggagcgccuucugcaag

SEQ ID NO: 4040525 - RNA, 13 nt, Molluscum contagiosum virus
gcggagcugcccg

SEQ ID NO: 4040526 - RNA, 14 nt, Molluscum contagiosum virus
gcggagcuggccac

SEQ ID NO: 4040527 - RNA, 12 nt, Molluscum contagiosum virus
gcggagcugugc

SEQ ID NO: 4040528 - RNA, 13 nt, Molluscum contagiosum virus
gcggagcugugcc

SEQ ID NO: 4040529 - RNA, 19 nt, Molluscum contagiosum virus
gcggagcugugccgcagca

SEQ ID NO: 4040530 - RNA, 16 nt, Molluscum contagiosum virus
gcggagggugcacgcg

SEQ ID NO: 4040531 - RNA, 21 nt, Molluscum contagiosum virus
gcggaggucgagcgcgccgcg

SEQ ID NO: 4040532 - RNA, 21 nt, Molluscum contagiosum virus
gcggaugccacgcagcuggcg

SEQ ID NO: 4040533 - RNA, 20 nt, Molluscum contagiosum virus
gcggaugugcuagcugcgug

SEQ ID NO: 4040534 - RNA, 15 nt, Molluscum contagiosum virus
gcggcaacagcacga

SEQ ID NO: 4040535 - RNA, 18 nt, Molluscum contagiosum virus
gccgcagaacacgggggc

SEQ ID NO: 4040536 - RNA, 20 nt, Molluscum contagiosum virus
gccgcagcgcuggagcuggc

SEQ ID NO: 4040537 - RNA, 17 nt, Molluscum contagiosum virus
gccgccaaugcugccgu

SEQ ID NO: 4040538 - RNA, 20 nt, Molluscum contagiosum virus
gccgcccgggaaaaucaggu

SEQ ID NO: 4040539 - RNA, 15 nt, Molluscum contagiosum virus
gccgccgccgcgagg

SEQ ID NO: 4040540 - RNA, 17 nt, Molluscum contagiosum virus
gccgcgaaagcgucgug

SEQ ID NO: 4040541 - RNA, 21 nt, Molluscum contagiosum virus
gccgcgaaagcgucgugcucc

SEQ ID NO: 4040542 - RNA, 21 nt, Molluscum contagiosum virus
gccgcgcaugacagccauggc

SEQ ID NO: 4040543 - RNA, 19 nt, Molluscum contagiosum virus
gccgcgcccacgggcuucg

SEQ ID NO: 4040544 - RNA, 20 nt, Molluscum contagiosum virus
gccgcgccgcacgugcugcg

SEQ ID NO: 4040545 - RNA, 11 nt, Molluscum contagiosum virus
gccgcgccgcg

SEQ ID NO: 4040546 - RNA, 18 nt, Molluscum contagiosum virus
gccgcgccgggcgccaga

SEQ ID NO: 4040547 - RNA, 22 nt, Molluscum contagiosum virus
gccgcgccuugagcgcgccgcg

SEQ ID NO: 4040548 - RNA, 14 nt, Molluscum contagiosum virus
gccgcgcgcgcacg

SEQ ID NO: 4040549 - RNA, 16 nt, Molluscum contagiosum virus
gccgcgcugcuggcca

SEQ ID NO: 4040550 - RNA, 22 nt, Molluscum contagiosum virus
gccgcggaccacgacgggcuca

SEQ ID NO: 4040551 - RNA, 15 nt, Molluscum contagiosum virus
gccgcggcagcucug

SEQ ID NO: 4040552 - RNA, 16 nt, Molluscum contagiosum virus
gccgcggcgcccacgg

SEQ ID NO: 4040553 - RNA, 17 nt, Molluscum contagiosum virus
gccgcgggcgcagagcc

SEQ ID NO: 4040554 - RNA, 19 nt, Molluscum contagiosum virus
gccgcggucguguacacgc

SEQ ID NO: 4040555 - RNA, 13 nt, Molluscum contagiosum virus
gccgcggugccgg

SEQ ID NO: 4040556 - RNA, 15 nt, Molluscum contagiosum virus
gccgcguagccgccg

SEQ ID NO: 4040557 - RNA, 23 nt, Molluscum contagiosum virus
gccgcguagcuagcucugcgcgc

SEQ ID NO: 4040558 - RNA, 16 nt, Molluscum contagiosum virus
gccgcgucguagcaaa

SEQ ID NO: 4040559 - RNA, 19 nt, Molluscum contagiosum virus
gccgcgugcaugcccagca

SEQ ID NO: 4040560 - RNA, 14 nt, Molluscum contagiosum virus
gccgcgugcuggcg

SEQ ID NO: 4040561 - RNA, 19 nt, Molluscum contagiosum virus
gccgcgugcuggcggggcu

SEQ ID NO: 4040562 - RNA, 19 nt, Molluscum contagiosum virus
gccgcugccaacgcggacc

SEQ ID NO: 4040563 - RNA, 21 nt, Molluscum contagiosum virus
gccgcugccaacgcggaccgc

SEQ ID NO: 4040564 - RNA, 18 nt, Molluscum contagiosum virus
gccgcuucgggcucagca

SEQ ID NO: 4040565 - RNA, 15 nt, Molluscum contagiosum virus
gccgcuucgugcgcg

SEQ ID NO: 4040566 - RNA, 17 nt, Molluscum contagiosum virus
gccgcuugaaggacgcg

SEQ ID NO: 4040567 - RNA, 22 nt, Molluscum contagiosum virus
gccggcaacgcugccgcuggcg

SEQ ID NO: 4040568 - RNA, 19 nt, Molluscum contagiosum virus
gccggccccgcgaacgaga

SEQ ID NO: 4040569 - RNA, 17 nt, Molluscum contagiosum virus
gccggccuuguucgcgc

SEQ ID NO: 4040570 - RNA, 13 nt, Molluscum contagiosum virus
gccggcgaaccga

SEQ ID NO: 4040571 - RNA, 20 nt, Molluscum contagiosum virus
gccggcgaaccgacugcccg

SEQ ID NO: 4040572 - RNA, 20 nt, Molluscum contagiosum virus
gccggcgcccgcgugcaccc

SEQ ID NO: 4040573 - RNA, 15 nt, Molluscum contagiosum virus
gccggcguccgcggc

SEQ ID NO: 4040574 - RNA, 19 nt, Molluscum contagiosum virus
gccggcguccgcggcacgc

SEQ ID NO: 4040575 - RNA, 23 nt, Molluscum contagiosum virus
gccggcguucacggacucgagcc

SEQ ID NO: 4040576 - RNA, 18 nt, Molluscum contagiosum virus
gccggcucagcguggagc

SEQ ID NO: 4040577 - RNA, 15 nt, Molluscum contagiosum virus
gccggcugcgccacc

SEQ ID NO: 4040578 - RNA, 17 nt, Molluscum contagiosum virus
gccgggaauaccggaga

SEQ ID NO: 4040579 - RNA, 13 nt, Molluscum contagiosum virus
gccgggagagccg

SEQ ID NO: 4040580 - RNA, 18 nt, Molluscum contagiosum virus
gccgggcacccagcccug

SEQ ID NO: 4040581 - RNA, 18 nt, Molluscum contagiosum virus
gccgggccccugucgcgc

SEQ ID NO: 4040582 - RNA, 19 nt, Molluscum contagiosum virus
gccgggccugcggcggcgc

SEQ ID NO: 4040583 - RNA, 16 nt, Molluscum contagiosum virus
gccgggcgccagaaca

SEQ ID NO: 4040584 - RNA, 17 nt, Molluscum contagiosum virus
gccgggcgccggcucug

SEQ ID NO: 4040585 - RNA, 17 nt, Molluscum contagiosum virus
gccggggcgcgcgcugc

SEQ ID NO: 4040586 - RNA, 21 nt, Molluscum contagiosum virus
gccggguguugaccaaagguc

SEQ ID NO: 4040587 - RNA, 15 nt, Molluscum contagiosum virus
gccggugcgugccca

SEQ ID NO: 4040588 - RNA, 17 nt, Molluscum contagiosum virus
gccgguggaagagcccg

SEQ ID NO: 4040589 - RNA, 22 nt, Molluscum contagiosum virus
gccguccaugugcccgcggcgc

SEQ ID NO: 4040590 - RNA, 17 nt, Molluscum contagiosum virus
gccguccccgcgcucac

SEQ ID NO: 4040591 - RNA, 17 nt, Molluscum contagiosum virus
gccguccgccucgagca

SEQ ID NO: 4040592 - RNA, 19 nt, Molluscum contagiosum virus
gccguccgccucgagcacg

SEQ ID NO: 4040593 - RNA, 14 nt, Molluscum contagiosum virus
gccgucgacgcuga

SEQ ID NO: 4040594 - RNA, 19 nt, Molluscum contagiosum virus
gccgucgacgcugacggcc

SEQ ID NO: 4040595 - RNA, 19 nt, Molluscum contagiosum virus
gccgugcgucucucugucu

SEQ ID NO: 4040596 - RNA, 22 nt, Molluscum contagiosum virus
gccguggcacugacgguacuca

SEQ ID NO: 4040597 - RNA, 19 nt, Molluscum contagiosum virus
gccguguacgucuuuccca

SEQ ID NO: 4040598 - RNA, 17 nt, Molluscum contagiosum virus
gccguucacgcacacga

SEQ ID NO: 4040599 - RNA, 14 nt, Molluscum contagiosum virus
gccuaccugcagga

SEQ ID NO: 4040600 - RNA, 23 nt, Molluscum contagiosum virus
gccuacgagcacauacacgcgca

SEQ ID NO: 4040601 - RNA, 15 nt, Molluscum contagiosum virus
gccucagccgagcgc

SEQ ID NO: 4040602 - RNA, 22 nt, Molluscum contagiosum virus
gccuccaagaagaggccagcac

SEQ ID NO: 4040603 - RNA, 22 nt, Molluscum contagiosum virus
gccuccaagaagaggccggcac

SEQ ID NO: 4040604 - RNA, 17 nt, Molluscum contagiosum virus
gccucccccgcgcacug

SEQ ID NO: 4040605 - RNA, 19 nt, Molluscum contagiosum virus
gccuccgguacguacagug

SEQ ID NO: 4040606 - RNA, 21 nt, Molluscum contagiosum virus
gccuccguuucccgcggcgug

SEQ ID NO: 4040607 - RNA, 12 nt, Molluscum contagiosum virus
gccucgagcagg

SEQ ID NO: 4040608 - RNA, 22 nt, Molluscum contagiosum virus
gccucgcguuagcgcuggcccg

SEQ ID NO: 4040609 - RNA, 21 nt, Molluscum contagiosum virus
gccucgucguccacaggcgcg

SEQ ID NO: 4040610 - RNA, 21 nt, Molluscum contagiosum virus
gccucucucguggggaggaca

SEQ ID NO: 4040611 - RNA, 15 nt, Molluscum contagiosum virus
gccucugccugcaag

SEQ ID NO: 4040612 - RNA, 12 nt, Molluscum contagiosum virus
gccugaggccgc

SEQ ID NO: 4040613 - RNA, 15 nt, Molluscum contagiosum virus
gccugcaaggagguc

SEQ ID NO: 4040614 - RNA, 14 nt, Molluscum contagiosum virus
gccugcacacgcgu

SEQ ID NO: 4040615 - RNA, 21 nt, Molluscum contagiosum virus
gccugcacgcgcacuugccug

SEQ ID NO: 4040616 - RNA, 10 nt, Molluscum contagiosum virus
gccugcacug

SEQ ID NO: 4040617 - RNA, 15 nt, Molluscum contagiosum virus
gccugccaucuacga

SEQ ID NO: 4040618 - RNA, 15 nt, Molluscum contagiosum virus
gccugcccgugugcg

SEQ ID NO: 4040619 - RNA, 12 nt, Molluscum contagiosum virus
gccugcccugcu

SEQ ID NO: 4040620 - RNA, 14 nt, Molluscum contagiosum virus
gccugccgcgagca

SEQ ID NO: 4040621 - RNA, 18 nt, Molluscum contagiosum virus
gccugccgcgagcacugg

SEQ ID NO: 4040622 - RNA, 12 nt, Molluscum contagiosum virus
gccugcgagcag

SEQ ID NO: 4040623 - RNA, 14 nt, Molluscum contagiosum virus
gccugcgagcagcc

SEQ ID NO: 4040624 - RNA, 22 nt, Molluscum contagiosum virus
gccugcggacccgccggugcuu

SEQ ID NO: 4040625 - RNA, 21 nt, Molluscum contagiosum virus
gccugcgggcggcacacacuu

SEQ ID NO: 4040626 - RNA, 15 nt, Molluscum contagiosum virus
gccugcucacgcccg

SEQ ID NO: 4040627 - RNA, 20 nt, Molluscum contagiosum virus
gccugcugaagaaggagccc

SEQ ID NO: 4040628 - RNA, 20 nt, Molluscum contagiosum virus
gccugcugcucuucgugcug

SEQ ID NO: 4040629 - RNA, 15 nt, Molluscum contagiosum virus
gccugcuggcgggga

SEQ ID NO: 4040630 - RNA, 22 nt, Molluscum contagiosum virus
gccugcuggcggggaaagcuga

SEQ ID NO: 4040631 - RNA, 21 nt, Molluscum contagiosum virus
gccuggagggcagugccaagg

SEQ ID NO: 4040632 - RNA, 22 nt, Molluscum contagiosum virus
gccuggcggccaaccgccugcu

SEQ ID NO: 4040633 - RNA, 18 nt, Molluscum contagiosum virus
gccugugggauggcucgc

SEQ ID NO: 4040634 - RNA, 19 nt, Molluscum contagiosum virus
gccuguuuccgcucgcgcu

SEQ ID NO: 4040635 - RNA, 19 nt, Molluscum contagiosum virus
gccuucucgucgagagcgc

SEQ ID NO: 4040636 - RNA, 17 nt, Molluscum contagiosum virus
gccuuggcgcccgugcc

SEQ ID NO: 4040637 - RNA, 16 nt, Molluscum contagiosum virus
gccuuucuugcggcac

SEQ ID NO: 4040638 - RNA, 17 nt, Molluscum contagiosum virus
gcgaaagcgccgcgcgc

SEQ ID NO: 4040639 - RNA, 15 nt, Molluscum contagiosum virus
gcgaaccgcggcagc

SEQ ID NO: 4040640 - RNA, 20 nt, Molluscum contagiosum virus
gcgaacgcguccacggcgcg

SEQ ID NO: 4040641 - RNA, 21 nt, Molluscum contagiosum virus
gcgaagagcacgaugcccagc

SEQ ID NO: 4040642 - RNA, 14 nt, Molluscum contagiosum virus
gcgacagcugcugc

SEQ ID NO: 4040643 - RNA, 14 nt, Molluscum contagiosum virus
gcgacaugcugccc

SEQ ID NO: 4040644 - RNA, 16 nt, Molluscum contagiosum virus
gcgaccggcgugccuu

SEQ ID NO: 4040645 - RNA, 16 nt, Molluscum contagiosum virus
gcgaccuuagcgaggu

SEQ ID NO: 4040646 - RNA, 17 nt, Molluscum contagiosum virus
gcgacgcgaucgugcgc

SEQ ID NO: 4040647 - RNA, 21 nt, Molluscum contagiosum virus
gcgacggagauggacacagca

SEQ ID NO: 4040648 - RNA, 14 nt, Molluscum contagiosum virus
gcgacggcaggccc

SEQ ID NO: 4040649 - RNA, 12 nt, Molluscum contagiosum virus
gcgacgugcgcg

SEQ ID NO: 4040650 - RNA, 20 nt, Molluscum contagiosum virus
gcgacgugcgcgcugcgcgc

SEQ ID NO: 4040651 - RNA, 13 nt, Molluscum contagiosum virus
gcgacuacgcgcu

SEQ ID NO: 4040652 - RNA, 17 nt, Molluscum contagiosum virus
gcgacuagccugugccc

SEQ ID NO: 4040653 - RNA, 17 nt, Molluscum contagiosum virus
gcgacuugcugcggagc

SEQ ID NO: 4040654 - RNA, 17 nt, Molluscum contagiosum virus
gcgacuuguagugcccg

SEQ ID NO: 4040655 - RNA, 18 nt, Molluscum contagiosum virus
gcgagaacuggcgcagca

SEQ ID NO: 4040656 - RNA, 13 nt, Molluscum contagiosum virus
gcgagaugcgcgg

SEQ ID NO: 4040657 - RNA, 16 nt, Molluscum contagiosum virus
gcgagaugcgcggaca

SEQ ID NO: 4040658 - RNA, 18 nt, Molluscum contagiosum virus
gcgagaugcucgccggca

SEQ ID NO: 4040659 - RNA, 14 nt, Molluscum contagiosum virus
gcgagcacgccugc

SEQ ID NO: 4040660 - RNA, 16 nt, Molluscum contagiosum virus
gcgagcacgccugcac

SEQ ID NO: 4040661 - RNA, 16 nt, Molluscum contagiosum virus
gcgagcagaggcaugc

SEQ ID NO: 4040662 - RNA, 23 nt, Molluscum contagiosum virus
gcgagcagugugaugccgcgcgu

SEQ ID NO: 4040663 - RNA, 16 nt, Molluscum contagiosum virus
gcgagcaucugcgcgu

SEQ ID NO: 4040664 - RNA, 16 nt, Molluscum contagiosum virus
gcgagcaugccgccgc

SEQ ID NO: 4040665 - RNA, 15 nt, Molluscum contagiosum virus
gcgagccacgcgcau

SEQ ID NO: 4040666 - RNA, 19 nt, Molluscum contagiosum virus
gcgagcccggaucagcccc

SEQ ID NO: 4040667 - RNA, 23 nt, Molluscum contagiosum virus
gcgagcccuucuuuccggcgcgg

SEQ ID NO: 4040668 - RNA, 12 nt, Molluscum contagiosum virus
gcgagcgccugc

SEQ ID NO: 4040669 - RNA, 14 nt, Molluscum contagiosum virus
gcgagcgcgccccc

SEQ ID NO: 4040670 - RNA, 16 nt, Molluscum contagiosum virus
gcgagcuagugcacac

SEQ ID NO: 4040671 - RNA, 17 nt, Molluscum contagiosum virus
gcgagcucgucgcgcgc

SEQ ID NO: 4040672 - RNA, 15 nt, Molluscum contagiosum virus
gcgagcugcgggcgc

SEQ ID NO: 4040673 - RNA, 16 nt, Molluscum contagiosum virus
gcgagcugcuagcggc

SEQ ID NO: 4040674 - RNA, 12 nt, Molluscum contagiosum virus
gcgaggccaagg

SEQ ID NO: 4040675 - RNA, 14 nt, Molluscum contagiosum virus
gcgaggcgcgcacg

SEQ ID NO: 4040676 - RNA, 15 nt, Molluscum contagiosum virus
gcgagugcggccacc

SEQ ID NO: 4040677 - RNA, 17 nt, Molluscum contagiosum virus
gcgaguucugccggcuc

SEQ ID NO: 4040678 - RNA, 18 nt, Molluscum contagiosum virus
gcgaucgcggccaugcgc

SEQ ID NO: 4040679 - RNA, 13 nt, Molluscum contagiosum virus
gcgaugcgcucgc

SEQ ID NO: 4040680 - RNA, 18 nt, Molluscum contagiosum virus
gcgauguacgcgugcagg

SEQ ID NO: 4040681 - RNA, 21 nt, Molluscum contagiosum virus
gcgauguuuugaacagacaac

SEQ ID NO: 4040682 - RNA, 21 nt, Molluscum contagiosum virus
gcgcaagucgcgcgcugcgaa

SEQ ID NO: 4040683 - RNA, 16 nt, Molluscum contagiosum virus
gcgcacaaacgcgcgc

SEQ ID NO: 4040684 - RNA, 23 nt, Molluscum contagiosum virus
gcgcacaagauggcgcagcacuu

SEQ ID NO: 4040685 - RNA, 18 nt, Molluscum contagiosum virus
gcgcacacccacacgugc

SEQ ID NO: 4040686 - RNA, 14 nt, Molluscum contagiosum virus
gcgcacacuugcgc

SEQ ID NO: 4040687 - RNA, 14 nt, Molluscum contagiosum virus
gcgcaccagcugca

SEQ ID NO: 4040688 - RNA, 14 nt, Molluscum contagiosum virus
gcgcacccgccacg

SEQ ID NO: 4040689 - RNA, 13 nt, Molluscum contagiosum virus
gcgcaccuggagu

SEQ ID NO: 4040690 - RNA, 20 nt, Molluscum contagiosum virus
gcgcacgcaagcccgcgcgc

SEQ ID NO: 4040691 - RNA, 19 nt, Molluscum contagiosum virus
gcgcacgcgagcacgccug

SEQ ID NO: 4040692 - RNA, 20 nt, Molluscum contagiosum virus
gcgcacgcuuguccgcggac

SEQ ID NO: 4040693 - RNA, 16 nt, Molluscum contagiosum virus
gcgcacggcagcggcg

SEQ ID NO: 4040694 - RNA, 15 nt, Molluscum contagiosum virus
gcgcacgugcucgcg

SEQ ID NO: 4040695 - RNA, 16 nt, Molluscum contagiosum virus
gcgcacguuggccacg

SEQ ID NO: 4040696 - RNA, 20 nt, Molluscum contagiosum virus
gcgcacuacucgucuugcgc

SEQ ID NO: 4040697 - RNA, 13 nt, Molluscum contagiosum virus
gcgcacugcucgc

SEQ ID NO: 4040698 - RNA, 18 nt, Molluscum contagiosum virus
gcgcagagcuccccgcgc

SEQ ID NO: 4040699 - RNA, 13 nt, Molluscum contagiosum virus
gcgcagcugcgcc

SEQ ID NO: 4040700 - RNA, 16 nt, Molluscum contagiosum virus
gcgcagcuguuucugc

SEQ ID NO: 4040701 - RNA, 22 nt, Molluscum contagiosum virus
gcgcagcuguuucugccgcgcc

SEQ ID NO: 4040702 - RNA, 16 nt, Molluscum contagiosum virus
gcgcagucccagcacc

SEQ ID NO: 4040703 - RNA, 19 nt, Molluscum contagiosum virus
gcgcagugccgcugagaga

SEQ ID NO: 4040704 - RNA, 21 nt, Molluscum contagiosum virus
gcgcaucgcgggcacgcagcu

SEQ ID NO: 4040705 - RNA, 18 nt, Molluscum contagiosum virus
gcgcaugcggcaggcgcu

SEQ ID NO: 4040706 - RNA, 23 nt, Molluscum contagiosum virus
gcgcauguauauacuccccgcgc

SEQ ID NO: 4040707 - RNA, 17 nt, Molluscum contagiosum virus
gcgcauuuaccggcgcu

SEQ ID NO: 4040708 - RNA, 15 nt, Molluscum contagiosum virus
gcgccaaccgcgagc

SEQ ID NO: 4040709 - RNA, 21 nt, Molluscum contagiosum virus
gcgccacgagcgccgcgacgc

SEQ ID NO: 4040710 - RNA, 13 nt, Molluscum contagiosum virus
gcgccacugccac

SEQ ID NO: 4040711 - RNA, 12 nt, Molluscum contagiosum virus
gcgccagcacgc

SEQ ID NO: 4040712 - RNA, 15 nt, Molluscum contagiosum virus
gcgccauccagcgca

SEQ ID NO: 4040713 - RNA, 14 nt, Molluscum contagiosum virus
gcgcccaaggccgc

SEQ ID NO: 4040714 - RNA, 20 nt, Molluscum contagiosum virus
gcgcccacggcggcacccgc

SEQ ID NO: 4040715 - RNA, 15 nt, Molluscum contagiosum virus
gcgcccgacgagcuu

SEQ ID NO: 4040716 - RNA, 17 nt, Molluscum contagiosum virus
gcgcccgccaccaugcu

SEQ ID NO: 4040717 - RNA, 13 nt, Molluscum contagiosum virus
gcgcccgcgcgcu

SEQ ID NO: 4040718 - RNA, 12 nt, Molluscum contagiosum virus
gcgcccgcggac

SEQ ID NO: 4040719 - RNA, 13 nt, Molluscum contagiosum virus
gcgcccgcggaga

SEQ ID NO: 4040720 - RNA, 11 nt, Molluscum contagiosum virus
gcgcccgcggc

SEQ ID NO: 4040721 - RNA, 22 nt, Molluscum contagiosum virus
gcgcccgcgugcacccuccgca

SEQ ID NO: 4040722 - RNA, 14 nt, Molluscum contagiosum virus
gcgcccgugccgcc

SEQ ID NO: 4040723 - RNA, 21 nt, Molluscum contagiosum virus
gcgcccgugcucgcgggccuu

SEQ ID NO: 4040724 - RNA, 19 nt, Molluscum contagiosum virus
gcgcccuaagggcccgcug

SEQ ID NO: 4040725 - RNA, 21 nt, Molluscum contagiosum virus
gcgcccuuugcggcacgggcu

SEQ ID NO: 4040726 - RNA, 23 nt, Molluscum contagiosum virus
gcgccgacgugcgcgugacgauu

SEQ ID NO: 4040727 - RNA, 17 nt, Molluscum contagiosum virus
gcgccgaugcagugcgg

SEQ ID NO: 4040728 - RNA, 15 nt, Molluscum contagiosum virus
gcgccgcacgcugcu

SEQ ID NO: 4040729 - RNA, 15 nt, Molluscum contagiosum virus
gcgccgccagcuccg

SEQ ID NO: 4040730 - RNA, 20 nt, Molluscum contagiosum virus
gcgccgccgcgccgcugcgc

SEQ ID NO: 4040731 - RNA, 21 nt, Molluscum contagiosum virus
gcgccgcgcaugacagccaug

SEQ ID NO: 4040732 - RNA, 15 nt, Molluscum contagiosum virus
gcgccgcugcgccgg

SEQ ID NO: 4040733 - RNA, 12 nt, Molluscum contagiosum virus
gcgccgcuuccu

SEQ ID NO: 4040734 - RNA, 21 nt, Molluscum contagiosum virus
gcgccggaaagaagggcucgc

SEQ ID NO: 4040735 - RNA, 14 nt, Molluscum contagiosum virus
gcgccggaaguaga

SEQ ID NO: 4040736 - RNA, 15 nt, Molluscum contagiosum virus
gcgccggcucugccu

SEQ ID NO: 4040737 - RNA, 15 nt, Molluscum contagiosum virus
gcgccggcugcgcca

SEQ ID NO: 4040738 - RNA, 24 nt, Molluscum contagiosum virus
gcgccgggaauaggucggaagaag

SEQ ID NO: 4040739 - RNA, 19 nt, Molluscum contagiosum virus
gcgccgguagggugccgag

SEQ ID NO: 4040740 - RNA, 18 nt, Molluscum contagiosum virus
gcgccguccaugugcccg

SEQ ID NO: 4040741 - RNA, 19 nt, Molluscum contagiosum virus
gcgccgucucgcggaagaa

SEQ ID NO: 4040742 - RNA, 24 nt, Molluscum contagiosum virus
gcgccuaccgcgcgggaggcgucc

SEQ ID NO: 4040743 - RNA, 22 nt, Molluscum contagiosum virus
ugcgcgcacugcucgcgcacgc

SEQ ID NO: 4040744 - RNA, 14 nt, Molluscum contagiosum virus
ugcgcgcaugccuu

SEQ ID NO: 4040745 - RNA, 16 nt, Molluscum contagiosum virus
ugcgcgccaagaacaa

SEQ ID NO: 4040746 - RNA, 12 nt, Molluscum contagiosum virus
ugcgcgcgcgcu

SEQ ID NO: 4040747 - RNA, 12 nt, Molluscum contagiosum virus
ugcgcgcgcuga

SEQ ID NO: 4040748 - RNA, 20 nt, Molluscum contagiosum virus
ugcgcgguggugcugggcgu

SEQ ID NO: 4040749 - RNA, 18 nt, Molluscum contagiosum virus
ugcgcgucugugcgcgcu

SEQ ID NO: 4040750 - RNA, 13 nt, Molluscum contagiosum virus
ugcgcgugccucu

SEQ ID NO: 4040751 - RNA, 22 nt, Molluscum contagiosum virus
ugcgcgugccucugccagccgc

SEQ ID NO: 4040752 - RNA, 21 nt, Molluscum contagiosum virus
ugcgcgugcggcgcaaccuca

SEQ ID NO: 4040753 - RNA, 19 nt, Molluscum contagiosum virus
ugcgcgugcgggcgagcau

SEQ ID NO: 4040754 - RNA, 20 nt, Molluscum contagiosum virus
ugcgcguguagcggcgcuug

SEQ ID NO: 4040755 - RNA, 13 nt, Molluscum contagiosum virus
ugcgcgugugcag

SEQ ID NO: 4040756 - RNA, 17 nt, Molluscum contagiosum virus
ugcgcuggaugcugcuc

SEQ ID NO: 4040757 - RNA, 16 nt, Molluscum contagiosum virus
ugcgcuggcccacgcu

SEQ ID NO: 4040758 - RNA, 18 nt, Molluscum contagiosum virus
ugcggagggugcacgcgg

SEQ ID NO: 4040759 - RNA, 22 nt, Molluscum contagiosum virus
ugcggagggugcacgcgggcgc

SEQ ID NO: 4040760 - RNA, 21 nt, Molluscum contagiosum virus
ugcggcaaccgcgcccgcgcg

SEQ ID NO: 4040761 - RNA, 21 nt, Molluscum contagiosum virus
ugcggcaggaagcuggcgcgg

SEQ ID NO: 4040762 - RNA, 16 nt, Molluscum contagiosum virus
ugcggccaccagcgcg

SEQ ID NO: 4040763 - RNA, 13 nt, Molluscum contagiosum virus
ugcggccagcacc

SEQ ID NO: 4040764 - RNA, 12 nt, Molluscum contagiosum virus
ugcggcgcgugc

SEQ ID NO: 4040765 - RNA, 12 nt, Molluscum contagiosum virus
ugcggcggcucg

SEQ ID NO: 4040766 - RNA, 20 nt, Molluscum contagiosum virus
ugcggcguacgcgcagggag

SEQ ID NO: 4040767 - RNA, 12 nt, Molluscum contagiosum virus
ugcggcugcugg

SEQ ID NO: 4040768 - RNA, 23 nt, Molluscum contagiosum virus
ugcgucacaagcaccgccugcug

SEQ ID NO: 4040769 - RNA, 14 nt, Molluscum contagiosum virus
ugcgucccagcagc

SEQ ID NO: 4040770 - RNA, 15 nt, Molluscum contagiosum virus
ugcgugcccagcagg

SEQ ID NO: 4040771 - RNA, 13 nt, Molluscum contagiosum virus
ugcgugcuagccc

SEQ ID NO: 4040772 - RNA, 12 nt, Molluscum contagiosum virus
ugcguggacagc

SEQ ID NO: 4040773 - RNA, 14 nt, Molluscum contagiosum virus
ugcgugguguccac

SEQ ID NO: 4040774 - RNA, 21 nt, Molluscum contagiosum virus
ugcgugguguccacgcgcgug

SEQ ID NO: 4040775 - RNA, 21 nt, Molluscum contagiosum virus
ugcguguuggcuucugcgcgg

SEQ ID NO: 4040776 - RNA, 13 nt, Molluscum contagiosum virus
ugcguuccgggcc

SEQ ID NO: 4040777 - RNA, 12 nt, Molluscum contagiosum virus
ugcguuuccagg

SEQ ID NO: 4040778 - RNA, 22 nt, Molluscum contagiosum virus
ugcucaaggacuaccagcucuu

SEQ ID NO: 4040779 - RNA, 12 nt, Molluscum contagiosum virus
ugcucauccucc

SEQ ID NO: 4040780 - RNA, 16 nt, Molluscum contagiosum virus
ugcuccacgcgcagcu

SEQ ID NO: 4040781 - RNA, 18 nt, Molluscum contagiosum virus
ugcuccgcacguggaguc

SEQ ID NO: 4040782 - RNA, 18 nt, Molluscum contagiosum virus
ugcuccugaucugcgugg

SEQ ID NO: 4040783 - RNA, 12 nt, Molluscum contagiosum virus
ugcucgccccuc

SEQ ID NO: 4040784 - RNA, 17 nt, Molluscum contagiosum virus
ugcucgcgugcgugcug

SEQ ID NO: 4040785 - RNA, 17 nt, Molluscum contagiosum virus
ugcucggacacacgcac

SEQ ID NO: 4040786 - RNA, 17 nt, Molluscum contagiosum virus
ugcucgucgccgggccc

SEQ ID NO: 4040787 - RNA, 22 nt, Molluscum contagiosum virus
ugcucguggaaaagcagggccc

SEQ ID NO: 4040788 - RNA, 20 nt, Molluscum contagiosum virus
ugcucucgcugcugcccaua

SEQ ID NO: 4040789 - RNA, 14 nt, Molluscum contagiosum virus
ugcucuuccaggag

SEQ ID NO: 4040790 - RNA, 14 nt, Molluscum contagiosum virus
ugcucuucggggac

SEQ ID NO: 4040791 - RNA, 15 nt, Molluscum contagiosum virus
ugcugaagacgcugg

SEQ ID NO: 4040792 - RNA, 15 nt, Molluscum contagiosum virus
ugcugcagcugcgcg

SEQ ID NO: 4040793 - RNA, 13 nt, Molluscum contagiosum virus
ugcugcgcgccgc

SEQ ID NO: 4040794 - RNA, 19 nt, Molluscum contagiosum virus
ugcugcggcaaccgcgccc

SEQ ID NO: 4040795 - RNA, 17 nt, Molluscum contagiosum virus
ugcugcgugcgcgcgau

SEQ ID NO: 4040796 - RNA, 22 nt, Molluscum contagiosum virus
ugcugcucgacgggcgcagcca

SEQ ID NO: 4040797 - RNA, 18 nt, Molluscum contagiosum virus
ugcugcucgcacccgcgc

SEQ ID NO: 4040798 - RNA, 15 nt, Molluscum contagiosum virus
ugcugcugcgcgcgc

SEQ ID NO: 4040799 - RNA, 20 nt, Molluscum contagiosum virus
ugcuggacacucgcggcaag

SEQ ID NO: 4040800 - RNA, 14 nt, Molluscum contagiosum virus
ugcuggagcggcau

SEQ ID NO: 4040801 - RNA, 20 nt, Molluscum contagiosum virus
ugcuggcgcgcggagagcag

SEQ ID NO: 4040802 - RNA, 19 nt, Molluscum contagiosum virus
ugcuggcgcucgcgcgcac

SEQ ID NO: 4040803 - RNA, 21 nt, Molluscum contagiosum virus
ugcuggcggggcuggcagaag

SEQ ID NO: 4040804 - RNA, 22 nt, Molluscum contagiosum virus
ugcugguucugcgcugccagcu

SEQ ID NO: 4040805 - RNA, 21 nt, Molluscum contagiosum virus
ugcugucccaagacucugccg

SEQ ID NO: 4040806 - RNA, 21 nt, Molluscum contagiosum virus
ugcuguccuucaagaacgaca

SEQ ID NO: 4040807 - RNA, 19 nt, Molluscum contagiosum virus
ugcuguugccgcgcucgug

SEQ ID NO: 4040808 - RNA, 19 nt, Molluscum contagiosum virus
ugcuuccgcaccuggucga

SEQ ID NO: 4040809 - RNA, 23 nt, Molluscum contagiosum virus
ugcuuccggugccggccgccggc

SEQ ID NO: 4040810 - RNA, 19 nt, Molluscum contagiosum virus
ugcuuugugcgucucccag

SEQ ID NO: 4040811 - RNA, 19 nt, Molluscum contagiosum virus
ugcuuuuucugugcgccuu

SEQ ID NO: 4040812 - RNA, 17 nt, Molluscum contagiosum virus
uggaacugcagcagcug

SEQ ID NO: 4040813 - RNA, 16 nt, Molluscum contagiosum virus
uggaagccgccagcca

SEQ ID NO: 4040814 - RNA, 20 nt, Molluscum contagiosum virus
uggaagcuuccuuuuucacu

SEQ ID NO: 4040815 - RNA, 16 nt, Molluscum contagiosum virus
uggacacgcacuggcg

SEQ ID NO: 4040816 - RNA, 20 nt, Molluscum contagiosum virus
uggacacgcacuggcgcugc

SEQ ID NO: 4040817 - RNA, 16 nt, Molluscum contagiosum virus
uggacacgcugcgcgu

SEQ ID NO: 4040818 - RNA, 12 nt, Molluscum contagiosum virus
uggacacgugcg

SEQ ID NO: 4040819 - RNA, 17 nt, Molluscum contagiosum virus
uggacacgugcguggug

SEQ ID NO: 4040820 - RNA, 15 nt, Molluscum contagiosum virus
uggacagcaucccca

SEQ ID NO: 4040821 - RNA, 11 nt, Molluscum contagiosum virus
uggaccugauu

SEQ ID NO: 4040822 - RNA, 18 nt, Molluscum contagiosum virus
uggacgagcgcuaccuga

SEQ ID NO: 4040823 - RNA, 20 nt, Molluscum contagiosum virus
uggacgagcgcuaccugaug

SEQ ID NO: 4040824 - RNA, 20 nt, Molluscum contagiosum virus
uggacgaugguggcgcugcu

SEQ ID NO: 4040825 - RNA, 11 nt, Molluscum contagiosum virus
uggacgcgcaa

SEQ ID NO: 4040826 - RNA, 23 nt, Molluscum contagiosum virus
uggacgcgcucaagauccgagaa

SEQ ID NO: 4040827 - RNA, 12 nt, Molluscum contagiosum virus
uggacggugcug

SEQ ID NO: 4040828 - RNA, 15 nt, Molluscum contagiosum virus
uggacgugcugcugg

SEQ ID NO: 4040829 - RNA, 21 nt, Molluscum contagiosum virus
uggacguguccggagccaagc

SEQ ID NO: 4040830 - RNA, 22 nt, Molluscum contagiosum virus
uggagaaggucuacgaggagca

SEQ ID NO: 4040831 - RNA, 20 nt, Molluscum contagiosum virus
uggagaccugucgugcaaug

SEQ ID NO: 4040832 - RNA, 21 nt, Molluscum contagiosum virus
uggagagcguacucgggccgc

SEQ ID NO: 4040833 - RNA, 18 nt, Molluscum contagiosum virus
uggagcaccuggaacgcg

SEQ ID NO: 4040834 - RNA, 14 nt, Molluscum contagiosum virus
uggagcgagugcgc

SEQ ID NO: 4040835 - RNA, 14 nt, Molluscum contagiosum virus
uggagcgcgcggac

SEQ ID NO: 4040836 - RNA, 19 nt, Molluscum contagiosum virus
uggagcugccgcugcgcga

SEQ ID NO: 4040837 - RNA, 18 nt, Molluscum contagiosum virus
uggaggcaaucuguccag

SEQ ID NO: 4040838 - RNA, 16 nt, Molluscum contagiosum virus
uggaggcccaggccau

SEQ ID NO: 4040839 - RNA, 18 nt, Molluscum contagiosum virus
uggaggcgcuagugcaga

SEQ ID NO: 4040840 - RNA, 21 nt, Molluscum contagiosum virus
uggagucacgaccgacccauc

SEQ ID NO: 4040841 - RNA, 20 nt, Molluscum contagiosum virus
uggaguuuaaugacgcgcac

SEQ ID NO: 4040842 - RNA, 23 nt, Molluscum contagiosum virus
uggaucaccacuggacacgugcc

SEQ ID NO: 4040843 - RNA, 19 nt, Molluscum contagiosum virus
uggaucgcgcgcaccugca

SEQ ID NO: 4040844 - RNA, 20 nt, Molluscum contagiosum virus
uggaucuucucaagagccgc

SEQ ID NO: 4040845 - RNA, 20 nt, Molluscum contagiosum virus
uggcaccugcggcugcggcg

SEQ ID NO: 4040846 - RNA, 16 nt, Molluscum contagiosum virus
uggcacgcgccgcgcg

SEQ ID NO: 4040847 - RNA, 13 nt, Molluscum contagiosum virus
ugcccgccagaag

SEQ ID NO: 4040848 - RNA, 19 nt, Molluscum contagiosum virus
ugcccgccagaagugaaau

SEQ ID NO: 4040849 - RNA, 17 nt, Molluscum contagiosum virus
ugccgacgugugccgcu

SEQ ID NO: 4040850 - RNA, 14 nt, Molluscum contagiosum virus
ugccgaggcgcugc

SEQ ID NO: 4040851 - RNA, 13 nt, Molluscum contagiosum virus
ugccgcagcccga

SEQ ID NO: 4040852 - RNA, 15 nt, Molluscum contagiosum virus
ugccgccggcgccgc

SEQ ID NO: 4040853 - RNA, 17 nt, Molluscum contagiosum virus
ugccgcgagcacuggcu

SEQ ID NO: 4040854 - RNA, 22 nt, Molluscum contagiosum virus
ugccgcgccuugagcgcgccgc

SEQ ID NO: 4040855 - RNA, 16 nt, Molluscum contagiosum virus
ugccgcggcaguggcc

SEQ ID NO: 4040856 - RNA, 20 nt, Molluscum contagiosum virus
ugccgcucgcuguccuuccg

SEQ ID NO: 4040857 - RNA, 16 nt, Molluscum contagiosum virus
ugccgcugagagacuu

SEQ ID NO: 4040858 - RNA, 15 nt, Molluscum contagiosum virus
ugccgcuugagcagc

SEQ ID NO: 4040859 - RNA, 21 nt, Molluscum contagiosum virus
ugccggcaacgcugccgcugg

SEQ ID NO: 4040860 - RNA, 17 nt, Molluscum contagiosum virus
ugccggcgcgugagcgc

SEQ ID NO: 4040861 - RNA, 21 nt, Molluscum contagiosum virus
ugccgggcgccggcucugccu

SEQ ID NO: 4040862 - RNA, 13 nt, Molluscum contagiosum virus
ugccguccccgcg

SEQ ID NO: 4040863 - RNA, 14 nt, Molluscum contagiosum virus
ugccgucgcccgug

SEQ ID NO: 4040864 - RNA, 16 nt, Molluscum contagiosum virus
ugccguucacgcacac

SEQ ID NO: 4040865 - RNA, 18 nt, Molluscum contagiosum virus
ugccugagaagcuguacc

SEQ ID NO: 4040866 - RNA, 15 nt, Molluscum contagiosum virus
ugccugcacugagaa

SEQ ID NO: 4040867 - RNA, 11 nt, Molluscum contagiosum virus
ugccuggcagu

SEQ ID NO: 4040868 - RNA, 19 nt, Molluscum contagiosum virus
ugccuuucgaguccccaga

SEQ ID NO: 4040869 - RNA, 14 nt, Molluscum contagiosum virus
ugccuuucuuccag

SEQ ID NO: 4040870 - RNA, 17 nt, Molluscum contagiosum virus
ugcgacagcugcugcuc

SEQ ID NO: 4040871 - RNA, 20 nt, Molluscum contagiosum virus
ugcgagcacuguacgcacgc

SEQ ID NO: 4040872 - RNA, 14 nt, Molluscum contagiosum virus
ugcgagcggcgcgc

SEQ ID NO: 4040873 - RNA, 15 nt, Molluscum contagiosum virus
ugcgaguggcgcgca

SEQ ID NO: 4040874 - RNA, 14 nt, Molluscum contagiosum virus
ugcgcaacgugcug

SEQ ID NO: 4040875 - RNA, 16 nt, Molluscum contagiosum virus
ugcgcaagcucagccu

SEQ ID NO: 4040876 - RNA, 12 nt, Molluscum contagiosum virus
ugcgcaaggccg

SEQ ID NO: 4040877 - RNA, 18 nt, Molluscum contagiosum virus
ugcgcaauaaggcggugg

SEQ ID NO: 4040878 - RNA, 23 nt, Molluscum contagiosum virus
ugcgcaccgcgggcuggacugug

SEQ ID NO: 4040879 - RNA, 23 nt, Molluscum contagiosum virus
ugcgcagcauucccggcgcgcgc

SEQ ID NO: 4040880 - RNA, 15 nt, Molluscum contagiosum virus
ugcgcaggaccgcga

SEQ ID NO: 4040881 - RNA, 22 nt, Molluscum contagiosum virus
ugcgcauggccacgcccgggcc

SEQ ID NO: 4040882 - RNA, 19 nt, Molluscum contagiosum virus
ugcgcccgugcgaggagca

SEQ ID NO: 4040883 - RNA, 11 nt, Molluscum contagiosum virus
ugcgccgccgc

SEQ ID NO: 4040884 - RNA, 17 nt, Molluscum contagiosum virus
ugcgccggcugcgccac

SEQ ID NO: 4040885 - RNA, 20 nt, Molluscum contagiosum virus
ugcgccugccgcgcaugcug

SEQ ID NO: 4040886 - RNA, 21 nt, Molluscum contagiosum virus
ugcgcgagacgcugcugcaca

SEQ ID NO: 4040887 - RNA, 17 nt, Molluscum contagiosum virus
ugcgcgagccgcugcac

SEQ ID NO: 4040888 - RNA, 19 nt, Molluscum contagiosum virus
ugcgcgagccgcugcacgc

SEQ ID NO: 4040889 - RNA, 22 nt, Molluscum contagiosum virus
ugcgcgcacggcuaggcgcggc

SEQ ID NO: 4040890 - RNA, 18 nt, Molluscum contagiosum virus
agcccgcgcgcgagcugg

SEQ ID NO: 4040891 - RNA, 17 nt, Molluscum contagiosum virus
agcccgcugcgcauggc

SEQ ID NO: 4040892 - RNA, 22 nt, Molluscum contagiosum virus
agcccgcugcgcauggccacgc

SEQ ID NO: 4040893 - RNA, 12 nt, Molluscum contagiosum virus
agcccuccugag

SEQ ID NO: 4040894 - RNA, 20 nt, Molluscum contagiosum virus
agcccuuccacgacauggac

SEQ ID NO: 4040895 - RNA, 13 nt, Molluscum contagiosum virus
agccgagcgccgc

SEQ ID NO: 4040896 - RNA, 17 nt, Molluscum contagiosum virus
agccgcaaccucuuccg

SEQ ID NO: 4040897 - RNA, 13 nt, Molluscum contagiosum virus
agccgcacggcgc

SEQ ID NO: 4040898 - RNA, 14 nt, Molluscum contagiosum virus
agccgccgcugccg

SEQ ID NO: 4040899 - RNA, 18 nt, Molluscum contagiosum virus
agccgcguagcuagcucu

SEQ ID NO: 4040900 - RNA, 14 nt, Molluscum contagiosum virus
agccgcuccugguc

SEQ ID NO: 4040901 - RNA, 21 nt, Molluscum contagiosum virus
agccgcuccuggucuucccgc

SEQ ID NO: 4040902 - RNA, 18 nt, Molluscum contagiosum virus
agccgcuggacgccucgg

SEQ ID NO: 4040903 - RNA, 21 nt, Molluscum contagiosum virus
agccggccuagagcuggcacc

SEQ ID NO: 4040904 - RNA, 14 nt, Molluscum contagiosum virus
agccuagccauaca

SEQ ID NO: 4040905 - RNA, 21 nt, Molluscum contagiosum virus
agccucccccgcgcacugcca

SEQ ID NO: 4040906 - RNA, 15 nt, Molluscum contagiosum virus
agccucgcuggugug

SEQ ID NO: 4040907 - RNA, 19 nt, Molluscum contagiosum virus
agccucucucguggggagg

SEQ ID NO: 4040908 - RNA, 19 nt, Molluscum contagiosum virus
agccugcucacggcggcgc

SEQ ID NO: 4040909 - RNA, 17 nt, Molluscum contagiosum virus
agccuuuuggcggcgca

SEQ ID NO: 4040910 - RNA, 17 nt, Molluscum contagiosum virus
agcgacuacgcgcugcu

SEQ ID NO: 4040911 - RNA, 14 nt, Molluscum contagiosum virus
agcgagugcgcgug

SEQ ID NO: 4040912 - RNA, 14 nt, Molluscum contagiosum virus
agcgccgccagcuc

SEQ ID NO: 4040913 - RNA, 21 nt, Molluscum contagiosum virus
agcgccggaaacggaccugga

SEQ ID NO: 4040914 - RNA, 18 nt, Molluscum contagiosum virus
agcgccgucucgcggaag

SEQ ID NO: 4040915 - RNA, 21 nt, Molluscum contagiosum virus
agcgccuguaccccgaacggc

SEQ ID NO: 4040916 - RNA, 17 nt, Molluscum contagiosum virus
agcgccuguccgugggc

SEQ ID NO: 4040917 - RNA, 14 nt, Molluscum contagiosum virus
agcgccuugccgag

SEQ ID NO: 4040918 - RNA, 20 nt, Molluscum contagiosum virus
agcgcgaauuggccgcggag

SEQ ID NO: 4040919 - RNA, 14 nt, Molluscum contagiosum virus
agcgcgagcugugc

SEQ ID NO: 4040920 - RNA, 22 nt, Molluscum contagiosum virus
agcgcgcccaccagcagccagg

SEQ ID NO: 4040921 - RNA, 19 nt, Molluscum contagiosum virus
agcgcgccuagcuccagcg

SEQ ID NO: 4040922 - RNA, 16 nt, Molluscum contagiosum virus
agcgcgcuagcuccac

SEQ ID NO: 4040923 - RNA, 14 nt, Molluscum contagiosum virus
agcgcgcugcgccg

SEQ ID NO: 4040924 - RNA, 21 nt, Molluscum contagiosum virus
agcgcgcuggacuugcgcgag

SEQ ID NO: 4040925 - RNA, 19 nt, Molluscum contagiosum virus
agcgcggcaacagcacgac

SEQ ID NO: 4040926 - RNA, 16 nt, Molluscum contagiosum virus
agcgcggccgcgcucg

SEQ ID NO: 4040927 - RNA, 19 nt, Molluscum contagiosum virus
agcgcguccaugcugaucu

SEQ ID NO: 4040928 - RNA, 15 nt, Molluscum contagiosum virus
agcgcgugccgcucg

SEQ ID NO: 4040929 - RNA, 23 nt, Molluscum contagiosum virus
agcgcguucgcgcgugcuggacg

SEQ ID NO: 4040930 - RNA, 16 nt, Molluscum contagiosum virus
agcgcucgcccagcuc

SEQ ID NO: 4040931 - RNA, 13 nt, Molluscum contagiosum virus
agcgcucugcauu

SEQ ID NO: 4040932 - RNA, 13 nt, Molluscum contagiosum virus
agcgcuggagcug

SEQ ID NO: 4040933 - RNA, 20 nt, Molluscum contagiosum virus
agcggacuacaucgcucucu

SEQ ID NO: 4040934 - RNA, 23 nt, Molluscum contagiosum virus
agcggcgccacgagcgccgcgac

SEQ ID NO: 4040935 - RNA, 19 nt, Molluscum contagiosum virus
agcgguguugcuguuucca

SEQ ID NO: 4040936 - RNA, 14 nt, Molluscum contagiosum virus
agcgguuccugcuu

SEQ ID NO: 4040937 - RNA, 21 nt, Molluscum contagiosum virus
agcgucgugugcgcgcacggc

SEQ ID NO: 4040938 - RNA, 15 nt, Molluscum contagiosum virus
agcguggcgcgcgag

SEQ ID NO: 4040939 - RNA, 19 nt, Molluscum contagiosum virus
agcgugucgaagcgcgcag

SEQ ID NO: 4040940 - RNA, 18 nt, Molluscum contagiosum virus
agcuagcucuggcagccc

SEQ ID NO: 4040941 - RNA, 19 nt, Molluscum contagiosum virus
agcuauccgcugucugaaa

SEQ ID NO: 4040942 - RNA, 17 nt, Molluscum contagiosum virus
agcucaaucucgcccag

SEQ ID NO: 4040943 - RNA, 18 nt, Molluscum contagiosum virus
agcucacggcuguggaca

SEQ ID NO: 4040944 - RNA, 16 nt, Molluscum contagiosum virus
agcuccgccgggaaua

SEQ ID NO: 4040945 - RNA, 20 nt, Molluscum contagiosum virus
agcuccgcgcaugccagacc

SEQ ID NO: 4040946 - RNA, 14 nt, Molluscum contagiosum virus
agcuccuagcgcgc

SEQ ID NO: 4040947 - RNA, 14 nt, Molluscum contagiosum virus
agcuccugcugguu

SEQ ID NO: 4040948 - RNA, 19 nt, Molluscum contagiosum virus
agcucgacacugugcuggc

SEQ ID NO: 4040949 - RNA, 23 nt, Molluscum contagiosum virus
agcucgcagccuccgugcgccag

SEQ ID NO: 4040950 - RNA, 20 nt, Molluscum contagiosum virus
agcucgccuccuugcccgag

SEQ ID NO: 4040951 - RNA, 23 nt, Molluscum contagiosum virus
agcucgcgcaguuagaaaugcuu

SEQ ID NO: 4040952 - RNA, 16 nt, Molluscum contagiosum virus
agcucgcgcgcaagaa

SEQ ID NO: 4040953 - RNA, 12 nt, Molluscum contagiosum virus
agcucguggaca

SEQ ID NO: 4040954 - RNA, 23 nt, Molluscum contagiosum virus
agcucugucccgcaagccacaca

SEQ ID NO: 4040955 - RNA, 11 nt, Molluscum contagiosum virus
agcucuucccc

SEQ ID NO: 4040956 - RNA, 20 nt, Molluscum contagiosum virus
agcucuucgacagcgugcgc

SEQ ID NO: 4040957 - RNA, 23 nt, Molluscum contagiosum virus
agcugacucggacacuggaggug

SEQ ID NO: 4040958 - RNA, 16 nt, Molluscum contagiosum virus
agcugcaagccagccc

SEQ ID NO: 4040959 - RNA, 14 nt, Molluscum contagiosum virus
agcugcaccggcgc

SEQ ID NO: 4040960 - RNA, 21 nt, Molluscum contagiosum virus
agcugcacgugcagcggcgcc

SEQ ID NO: 4040961 - RNA, 17 nt, Molluscum contagiosum virus
agcugcgcuugcgcgug

SEQ ID NO: 4040962 - RNA, 14 nt, Molluscum contagiosum virus
agcugcggacgcgg

SEQ ID NO: 4040963 - RNA, 22 nt, Molluscum contagiosum virus
agcuggagcugccgcugcgcga

SEQ ID NO: 4040964 - RNA, 16 nt, Molluscum contagiosum virus
agcugugcgagccagu

SEQ ID NO: 4040965 - RNA, 20 nt, Molluscum contagiosum virus
agcuucgucuucaccugcau

SEQ ID NO: 4040966 - RNA, 21 nt, Molluscum contagiosum virus
agcuucuccggaggccgcucc

SEQ ID NO: 4040967 - RNA, 15 nt, Molluscum contagiosum virus
agcuuggugcgcucg

SEQ ID NO: 4040968 - RNA, 16 nt, Molluscum contagiosum virus
ccggucaccgcguccg

SEQ ID NO: 4040969 - RNA, 12 nt, Molluscum contagiosum virus
ccgguccugacu

SEQ ID NO: 4040970 - RNA, 14 nt, Molluscum contagiosum virus
ccgguccugacucc

SEQ ID NO: 4040971 - RNA, 21 nt, Molluscum contagiosum virus
ccguaccccgagggcgcgacc

SEQ ID NO: 4040972 - RNA, 19 nt, Molluscum contagiosum virus
ccgucaaccugcugccucc

SEQ ID NO: 4040973 - RNA, 19 nt, Molluscum contagiosum virus
ccguccaguaagcgacagg

SEQ ID NO: 4040974 - RNA, 13 nt, Molluscum contagiosum virus
ccguccgcgcagc

SEQ ID NO: 4040975 - RNA, 17 nt, Molluscum contagiosum virus
ccguccucgcucgugcu

SEQ ID NO: 4040976 - RNA, 13 nt, Molluscum contagiosum virus
ccguccuugcucu

SEQ ID NO: 4040977 - RNA, 21 nt, Molluscum contagiosum virus
ccgucucgcggaagaauuccu

SEQ ID NO: 4040978 - RNA, 19 nt, Molluscum contagiosum virus
ccgucuugcgcacacacuu

SEQ ID NO: 4040979 - RNA, 19 nt, Molluscum contagiosum virus
ccgucuuugcggacgcgcg

SEQ ID NO: 4040980 - RNA, 13 nt, Molluscum contagiosum virus
ccgugaacucgac

SEQ ID NO: 4040981 - RNA, 16 nt, Molluscum contagiosum virus
ccgugacgcugcggcg

SEQ ID NO: 4040982 - RNA, 13 nt, Molluscum contagiosum virus
ccgugcccgagcc

SEQ ID NO: 4040983 - RNA, 19 nt, Molluscum contagiosum virus
cucagcgccgcgugcaugc

SEQ ID NO: 4040984 - RNA, 21 nt, Molluscum contagiosum virus
cucagcgcuucgacuuccagc

SEQ ID NO: 4040985 - RNA, 16 nt, Molluscum contagiosum virus
cucagcgggcagacag

SEQ ID NO: 4040986 - RNA, 15 nt, Molluscum contagiosum virus
cucaggggcucuccu

SEQ ID NO: 4040987 - RNA, 14 nt, Molluscum contagiosum virus
cucauagcccaugc

SEQ ID NO: 4040988 - RNA, 20 nt, Molluscum contagiosum virus
cucauagcgccacgagcagu

SEQ ID NO: 4040989 - RNA, 15 nt, Molluscum contagiosum virus
cucaucaagcccgag

SEQ ID NO: 4040990 - RNA, 12 nt, Molluscum contagiosum virus
cucauccaccug

SEQ ID NO: 4040991 - RNA, 16 nt, Molluscum contagiosum virus
cucauccucccugcgg

SEQ ID NO: 4040992 - RNA, 17 nt, Molluscum contagiosum virus
cucaucgagcaccucaa

SEQ ID NO: 4040993 - RNA, 18 nt, Molluscum contagiosum virus
cucaucggcgagcucuuu

SEQ ID NO: 4040994 - RNA, 23 nt, Molluscum contagiosum virus
cucaugcgcgggaugcuggacgg

SEQ ID NO: 4040995 - RNA, 16 nt, Molluscum contagiosum virus
cuccaacagcagcugg

SEQ ID NO: 4040996 - RNA, 13 nt, Molluscum contagiosum virus
cuccaagaacgag

SEQ ID NO: 4040997 - RNA, 16 nt, Molluscum contagiosum virus
cuccaagaagaggcca

SEQ ID NO: 4040998 - RNA, 17 nt, Molluscum contagiosum virus
cuccaagaagaggccag

SEQ ID NO: 4040999 - RNA, 19 nt, Molluscum contagiosum virus
cuccacuaccaacucugug

SEQ ID NO: 4041000 - RNA, 13 nt, Molluscum contagiosum virus
cuccagcguggug

SEQ ID NO: 4041001 - RNA, 15 nt, Molluscum contagiosum virus
cuccagguccuccag

SEQ ID NO: 4041002 - RNA, 17 nt, Molluscum contagiosum virus
cuccaucaucgagcugc

SEQ ID NO: 4041003 - RNA, 13 nt, Molluscum contagiosum virus
cuccauggagcgc

SEQ ID NO: 4041004 - RNA, 14 nt, Molluscum contagiosum virus
cuccauggagcgcc

SEQ ID NO: 4041005 - RNA, 23 nt, Molluscum contagiosum virus
cucccaggaagacgugcugcgcg

SEQ ID NO: 4041006 - RNA, 20 nt, Molluscum contagiosum virus
cucccgccgcgugcccgucu

SEQ ID NO: 4041007 - RNA, 17 nt, Molluscum contagiosum virus
cucccucgcgcgcaugu

SEQ ID NO: 4041008 - RNA, 17 nt, Molluscum contagiosum virus
cuccgaaaaaggcccgg

SEQ ID NO: 4041009 - RNA, 22 nt, Molluscum contagiosum virus
cuccgagcgcgacuuguccuca

SEQ ID NO: 4041010 - RNA, 13 nt, Molluscum contagiosum virus
cuccgagcgcgcg

SEQ ID NO: 4041011 - RNA, 21 nt, Molluscum contagiosum virus
cuccgaggaaacgcagcacuu

SEQ ID NO: 4041012 - RNA, 15 nt, Molluscum contagiosum virus
cuccgaggaggcaag

SEQ ID NO: 4041013 - RNA, 14 nt, Molluscum contagiosum virus
cuccgaguccagcu

SEQ ID NO: 4041014 - RNA, 22 nt, Molluscum contagiosum virus
cuccgcgaccgcgaacugcaac

SEQ ID NO: 4041015 - RNA, 14 nt, Molluscum contagiosum virus
cuccgcgcaccgcg

SEQ ID NO: 4041016 - RNA, 21 nt, Molluscum contagiosum virus
cuccgcggaggccaagcaaac

SEQ ID NO: 4041017 - RNA, 19 nt, Molluscum contagiosum virus
cuccgcgggaagaggacgc

SEQ ID NO: 4041018 - RNA, 15 nt, Molluscum contagiosum virus
cuccgcgggcagccg

SEQ ID NO: 4041019 - RNA, 19 nt, Molluscum contagiosum virus
cuccggucgcccuccgccg

SEQ ID NO: 4041020 - RNA, 12 nt, Molluscum contagiosum virus
cuccgugcgcca

SEQ ID NO: 4041021 - RNA, 14 nt, Molluscum contagiosum virus
cuccguuucccgcg

SEQ ID NO: 4041022 - RNA, 23 nt, Molluscum contagiosum virus
cuccuacacauuccucggcgcac

SEQ ID NO: 4041023 - RNA, 18 nt, Molluscum contagiosum virus
cuccucggcgcuacgcac

SEQ ID NO: 4041024 - RNA, 17 nt, Molluscum contagiosum virus
cuccucucacgcccucu

SEQ ID NO: 4041025 - RNA, 17 nt, Molluscum contagiosum virus
cuccugagaagcaaugc

SEQ ID NO: 4041026 - RNA, 23 nt, Molluscum contagiosum virus
cuccugugucgcgcgagcaaaga

SEQ ID NO: 4041027 - RNA, 19 nt, Molluscum contagiosum virus
cuccuucgacgcgcguucu

SEQ ID NO: 4041028 - RNA, 23 nt, Molluscum contagiosum virus
cucgaacgcaaggugugcgcgcu

SEQ ID NO: 4041029 - RNA, 19 nt, Molluscum contagiosum virus
cucgaccugcacgacccuc

SEQ ID NO: 4041030 - RNA, 16 nt, Molluscum contagiosum virus
cucgacgugaucgcgc

SEQ ID NO: 4041031 - RNA, 21 nt, Molluscum contagiosum virus
cucgagcacgccuccaagaag

SEQ ID NO: 4041032 - RNA, 12 nt, Molluscum contagiosum virus
cucgagcagcgg

SEQ ID NO: 4041033 - RNA, 20 nt, Molluscum contagiosum virus
cucgagcaggucaucgggcu

SEQ ID NO: 4041034 - RNA, 23 nt, Molluscum contagiosum virus
cucgagccugccagcgccagccu

SEQ ID NO: 4041035 - RNA, 22 nt, Molluscum contagiosum virus
cucgagcgcgcgccugcuggcg

SEQ ID NO: 4041036 - RNA, 15 nt, Molluscum contagiosum virus
cucgagcgcgcugga

SEQ ID NO: 4041037 - RNA, 23 nt, Molluscum contagiosum virus
cucgagcucuucucgcagcggga

SEQ ID NO: 4041038 - RNA, 14 nt, Molluscum contagiosum virus
cucgagugcacgua

SEQ ID NO: 4041039 - RNA, 17 nt, Molluscum contagiosum virus
cucgauggacgccagcu

SEQ ID NO: 4041040 - RNA, 17 nt, Molluscum contagiosum virus
cucgcagacgcagcgcg

SEQ ID NO: 4041041 - RNA, 15 nt, Molluscum contagiosum virus
cucgcagcucacgag

SEQ ID NO: 4041042 - RNA, 22 nt, Molluscum contagiosum virus
cucgccaguggccagcgcgcgg

SEQ ID NO: 4041043 - RNA, 22 nt, Molluscum contagiosum virus
cucgcccgcgcgcgcgcgaacg

SEQ ID NO: 4041044 - RNA, 13 nt, Molluscum contagiosum virus
cucgccgcacgcg

SEQ ID NO: 4041045 - RNA, 18 nt, Molluscum contagiosum virus
cucgccggcaccacggug

SEQ ID NO: 4041046 - RNA, 20 nt, Molluscum contagiosum virus
cucgccuccuugcccgagga

SEQ ID NO: 4041047 - RNA, 15 nt, Molluscum contagiosum virus
cucgccuuuccccgg

SEQ ID NO: 4041048 - RNA, 22 nt, Molluscum contagiosum virus
cucgcgcaggucaucgacgagc

SEQ ID NO: 4041049 - RNA, 16 nt, Molluscum contagiosum virus
cucgcgcaucugccgc

SEQ ID NO: 4041050 - RNA, 16 nt, Molluscum contagiosum virus
cucgcgcgcagcacac

SEQ ID NO: 4041051 - RNA, 12 nt, Molluscum contagiosum virus
cucgcgcgcgag

SEQ ID NO: 4041052 - RNA, 17 nt, Molluscum contagiosum virus
cucgcgcgcgagcacgu

SEQ ID NO: 4041053 - RNA, 19 nt, Molluscum contagiosum virus
cucgcgcguccgcaaagac

SEQ ID NO: 4041054 - RNA, 20 nt, Molluscum contagiosum virus
cucgcgcucgggaagcacgu

SEQ ID NO: 4041055 - RNA, 19 nt, Molluscum contagiosum virus
cucgcguaccuacucgccg

SEQ ID NO: 4041056 - RNA, 22 nt, Molluscum contagiosum virus
cucgcgucaucgcugcacgcga

SEQ ID NO: 4041057 - RNA, 19 nt, Molluscum contagiosum virus
cucgcguccgcgcagcucg

SEQ ID NO: 4041058 - RNA, 14 nt, Molluscum contagiosum virus
cucgcucgcgcaag

SEQ ID NO: 4041059 - RNA, 20 nt, Molluscum contagiosum virus
cucgcuguccuuccgacccg

SEQ ID NO: 4041060 - RNA, 17 nt, Molluscum contagiosum virus
cucggacggaggucugc

SEQ ID NO: 4041061 - RNA, 18 nt, Molluscum contagiosum virus
cucggacggaggucugcu

SEQ ID NO: 4041062 - RNA, 14 nt, Molluscum contagiosum virus
cucggacuuggccc

SEQ ID NO: 4041063 - RNA, 15 nt, Molluscum contagiosum virus
cucggcacugcuggc

SEQ ID NO: 4041064 - RNA, 12 nt, Molluscum contagiosum virus
cucggcgcacac

SEQ ID NO: 4041065 - RNA, 19 nt, Molluscum contagiosum virus
cucggcguggugcuggcca

SEQ ID NO: 4041066 - RNA, 16 nt, Molluscum contagiosum virus
cucgggcuagcaagca

SEQ ID NO: 4041067 - RNA, 20 nt, Molluscum contagiosum virus
cucgggcuagcaagcacgcc

SEQ ID NO: 4041068 - RNA, 18 nt, Molluscum contagiosum virus
cucgggugugugccugcu

SEQ ID NO: 4041069 - RNA, 15 nt, Molluscum contagiosum virus
cucggguuccagcuc

SEQ ID NO: 4041070 - RNA, 22 nt, Molluscum contagiosum virus
cucgguacaacuuuuccugcgu

SEQ ID NO: 4041071 - RNA, 14 nt, Molluscum contagiosum virus
cucgguggugcgcc

SEQ ID NO: 4041072 - RNA, 21 nt, Molluscum contagiosum virus
cucguacugcugcaggcaaag

SEQ ID NO: 4041073 - RNA, 14 nt, Molluscum contagiosum virus
cucguccggcgcuc

SEQ ID NO: 4041074 - RNA, 15 nt, Molluscum contagiosum virus
cucgucgccgggccc

SEQ ID NO: 4041075 - RNA, 15 nt, Molluscum contagiosum virus
cucgugccacugccg

SEQ ID NO: 4041076 - RNA, 13 nt, Molluscum contagiosum virus
cucgugcugcucu

SEQ ID NO: 4041077 - RNA, 14 nt, Molluscum contagiosum virus
cucgugcugggccu

SEQ ID NO: 4041078 - RNA, 17 nt, Molluscum contagiosum virus
cucguggaaaagcaggg

SEQ ID NO: 4041079 - RNA, 18 nt, Molluscum contagiosum virus
cucguggaucgcgcgcac

SEQ ID NO: 4041080 - RNA, 22 nt, Molluscum contagiosum virus
cucgugucacaauggcacuagc

SEQ ID NO: 4041081 - RNA, 16 nt, Molluscum contagiosum virus
cucguguguccgcacg

SEQ ID NO: 4041082 - RNA, 21 nt, Molluscum contagiosum virus
cucguguguccgcacgcacac

SEQ ID NO: 4041083 - RNA, 15 nt, Molluscum contagiosum virus
cucguguuguugcau

SEQ ID NO: 4041084 - RNA, 18 nt, Molluscum contagiosum virus
cucuacgccguguaccgc

SEQ ID NO: 4041085 - RNA, 17 nt, Molluscum contagiosum virus
cucucccgggcucuguc

SEQ ID NO: 4041086 - RNA, 23 nt, Molluscum contagiosum virus
cucuccgucagggaugccagugc

SEQ ID NO: 4041087 - RNA, 10 nt, Molluscum contagiosum virus
gcauugagcu

SEQ ID NO: 4041088 - RNA, 21 nt, Molluscum contagiosum virus
gccaaagucuuccuggggcug

SEQ ID NO: 4041089 - RNA, 20 nt, Molluscum contagiosum virus
gccaacacuaccacagccau

SEQ ID NO: 4041090 - RNA, 17 nt, Molluscum contagiosum virus
gccaaccuccugcaccu

SEQ ID NO: 4041091 - RNA, 23 nt, Molluscum contagiosum virus
gccaacgcggacgcgcagcucga

SEQ ID NO: 4041092 - RNA, 20 nt, Molluscum contagiosum virus
gccaagcguuggcgcccgag

SEQ ID NO: 4041093 - RNA, 13 nt, Molluscum contagiosum virus
gccaaggucucga

SEQ ID NO: 4041094 - RNA, 23 nt, Molluscum contagiosum virus
gccaccagcgcggccguggcugc

SEQ ID NO: 4041095 - RNA, 15 nt, Molluscum contagiosum virus
gccaccgcgcccuuu

SEQ ID NO: 4041096 - RNA, 15 nt, Molluscum contagiosum virus
gccacgagcgccgcg

SEQ ID NO: 4041097 - RNA, 16 nt, Molluscum contagiosum virus
gccacgauggccggca

SEQ ID NO: 4041098 - RNA, 18 nt, Molluscum contagiosum virus
gccacgcagcuggcgggc

SEQ ID NO: 4041099 - RNA, 21 nt, Molluscum contagiosum virus
gccacgcagcuggcgggcgug

SEQ ID NO: 4041100 - RNA, 15 nt, Molluscum contagiosum virus
gccacucuccuucag

SEQ ID NO: 4041101 - RNA, 20 nt, Molluscum contagiosum virus
gccacugccacggcugcaag

SEQ ID NO: 4041102 - RNA, 17 nt, Molluscum contagiosum virus
gccagcaagcucgaugc

SEQ ID NO: 4041103 - RNA, 17 nt, Molluscum contagiosum virus
gccagcauggcgagccc

SEQ ID NO: 4041104 - RNA, 15 nt, Molluscum contagiosum virus
gccagccaggcgccg

SEQ ID NO: 4041105 - RNA, 21 nt, Molluscum contagiosum virus
gccagcgccuguccgugggcg

SEQ ID NO: 4041106 - RNA, 13 nt, Molluscum contagiosum virus
gccagcggcgccg

SEQ ID NO: 4041107 - RNA, 15 nt, Molluscum contagiosum virus
gccagcggcgccgca

SEQ ID NO: 4041108 - RNA, 17 nt, Molluscum contagiosum virus
gccagcgucgcgcgccg

SEQ ID NO: 4041109 - RNA, 15 nt, Molluscum contagiosum virus
gccagcuccgcgcgg

SEQ ID NO: 4041110 - RNA, 17 nt, Molluscum contagiosum virus
gccagcucgacacugug

SEQ ID NO: 4041111 - RNA, 19 nt, Molluscum contagiosum virus
gccaggaaaacggaaacag

SEQ ID NO: 4041112 - RNA, 15 nt, Molluscum contagiosum virus
gccaggccgcgccgg

SEQ ID NO: 4041113 - RNA, 15 nt, Molluscum contagiosum virus
gccaggcgcggucgc

SEQ ID NO: 4041114 - RNA, 17 nt, Molluscum contagiosum virus
gcacugcuggcgcgcgc

SEQ ID NO: 4041115 - RNA, 16 nt, Molluscum contagiosum virus
gcacuggcgcgcacgc

SEQ ID NO: 4041116 - RNA, 20 nt, Molluscum contagiosum virus
gcacuucgcagacgacucgc

SEQ ID NO: 4041117 - RNA, 19 nt, Molluscum contagiosum virus
gcacuugccgggcgacggc

SEQ ID NO: 4041118 - RNA, 21 nt, Molluscum contagiosum virus
gcagacgacucgcugccagag

SEQ ID NO: 4041119 - RNA, 23 nt, Molluscum contagiosum virus
gcagacggucgacgacgcgcgca

SEQ ID NO: 4041120 - RNA, 17 nt, Molluscum contagiosum virus
gcagacguacgagcagg

SEQ ID NO: 4041121 - RNA, 21 nt, Molluscum contagiosum virus
gcagacguacgagcaggcgca

SEQ ID NO: 4041122 - RNA, 15 nt, Molluscum contagiosum virus
gcagacuaagaacgu

SEQ ID NO: 4041123 - RNA, 17 nt, Molluscum contagiosum virus
gcagaggacagcuccuu

SEQ ID NO: 4041124 - RNA, 19 nt, Molluscum contagiosum virus
gcagagugaaucuugccug

SEQ ID NO: 4041125 - RNA, 19 nt, Molluscum contagiosum virus
gcagauaguuuggacgagc

SEQ ID NO: 4041126 - RNA, 22 nt, Molluscum contagiosum virus
gcagcacaccgucgcguggugc

SEQ ID NO: 4041127 - RNA, 17 nt, Molluscum contagiosum virus
gcagcacggacaugagc

SEQ ID NO: 4041128 - RNA, 16 nt, Molluscum contagiosum virus
gcagcaggaugcuggu

SEQ ID NO: 4041129 - RNA, 21 nt, Molluscum contagiosum virus
gcagcaggugcacgugcugca

SEQ ID NO: 4041130 - RNA, 15 nt, Molluscum contagiosum virus
gcagcagugccagca

SEQ ID NO: 4041131 - RNA, 22 nt, Molluscum contagiosum virus
gcagcauuuuggugggcacgca

SEQ ID NO: 4041132 - RNA, 13 nt, Molluscum contagiosum virus
gcagcccaccagc

SEQ ID NO: 4041133 - RNA, 19 nt, Molluscum contagiosum virus
gcagccccgacgccagcgc

SEQ ID NO: 4041134 - RNA, 21 nt, Molluscum contagiosum virus
gcagccccguaggcgggccug

SEQ ID NO: 4041135 - RNA, 14 nt, Molluscum contagiosum virus
gcagcccuuccacg

SEQ ID NO: 4041136 - RNA, 16 nt, Molluscum contagiosum virus
gcagccgcagcccacg

SEQ ID NO: 4041137 - RNA, 20 nt, Molluscum contagiosum virus
gcagccgcagcccacgugcc

SEQ ID NO: 4041138 - RNA, 20 nt, Molluscum contagiosum virus
gcagccuccgguuuucgcgg

SEQ ID NO: 4041139 - RNA, 22 nt, Molluscum contagiosum virus
gcagcgcgacuagccugugccc

SEQ ID NO: 4041140 - RNA, 15 nt, Molluscum contagiosum virus
gcagcgcgcgcguag

SEQ ID NO: 4041141 - RNA, 23 nt, Molluscum contagiosum virus
gcagcgcgugacgcucacggccu

SEQ ID NO: 4041142 - RNA, 14 nt, Molluscum contagiosum virus
gcagcgcuugcgcg

SEQ ID NO: 4041143 - RNA, 22 nt, Molluscum contagiosum virus
gcagcggcgcgugcuccucgcg

SEQ ID NO: 4041144 - RNA, 23 nt, Molluscum contagiosum virus
gcagcgucgcggagcgcgcacgg

SEQ ID NO: 4041145 - RNA, 13 nt, Molluscum contagiosum virus
gcagcgugccgcg

SEQ ID NO: 4041146 - RNA, 13 nt, Molluscum contagiosum virus
gcagcgugcgcac

SEQ ID NO: 4041147 - RNA, 15 nt, Molluscum contagiosum virus
gcagcguuccaggaa

SEQ ID NO: 4041148 - RNA, 16 nt, Molluscum contagiosum virus
gcagcguuccaggaac

SEQ ID NO: 4041149 - RNA, 14 nt, Molluscum contagiosum virus
gcagcuaccgcgcg

SEQ ID NO: 4041150 - RNA, 15 nt, Molluscum contagiosum virus
gcagcucaagacgcu

SEQ ID NO: 4041151 - RNA, 22 nt, Molluscum contagiosum virus
gcagcucaagacgcugcuggcg

SEQ ID NO: 4041152 - RNA, 15 nt, Molluscum contagiosum virus
gcagcucuuccacga

SEQ ID NO: 4041153 - RNA, 13 nt, Molluscum contagiosum virus
gcagcugccgcag

SEQ ID NO: 4041154 - RNA, 13 nt, Molluscum contagiosum virus
gcagcuggagcug

SEQ ID NO: 4041155 - RNA, 16 nt, Molluscum contagiosum virus
gcagcuggcgcgcgcc

SEQ ID NO: 4041156 - RNA, 18 nt, Molluscum contagiosum virus
gcagcuguuucugccgcg

SEQ ID NO: 4041157 - RNA, 19 nt, Molluscum contagiosum virus
gcagcuucuuggagcccuu

SEQ ID NO: 4041158 - RNA, 16 nt, Molluscum contagiosum virus
gcaggaaaggcacccc

SEQ ID NO: 4041159 - RNA, 22 nt, Molluscum contagiosum virus
gcaggaaaggcaccccgcagga

SEQ ID NO: 4041160 - RNA, 21 nt, Molluscum contagiosum virus
gcaggaaaggcacccgcagga

SEQ ID NO: 4041161 - RNA, 20 nt, Molluscum contagiosum virus
gcaggaaagguacccgcagg

SEQ ID NO: 4041162 - RNA, 17 nt, Molluscum contagiosum virus
gcaggacgacgacacag

SEQ ID NO: 4041163 - RNA, 15 nt, Molluscum contagiosum virus
gcaggcgcagcgcgg

SEQ ID NO: 4041164 - RNA, 19 nt, Molluscum contagiosum virus
gcaggcggugggcgccgcg

SEQ ID NO: 4041165 - RNA, 18 nt, Molluscum contagiosum virus
gcaggcgugcucagcacc

SEQ ID NO: 4041166 - RNA, 12 nt, Molluscum contagiosum virus
gcaggcucuggc

SEQ ID NO: 4041167 - RNA, 23 nt, Molluscum contagiosum virus
gcaggucaacuccgagcgcgcgc

SEQ ID NO: 4041168 - RNA, 17 nt, Molluscum contagiosum virus
gcagguggccgcgcgcg

SEQ ID NO: 4041169 - RNA, 19 nt, Molluscum contagiosum virus
gcagguuugcacccgcgca

SEQ ID NO: 4041170 - RNA, 18 nt, Molluscum contagiosum virus
gcaguagcagcgccggca

SEQ ID NO: 4041171 - RNA, 19 nt, Molluscum contagiosum virus
gcagucacggucuugccga

SEQ ID NO: 4041172 - RNA, 14 nt, Molluscum contagiosum virus
gcagucccagcacc

SEQ ID NO: 4041173 - RNA, 21 nt, Molluscum contagiosum virus
gcagucccagcaccgcgccgc

SEQ ID NO: 4041174 - RNA, 14 nt, Molluscum contagiosum virus
gcagugccagcagc

SEQ ID NO: 4041175 - RNA, 12 nt, Molluscum contagiosum virus
gcagugcuugcu

SEQ ID NO: 4041176 - RNA, 22 nt, Molluscum contagiosum virus
gcaucagagaagugcuccgcac

SEQ ID NO: 4041177 - RNA, 16 nt, Molluscum contagiosum virus
gcauccggcacgcaca

SEQ ID NO: 4041178 - RNA, 18 nt, Molluscum contagiosum virus
gcauccucgccgaacggc

SEQ ID NO: 4041179 - RNA, 13 nt, Molluscum contagiosum virus
gcaucgucucgcu

SEQ ID NO: 4041180 - RNA, 20 nt, Molluscum contagiosum virus
gcaucugcgcgugcugucag

SEQ ID NO: 4041181 - RNA, 15 nt, Molluscum contagiosum virus
gcauggcgcgcucgc

SEQ ID NO: 4041182 - RNA, 14 nt, Molluscum contagiosum virus
gcaugucgcggugc

SEQ ID NO: 4041183 - RNA, 14 nt, Molluscum contagiosum virus
gcaugugcgagcgc

SEQ ID NO: 4041184 - RNA, 19 nt, Molluscum contagiosum virus
gcauuaaacaacacgcgcg

SEQ ID NO: 4041185 - RNA, 17 nt, Molluscum contagiosum virus
gcauucucggacagugc

SEQ ID NO: 4041186 - RNA, 14 nt, Molluscum contagiosum virus
gcaaugggcacgcu

SEQ ID NO: 4041187 - RNA, 18 nt, Molluscum contagiosum virus
gcacaaacacgcgcgcgc

SEQ ID NO: 4041188 - RNA, 16 nt, Molluscum contagiosum virus
gcacaacaagaagacg

SEQ ID NO: 4041189 - RNA, 22 nt, Molluscum contagiosum virus
gcacaacgggcucgugcuggag

SEQ ID NO: 4041190 - RNA, 16 nt, Molluscum contagiosum virus
gcacaagauggcgcag

SEQ ID NO: 4041191 - RNA, 15 nt, Molluscum contagiosum virus
gcacaagggcagcuc

SEQ ID NO: 4041192 - RNA, 17 nt, Molluscum contagiosum virus
gcacaagggcagcucaa

SEQ ID NO: 4041193 - RNA, 22 nt, Molluscum contagiosum virus
gcacaagggcagcucaagcugc

SEQ ID NO: 4041194 - RNA, 10 nt, Molluscum contagiosum virus
gcacaccccu

SEQ ID NO: 4041195 - RNA, 12 nt, Molluscum contagiosum virus
gcacaccggcgc

SEQ ID NO: 4041196 - RNA, 22 nt, Molluscum contagiosum virus
gcacacgagugcccgcgcgcug

SEQ ID NO: 4041197 - RNA, 22 nt, Molluscum contagiosum virus
gcacacgcaccgccuggugcug

SEQ ID NO: 4041198 - RNA, 13 nt, Molluscum contagiosum virus
gcacacgcgcgcg

SEQ ID NO: 4041199 - RNA, 21 nt, Molluscum contagiosum virus
gcacacgcgcgcgugcugcug

SEQ ID NO: 4041200 - RNA, 13 nt, Molluscum contagiosum virus
gcacacgcgucgc

SEQ ID NO: 4041201 - RNA, 23 nt, Molluscum contagiosum virus
gcacacugcagcacgucuugcgc

SEQ ID NO: 4041202 - RNA, 15 nt, Molluscum contagiosum virus
gcacagaaagccaac

SEQ ID NO: 4041203 - RNA, 21 nt, Molluscum contagiosum virus
gcacagacauggcccgcgcgg

SEQ ID NO: 4041204 - RNA, 18 nt, Molluscum contagiosum virus
gcacagcacaggccccag

SEQ ID NO: 4041205 - RNA, 20 nt, Molluscum contagiosum virus
gcacagcacaggccccagca

SEQ ID NO: 4041206 - RNA, 19 nt, Molluscum contagiosum virus
gcacaguccaacccgcggc

SEQ ID NO: 4041207 - RNA, 17 nt, Molluscum contagiosum virus
gcacaguccagcccgcg

SEQ ID NO: 4041208 - RNA, 23 nt, Molluscum contagiosum virus
gcacaguccagcccgcggugcgc

SEQ ID NO: 4041209 - RNA, 20 nt, Molluscum contagiosum virus
gcacaguucacggcgcucgc

SEQ ID NO: 4041210 - RNA, 18 nt, Molluscum contagiosum virus
gcacaucucucagggcag

SEQ ID NO: 4041211 - RNA, 15 nt, Molluscum contagiosum virus
gcacaugcagcugca

SEQ ID NO: 4041212 - RNA, 15 nt, Molluscum contagiosum virus
gcacauucucaacca

SEQ ID NO: 4041213 - RNA, 13 nt, Molluscum contagiosum virus
gcaccaccagugc

SEQ ID NO: 4041214 - RNA, 15 nt, Molluscum contagiosum virus
gcaccacgugcgcug

SEQ ID NO: 4041215 - RNA, 14 nt, Molluscum contagiosum virus
gcaccagcgcgcag

SEQ ID NO: 4041216 - RNA, 15 nt, Molluscum contagiosum virus
gcaccagcgcgcaga

SEQ ID NO: 4041217 - RNA, 22 nt, Molluscum contagiosum virus
gcaccagucucgaugugacaac

SEQ ID NO: 4041218 - RNA, 15 nt, Molluscum contagiosum virus
gcacccgcaggaaag

SEQ ID NO: 4041219 - RNA, 16 nt, Molluscum contagiosum virus
gcacccgcgcagcgug

SEQ ID NO: 4041220 - RNA, 14 nt, Molluscum contagiosum virus
gcaccgagcccgcc

SEQ ID NO: 4041221 - RNA, 15 nt, Molluscum contagiosum virus
gcaccgcaugggccc

SEQ ID NO: 4041222 - RNA, 21 nt, Molluscum contagiosum virus
gcaccgcccgcccgcgcucga

SEQ ID NO: 4041223 - RNA, 16 nt, Molluscum contagiosum virus
gcaccgccgacaacgc

SEQ ID NO: 4041224 - RNA, 18 nt, Molluscum contagiosum virus
gcaccgcgccccacugug

SEQ ID NO: 4041225 - RNA, 21 nt, Molluscum contagiosum virus
gcaccggaagcaacgacaagg

SEQ ID NO: 4041226 - RNA, 14 nt, Molluscum contagiosum virus
gcaccggcgcucac

SEQ ID NO: 4041227 - RNA, 14 nt, Molluscum contagiosum virus
gcaccgggcgccgc

SEQ ID NO: 4041228 - RNA, 18 nt, Molluscum contagiosum virus
gcaccguaccgcgcccgc

SEQ ID NO: 4041229 - RNA, 22 nt, Molluscum contagiosum virus
gcaccguacucgcguccgcgca

SEQ ID NO: 4041230 - RNA, 15 nt, Molluscum contagiosum virus
gcaccuggaacgcga

SEQ ID NO: 4041231 - RNA, 18 nt, Molluscum contagiosum virus
gcacgaagcuacgcuccg

SEQ ID NO: 4041232 - RNA, 19 nt, Molluscum contagiosum virus
gcacgaccacgugcaggau

SEQ ID NO: 4041233 - RNA, 22 nt, Molluscum contagiosum virus
gcacgacccucuucgacuuacg

SEQ ID NO: 4041234 - RNA, 23 nt, Molluscum contagiosum virus
gcacgagaugggcccgcgcgcgc

SEQ ID NO: 4041235 - RNA, 13 nt, Molluscum contagiosum virus
gcacgagcugcug

SEQ ID NO: 4041236 - RNA, 17 nt, Molluscum contagiosum virus
gcacgagcugcugcccg

SEQ ID NO: 4041237 - RNA, 14 nt, Molluscum contagiosum virus
gcacgaggagcccc

SEQ ID NO: 4041238 - RNA, 22 nt, Molluscum contagiosum virus
gcacgaggcagccgcggcgccc

SEQ ID NO: 4041239 - RNA, 20 nt, Molluscum contagiosum virus
gcacgauggggcgcucgggc

SEQ ID NO: 4041240 - RNA, 21 nt, Molluscum contagiosum virus
gcacgauggggcgcucgggca

SEQ ID NO: 4041241 - RNA, 13 nt, Molluscum contagiosum virus
gcacgcacgcgcu

SEQ ID NO: 4041242 - RNA, 11 nt, Molluscum contagiosum virus
gcacgcacggc

SEQ ID NO: 4041243 - RNA, 15 nt, Molluscum contagiosum virus
gcacgcacguggcgc

SEQ ID NO: 4041244 - RNA, 20 nt, Molluscum contagiosum virus
gcacgccagguguuccugcc

SEQ ID NO: 4041245 - RNA, 23 nt, Molluscum contagiosum virus
gcacgccgccagcgacgagcagc

SEQ ID NO: 4041246 - RNA, 18 nt, Molluscum contagiosum virus
gcacgccgcucggcacug

SEQ ID NO: 4041247 - RNA, 18 nt, Molluscum contagiosum virus
gcacgcgaaguuccugca

SEQ ID NO: 4041248 - RNA, 23 nt, Molluscum contagiosum virus
gcacgcgaugagcgucucggugc

SEQ ID NO: 4041249 - RNA, 13 nt, Molluscum contagiosum virus
gcacgcgcacggg

SEQ ID NO: 4041250 - RNA, 19 nt, Molluscum contagiosum virus
gcacgcgcacuugccuggc

SEQ ID NO: 4041251 - RNA, 22 nt, Molluscum contagiosum virus
cucuccuacacauuccucggcg

SEQ ID NO: 4041252 - RNA, 21 nt, Molluscum contagiosum virus
cucucgaagcagugcucggga

SEQ ID NO: 4041253 - RNA, 18 nt, Molluscum contagiosum virus
cucugauuacauccugcc

SEQ ID NO: 4041254 - RNA, 16 nt, Molluscum contagiosum virus
cucugcacgggcacgc

SEQ ID NO: 4041255 - RNA, 18 nt, Molluscum contagiosum virus
cucugccaccgcggcgcg

SEQ ID NO: 4041256 - RNA, 13 nt, Molluscum contagiosum virus
cucugcccucaga

SEQ ID NO: 4041257 - RNA, 17 nt, Molluscum contagiosum virus
cucugccggcgcaaucu

SEQ ID NO: 4041258 - RNA, 14 nt, Molluscum contagiosum virus
cucugcgccgcgcg

SEQ ID NO: 4041259 - RNA, 16 nt, Molluscum contagiosum virus
cucugcuccgcggagg

SEQ ID NO: 4041260 - RNA, 17 nt, Molluscum contagiosum virus
cucuggagccucccccg

SEQ ID NO: 4041261 - RNA, 20 nt, Molluscum contagiosum virus
cucuguagcaucugcgacac

SEQ ID NO: 4041262 - RNA, 17 nt, Molluscum contagiosum virus
cucuucccguuccuggg

SEQ ID NO: 4041263 - RNA, 13 nt, Molluscum contagiosum virus
cucuucggcgucc

SEQ ID NO: 4041264 - RNA, 16 nt, Molluscum contagiosum virus
cucuucggggacggcg

SEQ ID NO: 4041265 - RNA, 15 nt, Molluscum contagiosum virus
cugaaaauagagagu

SEQ ID NO: 4041266 - RNA, 14 nt, Molluscum contagiosum virus
cugaacaagcugca

SEQ ID NO: 4041267 - RNA, 21 nt, Molluscum contagiosum virus
cugacagcguguucggggccg

SEQ ID NO: 4041268 - RNA, 23 nt, Molluscum contagiosum virus
cugacagcguguucggggccgcg

SEQ ID NO: 4041269 - RNA, 23 nt, Molluscum contagiosum virus
cugagaggaccucccggcggcaa

SEQ ID NO: 4041270 - RNA, 17 nt, Molluscum contagiosum virus
cugagccgcaagcacac

SEQ ID NO: 4041271 - RNA, 12 nt, Molluscum contagiosum virus
cugagcgcagca

SEQ ID NO: 4041272 - RNA, 13 nt, Molluscum contagiosum virus
cugagcgcgcugc

SEQ ID NO: 4041273 - RNA, 15 nt, Molluscum contagiosum virus
cugcaaagcgcggcc

SEQ ID NO: 4041274 - RNA, 15 nt, Molluscum contagiosum virus
cugcaacucgcgcug

SEQ ID NO: 4041275 - RNA, 20 nt, Molluscum contagiosum virus
cugcaacucgcgcugcagca

SEQ ID NO: 4041276 - RNA, 14 nt, Molluscum contagiosum virus
cugcacaguucacg

SEQ ID NO: 4041277 - RNA, 21 nt, Molluscum contagiosum virus
cugcacgaccgcggacuccuu

SEQ ID NO: 4041278 - RNA, 13 nt, Molluscum contagiosum virus
cugcacgccgcca

SEQ ID NO: 4041279 - RNA, 20 nt, Molluscum contagiosum virus
cugcacgcgaauguccggcg

SEQ ID NO: 4041280 - RNA, 18 nt, Molluscum contagiosum virus
cugcacgugcagcggcgc

SEQ ID NO: 4041281 - RNA, 22 nt, Molluscum contagiosum virus
cugcagaaacagccgugcuccg

SEQ ID NO: 4041282 - RNA, 22 nt, Molluscum contagiosum virus
cugcagcagccccgacgccagc

SEQ ID NO: 4041283 - RNA, 17 nt, Molluscum contagiosum virus
cugcagcagcuccagca

SEQ ID NO: 4041284 - RNA, 16 nt, Molluscum contagiosum virus
cugcagcagcuccucc

SEQ ID NO: 4041285 - RNA, 13 nt, Molluscum contagiosum virus
cugcagcagcugg

SEQ ID NO: 4041286 - RNA, 14 nt, Molluscum contagiosum virus
cugcagcagcuggc

SEQ ID NO: 4041287 - RNA, 15 nt, Molluscum contagiosum virus
cugcagcagcuggcc

SEQ ID NO: 4041288 - RNA, 14 nt, Molluscum contagiosum virus
cugcagcccuucca

SEQ ID NO: 4041289 - RNA, 13 nt, Molluscum contagiosum virus
cugcaggaccugc

SEQ ID NO: 4041290 - RNA, 14 nt, Molluscum contagiosum virus
cugcaggaccugcu

SEQ ID NO: 4041291 - RNA, 21 nt, Molluscum contagiosum virus
cugcaggcaaagcggggcgcg

SEQ ID NO: 4041292 - RNA, 21 nt, Molluscum contagiosum virus
cugccagccaucgugcgcgac

SEQ ID NO: 4041293 - RNA, 16 nt, Molluscum contagiosum virus
cugcccgcgcacgagc

SEQ ID NO: 4041294 - RNA, 18 nt, Molluscum contagiosum virus
cugcccguggugggccgc

SEQ ID NO: 4041295 - RNA, 17 nt, Molluscum contagiosum virus
cugcccgugugcgggca

SEQ ID NO: 4041296 - RNA, 12 nt, Molluscum contagiosum virus
cugcccucggga

SEQ ID NO: 4041297 - RNA, 22 nt, Molluscum contagiosum virus
cugccgcccgcgcccgcgccgc

SEQ ID NO: 4041298 - RNA, 22 nt, Molluscum contagiosum virus
cugccgccgccgcgaggacccg

SEQ ID NO: 4041299 - RNA, 18 nt, Molluscum contagiosum virus
cugccgcgagcacuggcu

SEQ ID NO: 4041300 - RNA, 19 nt, Molluscum contagiosum virus
cugccgcgagcacuggcug

SEQ ID NO: 4041301 - RNA, 19 nt, Molluscum contagiosum virus
cugccgcgcaugcuggaga

SEQ ID NO: 4041302 - RNA, 21 nt, Molluscum contagiosum virus
cugccgcgccuccgagcgcgc

SEQ ID NO: 4041303 - RNA, 16 nt, Molluscum contagiosum virus
cugccgcgcgcgccgc

SEQ ID NO: 4041304 - RNA, 19 nt, Molluscum contagiosum virus
cugccguuuuacacagggc

SEQ ID NO: 4041305 - RNA, 14 nt, Molluscum contagiosum virus
cugccucgugccuu

SEQ ID NO: 4041306 - RNA, 14 nt, Molluscum contagiosum virus
cugccucguggaac

SEQ ID NO: 4041307 - RNA, 19 nt, Molluscum contagiosum virus
cugcgacagcugcugcucg

SEQ ID NO: 4041308 - RNA, 21 nt, Molluscum contagiosum virus
cugcgauacccuuggcagcaa

SEQ ID NO: 4041309 - RNA, 15 nt, Molluscum contagiosum virus
cugcgaucgcagcag

SEQ ID NO: 4041310 - RNA, 15 nt, Molluscum contagiosum virus
cugcgaucgcgggca

SEQ ID NO: 4041311 - RNA, 21 nt, Molluscum contagiosum virus
cugcgaucgcgggcacgagca

SEQ ID NO: 4041312 - RNA, 17 nt, Molluscum contagiosum virus
cugcgcaccugcacgac

SEQ ID NO: 4041313 - RNA, 22 nt, Molluscum contagiosum virus
cugcgccacgugcgcaucccug

SEQ ID NO: 4041314 - RNA, 14 nt, Molluscum contagiosum virus
cugcgcccgcggag

SEQ ID NO: 4041315 - RNA, 19 nt, Molluscum contagiosum virus
cugcgccgccucaugcgcg

SEQ ID NO: 4041316 - RNA, 18 nt, Molluscum contagiosum virus
cugcgccgccugcucucg

SEQ ID NO: 4041317 - RNA, 16 nt, Molluscum contagiosum virus
cugcgccgcuuccugg

SEQ ID NO: 4041318 - RNA, 18 nt, Molluscum contagiosum virus
cugcgcgagacgcugcug

SEQ ID NO: 4041319 - RNA, 16 nt, Molluscum contagiosum virus
cugcgcgagccgcugc

SEQ ID NO: 4041320 - RNA, 14 nt, Molluscum contagiosum virus
cugcgcgcgccaug

SEQ ID NO: 4041321 - RNA, 22 nt, Molluscum contagiosum virus
cugcgcgcgcuacugcgcgcac

SEQ ID NO: 4041322 - RNA, 15 nt, Molluscum contagiosum virus
cugcgcgcggacuuc

SEQ ID NO: 4041323 - RNA, 21 nt, Molluscum contagiosum virus
cugcgcuggaugcugcucgac

SEQ ID NO: 4041324 - RNA, 16 nt, Molluscum contagiosum virus
cugcgcuucgagcugc

SEQ ID NO: 4041325 - RNA, 17 nt, Molluscum contagiosum virus
cugcgcuucgccgcgcg

SEQ ID NO: 4041326 - RNA, 17 nt, Molluscum contagiosum virus
cugcggacgcgggccgc

SEQ ID NO: 4041327 - RNA, 20 nt, Molluscum contagiosum virus
cugcggcaaccgcgcccgcg

SEQ ID NO: 4041328 - RNA, 13 nt, Molluscum contagiosum virus
cugcggcucgcac

SEQ ID NO: 4041329 - RNA, 14 nt, Molluscum contagiosum virus
cugcggcugcugga

SEQ ID NO: 4041330 - RNA, 13 nt, Molluscum contagiosum virus
cugcgggcugccg

SEQ ID NO: 4041331 - RNA, 13 nt, Molluscum contagiosum virus
cugcggugucaac

SEQ ID NO: 4041332 - RNA, 22 nt, Molluscum contagiosum virus
cugcguaagcgccugcacacgc

SEQ ID NO: 4041333 - RNA, 23 nt, Molluscum contagiosum virus
cugcgugcgauugccccugggcu

SEQ ID NO: 4041334 - RNA, 17 nt, Molluscum contagiosum virus
cugcgugcuugugcgcc

SEQ ID NO: 4041335 - RNA, 16 nt, Molluscum contagiosum virus
cugcguugcgcgucau

SEQ ID NO: 4041336 - RNA, 13 nt, Molluscum contagiosum virus
cugcguugucucc

SEQ ID NO: 4041337 - RNA, 21 nt, Molluscum contagiosum virus
cugcucgacgggcgcagccac

SEQ ID NO: 4041338 - RNA, 21 nt, Molluscum contagiosum virus
cugcucgugcccgcacacgca

SEQ ID NO: 4041339 - RNA, 15 nt, Molluscum contagiosum virus
cugcucgugcugcuc

SEQ ID NO: 4041340 - RNA, 17 nt, Molluscum contagiosum virus
cugcucucgcgcgccag

SEQ ID NO: 4041341 - RNA, 21 nt, Molluscum contagiosum virus
cugcugcagaacugccugguc

SEQ ID NO: 4041342 - RNA, 22 nt, Molluscum contagiosum virus
cugcugcccauacucgaacgca

SEQ ID NO: 4041343 - RNA, 16 nt, Molluscum contagiosum virus
cugcugccgcgcggca

SEQ ID NO: 4041344 - RNA, 14 nt, Molluscum contagiosum virus
cugcugcgcgccgc

SEQ ID NO: 4041345 - RNA, 22 nt, Molluscum contagiosum virus
cugcugcgcgccgccgacgccu

SEQ ID NO: 4041346 - RNA, 16 nt, Molluscum contagiosum virus
cugcugcgcgcgccau

SEQ ID NO: 4041347 - RNA, 14 nt, Molluscum contagiosum virus
cugcugcucgaagc

SEQ ID NO: 4041348 - RNA, 16 nt, Molluscum contagiosum virus
cugcugcucgcggagg

SEQ ID NO: 4041349 - RNA, 15 nt, Molluscum contagiosum virus
cugcugcugcaaagc

SEQ ID NO: 4041350 - RNA, 14 nt, Molluscum contagiosum virus
cugcuggcagacac

SEQ ID NO: 4041351 - RNA, 15 nt, Molluscum contagiosum virus
cugcuggcagacaca

SEQ ID NO: 4041352 - RNA, 21 nt, Molluscum contagiosum virus
cugcuggccaacccucgcaag

SEQ ID NO: 4041353 - RNA, 15 nt, Molluscum contagiosum virus
cugcuggcgcgcgcg

SEQ ID NO: 4041354 - RNA, 15 nt, Molluscum contagiosum virus
cugcuggugcucgcc

SEQ ID NO: 4041355 - RNA, 14 nt, Molluscum contagiosum virus
cgcacgugcugcgc

SEQ ID NO: 4041356 - RNA, 20 nt, Molluscum contagiosum virus
cgcacguggaaucacggcca

SEQ ID NO: 4041357 - RNA, 15 nt, Molluscum contagiosum virus
cgcagagccagcgcg

SEQ ID NO: 4041358 - RNA, 15 nt, Molluscum contagiosum virus
cgcagaucaggagca

SEQ ID NO: 4041359 - RNA, 22 nt, Molluscum contagiosum virus
cgcagcaaagggcggccgcagc

SEQ ID NO: 4041360 - RNA, 20 nt, Molluscum contagiosum virus
cgcagcaggugcacgugcug

SEQ ID NO: 4041361 - RNA, 13 nt, Molluscum contagiosum virus
cgcagcagugcca

SEQ ID NO: 4041362 - RNA, 21 nt, Molluscum contagiosum virus
cgcagcagugccagcagccgc

SEQ ID NO: 4041363 - RNA, 22 nt, Molluscum contagiosum virus
cgcagcccacgugccagcucau

SEQ ID NO: 4041364 - RNA, 17 nt, Molluscum contagiosum virus
cgcagccuccgugcgcc

SEQ ID NO: 4041365 - RNA, 21 nt, Molluscum contagiosum virus
cgcagccuccgugcgccaguc

SEQ ID NO: 4041366 - RNA, 13 nt, Molluscum contagiosum virus
cgcagcgcgagcu

SEQ ID NO: 4041367 - RNA, 13 nt, Molluscum contagiosum virus
cgcagcgcgcggu

SEQ ID NO: 4041368 - RNA, 23 nt, Molluscum contagiosum virus
cgcagcgcuggagcuggcugggc

SEQ ID NO: 4041369 - RNA, 14 nt, Molluscum contagiosum virus
cgcagcggcgccac

SEQ ID NO: 4041370 - RNA, 13 nt, Molluscum contagiosum virus
cgcagcgugccgc

SEQ ID NO: 4041371 - RNA, 21 nt, Molluscum contagiosum virus
cgcagcucgccgcgcgccgcu

SEQ ID NO: 4041372 - RNA, 19 nt, Molluscum contagiosum virus
cgcaggaaagguacccgca

SEQ ID NO: 4041373 - RNA, 20 nt, Molluscum contagiosum virus
cgcaggaaaggucgggcccg

SEQ ID NO: 4041374 - RNA, 13 nt, Molluscum contagiosum virus
cgcaggagcaguc

SEQ ID NO: 4041375 - RNA, 23 nt, Molluscum contagiosum virus
cgcaggccgggcacccagcccug

SEQ ID NO: 4041376 - RNA, 17 nt, Molluscum contagiosum virus
cgcaggcgucaugcgcg

SEQ ID NO: 4041377 - RNA, 14 nt, Molluscum contagiosum virus
cgcagugcucgcac

SEQ ID NO: 4041378 - RNA, 22 nt, Molluscum contagiosum virus
cgcaucccccgcguuguccgcg

SEQ ID NO: 4041379 - RNA, 19 nt, Molluscum contagiosum virus
cgcaugaaaggcaccugcg

SEQ ID NO: 4041380 - RNA, 23 nt, Molluscum contagiosum virus
cgcaugaaaggcaccugcggcuc

SEQ ID NO: 4041381 - RNA, 22 nt, Molluscum contagiosum virus
cgcaugcgcgguccuguccgcg

SEQ ID NO: 4041382 - RNA, 13 nt, Molluscum contagiosum virus
cgcaugcuggaga

SEQ ID NO: 4041383 - RNA, 22 nt, Molluscum contagiosum virus
cgcauggccacgcccgggcccg

SEQ ID NO: 4041384 - RNA, 23 nt, Molluscum contagiosum virus
cgcaugguggcgauccuguccau

SEQ ID NO: 4041385 - RNA, 14 nt, Molluscum contagiosum virus
cgccaaccgcgagc

SEQ ID NO: 4041386 - RNA, 12 nt, Molluscum contagiosum virus
cgccaacuccuu

SEQ ID NO: 4041387 - RNA, 21 nt, Molluscum contagiosum virus
cgccaauaucacgccgguggc

SEQ ID NO: 4041388 - RNA, 18 nt, Molluscum contagiosum virus
cgccaccucggcguuggc

SEQ ID NO: 4041389 - RNA, 14 nt, Molluscum contagiosum virus
cgccacugccacgg

SEQ ID NO: 4041390 - RNA, 18 nt, Molluscum contagiosum virus
cgccacugccacggcugc

SEQ ID NO: 4041391 - RNA, 16 nt, Molluscum contagiosum virus
cgccacuggaagaaca

SEQ ID NO: 4041392 - RNA, 22 nt, Molluscum contagiosum virus
cgccacuggaagaacaggccgc

SEQ ID NO: 4041393 - RNA, 23 nt, Molluscum contagiosum virus
cgccagccuggaguacucgaagu

SEQ ID NO: 4041394 - RNA, 17 nt, Molluscum contagiosum virus
cgccagccugugcgcca

SEQ ID NO: 4041395 - RNA, 15 nt, Molluscum contagiosum virus
cgccagcgcgcccac

SEQ ID NO: 4041396 - RNA, 20 nt, Molluscum contagiosum virus
cgccagcgcgcccaccagca

SEQ ID NO: 4041397 - RNA, 18 nt, Molluscum contagiosum virus
cgccagcuaagccggagc

SEQ ID NO: 4041398 - RNA, 19 nt, Molluscum contagiosum virus
cgccagcuccgcgcggcgc

SEQ ID NO: 4041399 - RNA, 22 nt, Molluscum contagiosum virus
cgccaggaaaggcaggagccuc

SEQ ID NO: 4041400 - RNA, 20 nt, Molluscum contagiosum virus
cgccagggcggagccccgag

SEQ ID NO: 4041401 - RNA, 18 nt, Molluscum contagiosum virus
cgccaguacgcaugcgcg

SEQ ID NO: 4041402 - RNA, 15 nt, Molluscum contagiosum virus
cgccagugcuuuguc

SEQ ID NO: 4041403 - RNA, 23 nt, Molluscum contagiosum virus
cgccaguggccagcgcgcggcgc

SEQ ID NO: 4041404 - RNA, 16 nt, Molluscum contagiosum virus
cgccaugccaacgcac

SEQ ID NO: 4041405 - RNA, 15 nt, Molluscum contagiosum virus
cgccaugcugcgcga

SEQ ID NO: 4041406 - RNA, 19 nt, Molluscum contagiosum virus
cgccauuuucgugcgcguc

SEQ ID NO: 4041407 - RNA, 18 nt, Molluscum contagiosum virus
cgcccaccagcagccagg

SEQ ID NO: 4041408 - RNA, 12 nt, Molluscum contagiosum virus
cgccccuucccg

SEQ ID NO: 4041409 - RNA, 20 nt, Molluscum contagiosum virus
cgcccgcgaaaaacgugacu

SEQ ID NO: 4041410 - RNA, 14 nt, Molluscum contagiosum virus
cgcccgcgcccgcg

SEQ ID NO: 4041411 - RNA, 17 nt, Molluscum contagiosum virus
cgcccgcgcccgcgccg

SEQ ID NO: 4041412 - RNA, 13 nt, Molluscum contagiosum virus
cgcccgcugcucu

SEQ ID NO: 4041413 - RNA, 16 nt, Molluscum contagiosum virus
cgcccguaaagaagcg

SEQ ID NO: 4041414 - RNA, 17 nt, Molluscum contagiosum virus
cgcccgugcucgcgggc

SEQ ID NO: 4041415 - RNA, 18 nt, Molluscum contagiosum virus
cgcccguguucgcggagc

SEQ ID NO: 4041416 - RNA, 16 nt, Molluscum contagiosum virus
cgcccucgcgccugac

SEQ ID NO: 4041417 - RNA, 16 nt, Molluscum contagiosum virus
cgcccuggagcgcagu

SEQ ID NO: 4041418 - RNA, 13 nt, Molluscum contagiosum virus
cgccgaaguacuu

SEQ ID NO: 4041419 - RNA, 16 nt, Molluscum contagiosum virus
cgccgacgugcgcgug

SEQ ID NO: 4041420 - RNA, 14 nt, Molluscum contagiosum virus
cgccgacugccgcc

SEQ ID NO: 4041421 - RNA, 13 nt, Molluscum contagiosum virus
cgccgagcccgag

SEQ ID NO: 4041422 - RNA, 23 nt, Molluscum contagiosum virus
cgccgaucuccacgucgaucagc

SEQ ID NO: 4041423 - RNA, 13 nt, Molluscum contagiosum virus
cgccgaugcagug

SEQ ID NO: 4041424 - RNA, 17 nt, Molluscum contagiosum virus
cgccgauguccugcgga

SEQ ID NO: 4041425 - RNA, 16 nt, Molluscum contagiosum virus
cgccgcacgugcugcg

SEQ ID NO: 4041426 - RNA, 14 nt, Molluscum contagiosum virus
cgccgccagcuccg

SEQ ID NO: 4041427 - RNA, 13 nt, Molluscum contagiosum virus
cgccgccaugcug

SEQ ID NO: 4041428 - RNA, 19 nt, Molluscum contagiosum virus
cgccgccaugcugcgcgag

SEQ ID NO: 4041429 - RNA, 12 nt, Molluscum contagiosum virus
cgccgcgcggcu

SEQ ID NO: 4041430 - RNA, 18 nt, Molluscum contagiosum virus
cgccgcguacaugcgugc

SEQ ID NO: 4041431 - RNA, 14 nt, Molluscum contagiosum virus
cgccgcgugcccgu

SEQ ID NO: 4041432 - RNA, 13 nt, Molluscum contagiosum virus
cgccgcuggagca

SEQ ID NO: 4041433 - RNA, 17 nt, Molluscum contagiosum virus
cgccggacagcucagca

SEQ ID NO: 4041434 - RNA, 19 nt, Molluscum contagiosum virus
cgccggccuuguucgcgcu

SEQ ID NO: 4041435 - RNA, 17 nt, Molluscum contagiosum virus
cgccggggcccaugcuc

SEQ ID NO: 4041436 - RNA, 12 nt, Molluscum contagiosum virus
cgccggugcgug

SEQ ID NO: 4041437 - RNA, 14 nt, Molluscum contagiosum virus
cgccgguuugcuaa

SEQ ID NO: 4041438 - RNA, 23 nt, Molluscum contagiosum virus
cgccguccaugugcccgcggcgc

SEQ ID NO: 4041439 - RNA, 17 nt, Molluscum contagiosum virus
cgccgucggccucgggc

SEQ ID NO: 4041440 - RNA, 19 nt, Molluscum contagiosum virus
cgccgucgucgccgccguc

SEQ ID NO: 4041441 - RNA, 21 nt, Molluscum contagiosum virus
cgccguuccacuacaagcagc

SEQ ID NO: 4041442 - RNA, 20 nt, Molluscum contagiosum virus
cgccguuggccaccuggaaa

SEQ ID NO: 4041443 - RNA, 21 nt, Molluscum contagiosum virus
cgccuaccaccgggcacuucu

SEQ ID NO: 4041444 - RNA, 18 nt, Molluscum contagiosum virus
cgccuccgagcgcgcgug

SEQ ID NO: 4041445 - RNA, 14 nt, Molluscum contagiosum virus
cgccuccgggcgca

SEQ ID NO: 4041446 - RNA, 17 nt, Molluscum contagiosum virus
cgccucgagcacgccuc

SEQ ID NO: 4041447 - RNA, 15 nt, Molluscum contagiosum virus
cgccucgagcgcgcu

SEQ ID NO: 4041448 - RNA, 18 nt, Molluscum contagiosum virus
cgccugcuagcggccugu

SEQ ID NO: 4041449 - RNA, 22 nt, Molluscum contagiosum virus
cgccugcucucgcgcgccagca

SEQ ID NO: 4041450 - RNA, 12 nt, Molluscum contagiosum virus
cgcgcgccgcgc

SEQ ID NO: 4041451 - RNA, 17 nt, Molluscum contagiosum virus
cgcgcgccuugcagcgc

SEQ ID NO: 4041452 - RNA, 20 nt, Molluscum contagiosum virus
cgcgcgccuugcagcgcagc

SEQ ID NO: 4041453 - RNA, 15 nt, Molluscum contagiosum virus
cgcgcgcgagcacgu

SEQ ID NO: 4041454 - RNA, 13 nt, Molluscum contagiosum virus
cgcgcgcgcacgc

SEQ ID NO: 4041455 - RNA, 12 nt, Molluscum contagiosum virus
cgcgcgcgccgg

SEQ ID NO: 4041456 - RNA, 14 nt, Molluscum contagiosum virus
cgcgcgcgccucgc

SEQ ID NO: 4041457 - RNA, 13 nt, Molluscum contagiosum virus
cgcgcgcgcggcg

SEQ ID NO: 4041458 - RNA, 14 nt, Molluscum contagiosum virus
cgcgcgcgcggcgc

SEQ ID NO: 4041459 - RNA, 14 nt, Molluscum contagiosum virus
cgcgcgcgcugcug

SEQ ID NO: 4041460 - RNA, 12 nt, Molluscum contagiosum virus
cgcgcgcggcaa

SEQ ID NO: 4041461 - RNA, 12 nt, Molluscum contagiosum virus
cgcgcgcggcac

SEQ ID NO: 4041462 - RNA, 17 nt, Molluscum contagiosum virus
guacgguguccucuuca

SEQ ID NO: 4041463 - RNA, 22 nt, Molluscum contagiosum virus
guacuacuuccgcaacgagguc

SEQ ID NO: 4041464 - RNA, 16 nt, Molluscum contagiosum virus
guacuccguggugcgc

SEQ ID NO: 4041465 - RNA, 20 nt, Molluscum contagiosum virus
guacuccuugaagggcacaa

SEQ ID NO: 4041466 - RNA, 16 nt, Molluscum contagiosum virus
guacucgcguccgcgc

SEQ ID NO: 4041467 - RNA, 19 nt, Molluscum contagiosum virus
guacucgcguccgcgcagc

SEQ ID NO: 4041468 - RNA, 21 nt, Molluscum contagiosum virus
guacugaacgucuucgagagc

SEQ ID NO: 4041469 - RNA, 15 nt, Molluscum contagiosum virus
guacugcugcaggca

SEQ ID NO: 4041470 - RNA, 20 nt, Molluscum contagiosum virus
guacuucaagcacgagcugc

SEQ ID NO: 4041471 - RNA, 21 nt, Molluscum contagiosum virus
guacuucaucuucaagccgca

SEQ ID NO: 4041472 - RNA, 12 nt, Molluscum contagiosum virus
guagccgcgcga

SEQ ID NO: 4041473 - RNA, 23 nt, Molluscum contagiosum virus
guagccuuuguucuuagcagcgc

SEQ ID NO: 4041474 - RNA, 21 nt, Molluscum contagiosum virus
guagcgcgucucugcgcagag

SEQ ID NO: 4041475 - RNA, 17 nt, Molluscum contagiosum virus
guagcgguugaccagcu

SEQ ID NO: 4041476 - RNA, 14 nt, Molluscum contagiosum virus
guagcguggagcug

SEQ ID NO: 4041477 - RNA, 20 nt, Molluscum contagiosum virus
guagggugccgaggcgcugc

SEQ ID NO: 4041478 - RNA, 15 nt, Molluscum contagiosum virus
guaguaguagcgcuc

SEQ ID NO: 4041479 - RNA, 21 nt, Molluscum contagiosum virus
guagucgcccccgugccggaa

SEQ ID NO: 4041480 - RNA, 21 nt, Molluscum contagiosum virus
guagucuggccgggcucgggc

SEQ ID NO: 4041481 - RNA, 13 nt, Molluscum contagiosum virus
ucugcucgcgcau

SEQ ID NO: 4041482 - RNA, 22 nt, Molluscum contagiosum virus
ucuggaucaccacuggacacgu

SEQ ID NO: 4041483 - RNA, 15 nt, Molluscum contagiosum virus
ucugucccgcccgug

SEQ ID NO: 4041484 - RNA, 12 nt, Molluscum contagiosum virus
ucuuaauccagu

SEQ ID NO: 4041485 - RNA, 20 nt, Molluscum contagiosum virus
ucuucacuccgcacagcuuc

SEQ ID NO: 4041486 - RNA, 15 nt, Molluscum contagiosum virus
ucuucauggacgucg

SEQ ID NO: 4041487 - RNA, 18 nt, Molluscum contagiosum virus
ucuuccggaggcagcgcu

SEQ ID NO: 4041488 - RNA, 19 nt, Molluscum contagiosum virus
ucuuccggcccgacacacu

SEQ ID NO: 4041489 - RNA, 15 nt, Molluscum contagiosum virus
ucuuccuggggcugg

SEQ ID NO: 4041490 - RNA, 17 nt, Molluscum contagiosum virus
ucuucguggcgcugggc

SEQ ID NO: 4041491 - RNA, 22 nt, Molluscum contagiosum virus
ucuucguggcgcugggcgcgcc

SEQ ID NO: 4041492 - RNA, 21 nt, Molluscum contagiosum virus
ucuugaaacaguaggacaugu

SEQ ID NO: 4041493 - RNA, 17 nt, Molluscum contagiosum virus
ucuugcuggcgcucgcg

SEQ ID NO: 4041494 - RNA, 23 nt, Molluscum contagiosum virus
ucuugcuggcgcucgcgcgcacg

SEQ ID NO: 4041495 - RNA, 21 nt, Molluscum contagiosum virus
ucuugguggacagccuuugug

SEQ ID NO: 4041496 - RNA, 16 nt, Molluscum contagiosum virus
ucuugugaggaaacac

SEQ ID NO: 4041497 - RNA, 14 nt, Molluscum contagiosum virus
ucuuguugcgcaug

SEQ ID NO: 4041498 - RNA, 17 nt, Molluscum contagiosum virus
ucuuucacgcugcacga

SEQ ID NO: 4041499 - RNA, 16 nt, Molluscum contagiosum virus
ucuuucccgggcacug

SEQ ID NO: 4041500 - RNA, 11 nt, Molluscum contagiosum virus
ucuuucucuag

SEQ ID NO: 4041501 - RNA, 22 nt, Molluscum contagiosum virus
ucuuuguggucaagacuggccu

SEQ ID NO: 4041502 - RNA, 20 nt, Molluscum contagiosum virus
ugaaaagcgugauguugagc

SEQ ID NO: 4041503 - RNA, 22 nt, Molluscum contagiosum virus
ugaacaaauacaguggcugugc

SEQ ID NO: 4041504 - RNA, 17 nt, Molluscum contagiosum virus
ugaacaacauggugcug

SEQ ID NO: 4041505 - RNA, 18 nt, Molluscum contagiosum virus
ugaacaccauccugcgcu

SEQ ID NO: 4041506 - RNA, 17 nt, Molluscum contagiosum virus
ugaacagcauuagcgcc

SEQ ID NO: 4041507 - RNA, 13 nt, Molluscum contagiosum virus
ugaaccugggcau

SEQ ID NO: 4041508 - RNA, 15 nt, Molluscum contagiosum virus
ugaagcuggacgugg

SEQ ID NO: 4041509 - RNA, 19 nt, Molluscum contagiosum virus
ugaaggacgcguucuccag

SEQ ID NO: 4041510 - RNA, 20 nt, Molluscum contagiosum virus
ugaaucaugccuuuccgagc

SEQ ID NO: 4041511 - RNA, 16 nt, Molluscum contagiosum virus
ugacaaggauggacaa

SEQ ID NO: 4041512 - RNA, 22 nt, Molluscum contagiosum virus
ugacacgaguacgccagaauug

SEQ ID NO: 4041513 - RNA, 20 nt, Molluscum contagiosum virus
ugacaggcgcgcaagugcgu

SEQ ID NO: 4041514 - RNA, 20 nt, Molluscum contagiosum virus
ugacagucagcggcgugcug

SEQ ID NO: 4041515 - RNA, 16 nt, Molluscum contagiosum virus
ugaccagugcgugcuc

SEQ ID NO: 4041516 - RNA, 15 nt, Molluscum contagiosum virus
ugaccgacggcgacg

SEQ ID NO: 4041517 - RNA, 24 nt, Molluscum contagiosum virus
ugaccgcuucgagugcucccgagg

SEQ ID NO: 4041518 - RNA, 14 nt, Molluscum contagiosum virus
ugacgaagcugcgc

SEQ ID NO: 4041519 - RNA, 17 nt, Molluscum contagiosum virus
gcuacgcgcucuacgcu

SEQ ID NO: 4041520 - RNA, 21 nt, Molluscum contagiosum virus
gcuacgcuggacuuccugcug

SEQ ID NO: 4041521 - RNA, 13 nt, Molluscum contagiosum virus
gcuacguuccgcg

SEQ ID NO: 4041522 - RNA, 14 nt, Molluscum contagiosum virus
gcuacucaggcgcg

SEQ ID NO: 4041523 - RNA, 19 nt, Molluscum contagiosum virus
gcuagcgacgcggacacau

SEQ ID NO: 4041524 - RNA, 14 nt, Molluscum contagiosum virus
gcuagcgugugccg

SEQ ID NO: 4041525 - RNA, 23 nt, Molluscum contagiosum virus
gcucaagacgcugcuggcgcaca

SEQ ID NO: 4041526 - RNA, 14 nt, Molluscum contagiosum virus
gcucaagcugcuca

SEQ ID NO: 4041527 - RNA, 18 nt, Molluscum contagiosum virus
gcucaaggacuaccagcu

SEQ ID NO: 4041528 - RNA, 21 nt, Molluscum contagiosum virus
gcucacgagauggcugcucuc

SEQ ID NO: 4041529 - RNA, 21 nt, Molluscum contagiosum virus
gcucacggacucgccgcgcgc

SEQ ID NO: 4041530 - RNA, 14 nt, Molluscum contagiosum virus
gcucagccccagca

SEQ ID NO: 4041531 - RNA, 19 nt, Molluscum contagiosum virus
gcucagcgccgcgugcaug

SEQ ID NO: 4041532 - RNA, 12 nt, Molluscum contagiosum virus
gcucagcgcuuc

SEQ ID NO: 4041533 - RNA, 16 nt, Molluscum contagiosum virus
gcucaguugcgacgga

SEQ ID NO: 4041534 - RNA, 14 nt, Molluscum contagiosum virus
gcucauagcccaug

SEQ ID NO: 4041535 - RNA, 17 nt, Molluscum contagiosum virus
gcucauggacaugcucg

SEQ ID NO: 4041536 - RNA, 19 nt, Molluscum contagiosum virus
gcucauggcgcgcaaccag

SEQ ID NO: 4041537 - RNA, 20 nt, Molluscum contagiosum virus
gcucaugguuugcgugggug

SEQ ID NO: 4041538 - RNA, 19 nt, Molluscum contagiosum virus
gcuccaacagcagcuggcg

SEQ ID NO: 4041539 - RNA, 20 nt, Molluscum contagiosum virus
gcuccagcauggcgccacac

SEQ ID NO: 4041540 - RNA, 14 nt, Molluscum contagiosum virus
gcuccccgcgcgca

SEQ ID NO: 4041541 - RNA, 17 nt, Molluscum contagiosum virus
gcucccgucgagcacga

SEQ ID NO: 4041542 - RNA, 16 nt, Molluscum contagiosum virus
gcuccgagacugcuac

SEQ ID NO: 4041543 - RNA, 18 nt, Molluscum contagiosum virus
gcuccgagcggcugcucg

SEQ ID NO: 4041544 - RNA, 22 nt, Molluscum contagiosum virus
gcuccgcacguggagucacgac

SEQ ID NO: 4041545 - RNA, 14 nt, Molluscum contagiosum virus
gcuccgcagcagga

SEQ ID NO: 4041546 - RNA, 18 nt, Molluscum contagiosum virus
gcuccgcggaggccaagc

SEQ ID NO: 4041547 - RNA, 19 nt, Molluscum contagiosum virus
gcuccgcggaggccaagca

SEQ ID NO: 4041548 - RNA, 15 nt, Molluscum contagiosum virus
gcuccgcuggacccc

SEQ ID NO: 4041549 - RNA, 16 nt, Molluscum contagiosum virus
gcuccggucaccgcgu

SEQ ID NO: 4041550 - RNA, 13 nt, Molluscum contagiosum virus
gcuccgugcugcg

SEQ ID NO: 4041551 - RNA, 16 nt, Molluscum contagiosum virus
gcuccuagcgcgcgug

SEQ ID NO: 4041552 - RNA, 12 nt, Molluscum contagiosum virus
gcuccugcucug

SEQ ID NO: 4041553 - RNA, 22 nt, Molluscum contagiosum virus
gcucgaaaaaguucuuggugga

SEQ ID NO: 4041554 - RNA, 15 nt, Molluscum contagiosum virus
gcucgacgggcgcag

SEQ ID NO: 4041555 - RNA, 17 nt, Molluscum contagiosum virus
gcucgacgggcgcagcc

SEQ ID NO: 4041556 - RNA, 23 nt, Molluscum contagiosum virus
gcucgagccugccagcgccagcc

SEQ ID NO: 4041557 - RNA, 14 nt, Molluscum contagiosum virus
gcucgagcuccgag

SEQ ID NO: 4041558 - RNA, 13 nt, Molluscum contagiosum virus
gcucgaggcgacg

SEQ ID NO: 4041559 - RNA, 21 nt, Molluscum contagiosum virus
gcucgagggcgccgugcugcg

SEQ ID NO: 4041560 - RNA, 17 nt, Molluscum contagiosum virus
gcucgaucugcgccucc

SEQ ID NO: 4041561 - RNA, 15 nt, Molluscum contagiosum virus
gcucgaugggcucca

SEQ ID NO: 4041562 - RNA, 15 nt, Molluscum contagiosum virus
gcucgcacacgugca

SEQ ID NO: 4041563 - RNA, 22 nt, Molluscum contagiosum virus
gcucgcagccuccgugcgccag

SEQ ID NO: 4041564 - RNA, 19 nt, Molluscum contagiosum virus
gcucgcaggcggugggcgc

SEQ ID NO: 4041565 - RNA, 12 nt, Molluscum contagiosum virus
gcucgccagcag

SEQ ID NO: 4041566 - RNA, 19 nt, Molluscum contagiosum virus
gcucgccuccuugcccgag

SEQ ID NO: 4041567 - RNA, 17 nt, Molluscum contagiosum virus
gcucgcgagugugcaug

SEQ ID NO: 4041568 - RNA, 22 nt, Molluscum contagiosum virus
gcucgcgcaaguccagcgcgcu

SEQ ID NO: 4041569 - RNA, 23 nt, Molluscum contagiosum virus
gcucgcgcgcaagaacaaccaga

SEQ ID NO: 4041570 - RNA, 19 nt, Molluscum contagiosum virus
gcucgcgcgcacgcgcacg

SEQ ID NO: 4041571 - RNA, 23 nt, Molluscum contagiosum virus
gcucgcgcuguauucggcguacg

SEQ ID NO: 4041572 - RNA, 12 nt, Molluscum contagiosum virus
gcucgcggaggg

SEQ ID NO: 4041573 - RNA, 18 nt, Molluscum contagiosum virus
gcucgcggugcagcugcc

SEQ ID NO: 4041574 - RNA, 15 nt, Molluscum contagiosum virus
gcucgcggugccgga

SEQ ID NO: 4041575 - RNA, 16 nt, Molluscum contagiosum virus
gcucgcgugccgcgga

SEQ ID NO: 4041576 - RNA, 21 nt, Molluscum contagiosum virus
gcucggaggcuugccccgcgc

SEQ ID NO: 4041577 - RNA, 15 nt, Molluscum contagiosum virus
gcucggcacugcugg

SEQ ID NO: 4041578 - RNA, 22 nt, Molluscum contagiosum virus
gcucggcccgcggacgcgcagc

SEQ ID NO: 4041579 - RNA, 15 nt, Molluscum contagiosum virus
gcucggcguggugcu

SEQ ID NO: 4041580 - RNA, 21 nt, Molluscum contagiosum virus
gcucguggacagccugcaccg

SEQ ID NO: 4041581 - RNA, 22 nt, Molluscum contagiosum virus
gcucguugcgcagccgguacuc

SEQ ID NO: 4041582 - RNA, 19 nt, Molluscum contagiosum virus
gcucguuuucggauagccc

SEQ ID NO: 4041583 - RNA, 22 nt, Molluscum contagiosum virus
gcucguuuucggauagccccuc

SEQ ID NO: 4041584 - RNA, 21 nt, Molluscum contagiosum virus
gcucuaccuggugcuggggcu

SEQ ID NO: 4041585 - RNA, 20 nt, Molluscum contagiosum virus
gcucuacgagacucuggaag

SEQ ID NO: 4041586 - RNA, 13 nt, Molluscum contagiosum virus
gcucuacggcgug

SEQ ID NO: 4041587 - RNA, 20 nt, Molluscum contagiosum virus
gcucuacggcgugcugugcc

SEQ ID NO: 4041588 - RNA, 21 nt, Molluscum contagiosum virus
gcucuacggcgugcugugccu

SEQ ID NO: 4041589 - RNA, 13 nt, Molluscum contagiosum virus
gcucuacgugcug

SEQ ID NO: 4041590 - RNA, 15 nt, Molluscum contagiosum virus
gcucucgcgcgccag

SEQ ID NO: 4041591 - RNA, 15 nt, Molluscum contagiosum virus
gcucucgcugcugcc

SEQ ID NO: 4041592 - RNA, 18 nt, Molluscum contagiosum virus
gcucucgcugcugcccau

SEQ ID NO: 4041593 - RNA, 15 nt, Molluscum contagiosum virus
gcucugccgcccgcg

SEQ ID NO: 4041594 - RNA, 18 nt, Molluscum contagiosum virus
gcucugcguuuugcgcgg

SEQ ID NO: 4041595 - RNA, 21 nt, Molluscum contagiosum virus
gcucuguugcguuggcgccag

SEQ ID NO: 4041596 - RNA, 21 nt, Molluscum contagiosum virus
gcucuuggcguucgcagugcc

SEQ ID NO: 4041597 - RNA, 15 nt, Molluscum contagiosum virus
gcugaagaaggagcc

SEQ ID NO: 4041598 - RNA, 16 nt, Molluscum contagiosum virus
gcugagcgcagcacac

SEQ ID NO: 4041599 - RNA, 15 nt, Molluscum contagiosum virus
gcugauucugcuugc

SEQ ID NO: 4041600 - RNA, 23 nt, Molluscum contagiosum virus
gcugcaagccagcccgcugcgca

SEQ ID NO: 4041601 - RNA, 20 nt, Molluscum contagiosum virus
gcugcacgccgccagcgacg

SEQ ID NO: 4041602 - RNA, 21 nt, Molluscum contagiosum virus
gcugcacuacaaccauggcgc

SEQ ID NO: 4041603 - RNA, 20 nt, Molluscum contagiosum virus
gcugcaguguguacggcgug

SEQ ID NO: 4041604 - RNA, 21 nt, Molluscum contagiosum virus
gcugccagagauccgcccgcg

SEQ ID NO: 4041605 - RNA, 18 nt, Molluscum contagiosum virus
gcugcccgcgcacgagcu

SEQ ID NO: 4041606 - RNA, 15 nt, Molluscum contagiosum virus
gcugccgcgcgcgcc

SEQ ID NO: 4041607 - RNA, 18 nt, Molluscum contagiosum virus
gcugccgcgggacgagag

SEQ ID NO: 4041608 - RNA, 16 nt, Molluscum contagiosum virus
gcugccgcugcgcgac

SEQ ID NO: 4041609 - RNA, 16 nt, Molluscum contagiosum virus
gcugcgaccaagacag

SEQ ID NO: 4041610 - RNA, 19 nt, Molluscum contagiosum virus
gcugcgagaacucgcgugc

SEQ ID NO: 4041611 - RNA, 18 nt, Molluscum contagiosum virus
gcugcgcacgugcgcgcc

SEQ ID NO: 4041612 - RNA, 21 nt, Molluscum contagiosum virus
gcugcgcaucugcgagcgcga

SEQ ID NO: 4041613 - RNA, 21 nt, Molluscum contagiosum virus
gcugcgccaggaaaggcagga

SEQ ID NO: 4041614 - RNA, 23 nt, Molluscum contagiosum virus
gcugcgcgaguaccugggcaggc

SEQ ID NO: 4041615 - RNA, 13 nt, Molluscum contagiosum virus
gcugcgcgccgcc

SEQ ID NO: 4041616 - RNA, 14 nt, Molluscum contagiosum virus
gcugcgcgcggacu

SEQ ID NO: 4041617 - RNA, 22 nt, Molluscum contagiosum virus
gcugcgcgcggggagcucugcg

SEQ ID NO: 4041618 - RNA, 22 nt, Molluscum contagiosum virus
gcugcgcggcgccgcagcacgc

SEQ ID NO: 4041619 - RNA, 20 nt, Molluscum contagiosum virus
uccaagaacaauacaaacaa

SEQ ID NO: 4041620 - RNA, 23 nt, Molluscum contagiosum virus
uccaagaagacggcgcgcgcgcu

SEQ ID NO: 4041621 - RNA, 16 nt, Molluscum contagiosum virus
uccaagaagaggccgg

SEQ ID NO: 4041622 - RNA, 16 nt, Molluscum contagiosum virus
uccacaaagacgggcc

SEQ ID NO: 4041623 - RNA, 21 nt, Molluscum contagiosum virus
uccacaugccgcgcugcuccg

SEQ ID NO: 4041624 - RNA, 18 nt, Molluscum contagiosum virus
uccacgacgagccugcgg

SEQ ID NO: 4041625 - RNA, 23 nt, Molluscum contagiosum virus
uccacgcaggacuggcaccugcg

SEQ ID NO: 4041626 - RNA, 17 nt, Molluscum contagiosum virus
uccacgcccggcgugau

SEQ ID NO: 4041627 - RNA, 20 nt, Molluscum contagiosum virus
uggcccgugcacguccucca

SEQ ID NO: 4041628 - RNA, 12 nt, Molluscum contagiosum virus
uggccgagccgc

SEQ ID NO: 4041629 - RNA, 15 nt, Molluscum contagiosum virus
uggccgcgcgcgcac

SEQ ID NO: 4041630 - RNA, 17 nt, Molluscum contagiosum virus
uggccgcgcgcgcacgc

SEQ ID NO: 4041631 - RNA, 19 nt, Molluscum contagiosum virus
uggccggcaaggggccagc

SEQ ID NO: 4041632 - RNA, 23 nt, Molluscum contagiosum virus
uggccguagucuggccgggcucg

SEQ ID NO: 4041633 - RNA, 12 nt, Molluscum contagiosum virus
uggccucugcca

SEQ ID NO: 4041634 - RNA, 16 nt, Molluscum contagiosum virus
uggcgccagccuggcg

SEQ ID NO: 4041635 - RNA, 16 nt, Molluscum contagiosum virus
uggcgcccggcgccga

SEQ ID NO: 4041636 - RNA, 15 nt, Molluscum contagiosum virus
uggcgccgaugcagu

SEQ ID NO: 4041637 - RNA, 14 nt, Molluscum contagiosum virus
uggcgccgcugcug

SEQ ID NO: 4041638 - RNA, 20 nt, Molluscum contagiosum virus
uggcgccguuggccaccugg

SEQ ID NO: 4041639 - RNA, 21 nt, Molluscum contagiosum virus
uggcgccugcgcgcggcagug

SEQ ID NO: 4041640 - RNA, 17 nt, Molluscum contagiosum virus
uggcgcgccgcugcccg

SEQ ID NO: 4041641 - RNA, 15 nt, Molluscum contagiosum virus
uggcgcgccggcgcg

SEQ ID NO: 4041642 - RNA, 14 nt, Molluscum contagiosum virus
uggcgcgcgcgcug

SEQ ID NO: 4041643 - RNA, 16 nt, Molluscum contagiosum virus
uggcgcgcuccaugua

SEQ ID NO: 4041644 - RNA, 17 nt, Molluscum contagiosum virus
uggcgcucggcguggug

SEQ ID NO: 4041645 - RNA, 13 nt, Molluscum contagiosum virus
uggcggagguggc

SEQ ID NO: 4041646 - RNA, 21 nt, Molluscum contagiosum virus
uggcggcgcacgcgagcacgc

SEQ ID NO: 4041647 - RNA, 12 nt, Molluscum contagiosum virus
uggcggcgcugg

SEQ ID NO: 4041648 - RNA, 14 nt, Molluscum contagiosum virus
uggcggggcuggca

SEQ ID NO: 4041649 - RNA, 13 nt, Molluscum contagiosum virus
uggcgugcgcagu

SEQ ID NO: 4041650 - RNA, 12 nt, Molluscum contagiosum virus
uggcguguacgu

SEQ ID NO: 4041651 - RNA, 22 nt, Molluscum contagiosum virus
uggcuacuggaggagugucgcg

SEQ ID NO: 4041652 - RNA, 19 nt, Molluscum contagiosum virus
uggcugcgguagcggacgc

SEQ ID NO: 4041653 - RNA, 14 nt, Molluscum contagiosum virus
uggcugcugcgcga

SEQ ID NO: 4041654 - RNA, 15 nt, Molluscum contagiosum virus
uggcuucgcaagcau

SEQ ID NO: 4041655 - RNA, 23 nt, Molluscum contagiosum virus
ugggaaaccucaccucugcgcgg

SEQ ID NO: 4041656 - RNA, 16 nt, Molluscum contagiosum virus
ugggcaacgcgcgcgc

SEQ ID NO: 4041657 - RNA, 16 nt, Molluscum contagiosum virus
ugggcccgccuccggg

SEQ ID NO: 4041658 - RNA, 15 nt, Molluscum contagiosum virus
ugggcgagcgcacgu

SEQ ID NO: 4041659 - RNA, 11 nt, Molluscum contagiosum virus
ugggcgcgugc

SEQ ID NO: 4041660 - RNA, 18 nt, Molluscum contagiosum virus
ugggcgugcggcgcaccu

SEQ ID NO: 4041661 - RNA, 15 nt, Molluscum contagiosum virus
ugggcgugcucacgc

SEQ ID NO: 4041662 - RNA, 20 nt, Molluscum contagiosum virus
ugggcgugcucacgcugccc

SEQ ID NO: 4041663 - RNA, 20 nt, Molluscum contagiosum virus
ugggcucgcgcuuuuccagg

SEQ ID NO: 4041664 - RNA, 20 nt, Molluscum contagiosum virus
ugggcucggaguccgcgccc

SEQ ID NO: 4041665 - RNA, 16 nt, Molluscum contagiosum virus
ugggcuugcggcacgc

SEQ ID NO: 4041666 - RNA, 11 nt, Molluscum contagiosum virus
uggggcucgcg

SEQ ID NO: 4041667 - RNA, 16 nt, Molluscum contagiosum virus
uggucaagauccaagc

SEQ ID NO: 4041668 - RNA, 16 nt, Molluscum contagiosum virus
uggucacgcgcacgcg

SEQ ID NO: 4041669 - RNA, 19 nt, Molluscum contagiosum virus
uggucuccgcgggcagccg

SEQ ID NO: 4041670 - RNA, 14 nt, Molluscum contagiosum virus
uggugcccaugcuc

SEQ ID NO: 4041671 - RNA, 14 nt, Molluscum contagiosum virus
uggugccgcgcgcu

SEQ ID NO: 4041672 - RNA, 17 nt, Molluscum contagiosum virus
uggugcgcgacgacggc

SEQ ID NO: 4041673 - RNA, 19 nt, Molluscum contagiosum virus
uggugcucguggaaaagca

SEQ ID NO: 4041674 - RNA, 14 nt, Molluscum contagiosum virus
uggugcuggccaac

SEQ ID NO: 4041675 - RNA, 18 nt, Molluscum contagiosum virus
ugguguucugcgcgccgc

SEQ ID NO: 4041676 - RNA, 13 nt, Molluscum contagiosum virus
ugguugccaggca

SEQ ID NO: 4041677 - RNA, 13 nt, Molluscum contagiosum virus
ugguugcgcacgu

SEQ ID NO: 4041678 - RNA, 14 nt, Molluscum contagiosum virus
ugguugcuugcaug

SEQ ID NO: 4041679 - RNA, 23 nt, Molluscum contagiosum virus
uguaaguggcuucgcaagcaugc

SEQ ID NO: 4041680 - RNA, 14 nt, Molluscum contagiosum virus
uguacaacucggug

SEQ ID NO: 4041681 - RNA, 20 nt, Molluscum contagiosum virus
uguaccgccgcggccgcgag

SEQ ID NO: 4041682 - RNA, 21 nt, Molluscum contagiosum virus
uguaccuggugcgcccgcggc

SEQ ID NO: 4041683 - RNA, 14 nt, Molluscum contagiosum virus
uguacgacgcgccc

SEQ ID NO: 4041684 - RNA, 19 nt, Molluscum contagiosum virus
uguacggcgugugcgcgag

SEQ ID NO: 4041685 - RNA, 13 nt, Molluscum contagiosum virus
uguacuugcuucc

SEQ ID NO: 4041686 - RNA, 15 nt, Molluscum contagiosum virus
uguagaagcgcacga

SEQ ID NO: 4041687 - RNA, 15 nt, Molluscum contagiosum virus
uguaucaugcacaug

SEQ ID NO: 4041688 - RNA, 20 nt, Molluscum contagiosum virus
uguccacgaugaacggcucc

SEQ ID NO: 4041689 - RNA, 21 nt, Molluscum contagiosum virus
ugucccugcauacacuuccug

SEQ ID NO: 4041690 - RNA, 22 nt, Molluscum contagiosum virus
ugucccugcauacacuuccugc

SEQ ID NO: 4041691 - RNA, 23 nt, Molluscum contagiosum virus
uguccgcggacgcgggccugucc

SEQ ID NO: 4041692 - RNA, 13 nt, Molluscum contagiosum virus
uguccggcccgaa

SEQ ID NO: 4041693 - RNA, 17 nt, Molluscum contagiosum virus
uguccuuccgacccggc

SEQ ID NO: 4041694 - RNA, 13 nt, Molluscum contagiosum virus
ugucgacagagaa

SEQ ID NO: 4041695 - RNA, 19 nt, Molluscum contagiosum virus
ugucgaggccuucgcgccc

SEQ ID NO: 4041696 - RNA, 13 nt, Molluscum contagiosum virus
ugucucgcaagca

SEQ ID NO: 4041697 - RNA, 16 nt, Molluscum contagiosum virus
ugugaacacgacaugu

SEQ ID NO: 4041698 - RNA, 23 nt, Molluscum contagiosum virus
ugugccgccgcacuauggacgcu

SEQ ID NO: 4041699 - RNA, 23 nt, Molluscum contagiosum virus
ugugccgcucggcccgcggacgc

SEQ ID NO: 4041700 - RNA, 18 nt, Molluscum contagiosum virus
ugugccggugcugcggcg

SEQ ID NO: 4041701 - RNA, 14 nt, Molluscum contagiosum virus
ugugccuaggagga

SEQ ID NO: 4041702 - RNA, 16 nt, Molluscum contagiosum virus
ugugcgagaacuggcg

SEQ ID NO: 4041703 - RNA, 18 nt, Molluscum contagiosum virus
ugugcuccuuguccgagc

SEQ ID NO: 4041704 - RNA, 23 nt, Molluscum contagiosum virus
ugugcugacccccuccccagcgc

SEQ ID NO: 4041705 - RNA, 15 nt, Molluscum contagiosum virus
uguggccuacguggc

SEQ ID NO: 4041706 - RNA, 19 nt, Molluscum contagiosum virus
uguuacggacggcgcacgc

SEQ ID NO: 4041707 - RNA, 17 nt, Molluscum contagiosum virus
uguucaccauccagccg

SEQ ID NO: 4041708 - RNA, 20 nt, Molluscum contagiosum virus
uguuccguucgucagaggga

SEQ ID NO: 4041709 - RNA, 20 nt, Molluscum contagiosum virus
uguucgcgcugcucgcgcuc

SEQ ID NO: 4041710 - RNA, 12 nt, Molluscum contagiosum virus
uguucgcggagc

SEQ ID NO: 4041711 - RNA, 15 nt, Molluscum contagiosum virus
uguugccuggagggc

SEQ ID NO: 4041712 - RNA, 14 nt, Molluscum contagiosum virus
uguugcgcgcgccu

SEQ ID NO: 4041713 - RNA, 15 nt, Molluscum contagiosum virus
uguuuguagccgcgc

SEQ ID NO: 4041714 - RNA, 18 nt, Molluscum contagiosum virus
agcagcucggggcuguca

SEQ ID NO: 4041715 - RNA, 16 nt, Molluscum contagiosum virus
agcagcugcuccgccu

SEQ ID NO: 4041716 - RNA, 13 nt, Molluscum contagiosum virus
agcaggcgcaggc

SEQ ID NO: 4041717 - RNA, 18 nt, Molluscum contagiosum virus
agcaggcgccaucgcgcg

SEQ ID NO: 4041718 - RNA, 16 nt, Molluscum contagiosum virus
agcagguucucgcaca

SEQ ID NO: 4041719 - RNA, 16 nt, Molluscum contagiosum virus
agcaugcgugcaacag

SEQ ID NO: 4041720 - RNA, 19 nt, Molluscum contagiosum virus
agcauuccuuguccuggca

SEQ ID NO: 4041721 - RNA, 15 nt, Molluscum contagiosum virus
agccaaccccgagcc

SEQ ID NO: 4041722 - RNA, 19 nt, Molluscum contagiosum virus
agccacgaagagucgcgcc

SEQ ID NO: 4041723 - RNA, 15 nt, Molluscum contagiosum virus
agccacggccgcgcu

SEQ ID NO: 4041724 - RNA, 12 nt, Molluscum contagiosum virus
agccagccaggc

SEQ ID NO: 4041725 - RNA, 18 nt, Molluscum contagiosum virus
agccagucucgcgcuucc

SEQ ID NO: 4041726 - RNA, 20 nt, Molluscum contagiosum virus
agccagucucgcgcuuccag

SEQ ID NO: 4041727 - RNA, 14 nt, Molluscum contagiosum virus
agcccaaggagcug

SEQ ID NO: 4041728 - RNA, 18 nt, Molluscum contagiosum virus
agcccaggaacaucugca

SEQ ID NO: 4041729 - RNA, 14 nt, Molluscum contagiosum virus
agccccugcugcuc

SEQ ID NO: 4041730 - RNA, 19 nt, Molluscum contagiosum virus
agcccgacgcgggcgcgca

SEQ ID NO: 4041731 - RNA, 14 nt, Molluscum contagiosum virus
agcccgcccccgag

SEQ ID NO: 4041732 - RNA, 17 nt, Molluscum contagiosum virus
uuccggugccggccgcc

SEQ ID NO: 4041733 - RNA, 18 nt, Molluscum contagiosum virus
uuccgucccccgcggagc

SEQ ID NO: 4041734 - RNA, 17 nt, Molluscum contagiosum virus
uuccuugcgcuuguccu

SEQ ID NO: 4041735 - RNA, 20 nt, Molluscum contagiosum virus
uucgagaccuacgucaagca

SEQ ID NO: 4041736 - RNA, 18 nt, Molluscum contagiosum virus
uucgcggacggcgcgcag

SEQ ID NO: 4041737 - RNA, 19 nt, Molluscum contagiosum virus
uucgcggacggcgcgcagc

SEQ ID NO: 4041738 - RNA, 15 nt, Molluscum contagiosum virus
uucgcggagcugugc

SEQ ID NO: 4041739 - RNA, 15 nt, Molluscum contagiosum virus
uucgggaagcacagu

SEQ ID NO: 4041740 - RNA, 13 nt, Molluscum contagiosum virus
uucguaaagcugg

SEQ ID NO: 4041741 - RNA, 13 nt, Molluscum contagiosum virus
uucgucauggagc

SEQ ID NO: 4041742 - RNA, 19 nt, Molluscum contagiosum virus
uucguggagcccgugcugg

SEQ ID NO: 4041743 - RNA, 20 nt, Molluscum contagiosum virus
uucucgcagcguuccaggaa

SEQ ID NO: 4041744 - RNA, 17 nt, Molluscum contagiosum virus
uucuucaaguaccuguc

SEQ ID NO: 4041745 - RNA, 20 nt, Molluscum contagiosum virus
uucuuuacgggcgccagcua

SEQ ID NO: 4041746 - RNA, 15 nt, Molluscum contagiosum virus
uugaaugucgcgacg

SEQ ID NO: 4041747 - RNA, 15 nt, Molluscum contagiosum virus
uugacgcccauuaaa

SEQ ID NO: 4041748 - RNA, 22 nt, Molluscum contagiosum virus
uugaggaacuagugcugcuggg

SEQ ID NO: 4041749 - RNA, 15 nt, Molluscum contagiosum virus
uugcacccgcgcagc

SEQ ID NO: 4041750 - RNA, 14 nt, Molluscum contagiosum virus
uugcacgcgcacgc

SEQ ID NO: 4041751 - RNA, 18 nt, Molluscum contagiosum virus
uugcagcccaccagcagg

SEQ ID NO: 4041752 - RNA, 20 nt, Molluscum contagiosum virus
uugccccgcgcguugcugcc

SEQ ID NO: 4041753 - RNA, 13 nt, Molluscum contagiosum virus
uugccgaggaggu

SEQ ID NO: 4041754 - RNA, 14 nt, Molluscum contagiosum virus
uugccgcgcgcugc

SEQ ID NO: 4041755 - RNA, 12 nt, Molluscum contagiosum virus
uugcgcagagcu

SEQ ID NO: 4041756 - RNA, 16 nt, Molluscum contagiosum virus
uugcggaugcucgcuu

SEQ ID NO: 4041757 - RNA, 15 nt, Molluscum contagiosum virus
uugcuccaugacaga

SEQ ID NO: 4041758 - RNA, 22 nt, Molluscum contagiosum virus
uugcugggcacaagcuuucuca

SEQ ID NO: 4041759 - RNA, 13 nt, Molluscum contagiosum virus
uuggccgcggagg

SEQ ID NO: 4041760 - RNA, 15 nt, Molluscum contagiosum virus
uuggcgugaccaugg

SEQ ID NO: 4041761 - RNA, 22 nt, Molluscum contagiosum virus
uuuccuggcucgcgagugugca

SEQ ID NO: 4041762 - RNA, 16 nt, Molluscum contagiosum virus
uuuccuugccuucucg

SEQ ID NO: 4041763 - RNA, 15 nt, Molluscum contagiosum virus
uuucguccgccgcuc

SEQ ID NO: 4041764 - RNA, 14 nt, Molluscum contagiosum virus
uuucguugccugca

SEQ ID NO: 4041765 - RNA, 15 nt, Molluscum contagiosum virus
uuugcgcgagagcua

SEQ ID NO: 4041766 - RNA, 14 nt, Molluscum contagiosum virus
uuuguccugagccu

SEQ ID NO: 4041767 - RNA, 16 nt, Molluscum contagiosum virus
uuuguguuggccaggc

SEQ ID NO: 4041768 - RNA, 16 nt, Molluscum contagiosum virus
uuuuccggggacggag

SEQ ID NO: 4041769 - RNA, 20 nt, Molluscum contagiosum virus
gggugaggagcucgacucga

SEQ ID NO: 4041770 - RNA, 22 nt, Molluscum contagiosum virus
gguacccgcaaccccgcgcgua

SEQ ID NO: 4041771 - RNA, 14 nt, Molluscum contagiosum virus
gguagcgcgccgca

SEQ ID NO: 4041772 - RNA, 14 nt, Molluscum contagiosum virus
gguagcuagcucug

SEQ ID NO: 4041773 - RNA, 16 nt, Molluscum contagiosum virus
gguagcucgugccugu

SEQ ID NO: 4041774 - RNA, 21 nt, Molluscum contagiosum virus
ggucaacuccgagcgcgcgcg

SEQ ID NO: 4041775 - RNA, 13 nt, Molluscum contagiosum virus
ggucaagauccaa

SEQ ID NO: 4041776 - RNA, 16 nt, Molluscum contagiosum virus
gguccaccugcgacgc

SEQ ID NO: 4041777 - RNA, 15 nt, Molluscum contagiosum virus
ggucccuagccuucc

SEQ ID NO: 4041778 - RNA, 21 nt, Molluscum contagiosum virus
gguccgacaccagcggcaggc

SEQ ID NO: 4041779 - RNA, 21 nt, Molluscum contagiosum virus
ggucgcccgccgagcucuucc

SEQ ID NO: 4041780 - RNA, 17 nt, Molluscum contagiosum virus
ggucgcccuccgccgua

SEQ ID NO: 4041781 - RNA, 18 nt, Molluscum contagiosum virus
ggucgccuacgaggugcg

SEQ ID NO: 4041782 - RNA, 16 nt, Molluscum contagiosum virus
ggucguccuggagccu

SEQ ID NO: 4041783 - RNA, 14 nt, Molluscum contagiosum virus
ggugagugcgcgca

SEQ ID NO: 4041784 - RNA, 17 nt, Molluscum contagiosum virus
ggugcacgugcugcagc

SEQ ID NO: 4041785 - RNA, 21 nt, Molluscum contagiosum virus
ggugcacgugcugcagcugcg

SEQ ID NO: 4041786 - RNA, 20 nt, Molluscum contagiosum virus
ggugccgccgugggcgccgc

SEQ ID NO: 4041787 - RNA, 21 nt, Molluscum contagiosum virus
ggugccuggcguccgcacgca

SEQ ID NO: 4041788 - RNA, 14 nt, Molluscum contagiosum virus
ggugcgcgcgcgcg

SEQ ID NO: 4041789 - RNA, 14 nt, Molluscum contagiosum virus
ggugcugcgcacgg

SEQ ID NO: 4041790 - RNA, 20 nt, Molluscum contagiosum virus
ggugcugcgccacgugcgca

SEQ ID NO: 4041791 - RNA, 18 nt, Molluscum contagiosum virus
ggugcuggugcuggucaa

SEQ ID NO: 4041792 - RNA, 21 nt, Molluscum contagiosum virus
gguggaagagcccgcacacgc

SEQ ID NO: 4041793 - RNA, 14 nt, Molluscum contagiosum virus
gguggacguggacg

SEQ ID NO: 4041794 - RNA, 19 nt, Molluscum contagiosum virus
gguggcacccuggcugcug

SEQ ID NO: 4041795 - RNA, 14 nt, Molluscum contagiosum virus
gguggccaagcgcu

SEQ ID NO: 4041796 - RNA, 14 nt, Molluscum contagiosum virus
gguggccgcgcgcg

SEQ ID NO: 4041797 - RNA, 23 nt, Molluscum contagiosum virus
gguggugcgccugcacuacugcu

SEQ ID NO: 4041798 - RNA, 17 nt, Molluscum contagiosum virus
gguggugggcggguguc

SEQ ID NO: 4041799 - RNA, 16 nt, Molluscum contagiosum virus
ggugucgagcucgcgc

SEQ ID NO: 4041800 - RNA, 13 nt, Molluscum contagiosum virus
ggugugugccugc

SEQ ID NO: 4041801 - RNA, 16 nt, Molluscum contagiosum virus
gguguucugcgcgccg

SEQ ID NO: 4041802 - RNA, 17 nt, Molluscum contagiosum virus
gguucacuagcgcaggc

SEQ ID NO: 4041803 - RNA, 15 nt, Molluscum contagiosum virus
gguuccagcuccggc

SEQ ID NO: 4041804 - RNA, 13 nt, Molluscum contagiosum virus
gguuccugcgcuc

SEQ ID NO: 4041805 - RNA, 17 nt, Molluscum contagiosum virus
gguuccugcgcuccgac

SEQ ID NO: 4041806 - RNA, 15 nt, Molluscum contagiosum virus
gguucgcgcccugcg

SEQ ID NO: 4041807 - RNA, 16 nt, Molluscum contagiosum virus
gguucugcgcugccag

SEQ ID NO: 4041808 - RNA, 14 nt, Molluscum contagiosum virus
gguugccaggcaca

SEQ ID NO: 4041809 - RNA, 22 nt, Molluscum contagiosum virus
gguugcccgccugccgcgagca

SEQ ID NO: 4041810 - RNA, 19 nt, Molluscum contagiosum virus
gguuguagcgguugaccag

SEQ ID NO: 4041811 - RNA, 18 nt, Molluscum contagiosum virus
guaaagguacacuuuccg

SEQ ID NO: 4041812 - RNA, 15 nt, Molluscum contagiosum virus
guaagcgacagguca

SEQ ID NO: 4041813 - RNA, 13 nt, Molluscum contagiosum virus
guacacgcugacg

SEQ ID NO: 4041814 - RNA, 19 nt, Molluscum contagiosum virus
guacagcgggcgcugcucg

SEQ ID NO: 4041815 - RNA, 13 nt, Molluscum contagiosum virus
guacagugcgcgc

SEQ ID NO: 4041816 - RNA, 14 nt, Molluscum contagiosum virus
guacagugcgcgca

SEQ ID NO: 4041817 - RNA, 12 nt, Molluscum contagiosum virus
guaccagccgcu

SEQ ID NO: 4041818 - RNA, 17 nt, Molluscum contagiosum virus
guaccgccgcggccgcg

SEQ ID NO: 4041819 - RNA, 12 nt, Molluscum contagiosum virus
guaccgcgcgca

SEQ ID NO: 4041820 - RNA, 20 nt, Molluscum contagiosum virus
guaccugcucgggcugcgcg

SEQ ID NO: 4041821 - RNA, 15 nt, Molluscum contagiosum virus
guaccuggugcgccc

SEQ ID NO: 4041822 - RNA, 17 nt, Molluscum contagiosum virus
guacgagcagcugcugc

SEQ ID NO: 4041823 - RNA, 19 nt, Molluscum contagiosum virus
guacgagcagcugcugcgc

SEQ ID NO: 4041824 - RNA, 19 nt, Molluscum contagiosum virus
guacgcgugcgcuggcgcg

SEQ ID NO: 4041825 - RNA, 20 nt, Molluscum contagiosum virus
guacgugcgccagcucuggg

SEQ ID NO: 4041826 - RNA, 16 nt, Molluscum contagiosum virus
guacgugcuugcgcgc

SEQ ID NO: 4041827 - RNA, 13 nt, Molluscum contagiosum virus
cuugcgcagcgcc

SEQ ID NO: 4041828 - RNA, 16 nt, Molluscum contagiosum virus
cuugcgcgcgcccucg

SEQ ID NO: 4041829 - RNA, 12 nt, Molluscum contagiosum virus
cuugcuggcacg

SEQ ID NO: 4041830 - RNA, 18 nt, Molluscum contagiosum virus
cuuggacagcaagcagcg

SEQ ID NO: 4041831 - RNA, 15 nt, Molluscum contagiosum virus
cuuggcaugcgugcu

SEQ ID NO: 4041832 - RNA, 21 nt, Molluscum contagiosum virus
cuuggcgcccgugccgccggc

SEQ ID NO: 4041833 - RNA, 13 nt, Molluscum contagiosum virus
ggcgcacuggggc

SEQ ID NO: 4041834 - RNA, 15 nt, Molluscum contagiosum virus
ggcgcaucagagaag

SEQ ID NO: 4041835 - RNA, 16 nt, Molluscum contagiosum virus
ggcgccauugcucgcg

SEQ ID NO: 4041836 - RNA, 21 nt, Molluscum contagiosum virus
ggcgccgacaacgugcugcuc

SEQ ID NO: 4041837 - RNA, 19 nt, Molluscum contagiosum virus
ggcgccgcggccugggcca

SEQ ID NO: 4041838 - RNA, 15 nt, Molluscum contagiosum virus
ggcgccgcugcugga

SEQ ID NO: 4041839 - RNA, 16 nt, Molluscum contagiosum virus
ggcgccggcucugccu

SEQ ID NO: 4041840 - RNA, 16 nt, Molluscum contagiosum virus
ggcgcgacggcgacgc

SEQ ID NO: 4041841 - RNA, 14 nt, Molluscum contagiosum virus
ggcgcgacugcacg

SEQ ID NO: 4041842 - RNA, 16 nt, Molluscum contagiosum virus
ggcgcgcagcuccgcg

SEQ ID NO: 4041843 - RNA, 20 nt, Molluscum contagiosum virus
ggcgcgccgaguacugcugc

SEQ ID NO: 4041844 - RNA, 16 nt, Molluscum contagiosum virus
ggcgcgccggccagcg

SEQ ID NO: 4041845 - RNA, 21 nt, Molluscum contagiosum virus
ggcgcgcgcgcuagccgccgc

SEQ ID NO: 4041846 - RNA, 14 nt, Molluscum contagiosum virus
ggcgcgcgugccgc

SEQ ID NO: 4041847 - RNA, 14 nt, Molluscum contagiosum virus
ggcgcgcugugagc

SEQ ID NO: 4041848 - RNA, 12 nt, Molluscum contagiosum virus
ggcgcggcagcc

SEQ ID NO: 4041849 - RNA, 22 nt, Molluscum contagiosum virus
ggcgcgguccgcguuggcagcg

SEQ ID NO: 4041850 - RNA, 24 nt, Molluscum contagiosum virus
ggcgcgugccagucgcgcgagaag

SEQ ID NO: 4041851 - RNA, 16 nt, Molluscum contagiosum virus
ggcgcgugcugagcua

SEQ ID NO: 4041852 - RNA, 15 nt, Molluscum contagiosum virus
ggcgcguugcucccg

SEQ ID NO: 4041853 - RNA, 14 nt, Molluscum contagiosum virus
ggcgcucgccccuu

SEQ ID NO: 4041854 - RNA, 17 nt, Molluscum contagiosum virus
ggcgcucgccccuuccc

SEQ ID NO: 4041855 - RNA, 15 nt, Molluscum contagiosum virus
ggcgcucgcgagaag

SEQ ID NO: 4041856 - RNA, 23 nt, Molluscum contagiosum virus
ggcgcucggcguggugcuggcca

SEQ ID NO: 4041857 - RNA, 21 nt, Molluscum contagiosum virus
ggcgcugucgcgcaggcucug

SEQ ID NO: 4041858 - RNA, 20 nt, Molluscum contagiosum virus
ggcggagaugacgggcacgc

SEQ ID NO: 4041859 - RNA, 13 nt, Molluscum contagiosum virus
ggcggcacugcua

SEQ ID NO: 4041860 - RNA, 22 nt, Molluscum contagiosum virus
ggcggcauccugaugacggcag

SEQ ID NO: 4041861 - RNA, 20 nt, Molluscum contagiosum virus
ggcggcgauggcgauagcga

SEQ ID NO: 4041862 - RNA, 15 nt, Molluscum contagiosum virus
ggcggcugugcccgc

SEQ ID NO: 4041863 - RNA, 18 nt, Molluscum contagiosum virus
ggcgggccugcgcccgca

SEQ ID NO: 4041864 - RNA, 15 nt, Molluscum contagiosum virus
ggcgggcggcgucgc

SEQ ID NO: 4041865 - RNA, 18 nt, Molluscum contagiosum virus
ggcggguccgcaggcucg

SEQ ID NO: 4041866 - RNA, 22 nt, Molluscum contagiosum virus
ggcggucuuccagcacugcgcc

SEQ ID NO: 4041867 - RNA, 20 nt, Molluscum contagiosum virus
ggcguccgcacgaggagccc

SEQ ID NO: 4041868 - RNA, 17 nt, Molluscum contagiosum virus
ggcguccggcgcucgcc

SEQ ID NO: 4041869 - RNA, 14 nt, Molluscum contagiosum virus
ggcgucgcgcacag

SEQ ID NO: 4041870 - RNA, 13 nt, Molluscum contagiosum virus
ggcgugacagguc

SEQ ID NO: 4041871 - RNA, 18 nt, Molluscum contagiosum virus
ggcgugcagggcgugcuu

SEQ ID NO: 4041872 - RNA, 23 nt, Molluscum contagiosum virus
ggcgugcgcagcagcucggggcu

SEQ ID NO: 4041873 - RNA, 14 nt, Molluscum contagiosum virus
ggcguggccaggcc

SEQ ID NO: 4041874 - RNA, 21 nt, Molluscum contagiosum virus
ggcguguuccggcagcgccgc

SEQ ID NO: 4041875 - RNA, 20 nt, Molluscum contagiosum virus
ggcucaacucguaggacaac

SEQ ID NO: 4041876 - RNA, 14 nt, Molluscum contagiosum virus
ggcucaagcuggca

SEQ ID NO: 4041877 - RNA, 23 nt, Molluscum contagiosum virus
ggcucaccgcgcagaagccaaca

SEQ ID NO: 4041878 - RNA, 13 nt, Molluscum contagiosum virus
ggcuccgcuggac

SEQ ID NO: 4041879 - RNA, 15 nt, Molluscum contagiosum virus
ggcuccuucuucagc

SEQ ID NO: 4041880 - RNA, 20 nt, Molluscum contagiosum virus
ggcuccuucuucagcaggcc

SEQ ID NO: 4041881 - RNA, 17 nt, Molluscum contagiosum virus
ggcucgcgccugcgcuu

SEQ ID NO: 4041882 - RNA, 22 nt, Molluscum contagiosum virus
ggcucgcucaucaccgacacgc

SEQ ID NO: 4041883 - RNA, 15 nt, Molluscum contagiosum virus
ggcucguacugcugc

SEQ ID NO: 4041884 - RNA, 16 nt, Molluscum contagiosum virus
ggcucucaacugcagg

SEQ ID NO: 4041885 - RNA, 19 nt, Molluscum contagiosum virus
ggcucugucguugucgccg

SEQ ID NO: 4041886 - RNA, 18 nt, Molluscum contagiosum virus
ggcugauccugcgcgugu

SEQ ID NO: 4041887 - RNA, 15 nt, Molluscum contagiosum virus
ggcugcacgacgguc

SEQ ID NO: 4041888 - RNA, 19 nt, Molluscum contagiosum virus
gcgagcgcccgugcuugcg

SEQ ID NO: 4041889 - RNA, 14 nt, Molluscum contagiosum virus
gcgagcgcucugca

SEQ ID NO: 4041890 - RNA, 20 nt, Molluscum contagiosum virus
gcgagcggcgacuugcugcg

SEQ ID NO: 4041891 - RNA, 14 nt, Molluscum contagiosum virus
gcgagcggcgcgcg

SEQ ID NO: 4041892 - RNA, 19 nt, Molluscum contagiosum virus
gcgagcucgucgcgcgcgu

SEQ ID NO: 4041893 - RNA, 18 nt, Molluscum contagiosum virus
gcgaggccugcguggaca

SEQ ID NO: 4041894 - RNA, 22 nt, Molluscum contagiosum virus
gcgaguaccugggcaggccgcc

SEQ ID NO: 4041895 - RNA, 18 nt, Molluscum contagiosum virus
gcgagucaaugacacgag

SEQ ID NO: 4041896 - RNA, 22 nt, Molluscum contagiosum virus
gcgagucgcccguguucgcgga

SEQ ID NO: 4041897 - RNA, 15 nt, Molluscum contagiosum virus
gcgagucgcgggcgc

SEQ ID NO: 4041898 - RNA, 13 nt, Molluscum contagiosum virus
gcgagugugcaug

SEQ ID NO: 4041899 - RNA, 13 nt, Molluscum contagiosum virus
gcgagugugcgug

SEQ ID NO: 4041900 - RNA, 21 nt, Molluscum contagiosum virus
gcgagugugcgugucucucgu

SEQ ID NO: 4041901 - RNA, 15 nt, Molluscum contagiosum virus
gcgauaggacaugac

SEQ ID NO: 4041902 - RNA, 17 nt, Molluscum contagiosum virus
gcgauggcgccugcuuc

SEQ ID NO: 4041903 - RNA, 16 nt, Molluscum contagiosum virus
gcgauugcccgcgcgc

SEQ ID NO: 4041904 - RNA, 15 nt, Molluscum contagiosum virus
gcgcaaaccucugag

SEQ ID NO: 4041905 - RNA, 23 nt, Molluscum contagiosum virus
gcgcaaaccucugagcgagcgca

SEQ ID NO: 4041906 - RNA, 21 nt, Molluscum contagiosum virus
gcgcaacgucuuccgcgcgcu

SEQ ID NO: 4041907 - RNA, 19 nt, Molluscum contagiosum virus
gcgcaacgugcugcgccgc

SEQ ID NO: 4041908 - RNA, 19 nt, Molluscum contagiosum virus
gcgcaagcaccggcagcgc

SEQ ID NO: 4041909 - RNA, 20 nt, Molluscum contagiosum virus
gcgcaagcagcucggcgaga

SEQ ID NO: 4041910 - RNA, 19 nt, Molluscum contagiosum virus
gcgcaagccgcguaccacc

SEQ ID NO: 4041911 - RNA, 17 nt, Molluscum contagiosum virus
gcgcaaguccagcgcgc

SEQ ID NO: 4041912 - RNA, 18 nt, Molluscum contagiosum virus
gcgcacacuccucggcgc

SEQ ID NO: 4041913 - RNA, 19 nt, Molluscum contagiosum virus
gcgcacacuccucggcgcu

SEQ ID NO: 4041914 - RNA, 21 nt, Molluscum contagiosum virus
gcgcacagacauggcccgcgc

SEQ ID NO: 4041915 - RNA, 16 nt, Molluscum contagiosum virus
gcgcacagacggcgcg

SEQ ID NO: 4041916 - RNA, 20 nt, Molluscum contagiosum virus
gcgcacccgagggcgugcgc

SEQ ID NO: 4041917 - RNA, 21 nt, Molluscum contagiosum virus
gcgcaccugcacgagccggcg

SEQ ID NO: 4041918 - RNA, 14 nt, Molluscum contagiosum virus
gcgcaccugcuaga

SEQ ID NO: 4041919 - RNA, 19 nt, Molluscum contagiosum virus
gcgcaccugcuagagcaua

SEQ ID NO: 4041920 - RNA, 16 nt, Molluscum contagiosum virus
gcgcacgagcgcgggc

SEQ ID NO: 4041921 - RNA, 15 nt, Molluscum contagiosum virus
gcgcacgccagccug

SEQ ID NO: 4041922 - RNA, 16 nt, Molluscum contagiosum virus
gcgcacgcccucgccg

SEQ ID NO: 4041923 - RNA, 18 nt, Molluscum contagiosum virus
gcgcacgcggcucuggag

SEQ ID NO: 4041924 - RNA, 21 nt, Molluscum contagiosum virus
gcgcacgcugcgcacgggcgc

SEQ ID NO: 4041925 - RNA, 18 nt, Molluscum contagiosum virus
gcgcacgcuuguccgcgg

SEQ ID NO: 4041926 - RNA, 22 nt, Molluscum contagiosum virus
gcgcacgcuuguccgcggacgc

SEQ ID NO: 4041927 - RNA, 14 nt, Molluscum contagiosum virus
gcgcacugcucgcg

SEQ ID NO: 4041928 - RNA, 16 nt, Molluscum contagiosum virus
gcgcagaagccaacac

SEQ ID NO: 4041929 - RNA, 15 nt, Molluscum contagiosum virus
gcgcagacgccgagc

SEQ ID NO: 4041930 - RNA, 18 nt, Molluscum contagiosum virus
gcgcagcauucccggcgc

SEQ ID NO: 4041931 - RNA, 21 nt, Molluscum contagiosum virus
gcgcagcauucccggcgcgcg

SEQ ID NO: 4041932 - RNA, 18 nt, Molluscum contagiosum virus
gcgcagcucgccgcgcgc

SEQ ID NO: 4041933 - RNA, 21 nt, Molluscum contagiosum virus
gcgcagcucgccgcgcgccgc

SEQ ID NO: 4041934 - RNA, 17 nt, Molluscum contagiosum virus
gcgcagcugcgccugca

SEQ ID NO: 4041935 - RNA, 21 nt, Molluscum contagiosum virus
gcgcagcuucucugcgaucgc

SEQ ID NO: 4041936 - RNA, 22 nt, Molluscum contagiosum virus
gcgcaggucaucgacgagcacg

SEQ ID NO: 4041937 - RNA, 15 nt, Molluscum contagiosum virus
gcgcagucccagcac

SEQ ID NO: 4041938 - RNA, 17 nt, Molluscum contagiosum virus
gcgcagucccagcaccg

SEQ ID NO: 4041939 - RNA, 13 nt, Molluscum contagiosum virus
gcgcaucaugcgc

SEQ ID NO: 4041940 - RNA, 20 nt, Molluscum contagiosum virus
gcgcaucgcgggcacgcagc

SEQ ID NO: 4041941 - RNA, 14 nt, Molluscum contagiosum virus
gcgcaugcgcgccg

SEQ ID NO: 4041942 - RNA, 15 nt, Molluscum contagiosum virus
gcgcaugcgcgccgc

SEQ ID NO: 4041943 - RNA, 20 nt, Molluscum contagiosum virus
gcgcaugguggcgauccugu

SEQ ID NO: 4041944 - RNA, 13 nt, Molluscum contagiosum virus
gcgccaagaacaa

SEQ ID NO: 4041945 - RNA, 13 nt, Molluscum contagiosum virus
gcgccaaggcgcu

SEQ ID NO: 4041946 - RNA, 20 nt, Molluscum contagiosum virus
gcgccacgagcgccgcgugc

SEQ ID NO: 4041947 - RNA, 22 nt, Molluscum contagiosum virus
gcgccacuagcaaggcgccgcg

SEQ ID NO: 4041948 - RNA, 15 nt, Molluscum contagiosum virus
gcgccagcacgcgcu

SEQ ID NO: 4041949 - RNA, 14 nt, Molluscum contagiosum virus
gcgccauugcucgc

SEQ ID NO: 4041950 - RNA, 16 nt, Molluscum contagiosum virus
gcgcccaacgcccgcg

SEQ ID NO: 4041951 - RNA, 17 nt, Molluscum contagiosum virus
gcgcccgccgcccaagg

SEQ ID NO: 4041952 - RNA, 14 nt, Molluscum contagiosum virus
gcgcccgcggcaca

SEQ ID NO: 4041953 - RNA, 22 nt, Molluscum contagiosum virus
gcgcccgcggcacaugcagcug

SEQ ID NO: 4041954 - RNA, 13 nt, Molluscum contagiosum virus
gcgcccgcggcgc

SEQ ID NO: 4041955 - RNA, 17 nt, Molluscum contagiosum virus
gcgcccgcggcgcacgg

SEQ ID NO: 4041956 - RNA, 17 nt, Molluscum contagiosum virus
gcgcccggugcggcgug

SEQ ID NO: 4041957 - RNA, 20 nt, Molluscum contagiosum virus
gcgcccgugcuugcgcacgg

SEQ ID NO: 4041958 - RNA, 15 nt, Molluscum contagiosum virus
gcgcccucacgugcu

SEQ ID NO: 4041959 - RNA, 15 nt, Molluscum contagiosum virus
gcgcccucgcgcgca

SEQ ID NO: 4041960 - RNA, 19 nt, Molluscum contagiosum virus
gcgcccuuugcggcacggg

SEQ ID NO: 4041961 - RNA, 23 nt, Molluscum contagiosum virus
gcgccgaaguacuuuccucuucg

SEQ ID NO: 4041962 - RNA, 15 nt, Molluscum contagiosum virus
gcgccgacaugcgca

SEQ ID NO: 4041963 - RNA, 13 nt, Molluscum contagiosum virus
gcgccgaggacua

SEQ ID NO: 4041964 - RNA, 23 nt, Molluscum contagiosum virus
gcgccgcacgcugcugcgugcgc

SEQ ID NO: 4041965 - RNA, 18 nt, Molluscum contagiosum virus
gcgccgcacgugcugcgc

SEQ ID NO: 4041966 - RNA, 23 nt, Molluscum contagiosum virus
gcgccgccaugcugcgcgagcgc

SEQ ID NO: 4041967 - RNA, 12 nt, Molluscum contagiosum virus
gcgccgccucgc

SEQ ID NO: 4041968 - RNA, 18 nt, Molluscum contagiosum virus
gcgccgccucgcgcgcac

SEQ ID NO: 4041969 - RNA, 15 nt, Molluscum contagiosum virus
gcgccgcgcgccgcg

SEQ ID NO: 4041970 - RNA, 21 nt, Molluscum contagiosum virus
gcgccgcgcgcgcgcgagggc

SEQ ID NO: 4041971 - RNA, 14 nt, Molluscum contagiosum virus
gcgccgcgugcaug

SEQ ID NO: 4041972 - RNA, 21 nt, Molluscum contagiosum virus
gcgccggaacucgcgcgcgcc

SEQ ID NO: 4041973 - RNA, 19 nt, Molluscum contagiosum virus
gcgccggcgcgcgcgcgca

SEQ ID NO: 4041974 - RNA, 14 nt, Molluscum contagiosum virus
gcgccggcucugcc

SEQ ID NO: 4041975 - RNA, 14 nt, Molluscum contagiosum virus
gcgccuagcuccag

SEQ ID NO: 4041976 - RNA, 16 nt, Molluscum contagiosum virus
gcgccuagcuccagcg

SEQ ID NO: 4041977 - RNA, 14 nt, Molluscum contagiosum virus
gcgccugccgcgca

SEQ ID NO: 4041978 - RNA, 23 nt, Molluscum contagiosum virus
gcgccugccgcgcaugcuggaga

SEQ ID NO: 4041979 - RNA, 18 nt, Molluscum contagiosum virus
gcgccugugccugcaaga

SEQ ID NO: 4041980 - RNA, 15 nt, Molluscum contagiosum virus
gcgccuuccgcgcgg

SEQ ID NO: 4041981 - RNA, 18 nt, Molluscum contagiosum virus
gcgccuuuuccgcgaagu

SEQ ID NO: 4041982 - RNA, 19 nt, Molluscum contagiosum virus
gcgcgacaugcugcccgcg

SEQ ID NO: 4041983 - RNA, 24 nt, Molluscum contagiosum virus
gcgcgaccaguacaucaccgccau

SEQ ID NO: 4041984 - RNA, 14 nt, Molluscum contagiosum virus
gcgcgacgccauca

SEQ ID NO: 4041985 - RNA, 17 nt, Molluscum contagiosum virus
gcgcgacgccgucgaug

SEQ ID NO: 4041986 - RNA, 24 nt, Molluscum contagiosum virus
gcgcgacgucgucaaggauguagc

SEQ ID NO: 4041987 - RNA, 15 nt, Molluscum contagiosum virus
gcgcgacuuggggcu

SEQ ID NO: 4041988 - RNA, 21 nt, Molluscum contagiosum virus
gcgcgacuuguccucaagucg

SEQ ID NO: 4041989 - RNA, 20 nt, Molluscum contagiosum virus
gcgcgagcggagcgggcacg

SEQ ID NO: 4041990 - RNA, 20 nt, Molluscum contagiosum virus
gcgcuggaugcugcucgacg

SEQ ID NO: 4041991 - RNA, 14 nt, Molluscum contagiosum virus
gcgcuggcgugcgc

SEQ ID NO: 4041992 - RNA, 17 nt, Molluscum contagiosum virus
gcgcuguaccggcucag

SEQ ID NO: 4041993 - RNA, 17 nt, Molluscum contagiosum virus
gcgcuguauucggcgua

SEQ ID NO: 4041994 - RNA, 18 nt, Molluscum contagiosum virus
gcgcugugagcgcgccgc

SEQ ID NO: 4041995 - RNA, 17 nt, Molluscum contagiosum virus
gcgcuucugccugcucc

SEQ ID NO: 4041996 - RNA, 14 nt, Molluscum contagiosum virus
gcgcuucuuugcgc

SEQ ID NO: 4041997 - RNA, 17 nt, Molluscum contagiosum virus
gcgcuuguagccgcgac

SEQ ID NO: 4041998 - RNA, 16 nt, Molluscum contagiosum virus
gcgcuuguccucuugg

SEQ ID NO: 4041999 - RNA, 18 nt, Molluscum contagiosum virus
gcgcuuuuuuuguccugu

SEQ ID NO: 4042000 - RNA, 22 nt, Molluscum contagiosum virus
gcggaacuggacgccguugcgc

SEQ ID NO: 4042001 - RNA, 15 nt, Molluscum contagiosum virus
gcggaagacgcgagc

SEQ ID NO: 4042002 - RNA, 20 nt, Molluscum contagiosum virus
gcggacagagcccgcggcgc

SEQ ID NO: 4042003 - RNA, 23 nt, Molluscum contagiosum virus
gcggacgaaagcgucgugugcgc

SEQ ID NO: 4042004 - RNA, 14 nt, Molluscum contagiosum virus
gcggacgaagcugu

SEQ ID NO: 4042005 - RNA, 16 nt, Molluscum contagiosum virus
gcggagaucgccgcgc

SEQ ID NO: 4042006 - RNA, 15 nt, Molluscum contagiosum virus
gcggagcgccuucug

SEQ ID NO: 4042007 - RNA, 21 nt, Molluscum contagiosum virus
gcggagcgcgcacggcagcgg

SEQ ID NO: 4042008 - RNA, 19 nt, Molluscum contagiosum virus
gcggaggucgagcgcgccg

SEQ ID NO: 4042009 - RNA, 13 nt, Molluscum contagiosum virus
gcggaugcucgcu

SEQ ID NO: 4042010 - RNA, 18 nt, Molluscum contagiosum virus
gcggaugcuggcgagcac

SEQ ID NO: 4042011 - RNA, 14 nt, Molluscum contagiosum virus
gcggcaaaggcccg

SEQ ID NO: 4042012 - RNA, 21 nt, Molluscum contagiosum virus
gcggcaaccgcgcccgcgcgc

SEQ ID NO: 4042013 - RNA, 22 nt, Molluscum contagiosum virus
gcggcacacacuugcacgcgca

SEQ ID NO: 4042014 - RNA, 18 nt, Molluscum contagiosum virus
gcggcaccugucgcgcgc

SEQ ID NO: 4042015 - RNA, 23 nt, Molluscum contagiosum virus
gcggcacgccgcucggcacugcu

SEQ ID NO: 4042016 - RNA, 13 nt, Molluscum contagiosum virus
cgcgcaaccagcu

SEQ ID NO: 4042017 - RNA, 21 nt, Molluscum contagiosum virus
cgcgcaaccagcuggcgcccg

SEQ ID NO: 4042018 - RNA, 19 nt, Molluscum contagiosum virus
cgcgcaagaacaaccagac

SEQ ID NO: 4042019 - RNA, 17 nt, Molluscum contagiosum virus
cgcgcaaggccgcgccc

SEQ ID NO: 4042020 - RNA, 18 nt, Molluscum contagiosum virus
cgcgcaaguccagcgcgc

SEQ ID NO: 4042021 - RNA, 16 nt, Molluscum contagiosum virus
cgcgcaagucgcgcgc

SEQ ID NO: 4042022 - RNA, 12 nt, Molluscum contagiosum virus
cgcgcaagugug

SEQ ID NO: 4042023 - RNA, 13 nt, Molluscum contagiosum virus
cgcgcaagugugc

SEQ ID NO: 4042024 - RNA, 12 nt, Molluscum contagiosum virus
cgcgcacaagau

SEQ ID NO: 4042025 - RNA, 14 nt, Molluscum contagiosum virus
cgcgcacgagcugc

SEQ ID NO: 4042026 - RNA, 17 nt, Molluscum contagiosum virus
cgcgcacugccacgcgg

SEQ ID NO: 4042027 - RNA, 20 nt, Molluscum contagiosum virus
cgcgcacugccacgcggagc

SEQ ID NO: 4042028 - RNA, 14 nt, Molluscum contagiosum virus
cgcgcacugcucgc

SEQ ID NO: 4042029 - RNA, 19 nt, Molluscum contagiosum virus
cgcgcacugcucgcgcacg

SEQ ID NO: 4042030 - RNA, 15 nt, Molluscum contagiosum virus
cgcgcagcgcgucuu

SEQ ID NO: 4042031 - RNA, 15 nt, Molluscum contagiosum virus
cgcgcagcugcgccu

SEQ ID NO: 4042032 - RNA, 24 nt, Molluscum contagiosum virus
cgcgcagguugagcgcgcggaugc

SEQ ID NO: 4042033 - RNA, 17 nt, Molluscum contagiosum virus
cgcgcaguucgagcugc

SEQ ID NO: 4042034 - RNA, 22 nt, Molluscum contagiosum virus
cgcgcaguucgagcugcugcgc

SEQ ID NO: 4042035 - RNA, 15 nt, Molluscum contagiosum virus
cgcgcauacgcgccg

SEQ ID NO: 4042036 - RNA, 14 nt, Molluscum contagiosum virus
cgcgcaucugccgc

SEQ ID NO: 4042037 - RNA, 17 nt, Molluscum contagiosum virus
cgcgcaucugccgcgac

SEQ ID NO: 4042038 - RNA, 18 nt, Molluscum contagiosum virus
cgcgcauggagagcguac

SEQ ID NO: 4042039 - RNA, 22 nt, Molluscum contagiosum virus
cgcgccaacacguuuucuuuca

SEQ ID NO: 4042040 - RNA, 22 nt, Molluscum contagiosum virus
cgcgccagcacgcgcucguccg

SEQ ID NO: 4042041 - RNA, 13 nt, Molluscum contagiosum virus
cgcgccagcagcg

SEQ ID NO: 4042042 - RNA, 22 nt, Molluscum contagiosum virus
cgcgccaugguuuccguguccg

SEQ ID NO: 4042043 - RNA, 19 nt, Molluscum contagiosum virus
cgcgcccaccagcagccag

SEQ ID NO: 4042044 - RNA, 17 nt, Molluscum contagiosum virus
cgcgcccagcgccacga

SEQ ID NO: 4042045 - RNA, 21 nt, Molluscum contagiosum virus
cgcgcccaggcgcgcgcucag

SEQ ID NO: 4042046 - RNA, 22 nt, Molluscum contagiosum virus
cgcgcccccgugucggcgaaga

SEQ ID NO: 4042047 - RNA, 14 nt, Molluscum contagiosum virus
cgcgcccgcgcccg

SEQ ID NO: 4042048 - RNA, 17 nt, Molluscum contagiosum virus
cgcgcccgcggcgcacg

SEQ ID NO: 4042049 - RNA, 13 nt, Molluscum contagiosum virus
cgcgcccgcgucg

SEQ ID NO: 4042050 - RNA, 13 nt, Molluscum contagiosum virus
cgcgcccugcacg

SEQ ID NO: 4042051 - RNA, 14 nt, Molluscum contagiosum virus
cgcgcccugcacga

SEQ ID NO: 4042052 - RNA, 14 nt, Molluscum contagiosum virus
cgcgcccugcgcgc

SEQ ID NO: 4042053 - RNA, 18 nt, Molluscum contagiosum virus
cgcgcccuuugcggcacg

SEQ ID NO: 4042054 - RNA, 11 nt, Molluscum contagiosum virus
cgcgccgagua

SEQ ID NO: 4042055 - RNA, 17 nt, Molluscum contagiosum virus
cgcgccgaguacugcug

SEQ ID NO: 4042056 - RNA, 14 nt, Molluscum contagiosum virus
cgcgccgcgccgaa

SEQ ID NO: 4042057 - RNA, 14 nt, Molluscum contagiosum virus
cgcgccgcgcgccg

SEQ ID NO: 4042058 - RNA, 15 nt, Molluscum contagiosum virus
cgcgccgcgcugcug

SEQ ID NO: 4042059 - RNA, 14 nt, Molluscum contagiosum virus
cgcgccgcgcuggc

SEQ ID NO: 4042060 - RNA, 19 nt, Molluscum contagiosum virus
cgcgccgcgggcgcagagc

SEQ ID NO: 4042061 - RNA, 14 nt, Molluscum contagiosum virus
cgcgccgcugcccg

SEQ ID NO: 4042062 - RNA, 20 nt, Molluscum contagiosum virus
cgcgccgcugcccgcgcacg

SEQ ID NO: 4042063 - RNA, 15 nt, Molluscum contagiosum virus
cgcgccgcugcgccg

SEQ ID NO: 4042064 - RNA, 17 nt, Molluscum contagiosum virus
cgcgccgggaaugcugc

SEQ ID NO: 4042065 - RNA, 22 nt, Molluscum contagiosum virus
cgcgccgggaaugcugcgcacg

SEQ ID NO: 4042066 - RNA, 13 nt, Molluscum contagiosum virus
cgcgccgggccgc

SEQ ID NO: 4042067 - RNA, 13 nt, Molluscum contagiosum virus
cgcgccgggcgcc

SEQ ID NO: 4042068 - RNA, 16 nt, Molluscum contagiosum virus
cgcgccucgaacugcu

SEQ ID NO: 4042069 - RNA, 17 nt, Molluscum contagiosum virus
cgcgccucucgaggccg

SEQ ID NO: 4042070 - RNA, 15 nt, Molluscum contagiosum virus
cgcgccugccgccug

SEQ ID NO: 4042071 - RNA, 13 nt, Molluscum contagiosum virus
cgcgccugcucuc

SEQ ID NO: 4042072 - RNA, 23 nt, Molluscum contagiosum virus
cgcgccugucaagacgggcacgc

SEQ ID NO: 4042073 - RNA, 18 nt, Molluscum contagiosum virus
cgcgccuuccgcgcgggc

SEQ ID NO: 4042074 - RNA, 20 nt, Molluscum contagiosum virus
cgcgccuugagcgcgccgcg

SEQ ID NO: 4042075 - RNA, 20 nt, Molluscum contagiosum virus
cgcgcgagaugcgcggacag

SEQ ID NO: 4042076 - RNA, 14 nt, Molluscum contagiosum virus
cgcgcgagcgccgg

SEQ ID NO: 4042077 - RNA, 12 nt, Molluscum contagiosum virus
cgcgcgagcgga

SEQ ID NO: 4042078 - RNA, 13 nt, Molluscum contagiosum virus
cgcgcgagcugcu

SEQ ID NO: 4042079 - RNA, 18 nt, Molluscum contagiosum virus
cgcgcgagggcgcgcugg

SEQ ID NO: 4042080 - RNA, 14 nt, Molluscum contagiosum virus
cguggcgcugggcg

SEQ ID NO: 4042081 - RNA, 19 nt, Molluscum contagiosum virus
cgugggcagcuucugcucg

SEQ ID NO: 4042082 - RNA, 16 nt, Molluscum contagiosum virus
cgugggcgagcgcacg

SEQ ID NO: 4042083 - RNA, 22 nt, Molluscum contagiosum virus
cguggugcuuacugcgggcugc

SEQ ID NO: 4042084 - RNA, 22 nt, Molluscum contagiosum virus
cguguacaugaugcccugguga

SEQ ID NO: 4042085 - RNA, 23 nt, Molluscum contagiosum virus
cguguacaugcucaagcaccugc

SEQ ID NO: 4042086 - RNA, 16 nt, Molluscum contagiosum virus
cguguacgagaaguuc

SEQ ID NO: 4042087 - RNA, 17 nt, Molluscum contagiosum virus
cgugucaagcggcacgu

SEQ ID NO: 4042088 - RNA, 21 nt, Molluscum contagiosum virus
cgugucacaauggcacuagcc

SEQ ID NO: 4042089 - RNA, 13 nt, Molluscum contagiosum virus
cgugucgcggagc

SEQ ID NO: 4042090 - RNA, 22 nt, Molluscum contagiosum virus
cgugucuggagcccacguugcc

SEQ ID NO: 4042091 - RNA, 15 nt, Molluscum contagiosum virus
cguguuggcuucugc

SEQ ID NO: 4042092 - RNA, 13 nt, Molluscum contagiosum virus
cguucaccuuggc

SEQ ID NO: 4042093 - RNA, 16 nt, Molluscum contagiosum virus
cguucccaagcaaagc

SEQ ID NO: 4042094 - RNA, 16 nt, Molluscum contagiosum virus
cguuccgggcccgggc

SEQ ID NO: 4042095 - RNA, 17 nt, Molluscum contagiosum virus
cguucgacggcuggugu

SEQ ID NO: 4042096 - RNA, 17 nt, Molluscum contagiosum virus
cguucgcgcgccaguac

SEQ ID NO: 4042097 - RNA, 17 nt, Molluscum contagiosum virus
cguugcacgugcgugcc

SEQ ID NO: 4042098 - RNA, 16 nt, Molluscum contagiosum virus
cguugccgagcgagca

SEQ ID NO: 4042099 - RNA, 16 nt, Molluscum contagiosum virus
cguugccgcgcgcugc

SEQ ID NO: 4042100 - RNA, 13 nt, Molluscum contagiosum virus
cguugcugcugcg

SEQ ID NO: 4042101 - RNA, 13 nt, Molluscum contagiosum virus
cguuggcgcgccc

SEQ ID NO: 4042102 - RNA, 14 nt, Molluscum contagiosum virus
cguuggcgcgcccg

SEQ ID NO: 4042103 - RNA, 11 nt, Molluscum contagiosum virus
cguugucuuua

SEQ ID NO: 4042104 - RNA, 14 nt, Molluscum contagiosum virus
cguugugcuccuug

SEQ ID NO: 4042105 - RNA, 14 nt, Molluscum contagiosum virus
cguuugucgcgggc

SEQ ID NO: 4042106 - RNA, 21 nt, Molluscum contagiosum virus
cuaaauaaugaaccugcacgc

SEQ ID NO: 4042107 - RNA, 17 nt, Molluscum contagiosum virus
cuacacauuccucggcg

SEQ ID NO: 4042108 - RNA, 17 nt, Molluscum contagiosum virus
cuacagcagccgcagcc

SEQ ID NO: 4042109 - RNA, 15 nt, Molluscum contagiosum virus
cuacagcgcgcugca

SEQ ID NO: 4042110 - RNA, 23 nt, Molluscum contagiosum virus
cuacagcgcgcugcacaccgagc

SEQ ID NO: 4042111 - RNA, 20 nt, Molluscum contagiosum virus
cuaccacgggcccgcgcgug

SEQ ID NO: 4042112 - RNA, 16 nt, Molluscum contagiosum virus
cuaccacgucggcgag

SEQ ID NO: 4042113 - RNA, 14 nt, Molluscum contagiosum virus
cuaccgucgccggu

SEQ ID NO: 4042114 - RNA, 23 nt, Molluscum contagiosum virus
cuaccugcgcaagcucagccucu

SEQ ID NO: 4042115 - RNA, 18 nt, Molluscum contagiosum virus
cuaccuggcggcgcugga

SEQ ID NO: 4042116 - RNA, 21 nt, Molluscum contagiosum virus
cuaccuggcggcgcuggagac

SEQ ID NO: 4042117 - RNA, 18 nt, Molluscum contagiosum virus
cuaccuggugcuggggcu

SEQ ID NO: 4042118 - RNA, 19 nt, Molluscum contagiosum virus
cuaccugguggagcacuuc

SEQ ID NO: 4042119 - RNA, 19 nt, Molluscum contagiosum virus
cuacgacaugcucgcgcuc

SEQ ID NO: 4042120 - RNA, 13 nt, Molluscum contagiosum virus
cuacgagcagcgc

SEQ ID NO: 4042121 - RNA, 23 nt, Molluscum contagiosum virus
cuacgaggccuacgugcugcgca

SEQ ID NO: 4042122 - RNA, 20 nt, Molluscum contagiosum virus
cuacgcaagcugaggcgugc

SEQ ID NO: 4042123 - RNA, 13 nt, Molluscum contagiosum virus
cuacgcagcgcgc

SEQ ID NO: 4042124 - RNA, 13 nt, Molluscum contagiosum virus
cuacgcgcgcgug

SEQ ID NO: 4042125 - RNA, 15 nt, Molluscum contagiosum virus
cuacgcgcugcuaga

SEQ ID NO: 4042126 - RNA, 21 nt, Molluscum contagiosum virus
cuacggcgaguucugccggcu

SEQ ID NO: 4042127 - RNA, 21 nt, Molluscum contagiosum virus
cuacguguccgcauccgccuu

SEQ ID NO: 4042128 - RNA, 20 nt, Molluscum contagiosum virus
cuacugcgcgcacugcucgc

SEQ ID NO: 4042129 - RNA, 17 nt, Molluscum contagiosum virus
cuacuucgaggccggca

SEQ ID NO: 4042130 - RNA, 20 nt, Molluscum contagiosum virus
cuagaagaccacauccuuga

SEQ ID NO: 4042131 - RNA, 15 nt, Molluscum contagiosum virus
cuagacaaggggcca

SEQ ID NO: 4042132 - RNA, 20 nt, Molluscum contagiosum virus
cuagacacgagcgcggcaac

SEQ ID NO: 4042133 - RNA, 14 nt, Molluscum contagiosum virus
cuagacuggagcac

SEQ ID NO: 4042134 - RNA, 21 nt, Molluscum contagiosum virus
cuagagcuggcaccgggcgcc

SEQ ID NO: 4042135 - RNA, 20 nt, Molluscum contagiosum virus
cuagaguacuagguggcaug

SEQ ID NO: 4042136 - RNA, 18 nt, Molluscum contagiosum virus
cuagcaccgcaugggccc

SEQ ID NO: 4042137 - RNA, 19 nt, Molluscum contagiosum virus
cuagcagcgugcgcaccag

SEQ ID NO: 4042138 - RNA, 13 nt, Molluscum contagiosum virus
cuagccccagcac

SEQ ID NO: 4042139 - RNA, 16 nt, Molluscum contagiosum virus
cuagccccagcaccag

SEQ ID NO: 4042140 - RNA, 16 nt, Molluscum contagiosum virus
cuagcucugcgcgcgg

SEQ ID NO: 4042141 - RNA, 14 nt, Molluscum contagiosum virus
cuaggccucagccg

SEQ ID NO: 4042142 - RNA, 17 nt, Molluscum contagiosum virus
cuagugcacgcccuuau

SEQ ID NO: 4042143 - RNA, 19 nt, Molluscum contagiosum virus
cuagugcagaugaggcugc

SEQ ID NO: 4042144 - RNA, 18 nt, Molluscum contagiosum virus
cuagugcgcgccaagaac

SEQ ID NO: 4042145 - RNA, 15 nt, Molluscum contagiosum virus
cuagugcugcugggc

SEQ ID NO: 4042146 - RNA, 19 nt, Molluscum contagiosum virus
cuaguggcaagggccugcg

SEQ ID NO: 4042147 - RNA, 13 nt, Molluscum contagiosum virus
cuauugcgcggcg

SEQ ID NO: 4042148 - RNA, 16 nt, Molluscum contagiosum virus
cucaacaagcugcugg

SEQ ID NO: 4042149 - RNA, 14 nt, Molluscum contagiosum virus
cucaagcacugccu

SEQ ID NO: 4042150 - RNA, 16 nt, Molluscum contagiosum virus
cucaccuuccugggcg

SEQ ID NO: 4042151 - RNA, 12 nt, Molluscum contagiosum virus
cucacgcccucu

SEQ ID NO: 4042152 - RNA, 17 nt, Molluscum contagiosum virus
cucacgcuucguggcca

SEQ ID NO: 4042153 - RNA, 16 nt, Molluscum contagiosum virus
cucacggcgagcgcgc

SEQ ID NO: 4042154 - RNA, 13 nt, Molluscum contagiosum virus
cucacggcugugg

SEQ ID NO: 4042155 - RNA, 14 nt, Molluscum contagiosum virus
cucacugcagcagc

SEQ ID NO: 4042156 - RNA, 16 nt, Molluscum contagiosum virus
cucagcacgcgcacag

SEQ ID NO: 4042157 - RNA, 13 nt, Molluscum contagiosum virus
cucagcaggcugu

SEQ ID NO: 4042158 - RNA, 20 nt, Molluscum contagiosum virus
cucagcggcacugcgcgcau

SEQ ID NO: 4042159 - RNA, 22 nt, Molluscum contagiosum virus
cucagcggcacugcgcgcaugc

SEQ ID NO: 4042160 - RNA, 14 nt, Molluscum contagiosum virus
cucauagcgccacg

SEQ ID NO: 4042161 - RNA, 15 nt, Molluscum contagiosum virus
cucauccucccugcg

SEQ ID NO: 4042162 - RNA, 17 nt, Molluscum contagiosum virus
cuccaacguuuucggcu

SEQ ID NO: 4042163 - RNA, 15 nt, Molluscum contagiosum virus
cuccaagaagaggcc

SEQ ID NO: 4042164 - RNA, 18 nt, Molluscum contagiosum virus
cuccaagaagaggccagc

SEQ ID NO: 4042165 - RNA, 22 nt, Molluscum contagiosum virus
cuccaagaagaggccagcacaa

SEQ ID NO: 4042166 - RNA, 12 nt, Molluscum contagiosum virus
cuccaaggaggu

SEQ ID NO: 4042167 - RNA, 16 nt, Molluscum contagiosum virus
cuccacgcgcagcuuc

SEQ ID NO: 4042168 - RNA, 19 nt, Molluscum contagiosum virus
cuccacgcugcguucgagc

SEQ ID NO: 4042169 - RNA, 20 nt, Molluscum contagiosum virus
cuccacgcugcguucgagcu

SEQ ID NO: 4042170 - RNA, 18 nt, Molluscum contagiosum virus
cuccagaaucgcuuugcc

SEQ ID NO: 4042171 - RNA, 13 nt, Molluscum contagiosum virus
cuccaggaacgcg

SEQ ID NO: 4042172 - RNA, 17 nt, Molluscum contagiosum virus
cuccaggaacgcgccgc

SEQ ID NO: 4042173 - RNA, 16 nt, Molluscum contagiosum virus
cuccaugagguacucc

SEQ ID NO: 4042174 - RNA, 13 nt, Molluscum contagiosum virus
cuccaugcugccg

SEQ ID NO: 4042175 - RNA, 13 nt, Molluscum contagiosum virus
cucccagcagcgu

SEQ ID NO: 4042176 - RNA, 14 nt, Molluscum contagiosum virus
cucccgucgagcac

SEQ ID NO: 4042177 - RNA, 13 nt, Molluscum contagiosum virus
cucccugcgggcg

SEQ ID NO: 4042178 - RNA, 19 nt, Molluscum contagiosum virus
cuccgacgugcugcgcaac

SEQ ID NO: 4042179 - RNA, 22 nt, Molluscum contagiosum virus
cuccgagcgcgcgcgcugcugg

SEQ ID NO: 4042180 - RNA, 13 nt, Molluscum contagiosum virus
cuccgaggcaggu

SEQ ID NO: 4042181 - RNA, 16 nt, Molluscum contagiosum virus
cuccgagucgcgccuc

SEQ ID NO: 4042182 - RNA, 14 nt, Molluscum contagiosum virus
cuccgcacacgcgc

SEQ ID NO: 4042183 - RNA, 15 nt, Molluscum contagiosum virus
cuccgcacacgcgcg

SEQ ID NO: 4042184 - RNA, 22 nt, Molluscum contagiosum virus
cuccgcacacgcgcgcgugcug

SEQ ID NO: 4042185 - RNA, 21 nt, Molluscum contagiosum virus
aaaaagcugucgcgcagcagc

SEQ ID NO: 4042186 - RNA, 17 nt, Molluscum contagiosum virus
aaaacacaaaaauaagu

SEQ ID NO: 4042187 - RNA, 18 nt, Molluscum contagiosum virus
aaaacgcgcggcagcagc

SEQ ID NO: 4042188 - RNA, 21 nt, Molluscum contagiosum virus
aaaagcaaguaccagccgcug

SEQ ID NO: 4042189 - RNA, 17 nt, Molluscum contagiosum virus
aaacacgcuacgcagcg

SEQ ID NO: 4042190 - RNA, 14 nt, Molluscum contagiosum virus
aaacgcacuguguu

SEQ ID NO: 4042191 - RNA, 23 nt, Molluscum contagiosum virus
aaacguguuggcgcgguccgcgu

SEQ ID NO: 4042192 - RNA, 17 nt, Molluscum contagiosum virus
aaacuccguacagcucc

SEQ ID NO: 4042193 - RNA, 14 nt, Molluscum contagiosum virus
aaacugcauccugg

SEQ ID NO: 4042194 - RNA, 15 nt, Molluscum contagiosum virus
aaacugugcuccuga

SEQ ID NO: 4042195 - RNA, 22 nt, Molluscum contagiosum virus
aaagacgagcugugcgagccag

SEQ ID NO: 4042196 - RNA, 23 nt, Molluscum contagiosum virus
aaagacgagcugugcgagccagu

SEQ ID NO: 4042197 - RNA, 22 nt, Molluscum contagiosum virus
aaagacggacccgcgaacgagg

SEQ ID NO: 4042198 - RNA, 15 nt, Molluscum contagiosum virus
aaagagcguccagcc

SEQ ID NO: 4042199 - RNA, 15 nt, Molluscum contagiosum virus
aaagaggccugcuga

SEQ ID NO: 4042200 - RNA, 19 nt, Molluscum contagiosum virus
aaagcccuccugagaagca

SEQ ID NO: 4042201 - RNA, 14 nt, Molluscum contagiosum virus
aaagcgcacacuug

SEQ ID NO: 4042202 - RNA, 22 nt, Molluscum contagiosum virus
aaagcugcuggcggagacacuc

SEQ ID NO: 4042203 - RNA, 18 nt, Molluscum contagiosum virus
aaagguacccgcaggaaa

SEQ ID NO: 4042204 - RNA, 18 nt, Molluscum contagiosum virus
aaaucuguucgagcaaca

SEQ ID NO: 4042205 - RNA, 12 nt, Molluscum contagiosum virus
aaaugcgcugcu

SEQ ID NO: 4042206 - RNA, 20 nt, Molluscum contagiosum virus
aaaugguguacgaaaguacu

SEQ ID NO: 4042207 - RNA, 12 nt, Molluscum contagiosum virus
aacaagcugcug

SEQ ID NO: 4042208 - RNA, 21 nt, Molluscum contagiosum virus
aacaaggaaaggcacccgcag

SEQ ID NO: 4042209 - RNA, 23 nt, Molluscum contagiosum virus
aacaaguuccccgugagcgcgcu

SEQ ID NO: 4042210 - RNA, 21 nt, Molluscum contagiosum virus
aacaccagcgugcccuucucc

SEQ ID NO: 4042211 - RNA, 17 nt, Molluscum contagiosum virus
aacacugacgcucgggc

SEQ ID NO: 4042212 - RNA, 20 nt, Molluscum contagiosum virus
aacacugacgcucgggccgg

SEQ ID NO: 4042213 - RNA, 17 nt, Molluscum contagiosum virus
aacagagaaaggcaccc

SEQ ID NO: 4042214 - RNA, 22 nt, Molluscum contagiosum virus
aacagagaaaggcacccaccag

SEQ ID NO: 4042215 - RNA, 15 nt, Molluscum contagiosum virus
aacagcgcaagcuga

SEQ ID NO: 4042216 - RNA, 12 nt, Molluscum contagiosum virus
aacagucgcgcg

SEQ ID NO: 4042217 - RNA, 14 nt, Molluscum contagiosum virus
aaccacagcucucc

SEQ ID NO: 4042218 - RNA, 17 nt, Molluscum contagiosum virus
aaccuacuugcucgugu

SEQ ID NO: 4042219 - RNA, 23 nt, Molluscum contagiosum virus
aaccucugagcgagcgcaguugu

SEQ ID NO: 4042220 - RNA, 17 nt, Molluscum contagiosum virus
aaccugggcgccgcgcu

SEQ ID NO: 4042221 - RNA, 11 nt, Molluscum contagiosum virus
aacgaccucaa

SEQ ID NO: 4042222 - RNA, 12 nt, Molluscum contagiosum virus
aacgagggaugc

SEQ ID NO: 4042223 - RNA, 21 nt, Molluscum contagiosum virus
aacgcaaguacaacccaaaca

SEQ ID NO: 4042224 - RNA, 17 nt, Molluscum contagiosum virus
aacgcgagacgggcacg

SEQ ID NO: 4042225 - RNA, 18 nt, Molluscum contagiosum virus
aacgcgcgcgugcugucc

SEQ ID NO: 4042226 - RNA, 15 nt, Molluscum contagiosum virus
aacgcgcgugcgcgu

SEQ ID NO: 4042227 - RNA, 19 nt, Molluscum contagiosum virus
aacguagacagugcggcgc

SEQ ID NO: 4042228 - RNA, 15 nt, Molluscum contagiosum virus
aacgucgcacuggcc

SEQ ID NO: 4042229 - RNA, 19 nt, Molluscum contagiosum virus
aacgugcugcgccgccugc

SEQ ID NO: 4042230 - RNA, 20 nt, Molluscum contagiosum virus
aacgugggcaccugcaucgc

SEQ ID NO: 4042231 - RNA, 23 nt, Molluscum contagiosum virus
aacuaagcuaaaagagcugcugc

SEQ ID NO: 4042232 - RNA, 17 nt, Molluscum contagiosum virus
aacucacggaugcgcgc

SEQ ID NO: 4042233 - RNA, 19 nt, Molluscum contagiosum virus
aacucggcuucugcugcac

SEQ ID NO: 4042234 - RNA, 20 nt, Molluscum contagiosum virus
aacucuccgacgugcugcgc

SEQ ID NO: 4042235 - RNA, 21 nt, Molluscum contagiosum virus
aagaacagucgcgcgccugcc

SEQ ID NO: 4042236 - RNA, 21 nt, Molluscum contagiosum virus
aagaagcagcagaccaagaag

SEQ ID NO: 4042237 - RNA, 15 nt, Molluscum contagiosum virus
aagaagcccaaggag

SEQ ID NO: 4042238 - RNA, 14 nt, Molluscum contagiosum virus
aagaccaccagcac

SEQ ID NO: 4042239 - RNA, 15 nt, Molluscum contagiosum virus
aagacgggcccgcga

SEQ ID NO: 4042240 - RNA, 15 nt, Molluscum contagiosum virus
aagacggggccgcga

SEQ ID NO: 4042241 - RNA, 16 nt, Molluscum contagiosum virus
aagacuggcucagaac

SEQ ID NO: 4042242 - RNA, 20 nt, Molluscum contagiosum virus
aagagcacgaugcccagcag

SEQ ID NO: 4042243 - RNA, 19 nt, Molluscum contagiosum virus
aagauacuuccgguguccc

SEQ ID NO: 4042244 - RNA, 15 nt, Molluscum contagiosum virus
aagauccaagcgcaa

SEQ ID NO: 4042245 - RNA, 14 nt, Molluscum contagiosum virus
aagcacugccucau

SEQ ID NO: 4042246 - RNA, 17 nt, Molluscum contagiosum virus
aagcauggucuucgcgc

SEQ ID NO: 4042247 - RNA, 17 nt, Molluscum contagiosum virus
aagccaccgcgcaggac

SEQ ID NO: 4042248 - RNA, 17 nt, Molluscum contagiosum virus
aagcccggaagcuugcu

SEQ ID NO: 4042249 - RNA, 21 nt, Molluscum contagiosum virus
aagcgccgcucgguacaacuu

SEQ ID NO: 4042250 - RNA, 23 nt, Molluscum contagiosum virus
aagcgccggcgaccagcucuugg

SEQ ID NO: 4042251 - RNA, 13 nt, Molluscum contagiosum virus
aagcgcgucugca

SEQ ID NO: 4042252 - RNA, 16 nt, Molluscum contagiosum virus
aagcuaaaagagcugc

SEQ ID NO: 4042253 - RNA, 15 nt, Molluscum contagiosum virus
aagcucaagcccggc

SEQ ID NO: 4042254 - RNA, 23 nt, Molluscum contagiosum virus
aagcucgcgcugcugacacgcuc

SEQ ID NO: 4042255 - RNA, 23 nt, Molluscum contagiosum virus
aagcugcucaucggcgagcucuu

SEQ ID NO: 4042256 - RNA, 23 nt, Molluscum contagiosum virus
aagcuggcgggugccgugccccu

SEQ ID NO: 4042257 - RNA, 18 nt, Molluscum contagiosum virus
aagcuucgggccgcugcc

SEQ ID NO: 4042258 - RNA, 21 nt, Molluscum contagiosum virus
aaggagcccgucuacauuuug

SEQ ID NO: 4042259 - RNA, 19 nt, Molluscum contagiosum virus
aaggauuuaaauggcgcgc

SEQ ID NO: 4042260 - RNA, 12 nt, Molluscum contagiosum virus
aaggcacacccc

SEQ ID NO: 4042261 - RNA, 16 nt, Molluscum contagiosum virus
aaggcacccgcaggaa

SEQ ID NO: 4042262 - RNA, 17 nt, Molluscum contagiosum virus
aaggcacccgcaggaaa

SEQ ID NO: 4042263 - RNA, 20 nt, Molluscum contagiosum virus
aaggcacccgcaggaaaggc

SEQ ID NO: 4042264 - RNA, 17 nt, Molluscum contagiosum virus
aaggcaccugcaggaaa

SEQ ID NO: 4042265 - RNA, 19 nt, Molluscum contagiosum virus
aaggcgguggcggcucugc

SEQ ID NO: 4042266 - RNA, 16 nt, Molluscum contagiosum virus
aaggcgugcgccgugc

SEQ ID NO: 4042267 - RNA, 16 nt, Molluscum contagiosum virus
aagggcggucccgcga

SEQ ID NO: 4042268 - RNA, 17 nt, Molluscum contagiosum virus
aagguaccccgcaggaa

SEQ ID NO: 4042269 - RNA, 12 nt, Molluscum contagiosum virus
aagguggggcgc

SEQ ID NO: 4042270 - RNA, 19 nt, Molluscum contagiosum virus
aaguacaacccaaacaugu

SEQ ID NO: 4042271 - RNA, 14 nt, Molluscum contagiosum virus
aaguaccagccgcu

SEQ ID NO: 4042272 - RNA, 13 nt, Molluscum contagiosum virus
aagucgaagaggg

SEQ ID NO: 4042273 - RNA, 14 nt, Molluscum contagiosum virus
aagucgaagagggu

SEQ ID NO: 4042274 - RNA, 20 nt, Molluscum contagiosum virus
aaguuguuccggugaaaauc

SEQ ID NO: 4042275 - RNA, 13 nt, Molluscum contagiosum virus
aaugcgcaaggcc

SEQ ID NO: 4042276 - RNA, 22 nt, Molluscum contagiosum virus
aaugcgguucacuagcgcaggc

SEQ ID NO: 4042277 - RNA, 17 nt, Molluscum contagiosum virus
aaugcugccguguacgu

SEQ ID NO: 4042278 - RNA, 21 nt, Molluscum contagiosum virus
aauggccuugcgagcgcugcc

SEQ ID NO: 4042279 - RNA, 18 nt, Molluscum contagiosum virus
aauggggcaaacgcugac

SEQ ID NO: 4042280 - RNA, 16 nt, Molluscum contagiosum virus
aauguguacgacgcgc

SEQ ID NO: 4042281 - RNA, 20 nt, Molluscum contagiosum virus
acaacuacuucgaggccggc

SEQ ID NO: 4042282 - RNA, 11 nt, Molluscum contagiosum virus
acaacuuuucc

SEQ ID NO: 4042283 - RNA, 23 nt, Molluscum contagiosum virus
acaagcagccgcaguaccaguac

SEQ ID NO: 4042284 - RNA, 11 nt, Molluscum contagiosum virus
acaagcugcac

SEQ ID NO: 4042285 - RNA, 19 nt, Molluscum contagiosum virus
acaagcugcaccggcgcga

SEQ ID NO: 4042286 - RNA, 20 nt, Molluscum contagiosum virus
acaaggagggagagcugccc

SEQ ID NO: 4042287 - RNA, 16 nt, Molluscum contagiosum virus
acaaggugcuguccuu

SEQ ID NO: 4042288 - RNA, 21 nt, Molluscum contagiosum virus
acaaucucgccggcuguaaau

SEQ ID NO: 4042289 - RNA, 15 nt, Molluscum contagiosum virus
acacccgugcccgcu

SEQ ID NO: 4042290 - RNA, 23 nt, Molluscum contagiosum virus
acacgacgacggcugcucgcugc

SEQ ID NO: 4042291 - RNA, 15 nt, Molluscum contagiosum virus
acacgcacuggcgcu

SEQ ID NO: 4042292 - RNA, 13 nt, Molluscum contagiosum virus
acacgcgcggcgg

SEQ ID NO: 4042293 - RNA, 16 nt, Molluscum contagiosum virus
acacgcgcggcggaga

SEQ ID NO: 4042294 - RNA, 19 nt, Molluscum contagiosum virus
acacguugcagcagcacag

SEQ ID NO: 4042295 - RNA, 21 nt, Molluscum contagiosum virus
acacucacgcguccacaaaga

SEQ ID NO: 4042296 - RNA, 21 nt, Molluscum contagiosum virus
acacucgcgcguccgcaaaga

SEQ ID NO: 4042297 - RNA, 21 nt, Molluscum contagiosum virus
acagacgaugacgaggagcug

SEQ ID NO: 4042298 - RNA, 17 nt, Molluscum contagiosum virus
acagagaaaggcaccca

SEQ ID NO: 4042299 - RNA, 20 nt, Molluscum contagiosum virus
acagagaaaggcacccacca

SEQ ID NO: 4042300 - RNA, 12 nt, Molluscum contagiosum virus
acagagcccgcg

SEQ ID NO: 4042301 - RNA, 16 nt, Molluscum contagiosum virus
acagcaagcagcgcgc

SEQ ID NO: 4042302 - RNA, 19 nt, Molluscum contagiosum virus
acagcaggagcacgccugg

SEQ ID NO: 4042303 - RNA, 15 nt, Molluscum contagiosum virus
acagccccugcugcu

SEQ ID NO: 4042304 - RNA, 15 nt, Molluscum contagiosum virus
acagccgccugccgc

SEQ ID NO: 4042305 - RNA, 21 nt, Molluscum contagiosum virus
acagcguguucggggccgcga

SEQ ID NO: 4042306 - RNA, 14 nt, Molluscum contagiosum virus
acagcucuucgucu

SEQ ID NO: 4042307 - RNA, 12 nt, Molluscum contagiosum virus
acagcuuccugg

SEQ ID NO: 4042308 - RNA, 19 nt, Molluscum contagiosum virus
acaggcgcggcagccgcag

SEQ ID NO: 4042309 - RNA, 22 nt, Molluscum contagiosum virus
acagguagugguccaccagcug

SEQ ID NO: 4042310 - RNA, 20 nt, Molluscum contagiosum virus
acagugcggcgcggcugcuc

SEQ ID NO: 4042311 - RNA, 15 nt, Molluscum contagiosum virus
acaucuaugcacggc

SEQ ID NO: 4042312 - RNA, 17 nt, Molluscum contagiosum virus
acaugaccaagcacauu

SEQ ID NO: 4042313 - RNA, 23 nt, Molluscum contagiosum virus
acaugcacacucacgcguccaca

SEQ ID NO: 4042314 - RNA, 20 nt, Molluscum contagiosum virus
acaugcgcacgcgcgucaug

SEQ ID NO: 4042315 - RNA, 16 nt, Molluscum contagiosum virus
acaugcgugcuagccc

SEQ ID NO: 4042316 - RNA, 21 nt, Molluscum contagiosum virus
acaugcucaagcaccugcgcu

SEQ ID NO: 4042317 - RNA, 23 nt, Molluscum contagiosum virus
acauggacgugcugcuggcccug

SEQ ID NO: 4042318 - RNA, 17 nt, Molluscum contagiosum virus
acauggagcgcaucaug

SEQ ID NO: 4042319 - RNA, 13 nt, Molluscum contagiosum virus
acauguccaagaa

SEQ ID NO: 4042320 - RNA, 16 nt, Molluscum contagiosum virus
acauugccuuuugcac

SEQ ID NO: 4042321 - RNA, 17 nt, Molluscum contagiosum virus
acauugcugcugcaggc

SEQ ID NO: 4042322 - RNA, 15 nt, Molluscum contagiosum virus
accaagaagcccgag

SEQ ID NO: 4042323 - RNA, 14 nt, Molluscum contagiosum virus
accacgugcgcugg

SEQ ID NO: 4042324 - RNA, 14 nt, Molluscum contagiosum virus
accagauguucucg

SEQ ID NO: 4042325 - RNA, 12 nt, Molluscum contagiosum virus
accagcagccag

SEQ ID NO: 4042326 - RNA, 14 nt, Molluscum contagiosum virus
accaggaacaggga

SEQ ID NO: 4042327 - RNA, 20 nt, Molluscum contagiosum virus
accaugcucucgcugcugcc

SEQ ID NO: 4042328 - RNA, 21 nt, Molluscum contagiosum virus
accaugcucucgcugcugccc

SEQ ID NO: 4042329 - RNA, 22 nt, Molluscum contagiosum virus
accccagugcgagaucgacugc

SEQ ID NO: 4042330 - RNA, 21 nt, Molluscum contagiosum virus
accccgaaaggcacccgcagg

SEQ ID NO: 4042331 - RNA, 13 nt, Molluscum contagiosum virus
accccgagggcgc

SEQ ID NO: 4042332 - RNA, 10 nt, Molluscum contagiosum virus
accccgccgc

SEQ ID NO: 4042333 - RNA, 22 nt, Molluscum contagiosum virus
acccgcgcucgacgcgugcaug

SEQ ID NO: 4042334 - RNA, 21 nt, Molluscum contagiosum virus
acccgcggcucucgcggcccu

SEQ ID NO: 4042335 - RNA, 15 nt, Molluscum contagiosum virus
acccgugcgcgcgcu

SEQ ID NO: 4042336 - RNA, 15 nt, Molluscum contagiosum virus
accgaucccggccgc

SEQ ID NO: 4042337 - RNA, 14 nt, Molluscum contagiosum virus
accgcaccgagccc

SEQ ID NO: 4042338 - RNA, 20 nt, Molluscum contagiosum virus
accgccguacccggggagaa

SEQ ID NO: 4042339 - RNA, 22 nt, Molluscum contagiosum virus
accgcgagcgcaugcgcgccgc

SEQ ID NO: 4042340 - RNA, 21 nt, Molluscum contagiosum virus
accgcgcgaacgaggagggca

SEQ ID NO: 4042341 - RNA, 21 nt, Molluscum contagiosum virus
accgcgcgcgcaagcgccgcu

SEQ ID NO: 4042342 - RNA, 21 nt, Molluscum contagiosum virus
accgcggacuccuuucggugg

SEQ ID NO: 4042343 - RNA, 13 nt, Molluscum contagiosum virus
accgcgugcgugc

SEQ ID NO: 4042344 - RNA, 16 nt, Molluscum contagiosum virus
accgcuagagugcgcg

SEQ ID NO: 4042345 - RNA, 19 nt, Molluscum contagiosum virus
accggagacaccagcuccg

SEQ ID NO: 4042346 - RNA, 20 nt, Molluscum contagiosum virus
accggcaagcuucgggccgc

SEQ ID NO: 4042347 - RNA, 13 nt, Molluscum contagiosum virus
accgggcgccgcg

SEQ ID NO: 4042348 - RNA, 12 nt, Molluscum contagiosum virus
accgggcucucg

SEQ ID NO: 4042349 - RNA, 21 nt, Molluscum contagiosum virus
accguacucgcguccgcgcag

SEQ ID NO: 4042350 - RNA, 20 nt, Molluscum contagiosum virus
accgucaaccugcugccucc

SEQ ID NO: 4042351 - RNA, 21 nt, Molluscum contagiosum virus
accgugcccuggaccuccauc

SEQ ID NO: 4042352 - RNA, 19 nt, Molluscum contagiosum virus
accuacaugaguuucuggu

SEQ ID NO: 4042353 - RNA, 14 nt, Molluscum contagiosum virus
accuagagcacgaa

SEQ ID NO: 4042354 - RNA, 18 nt, Molluscum contagiosum virus
accucaccgcgcacaucu

SEQ ID NO: 4042355 - RNA, 13 nt, Molluscum contagiosum virus
accuccuucgcgu

SEQ ID NO: 4042356 - RNA, 18 nt, Molluscum contagiosum virus
accucgagaagaccuguu

SEQ ID NO: 4042357 - RNA, 14 nt, Molluscum contagiosum virus
accucgcgcgccgc

SEQ ID NO: 4042358 - RNA, 13 nt, Molluscum contagiosum virus
accucgcgcuucc

SEQ ID NO: 4042359 - RNA, 18 nt, Molluscum contagiosum virus
accucugagcgagcgcag

SEQ ID NO: 4042360 - RNA, 18 nt, Molluscum contagiosum virus
accucuuucucgcgccgu

SEQ ID NO: 4042361 - RNA, 22 nt, Molluscum contagiosum virus
accugauuuucccgggcggcgc

SEQ ID NO: 4042362 - RNA, 23 nt, Molluscum contagiosum virus
accugcaggaaaggcacccgcag

SEQ ID NO: 4042363 - RNA, 22 nt, Molluscum contagiosum virus
accugcaggcucuaagcgcacg

SEQ ID NO: 4042364 - RNA, 20 nt, Molluscum contagiosum virus
accugcgacagcugcugcuc

SEQ ID NO: 4042365 - RNA, 14 nt, Molluscum contagiosum virus
ugacgagcgcgugc

SEQ ID NO: 4042366 - RNA, 14 nt, Molluscum contagiosum virus
ugacgccgcgcgcg

SEQ ID NO: 4042367 - RNA, 16 nt, Molluscum contagiosum virus
ugacgcgcggcggcgc

SEQ ID NO: 4042368 - RNA, 14 nt, Molluscum contagiosum virus
ugacggcagcaagc

SEQ ID NO: 4042369 - RNA, 15 nt, Molluscum contagiosum virus
ugacucggacacugg

SEQ ID NO: 4042370 - RNA, 21 nt, Molluscum contagiosum virus
ugacugugucgacuucaccuu

SEQ ID NO: 4042371 - RNA, 13 nt, Molluscum contagiosum virus
ugagagcaaagaa

SEQ ID NO: 4042372 - RNA, 20 nt, Molluscum contagiosum virus
ugagcaagcugcaagccagc

SEQ ID NO: 4042373 - RNA, 17 nt, Molluscum contagiosum virus
ugagcccagaacauguc

SEQ ID NO: 4042374 - RNA, 14 nt, Molluscum contagiosum virus
ugagcgcgcugcgc

SEQ ID NO: 4042375 - RNA, 18 nt, Molluscum contagiosum virus
ugagcuagugccgagcuc

SEQ ID NO: 4042376 - RNA, 21 nt, Molluscum contagiosum virus
ugagcucuuuguacacccgug

SEQ ID NO: 4042377 - RNA, 21 nt, Molluscum contagiosum virus
ugaggaggccaacgccagcug

SEQ ID NO: 4042378 - RNA, 22 nt, Molluscum contagiosum virus
ugaggaggccaacgccagcugu

SEQ ID NO: 4042379 - RNA, 18 nt, Molluscum contagiosum virus
ugaggaggcggcacugcu

SEQ ID NO: 4042380 - RNA, 13 nt, Molluscum contagiosum virus
ugagugcgcgcac

SEQ ID NO: 4042381 - RNA, 15 nt, Molluscum contagiosum virus
ugagugcgggucaca

SEQ ID NO: 4042382 - RNA, 16 nt, Molluscum contagiosum virus
ugaucaccgaggagcc

SEQ ID NO: 4042383 - RNA, 20 nt, Molluscum contagiosum virus
ugaucgcgcaggcgcgccau

SEQ ID NO: 4042384 - RNA, 13 nt, Molluscum contagiosum virus
ugaugcuuuuguu

SEQ ID NO: 4042385 - RNA, 14 nt, Molluscum contagiosum virus
ugauuugcgcacca

SEQ ID NO: 4042386 - RNA, 18 nt, Molluscum contagiosum virus
ugcaacgcaggacacugu

SEQ ID NO: 4042387 - RNA, 21 nt, Molluscum contagiosum virus
ugcaacucgcgcugcagcacc

SEQ ID NO: 4042388 - RNA, 22 nt, Molluscum contagiosum virus
ugcaagcacaacgggcucgugc

SEQ ID NO: 4042389 - RNA, 15 nt, Molluscum contagiosum virus
ugcaagcccagcagc

SEQ ID NO: 4042390 - RNA, 13 nt, Molluscum contagiosum virus
ugcaaggagguca

SEQ ID NO: 4042391 - RNA, 14 nt, Molluscum contagiosum virus
ugcaaggcgcgcgc

SEQ ID NO: 4042392 - RNA, 14 nt, Molluscum contagiosum virus
ugcaaucugcgcuc

SEQ ID NO: 4042393 - RNA, 16 nt, Molluscum contagiosum virus
ugcacaagcaggaguc

SEQ ID NO: 4042394 - RNA, 21 nt, Molluscum contagiosum virus
ugcacagccgcuuucugggcg

SEQ ID NO: 4042395 - RNA, 20 nt, Molluscum contagiosum virus
ugcacgacguacgagugcug

SEQ ID NO: 4042396 - RNA, 20 nt, Molluscum contagiosum virus
ugcacgcacgcgcucuccag

SEQ ID NO: 4042397 - RNA, 18 nt, Molluscum contagiosum virus
ugcacgccgccagcgacg

SEQ ID NO: 4042398 - RNA, 16 nt, Molluscum contagiosum virus
ugcacgcggcgcgugu

SEQ ID NO: 4042399 - RNA, 13 nt, Molluscum contagiosum virus
ugcacucgcgcuc

SEQ ID NO: 4042400 - RNA, 19 nt, Molluscum contagiosum virus
ugcacuuucaacucucuac

SEQ ID NO: 4042401 - RNA, 15 nt, Molluscum contagiosum virus
ugcagaacagcacgu

SEQ ID NO: 4042402 - RNA, 18 nt, Molluscum contagiosum virus
ugcagcacgucuugcgcg

SEQ ID NO: 4042403 - RNA, 15 nt, Molluscum contagiosum virus
ugcagcagcacaggu

SEQ ID NO: 4042404 - RNA, 16 nt, Molluscum contagiosum virus
ugcagccgcugcugcu

SEQ ID NO: 4042405 - RNA, 12 nt, Molluscum contagiosum virus
ugcagcgcccgg

SEQ ID NO: 4042406 - RNA, 19 nt, Molluscum contagiosum virus
ugcagcugcgcgagccgcu

SEQ ID NO: 4042407 - RNA, 22 nt, Molluscum contagiosum virus
ugcagcuguccaaggugaacga

SEQ ID NO: 4042408 - RNA, 22 nt, Molluscum contagiosum virus
ugcaggaggaccgcgagcgcau

SEQ ID NO: 4042409 - RNA, 18 nt, Molluscum contagiosum virus
ugcaggauuuccucgcgg

SEQ ID NO: 4042410 - RNA, 20 nt, Molluscum contagiosum virus
ugcaggccccuacacgcaac

SEQ ID NO: 4042411 - RNA, 23 nt, Molluscum contagiosum virus
ugcaggccgagaugagcggcgcc

SEQ ID NO: 4042412 - RNA, 20 nt, Molluscum contagiosum virus
ugcaucuuugccuucgugga

SEQ ID NO: 4042413 - RNA, 17 nt, Molluscum contagiosum virus
ugcaugacggcgcgagc

SEQ ID NO: 4042414 - RNA, 22 nt, Molluscum contagiosum virus
ugccaagaccugggcgucgugc

SEQ ID NO: 4042415 - RNA, 22 nt, Molluscum contagiosum virus
ugccaagguucuggacgugucc

SEQ ID NO: 4042416 - RNA, 22 nt, Molluscum contagiosum virus
ugccagaagcccugagaaggag

SEQ ID NO: 4042417 - RNA, 22 nt, Molluscum contagiosum virus
ugccagcgagcucaaggacauc

SEQ ID NO: 4042418 - RNA, 24 nt, Molluscum contagiosum virus
ugccagcgccagccugcuggcacc

SEQ ID NO: 4042419 - RNA, 16 nt, Molluscum contagiosum virus
ugccagcgccucugcg

SEQ ID NO: 4042420 - RNA, 21 nt, Molluscum contagiosum virus
ugccaggcggucuuccagcac

SEQ ID NO: 4042421 - RNA, 19 nt, Molluscum contagiosum virus
ugccagucgcgccucgcau

SEQ ID NO: 4042422 - RNA, 22 nt, Molluscum contagiosum virus
ugcccccaccgggguccgcucc

SEQ ID NO: 4042423 - RNA, 13 nt, Molluscum contagiosum virus
ugccccgcgcgcc

SEQ ID NO: 4042424 - RNA, 19 nt, Molluscum contagiosum virus
ugccccgcgcguugcugcc

SEQ ID NO: 4042425 - RNA, 20 nt, Molluscum contagiosum virus
ugccccguccucgcucgugc

SEQ ID NO: 4042426 - RNA, 15 nt, Molluscum contagiosum virus
aaacacugucucugc

SEQ ID NO: 4042427 - RNA, 20 nt, Molluscum contagiosum virus
aaacgcacagccccugcugc

SEQ ID NO: 4042428 - RNA, 20 nt, Molluscum contagiosum virus
aaacgcgaaacuggacugag

SEQ ID NO: 4042429 - RNA, 21 nt, Molluscum contagiosum virus
aaacugcugcccgcgcagcgc

SEQ ID NO: 4042430 - RNA, 16 nt, Molluscum contagiosum virus
aaacuggacugagccg

SEQ ID NO: 4042431 - RNA, 20 nt, Molluscum contagiosum virus
aaagaccgugucugguguau

SEQ ID NO: 4042432 - RNA, 18 nt, Molluscum contagiosum virus
aaagccagacgcagagcc

SEQ ID NO: 4042433 - RNA, 23 nt, Molluscum contagiosum virus
aaagcgccgcgcgcggcuaagcu

SEQ ID NO: 4042434 - RNA, 23 nt, Molluscum contagiosum virus
aaaggaguuggcgcgcaagcgcu

SEQ ID NO: 4042435 - RNA, 18 nt, Molluscum contagiosum virus
aaaggcacccaccaggaa

SEQ ID NO: 4042436 - RNA, 23 nt, Molluscum contagiosum virus
aaaggcacccgcaacaaggaaag

SEQ ID NO: 4042437 - RNA, 15 nt, Molluscum contagiosum virus
aaagggcggccgcag

SEQ ID NO: 4042438 - RNA, 19 nt, Molluscum contagiosum virus
aaagguaccccgcaggaaa

SEQ ID NO: 4042439 - RNA, 20 nt, Molluscum contagiosum virus
aaaguacuugccgucacggc

SEQ ID NO: 4042440 - RNA, 13 nt, Molluscum contagiosum virus
aaagucaucugcc

SEQ ID NO: 4042441 - RNA, 13 nt, Molluscum contagiosum virus
aaagucuuccugg

SEQ ID NO: 4042442 - RNA, 16 nt, Molluscum contagiosum virus
aaauagcaugucacgc

SEQ ID NO: 4042443 - RNA, 16 nt, Molluscum contagiosum virus
aaauaugaaccacuuc

SEQ ID NO: 4042444 - RNA, 17 nt, Molluscum contagiosum virus
aaaucccaagagccaug

SEQ ID NO: 4042445 - RNA, 15 nt, Molluscum contagiosum virus
aaaugcgcacacuug

SEQ ID NO: 4042446 - RNA, 21 nt, Molluscum contagiosum virus
aaaugguguacgaaaguacuu

SEQ ID NO: 4042447 - RNA, 16 nt, Molluscum contagiosum virus
aacaagacgaacaugu

SEQ ID NO: 4042448 - RNA, 21 nt, Molluscum contagiosum virus
aacaagcguuuucgucaugga

SEQ ID NO: 4042449 - RNA, 22 nt, Molluscum contagiosum virus
aacaagcugcuggcacaaaucg

SEQ ID NO: 4042450 - RNA, 11 nt, Molluscum contagiosum virus
aacaaggccaa

SEQ ID NO: 4042451 - RNA, 16 nt, Molluscum contagiosum virus
aacacgcaaucgcgcg

SEQ ID NO: 4042452 - RNA, 20 nt, Molluscum contagiosum virus
aacacgcuguugcugcugcc

SEQ ID NO: 4042453 - RNA, 23 nt, Molluscum contagiosum virus
aacacgcuguugcugcugccgcg

SEQ ID NO: 4042454 - RNA, 16 nt, Molluscum contagiosum virus
aacagcagcuggcgcg

SEQ ID NO: 4042455 - RNA, 16 nt, Molluscum contagiosum virus
aacagcuuggcacagu

SEQ ID NO: 4042456 - RNA, 13 nt, Molluscum contagiosum virus
aaccacagcucuc

SEQ ID NO: 4042457 - RNA, 17 nt, Molluscum contagiosum virus
aaccagcuggcgcccgc

SEQ ID NO: 4042458 - RNA, 16 nt, Molluscum contagiosum virus
aaccuacgcuaccuga

SEQ ID NO: 4042459 - RNA, 12 nt, Molluscum contagiosum virus
aacgaaaagcca

SEQ ID NO: 4042460 - RNA, 11 nt, Molluscum contagiosum virus
aacgacagacc

SEQ ID NO: 4042461 - RNA, 14 nt, Molluscum contagiosum virus
aacgacuagcgugc

SEQ ID NO: 4042462 - RNA, 14 nt, Molluscum contagiosum virus
aacgagcagcccgu

SEQ ID NO: 4042463 - RNA, 13 nt, Molluscum contagiosum virus
aacgggcucgugc

SEQ ID NO: 4042464 - RNA, 16 nt, Molluscum contagiosum virus
aacuagggagcggcau

SEQ ID NO: 4042465 - RNA, 14 nt, Molluscum contagiosum virus
aacuagugcugcug

SEQ ID NO: 4042466 - RNA, 21 nt, Molluscum contagiosum virus
aacuccggcgucgaaacacug

SEQ ID NO: 4042467 - RNA, 18 nt, Molluscum contagiosum virus
aacucggcuucugcugca

SEQ ID NO: 4042468 - RNA, 19 nt, Molluscum contagiosum virus
aacugcgucucaagacaag

SEQ ID NO: 4042469 - RNA, 13 nt, Molluscum contagiosum virus
aacugcugggcgu

SEQ ID NO: 4042470 - RNA, 13 nt, Molluscum contagiosum virus
aagacaacacucg

SEQ ID NO: 4042471 - RNA, 19 nt, Molluscum contagiosum virus
aagaccugcuuccuccucc

SEQ ID NO: 4042472 - RNA, 14 nt, Molluscum contagiosum virus
aagacgagcugugc

SEQ ID NO: 4042473 - RNA, 17 nt, Molluscum contagiosum virus
aagacggaguuggagac

SEQ ID NO: 4042474 - RNA, 21 nt, Molluscum contagiosum virus
aagacggggccgcgaaagagg

SEQ ID NO: 4042475 - RNA, 14 nt, Molluscum contagiosum virus
aagacuugccgucu

SEQ ID NO: 4042476 - RNA, 21 nt, Molluscum contagiosum virus
aagagaccuggagguacuguc

SEQ ID NO: 4042477 - RNA, 21 nt, Molluscum contagiosum virus
aagagcacgaugcccagcagc

SEQ ID NO: 4042478 - RNA, 20 nt, Molluscum contagiosum virus
aagagcccgcacacgccgcg

SEQ ID NO: 4042479 - RNA, 15 nt, Molluscum contagiosum virus
aagagcgcgccucuc

SEQ ID NO: 4042480 - RNA, 20 nt, Molluscum contagiosum virus
aagaggaaagcgcacacuug

SEQ ID NO: 4042481 - RNA, 18 nt, Molluscum contagiosum virus
aagaggccagcacaagcc

SEQ ID NO: 4042482 - RNA, 15 nt, Molluscum contagiosum virus
aagaggggagccagc

SEQ ID NO: 4042483 - RNA, 16 nt, Molluscum contagiosum virus
aagaggugcgugcccc

SEQ ID NO: 4042484 - RNA, 19 nt, Molluscum contagiosum virus
aagaucgcgguggcaggcg

SEQ ID NO: 4042485 - RNA, 21 nt, Molluscum contagiosum virus
aagcaccgccugcugcagcuc

SEQ ID NO: 4042486 - RNA, 17 nt, Molluscum contagiosum virus
aagcacggaaacacucg

SEQ ID NO: 4042487 - RNA, 12 nt, Molluscum contagiosum virus
aagcagccgcag

SEQ ID NO: 4042488 - RNA, 21 nt, Molluscum contagiosum virus
aagcagcgugucaagcggcac

SEQ ID NO: 4042489 - RNA, 11 nt, Molluscum contagiosum virus
aagcagcucgg

SEQ ID NO: 4042490 - RNA, 18 nt, Molluscum contagiosum virus
aagcagguggccgcgcgc

SEQ ID NO: 4042491 - RNA, 17 nt, Molluscum contagiosum virus
aagcaucaugaaagaac

SEQ ID NO: 4042492 - RNA, 20 nt, Molluscum contagiosum virus
aagcauccaggccuucgggc

SEQ ID NO: 4042493 - RNA, 13 nt, Molluscum contagiosum virus
aagcccagcagcg

SEQ ID NO: 4042494 - RNA, 12 nt, Molluscum contagiosum virus
aagccugcugcg

SEQ ID NO: 4042495 - RNA, 23 nt, Molluscum contagiosum virus
aagcgcgcucgggcuagcaagca

SEQ ID NO: 4042496 - RNA, 21 nt, Molluscum contagiosum virus
aagcgcguucgcgcgugcugg

SEQ ID NO: 4042497 - RNA, 18 nt, Molluscum contagiosum virus
aagcguacgcgucgcgga

SEQ ID NO: 4042498 - RNA, 22 nt, Molluscum contagiosum virus
aagcguuuucgucauggagcag

SEQ ID NO: 4042499 - RNA, 17 nt, Molluscum contagiosum virus
aagcucgaggcgcuugg

SEQ ID NO: 4042500 - RNA, 19 nt, Molluscum contagiosum virus
aaggaaaaggcacaccccg

SEQ ID NO: 4042501 - RNA, 13 nt, Molluscum contagiosum virus
aaggaagcaacaa

SEQ ID NO: 4042502 - RNA, 16 nt, Molluscum contagiosum virus
aaggacguccuguagc

SEQ ID NO: 4042503 - RNA, 15 nt, Molluscum contagiosum virus
aaggagcccaagcac

SEQ ID NO: 4042504 - RNA, 18 nt, Molluscum contagiosum virus
aaggcaaagccugcugcg

SEQ ID NO: 4042505 - RNA, 21 nt, Molluscum contagiosum virus
aaggcaccccgaaggaaaggc

SEQ ID NO: 4042506 - RNA, 15 nt, Molluscum contagiosum virus
aaggcgggcccgcga

SEQ ID NO: 4042507 - RNA, 24 nt, Molluscum contagiosum virus
aaguacaugaggcagugcuugagc

SEQ ID NO: 4042508 - RNA, 23 nt, Molluscum contagiosum virus
aaguacuuuccucuucggcgucc

SEQ ID NO: 4042509 - RNA, 23 nt, Molluscum contagiosum virus
aagucguuugcucggggcugucg

SEQ ID NO: 4042510 - RNA, 17 nt, Molluscum contagiosum virus
aagucucucagcggcac

SEQ ID NO: 4042511 - RNA, 12 nt, Molluscum contagiosum virus
aagugcgcgugu

SEQ ID NO: 4042512 - RNA, 13 nt, Molluscum contagiosum virus
aagugcuccgcac

SEQ ID NO: 4042513 - RNA, 15 nt, Molluscum contagiosum virus
aaguguacuauuaca

SEQ ID NO: 4042514 - RNA, 21 nt, Molluscum contagiosum virus
aauacggugcagccgcugcug

SEQ ID NO: 4042515 - RNA, 17 nt, Molluscum contagiosum virus
aauagcuggggcaaaga

SEQ ID NO: 4042516 - RNA, 18 nt, Molluscum contagiosum virus
aauccaugucgagcccug

SEQ ID NO: 4042517 - RNA, 16 nt, Molluscum contagiosum virus
aaugaaccggcaagcu

SEQ ID NO: 4042518 - RNA, 15 nt, Molluscum contagiosum virus
aaugcgagcaaggcg

SEQ ID NO: 4042519 - RNA, 20 nt, Molluscum contagiosum virus
aaugcgguucacuagcgcag

SEQ ID NO: 4042520 - RNA, 16 nt, Molluscum contagiosum virus
aaugcgucccagcagc

SEQ ID NO: 4042521 - RNA, 13 nt, Molluscum contagiosum virus
aauuccgugucgu

SEQ ID NO: 4042522 - RNA, 22 nt, Molluscum contagiosum virus
ugaaaagcuauccgcugucuga

SEQ ID NO: 4042523 - RNA, 18 nt, Molluscum contagiosum virus
ugaaacaguaggacaugu

SEQ ID NO: 4042524 - RNA, 20 nt, Molluscum contagiosum virus
acaacaaguuccccgugagc

SEQ ID NO: 4042525 - RNA, 14 nt, Molluscum contagiosum virus
acaacgacagagcc

SEQ ID NO: 4042526 - RNA, 14 nt, Molluscum contagiosum virus
acaacgugcugcuc

SEQ ID NO: 4042527 - RNA, 14 nt, Molluscum contagiosum virus
acaagccguccgcc

SEQ ID NO: 4042528 - RNA, 18 nt, Molluscum contagiosum virus
acaagcguguucgugccg

SEQ ID NO: 4042529 - RNA, 20 nt, Molluscum contagiosum virus
acaagggcagcucaagcugc

SEQ ID NO: 4042530 - RNA, 15 nt, Molluscum contagiosum virus
acacacacacacucg

SEQ ID NO: 4042531 - RNA, 22 nt, Molluscum contagiosum virus
acacagaaguugccgcaggaac

SEQ ID NO: 4042532 - RNA, 16 nt, Molluscum contagiosum virus
acaccacacgcgcggc

SEQ ID NO: 4042533 - RNA, 23 nt, Molluscum contagiosum virus
acaccgagaucaugggcgugcuc

SEQ ID NO: 4042534 - RNA, 13 nt, Molluscum contagiosum virus
acaccggcgcgcu

SEQ ID NO: 4042535 - RNA, 20 nt, Molluscum contagiosum virus
acaccuggcgagcgcucugc

SEQ ID NO: 4042536 - RNA, 22 nt, Molluscum contagiosum virus
acaccuggcgagcgcucugcau

SEQ ID NO: 4042537 - RNA, 12 nt, Molluscum contagiosum virus
acaccugugccc

SEQ ID NO: 4042538 - RNA, 13 nt, Molluscum contagiosum virus
acacgagggccuu

SEQ ID NO: 4042539 - RNA, 22 nt, Molluscum contagiosum virus
acacgagggccuuggcggcgcg

SEQ ID NO: 4042540 - RNA, 21 nt, Molluscum contagiosum virus
acacgaggggcaagcucgcgc

SEQ ID NO: 4042541 - RNA, 19 nt, Molluscum contagiosum virus
acacgagugcccgcgcgcu

SEQ ID NO: 4042542 - RNA, 20 nt, Molluscum contagiosum virus
acacgccgggaaacgcacag

SEQ ID NO: 4042543 - RNA, 17 nt, Molluscum contagiosum virus
acacgcucuucggcacg

SEQ ID NO: 4042544 - RNA, 18 nt, Molluscum contagiosum virus
acacgcugcgcgugcugg

SEQ ID NO: 4042545 - RNA, 14 nt, Molluscum contagiosum virus
acacgcuggcgaag

SEQ ID NO: 4042546 - RNA, 18 nt, Molluscum contagiosum virus
acacgcuguugcugcugc

SEQ ID NO: 4042547 - RNA, 19 nt, Molluscum contagiosum virus
acacgcuguugcugcugcc

SEQ ID NO: 4042548 - RNA, 15 nt, Molluscum contagiosum virus
acacggccuccagca

SEQ ID NO: 4042549 - RNA, 15 nt, Molluscum contagiosum virus
acacucgcggcaagu

SEQ ID NO: 4042550 - RNA, 22 nt, Molluscum contagiosum virus
acacucggcaugugcgcaccgc

SEQ ID NO: 4042551 - RNA, 16 nt, Molluscum contagiosum virus
acacucgugcucgugu

SEQ ID NO: 4042552 - RNA, 18 nt, Molluscum contagiosum virus
acacuugcacgcgcacgc

SEQ ID NO: 4042553 - RNA, 14 nt, Molluscum contagiosum virus
acagagugccuggc

SEQ ID NO: 4042554 - RNA, 15 nt, Molluscum contagiosum virus
acagaugccacgacc

SEQ ID NO: 4042555 - RNA, 16 nt, Molluscum contagiosum virus
acagcaucgggcuguc

SEQ ID NO: 4042556 - RNA, 20 nt, Molluscum contagiosum virus
acagcaugaacucgcugcug

SEQ ID NO: 4042557 - RNA, 23 nt, Molluscum contagiosum virus
acagcaugaacucgcugcugcuc

SEQ ID NO: 4042558 - RNA, 13 nt, Molluscum contagiosum virus
acagcccccucuu

SEQ ID NO: 4042559 - RNA, 16 nt, Molluscum contagiosum virus
acagccccugcugcuc

SEQ ID NO: 4042560 - RNA, 18 nt, Molluscum contagiosum virus
acagccccugcugcucgc

SEQ ID NO: 4042561 - RNA, 23 nt, Molluscum contagiosum virus
acagccccugcugcucgcggagg

SEQ ID NO: 4042562 - RNA, 19 nt, Molluscum contagiosum virus
acagccgcuuucugggcgc

SEQ ID NO: 4042563 - RNA, 13 nt, Molluscum contagiosum virus
acagccguggagu

SEQ ID NO: 4042564 - RNA, 13 nt, Molluscum contagiosum virus
acagcgcgcgugc

SEQ ID NO: 4042565 - RNA, 15 nt, Molluscum contagiosum virus
acagcuugcugcugu

SEQ ID NO: 4042566 - RNA, 17 nt, Molluscum contagiosum virus
acaguccagcccgcggu

SEQ ID NO: 4042567 - RNA, 21 nt, Molluscum contagiosum virus
acagucuccacgcgugcgcgc

SEQ ID NO: 4042568 - RNA, 23 nt, Molluscum contagiosum virus
acaucuacuuccugccuguggga

SEQ ID NO: 4042569 - RNA, 17 nt, Molluscum contagiosum virus
acaugaucgacgaggac

SEQ ID NO: 4042570 - RNA, 21 nt, Molluscum contagiosum virus
acaugcaacgcaggacacugu

SEQ ID NO: 4042571 - RNA, 17 nt, Molluscum contagiosum virus
acaugccgcgcugcucc

SEQ ID NO: 4042572 - RNA, 18 nt, Molluscum contagiosum virus
acaugccuuucuuccaga

SEQ ID NO: 4042573 - RNA, 20 nt, Molluscum contagiosum virus
acaugcgugcuagcccgcac

SEQ ID NO: 4042574 - RNA, 16 nt, Molluscum contagiosum virus
acaugcuguccaccuc

SEQ ID NO: 4042575 - RNA, 17 nt, Molluscum contagiosum virus
acaugcugugcggcacg

SEQ ID NO: 4042576 - RNA, 20 nt, Molluscum contagiosum virus
acaugucguaccugguggcc

SEQ ID NO: 4042577 - RNA, 17 nt, Molluscum contagiosum virus
acauguugugcucgugu

SEQ ID NO: 4042578 - RNA, 16 nt, Molluscum contagiosum virus
accacagucggugcca

SEQ ID NO: 4042579 - RNA, 18 nt, Molluscum contagiosum virus
accaccagguacuccuug

SEQ ID NO: 4042580 - RNA, 18 nt, Molluscum contagiosum virus
accacgagcguguccagg

SEQ ID NO: 4042581 - RNA, 16 nt, Molluscum contagiosum virus
accacgguccugggcg

SEQ ID NO: 4042582 - RNA, 17 nt, Molluscum contagiosum virus
accacuccgucgcgcuc

SEQ ID NO: 4042583 - RNA, 22 nt, Molluscum contagiosum virus
accagaaccuucuucgucgugc

SEQ ID NO: 4042584 - RNA, 21 nt, Molluscum contagiosum virus
accagagugacgucuuccaga

SEQ ID NO: 4042585 - RNA, 14 nt, Molluscum contagiosum virus
accagcaccagcac

SEQ ID NO: 4042586 - RNA, 14 nt, Molluscum contagiosum virus
accagcagccaggc

SEQ ID NO: 4042587 - RNA, 15 nt, Molluscum contagiosum virus
accagccgcugcgcc

SEQ ID NO: 4042588 - RNA, 19 nt, Molluscum contagiosum virus
accagcgcggccguggcug

SEQ ID NO: 4042589 - RNA, 23 nt, Molluscum contagiosum virus
accagcuacgagccgcugcuccu

SEQ ID NO: 4042590 - RNA, 14 nt, Molluscum contagiosum virus
accagcucgcgccg

SEQ ID NO: 4042591 - RNA, 15 nt, Molluscum contagiosum virus
accagcucgcgccgc

SEQ ID NO: 4042592 - RNA, 19 nt, Molluscum contagiosum virus
accagcucgcgccgccgcg

SEQ ID NO: 4042593 - RNA, 13 nt, Molluscum contagiosum virus
accagcugccgcu

SEQ ID NO: 4042594 - RNA, 19 nt, Molluscum contagiosum virus
accagcuggacggugcugg

SEQ ID NO: 4042595 - RNA, 23 nt, Molluscum contagiosum virus
accagugccgacgugugccgcuc

SEQ ID NO: 4042596 - RNA, 13 nt, Molluscum contagiosum virus
accagugcgccuc

SEQ ID NO: 4042597 - RNA, 14 nt, Molluscum contagiosum virus
accaucaucgcgcu

SEQ ID NO: 4042598 - RNA, 20 nt, Molluscum contagiosum virus
accaugcggcguacgcgcag

SEQ ID NO: 4042599 - RNA, 18 nt, Molluscum contagiosum virus
accauggcgcgcucuuuu

SEQ ID NO: 4042600 - RNA, 17 nt, Molluscum contagiosum virus
acccaucggagaagugc

SEQ ID NO: 4042601 - RNA, 23 nt, Molluscum contagiosum virus
accccgagcuggugauccuggau

SEQ ID NO: 4042602 - RNA, 18 nt, Molluscum contagiosum virus
accccgagguucuccaga

SEQ ID NO: 4042603 - RNA, 22 nt, Molluscum contagiosum virus
accccucgugcugggccugccg

SEQ ID NO: 4042604 - RNA, 15 nt, Molluscum contagiosum virus
accccuugcuacagg

SEQ ID NO: 4042605 - RNA, 17 nt, Molluscum contagiosum virus
acccgagggcgugcgcu

SEQ ID NO: 4042606 - RNA, 17 nt, Molluscum contagiosum virus
acccgcaggaaaggcac

SEQ ID NO: 4042607 - RNA, 23 nt, Molluscum contagiosum virus
acccgcaggaaagguacccgcag

SEQ ID NO: 4042608 - RNA, 17 nt, Molluscum contagiosum virus
acccgugcccgcuccgc

SEQ ID NO: 4042609 - RNA, 12 nt, Molluscum contagiosum virus
acccgugcuugc

SEQ ID NO: 4042610 - RNA, 16 nt, Molluscum contagiosum virus
acccguggccgagccg

SEQ ID NO: 4042611 - RNA, 15 nt, Molluscum contagiosum virus
acccucagaccagag

SEQ ID NO: 4042612 - RNA, 15 nt, Molluscum contagiosum virus
acccuggcagccgag

SEQ ID NO: 4042613 - RNA, 15 nt, Molluscum contagiosum virus
acccuggcugcugcg

SEQ ID NO: 4042614 - RNA, 16 nt, Molluscum contagiosum virus
acccuggcugcugcgc

SEQ ID NO: 4042615 - RNA, 19 nt, Molluscum contagiosum virus
acccuuaauaaaaaaucaa

SEQ ID NO: 4042616 - RNA, 18 nt, Molluscum contagiosum virus
acccuuggcagcaacugc

SEQ ID NO: 4042617 - RNA, 21 nt, Molluscum contagiosum virus
accgacguuuucuuugcgcuc

SEQ ID NO: 4042618 - RNA, 14 nt, Molluscum contagiosum virus
accgcaaccagcug

SEQ ID NO: 4042619 - RNA, 18 nt, Molluscum contagiosum virus
accgcaaccagcugcugu

SEQ ID NO: 4042620 - RNA, 19 nt, Molluscum contagiosum virus
accgcauuuguguugccga

SEQ ID NO: 4042621 - RNA, 13 nt, Molluscum contagiosum virus
accgccugcucuc

SEQ ID NO: 4042622 - RNA, 17 nt, Molluscum contagiosum virus
accgccugcugcagcuc

SEQ ID NO: 4042623 - RNA, 21 nt, Molluscum contagiosum virus
accgccuguaccugcucgggc

SEQ ID NO: 4042624 - RNA, 17 nt, Molluscum contagiosum virus
acgcgcggcagcagccu

SEQ ID NO: 4042625 - RNA, 19 nt, Molluscum contagiosum virus
acgcgcggcagcagccucg

SEQ ID NO: 4042626 - RNA, 12 nt, Molluscum contagiosum virus
acgcgcugcgcc

SEQ ID NO: 4042627 - RNA, 14 nt, Molluscum contagiosum virus
acgcgcugcgccac

SEQ ID NO: 4042628 - RNA, 14 nt, Molluscum contagiosum virus
acgcgcugcuagag

SEQ ID NO: 4042629 - RNA, 13 nt, Molluscum contagiosum virus
aggaaaaggcaca

SEQ ID NO: 4042630 - RNA, 21 nt, Molluscum contagiosum virus
aggaaaggcacccaccaggaa

SEQ ID NO: 4042631 - RNA, 23 nt, Molluscum contagiosum virus
aggaaaggcaccccgaaggaaag

SEQ ID NO: 4042632 - RNA, 16 nt, Molluscum contagiosum virus
aggaaaggcaccccgc

SEQ ID NO: 4042633 - RNA, 18 nt, Molluscum contagiosum virus
aggaaaggcacccgcagg

SEQ ID NO: 4042634 - RNA, 16 nt, Molluscum contagiosum virus
aggaaaggccccccgc

SEQ ID NO: 4042635 - RNA, 23 nt, Molluscum contagiosum virus
aggaaagguaccccgcaggaaag

SEQ ID NO: 4042636 - RNA, 17 nt, Molluscum contagiosum virus
aggaagggcccgcggcu

SEQ ID NO: 4042637 - RNA, 15 nt, Molluscum contagiosum virus
aggacaucuacaucg

SEQ ID NO: 4042638 - RNA, 19 nt, Molluscum contagiosum virus
aggacgcguucuccaggaa

SEQ ID NO: 4042639 - RNA, 12 nt, Molluscum contagiosum virus
aggacuaccugg

SEQ ID NO: 4042640 - RNA, 22 nt, Molluscum contagiosum virus
aggacuagcauuccuucacaca

SEQ ID NO: 4042641 - RNA, 14 nt, Molluscum contagiosum virus
aggagacguagagc

SEQ ID NO: 4042642 - RNA, 18 nt, Molluscum contagiosum virus
aggagacguagagcagcg

SEQ ID NO: 4042643 - RNA, 14 nt, Molluscum contagiosum virus
aggagcugcgcgag

SEQ ID NO: 4042644 - RNA, 13 nt, Molluscum contagiosum virus
aggaggagaacuc

SEQ ID NO: 4042645 - RNA, 23 nt, Molluscum contagiosum virus
aggaguagcgugcgccugcagcc

SEQ ID NO: 4042646 - RNA, 14 nt, Molluscum contagiosum virus
aggaucccugcccg

SEQ ID NO: 4042647 - RNA, 18 nt, Molluscum contagiosum virus
aggaucggagcgcagcug

SEQ ID NO: 4042648 - RNA, 20 nt, Molluscum contagiosum virus
aggaucggagcgcagcugcc

SEQ ID NO: 4042649 - RNA, 15 nt, Molluscum contagiosum virus
aggaugcuggggcuc

SEQ ID NO: 4042650 - RNA, 17 nt, Molluscum contagiosum virus
aggaugcuggugucgag

SEQ ID NO: 4042651 - RNA, 18 nt, Molluscum contagiosum virus
aggauuuaaauggcgcgc

SEQ ID NO: 4042652 - RNA, 13 nt, Molluscum contagiosum virus
aggcacaccccgg

SEQ ID NO: 4042653 - RNA, 14 nt, Molluscum contagiosum virus
aggcacccaccagg

SEQ ID NO: 4042654 - RNA, 18 nt, Molluscum contagiosum virus
aggcacccgcaacaagga

SEQ ID NO: 4042655 - RNA, 21 nt, Molluscum contagiosum virus
agugccacguacuugcugguu

SEQ ID NO: 4042656 - RNA, 22 nt, Molluscum contagiosum virus
agugccacguacuugcugguug

SEQ ID NO: 4042657 - RNA, 18 nt, Molluscum contagiosum virus
agugccgcucgcuguccu

SEQ ID NO: 4042658 - RNA, 18 nt, Molluscum contagiosum virus
agugccgcugagagacuu

SEQ ID NO: 4042659 - RNA, 22 nt, Molluscum contagiosum virus
agugcgagaucgacugcgccuu

SEQ ID NO: 4042660 - RNA, 15 nt, Molluscum contagiosum virus
agugcgcgugcgccu

SEQ ID NO: 4042661 - RNA, 14 nt, Molluscum contagiosum virus
agugcgugccaggc

SEQ ID NO: 4042662 - RNA, 23 nt, Molluscum contagiosum virus
aguggacaagcuagacuggagca

SEQ ID NO: 4042663 - RNA, 19 nt, Molluscum contagiosum virus
aguggccgcuccagagccg

SEQ ID NO: 4042664 - RNA, 15 nt, Molluscum contagiosum virus
aguggccgucgcgag

SEQ ID NO: 4042665 - RNA, 23 nt, Molluscum contagiosum virus
aguggcggcaaaagggcucugcc

SEQ ID NO: 4042666 - RNA, 14 nt, Molluscum contagiosum virus
agugugccugcugc

SEQ ID NO: 4042667 - RNA, 18 nt, Molluscum contagiosum virus
agugugccugcugcgcuu

SEQ ID NO: 4042668 - RNA, 14 nt, Molluscum contagiosum virus
aguuagaaaugcuu

SEQ ID NO: 4042669 - RNA, 17 nt, Molluscum contagiosum virus
aguuauucucugcgcgc

SEQ ID NO: 4042670 - RNA, 13 nt, Molluscum contagiosum virus
aguuccacuccug

SEQ ID NO: 4042671 - RNA, 21 nt, Molluscum contagiosum virus
aguugagagcagcggcuacuu

SEQ ID NO: 4042672 - RNA, 21 nt, Molluscum contagiosum virus
aguugcagcccaccagcaggu

SEQ ID NO: 4042673 - RNA, 18 nt, Molluscum contagiosum virus
aguugcgagccagccagg

SEQ ID NO: 4042674 - RNA, 17 nt, Molluscum contagiosum virus
auaaaugaaccugggca

SEQ ID NO: 4042675 - RNA, 19 nt, Molluscum contagiosum virus
auacaccggcuuggccaag

SEQ ID NO: 4042676 - RNA, 12 nt, Molluscum contagiosum virus
auaccugugcca

SEQ ID NO: 4042677 - RNA, 14 nt, Molluscum contagiosum virus
auacuccugcuggc

SEQ ID NO: 4042678 - RNA, 15 nt, Molluscum contagiosum virus
auacuucaacuacaa

SEQ ID NO: 4042679 - RNA, 23 nt, Molluscum contagiosum virus
auagcgcgcuagcuccacgugcc

SEQ ID NO: 4042680 - RNA, 17 nt, Molluscum contagiosum virus
auaguccccggcgccgg

SEQ ID NO: 4042681 - RNA, 13 nt, Molluscum contagiosum virus
auagugggcuugc

SEQ ID NO: 4042682 - RNA, 11 nt, Molluscum contagiosum virus
auauccagccc

SEQ ID NO: 4042683 - RNA, 22 nt, Molluscum contagiosum virus
aucaacgcgcgcgugcuguccu

SEQ ID NO: 4042684 - RNA, 20 nt, Molluscum contagiosum virus
aucaagaucggacucagcau

SEQ ID NO: 4042685 - RNA, 15 nt, Molluscum contagiosum virus
aucaccccgcagcuc

SEQ ID NO: 4042686 - RNA, 16 nt, Molluscum contagiosum virus
aucaccccgcugggcc

SEQ ID NO: 4042687 - RNA, 22 nt, Molluscum contagiosum virus
caggcccggcggcccgcggcgc

SEQ ID NO: 4042688 - RNA, 14 nt, Molluscum contagiosum virus
caggccgcgcccgu

SEQ ID NO: 4042689 - RNA, 15 nt, Molluscum contagiosum virus
caggccgggcgcggu

SEQ ID NO: 4042690 - RNA, 21 nt, Molluscum contagiosum virus
caggccuccuucccugacagc

SEQ ID NO: 4042691 - RNA, 19 nt, Molluscum contagiosum virus
caggcgcccaacgcccgcg

SEQ ID NO: 4042692 - RNA, 19 nt, Molluscum contagiosum virus
caggcgcgaacucgcggca

SEQ ID NO: 4042693 - RNA, 21 nt, Molluscum contagiosum virus
caggcgcgcaagugcgugucc

SEQ ID NO: 4042694 - RNA, 16 nt, Molluscum contagiosum virus
caggcgcugcgcggcg

SEQ ID NO: 4042695 - RNA, 23 nt, Molluscum contagiosum virus
caggcggucuuccagcacugcgc

SEQ ID NO: 4042696 - RNA, 21 nt, Molluscum contagiosum virus
caggcggugggcgccgcggcc

SEQ ID NO: 4042697 - RNA, 16 nt, Molluscum contagiosum virus
caggcgucgcgcacag

SEQ ID NO: 4042698 - RNA, 21 nt, Molluscum contagiosum virus
caggcgucgcgcacagaaagc

SEQ ID NO: 4042699 - RNA, 16 nt, Molluscum contagiosum virus
caggcuaggcgcgacu

SEQ ID NO: 4042700 - RNA, 19 nt, Molluscum contagiosum virus
caggcucgucguggacgcu

SEQ ID NO: 4042701 - RNA, 16 nt, Molluscum contagiosum virus
cagggaaagagcacgc

SEQ ID NO: 4042702 - RNA, 17 nt, Molluscum contagiosum virus
cagggcaaucgcgugcu

SEQ ID NO: 4042703 - RNA, 15 nt, Molluscum contagiosum virus
cagggcacgaucgcg

SEQ ID NO: 4042704 - RNA, 15 nt, Molluscum contagiosum virus
cagggcccgcgcucg

SEQ ID NO: 4042705 - RNA, 18 nt, Molluscum contagiosum virus
cagggcggcgccugcgcc

SEQ ID NO: 4042706 - RNA, 19 nt, Molluscum contagiosum virus
cagggcgugcuugccugga

SEQ ID NO: 4042707 - RNA, 20 nt, Molluscum contagiosum virus
caggggccguucgcgcgcca

SEQ ID NO: 4042708 - RNA, 22 nt, Molluscum contagiosum virus
cagguagagcaacaugcugagu

SEQ ID NO: 4042709 - RNA, 22 nt, Molluscum contagiosum virus
caggucaacuccgagcgcgcgc

SEQ ID NO: 4042710 - RNA, 21 nt, Molluscum contagiosum virus
caggucaucgacgagcacgag

SEQ ID NO: 4042711 - RNA, 21 nt, Molluscum contagiosum virus
caggucaucgggcugcagccc

SEQ ID NO: 4042712 - RNA, 22 nt, Molluscum contagiosum virus
caggucaucgggcugcagcccu

SEQ ID NO: 4042713 - RNA, 12 nt, Molluscum contagiosum virus
cagguugcucgc

SEQ ID NO: 4042714 - RNA, 15 nt, Molluscum contagiosum virus
caguagcagcgccgg

SEQ ID NO: 4042715 - RNA, 16 nt, Molluscum contagiosum virus
cagucgcgacgcgcuu

SEQ ID NO: 4042716 - RNA, 12 nt, Molluscum contagiosum virus
cagugacagacu

SEQ ID NO: 4042717 - RNA, 13 nt, Molluscum contagiosum virus
cagugcaccagca

SEQ ID NO: 4042718 - RNA, 14 nt, Molluscum contagiosum virus
cagugccgccgcgc

SEQ ID NO: 4042719 - RNA, 15 nt, Molluscum contagiosum virus
cagugccgcugagag

SEQ ID NO: 4042720 - RNA, 21 nt, Molluscum contagiosum virus
cagugcgagaucgacugcgcc

SEQ ID NO: 4042721 - RNA, 18 nt, Molluscum contagiosum virus
cagugcgccucggacuuc

SEQ ID NO: 4042722 - RNA, 14 nt, Molluscum contagiosum virus
cagugcgcgcacaa

SEQ ID NO: 4042723 - RNA, 13 nt, Molluscum contagiosum virus
cagugcggccagc

SEQ ID NO: 4042724 - RNA, 12 nt, Molluscum contagiosum virus
cagugcgugcac

SEQ ID NO: 4042725 - RNA, 21 nt, Molluscum contagiosum virus
cagugcgugcucgguagcgug

SEQ ID NO: 4042726 - RNA, 14 nt, Molluscum contagiosum virus
caguguugugaagu

SEQ ID NO: 4042727 - RNA, 16 nt, Molluscum contagiosum virus
cauacacuuccugcua

SEQ ID NO: 4042728 - RNA, 18 nt, Molluscum contagiosum virus
cauagcgccacgagcagu

SEQ ID NO: 4042729 - RNA, 20 nt, Molluscum contagiosum virus
caucaagcacggcuuccggc

SEQ ID NO: 4042730 - RNA, 22 nt, Molluscum contagiosum virus
caucaugggcucgggcaagacc

SEQ ID NO: 4042731 - RNA, 21 nt, Molluscum contagiosum virus
cauccacauuacgcucgugga

SEQ ID NO: 4042732 - RNA, 17 nt, Molluscum contagiosum virus
cauccagccgucgccgc

SEQ ID NO: 4042733 - RNA, 22 nt, Molluscum contagiosum virus
cauccagccgucgccgcgcccg

SEQ ID NO: 4042734 - RNA, 14 nt, Molluscum contagiosum virus
cauccggcacgcac

SEQ ID NO: 4042735 - RNA, 14 nt, Molluscum contagiosum virus
cauccucaccuucc

SEQ ID NO: 4042736 - RNA, 23 nt, Molluscum contagiosum virus
cauccuugauaaaagcacagucc

SEQ ID NO: 4042737 - RNA, 13 nt, Molluscum contagiosum virus
caucgggcugucg

SEQ ID NO: 4042738 - RNA, 22 nt, Molluscum contagiosum virus
caucugcaacucgcgcugcagc

SEQ ID NO: 4042739 - RNA, 15 nt, Molluscum contagiosum virus
caugaaaggcaccug

SEQ ID NO: 4042740 - RNA, 15 nt, Molluscum contagiosum virus
caugaacucgcugcu

SEQ ID NO: 4042741 - RNA, 17 nt, Molluscum contagiosum virus
caugaacucgcugcugc

SEQ ID NO: 4042742 - RNA, 19 nt, Molluscum contagiosum virus
caugaggcggcgcaggugc

SEQ ID NO: 4042743 - RNA, 22 nt, Molluscum contagiosum virus
caugagguacuccacgcccggc

SEQ ID NO: 4042744 - RNA, 19 nt, Molluscum contagiosum virus
caugcacacucacgcgucc

SEQ ID NO: 4042745 - RNA, 15 nt, Molluscum contagiosum virus
caugcagcugcagga

SEQ ID NO: 4042746 - RNA, 20 nt, Molluscum contagiosum virus
caugcagucacgacuguguu

SEQ ID NO: 4042747 - RNA, 21 nt, Molluscum contagiosum virus
caugccaacgcaccggcaggg

SEQ ID NO: 4042748 - RNA, 19 nt, Molluscum contagiosum virus
caugccgaguguugucguc

SEQ ID NO: 4042749 - RNA, 15 nt, Molluscum contagiosum virus
caugccuucaggaac

SEQ ID NO: 4042750 - RNA, 17 nt, Molluscum contagiosum virus
caugccuuuccgagcuc

SEQ ID NO: 4042751 - RNA, 21 nt, Molluscum contagiosum virus
caugcgcgccgcgcugcuggc

SEQ ID NO: 4042752 - RNA, 23 nt, Molluscum contagiosum virus
caugcgugcuucacgugcuugcc

SEQ ID NO: 4042753 - RNA, 16 nt, Molluscum contagiosum virus
caugcucgcgcucucg

SEQ ID NO: 4042754 - RNA, 18 nt, Molluscum contagiosum virus
caugcucucgcugcugcc

SEQ ID NO: 4042755 - RNA, 16 nt, Molluscum contagiosum virus
caugcuggcgggcgcg

SEQ ID NO: 4042756 - RNA, 15 nt, Molluscum contagiosum virus
cauggagcaggagaa

SEQ ID NO: 4042757 - RNA, 15 nt, Molluscum contagiosum virus
cauggagcgcccgcu

SEQ ID NO: 4042758 - RNA, 17 nt, Molluscum contagiosum virus
cauggaggcgcuagugc

SEQ ID NO: 4042759 - RNA, 14 nt, Molluscum contagiosum virus
cauggccgcguccg

SEQ ID NO: 4042760 - RNA, 12 nt, Molluscum contagiosum virus
caugggcccugg

SEQ ID NO: 4042761 - RNA, 18 nt, Molluscum contagiosum virus
cauguacauagcccccua

SEQ ID NO: 4042762 - RNA, 21 nt, Molluscum contagiosum virus
caugucacgcgucgcgcgccg

SEQ ID NO: 4042763 - RNA, 18 nt, Molluscum contagiosum virus
caugucaggccggucgcg

SEQ ID NO: 4042764 - RNA, 22 nt, Molluscum contagiosum virus
cauuaacgaagaguggcucaca

SEQ ID NO: 4042765 - RNA, 13 nt, Molluscum contagiosum virus
cauucgcuggugc

SEQ ID NO: 4042766 - RNA, 20 nt, Molluscum contagiosum virus
cauugcgucuuacugcugca

SEQ ID NO: 4042767 - RNA, 17 nt, Molluscum contagiosum virus
cauugcguguggggcau

SEQ ID NO: 4042768 - RNA, 13 nt, Molluscum contagiosum virus
cauugcugcugca

SEQ ID NO: 4042769 - RNA, 22 nt, Molluscum contagiosum virus
ccaacacgcaaucgcgcgcgca

SEQ ID NO: 4042770 - RNA, 21 nt, Molluscum contagiosum virus
ccaacgcaccggcagggaaau

SEQ ID NO: 4042771 - RNA, 18 nt, Molluscum contagiosum virus
ccaacucugugaccugcg

SEQ ID NO: 4042772 - RNA, 13 nt, Molluscum contagiosum virus
ccaacuucgcggu

SEQ ID NO: 4042773 - RNA, 15 nt, Molluscum contagiosum virus
ccaagaacagagaaa

SEQ ID NO: 4042774 - RNA, 21 nt, Molluscum contagiosum virus
ccaagaagaagcagcagacca

SEQ ID NO: 4042775 - RNA, 15 nt, Molluscum contagiosum virus
ccaagaagacuacca

SEQ ID NO: 4042776 - RNA, 23 nt, Molluscum contagiosum virus
ccaagaccugggcgucgugcacc

SEQ ID NO: 4042777 - RNA, 17 nt, Molluscum contagiosum virus
ccaaggagcugcgcgag

SEQ ID NO: 4042778 - RNA, 19 nt, Molluscum contagiosum virus
ccaagguuugcgggcgcag

SEQ ID NO: 4042779 - RNA, 23 nt, Molluscum contagiosum virus
ccacaggcgcgaacucgcggcag

SEQ ID NO: 4042780 - RNA, 22 nt, Molluscum contagiosum virus
ccacagguuucucaacaugaau

SEQ ID NO: 4042781 - RNA, 14 nt, Molluscum contagiosum virus
ccaccaccuccagg

SEQ ID NO: 4042782 - RNA, 17 nt, Molluscum contagiosum virus
ccaccggcagugcuugc

SEQ ID NO: 4042783 - RNA, 16 nt, Molluscum contagiosum virus
ccaccguggaggagcc

SEQ ID NO: 4042784 - RNA, 21 nt, Molluscum contagiosum virus
ccaccucggcguuggccacga

SEQ ID NO: 4042785 - RNA, 21 nt, Molluscum contagiosum virus
ccaccugagccucuggaagga

SEQ ID NO: 4042786 - RNA, 13 nt, Molluscum contagiosum virus
ccacgcagcuggc

SEQ ID NO: 4042787 - RNA, 21 nt, Molluscum contagiosum virus
ccacgcaggacuggcaccugc

SEQ ID NO: 4042788 - RNA, 22 nt, Molluscum contagiosum virus
ccacgccaagcgcuugcucuuc

SEQ ID NO: 4042789 - RNA, 24 nt, Molluscum contagiosum virus
ccacgcccgggcccgacacguugc

SEQ ID NO: 4042790 - RNA, 18 nt, Molluscum contagiosum virus
ccacgcgcaugaggcggc

SEQ ID NO: 4042791 - RNA, 13 nt, Molluscum contagiosum virus
ccacgcgggcccg

SEQ ID NO: 4042792 - RNA, 20 nt, Molluscum contagiosum virus
ccacgcgugcgcgccaggug

SEQ ID NO: 4042793 - RNA, 13 nt, Molluscum contagiosum virus
ccacgcuggcacg

SEQ ID NO: 4042794 - RNA, 22 nt, Molluscum contagiosum virus
ccacgcuguacaugccgcagua

SEQ ID NO: 4042795 - RNA, 15 nt, Molluscum contagiosum virus
ccacggccgcgcgcg

SEQ ID NO: 4042796 - RNA, 20 nt, Molluscum contagiosum virus
ccacggguaccgugcgcgug

SEQ ID NO: 4042797 - RNA, 16 nt, Molluscum contagiosum virus
ccacggguagcagcgc

SEQ ID NO: 4042798 - RNA, 19 nt, Molluscum contagiosum virus
ccacguccaggccgcggca

SEQ ID NO: 4042799 - RNA, 20 nt, Molluscum contagiosum virus
ccacguccgacucggacacg

SEQ ID NO: 4042800 - RNA, 12 nt, Molluscum contagiosum virus
ccacgugccaag

SEQ ID NO: 4042801 - RNA, 12 nt, Molluscum contagiosum virus
ccacgugcgcug

SEQ ID NO: 4042802 - RNA, 17 nt, Molluscum contagiosum virus
ccacgugcgcuggccca

SEQ ID NO: 4042803 - RNA, 18 nt, Molluscum contagiosum virus
ccacgugguccaccagca

SEQ ID NO: 4042804 - RNA, 19 nt, Molluscum contagiosum virus
ccacuacaagcagccgcag

SEQ ID NO: 4042805 - RNA, 16 nt, Molluscum contagiosum virus
ccacuccgucgcgcuc

SEQ ID NO: 4042806 - RNA, 12 nt, Molluscum contagiosum virus
ccacuggugugu

SEQ ID NO: 4042807 - RNA, 17 nt, Molluscum contagiosum virus
ccacugugccagcagca

SEQ ID NO: 4042808 - RNA, 19 nt, Molluscum contagiosum virus
ccagaaaacaggcacuucg

SEQ ID NO: 4042809 - RNA, 15 nt, Molluscum contagiosum virus
ccagacgcagagcca

SEQ ID NO: 4042810 - RNA, 21 nt, Molluscum contagiosum virus
ccagagccgcgugcgccgccg

SEQ ID NO: 4042811 - RNA, 20 nt, Molluscum contagiosum virus
ccagcagagcugcccgccag

SEQ ID NO: 4042812 - RNA, 23 nt, Molluscum contagiosum virus
ccagcagcgcccggugcggcgug

SEQ ID NO: 4042813 - RNA, 16 nt, Molluscum contagiosum virus
ccagcagcggcgcgug

SEQ ID NO: 4042814 - RNA, 20 nt, Molluscum contagiosum virus
ccagcaugugcgagcgcagc

SEQ ID NO: 4042815 - RNA, 17 nt, Molluscum contagiosum virus
ccagcccgcugcgcaug

SEQ ID NO: 4042816 - RNA, 14 nt, Molluscum contagiosum virus
ccagccgcagccgc

SEQ ID NO: 4042817 - RNA, 13 nt, Molluscum contagiosum virus
ccagccgcgagcg

SEQ ID NO: 4042818 - RNA, 16 nt, Molluscum contagiosum virus
ccagcgcgcagaagcc

SEQ ID NO: 4042819 - RNA, 14 nt, Molluscum contagiosum virus
ccagcggcugcccg

SEQ ID NO: 4042820 - RNA, 23 nt, Molluscum contagiosum virus
ccagcgugacaaucucugcgccg

SEQ ID NO: 4042821 - RNA, 19 nt, Molluscum contagiosum virus
ccagcgugcccuucuccga

SEQ ID NO: 4042822 - RNA, 17 nt, Molluscum contagiosum virus
ccagcguuugauacagu

SEQ ID NO: 4042823 - RNA, 21 nt, Molluscum contagiosum virus
ccagcucgacacugugcuggc

SEQ ID NO: 4042824 - RNA, 22 nt, Molluscum contagiosum virus
ccagcucgacacugugcuggcg

SEQ ID NO: 4042825 - RNA, 20 nt, Molluscum contagiosum virus
ccagcucggguuccagcucc

SEQ ID NO: 4042826 - RNA, 18 nt, Molluscum contagiosum virus
ccagcuuggugcgcucga

SEQ ID NO: 4042827 - RNA, 14 nt, Molluscum contagiosum virus
ccaggaacagggaa

SEQ ID NO: 4042828 - RNA, 17 nt, Molluscum contagiosum virus
ccaggaacaucugcaac

SEQ ID NO: 4042829 - RNA, 15 nt, Molluscum contagiosum virus
ccaggaacgaggaaa

SEQ ID NO: 4042830 - RNA, 15 nt, Molluscum contagiosum virus
ccaggaacgccgcca

SEQ ID NO: 4042831 - RNA, 22 nt, Molluscum contagiosum virus
ccaggaucacgaugugcgcgcg

SEQ ID NO: 4042832 - RNA, 19 nt, Molluscum contagiosum virus
ccaggcacacgcagugcca

SEQ ID NO: 4042833 - RNA, 17 nt, Molluscum contagiosum virus
ccaggccgcggcagcuc

SEQ ID NO: 4042834 - RNA, 21 nt, Molluscum contagiosum virus
ccaggcggucuuccagcacug

SEQ ID NO: 4042835 - RNA, 19 nt, Molluscum contagiosum virus
ccagggcaguacgcgcgug

SEQ ID NO: 4042836 - RNA, 21 nt, Molluscum contagiosum virus
ccaggugcgaaggcucgagcu

SEQ ID NO: 4042837 - RNA, 20 nt, Molluscum contagiosum virus
ccaguaccagcucgcgccgc

SEQ ID NO: 4042838 - RNA, 15 nt, Molluscum contagiosum virus
ccaguaccugcugcc

SEQ ID NO: 4042839 - RNA, 16 nt, Molluscum contagiosum virus
ccaguaccugcugccg

SEQ ID NO: 4042840 - RNA, 14 nt, Molluscum contagiosum virus
ccaguacuucaucu

SEQ ID NO: 4042841 - RNA, 22 nt, Molluscum contagiosum virus
ccaguccgcggcgcgccggcca

SEQ ID NO: 4042842 - RNA, 13 nt, Molluscum contagiosum virus
ccagugcgcuugc

SEQ ID NO: 4042843 - RNA, 20 nt, Molluscum contagiosum virus
ccagugcuuugucgcaaccc

SEQ ID NO: 4042844 - RNA, 20 nt, Molluscum contagiosum virus
ccaguggcgcccgugcucgc

SEQ ID NO: 4042845 - RNA, 14 nt, Molluscum contagiosum virus
ccaucgacgagguc

SEQ ID NO: 4042846 - RNA, 17 nt, Molluscum contagiosum virus
ccaucggagaagugcuc

SEQ ID NO: 4042847 - RNA, 17 nt, Molluscum contagiosum virus
ccaugcgcacagcacuu

SEQ ID NO: 4042848 - RNA, 17 nt, Molluscum contagiosum virus
ccaugcuccugaucugc

SEQ ID NO: 4042849 - RNA, 22 nt, Molluscum contagiosum virus
ccaugcucgagccugccagcgc

SEQ ID NO: 4042850 - RNA, 20 nt, Molluscum contagiosum virus
ccauggacacgcugcgcgug

SEQ ID NO: 4042851 - RNA, 17 nt, Molluscum contagiosum virus
ccauggucacgcgcacg

SEQ ID NO: 4042852 - RNA, 22 nt, Molluscum contagiosum virus
ccauguccuuucagacagcgga

SEQ ID NO: 4042853 - RNA, 21 nt, Molluscum contagiosum virus
ccaugucgcgcaucaccgagc

SEQ ID NO: 4042854 - RNA, 21 nt, Molluscum contagiosum virus
ccaugugcccgcggcgcgaaa

SEQ ID NO: 4042855 - RNA, 16 nt, Molluscum contagiosum virus
cccaaggccgcgggcg

SEQ ID NO: 4042856 - RNA, 22 nt, Molluscum contagiosum virus
cccaagugcgcgugucuggagc

SEQ ID NO: 4042857 - RNA, 18 nt, Molluscum contagiosum virus
cccacgagcgccagccug

SEQ ID NO: 4042858 - RNA, 18 nt, Molluscum contagiosum virus
cccacguacgagcagcug

SEQ ID NO: 4042859 - RNA, 13 nt, Molluscum contagiosum virus
cccagcaaggccc

SEQ ID NO: 4042860 - RNA, 15 nt, Molluscum contagiosum virus
cccagcaccgcgccg

SEQ ID NO: 4042861 - RNA, 17 nt, Molluscum contagiosum virus
cccagcagcgagaccau

SEQ ID NO: 4042862 - RNA, 16 nt, Molluscum contagiosum virus
cccagcagcugcuccg

SEQ ID NO: 4042863 - RNA, 20 nt, Molluscum contagiosum virus
cccagcgguggucuccgcgg

SEQ ID NO: 4042864 - RNA, 21 nt, Molluscum contagiosum virus
cccagcgugacaaucucugcg

SEQ ID NO: 4042865 - RNA, 22 nt, Molluscum contagiosum virus
cccagcguggccagcuucauca

SEQ ID NO: 4042866 - RNA, 13 nt, Molluscum contagiosum virus
cccagcuucagca

SEQ ID NO: 4042867 - RNA, 16 nt, Molluscum contagiosum virus
cccagguucagcgcuc

SEQ ID NO: 4042868 - RNA, 17 nt, Molluscum contagiosum virus
ccccgagcugcggcgcg

SEQ ID NO: 4042869 - RNA, 16 nt, Molluscum contagiosum virus
ccccgcgcguugcugc

SEQ ID NO: 4042870 - RNA, 19 nt, Molluscum contagiosum virus
ccccggcguccggcgcucg

SEQ ID NO: 4042871 - RNA, 19 nt, Molluscum contagiosum virus
ccccguucacuugcgcgcg

SEQ ID NO: 4042872 - RNA, 14 nt, Molluscum contagiosum virus
ccccugagcgaguu

SEQ ID NO: 4042873 - RNA, 18 nt, Molluscum contagiosum virus
ccccuguaacaaggaaaa

SEQ ID NO: 4042874 - RNA, 15 nt, Molluscum contagiosum virus
cccgaaggccaccuc

SEQ ID NO: 4042875 - RNA, 12 nt, Molluscum contagiosum virus
cccgacacacuc

SEQ ID NO: 4042876 - RNA, 15 nt, Molluscum contagiosum virus
cccgacucgcagcuc

SEQ ID NO: 4042877 - RNA, 19 nt, Molluscum contagiosum virus
cccgacuucucgcgcgacu

SEQ ID NO: 4042878 - RNA, 19 nt, Molluscum contagiosum virus
cccgagcacguuccaaaag

SEQ ID NO: 4042879 - RNA, 21 nt, Molluscum contagiosum virus
cccgagcaggacgugcacgug

SEQ ID NO: 4042880 - RNA, 14 nt, Molluscum contagiosum virus
cccgagcgcgcgug

SEQ ID NO: 4042881 - RNA, 23 nt, Molluscum contagiosum virus
cccgagcuaaauggacgcggacc

SEQ ID NO: 4042882 - RNA, 22 nt, Molluscum contagiosum virus
cccgaggacgagccccgcgccg

SEQ ID NO: 4042883 - RNA, 21 nt, Molluscum contagiosum virus
cccgaguacuacuacacuguc

SEQ ID NO: 4042884 - RNA, 23 nt, Molluscum contagiosum virus
cccgaguuccuguugcgcgagcg

SEQ ID NO: 4042885 - RNA, 21 nt, Molluscum contagiosum virus
cccgcaaacacgagacugagu

SEQ ID NO: 4042886 - RNA, 14 nt, Molluscum contagiosum virus
cccgcaagccacac

SEQ ID NO: 4042887 - RNA, 15 nt, Molluscum contagiosum virus
cccgcacgcaccgcg

SEQ ID NO: 4042888 - RNA, 16 nt, Molluscum contagiosum virus
cccgcacgugggcuac

SEQ ID NO: 4042889 - RNA, 12 nt, Molluscum contagiosum virus
cccgcaggaaag

SEQ ID NO: 4042890 - RNA, 22 nt, Molluscum contagiosum virus
cccgcaggaaaggcaccccgca

SEQ ID NO: 4042891 - RNA, 17 nt, Molluscum contagiosum virus
cccgccgacugccgccg

SEQ ID NO: 4042892 - RNA, 22 nt, Molluscum contagiosum virus
cccgccgaguaccgcgcgcacg

SEQ ID NO: 4042893 - RNA, 18 nt, Molluscum contagiosum virus
cccgccuucgacggcuuc

SEQ ID NO: 4042894 - RNA, 22 nt, Molluscum contagiosum virus
cccgcgaacgagagacacgcac

SEQ ID NO: 4042895 - RNA, 19 nt, Molluscum contagiosum virus
cccgcgcacgagcugcugc

SEQ ID NO: 4042896 - RNA, 13 nt, Molluscum contagiosum virus
cccgcgcagcgcc

SEQ ID NO: 4042897 - RNA, 15 nt, Molluscum contagiosum virus
cccgcgcccgcgccg

SEQ ID NO: 4042898 - RNA, 16 nt, Molluscum contagiosum virus
cccgcgcccgcgccgc

SEQ ID NO: 4042899 - RNA, 12 nt, Molluscum contagiosum virus
cccgcgccgccc

SEQ ID NO: 4042900 - RNA, 14 nt, Molluscum contagiosum virus
cccgcgccgcggcg

SEQ ID NO: 4042901 - RNA, 19 nt, Molluscum contagiosum virus
cccgcgcgcgacuacgcac

SEQ ID NO: 4042902 - RNA, 14 nt, Molluscum contagiosum virus
cccgcgcgcgagcu

SEQ ID NO: 4042903 - RNA, 18 nt, Molluscum contagiosum virus
cccgcgcgcggacagccu

SEQ ID NO: 4042904 - RNA, 19 nt, Molluscum contagiosum virus
cccgcgcucuuacugcagc

SEQ ID NO: 4042905 - RNA, 20 nt, Molluscum contagiosum virus
cccgcggacggacgaagaga

SEQ ID NO: 4042906 - RNA, 13 nt, Molluscum contagiosum virus
cccgcggagcugu

SEQ ID NO: 4042907 - RNA, 17 nt, Molluscum contagiosum virus
cccgcggagcugugcca

SEQ ID NO: 4042908 - RNA, 18 nt, Molluscum contagiosum virus
cccgcggccgccacuguu

SEQ ID NO: 4042909 - RNA, 14 nt, Molluscum contagiosum virus
cccgcggcgcgccg

SEQ ID NO: 4042910 - RNA, 16 nt, Molluscum contagiosum virus
cccgcggcgcgccgca

SEQ ID NO: 4042911 - RNA, 20 nt, Molluscum contagiosum virus
cccgcgguguccuugcgccg

SEQ ID NO: 4042912 - RNA, 17 nt, Molluscum contagiosum virus
cccgcgucccgacagca

SEQ ID NO: 4042913 - RNA, 21 nt, Molluscum contagiosum virus
cccgcuccgcucgcgcgugcu

SEQ ID NO: 4042914 - RNA, 17 nt, Molluscum contagiosum virus
cccgcugcacgcucuuc

SEQ ID NO: 4042915 - RNA, 15 nt, Molluscum contagiosum virus
cccgcuggcggcacg

SEQ ID NO: 4042916 - RNA, 16 nt, Molluscum contagiosum virus
cccgcugucgcgcguc

SEQ ID NO: 4042917 - RNA, 23 nt, Molluscum contagiosum virus
cccgcugucgcgcgucgcggucg

SEQ ID NO: 4042918 - RNA, 16 nt, Molluscum contagiosum virus
cccggcacgugccccg

SEQ ID NO: 4042919 - RNA, 13 nt, Molluscum contagiosum virus
cccggcgcgcgcg

SEQ ID NO: 4042920 - RNA, 20 nt, Molluscum contagiosum virus
cccggcgcgcgcggcgcgcc

SEQ ID NO: 4042921 - RNA, 19 nt, Molluscum contagiosum virus
cccggcggcccgcggcgcg

SEQ ID NO: 4042922 - RNA, 13 nt, Molluscum contagiosum virus
cccgggcccgagc

SEQ ID NO: 4042923 - RNA, 15 nt, Molluscum contagiosum virus
cgagcacgcgcgagc

SEQ ID NO: 4042924 - RNA, 21 nt, Molluscum contagiosum virus
cgagcacguccguugcacgug

SEQ ID NO: 4042925 - RNA, 20 nt, Molluscum contagiosum virus
cgagcacguggacagcaucc

SEQ ID NO: 4042926 - RNA, 24 nt, Molluscum contagiosum virus
cgagcacguuccaaaagacagagg

SEQ ID NO: 4042927 - RNA, 17 nt, Molluscum contagiosum virus
cgagcacugcgcgcgcg

SEQ ID NO: 4042928 - RNA, 19 nt, Molluscum contagiosum virus
cgagcagagccgggacgcg

SEQ ID NO: 4042929 - RNA, 24 nt, Molluscum contagiosum virus
cgagcagagccgggacgcggaugc

SEQ ID NO: 4042930 - RNA, 19 nt, Molluscum contagiosum virus
cgagcagauucacgagcuc

SEQ ID NO: 4042931 - RNA, 19 nt, Molluscum contagiosum virus
cgagcagcccgugcgccug

SEQ ID NO: 4042932 - RNA, 20 nt, Molluscum contagiosum virus
cgagcagcggggacucuccc

SEQ ID NO: 4042933 - RNA, 15 nt, Molluscum contagiosum virus
cgagcagcugcugcg

SEQ ID NO: 4042934 - RNA, 13 nt, Molluscum contagiosum virus
cgagcaggcgcag

SEQ ID NO: 4042935 - RNA, 15 nt, Molluscum contagiosum virus
cgagcaggcgcagcg

SEQ ID NO: 4042936 - RNA, 15 nt, Molluscum contagiosum virus
cgagcaucugcgcgu

SEQ ID NO: 4042937 - RNA, 16 nt, Molluscum contagiosum virus
cgagcccgcggcgcgc

SEQ ID NO: 4042938 - RNA, 13 nt, Molluscum contagiosum virus
cgagccgcgcgag

SEQ ID NO: 4042939 - RNA, 20 nt, Molluscum contagiosum virus
cgagccgcugcuccugcucu

SEQ ID NO: 4042940 - RNA, 19 nt, Molluscum contagiosum virus
cgagccugccagcgccagc

SEQ ID NO: 4042941 - RNA, 15 nt, Molluscum contagiosum virus
cgagccugccgcgag

SEQ ID NO: 4042942 - RNA, 18 nt, Molluscum contagiosum virus
cgagcgcccgugcuugcg

SEQ ID NO: 4042943 - RNA, 20 nt, Molluscum contagiosum virus
cgagcgcccgugcuugcgca

SEQ ID NO: 4042944 - RNA, 19 nt, Molluscum contagiosum virus
cgagcgcccucagucacgu

SEQ ID NO: 4042945 - RNA, 16 nt, Molluscum contagiosum virus
cgagcgccgccagcuc

SEQ ID NO: 4042946 - RNA, 17 nt, Molluscum contagiosum virus
cgagcgccgccagcucc

SEQ ID NO: 4042947 - RNA, 21 nt, Molluscum contagiosum virus
cgagcgccgccagcuccgcgc

SEQ ID NO: 4042948 - RNA, 13 nt, Molluscum contagiosum virus
cgagcgcgcgcgc

SEQ ID NO: 4042949 - RNA, 16 nt, Molluscum contagiosum virus
cgagcgcgcgcgcugc

SEQ ID NO: 4042950 - RNA, 14 nt, Molluscum contagiosum virus
cgagcgcgcgcugc

SEQ ID NO: 4042951 - RNA, 19 nt, Molluscum contagiosum virus
cgagcgcgcgcugcgcgcc

SEQ ID NO: 4042952 - RNA, 16 nt, Molluscum contagiosum virus
cgagcgcgcgugcucg

SEQ ID NO: 4042953 - RNA, 18 nt, Molluscum contagiosum virus
cgagcgcgcuggacuugc

SEQ ID NO: 4042954 - RNA, 15 nt, Molluscum contagiosum virus
cgagcgcggcaacag

SEQ ID NO: 4042955 - RNA, 14 nt, Molluscum contagiosum virus
cgagcgcgggcgcc

SEQ ID NO: 4042956 - RNA, 20 nt, Molluscum contagiosum virus
cgagcgcguccaugagcauc

SEQ ID NO: 4042957 - RNA, 22 nt, Molluscum contagiosum virus
cgagcgcguccaugagcaucuc

SEQ ID NO: 4042958 - RNA, 18 nt, Molluscum contagiosum virus
cgagcgcugccgcuucgu

SEQ ID NO: 4042959 - RNA, 20 nt, Molluscum contagiosum virus
cgagcggcaagccgugcuuu

SEQ ID NO: 4042960 - RNA, 14 nt, Molluscum contagiosum virus
cgagcggcugcucg

SEQ ID NO: 4042961 - RNA, 11 nt, Molluscum contagiosum virus
cgagcgugcaa

SEQ ID NO: 4042962 - RNA, 17 nt, Molluscum contagiosum virus
cgagcuaaauggacgcg

SEQ ID NO: 4042963 - RNA, 12 nt, Molluscum contagiosum virus
cgagcucuccga

SEQ ID NO: 4042964 - RNA, 13 nt, Molluscum contagiosum virus
cgagcugcugccc

SEQ ID NO: 4042965 - RNA, 15 nt, Molluscum contagiosum virus
cgagcugcugcgcgc

SEQ ID NO: 4042966 - RNA, 16 nt, Molluscum contagiosum virus
cgagcugcuguacucg

SEQ ID NO: 4042967 - RNA, 11 nt, Molluscum contagiosum virus
cgagcugugcg

SEQ ID NO: 4042968 - RNA, 23 nt, Molluscum contagiosum virus
cgagcuuccucaaggcgcacgag

SEQ ID NO: 4042969 - RNA, 23 nt, Molluscum contagiosum virus
cgagcuuugugcgaccugcugcg

SEQ ID NO: 4042970 - RNA, 20 nt, Molluscum contagiosum virus
cgaggacgcgggcguguccg

SEQ ID NO: 4042971 - RNA, 19 nt, Molluscum contagiosum virus
cgaggagggcagccucaac

SEQ ID NO: 4042972 - RNA, 14 nt, Molluscum contagiosum virus
cgaggcaccgcccg

SEQ ID NO: 4042973 - RNA, 20 nt, Molluscum contagiosum virus
cgaggcacucgucgcgcugc

SEQ ID NO: 4042974 - RNA, 23 nt, Molluscum contagiosum virus
cgaggccaaccuccugcaccugc

SEQ ID NO: 4042975 - RNA, 16 nt, Molluscum contagiosum virus
cgaggccggcacgagc

SEQ ID NO: 4042976 - RNA, 22 nt, Molluscum contagiosum virus
cgaggccggccgugcagagcaa

SEQ ID NO: 4042977 - RNA, 20 nt, Molluscum contagiosum virus
cgaggccugcguggacagca

SEQ ID NO: 4042978 - RNA, 22 nt, Molluscum contagiosum virus
cgaggccugcguggacagcauc

SEQ ID NO: 4042979 - RNA, 13 nt, Molluscum contagiosum virus
cgaggcgcgcacg

SEQ ID NO: 4042980 - RNA, 17 nt, Molluscum contagiosum virus
cgaggcgcgcacgcugc

SEQ ID NO: 4042981 - RNA, 14 nt, Molluscum contagiosum virus
cgagggcgaggcca

SEQ ID NO: 4042982 - RNA, 14 nt, Molluscum contagiosum virus
cgagggcgcgcugg

SEQ ID NO: 4042983 - RNA, 19 nt, Molluscum contagiosum virus
cgaggucacucgcuacugc

SEQ ID NO: 4042984 - RNA, 14 nt, Molluscum contagiosum virus
cgaggugcugcgcc

SEQ ID NO: 4042985 - RNA, 20 nt, Molluscum contagiosum virus
cgaguccccagacuucucca

SEQ ID NO: 4042986 - RNA, 17 nt, Molluscum contagiosum virus
cgagucguacacgcaga

SEQ ID NO: 4042987 - RNA, 21 nt, Molluscum contagiosum virus
cgagucguacacgcagagcca

SEQ ID NO: 4042988 - RNA, 20 nt, Molluscum contagiosum virus
cgaucaagacauuucuccuc

SEQ ID NO: 4042989 - RNA, 17 nt, Molluscum contagiosum virus
cgaugagaacaacagcg

SEQ ID NO: 4042990 - RNA, 16 nt, Molluscum contagiosum virus
cgauggcgcagcuccu

SEQ ID NO: 4042991 - RNA, 16 nt, Molluscum contagiosum virus
cgauguacuccaccau

SEQ ID NO: 4042992 - RNA, 21 nt, Molluscum contagiosum virus
cgauguagguacccgcaaccc

SEQ ID NO: 4042993 - RNA, 20 nt, Molluscum contagiosum virus
cgauuuggacgcggcaccug

SEQ ID NO: 4042994 - RNA, 23 nt, Molluscum contagiosum virus
cgauuuguuugcaccggcaacag

SEQ ID NO: 4042995 - RNA, 21 nt, Molluscum contagiosum virus
cgcaaacaagcagucucaugg

SEQ ID NO: 4042996 - RNA, 16 nt, Molluscum contagiosum virus
cgcaaacaagcauggu

SEQ ID NO: 4042997 - RNA, 16 nt, Molluscum contagiosum virus
cgcaaagacggacccg

SEQ ID NO: 4042998 - RNA, 20 nt, Molluscum contagiosum virus
cgcaaccgcgugcgugcaca

SEQ ID NO: 4042999 - RNA, 17 nt, Molluscum contagiosum virus
cgcaagcguacgcgucg

SEQ ID NO: 4043000 - RNA, 18 nt, Molluscum contagiosum virus
cgcaagucaccgcuccgc

SEQ ID NO: 4043001 - RNA, 17 nt, Molluscum contagiosum virus
cgcaagugcacgcggcg

SEQ ID NO: 4043002 - RNA, 13 nt, Molluscum contagiosum virus
cgcaauucccggc

SEQ ID NO: 4043003 - RNA, 17 nt, Molluscum contagiosum virus
cgcacaacuugggcccg

SEQ ID NO: 4043004 - RNA, 17 nt, Molluscum contagiosum virus
cgcacaagggcagcuca

SEQ ID NO: 4043005 - RNA, 18 nt, Molluscum contagiosum virus
cgcacacuugcgcgucca

SEQ ID NO: 4043006 - RNA, 18 nt, Molluscum contagiosum virus
cgcacacuugcgcguucg

SEQ ID NO: 4043007 - RNA, 15 nt, Molluscum contagiosum virus
cgcacagccccugcu

SEQ ID NO: 4043008 - RNA, 17 nt, Molluscum contagiosum virus
cgcacagccccugcugc

SEQ ID NO: 4043009 - RNA, 17 nt, Molluscum contagiosum virus
cgcacaguaccagauua

SEQ ID NO: 4043010 - RNA, 15 nt, Molluscum contagiosum virus
cgcacccgcgcggcu

SEQ ID NO: 4043011 - RNA, 16 nt, Molluscum contagiosum virus
cgcaccgccuggugcu

SEQ ID NO: 4043012 - RNA, 14 nt, Molluscum contagiosum virus
cgcaccguacucgc

SEQ ID NO: 4043013 - RNA, 21 nt, Molluscum contagiosum virus
cgcaccuggucgagcaccugu

SEQ ID NO: 4043014 - RNA, 19 nt, Molluscum contagiosum virus
cgcaccuugacgccgcgcg

SEQ ID NO: 4043015 - RNA, 19 nt, Molluscum contagiosum virus
cgcacgaccacgcuggcac

SEQ ID NO: 4043016 - RNA, 20 nt, Molluscum contagiosum virus
cgcacgcgaacgccuacgcg

SEQ ID NO: 4043017 - RNA, 16 nt, Molluscum contagiosum virus
cgcacgcgagcacgcc

SEQ ID NO: 4043018 - RNA, 11 nt, Molluscum contagiosum virus
cgcacgcgcac

SEQ ID NO: 4043019 - RNA, 12 nt, Molluscum contagiosum virus
cgcacgcgcccu

SEQ ID NO: 4043020 - RNA, 18 nt, Molluscum contagiosum virus
cgcacgcgcgggcaucaa

SEQ ID NO: 4043021 - RNA, 18 nt, Molluscum contagiosum virus
cgcacgcggaaacaagca

SEQ ID NO: 4043022 - RNA, 13 nt, Molluscum contagiosum virus
cgcacgcgggacg

SEQ ID NO: 4043023 - RNA, 20 nt, Molluscum contagiosum virus
cgcacgcuagcgagcgcccg

SEQ ID NO: 4043024 - RNA, 22 nt, Molluscum contagiosum virus
cgcacgcuugccuuggcgcccg

SEQ ID NO: 4043025 - RNA, 22 nt, Molluscum contagiosum virus
cgcacggcuaggcgcggcgggc

SEQ ID NO: 4043026 - RNA, 18 nt, Molluscum contagiosum virus
cgcacggugugcuacugc

SEQ ID NO: 4043027 - RNA, 13 nt, Molluscum contagiosum virus
ccuggucuucccg

SEQ ID NO: 4043028 - RNA, 19 nt, Molluscum contagiosum virus
ccuggucuucccgcuggcg

SEQ ID NO: 4043029 - RNA, 13 nt, Molluscum contagiosum virus
ccuggugcugcgc

SEQ ID NO: 4043030 - RNA, 23 nt, Molluscum contagiosum virus
ccuggugcuggggcuagcgcugc

SEQ ID NO: 4043031 - RNA, 13 nt, Molluscum contagiosum virus
ccuguaccacccg

SEQ ID NO: 4043032 - RNA, 15 nt, Molluscum contagiosum virus
ccugucaagacgggc

SEQ ID NO: 4043033 - RNA, 20 nt, Molluscum contagiosum virus
ccugucaagacgggcacgcc

SEQ ID NO: 4043034 - RNA, 16 nt, Molluscum contagiosum virus
ccuguccgcggacgcg

SEQ ID NO: 4043035 - RNA, 16 nt, Molluscum contagiosum virus
ccugucgugcaauggc

SEQ ID NO: 4043036 - RNA, 17 nt, Molluscum contagiosum virus
ccuguggcgcacacgcg

SEQ ID NO: 4043037 - RNA, 14 nt, Molluscum contagiosum virus
ccuucccggcgucc

SEQ ID NO: 4043038 - RNA, 15 nt, Molluscum contagiosum virus
ccuuccgcgcgggca

SEQ ID NO: 4043039 - RNA, 16 nt, Molluscum contagiosum virus
ccuuccgcgcgggcau

SEQ ID NO: 4043040 - RNA, 17 nt, Molluscum contagiosum virus
ccuucgcguccacgggu

SEQ ID NO: 4043041 - RNA, 21 nt, Molluscum contagiosum virus
ccuucguguucgcggacggcg

SEQ ID NO: 4043042 - RNA, 22 nt, Molluscum contagiosum virus
ccuucuuccugcgcgugcgucc

SEQ ID NO: 4043043 - RNA, 15 nt, Molluscum contagiosum virus
ccuugaagggcacaa

SEQ ID NO: 4043044 - RNA, 18 nt, Molluscum contagiosum virus
ccuugaugccgugguaca

SEQ ID NO: 4043045 - RNA, 22 nt, Molluscum contagiosum virus
ccuugcccgaggagagcggcgc

SEQ ID NO: 4043046 - RNA, 20 nt, Molluscum contagiosum virus
ccuugccgaggaggugcucu

SEQ ID NO: 4043047 - RNA, 21 nt, Molluscum contagiosum virus
ccuugcgagcgcugccugugc

SEQ ID NO: 4043048 - RNA, 15 nt, Molluscum contagiosum virus
ccuugcuggcacgcg

SEQ ID NO: 4043049 - RNA, 23 nt, Molluscum contagiosum virus
ccuuggcaacgcaaacgcacgcg

SEQ ID NO: 4043050 - RNA, 17 nt, Molluscum contagiosum virus
ccuuggcagcaacugca

SEQ ID NO: 4043051 - RNA, 16 nt, Molluscum contagiosum virus
ccuuggcgcugcacag

SEQ ID NO: 4043052 - RNA, 21 nt, Molluscum contagiosum virus
ccuuggcggcgcggcuagcac

SEQ ID NO: 4043053 - RNA, 18 nt, Molluscum contagiosum virus
ccuuggcggugcgcaaag

SEQ ID NO: 4043054 - RNA, 16 nt, Molluscum contagiosum virus
ccuuggugcucauccu

SEQ ID NO: 4043055 - RNA, 16 nt, Molluscum contagiosum virus
ccuuuccccggcgucc

SEQ ID NO: 4043056 - RNA, 14 nt, Molluscum contagiosum virus
ccuuuguggacgcg

SEQ ID NO: 4043057 - RNA, 18 nt, Molluscum contagiosum virus
cgaaacacggccuccagc

SEQ ID NO: 4043058 - RNA, 17 nt, Molluscum contagiosum virus
cgaacacggcgcggauc

SEQ ID NO: 4043059 - RNA, 21 nt, Molluscum contagiosum virus
cgaaccgcggcagccuugcga

SEQ ID NO: 4043060 - RNA, 15 nt, Molluscum contagiosum virus
cgaacugcaacguga

SEQ ID NO: 4043061 - RNA, 14 nt, Molluscum contagiosum virus
cgaagaaggggccg

SEQ ID NO: 4043062 - RNA, 15 nt, Molluscum contagiosum virus
cgaagaccaccagca

SEQ ID NO: 4043063 - RNA, 16 nt, Molluscum contagiosum virus
cgaagacgaagcgcuc

SEQ ID NO: 4043064 - RNA, 18 nt, Molluscum contagiosum virus
cgaagacgagcgcgugcc

SEQ ID NO: 4043065 - RNA, 13 nt, Molluscum contagiosum virus
cgaagagcagaag

SEQ ID NO: 4043066 - RNA, 14 nt, Molluscum contagiosum virus
cgaagagcagaagg

SEQ ID NO: 4043067 - RNA, 15 nt, Molluscum contagiosum virus
cgaagagcgagaaca

SEQ ID NO: 4043068 - RNA, 18 nt, Molluscum contagiosum virus
cgaagagcgagaacacgg

SEQ ID NO: 4043069 - RNA, 16 nt, Molluscum contagiosum virus
cgaagagugcgcaaca

SEQ ID NO: 4043070 - RNA, 16 nt, Molluscum contagiosum virus
cgaagcaggcgccauc

SEQ ID NO: 4043071 - RNA, 18 nt, Molluscum contagiosum virus
cgaagcugcgcuugcgcg

SEQ ID NO: 4043072 - RNA, 18 nt, Molluscum contagiosum virus
cgaaggccgguccugacu

SEQ ID NO: 4043073 - RNA, 16 nt, Molluscum contagiosum virus
cgacaacgacagagcc

SEQ ID NO: 4043074 - RNA, 19 nt, Molluscum contagiosum virus
cgacaacgcacccgcgcgg

SEQ ID NO: 4043075 - RNA, 13 nt, Molluscum contagiosum virus
cgacaacucgcgc

SEQ ID NO: 4043076 - RNA, 18 nt, Molluscum contagiosum virus
cgacaauacggugcagcc

SEQ ID NO: 4043077 - RNA, 22 nt, Molluscum contagiosum virus
cgacacgagcgaguugagcagg

SEQ ID NO: 4043078 - RNA, 11 nt, Molluscum contagiosum virus
cgacagagccc

SEQ ID NO: 4043079 - RNA, 14 nt, Molluscum contagiosum virus
cgacagcgugcgcg

SEQ ID NO: 4043080 - RNA, 13 nt, Molluscum contagiosum virus
cgacaugcugccc

SEQ ID NO: 4043081 - RNA, 17 nt, Molluscum contagiosum virus
cgacauuucgcgccugu

SEQ ID NO: 4043082 - RNA, 18 nt, Molluscum contagiosum virus
cgacauuucgcgccuguc

SEQ ID NO: 4043083 - RNA, 16 nt, Molluscum contagiosum virus
cgaccaaaugcgcgug

SEQ ID NO: 4043084 - RNA, 16 nt, Molluscum contagiosum virus
cgaccacgugccagag

SEQ ID NO: 4043085 - RNA, 20 nt, Molluscum contagiosum virus
cgaccacgugccagagucgc

SEQ ID NO: 4043086 - RNA, 15 nt, Molluscum contagiosum virus
cgaccagcugguccu

SEQ ID NO: 4043087 - RNA, 13 nt, Molluscum contagiosum virus
cgacgacacgcgu

SEQ ID NO: 4043088 - RNA, 15 nt, Molluscum contagiosum virus
cgacgacggcacgcu

SEQ ID NO: 4043089 - RNA, 13 nt, Molluscum contagiosum virus
cgacgagggcgcc

SEQ ID NO: 4043090 - RNA, 17 nt, Molluscum contagiosum virus
cgacgccaucaggaaug

SEQ ID NO: 4043091 - RNA, 14 nt, Molluscum contagiosum virus
cgacgccgagcccg

SEQ ID NO: 4043092 - RNA, 15 nt, Molluscum contagiosum virus
cgacgccgagcccga

SEQ ID NO: 4043093 - RNA, 17 nt, Molluscum contagiosum virus
cgacgccuuccugcugg

SEQ ID NO: 4043094 - RNA, 14 nt, Molluscum contagiosum virus
cgacgcgcgcggca

SEQ ID NO: 4043095 - RNA, 14 nt, Molluscum contagiosum virus
cgacgggccccugu

SEQ ID NO: 4043096 - RNA, 23 nt, Molluscum contagiosum virus
cgacgggcucugugcggacaugc

SEQ ID NO: 4043097 - RNA, 21 nt, Molluscum contagiosum virus
cgacggucacgcaagcuuugu

SEQ ID NO: 4043098 - RNA, 16 nt, Molluscum contagiosum virus
cgacggugugccgcug

SEQ ID NO: 4043099 - RNA, 23 nt, Molluscum contagiosum virus
cgacgucgucaaggauguagccu

SEQ ID NO: 4043100 - RNA, 20 nt, Molluscum contagiosum virus
cgacgugaucgcgcaggcgc

SEQ ID NO: 4043101 - RNA, 19 nt, Molluscum contagiosum virus
cgacgugcugcugcagaac

SEQ ID NO: 4043102 - RNA, 22 nt, Molluscum contagiosum virus
cgacguggagccugaggccgcg

SEQ ID NO: 4043103 - RNA, 22 nt, Molluscum contagiosum virus
cgacguguguccgagaucacgg

SEQ ID NO: 4043104 - RNA, 14 nt, Molluscum contagiosum virus
cgacuacgcgcugc

SEQ ID NO: 4043105 - RNA, 17 nt, Molluscum contagiosum virus
cgacucgcagcucacga

SEQ ID NO: 4043106 - RNA, 13 nt, Molluscum contagiosum virus
cgacucgcgcccg

SEQ ID NO: 4043107 - RNA, 22 nt, Molluscum contagiosum virus
cgacugcgccuucugccugccc

SEQ ID NO: 4043108 - RNA, 21 nt, Molluscum contagiosum virus
cgacuuacggacgcccuccuc

SEQ ID NO: 4043109 - RNA, 12 nt, Molluscum contagiosum virus
cgacuuuguccu

SEQ ID NO: 4043110 - RNA, 18 nt, Molluscum contagiosum virus
cgacuuuucgcgccgcgg

SEQ ID NO: 4043111 - RNA, 20 nt, Molluscum contagiosum virus
cgagaaagaccuugucagug

SEQ ID NO: 4043112 - RNA, 18 nt, Molluscum contagiosum virus
cgagaaaugcgcacacuu

SEQ ID NO: 4043113 - RNA, 14 nt, Molluscum contagiosum virus
cgagaacggcucaa

SEQ ID NO: 4043114 - RNA, 20 nt, Molluscum contagiosum virus
cgagaauuucgacagcaucc

SEQ ID NO: 4043115 - RNA, 14 nt, Molluscum contagiosum virus
cgagacacgcgagc

SEQ ID NO: 4043116 - RNA, 17 nt, Molluscum contagiosum virus
cgagacgcagacgacgc

SEQ ID NO: 4043117 - RNA, 14 nt, Molluscum contagiosum virus
cgagacgcugcugc

SEQ ID NO: 4043118 - RNA, 15 nt, Molluscum contagiosum virus
cgagacgcugcugca

SEQ ID NO: 4043119 - RNA, 17 nt, Molluscum contagiosum virus
cgagacgugcggcacgc

SEQ ID NO: 4043120 - RNA, 18 nt, Molluscum contagiosum virus
cgagagugacgccucgag

SEQ ID NO: 4043121 - RNA, 19 nt, Molluscum contagiosum virus
cgagagugacgccucgaga

SEQ ID NO: 4043122 - RNA, 16 nt, Molluscum contagiosum virus
cgagauugagcucuuu

SEQ ID NO: 4043123 - RNA, 20 nt, Molluscum contagiosum virus
cgagcacagcgcgcggaagc

SEQ ID NO: 4043124 - RNA, 15 nt, Molluscum contagiosum virus
cgagcaccugucgcg

SEQ ID NO: 4043125 - RNA, 16 nt, Molluscum contagiosum virus
cgagcaccugucgcgc

SEQ ID NO: 4043126 - RNA, 16 nt, Molluscum contagiosum virus
cgagcacgagcauucc

SEQ ID NO: 4043127 - RNA, 13 nt, Molluscum contagiosum virus
cgagcacgccucc

SEQ ID NO: 4043128 - RNA, 18 nt, Molluscum contagiosum virus
cgagcacgccuccaagaa

SEQ ID NO: 4043129 - RNA, 23 nt, Molluscum contagiosum virus
cgagcacgccuccaagaagaggc

SEQ ID NO: 4043130 - RNA, 16 nt, Molluscum contagiosum virus
cgagcacgccugcacg

SEQ ID NO: 4043131 - RNA, 16 nt, Molluscum contagiosum virus
gugcgcacaugccgag

SEQ ID NO: 4043132 - RNA, 12 nt, Molluscum contagiosum virus
gugcgcaccauc

SEQ ID NO: 4043133 - RNA, 15 nt, Molluscum contagiosum virus
gugcgccgcgcccgc

SEQ ID NO: 4043134 - RNA, 17 nt, Molluscum contagiosum virus
gugcgcgacggcgagcu

SEQ ID NO: 4043135 - RNA, 15 nt, Molluscum contagiosum virus
gugcgcgcagacgug

SEQ ID NO: 4043136 - RNA, 13 nt, Molluscum contagiosum virus
gugcgcgcugcgc

SEQ ID NO: 4043137 - RNA, 15 nt, Molluscum contagiosum virus
gugcgcgugcgccug

SEQ ID NO: 4043138 - RNA, 17 nt, Molluscum contagiosum virus
gugcgcuggcgcgcgcg

SEQ ID NO: 4043139 - RNA, 20 nt, Molluscum contagiosum virus
gugcgucgacguggagccug

SEQ ID NO: 4043140 - RNA, 17 nt, Molluscum contagiosum virus
gugcgucucccaggaag

SEQ ID NO: 4043141 - RNA, 17 nt, Molluscum contagiosum virus
gugcgucucucugucuc

SEQ ID NO: 4043142 - RNA, 13 nt, Molluscum contagiosum virus
gugcgugcacagc

SEQ ID NO: 4043143 - RNA, 12 nt, Molluscum contagiosum virus
gugcgugcugcg

SEQ ID NO: 4043144 - RNA, 13 nt, Molluscum contagiosum virus
gugcucagcacgc

SEQ ID NO: 4043145 - RNA, 15 nt, Molluscum contagiosum virus
gugcucaggccagca

SEQ ID NO: 4043146 - RNA, 17 nt, Molluscum contagiosum virus
gugcucgccugcaucuu

SEQ ID NO: 4043147 - RNA, 22 nt, Molluscum contagiosum virus
gugcucguguguccgcacgcac

SEQ ID NO: 4043148 - RNA, 22 nt, Molluscum contagiosum virus
gugcucuuuaguacaacgcgcu

SEQ ID NO: 4043149 - RNA, 18 nt, Molluscum contagiosum virus
gugcugaagacgcuggcc

SEQ ID NO: 4043150 - RNA, 18 nt, Molluscum contagiosum virus
gugcugcagcugcgcgag

SEQ ID NO: 4043151 - RNA, 21 nt, Molluscum contagiosum virus
gugcuggacacucgcggcaag

SEQ ID NO: 4043152 - RNA, 14 nt, Molluscum contagiosum virus
gugcuggacgcgca

SEQ ID NO: 4043153 - RNA, 23 nt, Molluscum contagiosum virus
gugcuggagcagacguacgagca

SEQ ID NO: 4043154 - RNA, 16 nt, Molluscum contagiosum virus
gugcuggcggggcugg

SEQ ID NO: 4043155 - RNA, 21 nt, Molluscum contagiosum virus
gugcuggucaacagcuacacc

SEQ ID NO: 4043156 - RNA, 17 nt, Molluscum contagiosum virus
gugcugucccucugugc

SEQ ID NO: 4043157 - RNA, 12 nt, Molluscum contagiosum virus
gugcugugccua

SEQ ID NO: 4043158 - RNA, 14 nt, Molluscum contagiosum virus
gugcugugccuagg

SEQ ID NO: 4043159 - RNA, 14 nt, Molluscum contagiosum virus
gugcuugcgcacgg

SEQ ID NO: 4043160 - RNA, 23 nt, Molluscum contagiosum virus
guggaccuuggcgcgccgcugcc

SEQ ID NO: 4043161 - RNA, 13 nt, Molluscum contagiosum virus
guggacgagcaga

SEQ ID NO: 4043162 - RNA, 22 nt, Molluscum contagiosum virus
guggacgagcgcuaccugaugc

SEQ ID NO: 4043163 - RNA, 20 nt, Molluscum contagiosum virus
guggaucgcgcgcaccugca

SEQ ID NO: 4043164 - RNA, 16 nt, Molluscum contagiosum virus
guggauuucggcgcgc

SEQ ID NO: 4043165 - RNA, 18 nt, Molluscum contagiosum virus
guggcacccuggcugcug

SEQ ID NO: 4043166 - RNA, 19 nt, Molluscum contagiosum virus
guggcacccuggcugcugc

SEQ ID NO: 4043167 - RNA, 21 nt, Molluscum contagiosum virus
guggccaaggucucgagcucc

SEQ ID NO: 4043168 - RNA, 14 nt, Molluscum contagiosum virus
guggccaggccgcg

SEQ ID NO: 4043169 - RNA, 23 nt, Molluscum contagiosum virus
guggccgcgccgggcgccagaac

SEQ ID NO: 4043170 - RNA, 18 nt, Molluscum contagiosum virus
guggccuuuagcagcggc

SEQ ID NO: 4043171 - RNA, 13 nt, Molluscum contagiosum virus
guggcgagcaucu

SEQ ID NO: 4043172 - RNA, 20 nt, Molluscum contagiosum virus
guggcgagcaucugcgcgug

SEQ ID NO: 4043173 - RNA, 23 nt, Molluscum contagiosum virus
guggcgccauugcucgcggugcc

SEQ ID NO: 4043174 - RNA, 16 nt, Molluscum contagiosum virus
guggcgccugcgcgcg

SEQ ID NO: 4043175 - RNA, 22 nt, Molluscum contagiosum virus
guggcgcgaagugaacucuucc

SEQ ID NO: 4043176 - RNA, 17 nt, Molluscum contagiosum virus
guggcggcucugccgcg

SEQ ID NO: 4043177 - RNA, 11 nt, Molluscum contagiosum virus
guggcugugcg

SEQ ID NO: 4043178 - RNA, 22 nt, Molluscum contagiosum virus
gugggcaccugcaucgcgccgc

SEQ ID NO: 4043179 - RNA, 16 nt, Molluscum contagiosum virus
guggucgcgcgcgcuc

SEQ ID NO: 4043180 - RNA, 17 nt, Molluscum contagiosum virus
gugguuuacaucggcuc

SEQ ID NO: 4043181 - RNA, 22 nt, Molluscum contagiosum virus
guguacgcacggggccgcacgc

SEQ ID NO: 4043182 - RNA, 14 nt, Molluscum contagiosum virus
guguccacgacacu

SEQ ID NO: 4043183 - RNA, 22 nt, Molluscum contagiosum virus
guguccacgaugaacggcuccu

SEQ ID NO: 4043184 - RNA, 19 nt, Molluscum contagiosum virus
guguccgcgggcgcgcgcc

SEQ ID NO: 4043185 - RNA, 14 nt, Molluscum contagiosum virus
guguccucuucaca

SEQ ID NO: 4043186 - RNA, 16 nt, Molluscum contagiosum virus
gugucuggagcccacg

SEQ ID NO: 4043187 - RNA, 24 nt, Molluscum contagiosum virus
gugugcaggaacugcccgcgucgc

SEQ ID NO: 4043188 - RNA, 18 nt, Molluscum contagiosum virus
gugugccagcggcgccgc

SEQ ID NO: 4043189 - RNA, 17 nt, Molluscum contagiosum virus
gugugcggagagccgcc

SEQ ID NO: 4043190 - RNA, 13 nt, Molluscum contagiosum virus
gugugcguacugg

SEQ ID NO: 4043191 - RNA, 17 nt, Molluscum contagiosum virus
gugugcucugugcgcgc

SEQ ID NO: 4043192 - RNA, 19 nt, Molluscum contagiosum virus
guguggcuugcgggacaga

SEQ ID NO: 4043193 - RNA, 13 nt, Molluscum contagiosum virus
guguugcuguucc

SEQ ID NO: 4043194 - RNA, 11 nt, Molluscum contagiosum virus
guguuucucgc

SEQ ID NO: 4043195 - RNA, 14 nt, Molluscum contagiosum virus
guuacucucagagc

SEQ ID NO: 4043196 - RNA, 22 nt, Molluscum contagiosum virus
guucaacaucguggcgcgcgcg

SEQ ID NO: 4043197 - RNA, 15 nt, Molluscum contagiosum virus
guucagguagcgcgc

SEQ ID NO: 4043198 - RNA, 17 nt, Molluscum contagiosum virus
guuccacuacaagcagc

SEQ ID NO: 4043199 - RNA, 16 nt, Molluscum contagiosum virus
guuccagcuccggcuu

SEQ ID NO: 4043200 - RNA, 17 nt, Molluscum contagiosum virus
guuccaggaacgccgcc

SEQ ID NO: 4043201 - RNA, 20 nt, Molluscum contagiosum virus
guuccaggaacgccgccacg

SEQ ID NO: 4043202 - RNA, 13 nt, Molluscum contagiosum virus
guuccccgugagc

SEQ ID NO: 4043203 - RNA, 17 nt, Molluscum contagiosum virus
guuccgaacaguacuuu

SEQ ID NO: 4043204 - RNA, 22 nt, Molluscum contagiosum virus
guuccgccuaccccuugcuuca

SEQ ID NO: 4043205 - RNA, 14 nt, Molluscum contagiosum virus
guuccugccgggag

SEQ ID NO: 4043206 - RNA, 17 nt, Molluscum contagiosum virus
guuccuggugugccagc

SEQ ID NO: 4043207 - RNA, 17 nt, Molluscum contagiosum virus
guucgacuacacgcgcu

SEQ ID NO: 4043208 - RNA, 17 nt, Molluscum contagiosum virus
guucgagaccagccgcg

SEQ ID NO: 4043209 - RNA, 15 nt, Molluscum contagiosum virus
guucgagcugcugcg

SEQ ID NO: 4043210 - RNA, 17 nt, Molluscum contagiosum virus
guucgcggagcugugcc

SEQ ID NO: 4043211 - RNA, 18 nt, Molluscum contagiosum virus
guucgcggagcugugccg

SEQ ID NO: 4043212 - RNA, 16 nt, Molluscum contagiosum virus
guucgcgggaccgccc

SEQ ID NO: 4043213 - RNA, 15 nt, Molluscum contagiosum virus
guucgcugcuggcag

SEQ ID NO: 4043214 - RNA, 17 nt, Molluscum contagiosum virus
guucguccgcucgugcc

SEQ ID NO: 4043215 - RNA, 20 nt, Molluscum contagiosum virus
guucugcaucuucugccagg

SEQ ID NO: 4043216 - RNA, 20 nt, Molluscum contagiosum virus
guugaagcucucgcagagga

SEQ ID NO: 4043217 - RNA, 14 nt, Molluscum contagiosum virus
guugcagcccacca

SEQ ID NO: 4043218 - RNA, 17 nt, Molluscum contagiosum virus
guugccgcgcgcugcuc

SEQ ID NO: 4043219 - RNA, 13 nt, Molluscum contagiosum virus
guugccugcacug

SEQ ID NO: 4043220 - RNA, 19 nt, Molluscum contagiosum virus
guugcgcacguuggccacg

SEQ ID NO: 4043221 - RNA, 24 nt, Molluscum contagiosum virus
guugcgcagcacaaacucgcagaa

SEQ ID NO: 4043222 - RNA, 15 nt, Molluscum contagiosum virus
guuggucuccuccuu

SEQ ID NO: 4043223 - RNA, 16 nt, Molluscum contagiosum virus
guugucgaguucgcuc

SEQ ID NO: 4043224 - RNA, 18 nt, Molluscum contagiosum virus
guuguugcaucuucuugc

SEQ ID NO: 4043225 - RNA, 23 nt, Molluscum contagiosum virus
guuuccagggcaguacgcgcgug

SEQ ID NO: 4043226 - RNA, 19 nt, Molluscum contagiosum virus
guuugcgcucucagagcau

SEQ ID NO: 4043227 - RNA, 21 nt, Molluscum contagiosum virus
guuugcgggcgcaggcccgcc

SEQ ID NO: 4043228 - RNA, 12 nt, Molluscum contagiosum virus
uaacaaggaaaa

SEQ ID NO: 4043229 - RNA, 14 nt, Molluscum contagiosum virus
uaagaguccacugc

SEQ ID NO: 4043230 - RNA, 23 nt, Molluscum contagiosum virus
uaagcucugcguuuugcgcggca

SEQ ID NO: 4043231 - RNA, 15 nt, Molluscum contagiosum virus
uacacauugcgugug

SEQ ID NO: 4043232 - RNA, 20 nt, Molluscum contagiosum virus
uacaccagcuggacggugcu

SEQ ID NO: 4043233 - RNA, 17 nt, Molluscum contagiosum virus
uacacgcacgaccucac

SEQ ID NO: 4043234 - RNA, 22 nt, Molluscum contagiosum virus
uacacguggaauugcggccagg

SEQ ID NO: 4043235 - RNA, 18 nt, Molluscum contagiosum virus
gcgugucgcggagcaacg

SEQ ID NO: 4043236 - RNA, 23 nt, Molluscum contagiosum virus
gcgugucgguaugcgaggccugc

SEQ ID NO: 4043237 - RNA, 16 nt, Molluscum contagiosum virus
gcgugucuggagccca

SEQ ID NO: 4043238 - RNA, 21 nt, Molluscum contagiosum virus
gcgugugcgcgagcugaggca

SEQ ID NO: 4043239 - RNA, 18 nt, Molluscum contagiosum virus
gcguguugaacucgagca

SEQ ID NO: 4043240 - RNA, 16 nt, Molluscum contagiosum virus
gcguucacggacucga

SEQ ID NO: 4043241 - RNA, 17 nt, Molluscum contagiosum virus
gcguucuccaggaacgc

SEQ ID NO: 4043242 - RNA, 16 nt, Molluscum contagiosum virus
gcguucuucguggcgc

SEQ ID NO: 4043243 - RNA, 13 nt, Molluscum contagiosum virus
gcguugcugcugc

SEQ ID NO: 4043244 - RNA, 13 nt, Molluscum contagiosum virus
gcguuguccgcgu

SEQ ID NO: 4043245 - RNA, 16 nt, Molluscum contagiosum virus
gcguugugcggggcuc

SEQ ID NO: 4043246 - RNA, 19 nt, Molluscum contagiosum virus
gcuacagcagccgcagccc

SEQ ID NO: 4043247 - RNA, 23 nt, Molluscum contagiosum virus
gcuaccaagaacagagaaaggca

SEQ ID NO: 4043248 - RNA, 16 nt, Molluscum contagiosum virus
gcuaccagcucgcgca

SEQ ID NO: 4043249 - RNA, 16 nt, Molluscum contagiosum virus
gcuacccguugcugcg

SEQ ID NO: 4043250 - RNA, 14 nt, Molluscum contagiosum virus
gcuacgcagcgcgc

SEQ ID NO: 4043251 - RNA, 14 nt, Molluscum contagiosum virus
gcuacgcgagcacu

SEQ ID NO: 4043252 - RNA, 15 nt, Molluscum contagiosum virus
gcuacgcgagcacug

SEQ ID NO: 4043253 - RNA, 19 nt, Molluscum contagiosum virus
gcuacgcgagcacugcgcg

SEQ ID NO: 4043254 - RNA, 18 nt, Molluscum contagiosum virus
gcuacgucgcggcgcacg

SEQ ID NO: 4043255 - RNA, 20 nt, Molluscum contagiosum virus
gcuacgucgcggcgcacggu

SEQ ID NO: 4043256 - RNA, 18 nt, Molluscum contagiosum virus
gcuacugcaacguggcgc

SEQ ID NO: 4043257 - RNA, 17 nt, Molluscum contagiosum virus
gcuacuuggacgcgauc

SEQ ID NO: 4043258 - RNA, 13 nt, Molluscum contagiosum virus
gcuagagugcgcg

SEQ ID NO: 4043259 - RNA, 18 nt, Molluscum contagiosum virus
gcuagcaggcgucgcgca

SEQ ID NO: 4043260 - RNA, 22 nt, Molluscum contagiosum virus
gcuagccgccgcugccgcgcgc

SEQ ID NO: 4043261 - RNA, 17 nt, Molluscum contagiosum virus
gcuagcgcuggagauga

SEQ ID NO: 4043262 - RNA, 19 nt, Molluscum contagiosum virus
gcuagcuccacgugccgcu

SEQ ID NO: 4043263 - RNA, 11 nt, Molluscum contagiosum virus
gcuagcucugc

SEQ ID NO: 4043264 - RNA, 23 nt, Molluscum contagiosum virus
gcuaguccgcguacagcgcgcgu

SEQ ID NO: 4043265 - RNA, 21 nt, Molluscum contagiosum virus
gcucaaaguguacuauuacac

SEQ ID NO: 4043266 - RNA, 14 nt, Molluscum contagiosum virus
gcucaagaucucgc

SEQ ID NO: 4043267 - RNA, 22 nt, Molluscum contagiosum virus
gcucacccugcacgcuacggcu

SEQ ID NO: 4043268 - RNA, 16 nt, Molluscum contagiosum virus
gcucaccgccgagaug

SEQ ID NO: 4043269 - RNA, 22 nt, Molluscum contagiosum virus
gcucaccgccgagauggagcuc

SEQ ID NO: 4043270 - RNA, 14 nt, Molluscum contagiosum virus
gcucaccgcgcaga

SEQ ID NO: 4043271 - RNA, 19 nt, Molluscum contagiosum virus
gcucaccgcgcagaagcca

SEQ ID NO: 4043272 - RNA, 14 nt, Molluscum contagiosum virus
gcucacgcugcccg

SEQ ID NO: 4043273 - RNA, 18 nt, Molluscum contagiosum virus
gcucacggcggcgcucaa

SEQ ID NO: 4043274 - RNA, 21 nt, Molluscum contagiosum virus
gcucacguacgacugcuuuga

SEQ ID NO: 4043275 - RNA, 17 nt, Molluscum contagiosum virus
gcucauacuccugcugg

SEQ ID NO: 4043276 - RNA, 23 nt, Molluscum contagiosum virus
gcucaucaccgacacgcgcccgc

SEQ ID NO: 4043277 - RNA, 21 nt, Molluscum contagiosum virus
gcucaugcgcgggaugcugga

SEQ ID NO: 4043278 - RNA, 18 nt, Molluscum contagiosum virus
gcucauggacaugcucga

SEQ ID NO: 4043279 - RNA, 23 nt, Molluscum contagiosum virus
gcucauggucgucuccgggggcg

SEQ ID NO: 4043280 - RNA, 14 nt, Molluscum contagiosum virus
gcuccaacagcagc

SEQ ID NO: 4043281 - RNA, 15 nt, Molluscum contagiosum virus
gcuccaacagcagcu

SEQ ID NO: 4043282 - RNA, 22 nt, Molluscum contagiosum virus
gcuccagagccgcgugcgccgc

SEQ ID NO: 4043283 - RNA, 19 nt, Molluscum contagiosum virus
gcuccagcauggcgccaca

SEQ ID NO: 4043284 - RNA, 20 nt, Molluscum contagiosum virus
gcuccagcguuuccucuggc

SEQ ID NO: 4043285 - RNA, 15 nt, Molluscum contagiosum virus
gcucccucgcgcgca

SEQ ID NO: 4043286 - RNA, 19 nt, Molluscum contagiosum virus
gcuccgcacguggagucac

SEQ ID NO: 4043287 - RNA, 12 nt, Molluscum contagiosum virus
gcuccgccugca

SEQ ID NO: 4043288 - RNA, 22 nt, Molluscum contagiosum virus
gcuccgcgcggcgcucugccac

SEQ ID NO: 4043289 - RNA, 18 nt, Molluscum contagiosum virus
gcuccgggcgcuccgagc

SEQ ID NO: 4043290 - RNA, 22 nt, Molluscum contagiosum virus
gcuccgugcccacgagcgccag

SEQ ID NO: 4043291 - RNA, 22 nt, Molluscum contagiosum virus
gcuccuauaaauggccgcgccc

SEQ ID NO: 4043292 - RNA, 16 nt, Molluscum contagiosum virus
gcuccucgcacgggcg

SEQ ID NO: 4043293 - RNA, 16 nt, Molluscum contagiosum virus
gcuccugaucugcgug

SEQ ID NO: 4043294 - RNA, 18 nt, Molluscum contagiosum virus
gcuccuggucuucccgcu

SEQ ID NO: 4043295 - RNA, 17 nt, Molluscum contagiosum virus
gcuccuucucagggcuu

SEQ ID NO: 4043296 - RNA, 19 nt, Molluscum contagiosum virus
gcucgaacgcgcgugcgcg

SEQ ID NO: 4043297 - RNA, 17 nt, Molluscum contagiosum virus
gcucgaaguagccuccg

SEQ ID NO: 4043298 - RNA, 12 nt, Molluscum contagiosum virus
gcucgagaacga

SEQ ID NO: 4043299 - RNA, 19 nt, Molluscum contagiosum virus
gcucgagccugccagcgcc

SEQ ID NO: 4043300 - RNA, 15 nt, Molluscum contagiosum virus
gcucgagcgcgcgcc

SEQ ID NO: 4043301 - RNA, 20 nt, Molluscum contagiosum virus
gcucgaggaccucgcgcgcc

SEQ ID NO: 4043302 - RNA, 15 nt, Molluscum contagiosum virus
gcucgaggcgccguc

SEQ ID NO: 4043303 - RNA, 15 nt, Molluscum contagiosum virus
gcucgaggugugccu

SEQ ID NO: 4043304 - RNA, 19 nt, Molluscum contagiosum virus
guacuccuugaagggcaca

SEQ ID NO: 4043305 - RNA, 16 nt, Molluscum contagiosum virus
guacugccgccaggaa

SEQ ID NO: 4043306 - RNA, 13 nt, Molluscum contagiosum virus
guacugcugcagg

SEQ ID NO: 4043307 - RNA, 14 nt, Molluscum contagiosum virus
guagcaaggggucu

SEQ ID NO: 4043308 - RNA, 19 nt, Molluscum contagiosum virus
guagcacgaaggacgcgcu

SEQ ID NO: 4043309 - RNA, 16 nt, Molluscum contagiosum virus
guagcagcgccggcag

SEQ ID NO: 4043310 - RNA, 20 nt, Molluscum contagiosum virus
guagcagcgccugcacgcac

SEQ ID NO: 4043311 - RNA, 20 nt, Molluscum contagiosum virus
guagcccaggaacaucugca

SEQ ID NO: 4043312 - RNA, 20 nt, Molluscum contagiosum virus
guagcgaaugcagugcccgg

SEQ ID NO: 4043313 - RNA, 17 nt, Molluscum contagiosum virus
guagcgcucgcccagcu

SEQ ID NO: 4043314 - RNA, 15 nt, Molluscum contagiosum virus
guagcgugcgccugc

SEQ ID NO: 4043315 - RNA, 18 nt, Molluscum contagiosum virus
guagcuagcucugcgcgc

SEQ ID NO: 4043316 - RNA, 15 nt, Molluscum contagiosum virus
guaguacggcacgga

SEQ ID NO: 4043317 - RNA, 17 nt, Molluscum contagiosum virus
guaugcccacugggaac

SEQ ID NO: 4043318 - RNA, 19 nt, Molluscum contagiosum virus
guaugcgaggccugcgugg

SEQ ID NO: 4043319 - RNA, 19 nt, Molluscum contagiosum virus
gucaacagugcgugccagg

SEQ ID NO: 4043320 - RNA, 18 nt, Molluscum contagiosum virus
gucaagcagcgcgccacc

SEQ ID NO: 4043321 - RNA, 15 nt, Molluscum contagiosum virus
gucaaugacacgagc

SEQ ID NO: 4043322 - RNA, 20 nt, Molluscum contagiosum virus
gucaauggcgcgcgagcaca

SEQ ID NO: 4043323 - RNA, 18 nt, Molluscum contagiosum virus
gucacgcgcaaggccgcg

SEQ ID NO: 4043324 - RNA, 19 nt, Molluscum contagiosum virus
gucacgcuggucacgcgcu

SEQ ID NO: 4043325 - RNA, 16 nt, Molluscum contagiosum virus
gucacggccuucgcgc

SEQ ID NO: 4043326 - RNA, 18 nt, Molluscum contagiosum virus
gucacucgcgagacggaa

SEQ ID NO: 4043327 - RNA, 16 nt, Molluscum contagiosum virus
gucagcagcgcgagcu

SEQ ID NO: 4043328 - RNA, 17 nt, Molluscum contagiosum virus
gucagccgcacggcgcc

SEQ ID NO: 4043329 - RNA, 18 nt, Molluscum contagiosum virus
gucagccucugugcggcg

SEQ ID NO: 4043330 - RNA, 15 nt, Molluscum contagiosum virus
gucaguacaugcccg

SEQ ID NO: 4043331 - RNA, 17 nt, Molluscum contagiosum virus
gucaucaccagccugcu

SEQ ID NO: 4043332 - RNA, 14 nt, Molluscum contagiosum virus
gucaucggagagcc

SEQ ID NO: 4043333 - RNA, 19 nt, Molluscum contagiosum virus
gucaucgggcugcagcccu

SEQ ID NO: 4043334 - RNA, 21 nt, Molluscum contagiosum virus
guccacaaagcccuccugaga

SEQ ID NO: 4043335 - RNA, 12 nt, Molluscum contagiosum virus
guccacguggug

SEQ ID NO: 4043336 - RNA, 17 nt, Molluscum contagiosum virus
guccagccgcagccgcg

SEQ ID NO: 4043337 - RNA, 17 nt, Molluscum contagiosum virus
guccaucaaggccuacg

SEQ ID NO: 4043338 - RNA, 14 nt, Molluscum contagiosum virus
guccaucggugggc

SEQ ID NO: 4043339 - RNA, 19 nt, Molluscum contagiosum virus
gucccagcaccgcgccgcg

SEQ ID NO: 4043340 - RNA, 12 nt, Molluscum contagiosum virus
guccccaagagc

SEQ ID NO: 4043341 - RNA, 21 nt, Molluscum contagiosum virus
guccgacaccggacgaaaggu

SEQ ID NO: 4043342 - RNA, 19 nt, Molluscum contagiosum virus
guccgacuccaaggagguc

SEQ ID NO: 4043343 - RNA, 22 nt, Molluscum contagiosum virus
guccgcacgaggagccccgcgg

SEQ ID NO: 4043344 - RNA, 16 nt, Molluscum contagiosum virus
guccgcacgcacacga

SEQ ID NO: 4043345 - RNA, 20 nt, Molluscum contagiosum virus
guccgcacgcacggagcaca

SEQ ID NO: 4043346 - RNA, 20 nt, Molluscum contagiosum virus
guccgccucgagcacgccuc

SEQ ID NO: 4043347 - RNA, 19 nt, Molluscum contagiosum virus
guccgcggacgcgggccug

SEQ ID NO: 4043348 - RNA, 20 nt, Molluscum contagiosum virus
guccgcggacgcgggccugu

SEQ ID NO: 4043349 - RNA, 14 nt, Molluscum contagiosum virus
guccgcggcgcgcc

SEQ ID NO: 4043350 - RNA, 22 nt, Molluscum contagiosum virus
guccgcucgugccacugccgcc

SEQ ID NO: 4043351 - RNA, 21 nt, Molluscum contagiosum virus
guccggcaugcgcgcgcugcc

SEQ ID NO: 4043352 - RNA, 16 nt, Molluscum contagiosum virus
guccggcccgaagccg

SEQ ID NO: 4043353 - RNA, 15 nt, Molluscum contagiosum virus
guccggcgcucgccc

SEQ ID NO: 4043354 - RNA, 20 nt, Molluscum contagiosum virus
guccuacacgccgcuggagc

SEQ ID NO: 4043355 - RNA, 13 nt, Molluscum contagiosum virus
guccugcgugcuu

SEQ ID NO: 4043356 - RNA, 14 nt, Molluscum contagiosum virus
guccugcuagcgug

SEQ ID NO: 4043357 - RNA, 18 nt, Molluscum contagiosum virus
guccuguccgcggacgcg

SEQ ID NO: 4043358 - RNA, 16 nt, Molluscum contagiosum virus
guccuucaagaacgac

SEQ ID NO: 4043359 - RNA, 21 nt, Molluscum contagiosum virus
gucgagagcgcguucacaaag

SEQ ID NO: 4043360 - RNA, 18 nt, Molluscum contagiosum virus
gucgaguucgcucgcucg

SEQ ID NO: 4043361 - RNA, 22 nt, Molluscum contagiosum virus
gucgcaaccccgcgcugcgcgg

SEQ ID NO: 4043362 - RNA, 14 nt, Molluscum contagiosum virus
gucgcccgccgagc

SEQ ID NO: 4043363 - RNA, 22 nt, Molluscum contagiosum virus
gucgccggacagcucagcaggc

SEQ ID NO: 4043364 - RNA, 12 nt, Molluscum contagiosum virus
gucgccgucguc

SEQ ID NO: 4043365 - RNA, 13 nt, Molluscum contagiosum virus
gucgcgacgcgcu

SEQ ID NO: 4043366 - RNA, 15 nt, Molluscum contagiosum virus
gucgcgacggagaug

SEQ ID NO: 4043367 - RNA, 14 nt, Molluscum contagiosum virus
gucgcgcgccacaa

SEQ ID NO: 4043368 - RNA, 13 nt, Molluscum contagiosum virus
gucgcgcgccgca

SEQ ID NO: 4043369 - RNA, 21 nt, Molluscum contagiosum virus
gucgcgcgcuaccugcgcaag

SEQ ID NO: 4043370 - RNA, 15 nt, Molluscum contagiosum virus
gucgcgcgcugugga

SEQ ID NO: 4043371 - RNA, 16 nt, Molluscum contagiosum virus
gucgcgcuuccgcgag

SEQ ID NO: 4043372 - RNA, 16 nt, Molluscum contagiosum virus
gucgcgggcgcgcgcg

SEQ ID NO: 4043373 - RNA, 14 nt, Molluscum contagiosum virus
gucguaccuguguu

SEQ ID NO: 4043374 - RNA, 21 nt, Molluscum contagiosum virus
gucguagcaaaugcgcugcuc

SEQ ID NO: 4043375 - RNA, 13 nt, Molluscum contagiosum virus
gucguagcggcgg

SEQ ID NO: 4043376 - RNA, 12 nt, Molluscum contagiosum virus
gucuacgugucc

SEQ ID NO: 4043377 - RNA, 22 nt, Molluscum contagiosum virus
gucuagccgugaacgaggcugc

SEQ ID NO: 4043378 - RNA, 21 nt, Molluscum contagiosum virus
gucuccacgcgugcgcgccag

SEQ ID NO: 4043379 - RNA, 21 nt, Molluscum contagiosum virus
gucuccuccuugauuucgcgc

SEQ ID NO: 4043380 - RNA, 23 nt, Molluscum contagiosum virus
gucucgagcuuccucaaggcgca

SEQ ID NO: 4043381 - RNA, 21 nt, Molluscum contagiosum virus
gucugaaaggacaugggcaca

SEQ ID NO: 4043382 - RNA, 15 nt, Molluscum contagiosum virus
gucugcaaggccugu

SEQ ID NO: 4043383 - RNA, 15 nt, Molluscum contagiosum virus
gucuggccgggcucg

SEQ ID NO: 4043384 - RNA, 21 nt, Molluscum contagiosum virus
gugaacgaggcugcugccgcg

SEQ ID NO: 4043385 - RNA, 19 nt, Molluscum contagiosum virus
gugaagacgcuggcggcgc

SEQ ID NO: 4043386 - RNA, 15 nt, Molluscum contagiosum virus
gugaccugcgccauc

SEQ ID NO: 4043387 - RNA, 20 nt, Molluscum contagiosum virus
gugacggccguguacaugcu

SEQ ID NO: 4043388 - RNA, 12 nt, Molluscum contagiosum virus
gugagugcgcgc

SEQ ID NO: 4043389 - RNA, 16 nt, Molluscum contagiosum virus
gugaugugcgcacaga

SEQ ID NO: 4043390 - RNA, 17 nt, Molluscum contagiosum virus
gugcaagcccagcagcg

SEQ ID NO: 4043391 - RNA, 13 nt, Molluscum contagiosum virus
gugcaauuccguc

SEQ ID NO: 4043392 - RNA, 19 nt, Molluscum contagiosum virus
gugcacauugcugcugcag

SEQ ID NO: 4043393 - RNA, 20 nt, Molluscum contagiosum virus
gugcacucgagaagaggguc

SEQ ID NO: 4043394 - RNA, 21 nt, Molluscum contagiosum virus
gugcagaugaggcugcucucc

SEQ ID NO: 4043395 - RNA, 18 nt, Molluscum contagiosum virus
gugcagggcgugcuugcc

SEQ ID NO: 4043396 - RNA, 11 nt, Molluscum contagiosum virus
gugccacugcc

SEQ ID NO: 4043397 - RNA, 20 nt, Molluscum contagiosum virus
gugccaucucgcacacugca

SEQ ID NO: 4043398 - RNA, 21 nt, Molluscum contagiosum virus
gugccaucucgcacacugcag

SEQ ID NO: 4043399 - RNA, 16 nt, Molluscum contagiosum virus
gugcccuacgcgcgcg

SEQ ID NO: 4043400 - RNA, 12 nt, Molluscum contagiosum virus
gugcccugucca

SEQ ID NO: 4043401 - RNA, 15 nt, Molluscum contagiosum virus
gugccgacgugugcc

SEQ ID NO: 4043402 - RNA, 18 nt, Molluscum contagiosum virus
gugccgagcucgccuccu

SEQ ID NO: 4043403 - RNA, 21 nt, Molluscum contagiosum virus
gugccgcaagaaaggcggugc

SEQ ID NO: 4043404 - RNA, 23 nt, Molluscum contagiosum virus
gugccgcuccuucgaagaggucu

SEQ ID NO: 4043405 - RNA, 18 nt, Molluscum contagiosum virus
gugccgggcuugcucccu

SEQ ID NO: 4043406 - RNA, 19 nt, Molluscum contagiosum virus
gugccuuguacgggugcau

SEQ ID NO: 4043407 - RNA, 21 nt, Molluscum contagiosum virus
gugcgagaacuggcgcagcag

SEQ ID NO: 4043408 - RNA, 17 nt, Molluscum contagiosum virus
gcucuucgacagcgugc

SEQ ID NO: 4043409 - RNA, 19 nt, Molluscum contagiosum virus
gcucuucgaccucugcuuc

SEQ ID NO: 4043410 - RNA, 13 nt, Molluscum contagiosum virus
gcucuucucgcag

SEQ ID NO: 4043411 - RNA, 18 nt, Molluscum contagiosum virus
gcugaagaaggagcccuu

SEQ ID NO: 4043412 - RNA, 24 nt, Molluscum contagiosum virus
gcugaaggcauaccugugccagcg

SEQ ID NO: 4043413 - RNA, 18 nt, Molluscum contagiosum virus
gcugacccucgcggcucu

SEQ ID NO: 4043414 - RNA, 19 nt, Molluscum contagiosum virus
gcugacggccggcgggcgc

SEQ ID NO: 4043415 - RNA, 19 nt, Molluscum contagiosum virus
gcugagagacuucuugcac

SEQ ID NO: 4043416 - RNA, 17 nt, Molluscum contagiosum virus
gcugagcaagcucaaga

SEQ ID NO: 4043417 - RNA, 18 nt, Molluscum contagiosum virus
gcugagcgcgcugcgccg

SEQ ID NO: 4043418 - RNA, 14 nt, Molluscum contagiosum virus
gcugagcgugucga

SEQ ID NO: 4043419 - RNA, 17 nt, Molluscum contagiosum virus
gcugagcuagugccgag

SEQ ID NO: 4043420 - RNA, 14 nt, Molluscum contagiosum virus
gcugaugcccaggc

SEQ ID NO: 4043421 - RNA, 18 nt, Molluscum contagiosum virus
gcugcaagauuguagaga

SEQ ID NO: 4043422 - RNA, 19 nt, Molluscum contagiosum virus
gcugcacacaccgcgagca

SEQ ID NO: 4043423 - RNA, 16 nt, Molluscum contagiosum virus
gcugcacaugugcgug

SEQ ID NO: 4043424 - RNA, 13 nt, Molluscum contagiosum virus
gcugcaccggcgc

SEQ ID NO: 4043425 - RNA, 15 nt, Molluscum contagiosum virus
gcugcacgugcagcg

SEQ ID NO: 4043426 - RNA, 16 nt, Molluscum contagiosum virus
gcugcagaacugccug

SEQ ID NO: 4043427 - RNA, 20 nt, Molluscum contagiosum virus
gcugcagaacugccugguca

SEQ ID NO: 4043428 - RNA, 17 nt, Molluscum contagiosum virus
gcugcaggaccugcugg

SEQ ID NO: 4043429 - RNA, 19 nt, Molluscum contagiosum virus
gcugcaggaccugcuggug

SEQ ID NO: 4043430 - RNA, 12 nt, Molluscum contagiosum virus
gcugccccccuc

SEQ ID NO: 4043431 - RNA, 21 nt, Molluscum contagiosum virus
gcugcccccgccaugccaacg

SEQ ID NO: 4043432 - RNA, 21 nt, Molluscum contagiosum virus
gcugcccgcgcgcgacuacgc

SEQ ID NO: 4043433 - RNA, 19 nt, Molluscum contagiosum virus
gcugcccgcggagaccacc

SEQ ID NO: 4043434 - RNA, 20 nt, Molluscum contagiosum virus
gcugcccguggugggccgcg

SEQ ID NO: 4043435 - RNA, 15 nt, Molluscum contagiosum virus
gcugccggcucaagc

SEQ ID NO: 4043436 - RNA, 16 nt, Molluscum contagiosum virus
gcugcgcacgugcgcg

SEQ ID NO: 4043437 - RNA, 20 nt, Molluscum contagiosum virus
gcugcgcauggccacgcccg

SEQ ID NO: 4043438 - RNA, 15 nt, Molluscum contagiosum virus
gcugcgccggcugcg

SEQ ID NO: 4043439 - RNA, 20 nt, Molluscum contagiosum virus
gcugcgccggcugcgccacc

SEQ ID NO: 4043440 - RNA, 12 nt, Molluscum contagiosum virus
gcugcgcgcgcu

SEQ ID NO: 4043441 - RNA, 18 nt, Molluscum contagiosum virus
gcugcgcuccaugcugcc

SEQ ID NO: 4043442 - RNA, 19 nt, Molluscum contagiosum virus
gcugcgcuggaugcugcuc

SEQ ID NO: 4043443 - RNA, 17 nt, Molluscum contagiosum virus
gcugcggcugcugccug

SEQ ID NO: 4043444 - RNA, 15 nt, Molluscum contagiosum virus
gcugcggcugcugga

SEQ ID NO: 4043445 - RNA, 19 nt, Molluscum contagiosum virus
gcugcguucgagcugaucg

SEQ ID NO: 4043446 - RNA, 17 nt, Molluscum contagiosum virus
gcugcguuuccagggca

SEQ ID NO: 4043447 - RNA, 19 nt, Molluscum contagiosum virus
gcugcguuuccagggcagu

SEQ ID NO: 4043448 - RNA, 20 nt, Molluscum contagiosum virus
gcugcuccccgccagcacca

SEQ ID NO: 4043449 - RNA, 24 nt, Molluscum contagiosum virus
gcugcucgagauucguggcgagca

SEQ ID NO: 4043450 - RNA, 20 nt, Molluscum contagiosum virus
gcugcucuacuuccacgagc

SEQ ID NO: 4043451 - RNA, 21 nt, Molluscum contagiosum virus
gcugcucuacuuccacgagcu

SEQ ID NO: 4043452 - RNA, 18 nt, Molluscum contagiosum virus
gcugcugcggcugcugga

SEQ ID NO: 4043453 - RNA, 19 nt, Molluscum contagiosum virus
gcugcugcggcugcuggag

SEQ ID NO: 4043454 - RNA, 19 nt, Molluscum contagiosum virus
gcugcugcucuuccaggag

SEQ ID NO: 4043455 - RNA, 16 nt, Molluscum contagiosum virus
gcugcugguucugcuc

SEQ ID NO: 4043456 - RNA, 18 nt, Molluscum contagiosum virus
gcugcuucccgcugagcg

SEQ ID NO: 4043457 - RNA, 13 nt, Molluscum contagiosum virus
gcuggacgugggc

SEQ ID NO: 4043458 - RNA, 22 nt, Molluscum contagiosum virus
gcuggagaaagaagugugccug

SEQ ID NO: 4043459 - RNA, 16 nt, Molluscum contagiosum virus
gcuggagacggcagug

SEQ ID NO: 4043460 - RNA, 13 nt, Molluscum contagiosum virus
gcuggagcacgac

SEQ ID NO: 4043461 - RNA, 23 nt, Molluscum contagiosum virus
gcuggagcagacguacgagcagg

SEQ ID NO: 4043462 - RNA, 22 nt, Molluscum contagiosum virus
gcuggagcgagugcgcgugcgc

SEQ ID NO: 4043463 - RNA, 13 nt, Molluscum contagiosum virus
gcuggaggauucu

SEQ ID NO: 4043464 - RNA, 15 nt, Molluscum contagiosum virus
gcuggcaccgggcgc

SEQ ID NO: 4043465 - RNA, 23 nt, Molluscum contagiosum virus
gcuggcacggccggcgccgcgca

SEQ ID NO: 4043466 - RNA, 22 nt, Molluscum contagiosum virus
gcuggccaacacuaccacagcc

SEQ ID NO: 4043467 - RNA, 12 nt, Molluscum contagiosum virus
gcuggcccugcu

SEQ ID NO: 4043468 - RNA, 13 nt, Molluscum contagiosum virus
gcuggccucugcc

SEQ ID NO: 4043469 - RNA, 15 nt, Molluscum contagiosum virus
gcuggcgagcacguc

SEQ ID NO: 4043470 - RNA, 14 nt, Molluscum contagiosum virus
cuccgcacguggaa

SEQ ID NO: 4043471 - RNA, 21 nt, Molluscum contagiosum virus
cuccgccgggaauaccggaga

SEQ ID NO: 4043472 - RNA, 24 nt, Molluscum contagiosum virus
cuccgcgcggcgcucugccaccgc

SEQ ID NO: 4043473 - RNA, 20 nt, Molluscum contagiosum virus
cuccgcggacgcgcccugga

SEQ ID NO: 4043474 - RNA, 14 nt, Molluscum contagiosum virus
cuccgcgggcagcc

SEQ ID NO: 4043475 - RNA, 19 nt, Molluscum contagiosum virus
cuccgggcacguccgccuc

SEQ ID NO: 4043476 - RNA, 13 nt, Molluscum contagiosum virus
cuccggggcgcaa

SEQ ID NO: 4043477 - RNA, 17 nt, Molluscum contagiosum virus
cuccgguacguacagug

SEQ ID NO: 4043478 - RNA, 15 nt, Molluscum contagiosum virus
cuccuagcccagcac

SEQ ID NO: 4043479 - RNA, 14 nt, Molluscum contagiosum virus
cuccuaucucaaag

SEQ ID NO: 4043480 - RNA, 19 nt, Molluscum contagiosum virus
cuccuccugaugcccgcga

SEQ ID NO: 4043481 - RNA, 16 nt, Molluscum contagiosum virus
cuccucgagcgccgcc

SEQ ID NO: 4043482 - RNA, 14 nt, Molluscum contagiosum virus
cuccugaggaagca

SEQ ID NO: 4043483 - RNA, 14 nt, Molluscum contagiosum virus
cuccuggccaacag

SEQ ID NO: 4043484 - RNA, 18 nt, Molluscum contagiosum virus
cuccuggucuucccgcug

SEQ ID NO: 4043485 - RNA, 17 nt, Molluscum contagiosum virus
cuccugugucgcgcgag

SEQ ID NO: 4043486 - RNA, 21 nt, Molluscum contagiosum virus
cuccuuuccaucggaacuagc

SEQ ID NO: 4043487 - RNA, 19 nt, Molluscum contagiosum virus
cuccuuugcgagcacugua

SEQ ID NO: 4043488 - RNA, 19 nt, Molluscum contagiosum virus
cggcaggcucccgcugucg

SEQ ID NO: 4043489 - RNA, 23 nt, Molluscum contagiosum virus
cggcagguuugcacccgcgcagc

SEQ ID NO: 4043490 - RNA, 14 nt, Molluscum contagiosum virus
cggcauccugauga

SEQ ID NO: 4043491 - RNA, 14 nt, Molluscum contagiosum virus
cggcaugcgcgcgc

SEQ ID NO: 4043492 - RNA, 17 nt, Molluscum contagiosum virus
cggcaugcgcgcgcagc

SEQ ID NO: 4043493 - RNA, 21 nt, Molluscum contagiosum virus
cggccacaccccguacggcgc

SEQ ID NO: 4043494 - RNA, 13 nt, Molluscum contagiosum virus
cggccagagccca

SEQ ID NO: 4043495 - RNA, 17 nt, Molluscum contagiosum virus
cggcccgagcaggacgu

SEQ ID NO: 4043496 - RNA, 17 nt, Molluscum contagiosum virus
cggccgccggcgccugu

SEQ ID NO: 4043497 - RNA, 22 nt, Molluscum contagiosum virus
cggcgacaacgacagagcccgg

SEQ ID NO: 4043498 - RNA, 13 nt, Molluscum contagiosum virus
cggcgagcgccgc

SEQ ID NO: 4043499 - RNA, 18 nt, Molluscum contagiosum virus
cggcgagcgccgcucgca

SEQ ID NO: 4043500 - RNA, 23 nt, Molluscum contagiosum virus
cggcgagcugccauggcagcucg

SEQ ID NO: 4043501 - RNA, 21 nt, Molluscum contagiosum virus
cggcgagucgcgggcgcgcgc

SEQ ID NO: 4043502 - RNA, 13 nt, Molluscum contagiosum virus
cggcgcacgcaca

SEQ ID NO: 4043503 - RNA, 17 nt, Molluscum contagiosum virus
cggcgcccaggaacagu

SEQ ID NO: 4043504 - RNA, 21 nt, Molluscum contagiosum virus
cggcgccuguuuccgcucgcg

SEQ ID NO: 4043505 - RNA, 21 nt, Molluscum contagiosum virus
cggcgccuuugccacgccagc

SEQ ID NO: 4043506 - RNA, 17 nt, Molluscum contagiosum virus
cggcgcgaaaagucggg

SEQ ID NO: 4043507 - RNA, 16 nt, Molluscum contagiosum virus
cggcgcgaagcaggcg

SEQ ID NO: 4043508 - RNA, 19 nt, Molluscum contagiosum virus
cggcgcgacggcgacgcga

SEQ ID NO: 4043509 - RNA, 23 nt, Molluscum contagiosum virus
cggcgcgccgcgggccgccgggc

SEQ ID NO: 4043510 - RNA, 16 nt, Molluscum contagiosum virus
cggcgcggcgagccgc

SEQ ID NO: 4043511 - RNA, 18 nt, Molluscum contagiosum virus
cggcgcgggcaagcaggg

SEQ ID NO: 4043512 - RNA, 23 nt, Molluscum contagiosum virus
cggcgcguccucggccagagccu

SEQ ID NO: 4043513 - RNA, 18 nt, Molluscum contagiosum virus
cggcgcgugagcgccuac

SEQ ID NO: 4043514 - RNA, 19 nt, Molluscum contagiosum virus
cggcgcgugucgcggagca

SEQ ID NO: 4043515 - RNA, 17 nt, Molluscum contagiosum virus
cggcgcucgccucuggg

SEQ ID NO: 4043516 - RNA, 14 nt, Molluscum contagiosum virus
cggcggcaugcgcg

SEQ ID NO: 4043517 - RNA, 12 nt, Molluscum contagiosum virus
cggcggccacac

SEQ ID NO: 4043518 - RNA, 18 nt, Molluscum contagiosum virus
cggcggcgcacgcggcuc

SEQ ID NO: 4043519 - RNA, 12 nt, Molluscum contagiosum virus
cggcggcuccgc

SEQ ID NO: 4043520 - RNA, 14 nt, Molluscum contagiosum virus
cggcggcugugccc

SEQ ID NO: 4043521 - RNA, 18 nt, Molluscum contagiosum virus
cggcggggaugcuucccc

SEQ ID NO: 4043522 - RNA, 16 nt, Molluscum contagiosum virus
cggcggugcccgccaa

SEQ ID NO: 4043523 - RNA, 22 nt, Molluscum contagiosum virus
cggcguacgcgcagggagcugc

SEQ ID NO: 4043524 - RNA, 15 nt, Molluscum contagiosum virus
cggcguccgcggcac

SEQ ID NO: 4043525 - RNA, 19 nt, Molluscum contagiosum virus
cggcguccggcgcucgccc

SEQ ID NO: 4043526 - RNA, 17 nt, Molluscum contagiosum virus
cggcguggccaggccgc

SEQ ID NO: 4043527 - RNA, 16 nt, Molluscum contagiosum virus
cggcguguuccggcag

SEQ ID NO: 4043528 - RNA, 19 nt, Molluscum contagiosum virus
cggcguguuuugugucgcg

SEQ ID NO: 4043529 - RNA, 19 nt, Molluscum contagiosum virus
cggcuccaacagcagcugg

SEQ ID NO: 4043530 - RNA, 22 nt, Molluscum contagiosum virus
cggcugccgugcgggcgcggcg

SEQ ID NO: 4043531 - RNA, 12 nt, Molluscum contagiosum virus
cggcugcgccac

SEQ ID NO: 4043532 - RNA, 13 nt, Molluscum contagiosum virus
cggcugcgccacc

SEQ ID NO: 4043533 - RNA, 16 nt, Molluscum contagiosum virus
cggcugcggcgcgacg

SEQ ID NO: 4043534 - RNA, 14 nt, Molluscum contagiosum virus
cggcugcuggagcu

SEQ ID NO: 4043535 - RNA, 21 nt, Molluscum contagiosum virus
cggcugguguuaccgggucgc

SEQ ID NO: 4043536 - RNA, 15 nt, Molluscum contagiosum virus
cggcuuacacacgca

SEQ ID NO: 4043537 - RNA, 20 nt, Molluscum contagiosum virus
cgggaaguguugccgccggc

SEQ ID NO: 4043538 - RNA, 22 nt, Molluscum contagiosum virus
cgggacagacaucacgcguucg

SEQ ID NO: 4043539 - RNA, 19 nt, Molluscum contagiosum virus
cgggacgcggaugccacgc

SEQ ID NO: 4043540 - RNA, 23 nt, Molluscum contagiosum virus
cgggaggcuccugccgucgcccg

SEQ ID NO: 4043541 - RNA, 16 nt, Molluscum contagiosum virus
cgggcacccagcccug

SEQ ID NO: 4043542 - RNA, 20 nt, Molluscum contagiosum virus
cgggcaccggcgcucacugc

SEQ ID NO: 4043543 - RNA, 12 nt, Molluscum contagiosum virus
cgggcacgagca

SEQ ID NO: 4043544 - RNA, 22 nt, Molluscum contagiosum virus
cgggcacggguguacaaagagc

SEQ ID NO: 4043545 - RNA, 18 nt, Molluscum contagiosum virus
cgggcacgugcugcugcg

SEQ ID NO: 4043546 - RNA, 16 nt, Molluscum contagiosum virus
cgggcacuucucgcgc

SEQ ID NO: 4043547 - RNA, 14 nt, Molluscum contagiosum virus
cgggcccgacacgu

SEQ ID NO: 4043548 - RNA, 17 nt, Molluscum contagiosum virus
cgggcccgccuuugugg

SEQ ID NO: 4043549 - RNA, 19 nt, Molluscum contagiosum virus
cgggcccgcguggcaaggg

SEQ ID NO: 4043550 - RNA, 19 nt, Molluscum contagiosum virus
cgggcccgugcucaggcca

SEQ ID NO: 4043551 - RNA, 14 nt, Molluscum contagiosum virus
cgggccgccgcccg

SEQ ID NO: 4043552 - RNA, 16 nt, Molluscum contagiosum virus
cgggccgccgcccgcg

SEQ ID NO: 4043553 - RNA, 17 nt, Molluscum contagiosum virus
cgggccgccgcccgcga

SEQ ID NO: 4043554 - RNA, 13 nt, Molluscum contagiosum virus
cgggccugcgcgc

SEQ ID NO: 4043555 - RNA, 23 nt, Molluscum contagiosum virus
cgggccuguccgcgggcgcacgc

SEQ ID NO: 4043556 - RNA, 17 nt, Molluscum contagiosum virus
cgggccuuugccgcugc

SEQ ID NO: 4043557 - RNA, 19 nt, Molluscum contagiosum virus
cgggcgcagacgccgagcg

SEQ ID NO: 4043558 - RNA, 16 nt, Molluscum contagiosum virus
cgggcgcgccaacgac

SEQ ID NO: 4043559 - RNA, 14 nt, Molluscum contagiosum virus
cgggcgcgcguacg

SEQ ID NO: 4043560 - RNA, 20 nt, Molluscum contagiosum virus
cgggcgcuccgagcggcugc

SEQ ID NO: 4043561 - RNA, 12 nt, Molluscum contagiosum virus
cgggcgugcgca

SEQ ID NO: 4043562 - RNA, 20 nt, Molluscum contagiosum virus
cgggcucgaggugugccugu

SEQ ID NO: 4043563 - RNA, 21 nt, Molluscum contagiosum virus
cgggcucgaucugcgccuccg

SEQ ID NO: 4043564 - RNA, 17 nt, Molluscum contagiosum virus
cgggcucgugcuggagc

SEQ ID NO: 4043565 - RNA, 22 nt, Molluscum contagiosum virus
cgggcucuuccaccggcagcgc

SEQ ID NO: 4043566 - RNA, 14 nt, Molluscum contagiosum virus
cgggcugcgcggcg

SEQ ID NO: 4043567 - RNA, 18 nt, Molluscum contagiosum virus
cgggcugucgcccggcag

SEQ ID NO: 4043568 - RNA, 15 nt, Molluscum contagiosum virus
cgggcuucgccgccg

SEQ ID NO: 4043569 - RNA, 13 nt, Molluscum contagiosum virus
cggggaggagcuc

SEQ ID NO: 4043570 - RNA, 22 nt, Molluscum contagiosum virus
cggggaugaacgcgcugcgcca

SEQ ID NO: 4043571 - RNA, 21 nt, Molluscum contagiosum virus
cggggcccucggcgcgccguc

SEQ ID NO: 4043572 - RNA, 15 nt, Molluscum contagiosum virus
cggggcgcgcgcugc

SEQ ID NO: 4043573 - RNA, 18 nt, Molluscum contagiosum virus
cggggcgcgcgcugcgca

SEQ ID NO: 4043574 - RNA, 19 nt, Molluscum contagiosum virus
cgggguacaggcgcggcag

SEQ ID NO: 4043575 - RNA, 17 nt, Molluscum contagiosum virus
cgggugcauacgcagag

SEQ ID NO: 4043576 - RNA, 18 nt, Molluscum contagiosum virus
cgggugccgugccccugc

SEQ ID NO: 4043577 - RNA, 17 nt, Molluscum contagiosum virus
cgguaacgcgcgcgccu

SEQ ID NO: 4043578 - RNA, 13 nt, Molluscum contagiosum virus
cgguaagcgcccc

SEQ ID NO: 4043579 - RNA, 15 nt, Molluscum contagiosum virus
cgguacaugcugucc

SEQ ID NO: 4043580 - RNA, 13 nt, Molluscum contagiosum virus
cgguccuguccgc

SEQ ID NO: 4043581 - RNA, 20 nt, Molluscum contagiosum virus
cggucgacgagugcgccgcg

SEQ ID NO: 4043582 - RNA, 18 nt, Molluscum contagiosum virus
cggucgcccuccgccgua

SEQ ID NO: 4043583 - RNA, 13 nt, Molluscum contagiosum virus
cggugagcgccgu

SEQ ID NO: 4043584 - RNA, 18 nt, Molluscum contagiosum virus
cggugcgggucucggggc

SEQ ID NO: 4043585 - RNA, 16 nt, Molluscum contagiosum virus
cggugcgugcccagca

SEQ ID NO: 4043586 - RNA, 15 nt, Molluscum contagiosum virus
cggugcucgccccuc

SEQ ID NO: 4043587 - RNA, 22 nt, Molluscum contagiosum virus
cggugcucgccccuccccggcg

SEQ ID NO: 4043588 - RNA, 17 nt, Molluscum contagiosum virus
cggugggcgccgcggcc

SEQ ID NO: 4043589 - RNA, 15 nt, Molluscum contagiosum virus
cgguggugcauccug

SEQ ID NO: 4043590 - RNA, 20 nt, Molluscum contagiosum virus
cggugugcuacugcacugca

SEQ ID NO: 4043591 - RNA, 23 nt, Molluscum contagiosum virus
cggugugcuacugcacugcagcg

SEQ ID NO: 4043592 - RNA, 23 nt, Molluscum contagiosum virus
cgcucggaauuccuugugcaauu

SEQ ID NO: 4043593 - RNA, 20 nt, Molluscum contagiosum virus
cgcucggaggcuugccccgc

SEQ ID NO: 4043594 - RNA, 20 nt, Molluscum contagiosum virus
cgcucggaggggcuccgggc

SEQ ID NO: 4043595 - RNA, 20 nt, Molluscum contagiosum virus
cgcucguccagcugcgcgag

SEQ ID NO: 4043596 - RNA, 22 nt, Molluscum contagiosum virus
cgcucguggaucgcgcgcaccu

SEQ ID NO: 4043597 - RNA, 16 nt, Molluscum contagiosum virus
cgcucucgcuggcucc

SEQ ID NO: 4043598 - RNA, 21 nt, Molluscum contagiosum virus
cgcucuucguggugcucacgc

SEQ ID NO: 4043599 - RNA, 12 nt, Molluscum contagiosum virus
cgcugacggcgc

SEQ ID NO: 4043600 - RNA, 20 nt, Molluscum contagiosum virus
cgcugacggcgcugcgcgug

SEQ ID NO: 4043601 - RNA, 19 nt, Molluscum contagiosum virus
cgcugaguuacguggccgc

SEQ ID NO: 4043602 - RNA, 20 nt, Molluscum contagiosum virus
cgcugcacaguucacggcgc

SEQ ID NO: 4043603 - RNA, 23 nt, Molluscum contagiosum virus
cgcugcacaguucacggcgcucg

SEQ ID NO: 4043604 - RNA, 17 nt, Molluscum contagiosum virus
cgcugcacgagcugcug

SEQ ID NO: 4043605 - RNA, 22 nt, Molluscum contagiosum virus
cgcugcagaacuguagcguccg

SEQ ID NO: 4043606 - RNA, 15 nt, Molluscum contagiosum virus
cgcugcagcaccugc

SEQ ID NO: 4043607 - RNA, 22 nt, Molluscum contagiosum virus
cgcugcagcuaggauccugcuc

SEQ ID NO: 4043608 - RNA, 15 nt, Molluscum contagiosum virus
cgcugcccgcgcacg

SEQ ID NO: 4043609 - RNA, 17 nt, Molluscum contagiosum virus
cgcugcccgcgcacgag

SEQ ID NO: 4043610 - RNA, 17 nt, Molluscum contagiosum virus
cgcugccgcgcgcgccg

SEQ ID NO: 4043611 - RNA, 14 nt, Molluscum contagiosum virus
cgcugccgcuggcg

SEQ ID NO: 4043612 - RNA, 19 nt, Molluscum contagiosum virus
cgcugcgaacauggacgcg

SEQ ID NO: 4043613 - RNA, 20 nt, Molluscum contagiosum virus
cgcugcgcacgugcgcgccg

SEQ ID NO: 4043614 - RNA, 15 nt, Molluscum contagiosum virus
cgcugcgccgcuucc

SEQ ID NO: 4043615 - RNA, 17 nt, Molluscum contagiosum virus
cgcugcgccgcuuccug

SEQ ID NO: 4043616 - RNA, 19 nt, Molluscum contagiosum virus
cgcugcgccggcugcgcca

SEQ ID NO: 4043617 - RNA, 16 nt, Molluscum contagiosum virus
cgcugcgcggcgcgcg

SEQ ID NO: 4043618 - RNA, 18 nt, Molluscum contagiosum virus
cgcugcuccccgccagca

SEQ ID NO: 4043619 - RNA, 21 nt, Molluscum contagiosum virus
cgcugcuccccgccagcacca

SEQ ID NO: 4043620 - RNA, 21 nt, Molluscum contagiosum virus
cgcugcucgcuugcccggagc

SEQ ID NO: 4043621 - RNA, 21 nt, Molluscum contagiosum virus
cgcugcucuacuuccacgagc

SEQ ID NO: 4043622 - RNA, 12 nt, Molluscum contagiosum virus
cgcugcuggcag

SEQ ID NO: 4043623 - RNA, 14 nt, Molluscum contagiosum virus
cgcugcuucccgcu

SEQ ID NO: 4043624 - RNA, 19 nt, Molluscum contagiosum virus
cgcuggagaugauuccguc

SEQ ID NO: 4043625 - RNA, 15 nt, Molluscum contagiosum virus
cgcuggcacggccgg

SEQ ID NO: 4043626 - RNA, 20 nt, Molluscum contagiosum virus
cgcuggcacggccggcgccg

SEQ ID NO: 4043627 - RNA, 14 nt, Molluscum contagiosum virus
cgcuggcuccgcug

SEQ ID NO: 4043628 - RNA, 16 nt, Molluscum contagiosum virus
cgcugggcgcgccgcg

SEQ ID NO: 4043629 - RNA, 22 nt, Molluscum contagiosum virus
cgcuggggcgugacucggccgc

SEQ ID NO: 4043630 - RNA, 13 nt, Molluscum contagiosum virus
cgcugucacgcga

SEQ ID NO: 4043631 - RNA, 22 nt, Molluscum contagiosum virus
cgcuguuuggaauugugcugcu

SEQ ID NO: 4043632 - RNA, 22 nt, Molluscum contagiosum virus
cgcuucggcucgggaacaaagg

SEQ ID NO: 4043633 - RNA, 16 nt, Molluscum contagiosum virus
cgcuucuagcucgcgc

SEQ ID NO: 4043634 - RNA, 12 nt, Molluscum contagiosum virus
cgcuugccccuc

SEQ ID NO: 4043635 - RNA, 17 nt, Molluscum contagiosum virus
cgcuugcccggagccgg

SEQ ID NO: 4043636 - RNA, 22 nt, Molluscum contagiosum virus
cgcuugcuuccaggcgccgcac

SEQ ID NO: 4043637 - RNA, 15 nt, Molluscum contagiosum virus
cgcuuggcgagcgcu

SEQ ID NO: 4043638 - RNA, 19 nt, Molluscum contagiosum virus
cgcuuggcgagcgcugccg

SEQ ID NO: 4043639 - RNA, 17 nt, Molluscum contagiosum virus
cggaaauguuguuugaa

SEQ ID NO: 4043640 - RNA, 13 nt, Molluscum contagiosum virus
cggaacuggacgc

SEQ ID NO: 4043641 - RNA, 13 nt, Molluscum contagiosum virus
cggaagcgcccgu

SEQ ID NO: 4043642 - RNA, 12 nt, Molluscum contagiosum virus
cggaagcuccug

SEQ ID NO: 4043643 - RNA, 17 nt, Molluscum contagiosum virus
cggacaaaauggcugcg

SEQ ID NO: 4043644 - RNA, 12 nt, Molluscum contagiosum virus
cggacagugccu

SEQ ID NO: 4043645 - RNA, 22 nt, Molluscum contagiosum virus
cggacagugccuccgcggacgc

SEQ ID NO: 4043646 - RNA, 18 nt, Molluscum contagiosum virus
cggaccuaaagcugcugg

SEQ ID NO: 4043647 - RNA, 17 nt, Molluscum contagiosum virus
cggacgccggcgcccgc

SEQ ID NO: 4043648 - RNA, 22 nt, Molluscum contagiosum virus
cggacgccggcgcccgcgugca

SEQ ID NO: 4043649 - RNA, 12 nt, Molluscum contagiosum virus
cggacgcgcagc

SEQ ID NO: 4043650 - RNA, 13 nt, Molluscum contagiosum virus
cggacgcgcagcu

SEQ ID NO: 4043651 - RNA, 23 nt, Molluscum contagiosum virus
cggacgcgcgagugugcgugucu

SEQ ID NO: 4043652 - RNA, 14 nt, Molluscum contagiosum virus
cggacgcgggccgc

SEQ ID NO: 4043653 - RNA, 14 nt, Molluscum contagiosum virus
cggacgcgggccug

SEQ ID NO: 4043654 - RNA, 19 nt, Molluscum contagiosum virus
cggacgcggugaccggagc

SEQ ID NO: 4043655 - RNA, 14 nt, Molluscum contagiosum virus
cggacggcgcgcag

SEQ ID NO: 4043656 - RNA, 17 nt, Molluscum contagiosum virus
cggacggcgcgcagcgc

SEQ ID NO: 4043657 - RNA, 13 nt, Molluscum contagiosum virus
cggacucgcgagc

SEQ ID NO: 4043658 - RNA, 18 nt, Molluscum contagiosum virus
cggagaacaugcucgcca

SEQ ID NO: 4043659 - RNA, 23 nt, Molluscum contagiosum virus
cggagaagugcuccgcacgugga

SEQ ID NO: 4043660 - RNA, 22 nt, Molluscum contagiosum virus
cggagaucaggcagcugcugcg

SEQ ID NO: 4043661 - RNA, 16 nt, Molluscum contagiosum virus
cggagaucgacacgag

SEQ ID NO: 4043662 - RNA, 19 nt, Molluscum contagiosum virus
cggagcaggacgacgacac

SEQ ID NO: 4043663 - RNA, 22 nt, Molluscum contagiosum virus
cggagcgccuucugcaagcugc

SEQ ID NO: 4043664 - RNA, 16 nt, Molluscum contagiosum virus
cggagcuggcguugcc

SEQ ID NO: 4043665 - RNA, 13 nt, Molluscum contagiosum virus
cggagcugugcca

SEQ ID NO: 4043666 - RNA, 17 nt, Molluscum contagiosum virus
cggagcugugccgcagc

SEQ ID NO: 4043667 - RNA, 11 nt, Molluscum contagiosum virus
cggaggcagcg

SEQ ID NO: 4043668 - RNA, 15 nt, Molluscum contagiosum virus
cggaggcugcucccu

SEQ ID NO: 4043669 - RNA, 18 nt, Molluscum contagiosum virus
cggaggucgagcgcgccg

SEQ ID NO: 4043670 - RNA, 17 nt, Molluscum contagiosum virus
cggaggucugcuuuguc

SEQ ID NO: 4043671 - RNA, 20 nt, Molluscum contagiosum virus
cggagguuggaagcacgcaa

SEQ ID NO: 4043672 - RNA, 18 nt, Molluscum contagiosum virus
cggauagccccucgagca

SEQ ID NO: 4043673 - RNA, 15 nt, Molluscum contagiosum virus
cggauaugcgccugu

SEQ ID NO: 4043674 - RNA, 17 nt, Molluscum contagiosum virus
cggcaaccgcgcccgcg

SEQ ID NO: 4043675 - RNA, 17 nt, Molluscum contagiosum virus
cggcaacugccugcgcu

SEQ ID NO: 4043676 - RNA, 18 nt, Molluscum contagiosum virus
cggcaagcuucgggccgc

SEQ ID NO: 4043677 - RNA, 19 nt, Molluscum contagiosum virus
cggcacacacuugcacgcg

SEQ ID NO: 4043678 - RNA, 16 nt, Molluscum contagiosum virus
cggcacaugcagcugc

SEQ ID NO: 4043679 - RNA, 13 nt, Molluscum contagiosum virus
cggcacccgccag

SEQ ID NO: 4043680 - RNA, 13 nt, Molluscum contagiosum virus
cggcacccgccgc

SEQ ID NO: 4043681 - RNA, 18 nt, Molluscum contagiosum virus
cggcacccgccgcggugc

SEQ ID NO: 4043682 - RNA, 21 nt, Molluscum contagiosum virus
cggcaccguaccgcgcccgcc

SEQ ID NO: 4043683 - RNA, 14 nt, Molluscum contagiosum virus
cggcacgagcaguc

SEQ ID NO: 4043684 - RNA, 12 nt, Molluscum contagiosum virus
cggcacgcgagc

SEQ ID NO: 4043685 - RNA, 16 nt, Molluscum contagiosum virus
cggcacgcugcagaac

SEQ ID NO: 4043686 - RNA, 17 nt, Molluscum contagiosum virus
cggcacgcugcguuucc

SEQ ID NO: 4043687 - RNA, 17 nt, Molluscum contagiosum virus
cggcagcaugcucacgu

SEQ ID NO: 4043688 - RNA, 23 nt, Molluscum contagiosum virus
cggcagcgcauccgagucgagca

SEQ ID NO: 4043689 - RNA, 18 nt, Molluscum contagiosum virus
cggcagcuaccgcgcgcg

SEQ ID NO: 4043690 - RNA, 20 nt, Molluscum contagiosum virus
cggcagcucugcagcgccgc

SEQ ID NO: 4043691 - RNA, 21 nt, Molluscum contagiosum virus
cggcagcucugcagcgccgcg

SEQ ID NO: 4043692 - RNA, 19 nt, Molluscum contagiosum virus
cggcagcuggagcugccgc

SEQ ID NO: 4043693 - RNA, 20 nt, Molluscum contagiosum virus
cggcaggcgcugcgcggcgc

SEQ ID NO: 4043694 - RNA, 13 nt, Molluscum contagiosum virus
cggcaggcucccg

SEQ ID NO: 4043695 - RNA, 15 nt, Molluscum contagiosum virus
cggcaggcucccgcu

SEQ ID NO: 4043696 - RNA, 16 nt, Molluscum contagiosum virus
cgccaugcuggcgggc

SEQ ID NO: 4043697 - RNA, 20 nt, Molluscum contagiosum virus
cgccauugcucgcggugccg

SEQ ID NO: 4043698 - RNA, 19 nt, Molluscum contagiosum virus
cgcccaacgcccgcgcccg

SEQ ID NO: 4043699 - RNA, 20 nt, Molluscum contagiosum virus
cgcccaccagcagccaggcu

SEQ ID NO: 4043700 - RNA, 12 nt, Molluscum contagiosum virus
cgcccagcaccu

SEQ ID NO: 4043701 - RNA, 14 nt, Molluscum contagiosum virus
cgcccagcgccacg

SEQ ID NO: 4043702 - RNA, 19 nt, Molluscum contagiosum virus
cgcccagcucgaugggcuc

SEQ ID NO: 4043703 - RNA, 17 nt, Molluscum contagiosum virus
cgcccgagcgcgugucu

SEQ ID NO: 4043704 - RNA, 13 nt, Molluscum contagiosum virus
cgcccgcgccgca

SEQ ID NO: 4043705 - RNA, 12 nt, Molluscum contagiosum virus
cgcccgcggcac

SEQ ID NO: 4043706 - RNA, 21 nt, Molluscum contagiosum virus
cgcccgcggcuuucucgcacu

SEQ ID NO: 4043707 - RNA, 14 nt, Molluscum contagiosum virus
cgcccgcugcucua

SEQ ID NO: 4043708 - RNA, 22 nt, Molluscum contagiosum virus
cgcccggcaccgcggcgggugc

SEQ ID NO: 4043709 - RNA, 17 nt, Molluscum contagiosum virus
cgcccggcaggcucccg

SEQ ID NO: 4043710 - RNA, 22 nt, Molluscum contagiosum virus
cgcccguaaagaagcggugcag

SEQ ID NO: 4043711 - RNA, 13 nt, Molluscum contagiosum virus
cgcccgugccgcc

SEQ ID NO: 4043712 - RNA, 17 nt, Molluscum contagiosum virus
cgcccgugcuugcgcac

SEQ ID NO: 4043713 - RNA, 15 nt, Molluscum contagiosum virus
cgcccucgcgcgcag

SEQ ID NO: 4043714 - RNA, 14 nt, Molluscum contagiosum virus
cgcccucguguacg

SEQ ID NO: 4043715 - RNA, 18 nt, Molluscum contagiosum virus
cgcccuucaacgcgcgug

SEQ ID NO: 4043716 - RNA, 18 nt, Molluscum contagiosum virus
cgccgaucuccacgucga

SEQ ID NO: 4043717 - RNA, 12 nt, Molluscum contagiosum virus
cgccgcaaagcu

SEQ ID NO: 4043718 - RNA, 16 nt, Molluscum contagiosum virus
cgccgcaaauuccguc

SEQ ID NO: 4043719 - RNA, 21 nt, Molluscum contagiosum virus
cgccgccagcgucgcgcgccg

SEQ ID NO: 4043720 - RNA, 12 nt, Molluscum contagiosum virus
cgccgccaugcu

SEQ ID NO: 4043721 - RNA, 13 nt, Molluscum contagiosum virus
cgccgccgcgccg

SEQ ID NO: 4043722 - RNA, 15 nt, Molluscum contagiosum virus
cgccgccgcgccgcu

SEQ ID NO: 4043723 - RNA, 13 nt, Molluscum contagiosum virus
cgccgccggugcg

SEQ ID NO: 4043724 - RNA, 19 nt, Molluscum contagiosum virus
cgccgccucgcgcgcacug

SEQ ID NO: 4043725 - RNA, 20 nt, Molluscum contagiosum virus
cgccgcgcaaaagcacagca

SEQ ID NO: 4043726 - RNA, 23 nt, Molluscum contagiosum virus
cgccgcgcaugacagccauggcc

SEQ ID NO: 4043727 - RNA, 13 nt, Molluscum contagiosum virus
cgccgcgccgcac

SEQ ID NO: 4043728 - RNA, 18 nt, Molluscum contagiosum virus
cgccgcgcgagugccagc

SEQ ID NO: 4043729 - RNA, 16 nt, Molluscum contagiosum virus
cgccgcgcgcgccagc

SEQ ID NO: 4043730 - RNA, 16 nt, Molluscum contagiosum virus
cgccgcggccugggcc

SEQ ID NO: 4043731 - RNA, 16 nt, Molluscum contagiosum virus
cgccgcggcgguugcc

SEQ ID NO: 4043732 - RNA, 13 nt, Molluscum contagiosum virus
cgccgcgggcaca

SEQ ID NO: 4043733 - RNA, 14 nt, Molluscum contagiosum virus
cgccgcgggcacau

SEQ ID NO: 4043734 - RNA, 13 nt, Molluscum contagiosum virus
cgccgcgggccgc

SEQ ID NO: 4043735 - RNA, 22 nt, Molluscum contagiosum virus
cgccgcgggccgccgggccugc

SEQ ID NO: 4043736 - RNA, 17 nt, Molluscum contagiosum virus
cgccgcguacgcgccgg

SEQ ID NO: 4043737 - RNA, 13 nt, Molluscum contagiosum virus
cgccgcgugcaug

SEQ ID NO: 4043738 - RNA, 14 nt, Molluscum contagiosum virus
cgccgcugcgccgg

SEQ ID NO: 4043739 - RNA, 22 nt, Molluscum contagiosum virus
cgccgcugcgccggcugcgcca

SEQ ID NO: 4043740 - RNA, 12 nt, Molluscum contagiosum virus
cgccgcugcucg

SEQ ID NO: 4043741 - RNA, 23 nt, Molluscum contagiosum virus
cgccgcuggagcacgacuacggc

SEQ ID NO: 4043742 - RNA, 16 nt, Molluscum contagiosum virus
cgccgcugucacgcga

SEQ ID NO: 4043743 - RNA, 15 nt, Molluscum contagiosum virus
cgccggacagcucag

SEQ ID NO: 4043744 - RNA, 21 nt, Molluscum contagiosum virus
cgccggaccagauccgggcgc

SEQ ID NO: 4043745 - RNA, 23 nt, Molluscum contagiosum virus
cgccggccagcgagucucgcgcg

SEQ ID NO: 4043746 - RNA, 13 nt, Molluscum contagiosum virus
cgccggcgcggcg

SEQ ID NO: 4043747 - RNA, 13 nt, Molluscum contagiosum virus
cgccggcucugcc

SEQ ID NO: 4043748 - RNA, 15 nt, Molluscum contagiosum virus
cgccggcucugccuc

SEQ ID NO: 4043749 - RNA, 15 nt, Molluscum contagiosum virus
cgccggcugcgccac

SEQ ID NO: 4043750 - RNA, 20 nt, Molluscum contagiosum virus
cgccgggccugcggcggcgc

SEQ ID NO: 4043751 - RNA, 15 nt, Molluscum contagiosum virus
cgccgggcgccagaa

SEQ ID NO: 4043752 - RNA, 23 nt, Molluscum contagiosum virus
cgccgguggcgcgcgagcugcug

SEQ ID NO: 4043753 - RNA, 17 nt, Molluscum contagiosum virus
cgccgucaauacucugu

SEQ ID NO: 4043754 - RNA, 15 nt, Molluscum contagiosum virus
cgccguucguugucc

SEQ ID NO: 4043755 - RNA, 14 nt, Molluscum contagiosum virus
cgccguugcgcgug

SEQ ID NO: 4043756 - RNA, 15 nt, Molluscum contagiosum virus
cgccuagccugcagu

SEQ ID NO: 4043757 - RNA, 14 nt, Molluscum contagiosum virus
cgccuccaagaaga

SEQ ID NO: 4043758 - RNA, 21 nt, Molluscum contagiosum virus
cgccuccaagaagaggccagc

SEQ ID NO: 4043759 - RNA, 21 nt, Molluscum contagiosum virus
cgccuccaagaagaggccggc

SEQ ID NO: 4043760 - RNA, 13 nt, Molluscum contagiosum virus
cgccucgcauucu

SEQ ID NO: 4043761 - RNA, 20 nt, Molluscum contagiosum virus
cgccucggacggaggucugc

SEQ ID NO: 4043762 - RNA, 20 nt, Molluscum contagiosum virus
cgccucggacuucgacgcgc

SEQ ID NO: 4043763 - RNA, 24 nt, Molluscum contagiosum virus
cgccucgggaaaacgcgcggcagc

SEQ ID NO: 4043764 - RNA, 21 nt, Molluscum contagiosum virus
cgccugaaccugggcgcgcac

SEQ ID NO: 4043765 - RNA, 18 nt, Molluscum contagiosum virus
cgccugacucccgucagc

SEQ ID NO: 4043766 - RNA, 22 nt, Molluscum contagiosum virus
cgccugccgcgagcacuggcug

SEQ ID NO: 4043767 - RNA, 16 nt, Molluscum contagiosum virus
cgccuuccugcuggcg

SEQ ID NO: 4043768 - RNA, 17 nt, Molluscum contagiosum virus
cgccuucgucgcgcgcu

SEQ ID NO: 4043769 - RNA, 23 nt, Molluscum contagiosum virus
cgccuucuugcuggcgcucgcgc

SEQ ID NO: 4043770 - RNA, 22 nt, Molluscum contagiosum virus
cgcgaacgaggagggcagccuc

SEQ ID NO: 4043771 - RNA, 14 nt, Molluscum contagiosum virus
cgcgaacgcgucca

SEQ ID NO: 4043772 - RNA, 24 nt, Molluscum contagiosum virus
cgcgaaggcaaccgcgacgagcag

SEQ ID NO: 4043773 - RNA, 15 nt, Molluscum contagiosum virus
cgcgaaguccugggc

SEQ ID NO: 4043774 - RNA, 15 nt, Molluscum contagiosum virus
cgcgaccggcgugcc

SEQ ID NO: 4043775 - RNA, 20 nt, Molluscum contagiosum virus
cgcgaccuacuccuggccaa

SEQ ID NO: 4043776 - RNA, 21 nt, Molluscum contagiosum virus
cgcgacgacggcacgcugagc

SEQ ID NO: 4043777 - RNA, 20 nt, Molluscum contagiosum virus
cgcgacgacguugugcuccu

SEQ ID NO: 4043778 - RNA, 16 nt, Molluscum contagiosum virus
cgcgacgagcucacgc

SEQ ID NO: 4043779 - RNA, 16 nt, Molluscum contagiosum virus
cgcgacgauggccacg

SEQ ID NO: 4043780 - RNA, 17 nt, Molluscum contagiosum virus
cgcgacgcgcguggagc

SEQ ID NO: 4043781 - RNA, 16 nt, Molluscum contagiosum virus
cgcgacgugcgcgcug

SEQ ID NO: 4043782 - RNA, 17 nt, Molluscum contagiosum virus
cgcgacuaccugcugcu

SEQ ID NO: 4043783 - RNA, 20 nt, Molluscum contagiosum virus
cgcgacuggcacgcgccgcg

SEQ ID NO: 4043784 - RNA, 22 nt, Molluscum contagiosum virus
cgcgagaagucgggcuggcgug

SEQ ID NO: 4043785 - RNA, 17 nt, Molluscum contagiosum virus
cgcgagaugcgcggaca

SEQ ID NO: 4043786 - RNA, 13 nt, Molluscum contagiosum virus
cgcgagcagcugc

SEQ ID NO: 4043787 - RNA, 20 nt, Molluscum contagiosum virus
cgcgagcaguucgcgcgccu

SEQ ID NO: 4043788 - RNA, 17 nt, Molluscum contagiosum virus
cgcgagcaugccgccgc

SEQ ID NO: 4043789 - RNA, 13 nt, Molluscum contagiosum virus
cgcgagccacgcg

SEQ ID NO: 4043790 - RNA, 22 nt, Molluscum contagiosum virus
cgcgagcccaccgauggacuuc

SEQ ID NO: 4043791 - RNA, 19 nt, Molluscum contagiosum virus
cgcgagcgcaugcgcgccg

SEQ ID NO: 4043792 - RNA, 20 nt, Molluscum contagiosum virus
cgcgagcgcaugcgcgccgc

SEQ ID NO: 4043793 - RNA, 22 nt, Molluscum contagiosum virus
cgcgagcgcgcgcugcgcgccg

SEQ ID NO: 4043794 - RNA, 17 nt, Molluscum contagiosum virus
cgcgagcguuucugccg

SEQ ID NO: 4043795 - RNA, 15 nt, Molluscum contagiosum virus
cgcgagcugcugcgc

SEQ ID NO: 4043796 - RNA, 19 nt, Molluscum contagiosum virus
cgcgagcuggagcgcgucg

SEQ ID NO: 4043797 - RNA, 19 nt, Molluscum contagiosum virus
cgcgaggagacguagagca

SEQ ID NO: 4043798 - RNA, 17 nt, Molluscum contagiosum virus
cgcgagugugcgugucu

SEQ ID NO: 4043799 - RNA, 21 nt, Molluscum contagiosum virus
cgcgcaaaagcacagcaggag

SEQ ID NO: 4043800 - RNA, 23 nt, Molluscum contagiosum virus
cgagugcucccgaggcgcgcucu

SEQ ID NO: 4043801 - RNA, 13 nt, Molluscum contagiosum virus
cgagugugugcau

SEQ ID NO: 4043802 - RNA, 15 nt, Molluscum contagiosum virus
cgaguucgagggcaa

SEQ ID NO: 4043803 - RNA, 18 nt, Molluscum contagiosum virus
cgauacccuuggcagcaa

SEQ ID NO: 4043804 - RNA, 15 nt, Molluscum contagiosum virus
cgaucgcagcagugc

SEQ ID NO: 4043805 - RNA, 17 nt, Molluscum contagiosum virus
cgaucgcgggcacgagc

SEQ ID NO: 4043806 - RNA, 21 nt, Molluscum contagiosum virus
cgaucuucuucuugcgcaccu

SEQ ID NO: 4043807 - RNA, 22 nt, Molluscum contagiosum virus
cgaugacaucuggaggcaaucu

SEQ ID NO: 4043808 - RNA, 17 nt, Molluscum contagiosum virus
cgaugcccagcagcgag

SEQ ID NO: 4043809 - RNA, 16 nt, Molluscum contagiosum virus
cgauggacgccagcuu

SEQ ID NO: 4043810 - RNA, 22 nt, Molluscum contagiosum virus
cgauggccacgcagaucaggag

SEQ ID NO: 4043811 - RNA, 14 nt, Molluscum contagiosum virus
cgauggcgcagcuc

SEQ ID NO: 4043812 - RNA, 14 nt, Molluscum contagiosum virus
cgauggggcgcucg

SEQ ID NO: 4043813 - RNA, 19 nt, Molluscum contagiosum virus
cgauguacgcgugcaggaa

SEQ ID NO: 4043814 - RNA, 15 nt, Molluscum contagiosum virus
cgauguacuccacca

SEQ ID NO: 4043815 - RNA, 20 nt, Molluscum contagiosum virus
cgcaaaagaggccugcugaa

SEQ ID NO: 4043816 - RNA, 16 nt, Molluscum contagiosum virus
cgcaacacggcggugc

SEQ ID NO: 4043817 - RNA, 19 nt, Molluscum contagiosum virus
cgcaacacggcggugcccg

SEQ ID NO: 4043818 - RNA, 14 nt, Molluscum contagiosum virus
cgcaaccccgcgcg

SEQ ID NO: 4043819 - RNA, 20 nt, Molluscum contagiosum virus
cgcaaccccgcgcugcgcgg

SEQ ID NO: 4043820 - RNA, 14 nt, Molluscum contagiosum virus
cgcaaccgcgugcg

SEQ ID NO: 4043821 - RNA, 12 nt, Molluscum contagiosum virus
cgcaagccacac

SEQ ID NO: 4043822 - RNA, 15 nt, Molluscum contagiosum virus
cgcaagccgcguacc

SEQ ID NO: 4043823 - RNA, 23 nt, Molluscum contagiosum virus
cgcaagcuuugugcucgcuuagc

SEQ ID NO: 4043824 - RNA, 17 nt, Molluscum contagiosum virus
cgcaaggucuuccacgc

SEQ ID NO: 4043825 - RNA, 19 nt, Molluscum contagiosum virus
cgcaaguccagcgcgcucg

SEQ ID NO: 4043826 - RNA, 21 nt, Molluscum contagiosum virus
cgcaaguccagcgcgcucgag

SEQ ID NO: 4043827 - RNA, 19 nt, Molluscum contagiosum virus
cgcaagugcacaccagaca

SEQ ID NO: 4043828 - RNA, 24 nt, Molluscum contagiosum virus
cgcaagugugcgcaucccucgucu

SEQ ID NO: 4043829 - RNA, 20 nt, Molluscum contagiosum virus
cgcacaaagaacgcgcgucg

SEQ ID NO: 4043830 - RNA, 21 nt, Molluscum contagiosum virus
cgcacaaccacagcucuccga

SEQ ID NO: 4043831 - RNA, 18 nt, Molluscum contagiosum virus
cgcacacgaucucgggug

SEQ ID NO: 4043832 - RNA, 14 nt, Molluscum contagiosum virus
cgcacacgccgcgu

SEQ ID NO: 4043833 - RNA, 21 nt, Molluscum contagiosum virus
cgcacacgcgcgcgugcugcu

SEQ ID NO: 4043834 - RNA, 18 nt, Molluscum contagiosum virus
cgcacacggacgagcccu

SEQ ID NO: 4043835 - RNA, 14 nt, Molluscum contagiosum virus
cgcacacuugcgcg

SEQ ID NO: 4043836 - RNA, 23 nt, Molluscum contagiosum virus
cgcacacuugcgcguccgcaaag

SEQ ID NO: 4043837 - RNA, 20 nt, Molluscum contagiosum virus
cgcacagucuccacgcgugc

SEQ ID NO: 4043838 - RNA, 20 nt, Molluscum contagiosum virus
cgcacaguucacggcgcuug

SEQ ID NO: 4043839 - RNA, 12 nt, Molluscum contagiosum virus
cgcacccgccac

SEQ ID NO: 4043840 - RNA, 13 nt, Molluscum contagiosum virus
cgcacccucacac

SEQ ID NO: 4043841 - RNA, 14 nt, Molluscum contagiosum virus
cgcaccugcuagag

SEQ ID NO: 4043842 - RNA, 19 nt, Molluscum contagiosum virus
cgcacgaccacgugcagga

SEQ ID NO: 4043843 - RNA, 15 nt, Molluscum contagiosum virus
cgcacgauguacucc

SEQ ID NO: 4043844 - RNA, 19 nt, Molluscum contagiosum virus
cgcacgauguacuccacca

SEQ ID NO: 4043845 - RNA, 14 nt, Molluscum contagiosum virus
cgcacgcgcgagca

SEQ ID NO: 4043846 - RNA, 18 nt, Molluscum contagiosum virus
cgcacgcgcgcuuagcac

SEQ ID NO: 4043847 - RNA, 14 nt, Molluscum contagiosum virus
cgcacgcgcucucc

SEQ ID NO: 4043848 - RNA, 21 nt, Molluscum contagiosum virus
cgcacgcugcgcacgggcgcg

SEQ ID NO: 4043849 - RNA, 16 nt, Molluscum contagiosum virus
cgcacgcuuguccgcg

SEQ ID NO: 4043850 - RNA, 13 nt, Molluscum contagiosum virus
cgcacggagcaca

SEQ ID NO: 4043851 - RNA, 22 nt, Molluscum contagiosum virus
cgcacggccugcggcaggaagc

SEQ ID NO: 4043852 - RNA, 19 nt, Molluscum contagiosum virus
cgcacgguagcuagcucug

SEQ ID NO: 4043853 - RNA, 16 nt, Molluscum contagiosum virus
cgcacgugccgugcug

SEQ ID NO: 4043854 - RNA, 18 nt, Molluscum contagiosum virus
cgcacucgggugcccgga

SEQ ID NO: 4043855 - RNA, 22 nt, Molluscum contagiosum virus
cgcacugccacgcggagcucgc

SEQ ID NO: 4043856 - RNA, 17 nt, Molluscum contagiosum virus
cgcacuugcgcgccugu

SEQ ID NO: 4043857 - RNA, 17 nt, Molluscum contagiosum virus
cgcagaacugcugcgcg

SEQ ID NO: 4043858 - RNA, 17 nt, Molluscum contagiosum virus
cgcagaaguggcgcugu

SEQ ID NO: 4043859 - RNA, 15 nt, Molluscum contagiosum virus
cgcagcaagcagccg

SEQ ID NO: 4043860 - RNA, 18 nt, Molluscum contagiosum virus
cgcagcauucccggcgcg

SEQ ID NO: 4043861 - RNA, 19 nt, Molluscum contagiosum virus
cgcagccucgagcgccgug

SEQ ID NO: 4043862 - RNA, 13 nt, Molluscum contagiosum virus
cgcagcgcgcgcg

SEQ ID NO: 4043863 - RNA, 13 nt, Molluscum contagiosum virus
cgcagcgcggccu

SEQ ID NO: 4043864 - RNA, 20 nt, Molluscum contagiosum virus
cgcagcguuccaggaacgcc

SEQ ID NO: 4043865 - RNA, 14 nt, Molluscum contagiosum virus
cgcagcuguuucug

SEQ ID NO: 4043866 - RNA, 20 nt, Molluscum contagiosum virus
cgcaggacaugauccgcgac

SEQ ID NO: 4043867 - RNA, 12 nt, Molluscum contagiosum virus
cgcaggacgcgg

SEQ ID NO: 4043868 - RNA, 20 nt, Molluscum contagiosum virus
cgcaggacuggcaccugcgg

SEQ ID NO: 4043869 - RNA, 21 nt, Molluscum contagiosum virus
cgcaggaugcuggggcucgcg

SEQ ID NO: 4043870 - RNA, 18 nt, Molluscum contagiosum virus
cgcaggccaggugcagcg

SEQ ID NO: 4043871 - RNA, 15 nt, Molluscum contagiosum virus
cgcaggccgcgcccg

SEQ ID NO: 4043872 - RNA, 15 nt, Molluscum contagiosum virus
cgcaggccgggcacc

SEQ ID NO: 4043873 - RNA, 13 nt, Molluscum contagiosum virus
cgcaggcucgucg

SEQ ID NO: 4043874 - RNA, 18 nt, Molluscum contagiosum virus
cgcagggacgcgcuuuuc

SEQ ID NO: 4043875 - RNA, 17 nt, Molluscum contagiosum virus
cgcagggagcugcggac

SEQ ID NO: 4043876 - RNA, 19 nt, Molluscum contagiosum virus
cgcaggucaucgacgagca

SEQ ID NO: 4043877 - RNA, 21 nt, Molluscum contagiosum virus
cgcagucccagcaccgcgccg

SEQ ID NO: 4043878 - RNA, 21 nt, Molluscum contagiosum virus
cgcagucgccuuccugcgccc

SEQ ID NO: 4043879 - RNA, 16 nt, Molluscum contagiosum virus
cgcagugcggccagca

SEQ ID NO: 4043880 - RNA, 19 nt, Molluscum contagiosum virus
cgcagugcggccagcaccg

SEQ ID NO: 4043881 - RNA, 23 nt, Molluscum contagiosum virus
cgcaguuggucaccgccuguacc

SEQ ID NO: 4043882 - RNA, 17 nt, Molluscum contagiosum virus
cgcaucccugcgcaccu

SEQ ID NO: 4043883 - RNA, 21 nt, Molluscum contagiosum virus
cgcauccucaaccgcugcaau

SEQ ID NO: 4043884 - RNA, 19 nt, Molluscum contagiosum virus
cgcaugcggcaggcgcugc

SEQ ID NO: 4043885 - RNA, 16 nt, Molluscum contagiosum virus
cgcauggccacgcccg

SEQ ID NO: 4043886 - RNA, 20 nt, Molluscum contagiosum virus
cgccaaagaggacguguacg

SEQ ID NO: 4043887 - RNA, 23 nt, Molluscum contagiosum virus
cgccaacuucgucucgagcuucc

SEQ ID NO: 4043888 - RNA, 22 nt, Molluscum contagiosum virus
cgccaccucggcguuggccacg

SEQ ID NO: 4043889 - RNA, 14 nt, Molluscum contagiosum virus
cgccacgagcgccg

SEQ ID NO: 4043890 - RNA, 20 nt, Molluscum contagiosum virus
cgccacgagcgccgcgugcg

SEQ ID NO: 4043891 - RNA, 17 nt, Molluscum contagiosum virus
cgccacuagcaaggcgc

SEQ ID NO: 4043892 - RNA, 13 nt, Molluscum contagiosum virus
cgccacugccacg

SEQ ID NO: 4043893 - RNA, 15 nt, Molluscum contagiosum virus
cgccagaagugaaau

SEQ ID NO: 4043894 - RNA, 11 nt, Molluscum contagiosum virus
cgccagcacca

SEQ ID NO: 4043895 - RNA, 13 nt, Molluscum contagiosum virus
cgccagcacgcgc

SEQ ID NO: 4043896 - RNA, 15 nt, Molluscum contagiosum virus
cgccagcagcgcccg

SEQ ID NO: 4043897 - RNA, 15 nt, Molluscum contagiosum virus
cgccagccugcuggc

SEQ ID NO: 4043898 - RNA, 17 nt, Molluscum contagiosum virus
cgccaggugcgaaggcu

SEQ ID NO: 4043899 - RNA, 16 nt, Molluscum contagiosum virus
cgccaguccgcggcgc

SEQ ID NO: 4043900 - RNA, 22 nt, Molluscum contagiosum virus
cgccaguggccagcgcgcggcg

SEQ ID NO: 4043901 - RNA, 23 nt, Molluscum contagiosum virus
cgccaguuccacuccugugagca

SEQ ID NO: 4043902 - RNA, 14 nt, Molluscum contagiosum virus
cgccauccgcgagc

SEQ ID NO: 4043903 - RNA, 18 nt, Molluscum contagiosum virus
cgccaucgugguggagga

SEQ ID NO: 4043904 - RNA, 16 nt, Molluscum contagiosum virus
ccagcgccgccucgcg

SEQ ID NO: 4043905 - RNA, 18 nt, Molluscum contagiosum virus
ccagcgcgcccaccagca

SEQ ID NO: 4043906 - RNA, 20 nt, Molluscum contagiosum virus
ccagcgcgcccucgcgcgcg

SEQ ID NO: 4043907 - RNA, 18 nt, Molluscum contagiosum virus
ccagcggauaugcgccug

SEQ ID NO: 4043908 - RNA, 17 nt, Molluscum contagiosum virus
ccagcggcgccgcagcu

SEQ ID NO: 4043909 - RNA, 15 nt, Molluscum contagiosum virus
ccagcggcugcccgc

SEQ ID NO: 4043910 - RNA, 18 nt, Molluscum contagiosum virus
ccagcgggaaacugcugc

SEQ ID NO: 4043911 - RNA, 21 nt, Molluscum contagiosum virus
ccagcgggaaacugcugcccg

SEQ ID NO: 4043912 - RNA, 13 nt, Molluscum contagiosum virus
ccagcgugcagac

SEQ ID NO: 4043913 - RNA, 18 nt, Molluscum contagiosum virus
ccagcguuuccucuggcu

SEQ ID NO: 4043914 - RNA, 16 nt, Molluscum contagiosum virus
ccagcuacgagccgcu

SEQ ID NO: 4043915 - RNA, 24 nt, Molluscum contagiosum virus
ccagcucauagcccaugcgcagug

SEQ ID NO: 4043916 - RNA, 19 nt, Molluscum contagiosum virus
ccagcugccgcuugaagga

SEQ ID NO: 4043917 - RNA, 15 nt, Molluscum contagiosum virus
ccagcugcgcgagcu

SEQ ID NO: 4043918 - RNA, 17 nt, Molluscum contagiosum virus
ccagcuucaucaagcac

SEQ ID NO: 4043919 - RNA, 17 nt, Molluscum contagiosum virus
ccagcuugagcacacgg

SEQ ID NO: 4043920 - RNA, 22 nt, Molluscum contagiosum virus
ccagcuuggugcgcucgagcuc

SEQ ID NO: 4043921 - RNA, 23 nt, Molluscum contagiosum virus
ccaggaacgaggaaaggcacacc

SEQ ID NO: 4043922 - RNA, 21 nt, Molluscum contagiosum virus
ccaggaacgcgccgcggaugu

SEQ ID NO: 4043923 - RNA, 13 nt, Molluscum contagiosum virus
ccaggcacacgca

SEQ ID NO: 4043924 - RNA, 15 nt, Molluscum contagiosum virus
ccaggcacuggcccu

SEQ ID NO: 4043925 - RNA, 11 nt, Molluscum contagiosum virus
ccaggcgccgc

SEQ ID NO: 4043926 - RNA, 14 nt, Molluscum contagiosum virus
ccaggcuaggcgcg

SEQ ID NO: 4043927 - RNA, 15 nt, Molluscum contagiosum virus
ccagguccuccagcg

SEQ ID NO: 4043928 - RNA, 21 nt, Molluscum contagiosum virus
ccagguucucgcgguuguagc

SEQ ID NO: 4043929 - RNA, 17 nt, Molluscum contagiosum virus
ccaguaagcgacagguc

SEQ ID NO: 4043930 - RNA, 18 nt, Molluscum contagiosum virus
ccaguggccagcgcgcgg

SEQ ID NO: 4043931 - RNA, 21 nt, Molluscum contagiosum virus
ccaucaucgcgcugcucuucg

SEQ ID NO: 4043932 - RNA, 13 nt, Molluscum contagiosum virus
ccaucgagcuucc

SEQ ID NO: 4043933 - RNA, 21 nt, Molluscum contagiosum virus
ccaucggaacuagcccuagcc

SEQ ID NO: 4043934 - RNA, 19 nt, Molluscum contagiosum virus
ccaucuccaagcacgcgcg

SEQ ID NO: 4043935 - RNA, 14 nt, Molluscum contagiosum virus
ccaucugcgcgacg

SEQ ID NO: 4043936 - RNA, 16 nt, Molluscum contagiosum virus
ccaugaggacagcuug

SEQ ID NO: 4043937 - RNA, 19 nt, Molluscum contagiosum virus
ccaugaggacagcuugcug

SEQ ID NO: 4043938 - RNA, 23 nt, Molluscum contagiosum virus
ccaugaggacagcuugcugcugu

SEQ ID NO: 4043939 - RNA, 18 nt, Molluscum contagiosum virus
ccaugcucucgcugcugc

SEQ ID NO: 4043940 - RNA, 15 nt, Molluscum contagiosum virus
ccauggaggcgcuag

SEQ ID NO: 4043941 - RNA, 14 nt, Molluscum contagiosum virus
ccaugucgagcccu

SEQ ID NO: 4043942 - RNA, 22 nt, Molluscum contagiosum virus
ccaugucgcgcaucaccgagcg

SEQ ID NO: 4043943 - RNA, 17 nt, Molluscum contagiosum virus
ccaugucugugcgcgag

SEQ ID NO: 4043944 - RNA, 21 nt, Molluscum contagiosum virus
ccauguuuccugcggcgcugc

SEQ ID NO: 4043945 - RNA, 18 nt, Molluscum contagiosum virus
ccauuuuuacgcuacuca

SEQ ID NO: 4043946 - RNA, 22 nt, Molluscum contagiosum virus
ccauuuuuugccccgcgcgccc

SEQ ID NO: 4043947 - RNA, 19 nt, Molluscum contagiosum virus
cccaaggccgcgggcgcgg

SEQ ID NO: 4043948 - RNA, 22 nt, Molluscum contagiosum virus
cccaccagcagccaggcuaggc

SEQ ID NO: 4043949 - RNA, 13 nt, Molluscum contagiosum virus
cccacguacgagc

SEQ ID NO: 4043950 - RNA, 14 nt, Molluscum contagiosum virus
cccacgugccaaga

SEQ ID NO: 4043951 - RNA, 18 nt, Molluscum contagiosum virus
cccagcaccgcgccgcga

SEQ ID NO: 4043952 - RNA, 22 nt, Molluscum contagiosum virus
cccagcaccuggaacgcgaccu

SEQ ID NO: 4043953 - RNA, 12 nt, Molluscum contagiosum virus
cccagguggagc

SEQ ID NO: 4043954 - RNA, 21 nt, Molluscum contagiosum virus
cccaucggagaagugcuccgc

SEQ ID NO: 4043955 - RNA, 16 nt, Molluscum contagiosum virus
cccaugcucgagccug

SEQ ID NO: 4043956 - RNA, 16 nt, Molluscum contagiosum virus
cccauuccuguugcuc

SEQ ID NO: 4043957 - RNA, 16 nt, Molluscum contagiosum virus
ccccacgagagaggcu

SEQ ID NO: 4043958 - RNA, 14 nt, Molluscum contagiosum virus
ccccacugugccag

SEQ ID NO: 4043959 - RNA, 22 nt, Molluscum contagiosum virus
ccccaugcccgaccacgugcca

SEQ ID NO: 4043960 - RNA, 13 nt, Molluscum contagiosum virus
ccccccuucuguc

SEQ ID NO: 4043961 - RNA, 16 nt, Molluscum contagiosum virus
ccccgaaaggcacccg

SEQ ID NO: 4043962 - RNA, 21 nt, Molluscum contagiosum virus
ccccgaaaggcacccgcagga

SEQ ID NO: 4043963 - RNA, 13 nt, Molluscum contagiosum virus
ccccgagcagcgg

SEQ ID NO: 4043964 - RNA, 14 nt, Molluscum contagiosum virus
ccccgagcugcggc

SEQ ID NO: 4043965 - RNA, 13 nt, Molluscum contagiosum virus
ccccgccagcacc

SEQ ID NO: 4043966 - RNA, 14 nt, Molluscum contagiosum virus
ccccguccucgcuc

SEQ ID NO: 4043967 - RNA, 14 nt, Molluscum contagiosum virus
ccccguccuugcuc

SEQ ID NO: 4043968 - RNA, 13 nt, Molluscum contagiosum virus
ccccgugagcgcg

SEQ ID NO: 4043969 - RNA, 14 nt, Molluscum contagiosum virus
ccccugucgcgcac

SEQ ID NO: 4043970 - RNA, 18 nt, Molluscum contagiosum virus
cccgaacugcugggcgug

SEQ ID NO: 4043971 - RNA, 16 nt, Molluscum contagiosum virus
cccgagcccgagcccg

SEQ ID NO: 4043972 - RNA, 15 nt, Molluscum contagiosum virus
cccgagcccgggccc

SEQ ID NO: 4043973 - RNA, 20 nt, Molluscum contagiosum virus
cccgagcugcggcgcgugcu

SEQ ID NO: 4043974 - RNA, 21 nt, Molluscum contagiosum virus
cccgaggacgcgggcgugucc

SEQ ID NO: 4043975 - RNA, 23 nt, Molluscum contagiosum virus
cccgagggcgcgaccggcgugcc

SEQ ID NO: 4043976 - RNA, 13 nt, Molluscum contagiosum virus
cccgcaccagugc

SEQ ID NO: 4043977 - RNA, 20 nt, Molluscum contagiosum virus
cccgcaggaaaggcaccccg

SEQ ID NO: 4043978 - RNA, 22 nt, Molluscum contagiosum virus
cccgcaggaaagguaccccgca

SEQ ID NO: 4043979 - RNA, 23 nt, Molluscum contagiosum virus
cccgcaggaaagguacccgcagg

SEQ ID NO: 4043980 - RNA, 11 nt, Molluscum contagiosum virus
cccgcccgugc

SEQ ID NO: 4043981 - RNA, 19 nt, Molluscum contagiosum virus
cccgccgcguacaugcgug

SEQ ID NO: 4043982 - RNA, 13 nt, Molluscum contagiosum virus
cccgccgcgugcc

SEQ ID NO: 4043983 - RNA, 13 nt, Molluscum contagiosum virus
cccgccgggcacc

SEQ ID NO: 4043984 - RNA, 17 nt, Molluscum contagiosum virus
cccgcgaacgagagaca

SEQ ID NO: 4043985 - RNA, 23 nt, Molluscum contagiosum virus
cccgcgcacugccacgcggagcu

SEQ ID NO: 4043986 - RNA, 18 nt, Molluscum contagiosum virus
cccgcgcagcgccacgcc

SEQ ID NO: 4043987 - RNA, 12 nt, Molluscum contagiosum virus
cccgcgccagca

SEQ ID NO: 4043988 - RNA, 12 nt, Molluscum contagiosum virus
cccgcgcgcccg

SEQ ID NO: 4043989 - RNA, 15 nt, Molluscum contagiosum virus
cccgcgcgugcaguu

SEQ ID NO: 4043990 - RNA, 13 nt, Molluscum contagiosum virus
cccgcgcugcgcg

SEQ ID NO: 4043991 - RNA, 13 nt, Molluscum contagiosum virus
cccgcggcgugcc

SEQ ID NO: 4043992 - RNA, 23 nt, Molluscum contagiosum virus
cccgcggcguucccgcucaaccu

SEQ ID NO: 4043993 - RNA, 13 nt, Molluscum contagiosum virus
cccgcgggccgcc

SEQ ID NO: 4043994 - RNA, 23 nt, Molluscum contagiosum virus
cccgcguggcaagggcuccuucu

SEQ ID NO: 4043995 - RNA, 22 nt, Molluscum contagiosum virus
cccgcuaaagaucgugcgcuuc

SEQ ID NO: 4043996 - RNA, 16 nt, Molluscum contagiosum virus
cccgcugagcgcagca

SEQ ID NO: 4043997 - RNA, 18 nt, Molluscum contagiosum virus
cccgcugcgcauggccac

SEQ ID NO: 4043998 - RNA, 20 nt, Molluscum contagiosum virus
cccggacagagccccguuca

SEQ ID NO: 4043999 - RNA, 21 nt, Molluscum contagiosum virus
cccggaucagccccgcgccag

SEQ ID NO: 4044000 - RNA, 22 nt, Molluscum contagiosum virus
cccggcagcgacuacgcgcugc

SEQ ID NO: 4044001 - RNA, 21 nt, Molluscum contagiosum virus
cccggccucgccuccgggcgc

SEQ ID NO: 4044002 - RNA, 16 nt, Molluscum contagiosum virus
cccggcucgcucauca

SEQ ID NO: 4044003 - RNA, 20 nt, Molluscum contagiosum virus
cccggcugccgcugccugug

SEQ ID NO: 4044004 - RNA, 17 nt, Molluscum contagiosum virus
cccgggcccgcaugcag

SEQ ID NO: 4044005 - RNA, 22 nt, Molluscum contagiosum virus
cccguccuugcucuggcucucg

SEQ ID NO: 4044006 - RNA, 22 nt, Molluscum contagiosum virus
cccguggugggccgcggcgcgg

SEQ ID NO: 4044007 - RNA, 22 nt, Molluscum contagiosum virus
cccuaagggcccgcuggcggcg

SEQ ID NO: 4044008 - RNA, 17 nt, Molluscum contagiosum virus
cccuccccagcgccgcc

SEQ ID NO: 4044009 - RNA, 22 nt, Molluscum contagiosum virus
cccuccuaucucaaagaacgcg

SEQ ID NO: 4044010 - RNA, 15 nt, Molluscum contagiosum virus
cccucgcaagcugag

SEQ ID NO: 4044011 - RNA, 15 nt, Molluscum contagiosum virus
cccucgcgcgcagcu

SEQ ID NO: 4044012 - RNA, 14 nt, Molluscum contagiosum virus
cccucggcgcgccg

SEQ ID NO: 4044013 - RNA, 15 nt, Molluscum contagiosum virus
cccucggcgcgccgu

SEQ ID NO: 4044014 - RNA, 16 nt, Molluscum contagiosum virus
cccucgucgcgcuucc

SEQ ID NO: 4044015 - RNA, 17 nt, Molluscum contagiosum virus
cccucguguacgagaag

SEQ ID NO: 4044016 - RNA, 13 nt, Molluscum contagiosum virus
cccugcgcgagca

SEQ ID NO: 4044017 - RNA, 14 nt, Molluscum contagiosum virus
cccugcgggcgcuc

SEQ ID NO: 4044018 - RNA, 13 nt, Molluscum contagiosum virus
cccugcugcucgc

SEQ ID NO: 4044019 - RNA, 20 nt, Molluscum contagiosum virus
cccuggcugcugcgcgaccg

SEQ ID NO: 4044020 - RNA, 22 nt, Molluscum contagiosum virus
cccuucgcuugucgugcuuccu

SEQ ID NO: 4044021 - RNA, 18 nt, Molluscum contagiosum virus
cccuugauccaggcccgu

SEQ ID NO: 4044022 - RNA, 22 nt, Molluscum contagiosum virus
cccuuucgcggauucccauucc

SEQ ID NO: 4044023 - RNA, 21 nt, Molluscum contagiosum virus
ccgaagccgcaggccaggugc

SEQ ID NO: 4044024 - RNA, 11 nt, Molluscum contagiosum virus
ccgaaggaaag

SEQ ID NO: 4044025 - RNA, 17 nt, Molluscum contagiosum virus
ccgaaggaaaggccccc

SEQ ID NO: 4044026 - RNA, 16 nt, Molluscum contagiosum virus
ccgaagucgcagcagc

SEQ ID NO: 4044027 - RNA, 22 nt, Molluscum contagiosum virus
ccgaauggugcgguacaugcug

SEQ ID NO: 4044028 - RNA, 20 nt, Molluscum contagiosum virus
ccgacaccggacgaaagguc

SEQ ID NO: 4044029 - RNA, 12 nt, Molluscum contagiosum virus
ccgaccaccagg

SEQ ID NO: 4044030 - RNA, 20 nt, Molluscum contagiosum virus
ccgacccaucggagaagugc

SEQ ID NO: 4044031 - RNA, 15 nt, Molluscum contagiosum virus
ccgacccggcucgcu

SEQ ID NO: 4044032 - RNA, 17 nt, Molluscum contagiosum virus
ccgacccggcucgcuca

SEQ ID NO: 4044033 - RNA, 17 nt, Molluscum contagiosum virus
ccgacgccagcgcgccc

SEQ ID NO: 4044034 - RNA, 20 nt, Molluscum contagiosum virus
ccgacgcgggcgcgcacccc

SEQ ID NO: 4044035 - RNA, 12 nt, Molluscum contagiosum virus
ccgacgggcccc

SEQ ID NO: 4044036 - RNA, 23 nt, Molluscum contagiosum virus
ccgacgggccccuguuggccccg

SEQ ID NO: 4044037 - RNA, 15 nt, Molluscum contagiosum virus
ccgacucggugcuca

SEQ ID NO: 4044038 - RNA, 22 nt, Molluscum contagiosum virus
ccgagaucacggcgugcgcgag

SEQ ID NO: 4044039 - RNA, 20 nt, Molluscum contagiosum virus
ccgagcaauugcugggcaca

SEQ ID NO: 4044040 - RNA, 21 nt, Molluscum contagiosum virus
ccgagccaaggaugccugcca

SEQ ID NO: 4044041 - RNA, 14 nt, Molluscum contagiosum virus
ccgagcccggccag

SEQ ID NO: 4044042 - RNA, 16 nt, Molluscum contagiosum virus
ccgagcgcacgccgcu

SEQ ID NO: 4044043 - RNA, 15 nt, Molluscum contagiosum virus
ccgagcgcgcgugcu

SEQ ID NO: 4044044 - RNA, 22 nt, Molluscum contagiosum virus
ccgagcggcaagccgugcuuug

SEQ ID NO: 4044045 - RNA, 12 nt, Molluscum contagiosum virus
ccgagcggggac

SEQ ID NO: 4044046 - RNA, 21 nt, Molluscum contagiosum virus
ccgagcgugggcgagcgcacg

SEQ ID NO: 4044047 - RNA, 18 nt, Molluscum contagiosum virus
ccgaggacgacgccgagc

SEQ ID NO: 4044048 - RNA, 15 nt, Molluscum contagiosum virus
ccgaggacgcgcccg

SEQ ID NO: 4044049 - RNA, 20 nt, Molluscum contagiosum virus
ccgaggagagcggcgccccu

SEQ ID NO: 4044050 - RNA, 17 nt, Molluscum contagiosum virus
ccgaggccgcgcucuuc

SEQ ID NO: 4044051 - RNA, 13 nt, Molluscum contagiosum virus
ccgagggcgugcg

SEQ ID NO: 4044052 - RNA, 18 nt, Molluscum contagiosum virus
ccgaguaccgcgcgcacg

SEQ ID NO: 4044053 - RNA, 18 nt, Molluscum contagiosum virus
ccgauuuggacgcggcac

SEQ ID NO: 4044054 - RNA, 21 nt, Molluscum contagiosum virus
ccgcaaauuccguccccucuc

SEQ ID NO: 4044055 - RNA, 15 nt, Molluscum contagiosum virus
ccgcacgcugcugcg

SEQ ID NO: 4044056 - RNA, 17 nt, Molluscum contagiosum virus
ccgcacgcugcugcgug

SEQ ID NO: 4044057 - RNA, 18 nt, Molluscum contagiosum virus
ccgcacucgccgcggaac

SEQ ID NO: 4044058 - RNA, 15 nt, Molluscum contagiosum virus
ccgcagccgcgcucg

SEQ ID NO: 4044059 - RNA, 22 nt, Molluscum contagiosum virus
ccgcagcgcuggagcuggcugg

SEQ ID NO: 4044060 - RNA, 18 nt, Molluscum contagiosum virus
ccgcaggaaaggcacccc

SEQ ID NO: 4044061 - RNA, 17 nt, Molluscum contagiosum virus
ccgcaucggcgccgccc

SEQ ID NO: 4044062 - RNA, 20 nt, Molluscum contagiosum virus
ccgcaugcaccuacgcgccg

SEQ ID NO: 4044063 - RNA, 16 nt, Molluscum contagiosum virus
ccgccagaagugaaau

SEQ ID NO: 4044064 - RNA, 21 nt, Molluscum contagiosum virus
ccgccagcgacgagcagcugc

SEQ ID NO: 4044065 - RNA, 12 nt, Molluscum contagiosum virus
ccgccaggaacg

SEQ ID NO: 4044066 - RNA, 15 nt, Molluscum contagiosum virus
ccgccaugcugcgcg

SEQ ID NO: 4044067 - RNA, 13 nt, Molluscum contagiosum virus
ccgcccgaguccg

SEQ ID NO: 4044068 - RNA, 21 nt, Molluscum contagiosum virus
ccgcccgcgcuucugccugcu

SEQ ID NO: 4044069 - RNA, 20 nt, Molluscum contagiosum virus
ccgccgacaacgcacccgcg

SEQ ID NO: 4044070 - RNA, 20 nt, Molluscum contagiosum virus
ccgccgcggcgcccacggcg

SEQ ID NO: 4044071 - RNA, 13 nt, Molluscum contagiosum virus
ccgccggcgccgc

SEQ ID NO: 4044072 - RNA, 21 nt, Molluscum contagiosum virus
ccgccucgagcacgccuccaa

SEQ ID NO: 4044073 - RNA, 20 nt, Molluscum contagiosum virus
ccgccugccgcgagcacugg

SEQ ID NO: 4044074 - RNA, 17 nt, Molluscum contagiosum virus
ccgccugcugcagcucc

SEQ ID NO: 4044075 - RNA, 15 nt, Molluscum contagiosum virus
ccgccuguaccugcu

SEQ ID NO: 4044076 - RNA, 20 nt, Molluscum contagiosum virus
ccgccuuuguggacgcgcaa

SEQ ID NO: 4044077 - RNA, 23 nt, Molluscum contagiosum virus
ccgcgaaagaggaaagcgcacac

SEQ ID NO: 4044078 - RNA, 14 nt, Molluscum contagiosum virus
ccgcgaaggagaga

SEQ ID NO: 4044079 - RNA, 22 nt, Molluscum contagiosum virus
ccgcgacaugccucgcggcccg

SEQ ID NO: 4044080 - RNA, 16 nt, Molluscum contagiosum virus
ccgcgagauugagagc

SEQ ID NO: 4044081 - RNA, 23 nt, Molluscum contagiosum virus
ccgcgagcacguggacagcaucc

SEQ ID NO: 4044082 - RNA, 17 nt, Molluscum contagiosum virus
ccgcgauucugcucuuu

SEQ ID NO: 4044083 - RNA, 17 nt, Molluscum contagiosum virus
ccgcgcaagagccgccg

SEQ ID NO: 4044084 - RNA, 22 nt, Molluscum contagiosum virus
ccgcgcaccgcguugccgcccg

SEQ ID NO: 4044085 - RNA, 17 nt, Molluscum contagiosum virus
ccgcgcaugccagaccc

SEQ ID NO: 4044086 - RNA, 19 nt, Molluscum contagiosum virus
ccgcgcccaagaagaagca

SEQ ID NO: 4044087 - RNA, 20 nt, Molluscum contagiosum virus
ccgcgcccgacucgcagcuc

SEQ ID NO: 4044088 - RNA, 19 nt, Molluscum contagiosum virus
ccgcgcccgccagcauggc

SEQ ID NO: 4044089 - RNA, 14 nt, Molluscum contagiosum virus
ccgcgccgggcgcc

SEQ ID NO: 4044090 - RNA, 17 nt, Molluscum contagiosum virus
ccgcgccuagccgugcg

SEQ ID NO: 4044091 - RNA, 17 nt, Molluscum contagiosum virus
ccgcgcgccgcgcgccg

SEQ ID NO: 4044092 - RNA, 13 nt, Molluscum contagiosum virus
ccgcgcgcgcgcg

SEQ ID NO: 4044093 - RNA, 15 nt, Molluscum contagiosum virus
ccgcgcgcgcgcgug

SEQ ID NO: 4044094 - RNA, 15 nt, Molluscum contagiosum virus
ccgcgcgcgcuccga

SEQ ID NO: 4044095 - RNA, 22 nt, Molluscum contagiosum virus
ccgcgcgcggcuaagcucugcg

SEQ ID NO: 4044096 - RNA, 17 nt, Molluscum contagiosum virus
ccgcgcgcucgcgcuuc

SEQ ID NO: 4044097 - RNA, 19 nt, Molluscum contagiosum virus
ccgcgcgcucucacgcuuc

SEQ ID NO: 4044098 - RNA, 21 nt, Molluscum contagiosum virus
ccgcgcgcucucacgcuucgu

SEQ ID NO: 4044099 - RNA, 21 nt, Molluscum contagiosum virus
ccgcgcggcuuggcgcccuuc

SEQ ID NO: 4044100 - RNA, 22 nt, Molluscum contagiosum virus
ccgcgcgggccaugucugugcg

SEQ ID NO: 4044101 - RNA, 16 nt, Molluscum contagiosum virus
ccgcgcugaugcuagc

SEQ ID NO: 4044102 - RNA, 13 nt, Molluscum contagiosum virus
ccgcgcugcuccg

SEQ ID NO: 4044103 - RNA, 20 nt, Molluscum contagiosum virus
ccgcgcuuugucgaggccuu

SEQ ID NO: 4044104 - RNA, 19 nt, Molluscum contagiosum virus
ccgcggaagugcgagccgu

SEQ ID NO: 4044105 - RNA, 15 nt, Molluscum contagiosum virus
ccgcggacgcgcccu

SEQ ID NO: 4044106 - RNA, 13 nt, Molluscum contagiosum virus
ccgcggagggagg

SEQ ID NO: 4044107 - RNA, 13 nt, Molluscum contagiosum virus
ccgcggccugggc

SEQ ID NO: 4044108 - RNA, 15 nt, Molluscum contagiosum virus
ccgcggcgacgucaa

SEQ ID NO: 4044109 - RNA, 16 nt, Molluscum contagiosum virus
ccgcggcgcgcagcuc

SEQ ID NO: 4044110 - RNA, 20 nt, Molluscum contagiosum virus
ccgcggcgcggcggaagugg

SEQ ID NO: 4044111 - RNA, 17 nt, Molluscum contagiosum virus
ccgcgggcgcacgcuug

SEQ ID NO: 4044112 - RNA, 16 nt, Molluscum contagiosum virus
cacagacauggcccgc

SEQ ID NO: 4044113 - RNA, 13 nt, Molluscum contagiosum virus
cacagagggacag

SEQ ID NO: 4044114 - RNA, 16 nt, Molluscum contagiosum virus
cacagcaggagcacgc

SEQ ID NO: 4044115 - RNA, 19 nt, Molluscum contagiosum virus
cacagcaggagcacgccug

SEQ ID NO: 4044116 - RNA, 16 nt, Molluscum contagiosum virus
cacagccccugcugcu

SEQ ID NO: 4044117 - RNA, 19 nt, Molluscum contagiosum virus
cacagucuugcgcagcgcc

SEQ ID NO: 4044118 - RNA, 20 nt, Molluscum contagiosum virus
cacaguucacggcgcucgcc

SEQ ID NO: 4044119 - RNA, 22 nt, Molluscum contagiosum virus
cacaguucacggcgcucgccuc

SEQ ID NO: 4044120 - RNA, 17 nt, Molluscum contagiosum virus
cacaguucggccgcacg

SEQ ID NO: 4044121 - RNA, 13 nt, Molluscum contagiosum virus
cacaucaugggcu

SEQ ID NO: 4044122 - RNA, 13 nt, Molluscum contagiosum virus
cacaugcagcugc

SEQ ID NO: 4044123 - RNA, 13 nt, Molluscum contagiosum virus
cacaugccuucag

SEQ ID NO: 4044124 - RNA, 13 nt, Molluscum contagiosum virus
cacaugugcugcc

SEQ ID NO: 4044125 - RNA, 16 nt, Molluscum contagiosum virus
caccaaggacguguac

SEQ ID NO: 4044126 - RNA, 13 nt, Molluscum contagiosum virus
caccacaacugaa

SEQ ID NO: 4044127 - RNA, 13 nt, Molluscum contagiosum virus
caccaccagcacg

SEQ ID NO: 4044128 - RNA, 14 nt, Molluscum contagiosum virus
caccaccagcacgc

SEQ ID NO: 4044129 - RNA, 17 nt, Molluscum contagiosum virus
caccaccuccagguccc

SEQ ID NO: 4044130 - RNA, 15 nt, Molluscum contagiosum virus
caccacguggaccug

SEQ ID NO: 4044131 - RNA, 16 nt, Molluscum contagiosum virus
cauacuccugcuggcg

SEQ ID NO: 4044132 - RNA, 15 nt, Molluscum contagiosum virus
cauagcccaugcgca

SEQ ID NO: 4044133 - RNA, 14 nt, Molluscum contagiosum virus
cauccgcgagcacc

SEQ ID NO: 4044134 - RNA, 12 nt, Molluscum contagiosum virus
cauccgcgcgcu

SEQ ID NO: 4044135 - RNA, 16 nt, Molluscum contagiosum virus
cauccggccgaggcac

SEQ ID NO: 4044136 - RNA, 19 nt, Molluscum contagiosum virus
cauccggccgaggcacgcg

SEQ ID NO: 4044137 - RNA, 14 nt, Molluscum contagiosum virus
cauccuccacgcug

SEQ ID NO: 4044138 - RNA, 14 nt, Molluscum contagiosum virus
cauccucuaccgcc

SEQ ID NO: 4044139 - RNA, 14 nt, Molluscum contagiosum virus
cauccugccacacc

SEQ ID NO: 4044140 - RNA, 18 nt, Molluscum contagiosum virus
cauccuggggaaccgcug

SEQ ID NO: 4044141 - RNA, 15 nt, Molluscum contagiosum virus
caucgacgagcacga

SEQ ID NO: 4044142 - RNA, 20 nt, Molluscum contagiosum virus
caucgacgugcagacgcuca

SEQ ID NO: 4044143 - RNA, 14 nt, Molluscum contagiosum virus
caucgcugcacgcg

SEQ ID NO: 4044144 - RNA, 17 nt, Molluscum contagiosum virus
caucggcuccgcgcccg

SEQ ID NO: 4044145 - RNA, 16 nt, Molluscum contagiosum virus
caucuccacgucggcc

SEQ ID NO: 4044146 - RNA, 13 nt, Molluscum contagiosum virus
caucuccuugucu

SEQ ID NO: 4044147 - RNA, 19 nt, Molluscum contagiosum virus
caucucgagacgcugccug

SEQ ID NO: 4044148 - RNA, 17 nt, Molluscum contagiosum virus
caucugcgagcgcgaau

SEQ ID NO: 4044149 - RNA, 23 nt, Molluscum contagiosum virus
caugcagcugcaggaccugcugg

SEQ ID NO: 4044150 - RNA, 15 nt, Molluscum contagiosum virus
caugcagucacgacu

SEQ ID NO: 4044151 - RNA, 13 nt, Molluscum contagiosum virus
caugcccacgcgc

SEQ ID NO: 4044152 - RNA, 22 nt, Molluscum contagiosum virus
caugccggggaugaacgcgcug

SEQ ID NO: 4044153 - RNA, 14 nt, Molluscum contagiosum virus
caugcgcgcagugc

SEQ ID NO: 4044154 - RNA, 16 nt, Molluscum contagiosum virus
caugcgcgcgcagcag

SEQ ID NO: 4044155 - RNA, 15 nt, Molluscum contagiosum virus
caugcggcaggcgcu

SEQ ID NO: 4044156 - RNA, 23 nt, Molluscum contagiosum virus
caugcucgagccugccagcgcca

SEQ ID NO: 4044157 - RNA, 20 nt, Molluscum contagiosum virus
caugcugcccgcgcgcgacu

SEQ ID NO: 4044158 - RNA, 15 nt, Molluscum contagiosum virus
cauggaccgcgucaa

SEQ ID NO: 4044159 - RNA, 16 nt, Molluscum contagiosum virus
cauggaccgcgucaag

SEQ ID NO: 4044160 - RNA, 18 nt, Molluscum contagiosum virus
cauggacgugcugcuggc

SEQ ID NO: 4044161 - RNA, 22 nt, Molluscum contagiosum virus
cauggacgugcugcuggcccug

SEQ ID NO: 4044162 - RNA, 22 nt, Molluscum contagiosum virus
cauggaggacggcgcgggcgcg

SEQ ID NO: 4044163 - RNA, 13 nt, Molluscum contagiosum virus
cauggccacgccc

SEQ ID NO: 4044164 - RNA, 14 nt, Molluscum contagiosum virus
cauggcgccacacc

SEQ ID NO: 4044165 - RNA, 12 nt, Molluscum contagiosum virus
cauggcgccgcu

SEQ ID NO: 4044166 - RNA, 14 nt, Molluscum contagiosum virus
cauggcgccgcugc

SEQ ID NO: 4044167 - RNA, 22 nt, Molluscum contagiosum virus
cauggcucccgcacgcaccgcg

SEQ ID NO: 4044168 - RNA, 19 nt, Molluscum contagiosum virus
cauguccuuucagacagcg

SEQ ID NO: 4044169 - RNA, 17 nt, Molluscum contagiosum virus
caugucgcggugcgugc

SEQ ID NO: 4044170 - RNA, 17 nt, Molluscum contagiosum virus
caugugcgagaacuggc

SEQ ID NO: 4044171 - RNA, 14 nt, Molluscum contagiosum virus
caugugcgugcacc

SEQ ID NO: 4044172 - RNA, 23 nt, Molluscum contagiosum virus
cauguguuuguagccgcgcgaac

SEQ ID NO: 4044173 - RNA, 23 nt, Molluscum contagiosum virus
cauuacccccccuucugucccaa

SEQ ID NO: 4044174 - RNA, 20 nt, Molluscum contagiosum virus
cauucccggcgcgcgcggcg

SEQ ID NO: 4044175 - RNA, 15 nt, Molluscum contagiosum virus
cauuccuuguccugg

SEQ ID NO: 4044176 - RNA, 15 nt, Molluscum contagiosum virus
cauuuucucuggaga

SEQ ID NO: 4044177 - RNA, 21 nt, Molluscum contagiosum virus
ccaaaucgcguuugccaggca

SEQ ID NO: 4044178 - RNA, 15 nt, Molluscum contagiosum virus
ccaacccucgcaagc

SEQ ID NO: 4044179 - RNA, 20 nt, Molluscum contagiosum virus
ccaaccuccugcaccugcug

SEQ ID NO: 4044180 - RNA, 22 nt, Molluscum contagiosum virus
ccaacgacuagcgugcgcagca

SEQ ID NO: 4044181 - RNA, 14 nt, Molluscum contagiosum virus
ccaacgccagcugu

SEQ ID NO: 4044182 - RNA, 20 nt, Molluscum contagiosum virus
ccaacucugugaccugcgcc

SEQ ID NO: 4044183 - RNA, 18 nt, Molluscum contagiosum virus
ccaagaacaagcucgagg

SEQ ID NO: 4044184 - RNA, 22 nt, Molluscum contagiosum virus
ccaagaacaagcucgaggcgcu

SEQ ID NO: 4044185 - RNA, 13 nt, Molluscum contagiosum virus
ccaagaacaauac

SEQ ID NO: 4044186 - RNA, 19 nt, Molluscum contagiosum virus
ccaagaagaggccggcaca

SEQ ID NO: 4044187 - RNA, 18 nt, Molluscum contagiosum virus
ccaagaggacgagcugcu

SEQ ID NO: 4044188 - RNA, 17 nt, Molluscum contagiosum virus
ccaagcucuggcuugcg

SEQ ID NO: 4044189 - RNA, 13 nt, Molluscum contagiosum virus
ccaaggggagaca

SEQ ID NO: 4044190 - RNA, 23 nt, Molluscum contagiosum virus
ccaaggucgagcugacucggaca

SEQ ID NO: 4044191 - RNA, 23 nt, Molluscum contagiosum virus
ccaaugcuuucccguuagagaca

SEQ ID NO: 4044192 - RNA, 19 nt, Molluscum contagiosum virus
ccaauggagccgcugcugc

SEQ ID NO: 4044193 - RNA, 16 nt, Molluscum contagiosum virus
ccacaugccgcgcugc

SEQ ID NO: 4044194 - RNA, 14 nt, Molluscum contagiosum virus
ccaccagcgcggcc

SEQ ID NO: 4044195 - RNA, 14 nt, Molluscum contagiosum virus
ccaccggcagcgca

SEQ ID NO: 4044196 - RNA, 19 nt, Molluscum contagiosum virus
ccaccuggaaaagcgcgag

SEQ ID NO: 4044197 - RNA, 18 nt, Molluscum contagiosum virus
ccacgaacgacagcgccg

SEQ ID NO: 4044198 - RNA, 17 nt, Molluscum contagiosum virus
ccacgaagaacgcggcg

SEQ ID NO: 4044199 - RNA, 16 nt, Molluscum contagiosum virus
ccacgacauggaccgc

SEQ ID NO: 4044200 - RNA, 18 nt, Molluscum contagiosum virus
ccacgaccgcaagugcac

SEQ ID NO: 4044201 - RNA, 18 nt, Molluscum contagiosum virus
ccacgagagaggcuuugc

SEQ ID NO: 4044202 - RNA, 13 nt, Molluscum contagiosum virus
ccacgagcgccgc

SEQ ID NO: 4044203 - RNA, 18 nt, Molluscum contagiosum virus
ccacgaugaacggcuccu

SEQ ID NO: 4044204 - RNA, 14 nt, Molluscum contagiosum virus
ccacgcagcuggcg

SEQ ID NO: 4044205 - RNA, 22 nt, Molluscum contagiosum virus
ccacgcaggacuggcaccugcg

SEQ ID NO: 4044206 - RNA, 11 nt, Molluscum contagiosum virus
ccacgcgcccg

SEQ ID NO: 4044207 - RNA, 22 nt, Molluscum contagiosum virus
ccacgcucgcgcgcaugcucgc

SEQ ID NO: 4044208 - RNA, 22 nt, Molluscum contagiosum virus
ccacggcgagcugccauggcag

SEQ ID NO: 4044209 - RNA, 13 nt, Molluscum contagiosum virus
ccacggcugcaag

SEQ ID NO: 4044210 - RNA, 21 nt, Molluscum contagiosum virus
ccacguacgagcagcugcugc

SEQ ID NO: 4044211 - RNA, 14 nt, Molluscum contagiosum virus
ccacgugccagagu

SEQ ID NO: 4044212 - RNA, 14 nt, Molluscum contagiosum virus
ccacgugcgcuggc

SEQ ID NO: 4044213 - RNA, 22 nt, Molluscum contagiosum virus
ccacgugcuccgugugccaguc

SEQ ID NO: 4044214 - RNA, 14 nt, Molluscum contagiosum virus
ccacucuccuucag

SEQ ID NO: 4044215 - RNA, 21 nt, Molluscum contagiosum virus
ccacugggaacaccacacgcg

SEQ ID NO: 4044216 - RNA, 14 nt, Molluscum contagiosum virus
ccacugugccagca

SEQ ID NO: 4044217 - RNA, 22 nt, Molluscum contagiosum virus
ccagagucgccgcugcgcaucu

SEQ ID NO: 4044218 - RNA, 17 nt, Molluscum contagiosum virus
ccagauguucucgccag

SEQ ID NO: 4044219 - RNA, 13 nt, Molluscum contagiosum virus
ccagcagccaggc

SEQ ID NO: 4044220 - RNA, 16 nt, Molluscum contagiosum virus
ccagcagcgccagcuu

SEQ ID NO: 4044221 - RNA, 12 nt, Molluscum contagiosum virus
ccagcagcuccu

SEQ ID NO: 4044222 - RNA, 19 nt, Molluscum contagiosum virus
ccagccaggcgccggcgcg

SEQ ID NO: 4044223 - RNA, 19 nt, Molluscum contagiosum virus
ccagccgcugcgccgccag

SEQ ID NO: 4044224 - RNA, 15 nt, Molluscum contagiosum virus
ccagccugacggcag

SEQ ID NO: 4044225 - RNA, 21 nt, Molluscum contagiosum virus
ccagccugcuggcaccgcgcg

SEQ ID NO: 4044226 - RNA, 15 nt, Molluscum contagiosum virus
ccagcgauugcccgc

SEQ ID NO: 4044227 - RNA, 14 nt, Molluscum contagiosum virus
ccagcgccagccug

SEQ ID NO: 4044228 - RNA, 19 nt, Molluscum contagiosum virus
ccagcgccagccugcuggc

SEQ ID NO: 4044229 - RNA, 15 nt, Molluscum contagiosum virus
auggacgucgcggcc

SEQ ID NO: 4044230 - RNA, 14 nt, Molluscum contagiosum virus
auggacgugcuccg

SEQ ID NO: 4044231 - RNA, 18 nt, Molluscum contagiosum virus
auggcauucucggacagu

SEQ ID NO: 4044232 - RNA, 17 nt, Molluscum contagiosum virus
auggccgagaaaaagcu

SEQ ID NO: 4044233 - RNA, 16 nt, Molluscum contagiosum virus
auggccggcaacuggc

SEQ ID NO: 4044234 - RNA, 20 nt, Molluscum contagiosum virus
auggcgauagcgauggcugu

SEQ ID NO: 4044235 - RNA, 15 nt, Molluscum contagiosum virus
auggcggccugcccu

SEQ ID NO: 4044236 - RNA, 22 nt, Molluscum contagiosum virus
auggcucccgcacgcaccgcga

SEQ ID NO: 4044237 - RNA, 16 nt, Molluscum contagiosum virus
auggcugcgaccaaga

SEQ ID NO: 4044238 - RNA, 19 nt, Molluscum contagiosum virus
auggcugcucucggcagcg

SEQ ID NO: 4044239 - RNA, 14 nt, Molluscum contagiosum virus
auggggauguggac

SEQ ID NO: 4044240 - RNA, 19 nt, Molluscum contagiosum virus
auggugcgguacaugcugu

SEQ ID NO: 4044241 - RNA, 16 nt, Molluscum contagiosum virus
auguagaacgccagga

SEQ ID NO: 4044242 - RNA, 15 nt, Molluscum contagiosum virus
auguagccuacgugg

SEQ ID NO: 4044243 - RNA, 14 nt, Molluscum contagiosum virus
auguccggcgcugg

SEQ ID NO: 4044244 - RNA, 13 nt, Molluscum contagiosum virus
augucgagcccug

SEQ ID NO: 4044245 - RNA, 21 nt, Molluscum contagiosum virus
augucgccgcguagccgccgc

SEQ ID NO: 4044246 - RNA, 18 nt, Molluscum contagiosum virus
augucuccccuugggcuc

SEQ ID NO: 4044247 - RNA, 15 nt, Molluscum contagiosum virus
augugaacacgacau

SEQ ID NO: 4044248 - RNA, 16 nt, Molluscum contagiosum virus
augugcuggucaagaa

SEQ ID NO: 4044249 - RNA, 20 nt, Molluscum contagiosum virus
auuacgcugccgugagcacg

SEQ ID NO: 4044250 - RNA, 13 nt, Molluscum contagiosum virus
auucccguggacc

SEQ ID NO: 4044251 - RNA, 16 nt, Molluscum contagiosum virus
auuccucgagagggag

SEQ ID NO: 4044252 - RNA, 21 nt, Molluscum contagiosum virus
auucucggacagugccuccgc

SEQ ID NO: 4044253 - RNA, 21 nt, Molluscum contagiosum virus
auugagccggacuuguaguuc

SEQ ID NO: 4044254 - RNA, 14 nt, Molluscum contagiosum virus
auugccccugggcu

SEQ ID NO: 4044255 - RNA, 23 nt, Molluscum contagiosum virus
auugcccgcgcgcggacagccua

SEQ ID NO: 4044256 - RNA, 21 nt, Molluscum contagiosum virus
auuguucggaggcugcucccu

SEQ ID NO: 4044257 - RNA, 19 nt, Molluscum contagiosum virus
auuucguugagaccgccgc

SEQ ID NO: 4044258 - RNA, 18 nt, Molluscum contagiosum virus
caaaaaaaagugcgcgug

SEQ ID NO: 4044259 - RNA, 14 nt, Molluscum contagiosum virus
caaaacgcgacgcc

SEQ ID NO: 4044260 - RNA, 15 nt, Molluscum contagiosum virus
caaacgcuguuuuca

SEQ ID NO: 4044261 - RNA, 14 nt, Molluscum contagiosum virus
caaacgugcaugca

SEQ ID NO: 4044262 - RNA, 15 nt, Molluscum contagiosum virus
caaagaagcgcgccc

SEQ ID NO: 4044263 - RNA, 14 nt, Molluscum contagiosum virus
caaagacgggcccg

SEQ ID NO: 4044264 - RNA, 22 nt, Molluscum contagiosum virus
caaagagacgcggccgcggagg

SEQ ID NO: 4044265 - RNA, 15 nt, Molluscum contagiosum virus
caaagcccuccugag

SEQ ID NO: 4044266 - RNA, 13 nt, Molluscum contagiosum virus
caaagccugcugc

SEQ ID NO: 4044267 - RNA, 14 nt, Molluscum contagiosum virus
caaagccugcugcg

SEQ ID NO: 4044268 - RNA, 15 nt, Molluscum contagiosum virus
caaaggaagagcccg

SEQ ID NO: 4044269 - RNA, 17 nt, Molluscum contagiosum virus
caaaggaguuggcgcgc

SEQ ID NO: 4044270 - RNA, 16 nt, Molluscum contagiosum virus
caaaggcccgcgagca

SEQ ID NO: 4044271 - RNA, 15 nt, Molluscum contagiosum virus
caaaugcgcgcgaac

SEQ ID NO: 4044272 - RNA, 23 nt, Molluscum contagiosum virus
caaaugcgucccagcagcugcuc

SEQ ID NO: 4044273 - RNA, 18 nt, Molluscum contagiosum virus
caacaaggaaaggcaccc

SEQ ID NO: 4044274 - RNA, 13 nt, Molluscum contagiosum virus
caacacgagcgcg

SEQ ID NO: 4044275 - RNA, 14 nt, Molluscum contagiosum virus
caacacggcggugc

SEQ ID NO: 4044276 - RNA, 16 nt, Molluscum contagiosum virus
caacacucgugcucgu

SEQ ID NO: 4044277 - RNA, 13 nt, Molluscum contagiosum virus
caacaugccuuuc

SEQ ID NO: 4044278 - RNA, 16 nt, Molluscum contagiosum virus
caacauggugcuggcc

SEQ ID NO: 4044279 - RNA, 18 nt, Molluscum contagiosum virus
caacauggugcuggccau

SEQ ID NO: 4044280 - RNA, 20 nt, Molluscum contagiosum virus
caacauuuacuucgggcgca

SEQ ID NO: 4044281 - RNA, 23 nt, Molluscum contagiosum virus
caaccgcaaggaaaacugcaucc

SEQ ID NO: 4044282 - RNA, 23 nt, Molluscum contagiosum virus
caaccgcauguccacggacaugg

SEQ ID NO: 4044283 - RNA, 13 nt, Molluscum contagiosum virus
caaccgggcucuc

SEQ ID NO: 4044284 - RNA, 20 nt, Molluscum contagiosum virus
caacgagcacgugugcggag

SEQ ID NO: 4044285 - RNA, 16 nt, Molluscum contagiosum virus
caacgcacccgcgcgg

SEQ ID NO: 4044286 - RNA, 14 nt, Molluscum contagiosum virus
caacgccgggcacg

SEQ ID NO: 4044287 - RNA, 11 nt, Molluscum contagiosum virus
caacugccugc

SEQ ID NO: 4044288 - RNA, 15 nt, Molluscum contagiosum virus
caacuguugccugga

SEQ ID NO: 4044289 - RNA, 15 nt, Molluscum contagiosum virus
caagaacaaccagac

SEQ ID NO: 4044290 - RNA, 21 nt, Molluscum contagiosum virus
caagaagacggcgcgcgcgcu

SEQ ID NO: 4044291 - RNA, 20 nt, Molluscum contagiosum virus
caagaagaucgcggcgccgc

SEQ ID NO: 4044292 - RNA, 19 nt, Molluscum contagiosum virus
caagacucgcccgcgcgcg

SEQ ID NO: 4044293 - RNA, 11 nt, Molluscum contagiosum virus
caagacuggca

SEQ ID NO: 4044294 - RNA, 17 nt, Molluscum contagiosum virus
caagaggacgagcugcu

SEQ ID NO: 4044295 - RNA, 14 nt, Molluscum contagiosum virus
caagaugacgacgg

SEQ ID NO: 4044296 - RNA, 14 nt, Molluscum contagiosum virus
caagcccagcagcg

SEQ ID NO: 4044297 - RNA, 21 nt, Molluscum contagiosum virus
caagcccgaguucgcggcgcg

SEQ ID NO: 4044298 - RNA, 17 nt, Molluscum contagiosum virus
caagcccggcaugggca

SEQ ID NO: 4044299 - RNA, 22 nt, Molluscum contagiosum virus
caagccguccgccucgagcacg

SEQ ID NO: 4044300 - RNA, 16 nt, Molluscum contagiosum virus
caagcgccgccaugcu

SEQ ID NO: 4044301 - RNA, 18 nt, Molluscum contagiosum virus
caagcgcguucgcgcgug

SEQ ID NO: 4044302 - RNA, 22 nt, Molluscum contagiosum virus
caagcuuugcacgcacgcgcuc

SEQ ID NO: 4044303 - RNA, 19 nt, Molluscum contagiosum virus
caaggaaaggcaccugcag

SEQ ID NO: 4044304 - RNA, 23 nt, Molluscum contagiosum virus
caaggaaaggcaccugcaggaaa

SEQ ID NO: 4044305 - RNA, 13 nt, Molluscum contagiosum virus
caaggacaccgcg

SEQ ID NO: 4044306 - RNA, 16 nt, Molluscum contagiosum virus
caaggagcugcgcgag

SEQ ID NO: 4044307 - RNA, 13 nt, Molluscum contagiosum virus
caaggcgcacgag

SEQ ID NO: 4044308 - RNA, 17 nt, Molluscum contagiosum virus
caagggccugcgggcgg

SEQ ID NO: 4044309 - RNA, 14 nt, Molluscum contagiosum virus
caagggcguagagc

SEQ ID NO: 4044310 - RNA, 18 nt, Molluscum contagiosum virus
caaguagguugcgucccg

SEQ ID NO: 4044311 - RNA, 13 nt, Molluscum contagiosum virus
caagucacugcua

SEQ ID NO: 4044312 - RNA, 17 nt, Molluscum contagiosum virus
caagugcacgcggcgcg

SEQ ID NO: 4044313 - RNA, 17 nt, Molluscum contagiosum virus
caaguucgcugcuggca

SEQ ID NO: 4044314 - RNA, 18 nt, Molluscum contagiosum virus
caaugcagugcaccagca

SEQ ID NO: 4044315 - RNA, 18 nt, Molluscum contagiosum virus
caauggacacgcacuggc

SEQ ID NO: 4044316 - RNA, 21 nt, Molluscum contagiosum virus
caauggcgcgcgagcacagcg

SEQ ID NO: 4044317 - RNA, 22 nt, Molluscum contagiosum virus
caauggcgcgcgagcacagcgc

SEQ ID NO: 4044318 - RNA, 16 nt, Molluscum contagiosum virus
cacaaagacggggccg

SEQ ID NO: 4044319 - RNA, 16 nt, Molluscum contagiosum virus
cacaaaggcgggcccg

SEQ ID NO: 4044320 - RNA, 14 nt, Molluscum contagiosum virus
cacaagcaccgccu

SEQ ID NO: 4044321 - RNA, 22 nt, Molluscum contagiosum virus
cacaagggcagcucaagcugcu

SEQ ID NO: 4044322 - RNA, 12 nt, Molluscum contagiosum virus
cacacacacucg

SEQ ID NO: 4044323 - RNA, 20 nt, Molluscum contagiosum virus
cacacacuugcacgcgcacg

SEQ ID NO: 4044324 - RNA, 12 nt, Molluscum contagiosum virus
cacaccagcugg

SEQ ID NO: 4044325 - RNA, 20 nt, Molluscum contagiosum virus
cacaccgucgcguggugcuu

SEQ ID NO: 4044326 - RNA, 14 nt, Molluscum contagiosum virus
cacacgcaccgccu

SEQ ID NO: 4044327 - RNA, 21 nt, Molluscum contagiosum virus
cacacgcaccgccuggugcug

SEQ ID NO: 4044328 - RNA, 13 nt, Molluscum contagiosum virus
cacacgcgcggcg

SEQ ID NO: 4044329 - RNA, 22 nt, Molluscum contagiosum virus
cacacgcgucgcgcaggcgccc

SEQ ID NO: 4044330 - RNA, 22 nt, Molluscum contagiosum virus
cacacgcugaguuacguggccg

SEQ ID NO: 4044331 - RNA, 14 nt, Molluscum contagiosum virus
cacacggacgagcc

SEQ ID NO: 4044332 - RNA, 14 nt, Molluscum contagiosum virus
cacacuugcgcguc

SEQ ID NO: 4044333 - RNA, 20 nt, Molluscum contagiosum virus
agguggcaugcgcccucacg

SEQ ID NO: 4044334 - RNA, 18 nt, Molluscum contagiosum virus
agguucguccgcucgugc

SEQ ID NO: 4044335 - RNA, 13 nt, Molluscum contagiosum virus
agguugcgcagag

SEQ ID NO: 4044336 - RNA, 21 nt, Molluscum contagiosum virus
agguuggggcggcggggcugc

SEQ ID NO: 4044337 - RNA, 14 nt, Molluscum contagiosum virus
aguaccagccgcug

SEQ ID NO: 4044338 - RNA, 16 nt, Molluscum contagiosum virus
aguaccgcgcgcacgc

SEQ ID NO: 4044339 - RNA, 16 nt, Molluscum contagiosum virus
aguaccggccaaggca

SEQ ID NO: 4044340 - RNA, 15 nt, Molluscum contagiosum virus
aguaccuagugcaca

SEQ ID NO: 4044341 - RNA, 17 nt, Molluscum contagiosum virus
aguacugcagcagcucc

SEQ ID NO: 4044342 - RNA, 19 nt, Molluscum contagiosum virus
aguacugcagcagcuccuc

SEQ ID NO: 4044343 - RNA, 22 nt, Molluscum contagiosum virus
aguacuucuacgggaagcugca

SEQ ID NO: 4044344 - RNA, 21 nt, Molluscum contagiosum virus
aguagcagcuucuuggagccc

SEQ ID NO: 4044345 - RNA, 19 nt, Molluscum contagiosum virus
agucacgaccgacccaucg

SEQ ID NO: 4044346 - RNA, 18 nt, Molluscum contagiosum virus
aguccgccucgagcacgc

SEQ ID NO: 4044347 - RNA, 18 nt, Molluscum contagiosum virus
agucgccuuccugcgccc

SEQ ID NO: 4044348 - RNA, 18 nt, Molluscum contagiosum virus
agucggcguggccaggcc

SEQ ID NO: 4044349 - RNA, 14 nt, Molluscum contagiosum virus
agucucuguaacaa

SEQ ID NO: 4044350 - RNA, 20 nt, Molluscum contagiosum virus
agucuuccuggggcuggaca

SEQ ID NO: 4044351 - RNA, 17 nt, Molluscum contagiosum virus
agugcacaccggcgcgc

SEQ ID NO: 4044352 - RNA, 14 nt, Molluscum contagiosum virus
agugccgagcucgc

SEQ ID NO: 4044353 - RNA, 23 nt, Molluscum contagiosum virus
agugccuccgcggacgcgcccug

SEQ ID NO: 4044354 - RNA, 21 nt, Molluscum contagiosum virus
agugcgagccgugaccuucgu

SEQ ID NO: 4044355 - RNA, 15 nt, Molluscum contagiosum virus
agugcgcgccaagaa

SEQ ID NO: 4044356 - RNA, 16 nt, Molluscum contagiosum virus
agugcucccgaggcgc

SEQ ID NO: 4044357 - RNA, 14 nt, Molluscum contagiosum virus
aguggccggcaagg

SEQ ID NO: 4044358 - RNA, 22 nt, Molluscum contagiosum virus
aguggcgcgcauuuaccggcgc

SEQ ID NO: 4044359 - RNA, 15 nt, Molluscum contagiosum virus
aguggcgcucgcgag

SEQ ID NO: 4044360 - RNA, 16 nt, Molluscum contagiosum virus
aguggcgugacagguc

SEQ ID NO: 4044361 - RNA, 20 nt, Molluscum contagiosum virus
aguggcuuguugucgagcag

SEQ ID NO: 4044362 - RNA, 15 nt, Molluscum contagiosum virus
agugugugcaucccu

SEQ ID NO: 4044363 - RNA, 18 nt, Molluscum contagiosum virus
aguguugucguccuuggc

SEQ ID NO: 4044364 - RNA, 12 nt, Molluscum contagiosum virus
aguguugugaag

SEQ ID NO: 4044365 - RNA, 22 nt, Molluscum contagiosum virus
aguguugugaaguccucucucc

SEQ ID NO: 4044366 - RNA, 17 nt, Molluscum contagiosum virus
aguuccagcagcgccag

SEQ ID NO: 4044367 - RNA, 19 nt, Molluscum contagiosum virus
aguucugcacagcacaggc

SEQ ID NO: 4044368 - RNA, 14 nt, Molluscum contagiosum virus
aguugcgagccagc

SEQ ID NO: 4044369 - RNA, 22 nt, Molluscum contagiosum virus
aguuggcgcgcaagcgcugcuc

SEQ ID NO: 4044370 - RNA, 20 nt, Molluscum contagiosum virus
auaaggcgguggcggcucug

SEQ ID NO: 4044371 - RNA, 20 nt, Molluscum contagiosum virus
auaaucggucagacuuucug

SEQ ID NO: 4044372 - RNA, 14 nt, Molluscum contagiosum virus
auacacuuccugcu

SEQ ID NO: 4044373 - RNA, 13 nt, Molluscum contagiosum virus
auacuccugcugg

SEQ ID NO: 4044374 - RNA, 14 nt, Molluscum contagiosum virus
auacucuguagcau

SEQ ID NO: 4044375 - RNA, 19 nt, Molluscum contagiosum virus
auacugcgggcuguuccaa

SEQ ID NO: 4044376 - RNA, 16 nt, Molluscum contagiosum virus
auagcccaugcgcagu

SEQ ID NO: 4044377 - RNA, 20 nt, Molluscum contagiosum virus
auagcgccacgagcagugcc

SEQ ID NO: 4044378 - RNA, 14 nt, Molluscum contagiosum virus
aucaccagccugcu

SEQ ID NO: 4044379 - RNA, 17 nt, Molluscum contagiosum virus
aucacgaugugcgcgcg

SEQ ID NO: 4044380 - RNA, 16 nt, Molluscum contagiosum virus
aucacggcgugcgcga

SEQ ID NO: 4044381 - RNA, 17 nt, Molluscum contagiosum virus
aucagagaagugcuccg

SEQ ID NO: 4044382 - RNA, 14 nt, Molluscum contagiosum virus
aucaucgcgcugcu

SEQ ID NO: 4044383 - RNA, 20 nt, Molluscum contagiosum virus
auccagcccugugcccgagu

SEQ ID NO: 4044384 - RNA, 19 nt, Molluscum contagiosum virus
aucccacguacgagcagcu

SEQ ID NO: 4044385 - RNA, 23 nt, Molluscum contagiosum virus
aucccacguacgagcagcugcug

SEQ ID NO: 4044386 - RNA, 17 nt, Molluscum contagiosum virus
aucccugcgcaccugca

SEQ ID NO: 4044387 - RNA, 21 nt, Molluscum contagiosum virus
auccgcaauuacgugcgcgag

SEQ ID NO: 4044388 - RNA, 20 nt, Molluscum contagiosum virus
auccgcaauucuagcgcgag

SEQ ID NO: 4044389 - RNA, 13 nt, Molluscum contagiosum virus
auccgcuaccugg

SEQ ID NO: 4044390 - RNA, 19 nt, Molluscum contagiosum virus
auccucaccuuccugggcg

SEQ ID NO: 4044391 - RNA, 17 nt, Molluscum contagiosum virus
auccuggggaaccgcug

SEQ ID NO: 4044392 - RNA, 15 nt, Molluscum contagiosum virus
aucgacgagcacgag

SEQ ID NO: 4044393 - RNA, 13 nt, Molluscum contagiosum virus
aucgcgcaggcgc

SEQ ID NO: 4044394 - RNA, 13 nt, Molluscum contagiosum virus
aucgcgcugcugg

SEQ ID NO: 4044395 - RNA, 15 nt, Molluscum contagiosum virus
aucgcgcugcuggug

SEQ ID NO: 4044396 - RNA, 18 nt, Molluscum contagiosum virus
aucgcggagcugcgcgcg

SEQ ID NO: 4044397 - RNA, 20 nt, Molluscum contagiosum virus
aucgcucgcggugcagcugc

SEQ ID NO: 4044398 - RNA, 17 nt, Molluscum contagiosum virus
aucggagaagugcuccg

SEQ ID NO: 4044399 - RNA, 16 nt, Molluscum contagiosum virus
aucggcacugcucacg

SEQ ID NO: 4044400 - RNA, 17 nt, Molluscum contagiosum virus
aucgucacgugaacucc

SEQ ID NO: 4044401 - RNA, 19 nt, Molluscum contagiosum virus
aucgucgcggccguggcac

SEQ ID NO: 4044402 - RNA, 12 nt, Molluscum contagiosum virus
aucgugcuggag

SEQ ID NO: 4044403 - RNA, 17 nt, Molluscum contagiosum virus
aucgugggcaucgaccc

SEQ ID NO: 4044404 - RNA, 14 nt, Molluscum contagiosum virus
aucucugcccucag

SEQ ID NO: 4044405 - RNA, 20 nt, Molluscum contagiosum virus
aucuucgaaguggccgucgc

SEQ ID NO: 4044406 - RNA, 20 nt, Molluscum contagiosum virus
augaaccacuucgucaagca

SEQ ID NO: 4044407 - RNA, 11 nt, Molluscum contagiosum virus
augagcggcac

SEQ ID NO: 4044408 - RNA, 15 nt, Molluscum contagiosum virus
augagcguggagaag

SEQ ID NO: 4044409 - RNA, 23 nt, Molluscum contagiosum virus
augcacacacucgcgcguccaca

SEQ ID NO: 4044410 - RNA, 17 nt, Molluscum contagiosum virus
augcacuuucaacucuc

SEQ ID NO: 4044411 - RNA, 16 nt, Molluscum contagiosum virus
augcagauuggaggag

SEQ ID NO: 4044412 - RNA, 17 nt, Molluscum contagiosum virus
augcagugcaccagcac

SEQ ID NO: 4044413 - RNA, 12 nt, Molluscum contagiosum virus
augcccagccug

SEQ ID NO: 4044414 - RNA, 19 nt, Molluscum contagiosum virus
augcccgcaaugcaagccc

SEQ ID NO: 4044415 - RNA, 21 nt, Molluscum contagiosum virus
augcccggccucgccuccggg

SEQ ID NO: 4044416 - RNA, 10 nt, Molluscum contagiosum virus
augccgccgc

SEQ ID NO: 4044417 - RNA, 16 nt, Molluscum contagiosum virus
augccgcgugcucugc

SEQ ID NO: 4044418 - RNA, 21 nt, Molluscum contagiosum virus
augccggggaugaacgcgcug

SEQ ID NO: 4044419 - RNA, 19 nt, Molluscum contagiosum virus
augccuuucaggggucugu

SEQ ID NO: 4044420 - RNA, 21 nt, Molluscum contagiosum virus
augccuuuccgagcucgcaaa

SEQ ID NO: 4044421 - RNA, 22 nt, Molluscum contagiosum virus
augcgcgccgcgcugcuggcca

SEQ ID NO: 4044422 - RNA, 19 nt, Molluscum contagiosum virus
augcgcgggcuacuuuucg

SEQ ID NO: 4044423 - RNA, 14 nt, Molluscum contagiosum virus
augcgcuucggcuc

SEQ ID NO: 4044424 - RNA, 20 nt, Molluscum contagiosum virus
augcucaagcaccugcgcuu

SEQ ID NO: 4044425 - RNA, 15 nt, Molluscum contagiosum virus
augcucaagcacugc

SEQ ID NO: 4044426 - RNA, 13 nt, Molluscum contagiosum virus
augcucgccagca

SEQ ID NO: 4044427 - RNA, 12 nt, Molluscum contagiosum virus
augcucgcgcuc

SEQ ID NO: 4044428 - RNA, 20 nt, Molluscum contagiosum virus
augcucgucgccgggccccu

SEQ ID NO: 4044429 - RNA, 22 nt, Molluscum contagiosum virus
augcucgucgccgggccccugu

SEQ ID NO: 4044430 - RNA, 18 nt, Molluscum contagiosum virus
augcugcucgacgggcgc

SEQ ID NO: 4044431 - RNA, 19 nt, Molluscum contagiosum virus
augcugcucgacgggcgca

SEQ ID NO: 4044432 - RNA, 17 nt, Molluscum contagiosum virus
augcugugcggcacgcc

SEQ ID NO: 4044433 - RNA, 24 nt, Molluscum contagiosum virus
augcuugcuuccggugccggccgc

SEQ ID NO: 4044434 - RNA, 22 nt, Molluscum contagiosum virus
augcuuuuguuacucucagagc

SEQ ID NO: 4044435 - RNA, 21 nt, Molluscum contagiosum virus
auggaccgguuccgugcgcuc

SEQ ID NO: 4044436 - RNA, 15 nt, Molluscum contagiosum virus
auggacgcgccgcgc

SEQ ID NO: 4044437 - RNA, 12 nt, Molluscum contagiosum virus
uucgagcugcug

SEQ ID NO: 4044438 - RNA, 13 nt, Molluscum contagiosum virus
uucgaucgcgcuc

SEQ ID NO: 4044439 - RNA, 17 nt, Molluscum contagiosum virus
uucgccggaggaaggac

SEQ ID NO: 4044440 - RNA, 22 nt, Molluscum contagiosum virus
uucgccggcaucgcgcugcugg

SEQ ID NO: 4044441 - RNA, 14 nt, Molluscum contagiosum virus
uucgcgagccacuc

SEQ ID NO: 4044442 - RNA, 13 nt, Molluscum contagiosum virus
uucgugcugugcc

SEQ ID NO: 4044443 - RNA, 12 nt, Molluscum contagiosum virus
uucguggccaac

SEQ ID NO: 4044444 - RNA, 13 nt, Molluscum contagiosum virus
uucguggcgcugg

SEQ ID NO: 4044445 - RNA, 17 nt, Molluscum contagiosum virus
uucuacgggaagcugca

SEQ ID NO: 4044446 - RNA, 16 nt, Molluscum contagiosum virus
uucucagguacguguc

SEQ ID NO: 4044447 - RNA, 19 nt, Molluscum contagiosum virus
uucugcguugccagcguaa

SEQ ID NO: 4044448 - RNA, 15 nt, Molluscum contagiosum virus
uugaacucgagcacg

SEQ ID NO: 4044449 - RNA, 13 nt, Molluscum contagiosum virus
uugagagcgcugg

SEQ ID NO: 4044450 - RNA, 22 nt, Molluscum contagiosum virus
uugagcucgcgcgcaagaacaa

SEQ ID NO: 4044451 - RNA, 21 nt, Molluscum contagiosum virus
uugaggaacuagugcugcugg

SEQ ID NO: 4044452 - RNA, 19 nt, Molluscum contagiosum virus
uugagugguacuaccucuu

SEQ ID NO: 4044453 - RNA, 18 nt, Molluscum contagiosum virus
uugcacgcgcacgcgccc

SEQ ID NO: 4044454 - RNA, 23 nt, Molluscum contagiosum virus
uugccgugcccaucuccuugucu

SEQ ID NO: 4044455 - RNA, 16 nt, Molluscum contagiosum virus
uugcgagccagccagg

SEQ ID NO: 4044456 - RNA, 17 nt, Molluscum contagiosum virus
uugcgagccagccaggc

SEQ ID NO: 4044457 - RNA, 14 nt, Molluscum contagiosum virus
uugcgcgagcgcgu

SEQ ID NO: 4044458 - RNA, 23 nt, Molluscum contagiosum virus
uugcgcgcggggcacugcgcacg

SEQ ID NO: 4044459 - RNA, 23 nt, Molluscum contagiosum virus
uugcgcggauauggcgcgccgag

SEQ ID NO: 4044460 - RNA, 17 nt, Molluscum contagiosum virus
uugcgcguccacaaagg

SEQ ID NO: 4044461 - RNA, 13 nt, Molluscum contagiosum virus
uugcggcgccgcc

SEQ ID NO: 4044462 - RNA, 16 nt, Molluscum contagiosum virus
uugcguaucggaguca

SEQ ID NO: 4044463 - RNA, 15 nt, Molluscum contagiosum virus
uugcuacaggacguc

SEQ ID NO: 4044464 - RNA, 22 nt, Molluscum contagiosum virus
uugcugucccaagacucugccg

SEQ ID NO: 4044465 - RNA, 13 nt, Molluscum contagiosum virus
uuggaggaggaag

SEQ ID NO: 4044466 - RNA, 21 nt, Molluscum contagiosum virus
uuguccgcggacgcgggccug

SEQ ID NO: 4044467 - RNA, 11 nt, Molluscum contagiosum virus
uugugcugcug

SEQ ID NO: 4044468 - RNA, 14 nt, Molluscum contagiosum virus
uuguguuggccagg

SEQ ID NO: 4044469 - RNA, 13 nt, Molluscum contagiosum virus
uuuacugcaagau

SEQ ID NO: 4044470 - RNA, 24 nt, Molluscum contagiosum virus
uuucaaugcaguaugugaacacga

SEQ ID NO: 4044471 - RNA, 15 nt, Molluscum contagiosum virus
uuuucccgggcggcg

SEQ ID NO: 4044472 - RNA, 22 nt, Molluscum contagiosum virus
uuuucuggcgcguaaggcggcg

SEQ ID NO: 4044473 - RNA, 18 nt, Molluscum contagiosum virus
uuuuugcggcgccgccgc

SEQ ID NO: 4044474 - RNA, 23 nt, Molluscum contagiosum virus
uguaaugugcuggucaagaacau

SEQ ID NO: 4044475 - RNA, 13 nt, Molluscum contagiosum virus
uguacaaagagcu

SEQ ID NO: 4044476 - RNA, 16 nt, Molluscum contagiosum virus
ugucaguggacaagcu

SEQ ID NO: 4044477 - RNA, 20 nt, Molluscum contagiosum virus
ugucaucaccccgcugggcc

SEQ ID NO: 4044478 - RNA, 17 nt, Molluscum contagiosum virus
uguccacgacacuggcg

SEQ ID NO: 4044479 - RNA, 22 nt, Molluscum contagiosum virus
uguccgaggacuuccgcgcgcu

SEQ ID NO: 4044480 - RNA, 14 nt, Molluscum contagiosum virus
uguccgcaagcacg

SEQ ID NO: 4044481 - RNA, 14 nt, Molluscum contagiosum virus
uguccgcacgcaca

SEQ ID NO: 4044482 - RNA, 16 nt, Molluscum contagiosum virus
uguccuacacgccgcu

SEQ ID NO: 4044483 - RNA, 17 nt, Molluscum contagiosum virus
uguccucuuggccccuc

SEQ ID NO: 4044484 - RNA, 13 nt, Molluscum contagiosum virus
ugucgagacaggc

SEQ ID NO: 4044485 - RNA, 21 nt, Molluscum contagiosum virus
ugucgagaccuuccuccaggg

SEQ ID NO: 4044486 - RNA, 23 nt, Molluscum contagiosum virus
ugucgcucguggaucgcgcgcac

SEQ ID NO: 4044487 - RNA, 20 nt, Molluscum contagiosum virus
ugucggcacaucucucaggg

SEQ ID NO: 4044488 - RNA, 17 nt, Molluscum contagiosum virus
ugugacaacaugugauc

SEQ ID NO: 4044489 - RNA, 21 nt, Molluscum contagiosum virus
ugugcacgcuguccaggcgcu

SEQ ID NO: 4044490 - RNA, 21 nt, Molluscum contagiosum virus
ugugcauggcggcggccacgc

SEQ ID NO: 4044491 - RNA, 13 nt, Molluscum contagiosum virus
ugugccagcagca

SEQ ID NO: 4044492 - RNA, 13 nt, Molluscum contagiosum virus
ugugcgagccagu

SEQ ID NO: 4044493 - RNA, 13 nt, Molluscum contagiosum virus
ugugcgcgcacgg

SEQ ID NO: 4044494 - RNA, 13 nt, Molluscum contagiosum virus
ugugcggacaugc

SEQ ID NO: 4044495 - RNA, 17 nt, Molluscum contagiosum virus
ugugggucucgagccgc

SEQ ID NO: 4044496 - RNA, 19 nt, Molluscum contagiosum virus
ugugguucaugacggcgug

SEQ ID NO: 4044497 - RNA, 19 nt, Molluscum contagiosum virus
ugugugcuuauaccaugga

SEQ ID NO: 4044498 - RNA, 13 nt, Molluscum contagiosum virus
uguguugagccuu

SEQ ID NO: 4044499 - RNA, 22 nt, Molluscum contagiosum virus
uguucaccaccaccagcacgcu

SEQ ID NO: 4044500 - RNA, 18 nt, Molluscum contagiosum virus
uguucaccauccagccgu

SEQ ID NO: 4044501 - RNA, 20 nt, Molluscum contagiosum virus
uguuccaagaagacuaccac

SEQ ID NO: 4044502 - RNA, 22 nt, Molluscum contagiosum virus
uguuccacgaccgcaagugcac

SEQ ID NO: 4044503 - RNA, 22 nt, Molluscum contagiosum virus
uguucccggcugccgcugccug

SEQ ID NO: 4044504 - RNA, 12 nt, Molluscum contagiosum virus
uguuccugccgg

SEQ ID NO: 4044505 - RNA, 21 nt, Molluscum contagiosum virus
uguucgcgcuucugccccguc

SEQ ID NO: 4044506 - RNA, 15 nt, Molluscum contagiosum virus
uguucggcaugcagc

SEQ ID NO: 4044507 - RNA, 16 nt, Molluscum contagiosum virus
uguucuggucuggaaa

SEQ ID NO: 4044508 - RNA, 12 nt, Molluscum contagiosum virus
uguugaccaaag

SEQ ID NO: 4044509 - RNA, 16 nt, Molluscum contagiosum virus
uguugccuggagggca

SEQ ID NO: 4044510 - RNA, 17 nt, Molluscum contagiosum virus
uguuuccuugccuucuc

SEQ ID NO: 4044511 - RNA, 22 nt, Molluscum contagiosum virus
uguuucucgcgaaucacaaaca

SEQ ID NO: 4044512 - RNA, 15 nt, Molluscum contagiosum virus
uuagccacugugcug

SEQ ID NO: 4044513 - RNA, 16 nt, Molluscum contagiosum virus
uuagccacugugcuga

SEQ ID NO: 4044514 - RNA, 19 nt, Molluscum contagiosum virus
uucacgcccgcaaugcagu

SEQ ID NO: 4044515 - RNA, 18 nt, Molluscum contagiosum virus
uucacuccgcacagcuuc

SEQ ID NO: 4044516 - RNA, 12 nt, Molluscum contagiosum virus
uucagcgcacgc

SEQ ID NO: 4044517 - RNA, 18 nt, Molluscum contagiosum virus
uucaugugcgagaacugg

SEQ ID NO: 4044518 - RNA, 17 nt, Molluscum contagiosum virus
uuccacgucuccaacaa

SEQ ID NO: 4044519 - RNA, 15 nt, Molluscum contagiosum virus
uucccaagcaaagcc

SEQ ID NO: 4044520 - RNA, 16 nt, Molluscum contagiosum virus
uucccgggcacuguaa

SEQ ID NO: 4044521 - RNA, 15 nt, Molluscum contagiosum virus
uuccgagcgcgcacg

SEQ ID NO: 4044522 - RNA, 23 nt, Molluscum contagiosum virus
uuccggcaccacgugcgcuggcc

SEQ ID NO: 4044523 - RNA, 16 nt, Molluscum contagiosum virus
uuccugaacaagcugc

SEQ ID NO: 4044524 - RNA, 15 nt, Molluscum contagiosum virus
uuccugcgucgccug

SEQ ID NO: 4044525 - RNA, 19 nt, Molluscum contagiosum virus
uucgaaguuucacgcguga

SEQ ID NO: 4044526 - RNA, 19 nt, Molluscum contagiosum virus
uucgagacgcugcgcgacg

SEQ ID NO: 4044527 - RNA, 13 nt, Molluscum contagiosum virus
ucagcagcgcgag

SEQ ID NO: 4044528 - RNA, 21 nt, Molluscum contagiosum virus
ucagccgagcgccgccagcuc

SEQ ID NO: 4044529 - RNA, 20 nt, Molluscum contagiosum virus
ucagcggcggccccugccuu

SEQ ID NO: 4044530 - RNA, 14 nt, Molluscum contagiosum virus
ucagcuucauggag

SEQ ID NO: 4044531 - RNA, 20 nt, Molluscum contagiosum virus
ucaggaacaaggccaaagcc

SEQ ID NO: 4044532 - RNA, 23 nt, Molluscum contagiosum virus
ucaggacgcaggacgcggucgcg

SEQ ID NO: 4044533 - RNA, 14 nt, Molluscum contagiosum virus
ucaggccagcaucu

SEQ ID NO: 4044534 - RNA, 17 nt, Molluscum contagiosum virus
ucagggcuucuggcaaa

SEQ ID NO: 4044535 - RNA, 19 nt, Molluscum contagiosum virus
ucaguacaugcccggccuc

SEQ ID NO: 4044536 - RNA, 15 nt, Molluscum contagiosum virus
ucauacuccugcugg

SEQ ID NO: 4044537 - RNA, 14 nt, Molluscum contagiosum virus
ucaucgccagcauc

SEQ ID NO: 4044538 - RNA, 15 nt, Molluscum contagiosum virus
ucaucuucgugcuga

SEQ ID NO: 4044539 - RNA, 13 nt, Molluscum contagiosum virus
ucaugcugcucau

SEQ ID NO: 4044540 - RNA, 14 nt, Molluscum contagiosum virus
ucauucgcuggugc

SEQ ID NO: 4044541 - RNA, 17 nt, Molluscum contagiosum virus
uccaagaacgagaagag

SEQ ID NO: 4044542 - RNA, 22 nt, Molluscum contagiosum virus
uccacgaugaacggcuccuuga

SEQ ID NO: 4044543 - RNA, 14 nt, Molluscum contagiosum virus
uccacgcgugcgcg

SEQ ID NO: 4044544 - RNA, 19 nt, Molluscum contagiosum virus
uccacggguaccgugcgcg

SEQ ID NO: 4044545 - RNA, 12 nt, Molluscum contagiosum virus
uccagcagcgcc

SEQ ID NO: 4044546 - RNA, 20 nt, Molluscum contagiosum virus
uccagccgcagccgcgcuag

SEQ ID NO: 4044547 - RNA, 22 nt, Molluscum contagiosum virus
uccagcguuuccucuggcucca

SEQ ID NO: 4044548 - RNA, 21 nt, Molluscum contagiosum virus
uccaggaacgccgccacgccg

SEQ ID NO: 4044549 - RNA, 13 nt, Molluscum contagiosum virus
uccaggcgccgca

SEQ ID NO: 4044550 - RNA, 15 nt, Molluscum contagiosum virus
uccagguccuccagc

SEQ ID NO: 4044551 - RNA, 16 nt, Molluscum contagiosum virus
uccaggugcugggcga

SEQ ID NO: 4044552 - RNA, 21 nt, Molluscum contagiosum virus
uccaguaagcgacaggucagg

SEQ ID NO: 4044553 - RNA, 13 nt, Molluscum contagiosum virus
uccaguggcgccc

SEQ ID NO: 4044554 - RNA, 15 nt, Molluscum contagiosum virus
uccaugagcaucucc

SEQ ID NO: 4044555 - RNA, 22 nt, Molluscum contagiosum virus
uccauugcauggacauccucac

SEQ ID NO: 4044556 - RNA, 23 nt, Molluscum contagiosum virus
ucccaagcaaagccucucucgug

SEQ ID NO: 4044557 - RNA, 15 nt, Molluscum contagiosum virus
ucccacguacgagca

SEQ ID NO: 4044558 - RNA, 11 nt, Molluscum contagiosum virus
ucccagcaccg

SEQ ID NO: 4044559 - RNA, 19 nt, Molluscum contagiosum virus
uccccguccuugcucuggc

SEQ ID NO: 4044560 - RNA, 12 nt, Molluscum contagiosum virus
gugcgccuucgu

SEQ ID NO: 4044561 - RNA, 16 nt, Molluscum contagiosum virus
gugcgccuuuccucuc

SEQ ID NO: 4044562 - RNA, 22 nt, Molluscum contagiosum virus
gugcgcgcugcacgccgccagc

SEQ ID NO: 4044563 - RNA, 14 nt, Molluscum contagiosum virus
gugcgcuacguggc

SEQ ID NO: 4044564 - RNA, 18 nt, Molluscum contagiosum virus
gugcgguacaugcugucc

SEQ ID NO: 4044565 - RNA, 19 nt, Molluscum contagiosum virus
gugcgucgacguggagccu

SEQ ID NO: 4044566 - RNA, 19 nt, Molluscum contagiosum virus
gugcgugcccaagugcgcg

SEQ ID NO: 4044567 - RNA, 21 nt, Molluscum contagiosum virus
gugcgugcccaagugcgcgug

SEQ ID NO: 4044568 - RNA, 14 nt, Molluscum contagiosum virus
gugcgugcccagca

SEQ ID NO: 4044569 - RNA, 20 nt, Molluscum contagiosum virus
gugcgugguguccacgcgcg

SEQ ID NO: 4044570 - RNA, 22 nt, Molluscum contagiosum virus
gugcucggugucgguaccugca

SEQ ID NO: 4044571 - RNA, 16 nt, Molluscum contagiosum virus
gugcucguguguccgc

SEQ ID NO: 4044572 - RNA, 15 nt, Molluscum contagiosum virus
gugcucugugcgcgc

SEQ ID NO: 4044573 - RNA, 21 nt, Molluscum contagiosum virus
gugcucugugcgcgcagacgu

SEQ ID NO: 4044574 - RNA, 23 nt, Molluscum contagiosum virus
gugcucuuggcguucgcagugcc

SEQ ID NO: 4044575 - RNA, 14 nt, Molluscum contagiosum virus
gugcugagccacaa

SEQ ID NO: 4044576 - RNA, 22 nt, Molluscum contagiosum virus
gugcugcgucacaagcaccgcc

SEQ ID NO: 4044577 - RNA, 17 nt, Molluscum contagiosum virus
gugcuggagcagacgua

SEQ ID NO: 4044578 - RNA, 22 nt, Molluscum contagiosum virus
gugcuggagggcacgcugcaca

SEQ ID NO: 4044579 - RNA, 19 nt, Molluscum contagiosum virus
gugcuggcggggcuggcag

SEQ ID NO: 4044580 - RNA, 20 nt, Molluscum contagiosum virus
gugcuggucaagaaggcgcu

SEQ ID NO: 4044581 - RNA, 21 nt, Molluscum contagiosum virus
gugcuugcgcacggaccucaa

SEQ ID NO: 4044582 - RNA, 22 nt, Molluscum contagiosum virus
gugcuugcuucggcggcugugc

SEQ ID NO: 4044583 - RNA, 14 nt, Molluscum contagiosum virus
guggaccuuggcgc

SEQ ID NO: 4044584 - RNA, 19 nt, Molluscum contagiosum virus
guggaccuuggcgcgccgc

SEQ ID NO: 4044585 - RNA, 20 nt, Molluscum contagiosum virus
guggacgcgcaagugugcgc

SEQ ID NO: 4044586 - RNA, 21 nt, Molluscum contagiosum virus
guggacgcgcgagugugugca

SEQ ID NO: 4044587 - RNA, 15 nt, Molluscum contagiosum virus
guggaggugcgcgac

SEQ ID NO: 4044588 - RNA, 18 nt, Molluscum contagiosum virus
guggaggugcgcgacucc

SEQ ID NO: 4044589 - RNA, 14 nt, Molluscum contagiosum virus
guggaucgcgcgca

SEQ ID NO: 4044590 - RNA, 19 nt, Molluscum contagiosum virus
guggcaaaccacgagcgug

SEQ ID NO: 4044591 - RNA, 13 nt, Molluscum contagiosum virus
guggccagcgcgc

SEQ ID NO: 4044592 - RNA, 23 nt, Molluscum contagiosum virus
guggccgcgcgcgcacgcaagcc

SEQ ID NO: 4044593 - RNA, 16 nt, Molluscum contagiosum virus
guggccuacguggcgu

SEQ ID NO: 4044594 - RNA, 19 nt, Molluscum contagiosum virus
guggcgccgaugcagugcg

SEQ ID NO: 4044595 - RNA, 17 nt, Molluscum contagiosum virus
guggcgccgcugcugga

SEQ ID NO: 4044596 - RNA, 15 nt, Molluscum contagiosum virus
guggcgccugcgcgc

SEQ ID NO: 4044597 - RNA, 13 nt, Molluscum contagiosum virus
guggcgcugcugc

SEQ ID NO: 4044598 - RNA, 13 nt, Molluscum contagiosum virus
guggcgcugugcg

SEQ ID NO: 4044599 - RNA, 22 nt, Molluscum contagiosum virus
guggcgcuuggcgagcgcugcc

SEQ ID NO: 4044600 - RNA, 16 nt, Molluscum contagiosum virus
guggcuugcgggacag

SEQ ID NO: 4044601 - RNA, 15 nt, Molluscum contagiosum virus
guggcuugcugcagu

SEQ ID NO: 4044602 - RNA, 14 nt, Molluscum contagiosum virus
gugggcaccugcau

SEQ ID NO: 4044603 - RNA, 18 nt, Molluscum contagiosum virus
gugggcagccgccuggcc

SEQ ID NO: 4044604 - RNA, 14 nt, Molluscum contagiosum virus
gugggccgcggcgc

SEQ ID NO: 4044605 - RNA, 23 nt, Molluscum contagiosum virus
gugggugaggagcucgacucgag

SEQ ID NO: 4044606 - RNA, 15 nt, Molluscum contagiosum virus
gugguccaccagcac

SEQ ID NO: 4044607 - RNA, 18 nt, Molluscum contagiosum virus
guggucgccuacgaggug

SEQ ID NO: 4044608 - RNA, 23 nt, Molluscum contagiosum virus
guguaguuaaaugacggagccgc

SEQ ID NO: 4044609 - RNA, 19 nt, Molluscum contagiosum virus
guguaugcucgucgccggg

SEQ ID NO: 4044610 - RNA, 20 nt, Molluscum contagiosum virus
gugucagccccgggcccgca

SEQ ID NO: 4044611 - RNA, 14 nt, Molluscum contagiosum virus
guguccgcacgcac

SEQ ID NO: 4044612 - RNA, 17 nt, Molluscum contagiosum virus
guguucggggccgcgag

SEQ ID NO: 4044613 - RNA, 14 nt, Molluscum contagiosum virus
guguugcugaugcc

SEQ ID NO: 4044614 - RNA, 22 nt, Molluscum contagiosum virus
guguuuuaauuuuccaaccugu

SEQ ID NO: 4044615 - RNA, 15 nt, Molluscum contagiosum virus
guguuuugugccugc

SEQ ID NO: 4044616 - RNA, 21 nt, Molluscum contagiosum virus
guuaaaaaugagaauaaaaua

SEQ ID NO: 4044617 - RNA, 22 nt, Molluscum contagiosum virus
guuccacgaccgcaagugcacg

SEQ ID NO: 4044618 - RNA, 15 nt, Molluscum contagiosum virus
guucccauguaggag

SEQ ID NO: 4044619 - RNA, 20 nt, Molluscum contagiosum virus
guucccggugcugcugccaa

SEQ ID NO: 4044620 - RNA, 15 nt, Molluscum contagiosum virus
guucgcagugcccgg

SEQ ID NO: 4044621 - RNA, 13 nt, Molluscum contagiosum virus
guucgcgcgccag

SEQ ID NO: 4044622 - RNA, 16 nt, Molluscum contagiosum virus
guucgcgcgugcugga

SEQ ID NO: 4044623 - RNA, 14 nt, Molluscum contagiosum virus
guucuagcagcgug

SEQ ID NO: 4044624 - RNA, 21 nt, Molluscum contagiosum virus
guucugcacagcacaggcccc

SEQ ID NO: 4044625 - RNA, 15 nt, Molluscum contagiosum virus
guucuggacgugucc

SEQ ID NO: 4044626 - RNA, 19 nt, Molluscum contagiosum virus
guugacgagcgcgugcccg

SEQ ID NO: 4044627 - RNA, 23 nt, Molluscum contagiosum virus
guugccaguagcgaaugcagugc

SEQ ID NO: 4044628 - RNA, 23 nt, Molluscum contagiosum virus
guugccgcccgccgaguaccgcg

SEQ ID NO: 4044629 - RNA, 14 nt, Molluscum contagiosum virus
guugccggagcuga

SEQ ID NO: 4044630 - RNA, 13 nt, Molluscum contagiosum virus
guugccuggaggg

SEQ ID NO: 4044631 - RNA, 14 nt, Molluscum contagiosum virus
guugcgagccagcc

SEQ ID NO: 4044632 - RNA, 16 nt, Molluscum contagiosum virus
guugcgcaugcgcaag

SEQ ID NO: 4044633 - RNA, 12 nt, Molluscum contagiosum virus
guugcugcugcc

SEQ ID NO: 4044634 - RNA, 13 nt, Molluscum contagiosum virus
guugcugcugccg

SEQ ID NO: 4044635 - RNA, 16 nt, Molluscum contagiosum virus
guuggcccgcaaacac

SEQ ID NO: 4044636 - RNA, 16 nt, Molluscum contagiosum virus
guuggcgugcucgcuc

SEQ ID NO: 4044637 - RNA, 20 nt, Molluscum contagiosum virus
guuggcuuucugugcgcgac

SEQ ID NO: 4044638 - RNA, 23 nt, Molluscum contagiosum virus
guuggggcggcggggcugcuggc

SEQ ID NO: 4044639 - RNA, 14 nt, Molluscum contagiosum virus
guuuccgcgccucc

SEQ ID NO: 4044640 - RNA, 23 nt, Molluscum contagiosum virus
guuuccguguccgguacugcugc

SEQ ID NO: 4044641 - RNA, 16 nt, Molluscum contagiosum virus
guuucgcaugcacagc

SEQ ID NO: 4044642 - RNA, 17 nt, Molluscum contagiosum virus
guuuguggcgacacgga

SEQ ID NO: 4044643 - RNA, 19 nt, Molluscum contagiosum virus
guuuucacgcaaggaagca

SEQ ID NO: 4044644 - RNA, 20 nt, Molluscum contagiosum virus
uaaagaccgugucuggugua

SEQ ID NO: 4044645 - RNA, 21 nt, Molluscum contagiosum virus
uaaaguacgagagcgcaugcc

SEQ ID NO: 4044646 - RNA, 16 nt, Molluscum contagiosum virus
uaacaaggaaaaggca

SEQ ID NO: 4044647 - RNA, 12 nt, Molluscum contagiosum virus
uaaccaugaaga

SEQ ID NO: 4044648 - RNA, 16 nt, Molluscum contagiosum virus
uaaugaagcgcugugc

SEQ ID NO: 4044649 - RNA, 15 nt, Molluscum contagiosum virus
uaaugacgcgcacgc

SEQ ID NO: 4044650 - RNA, 23 nt, Molluscum contagiosum virus
uacaacucgguggugcgccugca

SEQ ID NO: 4044651 - RNA, 14 nt, Molluscum contagiosum virus
uacacgcagagcca

SEQ ID NO: 4044652 - RNA, 16 nt, Molluscum contagiosum virus
uacacgcagagccagc

SEQ ID NO: 4044653 - RNA, 14 nt, Molluscum contagiosum virus
uacaucgacaagca

SEQ ID NO: 4044654 - RNA, 23 nt, Molluscum contagiosum virus
uacauggacgugcugcuggcccu

SEQ ID NO: 4044655 - RNA, 21 nt, Molluscum contagiosum virus
uaccaagaacagagaaaggca

SEQ ID NO: 4044656 - RNA, 22 nt, Molluscum contagiosum virus
uaccagaggguggcuugcugca

SEQ ID NO: 4044657 - RNA, 13 nt, Molluscum contagiosum virus
uaccagcucgcgc

SEQ ID NO: 4044658 - RNA, 17 nt, Molluscum contagiosum virus
uacccuuggcagcaacu

SEQ ID NO: 4044659 - RNA, 20 nt, Molluscum contagiosum virus
uaccgcaaccagcugcuguc

SEQ ID NO: 4044660 - RNA, 18 nt, Molluscum contagiosum virus
uaccgcgacggcgugcug

SEQ ID NO: 4044661 - RNA, 17 nt, Molluscum contagiosum virus
uaccgcgcgcgcaagcg

SEQ ID NO: 4044662 - RNA, 16 nt, Molluscum contagiosum virus
uaccggagacaccagc

SEQ ID NO: 4044663 - RNA, 14 nt, Molluscum contagiosum virus
gcugcgcuaccacg

SEQ ID NO: 4044664 - RNA, 14 nt, Molluscum contagiosum virus
gcugcgcugcaacc

SEQ ID NO: 4044665 - RNA, 20 nt, Molluscum contagiosum virus
gcugcgcuucgccgcgcgcg

SEQ ID NO: 4044666 - RNA, 20 nt, Molluscum contagiosum virus
gcugcuacaagcggugcagc

SEQ ID NO: 4044667 - RNA, 19 nt, Molluscum contagiosum virus
gcugcuccccgccagcacc

SEQ ID NO: 4044668 - RNA, 23 nt, Molluscum contagiosum virus
gcugcucccucucgaggaauuug

SEQ ID NO: 4044669 - RNA, 22 nt, Molluscum contagiosum virus
gcugcucgcugccuggugcaca

SEQ ID NO: 4044670 - RNA, 15 nt, Molluscum contagiosum virus
gcugcucgcuugccc

SEQ ID NO: 4044671 - RNA, 19 nt, Molluscum contagiosum virus
gcugcucgugcugcucugc

SEQ ID NO: 4044672 - RNA, 15 nt, Molluscum contagiosum virus
gcugcugcacagcuu

SEQ ID NO: 4044673 - RNA, 15 nt, Molluscum contagiosum virus
gcugcugcucgcacc

SEQ ID NO: 4044674 - RNA, 20 nt, Molluscum contagiosum virus
gcugcuggaacaggugcgca

SEQ ID NO: 4044675 - RNA, 13 nt, Molluscum contagiosum virus
gcugcuggagcua

SEQ ID NO: 4044676 - RNA, 19 nt, Molluscum contagiosum virus
gcugcuguuucugugucac

SEQ ID NO: 4044677 - RNA, 22 nt, Molluscum contagiosum virus
gcuggaccccgagcugcggcgc

SEQ ID NO: 4044678 - RNA, 14 nt, Molluscum contagiosum virus
gcuggacgggcacg

SEQ ID NO: 4044679 - RNA, 18 nt, Molluscum contagiosum virus
gcuggacgggcacgagca

SEQ ID NO: 4044680 - RNA, 19 nt, Molluscum contagiosum virus
gcuggagaaagaagugugc

SEQ ID NO: 4044681 - RNA, 12 nt, Molluscum contagiosum virus
gcuggagcagac

SEQ ID NO: 4044682 - RNA, 16 nt, Molluscum contagiosum virus
gcuggaugcugcucga

SEQ ID NO: 4044683 - RNA, 14 nt, Molluscum contagiosum virus
gcuggccgugcccg

SEQ ID NO: 4044684 - RNA, 17 nt, Molluscum contagiosum virus
gcuggccgugcccgccg

SEQ ID NO: 4044685 - RNA, 14 nt, Molluscum contagiosum virus
gcuggccucugcca

SEQ ID NO: 4044686 - RNA, 15 nt, Molluscum contagiosum virus
gcuggcgcccgcgga

SEQ ID NO: 4044687 - RNA, 15 nt, Molluscum contagiosum virus
gcuggcgcgcgcgca

SEQ ID NO: 4044688 - RNA, 17 nt, Molluscum contagiosum virus
gcuggcgcucgcgcgca

SEQ ID NO: 4044689 - RNA, 17 nt, Molluscum contagiosum virus
gcuggcgcucggcgugg

SEQ ID NO: 4044690 - RNA, 20 nt, Molluscum contagiosum virus
gcuggcgcucggcguggugc

SEQ ID NO: 4044691 - RNA, 17 nt, Molluscum contagiosum virus
gcuggcggcgcacgcga

SEQ ID NO: 4044692 - RNA, 13 nt, Molluscum contagiosum virus
gcuggcggggaaa

SEQ ID NO: 4044693 - RNA, 16 nt, Molluscum contagiosum virus
gcuggcgggugccgug

SEQ ID NO: 4044694 - RNA, 15 nt, Molluscum contagiosum virus
gcuggcugggcacuc

SEQ ID NO: 4044695 - RNA, 21 nt, Molluscum contagiosum virus
gcugggaaagggcugcuugcg

SEQ ID NO: 4044696 - RNA, 18 nt, Molluscum contagiosum virus
gcugggcgugggcagccg

SEQ ID NO: 4044697 - RNA, 18 nt, Molluscum contagiosum virus
gcuggggccugugcugug

SEQ ID NO: 4044698 - RNA, 14 nt, Molluscum contagiosum virus
gcugucaacagugc

SEQ ID NO: 4044699 - RNA, 17 nt, Molluscum contagiosum virus
gcugugagcgcgccgcu

SEQ ID NO: 4044700 - RNA, 21 nt, Molluscum contagiosum virus
gcugugcgcuacguggcgcga

SEQ ID NO: 4044701 - RNA, 20 nt, Molluscum contagiosum virus
gcuguucaacaucguggcgc

SEQ ID NO: 4044702 - RNA, 18 nt, Molluscum contagiosum virus
gcuuccgcgagucugcca

SEQ ID NO: 4044703 - RNA, 19 nt, Molluscum contagiosum virus
gcuuccgcgagucugccag

SEQ ID NO: 4044704 - RNA, 23 nt, Molluscum contagiosum virus
gcuuccggcaccacgugcgcugg

SEQ ID NO: 4044705 - RNA, 20 nt, Molluscum contagiosum virus
gcuucgcuggcggggacagc

SEQ ID NO: 4044706 - RNA, 19 nt, Molluscum contagiosum virus
gcuucgucuucaccugcau

SEQ ID NO: 4044707 - RNA, 21 nt, Molluscum contagiosum virus
gcuucucgaacuccaggcgca

SEQ ID NO: 4044708 - RNA, 18 nt, Molluscum contagiosum virus
gcuucucgccagaaguca

SEQ ID NO: 4044709 - RNA, 22 nt, Molluscum contagiosum virus
gcuucucuucaugaaauacuuc

SEQ ID NO: 4044710 - RNA, 22 nt, Molluscum contagiosum virus
gcuugaaggacgcguucuccag

SEQ ID NO: 4044711 - RNA, 14 nt, Molluscum contagiosum virus
gcuugagcagcaaa

SEQ ID NO: 4044712 - RNA, 17 nt, Molluscum contagiosum virus
gcuugccgcuugagcag

SEQ ID NO: 4044713 - RNA, 15 nt, Molluscum contagiosum virus
gcuugcucagcagcu

SEQ ID NO: 4044714 - RNA, 11 nt, Molluscum contagiosum virus
gcuugcugcug

SEQ ID NO: 4044715 - RNA, 16 nt, Molluscum contagiosum virus
gcuugcuuccggugcc

SEQ ID NO: 4044716 - RNA, 16 nt, Molluscum contagiosum virus
gcuuggccauggugga

SEQ ID NO: 4044717 - RNA, 18 nt, Molluscum contagiosum virus
gcuuggugcgcucgagcu

SEQ ID NO: 4044718 - RNA, 23 nt, Molluscum contagiosum virus
gcuuguucaccaccaccagcacg

SEQ ID NO: 4044719 - RNA, 15 nt, Molluscum contagiosum virus
gcuuuaguccaugcc

SEQ ID NO: 4044720 - RNA, 23 nt, Molluscum contagiosum virus
gcuuucagagugacgcugcaaga

SEQ ID NO: 4044721 - RNA, 15 nt, Molluscum contagiosum virus
gcuuucucacgcgcu

SEQ ID NO: 4044722 - RNA, 19 nt, Molluscum contagiosum virus
gcuuugugcgucucccagg

SEQ ID NO: 4044723 - RNA, 20 nt, Molluscum contagiosum virus
gcuuuuugccgcucacagcu

SEQ ID NO: 4044724 - RNA, 22 nt, Molluscum contagiosum virus
gcuuuuugccgcucacagcuuc

SEQ ID NO: 4044725 - RNA, 23 nt, Molluscum contagiosum virus
ggaaaacuguaggggagggcggc

SEQ ID NO: 4044726 - RNA, 12 nt, Molluscum contagiosum virus
ggaaaaggcaca

SEQ ID NO: 4044727 - RNA, 19 nt, Molluscum contagiosum virus
ggaaacacucgauggcgag

SEQ ID NO: 4044728 - RNA, 20 nt, Molluscum contagiosum virus
ggaaaggcacccaccaggaa

SEQ ID NO: 4044729 - RNA, 14 nt, Molluscum contagiosum virus
ggaacaaugcugca

SEQ ID NO: 4044730 - RNA, 19 nt, Molluscum contagiosum virus
ggaaccguggugcgcgacc

SEQ ID NO: 4044731 - RNA, 22 nt, Molluscum contagiosum virus
ggaacgaggaaaggcacacccc

SEQ ID NO: 4044732 - RNA, 15 nt, Molluscum contagiosum virus
ggaacugacugcugc

SEQ ID NO: 4044733 - RNA, 19 nt, Molluscum contagiosum virus
ggaagagcguccgcggugc

SEQ ID NO: 4044734 - RNA, 16 nt, Molluscum contagiosum virus
ggaagcugcacgugca

SEQ ID NO: 4044735 - RNA, 22 nt, Molluscum contagiosum virus
ggaagcuggcgcgguccagccg

SEQ ID NO: 4044736 - RNA, 13 nt, Molluscum contagiosum virus
ggaaggagcuggg

SEQ ID NO: 4044737 - RNA, 21 nt, Molluscum contagiosum virus
ggaagucggcguggccaggcc

SEQ ID NO: 4044738 - RNA, 18 nt, Molluscum contagiosum virus
ggaagugcgagccgugac

SEQ ID NO: 4044739 - RNA, 17 nt, Molluscum contagiosum virus
ggacaaagucgcgcgcg

SEQ ID NO: 4044740 - RNA, 16 nt, Molluscum contagiosum virus
ggacaagucacugcua

SEQ ID NO: 4044741 - RNA, 13 nt, Molluscum contagiosum virus
ggacaccgcgggc

SEQ ID NO: 4044742 - RNA, 13 nt, Molluscum contagiosum virus
ggacacgcgcacg

SEQ ID NO: 4044743 - RNA, 16 nt, Molluscum contagiosum virus
ggacacgggugagcuc

SEQ ID NO: 4044744 - RNA, 20 nt, Molluscum contagiosum virus
ggacacgggugagcucgcca

SEQ ID NO: 4044745 - RNA, 18 nt, Molluscum contagiosum virus
ggacacguugcagcagca

SEQ ID NO: 4044746 - RNA, 21 nt, Molluscum contagiosum virus
ggacacguugcagcagcacag

SEQ ID NO: 4044747 - RNA, 14 nt, Molluscum contagiosum virus
ggacacucgcggca

SEQ ID NO: 4044748 - RNA, 15 nt, Molluscum contagiosum virus
ggacacuggagguga

SEQ ID NO: 4044749 - RNA, 22 nt, Molluscum contagiosum virus
ggacagcaugaacucgcugcug

SEQ ID NO: 4044750 - RNA, 13 nt, Molluscum contagiosum virus
ggaccccgagcug

SEQ ID NO: 4044751 - RNA, 16 nt, Molluscum contagiosum virus
ggaccucaaggaggcg

SEQ ID NO: 4044752 - RNA, 18 nt, Molluscum contagiosum virus
ggaccucaaggaggcgug

SEQ ID NO: 4044753 - RNA, 14 nt, Molluscum contagiosum virus
ggaccucgcgcgcc

SEQ ID NO: 4044754 - RNA, 17 nt, Molluscum contagiosum virus
ggaccugcgccagcgcc

SEQ ID NO: 4044755 - RNA, 21 nt, Molluscum contagiosum virus
ggacgagcugcuucgcgacca

SEQ ID NO: 4044756 - RNA, 12 nt, Molluscum contagiosum virus
ggacgcacuaga

SEQ ID NO: 4044757 - RNA, 21 nt, Molluscum contagiosum virus
ggacgcggaauuggcgucagg

SEQ ID NO: 4044758 - RNA, 22 nt, Molluscum contagiosum virus
ggacgcgugcaagcccagcagc

SEQ ID NO: 4044759 - RNA, 15 nt, Molluscum contagiosum virus
ggacggcgcgcagcg

SEQ ID NO: 4044760 - RNA, 20 nt, Molluscum contagiosum virus
ggacggcgcgcagcgcguga

SEQ ID NO: 4044761 - RNA, 18 nt, Molluscum contagiosum virus
ggacgucgcggccacgca

SEQ ID NO: 4044762 - RNA, 13 nt, Molluscum contagiosum virus
gcgcauccucucc

SEQ ID NO: 4044763 - RNA, 14 nt, Molluscum contagiosum virus
gcgcaucugcgagc

SEQ ID NO: 4044764 - RNA, 15 nt, Molluscum contagiosum virus
gcgcaugacagccau

SEQ ID NO: 4044765 - RNA, 12 nt, Molluscum contagiosum virus
gcgcauggagag

SEQ ID NO: 4044766 - RNA, 13 nt, Molluscum contagiosum virus
gcgcauggccacg

SEQ ID NO: 4044767 - RNA, 16 nt, Molluscum contagiosum virus
gcgcauggccacgccc

SEQ ID NO: 4044768 - RNA, 23 nt, Molluscum contagiosum virus
gcgcauucccguggaccucauca

SEQ ID NO: 4044769 - RNA, 14 nt, Molluscum contagiosum virus
gcgcauucgcgcgc

SEQ ID NO: 4044770 - RNA, 16 nt, Molluscum contagiosum virus
gcgcauuuaccggcgc

SEQ ID NO: 4044771 - RNA, 21 nt, Molluscum contagiosum virus
gcgccaagguggccaagcgcu

SEQ ID NO: 4044772 - RNA, 20 nt, Molluscum contagiosum virus
gcgccacgugcgcaucccug

SEQ ID NO: 4044773 - RNA, 18 nt, Molluscum contagiosum virus
gcgccagaacauugccac

SEQ ID NO: 4044774 - RNA, 15 nt, Molluscum contagiosum virus
gcgccagcaagcucg

SEQ ID NO: 4044775 - RNA, 15 nt, Molluscum contagiosum virus
gcgccagccugcugg

SEQ ID NO: 4044776 - RNA, 19 nt, Molluscum contagiosum virus
gcgccagggcggagccccg

SEQ ID NO: 4044777 - RNA, 13 nt, Molluscum contagiosum virus
gcgccauccacgu

SEQ ID NO: 4044778 - RNA, 22 nt, Molluscum contagiosum virus
gcgcccaccagcagccaggcua

SEQ ID NO: 4044779 - RNA, 14 nt, Molluscum contagiosum virus
gcgcccaggaacag

SEQ ID NO: 4044780 - RNA, 14 nt, Molluscum contagiosum virus
gcgcccccgcuugc

SEQ ID NO: 4044781 - RNA, 15 nt, Molluscum contagiosum virus
gcgcccgcagcgcgc

SEQ ID NO: 4044782 - RNA, 19 nt, Molluscum contagiosum virus
gcgcccgcguacacgugca

SEQ ID NO: 4044783 - RNA, 20 nt, Molluscum contagiosum virus
gcgcccgcugcgcgcucugg

SEQ ID NO: 4044784 - RNA, 17 nt, Molluscum contagiosum virus
gcgcccucgcgcgcagc

SEQ ID NO: 4044785 - RNA, 14 nt, Molluscum contagiosum virus
gcgcccuuccugga

SEQ ID NO: 4044786 - RNA, 23 nt, Molluscum contagiosum virus
gcgccgaaacacggccuccagca

SEQ ID NO: 4044787 - RNA, 18 nt, Molluscum contagiosum virus
gcgccgacagcgcgcgca

SEQ ID NO: 4044788 - RNA, 16 nt, Molluscum contagiosum virus
gcgccgacaugcgcac

SEQ ID NO: 4044789 - RNA, 15 nt, Molluscum contagiosum virus
gcgccgaugcagugc

SEQ ID NO: 4044790 - RNA, 16 nt, Molluscum contagiosum virus
gcgccgcaaaagcaag

SEQ ID NO: 4044791 - RNA, 14 nt, Molluscum contagiosum virus
gcgccgcacgugcu

SEQ ID NO: 4044792 - RNA, 17 nt, Molluscum contagiosum virus
gcgccgcacgugcugcg

SEQ ID NO: 4044793 - RNA, 13 nt, Molluscum contagiosum virus
gcgccgcagaaca

SEQ ID NO: 4044794 - RNA, 23 nt, Molluscum contagiosum virus
gcgccgcagaacacgggggcugc

SEQ ID NO: 4044795 - RNA, 16 nt, Molluscum contagiosum virus
gcgccgccgacgccuu

SEQ ID NO: 4044796 - RNA, 12 nt, Molluscum contagiosum virus
gcgccgccgcag

SEQ ID NO: 4044797 - RNA, 16 nt, Molluscum contagiosum virus
gcgccgccggugcgug

SEQ ID NO: 4044798 - RNA, 17 nt, Molluscum contagiosum virus
gcgccgccucgcgcgca

SEQ ID NO: 4044799 - RNA, 12 nt, Molluscum contagiosum virus
gcgccgcggcgg

SEQ ID NO: 4044800 - RNA, 23 nt, Molluscum contagiosum virus
gcgccgcggcgguugcccgccug

SEQ ID NO: 4044801 - RNA, 14 nt, Molluscum contagiosum virus
gcgccgcgggcaca

SEQ ID NO: 4044802 - RNA, 17 nt, Molluscum contagiosum virus
gcgccgcguacgcacgu

SEQ ID NO: 4044803 - RNA, 13 nt, Molluscum contagiosum virus
gcgccgcuaccag

SEQ ID NO: 4044804 - RNA, 13 nt, Molluscum contagiosum virus
gcgccgcugcgcc

SEQ ID NO: 4044805 - RNA, 19 nt, Molluscum contagiosum virus
gcgccggaaacggaccugg

SEQ ID NO: 4044806 - RNA, 14 nt, Molluscum contagiosum virus
gcgccggacuacua

SEQ ID NO: 4044807 - RNA, 19 nt, Molluscum contagiosum virus
gcgccggcacccgugcgcg

SEQ ID NO: 4044808 - RNA, 23 nt, Molluscum contagiosum virus
gcgccggcacccgugcgcgcgcu

SEQ ID NO: 4044809 - RNA, 17 nt, Molluscum contagiosum virus
gcgccggcugcgccacc

SEQ ID NO: 4044810 - RNA, 17 nt, Molluscum contagiosum virus
gcgccgggcgccagaac

SEQ ID NO: 4044811 - RNA, 14 nt, Molluscum contagiosum virus
gcgccgggcgcgcc

SEQ ID NO: 4044812 - RNA, 17 nt, Molluscum contagiosum virus
gcgccgggcgcgccaac

SEQ ID NO: 4044813 - RNA, 13 nt, Molluscum contagiosum virus
gcgccgugcugcg

SEQ ID NO: 4044814 - RNA, 17 nt, Molluscum contagiosum virus
gcgccgugcugcgucac

SEQ ID NO: 4044815 - RNA, 17 nt, Molluscum contagiosum virus
gcgccgugucggcaccg

SEQ ID NO: 4044816 - RNA, 21 nt, Molluscum contagiosum virus
gcgccugcacuacugcuccau

SEQ ID NO: 4044817 - RNA, 12 nt, Molluscum contagiosum virus
gcgccugcgcga

SEQ ID NO: 4044818 - RNA, 14 nt, Molluscum contagiosum virus
gcgccugcuugcgc

SEQ ID NO: 4044819 - RNA, 17 nt, Molluscum contagiosum virus
gcgccuuuccucucccg

SEQ ID NO: 4044820 - RNA, 17 nt, Molluscum contagiosum virus
gcgccuuugccacgcca

SEQ ID NO: 4044821 - RNA, 18 nt, Molluscum contagiosum virus
gcgcgaacucgcggcagu

SEQ ID NO: 4044822 - RNA, 14 nt, Molluscum contagiosum virus
gcgcgaagcaggcg

SEQ ID NO: 4044823 - RNA, 16 nt, Molluscum contagiosum virus
gcgcgaauuggccgcg

SEQ ID NO: 4044824 - RNA, 15 nt, Molluscum contagiosum virus
gcgcgaccgcaccga

SEQ ID NO: 4044825 - RNA, 16 nt, Molluscum contagiosum virus
gcgcgacgccaucagg

SEQ ID NO: 4044826 - RNA, 13 nt, Molluscum contagiosum virus
gcgcgacgucguc

SEQ ID NO: 4044827 - RNA, 19 nt, Molluscum contagiosum virus
gcgcgacgucgucaaggau

SEQ ID NO: 4044828 - RNA, 14 nt, Molluscum contagiosum virus
gcgcgacuacgcac

SEQ ID NO: 4044829 - RNA, 18 nt, Molluscum contagiosum virus
gcgcgacuggcacgcgcc

SEQ ID NO: 4044830 - RNA, 15 nt, Molluscum contagiosum virus
gcgcgagcccaccga

SEQ ID NO: 4044831 - RNA, 15 nt, Molluscum contagiosum virus
gcgcgagugccagcg

SEQ ID NO: 4044832 - RNA, 15 nt, Molluscum contagiosum virus
gcgcgagugugcgug

SEQ ID NO: 4044833 - RNA, 17 nt, Molluscum contagiosum virus
gcgcgauggcgccugcu

SEQ ID NO: 4044834 - RNA, 19 nt, Molluscum contagiosum virus
gcgcgcacaaacgcgcgca

SEQ ID NO: 4044835 - RNA, 17 nt, Molluscum contagiosum virus
gcgcgcagacguggugc

SEQ ID NO: 4044836 - RNA, 13 nt, Molluscum contagiosum virus
gcgcgcagcacac

SEQ ID NO: 4044837 - RNA, 14 nt, Molluscum contagiosum virus
gcgcgcaugcucgc

SEQ ID NO: 4044838 - RNA, 14 nt, Molluscum contagiosum virus
gcgcgccagcagcg

SEQ ID NO: 4044839 - RNA, 20 nt, Molluscum contagiosum virus
gcgcgcccccgagcugcgug

SEQ ID NO: 4044840 - RNA, 15 nt, Molluscum contagiosum virus
gcgcgcccggcgccc

SEQ ID NO: 4044841 - RNA, 14 nt, Molluscum contagiosum virus
gcgcgccgagcgca

SEQ ID NO: 4044842 - RNA, 15 nt, Molluscum contagiosum virus
gcgcgccgcgccgca

SEQ ID NO: 4044843 - RNA, 13 nt, Molluscum contagiosum virus
gcgcgccgcgcgc

SEQ ID NO: 4044844 - RNA, 15 nt, Molluscum contagiosum virus
gcgcgccgcucgucg

SEQ ID NO: 4044845 - RNA, 17 nt, Molluscum contagiosum virus
gcgcgccgcugcccgcg

SEQ ID NO: 4044846 - RNA, 15 nt, Molluscum contagiosum virus
gcgcgccggcccgag

SEQ ID NO: 4044847 - RNA, 14 nt, Molluscum contagiosum virus
gcgcgccgggccgc

SEQ ID NO: 4044848 - RNA, 21 nt, Molluscum contagiosum virus
gcgcgcgacuuuguccugagc

SEQ ID NO: 4044849 - RNA, 14 nt, Molluscum contagiosum virus
gcgcgcgagcacag

SEQ ID NO: 4044850 - RNA, 19 nt, Molluscum contagiosum virus
gcgcgcgagcacagcgcgc

SEQ ID NO: 4044851 - RNA, 12 nt, Molluscum contagiosum virus
gcgcgcgcacgc

SEQ ID NO: 4044852 - RNA, 14 nt, Molluscum contagiosum virus
gcgcgcgccagcag

SEQ ID NO: 4044853 - RNA, 13 nt, Molluscum contagiosum virus
gcgcgcgccagcu

SEQ ID NO: 4044854 - RNA, 18 nt, Molluscum contagiosum virus
gcgcgcgccugcucuccg

SEQ ID NO: 4044855 - RNA, 14 nt, Molluscum contagiosum virus
gcgcgcgcgcaagu

SEQ ID NO: 4044856 - RNA, 14 nt, Molluscum contagiosum virus
gaagcuccugcugg

SEQ ID NO: 4044857 - RNA, 12 nt, Molluscum contagiosum virus
gaagcugcacgu

SEQ ID NO: 4044858 - RNA, 18 nt, Molluscum contagiosum virus
gaagcuugcucagcagcu

SEQ ID NO: 4044859 - RNA, 21 nt, Molluscum contagiosum virus
gaaggagcccgucuacauuuu

SEQ ID NO: 4044860 - RNA, 22 nt, Molluscum contagiosum virus
gaaggaucccugcccgcgugag

SEQ ID NO: 4044861 - RNA, 22 nt, Molluscum contagiosum virus
gaaggcauaccagauguucucg

SEQ ID NO: 4044862 - RNA, 17 nt, Molluscum contagiosum virus
gaaggcauaccugugcc

SEQ ID NO: 4044863 - RNA, 14 nt, Molluscum contagiosum virus
gaaggccaccucgc

SEQ ID NO: 4044864 - RNA, 23 nt, Molluscum contagiosum virus
gaagggcgcggacgccuucuucc

SEQ ID NO: 4044865 - RNA, 23 nt, Molluscum contagiosum virus
gaagggcgggaagaaggugcuca

SEQ ID NO: 4044866 - RNA, 14 nt, Molluscum contagiosum virus
gaaggguguggccu

SEQ ID NO: 4044867 - RNA, 12 nt, Molluscum contagiosum virus
gaaggugcucag

SEQ ID NO: 4044868 - RNA, 23 nt, Molluscum contagiosum virus
gaaguacuucgcgaugugcaccu

SEQ ID NO: 4044869 - RNA, 19 nt, Molluscum contagiosum virus
gaagucguuaggcggcucc

SEQ ID NO: 4044870 - RNA, 12 nt, Molluscum contagiosum virus
gaaguugccgca

SEQ ID NO: 4044871 - RNA, 22 nt, Molluscum contagiosum virus
gaauaccggagacaccagcucc

SEQ ID NO: 4044872 - RNA, 23 nt, Molluscum contagiosum virus
gaauaccggagacaccagcuccg

SEQ ID NO: 4044873 - RNA, 18 nt, Molluscum contagiosum virus
gaauccuuuacugcaaga

SEQ ID NO: 4044874 - RNA, 23 nt, Molluscum contagiosum virus
gaaugacuuagccacugugcuga

SEQ ID NO: 4044875 - RNA, 23 nt, Molluscum contagiosum virus
gaauguagccuuuguucuuagca

SEQ ID NO: 4044876 - RNA, 24 nt, Molluscum contagiosum virus
gacaacucauagcgccacgagcag

SEQ ID NO: 4044877 - RNA, 19 nt, Molluscum contagiosum virus
gacaaggaaaggcacccac

SEQ ID NO: 4044878 - RNA, 20 nt, Molluscum contagiosum virus
gacaaggaaaggcacccacc

SEQ ID NO: 4044879 - RNA, 15 nt, Molluscum contagiosum virus
gacaaguacaugcac

SEQ ID NO: 4044880 - RNA, 17 nt, Molluscum contagiosum virus
gacaaucucugcgccgc

SEQ ID NO: 4044881 - RNA, 19 nt, Molluscum contagiosum virus
gacacaaggaucucugccc

SEQ ID NO: 4044882 - RNA, 19 nt, Molluscum contagiosum virus
gacacgagccgugugcucg

SEQ ID NO: 4044883 - RNA, 15 nt, Molluscum contagiosum virus
gacacgagggccuug

SEQ ID NO: 4044884 - RNA, 21 nt, Molluscum contagiosum virus
gacacgagggccuuggcggcg

SEQ ID NO: 4044885 - RNA, 18 nt, Molluscum contagiosum virus
gacacgcugcgcgugcug

SEQ ID NO: 4044886 - RNA, 20 nt, Molluscum contagiosum virus
gacacguuccagagcacugc

SEQ ID NO: 4044887 - RNA, 22 nt, Molluscum contagiosum virus
gacacucuucgcaggcgugcuc

SEQ ID NO: 4044888 - RNA, 15 nt, Molluscum contagiosum virus
gacacugugcuggcg

SEQ ID NO: 4044889 - RNA, 14 nt, Molluscum contagiosum virus
gacagagcccggga

SEQ ID NO: 4044890 - RNA, 17 nt, Molluscum contagiosum virus
gacagccugcaccgagu

SEQ ID NO: 4044891 - RNA, 13 nt, Molluscum contagiosum virus
gacagcgcgcgca

SEQ ID NO: 4044892 - RNA, 20 nt, Molluscum contagiosum virus
gacagcgugcgcgggcacgc

SEQ ID NO: 4044893 - RNA, 13 nt, Molluscum contagiosum virus
gacagcuugcugc

SEQ ID NO: 4044894 - RNA, 22 nt, Molluscum contagiosum virus
gacaucaucgcggagcugcgcg

SEQ ID NO: 4044895 - RNA, 14 nt, Molluscum contagiosum virus
gacaugcacacuca

SEQ ID NO: 4044896 - RNA, 22 nt, Molluscum contagiosum virus
gacauggaccgcgucaagauca

SEQ ID NO: 4044897 - RNA, 20 nt, Molluscum contagiosum virus
gacauggagcgcaucauguu

SEQ ID NO: 4044898 - RNA, 15 nt, Molluscum contagiosum virus
gaccaccagcaccag

SEQ ID NO: 4044899 - RNA, 16 nt, Molluscum contagiosum virus
gaccagauccgggcgc

SEQ ID NO: 4044900 - RNA, 12 nt, Molluscum contagiosum virus
gaccagcucuug

SEQ ID NO: 4044901 - RNA, 22 nt, Molluscum contagiosum virus
gaccagcugguccugaacagca

SEQ ID NO: 4044902 - RNA, 20 nt, Molluscum contagiosum virus
gacccagaagcgagagcgcg

SEQ ID NO: 4044903 - RNA, 18 nt, Molluscum contagiosum virus
gacccagcaaggcccacu

SEQ ID NO: 4044904 - RNA, 17 nt, Molluscum contagiosum virus
gacccaucggagaagug

SEQ ID NO: 4044905 - RNA, 22 nt, Molluscum contagiosum virus
gacccaucggagaagugcuccg

SEQ ID NO: 4044906 - RNA, 21 nt, Molluscum contagiosum virus
gaccgcaagugcacgcggcgc

SEQ ID NO: 4044907 - RNA, 15 nt, Molluscum contagiosum virus
gaccgcgcacgcagc

SEQ ID NO: 4044908 - RNA, 17 nt, Molluscum contagiosum virus
gaccgcuagagugcgcg

SEQ ID NO: 4044909 - RNA, 15 nt, Molluscum contagiosum virus
gaccgucaccgcagu

SEQ ID NO: 4044910 - RNA, 14 nt, Molluscum contagiosum virus
gaccgugcccugga

SEQ ID NO: 4044911 - RNA, 19 nt, Molluscum contagiosum virus
gaccuacgaggugcugcgc

SEQ ID NO: 4044912 - RNA, 16 nt, Molluscum contagiosum virus
gaccuacuccuggcca

SEQ ID NO: 4044913 - RNA, 19 nt, Molluscum contagiosum virus
gaccucgcugcugagcccu

SEQ ID NO: 4044914 - RNA, 22 nt, Molluscum contagiosum virus
gaccugcgccauccacgugggc

SEQ ID NO: 4044915 - RNA, 17 nt, Molluscum contagiosum virus
gaccugggcgucgugca

SEQ ID NO: 4044916 - RNA, 15 nt, Molluscum contagiosum virus
gacgacacagcccug

SEQ ID NO: 4044917 - RNA, 22 nt, Molluscum contagiosum virus
gacgacaugcacacgcaccgcc

SEQ ID NO: 4044918 - RNA, 13 nt, Molluscum contagiosum virus
gacgacggcacgc

SEQ ID NO: 4044919 - RNA, 18 nt, Molluscum contagiosum virus
gacgacggcugcucgcug

SEQ ID NO: 4044920 - RNA, 13 nt, Molluscum contagiosum virus
gacgacucgcugc

SEQ ID NO: 4044921 - RNA, 16 nt, Molluscum contagiosum virus
gacgagagggcgcgcg

SEQ ID NO: 4044922 - RNA, 13 nt, Molluscum contagiosum virus
gacgagcugugcg

SEQ ID NO: 4044923 - RNA, 12 nt, Molluscum contagiosum virus
gacgaggagcug

SEQ ID NO: 4044924 - RNA, 19 nt, Molluscum contagiosum virus
gacgaggccuacagcgcgc

SEQ ID NO: 4044925 - RNA, 14 nt, Molluscum contagiosum virus
gacgagugcgccgc

SEQ ID NO: 4044926 - RNA, 13 nt, Molluscum contagiosum virus
gacgauggccacg

SEQ ID NO: 4044927 - RNA, 17 nt, Molluscum contagiosum virus
gacgcaaaagaggccug

SEQ ID NO: 4044928 - RNA, 18 nt, Molluscum contagiosum virus
gacgcaggacgcggucgc

SEQ ID NO: 4044929 - RNA, 13 nt, Molluscum contagiosum virus
gacgccagcgcgc

SEQ ID NO: 4044930 - RNA, 19 nt, Molluscum contagiosum virus
gacgccauuuucgugcgcg

SEQ ID NO: 4044931 - RNA, 14 nt, Molluscum contagiosum virus
gacgcccggugccu

SEQ ID NO: 4044932 - RNA, 20 nt, Molluscum contagiosum virus
gacgcccuccucgaccugca

SEQ ID NO: 4044933 - RNA, 15 nt, Molluscum contagiosum virus
gacgccgagcccgag

SEQ ID NO: 4044934 - RNA, 16 nt, Molluscum contagiosum virus
gacgccgauguccugc

SEQ ID NO: 4044935 - RNA, 20 nt, Molluscum contagiosum virus
gacgccggggggcgccaagu

SEQ ID NO: 4044936 - RNA, 15 nt, Molluscum contagiosum virus
gacgccguccgcgca

SEQ ID NO: 4044937 - RNA, 16 nt, Molluscum contagiosum virus
gacgccguccgcgcag

SEQ ID NO: 4044938 - RNA, 15 nt, Molluscum contagiosum virus
gacgccuuccugcug

SEQ ID NO: 4044939 - RNA, 20 nt, Molluscum contagiosum virus
gacgccuuccugcuggcgcg

SEQ ID NO: 4044940 - RNA, 17 nt, Molluscum contagiosum virus
gacgcgaacugcccgag

SEQ ID NO: 4044941 - RNA, 18 nt, Molluscum contagiosum virus
gacgcgaauacgcgcucc

SEQ ID NO: 4044942 - RNA, 22 nt, Molluscum contagiosum virus
gacgcgaguugcgucucccgcg

SEQ ID NO: 4044943 - RNA, 17 nt, Molluscum contagiosum virus
gacgcgcaagugugcgc

SEQ ID NO: 4044944 - RNA, 18 nt, Molluscum contagiosum virus
gacgcgcacgcgggacgc

SEQ ID NO: 4044945 - RNA, 13 nt, Molluscum contagiosum virus
gacgcgcagcugu

SEQ ID NO: 4044946 - RNA, 15 nt, Molluscum contagiosum virus
gacgcgccucgagca

SEQ ID NO: 4044947 - RNA, 20 nt, Molluscum contagiosum virus
gacgcgccucgagcagguca

SEQ ID NO: 4044948 - RNA, 17 nt, Molluscum contagiosum virus
gacgcgcgagugugcgu

SEQ ID NO: 4044949 - RNA, 18 nt, Molluscum contagiosum virus
gacgcgcgagugugcgug

SEQ ID NO: 4044950 - RNA, 23 nt, Molluscum contagiosum virus
gacgcgcguucuuugugcggcuc

SEQ ID NO: 4044951 - RNA, 18 nt, Molluscum contagiosum virus
gacgcggaugccacgcag

SEQ ID NO: 4044952 - RNA, 14 nt, Molluscum contagiosum virus
gacgcggccgcgga

SEQ ID NO: 4044953 - RNA, 19 nt, Molluscum contagiosum virus
gacgcggucgcgcccuugc

SEQ ID NO: 4044954 - RNA, 14 nt, Molluscum contagiosum virus
cggauacgcgcaca

SEQ ID NO: 4044955 - RNA, 16 nt, Molluscum contagiosum virus
cggauauggcgcgccg

SEQ ID NO: 4044956 - RNA, 15 nt, Molluscum contagiosum virus
cggaucggcacugug

SEQ ID NO: 4044957 - RNA, 19 nt, Molluscum contagiosum virus
cggaugcagaacagcacgu

SEQ ID NO: 4044958 - RNA, 15 nt, Molluscum contagiosum virus
cggaugccacgcagc

SEQ ID NO: 4044959 - RNA, 16 nt, Molluscum contagiosum virus
cggaugccacgcagcu

SEQ ID NO: 4044960 - RNA, 18 nt, Molluscum contagiosum virus
cggcaaaugcgucccagc

SEQ ID NO: 4044961 - RNA, 17 nt, Molluscum contagiosum virus
cggcaacaacgucacgc

SEQ ID NO: 4044962 - RNA, 15 nt, Molluscum contagiosum virus
cggcaacacaaaugc

SEQ ID NO: 4044963 - RNA, 15 nt, Molluscum contagiosum virus
cggcaacgcugccgc

SEQ ID NO: 4044964 - RNA, 18 nt, Molluscum contagiosum virus
cggcaagccgugcuuugc

SEQ ID NO: 4044965 - RNA, 15 nt, Molluscum contagiosum virus
cggcaccacgugcgc

SEQ ID NO: 4044966 - RNA, 23 nt, Molluscum contagiosum virus
cggcaccacgugcgcuggcccac

SEQ ID NO: 4044967 - RNA, 14 nt, Molluscum contagiosum virus
cggcacccgugcgc

SEQ ID NO: 4044968 - RNA, 19 nt, Molluscum contagiosum virus
cggcacccgugcgcgcgcu

SEQ ID NO: 4044969 - RNA, 19 nt, Molluscum contagiosum virus
cggcaccguaccgcgcccg

SEQ ID NO: 4044970 - RNA, 23 nt, Molluscum contagiosum virus
cggcacgccgcucggcacugcug

SEQ ID NO: 4044971 - RNA, 14 nt, Molluscum contagiosum virus
cggcacgcugagca

SEQ ID NO: 4044972 - RNA, 17 nt, Molluscum contagiosum virus
cggcacgcugagcaagc

SEQ ID NO: 4044973 - RNA, 21 nt, Molluscum contagiosum virus
cggcacgugcguacgcggcgc

SEQ ID NO: 4044974 - RNA, 15 nt, Molluscum contagiosum virus
cggcacugcucacgg

SEQ ID NO: 4044975 - RNA, 15 nt, Molluscum contagiosum virus
cggcacugcuggcgc

SEQ ID NO: 4044976 - RNA, 18 nt, Molluscum contagiosum virus
cggcacuguguccccuga

SEQ ID NO: 4044977 - RNA, 22 nt, Molluscum contagiosum virus
cggcagacaacaccagcgugcc

SEQ ID NO: 4044978 - RNA, 16 nt, Molluscum contagiosum virus
cggcagacgccagcga

SEQ ID NO: 4044979 - RNA, 17 nt, Molluscum contagiosum virus
cggcagcgacuacgcgc

SEQ ID NO: 4044980 - RNA, 21 nt, Molluscum contagiosum virus
cggcagcgacuacgcgcugcu

SEQ ID NO: 4044981 - RNA, 17 nt, Molluscum contagiosum virus
cggcagcgccagcgaga

SEQ ID NO: 4044982 - RNA, 16 nt, Molluscum contagiosum virus
cggcagcgcgccuagc

SEQ ID NO: 4044983 - RNA, 19 nt, Molluscum contagiosum virus
cggcagcgucgcggagcgc

SEQ ID NO: 4044984 - RNA, 14 nt, Molluscum contagiosum virus
cggcagcuggagcu

SEQ ID NO: 4044985 - RNA, 17 nt, Molluscum contagiosum virus
cggcaguccgagcuguu

SEQ ID NO: 4044986 - RNA, 20 nt, Molluscum contagiosum virus
cggcaugcgcgcgcugccag

SEQ ID NO: 4044987 - RNA, 12 nt, Molluscum contagiosum virus
cggccagcaccg

SEQ ID NO: 4044988 - RNA, 14 nt, Molluscum contagiosum virus
cggccagcgugcag

SEQ ID NO: 4044989 - RNA, 15 nt, Molluscum contagiosum virus
cggccauggucacgc

SEQ ID NO: 4044990 - RNA, 17 nt, Molluscum contagiosum virus
cggcccgaaggccaccu

SEQ ID NO: 4044991 - RNA, 19 nt, Molluscum contagiosum virus
cggcccgcggacgcgcagc

SEQ ID NO: 4044992 - RNA, 13 nt, Molluscum contagiosum virus
cggcccgcggcgc

SEQ ID NO: 4044993 - RNA, 12 nt, Molluscum contagiosum virus
cggcccgcgggc

SEQ ID NO: 4044994 - RNA, 19 nt, Molluscum contagiosum virus
cggcccgcgggcugcaaga

SEQ ID NO: 4044995 - RNA, 14 nt, Molluscum contagiosum virus
cggccgccaccgcg

SEQ ID NO: 4044996 - RNA, 21 nt, Molluscum contagiosum virus
cggccgggaucggacgcagac

SEQ ID NO: 4044997 - RNA, 14 nt, Molluscum contagiosum virus
cggccgugcagagc

SEQ ID NO: 4044998 - RNA, 15 nt, Molluscum contagiosum virus
cggccgugcagagca

SEQ ID NO: 4044999 - RNA, 14 nt, Molluscum contagiosum virus
cggccguggcgugc

SEQ ID NO: 4045000 - RNA, 15 nt, Molluscum contagiosum virus
cggccuagagcuggc

SEQ ID NO: 4045001 - RNA, 17 nt, Molluscum contagiosum virus
cggccuagagcuggcac

SEQ ID NO: 4045002 - RNA, 16 nt, Molluscum contagiosum virus
cggccucgccuccggg

SEQ ID NO: 4045003 - RNA, 19 nt, Molluscum contagiosum virus
cggccuguucuuccagugg

SEQ ID NO: 4045004 - RNA, 16 nt, Molluscum contagiosum virus
cggcgacaacgacaga

SEQ ID NO: 4045005 - RNA, 21 nt, Molluscum contagiosum virus
cggcgagaugcgagcgcgucu

SEQ ID NO: 4045006 - RNA, 19 nt, Molluscum contagiosum virus
cggcgagcugccauggcag

SEQ ID NO: 4045007 - RNA, 19 nt, Molluscum contagiosum virus
cggcgauguacgcgugcag

SEQ ID NO: 4045008 - RNA, 20 nt, Molluscum contagiosum virus
cggcgcaacgagcagcccgu

SEQ ID NO: 4045009 - RNA, 15 nt, Molluscum contagiosum virus
cggcgccaccggcag

SEQ ID NO: 4045010 - RNA, 14 nt, Molluscum contagiosum virus
cggcgccacgagcg

SEQ ID NO: 4045011 - RNA, 23 nt, Molluscum contagiosum virus
cggcgcccgcgugcacccuccgc

SEQ ID NO: 4045012 - RNA, 15 nt, Molluscum contagiosum virus
cggcgcccgugagca

SEQ ID NO: 4045013 - RNA, 15 nt, Molluscum contagiosum virus
cggcgccgcgcaaga

SEQ ID NO: 4045014 - RNA, 22 nt, Molluscum contagiosum virus
cggcgccuguuuccgcucgcgc

SEQ ID NO: 4045015 - RNA, 14 nt, Molluscum contagiosum virus
cggcgcgaaaaguc

SEQ ID NO: 4045016 - RNA, 15 nt, Molluscum contagiosum virus
cggcgcgaagcaggc

SEQ ID NO: 4045017 - RNA, 15 nt, Molluscum contagiosum virus
cggcgcgcagcgcgu

SEQ ID NO: 4045018 - RNA, 13 nt, Molluscum contagiosum virus
cggcgcgcagcuc

SEQ ID NO: 4045019 - RNA, 14 nt, Molluscum contagiosum virus
cggcgcgcagcucg

SEQ ID NO: 4045020 - RNA, 18 nt, Molluscum contagiosum virus
cggcgcgcagcucgccgc

SEQ ID NO: 4045021 - RNA, 13 nt, Molluscum contagiosum virus
cggcgcgccgccc

SEQ ID NO: 4045022 - RNA, 19 nt, Molluscum contagiosum virus
cggcgcggccuggccacgc

SEQ ID NO: 4045023 - RNA, 14 nt, Molluscum contagiosum virus
cggcgcggcuagca

SEQ ID NO: 4045024 - RNA, 15 nt, Molluscum contagiosum virus
cggcgcgugagcgcc

SEQ ID NO: 4045025 - RNA, 22 nt, Molluscum contagiosum virus
cggcgcgugccagucgcgcgag

SEQ ID NO: 4045026 - RNA, 17 nt, Molluscum contagiosum virus
cggcgcgugcugagcua

SEQ ID NO: 4045027 - RNA, 19 nt, Molluscum contagiosum virus
cggcgcguuucggccugca

SEQ ID NO: 4045028 - RNA, 18 nt, Molluscum contagiosum virus
cggcgcguuuucgcggcc

SEQ ID NO: 4045029 - RNA, 16 nt, Molluscum contagiosum virus
cggcgcuagcgcccgu

SEQ ID NO: 4045030 - RNA, 14 nt, Molluscum contagiosum virus
cggcgcucgccccu

SEQ ID NO: 4045031 - RNA, 16 nt, Molluscum contagiosum virus
cggaagcuccugcugg

SEQ ID NO: 4045032 - RNA, 22 nt, Molluscum contagiosum virus
cggaagcuugcucagcagcuuc

SEQ ID NO: 4045033 - RNA, 18 nt, Molluscum contagiosum virus
cggaauuccuugugcaau

SEQ ID NO: 4045034 - RNA, 15 nt, Molluscum contagiosum virus
cggacaagacaacac

SEQ ID NO: 4045035 - RNA, 21 nt, Molluscum contagiosum virus
cggacacguugcagcagcaca

SEQ ID NO: 4045036 - RNA, 20 nt, Molluscum contagiosum virus
cggacagugccuccgcggac

SEQ ID NO: 4045037 - RNA, 14 nt, Molluscum contagiosum virus
cggacucgagcccc

SEQ ID NO: 4045038 - RNA, 16 nt, Molluscum contagiosum virus
cggacugggagcaccg

SEQ ID NO: 4045039 - RNA, 18 nt, Molluscum contagiosum virus
cggacuucucgcucacgc

SEQ ID NO: 4045040 - RNA, 16 nt, Molluscum contagiosum virus
cggagaagugcgcagc

SEQ ID NO: 4045041 - RNA, 14 nt, Molluscum contagiosum virus
cggagacaccagcu

SEQ ID NO: 4045042 - RNA, 17 nt, Molluscum contagiosum virus
cggagacaccagcuccg

SEQ ID NO: 4045043 - RNA, 17 nt, Molluscum contagiosum virus
cggagagccgccuuugc

SEQ ID NO: 4045044 - RNA, 18 nt, Molluscum contagiosum virus
cggagagcuccggcugcu

SEQ ID NO: 4045045 - RNA, 15 nt, Molluscum contagiosum virus
cggagaucaggcagc

SEQ ID NO: 4045046 - RNA, 14 nt, Molluscum contagiosum virus
cggagcagauucgg

SEQ ID NO: 4045047 - RNA, 22 nt, Molluscum contagiosum virus
cggagcucgccaaagcgcgccu

SEQ ID NO: 4045048 - RNA, 16 nt, Molluscum contagiosum virus
cggagcugcgcgcgcu

SEQ ID NO: 4045049 - RNA, 12 nt, Molluscum contagiosum virus
cggagcuggccg

SEQ ID NO: 4045050 - RNA, 18 nt, Molluscum contagiosum virus
cggaggcacgggcucgau

SEQ ID NO: 4045051 - RNA, 12 nt, Molluscum contagiosum virus
cggaggcagcgc

SEQ ID NO: 4045052 - RNA, 15 nt, Molluscum contagiosum virus
cggaguccgcgccca

SEQ ID NO: 4045053 - RNA, 22 nt, Molluscum contagiosum virus
cgggagaguggccgcuccagag

SEQ ID NO: 4045054 - RNA, 16 nt, Molluscum contagiosum virus
cgggagcucacggcug

SEQ ID NO: 4045055 - RNA, 18 nt, Molluscum contagiosum virus
cgggauacagcgcggaga

SEQ ID NO: 4045056 - RNA, 18 nt, Molluscum contagiosum virus
cgggaugcuggacgggca

SEQ ID NO: 4045057 - RNA, 23 nt, Molluscum contagiosum virus
cgggaugcuggacgggcacgagc

SEQ ID NO: 4045058 - RNA, 20 nt, Molluscum contagiosum virus
cgggauggucucgcugcugg

SEQ ID NO: 4045059 - RNA, 21 nt, Molluscum contagiosum virus
cgggauggucucgcugcuggg

SEQ ID NO: 4045060 - RNA, 22 nt, Molluscum contagiosum virus
cgggauuugccgguugcgcgug

SEQ ID NO: 4045061 - RNA, 14 nt, Molluscum contagiosum virus
cgggcacgcagcuc

SEQ ID NO: 4045062 - RNA, 19 nt, Molluscum contagiosum virus
cgggcacgccgcagcgcug

SEQ ID NO: 4045063 - RNA, 17 nt, Molluscum contagiosum virus
cgggcacgcgcgcgccu

SEQ ID NO: 4045064 - RNA, 22 nt, Molluscum contagiosum virus
cgggcacuucucgcgcgacacg

SEQ ID NO: 4045065 - RNA, 15 nt, Molluscum contagiosum virus
cgggcagacaggcuc

SEQ ID NO: 4045066 - RNA, 21 nt, Molluscum contagiosum virus
cgggcauguccuuggcggugc

SEQ ID NO: 4045067 - RNA, 23 nt, Molluscum contagiosum virus
cgggcccgacacguugcacugcg

SEQ ID NO: 4045068 - RNA, 16 nt, Molluscum contagiosum virus
cgggcccgagcagaag

SEQ ID NO: 4045069 - RNA, 19 nt, Molluscum contagiosum virus
cgggcccgcaugcagucac

SEQ ID NO: 4045070 - RNA, 17 nt, Molluscum contagiosum virus
cgggccuguccgcgggc

SEQ ID NO: 4045071 - RNA, 19 nt, Molluscum contagiosum virus
cgggcgaaagcgccgcgcg

SEQ ID NO: 4045072 - RNA, 13 nt, Molluscum contagiosum virus
cgggcgcaggccc

SEQ ID NO: 4045073 - RNA, 18 nt, Molluscum contagiosum virus
cgggcgccaacacgagcg

SEQ ID NO: 4045074 - RNA, 13 nt, Molluscum contagiosum virus
cgggcgccagcua

SEQ ID NO: 4045075 - RNA, 16 nt, Molluscum contagiosum virus
cgggcgccgcggcugc

SEQ ID NO: 4045076 - RNA, 13 nt, Molluscum contagiosum virus
cgggcgcugcacc

SEQ ID NO: 4045077 - RNA, 15 nt, Molluscum contagiosum virus
cgggcgcugcaccgc

SEQ ID NO: 4045078 - RNA, 15 nt, Molluscum contagiosum virus
cgggcgugcgcagca

SEQ ID NO: 4045079 - RNA, 23 nt, Molluscum contagiosum virus
cgggcguggggagcuggagcgag

SEQ ID NO: 4045080 - RNA, 13 nt, Molluscum contagiosum virus
cgggcucgggcag

SEQ ID NO: 4045081 - RNA, 16 nt, Molluscum contagiosum virus
cgggcugucgcccggc

SEQ ID NO: 4045082 - RNA, 21 nt, Molluscum contagiosum virus
cgggcuucgcugcgcaggugc

SEQ ID NO: 4045083 - RNA, 23 nt, Molluscum contagiosum virus
cgggcuugcucccucgcgcgcag

SEQ ID NO: 4045084 - RNA, 14 nt, Molluscum contagiosum virus
cggggaggagcucu

SEQ ID NO: 4045085 - RNA, 15 nt, Molluscum contagiosum virus
cggggcaggcagugc

SEQ ID NO: 4045086 - RNA, 23 nt, Molluscum contagiosum virus
cggggcccaugcucaccgccgag

SEQ ID NO: 4045087 - RNA, 19 nt, Molluscum contagiosum virus
cggggcccucggcgcgccg

SEQ ID NO: 4045088 - RNA, 15 nt, Molluscum contagiosum virus
cggggcuggcagaag

SEQ ID NO: 4045089 - RNA, 20 nt, Molluscum contagiosum virus
cgggggcucggaagagcguc

SEQ ID NO: 4045090 - RNA, 19 nt, Molluscum contagiosum virus
cggguaguugcgagccagc

SEQ ID NO: 4045091 - RNA, 16 nt, Molluscum contagiosum virus
cgggugccgugccccu

SEQ ID NO: 4045092 - RNA, 19 nt, Molluscum contagiosum virus
cggguguugaccaaagguc

SEQ ID NO: 4045093 - RNA, 13 nt, Molluscum contagiosum virus
cgguacugcugca

SEQ ID NO: 4045094 - RNA, 19 nt, Molluscum contagiosum virus
cggucgacgacgcgcgcac

SEQ ID NO: 4045095 - RNA, 22 nt, Molluscum contagiosum virus
cggucgccuucuugcuggcgcu

SEQ ID NO: 4045096 - RNA, 17 nt, Molluscum contagiosum virus
cggucggguacacgugc

SEQ ID NO: 4045097 - RNA, 23 nt, Molluscum contagiosum virus
cggucugauugagccggacuugu

SEQ ID NO: 4045098 - RNA, 21 nt, Molluscum contagiosum virus
cggucuuccagcacugcgcca

SEQ ID NO: 4045099 - RNA, 16 nt, Molluscum contagiosum virus
cggugagugcgcgcac

SEQ ID NO: 4045100 - RNA, 20 nt, Molluscum contagiosum virus
cggugcaaccgcugcucgac

SEQ ID NO: 4045101 - RNA, 15 nt, Molluscum contagiosum virus
cggugcagccgcugc

SEQ ID NO: 4045102 - RNA, 16 nt, Molluscum contagiosum virus
cggugcagcuacugcg

SEQ ID NO: 4045103 - RNA, 14 nt, Molluscum contagiosum virus
cggugcagcugccg

SEQ ID NO: 4045104 - RNA, 14 nt, Molluscum contagiosum virus
cggugcucgccccu

SEQ ID NO: 4045105 - RNA, 14 nt, Molluscum contagiosum virus
cgguggacgcacag

SEQ ID NO: 4045106 - RNA, 14 nt, Molluscum contagiosum virus
cgguggcggcucug

SEQ ID NO: 4045107 - RNA, 17 nt, Molluscum contagiosum virus
cgguguccucuucacau

SEQ ID NO: 4045108 - RNA, 19 nt, Molluscum contagiosum virus
cguaaagagcguccagccg

SEQ ID NO: 4045109 - RNA, 23 nt, Molluscum contagiosum virus
cguaacaauggacacgcacuggc

SEQ ID NO: 4045110 - RNA, 16 nt, Molluscum contagiosum virus
cguaagccaccgcgca

SEQ ID NO: 4045111 - RNA, 18 nt, Molluscum contagiosum virus
cguaaugauugucaagca

SEQ ID NO: 4045112 - RNA, 18 nt, Molluscum contagiosum virus
cguacagcgcgcgugccg

SEQ ID NO: 4045113 - RNA, 20 nt, Molluscum contagiosum virus
cguacagcuccccgcgcaag

SEQ ID NO: 4045114 - RNA, 14 nt, Molluscum contagiosum virus
cguaccgcgcccgc

SEQ ID NO: 4045115 - RNA, 21 nt, Molluscum contagiosum virus
cguacucaacaagcugcuggc

SEQ ID NO: 4045116 - RNA, 16 nt, Molluscum contagiosum virus
cguacugggagcuuuc

SEQ ID NO: 4045117 - RNA, 17 nt, Molluscum contagiosum virus
cguagcaaaugcgcugc

SEQ ID NO: 4045118 - RNA, 13 nt, Molluscum contagiosum virus
cguagccuagcca

SEQ ID NO: 4045119 - RNA, 19 nt, Molluscum contagiosum virus
cguaguacugcagcagcuc

SEQ ID NO: 4045120 - RNA, 15 nt, Molluscum contagiosum virus
cguaguccagcgcgu

SEQ ID NO: 4045121 - RNA, 18 nt, Molluscum contagiosum virus
cgucacaagcaccgccug

SEQ ID NO: 4045122 - RNA, 14 nt, Molluscum contagiosum virus
cgucaccaccgcuu

SEQ ID NO: 4045123 - RNA, 23 nt, Molluscum contagiosum virus
cgucagccucugugcggcgccgu

SEQ ID NO: 4045124 - RNA, 15 nt, Molluscum contagiosum virus
cguccacgacgagcc

SEQ ID NO: 4045125 - RNA, 18 nt, Molluscum contagiosum virus
acagccgcuuucugggcg

SEQ ID NO: 4045126 - RNA, 22 nt, Molluscum contagiosum virus
acagccuagaaacgacgggcgc

SEQ ID NO: 4045127 - RNA, 12 nt, Molluscum contagiosum virus
acagcgcaagcu

SEQ ID NO: 4045128 - RNA, 16 nt, Molluscum contagiosum virus
acagcgcgcgugccgc

SEQ ID NO: 4045129 - RNA, 16 nt, Molluscum contagiosum virus
acagcgggcgcugcuc

SEQ ID NO: 4045130 - RNA, 12 nt, Molluscum contagiosum virus
acagcugcugcu

SEQ ID NO: 4045131 - RNA, 23 nt, Molluscum contagiosum virus
acaggagcauuccuuguccuggc

SEQ ID NO: 4045132 - RNA, 19 nt, Molluscum contagiosum virus
acaggcgcgcaagugcgug

SEQ ID NO: 4045133 - RNA, 16 nt, Molluscum contagiosum virus
acagggauucgccgcg

SEQ ID NO: 4045134 - RNA, 22 nt, Molluscum contagiosum virus
acaggggggagacgguggaggu

SEQ ID NO: 4045135 - RNA, 14 nt, Molluscum contagiosum virus
acaggugcguaaug

SEQ ID NO: 4045136 - RNA, 21 nt, Molluscum contagiosum virus
acaguaccagauuagcaacug

SEQ ID NO: 4045137 - RNA, 17 nt, Molluscum contagiosum virus
acaguccaacccgcggc

SEQ ID NO: 4045138 - RNA, 20 nt, Molluscum contagiosum virus
acagucgcgcgccugccgcc

SEQ ID NO: 4045139 - RNA, 19 nt, Molluscum contagiosum virus
acagucuagugcguccgcc

SEQ ID NO: 4045140 - RNA, 17 nt, Molluscum contagiosum virus
acagucuugcgcagcgc

SEQ ID NO: 4045141 - RNA, 16 nt, Molluscum contagiosum virus
acaguggcugugcgcc

SEQ ID NO: 4045142 - RNA, 15 nt, Molluscum contagiosum virus
acauaguaccaugac

SEQ ID NO: 4045143 - RNA, 22 nt, Molluscum contagiosum virus
acaucaucgcggagcugcgcgc

SEQ ID NO: 4045144 - RNA, 23 nt, Molluscum contagiosum virus
acauccugccacaccagcuggcu

SEQ ID NO: 4045145 - RNA, 15 nt, Molluscum contagiosum virus
acaucggcacugcuc

SEQ ID NO: 4045146 - RNA, 23 nt, Molluscum contagiosum virus
acaucuucgugcccacgcuggcg

SEQ ID NO: 4045147 - RNA, 16 nt, Molluscum contagiosum virus
acaugcaacgcaggac

SEQ ID NO: 4045148 - RNA, 16 nt, Molluscum contagiosum virus
acaugcagcugcagga

SEQ ID NO: 4045149 - RNA, 16 nt, Molluscum contagiosum virus
acaugccgcgcugcuc

SEQ ID NO: 4045150 - RNA, 15 nt, Molluscum contagiosum virus
acaugcggagacugu

SEQ ID NO: 4045151 - RNA, 19 nt, Molluscum contagiosum virus
acaugcgugcuagcccgca

SEQ ID NO: 4045152 - RNA, 22 nt, Molluscum contagiosum virus
acaugcucgcgcucuacgccag

SEQ ID NO: 4045153 - RNA, 19 nt, Molluscum contagiosum virus
acaugcuguccaccuccuc

SEQ ID NO: 4045154 - RNA, 12 nt, Molluscum contagiosum virus
acaugugccugc

SEQ ID NO: 4045155 - RNA, 23 nt, Molluscum contagiosum virus
acaugugcgugcaccucaagaag

SEQ ID NO: 4045156 - RNA, 12 nt, Molluscum contagiosum virus
accacacgcgcg

SEQ ID NO: 4045157 - RNA, 19 nt, Molluscum contagiosum virus
accacccgaaagucccgcu

SEQ ID NO: 4045158 - RNA, 21 nt, Molluscum contagiosum virus
accacuggacacgugccuucu

SEQ ID NO: 4045159 - RNA, 13 nt, Molluscum contagiosum virus
accagaggguggc

SEQ ID NO: 4045160 - RNA, 15 nt, Molluscum contagiosum virus
accagauccgggcgc

SEQ ID NO: 4045161 - RNA, 10 nt, Molluscum contagiosum virus
accagcagcc

SEQ ID NO: 4045162 - RNA, 15 nt, Molluscum contagiosum virus
accagcagccaggcu

SEQ ID NO: 4045163 - RNA, 22 nt, Molluscum contagiosum virus
accagcgcggccguggcugcgg

SEQ ID NO: 4045164 - RNA, 21 nt, Molluscum contagiosum virus
accagcgugcccuucuccgag

SEQ ID NO: 4045165 - RNA, 16 nt, Molluscum contagiosum virus
accaguacaucaccgc

SEQ ID NO: 4045166 - RNA, 16 nt, Molluscum contagiosum virus
accaguaccugcugcc

SEQ ID NO: 4045167 - RNA, 14 nt, Molluscum contagiosum virus
acccagcaaggccc

SEQ ID NO: 4045168 - RNA, 17 nt, Molluscum contagiosum virus
accccaagaagaacguc

SEQ ID NO: 4045169 - RNA, 18 nt, Molluscum contagiosum virus
accccaagaagaacgucu

SEQ ID NO: 4045170 - RNA, 20 nt, Molluscum contagiosum virus
accccgcgcguacgcugcuc

SEQ ID NO: 4045171 - RNA, 14 nt, Molluscum contagiosum virus
accccucgugcugg

SEQ ID NO: 4045172 - RNA, 19 nt, Molluscum contagiosum virus
acccgcaggaaaggcaccc

SEQ ID NO: 4045173 - RNA, 20 nt, Molluscum contagiosum virus
acccguggccgagccgcugg

SEQ ID NO: 4045174 - RNA, 21 nt, Molluscum contagiosum virus
acccucgcaagcugagcgcgc

SEQ ID NO: 4045175 - RNA, 23 nt, Molluscum contagiosum virus
acccugcacgcuacggcugccgg

SEQ ID NO: 4045176 - RNA, 22 nt, Molluscum contagiosum virus
acccuggcugcugcgcgaccgc

SEQ ID NO: 4045177 - RNA, 23 nt, Molluscum contagiosum virus
acccuuggcagcaacugcacagg

SEQ ID NO: 4045178 - RNA, 17 nt, Molluscum contagiosum virus
accgacaaggagggaga

SEQ ID NO: 4045179 - RNA, 17 nt, Molluscum contagiosum virus
accgacgaggugcgcgc

SEQ ID NO: 4045180 - RNA, 15 nt, Molluscum contagiosum virus
accgagugcuggccg

SEQ ID NO: 4045181 - RNA, 16 nt, Molluscum contagiosum virus
accgcaagcucauggu

SEQ ID NO: 4045182 - RNA, 17 nt, Molluscum contagiosum virus
accgccgcggccgcgag

SEQ ID NO: 4045183 - RNA, 23 nt, Molluscum contagiosum virus
accgccgcggccgcgagacgcag

SEQ ID NO: 4045184 - RNA, 14 nt, Molluscum contagiosum virus
accgcgcagaagcc

SEQ ID NO: 4045185 - RNA, 16 nt, Molluscum contagiosum virus
accgcgcgcgcuccga

SEQ ID NO: 4045186 - RNA, 18 nt, Molluscum contagiosum virus
accgcggcgggugccgcc

SEQ ID NO: 4045187 - RNA, 13 nt, Molluscum contagiosum virus
accgcgugcgcag

SEQ ID NO: 4045188 - RNA, 21 nt, Molluscum contagiosum virus
accggcgcucacugcgaucgc

SEQ ID NO: 4045189 - RNA, 15 nt, Molluscum contagiosum virus
accgggcacuucucg

SEQ ID NO: 4045190 - RNA, 20 nt, Molluscum contagiosum virus
accgggcacuucucgcgcga

SEQ ID NO: 4045191 - RNA, 17 nt, Molluscum contagiosum virus
accgguuccgugcgcuc

SEQ ID NO: 4045192 - RNA, 17 nt, Molluscum contagiosum virus
accgucaaccugcugcc

SEQ ID NO: 4045193 - RNA, 14 nt, Molluscum contagiosum virus
accuacgcgccgac

SEQ ID NO: 4045194 - RNA, 22 nt, Molluscum contagiosum virus
accuacgcuaccugaagcugga

SEQ ID NO: 4045195 - RNA, 15 nt, Molluscum contagiosum virus
accuacuccuggcca

SEQ ID NO: 4045196 - RNA, 18 nt, Molluscum contagiosum virus
accucaacuguugccugg

SEQ ID NO: 4045197 - RNA, 12 nt, Molluscum contagiosum virus
accucaccgcgc

SEQ ID NO: 4045198 - RNA, 17 nt, Molluscum contagiosum virus
accucaccucugcgcgg

SEQ ID NO: 4045199 - RNA, 14 nt, Molluscum contagiosum virus
accucaucaagccc

SEQ ID NO: 4045200 - RNA, 23 nt, Molluscum contagiosum virus
accucccugugaacgcaccgccg

SEQ ID NO: 4045201 - RNA, 14 nt, Molluscum contagiosum virus
accuccugcaccug

SEQ ID NO: 4045202 - RNA, 18 nt, Molluscum contagiosum virus
accuccugcaccugcugg

SEQ ID NO: 4045203 - RNA, 20 nt, Molluscum contagiosum virus
accuccugcaccugcuggaa

SEQ ID NO: 4045204 - RNA, 24 nt, Molluscum contagiosum virus
accucugcuucacgcugcucgugc

SEQ ID NO: 4045205 - RNA, 16 nt, Molluscum contagiosum virus
accugagccucuggaa

SEQ ID NO: 4045206 - RNA, 18 nt, Molluscum contagiosum virus
accugcacgagccggcgc

SEQ ID NO: 4045207 - RNA, 19 nt, Molluscum contagiosum virus
accugcgacagcugcugcu

SEQ ID NO: 4045208 - RNA, 17 nt, Molluscum contagiosum virus
accugcgcaacgugcug

SEQ ID NO: 4045209 - RNA, 17 nt, Molluscum contagiosum virus
accugcguucgcuccgu

SEQ ID NO: 4045210 - RNA, 19 nt, Molluscum contagiosum virus
accugcucgggcugcgcgg

SEQ ID NO: 4045211 - RNA, 12 nt, Molluscum contagiosum virus
accugcugcgag

SEQ ID NO: 4045212 - RNA, 13 nt, Molluscum contagiosum virus
accugcugcugag

SEQ ID NO: 4045213 - RNA, 17 nt, Molluscum contagiosum virus
accugcugguggugcug

SEQ ID NO: 4045214 - RNA, 13 nt, Molluscum contagiosum virus
accuggaguacuu

SEQ ID NO: 4045215 - RNA, 18 nt, Molluscum contagiosum virus
accuggcgagcgcucugc

SEQ ID NO: 4045216 - RNA, 20 nt, Molluscum contagiosum virus
accuggcgagcgcucugcau

SEQ ID NO: 4045217 - RNA, 14 nt, Molluscum contagiosum virus
accugggcgccgcg

SEQ ID NO: 4045218 - RNA, 14 nt, Molluscum contagiosum virus
accugggcgucgug

SEQ ID NO: 4045219 - RNA, 16 nt, Molluscum contagiosum virus
accugguucaugcugg

SEQ ID NO: 4045220 - RNA, 15 nt, Molluscum contagiosum virus
accuguuaaauggac

SEQ ID NO: 4045221 - RNA, 18 nt, Molluscum contagiosum virus
accuuggacacgugcgug

SEQ ID NO: 4045222 - RNA, 16 nt, Molluscum contagiosum virus
accuuggcgcgccgcu

SEQ ID NO: 4045223 - RNA, 22 nt, Molluscum contagiosum virus
accuuggcgcugcacaguucac

SEQ ID NO: 4045224 - RNA, 20 nt, Molluscum contagiosum virus
accuuucuuccgacgggccc

SEQ ID NO: 4045225 - RNA, 16 nt, Molluscum contagiosum virus
acgaaaucgcaaagca

SEQ ID NO: 4045226 - RNA, 23 nt, Molluscum contagiosum virus
acgaacaugggguuucggaacgc

SEQ ID NO: 4045227 - RNA, 18 nt, Molluscum contagiosum virus
augcgguccgacucggug

SEQ ID NO: 4045228 - RNA, 20 nt, Molluscum contagiosum virus
augcgguguguguucucaaa

SEQ ID NO: 4045229 - RNA, 14 nt, Molluscum contagiosum virus
augcucgagccugc

SEQ ID NO: 4045230 - RNA, 18 nt, Molluscum contagiosum virus
augcucuacgugcugcag

SEQ ID NO: 4045231 - RNA, 22 nt, Molluscum contagiosum virus
augcugcucauggucgucuccg

SEQ ID NO: 4045232 - RNA, 19 nt, Molluscum contagiosum virus
augcuuuuguuacucucag

SEQ ID NO: 4045233 - RNA, 18 nt, Molluscum contagiosum virus
auggacaaagaugcagcc

SEQ ID NO: 4045234 - RNA, 15 nt, Molluscum contagiosum virus
auggacacgcugcgc

SEQ ID NO: 4045235 - RNA, 22 nt, Molluscum contagiosum virus
auggacgugcugcuggcccugc

SEQ ID NO: 4045236 - RNA, 15 nt, Molluscum contagiosum virus
auggccgcgccgcgc

SEQ ID NO: 4045237 - RNA, 11 nt, Molluscum contagiosum virus
auggcugcuca

SEQ ID NO: 4045238 - RNA, 12 nt, Molluscum contagiosum virus
auggcugcucuc

SEQ ID NO: 4045239 - RNA, 14 nt, Molluscum contagiosum virus
augggcacggcaac

SEQ ID NO: 4045240 - RNA, 17 nt, Molluscum contagiosum virus
augggcacggcaacgag

SEQ ID NO: 4045241 - RNA, 20 nt, Molluscum contagiosum virus
auguacuucuacgagcagcg

SEQ ID NO: 4045242 - RNA, 18 nt, Molluscum contagiosum virus
augucacgcgucgcgcgc

SEQ ID NO: 4045243 - RNA, 14 nt, Molluscum contagiosum virus
auguccacggacau

SEQ ID NO: 4045244 - RNA, 18 nt, Molluscum contagiosum virus
auguccaugucgcgcauc

SEQ ID NO: 4045245 - RNA, 23 nt, Molluscum contagiosum virus
augucgcgacggagauggacaca

SEQ ID NO: 4045246 - RNA, 21 nt, Molluscum contagiosum virus
augugagcaagcugcaagcca

SEQ ID NO: 4045247 - RNA, 15 nt, Molluscum contagiosum virus
auguugugcucgugu

SEQ ID NO: 4045248 - RNA, 12 nt, Molluscum contagiosum virus
auguuguuugaa

SEQ ID NO: 4045249 - RNA, 18 nt, Molluscum contagiosum virus
auucacuuucgucgccuc

SEQ ID NO: 4045250 - RNA, 19 nt, Molluscum contagiosum virus
auucgcgcgcccccgcaaa

SEQ ID NO: 4045251 - RNA, 23 nt, Molluscum contagiosum virus
auucuugcacgggcaugcacagc

SEQ ID NO: 4045252 - RNA, 14 nt, Molluscum contagiosum virus
auugccacgcaaaa

SEQ ID NO: 4045253 - RNA, 21 nt, Molluscum contagiosum virus
auugcccgcgcgcggacagcc

SEQ ID NO: 4045254 - RNA, 20 nt, Molluscum contagiosum virus
auuucguugauuugcgcacc

SEQ ID NO: 4045255 - RNA, 19 nt, Molluscum contagiosum virus
auuucuuuuuccgggacgc

SEQ ID NO: 4045256 - RNA, 14 nt, Molluscum contagiosum virus
auuuuuugccccgc

SEQ ID NO: 4045257 - RNA, 15 nt, Molluscum contagiosum virus
caaaagagcgcgccu

SEQ ID NO: 4045258 - RNA, 15 nt, Molluscum contagiosum virus
caaaagaggccugcu

SEQ ID NO: 4045259 - RNA, 16 nt, Molluscum contagiosum virus
caaaagcacagcagga

SEQ ID NO: 4045260 - RNA, 14 nt, Molluscum contagiosum virus
caaacagccugugu

SEQ ID NO: 4045261 - RNA, 15 nt, Molluscum contagiosum virus
caaagaaugcaugcg

SEQ ID NO: 4045262 - RNA, 19 nt, Molluscum contagiosum virus
caaagacgagggaugcgca

SEQ ID NO: 4045263 - RNA, 12 nt, Molluscum contagiosum virus
caaagcggggcg

SEQ ID NO: 4045264 - RNA, 20 nt, Molluscum contagiosum virus
caaagcugugcguacaccua

SEQ ID NO: 4045265 - RNA, 18 nt, Molluscum contagiosum virus
caaaggcccgcgagcacg

SEQ ID NO: 4045266 - RNA, 14 nt, Molluscum contagiosum virus
caaaggugcucacc

SEQ ID NO: 4045267 - RNA, 23 nt, Molluscum contagiosum virus
caaaguacuugccgucacggccg

SEQ ID NO: 4045268 - RNA, 20 nt, Molluscum contagiosum virus
caaaucuguucgagcaacag

SEQ ID NO: 4045269 - RNA, 15 nt, Molluscum contagiosum virus
caacaacgagagcgg

SEQ ID NO: 4045270 - RNA, 19 nt, Molluscum contagiosum virus
caacacgaucaaggugcag

SEQ ID NO: 4045271 - RNA, 20 nt, Molluscum contagiosum virus
caacacgcuguugcugcugc

SEQ ID NO: 4045272 - RNA, 18 nt, Molluscum contagiosum virus
caacacuaccacagccau

SEQ ID NO: 4045273 - RNA, 12 nt, Molluscum contagiosum virus
caacagcagcug

SEQ ID NO: 4045274 - RNA, 23 nt, Molluscum contagiosum virus
caacaggaauguguacgacgcgc

SEQ ID NO: 4045275 - RNA, 14 nt, Molluscum contagiosum virus
caacauccaaacca

SEQ ID NO: 4045276 - RNA, 15 nt, Molluscum contagiosum virus
caaccacagcucucc

SEQ ID NO: 4045277 - RNA, 19 nt, Molluscum contagiosum virus
caaccacucuuucacgcug

SEQ ID NO: 4045278 - RNA, 22 nt, Molluscum contagiosum virus
caaccaguacuucaucuucaag

SEQ ID NO: 4045279 - RNA, 23 nt, Molluscum contagiosum virus
caaccccgcgcguacgcugcucg

SEQ ID NO: 4045280 - RNA, 15 nt, Molluscum contagiosum virus
caaccccgcgcugcg

SEQ ID NO: 4045281 - RNA, 20 nt, Molluscum contagiosum virus
caaccccgcgcugcgcggcg

SEQ ID NO: 4045282 - RNA, 15 nt, Molluscum contagiosum virus
caaccuccugcaccu

SEQ ID NO: 4045283 - RNA, 19 nt, Molluscum contagiosum virus
caaccuccugcaccugcug

SEQ ID NO: 4045284 - RNA, 21 nt, Molluscum contagiosum virus
caaccuccugcaccugcugga

SEQ ID NO: 4045285 - RNA, 15 nt, Molluscum contagiosum virus
caacgacaaggaaag

SEQ ID NO: 4045286 - RNA, 21 nt, Molluscum contagiosum virus
caacgacaaggaaaggcaccc

SEQ ID NO: 4045287 - RNA, 22 nt, Molluscum contagiosum virus
caacgagcucuccgaagagcag

SEQ ID NO: 4045288 - RNA, 15 nt, Molluscum contagiosum virus
caacgccagcuguag

SEQ ID NO: 4045289 - RNA, 21 nt, Molluscum contagiosum virus
caacgccuaccaccgggcacu

SEQ ID NO: 4045290 - RNA, 17 nt, Molluscum contagiosum virus
caacgcugccgcuggcg

SEQ ID NO: 4045291 - RNA, 20 nt, Molluscum contagiosum virus
caacguaguacugcagcagc

SEQ ID NO: 4045292 - RNA, 16 nt, Molluscum contagiosum virus
caacgugcugcgccgc

SEQ ID NO: 4045293 - RNA, 18 nt, Molluscum contagiosum virus
caacguggcgccgcugcu

SEQ ID NO: 4045294 - RNA, 19 nt, Molluscum contagiosum virus
caacuacaaggugcugucc

SEQ ID NO: 4045295 - RNA, 20 nt, Molluscum contagiosum virus
caacuccgagcgcgcgcgcu

SEQ ID NO: 4045296 - RNA, 15 nt, Molluscum contagiosum virus
caacuucgcgcugua

SEQ ID NO: 4045297 - RNA, 22 nt, Molluscum contagiosum virus
caacuugcucuacuggcggcgc

SEQ ID NO: 4045298 - RNA, 14 nt, Molluscum contagiosum virus
caacuugggcccgc

SEQ ID NO: 4045299 - RNA, 21 nt, Molluscum contagiosum virus
caagaaacgggagucacuucu

SEQ ID NO: 4045300 - RNA, 21 nt, Molluscum contagiosum virus
caagaagaggccagcacaagc

SEQ ID NO: 4045301 - RNA, 21 nt, Molluscum contagiosum virus
caagacgacacgagggccuug

SEQ ID NO: 4045302 - RNA, 11 nt, Molluscum contagiosum virus
caagacuggcc

SEQ ID NO: 4045303 - RNA, 21 nt, Molluscum contagiosum virus
caagagcuuacuagacuggcu

SEQ ID NO: 4045304 - RNA, 19 nt, Molluscum contagiosum virus
caagaggacgagcugcuaa

SEQ ID NO: 4045305 - RNA, 19 nt, Molluscum contagiosum virus
caagagggggcuguuauuu

SEQ ID NO: 4045306 - RNA, 17 nt, Molluscum contagiosum virus
caagauucuucgcgaag

SEQ ID NO: 4045307 - RNA, 18 nt, Molluscum contagiosum virus
caagcaccgccugcugca

SEQ ID NO: 4045308 - RNA, 20 nt, Molluscum contagiosum virus
caagcaccgccugcugcagc

SEQ ID NO: 4045309 - RNA, 16 nt, Molluscum contagiosum virus
caagcacgagcugcug

SEQ ID NO: 4045310 - RNA, 17 nt, Molluscum contagiosum virus
caagcacgagcugcugc

SEQ ID NO: 4045311 - RNA, 23 nt, Molluscum contagiosum virus
caagcacgcaacgucgcacuggc

SEQ ID NO: 4045312 - RNA, 12 nt, Molluscum contagiosum virus
caagcacgccag

SEQ ID NO: 4045313 - RNA, 13 nt, Molluscum contagiosum virus
caagcacugccuc

SEQ ID NO: 4045314 - RNA, 20 nt, Molluscum contagiosum virus
caagcagguggccgcgcgcg

SEQ ID NO: 4045315 - RNA, 15 nt, Molluscum contagiosum virus
caagcccagcagcga

SEQ ID NO: 4045316 - RNA, 13 nt, Molluscum contagiosum virus
caagcgcugcucg

SEQ ID NO: 4045317 - RNA, 21 nt, Molluscum contagiosum virus
caagcggucaggccgggcgcg

SEQ ID NO: 4045318 - RNA, 14 nt, Molluscum contagiosum virus
caagcggugcagcu

SEQ ID NO: 4045319 - RNA, 22 nt, Molluscum contagiosum virus
caagcguuuucgucauggagca

SEQ ID NO: 4045320 - RNA, 14 nt, Molluscum contagiosum virus
caagcucgaacaga

SEQ ID NO: 4045321 - RNA, 18 nt, Molluscum contagiosum virus
caagcugagcgcgcugcg

SEQ ID NO: 4045322 - RNA, 16 nt, Molluscum contagiosum virus
caaggaaaaggcacac

SEQ ID NO: 4045323 - RNA, 17 nt, Molluscum contagiosum virus
caaggaaaaggcacacc

SEQ ID NO: 4045324 - RNA, 19 nt, Molluscum contagiosum virus
caaggaaaggcacccgcag

SEQ ID NO: 4045325 - RNA, 21 nt, Molluscum contagiosum virus
caaggaaaggcaccugcagga

SEQ ID NO: 4045326 - RNA, 13 nt, Molluscum contagiosum virus
caaggaucucugc

SEQ ID NO: 4045327 - RNA, 19 nt, Molluscum contagiosum virus
caaggauuacgcugccgug

SEQ ID NO: 4045328 - RNA, 12 nt, Molluscum contagiosum virus
caaggauuuaaa

SEQ ID NO: 4045329 - RNA, 14 nt, Molluscum contagiosum virus
gccgccggcgccgc

SEQ ID NO: 4045330 - RNA, 13 nt, Molluscum contagiosum virus
gccgccgggccug

SEQ ID NO: 4045331 - RNA, 21 nt, Molluscum contagiosum virus
gccgccggggcccaugcucac

SEQ ID NO: 4045332 - RNA, 23 nt, Molluscum contagiosum virus
gccgccugcucucgaagcagugc

SEQ ID NO: 4045333 - RNA, 18 nt, Molluscum contagiosum virus
gccgccuuugcgcugucu

SEQ ID NO: 4045334 - RNA, 12 nt, Molluscum contagiosum virus
gccgcgagcacu

SEQ ID NO: 4045335 - RNA, 20 nt, Molluscum contagiosum virus
gccgcgagcacuggcuggcg

SEQ ID NO: 4045336 - RNA, 13 nt, Molluscum contagiosum virus
gccgcgagcgcgu

SEQ ID NO: 4045337 - RNA, 12 nt, Molluscum contagiosum virus
gccgcgaggacc

SEQ ID NO: 4045338 - RNA, 18 nt, Molluscum contagiosum virus
gccgcgaggacccgcgcu

SEQ ID NO: 4045339 - RNA, 21 nt, Molluscum contagiosum virus
gccgcgcaagugggcgucgac

SEQ ID NO: 4045340 - RNA, 19 nt, Molluscum contagiosum virus
gccgcgcccgcggcgcacg

SEQ ID NO: 4045341 - RNA, 22 nt, Molluscum contagiosum virus
gccgcgcccgcgucgcgcgccg

SEQ ID NO: 4045342 - RNA, 20 nt, Molluscum contagiosum virus
gccgcgcgcgccagcuaugc

SEQ ID NO: 4045343 - RNA, 19 nt, Molluscum contagiosum virus
gccgcgcgcugcucuggag

SEQ ID NO: 4045344 - RNA, 17 nt, Molluscum contagiosum virus
gccgcgcgucugcgagu

SEQ ID NO: 4045345 - RNA, 14 nt, Molluscum contagiosum virus
gccgcgcugcuccg

SEQ ID NO: 4045346 - RNA, 13 nt, Molluscum contagiosum virus
gccgcgcugcugg

SEQ ID NO: 4045347 - RNA, 14 nt, Molluscum contagiosum virus
gccgcgcugcuggc

SEQ ID NO: 4045348 - RNA, 17 nt, Molluscum contagiosum virus
gccgcgcuucgagcacg

SEQ ID NO: 4045349 - RNA, 22 nt, Molluscum contagiosum virus
gccgcggcacugggugcccgag

SEQ ID NO: 4045350 - RNA, 16 nt, Molluscum contagiosum virus
gccgcggccugggcca

SEQ ID NO: 4045351 - RNA, 21 nt, Molluscum contagiosum virus
gccgcgugcaugcccagcaug

SEQ ID NO: 4045352 - RNA, 13 nt, Molluscum contagiosum virus
gccgcgugcucgu

SEQ ID NO: 4045353 - RNA, 11 nt, Molluscum contagiosum virus
gccgcgugcug

SEQ ID NO: 4045354 - RNA, 20 nt, Molluscum contagiosum virus
gccgcucggcacugcuggcg

SEQ ID NO: 4045355 - RNA, 15 nt, Molluscum contagiosum virus
gccgcucggcccgcg

SEQ ID NO: 4045356 - RNA, 16 nt, Molluscum contagiosum virus
gccgcucguccagcug

SEQ ID NO: 4045357 - RNA, 16 nt, Molluscum contagiosum virus
gccgcugccugugccc

SEQ ID NO: 4045358 - RNA, 12 nt, Molluscum contagiosum virus
gccgcugcgcau

SEQ ID NO: 4045359 - RNA, 13 nt, Molluscum contagiosum virus
gccgcugcgcgac

SEQ ID NO: 4045360 - RNA, 15 nt, Molluscum contagiosum virus
gccgcuugagcagca

SEQ ID NO: 4045361 - RNA, 21 nt, Molluscum contagiosum virus
gccgcuuucugggcgcgugcg

SEQ ID NO: 4045362 - RNA, 12 nt, Molluscum contagiosum virus
gccggacagcuc

SEQ ID NO: 4045363 - RNA, 15 nt, Molluscum contagiosum virus
gccggacagcucagc

SEQ ID NO: 4045364 - RNA, 17 nt, Molluscum contagiosum virus
gccggcacgagcagucc

SEQ ID NO: 4045365 - RNA, 19 nt, Molluscum contagiosum virus
gccggcaucgcgcugcugg

SEQ ID NO: 4045366 - RNA, 13 nt, Molluscum contagiosum virus
gccggccccgcga

SEQ ID NO: 4045367 - RNA, 14 nt, Molluscum contagiosum virus
gccggccgccggcg

SEQ ID NO: 4045368 - RNA, 12 nt, Molluscum contagiosum virus
gccggcgccgcg

SEQ ID NO: 4045369 - RNA, 15 nt, Molluscum contagiosum virus
gccggcgcgccgcgg

SEQ ID NO: 4045370 - RNA, 22 nt, Molluscum contagiosum virus
gccggcgcgcgcgcgcaggcuc

SEQ ID NO: 4045371 - RNA, 22 nt, Molluscum contagiosum virus
gccggcgggcgcgugcucacgc

SEQ ID NO: 4045372 - RNA, 18 nt, Molluscum contagiosum virus
gccgggaaugcugcgcac

SEQ ID NO: 4045373 - RNA, 22 nt, Molluscum contagiosum virus
gccgggccugcggcggcgcacg

SEQ ID NO: 4045374 - RNA, 19 nt, Molluscum contagiosum virus
gccgggcgucuccgcgcgg

SEQ ID NO: 4045375 - RNA, 19 nt, Molluscum contagiosum virus
gccgguacucgugcgucac

SEQ ID NO: 4045376 - RNA, 15 nt, Molluscum contagiosum virus
gccgguacugcggac

SEQ ID NO: 4045377 - RNA, 20 nt, Molluscum contagiosum virus
gccggucuccacguggccag

SEQ ID NO: 4045378 - RNA, 21 nt, Molluscum contagiosum virus
gccguacccggggagaagaug

SEQ ID NO: 4045379 - RNA, 20 nt, Molluscum contagiosum virus
gccguccccggaaagcagca

SEQ ID NO: 4045380 - RNA, 23 nt, Molluscum contagiosum virus
gccgucgcccggcaggcucccgc

SEQ ID NO: 4045381 - RNA, 17 nt, Molluscum contagiosum virus
gccgucgcgcgcugugg

SEQ ID NO: 4045382 - RNA, 20 nt, Molluscum contagiosum virus
gccgucgucaacaacacgau

SEQ ID NO: 4045383 - RNA, 16 nt, Molluscum contagiosum virus
gccgugacgcugcggc

SEQ ID NO: 4045384 - RNA, 14 nt, Molluscum contagiosum virus
gccgugagcacgag

SEQ ID NO: 4045385 - RNA, 14 nt, Molluscum contagiosum virus
gccgugcagagcaa

SEQ ID NO: 4045386 - RNA, 12 nt, Molluscum contagiosum virus
gccgugcgcgac

SEQ ID NO: 4045387 - RNA, 16 nt, Molluscum contagiosum virus
gccguggcaaacaggc

SEQ ID NO: 4045388 - RNA, 16 nt, Molluscum contagiosum virus
gccgugguacacguag

SEQ ID NO: 4045389 - RNA, 17 nt, Molluscum contagiosum virus
gccgugugaucaagagc

SEQ ID NO: 4045390 - RNA, 18 nt, Molluscum contagiosum virus
gccguuuuacacagggcu

SEQ ID NO: 4045391 - RNA, 15 nt, Molluscum contagiosum virus
gccuaccugcaggag

SEQ ID NO: 4045392 - RNA, 22 nt, Molluscum contagiosum virus
gccuacgcgcgcguaacagcgc

SEQ ID NO: 4045393 - RNA, 12 nt, Molluscum contagiosum virus
gccuacgugcug

SEQ ID NO: 4045394 - RNA, 16 nt, Molluscum contagiosum virus
gccuacgugcugcgca

SEQ ID NO: 4045395 - RNA, 13 nt, Molluscum contagiosum virus
gccuacguggcgg

SEQ ID NO: 4045396 - RNA, 22 nt, Molluscum contagiosum virus
gccuacucgcgacgcguccgcc

SEQ ID NO: 4045397 - RNA, 13 nt, Molluscum contagiosum virus
gccuagagcuggc

SEQ ID NO: 4045398 - RNA, 13 nt, Molluscum contagiosum virus
gccuaggaggaga

SEQ ID NO: 4045399 - RNA, 20 nt, Molluscum contagiosum virus
gccuaggaggagaacuccaa

SEQ ID NO: 4045400 - RNA, 18 nt, Molluscum contagiosum virus
gccucagccgagcgccgc

SEQ ID NO: 4045401 - RNA, 21 nt, Molluscum contagiosum virus
gccucagccgagcgccgccag

SEQ ID NO: 4045402 - RNA, 23 nt, Molluscum contagiosum virus
gccuccaagaagaggccagcaca

SEQ ID NO: 4045403 - RNA, 17 nt, Molluscum contagiosum virus
gccuccgagcgcgcgug

SEQ ID NO: 4045404 - RNA, 16 nt, Molluscum contagiosum virus
gccucgagcacgccuc

SEQ ID NO: 4045405 - RNA, 22 nt, Molluscum contagiosum virus
gccucggacggaggucugcuuu

SEQ ID NO: 4045406 - RNA, 15 nt, Molluscum contagiosum virus
gccucguucacggcu

SEQ ID NO: 4045407 - RNA, 16 nt, Molluscum contagiosum virus
gccucguucacggcua

SEQ ID NO: 4045408 - RNA, 16 nt, Molluscum contagiosum virus
gccucugugcggcgcc

SEQ ID NO: 4045409 - RNA, 15 nt, Molluscum contagiosum virus
gccugagaagcugua

SEQ ID NO: 4045410 - RNA, 20 nt, Molluscum contagiosum virus
gccugcaagaggcgcugucg

SEQ ID NO: 4045411 - RNA, 20 nt, Molluscum contagiosum virus
gccugcaccgagugcuggcc

SEQ ID NO: 4045412 - RNA, 13 nt, Molluscum contagiosum virus
gccugcacgcgca

SEQ ID NO: 4045413 - RNA, 16 nt, Molluscum contagiosum virus
gccugccagcagagcu

SEQ ID NO: 4045414 - RNA, 19 nt, Molluscum contagiosum virus
gccugcccgugugcgggca

SEQ ID NO: 4045415 - RNA, 21 nt, Molluscum contagiosum virus
gccugcgcaacgcgggccagg

SEQ ID NO: 4045416 - RNA, 13 nt, Molluscum contagiosum virus
gccugcgcgagca

SEQ ID NO: 4045417 - RNA, 14 nt, Molluscum contagiosum virus
gccugcgcgcaccc

SEQ ID NO: 4045418 - RNA, 23 nt, Molluscum contagiosum virus
gccugcggguaguugcgagccag

SEQ ID NO: 4045419 - RNA, 24 nt, Molluscum contagiosum virus
gccugcggguaguugcgagccagc

SEQ ID NO: 4045420 - RNA, 19 nt, Molluscum contagiosum virus
gccugcguggacagcaucc

SEQ ID NO: 4045421 - RNA, 15 nt, Molluscum contagiosum virus
gccugcucuccgcgg

SEQ ID NO: 4045422 - RNA, 15 nt, Molluscum contagiosum virus
gccugcugcagcucc

SEQ ID NO: 4045423 - RNA, 21 nt, Molluscum contagiosum virus
gccuggccgaacugcucugcg

SEQ ID NO: 4045424 - RNA, 13 nt, Molluscum contagiosum virus
gccuggcggcagc

SEQ ID NO: 4045425 - RNA, 21 nt, Molluscum contagiosum virus
gccuguaccccgaacggcgug

SEQ ID NO: 4045426 - RNA, 18 nt, Molluscum contagiosum virus
gccuguaccugcgacagc

SEQ ID NO: 4045427 - RNA, 18 nt, Molluscum contagiosum virus
gccuguaccugcucgggc

SEQ ID NO: 4045428 - RNA, 14 nt, Molluscum contagiosum virus
gccugucucgcaag

SEQ ID NO: 4045429 - RNA, 15 nt, Molluscum contagiosum virus
gccugugccugcaag

SEQ ID NO: 4045430 - RNA, 16 nt, Molluscum contagiosum virus
gccuguuuccgcucgc

SEQ ID NO: 4045431 - RNA, 13 nt, Molluscum contagiosum virus
gccuucgacggcu

SEQ ID NO: 4045432 - RNA, 16 nt, Molluscum contagiosum virus
gcgccgcagcacgcgu

SEQ ID NO: 4045433 - RNA, 12 nt, Molluscum contagiosum virus
gcgccgccagcg

SEQ ID NO: 4045434 - RNA, 14 nt, Molluscum contagiosum virus
gcgccgccagcucc

SEQ ID NO: 4045435 - RNA, 17 nt, Molluscum contagiosum virus
gcgccgcgcgcgccggg

SEQ ID NO: 4045436 - RNA, 16 nt, Molluscum contagiosum virus
gcgccgcgcggcuccu

SEQ ID NO: 4045437 - RNA, 18 nt, Molluscum contagiosum virus
gcgccgcggcgggggcag

SEQ ID NO: 4045438 - RNA, 21 nt, Molluscum contagiosum virus
gcgccgcgugcaugcccagca

SEQ ID NO: 4045439 - RNA, 13 nt, Molluscum contagiosum virus
gcgccgcucgcac

SEQ ID NO: 4045440 - RNA, 21 nt, Molluscum contagiosum virus
gcgccgcucgucgcugcggac

SEQ ID NO: 4045441 - RNA, 23 nt, Molluscum contagiosum virus
gcgccgcugcccgcgcacgagcu

SEQ ID NO: 4045442 - RNA, 16 nt, Molluscum contagiosum virus
gcgccgcugcucgcuu

SEQ ID NO: 4045443 - RNA, 13 nt, Molluscum contagiosum virus
gcgccgcugcugg

SEQ ID NO: 4045444 - RNA, 20 nt, Molluscum contagiosum virus
gcgccggcacccgugcgcgc

SEQ ID NO: 4045445 - RNA, 15 nt, Molluscum contagiosum virus
gcgccgggccgcggu

SEQ ID NO: 4045446 - RNA, 17 nt, Molluscum contagiosum virus
gcgccggggcgcgcgcu

SEQ ID NO: 4045447 - RNA, 16 nt, Molluscum contagiosum virus
gcgccuacucuugcgc

SEQ ID NO: 4045448 - RNA, 12 nt, Molluscum contagiosum virus
gcgccucucgag

SEQ ID NO: 4045449 - RNA, 13 nt, Molluscum contagiosum virus
gcgccugaaccug

SEQ ID NO: 4045450 - RNA, 16 nt, Molluscum contagiosum virus
gcgccugcgcgagcaa

SEQ ID NO: 4045451 - RNA, 12 nt, Molluscum contagiosum virus
gcgccuugcagc

SEQ ID NO: 4045452 - RNA, 22 nt, Molluscum contagiosum virus
gcgcgaaacgguaagcucgacg

SEQ ID NO: 4045453 - RNA, 14 nt, Molluscum contagiosum virus
gcgcgacaugcugc

SEQ ID NO: 4045454 - RNA, 16 nt, Molluscum contagiosum virus
gcgcgacaugcugccc

SEQ ID NO: 4045455 - RNA, 18 nt, Molluscum contagiosum virus
gcgcgaccuacuccuggc

SEQ ID NO: 4045456 - RNA, 21 nt, Molluscum contagiosum virus
gcgcgacuccaucugcgcgac

SEQ ID NO: 4045457 - RNA, 20 nt, Molluscum contagiosum virus
gcgcgacuuggggcucgccg

SEQ ID NO: 4045458 - RNA, 20 nt, Molluscum contagiosum virus
gcgcgagacgcugcugcaca

SEQ ID NO: 4045459 - RNA, 15 nt, Molluscum contagiosum virus
gcgcgagaugcucgc

SEQ ID NO: 4045460 - RNA, 18 nt, Molluscum contagiosum virus
gcgcgagcagcugcugcg

SEQ ID NO: 4045461 - RNA, 12 nt, Molluscum contagiosum virus
gcgcgagcgacg

SEQ ID NO: 4045462 - RNA, 15 nt, Molluscum contagiosum virus
gcgcgagcgcgcgcu

SEQ ID NO: 4045463 - RNA, 14 nt, Molluscum contagiosum virus
gcgcgagcugcugc

SEQ ID NO: 4045464 - RNA, 17 nt, Molluscum contagiosum virus
gcgcgaguacaagcucg

SEQ ID NO: 4045465 - RNA, 24 nt, Molluscum contagiosum virus
gcgcgcaaaaggcacgaggcagcc

SEQ ID NO: 4045466 - RNA, 21 nt, Molluscum contagiosum virus
gcgcgcaagucgcgcgcugcg

SEQ ID NO: 4045467 - RNA, 20 nt, Molluscum contagiosum virus
gcgcgcacaaacgcgcgcac

SEQ ID NO: 4045468 - RNA, 16 nt, Molluscum contagiosum virus
gcgcgcacacgacgcu

SEQ ID NO: 4045469 - RNA, 14 nt, Molluscum contagiosum virus
gcgcgcacaucggc

SEQ ID NO: 4045470 - RNA, 12 nt, Molluscum contagiosum virus
gcgcgcacgcga

SEQ ID NO: 4045471 - RNA, 18 nt, Molluscum contagiosum virus
gcgcgcacggcuaggcgc

SEQ ID NO: 4045472 - RNA, 19 nt, Molluscum contagiosum virus
gcgcgcacucgggugcccg

SEQ ID NO: 4045473 - RNA, 13 nt, Molluscum contagiosum virus
gcgcgcagcgccc

SEQ ID NO: 4045474 - RNA, 15 nt, Molluscum contagiosum virus
gcgcgcaggaaaggu

SEQ ID NO: 4045475 - RNA, 19 nt, Molluscum contagiosum virus
gcgcgcaggcucgcaccgu

SEQ ID NO: 4045476 - RNA, 19 nt, Molluscum contagiosum virus
gcgcgcaucgcgggcacgc

SEQ ID NO: 4045477 - RNA, 20 nt, Molluscum contagiosum virus
gcgcgccaacgacuagcgug

SEQ ID NO: 4045478 - RNA, 16 nt, Molluscum contagiosum virus
gcgcgccagcagcgcc

SEQ ID NO: 4045479 - RNA, 15 nt, Molluscum contagiosum virus
gcgcgcccaccagca

SEQ ID NO: 4045480 - RNA, 18 nt, Molluscum contagiosum virus
gcgcgcccaccagcagcc

SEQ ID NO: 4045481 - RNA, 22 nt, Molluscum contagiosum virus
gcgcgcccaccagcagccaggc

SEQ ID NO: 4045482 - RNA, 22 nt, Molluscum contagiosum virus
gcgcgcccucgcgcgcagcaca

SEQ ID NO: 4045483 - RNA, 22 nt, Molluscum contagiosum virus
gcgcgccgcacgcugcugcgug

SEQ ID NO: 4045484 - RNA, 15 nt, Molluscum contagiosum virus
gcgcgccgcgcgccg

SEQ ID NO: 4045485 - RNA, 14 nt, Molluscum contagiosum virus
gcgcgccgcgcgcu

SEQ ID NO: 4045486 - RNA, 16 nt, Molluscum contagiosum virus
gcgcgccgcgggccgc

SEQ ID NO: 4045487 - RNA, 19 nt, Molluscum contagiosum virus
gcgcgccgggaaugcugcg

SEQ ID NO: 4045488 - RNA, 15 nt, Molluscum contagiosum virus
gcgcgccgggccgcg

SEQ ID NO: 4045489 - RNA, 21 nt, Molluscum contagiosum virus
gcgcgccucucgaggccggca

SEQ ID NO: 4045490 - RNA, 13 nt, Molluscum contagiosum virus
gcgcgccugcugg

SEQ ID NO: 4045491 - RNA, 12 nt, Molluscum contagiosum virus
gcgcgccuuccg

SEQ ID NO: 4045492 - RNA, 17 nt, Molluscum contagiosum virus
gcgcgccuuccgcgcgg

SEQ ID NO: 4045493 - RNA, 15 nt, Molluscum contagiosum virus
gcgcgcgcagcgcgc

SEQ ID NO: 4045494 - RNA, 14 nt, Molluscum contagiosum virus
gcgcgcgcauggag

SEQ ID NO: 4045495 - RNA, 14 nt, Molluscum contagiosum virus
gcgcgcgcgaacgc

SEQ ID NO: 4045496 - RNA, 15 nt, Molluscum contagiosum virus
gcgcgcgcggcgcag

SEQ ID NO: 4045497 - RNA, 15 nt, Molluscum contagiosum virus
gcgcgcgcggucgac

SEQ ID NO: 4045498 - RNA, 14 nt, Molluscum contagiosum virus
gcgcgcgcucugcc

SEQ ID NO: 4045499 - RNA, 19 nt, Molluscum contagiosum virus
gcgcgcggaagcccgccuc

SEQ ID NO: 4045500 - RNA, 15 nt, Molluscum contagiosum virus
gcgcgcggcgcgccc

SEQ ID NO: 4045501 - RNA, 16 nt, Molluscum contagiosum virus
gcgcgcggugcugcgc

SEQ ID NO: 4045502 - RNA, 20 nt, Molluscum contagiosum virus
gcgcgcguuuccguggcgug

SEQ ID NO: 4045503 - RNA, 18 nt, Molluscum contagiosum virus
gcgcgcuccgagacugcu

SEQ ID NO: 4045504 - RNA, 15 nt, Molluscum contagiosum virus
gcgcgcucgaggcgc

SEQ ID NO: 4045505 - RNA, 18 nt, Molluscum contagiosum virus
gcgcgcucgaggcgccgu

SEQ ID NO: 4045506 - RNA, 20 nt, Molluscum contagiosum virus
gcgcgcucgccaccgcgccc

SEQ ID NO: 4045507 - RNA, 15 nt, Molluscum contagiosum virus
gcgcgcucgcgcagg

SEQ ID NO: 4045508 - RNA, 15 nt, Molluscum contagiosum virus
gcgcgcugcgccgcu

SEQ ID NO: 4045509 - RNA, 14 nt, Molluscum contagiosum virus
gcgcgcugcgcgcg

SEQ ID NO: 4045510 - RNA, 12 nt, Molluscum contagiosum virus
gcgcgcugcgug

SEQ ID NO: 4045511 - RNA, 15 nt, Molluscum contagiosum virus
gcgcgcugcucugga

SEQ ID NO: 4045512 - RNA, 12 nt, Molluscum contagiosum virus
gcgcgcuggccg

SEQ ID NO: 4045513 - RNA, 16 nt, Molluscum contagiosum virus
gcgcgcuggcgugcgc

SEQ ID NO: 4045514 - RNA, 20 nt, Molluscum contagiosum virus
gcgcgcugguuaccaagggc

SEQ ID NO: 4045515 - RNA, 22 nt, Molluscum contagiosum virus
gcgcgcuuuuugccgcucacag

SEQ ID NO: 4045516 - RNA, 17 nt, Molluscum contagiosum virus
gcgcggaagaagcugcg

SEQ ID NO: 4045517 - RNA, 18 nt, Molluscum contagiosum virus
gcgcggaagcccgagcgc

SEQ ID NO: 4045518 - RNA, 19 nt, Molluscum contagiosum virus
gcgcggaagcccgagcgcg

SEQ ID NO: 4045519 - RNA, 18 nt, Molluscum contagiosum virus
gcgcggacagccuagaaa

SEQ ID NO: 4045520 - RNA, 13 nt, Molluscum contagiosum virus
gcgcggagcuggc

SEQ ID NO: 4045521 - RNA, 19 nt, Molluscum contagiosum virus
gcgcggcaacagcacgacg

SEQ ID NO: 4045522 - RNA, 21 nt, Molluscum contagiosum virus
gcgcggcccgagcaggacgug

SEQ ID NO: 4045523 - RNA, 15 nt, Molluscum contagiosum virus
gcgcggcgagccgcg

SEQ ID NO: 4045524 - RNA, 19 nt, Molluscum contagiosum virus
gcgcggcgagccgcgcgag

SEQ ID NO: 4045525 - RNA, 13 nt, Molluscum contagiosum virus
gcgcggcugcucg

SEQ ID NO: 4045526 - RNA, 22 nt, Molluscum contagiosum virus
gcgcgggaggcguccugcggga

SEQ ID NO: 4045527 - RNA, 22 nt, Molluscum contagiosum virus
gcgcgggccaugucugugcgcg

SEQ ID NO: 4045528 - RNA, 14 nt, Molluscum contagiosum virus
gcgcgguccugucc

SEQ ID NO: 4045529 - RNA, 22 nt, Molluscum contagiosum virus
gcgcggucgcccgccgagcucu

SEQ ID NO: 4045530 - RNA, 13 nt, Molluscum contagiosum virus
gcgcggugagccg

SEQ ID NO: 4045531 - RNA, 15 nt, Molluscum contagiosum virus
gcgcggugcugcgcc

SEQ ID NO: 4045532 - RNA, 19 nt, Molluscum contagiosum virus
gcgcggugcugcgccagga

SEQ ID NO: 4045533 - RNA, 18 nt, Molluscum contagiosum virus
gcgcgguggugcugggcg

SEQ ID NO: 4045534 - RNA, 20 nt, Molluscum contagiosum virus
gcgcguacgcgugcgcuggc

SEQ ID NO: 4045535 - RNA, 13 nt, Molluscum contagiosum virus
gcgggcgcaggcc

SEQ ID NO: 4045536 - RNA, 17 nt, Molluscum contagiosum virus
gcgggcgcaggcccgcc

SEQ ID NO: 4045537 - RNA, 15 nt, Molluscum contagiosum virus
gcgggcgccgggcgc

SEQ ID NO: 4045538 - RNA, 12 nt, Molluscum contagiosum virus
gcgggcgcgcac

SEQ ID NO: 4045539 - RNA, 21 nt, Molluscum contagiosum virus
gcgggcggcacacacuugcac

SEQ ID NO: 4045540 - RNA, 14 nt, Molluscum contagiosum virus
gcgggcggcggccc

SEQ ID NO: 4045541 - RNA, 20 nt, Molluscum contagiosum virus
gcgggcgucaagacucgccc

SEQ ID NO: 4045542 - RNA, 20 nt, Molluscum contagiosum virus
gcgggcguggggagcuggag

SEQ ID NO: 4045543 - RNA, 20 nt, Molluscum contagiosum virus
gcgggcguguccgcgggcgc

SEQ ID NO: 4045544 - RNA, 16 nt, Molluscum contagiosum virus
gcgggcuacucgagca

SEQ ID NO: 4045545 - RNA, 16 nt, Molluscum contagiosum virus
gcggggcccucgagca

SEQ ID NO: 4045546 - RNA, 17 nt, Molluscum contagiosum virus
gcggggccggcuuugcg

SEQ ID NO: 4045547 - RNA, 13 nt, Molluscum contagiosum virus
gcggggcugcugg

SEQ ID NO: 4045548 - RNA, 16 nt, Molluscum contagiosum virus
gcggggcugcuggcgg

SEQ ID NO: 4045549 - RNA, 21 nt, Molluscum contagiosum virus
gcgguccgacucggugcucau

SEQ ID NO: 4045550 - RNA, 22 nt, Molluscum contagiosum virus
gcggugcggcgcacgcugcugu

SEQ ID NO: 4045551 - RNA, 14 nt, Molluscum contagiosum virus
gcgguggcaggcgc

SEQ ID NO: 4045552 - RNA, 22 nt, Molluscum contagiosum virus
gcgguggucuccgcgggcagcc

SEQ ID NO: 4045553 - RNA, 14 nt, Molluscum contagiosum virus
gcgguggugcuggg

SEQ ID NO: 4045554 - RNA, 21 nt, Molluscum contagiosum virus
gcgguucacuagcgcaggcag

SEQ ID NO: 4045555 - RNA, 16 nt, Molluscum contagiosum virus
gcguacauccgcgagc

SEQ ID NO: 4045556 - RNA, 19 nt, Molluscum contagiosum virus
gcguaccaagccgugacgc

SEQ ID NO: 4045557 - RNA, 14 nt, Molluscum contagiosum virus
gcguacgcgugcgc

SEQ ID NO: 4045558 - RNA, 22 nt, Molluscum contagiosum virus
gcguacucgugucacaauggca

SEQ ID NO: 4045559 - RNA, 11 nt, Molluscum contagiosum virus
gcguagagcaa

SEQ ID NO: 4045560 - RNA, 20 nt, Molluscum contagiosum virus
gcguagcuagcucugcgcgc

SEQ ID NO: 4045561 - RNA, 21 nt, Molluscum contagiosum virus
gcguaguaguagcgcucgccc

SEQ ID NO: 4045562 - RNA, 21 nt, Molluscum contagiosum virus
gcguauucgcgucuugaaaug

SEQ ID NO: 4045563 - RNA, 21 nt, Molluscum contagiosum virus
gcgucaagaucaaccgcaagg

SEQ ID NO: 4045564 - RNA, 14 nt, Molluscum contagiosum virus
gcgucaccaccgcu

SEQ ID NO: 4045565 - RNA, 18 nt, Molluscum contagiosum virus
gcgucaugcgcgcgcgcu

SEQ ID NO: 4045566 - RNA, 15 nt, Molluscum contagiosum virus
gcguccggcgcucgc

SEQ ID NO: 4045567 - RNA, 17 nt, Molluscum contagiosum virus
gcgucgacguggagccu

SEQ ID NO: 4045568 - RNA, 17 nt, Molluscum contagiosum virus
gcgucguagacgcgccc

SEQ ID NO: 4045569 - RNA, 14 nt, Molluscum contagiosum virus
gcgucuccgcgagu

SEQ ID NO: 4045570 - RNA, 15 nt, Molluscum contagiosum virus
gcgucugggugccca

SEQ ID NO: 4045571 - RNA, 21 nt, Molluscum contagiosum virus
gcgucuuugucacaauguuug

SEQ ID NO: 4045572 - RNA, 13 nt, Molluscum contagiosum virus
gcgugagagccau

SEQ ID NO: 4045573 - RNA, 21 nt, Molluscum contagiosum virus
gcgugaggaggcggcacugcu

SEQ ID NO: 4045574 - RNA, 18 nt, Molluscum contagiosum virus
gcgugcaggaacgcgcgc

SEQ ID NO: 4045575 - RNA, 23 nt, Molluscum contagiosum virus
gcgugccagcguacggcccgaag

SEQ ID NO: 4045576 - RNA, 23 nt, Molluscum contagiosum virus
gcgugccgcccgaguccgcgcuc

SEQ ID NO: 4045577 - RNA, 17 nt, Molluscum contagiosum virus
gcgugcgagcggcgcgc

SEQ ID NO: 4045578 - RNA, 14 nt, Molluscum contagiosum virus
gcgugcgccgugcg

SEQ ID NO: 4045579 - RNA, 14 nt, Molluscum contagiosum virus
gcgugcgugcacag

SEQ ID NO: 4045580 - RNA, 16 nt, Molluscum contagiosum virus
gcgugcuagcccgcac

SEQ ID NO: 4045581 - RNA, 14 nt, Molluscum contagiosum virus
gcgugcucacgccc

SEQ ID NO: 4045582 - RNA, 13 nt, Molluscum contagiosum virus
gcgugcucgacuc

SEQ ID NO: 4045583 - RNA, 19 nt, Molluscum contagiosum virus
gcgugcucgacucggaugc

SEQ ID NO: 4045584 - RNA, 17 nt, Molluscum contagiosum virus
gcgugcucggugucggu

SEQ ID NO: 4045585 - RNA, 16 nt, Molluscum contagiosum virus
gcgugcugcgcggcgc

SEQ ID NO: 4045586 - RNA, 19 nt, Molluscum contagiosum virus
gcgugcuuguagcgcaagg

SEQ ID NO: 4045587 - RNA, 21 nt, Molluscum contagiosum virus
gcgugcuugugcgccugugcu

SEQ ID NO: 4045588 - RNA, 20 nt, Molluscum contagiosum virus
gcguggacuuuggcgugacc

SEQ ID NO: 4045589 - RNA, 15 nt, Molluscum contagiosum virus
gcguggccaggccgc

SEQ ID NO: 4045590 - RNA, 16 nt, Molluscum contagiosum virus
gcguggcgcaccugcu

SEQ ID NO: 4045591 - RNA, 21 nt, Molluscum contagiosum virus
gcguggggagcuggagcgagu

SEQ ID NO: 4045592 - RNA, 22 nt, Molluscum contagiosum virus
gcguguacucgaaggugcucag

SEQ ID NO: 4045593 - RNA, 15 nt, Molluscum contagiosum virus
gcgugucuggagccc

SEQ ID NO: 4045594 - RNA, 15 nt, Molluscum contagiosum virus
gcguuccaggaacgc

SEQ ID NO: 4045595 - RNA, 14 nt, Molluscum contagiosum virus
gcguucgacagcuc

SEQ ID NO: 4045596 - RNA, 18 nt, Molluscum contagiosum virus
gcguucgcgcgugcugga

SEQ ID NO: 4045597 - RNA, 22 nt, Molluscum contagiosum virus
gcguugccggcgaaccgacugc

SEQ ID NO: 4045598 - RNA, 21 nt, Molluscum contagiosum virus
gcuaccacgggcccgcgcgug

SEQ ID NO: 4045599 - RNA, 16 nt, Molluscum contagiosum virus
gcuaccgcagccacgg

SEQ ID NO: 4045600 - RNA, 24 nt, Molluscum contagiosum virus
gcuaccgcgacggcgugcuggcca

SEQ ID NO: 4045601 - RNA, 16 nt, Molluscum contagiosum virus
gcuaccgcgcgcgcaa

SEQ ID NO: 4045602 - RNA, 15 nt, Molluscum contagiosum virus
gcuaccugcgcaagc

SEQ ID NO: 4045603 - RNA, 19 nt, Molluscum contagiosum virus
gcuaccugguggagcacuu

SEQ ID NO: 4045604 - RNA, 22 nt, Molluscum contagiosum virus
gcuacgacgacaugcacacgca

SEQ ID NO: 4045605 - RNA, 16 nt, Molluscum contagiosum virus
gcuacguuccgcgcgg

SEQ ID NO: 4045606 - RNA, 14 nt, Molluscum contagiosum virus
gcuacugcgcgcgu

SEQ ID NO: 4045607 - RNA, 21 nt, Molluscum contagiosum virus
gcuaggggugccgcugcgcug

SEQ ID NO: 4045608 - RNA, 23 nt, Molluscum contagiosum virus
gcuaguuaccagaggguggcuug

SEQ ID NO: 4045609 - RNA, 15 nt, Molluscum contagiosum virus
gcuaugcgcagcugc

SEQ ID NO: 4045610 - RNA, 12 nt, Molluscum contagiosum virus
gcuaugcuuugc

SEQ ID NO: 4045611 - RNA, 19 nt, Molluscum contagiosum virus
gcucaagacgcugcuggcg

SEQ ID NO: 4045612 - RNA, 14 nt, Molluscum contagiosum virus
gcucaagcacugcc

SEQ ID NO: 4045613 - RNA, 14 nt, Molluscum contagiosum virus
gcucaagugcgucg

SEQ ID NO: 4045614 - RNA, 18 nt, Molluscum contagiosum virus
gcucaaucucgcccagca

SEQ ID NO: 4045615 - RNA, 21 nt, Molluscum contagiosum virus
gcucacgcugcccgcgccgcc

SEQ ID NO: 4045616 - RNA, 15 nt, Molluscum contagiosum virus
gcucacggcugugga

SEQ ID NO: 4045617 - RNA, 20 nt, Molluscum contagiosum virus
gcucauccucccugcgggcg

SEQ ID NO: 4045618 - RNA, 20 nt, Molluscum contagiosum virus
gcucaucggcgagcucuuuu

SEQ ID NO: 4045619 - RNA, 16 nt, Molluscum contagiosum virus
gcucaugcgcaagcag

SEQ ID NO: 4045620 - RNA, 17 nt, Molluscum contagiosum virus
gcuccaugagguacucc

SEQ ID NO: 4045621 - RNA, 17 nt, Molluscum contagiosum virus
gcuccauggagcgccuu

SEQ ID NO: 4045622 - RNA, 14 nt, Molluscum contagiosum virus
gcuccccgccagca

SEQ ID NO: 4045623 - RNA, 16 nt, Molluscum contagiosum virus
gcuccccgccagcacc

SEQ ID NO: 4045624 - RNA, 15 nt, Molluscum contagiosum virus
gcuccccgcgcgcag

SEQ ID NO: 4045625 - RNA, 15 nt, Molluscum contagiosum virus
gcucccgcacgcacc

SEQ ID NO: 4045626 - RNA, 17 nt, Molluscum contagiosum virus
gcucccgcgccacgagc

SEQ ID NO: 4045627 - RNA, 20 nt, Molluscum contagiosum virus
gcuccgaaccccucgugcug

SEQ ID NO: 4045628 - RNA, 22 nt, Molluscum contagiosum virus
gcuccgcgcccggcgggcacau

SEQ ID NO: 4045629 - RNA, 20 nt, Molluscum contagiosum virus
gcuccgcgcggcgcucugcc

SEQ ID NO: 4045630 - RNA, 14 nt, Molluscum contagiosum virus
gcuccggcugcucc

SEQ ID NO: 4045631 - RNA, 15 nt, Molluscum contagiosum virus
gcuccggcugcuccu

SEQ ID NO: 4045632 - RNA, 22 nt, Molluscum contagiosum virus
gcuccggcugcuccucgagcgc

SEQ ID NO: 4045633 - RNA, 17 nt, Molluscum contagiosum virus
gcuccucgagcgccgcc

SEQ ID NO: 4045634 - RNA, 17 nt, Molluscum contagiosum virus
gcuccucgcacgggcgc

SEQ ID NO: 4045635 - RNA, 19 nt, Molluscum contagiosum virus
gcucgcacuugccgggcga

SEQ ID NO: 4045636 - RNA, 22 nt, Molluscum contagiosum virus
gcucgcaggcggugggcgccgc

SEQ ID NO: 4045637 - RNA, 18 nt, Molluscum contagiosum virus
ugaguuucuggugccgcg

SEQ ID NO: 4045638 - RNA, 16 nt, Molluscum contagiosum virus
ugauccuugccaagcc

SEQ ID NO: 4045639 - RNA, 23 nt, Molluscum contagiosum virus
ugcaaagacgguacauauucccu

SEQ ID NO: 4045640 - RNA, 13 nt, Molluscum contagiosum virus
ugcaaagcgcggc

SEQ ID NO: 4045641 - RNA, 18 nt, Molluscum contagiosum virus
ugcaaauugaaaaaacau

SEQ ID NO: 4045642 - RNA, 19 nt, Molluscum contagiosum virus
ugcaagguuuacgccgugc

SEQ ID NO: 4045643 - RNA, 17 nt, Molluscum contagiosum virus
ugcaaguucgcugcugg

SEQ ID NO: 4045644 - RNA, 18 nt, Molluscum contagiosum virus
ugcacaccggcgcgcuga

SEQ ID NO: 4045645 - RNA, 22 nt, Molluscum contagiosum virus
ugcacagcacaggccccagcaa

SEQ ID NO: 4045646 - RNA, 18 nt, Molluscum contagiosum virus
ugcacaguucacggcgcu

SEQ ID NO: 4045647 - RNA, 22 nt, Molluscum contagiosum virus
ugcacaugcccgugcaccuccc

SEQ ID NO: 4045648 - RNA, 13 nt, Molluscum contagiosum virus
ugcacgagccggc

SEQ ID NO: 4045649 - RNA, 17 nt, Molluscum contagiosum virus
ugcacgcuguccaggcg

SEQ ID NO: 4045650 - RNA, 22 nt, Molluscum contagiosum virus
ugcacggcuaccgcgacggcgu

SEQ ID NO: 4045651 - RNA, 15 nt, Molluscum contagiosum virus
ugcacgucgacaagu

SEQ ID NO: 4045652 - RNA, 15 nt, Molluscum contagiosum virus
ugcacguggcgcaca

SEQ ID NO: 4045653 - RNA, 22 nt, Molluscum contagiosum virus
ugcacuacaaccauggcgcgcu

SEQ ID NO: 4045654 - RNA, 13 nt, Molluscum contagiosum virus
ugcacuacugcuc

SEQ ID NO: 4045655 - RNA, 14 nt, Molluscum contagiosum virus
ugcacuacugcucc

SEQ ID NO: 4045656 - RNA, 12 nt, Molluscum contagiosum virus
ugcacugcgcgg

SEQ ID NO: 4045657 - RNA, 18 nt, Molluscum contagiosum virus
ugcacugcgcggcgugcg

SEQ ID NO: 4045658 - RNA, 19 nt, Molluscum contagiosum virus
ugcacuucggacaccucac

SEQ ID NO: 4045659 - RNA, 21 nt, Molluscum contagiosum virus
ugcacuucggacaccucaccu

SEQ ID NO: 4045660 - RNA, 21 nt, Molluscum contagiosum virus
ugcagagcaaggcgagucaau

SEQ ID NO: 4045661 - RNA, 17 nt, Molluscum contagiosum virus
ugcagagcgugcugguc

SEQ ID NO: 4045662 - RNA, 15 nt, Molluscum contagiosum virus
ugcagaugaggcugc

SEQ ID NO: 4045663 - RNA, 18 nt, Molluscum contagiosum virus
ugcagcagguugaagcuc

SEQ ID NO: 4045664 - RNA, 17 nt, Molluscum contagiosum virus
ugcagccgcugcugcug

SEQ ID NO: 4045665 - RNA, 15 nt, Molluscum contagiosum virus
ugcagcgccgcgcgg

SEQ ID NO: 4045666 - RNA, 12 nt, Molluscum contagiosum virus
ugcagcgcgugc

SEQ ID NO: 4045667 - RNA, 15 nt, Molluscum contagiosum virus
ugcagcugcaggacc

SEQ ID NO: 4045668 - RNA, 21 nt, Molluscum contagiosum virus
ugcagcugcaggaccugcugg

SEQ ID NO: 4045669 - RNA, 13 nt, Molluscum contagiosum virus
ugcaggaaaggca

SEQ ID NO: 4045670 - RNA, 16 nt, Molluscum contagiosum virus
ugcaggaacgcgcgcu

SEQ ID NO: 4045671 - RNA, 14 nt, Molluscum contagiosum virus
ugcagggcgugcuu

SEQ ID NO: 4045672 - RNA, 18 nt, Molluscum contagiosum virus
ugcaggucgaggagggcg

SEQ ID NO: 4045673 - RNA, 14 nt, Molluscum contagiosum virus
ugcaguacggcgcg

SEQ ID NO: 4045674 - RNA, 15 nt, Molluscum contagiosum virus
ugcaguugagagcag

SEQ ID NO: 4045675 - RNA, 14 nt, Molluscum contagiosum virus
ugcaugcccagcau

SEQ ID NO: 4045676 - RNA, 15 nt, Molluscum contagiosum virus
ugcaugcggagcugg

SEQ ID NO: 4045677 - RNA, 19 nt, Molluscum contagiosum virus
ugcaugcggagcuggccga

SEQ ID NO: 4045678 - RNA, 20 nt, Molluscum contagiosum virus
ugccacggccgcgcgcgacu

SEQ ID NO: 4045679 - RNA, 21 nt, Molluscum contagiosum virus
ugccagauugccggcgcgcgc

SEQ ID NO: 4045680 - RNA, 17 nt, Molluscum contagiosum virus
ugccaggcggucuucca

SEQ ID NO: 4045681 - RNA, 12 nt, Molluscum contagiosum virus
ugcccacgcgca

SEQ ID NO: 4045682 - RNA, 14 nt, Molluscum contagiosum virus
ugcccagccugacg

SEQ ID NO: 4045683 - RNA, 18 nt, Molluscum contagiosum virus
ugcccccgagguggccaa

SEQ ID NO: 4045684 - RNA, 17 nt, Molluscum contagiosum virus
ugccccgcgcgugcagu

SEQ ID NO: 4045685 - RNA, 17 nt, Molluscum contagiosum virus
ugcccgccaagagcugg

SEQ ID NO: 4045686 - RNA, 14 nt, Molluscum contagiosum virus
ugcccgccugccgc

SEQ ID NO: 4045687 - RNA, 13 nt, Molluscum contagiosum virus
ugcccgcgccgca

SEQ ID NO: 4045688 - RNA, 14 nt, Molluscum contagiosum virus
ugcccgcgcgcugu

SEQ ID NO: 4045689 - RNA, 16 nt, Molluscum contagiosum virus
ugcccggacagagccc

SEQ ID NO: 4045690 - RNA, 14 nt, Molluscum contagiosum virus
ugcccggcagcgag

SEQ ID NO: 4045691 - RNA, 19 nt, Molluscum contagiosum virus
ugccgaggcgcugccgcgg

SEQ ID NO: 4045692 - RNA, 19 nt, Molluscum contagiosum virus
ugccgccgccgcgaggacc

SEQ ID NO: 4045693 - RNA, 14 nt, Molluscum contagiosum virus
ugccgccucggacg

SEQ ID NO: 4045694 - RNA, 20 nt, Molluscum contagiosum virus
ugccgccugcgcgcacccga

SEQ ID NO: 4045695 - RNA, 15 nt, Molluscum contagiosum virus
ugccgcgcgcgccgc

SEQ ID NO: 4045696 - RNA, 17 nt, Molluscum contagiosum virus
ugccgcgcgcugcucug

SEQ ID NO: 4045697 - RNA, 14 nt, Molluscum contagiosum virus
ugccgcggcagugg

SEQ ID NO: 4045698 - RNA, 12 nt, Molluscum contagiosum virus
ugccgcgugcuc

SEQ ID NO: 4045699 - RNA, 18 nt, Molluscum contagiosum virus
ugccgcugccugugccca

SEQ ID NO: 4045700 - RNA, 14 nt, Molluscum contagiosum virus
ugccgcugcgcugg

SEQ ID NO: 4045701 - RNA, 23 nt, Molluscum contagiosum virus
ugccgcugcgcuggaugcugcuc

SEQ ID NO: 4045702 - RNA, 13 nt, Molluscum contagiosum virus
ugccggcgcguga

SEQ ID NO: 4045703 - RNA, 16 nt, Molluscum contagiosum virus
ugccggcgcgugagcg

SEQ ID NO: 4045704 - RNA, 22 nt, Molluscum contagiosum virus
ugccgggcuugcucccucgcgc

SEQ ID NO: 4045705 - RNA, 17 nt, Molluscum contagiosum virus
ugccucugccagccgcu

SEQ ID NO: 4045706 - RNA, 19 nt, Molluscum contagiosum virus
ugccugcaagaggcgcugu

SEQ ID NO: 4045707 - RNA, 15 nt, Molluscum contagiosum virus
ugccugucucgcaag

SEQ ID NO: 4045708 - RNA, 21 nt, Molluscum contagiosum virus
ugccuuggcgcccgugccgcc

SEQ ID NO: 4045709 - RNA, 23 nt, Molluscum contagiosum virus
ugcgaacgcgcaagugugcgcau

SEQ ID NO: 4045710 - RNA, 18 nt, Molluscum contagiosum virus
ugcgagaacuggcgcagc

SEQ ID NO: 4045711 - RNA, 14 nt, Molluscum contagiosum virus
ugcgagcagcccgc

SEQ ID NO: 4045712 - RNA, 12 nt, Molluscum contagiosum virus
ugcgaggccugc

SEQ ID NO: 4045713 - RNA, 14 nt, Molluscum contagiosum virus
ugcgaggcgcgcac

SEQ ID NO: 4045714 - RNA, 16 nt, Molluscum contagiosum virus
ugcgaggcgcgcacgc

SEQ ID NO: 4045715 - RNA, 13 nt, Molluscum contagiosum virus
ugcgagucucugu

SEQ ID NO: 4045716 - RNA, 14 nt, Molluscum contagiosum virus
ugcgaguggcgcgc

SEQ ID NO: 4045717 - RNA, 21 nt, Molluscum contagiosum virus
ugcgcaaagcaacugcggacu

SEQ ID NO: 4045718 - RNA, 20 nt, Molluscum contagiosum virus
ugcgcaacgugcugcgccgc

SEQ ID NO: 4045719 - RNA, 15 nt, Molluscum contagiosum virus
ugcgcaccagcugca

SEQ ID NO: 4045720 - RNA, 17 nt, Molluscum contagiosum virus
ugcgcaccgcgggcugg

SEQ ID NO: 4045721 - RNA, 13 nt, Molluscum contagiosum virus
ugcgcacgcugac

SEQ ID NO: 4045722 - RNA, 15 nt, Molluscum contagiosum virus
ugcgcagcauccucg

SEQ ID NO: 4045723 - RNA, 22 nt, Molluscum contagiosum virus
ugcgcaguuuuuuuccgcaaga

SEQ ID NO: 4045724 - RNA, 13 nt, Molluscum contagiosum virus
ugcgcauggccac

SEQ ID NO: 4045725 - RNA, 18 nt, Molluscum contagiosum virus
ugcgccagcgccuguccg

SEQ ID NO: 4045726 - RNA, 19 nt, Molluscum contagiosum virus
ugcgccuucugccugcccg

SEQ ID NO: 4045727 - RNA, 22 nt, Molluscum contagiosum virus
ugcgcgaccgcaccgagcccgc

SEQ ID NO: 4045728 - RNA, 16 nt, Molluscum contagiosum virus
ugcgcgacgaggaggc

SEQ ID NO: 4045729 - RNA, 17 nt, Molluscum contagiosum virus
ugcgcgcccaggcgcgc

SEQ ID NO: 4045730 - RNA, 15 nt, Molluscum contagiosum virus
ugcgcgccgcgccgc

SEQ ID NO: 4045731 - RNA, 15 nt, Molluscum contagiosum virus
ugcgcgccgcgcugc

SEQ ID NO: 4045732 - RNA, 20 nt, Molluscum contagiosum virus
ugcgcgcgcucgcgcagguc

SEQ ID NO: 4045733 - RNA, 23 nt, Molluscum contagiosum virus
ugcgcgcgguaacgcgcgcgccu

SEQ ID NO: 4045734 - RNA, 13 nt, Molluscum contagiosum virus
ugcgcgcugcgcg

SEQ ID NO: 4045735 - RNA, 15 nt, Molluscum contagiosum virus
ugcgcggacagagcc

SEQ ID NO: 4045736 - RNA, 23 nt, Molluscum contagiosum virus
ugcgcggcccgcgggcugcaaga

SEQ ID NO: 4045737 - RNA, 21 nt, Molluscum contagiosum virus
ugcgcgucaugcgacugccag

SEQ ID NO: 4045738 - RNA, 14 nt, Molluscum contagiosum virus
ugcgcgucugugcg

SEQ ID NO: 4045739 - RNA, 15 nt, Molluscum contagiosum virus
ugcgcgugcugggcc

SEQ ID NO: 4045740 - RNA, 17 nt, Molluscum contagiosum virus
uugacgcccggugccug

SEQ ID NO: 4045741 - RNA, 23 nt, Molluscum contagiosum virus
uugcaccggcaacagcgcgacgc

SEQ ID NO: 4045742 - RNA, 11 nt, Molluscum contagiosum virus
uugcacgugcg

SEQ ID NO: 4045743 - RNA, 20 nt, Molluscum contagiosum virus
uugcccccgagguggccaag

SEQ ID NO: 4045744 - RNA, 16 nt, Molluscum contagiosum virus
uugccgcgcgcugcuc

SEQ ID NO: 4045745 - RNA, 12 nt, Molluscum contagiosum virus
uugcgaggcacc

SEQ ID NO: 4045746 - RNA, 24 nt, Molluscum contagiosum virus
uugcgcagagcuccccgcgcgcag

SEQ ID NO: 4045747 - RNA, 22 nt, Molluscum contagiosum virus
uugcgcgcggugcgggcgcgag

SEQ ID NO: 4045748 - RNA, 14 nt, Molluscum contagiosum virus
uugcgcguccgcaa

SEQ ID NO: 4045749 - RNA, 18 nt, Molluscum contagiosum virus
uugcgugcgccucgcagg

SEQ ID NO: 4045750 - RNA, 24 nt, Molluscum contagiosum virus
uugcgugggugaggagcucgacuc

SEQ ID NO: 4045751 - RNA, 20 nt, Molluscum contagiosum virus
uugcuauuaccugaccgacg

SEQ ID NO: 4045752 - RNA, 15 nt, Molluscum contagiosum virus
uugcucgcuugccgc

SEQ ID NO: 4045753 - RNA, 21 nt, Molluscum contagiosum virus
uugcucggggcugucgcugga

SEQ ID NO: 4045754 - RNA, 12 nt, Molluscum contagiosum virus
uugcucucuuuc

SEQ ID NO: 4045755 - RNA, 19 nt, Molluscum contagiosum virus
uuggcgcccgugccgccgg

SEQ ID NO: 4045756 - RNA, 11 nt, Molluscum contagiosum virus
uuggcgcgcaa

SEQ ID NO: 4045757 - RNA, 13 nt, Molluscum contagiosum virus
uuggcgcgccgcu

SEQ ID NO: 4045758 - RNA, 16 nt, Molluscum contagiosum virus
uuggcuaugaggaggc

SEQ ID NO: 4045759 - RNA, 14 nt, Molluscum contagiosum virus
uugggcacuuccug

SEQ ID NO: 4045760 - RNA, 16 nt, Molluscum contagiosum virus
uuggucaccacgaucu

SEQ ID NO: 4045761 - RNA, 19 nt, Molluscum contagiosum virus
uuguagcgguugaccagcu

SEQ ID NO: 4045762 - RNA, 21 nt, Molluscum contagiosum virus
uuguccucuuggccccucccg

SEQ ID NO: 4045763 - RNA, 13 nt, Molluscum contagiosum virus
uuguccugagccu

SEQ ID NO: 4045764 - RNA, 23 nt, Molluscum contagiosum virus
uugugcaauuccguccagugaaa

SEQ ID NO: 4045765 - RNA, 18 nt, Molluscum contagiosum virus
uuuccgcgaaguccuggg

SEQ ID NO: 4045766 - RNA, 22 nt, Molluscum contagiosum virus
uuuccugucaucaccccgcugg

SEQ ID NO: 4045767 - RNA, 20 nt, Molluscum contagiosum virus
uuucgccggaggaaggacag

SEQ ID NO: 4045768 - RNA, 21 nt, Molluscum contagiosum virus
uuugcgagcacuguacgcacg

SEQ ID NO: 4045769 - RNA, 17 nt, Molluscum contagiosum virus
ccgugggcagcuucugc

SEQ ID NO: 4045770 - RNA, 22 nt, Molluscum contagiosum virus
ccgugguacacguagaggaagu

SEQ ID NO: 4045771 - RNA, 15 nt, Molluscum contagiosum virus
ccguggugcgcgacc

SEQ ID NO: 4045772 - RNA, 19 nt, Molluscum contagiosum virus
ccguguccuacacgccgcu

SEQ ID NO: 4045773 - RNA, 16 nt, Molluscum contagiosum virus
ccgugucggcaccgcg

SEQ ID NO: 4045774 - RNA, 15 nt, Molluscum contagiosum virus
ccguucacgggcacg

SEQ ID NO: 4045775 - RNA, 21 nt, Molluscum contagiosum virus
ccuaccugcaggaggaccgcg

SEQ ID NO: 4045776 - RNA, 22 nt, Molluscum contagiosum virus
ccuacgcgcgcguaacagcgcg

SEQ ID NO: 4045777 - RNA, 20 nt, Molluscum contagiosum virus
ccuacguggcgucgcgccgc

SEQ ID NO: 4045778 - RNA, 19 nt, Molluscum contagiosum virus
ccuagacacgagcgcggca

SEQ ID NO: 4045779 - RNA, 13 nt, Molluscum contagiosum virus
ccuagcuccagcg

SEQ ID NO: 4045780 - RNA, 20 nt, Molluscum contagiosum virus
ccuaggcacuccgcgcaccg

SEQ ID NO: 4045781 - RNA, 20 nt, Molluscum contagiosum virus
ccuaucucaaagaacgcgcg

SEQ ID NO: 4045782 - RNA, 19 nt, Molluscum contagiosum virus
ccucaaggaggcgugcguu

SEQ ID NO: 4045783 - RNA, 15 nt, Molluscum contagiosum virus
ccucaccgcgcacau

SEQ ID NO: 4045784 - RNA, 16 nt, Molluscum contagiosum virus
ccucaccucugcgcgg

SEQ ID NO: 4045785 - RNA, 19 nt, Molluscum contagiosum virus
ccucagccgagcgccgcca

SEQ ID NO: 4045786 - RNA, 16 nt, Molluscum contagiosum virus
ccucaggggcucuccu

SEQ ID NO: 4045787 - RNA, 21 nt, Molluscum contagiosum virus
ccucgaagcgagagguugggg

SEQ ID NO: 4045788 - RNA, 14 nt, Molluscum contagiosum virus
ccucgaccugcacg

SEQ ID NO: 4045789 - RNA, 13 nt, Molluscum contagiosum virus
ccucgagagggag

SEQ ID NO: 4045790 - RNA, 13 nt, Molluscum contagiosum virus
ccucgagcacgcc

SEQ ID NO: 4045791 - RNA, 17 nt, Molluscum contagiosum virus
ccucgagcacgccucca

SEQ ID NO: 4045792 - RNA, 19 nt, Molluscum contagiosum virus
ccucgagcacgccuccaag

SEQ ID NO: 4045793 - RNA, 20 nt, Molluscum contagiosum virus
ccucgagcgccgugcaguug

SEQ ID NO: 4045794 - RNA, 22 nt, Molluscum contagiosum virus
ccucgcaagcugagcgcgcugc

SEQ ID NO: 4045795 - RNA, 19 nt, Molluscum contagiosum virus
ccucgcgagggcucguccu

SEQ ID NO: 4045796 - RNA, 15 nt, Molluscum contagiosum virus
ccucgcgcgccgccg

SEQ ID NO: 4045797 - RNA, 15 nt, Molluscum contagiosum virus
ccucgcggcucuggu

SEQ ID NO: 4045798 - RNA, 22 nt, Molluscum contagiosum virus
ccucgcgggaggcuccugccgu

SEQ ID NO: 4045799 - RNA, 21 nt, Molluscum contagiosum virus
ccucgcucgagggcgccgugc

SEQ ID NO: 4045800 - RNA, 13 nt, Molluscum contagiosum virus
ccucggccagagc

SEQ ID NO: 4045801 - RNA, 15 nt, Molluscum contagiosum virus
ccucggucaacggca

SEQ ID NO: 4045802 - RNA, 15 nt, Molluscum contagiosum virus
ccucgugcugggccu

SEQ ID NO: 4045803 - RNA, 21 nt, Molluscum contagiosum virus
ccucuccggucgcccuccgcc

SEQ ID NO: 4045804 - RNA, 13 nt, Molluscum contagiosum virus
ccucugccagccg

SEQ ID NO: 4045805 - RNA, 14 nt, Molluscum contagiosum virus
ccucugcgcggccc

SEQ ID NO: 4045806 - RNA, 22 nt, Molluscum contagiosum virus
ccucugcuucacgcugcucgug

SEQ ID NO: 4045807 - RNA, 19 nt, Molluscum contagiosum virus
ccucuuggcaaaggcaggg

SEQ ID NO: 4045808 - RNA, 19 nt, Molluscum contagiosum virus
ccugagauccacgcgugcu

SEQ ID NO: 4045809 - RNA, 14 nt, Molluscum contagiosum virus
ccugagcuucuuug

SEQ ID NO: 4045810 - RNA, 23 nt, Molluscum contagiosum virus
ccugaggaagcaagacccagcaa

SEQ ID NO: 4045811 - RNA, 13 nt, Molluscum contagiosum virus
ccugcaaacgcga

SEQ ID NO: 4045812 - RNA, 23 nt, Molluscum contagiosum virus
ccugcaaacgcgaaacuggacug

SEQ ID NO: 4045813 - RNA, 21 nt, Molluscum contagiosum virus
ccugcacaagcaggaguccgu

SEQ ID NO: 4045814 - RNA, 16 nt, Molluscum contagiosum virus
ccugcacgacccucuu

SEQ ID NO: 4045815 - RNA, 16 nt, Molluscum contagiosum virus
ccugcacgagccggcg

SEQ ID NO: 4045816 - RNA, 15 nt, Molluscum contagiosum virus
ccugcacuacugcuc

SEQ ID NO: 4045817 - RNA, 18 nt, Molluscum contagiosum virus
ccugcaggaaaggcaccc

SEQ ID NO: 4045818 - RNA, 15 nt, Molluscum contagiosum virus
ccugccacaccagcu

SEQ ID NO: 4045819 - RNA, 18 nt, Molluscum contagiosum virus
ccugccacaccagcuggc

SEQ ID NO: 4045820 - RNA, 17 nt, Molluscum contagiosum virus
ccugccagcagagcugc

SEQ ID NO: 4045821 - RNA, 18 nt, Molluscum contagiosum virus
ccugccgccugcaggcaa

SEQ ID NO: 4045822 - RNA, 13 nt, Molluscum contagiosum virus
ccugcgcaacgcg

SEQ ID NO: 4045823 - RNA, 22 nt, Molluscum contagiosum virus
ccugcgcaacgugcugcgccgc

SEQ ID NO: 4045824 - RNA, 19 nt, Molluscum contagiosum virus
ccugcgccauccacguggg

SEQ ID NO: 4045825 - RNA, 20 nt, Molluscum contagiosum virus
ccugcgcuuccucuacacca

SEQ ID NO: 4045826 - RNA, 20 nt, Molluscum contagiosum virus
ccugcucgggcugcgcggcg

SEQ ID NO: 4045827 - RNA, 18 nt, Molluscum contagiosum virus
ccugcucuccgcgggaag

SEQ ID NO: 4045828 - RNA, 20 nt, Molluscum contagiosum virus
ccugcugaagaaggagcccu

SEQ ID NO: 4045829 - RNA, 16 nt, Molluscum contagiosum virus
ccugcuggcgugcgua

SEQ ID NO: 4045830 - RNA, 17 nt, Molluscum contagiosum virus
ccugcuuccuccuccaa

SEQ ID NO: 4045831 - RNA, 13 nt, Molluscum contagiosum virus
ccugcuugcccgc

SEQ ID NO: 4045832 - RNA, 14 nt, Molluscum contagiosum virus
ccugcuugucugcc

SEQ ID NO: 4045833 - RNA, 18 nt, Molluscum contagiosum virus
ccuggaacucuacgccgc

SEQ ID NO: 4045834 - RNA, 19 nt, Molluscum contagiosum virus
ccuggagggcagugccaag

SEQ ID NO: 4045835 - RNA, 21 nt, Molluscum contagiosum virus
ccuggagggucacgcgcacau

SEQ ID NO: 4045836 - RNA, 14 nt, Molluscum contagiosum virus
ccuggcagccgagc

SEQ ID NO: 4045837 - RNA, 21 nt, Molluscum contagiosum virus
ccuggggaaccgcugcuucgu

SEQ ID NO: 4045838 - RNA, 22 nt, Molluscum contagiosum virus
ccugguacgcgcgcgcgcucac

SEQ ID NO: 4045839 - RNA, 14 nt, Molluscum contagiosum virus
ccugguaguccugc

SEQ ID NO: 4045840 - RNA, 21 nt, Molluscum contagiosum virus
ccuggugcugcgcgacaugcu

SEQ ID NO: 4045841 - RNA, 19 nt, Molluscum contagiosum virus
ccuggugugccagcggcgc

SEQ ID NO: 4045842 - RNA, 14 nt, Molluscum contagiosum virus
ccugguuugcgcuc

SEQ ID NO: 4045843 - RNA, 19 nt, Molluscum contagiosum virus
ccugucaagacgggcacgc

SEQ ID NO: 4045844 - RNA, 23 nt, Molluscum contagiosum virus
ccugucaucaccccgcugggccg

SEQ ID NO: 4045845 - RNA, 21 nt, Molluscum contagiosum virus
ccugucggcacaucucucagg

SEQ ID NO: 4045846 - RNA, 14 nt, Molluscum contagiosum virus
ccugucgugcaaug

SEQ ID NO: 4045847 - RNA, 16 nt, Molluscum contagiosum virus
ccugugcccuggaagc

SEQ ID NO: 4045848 - RNA, 17 nt, Molluscum contagiosum virus
ccugugccucuugugag

SEQ ID NO: 4045849 - RNA, 17 nt, Molluscum contagiosum virus
ccugugcuacgcgagca

SEQ ID NO: 4045850 - RNA, 23 nt, Molluscum contagiosum virus
ccugugcugugcagaacuucucg

SEQ ID NO: 4045851 - RNA, 19 nt, Molluscum contagiosum virus
ccuucaacgcgcgugcgua

SEQ ID NO: 4045852 - RNA, 22 nt, Molluscum contagiosum virus
ccuuccggagacaccagcuccg

SEQ ID NO: 4045853 - RNA, 23 nt, Molluscum contagiosum virus
ccuuccggagacaccagcuccgc

SEQ ID NO: 4045854 - RNA, 14 nt, Molluscum contagiosum virus
ccuucgcggagcgc

SEQ ID NO: 4045855 - RNA, 20 nt, Molluscum contagiosum virus
ccuucuucgugcugugccua

SEQ ID NO: 4045856 - RNA, 13 nt, Molluscum contagiosum virus
ccuugcagcgcag

SEQ ID NO: 4045857 - RNA, 15 nt, Molluscum contagiosum virus
ccuugucgagacagg

SEQ ID NO: 4045858 - RNA, 12 nt, Molluscum contagiosum virus
ccuuucuuccag

SEQ ID NO: 4045859 - RNA, 18 nt, Molluscum contagiosum virus
cgaacaaaaaacaacucu

SEQ ID NO: 4045860 - RNA, 13 nt, Molluscum contagiosum virus
cgaacaccuccug

SEQ ID NO: 4045861 - RNA, 21 nt, Molluscum contagiosum virus
cgaacaccuccugcuuugcac

SEQ ID NO: 4045862 - RNA, 16 nt, Molluscum contagiosum virus
cgaacagagcgccagc

SEQ ID NO: 4045863 - RNA, 17 nt, Molluscum contagiosum virus
cgaacgagaaaugcgca

SEQ ID NO: 4045864 - RNA, 22 nt, Molluscum contagiosum virus
cgaacgagaaaugcgcacacuu

SEQ ID NO: 4045865 - RNA, 23 nt, Molluscum contagiosum virus
cgaacgagagacacgcacacucg

SEQ ID NO: 4045866 - RNA, 21 nt, Molluscum contagiosum virus
cgaacgagggaugcacacacu

SEQ ID NO: 4045867 - RNA, 17 nt, Molluscum contagiosum virus
cgaacggaacacagugc

SEQ ID NO: 4045868 - RNA, 18 nt, Molluscum contagiosum virus
cgaacuccaggcgcaccu

SEQ ID NO: 4045869 - RNA, 14 nt, Molluscum contagiosum virus
cgaacugcccggcg

SEQ ID NO: 4045870 - RNA, 18 nt, Molluscum contagiosum virus
cgaagaaggggccgaagu

SEQ ID NO: 4045871 - RNA, 19 nt, Molluscum contagiosum virus
cgaagaccaccagcaccag

SEQ ID NO: 4045872 - RNA, 18 nt, Molluscum contagiosum virus
cucgagacccacaauggu

SEQ ID NO: 4045873 - RNA, 21 nt, Molluscum contagiosum virus
cucgagcgcgcgccugcuggc

SEQ ID NO: 4045874 - RNA, 22 nt, Molluscum contagiosum virus
cucgaugccaacagacuugucc

SEQ ID NO: 4045875 - RNA, 16 nt, Molluscum contagiosum virus
cucgaugggcuccagg

SEQ ID NO: 4045876 - RNA, 17 nt, Molluscum contagiosum virus
cucgcacacgugcacgu

SEQ ID NO: 4045877 - RNA, 21 nt, Molluscum contagiosum virus
cucgcagccuccgugcgccag

SEQ ID NO: 4045878 - RNA, 20 nt, Molluscum contagiosum virus
cucgcagcguuccaggaacg

SEQ ID NO: 4045879 - RNA, 19 nt, Molluscum contagiosum virus
cucgcaggcggugggcgcc

SEQ ID NO: 4045880 - RNA, 14 nt, Molluscum contagiosum virus
cucgcccagcucga

SEQ ID NO: 4045881 - RNA, 20 nt, Molluscum contagiosum virus
cucgcccgacuuuucgcgcc

SEQ ID NO: 4045882 - RNA, 14 nt, Molluscum contagiosum virus
cucgcccgcgcgcg

SEQ ID NO: 4045883 - RNA, 17 nt, Molluscum contagiosum virus
cucgcgacgugcgcgcu

SEQ ID NO: 4045884 - RNA, 15 nt, Molluscum contagiosum virus
cucgcgagugugcau

SEQ ID NO: 4045885 - RNA, 20 nt, Molluscum contagiosum virus
cucgcgcaauacugcgggcu

SEQ ID NO: 4045886 - RNA, 17 nt, Molluscum contagiosum virus
cucgcgcacgaccacgu

SEQ ID NO: 4045887 - RNA, 15 nt, Molluscum contagiosum virus
cucgcgcgacuggca

SEQ ID NO: 4045888 - RNA, 20 nt, Molluscum contagiosum virus
cucgcgcgcagcucgcacac

SEQ ID NO: 4045889 - RNA, 18 nt, Molluscum contagiosum virus
cucgcgcgccagcacgcg

SEQ ID NO: 4045890 - RNA, 17 nt, Molluscum contagiosum virus
cucgcgcucuacgccag

SEQ ID NO: 4045891 - RNA, 19 nt, Molluscum contagiosum virus
cucgcggaagaauuccuuc

SEQ ID NO: 4045892 - RNA, 15 nt, Molluscum contagiosum virus
cucgcggucaauguu

SEQ ID NO: 4045893 - RNA, 19 nt, Molluscum contagiosum virus
cucgcgugccgcggacgcc

SEQ ID NO: 4045894 - RNA, 23 nt, Molluscum contagiosum virus
cucgcugccuggugcacacacac

SEQ ID NO: 4045895 - RNA, 14 nt, Molluscum contagiosum virus
cucgcuuagccaac

SEQ ID NO: 4045896 - RNA, 19 nt, Molluscum contagiosum virus
cucggaaaauccgcgcccg

SEQ ID NO: 4045897 - RNA, 19 nt, Molluscum contagiosum virus
cucggagaagaacagcacg

SEQ ID NO: 4045898 - RNA, 21 nt, Molluscum contagiosum virus
cucggagaagaacagcacgaa

SEQ ID NO: 4045899 - RNA, 13 nt, Molluscum contagiosum virus
cucggaggcgcag

SEQ ID NO: 4045900 - RNA, 18 nt, Molluscum contagiosum virus
cucggaggcuugccccgc

SEQ ID NO: 4045901 - RNA, 19 nt, Molluscum contagiosum virus
cucggcugccgugcgggcg

SEQ ID NO: 4045902 - RNA, 13 nt, Molluscum contagiosum virus
cucgggcugcgcg

SEQ ID NO: 4045903 - RNA, 22 nt, Molluscum contagiosum virus
cucgggugcccggacagagccc

SEQ ID NO: 4045904 - RNA, 18 nt, Molluscum contagiosum virus
cucgguagcguggagcug

SEQ ID NO: 4045905 - RNA, 18 nt, Molluscum contagiosum virus
cucguacucguugccgug

SEQ ID NO: 4045906 - RNA, 17 nt, Molluscum contagiosum virus
cucgucgccgggccccu

SEQ ID NO: 4045907 - RNA, 15 nt, Molluscum contagiosum virus
cucgugcccgcacac

SEQ ID NO: 4045908 - RNA, 15 nt, Molluscum contagiosum virus
cucgugcugcucugc

SEQ ID NO: 4045909 - RNA, 17 nt, Molluscum contagiosum virus
cucgugcugggccugcc

SEQ ID NO: 4045910 - RNA, 17 nt, Molluscum contagiosum virus
cucgugguugcgcacgu

SEQ ID NO: 4045911 - RNA, 13 nt, Molluscum contagiosum virus
cucuacgagacuc

SEQ ID NO: 4045912 - RNA, 19 nt, Molluscum contagiosum virus
cucuacgccgcgcaccugg

SEQ ID NO: 4045913 - RNA, 16 nt, Molluscum contagiosum virus
cucucgagcucacagg

SEQ ID NO: 4045914 - RNA, 22 nt, Molluscum contagiosum virus
cucucggcguccgcagcggcgc

SEQ ID NO: 4045915 - RNA, 23 nt, Molluscum contagiosum virus
cucugcacgggcacgccgugggc

SEQ ID NO: 4045916 - RNA, 19 nt, Molluscum contagiosum virus
cucugccugcaaggagguc

SEQ ID NO: 4045917 - RNA, 23 nt, Molluscum contagiosum virus
cucugcgaucgcgggcacgagca

SEQ ID NO: 4045918 - RNA, 15 nt, Molluscum contagiosum virus
cucugcguguacgac

SEQ ID NO: 4045919 - RNA, 23 nt, Molluscum contagiosum virus
cucugcucgugcccgcacacgca

SEQ ID NO: 4045920 - RNA, 19 nt, Molluscum contagiosum virus
cucuggagcggccacucuc

SEQ ID NO: 4045921 - RNA, 18 nt, Molluscum contagiosum virus
cucuggcuucuccaccuu

SEQ ID NO: 4045922 - RNA, 17 nt, Molluscum contagiosum virus
cucugggcgucgcacag

SEQ ID NO: 4045923 - RNA, 20 nt, Molluscum contagiosum virus
cucuggucgagaugcucuac

SEQ ID NO: 4045924 - RNA, 18 nt, Molluscum contagiosum virus
cucuuccccgcgggccgc

SEQ ID NO: 4045925 - RNA, 13 nt, Molluscum contagiosum virus
cugaaccugggcg

SEQ ID NO: 4045926 - RNA, 16 nt, Molluscum contagiosum virus
cugaagaaggagcccu

SEQ ID NO: 4045927 - RNA, 17 nt, Molluscum contagiosum virus
cugaauaaucucgagca

SEQ ID NO: 4045928 - RNA, 18 nt, Molluscum contagiosum virus
cugacacgcucuucggca

SEQ ID NO: 4045929 - RNA, 19 nt, Molluscum contagiosum virus
cugaccgcgggcacgggca

SEQ ID NO: 4045930 - RNA, 18 nt, Molluscum contagiosum virus
cugacgccgauguccugc

SEQ ID NO: 4045931 - RNA, 23 nt, Molluscum contagiosum virus
cugagcgugucgaagcgcgcagc

SEQ ID NO: 4045932 - RNA, 23 nt, Molluscum contagiosum virus
cugagcuagugccgagcucgccu

SEQ ID NO: 4045933 - RNA, 17 nt, Molluscum contagiosum virus
cugaggaagcaagaccc

SEQ ID NO: 4045934 - RNA, 20 nt, Molluscum contagiosum virus
cugcacgacguacgagugcu

SEQ ID NO: 4045935 - RNA, 14 nt, Molluscum contagiosum virus
cugcacgagcugcu

SEQ ID NO: 4045936 - RNA, 21 nt, Molluscum contagiosum virus
cugcacgucgaagaccaccag

SEQ ID NO: 4045937 - RNA, 15 nt, Molluscum contagiosum virus
cugcacuacugcucc

SEQ ID NO: 4045938 - RNA, 16 nt, Molluscum contagiosum virus
cugcacugcagcgagc

SEQ ID NO: 4045939 - RNA, 17 nt, Molluscum contagiosum virus
cugcacuucggacaccu

SEQ ID NO: 4045940 - RNA, 18 nt, Molluscum contagiosum virus
cugcagaaacagccgugc

SEQ ID NO: 4045941 - RNA, 21 nt, Molluscum contagiosum virus
cugcagcagcuccagcauggc

SEQ ID NO: 4045942 - RNA, 23 nt, Molluscum contagiosum virus
cugcagcugcgcgagccgcugca

SEQ ID NO: 4045943 - RNA, 22 nt, Molluscum contagiosum virus
cugcaggaaaggcacccgcagg

SEQ ID NO: 4045944 - RNA, 16 nt, Molluscum contagiosum virus
cugcaggaccugcugg

SEQ ID NO: 4045945 - RNA, 20 nt, Molluscum contagiosum virus
cugcaggaccugcugguggu

SEQ ID NO: 4045946 - RNA, 16 nt, Molluscum contagiosum virus
cugcauacacuuccug

SEQ ID NO: 4045947 - RNA, 15 nt, Molluscum contagiosum virus
cugcauccuggggaa

SEQ ID NO: 4045948 - RNA, 16 nt, Molluscum contagiosum virus
cugccacggcugcaag

SEQ ID NO: 4045949 - RNA, 14 nt, Molluscum contagiosum virus
cugccagcagagcu

SEQ ID NO: 4045950 - RNA, 22 nt, Molluscum contagiosum virus
cugccagcucgacacugugcug

SEQ ID NO: 4045951 - RNA, 13 nt, Molluscum contagiosum virus
cugccauggcagc

SEQ ID NO: 4045952 - RNA, 16 nt, Molluscum contagiosum virus
cugccauggcagcucg

SEQ ID NO: 4045953 - RNA, 13 nt, Molluscum contagiosum virus
cugccccucgggg

SEQ ID NO: 4045954 - RNA, 19 nt, Molluscum contagiosum virus
cugcccgaguuucggaaga

SEQ ID NO: 4045955 - RNA, 15 nt, Molluscum contagiosum virus
cugcccucgggagaa

SEQ ID NO: 4045956 - RNA, 13 nt, Molluscum contagiosum virus
cugccgcagagcc

SEQ ID NO: 4045957 - RNA, 15 nt, Molluscum contagiosum virus
cugccgcagagccgc

SEQ ID NO: 4045958 - RNA, 18 nt, Molluscum contagiosum virus
cugccgcuugaaggacgc

SEQ ID NO: 4045959 - RNA, 17 nt, Molluscum contagiosum virus
cugccgucgcgcgcugu

SEQ ID NO: 4045960 - RNA, 15 nt, Molluscum contagiosum virus
cugccgugcgggcgc

SEQ ID NO: 4045961 - RNA, 18 nt, Molluscum contagiosum virus
cugccuagguccacauuu

SEQ ID NO: 4045962 - RNA, 23 nt, Molluscum contagiosum virus
cugccucguggaacaaagaggca

SEQ ID NO: 4045963 - RNA, 20 nt, Molluscum contagiosum virus
cugcgcaacgcgggccaggc

SEQ ID NO: 4045964 - RNA, 13 nt, Molluscum contagiosum virus
cugcgcaagcgcu

SEQ ID NO: 4045965 - RNA, 19 nt, Molluscum contagiosum virus
cugcgcaagcucagccucu

SEQ ID NO: 4045966 - RNA, 12 nt, Molluscum contagiosum virus
cugcgcaauaag

SEQ ID NO: 4045967 - RNA, 19 nt, Molluscum contagiosum virus
cugcgcaauaaggcggugg

SEQ ID NO: 4045968 - RNA, 17 nt, Molluscum contagiosum virus
cugcgcacgggcgcgcg

SEQ ID NO: 4045969 - RNA, 19 nt, Molluscum contagiosum virus
cugcgcaucugcgagcgcg

SEQ ID NO: 4045970 - RNA, 20 nt, Molluscum contagiosum virus
cugcgccaagguggccaagc

SEQ ID NO: 4045971 - RNA, 21 nt, Molluscum contagiosum virus
cugcgcccgcaaaccuuggcc

SEQ ID NO: 4045972 - RNA, 20 nt, Molluscum contagiosum virus
cugcgcgacaugcugcccgc

SEQ ID NO: 4045973 - RNA, 18 nt, Molluscum contagiosum virus
cugcgcgagcagcugcug

SEQ ID NO: 4045974 - RNA, 12 nt, Molluscum contagiosum virus
cuuagccacugu

SEQ ID NO: 4045975 - RNA, 23 nt, Molluscum contagiosum virus
cuuagcuuccgucugcugcucga

SEQ ID NO: 4045976 - RNA, 14 nt, Molluscum contagiosum virus
cuuaugcauccuga

SEQ ID NO: 4045977 - RNA, 18 nt, Molluscum contagiosum virus
cuucaaguuccuggagcc

SEQ ID NO: 4045978 - RNA, 16 nt, Molluscum contagiosum virus
cuucaggaacaaggcc

SEQ ID NO: 4045979 - RNA, 13 nt, Molluscum contagiosum virus
cuuccagcacugc

SEQ ID NO: 4045980 - RNA, 18 nt, Molluscum contagiosum virus
cuuccccgcacaagggca

SEQ ID NO: 4045981 - RNA, 17 nt, Molluscum contagiosum virus
cuuccccguccuugcuc

SEQ ID NO: 4045982 - RNA, 20 nt, Molluscum contagiosum virus
cuucccgcugagcgcagcac

SEQ ID NO: 4045983 - RNA, 21 nt, Molluscum contagiosum virus
cuucccgcugagcgcagcaca

SEQ ID NO: 4045984 - RNA, 22 nt, Molluscum contagiosum virus
cuucccguuccugggcaacgcg

SEQ ID NO: 4045985 - RNA, 19 nt, Molluscum contagiosum virus
cuuccgcaccuggucgagc

SEQ ID NO: 4045986 - RNA, 21 nt, Molluscum contagiosum virus
cuuccggagacaccagcuccg

SEQ ID NO: 4045987 - RNA, 17 nt, Molluscum contagiosum virus
cuuccggggcgggcggc

SEQ ID NO: 4045988 - RNA, 20 nt, Molluscum contagiosum virus
cuuccucuacaccagcugga

SEQ ID NO: 4045989 - RNA, 14 nt, Molluscum contagiosum virus
cuucgaccucugcu

SEQ ID NO: 4045990 - RNA, 22 nt, Molluscum contagiosum virus
cuucgacuuacggacgcccucc

SEQ ID NO: 4045991 - RNA, 19 nt, Molluscum contagiosum virus
cuucgcgggauacgggcgc

SEQ ID NO: 4045992 - RNA, 20 nt, Molluscum contagiosum virus
cuucgcguuccggcggcugg

SEQ ID NO: 4045993 - RNA, 22 nt, Molluscum contagiosum virus
cuucggcgcaacgcuggccgcc

SEQ ID NO: 4045994 - RNA, 21 nt, Molluscum contagiosum virus
cuucgguuucuaugcccagcc

SEQ ID NO: 4045995 - RNA, 17 nt, Molluscum contagiosum virus
cuucgucaagcagcgcg

SEQ ID NO: 4045996 - RNA, 20 nt, Molluscum contagiosum virus
cuucgucaagcagcgcgcca

SEQ ID NO: 4045997 - RNA, 15 nt, Molluscum contagiosum virus
cuucgugcgcggaga

SEQ ID NO: 4045998 - RNA, 16 nt, Molluscum contagiosum virus
cuucgugcugugccua

SEQ ID NO: 4045999 - RNA, 14 nt, Molluscum contagiosum virus
cuucguggacgagc

SEQ ID NO: 4046000 - RNA, 13 nt, Molluscum contagiosum virus
cuucucgucgaga

SEQ ID NO: 4046001 - RNA, 21 nt, Molluscum contagiosum virus
cuucuggcaaacgcacugugu

SEQ ID NO: 4046002 - RNA, 14 nt, Molluscum contagiosum virus
cuucuuggagcccu

SEQ ID NO: 4046003 - RNA, 19 nt, Molluscum contagiosum virus
cuugcucacgcugcgcucg

SEQ ID NO: 4046004 - RNA, 18 nt, Molluscum contagiosum virus
cuugcucggacacacgca

SEQ ID NO: 4046005 - RNA, 18 nt, Molluscum contagiosum virus
cuugcuggcgcgcggaga

SEQ ID NO: 4046006 - RNA, 15 nt, Molluscum contagiosum virus
cuuggcagcaacugc

SEQ ID NO: 4046007 - RNA, 20 nt, Molluscum contagiosum virus
cuuggccaagcuuugcacgc

SEQ ID NO: 4046008 - RNA, 13 nt, Molluscum contagiosum virus
cuuggcgagcgcu

SEQ ID NO: 4046009 - RNA, 17 nt, Molluscum contagiosum virus
cuuggcgcccgugccgc

SEQ ID NO: 4046010 - RNA, 15 nt, Molluscum contagiosum virus
cuuggcgcccuuccu

SEQ ID NO: 4046011 - RNA, 16 nt, Molluscum contagiosum virus
cuuggcgcgccgcugc

SEQ ID NO: 4046012 - RNA, 20 nt, Molluscum contagiosum virus
cuuggcgcgccgcugcccgc

SEQ ID NO: 4046013 - RNA, 23 nt, Molluscum contagiosum virus
cuuggcggcgcggcuagcaccgc

SEQ ID NO: 4046014 - RNA, 20 nt, Molluscum contagiosum virus
cuugggcacugcuacgagcc

SEQ ID NO: 4046015 - RNA, 13 nt, Molluscum contagiosum virus
cuugggcucuggc

SEQ ID NO: 4046016 - RNA, 20 nt, Molluscum contagiosum virus
cuuucaggggucugucguuu

SEQ ID NO: 4046017 - RNA, 13 nt, Molluscum contagiosum virus
cuuuccccggcgu

SEQ ID NO: 4046018 - RNA, 15 nt, Molluscum contagiosum virus
cuuucccgggcacug

SEQ ID NO: 4046019 - RNA, 14 nt, Molluscum contagiosum virus
cuuuccgugcuuga

SEQ ID NO: 4046020 - RNA, 14 nt, Molluscum contagiosum virus
cuuucuccaugucg

SEQ ID NO: 4046021 - RNA, 23 nt, Molluscum contagiosum virus
cuuugaggaacuagugcugcugg

SEQ ID NO: 4046022 - RNA, 22 nt, Molluscum contagiosum virus
cuuuuccgcgaaguccugggcg

SEQ ID NO: 4046023 - RNA, 22 nt, Molluscum contagiosum virus
cuuuucgcgccgcgggcacaug

SEQ ID NO: 4046024 - RNA, 23 nt, Molluscum contagiosum virus
cuuuucgggcaaacgccagugcu

SEQ ID NO: 4046025 - RNA, 22 nt, Molluscum contagiosum virus
cuuuugcgcgagagcuacagca

SEQ ID NO: 4046026 - RNA, 16 nt, Molluscum contagiosum virus
cuuuuugcggcgccgc

SEQ ID NO: 4046027 - RNA, 15 nt, Molluscum contagiosum virus
gaaaaaucccccgcc

SEQ ID NO: 4046028 - RNA, 17 nt, Molluscum contagiosum virus
gaaaacuuguggcgcaa

SEQ ID NO: 4046029 - RNA, 23 nt, Molluscum contagiosum virus
gaaaaggcacaccccgggaacga

SEQ ID NO: 4046030 - RNA, 20 nt, Molluscum contagiosum virus
gaaaaggcugauccugcgcg

SEQ ID NO: 4046031 - RNA, 22 nt, Molluscum contagiosum virus
gaaaauuuaaucaaggauuuaa

SEQ ID NO: 4046032 - RNA, 13 nt, Molluscum contagiosum virus
gaaacaagcgugu

SEQ ID NO: 4046033 - RNA, 22 nt, Molluscum contagiosum virus
gaaacaguaggacauguccggc

SEQ ID NO: 4046034 - RNA, 21 nt, Molluscum contagiosum virus
gaaacgcacagccccugcugc

SEQ ID NO: 4046035 - RNA, 21 nt, Molluscum contagiosum virus
gaaacucuccgacgugcugcg

SEQ ID NO: 4046036 - RNA, 20 nt, Molluscum contagiosum virus
gaaacugcugcccgcgcagc

SEQ ID NO: 4046037 - RNA, 19 nt, Molluscum contagiosum virus
gaaacuggacugagccgca

SEQ ID NO: 4046038 - RNA, 21 nt, Molluscum contagiosum virus
gaaaggcaccccgaaggaaag

SEQ ID NO: 4046039 - RNA, 18 nt, Molluscum contagiosum virus
gaaaggcaccccgcagga

SEQ ID NO: 4046040 - RNA, 22 nt, Molluscum contagiosum virus
gaaaggccccccgcaacaagga

SEQ ID NO: 4046041 - RNA, 16 nt, Molluscum contagiosum virus
gaacaagaagcgcuuc

SEQ ID NO: 4046042 - RNA, 22 nt, Molluscum contagiosum virus
gaacaaugcugcaucuagccuc

SEQ ID NO: 4046043 - RNA, 20 nt, Molluscum contagiosum virus
gaacaccccgagcuggugau

SEQ ID NO: 4046044 - RNA, 17 nt, Molluscum contagiosum virus
gaacacgggggcugccg

SEQ ID NO: 4046045 - RNA, 14 nt, Molluscum contagiosum virus
gaacaucagcacgg

SEQ ID NO: 4046046 - RNA, 21 nt, Molluscum contagiosum virus
gaaccccucgugcugggccug

SEQ ID NO: 4046047 - RNA, 23 nt, Molluscum contagiosum virus
gaaccugugcgcgguggugcugg

SEQ ID NO: 4046048 - RNA, 16 nt, Molluscum contagiosum virus
gaacgaggagggcagc

SEQ ID NO: 4046049 - RNA, 16 nt, Molluscum contagiosum virus
gaacgaggcugcugcc

SEQ ID NO: 4046050 - RNA, 17 nt, Molluscum contagiosum virus
gaacgcgcaagugugcg

SEQ ID NO: 4046051 - RNA, 19 nt, Molluscum contagiosum virus
gaacgcgcaagugugcgca

SEQ ID NO: 4046052 - RNA, 11 nt, Molluscum contagiosum virus
gaacgcgcgcu

SEQ ID NO: 4046053 - RNA, 23 nt, Molluscum contagiosum virus
gaacgcgcugcgccacugccacg

SEQ ID NO: 4046054 - RNA, 18 nt, Molluscum contagiosum virus
gaacgugacgcgccucga

SEQ ID NO: 4046055 - RNA, 16 nt, Molluscum contagiosum virus
gaacguuggcccgcaa

SEQ ID NO: 4046056 - RNA, 20 nt, Molluscum contagiosum virus
gaacucggcuucugcugcac

SEQ ID NO: 4046057 - RNA, 14 nt, Molluscum contagiosum virus
gaacugcugggcgu

SEQ ID NO: 4046058 - RNA, 14 nt, Molluscum contagiosum virus
gaagaccaccagca

SEQ ID NO: 4046059 - RNA, 17 nt, Molluscum contagiosum virus
gaagaccaccagcacca

SEQ ID NO: 4046060 - RNA, 16 nt, Molluscum contagiosum virus
gaagacggcgcgcgcg

SEQ ID NO: 4046061 - RNA, 16 nt, Molluscum contagiosum virus
gaagacgucggggcgc

SEQ ID NO: 4046062 - RNA, 22 nt, Molluscum contagiosum virus
gaagacgugcugcgcgcccagg

SEQ ID NO: 4046063 - RNA, 20 nt, Molluscum contagiosum virus
gaagacguuuacguccacgc

SEQ ID NO: 4046064 - RNA, 18 nt, Molluscum contagiosum virus
gaagacuugccgucucgc

SEQ ID NO: 4046065 - RNA, 17 nt, Molluscum contagiosum virus
gaagagggucgugcagg

SEQ ID NO: 4046066 - RNA, 12 nt, Molluscum contagiosum virus
gaagaggucucu

SEQ ID NO: 4046067 - RNA, 19 nt, Molluscum contagiosum virus
gaagcaacgacaaggaaag

SEQ ID NO: 4046068 - RNA, 18 nt, Molluscum contagiosum virus
gaagcaaugcgcaaggcc

SEQ ID NO: 4046069 - RNA, 23 nt, Molluscum contagiosum virus
gaagcaggcgccaucgcgcguga

SEQ ID NO: 4046070 - RNA, 14 nt, Molluscum contagiosum virus
gaagcagugcucgg

SEQ ID NO: 4046071 - RNA, 17 nt, Molluscum contagiosum virus
gaagcagugcucgggag

SEQ ID NO: 4046072 - RNA, 17 nt, Molluscum contagiosum virus
gaagcccgucggggcag

SEQ ID NO: 4046073 - RNA, 17 nt, Molluscum contagiosum virus
gaagcccugagaaggag

SEQ ID NO: 4046074 - RNA, 16 nt, Molluscum contagiosum virus
gaagcucucgcgcgca

SEQ ID NO: 4046075 - RNA, 16 nt, Molluscum contagiosum virus
gaagcuugcucagcag

SEQ ID NO: 4046076 - RNA, 23 nt, Molluscum contagiosum virus
gacgugcuccgaguccagcuucu

SEQ ID NO: 4046077 - RNA, 13 nt, Molluscum contagiosum virus
gacgugcugcugc

SEQ ID NO: 4046078 - RNA, 13 nt, Molluscum contagiosum virus
gacgugggcgacg

SEQ ID NO: 4046079 - RNA, 14 nt, Molluscum contagiosum virus
gacuaccugcugcu

SEQ ID NO: 4046080 - RNA, 15 nt, Molluscum contagiosum virus
gacuacgcacuggcg

SEQ ID NO: 4046081 - RNA, 18 nt, Molluscum contagiosum virus
gacuacgcgcugcggcgc

SEQ ID NO: 4046082 - RNA, 22 nt, Molluscum contagiosum virus
gacuccaaggaggucccuagcc

SEQ ID NO: 4046083 - RNA, 17 nt, Molluscum contagiosum virus
gacucgagccccagaag

SEQ ID NO: 4046084 - RNA, 17 nt, Molluscum contagiosum virus
gacucgcgucugcaagg

SEQ ID NO: 4046085 - RNA, 23 nt, Molluscum contagiosum virus
gacucgcugccagagauccgccc

SEQ ID NO: 4046086 - RNA, 17 nt, Molluscum contagiosum virus
gacuggccucguccugg

SEQ ID NO: 4046087 - RNA, 22 nt, Molluscum contagiosum virus
gacuucccgacgucuuccccaa

SEQ ID NO: 4046088 - RNA, 23 nt, Molluscum contagiosum virus
gacuuugacuacuacguggugcg

SEQ ID NO: 4046089 - RNA, 18 nt, Molluscum contagiosum virus
gagaaagaagugugccug

SEQ ID NO: 4046090 - RNA, 18 nt, Molluscum contagiosum virus
gagaacuacaaaacugaa

SEQ ID NO: 4046091 - RNA, 18 nt, Molluscum contagiosum virus
gagaagcaaugcgcaagg

SEQ ID NO: 4046092 - RNA, 20 nt, Molluscum contagiosum virus
gagaagcaaugcgcaaggcc

SEQ ID NO: 4046093 - RNA, 18 nt, Molluscum contagiosum virus
gagaccugucgugcaaug

SEQ ID NO: 4046094 - RNA, 17 nt, Molluscum contagiosum virus
gagacgcggccgcggag

SEQ ID NO: 4046095 - RNA, 23 nt, Molluscum contagiosum virus
gagacgcugccggcaacgcugcc

SEQ ID NO: 4046096 - RNA, 15 nt, Molluscum contagiosum virus
gagacgcugcugcac

SEQ ID NO: 4046097 - RNA, 22 nt, Molluscum contagiosum virus
gagacugcuacgucgcggcgca

SEQ ID NO: 4046098 - RNA, 14 nt, Molluscum contagiosum virus
gagacuucuugcac

SEQ ID NO: 4046099 - RNA, 15 nt, Molluscum contagiosum virus
gagaggagugaaggg

SEQ ID NO: 4046100 - RNA, 14 nt, Molluscum contagiosum virus
gagagugcgggagc

SEQ ID NO: 4046101 - RNA, 17 nt, Molluscum contagiosum virus
gagaguucugcgcccgc

SEQ ID NO: 4046102 - RNA, 20 nt, Molluscum contagiosum virus
gagaguucugcgcccgcgga

SEQ ID NO: 4046103 - RNA, 20 nt, Molluscum contagiosum virus
gagauccacgcgugcugcgc

SEQ ID NO: 4046104 - RNA, 17 nt, Molluscum contagiosum virus
gagaucgacaagaucaa

SEQ ID NO: 4046105 - RNA, 21 nt, Molluscum contagiosum virus
gagauggaggcccaggccaug

SEQ ID NO: 4046106 - RNA, 16 nt, Molluscum contagiosum virus
gagauggucacgcgca

SEQ ID NO: 4046107 - RNA, 15 nt, Molluscum contagiosum virus
gagauugagcucuuu

SEQ ID NO: 4046108 - RNA, 17 nt, Molluscum contagiosum virus
gagcaaggccuggccuu

SEQ ID NO: 4046109 - RNA, 22 nt, Molluscum contagiosum virus
gagcaaugcgagcaaggcgcgc

SEQ ID NO: 4046110 - RNA, 21 nt, Molluscum contagiosum virus
gagcaauggcggccugcccug

SEQ ID NO: 4046111 - RNA, 17 nt, Molluscum contagiosum virus
gagcaccugucgcgcga

SEQ ID NO: 4046112 - RNA, 23 nt, Molluscum contagiosum virus
gagcacgacuacggcgagcccau

SEQ ID NO: 4046113 - RNA, 16 nt, Molluscum contagiosum virus
gagcacggacagcacc

SEQ ID NO: 4046114 - RNA, 17 nt, Molluscum contagiosum virus
gagcacggacagcaccc

SEQ ID NO: 4046115 - RNA, 22 nt, Molluscum contagiosum virus
gagcacguuccaaaagacagag

SEQ ID NO: 4046116 - RNA, 15 nt, Molluscum contagiosum virus
gagcagaaggugcgc

SEQ ID NO: 4046117 - RNA, 17 nt, Molluscum contagiosum virus
gagcagcgcuugcgcgc

SEQ ID NO: 4046118 - RNA, 14 nt, Molluscum contagiosum virus
gagcagcugcugcg

SEQ ID NO: 4046119 - RNA, 15 nt, Molluscum contagiosum virus
gagcaggagaacuac

SEQ ID NO: 4046120 - RNA, 21 nt, Molluscum contagiosum virus
gagcaggcgcagcgcggccug

SEQ ID NO: 4046121 - RNA, 21 nt, Molluscum contagiosum virus
gagcaguccgccucgagcacg

SEQ ID NO: 4046122 - RNA, 17 nt, Molluscum contagiosum virus
gagcagugccgccgcgc

SEQ ID NO: 4046123 - RNA, 22 nt, Molluscum contagiosum virus
gagcaguucgcgcgccugcgcg

SEQ ID NO: 4046124 - RNA, 13 nt, Molluscum contagiosum virus
gagccagccaggc

SEQ ID NO: 4046125 - RNA, 13 nt, Molluscum contagiosum virus
gagccagcgcgga

SEQ ID NO: 4046126 - RNA, 19 nt, Molluscum contagiosum virus
gagcccggaucagccccgc

SEQ ID NO: 4046127 - RNA, 19 nt, Molluscum contagiosum virus
gagcccgggcccgagcccg

SEQ ID NO: 4046128 - RNA, 21 nt, Molluscum contagiosum virus
gagcccgggcccgugcccgag

SEQ ID NO: 4046129 - RNA, 18 nt, Molluscum contagiosum virus
gagccgggggaacacgcu

SEQ ID NO: 4046130 - RNA, 15 nt, Molluscum contagiosum virus
gagcgcagcugccgg

SEQ ID NO: 4046131 - RNA, 14 nt, Molluscum contagiosum virus
gagcgcaugccggg

SEQ ID NO: 4046132 - RNA, 15 nt, Molluscum contagiosum virus
gagcgcaugccgggg

SEQ ID NO: 4046133 - RNA, 19 nt, Molluscum contagiosum virus
gagcgcaugccggggauga

SEQ ID NO: 4046134 - RNA, 18 nt, Molluscum contagiosum virus
gagcgcaugcgcgccgcg

SEQ ID NO: 4046135 - RNA, 19 nt, Molluscum contagiosum virus
gagcgccgccagcuccgcg

SEQ ID NO: 4046136 - RNA, 15 nt, Molluscum contagiosum virus
gagcgccgcgugcgc

SEQ ID NO: 4046137 - RNA, 18 nt, Molluscum contagiosum virus
gagcgcgcccccgagcug

SEQ ID NO: 4046138 - RNA, 12 nt, Molluscum contagiosum virus
gagcgcgcgcac

SEQ ID NO: 4046139 - RNA, 20 nt, Molluscum contagiosum virus
gagcgcguccaugagcaucu

SEQ ID NO: 4046140 - RNA, 20 nt, Molluscum contagiosum virus
gagcggcauggaaagcuucu

SEQ ID NO: 4046141 - RNA, 17 nt, Molluscum contagiosum virus
gagcucgaaaaaguucu

SEQ ID NO: 4046142 - RNA, 23 nt, Molluscum contagiosum virus
gagcucgccaugugcgaagacga

SEQ ID NO: 4046143 - RNA, 19 nt, Molluscum contagiosum virus
gagcucgcgcgccagcacg

SEQ ID NO: 4046144 - RNA, 15 nt, Molluscum contagiosum virus
gagcucguggacagc

SEQ ID NO: 4046145 - RNA, 17 nt, Molluscum contagiosum virus
gagcucuuccccgcggg

SEQ ID NO: 4046146 - RNA, 14 nt, Molluscum contagiosum virus
gagcugcgcgcgcu

SEQ ID NO: 4046147 - RNA, 20 nt, Molluscum contagiosum virus
gagcugcuaacaacaugagg

SEQ ID NO: 4046148 - RNA, 13 nt, Molluscum contagiosum virus
gagcugcugcccg

SEQ ID NO: 4046149 - RNA, 17 nt, Molluscum contagiosum virus
gagcugcuucgcgacca

SEQ ID NO: 4046150 - RNA, 18 nt, Molluscum contagiosum virus
gagcuggagcgagugcgc

SEQ ID NO: 4046151 - RNA, 15 nt, Molluscum contagiosum virus
gagcuggcugggcac

SEQ ID NO: 4046152 - RNA, 20 nt, Molluscum contagiosum virus
gagcugggauaacaggcgug

SEQ ID NO: 4046153 - RNA, 21 nt, Molluscum contagiosum virus
gagcugugcgagccaguuucu

SEQ ID NO: 4046154 - RNA, 15 nt, Molluscum contagiosum virus
gagcuuaauuuugca

SEQ ID NO: 4046155 - RNA, 18 nt, Molluscum contagiosum virus
gaggaaaagcacgcggcc

SEQ ID NO: 4046156 - RNA, 19 nt, Molluscum contagiosum virus
gaggaaagcgcacacuugc

SEQ ID NO: 4046157 - RNA, 15 nt, Molluscum contagiosum virus
gaggaacuagugcug

SEQ ID NO: 4046158 - RNA, 22 nt, Molluscum contagiosum virus
gaggacgagccccgcgccggcg

SEQ ID NO: 4046159 - RNA, 18 nt, Molluscum contagiosum virus
gaggacuaccuggcggcg

SEQ ID NO: 4046160 - RNA, 19 nt, Molluscum contagiosum virus
gaggacuaccuggcggcgc

SEQ ID NO: 4046161 - RNA, 21 nt, Molluscum contagiosum virus
gaggacuaccuggcggcgcug

SEQ ID NO: 4046162 - RNA, 15 nt, Molluscum contagiosum virus
gaggagaaaguaaau

SEQ ID NO: 4046163 - RNA, 16 nt, Molluscum contagiosum virus
gaggagugaagggugu

SEQ ID NO: 4046164 - RNA, 20 nt, Molluscum contagiosum virus
gaggcccaggccauggagcg

SEQ ID NO: 4046165 - RNA, 20 nt, Molluscum contagiosum virus
gaggccggccgugcagagca

SEQ ID NO: 4046166 - RNA, 20 nt, Molluscum contagiosum virus
gaggccuacgugcugcgcac

SEQ ID NO: 4046167 - RNA, 19 nt, Molluscum contagiosum virus
gaggcgcuagugcagauga

SEQ ID NO: 4046168 - RNA, 14 nt, Molluscum contagiosum virus
gaggcgcugccgcg

SEQ ID NO: 4046169 - RNA, 19 nt, Molluscum contagiosum virus
gaggcggagcugcccgcga

SEQ ID NO: 4046170 - RNA, 21 nt, Molluscum contagiosum virus
gaggcguacuccguggugcgc

SEQ ID NO: 4046171 - RNA, 18 nt, Molluscum contagiosum virus
gaggcguccugcgggagc

SEQ ID NO: 4046172 - RNA, 17 nt, Molluscum contagiosum virus
gaggcucgagcgcgcgc

SEQ ID NO: 4046173 - RNA, 16 nt, Molluscum contagiosum virus
gaggcucucgagcacu

SEQ ID NO: 4046174 - RNA, 14 nt, Molluscum contagiosum virus
gagggagccucgcu

SEQ ID NO: 4046175 - RNA, 16 nt, Molluscum contagiosum virus
gagggaugcacacacu

SEQ ID NO: 4046176 - RNA, 14 nt, Molluscum contagiosum virus
gagggucgugcagg

SEQ ID NO: 4046177 - RNA, 14 nt, Molluscum contagiosum virus
gagguacugccgcc

SEQ ID NO: 4046178 - RNA, 14 nt, Molluscum contagiosum virus
gcaagcgcaccuuu

SEQ ID NO: 4046179 - RNA, 22 nt, Molluscum contagiosum virus
gcaagcgggcuucgccgccgga

SEQ ID NO: 4046180 - RNA, 14 nt, Molluscum contagiosum virus
gcaagcucccgcug

SEQ ID NO: 4046181 - RNA, 19 nt, Molluscum contagiosum virus
gcaagcugagcgcgcugcg

SEQ ID NO: 4046182 - RNA, 18 nt, Molluscum contagiosum virus
gcaagcuucgggccgcug

SEQ ID NO: 4046183 - RNA, 17 nt, Molluscum contagiosum virus
gcaaggcaugcgcgcag

SEQ ID NO: 4046184 - RNA, 11 nt, Molluscum contagiosum virus
gcaaggcccac

SEQ ID NO: 4046185 - RNA, 22 nt, Molluscum contagiosum virus
gcaaggccguccccggaaagca

SEQ ID NO: 4046186 - RNA, 13 nt, Molluscum contagiosum virus
gcaaggcgcgcgc

SEQ ID NO: 4046187 - RNA, 22 nt, Molluscum contagiosum virus
gcaagggccugcgggcggcaca

SEQ ID NO: 4046188 - RNA, 18 nt, Molluscum contagiosum virus
gcaaggugugcgcgcugc

SEQ ID NO: 4046189 - RNA, 19 nt, Molluscum contagiosum virus
gcaagucaccgcuccgcag

SEQ ID NO: 4046190 - RNA, 16 nt, Molluscum contagiosum virus
gcaagucgcgcgcugc

SEQ ID NO: 4046191 - RNA, 20 nt, Molluscum contagiosum virus
gcaagugggcgucgaccugg

SEQ ID NO: 4046192 - RNA, 18 nt, Molluscum contagiosum virus
gcaaguucgcugcuggca

SEQ ID NO: 4046193 - RNA, 15 nt, Molluscum contagiosum virus
gcaauagcgcccgua

SEQ ID NO: 4046194 - RNA, 21 nt, Molluscum contagiosum virus
gcaauccugguacgcgcgcgc

SEQ ID NO: 4046195 - RNA, 20 nt, Molluscum contagiosum virus
gcaaucgcgugcuugcugcg

SEQ ID NO: 4046196 - RNA, 16 nt, Molluscum contagiosum virus
gcaaugcagugcacca

SEQ ID NO: 4046197 - RNA, 16 nt, Molluscum contagiosum virus
gcaaugcgcaaggccg

SEQ ID NO: 4046198 - RNA, 15 nt, Molluscum contagiosum virus
gcaauugcugggcac

SEQ ID NO: 4046199 - RNA, 23 nt, Molluscum contagiosum virus
gcacaacgggcucgugcuggagc

SEQ ID NO: 4046200 - RNA, 21 nt, Molluscum contagiosum virus
gcacacacuugcacgcgcacg

SEQ ID NO: 4046201 - RNA, 13 nt, Molluscum contagiosum virus
gcacaccgagcgc

SEQ ID NO: 4046202 - RNA, 18 nt, Molluscum contagiosum virus
gcacaccgucgcguggug

SEQ ID NO: 4046203 - RNA, 17 nt, Molluscum contagiosum virus
gcacacgaaucgcucgc

SEQ ID NO: 4046204 - RNA, 19 nt, Molluscum contagiosum virus
gcacacgacgacggcugcu

SEQ ID NO: 4046205 - RNA, 15 nt, Molluscum contagiosum virus
gcacacgagugcccg

SEQ ID NO: 4046206 - RNA, 16 nt, Molluscum contagiosum virus
gcacacgagugcccgc

SEQ ID NO: 4046207 - RNA, 14 nt, Molluscum contagiosum virus
gcacacgcaccgcc

SEQ ID NO: 4046208 - RNA, 17 nt, Molluscum contagiosum virus
gcacacgcgcgcgcagg

SEQ ID NO: 4046209 - RNA, 19 nt, Molluscum contagiosum virus
gcacacgcgcgcgugcugc

SEQ ID NO: 4046210 - RNA, 19 nt, Molluscum contagiosum virus
gcacacgugcacguccugc

SEQ ID NO: 4046211 - RNA, 16 nt, Molluscum contagiosum virus
gcacacuccucggcgc

SEQ ID NO: 4046212 - RNA, 23 nt, Molluscum contagiosum virus
gcacacuugcgcguccacaaagg

SEQ ID NO: 4046213 - RNA, 15 nt, Molluscum contagiosum virus
gcacagccccugcug

SEQ ID NO: 4046214 - RNA, 20 nt, Molluscum contagiosum virus
gcacagccccugcugcucgc

SEQ ID NO: 4046215 - RNA, 17 nt, Molluscum contagiosum virus
gcacaggguuccgcgcc

SEQ ID NO: 4046216 - RNA, 22 nt, Molluscum contagiosum virus
gcgugcgcgccaggugcgaagg

SEQ ID NO: 4046217 - RNA, 19 nt, Molluscum contagiosum virus
gcgugcgcgugccucugcc

SEQ ID NO: 4046218 - RNA, 18 nt, Molluscum contagiosum virus
gcgugcgcuggcgcgcgc

SEQ ID NO: 4046219 - RNA, 14 nt, Molluscum contagiosum virus
gcgugcggcgcacc

SEQ ID NO: 4046220 - RNA, 21 nt, Molluscum contagiosum virus
gcgugcucgguagcguggagc

SEQ ID NO: 4046221 - RNA, 13 nt, Molluscum contagiosum virus
gcgugcucggugu

SEQ ID NO: 4046222 - RNA, 13 nt, Molluscum contagiosum virus
gcgugcugggccc

SEQ ID NO: 4046223 - RNA, 14 nt, Molluscum contagiosum virus
gcgugcugggcccc

SEQ ID NO: 4046224 - RNA, 17 nt, Molluscum contagiosum virus
gcguggagcgcgcggac

SEQ ID NO: 4046225 - RNA, 19 nt, Molluscum contagiosum virus
gcguggcgcgcgagcugcu

SEQ ID NO: 4046226 - RNA, 19 nt, Molluscum contagiosum virus
gcguggugcuuacugcggg

SEQ ID NO: 4046227 - RNA, 18 nt, Molluscum contagiosum virus
gcgugguguccacgcgcg

SEQ ID NO: 4046228 - RNA, 22 nt, Molluscum contagiosum virus
gcguguaucaugcacaugcgcu

SEQ ID NO: 4046229 - RNA, 23 nt, Molluscum contagiosum virus
gcgugucgcggagcaacgcgacc

SEQ ID NO: 4046230 - RNA, 16 nt, Molluscum contagiosum virus
gcguucgcagugcccg

SEQ ID NO: 4046231 - RNA, 19 nt, Molluscum contagiosum virus
gcguuggucuugugacccg

SEQ ID NO: 4046232 - RNA, 16 nt, Molluscum contagiosum virus
gcuacaccgagaucau

SEQ ID NO: 4046233 - RNA, 23 nt, Molluscum contagiosum virus
gcuaccacgagcacugccugccg

SEQ ID NO: 4046234 - RNA, 15 nt, Molluscum contagiosum virus
gcuaccgcgcgcgca

SEQ ID NO: 4046235 - RNA, 14 nt, Molluscum contagiosum virus
gcuaccugaagcug

SEQ ID NO: 4046236 - RNA, 17 nt, Molluscum contagiosum virus
gcuaccugguggagcac

SEQ ID NO: 4046237 - RNA, 22 nt, Molluscum contagiosum virus
gcuacgaggccuacgugcugcg

SEQ ID NO: 4046238 - RNA, 13 nt, Molluscum contagiosum virus
gcuacguggcgcg

SEQ ID NO: 4046239 - RNA, 20 nt, Molluscum contagiosum virus
gcuacguuccgcgcggggac

SEQ ID NO: 4046240 - RNA, 13 nt, Molluscum contagiosum virus
gcuacuggccgcg

SEQ ID NO: 4046241 - RNA, 14 nt, Molluscum contagiosum virus
gcuacuugcuggcg

SEQ ID NO: 4046242 - RNA, 19 nt, Molluscum contagiosum virus
gcuagagaaccugugcgcg

SEQ ID NO: 4046243 - RNA, 18 nt, Molluscum contagiosum virus
gcuagcgugugccgccgc

SEQ ID NO: 4046244 - RNA, 15 nt, Molluscum contagiosum virus
gcuagcucugcgcgc

SEQ ID NO: 4046245 - RNA, 17 nt, Molluscum contagiosum virus
gcuagcucuggcagccc

SEQ ID NO: 4046246 - RNA, 19 nt, Molluscum contagiosum virus
gcuagcucuggcagcccgu

SEQ ID NO: 4046247 - RNA, 14 nt, Molluscum contagiosum virus
gcuagcugcgugcg

SEQ ID NO: 4046248 - RNA, 19 nt, Molluscum contagiosum virus
gcuaggauccugcucaaga

SEQ ID NO: 4046249 - RNA, 15 nt, Molluscum contagiosum virus
gcuaggggugccgcu

SEQ ID NO: 4046250 - RNA, 19 nt, Molluscum contagiosum virus
gcuaggguccaccugcgac

SEQ ID NO: 4046251 - RNA, 12 nt, Molluscum contagiosum virus
gcuaguccgcgu

SEQ ID NO: 4046252 - RNA, 17 nt, Molluscum contagiosum virus
gcuagugccgagcucgc

SEQ ID NO: 4046253 - RNA, 15 nt, Molluscum contagiosum virus
gcuaguggcgcucgc

SEQ ID NO: 4046254 - RNA, 13 nt, Molluscum contagiosum virus
gcucaacgugggc

SEQ ID NO: 4046255 - RNA, 17 nt, Molluscum contagiosum virus
gcucaagacgcugcugg

SEQ ID NO: 4046256 - RNA, 18 nt, Molluscum contagiosum virus
gcucaagacgcugcuggc

SEQ ID NO: 4046257 - RNA, 20 nt, Molluscum contagiosum virus
gcucaaggacuaccagcucu

SEQ ID NO: 4046258 - RNA, 12 nt, Molluscum contagiosum virus
gcucaccgccga

SEQ ID NO: 4046259 - RNA, 21 nt, Molluscum contagiosum virus
gcucaccgcgcagaagccaac

SEQ ID NO: 4046260 - RNA, 17 nt, Molluscum contagiosum virus
gcucacgcugcccgcgc

SEQ ID NO: 4046261 - RNA, 17 nt, Molluscum contagiosum virus
gcucagccucuacucca

SEQ ID NO: 4046262 - RNA, 13 nt, Molluscum contagiosum virus
gcucagcgccgcg

SEQ ID NO: 4046263 - RNA, 12 nt, Molluscum contagiosum virus
gcucaggccagc

SEQ ID NO: 4046264 - RNA, 14 nt, Molluscum contagiosum virus
gcucaggccagcau

SEQ ID NO: 4046265 - RNA, 18 nt, Molluscum contagiosum virus
gcucauacuccugcuggc

SEQ ID NO: 4046266 - RNA, 21 nt, Molluscum contagiosum virus
gcucauagcccaugcgcagug

SEQ ID NO: 4046267 - RNA, 12 nt, Molluscum contagiosum virus
gcucaugcgcgg

SEQ ID NO: 4046268 - RNA, 21 nt, Molluscum contagiosum virus
gcuccacgcgcagcuucucug

SEQ ID NO: 4046269 - RNA, 17 nt, Molluscum contagiosum virus
gcuccagagccgcgugc

SEQ ID NO: 4046270 - RNA, 15 nt, Molluscum contagiosum virus
gcuccagggcucaag

SEQ ID NO: 4046271 - RNA, 16 nt, Molluscum contagiosum virus
gcuccgacgcgguggu

SEQ ID NO: 4046272 - RNA, 14 nt, Molluscum contagiosum virus
gcuccgaguccagc

SEQ ID NO: 4046273 - RNA, 16 nt, Molluscum contagiosum virus
gcuccgccaacgcgga

SEQ ID NO: 4046274 - RNA, 21 nt, Molluscum contagiosum virus
gcuccgccaacgcggacgcgc

SEQ ID NO: 4046275 - RNA, 19 nt, Molluscum contagiosum virus
gcuccgccgggaauaccgg

SEQ ID NO: 4046276 - RNA, 14 nt, Molluscum contagiosum virus
gcuccgcggaggcc

SEQ ID NO: 4046277 - RNA, 23 nt, Molluscum contagiosum virus
gcuccgcuggaccccgagcugcg

SEQ ID NO: 4046278 - RNA, 23 nt, Molluscum contagiosum virus
gcuccggcuuagcuggcgcccgu

SEQ ID NO: 4046279 - RNA, 21 nt, Molluscum contagiosum virus
gcuccggcuuuauuuccggcu

SEQ ID NO: 4046280 - RNA, 12 nt, Molluscum contagiosum virus
gcuccucuucag

SEQ ID NO: 4046281 - RNA, 13 nt, Molluscum contagiosum virus
gcuccuucuucag

SEQ ID NO: 4046282 - RNA, 22 nt, Molluscum contagiosum virus
gcucgaagccuucgcagagacc

SEQ ID NO: 4046283 - RNA, 20 nt, Molluscum contagiosum virus
gcucgacacugugcuggcgc

SEQ ID NO: 4046284 - RNA, 23 nt, Molluscum contagiosum virus
gcucgagcgcgcgccugcuggcg

SEQ ID NO: 4046285 - RNA, 13 nt, Molluscum contagiosum virus
gcucgaggcgccg

SEQ ID NO: 4046286 - RNA, 16 nt, Molluscum contagiosum virus
gcucgcacggcgacuc

SEQ ID NO: 4046287 - RNA, 14 nt, Molluscum contagiosum virus
gcucgccuuucccc

SEQ ID NO: 4046288 - RNA, 18 nt, Molluscum contagiosum virus
gcucgcgacgugcgcgcu

SEQ ID NO: 4046289 - RNA, 22 nt, Molluscum contagiosum virus
gcucgcgagcguuucugccgga

SEQ ID NO: 4046290 - RNA, 23 nt, Molluscum contagiosum virus
gcucgcgcaauacugcgggcugu

SEQ ID NO: 4046291 - RNA, 18 nt, Molluscum contagiosum virus
gcucgcgcaucugccgcg

SEQ ID NO: 4046292 - RNA, 12 nt, Molluscum contagiosum virus
gcucgcgccgcc

SEQ ID NO: 4046293 - RNA, 13 nt, Molluscum contagiosum virus
gcucgcgcgcaag

SEQ ID NO: 4046294 - RNA, 17 nt, Molluscum contagiosum virus
gcucgcgcgcacgcgca

SEQ ID NO: 4046295 - RNA, 15 nt, Molluscum contagiosum virus
gcucgcgcgcagcuc

SEQ ID NO: 4046296 - RNA, 23 nt, Molluscum contagiosum virus
gcucgcgcgcaugcucgcgcucu

SEQ ID NO: 4046297 - RNA, 17 nt, Molluscum contagiosum virus
gcucgcgcgcgcacgcc

SEQ ID NO: 4046298 - RNA, 15 nt, Molluscum contagiosum virus
gcucgcgcgugcucg

SEQ ID NO: 4046299 - RNA, 20 nt, Molluscum contagiosum virus
gcucgcggcuaggacuagca

SEQ ID NO: 4046300 - RNA, 19 nt, Molluscum contagiosum virus
gcucgcggcucggcucuug

SEQ ID NO: 4046301 - RNA, 13 nt, Molluscum contagiosum virus
gcucgcgugcgug

SEQ ID NO: 4046302 - RNA, 16 nt, Molluscum contagiosum virus
gcucggaaagagcgcg

SEQ ID NO: 4046303 - RNA, 17 nt, Molluscum contagiosum virus
gcucggaggcuugcccc

SEQ ID NO: 4046304 - RNA, 17 nt, Molluscum contagiosum virus
gcucggagucggagaaa

SEQ ID NO: 4046305 - RNA, 16 nt, Molluscum contagiosum virus
gcucggcacugcuggc

SEQ ID NO: 4046306 - RNA, 17 nt, Molluscum contagiosum virus
gcucgggaagcacguag

SEQ ID NO: 4046307 - RNA, 15 nt, Molluscum contagiosum virus
gcucgguagccaggc

SEQ ID NO: 4046308 - RNA, 13 nt, Molluscum contagiosum virus
gcucguccagcug

SEQ ID NO: 4046309 - RNA, 13 nt, Molluscum contagiosum virus
gcucguccccgug

SEQ ID NO: 4046310 - RNA, 18 nt, Molluscum contagiosum virus
gcucguccccgugcacga

SEQ ID NO: 4046311 - RNA, 21 nt, Molluscum contagiosum virus
gcucgugcucuuggcguucgc

SEQ ID NO: 4046312 - RNA, 13 nt, Molluscum contagiosum virus
gcucgugcuggag

SEQ ID NO: 4046313 - RNA, 20 nt, Molluscum contagiosum virus
gcucgugguugcgcacguug

SEQ ID NO: 4046314 - RNA, 17 nt, Molluscum contagiosum virus
gcucuacgccagcgacg

SEQ ID NO: 4046315 - RNA, 22 nt, Molluscum contagiosum virus
gcucuacggcgugcugugccug

SEQ ID NO: 4046316 - RNA, 13 nt, Molluscum contagiosum virus
gcucucagagcau

SEQ ID NO: 4046317 - RNA, 14 nt, Molluscum contagiosum virus
gcucucgagcacuu

SEQ ID NO: 4046318 - RNA, 20 nt, Molluscum contagiosum virus
gcucugauuacauccugccc

SEQ ID NO: 4046319 - RNA, 14 nt, Molluscum contagiosum virus
gcuugggcacugcu

SEQ ID NO: 4046320 - RNA, 16 nt, Molluscum contagiosum virus
gcuuugucgcgaacgc

SEQ ID NO: 4046321 - RNA, 18 nt, Molluscum contagiosum virus
gcuuuuguuacucucaga

SEQ ID NO: 4046322 - RNA, 21 nt, Molluscum contagiosum virus
ggaaaacgcccgagcgcgugu

SEQ ID NO: 4046323 - RNA, 15 nt, Molluscum contagiosum virus
ggaaaaggcacaccc

SEQ ID NO: 4046324 - RNA, 22 nt, Molluscum contagiosum virus
ggaaaauccgcgcccgcgcggc

SEQ ID NO: 4046325 - RNA, 23 nt, Molluscum contagiosum virus
ggaaagauauacaccaggcgcgu

SEQ ID NO: 4046326 - RNA, 12 nt, Molluscum contagiosum virus
ggaaagcgcaca

SEQ ID NO: 4046327 - RNA, 11 nt, Molluscum contagiosum virus
ggaaaggcacc

SEQ ID NO: 4046328 - RNA, 16 nt, Molluscum contagiosum virus
ggaaaggcacccacca

SEQ ID NO: 4046329 - RNA, 15 nt, Molluscum contagiosum virus
ggaacaaagaggcaa

SEQ ID NO: 4046330 - RNA, 24 nt, Molluscum contagiosum virus
ggaacaucugcaacucgcgcugca

SEQ ID NO: 4046331 - RNA, 16 nt, Molluscum contagiosum virus
ggaacccagaaagaag

SEQ ID NO: 4046332 - RNA, 19 nt, Molluscum contagiosum virus
ggaacggcgacuuguagug

SEQ ID NO: 4046333 - RNA, 16 nt, Molluscum contagiosum virus
ggaacuagugcugcug

SEQ ID NO: 4046334 - RNA, 17 nt, Molluscum contagiosum virus
ggaacucgaggcucugu

SEQ ID NO: 4046335 - RNA, 14 nt, Molluscum contagiosum virus
ggaacugacugcug

SEQ ID NO: 4046336 - RNA, 12 nt, Molluscum contagiosum virus
ggaagcgcgugc

SEQ ID NO: 4046337 - RNA, 12 nt, Molluscum contagiosum virus
ggaagcugcacg

SEQ ID NO: 4046338 - RNA, 16 nt, Molluscum contagiosum virus
ggaaggcgaccagcug

SEQ ID NO: 4046339 - RNA, 15 nt, Molluscum contagiosum virus
ggaaggggugauggc

SEQ ID NO: 4046340 - RNA, 14 nt, Molluscum contagiosum virus
ggaagucguggccg

SEQ ID NO: 4046341 - RNA, 14 nt, Molluscum contagiosum virus
ggaagugcgagccg

SEQ ID NO: 4046342 - RNA, 16 nt, Molluscum contagiosum virus
ggaauugugcugcugu

SEQ ID NO: 4046343 - RNA, 17 nt, Molluscum contagiosum virus
ggacaacucauagcgcc

SEQ ID NO: 4046344 - RNA, 21 nt, Molluscum contagiosum virus
ggacagagcccgcggcgcacg

SEQ ID NO: 4046345 - RNA, 12 nt, Molluscum contagiosum virus
ggacagcaaaca

SEQ ID NO: 4046346 - RNA, 23 nt, Molluscum contagiosum virus
ggacagccaugaggacagcuugc

SEQ ID NO: 4046347 - RNA, 15 nt, Molluscum contagiosum virus
ggacagcucagcagg

SEQ ID NO: 4046348 - RNA, 17 nt, Molluscum contagiosum virus
ggacagcuugcugcugu

SEQ ID NO: 4046349 - RNA, 23 nt, Molluscum contagiosum virus
ggaccgcgcgaacgaggagggca

SEQ ID NO: 4046350 - RNA, 20 nt, Molluscum contagiosum virus
ggaccucaaggaggcgugcg

SEQ ID NO: 4046351 - RNA, 20 nt, Molluscum contagiosum virus
ggaccucuuucucgcgccgu

SEQ ID NO: 4046352 - RNA, 12 nt, Molluscum contagiosum virus
ggaccugcgcca

SEQ ID NO: 4046353 - RNA, 19 nt, Molluscum contagiosum virus
ggaccugcugguggugcug

SEQ ID NO: 4046354 - RNA, 18 nt, Molluscum contagiosum virus
ggacgaugguggcgcugc

SEQ ID NO: 4046355 - RNA, 15 nt, Molluscum contagiosum virus
ggacgcccuccucga

SEQ ID NO: 4046356 - RNA, 13 nt, Molluscum contagiosum virus
ggacgcgcggagc

SEQ ID NO: 4046357 - RNA, 21 nt, Molluscum contagiosum virus
ggacgcgugcaagcccagcag

SEQ ID NO: 4046358 - RNA, 15 nt, Molluscum contagiosum virus
ggacgcuugcuagca

SEQ ID NO: 4046359 - RNA, 14 nt, Molluscum contagiosum virus
ggacggcgugcgcc

SEQ ID NO: 4046360 - RNA, 13 nt, Molluscum contagiosum virus
ggacgugcugcug

SEQ ID NO: 4046361 - RNA, 15 nt, Molluscum contagiosum virus
ggacuuccgcgcgcu

SEQ ID NO: 4046362 - RNA, 20 nt, Molluscum contagiosum virus
ggagaacaugcucgccagca

SEQ ID NO: 4046363 - RNA, 20 nt, Molluscum contagiosum virus
ggagaccggcgucggcaaga

SEQ ID NO: 4046364 - RNA, 18 nt, Molluscum contagiosum virus
ggagacgucguggauggc

SEQ ID NO: 4046365 - RNA, 15 nt, Molluscum contagiosum virus
ggagaucgccgcgca

SEQ ID NO: 4046366 - RNA, 15 nt, Molluscum contagiosum virus
ggagcaacgcgaccu

SEQ ID NO: 4046367 - RNA, 18 nt, Molluscum contagiosum virus
ggagcacuuccgcgcgcu

SEQ ID NO: 4046368 - RNA, 18 nt, Molluscum contagiosum virus
ggagcagacguacgagca

SEQ ID NO: 4046369 - RNA, 14 nt, Molluscum contagiosum virus
ggagccgcugcugc

SEQ ID NO: 4046370 - RNA, 18 nt, Molluscum contagiosum virus
ggagcgcacgaagcggcg

SEQ ID NO: 4046371 - RNA, 18 nt, Molluscum contagiosum virus
ggagcgcuucuagcucgc

SEQ ID NO: 4046372 - RNA, 17 nt, Molluscum contagiosum virus
ggagcggccacucuccc

SEQ ID NO: 4046373 - RNA, 20 nt, Molluscum contagiosum virus
ggagcguccacgacgagccu

SEQ ID NO: 4046374 - RNA, 15 nt, Molluscum contagiosum virus
ggagcuccgugcugc

SEQ ID NO: 4046375 - RNA, 15 nt, Molluscum contagiosum virus
ggagcugcgcgcgcu

SEQ ID NO: 4046376 - RNA, 14 nt, Molluscum contagiosum virus
ggagcuggagcgag

SEQ ID NO: 4046377 - RNA, 17 nt, Molluscum contagiosum virus
ggaggaccgcgagcgca

SEQ ID NO: 4046378 - RNA, 12 nt, Molluscum contagiosum virus
ggaggacggcgc

SEQ ID NO: 4046379 - RNA, 11 nt, Molluscum contagiosum virus
ggaggcagcgc

SEQ ID NO: 4046380 - RNA, 15 nt, Molluscum contagiosum virus
ggaggcggcacugcu

SEQ ID NO: 4046381 - RNA, 16 nt, Molluscum contagiosum virus
ggaggcguccugcggg

SEQ ID NO: 4046382 - RNA, 20 nt, Molluscum contagiosum virus
ggaggcgugcguuccgggcc

SEQ ID NO: 4046383 - RNA, 14 nt, Molluscum contagiosum virus
ggagggucacgcgc

SEQ ID NO: 4046384 - RNA, 22 nt, Molluscum contagiosum virus
ggagggugcacgcgggcgccgg

SEQ ID NO: 4046385 - RNA, 20 nt, Molluscum contagiosum virus
ggagguacugccgccaggaa

SEQ ID NO: 4046386 - RNA, 19 nt, Molluscum contagiosum virus
ggagguaguaguacggcac

SEQ ID NO: 4046387 - RNA, 22 nt, Molluscum contagiosum virus
ggaggucugcuuugucugcagg

SEQ ID NO: 4046388 - RNA, 18 nt, Molluscum contagiosum virus
ggagucacgaccgaccca

SEQ ID NO: 4046389 - RNA, 12 nt, Molluscum contagiosum virus
ggaucaccacug

SEQ ID NO: 4046390 - RNA, 20 nt, Molluscum contagiosum virus
ggaucacgaugugcgcgcga

SEQ ID NO: 4046391 - RNA, 17 nt, Molluscum contagiosum virus
ggaucagccccgcgcca

SEQ ID NO: 4046392 - RNA, 21 nt, Molluscum contagiosum virus
ggaugaacaccauccugcgcu

SEQ ID NO: 4046393 - RNA, 15 nt, Molluscum contagiosum virus
ggaugaacgcgcugc

SEQ ID NO: 4046394 - RNA, 19 nt, Molluscum contagiosum virus
ggaugccacgcagcuggcg

SEQ ID NO: 4046395 - RNA, 14 nt, Molluscum contagiosum virus
ggaugccugccagc

SEQ ID NO: 4046396 - RNA, 12 nt, Molluscum contagiosum virus
ggaugcgcacac

SEQ ID NO: 4046397 - RNA, 18 nt, Molluscum contagiosum virus
ggcaaaagggcucugcca

SEQ ID NO: 4046398 - RNA, 17 nt, Molluscum contagiosum virus
ggcaaccgcgacgagca

SEQ ID NO: 4046399 - RNA, 21 nt, Molluscum contagiosum virus
ggcaacgcugccgcuggcgcu

SEQ ID NO: 4046400 - RNA, 22 nt, Molluscum contagiosum virus
ggcaacugccugcgcuagugaa

SEQ ID NO: 4046401 - RNA, 17 nt, Molluscum contagiosum virus
ggcaagcgcgcucgggc

SEQ ID NO: 4046402 - RNA, 20 nt, Molluscum contagiosum virus
ggcaagcuucgggccgcugc

SEQ ID NO: 4046403 - RNA, 19 nt, Molluscum contagiosum virus
ggcaaggcguaagagcgug

SEQ ID NO: 4046404 - RNA, 15 nt, Molluscum contagiosum virus
ggcaaucgcgugcuu

SEQ ID NO: 4046405 - RNA, 13 nt, Molluscum contagiosum virus
ggcaaucugucca

SEQ ID NO: 4046406 - RNA, 13 nt, Molluscum contagiosum virus
ggcaaugggcacg

SEQ ID NO: 4046407 - RNA, 20 nt, Molluscum contagiosum virus
ggcacaccccgggaacgagg

SEQ ID NO: 4046408 - RNA, 22 nt, Molluscum contagiosum virus
ggcacaccccuguaacaaggaa

SEQ ID NO: 4046409 - RNA, 18 nt, Molluscum contagiosum virus
ggcacaugcagcugcagg

SEQ ID NO: 4046410 - RNA, 13 nt, Molluscum contagiosum virus
ggcaccacgugcg

SEQ ID NO: 4046411 - RNA, 18 nt, Molluscum contagiosum virus
ggcaccacgugcgcuggc

SEQ ID NO: 4046412 - RNA, 14 nt, Molluscum contagiosum virus
ggcacccaccagga

SEQ ID NO: 4046413 - RNA, 15 nt, Molluscum contagiosum virus
ggcacccaccaggaa

SEQ ID NO: 4046414 - RNA, 19 nt, Molluscum contagiosum virus
ggcacccaccaggaacagg

SEQ ID NO: 4046415 - RNA, 18 nt, Molluscum contagiosum virus
ggcaccccgaaaggcacc

SEQ ID NO: 4046416 - RNA, 22 nt, Molluscum contagiosum virus
ggcaccccgaaaggcacccgca

SEQ ID NO: 4046417 - RNA, 19 nt, Molluscum contagiosum virus
ggcaccccgaaggaaaggc

SEQ ID NO: 4046418 - RNA, 20 nt, Molluscum contagiosum virus
ggcacccgcaacaaggaaag

SEQ ID NO: 4046419 - RNA, 16 nt, Molluscum contagiosum virus
ggcacccgcaggaaag

SEQ ID NO: 4046420 - RNA, 14 nt, Molluscum contagiosum virus
ggcacccgccagcu

SEQ ID NO: 4046421 - RNA, 19 nt, Molluscum contagiosum virus
ggcacccgugcgcgcgcug

SEQ ID NO: 4046422 - RNA, 16 nt, Molluscum contagiosum virus
ggcggagguggcggag

SEQ ID NO: 4046423 - RNA, 15 nt, Molluscum contagiosum virus
ggcggcacccgccgc

SEQ ID NO: 4046424 - RNA, 23 nt, Molluscum contagiosum virus
ggcggcagcgccagcgagaucaa

SEQ ID NO: 4046425 - RNA, 14 nt, Molluscum contagiosum virus
ggcggccguguccu

SEQ ID NO: 4046426 - RNA, 21 nt, Molluscum contagiosum virus
ggcggcgcgaagcaggcgcca

SEQ ID NO: 4046427 - RNA, 16 nt, Molluscum contagiosum virus
ggcggcguaggccugc

SEQ ID NO: 4046428 - RNA, 13 nt, Molluscum contagiosum virus
ggcggcugugccc

SEQ ID NO: 4046429 - RNA, 21 nt, Molluscum contagiosum virus
ggcgggaagaaacucaggaag

SEQ ID NO: 4046430 - RNA, 23 nt, Molluscum contagiosum virus
ggcgggcacauccgcuaccuggu

SEQ ID NO: 4046431 - RNA, 18 nt, Molluscum contagiosum virus
ggcgggcgaaagcgccgc

SEQ ID NO: 4046432 - RNA, 17 nt, Molluscum contagiosum virus
ggcggggaucuugcgug

SEQ ID NO: 4046433 - RNA, 13 nt, Molluscum contagiosum virus
ggcgggugccgcc

SEQ ID NO: 4046434 - RNA, 13 nt, Molluscum contagiosum virus
ggcgggugccgug

SEQ ID NO: 4046435 - RNA, 18 nt, Molluscum contagiosum virus
ggcggugggcgccgcggc

SEQ ID NO: 4046436 - RNA, 18 nt, Molluscum contagiosum virus
ggcgguguaugcucgucg

SEQ ID NO: 4046437 - RNA, 20 nt, Molluscum contagiosum virus
ggcguaugcgccaagccugc

SEQ ID NO: 4046438 - RNA, 18 nt, Molluscum contagiosum virus
ggcguccggcgcucgccc

SEQ ID NO: 4046439 - RNA, 18 nt, Molluscum contagiosum virus
ggcguccggcgcucgccu

SEQ ID NO: 4046440 - RNA, 18 nt, Molluscum contagiosum virus
ggcguccggugcucgccc

SEQ ID NO: 4046441 - RNA, 22 nt, Molluscum contagiosum virus
ggcguccuucuuugcgugcgcc

SEQ ID NO: 4046442 - RNA, 20 nt, Molluscum contagiosum virus
ggcgugcagggcgugcuugc

SEQ ID NO: 4046443 - RNA, 13 nt, Molluscum contagiosum virus
ggcgugcgcagca

SEQ ID NO: 4046444 - RNA, 13 nt, Molluscum contagiosum virus
ggcgugcugugcc

SEQ ID NO: 4046445 - RNA, 14 nt, Molluscum contagiosum virus
ggcgugcugugccu

SEQ ID NO: 4046446 - RNA, 17 nt, Molluscum contagiosum virus
ggcguggccaggccgcg

SEQ ID NO: 4046447 - RNA, 16 nt, Molluscum contagiosum virus
ggcguggugcuggcca

SEQ ID NO: 4046448 - RNA, 16 nt, Molluscum contagiosum virus
ggcgugugcgggcucu

SEQ ID NO: 4046449 - RNA, 18 nt, Molluscum contagiosum virus
ggcguguuccggcagcgc

SEQ ID NO: 4046450 - RNA, 13 nt, Molluscum contagiosum virus
ggcguugcugcug

SEQ ID NO: 4046451 - RNA, 16 nt, Molluscum contagiosum virus
ggcucaagucgcccuu

SEQ ID NO: 4046452 - RNA, 14 nt, Molluscum contagiosum virus
ggcuccgcuggacc

SEQ ID NO: 4046453 - RNA, 14 nt, Molluscum contagiosum virus
ggcuccugugucgc

SEQ ID NO: 4046454 - RNA, 22 nt, Molluscum contagiosum virus
ggcucgagcgcgcgccugcugg

SEQ ID NO: 4046455 - RNA, 20 nt, Molluscum contagiosum virus
ggcucgcgugccccgggaag

SEQ ID NO: 4046456 - RNA, 19 nt, Molluscum contagiosum virus
ggcucgggcucgaggugug

SEQ ID NO: 4046457 - RNA, 15 nt, Molluscum contagiosum virus
ggcucgucguggacg

SEQ ID NO: 4046458 - RNA, 19 nt, Molluscum contagiosum virus
ggcucuaagcgcacgcgcg

SEQ ID NO: 4046459 - RNA, 21 nt, Molluscum contagiosum virus
ggcucucgcggaacuggacgc

SEQ ID NO: 4046460 - RNA, 20 nt, Molluscum contagiosum virus
ggcucuggagcggccacucu

SEQ ID NO: 4046461 - RNA, 21 nt, Molluscum contagiosum virus
ggcucuuccuuugcucuacgc

SEQ ID NO: 4046462 - RNA, 16 nt, Molluscum contagiosum virus
ggcucuucucgcagcg

SEQ ID NO: 4046463 - RNA, 23 nt, Molluscum contagiosum virus
ggcugcccgcggagaccaccgcu

SEQ ID NO: 4046464 - RNA, 15 nt, Molluscum contagiosum virus
ggcugcucgcugccu

SEQ ID NO: 4046465 - RNA, 20 nt, Molluscum contagiosum virus
ggcugcucucggcagcgucg

SEQ ID NO: 4046466 - RNA, 13 nt, Molluscum contagiosum virus
ggcugcugcgcga

SEQ ID NO: 4046467 - RNA, 15 nt, Molluscum contagiosum virus
ggcuggacugugcuu

SEQ ID NO: 4046468 - RNA, 23 nt, Molluscum contagiosum virus
ggcuguagaagagcgguuccugc

SEQ ID NO: 4046469 - RNA, 18 nt, Molluscum contagiosum virus
ggcuguuguacuggagac

SEQ ID NO: 4046470 - RNA, 15 nt, Molluscum contagiosum virus
ggcuucgccgccgga

SEQ ID NO: 4046471 - RNA, 13 nt, Molluscum contagiosum virus
ggcuucugcgcgg

SEQ ID NO: 4046472 - RNA, 20 nt, Molluscum contagiosum virus
ggcuugcggcacgcacggcc

SEQ ID NO: 4046473 - RNA, 17 nt, Molluscum contagiosum virus
ggcuuuucaugugcgag

SEQ ID NO: 4046474 - RNA, 22 nt, Molluscum contagiosum virus
gggaaaaaucccccgccaggaa

SEQ ID NO: 4046475 - RNA, 14 nt, Molluscum contagiosum virus
gggaacccguggcc

SEQ ID NO: 4046476 - RNA, 17 nt, Molluscum contagiosum virus
gggaccgcccuugugga

SEQ ID NO: 4046477 - RNA, 20 nt, Molluscum contagiosum virus
gggaccugguucaugcuggc

SEQ ID NO: 4046478 - RNA, 15 nt, Molluscum contagiosum virus
gggagaagaugcugc

SEQ ID NO: 4046479 - RNA, 21 nt, Molluscum contagiosum virus
gggcaagcgccgccaugcugc

SEQ ID NO: 4046480 - RNA, 12 nt, Molluscum contagiosum virus
gggcaauguuug

SEQ ID NO: 4046481 - RNA, 14 nt, Molluscum contagiosum virus
gggcacaagcuuuc

SEQ ID NO: 4046482 - RNA, 20 nt, Molluscum contagiosum virus
gggcacggcacccgccagcu

SEQ ID NO: 4046483 - RNA, 16 nt, Molluscum contagiosum virus
gggcagcuucugcucg

SEQ ID NO: 4046484 - RNA, 13 nt, Molluscum contagiosum virus
gggccaggcacug

SEQ ID NO: 4046485 - RNA, 12 nt, Molluscum contagiosum virus
gggccgcgcgca

SEQ ID NO: 4046486 - RNA, 15 nt, Molluscum contagiosum virus
gggccgcgguggccg

SEQ ID NO: 4046487 - RNA, 15 nt, Molluscum contagiosum virus
gggcgcacgcuuguc

SEQ ID NO: 4046488 - RNA, 19 nt, Molluscum contagiosum virus
gggcgcagccacgacucgc

SEQ ID NO: 4046489 - RNA, 20 nt, Molluscum contagiosum virus
gggcgccaaguccgagcaag

SEQ ID NO: 4046490 - RNA, 18 nt, Molluscum contagiosum virus
gggcgccggcucugccuc

SEQ ID NO: 4046491 - RNA, 21 nt, Molluscum contagiosum virus
gggcgggaagaaggugcucag

SEQ ID NO: 4046492 - RNA, 19 nt, Molluscum contagiosum virus
gggcgugacucggccgcgg

SEQ ID NO: 4046493 - RNA, 16 nt, Molluscum contagiosum virus
gggcuccuucuucuuu

SEQ ID NO: 4046494 - RNA, 20 nt, Molluscum contagiosum virus
gggcucgggcucgaggugug

SEQ ID NO: 4046495 - RNA, 20 nt, Molluscum contagiosum virus
gggcugcaucuucagcacca

SEQ ID NO: 4046496 - RNA, 21 nt, Molluscum contagiosum virus
gggcuucgcugcgcaggugca

SEQ ID NO: 4046497 - RNA, 19 nt, Molluscum contagiosum virus
ggggaacucggcuucugcu

SEQ ID NO: 4046498 - RNA, 22 nt, Molluscum contagiosum virus
ggggaacucggcuucugcugca

SEQ ID NO: 4046499 - RNA, 17 nt, Molluscum contagiosum virus
ggggccacaagcacgca

SEQ ID NO: 4046500 - RNA, 13 nt, Molluscum contagiosum virus
ggggcccaugcuc

SEQ ID NO: 4046501 - RNA, 19 nt, Molluscum contagiosum virus
ggggcucuccuacacauuc

SEQ ID NO: 4046502 - RNA, 13 nt, Molluscum contagiosum virus
gggguccgcuccu

SEQ ID NO: 4046503 - RNA, 15 nt, Molluscum contagiosum virus
ggggugauggcggug

SEQ ID NO: 4046504 - RNA, 13 nt, Molluscum contagiosum virus
gggucgugcaggu

SEQ ID NO: 4046505 - RNA, 23 nt, Molluscum contagiosum virus
gggugaggagcucgacucgagcg

SEQ ID NO: 4046506 - RNA, 14 nt, Molluscum contagiosum virus
gggugccuacucgc

SEQ ID NO: 4046507 - RNA, 14 nt, Molluscum contagiosum virus
gguaacgcgcgcgc

SEQ ID NO: 4046508 - RNA, 20 nt, Molluscum contagiosum virus
gguacaagucaucggagagc

SEQ ID NO: 4046509 - RNA, 16 nt, Molluscum contagiosum virus
gguaccgugcgcguga

SEQ ID NO: 4046510 - RNA, 21 nt, Molluscum contagiosum virus
gguacggugccguccccgcgc

SEQ ID NO: 4046511 - RNA, 17 nt, Molluscum contagiosum virus
gguacguacagugcgcg

SEQ ID NO: 4046512 - RNA, 22 nt, Molluscum contagiosum virus
gguacugaacgucuucgagagc

SEQ ID NO: 4046513 - RNA, 19 nt, Molluscum contagiosum virus
gguacuuguugugcacgcu

SEQ ID NO: 4046514 - RNA, 17 nt, Molluscum contagiosum virus
gguagagcgugaugugc

SEQ ID NO: 4046515 - RNA, 17 nt, Molluscum contagiosum virus
gguagugguccaccagc

SEQ ID NO: 4046516 - RNA, 22 nt, Molluscum contagiosum virus
ggucaagaacaugugcuccgcc

SEQ ID NO: 4046517 - RNA, 23 nt, Molluscum contagiosum virus
ggucaccaccaccuccagguccc

SEQ ID NO: 4046518 - RNA, 14 nt, Molluscum contagiosum virus
ggucaccacgaucu

SEQ ID NO: 4046519 - RNA, 11 nt, Molluscum contagiosum virus
ggucccuagcc

SEQ ID NO: 4046520 - RNA, 14 nt, Molluscum contagiosum virus
gguccuguccgcgg

SEQ ID NO: 4046521 - RNA, 13 nt, Molluscum contagiosum virus
ggucgaggagggc

SEQ ID NO: 4046522 - RNA, 18 nt, Molluscum contagiosum virus
ggucuccgcgggcagccg

SEQ ID NO: 4046523 - RNA, 20 nt, Molluscum contagiosum virus
ggucugcuuugucugcaggc

SEQ ID NO: 4046524 - RNA, 20 nt, Molluscum contagiosum virus
ggucuucccgcuggcggcac

SEQ ID NO: 4046525 - RNA, 15 nt, Molluscum contagiosum virus
cgcacgcacggagca

SEQ ID NO: 4046526 - RNA, 17 nt, Molluscum contagiosum virus
cgcacgcacggagcaca

SEQ ID NO: 4046527 - RNA, 14 nt, Molluscum contagiosum virus
cgcacgccagccug

SEQ ID NO: 4046528 - RNA, 13 nt, Molluscum contagiosum virus
cgcacgcgagcac

SEQ ID NO: 4046529 - RNA, 20 nt, Molluscum contagiosum virus
cgcacgcuuguccgcggacg

SEQ ID NO: 4046530 - RNA, 16 nt, Molluscum contagiosum virus
cgcacggcagcggcga

SEQ ID NO: 4046531 - RNA, 14 nt, Molluscum contagiosum virus
cgcacggccugcgg

SEQ ID NO: 4046532 - RNA, 13 nt, Molluscum contagiosum virus
cgcacggcuaggc

SEQ ID NO: 4046533 - RNA, 14 nt, Molluscum contagiosum virus
cgcacgggccugcg

SEQ ID NO: 4046534 - RNA, 16 nt, Molluscum contagiosum virus
cgcacgggccugcgcg

SEQ ID NO: 4046535 - RNA, 12 nt, Molluscum contagiosum virus
cgcacgggcgca

SEQ ID NO: 4046536 - RNA, 22 nt, Molluscum contagiosum virus
cgcacggugugcuacugcacug

SEQ ID NO: 4046537 - RNA, 16 nt, Molluscum contagiosum virus
cgcacguaggggacgc

SEQ ID NO: 4046538 - RNA, 19 nt, Molluscum contagiosum virus
cgcacucgcuggccucugc

SEQ ID NO: 4046539 - RNA, 22 nt, Molluscum contagiosum virus
cgcacuugccgggcgacggcgg

SEQ ID NO: 4046540 - RNA, 21 nt, Molluscum contagiosum virus
cgcagaacacgggggcugccg

SEQ ID NO: 4046541 - RNA, 19 nt, Molluscum contagiosum virus
cgcagaacugcugcgcgcu

SEQ ID NO: 4046542 - RNA, 19 nt, Molluscum contagiosum virus
cgcagaccacggcgcgccg

SEQ ID NO: 4046543 - RNA, 18 nt, Molluscum contagiosum virus
cgcagacgcagcgcgagc

SEQ ID NO: 4046544 - RNA, 16 nt, Molluscum contagiosum virus
cgcagacgcgcguccg

SEQ ID NO: 4046545 - RNA, 21 nt, Molluscum contagiosum virus
cgcagagccugcugcucuucg

SEQ ID NO: 4046546 - RNA, 22 nt, Molluscum contagiosum virus
cgcagagcuccccgcgcgcagc

SEQ ID NO: 4046547 - RNA, 16 nt, Molluscum contagiosum virus
cgcagcaagcagccgc

SEQ ID NO: 4046548 - RNA, 23 nt, Molluscum contagiosum virus
cgcagcacaaacucgcagaacug

SEQ ID NO: 4046549 - RNA, 20 nt, Molluscum contagiosum virus
cgcagcacaugcaggccgag

SEQ ID NO: 4046550 - RNA, 13 nt, Molluscum contagiosum virus
cgcagccacgacu

SEQ ID NO: 4046551 - RNA, 18 nt, Molluscum contagiosum virus
cgcagcccacgugccagc

SEQ ID NO: 4046552 - RNA, 19 nt, Molluscum contagiosum virus
cgcagccuccgugcgccag

SEQ ID NO: 4046553 - RNA, 20 nt, Molluscum contagiosum virus
cgcagccuccgugcgccagu

SEQ ID NO: 4046554 - RNA, 16 nt, Molluscum contagiosum virus
cgcagcgcggccuggu

SEQ ID NO: 4046555 - RNA, 20 nt, Molluscum contagiosum virus
cgcagcgggcuacucgagca

SEQ ID NO: 4046556 - RNA, 16 nt, Molluscum contagiosum virus
cgcagcuccuagcgcg

SEQ ID NO: 4046557 - RNA, 16 nt, Molluscum contagiosum virus
cgcagcucgccgcgcg

SEQ ID NO: 4046558 - RNA, 19 nt, Molluscum contagiosum virus
cgcagcucgccgcgcgccg

SEQ ID NO: 4046559 - RNA, 19 nt, Molluscum contagiosum virus
cgcagcucuuccacgaagu

SEQ ID NO: 4046560 - RNA, 21 nt, Molluscum contagiosum virus
cgcagcuguggcgccugcgcg

SEQ ID NO: 4046561 - RNA, 13 nt, Molluscum contagiosum virus
cgcaggaaaggca

SEQ ID NO: 4046562 - RNA, 13 nt, Molluscum contagiosum virus
cgcaggaaaggua

SEQ ID NO: 4046563 - RNA, 22 nt, Molluscum contagiosum virus
cgcaggaaagguacccgcagga

SEQ ID NO: 4046564 - RNA, 19 nt, Molluscum contagiosum virus
cgcaggaaccgcgugcgca

SEQ ID NO: 4046565 - RNA, 15 nt, Molluscum contagiosum virus
cgcaggaccgcgacc

SEQ ID NO: 4046566 - RNA, 16 nt, Molluscum contagiosum virus
cgcaggaccuggcugg

SEQ ID NO: 4046567 - RNA, 22 nt, Molluscum contagiosum virus
cgcaggacgcggucgcgcccuu

SEQ ID NO: 4046568 - RNA, 15 nt, Molluscum contagiosum virus
cgcaggaugcugggg

SEQ ID NO: 4046569 - RNA, 19 nt, Molluscum contagiosum virus
cgcaggcccggcggcccgc

SEQ ID NO: 4046570 - RNA, 13 nt, Molluscum contagiosum virus
cgcaggccgcgcc

SEQ ID NO: 4046571 - RNA, 18 nt, Molluscum contagiosum virus
cgcagugcucgcacacgu

SEQ ID NO: 4046572 - RNA, 13 nt, Molluscum contagiosum virus
cgcaucagcacac

SEQ ID NO: 4046573 - RNA, 17 nt, Molluscum contagiosum virus
cgcaugcacagccgcuu

SEQ ID NO: 4046574 - RNA, 15 nt, Molluscum contagiosum virus
cgccaacacgagcgc

SEQ ID NO: 4046575 - RNA, 17 nt, Molluscum contagiosum virus
cgccaagagcuggucgc

SEQ ID NO: 4046576 - RNA, 16 nt, Molluscum contagiosum virus
cgccaccaugcuuguu

SEQ ID NO: 4046577 - RNA, 14 nt, Molluscum contagiosum virus
cgccaccgcgcccu

SEQ ID NO: 4046578 - RNA, 21 nt, Molluscum contagiosum virus
cgccaccucggcguuggccac

SEQ ID NO: 4046579 - RNA, 17 nt, Molluscum contagiosum virus
cgccacugccacggcug

SEQ ID NO: 4046580 - RNA, 13 nt, Molluscum contagiosum virus
cgccagcaguccg

SEQ ID NO: 4046581 - RNA, 14 nt, Molluscum contagiosum virus
cgccagccugcugg

SEQ ID NO: 4046582 - RNA, 15 nt, Molluscum contagiosum virus
cgccagccuggcggc

SEQ ID NO: 4046583 - RNA, 20 nt, Molluscum contagiosum virus
cgccagcgacgagcagcugc

SEQ ID NO: 4046584 - RNA, 19 nt, Molluscum contagiosum virus
cgccagcgcgcccaccagc

SEQ ID NO: 4046585 - RNA, 22 nt, Molluscum contagiosum virus
cgccagcuaagccggagcagcc

SEQ ID NO: 4046586 - RNA, 18 nt, Molluscum contagiosum virus
cgccagcuccgcgcggcg

SEQ ID NO: 4046587 - RNA, 15 nt, Molluscum contagiosum virus
cgccagcucugggcg

SEQ ID NO: 4046588 - RNA, 20 nt, Molluscum contagiosum virus
cgccagugcgugcacugucu

SEQ ID NO: 4046589 - RNA, 17 nt, Molluscum contagiosum virus
cgccauccagcgcauca

SEQ ID NO: 4046590 - RNA, 21 nt, Molluscum contagiosum virus
cgccauuuccgagcgcgcacg

SEQ ID NO: 4046591 - RNA, 23 nt, Molluscum contagiosum virus
cgccauuuccgagcgcgcacgag

SEQ ID NO: 4046592 - RNA, 13 nt, Molluscum contagiosum virus
cgcccaaggccgc

SEQ ID NO: 4046593 - RNA, 17 nt, Molluscum contagiosum virus
cgcccagcaccuggaac

SEQ ID NO: 4046594 - RNA, 16 nt, Molluscum contagiosum virus
cgcccgaggacgagcc

SEQ ID NO: 4046595 - RNA, 14 nt, Molluscum contagiosum virus
cgcccgcagcgcgc

SEQ ID NO: 4046596 - RNA, 14 nt, Molluscum contagiosum virus
cgcccgccagcaug

SEQ ID NO: 4046597 - RNA, 20 nt, Molluscum contagiosum virus
cgcccgccagcauggcgagc

SEQ ID NO: 4046598 - RNA, 22 nt, Molluscum contagiosum virus
cgcccgcgaaagaacacggaca

SEQ ID NO: 4046599 - RNA, 23 nt, Molluscum contagiosum virus
cgcccggcagcgacuacgcgcug

SEQ ID NO: 4046600 - RNA, 15 nt, Molluscum contagiosum virus
cgcccggcgugaucu

SEQ ID NO: 4046601 - RNA, 20 nt, Molluscum contagiosum virus
cgcccggugcggcguguucc

SEQ ID NO: 4046602 - RNA, 13 nt, Molluscum contagiosum virus
cgcccuggagcgc

SEQ ID NO: 4046603 - RNA, 14 nt, Molluscum contagiosum virus
cgccgaagagccgc

SEQ ID NO: 4046604 - RNA, 23 nt, Molluscum contagiosum virus
cgccgagauggagcucacgcuca

SEQ ID NO: 4046605 - RNA, 22 nt, Molluscum contagiosum virus
cgccgagcccgagcccgggccc

SEQ ID NO: 4046606 - RNA, 20 nt, Molluscum contagiosum virus
cgccgaggacuaccuggcgg

SEQ ID NO: 4046607 - RNA, 22 nt, Molluscum contagiosum virus
cgccgagugcgacgcgcgucac

SEQ ID NO: 4046608 - RNA, 12 nt, Molluscum contagiosum virus
cgccgaugcagu

SEQ ID NO: 4046609 - RNA, 20 nt, Molluscum contagiosum virus
cgccgcaaacacugucucug

SEQ ID NO: 4046610 - RNA, 21 nt, Molluscum contagiosum virus
cgccgcagcgcuggagcuggc

SEQ ID NO: 4046611 - RNA, 15 nt, Molluscum contagiosum virus
cgccgccgcaggccc

SEQ ID NO: 4046612 - RNA, 17 nt, Molluscum contagiosum virus
cgccgccgcgccgcugc

SEQ ID NO: 4046613 - RNA, 20 nt, Molluscum contagiosum virus
cgccgcgcaauagcgcccgu

SEQ ID NO: 4046614 - RNA, 21 nt, Molluscum contagiosum virus
cgccgcgcgcgauguacaagc

SEQ ID NO: 4046615 - RNA, 15 nt, Molluscum contagiosum virus
cgccgcgcgcgccgg

SEQ ID NO: 4046616 - RNA, 14 nt, Molluscum contagiosum virus
cgccgcgcgcggcu

SEQ ID NO: 4046617 - RNA, 15 nt, Molluscum contagiosum virus
cgccgcugccgcgcg

SEQ ID NO: 4046618 - RNA, 15 nt, Molluscum contagiosum virus
cgccgcugucacgcg

SEQ ID NO: 4046619 - RNA, 14 nt, Molluscum contagiosum virus
cgccggcucugccu

SEQ ID NO: 4046620 - RNA, 21 nt, Molluscum contagiosum virus
cgccgggaaacgcacagcccc

SEQ ID NO: 4046621 - RNA, 20 nt, Molluscum contagiosum virus
cgccgggaauaccggagaca

SEQ ID NO: 4046622 - RNA, 20 nt, Molluscum contagiosum virus
cgccgggcaccggcgcucac

SEQ ID NO: 4046623 - RNA, 18 nt, Molluscum contagiosum virus
cgccggggcgcgcgcugc

SEQ ID NO: 4046624 - RNA, 13 nt, Molluscum contagiosum virus
cgccguccgcgca

SEQ ID NO: 4046625 - RNA, 15 nt, Molluscum contagiosum virus
cgccgucgcagaaga

SEQ ID NO: 4046626 - RNA, 13 nt, Molluscum contagiosum virus
cgccgugcgcgug

SEQ ID NO: 4046627 - RNA, 21 nt, Molluscum contagiosum virus
cgccguguaccgccgcggccg

SEQ ID NO: 4046628 - RNA, 14 nt, Molluscum contagiosum virus
cgcgcgcgcgcgag

SEQ ID NO: 4046629 - RNA, 16 nt, Molluscum contagiosum virus
cgcgcgcgcgcggcgc

SEQ ID NO: 4046630 - RNA, 16 nt, Molluscum contagiosum virus
cgcgcgcgcucacccu

SEQ ID NO: 4046631 - RNA, 14 nt, Molluscum contagiosum virus
cgcgcgcgcucugc

SEQ ID NO: 4046632 - RNA, 21 nt, Molluscum contagiosum virus
cgcgcgcggucgacgggaacg

SEQ ID NO: 4046633 - RNA, 23 nt, Molluscum contagiosum virus
cgcgcgcguaaagagcguccagc

SEQ ID NO: 4046634 - RNA, 18 nt, Molluscum contagiosum virus
cgcgcgcuagccgccgcu

SEQ ID NO: 4046635 - RNA, 20 nt, Molluscum contagiosum virus
cgcgcgcuagccgccgcugc

SEQ ID NO: 4046636 - RNA, 21 nt, Molluscum contagiosum virus
cgcgcgcuauucaaagcugug

SEQ ID NO: 4046637 - RNA, 12 nt, Molluscum contagiosum virus
cgcgcgcucgcg

SEQ ID NO: 4046638 - RNA, 14 nt, Molluscum contagiosum virus
cgcgcgcucgcgcu

SEQ ID NO: 4046639 - RNA, 13 nt, Molluscum contagiosum virus
cgcgcgcucugcc

SEQ ID NO: 4046640 - RNA, 16 nt, Molluscum contagiosum virus
cgcgcgcucugccgcc

SEQ ID NO: 4046641 - RNA, 22 nt, Molluscum contagiosum virus
cgcgcgcucugccgcccgcgcc

SEQ ID NO: 4046642 - RNA, 19 nt, Molluscum contagiosum virus
cgcgcgcugagcgcggagc

SEQ ID NO: 4046643 - RNA, 15 nt, Molluscum contagiosum virus
cgcgcgcuggcgugc

SEQ ID NO: 4046644 - RNA, 18 nt, Molluscum contagiosum virus
cgcgcgcuuuuugccgcu

SEQ ID NO: 4046645 - RNA, 16 nt, Molluscum contagiosum virus
cgcgcguacgcgugcg

SEQ ID NO: 4046646 - RNA, 19 nt, Molluscum contagiosum virus
cgcgcguacgcgugcgcug

SEQ ID NO: 4046647 - RNA, 17 nt, Molluscum contagiosum virus
cgcgcguacgcugcucg

SEQ ID NO: 4046648 - RNA, 17 nt, Molluscum contagiosum virus
cgcgcgugccgcccgag

SEQ ID NO: 4046649 - RNA, 14 nt, Molluscum contagiosum virus
cgcgcgugcucgac

SEQ ID NO: 4046650 - RNA, 17 nt, Molluscum contagiosum virus
cgcgcuaccugcgcaag

SEQ ID NO: 4046651 - RNA, 16 nt, Molluscum contagiosum virus
cgcgcuagcuccacgu

SEQ ID NO: 4046652 - RNA, 18 nt, Molluscum contagiosum virus
cgcgcuccauguacgucg

SEQ ID NO: 4046653 - RNA, 20 nt, Molluscum contagiosum virus
cgcgcucgaacgcgcgugcg

SEQ ID NO: 4046654 - RNA, 16 nt, Molluscum contagiosum virus
cgcgcucgacgcgugc

SEQ ID NO: 4046655 - RNA, 17 nt, Molluscum contagiosum virus
cgcgcucgacgcgugca

SEQ ID NO: 4046656 - RNA, 20 nt, Molluscum contagiosum virus
cgcgcucgucaaugcgcacg

SEQ ID NO: 4046657 - RNA, 15 nt, Molluscum contagiosum virus
cgcgcucgugccgcc

SEQ ID NO: 4046658 - RNA, 13 nt, Molluscum contagiosum virus
cgcgcucucacgc

SEQ ID NO: 4046659 - RNA, 22 nt, Molluscum contagiosum virus
cgcgcucugccgcccgcgcccg

SEQ ID NO: 4046660 - RNA, 20 nt, Molluscum contagiosum virus
cgcgcugaucaccgaggagc

SEQ ID NO: 4046661 - RNA, 13 nt, Molluscum contagiosum virus
cgcgcugcgcacg

SEQ ID NO: 4046662 - RNA, 24 nt, Molluscum contagiosum virus
auggaaggcgaccagcugguccug

SEQ ID NO: 4046663 - RNA, 17 nt, Molluscum contagiosum virus
auggacacgcacuggcg

SEQ ID NO: 4046664 - RNA, 20 nt, Molluscum contagiosum virus
auggagcaggagaacuacaa

SEQ ID NO: 4046665 - RNA, 20 nt, Molluscum contagiosum virus
auggagcgcccgcugcucua

SEQ ID NO: 4046666 - RNA, 19 nt, Molluscum contagiosum virus
auggcaggugcgcaacugc

SEQ ID NO: 4046667 - RNA, 15 nt, Molluscum contagiosum virus
auggccggcaacugg

SEQ ID NO: 4046668 - RNA, 17 nt, Molluscum contagiosum virus
auggccggcaacuggcu

SEQ ID NO: 4046669 - RNA, 19 nt, Molluscum contagiosum virus
auggcgcgcaaccagcugg

SEQ ID NO: 4046670 - RNA, 14 nt, Molluscum contagiosum virus
auggcgcgcagcuc

SEQ ID NO: 4046671 - RNA, 16 nt, Molluscum contagiosum virus
augggcucgggcaaga

SEQ ID NO: 4046672 - RNA, 14 nt, Molluscum contagiosum virus
auggucucgcugcu

SEQ ID NO: 4046673 - RNA, 19 nt, Molluscum contagiosum virus
auguacaagcccguacgca

SEQ ID NO: 4046674 - RNA, 21 nt, Molluscum contagiosum virus
auguccaugucgcgcaucacc

SEQ ID NO: 4046675 - RNA, 18 nt, Molluscum contagiosum virus
auguccggcgcuggagaa

SEQ ID NO: 4046676 - RNA, 18 nt, Molluscum contagiosum virus
augucgaacaccuccugc

SEQ ID NO: 4046677 - RNA, 23 nt, Molluscum contagiosum virus
auucucguggcguugcugcugcg

SEQ ID NO: 4046678 - RNA, 17 nt, Molluscum contagiosum virus
auucucucgagagacaa

SEQ ID NO: 4046679 - RNA, 19 nt, Molluscum contagiosum virus
auugcgucuuacugcugca

SEQ ID NO: 4046680 - RNA, 16 nt, Molluscum contagiosum virus
auugcguguuggcuuc

SEQ ID NO: 4046681 - RNA, 22 nt, Molluscum contagiosum virus
auugcugggcacaagcuuucuc

SEQ ID NO: 4046682 - RNA, 20 nt, Molluscum contagiosum virus
auuucguucgacuacacgcg

SEQ ID NO: 4046683 - RNA, 21 nt, Molluscum contagiosum virus
caaaagaggccugcugaagaa

SEQ ID NO: 4046684 - RNA, 22 nt, Molluscum contagiosum virus
caaaauggcugcgaccaagaca

SEQ ID NO: 4046685 - RNA, 13 nt, Molluscum contagiosum virus
caaacgccagugc

SEQ ID NO: 4046686 - RNA, 23 nt, Molluscum contagiosum virus
caaagaccacuugugaaauguug

SEQ ID NO: 4046687 - RNA, 15 nt, Molluscum contagiosum virus
caaagacggggccgc

SEQ ID NO: 4046688 - RNA, 23 nt, Molluscum contagiosum virus
caaagaucgcgguggcaggcgcg

SEQ ID NO: 4046689 - RNA, 14 nt, Molluscum contagiosum virus
caaaggcgggcccg

SEQ ID NO: 4046690 - RNA, 15 nt, Molluscum contagiosum virus
caaaggcgggcccgc

SEQ ID NO: 4046691 - RNA, 14 nt, Molluscum contagiosum virus
caaagggcggccgc

SEQ ID NO: 4046692 - RNA, 16 nt, Molluscum contagiosum virus
caaaugcgcugcucgc

SEQ ID NO: 4046693 - RNA, 17 nt, Molluscum contagiosum virus
caaauuccucgagaggg

SEQ ID NO: 4046694 - RNA, 18 nt, Molluscum contagiosum virus
caaauuccucgagaggga

SEQ ID NO: 4046695 - RNA, 21 nt, Molluscum contagiosum virus
caacaagcucgaacagagcgc

SEQ ID NO: 4046696 - RNA, 19 nt, Molluscum contagiosum virus
caacaaggaaaggcacccg

SEQ ID NO: 4046697 - RNA, 14 nt, Molluscum contagiosum virus
caacacgagcacga

SEQ ID NO: 4046698 - RNA, 20 nt, Molluscum contagiosum virus
caacacugacgcucgggccg

SEQ ID NO: 4046699 - RNA, 19 nt, Molluscum contagiosum virus
caacagcacgacggucuuc

SEQ ID NO: 4046700 - RNA, 18 nt, Molluscum contagiosum virus
caacagcagcuggcgcgc

SEQ ID NO: 4046701 - RNA, 15 nt, Molluscum contagiosum virus
caacagcgcgacgcc

SEQ ID NO: 4046702 - RNA, 15 nt, Molluscum contagiosum virus
caacagugcgugcca

SEQ ID NO: 4046703 - RNA, 22 nt, Molluscum contagiosum virus
caacauccugccacaccagcug

SEQ ID NO: 4046704 - RNA, 14 nt, Molluscum contagiosum virus
caaccacagcucuc

SEQ ID NO: 4046705 - RNA, 14 nt, Molluscum contagiosum virus
caaccagacgugcu

SEQ ID NO: 4046706 - RNA, 16 nt, Molluscum contagiosum virus
caaccagcuggcgccc

SEQ ID NO: 4046707 - RNA, 21 nt, Molluscum contagiosum virus
caaccauggcgcgcucuuuug

SEQ ID NO: 4046708 - RNA, 14 nt, Molluscum contagiosum virus
caaccgccugcucu

SEQ ID NO: 4046709 - RNA, 18 nt, Molluscum contagiosum virus
caaccucgagaagaccug

SEQ ID NO: 4046710 - RNA, 14 nt, Molluscum contagiosum virus
caacgacagagccc

SEQ ID NO: 4046711 - RNA, 19 nt, Molluscum contagiosum virus
caacgacuagcgugcgcag

SEQ ID NO: 4046712 - RNA, 16 nt, Molluscum contagiosum virus
caacgagcagcccgug

SEQ ID NO: 4046713 - RNA, 15 nt, Molluscum contagiosum virus
caacgagcgcaucag

SEQ ID NO: 4046714 - RNA, 23 nt, Molluscum contagiosum virus
caacgagcucuccgaagagcaga

SEQ ID NO: 4046715 - RNA, 18 nt, Molluscum contagiosum virus
caacgcgacgauggccac

SEQ ID NO: 4046716 - RNA, 16 nt, Molluscum contagiosum virus
caacgcuuggcaagcu

SEQ ID NO: 4046717 - RNA, 14 nt, Molluscum contagiosum virus
caacgugcugcgcc

SEQ ID NO: 4046718 - RNA, 13 nt, Molluscum contagiosum virus
caacgugcugcuc

SEQ ID NO: 4046719 - RNA, 14 nt, Molluscum contagiosum virus
caacgugcugcuca

SEQ ID NO: 4046720 - RNA, 11 nt, Molluscum contagiosum virus
caacuuccaca

SEQ ID NO: 4046721 - RNA, 13 nt, Molluscum contagiosum virus
caagaacagagaa

SEQ ID NO: 4046722 - RNA, 17 nt, Molluscum contagiosum virus
caagaagcgcuucuuug

SEQ ID NO: 4046723 - RNA, 15 nt, Molluscum contagiosum virus
caagaagcggcccug

SEQ ID NO: 4046724 - RNA, 17 nt, Molluscum contagiosum virus
caagaaggcgcuggugg
